United States Patent 7,888,497 (BIOINFORMATICALLY DETECTABLE GROUP OF NOVEL REGULATORY OLIGONUCLEOTIDES AND USES THEREOF) - sequence listing, part 92

SEQ ID NO: 3887280 - DNA, 12 bp, Homo sapiens
tgcactgaccct

SEQ ID NO: 3887281 - DNA, 23 bp, Homo sapiens
tgcactgacccttccagacatac

SEQ ID NO: 3887282 - DNA, 14 bp, Homo sapiens
tgcactgagggcca

SEQ ID NO: 3887283 - DNA, 16 bp, Homo sapiens
tgcactgagggccaca

SEQ ID NO: 3887284 - DNA, 17 bp, Homo sapiens
tgcactggccccaccct

SEQ ID NO: 3887285 - DNA, 15 bp, Homo sapiens
tgcactgggtgtggc

SEQ ID NO: 3887286 - DNA, 16 bp, Homo sapiens
tgcactgtcaagatga

SEQ ID NO: 3887287 - DNA, 16 bp, Homo sapiens
tgcactgttacttttt

SEQ ID NO: 3887288 - DNA, 15 bp, Homo sapiens
tgcacttcagacacc

SEQ ID NO: 3887289 - DNA, 21 bp, Homo sapiens
tgcagaaaaaaaaaaagaaac

SEQ ID NO: 3887290 - DNA, 23 bp, Homo sapiens
tgcagaaggaagggcatccttct

SEQ ID NO: 3887291 - DNA, 20 bp, Homo sapiens
tgcagactcctcagatctga

SEQ ID NO: 3887292 - DNA, 18 bp, Homo sapiens
tgcagagatttcctccat

SEQ ID NO: 3887293 - DNA, 21 bp, Homo sapiens
tgcagagatttcctccatggt

SEQ ID NO: 3887294 - DNA, 18 bp, Homo sapiens
tgcagagctgacccagag

SEQ ID NO: 3887295 - DNA, 20 bp, Homo sapiens
tgcagaggtgagcagaggag

SEQ ID NO: 3887296 - DNA, 23 bp, Homo sapiens
tgcagatagccagacacatggct

SEQ ID NO: 3887297 - DNA, 14 bp, Homo sapiens
tgcagatgggctgt

SEQ ID NO: 3887298 - DNA, 17 bp, Homo sapiens
tgcagattcctgggcct

SEQ ID NO: 3887299 - DNA, 23 bp, Homo sapiens
tgcagattcctgggcctgtcccc

SEQ ID NO: 3887300 - DNA, 15 bp, Homo sapiens
tgcagattctgattt

SEQ ID NO: 3887301 - DNA, 16 bp, Homo sapiens
tgcagattctgatttt

SEQ ID NO: 3887302 - DNA, 20 bp, Homo sapiens
tgcagcaactcccacgactg

SEQ ID NO: 3887303 - DNA, 11 bp, Homo sapiens
tgcagcacttt

SEQ ID NO: 3887304 - DNA, 19 bp, Homo sapiens
tgcagcactttaaccctct

SEQ ID NO: 3887305 - DNA, 20 bp, Homo sapiens
tgcagcactttaaccctctc

SEQ ID NO: 3887306 - DNA, 11 bp, Homo sapiens
tgcagcagccc

SEQ ID NO: 3887307 - DNA, 13 bp, Homo sapiens
tgcagcagcccag

SEQ ID NO: 3887308 - DNA, 19 bp, Homo sapiens
tgcagccagcccagcccag

SEQ ID NO: 3887309 - DNA, 14 bp, Homo sapiens
tgcagcctccccca

SEQ ID NO: 3887310 - DNA, 15 bp, Homo sapiens
tgcagcctcccccac

SEQ ID NO: 3887311 - DNA, 15 bp, Homo sapiens
tgcagcctcctcctg

SEQ ID NO: 3887312 - DNA, 15 bp, Homo sapiens
tgcagcctggtagaa

SEQ ID NO: 3887313 - DNA, 23 bp, Homo sapiens
tgcagctgcaccatcacacatgc

SEQ ID NO: 3887314 - DNA, 19 bp, Homo sapiens
tgcagctgggccccatgct

SEQ ID NO: 3887315 - DNA, 20 bp, Homo sapiens
tgcagctgggccccatgctc

SEQ ID NO: 3887316 - DNA, 23 bp, Homo sapiens
tgcagctgggccccatgctctgc

SEQ ID NO: 3887317 - DNA, 24 bp, Homo sapiens
tgcagctgggccccatgctctgcc

SEQ ID NO: 3887318 - DNA, 17 bp, Homo sapiens
tgcagcttgtagccagc

SEQ ID NO: 3887319 - DNA, 16 bp, Homo sapiens
tgcagctttacatgca

SEQ ID NO: 3887320 - DNA, 21 bp, Homo sapiens
tgcaggaacgagcactggcca

SEQ ID NO: 3887321 - DNA, 22 bp, Homo sapiens
tgcaggaacgagcactggccag

SEQ ID NO: 3887322 - DNA, 23 bp, Homo sapiens
tgcaggaacgagcactggccaga

SEQ ID NO: 3887323 - DNA, 19 bp, Homo sapiens
tgcaggccccgcttgtcca

SEQ ID NO: 3887324 - DNA, 21 bp, Homo sapiens
tgcaggcctgctcagggactg

SEQ ID NO: 3887325 - DNA, 12 bp, Homo sapiens
tgcaggctctgg

SEQ ID NO: 3887326 - DNA, 16 bp, Homo sapiens
tgcaggctctgggctc

SEQ ID NO: 3887327 - DNA, 18 bp, Homo sapiens
tgcaggctctgggctcag

SEQ ID NO: 3887328 - DNA, 15 bp, Homo sapiens
tgcagggaagagggc

SEQ ID NO: 3887329 - DNA, 20 bp, Homo sapiens
tgcagggaagagggcagtac

SEQ ID NO: 3887330 - DNA, 16 bp, Homo sapiens
tgcagggacaaagagg

SEQ ID NO: 3887331 - DNA, 23 bp, Homo sapiens
tgcagggagcatggctgtgagga

SEQ ID NO: 3887332 - DNA, 19 bp, Homo sapiens
tgcaggtacttcctcctga

SEQ ID NO: 3887333 - DNA, 22 bp, Homo sapiens
tgcaggtacttcctcctgatgg

SEQ ID NO: 3887334 - DNA, 13 bp, Homo sapiens
tgcagtacaggca

SEQ ID NO: 3887335 - DNA, 18 bp, Homo sapiens
tgcagtactttacctcct

SEQ ID NO: 3887336 - DNA, 18 bp, Homo sapiens
tgcagtagtctctgtgct

SEQ ID NO: 3887337 - DNA, 20 bp, Homo sapiens
tgcagtattttattaaagca

SEQ ID NO: 3887338 - DNA, 21 bp, Homo sapiens
tgcagtattttattaaagcaa

SEQ ID NO: 3887339 - DNA, 19 bp, Homo sapiens
tgcagtccagaataagtgc

SEQ ID NO: 3887340 - DNA, 14 bp, Homo sapiens
tgcagtccccagtc

SEQ ID NO: 3887341 - DNA, 16 bp, Homo sapiens
tgcagtgatacatgta

SEQ ID NO: 3887342 - DNA, 18 bp, Homo sapiens
tgcagtgatacatgtact

SEQ ID NO: 3887343 - DNA, 23 bp, Homo sapiens
tgcagtgatggcgcgggaggcac

SEQ ID NO: 3887344 - DNA, 14 bp, Homo sapiens
tgcagttttccagg

SEQ ID NO: 3887345 - DNA, 15 bp, Homo sapiens
tgcataaaccaatga

SEQ ID NO: 3887346 - DNA, 18 bp, Homo sapiens
tgcataagattaaaggaa

SEQ ID NO: 3887347 - DNA, 19 bp, Homo sapiens
tgcatagaggtaccagcaa

SEQ ID NO: 3887348 - DNA, 19 bp, Homo sapiens
tgcatcaagggctttatca

SEQ ID NO: 3887349 - DNA, 21 bp, Homo sapiens
tgcatcagaaagggagggctc

SEQ ID NO: 3887350 - DNA, 22 bp, Homo sapiens
tgcatcagaaagggagggctct

SEQ ID NO: 3887351 - DNA, 13 bp, Homo sapiens
tgcatcagctgct

SEQ ID NO: 3887352 - DNA, 14 bp, Homo sapiens
tgcatcagtattaa

SEQ ID NO: 3887353 - DNA, 17 bp, Homo sapiens
tgcatccaatctgctca

SEQ ID NO: 3887354 - DNA, 16 bp, Homo sapiens
tgcatccggagaattg

SEQ ID NO: 3887355 - DNA, 22 bp, Homo sapiens
tgcatccggagaattgcctcta

SEQ ID NO: 3887356 - DNA, 19 bp, Homo sapiens
tgcatccgtagttccctga

SEQ ID NO: 3887357 - DNA, 13 bp, Homo sapiens
tgcatctcagccc

SEQ ID NO: 3887358 - DNA, 14 bp, Homo sapiens
tgcatctcagccca

SEQ ID NO: 3887359 - DNA, 23 bp, Homo sapiens
tgcatctgggattcccaccaagg

SEQ ID NO: 3887360 - DNA, 17 bp, Homo sapiens
tgcatgattttatacat

SEQ ID NO: 3887361 - DNA, 19 bp, Homo sapiens
tgcatgattttatacatag

SEQ ID NO: 3887362 - DNA, 20 bp, Homo sapiens
tgcatgattttatacatagt

SEQ ID NO: 3887363 - DNA, 22 bp, Homo sapiens
tgcatgcagccactgtgctgaa

SEQ ID NO: 3887364 - DNA, 22 bp, Homo sapiens
tgcatgccaaattgtagttctt

SEQ ID NO: 3887365 - DNA, 17 bp, Homo sapiens
tgcaaacagttcttgga

SEQ ID NO: 3887366 - DNA, 12 bp, Homo sapiens
tgcaaactttat

SEQ ID NO: 3887367 - DNA, 20 bp, Homo sapiens
tgcaaagcactgacttctaa

SEQ ID NO: 3887368 - DNA, 17 bp, Homo sapiens
tgcaaagtgcaaatact

SEQ ID NO: 3887369 - DNA, 16 bp, Homo sapiens
tgcaaagtgccctcat

SEQ ID NO: 3887370 - DNA, 22 bp, Homo sapiens
tgcaaagtgttttctcagaaca

SEQ ID NO: 3887371 - DNA, 21 bp, Homo sapiens
tgcaaatactccaagcttcaa

SEQ ID NO: 3887372 - DNA, 13 bp, Homo sapiens
tgcaaatttcaaa

SEQ ID NO: 3887373 - DNA, 17 bp, Homo sapiens
tgcaaattttgcattta

SEQ ID NO: 3887374 - DNA, 11 bp, Homo sapiens
tgcaaccactg

SEQ ID NO: 3887375 - DNA, 13 bp, Homo sapiens
tgcaaccactgca

SEQ ID NO: 3887376 - DNA, 20 bp, Homo sapiens
tgcaacgctttttgggagaa

SEQ ID NO: 3887377 - DNA, 16 bp, Homo sapiens
tgcaacggcttagact

SEQ ID NO: 3887378 - DNA, 13 bp, Homo sapiens
tgcaactagccaa

SEQ ID NO: 3887379 - DNA, 16 bp, Homo sapiens
tgcaactagccaaggc

SEQ ID NO: 3887380 - DNA, 14 bp, Homo sapiens
tgcaagagacagag

SEQ ID NO: 3887381 - DNA, 20 bp, Homo sapiens
tgcaagagacagagccccca

SEQ ID NO: 3887382 - DNA, 18 bp, Homo sapiens
tgcaagagactctggcct

SEQ ID NO: 3887383 - DNA, 13 bp, Homo sapiens
tgcaagagtggac

SEQ ID NO: 3887384 - DNA, 18 bp, Homo sapiens
tgcaagatttaacactaa

SEQ ID NO: 3887385 - DNA, 20 bp, Homo sapiens
tgcaagcagggctctgcccc

SEQ ID NO: 3887386 - DNA, 14 bp, Homo sapiens
tgcaagccactatg

SEQ ID NO: 3887387 - DNA, 15 bp, Homo sapiens
tgcaagccactatgt

SEQ ID NO: 3887388 - DNA, 15 bp, Homo sapiens
tgcaagccccagggc

SEQ ID NO: 3887389 - DNA, 17 bp, Homo sapiens
tgcaagccccagggcct

SEQ ID NO: 3887390 - DNA, 23 bp, Homo sapiens
tgcaagccccagggcctgggggc

SEQ ID NO: 3887391 - DNA, 15 bp, Homo sapiens
tgcaaggaaaataat

SEQ ID NO: 3887392 - DNA, 24 bp, Homo sapiens
tgcaaggccgctgttcacccacag

SEQ ID NO: 3887393 - DNA, 14 bp, Homo sapiens
tgcaaggggctcag

SEQ ID NO: 3887394 - DNA, 20 bp, Homo sapiens
tgcaagtttcccgccaggag

SEQ ID NO: 3887395 - DNA, 14 bp, Homo sapiens
tgcaatctccaggg

SEQ ID NO: 3887396 - DNA, 16 bp, Homo sapiens
tgcaatctccagggct

SEQ ID NO: 3887397 - DNA, 15 bp, Homo sapiens
tgcaattgcttagga

SEQ ID NO: 3887398 - DNA, 22 bp, Homo sapiens
tgcaatttattaaaatgattgt

SEQ ID NO: 3887399 - DNA, 20 bp, Homo sapiens
tgcaattttaattgattatt

SEQ ID NO: 3887400 - DNA, 14 bp, Homo sapiens
tgcaatttttaaac

SEQ ID NO: 3887401 - DNA, 17 bp, Homo sapiens
tgcaatttttaaactag

SEQ ID NO: 3887402 - DNA, 19 bp, Homo sapiens
tgcaatttttaaactagta

SEQ ID NO: 3887403 - DNA, 15 bp, Homo sapiens
tgcacaaagcccttc

SEQ ID NO: 3887404 - DNA, 17 bp, Homo sapiens
tgcacaaagcccttcca

SEQ ID NO: 3887405 - DNA, 21 bp, Homo sapiens
tgcacaagcttgtatatacat

SEQ ID NO: 3887406 - DNA, 22 bp, Homo sapiens
tgcacaagcttgtatatacata

SEQ ID NO: 3887407 - DNA, 23 bp, Homo sapiens
tgcacaagcttgtatatacatat

SEQ ID NO: 3887408 - DNA, 19 bp, Homo sapiens
tgcacaatttagaaaacat

SEQ ID NO: 3887409 - DNA, 19 bp, Homo sapiens
tgcacaatttgagcaattc

SEQ ID NO: 3887410 - DNA, 21 bp, Homo sapiens
tgcacacaaacacctcctagc

SEQ ID NO: 3887411 - DNA, 13 bp, Homo sapiens
tgcacacacacag

SEQ ID NO: 3887412 - DNA, 12 bp, Homo sapiens
tgcacacacagc

SEQ ID NO: 3887413 - DNA, 16 bp, Homo sapiens
tgcacacagaaatata

SEQ ID NO: 3887414 - DNA, 18 bp, Homo sapiens
tgcacacagaaatatata

SEQ ID NO: 3887415 - DNA, 19 bp, Homo sapiens
tgcacactagcctctccag

SEQ ID NO: 3887416 - DNA, 21 bp, Homo sapiens
tgcacactagcctctccagga

SEQ ID NO: 3887417 - DNA, 18 bp, Homo sapiens
tgcacagcggcccctgca

SEQ ID NO: 3887418 - DNA, 12 bp, Homo sapiens
tgcacagctgct

SEQ ID NO: 3887419 - DNA, 14 bp, Homo sapiens
tgcacagctgcttg

SEQ ID NO: 3887420 - DNA, 12 bp, Homo sapiens
tgcacaggaggg

SEQ ID NO: 3887421 - DNA, 16 bp, Homo sapiens
tgcacagtgcatctca

SEQ ID NO: 3887422 - DNA, 20 bp, Homo sapiens
tgcacagtgcatctcagccc

SEQ ID NO: 3887423 - DNA, 13 bp, Homo sapiens
tgcacatatttga

SEQ ID NO: 3887424 - DNA, 15 bp, Homo sapiens
tgcacatatttgaat

SEQ ID NO: 3887425 - DNA, 16 bp, Homo sapiens
tgcacatctctgcagt

SEQ ID NO: 3887426 - DNA, 15 bp, Homo sapiens
tgcacatgtgtctgt

SEQ ID NO: 3887427 - DNA, 11 bp, Homo sapiens
tgcacattcct

SEQ ID NO: 3887428 - DNA, 16 bp, Homo sapiens
tgcacattcctggccc

SEQ ID NO: 3887429 - DNA, 13 bp, Homo sapiens
tgcacatttatat

SEQ ID NO: 3887430 - DNA, 16 bp, Homo sapiens
tgcacatttatatata

SEQ ID NO: 3887431 - DNA, 22 bp, Homo sapiens
tgcacatttatatatatatgta

SEQ ID NO: 3887432 - DNA, 14 bp, Homo sapiens
tgcaccaccatgcc

SEQ ID NO: 3887433 - DNA, 18 bp, Homo sapiens
tgcaccagcccttccctg

SEQ ID NO: 3887434 - DNA, 19 bp, Homo sapiens
tgcaccagcccttccctgc

SEQ ID NO: 3887435 - DNA, 22 bp, Homo sapiens
tgcaccagcccttccctgcttt

SEQ ID NO: 3887436 - DNA, 15 bp, Homo sapiens
tgcaccatctgcttg

SEQ ID NO: 3887437 - DNA, 18 bp, Homo sapiens
tgcacccactcaccaggg

SEQ ID NO: 3887438 - DNA, 23 bp, Homo sapiens
tgcacccagaaattccttcccac

SEQ ID NO: 3887439 - DNA, 14 bp, Homo sapiens
tgcacctcccccca

SEQ ID NO: 3887440 - DNA, 19 bp, Homo sapiens
  misc_feature (10)..(10): n is a, c, g or t
tgcacctgcnttgtccctg

SEQ ID NO: 3887441 - DNA, 17 bp, Homo sapiens
tgcaccttacattccta

SEQ ID NO: 3887442 - DNA, 13 bp, Homo sapiens
tgcaccttaccaa

SEQ ID NO: 3887443 - DNA, 18 bp, Homo sapiens
tgcaccttaccaactttc

SEQ ID NO: 3887444 - DNA, 19 bp, Homo sapiens
tgcactagcattttcttga

SEQ ID NO: 3887445 - DNA, 13 bp, Homo sapiens
tgcactagcctgt

SEQ ID NO: 3887446 - DNA, 14 bp, Homo sapiens
tgcactagcctgtg

SEQ ID NO: 3887447 - DNA, 16 bp, Homo sapiens
tgcactccatggccac

SEQ ID NO: 3887448 - DNA, 17 bp, Homo sapiens
tgcactccatggccacc

SEQ ID NO: 3887449 - DNA, 19 bp, Homo sapiens
tgcactccatggccacccc

SEQ ID NO: 3887450 - DNA, 10 bp, Homo sapiens
tgcactgaca

SEQ ID NO: 3887451 - DNA, 13 bp, Homo sapiens
tgcactgacaaga

SEQ ID NO: 3887452 - DNA, 16 bp, Homo sapiens
tgagggtcagggcagt

SEQ ID NO: 3887453 - DNA, 12 bp, Homo sapiens
tgagggtgactg

SEQ ID NO: 3887454 - DNA, 21 bp, Homo sapiens
tgagggtttcattgtgtgtta

SEQ ID NO: 3887455 - DNA, 14 bp, Homo sapiens
tgaggtcctgagca

SEQ ID NO: 3887456 - DNA, 16 bp, Homo sapiens
tgaggtcctgagcact

SEQ ID NO: 3887457 - DNA, 20 bp, Homo sapiens
tgaggtcctgagcactgcca

SEQ ID NO: 3887458 - DNA, 15 bp, Homo sapiens
tgaggtgaaacaatt

SEQ ID NO: 3887459 - DNA, 18 bp, Homo sapiens
tgaggtgaaatgggagat

SEQ ID NO: 3887460 - DNA, 12 bp, Homo sapiens
tgaggtgcccag

SEQ ID NO: 3887461 - DNA, 13 bp, Homo sapiens
tgaggtgcccagg

SEQ ID NO: 3887462 - DNA, 14 bp, Homo sapiens
tgaggtgcccagga

SEQ ID NO: 3887463 - DNA, 17 bp, Homo sapiens
tgaggtgcccaggagaa

SEQ ID NO: 3887464 - DNA, 17 bp, Homo sapiens
tgaggtgcttgccccca

SEQ ID NO: 3887465 - DNA, 17 bp, Homo sapiens
tgaggtggaagccctcc

SEQ ID NO: 3887466 - DNA, 21 bp, Homo sapiens
tgaggtgggttttcttcccat

SEQ ID NO: 3887467 - DNA, 21 bp, Homo sapiens
tgaggttaaaatataaattaa

SEQ ID NO: 3887468 - DNA, 18 bp, Homo sapiens
tgagtaaattggaaacat

SEQ ID NO: 3887469 - DNA, 19 bp, Homo sapiens
tgagtactagaatttgtat

SEQ ID NO: 3887470 - DNA, 20 bp, Homo sapiens
tgagtcaccctacctgtgcc

SEQ ID NO: 3887471 - DNA, 22 bp, Homo sapiens
tgagtcaccctacctgtgcctg

SEQ ID NO: 3887472 - DNA, 23 bp, Homo sapiens
tgagtcacctcctccactcactc

SEQ ID NO: 3887473 - DNA, 20 bp, Homo sapiens
tgagtcatgatctccctgcc

SEQ ID NO: 3887474 - DNA, 22 bp, Homo sapiens
tgagtcatgatctccctgccgc

SEQ ID NO: 3887475 - DNA, 15 bp, Homo sapiens
tgagtcctcctcttc

SEQ ID NO: 3887476 - DNA, 14 bp, Homo sapiens
tgagtcctgtctct

SEQ ID NO: 3887477 - DNA, 19 bp, Homo sapiens
tgagtcctgtctctgcctg

SEQ ID NO: 3887478 - DNA, 23 bp, Homo sapiens
tgagtctgggcaatgaaaccaaa

SEQ ID NO: 3887479 - DNA, 21 bp, Homo sapiens
tgagtctttaacatcttgaac

SEQ ID NO: 3887480 - DNA, 16 bp, Homo sapiens
tgagtgactcggtgta

SEQ ID NO: 3887481 - DNA, 13 bp, Homo sapiens
tgagtgcaacaag

SEQ ID NO: 3887482 - DNA, 14 bp, Homo sapiens
tgagtggaatgcag

SEQ ID NO: 3887483 - DNA, 17 bp, Homo sapiens
tgagtggaatgcaggga

SEQ ID NO: 3887484 - DNA, 19 bp, Homo sapiens
tgagtggaatgcagggaag

SEQ ID NO: 3887485 - DNA, 21 bp, Homo sapiens
tgagtggatggaggagaaata

SEQ ID NO: 3887486 - DNA, 13 bp, Homo sapiens
tgagtggcagcca

SEQ ID NO: 3887487 - DNA, 16 bp, Homo sapiens
tgagtggcagccatgc

SEQ ID NO: 3887488 - DNA, 20 bp, Homo sapiens
tgagtggcagccatgcctca

SEQ ID NO: 3887489 - DNA, 14 bp, Homo sapiens
tgagtgttcatttt

SEQ ID NO: 3887490 - DNA, 22 bp, Homo sapiens
tgagtgtttttactacagttgt

SEQ ID NO: 3887491 - DNA, 23 bp, Homo sapiens
tgagttacaccagacctgttctg

SEQ ID NO: 3887492 - DNA, 17 bp, Homo sapiens
tgagttattttaattat

SEQ ID NO: 3887493 - DNA, 16 bp, Homo sapiens
tgagttggacacactg

SEQ ID NO: 3887494 - DNA, 18 bp, Homo sapiens
tgagttttattgagaatt

SEQ ID NO: 3887495 - DNA, 19 bp, Homo sapiens
tgagtttttatggggctga

SEQ ID NO: 3887496 - DNA, 14 bp, Homo sapiens
tgataaaattgtga

SEQ ID NO: 3887497 - DNA, 16 bp, Homo sapiens
tgataaacattaaaca

SEQ ID NO: 3887498 - DNA, 16 bp, Homo sapiens
tgataaactaaaagca

SEQ ID NO: 3887499 - DNA, 13 bp, Homo sapiens
tgataagtggaaa

SEQ ID NO: 3887500 - DNA, 18 bp, Homo sapiens
tgataagtggaaaaaaga

SEQ ID NO: 3887501 - DNA, 22 bp, Homo sapiens
tgataatcaattattacattta

SEQ ID NO: 3887502 - DNA, 24 bp, Homo sapiens
tgataccctgcttggtcaaatccc

SEQ ID NO: 3887503 - DNA, 15 bp, Homo sapiens
tgatacgtacagcca

SEQ ID NO: 3887504 - DNA, 13 bp, Homo sapiens
tgatacttcaggt

SEQ ID NO: 3887505 - DNA, 15 bp, Homo sapiens
tgatacttcaggtgc

SEQ ID NO: 3887506 - DNA, 17 bp, Homo sapiens
tgatacttcaggtgctt

SEQ ID NO: 3887507 - DNA, 20 bp, Homo sapiens
tgatacttcaggtgcttttg

SEQ ID NO: 3887508 - DNA, 13 bp, Homo sapiens
tgataggaaaaga

SEQ ID NO: 3887509 - DNA, 18 bp, Homo sapiens
tgataggaaaagaaggct

SEQ ID NO: 3887510 - DNA, 16 bp, Homo sapiens
tgatatagaaagctgt

SEQ ID NO: 3887511 - DNA, 13 bp, Homo sapiens
tgatatatgtatt

SEQ ID NO: 3887512 - DNA, 13 bp, Homo sapiens
tgatatcacctct

SEQ ID NO: 3887513 - DNA, 16 bp, Homo sapiens
tgatatcacctctctt

SEQ ID NO: 3887514 - DNA, 18 bp, Homo sapiens
tgatatcacctctcttca

SEQ ID NO: 3887515 - DNA, 20 bp, Homo sapiens
tgatatccagtaagcacatg

SEQ ID NO: 3887516 - DNA, 17 bp, Homo sapiens
tgatatctgaacacata

SEQ ID NO: 3887517 - DNA, 16 bp, Homo sapiens
tgatatgagtatacaa

SEQ ID NO: 3887518 - DNA, 21 bp, Homo sapiens
tgatatgcagagtatttctgc

SEQ ID NO: 3887519 - DNA, 14 bp, Homo sapiens
tgatatgggactga

SEQ ID NO: 3887520 - DNA, 15 bp, Homo sapiens
tgatatgtaaacata

SEQ ID NO: 3887521 - DNA, 13 bp, Homo sapiens
tgatattaaagga

SEQ ID NO: 3887522 - DNA, 23 bp, Homo sapiens
tgatattaaaggagttaagagta

SEQ ID NO: 3887523 - DNA, 21 bp, Homo sapiens
tgatattttcaacgcagccct

SEQ ID NO: 3887524 - DNA, 17 bp, Homo sapiens
tgatcaaattcattttt

SEQ ID NO: 3887525 - DNA, 12 bp, Homo sapiens
tgatcaatgaaa

SEQ ID NO: 3887526 - DNA, 12 bp, Homo sapiens
tgatcagaaggc

SEQ ID NO: 3887527 - DNA, 13 bp, Homo sapiens
tgatcagaaggct

SEQ ID NO: 3887528 - DNA, 15 bp, Homo sapiens
tgatcagaaggctgg

SEQ ID NO: 3887529 - DNA, 15 bp, Homo sapiens
tgatcataagtctaa

SEQ ID NO: 3887530 - DNA, 21 bp, Homo sapiens
tgatcataagtctaaataaat

SEQ ID NO: 3887531 - DNA, 15 bp, Homo sapiens
tgatcatggtcagct

SEQ ID NO: 3887532 - DNA, 17 bp, Homo sapiens
tgatcatggtcagctca

SEQ ID NO: 3887533 - DNA, 15 bp, Homo sapiens
tgatcccacttcact

SEQ ID NO: 3887534 - DNA, 18 bp, Homo sapiens
tgatcccacttcactgtg

SEQ ID NO: 3887535 - DNA, 19 bp, Homo sapiens
tgatcccacttcactgtga

SEQ ID NO: 3887536 - DNA, 21 bp, Homo sapiens
tgatccctgttacccagagaa

SEQ ID NO: 3887537 - DNA, 14 bp, Homo sapiens
tgatccctttccca

SEQ ID NO: 3887538 - DNA, 20 bp, Homo sapiens
tgagccaggtaatgagggac

SEQ ID NO: 3887539 - DNA, 21 bp, Homo sapiens
tgagccatgatcgagccactg

SEQ ID NO: 3887540 - DNA, 14 bp, Homo sapiens
tgagcccaggagct

SEQ ID NO: 3887541 - DNA, 13 bp, Homo sapiens
tgagcccaggccg

SEQ ID NO: 3887542 - DNA, 11 bp, Homo sapiens
tgagcccaggg

SEQ ID NO: 3887543 - DNA, 12 bp, Homo sapiens
tgagcccaggga

SEQ ID NO: 3887544 - DNA, 20 bp, Homo sapiens
tgagccgagattgcgccact

SEQ ID NO: 3887545 - DNA, 20 bp, Homo sapiens
tgagccgcatcttctccatc

SEQ ID NO: 3887546 - DNA, 21 bp, Homo sapiens
tgagccgcatcttctccatct

SEQ ID NO: 3887547 - DNA, 21 bp, Homo sapiens
tgagccgctgtgagcccctgg

SEQ ID NO: 3887548 - DNA, 22 bp, Homo sapiens
tgagcctggcccatagaaacat

SEQ ID NO: 3887549 - DNA, 15 bp, Homo sapiens
tgagccttgagagaa

SEQ ID NO: 3887550 - DNA, 13 bp, Homo sapiens
tgagcgaaatcat

SEQ ID NO: 3887551 - DNA, 19 bp, Homo sapiens
tgagctagaagctggagga

SEQ ID NO: 3887552 - DNA, 17 bp, Homo sapiens
tgagctcacaaggcagc

SEQ ID NO: 3887553 - DNA, 20 bp, Homo sapiens
tgagctcacaaggcagcaag

SEQ ID NO: 3887554 - DNA, 23 bp, Homo sapiens
tgagctcacaaggcagcaaggcc

SEQ ID NO: 3887555 - DNA, 22 bp, Homo sapiens
tgagctcagacccccactctca

SEQ ID NO: 3887556 - DNA, 12 bp, Homo sapiens
tgagctcaggca

SEQ ID NO: 3887557 - DNA, 19 bp, Homo sapiens
tgagctctatttccccacc

SEQ ID NO: 3887558 - DNA, 20 bp, Homo sapiens
tgagctctgagaggccctgg

SEQ ID NO: 3887559 - DNA, 22 bp, Homo sapiens
tgagctctgagaggccctggat

SEQ ID NO: 3887560 - DNA, 15 bp, Homo sapiens
tgagctgaagacaaa

SEQ ID NO: 3887561 - DNA, 19 bp, Homo sapiens
tgagctgagatcgtgccgt

SEQ ID NO: 3887562 - DNA, 15 bp, Homo sapiens
tgagctgcagaaacg

SEQ ID NO: 3887563 - DNA, 22 bp, Homo sapiens
tgagctggcattggtctgctga

SEQ ID NO: 3887564 - DNA, 12 bp, Homo sapiens
tgagctggggcc

SEQ ID NO: 3887565 - DNA, 15 bp, Homo sapiens
tgagctggggccaca

SEQ ID NO: 3887566 - DNA, 14 bp, Homo sapiens
tgagctggggcctg

SEQ ID NO: 3887567 - DNA, 14 bp, Homo sapiens
tgagctgtatatat

SEQ ID NO: 3887568 - DNA, 12 bp, Homo sapiens
tgagctgtcact

SEQ ID NO: 3887569 - DNA, 20 bp, Homo sapiens
tgagcttagccttgtgccct

SEQ ID NO: 3887570 - DNA, 21 bp, Homo sapiens
tgagcttagccttgtgccctg

SEQ ID NO: 3887571 - DNA, 22 bp, Homo sapiens
tgagcttagccttgtgccctgc

SEQ ID NO: 3887572 - DNA, 18 bp, Homo sapiens
tgagcttctattaaatgt

SEQ ID NO: 3887573 - DNA, 19 bp, Homo sapiens
tgaggaattatcatgggaa

SEQ ID NO: 3887574 - DNA, 13 bp, Homo sapiens
tgaggaattttct

SEQ ID NO: 3887575 - DNA, 12 bp, Homo sapiens
tgaggacatgga

SEQ ID NO: 3887576 - DNA, 18 bp, Homo sapiens
tgaggacatggagagaga

SEQ ID NO: 3887577 - DNA, 21 bp, Homo sapiens
tgaggacatgtttttgttttc

SEQ ID NO: 3887578 - DNA, 21 bp, Homo sapiens
tgaggaccacactttgagaac

SEQ ID NO: 3887579 - DNA, 14 bp, Homo sapiens
tgaggactgggggc

SEQ ID NO: 3887580 - DNA, 16 bp, Homo sapiens
tgaggagcagcttcag

SEQ ID NO: 3887581 - DNA, 23 bp, Homo sapiens
tgaggaggattgcttcttgtgaa

SEQ ID NO: 3887582 - DNA, 13 bp, Homo sapiens
tgaggagggtgcc

SEQ ID NO: 3887583 - DNA, 23 bp, Homo sapiens
tgaggagtagctgagaggaagat

SEQ ID NO: 3887584 - DNA, 13 bp, Homo sapiens
tgaggagtctgag

SEQ ID NO: 3887585 - DNA, 17 bp, Homo sapiens
tgaggagtctgaggtcc

SEQ ID NO: 3887586 - DNA, 21 bp, Homo sapiens
tgaggagtctgaggtcctgag

SEQ ID NO: 3887587 - DNA, 21 bp, Homo sapiens
tgaggatcctcacaggagcag

SEQ ID NO: 3887588 - DNA, 23 bp, Homo sapiens
tgaggatcctcacaggagcagac

SEQ ID NO: 3887589 - DNA, 17 bp, Homo sapiens
tgaggatgcaacaaata

SEQ ID NO: 3887590 - DNA, 13 bp, Homo sapiens
tgaggattcctga

SEQ ID NO: 3887591 - DNA, 20 bp, Homo sapiens
tgaggcaaaggccagcagca

SEQ ID NO: 3887592 - DNA, 18 bp, Homo sapiens
tgaggcagaagaattgaa

SEQ ID NO: 3887593 - DNA, 15 bp, Homo sapiens
tgaggcaggggcgga

SEQ ID NO: 3887594 - DNA, 14 bp, Homo sapiens
tgaggccagcctgg

SEQ ID NO: 3887595 - DNA, 21 bp, Homo sapiens
tgaggccagcctggcctcctg

SEQ ID NO: 3887596 - DNA, 16 bp, Homo sapiens
tgaggccattatttca

SEQ ID NO: 3887597 - DNA, 12 bp, Homo sapiens
tgaggcccagcc

SEQ ID NO: 3887598 - DNA, 15 bp, Homo sapiens
tgaggcccagcctgt

SEQ ID NO: 3887599 - DNA, 14 bp, Homo sapiens
tgaggcctcatccc

SEQ ID NO: 3887600 - DNA, 15 bp, Homo sapiens
tgaggcctcttggac

SEQ ID NO: 3887601 - DNA, 23 bp, Homo sapiens
tgaggcctcttggacctctgctc

SEQ ID NO: 3887602 - DNA, 14 bp, Homo sapiens
tgaggcctggccag

SEQ ID NO: 3887603 - DNA, 15 bp, Homo sapiens
tgaggcctggccagg

SEQ ID NO: 3887604 - DNA, 16 bp, Homo sapiens
tgaggcctggccaggc

SEQ ID NO: 3887605 - DNA, 23 bp, Homo sapiens
tgaggcgccccaacccgtggagg

SEQ ID NO: 3887606 - DNA, 22 bp, Homo sapiens
tgaggctcaagaggcccaggga

SEQ ID NO: 3887607 - DNA, 23 bp, Homo sapiens
tgaggctcaagaggcccagggag

SEQ ID NO: 3887608 - DNA, 15 bp, Homo sapiens
tgaggctcctgtgct

SEQ ID NO: 3887609 - DNA, 16 bp, Homo sapiens
tgaggctcctgtgcta

SEQ ID NO: 3887610 - DNA, 24 bp, Homo sapiens
tgaggctgggccagcctcagctca

SEQ ID NO: 3887611 - DNA, 22 bp, Homo sapiens
tgaggcttccaggctcttcctg

SEQ ID NO: 3887612 - DNA, 22 bp, Homo sapiens
tgagggaacagacaggagaaat

SEQ ID NO: 3887613 - DNA, 13 bp, Homo sapiens
tgagggagagact

SEQ ID NO: 3887614 - DNA, 22 bp, Homo sapiens
tgagggagggggcgctcaggac

SEQ ID NO: 3887615 - DNA, 12 bp, Homo sapiens
tgagggcagcag

SEQ ID NO: 3887616 - DNA, 16 bp, Homo sapiens
tgagggcagcagccag

SEQ ID NO: 3887617 - DNA, 19 bp, Homo sapiens
tgagggcagttcgcagcca

SEQ ID NO: 3887618 - DNA, 23 bp, Homo sapiens
tgagggcagttcgcagccaccct

SEQ ID NO: 3887619 - DNA, 13 bp, Homo sapiens
tgagggctgggca

SEQ ID NO: 3887620 - DNA, 20 bp, Homo sapiens
tgaggggggccgtgcccagg

SEQ ID NO: 3887621 - DNA, 22 bp, Homo sapiens
tgaggggggccgtgcccagggg

SEQ ID NO: 3887622 - DNA, 14 bp, Homo sapiens
tgaggggtccctga

SEQ ID NO: 3887623 - DNA, 13 bp, Homo sapiens
tgagggtcagggc

SEQ ID NO: 3887624 - DNA, 13 bp, Homo sapiens
tgaaggagaaagg

SEQ ID NO: 3887625 - DNA, 17 bp, Homo sapiens
tgaaggagaaaggagcc

SEQ ID NO: 3887626 - DNA, 18 bp, Homo sapiens
tgaaggaggtgagagaag

SEQ ID NO: 3887627 - DNA, 17 bp, Homo sapiens
tgaaggaggtgagggat

SEQ ID NO: 3887628 - DNA, 16 bp, Homo sapiens
tgaaggataagagaaa

SEQ ID NO: 3887629 - DNA, 14 bp, Homo sapiens
tgaaggcagtctga

SEQ ID NO: 3887630 - DNA, 16 bp, Homo sapiens
tgaaggcagtctgaac

SEQ ID NO: 3887631 - DNA, 19 bp, Homo sapiens
tgaagggtgacatcccagg

SEQ ID NO: 3887632 - DNA, 13 bp, Homo sapiens
tgaagggtggggt

SEQ ID NO: 3887633 - DNA, 20 bp, Homo sapiens
tgaaggttaggatttaacag

SEQ ID NO: 3887634 - DNA, 19 bp, Homo sapiens
tgaagtcaccgggatgaac

SEQ ID NO: 3887635 - DNA, 14 bp, Homo sapiens
tgaagtgaaggaga

SEQ ID NO: 3887636 - DNA, 15 bp, Homo sapiens
tgaagtgaaggagaa

SEQ ID NO: 3887637 - DNA, 18 bp, Homo sapiens
tgaagtgaaggagaaagg

SEQ ID NO: 3887638 - DNA, 22 bp, Homo sapiens
tgaagtgtgtttccttcagtgc

SEQ ID NO: 3887639 - DNA, 20 bp, Homo sapiens
tgaagtgttttgttctttct

SEQ ID NO: 3887640 - DNA, 14 bp, Homo sapiens
tgaagttaacagag

SEQ ID NO: 3887641 - DNA, 18 bp, Homo sapiens
tgaagttcatggtgatca

SEQ ID NO: 3887642 - DNA, 16 bp, Homo sapiens
tgaataaacttcagca

SEQ ID NO: 3887643 - DNA, 15 bp, Homo sapiens
tgaataaagacacct

SEQ ID NO: 3887644 - DNA, 20 bp, Homo sapiens
tgaataaagcctgcttttta

SEQ ID NO: 3887645 - DNA, 15 bp, Homo sapiens
tgaatacccccagag

SEQ ID NO: 3887646 - DNA, 13 bp, Homo sapiens
tgaatagatgtga

SEQ ID NO: 3887647 - DNA, 15 bp, Homo sapiens
tgaatatcattaaat

SEQ ID NO: 3887648 - DNA, 22 bp, Homo sapiens
tgaatcagaccctaccccacca

SEQ ID NO: 3887649 - DNA, 19 bp, Homo sapiens
tgaatcatgttaatagaca

SEQ ID NO: 3887650 - DNA, 20 bp, Homo sapiens
tgaatctgcagggagcaact

SEQ ID NO: 3887651 - DNA, 19 bp, Homo sapiens
tgaatctgttactgaaatg

SEQ ID NO: 3887652 - DNA, 15 bp, Homo sapiens
tgaatcttactcctt

SEQ ID NO: 3887653 - DNA, 13 bp, Homo sapiens
tgaatctttgtgc

SEQ ID NO: 3887654 - DNA, 16 bp, Homo sapiens
tgaatgacatatttta

SEQ ID NO: 3887655 - DNA, 15 bp, Homo sapiens
tgaatgacatcaaca

SEQ ID NO: 3887656 - DNA, 20 bp, Homo sapiens
tgaatgccttccgggccggg

SEQ ID NO: 3887657 - DNA, 14 bp, Homo sapiens
tgaatgctgagacc

SEQ ID NO: 3887658 - DNA, 18 bp, Homo sapiens
tgaatggccctagaactg

SEQ ID NO: 3887659 - DNA, 21 bp, Homo sapiens
tgaatggttccatgcctgagg

SEQ ID NO: 3887660 - DNA, 16 bp, Homo sapiens
tgaatgtattgaactt

SEQ ID NO: 3887661 - DNA, 16 bp, Homo sapiens
tgaatgtcattcacaa

SEQ ID NO: 3887662 - DNA, 15 bp, Homo sapiens
tgaatgttatttgtt

SEQ ID NO: 3887663 - DNA, 21 bp, Homo sapiens
tgaatgtttccaacctggagt

SEQ ID NO: 3887664 - DNA, 11 bp, Homo sapiens
tgaattaaaac

SEQ ID NO: 3887665 - DNA, 14 bp, Homo sapiens
tgaattaagttatt

SEQ ID NO: 3887666 - DNA, 21 bp, Homo sapiens
tgaattattttgttgtgattt

SEQ ID NO: 3887667 - DNA, 22 bp, Homo sapiens
tgaattattttgttgtgatttt

SEQ ID NO: 3887668 - DNA, 17 bp, Homo sapiens
tgaattctgtgaagaat

SEQ ID NO: 3887669 - DNA, 20 bp, Homo sapiens
tgaatttagtgagatttacc

SEQ ID NO: 3887670 - DNA, 15 bp, Homo sapiens
tgaatttattattgt

SEQ ID NO: 3887671 - DNA, 19 bp, Homo sapiens
tgaatttcaggcattttgt

SEQ ID NO: 3887672 - DNA, 16 bp, Homo sapiens
tgaatttcctatctgt

SEQ ID NO: 3887673 - DNA, 14 bp, Homo sapiens
tgaatttgggcctc

SEQ ID NO: 3887674 - DNA, 17 bp, Homo sapiens
tgaatttgggcctcttg

SEQ ID NO: 3887675 - DNA, 17 bp, Homo sapiens
tgaattttaaatgttca

SEQ ID NO: 3887676 - DNA, 16 bp, Homo sapiens
tgaattttatcagcca

SEQ ID NO: 3887677 - DNA, 14 bp, Homo sapiens
tgaattttgttgct

SEQ ID NO: 3887678 - DNA, 19 bp, Homo sapiens
tgacaaagaaacccaagtg

SEQ ID NO: 3887679 - DNA, 22 bp, Homo sapiens
tgacaacagaagcttcagaagt

SEQ ID NO: 3887680 - DNA, 13 bp, Homo sapiens
tgacaacagactg

SEQ ID NO: 3887681 - DNA, 15 bp, Homo sapiens
tgacaacatcccaca

SEQ ID NO: 3887682 - DNA, 18 bp, Homo sapiens
tgacaacatcccacagtg

SEQ ID NO: 3887683 - DNA, 15 bp, Homo sapiens
tgacaagataaagga

SEQ ID NO: 3887684 - DNA, 15 bp, Homo sapiens
tgacaagcactgcta

SEQ ID NO: 3887685 - DNA, 16 bp, Homo sapiens
tgacaagggctgacct

SEQ ID NO: 3887686 - DNA, 17 bp, Homo sapiens
tgacaaggtagacatgg

SEQ ID NO: 3887687 - DNA, 14 bp, Homo sapiens
tgacaatatgattt

SEQ ID NO: 3887688 - DNA, 20 bp, Homo sapiens
tgacaatatgattttaaatt

SEQ ID NO: 3887689 - DNA, 12 bp, Homo sapiens
tgacaatgcaat

SEQ ID NO: 3887690 - DNA, 20 bp, Homo sapiens
tgacacaagaggaataagaa

SEQ ID NO: 3887691 - DNA, 20 bp, Homo sapiens
tgacacacgtatttatattt

SEQ ID NO: 3887692 - DNA, 17 bp, Homo sapiens
tgacaccgtccctcagt

SEQ ID NO: 3887693 - DNA, 21 bp, Homo sapiens
tgacaccgtccctcagtgata

SEQ ID NO: 3887694 - DNA, 19 bp, Homo sapiens
tgacacctaccatgctgct

SEQ ID NO: 3887695 - DNA, 23 bp, Homo sapiens
tgacacggtaggccaagctgaag

SEQ ID NO: 3887696 - DNA, 20 bp, Homo sapiens
tgacacggtgaaatccaggt

SEQ ID NO: 3887697 - DNA, 19 bp, Homo sapiens
tgacactctagtgacttcc

SEQ ID NO: 3887698 - DNA, 18 bp, Homo sapiens
tgacagaatcttgtattt

SEQ ID NO: 3887699 - DNA, 16 bp, Homo sapiens
tgacagaatgctgttt

SEQ ID NO: 3887700 - DNA, 20 bp, Homo sapiens
tgacagacattttcaataat

SEQ ID NO: 3887701 - DNA, 21 bp, Homo sapiens
tgacagatacatagatggacc

SEQ ID NO: 3887702 - DNA, 19 bp, Homo sapiens
tgacagatgtcagccgagc

SEQ ID NO: 3887703 - DNA, 19 bp, Homo sapiens
tgacagatgttgaatgccc

SEQ ID NO: 3887704 - DNA, 18 bp, Homo sapiens
tgacaggaaagccctccc

SEQ ID NO: 3887705 - DNA, 15 bp, Homo sapiens
tgacaggcccagtgg

SEQ ID NO: 3887706 - DNA, 20 bp, Homo sapiens
tgacaggcccagtggaacag

SEQ ID NO: 3887707 - DNA, 15 bp, Homo sapiens
tgacaggtaaactat

SEQ ID NO: 3887708 - DNA, 16 bp, Homo sapiens
tgacaggttcccagca

SEQ ID NO: 3887709 - DNA, 20 bp, Homo sapiens
tgacaggttcccagcagctg

SEQ ID NO: 3887710 - DNA, 20 bp, Homo sapiens
tgactcttgttttcagtttc

SEQ ID NO: 3887711 - DNA, 22 bp, Homo sapiens
tgactctttgacgggaggcctc

SEQ ID NO: 3887712 - DNA, 15 bp, Homo sapiens
tgactgccccaactc

SEQ ID NO: 3887713 - DNA, 19 bp, Homo sapiens
tgactgccccaactcctgg

SEQ ID NO: 3887714 - DNA, 16 bp, Homo sapiens
tgactgcgatcttcag

SEQ ID NO: 3887715 - DNA, 23 bp, Homo sapiens
tgactgctccccagccctggctc

SEQ ID NO: 3887716 - DNA, 16 bp, Homo sapiens
tgactggcaggtgcag

SEQ ID NO: 3887717 - DNA, 23 bp, Homo sapiens
tgactgggtttctctgtatagta

SEQ ID NO: 3887718 - DNA, 16 bp, Homo sapiens
tgactgtactcctccc

SEQ ID NO: 3887719 - DNA, 17 bp, Homo sapiens
tgactgtactcctccca

SEQ ID NO: 3887720 - DNA, 16 bp, Homo sapiens
tgactgtcactgttcc

SEQ ID NO: 3887721 - DNA, 22 bp, Homo sapiens
tgactgtcgtgtttacaaaagg

SEQ ID NO: 3887722 - DNA, 15 bp, Homo sapiens
tgacttctaagtaaa

SEQ ID NO: 3887723 - DNA, 20 bp, Homo sapiens
tgacttctgccccagcttta

SEQ ID NO: 3887724 - DNA, 18 bp, Homo sapiens
tgacttttccatgtatct

SEQ ID NO: 3887725 - DNA, 17 bp, Homo sapiens
tgactttttagccagtg

SEQ ID NO: 3887726 - DNA, 15 bp, Homo sapiens
tgactttttataatg

SEQ ID NO: 3887727 - DNA, 22 bp, Homo sapiens
tgactttttctgagcttttcat

SEQ ID NO: 3887728 - DNA, 21 bp, Homo sapiens
tgagaaaaatttacatggcaa

SEQ ID NO: 3887729 - DNA, 16 bp, Homo sapiens
tgagaaagaatgagca

SEQ ID NO: 3887730 - DNA, 20 bp, Homo sapiens
tgagaaagactattcaaaca

SEQ ID NO: 3887731 - DNA, 21 bp, Homo sapiens
tgagaacaagtcacagctgca

SEQ ID NO: 3887732 - DNA, 17 bp, Homo sapiens
tgagaagaagctgagga

SEQ ID NO: 3887733 - DNA, 16 bp, Homo sapiens
tgagaagagggcctgt

SEQ ID NO: 3887734 - DNA, 21 bp, Homo sapiens
tgagaagagggcctgtgggag

SEQ ID NO: 3887735 - DNA, 17 bp, Homo sapiens
tgagaagttttgtacag

SEQ ID NO: 3887736 - DNA, 24 bp, Homo sapiens
tgagaagttttgtacagagaatta

SEQ ID NO: 3887737 - DNA, 12 bp, Homo sapiens
tgagaatgtgat

SEQ ID NO: 3887738 - DNA, 19 bp, Homo sapiens
tgagaattattcctttcct

SEQ ID NO: 3887739 - DNA, 13 bp, Homo sapiens
tgagaattttaaa

SEQ ID NO: 3887740 - DNA, 16 bp, Homo sapiens
tgagacaagccctggc

SEQ ID NO: 3887741 - DNA, 17 bp, Homo sapiens
tgagacaagccctggca

SEQ ID NO: 3887742 - DNA, 20 bp, Homo sapiens
tgagacaagccctggcaaca

SEQ ID NO: 3887743 - DNA, 18 bp, Homo sapiens
tgagacagccacttggtt

SEQ ID NO: 3887744 - DNA, 17 bp, Homo sapiens
tgagacattacagtttg

SEQ ID NO: 3887745 - DNA, 15 bp, Homo sapiens
tgagaccacctctca

SEQ ID NO: 3887746 - DNA, 21 bp, Homo sapiens
tgagacggtgctcgcttctcc

SEQ ID NO: 3887747 - DNA, 20 bp, Homo sapiens
tgagactataactgtcatct

SEQ ID NO: 3887748 - DNA, 13 bp, Homo sapiens
tgagactccagaa

SEQ ID NO: 3887749 - DNA, 21 bp, Homo sapiens
tgagactccagaatctgctgt

SEQ ID NO: 3887750 - DNA, 19 bp, Homo sapiens
tgagactctcttaggagca

SEQ ID NO: 3887751 - DNA, 13 bp, Homo sapiens
tgagactggcact

SEQ ID NO: 3887752 - DNA, 14 bp, Homo sapiens
tgagacttgctctc

SEQ ID NO: 3887753 - DNA, 19 bp, Homo sapiens
tgagagaaaaagtgcccct

SEQ ID NO: 3887754 - DNA, 16 bp, Homo sapiens
tgagagaagccacgct

SEQ ID NO: 3887755 - DNA, 21 bp, Homo sapiens
tgagagaagccacgctgtcct

SEQ ID NO: 3887756 - DNA, 18 bp, Homo sapiens
tgagagaattgtatcatt

SEQ ID NO: 3887757 - DNA, 17 bp, Homo sapiens
tgagagccctgctgtgg

SEQ ID NO: 3887758 - DNA, 13 bp, Homo sapiens
tgagaggaagatg

SEQ ID NO: 3887759 - DNA, 22 bp, Homo sapiens
tgagaggaagatgaagagaagc

SEQ ID NO: 3887760 - DNA, 14 bp, Homo sapiens
tgagaggcagaagt

SEQ ID NO: 3887761 - DNA, 18 bp, Homo sapiens
tgagaggcagacttccct

SEQ ID NO: 3887762 - DNA, 12 bp, Homo sapiens
tgagaggccctg

SEQ ID NO: 3887763 - DNA, 13 bp, Homo sapiens
tgagaggccctgg

SEQ ID NO: 3887764 - DNA, 22 bp, Homo sapiens
tgagagggcatgcgcacaaggc

SEQ ID NO: 3887765 - DNA, 14 bp, Homo sapiens
tgagagttggctca

SEQ ID NO: 3887766 - DNA, 19 bp, Homo sapiens
tgagagttggctcaggcag

SEQ ID NO: 3887767 - DNA, 18 bp, Homo sapiens
tgagatctccctccaggg

SEQ ID NO: 3887768 - DNA, 19 bp, Homo sapiens
tgagatctccctccaggga

SEQ ID NO: 3887769 - DNA, 14 bp, Homo sapiens
tgagatgatgaaaa

SEQ ID NO: 3887770 - DNA, 19 bp, Homo sapiens
tgagatgtgaacacatcag

SEQ ID NO: 3887771 - DNA, 18 bp, Homo sapiens
tgagattactttgtcccg

SEQ ID NO: 3887772 - DNA, 14 bp, Homo sapiens
tgagatttctttta

SEQ ID NO: 3887773 - DNA, 15 bp, Homo sapiens
tgagatttcttttaa

SEQ ID NO: 3887774 - DNA, 21 bp, Homo sapiens
tgagatttcttttaaagaagt

SEQ ID NO: 3887775 - DNA, 20 bp, Homo sapiens
tgagatttgccagcacaggg

SEQ ID NO: 3887776 - DNA, 16 bp, Homo sapiens
tgagcaaatgtggctc

SEQ ID NO: 3887777 - DNA, 18 bp, Homo sapiens
tgagcaaatgtggctcct

SEQ ID NO: 3887778 - DNA, 19 bp, Homo sapiens
tgagcaaatgtggctcctg

SEQ ID NO: 3887779 - DNA, 23 bp, Homo sapiens
tgagcacatgcgtatatgtgcgt

SEQ ID NO: 3887780 - DNA, 18 bp, Homo sapiens
tgagcactgccaggaggg

SEQ ID NO: 3887781 - DNA, 22 bp, Homo sapiens
tgagcactgccaggagggacaa

SEQ ID NO: 3887782 - DNA, 20 bp, Homo sapiens
tgagcagatctgaaaggcac

SEQ ID NO: 3887783 - DNA, 20 bp, Homo sapiens
tgagcaggattttaatcttt

SEQ ID NO: 3887784 - DNA, 13 bp, Homo sapiens
tgagcaggcccga

SEQ ID NO: 3887785 - DNA, 18 bp, Homo sapiens
tgagcaggcccgacagag

SEQ ID NO: 3887786 - DNA, 21 bp, Homo sapiens
tgagcaggcccgacagagaga

SEQ ID NO: 3887787 - DNA, 12 bp, Homo sapiens
tgagcagggccg

SEQ ID NO: 3887788 - DNA, 14 bp, Homo sapiens
tgagcagggccggg

SEQ ID NO: 3887789 - DNA, 20 bp, Homo sapiens
tgagcagggccggggaactg

SEQ ID NO: 3887790 - DNA, 18 bp, Homo sapiens
tgagcatgcacagctgct

SEQ ID NO: 3887791 - DNA, 20 bp, Homo sapiens
tgagcatgcacagctgcttg

SEQ ID NO: 3887792 - DNA, 18 bp, Homo sapiens
tgagcatgggtgtgccct

SEQ ID NO: 3887793 - DNA, 18 bp, Homo sapiens
tgagccaaacacactgta

SEQ ID NO: 3887794 - DNA, 21 bp, Homo sapiens
tgagccaaacacactgtaaat

SEQ ID NO: 3887795 - DNA, 21 bp, Homo sapiens
tgacataacactataaaggtt

SEQ ID NO: 3887796 - DNA, 18 bp, Homo sapiens
tgacatcacttgtacaaa

SEQ ID NO: 3887797 - DNA, 21 bp, Homo sapiens
tgacatcacttgtacaaaata

SEQ ID NO: 3887798 - DNA, 12 bp, Homo sapiens
tgacatcccagg

SEQ ID NO: 3887799 - DNA, 12 bp, Homo sapiens
tgacatctcctc

SEQ ID NO: 3887800 - DNA, 14 bp, Homo sapiens
tgacatctctttga

SEQ ID NO: 3887801 - DNA, 13 bp, Homo sapiens
tgacatgcactga

SEQ ID NO: 3887802 - DNA, 17 bp, Homo sapiens
tgacatgcactgaccct

SEQ ID NO: 3887803 - DNA, 16 bp, Homo sapiens
tgacatgccaccctct

SEQ ID NO: 3887804 - DNA, 13 bp, Homo sapiens
tgacatggctttg

SEQ ID NO: 3887805 - DNA, 17 bp, Homo sapiens
tgacatgtaatgaatgg

SEQ ID NO: 3887806 - DNA, 20 bp, Homo sapiens
tgacatgtaatgaatggtca

SEQ ID NO: 3887807 - DNA, 14 bp, Homo sapiens
tgacatgtgcctgt

SEQ ID NO: 3887808 - DNA, 10 bp, Homo sapiens
tgacattcct

SEQ ID NO: 3887809 - DNA, 11 bp, Homo sapiens
tgacattcctt

SEQ ID NO: 3887810 - DNA, 17 bp, Homo sapiens
tgacattccttgtcacc

SEQ ID NO: 3887811 - DNA, 15 bp, Homo sapiens
tgacatttctaacat

SEQ ID NO: 3887812 - DNA, 22 bp, Homo sapiens
tgacatttctaacatatgtatt

SEQ ID NO: 3887813 - DNA, 17 bp, Homo sapiens
tgaccaagaaaaagaaa

SEQ ID NO: 3887814 - DNA, 14 bp, Homo sapiens
tgaccacacgctgt

SEQ ID NO: 3887815 - DNA, 21 bp, Homo sapiens
tgaccacacgctgtctcttga

SEQ ID NO: 3887816 - DNA, 17 bp, Homo sapiens
tgaccacatacgtgtta

SEQ ID NO: 3887817 - DNA, 21 bp, Homo sapiens
tgaccacggacgtttccatca

SEQ ID NO: 3887818 - DNA, 16 bp, Homo sapiens
tgaccacgggcctcag

SEQ ID NO: 3887819 - DNA, 21 bp, Homo sapiens
tgaccagacctagacctgggc

SEQ ID NO: 3887820 - DNA, 21 bp, Homo sapiens
tgaccagcctccatgctgcct

SEQ ID NO: 3887821 - DNA, 12 bp, Homo sapiens
tgaccaggacta

SEQ ID NO: 3887822 - DNA, 24 bp, Homo sapiens
tgaccagttctggccaggagctgg

SEQ ID NO: 3887823 - DNA, 16 bp, Homo sapiens
tgacccaaagaccaat

SEQ ID NO: 3887824 - DNA, 17 bp, Homo sapiens
tgacccaatgctcctgg

SEQ ID NO: 3887825 - DNA, 14 bp, Homo sapiens
tgacccacagcctc

SEQ ID NO: 3887826 - DNA, 15 bp, Homo sapiens
tgacccacagcctct

SEQ ID NO: 3887827 - DNA, 22 bp, Homo sapiens
tgacccagagtggagtctgagt

SEQ ID NO: 3887828 - DNA, 12 bp, Homo sapiens
tgacccagtccc

SEQ ID NO: 3887829 - DNA, 13 bp, Homo sapiens
tgaccccagggca

SEQ ID NO: 3887830 - DNA, 17 bp, Homo sapiens
tgaccccagggcacagg

SEQ ID NO: 3887831 - DNA, 18 bp, Homo sapiens
tgaccccagggcacagga

SEQ ID NO: 3887832 - DNA, 19 bp, Homo sapiens
tgaccccagggcacaggag

SEQ ID NO: 3887833 - DNA, 21 bp, Homo sapiens
tgaccccagggcacaggagct

SEQ ID NO: 3887834 - DNA, 19 bp, Homo sapiens
tgacccggcaccccctgca

SEQ ID NO: 3887835 - DNA, 20 bp, Homo sapiens
tgacccggcaccccctgcag

SEQ ID NO: 3887836 - DNA, 22 bp, Homo sapiens
tgacccggcaccccctgcagct

SEQ ID NO: 3887837 - DNA, 22 bp, Homo sapiens
tgaccctctgaatggtccaggg

SEQ ID NO: 3887838 - DNA, 12 bp, Homo sapiens
tgacccttcagg

SEQ ID NO: 3887839 - DNA, 15 bp, Homo sapiens
tgacccttcagggcc

SEQ ID NO: 3887840 - DNA, 17 bp, Homo sapiens
tgacccttcagggccag

SEQ ID NO: 3887841 - DNA, 23 bp, Homo sapiens
tgacccttcccaatcagcactga

SEQ ID NO: 3887842 - DNA, 15 bp, Homo sapiens
tgaccggcacctgcg

SEQ ID NO: 3887843 - DNA, 19 bp, Homo sapiens
tgaccgggacttcaaagcc

SEQ ID NO: 3887844 - DNA, 17 bp, Homo sapiens
tgaccgttttcatcctg

SEQ ID NO: 3887845 - DNA, 22 bp, Homo sapiens
tgaccgttttcatcctggcctc

SEQ ID NO: 3887846 - DNA, 23 bp, Homo sapiens
tgaccgttttcatcctggcctcc

SEQ ID NO: 3887847 - DNA, 14 bp, Homo sapiens
tgacctcagctgca

SEQ ID NO: 3887848 - DNA, 21 bp, Homo sapiens
tgacctcagctgcacattcct

SEQ ID NO: 3887849 - DNA, 22 bp, Homo sapiens
tgacctcagctgcacattcctg

SEQ ID NO: 3887850 - DNA, 12 bp, Homo sapiens
tgacctcccagc

SEQ ID NO: 3887851 - DNA, 14 bp, Homo sapiens
tgacctcccagccc

SEQ ID NO: 3887852 - DNA, 15 bp, Homo sapiens
tgacctcccagccct

SEQ ID NO: 3887853 - DNA, 20 bp, Homo sapiens
tgacctgaggctcctgtgct

SEQ ID NO: 3887854 - DNA, 11 bp, Homo sapiens
tgacctgctga

SEQ ID NO: 3887855 - DNA, 13 bp, Homo sapiens
tgacctgctgagc

SEQ ID NO: 3887856 - DNA, 14 bp, Homo sapiens
tgacctgctgagct

SEQ ID NO: 3887857 - DNA, 16 bp, Homo sapiens
tgacctgctgagctct

SEQ ID NO: 3887858 - DNA, 19 bp, Homo sapiens
tgacctgctgagctctgag

SEQ ID NO: 3887859 - DNA, 20 bp, Homo sapiens
tgacctgctgagctctgaga

SEQ ID NO: 3887860 - DNA, 21 bp, Homo sapiens
tgacctgctgagctctgagag

SEQ ID NO: 3887861 - DNA, 19 bp, Homo sapiens
tgacctgttagatgtgaca

SEQ ID NO: 3887862 - DNA, 15 bp, Homo sapiens
tgacgcatcctgcag

SEQ ID NO: 3887863 - DNA, 19 bp, Homo sapiens
tgacgggagcctcctctgc

SEQ ID NO: 3887864 - DNA, 15 bp, Homo sapiens
tgacgggaggcctca

SEQ ID NO: 3887865 - DNA, 18 bp, Homo sapiens
tgacgggaggcctcagtt

SEQ ID NO: 3887866 - DNA, 19 bp, Homo sapiens
tgacgtcaagtctccttcc

SEQ ID NO: 3887867 - DNA, 16 bp, Homo sapiens
tgacgtgaccatggtg

SEQ ID NO: 3887868 - DNA, 21 bp, Homo sapiens
tgactagaggcagggagggga

SEQ ID NO: 3887869 - DNA, 17 bp, Homo sapiens
tgactaggaagaaaaca

SEQ ID NO: 3887870 - DNA, 16 bp, Homo sapiens
tgactagtcatagaaa

SEQ ID NO: 3887871 - DNA, 20 bp, Homo sapiens
tgactatggctctggcacca

SEQ ID NO: 3887872 - DNA, 11 bp, Homo sapiens
tgactcaccca

SEQ ID NO: 3887873 - DNA, 15 bp, Homo sapiens
tgactcacccaagca

SEQ ID NO: 3887874 - DNA, 14 bp, Homo sapiens
tgactccagcctgc

SEQ ID NO: 3887875 - DNA, 17 bp, Homo sapiens
tgactccagtgagctgg

SEQ ID NO: 3887876 - DNA, 19 bp, Homo sapiens
tgactccatatggaggcct

SEQ ID NO: 3887877 - DNA, 18 bp, Homo sapiens
tgactccatgtgtgctgt

SEQ ID NO: 3887878 - DNA, 22 bp, Homo sapiens
tgactccatgtgtgctgtcctc

SEQ ID NO: 3887879 - DNA, 19 bp, Homo sapiens
tgactcggtgtaaaaccat

SEQ ID NO: 3887880 - DNA, 12 bp, Homo sapiens
tgactctaaatt

SEQ ID NO: 3887881 - DNA, 13 bp, Homo sapiens
tgaaaactgtaaa

SEQ ID NO: 3887882 - DNA, 20 bp, Homo sapiens
tgaaaactgtaaatacaaaa

SEQ ID NO: 3887883 - DNA, 14 bp, Homo sapiens
tgaaaagaggaaca

SEQ ID NO: 3887884 - DNA, 18 bp, Homo sapiens
tgaaaagcaattgccctg

SEQ ID NO: 3887885 - DNA, 21 bp, Homo sapiens
tgaaaatcatgaaaagaggaa

SEQ ID NO: 3887886 - DNA, 14 bp, Homo sapiens
tgaaaatgtcaaag

SEQ ID NO: 3887887 - DNA, 15 bp, Homo sapiens
tgaaaattattttaa

SEQ ID NO: 3887888 - DNA, 21 bp, Homo sapiens
tgaaacaagataactgagaat

SEQ ID NO: 3887889 - DNA, 13 bp, Homo sapiens
tgaaacagaaaca

SEQ ID NO: 3887890 - DNA, 23 bp, Homo sapiens
tgaaacccattaggcatgcctaa

SEQ ID NO: 3887891 - DNA, 16 bp, Homo sapiens
tgaaaccctgtctcta

SEQ ID NO: 3887892 - DNA, 19 bp, Homo sapiens
tgaaactagaagtcaaaaa

SEQ ID NO: 3887893 - DNA, 15 bp, Homo sapiens
tgaaagatgcaagca

SEQ ID NO: 3887894 - DNA, 11 bp, Homo sapiens
tgaaagcacag

SEQ ID NO: 3887895 - DNA, 21 bp, Homo sapiens
tgaaagcacaggagacactgt

SEQ ID NO: 3887896 - DNA, 14 bp, Homo sapiens
tgaaagcagcagct

SEQ ID NO: 3887897 - DNA, 16 bp, Homo sapiens
tgaaagcagcagctag

SEQ ID NO: 3887898 - DNA, 17 bp, Homo sapiens
tgaaagcagcagctagg

SEQ ID NO: 3887899 - DNA, 12 bp, Homo sapiens
tgaaagctgaat

SEQ ID NO: 3887900 - DNA, 15 bp, Homo sapiens
tgaaagggctatggc

SEQ ID NO: 3887901 - DNA, 17 bp, Homo sapiens
tgaaataatgttctgtc

SEQ ID NO: 3887902 - DNA, 18 bp, Homo sapiens
tgaaataattaaaaacca

SEQ ID NO: 3887903 - DNA, 22 bp, Homo sapiens
tgaaataccagtgaaccaaaga

SEQ ID NO: 3887904 - DNA, 23 bp, Homo sapiens
tgaaataccagtgaaccaaagag

SEQ ID NO: 3887905 - DNA, 14 bp, Homo sapiens
tgaaataccagtgt

SEQ ID NO: 3887906 - DNA, 15 bp, Homo sapiens
tgaaatgaaagaact

SEQ ID NO: 3887907 - DNA, 21 bp, Homo sapiens
tgaaatgaggagagaaggaca

SEQ ID NO: 3887908 - DNA, 11 bp, Homo sapiens
tgaaatgtctt

SEQ ID NO: 3887909 - DNA, 16 bp, Homo sapiens
tgaaattcttgaagtt

SEQ ID NO: 3887910 - DNA, 16 bp, Homo sapiens
tgaaattgaacctggt

SEQ ID NO: 3887911 - DNA, 13 bp, Homo sapiens
tgaaattgagaag

SEQ ID NO: 3887912 - DNA, 22 bp, Homo sapiens
tgaaatttcagattcccagagc

SEQ ID NO: 3887913 - DNA, 19 bp, Homo sapiens
tgaaattttctagactttc

SEQ ID NO: 3887914 - DNA, 22 bp, Homo sapiens
tgaacaaacactgaatcatgtt

SEQ ID NO: 3887915 - DNA, 23 bp, Homo sapiens
tgaacaaacactgaatcatgtta

SEQ ID NO: 3887916 - DNA, 18 bp, Homo sapiens
tgaacaagaattggaagc

SEQ ID NO: 3887917 - DNA, 23 bp, Homo sapiens
tgaacacagctgctgaagaggca

SEQ ID NO: 3887918 - DNA, 15 bp, Homo sapiens
tgaacacagtttagt

SEQ ID NO: 3887919 - DNA, 14 bp, Homo sapiens
tgaacatggactct

SEQ ID NO: 3887920 - DNA, 12 bp, Homo sapiens
tgaacccaggac

SEQ ID NO: 3887921 - DNA, 13 bp, Homo sapiens
tgaacccaggaca

SEQ ID NO: 3887922 - DNA, 19 bp, Homo sapiens
tgaacccattttgagtgac

SEQ ID NO: 3887923 - DNA, 13 bp, Homo sapiens
tgaaccccatggg

SEQ ID NO: 3887924 - DNA, 19 bp, Homo sapiens
tgaaccccatgggcttgga

SEQ ID NO: 3887925 - DNA, 16 bp, Homo sapiens
tgaacctcagtttcct

SEQ ID NO: 3887926 - DNA, 18 bp, Homo sapiens
tgaacctcagtttcctca

SEQ ID NO: 3887927 - DNA, 18 bp, Homo sapiens
tgaacctttaaagtaaag

SEQ ID NO: 3887928 - DNA, 15 bp, Homo sapiens
tgaacggggagaaaa

SEQ ID NO: 3887929 - DNA, 16 bp, Homo sapiens
tgaactaataaaagca

SEQ ID NO: 3887930 - DNA, 20 bp, Homo sapiens
tgaactatttctacacagtg

SEQ ID NO: 3887931 - DNA, 19 bp, Homo sapiens
tgaactcagagcccctccc

SEQ ID NO: 3887932 - DNA, 22 bp, Homo sapiens
tgaactcagagcccctccctgc

SEQ ID NO: 3887933 - DNA, 16 bp, Homo sapiens
tgaacttacacttgga

SEQ ID NO: 3887934 - DNA, 16 bp, Homo sapiens
tgaacttgaggacaca

SEQ ID NO: 3887935 - DNA, 17 bp, Homo sapiens
tgaacttgaggacacat

SEQ ID NO: 3887936 - DNA, 20 bp, Homo sapiens
tgaacttgagtaaataacaa

SEQ ID NO: 3887937 - DNA, 17 bp, Homo sapiens
tgaactttccaaaacct

SEQ ID NO: 3887938 - DNA, 22 bp, Homo sapiens
tgaactttctcttcatactttt

SEQ ID NO: 3887939 - DNA, 17 bp, Homo sapiens
tgaagaaaactccttta

SEQ ID NO: 3887940 - DNA, 15 bp, Homo sapiens
tgaagaaaatgaagc

SEQ ID NO: 3887941 - DNA, 18 bp, Homo sapiens
tgaagaaacagataccat

SEQ ID NO: 3887942 - DNA, 14 bp, Homo sapiens
tgaagaaaccacag

SEQ ID NO: 3887943 - DNA, 13 bp, Homo sapiens
tgaagaacagtaa

SEQ ID NO: 3887944 - DNA, 20 bp, Homo sapiens
tgaagaacagtaactgccat

SEQ ID NO: 3887945 - DNA, 16 bp, Homo sapiens
tgaagaatcaagaggg

SEQ ID NO: 3887946 - DNA, 22 bp, Homo sapiens
tgaagacaaaccactgtacata

SEQ ID NO: 3887947 - DNA, 23 bp, Homo sapiens
tgaagacaaaccactgtacatat

SEQ ID NO: 3887948 - DNA, 23 bp, Homo sapiens
tgaagacccagtgtaaagaataa

SEQ ID NO: 3887949 - DNA, 15 bp, Homo sapiens
tgaagagaagctgag

SEQ ID NO: 3887950 - DNA, 20 bp, Homo sapiens
tgaagagaagctgagaagaa

SEQ ID NO: 3887951 - DNA, 23 bp, Homo sapiens
tgaagagaccaagactctgaaat

SEQ ID NO: 3887952 - DNA, 24 bp, Homo sapiens
tgaagagtttaactttgggcccag

SEQ ID NO: 3887953 - DNA, 15 bp, Homo sapiens
tgaagattctcctgt

SEQ ID NO: 3887954 - DNA, 19 bp, Homo sapiens
tgaagattctcctgtgcta

SEQ ID NO: 3887955 - DNA, 17 bp, Homo sapiens
tgaagcaaagcaccagc

SEQ ID NO: 3887956 - DNA, 18 bp, Homo sapiens
tgaagcaaagcaccagct

SEQ ID NO: 3887957 - DNA, 13 bp, Homo sapiens
tgaagcagtgcct

SEQ ID NO: 3887958 - DNA, 23 bp, Homo sapiens
tgaagcagtgcctcgaggcaccg

SEQ ID NO: 3887959 - DNA, 15 bp, Homo sapiens
tgaagcccaataaac

SEQ ID NO: 3887960 - DNA, 22 bp, Homo sapiens
tgaagccccttgtcctctcccg

SEQ ID NO: 3887961 - DNA, 23 bp, Homo sapiens
tgaagccccttgtcctctcccgc

SEQ ID NO: 3887962 - DNA, 16 bp, Homo sapiens
tgaagcctatttattt

SEQ ID NO: 3887963 - DNA, 19 bp, Homo sapiens
tgaagcctctgccctgcct

SEQ ID NO: 3887964 - DNA, 15 bp, Homo sapiens
tgaagctattgatgt

SEQ ID NO: 3887965 - DNA, 23 bp, Homo sapiens
tgaagctattgatgtttccagaa

SEQ ID NO: 3887966 - DNA, 21 bp, Homo sapiens
tgaaggaatagccagagagga

SEQ ID NO: 3887967 - DNA, 12 bp, Homo sapiens
tctgtccaggcc

SEQ ID NO: 3887968 - DNA, 14 bp, Homo sapiens
tctgtccaggccac

SEQ ID NO: 3887969 - DNA, 18 bp, Homo sapiens
tctgtccaggccactgtg

SEQ ID NO: 3887970 - DNA, 13 bp, Homo sapiens
tctgtctctcttg

SEQ ID NO: 3887971 - DNA, 15 bp, Homo sapiens
tctgtctttgtggga

SEQ ID NO: 3887972 - DNA, 14 bp, Homo sapiens
tctgtgaagaatga

SEQ ID NO: 3887973 - DNA, 20 bp, Homo sapiens
tctgtgaagaatgaagtgga

SEQ ID NO: 3887974 - DNA, 18 bp, Homo sapiens
tctgtgaattgagctgca

SEQ ID NO: 3887975 - DNA, 13 bp, Homo sapiens
tctgtgccagagc

SEQ ID NO: 3887976 - DNA, 15 bp, Homo sapiens
tctgtgccagagcct

SEQ ID NO: 3887977 - DNA, 17 bp, Homo sapiens
tctgtgccagagcctgg

SEQ ID NO: 3887978 - DNA, 22 bp, Homo sapiens
tctgtgccagagcctggggctc

SEQ ID NO: 3887979 - DNA, 23 bp, Homo sapiens
tctgtgctgccctgctctgggga

SEQ ID NO: 3887980 - DNA, 15 bp, Homo sapiens
tctgtgctgtgcctg

SEQ ID NO: 3887981 - DNA, 14 bp, Homo sapiens
tctgtggcctgtgt

SEQ ID NO: 3887982 - DNA, 19 bp, Homo sapiens
tctgtgggcttggccttgt

SEQ ID NO: 3887983 - DNA, 11 bp, Homo sapiens
tctgtggtggg

SEQ ID NO: 3887984 - DNA, 18 bp, Homo sapiens
tctgtgtgatgaactttc

SEQ ID NO: 3887985 - DNA, 16 bp, Homo sapiens
tctgtgtgtctgatgt

SEQ ID NO: 3887986 - DNA, 19 bp, Homo sapiens
tctgtgtgtctgatgtttg

SEQ ID NO: 3887987 - DNA, 13 bp, Homo sapiens
tctgtgttgaaca

SEQ ID NO: 3887988 - DNA, 20 bp, Homo sapiens
tctgtgtttgaccttcacat

SEQ ID NO: 3887989 - DNA, 14 bp, Homo sapiens
tctgttactgaaat

SEQ ID NO: 3887990 - DNA, 21 bp, Homo sapiens
tctgttctcaaatgctaaatg

SEQ ID NO: 3887991 - DNA, 13 bp, Homo sapiens
tctgttctgttga

SEQ ID NO: 3887992 - DNA, 14 bp, Homo sapiens
tctgttgagtgcaa

SEQ ID NO: 3887993 - DNA, 23 bp, Homo sapiens
tctgttgagtgcaacaagagcaa

SEQ ID NO: 3887994 - DNA, 12 bp, Homo sapiens
tctgttgtaaat

SEQ ID NO: 3887995 - DNA, 11 bp, Homo sapiens
tctgttttctt

SEQ ID NO: 3887996 - DNA, 21 bp, Homo sapiens
tcttaaaataacttatatcat

SEQ ID NO: 3887997 - DNA, 21 bp, Homo sapiens
tcttaaagctgcctgtagtta

SEQ ID NO: 3887998 - DNA, 21 bp, Homo sapiens
tcttaattaaaagaatatttt

SEQ ID NO: 3887999 - DNA, 12 bp, Homo sapiens
tcttacatctgc

SEQ ID NO: 3888000 - DNA, 18 bp, Homo sapiens
tcttacccatatatctta

SEQ ID NO: 3888001 - DNA, 23 bp, Homo sapiens
tcttaccgagaaaaggagaaagg

SEQ ID NO: 3888002 - DNA, 21 bp, Homo sapiens
tcttacctgtatgtctccagt

SEQ ID NO: 3888003 - DNA, 13 bp, Homo sapiens
tcttacttaaaaa

SEQ ID NO: 3888004 - DNA, 20 bp, Homo sapiens
tcttacttatcaaaagacag

SEQ ID NO: 3888005 - DNA, 21 bp, Homo sapiens
tcttagaagtggaccaggaca

SEQ ID NO: 3888006 - DNA, 15 bp, Homo sapiens
tcttagtgcccgcct

SEQ ID NO: 3888007 - DNA, 12 bp, Homo sapiens
tcttatatagca

SEQ ID NO: 3888008 - DNA, 22 bp, Homo sapiens
tcttatatagcagcaaaaatat

SEQ ID NO: 3888009 - DNA, 13 bp, Homo sapiens
tcttatgaaatgg

SEQ ID NO: 3888010 - DNA, 22 bp, Homo sapiens
tcttattagaacaggcaagtga

SEQ ID NO: 3888011 - DNA, 23 bp, Homo sapiens
tcttattcatgctttctcctttt

SEQ ID NO: 3888012 - DNA, 15 bp, Homo sapiens
tcttattctcactcc

SEQ ID NO: 3888013 - DNA, 16 bp, Homo sapiens
tcttatttcatttctt

SEQ ID NO: 3888014 - DNA, 17 bp, Homo sapiens
tcttattttttaaaaag

SEQ ID NO: 3888015 - DNA, 16 bp, Homo sapiens
tcttcaactgaccagc

SEQ ID NO: 3888016 - DNA, 17 bp, Homo sapiens
tcttcaagcacctgcag

SEQ ID NO: 3888017 - DNA, 19 bp, Homo sapiens
tcttcaagggaagaaacac

SEQ ID NO: 3888018 - DNA, 12 bp, Homo sapiens
tcttcacaacct

SEQ ID NO: 3888019 - DNA, 14 bp, Homo sapiens
tcttcacaacctcc

SEQ ID NO: 3888020 - DNA, 16 bp, Homo sapiens
tcttcactcagccaca

SEQ ID NO: 3888021 - DNA, 17 bp, Homo sapiens
tcttcactcagccacac

SEQ ID NO: 3888022 - DNA, 16 bp, Homo sapiens
tcttcagagcaggggt

SEQ ID NO: 3888023 - DNA, 19 bp, Homo sapiens
tcttcagccacctctcttt

SEQ ID NO: 3888024 - DNA, 16 bp, Homo sapiens
tcttcagccatcaaca

SEQ ID NO: 3888025 - DNA, 12 bp, Homo sapiens
tcttcagctccc

SEQ ID NO: 3888026 - DNA, 16 bp, Homo sapiens
tcttcagctcccatag

SEQ ID NO: 3888027 - DNA, 16 bp, Homo sapiens
tcttcaggaggccctg

SEQ ID NO: 3888028 - DNA, 16 bp, Homo sapiens
tcttcaggtggaaaaa

SEQ ID NO: 3888029 - DNA, 19 bp, Homo sapiens
tcttcagtgggagaaaaca

SEQ ID NO: 3888030 - DNA, 19 bp, Homo sapiens
tcttcattttgagtctcag

SEQ ID NO: 3888031 - DNA, 16 bp, Homo sapiens
tcttccaaccccagct

SEQ ID NO: 3888032 - DNA, 17 bp, Homo sapiens
tcttccaaccccagctg

SEQ ID NO: 3888033 - DNA, 18 bp, Homo sapiens
tcttccaaccccagctgg

SEQ ID NO: 3888034 - DNA, 22 bp, Homo sapiens
tcttccaaccccagctggcctc

SEQ ID NO: 3888035 - DNA, 20 bp, Homo sapiens
tcttccagagcctaagaaaa

SEQ ID NO: 3888036 - DNA, 13 bp, Homo sapiens
tcttccccttgcc

SEQ ID NO: 3888037 - DNA, 15 bp, Homo sapiens
tcttccccttgccct

SEQ ID NO: 3888038 - DNA, 16 bp, Homo sapiens
tcttccccttgccctt

SEQ ID NO: 3888039 - DNA, 14 bp, Homo sapiens
tcttccctccttcc

SEQ ID NO: 3888040 - DNA, 15 bp, Homo sapiens
tcttccctccttccc

SEQ ID NO: 3888041 - DNA, 18 bp, Homo sapiens
tcttcctaccaaatataa

SEQ ID NO: 3888042 - DNA, 12 bp, Homo sapiens
tcttcctgctgc

SEQ ID NO: 3888043 - DNA, 18 bp, Homo sapiens
tcttcctggacctgagtc

SEQ ID NO: 3888044 - DNA, 11 bp, Homo sapiens
tcttccttccc

SEQ ID NO: 3888045 - DNA, 12 bp, Homo sapiens
tcttccttcccc

SEQ ID NO: 3888046 - DNA, 19 bp, Homo sapiens
tcttcggggaactcctgga

SEQ ID NO: 3888047 - DNA, 17 bp, Homo sapiens
tcttctacaaccagagc

SEQ ID NO: 3888048 - DNA, 19 bp, Homo sapiens
tcttctacaaccagagccc

SEQ ID NO: 3888049 - DNA, 20 bp, Homo sapiens
tcttctacaaccagagcccc

SEQ ID NO: 3888050 - DNA, 18 bp, Homo sapiens
tcttctatttaaaaaata

SEQ ID NO: 3888051 - DNA, 22 bp, Homo sapiens
tcttctatttaaaaaataaaaa

SEQ ID NO: 3888052 - DNA, 14 bp, Homo sapiens
tcttctccatctgg

SEQ ID NO: 3888053 - DNA, 20 bp, Homo sapiens
tcttctctattcctgaccct

SEQ ID NO: 3888054 - DNA, 11 bp, Homo sapiens
tcttctctcaa

SEQ ID NO: 3888055 - DNA, 13 bp, Homo sapiens
tcttctcttcctg

SEQ ID NO: 3888056 - DNA, 19 bp, Homo sapiens
tcttctgtatactgtggag

SEQ ID NO: 3888057 - DNA, 18 bp, Homo sapiens
tcttcttaagacttttgg

SEQ ID NO: 3888058 - DNA, 16 bp, Homo sapiens
tcttcttcagaagaca

SEQ ID NO: 3888059 - DNA, 22 bp, Homo sapiens
tcttgaatctagggagggggaa

SEQ ID NO: 3888060 - DNA, 16 bp, Homo sapiens
tcttgacacggtgaaa

SEQ ID NO: 3888061 - DNA, 19 bp, Homo sapiens
tcttgacagtatatttgaa

SEQ ID NO: 3888062 - DNA, 20 bp, Homo sapiens
tcttgacagtatatttgaaa

SEQ ID NO: 3888063 - DNA, 18 bp, Homo sapiens
tcttgagtactagaattt

SEQ ID NO: 3888064 - DNA, 23 bp, Homo sapiens
tcttgagtactagaatttgtatt

SEQ ID NO: 3888065 - DNA, 23 bp, Homo sapiens
tcttgcatggcaaggactgcagg

SEQ ID NO: 3888066 - DNA, 23 bp, Homo sapiens
tcttgccccctcatctcactgcc

SEQ ID NO: 3888067 - DNA, 14 bp, Homo sapiens
tcttgcctgaggct

SEQ ID NO: 3888068 - DNA, 22 bp, Homo sapiens
tcttgcctgaggctcaagaggc

SEQ ID NO: 3888069 - DNA, 23 bp, Homo sapiens
tcttgcctgaggctcaagaggcc

SEQ ID NO: 3888070 - DNA, 16 bp, Homo sapiens
tcttgctatttgagca

SEQ ID NO: 3888071 - DNA, 14 bp, Homo sapiens
tcttgctttgctgt

SEQ ID NO: 3888072 - DNA, 13 bp, Homo sapiens
tcttggaaaaaaa

SEQ ID NO: 3888073 - DNA, 15 bp, Homo sapiens
tcttggaaaaaaatt

SEQ ID NO: 3888074 - DNA, 16 bp, Homo sapiens
tcttggaagtgtgtgg

SEQ ID NO: 3888075 - DNA, 23 bp, Homo sapiens
tcttggacctctgctctgaggct

SEQ ID NO: 3888076 - DNA, 21 bp, Homo sapiens
tcttggcagcttaacattgac

SEQ ID NO: 3888077 - DNA, 13 bp, Homo sapiens
tcttggcctgcct

SEQ ID NO: 3888078 - DNA, 16 bp, Homo sapiens
tcttgggaactccact

SEQ ID NO: 3888079 - DNA, 21 bp, Homo sapiens
tcttgggaactccactctcct

SEQ ID NO: 3888080 - DNA, 15 bp, Homo sapiens
tcttgggctactggc

SEQ ID NO: 3888081 - DNA, 14 bp, Homo sapiens
tcttggtattctta

SEQ ID NO: 3888082 - DNA, 21 bp, Homo sapiens
tcttgtagaagatggactctg

SEQ ID NO: 3888083 - DNA, 11 bp, Homo sapiens
tcttgtatttg

SEQ ID NO: 3888084 - DNA, 14 bp, Homo sapiens
tcttgtccacagtc

SEQ ID NO: 3888085 - DNA, 15 bp, Homo sapiens
tcttgtccacagtct

SEQ ID NO: 3888086 - DNA, 11 bp, Homo sapiens
tcttgtgcatg

SEQ ID NO: 3888087 - DNA, 17 bp, Homo sapiens
tcttgtgcatgtttact

SEQ ID NO: 3888088 - DNA, 14 bp, Homo sapiens
tcttgtgcctcagc

SEQ ID NO: 3888089 - DNA, 18 bp, Homo sapiens
tcttgtgctcacgctccc

SEQ ID NO: 3888090 - DNA, 18 bp, Homo sapiens
tcttgtggaggatgaata

SEQ ID NO: 3888091 - DNA, 17 bp, Homo sapiens
tctttaaaatacacact

SEQ ID NO: 3888092 - DNA, 14 bp, Homo sapiens
tctttaatcccagt

SEQ ID NO: 3888093 - DNA, 17 bp, Homo sapiens
tctttaatgttgtccag

SEQ ID NO: 3888094 - DNA, 20 bp, Homo sapiens
tctttaatgttgtccaggaa

SEQ ID NO: 3888095 - DNA, 14 bp, Homo sapiens
tctttacaataaac

SEQ ID NO: 3888096 - DNA, 16 bp, Homo sapiens
tctttacctgagacca

SEQ ID NO: 3888097 - DNA, 22 bp, Homo sapiens
tctttactcccttcctggcctc

SEQ ID NO: 3888098 - DNA, 15 bp, Homo sapiens
tctttcacaaaaaag

SEQ ID NO: 3888099 - DNA, 13 bp, Homo sapiens
tctttccccacct

SEQ ID NO: 3888100 - DNA, 15 bp, Homo sapiens
tctttccccacctct

SEQ ID NO: 3888101 - DNA, 19 bp, Homo sapiens
tctttccccacctcttcct

SEQ ID NO: 3888102 - DNA, 22 bp, Homo sapiens
tctttccccacctcttccttcc

SEQ ID NO: 3888103 - DNA, 16 bp, Homo sapiens
tctttcccctcagagc

SEQ ID NO: 3888104 - DNA, 16 bp, Homo sapiens
tctttcctccaaactc

SEQ ID NO: 3888105 - DNA, 22 bp, Homo sapiens
tctttcctcttccccttgccct

SEQ ID NO: 3888106 - DNA, 21 bp, Homo sapiens
tctttctaactccagtgaagt

SEQ ID NO: 3888107 - DNA, 15 bp, Homo sapiens
tctttctattccaaa

SEQ ID NO: 3888108 - DNA, 21 bp, Homo sapiens
tctttctctccttcttccctg

SEQ ID NO: 3888109 - DNA, 17 bp, Homo sapiens
tctttctcttccctcct

SEQ ID NO: 3888110 - DNA, 15 bp, Homo sapiens
tctttcttcctctgc

SEQ ID NO: 3888111 - DNA, 17 bp, Homo sapiens
tctttctttacctgaga

SEQ ID NO: 3888112 - DNA, 12 bp, Homo sapiens
tctttctttgga

SEQ ID NO: 3888113 - DNA, 20 bp, Homo sapiens
tctttctttttctggaaatt

SEQ ID NO: 3888114 - DNA, 19 bp, Homo sapiens
tctttctttttctgtctct

SEQ ID NO: 3888115 - DNA, 22 bp, Homo sapiens
tctttctttttctgtctctctt

SEQ ID NO: 3888116 - DNA, 14 bp, Homo sapiens
tctttgaaaagaaa

SEQ ID NO: 3888117 - DNA, 22 bp, Homo sapiens
tctttgacgggaggcctcagtt

SEQ ID NO: 3888118 - DNA, 21 bp, Homo sapiens
tctttgagaaaggattaagat

SEQ ID NO: 3888119 - DNA, 13 bp, Homo sapiens
tctttgcacatgt

SEQ ID NO: 3888120 - DNA, 17 bp, Homo sapiens
tctttgcacatgtgacc

SEQ ID NO: 3888121 - DNA, 16 bp, Homo sapiens
tctttgctacaataaa

SEQ ID NO: 3888122 - DNA, 20 bp, Homo sapiens
tctttgctacaataaatgct

SEQ ID NO: 3888123 - DNA, 21 bp, Homo sapiens
tctttgctacaataaatgctg

SEQ ID NO: 3888124 - DNA, 22 bp, Homo sapiens
tctttgctacaataaatgctga

SEQ ID NO: 3888125 - DNA, 24 bp, Homo sapiens
tctttggaaggagtgagatcattt

SEQ ID NO: 3888126 - DNA, 19 bp, Homo sapiens
tcttttaaagaagtaaatt

SEQ ID NO: 3888127 - DNA, 16 bp, Homo sapiens
tcttttcccacattca

SEQ ID NO: 3888128 - DNA, 12 bp, Homo sapiens
tctttttcagtt

SEQ ID NO: 3888129 - DNA, 15 bp, Homo sapiens
tctttttctggaaat

SEQ ID NO: 3888130 - DNA, 21 bp, Homo sapiens
tcttttttcaactggctggga

SEQ ID NO: 3888131 - DNA, 14 bp, Homo sapiens
tgaaaaaaaagttt

SEQ ID NO: 3888132 - DNA, 18 bp, Homo sapiens
tgaaaaacattccaggaa

SEQ ID NO: 3888133 - DNA, 12 bp, Homo sapiens
tgaaaaactgat

SEQ ID NO: 3888134 - DNA, 21 bp, Homo sapiens
tgaaaaactgatcaaaaataa

SEQ ID NO: 3888135 - DNA, 23 bp, Homo sapiens
tgaaaaactgatcaaaaataaac

SEQ ID NO: 3888136 - DNA, 20 bp, Homo sapiens
tgaaaaatatgtgcttgaaa

SEQ ID NO: 3888137 - DNA, 12 bp, Homo sapiens
tgaaaaatgtca

SEQ ID NO: 3888138 - DNA, 16 bp, Homo sapiens
tgaaaacccagagagg

SEQ ID NO: 3888139 - DNA, 19 bp, Homo sapiens
tgaaaactcattacttttc

SEQ ID NO: 3888140 - DNA, 14 bp, Homo sapiens
tctgcctgtggcct

SEQ ID NO: 3888141 - DNA, 13 bp, Homo sapiens
tctgcctttttta

SEQ ID NO: 3888142 - DNA, 17 bp, Homo sapiens
tctgcggtggtgccaga

SEQ ID NO: 3888143 - DNA, 20 bp, Homo sapiens
tctgcggtggtgccagaggt

SEQ ID NO: 3888144 - DNA, 15 bp, Homo sapiens
tctgcgttacaacag

SEQ ID NO: 3888145 - DNA, 22 bp, Homo sapiens
tctgctcagacagaacccctac

SEQ ID NO: 3888146 - DNA, 22 bp, Homo sapiens
tctgctcagtaatttgaggaca

SEQ ID NO: 3888147 - DNA, 12 bp, Homo sapiens
tctgctccagag

SEQ ID NO: 3888148 - DNA, 12 bp, Homo sapiens
tctgctcctctc

SEQ ID NO: 3888149 - DNA, 16 bp, Homo sapiens
tctgctcctctccagg

SEQ ID NO: 3888150 - DNA, 18 bp, Homo sapiens
tctgctcctctccaggca

SEQ ID NO: 3888151 - DNA, 20 bp, Homo sapiens
tctgctcctctccaggcacc

SEQ ID NO: 3888152 - DNA, 13 bp, Homo sapiens
tctgctctagcca

SEQ ID NO: 3888153 - DNA, 11 bp, Homo sapiens
tctgctctgat

SEQ ID NO: 3888154 - DNA, 19 bp, Homo sapiens
tctgctgcctccctctgct

SEQ ID NO: 3888155 - DNA, 14 bp, Homo sapiens
tctgctggcctgga

SEQ ID NO: 3888156 - DNA, 17 bp, Homo sapiens
tctgctggcctggatct

SEQ ID NO: 3888157 - DNA, 17 bp, Homo sapiens
tctgctggttttaacaa

SEQ ID NO: 3888158 - DNA, 12 bp, Homo sapiens
tctgctgttgcc

SEQ ID NO: 3888159 - DNA, 13 bp, Homo sapiens
tctgctgttgcca

SEQ ID NO: 3888160 - DNA, 17 bp, Homo sapiens
tctgctgttgccatagc

SEQ ID NO: 3888161 - DNA, 19 bp, Homo sapiens
tctgctgttgccatagccc

SEQ ID NO: 3888162 - DNA, 21 bp, Homo sapiens
tctgctgttgccatagcccca

SEQ ID NO: 3888163 - DNA, 19 bp, Homo sapiens
tctgcttctgtccaggaca

SEQ ID NO: 3888164 - DNA, 11 bp, Homo sapiens
tctgcttgcat

SEQ ID NO: 3888165 - DNA, 20 bp, Homo sapiens
tctgcttgcatcacttgggg

SEQ ID NO: 3888166 - DNA, 15 bp, Homo sapiens
tctggaaaaaaaata

SEQ ID NO: 3888167 - DNA, 14 bp, Homo sapiens
tctggaaagcaaag

SEQ ID NO: 3888168 - DNA, 13 bp, Homo sapiens
tctggaaagggca

SEQ ID NO: 3888169 - DNA, 21 bp, Homo sapiens
tctggaagctgagcaggcccg

SEQ ID NO: 3888170 - DNA, 14 bp, Homo sapiens
tctggaaggctggc

SEQ ID NO: 3888171 - DNA, 14 bp, Homo sapiens
tctggaatacatga

SEQ ID NO: 3888172 - DNA, 21 bp, Homo sapiens
tctggacaagccaacttgtaa

SEQ ID NO: 3888173 - DNA, 20 bp, Homo sapiens
tctggacctccccctcttgg

SEQ ID NO: 3888174 - DNA, 18 bp, Homo sapiens
tctggactcctctgtcca

SEQ ID NO: 3888175 - DNA, 22 bp, Homo sapiens
tctggactcctctgtccaggca

SEQ ID NO: 3888176 - DNA, 15 bp, Homo sapiens
tctggagaagcagtg

SEQ ID NO: 3888177 - DNA, 14 bp, Homo sapiens
tctggagagctaga

SEQ ID NO: 3888178 - DNA, 23 bp, Homo sapiens
tctggagagctagaacctggagg

SEQ ID NO: 3888179 - DNA, 19 bp, Homo sapiens
tctggagtctccagtggtt

SEQ ID NO: 3888180 - DNA, 22 bp, Homo sapiens
tctggatcctgctgtggcctca

SEQ ID NO: 3888181 - DNA, 12 bp, Homo sapiens
tctggcacccag

SEQ ID NO: 3888182 - DNA, 11 bp, Homo sapiens
tctggcagcca

SEQ ID NO: 3888183 - DNA, 13 bp, Homo sapiens
tctggcagccaca

SEQ ID NO: 3888184 - DNA, 15 bp, Homo sapiens
tctggcagccacact

SEQ ID NO: 3888185 - DNA, 21 bp, Homo sapiens
tctggcagccacacttctcag

SEQ ID NO: 3888186 - DNA, 19 bp, Homo sapiens
tctggcagggtgggatgga

SEQ ID NO: 3888187 - DNA, 18 bp, Homo sapiens
tctggccaccctggcccg

SEQ ID NO: 3888188 - DNA, 15 bp, Homo sapiens
tctggccaggagctg

SEQ ID NO: 3888189 - DNA, 13 bp, Homo sapiens
tctggcccagcct

SEQ ID NO: 3888190 - DNA, 16 bp, Homo sapiens
tctggccctgccttct

SEQ ID NO: 3888191 - DNA, 16 bp, Homo sapiens
tctggcctcagaccaa

SEQ ID NO: 3888192 - DNA, 13 bp, Homo sapiens
tctggcctcagca

SEQ ID NO: 3888193 - DNA, 14 bp, Homo sapiens
tctggccttttcct

SEQ ID NO: 3888194 - DNA, 13 bp, Homo sapiens
tctggctccagaa

SEQ ID NO: 3888195 - DNA, 12 bp, Homo sapiens
tctggctcctgt

SEQ ID NO: 3888196 - DNA, 14 bp, Homo sapiens
tctggctcctgttt

SEQ ID NO: 3888197 - DNA, 14 bp, Homo sapiens
tctggctgagctga

SEQ ID NO: 3888198 - DNA, 20 bp, Homo sapiens
tctggctgcaagggccagag

SEQ ID NO: 3888199 - DNA, 24 bp, Homo sapiens
tctggcttccaggtatctccagga

SEQ ID NO: 3888200 - DNA, 14 bp, Homo sapiens
tctggcttgactgg

SEQ ID NO: 3888201 - DNA, 20 bp, Homo sapiens
tctgggaggcagaacaggct

SEQ ID NO: 3888202 - DNA, 18 bp, Homo sapiens
tctgggaggtctccactg

SEQ ID NO: 3888203 - DNA, 21 bp, Homo sapiens
tctgggagtgttctgtttccc

SEQ ID NO: 3888204 - DNA, 23 bp, Homo sapiens
tctgggatggaccctcgcagcag

SEQ ID NO: 3888205 - DNA, 22 bp, Homo sapiens
tctgggatgtagaacttcaaga

SEQ ID NO: 3888206 - DNA, 12 bp, Homo sapiens
tctgggctcagg

SEQ ID NO: 3888207 - DNA, 19 bp, Homo sapiens
tctggggaggaagggccag

SEQ ID NO: 3888208 - DNA, 15 bp, Homo sapiens
tctggggcagggtta

SEQ ID NO: 3888209 - DNA, 22 bp, Homo sapiens
tctggggttcagcccctcctct

SEQ ID NO: 3888210 - DNA, 22 bp, Homo sapiens
tctggtatgaacttgaggacac

SEQ ID NO: 3888211 - DNA, 21 bp, Homo sapiens
tctggtgtagctcctctgctg

SEQ ID NO: 3888212 - DNA, 15 bp, Homo sapiens
tctgtaatttttcag

SEQ ID NO: 3888213 - DNA, 15 bp, Homo sapiens
tctgtacaaaaacaa

SEQ ID NO: 3888214 - DNA, 14 bp, Homo sapiens
tctgtagggctgga

SEQ ID NO: 3888215 - DNA, 23 bp, Homo sapiens
tctgtataaaatgcaaaataaat

SEQ ID NO: 3888216 - DNA, 14 bp, Homo sapiens
tctgtataatctat

SEQ ID NO: 3888217 - DNA, 14 bp, Homo sapiens
tctgtatactgtgg

SEQ ID NO: 3888218 - DNA, 13 bp, Homo sapiens
tctgtatatacat

SEQ ID NO: 3888219 - DNA, 14 bp, Homo sapiens
tctgtatatacatt

SEQ ID NO: 3888220 - DNA, 15 bp, Homo sapiens
tctgtattttcatgt

SEQ ID NO: 3888221 - DNA, 20 bp, Homo sapiens
tctgtcaccagctatctgtc

SEQ ID NO: 3888222 - DNA, 17 bp, Homo sapiens
tctgtcacccaggctgg

SEQ ID NO: 3888223 - DNA, 18 bp, Homo sapiens
tctgtcacgtgaaatatt

SEQ ID NO: 3888224 - DNA, 19 bp, Homo sapiens
tctgtcagatgggaagaca

SEQ ID NO: 3888225 - DNA, 17 bp, Homo sapiens
tctgtcagccagccgcc

SEQ ID NO: 3888226 - DNA, 21 bp, Homo sapiens
tctgtcagccagccgccctgg

SEQ ID NO: 3888227 - DNA, 19 bp, Homo sapiens
tctaagctgcagcttcctg

SEQ ID NO: 3888228 - DNA, 15 bp, Homo sapiens
tctaagctggagctc

SEQ ID NO: 3888229 - DNA, 19 bp, Homo sapiens
tctaagctggagctcttgg

SEQ ID NO: 3888230 - DNA, 15 bp, Homo sapiens
tctaagtaaaaccac

SEQ ID NO: 3888231 - DNA, 20 bp, Homo sapiens
tctaagtagatagaaagcaa

SEQ ID NO: 3888232 - DNA, 20 bp, Homo sapiens
tctaatatggcaaaaatggc

SEQ ID NO: 3888233 - DNA, 18 bp, Homo sapiens
tctaatattaaaaatatg

SEQ ID NO: 3888234 - DNA, 20 bp, Homo sapiens
tctaatgtctcttcctctgt

SEQ ID NO: 3888235 - DNA, 14 bp, Homo sapiens
tctaatttatacaa

SEQ ID NO: 3888236 - DNA, 20 bp, Homo sapiens
tctaatttatacaaaataat

SEQ ID NO: 3888237 - DNA, 21 bp, Homo sapiens
tctaatttatacaaaataatt

SEQ ID NO: 3888238 - DNA, 16 bp, Homo sapiens
tctacaagcatttgcc

SEQ ID NO: 3888239 - DNA, 23 bp, Homo sapiens
tctacaagcatttgccctgtgga

SEQ ID NO: 3888240 - DNA, 23 bp, Homo sapiens
tctacacagtgggaactctgaca

SEQ ID NO: 3888241 - DNA, 16 bp, Homo sapiens
tctacagcatacagag

SEQ ID NO: 3888242 - DNA, 16 bp, Homo sapiens
tctacatactatggaa

SEQ ID NO: 3888243 - DNA, 14 bp, Homo sapiens
tctaccatttcaga

SEQ ID NO: 3888244 - DNA, 15 bp, Homo sapiens
tctaccatttcagag

SEQ ID NO: 3888245 - DNA, 16 bp, Homo sapiens
tctacccggcccagag

SEQ ID NO: 3888246 - DNA, 17 bp, Homo sapiens
tctacccggcccagaga

SEQ ID NO: 3888247 - DNA, 22 bp, Homo sapiens
tctacccggcccagagacccct

SEQ ID NO: 3888248 - DNA, 14 bp, Homo sapiens
tctacctgccctct

SEQ ID NO: 3888249 - DNA, 20 bp, Homo sapiens
tctacctgtgttcattctta

SEQ ID NO: 3888250 - DNA, 15 bp, Homo sapiens
tctacgctctccttt

SEQ ID NO: 3888251 - DNA, 18 bp, Homo sapiens
tctacgttctccagccca

SEQ ID NO: 3888252 - DNA, 19 bp, Homo sapiens
tctactccatgcacatagt

SEQ ID NO: 3888253 - DNA, 17 bp, Homo sapiens
tctactgagacatgact

SEQ ID NO: 3888254 - DNA, 20 bp, Homo sapiens
tctactgggaaggctacttc

SEQ ID NO: 3888255 - DNA, 21 bp, Homo sapiens
tctacttctttttctttgaga

SEQ ID NO: 3888256 - DNA, 14 bp, Homo sapiens
tctacttttaaaga

SEQ ID NO: 3888257 - DNA, 15 bp, Homo sapiens
tctagaacacccact

SEQ ID NO: 3888258 - DNA, 19 bp, Homo sapiens
tctagaacacccactggcc

SEQ ID NO: 3888259 - DNA, 22 bp, Homo sapiens
tctagaacacccactggccagt

SEQ ID NO: 3888260 - DNA, 14 bp, Homo sapiens
tctagactttctca

SEQ ID NO: 3888261 - DNA, 17 bp, Homo sapiens
tctagactttctcagtg

SEQ ID NO: 3888262 - DNA, 20 bp, Homo sapiens
tctagagattttcttggcag

SEQ ID NO: 3888263 - DNA, 20 bp, Homo sapiens
tctagagtgagaatctggct

SEQ ID NO: 3888264 - DNA, 21 bp, Homo sapiens
tctagatcaattaattcttaa

SEQ ID NO: 3888265 - DNA, 21 bp, Homo sapiens
tctagattaccccctcattgt

SEQ ID NO: 3888266 - DNA, 13 bp, Homo sapiens
tctagcagagtga

SEQ ID NO: 3888267 - DNA, 15 bp, Homo sapiens
tctagccctccctgg

SEQ ID NO: 3888268 - DNA, 14 bp, Homo sapiens
tctagcctgggcca

SEQ ID NO: 3888269 - DNA, 21 bp, Homo sapiens
tctagctagaaatatgatttt

SEQ ID NO: 3888270 - DNA, 16 bp, Homo sapiens
tctagctattattttc

SEQ ID NO: 3888271 - DNA, 13 bp, Homo sapiens
tctagctggcagg

SEQ ID NO: 3888272 - DNA, 18 bp, Homo sapiens
tctagcttcatgcctcag

SEQ ID NO: 3888273 - DNA, 17 bp, Homo sapiens
tctaggagctgggagga

SEQ ID NO: 3888274 - DNA, 18 bp, Homo sapiens
tctaggagctgggaggaa

SEQ ID NO: 3888275 - DNA, 21 bp, Homo sapiens
tctaggcagttcaaagcagga

SEQ ID NO: 3888276 - DNA, 18 bp, Homo sapiens
tctaggcatcccagggga

SEQ ID NO: 3888277 - DNA, 17 bp, Homo sapiens
tctagggagagaccctt

SEQ ID NO: 3888278 - DNA, 20 bp, Homo sapiens
tctagtctcctttgcactga

SEQ ID NO: 3888279 - DNA, 22 bp, Homo sapiens
tctagtctcctttgcactgagg

SEQ ID NO: 3888280 - DNA, 15 bp, Homo sapiens
tctagtgatttcctg

SEQ ID NO: 3888281 - DNA, 14 bp, Homo sapiens
tctagtttcttgtg

SEQ ID NO: 3888282 - DNA, 15 bp, Homo sapiens
tctataatggaaaca

SEQ ID NO: 3888283 - DNA, 13 bp, Homo sapiens
tctatagagaaaa

SEQ ID NO: 3888284 - DNA, 17 bp, Homo sapiens
tctatagtagtcaatta

SEQ ID NO: 3888285 - DNA, 15 bp, Homo sapiens
tctatcaatagtcaa

SEQ ID NO: 3888286 - DNA, 16 bp, Homo sapiens
tctatcctacaacaag

SEQ ID NO: 3888287 - DNA, 14 bp, Homo sapiens
tctatgcaattttt

SEQ ID NO: 3888288 - DNA, 20 bp, Homo sapiens
tctatgcagtattgccacaa

SEQ ID NO: 3888289 - DNA, 17 bp, Homo sapiens
tctattaagatttccaa

SEQ ID NO: 3888290 - DNA, 19 bp, Homo sapiens
tctattagttttctttgta

SEQ ID NO: 3888291 - DNA, 15 bp, Homo sapiens
tctattcctgaccct

SEQ ID NO: 3888292 - DNA, 17 bp, Homo sapiens
tctattcctgaccctcc

SEQ ID NO: 3888293 - DNA, 18 bp, Homo sapiens
tctattcctgaccctccc

SEQ ID NO: 3888294 - DNA, 20 bp, Homo sapiens
tctatttaaaaaataaaaaa

SEQ ID NO: 3888295 - DNA, 12 bp, Homo sapiens
tctatttaagcc

SEQ ID NO: 3888296 - DNA, 14 bp, Homo sapiens
tctattttgatttt

SEQ ID NO: 3888297 - DNA, 17 bp, Homo sapiens
tctattttgtaaactca

SEQ ID NO: 3888298 - DNA, 18 bp, Homo sapiens
tctcaaaataagttgaaa

SEQ ID NO: 3888299 - DNA, 17 bp, Homo sapiens
tctcaaattctcaacct

SEQ ID NO: 3888300 - DNA, 17 bp, Homo sapiens
tctcaagagggcactgg

SEQ ID NO: 3888301 - DNA, 18 bp, Homo sapiens
tctcaagagggcactggt

SEQ ID NO: 3888302 - DNA, 19 bp, Homo sapiens
tctcaagcactaaaaagtg

SEQ ID NO: 3888303 - DNA, 15 bp, Homo sapiens
tctcaagctcttcct

SEQ ID NO: 3888304 - DNA, 20 bp, Homo sapiens
tctcaatattcaataaagct

SEQ ID NO: 3888305 - DNA, 24 bp, Homo sapiens
tctcaatcttcggggtgtgatgaa

SEQ ID NO: 3888306 - DNA, 12 bp, Homo sapiens
tctcaatgtgaa

SEQ ID NO: 3888307 - DNA, 17 bp, Homo sapiens
tctcaccagctgctgct

SEQ ID NO: 3888308 - DNA, 15 bp, Homo sapiens
tctcactaaacttta

SEQ ID NO: 3888309 - DNA, 13 bp, Homo sapiens
tctcactcctacc

SEQ ID NO: 3888310 - DNA, 17 bp, Homo sapiens
tctcactcctacctggt

SEQ ID NO: 3888311 - DNA, 13 bp, Homo sapiens
tctcactcctgag

SEQ ID NO: 3888312 - DNA, 16 bp, Homo sapiens
tctcagaacagctgaa

SEQ ID NO: 3888313 - DNA, 14 bp, Homo sapiens
tctcaggaaatcaa

SEQ ID NO: 3888314 - DNA, 19 bp, Homo sapiens
tctcaggacacaggcctgt

SEQ ID NO: 3888315 - DNA, 15 bp, Homo sapiens
tctcaggagcacagg

SEQ ID NO: 3888316 - DNA, 19 bp, Homo sapiens
tctcaggaggcgcagcccg

SEQ ID NO: 3888317 - DNA, 20 bp, Homo sapiens
tctcagggggtcagcagagt

SEQ ID NO: 3888318 - DNA, 14 bp, Homo sapiens
tctcaggtcactcc

SEQ ID NO: 3888319 - DNA, 15 bp, Homo sapiens
tctcaggtccctgca

SEQ ID NO: 3888320 - DNA, 14 bp, Homo sapiens
tctcaggtgccact

SEQ ID NO: 3888321 - DNA, 16 bp, Homo sapiens
tctcaggtgccactcc

SEQ ID NO: 3888322 - DNA, 15 bp, Homo sapiens
tctcagtcagtaatt

SEQ ID NO: 3888323 - DNA, 19 bp, Homo sapiens
tctcagttattcagattga

SEQ ID NO: 3888324 - DNA, 16 bp, Homo sapiens
tctcagtttgtataga

SEQ ID NO: 3888325 - DNA, 19 bp, Homo sapiens
tctcatacctctgaccaac

SEQ ID NO: 3888326 - DNA, 21 bp, Homo sapiens
tctcataggaaaagtacattt

SEQ ID NO: 3888327 - DNA, 22 bp, Homo sapiens
tctcataggaaaagtacattta

SEQ ID NO: 3888328 - DNA, 24 bp, Homo sapiens
tctcataggaaaagtacatttaat

SEQ ID NO: 3888329 - DNA, 15 bp, Homo sapiens
tctcatcagaaatgt

SEQ ID NO: 3888330 - DNA, 21 bp, Homo sapiens
tctcatcagtgtcctcttgct

SEQ ID NO: 3888331 - DNA, 14 bp, Homo sapiens
tctcatcatattgt

SEQ ID NO: 3888332 - DNA, 16 bp, Homo sapiens
tctcatcatattgtat

SEQ ID NO: 3888333 - DNA, 18 bp, Homo sapiens
tctcatcatattgtatgt

SEQ ID NO: 3888334 - DNA, 16 bp, Homo sapiens
tctcatccccagtccc

SEQ ID NO: 3888335 - DNA, 16 bp, Homo sapiens
tctcatgcctgcctga

SEQ ID NO: 3888336 - DNA, 19 bp, Homo sapiens
tctcatgtgatccttttat

SEQ ID NO: 3888337 - DNA, 23 bp, Homo sapiens
tctcatgtgatccttttatgtta

SEQ ID NO: 3888338 - DNA, 17 bp, Homo sapiens
tctcattccaacagtga

SEQ ID NO: 3888339 - DNA, 13 bp, Homo sapiens
tctcattccccag

SEQ ID NO: 3888340 - DNA, 16 bp, Homo sapiens
tctcattccccaggtg

SEQ ID NO: 3888341 - DNA, 16 bp, Homo sapiens
tctcattctctttctt

SEQ ID NO: 3888342 - DNA, 23 bp, Homo sapiens
tctcattgtagagcttggtggct

SEQ ID NO: 3888343 - DNA, 18 bp, Homo sapiens
tctccaaaggggctgctg

SEQ ID NO: 3888344 - DNA, 19 bp, Homo sapiens
tctccaaaggggctgctgg

SEQ ID NO: 3888345 - DNA, 20 bp, Homo sapiens
tctccaaatattattcaagt

SEQ ID NO: 3888346 - DNA, 14 bp, Homo sapiens
tctccaaggaccag

SEQ ID NO: 3888347 - DNA, 16 bp, Homo sapiens
tctccaaggaccaggt

SEQ ID NO: 3888348 - DNA, 17 bp, Homo sapiens
tctccaattgtaaaaaa

SEQ ID NO: 3888349 - DNA, 14 bp, Homo sapiens
tctccacctcagcc

SEQ ID NO: 3888350 - DNA, 19 bp, Homo sapiens
tctccacctcagccttgga

SEQ ID NO: 3888351 - DNA, 14 bp, Homo sapiens
tctccactgccttc

SEQ ID NO: 3888352 - DNA, 19 bp, Homo sapiens
tctccaggcaccatctccc

SEQ ID NO: 3888353 - DNA, 16 bp, Homo sapiens
tctccagggctgcccc

SEQ ID NO: 3888354 - DNA, 17 bp, Homo sapiens
tctccagtggttgctgt

SEQ ID NO: 3888355 - DNA, 20 bp, Homo sapiens
tctccagtggttgctgttga

SEQ ID NO: 3888356 - DNA, 17 bp, Homo sapiens
tctccataatgccactg

SEQ ID NO: 3888357 - DNA, 16 bp, Homo sapiens
tctccatatctccttc

SEQ ID NO: 3888358 - DNA, 19 bp, Homo sapiens
tctccatttcacacaggtc

SEQ ID NO: 3888359 - DNA, 21 bp, Homo sapiens
tctcccaccccggcctccact

SEQ ID NO: 3888360 - DNA, 15 bp, Homo sapiens
tctcccacgtgggag

SEQ ID NO: 3888361 - DNA, 12 bp, Homo sapiens
tctcccaggccc

SEQ ID NO: 3888362 - DNA, 20 bp, Homo sapiens
tctcccataccatcactgag

SEQ ID NO: 3888363 - DNA, 13 bp, Homo sapiens
tctccccaggcct

SEQ ID NO: 3888364 - DNA, 18 bp, Homo sapiens
tctccccaggcctccagc

SEQ ID NO: 3888365 - DNA, 20 bp, Homo sapiens
tctccccaggcctccagcct

SEQ ID NO: 3888366 - DNA, 16 bp, Homo sapiens
tctcccccgacactgc

SEQ ID NO: 3888367 - DNA, 19 bp, Homo sapiens
tctcccccgacactgctgc

SEQ ID NO: 3888368 - DNA, 21 bp, Homo sapiens
tctcccccgacactgctgcac

SEQ ID NO: 3888369 - DNA, 14 bp, Homo sapiens
tctcccccgcccaa

SEQ ID NO: 3888370 - DNA, 13 bp, Homo sapiens
tctcccctccctc

SEQ ID NO: 3888371 - DNA, 15 bp, Homo sapiens
tctcccctccctctt

SEQ ID NO: 3888372 - DNA, 22 bp, Homo sapiens
tctcccctccctcttccttccc

SEQ ID NO: 3888373 - DNA, 14 bp, Homo sapiens
tctcccctgccctg

SEQ ID NO: 3888374 - DNA, 14 bp, Homo sapiens
tctcccggctgcct

SEQ ID NO: 3888375 - DNA, 16 bp, Homo sapiens
tctcccggctgcctgc

SEQ ID NO: 3888376 - DNA, 17 bp, Homo sapiens
tctccctctcctgccta

SEQ ID NO: 3888377 - DNA, 14 bp, Homo sapiens
tctccctctggccc

SEQ ID NO: 3888378 - DNA, 12 bp, Homo sapiens
tctccctgccgc

SEQ ID NO: 3888379 - DNA, 15 bp, Homo sapiens
tctccggggtctgtg

SEQ ID NO: 3888380 - DNA, 17 bp, Homo sapiens
tctccggggtctgtgct

SEQ ID NO: 3888381 - DNA, 21 bp, Homo sapiens
tctccggggtctgtgctgtgc

SEQ ID NO: 3888382 - DNA, 16 bp, Homo sapiens
tctccgggtgtggcct

SEQ ID NO: 3888383 - DNA, 18 bp, Homo sapiens
tctccgggtgtggcctca

SEQ ID NO: 3888384 - DNA, 21 bp, Homo sapiens
tctccgggtgtggcctcagcc

SEQ ID NO: 3888385 - DNA, 23 bp, Homo sapiens
tctcctaaaacatgaaaattatc

SEQ ID NO: 3888386 - DNA, 15 bp, Homo sapiens
tctcctaccccacct

SEQ ID NO: 3888387 - DNA, 16 bp, Homo sapiens
tctcctaccccacctc

SEQ ID NO: 3888388 - DNA, 16 bp, Homo sapiens
tctcctacctgctgct

SEQ ID NO: 3888389 - DNA, 15 bp, Homo sapiens
tctcctaggagaagc

SEQ ID NO: 3888390 - DNA, 16 bp, Homo sapiens
tctcctcttgccactg

SEQ ID NO: 3888391 - DNA, 15 bp, Homo sapiens
tctcctgcctactca

SEQ ID NO: 3888392 - DNA, 17 bp, Homo sapiens
tctcctgcctactcacg

SEQ ID NO: 3888393 - DNA, 20 bp, Homo sapiens
tctcctgggggtggcaggca

SEQ ID NO: 3888394 - DNA, 22 bp, Homo sapiens
tctcctgggggtggcaggcaca

SEQ ID NO: 3888395 - DNA, 22 bp, Homo sapiens
tctcctgtataaccccaccttg

SEQ ID NO: 3888396 - DNA, 22 bp, Homo sapiens
tctcctgtcagagatctgggag

SEQ ID NO: 3888397 - DNA, 16 bp, Homo sapiens
tctcctgtccaaccta

SEQ ID NO: 3888398 - DNA, 19 bp, Homo sapiens
tctcctgtgcccctcagag

SEQ ID NO: 3888399 - DNA, 17 bp, Homo sapiens
tctcctgtttttctggg

SEQ ID NO: 3888400 - DNA, 16 bp, Homo sapiens
tctccttactctgagc

SEQ ID NO: 3888401 - DNA, 20 bp, Homo sapiens
tctccttactctgagcccag

SEQ ID NO: 3888402 - DNA, 21 bp, Homo sapiens
tctccttactctgagcccagg

SEQ ID NO: 3888403 - DNA, 18 bp, Homo sapiens
tctccttcccctacacct

SEQ ID NO: 3888404 - DNA, 11 bp, Homo sapiens
tctccttccct

SEQ ID NO: 3888405 - DNA, 17 bp, Homo sapiens
tctccttccctctttcc

SEQ ID NO: 3888406 - DNA, 16 bp, Homo sapiens
tctccttgggctcctg

SEQ ID NO: 3888407 - DNA, 16 bp, Homo sapiens
tctcctttcacaacct

SEQ ID NO: 3888408 - DNA, 17 bp, Homo sapiens
tctcctttgcactgagg

SEQ ID NO: 3888409 - DNA, 13 bp, Homo sapiens
tctcgagcccaga

SEQ ID NO: 3888410 - DNA, 17 bp, Homo sapiens
tctcgagcgccctgcag

SEQ ID NO: 3888411 - DNA, 22 bp, Homo sapiens
tctcgagcgccctgcagaccct

SEQ ID NO: 3888412 - DNA, 21 bp, Homo sapiens
tctcggacctttcagctgtga

SEQ ID NO: 3888413 - DNA, 21 bp, Homo sapiens
tctcggcaactaagcagtccc

SEQ ID NO: 3888414 - DNA, 15 bp, Homo sapiens
tctcgggaaattatt

SEQ ID NO: 3888415 - DNA, 21 bp, Homo sapiens
tctcgggtccgattaatttat

SEQ ID NO: 3888416 - DNA, 12 bp, Homo sapiens
tctcgtctcctg

SEQ ID NO: 3888417 - DNA, 17 bp, Homo sapiens
tctcgtggtagaagcca

SEQ ID NO: 3888418 - DNA, 19 bp, Homo sapiens
tctcgtggtagaagccagt

SEQ ID NO: 3888419 - DNA, 16 bp, Homo sapiens
tctctaaaaataaaat

SEQ ID NO: 3888420 - DNA, 16 bp, Homo sapiens
tctctaagccacagct

SEQ ID NO: 3888421 - DNA, 12 bp, Homo sapiens
tctctagagaac

SEQ ID NO: 3888422 - DNA, 13 bp, Homo sapiens
tctctagagaaca

SEQ ID NO: 3888423 - DNA, 12 bp, Homo sapiens
tctctagccact

SEQ ID NO: 3888424 - DNA, 20 bp, Homo sapiens
tctctagctttaggggacca

SEQ ID NO: 3888425 - DNA, 17 bp, Homo sapiens
tctctattcctgaccct

SEQ ID NO: 3888426 - DNA, 17 bp, Homo sapiens
tctctatttaatattta

SEQ ID NO: 3888427 - DNA, 16 bp, Homo sapiens
tctctcaatatgctta

SEQ ID NO: 3888428 - DNA, 14 bp, Homo sapiens
tctctcaggagcac

SEQ ID NO: 3888429 - DNA, 16 bp, Homo sapiens
tctctcaggagtatct

SEQ ID NO: 3888430 - DNA, 17 bp, Homo sapiens
tctctcaggagtatctt

SEQ ID NO: 3888431 - DNA, 12 bp, Homo sapiens
tctctccacttt

SEQ ID NO: 3888432 - DNA, 14 bp, Homo sapiens
tctctccaggaagt

SEQ ID NO: 3888433 - DNA, 21 bp, Homo sapiens
tctctcccaccccggcctcca

SEQ ID NO: 3888434 - DNA, 19 bp, Homo sapiens
tctctccttcttccctgtt

SEQ ID NO: 3888435 - DNA, 16 bp, Homo sapiens
tctctcgggcccccca

SEQ ID NO: 3888436 - DNA, 23 bp, Homo sapiens
tctctcggttccacgtccccctg

SEQ ID NO: 3888437 - DNA, 20 bp, Homo sapiens
tctctcgtaactggtttcat

SEQ ID NO: 3888438 - DNA, 11 bp, Homo sapiens
tctctctcctg

SEQ ID NO: 3888439 - DNA, 12 bp, Homo sapiens
tctctctcctgt

SEQ ID NO: 3888440 - DNA, 18 bp, Homo sapiens
tctctctggggccctggg

SEQ ID NO: 3888441 - DNA, 10 bp, Homo sapiens
tctctcttcc

SEQ ID NO: 3888442 - DNA, 14 bp, Homo sapiens
tctctgaacagaaa

SEQ ID NO: 3888443 - DNA, 16 bp, Homo sapiens
tctctgagagagatga

SEQ ID NO: 3888444 - DNA, 22 bp, Homo sapiens
tctctgagatgcccctctgcct

SEQ ID NO: 3888445 - DNA, 18 bp, Homo sapiens
tctctgcagccagcccag

SEQ ID NO: 3888446 - DNA, 19 bp, Homo sapiens
tctctgcagccagcccagc

SEQ ID NO: 3888447 - DNA, 20 bp, Homo sapiens
tctctgcagccagcccagcc

SEQ ID NO: 3888448 - DNA, 18 bp, Homo sapiens
tctctgcagtatttataa

SEQ ID NO: 3888449 - DNA, 21 bp, Homo sapiens
tctctgcgtgcagggacaaag

SEQ ID NO: 3888450 - DNA, 14 bp, Homo sapiens
tctctgctccagag

SEQ ID NO: 3888451 - DNA, 17 bp, Homo sapiens
tctctgcttacccttca

SEQ ID NO: 3888452 - DNA, 13 bp, Homo sapiens
tctctggctccag

SEQ ID NO: 3888453 - DNA, 16 bp, Homo sapiens
tctctggctccagaat

SEQ ID NO: 3888454 - DNA, 19 bp, Homo sapiens
tctctgtaaaatttataca

SEQ ID NO: 3888455 - DNA, 13 bp, Homo sapiens
tctctgtacaaaa

SEQ ID NO: 3888456 - DNA, 16 bp, Homo sapiens
tctctgtataaacatt

SEQ ID NO: 3888457 - DNA, 11 bp, Homo sapiens
tctctgtgctt

SEQ ID NO: 3888458 - DNA, 14 bp, Homo sapiens
tctcttacccagaa

SEQ ID NO: 3888459 - DNA, 21 bp, Homo sapiens
tctcttaccgcgagactgaga

SEQ ID NO: 3888460 - DNA, 13 bp, Homo sapiens
tctcttcactccc

SEQ ID NO: 3888461 - DNA, 24 bp, Homo sapiens
tctcttcaggaggccctggtgtca

SEQ ID NO: 3888462 - DNA, 14 bp, Homo sapiens
tctcttcatacttt

SEQ ID NO: 3888463 - DNA, 12 bp, Homo sapiens
tctcttccctat

SEQ ID NO: 3888464 - DNA, 11 bp, Homo sapiens
tctcttctcca

SEQ ID NO: 3888465 - DNA, 14 bp, Homo sapiens
tctcttctccactg

SEQ ID NO: 3888466 - DNA, 18 bp, Homo sapiens
tctcttctctattcctga

SEQ ID NO: 3888467 - DNA, 13 bp, Homo sapiens
tctcttctttaaa

SEQ ID NO: 3888468 - DNA, 13 bp, Homo sapiens
tctcttgccagca

SEQ ID NO: 3888469 - DNA, 14 bp, Homo sapiens
tctcttgctttgtt

SEQ ID NO: 3888470 - DNA, 13 bp, Homo sapiens
tctcttgtagaag

SEQ ID NO: 3888471 - DNA, 13 bp, Homo sapiens
tctctttttcagt

SEQ ID NO: 3888472 - DNA, 17 bp, Homo sapiens
tctcttttttattctgt

SEQ ID NO: 3888473 - DNA, 22 bp, Homo sapiens
tctcttttttattctgttttct

SEQ ID NO: 3888474 - DNA, 21 bp, Homo sapiens
tctgaaaagcaattgccctgt

SEQ ID NO: 3888475 - DNA, 22 bp, Homo sapiens
tctgaaaatgttgttatgctat

SEQ ID NO: 3888476 - DNA, 19 bp, Homo sapiens
tctgaaacttcataaatgt

SEQ ID NO: 3888477 - DNA, 20 bp, Homo sapiens
tctgaaagacagaatgtcac

SEQ ID NO: 3888478 - DNA, 21 bp, Homo sapiens
tctgaaagacagaatgtcacc

SEQ ID NO: 3888479 - DNA, 12 bp, Homo sapiens
tctgaaagccac

SEQ ID NO: 3888480 - DNA, 16 bp, Homo sapiens
tctgaaagtatatttt

SEQ ID NO: 3888481 - DNA, 18 bp, Homo sapiens
tctgaaatcgccgtgtta

SEQ ID NO: 3888482 - DNA, 22 bp, Homo sapiens
tctgaacccttgtgcttggtgg

SEQ ID NO: 3888483 - DNA, 20 bp, Homo sapiens
tctgaaggaatagccagaga

SEQ ID NO: 3888484 - DNA, 18 bp, Homo sapiens
tctgaagtcactgcacag

SEQ ID NO: 3888485 - DNA, 14 bp, Homo sapiens
tctgaatattttgt

SEQ ID NO: 3888486 - DNA, 15 bp, Homo sapiens
tctgaatattttgta

SEQ ID NO: 3888487 - DNA, 22 bp, Homo sapiens
tctgacagttactcttcagttt

SEQ ID NO: 3888488 - DNA, 15 bp, Homo sapiens
tctgacccagtgaga

SEQ ID NO: 3888489 - DNA, 13 bp, Homo sapiens
tctgactccagag

SEQ ID NO: 3888490 - DNA, 17 bp, Homo sapiens
tctgactccagagtctg

SEQ ID NO: 3888491 - DNA, 17 bp, Homo sapiens
tctgacttctcccatct

SEQ ID NO: 3888492 - DNA, 19 bp, Homo sapiens
tctgagaaagactattcaa

SEQ ID NO: 3888493 - DNA, 21 bp, Homo sapiens
tctgagaaagactattcaaac

SEQ ID NO: 3888494 - DNA, 23 bp, Homo sapiens
tctgagaaagactattcaaacag

SEQ ID NO: 3888495 - DNA, 21 bp, Homo sapiens
tctgagaacagacgttaccaa

SEQ ID NO: 3888496 - DNA, 22 bp, Homo sapiens
tctgagactctcttaggagcag

SEQ ID NO: 3888497 - DNA, 15 bp, Homo sapiens
tctgagagagatgat

SEQ ID NO: 3888498 - DNA, 16 bp, Homo sapiens
tctgagcaagagctgg

SEQ ID NO: 3888499 - DNA, 15 bp, Homo sapiens
tctgagcaccccctc

SEQ ID NO: 3888500 - DNA, 19 bp, Homo sapiens
tctgagcaccccctcattc

SEQ ID NO: 3888501 - DNA, 22 bp, Homo sapiens
tctgagcaccccctcattcccc

SEQ ID NO: 3888502 - DNA, 14 bp, Homo sapiens
tctgagcccaggcc

SEQ ID NO: 3888503 - DNA, 17 bp, Homo sapiens
tctgagccttgagagaa

SEQ ID NO: 3888504 - DNA, 15 bp, Homo sapiens
tctgagcttcagtat

SEQ ID NO: 3888505 - DNA, 18 bp, Homo sapiens
tctgagcttttcatggaa

SEQ ID NO: 3888506 - DNA, 20 bp, Homo sapiens
tctgaggacatggagagaga

SEQ ID NO: 3888507 - DNA, 23 bp, Homo sapiens
tctgaggacatggagagagactc

SEQ ID NO: 3888508 - DNA, 15 bp, Homo sapiens
tctgaggccagcctg

SEQ ID NO: 3888509 - DNA, 16 bp, Homo sapiens
tctgaggccagcctgg

SEQ ID NO: 3888510 - DNA, 18 bp, Homo sapiens
tctgaggccagcctggcc

SEQ ID NO: 3888511 - DNA, 19 bp, Homo sapiens
tctgaggccagcctggcct

SEQ ID NO: 3888512 - DNA, 17 bp, Homo sapiens
tctgaggccccaggccc

SEQ ID NO: 3888513 - DNA, 14 bp, Homo sapiens
tctgagtcctgtct

SEQ ID NO: 3888514 - DNA, 16 bp, Homo sapiens
tctgagtcctgtctct

SEQ ID NO: 3888515 - DNA, 22 bp, Homo sapiens
tctgagtcctgtctctgcctgc

SEQ ID NO: 3888516 - DNA, 12 bp, Homo sapiens
tctgataaacac

SEQ ID NO: 3888517 - DNA, 15 bp, Homo sapiens
tctgataaacacaga

SEQ ID NO: 3888518 - DNA, 21 bp, Homo sapiens
tctgatatgggactgagcctg

SEQ ID NO: 3888519 - DNA, 15 bp, Homo sapiens
tctgatccctcgccc

SEQ ID NO: 3888520 - DNA, 19 bp, Homo sapiens
tctgatcgggataacaaaa

SEQ ID NO: 3888521 - DNA, 16 bp, Homo sapiens
tctgatggtgagctgg

SEQ ID NO: 3888522 - DNA, 13 bp, Homo sapiens
tctgatgtttgtt

SEQ ID NO: 3888523 - DNA, 13 bp, Homo sapiens
tctgattccatat

SEQ ID NO: 3888524 - DNA, 13 bp, Homo sapiens
tctgattggctca

SEQ ID NO: 3888525 - DNA, 14 bp, Homo sapiens
tctgatttaatgtt

SEQ ID NO: 3888526 - DNA, 18 bp, Homo sapiens
tctgatttaatgttttct

SEQ ID NO: 3888527 - DNA, 14 bp, Homo sapiens
tctgattttggcat

SEQ ID NO: 3888528 - DNA, 18 bp, Homo sapiens
tctgcaaagaatgagaag

SEQ ID NO: 3888529 - DNA, 16 bp, Homo sapiens
tctgcaactagccaag

SEQ ID NO: 3888530 - DNA, 17 bp, Homo sapiens
tctgcaaggtctttggt

SEQ ID NO: 3888531 - DNA, 19 bp, Homo sapiens
tctgcaatgggcactggga

SEQ ID NO: 3888532 - DNA, 15 bp, Homo sapiens
tctgcacccaggggt

SEQ ID NO: 3888533 - DNA, 15 bp, Homo sapiens
tctgcagcaactccc

SEQ ID NO: 3888534 - DNA, 17 bp, Homo sapiens
tctgcagcaactcccac

SEQ ID NO: 3888535 - DNA, 21 bp, Homo sapiens
tctgcagcaactcccacgact

SEQ ID NO: 3888536 - DNA, 20 bp, Homo sapiens
tctgcagcactttaaccctc

SEQ ID NO: 3888537 - DNA, 18 bp, Homo sapiens
tctgcagccagcccagcc

SEQ ID NO: 3888538 - DNA, 19 bp, Homo sapiens
tctgcagccagcccagccc

SEQ ID NO: 3888539 - DNA, 22 bp, Homo sapiens
tctgcagctatgcgcaatgtgg

SEQ ID NO: 3888540 - DNA, 14 bp, Homo sapiens
tctgcaggcacctt

SEQ ID NO: 3888541 - DNA, 17 bp, Homo sapiens
tctgcaggcaccttagt

SEQ ID NO: 3888542 - DNA, 22 bp, Homo sapiens
tctgcaggcaccttagtggctt

SEQ ID NO: 3888543 - DNA, 16 bp, Homo sapiens
tctgcagggagcaact

SEQ ID NO: 3888544 - DNA, 19 bp, Homo sapiens
tctgcagggggtgtgtctg

SEQ ID NO: 3888545 - DNA, 16 bp, Homo sapiens
tctgcagtagtctctg

SEQ ID NO: 3888546 - DNA, 21 bp, Homo sapiens
tctgcagtagtctctgtgctt

SEQ ID NO: 3888547 - DNA, 14 bp, Homo sapiens
tctgcatcagctgc

SEQ ID NO: 3888548 - DNA, 21 bp, Homo sapiens
tctgcatcagctgctgaaaca

SEQ ID NO: 3888549 - DNA, 17 bp, Homo sapiens
tctgcattcaggatcaa

SEQ ID NO: 3888550 - DNA, 19 bp, Homo sapiens
tctgcattccccgctgccc

SEQ ID NO: 3888551 - DNA, 13 bp, Homo sapiens
tctgccaagccct

SEQ ID NO: 3888552 - DNA, 19 bp, Homo sapiens
tctgccacagagagtcctt

SEQ ID NO: 3888553 - DNA, 14 bp, Homo sapiens
tctgccccaagcag

SEQ ID NO: 3888554 - DNA, 18 bp, Homo sapiens
tctgccccaagcagccag

SEQ ID NO: 3888555 - DNA, 16 bp, Homo sapiens
tctgccccaaggggcc

SEQ ID NO: 3888556 - DNA, 20 bp, Homo sapiens
tctgccccaaggggcccaca

SEQ ID NO: 3888557 - DNA, 15 bp, Homo sapiens
tctgccccagcttta

SEQ ID NO: 3888558 - DNA, 17 bp, Homo sapiens
tctgccccagctttatc

SEQ ID NO: 3888559 - DNA, 13 bp, Homo sapiens
tctgccccagtag

SEQ ID NO: 3888560 - DNA, 16 bp, Homo sapiens
tctgccccagtagtca

SEQ ID NO: 3888561 - DNA, 15 bp, Homo sapiens
tctgccccttgggca

SEQ ID NO: 3888562 - DNA, 14 bp, Homo sapiens
tctgccctgcctcc

SEQ ID NO: 3888563 - DNA, 15 bp, Homo sapiens
tctgccctgcctccc

SEQ ID NO: 3888564 - DNA, 13 bp, Homo sapiens
tctgccctgtata

SEQ ID NO: 3888565 - DNA, 16 bp, Homo sapiens
tctgcctatttattgg

SEQ ID NO: 3888566 - DNA, 15 bp, Homo sapiens
tctgcctcctcttca

SEQ ID NO: 3888567 - DNA, 12 bp, Homo sapiens
tctgcctggcct

SEQ ID NO: 3888568 - DNA, 13 bp, Homo sapiens
tctgcctggcctg

SEQ ID NO: 3888569 - DNA, 17 bp, Homo sapiens
tctgcctggcctggctc

SEQ ID NO: 3888570 - DNA, 10 bp, Homo sapiens
tctgcctggg

SEQ ID NO: 3888571 - DNA, 18 bp, Homo sapiens
tctgcctgggcctgtgca

SEQ ID NO: 3888572 - DNA, 19 bp, Homo sapiens
tcctgataaacattaaaca

SEQ ID NO: 3888573 - DNA, 19 bp, Homo sapiens
tcctgataataattgatca

SEQ ID NO: 3888574 - DNA, 13 bp, Homo sapiens
tcctgatggccaa

SEQ ID NO: 3888575 - DNA, 18 bp, Homo sapiens
tcctgatggtacaggaaa

SEQ ID NO: 3888576 - DNA, 13 bp, Homo sapiens
tcctgattcccca

SEQ ID NO: 3888577 - DNA, 17 bp, Homo sapiens
tcctgatttcagggaaa

SEQ ID NO: 3888578 - DNA, 19 bp, Homo sapiens
tcctgatttctctgaacag

SEQ ID NO: 3888579 - DNA, 17 bp, Homo sapiens
tcctgcaaagggaactg

SEQ ID NO: 3888580 - DNA, 18 bp, Homo sapiens
tcctgcaatctccagggc

SEQ ID NO: 3888581 - DNA, 20 bp, Homo sapiens
tcctgcaatctccagggctg

SEQ ID NO: 3888582 - DNA, 19 bp, Homo sapiens
tcctgcagcctcctcctga

SEQ ID NO: 3888583 - DNA, 16 bp, Homo sapiens
tcctgcatttgtgaaa

SEQ ID NO: 3888584 - DNA, 13 bp, Homo sapiens
tcctgccagctgc

SEQ ID NO: 3888585 - DNA, 20 bp, Homo sapiens
tcctgccagctgccttcctc

SEQ ID NO: 3888586 - DNA, 14 bp, Homo sapiens
tcctgcccaggaga

SEQ ID NO: 3888587 - DNA, 18 bp, Homo sapiens
tcctgcccaggagagcca

SEQ ID NO: 3888588 - DNA, 23 bp, Homo sapiens
tcctgcccaggagagccagccct

SEQ ID NO: 3888589 - DNA, 18 bp, Homo sapiens
tcctgcccatgtgtcccc

SEQ ID NO: 3888590 - DNA, 19 bp, Homo sapiens
tcctgcccccgacagccca

SEQ ID NO: 3888591 - DNA, 14 bp, Homo sapiens
tcctgcccctcgcc

SEQ ID NO: 3888592 - DNA, 15 bp, Homo sapiens
tcctgcccctcgcct

SEQ ID NO: 3888593 - DNA, 22 bp, Homo sapiens
tcctgcctctactgggaaggct

SEQ ID NO: 3888594 - DNA, 22 bp, Homo sapiens
tcctgcctctctgctccagaga

SEQ ID NO: 3888595 - DNA, 16 bp, Homo sapiens
tcctgctagctgtaga

SEQ ID NO: 3888596 - DNA, 16 bp, Homo sapiens
tcctgctctcttcagg

SEQ ID NO: 3888597 - DNA, 13 bp, Homo sapiens
tcctgctgctgta

SEQ ID NO: 3888598 - DNA, 22 bp, Homo sapiens
tcctgctgctgtaactgctgag

SEQ ID NO: 3888599 - DNA, 24 bp, Homo sapiens
tcctgctgctgtaactgctgagcc

SEQ ID NO: 3888600 - DNA, 15 bp, Homo sapiens
tcctgctgctgtgtt

SEQ ID NO: 3888601 - DNA, 12 bp, Homo sapiens
tcctgctggcac

SEQ ID NO: 3888602 - DNA, 16 bp, Homo sapiens
tcctgctggcacctca

SEQ ID NO: 3888603 - DNA, 18 bp, Homo sapiens
tcctgctggcacctcaga

SEQ ID NO: 3888604 - DNA, 14 bp, Homo sapiens
tcctgctgtggcct

SEQ ID NO: 3888605 - DNA, 15 bp, Homo sapiens
tcctgctgtggcctc

SEQ ID NO: 3888606 - DNA, 17 bp, Homo sapiens
tcctgctgtggcctcac

SEQ ID NO: 3888607 - DNA, 18 bp, Homo sapiens
tcctgctttccctcccca

SEQ ID NO: 3888608 - DNA, 23 bp, Homo sapiens
tcctggaaagactgattgtttta

SEQ ID NO: 3888609 - DNA, 15 bp, Homo sapiens
tcctggaaccaatcc

SEQ ID NO: 3888610 - DNA, 14 bp, Homo sapiens
tcctggaagctgtg

SEQ ID NO: 3888611 - DNA, 21 bp, Homo sapiens
tcctggaagctgtgtccttgc

SEQ ID NO: 3888612 - DNA, 13 bp, Homo sapiens
tcctggacagctg

SEQ ID NO: 3888613 - DNA, 16 bp, Homo sapiens
tcctggagcatcccag

SEQ ID NO: 3888614 - DNA, 18 bp, Homo sapiens
tcctggaggatgaccagg

SEQ ID NO: 3888615 - DNA, 23 bp, Homo sapiens
tcctggcaggaagtctctcccga

SEQ ID NO: 3888616 - DNA, 22 bp, Homo sapiens
tcctggccattttcttgcctga

SEQ ID NO: 3888617 - DNA, 12 bp, Homo sapiens
tcctggcccctc

SEQ ID NO: 3888618 - DNA, 22 bp, Homo sapiens
tcctggcccctccagaccctgc

SEQ ID NO: 3888619 - DNA, 13 bp, Homo sapiens
tcctggcctcctt

SEQ ID NO: 3888620 - DNA, 14 bp, Homo sapiens
tcctggctgccagg

SEQ ID NO: 3888621 - DNA, 20 bp, Homo sapiens
tcctggctgctctcatgcct

SEQ ID NO: 3888622 - DNA, 15 bp, Homo sapiens
tcctggggccccgct

SEQ ID NO: 3888623 - DNA, 21 bp, Homo sapiens
tcctggggccccgctgggatt

SEQ ID NO: 3888624 - DNA, 21 bp, Homo sapiens
tcctgggggttctttcttcct

SEQ ID NO: 3888625 - DNA, 23 bp, Homo sapiens
tcctgggggttctttcttcctct

SEQ ID NO: 3888626 - DNA, 15 bp, Homo sapiens
tcctgggtggctact

SEQ ID NO: 3888627 - DNA, 24 bp, Homo sapiens
tcctgggtggctactctgtgccag

SEQ ID NO: 3888628 - DNA, 18 bp, Homo sapiens
tcctggtacagcagggtc

SEQ ID NO: 3888629 - DNA, 16 bp, Homo sapiens
tcctggtgaggcccag

SEQ ID NO: 3888630 - DNA, 17 bp, Homo sapiens
tcctggtgaggcccagc

SEQ ID NO: 3888631 - DNA, 18 bp, Homo sapiens
tcctggtgaggcccagcc

SEQ ID NO: 3888632 - DNA, 21 bp, Homo sapiens
tcctggtgaggcccagcctgt

SEQ ID NO: 3888633 - DNA, 22 bp, Homo sapiens
tcctggtgaggcccagcctgtc

SEQ ID NO: 3888634 - DNA, 16 bp, Homo sapiens
tcctggtggggcagct

SEQ ID NO: 3888635 - DNA, 21 bp, Homo sapiens
tcctggtggggcagctcctct

SEQ ID NO: 3888636 - DNA, 21 bp, Homo sapiens
tcctgtaacacaagccacaga

SEQ ID NO: 3888637 - DNA, 22 bp, Homo sapiens
tcctgtataatctctctcctgt

SEQ ID NO: 3888638 - DNA, 14 bp, Homo sapiens
tcctgtatattatg

SEQ ID NO: 3888639 - DNA, 20 bp, Homo sapiens
tcctgtatttgttcccaaga

SEQ ID NO: 3888640 - DNA, 21 bp, Homo sapiens
tcctgtatttgttcccaagag

SEQ ID NO: 3888641 - DNA, 16 bp, Homo sapiens
tcctgtcatcccctac

SEQ ID NO: 3888642 - DNA, 18 bp, Homo sapiens
tcctgtccaacctaaccc

SEQ ID NO: 3888643 - DNA, 14 bp, Homo sapiens
tcctgtcccagagg

SEQ ID NO: 3888644 - DNA, 15 bp, Homo sapiens
tcctgtcccagaggt

SEQ ID NO: 3888645 - DNA, 18 bp, Homo sapiens
tcctgtccctacccactc

SEQ ID NO: 3888646 - DNA, 11 bp, Homo sapiens
tcctgtcctcc

SEQ ID NO: 3888647 - DNA, 14 bp, Homo sapiens
tcctgtctctgcct

SEQ ID NO: 3888648 - DNA, 15 bp, Homo sapiens
tcctgtctctgcctg

SEQ ID NO: 3888649 - DNA, 18 bp, Homo sapiens
tcctgtctgtcctggagg

SEQ ID NO: 3888650 - DNA, 22 bp, Homo sapiens
tcctgtgccaacctgatgcccc

SEQ ID NO: 3888651 - DNA, 17 bp, Homo sapiens
tcctgtgcccacatccc

SEQ ID NO: 3888652 - DNA, 13 bp, Homo sapiens
tcctgtgcccctc

SEQ ID NO: 3888653 - DNA, 16 bp, Homo sapiens
tcctgtgcccctcaga

SEQ ID NO: 3888654 - DNA, 14 bp, Homo sapiens
tcctgtgggagcct

SEQ ID NO: 3888655 - DNA, 15 bp, Homo sapiens
tcctgtgggagcctc

SEQ ID NO: 3888656 - DNA, 16 bp, Homo sapiens
tcctgtgggccaggag

SEQ ID NO: 3888657 - DNA, 18 bp, Homo sapiens
tcctgtgggccaggagct

SEQ ID NO: 3888658 - DNA, 14 bp, Homo sapiens
tcctgtgtggggag

SEQ ID NO: 3888659 - DNA, 16 bp, Homo sapiens
tcctgtgtggggaggc

SEQ ID NO: 3888660 - DNA, 14 bp, Homo sapiens
tcctgttgaatctt

SEQ ID NO: 3888661 - DNA, 13 bp, Homo sapiens
tcctgtttccatg

SEQ ID NO: 3888662 - DNA, 17 bp, Homo sapiens
tccttaattcactccca

SEQ ID NO: 3888663 - DNA, 20 bp, Homo sapiens
tccttactcctgtgggagcc

SEQ ID NO: 3888664 - DNA, 22 bp, Homo sapiens
tccttactcctgtgggagcctc

SEQ ID NO: 3888665 - DNA, 15 bp, Homo sapiens
tccttactctgagcc

SEQ ID NO: 3888666 - DNA, 16 bp, Homo sapiens
tccttactctgagccc

SEQ ID NO: 3888667 - DNA, 22 bp, Homo sapiens
tccttactctgagcccaggccg

SEQ ID NO: 3888668 - DNA, 22 bp, Homo sapiens
tccttaggaaaatgcttctgtt

SEQ ID NO: 3888669 - DNA, 23 bp, Homo sapiens
tccttaggaaaatgcttctgttg

SEQ ID NO: 3888670 - DNA, 14 bp, Homo sapiens
tccttatttatcaa

SEQ ID NO: 3888671 - DNA, 23 bp, Homo sapiens
tccttcagagctcttcaagctgt

SEQ ID NO: 3888672 - DNA, 18 bp, Homo sapiens
tccttcagcttccatttc

SEQ ID NO: 3888673 - DNA, 16 bp, Homo sapiens
tccttccagctagtga

SEQ ID NO: 3888674 - DNA, 18 bp, Homo sapiens
tccttcccccatcccctt

SEQ ID NO: 3888675 - DNA, 14 bp, Homo sapiens
tccttccctggctt

SEQ ID NO: 3888676 - DNA, 15 bp, Homo sapiens
tccttccctggcttg

SEQ ID NO: 3888677 - DNA, 14 bp, Homo sapiens
tccttcccttctct

SEQ ID NO: 3888678 - DNA, 16 bp, Homo sapiens
tccttccgctccttta

SEQ ID NO: 3888679 - DNA, 22 bp, Homo sapiens
tccttcctacacccttggactt

SEQ ID NO: 3888680 - DNA, 12 bp, Homo sapiens
tccttcctgccc

SEQ ID NO: 3888681 - DNA, 14 bp, Homo sapiens
tccttcctgcccca

SEQ ID NO: 3888682 - DNA, 15 bp, Homo sapiens
tccttccttccctgg

SEQ ID NO: 3888683 - DNA, 19 bp, Homo sapiens
tccttcgtgtctctcccac

SEQ ID NO: 3888684 - DNA, 14 bp, Homo sapiens
tccttctgcaccca

SEQ ID NO: 3888685 - DNA, 15 bp, Homo sapiens
tccttctgcacccag

SEQ ID NO: 3888686 - DNA, 21 bp, Homo sapiens
tccttctgcttctccctggct

SEQ ID NO: 3888687 - DNA, 12 bp, Homo sapiens
tccttctttctc

SEQ ID NO: 3888688 - DNA, 20 bp, Homo sapiens
tccttctttctcttccctcc

SEQ ID NO: 3888689 - DNA, 22 bp, Homo sapiens
tccttgcacccctcactctggc

SEQ ID NO: 3888690 - DNA, 24 bp, Homo sapiens
tccttgcacccctcactctggcct

SEQ ID NO: 3888691 - DNA, 17 bp, Homo sapiens
tccttgcacctgcatcc

SEQ ID NO: 3888692 - DNA, 15 bp, Homo sapiens
tccttgcatcaattt

SEQ ID NO: 3888693 - DNA, 16 bp, Homo sapiens
tccttgctttgctgtt

SEQ ID NO: 3888694 - DNA, 18 bp, Homo sapiens
tccttggagagcagctgg

SEQ ID NO: 3888695 - DNA, 19 bp, Homo sapiens
tccttggagagcagctggc

SEQ ID NO: 3888696 - DNA, 14 bp, Homo sapiens
tccttgggctcctg

SEQ ID NO: 3888697 - DNA, 15 bp, Homo sapiens
tccttgggctcctgg

SEQ ID NO: 3888698 - DNA, 14 bp, Homo sapiens
tccttggtctgctg

SEQ ID NO: 3888699 - DNA, 15 bp, Homo sapiens
tccttgtcaccagca

SEQ ID NO: 3888700 - DNA, 13 bp, Homo sapiens
tccttgtcactgg

SEQ ID NO: 3888701 - DNA, 22 bp, Homo sapiens
tccttgtggtttatgtcatcat

SEQ ID NO: 3888702 - DNA, 13 bp, Homo sapiens
tcctttacctacc

SEQ ID NO: 3888703 - DNA, 15 bp, Homo sapiens
tcctttacctaccac

SEQ ID NO: 3888704 - DNA, 22 bp, Homo sapiens
tcctttacctaccaccttccct

SEQ ID NO: 3888705 - DNA, 14 bp, Homo sapiens
tcctttaggcagcc

SEQ ID NO: 3888706 - DNA, 17 bp, Homo sapiens
tcctttaggcagcctgc

SEQ ID NO: 3888707 - DNA, 16 bp, Homo sapiens
tcctttatatttagtg

SEQ ID NO: 3888708 - DNA, 18 bp, Homo sapiens
tcctttcacaaccttctg

SEQ ID NO: 3888709 - DNA, 16 bp, Homo sapiens
tcctttgagaaagaaa

SEQ ID NO: 3888710 - DNA, 19 bp, Homo sapiens
tcctttgagaatgtgattc

SEQ ID NO: 3888711 - DNA, 14 bp, Homo sapiens
tcctttgagggcag

SEQ ID NO: 3888712 - DNA, 17 bp, Homo sapiens
tcctttgcactgagggc

SEQ ID NO: 3888713 - DNA, 10 bp, Homo sapiens
tcctttgttc

SEQ ID NO: 3888714 - DNA, 16 bp, Homo sapiens
tcctttgttcttacct

SEQ ID NO: 3888715 - DNA, 19 bp, Homo sapiens
tccttttaaaacacttcca

SEQ ID NO: 3888716 - DNA, 14 bp, Homo sapiens
tccttttattctgt

SEQ ID NO: 3888717 - DNA, 13 bp, Homo sapiens
tccttttcttcct

SEQ ID NO: 3888718 - DNA, 15 bp, Homo sapiens
tccttttcttccttc

SEQ ID NO: 3888719 - DNA, 17 bp, Homo sapiens
tccttttgatggggaga

SEQ ID NO: 3888720 - DNA, 14 bp, Homo sapiens
tccttttgctgtct

SEQ ID NO: 3888721 - DNA, 20 bp, Homo sapiens
tccttttgctgtctttctct

SEQ ID NO: 3888722 - DNA, 20 bp, Homo sapiens
tccttttgtccccagggccc

SEQ ID NO: 3888723 - DNA, 18 bp, Homo sapiens
tccttttgtgtacagtgt

SEQ ID NO: 3888724 - DNA, 14 bp, Homo sapiens
tcctttttctttat

SEQ ID NO: 3888725 - DNA, 23 bp, Homo sapiens
tcctttttgcagtatatttctga

SEQ ID NO: 3888726 - DNA, 19 bp, Homo sapiens
tcgaaaattcatttcacat

SEQ ID NO: 3888727 - DNA, 21 bp, Homo sapiens
tcgaaaattcatttcacatta

SEQ ID NO: 3888728 - DNA, 17 bp, Homo sapiens
tcgaaccaaggcagcct

SEQ ID NO: 3888729 - DNA, 22 bp, Homo sapiens
tcgaaccaaggcagcctccaga

SEQ ID NO: 3888730 - DNA, 21 bp, Homo sapiens
tcgaattaatagcttttattg

SEQ ID NO: 3888731 - DNA, 14 bp, Homo sapiens
tcgaccccaaagcc

SEQ ID NO: 3888732 - DNA, 15 bp, Homo sapiens
tcgaccctttctctg

SEQ ID NO: 3888733 - DNA, 20 bp, Homo sapiens
tcgacctgcggctgctgtgt

SEQ ID NO: 3888734 - DNA, 14 bp, Homo sapiens
tcgactcaggatcc

SEQ ID NO: 3888735 - DNA, 18 bp, Homo sapiens
tcgactttatacagaact

SEQ ID NO: 3888736 - DNA, 23 bp, Homo sapiens
tcgagaccatcctggcccctcca

SEQ ID NO: 3888737 - DNA, 14 bp, Homo sapiens
tcgagcagggtgct

SEQ ID NO: 3888738 - DNA, 20 bp, Homo sapiens
tcgagcagggtgctgtgggt

SEQ ID NO: 3888739 - DNA, 15 bp, Homo sapiens
tcgagccactgcact

SEQ ID NO: 3888740 - DNA, 18 bp, Homo sapiens
tcgagcgccctgcagacc

SEQ ID NO: 3888741 - DNA, 17 bp, Homo sapiens
tcgaggacaagtgagag

SEQ ID NO: 3888742 - DNA, 19 bp, Homo sapiens
tcgatctgtactgtaattt

SEQ ID NO: 3888743 - DNA, 19 bp, Homo sapiens
tcgatgaagcccaataaac

SEQ ID NO: 3888744 - DNA, 23 bp, Homo sapiens
tcgatgaagcccaataaacctct

SEQ ID NO: 3888745 - DNA, 21 bp, Homo sapiens
tcgcaccactgtgtatttaac

SEQ ID NO: 3888746 - DNA, 16 bp, Homo sapiens
tcgcaccttttatacc

SEQ ID NO: 3888747 - DNA, 16 bp, Homo sapiens
tcgcagcaggtgcaag

SEQ ID NO: 3888748 - DNA, 17 bp, Homo sapiens
tcgcagcaggtgcaaga

SEQ ID NO: 3888749 - DNA, 21 bp, Homo sapiens
tcgcagcaggtgcaagagaca

SEQ ID NO: 3888750 - DNA, 10 bp, Homo sapiens
tcgcagccac

SEQ ID NO: 3888751 - DNA, 12 bp, Homo sapiens
tcgcagccaccc

SEQ ID NO: 3888752 - DNA, 19 bp, Homo sapiens
tcgcagccaccctgaggag

SEQ ID NO: 3888753 - DNA, 21 bp, Homo sapiens
tcgcagcctggcggggcagga

SEQ ID NO: 3888754 - DNA, 19 bp, Homo sapiens
tcgcaggatccgctgccac

SEQ ID NO: 3888755 - DNA, 22 bp, Homo sapiens
tcgcccacaagccttactcacc

SEQ ID NO: 3888756 - DNA, 12 bp, Homo sapiens
tcgccccaccca

SEQ ID NO: 3888757 - DNA, 15 bp, Homo sapiens
tcgccccagatcacc

SEQ ID NO: 3888758 - DNA, 22 bp, Homo sapiens
tcgccccagatcaccagcccgg

SEQ ID NO: 3888759 - DNA, 15 bp, Homo sapiens
tcgcccccacacccc

SEQ ID NO: 3888760 - DNA, 14 bp, Homo sapiens
tcgcctaggcctgt

SEQ ID NO: 3888761 - DNA, 16 bp, Homo sapiens
tcgcctaggcctgtga

SEQ ID NO: 3888762 - DNA, 17 bp, Homo sapiens
tcgcctgggcccaggct

SEQ ID NO: 3888763 - DNA, 18 bp, Homo sapiens
tcgcctgggcccaggctc

SEQ ID NO: 3888764 - DNA, 23 bp, Homo sapiens
tcgccttttaggctcaggacgga

SEQ ID NO: 3888765 - DNA, 20 bp, Homo sapiens
tcgctccccactctgctctg

SEQ ID NO: 3888766 - DNA, 23 bp, Homo sapiens
tcgctccctgtagctctgcctcc

SEQ ID NO: 3888767 - DNA, 16 bp, Homo sapiens
tcgctgccaggacacc

SEQ ID NO: 3888768 - DNA, 17 bp, Homo sapiens
tcgctgccaggacacct

SEQ ID NO: 3888769 - DNA, 18 bp, Homo sapiens
tcgctgccaggacacctg

SEQ ID NO: 3888770 - DNA, 19 bp, Homo sapiens
tcgctgccaggacacctgc

SEQ ID NO: 3888771 - DNA, 17 bp, Homo sapiens
tcgctgctctagctggc

SEQ ID NO: 3888772 - DNA, 16 bp, Homo sapiens
tcgctgcttcgtggga

SEQ ID NO: 3888773 - DNA, 21 bp, Homo sapiens
tcgctggaatcaatttcccag

SEQ ID NO: 3888774 - DNA, 13 bp, Homo sapiens
tcgcttgcttctg

SEQ ID NO: 3888775 - DNA, 17 bp, Homo sapiens
tcggacctttcagctgt

SEQ ID NO: 3888776 - DNA, 15 bp, Homo sapiens
tcggaggctgggccc

SEQ ID NO: 3888777 - DNA, 17 bp, Homo sapiens
tcggaggtggtggagga

SEQ ID NO: 3888778 - DNA, 16 bp, Homo sapiens
tcggagtagaaattgt

SEQ ID NO: 3888779 - DNA, 18 bp, Homo sapiens
tcggcaactaagcagtcc

SEQ ID NO: 3888780 - DNA, 19 bp, Homo sapiens
tcggcccacagctcccacc

SEQ ID NO: 3888781 - DNA, 16 bp, Homo sapiens
tcgggaggctgagaca

SEQ ID NO: 3888782 - DNA, 18 bp, Homo sapiens
tcgggataacaaaatcac

SEQ ID NO: 3888783 - DNA, 23 bp, Homo sapiens
tcggggcccttggggcctggctt

SEQ ID NO: 3888784 - DNA, 15 bp, Homo sapiens
tcggggtgcacagga

SEQ ID NO: 3888785 - DNA, 16 bp, Homo sapiens
tcggggtgcacaggag

SEQ ID NO: 3888786 - DNA, 20 bp, Homo sapiens
tcgggtccgattaatttatg

SEQ ID NO: 3888787 - DNA, 13 bp, Homo sapiens
tcggtgggacagc

SEQ ID NO: 3888788 - DNA, 14 bp, Homo sapiens
tcggtgtaaaacca

SEQ ID NO: 3888789 - DNA, 23 bp, Homo sapiens
tcggttccacgtccccctggggc

SEQ ID NO: 3888790 - DNA, 14 bp, Homo sapiens
tcggtttctgagca

SEQ ID NO: 3888791 - DNA, 19 bp, Homo sapiens
tcgtccacaggggcaggcc

SEQ ID NO: 3888792 - DNA, 20 bp, Homo sapiens
tcgtccacaggggcaggcct

SEQ ID NO: 3888793 - DNA, 23 bp, Homo sapiens
tcgtcctccccctgccagtgcct

SEQ ID NO: 3888794 - DNA, 23 bp, Homo sapiens
tcgtcctgcccccgacagcccag

SEQ ID NO: 3888795 - DNA, 16 bp, Homo sapiens
tcgtcctgtcccagag

SEQ ID NO: 3888796 - DNA, 19 bp, Homo sapiens
tcgtccttactcctgtggg

SEQ ID NO: 3888797 - DNA, 13 bp, Homo sapiens
tcgtctgtcccag

SEQ ID NO: 3888798 - DNA, 18 bp, Homo sapiens
tcgtgacccttcagggcc

SEQ ID NO: 3888799 - DNA, 19 bp, Homo sapiens
tcgtgacccttcagggcca

SEQ ID NO: 3888800 - DNA, 20 bp, Homo sapiens
tcgtgacccttcagggccag

SEQ ID NO: 3888801 - DNA, 18 bp, Homo sapiens
tcgtgccatgatctgtat

SEQ ID NO: 3888802 - DNA, 12 bp, Homo sapiens
tcgtggacacct

SEQ ID NO: 3888803 - DNA, 13 bp, Homo sapiens
tcgtggacacctg

SEQ ID NO: 3888804 - DNA, 14 bp, Homo sapiens
tcgtggacacctgc

SEQ ID NO: 3888805 - DNA, 18 bp, Homo sapiens
tcgtggacacctgccctg

SEQ ID NO: 3888806 - DNA, 18 bp, Homo sapiens
tcgtggagagctaggagc

SEQ ID NO: 3888807 - DNA, 24 bp, Homo sapiens
tcgtggagagctaggagcaaagcc

SEQ ID NO: 3888808 - DNA, 16 bp, Homo sapiens
tcgtggtagaagccag

SEQ ID NO: 3888809 - DNA, 17 bp, Homo sapiens
tcgtggtagaagccagt

SEQ ID NO: 3888810 - DNA, 21 bp, Homo sapiens
tcgtgtgatttcctacagaaa

SEQ ID NO: 3888811 - DNA, 14 bp, Homo sapiens
tcgtgtttacaaaa

SEQ ID NO: 3888812 - DNA, 21 bp, Homo sapiens
tctaaaactatggttcccaat

SEQ ID NO: 3888813 - DNA, 23 bp, Homo sapiens
tctaaaactatggttcccaataa

SEQ ID NO: 3888814 - DNA, 14 bp, Homo sapiens
tctaaacattaatc

SEQ ID NO: 3888815 - DNA, 15 bp, Homo sapiens
tctaaagctttctga

SEQ ID NO: 3888816 - DNA, 19 bp, Homo sapiens
tctaaagttgttcacatat

SEQ ID NO: 3888817 - DNA, 13 bp, Homo sapiens
tctaaagtttaca

SEQ ID NO: 3888818 - DNA, 15 bp, Homo sapiens
tctaaagtttacagt

SEQ ID NO: 3888819 - DNA, 17 bp, Homo sapiens
tctaaagtttacagtaa

SEQ ID NO: 3888820 - DNA, 18 bp, Homo sapiens
tctaaagtttacagtaaa

SEQ ID NO: 3888821 - DNA, 19 bp, Homo sapiens
tctaaagtttacagtaaat

SEQ ID NO: 3888822 - DNA, 21 bp, Homo sapiens
tctaacccccagtgccacaga

SEQ ID NO: 3888823 - DNA, 22 bp, Homo sapiens
tctaacccccagtgccacagag

SEQ ID NO: 3888824 - DNA, 12 bp, Homo sapiens
tctaacctcagc

SEQ ID NO: 3888825 - DNA, 15 bp, Homo sapiens
tctaactgtaaatca

SEQ ID NO: 3888826 - DNA, 21 bp, Homo sapiens
tctaactgtaaatcacttgta

SEQ ID NO: 3888827 - DNA, 22 bp, Homo sapiens
tctaactgtaaatcacttgtaa

SEQ ID NO: 3888828 - DNA, 21 bp, Homo sapiens
tctaagcatcttgtcaagaaa

SEQ ID NO: 3888829 - DNA, 15 bp, Homo sapiens
tctaagctgcagctt

SEQ ID NO: 3888830 - DNA, 19 bp, Homo sapiens
tccctgaaaacccagagag

SEQ ID NO: 3888831 - DNA, 16 bp, Homo sapiens
tccctgaacctcagtt

SEQ ID NO: 3888832 - DNA, 19 bp, Homo sapiens
tccctgaacctcagtttcc

SEQ ID NO: 3888833 - DNA, 24 bp, Homo sapiens
tccctgacgacactgaagaatcaa

SEQ ID NO: 3888834 - DNA, 14 bp, Homo sapiens
tccctgagctttgg

SEQ ID NO: 3888835 - DNA, 19 bp, Homo sapiens
tccctgataacaacctgga

SEQ ID NO: 3888836 - DNA, 21 bp, Homo sapiens
tccctgataacaacctggaga

SEQ ID NO: 3888837 - DNA, 19 bp, Homo sapiens
tccctgcccctcccttcaa

SEQ ID NO: 3888838 - DNA, 21 bp, Homo sapiens
tccctgctaccaaggcccagc

SEQ ID NO: 3888839 - DNA, 12 bp, Homo sapiens
tccctgctcctc

SEQ ID NO: 3888840 - DNA, 23 bp, Homo sapiens
tccctggcatgtcagagccaggc

SEQ ID NO: 3888841 - DNA, 18 bp, Homo sapiens
tccctggcttgtaactcc

SEQ ID NO: 3888842 - DNA, 21 bp, Homo sapiens
tccctggcttgtaactccacc

SEQ ID NO: 3888843 - DNA, 17 bp, Homo sapiens
tccctgggaactcatcc

SEQ ID NO: 3888844 - DNA, 12 bp, Homo sapiens
tccctgggcctg

SEQ ID NO: 3888845 - DNA, 13 bp, Homo sapiens
tccctgggcctgc

SEQ ID NO: 3888846 - DNA, 18 bp, Homo sapiens
tccctgggcctgctgctg

SEQ ID NO: 3888847 - DNA, 19 bp, Homo sapiens
tccctgggcctgctgctga

SEQ ID NO: 3888848 - DNA, 17 bp, Homo sapiens
tccctggggatatgcaa

SEQ ID NO: 3888849 - DNA, 16 bp, Homo sapiens
tccctggggtccttgc

SEQ ID NO: 3888850 - DNA, 19 bp, Homo sapiens
tccctggtcccttggagac

SEQ ID NO: 3888851 - DNA, 16 bp, Homo sapiens
tccctggtgcagaggt

SEQ ID NO: 3888852 - DNA, 17 bp, Homo sapiens
tccctgtagctctgcct

SEQ ID NO: 3888853 - DNA, 14 bp, Homo sapiens
tccctgtcaccaag

SEQ ID NO: 3888854 - DNA, 15 bp, Homo sapiens
tccctgtcagaggct

SEQ ID NO: 3888855 - DNA, 12 bp, Homo sapiens
tccctgtcctcc

SEQ ID NO: 3888856 - DNA, 14 bp, Homo sapiens
tccctgtcctcctc

SEQ ID NO: 3888857 - DNA, 17 bp, Homo sapiens
tccctgtttcaaactga

SEQ ID NO: 3888858 - DNA, 13 bp, Homo sapiens
tcccttaggcatt

SEQ ID NO: 3888859 - DNA, 16 bp, Homo sapiens
tcccttaggcattatt

SEQ ID NO: 3888860 - DNA, 18 bp, Homo sapiens
tcccttaggcattattta

SEQ ID NO: 3888861 - DNA, 11 bp, Homo sapiens
tcccttcaacc

SEQ ID NO: 3888862 - DNA, 21 bp, Homo sapiens
tcccttcaaccattccccatg

SEQ ID NO: 3888863 - DNA, 22 bp, Homo sapiens
tcccttcaaccattccccatgg

SEQ ID NO: 3888864 - DNA, 15 bp, Homo sapiens
tcccttcccctgcct

SEQ ID NO: 3888865 - DNA, 15 bp, Homo sapiens
tcccttcctggcctc

SEQ ID NO: 3888866 - DNA, 15 bp, Homo sapiens
tcccttctctccttc

SEQ ID NO: 3888867 - DNA, 17 bp, Homo sapiens
tcccttctttttcttct

SEQ ID NO: 3888868 - DNA, 18 bp, Homo sapiens
tcccttgagacctcagcc

SEQ ID NO: 3888869 - DNA, 21 bp, Homo sapiens
tcccttgctcagtgcctcctg

SEQ ID NO: 3888870 - DNA, 22 bp, Homo sapiens
tcccttggaaagttcagccaga

SEQ ID NO: 3888871 - DNA, 22 bp, Homo sapiens
tccctttcccatccataaggtg

SEQ ID NO: 3888872 - DNA, 13 bp, Homo sapiens
tccctttctcttc

SEQ ID NO: 3888873 - DNA, 13 bp, Homo sapiens
tccctttctggga

SEQ ID NO: 3888874 - DNA, 14 bp, Homo sapiens
tccgagaacaacag

SEQ ID NO: 3888875 - DNA, 16 bp, Homo sapiens
tccgattaatttatgg

SEQ ID NO: 3888876 - DNA, 14 bp, Homo sapiens
tccgcaccagctgc

SEQ ID NO: 3888877 - DNA, 13 bp, Homo sapiens
tccgcacttggaa

SEQ ID NO: 3888878 - DNA, 17 bp, Homo sapiens
tccgccaaacactccac

SEQ ID NO: 3888879 - DNA, 21 bp, Homo sapiens
tccgcctgcagaggacagagc

SEQ ID NO: 3888880 - DNA, 19 bp, Homo sapiens
tccgctaagacctccccac

SEQ ID NO: 3888881 - DNA, 21 bp, Homo sapiens
tccgctcctttacctaccacc

SEQ ID NO: 3888882 - DNA, 20 bp, Homo sapiens
tccgctgtcgccccaggccc

SEQ ID NO: 3888883 - DNA, 23 bp, Homo sapiens
tccggaggggttgcgggggagct

SEQ ID NO: 3888884 - DNA, 15 bp, Homo sapiens
tccgggacgcttcca

SEQ ID NO: 3888885 - DNA, 17 bp, Homo sapiens
tccgggacgcttccaga

SEQ ID NO: 3888886 - DNA, 18 bp, Homo sapiens
tccgggacgcttccagac

SEQ ID NO: 3888887 - DNA, 23 bp, Homo sapiens
tccgggacgcttccagaccacct

SEQ ID NO: 3888888 - DNA, 20 bp, Homo sapiens
tccgggccgggcggaagggg

SEQ ID NO: 3888889 - DNA, 15 bp, Homo sapiens
tccggggtctgtgct

SEQ ID NO: 3888890 - DNA, 18 bp, Homo sapiens
tccggggtctgtgctgtg

SEQ ID NO: 3888891 - DNA, 14 bp, Homo sapiens
tccgggtgccattc

SEQ ID NO: 3888892 - DNA, 19 bp, Homo sapiens
tccgggtgtggcctcagcc

SEQ ID NO: 3888893 - DNA, 20 bp, Homo sapiens
tccgggtgtggcctcagccc

SEQ ID NO: 3888894 - DNA, 14 bp, Homo sapiens
tccgtagttccctg

SEQ ID NO: 3888895 - DNA, 15 bp, Homo sapiens
tccgtccacccaggc

SEQ ID NO: 3888896 - DNA, 16 bp, Homo sapiens
tccgtcccaaacagag

SEQ ID NO: 3888897 - DNA, 17 bp, Homo sapiens
tccgtccggaaatgaag

SEQ ID NO: 3888898 - DNA, 20 bp, Homo sapiens
tccgtttcagctgacagctg

SEQ ID NO: 3888899 - DNA, 15 bp, Homo sapiens
tcctaaagtctctgc

SEQ ID NO: 3888900 - DNA, 14 bp, Homo sapiens
tcctaactgagaat

SEQ ID NO: 3888901 - DNA, 13 bp, Homo sapiens
tcctaagcagctg

SEQ ID NO: 3888902 - DNA, 19 bp, Homo sapiens
tcctaagcagtgcttgtaa

SEQ ID NO: 3888903 - DNA, 13 bp, Homo sapiens
tcctaagcctgtt

SEQ ID NO: 3888904 - DNA, 14 bp, Homo sapiens
tcctacaaaatgga

SEQ ID NO: 3888905 - DNA, 17 bp, Homo sapiens
tcctacacccttggact

SEQ ID NO: 3888906 - DNA, 20 bp, Homo sapiens
tcctacacccttggacttga

SEQ ID NO: 3888907 - DNA, 13 bp, Homo sapiens
tcctaccaatgca

SEQ ID NO: 3888908 - DNA, 21 bp, Homo sapiens
tcctaccaatgcatgcagcca

SEQ ID NO: 3888909 - DNA, 15 bp, Homo sapiens
tcctacccaaccact

SEQ ID NO: 3888910 - DNA, 14 bp, Homo sapiens
tcctaccccacctc

SEQ ID NO: 3888911 - DNA, 14 bp, Homo sapiens
tcctacctgctgct

SEQ ID NO: 3888912 - DNA, 15 bp, Homo sapiens
tcctacctgctgctg

SEQ ID NO: 3888913 - DNA, 15 bp, Homo sapiens
tcctagaaccaagct

SEQ ID NO: 3888914 - DNA, 23 bp, Homo sapiens
tcctagactaattaaaatctgga

SEQ ID NO: 3888915 - DNA, 16 bp, Homo sapiens
tcctagagctcctgtc

SEQ ID NO: 3888916 - DNA, 18 bp, Homo sapiens
tcctagagctcctgtccc

SEQ ID NO: 3888917 - DNA, 23 bp, Homo sapiens
tcctagaggtgggcagctgggcc

SEQ ID NO: 3888918 - DNA, 14 bp, Homo sapiens
tcctaggagaagca

SEQ ID NO: 3888919 - DNA, 22 bp, Homo sapiens
tcctaggagaagcagcctccta

SEQ ID NO: 3888920 - DNA, 20 bp, Homo sapiens
tcctaggctccaccccatcc

SEQ ID NO: 3888921 - DNA, 13 bp, Homo sapiens
tcctagttttctc

SEQ ID NO: 3888922 - DNA, 14 bp, Homo sapiens
tcctataaggagag

SEQ ID NO: 3888923 - DNA, 17 bp, Homo sapiens
tcctatacatttctgtt

SEQ ID NO: 3888924 - DNA, 22 bp, Homo sapiens
tcctatccttggagagcagctg

SEQ ID NO: 3888925 - DNA, 15 bp, Homo sapiens
tcctatggaaaaggg

SEQ ID NO: 3888926 - DNA, 14 bp, Homo sapiens
tcctattctcacca

SEQ ID NO: 3888927 - DNA, 16 bp, Homo sapiens
tcctattctcaccagg

SEQ ID NO: 3888928 - DNA, 17 bp, Homo sapiens
tcctattctcaccagga

SEQ ID NO: 3888929 - DNA, 14 bp, Homo sapiens
tcctattttaaaac

SEQ ID NO: 3888930 - DNA, 16 bp, Homo sapiens
tcctattttaaaacca

SEQ ID NO: 3888931 - DNA, 22 bp, Homo sapiens
tcctattttaaaaccatgcagc

SEQ ID NO: 3888932 - DNA, 18 bp, Homo sapiens
tcctcaatggacttcaaa

SEQ ID NO: 3888933 - DNA, 13 bp, Homo sapiens
tcctcacaggagc

SEQ ID NO: 3888934 - DNA, 17 bp, Homo sapiens
tcctcagagaatttcta

SEQ ID NO: 3888935 - DNA, 14 bp, Homo sapiens
tcctcagctgccaa

SEQ ID NO: 3888936 - DNA, 20 bp, Homo sapiens
tcctcagctgccaagcactc

SEQ ID NO: 3888937 - DNA, 12 bp, Homo sapiens
tcctcatctgca

SEQ ID NO: 3888938 - DNA, 14 bp, Homo sapiens
tcctcatctgcaga

SEQ ID NO: 3888939 - DNA, 19 bp, Homo sapiens
tcctccaacaataaagagc

SEQ ID NO: 3888940 - DNA, 19 bp, Homo sapiens
tcctccaacgttaaaagac

SEQ ID NO: 3888941 - DNA, 19 bp, Homo sapiens
tcctccacagtgctgcttc

SEQ ID NO: 3888942 - DNA, 16 bp, Homo sapiens
tcctccactcactcca

SEQ ID NO: 3888943 - DNA, 17 bp, Homo sapiens
tcctccactcactccag

SEQ ID NO: 3888944 - DNA, 22 bp, Homo sapiens
tcctccagacagatacagcccc

SEQ ID NO: 3888945 - DNA, 20 bp, Homo sapiens
tcctccagacccctgtggca

SEQ ID NO: 3888946 - DNA, 23 bp, Homo sapiens
tcctccagggccacgtgccaggc

SEQ ID NO: 3888947 - DNA, 15 bp, Homo sapiens
tcctccatggtggaa

SEQ ID NO: 3888948 - DNA, 13 bp, Homo sapiens
tcctcccacaatc

SEQ ID NO: 3888949 - DNA, 13 bp, Homo sapiens
tcctcccatcccc

SEQ ID NO: 3888950 - DNA, 13 bp, Homo sapiens
tcctccccagtct

SEQ ID NO: 3888951 - DNA, 20 bp, Homo sapiens
tcctccccctgccagtgcct

SEQ ID NO: 3888952 - DNA, 23 bp, Homo sapiens
tcctccccctgccagtgccttac

SEQ ID NO: 3888953 - DNA, 17 bp, Homo sapiens
tcctcccctattttaag

SEQ ID NO: 3888954 - DNA, 14 bp, Homo sapiens
tcctcccttcctcc

SEQ ID NO: 3888955 - DNA, 15 bp, Homo sapiens
tcctccgtccaccca

SEQ ID NO: 3888956 - DNA, 12 bp, Homo sapiens
tcctcctccaca

SEQ ID NO: 3888957 - DNA, 13 bp, Homo sapiens
tcctcctccacag

SEQ ID NO: 3888958 - DNA, 14 bp, Homo sapiens
tcctcctgaagcct

SEQ ID NO: 3888959 - DNA, 16 bp, Homo sapiens
tcctcctgaagcctct

SEQ ID NO: 3888960 - DNA, 20 bp, Homo sapiens
tcctcctgatggccaagagc

SEQ ID NO: 3888961 - DNA, 16 bp, Homo sapiens
tcctcctgtgtacagg

SEQ ID NO: 3888962 - DNA, 18 bp, Homo sapiens
tcctccttcccctgtggt

SEQ ID NO: 3888963 - DNA, 14 bp, Homo sapiens
tcctcgccctgggt

SEQ ID NO: 3888964 - DNA, 14 bp, Homo sapiens
tcctcggccccctc

SEQ ID NO: 3888965 - DNA, 15 bp, Homo sapiens
tcctcggtactccca

SEQ ID NO: 3888966 - DNA, 12 bp, Homo sapiens
tcctctactact

SEQ ID NO: 3888967 - DNA, 14 bp, Homo sapiens
tcctctccaattgt

SEQ ID NO: 3888968 - DNA, 18 bp, Homo sapiens
tcctctccaattgtaaaa

SEQ ID NO: 3888969 - DNA, 14 bp, Homo sapiens
tcctctccactgcc

SEQ ID NO: 3888970 - DNA, 18 bp, Homo sapiens
tcctctccactgccttcg

SEQ ID NO: 3888971 - DNA, 12 bp, Homo sapiens
tcctctccaggc

SEQ ID NO: 3888972 - DNA, 18 bp, Homo sapiens
tcctctcccctctgccct

SEQ ID NO: 3888973 - DNA, 14 bp, Homo sapiens
tcctctccttgggc

SEQ ID NO: 3888974 - DNA, 18 bp, Homo sapiens
tcctctcgagcccagatg

SEQ ID NO: 3888975 - DNA, 14 bp, Homo sapiens
tcctctgcagcact

SEQ ID NO: 3888976 - DNA, 15 bp, Homo sapiens
tcctctgcagcactt

SEQ ID NO: 3888977 - DNA, 23 bp, Homo sapiens
tcctctgccacctcccctatcca

SEQ ID NO: 3888978 - DNA, 13 bp, Homo sapiens
tcctctggcccag

SEQ ID NO: 3888979 - DNA, 22 bp, Homo sapiens
tcctctgtccaggcactgctgc

SEQ ID NO: 3888980 - DNA, 12 bp, Homo sapiens
tcctctgttcta

SEQ ID NO: 3888981 - DNA, 17 bp, Homo sapiens
tcctctgttctatccca

SEQ ID NO: 3888982 - DNA, 19 bp, Homo sapiens
tcctcttaccgtagcctcc

SEQ ID NO: 3888983 - DNA, 13 bp, Homo sapiens
tcctcttatttgc

SEQ ID NO: 3888984 - DNA, 19 bp, Homo sapiens
tcctcttctattttgtaaa

SEQ ID NO: 3888985 - DNA, 19 bp, Homo sapiens
tcctcttgccactgcctct

SEQ ID NO: 3888986 - DNA, 13 bp, Homo sapiens
tcctcttgctcaa

SEQ ID NO: 3888987 - DNA, 14 bp, Homo sapiens
tcctcttgctcaaa

SEQ ID NO: 3888988 - DNA, 20 bp, Homo sapiens
tcctgaagaaaccacaggtt

SEQ ID NO: 3888989 - DNA, 13 bp, Homo sapiens
tcctgaagccaga

SEQ ID NO: 3888990 - DNA, 19 bp, Homo sapiens
tcctgaagccagatccacc

SEQ ID NO: 3888991 - DNA, 14 bp, Homo sapiens
tcctgaagcctctg

SEQ ID NO: 3888992 - DNA, 17 bp, Homo sapiens
tcctgaagcctctgccc

SEQ ID NO: 3888993 - DNA, 22 bp, Homo sapiens
tcctgacattaagacacacctc

SEQ ID NO: 3888994 - DNA, 12 bp, Homo sapiens
tcctgaccctcc

SEQ ID NO: 3888995 - DNA, 14 bp, Homo sapiens
tcctgaccctccct

SEQ ID NO: 3888996 - DNA, 14 bp, Homo sapiens
tcctgacgccctgc

SEQ ID NO: 3888997 - DNA, 23 bp, Homo sapiens
tcctgacgccctgcgttggagcc

SEQ ID NO: 3888998 - DNA, 20 bp, Homo sapiens
tcctgagaaggcgaggagag

SEQ ID NO: 3888999 - DNA, 23 bp, Homo sapiens
tcctgagaataagaaagtttcac

SEQ ID NO: 3889000 - DNA, 13 bp, Homo sapiens
tcctgagcactgc

SEQ ID NO: 3889001 - DNA, 20 bp, Homo sapiens
tcctgagcactgccaggagg

SEQ ID NO: 3889002 - DNA, 18 bp, Homo sapiens
tcctgagtcttggcctgc

SEQ ID NO: 3889003 - DNA, 22 bp, Homo sapiens
tcaataccccaagtccacctgc

SEQ ID NO: 3889004 - DNA, 17 bp, Homo sapiens
tcaatagtcaagaaaaa

SEQ ID NO: 3889005 - DNA, 14 bp, Homo sapiens
tcaatattaaatac

SEQ ID NO: 3889006 - DNA, 15 bp, Homo sapiens
tcaatattaaataca

SEQ ID NO: 3889007 - DNA, 17 bp, Homo sapiens
tcaatattaaatacaga

SEQ ID NO: 3889008 - DNA, 12 bp, Homo sapiens
tcaatatttaag

SEQ ID NO: 3889009 - DNA, 17 bp, Homo sapiens
tcaatatttaagtttgt

SEQ ID NO: 3889010 - DNA, 15 bp, Homo sapiens
tcaatcagtgcagtg

SEQ ID NO: 3889011 - DNA, 16 bp, Homo sapiens
tcaatcagtgcagtga

SEQ ID NO: 3889012 - DNA, 15 bp, Homo sapiens
tcaatcatctgtgtg

SEQ ID NO: 3889013 - DNA, 20 bp, Homo sapiens
tcaatcatctgtgtgaaaat

SEQ ID NO: 3889014 - DNA, 16 bp, Homo sapiens
tcaatctgtttttcat

SEQ ID NO: 3889015 - DNA, 18 bp, Homo sapiens
tcaatggaaacagggcag

SEQ ID NO: 3889016 - DNA, 23 bp, Homo sapiens
tcaatggaaacagggcagtgaca

SEQ ID NO: 3889017 - DNA, 15 bp, Homo sapiens
tcaatgtcaagtacc

SEQ ID NO: 3889018 - DNA, 18 bp, Homo sapiens
tcaatgtggtgatgaaat

SEQ ID NO: 3889019 - DNA, 14 bp, Homo sapiens
tcaatgtttttaaa

SEQ ID NO: 3889020 - DNA, 11 bp, Homo sapiens
tcaattaataa

SEQ ID NO: 3889021 - DNA, 14 bp, Homo sapiens
tcaattagtacagt

SEQ ID NO: 3889022 - DNA, 16 bp, Homo sapiens
tcaattattacattta

SEQ ID NO: 3889023 - DNA, 16 bp, Homo sapiens
tcaattcaacacatta

SEQ ID NO: 3889024 - DNA, 16 bp, Homo sapiens
tcaattcccattgcat

SEQ ID NO: 3889025 - DNA, 14 bp, Homo sapiens
tcaattgtatttta

SEQ ID NO: 3889026 - DNA, 15 bp, Homo sapiens
tcaatttaaataacc

SEQ ID NO: 3889027 - DNA, 13 bp, Homo sapiens
tcaatttcccaga

SEQ ID NO: 3889028 - DNA, 14 bp, Homo sapiens
tcaatttcccagaa

SEQ ID NO: 3889029 - DNA, 21 bp, Homo sapiens
tcaatttccctgactcctcta

SEQ ID NO: 3889030 - DNA, 16 bp, Homo sapiens
tcaatttgtatatcat

SEQ ID NO: 3889031 - DNA, 23 bp, Homo sapiens
tcaatttttcttatttcatttct

SEQ ID NO: 3889032 - DNA, 13 bp, Homo sapiens
tcaattttttgct

SEQ ID NO: 3889033 - DNA, 13 bp, Homo sapiens
tcacaaaaatggt

SEQ ID NO: 3889034 - DNA, 12 bp, Homo sapiens
tcacaaaatgca

SEQ ID NO: 3889035 - DNA, 14 bp, Homo sapiens
tcacaaaattttat

SEQ ID NO: 3889036 - DNA, 22 bp, Homo sapiens
tcacaaaattttattcctatat

SEQ ID NO: 3889037 - DNA, 20 bp, Homo sapiens
tcacaacctccgtgctgggc

SEQ ID NO: 3889038 - DNA, 17 bp, Homo sapiens
tcacaagagcccagcag

SEQ ID NO: 3889039 - DNA, 14 bp, Homo sapiens
tcacaagcaataat

SEQ ID NO: 3889040 - DNA, 17 bp, Homo sapiens
tcacaagcaataattag

SEQ ID NO: 3889041 - DNA, 16 bp, Homo sapiens
tcacaagcccaggctg

SEQ ID NO: 3889042 - DNA, 12 bp, Homo sapiens
tcacaaggcagc

SEQ ID NO: 3889043 - DNA, 23 bp, Homo sapiens
tcacaatgaaatgctctcctttc

SEQ ID NO: 3889044 - DNA, 14 bp, Homo sapiens
tcacacacatagat

SEQ ID NO: 3889045 - DNA, 12 bp, Homo sapiens
tcacacaggcat

SEQ ID NO: 3889046 - DNA, 20 bp, Homo sapiens
tcacacaggcatttcctggg

SEQ ID NO: 3889047 - DNA, 15 bp, Homo sapiens
tcacacatgcatcat

SEQ ID NO: 3889048 - DNA, 19 bp, Homo sapiens
tcacacctcacgctctgga

SEQ ID NO: 3889049 - DNA, 20 bp, Homo sapiens
tcacacctgtaatcccagca

SEQ ID NO: 3889050 - DNA, 20 bp, Homo sapiens
tcacactgcaagagccttgg

SEQ ID NO: 3889051 - DNA, 23 bp, Homo sapiens
tcacacttggagctaattaaggt

SEQ ID NO: 3889052 - DNA, 12 bp, Homo sapiens
tcacagaagaat

SEQ ID NO: 3889053 - DNA, 22 bp, Homo sapiens
tcacagacgctcctgaagttag

SEQ ID NO: 3889054 - DNA, 15 bp, Homo sapiens
tcacagcctctccct

SEQ ID NO: 3889055 - DNA, 13 bp, Homo sapiens
tcacagctgcagc

SEQ ID NO: 3889056 - DNA, 15 bp, Homo sapiens
tcacagctgcagctg

SEQ ID NO: 3889057 - DNA, 17 bp, Homo sapiens
tcacagctgcagctggg

SEQ ID NO: 3889058 - DNA, 17 bp, Homo sapiens
tcacaggggcggggcag

SEQ ID NO: 3889059 - DNA, 17 bp, Homo sapiens
tcacagtacaatgtttc

SEQ ID NO: 3889060 - DNA, 20 bp, Homo sapiens
tcacagtggcgagaggagag

SEQ ID NO: 3889061 - DNA, 22 bp, Homo sapiens
tcacagtggcgagaggagagga

SEQ ID NO: 3889062 - DNA, 11 bp, Homo sapiens
tcacagtgttt

SEQ ID NO: 3889063 - DNA, 14 bp, Homo sapiens
tcacatacaatttg

SEQ ID NO: 3889064 - DNA, 17 bp, Homo sapiens
tcacatacaatttgcac

SEQ ID NO: 3889065 - DNA, 21 bp, Homo sapiens
tcacatacaatttgcactgtt

SEQ ID NO: 3889066 - DNA, 16 bp, Homo sapiens
tcacataccctccccc

SEQ ID NO: 3889067 - DNA, 18 bp, Homo sapiens
tcacatatacaaaagcaa

SEQ ID NO: 3889068 - DNA, 18 bp, Homo sapiens
tcacatcaagcatgcaat

SEQ ID NO: 3889069 - DNA, 17 bp, Homo sapiens
tcacatccaatgcatag

SEQ ID NO: 3889070 - DNA, 19 bp, Homo sapiens
tcacattaatatttgctga

SEQ ID NO: 3889071 - DNA, 22 bp, Homo sapiens
tcacattaatggtctaaaaata

SEQ ID NO: 3889072 - DNA, 13 bp, Homo sapiens
tcacattcaggaa

SEQ ID NO: 3889073 - DNA, 16 bp, Homo sapiens
tcacatttgatgtaca

SEQ ID NO: 3889074 - DNA, 22 bp, Homo sapiens
tcacatttgatgtacatgtgta

SEQ ID NO: 3889075 - DNA, 19 bp, Homo sapiens
tcaccaaatgatgccactt

SEQ ID NO: 3889076 - DNA, 21 bp, Homo sapiens
tcaccaagctcacagttcctc

SEQ ID NO: 3889077 - DNA, 23 bp, Homo sapiens
tcaccaatgtacccaccgggcca

SEQ ID NO: 3889078 - DNA, 13 bp, Homo sapiens
tcaccacctctcc

SEQ ID NO: 3889079 - DNA, 18 bp, Homo sapiens
tcaccaccttcccagctc

SEQ ID NO: 3889080 - DNA, 18 bp, Homo sapiens
tcaccagaattgtgcaaa

SEQ ID NO: 3889081 - DNA, 21 bp, Homo sapiens
tcaccagatttgctaatttat

SEQ ID NO: 3889082 - DNA, 20 bp, Homo sapiens
tcaccagctgccaaaatcgt

SEQ ID NO: 3889083 - DNA, 18 bp, Homo sapiens
tcaccagctgctgctctg

SEQ ID NO: 3889084 - DNA, 22 bp, Homo sapiens
tcaccaggaatgttaaagtcag

SEQ ID NO: 3889085 - DNA, 23 bp, Homo sapiens
tcaccagggtccgcaccagctgc

SEQ ID NO: 3889086 - DNA, 18 bp, Homo sapiens
tcaccatacttcattcag

SEQ ID NO: 3889087 - DNA, 15 bp, Homo sapiens
tcaccatcttggcca

SEQ ID NO: 3889088 - DNA, 13 bp, Homo sapiens
tcaccatgtaaca

SEQ ID NO: 3889089 - DNA, 17 bp, Homo sapiens
tccccattcttcctagt

SEQ ID NO: 3889090 - DNA, 22 bp, Homo sapiens
tccccattcttcctagttttct

SEQ ID NO: 3889091 - DNA, 19 bp, Homo sapiens
tcccccaccccctccccag

SEQ ID NO: 3889092 - DNA, 15 bp, Homo sapiens
tcccccacctgacaa

SEQ ID NO: 3889093 - DNA, 22 bp, Homo sapiens
tcccccacctgacaatggcagc

SEQ ID NO: 3889094 - DNA, 14 bp, Homo sapiens
tcccccagacagag

SEQ ID NO: 3889095 - DNA, 15 bp, Homo sapiens
tcccccagagccact

SEQ ID NO: 3889096 - DNA, 23 bp, Homo sapiens
tcccccagtcattctgggaacat

SEQ ID NO: 3889097 - DNA, 17 bp, Homo sapiens
tcccccatgtggctgaa

SEQ ID NO: 3889098 - DNA, 19 bp, Homo sapiens
tccccccactgcaggcccc

SEQ ID NO: 3889099 - DNA, 16 bp, Homo sapiens
tcccccccctgtatag

SEQ ID NO: 3889100 - DNA, 17 bp, Homo sapiens
tcccccgacactgctgc

SEQ ID NO: 3889101 - DNA, 21 bp, Homo sapiens
tcccccgacactgctgcacca

SEQ ID NO: 3889102 - DNA, 22 bp, Homo sapiens
tcccccgcagtccccagccctt

SEQ ID NO: 3889103 - DNA, 16 bp, Homo sapiens
tccccctgccagtgcc

SEQ ID NO: 3889104 - DNA, 18 bp, Homo sapiens
tccccctgccagtgcctt

SEQ ID NO: 3889105 - DNA, 14 bp, Homo sapiens
tcccccttcccagt

SEQ ID NO: 3889106 - DNA, 21 bp, Homo sapiens
tccccgcaccccccaagctgt

SEQ ID NO: 3889107 - DNA, 13 bp, Homo sapiens
tccccgcctgtcc

SEQ ID NO: 3889108 - DNA, 16 bp, Homo sapiens
tccccgcctgtcctgc

SEQ ID NO: 3889109 - DNA, 16 bp, Homo sapiens
tccccgctgcccaatc

SEQ ID NO: 3889110 - DNA, 14 bp, Homo sapiens
tccccggctgcttc

SEQ ID NO: 3889111 - DNA, 16 bp, Homo sapiens
tcccctatccacccag

SEQ ID NO: 3889112 - DNA, 21 bp, Homo sapiens
tcccctatccacccagcccat

SEQ ID NO: 3889113 - DNA, 17 bp, Homo sapiens
tcccctcactctgtcag

SEQ ID NO: 3889114 - DNA, 22 bp, Homo sapiens
tcccctcactctgtcagccagc

SEQ ID NO: 3889115 - DNA, 13 bp, Homo sapiens
tcccctcattcag

SEQ ID NO: 3889116 - DNA, 15 bp, Homo sapiens
tcccctccactgtca

SEQ ID NO: 3889117 - DNA, 15 bp, Homo sapiens
tcccctccctcttcc

SEQ ID NO: 3889118 - DNA, 16 bp, Homo sapiens
tcccctccctcttcct

SEQ ID NO: 3889119 - DNA, 12 bp, Homo sapiens
tcccctgaagac

SEQ ID NO: 3889120 - DNA, 18 bp, Homo sapiens
tcccctgcccccatccca

SEQ ID NO: 3889121 - DNA, 15 bp, Homo sapiens
tcccctgccctgctg

SEQ ID NO: 3889122 - DNA, 12 bp, Homo sapiens
tcccctgcctgg

SEQ ID NO: 3889123 - DNA, 19 bp, Homo sapiens
tcccctgctactcctgtgc

SEQ ID NO: 3889124 - DNA, 23 bp, Homo sapiens
tcccctgctactcctgtgctctg

SEQ ID NO: 3889125 - DNA, 15 bp, Homo sapiens
tcccctggactggga

SEQ ID NO: 3889126 - DNA, 17 bp, Homo sapiens
tcccctggactgggagg

SEQ ID NO: 3889127 - DNA, 12 bp, Homo sapiens
tcccctgtccca

SEQ ID NO: 3889128 - DNA, 14 bp, Homo sapiens
tcccctgtcccacc

SEQ ID NO: 3889129 - DNA, 15 bp, Homo sapiens
tcccctgttcactct

SEQ ID NO: 3889130 - DNA, 14 bp, Homo sapiens
tccccttgcccttg

SEQ ID NO: 3889131 - DNA, 20 bp, Homo sapiens
tccccttgcccttgccctga

SEQ ID NO: 3889132 - DNA, 21 bp, Homo sapiens
tccccttgcccttgccctgac

SEQ ID NO: 3889133 - DNA, 23 bp, Homo sapiens
tccccttgcccttgccctgacct

SEQ ID NO: 3889134 - DNA, 16 bp, Homo sapiens
tccccttggcttcctc

SEQ ID NO: 3889135 - DNA, 14 bp, Homo sapiens
tcccctttattaat

SEQ ID NO: 3889136 - DNA, 12 bp, Homo sapiens
tcccctttcctc

SEQ ID NO: 3889137 - DNA, 13 bp, Homo sapiens
tcccctttcctcc

SEQ ID NO: 3889138 - DNA, 20 bp, Homo sapiens
tccccttttgcctggctgtg

SEQ ID NO: 3889139 - DNA, 21 bp, Homo sapiens
tccccttttgcctggctgtgg

SEQ ID NO: 3889140 - DNA, 24 bp, Homo sapiens
tccccttttgcctggctgtggagg

SEQ ID NO: 3889141 - DNA, 20 bp, Homo sapiens
tcccgagcaaagtctaaagt

SEQ ID NO: 3889142 - DNA, 22 bp, Homo sapiens
tcccgccaggaggtcctcctct

SEQ ID NO: 3889143 - DNA, 18 bp, Homo sapiens
tcccgccttcctcctcca

SEQ ID NO: 3889144 - DNA, 13 bp, Homo sapiens
tcccgctcagccc

SEQ ID NO: 3889145 - DNA, 13 bp, Homo sapiens
tcccggctgcctg

SEQ ID NO: 3889146 - DNA, 14 bp, Homo sapiens
tcccggctgcctgc

SEQ ID NO: 3889147 - DNA, 17 bp, Homo sapiens
tccctaaccaaatgctg

SEQ ID NO: 3889148 - DNA, 14 bp, Homo sapiens
tccctaactctcgg

SEQ ID NO: 3889149 - DNA, 18 bp, Homo sapiens
tccctaaggaatctgaaa

SEQ ID NO: 3889150 - DNA, 23 bp, Homo sapiens
tccctaccgagtctcttctccac

SEQ ID NO: 3889151 - DNA, 17 bp, Homo sapiens
tccctactagagacctc

SEQ ID NO: 3889152 - DNA, 15 bp, Homo sapiens
tccctacttttcaag

SEQ ID NO: 3889153 - DNA, 15 bp, Homo sapiens
tccctagcagtgaac

SEQ ID NO: 3889154 - DNA, 17 bp, Homo sapiens
tccctatcaaaacatat

SEQ ID NO: 3889155 - DNA, 19 bp, Homo sapiens
tccctcaaatgacccaaag

SEQ ID NO: 3889156 - DNA, 16 bp, Homo sapiens
tccctcaaccccacca

SEQ ID NO: 3889157 - DNA, 18 bp, Homo sapiens
tccctcacccccaggtgt

SEQ ID NO: 3889158 - DNA, 22 bp, Homo sapiens
tccctccagggaatccgcctgc

SEQ ID NO: 3889159 - DNA, 23 bp, Homo sapiens
tccctccccaaacccatcagaca

SEQ ID NO: 3889160 - DNA, 22 bp, Homo sapiens
tccctccccacagtcctcacag

SEQ ID NO: 3889161 - DNA, 15 bp, Homo sapiens
tccctccccagctcc

SEQ ID NO: 3889162 - DNA, 14 bp, Homo sapiens
tccctcggaagccg

SEQ ID NO: 3889163 - DNA, 16 bp, Homo sapiens
tccctcggacccacca

SEQ ID NO: 3889164 - DNA, 19 bp, Homo sapiens
tccctcgtccacaggggca

SEQ ID NO: 3889165 - DNA, 15 bp, Homo sapiens
tccctctcccaggcc

SEQ ID NO: 3889166 - DNA, 16 bp, Homo sapiens
tccctctcccaggccc

SEQ ID NO: 3889167 - DNA, 15 bp, Homo sapiens
tccctctcctgccta

SEQ ID NO: 3889168 - DNA, 13 bp, Homo sapiens
tccctctgcccca

SEQ ID NO: 3889169 - DNA, 23 bp, Homo sapiens
tccctctgccccaagcagccagc

SEQ ID NO: 3889170 - DNA, 19 bp, Homo sapiens
tccctctggccctgccttc

SEQ ID NO: 3889171 - DNA, 15 bp, Homo sapiens
tccctcttccttccc

SEQ ID NO: 3889172 - DNA, 18 bp, Homo sapiens
tccctctttccccacctc

SEQ ID NO: 3889173 - DNA, 17 bp, Homo sapiens
tccctgaaaacccagag

SEQ ID NO: 3889174 - DNA, 18 bp, Homo sapiens
tccctgaaaacccagaga

SEQ ID NO: 3889175 - DNA, 13 bp, Homo sapiens
tcccaattcattt

SEQ ID NO: 3889176 - DNA, 15 bp, Homo sapiens
tcccaattcatttca

SEQ ID NO: 3889177 - DNA, 17 bp, Homo sapiens
tcccacaccccagcgcc

SEQ ID NO: 3889178 - DNA, 19 bp, Homo sapiens
tcccaccaaccctcagagc

SEQ ID NO: 3889179 - DNA, 14 bp, Homo sapiens
tcccaccaactctg

SEQ ID NO: 3889180 - DNA, 19 bp, Homo sapiens
tcccaccaactctgcactc

SEQ ID NO: 3889181 - DNA, 20 bp, Homo sapiens
tcccaccaactctgcactcc

SEQ ID NO: 3889182 - DNA, 21 bp, Homo sapiens
tcccaccaactctgcactcca

SEQ ID NO: 3889183 - DNA, 23 bp, Homo sapiens
tcccacccaacagctcagagatg

SEQ ID NO: 3889184 - DNA, 13 bp, Homo sapiens
tcccaccccaccc

SEQ ID NO: 3889185 - DNA, 18 bp, Homo sapiens
tcccaccccacccccttc

SEQ ID NO: 3889186 - DNA, 13 bp, Homo sapiens
tcccaccccactc

SEQ ID NO: 3889187 - DNA, 17 bp, Homo sapiens
tcccaccccactccagc

SEQ ID NO: 3889188 - DNA, 18 bp, Homo sapiens
tcccaccccactccagcc

SEQ ID NO: 3889189 - DNA, 12 bp, Homo sapiens
tcccaccgggag

SEQ ID NO: 3889190 - DNA, 15 bp, Homo sapiens
tcccacgaatttgct

SEQ ID NO: 3889191 - DNA, 21 bp, Homo sapiens
tcccacgaatttgctggggaa

SEQ ID NO: 3889192 - DNA, 14 bp, Homo sapiens
tcccacgtgggaga

SEQ ID NO: 3889193 - DNA, 14 bp, Homo sapiens
tcccacttcactgt

SEQ ID NO: 3889194 - DNA, 18 bp, Homo sapiens
tcccacttcactgtgagg

SEQ ID NO: 3889195 - DNA, 14 bp, Homo sapiens
tcccagaagggagt

SEQ ID NO: 3889196 - DNA, 17 bp, Homo sapiens
tcccagactttctacac

SEQ ID NO: 3889197 - DNA, 16 bp, Homo sapiens
tcccagagacaggaaa

SEQ ID NO: 3889198 - DNA, 12 bp, Homo sapiens
tcccagagcagg

SEQ ID NO: 3889199 - DNA, 22 bp, Homo sapiens
tcccagagcttattggccactg

SEQ ID NO: 3889200 - DNA, 13 bp, Homo sapiens
tcccagaggcaga

SEQ ID NO: 3889201 - DNA, 15 bp, Homo sapiens
tcccagaggccagga

SEQ ID NO: 3889202 - DNA, 20 bp, Homo sapiens
tcccagagtcagaggagaag

SEQ ID NO: 3889203 - DNA, 15 bp, Homo sapiens
tcccagatgctgggg

SEQ ID NO: 3889204 - DNA, 24 bp, Homo sapiens
tcccagcactttgggaggccgagg

SEQ ID NO: 3889205 - DNA, 16 bp, Homo sapiens
tcccagccactcggga

SEQ ID NO: 3889206 - DNA, 16 bp, Homo sapiens
tcccagccctgccagg

SEQ ID NO: 3889207 - DNA, 14 bp, Homo sapiens
tcccagctctccct

SEQ ID NO: 3889208 - DNA, 14 bp, Homo sapiens
tcccagctgtctgt

SEQ ID NO: 3889209 - DNA, 16 bp, Homo sapiens
tcccaggagacagttc

SEQ ID NO: 3889210 - DNA, 12 bp, Homo sapiens
tcccaggccagg

SEQ ID NO: 3889211 - DNA, 20 bp, Homo sapiens
tcccaggcgccccttccccc

SEQ ID NO: 3889212 - DNA, 15 bp, Homo sapiens
tcccaggcttcaccc

SEQ ID NO: 3889213 - DNA, 14 bp, Homo sapiens
tcccagtcatttaa

SEQ ID NO: 3889214 - DNA, 22 bp, Homo sapiens
tcccagtcatttaataaatgtg

SEQ ID NO: 3889215 - DNA, 18 bp, Homo sapiens
tcccagttctacaagcat

SEQ ID NO: 3889216 - DNA, 21 bp, Homo sapiens
tcccagttctacaagcatatt

SEQ ID NO: 3889217 - DNA, 14 bp, Homo sapiens
tcccataccatcac

SEQ ID NO: 3889218 - DNA, 16 bp, Homo sapiens
tcccataccatcactg

SEQ ID NO: 3889219 - DNA, 19 bp, Homo sapiens
tcccatagcgctggctcag

SEQ ID NO: 3889220 - DNA, 14 bp, Homo sapiens
tcccatccccagcg

SEQ ID NO: 3889221 - DNA, 17 bp, Homo sapiens
tcccatctaagctgcag

SEQ ID NO: 3889222 - DNA, 19 bp, Homo sapiens
tcccatctaagctgcagct

SEQ ID NO: 3889223 - DNA, 23 bp, Homo sapiens
tcccatctaagctgcagcttcct

SEQ ID NO: 3889224 - DNA, 14 bp, Homo sapiens
tcccatctcttcct

SEQ ID NO: 3889225 - DNA, 16 bp, Homo sapiens
tcccatggccttccct

SEQ ID NO: 3889226 - DNA, 16 bp, Homo sapiens
tcccatgtcacctcag

SEQ ID NO: 3889227 - DNA, 13 bp, Homo sapiens
tcccatgtgcatg

SEQ ID NO: 3889228 - DNA, 16 bp, Homo sapiens
tcccatgttgcatgcc

SEQ ID NO: 3889229 - DNA, 22 bp, Homo sapiens
tcccattgcatcacctctgtaa

SEQ ID NO: 3889230 - DNA, 14 bp, Homo sapiens
tcccattgccctgg

SEQ ID NO: 3889231 - DNA, 18 bp, Homo sapiens
tcccattttggaagtttt

SEQ ID NO: 3889232 - DNA, 18 bp, Homo sapiens
tccccaaactgtgccctg

SEQ ID NO: 3889233 - DNA, 23 bp, Homo sapiens
tccccaaactgtgccctgccttc

SEQ ID NO: 3889234 - DNA, 15 bp, Homo sapiens
tccccaaaggcatcc

SEQ ID NO: 3889235 - DNA, 18 bp, Homo sapiens
tccccaaagtcttaaaat

SEQ ID NO: 3889236 - DNA, 23 bp, Homo sapiens
tccccacacgtgctcgcagcctg

SEQ ID NO: 3889237 - DNA, 20 bp, Homo sapiens
tccccacagtcctcacagcc

SEQ ID NO: 3889238 - DNA, 23 bp, Homo sapiens
tccccacagtcctcacagcctct

SEQ ID NO: 3889239 - DNA, 19 bp, Homo sapiens
tccccacccccgctggggg

SEQ ID NO: 3889240 - DNA, 17 bp, Homo sapiens
tccccacctcttccttc

SEQ ID NO: 3889241 - DNA, 20 bp, Homo sapiens
tccccaccttccccagactc

SEQ ID NO: 3889242 - DNA, 20 bp, Homo sapiens
tccccaccttcttcagccac

SEQ ID NO: 3889243 - DNA, 20 bp, Homo sapiens
tccccacgagtcacctgcaa

SEQ ID NO: 3889244 - DNA, 11 bp, Homo sapiens
tccccagacac

SEQ ID NO: 3889245 - DNA, 13 bp, Homo sapiens
tccccagacacat

SEQ ID NO: 3889246 - DNA, 14 bp, Homo sapiens
tccccagacacatt

SEQ ID NO: 3889247 - DNA, 15 bp, Homo sapiens
tccccagccctggct

SEQ ID NO: 3889248 - DNA, 18 bp, Homo sapiens
tccccagccctggctctg

SEQ ID NO: 3889249 - DNA, 14 bp, Homo sapiens
tccccagcccttct

SEQ ID NO: 3889250 - DNA, 19 bp, Homo sapiens
tccccagcccttctgcctt

SEQ ID NO: 3889251 - DNA, 22 bp, Homo sapiens
tccccaggccaggccaccagga

SEQ ID NO: 3889252 - DNA, 12 bp, Homo sapiens
tccccaggcctc

SEQ ID NO: 3889253 - DNA, 17 bp, Homo sapiens
tccccaggcctccagcc

SEQ ID NO: 3889254 - DNA, 18 bp, Homo sapiens
tccccaggcctccagcct

SEQ ID NO: 3889255 - DNA, 10 bp, Homo sapiens
tccccagggg

SEQ ID NO: 3889256 - DNA, 19 bp, Homo sapiens
tccccaggggaaaatgaag

SEQ ID NO: 3889257 - DNA, 23 bp, Homo sapiens
tccccaggggagagggtctggag

SEQ ID NO: 3889258 - DNA, 14 bp, Homo sapiens
tccccatcatccca

SEQ ID NO: 3889259 - DNA, 16 bp, Homo sapiens
tccccatcatcccagc

SEQ ID NO: 3889260 - DNA, 19 bp, Homo sapiens
tccccatctccatttcaca

SEQ ID NO: 3889261 - DNA, 12 bp, Homo sapiens
tccaggaaggca

SEQ ID NO: 3889262 - DNA, 15 bp, Homo sapiens
tccaggaaggcagct

SEQ ID NO: 3889263 - DNA, 16 bp, Homo sapiens
tccaggaaggcagctg

SEQ ID NO: 3889264 - DNA, 18 bp, Homo sapiens
tccaggaaggcagctgct

SEQ ID NO: 3889265 - DNA, 20 bp, Homo sapiens
tccaggaaggcagctgctct

SEQ ID NO: 3889266 - DNA, 16 bp, Homo sapiens
tccaggaataggcatt

SEQ ID NO: 3889267 - DNA, 23 bp, Homo sapiens
tccaggagcctggctccgtccag

SEQ ID NO: 3889268 - DNA, 18 bp, Homo sapiens
tccaggagcctgtgcctc

SEQ ID NO: 3889269 - DNA, 16 bp, Homo sapiens
tccaggatcctgcagg

SEQ ID NO: 3889270 - DNA, 17 bp, Homo sapiens
tccaggatcctgcagga

SEQ ID NO: 3889271 - DNA, 19 bp, Homo sapiens
tccaggcacccttctttcc

SEQ ID NO: 3889272 - DNA, 16 bp, Homo sapiens
tccaggcatgctggcc

SEQ ID NO: 3889273 - DNA, 14 bp, Homo sapiens
tccaggccactgtg

SEQ ID NO: 3889274 - DNA, 18 bp, Homo sapiens
tccaggccactgtggcca

SEQ ID NO: 3889275 - DNA, 20 bp, Homo sapiens
tccaggccactgtggccaga

SEQ ID NO: 3889276 - DNA, 22 bp, Homo sapiens
tccaggctctttggggtcagcc

SEQ ID NO: 3889277 - DNA, 13 bp, Homo sapiens
tccagggcagcct

SEQ ID NO: 3889278 - DNA, 14 bp, Homo sapiens
tccagggcagcctc

SEQ ID NO: 3889279 - DNA, 23 bp, Homo sapiens
tccagggccacgtgccaggcccg

SEQ ID NO: 3889280 - DNA, 14 bp, Homo sapiens
tccagggctgcccc

SEQ ID NO: 3889281 - DNA, 16 bp, Homo sapiens
tccagggtcttgggct

SEQ ID NO: 3889282 - DNA, 18 bp, Homo sapiens
tccagggttgatcacact

SEQ ID NO: 3889283 - DNA, 15 bp, Homo sapiens
tccaggtcctggtgg

SEQ ID NO: 3889284 - DNA, 17 bp, Homo sapiens
tccaggtgggagagaca

SEQ ID NO: 3889285 - DNA, 22 bp, Homo sapiens
tccagtaggtaatgattatgtg

SEQ ID NO: 3889286 - DNA, 19 bp, Homo sapiens
tccagtattcttgtcaaaa

SEQ ID NO: 3889287 - DNA, 17 bp, Homo sapiens
tccagtctcctgacatt

SEQ ID NO: 3889288 - DNA, 19 bp, Homo sapiens
tccagtgatgtgctggagc

SEQ ID NO: 3889289 - DNA, 18 bp, Homo sapiens
tccagtgttggctgtgtg

SEQ ID NO: 3889290 - DNA, 23 bp, Homo sapiens
tccagtgttggctgtgtgacaga

SEQ ID NO: 3889291 - DNA, 14 bp, Homo sapiens
tccagttagttctc

SEQ ID NO: 3889292 - DNA, 19 bp, Homo sapiens
tccagttcatgagaatcta

SEQ ID NO: 3889293 - DNA, 15 bp, Homo sapiens
tccagttgcaataaa

SEQ ID NO: 3889294 - DNA, 21 bp, Homo sapiens
tccagttgcaataaaatagta

SEQ ID NO: 3889295 - DNA, 13 bp, Homo sapiens
tccagtttcccac

SEQ ID NO: 3889296 - DNA, 17 bp, Homo sapiens
tccagtttgttctccgg

SEQ ID NO: 3889297 - DNA, 19 bp, Homo sapiens
tccagtttgttctccgggt

SEQ ID NO: 3889298 - DNA, 15 bp, Homo sapiens
tccataaagcaagct

SEQ ID NO: 3889299 - DNA, 21 bp, Homo sapiens
tccataaccccaggcatccca

SEQ ID NO: 3889300 - DNA, 16 bp, Homo sapiens
tccataatcaatctat

SEQ ID NO: 3889301 - DNA, 21 bp, Homo sapiens
tccataatctggactcctctg

SEQ ID NO: 3889302 - DNA, 13 bp, Homo sapiens
tccataatgccac

SEQ ID NO: 3889303 - DNA, 24 bp, Homo sapiens
tccatatctccttcccctacacct

SEQ ID NO: 3889304 - DNA, 13 bp, Homo sapiens
tccatattttcac

SEQ ID NO: 3889305 - DNA, 23 bp, Homo sapiens
tccatccccaaactgtgccctgc

SEQ ID NO: 3889306 - DNA, 20 bp, Homo sapiens
tccatgattttacagagaat

SEQ ID NO: 3889307 - DNA, 19 bp, Homo sapiens
tccatgcagactcctcaga

SEQ ID NO: 3889308 - DNA, 15 bp, Homo sapiens
tccatgcctgagggt

SEQ ID NO: 3889309 - DNA, 16 bp, Homo sapiens
tccatgcctgagggtg

SEQ ID NO: 3889310 - DNA, 14 bp, Homo sapiens
tccatggaggaggt

SEQ ID NO: 3889311 - DNA, 15 bp, Homo sapiens
tccatggaggaggtg

SEQ ID NO: 3889312 - DNA, 14 bp, Homo sapiens
tccatggccacccc

SEQ ID NO: 3889313 - DNA, 21 bp, Homo sapiens
tccatggccaccccgtgccac

SEQ ID NO: 3889314 - DNA, 15 bp, Homo sapiens
tccatgtagcaggac

SEQ ID NO: 3889315 - DNA, 14 bp, Homo sapiens
tccatgtccctgta

SEQ ID NO: 3889316 - DNA, 17 bp, Homo sapiens
tccatgtcctatgtgtg

SEQ ID NO: 3889317 - DNA, 18 bp, Homo sapiens
tccatgtcctatgtgtga

SEQ ID NO: 3889318 - DNA, 18 bp, Homo sapiens
tccatgtcgcctctgcat

SEQ ID NO: 3889319 - DNA, 19 bp, Homo sapiens
tccatgtcgcctctgcatt

SEQ ID NO: 3889320 - DNA, 22 bp, Homo sapiens
tccatgtggccccaggtgccac

SEQ ID NO: 3889321 - DNA, 10 bp, Homo sapiens
tccattccca

SEQ ID NO: 3889322 - DNA, 14 bp, Homo sapiens
tccattgctgttgt

SEQ ID NO: 3889323 - DNA, 15 bp, Homo sapiens
tccattgctgttgtt

SEQ ID NO: 3889324 - DNA, 17 bp, Homo sapiens
tccatttcaactccaga

SEQ ID NO: 3889325 - DNA, 20 bp, Homo sapiens
tccatttcaactccagaagt

SEQ ID NO: 3889326 - DNA, 23 bp, Homo sapiens
tccatttcacacaggtcctgaaa

SEQ ID NO: 3889327 - DNA, 19 bp, Homo sapiens
tccatttctcaatcagtgc

SEQ ID NO: 3889328 - DNA, 24 bp, Homo sapiens
tccatttctcaatcagtgcagtga

SEQ ID NO: 3889329 - DNA, 18 bp, Homo sapiens
tcccaaattccctggacc

SEQ ID NO: 3889330 - DNA, 16 bp, Homo sapiens
tcccaaatttcatacc

SEQ ID NO: 3889331 - DNA, 19 bp, Homo sapiens
tcccaacaacatccatgtc

SEQ ID NO: 3889332 - DNA, 22 bp, Homo sapiens
tcccaacccaattcaggactgg

SEQ ID NO: 3889333 - DNA, 16 bp, Homo sapiens
tcccaacctcaatgcc

SEQ ID NO: 3889334 - DNA, 21 bp, Homo sapiens
tcccaacctcaatgccctgcc

SEQ ID NO: 3889335 - DNA, 14 bp, Homo sapiens
tcccaactgctctg

SEQ ID NO: 3889336 - DNA, 16 bp, Homo sapiens
tcccaactgctctgcc

SEQ ID NO: 3889337 - DNA, 17 bp, Homo sapiens
tcccaactgctctgccc

SEQ ID NO: 3889338 - DNA, 14 bp, Homo sapiens
tcccaacttgtaaa

SEQ ID NO: 3889339 - DNA, 22 bp, Homo sapiens
tcccaagagcatcatgcctctg

SEQ ID NO: 3889340 - DNA, 23 bp, Homo sapiens
tcccaagctttgaatacccccag

SEQ ID NO: 3889341 - DNA, 15 bp, Homo sapiens
tcccaaggagctgat

SEQ ID NO: 3889342 - DNA, 18 bp, Homo sapiens
tcccaaggctctgagcaa

SEQ ID NO: 3889343 - DNA, 14 bp, Homo sapiens
tcccaataaaagtg

SEQ ID NO: 3889344 - DNA, 16 bp, Homo sapiens
tcccaataaaagtgac

SEQ ID NO: 3889345 - DNA, 12 bp, Homo sapiens
tcccaataaagc

SEQ ID NO: 3889346 - DNA, 16 bp, Homo sapiens
tcccaatcagcactga

SEQ ID NO: 3889347 - DNA, 20 bp, Homo sapiens
tcatgttgttcccacacaca

SEQ ID NO: 3889348 - DNA, 23 bp, Homo sapiens
tcattaaggtattattttttcca

SEQ ID NO: 3889349 - DNA, 15 bp, Homo sapiens
tcattactgcctttg

SEQ ID NO: 3889350 - DNA, 20 bp, Homo sapiens
tcattaggtttccttttatt

SEQ ID NO: 3889351 - DNA, 19 bp, Homo sapiens
tcattatctcaaaactgca

SEQ ID NO: 3889352 - DNA, 20 bp, Homo sapiens
tcattatctcaaaactgcac

SEQ ID NO: 3889353 - DNA, 13 bp, Homo sapiens
tcattatgtagaa

SEQ ID NO: 3889354 - DNA, 16 bp, Homo sapiens
tcattatgtagaaata

SEQ ID NO: 3889355 - DNA, 13 bp, Homo sapiens
tcattcaaaacaa

SEQ ID NO: 3889356 - DNA, 12 bp, Homo sapiens
tcattcaggaaa

SEQ ID NO: 3889357 - DNA, 13 bp, Homo sapiens
tcattcaggaaaa

SEQ ID NO: 3889358 - DNA, 19 bp, Homo sapiens
tcattcaggtgttctcttc

SEQ ID NO: 3889359 - DNA, 20 bp, Homo sapiens
tcattcagtgagacacagag

SEQ ID NO: 3889360 - DNA, 13 bp, Homo sapiens
tcattcccagagt

SEQ ID NO: 3889361 - DNA, 14 bp, Homo sapiens
tcattccccaggtg

SEQ ID NO: 3889362 - DNA, 14 bp, Homo sapiens
tcattctcctgcct

SEQ ID NO: 3889363 - DNA, 23 bp, Homo sapiens
tcattcttaccgagaaaaggaga

SEQ ID NO: 3889364 - DNA, 21 bp, Homo sapiens
tcattctttcccctcagagct

SEQ ID NO: 3889365 - DNA, 18 bp, Homo sapiens
tcattgggttttatcagt

SEQ ID NO: 3889366 - DNA, 23 bp, Homo sapiens
tcattgtagagcttggtggctga

SEQ ID NO: 3889367 - DNA, 15 bp, Homo sapiens
tcattgtcgctcagc

SEQ ID NO: 3889368 - DNA, 11 bp, Homo sapiens
tcattgtctca

SEQ ID NO: 3889369 - DNA, 13 bp, Homo sapiens
tcattgtggctat

SEQ ID NO: 3889370 - DNA, 18 bp, Homo sapiens
tcattgtggctatctgca

SEQ ID NO: 3889371 - DNA, 24 bp, Homo sapiens
tcattgttttacttttgtcttcct

SEQ ID NO: 3889372 - DNA, 13 bp, Homo sapiens
tcatttaaaatga

SEQ ID NO: 3889373 - DNA, 13 bp, Homo sapiens
tcatttattttgt

SEQ ID NO: 3889374 - DNA, 14 bp, Homo sapiens
tcatttcacattaa

SEQ ID NO: 3889375 - DNA, 17 bp, Homo sapiens
tcatttctaaaagaata

SEQ ID NO: 3889376 - DNA, 18 bp, Homo sapiens
tcatttctactgtgactg

SEQ ID NO: 3889377 - DNA, 16 bp, Homo sapiens
tcatttctgcatcagc

SEQ ID NO: 3889378 - DNA, 13 bp, Homo sapiens
tcatttggtgctg

SEQ ID NO: 3889379 - DNA, 19 bp, Homo sapiens
tcattttaagaagacatga

SEQ ID NO: 3889380 - DNA, 21 bp, Homo sapiens
tcattttcttatcttctgcaa

SEQ ID NO: 3889381 - DNA, 22 bp, Homo sapiens
tcattttgagtctcaggccctg

SEQ ID NO: 3889382 - DNA, 17 bp, Homo sapiens
tcattttgtaacaaatg

SEQ ID NO: 3889383 - DNA, 19 bp, Homo sapiens
tcattttttttttttgagg

SEQ ID NO: 3889384 - DNA, 23 bp, Homo sapiens
tccaaaatttgaaatattaaaat

SEQ ID NO: 3889385 - DNA, 12 bp, Homo sapiens
tccaaacaccgg

SEQ ID NO: 3889386 - DNA, 17 bp, Homo sapiens
tccaaagaaatgtaagg

SEQ ID NO: 3889387 - DNA, 17 bp, Homo sapiens
tccaaaggggctgctgg

SEQ ID NO: 3889388 - DNA, 21 bp, Homo sapiens
tccaaatgattttcatcaatt

SEQ ID NO: 3889389 - DNA, 22 bp, Homo sapiens
tccaaatgattttcatcaattt

SEQ ID NO: 3889390 - DNA, 18 bp, Homo sapiens
tccaacagcttgaccaga

SEQ ID NO: 3889391 - DNA, 21 bp, Homo sapiens
tccaacagcttgaccagacct

SEQ ID NO: 3889392 - DNA, 22 bp, Homo sapiens
tccaacccatgatgagctcctc

SEQ ID NO: 3889393 - DNA, 13 bp, Homo sapiens
tccaaccccagct

SEQ ID NO: 3889394 - DNA, 15 bp, Homo sapiens
tccaaccccagctgg

SEQ ID NO: 3889395 - DNA, 19 bp, Homo sapiens
tccaaccccagctggcctc

SEQ ID NO: 3889396 - DNA, 18 bp, Homo sapiens
tccaacctaacccctttc

SEQ ID NO: 3889397 - DNA, 21 bp, Homo sapiens
tccaacctaacccctttcctg

SEQ ID NO: 3889398 - DNA, 16 bp, Homo sapiens
tccaacgttaaaagac

SEQ ID NO: 3889399 - DNA, 19 bp, Homo sapiens
tccaacgttaaaagacagt

SEQ ID NO: 3889400 - DNA, 21 bp, Homo sapiens
tccaactggattataaataaa

SEQ ID NO: 3889401 - DNA, 17 bp, Homo sapiens
tccaagaaagatccacc

SEQ ID NO: 3889402 - DNA, 19 bp, Homo sapiens
tccaagaatacagaaaatg

SEQ ID NO: 3889403 - DNA, 11 bp, Homo sapiens
tccaagcaaag

SEQ ID NO: 3889404 - DNA, 16 bp, Homo sapiens
tccaagcttcaagtga

SEQ ID NO: 3889405 - DNA, 17 bp, Homo sapiens
tccaagcttcaagtgat

SEQ ID NO: 3889406 - DNA, 12 bp, Homo sapiens
tccaagcttttg

SEQ ID NO: 3889407 - DNA, 15 bp, Homo sapiens
tccaaggagaaacag

SEQ ID NO: 3889408 - DNA, 16 bp, Homo sapiens
tccaaggagaaacaga

SEQ ID NO: 3889409 - DNA, 20 bp, Homo sapiens
tccaaggagaaacagagaca

SEQ ID NO: 3889410 - DNA, 20 bp, Homo sapiens
tccaagggtatgggaagcca

SEQ ID NO: 3889411 - DNA, 22 bp, Homo sapiens
tccaagggtatgggaagccata

SEQ ID NO: 3889412 - DNA, 15 bp, Homo sapiens
tccaagtcaacactc

SEQ ID NO: 3889413 - DNA, 22 bp, Homo sapiens
tccaagtcaacactcttcttga

SEQ ID NO: 3889414 - DNA, 16 bp, Homo sapiens
tccaagtccaacctgc

SEQ ID NO: 3889415 - DNA, 18 bp, Homo sapiens
tccaagtccaacctgcct

SEQ ID NO: 3889416 - DNA, 23 bp, Homo sapiens
tccaagttcctgcactccagaat

SEQ ID NO: 3889417 - DNA, 12 bp, Homo sapiens
tccaatatttgg

SEQ ID NO: 3889418 - DNA, 22 bp, Homo sapiens
tccaatctgctcagcaggccct

SEQ ID NO: 3889419 - DNA, 16 bp, Homo sapiens
tccaatggctgtaaac

SEQ ID NO: 3889420 - DNA, 17 bp, Homo sapiens
tccaattatgcactggc

SEQ ID NO: 3889421 - DNA, 15 bp, Homo sapiens
tccaattgtaaaaaa

SEQ ID NO: 3889422 - DNA, 20 bp, Homo sapiens
tccacaaagccgtgcctttc

SEQ ID NO: 3889423 - DNA, 22 bp, Homo sapiens
tccacaaatctatattaaagtg

SEQ ID NO: 3889424 - DNA, 17 bp, Homo sapiens
tccacaagattcccaga

SEQ ID NO: 3889425 - DNA, 23 bp, Homo sapiens
tccacaagattcccagagacagg

SEQ ID NO: 3889426 - DNA, 23 bp, Homo sapiens
tccacaagcaatggacctttggg

SEQ ID NO: 3889427 - DNA, 15 bp, Homo sapiens
tccacacacagagga

SEQ ID NO: 3889428 - DNA, 23 bp, Homo sapiens
tccacacacagaggaagagcagg

SEQ ID NO: 3889429 - DNA, 19 bp, Homo sapiens
tccacacacgcaggaactc

SEQ ID NO: 3889430 - DNA, 11 bp, Homo sapiens
tccacagccaa

SEQ ID NO: 3889431 - DNA, 15 bp, Homo sapiens
tccacaggggcaggc

SEQ ID NO: 3889432 - DNA, 17 bp, Homo sapiens
tccacaggggcaggcct

SEQ ID NO: 3889433 - DNA, 18 bp, Homo sapiens
tccacaggggcaggcctg

SEQ ID NO: 3889434 - DNA, 15 bp, Homo sapiens
tccacagtgctgctt

SEQ ID NO: 3889435 - DNA, 16 bp, Homo sapiens
tccaccaacccatcag

SEQ ID NO: 3889436 - DNA, 15 bp, Homo sapiens
tccacccacctcagc

SEQ ID NO: 3889437 - DNA, 12 bp, Homo sapiens
tccacccagccc

SEQ ID NO: 3889438 - DNA, 13 bp, Homo sapiens
tccacccagccca

SEQ ID NO: 3889439 - DNA, 17 bp, Homo sapiens
tccacccagcccattct

SEQ ID NO: 3889440 - DNA, 12 bp, Homo sapiens
tccacccaggct

SEQ ID NO: 3889441 - DNA, 17 bp, Homo sapiens
tccacccaggctgcact

SEQ ID NO: 3889442 - DNA, 18 bp, Homo sapiens
tccacccaggctgcactg

SEQ ID NO: 3889443 - DNA, 22 bp, Homo sapiens
tccacccaggctgcactgcagt

SEQ ID NO: 3889444 - DNA, 23 bp, Homo sapiens
tccacccaggctgcactgcagtg

SEQ ID NO: 3889445 - DNA, 18 bp, Homo sapiens
tccacccagtgctgccat

SEQ ID NO: 3889446 - DNA, 21 bp, Homo sapiens
tccacccagtgctgccatgcc

SEQ ID NO: 3889447 - DNA, 15 bp, Homo sapiens
tccaccccctccagc

SEQ ID NO: 3889448 - DNA, 20 bp, Homo sapiens
tccaccccctccagctccag

SEQ ID NO: 3889449 - DNA, 22 bp, Homo sapiens
tccaccctcaaatgtcagagct

SEQ ID NO: 3889450 - DNA, 23 bp, Homo sapiens
tccaccctcaaatgtcagagcta

SEQ ID NO: 3889451 - DNA, 15 bp, Homo sapiens
tccaccgcagaagga

SEQ ID NO: 3889452 - DNA, 16 bp, Homo sapiens
tccaccgcagaaggaa

SEQ ID NO: 3889453 - DNA, 15 bp, Homo sapiens
tccaccgctgcctaa

SEQ ID NO: 3889454 - DNA, 17 bp, Homo sapiens
tccacctcagccttgga

SEQ ID NO: 3889455 - DNA, 20 bp, Homo sapiens
tccacctcctagaggtgggc

SEQ ID NO: 3889456 - DNA, 16 bp, Homo sapiens
tccacctctccttgga

SEQ ID NO: 3889457 - DNA, 18 bp, Homo sapiens
tccacctcttcacccccc

SEQ ID NO: 3889458 - DNA, 22 bp, Homo sapiens
tccacctgcctatccatcctgc

SEQ ID NO: 3889459 - DNA, 15 bp, Homo sapiens
tccaccttcccatgc

SEQ ID NO: 3889460 - DNA, 19 bp, Homo sapiens
tccaccttcccatgccctg

SEQ ID NO: 3889461 - DNA, 21 bp, Homo sapiens
tccaccttgctcttctttctg

SEQ ID NO: 3889462 - DNA, 17 bp, Homo sapiens
tccacgcctcctggcca

SEQ ID NO: 3889463 - DNA, 14 bp, Homo sapiens
tccacgggaagcct

SEQ ID NO: 3889464 - DNA, 19 bp, Homo sapiens
tccacggtcagatttgctg

SEQ ID NO: 3889465 - DNA, 22 bp, Homo sapiens
tccacggtcagatttgctgttc

SEQ ID NO: 3889466 - DNA, 16 bp, Homo sapiens
tccacggtgcgtggct

SEQ ID NO: 3889467 - DNA, 20 bp, Homo sapiens
tccactcaatatgtgatttt

SEQ ID NO: 3889468 - DNA, 17 bp, Homo sapiens
tccactcactccagccc

SEQ ID NO: 3889469 - DNA, 23 bp, Homo sapiens
tccactccatatttatttaaaca

SEQ ID NO: 3889470 - DNA, 18 bp, Homo sapiens
tccactcccccacctgac

SEQ ID NO: 3889471 - DNA, 21 bp, Homo sapiens
tccactctcggggcccttggg

SEQ ID NO: 3889472 - DNA, 13 bp, Homo sapiens
tccactgccttcg

SEQ ID NO: 3889473 - DNA, 17 bp, Homo sapiens
tccactgtcaccctcca

SEQ ID NO: 3889474 - DNA, 21 bp, Homo sapiens
tccacttagaaattgcatttc

SEQ ID NO: 3889475 - DNA, 14 bp, Homo sapiens
tccacttcaatctg

SEQ ID NO: 3889476 - DNA, 20 bp, Homo sapiens
tccacttctctagagaacat

SEQ ID NO: 3889477 - DNA, 18 bp, Homo sapiens
tccagaaaatataaatgc

SEQ ID NO: 3889478 - DNA, 20 bp, Homo sapiens
tccagaagaatattcaggac

SEQ ID NO: 3889479 - DNA, 15 bp, Homo sapiens
tccagaagtccctcc

SEQ ID NO: 3889480 - DNA, 14 bp, Homo sapiens
tccagaagtggggc

SEQ ID NO: 3889481 - DNA, 19 bp, Homo sapiens
tccagaagtggggctctgg

SEQ ID NO: 3889482 - DNA, 23 bp, Homo sapiens
tccagaagtggggctctgggagg

SEQ ID NO: 3889483 - DNA, 18 bp, Homo sapiens
tccagaataagtgctgtt

SEQ ID NO: 3889484 - DNA, 16 bp, Homo sapiens
tccagaatctgctgtt

SEQ ID NO: 3889485 - DNA, 15 bp, Homo sapiens
tccagaccacctgcc

SEQ ID NO: 3889486 - DNA, 18 bp, Homo sapiens
tccagaccacctgccagc

SEQ ID NO: 3889487 - DNA, 17 bp, Homo sapiens
tccagaccattgtcttc

SEQ ID NO: 3889488 - DNA, 19 bp, Homo sapiens
tccagaccattgtcttcca

SEQ ID NO: 3889489 - DNA, 23 bp, Homo sapiens
tccagacccctggcttttcactg

SEQ ID NO: 3889490 - DNA, 15 bp, Homo sapiens
tccagaccctgcctg

SEQ ID NO: 3889491 - DNA, 20 bp, Homo sapiens
tccagaccctgcctgagccc

SEQ ID NO: 3889492 - DNA, 16 bp, Homo sapiens
tccagagagtggctcc

SEQ ID NO: 3889493 - DNA, 14 bp, Homo sapiens
tccagagccagcct

SEQ ID NO: 3889494 - DNA, 16 bp, Homo sapiens
tccagagccagcctgg

SEQ ID NO: 3889495 - DNA, 18 bp, Homo sapiens
tccagagccagcctggga

SEQ ID NO: 3889496 - DNA, 19 bp, Homo sapiens
tccagagccagcctgggac

SEQ ID NO: 3889497 - DNA, 20 bp, Homo sapiens
tccagagcctaagaaaatca

SEQ ID NO: 3889498 - DNA, 17 bp, Homo sapiens
tccagagtctgagcccc

SEQ ID NO: 3889499 - DNA, 20 bp, Homo sapiens
tccagagtgtgcagactgat

SEQ ID NO: 3889500 - DNA, 20 bp, Homo sapiens
tccagatgccttcctgtctt

SEQ ID NO: 3889501 - DNA, 12 bp, Homo sapiens
tccagcagctgc

SEQ ID NO: 3889502 - DNA, 14 bp, Homo sapiens
tccagcagctgcgg

SEQ ID NO: 3889503 - DNA, 23 bp, Homo sapiens
tccagcagctgcgggtctgaagg

SEQ ID NO: 3889504 - DNA, 15 bp, Homo sapiens
tccagcatccagcct

SEQ ID NO: 3889505 - DNA, 16 bp, Homo sapiens
tccagcatccagcctg

SEQ ID NO: 3889506 - DNA, 18 bp, Homo sapiens
tccagcatccagcctgtg

SEQ ID NO: 3889507 - DNA, 19 bp, Homo sapiens
tccagcatccagcctgtgt

SEQ ID NO: 3889508 - DNA, 21 bp, Homo sapiens
tccagcatttgccattcctgg

SEQ ID NO: 3889509 - DNA, 23 bp, Homo sapiens
tccagccagcaatgatgtccaga

SEQ ID NO: 3889510 - DNA, 19 bp, Homo sapiens
tccagcctctcccggctgc

SEQ ID NO: 3889511 - DNA, 23 bp, Homo sapiens
tccagcctctcccggctgcctgc

SEQ ID NO: 3889512 - DNA, 13 bp, Homo sapiens
tccagcctgtgtg

SEQ ID NO: 3889513 - DNA, 14 bp, Homo sapiens
tccagcctgtgtgt

SEQ ID NO: 3889514 - DNA, 15 bp, Homo sapiens
tccagctagtgaccc

SEQ ID NO: 3889515 - DNA, 14 bp, Homo sapiens
tccagctgcctggg

SEQ ID NO: 3889516 - DNA, 15 bp, Homo sapiens
tccagcttgctcttc

SEQ ID NO: 3889517 - DNA, 16 bp, Homo sapiens
tccagcttgctcttca

SEQ ID NO: 3889518 - DNA, 19 bp, Homo sapiens
tccagcttgctcttcagtg

SEQ ID NO: 3889519 - DNA, 18 bp, Homo sapiens
tcaaaaaggtgtgtcaaa

SEQ ID NO: 3889520 - DNA, 14 bp, Homo sapiens
tcaaaaataaacta

SEQ ID NO: 3889521 - DNA, 15 bp, Homo sapiens
tcaaaaataaactag

SEQ ID NO: 3889522 - DNA, 18 bp, Homo sapiens
tcaaaaataaactagttt

SEQ ID NO: 3889523 - DNA, 19 bp, Homo sapiens
tcaaaaataaactagtttc

SEQ ID NO: 3889524 - DNA, 13 bp, Homo sapiens
tcaaaagacatgt

SEQ ID NO: 3889525 - DNA, 12 bp, Homo sapiens
tcaaaagcactt

SEQ ID NO: 3889526 - DNA, 23 bp, Homo sapiens
tcaaaagcacttgttccttctgc

SEQ ID NO: 3889527 - DNA, 15 bp, Homo sapiens
tcaaaagctgcttga

SEQ ID NO: 3889528 - DNA, 14 bp, Homo sapiens
tcaaaataaattga

SEQ ID NO: 3889529 - DNA, 19 bp, Homo sapiens
tcaaaatttcaaaagtgat

SEQ ID NO: 3889530 - DNA, 16 bp, Homo sapiens
tcaaacagaattttaa

SEQ ID NO: 3889531 - DNA, 13 bp, Homo sapiens
tcaaacagtctca

SEQ ID NO: 3889532 - DNA, 21 bp, Homo sapiens
tcaaaccataaacttcatggt

SEQ ID NO: 3889533 - DNA, 14 bp, Homo sapiens
tcaaaccatttaat

SEQ ID NO: 3889534 - DNA, 22 bp, Homo sapiens
tcaaaccatttaattcataatt

SEQ ID NO: 3889535 - DNA, 13 bp, Homo sapiens
tcaaactcaaggt

SEQ ID NO: 3889536 - DNA, 22 bp, Homo sapiens
tcaaactgagtaaattggaaac

SEQ ID NO: 3889537 - DNA, 15 bp, Homo sapiens
tcaaacttgtgctga

SEQ ID NO: 3889538 - DNA, 17 bp, Homo sapiens
tcaaacttgtgctgaga

SEQ ID NO: 3889539 - DNA, 12 bp, Homo sapiens
tcaaagagactc

SEQ ID NO: 3889540 - DNA, 15 bp, Homo sapiens
tcaaagctttttcca

SEQ ID NO: 3889541 - DNA, 16 bp, Homo sapiens
tcaaagctttttccag

SEQ ID NO: 3889542 - DNA, 17 bp, Homo sapiens
tcaaagtgtaagcactt

SEQ ID NO: 3889543 - DNA, 14 bp, Homo sapiens
tcaaagttcctgtt

SEQ ID NO: 3889544 - DNA, 18 bp, Homo sapiens
tcaaatatagagatattt

SEQ ID NO: 3889545 - DNA, 15 bp, Homo sapiens
tcaaatatctcagag

SEQ ID NO: 3889546 - DNA, 14 bp, Homo sapiens
tcaaatatgcaaag

SEQ ID NO: 3889547 - DNA, 17 bp, Homo sapiens
tcaaatcctcaccatcc

SEQ ID NO: 3889548 - DNA, 16 bp, Homo sapiens
tcaaatctattcagac

SEQ ID NO: 3889549 - DNA, 18 bp, Homo sapiens
tcaaatctattcagacaa

SEQ ID NO: 3889550 - DNA, 12 bp, Homo sapiens
tcaaatctgtat

SEQ ID NO: 3889551 - DNA, 20 bp, Homo sapiens
tcaaatctgtatatgttgta

SEQ ID NO: 3889552 - DNA, 12 bp, Homo sapiens
tcaaatgaacac

SEQ ID NO: 3889553 - DNA, 15 bp, Homo sapiens
tcaaatgacccaaag

SEQ ID NO: 3889554 - DNA, 13 bp, Homo sapiens
tcaaatgctaaat

SEQ ID NO: 3889555 - DNA, 15 bp, Homo sapiens
tcaaatgctaaatgc

SEQ ID NO: 3889556 - DNA, 15 bp, Homo sapiens
tcaaatgtcagagct

SEQ ID NO: 3889557 - DNA, 20 bp, Homo sapiens
tcaaattcatttttttcact

SEQ ID NO: 3889558 - DNA, 16 bp, Homo sapiens
tcaaattctcaaccta

SEQ ID NO: 3889559 - DNA, 20 bp, Homo sapiens
tcaacaagaatattgtatgt

SEQ ID NO: 3889560 - DNA, 12 bp, Homo sapiens
tcaacaataaag

SEQ ID NO: 3889561 - DNA, 20 bp, Homo sapiens
tcaacatctttttcctccct

SEQ ID NO: 3889562 - DNA, 14 bp, Homo sapiens
tcaacattctttgc

SEQ ID NO: 3889563 - DNA, 17 bp, Homo sapiens
tcaaccagcattttact

SEQ ID NO: 3889564 - DNA, 16 bp, Homo sapiens
tcaaccgcttgccata

SEQ ID NO: 3889565 - DNA, 15 bp, Homo sapiens
tcaacctaccacccc

SEQ ID NO: 3889566 - DNA, 22 bp, Homo sapiens
tcaacctaccaccccttcctgt

SEQ ID NO: 3889567 - DNA, 11 bp, Homo sapiens
tcaacctgctc

SEQ ID NO: 3889568 - DNA, 17 bp, Homo sapiens
tcaacctggtggcacca

SEQ ID NO: 3889569 - DNA, 15 bp, Homo sapiens
tcaacgcagccctgc

SEQ ID NO: 3889570 - DNA, 18 bp, Homo sapiens
tcaactgaccagcctcca

SEQ ID NO: 3889571 - DNA, 18 bp, Homo sapiens
tcaactggagcaagaagg

SEQ ID NO: 3889572 - DNA, 15 bp, Homo sapiens
tcaactggctgggac

SEQ ID NO: 3889573 - DNA, 18 bp, Homo sapiens
tcaacttgaagcaagctt

SEQ ID NO: 3889574 - DNA, 19 bp, Homo sapiens
tcaacttggaaaaagaaag

SEQ ID NO: 3889575 - DNA, 22 bp, Homo sapiens
tcaactttcttttgattagtgt

SEQ ID NO: 3889576 - DNA, 19 bp, Homo sapiens
tcaagaagacatggagact

SEQ ID NO: 3889577 - DNA, 17 bp, Homo sapiens
tcaagaagtaagagcta

SEQ ID NO: 3889578 - DNA, 15 bp, Homo sapiens
tcaagaatcctctgg

SEQ ID NO: 3889579 - DNA, 16 bp, Homo sapiens
tcaagaatcctctggg

SEQ ID NO: 3889580 - DNA, 16 bp, Homo sapiens
tcaagaccttctcccc

SEQ ID NO: 3889581 - DNA, 13 bp, Homo sapiens
tcaagacttgata

SEQ ID NO: 3889582 - DNA, 17 bp, Homo sapiens
tcaagagaagaaaaaat

SEQ ID NO: 3889583 - DNA, 14 bp, Homo sapiens
tcaagaggcccagg

SEQ ID NO: 3889584 - DNA, 20 bp, Homo sapiens
tcaagagggcactggtggcc

SEQ ID NO: 3889585 - DNA, 21 bp, Homo sapiens
tcaagagggcactggtggccc

SEQ ID NO: 3889586 - DNA, 17 bp, Homo sapiens
tcaagatttcaggatta

SEQ ID NO: 3889587 - DNA, 18 bp, Homo sapiens
tcaagattttttttgtaa

SEQ ID NO: 3889588 - DNA, 19 bp, Homo sapiens
tcaagattttttttgtaac

SEQ ID NO: 3889589 - DNA, 14 bp, Homo sapiens
tcaagcagtcctcc

SEQ ID NO: 3889590 - DNA, 22 bp, Homo sapiens
tcaagcatgcaataatgtgcaa

SEQ ID NO: 3889591 - DNA, 14 bp, Homo sapiens
tcaagcctgcctag

SEQ ID NO: 3889592 - DNA, 23 bp, Homo sapiens
tcaagcgattcttgtgcctcagc

SEQ ID NO: 3889593 - DNA, 16 bp, Homo sapiens
tcaagctagaaggcca

SEQ ID NO: 3889594 - DNA, 20 bp, Homo sapiens
tcaagctagaaggccacatg

SEQ ID NO: 3889595 - DNA, 12 bp, Homo sapiens
tcaagctgtccc

SEQ ID NO: 3889596 - DNA, 16 bp, Homo sapiens
tcaaggaccacatgtg

SEQ ID NO: 3889597 - DNA, 23 bp, Homo sapiens
tcaagggtaccaatcctggcagg

SEQ ID NO: 3889598 - DNA, 17 bp, Homo sapiens
tcaaggtcaacggctta

SEQ ID NO: 3889599 - DNA, 21 bp, Homo sapiens
tcaagtagaaaatttcttata

SEQ ID NO: 3889600 - DNA, 17 bp, Homo sapiens
tcaagtgatatatgtat

SEQ ID NO: 3889601 - DNA, 22 bp, Homo sapiens
tcaagtgatatatgtatttatt

SEQ ID NO: 3889602 - DNA, 20 bp, Homo sapiens
tcaagtgcatgctctctgca

SEQ ID NO: 3889603 - DNA, 17 bp, Homo sapiens
tcaagtgcctcttgttg

SEQ ID NO: 3889604 - DNA, 22 bp, Homo sapiens
tcaataaaaaaaagaaatgaaa

SEQ ID NO: 3889605 - DNA, 17 bp, Homo sapiens
tatgtcatttattttgt

SEQ ID NO: 3889606 - DNA, 15 bp, Homo sapiens
tatgtctatttaagc

SEQ ID NO: 3889607 - DNA, 21 bp, Homo sapiens
tatgtctgcttctgtccagga

SEQ ID NO: 3889608 - DNA, 15 bp, Homo sapiens
tatgtctgtgtgtgt

SEQ ID NO: 3889609 - DNA, 16 bp, Homo sapiens
tatgtgaaagtgtaaa

SEQ ID NO: 3889610 - DNA, 17 bp, Homo sapiens
tatgtgaaagtgtaaaa

SEQ ID NO: 3889611 - DNA, 22 bp, Homo sapiens
tatgtgaatatggactcagttt

SEQ ID NO: 3889612 - DNA, 15 bp, Homo sapiens
tatgtgcacatgtgt

SEQ ID NO: 3889613 - DNA, 16 bp, Homo sapiens
tatgtgcacatgtgtc

SEQ ID NO: 3889614 - DNA, 21 bp, Homo sapiens
tatgtgcacatgtgtctgtgt

SEQ ID NO: 3889615 - DNA, 14 bp, Homo sapiens
tatgtgcagtattt

SEQ ID NO: 3889616 - DNA, 17 bp, Homo sapiens
tatgtgtatatatacat

SEQ ID NO: 3889617 - DNA, 21 bp, Homo sapiens
tatgtgtatatatacatacac

SEQ ID NO: 3889618 - DNA, 18 bp, Homo sapiens
tatgtgtcacagctctgt

SEQ ID NO: 3889619 - DNA, 18 bp, Homo sapiens
tatgtgtgcatgtgtgta

SEQ ID NO: 3889620 - DNA, 20 bp, Homo sapiens
tatgtgtgcatgtgtgtata

SEQ ID NO: 3889621 - DNA, 20 bp, Homo sapiens
tatgtgtgtttaaataaagt

SEQ ID NO: 3889622 - DNA, 21 bp, Homo sapiens
tatgtgtgtttaaataaagta

SEQ ID NO: 3889623 - DNA, 20 bp, Homo sapiens
tatgttaatttgttatgtat

SEQ ID NO: 3889624 - DNA, 19 bp, Homo sapiens
tatgttacatctgttttaa

SEQ ID NO: 3889625 - DNA, 22 bp, Homo sapiens
tatgttacatctgttttaaatt

SEQ ID NO: 3889626 - DNA, 12 bp, Homo sapiens
tatgttcaatgc

SEQ ID NO: 3889627 - DNA, 15 bp, Homo sapiens
tatgttctcagaatc

SEQ ID NO: 3889628 - DNA, 20 bp, Homo sapiens
tatgttgtaataaaacttat

SEQ ID NO: 3889629 - DNA, 13 bp, Homo sapiens
tattaaaaaacaa

SEQ ID NO: 3889630 - DNA, 22 bp, Homo sapiens
tattaaaaatatggaacttcta

SEQ ID NO: 3889631 - DNA, 14 bp, Homo sapiens
tattaaagatgtgt

SEQ ID NO: 3889632 - DNA, 12 bp, Homo sapiens
tattaaatacag

SEQ ID NO: 3889633 - DNA, 18 bp, Homo sapiens
tattaaatacagacacta

SEQ ID NO: 3889634 - DNA, 16 bp, Homo sapiens
tattaacaaattatgt

SEQ ID NO: 3889635 - DNA, 17 bp, Homo sapiens
tattaagatttccaagt

SEQ ID NO: 3889636 - DNA, 15 bp, Homo sapiens
tattaagggcatttt

SEQ ID NO: 3889637 - DNA, 14 bp, Homo sapiens
tattaataccaaat

SEQ ID NO: 3889638 - DNA, 15 bp, Homo sapiens
tattaatcttatgtg

SEQ ID NO: 3889639 - DNA, 14 bp, Homo sapiens
tattaattatctga

SEQ ID NO: 3889640 - DNA, 14 bp, Homo sapiens
tattacatctaatg

SEQ ID NO: 3889641 - DNA, 16 bp, Homo sapiens
tattacatctaatgct

SEQ ID NO: 3889642 - DNA, 17 bp, Homo sapiens
tattacatctaatgctt

SEQ ID NO: 3889643 - DNA, 16 bp, Homo sapiens
tattacatggcagtgt

SEQ ID NO: 3889644 - DNA, 21 bp, Homo sapiens
tattaccaaaaaagtattttt

SEQ ID NO: 3889645 - DNA, 23 bp, Homo sapiens
tattacttatttttgacagtgtt

SEQ ID NO: 3889646 - DNA, 14 bp, Homo sapiens
tattacttgaactt

SEQ ID NO: 3889647 - DNA, 17 bp, Homo sapiens
tattaggggtaatatat

SEQ ID NO: 3889648 - DNA, 18 bp, Homo sapiens
tattagttttctttgtaa

SEQ ID NO: 3889649 - DNA, 15 bp, Homo sapiens
tattataaataaatg

SEQ ID NO: 3889650 - DNA, 18 bp, Homo sapiens
tattataaataaatgcca

SEQ ID NO: 3889651 - DNA, 16 bp, Homo sapiens
tattataacttaaaaa

SEQ ID NO: 3889652 - DNA, 15 bp, Homo sapiens
tattatggtgtaatg

SEQ ID NO: 3889653 - DNA, 18 bp, Homo sapiens
tattatggtgtaatgcac

SEQ ID NO: 3889654 - DNA, 23 bp, Homo sapiens
tattatggtgtaatgcacaattt

SEQ ID NO: 3889655 - DNA, 19 bp, Homo sapiens
tattatgtaacatccagaa

SEQ ID NO: 3889656 - DNA, 19 bp, Homo sapiens
tattattacttatttttga

SEQ ID NO: 3889657 - DNA, 19 bp, Homo sapiens
tattcaagtgcctcttgtt

SEQ ID NO: 3889658 - DNA, 16 bp, Homo sapiens
tattcaagttattgta

SEQ ID NO: 3889659 - DNA, 11 bp, Homo sapiens
tattcaataaa

SEQ ID NO: 3889660 - DNA, 20 bp, Homo sapiens
tattcaataaaaaaaagaaa

SEQ ID NO: 3889661 - DNA, 22 bp, Homo sapiens
tattcaataaaaaaaagaaatg

SEQ ID NO: 3889662 - DNA, 14 bp, Homo sapiens
tattcactgtaagt

SEQ ID NO: 3889663 - DNA, 22 bp, Homo sapiens
tattcagacaagcaacaggttt

SEQ ID NO: 3889664 - DNA, 20 bp, Homo sapiens
tattcagatcgtattaatta

SEQ ID NO: 3889665 - DNA, 21 bp, Homo sapiens
tattcagatcgtattaattat

SEQ ID NO: 3889666 - DNA, 14 bp, Homo sapiens
tattcatgccatct

SEQ ID NO: 3889667 - DNA, 18 bp, Homo sapiens
tattcatgccatctgttt

SEQ ID NO: 3889668 - DNA, 16 bp, Homo sapiens
tattcatgctttctcc

SEQ ID NO: 3889669 - DNA, 20 bp, Homo sapiens
tattcatgctttctcctttt

SEQ ID NO: 3889670 - DNA, 15 bp, Homo sapiens
tattcatgtaataaa

SEQ ID NO: 3889671 - DNA, 12 bp, Homo sapiens
tattcatttaaa

SEQ ID NO: 3889672 - DNA, 13 bp, Homo sapiens
tattcatttaaaa

SEQ ID NO: 3889673 - DNA, 17 bp, Homo sapiens
tattcatttaaaatgat

SEQ ID NO: 3889674 - DNA, 16 bp, Homo sapiens
tattcatttttgttat

SEQ ID NO: 3889675 - DNA, 19 bp, Homo sapiens
tattccaccattcacattt

SEQ ID NO: 3889676 - DNA, 19 bp, Homo sapiens
tattccatgggatgttaag

SEQ ID NO: 3889677 - DNA, 17 bp, Homo sapiens
tattcctgcatttgtga

SEQ ID NO: 3889678 - DNA, 20 bp, Homo sapiens
tattccttttgtgtacagtg

SEQ ID NO: 3889679 - DNA, 16 bp, Homo sapiens
tattctatgagaacaa

SEQ ID NO: 3889680 - DNA, 15 bp, Homo sapiens
tattctcaccaggaa

SEQ ID NO: 3889681 - DNA, 15 bp, Homo sapiens
tattctcactccacc

SEQ ID NO: 3889682 - DNA, 22 bp, Homo sapiens
tattctcactccaccacccaaa

SEQ ID NO: 3889683 - DNA, 17 bp, Homo sapiens
tattctctcctcagact

SEQ ID NO: 3889684 - DNA, 12 bp, Homo sapiens
tattctggaaaa

SEQ ID NO: 3889685 - DNA, 20 bp, Homo sapiens
tattctggaaaaaaaatata

SEQ ID NO: 3889686 - DNA, 18 bp, Homo sapiens
tattgaacttggaaagaa

SEQ ID NO: 3889687 - DNA, 16 bp, Homo sapiens
tattgaagaaaagcac

SEQ ID NO: 3889688 - DNA, 13 bp, Homo sapiens
tattgaatatatc

SEQ ID NO: 3889689 - DNA, 14 bp, Homo sapiens
tattgaatcttaat

SEQ ID NO: 3889690 - DNA, 13 bp, Homo sapiens
tattgacaataat

SEQ ID NO: 3889691 - DNA, 17 bp, Homo sapiens
tattgacaataatttca

SEQ ID NO: 3889692 - DNA, 17 bp, Homo sapiens
tattgatgtttccagaa

SEQ ID NO: 3889693 - DNA, 18 bp, Homo sapiens
tattgatgtttccagaaa

SEQ ID NO: 3889694 - DNA, 19 bp, Homo sapiens
tattgatgtttccagaaaa

SEQ ID NO: 3889695 - DNA, 22 bp, Homo sapiens
tattgccacaatgcctctccca

SEQ ID NO: 3889696 - DNA, 17 bp, Homo sapiens
tattgcctttgcctctt

SEQ ID NO: 3889697 - DNA, 19 bp, Homo sapiens
tattgcgaatgtgcagaaa

SEQ ID NO: 3889698 - DNA, 13 bp, Homo sapiens
tattgcttaatcc

SEQ ID NO: 3889699 - DNA, 22 bp, Homo sapiens
tattggtccagcttgctcttca

SEQ ID NO: 3889700 - DNA, 19 bp, Homo sapiens
tattgtatattctggaaaa

SEQ ID NO: 3889701 - DNA, 20 bp, Homo sapiens
tattgtatattctggaaaaa

SEQ ID NO: 3889702 - DNA, 14 bp, Homo sapiens
tattgtatgtaagt

SEQ ID NO: 3889703 - DNA, 20 bp, Homo sapiens
tattgtcattactgcctttg

SEQ ID NO: 3889704 - DNA, 14 bp, Homo sapiens
tattgtgttgcctt

SEQ ID NO: 3889705 - DNA, 21 bp, Homo sapiens
tattgtgttgccttagcactt

SEQ ID NO: 3889706 - DNA, 24 bp, Homo sapiens
tattgtttattctttttaaagtat

SEQ ID NO: 3889707 - DNA, 15 bp, Homo sapiens
tatttaaaaaataaa

SEQ ID NO: 3889708 - DNA, 18 bp, Homo sapiens
tatttaaaaaataaaaaa

SEQ ID NO: 3889709 - DNA, 18 bp, Homo sapiens
tatttaaatgttgaaatc

SEQ ID NO: 3889710 - DNA, 20 bp, Homo sapiens
tatttaaatgttgaaatctt

SEQ ID NO: 3889711 - DNA, 21 bp, Homo sapiens
tatttaactgccttgtgtaca

SEQ ID NO: 3889712 - DNA, 21 bp, Homo sapiens
tatttaagcctcatatttaaa

SEQ ID NO: 3889713 - DNA, 22 bp, Homo sapiens
tatttaagtttgttgctgtcaa

SEQ ID NO: 3889714 - DNA, 16 bp, Homo sapiens
tatttactaaaagaat

SEQ ID NO: 3889715 - DNA, 19 bp, Homo sapiens
tatttacttgtagaaatct

SEQ ID NO: 3889716 - DNA, 22 bp, Homo sapiens
tatttagattgttaaaataact

SEQ ID NO: 3889717 - DNA, 17 bp, Homo sapiens
tatttagttatagtttc

SEQ ID NO: 3889718 - DNA, 14 bp, Homo sapiens
tatttataagcaga

SEQ ID NO: 3889719 - DNA, 15 bp, Homo sapiens
tatttatactctaga

SEQ ID NO: 3889720 - DNA, 16 bp, Homo sapiens
tatttatatatttgaa

SEQ ID NO: 3889721 - DNA, 16 bp, Homo sapiens
tatttatatttggaaa

SEQ ID NO: 3889722 - DNA, 21 bp, Homo sapiens
tatttatatttggaaagagac

SEQ ID NO: 3889723 - DNA, 22 bp, Homo sapiens
tatttatctccgcaggctattt

SEQ ID NO: 3889724 - DNA, 12 bp, Homo sapiens
tatttatcttta

SEQ ID NO: 3889725 - DNA, 20 bp, Homo sapiens
tatttatgcttaaaatatgt

SEQ ID NO: 3889726 - DNA, 21 bp, Homo sapiens
tatttatgcttaaaatatgta

SEQ ID NO: 3889727 - DNA, 17 bp, Homo sapiens
tatttatggcttataaa

SEQ ID NO: 3889728 - DNA, 16 bp, Homo sapiens
tatttattagctgtaa

SEQ ID NO: 3889729 - DNA, 15 bp, Homo sapiens
tatttattcactgta

SEQ ID NO: 3889730 - DNA, 19 bp, Homo sapiens
tatttattcactgtaagtt

SEQ ID NO: 3889731 - DNA, 13 bp, Homo sapiens
tatttattcattc

SEQ ID NO: 3889732 - DNA, 15 bp, Homo sapiens
tatttattcattcag

SEQ ID NO: 3889733 - DNA, 14 bp, Homo sapiens
tatttattggggtg

SEQ ID NO: 3889734 - DNA, 20 bp, Homo sapiens
tatttcaaatgaacacgtgc

SEQ ID NO: 3889735 - DNA, 13 bp, Homo sapiens
tatttcatttctt

SEQ ID NO: 3889736 - DNA, 21 bp, Homo sapiens
tatttccccaggggaaaatga

SEQ ID NO: 3889737 - DNA, 22 bp, Homo sapiens
tatttccccaggggaaaatgaa

SEQ ID NO: 3889738 - DNA, 19 bp, Homo sapiens
tatttcccccttactactt

SEQ ID NO: 3889739 - DNA, 18 bp, Homo sapiens
tatttcctcccccagtta

SEQ ID NO: 3889740 - DNA, 13 bp, Homo sapiens
tatttctagcaga

SEQ ID NO: 3889741 - DNA, 14 bp, Homo sapiens
tatttctagcagag

SEQ ID NO: 3889742 - DNA, 17 bp, Homo sapiens
tatttctagcagagtga

SEQ ID NO: 3889743 - DNA, 20 bp, Homo sapiens
tatttctgtcattcaaatgg

SEQ ID NO: 3889744 - DNA, 22 bp, Homo sapiens
tatttctttgtgataacaaaga

SEQ ID NO: 3889745 - DNA, 19 bp, Homo sapiens
tatttgaaactgaatgttt

SEQ ID NO: 3889746 - DNA, 22 bp, Homo sapiens
tatttgaaattttatttagttc

SEQ ID NO: 3889747 - DNA, 16 bp, Homo sapiens
tatttgaatatcatta

SEQ ID NO: 3889748 - DNA, 23 bp, Homo sapiens
tatttgagcatgcacagctgctt

SEQ ID NO: 3889749 - DNA, 16 bp, Homo sapiens
tatttgtatgtactgt

SEQ ID NO: 3889750 - DNA, 14 bp, Homo sapiens
tatttgtgtaatag

SEQ ID NO: 3889751 - DNA, 13 bp, Homo sapiens
tatttgtgtatgt

SEQ ID NO: 3889752 - DNA, 19 bp, Homo sapiens
tattttaaaaaatgaaaat

SEQ ID NO: 3889753 - DNA, 17 bp, Homo sapiens
tattttaaaaccatgca

SEQ ID NO: 3889754 - DNA, 12 bp, Homo sapiens
tattttaaacaa

SEQ ID NO: 3889755 - DNA, 13 bp, Homo sapiens
tattttaaatgtt

SEQ ID NO: 3889756 - DNA, 16 bp, Homo sapiens
tattttaatattttgt

SEQ ID NO: 3889757 - DNA, 15 bp, Homo sapiens
tattttagatgcaat

SEQ ID NO: 3889758 - DNA, 18 bp, Homo sapiens
tattttaggcagggattt

SEQ ID NO: 3889759 - DNA, 21 bp, Homo sapiens
tattttaggcagggatttgag

SEQ ID NO: 3889760 - DNA, 22 bp, Homo sapiens
tattttaggcagggatttgagg

SEQ ID NO: 3889761 - DNA, 15 bp, Homo sapiens
tattttatatgagag

SEQ ID NO: 3889762 - DNA, 15 bp, Homo sapiens
tattttatgtatata

SEQ ID NO: 3889763 - DNA, 22 bp, Homo sapiens
tattttattaaagcaacatttt

SEQ ID NO: 3889764 - DNA, 19 bp, Homo sapiens
tattttattccctttcaca

SEQ ID NO: 3889765 - DNA, 21 bp, Homo sapiens
tattttcaacgcagccctgct

SEQ ID NO: 3889766 - DNA, 16 bp, Homo sapiens
tattttcaagaaactg

SEQ ID NO: 3889767 - DNA, 13 bp, Homo sapiens
tattttcattaca

SEQ ID NO: 3889768 - DNA, 21 bp, Homo sapiens
tattttcattacaatggaaac

SEQ ID NO: 3889769 - DNA, 16 bp, Homo sapiens
tatttttcaaccagca

SEQ ID NO: 3889770 - DNA, 17 bp, Homo sapiens
tatttttcaaccagcat

SEQ ID NO: 3889771 - DNA, 19 bp, Homo sapiens
tatttttcaaccagcattt

SEQ ID NO: 3889772 - DNA, 15 bp, Homo sapiens
tatttttccacattt

SEQ ID NO: 3889773 - DNA, 12 bp, Homo sapiens
tattttttaaag

SEQ ID NO: 3889774 - DNA, 21 bp, Homo sapiens
tattttttcaatttaaaggtt

SEQ ID NO: 3889775 - DNA, 15 bp, Homo sapiens
tattttttctacaca

SEQ ID NO: 3889776 - DNA, 14 bp, Homo sapiens
tcaaaaaaacacta

SEQ ID NO: 3889777 - DNA, 12 bp, Homo sapiens
tcagaagataac

SEQ ID NO: 3889778 - DNA, 14 bp, Homo sapiens
tcagaagcctgggg

SEQ ID NO: 3889779 - DNA, 16 bp, Homo sapiens
tcagaagcctgggggc

SEQ ID NO: 3889780 - DNA, 16 bp, Homo sapiens
tcagaaggagaaggaa

SEQ ID NO: 3889781 - DNA, 18 bp, Homo sapiens
tcagaaggagaaggaagg

SEQ ID NO: 3889782 - DNA, 19 bp, Homo sapiens
tcagaatatggacaaagaa

SEQ ID NO: 3889783 - DNA, 22 bp, Homo sapiens
tcagaatcaggttgacagtccc

SEQ ID NO: 3889784 - DNA, 15 bp, Homo sapiens
tcagaatggaaagaa

SEQ ID NO: 3889785 - DNA, 18 bp, Homo sapiens
tcagacaataccactggt

SEQ ID NO: 3889786 - DNA, 20 bp, Homo sapiens
tcagacaataccactggtta

SEQ ID NO: 3889787 - DNA, 16 bp, Homo sapiens
tcagacaatccactct

SEQ ID NO: 3889788 - DNA, 18 bp, Homo sapiens
tcagacaatccactctca

SEQ ID NO: 3889789 - DNA, 17 bp, Homo sapiens
tcagacaattcagaagc

SEQ ID NO: 3889790 - DNA, 18 bp, Homo sapiens
tcagacagaacccctaca

SEQ ID NO: 3889791 - DNA, 20 bp, Homo sapiens
tcagaccaactctctcctgt

SEQ ID NO: 3889792 - DNA, 14 bp, Homo sapiens
tcagaccctacccc

SEQ ID NO: 3889793 - DNA, 12 bp, Homo sapiens
tcagacctctga

SEQ ID NO: 3889794 - DNA, 16 bp, Homo sapiens
tcagacctctgatccc

SEQ ID NO: 3889795 - DNA, 19 bp, Homo sapiens
tcagacttttatcaaaatc

SEQ ID NO: 3889796 - DNA, 12 bp, Homo sapiens
tcagagaatttc

SEQ ID NO: 3889797 - DNA, 21 bp, Homo sapiens
tcagagacagaccccttggct

SEQ ID NO: 3889798 - DNA, 21 bp, Homo sapiens
tcagagaggccttttggaatg

SEQ ID NO: 3889799 - DNA, 22 bp, Homo sapiens
tcagagaggccttttgtttaaa

SEQ ID NO: 3889800 - DNA, 14 bp, Homo sapiens
tcagagcaggctca

SEQ ID NO: 3889801 - DNA, 14 bp, Homo sapiens
tcagagccaggctc

SEQ ID NO: 3889802 - DNA, 21 bp, Homo sapiens
tcagagccaggctctgcctgg

SEQ ID NO: 3889803 - DNA, 18 bp, Homo sapiens
tcagagccagtgaaggag

SEQ ID NO: 3889804 - DNA, 21 bp, Homo sapiens
tcagagccagtgaaggagcca

SEQ ID NO: 3889805 - DNA, 18 bp, Homo sapiens
tcagagcctagccacctc

SEQ ID NO: 3889806 - DNA, 21 bp, Homo sapiens
tcagagcctagccacctccca

SEQ ID NO: 3889807 - DNA, 23 bp, Homo sapiens
tcagagcctagccacctcccacc

SEQ ID NO: 3889808 - DNA, 13 bp, Homo sapiens
tcagagctcttaa

SEQ ID NO: 3889809 - DNA, 16 bp, Homo sapiens
tcagagctcttaatgt

SEQ ID NO: 3889810 - DNA, 23 bp, Homo sapiens
tcagagctcttcaagctgtcccc

SEQ ID NO: 3889811 - DNA, 23 bp, Homo sapiens
tcagagctgttggcctcgcctgg

SEQ ID NO: 3889812 - DNA, 15 bp, Homo sapiens
tcagagtcttgtccc

SEQ ID NO: 3889813 - DNA, 19 bp, Homo sapiens
tcagagtgacatccaggag

SEQ ID NO: 3889814 - DNA, 17 bp, Homo sapiens
tcagagttgctttaaag

SEQ ID NO: 3889815 - DNA, 18 bp, Homo sapiens
tcagatatatttttcaca

SEQ ID NO: 3889816 - DNA, 23 bp, Homo sapiens
tcagatattttttcagaaatatg

SEQ ID NO: 3889817 - DNA, 22 bp, Homo sapiens
tcagatcgtattaattatctga

SEQ ID NO: 3889818 - DNA, 17 bp, Homo sapiens
tcagatgatctctccac

SEQ ID NO: 3889819 - DNA, 18 bp, Homo sapiens
tcagatgggaagacatga

SEQ ID NO: 3889820 - DNA, 22 bp, Homo sapiens
tcagattgacaaggtagacatg

SEQ ID NO: 3889821 - DNA, 18 bp, Homo sapiens
tcagcacaccccaaggga

SEQ ID NO: 3889822 - DNA, 21 bp, Homo sapiens
tcagcacaccccaagggacaa

SEQ ID NO: 3889823 - DNA, 23 bp, Homo sapiens
tcagcaccctgggtgccattccc

SEQ ID NO: 3889824 - DNA, 11 bp, Homo sapiens
tcagcactgaa

SEQ ID NO: 3889825 - DNA, 14 bp, Homo sapiens
tcagcagccccctg

SEQ ID NO: 3889826 - DNA, 15 bp, Homo sapiens
tcagcagccctcctc

SEQ ID NO: 3889827 - DNA, 18 bp, Homo sapiens
tcagcagccctcctcacc

SEQ ID NO: 3889828 - DNA, 15 bp, Homo sapiens
tcagcaggaacctgt

SEQ ID NO: 3889829 - DNA, 17 bp, Homo sapiens
tcagcatacctttattg

SEQ ID NO: 3889830 - DNA, 17 bp, Homo sapiens
tcagcattctcactcct

SEQ ID NO: 3889831 - DNA, 20 bp, Homo sapiens
tcagccaccctgaggcctct

SEQ ID NO: 3889832 - DNA, 15 bp, Homo sapiens
tcagccagccgccct

SEQ ID NO: 3889833 - DNA, 18 bp, Homo sapiens
tcagccagccgccctggg

SEQ ID NO: 3889834 - DNA, 13 bp, Homo sapiens
tcagccagggcca

SEQ ID NO: 3889835 - DNA, 16 bp, Homo sapiens
tcagccagggccaggg

SEQ ID NO: 3889836 - DNA, 20 bp, Homo sapiens
tcagccataaagtgccagtt

SEQ ID NO: 3889837 - DNA, 18 bp, Homo sapiens
tcagccatcaacaagagt

SEQ ID NO: 3889838 - DNA, 15 bp, Homo sapiens
tcagcccctcctctg

SEQ ID NO: 3889839 - DNA, 21 bp, Homo sapiens
tcagcccctcctctgccacct

SEQ ID NO: 3889840 - DNA, 22 bp, Homo sapiens
tcagcccctcctctgccacctc

SEQ ID NO: 3889841 - DNA, 17 bp, Homo sapiens
tcagcccgaatgcctgt

SEQ ID NO: 3889842 - DNA, 13 bp, Homo sapiens
tcagccctccctg

SEQ ID NO: 3889843 - DNA, 19 bp, Homo sapiens
tcagccctccctgcccctc

SEQ ID NO: 3889844 - DNA, 18 bp, Homo sapiens
tcagccctgggccccacc

SEQ ID NO: 3889845 - DNA, 19 bp, Homo sapiens
tcagccgagccgggcctgg

SEQ ID NO: 3889846 - DNA, 10 bp, Homo sapiens
tcagccgtgc

SEQ ID NO: 3889847 - DNA, 16 bp, Homo sapiens
tcagccgtgcactccc

SEQ ID NO: 3889848 - DNA, 13 bp, Homo sapiens
tcagcctcccaga

SEQ ID NO: 3889849 - DNA, 14 bp, Homo sapiens
tcagcctcccagag

SEQ ID NO: 3889850 - DNA, 21 bp, Homo sapiens
tcagcctcccagagtgctagg

SEQ ID NO: 3889851 - DNA, 22 bp, Homo sapiens
tcagcctcccagagtgctagga

SEQ ID NO: 3889852 - DNA, 21 bp, Homo sapiens
tcagcctccccctgctgctca

SEQ ID NO: 3889853 - DNA, 13 bp, Homo sapiens
tcagcctcctcag

SEQ ID NO: 3889854 - DNA, 12 bp, Homo sapiens
tcagcctcttaa

SEQ ID NO: 3889855 - DNA, 22 bp, Homo sapiens
tcagcctcttaaagctgcctgt

SEQ ID NO: 3889856 - DNA, 19 bp, Homo sapiens
tcagcctgagtctcctgtg

SEQ ID NO: 3889857 - DNA, 22 bp, Homo sapiens
tcagcgccctggagtcccctgg

SEQ ID NO: 3889858 - DNA, 13 bp, Homo sapiens
tcagcgtggcctt

SEQ ID NO: 3889859 - DNA, 17 bp, Homo sapiens
tcagcgtggccttgttc

SEQ ID NO: 3889860 - DNA, 19 bp, Homo sapiens
tcagctactgatttttgtg

SEQ ID NO: 3889861 - DNA, 12 bp, Homo sapiens
tcagctcagcct

SEQ ID NO: 3889862 - DNA, 16 bp, Homo sapiens
tcagctcagcctcccc

SEQ ID NO: 3889863 - DNA, 22 bp, Homo sapiens
tcagctccagaataccttcttc

SEQ ID NO: 3889864 - DNA, 20 bp, Homo sapiens
tcagctcccatagcgctggc

SEQ ID NO: 3889865 - DNA, 22 bp, Homo sapiens
tcagctcccatagcgctggctc

SEQ ID NO: 3889866 - DNA, 18 bp, Homo sapiens
tcagctcccctcggagaa

SEQ ID NO: 3889867 - DNA, 22 bp, Homo sapiens
tcagctcccctcggagaagagc

SEQ ID NO: 3889868 - DNA, 21 bp, Homo sapiens
tcagctcccttcccctgcctg

SEQ ID NO: 3889869 - DNA, 22 bp, Homo sapiens
tcagctcccttcccctgcctgg

SEQ ID NO: 3889870 - DNA, 18 bp, Homo sapiens
tcagctctcctgctgcag

SEQ ID NO: 3889871 - DNA, 17 bp, Homo sapiens
tcagctgacacataatt

SEQ ID NO: 3889872 - DNA, 18 bp, Homo sapiens
tcagctgacagctgctca

SEQ ID NO: 3889873 - DNA, 16 bp, Homo sapiens
tcagctgcacattcct

SEQ ID NO: 3889874 - DNA, 16 bp, Homo sapiens
tcagctgctgaaacaa

SEQ ID NO: 3889875 - DNA, 12 bp, Homo sapiens
tcagctgtgaac

SEQ ID NO: 3889876 - DNA, 18 bp, Homo sapiens
tcagcttttaataaaatt

SEQ ID NO: 3889877 - DNA, 22 bp, Homo sapiens
tcaggaaaactgacagaggagg

SEQ ID NO: 3889878 - DNA, 14 bp, Homo sapiens
tcaggaagaaaccc

SEQ ID NO: 3889879 - DNA, 20 bp, Homo sapiens
tcaggaagaaaccccaagca

SEQ ID NO: 3889880 - DNA, 16 bp, Homo sapiens
tcaggaagagaaggag

SEQ ID NO: 3889881 - DNA, 20 bp, Homo sapiens
tcaggaagagaaggagcaga

SEQ ID NO: 3889882 - DNA, 16 bp, Homo sapiens
tcaggacacaggcctg

SEQ ID NO: 3889883 - DNA, 17 bp, Homo sapiens
tcaggacacaggcctgt

SEQ ID NO: 3889884 - DNA, 19 bp, Homo sapiens
tcaggacacaggcctgtgt

SEQ ID NO: 3889885 - DNA, 22 bp, Homo sapiens
tcaggacatggggcatagaaac

SEQ ID NO: 3889886 - DNA, 13 bp, Homo sapiens
tcaggacccaggc

SEQ ID NO: 3889887 - DNA, 14 bp, Homo sapiens
tcaggacccaggcc

SEQ ID NO: 3889888 - DNA, 19 bp, Homo sapiens
tcaggacccaggccctcca

SEQ ID NO: 3889889 - DNA, 22 bp, Homo sapiens
tcaggacctccggggagagcag

SEQ ID NO: 3889890 - DNA, 23 bp, Homo sapiens
tcaggacctccggggagagcaga

SEQ ID NO: 3889891 - DNA, 13 bp, Homo sapiens
tcaggactggctc

SEQ ID NO: 3889892 - DNA, 14 bp, Homo sapiens
tcaggactggctca

SEQ ID NO: 3889893 - DNA, 15 bp, Homo sapiens
tcaggactggctcac

SEQ ID NO: 3889894 - DNA, 21 bp, Homo sapiens
tcaggaggccctggtgtcagg

SEQ ID NO: 3889895 - DNA, 13 bp, Homo sapiens
tcaggaggctgag

SEQ ID NO: 3889896 - DNA, 15 bp, Homo sapiens
tcaggcaagcccctc

SEQ ID NO: 3889897 - DNA, 21 bp, Homo sapiens
tcaggcaagcccctcagccct

SEQ ID NO: 3889898 - DNA, 16 bp, Homo sapiens
tcaggcacaggcagga

SEQ ID NO: 3889899 - DNA, 19 bp, Homo sapiens
tcaggcacaggcaggaaga

SEQ ID NO: 3889900 - DNA, 14 bp, Homo sapiens
tcaggcactggtgg

SEQ ID NO: 3889901 - DNA, 16 bp, Homo sapiens
tcaggcactggtggca

SEQ ID NO: 3889902 - DNA, 17 bp, Homo sapiens
tcaggcactggtggcat

SEQ ID NO: 3889903 - DNA, 15 bp, Homo sapiens
tcaggcagacaagag

SEQ ID NO: 3889904 - DNA, 21 bp, Homo sapiens
tcaggcagacaagagctgctg

SEQ ID NO: 3889905 - DNA, 23 bp, Homo sapiens
tcaggcagacaagagctgctgtc

SEQ ID NO: 3889906 - DNA, 19 bp, Homo sapiens
tcaggcagaggatgttctg

SEQ ID NO: 3889907 - DNA, 12 bp, Homo sapiens
tcaggcagcctt

SEQ ID NO: 3889908 - DNA, 15 bp, Homo sapiens
tcaggcagccttcat

SEQ ID NO: 3889909 - DNA, 21 bp, Homo sapiens
tcaggcccggctaactctggc

SEQ ID NO: 3889910 - DNA, 23 bp, Homo sapiens
tcaggcccggctaactctggcac

SEQ ID NO: 3889911 - DNA, 19 bp, Homo sapiens
tcaggcccttattttcaag

SEQ ID NO: 3889912 - DNA, 16 bp, Homo sapiens
tcaggctccattagga

SEQ ID NO: 3889913 - DNA, 22 bp, Homo sapiens
tcaggctgctgctctgccttca

SEQ ID NO: 3889914 - DNA, 16 bp, Homo sapiens
tcagggaaatggaggg

SEQ ID NO: 3889915 - DNA, 19 bp, Homo sapiens
tcagggaagcaggcagagc

SEQ ID NO: 3889916 - DNA, 19 bp, Homo sapiens
tcagggccagaaggagggc

SEQ ID NO: 3889917 - DNA, 17 bp, Homo sapiens
tcagggtgaatcagatg

SEQ ID NO: 3889918 - DNA, 18 bp, Homo sapiens
tcagggtgggccactctc

SEQ ID NO: 3889919 - DNA, 23 bp, Homo sapiens
tcagggtgggccactctcccctc

SEQ ID NO: 3889920 - DNA, 12 bp, Homo sapiens
tcaggtccctgc

SEQ ID NO: 3889921 - DNA, 14 bp, Homo sapiens
tcaggtgaaaatgt

SEQ ID NO: 3889922 - DNA, 11 bp, Homo sapiens
tcaggtgccac

SEQ ID NO: 3889923 - DNA, 16 bp, Homo sapiens
tcaggtgccactccct

SEQ ID NO: 3889924 - DNA, 19 bp, Homo sapiens
tcaggtgccactccctgag

SEQ ID NO: 3889925 - DNA, 21 bp, Homo sapiens
tcaggtgccactccctgagct

SEQ ID NO: 3889926 - DNA, 14 bp, Homo sapiens
tcaggttgttctgt

SEQ ID NO: 3889927 - DNA, 13 bp, Homo sapiens
tcaggttttgtaa

SEQ ID NO: 3889928 - DNA, 16 bp, Homo sapiens
tcagtaaataatgaaa

SEQ ID NO: 3889929 - DNA, 14 bp, Homo sapiens
tcagtaatttgagg

SEQ ID NO: 3889930 - DNA, 17 bp, Homo sapiens
tcagtaatttgaggaca

SEQ ID NO: 3889931 - DNA, 17 bp, Homo sapiens
tcagtaggtccaagggc

SEQ ID NO: 3889932 - DNA, 20 bp, Homo sapiens
tcagtaggtccaagggccat

SEQ ID NO: 3889933 - DNA, 12 bp, Homo sapiens
tcagtatagcat

SEQ ID NO: 3889934 - DNA, 16 bp, Homo sapiens
tcagtattaatactaa

SEQ ID NO: 3889935 - DNA, 19 bp, Homo sapiens
tcagtattttggagaaatt

SEQ ID NO: 3889936 - DNA, 13 bp, Homo sapiens
tcagtcagttccc

SEQ ID NO: 3889937 - DNA, 15 bp, Homo sapiens
tcagtcagttcccgg

SEQ ID NO: 3889938 - DNA, 14 bp, Homo sapiens
tcagtcatattctt

SEQ ID NO: 3889939 - DNA, 20 bp, Homo sapiens
tcagtcttctctcactttga

SEQ ID NO: 3889940 - DNA, 19 bp, Homo sapiens
tcagtgcacacggatgcac

SEQ ID NO: 3889941 - DNA, 21 bp, Homo sapiens
tcagtgcagtgatacatgtac

SEQ ID NO: 3889942 - DNA, 14 bp, Homo sapiens
tcagtgccacttga

SEQ ID NO: 3889943 - DNA, 17 bp, Homo sapiens
tcagtgccacttgacat

SEQ ID NO: 3889944 - DNA, 21 bp, Homo sapiens
tcagtgccacttgacattcct

SEQ ID NO: 3889945 - DNA, 22 bp, Homo sapiens
tcagtgccacttgacattcctt

SEQ ID NO: 3889946 - DNA, 16 bp, Homo sapiens
tcagtgcctcctggcc

SEQ ID NO: 3889947 - DNA, 15 bp, Homo sapiens
tcagtgggaacgtga

SEQ ID NO: 3889948 - DNA, 13 bp, Homo sapiens
tcagtgggagaaa

SEQ ID NO: 3889949 - DNA, 18 bp, Homo sapiens
tcaccatgtaacaaccag

SEQ ID NO: 3889950 - DNA, 19 bp, Homo sapiens
tcacccaagcaaggccaaa

SEQ ID NO: 3889951 - DNA, 11 bp, Homo sapiens
tcacccacagg

SEQ ID NO: 3889952 - DNA, 12 bp, Homo sapiens
tcacccacaggg

SEQ ID NO: 3889953 - DNA, 23 bp, Homo sapiens
tcacccaggctctggagccagag

SEQ ID NO: 3889954 - DNA, 13 bp, Homo sapiens
tcacccagtcctg

SEQ ID NO: 3889955 - DNA, 14 bp, Homo sapiens
tcacccagtcctgg

SEQ ID NO: 3889956 - DNA, 15 bp, Homo sapiens
tcaccctacctgtgc

SEQ ID NO: 3889957 - DNA, 13 bp, Homo sapiens
tcaccctccacct

SEQ ID NO: 3889958 - DNA, 12 bp, Homo sapiens
tcaccctgcaga

SEQ ID NO: 3889959 - DNA, 17 bp, Homo sapiens
tcaccgacgcgtctcct

SEQ ID NO: 3889960 - DNA, 19 bp, Homo sapiens
tcaccgacttattctgatt

SEQ ID NO: 3889961 - DNA, 23 bp, Homo sapiens
tcaccgagacggctggacctgca

SEQ ID NO: 3889962 - DNA, 14 bp, Homo sapiens
tcaccggagctttc

SEQ ID NO: 3889963 - DNA, 19 bp, Homo sapiens
tcacctactcacacaggca

SEQ ID NO: 3889964 - DNA, 16 bp, Homo sapiens
tcacctcctccactca

SEQ ID NO: 3889965 - DNA, 20 bp, Homo sapiens
tcacctcctccactcactcc

SEQ ID NO: 3889966 - DNA, 23 bp, Homo sapiens
tcacctctctctaagtttagaag

SEQ ID NO: 3889967 - DNA, 15 bp, Homo sapiens
tcacctctgcctcaa

SEQ ID NO: 3889968 - DNA, 17 bp, Homo sapiens
tcacctgaggtcgggag

SEQ ID NO: 3889969 - DNA, 15 bp, Homo sapiens
tcacctgcaagcccc

SEQ ID NO: 3889970 - DNA, 16 bp, Homo sapiens
tcaccttatgtattat

SEQ ID NO: 3889971 - DNA, 19 bp, Homo sapiens
tcaccttgccgagagaggc

SEQ ID NO: 3889972 - DNA, 14 bp, Homo sapiens
tcaccttggagcct

SEQ ID NO: 3889973 - DNA, 20 bp, Homo sapiens
tcaccttggagcctgaacat

SEQ ID NO: 3889974 - DNA, 21 bp, Homo sapiens
tcaccttggagcctgaacatg

SEQ ID NO: 3889975 - DNA, 13 bp, Homo sapiens
tcacgactcttcc

SEQ ID NO: 3889976 - DNA, 14 bp, Homo sapiens
tcacgactcttcct

SEQ ID NO: 3889977 - DNA, 21 bp, Homo sapiens
tcacgcctgtaatcccagcag

SEQ ID NO: 3889978 - DNA, 20 bp, Homo sapiens
tcacgctcccccgcagtccc

SEQ ID NO: 3889979 - DNA, 21 bp, Homo sapiens
tcacgctcccccgcagtcccc

SEQ ID NO: 3889980 - DNA, 18 bp, Homo sapiens
tcacgggcagtagctgtg

SEQ ID NO: 3889981 - DNA, 15 bp, Homo sapiens
tcactatgctatttc

SEQ ID NO: 3889982 - DNA, 24 bp, Homo sapiens
tcactatgctatttctggcctcag

SEQ ID NO: 3889983 - DNA, 13 bp, Homo sapiens
tcactatggtatg

SEQ ID NO: 3889984 - DNA, 17 bp, Homo sapiens
tcactatggtatgctgg

SEQ ID NO: 3889985 - DNA, 22 bp, Homo sapiens
tcactatggtatgctggccagc

SEQ ID NO: 3889986 - DNA, 23 bp, Homo sapiens
tcactatggtatgctggccagca

SEQ ID NO: 3889987 - DNA, 19 bp, Homo sapiens
tcactatgttgcccaggct

SEQ ID NO: 3889988 - DNA, 18 bp, Homo sapiens
tcactattcaagtattag

SEQ ID NO: 3889989 - DNA, 23 bp, Homo sapiens
tcactcaaaaaggtgtgtcaaag

SEQ ID NO: 3889990 - DNA, 13 bp, Homo sapiens
tcactccaccacc

SEQ ID NO: 3889991 - DNA, 14 bp, Homo sapiens
tcactccaccaccc

SEQ ID NO: 3889992 - DNA, 16 bp, Homo sapiens
tcactccaccacccaa

SEQ ID NO: 3889993 - DNA, 18 bp, Homo sapiens
tcactcccataagctaag

SEQ ID NO: 3889994 - DNA, 15 bp, Homo sapiens
tcactcctacctggt

SEQ ID NO: 3889995 - DNA, 20 bp, Homo sapiens
tcactcctgttacttaccta

SEQ ID NO: 3889996 - DNA, 20 bp, Homo sapiens
tcactctacttagcatgtcc

SEQ ID NO: 3889997 - DNA, 18 bp, Homo sapiens
tcactctgtcagccagcc

SEQ ID NO: 3889998 - DNA, 23 bp, Homo sapiens
tcactctgtcagccagccgccct

SEQ ID NO: 3889999 - DNA, 14 bp, Homo sapiens
tcactcttatgaaa

SEQ ID NO: 3890000 - DNA, 17 bp, Homo sapiens
tcactgattgggtgcca

SEQ ID NO: 3890001 - DNA, 15 bp, Homo sapiens
tcactgctggctgcc

SEQ ID NO: 3890002 - DNA, 16 bp, Homo sapiens
tcactgctggctgcct

SEQ ID NO: 3890003 - DNA, 19 bp, Homo sapiens
tcactggagttacattaat

SEQ ID NO: 3890004 - DNA, 14 bp, Homo sapiens
tcactggatgaaga

SEQ ID NO: 3890005 - DNA, 16 bp, Homo sapiens
tcactggcaatgaaaa

SEQ ID NO: 3890006 - DNA, 11 bp, Homo sapiens
tcactggctgg

SEQ ID NO: 3890007 - DNA, 13 bp, Homo sapiens
tcactggctgggg

SEQ ID NO: 3890008 - DNA, 19 bp, Homo sapiens
tcactggtagaccaaaata

SEQ ID NO: 3890009 - DNA, 16 bp, Homo sapiens
tcactgtaagtttatt

SEQ ID NO: 3890010 - DNA, 20 bp, Homo sapiens
tcactgtagaatgatttcat

SEQ ID NO: 3890011 - DNA, 21 bp, Homo sapiens
tcactgtagaatgatttcatg

SEQ ID NO: 3890012 - DNA, 14 bp, Homo sapiens
tcactgtcaatgat

SEQ ID NO: 3890013 - DNA, 23 bp, Homo sapiens
tcactgtcaatgattattttcat

SEQ ID NO: 3890014 - DNA, 18 bp, Homo sapiens
tcactgtccctcaaatga

SEQ ID NO: 3890015 - DNA, 20 bp, Homo sapiens
tcactgtgttggccaggctg

SEQ ID NO: 3890016 - DNA, 15 bp, Homo sapiens
tcactgttgaaaatt

SEQ ID NO: 3890017 - DNA, 20 bp, Homo sapiens
tcactgttgaaaattatttt

SEQ ID NO: 3890018 - DNA, 22 bp, Homo sapiens
tcacttccagtgttggctgtgt

SEQ ID NO: 3890019 - DNA, 13 bp, Homo sapiens
tcacttccctggg

SEQ ID NO: 3890020 - DNA, 18 bp, Homo sapiens
tcacttccctgggaactc

SEQ ID NO: 3890021 - DNA, 19 bp, Homo sapiens
tcacttccctgggaactca

SEQ ID NO: 3890022 - DNA, 15 bp, Homo sapiens
tcactttaattctca

SEQ ID NO: 3890023 - DNA, 16 bp, Homo sapiens
tcactttaattctcat

SEQ ID NO: 3890024 - DNA, 18 bp, Homo sapiens
tcactttaattctcatgt

SEQ ID NO: 3890025 - DNA, 13 bp, Homo sapiens
tcacttttctgta

SEQ ID NO: 3890026 - DNA, 20 bp, Homo sapiens
tcactttttaaaccactgta

SEQ ID NO: 3890027 - DNA, 15 bp, Homo sapiens
tcagaaaagaaaacc

SEQ ID NO: 3890028 - DNA, 10 bp, Homo sapiens
tcagaaaagt

SEQ ID NO: 3890029 - DNA, 13 bp, Homo sapiens
tcagaaaagtaga

SEQ ID NO: 3890030 - DNA, 15 bp, Homo sapiens
tcagaaaccagactc

SEQ ID NO: 3890031 - DNA, 12 bp, Homo sapiens
tcagaaactgtt

SEQ ID NO: 3890032 - DNA, 12 bp, Homo sapiens
tcagaaatatgt

SEQ ID NO: 3890033 - DNA, 15 bp, Homo sapiens
tcagaacatgctgga

SEQ ID NO: 3890034 - DNA, 12 bp, Homo sapiens
tcagaagaaaga

SEQ ID NO: 3890035 - DNA, 21 bp, Homo sapiens
tcagtgtagttaaagggcaga

SEQ ID NO: 3890036 - DNA, 22 bp, Homo sapiens
tcagtgtatggaaataaatgta

SEQ ID NO: 3890037 - DNA, 15 bp, Homo sapiens
tcagttactcagccc

SEQ ID NO: 3890038 - DNA, 16 bp, Homo sapiens
tcagttactcagccct

SEQ ID NO: 3890039 - DNA, 17 bp, Homo sapiens
tcagttactcagccctg

SEQ ID NO: 3890040 - DNA, 14 bp, Homo sapiens
tcagttattcagat

SEQ ID NO: 3890041 - DNA, 23 bp, Homo sapiens
tcagttcccggagcacagccctg

SEQ ID NO: 3890042 - DNA, 18 bp, Homo sapiens
tcagtttctccatcagct

SEQ ID NO: 3890043 - DNA, 14 bp, Homo sapiens
tcagtttgtataga

SEQ ID NO: 3890044 - DNA, 23 bp, Homo sapiens
tcagtttttcggtgggacagccc

SEQ ID NO: 3890045 - DNA, 14 bp, Homo sapiens
tcataaagaattgt

SEQ ID NO: 3890046 - DNA, 14 bp, Homo sapiens
tcataaccattccc

SEQ ID NO: 3890047 - DNA, 13 bp, Homo sapiens
tcataaggcctgc

SEQ ID NO: 3890048 - DNA, 17 bp, Homo sapiens
tcataaggcctgccctc

SEQ ID NO: 3890049 - DNA, 12 bp, Homo sapiens
tcataattttca

SEQ ID NO: 3890050 - DNA, 13 bp, Homo sapiens
tcataattttcaa

SEQ ID NO: 3890051 - DNA, 14 bp, Homo sapiens
tcataattttcaag

SEQ ID NO: 3890052 - DNA, 20 bp, Homo sapiens
tcatagaaatacctcattcg

SEQ ID NO: 3890053 - DNA, 13 bp, Homo sapiens
tcatagaaatgta

SEQ ID NO: 3890054 - DNA, 20 bp, Homo sapiens
tcataggaaaagtacattta

SEQ ID NO: 3890055 - DNA, 18 bp, Homo sapiens
tcataggcggtcatgtgt

SEQ ID NO: 3890056 - DNA, 21 bp, Homo sapiens
tcataggcggtcatgtgtgca

SEQ ID NO: 3890057 - DNA, 23 bp, Homo sapiens
tcatatatttaagccttttgtgt

SEQ ID NO: 3890058 - DNA, 18 bp, Homo sapiens
tcatatccagctgagtga

SEQ ID NO: 3890059 - DNA, 12 bp, Homo sapiens
tcatatgaaaaa

SEQ ID NO: 3890060 - DNA, 15 bp, Homo sapiens
tcatatgtagccctc

SEQ ID NO: 3890061 - DNA, 19 bp, Homo sapiens
tcatattgaatgtttccaa

SEQ ID NO: 3890062 - DNA, 15 bp, Homo sapiens
tcatcaatttttata

SEQ ID NO: 3890063 - DNA, 21 bp, Homo sapiens
tcatcaatttttatacatatc

SEQ ID NO: 3890064 - DNA, 15 bp, Homo sapiens
tcatcactccctgga

SEQ ID NO: 3890065 - DNA, 15 bp, Homo sapiens
tcatcacttttcagt

SEQ ID NO: 3890066 - DNA, 15 bp, Homo sapiens
tcatcatacatgact

SEQ ID NO: 3890067 - DNA, 14 bp, Homo sapiens
tcatcatattgtat

SEQ ID NO: 3890068 - DNA, 17 bp, Homo sapiens
tcatcatattgtatgta

SEQ ID NO: 3890069 - DNA, 20 bp, Homo sapiens
tcatcattgtatatatgtgt

SEQ ID NO: 3890070 - DNA, 21 bp, Homo sapiens
tcatccaccaatctctaagcc

SEQ ID NO: 3890071 - DNA, 19 bp, Homo sapiens
tcatccagttgcaataaaa

SEQ ID NO: 3890072 - DNA, 14 bp, Homo sapiens
tcatcccagcccca

SEQ ID NO: 3890073 - DNA, 14 bp, Homo sapiens
tcatccccaccttg

SEQ ID NO: 3890074 - DNA, 14 bp, Homo sapiens
tcatccccagtccc

SEQ ID NO: 3890075 - DNA, 15 bp, Homo sapiens
tcatccccagtccca

SEQ ID NO: 3890076 - DNA, 20 bp, Homo sapiens
tcatcctggcctccttttgc

SEQ ID NO: 3890077 - DNA, 17 bp, Homo sapiens
tcatcgaacaaactgat

SEQ ID NO: 3890078 - DNA, 19 bp, Homo sapiens
tcatcgaacaaactgatgc

SEQ ID NO: 3890079 - DNA, 17 bp, Homo sapiens
tcatcgccagacaactg

SEQ ID NO: 3890080 - DNA, 19 bp, Homo sapiens
tcatcggaggctgggcccc

SEQ ID NO: 3890081 - DNA, 23 bp, Homo sapiens
tcatcggaggctgggcccctggg

SEQ ID NO: 3890082 - DNA, 20 bp, Homo sapiens
tcatctcaggcctccctcaa

SEQ ID NO: 3890083 - DNA, 18 bp, Homo sapiens
tcatctcctttattgcag

SEQ ID NO: 3890084 - DNA, 20 bp, Homo sapiens
tcatctctctggggccctgg

SEQ ID NO: 3890085 - DNA, 21 bp, Homo sapiens
tcatctctctggggccctggg

SEQ ID NO: 3890086 - DNA, 17 bp, Homo sapiens
tcatctgtgtgaaaatg

SEQ ID NO: 3890087 - DNA, 17 bp, Homo sapiens
tcatctgtttttctttt

SEQ ID NO: 3890088 - DNA, 13 bp, Homo sapiens
tcatcttgacatg

SEQ ID NO: 3890089 - DNA, 14 bp, Homo sapiens
tcatcttgccccct

SEQ ID NO: 3890090 - DNA, 15 bp, Homo sapiens
tcatcttgccccctc

SEQ ID NO: 3890091 - DNA, 19 bp, Homo sapiens
tcatgacatgttatatatt

SEQ ID NO: 3890092 - DNA, 16 bp, Homo sapiens
tcatgaccagcaaata

SEQ ID NO: 3890093 - DNA, 18 bp, Homo sapiens
tcatgacttttccatgta

SEQ ID NO: 3890094 - DNA, 12 bp, Homo sapiens
tcatgagtggat

SEQ ID NO: 3890095 - DNA, 16 bp, Homo sapiens
tcatgatctccctgcc

SEQ ID NO: 3890096 - DNA, 17 bp, Homo sapiens
tcatgccaaagcaaaag

SEQ ID NO: 3890097 - DNA, 16 bp, Homo sapiens
tcatgccatctgtttt

SEQ ID NO: 3890098 - DNA, 13 bp, Homo sapiens
tcatgcctctgag

SEQ ID NO: 3890099 - DNA, 14 bp, Homo sapiens
tcatgcctctgagg

SEQ ID NO: 3890100 - DNA, 16 bp, Homo sapiens
tcatgcctctgaggcc

SEQ ID NO: 3890101 - DNA, 22 bp, Homo sapiens
tcatgcctgcctgataccctgc

SEQ ID NO: 3890102 - DNA, 15 bp, Homo sapiens
tcatgctatctctgt

SEQ ID NO: 3890103 - DNA, 13 bp, Homo sapiens
tcatgcttcagtt

SEQ ID NO: 3890104 - DNA, 19 bp, Homo sapiens
tcatgcttcagttgtactt

SEQ ID NO: 3890105 - DNA, 13 bp, Homo sapiens
tcatgctttaaag

SEQ ID NO: 3890106 - DNA, 23 bp, Homo sapiens
tcatgctttcctaaagtctctgc

SEQ ID NO: 3890107 - DNA, 17 bp, Homo sapiens
tcatgcttttgccactt

SEQ ID NO: 3890108 - DNA, 20 bp, Homo sapiens
tcatggaagtggcagtgaaa

SEQ ID NO: 3890109 - DNA, 21 bp, Homo sapiens
tcatggcagatgtaggaggga

SEQ ID NO: 3890110 - DNA, 22 bp, Homo sapiens
tcatggcagatgtaggagggac

SEQ ID NO: 3890111 - DNA, 20 bp, Homo sapiens
tcatggcgtaatgggcctgc

SEQ ID NO: 3890112 - DNA, 21 bp, Homo sapiens
tcatgggaaaagaccagggct

SEQ ID NO: 3890113 - DNA, 19 bp, Homo sapiens
tcatggtgatcagtgcaat

SEQ ID NO: 3890114 - DNA, 14 bp, Homo sapiens
tcatgtacttcctg

SEQ ID NO: 3890115 - DNA, 23 bp, Homo sapiens
tcatgtacttcctgtgtactctt

SEQ ID NO: 3890116 - DNA, 20 bp, Homo sapiens
tcatgtagattttagttcac

SEQ ID NO: 3890117 - DNA, 19 bp, Homo sapiens
tcatgtctcagcctcctca

SEQ ID NO: 3890118 - DNA, 20 bp, Homo sapiens
tcatgtgatccttttatgtt

SEQ ID NO: 3890119 - DNA, 21 bp, Homo sapiens
tcatgtggaatggattataga

SEQ ID NO: 3890120 - DNA, 17 bp, Homo sapiens
tcatgtgtgcatgtgag

SEQ ID NO: 3890121 - DNA, 11 bp, Homo sapiens
aaaataaaatg

SEQ ID NO: 3890122 - DNA, 14 bp, Homo sapiens
aaaataaacaaata

SEQ ID NO: 3890123 - DNA, 12 bp, Homo sapiens
aaaataaactag

SEQ ID NO: 3890124 - DNA, 14 bp, Homo sapiens
aaaataaactagtt

SEQ ID NO: 3890125 - DNA, 13 bp, Homo sapiens
aaaataaagttgg

SEQ ID NO: 3890126 - DNA, 12 bp, Homo sapiens
aaaataaattga

SEQ ID NO: 3890127 - DNA, 15 bp, Homo sapiens
aaaataaattttgaa

SEQ ID NO: 3890128 - DNA, 14 bp, Homo sapiens
aaaataagctttat

SEQ ID NO: 3890129 - DNA, 13 bp, Homo sapiens
aaaataagtgaat

SEQ ID NO: 3890130 - DNA, 12 bp, Homo sapiens
aaaatacagtaa

SEQ ID NO: 3890131 - DNA, 22 bp, Homo sapiens
aaaatacagtaaagtttaaaaa

SEQ ID NO: 3890132 - DNA, 21 bp, Homo sapiens
aaaatagcaacactctatatt

SEQ ID NO: 3890133 - DNA, 19 bp, Homo sapiens
aaaatagcttgtatagtgt

SEQ ID NO: 3890134 - DNA, 21 bp, Homo sapiens
aaaatagcttgtatagtgtaa

SEQ ID NO: 3890135 - DNA, 18 bp, Homo sapiens
aaaatagtaagcctccct

SEQ ID NO: 3890136 - DNA, 16 bp, Homo sapiens
aaaatagttgtccata

SEQ ID NO: 3890137 - DNA, 20 bp, Homo sapiens
aaaatataaatgcatgattt

SEQ ID NO: 3890138 - DNA, 19 bp, Homo sapiens
aaaatatatatagtgctat

SEQ ID NO: 3890139 - DNA, 21 bp, Homo sapiens
aaaatatatatatatatttaa

SEQ ID NO: 3890140 - DNA, 20 bp, Homo sapiens
aaaatatggaacttctaata

SEQ ID NO: 3890141 - DNA, 13 bp, Homo sapiens
aaaatatgtctcg

SEQ ID NO: 3890142 - DNA, 23 bp, Homo sapiens
aaaatatgtctcgctagtgatgt

SEQ ID NO: 3890143 - DNA, 18 bp, Homo sapiens
aaaatcaaaacaaaaaaa

SEQ ID NO: 3890144 - DNA, 21 bp, Homo sapiens
aaaatcacaagcaataattag

SEQ ID NO: 3890145 - DNA, 13 bp, Homo sapiens
aaaatccttgctt

SEQ ID NO: 3890146 - DNA, 15 bp, Homo sapiens
aaaatctaatattaa

SEQ ID NO: 3890147 - DNA, 12 bp, Homo sapiens
aaaatctgattt

SEQ ID NO: 3890148 - DNA, 22 bp, Homo sapiens
aaaatctgatttaatgttttct

SEQ ID NO: 3890149 - DNA, 17 bp, Homo sapiens
aaaatgaaatgtttttg

SEQ ID NO: 3890150 - DNA, 20 bp, Homo sapiens
aaaatgaaggttaggattta

SEQ ID NO: 3890151 - DNA, 16 bp, Homo sapiens
aaaatgacaaggggag

SEQ ID NO: 3890152 - DNA, 18 bp, Homo sapiens
aaaatgacagatgttgaa

SEQ ID NO: 3890153 - DNA, 17 bp, Homo sapiens
aaaatgagcctgtaatc

SEQ ID NO: 3890154 - DNA, 14 bp, Homo sapiens
aaaatgaggaggat

SEQ ID NO: 3890155 - DNA, 23 bp, Homo sapiens
aaaatgagtttttatggggctga

SEQ ID NO: 3890156 - DNA, 21 bp, Homo sapiens
aaaatgcagtccagaataagt

SEQ ID NO: 3890157 - DNA, 14 bp, Homo sapiens
aaaatgcttctgtt

SEQ ID NO: 3890158 - DNA, 14 bp, Homo sapiens
aaaatggaaagaat

SEQ ID NO: 3890159 - DNA, 23 bp, Homo sapiens
aaaatggcttcagaattaaaact

SEQ ID NO: 3890160 - DNA, 16 bp, Homo sapiens
aaaatgttcagaaggt

SEQ ID NO: 3890161 - DNA, 20 bp, Homo sapiens
aaaattaagacaagcctggc

SEQ ID NO: 3890162 - DNA, 16 bp, Homo sapiens
aaaattcatttcacat

SEQ ID NO: 3890163 - DNA, 20 bp, Homo sapiens
aaaattctcagtcagtaatt

SEQ ID NO: 3890164 - DNA, 9 bp, Homo sapiens
aaaattgca

SEQ ID NO: 3890165 - DNA, 11 bp, Homo sapiens
aaaattgcaca

SEQ ID NO: 3890166 - DNA, 14 bp, Homo sapiens
aaaattgcacaatt

SEQ ID NO: 3890167 - DNA, 16 bp, Homo sapiens
aaaattgcacaatttg

SEQ ID NO: 3890168 - DNA, 17 bp, Homo sapiens
aaaattggtacttgttt

SEQ ID NO: 3890169 - DNA, 22 bp, Homo sapiens
aaaattgtgatgttttgttcaa

SEQ ID NO: 3890170 - DNA, 16 bp, Homo sapiens
aaaatttcaaaagtga

SEQ ID NO: 3890171 - DNA, 18 bp, Homo sapiens
aaaatttcaaaagtgatc

SEQ ID NO: 3890172 - DNA, 13 bp, Homo sapiens
aaaatttcacatt

SEQ ID NO: 3890173 - DNA, 20 bp, Homo sapiens
aaaatttcacattaatattt

SEQ ID NO: 3890174 - DNA, 16 bp, Homo sapiens
aaaatttgttttgacg

SEQ ID NO: 3890175 - DNA, 22 bp, Homo sapiens
aaaatttgttttgacggatgat

SEQ ID NO: 3890176 - DNA, 19 bp, Homo sapiens
aaaattttacttttgttct

SEQ ID NO: 3890177 - DNA, 13 bp, Homo sapiens
aaaattttattcc

SEQ ID NO: 3890178 - DNA, 15 bp, Homo sapiens
aaaattttgtgagtg

SEQ ID NO: 3890179 - DNA, 13 bp, Homo sapiens
aaacaaaaacact

SEQ ID NO: 3890180 - DNA, 14 bp, Homo sapiens
aaacaaaacaacaa

SEQ ID NO: 3890181 - DNA, 16 bp, Homo sapiens
aaacaagaaagaaacg

SEQ ID NO: 3890182 - DNA, 19 bp, Homo sapiens
aaacaagacacccaagtcc

SEQ ID NO: 3890183 - DNA, 19 bp, Homo sapiens
aaacaaggggctgttacat

SEQ ID NO: 3890184 - DNA, 13 bp, Homo sapiens
aaacacactgtaa

SEQ ID NO: 3890185 - DNA, 14 bp, Homo sapiens
aaacacagcaaggg

SEQ ID NO: 3890186 - DNA, 18 bp, Homo sapiens
aaacacatctttcctgtc

SEQ ID NO: 3890187 - DNA, 13 bp, Homo sapiens
aaacacctcccca

SEQ ID NO: 3890188 - DNA, 14 bp, Homo sapiens
aaacacctgacaca

SEQ ID NO: 3890189 - DNA, 17 bp, Homo sapiens
aaacactgaatcatgtt

SEQ ID NO: 3890190 - DNA, 14 bp, Homo sapiens
aaacactgtaatct

SEQ ID NO: 3890191 - DNA, 15 bp, Homo sapiens
aaacactgtaatctt

SEQ ID NO: 3890192 - DNA, 18 bp, Homo sapiens
aaacacttctcatcatat

SEQ ID NO: 3890193 - DNA, 19 bp, Homo sapiens
aaacagaaacaaaaacact

SEQ ID NO: 3890194 - DNA, 15 bp, Homo sapiens
aaacagagacaggcc

SEQ ID NO: 3890195 - DNA, 13 bp, Homo sapiens
aaacagagagaga

SEQ ID NO: 3890196 - DNA, 13 bp, Homo sapiens
aaacagataccat

SEQ ID NO: 3890197 - DNA, 15 bp, Homo sapiens
aaacagatataaatg

SEQ ID NO: 3890198 - DNA, 14 bp, Homo sapiens
aaacagctgtaact

SEQ ID NO: 3890199 - DNA, 12 bp, Homo sapiens
aaacaggaaaaa

SEQ ID NO: 3890200 - DNA, 22 bp, Homo sapiens
aaacaggaaaaaaaataatgta

SEQ ID NO: 3890201 - DNA, 21 bp, Homo sapiens
aaacaggacttaaaatgacat

SEQ ID NO: 3890202 - DNA, 16 bp, Homo sapiens
aaacaggggatcaaag

SEQ ID NO: 3890203 - DNA, 19 bp, Homo sapiens
aaacaggggatcaaagttc

SEQ ID NO: 3890204 - DNA, 21 bp, Homo sapiens
aaacaggggatcaaagttcct

SEQ ID NO: 3890205 - DNA, 15 bp, Homo sapiens
aaacagttcttggac

SEQ ID NO: 3890206 - DNA, 16 bp, Homo sapiens
aaacagttcttggacc

SEQ ID NO: 3890207 - DNA, 24 bp, Homo sapiens
aaacataaaatatacaaacatgtg

SEQ ID NO: 3890208 - DNA, 17 bp, Homo sapiens
aaacttaacatatttac

SEQ ID NO: 3890209 - DNA, 23 bp, Homo sapiens
aaacttatgctagtttattggaa

SEQ ID NO: 3890210 - DNA, 12 bp, Homo sapiens
aaacttatttga

SEQ ID NO: 3890211 - DNA, 13 bp, Homo sapiens
aaacttgaatctg

SEQ ID NO: 3890212 - DNA, 14 bp, Homo sapiens
aaacttgaatctgt

SEQ ID NO: 3890213 - DNA, 14 bp, Homo sapiens
aaactttctctgca

SEQ ID NO: 3890214 - DNA, 15 bp, Homo sapiens
aaactttgtgccttt

SEQ ID NO: 3890215 - DNA, 16 bp, Homo sapiens
aaactttgtgcctttg

SEQ ID NO: 3890216 - DNA, 22 bp, Homo sapiens
aaagaaaccgtaattttattat

SEQ ID NO: 3890217 - DNA, 13 bp, Homo sapiens
aaagaaagaaaca

SEQ ID NO: 3890218 - DNA, 20 bp, Homo sapiens
aaagaactccttattttgta

SEQ ID NO: 3890219 - DNA, 21 bp, Homo sapiens
aaagaactccttattttgtat

SEQ ID NO: 3890220 - DNA, 14 bp, Homo sapiens
aaagaactgcccca

SEQ ID NO: 3890221 - DNA, 16 bp, Homo sapiens
aaagaagtaaatttgt

SEQ ID NO: 3890222 - DNA, 18 bp, Homo sapiens
aaagaagtaaatttgtcc

SEQ ID NO: 3890223 - DNA, 15 bp, Homo sapiens
aaagaagtttgatat

SEQ ID NO: 3890224 - DNA, 18 bp, Homo sapiens
aaagaataaatgaatctt

SEQ ID NO: 3890225 - DNA, 22 bp, Homo sapiens
aaagaatattcagagaatatca

SEQ ID NO: 3890226 - DNA, 15 bp, Homo sapiens
aaagaatccctgcag

SEQ ID NO: 3890227 - DNA, 20 bp, Homo sapiens
aaagaattatttttgtgttt

SEQ ID NO: 3890228 - DNA, 22 bp, Homo sapiens
aaagaattatttttgtgtttct

SEQ ID NO: 3890229 - DNA, 19 bp, Homo sapiens
aaagacacctactgagtgg

SEQ ID NO: 3890230 - DNA, 20 bp, Homo sapiens
aaagaccctgagactccaga

SEQ ID NO: 3890231 - DNA, 20 bp, Homo sapiens
aaagactaatttaaaaaata

SEQ ID NO: 3890232 - DNA, 14 bp, Homo sapiens
aaagactattcaaa

SEQ ID NO: 3890233 - DNA, 23 bp, Homo sapiens
aaagactattcaaacagtctcag

SEQ ID NO: 3890234 - DNA, 13 bp, Homo sapiens
aaagactccaaag

SEQ ID NO: 3890235 - DNA, 14 bp, Homo sapiens
aaagactccaaaga

SEQ ID NO: 3890236 - DNA, 21 bp, Homo sapiens
aaagactccaaagaaatgtaa

SEQ ID NO: 3890237 - DNA, 11 bp, Homo sapiens
aaagacttaag

SEQ ID NO: 3890238 - DNA, 13 bp, Homo sapiens
aaagacttaagat

SEQ ID NO: 3890239 - DNA, 15 bp, Homo sapiens
aaagacttaagatta

SEQ ID NO: 3890240 - DNA, 15 bp, Homo sapiens
aaagacttcatgttc

SEQ ID NO: 3890241 - DNA, 12 bp, Homo sapiens
aaagagaaaaac

SEQ ID NO: 3890242 - DNA, 15 bp, Homo sapiens
aaagagaaaaaccaa

SEQ ID NO: 3890243 - DNA, 17 bp, Homo sapiens
aaagagaaaaagaaatg

SEQ ID NO: 3890244 - DNA, 23 bp, Homo sapiens
aaagagactaatagagacacaga

SEQ ID NO: 3890245 - DNA, 13 bp, Homo sapiens
aaagagagaaaac

SEQ ID NO: 3890246 - DNA, 15 bp, Homo sapiens
aaagagcaagtctgg

SEQ ID NO: 3890247 - DNA, 15 bp, Homo sapiens
aaagaggcagcttga

SEQ ID NO: 3890248 - DNA, 18 bp, Homo sapiens
aaagaggtgaccccaggg

SEQ ID NO: 3890249 - DNA, 16 bp, Homo sapiens
aaagagttcttaagga

SEQ ID NO: 3890250 - DNA, 20 bp, Homo sapiens
aaagataacaagatctttca

SEQ ID NO: 3890251 - DNA, 20 bp, Homo sapiens
aaagatgagctctgaacaaa

SEQ ID NO: 3890252 - DNA, 22 bp, Homo sapiens
aaagatgccgggttttatattt

SEQ ID NO: 3890253 - DNA, 22 bp, Homo sapiens
aaagatggctgtgcctctgcct

SEQ ID NO: 3890254 - DNA, 11 bp, Homo sapiens
aaagatgtgtt

SEQ ID NO: 3890255 - DNA, 21 bp, Homo sapiens
aaagatgtttgtcagatatga

SEQ ID NO: 3890256 - DNA, 20 bp, Homo sapiens
aaagattctagctattattt

SEQ ID NO: 3890257 - DNA, 13 bp, Homo sapiens
aaagcaaaagaag

SEQ ID NO: 3890258 - DNA, 19 bp, Homo sapiens
aaagcaattgccctgtaac

SEQ ID NO: 3890259 - DNA, 19 bp, Homo sapiens
aaagcacaggagacactgt

SEQ ID NO: 3890260 - DNA, 12 bp, Homo sapiens
aaagcacctgcc

SEQ ID NO: 3890261 - DNA, 21 bp, Homo sapiens
aaagcactcccttaggcatta

SEQ ID NO: 3890262 - DNA, 17 bp, Homo sapiens
aaagcactgacttctaa

SEQ ID NO: 3890263 - DNA, 21 bp, Homo sapiens
aaagcagcagctaggactgag

SEQ ID NO: 3890264 - DNA, 18 bp, Homo sapiens
aaagcagtagacaatccc

SEQ ID NO: 3890265 - DNA, 23 bp, Homo sapiens
aaagcagttaactttaagactga

SEQ ID NO: 3890266 - DNA, 23 bp, Homo sapiens
aaagccaacagtcaaaacagaga

SEQ ID NO: 3890267 - DNA, 18 bp, Homo sapiens
aaagccacgttccttact

SEQ ID NO: 3890268 - DNA, 23 bp, Homo sapiens
aaagcccttccatgtcgcctctg

SEQ ID NO: 3890269 - DNA, 17 bp, Homo sapiens
aaagcctatttttcaaa

SEQ ID NO: 3890270 - DNA, 17 bp, Homo sapiens
aaagcctgttcatggca

SEQ ID NO: 3890271 - DNA, 18 bp, Homo sapiens
aaagcctgttcatggcag

SEQ ID NO: 3890272 - DNA, 19 bp, Homo sapiens
aaagcgagatcccatctct

SEQ ID NO: 3890273 - DNA, 21 bp, Homo sapiens
aaagctcatattttgtatata

SEQ ID NO: 3890274 - DNA, 17 bp, Homo sapiens
aaagctctgcatgtgtg

SEQ ID NO: 3890275 - DNA, 15 bp, Homo sapiens
aaagctgcctgtagt

SEQ ID NO: 3890276 - DNA, 21 bp, Homo sapiens
aaagctgcttgactatcacat

SEQ ID NO: 3890277 - DNA, 20 bp, Homo sapiens
aaagctttctgacaagataa

SEQ ID NO: 3890278 - DNA, 21 bp, Homo sapiens
aaagctttgcttatggtaata

SEQ ID NO: 3890279 - DNA, 12 bp, Homo sapiens
aaaggaaggaaa

SEQ ID NO: 3890280 - DNA, 17 bp, Homo sapiens
aaaggaagtcaccaaaa

SEQ ID NO: 3890281 - DNA, 14 bp, Homo sapiens
aaaggaagtctagg

SEQ ID NO: 3890282 - DNA, 15 bp, Homo sapiens
aaaggacattatgtg

SEQ ID NO: 3890283 - DNA, 18 bp, Homo sapiens
aaaggacattatgtgtgc

SEQ ID NO: 3890284 - DNA, 21 bp, Homo sapiens
aaaggaccaactggcttctgt

SEQ ID NO: 3890285 - DNA, 15 bp, Homo sapiens
aaaggagaaaggagc

SEQ ID NO: 3890286 - DNA, 17 bp, Homo sapiens
aaaggagagaagaaagt

SEQ ID NO: 3890287 - DNA, 19 bp, Homo sapiens
aaaggagagaagagagaaa

SEQ ID NO: 3890288 - DNA, 12 bp, Homo sapiens
aaaggagcctgt

SEQ ID NO: 3890289 - DNA, 16 bp, Homo sapiens
aaaggaggcatgcctc

SEQ ID NO: 3890290 - DNA, 19 bp, Homo sapiens
aaaggattaagatacactc

SEQ ID NO: 3890291 - DNA, 21 bp, Homo sapiens
aaaggattaagatacactcct

SEQ ID NO: 3890292 - DNA, 21 bp, Homo sapiens
aaaggcataagaccctaagcc

SEQ ID NO: 3890293 - DNA, 16 bp, Homo sapiens
aaaggcctcatctcct

SEQ ID NO: 3890294 - DNA, 12 bp, Homo sapiens
aacaagaaagaa

SEQ ID NO: 3890295 - DNA, 14 bp, Homo sapiens
aacaagaaagaaac

SEQ ID NO: 3890296 - DNA, 19 bp, Homo sapiens
aacaagatctttcaggaaa

SEQ ID NO: 3890297 - DNA, 20 bp, Homo sapiens
aacaagtcacagctgcagct

SEQ ID NO: 3890298 - DNA, 14 bp, Homo sapiens
aacaatacaacaag

SEQ ID NO: 3890299 - DNA, 15 bp, Homo sapiens
aacaatacaacaaga

SEQ ID NO: 3890300 - DNA, 22 bp, Homo sapiens
aacaatacaacaagaacaacaa

SEQ ID NO: 3890301 - DNA, 23 bp, Homo sapiens
aacaatagctattgcatgtaaaa

SEQ ID NO: 3890302 - DNA, 20 bp, Homo sapiens
aacaatggtttacatgaaca

SEQ ID NO: 3890303 - DNA, 20 bp, Homo sapiens
aacaatgttgttttaagact

SEQ ID NO: 3890304 - DNA, 20 bp, Homo sapiens
aacaatttcctttatattta

SEQ ID NO: 3890305 - DNA, 22 bp, Homo sapiens
aacaatttcctttatatttagt

SEQ ID NO: 3890306 - DNA, 15 bp, Homo sapiens
aacacaaaccacaac

SEQ ID NO: 3890307 - DNA, 18 bp, Homo sapiens
aacacaagacaccttttg

SEQ ID NO: 3890308 - DNA, 16 bp, Homo sapiens
aacacaagccacagaa

SEQ ID NO: 3890309 - DNA, 15 bp, Homo sapiens
aacacaagctggaag

SEQ ID NO: 3890310 - DNA, 20 bp, Homo sapiens
aacacaattgatacttcagg

SEQ ID NO: 3890311 - DNA, 13 bp, Homo sapiens
aacacactgtaaa

SEQ ID NO: 3890312 - DNA, 15 bp, Homo sapiens
aacacactgtaaata

SEQ ID NO: 3890313 - DNA, 21 bp, Homo sapiens
aacacagagctggcgactgca

SEQ ID NO: 3890314 - DNA, 22 bp, Homo sapiens
aacacaggcaaaatccttgctt

SEQ ID NO: 3890315 - DNA, 20 bp, Homo sapiens
aacacagttttgaaagaaaa

SEQ ID NO: 3890316 - DNA, 18 bp, Homo sapiens
aacacattacttgcacaa

SEQ ID NO: 3890317 - DNA, 12 bp, Homo sapiens
aacacccactgg

SEQ ID NO: 3890318 - DNA, 21 bp, Homo sapiens
aacacccatgaatcaaagaca

SEQ ID NO: 3890319 - DNA, 13 bp, Homo sapiens
aacacctcccagg

SEQ ID NO: 3890320 - DNA, 23 bp, Homo sapiens
aacacctcccaggagacagttca

SEQ ID NO: 3890321 - DNA, 18 bp, Homo sapiens
aacactcagaagcctggg

SEQ ID NO: 3890322 - DNA, 20 bp, Homo sapiens
aacactcagaagcctggggg

SEQ ID NO: 3890323 - DNA, 21 bp, Homo sapiens
aacactctctgagatgcccct

SEQ ID NO: 3890324 - DNA, 16 bp, Homo sapiens
aacactgtgtatttat

SEQ ID NO: 3890325 - DNA, 11 bp, Homo sapiens
aacagacagga

SEQ ID NO: 3890326 - DNA, 14 bp, Homo sapiens
aacagacaggagaa

SEQ ID NO: 3890327 - DNA, 20 bp, Homo sapiens
aacagactatttaacttgag

SEQ ID NO: 3890328 - DNA, 13 bp, Homo sapiens
aacagagaaggca

SEQ ID NO: 3890329 - DNA, 11 bp, Homo sapiens
aacagagactc

SEQ ID NO: 3890330 - DNA, 16 bp, Homo sapiens
aacagagactctggaa

SEQ ID NO: 3890331 - DNA, 16 bp, Homo sapiens
aacagagcgggcctct

SEQ ID NO: 3890332 - DNA, 13 bp, Homo sapiens
aacagaggcagga

SEQ ID NO: 3890333 - DNA, 20 bp, Homo sapiens
aacagaggcaggagtggcag

SEQ ID NO: 3890334 - DNA, 19 bp, Homo sapiens
aacagattattaccttaca

SEQ ID NO: 3890335 - DNA, 15 bp, Homo sapiens
aacagcagtgttccc

SEQ ID NO: 3890336 - DNA, 14 bp, Homo sapiens
aacagcctcacaga

SEQ ID NO: 3890337 - DNA, 11 bp, Homo sapiens
aacagctcaga

SEQ ID NO: 3890338 - DNA, 23 bp, Homo sapiens
aacagctcttcactcagccacac

SEQ ID NO: 3890339 - DNA, 19 bp, Homo sapiens
aacaggaaaaaaaataatg

SEQ ID NO: 3890340 - DNA, 19 bp, Homo sapiens
aacaggacttaaaatgaca

SEQ ID NO: 3890341 - DNA, 17 bp, Homo sapiens
aacaggagacaggaagg

SEQ ID NO: 3890342 - DNA, 22 bp, Homo sapiens
aacagggaaggcaggcagggct

SEQ ID NO: 3890343 - DNA, 15 bp, Homo sapiens
aacagggcagtgaca

SEQ ID NO: 3890344 - DNA, 17 bp, Homo sapiens
aacaggggatcaaagtt

SEQ ID NO: 3890345 - DNA, 18 bp, Homo sapiens
aacaggggatcaaagttc

SEQ ID NO: 3890346 - DNA, 19 bp, Homo sapiens
aacaggtggcaggaccagg

SEQ ID NO: 3890347 - DNA, 23 bp, Homo sapiens
aacaggtggcaggaccaggacta

SEQ ID NO: 3890348 - DNA, 13 bp, Homo sapiens
aacagtgcctgct

SEQ ID NO: 3890349 - DNA, 15 bp, Homo sapiens
aacagtgcctgctga

SEQ ID NO: 3890350 - DNA, 15 bp, Homo sapiens
aacataaaatataca

SEQ ID NO: 3890351 - DNA, 19 bp, Homo sapiens
aacataaagcaaatagaca

SEQ ID NO: 3890352 - DNA, 17 bp, Homo sapiens
aacatacccttctttaa

SEQ ID NO: 3890353 - DNA, 13 bp, Homo sapiens
aacatatgtatta

SEQ ID NO: 3890354 - DNA, 22 bp, Homo sapiens
aacatccaaggagaaacagaga

SEQ ID NO: 3890355 - DNA, 16 bp, Homo sapiens
aacatcccattgccct

SEQ ID NO: 3890356 - DNA, 20 bp, Homo sapiens
aacatctattataaaaccat

SEQ ID NO: 3890357 - DNA, 14 bp, Homo sapiens
aacatctcgagccc

SEQ ID NO: 3890358 - DNA, 19 bp, Homo sapiens
aacatgcaattttgcattt

SEQ ID NO: 3890359 - DNA, 12 bp, Homo sapiens
aacatgcacatt

SEQ ID NO: 3890360 - DNA, 19 bp, Homo sapiens
aacatgcacatttatatat

SEQ ID NO: 3890361 - DNA, 19 bp, Homo sapiens
aacatggagaaaccctgtc

SEQ ID NO: 3890362 - DNA, 20 bp, Homo sapiens
aacatggagaaaccctgtct

SEQ ID NO: 3890363 - DNA, 19 bp, Homo sapiens
aacatgtcggagtagaaat

SEQ ID NO: 3890364 - DNA, 20 bp, Homo sapiens
aacatgtttacttttcaggg

SEQ ID NO: 3890365 - DNA, 21 bp, Homo sapiens
aacattaaaagaagactggaa

SEQ ID NO: 3890366 - DNA, 13 bp, Homo sapiens
aacattaaacact

SEQ ID NO: 3890367 - DNA, 16 bp, Homo sapiens
aacattaaacactgta

SEQ ID NO: 3890368 - DNA, 17 bp, Homo sapiens
aacattcaaagcagcag

SEQ ID NO: 3890369 - DNA, 22 bp, Homo sapiens
aacattcacacagggctctttg

SEQ ID NO: 3890370 - DNA, 20 bp, Homo sapiens
aacatttacaataaatattc

SEQ ID NO: 3890371 - DNA, 19 bp, Homo sapiens
aacatttgctttgttttct

SEQ ID NO: 3890372 - DNA, 19 bp, Homo sapiens
aaccaaagagactggagca

SEQ ID NO: 3890373 - DNA, 17 bp, Homo sapiens
aaccaactatttttgag

SEQ ID NO: 3890374 - DNA, 14 bp, Homo sapiens
aaccaagaagggct

SEQ ID NO: 3890375 - DNA, 18 bp, Homo sapiens
aaccaagccgtggcttcc

SEQ ID NO: 3890376 - DNA, 18 bp, Homo sapiens
aaccaagcttcagagcct

SEQ ID NO: 3890377 - DNA, 14 bp, Homo sapiens
aaccaaggcagcct

SEQ ID NO: 3890378 - DNA, 18 bp, Homo sapiens
aaccaatcccgtgaaaga

SEQ ID NO: 3890379 - DNA, 23 bp, Homo sapiens
aaccaatcccgtgaaagaattat

SEQ ID NO: 3890380 - DNA, 17 bp, Homo sapiens
aagactccaaagaaatg

SEQ ID NO: 3890381 - DNA, 15 bp, Homo sapiens
aagactgagcacctg

SEQ ID NO: 3890382 - DNA, 12 bp, Homo sapiens
aagactgcagct

SEQ ID NO: 3890383 - DNA, 13 bp, Homo sapiens
aagactgcagctg

SEQ ID NO: 3890384 - DNA, 15 bp, Homo sapiens
aagactgcagctgct

SEQ ID NO: 3890385 - DNA, 13 bp, Homo sapiens
aagactggaagca

SEQ ID NO: 3890386 - DNA, 24 bp, Homo sapiens
aagactgttgctcaaatctattca

SEQ ID NO: 3890387 - DNA, 13 bp, Homo sapiens
aagacttaagatt

SEQ ID NO: 3890388 - DNA, 15 bp, Homo sapiens
aagacttaagattaa

SEQ ID NO: 3890389 - DNA, 19 bp, Homo sapiens
aagacttggcaacagaagc

SEQ ID NO: 3890390 - DNA, 18 bp, Homo sapiens
aagagaaaaagaaatgca

SEQ ID NO: 3890391 - DNA, 11 bp, Homo sapiens
aagagaaatct

SEQ ID NO: 3890392 - DNA, 12 bp, Homo sapiens
aagagaagaaaa

SEQ ID NO: 3890393 - DNA, 12 bp, Homo sapiens
aagagaataaag

SEQ ID NO: 3890394 - DNA, 21 bp, Homo sapiens
aagagacaaacacctcccagg

SEQ ID NO: 3890395 - DNA, 17 bp, Homo sapiens
aagagacagagccccca

SEQ ID NO: 3890396 - DNA, 21 bp, Homo sapiens
aagagacagagcccccaagcc

SEQ ID NO: 3890397 - DNA, 17 bp, Homo sapiens
aagagacagttatttat

SEQ ID NO: 3890398 - DNA, 21 bp, Homo sapiens
aagagactaatagagacacag

SEQ ID NO: 3890399 - DNA, 14 bp, Homo sapiens
aagagactggagca

SEQ ID NO: 3890400 - DNA, 18 bp, Homo sapiens
aagagactggagcatctg

SEQ ID NO: 3890401 - DNA, 21 bp, Homo sapiens
aagagagaaagaagtaggcat

SEQ ID NO: 3890402 - DNA, 13 bp, Homo sapiens
aagagagagagag

SEQ ID NO: 3890403 - DNA, 15 bp, Homo sapiens
aagagagccctggtc

SEQ ID NO: 3890404 - DNA, 19 bp, Homo sapiens
aagagaggcacctgctgga

SEQ ID NO: 3890405 - DNA, 22 bp, Homo sapiens
aagagagggccatgcaattcat

SEQ ID NO: 3890406 - DNA, 14 bp, Homo sapiens
aagagatacattcc

SEQ ID NO: 3890407 - DNA, 13 bp, Homo sapiens
aagagatgaagag

SEQ ID NO: 3890408 - DNA, 20 bp, Homo sapiens
aagagatgtagcagaataat

SEQ ID NO: 3890409 - DNA, 21 bp, Homo sapiens
aagagatgtggcaaagtgctg

SEQ ID NO: 3890410 - DNA, 15 bp, Homo sapiens
aagagcagcctgatg

SEQ ID NO: 3890411 - DNA, 19 bp, Homo sapiens
aagagcagcctgatggcca

SEQ ID NO: 3890412 - DNA, 21 bp, Homo sapiens
aagagcatcatgcctctgagg

SEQ ID NO: 3890413 - DNA, 16 bp, Homo sapiens
aagagcctggagaagc

SEQ ID NO: 3890414 - DNA, 21 bp, Homo sapiens
aagagcctggagaagctgatg

SEQ ID NO: 3890415 - DNA, 21 bp, Homo sapiens
aagagccttggtgtccacctg

SEQ ID NO: 3890416 - DNA, 20 bp, Homo sapiens
aagagctagcgctgccgcac

SEQ ID NO: 3890417 - DNA, 11 bp, Homo sapiens
aagagctgctg

SEQ ID NO: 3890418 - DNA, 18 bp, Homo sapiens
aagagctgttcacagcca

SEQ ID NO: 3890419 - DNA, 12 bp, Homo sapiens
aagaggaaaaaa

SEQ ID NO: 3890420 - DNA, 19 bp, Homo sapiens
aagaggaaaagtgcaatgc

SEQ ID NO: 3890421 - DNA, 17 bp, Homo sapiens
aagaggcaagagacaga

SEQ ID NO: 3890422 - DNA, 12 bp, Homo sapiens
aagaggcccagg

SEQ ID NO: 3890423 - DNA, 14 bp, Homo sapiens
aagaggcccaggga

SEQ ID NO: 3890424 - DNA, 23 bp, Homo sapiens
aagagggaagaaagagaaggagc

SEQ ID NO: 3890425 - DNA, 19 bp, Homo sapiens
aagagggcctgtgggagcc

SEQ ID NO: 3890426 - DNA, 13 bp, Homo sapiens
aagaggtctgagc

SEQ ID NO: 3890427 - DNA, 17 bp, Homo sapiens
aagaggtgaccccaggg

SEQ ID NO: 3890428 - DNA, 24 bp, Homo sapiens
aagaggtgaccccagggcacagga

SEQ ID NO: 3890429 - DNA, 12 bp, Homo sapiens
aagaggtgggga

SEQ ID NO: 3890430 - DNA, 16 bp, Homo sapiens
aagagtgggctgcatc

SEQ ID NO: 3890431 - DNA, 18 bp, Homo sapiens
aagataaaatatcctcag

SEQ ID NO: 3890432 - DNA, 12 bp, Homo sapiens
aagataaagatg

SEQ ID NO: 3890433 - DNA, 14 bp, Homo sapiens
aagataaagatgat

SEQ ID NO: 3890434 - DNA, 20 bp, Homo sapiens
aagataacaagatctttcag

SEQ ID NO: 3890435 - DNA, 15 bp, Homo sapiens
aagatagcagggcat

SEQ ID NO: 3890436 - DNA, 20 bp, Homo sapiens
aagatatcagagctcttaat

SEQ ID NO: 3890437 - DNA, 22 bp, Homo sapiens
aagatatcagagctcttaatgt

SEQ ID NO: 3890438 - DNA, 18 bp, Homo sapiens
aagatatttatatatatt

SEQ ID NO: 3890439 - DNA, 22 bp, Homo sapiens
aagatcaaaagcttattcatct

SEQ ID NO: 3890440 - DNA, 23 bp, Homo sapiens
aagatgaaaaatggtcccttctt

SEQ ID NO: 3890441 - DNA, 13 bp, Homo sapiens
aagatgaaaatat

SEQ ID NO: 3890442 - DNA, 13 bp, Homo sapiens
aagatgaagagaa

SEQ ID NO: 3890443 - DNA, 23 bp, Homo sapiens
aagatgaagagaagctgagaaga

SEQ ID NO: 3890444 - DNA, 13 bp, Homo sapiens
aagatgacacaag

SEQ ID NO: 3890445 - DNA, 18 bp, Homo sapiens
aagatgagagaactggag

SEQ ID NO: 3890446 - DNA, 19 bp, Homo sapiens
aagatgagatttgccagca

SEQ ID NO: 3890447 - DNA, 16 bp, Homo sapiens
aagatgagctctgaac

SEQ ID NO: 3890448 - DNA, 21 bp, Homo sapiens
aagatgagctctgaacaaaca

SEQ ID NO: 3890449 - DNA, 17 bp, Homo sapiens
aagatgatctactcaga

SEQ ID NO: 3890450 - DNA, 11 bp, Homo sapiens
aagatgccctc

SEQ ID NO: 3890451 - DNA, 22 bp, Homo sapiens
aagatggactctgaaaaacatt

SEQ ID NO: 3890452 - DNA, 14 bp, Homo sapiens
aagatgggcacatg

SEQ ID NO: 3890453 - DNA, 19 bp, Homo sapiens
aagatgggcacatgaggag

SEQ ID NO: 3890454 - DNA, 14 bp, Homo sapiens
aagatggtagcaga

SEQ ID NO: 3890455 - DNA, 12 bp, Homo sapiens
aagatgtgttgt

SEQ ID NO: 3890456 - DNA, 13 bp, Homo sapiens
aagatgttgtcat

SEQ ID NO: 3890457 - DNA, 15 bp, Homo sapiens
aagattcaaagagac

SEQ ID NO: 3890458 - DNA, 18 bp, Homo sapiens
aagattcccagagacagg

SEQ ID NO: 3890459 - DNA, 19 bp, Homo sapiens
aagattcccagagacagga

SEQ ID NO: 3890460 - DNA, 16 bp, Homo sapiens
aagattgcttaaaata

SEQ ID NO: 3890461 - DNA, 22 bp, Homo sapiens
aagattggacatggtctcctct

SEQ ID NO: 3890462 - DNA, 21 bp, Homo sapiens
aagatttttaattacaataat

SEQ ID NO: 3890463 - DNA, 20 bp, Homo sapiens
aagattttttttgtaacttc

SEQ ID NO: 3890464 - DNA, 17 bp, Homo sapiens
aagcaaagcaccagctt

SEQ ID NO: 3890465 - DNA, 13 bp, Homo sapiens
aagcaaatttcaa

SEQ ID NO: 3890466 - DNA, 16 bp, Homo sapiens
aagcaagggctccagc

SEQ ID NO: 3890467 - DNA, 19 bp, Homo sapiens
aagggagaagaaatccata

SEQ ID NO: 3890468 - DNA, 17 bp, Homo sapiens
aagggagagcggggcag

SEQ ID NO: 3890469 - DNA, 24 bp, Homo sapiens
aagggagcactgggttgactttca

SEQ ID NO: 3890470 - DNA, 13 bp, Homo sapiens
aagggagggctct

SEQ ID NO: 3890471 - DNA, 14 bp, Homo sapiens
aagggagggctctg

SEQ ID NO: 3890472 - DNA, 18 bp, Homo sapiens
aagggagggctctgaggc

SEQ ID NO: 3890473 - DNA, 19 bp, Homo sapiens
aagggagggctctgaggcg

SEQ ID NO: 3890474 - DNA, 17 bp, Homo sapiens
aagggagttgctcactc

SEQ ID NO: 3890475 - DNA, 13 bp, Homo sapiens
aagggcagccagg

SEQ ID NO: 3890476 - DNA, 14 bp, Homo sapiens
aagggcagccaggg

SEQ ID NO: 3890477 - DNA, 19 bp, Homo sapiens
aagggcagccaggggctgc

SEQ ID NO: 3890478 - DNA, 9 bp, Homo sapiens
aagggccag

SEQ ID NO: 3890479 - DNA, 12 bp, Homo sapiens
aagggccagccc

SEQ ID NO: 3890480 - DNA, 14 bp, Homo sapiens
aagggccagcccta

SEQ ID NO: 3890481 - DNA, 16 bp, Homo sapiens
aagggccaggagagag

SEQ ID NO: 3890482 - DNA, 18 bp, Homo sapiens
aagggccaggagagagat

SEQ ID NO: 3890483 - DNA, 17 bp, Homo sapiens
aagggccatgctgaagg

SEQ ID NO: 3890484 - DNA, 17 bp, Homo sapiens
aagggctagaacctgga

SEQ ID NO: 3890485 - DNA, 21 bp, Homo sapiens
aagggctccagcatccagcct

SEQ ID NO: 3890486 - DNA, 18 bp, Homo sapiens
aagggctgacctgcctct

SEQ ID NO: 3890487 - DNA, 19 bp, Homo sapiens
aaggggagaagggccagcc

SEQ ID NO: 3890488 - DNA, 14 bp, Homo sapiens
aaggggcacaccac

SEQ ID NO: 3890489 - DNA, 17 bp, Homo sapiens
aaggggcacaccactgc

SEQ ID NO: 3890490 - DNA, 21 bp, Homo sapiens
aaggggcacaccactgccctg

SEQ ID NO: 3890491 - DNA, 23 bp, Homo sapiens
aaggggcacctgggaaaacagag

SEQ ID NO: 3890492 - DNA, 16 bp, Homo sapiens
aaggggcagataaagg

SEQ ID NO: 3890493 - DNA, 17 bp, Homo sapiens
aaggggctcagcaaggt

SEQ ID NO: 3890494 - DNA, 19 bp, Homo sapiens
aagggggagtttttagttt

SEQ ID NO: 3890495 - DNA, 16 bp, Homo sapiens
aagggggtccacccag

SEQ ID NO: 3890496 - DNA, 14 bp, Homo sapiens
aagggtaagggaga

SEQ ID NO: 3890497 - DNA, 17 bp, Homo sapiens
aagggtaagggagaggg

SEQ ID NO: 3890498 - DNA, 13 bp, Homo sapiens
aagggtccagaag

SEQ ID NO: 3890499 - DNA, 22 bp, Homo sapiens
aagggtctagggagagaccctt

SEQ ID NO: 3890500 - DNA, 16 bp, Homo sapiens
aagggtcttcttggca

SEQ ID NO: 3890501 - DNA, 21 bp, Homo sapiens
aagggtgatgggaaagcattg

SEQ ID NO: 3890502 - DNA, 15 bp, Homo sapiens
aagggttgaaggcag

SEQ ID NO: 3890503 - DNA, 17 bp, Homo sapiens
aagggttgaaggcagtc

SEQ ID NO: 3890504 - DNA, 19 bp, Homo sapiens
aagggttggtgggctggcc

SEQ ID NO: 3890505 - DNA, 23 bp, Homo sapiens
aagggtttctgacccaagaggtg

SEQ ID NO: 3890506 - DNA, 17 bp, Homo sapiens
aaggtagaacctcacct

SEQ ID NO: 3890507 - DNA, 22 bp, Homo sapiens
aaggtagacatggatttgatga

SEQ ID NO: 3890508 - DNA, 18 bp, Homo sapiens
aaggtagagatgtgtgtg

SEQ ID NO: 3890509 - DNA, 17 bp, Homo sapiens
aaggtcattgtggctat

SEQ ID NO: 3890510 - DNA, 21 bp, Homo sapiens
aaggtctccttactctgagcc

SEQ ID NO: 3890511 - DNA, 12 bp, Homo sapiens
aaggtctgcttt

SEQ ID NO: 3890512 - DNA, 23 bp, Homo sapiens
aaggtcttcttgtgtcctgatga

SEQ ID NO: 3890513 - DNA, 12 bp, Homo sapiens
aaggtctttgca

SEQ ID NO: 3890514 - DNA, 13 bp, Homo sapiens
aaggtctttggtt

SEQ ID NO: 3890515 - DNA, 18 bp, Homo sapiens
aaggtgcagtaggagcaa

SEQ ID NO: 3890516 - DNA, 18 bp, Homo sapiens
aaggtgcctgtgaggcag

SEQ ID NO: 3890517 - DNA, 14 bp, Homo sapiens
aaggtgctgagctt

SEQ ID NO: 3890518 - DNA, 15 bp, Homo sapiens
aaggtgggtccagga

SEQ ID NO: 3890519 - DNA, 17 bp, Homo sapiens
aaggtgtaaaatatcta

SEQ ID NO: 3890520 - DNA, 23 bp, Homo sapiens
aaggtgtaaaatatctacctgcc

SEQ ID NO: 3890521 - DNA, 18 bp, Homo sapiens
aaggttaggatttaacag

SEQ ID NO: 3890522 - DNA, 19 bp, Homo sapiens
aaggttcttcatccctttc

SEQ ID NO: 3890523 - DNA, 20 bp, Homo sapiens
aaggttcttcatccctttcc

SEQ ID NO: 3890524 - DNA, 13 bp, Homo sapiens
aaggtttggtgtg

SEQ ID NO: 3890525 - DNA, 15 bp, Homo sapiens
aagtaaaaccacagc

SEQ ID NO: 3890526 - DNA, 15 bp, Homo sapiens
aagtaacttttacaa

SEQ ID NO: 3890527 - DNA, 13 bp, Homo sapiens
aagtagaagagga

SEQ ID NO: 3890528 - DNA, 16 bp, Homo sapiens
aagtagaagaggagga

SEQ ID NO: 3890529 - DNA, 17 bp, Homo sapiens
aagtagaattatatcta

SEQ ID NO: 3890530 - DNA, 21 bp, Homo sapiens
aagtagaattatatctaattt

SEQ ID NO: 3890531 - DNA, 23 bp, Homo sapiens
aagtagaattatatctaatttat

SEQ ID NO: 3890532 - DNA, 17 bp, Homo sapiens
aagtagatagaaagcaa

SEQ ID NO: 3890533 - DNA, 21 bp, Homo sapiens
aagtagggacttctgtcttca

SEQ ID NO: 3890534 - DNA, 20 bp, Homo sapiens
aagtagtttgtataacttct

SEQ ID NO: 3890535 - DNA, 23 bp, Homo sapiens
aagtataaagtcacttccagtgt

SEQ ID NO: 3890536 - DNA, 18 bp, Homo sapiens
aagtatatagtatattta

SEQ ID NO: 3890537 - DNA, 13 bp, Homo sapiens
aagtatatattta

SEQ ID NO: 3890538 - DNA, 14 bp, Homo sapiens
aagtatcatgcatt

SEQ ID NO: 3890539 - DNA, 15 bp, Homo sapiens
aagtatcatgcattc

SEQ ID NO: 3890540 - DNA, 21 bp, Homo sapiens
aagtatgtaaacaggagacag

SEQ ID NO: 3890541 - DNA, 20 bp, Homo sapiens
aagtattaggggtaatatat

SEQ ID NO: 3890542 - DNA, 18 bp, Homo sapiens
aagtatttttttaagtta

SEQ ID NO: 3890543 - DNA, 23 bp, Homo sapiens
aagtatttttttaagttagagaa

SEQ ID NO: 3890544 - DNA, 17 bp, Homo sapiens
aagtcaacactcttctt

SEQ ID NO: 3890545 - DNA, 14 bp, Homo sapiens
aagtcaacatcttc

SEQ ID NO: 3890546 - DNA, 18 bp, Homo sapiens
aagtcaacatcttctctc

SEQ ID NO: 3890547 - DNA, 13 bp, Homo sapiens
aagtcaaggagaa

SEQ ID NO: 3890548 - DNA, 13 bp, Homo sapiens
aagtcacagctgc

SEQ ID NO: 3890549 - DNA, 20 bp, Homo sapiens
aagtcaccactccattccca

SEQ ID NO: 3890550 - DNA, 14 bp, Homo sapiens
aagtcacttccagt

SEQ ID NO: 3890551 - DNA, 19 bp, Homo sapiens
aagtcatgatggagacttc

SEQ ID NO: 3890552 - DNA, 16 bp, Homo sapiens
aagtccaacctgcctg

SEQ ID NO: 3890553 - DNA, 17 bp, Homo sapiens
aagtccaagcataccaa

SEQ ID NO: 3890554 - DNA, 20 bp, Homo sapiens
aatcctagaaccaagcttca

SEQ ID NO: 3890555 - DNA, 23 bp, Homo sapiens
aatcctagaaccaagcttcagag

SEQ ID NO: 3890556 - DNA, 11 bp, Homo sapiens
aatcctctggc

SEQ ID NO: 3890557 - DNA, 20 bp, Homo sapiens
aatcctctggggttcatcta

SEQ ID NO: 3890558 - DNA, 22 bp, Homo sapiens
aatcctgaagaaaccacaggtt

SEQ ID NO: 3890559 - DNA, 13 bp, Homo sapiens
aatcctgcctctc

SEQ ID NO: 3890560 - DNA, 17 bp, Homo sapiens
aatccttgcttatgaca

SEQ ID NO: 3890561 - DNA, 18 bp, Homo sapiens
aatccttgcttatgacat

SEQ ID NO: 3890562 - DNA, 18 bp, Homo sapiens
aatcggcccacagctccc

SEQ ID NO: 3890563 - DNA, 16 bp, Homo sapiens
aatctaatattaaaaa

SEQ ID NO: 3890564 - DNA, 17 bp, Homo sapiens
aatctaatattaaaaat

SEQ ID NO: 3890565 - DNA, 20 bp, Homo sapiens
aatctaatattaaaaatatg

SEQ ID NO: 3890566 - DNA, 20 bp, Homo sapiens
aatctagatcaattaattct

SEQ ID NO: 3890567 - DNA, 21 bp, Homo sapiens
aatctagatcaattaattctt

SEQ ID NO: 3890568 - DNA, 19 bp, Homo sapiens
aatctagttttttttgtaa

SEQ ID NO: 3890569 - DNA, 21 bp, Homo sapiens
aatctagttttttttgtaaac

SEQ ID NO: 3890570 - DNA, 23 bp, Homo sapiens
aatctagttttttttgtaaactg

SEQ ID NO: 3890571 - DNA, 14 bp, Homo sapiens
aatctatattaaag

SEQ ID NO: 3890572 - DNA, 21 bp, Homo sapiens
aattgtaaaattgtatagaga

SEQ ID NO: 3890573 - DNA, 18 bp, Homo sapiens
aattgtacattccctgca

SEQ ID NO: 3890574 - DNA, 13 bp, Homo sapiens
aattgtatacatt

SEQ ID NO: 3890575 - DNA, 18 bp, Homo sapiens
aattgtattttatatgag

SEQ ID NO: 3890576 - DNA, 18 bp, Homo sapiens
aattgtccctgtttcaaa

SEQ ID NO: 3890577 - DNA, 20 bp, Homo sapiens
aattgtttggcttcctcctg

SEQ ID NO: 3890578 - DNA, 20 bp, Homo sapiens
aatttaaaccagcagaaaag

SEQ ID NO: 3890579 - DNA, 22 bp, Homo sapiens
aatttaaaccagcagaaaagtg

SEQ ID NO: 3890580 - DNA, 17 bp, Homo sapiens
aatttaactaatttaaa

SEQ ID NO: 3890581 - DNA, 19 bp, Homo sapiens
aatttaataaaaacttcag

SEQ ID NO: 3890582 - DNA, 18 bp, Homo sapiens
aatttagcagtccaaaga

SEQ ID NO: 3890583 - DNA, 20 bp, Homo sapiens
aatttatacaaaataattta

SEQ ID NO: 3890584 - DNA, 22 bp, Homo sapiens
aatttatacaaaataatttaac

SEQ ID NO: 3890585 - DNA, 17 bp, Homo sapiens
aatttatatttgaaatt

SEQ ID NO: 3890586 - DNA, 18 bp, Homo sapiens
aatttatcctgaaatttc

SEQ ID NO: 3890587 - DNA, 19 bp, Homo sapiens
aatttatcctgaaatttca

SEQ ID NO: 3890588 - DNA, 15 bp, Homo sapiens
aatttattaaaatga

SEQ ID NO: 3890589 - DNA, 19 bp, Homo sapiens
aatttattacttgttgcaa

SEQ ID NO: 3890590 - DNA, 18 bp, Homo sapiens
aatttattagttaatata

SEQ ID NO: 3890591 - DNA, 16 bp, Homo sapiens
aatttattattgttct

SEQ ID NO: 3890592 - DNA, 19 bp, Homo sapiens
aatttcaaccagcattcat

SEQ ID NO: 3890593 - DNA, 16 bp, Homo sapiens
aatttcaggcattttg

SEQ ID NO: 3890594 - DNA, 21 bp, Homo sapiens
aatttcaggcattttgttcta

SEQ ID NO: 3890595 - DNA, 20 bp, Homo sapiens
aatttcaggttttgtaaaga

SEQ ID NO: 3890596 - DNA, 22 bp, Homo sapiens
aatttcaggttttgtaaagatg

SEQ ID NO: 3890597 - DNA, 22 bp, Homo sapiens
aatttcccacaccccagcgcct

SEQ ID NO: 3890598 - DNA, 16 bp, Homo sapiens
aatttctaccatttca

SEQ ID NO: 3890599 - DNA, 21 bp, Homo sapiens
aatttcttcactgttgaaaat

SEQ ID NO: 3890600 - DNA, 14 bp, Homo sapiens
aatttgagcaattc

SEQ ID NO: 3890601 - DNA, 14 bp, Homo sapiens
aatttgaggacaac

SEQ ID NO: 3890602 - DNA, 20 bp, Homo sapiens
aatttgatacatatgtgaat

SEQ ID NO: 3890603 - DNA, 15 bp, Homo sapiens
aatttgggcctcttg

SEQ ID NO: 3890604 - DNA, 19 bp, Homo sapiens
aatttgggcctcttgtaca

SEQ ID NO: 3890605 - DNA, 15 bp, Homo sapiens
aatttgtaagtttat

SEQ ID NO: 3890606 - DNA, 20 bp, Homo sapiens
aatttgtacatatgtaaaat

SEQ ID NO: 3890607 - DNA, 12 bp, Homo sapiens
aatttgtatctg

SEQ ID NO: 3890608 - DNA, 18 bp, Homo sapiens
aatttgtatctgaaggag

SEQ ID NO: 3890609 - DNA, 19 bp, Homo sapiens
aatttgtatctgaaggaga

SEQ ID NO: 3890610 - DNA, 14 bp, Homo sapiens
aattttaacatttt

SEQ ID NO: 3890611 - DNA, 17 bp, Homo sapiens
aattttaacttaaattt

SEQ ID NO: 3890612 - DNA, 21 bp, Homo sapiens
aattttacttttgttctgtat

SEQ ID NO: 3890613 - DNA, 23 bp, Homo sapiens
aattttattggtaggatttatat

SEQ ID NO: 3890614 - DNA, 15 bp, Homo sapiens
aattttcaagagaag

SEQ ID NO: 3890615 - DNA, 20 bp, Homo sapiens
aattttcaagagaagaaaaa

SEQ ID NO: 3890616 - DNA, 12 bp, Homo sapiens
aattttctagac

SEQ ID NO: 3890617 - DNA, 15 bp, Homo sapiens
aattttctagacttt

SEQ ID NO: 3890618 - DNA, 22 bp, Homo sapiens
aattttctggaatacatgaaat

SEQ ID NO: 3890619 - DNA, 20 bp, Homo sapiens
aattttcttacccatatatc

SEQ ID NO: 3890620 - DNA, 18 bp, Homo sapiens
aattttgaatgtttatgt

SEQ ID NO: 3890621 - DNA, 16 bp, Homo sapiens
aattttgtatgaaaaa

SEQ ID NO: 3890622 - DNA, 12 bp, Homo sapiens
aattttgtttca

SEQ ID NO: 3890623 - DNA, 13 bp, Homo sapiens
aattttgtttgta

SEQ ID NO: 3890624 - DNA, 18 bp, Homo sapiens
aattttgtttgtaatcct

SEQ ID NO: 3890625 - DNA, 13 bp, Homo sapiens
aatttttaaacta

SEQ ID NO: 3890626 - DNA, 18 bp, Homo sapiens
aatttttaaactagtaat

SEQ ID NO: 3890627 - DNA, 19 bp, Homo sapiens
aatttttaaagtatatatt

SEQ ID NO: 3890628 - DNA, 20 bp, Homo sapiens
aatttttaaagtatatattt

SEQ ID NO: 3890629 - DNA, 21 bp, Homo sapiens
aatttttaatgactttttata

SEQ ID NO: 3890630 - DNA, 16 bp, Homo sapiens
aatttttacatgacca

SEQ ID NO: 3890631 - DNA, 14 bp, Homo sapiens
aatttttatacata

SEQ ID NO: 3890632 - DNA, 19 bp, Homo sapiens
aatttttatacatatcaga

SEQ ID NO: 3890633 - DNA, 21 bp, Homo sapiens
aatttttatacatatcagaaa

SEQ ID NO: 3890634 - DNA, 16 bp, Homo sapiens
aatttttatttttcta

SEQ ID NO: 3890635 - DNA, 21 bp, Homo sapiens
aatttttcagctctctgtata

SEQ ID NO: 3890636 - DNA, 19 bp, Homo sapiens
aattttttgatgtcagcct

SEQ ID NO: 3890637 - DNA, 19 bp, Homo sapiens
aatttttttatactaccaa

SEQ ID NO: 3890638 - DNA, 20 bp, Homo sapiens
aattttttttaatgtacaag

SEQ ID NO: 3890639 - DNA, 12 bp, Homo sapiens
acaaaaaagaag

SEQ ID NO: 3890640 - DNA, 14 bp, Homo sapiens
acaaaaacaaaaca

SEQ ID NO: 3890641 - DNA, 14 bp, Homo sapiens
acaaaaacacagca

SEQ ID NO: 3890642 - DNA, 15 bp, Homo sapiens
acaaaaacacagcaa

SEQ ID NO: 3890643 - DNA, 16 bp, Homo sapiens
acaaaaacacagcaag

SEQ ID NO: 3890644 - DNA, 21 bp, Homo sapiens
acaaaaatgtaatgatcataa

SEQ ID NO: 3890645 - DNA, 13 bp, Homo sapiens
acaaaacaacaac

SEQ ID NO: 3890646 - DNA, 16 bp, Homo sapiens
acaaaacaagaaagaa

SEQ ID NO: 3890647 - DNA, 13 bp, Homo sapiens
acaaaacttcctg

SEQ ID NO: 3890648 - DNA, 14 bp, Homo sapiens
acaaaagagagaat

SEQ ID NO: 3890649 - DNA, 23 bp, Homo sapiens
acaaaagcaagactgttgctcaa

SEQ ID NO: 3890650 - DNA, 12 bp, Homo sapiens
acaaaataattt

SEQ ID NO: 3890651 - DNA, 13 bp, Homo sapiens
acaaaataattta

SEQ ID NO: 3890652 - DNA, 21 bp, Homo sapiens
acaaaataatttaactaattt

SEQ ID NO: 3890653 - DNA, 12 bp, Homo sapiens
acaaaatagaag

SEQ ID NO: 3890654 - DNA, 15 bp, Homo sapiens
acaaaatagaagctg

SEQ ID NO: 3890655 - DNA, 18 bp, Homo sapiens
acaaaatagaagctgtag

SEQ ID NO: 3890656 - DNA, 13 bp, Homo sapiens
acaaaatcacaag

SEQ ID NO: 3890657 - DNA, 15 bp, Homo sapiens
acaaaatcacaagca

SEQ ID NO: 3890658 - DNA, 23 bp, Homo sapiens
acaaaatcacaagcaataattag

SEQ ID NO: 3890659 - DNA, 15 bp, Homo sapiens
cctctttactccctt

SEQ ID NO: 3890660 - DNA, 16 bp, Homo sapiens
cctctttccccacctc

SEQ ID NO: 3890661 - DNA, 17 bp, Homo sapiens
cctctttccccacctct

SEQ ID NO: 3890662 - DNA, 22 bp, Homo sapiens
cctctttctacattctcatcta

SEQ ID NO: 3890663 - DNA, 15 bp, Homo sapiens
cctctttctctcctt

SEQ ID NO: 3890664 - DNA, 17 bp, Homo sapiens
cctctttctctccttct

SEQ ID NO: 3890665 - DNA, 14 bp, Homo sapiens
cctgaaaaactgat

SEQ ID NO: 3890666 - DNA, 13 bp, Homo sapiens
cctgaaaattgta

SEQ ID NO: 3890667 - DNA, 14 bp, Homo sapiens
cctgaaatttcaga

SEQ ID NO: 3890668 - DNA, 15 bp, Homo sapiens
cctgaacatgacatt

SEQ ID NO: 3890669 - DNA, 20 bp, Homo sapiens
cctgaaccccatgggcttgg

SEQ ID NO: 3890670 - DNA, 14 bp, Homo sapiens
cctgaacctcagtt

SEQ ID NO: 3890671 - DNA, 18 bp, Homo sapiens
cctgaacctcagtttcct

SEQ ID NO: 3890672 - DNA, 14 bp, Homo sapiens
cctgaagaacagta

SEQ ID NO: 3890673 - DNA, 13 bp, Homo sapiens
cctgaagcctctg

SEQ ID NO: 3890674 - DNA, 15 bp, Homo sapiens
cctgaagcctctgcc

SEQ ID NO: 3890675 - DNA, 21 bp, Homo sapiens
cctgaagcctctgccctgcct

SEQ ID NO: 3890676 - DNA, 20 bp, Homo sapiens
cctgaagggtgacatcccag

SEQ ID NO: 3890677 - DNA, 15 bp, Homo sapiens
cctgaaggttcctga

SEQ ID NO: 3890678 - DNA, 20 bp, Homo sapiens
cctgaatataacaaccttta

SEQ ID NO: 3890679 - DNA, 16 bp, Homo sapiens
cctgacagaaggactc

SEQ ID NO: 3890680 - DNA, 14 bp, Homo sapiens
cctgacatgtctca

SEQ ID NO: 3890681 - DNA, 21 bp, Homo sapiens
cctgacattaagacacacctc

SEQ ID NO: 3890682 - DNA, 23 bp, Homo sapiens
cctgacattaagacacacctctg

SEQ ID NO: 3890683 - DNA, 19 bp, Homo sapiens
cctgaccaacatggagaaa

SEQ ID NO: 3890684 - DNA, 13 bp, Homo sapiens
cctgaccggcacc

SEQ ID NO: 3890685 - DNA, 19 bp, Homo sapiens
cctgaccggcacctgcgag

SEQ ID NO: 3890686 - DNA, 12 bp, Homo sapiens
cctgacctccca

SEQ ID NO: 3890687 - DNA, 15 bp, Homo sapiens
cctgacctcccagcc

SEQ ID NO: 3890688 - DNA, 14 bp, Homo sapiens
cctgacctgaggct

SEQ ID NO: 3890689 - DNA, 15 bp, Homo sapiens
cctgacctgaggctc

SEQ ID NO: 3890690 - DNA, 18 bp, Homo sapiens
cctgacgccctgcgttgg

SEQ ID NO: 3890691 - DNA, 21 bp, Homo sapiens
cctgacgccctgcgttggagc

SEQ ID NO: 3890692 - DNA, 13 bp, Homo sapiens
cctgactcctcta

SEQ ID NO: 3890693 - DNA, 20 bp, Homo sapiens
cctgactcctctaagccact

SEQ ID NO: 3890694 - DNA, 21 bp, Homo sapiens
cctgactggtgctataggctg

SEQ ID NO: 3890695 - DNA, 19 bp, Homo sapiens
cctgagaaggcgaggagag

SEQ ID NO: 3890696 - DNA, 22 bp, Homo sapiens
cctgagaataagaaagtttcac

SEQ ID NO: 3890697 - DNA, 22 bp, Homo sapiens
cctgagaccagttgggagcact

SEQ ID NO: 3890698 - DNA, 15 bp, Homo sapiens
cctgagatcagagtc

SEQ ID NO: 3890699 - DNA, 16 bp, Homo sapiens
cctgagcactgccagg

SEQ ID NO: 3890700 - DNA, 16 bp, Homo sapiens
cctgagcccaggagct

SEQ ID NO: 3890701 - DNA, 13 bp, Homo sapiens
cctgagcccaggg

SEQ ID NO: 3890702 - DNA, 16 bp, Homo sapiens
cctgagcccagggagg

SEQ ID NO: 3890703 - DNA, 17 bp, Homo sapiens
cctgagcccagggaggc

SEQ ID NO: 3890704 - DNA, 18 bp, Homo sapiens
cctgagcccagggaggcc

SEQ ID NO: 3890705 - DNA, 12 bp, Homo sapiens
cctgagcctgcc

SEQ ID NO: 3890706 - DNA, 13 bp, Homo sapiens
cctgagcctgccg

SEQ ID NO: 3890707 - DNA, 14 bp, Homo sapiens
cctgagcctgccga

SEQ ID NO: 3890708 - DNA, 17 bp, Homo sapiens
cctgagcctgccgagca

SEQ ID NO: 3890709 - DNA, 11 bp, Homo sapiens
cctgagctaga

SEQ ID NO: 3890710 - DNA, 14 bp, Homo sapiens
cctgaggagtctga

SEQ ID NO: 3890711 - DNA, 15 bp, Homo sapiens
cctgaggctcaagag

SEQ ID NO: 3890712 - DNA, 16 bp, Homo sapiens
cctgaggctcaagagg

SEQ ID NO: 3890713 - DNA, 18 bp, Homo sapiens
cctgaggctcaagaggcc

SEQ ID NO: 3890714 - DNA, 16 bp, Homo sapiens
cctgagggtggagact

SEQ ID NO: 3890715 - DNA, 18 bp, Homo sapiens
cctgagtcaactggagca

SEQ ID NO: 3890716 - DNA, 19 bp, Homo sapiens
cctgagtcaactggagcaa

SEQ ID NO: 3890717 - DNA, 22 bp, Homo sapiens
cctgagtcaactggagcaagaa

SEQ ID NO: 3890718 - DNA, 15 bp, Homo sapiens
cctgagtcaccagga

SEQ ID NO: 3890719 - DNA, 19 bp, Homo sapiens
cctgagtcggccccacatg

SEQ ID NO: 3890720 - DNA, 16 bp, Homo sapiens
cctgagtctcctgtgc

SEQ ID NO: 3890721 - DNA, 19 bp, Homo sapiens
cctgagtcttggcctgcct

SEQ ID NO: 3890722 - DNA, 18 bp, Homo sapiens
cctgagtggatctccaag

SEQ ID NO: 3890723 - DNA, 23 bp, Homo sapiens
cctgataaacattaaacactgta

SEQ ID NO: 3890724 - DNA, 16 bp, Homo sapiens
cctgataccctgcttg

SEQ ID NO: 3890725 - DNA, 23 bp, Homo sapiens
cctgatcatggtcagctcacacc

SEQ ID NO: 3890726 - DNA, 12 bp, Homo sapiens
cctgatgcccct

SEQ ID NO: 3890727 - DNA, 13 bp, Homo sapiens
cctgatgcccctt

SEQ ID NO: 3890728 - DNA, 23 bp, Homo sapiens
cctgatgctgccccgttccctgt

SEQ ID NO: 3890729 - DNA, 18 bp, Homo sapiens
cctgatggtacaggaaag

SEQ ID NO: 3890730 - DNA, 13 bp, Homo sapiens
cctgattccccac

SEQ ID NO: 3890731 - DNA, 15 bp, Homo sapiens
cctgattttgtagtt

SEQ ID NO: 3890732 - DNA, 14 bp, Homo sapiens
cctgcaaactcact

SEQ ID NO: 3890733 - DNA, 22 bp, Homo sapiens
cctgcaaactcactgctcaaga

SEQ ID NO: 3890734 - DNA, 19 bp, Homo sapiens
cctgcaagccccagggcct

SEQ ID NO: 3890735 - DNA, 21 bp, Homo sapiens
cctgcaagccccagggcctgg

SEQ ID NO: 3890736 - DNA, 22 bp, Homo sapiens
cctgcaagccccagggcctggg

SEQ ID NO: 3890737 - DNA, 23 bp, Homo sapiens
cctgcaagccccagggcctgggg

SEQ ID NO: 3890738 - DNA, 16 bp, Homo sapiens
cctgcaatctccaggg

SEQ ID NO: 3890739 - DNA, 17 bp, Homo sapiens
cctgcaatctccagggc

SEQ ID NO: 3890740 - DNA, 18 bp, Homo sapiens
cctgcaatctccagggct

SEQ ID NO: 3890741 - DNA, 23 bp, Homo sapiens
cctgcaatctccagggctgcccc

SEQ ID NO: 3890742 - DNA, 18 bp, Homo sapiens
cctgcaccagcccttccc

SEQ ID NO: 3890743 - DNA, 18 bp, Homo sapiens
cctgcacctccccccact

SEQ ID NO: 3890744 - DNA, 12 bp, Homo sapiens
cctgcactccag

SEQ ID NO: 3890745 - DNA, 15 bp, Homo sapiens
cctgcactccagaat

SEQ ID NO: 3890746 - DNA, 11 bp, Homo sapiens
cgctgctgcta

SEQ ID NO: 3890747 - DNA, 18 bp, Homo sapiens
cgctgcttcgtgggatac

SEQ ID NO: 3890748 - DNA, 12 bp, Homo sapiens
cgctggaatcaa

SEQ ID NO: 3890749 - DNA, 16 bp, Homo sapiens
cgctggacaacccaga

SEQ ID NO: 3890750 - DNA, 22 bp, Homo sapiens
cgctgggatttcttcgctgctc

SEQ ID NO: 3890751 - DNA, 23 bp, Homo sapiens
cgctggggaacagagcgggcctc

SEQ ID NO: 3890752 - DNA, 14 bp, Homo sapiens
cgctgggggtgggg

SEQ ID NO: 3890753 - DNA, 17 bp, Homo sapiens
cgctgtcgccccaggcc

SEQ ID NO: 3890754 - DNA, 23 bp, Homo sapiens
cgctgtcgccccaggccctccct

SEQ ID NO: 3890755 - DNA, 14 bp, Homo sapiens
cgctgttcacccac

SEQ ID NO: 3890756 - DNA, 13 bp, Homo sapiens
cgcttcacccctg

SEQ ID NO: 3890757 - DNA, 15 bp, Homo sapiens
cgcttcacccctgca

SEQ ID NO: 3890758 - DNA, 12 bp, Homo sapiens
cgcttccagacc

SEQ ID NO: 3890759 - DNA, 13 bp, Homo sapiens
cgcttccagacca

SEQ ID NO: 3890760 - DNA, 15 bp, Homo sapiens
cgcttccagaccacc

SEQ ID NO: 3890761 - DNA, 19 bp, Homo sapiens
cgcttccagaccacctgcc

SEQ ID NO: 3890762 - DNA, 22 bp, Homo sapiens
cgcttccagaccacctgccagc

SEQ ID NO: 3890763 - DNA, 21 bp, Homo sapiens
cgcttccttagccttgctcag

SEQ ID NO: 3890764 - DNA, 14 bp, Homo sapiens
cgcttctcctccag

SEQ ID NO: 3890765 - DNA, 12 bp, Homo sapiens
cgcttgagccca

SEQ ID NO: 3890766 - DNA, 14 bp, Homo sapiens
cgcttgagcccagg

SEQ ID NO: 3890767 - DNA, 17 bp, Homo sapiens
cgcttgagcccaggagt

SEQ ID NO: 3890768 - DNA, 18 bp, Homo sapiens
cgcttgagcccaggagtt

SEQ ID NO: 3890769 - DNA, 13 bp, Homo sapiens
cgcttgcttctgc

SEQ ID NO: 3890770 - DNA, 17 bp, Homo sapiens
cgcttgcttctgcagca

SEQ ID NO: 3890771 - DNA, 22 bp, Homo sapiens
cgcttgcttctgcagcaactcc

SEQ ID NO: 3890772 - DNA, 23 bp, Homo sapiens
cgcttgcttctgcagcaactccc

SEQ ID NO: 3890773 - DNA, 20 bp, Homo sapiens
cggaagcctttttccccaaa

SEQ ID NO: 3890774 - DNA, 22 bp, Homo sapiens
cggaaggggacgcgggctgtgc

SEQ ID NO: 3890775 - DNA, 21 bp, Homo sapiens
cggaattctcgggaaattatt

SEQ ID NO: 3890776 - DNA, 20 bp, Homo sapiens
cggaccaagatgggcacatg

SEQ ID NO: 3890777 - DNA, 22 bp, Homo sapiens
cggaccaagatgggcacatgag

SEQ ID NO: 3890778 - DNA, 17 bp, Homo sapiens
cggaccgcgtagagagc

SEQ ID NO: 3890779 - DNA, 18 bp, Homo sapiens
cggaccgcgtagagagcc

SEQ ID NO: 3890780 - DNA, 21 bp, Homo sapiens
cggacgtcctgctggcacctc

SEQ ID NO: 3890781 - DNA, 15 bp, Homo sapiens
cggacgtttccatca

SEQ ID NO: 3890782 - DNA, 15 bp, Homo sapiens
cggagaattgcctct

SEQ ID NO: 3890783 - DNA, 14 bp, Homo sapiens
cggagaccctgagt

SEQ ID NO: 3890784 - DNA, 18 bp, Homo sapiens
cggagagtacagtgagcc

SEQ ID NO: 3890785 - DNA, 21 bp, Homo sapiens
cggagagtacagtgagccaag

SEQ ID NO: 3890786 - DNA, 22 bp, Homo sapiens
cggaggagctccgctaagacct

SEQ ID NO: 3890787 - DNA, 16 bp, Homo sapiens
cggaggcggctccagg

SEQ ID NO: 3890788 - DNA, 16 bp, Homo sapiens
cggaggggcctggcag

SEQ ID NO: 3890789 - DNA, 14 bp, Homo sapiens
cggaggtggtggag

SEQ ID NO: 3890790 - DNA, 19 bp, Homo sapiens
cggaggtggtggaggagga

SEQ ID NO: 3890791 - DNA, 16 bp, Homo sapiens
cggagtaatcaggcag

SEQ ID NO: 3890792 - DNA, 17 bp, Homo sapiens
cggagtaatcaggcagc

SEQ ID NO: 3890793 - DNA, 20 bp, Homo sapiens
cggatcgaggacaagtgaga

SEQ ID NO: 3890794 - DNA, 17 bp, Homo sapiens
cggcaaccccagttctg

SEQ ID NO: 3890795 - DNA, 19 bp, Homo sapiens
cggcaaccccagttctgct

SEQ ID NO: 3890796 - DNA, 20 bp, Homo sapiens
cggcaaccccagttctgctc

SEQ ID NO: 3890797 - DNA, 21 bp, Homo sapiens
cggcaaccccagttctgctcc

SEQ ID NO: 3890798 - DNA, 20 bp, Homo sapiens
cggcaccccctgcagcttgt

SEQ ID NO: 3890799 - DNA, 17 bp, Homo sapiens
cggcagagaccccagga

SEQ ID NO: 3890800 - DNA, 18 bp, Homo sapiens
cggcagagaccccaggat

SEQ ID NO: 3890801 - DNA, 10 bp, Homo sapiens
cggcagctgt

SEQ ID NO: 3890802 - DNA, 20 bp, Homo sapiens
cggcaggagcaggaacagag

SEQ ID NO: 3890803 - DNA, 15 bp, Homo sapiens
cggcaggctgggttc

SEQ ID NO: 3890804 - DNA, 19 bp, Homo sapiens
cggcatattattccatatc

SEQ ID NO: 3890805 - DNA, 11 bp, Homo sapiens
cggccaccctc

SEQ ID NO: 3890806 - DNA, 15 bp, Homo sapiens
cggccagggcctggt

SEQ ID NO: 3890807 - DNA, 18 bp, Homo sapiens
cggcccagaagtttccct

SEQ ID NO: 3890808 - DNA, 21 bp, Homo sapiens
cggcccagagaccccttcctt

SEQ ID NO: 3890809 - DNA, 13 bp, Homo sapiens
cggccgcattccc

SEQ ID NO: 3890810 - DNA, 13 bp, Homo sapiens
cggccgggctgcc

SEQ ID NO: 3890811 - DNA, 17 bp, Homo sapiens
cggcctatgacttgggc

SEQ ID NO: 3890812 - DNA, 18 bp, Homo sapiens
cggcctatgacttgggca

SEQ ID NO: 3890813 - DNA, 19 bp, Homo sapiens
cggcctatgacttgggcac

SEQ ID NO: 3890814 - DNA, 14 bp, Homo sapiens
cggcctcagcaccc

SEQ ID NO: 3890815 - DNA, 10 bp, Homo sapiens
cggcctccac

SEQ ID NO: 3890816 - DNA, 22 bp, Homo sapiens
cggcctccgtccaggagcctgg

SEQ ID NO: 3890817 - DNA, 19 bp, Homo sapiens
cggcctctctcttcccagc

SEQ ID NO: 3890818 - DNA, 12 bp, Homo sapiens
cggcctcttcca

SEQ ID NO: 3890819 - DNA, 15 bp, Homo sapiens
cggccttccaccggg

SEQ ID NO: 3890820 - DNA, 20 bp, Homo sapiens
cggcgcggtggctcacgcct

SEQ ID NO: 3890821 - DNA, 14 bp, Homo sapiens
cggctactcagcag

SEQ ID NO: 3890822 - DNA, 18 bp, Homo sapiens
cggctccaggtccggagg

SEQ ID NO: 3890823 - DNA, 20 bp, Homo sapiens
cggctgagtcatgatctccc

SEQ ID NO: 3890824 - DNA, 13 bp, Homo sapiens
cggctgcctgccg

SEQ ID NO: 3890825 - DNA, 14 bp, Homo sapiens
cggctgcctgccgc

SEQ ID NO: 3890826 - DNA, 17 bp, Homo sapiens
cggctgcctgccgccca

SEQ ID NO: 3890827 - DNA, 15 bp, Homo sapiens
cggcttcctgtccac

SEQ ID NO: 3890828 - DNA, 21 bp, Homo sapiens
cgggaagcctccgtcaggaga

SEQ ID NO: 3890829 - DNA, 15 bp, Homo sapiens
cgggacagagaggag

SEQ ID NO: 3890830 - DNA, 19 bp, Homo sapiens
cgggaccattgacctcagc

SEQ ID NO: 3890831 - DNA, 19 bp, Homo sapiens
cgggaccccctggccctgc

SEQ ID NO: 3890832 - DNA, 21 bp, Homo sapiens
cgggacgagaccctacaggag

SEQ ID NO: 3890833 - DNA, 14 bp, Homo sapiens
cgggacgcttccag

SEQ ID NO: 3890834 - DNA, 15 bp, Homo sapiens
cgggacgcttccaga

SEQ ID NO: 3890835 - DNA, 17 bp, Homo sapiens
cgggacgcttccagacc

SEQ ID NO: 3890836 - DNA, 20 bp, Homo sapiens
cgggacgcttccagaccacc

SEQ ID NO: 3890837 - DNA, 23 bp, Homo sapiens
cgggacgcttccagaccacctgc

SEQ ID NO: 3890838 - DNA, 15 bp, Homo sapiens
cgggagaggactctg

SEQ ID NO: 3890839 - DNA, 21 bp, Homo sapiens
cgggaggactccgggaccatt

SEQ ID NO: 3890840 - DNA, 14 bp, Homo sapiens
cgggaggcctcagt

SEQ ID NO: 3890841 - DNA, 13 bp, Homo sapiens
cgggaggctgaga

SEQ ID NO: 3890842 - DNA, 18 bp, Homo sapiens
cgggataacaaaatcaca

SEQ ID NO: 3890843 - DNA, 14 bp, Homo sapiens
cgggcacctgtagt

SEQ ID NO: 3890844 - DNA, 21 bp, Homo sapiens
cgggcaggtcctgcccatgtg

SEQ ID NO: 3890845 - DNA, 18 bp, Homo sapiens
cgggcatgtattatcaca

SEQ ID NO: 3890846 - DNA, 19 bp, Homo sapiens
cgggccactccttcctgcc

SEQ ID NO: 3890847 - DNA, 16 bp, Homo sapiens
cgggcctcagtttccc

SEQ ID NO: 3890848 - DNA, 19 bp, Homo sapiens
cgggcctcagtttccccat

SEQ ID NO: 3890849 - DNA, 17 bp, Homo sapiens
cgggcctcttccctcag

SEQ ID NO: 3890850 - DNA, 22 bp, Homo sapiens
cgggctgcccttcgctgccagg

SEQ ID NO: 3890851 - DNA, 20 bp, Homo sapiens
cgggctgggagctctgcaga

SEQ ID NO: 3890852 - DNA, 21 bp, Homo sapiens
cggggaacccagccctggggt

SEQ ID NO: 3890853 - DNA, 17 bp, Homo sapiens
cggggcaggaggcctgg

SEQ ID NO: 3890854 - DNA, 23 bp, Homo sapiens
cggggcgggggcccgaaagctga

SEQ ID NO: 3890855 - DNA, 17 bp, Homo sapiens
cgggggccagacacaga

SEQ ID NO: 3890856 - DNA, 22 bp, Homo sapiens
cgggggcccgaaagctgagacc

SEQ ID NO: 3890857 - DNA, 19 bp, Homo sapiens
cgggggtgcggcaggagca

SEQ ID NO: 3890858 - DNA, 23 bp, Homo sapiens
cgggggtggcaagggggcggggc

SEQ ID NO: 3890859 - DNA, 14 bp, Homo sapiens
cggggtctgtgctg

SEQ ID NO: 3890860 - DNA, 21 bp, Homo sapiens
cggggtctgtgctgtgcctgc

SEQ ID NO: 3890861 - DNA, 17 bp, Homo sapiens
cgggtccgattaattta

SEQ ID NO: 3890862 - DNA, 22 bp, Homo sapiens
cgggtgcatttgagagaagcca

SEQ ID NO: 3890863 - DNA, 15 bp, Homo sapiens
cgggtgggcctggcc

SEQ ID NO: 3890864 - DNA, 16 bp, Homo sapiens
cgggtgggcctggcct

SEQ ID NO: 3890865 - DNA, 20 bp, Homo sapiens
cgggtgggcctggcctgagc

SEQ ID NO: 3890866 - DNA, 22 bp, Homo sapiens
cgggtgggcctggcctgagctg

SEQ ID NO: 3890867 - DNA, 22 bp, Homo sapiens
cgggtgtggcctcagccctcag

SEQ ID NO: 3890868 - DNA, 20 bp, Homo sapiens
cggtaaaacaccggagacta

SEQ ID NO: 3890869 - DNA, 16 bp, Homo sapiens
cggtaggccaagctga

SEQ ID NO: 3890870 - DNA, 18 bp, Homo sapiens
cggtcctttaggcagcct

SEQ ID NO: 3890871 - DNA, 22 bp, Homo sapiens
cggtcgggttttattgtttaaa

SEQ ID NO: 3890872 - DNA, 14 bp, Homo sapiens
cggtgaggccgggc

SEQ ID NO: 3890873 - DNA, 19 bp, Homo sapiens
cggtgcgtggctgtggcac

SEQ ID NO: 3890874 - DNA, 24 bp, Homo sapiens
cggtgcgtggctgtggcacagact

SEQ ID NO: 3890875 - DNA, 22 bp, Homo sapiens
cggtgctcgcttctcctccagg

SEQ ID NO: 3890876 - DNA, 11 bp, Homo sapiens
cggtggctcac

SEQ ID NO: 3890877 - DNA, 20 bp, Homo sapiens
cggtggctcacgcctgtaat

SEQ ID NO: 3890878 - DNA, 14 bp, Homo sapiens
cggtgggacagccc

SEQ ID NO: 3890879 - DNA, 14 bp, Homo sapiens
cggtggtgccagag

SEQ ID NO: 3890880 - DNA, 13 bp, Homo sapiens
cggtttctgagca

SEQ ID NO: 3890881 - DNA, 20 bp, Homo sapiens
cggtttctgagcataatgct

SEQ ID NO: 3890882 - DNA, 13 bp, Homo sapiens
cgtaatgggcctg

SEQ ID NO: 3890883 - DNA, 17 bp, Homo sapiens
cgtaatgggcctgccca

SEQ ID NO: 3890884 - DNA, 14 bp, Homo sapiens
cgtacttaactgtg

SEQ ID NO: 3890885 - DNA, 20 bp, Homo sapiens
cgtaggcagcctctctgcta

SEQ ID NO: 3890886 - DNA, 14 bp, Homo sapiens
cgtagttccctgaa

SEQ ID NO: 3890887 - DNA, 22 bp, Homo sapiens
cgtatatgtctcaggtccctgc

SEQ ID NO: 3890888 - DNA, 19 bp, Homo sapiens
cgtatttatatttggaaag

SEQ ID NO: 3890889 - DNA, 22 bp, Homo sapiens
cgtcaggagagacgcagccctg

SEQ ID NO: 3890890 - DNA, 19 bp, Homo sapiens
cgtcatcacttttcagtga

SEQ ID NO: 3890891 - DNA, 20 bp, Homo sapiens
cgtcatcggaggctgggccc

SEQ ID NO: 3890892 - DNA, 14 bp, Homo sapiens
cgtccacaggggca

SEQ ID NO: 3890893 - DNA, 17 bp, Homo sapiens
cgtccacaggggcaggc

SEQ ID NO: 3890894 - DNA, 13 bp, Homo sapiens
cgtccacccaggc

SEQ ID NO: 3890895 - DNA, 15 bp, Homo sapiens
cgtccacccaggctg

SEQ ID NO: 3890896 - DNA, 19 bp, Homo sapiens
cgtccacccaggctgcact

SEQ ID NO: 3890897 - DNA, 23 bp, Homo sapiens
cgtccacccaggctgcactgcag

SEQ ID NO: 3890898 - DNA, 15 bp, Homo sapiens
cgtccctagcagtga

SEQ ID NO: 3890899 - DNA, 22 bp, Homo sapiens
cgtcccttggaaagttcagcca

SEQ ID NO: 3890900 - DNA, 15 bp, Homo sapiens
cgtcctccccctgcc

SEQ ID NO: 3890901 - DNA, 17 bp, Homo sapiens
cgtcctccccctgccag

SEQ ID NO: 3890902 - DNA, 22 bp, Homo sapiens
cgtcctccccctgccagtgcct

SEQ ID NO: 3890903 - DNA, 17 bp, Homo sapiens
cgtcctgacgccctgcg

SEQ ID NO: 3890904 - DNA, 14 bp, Homo sapiens
cgtcctgcagagga

SEQ ID NO: 3890905 - DNA, 12 bp, Homo sapiens
cgtcctgctggc

SEQ ID NO: 3890906 - DNA, 12 bp, Homo sapiens
cgtcctgtccca

SEQ ID NO: 3890907 - DNA, 13 bp, Homo sapiens
cgtcctgtcccag

SEQ ID NO: 3890908 - DNA, 21 bp, Homo sapiens
cgtccttactcctgtgggagc

SEQ ID NO: 3890909 - DNA, 20 bp, Homo sapiens
cgtcgctggacaacccagaa

SEQ ID NO: 3890910 - DNA, 21 bp, Homo sapiens
cgtcgctggacaacccagaac

SEQ ID NO: 3890911 - DNA, 19 bp, Homo sapiens
cgtctgactccagagtctg

SEQ ID NO: 3890912 - DNA, 14 bp, Homo sapiens
cgtctgccaggccc

SEQ ID NO: 3890913 - DNA, 18 bp, Homo sapiens
cgtctgccaggcccatct

SEQ ID NO: 3890914 - DNA, 23 bp, Homo sapiens
cgtctggggttcagcccctcctc

SEQ ID NO: 3890915 - DNA, 16 bp, Homo sapiens
cgtcttgggtcgccct

SEQ ID NO: 3890916 - DNA, 19 bp, Homo sapiens
cgtgaaagaattatttttg

SEQ ID NO: 3890917 - DNA, 19 bp, Homo sapiens
cgtgacccttcagggccag

SEQ ID NO: 3890918 - DNA, 13 bp, Homo sapiens
cgtgactcaccca

SEQ ID NO: 3890919 - DNA, 21 bp, Homo sapiens
cgtgactgccccaactcctgg

SEQ ID NO: 3890920 - DNA, 22 bp, Homo sapiens
cgtgactgccccaactcctgga

SEQ ID NO: 3890921 - DNA, 15 bp, Homo sapiens
cgtgcaaggggctca

SEQ ID NO: 3890922 - DNA, 22 bp, Homo sapiens
cgtgcaccaccatgccaggcta

SEQ ID NO: 3890923 - DNA, 20 bp, Homo sapiens
cgtgccaagtccaggtcctg

SEQ ID NO: 3890924 - DNA, 23 bp, Homo sapiens
cgtgccacccgtaggcagcctct

SEQ ID NO: 3890925 - DNA, 17 bp, Homo sapiens
cgtgccagctctagttt

SEQ ID NO: 3890926 - DNA, 16 bp, Homo sapiens
cgtgccatgatctgta

SEQ ID NO: 3890927 - DNA, 17 bp, Homo sapiens
cgtgccgttactctcca

SEQ ID NO: 3890928 - DNA, 19 bp, Homo sapiens
cgtgccgttactctccaac

SEQ ID NO: 3890929 - DNA, 22 bp, Homo sapiens
cgtgcgtgttagtgtgtgtgca

SEQ ID NO: 3890930 - DNA, 22 bp, Homo sapiens
cgtgctgggcttgtagaccact

SEQ ID NO: 3890931 - DNA, 20 bp, Homo sapiens
cgtgcttagcctcctgacct

SEQ ID NO: 3890932 - DNA, 12 bp, Homo sapiens
cgtggacacctg

SEQ ID NO: 3890933 - DNA, 14 bp, Homo sapiens
cgtggacacctgcc

SEQ ID NO: 3890934 - DNA, 17 bp, Homo sapiens
cgtggacacctgccctg

SEQ ID NO: 3890935 - DNA, 14 bp, Homo sapiens
cgtggaccacccgc

SEQ ID NO: 3890936 - DNA, 15 bp, Homo sapiens
cgtggaccttcctgc

SEQ ID NO: 3890937 - DNA, 15 bp, Homo sapiens
cgtggagagctagga

SEQ ID NO: 3890938 - DNA, 18 bp, Homo sapiens
cgtggagagctaggagca

SEQ ID NO: 3890939 - DNA, 14 bp, Homo sapiens
cgtggagggtaggg

SEQ ID NO: 3890940 - DNA, 18 bp, Homo sapiens
cgtggcaaatataaaact

SEQ ID NO: 3890941 - DNA, 20 bp, Homo sapiens
cgtggcagataatcagcctc

SEQ ID NO: 3890942 - DNA, 14 bp, Homo sapiens
cgtggcccttcctg

SEQ ID NO: 3890943 - DNA, 21 bp, Homo sapiens
cgtggccttccccttttgcct

SEQ ID NO: 3890944 - DNA, 13 bp, Homo sapiens
cgtggccttgttc

SEQ ID NO: 3890945 - DNA, 15 bp, Homo sapiens
cgtggtagaagccag

SEQ ID NO: 3890946 - DNA, 20 bp, Homo sapiens
cgtgtagtggaagagcagcc

SEQ ID NO: 3890947 - DNA, 21 bp, Homo sapiens
cgtgtagtggaagagcagcct

SEQ ID NO: 3890948 - DNA, 22 bp, Homo sapiens
cgtgtagtggaagagcagcctg

SEQ ID NO: 3890949 - DNA, 23 bp, Homo sapiens
cgtgtagtggaagagcagcctga

SEQ ID NO: 3890950 - DNA, 16 bp, Homo sapiens
cgtgtccccggcctca

SEQ ID NO: 3890951 - DNA, 13 bp, Homo sapiens
cgtgtctctccca

SEQ ID NO: 3890952 - DNA, 19 bp, Homo sapiens
cgtgttagtgtgtgtgcat

SEQ ID NO: 3890953 - DNA, 15 bp, Homo sapiens
cgttaaaagacagtg

SEQ ID NO: 3890954 - DNA, 20 bp, Homo sapiens
cgttaagggaaggaactctg

SEQ ID NO: 3890955 - DNA, 13 bp, Homo sapiens
cgttatatattgt

SEQ ID NO: 3890956 - DNA, 14 bp, Homo sapiens
cgttatatattgta

SEQ ID NO: 3890957 - DNA, 18 bp, Homo sapiens
cgttccccttggcttcct

SEQ ID NO: 3890958 - DNA, 21 bp, Homo sapiens
cgttccccttggcttcctccg

SEQ ID NO: 3890959 - DNA, 18 bp, Homo sapiens
cgttccctgtcagaggct

SEQ ID NO: 3890960 - DNA, 15 bp, Homo sapiens
cgttctccagcccac

SEQ ID NO: 3890961 - DNA, 20 bp, Homo sapiens
cgttggagccactcctgtcc

SEQ ID NO: 3890962 - DNA, 11 bp, Homo sapiens
cgttgtgaggg

SEQ ID NO: 3890963 - DNA, 20 bp, Homo sapiens
ctaaaaacatttactgacca

SEQ ID NO: 3890964 - DNA, 15 bp, Homo sapiens
ctaaaaagtggctaa

SEQ ID NO: 3890965 - DNA, 16 bp, Homo sapiens
ctaaaaataaaatgat

SEQ ID NO: 3890966 - DNA, 17 bp, Homo sapiens
ctaaaaataaaatgatg

SEQ ID NO: 3890967 - DNA, 18 bp, Homo sapiens
ctaaaaataaaatgatgt

SEQ ID NO: 3890968 - DNA, 15 bp, Homo sapiens
ctaaaaataaaccaa

SEQ ID NO: 3890969 - DNA, 13 bp, Homo sapiens
ctaaaaatgcaac

SEQ ID NO: 3890970 - DNA, 22 bp, Homo sapiens
ctaaaacctgagctagaagctg

SEQ ID NO: 3890971 - DNA, 20 bp, Homo sapiens
ctaaaagaatattcagagaa

SEQ ID NO: 3890972 - DNA, 19 bp, Homo sapiens
ctaaaagtggtttttattt

SEQ ID NO: 3890973 - DNA, 14 bp, Homo sapiens
ctaaaataaaaacc

SEQ ID NO: 3890974 - DNA, 18 bp, Homo sapiens
ctaaaatagatcctaggt

SEQ ID NO: 3890975 - DNA, 14 bp, Homo sapiens
ctaaaatatttatt

SEQ ID NO: 3890976 - DNA, 16 bp, Homo sapiens
ctaaacagactattta

SEQ ID NO: 3890977 - DNA, 17 bp, Homo sapiens
ctaaacagatataaatg

SEQ ID NO: 3890978 - DNA, 12 bp, Homo sapiens
ctaaagacagaa

SEQ ID NO: 3890979 - DNA, 19 bp, Homo sapiens
ctaaagatatcagagctct

SEQ ID NO: 3890980 - DNA, 18 bp, Homo sapiens
ctaaagtctctgctgcta

SEQ ID NO: 3890981 - DNA, 13 bp, Homo sapiens
ctaaagtgtctat

SEQ ID NO: 3890982 - DNA, 14 bp, Homo sapiens
ctaaagtttacagt

SEQ ID NO: 3890983 - DNA, 19 bp, Homo sapiens
ctaaagtttacagtaaata

SEQ ID NO: 3890984 - DNA, 15 bp, Homo sapiens
ctaaatactgtacat

SEQ ID NO: 3890985 - DNA, 15 bp, Homo sapiens
ctaaatctctaatat

SEQ ID NO: 3890986 - DNA, 13 bp, Homo sapiens
ctaaatgaagtgc

SEQ ID NO: 3890987 - DNA, 17 bp, Homo sapiens
ctaaattctttatttct

SEQ ID NO: 3890988 - DNA, 19 bp, Homo sapiens
ctaaattctttatttctgt

SEQ ID NO: 3890989 - DNA, 21 bp, Homo sapiens
ctaaattctttatttctgtca

SEQ ID NO: 3890990 - DNA, 17 bp, Homo sapiens
ctaacagggaaggcagg

SEQ ID NO: 3890991 - DNA, 18 bp, Homo sapiens
ctaacagggaaggcaggc

SEQ ID NO: 3890992 - DNA, 16 bp, Homo sapiens
ctaacccatgggtcca

SEQ ID NO: 3890993 - DNA, 19 bp, Homo sapiens
ctaaccccaacgcacagga

SEQ ID NO: 3890994 - DNA, 18 bp, Homo sapiens
ctaacccccagtgccaca

SEQ ID NO: 3890995 - DNA, 19 bp, Homo sapiens
ctaacccccagtgccacag

SEQ ID NO: 3890996 - DNA, 23 bp, Homo sapiens
ctaacccccagtgccacagagaa

SEQ ID NO: 3890997 - DNA, 14 bp, Homo sapiens
ctaacccctttcct

SEQ ID NO: 3890998 - DNA, 22 bp, Homo sapiens
ctaacctaagcaaaaccactga

SEQ ID NO: 3890999 - DNA, 21 bp, Homo sapiens
ctaacctcagccaaacacaga

SEQ ID NO: 3891000 - DNA, 14 bp, Homo sapiens
ctaacctggcttat

SEQ ID NO: 3891001 - DNA, 15 bp, Homo sapiens
ctaacgcctgagccc

SEQ ID NO: 3891002 - DNA, 20 bp, Homo sapiens
ctaacgcctgagcccaggga

SEQ ID NO: 3891003 - DNA, 21 bp, Homo sapiens
ctaactacaaggacaatgcct

SEQ ID NO: 3891004 - DNA, 15 bp, Homo sapiens
ctaactgaagagaca

SEQ ID NO: 3891005 - DNA, 11 bp, Homo sapiens
ctaactgtaaa

SEQ ID NO: 3891006 - DNA, 13 bp, Homo sapiens
ctaactgtaaatc

SEQ ID NO: 3891007 - DNA, 18 bp, Homo sapiens
ctaactgtaaatcacttg

SEQ ID NO: 3891008 - DNA, 20 bp, Homo sapiens
ctaagaagtccccaggtcat

SEQ ID NO: 3891009 - DNA, 16 bp, Homo sapiens
ctaagagagcacctgg

SEQ ID NO: 3891010 - DNA, 18 bp, Homo sapiens
ctaagcagtgcttgtaaa

SEQ ID NO: 3891011 - DNA, 13 bp, Homo sapiens
ctaagccacagct

SEQ ID NO: 3891012 - DNA, 20 bp, Homo sapiens
ctaagccctcgaaccaaggc

SEQ ID NO: 3891013 - DNA, 13 bp, Homo sapiens
ctaagcctgttgc

SEQ ID NO: 3891014 - DNA, 16 bp, Homo sapiens
ctaagctgcagcttcc

SEQ ID NO: 3891015 - DNA, 13 bp, Homo sapiens
ctaagctggagct

SEQ ID NO: 3891016 - DNA, 22 bp, Homo sapiens
ctaagctggagctcttggaaga

SEQ ID NO: 3891017 - DNA, 17 bp, Homo sapiens
ctaagctttctcctttg

SEQ ID NO: 3891018 - DNA, 12 bp, Homo sapiens
ctaaggacacac

SEQ ID NO: 3891019 - DNA, 18 bp, Homo sapiens
ctaaggatctctcaggag

SEQ ID NO: 3891020 - DNA, 14 bp, Homo sapiens
ctaaggttctcata

SEQ ID NO: 3891021 - DNA, 18 bp, Homo sapiens
ctaagtaaaaccacagca

SEQ ID NO: 3891022 - DNA, 19 bp, Homo sapiens
ctaagtaaaaccacagcag

SEQ ID NO: 3891023 - DNA, 20 bp, Homo sapiens
ctaagtaaaaccacagcagt

SEQ ID NO: 3891024 - DNA, 16 bp, Homo sapiens
ctaagtaaaagggtgg

SEQ ID NO: 3891025 - DNA, 21 bp, Homo sapiens
ctaagtagatagaaagcaata

SEQ ID NO: 3891026 - DNA, 17 bp, Homo sapiens
ctaagtgggaagtgaag

SEQ ID NO: 3891027 - DNA, 19 bp, Homo sapiens
ctaagtgggaagtgaagcc

SEQ ID NO: 3891028 - DNA, 20 bp, Homo sapiens
ctaagttatagtatatctgg

SEQ ID NO: 3891029 - DNA, 15 bp, Homo sapiens
ctaagttcagttctg

SEQ ID NO: 3891030 - DNA, 17 bp, Homo sapiens
ctaagttctaagttcat

SEQ ID NO: 3891031 - DNA, 17 bp, Homo sapiens
ctaatagactaaatgaa

SEQ ID NO: 3891032 - DNA, 23 bp, Homo sapiens
ctaatagcgggttactttcacat

SEQ ID NO: 3891033 - DNA, 16 bp, Homo sapiens
ctaatattaaaaatat

SEQ ID NO: 3891034 - DNA, 22 bp, Homo sapiens
ctaatcaagagtgagtgaacaa

SEQ ID NO: 3891035 - DNA, 20 bp, Homo sapiens
ctaatcaggctgaggtgtct

SEQ ID NO: 3891036 - DNA, 15 bp, Homo sapiens
ctaatcgaactatga

SEQ ID NO: 3891037 - DNA, 15 bp, Homo sapiens
ctaatctcatacctc

SEQ ID NO: 3891038 - DNA, 22 bp, Homo sapiens
ctaatctgtagggctggaccta

SEQ ID NO: 3891039 - DNA, 15 bp, Homo sapiens
ctaatgacacggtag

SEQ ID NO: 3891040 - DNA, 19 bp, Homo sapiens
ctaatgtctcttcctctgt

SEQ ID NO: 3891041 - DNA, 23 bp, Homo sapiens
ctaatgtctcttcctctgttcta

SEQ ID NO: 3891042 - DNA, 12 bp, Homo sapiens
ctaatttaaaaa

SEQ ID NO: 3891043 - DNA, 12 bp, Homo sapiens
ctaatttaaacc

SEQ ID NO: 3891044 - DNA, 13 bp, Homo sapiens
ctaatttaaacca

SEQ ID NO: 3891045 - DNA, 12 bp, Homo sapiens
ctaatttataca

SEQ ID NO: 3891046 - DNA, 13 bp, Homo sapiens
ctaatttatacaa

SEQ ID NO: 3891047 - DNA, 14 bp, Homo sapiens
ctaatttatacaaa

SEQ ID NO: 3891048 - DNA, 20 bp, Homo sapiens
ctaatttatacaaaataatt

SEQ ID NO: 3891049 - DNA, 23 bp, Homo sapiens
ctaatttatacaaaataatttaa

SEQ ID NO: 3891050 - DNA, 21 bp, Homo sapiens
ctaatttatcctgaaatttca

SEQ ID NO: 3891051 - DNA, 15 bp, Homo sapiens
ctaatttatttttag

SEQ ID NO: 3891052 - DNA, 15 bp, Homo sapiens
ctacaaaaacacagc

SEQ ID NO: 3891053 - DNA, 20 bp, Homo sapiens
ctacaaaaacacagcaaggg

SEQ ID NO: 3891054 - DNA, 23 bp, Homo sapiens
ctacaaagctgaagaaaatgaag

SEQ ID NO: 3891055 - DNA, 22 bp, Homo sapiens
ctacaaccagagccccccacaa

SEQ ID NO: 3891056 - DNA, 15 bp, Homo sapiens
ctacaagcatatttg

SEQ ID NO: 3891057 - DNA, 19 bp, Homo sapiens
ctacaagcatatttgagaa

SEQ ID NO: 3891058 - DNA, 22 bp, Homo sapiens
ctacaagcatttgccctgtgga

SEQ ID NO: 3891059 - DNA, 11 bp, Homo sapiens
ctacaataaat

SEQ ID NO: 3891060 - DNA, 14 bp, Homo sapiens
ctacaataaatgct

SEQ ID NO: 3891061 - DNA, 15 bp, Homo sapiens
ctacaataaatgctg

SEQ ID NO: 3891062 - DNA, 13 bp, Homo sapiens
ctacaccactctg

SEQ ID NO: 3891063 - DNA, 15 bp, Homo sapiens
ctacaccactctggc

SEQ ID NO: 3891064 - DNA, 18 bp, Homo sapiens
ctacaccactctggcagc

SEQ ID NO: 3891065 - DNA, 20 bp, Homo sapiens
ctacaccactctggcagcca

SEQ ID NO: 3891066 - DNA, 16 bp, Homo sapiens
ctacacccttggactt

SEQ ID NO: 3891067 - DNA, 19 bp, Homo sapiens
ctacacctgttgcacctca

SEQ ID NO: 3891068 - DNA, 17 bp, Homo sapiens
ctacagaataatgtgtt

SEQ ID NO: 3891069 - DNA, 21 bp, Homo sapiens
ctacagacttctccagaccca

SEQ ID NO: 3891070 - DNA, 14 bp, Homo sapiens
ctacagatagtcaa

SEQ ID NO: 3891071 - DNA, 17 bp, Homo sapiens
ctacatcttcagctccc

SEQ ID NO: 3891072 - DNA, 18 bp, Homo sapiens
ctacatcttcagctccca

SEQ ID NO: 3891073 - DNA, 21 bp, Homo sapiens
ctacatcttcagctcccatag

SEQ ID NO: 3891074 - DNA, 13 bp, Homo sapiens
ctacatgaaacag

SEQ ID NO: 3891075 - DNA, 18 bp, Homo sapiens
ctacatgaaacagaaaca

SEQ ID NO: 3891076 - DNA, 10 bp, Homo sapiens
ctacattcct

SEQ ID NO: 3891077 - DNA, 11 bp, Homo sapiens
ctacattcctc

SEQ ID NO: 3891078 - DNA, 14 bp, Homo sapiens
ctacattcctcagc

SEQ ID NO: 3891079 - DNA, 17 bp, Homo sapiens
ctacattcctcagctgc

SEQ ID NO: 3891080 - DNA, 18 bp, Homo sapiens
ctacattcctcagctgcc

SEQ ID NO: 3891081 - DNA, 14 bp, Homo sapiens
ctaccaaagcacct

SEQ ID NO: 3891082 - DNA, 16 bp, Homo sapiens
ctaccaaatataaact

SEQ ID NO: 3891083 - DNA, 14 bp, Homo sapiens
ctaccaatgcatgc

SEQ ID NO: 3891084 - DNA, 17 bp, Homo sapiens
ctaccaccccttcctgt

SEQ ID NO: 3891085 - DNA, 22 bp, Homo sapiens
ctaccaccccttcctgtcccac

SEQ ID NO: 3891086 - DNA, 14 bp, Homo sapiens
ctaccaccttccct

SEQ ID NO: 3891087 - DNA, 18 bp, Homo sapiens
ctaccaccttccctcttt

SEQ ID NO: 3891088 - DNA, 17 bp, Homo sapiens
ctaccagctaactccag

SEQ ID NO: 3891089 - DNA, 14 bp, Homo sapiens
ctaccatgctgctt

SEQ ID NO: 3891090 - DNA, 15 bp, Homo sapiens
ctacccaaccactca

SEQ ID NO: 3891091 - DNA, 12 bp, Homo sapiens
ctacccactctt

SEQ ID NO: 3891092 - DNA, 23 bp, Homo sapiens
ctacccactctttgctacaataa

SEQ ID NO: 3891093 - DNA, 15 bp, Homo sapiens
ctacccgagcccagc

SEQ ID NO: 3891094 - DNA, 20 bp, Homo sapiens
ctacccgagcccagctacat

SEQ ID NO: 3891095 - DNA, 14 bp, Homo sapiens
ctacccttgtaccc

SEQ ID NO: 3891096 - DNA, 18 bp, Homo sapiens
ctacccttgtaccccatc

SEQ ID NO: 3891097 - DNA, 17 bp, Homo sapiens
ctaccgagtctcttctc

SEQ ID NO: 3891098 - DNA, 21 bp, Homo sapiens
ctaccgagtctcttctccact

SEQ ID NO: 3891099 - DNA, 22 bp, Homo sapiens
ctaccgagtctcttctccactg

SEQ ID NO: 3891100 - DNA, 23 bp, Homo sapiens
ctaccgagtctcttctccactgg

SEQ ID NO: 3891101 - DNA, 21 bp, Homo sapiens
ctacctgccctctctcagtta

SEQ ID NO: 3891102 - DNA, 19 bp, Homo sapiens
ctacctgtgttcattctta

SEQ ID NO: 3891103 - DNA, 14 bp, Homo sapiens
ctaccttctgacct

SEQ ID NO: 3891104 - DNA, 22 bp, Homo sapiens
ctacgccaaagtgcagcccttc

SEQ ID NO: 3891105 - DNA, 21 bp, Homo sapiens
ctacgctctcctttctttcta

SEQ ID NO: 3891106 - DNA, 16 bp, Homo sapiens
ctacgtataaatatga

SEQ ID NO: 3891107 - DNA, 19 bp, Homo sapiens
ctacgtataaatatgaaat

SEQ ID NO: 3891108 - DNA, 16 bp, Homo sapiens
ctacgttaagggaagg

SEQ ID NO: 3891109 - DNA, 14 bp, Homo sapiens
ctacgttctccagc

SEQ ID NO: 3891110 - DNA, 20 bp, Homo sapiens
ctactaaaaatacaaaaaat

SEQ ID NO: 3891111 - DNA, 18 bp, Homo sapiens
ctactacccgagcccagc

SEQ ID NO: 3891112 - DNA, 14 bp, Homo sapiens
ctactcacacaggc

SEQ ID NO: 3891113 - DNA, 23 bp, Homo sapiens
ctactcacacaggcatttcctgg

SEQ ID NO: 3891114 - DNA, 18 bp, Homo sapiens
ctactcagcagccctcct

SEQ ID NO: 3891115 - DNA, 13 bp, Homo sapiens
ctactcaggaggc

SEQ ID NO: 3891116 - DNA, 15 bp, Homo sapiens
ctactcaggaggctg

SEQ ID NO: 3891117 - DNA, 20 bp, Homo sapiens
ctactcatacttaagcaaaa

SEQ ID NO: 3891118 - DNA, 16 bp, Homo sapiens
ctactcattgtctcag

SEQ ID NO: 3891119 - DNA, 19 bp, Homo sapiens
ctactcattgtctcagtgc

SEQ ID NO: 3891120 - DNA, 13 bp, Homo sapiens
ctactcccctggg

SEQ ID NO: 3891121 - DNA, 13 bp, Homo sapiens
ctactcctgtgct

SEQ ID NO: 3891122 - DNA, 17 bp, Homo sapiens
ctactctcttgccagca

SEQ ID NO: 3891123 - DNA, 13 bp, Homo sapiens
ctactctgtccag

SEQ ID NO: 3891124 - DNA, 17 bp, Homo sapiens
ctactctgtccaggcca

SEQ ID NO: 3891125 - DNA, 13 bp, Homo sapiens
ctactctgtgcca

SEQ ID NO: 3891126 - DNA, 16 bp, Homo sapiens
ctactgatttttgtga

SEQ ID NO: 3891127 - DNA, 17 bp, Homo sapiens
ctactgcagctttacat

SEQ ID NO: 3891128 - DNA, 12 bp, Homo sapiens
ctactggcagct

SEQ ID NO: 3891129 - DNA, 15 bp, Homo sapiens
ctactggcagctcct

SEQ ID NO: 3891130 - DNA, 22 bp, Homo sapiens
ctactggcagctcctctccttg

SEQ ID NO: 3891131 - DNA, 18 bp, Homo sapiens
ctactgtaattaagtgca

SEQ ID NO: 3891132 - DNA, 17 bp, Homo sapiens
ctacttagcatgtccct

SEQ ID NO: 3891133 - DNA, 20 bp, Homo sapiens
ctacttcctgtgacttcagc

SEQ ID NO: 3891134 - DNA, 17 bp, Homo sapiens
ctacttcttggaaaaaa

SEQ ID NO: 3891135 - DNA, 23 bp, Homo sapiens
ctacttgggaggctgaggcagga

SEQ ID NO: 3891136 - DNA, 17 bp, Homo sapiens
ctacttgtgactgaagg

SEQ ID NO: 3891137 - DNA, 14 bp, Homo sapiens
ctactttacactct

SEQ ID NO: 3891138 - DNA, 16 bp, Homo sapiens
ctactttttatactcc

SEQ ID NO: 3891139 - DNA, 21 bp, Homo sapiens
ctagaaaccagtatggaaggg

SEQ ID NO: 3891140 - DNA, 21 bp, Homo sapiens
ctagaaagctctgcatgtgtg

SEQ ID NO: 3891141 - DNA, 13 bp, Homo sapiens
ctagaaatatgat

SEQ ID NO: 3891142 - DNA, 22 bp, Homo sapiens
ctagaacacaggcaaaatcctt

SEQ ID NO: 3891143 - DNA, 17 bp, Homo sapiens
ctagaacacccactggc

SEQ ID NO: 3891144 - DNA, 18 bp, Homo sapiens
ctagaacacccactggcc

SEQ ID NO: 3891145 - DNA, 22 bp, Homo sapiens
ctagaacacccactggccagtc

SEQ ID NO: 3891146 - DNA, 15 bp, Homo sapiens
ctagaacatgcacat

SEQ ID NO: 3891147 - DNA, 20 bp, Homo sapiens
ctagaacatgcacatttata

SEQ ID NO: 3891148 - DNA, 17 bp, Homo sapiens
ctagaaccaagcttcag

SEQ ID NO: 3891149 - DNA, 19 bp, Homo sapiens
ctagaaccaagcttcagag

SEQ ID NO: 3891150 - DNA, 14 bp, Homo sapiens
ctagaacctggaga

SEQ ID NO: 3891151 - DNA, 13 bp, Homo sapiens
ctagaacttcaaa

SEQ ID NO: 3891152 - DNA, 17 bp, Homo sapiens
ctagaacttcaaaatgt

SEQ ID NO: 3891153 - DNA, 21 bp, Homo sapiens
ctagaagggctagaacctgga

SEQ ID NO: 3891154 - DNA, 22 bp, Homo sapiens
ctagaagggctagaacctggag

SEQ ID NO: 3891155 - DNA, 22 bp, Homo sapiens
ctagaatagccatgtactataa

SEQ ID NO: 3891156 - DNA, 18 bp, Homo sapiens
ctagaatggtagcactac

SEQ ID NO: 3891157 - DNA, 21 bp, Homo sapiens
ctagactaattaaaatctgga

SEQ ID NO: 3891158 - DNA, 13 bp, Homo sapiens
ctagactttctgt

SEQ ID NO: 3891159 - DNA, 12 bp, Homo sapiens
ctagagaagagg

SEQ ID NO: 3891160 - DNA, 17 bp, Homo sapiens
ctagagatatggcagcg

SEQ ID NO: 3891161 - DNA, 21 bp, Homo sapiens
ctagagcaacccctgtaccca

SEQ ID NO: 3891162 - DNA, 23 bp, Homo sapiens
ctagagcaacccctgtacccagc

SEQ ID NO: 3891163 - DNA, 10 bp, Homo sapiens
ctagagcctg

SEQ ID NO: 3891164 - DNA, 23 bp, Homo sapiens
ctagagctcctgtccctacccac

SEQ ID NO: 3891165 - DNA, 22 bp, Homo sapiens
ctagagctgggaaacagggagc

SEQ ID NO: 3891166 - DNA, 19 bp, Homo sapiens
ctagaggcagggaggggac

SEQ ID NO: 3891167 - DNA, 15 bp, Homo sapiens
ctagaggtgggcagc

SEQ ID NO: 3891168 - DNA, 17 bp, Homo sapiens
ctagaggtgggcagctg

SEQ ID NO: 3891169 - DNA, 19 bp, Homo sapiens
ctagaggtgggcagctggg

SEQ ID NO: 3891170 - DNA, 22 bp, Homo sapiens
ctagaggtgggcagctgggccc

SEQ ID NO: 3891171 - DNA, 21 bp, Homo sapiens
ctagagtgactctacctgcaa

SEQ ID NO: 3891172 - DNA, 21 bp, Homo sapiens
ctagattaccccctcattgtt

SEQ ID NO: 3891173 - DNA, 20 bp, Homo sapiens
ctagattctacatattcttt

SEQ ID NO: 3891174 - DNA, 18 bp, Homo sapiens
ctagcaagacctgttggt

SEQ ID NO: 3891175 - DNA, 17 bp, Homo sapiens
ctagcagtgaactattt

SEQ ID NO: 3891176 - DNA, 18 bp, Homo sapiens
ctagcattttcttgaacc

SEQ ID NO: 3891177 - DNA, 17 bp, Homo sapiens
ctagccaactcctcctt

SEQ ID NO: 3891178 - DNA, 12 bp, Homo sapiens
ctagccaaggct

SEQ ID NO: 3891179 - DNA, 23 bp, Homo sapiens
ctagccaaggctagttcctttca

SEQ ID NO: 3891180 - DNA, 13 bp, Homo sapiens
ctagccacctccc

SEQ ID NO: 3891181 - DNA, 21 bp, Homo sapiens
ctagccacctcccaccccact

SEQ ID NO: 3891182 - DNA, 12 bp, Homo sapiens
ctagccaggagt

SEQ ID NO: 3891183 - DNA, 13 bp, Homo sapiens
ctagccctctcac

SEQ ID NO: 3891184 - DNA, 18 bp, Homo sapiens
ctagccctctcacattta

SEQ ID NO: 3891185 - DNA, 21 bp, Homo sapiens
ctagccgggccatgctttcct

SEQ ID NO: 3891186 - DNA, 21 bp, Homo sapiens
ctagcctgtgattaacttgct

SEQ ID NO: 3891187 - DNA, 23 bp, Homo sapiens
ctagctagaagtgggccaggaca

SEQ ID NO: 3891188 - DNA, 12 bp, Homo sapiens
ctagctggcagg

SEQ ID NO: 3891189 - DNA, 13 bp, Homo sapiens
ctagctggcagga

SEQ ID NO: 3891190 - DNA, 18 bp, Homo sapiens
ctagctgggcaaaccctt

SEQ ID NO: 3891191 - DNA, 21 bp, Homo sapiens
ctagctgggcaaacccttctc

SEQ ID NO: 3891192 - DNA, 13 bp, Homo sapiens
ctagcttcatgcc

SEQ ID NO: 3891193 - DNA, 15 bp, Homo sapiens
ctagcttcatgcctc

SEQ ID NO: 3891194 - DNA, 23 bp, Homo sapiens
ctagcttcatgcctcagtttccc

SEQ ID NO: 3891195 - DNA, 17 bp, Homo sapiens
ctaggaatgaaatcctg

SEQ ID NO: 3891196 - DNA, 21 bp, Homo sapiens
ctaggagagactgaaagcagc

SEQ ID NO: 3891197 - DNA, 16 bp, Homo sapiens
ctaggagctgggagga

SEQ ID NO: 3891198 - DNA, 15 bp, Homo sapiens
ctaggcatcccaggg

SEQ ID NO: 3891199 - DNA, 18 bp, Homo sapiens
ctaggcatcccaggggac

SEQ ID NO: 3891200 - DNA, 15 bp, Homo sapiens
ctaggccactcctcc

SEQ ID NO: 3891201 - DNA, 16 bp, Homo sapiens
ctaggccactcctcca

SEQ ID NO: 3891202 - DNA, 17 bp, Homo sapiens
ctaggccactcctccaa

SEQ ID NO: 3891203 - DNA, 14 bp, Homo sapiens
ctaggccccagagc

SEQ ID NO: 3891204 - DNA, 18 bp, Homo sapiens
ctaggcgagtgccaggac

SEQ ID NO: 3891205 - DNA, 20 bp, Homo sapiens
ctaggcgagtgccaggactc

SEQ ID NO: 3891206 - DNA, 21 bp, Homo sapiens
ctaggcttcagcatatttata

SEQ ID NO: 3891207 - DNA, 14 bp, Homo sapiens
ctagggagagaccc

SEQ ID NO: 3891208 - DNA, 15 bp, Homo sapiens
ctaggttcaattccc

SEQ ID NO: 3891209 - DNA, 21 bp, Homo sapiens
ctagtaccctatagagagggg

SEQ ID NO: 3891210 - DNA, 15 bp, Homo sapiens
ctagtactctctgct

SEQ ID NO: 3891211 - DNA, 18 bp, Homo sapiens
ctagtactctctgctcta

SEQ ID NO: 3891212 - DNA, 19 bp, Homo sapiens
ctagtactctctgctctag

SEQ ID NO: 3891213 - DNA, 13 bp, Homo sapiens
ctagtcagagaga

SEQ ID NO: 3891214 - DNA, 16 bp, Homo sapiens
ctagtcagagagagtg

SEQ ID NO: 3891215 - DNA, 18 bp, Homo sapiens
ctagtcttgctttgctgt

SEQ ID NO: 3891216 - DNA, 23 bp, Homo sapiens
ctagtcttgctttgctgtctggt

SEQ ID NO: 3891217 - DNA, 17 bp, Homo sapiens
ctagtgctattctgtgt

SEQ ID NO: 3891218 - DNA, 19 bp, Homo sapiens
ctagtggggtctccctctc

SEQ ID NO: 3891219 - DNA, 20 bp, Homo sapiens
ctagtggggtctccctctcc

SEQ ID NO: 3891220 - DNA, 22 bp, Homo sapiens
ctagtggggtctccctctcctg

SEQ ID NO: 3891221 - DNA, 22 bp, Homo sapiens
ctagtgtgagtggcagccatgc

SEQ ID NO: 3891222 - DNA, 23 bp, Homo sapiens
ctagttctcaatcactgctcccc

SEQ ID NO: 3891223 - DNA, 14 bp, Homo sapiens
ctagtttattttgt

SEQ ID NO: 3891224 - DNA, 18 bp, Homo sapiens
ctagtttcagtaaataat

SEQ ID NO: 3891225 - DNA, 15 bp, Homo sapiens
ctagttttcagcctt

SEQ ID NO: 3891226 - DNA, 16 bp, Homo sapiens
ctagttttctcctccc

SEQ ID NO: 3891227 - DNA, 20 bp, Homo sapiens
ctagttttctcctcccagga

SEQ ID NO: 3891228 - DNA, 20 bp, Homo sapiens
ctataaacattaaaagaaga

SEQ ID NO: 3891229 - DNA, 15 bp, Homo sapiens
ctataaactactgta

SEQ ID NO: 3891230 - DNA, 14 bp, Homo sapiens
ctataacatgtctt

SEQ ID NO: 3891231 - DNA, 12 bp, Homo sapiens
ctatacaacaat

SEQ ID NO: 3891232 - DNA, 13 bp, Homo sapiens
ctatacccattct

SEQ ID NO: 3891233 - DNA, 18 bp, Homo sapiens
ctatacccattcttcagt

SEQ ID NO: 3891234 - DNA, 22 bp, Homo sapiens
ctatagagaaaaactttcattt

SEQ ID NO: 3891235 - DNA, 21 bp, Homo sapiens
ctatagagagggggctctcca

SEQ ID NO: 3891236 - DNA, 15 bp, Homo sapiens
ctatagcccaggtcc

SEQ ID NO: 3891237 - DNA, 12 bp, Homo sapiens
ctatagctcttc

SEQ ID NO: 3891238 - DNA, 20 bp, Homo sapiens
ctatagctcttctatttaaa

SEQ ID NO: 3891239 - DNA, 21 bp, Homo sapiens
ctatagctcttctatttaaaa

SEQ ID NO: 3891240 - DNA, 18 bp, Homo sapiens
ctataggctggagaagct

SEQ ID NO: 3891241 - DNA, 21 bp, Homo sapiens
ctataggtgctacaaaaacac

SEQ ID NO: 3891242 - DNA, 22 bp, Homo sapiens
ctataggtgctacaaaaacaca

SEQ ID NO: 3891243 - DNA, 17 bp, Homo sapiens
ctatagttattgtttta

SEQ ID NO: 3891244 - DNA, 16 bp, Homo sapiens
ctatatacatgtgtgt

SEQ ID NO: 3891245 - DNA, 22 bp, Homo sapiens
ctatatacatgtgtgtatatat

SEQ ID NO: 3891246 - DNA, 22 bp, Homo sapiens
ctatatagtttattgacaataa

SEQ ID NO: 3891247 - DNA, 16 bp, Homo sapiens
ctatatatataaatat

SEQ ID NO: 3891248 - DNA, 19 bp, Homo sapiens
ctatatgtagctttatcct

SEQ ID NO: 3891249 - DNA, 15 bp, Homo sapiens
ctatattaaagtgtt

SEQ ID NO: 3891250 - DNA, 20 bp, Homo sapiens
ctatattccgggtgccattc

SEQ ID NO: 3891251 - DNA, 21 bp, Homo sapiens
ctatcaaaacatatcaattca

SEQ ID NO: 3891252 - DNA, 15 bp, Homo sapiens
ctatcaaaataaatt

SEQ ID NO: 3891253 - DNA, 16 bp, Homo sapiens
ctatcaatagtcaaga

SEQ ID NO: 3891254 - DNA, 20 bp, Homo sapiens
ctatcaatagtcaagaaaaa

SEQ ID NO: 3891255 - DNA, 15 bp, Homo sapiens
ctatcaatatttaag

SEQ ID NO: 3891256 - DNA, 17 bp, Homo sapiens
ctatcacatacaatttg

SEQ ID NO: 3891257 - DNA, 14 bp, Homo sapiens
ctatccacccagcc

SEQ ID NO: 3891258 - DNA, 15 bp, Homo sapiens
ctatccacccagccc

SEQ ID NO: 3891259 - DNA, 12 bp, Homo sapiens
ctatccatcctg

SEQ ID NO: 3891260 - DNA, 18 bp, Homo sapiens
ctatcccacccaacagct

SEQ ID NO: 3891261 - DNA, 23 bp, Homo sapiens
ctatcccacccaacagctcagag

SEQ ID NO: 3891262 - DNA, 16 bp, Homo sapiens
ctatcctagagaggct

SEQ ID NO: 3891263 - DNA, 17 bp, Homo sapiens
ctatcctgcgggtttta

SEQ ID NO: 3891264 - DNA, 21 bp, Homo sapiens
ctatccttggagagcagctgg

SEQ ID NO: 3891265 - DNA, 14 bp, Homo sapiens
ctatcgactttata

SEQ ID NO: 3891266 - DNA, 18 bp, Homo sapiens
ctatctgcatttataaat

SEQ ID NO: 3891267 - DNA, 21 bp, Homo sapiens
ctatctgtcatctctctgggg

SEQ ID NO: 3891268 - DNA, 16 bp, Homo sapiens
ctatgacttgggcacc

SEQ ID NO: 3891269 - DNA, 20 bp, Homo sapiens
ctatgacttgggcaccccca

SEQ ID NO: 3891270 - DNA, 17 bp, Homo sapiens
ctatgagaacaagtcac

SEQ ID NO: 3891271 - DNA, 21 bp, Homo sapiens
ctatgagaattgggattacat

SEQ ID NO: 3891272 - DNA, 14 bp, Homo sapiens
ctatgatcacagtg

SEQ ID NO: 3891273 - DNA, 15 bp, Homo sapiens
ctatgatcacagtga

SEQ ID NO: 3891274 - DNA, 18 bp, Homo sapiens
ctatgattatgccactgc

SEQ ID NO: 3891275 - DNA, 20 bp, Homo sapiens
ctatgcaatttttaaactag

SEQ ID NO: 3891276 - DNA, 21 bp, Homo sapiens
ctatgcaatttttaaactagt

SEQ ID NO: 3891277 - DNA, 23 bp, Homo sapiens
ctatgcagtattgccacaatgcc

SEQ ID NO: 3891278 - DNA, 14 bp, Homo sapiens
ctatgccaagccat

SEQ ID NO: 3891279 - DNA, 14 bp, Homo sapiens
ctatgctatttctg

SEQ ID NO: 3891280 - DNA, 19 bp, Homo sapiens
ctatgctatttctggcctc

SEQ ID NO: 3891281 - DNA, 20 bp, Homo sapiens
ctatgctatttctggcctca

SEQ ID NO: 3891282 - DNA, 13 bp, Homo sapiens
ctatgctgaagag

SEQ ID NO: 3891283 - DNA, 10 bp, Homo sapiens
ctatggatgt

SEQ ID NO: 3891284 - DNA, 11 bp, Homo sapiens
ctatggatgtg

SEQ ID NO: 3891285 - DNA, 15 bp, Homo sapiens
ctatggccccagggt

SEQ ID NO: 3891286 - DNA, 19 bp, Homo sapiens
ctatgggggcactgaggac

SEQ ID NO: 3891287 - DNA, 15 bp, Homo sapiens
ctatggtgaggtgtg

SEQ ID NO: 3891288 - DNA, 14 bp, Homo sapiens
ctatgtatggaata

SEQ ID NO: 3891289 - DNA, 22 bp, Homo sapiens
ctatgtatggaatacagtgtta

SEQ ID NO: 3891290 - DNA, 14 bp, Homo sapiens
ctatgtcctaagga

SEQ ID NO: 3891291 - DNA, 18 bp, Homo sapiens
ctatgtcctaaggacaca

SEQ ID NO: 3891292 - DNA, 20 bp, Homo sapiens
ctatgtcctaaggacacact

SEQ ID NO: 3891293 - DNA, 19 bp, Homo sapiens
ctatgttgcccaggctgct

SEQ ID NO: 3891294 - DNA, 20 bp, Homo sapiens
ctattaagataaatagagtt

SEQ ID NO: 3891295 - DNA, 15 bp, Homo sapiens
ctattataatttaat

SEQ ID NO: 3891296 - DNA, 16 bp, Homo sapiens
ctattataatttaatg

SEQ ID NO: 3891297 - DNA, 18 bp, Homo sapiens
ctattatagccacatccc

SEQ ID NO: 3891298 - DNA, 14 bp, Homo sapiens
ctattatctgtgct

SEQ ID NO: 3891299 - DNA, 18 bp, Homo sapiens
ctattcaaacagtctcag

SEQ ID NO: 3891300 - DNA, 23 bp, Homo sapiens
ctattcaaacagtctcaggaaat

SEQ ID NO: 3891301 - DNA, 22 bp, Homo sapiens
ctattcaaggtggccaaattat

SEQ ID NO: 3891302 - DNA, 23 bp, Homo sapiens
ctattcaaggtggccaaattatt

SEQ ID NO: 3891303 - DNA, 15 bp, Homo sapiens
ctattcagacaagca

SEQ ID NO: 3891304 - DNA, 14 bp, Homo sapiens
ctattcctgaccct

SEQ ID NO: 3891305 - DNA, 14 bp, Homo sapiens
ctattctctcctca

SEQ ID NO: 3891306 - DNA, 16 bp, Homo sapiens
ctattctctcctcaga

SEQ ID NO: 3891307 - DNA, 13 bp, Homo sapiens
ctattctgagcct

SEQ ID NO: 3891308 - DNA, 14 bp, Homo sapiens
ctattctgagcctt

SEQ ID NO: 3891309 - DNA, 15 bp, Homo sapiens
ctattgaaattactg

SEQ ID NO: 3891310 - DNA, 13 bp, Homo sapiens
ctattgaactgag

SEQ ID NO: 3891311 - DNA, 18 bp, Homo sapiens
ctattgaactgagccaaa

SEQ ID NO: 3891312 - DNA, 12 bp, Homo sapiens
ctattgatgttt

SEQ ID NO: 3891313 - DNA, 14 bp, Homo sapiens
ctattgcatgtaaa

SEQ ID NO: 3891314 - DNA, 15 bp, Homo sapiens
ctattgcatgtaaaa

SEQ ID NO: 3891315 - DNA, 17 bp, Homo sapiens
ctattgcatgtaaaatg

SEQ ID NO: 3891316 - DNA, 18 bp, Homo sapiens
ctattgcatgtaaaatgc

SEQ ID NO: 3891317 - DNA, 14 bp, Homo sapiens
ctattgtttattct

SEQ ID NO: 3891318 - DNA, 21 bp, Homo sapiens
ctattgtttctttaagaaagt

SEQ ID NO: 3891319 - DNA, 15 bp, Homo sapiens
ctatttaaaaaagag

SEQ ID NO: 3891320 - DNA, 13 bp, Homo sapiens
ctatttaaaaaat

SEQ ID NO: 3891321 - DNA, 19 bp, Homo sapiens
ctatttaaaaaataaaaaa

SEQ ID NO: 3891322 - DNA, 15 bp, Homo sapiens
ctatttaacttgagg

SEQ ID NO: 3891323 - DNA, 13 bp, Homo sapiens
ctatttataaact

SEQ ID NO: 3891324 - DNA, 21 bp, Homo sapiens
ctatttattcattcagtgaga

SEQ ID NO: 3891325 - DNA, 19 bp, Homo sapiens
ctatttattccctgttaaa

SEQ ID NO: 3891326 - DNA, 14 bp, Homo sapiens
ctatttattggggt

SEQ ID NO: 3891327 - DNA, 21 bp, Homo sapiens
ctatttccccaggggaaaatg

SEQ ID NO: 3891328 - DNA, 14 bp, Homo sapiens
ctatttctctcccc

SEQ ID NO: 3891329 - DNA, 14 bp, Homo sapiens
ctatttctggcctc

SEQ ID NO: 3891330 - DNA, 16 bp, Homo sapiens
ctatttctggcctcag

SEQ ID NO: 3891331 - DNA, 23 bp, Homo sapiens
ctatttgagcatgcacagctgct

SEQ ID NO: 3891332 - DNA, 17 bp, Homo sapiens
ctatttgtctttcagga

SEQ ID NO: 3891333 - DNA, 23 bp, Homo sapiens
ctatttgttgtttttaacaacta

SEQ ID NO: 3891334 - DNA, 13 bp, Homo sapiens
ctattttaaaacc

SEQ ID NO: 3891335 - DNA, 16 bp, Homo sapiens
ctattttaaaaccatg

SEQ ID NO: 3891336 - DNA, 19 bp, Homo sapiens
ctattttaaaaccatgcag

SEQ ID NO: 3891337 - DNA, 19 bp, Homo sapiens
ctattttaagacgtgaatg

SEQ ID NO: 3891338 - DNA, 12 bp, Homo sapiens
ctattttattcc

SEQ ID NO: 3891339 - DNA, 17 bp, Homo sapiens
ctattttatttgtattc

SEQ ID NO: 3891340 - DNA, 19 bp, Homo sapiens
ctattttgtaaactcaaaa

SEQ ID NO: 3891341 - DNA, 13 bp, Homo sapiens
ctcaaaactgcac

SEQ ID NO: 3891342 - DNA, 17 bp, Homo sapiens
ctcaaaactgcactgtc

SEQ ID NO: 3891343 - DNA, 20 bp, Homo sapiens
ctcaaaacttaacatattta

SEQ ID NO: 3891344 - DNA, 17 bp, Homo sapiens
ctcaaaagattgtttta

SEQ ID NO: 3891345 - DNA, 20 bp, Homo sapiens
ctcaaaagcacccttgacgt

SEQ ID NO: 3891346 - DNA, 23 bp, Homo sapiens
ctcaaaataccatgccatttaaa

SEQ ID NO: 3891347 - DNA, 19 bp, Homo sapiens
ctcaaacatggaagatgaa

SEQ ID NO: 3891348 - DNA, 12 bp, Homo sapiens
ctcaaatccttg

SEQ ID NO: 3891349 - DNA, 15 bp, Homo sapiens
ctcaaatctattcag

SEQ ID NO: 3891350 - DNA, 18 bp, Homo sapiens
ctcaaatgctaaatgcaa

SEQ ID NO: 3891351 - DNA, 24 bp, Homo sapiens
ctcaaatgctaaatgcaaacactg

SEQ ID NO: 3891352 - DNA, 17 bp, Homo sapiens
ctcaacaacaaaccaaa

SEQ ID NO: 3891353 - DNA, 23 bp, Homo sapiens
ctcaacaacaaaccaaaacagaa

SEQ ID NO: 3891354 - DNA, 18 bp, Homo sapiens
ctcaacaataaagactga

SEQ ID NO: 3891355 - DNA, 19 bp, Homo sapiens
ctcaacagatctgtgggcc

SEQ ID NO: 3891356 - DNA, 14 bp, Homo sapiens
ctcaactactcagc

SEQ ID NO: 3891357 - DNA, 17 bp, Homo sapiens
ctcaagagggcactggt

SEQ ID NO: 3891358 - DNA, 18 bp, Homo sapiens
ctcaagattatattataa

SEQ ID NO: 3891359 - DNA, 20 bp, Homo sapiens
ctcaagattatattataata

SEQ ID NO: 3891360 - DNA, 16 bp, Homo sapiens
ctcaagggtccagaag

SEQ ID NO: 3891361 - DNA, 18 bp, Homo sapiens
ctcaagggtccagaagtc

SEQ ID NO: 3891362 - DNA, 17 bp, Homo sapiens
ctcaagtcttccctgat

SEQ ID NO: 3891363 - DNA, 18 bp, Homo sapiens
ctcaagtgatccacctgc

SEQ ID NO: 3891364 - DNA, 19 bp, Homo sapiens
ctcaagtgatccacctgcc

SEQ ID NO: 3891365 - DNA, 16 bp, Homo sapiens
ctcaatattcaataaa

SEQ ID NO: 3891366 - DNA, 18 bp, Homo sapiens
ctcaatattcaataaagc

SEQ ID NO: 3891367 - DNA, 13 bp, Homo sapiens
ctcaatcagtgca

SEQ ID NO: 3891368 - DNA, 15 bp, Homo sapiens
ctcaatcagtgcagt

SEQ ID NO: 3891369 - DNA, 20 bp, Homo sapiens
ctcaatcagtgcagtgatac

SEQ ID NO: 3891370 - DNA, 20 bp, Homo sapiens
ctcaatgcattgtcttgtgg

SEQ ID NO: 3891371 - DNA, 16 bp, Homo sapiens
ctcaatgccctgccat

SEQ ID NO: 3891372 - DNA, 18 bp, Homo sapiens
ctcaatgccctgccatta

SEQ ID NO: 3891373 - DNA, 16 bp, Homo sapiens
ctcaatggacttcaaa

SEQ ID NO: 3891374 - DNA, 14 bp, Homo sapiens
ctcaatgtgaccag

SEQ ID NO: 3891375 - DNA, 19 bp, Homo sapiens
ctcacaagaagaccagact

SEQ ID NO: 3891376 - DNA, 13 bp, Homo sapiens
ctcacaaggcagc

SEQ ID NO: 3891377 - DNA, 16 bp, Homo sapiens
ctcacaaggcagcaag

SEQ ID NO: 3891378 - DNA, 17 bp, Homo sapiens
ctcacaaggcagcaagg

SEQ ID NO: 3891379 - DNA, 22 bp, Homo sapiens
ctcacacaggcatttcctgggt

SEQ ID NO: 3891380 - DNA, 23 bp, Homo sapiens
ctcacacaggcatttcctgggtg

SEQ ID NO: 3891381 - DNA, 13 bp, Homo sapiens
ctcacagcctctc

SEQ ID NO: 3891382 - DNA, 18 bp, Homo sapiens
ctcacagtgacccttccc

SEQ ID NO: 3891383 - DNA, 18 bp, Homo sapiens
ctcacagttcctcgccct

SEQ ID NO: 3891384 - DNA, 19 bp, Homo sapiens
ctcacagttcctcgccctg

SEQ ID NO: 3891385 - DNA, 16 bp, Homo sapiens
ctcacattacacacac

SEQ ID NO: 3891386 - DNA, 10 bp, Homo sapiens
ctcaccaggg

SEQ ID NO: 3891387 - DNA, 22 bp, Homo sapiens
ctcaccagggtccgcaccagct

SEQ ID NO: 3891388 - DNA, 23 bp, Homo sapiens
ctcaccagtgtcccctccactgt

SEQ ID NO: 3891389 - DNA, 19 bp, Homo sapiens
ctcacccccagctttgcta

SEQ ID NO: 3891390 - DNA, 15 bp, Homo sapiens
ctcacctctctctaa

SEQ ID NO: 3891391 - DNA, 16 bp, Homo sapiens
ctcacctctctctaag

SEQ ID NO: 3891392 - DNA, 14 bp, Homo sapiens
ctcacctctgcctc

SEQ ID NO: 3891393 - DNA, 14 bp, Homo sapiens
ctcacctgggcctt

SEQ ID NO: 3891394 - DNA, 24 bp, Homo sapiens
ctcacctgggcctttcctgtgcca

SEQ ID NO: 3891395 - DNA, 20 bp, Homo sapiens
ctcacgcctgtaatcccagc

SEQ ID NO: 3891396 - DNA, 18 bp, Homo sapiens
ctcacgctcccccgcagt

SEQ ID NO: 3891397 - DNA, 21 bp, Homo sapiens
ctcacgctcccccgcagtccc

SEQ ID NO: 3891398 - DNA, 19 bp, Homo sapiens
ctcacgggcagtagctgtg

SEQ ID NO: 3891399 - DNA, 21 bp, Homo sapiens
ctcactatggtatgctggcca

SEQ ID NO: 3891400 - DNA, 20 bp, Homo sapiens
ctcactattacttgaacttt

SEQ ID NO: 3891401 - DNA, 11 bp, Homo sapiens
ctcactcagga

SEQ ID NO: 3891402 - DNA, 14 bp, Homo sapiens
ctcactcccactgg

SEQ ID NO: 3891403 - DNA, 15 bp, Homo sapiens
ctcactcccactgga

SEQ ID NO: 3891404 - DNA, 15 bp, Homo sapiens
ctcactctggcctca

SEQ ID NO: 3891405 - DNA, 13 bp, Homo sapiens
ctcactctgtcag

SEQ ID NO: 3891406 - DNA, 14 bp, Homo sapiens
ctcactctgtcagc

SEQ ID NO: 3891407 - DNA, 18 bp, Homo sapiens
ctcactcttatgaaatgg

SEQ ID NO: 3891408 - DNA, 14 bp, Homo sapiens
ctcactgctcaaga

SEQ ID NO: 3891409 - DNA, 14 bp, Homo sapiens
ctcactggctgggg

SEQ ID NO: 3891410 - DNA, 16 bp, Homo sapiens
ctcactggctggggca

SEQ ID NO: 3891411 - DNA, 17 bp, Homo sapiens
ctcacttataccaaagg

SEQ ID NO: 3891412 - DNA, 17 bp, Homo sapiens
ctcacttccctgggaac

SEQ ID NO: 3891413 - DNA, 17 bp, Homo sapiens
ctcagaaatttttattt

SEQ ID NO: 3891414 - DNA, 21 bp, Homo sapiens
ctcagaaatttttatttttct

SEQ ID NO: 3891415 - DNA, 14 bp, Homo sapiens
ctcagaagcctggg

SEQ ID NO: 3891416 - DNA, 21 bp, Homo sapiens
ctcagaagcctgggggcctgg

SEQ ID NO: 3891417 - DNA, 19 bp, Homo sapiens
ctcagaaggtattcctttt

SEQ ID NO: 3891418 - DNA, 13 bp, Homo sapiens
ctcagaccaactc

SEQ ID NO: 3891419 - DNA, 21 bp, Homo sapiens
ctcagaccaactctctcctgt

SEQ ID NO: 3891420 - DNA, 22 bp, Homo sapiens
ctcagacccccactctcattcc

SEQ ID NO: 3891421 - DNA, 23 bp, Homo sapiens
ctcagacccccactctcattccc

SEQ ID NO: 3891422 - DNA, 23 bp, Homo sapiens
ctcagagaatttctaccatttca

SEQ ID NO: 3891423 - DNA, 14 bp, Homo sapiens
ctcagagcaggctc

SEQ ID NO: 3891424 - DNA, 22 bp, Homo sapiens
ctcagagcaggctcagactctg

SEQ ID NO: 3891425 - DNA, 23 bp, Homo sapiens
ctcagagcaggctcagactctgg

SEQ ID NO: 3891426 - DNA, 12 bp, Homo sapiens
ctcagatctgaa

SEQ ID NO: 3891427 - DNA, 20 bp, Homo sapiens
ctcagatgatctctccacgg

SEQ ID NO: 3891428 - DNA, 19 bp, Homo sapiens
ctcagcaatagggtgcagt

SEQ ID NO: 3891429 - DNA, 13 bp, Homo sapiens
ctcagcacagact

SEQ ID NO: 3891430 - DNA, 19 bp, Homo sapiens
ctcagcagccccctgcccg

SEQ ID NO: 3891431 - DNA, 12 bp, Homo sapiens
ctcagcagccct

SEQ ID NO: 3891432 - DNA, 13 bp, Homo sapiens
ctcagcagccctc

SEQ ID NO: 3891433 - DNA, 18 bp, Homo sapiens
ctcagcagccctcctcac

SEQ ID NO: 3891434 - DNA, 19 bp, Homo sapiens
ctcagcagccctcctcacc

SEQ ID NO: 3891435 - DNA, 19 bp, Homo sapiens
ctcagcaggaacctgtact

SEQ ID NO: 3891436 - DNA, 13 bp, Homo sapiens
ctcagcaggccct

SEQ ID NO: 3891437 - DNA, 12 bp, Homo sapiens
ctcagcatacct

SEQ ID NO: 3891438 - DNA, 13 bp, Homo sapiens
ctcagccacaccc

SEQ ID NO: 3891439 - DNA, 15 bp, Homo sapiens
ctcagccatgaggag

SEQ ID NO: 3891440 - DNA, 14 bp, Homo sapiens
ctcagccctccctg

SEQ ID NO: 3891441 - DNA, 18 bp, Homo sapiens
ctcagcccttgcccccat

SEQ ID NO: 3891442 - DNA, 23 bp, Homo sapiens
ctcagccggcgtggcaaatataa

SEQ ID NO: 3891443 - DNA, 14 bp, Homo sapiens
ctcagcctcccaga

SEQ ID NO: 3891444 - DNA, 16 bp, Homo sapiens
ctcagcctcccagagt

SEQ ID NO: 3891445 - DNA, 22 bp, Homo sapiens
ctcagcctccccctgctgctca

SEQ ID NO: 3891446 - DNA, 12 bp, Homo sapiens
ctcagcctccta

SEQ ID NO: 3891447 - DNA, 13 bp, Homo sapiens
ctcagcctcctca

SEQ ID NO: 3891448 - DNA, 14 bp, Homo sapiens
ctcagcgaggtgta

SEQ ID NO: 3891449 - DNA, 16 bp, Homo sapiens
ctcagctcagcctccc

SEQ ID NO: 3891450 - DNA, 22 bp, Homo sapiens
ctcagctccagaataccttctt

SEQ ID NO: 3891451 - DNA, 23 bp, Homo sapiens
ctcagctccagaataccttcttc

SEQ ID NO: 3891452 - DNA, 15 bp, Homo sapiens
ctcagctcccaaggc

SEQ ID NO: 3891453 - DNA, 19 bp, Homo sapiens
ctcagctctcctgctgcag

SEQ ID NO: 3891454 - DNA, 23 bp, Homo sapiens
ctcagctgacacataatttgaat

SEQ ID NO: 3891455 - DNA, 18 bp, Homo sapiens
ctcagctgcacattcctg

SEQ ID NO: 3891456 - DNA, 21 bp, Homo sapiens
ctcagctgcacattcctggcc

SEQ ID NO: 3891457 - DNA, 12 bp, Homo sapiens
ctcagctgccaa

SEQ ID NO: 3891458 - DNA, 16 bp, Homo sapiens
ctcagctgccaagcac

SEQ ID NO: 3891459 - DNA, 17 bp, Homo sapiens
ctcagctgccaagcact

SEQ ID NO: 3891460 - DNA, 19 bp, Homo sapiens
ctcaggaagaaaccccaag

SEQ ID NO: 3891461 - DNA, 20 bp, Homo sapiens
ctcaggaagaaaccccaagc

SEQ ID NO: 3891462 - DNA, 21 bp, Homo sapiens
ctcaggaagaaaccccaagca

SEQ ID NO: 3891463 - DNA, 17 bp, Homo sapiens
ctcaggacacaggcctg

SEQ ID NO: 3891464 - DNA, 18 bp, Homo sapiens
ctcaggacacaggcctgt

SEQ ID NO: 3891465 - DNA, 21 bp, Homo sapiens
ctcaggacacaggcctgtgta

SEQ ID NO: 3891466 - DNA, 17 bp, Homo sapiens
ctcaggacccaggccct

SEQ ID NO: 3891467 - DNA, 19 bp, Homo sapiens
ctcaggacccaggccctcc

SEQ ID NO: 3891468 - DNA, 23 bp, Homo sapiens
ctcaggacccaggccctccatgg

SEQ ID NO: 3891469 - DNA, 20 bp, Homo sapiens
ctcaggacggaaggtcagtt

SEQ ID NO: 3891470 - DNA, 14 bp, Homo sapiens
ctcaggagcacagg

SEQ ID NO: 3891471 - DNA, 17 bp, Homo sapiens
ctcaggagcacaggcag

SEQ ID NO: 3891472 - DNA, 18 bp, Homo sapiens
ctcaggagcacaggcagc

SEQ ID NO: 3891473 - DNA, 23 bp, Homo sapiens
ctcaggaggcgaataaatgttca

SEQ ID NO: 3891474 - DNA, 16 bp, Homo sapiens
ctcaggaggcgcagcc

SEQ ID NO: 3891475 - DNA, 13 bp, Homo sapiens
ctcaggaggctga

SEQ ID NO: 3891476 - DNA, 13 bp, Homo sapiens
ctcaggcaagccc

SEQ ID NO: 3891477 - DNA, 15 bp, Homo sapiens
ctcaggcaagcccct

SEQ ID NO: 3891478 - DNA, 19 bp, Homo sapiens
ctcaggcaagcccctcagc

SEQ ID NO: 3891479 - DNA, 19 bp, Homo sapiens
ctcaggcagacaagagctg

SEQ ID NO: 3891480 - DNA, 22 bp, Homo sapiens
ctcaggcagacaagagctgctg

SEQ ID NO: 3891481 - DNA, 23 bp, Homo sapiens
ctcaggcagacaagagctgctgt

SEQ ID NO: 3891482 - DNA, 14 bp, Homo sapiens
ctcaggcccggcat

SEQ ID NO: 3891483 - DNA, 17 bp, Homo sapiens
ctcagggacaacatttt

SEQ ID NO: 3891484 - DNA, 14 bp, Homo sapiens
ctcagggacagaga

SEQ ID NO: 3891485 - DNA, 19 bp, Homo sapiens
ctcagggacagagacacct

SEQ ID NO: 3891486 - DNA, 22 bp, Homo sapiens
ctcagggacagagacacctgca

SEQ ID NO: 3891487 - DNA, 14 bp, Homo sapiens
ctcagggctgccac

SEQ ID NO: 3891488 - DNA, 15 bp, Homo sapiens
ctcagggctggagtg

SEQ ID NO: 3891489 - DNA, 17 bp, Homo sapiens
ctcaggtagtactggga

SEQ ID NO: 3891490 - DNA, 20 bp, Homo sapiens
ctcaggtgactggagcccga

SEQ ID NO: 3891491 - DNA, 13 bp, Homo sapiens
ctcaggtgccact

SEQ ID NO: 3891492 - DNA, 21 bp, Homo sapiens
ctcaggtgccactccctgagc

SEQ ID NO: 3891493 - DNA, 22 bp, Homo sapiens
ctcaggtgccactccctgagct

SEQ ID NO: 3891494 - DNA, 14 bp, Homo sapiens
ctcaggttgtctga

SEQ ID NO: 3891495 - DNA, 14 bp, Homo sapiens
ctcagtccagatgc

SEQ ID NO: 3891496 - DNA, 21 bp, Homo sapiens
ctcagtccagatgccttcctg

SEQ ID NO: 3891497 - DNA, 13 bp, Homo sapiens
ctcagtgcctcct

SEQ ID NO: 3891498 - DNA, 15 bp, Homo sapiens
ctcagtgcctcctgg

SEQ ID NO: 3891499 - DNA, 17 bp, Homo sapiens
ctcagtgttttagctgt

SEQ ID NO: 3891500 - DNA, 14 bp, Homo sapiens
ctcagttaaaatgt

SEQ ID NO: 3891501 - DNA, 22 bp, Homo sapiens
ctcagttcaacctggtggcacc

SEQ ID NO: 3891502 - DNA, 13 bp, Homo sapiens
ctcagtttcccca

SEQ ID NO: 3891503 - DNA, 14 bp, Homo sapiens
ctcagtttccccat

SEQ ID NO: 3891504 - DNA, 23 bp, Homo sapiens
ctcagtttttcggtgggacagcc

SEQ ID NO: 3891505 - DNA, 13 bp, Homo sapiens
ctcataacatctt

SEQ ID NO: 3891506 - DNA, 17 bp, Homo sapiens
ctcataaggcatataca

SEQ ID NO: 3891507 - DNA, 21 bp, Homo sapiens
ctcataggaaaagtacattta

SEQ ID NO: 3891508 - DNA, 23 bp, Homo sapiens
ctcataggaaaagtacatttaat

SEQ ID NO: 3891509 - DNA, 15 bp, Homo sapiens
ctcatatatttaagc

SEQ ID NO: 3891510 - DNA, 15 bp, Homo sapiens
ctcatatttaaagac

SEQ ID NO: 3891511 - DNA, 13 bp, Homo sapiens
ctcatattttgta

SEQ ID NO: 3891512 - DNA, 13 bp, Homo sapiens
ctcatcacccagt

SEQ ID NO: 3891513 - DNA, 14 bp, Homo sapiens
ctcatcacccagtc

SEQ ID NO: 3891514 - DNA, 15 bp, Homo sapiens
ctcatcactggatga

SEQ ID NO: 3891515 - DNA, 17 bp, Homo sapiens
ctcatcccctcgtcctg

SEQ ID NO: 3891516 - DNA, 20 bp, Homo sapiens
ctcatcccctcgtcctgtcc

SEQ ID NO: 3891517 - DNA, 13 bp, Homo sapiens
ctcatcctccttc

SEQ ID NO: 3891518 - DNA, 16 bp, Homo sapiens
ctcatcctccttcttc

SEQ ID NO: 3891519 - DNA, 18 bp, Homo sapiens
ctcatcctgtgtggggag

SEQ ID NO: 3891520 - DNA, 23 bp, Homo sapiens
ctcatctgatatgcagagtattt

SEQ ID NO: 3891521 - DNA, 15 bp, Homo sapiens
ctcatgcctgcctga

SEQ ID NO: 3891522 - DNA, 16 bp, Homo sapiens
ctcatgcctggccccc

SEQ ID NO: 3891523 - DNA, 18 bp, Homo sapiens
ctcatggagaaacatcct

SEQ ID NO: 3891524 - DNA, 23 bp, Homo sapiens
ctcatggcgtaatgggcctgccc

SEQ ID NO: 3891525 - DNA, 18 bp, Homo sapiens
ctcatggcttagaaatct

SEQ ID NO: 3891526 - DNA, 17 bp, Homo sapiens
ctcatgtctcagcctcc

SEQ ID NO: 3891527 - DNA, 14 bp, Homo sapiens
ctcatgtgatcctt

SEQ ID NO: 3891528 - DNA, 23 bp, Homo sapiens
ctcatgttgaagccactgccttc

SEQ ID NO: 3891529 - DNA, 18 bp, Homo sapiens
ctcatgttgttcccacac

SEQ ID NO: 3891530 - DNA, 21 bp, Homo sapiens
ctcatgttgttcccacacaca

SEQ ID NO: 3891531 - DNA, 21 bp, Homo sapiens
ctcattccaccttcccatgcc

SEQ ID NO: 3891532 - DNA, 13 bp, Homo sapiens
ctcattccccagg

SEQ ID NO: 3891533 - DNA, 20 bp, Homo sapiens
ctcattcgcctgtgggaaga

SEQ ID NO: 3891534 - DNA, 14 bp, Homo sapiens
ctcattctctttct

SEQ ID NO: 3891535 - DNA, 15 bp, Homo sapiens
ctcattctctttctt

SEQ ID NO: 3891536 - DNA, 23 bp, Homo sapiens
ctcattctctttctttttctgtc

SEQ ID NO: 3891537 - DNA, 22 bp, Homo sapiens
ctcattctgttgcccaggctgg

SEQ ID NO: 3891538 - DNA, 12 bp, Homo sapiens
ctcattgtagag

SEQ ID NO: 3891539 - DNA, 17 bp, Homo sapiens
ctcattttaggcctcct

SEQ ID NO: 3891540 - DNA, 24 bp, Homo sapiens
ctcattttaggcctcctctctgcc

SEQ ID NO: 3891541 - DNA, 18 bp, Homo sapiens
ctccaaacaccggcagaa

SEQ ID NO: 3891542 - DNA, 14 bp, Homo sapiens
ctccaaactcctgc

SEQ ID NO: 3891543 - DNA, 15 bp, Homo sapiens
ctccaaactcctgcc

SEQ ID NO: 3891544 - DNA, 18 bp, Homo sapiens
ctccaaactcctgcctgt

SEQ ID NO: 3891545 - DNA, 12 bp, Homo sapiens
ctccaaagaaat

SEQ ID NO: 3891546 - DNA, 16 bp, Homo sapiens
ctccaaaggggctgct

SEQ ID NO: 3891547 - DNA, 20 bp, Homo sapiens
ctccaaaggggctgctgggg

SEQ ID NO: 3891548 - DNA, 20 bp, Homo sapiens
ctccaaatgagacacattaa

SEQ ID NO: 3891549 - DNA, 12 bp, Homo sapiens
ctccaaatgatt

SEQ ID NO: 3891550 - DNA, 18 bp, Homo sapiens
ctccaacaataaagagct

SEQ ID NO: 3891551 - DNA, 14 bp, Homo sapiens
ctccaacagcttga

SEQ ID NO: 3891552 - DNA, 20 bp, Homo sapiens
ctccaacagcttgaccagac

SEQ ID NO: 3891553 - DNA, 23 bp, Homo sapiens
ctccaacagcttgaccagaccta

SEQ ID NO: 3891554 - DNA, 14 bp, Homo sapiens
ctccaacctggaca

SEQ ID NO: 3891555 - DNA, 20 bp, Homo sapiens
ctccaacgttaaaagacagt

SEQ ID NO: 3891556 - DNA, 18 bp, Homo sapiens
ctccaactggattataaa

SEQ ID NO: 3891557 - DNA, 20 bp, Homo sapiens
ctccaagaatacagaaaatg

SEQ ID NO: 3891558 - DNA, 17 bp, Homo sapiens
ctccaagcttcaagtga

SEQ ID NO: 3891559 - DNA, 15 bp, Homo sapiens
ctccaaggtggggtc

SEQ ID NO: 3891560 - DNA, 14 bp, Homo sapiens
ctccaatcctttcc

SEQ ID NO: 3891561 - DNA, 15 bp, Homo sapiens
ctccaattgtaaaaa

SEQ ID NO: 3891562 - DNA, 21 bp, Homo sapiens
ctccacagttcgacctgcggc

SEQ ID NO: 3891563 - DNA, 13 bp, Homo sapiens
ctccaccaaccca

SEQ ID NO: 3891564 - DNA, 20 bp, Homo sapiens
ctccaccaacccatcagaag

SEQ ID NO: 3891565 - DNA, 14 bp, Homo sapiens
ctccacccactgtc

SEQ ID NO: 3891566 - DNA, 18 bp, Homo sapiens
ctccacccccgccacggc

SEQ ID NO: 3891567 - DNA, 19 bp, Homo sapiens
ctccacccccgccacggcc

SEQ ID NO: 3891568 - DNA, 23 bp, Homo sapiens
ctccacccccgccacggccaccc

SEQ ID NO: 3891569 - DNA, 17 bp, Homo sapiens
ctccaccccctccagct

SEQ ID NO: 3891570 - DNA, 22 bp, Homo sapiens
ctccaccccctccagctccagt

SEQ ID NO: 3891571 - DNA, 18 bp, Homo sapiens
ctccaccgcagaaggaag

SEQ ID NO: 3891572 - DNA, 19 bp, Homo sapiens
ctccaccgctgcctaagtg

SEQ ID NO: 3891573 - DNA, 12 bp, Homo sapiens
ctccacctcagc

SEQ ID NO: 3891574 - DNA, 14 bp, Homo sapiens
ctccacctcagcct

SEQ ID NO: 3891575 - DNA, 13 bp, Homo sapiens
ctccacctcctga

SEQ ID NO: 3891576 - DNA, 18 bp, Homo sapiens
ctccacctctccttggaa

SEQ ID NO: 3891577 - DNA, 16 bp, Homo sapiens
ctccacgcctcctggc

SEQ ID NO: 3891578 - DNA, 19 bp, Homo sapiens
ctccacgcctcctggccag

SEQ ID NO: 3891579 - DNA, 22 bp, Homo sapiens
ctccacggtcagatttgctgtt

SEQ ID NO: 3891580 - DNA, 17 bp, Homo sapiens
ctccacggtgcgtggct

SEQ ID NO: 3891581 - DNA, 20 bp, Homo sapiens
ctccacggtgcgtggctgtg

SEQ ID NO: 3891582 - DNA, 22 bp, Homo sapiens
ctccacggtgcgtggctgtggc

SEQ ID NO: 3891583 - DNA, 23 bp, Homo sapiens
ctccacggtgcgtggctgtggca

SEQ ID NO: 3891584 - DNA, 13 bp, Homo sapiens
ctccactcactcc

SEQ ID NO: 3891585 - DNA, 20 bp, Homo sapiens
ctccactctccttcgtgtct

SEQ ID NO: 3891586 - DNA, 13 bp, Homo sapiens
ctccactggatgg

SEQ ID NO: 3891587 - DNA, 18 bp, Homo sapiens
ctccactgtcaccctcca

SEQ ID NO: 3891588 - DNA, 15 bp, Homo sapiens
ctccactttgttgga

SEQ ID NO: 3891589 - DNA, 20 bp, Homo sapiens
ctccagaagtggggctctgg

SEQ ID NO: 3891590 - DNA, 21 bp, Homo sapiens
ctccagaatctgctgttgcca

SEQ ID NO: 3891591 - DNA, 22 bp, Homo sapiens
ctccagaatctgctgttgccat

SEQ ID NO: 3891592 - DNA, 21 bp, Homo sapiens
ctccagacagatacagcccca

SEQ ID NO: 3891593 - DNA, 17 bp, Homo sapiens
ctccagacccaccacac

SEQ ID NO: 3891594 - DNA, 17 bp, Homo sapiens
ctccagacccctggctt

SEQ ID NO: 3891595 - DNA, 17 bp, Homo sapiens
ctccagacccctgtggc

SEQ ID NO: 3891596 - DNA, 18 bp, Homo sapiens
ctccagacccctgtggca

SEQ ID NO: 3891597 - DNA, 22 bp, Homo sapiens
ctccagacccctgtggcagacc

SEQ ID NO: 3891598 - DNA, 13 bp, Homo sapiens
ctccagaccctgc

SEQ ID NO: 3891599 - DNA, 20 bp, Homo sapiens
ctccagagacaggaaagaat

SEQ ID NO: 3891600 - DNA, 18 bp, Homo sapiens
ctccagagccagcctggg

SEQ ID NO: 3891601 - DNA, 14 bp, Homo sapiens
ctccagagggacag

SEQ ID NO: 3891602 - DNA, 23 bp, Homo sapiens
ctccagagtctgagcccccggct

SEQ ID NO: 3891603 - DNA, 21 bp, Homo sapiens
ctccagagtgtgcagactgat

SEQ ID NO: 3891604 - DNA, 11 bp, Homo sapiens
gtcctgccagc

SEQ ID NO: 3891605 - DNA, 15 bp, Homo sapiens
gtcctgccagctgcc

SEQ ID NO: 3891606 - DNA, 22 bp, Homo sapiens
gtcctgccagctgccttcctca

SEQ ID NO: 3891607 - DNA, 15 bp, Homo sapiens
gtcctgcccaatgcc

SEQ ID NO: 3891608 - DNA, 13 bp, Homo sapiens
gtcctgcccatgt

SEQ ID NO: 3891609 - DNA, 18 bp, Homo sapiens
gtcctgcctctctgctcc

SEQ ID NO: 3891610 - DNA, 19 bp, Homo sapiens
gtcctgcctctctgctcca

SEQ ID NO: 3891611 - DNA, 19 bp, Homo sapiens
gtcctgcgtcgaagctttg

SEQ ID NO: 3891612 - DNA, 15 bp, Homo sapiens
gtcctgctggcacct

SEQ ID NO: 3891613 - DNA, 17 bp, Homo sapiens
gtcctgctggcacctca

SEQ ID NO: 3891614 - DNA, 13 bp, Homo sapiens
gtcctggctgctc

SEQ ID NO: 3891615 - DNA, 23 bp, Homo sapiens
gtcctggcttctagatctggaac

SEQ ID NO: 3891616 - DNA, 16 bp, Homo sapiens
gtcctggtggggcagc

SEQ ID NO: 3891617 - DNA, 17 bp, Homo sapiens
gtcctggtggggcagct

SEQ ID NO: 3891618 - DNA, 20 bp, Homo sapiens
gtcctggtggggcagctcct

SEQ ID NO: 3891619 - DNA, 12 bp, Homo sapiens
gtcctgtcccag

SEQ ID NO: 3891620 - DNA, 14 bp, Homo sapiens
gtcctgtcccagag

SEQ ID NO: 3891621 - DNA, 15 bp, Homo sapiens
gtcctgtcccagagg

SEQ ID NO: 3891622 - DNA, 15 bp, Homo sapiens
gtcctgtctctgcct

SEQ ID NO: 3891623 - DNA, 19 bp, Homo sapiens
gtcctgtggtgacaggccc

SEQ ID NO: 3891624 - DNA, 15 bp, Homo sapiens
gtcctgttccctacc

SEQ ID NO: 3891625 - DNA, 13 bp, Homo sapiens
gtccttactcctg

SEQ ID NO: 3891626 - DNA, 17 bp, Homo sapiens
gtccttactcctgtggg

SEQ ID NO: 3891627 - DNA, 22 bp, Homo sapiens
gtccttactcctgtgggagcct

SEQ ID NO: 3891628 - DNA, 23 bp, Homo sapiens
gtccttactcctgtgggagcctc

SEQ ID NO: 3891629 - DNA, 19 bp, Homo sapiens
gtccttgcacccctcactc

SEQ ID NO: 3891630 - DNA, 14 bp, Homo sapiens
gtccttgcacctgc

SEQ ID NO: 3891631 - DNA, 18 bp, Homo sapiens
gtccttgcacctgcatcc

SEQ ID NO: 3891632 - DNA, 16 bp, Homo sapiens
gtccttggggcacagt

SEQ ID NO: 3891633 - DNA, 16 bp, Homo sapiens
gtcctttaggcagcct

SEQ ID NO: 3891634 - DNA, 17 bp, Homo sapiens
gtcctttaggcagcctg

SEQ ID NO: 3891635 - DNA, 18 bp, Homo sapiens
gtcctttgagaaagaaat

SEQ ID NO: 3891636 - DNA, 19 bp, Homo sapiens
gtcgcaggatccgctgcca

SEQ ID NO: 3891637 - DNA, 22 bp, Homo sapiens
gtcgcaggatccgctgccacca

SEQ ID NO: 3891638 - DNA, 15 bp, Homo sapiens
gtcgccccaggccct

SEQ ID NO: 3891639 - DNA, 22 bp, Homo sapiens
gtcgccccaggccctccctgac

SEQ ID NO: 3891640 - DNA, 12 bp, Homo sapiens
gtcgcctctgca

SEQ ID NO: 3891641 - DNA, 16 bp, Homo sapiens
gtcgctggacaaccca

SEQ ID NO: 3891642 - DNA, 17 bp, Homo sapiens
gtcgctggacaacccag

SEQ ID NO: 3891643 - DNA, 22 bp, Homo sapiens
gtcggcacgtcccatgtgcatg

SEQ ID NO: 3891644 - DNA, 23 bp, Homo sapiens
gtcgggttttattgtttaaaatc

SEQ ID NO: 3891645 - DNA, 17 bp, Homo sapiens
gtcgtccttactcctgt

SEQ ID NO: 3891646 - DNA, 22 bp, Homo sapiens
gtcgtggcagataatcagcctc

SEQ ID NO: 3891647 - DNA, 14 bp, Homo sapiens
gtctaaagagcttt

SEQ ID NO: 3891648 - DNA, 16 bp, Homo sapiens
gtctaaagtttacagt

SEQ ID NO: 3891649 - DNA, 13 bp, Homo sapiens
gtctaccctggga

SEQ ID NO: 3891650 - DNA, 13 bp, Homo sapiens
gtctagaaaccag

SEQ ID NO: 3891651 - DNA, 13 bp, Homo sapiens
gtctaggagctgg

SEQ ID NO: 3891652 - DNA, 17 bp, Homo sapiens
gtctatatgaaaaacaa

SEQ ID NO: 3891653 - DNA, 14 bp, Homo sapiens
gtctattctgagcc

SEQ ID NO: 3891654 - DNA, 18 bp, Homo sapiens
gtctattctgagccttga

SEQ ID NO: 3891655 - DNA, 10 bp, Homo sapiens
gtctatttaa

SEQ ID NO: 3891656 - DNA, 17 bp, Homo sapiens
gtctcaactactcagct

SEQ ID NO: 3891657 - DNA, 19 bp, Homo sapiens
gtctcactatgttgcccag

SEQ ID NO: 3891658 - DNA, 22 bp, Homo sapiens
gtctcagcccgggacagggtct

SEQ ID NO: 3891659 - DNA, 14 bp, Homo sapiens
gtctcagcctcctc

SEQ ID NO: 3891660 - DNA, 13 bp, Homo sapiens
gtctcaggccctg

SEQ ID NO: 3891661 - DNA, 23 bp, Homo sapiens
gtctcattctgttgcccaggctg

SEQ ID NO: 3891662 - DNA, 14 bp, Homo sapiens
gtctccaagaatac

SEQ ID NO: 3891663 - DNA, 21 bp, Homo sapiens
gtctccagtatccactttgca

SEQ ID NO: 3891664 - DNA, 17 bp, Homo sapiens
gtctcccacgtgggaga

SEQ ID NO: 3891665 - DNA, 15 bp, Homo sapiens
gtctccctaaaataa

SEQ ID NO: 3891666 - DNA, 16 bp, Homo sapiens
gtctccctggagtgca

SEQ ID NO: 3891667 - DNA, 16 bp, Homo sapiens
gtctccgcacttggaa

SEQ ID NO: 3891668 - DNA, 17 bp, Homo sapiens
gtctccgcacttggaaa

SEQ ID NO: 3891669 - DNA, 19 bp, Homo sapiens
gtctcctctgattatcagg

SEQ ID NO: 3891670 - DNA, 18 bp, Homo sapiens
gtctccttactctgagcc

SEQ ID NO: 3891671 - DNA, 23 bp, Homo sapiens
gtctccttactctgagcccaggc

SEQ ID NO: 3891672 - DNA, 15 bp, Homo sapiens
gtctcctttgcactg

SEQ ID NO: 3891673 - DNA, 18 bp, Homo sapiens
gtctcctttgcactgagg

SEQ ID NO: 3891674 - DNA, 22 bp, Homo sapiens
gtctcctttgcactgagggcca

SEQ ID NO: 3891675 - DNA, 23 bp, Homo sapiens
gtctcgggtggctagtcagagag

SEQ ID NO: 3891676 - DNA, 18 bp, Homo sapiens
gtctctcattctctttct

SEQ ID NO: 3891677 - DNA, 19 bp, Homo sapiens
gtctctcattctctttctt

SEQ ID NO: 3891678 - DNA, 13 bp, Homo sapiens
gtctctcccaccc

SEQ ID NO: 3891679 - DNA, 16 bp, Homo sapiens
gtctctcccaccccgg

SEQ ID NO: 3891680 - DNA, 22 bp, Homo sapiens
gtgaattgcctgcagagagaag

SEQ ID NO: 3891681 - DNA, 18 bp, Homo sapiens
gtgacaaaattttataag

SEQ ID NO: 3891682 - DNA, 20 bp, Homo sapiens
gtgacacaatcctcaaacat

SEQ ID NO: 3891683 - DNA, 16 bp, Homo sapiens
gtgacaggaaagccct

SEQ ID NO: 3891684 - DNA, 15 bp, Homo sapiens
gtgacaggcccagtg

SEQ ID NO: 3891685 - DNA, 17 bp, Homo sapiens
gtgacatcccaggaggg

SEQ ID NO: 3891686 - DNA, 13 bp, Homo sapiens
gtgaccccagggc

SEQ ID NO: 3891687 - DNA, 15 bp, Homo sapiens
gtgaccccagggcac

SEQ ID NO: 3891688 - DNA, 22 bp, Homo sapiens
gtgaccccagggcacaggagct

SEQ ID NO: 3891689 - DNA, 20 bp, Homo sapiens
tacagaaatactgctctgaa

SEQ ID NO: 3891690 - DNA, 19 bp, Homo sapiens
tacagaacacgctttcaca

SEQ ID NO: 3891691 - DNA, 16 bp, Homo sapiens
tacagaatttttaatg

SEQ ID NO: 3891692 - DNA, 18 bp, Homo sapiens
tacagaatttttaatgac

SEQ ID NO: 3891693 - DNA, 20 bp, Homo sapiens
tacagaatttttaatgactt

SEQ ID NO: 3891694 - DNA, 21 bp, Homo sapiens
tacagaatttttaatgacttt

SEQ ID NO: 3891695 - DNA, 19 bp, Homo sapiens
tacagagaaattctgtggt

SEQ ID NO: 3891696 - DNA, 15 bp, Homo sapiens
tacagagaagtgaat

SEQ ID NO: 3891697 - DNA, 21 bp, Homo sapiens
tacagcagggtcttgctgtaa

SEQ ID NO: 3891698 - DNA, 16 bp, Homo sapiens
tacagcgagaggcaga

SEQ ID NO: 3891699 - DNA, 19 bp, Homo sapiens
tacagcgagaggcagagaa

SEQ ID NO: 3891700 - DNA, 20 bp, Homo sapiens
tacagcgagaggcagagaaa

SEQ ID NO: 3891701 - DNA, 16 bp, Homo sapiens
tacagctaatcagcat

SEQ ID NO: 3891702 - DNA, 17 bp, Homo sapiens
tacagctcttggcattt

SEQ ID NO: 3891703 - DNA, 19 bp, Homo sapiens
tacaggccttttgactctt

SEQ ID NO: 3891704 - DNA, 18 bp, Homo sapiens
tacagggtagcaggtacc

SEQ ID NO: 3891705 - DNA, 15 bp, Homo sapiens
tacagtaaataaatt

SEQ ID NO: 3891706 - DNA, 16 bp, Homo sapiens
tacagtaaataaattg

SEQ ID NO: 3891707 - DNA, 21 bp, Homo sapiens
tacagtaaataaattgtttga

SEQ ID NO: 3891708 - DNA, 20 bp, Homo sapiens
tacagtagcttaaataaatt

SEQ ID NO: 3891709 - DNA, 15 bp, Homo sapiens
tacagtcaattttac

SEQ ID NO: 3891710 - DNA, 22 bp, Homo sapiens
tacagtgactgtcgtgtttaca

SEQ ID NO: 3891711 - DNA, 17 bp, Homo sapiens
tacagtgaggagggtgg

SEQ ID NO: 3891712 - DNA, 15 bp, Homo sapiens
tacagtggagtgaga

SEQ ID NO: 3891713 - DNA, 20 bp, Homo sapiens
tacagttatgcatcctgtat

SEQ ID NO: 3891714 - DNA, 12 bp, Homo sapiens
tacagttcagtt

SEQ ID NO: 3891715 - DNA, 13 bp, Homo sapiens
tacataacaagaa

SEQ ID NO: 3891716 - DNA, 18 bp, Homo sapiens
tacataacaagaaaatca

SEQ ID NO: 3891717 - DNA, 18 bp, Homo sapiens
tacataacttgatataga

SEQ ID NO: 3891718 - DNA, 22 bp, Homo sapiens
tacataacttgatatagaaagc

SEQ ID NO: 3891719 - DNA, 19 bp, Homo sapiens
tacataattttttattcaa

SEQ ID NO: 3891720 - DNA, 13 bp, Homo sapiens
tacatacacatac

SEQ ID NO: 3891721 - DNA, 22 bp, Homo sapiens
tacatacacttgtataaatgta

SEQ ID NO: 3891722 - DNA, 18 bp, Homo sapiens
tacatacatacatacata

SEQ ID NO: 3891723 - DNA, 16 bp, Homo sapiens
tacatagatggaccag

SEQ ID NO: 3891724 - DNA, 18 bp, Homo sapiens
tacatagatgtatcatta

SEQ ID NO: 3891725 - DNA, 14 bp, Homo sapiens
tacatagtcacaaa

SEQ ID NO: 3891726 - DNA, 15 bp, Homo sapiens
tacatatatatctga

SEQ ID NO: 3891727 - DNA, 13 bp, Homo sapiens
tacatatcagaaa

SEQ ID NO: 3891728 - DNA, 20 bp, Homo sapiens
tacatatcagaaaagtagaa

SEQ ID NO: 3891729 - DNA, 22 bp, Homo sapiens
tacatatcagaaaagtagaatt

SEQ ID NO: 3891730 - DNA, 16 bp, Homo sapiens
tacatatgtaaaataa

SEQ ID NO: 3891731 - DNA, 17 bp, Homo sapiens
tacatatgtaaaataaa

SEQ ID NO: 3891732 - DNA, 15 bp, Homo sapiens
tacatatgtagacta

SEQ ID NO: 3891733 - DNA, 18 bp, Homo sapiens
tacatattataaataaat

SEQ ID NO: 3891734 - DNA, 20 bp, Homo sapiens
tacatattataaataaatgc

SEQ ID NO: 3891735 - DNA, 15 bp, Homo sapiens
tacatattctttaaa

SEQ ID NO: 3891736 - DNA, 15 bp, Homo sapiens
tacatctaatgcttc

SEQ ID NO: 3891737 - DNA, 19 bp, Homo sapiens
tacatcttcagctcccata

SEQ ID NO: 3891738 - DNA, 21 bp, Homo sapiens
tacatcttcagctcccatagc

SEQ ID NO: 3891739 - DNA, 15 bp, Homo sapiens
tacatgaacacagct

SEQ ID NO: 3891740 - DNA, 19 bp, Homo sapiens
tacatgactcagcatacct

SEQ ID NO: 3891741 - DNA, 16 bp, Homo sapiens
tacatgcaatttatta

SEQ ID NO: 3891742 - DNA, 17 bp, Homo sapiens
tacatgctgtgctcttt

SEQ ID NO: 3891743 - DNA, 16 bp, Homo sapiens
tacatgtgtgtatata

SEQ ID NO: 3891744 - DNA, 21 bp, Homo sapiens
tacatgtgtgtatatatgtgt

SEQ ID NO: 3891745 - DNA, 17 bp, Homo sapiens
tacatgtttaaattgta

SEQ ID NO: 3891746 - DNA, 12 bp, Homo sapiens
tacattaatgtt

SEQ ID NO: 3891747 - DNA, 20 bp, Homo sapiens
tacattcctcagctgccaag

SEQ ID NO: 3891748 - DNA, 15 bp, Homo sapiens
tacatttaatacagc

SEQ ID NO: 3891749 - DNA, 13 bp, Homo sapiens
tacatttatacat

SEQ ID NO: 3891750 - DNA, 14 bp, Homo sapiens
tacatttatacatc

SEQ ID NO: 3891751 - DNA, 16 bp, Homo sapiens
tacatttatacatcac

SEQ ID NO: 3891752 - DNA, 16 bp, Homo sapiens
tacatttccctgtgct

SEQ ID NO: 3891753 - DNA, 14 bp, Homo sapiens
tacatttttacaat

SEQ ID NO: 3891754 - DNA, 16 bp, Homo sapiens
tacatttttacaataa

SEQ ID NO: 3891755 - DNA, 14 bp, Homo sapiens
taccaaatataaac

SEQ ID NO: 3891756 - DNA, 17 bp, Homo sapiens
taccaaatataaacttg

SEQ ID NO: 3891757 - DNA, 18 bp, Homo sapiens
taccaaatataaacttgt

SEQ ID NO: 3891758 - DNA, 14 bp, Homo sapiens
taccaaatatttta

SEQ ID NO: 3891759 - DNA, 14 bp, Homo sapiens
taccaactttctgt

SEQ ID NO: 3891760 - DNA, 14 bp, Homo sapiens
taccaatgcatgca

SEQ ID NO: 3891761 - DNA, 14 bp, Homo sapiens
taccaatgccaaga

SEQ ID NO: 3891762 - DNA, 21 bp, Homo sapiens
taccaatgccaagataattca

SEQ ID NO: 3891763 - DNA, 19 bp, Homo sapiens
taccaatgcttttatcaaa

SEQ ID NO: 3891764 - DNA, 12 bp, Homo sapiens
taccacagcagc

SEQ ID NO: 3891765 - DNA, 20 bp, Homo sapiens
taccaccttccctctttcta

SEQ ID NO: 3891766 - DNA, 17 bp, Homo sapiens
taccagggatgtagatt

SEQ ID NO: 3891767 - DNA, 16 bp, Homo sapiens
taccatactcatttct

SEQ ID NO: 3891768 - DNA, 22 bp, Homo sapiens
taccatactcatttctaaaaga

SEQ ID NO: 3891769 - DNA, 19 bp, Homo sapiens
taccatatgtctgcttctg

SEQ ID NO: 3891770 - DNA, 12 bp, Homo sapiens
taccatgctgct

SEQ ID NO: 3891771 - DNA, 22 bp, Homo sapiens
taccatgctgctttttggcaca

SEQ ID NO: 3891772 - DNA, 14 bp, Homo sapiens
tagactgaagagac

SEQ ID NO: 3891773 - DNA, 17 bp, Homo sapiens
tagacttactttcctat

SEQ ID NO: 3891774 - DNA, 21 bp, Homo sapiens
tagacttcagaacatgctgga

SEQ ID NO: 3891775 - DNA, 21 bp, Homo sapiens
tagactttctcagtgggacaa

SEQ ID NO: 3891776 - DNA, 13 bp, Homo sapiens
tagagaaggaccc

SEQ ID NO: 3891777 - DNA, 22 bp, Homo sapiens
tagagaaggacccggaggggcc

SEQ ID NO: 3891778 - DNA, 12 bp, Homo sapiens
tagagatgtgtg

SEQ ID NO: 3891779 - DNA, 17 bp, Homo sapiens
tagagattttcttggca

SEQ ID NO: 3891780 - DNA, 14 bp, Homo sapiens
tagagcagcccaaa

SEQ ID NO: 3891781 - DNA, 14 bp, Homo sapiens
tagagctcctgtcc

SEQ ID NO: 3891782 - DNA, 23 bp, Homo sapiens
tagagctcctgtccctacccact

SEQ ID NO: 3891783 - DNA, 15 bp, Homo sapiens
tagagcttctggcac

SEQ ID NO: 3891784 - DNA, 15 bp, Homo sapiens
tagagcttggacagt

SEQ ID NO: 3891785 - DNA, 19 bp, Homo sapiens
tagagcttggacagtctga

SEQ ID NO: 3891786 - DNA, 17 bp, Homo sapiens
tagagctttcaagtaca

SEQ ID NO: 3891787 - DNA, 13 bp, Homo sapiens
tagagtttaacac

SEQ ID NO: 3891788 - DNA, 20 bp, Homo sapiens
tagatactttgctagccggc

SEQ ID NO: 3891789 - DNA, 17 bp, Homo sapiens
tagatatcacttactca

SEQ ID NO: 3891790 - DNA, 16 bp, Homo sapiens
tagatccacacacaga

SEQ ID NO: 3891791 - DNA, 18 bp, Homo sapiens
tagatccacacacagagg

SEQ ID NO: 3891792 - DNA, 21 bp, Homo sapiens
tagatccatttggacaaaatg

SEQ ID NO: 3891793 - DNA, 21 bp, Homo sapiens
tagatcccatgtcacctcagc

SEQ ID NO: 3891794 - DNA, 15 bp, Homo sapiens
tagatcgcttgagcc

SEQ ID NO: 3891795 - DNA, 17 bp, Homo sapiens
tagatcgcttgagccca

SEQ ID NO: 3891796 - DNA, 18 bp, Homo sapiens
tagatcgcttgagcccag

SEQ ID NO: 3891797 - DNA, 15 bp, Homo sapiens
tagatggtgaaattt

SEQ ID NO: 3891798 - DNA, 23 bp, Homo sapiens
tagattacctgatcatggtcagc

SEQ ID NO: 3891799 - DNA, 20 bp, Homo sapiens
tagcaagattgcttaaaata

SEQ ID NO: 3891800 - DNA, 16 bp, Homo sapiens
tagcaaggcatgatgt

SEQ ID NO: 3891801 - DNA, 17 bp, Homo sapiens
tagcaagttctagagaa

SEQ ID NO: 3891802 - DNA, 19 bp, Homo sapiens
tagcaagttctagagaaga

SEQ ID NO: 3891803 - DNA, 16 bp, Homo sapiens
tagcaattccatcacc

SEQ ID NO: 3891804 - DNA, 23 bp, Homo sapiens
tagcagataaagacagctgacag

SEQ ID NO: 3891805 - DNA, 17 bp, Homo sapiens
tagcaggtaccactgat

SEQ ID NO: 3891806 - DNA, 16 bp, Homo sapiens
tagcatcttctggagt

SEQ ID NO: 3891807 - DNA, 17 bp, Homo sapiens
tagcatggactctgggt

SEQ ID NO: 3891808 - DNA, 16 bp, Homo sapiens
tagcattttcttgaac

SEQ ID NO: 3891809 - DNA, 20 bp, Homo sapiens
tagcatttttgatttatgca

SEQ ID NO: 3891810 - DNA, 14 bp, Homo sapiens
tagccaactcctcc

SEQ ID NO: 3891811 - DNA, 22 bp, Homo sapiens
tagccaagttatattgaatata

SEQ ID NO: 3891812 - DNA, 19 bp, Homo sapiens
tagccacctcccaccccac

SEQ ID NO: 3891813 - DNA, 21 bp, Homo sapiens
tagccacctcccaccccactc

SEQ ID NO: 3891814 - DNA, 16 bp, Homo sapiens
tagccaggagtctgtg

SEQ ID NO: 3891815 - DNA, 21 bp, Homo sapiens
tagccaggagtctgtgctctt

SEQ ID NO: 3891816 - DNA, 12 bp, Homo sapiens
tagccagtgact

SEQ ID NO: 3891817 - DNA, 23 bp, Homo sapiens
tagccagtgactttttctgagct

SEQ ID NO: 3891818 - DNA, 21 bp, Homo sapiens
tagccatccttggcctggcgc

SEQ ID NO: 3891819 - DNA, 14 bp, Homo sapiens
tagccatggctcag

SEQ ID NO: 3891820 - DNA, 15 bp, Homo sapiens
tagcccaagaggtct

SEQ ID NO: 3891821 - DNA, 17 bp, Homo sapiens
tagcccggccagggcct

SEQ ID NO: 3891822 - DNA, 14 bp, Homo sapiens
tagccctttctgtg

SEQ ID NO: 3891823 - DNA, 19 bp, Homo sapiens
tagccgagagcctgctccc

SEQ ID NO: 3891824 - DNA, 15 bp, Homo sapiens
tagccgtccatggca

SEQ ID NO: 3891825 - DNA, 15 bp, Homo sapiens
tagcctacaaatgtt

SEQ ID NO: 3891826 - DNA, 20 bp, Homo sapiens
tagcctccgtttatgggcct

SEQ ID NO: 3891827 - DNA, 15 bp, Homo sapiens
tagccttaaattttt

SEQ ID NO: 3891828 - DNA, 16 bp, Homo sapiens
tagccttaaatttttg

SEQ ID NO: 3891829 - DNA, 17 bp, Homo sapiens
tagccttgtgccctgcc

SEQ ID NO: 3891830 - DNA, 14 bp, Homo sapiens
tagcctttgccctg

SEQ ID NO: 3891831 - DNA, 15 bp, Homo sapiens
tagcgctctcttcca

SEQ ID NO: 3891832 - DNA, 16 bp, Homo sapiens
tagcggatctcactca

SEQ ID NO: 3891833 - DNA, 19 bp, Homo sapiens
tagctacccaaaagagaaa

SEQ ID NO: 3891834 - DNA, 20 bp, Homo sapiens
tagctagaagtgggccagga

SEQ ID NO: 3891835 - DNA, 16 bp, Homo sapiens
tagctagaatgcacac

SEQ ID NO: 3891836 - DNA, 12 bp, Homo sapiens
tagctatgtgga

SEQ ID NO: 3891837 - DNA, 23 bp, Homo sapiens
tagctccaccctcaccaggatga

SEQ ID NO: 3891838 - DNA, 12 bp, Homo sapiens
tagctctgcctc

SEQ ID NO: 3891839 - DNA, 17 bp, Homo sapiens
tagctgacatctcctct

SEQ ID NO: 3891840 - DNA, 18 bp, Homo sapiens
tagctgacatctcctcta

SEQ ID NO: 3891841 - DNA, 21 bp, Homo sapiens
tagctgagctcacaaggcagc

SEQ ID NO: 3891842 - DNA, 14 bp, Homo sapiens
tagctgatgaaact

SEQ ID NO: 3891843 - DNA, 13 bp, Homo sapiens
tagctgccttttt

SEQ ID NO: 3891844 - DNA, 19 bp, Homo sapiens
tagctggaactacaggctc

SEQ ID NO: 3891845 - DNA, 13 bp, Homo sapiens
tagctggcaggac

SEQ ID NO: 3891846 - DNA, 15 bp, Homo sapiens
tagctggcaggacac

SEQ ID NO: 3891847 - DNA, 16 bp, Homo sapiens
tagctggcaggacaca

SEQ ID NO: 3891848 - DNA, 21 bp, Homo sapiens
tagctgtctgctcagacagaa

SEQ ID NO: 3891849 - DNA, 13 bp, Homo sapiens
tagctgtgacctg

SEQ ID NO: 3891850 - DNA, 20 bp, Homo sapiens
tagctgtgacctgctgagct

SEQ ID NO: 3891851 - DNA, 22 bp, Homo sapiens
tagctgtgacctgctgagctct

SEQ ID NO: 3891852 - DNA, 16 bp, Homo sapiens
tagcttaaataaattc

SEQ ID NO: 3891853 - DNA, 19 bp, Homo sapiens
tagcttaaataaattcaaa

SEQ ID NO: 3891854 - DNA, 21 bp, Homo sapiens
tagcttacagtcaattttaca

SEQ ID NO: 3891855 - DNA, 15 bp, Homo sapiens
tagcttacctgacac

SEQ ID NO: 3891856 - DNA, 18 bp, Homo sapiens
tagcttcatgcctcagtt

SEQ ID NO: 3891857 - DNA, 22 bp, Homo sapiens
tagcttcatgcctcagtttccc

SEQ ID NO: 3891858 - DNA, 19 bp, Homo sapiens
tagcttgtatagtgtaaaa

SEQ ID NO: 3891859 - DNA, 16 bp, Homo sapiens
gtgcactggccccacc

SEQ ID NO: 3891860 - DNA, 22 bp, Homo sapiens
gtgcagaaaaaaaaaaagaaac

SEQ ID NO: 3891861 - DNA, 12 bp, Homo sapiens
gtgcagcagccc

SEQ ID NO: 3891862 - DNA, 15 bp, Homo sapiens
gtgcagcagcccagc

SEQ ID NO: 3891863 - DNA, 19 bp, Homo sapiens
gtgcagcagcccagcttcc

SEQ ID NO: 3891864 - DNA, 16 bp, Homo sapiens
gtgcagcttctgtcct

SEQ ID NO: 3891865 - DNA, 16 bp, Homo sapiens
gtgcagtacacatcag

SEQ ID NO: 3891866 - DNA, 17 bp, Homo sapiens
gtgcagtaggagcaaga

SEQ ID NO: 3891867 - DNA, 15 bp, Homo sapiens
gtgcagttgacagca

SEQ ID NO: 3891868 - DNA, 19 bp, Homo sapiens
gtgcagttgacagcaggtg

SEQ ID NO: 3891869 - DNA, 20 bp, Homo sapiens
gtgcagttgacagcaggtgg

SEQ ID NO: 3891870 - DNA, 20 bp, Homo sapiens
gtgcatccacgcacacatgg

SEQ ID NO: 3891871 - DNA, 19 bp, Homo sapiens
gtgcatcccccagcactga

SEQ ID NO: 3891872 - DNA, 18 bp, Homo sapiens
gtgcatgctctctgcagc

SEQ ID NO: 3891873 - DNA, 21 bp, Homo sapiens
gtgcatgtatgtgcacatgtg

SEQ ID NO: 3891874 - DNA, 19 bp, Homo sapiens
gtgcatttgagagaagcca

SEQ ID NO: 3891875 - DNA, 17 bp, Homo sapiens
gtgcattttcccagata

SEQ ID NO: 3891876 - DNA, 16 bp, Homo sapiens
gtgccaaggttgtcct

SEQ ID NO: 3891877 - DNA, 18 bp, Homo sapiens
gtgccaagtccaggtcct

SEQ ID NO: 3891878 - DNA, 20 bp, Homo sapiens
gtgccaagtccaggtcctgg

SEQ ID NO: 3891879 - DNA, 21 bp, Homo sapiens
gtgccaagtccaggtcctggt

SEQ ID NO: 3891880 - DNA, 17 bp, Homo sapiens
gtgccaccaataaaaat

SEQ ID NO: 3891881 - DNA, 21 bp, Homo sapiens
gtgccacccgtaggcagcctc

SEQ ID NO: 3891882 - DNA, 17 bp, Homo sapiens
gtgccactccctgagct

SEQ ID NO: 3891883 - DNA, 23 bp, Homo sapiens
gtgccacttcttaaaggcctgga

SEQ ID NO: 3891884 - DNA, 18 bp, Homo sapiens
gtgccacttgacattcct

SEQ ID NO: 3891885 - DNA, 13 bp, Homo sapiens
gtgccagagcctg

SEQ ID NO: 3891886 - DNA, 14 bp, Homo sapiens
gtgccagagcctgg

SEQ ID NO: 3891887 - DNA, 16 bp, Homo sapiens
gtgccagagcctgggg

SEQ ID NO: 3891888 - DNA, 12 bp, Homo sapiens
gtgccagctcag

SEQ ID NO: 3891889 - DNA, 20 bp, Homo sapiens
gtgccaggcccggggctggc

SEQ ID NO: 3891890 - DNA, 13 bp, Homo sapiens
gtgccatcccaca

SEQ ID NO: 3891891 - DNA, 20 bp, Homo sapiens
gtgcccacatcccaggcttc

SEQ ID NO: 3891892 - DNA, 23 bp, Homo sapiens
gtgcccaccaacatcccattgcc

SEQ ID NO: 3891893 - DNA, 12 bp, Homo sapiens
gtgcccaggaga

SEQ ID NO: 3891894 - DNA, 14 bp, Homo sapiens
gtgcccccacccag

SEQ ID NO: 3891895 - DNA, 16 bp, Homo sapiens
gtgccccgcctccccg

SEQ ID NO: 3891896 - DNA, 17 bp, Homo sapiens
gtgccccttaagggttg

SEQ ID NO: 3891897 - DNA, 23 bp, Homo sapiens
gtgccccttaagggttgaaggca

SEQ ID NO: 3891898 - DNA, 20 bp, Homo sapiens
gtgcccgcctaggagttgag

SEQ ID NO: 3891899 - DNA, 18 bp, Homo sapiens
gtgccctgcccccatctc

SEQ ID NO: 3891900 - DNA, 19 bp, Homo sapiens
gtgccctgcccccatctcc

SEQ ID NO: 3891901 - DNA, 12 bp, Homo sapiens
gtgccctgcctt

SEQ ID NO: 3891902 - DNA, 12 bp, Homo sapiens
gtgcccttgggg

SEQ ID NO: 3891903 - DNA, 22 bp, Homo sapiens
gtgccgtgaactgcgtgccagt

SEQ ID NO: 3891904 - DNA, 16 bp, Homo sapiens
gtgcctatttattcat

SEQ ID NO: 3891905 - DNA, 14 bp, Homo sapiens
gtgcctcagagcag

SEQ ID NO: 3891906 - DNA, 14 bp, Homo sapiens
gtgcctcctgggac

SEQ ID NO: 3891907 - DNA, 20 bp, Homo sapiens
gtgcctcgctccccactctg

SEQ ID NO: 3891908 - DNA, 13 bp, Homo sapiens
gtgcctctgcctg

SEQ ID NO: 3891909 - DNA, 15 bp, Homo sapiens
gtgcctgagctgggg

SEQ ID NO: 3891910 - DNA, 14 bp, Homo sapiens
gtgcctgctagagc

SEQ ID NO: 3891911 - DNA, 18 bp, Homo sapiens
gtgcctgctagagcaacc

SEQ ID NO: 3891912 - DNA, 22 bp, Homo sapiens
gtgcctgctagagcaacccctg

SEQ ID NO: 3891913 - DNA, 20 bp, Homo sapiens
gtgcctgggtggggctgctc

SEQ ID NO: 3891914 - DNA, 19 bp, Homo sapiens
gtgccttaaaaggagagaa

SEQ ID NO: 3891915 - DNA, 15 bp, Homo sapiens
gtgccttacctcctg

SEQ ID NO: 3891916 - DNA, 17 bp, Homo sapiens
gtgccttacctcctgcc

SEQ ID NO: 3891917 - DNA, 19 bp, Homo sapiens
gtgccttcttattctcact

SEQ ID NO: 3891918 - DNA, 13 bp, Homo sapiens
gtgcctttctctg

SEQ ID NO: 3891919 - DNA, 22 bp, Homo sapiens
gtgcctttctctggctccagaa

SEQ ID NO: 3891920 - DNA, 23 bp, Homo sapiens
gtgcctttctctggctccagaat

SEQ ID NO: 3891921 - DNA, 20 bp, Homo sapiens
gtgcgacttcacaaaatgca

SEQ ID NO: 3891922 - DNA, 17 bp, Homo sapiens
gtgcgcaacaacaagga

SEQ ID NO: 3891923 - DNA, 14 bp, Homo sapiens
gtgcgcacacacag

SEQ ID NO: 3891924 - DNA, 20 bp, Homo sapiens
gtgcgctcattttaggcctc

SEQ ID NO: 3891925 - DNA, 19 bp, Homo sapiens
gtgcgctcttggtccctgg

SEQ ID NO: 3891926 - DNA, 15 bp, Homo sapiens
gtgcggcaggagcag

SEQ ID NO: 3891927 - DNA, 15 bp, Homo sapiens
gtgcggtggctcacg

SEQ ID NO: 3891928 - DNA, 23 bp, Homo sapiens
gtgcgtctctctttctccctcac

SEQ ID NO: 3891929 - DNA, 15 bp, Homo sapiens
gtgcgtggctgtggc

SEQ ID NO: 3891930 - DNA, 22 bp, Homo sapiens
gtgcgtgttagtgtgtgtgcat

SEQ ID NO: 3891931 - DNA, 23 bp, Homo sapiens
gtgcgtgttagtgtgtgtgcatg

SEQ ID NO: 3891932 - DNA, 15 bp, Homo sapiens
gtgctacaaaaacac

SEQ ID NO: 3891933 - DNA, 16 bp, Homo sapiens
gtgctaggggatgagg

SEQ ID NO: 3891934 - DNA, 18 bp, Homo sapiens
gtgctataggctggagaa

SEQ ID NO: 3891935 - DNA, 18 bp, Homo sapiens
gtgctatgccaagccatg

SEQ ID NO: 3891936 - DNA, 14 bp, Homo sapiens
gtgctattgaactg

SEQ ID NO: 3891937 - DNA, 21 bp, Homo sapiens
gtgctcacgctcccccgcagt

SEQ ID NO: 3891938 - DNA, 15 bp, Homo sapiens
gtgctcgcagcctgg

SEQ ID NO: 3891939 - DNA, 19 bp, Homo sapiens
gtgctcgcttctcctccag

SEQ ID NO: 3891940 - DNA, 11 bp, Homo sapiens
gtgctctggcg

SEQ ID NO: 3891941 - DNA, 17 bp, Homo sapiens
gtgctcttctgttctca

SEQ ID NO: 3891942 - DNA, 18 bp, Homo sapiens
gtgctcttctgttctcaa

SEQ ID NO: 3891943 - DNA, 15 bp, Homo sapiens
gtgctgacctctggt

SEQ ID NO: 3891944 - DNA, 13 bp, Homo sapiens
gtgctgcaaggaa

SEQ ID NO: 3891945 - DNA, 19 bp, Homo sapiens
gtgctgccatgccactgcc

SEQ ID NO: 3891946 - DNA, 14 bp, Homo sapiens
gtggctgacccagt

SEQ ID NO: 3891947 - DNA, 16 bp, Homo sapiens
gtggctgtggcacaga

SEQ ID NO: 3891948 - DNA, 13 bp, Homo sapiens
gtgggacagcccc

SEQ ID NO: 3891949 - DNA, 17 bp, Homo sapiens
gtgggacagccccaggg

SEQ ID NO: 3891950 - DNA, 19 bp, Homo sapiens
gtgggagagacactcccag

SEQ ID NO: 3891951 - DNA, 11 bp, Homo sapiens
gtgggagcctc

SEQ ID NO: 3891952 - DNA, 14 bp, Homo sapiens
gtgggagcctcgca

SEQ ID NO: 3891953 - DNA, 19 bp, Homo sapiens
gtgggatggatgctgggga

SEQ ID NO: 3891954 - DNA, 16 bp, Homo sapiens
gtgggcagctgggccc

SEQ ID NO: 3891955 - DNA, 17 bp, Homo sapiens
gtgggccactctcccct

SEQ ID NO: 3891956 - DNA, 13 bp, Homo sapiens
gtgggccaggagc

SEQ ID NO: 3891957 - DNA, 18 bp, Homo sapiens
gtgggcctggcctgagct

SEQ ID NO: 3891958 - DNA, 19 bp, Homo sapiens
gtgggcctggcctgagctg

SEQ ID NO: 3891959 - DNA, 14 bp, Homo sapiens
gtgggctaattaaa

SEQ ID NO: 3891960 - DNA, 17 bp, Homo sapiens
gtgggctggcccagcca

SEQ ID NO: 3891961 - DNA, 17 bp, Homo sapiens
gtggggaggcagctcca

SEQ ID NO: 3891962 - DNA, 12 bp, Homo sapiens
gtggggagggag

SEQ ID NO: 3891963 - DNA, 15 bp, Homo sapiens
gtggggcctagatcc

SEQ ID NO: 3891964 - DNA, 17 bp, Homo sapiens
gtgggggcagagggcag

SEQ ID NO: 3891965 - DNA, 22 bp, Homo sapiens
gtgggggcagagggcagaggct

SEQ ID NO: 3891966 - DNA, 17 bp, Homo sapiens
gtgggggctgtgccgtg

SEQ ID NO: 3891967 - DNA, 14 bp, Homo sapiens
gtggggtctccctc

SEQ ID NO: 3891968 - DNA, 21 bp, Homo sapiens
gtggggtctccctctcctgcc

SEQ ID NO: 3891969 - DNA, 22 bp, Homo sapiens
gtgggtccaggaaggcagctgc

SEQ ID NO: 3891970 - DNA, 18 bp, Homo sapiens
gtgggtgatcagaaggct

SEQ ID NO: 3891971 - DNA, 18 bp, Homo sapiens
gtgggtggcacctcctga

SEQ ID NO: 3891972 - DNA, 21 bp, Homo sapiens
gtggtctgcttttgctggggt

SEQ ID NO: 3891973 - DNA, 15 bp, Homo sapiens
gtggtgaagaaaact

SEQ ID NO: 3891974 - DNA, 14 bp, Homo sapiens
gtggtgacaggccc

SEQ ID NO: 3891975 - DNA, 15 bp, Homo sapiens
gtggtggaggaggag

SEQ ID NO: 3891976 - DNA, 16 bp, Homo sapiens
gtggtggaggaggagg

SEQ ID NO: 3891977 - DNA, 23 bp, Homo sapiens
gtgtaaaatatctacctgccctc

SEQ ID NO: 3891978 - DNA, 15 bp, Homo sapiens
gtgtaagcacttctg

SEQ ID NO: 3891979 - DNA, 15 bp, Homo sapiens
gtgtaataagaaagt

SEQ ID NO: 3891980 - DNA, 16 bp, Homo sapiens
gtgtaatgcacaattt

SEQ ID NO: 3891981 - DNA, 17 bp, Homo sapiens
gtgtaatgcacaattta

SEQ ID NO: 3891982 - DNA, 18 bp, Homo sapiens
gtgtaatgcacaatttag

SEQ ID NO: 3891983 - DNA, 13 bp, Homo sapiens
gtgtactgataaa

SEQ ID NO: 3891984 - DNA, 23 bp, Homo sapiens
gtgtagatagttaaaagactgca

SEQ ID NO: 3891985 - DNA, 15 bp, Homo sapiens
gtgtagctgtgacct

SEQ ID NO: 3891986 - DNA, 18 bp, Homo sapiens
gtgtagctgtgacctgct

SEQ ID NO: 3891987 - DNA, 20 bp, Homo sapiens
gtgtagctgtgacctgctga

SEQ ID NO: 3891988 - DNA, 17 bp, Homo sapiens
gtgtagtggaagagcag

SEQ ID NO: 3891989 - DNA, 15 bp, Homo sapiens
gtgtatatatacata

SEQ ID NO: 3891990 - DNA, 13 bp, Homo sapiens
gtgtatatatgtg

SEQ ID NO: 3891991 - DNA, 18 bp, Homo sapiens
gtgtatatatgtgtatat

SEQ ID NO: 3891992 - DNA, 21 bp, Homo sapiens
gtgtatcccccccctgtatag

SEQ ID NO: 3891993 - DNA, 12 bp, Homo sapiens
gtgtatgtgtat

SEQ ID NO: 3891994 - DNA, 22 bp, Homo sapiens
gtgtatttttcaggtaggccct

SEQ ID NO: 3891995 - DNA, 23 bp, Homo sapiens
gtgtcacagttcttggtgactgt

SEQ ID NO: 3891996 - DNA, 23 bp, Homo sapiens
gtgtcactttttaaaccactgta

SEQ ID NO: 3891997 - DNA, 16 bp, Homo sapiens
gtgtcatcagaagata

SEQ ID NO: 3891998 - DNA, 13 bp, Homo sapiens
gtgtccacctggc

SEQ ID NO: 3891999 - DNA, 20 bp, Homo sapiens
gtgtccagaccattgtcttc

SEQ ID NO: 3892000 - DNA, 22 bp, Homo sapiens
gtgtccagaccattgtcttcca

SEQ ID NO: 3892001 - DNA, 23 bp, Homo sapiens
gtgtccagaccattgtcttccaa

SEQ ID NO: 3892002 - DNA, 15 bp, Homo sapiens
gtgtccagcagctgc

SEQ ID NO: 3892003 - DNA, 12 bp, Homo sapiens
gtgtcccaagct

SEQ ID NO: 3892004 - DNA, 17 bp, Homo sapiens
gtgtcccaaggagctga

SEQ ID NO: 3892005 - DNA, 13 bp, Homo sapiens
gtgtcccctcact

SEQ ID NO: 3892006 - DNA, 23 bp, Homo sapiens
gtgtcccctcactctgtcagcca

SEQ ID NO: 3892007 - DNA, 13 bp, Homo sapiens
gtgtcccctccac

SEQ ID NO: 3892008 - DNA, 20 bp, Homo sapiens
gtgtcccctccactgtcaca

SEQ ID NO: 3892009 - DNA, 12 bp, Homo sapiens
gtgtccttccct

SEQ ID NO: 3892010 - DNA, 18 bp, Homo sapiens
gtgtccttgcacctgcat

SEQ ID NO: 3892011 - DNA, 19 bp, Homo sapiens
gtgtccttgcacctgcatc

SEQ ID NO: 3892012 - DNA, 18 bp, Homo sapiens
gtgtccttggggcacagt

SEQ ID NO: 3892013 - DNA, 12 bp, Homo sapiens
gtgtctctccca

SEQ ID NO: 3892014 - DNA, 15 bp, Homo sapiens
gtgtctgtctttgtg

SEQ ID NO: 3892015 - DNA, 13 bp, Homo sapiens
gtgtctttatcag

SEQ ID NO: 3892016 - DNA, 21 bp, Homo sapiens
gtgtcttttctgtagagcata

SEQ ID NO: 3892017 - DNA, 16 bp, Homo sapiens
gtgtgagtggcagcca

SEQ ID NO: 3892018 - DNA, 14 bp, Homo sapiens
gtgtgcatgtatgt

SEQ ID NO: 3892019 - DNA, 15 bp, Homo sapiens
gtgtgcatgtatgtg

SEQ ID NO: 3892020 - DNA, 11 bp, Homo sapiens
gtgtgcatgtg

SEQ ID NO: 3892021 - DNA, 17 bp, Homo sapiens
gtgtgcctgccctggag

SEQ ID NO: 3892022 - DNA, 13 bp, Homo sapiens
gtgtggacaggac

SEQ ID NO: 3892023 - DNA, 14 bp, Homo sapiens
gtgtggctgtattc

SEQ ID NO: 3892024 - DNA, 15 bp, Homo sapiens
gtgtggctgtattca

SEQ ID NO: 3892025 - DNA, 16 bp, Homo sapiens
gtgtgggaaagggacc

SEQ ID NO: 3892026 - DNA, 13 bp, Homo sapiens
gtgtgggaaggga

SEQ ID NO: 3892027 - DNA, 12 bp, Homo sapiens
gtgtggggaggc

SEQ ID NO: 3892028 - DNA, 15 bp, Homo sapiens
gtgtggggaggcagc

SEQ ID NO: 3892029 - DNA, 16 bp, Homo sapiens
gtgtggtgtgtgtgct

SEQ ID NO: 3892030 - DNA, 22 bp, Homo sapiens
gtgtgtataagtgcacacagaa

SEQ ID NO: 3892031 - DNA, 15 bp, Homo sapiens
gtgtgtctgctcagt

SEQ ID NO: 3892032 - DNA, 16 bp, Homo sapiens
gtgtgtctgctcagta

SEQ ID NO: 3892033 - DNA, 14 bp, Homo sapiens
gttccctctgagaa

SEQ ID NO: 3892034 - DNA, 11 bp, Homo sapiens
gttccctgcac

SEQ ID NO: 3892035 - DNA, 16 bp, Homo sapiens
gttccctgcaccctgg

SEQ ID NO: 3892036 - DNA, 17 bp, Homo sapiens
gttccctgtcagaggct

SEQ ID NO: 3892037 - DNA, 18 bp, Homo sapiens
gttccgtcccaaacagag

SEQ ID NO: 3892038 - DNA, 16 bp, Homo sapiens
gttcctcgccctgggt

SEQ ID NO: 3892039 - DNA, 13 bp, Homo sapiens
gttcctctttgca

SEQ ID NO: 3892040 - DNA, 16 bp, Homo sapiens
gttcctgcactccaga

SEQ ID NO: 3892041 - DNA, 17 bp, Homo sapiens
gttcctgcactccagaa

SEQ ID NO: 3892042 - DNA, 15 bp, Homo sapiens
gttccttactgcaga

SEQ ID NO: 3892043 - DNA, 14 bp, Homo sapiens
gttccttccctggg

SEQ ID NO: 3892044 - DNA, 17 bp, Homo sapiens
gttccttctgcttctcc

SEQ ID NO: 3892045 - DNA, 22 bp, Homo sapiens
gttcgacgagacggtcgagcag

SEQ ID NO: 3892046 - DNA, 16 bp, Homo sapiens
gttcgccgcgtggaat

SEQ ID NO: 3892047 - DNA, 13 bp, Homo sapiens
gttcgtagctttc

SEQ ID NO: 3892048 - DNA, 14 bp, Homo sapiens
gttctaatattttt

SEQ ID NO: 3892049 - DNA, 19 bp, Homo sapiens
gttctaggtcctggcttct

SEQ ID NO: 3892050 - DNA, 23 bp, Homo sapiens
gttctagtctcctttgcactgag

SEQ ID NO: 3892051 - DNA, 18 bp, Homo sapiens
gttctatataaggaggaa

SEQ ID NO: 3892052 - DNA, 19 bp, Homo sapiens
gttctatataaggaggaaa

SEQ ID NO: 3892053 - DNA, 20 bp, Homo sapiens
gttctatataaggaggaaaa

SEQ ID NO: 3892054 - DNA, 21 bp, Homo sapiens
gttctccagcccacacccctc

SEQ ID NO: 3892055 - DNA, 22 bp, Homo sapiens
gttctccagcccacacccctcc

SEQ ID NO: 3892056 - DNA, 19 bp, Homo sapiens
gttctccgggtgtggcctc

SEQ ID NO: 3892057 - DNA, 21 bp, Homo sapiens
gttctctattttgcctttaaa

SEQ ID NO: 3892058 - DNA, 14 bp, Homo sapiens
gttctgcactgaaa

SEQ ID NO: 3892059 - DNA, 15 bp, Homo sapiens
gttctgcactgaaaa

SEQ ID NO: 3892060 - DNA, 14 bp, Homo sapiens
gttctgctcctctc

SEQ ID NO: 3892061 - DNA, 15 bp, Homo sapiens
gttctgctcctctcc

SEQ ID NO: 3892062 - DNA, 17 bp, Homo sapiens
gttctgctcctctccag

SEQ ID NO: 3892063 - DNA, 17 bp, Homo sapiens
gttctggacctccccct

SEQ ID NO: 3892064 - DNA, 21 bp, Homo sapiens
gttctgtaatggaactgaccc

SEQ ID NO: 3892065 - DNA, 13 bp, Homo sapiens
gttctgtattttc

SEQ ID NO: 3892066 - DNA, 15 bp, Homo sapiens
gttctgtgtgggtct

SEQ ID NO: 3892067 - DNA, 20 bp, Homo sapiens
gttcttgagtagatctgctt

SEQ ID NO: 3892068 - DNA, 13 bp, Homo sapiens
gttcttgatgtca

SEQ ID NO: 3892069 - DNA, 14 bp, Homo sapiens
gttctttcttcctc

SEQ ID NO: 3892070 - DNA, 15 bp, Homo sapiens
gttctttcttcctct

SEQ ID NO: 3892071 - DNA, 16 bp, Homo sapiens
gttctttcttcctctg

SEQ ID NO: 3892072 - DNA, 18 bp, Homo sapiens
gttctttcttcctctgct

SEQ ID NO: 3892073 - DNA, 19 bp, Homo sapiens
gttctttcttcctctgctg

SEQ ID NO: 3892074 - DNA, 22 bp, Homo sapiens
gttcttttttgttacagctatg

SEQ ID NO: 3892075 - DNA, 19 bp, Homo sapiens
gttgaaaattattttaaac

SEQ ID NO: 3892076 - DNA, 13 bp, Homo sapiens
gttgaaggcagtc

SEQ ID NO: 3892077 - DNA, 21 bp, Homo sapiens
gttgaaggcagtctgaaccct

SEQ ID NO: 3892078 - DNA, 23 bp, Homo sapiens
gttgagaacaaaaattgggtttt

SEQ ID NO: 3892079 - DNA, 21 bp, Homo sapiens
gttgaggcagggcaaatgaca

SEQ ID NO: 3892080 - DNA, 22 bp, Homo sapiens
gttgagggaacagacaggagaa

SEQ ID NO: 3892081 - DNA, 19 bp, Homo sapiens
gttgagtacagtgaggagg

SEQ ID NO: 3892082 - DNA, 16 bp, Homo sapiens
gttgatgaggcctctt

SEQ ID NO: 3892083 - DNA, 19 bp, Homo sapiens
gttgattctgaatctgaaa

SEQ ID NO: 3892084 - DNA, 15 bp, Homo sapiens
gttgcaaggccgctg

SEQ ID NO: 3892085 - DNA, 17 bp, Homo sapiens
gttgcaaggccgctgtt

SEQ ID NO: 3892086 - DNA, 14 bp, Homo sapiens
gttgcaataaaata

SEQ ID NO: 3892087 - DNA, 15 bp, Homo sapiens
gttgcaataaaatag

SEQ ID NO: 3892088 - DNA, 19 bp, Homo sapiens
gttgcaccatctgcttggt

SEQ ID NO: 3892089 - DNA, 19 bp, Homo sapiens
gttgcagtctcagaaagcc

SEQ ID NO: 3892090 - DNA, 17 bp, Homo sapiens
gttgccccttccccatc

SEQ ID NO: 3892091 - DNA, 20 bp, Homo sapiens
gttgcgggggagctggaaat

SEQ ID NO: 3892092 - DNA, 22 bp, Homo sapiens
gttgctgattcaagaaacagaa

SEQ ID NO: 3892093 - DNA, 12 bp, Homo sapiens
gttgcttcagac

SEQ ID NO: 3892094 - DNA, 17 bp, Homo sapiens
gttgcttctggctcctc

SEQ ID NO: 3892095 - DNA, 20 bp, Homo sapiens
gttgctttaaagtacctgta

SEQ ID NO: 3892096 - DNA, 15 bp, Homo sapiens
gttggaaaagaatac

SEQ ID NO: 3892097 - DNA, 20 bp, Homo sapiens
gttggaaaagaatacagaaa

SEQ ID NO: 3892098 - DNA, 22 bp, Homo sapiens
gttggaaaagaatacagaaaga

SEQ ID NO: 3892099 - DNA, 18 bp, Homo sapiens
gttggaaatattcatgct

SEQ ID NO: 3892100 - DNA, 22 bp, Homo sapiens
gttggaatgaattaaataaacc

SEQ ID NO: 3892101 - DNA, 12 bp, Homo sapiens
gttggagccact

SEQ ID NO: 3892102 - DNA, 21 bp, Homo sapiens
gttggagccactcctgtcccg

SEQ ID NO: 3892103 - DNA, 14 bp, Homo sapiens
gttggccaggctgg

SEQ ID NO: 3892104 - DNA, 13 bp, Homo sapiens
gttggcctcgcct

SEQ ID NO: 3892105 - DNA, 17 bp, Homo sapiens
gttggcctcgcctgggc

SEQ ID NO: 3892106 - DNA, 23 bp, Homo sapiens
gttggcctcgcctgggcccaggc

SEQ ID NO: 3892107 - DNA, 16 bp, Homo sapiens
gttggctcaggcagac

SEQ ID NO: 3892108 - DNA, 19 bp, Homo sapiens
gttggctgtgtgacagaat

SEQ ID NO: 3892109 - DNA, 14 bp, Homo sapiens
gttgggagcactgg

SEQ ID NO: 3892110 - DNA, 15 bp, Homo sapiens
gttgggatttatatc

SEQ ID NO: 3892111 - DNA, 13 bp, Homo sapiens
gttggggtggggc

SEQ ID NO: 3892112 - DNA, 16 bp, Homo sapiens
gttggggtggggcagg

SEQ ID NO: 3892113 - DNA, 17 bp, Homo sapiens
gttggggtggggcagga

SEQ ID NO: 3892114 - DNA, 18 bp, Homo sapiens
gttggtgggctggcccag

SEQ ID NO: 3892115 - DNA, 19 bp, Homo sapiens
gttggtttccaaaaaggaa

SEQ ID NO: 3892116 - DNA, 12 bp, Homo sapiens
gttgtaaataaa

SEQ ID NO: 3892117 - DNA, 20 bp, Homo sapiens
gttgtaaatatttatgtaaa

SEQ ID NO: 3892118 - DNA, 16 bp, Homo sapiens
gttgtaaatgaccaag

SEQ ID NO: 3892119 - DNA, 21 bp, Homo sapiens
gttgtactattgtttaaaaac

SEQ ID NO: 3892120 - DNA, 15 bp, Homo sapiens
gttttggtgcctgcc

SEQ ID NO: 3892121 - DNA, 18 bp, Homo sapiens
gttttggtgcctgcctct

SEQ ID NO: 3892122 - DNA, 16 bp, Homo sapiens
gttttgtatatgatct

SEQ ID NO: 3892123 - DNA, 16 bp, Homo sapiens
gtttttactacagttg

SEQ ID NO: 3892124 - DNA, 16 bp, Homo sapiens
gtttttatggggctga

SEQ ID NO: 3892125 - DNA, 18 bp, Homo sapiens
gtttttatggggctgaac

SEQ ID NO: 3892126 - DNA, 16 bp, Homo sapiens
gtttttctgggtggcc

SEQ ID NO: 3892127 - DNA, 14 bp, Homo sapiens
gtttttgctataga

SEQ ID NO: 3892128 - DNA, 15 bp, Homo sapiens
taaaaaaaagaagag

SEQ ID NO: 3892129 - DNA, 13 bp, Homo sapiens
taaaaaaatgaca

SEQ ID NO: 3892130 - DNA, 21 bp, Homo sapiens
taaaaaactatctttttgctt

SEQ ID NO: 3892131 - DNA, 15 bp, Homo sapiens
taaaaaacttgtaaa

SEQ ID NO: 3892132 - DNA, 13 bp, Homo sapiens
taaaaaatacacc

SEQ ID NO: 3892133 - DNA, 21 bp, Homo sapiens
taaaaaatgtctatagagaaa

SEQ ID NO: 3892134 - DNA, 13 bp, Homo sapiens
taaaaacaggaaa

SEQ ID NO: 3892135 - DNA, 13 bp, Homo sapiens
taaaaaccctgta

SEQ ID NO: 3892136 - DNA, 23 bp, Homo sapiens
taaaaaggatgaaagtctgagaa

SEQ ID NO: 3892137 - DNA, 19 bp, Homo sapiens
taaaaataaaatgatgtat

SEQ ID NO: 3892138 - DNA, 15 bp, Homo sapiens
taaaaataagcttta

SEQ ID NO: 3892139 - DNA, 21 bp, Homo sapiens
taaaaatactatgaaatgaaa

SEQ ID NO: 3892140 - DNA, 22 bp, Homo sapiens
taaaaatatatatagtgctata

SEQ ID NO: 3892141 - DNA, 23 bp, Homo sapiens
taaaaatatggaacttctaatat

SEQ ID NO: 3892142 - DNA, 14 bp, Homo sapiens
taaaaatgaaatta

SEQ ID NO: 3892143 - DNA, 21 bp, Homo sapiens
taaaacacacctaagagaaaa

SEQ ID NO: 3892144 - DNA, 19 bp, Homo sapiens
taaaacacttccataatct

SEQ ID NO: 3892145 - DNA, 15 bp, Homo sapiens
taaaaccacagcagt

SEQ ID NO: 3892146 - DNA, 18 bp, Homo sapiens
taaaaccatgtagtttta

SEQ ID NO: 3892147 - DNA, 19 bp, Homo sapiens
taaaaccatgtagttttaa

SEQ ID NO: 3892148 - DNA, 17 bp, Homo sapiens
taaaacccagcatgtac

SEQ ID NO: 3892149 - DNA, 21 bp, Homo sapiens
taaaaccccagccaactcatt

SEQ ID NO: 3892150 - DNA, 18 bp, Homo sapiens
taaaacctagaacttcaa

SEQ ID NO: 3892151 - DNA, 19 bp, Homo sapiens
taaaaccttgatttaaaat

SEQ ID NO: 3892152 - DNA, 10 bp, Homo sapiens
taaaaccttt

SEQ ID NO: 3892153 - DNA, 13 bp, Homo sapiens
taaaacctttcaa

SEQ ID NO: 3892154 - DNA, 16 bp, Homo sapiens
taaaacctttcaaatt

SEQ ID NO: 3892155 - DNA, 16 bp, Homo sapiens
taaaactgctttgtat

SEQ ID NO: 3892156 - DNA, 14 bp, Homo sapiens
taaaacttaaaact

SEQ ID NO: 3892157 - DNA, 12 bp, Homo sapiens
taaaagaaaaag

SEQ ID NO: 3892158 - DNA, 13 bp, Homo sapiens
taaaagaatattt

SEQ ID NO: 3892159 - DNA, 16 bp, Homo sapiens
taaaagaatattttaa

SEQ ID NO: 3892160 - DNA, 20 bp, Homo sapiens
taaaagactgcagctgctga

SEQ ID NO: 3892161 - DNA, 19 bp, Homo sapiens
taaaagcaattatattgtc

SEQ ID NO: 3892162 - DNA, 11 bp, Homo sapiens
taaaagctaat

SEQ ID NO: 3892163 - DNA, 16 bp, Homo sapiens
taaaaggagagaagaa

SEQ ID NO: 3892164 - DNA, 22 bp, Homo sapiens
taaaaggtattaaattgatgtt

SEQ ID NO: 3892165 - DNA, 14 bp, Homo sapiens
taaaagtaaacatt

SEQ ID NO: 3892166 - DNA, 18 bp, Homo sapiens
taaaagtgtgagcagtga

SEQ ID NO: 3892167 - DNA, 19 bp, Homo sapiens
taaaagtgttgattacata

SEQ ID NO: 3892168 - DNA, 15 bp, Homo sapiens
taaaagttgtgattc

SEQ ID NO: 3892169 - DNA, 21 bp, Homo sapiens
taaaagttgtgattccagata

SEQ ID NO: 3892170 - DNA, 14 bp, Homo sapiens
taaaataaaaaagt

SEQ ID NO: 3892171 - DNA, 16 bp, Homo sapiens
taaaataaaaaccaga

SEQ ID NO: 3892172 - DNA, 15 bp, Homo sapiens
taaaataaagcctat

SEQ ID NO: 3892173 - DNA, 23 bp, Homo sapiens
taaaataaagcctatttttcaaa

SEQ ID NO: 3892174 - DNA, 21 bp, Homo sapiens
taaaatacacactcaaatcaa

SEQ ID NO: 3892175 - DNA, 18 bp, Homo sapiens
taaaatagcttgtatagt

SEQ ID NO: 3892176 - DNA, 19 bp, Homo sapiens
taaaatagtattgaaagtg

SEQ ID NO: 3892177 - DNA, 23 bp, Homo sapiens
taaaatagttgtccatattttca

SEQ ID NO: 3892178 - DNA, 16 bp, Homo sapiens
taaaatatacaaacat

SEQ ID NO: 3892179 - DNA, 18 bp, Homo sapiens
taaaatatatataaatat

SEQ ID NO: 3892180 - DNA, 19 bp, Homo sapiens
taaaatatatataaatata

SEQ ID NO: 3892181 - DNA, 15 bp, Homo sapiens
taaaatatcctcagg

SEQ ID NO: 3892182 - DNA, 20 bp, Homo sapiens
taaaatatctacctgccctc

SEQ ID NO: 3892183 - DNA, 18 bp, Homo sapiens
taaaatcatttctgcatc

SEQ ID NO: 3892184 - DNA, 20 bp, Homo sapiens
taaaatcttggcacagaaac

SEQ ID NO: 3892185 - DNA, 17 bp, Homo sapiens
taaaatgaggacatgtt

SEQ ID NO: 3892186 - DNA, 18 bp, Homo sapiens
taaaatgattgtaaaata

SEQ ID NO: 3892187 - DNA, 20 bp, Homo sapiens
taaaatgattgtaaaatagc

SEQ ID NO: 3892188 - DNA, 20 bp, Homo sapiens
taaaatgcagtccagaataa

SEQ ID NO: 3892189 - DNA, 21 bp, Homo sapiens
taaaatgcagtccagaataag

SEQ ID NO: 3892190 - DNA, 15 bp, Homo sapiens
taaaattgtaaaatt

SEQ ID NO: 3892191 - DNA, 16 bp, Homo sapiens
taaaattgtatagaga

SEQ ID NO: 3892192 - DNA, 20 bp, Homo sapiens
taaaattttacttttgttct

SEQ ID NO: 3892193 - DNA, 23 bp, Homo sapiens
taaacaaaatagaagctgtagta

SEQ ID NO: 3892194 - DNA, 23 bp, Homo sapiens
taaacacccatgaatcaaagaca

SEQ ID NO: 3892195 - DNA, 13 bp, Homo sapiens
taaacacctgaca

SEQ ID NO: 3892196 - DNA, 16 bp, Homo sapiens
taaacacctgacacat

SEQ ID NO: 3892197 - DNA, 18 bp, Homo sapiens
taaacacctgacacatct

SEQ ID NO: 3892198 - DNA, 14 bp, Homo sapiens
taaacactgtaatc

SEQ ID NO: 3892199 - DNA, 20 bp, Homo sapiens
taaacactgtaatcttaaaa

SEQ ID NO: 3892200 - DNA, 18 bp, Homo sapiens
taaacaggagacaggaag

SEQ ID NO: 3892201 - DNA, 23 bp, Homo sapiens
taaacagtgagcctgaattttgt

SEQ ID NO: 3892202 - DNA, 12 bp, Homo sapiens
taaacagtgcct

SEQ ID NO: 3892203 - DNA, 14 bp, Homo sapiens
taaacattaaaaga

SEQ ID NO: 3892204 - DNA, 15 bp, Homo sapiens
taaacattaaatgtc

SEQ ID NO: 3892205 - DNA, 16 bp, Homo sapiens
taaacattaaatgtct

SEQ ID NO: 3892206 - DNA, 15 bp, Homo sapiens
taaaccaaaggacat

SEQ ID NO: 3892207 - DNA, 14 bp, Homo sapiens
taaatatccacaga

SEQ ID NO: 3892208 - DNA, 14 bp, Homo sapiens
taaatatgaaatga

SEQ ID NO: 3892209 - DNA, 14 bp, Homo sapiens
taaatatgactcct

SEQ ID NO: 3892210 - DNA, 16 bp, Homo sapiens
taaatcaaaagctgct

SEQ ID NO: 3892211 - DNA, 17 bp, Homo sapiens
taaatcaaaagctgctt

SEQ ID NO: 3892212 - DNA, 19 bp, Homo sapiens
taaatcaaaagctgcttga

SEQ ID NO: 3892213 - DNA, 20 bp, Homo sapiens
taaatcaaaagctgcttgac

SEQ ID NO: 3892214 - DNA, 19 bp, Homo sapiens
gtccatgtggttcttcaaa

SEQ ID NO: 3892215 - DNA, 23 bp, Homo sapiens
gtccatttgggtacgtctgggcc

SEQ ID NO: 3892216 - DNA, 15 bp, Homo sapiens
gtcccaacttgtaaa

SEQ ID NO: 3892217 - DNA, 13 bp, Homo sapiens
gtcccaagcagcc

SEQ ID NO: 3892218 - DNA, 21 bp, Homo sapiens
gtcccaagctttgaatacccc

SEQ ID NO: 3892219 - DNA, 14 bp, Homo sapiens
gtcccaaggagctg

SEQ ID NO: 3892220 - DNA, 23 bp, Homo sapiens
gtcccaatgcacatccattccca

SEQ ID NO: 3892221 - DNA, 17 bp, Homo sapiens
gtcccacactggtgact

SEQ ID NO: 3892222 - DNA, 21 bp, Homo sapiens
gtcccacatccctgggcctgc

SEQ ID NO: 3892223 - DNA, 22 bp, Homo sapiens
gtcccacatccctgggcctgct

SEQ ID NO: 3892224 - DNA, 16 bp, Homo sapiens
gtcccaccaactctgc

SEQ ID NO: 3892225 - DNA, 17 bp, Homo sapiens
gtcccaccaactctgca

SEQ ID NO: 3892226 - DNA, 20 bp, Homo sapiens
gtcccaccaactctgcactc

SEQ ID NO: 3892227 - DNA, 21 bp, Homo sapiens
gtcccaccaactctgcactcc

SEQ ID NO: 3892228 - DNA, 19 bp, Homo sapiens
gtcccaccgggagcctccc

SEQ ID NO: 3892229 - DNA, 19 bp, Homo sapiens
gtcccagaaccacactgtt

SEQ ID NO: 3892230 - DNA, 12 bp, Homo sapiens
gtcccagagcag

SEQ ID NO: 3892231 - DNA, 22 bp, Homo sapiens
gtcccagagcttattggccact

SEQ ID NO: 3892232 - DNA, 20 bp, Homo sapiens
gtcccagaggttatctgcct

SEQ ID NO: 3892233 - DNA, 21 bp, Homo sapiens
gtcccagaggttatctgcctg

SEQ ID NO: 3892234 - DNA, 23 bp, Homo sapiens
gtcccagaggttatctgcctggc

SEQ ID NO: 3892235 - DNA, 13 bp, Homo sapiens
gtccccacagcct

SEQ ID NO: 3892236 - DNA, 14 bp, Homo sapiens
gtccccagcccttc

SEQ ID NO: 3892237 - DNA, 19 bp, Homo sapiens
gtccccagcccttctgcct

SEQ ID NO: 3892238 - DNA, 20 bp, Homo sapiens
gtccccagcccttctgcctt

SEQ ID NO: 3892239 - DNA, 13 bp, Homo sapiens
gtccccagctggt

SEQ ID NO: 3892240 - DNA, 19 bp, Homo sapiens
gtccccagtttgcagaaaa

SEQ ID NO: 3892241 - DNA, 20 bp, Homo sapiens
gtccccatcatcccagctgc

SEQ ID NO: 3892242 - DNA, 22 bp, Homo sapiens
gtcccccaaggttttggagtca

SEQ ID NO: 3892243 - DNA, 16 bp, Homo sapiens
gtcccctcactctgtc

SEQ ID NO: 3892244 - DNA, 20 bp, Homo sapiens
gtcccctcactctgtcagcc

SEQ ID NO: 3892245 - DNA, 23 bp, Homo sapiens
gtcccctcactctgtcagccagc

SEQ ID NO: 3892246 - DNA, 15 bp, Homo sapiens
gtcccctctcccctc

SEQ ID NO: 3892247 - DNA, 20 bp, Homo sapiens
gtcccctgtcccaccaactc

SEQ ID NO: 3892248 - DNA, 14 bp, Homo sapiens
gtcccgccttcctc

SEQ ID NO: 3892249 - DNA, 20 bp, Homo sapiens
gtccctacccactctttgct

SEQ ID NO: 3892250 - DNA, 20 bp, Homo sapiens
gtccctcaaatgacccaaag

SEQ ID NO: 3892251 - DNA, 22 bp, Homo sapiens
gtccctcggagctgccagccgg

SEQ ID NO: 3892252 - DNA, 11 bp, Homo sapiens
gtccctgctcc

SEQ ID NO: 3892253 - DNA, 18 bp, Homo sapiens
gtccctgcttacctgacg

SEQ ID NO: 3892254 - DNA, 19 bp, Homo sapiens
gtccctgggggaagccctg

SEQ ID NO: 3892255 - DNA, 20 bp, Homo sapiens
gtccctgggggaagccctgg

SEQ ID NO: 3892256 - DNA, 21 bp, Homo sapiens
gtccctgggggaagccctgga

SEQ ID NO: 3892257 - DNA, 22 bp, Homo sapiens
gtccctgggggaagccctggat

SEQ ID NO: 3892258 - DNA, 13 bp, Homo sapiens
gtccctggtccct

SEQ ID NO: 3892259 - DNA, 16 bp, Homo sapiens
gtccctggtccctcgt

SEQ ID NO: 3892260 - DNA, 19 bp, Homo sapiens
gtccctggtccctcgtcca

SEQ ID NO: 3892261 - DNA, 22 bp, Homo sapiens
gtcccttcttccctaatcagct

SEQ ID NO: 3892262 - DNA, 21 bp, Homo sapiens
gtcccttgagacctcagccat

SEQ ID NO: 3892263 - DNA, 22 bp, Homo sapiens
gtcccttggaaagttcagccag

SEQ ID NO: 3892264 - DNA, 20 bp, Homo sapiens
gtccgaaaccagttaagaat

SEQ ID NO: 3892265 - DNA, 14 bp, Homo sapiens
gtccgattaattta

SEQ ID NO: 3892266 - DNA, 19 bp, Homo sapiens
gtccgcaagttcagggaag

SEQ ID NO: 3892267 - DNA, 22 bp, Homo sapiens
gtccgcaagttcagggaagcag

SEQ ID NO: 3892268 - DNA, 16 bp, Homo sapiens
gtccgcaccagctgct

SEQ ID NO: 3892269 - DNA, 17 bp, Homo sapiens
gtccgcaccagctgctc

SEQ ID NO: 3892270 - DNA, 19 bp, Homo sapiens
gtccgcaccagctgctctg

SEQ ID NO: 3892271 - DNA, 12 bp, Homo sapiens
gtccgcctctgc

SEQ ID NO: 3892272 - DNA, 14 bp, Homo sapiens
gtccgccttaatct

SEQ ID NO: 3892273 - DNA, 19 bp, Homo sapiens
gtccgccttaatctggaag

SEQ ID NO: 3892274 - DNA, 17 bp, Homo sapiens
gtccggtgtccttttca

SEQ ID NO: 3892275 - DNA, 19 bp, Homo sapiens
gtcctaaggacacactaat

SEQ ID NO: 3892276 - DNA, 14 bp, Homo sapiens
gtcctagagctcct

SEQ ID NO: 3892277 - DNA, 13 bp, Homo sapiens
gtcctcacagcct

SEQ ID NO: 3892278 - DNA, 21 bp, Homo sapiens
gtcctccatttcaactccaga

SEQ ID NO: 3892279 - DNA, 22 bp, Homo sapiens
gtcctccatttcaactccagaa

SEQ ID NO: 3892280 - DNA, 14 bp, Homo sapiens
gtcctcccacccta

SEQ ID NO: 3892281 - DNA, 18 bp, Homo sapiens
gtcctcccatcccctgga

SEQ ID NO: 3892282 - DNA, 19 bp, Homo sapiens
gtcctcccatcccctggac

SEQ ID NO: 3892283 - DNA, 21 bp, Homo sapiens
gtcctccccctgccagtgcct

SEQ ID NO: 3892284 - DNA, 16 bp, Homo sapiens
gtcctcccctatttta

SEQ ID NO: 3892285 - DNA, 11 bp, Homo sapiens
gtcctctcccc

SEQ ID NO: 3892286 - DNA, 12 bp, Homo sapiens
gtcctctcccct

SEQ ID NO: 3892287 - DNA, 13 bp, Homo sapiens
gtcctctcccctc

SEQ ID NO: 3892288 - DNA, 13 bp, Homo sapiens
gtcctctcgagcc

SEQ ID NO: 3892289 - DNA, 17 bp, Homo sapiens
gtcctctcgagcccaga

SEQ ID NO: 3892290 - DNA, 20 bp, Homo sapiens
gtcctctttacatgaaacta

SEQ ID NO: 3892291 - DNA, 23 bp, Homo sapiens
gtcctctttactcccttcctggc

SEQ ID NO: 3892292 - DNA, 21 bp, Homo sapiens
ggcctgtgtccagcagctgcg

SEQ ID NO: 3892293 - DNA, 19 bp, Homo sapiens
ggccttacttaaacccagc

SEQ ID NO: 3892294 - DNA, 19 bp, Homo sapiens
ggccttccccttttgcctg

SEQ ID NO: 3892295 - DNA, 22 bp, Homo sapiens
ggccttccccttttgcctggct

SEQ ID NO: 3892296 - DNA, 16 bp, Homo sapiens
ggccttgcccagagat

SEQ ID NO: 3892297 - DNA, 20 bp, Homo sapiens
ggccttgtcaggacccaggc

SEQ ID NO: 3892298 - DNA, 20 bp, Homo sapiens
ggccttgtggataagggaga

SEQ ID NO: 3892299 - DNA, 13 bp, Homo sapiens
ggccttgttctgt

SEQ ID NO: 3892300 - DNA, 17 bp, Homo sapiens
ggcgaataaatgttcaa

SEQ ID NO: 3892301 - DNA, 15 bp, Homo sapiens
ggcgagtgccaggac

SEQ ID NO: 3892302 - DNA, 16 bp, Homo sapiens
ggcgagtgccaggact

SEQ ID NO: 3892303 - DNA, 14 bp, Homo sapiens
ggcgcaagcctgta

SEQ ID NO: 3892304 - DNA, 21 bp, Homo sapiens
ggcgcacctatcacccaggct

SEQ ID NO: 3892305 - DNA, 16 bp, Homo sapiens
ggcgcagcccgaagcc

SEQ ID NO: 3892306 - DNA, 18 bp, Homo sapiens
ggcgcagcccgaagccca

SEQ ID NO: 3892307 - DNA, 11 bp, Homo sapiens
ggcgcaggagg

SEQ ID NO: 3892308 - DNA, 19 bp, Homo sapiens
ggcgccccaacccgtggag

SEQ ID NO: 3892309 - DNA, 18 bp, Homo sapiens
ggcgcctgtagtcccagc

SEQ ID NO: 3892310 - DNA, 20 bp, Homo sapiens
ggcgcctgtagtcccagcca

SEQ ID NO: 3892311 - DNA, 18 bp, Homo sapiens
ggcgcgggaggcaccagc

SEQ ID NO: 3892312 - DNA, 14 bp, Homo sapiens
ggcggaaaccttgc

SEQ ID NO: 3892313 - DNA, 22 bp, Homo sapiens
ggcggcctatgacttgggcacc

SEQ ID NO: 3892314 - DNA, 14 bp, Homo sapiens
ggcggcgcagaggg

SEQ ID NO: 3892315 - DNA, 16 bp, Homo sapiens
ggcggcgcagagggaa

SEQ ID NO: 3892316 - DNA, 15 bp, Homo sapiens
ggcggctccaggtcc

SEQ ID NO: 3892317 - DNA, 18 bp, Homo sapiens
ggcggcttcctgtccact

SEQ ID NO: 3892318 - DNA, 17 bp, Homo sapiens
ggcggggcaggaggcct

SEQ ID NO: 3892319 - DNA, 14 bp, Homo sapiens
ggcgggggagccaa

SEQ ID NO: 3892320 - DNA, 21 bp, Homo sapiens
ggcgggggagccaacagcagc

SEQ ID NO: 3892321 - DNA, 20 bp, Homo sapiens
ggcgtcgctggacaacccag

SEQ ID NO: 3892322 - DNA, 17 bp, Homo sapiens
ggcgttggtgccacttc

SEQ ID NO: 3892323 - DNA, 19 bp, Homo sapiens
ggctaagagctagcgctgc

SEQ ID NO: 3892324 - DNA, 20 bp, Homo sapiens
ggctaagagctagcgctgcc

SEQ ID NO: 3892325 - DNA, 22 bp, Homo sapiens
ggctaagatgagatttgccagc

SEQ ID NO: 3892326 - DNA, 23 bp, Homo sapiens
ggctaattcccagagtgtgaaac

SEQ ID NO: 3892327 - DNA, 12 bp, Homo sapiens
ggctaccctccc

SEQ ID NO: 3892328 - DNA, 18 bp, Homo sapiens
ggctactcagcagccctc

SEQ ID NO: 3892329 - DNA, 15 bp, Homo sapiens
ggctactctgtgcca

SEQ ID NO: 3892330 - DNA, 16 bp, Homo sapiens
ggctactctgtgccag

SEQ ID NO: 3892331 - DNA, 19 bp, Homo sapiens
ggctactctgtgccagagc

SEQ ID NO: 3892332 - DNA, 24 bp, Homo sapiens
ggctactctgtgccagagcctggg

SEQ ID NO: 3892333 - DNA, 21 bp, Homo sapiens
ggctagaacctagaagggcta

SEQ ID NO: 3892334 - DNA, 16 bp, Homo sapiens
ggctagaacctggaga

SEQ ID NO: 3892335 - DNA, 20 bp, Homo sapiens
ggctagagtgcagtggcatg

SEQ ID NO: 3892336 - DNA, 13 bp, Homo sapiens
ggctaggtacaca

SEQ ID NO: 3892337 - DNA, 15 bp, Homo sapiens
ggctagtcagagaga

SEQ ID NO: 3892338 - DNA, 15 bp, Homo sapiens
ggctagtgtgagtgg

SEQ ID NO: 3892339 - DNA, 18 bp, Homo sapiens
ggctagtgtgagtggcag

SEQ ID NO: 3892340 - DNA, 21 bp, Homo sapiens
ggctagtgtgagtggcagcca

SEQ ID NO: 3892341 - DNA, 18 bp, Homo sapiens
ggctatggcaagggggtg

SEQ ID NO: 3892342 - DNA, 19 bp, Homo sapiens
ggctatgtatggaatacag

SEQ ID NO: 3892343 - DNA, 13 bp, Homo sapiens
ggctatttgttca

SEQ ID NO: 3892344 - DNA, 15 bp, Homo sapiens
ggctatttgttcaga

SEQ ID NO: 3892345 - DNA, 16 bp, Homo sapiens
ggctatttgttcagag

SEQ ID NO: 3892346 - DNA, 15 bp, Homo sapiens
ggctcaagaggccca

SEQ ID NO: 3892347 - DNA, 19 bp, Homo sapiens
ggctcaagaggcccaggga

SEQ ID NO: 3892348 - DNA, 24 bp, Homo sapiens
ggctcacgcctgtaatcccagcag

SEQ ID NO: 3892349 - DNA, 12 bp, Homo sapiens
ggctcaggaaga

SEQ ID NO: 3892350 - DNA, 23 bp, Homo sapiens
ggctcaggaagaaaccccaagca

SEQ ID NO: 3892351 - DNA, 17 bp, Homo sapiens
ggctcatatgcgtccca

SEQ ID NO: 3892352 - DNA, 21 bp, Homo sapiens
ggctcatggcgtaatgggcct

SEQ ID NO: 3892353 - DNA, 15 bp, Homo sapiens
ggctccagcatccag

SEQ ID NO: 3892354 - DNA, 18 bp, Homo sapiens
ggctccagcatccagcct

SEQ ID NO: 3892355 - DNA, 20 bp, Homo sapiens
ggctccagcatccagcctgt

SEQ ID NO: 3892356 - DNA, 15 bp, Homo sapiens
ggctccatggaggag

SEQ ID NO: 3892357 - DNA, 17 bp, Homo sapiens
ggctccatggaggaggt

SEQ ID NO: 3892358 - DNA, 18 bp, Homo sapiens
ggctccatggaggaggtg

SEQ ID NO: 3892359 - DNA, 16 bp, Homo sapiens
ggctccctcctggagc

SEQ ID NO: 3892360 - DNA, 18 bp, Homo sapiens
ggctccgaaaaactttgt

SEQ ID NO: 3892361 - DNA, 17 bp, Homo sapiens
ggctcctggaaccaatc

SEQ ID NO: 3892362 - DNA, 13 bp, Homo sapiens
ggctcctggctgc

SEQ ID NO: 3892363 - DNA, 20 bp, Homo sapiens
ggctcctgtgctactttgcc

SEQ ID NO: 3892364 - DNA, 19 bp, Homo sapiens
ggctcctttctccagccag

SEQ ID NO: 3892365 - DNA, 22 bp, Homo sapiens
ggctcgctccctgtagctctgc

SEQ ID NO: 3892366 - DNA, 14 bp, Homo sapiens
ggctctaacgcctg

SEQ ID NO: 3892367 - DNA, 15 bp, Homo sapiens
ggctctaacgcctga

SEQ ID NO: 3892368 - DNA, 16 bp, Homo sapiens
ggctctaacgcctgag

SEQ ID NO: 3892369 - DNA, 21 bp, Homo sapiens
ggctctccaaaggggctgctg

SEQ ID NO: 3892370 - DNA, 14 bp, Homo sapiens
ggctctccacctca

SEQ ID NO: 3892371 - DNA, 21 bp, Homo sapiens
ggctctccacctcagccttgg

SEQ ID NO: 3892372 - DNA, 20 bp, Homo sapiens
ggctctcctcagaagaaaga

SEQ ID NO: 3892373 - DNA, 13 bp, Homo sapiens
ggctctcctggct

SEQ ID NO: 3892374 - DNA, 16 bp, Homo sapiens
ggctctcctggcttcc

SEQ ID NO: 3892375 - DNA, 18 bp, Homo sapiens
ggctctgccccagaggcc

SEQ ID NO: 3892376 - DNA, 21 bp, Homo sapiens
ggctctgccccagaggcctct

SEQ ID NO: 3892377 - DNA, 13 bp, Homo sapiens
ggctctggccacc

SEQ ID NO: 3892378 - DNA, 21 bp, Homo sapiens
tggaggggtgacagtggagga

SEQ ID NO: 3892379 - DNA, 16 bp, Homo sapiens
tggagtctgagtctga

SEQ ID NO: 3892380 - DNA, 12 bp, Homo sapiens
tggagtgagatc

SEQ ID NO: 3892381 - DNA, 18 bp, Homo sapiens
tggagtgagatcttacag

SEQ ID NO: 3892382 - DNA, 12 bp, Homo sapiens
tggagtgagcag

SEQ ID NO: 3892383 - DNA, 17 bp, Homo sapiens
tggagtgcagggaggag

SEQ ID NO: 3892384 - DNA, 19 bp, Homo sapiens
tggagtgcagggaggagag

SEQ ID NO: 3892385 - DNA, 15 bp, Homo sapiens
tggagtgcgctcttg

SEQ ID NO: 3892386 - DNA, 18 bp, Homo sapiens
tggagtgtgcgtgtgtgc

SEQ ID NO: 3892387 - DNA, 19 bp, Homo sapiens
tggagtgtgcgtgtgtgca

SEQ ID NO: 3892388 - DNA, 21 bp, Homo sapiens
tggagtgtgcgtgtgtgcatg

SEQ ID NO: 3892389 - DNA, 20 bp, Homo sapiens
tggataccagatatttgaat

SEQ ID NO: 3892390 - DNA, 17 bp, Homo sapiens
tggatagctgccttttt

SEQ ID NO: 3892391 - DNA, 20 bp, Homo sapiens
tggatcatgaggtcaggaga

SEQ ID NO: 3892392 - DNA, 21 bp, Homo sapiens
tggatctccaaggaccaggtt

SEQ ID NO: 3892393 - DNA, 19 bp, Homo sapiens
tggatctgggaccctttcc

SEQ ID NO: 3892394 - DNA, 23 bp, Homo sapiens
tggatctgggaccctttccttcc

SEQ ID NO: 3892395 - DNA, 14 bp, Homo sapiens
tggatgaaattttc

SEQ ID NO: 3892396 - DNA, 15 bp, Homo sapiens
tggatgaaattttct

SEQ ID NO: 3892397 - DNA, 17 bp, Homo sapiens
tggatgaaattttctag

SEQ ID NO: 3892398 - DNA, 20 bp, Homo sapiens
tggatgagacttccaaacct

SEQ ID NO: 3892399 - DNA, 16 bp, Homo sapiens
tggatgctccagggca

SEQ ID NO: 3892400 - DNA, 13 bp, Homo sapiens
tggatgctgggga

SEQ ID NO: 3892401 - DNA, 15 bp, Homo sapiens
tgccacacttcaggc

SEQ ID NO: 3892402 - DNA, 22 bp, Homo sapiens
tgccacacttcaggctcttctc

SEQ ID NO: 3892403 - DNA, 14 bp, Homo sapiens
tgccacagccccac

SEQ ID NO: 3892404 - DNA, 16 bp, Homo sapiens
tgccacagccccacag

SEQ ID NO: 3892405 - DNA, 13 bp, Homo sapiens
tgccaccaataaa

SEQ ID NO: 3892406 - DNA, 15 bp, Homo sapiens
tgccaccaataaaaa

SEQ ID NO: 3892407 - DNA, 16 bp, Homo sapiens
tgccaccaataaaaat

SEQ ID NO: 3892408 - DNA, 19 bp, Homo sapiens
tgccaccaataaaaatcct

SEQ ID NO: 3892409 - DNA, 21 bp, Homo sapiens
tgccaccaataaaaatcctac

SEQ ID NO: 3892410 - DNA, 22 bp, Homo sapiens
tgccaccacgtctgccaggccc

SEQ ID NO: 3892411 - DNA, 16 bp, Homo sapiens
tgccaccagtcactgt

SEQ ID NO: 3892412 - DNA, 15 bp, Homo sapiens
tgccaccatcctgct

SEQ ID NO: 3892413 - DNA, 19 bp, Homo sapiens
tgccaccatcctgctgctg

SEQ ID NO: 3892414 - DNA, 15 bp, Homo sapiens
tgccaccctctccat

SEQ ID NO: 3892415 - DNA, 13 bp, Homo sapiens
tgccacctcccct

SEQ ID NO: 3892416 - DNA, 22 bp, Homo sapiens
tgccacctcccctatccaccca

SEQ ID NO: 3892417 - DNA, 14 bp, Homo sapiens
tgccacctgtctgt

SEQ ID NO: 3892418 - DNA, 16 bp, Homo sapiens
tgccacctgtctgtct

SEQ ID NO: 3892419 - DNA, 13 bp, Homo sapiens
tgccactccctga

SEQ ID NO: 3892420 - DNA, 14 bp, Homo sapiens
tgccactgccaggc

SEQ ID NO: 3892421 - DNA, 15 bp, Homo sapiens
tgccactgccaggca

SEQ ID NO: 3892422 - DNA, 19 bp, Homo sapiens
tgccactgccaggcacctg

SEQ ID NO: 3892423 - DNA, 23 bp, Homo sapiens
tgccactgccaggcacctggcct

SEQ ID NO: 3892424 - DNA, 19 bp, Homo sapiens
tgccactgcctcttcctcc

SEQ ID NO: 3892425 - DNA, 16 bp, Homo sapiens
tgccacttgacattcc

SEQ ID NO: 3892426 - DNA, 17 bp, Homo sapiens
tgccacttgacattcct

SEQ ID NO: 3892427 - DNA, 16 bp, Homo sapiens
tgccactttggcttct

SEQ ID NO: 3892428 - DNA, 14 bp, Homo sapiens
tgccagacttaaat

SEQ ID NO: 3892429 - DNA, 22 bp, Homo sapiens
tgccagagcccaagtgccatcc

SEQ ID NO: 3892430 - DNA, 20 bp, Homo sapiens
tgccagcacaggggccccag

SEQ ID NO: 3892431 - DNA, 12 bp, Homo sapiens
tgccagccatca

SEQ ID NO: 3892432 - DNA, 23 bp, Homo sapiens
tgccagcccattttgaggccaga

SEQ ID NO: 3892433 - DNA, 24 bp, Homo sapiens
tgccagctcaggtgactggagccc

SEQ ID NO: 3892434 - DNA, 21 bp, Homo sapiens
tgccagctgccttcctcatcc

SEQ ID NO: 3892435 - DNA, 21 bp, Homo sapiens
tgccagcttcctgtgggccag

SEQ ID NO: 3892436 - DNA, 19 bp, Homo sapiens
tgccaggacacctgcccca

SEQ ID NO: 3892437 - DNA, 22 bp, Homo sapiens
tgccaggacacctgccccagcg

SEQ ID NO: 3892438 - DNA, 16 bp, Homo sapiens
tgccaggactccccag

SEQ ID NO: 3892439 - DNA, 13 bp, Homo sapiens
tgccaggagggac

SEQ ID NO: 3892440 - DNA, 13 bp, Homo sapiens
tgccaggcacctg

SEQ ID NO: 3892441 - DNA, 19 bp, Homo sapiens
tgccaggcacctggcctgc

SEQ ID NO: 3892442 - DNA, 23 bp, Homo sapiens
tgccaggcccatctcaggtgcca

SEQ ID NO: 3892443 - DNA, 14 bp, Homo sapiens
tgccaggctccctt

SEQ ID NO: 3892444 - DNA, 19 bp, Homo sapiens
tgccaggctccctttctct

SEQ ID NO: 3892445 - DNA, 23 bp, Homo sapiens
tgccaggctccctttctcttctt

SEQ ID NO: 3892446 - DNA, 14 bp, Homo sapiens
tgccagtaaaaaaa

SEQ ID NO: 3892447 - DNA, 22 bp, Homo sapiens
tgccagtaaaaaaaaaaaatgg

SEQ ID NO: 3892448 - DNA, 13 bp, Homo sapiens
tgccagtgcctta

SEQ ID NO: 3892449 - DNA, 20 bp, Homo sapiens
tgccagtgccttacctcctg

SEQ ID NO: 3892450 - DNA, 17 bp, Homo sapiens
tgccagttatggctata

SEQ ID NO: 3892451 - DNA, 22 bp, Homo sapiens
tgccagttgaaaatggattttt

SEQ ID NO: 3892452 - DNA, 18 bp, Homo sapiens
tgccataccgctggggaa

SEQ ID NO: 3892453 - DNA, 21 bp, Homo sapiens
tgccatagagtttaacacaag

SEQ ID NO: 3892454 - DNA, 14 bp, Homo sapiens
tgccatagccccat

SEQ ID NO: 3892455 - DNA, 17 bp, Homo sapiens
tgccatccattctgccg

SEQ ID NO: 3892456 - DNA, 12 bp, Homo sapiens
tgccatctgttt

SEQ ID NO: 3892457 - DNA, 14 bp, Homo sapiens
tgccatgatctgta

SEQ ID NO: 3892458 - DNA, 15 bp, Homo sapiens
tgccatgatctgtat

SEQ ID NO: 3892459 - DNA, 20 bp, Homo sapiens
tgccatgccactgccaggca

SEQ ID NO: 3892460 - DNA, 15 bp, Homo sapiens
tgccatgggcctgct

SEQ ID NO: 3892461 - DNA, 16 bp, Homo sapiens
tgccatgggcctgctg

SEQ ID NO: 3892462 - DNA, 17 bp, Homo sapiens
tgccatgggcctgctgc

SEQ ID NO: 3892463 - DNA, 21 bp, Homo sapiens
tgccatgtttagattccagga

SEQ ID NO: 3892464 - DNA, 22 bp, Homo sapiens
tgccattaaatccgcaaacagc

SEQ ID NO: 3892465 - DNA, 18 bp, Homo sapiens
tgcgtgctttatttatgg

SEQ ID NO: 3892466 - DNA, 21 bp, Homo sapiens
tgcgtgctttatttatggctt

SEQ ID NO: 3892467 - DNA, 15 bp, Homo sapiens
tgcgttggagccact

SEQ ID NO: 3892468 - DNA, 17 bp, Homo sapiens
tgctaaagttggaaagt

SEQ ID NO: 3892469 - DNA, 16 bp, Homo sapiens
tgctaactgtatgtgt

SEQ ID NO: 3892470 - DNA, 19 bp, Homo sapiens
tgctaactgtatgtgtctt

SEQ ID NO: 3892471 - DNA, 13 bp, Homo sapiens
tgctaatcttctt

SEQ ID NO: 3892472 - DNA, 20 bp, Homo sapiens
tgctaatcttcttatgcaat

SEQ ID NO: 3892473 - DNA, 15 bp, Homo sapiens
tgctacaaaaacaca

SEQ ID NO: 3892474 - DNA, 19 bp, Homo sapiens
tgctacaaaaacacagcaa

SEQ ID NO: 3892475 - DNA, 20 bp, Homo sapiens
tgctacaaaaacacagcaag

SEQ ID NO: 3892476 - DNA, 20 bp, Homo sapiens
tgctacaagaatgcaaaaaa

SEQ ID NO: 3892477 - DNA, 14 bp, Homo sapiens
tgctacacagtata

SEQ ID NO: 3892478 - DNA, 13 bp, Homo sapiens
tgctaccaaagca

SEQ ID NO: 3892479 - DNA, 16 bp, Homo sapiens
tgctaccaaggcccag

SEQ ID NO: 3892480 - DNA, 12 bp, Homo sapiens
tgctactcctgt

SEQ ID NO: 3892481 - DNA, 15 bp, Homo sapiens
tgctactcctgtgct

SEQ ID NO: 3892482 - DNA, 17 bp, Homo sapiens
tgctactttgccttttg

SEQ ID NO: 3892483 - DNA, 18 bp, Homo sapiens
tgctactttgccttttgc

SEQ ID NO: 3892484 - DNA, 22 bp, Homo sapiens
tgctagagcaacccctgtaccc

SEQ ID NO: 3892485 - DNA, 20 bp, Homo sapiens
tgctagatatcacttactca

SEQ ID NO: 3892486 - DNA, 21 bp, Homo sapiens
tgctagatatcacttactcag

SEQ ID NO: 3892487 - DNA, 22 bp, Homo sapiens
tgctagatatcacttactcagt

SEQ ID NO: 3892488 - DNA, 19 bp, Homo sapiens
tgcaagccccagggcctgg

SEQ ID NO: 3892489 - DNA, 23 bp, Homo sapiens
tgcaaggccgctgttcacccaca

SEQ ID NO: 3892490 - DNA, 13 bp, Homo sapiens
tgcaaggggctca

SEQ ID NO: 3892491 - DNA, 15 bp, Homo sapiens
tgcaaggggctcagc

SEQ ID NO: 3892492 - DNA, 15 bp, Homo sapiens
tgcaagtactgctgt

SEQ ID NO: 3892493 - DNA, 17 bp, Homo sapiens
tgcaagtcatacttagg

SEQ ID NO: 3892494 - DNA, 16 bp, Homo sapiens
tgcaagtgacatctct

SEQ ID NO: 3892495 - DNA, 13 bp, Homo sapiens
tgcaataaaatag

SEQ ID NO: 3892496 - DNA, 15 bp, Homo sapiens
tgcaataaaatagta

SEQ ID NO: 3892497 - DNA, 22 bp, Homo sapiens
tgcaatctccagggctgcccct

SEQ ID NO: 3892498 - DNA, 18 bp, Homo sapiens
tgcaatggctatatggca

SEQ ID NO: 3892499 - DNA, 15 bp, Homo sapiens
tgcaatttattaaaa

SEQ ID NO: 3892500 - DNA, 19 bp, Homo sapiens
tgcaatttcccctctgtgt

SEQ ID NO: 3892501 - DNA, 22 bp, Homo sapiens
tgcaatttttaaactagtaatg

SEQ ID NO: 3892502 - DNA, 21 bp, Homo sapiens
tgcacaaatatttattttctt

SEQ ID NO: 3892503 - DNA, 13 bp, Homo sapiens
tgcacaagctcag

SEQ ID NO: 3892504 - DNA, 16 bp, Homo sapiens
tgcacaagcttgtata

SEQ ID NO: 3892505 - DNA, 20 bp, Homo sapiens
tgcacaagcttgtatataca

SEQ ID NO: 3892506 - DNA, 11 bp, Homo sapiens
tgcacaattta

SEQ ID NO: 3892507 - DNA, 18 bp, Homo sapiens
tgcacaatttagaaaaca

SEQ ID NO: 3892508 - DNA, 16 bp, Homo sapiens
tgcacacacacagaga

SEQ ID NO: 3892509 - DNA, 18 bp, Homo sapiens
tgcacacacagatgcaca

SEQ ID NO: 3892510 - DNA, 13 bp, Homo sapiens
tgcacacacagct

SEQ ID NO: 3892511 - DNA, 15 bp, Homo sapiens
tgcacacacagctcc

SEQ ID NO: 3892512 - DNA, 14 bp, Homo sapiens
tgcacacacatgga

SEQ ID NO: 3892513 - DNA, 20 bp, Homo sapiens
tgcacacagaaatatatata

SEQ ID NO: 3892514 - DNA, 22 bp, Homo sapiens
tgcacacagaaatatatataca

SEQ ID NO: 3892515 - DNA, 23 bp, Homo sapiens
tgcacacagaaatatatatacat

SEQ ID NO: 3892516 - DNA, 16 bp, Homo sapiens
tgcacacgcacataga

SEQ ID NO: 3892517 - DNA, 14 bp, Homo sapiens
tgcacagcgcgggc

SEQ ID NO: 3892518 - DNA, 13 bp, Homo sapiens
tgcacagctgctt

SEQ ID NO: 3892519 - DNA, 13 bp, Homo sapiens
tgcacaggagggg

SEQ ID NO: 3892520 - DNA, 16 bp, Homo sapiens
tgcacaggttttcagc

SEQ ID NO: 3892521 - DNA, 15 bp, Homo sapiens
tgcacagtgcatctc

SEQ ID NO: 3892522 - DNA, 19 bp, Homo sapiens
tgcacagtgcatctcagcc

SEQ ID NO: 3892523 - DNA, 20 bp, Homo sapiens
tgcacatatgggtgctggca

SEQ ID NO: 3892524 - DNA, 16 bp, Homo sapiens
tgcacatccattccca

SEQ ID NO: 3892525 - DNA, 12 bp, Homo sapiens
tgcacatgtgtc

SEQ ID NO: 3892526 - DNA, 14 bp, Homo sapiens
tgcacattcctggc

SEQ ID NO: 3892527 - DNA, 20 bp, Homo sapiens
tgcaccaccatgccaggcta

SEQ ID NO: 3892528 - DNA, 22 bp, Homo sapiens
tgcaccacggcgtttttttaca

SEQ ID NO: 3892529 - DNA, 17 bp, Homo sapiens
tgcaccagcccttccct

SEQ ID NO: 3892530 - DNA, 17 bp, Homo sapiens
tgcaccatcacacatgc

SEQ ID NO: 3892531 - DNA, 16 bp, Homo sapiens
tgcacccactcaccag

SEQ ID NO: 3892532 - DNA, 17 bp, Homo sapiens
tgcacccactcaccagg

SEQ ID NO: 3892533 - DNA, 16 bp, Homo sapiens
tgcacccatgccatag

SEQ ID NO: 3892534 - DNA, 19 bp, Homo sapiens
tgcaccttaccaactttct

SEQ ID NO: 3892535 - DNA, 20 bp, Homo sapiens
tgcaccttaccaactttctg

SEQ ID NO: 3892536 - DNA, 21 bp, Homo sapiens
tgcacggcggcagggtggggg

SEQ ID NO: 3892537 - DNA, 16 bp, Homo sapiens
tgcacgtcttgctatt

SEQ ID NO: 3892538 - DNA, 20 bp, Homo sapiens
tgcacgtgctcttctgttct

SEQ ID NO: 3892539 - DNA, 13 bp, Homo sapiens
tgcactagcattt

SEQ ID NO: 3892540 - DNA, 17 bp, Homo sapiens
tgcactagcctgtgatt

SEQ ID NO: 3892541 - DNA, 18 bp, Homo sapiens
tgcactatgaaaatcagt

SEQ ID NO: 3892542 - DNA, 11 bp, Homo sapiens
tgcactccaga

SEQ ID NO: 3892543 - DNA, 13 bp, Homo sapiens
tgcactccagaat

SEQ ID NO: 3892544 - DNA, 14 bp, Homo sapiens
tgcactccatggcc

SEQ ID NO: 3892545 - DNA, 20 bp, Homo sapiens
tgcactccatggccaccccg

SEQ ID NO: 3892546 - DNA, 19 bp, Homo sapiens
tgcactccctaagaaaccc

SEQ ID NO: 3892547 - DNA, 18 bp, Homo sapiens
tgcactgacaagatggaa

SEQ ID NO: 3892548 - DNA, 18 bp, Homo sapiens
tgcactgacccacagcct

SEQ ID NO: 3892549 - DNA, 22 bp, Homo sapiens
tgcactgacccacagcctctgc

SEQ ID NO: 3892550 - DNA, 15 bp, Homo sapiens
tgcactgacccttcc

SEQ ID NO: 3892551 - DNA, 20 bp, Homo sapiens
tgcactgacccttccagaca

SEQ ID NO: 3892552 - DNA, 12 bp, Homo sapiens
tgcactgagggc

SEQ ID NO: 3892553 - DNA, 15 bp, Homo sapiens
tgcactggccaccca

SEQ ID NO: 3892554 - DNA, 14 bp, Homo sapiens
tccagtttgttctc

SEQ ID NO: 3892555 - DNA, 18 bp, Homo sapiens
tccagtttgttctccggg

SEQ ID NO: 3892556 - DNA, 21 bp, Homo sapiens
tccataaagcaagctcaacct

SEQ ID NO: 3892557 - DNA, 23 bp, Homo sapiens
tccataaccccaggcatcccatc

SEQ ID NO: 3892558 - DNA, 15 bp, Homo sapiens
tccataatgccactg

SEQ ID NO: 3892559 - DNA, 15 bp, Homo sapiens
tccatatcagacctc

SEQ ID NO: 3892560 - DNA, 16 bp, Homo sapiens
tccatatcagacctct

SEQ ID NO: 3892561 - DNA, 12 bp, Homo sapiens
tccatattttca

SEQ ID NO: 3892562 - DNA, 18 bp, Homo sapiens
tccatattttcacaggtg

SEQ ID NO: 3892563 - DNA, 14 bp, Homo sapiens
tccatcagctccct

SEQ ID NO: 3892564 - DNA, 14 bp, Homo sapiens
tccatcaggccact

SEQ ID NO: 3892565 - DNA, 22 bp, Homo sapiens
tccatccccaaactgtgccctg

SEQ ID NO: 3892566 - DNA, 23 bp, Homo sapiens
tccatctagagattttcttggca

SEQ ID NO: 3892567 - DNA, 17 bp, Homo sapiens
tccatgaagacacgctt

SEQ ID NO: 3892568 - DNA, 14 bp, Homo sapiens
tccatgcccaacct

SEQ ID NO: 3892569 - DNA, 12 bp, Homo sapiens
tccatgcctgag

SEQ ID NO: 3892570 - DNA, 22 bp, Homo sapiens
tctgtcagccagccgccctggg

SEQ ID NO: 3892571 - DNA, 13 bp, Homo sapiens
tctgtcatctctc

SEQ ID NO: 3892572 - DNA, 16 bp, Homo sapiens
tctgtcatctctctgg

SEQ ID NO: 3892573 - DNA, 12 bp, Homo sapiens
tctgtccaagga

SEQ ID NO: 3892574 - DNA, 19 bp, Homo sapiens
tctgtccagaggctgcaag

SEQ ID NO: 3892575 - DNA, 24 bp, Homo sapiens
tctgtccaggcactgctgcccagc

SEQ ID NO: 3892576 - DNA, 13 bp, Homo sapiens
tctgtccaggcca

SEQ ID NO: 3892577 - DNA, 21 bp, Homo sapiens
tctgtccaggccactgtggcc

SEQ ID NO: 3892578 - DNA, 23 bp, Homo sapiens
tctgtccaggccactgtggccag

SEQ ID NO: 3892579 - DNA, 16 bp, Homo sapiens
tctgtcgctgggctgt

SEQ ID NO: 3892580 - DNA, 22 bp, Homo sapiens
tctgtctctagtttctttctgt

SEQ ID NO: 3892581 - DNA, 15 bp, Homo sapiens
tctgtctgtctgtcc

SEQ ID NO: 3892582 - DNA, 15 bp, Homo sapiens
tctgtgaagaatgaa

SEQ ID NO: 3892583 - DNA, 20 bp, Homo sapiens
tctgtgaggaaagcacacag

SEQ ID NO: 3892584 - DNA, 21 bp, Homo sapiens
tctgtgcactagcctgtgatt

SEQ ID NO: 3892585 - DNA, 22 bp, Homo sapiens
tctgtgcactagcctgtgatta

SEQ ID NO: 3892586 - DNA, 18 bp, Homo sapiens
tctgtgccagagcctggg

SEQ ID NO: 3892587 - DNA, 17 bp, Homo sapiens
tctgtgctgtgcctgct

SEQ ID NO: 3892588 - DNA, 23 bp, Homo sapiens
tctgtgctgtgcctgctagagca

SEQ ID NO: 3892589 - DNA, 12 bp, Homo sapiens
tctgtggcctgt

SEQ ID NO: 3892590 - DNA, 23 bp, Homo sapiens
tctgtggcctgtgtccagcagct

SEQ ID NO: 3892591 - DNA, 15 bp, Homo sapiens
tctgtgggcttggcc

SEQ ID NO: 3892592 - DNA, 18 bp, Homo sapiens
tctgtgggcttggccttg

SEQ ID NO: 3892593 - DNA, 23 bp, Homo sapiens
tctgtgtaaatctaactacaagg

SEQ ID NO: 3892594 - DNA, 11 bp, Homo sapiens
tctgtgtcctt

SEQ ID NO: 3892595 - DNA, 14 bp, Homo sapiens
tctgtgtgcacaaa

SEQ ID NO: 3892596 - DNA, 21 bp, Homo sapiens
tctgtgtgcacaaatatttat

SEQ ID NO: 3892597 - DNA, 15 bp, Homo sapiens
tctgttactgaaatg

SEQ ID NO: 3892598 - DNA, 12 bp, Homo sapiens
tctgttctcaaa

SEQ ID NO: 3892599 - DNA, 18 bp, Homo sapiens
tctgttgatcccacttca

SEQ ID NO: 3892600 - DNA, 22 bp, Homo sapiens
tctgttgatcccacttcactgt

SEQ ID NO: 3892601 - DNA, 23 bp, Homo sapiens
tctgttgatcccacttcactgtg

SEQ ID NO: 3892602 - DNA, 18 bp, Homo sapiens
tctgttgccacaaccctg

SEQ ID NO: 3892603 - DNA, 12 bp, Homo sapiens
tctgttgtaata

SEQ ID NO: 3892604 - DNA, 12 bp, Homo sapiens
tctgtttccata

SEQ ID NO: 3892605 - DNA, 17 bp, Homo sapiens
tctgttttgtatatgat

SEQ ID NO: 3892606 - DNA, 14 bp, Homo sapiens
tctgtttttctttt

SEQ ID NO: 3892607 - DNA, 14 bp, Homo sapiens
tcttaaaataactt

SEQ ID NO: 3892608 - DNA, 15 bp, Homo sapiens
tcttaaaataactta

SEQ ID NO: 3892609 - DNA, 20 bp, Homo sapiens
tcttaaagctgcctgtagtt

SEQ ID NO: 3892610 - DNA, 23 bp, Homo sapiens
tcttaaagctgcctgtagttagg

SEQ ID NO: 3892611 - DNA, 18 bp, Homo sapiens
tcttaaaggaaaagtcaa

SEQ ID NO: 3892612 - DNA, 14 bp, Homo sapiens
tcttaaaggcctgg

SEQ ID NO: 3892613 - DNA, 17 bp, Homo sapiens
tcttaaaggcctggaac

SEQ ID NO: 3892614 - DNA, 13 bp, Homo sapiens
tcttaaatgacag

SEQ ID NO: 3892615 - DNA, 17 bp, Homo sapiens
tcttaaatgacagtgaa

SEQ ID NO: 3892616 - DNA, 15 bp, Homo sapiens
tcttaagacttttgg

SEQ ID NO: 3892617 - DNA, 23 bp, Homo sapiens
tcttaagatttctcctgactcca

SEQ ID NO: 3892618 - DNA, 16 bp, Homo sapiens
tcttaatcaagaatat

SEQ ID NO: 3892619 - DNA, 18 bp, Homo sapiens
tcttaattaaaagaatat

SEQ ID NO: 3892620 - DNA, 17 bp, Homo sapiens
tcttacccatatatctt

SEQ ID NO: 3892621 - DNA, 16 bp, Homo sapiens
tcttaccgagaaaagg

SEQ ID NO: 3892622 - DNA, 20 bp, Homo sapiens
tcttaccgagaaaaggagaa

SEQ ID NO: 3892623 - DNA, 15 bp, Homo sapiens
tcttaccgtagcctc

SEQ ID NO: 3892624 - DNA, 17 bp, Homo sapiens
tcttaccgtagcctccg

SEQ ID NO: 3892625 - DNA, 23 bp, Homo sapiens
tcttagctgtctgctcagacaga

SEQ ID NO: 3892626 - DNA, 14 bp, Homo sapiens
tcttaggagcagag

SEQ ID NO: 3892627 - DNA, 22 bp, Homo sapiens
tcttatagtcaatgtttctttt

SEQ ID NO: 3892628 - DNA, 15 bp, Homo sapiens
tcttatcttctgcaa

SEQ ID NO: 3892629 - DNA, 20 bp, Homo sapiens
tcttatgaaatgggctttaa

SEQ ID NO: 3892630 - DNA, 14 bp, Homo sapiens
tcttatgcaatttc

SEQ ID NO: 3892631 - DNA, 21 bp, Homo sapiens
tcttattcccaaactacagaa

SEQ ID NO: 3892632 - DNA, 15 bp, Homo sapiens
tcttatttcatttct

SEQ ID NO: 3892633 - DNA, 11 bp, Homo sapiens
tcttatttgct

SEQ ID NO: 3892634 - DNA, 17 bp, Homo sapiens
tcttcaaggtgtaaaat

SEQ ID NO: 3892635 - DNA, 16 bp, Homo sapiens
tcttcaataaattaag

SEQ ID NO: 3892636 - DNA, 15 bp, Homo sapiens
tcttcacaacagatt

SEQ ID NO: 3892637 - DNA, 12 bp, Homo sapiens
tcttcactcagc

SEQ ID NO: 3892638 - DNA, 20 bp, Homo sapiens
tcttcactgccatgcctcaa

SEQ ID NO: 3892639 - DNA, 13 bp, Homo sapiens
tcttcagaagaca

SEQ ID NO: 3892640 - DNA, 16 bp, Homo sapiens
tcttcagccacctctc

SEQ ID NO: 3892641 - DNA, 13 bp, Homo sapiens
tcttcatactttt

SEQ ID NO: 3892642 - DNA, 15 bp, Homo sapiens
tcttcatactttttt

SEQ ID NO: 3892643 - DNA, 11 bp, Homo sapiens
tcttcattttg

SEQ ID NO: 3892644 - DNA, 15 bp, Homo sapiens
tcttccaaccccagc

SEQ ID NO: 3892645 - DNA, 20 bp, Homo sapiens
tcttccaaccccagctggcc

SEQ ID NO: 3892646 - DNA, 24 bp, Homo sapiens
tcttccaagcaaaggtgaagagac

SEQ ID NO: 3892647 - DNA, 22 bp, Homo sapiens
tcttccagagcctaagaaaatc

SEQ ID NO: 3892648 - DNA, 16 bp, Homo sapiens
tcttccagtgcaacaa

SEQ ID NO: 3892649 - DNA, 19 bp, Homo sapiens
tcttccagtgcaacaaaat

SEQ ID NO: 3892650 - DNA, 15 bp, Homo sapiens
tcttccatttattgc

SEQ ID NO: 3892651 - DNA, 17 bp, Homo sapiens
tcttcccatcactggag

SEQ ID NO: 3892652 - DNA, 18 bp, Homo sapiens
tcttcccccactcctctt

SEQ ID NO: 3892653 - DNA, 12 bp, Homo sapiens
tcttccctcagt

SEQ ID NO: 3892654 - DNA, 19 bp, Homo sapiens
tcttccctgttttaaatta

SEQ ID NO: 3892655 - DNA, 22 bp, Homo sapiens
tcttcctaccaaatataaactt

SEQ ID NO: 3892656 - DNA, 11 bp, Homo sapiens
tcttcctctgc

SEQ ID NO: 3892657 - DNA, 16 bp, Homo sapiens
tgacccactcacactt

SEQ ID NO: 3892658 - DNA, 18 bp, Homo sapiens
tgacccagagtggagtct

SEQ ID NO: 3892659 - DNA, 20 bp, Homo sapiens
tgacccagagtggagtctga

SEQ ID NO: 3892660 - DNA, 21 bp, Homo sapiens
tgacccagtccccgtgccccg

SEQ ID NO: 3892661 - DNA, 20 bp, Homo sapiens
tgacccagtccctgggggaa

SEQ ID NO: 3892662 - DNA, 13 bp, Homo sapiens
tgacccagtgaga

SEQ ID NO: 3892663 - DNA, 11 bp, Homo sapiens
tgaccccaggg

SEQ ID NO: 3892664 - DNA, 22 bp, Homo sapiens
tgacccccaaccaagtggctcc

SEQ ID NO: 3892665 - DNA, 14 bp, Homo sapiens
tgacccctctaatt

SEQ ID NO: 3892666 - DNA, 18 bp, Homo sapiens
tgacccggcaccccctgc

SEQ ID NO: 3892667 - DNA, 23 bp, Homo sapiens
tgaccctccaccgcagaaggaag

SEQ ID NO: 3892668 - DNA, 21 bp, Homo sapiens
tgacccttcagggccagaagg

SEQ ID NO: 3892669 - DNA, 22 bp, Homo sapiens
tgacccttcccaatcagcactg

SEQ ID NO: 3892670 - DNA, 18 bp, Homo sapiens
tgaccgttttcatcctgg

SEQ ID NO: 3892671 - DNA, 18 bp, Homo sapiens
tgacctcacagtgaccct

SEQ ID NO: 3892672 - DNA, 11 bp, Homo sapiens
tgacctcccag

SEQ ID NO: 3892673 - DNA, 22 bp, Homo sapiens
tgacctcccagccctatggatg

SEQ ID NO: 3892674 - DNA, 15 bp, Homo sapiens
tgacctgcctctcac

SEQ ID NO: 3892675 - DNA, 18 bp, Homo sapiens
tgacctgcctctcacaca

SEQ ID NO: 3892676 - DNA, 20 bp, Homo sapiens
tgacctgcctctcacacaca

SEQ ID NO: 3892677 - DNA, 12 bp, Homo sapiens
tgacctgctgag

SEQ ID NO: 3892678 - DNA, 17 bp, Homo sapiens
tgacctgctgagctctg

SEQ ID NO: 3892679 - DNA, 18 bp, Homo sapiens
tgacctgctgagctctga

SEQ ID NO: 3892680 - DNA, 14 bp, Homo sapiens
tgaccttctctata

SEQ ID NO: 3892681 - DNA, 17 bp, Homo sapiens
tgaccttggagagacac

SEQ ID NO: 3892682 - DNA, 19 bp, Homo sapiens
tgaccttggagagacacag

SEQ ID NO: 3892683 - DNA, 20 bp, Homo sapiens
tgaccttggagagacacagc

SEQ ID NO: 3892684 - DNA, 21 bp, Homo sapiens
tgacgccctgcgttggagcca

SEQ ID NO: 3892685 - DNA, 23 bp, Homo sapiens
tgacgccctgcgttggagccact

SEQ ID NO: 3892686 - DNA, 20 bp, Homo sapiens
tgacggaagccaacttggct

SEQ ID NO: 3892687 - DNA, 23 bp, Homo sapiens
tgacggtcccacactggtgactg

SEQ ID NO: 3892688 - DNA, 21 bp, Homo sapiens
tgacggtcctttaggcagcct

SEQ ID NO: 3892689 - DNA, 22 bp, Homo sapiens
tgacggtcctttaggcagcctg

SEQ ID NO: 3892690 - DNA, 14 bp, Homo sapiens
tgactaaaaatatt

SEQ ID NO: 3892691 - DNA, 17 bp, Homo sapiens
tgactagtcatagaaat

SEQ ID NO: 3892692 - DNA, 22 bp, Homo sapiens
tgactataaacattaaaagaag

SEQ ID NO: 3892693 - DNA, 14 bp, Homo sapiens
tgactatcacatac

SEQ ID NO: 3892694 - DNA, 17 bp, Homo sapiens
tgactatcacatacaat

SEQ ID NO: 3892695 - DNA, 18 bp, Homo sapiens
tgactatcacatacaatt

SEQ ID NO: 3892696 - DNA, 19 bp, Homo sapiens
tgactatcacatacaattt

SEQ ID NO: 3892697 - DNA, 16 bp, Homo sapiens
tgactcaaatctccag

SEQ ID NO: 3892698 - DNA, 19 bp, Homo sapiens
tgactcacaagaagaccag

SEQ ID NO: 3892699 - DNA, 13 bp, Homo sapiens
tgactcacccaag

SEQ ID NO: 3892700 - DNA, 14 bp, Homo sapiens
tgactcacccaagc

SEQ ID NO: 3892701 - DNA, 13 bp, Homo sapiens
tgactccagagtc

SEQ ID NO: 3892702 - DNA, 19 bp, Homo sapiens
tgactccagagtctgagcc

SEQ ID NO: 3892703 - DNA, 23 bp, Homo sapiens
tgactccagagtctgagcccccg

SEQ ID NO: 3892704 - DNA, 17 bp, Homo sapiens
tgactcctctaagccac

SEQ ID NO: 3892705 - DNA, 14 bp, Homo sapiens
tgactccttgtggt

SEQ ID NO: 3892706 - DNA, 21 bp, Homo sapiens
tgactccttgtggtttatgtc

SEQ ID NO: 3892707 - DNA, 17 bp, Homo sapiens
tgactcctttctctatc

SEQ ID NO: 3892708 - DNA, 14 bp, Homo sapiens
tgactcggtgtaaa

SEQ ID NO: 3892709 - DNA, 21 bp, Homo sapiens
tgactcggtgtaaaaccatgt

SEQ ID NO: 3892710 - DNA, 21 bp, Homo sapiens
tgactcgtatatgtctcaggt

SEQ ID NO: 3892711 - DNA, 15 bp, Homo sapiens
tgactcgtgctgcat

SEQ ID NO: 3892712 - DNA, 22 bp, Homo sapiens
tgactctttttagggccaggca

SEQ ID NO: 3892713 - DNA, 15 bp, Homo sapiens
tgactgagcttccct

SEQ ID NO: 3892714 - DNA, 16 bp, Homo sapiens
tgactgccccaactcc

SEQ ID NO: 3892715 - DNA, 17 bp, Homo sapiens
tgactgccccaactcct

SEQ ID NO: 3892716 - DNA, 17 bp, Homo sapiens
tgactgcgatcttcaga

SEQ ID NO: 3892717 - DNA, 21 bp, Homo sapiens
tgactgctccccagccctggc

SEQ ID NO: 3892718 - DNA, 22 bp, Homo sapiens
tgactgctccccagccctggct

SEQ ID NO: 3892719 - DNA, 15 bp, Homo sapiens
tgactggagcccgag

SEQ ID NO: 3892720 - DNA, 12 bp, Homo sapiens
tgactggcaggt

SEQ ID NO: 3892721 - DNA, 14 bp, Homo sapiens
tgactggcaggtgc

SEQ ID NO: 3892722 - DNA, 24 bp, Homo sapiens
tgactggcaggtgcagatgggctg

SEQ ID NO: 3892723 - DNA, 16 bp, Homo sapiens
tgactgggaccaggca

SEQ ID NO: 3892724 - DNA, 18 bp, Homo sapiens
tgactgtactcctcccag

SEQ ID NO: 3892725 - DNA, 17 bp, Homo sapiens
tgactgtcactgttcct

SEQ ID NO: 3892726 - DNA, 15 bp, Homo sapiens
tgactgtcgtgttta

SEQ ID NO: 3892727 - DNA, 21 bp, Homo sapiens
tgactgtcgtgtttacaaaag

SEQ ID NO: 3892728 - DNA, 19 bp, Homo sapiens
tgacttcctcgcctctccc

SEQ ID NO: 3892729 - DNA, 22 bp, Homo sapiens
tgacttctaagtaaaaccacag

SEQ ID NO: 3892730 - DNA, 24 bp, Homo sapiens
tgacttctaagtaaaaccacagca

SEQ ID NO: 3892731 - DNA, 20 bp, Homo sapiens
tgacttcttggtttggggag

SEQ ID NO: 3892732 - DNA, 23 bp, Homo sapiens
tgacttcttggtttggggagaaa

SEQ ID NO: 3892733 - DNA, 18 bp, Homo sapiens
tgacttgcacatctctgc

SEQ ID NO: 3892734 - DNA, 22 bp, Homo sapiens
tgacttgggcacccccagcctg

SEQ ID NO: 3892735 - DNA, 14 bp, Homo sapiens
tgactttacaggag

SEQ ID NO: 3892736 - DNA, 16 bp, Homo sapiens
tgactttgctctttct

SEQ ID NO: 3892737 - DNA, 13 bp, Homo sapiens
tgacttttccatg

SEQ ID NO: 3892738 - DNA, 18 bp, Homo sapiens
tgacttttctggaagaca

SEQ ID NO: 3892739 - DNA, 19 bp, Homo sapiens
tgacttttctggaagacat

SEQ ID NO: 3892740 - DNA, 22 bp, Homo sapiens
tgactttttataatgtggattt

SEQ ID NO: 3892741 - DNA, 16 bp, Homo sapiens
tgactttttcagagtt

SEQ ID NO: 3892742 - DNA, 13 bp, Homo sapiens
tgagaaacatgaa

SEQ ID NO: 3892743 - DNA, 17 bp, Homo sapiens
tgaggatcctcacagga

SEQ ID NO: 3892744 - DNA, 20 bp, Homo sapiens
tgaggatcctcacaggagca

SEQ ID NO: 3892745 - DNA, 17 bp, Homo sapiens
tgaggatctagcttcat

SEQ ID NO: 3892746 - DNA, 14 bp, Homo sapiens
tgaggatgacagag

SEQ ID NO: 3892747 - DNA, 16 bp, Homo sapiens
tgaggattttgagtat

SEQ ID NO: 3892748 - DNA, 13 bp, Homo sapiens
tgaggcagaagaa

SEQ ID NO: 3892749 - DNA, 16 bp, Homo sapiens
tgaggccagaggtgct

SEQ ID NO: 3892750 - DNA, 13 bp, Homo sapiens
tgaggccagcctg

SEQ ID NO: 3892751 - DNA, 20 bp, Homo sapiens
tgaggccagcctggcctcct

SEQ ID NO: 3892752 - DNA, 20 bp, Homo sapiens
tgaggcccagcctgtcctgg

SEQ ID NO: 3892753 - DNA, 15 bp, Homo sapiens
tgaggccccaggccc

SEQ ID NO: 3892754 - DNA, 14 bp, Homo sapiens
tgaggcctcttgga

SEQ ID NO: 3892755 - DNA, 19 bp, Homo sapiens
tgaggcctgccctcaggga

SEQ ID NO: 3892756 - DNA, 21 bp, Homo sapiens
tgaggcctgccctcagggatc

SEQ ID NO: 3892757 - DNA, 15 bp, Homo sapiens
tgaggctcaagaggc

SEQ ID NO: 3892758 - DNA, 18 bp, Homo sapiens
tgaggctcaagaggccca

SEQ ID NO: 3892759 - DNA, 15 bp, Homo sapiens
tgaggctgggccagc

SEQ ID NO: 3892760 - DNA, 21 bp, Homo sapiens
tgaggctgggggcgggggagc

SEQ ID NO: 3892761 - DNA, 14 bp, Homo sapiens
tgaggcttccaggc

SEQ ID NO: 3892762 - DNA, 16 bp, Homo sapiens
tgaggcttccaggctc

SEQ ID NO: 3892763 - DNA, 18 bp, Homo sapiens
tgagggactggaaccagg

SEQ ID NO: 3892764 - DNA, 19 bp, Homo sapiens
tgagggagggggcgctcag

SEQ ID NO: 3892765 - DNA, 21 bp, Homo sapiens
tgagggagggggcgctcagga

SEQ ID NO: 3892766 - DNA, 17 bp, Homo sapiens
tgagggatcacagggcc

SEQ ID NO: 3892767 - DNA, 18 bp, Homo sapiens
tgagggatcacagggccc

SEQ ID NO: 3892768 - DNA, 13 bp, Homo sapiens
tgagggcagcagc

SEQ ID NO: 3892769 - DNA, 21 bp, Homo sapiens
tgagggcagcagccagccctg

SEQ ID NO: 3892770 - DNA, 20 bp, Homo sapiens
tgagggcagttcgcagccac

SEQ ID NO: 3892771 - DNA, 15 bp, Homo sapiens
tgagggctgggcagc

SEQ ID NO: 3892772 - DNA, 14 bp, Homo sapiens
tgagggctgggccc

SEQ ID NO: 3892773 - DNA, 16 bp, Homo sapiens
tgagggctgggcccac

SEQ ID NO: 3892774 - DNA, 18 bp, Homo sapiens
tgagggtaataaacttag

SEQ ID NO: 3892775 - DNA, 19 bp, Homo sapiens
tgagggtccccacctggga

SEQ ID NO: 3892776 - DNA, 14 bp, Homo sapiens
tgagggtggagact

SEQ ID NO: 3892777 - DNA, 18 bp, Homo sapiens
tgaggtcactgggttcta

SEQ ID NO: 3892778 - DNA, 17 bp, Homo sapiens
tgaggtcctgagcactg

SEQ ID NO: 3892779 - DNA, 19 bp, Homo sapiens
tgaggtcctgagcactgcc

SEQ ID NO: 3892780 - DNA, 22 bp, Homo sapiens
tgaggtcctgagcactgccagg

SEQ ID NO: 3892781 - DNA, 23 bp, Homo sapiens
tgaggtcctgagcactgccagga

SEQ ID NO: 3892782 - DNA, 15 bp, Homo sapiens
tgaggtgcccaggag

SEQ ID NO: 3892783 - DNA, 16 bp, Homo sapiens
tgaggtgcccaggaga

SEQ ID NO: 3892784 - DNA, 16 bp, Homo sapiens
tgaggtggaagccctc

SEQ ID NO: 3892785 - DNA, 22 bp, Homo sapiens
tgaggtggaagccctccttcca

SEQ ID NO: 3892786 - DNA, 18 bp, Homo sapiens
tgaggtgtcttaagcctt

SEQ ID NO: 3892787 - DNA, 15 bp, Homo sapiens
tgaggttgctttgtt

SEQ ID NO: 3892788 - DNA, 20 bp, Homo sapiens
tgagtaaattggaaacattt

SEQ ID NO: 3892789 - DNA, 22 bp, Homo sapiens
tgagtaaattggaaacattttc

SEQ ID NO: 3892790 - DNA, 16 bp, Homo sapiens
tgagtacagtgaggag

SEQ ID NO: 3892791 - DNA, 22 bp, Homo sapiens
tgagtaccaaatccacaagcca

SEQ ID NO: 3892792 - DNA, 15 bp, Homo sapiens
tgagtagatctgctt

SEQ ID NO: 3892793 - DNA, 16 bp, Homo sapiens
tgagtcaaaagcctgg

SEQ ID NO: 3892794 - DNA, 15 bp, Homo sapiens
tgagtcaactggagc

SEQ ID NO: 3892795 - DNA, 14 bp, Homo sapiens
tgagtcaattggaa

SEQ ID NO: 3892796 - DNA, 21 bp, Homo sapiens
tgagtcatgatctccctgccg

SEQ ID NO: 3892797 - DNA, 18 bp, Homo sapiens
tgagtcctgtctctgcct

SEQ ID NO: 3892798 - DNA, 19 bp, Homo sapiens
tgagtcggccccacatggg

SEQ ID NO: 3892799 - DNA, 18 bp, Homo sapiens
tgagtcgtcatcactttt

SEQ ID NO: 3892800 - DNA, 15 bp, Homo sapiens
tgagtctgaggcccc

SEQ ID NO: 3892801 - DNA, 18 bp, Homo sapiens
tgagtctgagtcctgtct

SEQ ID NO: 3892802 - DNA, 18 bp, Homo sapiens
tgagtctttaatcccagt

SEQ ID NO: 3892803 - DNA, 15 bp, Homo sapiens
tgagtgaatagcttt

SEQ ID NO: 3892804 - DNA, 21 bp, Homo sapiens
tgagtggatggatggacagaa

SEQ ID NO: 3892805 - DNA, 14 bp, Homo sapiens
tgagtggcagccat

SEQ ID NO: 3892806 - DNA, 18 bp, Homo sapiens
tgagtggcagccatgcct

SEQ ID NO: 3892807 - DNA, 20 bp, Homo sapiens
tgagtggcttgtgattctgg

SEQ ID NO: 3892808 - DNA, 18 bp, Homo sapiens
tgagttgttgccctgggt

SEQ ID NO: 3892809 - DNA, 24 bp, Homo sapiens
tgagttgttttggtgcctgcctct

SEQ ID NO: 3892810 - DNA, 19 bp, Homo sapiens
tgagtttcattctcctgcc

SEQ ID NO: 3892811 - DNA, 13 bp, Homo sapiens
tgagtttgcttat

SEQ ID NO: 3892812 - DNA, 22 bp, Homo sapiens
tgagtttgcttatgtaatctca

SEQ ID NO: 3892813 - DNA, 18 bp, Homo sapiens
tgagtttttatggggctg

SEQ ID NO: 3892814 - DNA, 21 bp, Homo sapiens
tgataaaattgtgatgttttg

SEQ ID NO: 3892815 - DNA, 13 bp, Homo sapiens
tgataaacacaga

SEQ ID NO: 3892816 - DNA, 22 bp, Homo sapiens
tgataaacattaaacactgtaa

SEQ ID NO: 3892817 - DNA, 18 bp, Homo sapiens
tgataacaacctggagac

SEQ ID NO: 3892818 - DNA, 20 bp, Homo sapiens
tgataagtggaaaaaagaga

SEQ ID NO: 3892819 - DNA, 14 bp, Homo sapiens
tgatactgatgcca

SEQ ID NO: 3892820 - DNA, 18 bp, Homo sapiens
tgatacttcaggtgcttt

SEQ ID NO: 3892821 - DNA, 24 bp, Homo sapiens
tgatagcagaagaaaaagttgcag

SEQ ID NO: 3892822 - DNA, 14 bp, Homo sapiens
tgatatatgtattt

SEQ ID NO: 3892823 - DNA, 15 bp, Homo sapiens
tgatatatgtattta

SEQ ID NO: 3892824 - DNA, 14 bp, Homo sapiens
tgatatcacctctc

SEQ ID NO: 3892825 - DNA, 19 bp, Homo sapiens
tgatatccagtaagcacat

SEQ ID NO: 3892826 - DNA, 21 bp, Homo sapiens
tgatatccagtaagcacatgt

SEQ ID NO: 3892827 - DNA, 12 bp, Homo sapiens
tgatatccctga

SEQ ID NO: 3892828 - DNA, 17 bp, Homo sapiens
tgatatgagtatacaat

SEQ ID NO: 3892829 - DNA, 19 bp, Homo sapiens
tgatatgagtatacaatat

SEQ ID NO: 3892830 - DNA, 19 bp, Homo sapiens
tgatattttcaacgcagcc

SEQ ID NO: 3892831 - DNA, 23 bp, Homo sapiens
tgatattttcaacgcagccctgc

SEQ ID NO: 3892832 - DNA, 15 bp, Homo sapiens
tgatcaaaaataaac

SEQ ID NO: 3892833 - DNA, 19 bp, Homo sapiens
tgatcaaaaataaactagt

SEQ ID NO: 3892834 - DNA, 15 bp, Homo sapiens
tgatcaaattcattt

SEQ ID NO: 3892835 - DNA, 14 bp, Homo sapiens
tgatcaactgttca

SEQ ID NO: 3892836 - DNA, 14 bp, Homo sapiens
tgatcaatgaaatg

SEQ ID NO: 3892837 - DNA, 12 bp, Homo sapiens
tgatcacactct

SEQ ID NO: 3892838 - DNA, 13 bp, Homo sapiens
tgatcacactctg

SEQ ID NO: 3892839 - DNA, 12 bp, Homo sapiens
tgatcacagtga

SEQ ID NO: 3892840 - DNA, 14 bp, Homo sapiens
tgatcacagtgact

SEQ ID NO: 3892841 - DNA, 16 bp, Homo sapiens
tgatcacagtgacttt

SEQ ID NO: 3892842 - DNA, 19 bp, Homo sapiens
tgatcataggtatttcaaa

SEQ ID NO: 3892843 - DNA, 20 bp, Homo sapiens
tgatcataggtatttcaaaa

SEQ ID NO: 3892844 - DNA, 13 bp, Homo sapiens
tgatcatggtcag

SEQ ID NO: 3892845 - DNA, 21 bp, Homo sapiens
tgatccacccacctcagcctc

SEQ ID NO: 3892846 - DNA, 15 bp, Homo sapiens
tgatcccccaggttc

SEQ ID NO: 3892847 - DNA, 16 bp, Homo sapiens
tgatcgagccactgca

SEQ ID NO: 3892848 - DNA, 18 bp, Homo sapiens
tgatcggagcctcctctc

SEQ ID NO: 3892849 - DNA, 19 bp, Homo sapiens
tgatcgggataacaaaatc

SEQ ID NO: 3892850 - DNA, 23 bp, Homo sapiens
tgatcgggataacaaaatcacaa

SEQ ID NO: 3892851 - DNA, 15 bp, Homo sapiens
tgatctccctgccgc

SEQ ID NO: 3892852 - DNA, 12 bp, Homo sapiens
tgatctctccac

SEQ ID NO: 3892853 - DNA, 14 bp, Homo sapiens
tgatctttaaaata

SEQ ID NO: 3892854 - DNA, 17 bp, Homo sapiens
tgatctttaaaatacac

SEQ ID NO: 3892855 - DNA, 14 bp, Homo sapiens
tgatgaaaataata

SEQ ID NO: 3892856 - DNA, 23 bp, Homo sapiens
tgatgaaaatgaatagagagtat

SEQ ID NO: 3892857 - DNA, 20 bp, Homo sapiens
tgatgaaactcctgattttg

SEQ ID NO: 3892858 - DNA, 16 bp, Homo sapiens
tgatgaaattcttgaa

SEQ ID NO: 3892859 - DNA, 13 bp, Homo sapiens
tgatgaactttct

SEQ ID NO: 3892860 - DNA, 15 bp, Homo sapiens
tgatgaactttctct

SEQ ID NO: 3892861 - DNA, 16 bp, Homo sapiens
tgatgagctcctcttc

SEQ ID NO: 3892862 - DNA, 17 bp, Homo sapiens
tgatgaggcctcttgga

SEQ ID NO: 3892863 - DNA, 19 bp, Homo sapiens
tgatgagggcagcagccag

SEQ ID NO: 3892864 - DNA, 18 bp, Homo sapiens
tgatgattaaacacctga

SEQ ID NO: 3892865 - DNA, 21 bp, Homo sapiens
tgatgattaaacacctgacac

SEQ ID NO: 3892866 - DNA, 21 bp, Homo sapiens
tgatgcatcagaaagggaggg

SEQ ID NO: 3892867 - DNA, 17 bp, Homo sapiens
tgatgcatttccacact

SEQ ID NO: 3892868 - DNA, 18 bp, Homo sapiens
tgatgcatttccacactg

SEQ ID NO: 3892869 - DNA, 14 bp, Homo sapiens
tgatgccccttccc

SEQ ID NO: 3892870 - DNA, 17 bp, Homo sapiens
tgatgcgaaaacttgaa

SEQ ID NO: 3892871 - DNA, 13 bp, Homo sapiens
tgatggagaagga

SEQ ID NO: 3892872 - DNA, 17 bp, Homo sapiens
tgatggcaattttgtaa

SEQ ID NO: 3892873 - DNA, 17 bp, Homo sapiens
tgatggccaagagcatc

SEQ ID NO: 3892874 - DNA, 19 bp, Homo sapiens
tgatgggaaagcattgtaa

SEQ ID NO: 3892875 - DNA, 15 bp, Homo sapiens
tgatggtgacttcct

SEQ ID NO: 3892876 - DNA, 14 bp, Homo sapiens
tgatggtgagctgg

SEQ ID NO: 3892877 - DNA, 11 bp, Homo sapiens
tgatgtacatg

SEQ ID NO: 3892878 - DNA, 14 bp, Homo sapiens
tgatgtacatgtgt

SEQ ID NO: 3892879 - DNA, 12 bp, Homo sapiens
tgatgtcagcct

SEQ ID NO: 3892880 - DNA, 15 bp, Homo sapiens
tgatgtcagccttgc

SEQ ID NO: 3892881 - DNA, 13 bp, Homo sapiens
tgatgtccagaag

SEQ ID NO: 3892882 - DNA, 17 bp, Homo sapiens
tgatgtctcttgtagaa

SEQ ID NO: 3892883 - DNA, 15 bp, Homo sapiens
tgatgtcttcaataa

SEQ ID NO: 3892884 - DNA, 13 bp, Homo sapiens
tgatgtgcaagga

SEQ ID NO: 3892885 - DNA, 10 bp, Homo sapiens
tgatgttaac

SEQ ID NO: 3892886 - DNA, 17 bp, Homo sapiens
tgatgttgagggaacag

SEQ ID NO: 3892887 - DNA, 20 bp, Homo sapiens
tgatgtttccagaaaatata

SEQ ID NO: 3892888 - DNA, 14 bp, Homo sapiens
tgattaaacacctg

SEQ ID NO: 3892889 - DNA, 16 bp, Homo sapiens
tgattaaacacctgac

SEQ ID NO: 3892890 - DNA, 18 bp, Homo sapiens
tgattacataatcaaagc

SEQ ID NO: 3892891 - DNA, 11 bp, Homo sapiens
tgattagatga

SEQ ID NO: 3892892 - DNA, 21 bp, Homo sapiens
tgattatgtgtcctttcttga

SEQ ID NO: 3892893 - DNA, 16 bp, Homo sapiens
tgattcaagaaacaga

SEQ ID NO: 3892894 - DNA, 13 bp, Homo sapiens
tgattcataacaa

SEQ ID NO: 3892895 - DNA, 11 bp, Homo sapiens
tgattccccac

SEQ ID NO: 3892896 - DNA, 14 bp, Homo sapiens
tgattccttttgat

SEQ ID NO: 3892897 - DNA, 15 bp, Homo sapiens
tgattctcctgtcag

SEQ ID NO: 3892898 - DNA, 17 bp, Homo sapiens
tgattctgaatctgaaa

SEQ ID NO: 3892899 - DNA, 15 bp, Homo sapiens
tgattggattattca

SEQ ID NO: 3892900 - DNA, 17 bp, Homo sapiens
tgattggattattcatt

SEQ ID NO: 3892901 - DNA, 18 bp, Homo sapiens
tgattggattattcattt

SEQ ID NO: 3892902 - DNA, 12 bp, Homo sapiens
tgatttaatgtt

SEQ ID NO: 3892903 - DNA, 16 bp, Homo sapiens
tgatttatagtttgta

SEQ ID NO: 3892904 - DNA, 16 bp, Homo sapiens
tgatttatatatggca

SEQ ID NO: 3892905 - DNA, 19 bp, Homo sapiens
tgatttcacaacagatcaa

SEQ ID NO: 3892906 - DNA, 18 bp, Homo sapiens
tgatttcagggaaatgga

SEQ ID NO: 3892907 - DNA, 13 bp, Homo sapiens
tgatttctattca

SEQ ID NO: 3892908 - DNA, 14 bp, Homo sapiens
tgatttctattcaa

SEQ ID NO: 3892909 - DNA, 11 bp, Homo sapiens
tgatttctcac

SEQ ID NO: 3892910 - DNA, 13 bp, Homo sapiens
tgattttacagag

SEQ ID NO: 3892911 - DNA, 21 bp, Homo sapiens
tgattttacagagaatctgaa

SEQ ID NO: 3892912 - DNA, 18 bp, Homo sapiens
tgattttagctgcagaac

SEQ ID NO: 3892913 - DNA, 14 bp, Homo sapiens
tgattttgtacaga

SEQ ID NO: 3892914 - DNA, 16 bp, Homo sapiens
tgattttgtacagaat

SEQ ID NO: 3892915 - DNA, 14 bp, Homo sapiens
tgatttttgtaata

SEQ ID NO: 3892916 - DNA, 17 bp, Homo sapiens
tgattttttaaaagaaa

SEQ ID NO: 3892917 - DNA, 14 bp, Homo sapiens
tcctgcactccaga

SEQ ID NO: 3892918 - DNA, 16 bp, Homo sapiens
tcctgcagcctcctcc

SEQ ID NO: 3892919 - DNA, 17 bp, Homo sapiens
tcctgcaggaacgagca

SEQ ID NO: 3892920 - DNA, 20 bp, Homo sapiens
tcctgcaggaacgagcactg

SEQ ID NO: 3892921 - DNA, 23 bp, Homo sapiens
tcctgcaggaacgagcactggcc

SEQ ID NO: 3892922 - DNA, 24 bp, Homo sapiens
tcctgcaggaacgagcactggcca

SEQ ID NO: 3892923 - DNA, 22 bp, Homo sapiens
tcctgccaccagtcactgtccc

SEQ ID NO: 3892924 - DNA, 12 bp, Homo sapiens
tcctgccagctg

SEQ ID NO: 3892925 - DNA, 16 bp, Homo sapiens
tcctgccagctgcctt

SEQ ID NO: 3892926 - DNA, 12 bp, Homo sapiens
tcctgcccagga

SEQ ID NO: 3892927 - DNA, 13 bp, Homo sapiens
tcctgcccatgtg

SEQ ID NO: 3892928 - DNA, 20 bp, Homo sapiens
tcctgcccatgtgtcccctc

SEQ ID NO: 3892929 - DNA, 15 bp, Homo sapiens
tcctgcccccagcca

SEQ ID NO: 3892930 - DNA, 23 bp, Homo sapiens
tcctgcccccgacagcccagcct

SEQ ID NO: 3892931 - DNA, 18 bp, Homo sapiens
tcctgccctgttgtgtat

SEQ ID NO: 3892932 - DNA, 16 bp, Homo sapiens
tcctgcctctactggg

SEQ ID NO: 3892933 - DNA, 17 bp, Homo sapiens
tcctgcctctactggga

SEQ ID NO: 3892934 - DNA, 12 bp, Homo sapiens
tcctgcctctct

SEQ ID NO: 3892935 - DNA, 17 bp, Homo sapiens
tcctgcctctctgctcc

SEQ ID NO: 3892936 - DNA, 12 bp, Homo sapiens
tcctgcgggctt

SEQ ID NO: 3892937 - DNA, 20 bp, Homo sapiens
tcctgcgggcttttccccgg

SEQ ID NO: 3892938 - DNA, 14 bp, Homo sapiens
tcctgcgggtttta

SEQ ID NO: 3892939 - DNA, 21 bp, Homo sapiens
tcctgctctcttcaggaggcc

SEQ ID NO: 3892940 - DNA, 19 bp, Homo sapiens
tcctgctgctgacctgatc

SEQ ID NO: 3892941 - DNA, 14 bp, Homo sapiens
tcctgctgctgtgt

SEQ ID NO: 3892942 - DNA, 20 bp, Homo sapiens
tcctgctggcacctcagaca

SEQ ID NO: 3892943 - DNA, 23 bp, Homo sapiens
tcctgcttcctaggccccagagc

SEQ ID NO: 3892944 - DNA, 15 bp, Homo sapiens
tcctggacagctgtg

SEQ ID NO: 3892945 - DNA, 16 bp, Homo sapiens
tcctggacagctgtgc

SEQ ID NO: 3892946 - DNA, 19 bp, Homo sapiens
tcctggacagctgtgcctc

SEQ ID NO: 3892947 - DNA, 14 bp, Homo sapiens
tcctggagcatccc

SEQ ID NO: 3892948 - DNA, 19 bp, Homo sapiens
tcctggagcatcccaggcg

SEQ ID NO: 3892949 - DNA, 17 bp, Homo sapiens
tcctggagggggcaagc

SEQ ID NO: 3892950 - DNA, 18 bp, Homo sapiens
tcctggagggggcaagcc

SEQ ID NO: 3892951 - DNA, 19 bp, Homo sapiens
tcctggagggggcaagcct

SEQ ID NO: 3892952 - DNA, 20 bp, Homo sapiens
tcctggaggtgggagacaag

SEQ ID NO: 3892953 - DNA, 21 bp, Homo sapiens
tcctggccattttcttgcctg

SEQ ID NO: 3892954 - DNA, 20 bp, Homo sapiens
tcctggccccgggctctggc

SEQ ID NO: 3892955 - DNA, 23 bp, Homo sapiens
tcctggccccgggctctggccac

SEQ ID NO: 3892956 - DNA, 22 bp, Homo sapiens
tcctggcctcactggctggggc

SEQ ID NO: 3892957 - DNA, 18 bp, Homo sapiens
tcctggctgctctcatgc

SEQ ID NO: 3892958 - DNA, 14 bp, Homo sapiens
tcctggcttcccat

SEQ ID NO: 3892959 - DNA, 15 bp, Homo sapiens
tcctgggcctgtccc

SEQ ID NO: 3892960 - DNA, 19 bp, Homo sapiens
tcctggggccccgctggga

SEQ ID NO: 3892961 - DNA, 20 bp, Homo sapiens
tcctggggccccgctgggat

SEQ ID NO: 3892962 - DNA, 13 bp, Homo sapiens
tcctgggggtggc

SEQ ID NO: 3892963 - DNA, 16 bp, Homo sapiens
tcctgggggtggcagg

SEQ ID NO: 3892964 - DNA, 19 bp, Homo sapiens
tcctgggggtggcaggcac

SEQ ID NO: 3892965 - DNA, 15 bp, Homo sapiens
tcctggtacagcagg

SEQ ID NO: 3892966 - DNA, 15 bp, Homo sapiens
tcctggtctgtgctg

SEQ ID NO: 3892967 - DNA, 19 bp, Homo sapiens
tcctggtgaggcccagcct

SEQ ID NO: 3892968 - DNA, 17 bp, Homo sapiens
tcctggtggggcagctc

SEQ ID NO: 3892969 - DNA, 19 bp, Homo sapiens
tcctggtggggcagctcct

SEQ ID NO: 3892970 - DNA, 23 bp, Homo sapiens
tcctgtaacacaagccacagaag

SEQ ID NO: 3892971 - DNA, 21 bp, Homo sapiens
tcctgtagaggttttgttgtt

SEQ ID NO: 3892972 - DNA, 14 bp, Homo sapiens
tcctgtagcatctt

SEQ ID NO: 3892973 - DNA, 15 bp, Homo sapiens
tcctgtagcatcttc

SEQ ID NO: 3892974 - DNA, 21 bp, Homo sapiens
tcctgtagcatcttctggagt

SEQ ID NO: 3892975 - DNA, 17 bp, Homo sapiens
tcctgtatttgttccca

SEQ ID NO: 3892976 - DNA, 22 bp, Homo sapiens
tcctgtatttgttcccaagagc

SEQ ID NO: 3892977 - DNA, 19 bp, Homo sapiens
tcctgtccactctcggggc

SEQ ID NO: 3892978 - DNA, 22 bp, Homo sapiens
tcctgtcccgccttcctcctcc

SEQ ID NO: 3892979 - DNA, 13 bp, Homo sapiens
tcctgtccctacc

SEQ ID NO: 3892980 - DNA, 15 bp, Homo sapiens
tcctgtccctaccca

SEQ ID NO: 3892981 - DNA, 17 bp, Homo sapiens
tcctgtccctacccact

SEQ ID NO: 3892982 - DNA, 21 bp, Homo sapiens
tcctgtccctacccactcttt

SEQ ID NO: 3892983 - DNA, 21 bp, Homo sapiens
tcctgtgaccccaccttgacg

SEQ ID NO: 3892984 - DNA, 18 bp, Homo sapiens
tcctgtgacttcagctct

SEQ ID NO: 3892985 - DNA, 18 bp, Homo sapiens
tcctgtgctactttgcct

SEQ ID NO: 3892986 - DNA, 19 bp, Homo sapiens
tcctgtgctctggaggctg

SEQ ID NO: 3892987 - DNA, 13 bp, Homo sapiens
tcctgtgggagcc

SEQ ID NO: 3892988 - DNA, 21 bp, Homo sapiens
tcctgtgggccaggagctcag

SEQ ID NO: 3892989 - DNA, 22 bp, Homo sapiens
tcctgtgggccaggagctcagc

SEQ ID NO: 3892990 - DNA, 13 bp, Homo sapiens
tcctgtgtacagg

SEQ ID NO: 3892991 - DNA, 18 bp, Homo sapiens
tcctgtgtggggaggcag

SEQ ID NO: 3892992 - DNA, 22 bp, Homo sapiens
tcctgttaggtattagaaagtg

SEQ ID NO: 3892993 - DNA, 23 bp, Homo sapiens
tccttaaaggcaccatctaatag

SEQ ID NO: 3892994 - DNA, 18 bp, Homo sapiens
tccttaattcactcccac

SEQ ID NO: 3892995 - DNA, 19 bp, Homo sapiens
tccttaattcactcccaca

SEQ ID NO: 3892996 - DNA, 16 bp, Homo sapiens
tccttactcccaggca

SEQ ID NO: 3892997 - DNA, 23 bp, Homo sapiens
tccttactcctgtgggagcctcg

SEQ ID NO: 3892998 - DNA, 17 bp, Homo sapiens
tccttactctgagccca

SEQ ID NO: 3892999 - DNA, 20 bp, Homo sapiens
tccttaggaaaatgcttctg

SEQ ID NO: 3893000 - DNA, 18 bp, Homo sapiens
tccttcactcatccagcc

SEQ ID NO: 3893001 - DNA, 21 bp, Homo sapiens
tccttcatcgaacaaactgat

SEQ ID NO: 3893002 - DNA, 22 bp, Homo sapiens
tccttccagctagtgacccaca

SEQ ID NO: 3893003 - DNA, 16 bp, Homo sapiens
tctacaaccagagccc

SEQ ID NO: 3893004 - DNA, 20 bp, Homo sapiens
tctacaagcatatttgagaa

SEQ ID NO: 3893005 - DNA, 19 bp, Homo sapiens
tctacaagcatttgccctg

SEQ ID NO: 3893006 - DNA, 21 bp, Homo sapiens
tctacacagcagtatgaatga

SEQ ID NO: 3893007 - DNA, 17 bp, Homo sapiens
tctacagacttctccag

SEQ ID NO: 3893008 - DNA, 18 bp, Homo sapiens
tctacagacttctccaga

SEQ ID NO: 3893009 - DNA, 20 bp, Homo sapiens
tctacagctaatcagcattc

SEQ ID NO: 3893010 - DNA, 23 bp, Homo sapiens
tctacagctaatcagcattctca

SEQ ID NO: 3893011 - DNA, 15 bp, Homo sapiens
tctacatattcttta

SEQ ID NO: 3893012 - DNA, 18 bp, Homo sapiens
tctaccatttcagagagg

SEQ ID NO: 3893013 - DNA, 19 bp, Homo sapiens
tctacccggcccagagacc

SEQ ID NO: 3893014 - DNA, 13 bp, Homo sapiens
tctaccctgggat

SEQ ID NO: 3893015 - DNA, 19 bp, Homo sapiens
tctacctgccctctctcag

SEQ ID NO: 3893016 - DNA, 19 bp, Homo sapiens
tctacctttttttctctcc

SEQ ID NO: 3893017 - DNA, 16 bp, Homo sapiens
tctacgctctcctttc

SEQ ID NO: 3893018 - DNA, 15 bp, Homo sapiens
tctacgtataaatat

SEQ ID NO: 3893019 - DNA, 16 bp, Homo sapiens
tctacgtataaatatg

SEQ ID NO: 3893020 - DNA, 20 bp, Homo sapiens
tctacgtataaatatgaaat

SEQ ID NO: 3893021 - DNA, 14 bp, Homo sapiens
tctactcagaaatt

SEQ ID NO: 3893022 - DNA, 21 bp, Homo sapiens
tctactcagaaatttttattt

SEQ ID NO: 3893023 - DNA, 19 bp, Homo sapiens
tctactgggaaggctactt

SEQ ID NO: 3893024 - DNA, 16 bp, Homo sapiens
tctactggtcttgtgg

SEQ ID NO: 3893025 - DNA, 21 bp, Homo sapiens
tctagaaaccagtatggaagg

SEQ ID NO: 3893026 - DNA, 20 bp, Homo sapiens
tctagaaagaaaagaccctg

SEQ ID NO: 3893027 - DNA, 23 bp, Homo sapiens
tctagaaagaaaagaccctgaga

SEQ ID NO: 3893028 - DNA, 17 bp, Homo sapiens
tctagaaagtgggttca

SEQ ID NO: 3893029 - DNA, 17 bp, Homo sapiens
tctagaacacccactgg

SEQ ID NO: 3893030 - DNA, 18 bp, Homo sapiens
tctagaacacccactggc

SEQ ID NO: 3893031 - DNA, 17 bp, Homo sapiens
tctagaacatgcacatt

SEQ ID NO: 3893032 - DNA, 19 bp, Homo sapiens
tctagaacatgcacattta

SEQ ID NO: 3893033 - DNA, 14 bp, Homo sapiens
tctagactttctgt

SEQ ID NO: 3893034 - DNA, 16 bp, Homo sapiens
tctagagaagaggctg

SEQ ID NO: 3893035 - DNA, 13 bp, Homo sapiens
tctagaggcctca

SEQ ID NO: 3893036 - DNA, 13 bp, Homo sapiens
tctagatcaatta

SEQ ID NO: 3893037 - DNA, 23 bp, Homo sapiens
tctagattaccccctcattgttt

SEQ ID NO: 3893038 - DNA, 23 bp, Homo sapiens
tctagccactttggtcccgtgca

SEQ ID NO: 3893039 - DNA, 21 bp, Homo sapiens
tctagccaggagtctgtgctc

SEQ ID NO: 3893040 - DNA, 17 bp, Homo sapiens
tctagcctgggccagag

SEQ ID NO: 3893041 - DNA, 14 bp, Homo sapiens
tctagctggcagga

SEQ ID NO: 3893042 - DNA, 16 bp, Homo sapiens
tctaggagctgggagg

SEQ ID NO: 3893043 - DNA, 20 bp, Homo sapiens
tctagtccttggtctgctgg

SEQ ID NO: 3893044 - DNA, 14 bp, Homo sapiens
tctagtgaagatgt

SEQ ID NO: 3893045 - DNA, 15 bp, Homo sapiens
tctagtgaagatgtt

SEQ ID NO: 3893046 - DNA, 16 bp, Homo sapiens
tctagtgacttcctgg

SEQ ID NO: 3893047 - DNA, 22 bp, Homo sapiens
tctagttctcaatcactgctcc

SEQ ID NO: 3893048 - DNA, 16 bp, Homo sapiens
tctagtttctttctgt

SEQ ID NO: 3893049 - DNA, 11 bp, Homo sapiens
tctatagagaa

SEQ ID NO: 3893050 - DNA, 13 bp, Homo sapiens
tctatagctcttc

SEQ ID NO: 3893051 - DNA, 20 bp, Homo sapiens
tctatagctcttctatttaa

SEQ ID NO: 3893052 - DNA, 14 bp, Homo sapiens
tctatagtagtcaa

SEQ ID NO: 3893053 - DNA, 19 bp, Homo sapiens
tctatagttattgttttat

SEQ ID NO: 3893054 - DNA, 22 bp, Homo sapiens
tctatattccgggtgccattcc

SEQ ID NO: 3893055 - DNA, 23 bp, Homo sapiens
tctatcccacccaacagctcaga

SEQ ID NO: 3893056 - DNA, 16 bp, Homo sapiens
tctatgcaatttttaa

SEQ ID NO: 3893057 - DNA, 21 bp, Homo sapiens
tctatgcaatttttaaactag

SEQ ID NO: 3893058 - DNA, 19 bp, Homo sapiens
tctattctctcctcagact

SEQ ID NO: 3893059 - DNA, 14 bp, Homo sapiens
tctattctgagcct

SEQ ID NO: 3893060 - DNA, 14 bp, Homo sapiens
tctattgtgcctat

SEQ ID NO: 3893061 - DNA, 15 bp, Homo sapiens
tctattgtgcctatg

SEQ ID NO: 3893062 - DNA, 14 bp, Homo sapiens
tctatttaaaaaat

SEQ ID NO: 3893063 - DNA, 17 bp, Homo sapiens
tctatttaaaaaataaa

SEQ ID NO: 3893064 - DNA, 17 bp, Homo sapiens
tctcaaaactgcactgt

SEQ ID NO: 3893065 - DNA, 14 bp, Homo sapiens
tctcaaactggggc

SEQ ID NO: 3893066 - DNA, 21 bp, Homo sapiens
tctcaacctaccaccccttcc

SEQ ID NO: 3893067 - DNA, 12 bp, Homo sapiens
tctcaagactga

SEQ ID NO: 3893068 - DNA, 22 bp, Homo sapiens
tctcaagattatattataataa

SEQ ID NO: 3893069 - DNA, 23 bp, Homo sapiens
tctcaagggtaccaatcctggca

SEQ ID NO: 3893070 - DNA, 14 bp, Homo sapiens
tctcaatatgctta

SEQ ID NO: 3893071 - DNA, 13 bp, Homo sapiens
tctcaatcagtgc

SEQ ID NO: 3893072 - DNA, 14 bp, Homo sapiens
tctcaatcagtgca

SEQ ID NO: 3893073 - DNA, 12 bp, Homo sapiens
tctcacacacat

SEQ ID NO: 3893074 - DNA, 14 bp, Homo sapiens
tctcacacacatag

SEQ ID NO: 3893075 - DNA, 15 bp, Homo sapiens
tctcacacacataga

SEQ ID NO: 3893076 - DNA, 15 bp, Homo sapiens
tctcaccagctgctg

SEQ ID NO: 3893077 - DNA, 15 bp, Homo sapiens
tctcaccaggaaggg

SEQ ID NO: 3893078 - DNA, 17 bp, Homo sapiens
tctcactaaactttacc

SEQ ID NO: 3893079 - DNA, 21 bp, Homo sapiens
tctcactcagccgcagacaag

SEQ ID NO: 3893080 - DNA, 13 bp, Homo sapiens
tctcactccacca

SEQ ID NO: 3893081 - DNA, 18 bp, Homo sapiens
tctcactcctacctggta

SEQ ID NO: 3893082 - DNA, 14 bp, Homo sapiens
tctcactgcccagt

SEQ ID NO: 3893083 - DNA, 16 bp, Homo sapiens
tctcactgcccagttt

SEQ ID NO: 3893084 - DNA, 14 bp, Homo sapiens
tctcacttatacca

SEQ ID NO: 3893085 - DNA, 18 bp, Homo sapiens
tctcacttataccaaagg

SEQ ID NO: 3893086 - DNA, 15 bp, Homo sapiens
tctcagacttgttgt

SEQ ID NO: 3893087 - DNA, 23 bp, Homo sapiens
tctcagccataaagtgccagttt

SEQ ID NO: 3893088 - DNA, 15 bp, Homo sapiens
tctcagcctcctcag

SEQ ID NO: 3893089 - DNA, 21 bp, Homo sapiens
tctcaggaaatcaaatatgca

SEQ ID NO: 3893090 - DNA, 22 bp, Homo sapiens
tctcctcttgccactgcctctt

SEQ ID NO: 3893091 - DNA, 15 bp, Homo sapiens
tctcctgactccagt

SEQ ID NO: 3893092 - DNA, 21 bp, Homo sapiens
tctcctgactccagtgagctg

SEQ ID NO: 3893093 - DNA, 17 bp, Homo sapiens
tctcctgatttctctga

SEQ ID NO: 3893094 - DNA, 14 bp, Homo sapiens
tctcctgcctactc

SEQ ID NO: 3893095 - DNA, 22 bp, Homo sapiens
tctcctgcctgtagcagtgaga

SEQ ID NO: 3893096 - DNA, 23 bp, Homo sapiens
tctcctggcttcccatccccagc

SEQ ID NO: 3893097 - DNA, 16 bp, Homo sapiens
tctcctggtctgtgct

SEQ ID NO: 3893098 - DNA, 19 bp, Homo sapiens
tctcctgtataaccccacc

SEQ ID NO: 3893099 - DNA, 20 bp, Homo sapiens
tctcctgtataaccccacct

SEQ ID NO: 3893100 - DNA, 14 bp, Homo sapiens
tctcctgtccaacc

SEQ ID NO: 3893101 - DNA, 17 bp, Homo sapiens
tctcctgtgcccacatc

SEQ ID NO: 3893102 - DNA, 15 bp, Homo sapiens
tctcctgtgcccctc

SEQ ID NO: 3893103 - DNA, 14 bp, Homo sapiens
tctccttcccctac

SEQ ID NO: 3893104 - DNA, 19 bp, Homo sapiens
tctccttcccctttcccca

SEQ ID NO: 3893105 - DNA, 14 bp, Homo sapiens
tctccttccctctt

SEQ ID NO: 3893106 - DNA, 15 bp, Homo sapiens
tctccttccctcttt

SEQ ID NO: 3893107 - DNA, 14 bp, Homo sapiens
tctccttccttacc

SEQ ID NO: 3893108 - DNA, 19 bp, Homo sapiens
tctccttcgtgtctctccc

SEQ ID NO: 3893109 - DNA, 15 bp, Homo sapiens
tctccttcttccctg

SEQ ID NO: 3893110 - DNA, 21 bp, Homo sapiens
tctccttgggctcctggctgc

SEQ ID NO: 3893111 - DNA, 23 bp, Homo sapiens
tctccttgggctcctggctgcca

SEQ ID NO: 3893112 - DNA, 22 bp, Homo sapiens
tctcctttgcactgagggccac

SEQ ID NO: 3893113 - DNA, 14 bp, Homo sapiens
tctcgagcgccctg

SEQ ID NO: 3893114 - DNA, 19 bp, Homo sapiens
tctcgagcgccctgcagac

SEQ ID NO: 3893115 - DNA, 20 bp, Homo sapiens
tctcggggcccttggggcct

SEQ ID NO: 3893116 - DNA, 21 bp, Homo sapiens
tctcgggtgcatttgagagaa

SEQ ID NO: 3893117 - DNA, 19 bp, Homo sapiens
tctctaaaaataaaatgat

SEQ ID NO: 3893118 - DNA, 20 bp, Homo sapiens
tctctaaaaataaaatgatg

SEQ ID NO: 3893119 - DNA, 14 bp, Homo sapiens
tctctaaacccaaa

SEQ ID NO: 3893120 - DNA, 17 bp, Homo sapiens
tctctaagccacagctt

SEQ ID NO: 3893121 - DNA, 16 bp, Homo sapiens
tctctaccccaaagaa

SEQ ID NO: 3893122 - DNA, 19 bp, Homo sapiens
tctctacccggcccagaga

SEQ ID NO: 3893123 - DNA, 16 bp, Homo sapiens
tctctaggctgttttc

SEQ ID NO: 3893124 - DNA, 17 bp, Homo sapiens
tctctcaggagcacagg

SEQ ID NO: 3893125 - DNA, 21 bp, Homo sapiens
tctctcaggagcacaggcagc

SEQ ID NO: 3893126 - DNA, 19 bp, Homo sapiens
tctctcccaccccggcctc

SEQ ID NO: 3893127 - DNA, 16 bp, Homo sapiens
tctctcctcagactgc

SEQ ID NO: 3893128 - DNA, 14 bp, Homo sapiens
tctctcctgtccaa

SEQ ID NO: 3893129 - DNA, 19 bp, Homo sapiens
tctctctaaaaataaaatg

SEQ ID NO: 3893130 - DNA, 13 bp, Homo sapiens
tctctctgcctat

SEQ ID NO: 3893131 - DNA, 19 bp, Homo sapiens
tctctctggggccctgggc

SEQ ID NO: 3893132 - DNA, 11 bp, Homo sapiens
tctctctttcc

SEQ ID NO: 3893133 - DNA, 14 bp, Homo sapiens
tctctgagaacaga

SEQ ID NO: 3893134 - DNA, 11 bp, Homo sapiens
tctctgcagcc

SEQ ID NO: 3893135 - DNA, 21 bp, Homo sapiens
tctctgcctatttattggggt

SEQ ID NO: 3893136 - DNA, 13 bp, Homo sapiens
tctctgctctagc

SEQ ID NO: 3893137 - DNA, 16 bp, Homo sapiens
tctctgctctagccag

SEQ ID NO: 3893138 - DNA, 20 bp, Homo sapiens
tctctgctctagccaggagt

SEQ ID NO: 3893139 - DNA, 15 bp, Homo sapiens
tctctgcttaccctt

SEQ ID NO: 3893140 - DNA, 19 bp, Homo sapiens
tctctgcttacccttcacc

SEQ ID NO: 3893141 - DNA, 14 bp, Homo sapiens
tctctgctttaaag

SEQ ID NO: 3893142 - DNA, 14 bp, Homo sapiens
tctctggctccaga

SEQ ID NO: 3893143 - DNA, 16 bp, Homo sapiens
tctctgtataatctat

SEQ ID NO: 3893144 - DNA, 16 bp, Homo sapiens
tctctgtgctttgact

SEQ ID NO: 3893145 - DNA, 22 bp, Homo sapiens
tctctgtgctttgactcacctg

SEQ ID NO: 3893146 - DNA, 16 bp, Homo sapiens
tctcttaggtctaatg

SEQ ID NO: 3893147 - DNA, 17 bp, Homo sapiens
tctcttcactcccaata

SEQ ID NO: 3893148 - DNA, 21 bp, Homo sapiens
tctcttccagaagatgccctc

SEQ ID NO: 3893149 - DNA, 15 bp, Homo sapiens
tctcttccctccttc

SEQ ID NO: 3893150 - DNA, 16 bp, Homo sapiens
tctcttcctctgttct

SEQ ID NO: 3893151 - DNA, 13 bp, Homo sapiens
tctcttctccact

SEQ ID NO: 3893152 - DNA, 21 bp, Homo sapiens
tctcttctctattcctgaccc

SEQ ID NO: 3893153 - DNA, 12 bp, Homo sapiens
tctcttctttaa

SEQ ID NO: 3893154 - DNA, 13 bp, Homo sapiens
tctcttgctttgt

SEQ ID NO: 3893155 - DNA, 22 bp, Homo sapiens
tctgaaaaccccatttgctttc

SEQ ID NO: 3893156 - DNA, 17 bp, Homo sapiens
tctgaaagacagaatgt

SEQ ID NO: 3893157 - DNA, 19 bp, Homo sapiens
tctgaaagacagaatgtca

SEQ ID NO: 3893158 - DNA, 14 bp, Homo sapiens
tctgaaagccacgt

SEQ ID NO: 3893159 - DNA, 13 bp, Homo sapiens
tctgaacaaacac

SEQ ID NO: 3893160 - DNA, 15 bp, Homo sapiens
tctgaacaaacactg

SEQ ID NO: 3893161 - DNA, 22 bp, Homo sapiens
tctgaacacagtttagtgcttt

SEQ ID NO: 3893162 - DNA, 21 bp, Homo sapiens
tctgaacccttgtgcttggtg

SEQ ID NO: 3893163 - DNA, 16 bp, Homo sapiens
tctgaagctattgatg

SEQ ID NO: 3893164 - DNA, 18 bp, Homo sapiens
tctgaaggaatagccaga

SEQ ID NO: 3893165 - DNA, 21 bp, Homo sapiens
tctgaaggaatagccagagag

SEQ ID NO: 3893166 - DNA, 19 bp, Homo sapiens
tctgaaggagattttcctt

SEQ ID NO: 3893167 - DNA, 23 bp, Homo sapiens
tctgaaggcgtcaacgtgcattt

SEQ ID NO: 3893168 - DNA, 16 bp, Homo sapiens
tctgaagtcactgcac

SEQ ID NO: 3893169 - DNA, 22 bp, Homo sapiens
tctgaatctgataggaaaagaa

SEQ ID NO: 3893170 - DNA, 16 bp, Homo sapiens
tctgacaagggctgac

SEQ ID NO: 3893171 - DNA, 18 bp, Homo sapiens
tctgacagttactcttca

SEQ ID NO: 3893172 - DNA, 14 bp, Homo sapiens
tctgaccatttcag

SEQ ID NO: 3893173 - DNA, 22 bp, Homo sapiens
tctgacccaagaggtggggacc

SEQ ID NO: 3893174 - DNA, 12 bp, Homo sapiens
tctgacctcccc

SEQ ID NO: 3893175 - DNA, 14 bp, Homo sapiens
tctgactcacaaga

SEQ ID NO: 3893176 - DNA, 15 bp, Homo sapiens
tctgagaaagactat

SEQ ID NO: 3893177 - DNA, 12 bp, Homo sapiens
tctgctctagcc

SEQ ID NO: 3893178 - DNA, 14 bp, Homo sapiens
tctgctctagccag

SEQ ID NO: 3893179 - DNA, 18 bp, Homo sapiens
tctgctctagccaggagt

SEQ ID NO: 3893180 - DNA, 20 bp, Homo sapiens
tctgctctgaggcttccaga

SEQ ID NO: 3893181 - DNA, 13 bp, Homo sapiens
tctgctctgatgc

SEQ ID NO: 3893182 - DNA, 14 bp, Homo sapiens
tctgctctgatgca

SEQ ID NO: 3893183 - DNA, 18 bp, Homo sapiens
tctgctcttccaaagctc

SEQ ID NO: 3893184 - DNA, 13 bp, Homo sapiens
tctgctgaaggaa

SEQ ID NO: 3893185 - DNA, 11 bp, Homo sapiens
tctgctgacct

SEQ ID NO: 3893186 - DNA, 15 bp, Homo sapiens
tctgctggcctggat

SEQ ID NO: 3893187 - DNA, 16 bp, Homo sapiens
tctgctggcctggatc

SEQ ID NO: 3893188 - DNA, 17 bp, Homo sapiens
tctgcttacccttcacc

SEQ ID NO: 3893189 - DNA, 19 bp, Homo sapiens
tctgcttctccctggctga

SEQ ID NO: 3893190 - DNA, 16 bp, Homo sapiens
tctgcttcttcatctt

SEQ ID NO: 3893191 - DNA, 18 bp, Homo sapiens
tctggaaaaaaaatatat

SEQ ID NO: 3893192 - DNA, 19 bp, Homo sapiens
tcccaggaggggcctctga

SEQ ID NO: 3893193 - DNA, 22 bp, Homo sapiens
tcccaggagtggaggaggcctg

SEQ ID NO: 3893194 - DNA, 21 bp, Homo sapiens
tcccaggccccatgacctcca

SEQ ID NO: 3893195 - DNA, 22 bp, Homo sapiens
tcccaggccccatgacctccag

SEQ ID NO: 3893196 - DNA, 16 bp, Homo sapiens
tcccaggcgccccttc

SEQ ID NO: 3893197 - DNA, 21 bp, Homo sapiens
tcccaggcgccccttccccct

SEQ ID NO: 3893198 - DNA, 18 bp, Homo sapiens
tcccaggcttcaccctga

SEQ ID NO: 3893199 - DNA, 22 bp, Homo sapiens
tcccaggcttcaccctgaatgg

SEQ ID NO: 3893200 - DNA, 21 bp, Homo sapiens
tcccaggtggattttgtggag

SEQ ID NO: 3893201 - DNA, 20 bp, Homo sapiens
tcccagttctacaagcatat

SEQ ID NO: 3893202 - DNA, 12 bp, Homo sapiens
tcccataagcta

SEQ ID NO: 3893203 - DNA, 22 bp, Homo sapiens
tcccataagctaagccttatgt

SEQ ID NO: 3893204 - DNA, 17 bp, Homo sapiens
tcccatagcgctggctc

SEQ ID NO: 3893205 - DNA, 21 bp, Homo sapiens
tcccatattggcatggatttc

SEQ ID NO: 3893206 - DNA, 18 bp, Homo sapiens
tcccatccatcagctccc

SEQ ID NO: 3893207 - DNA, 13 bp, Homo sapiens
tcccatcccctgg

SEQ ID NO: 3893208 - DNA, 20 bp, Homo sapiens
tcccatctaagctgcagctt

SEQ ID NO: 3893209 - DNA, 22 bp, Homo sapiens
tcccatctaagctgcagcttcc

SEQ ID NO: 3893210 - DNA, 18 bp, Homo sapiens
tcccatctcctgatttct

SEQ ID NO: 3893211 - DNA, 14 bp, Homo sapiens
tcccatgatccaga

SEQ ID NO: 3893212 - DNA, 15 bp, Homo sapiens
tcccatgatccagaa

SEQ ID NO: 3893213 - DNA, 16 bp, Homo sapiens
tcccatgatccagaac

SEQ ID NO: 3893214 - DNA, 12 bp, Homo sapiens
tcccatgctgaa

SEQ ID NO: 3893215 - DNA, 19 bp, Homo sapiens
tcccatgctgaattatttt

SEQ ID NO: 3893216 - DNA, 22 bp, Homo sapiens
tcccatgtatttatctctattt

SEQ ID NO: 3893217 - DNA, 18 bp, Homo sapiens
tcccatgtcacctcagct

SEQ ID NO: 3893218 - DNA, 20 bp, Homo sapiens
tcccatgtcacctcagctga

SEQ ID NO: 3893219 - DNA, 16 bp, Homo sapiens
tcccatgtgtgactcc

SEQ ID NO: 3893220 - DNA, 22 bp, Homo sapiens
tcccatgtgtgactccagcctg

SEQ ID NO: 3893221 - DNA, 17 bp, Homo sapiens
tcccatgttgcatgcct

SEQ ID NO: 3893222 - DNA, 15 bp, Homo sapiens
tcccattgccctggt

SEQ ID NO: 3893223 - DNA, 20 bp, Homo sapiens
tcccattttggaagttttca

SEQ ID NO: 3893224 - DNA, 21 bp, Homo sapiens
tccccaaactgtgccctgcct

SEQ ID NO: 3893225 - DNA, 21 bp, Homo sapiens
tccccaatcccggtcatgctt

SEQ ID NO: 3893226 - DNA, 18 bp, Homo sapiens
tccccacagtcctcacag

SEQ ID NO: 3893227 - DNA, 21 bp, Homo sapiens
tccccacagtcctcacagcct

SEQ ID NO: 3893228 - DNA, 15 bp, Homo sapiens
tccccacccccgctg

SEQ ID NO: 3893229 - DNA, 23 bp, Homo sapiens
tccccacccccgctgggggtggg

SEQ ID NO: 3893230 - DNA, 13 bp, Homo sapiens
tccccacctggga

SEQ ID NO: 3893231 - DNA, 14 bp, Homo sapiens
tccccacctgggac

SEQ ID NO: 3893232 - DNA, 21 bp, Homo sapiens
tccccacgagtcacctgcaag

SEQ ID NO: 3893233 - DNA, 20 bp, Homo sapiens
tccccactctgctctgatgc

SEQ ID NO: 3893234 - DNA, 12 bp, Homo sapiens
tccccagccctt

SEQ ID NO: 3893235 - DNA, 13 bp, Homo sapiens
tccccagcccttc

SEQ ID NO: 3893236 - DNA, 16 bp, Homo sapiens
tccccagcccttctgc

SEQ ID NO: 3893237 - DNA, 15 bp, Homo sapiens
tccccagccctttgc

SEQ ID NO: 3893238 - DNA, 23 bp, Homo sapiens
tccccagcgattccctctcccag

SEQ ID NO: 3893239 - DNA, 15 bp, Homo sapiens
tccccagctggtcca

SEQ ID NO: 3893240 - DNA, 12 bp, Homo sapiens
tccccaggccag

SEQ ID NO: 3893241 - DNA, 16 bp, Homo sapiens
tccccaggccaggcca

SEQ ID NO: 3893242 - DNA, 23 bp, Homo sapiens
tccccaggccaggccaccaggat

SEQ ID NO: 3893243 - DNA, 15 bp, Homo sapiens
tccccaggcctccag

SEQ ID NO: 3893244 - DNA, 19 bp, Homo sapiens
tccccaggcctccagcctc

SEQ ID NO: 3893245 - DNA, 20 bp, Homo sapiens
tccccaggcctccagcctct

SEQ ID NO: 3893246 - DNA, 21 bp, Homo sapiens
tccccaggcctccagcctctc

SEQ ID NO: 3893247 - DNA, 11 bp, Homo sapiens
tccccagggcc

SEQ ID NO: 3893248 - DNA, 15 bp, Homo sapiens
tccccagggcccctc

SEQ ID NO: 3893249 - DNA, 16 bp, Homo sapiens
tccccagggcccctcc

SEQ ID NO: 3893250 - DNA, 21 bp, Homo sapiens
tccccagggcccctccctctg

SEQ ID NO: 3893251 - DNA, 18 bp, Homo sapiens
tccccaggggaaaatgaa

SEQ ID NO: 3893252 - DNA, 19 bp, Homo sapiens
tccccaggtggctgaccca

SEQ ID NO: 3893253 - DNA, 22 bp, Homo sapiens
tccccagtctacgttctccagc

SEQ ID NO: 3893254 - DNA, 14 bp, Homo sapiens
tccccattcttcct

SEQ ID NO: 3893255 - DNA, 21 bp, Homo sapiens
tcccccaccccctccccaggg

SEQ ID NO: 3893256 - DNA, 22 bp, Homo sapiens
tcccccactcctcttatttgct

SEQ ID NO: 3893257 - DNA, 20 bp, Homo sapiens
tccctgggcccctccacgcc

SEQ ID NO: 3893258 - DNA, 15 bp, Homo sapiens
tccctgggcctgctg

SEQ ID NO: 3893259 - DNA, 19 bp, Homo sapiens
tccctgggggaagccctgg

SEQ ID NO: 3893260 - DNA, 21 bp, Homo sapiens
tccctgggggaagccctggat

SEQ ID NO: 3893261 - DNA, 13 bp, Homo sapiens
tccctggtccctt

SEQ ID NO: 3893262 - DNA, 13 bp, Homo sapiens
tccctggtgcaga

SEQ ID NO: 3893263 - DNA, 16 bp, Homo sapiens
tccctgtagctctgcc

SEQ ID NO: 3893264 - DNA, 18 bp, Homo sapiens
tccctgtagctctgcctc

SEQ ID NO: 3893265 - DNA, 14 bp, Homo sapiens
tccctgtcagaggc

SEQ ID NO: 3893266 - DNA, 20 bp, Homo sapiens
tccctgtgctgacggaagcc

SEQ ID NO: 3893267 - DNA, 21 bp, Homo sapiens
tccctgtgggggtggccatcc

SEQ ID NO: 3893268 - DNA, 15 bp, Homo sapiens
tccctgtttaatatt

SEQ ID NO: 3893269 - DNA, 18 bp, Homo sapiens
tccctgtttaatatttaa

SEQ ID NO: 3893270 - DNA, 12 bp, Homo sapiens
tcccttccagtt

SEQ ID NO: 3893271 - DNA, 15 bp, Homo sapiens
tcccttcctccccag

SEQ ID NO: 3893272 - DNA, 13 bp, Homo sapiens
tcccttcctggcc

SEQ ID NO: 3893273 - DNA, 20 bp, Homo sapiens
tcccttctctccttccctct

SEQ ID NO: 3893274 - DNA, 23 bp, Homo sapiens
tcccttgaactgttctggcctca

SEQ ID NO: 3893275 - DNA, 20 bp, Homo sapiens
tcccttgctcagtgcctcct

SEQ ID NO: 3893276 - DNA, 20 bp, Homo sapiens
tcccttggaaagttcagcca

SEQ ID NO: 3893277 - DNA, 13 bp, Homo sapiens
tagttttctttgt

SEQ ID NO: 3893278 - DNA, 18 bp, Homo sapiens
tagttttctttgtaaagg

SEQ ID NO: 3893279 - DNA, 18 bp, Homo sapiens
tagttttttttgtaaact

SEQ ID NO: 3893280 - DNA, 21 bp, Homo sapiens
tataaaaagaaaagataaaga

SEQ ID NO: 3893281 - DNA, 19 bp, Homo sapiens
tataaaatagttgtccata

SEQ ID NO: 3893282 - DNA, 17 bp, Homo sapiens
tataaaatctagatcaa

SEQ ID NO: 3893283 - DNA, 19 bp, Homo sapiens
tataaaatctagatcaatt

SEQ ID NO: 3893284 - DNA, 15 bp, Homo sapiens
tataaaattagaaag

SEQ ID NO: 3893285 - DNA, 16 bp, Homo sapiens
tataaactagatctcc

SEQ ID NO: 3893286 - DNA, 20 bp, Homo sapiens
tataaactgaaaaatgtcag

SEQ ID NO: 3893287 - DNA, 13 bp, Homo sapiens
tataaactttaga

SEQ ID NO: 3893288 - DNA, 16 bp, Homo sapiens
tataaaggttgacaat

SEQ ID NO: 3893289 - DNA, 12 bp, Homo sapiens
tataaataaatg

SEQ ID NO: 3893290 - DNA, 15 bp, Homo sapiens
tataaataaatgcca

SEQ ID NO: 3893291 - DNA, 16 bp, Homo sapiens
tataaataaatgccaa

SEQ ID NO: 3893292 - DNA, 14 bp, Homo sapiens
tataaatatatatt

SEQ ID NO: 3893293 - DNA, 20 bp, Homo sapiens
tataaatatatatttttcaa

SEQ ID NO: 3893294 - DNA, 23 bp, Homo sapiens
tataaatatatatttttcaacca

SEQ ID NO: 3893295 - DNA, 17 bp, Homo sapiens
tataaatatgaaatgat

SEQ ID NO: 3893296 - DNA, 13 bp, Homo sapiens
tataaatgcatga

SEQ ID NO: 3893297 - DNA, 15 bp, Homo sapiens
tataaatgcatgatt

SEQ ID NO: 3893298 - DNA, 16 bp, Homo sapiens
tataaatgcatgattt

SEQ ID NO: 3893299 - DNA, 22 bp, Homo sapiens
tataaatgcatgattttataca

SEQ ID NO: 3893300 - DNA, 15 bp, Homo sapiens
tataaattaagactt

SEQ ID NO: 3893301 - DNA, 19 bp, Homo sapiens
tataacaaggttcttctaa

SEQ ID NO: 3893302 - DNA, 13 bp, Homo sapiens
tataaccattaca

SEQ ID NO: 3893303 - DNA, 17 bp, Homo sapiens
tataaccattacatgtt

SEQ ID NO: 3893304 - DNA, 13 bp, Homo sapiens
tataaccccacct

SEQ ID NO: 3893305 - DNA, 16 bp, Homo sapiens
tataactgaaggagaa

SEQ ID NO: 3893306 - DNA, 15 bp, Homo sapiens
tataacttcttaaaa

SEQ ID NO: 3893307 - DNA, 16 bp, Homo sapiens
tataactttagaaata

SEQ ID NO: 3893308 - DNA, 16 bp, Homo sapiens
tataagtagcaggcca

SEQ ID NO: 3893309 - DNA, 23 bp, Homo sapiens
tataagtgcacacagaaatatat

SEQ ID NO: 3893310 - DNA, 15 bp, Homo sapiens
tataatactaaagtg

SEQ ID NO: 3893311 - DNA, 14 bp, Homo sapiens
tataatctatttac

SEQ ID NO: 3893312 - DNA, 18 bp, Homo sapiens
tataatctatttacataa

SEQ ID NO: 3893313 - DNA, 20 bp, Homo sapiens
tataatcttccatacttctt

SEQ ID NO: 3893314 - DNA, 20 bp, Homo sapiens
tataatggaaacatttacaa

SEQ ID NO: 3893315 - DNA, 17 bp, Homo sapiens
tataatggaagagaaat

SEQ ID NO: 3893316 - DNA, 14 bp, Homo sapiens
tataatgtgtgtat

SEQ ID NO: 3893317 - DNA, 15 bp, Homo sapiens
tataatgtgtgtatg

SEQ ID NO: 3893318 - DNA, 17 bp, Homo sapiens
tataatgtgtgtatgtg

SEQ ID NO: 3893319 - DNA, 20 bp, Homo sapiens
tataatgtgtgtatgtgtat

SEQ ID NO: 3893320 - DNA, 20 bp, Homo sapiens
tataattaagtaaattacat

SEQ ID NO: 3893321 - DNA, 15 bp, Homo sapiens
tatacaaaataattt

SEQ ID NO: 3893322 - DNA, 18 bp, Homo sapiens
tatacaaaataatttaac

SEQ ID NO: 3893323 - DNA, 20 bp, Homo sapiens
tatacaaaataatttaacta

SEQ ID NO: 3893324 - DNA, 17 bp, Homo sapiens
tatacaaataaacttgt

SEQ ID NO: 3893325 - DNA, 15 bp, Homo sapiens
tatacaataacataa

SEQ ID NO: 3893326 - DNA, 19 bp, Homo sapiens
tatacaatatataaaaata

SEQ ID NO: 3893327 - DNA, 14 bp, Homo sapiens
tatacacaacattt

SEQ ID NO: 3893328 - DNA, 20 bp, Homo sapiens
tatacacaacatttatttca

SEQ ID NO: 3893329 - DNA, 16 bp, Homo sapiens
tatacacacatataca

SEQ ID NO: 3893330 - DNA, 20 bp, Homo sapiens
tatacacacatatacatata

SEQ ID NO: 3893331 - DNA, 20 bp, Homo sapiens
tatacacatacatacacata

SEQ ID NO: 3893332 - DNA, 21 bp, Homo sapiens
tatacacatacatacacatac

SEQ ID NO: 3893333 - DNA, 22 bp, Homo sapiens
tatacaccattgttccttacct

SEQ ID NO: 3893334 - DNA, 13 bp, Homo sapiens
tatacatatatat

SEQ ID NO: 3893335 - DNA, 19 bp, Homo sapiens
tatacatatcagaaaagta

SEQ ID NO: 3893336 - DNA, 23 bp, Homo sapiens
tatacatatcagaaaagtagaat

SEQ ID NO: 3893337 - DNA, 19 bp, Homo sapiens
tatacatatgtagactata

SEQ ID NO: 3893338 - DNA, 16 bp, Homo sapiens
tatacatattataaat

SEQ ID NO: 3893339 - DNA, 15 bp, Homo sapiens
tatacatgtgtgtat

SEQ ID NO: 3893340 - DNA, 22 bp, Homo sapiens
tatacatgtgtgtatatatgtg

SEQ ID NO: 3893341 - DNA, 23 bp, Homo sapiens
tatacatttcataaggcctgccc

SEQ ID NO: 3893342 - DNA, 22 bp, Homo sapiens
tatacattttgttatagaatac

SEQ ID NO: 3893343 - DNA, 20 bp, Homo sapiens
tataccatatgtctgcttct

SEQ ID NO: 3893344 - DNA, 18 bp, Homo sapiens
tatacctataatgtgtgt

SEQ ID NO: 3893345 - DNA, 14 bp, Homo sapiens
tcaggcattttgtt

SEQ ID NO: 3893346 - DNA, 11 bp, Homo sapiens
tcaggctccat

SEQ ID NO: 3893347 - DNA, 15 bp, Homo sapiens
tcaggctcttctcct

SEQ ID NO: 3893348 - DNA, 20 bp, Homo sapiens
tcaggcttctttcaaagtgt

SEQ ID NO: 3893349 - DNA, 18 bp, Homo sapiens
tcaggcttgaaatgcatt

SEQ ID NO: 3893350 - DNA, 17 bp, Homo sapiens
tcagggaaatggagggt

SEQ ID NO: 3893351 - DNA, 19 bp, Homo sapiens
tcagggaaatggagggtgg

SEQ ID NO: 3893352 - DNA, 12 bp, Homo sapiens
tcagggaagcag

SEQ ID NO: 3893353 - DNA, 14 bp, Homo sapiens
tcagggaagcaggc

SEQ ID NO: 3893354 - DNA, 22 bp, Homo sapiens
tcagggccagaaggagggcaga

SEQ ID NO: 3893355 - DNA, 19 bp, Homo sapiens
tcagggcctgagtgcttta

SEQ ID NO: 3893356 - DNA, 23 bp, Homo sapiens
tcagggcgataaaactaaatata

SEQ ID NO: 3893357 - DNA, 12 bp, Homo sapiens
tcagggctggag

SEQ ID NO: 3893358 - DNA, 22 bp, Homo sapiens
tcagggggcctttaaagactta

SEQ ID NO: 3893359 - DNA, 20 bp, Homo sapiens
tcaggggggttgtgaggcct

SEQ ID NO: 3893360 - DNA, 15 bp, Homo sapiens
tcagggtgggaagaa

SEQ ID NO: 3893361 - DNA, 13 bp, Homo sapiens
tcagggtgggcca

SEQ ID NO: 3893362 - DNA, 21 bp, Homo sapiens
tcagggtgggccactctcccc

SEQ ID NO: 3893363 - DNA, 23 bp, Homo sapiens
tcaggtaggcccttgtcctgcca

SEQ ID NO: 3893364 - DNA, 14 bp, Homo sapiens
tcaggtagtactgg

SEQ ID NO: 3893365 - DNA, 17 bp, Homo sapiens
tcaggtgaaaatgttca

SEQ ID NO: 3893366 - DNA, 18 bp, Homo sapiens
tcaggtgaaaatgttcat

SEQ ID NO: 3893367 - DNA, 13 bp, Homo sapiens
tcaggtgccactc

SEQ ID NO: 3893368 - DNA, 20 bp, Homo sapiens
tcaggtgccactccctgagc

SEQ ID NO: 3893369 - DNA, 15 bp, Homo sapiens
tcaggttgttctgta

SEQ ID NO: 3893370 - DNA, 14 bp, Homo sapiens
tcaggttttgtaaa

SEQ ID NO: 3893371 - DNA, 19 bp, Homo sapiens
tcagtatagcattgaacat

SEQ ID NO: 3893372 - DNA, 21 bp, Homo sapiens
tcagtattaatactaaaatat

SEQ ID NO: 3893373 - DNA, 22 bp, Homo sapiens
tcagtattttggagaaattatt

SEQ ID NO: 3893374 - DNA, 23 bp, Homo sapiens
tcagtcagttcccggagcacagc

SEQ ID NO: 3893375 - DNA, 14 bp, Homo sapiens
tcagtccagatgcc

SEQ ID NO: 3893376 - DNA, 20 bp, Homo sapiens
tcagtccagatgccttcctg

SEQ ID NO: 3893377 - DNA, 21 bp, Homo sapiens
tcagtccagatgccttcctgt

SEQ ID NO: 3893378 - DNA, 18 bp, Homo sapiens
tcagtccccgtgaaggag

SEQ ID NO: 3893379 - DNA, 12 bp, Homo sapiens
tcagtctctctc

SEQ ID NO: 3893380 - DNA, 14 bp, Homo sapiens
tcagtgagacacag

SEQ ID NO: 3893381 - DNA, 15 bp, Homo sapiens
tcagtgccacttgac

SEQ ID NO: 3893382 - DNA, 9 bp, Homo sapiens
tcagtgccc

SEQ ID NO: 3893383 - DNA, 14 bp, Homo sapiens
tcagtgggagaaaa

SEQ ID NO: 3893384 - DNA, 16 bp, Homo sapiens
tcagtgggagaaaaca

SEQ ID NO: 3893385 - DNA, 13 bp, Homo sapiens
tcagtgtggagag

SEQ ID NO: 3893386 - DNA, 17 bp, Homo sapiens
tcagtgtggagaggggt

SEQ ID NO: 3893387 - DNA, 23 bp, Homo sapiens
tcagtgtggagaggggtgcaccc

SEQ ID NO: 3893388 - DNA, 20 bp, Homo sapiens
tcagtgttccctttcctact

SEQ ID NO: 3893389 - DNA, 18 bp, Homo sapiens
tcagttactcagccctgg

SEQ ID NO: 3893390 - DNA, 22 bp, Homo sapiens
tcagttcaacctggtggcacca

SEQ ID NO: 3893391 - DNA, 17 bp, Homo sapiens
tcagttcctctttgcat

SEQ ID NO: 3893392 - DNA, 21 bp, Homo sapiens
tcagttcctctttgcatggaa

SEQ ID NO: 3893393 - DNA, 20 bp, Homo sapiens
tcagttcctgcccttggcct

SEQ ID NO: 3893394 - DNA, 18 bp, Homo sapiens
tcagttgataaaaggaaa

SEQ ID NO: 3893395 - DNA, 19 bp, Homo sapiens
tcagttgtacgtaatgtat

SEQ ID NO: 3893396 - DNA, 12 bp, Homo sapiens
tcagttgttttc

SEQ ID NO: 3893397 - DNA, 12 bp, Homo sapiens
tcagtttcccca

SEQ ID NO: 3893398 - DNA, 23 bp, Homo sapiens
tcagtttccccattgacttgcac

SEQ ID NO: 3893399 - DNA, 12 bp, Homo sapiens
tcataacaatgt

SEQ ID NO: 3893400 - DNA, 13 bp, Homo sapiens
tcataacaatgta

SEQ ID NO: 3893401 - DNA, 17 bp, Homo sapiens
tcataacaatgtatgtg

SEQ ID NO: 3893402 - DNA, 15 bp, Homo sapiens
tcataacatctttga

SEQ ID NO: 3893403 - DNA, 22 bp, Homo sapiens
tcataacgtaatgattatatga

SEQ ID NO: 3893404 - DNA, 21 bp, Homo sapiens
tcataacttgctgaatttcag

SEQ ID NO: 3893405 - DNA, 23 bp, Homo sapiens
tcataaggcatatacaaataaac

SEQ ID NO: 3893406 - DNA, 19 bp, Homo sapiens
tcataaggcctgccctccc

SEQ ID NO: 3893407 - DNA, 12 bp, Homo sapiens
tcataattagaa

SEQ ID NO: 3893408 - DNA, 13 bp, Homo sapiens
tcataattagaac

SEQ ID NO: 3893409 - DNA, 16 bp, Homo sapiens
tcataattagaacaat

SEQ ID NO: 3893410 - DNA, 18 bp, Homo sapiens
tcataattagaacaatag

SEQ ID NO: 3893411 - DNA, 20 bp, Homo sapiens
tcataattttcaagagaaga

SEQ ID NO: 3893412 - DNA, 23 bp, Homo sapiens
tcatacaatgacaagtatgatga

SEQ ID NO: 3893413 - DNA, 15 bp, Homo sapiens
tcataccacaataaa

SEQ ID NO: 3893414 - DNA, 18 bp, Homo sapiens
tcatacctatcatcttaa

SEQ ID NO: 3893415 - DNA, 15 bp, Homo sapiens
tcatacttggacagt

SEQ ID NO: 3893416 - DNA, 23 bp, Homo sapiens
tcatagaaatgtaacttttgtaa

SEQ ID NO: 3893417 - DNA, 19 bp, Homo sapiens
tcataggcggtcatgtgtg

SEQ ID NO: 3893418 - DNA, 22 bp, Homo sapiens
tcataggcggtcatgtgtgcat

SEQ ID NO: 3893419 - DNA, 23 bp, Homo sapiens
tcataggcggtcatgtgtgcatg

SEQ ID NO: 3893420 - DNA, 20 bp, Homo sapiens
tcataggttgccaataatac

SEQ ID NO: 3893421 - DNA, 16 bp, Homo sapiens
tcatatattcatgtaa

SEQ ID NO: 3893422 - DNA, 22 bp, Homo sapiens
tcatatattcatgtaataaatc

SEQ ID NO: 3893423 - DNA, 13 bp, Homo sapiens
tcatatatttaag

SEQ ID NO: 3893424 - DNA, 15 bp, Homo sapiens
tcatatccagctgag

SEQ ID NO: 3893425 - DNA, 20 bp, Homo sapiens
tcatatgacatgccaccctc

SEQ ID NO: 3893426 - DNA, 13 bp, Homo sapiens
tcatattgtatgt

SEQ ID NO: 3893427 - DNA, 14 bp, Homo sapiens
tcatattgtttcct

SEQ ID NO: 3893428 - DNA, 12 bp, Homo sapiens
tcatatttaaag

SEQ ID NO: 3893429 - DNA, 15 bp, Homo sapiens
tcatattttgtatat

SEQ ID NO: 3893430 - DNA, 23 bp, Homo sapiens
tcatattttgtatatatctgctt

SEQ ID NO: 3893431 - DNA, 15 bp, Homo sapiens
tcatcaattcccatt

SEQ ID NO: 3893432 - DNA, 22 bp, Homo sapiens
tcattgtatatatgtgtgttta

SEQ ID NO: 3893433 - DNA, 16 bp, Homo sapiens
tcattgtcgctcagca

SEQ ID NO: 3893434 - DNA, 16 bp, Homo sapiens
tcattgtctcagtgct

SEQ ID NO: 3893435 - DNA, 18 bp, Homo sapiens
tcattgtctcagtgctgg

SEQ ID NO: 3893436 - DNA, 23 bp, Homo sapiens
tcattgtttattaacaaattatg

SEQ ID NO: 3893437 - DNA, 22 bp, Homo sapiens
tcatttaatcctcccttcctcc

SEQ ID NO: 3893438 - DNA, 15 bp, Homo sapiens
tcatttcactttaaa

SEQ ID NO: 3893439 - DNA, 18 bp, Homo sapiens
tcatttcactttaaagtc

SEQ ID NO: 3893440 - DNA, 15 bp, Homo sapiens
tcatttctaaaagaa

SEQ ID NO: 3893441 - DNA, 22 bp, Homo sapiens
tcatttctgcatcagctgctga

SEQ ID NO: 3893442 - DNA, 14 bp, Homo sapiens
tcatttctttgagt

SEQ ID NO: 3893443 - DNA, 15 bp, Homo sapiens
tcatttgttggaatg

SEQ ID NO: 3893444 - DNA, 16 bp, Homo sapiens
tcattttaaaatctga

SEQ ID NO: 3893445 - DNA, 13 bp, Homo sapiens
tcattttaattta

SEQ ID NO: 3893446 - DNA, 14 bp, Homo sapiens
tcattttaatttat

SEQ ID NO: 3893447 - DNA, 17 bp, Homo sapiens
ttttataatgtggattt

SEQ ID NO: 3893448 - DNA, 18 bp, Homo sapiens
ttttatacacaacattta

SEQ ID NO: 3893449 - DNA, 12 bp, Homo sapiens
ttttatacatag

SEQ ID NO: 3893450 - DNA, 13 bp, Homo sapiens
ttttatacatatc

SEQ ID NO: 3893451 - DNA, 16 bp, Homo sapiens
ttttatacatatcaga

SEQ ID NO: 3893452 - DNA, 21 bp, Homo sapiens
ttttatacatatcagaaaagt

SEQ ID NO: 3893453 - DNA, 17 bp, Homo sapiens
ttttatactccatacat

SEQ ID NO: 3893454 - DNA, 15 bp, Homo sapiens
ttttatagaaaagat

SEQ ID NO: 3893455 - DNA, 16 bp, Homo sapiens
ttttatcagccatgtt

SEQ ID NO: 3893456 - DNA, 15 bp, Homo sapiens
ttttatgatatccct

SEQ ID NO: 3893457 - DNA, 21 bp, Homo sapiens
ttttatgtgctctcatcagaa

SEQ ID NO: 3893458 - DNA, 12 bp, Homo sapiens
ttttattaaagc

SEQ ID NO: 3893459 - DNA, 18 bp, Homo sapiens
ttttattctgttttcttg

SEQ ID NO: 3893460 - DNA, 20 bp, Homo sapiens
ttttattgtataaactatca

SEQ ID NO: 3893461 - DNA, 12 bp, Homo sapiens
ttttatttttga

SEQ ID NO: 3893462 - DNA, 20 bp, Homo sapiens
ttttcaaccagcattttact

SEQ ID NO: 3893463 - DNA, 14 bp, Homo sapiens
ttttcaactggctg

SEQ ID NO: 3893464 - DNA, 23 bp, Homo sapiens
ttttcacaggtgtggtgtaattt

SEQ ID NO: 3893465 - DNA, 19 bp, Homo sapiens
ttttcaccagatttgctaa

SEQ ID NO: 3893466 - DNA, 16 bp, Homo sapiens
ttttcactgtagaatg

SEQ ID NO: 3893467 - DNA, 15 bp, Homo sapiens
ttttcagaaatatgt

SEQ ID NO: 3893468 - DNA, 11 bp, Homo sapiens
ttttcagaccc

SEQ ID NO: 3893469 - DNA, 17 bp, Homo sapiens
ttttcagctctctgtat

SEQ ID NO: 3893470 - DNA, 16 bp, Homo sapiens
ttttcagtattttgga

SEQ ID NO: 3893471 - DNA, 20 bp, Homo sapiens
ttttcagtttcaattcagtg

SEQ ID NO: 3893472 - DNA, 23 bp, Homo sapiens
ttttcataacttgctgaatttca

SEQ ID NO: 3893473 - DNA, 16 bp, Homo sapiens
ttttcatcctggcctc

SEQ ID NO: 3893474 - DNA, 13 bp, Homo sapiens
ttttcatggaagt

SEQ ID NO: 3893475 - DNA, 19 bp, Homo sapiens
ttttcatggaagtggcagt

SEQ ID NO: 3893476 - DNA, 19 bp, Homo sapiens
ttttcattacaatggaaac

SEQ ID NO: 3893477 - DNA, 22 bp, Homo sapiens
ttttcattttaatttatatttg

SEQ ID NO: 3893478 - DNA, 18 bp, Homo sapiens
ttttccactcctatggaa

SEQ ID NO: 3893479 - DNA, 19 bp, Homo sapiens
ttttccaggatcctgcagg

SEQ ID NO: 3893480 - DNA, 18 bp, Homo sapiens
ttttcctcttctattttg

SEQ ID NO: 3893481 - DNA, 12 bp, Homo sapiens
ttttctaactgt

SEQ ID NO: 3893482 - DNA, 14 bp, Homo sapiens
ttttctaactgtaa

SEQ ID NO: 3893483 - DNA, 22 bp, Homo sapiens
ttttctaactgtaaatcacttg

SEQ ID NO: 3893484 - DNA, 22 bp, Homo sapiens
ttttctatagctcttctattta

SEQ ID NO: 3893485 - DNA, 17 bp, Homo sapiens
ttttctccactttgttg

SEQ ID NO: 3893486 - DNA, 14 bp, Homo sapiens
ttttctcctcccag

SEQ ID NO: 3893487 - DNA, 21 bp, Homo sapiens
ttttctggaaattttgtccat

SEQ ID NO: 3893488 - DNA, 14 bp, Homo sapiens
ttttctggaagaca

SEQ ID NO: 3893489 - DNA, 15 bp, Homo sapiens
ttttctgtctctctt

SEQ ID NO: 3893490 - DNA, 13 bp, Homo sapiens
ttttcttacataa

SEQ ID NO: 3893491 - DNA, 14 bp, Homo sapiens
ttttctttgaaatt

SEQ ID NO: 3893492 - DNA, 18 bp, Homo sapiens
ttttctttgtaaaggtca

SEQ ID NO: 3893493 - DNA, 16 bp, Homo sapiens
ttttctttgtgtagct

SEQ ID NO: 3893494 - DNA, 21 bp, Homo sapiens
ttttgaactaataaaagcata

SEQ ID NO: 3893495 - DNA, 13 bp, Homo sapiens
ttttgaatgttat

SEQ ID NO: 3893496 - DNA, 24 bp, Homo sapiens
ttttgacagtgttgaaaatgttca

SEQ ID NO: 3893497 - DNA, 16 bp, Homo sapiens
ttttgatatgagtata

SEQ ID NO: 3893498 - DNA, 14 bp, Homo sapiens
ttttgatggggaga

SEQ ID NO: 3893499 - DNA, 12 bp, Homo sapiens
ttttgatgtgaa

SEQ ID NO: 3893500 - DNA, 13 bp, Homo sapiens
ttttgatgtgaaa

SEQ ID NO: 3893501 - DNA, 20 bp, Homo sapiens
ttttgatttgtactgaaaaa

SEQ ID NO: 3893502 - DNA, 17 bp, Homo sapiens
ttttgcaatggctatat

SEQ ID NO: 3893503 - DNA, 23 bp, Homo sapiens
ttttgcacgtcttgctatttgag

SEQ ID NO: 3893504 - DNA, 15 bp, Homo sapiens
ttttgcatttagttt

SEQ ID NO: 3893505 - DNA, 22 bp, Homo sapiens
ttttgccactttggcttctcct

SEQ ID NO: 3893506 - DNA, 12 bp, Homo sapiens
ttttgcctggct

SEQ ID NO: 3893507 - DNA, 13 bp, Homo sapiens
ttttgcctggctg

SEQ ID NO: 3893508 - DNA, 14 bp, Homo sapiens
ttttgcctggctgt

SEQ ID NO: 3893509 - DNA, 15 bp, Homo sapiens
ttttgcctttaaatt

SEQ ID NO: 3893510 - DNA, 11 bp, Homo sapiens
ttttgctgctg

SEQ ID NO: 3893511 - DNA, 17 bp, Homo sapiens
ttttgctgtctttctct

SEQ ID NO: 3893512 - DNA, 18 bp, Homo sapiens
ttttgctgtttcctttta

SEQ ID NO: 3893513 - DNA, 15 bp, Homo sapiens
ttttgcttaaaattt

SEQ ID NO: 3893514 - DNA, 18 bp, Homo sapiens
ttttggctctttcagaga

SEQ ID NO: 3893515 - DNA, 23 bp, Homo sapiens
ttttggggggcccccctccttgc

SEQ ID NO: 3893516 - DNA, 19 bp, Homo sapiens
ttttgggggtttttaatct

SEQ ID NO: 3893517 - DNA, 18 bp, Homo sapiens
ttttgtaaactcaaaata

SEQ ID NO: 3893518 - DNA, 16 bp, Homo sapiens
ttttgtaacttcaaat

SEQ ID NO: 3893519 - DNA, 14 bp, Homo sapiens
ttttgtacaattac

SEQ ID NO: 3893520 - DNA, 15 bp, Homo sapiens
ttttgtacagaattt

SEQ ID NO: 3893521 - DNA, 20 bp, Homo sapiens
ttttgtacagaatttttaat

SEQ ID NO: 3893522 - DNA, 22 bp, Homo sapiens
ttttgtaggggtcaaagaaatg

SEQ ID NO: 3893523 - DNA, 16 bp, Homo sapiens
ttttgtatagtaaagt

SEQ ID NO: 3893524 - DNA, 17 bp, Homo sapiens
ttttgtatagtaaagtg

SEQ ID NO: 3893525 - DNA, 18 bp, Homo sapiens
ttttgtatagtaaagtga

SEQ ID NO: 3893526 - DNA, 13 bp, Homo sapiens
ttttgtatatatc

SEQ ID NO: 3893527 - DNA, 22 bp, Homo sapiens
ttttgtcctttgagaaagaaat

SEQ ID NO: 3893528 - DNA, 13 bp, Homo sapiens
ttttgtgtttcta

SEQ ID NO: 3893529 - DNA, 15 bp, Homo sapiens
ttttgtgtttctaaa

SEQ ID NO: 3893530 - DNA, 15 bp, Homo sapiens
ttttgttctgtattt

SEQ ID NO: 3893531 - DNA, 12 bp, Homo sapiens
ttttgtttcaga

SEQ ID NO: 3893532 - DNA, 15 bp, Homo sapiens
ttttgttttcattat

SEQ ID NO: 3893533 - DNA, 11 bp, Homo sapiens
tttttaaaagt

SEQ ID NO: 3893534 - DNA, 17 bp, Homo sapiens
ggctctgggaaggggtg

SEQ ID NO: 3893535 - DNA, 18 bp, Homo sapiens
ggctctgggaaggggtgc

SEQ ID NO: 3893536 - DNA, 22 bp, Homo sapiens
ggctctgggaaggggtgccctc

SEQ ID NO: 3893537 - DNA, 14 bp, Homo sapiens
ggctcttcctggac

SEQ ID NO: 3893538 - DNA, 19 bp, Homo sapiens
ggctcttcctggacctgag

SEQ ID NO: 3893539 - DNA, 14 bp, Homo sapiens
ggctcttctccttt

SEQ ID NO: 3893540 - DNA, 16 bp, Homo sapiens
ggctcttctcctttca

SEQ ID NO: 3893541 - DNA, 23 bp, Homo sapiens
ggctcttctcctttcacaacctt

SEQ ID NO: 3893542 - DNA, 15 bp, Homo sapiens
ggctctttcagagag

SEQ ID NO: 3893543 - DNA, 15 bp, Homo sapiens
ggctgaacggggaga

SEQ ID NO: 3893544 - DNA, 18 bp, Homo sapiens
ggctgacccagtccctgg

SEQ ID NO: 3893545 - DNA, 22 bp, Homo sapiens
ggctgacccagtccctggggga

SEQ ID NO: 3893546 - DNA, 17 bp, Homo sapiens
ggctgaggcagaagaat

SEQ ID NO: 3893547 - DNA, 12 bp, Homo sapiens
ggctgcactgca

SEQ ID NO: 3893548 - DNA, 18 bp, Homo sapiens
ggctgcagagctgaccca

SEQ ID NO: 3893549 - DNA, 15 bp, Homo sapiens
ggctgcatgctctgg

SEQ ID NO: 3893550 - DNA, 19 bp, Homo sapiens
ggctgcatgctctggaagc

SEQ ID NO: 3893551 - DNA, 20 bp, Homo sapiens
ggctgcatgctctggaagcc

SEQ ID NO: 3893552 - DNA, 12 bp, Homo sapiens
ggctgccaggcg

SEQ ID NO: 3893553 - DNA, 12 bp, Homo sapiens
ggctgccctggt

SEQ ID NO: 3893554 - DNA, 18 bp, Homo sapiens
ggctgcccttcgctgcca

SEQ ID NO: 3893555 - DNA, 19 bp, Homo sapiens
ggctgcccttcgctgccag

SEQ ID NO: 3893556 - DNA, 23 bp, Homo sapiens
ggctgcccttcgctgccaggaca

SEQ ID NO: 3893557 - DNA, 21 bp, Homo sapiens
ggctgccgggttctagtctcc

SEQ ID NO: 3893558 - DNA, 12 bp, Homo sapiens
ggctgcctgccg

SEQ ID NO: 3893559 - DNA, 13 bp, Homo sapiens
ggctgcctgccgc

SEQ ID NO: 3893560 - DNA, 18 bp, Homo sapiens
ggctgcggcctaggggtc

SEQ ID NO: 3893561 - DNA, 24 bp, Homo sapiens
ggctgctcattccttctggaggac

SEQ ID NO: 3893562 - DNA, 13 bp, Homo sapiens
ggctgctcctcca

SEQ ID NO: 3893563 - DNA, 15 bp, Homo sapiens
ggctgctcctccagg

SEQ ID NO: 3893564 - DNA, 21 bp, Homo sapiens
ggctgctcggggtgcacagga

SEQ ID NO: 3893565 - DNA, 17 bp, Homo sapiens
ggctgctctcatgcctg

SEQ ID NO: 3893566 - DNA, 16 bp, Homo sapiens
ggctgctggggcatgt

SEQ ID NO: 3893567 - DNA, 23 bp, Homo sapiens
ggctgctggggcatgtgtgcctg

SEQ ID NO: 3893568 - DNA, 14 bp, Homo sapiens
ggctggacctgcac

SEQ ID NO: 3893569 - DNA, 19 bp, Homo sapiens
ggctggaggcagggccttg

SEQ ID NO: 3893570 - DNA, 23 bp, Homo sapiens
ggctggaggcagggccttgccca

SEQ ID NO: 3893571 - DNA, 14 bp, Homo sapiens
ggctggagtgcgct

SEQ ID NO: 3893572 - DNA, 16 bp, Homo sapiens
ggctggagtgcgctct

SEQ ID NO: 3893573 - DNA, 20 bp, Homo sapiens
ggctggagtggagtggcacg

SEQ ID NO: 3893574 - DNA, 14 bp, Homo sapiens
ggctggcaagcagg

SEQ ID NO: 3893575 - DNA, 16 bp, Homo sapiens
ggctggcaagcaggga

SEQ ID NO: 3893576 - DNA, 17 bp, Homo sapiens
ggctggcaagcagggaa

SEQ ID NO: 3893577 - DNA, 14 bp, Homo sapiens
ggctggcagtgctg

SEQ ID NO: 3893578 - DNA, 13 bp, Homo sapiens
ggctggcccagcc

SEQ ID NO: 3893579 - DNA, 20 bp, Homo sapiens
ggctggcggctactcagcag

SEQ ID NO: 3893580 - DNA, 14 bp, Homo sapiens
ggctggctgagggc

SEQ ID NO: 3893581 - DNA, 18 bp, Homo sapiens
ggctgggcacctctagtg

SEQ ID NO: 3893582 - DNA, 17 bp, Homo sapiens
ggctgggccagcctcag

SEQ ID NO: 3893583 - DNA, 22 bp, Homo sapiens
ggctgggccagcctcagctcag

SEQ ID NO: 3893584 - DNA, 15 bp, Homo sapiens
ggctggggcagaggg

SEQ ID NO: 3893585 - DNA, 22 bp, Homo sapiens
ggctgggggcgggggagccaac

SEQ ID NO: 3893586 - DNA, 13 bp, Homo sapiens
ggctgtggaggcc

SEQ ID NO: 3893587 - DNA, 15 bp, Homo sapiens
ggctgtggaggcctg

SEQ ID NO: 3893588 - DNA, 16 bp, Homo sapiens
ggctgtggaggcctga

SEQ ID NO: 3893589 - DNA, 15 bp, Homo sapiens
ggcttaaggagagga

SEQ ID NO: 3893590 - DNA, 16 bp, Homo sapiens
ggcttaatgtttattc

SEQ ID NO: 3893591 - DNA, 17 bp, Homo sapiens
ggcttaggtgccaggct

SEQ ID NO: 3893592 - DNA, 13 bp, Homo sapiens
ggcttataaatgt

SEQ ID NO: 3893593 - DNA, 22 bp, Homo sapiens
ggcttataaatgtgtattctgg

SEQ ID NO: 3893594 - DNA, 22 bp, Homo sapiens
ggcttccagagagtcctctgga

SEQ ID NO: 3893595 - DNA, 12 bp, Homo sapiens
ggcttccaggta

SEQ ID NO: 3893596 - DNA, 18 bp, Homo sapiens
ggcttcccatccccagcg

SEQ ID NO: 3893597 - DNA, 16 bp, Homo sapiens
ggcttcccgctcagcc

SEQ ID NO: 3893598 - DNA, 22 bp, Homo sapiens
ggcttcccgctcagccctccct

SEQ ID NO: 3893599 - DNA, 20 bp, Homo sapiens
ggcttcctccgtccacccag

SEQ ID NO: 3893600 - DNA, 21 bp, Homo sapiens
ggcttcctccgtccacccagg

SEQ ID NO: 3893601 - DNA, 23 bp, Homo sapiens
ggcttcctccgtccacccaggct

SEQ ID NO: 3893602 - DNA, 17 bp, Homo sapiens
ggcttcctgtccactct

SEQ ID NO: 3893603 - DNA, 18 bp, Homo sapiens
ggcttcctgtccactctc

SEQ ID NO: 3893604 - DNA, 12 bp, Homo sapiens
ggcttctcctga

SEQ ID NO: 3893605 - DNA, 13 bp, Homo sapiens
ggcttctcctgac

SEQ ID NO: 3893606 - DNA, 12 bp, Homo sapiens
ggcttctgtgca

SEQ ID NO: 3893607 - DNA, 13 bp, Homo sapiens
ggcttgctccagg

SEQ ID NO: 3893608 - DNA, 16 bp, Homo sapiens
ggcttgctccagggtc

SEQ ID NO: 3893609 - DNA, 22 bp, Homo sapiens
ggcttgctccagggtcttgggc

SEQ ID NO: 3893610 - DNA, 13 bp, Homo sapiens
ggcttggccgcca

SEQ ID NO: 3893611 - DNA, 18 bp, Homo sapiens
ggcttgtaactccaccaa

SEQ ID NO: 3893612 - DNA, 18 bp, Homo sapiens
ggctttcaattgtatttt

SEQ ID NO: 3893613 - DNA, 16 bp, Homo sapiens
ggctttgcaggctctg

SEQ ID NO: 3893614 - DNA, 19 bp, Homo sapiens
ggctttgcaggctctgggc

SEQ ID NO: 3893615 - DNA, 13 bp, Homo sapiens
ggcttttaagaaa

SEQ ID NO: 3893616 - DNA, 22 bp, Homo sapiens
ggcttttcactgctggctgcct

SEQ ID NO: 3893617 - DNA, 21 bp, Homo sapiens
gggaaacctatcaatcctgcc

SEQ ID NO: 3893618 - DNA, 18 bp, Homo sapiens
gggaaaggaaaaccaggg

SEQ ID NO: 3893619 - DNA, 22 bp, Homo sapiens
gggaaaggaaaaccagggatag

SEQ ID NO: 3893620 - DNA, 19 bp, Homo sapiens
gggaaattattatgactca

SEQ ID NO: 3893621 - DNA, 20 bp, Homo sapiens
gggaacccaagtccaagcat

SEQ ID NO: 3893622 - DNA, 16 bp, Homo sapiens
gggaacccagccctgg

SEQ ID NO: 3893623 - DNA, 18 bp, Homo sapiens
gggaaccccgcagcccgt

SEQ ID NO: 3893624 - DNA, 20 bp, Homo sapiens
gggaacccgactgtgaaagt

SEQ ID NO: 3893625 - DNA, 12 bp, Homo sapiens
gggaaccctccc

SEQ ID NO: 3893626 - DNA, 18 bp, Homo sapiens
gggaacgtgactgcccca

SEQ ID NO: 3893627 - DNA, 21 bp, Homo sapiens
gggaactggccaagctgaggt

SEQ ID NO: 3893628 - DNA, 20 bp, Homo sapiens
gggaagacaggtctagactt

SEQ ID NO: 3893629 - DNA, 12 bp, Homo sapiens
gggaagagggca

SEQ ID NO: 3893630 - DNA, 17 bp, Homo sapiens
gggaagatggtagcaga

SEQ ID NO: 3893631 - DNA, 15 bp, Homo sapiens
gggaagcaggcagag

SEQ ID NO: 3893632 - DNA, 20 bp, Homo sapiens
gggaagcctccgtcaggaga

SEQ ID NO: 3893633 - DNA, 20 bp, Homo sapiens
gggaagcctcttcagggtga

SEQ ID NO: 3893634 - DNA, 14 bp, Homo sapiens
gggaagctggggga

SEQ ID NO: 3893635 - DNA, 18 bp, Homo sapiens
gggaagctgtactcagag

SEQ ID NO: 3893636 - DNA, 20 bp, Homo sapiens
gggaagcttgctggcttctg

SEQ ID NO: 3893637 - DNA, 20 bp, Homo sapiens
gggaaggaagggacacacac

SEQ ID NO: 3893638 - DNA, 22 bp, Homo sapiens
gggaaggctacttcggggctgg

SEQ ID NO: 3893639 - DNA, 13 bp, Homo sapiens
gggaagggagagc

SEQ ID NO: 3893640 - DNA, 18 bp, Homo sapiens
gggaagtgctccccacac

SEQ ID NO: 3893641 - DNA, 13 bp, Homo sapiens
gggaatccgcctg

SEQ ID NO: 3893642 - DNA, 18 bp, Homo sapiens
gggaatccgcctgcagag

SEQ ID NO: 3893643 - DNA, 16 bp, Homo sapiens
gggaatgaacctggag

SEQ ID NO: 3893644 - DNA, 15 bp, Homo sapiens
gggaatgttccctgc

SEQ ID NO: 3893645 - DNA, 16 bp, Homo sapiens
gggaatgttccctgca

SEQ ID NO: 3893646 - DNA, 23 bp, Homo sapiens
gggaatgttccctgcaccctgga

SEQ ID NO: 3893647 - DNA, 22 bp, Homo sapiens
gggaattctttacaataaacat

SEQ ID NO: 3893648 - DNA, 22 bp, Homo sapiens
gggacaaagaggcctttaacca

SEQ ID NO: 3893649 - DNA, 18 bp, Homo sapiens
gggacaaaggagcctgtg

SEQ ID NO: 3893650 - DNA, 17 bp, Homo sapiens
gggacagagacacctgc

SEQ ID NO: 3893651 - DNA, 23 bp, Homo sapiens
gggacagagaggagttgccaggg

SEQ ID NO: 3893652 - DNA, 14 bp, Homo sapiens
gggacagccccagg

SEQ ID NO: 3893653 - DNA, 16 bp, Homo sapiens
gggacagccccagggc

SEQ ID NO: 3893654 - DNA, 19 bp, Homo sapiens
gggacagccccagggccct

SEQ ID NO: 3893655 - DNA, 16 bp, Homo sapiens
gggaccattgacctca

SEQ ID NO: 3893656 - DNA, 17 bp, Homo sapiens
gggaccattgacctcag

SEQ ID NO: 3893657 - DNA, 22 bp, Homo sapiens
gggaccattgacctcagctgca

SEQ ID NO: 3893658 - DNA, 21 bp, Homo sapiens
gggaccccagctagggctgga

SEQ ID NO: 3893659 - DNA, 22 bp, Homo sapiens
gggacccctcccaacctcaatg

SEQ ID NO: 3893660 - DNA, 16 bp, Homo sapiens
gggaccctttccttcc

SEQ ID NO: 3893661 - DNA, 22 bp, Homo sapiens
gggaccgctacaccactctggc

SEQ ID NO: 3893662 - DNA, 17 bp, Homo sapiens
gggacgcttccagacca

SEQ ID NO: 3893663 - DNA, 18 bp, Homo sapiens
gggacgcttccagaccac

SEQ ID NO: 3893664 - DNA, 18 bp, Homo sapiens
gggactcagcgtcccctg

SEQ ID NO: 3893665 - DNA, 23 bp, Homo sapiens
gggactgccagtccccctgcccc

SEQ ID NO: 3893666 - DNA, 15 bp, Homo sapiens
gggactgtgcctttg

SEQ ID NO: 3893667 - DNA, 13 bp, Homo sapiens
gggagaagggcca

SEQ ID NO: 3893668 - DNA, 18 bp, Homo sapiens
gggagaagggccagccct

SEQ ID NO: 3893669 - DNA, 22 bp, Homo sapiens
gggagacagggcaatcttgtcc

SEQ ID NO: 3893670 - DNA, 20 bp, Homo sapiens
gggagagacactcccaggga

SEQ ID NO: 3893671 - DNA, 13 bp, Homo sapiens
gggagaggggaga

SEQ ID NO: 3893672 - DNA, 21 bp, Homo sapiens
gggagagttgaccgttttcat

SEQ ID NO: 3893673 - DNA, 13 bp, Homo sapiens
gggagatactctc

SEQ ID NO: 3893674 - DNA, 16 bp, Homo sapiens
gggagatactctccct

SEQ ID NO: 3893675 - DNA, 14 bp, Homo sapiens
gggagcactggagt

SEQ ID NO: 3893676 - DNA, 20 bp, Homo sapiens
gggagcacttgcgtcctgca

SEQ ID NO: 3893677 - DNA, 20 bp, Homo sapiens
gggagcccctaggaaagcag

SEQ ID NO: 3893678 - DNA, 13 bp, Homo sapiens
gggagcctccccc

SEQ ID NO: 3893679 - DNA, 21 bp, Homo sapiens
gggagcctcgcaacccgtgcc

SEQ ID NO: 3893680 - DNA, 15 bp, Homo sapiens
gggaggaagggccag

SEQ ID NO: 3893681 - DNA, 20 bp, Homo sapiens
gggaggaagggccaggagag

SEQ ID NO: 3893682 - DNA, 21 bp, Homo sapiens
gggaggagaggggaagggcca

SEQ ID NO: 3893683 - DNA, 15 bp, Homo sapiens
gggaggaggcagaga

SEQ ID NO: 3893684 - DNA, 22 bp, Homo sapiens
gggaggatgccacagccccaca

SEQ ID NO: 3893685 - DNA, 16 bp, Homo sapiens
gggaggcaccagctct

SEQ ID NO: 3893686 - DNA, 23 bp, Homo sapiens
gggaggcaccagctctgtggcct

SEQ ID NO: 3893687 - DNA, 16 bp, Homo sapiens
gggaggcatggccctg

SEQ ID NO: 3893688 - DNA, 14 bp, Homo sapiens
gggaggccaaggca

SEQ ID NO: 3893689 - DNA, 16 bp, Homo sapiens
gggaggccaaggcagg

SEQ ID NO: 3893690 - DNA, 20 bp, Homo sapiens
gggaggcggagagtacagtg

SEQ ID NO: 3893691 - DNA, 13 bp, Homo sapiens
gggaggctttcaa

SEQ ID NO: 3893692 - DNA, 15 bp, Homo sapiens
gggagggctctgagg

SEQ ID NO: 3893693 - DNA, 13 bp, Homo sapiens
gggagggggctcc

SEQ ID NO: 3893694 - DNA, 13 bp, Homo sapiens
gggaggggtcctg

SEQ ID NO: 3893695 - DNA, 16 bp, Homo sapiens
gggaggtcgaggtagg

SEQ ID NO: 3893696 - DNA, 19 bp, Homo sapiens
gggaggtgcctgagctggg

SEQ ID NO: 3893697 - DNA, 19 bp, Homo sapiens
gggagtgagacagaagtaa

SEQ ID NO: 3893698 - DNA, 18 bp, Homo sapiens
gggagttgctcactcagg

SEQ ID NO: 3893699 - DNA, 17 bp, Homo sapiens
gggataacagaggcagg

SEQ ID NO: 3893700 - DNA, 23 bp, Homo sapiens
gggatgactagaggcagggaggg

SEQ ID NO: 3893701 - DNA, 20 bp, Homo sapiens
gggatgagctcaagcaggaa

SEQ ID NO: 3893702 - DNA, 18 bp, Homo sapiens
gggatttcttcgctgctc

SEQ ID NO: 3893703 - DNA, 18 bp, Homo sapiens
gggcaaacccttctcttc

SEQ ID NO: 3893704 - DNA, 19 bp, Homo sapiens
gggcaagtcgagagggctg

SEQ ID NO: 3893705 - DNA, 22 bp, Homo sapiens
gggcaatcttgtccacagtctc

SEQ ID NO: 3893706 - DNA, 19 bp, Homo sapiens
gggcacaccactgccctgc

SEQ ID NO: 3893707 - DNA, 21 bp, Homo sapiens
gggcacaccactgccctgcct

SEQ ID NO: 3893708 - DNA, 23 bp, Homo sapiens
gggcacaccactgccctgcctgc

SEQ ID NO: 3893709 - DNA, 15 bp, Homo sapiens
gggcacaggagctac

SEQ ID NO: 3893710 - DNA, 15 bp, Homo sapiens
gggcacatgaggagg

SEQ ID NO: 3893711 - DNA, 17 bp, Homo sapiens
gggcacatgaggagggt

SEQ ID NO: 3893712 - DNA, 18 bp, Homo sapiens
gggcacatgaggagggtg

SEQ ID NO: 3893713 - DNA, 16 bp, Homo sapiens
gggcacccccagcctg

SEQ ID NO: 3893714 - DNA, 18 bp, Homo sapiens
gggcacccccagcctggg

SEQ ID NO: 3893715 - DNA, 21 bp, Homo sapiens
gggcacccccagcctgggcct

SEQ ID NO: 3893716 - DNA, 15 bp, Homo sapiens
gggcagaaagtggcc

SEQ ID NO: 3893717 - DNA, 20 bp, Homo sapiens
gggcagagccatgggcctgg

SEQ ID NO: 3893718 - DNA, 16 bp, Homo sapiens
gggcagaggctggagg

SEQ ID NO: 3893719 - DNA, 21 bp, Homo sapiens
gggcagaggctggaggcaggg

SEQ ID NO: 3893720 - DNA, 14 bp, Homo sapiens
gggcagagggaatg

SEQ ID NO: 3893721 - DNA, 22 bp, Homo sapiens
gggcagagggaatgttccctgc

SEQ ID NO: 3893722 - DNA, 23 bp, Homo sapiens
gggcagagggaatgttccctgca

SEQ ID NO: 3893723 - DNA, 15 bp, Homo sapiens
gggcagaggggcagc

SEQ ID NO: 3893724 - DNA, 18 bp, Homo sapiens
gggcagaggggcagccgc

SEQ ID NO: 3893725 - DNA, 14 bp, Homo sapiens
gggcagcaccctcc

SEQ ID NO: 3893726 - DNA, 15 bp, Homo sapiens
gggcagcaccctccc

SEQ ID NO: 3893727 - DNA, 18 bp, Homo sapiens
gggcagcaccctcccccg

SEQ ID NO: 3893728 - DNA, 13 bp, Homo sapiens
gggcagcagccag

SEQ ID NO: 3893729 - DNA, 14 bp, Homo sapiens
gggcagcagccagc

SEQ ID NO: 3893730 - DNA, 18 bp, Homo sapiens
gggcagcagccagccctg

SEQ ID NO: 3893731 - DNA, 23 bp, Homo sapiens
gggcagcagccagccctgcctgg

SEQ ID NO: 3893732 - DNA, 16 bp, Homo sapiens
gggcagccaggggctg

SEQ ID NO: 3893733 - DNA, 18 bp, Homo sapiens
gggcaggaggcctggcct

SEQ ID NO: 3893734 - DNA, 12 bp, Homo sapiens
gggcaggcctgg

SEQ ID NO: 3893735 - DNA, 17 bp, Homo sapiens
gggcaggtcctgcccat

SEQ ID NO: 3893736 - DNA, 21 bp, Homo sapiens
gggcagtgacaagtggagggg

SEQ ID NO: 3893737 - DNA, 12 bp, Homo sapiens
gggcagtgactg

SEQ ID NO: 3893738 - DNA, 15 bp, Homo sapiens
gggcagtgcctcctg

SEQ ID NO: 3893739 - DNA, 18 bp, Homo sapiens
gggcagtgcctcctggga

SEQ ID NO: 3893740 - DNA, 21 bp, Homo sapiens
gggcagtggtaagctctggct

SEQ ID NO: 3893741 - DNA, 19 bp, Homo sapiens
gggcagttcgcagccaccc

SEQ ID NO: 3893742 - DNA, 21 bp, Homo sapiens
gggcagttcgcagccaccctg

SEQ ID NO: 3893743 - DNA, 18 bp, Homo sapiens
gggcatagaaactgagga

SEQ ID NO: 3893744 - DNA, 19 bp, Homo sapiens
gggcatagaaactgaggag

SEQ ID NO: 3893745 - DNA, 21 bp, Homo sapiens
gggcatccacccagtgctgcc

SEQ ID NO: 3893746 - DNA, 22 bp, Homo sapiens
gggcatccacccagtgctgcca

SEQ ID NO: 3893747 - DNA, 15 bp, Homo sapiens
gggcatggccaggtg

SEQ ID NO: 3893748 - DNA, 20 bp, Homo sapiens
gggcatgggagggagggaga

SEQ ID NO: 3893749 - DNA, 21 bp, Homo sapiens
gggcatgtgtgcctgtggcag

SEQ ID NO: 3893750 - DNA, 23 bp, Homo sapiens
gggcatgtgtgcctgtggcagaa

SEQ ID NO: 3893751 - DNA, 23 bp, Homo sapiens
gggcattgggctgacacctacca

SEQ ID NO: 3893752 - DNA, 18 bp, Homo sapiens
gggccaaaagggcagcca

SEQ ID NO: 3893753 - DNA, 18 bp, Homo sapiens
gggccaattaaaatatat

SEQ ID NO: 3893754 - DNA, 21 bp, Homo sapiens
gggccaattaaaatatatata

SEQ ID NO: 3893755 - DNA, 18 bp, Homo sapiens
gggccacgtgccaggccc

SEQ ID NO: 3893756 - DNA, 19 bp, Homo sapiens
gggccactccttcctgccc

SEQ ID NO: 3893757 - DNA, 18 bp, Homo sapiens
gggccagaaggagggcag

SEQ ID NO: 3893758 - DNA, 19 bp, Homo sapiens
gggccagaaggagggcaga

SEQ ID NO: 3893759 - DNA, 19 bp, Homo sapiens
gggccagccctacatcttc

SEQ ID NO: 3893760 - DNA, 18 bp, Homo sapiens
gggccagctggtgctgca

SEQ ID NO: 3893761 - DNA, 13 bp, Homo sapiens
gggccaggagaga

SEQ ID NO: 3893762 - DNA, 16 bp, Homo sapiens
gggccaggagagagat

SEQ ID NO: 3893763 - DNA, 12 bp, Homo sapiens
gggccaggcagg

SEQ ID NO: 3893764 - DNA, 22 bp, Homo sapiens
gggccagtgagggctgggccca

SEQ ID NO: 3893765 - DNA, 15 bp, Homo sapiens
gggccatgctgaagg

SEQ ID NO: 3893766 - DNA, 20 bp, Homo sapiens
gggcccacagacagatccca

SEQ ID NO: 3893767 - DNA, 12 bp, Homo sapiens
gggcccaggctc

SEQ ID NO: 3893768 - DNA, 14 bp, Homo sapiens
gggcccaggctctg

SEQ ID NO: 3893769 - DNA, 18 bp, Homo sapiens
gggccccatgctctgccc

SEQ ID NO: 3893770 - DNA, 19 bp, Homo sapiens
gggccccatgctctgcccc

SEQ ID NO: 3893771 - DNA, 14 bp, Homo sapiens
gggccccccacacg

SEQ ID NO: 3893772 - DNA, 14 bp, Homo sapiens
gggccccggggctg

SEQ ID NO: 3893773 - DNA, 12 bp, Homo sapiens
gggcccctccac

SEQ ID NO: 3893774 - DNA, 14 bp, Homo sapiens
gggcccctccacgc

SEQ ID NO: 3893775 - DNA, 17 bp, Homo sapiens
gggcccctccacgcctc

SEQ ID NO: 3893776 - DNA, 20 bp, Homo sapiens
gggcccctccctctgcccca

SEQ ID NO: 3893777 - DNA, 15 bp, Homo sapiens
gggcccgaaagctga

SEQ ID NO: 3893778 - DNA, 19 bp, Homo sapiens
gggccctgcacctgtgcag

SEQ ID NO: 3893779 - DNA, 12 bp, Homo sapiens
gggccctgggcc

SEQ ID NO: 3893780 - DNA, 14 bp, Homo sapiens
gggccctgggcctc

SEQ ID NO: 3893781 - DNA, 14 bp, Homo sapiens
gggccctggggcct

SEQ ID NO: 3893782 - DNA, 17 bp, Homo sapiens
gggccctggggcctgta

SEQ ID NO: 3893783 - DNA, 17 bp, Homo sapiens
gggcccttggggcctgg

SEQ ID NO: 3893784 - DNA, 18 bp, Homo sapiens
gggcccttggggcctggc

SEQ ID NO: 3893785 - DNA, 20 bp, Homo sapiens
gggccggggaactggccaag

SEQ ID NO: 3893786 - DNA, 23 bp, Homo sapiens
gggccggggaactggccaagctg

SEQ ID NO: 3893787 - DNA, 17 bp, Homo sapiens
gggccgtgcccaggggc

SEQ ID NO: 3893788 - DNA, 16 bp, Homo sapiens
gggcctatggagagcc

SEQ ID NO: 3893789 - DNA, 19 bp, Homo sapiens
gggcctatggagagccctg

SEQ ID NO: 3893790 - DNA, 20 bp, Homo sapiens
gggcctatggagagccctgg

SEQ ID NO: 3893791 - DNA, 14 bp, Homo sapiens
ggcagctagactgg

SEQ ID NO: 3893792 - DNA, 16 bp, Homo sapiens
ggcagctccaacagct

SEQ ID NO: 3893793 - DNA, 22 bp, Homo sapiens
ggcagctcctctccttgggctc

SEQ ID NO: 3893794 - DNA, 15 bp, Homo sapiens
ggccactccttcctg

SEQ ID NO: 3893795 - DNA, 16 bp, Homo sapiens
ggccactctcccctcc

SEQ ID NO: 3893796 - DNA, 14 bp, Homo sapiens
ggccactgtggcca

SEQ ID NO: 3893797 - DNA, 17 bp, Homo sapiens
ggccactgtggccagag

SEQ ID NO: 3893798 - DNA, 21 bp, Homo sapiens
ggccactgtggccagagctgg

SEQ ID NO: 3893799 - DNA, 16 bp, Homo sapiens
ggccagaaggagggca

SEQ ID NO: 3893800 - DNA, 20 bp, Homo sapiens
ggccagaaggagggcagagc

SEQ ID NO: 3893801 - DNA, 14 bp, Homo sapiens
ggccagacgctgcc

SEQ ID NO: 3893802 - DNA, 13 bp, Homo sapiens
ggccagagagggc

SEQ ID NO: 3893803 - DNA, 20 bp, Homo sapiens
ggccagagagggcccagctg

SEQ ID NO: 3893804 - DNA, 15 bp, Homo sapiens
ggccagagctggaag

SEQ ID NO: 3893805 - DNA, 16 bp, Homo sapiens
ggccagagctggaagg

SEQ ID NO: 3893806 - DNA, 23 bp, Homo sapiens
ggccagagctggaaggcagggca

SEQ ID NO: 3893807 - DNA, 21 bp, Homo sapiens
ggccagagctgggaggcatgg

SEQ ID NO: 3893808 - DNA, 17 bp, Homo sapiens
ggccagcctcagctcag

SEQ ID NO: 3893809 - DNA, 19 bp, Homo sapiens
ggccagcctcagctcagcc

SEQ ID NO: 3893810 - DNA, 12 bp, Homo sapiens
ggccagcctggc

SEQ ID NO: 3893811 - DNA, 20 bp, Homo sapiens
ggccagctcacaagcccagg

SEQ ID NO: 3893812 - DNA, 16 bp, Homo sapiens
ggccaggaatctgcca

SEQ ID NO: 3893813 - DNA, 17 bp, Homo sapiens
ggccaggaatctgccat

SEQ ID NO: 3893814 - DNA, 11 bp, Homo sapiens
ggccaggagag

SEQ ID NO: 3893815 - DNA, 16 bp, Homo sapiens
ggccaggattcctctc

SEQ ID NO: 3893816 - DNA, 11 bp, Homo sapiens
ggccaggcagg

SEQ ID NO: 3893817 - DNA, 15 bp, Homo sapiens
ggccaggccaccagg

SEQ ID NO: 3893818 - DNA, 12 bp, Homo sapiens
ggccagggcctg

SEQ ID NO: 3893819 - DNA, 19 bp, Homo sapiens
ggccaggtggccactccag

SEQ ID NO: 3893820 - DNA, 14 bp, Homo sapiens
ggccagtcctagag

SEQ ID NO: 3893821 - DNA, 15 bp, Homo sapiens
ggccagtcctagagc

SEQ ID NO: 3893822 - DNA, 16 bp, Homo sapiens
ggccagtcctagagct

SEQ ID NO: 3893823 - DNA, 13 bp, Homo sapiens
ggccagtgagggc

SEQ ID NO: 3893824 - DNA, 21 bp, Homo sapiens
ggccatccctgggcccctcca

SEQ ID NO: 3893825 - DNA, 19 bp, Homo sapiens
ggccatgcaattcatccca

SEQ ID NO: 3893826 - DNA, 19 bp, Homo sapiens
ggccatgctttccttttct

SEQ ID NO: 3893827 - DNA, 22 bp, Homo sapiens
ggccattttcttgcctgaggct

SEQ ID NO: 3893828 - DNA, 15 bp, Homo sapiens
ggcccacaaagggga

SEQ ID NO: 3893829 - DNA, 14 bp, Homo sapiens
ggcccacagctccc

SEQ ID NO: 3893830 - DNA, 17 bp, Homo sapiens
ggcccagaagtttccct

SEQ ID NO: 3893831 - DNA, 15 bp, Homo sapiens
ggcccagagaagcaa

SEQ ID NO: 3893832 - DNA, 17 bp, Homo sapiens
ggcccagagaccccttc

SEQ ID NO: 3893833 - DNA, 23 bp, Homo sapiens
ggcccagagaccccttcctttcc

SEQ ID NO: 3893834 - DNA, 17 bp, Homo sapiens
ggcccagagctggaaca

SEQ ID NO: 3893835 - DNA, 22 bp, Homo sapiens
ggcccagctatggccccagggt

SEQ ID NO: 3893836 - DNA, 21 bp, Homo sapiens
ggcccagctgtagccatggct

SEQ ID NO: 3893837 - DNA, 19 bp, Homo sapiens
ggcccaggctctgggaagg

SEQ ID NO: 3893838 - DNA, 20 bp, Homo sapiens
ggcccaggctctgggaaggg

SEQ ID NO: 3893839 - DNA, 22 bp, Homo sapiens
ggcccatagaaacatgacactg

SEQ ID NO: 3893840 - DNA, 13 bp, Homo sapiens
ggcccatctcagg

SEQ ID NO: 3893841 - DNA, 23 bp, Homo sapiens
ggccccaccctcgtggacacctg

SEQ ID NO: 3893842 - DNA, 12 bp, Homo sapiens
ggccccagagca

SEQ ID NO: 3893843 - DNA, 18 bp, Homo sapiens
ggccccagggctaccctc

SEQ ID NO: 3893844 - DNA, 17 bp, Homo sapiens
ggccccaggtgccacca

SEQ ID NO: 3893845 - DNA, 22 bp, Homo sapiens
ggccccaggtgccaccaataaa

SEQ ID NO: 3893846 - DNA, 21 bp, Homo sapiens
ggccccatgctctgccccaag

SEQ ID NO: 3893847 - DNA, 15 bp, Homo sapiens
ggcccccctccaggc

SEQ ID NO: 3893848 - DNA, 15 bp, Homo sapiens
ggccccctccatcgg

SEQ ID NO: 3893849 - DNA, 17 bp, Homo sapiens
ggccccctgtgccagct

SEQ ID NO: 3893850 - DNA, 21 bp, Homo sapiens
ggccccgggctctggccaccc

SEQ ID NO: 3893851 - DNA, 15 bp, Homo sapiens
ggccccggggctggc

SEQ ID NO: 3893852 - DNA, 19 bp, Homo sapiens
ggcccctcacctgggcctt

SEQ ID NO: 3893853 - DNA, 18 bp, Homo sapiens
ggcccctccacgcctcct

SEQ ID NO: 3893854 - DNA, 19 bp, Homo sapiens
ggcccctccagaccctgcc

SEQ ID NO: 3893855 - DNA, 14 bp, Homo sapiens
ggcccctccctctg

SEQ ID NO: 3893856 - DNA, 19 bp, Homo sapiens
ggcccctccctctgcccca

SEQ ID NO: 3893857 - DNA, 13 bp, Homo sapiens
ggcccctgaggac

SEQ ID NO: 3893858 - DNA, 12 bp, Homo sapiens
ggcccctgggat

SEQ ID NO: 3893859 - DNA, 22 bp, Homo sapiens
ggcccctgggatgggaccaggg

SEQ ID NO: 3893860 - DNA, 18 bp, Homo sapiens
ggcccgagcagctgagca

SEQ ID NO: 3893861 - DNA, 12 bp, Homo sapiens
ggcccgcccctc

SEQ ID NO: 3893862 - DNA, 20 bp, Homo sapiens
ggcccggagtaatcaggcag

SEQ ID NO: 3893863 - DNA, 22 bp, Homo sapiens
ggcccggagtaatcaggcagcc

SEQ ID NO: 3893864 - DNA, 21 bp, Homo sapiens
ggcccggggggaccaggatga

SEQ ID NO: 3893865 - DNA, 17 bp, Homo sapiens
ggccctccatgggctag

SEQ ID NO: 3893866 - DNA, 19 bp, Homo sapiens
ggccctccctgactccctg

SEQ ID NO: 3893867 - DNA, 21 bp, Homo sapiens
ggccctcccttgcaggtcggt

SEQ ID NO: 3893868 - DNA, 17 bp, Homo sapiens
ggccctgcaaaaatata

SEQ ID NO: 3893869 - DNA, 21 bp, Homo sapiens
ggccctgccctctccttcctt

SEQ ID NO: 3893870 - DNA, 10 bp, Homo sapiens
ggccctgcct

SEQ ID NO: 3893871 - DNA, 22 bp, Homo sapiens
ggccctggcctgctgggctctc

SEQ ID NO: 3893872 - DNA, 15 bp, Homo sapiens
ggccctggggcctgt

SEQ ID NO: 3893873 - DNA, 16 bp, Homo sapiens
ggccctggggcctgta

SEQ ID NO: 3893874 - DNA, 23 bp, Homo sapiens
ggccctggggcctgtactgcctg

SEQ ID NO: 3893875 - DNA, 19 bp, Homo sapiens
ggcccttcctctccactgc

SEQ ID NO: 3893876 - DNA, 15 bp, Homo sapiens
ggcccttcctggaca

SEQ ID NO: 3893877 - DNA, 16 bp, Homo sapiens
ggcccttcctggacag

SEQ ID NO: 3893878 - DNA, 17 bp, Homo sapiens
ggcccttcctggacagc

SEQ ID NO: 3893879 - DNA, 16 bp, Homo sapiens
ggcccttggggcctgg

SEQ ID NO: 3893880 - DNA, 14 bp, Homo sapiens
ggcccttgtcctgc

SEQ ID NO: 3893881 - DNA, 18 bp, Homo sapiens
ggcccttgtcctgccagc

SEQ ID NO: 3893882 - DNA, 18 bp, Homo sapiens
ggccgaagctaacaggga

SEQ ID NO: 3893883 - DNA, 17 bp, Homo sapiens
ggccgcaagcgcaggga

SEQ ID NO: 3893884 - DNA, 20 bp, Homo sapiens
ggccgccatccgggacgctt

SEQ ID NO: 3893885 - DNA, 15 bp, Homo sapiens
ggccgcctgccatac

SEQ ID NO: 3893886 - DNA, 12 bp, Homo sapiens
ggccggccagcc

SEQ ID NO: 3893887 - DNA, 15 bp, Homo sapiens
ggccggccagccttg

SEQ ID NO: 3893888 - DNA, 19 bp, Homo sapiens
ggccggggaactggccaag

SEQ ID NO: 3893889 - DNA, 15 bp, Homo sapiens
ggccgtgaggacacg

SEQ ID NO: 3893890 - DNA, 13 bp, Homo sapiens
ggccgtgcccagg

SEQ ID NO: 3893891 - DNA, 17 bp, Homo sapiens
ggccgttccccttggct

SEQ ID NO: 3893892 - DNA, 23 bp, Homo sapiens
ggcctagatccacacacagagga

SEQ ID NO: 3893893 - DNA, 14 bp, Homo sapiens
ggcctatctgagac

SEQ ID NO: 3893894 - DNA, 18 bp, Homo sapiens
ggcctatggagagccctg

SEQ ID NO: 3893895 - DNA, 20 bp, Homo sapiens
ggcctcacacccagagggta

SEQ ID NO: 3893896 - DNA, 12 bp, Homo sapiens
ggcctcacttcc

SEQ ID NO: 3893897 - DNA, 20 bp, Homo sapiens
ggcctcacttccctgggaac

SEQ ID NO: 3893898 - DNA, 12 bp, Homo sapiens
ggcctcagacca

SEQ ID NO: 3893899 - DNA, 23 bp, Homo sapiens
ggcctcagaccaactctctcctg

SEQ ID NO: 3893900 - DNA, 14 bp, Homo sapiens
ggcctcagtttccc

SEQ ID NO: 3893901 - DNA, 19 bp, Homo sapiens
ggcctcagtttctccatca

SEQ ID NO: 3893902 - DNA, 21 bp, Homo sapiens
ggcctcatccctcggaagccg

SEQ ID NO: 3893903 - DNA, 16 bp, Homo sapiens
ggcctccactccccca

SEQ ID NO: 3893904 - DNA, 21 bp, Homo sapiens
ggcctccactcccccacctga

SEQ ID NO: 3893905 - DNA, 22 bp, Homo sapiens
ggcctccactcccccacctgac

SEQ ID NO: 3893906 - DNA, 23 bp, Homo sapiens
ggcctccactcccccacctgaca

SEQ ID NO: 3893907 - DNA, 21 bp, Homo sapiens
ggcctccagcctctcccggct

SEQ ID NO: 3893908 - DNA, 23 bp, Homo sapiens
ggcctccagcctctcccggctgc

SEQ ID NO: 3893909 - DNA, 21 bp, Homo sapiens
ggcctcccaataaagctggac

SEQ ID NO: 3893910 - DNA, 21 bp, Homo sapiens
ggcctccgtccaggagcctgg

SEQ ID NO: 3893911 - DNA, 15 bp, Homo sapiens
ggcctcctgcctcta

SEQ ID NO: 3893912 - DNA, 23 bp, Homo sapiens
ggcctcgcctgggcccaggctct

SEQ ID NO: 3893913 - DNA, 17 bp, Homo sapiens
ggcctcgtaccagccag

SEQ ID NO: 3893914 - DNA, 17 bp, Homo sapiens
ggcctctagaacaccca

SEQ ID NO: 3893915 - DNA, 18 bp, Homo sapiens
ggcctctagaacacccac

SEQ ID NO: 3893916 - DNA, 21 bp, Homo sapiens
ggcctctagaacacccactgg

SEQ ID NO: 3893917 - DNA, 19 bp, Homo sapiens
ggcctctcgagttctccta

SEQ ID NO: 3893918 - DNA, 15 bp, Homo sapiens
ggcctcttccaccca

SEQ ID NO: 3893919 - DNA, 16 bp, Homo sapiens
ggcctcttccacccat

SEQ ID NO: 3893920 - DNA, 12 bp, Homo sapiens
ggcctcttccct

SEQ ID NO: 3893921 - DNA, 15 bp, Homo sapiens
ggcctcttccctcag

SEQ ID NO: 3893922 - DNA, 17 bp, Homo sapiens
ggcctcttggacctctg

SEQ ID NO: 3893923 - DNA, 22 bp, Homo sapiens
ggcctgacaggttcccagcagc

SEQ ID NO: 3893924 - DNA, 23 bp, Homo sapiens
ggcctgacaggttcccagcagct

SEQ ID NO: 3893925 - DNA, 12 bp, Homo sapiens
ggcctgagctgg

SEQ ID NO: 3893926 - DNA, 13 bp, Homo sapiens
ggcctgagctggg

SEQ ID NO: 3893927 - DNA, 22 bp, Homo sapiens
ggcctgagctggggccacaaat

SEQ ID NO: 3893928 - DNA, 18 bp, Homo sapiens
ggcctgatgacagagcga

SEQ ID NO: 3893929 - DNA, 15 bp, Homo sapiens
ggcctgatgctgccc

SEQ ID NO: 3893930 - DNA, 15 bp, Homo sapiens
ggcctgcctcccagc

SEQ ID NO: 3893931 - DNA, 17 bp, Homo sapiens
ggcctgcctcccagccc

SEQ ID NO: 3893932 - DNA, 18 bp, Homo sapiens
ggcctgcctcccagccct

SEQ ID NO: 3893933 - DNA, 21 bp, Homo sapiens
ggcctgcgtgccgggagagga

SEQ ID NO: 3893934 - DNA, 20 bp, Homo sapiens
ggcctgctaatagctgctag

SEQ ID NO: 3893935 - DNA, 10 bp, Homo sapiens
ggcctgctgc

SEQ ID NO: 3893936 - DNA, 19 bp, Homo sapiens
ggcctgctgcgtcagacca

SEQ ID NO: 3893937 - DNA, 16 bp, Homo sapiens
ggcctgctgctgagaa

SEQ ID NO: 3893938 - DNA, 20 bp, Homo sapiens
ggcctgctgctgagaacctg

SEQ ID NO: 3893939 - DNA, 16 bp, Homo sapiens
ggcctggagaggggcc

SEQ ID NO: 3893940 - DNA, 15 bp, Homo sapiens
ggcctggcagccgtg

SEQ ID NO: 3893941 - DNA, 21 bp, Homo sapiens
ggcctggccggcaaccccagt

SEQ ID NO: 3893942 - DNA, 11 bp, Homo sapiens
ggcctggcctg

SEQ ID NO: 3893943 - DNA, 16 bp, Homo sapiens
ggcctggcctgagctg

SEQ ID NO: 3893944 - DNA, 14 bp, Homo sapiens
ggcctggccttgtc

SEQ ID NO: 3893945 - DNA, 15 bp, Homo sapiens
ggcctggctggctga

SEQ ID NO: 3893946 - DNA, 19 bp, Homo sapiens
ggcctggctggctgagggc

SEQ ID NO: 3893947 - DNA, 20 bp, Homo sapiens
ggcctggcttgctccagggt

SEQ ID NO: 3893948 - DNA, 12 bp, Homo sapiens
ggcctgggcctg

SEQ ID NO: 3893949 - DNA, 14 bp, Homo sapiens
ggcctgggcctgct

SEQ ID NO: 3893950 - DNA, 14 bp, Homo sapiens
ggcctggggctcct

SEQ ID NO: 3893951 - DNA, 17 bp, Homo sapiens
ggcctgggggcagtgac

SEQ ID NO: 3893952 - DNA, 11 bp, Homo sapiens
ggcctggggtg

SEQ ID NO: 3893953 - DNA, 19 bp, Homo sapiens
ggcctggggtgacccggca

SEQ ID NO: 3893954 - DNA, 15 bp, Homo sapiens
ggcctgtactgcctg

SEQ ID NO: 3893955 - DNA, 18 bp, Homo sapiens
ggcctgtactgcctgctt

SEQ ID NO: 3893956 - DNA, 17 bp, Homo sapiens
ggcctgtgggagcctgc

SEQ ID NO: 3893957 - DNA, 17 bp, Homo sapiens
ggcctgtgtagctgtga

SEQ ID NO: 3893958 - DNA, 22 bp, Homo sapiens
ggcctgtgtagctgtgacctgc

SEQ ID NO: 3893959 - DNA, 17 bp, Homo sapiens
ggcctgtgtccagcagc

SEQ ID NO: 3893960 - DNA, 18 bp, Homo sapiens
ggcctgtgtccagcagct

SEQ ID NO: 3893961 - DNA, 20 bp, Homo sapiens
ggcctgtgtccagcagctgc

SEQ ID NO: 3893962 - DNA, 21 bp, Homo sapiens
ggatttcctattttaaaacca

SEQ ID NO: 3893963 - DNA, 16 bp, Homo sapiens
ggcaaaatccttgctt

SEQ ID NO: 3893964 - DNA, 19 bp, Homo sapiens
ggcaaaccatttcaaatgg

SEQ ID NO: 3893965 - DNA, 17 bp, Homo sapiens
ggcaaacggagtacaga

SEQ ID NO: 3893966 - DNA, 23 bp, Homo sapiens
ggcaaagaactgccccatctcct

SEQ ID NO: 3893967 - DNA, 13 bp, Homo sapiens
ggcaaatataaaa

SEQ ID NO: 3893968 - DNA, 12 bp, Homo sapiens
gcctggatctcc

SEQ ID NO: 3893969 - DNA, 15 bp, Homo sapiens
gcctggcacaggact

SEQ ID NO: 3893970 - DNA, 19 bp, Homo sapiens
gcctggcacagggcagtgg

SEQ ID NO: 3893971 - DNA, 12 bp, Homo sapiens
gcctggcagccg

SEQ ID NO: 3893972 - DNA, 20 bp, Homo sapiens
gcctggcagccgtgccttca

SEQ ID NO: 3893973 - DNA, 21 bp, Homo sapiens
gcctggcagccgtgccttcag

SEQ ID NO: 3893974 - DNA, 19 bp, Homo sapiens
gctttgggctgccctggtg

SEQ ID NO: 3893975 - DNA, 19 bp, Homo sapiens
gctttggggacagttggca

SEQ ID NO: 3893976 - DNA, 15 bp, Homo sapiens
gctttgtatgcactt

SEQ ID NO: 3893977 - DNA, 17 bp, Homo sapiens
gcttttaaaaaaaaata

SEQ ID NO: 3893978 - DNA, 15 bp, Homo sapiens
gcttttaagaaacac

SEQ ID NO: 3893979 - DNA, 14 bp, Homo sapiens
gcttttaataaaat

SEQ ID NO: 3893980 - DNA, 20 bp, Homo sapiens
ggaagctgtactcagagcag

SEQ ID NO: 3893981 - DNA, 21 bp, Homo sapiens
ggaagctgtactcagagcaga

SEQ ID NO: 3893982 - DNA, 21 bp, Homo sapiens
ggaagctgtgtccttgcacct

SEQ ID NO: 3893983 - DNA, 16 bp, Homo sapiens
ggaaggaagggacaca

SEQ ID NO: 3893984 - DNA, 21 bp, Homo sapiens
ggaaggcaaagcccctggaaa

SEQ ID NO: 3893985 - DNA, 13 bp, Homo sapiens
ggaaggcagctgc

SEQ ID NO: 3893986 - DNA, 15 bp, Homo sapiens
ggaaggcagctgctc

SEQ ID NO: 3893987 - DNA, 11 bp, Homo sapiens
ggaaggcaggc

SEQ ID NO: 3893988 - DNA, 12 bp, Homo sapiens
ggaaggcaggca

SEQ ID NO: 3893989 - DNA, 18 bp, Homo sapiens
ggaaggcaggcagggctc

SEQ ID NO: 3893990 - DNA, 13 bp, Homo sapiens
ggaaggcagggac

SEQ ID NO: 3893991 - DNA, 16 bp, Homo sapiens
ggaaggcagggacaga

SEQ ID NO: 3893992 - DNA, 13 bp, Homo sapiens
ggaagggaggggt

SEQ ID NO: 3893993 - DNA, 15 bp, Homo sapiens
ggaagggggtgtgcg

SEQ ID NO: 3893994 - DNA, 22 bp, Homo sapiens
ggaagggttggtgggctggccc

SEQ ID NO: 3893995 - DNA, 23 bp, Homo sapiens
ggaagtcgtccttactcctgtgg

SEQ ID NO: 3893996 - DNA, 14 bp, Homo sapiens
ggaagtctaggagc

SEQ ID NO: 3893997 - DNA, 14 bp, Homo sapiens
ggaagtgaagcccc

SEQ ID NO: 3893998 - DNA, 14 bp, Homo sapiens
ggaagtgctcccca

SEQ ID NO: 3893999 - DNA, 18 bp, Homo sapiens
ggaagtgttcaagaaata

SEQ ID NO: 3894000 - DNA, 22 bp, Homo sapiens
ggaagtgttcaagaaataaaaa

SEQ ID NO: 3894001 - DNA, 15 bp, Homo sapiens
ggaatagccagagag

SEQ ID NO: 3894002 - DNA, 14 bp, Homo sapiens
ggaatcacctggag

SEQ ID NO: 3894003 - DNA, 16 bp, Homo sapiens
ggaatcacctggaggg

SEQ ID NO: 3894004 - DNA, 21 bp, Homo sapiens
ggaatcacctggagggcttgg

SEQ ID NO: 3894005 - DNA, 15 bp, Homo sapiens
ggaatcatgtcaggc

SEQ ID NO: 3894006 - DNA, 19 bp, Homo sapiens
ggaatcatgtcaggcctgt

SEQ ID NO: 3894007 - DNA, 20 bp, Homo sapiens
ggaatgaccacgggcctcag

SEQ ID NO: 3894008 - DNA, 15 bp, Homo sapiens
ggaatggaaggcttt

SEQ ID NO: 3894009 - DNA, 16 bp, Homo sapiens
ggaatgttaaagtcag

SEQ ID NO: 3894010 - DNA, 21 bp, Homo sapiens
ggaatgttccctgcaccctgg

SEQ ID NO: 3894011 - DNA, 21 bp, Homo sapiens
ggaatgtttgggcagaaggga

SEQ ID NO: 3894012 - DNA, 17 bp, Homo sapiens
ggaattcagcaccctgg

SEQ ID NO: 3894013 - DNA, 17 bp, Homo sapiens
ggaatttaggataaaga

SEQ ID NO: 3894014 - DNA, 23 bp, Homo sapiens
ggaatttctcccagtcatttaat

SEQ ID NO: 3894015 - DNA, 14 bp, Homo sapiens
ggacaaaggagcct

SEQ ID NO: 3894016 - DNA, 15 bp, Homo sapiens
ggacaaaggagcctg

SEQ ID NO: 3894017 - DNA, 17 bp, Homo sapiens
ggacaaaggagcctgtg

SEQ ID NO: 3894018 - DNA, 19 bp, Homo sapiens
ggacaacctgcccctcccc

SEQ ID NO: 3894019 - DNA, 13 bp, Homo sapiens
ggacaagcagagg

SEQ ID NO: 3894020 - DNA, 23 bp, Homo sapiens
ggacaagccaacttgtaaataca

SEQ ID NO: 3894021 - DNA, 23 bp, Homo sapiens
ggacaagggggaggaaaggggcg

SEQ ID NO: 3894022 - DNA, 23 bp, Homo sapiens
ggacaatataaactgaaaaatgt

SEQ ID NO: 3894023 - DNA, 12 bp, Homo sapiens
ggacacactaat

SEQ ID NO: 3894024 - DNA, 12 bp, Homo sapiens
ggacacaggcct

SEQ ID NO: 3894025 - DNA, 15 bp, Homo sapiens
ggacacatcccggcc

SEQ ID NO: 3894026 - DNA, 23 bp, Homo sapiens
ggacacatcccggcctcttccac

SEQ ID NO: 3894027 - DNA, 12 bp, Homo sapiens
ggacacatgtcc

SEQ ID NO: 3894028 - DNA, 21 bp, Homo sapiens
ggacaccccccgccccccacc

SEQ ID NO: 3894029 - DNA, 19 bp, Homo sapiens
ggacaccccttatccagga

SEQ ID NO: 3894030 - DNA, 11 bp, Homo sapiens
ggacacctgcc

SEQ ID NO: 3894031 - DNA, 13 bp, Homo sapiens
ggacacctgcccc

SEQ ID NO: 3894032 - DNA, 22 bp, Homo sapiens
ggacacctgccccagcgcggct

SEQ ID NO: 3894033 - DNA, 13 bp, Homo sapiens
ggacacctgccct

SEQ ID NO: 3894034 - DNA, 17 bp, Homo sapiens
ggacacctgccctgccc

SEQ ID NO: 3894035 - DNA, 12 bp, Homo sapiens
ggacagagatgg

SEQ ID NO: 3894036 - DNA, 20 bp, Homo sapiens
ggacagaggagcaaggttta

SEQ ID NO: 3894037 - DNA, 14 bp, Homo sapiens
ggacagctgcttgt

SEQ ID NO: 3894038 - DNA, 20 bp, Homo sapiens
ggacagctgtgcctcgctcc

SEQ ID NO: 3894039 - DNA, 15 bp, Homo sapiens
ggacagggcatggcc

SEQ ID NO: 3894040 - DNA, 17 bp, Homo sapiens
ggacagtattctcagtg

SEQ ID NO: 3894041 - DNA, 21 bp, Homo sapiens
ggacatgatttagggaagcag

SEQ ID NO: 3894042 - DNA, 16 bp, Homo sapiens
ggacatggagagagac

SEQ ID NO: 3894043 - DNA, 16 bp, Homo sapiens
ggacatggggcataga

SEQ ID NO: 3894044 - DNA, 23 bp, Homo sapiens
ggacatgtgctattgaactgagc

SEQ ID NO: 3894045 - DNA, 17 bp, Homo sapiens
ggacattcaaaaacctg

SEQ ID NO: 3894046 - DNA, 13 bp, Homo sapiens
ggaccaactggct

SEQ ID NO: 3894047 - DNA, 16 bp, Homo sapiens
ggaccaactggcttct

SEQ ID NO: 3894048 - DNA, 22 bp, Homo sapiens
ggaccacaaaaatgaaagcatg

SEQ ID NO: 3894049 - DNA, 22 bp, Homo sapiens
ggaccacactttgagaacctgt

SEQ ID NO: 3894050 - DNA, 22 bp, Homo sapiens
ggaccacccgccctggcagttg

SEQ ID NO: 3894051 - DNA, 17 bp, Homo sapiens
ggaccagcctgttggac

SEQ ID NO: 3894052 - DNA, 14 bp, Homo sapiens
ggaccaggacagga

SEQ ID NO: 3894053 - DNA, 17 bp, Homo sapiens
ggaccaggacaggacca

SEQ ID NO: 3894054 - DNA, 16 bp, Homo sapiens
ggaccagggatggggg

SEQ ID NO: 3894055 - DNA, 14 bp, Homo sapiens
ggaccatcctattt

SEQ ID NO: 3894056 - DNA, 16 bp, Homo sapiens
ggaccatgaagagact

SEQ ID NO: 3894057 - DNA, 24 bp, Homo sapiens
ggaccattgacctcagctgcacat

SEQ ID NO: 3894058 - DNA, 10 bp, Homo sapiens
ggacccacca

SEQ ID NO: 3894059 - DNA, 20 bp, Homo sapiens
ggacccaccaaactgcacac

SEQ ID NO: 3894060 - DNA, 22 bp, Homo sapiens
ggacccacccatcttcctgctg

SEQ ID NO: 3894061 - DNA, 23 bp, Homo sapiens
ggacccagccgccatcagcccaa

SEQ ID NO: 3894062 - DNA, 13 bp, Homo sapiens
ggacccagctact

SEQ ID NO: 3894063 - DNA, 23 bp, Homo sapiens
ggacccagctactctgtccaggc

SEQ ID NO: 3894064 - DNA, 14 bp, Homo sapiens
ggacccaggccctc

SEQ ID NO: 3894065 - DNA, 13 bp, Homo sapiens
ggacccaggccgc

SEQ ID NO: 3894066 - DNA, 18 bp, Homo sapiens
ggaccccctggccctgcc

SEQ ID NO: 3894067 - DNA, 22 bp, Homo sapiens
ggagcaaagcctgttcatggca

SEQ ID NO: 3894068 - DNA, 16 bp, Homo sapiens
ggagcaaatgtttctg

SEQ ID NO: 3894069 - DNA, 20 bp, Homo sapiens
ggagcaaatgtttctgcagt

SEQ ID NO: 3894070 - DNA, 23 bp, Homo sapiens
ggagcaagaaggaaggaggcaga

SEQ ID NO: 3894071 - DNA, 15 bp, Homo sapiens
ggagcaatgggaggg

SEQ ID NO: 3894072 - DNA, 15 bp, Homo sapiens
ggagcacagccctgg

SEQ ID NO: 3894073 - DNA, 13 bp, Homo sapiens
ggagcacaggcag

SEQ ID NO: 3894074 - DNA, 15 bp, Homo sapiens
ggagcacaggcagct

SEQ ID NO: 3894075 - DNA, 17 bp, Homo sapiens
ggagcaccaggcacgaa

SEQ ID NO: 3894076 - DNA, 14 bp, Homo sapiens
ggagcacctgaacc

SEQ ID NO: 3894077 - DNA, 21 bp, Homo sapiens
ggagcacttgcgtcctgcaga

SEQ ID NO: 3894078 - DNA, 15 bp, Homo sapiens
ggagcagacagagaa

SEQ ID NO: 3894079 - DNA, 17 bp, Homo sapiens
ggagcagacagagaaat

SEQ ID NO: 3894080 - DNA, 23 bp, Homo sapiens
ggagcagagctgatggagaagga

SEQ ID NO: 3894081 - DNA, 19 bp, Homo sapiens
ggagcagagtataggatgg

SEQ ID NO: 3894082 - DNA, 21 bp, Homo sapiens
ggagcagagtataggatggat

SEQ ID NO: 3894083 - DNA, 13 bp, Homo sapiens
ggagcaggaacag

SEQ ID NO: 3894084 - DNA, 17 bp, Homo sapiens
ggagcaggaacagagac

SEQ ID NO: 3894085 - DNA, 19 bp, Homo sapiens
ggagcaggaacagagactc

SEQ ID NO: 3894086 - DNA, 22 bp, Homo sapiens
ggagcaggaacagagactctgg

SEQ ID NO: 3894087 - DNA, 14 bp, Homo sapiens
ggagccggaccaag

SEQ ID NO: 3894088 - DNA, 16 bp, Homo sapiens
ggagccggtggcggtg

SEQ ID NO: 3894089 - DNA, 14 bp, Homo sapiens
ggagcctggcacag

SEQ ID NO: 3894090 - DNA, 16 bp, Homo sapiens
ggagcctggcacagga

SEQ ID NO: 3894091 - DNA, 14 bp, Homo sapiens
ggagcctgtgaacc

SEQ ID NO: 3894092 - DNA, 20 bp, Homo sapiens
ggagcctgtgaacccaggac

SEQ ID NO: 3894093 - DNA, 22 bp, Homo sapiens
ggagctacctgtgtggacagga

SEQ ID NO: 3894094 - DNA, 15 bp, Homo sapiens
ggagctcttggaaga

SEQ ID NO: 3894095 - DNA, 21 bp, Homo sapiens
ggagctgagtcacctcctcca

SEQ ID NO: 3894096 - DNA, 17 bp, Homo sapiens
ggagctgatttccaggc

SEQ ID NO: 3894097 - DNA, 14 bp, Homo sapiens
ggagctgccagccg

SEQ ID NO: 3894098 - DNA, 12 bp, Homo sapiens
ggagctggaaat

SEQ ID NO: 3894099 - DNA, 13 bp, Homo sapiens
ggagctggaaata

SEQ ID NO: 3894100 - DNA, 15 bp, Homo sapiens
ggagctgggaggaaa

SEQ ID NO: 3894101 - DNA, 21 bp, Homo sapiens
ggagcttctctgatgtgatat

SEQ ID NO: 3894102 - DNA, 15 bp, Homo sapiens
ggagcttgggaatgg

SEQ ID NO: 3894103 - DNA, 21 bp, Homo sapiens
ggaggaaaaccaagccgtggc

SEQ ID NO: 3894104 - DNA, 22 bp, Homo sapiens
ggaggaaaaccaagccgtggct

SEQ ID NO: 3894105 - DNA, 17 bp, Homo sapiens
ggaggaagggccaggag

SEQ ID NO: 3894106 - DNA, 22 bp, Homo sapiens
ggaggaagggccaggagagaga

SEQ ID NO: 3894107 - DNA, 14 bp, Homo sapiens
ggaggaaggtgctg

SEQ ID NO: 3894108 - DNA, 13 bp, Homo sapiens
ggaggacctgagc

SEQ ID NO: 3894109 - DNA, 14 bp, Homo sapiens
ggaggacctgagcc

SEQ ID NO: 3894110 - DNA, 18 bp, Homo sapiens
ggaggacctgagcctgcc

SEQ ID NO: 3894111 - DNA, 22 bp, Homo sapiens
ggaggactagaacctggagggc

SEQ ID NO: 3894112 - DNA, 13 bp, Homo sapiens
ggaggagaatgag

SEQ ID NO: 3894113 - DNA, 18 bp, Homo sapiens
ggaggaggtgtcccaagc

SEQ ID NO: 3894114 - DNA, 22 bp, Homo sapiens
ggaggatgccacagccccacag

SEQ ID NO: 3894115 - DNA, 23 bp, Homo sapiens
ggaggatgccacagccccacagc

SEQ ID NO: 3894116 - DNA, 12 bp, Homo sapiens
ggaggatggaga

SEQ ID NO: 3894117 - DNA, 14 bp, Homo sapiens
ggaggatggagaga

SEQ ID NO: 3894118 - DNA, 21 bp, Homo sapiens
ggaggatggagagaggggaat

SEQ ID NO: 3894119 - DNA, 17 bp, Homo sapiens
ggaggcaccagctctgt

SEQ ID NO: 3894120 - DNA, 22 bp, Homo sapiens
ggaggcaccagctctgtggcct

SEQ ID NO: 3894121 - DNA, 13 bp, Homo sapiens
ggaggcagctcca

SEQ ID NO: 3894122 - DNA, 21 bp, Homo sapiens
ggaggcaggctccccctgcct

SEQ ID NO: 3894123 - DNA, 18 bp, Homo sapiens
ggaggccaaggcaggtag

SEQ ID NO: 3894124 - DNA, 13 bp, Homo sapiens
ggaggcgcagccc

SEQ ID NO: 3894125 - DNA, 20 bp, Homo sapiens
ggaggcgcagcccgaagccc

SEQ ID NO: 3894126 - DNA, 12 bp, Homo sapiens
ggaggcggagag

SEQ ID NO: 3894127 - DNA, 20 bp, Homo sapiens
ggaggcggaggttgcagtga

SEQ ID NO: 3894128 - DNA, 16 bp, Homo sapiens
ggaggcggctccaggt

SEQ ID NO: 3894129 - DNA, 22 bp, Homo sapiens
ggaggcggctccaggtccggag

SEQ ID NO: 3894130 - DNA, 15 bp, Homo sapiens
ggaggctgagacagg

SEQ ID NO: 3894131 - DNA, 19 bp, Homo sapiens
ggaggctgagacaggagaa

SEQ ID NO: 3894132 - DNA, 18 bp, Homo sapiens
ggaggctgaggcagaaga

SEQ ID NO: 3894133 - DNA, 17 bp, Homo sapiens
ggaggctgaggcaggag

SEQ ID NO: 3894134 - DNA, 19 bp, Homo sapiens
ggaggctgcatgctctgga

SEQ ID NO: 3894135 - DNA, 11 bp, Homo sapiens
ggaggctgctc

SEQ ID NO: 3894136 - DNA, 14 bp, Homo sapiens
ggaggctgggcccc

SEQ ID NO: 3894137 - DNA, 19 bp, Homo sapiens
ggaggctgggcccctggga

SEQ ID NO: 3894138 - DNA, 20 bp, Homo sapiens
ggagggacaaaggagcctgt

SEQ ID NO: 3894139 - DNA, 14 bp, Homo sapiens
ggagggagggagag

SEQ ID NO: 3894140 - DNA, 16 bp, Homo sapiens
ggagggatggagaggc

SEQ ID NO: 3894141 - DNA, 15 bp, Homo sapiens
ggagggcagagccat

SEQ ID NO: 3894142 - DNA, 18 bp, Homo sapiens
ggagggcagagccatggg

SEQ ID NO: 3894143 - DNA, 23 bp, Homo sapiens
ggagggcagagccatgggcctgg

SEQ ID NO: 3894144 - DNA, 15 bp, Homo sapiens
ggagggctctgaggc

SEQ ID NO: 3894145 - DNA, 21 bp, Homo sapiens
ggagggctctgaggcgcccca

SEQ ID NO: 3894146 - DNA, 21 bp, Homo sapiens
ggagggggacgcgcacacaca

SEQ ID NO: 3894147 - DNA, 21 bp, Homo sapiens
ggagggggctatttctctccc

SEQ ID NO: 3894148 - DNA, 18 bp, Homo sapiens
ggagggggctccatggag

SEQ ID NO: 3894149 - DNA, 22 bp, Homo sapiens
ggaggggttgcgggggagctgg

SEQ ID NO: 3894150 - DNA, 18 bp, Homo sapiens
ggaggtgcctgagctggg

SEQ ID NO: 3894151 - DNA, 15 bp, Homo sapiens
ggaggtggtggagga

SEQ ID NO: 3894152 - DNA, 14 bp, Homo sapiens
ggaggttgcagtga

SEQ ID NO: 3894153 - DNA, 20 bp, Homo sapiens
ggaggttgcagtgagctgag

SEQ ID NO: 3894154 - DNA, 13 bp, Homo sapiens
gcctcctgcctct

SEQ ID NO: 3894155 - DNA, 14 bp, Homo sapiens
gcctcctggccaga

SEQ ID NO: 3894156 - DNA, 16 bp, Homo sapiens
gcctcctggccagacg

SEQ ID NO: 3894157 - DNA, 12 bp, Homo sapiens
gcctcctgggca

SEQ ID NO: 3894158 - DNA, 16 bp, Homo sapiens
gcctccttatttatca

SEQ ID NO: 3894159 - DNA, 21 bp, Homo sapiens
gcctcgaggcaccggcgctgc

SEQ ID NO: 3894160 - DNA, 16 bp, Homo sapiens
gcctcgcctgggccca

SEQ ID NO: 3894161 - DNA, 20 bp, Homo sapiens
gcctcgcctgggcccaggct

SEQ ID NO: 3894162 - DNA, 14 bp, Homo sapiens
gcctcgctccccac

SEQ ID NO: 3894163 - DNA, 14 bp, Homo sapiens
gccgggcaggtcct

SEQ ID NO: 3894164 - DNA, 17 bp, Homo sapiens
gccgggcaggtcctgcc

SEQ ID NO: 3894165 - DNA, 12 bp, Homo sapiens
gccgggctgccc

SEQ ID NO: 3894166 - DNA, 23 bp, Homo sapiens
gccgggctgcccttcgctgccag

SEQ ID NO: 3894167 - DNA, 16 bp, Homo sapiens
gccgggtgcggtggct

SEQ ID NO: 3894168 - DNA, 19 bp, Homo sapiens
gccgggtgcggtggctcac

SEQ ID NO: 3894169 - DNA, 17 bp, Homo sapiens
gccggtcacccaggctc

SEQ ID NO: 3894170 - DNA, 19 bp, Homo sapiens
gccgtccatggcaccagcc

SEQ ID NO: 3894171 - DNA, 20 bp, Homo sapiens
gccgtccatggcaccagccc

SEQ ID NO: 3894172 - DNA, 17 bp, Homo sapiens
gccgtgcactccctaag

SEQ ID NO: 3894173 - DNA, 17 bp, Homo sapiens
gccgtgccttcagctct

SEQ ID NO: 3894174 - DNA, 13 bp, Homo sapiens
gccgtggcttccc

SEQ ID NO: 3894175 - DNA, 21 bp, Homo sapiens
gccgtggcttcccgctcagcc

SEQ ID NO: 3894176 - DNA, 22 bp, Homo sapiens
gccgtgtgtctcgtctcctgac

SEQ ID NO: 3894177 - DNA, 16 bp, Homo sapiens
gccgtgttactgttgc

SEQ ID NO: 3894178 - DNA, 21 bp, Homo sapiens
gccgtgttactgttgcactga

SEQ ID NO: 3894179 - DNA, 15 bp, Homo sapiens
gccgttactctccaa

SEQ ID NO: 3894180 - DNA, 20 bp, Homo sapiens
gccgttactctccaacctgg

SEQ ID NO: 3894181 - DNA, 16 bp, Homo sapiens
gccgttccccttggct

SEQ ID NO: 3894182 - DNA, 15 bp, Homo sapiens
gcctaaaagtaaaca

SEQ ID NO: 3894183 - DNA, 16 bp, Homo sapiens
gcctaatggagaagac

SEQ ID NO: 3894184 - DNA, 15 bp, Homo sapiens
gcctaattcctggca

SEQ ID NO: 3894185 - DNA, 17 bp, Homo sapiens
gcctaattcctggcatg

SEQ ID NO: 3894186 - DNA, 21 bp, Homo sapiens
gcctacccttgtaccccatcc

SEQ ID NO: 3894187 - DNA, 12 bp, Homo sapiens
gcctactcacga

SEQ ID NO: 3894188 - DNA, 17 bp, Homo sapiens
gcctagaaaatgcaaaa

SEQ ID NO: 3894189 - DNA, 14 bp, Homo sapiens
gcctagccacctcc

SEQ ID NO: 3894190 - DNA, 21 bp, Homo sapiens
gcctagccacctcccacccca

SEQ ID NO: 3894191 - DNA, 19 bp, Homo sapiens
gcctagtggggtctccctc

SEQ ID NO: 3894192 - DNA, 14 bp, Homo sapiens
gcctatccatcctg

SEQ ID NO: 3894193 - DNA, 16 bp, Homo sapiens
gcctatgacttgggca

SEQ ID NO: 3894194 - DNA, 13 bp, Homo sapiens
gcctatggagagc

SEQ ID NO: 3894195 - DNA, 17 bp, Homo sapiens
gcctatggagagccctg

SEQ ID NO: 3894196 - DNA, 19 bp, Homo sapiens
gcctatggagagccctggg

SEQ ID NO: 3894197 - DNA, 20 bp, Homo sapiens
gcctatggagagccctggga

SEQ ID NO: 3894198 - DNA, 15 bp, Homo sapiens
gcctattatattaaa

SEQ ID NO: 3894199 - DNA, 17 bp, Homo sapiens
gcctatttattcattca

SEQ ID NO: 3894200 - DNA, 18 bp, Homo sapiens
gcctatttattggggtgc

SEQ ID NO: 3894201 - DNA, 22 bp, Homo sapiens
gcctcaatgtgaatcagaccct

SEQ ID NO: 3894202 - DNA, 21 bp, Homo sapiens
gcctcaatgtggttgcaaggc

SEQ ID NO: 3894203 - DNA, 16 bp, Homo sapiens
gcctcacacccagagg

SEQ ID NO: 3894204 - DNA, 15 bp, Homo sapiens
gcctcacagaagaat

SEQ ID NO: 3894205 - DNA, 16 bp, Homo sapiens
gcctcacagaagaata

SEQ ID NO: 3894206 - DNA, 19 bp, Homo sapiens
gcctcactattacttgaac

SEQ ID NO: 3894207 - DNA, 13 bp, Homo sapiens
gcctcactggctg

SEQ ID NO: 3894208 - DNA, 14 bp, Homo sapiens
gcctcacttccctg

SEQ ID NO: 3894209 - DNA, 20 bp, Homo sapiens
gcctcagaccaactctctcc

SEQ ID NO: 3894210 - DNA, 17 bp, Homo sapiens
gcctcagcaggaacctg

SEQ ID NO: 3894211 - DNA, 12 bp, Homo sapiens
gcctcagccctc

SEQ ID NO: 3894212 - DNA, 14 bp, Homo sapiens
gcctcagccctcag

SEQ ID NO: 3894213 - DNA, 18 bp, Homo sapiens
gcctcagctcagcctccc

SEQ ID NO: 3894214 - DNA, 11 bp, Homo sapiens
gcctcagtttc

SEQ ID NO: 3894215 - DNA, 16 bp, Homo sapiens
gcctcagtttccccat

SEQ ID NO: 3894216 - DNA, 20 bp, Homo sapiens
gcctcagtttccccatttgt

SEQ ID NO: 3894217 - DNA, 16 bp, Homo sapiens
gcctcagtttctccat

SEQ ID NO: 3894218 - DNA, 22 bp, Homo sapiens
gcctcagtttctccatcagctt

SEQ ID NO: 3894219 - DNA, 12 bp, Homo sapiens
gcctcatccctc

SEQ ID NO: 3894220 - DNA, 14 bp, Homo sapiens
gcctcatccctcgg

SEQ ID NO: 3894221 - DNA, 17 bp, Homo sapiens
gcctcatccctcggaag

SEQ ID NO: 3894222 - DNA, 14 bp, Homo sapiens
gcctcatgccacac

SEQ ID NO: 3894223 - DNA, 17 bp, Homo sapiens
gcctccaagctccatct

SEQ ID NO: 3894224 - DNA, 12 bp, Homo sapiens
gcctccaccgct

SEQ ID NO: 3894225 - DNA, 18 bp, Homo sapiens
gcctccacgggggcggca

SEQ ID NO: 3894226 - DNA, 20 bp, Homo sapiens
gcctccactcccccacctga

SEQ ID NO: 3894227 - DNA, 22 bp, Homo sapiens
gcctccactcccccacctgaca

SEQ ID NO: 3894228 - DNA, 22 bp, Homo sapiens
gcctccagagccagcctgggac

SEQ ID NO: 3894229 - DNA, 12 bp, Homo sapiens
gcctccagcctc

SEQ ID NO: 3894230 - DNA, 13 bp, Homo sapiens
gcctccagcctct

SEQ ID NO: 3894231 - DNA, 14 bp, Homo sapiens
gcctccagcctctc

SEQ ID NO: 3894232 - DNA, 18 bp, Homo sapiens
gcctccagcctctcccgg

SEQ ID NO: 3894233 - DNA, 16 bp, Homo sapiens
gcctccattctgacca

SEQ ID NO: 3894234 - DNA, 12 bp, Homo sapiens
gcctcccagagt

SEQ ID NO: 3894235 - DNA, 10 bp, Homo sapiens
gcctcccagc

SEQ ID NO: 3894236 - DNA, 22 bp, Homo sapiens
gcctcccagccctgccaggagg

SEQ ID NO: 3894237 - DNA, 14 bp, Homo sapiens
gcctcccagcctgg

SEQ ID NO: 3894238 - DNA, 13 bp, Homo sapiens
gcctccccctcag

SEQ ID NO: 3894239 - DNA, 18 bp, Homo sapiens
gcctccccctgctgctca

SEQ ID NO: 3894240 - DNA, 13 bp, Homo sapiens
gcctccctctcca

SEQ ID NO: 3894241 - DNA, 23 bp, Homo sapiens
gcctccctctccatatctccttc

SEQ ID NO: 3894242 - DNA, 15 bp, Homo sapiens
gcctccctctgctgt

SEQ ID NO: 3894243 - DNA, 20 bp, Homo sapiens
gcctccgtttatgggccttg

SEQ ID NO: 3894244 - DNA, 22 bp, Homo sapiens
gcctccgtttatgggccttgct

SEQ ID NO: 3894245 - DNA, 23 bp, Homo sapiens
gcctccgtttatgggccttgctt

SEQ ID NO: 3894246 - DNA, 17 bp, Homo sapiens
gcctcctcacccccagc

SEQ ID NO: 3894247 - DNA, 21 bp, Homo sapiens
gcctcctcacccccagctttg

SEQ ID NO: 3894248 - DNA, 16 bp, Homo sapiens
gcctcctgacctgagg

SEQ ID NO: 3894249 - DNA, 13 bp, Homo sapiens
gaggaggaaggca

SEQ ID NO: 3894250 - DNA, 14 bp, Homo sapiens
gaggaggaaggcaa

SEQ ID NO: 3894251 - DNA, 12 bp, Homo sapiens
gaggaggaggaa

SEQ ID NO: 3894252 - DNA, 13 bp, Homo sapiens
gaggaggaggaag

SEQ ID NO: 3894253 - DNA, 14 bp, Homo sapiens
gaggaggaggaagg

SEQ ID NO: 3894254 - DNA, 13 bp, Homo sapiens
gaggagggcatgg

SEQ ID NO: 3894255 - DNA, 16 bp, Homo sapiens
gaggagggtggaggaa

SEQ ID NO: 3894256 - DNA, 17 bp, Homo sapiens
gaggaggtgtcccaagc

SEQ ID NO: 3894257 - DNA, 22 bp, Homo sapiens
gaggaggtgtcccaagctttga

SEQ ID NO: 3894258 - DNA, 18 bp, Homo sapiens
gaggagtagctgagagga

SEQ ID NO: 3894259 - DNA, 19 bp, Homo sapiens
gaggagtccagggcgggag

SEQ ID NO: 3894260 - DNA, 15 bp, Homo sapiens
gaggagtctgaggtc

SEQ ID NO: 3894261 - DNA, 20 bp, Homo sapiens
gaggagtctgaggtcctgag

SEQ ID NO: 3894262 - DNA, 21 bp, Homo sapiens
gaggagtctgaggtcctgagc

SEQ ID NO: 3894263 - DNA, 21 bp, Homo sapiens
gaggatcctcacaggagcaga

SEQ ID NO: 3894264 - DNA, 22 bp, Homo sapiens
gaggatcctcacaggagcagac

SEQ ID NO: 3894265 - DNA, 15 bp, Homo sapiens
gaggatctagcttca

SEQ ID NO: 3894266 - DNA, 21 bp, Homo sapiens
gcaggaacgagcactggccag

SEQ ID NO: 3894267 - DNA, 15 bp, Homo sapiens
gcaggaagagagaga

SEQ ID NO: 3894268 - DNA, 22 bp, Homo sapiens
gcaggaagagagagagagaggt

SEQ ID NO: 3894269 - DNA, 17 bp, Homo sapiens
gcaggaaggatggcaag

SEQ ID NO: 3894270 - DNA, 18 bp, Homo sapiens
gcaggaagtctctcccga

SEQ ID NO: 3894271 - DNA, 23 bp, Homo sapiens
gcaggacacatcccggcctcttc

SEQ ID NO: 3894272 - DNA, 15 bp, Homo sapiens
gcaggacaggagaca

SEQ ID NO: 3894273 - DNA, 17 bp, Homo sapiens
gcaggagcaggaacaga

SEQ ID NO: 3894274 - DNA, 13 bp, Homo sapiens
gcaggaggcctgg

SEQ ID NO: 3894275 - DNA, 14 bp, Homo sapiens
gcaggaggcctggc

SEQ ID NO: 3894276 - DNA, 15 bp, Homo sapiens
gcaggaggcctggcc

SEQ ID NO: 3894277 - DNA, 14 bp, Homo sapiens
gcaggagtagctga

SEQ ID NO: 3894278 - DNA, 16 bp, Homo sapiens
gcaggagtagctgagc

SEQ ID NO: 3894279 - DNA, 21 bp, Homo sapiens
gcaggagtagctgagctcaca

SEQ ID NO: 3894280 - DNA, 18 bp, Homo sapiens
gcaggcacacagcagccc

SEQ ID NO: 3894281 - DNA, 20 bp, Homo sapiens
gcaggcacctagcaattcca

SEQ ID NO: 3894282 - DNA, 13 bp, Homo sapiens
gcaggcagggctc

SEQ ID NO: 3894283 - DNA, 19 bp, Homo sapiens
gcaggcagggctctcctgg

SEQ ID NO: 3894284 - DNA, 22 bp, Homo sapiens
gcaggcagggctctcctggctt

SEQ ID NO: 3894285 - DNA, 16 bp, Homo sapiens
gcaggcccgacagaga

SEQ ID NO: 3894286 - DNA, 19 bp, Homo sapiens
gcaggcctgggacccagct

SEQ ID NO: 3894287 - DNA, 22 bp, Homo sapiens
gcaggcctgggacccagctact

SEQ ID NO: 3894288 - DNA, 14 bp, Homo sapiens
gcaggctctgggct

SEQ ID NO: 3894289 - DNA, 20 bp, Homo sapiens
gcaggctctgggctcagggc

SEQ ID NO: 3894290 - DNA, 21 bp, Homo sapiens
gcaggctctgggctcagggct

SEQ ID NO: 3894291 - DNA, 22 bp, Homo sapiens
gcaggctctgggctcagggctg

SEQ ID NO: 3894292 - DNA, 22 bp, Homo sapiens
gcagggaaaggctctgaaagcc

SEQ ID NO: 3894293 - DNA, 14 bp, Homo sapiens
gcagggacaccccc

SEQ ID NO: 3894294 - DNA, 22 bp, Homo sapiens
gcagggacaccccccgcccccc

SEQ ID NO: 3894295 - DNA, 17 bp, Homo sapiens
gcagggacggggactgg

SEQ ID NO: 3894296 - DNA, 19 bp, Homo sapiens
gcagggagcaactctccac

SEQ ID NO: 3894297 - DNA, 21 bp, Homo sapiens
gcagggagcatggctgtgagg

SEQ ID NO: 3894298 - DNA, 16 bp, Homo sapiens
gcagggaggatgccac

SEQ ID NO: 3894299 - DNA, 20 bp, Homo sapiens
gcagggaggatgccacagcc

SEQ ID NO: 3894300 - DNA, 21 bp, Homo sapiens
gcagggaggatgccacagccc

SEQ ID NO: 3894301 - DNA, 23 bp, Homo sapiens
gcagggaggatgccacagcccca

SEQ ID NO: 3894302 - DNA, 13 bp, Homo sapiens
gcagggaggggac

SEQ ID NO: 3894303 - DNA, 15 bp, Homo sapiens
gcagggaggggacta

SEQ ID NO: 3894304 - DNA, 14 bp, Homo sapiens
gcagggatttgagg

SEQ ID NO: 3894305 - DNA, 23 bp, Homo sapiens
gcagggcaaatgacatgcactga

SEQ ID NO: 3894306 - DNA, 15 bp, Homo sapiens
gcagggcagagggaa

SEQ ID NO: 3894307 - DNA, 21 bp, Homo sapiens
gcagggccttgcccagagatg

SEQ ID NO: 3894308 - DNA, 19 bp, Homo sapiens
gcaggggtccttggtgtga

SEQ ID NO: 3894309 - DNA, 17 bp, Homo sapiens
gcaggggtctgagccac

SEQ ID NO: 3894310 - DNA, 15 bp, Homo sapiens
gcaggggtgggagag

SEQ ID NO: 3894311 - DNA, 14 bp, Homo sapiens
gcaggtaccactga

SEQ ID NO: 3894312 - DNA, 24 bp, Homo sapiens
gcaggtacttcctcctgatggcca

SEQ ID NO: 3894313 - DNA, 20 bp, Homo sapiens
gcaggtagatcgcttgagcc

SEQ ID NO: 3894314 - DNA, 22 bp, Homo sapiens
gcaggtagatcgcttgagccca

SEQ ID NO: 3894315 - DNA, 23 bp, Homo sapiens
gcaggtagatcgcttgagcccag

SEQ ID NO: 3894316 - DNA, 20 bp, Homo sapiens
gcaggtgtggtggctcatgg

SEQ ID NO: 3894317 - DNA, 23 bp, Homo sapiens
gcaggttcttgatgtcatgtact

SEQ ID NO: 3894318 - DNA, 18 bp, Homo sapiens
gcagtaaactttctctgc

SEQ ID NO: 3894319 - DNA, 19 bp, Homo sapiens
gcagtaaatccacagccaa

SEQ ID NO: 3894320 - DNA, 15 bp, Homo sapiens
gcagtaagtcttttt

SEQ ID NO: 3894321 - DNA, 17 bp, Homo sapiens
gcagtatgaatgatgtt

SEQ ID NO: 3894322 - DNA, 23 bp, Homo sapiens
gcagtattgccacaatgcctctc

SEQ ID NO: 3894323 - DNA, 13 bp, Homo sapiens
gcagtccccagcc

SEQ ID NO: 3894324 - DNA, 14 bp, Homo sapiens
gcagtccccagccc

SEQ ID NO: 3894325 - DNA, 17 bp, Homo sapiens
gcagtcccgtggagggt

SEQ ID NO: 3894326 - DNA, 15 bp, Homo sapiens
gcagtctcagaaagc

SEQ ID NO: 3894327 - DNA, 13 bp, Homo sapiens
gcagtctgaaccc

SEQ ID NO: 3894328 - DNA, 14 bp, Homo sapiens
gcagtctgaaccct

SEQ ID NO: 3894329 - DNA, 22 bp, Homo sapiens
gcagtctgaacccttgtgcttg

SEQ ID NO: 3894330 - DNA, 23 bp, Homo sapiens
gcagtgaacacactcagcagccc

SEQ ID NO: 3894331 - DNA, 18 bp, Homo sapiens
gcagtgacaagtggaggg

SEQ ID NO: 3894332 - DNA, 19 bp, Homo sapiens
gcagtgacaagtggagggg

SEQ ID NO: 3894333 - DNA, 22 bp, Homo sapiens
gcagtgagaaaaagctcctgtc

SEQ ID NO: 3894334 - DNA, 16 bp, Homo sapiens
gcagtgagcttctatt

SEQ ID NO: 3894335 - DNA, 21 bp, Homo sapiens
gcagtgatggcgcgggaggca

SEQ ID NO: 3894336 - DNA, 20 bp, Homo sapiens
gcagtgcaagagactctggc

SEQ ID NO: 3894337 - DNA, 16 bp, Homo sapiens
gcagtgcctcctggga

SEQ ID NO: 3894338 - DNA, 18 bp, Homo sapiens
gcagtgcctcctgggacc

SEQ ID NO: 3894339 - DNA, 17 bp, Homo sapiens
gcagtgcctcgaggcac

SEQ ID NO: 3894340 - DNA, 18 bp, Homo sapiens
gcagtgcctcgaggcacc

SEQ ID NO: 3894341 - DNA, 21 bp, Homo sapiens
gcagtggagagtgttcctgtt

SEQ ID NO: 3894342 - DNA, 22 bp, Homo sapiens
gcagtggccgcaagcgcaggga

SEQ ID NO: 3894343 - DNA, 23 bp, Homo sapiens
gcagtggccgcaagcgcagggag

SEQ ID NO: 3894344 - DNA, 18 bp, Homo sapiens
gcagttaatggggtagag

SEQ ID NO: 3894345 - DNA, 15 bp, Homo sapiens
gcagttccatgaaga

SEQ ID NO: 3894346 - DNA, 13 bp, Homo sapiens
gcagttcctgagt

SEQ ID NO: 3894347 - DNA, 16 bp, Homo sapiens
gcagttcgcagccacc

SEQ ID NO: 3894348 - DNA, 22 bp, Homo sapiens
gcagttgaatgacaacagaagc

SEQ ID NO: 3894349 - DNA, 15 bp, Homo sapiens
gcagttttccaggaa

SEQ ID NO: 3894350 - DNA, 16 bp, Homo sapiens
gcataagattaaagga

SEQ ID NO: 3894351 - DNA, 20 bp, Homo sapiens
gcatacctttattgtgatct

SEQ ID NO: 3894352 - DNA, 18 bp, Homo sapiens
gcatagaaactgaggagt

SEQ ID NO: 3894353 - DNA, 21 bp, Homo sapiens
gcatagaaactgaggagtagc

SEQ ID NO: 3894354 - DNA, 23 bp, Homo sapiens
gcatagggaatatgtaagtcagg

SEQ ID NO: 3894355 - DNA, 16 bp, Homo sapiens
gcatatcggaggtggt

SEQ ID NO: 3894356 - DNA, 23 bp, Homo sapiens
gcatatcggaggtggtggaggag

SEQ ID NO: 3894357 - DNA, 16 bp, Homo sapiens
gcatcaagggctttat

SEQ ID NO: 3894358 - DNA, 17 bp, Homo sapiens
gcatcagaaagaggcag

SEQ ID NO: 3894359 - DNA, 22 bp, Homo sapiens
gcatcagaaagggagggctctg

SEQ ID NO: 3894360 - DNA, 22 bp, Homo sapiens
gcatcagctgctgaaacaacaa

SEQ ID NO: 3894361 - DNA, 18 bp, Homo sapiens
gcatcaggcactggtggc

SEQ ID NO: 3894362 - DNA, 16 bp, Homo sapiens
gcatccacccagtgct

SEQ ID NO: 3894363 - DNA, 17 bp, Homo sapiens
gcatccacccagtgctg

SEQ ID NO: 3894364 - DNA, 14 bp, Homo sapiens
gcatccagcctgtg

SEQ ID NO: 3894365 - DNA, 15 bp, Homo sapiens
gcatccagcctgtgt

SEQ ID NO: 3894366 - DNA, 17 bp, Homo sapiens
gcatccagcctgtgtgt

SEQ ID NO: 3894367 - DNA, 16 bp, Homo sapiens
gcatccattcctcagg

SEQ ID NO: 3894368 - DNA, 14 bp, Homo sapiens
gcatcccaggggac

SEQ ID NO: 3894369 - DNA, 19 bp, Homo sapiens
gcatcccaggggaccacac

SEQ ID NO: 3894370 - DNA, 20 bp, Homo sapiens
gcatccccttggctgtgagg

SEQ ID NO: 3894371 - DNA, 21 bp, Homo sapiens
gcatccccttggctgtgaggc

SEQ ID NO: 3894372 - DNA, 17 bp, Homo sapiens
gcatccgtagttccctg

SEQ ID NO: 3894373 - DNA, 19 bp, Homo sapiens
gcatcctaaagataaagcc

SEQ ID NO: 3894374 - DNA, 20 bp, Homo sapiens
gcatcctaaagataaagcca

SEQ ID NO: 3894375 - DNA, 17 bp, Homo sapiens
gcatcctcctcccaact

SEQ ID NO: 3894376 - DNA, 18 bp, Homo sapiens
gcatcgtgacccttcagg

SEQ ID NO: 3894377 - DNA, 19 bp, Homo sapiens
gcatcgtgacccttcaggg

SEQ ID NO: 3894378 - DNA, 22 bp, Homo sapiens
gcatcgtgacccttcagggcca

SEQ ID NO: 3894379 - DNA, 13 bp, Homo sapiens
gcatctcagccca

SEQ ID NO: 3894380 - DNA, 19 bp, Homo sapiens
gcatctcgtgccagggcag

SEQ ID NO: 3894381 - DNA, 20 bp, Homo sapiens
gcatctgggattcccaccaa

SEQ ID NO: 3894382 - DNA, 23 bp, Homo sapiens
gcatctgggattcccaccaaggt

SEQ ID NO: 3894383 - DNA, 19 bp, Homo sapiens
gcatgagggatcacagggc

SEQ ID NO: 3894384 - DNA, 20 bp, Homo sapiens
gcatgagggatcacagggcc

SEQ ID NO: 3894385 - DNA, 23 bp, Homo sapiens
gcatgagtgctggatattttact

SEQ ID NO: 3894386 - DNA, 15 bp, Homo sapiens
gcatgatttatatat

SEQ ID NO: 3894387 - DNA, 14 bp, Homo sapiens
gcatgattttatac

SEQ ID NO: 3894388 - DNA, 15 bp, Homo sapiens
gcatgattttataca

SEQ ID NO: 3894389 - DNA, 17 bp, Homo sapiens
gcatgattttatacata

SEQ ID NO: 3894390 - DNA, 17 bp, Homo sapiens
gcatgcaataatgtgca

SEQ ID NO: 3894391 - DNA, 17 bp, Homo sapiens
gcatgctctctgcagcc

SEQ ID NO: 3894392 - DNA, 18 bp, Homo sapiens
gcatgctctctgcagcca

SEQ ID NO: 3894393 - DNA, 21 bp, Homo sapiens
gcatgctctctgcagccagcc

SEQ ID NO: 3894394 - DNA, 15 bp, Homo sapiens
gcatgctctggaagc

SEQ ID NO: 3894395 - DNA, 18 bp, Homo sapiens
gcatgctctggaagcctg

SEQ ID NO: 3894396 - DNA, 13 bp, Homo sapiens
gcatggaatttgt

SEQ ID NO: 3894397 - DNA, 15 bp, Homo sapiens
gcatggagaataaac

SEQ ID NO: 3894398 - DNA, 19 bp, Homo sapiens
gcatggagagcctcttagt

SEQ ID NO: 3894399 - DNA, 15 bp, Homo sapiens
gcatggatttctgtc

SEQ ID NO: 3894400 - DNA, 15 bp, Homo sapiens
gcatggctgtgagga

SEQ ID NO: 3894401 - DNA, 19 bp, Homo sapiens
gcatggcttggggagcaga

SEQ ID NO: 3894402 - DNA, 21 bp, Homo sapiens
gcatggcttggggagcagagt

SEQ ID NO: 3894403 - DNA, 21 bp, Homo sapiens
gcatgggagggagggagaggt

SEQ ID NO: 3894404 - DNA, 15 bp, Homo sapiens
gcatgggtgtgccct

SEQ ID NO: 3894405 - DNA, 20 bp, Homo sapiens
gcatggtcccacatccctgg

SEQ ID NO: 3894406 - DNA, 23 bp, Homo sapiens
gcatggtcctggaggatgaccag

SEQ ID NO: 3894407 - DNA, 21 bp, Homo sapiens
gcatggttccttccctgggaa

SEQ ID NO: 3894408 - DNA, 14 bp, Homo sapiens
gcatgtaaaatgca

SEQ ID NO: 3894409 - DNA, 22 bp, Homo sapiens
gcatgtaaaatgcagtccagaa

SEQ ID NO: 3894410 - DNA, 23 bp, Homo sapiens
gcatgtaaaatgcagtccagaat

SEQ ID NO: 3894411 - DNA, 19 bp, Homo sapiens
gcatgtacaaaagtaccat

SEQ ID NO: 3894412 - DNA, 23 bp, Homo sapiens
gcatgtccctaccgagtctcttc

SEQ ID NO: 3894413 - DNA, 11 bp, Homo sapiens
gcatgtggaga

SEQ ID NO: 3894414 - DNA, 13 bp, Homo sapiens
gcatgtgtgcctg

SEQ ID NO: 3894415 - DNA, 13 bp, Homo sapiens
gcatgtgtgtata

SEQ ID NO: 3894416 - DNA, 19 bp, Homo sapiens
gcatgtgtgtgtctgtctt

SEQ ID NO: 3894417 - DNA, 15 bp, Homo sapiens
gcattacgtgagcca

SEQ ID NO: 3894418 - DNA, 21 bp, Homo sapiens
gcattaggcttttaagaaaca

SEQ ID NO: 3894419 - DNA, 17 bp, Homo sapiens
gcattatttaatgtttg

SEQ ID NO: 3894420 - DNA, 23 bp, Homo sapiens
gcattatttaatgtttgatttag

SEQ ID NO: 3894421 - DNA, 21 bp, Homo sapiens
gcattcagcacaccccaaggg

SEQ ID NO: 3894422 - DNA, 15 bp, Homo sapiens
gcattccatgatttt

SEQ ID NO: 3894423 - DNA, 17 bp, Homo sapiens
gcattccatgattttac

SEQ ID NO: 3894424 - DNA, 13 bp, Homo sapiens
gcattccccgctg

SEQ ID NO: 3894425 - DNA, 18 bp, Homo sapiens
gcattccccgctgcccaa

SEQ ID NO: 3894426 - DNA, 16 bp, Homo sapiens
gcattcctacaaagat

SEQ ID NO: 3894427 - DNA, 16 bp, Homo sapiens
gcattgggctgacacc

SEQ ID NO: 3894428 - DNA, 17 bp, Homo sapiens
gcattggtctgctgacc

SEQ ID NO: 3894429 - DNA, 19 bp, Homo sapiens
gcatttccacactgtcaga

SEQ ID NO: 3894430 - DNA, 22 bp, Homo sapiens
gcatttccacactgtcagagct

SEQ ID NO: 3894431 - DNA, 13 bp, Homo sapiens
gcatttcctgggt

SEQ ID NO: 3894432 - DNA, 14 bp, Homo sapiens
gcatttcctgggtg

SEQ ID NO: 3894433 - DNA, 18 bp, Homo sapiens
gcattttactacttgtta

SEQ ID NO: 3894434 - DNA, 12 bp, Homo sapiens
gcattttattct

SEQ ID NO: 3894435 - DNA, 21 bp, Homo sapiens
gcatttttgatttatgcatgg

SEQ ID NO: 3894436 - DNA, 13 bp, Homo sapiens
gccaaaaaggacc

SEQ ID NO: 3894437 - DNA, 15 bp, Homo sapiens
gccaaaagggcagcc

SEQ ID NO: 3894438 - DNA, 17 bp, Homo sapiens
gccaaaagggcagccag

SEQ ID NO: 3894439 - DNA, 18 bp, Homo sapiens
gccaaaagggcagccagg

SEQ ID NO: 3894440 - DNA, 19 bp, Homo sapiens
gccaaaagggcagccaggg

SEQ ID NO: 3894441 - DNA, 16 bp, Homo sapiens
gccaaagcaaaagaag

SEQ ID NO: 3894442 - DNA, 18 bp, Homo sapiens
gccaaattatttgtgtaa

SEQ ID NO: 3894443 - DNA, 20 bp, Homo sapiens
gccaacagtcaaaacagaga

SEQ ID NO: 3894444 - DNA, 22 bp, Homo sapiens
gccaacatacccttctttaaat

SEQ ID NO: 3894445 - DNA, 14 bp, Homo sapiens
gccaacatggtgaa

SEQ ID NO: 3894446 - DNA, 15 bp, Homo sapiens
gccaaccaagagcac

SEQ ID NO: 3894447 - DNA, 20 bp, Homo sapiens
gccaacgcacgcaacccttg

SEQ ID NO: 3894448 - DNA, 16 bp, Homo sapiens
gccaactaagccctcg

SEQ ID NO: 3894449 - DNA, 18 bp, Homo sapiens
gccaacttgtaaatacac

SEQ ID NO: 3894450 - DNA, 22 bp, Homo sapiens
gccaagagagacattgcctcca

SEQ ID NO: 3894451 - DNA, 22 bp, Homo sapiens
gccaagccctccccatcccatg

SEQ ID NO: 3894452 - DNA, 17 bp, Homo sapiens
gccaagctgaagtgaag

SEQ ID NO: 3894453 - DNA, 14 bp, Homo sapiens
gccaagctgaggtg

SEQ ID NO: 3894454 - DNA, 22 bp, Homo sapiens
gccaagctgaggtgcccaggag

SEQ ID NO: 3894455 - DNA, 15 bp, Homo sapiens
gccaaggcaggtaga

SEQ ID NO: 3894456 - DNA, 23 bp, Homo sapiens
gccaaggtgtttccatttctcaa

SEQ ID NO: 3894457 - DNA, 16 bp, Homo sapiens
gccaagtccaggtcct

SEQ ID NO: 3894458 - DNA, 17 bp, Homo sapiens
gccaagtccaggtcctg

SEQ ID NO: 3894459 - DNA, 19 bp, Homo sapiens
gccaatggagactgtctca

SEQ ID NO: 3894460 - DNA, 21 bp, Homo sapiens
gccaatggagactgtctcaag

SEQ ID NO: 3894461 - DNA, 20 bp, Homo sapiens
gccacaaatcaaagcaaggg

SEQ ID NO: 3894462 - DNA, 20 bp, Homo sapiens
gccacaatgcctctcccacg

SEQ ID NO: 3894463 - DNA, 17 bp, Homo sapiens
gccacacttctcaggac

SEQ ID NO: 3894464 - DNA, 22 bp, Homo sapiens
gccacacttctcaggacacagg

SEQ ID NO: 3894465 - DNA, 19 bp, Homo sapiens
gccacagaagccaggagca

SEQ ID NO: 3894466 - DNA, 12 bp, Homo sapiens
gccacagcccca

SEQ ID NO: 3894467 - DNA, 13 bp, Homo sapiens
gccacagccccac

SEQ ID NO: 3894468 - DNA, 18 bp, Homo sapiens
gccacagccccacagcac

SEQ ID NO: 3894469 - DNA, 22 bp, Homo sapiens
gccacagccccacagcacccag

SEQ ID NO: 3894470 - DNA, 14 bp, Homo sapiens
gccaccaataaaaa

SEQ ID NO: 3894471 - DNA, 15 bp, Homo sapiens
gccaccacgtctgcc

SEQ ID NO: 3894472 - DNA, 16 bp, Homo sapiens
gccaccacgtctgcca

SEQ ID NO: 3894473 - DNA, 18 bp, Homo sapiens
gccaccacgtctgccagg

SEQ ID NO: 3894474 - DNA, 19 bp, Homo sapiens
gccaccacgtctgccaggc

SEQ ID NO: 3894475 - DNA, 22 bp, Homo sapiens
gccaccacgtctgccaggccca

SEQ ID NO: 3894476 - DNA, 12 bp, Homo sapiens
gccaccatcctg

SEQ ID NO: 3894477 - DNA, 17 bp, Homo sapiens
gccacccaacagcacca

SEQ ID NO: 3894478 - DNA, 15 bp, Homo sapiens
gccaccccgtgccac

SEQ ID NO: 3894479 - DNA, 21 bp, Homo sapiens
gccacccgtaggcagcctctc

SEQ ID NO: 3894480 - DNA, 21 bp, Homo sapiens
gccacccgttctgctggcctg

SEQ ID NO: 3894481 - DNA, 23 bp, Homo sapiens
gccacccgttctgctggcctgga

SEQ ID NO: 3894482 - DNA, 18 bp, Homo sapiens
gccaccctccttcccgcc

SEQ ID NO: 3894483 - DNA, 17 bp, Homo sapiens
gccaccctctccatgcc

SEQ ID NO: 3894484 - DNA, 16 bp, Homo sapiens
gccaccctgaggagtc

SEQ ID NO: 3894485 - DNA, 23 bp, Homo sapiens
gccaccctgaggagtctgaggtc

SEQ ID NO: 3894486 - DNA, 13 bp, Homo sapiens
gccaccctggccc

SEQ ID NO: 3894487 - DNA, 18 bp, Homo sapiens
gccaccggggaacccagc

SEQ ID NO: 3894488 - DNA, 15 bp, Homo sapiens
gccacctcccacccc

SEQ ID NO: 3894489 - DNA, 20 bp, Homo sapiens
gccacctcccaccccactcc

SEQ ID NO: 3894490 - DNA, 17 bp, Homo sapiens
gccacctcccctatcca

SEQ ID NO: 3894491 - DNA, 22 bp, Homo sapiens
gccacctcccctatccacccag

SEQ ID NO: 3894492 - DNA, 12 bp, Homo sapiens
gccacctgtctg

SEQ ID NO: 3894493 - DNA, 13 bp, Homo sapiens
gccacgctgtcct

SEQ ID NO: 3894494 - DNA, 18 bp, Homo sapiens
gccacgctgtcctctcga

SEQ ID NO: 3894495 - DNA, 21 bp, Homo sapiens
gccacgctgtcctctcgagcc

SEQ ID NO: 3894496 - DNA, 17 bp, Homo sapiens
gccacggccaccctcct

SEQ ID NO: 3894497 - DNA, 16 bp, Homo sapiens
gccacgttccttactg

SEQ ID NO: 3894498 - DNA, 20 bp, Homo sapiens
gccactcatattctgggctc

SEQ ID NO: 3894499 - DNA, 20 bp, Homo sapiens
gccactccagacccctggct

SEQ ID NO: 3894500 - DNA, 16 bp, Homo sapiens
gccactccctgagctt

SEQ ID NO: 3894501 - DNA, 13 bp, Homo sapiens
gccactcctgtcc

SEQ ID NO: 3894502 - DNA, 17 bp, Homo sapiens
gccactcctgtcccgcc

SEQ ID NO: 3894503 - DNA, 18 bp, Homo sapiens
gccactcctgtcccgcct

SEQ ID NO: 3894504 - DNA, 22 bp, Homo sapiens
gccactcctgtcccgccttcct

SEQ ID NO: 3894505 - DNA, 15 bp, Homo sapiens
gccactccttcctgc

SEQ ID NO: 3894506 - DNA, 18 bp, Homo sapiens
gccactccttcctgcccc

SEQ ID NO: 3894507 - DNA, 18 bp, Homo sapiens
gccactcgcagtcgcagg

SEQ ID NO: 3894508 - DNA, 22 bp, Homo sapiens
gccactcgcagtcgcaggatcc

SEQ ID NO: 3894509 - DNA, 15 bp, Homo sapiens
gccactctcccctcc

SEQ ID NO: 3894510 - DNA, 15 bp, Homo sapiens
gccactgcactccgg

SEQ ID NO: 3894511 - DNA, 14 bp, Homo sapiens
gccactgccaggca

SEQ ID NO: 3894512 - DNA, 21 bp, Homo sapiens
gccactgccaggcacctggcc

SEQ ID NO: 3894513 - DNA, 16 bp, Homo sapiens
gccactgcctcttcct

SEQ ID NO: 3894514 - DNA, 20 bp, Homo sapiens
gccactgctttccagcctgg

SEQ ID NO: 3894515 - DNA, 12 bp, Homo sapiens
gccactgtggcc

SEQ ID NO: 3894516 - DNA, 16 bp, Homo sapiens
gccactgtggccagag

SEQ ID NO: 3894517 - DNA, 20 bp, Homo sapiens
gccactgtggccagagctgg

SEQ ID NO: 3894518 - DNA, 21 bp, Homo sapiens
gccactgtggccagagctgga

SEQ ID NO: 3894519 - DNA, 22 bp, Homo sapiens
gccacttcttaaaggcctggaa

SEQ ID NO: 3894520 - DNA, 21 bp, Homo sapiens
gccacttgatgacccccaacc

SEQ ID NO: 3894521 - DNA, 20 bp, Homo sapiens
gccacttggtttttggctct

SEQ ID NO: 3894522 - DNA, 22 bp, Homo sapiens
gccactttaagagagaaatctg

SEQ ID NO: 3894523 - DNA, 16 bp, Homo sapiens
gccactttggcttctc

SEQ ID NO: 3894524 - DNA, 20 bp, Homo sapiens
gccactttggcttctcctgt

SEQ ID NO: 3894525 - DNA, 22 bp, Homo sapiens
gccactttggcttctcctgtga

SEQ ID NO: 3894526 - DNA, 23 bp, Homo sapiens
gccagaaactccttttgctgtct

SEQ ID NO: 3894527 - DNA, 17 bp, Homo sapiens
gccagaacctggagggc

SEQ ID NO: 3894528 - DNA, 13 bp, Homo sapiens
gccagaacttcga

SEQ ID NO: 3894529 - DNA, 17 bp, Homo sapiens
gccagaaggagggcaga

SEQ ID NO: 3894530 - DNA, 18 bp, Homo sapiens
gccagaaggagggcagag

SEQ ID NO: 3894531 - DNA, 20 bp, Homo sapiens
gccagaaggagggcagagcc

SEQ ID NO: 3894532 - DNA, 21 bp, Homo sapiens
gccagaagtttgtcaagtcaa

SEQ ID NO: 3894533 - DNA, 16 bp, Homo sapiens
gccagacacagataca

SEQ ID NO: 3894534 - DNA, 17 bp, Homo sapiens
gccagagaggagcacct

SEQ ID NO: 3894535 - DNA, 19 bp, Homo sapiens
gccagagaggagcacctga

SEQ ID NO: 3894536 - DNA, 14 bp, Homo sapiens
gccagagagggccc

SEQ ID NO: 3894537 - DNA, 15 bp, Homo sapiens
gccagagagggccca

SEQ ID NO: 3894538 - DNA, 17 bp, Homo sapiens
gccagagagggcccagc

SEQ ID NO: 3894539 - DNA, 18 bp, Homo sapiens
gccagagagggcccagct

SEQ ID NO: 3894540 - DNA, 19 bp, Homo sapiens
gccagagagggcccagctg

SEQ ID NO: 3894541 - DNA, 20 bp, Homo sapiens
gccagagagggcccagctgt

SEQ ID NO: 3894542 - DNA, 20 bp, Homo sapiens
gccagagcccaagtgccatc

SEQ ID NO: 3894543 - DNA, 21 bp, Homo sapiens
gccagagcccaagtgccatcc

SEQ ID NO: 3894544 - DNA, 15 bp, Homo sapiens
gccagagcctggggc

SEQ ID NO: 3894545 - DNA, 16 bp, Homo sapiens
gccagagcctggggct

SEQ ID NO: 3894546 - DNA, 20 bp, Homo sapiens
gccagagctggaaggcaggg

SEQ ID NO: 3894547 - DNA, 22 bp, Homo sapiens
gccagagctggaaggcagggca

SEQ ID NO: 3894548 - DNA, 15 bp, Homo sapiens
gccagatccacccta

SEQ ID NO: 3894549 - DNA, 16 bp, Homo sapiens
gccagcaacacagagc

SEQ ID NO: 3894550 - DNA, 17 bp, Homo sapiens
gccagcaacacagagca

SEQ ID NO: 3894551 - DNA, 24 bp, Homo sapiens
gccagcacaggggccccagatctg

SEQ ID NO: 3894552 - DNA, 17 bp, Homo sapiens
gccagcaccctctcctg

SEQ ID NO: 3894553 - DNA, 12 bp, Homo sapiens
gccagcagcaga

SEQ ID NO: 3894554 - DNA, 17 bp, Homo sapiens
gccagccatcacaaggg

SEQ ID NO: 3894555 - DNA, 22 bp, Homo sapiens
gccagccctacatcttcagctc

SEQ ID NO: 3894556 - DNA, 23 bp, Homo sapiens
gccagccctacatcttcagctcc

SEQ ID NO: 3894557 - DNA, 15 bp, Homo sapiens
gccagccctccctgt

SEQ ID NO: 3894558 - DNA, 22 bp, Homo sapiens
gccagccctccctgtcctcctc

SEQ ID NO: 3894559 - DNA, 23 bp, Homo sapiens
gccagccctccctgtcctcctcg

SEQ ID NO: 3894560 - DNA, 23 bp, Homo sapiens
gccagccctgcctggaggacctg

SEQ ID NO: 3894561 - DNA, 15 bp, Homo sapiens
gccagccgccctggg

SEQ ID NO: 3894562 - DNA, 20 bp, Homo sapiens
gccagccgccctgggctgtc

SEQ ID NO: 3894563 - DNA, 17 bp, Homo sapiens
gccagccggtgcctggc

SEQ ID NO: 3894564 - DNA, 21 bp, Homo sapiens
gccagccgtgatgctcaggct

SEQ ID NO: 3894565 - DNA, 19 bp, Homo sapiens
gccagcctcagtgccactt

SEQ ID NO: 3894566 - DNA, 13 bp, Homo sapiens
gccagcctggcct

SEQ ID NO: 3894567 - DNA, 14 bp, Homo sapiens
gccagcctggcctc

SEQ ID NO: 3894568 - DNA, 22 bp, Homo sapiens
gccagcctggcctcctgcctct

SEQ ID NO: 3894569 - DNA, 23 bp, Homo sapiens
gccagcctggcctcctgcctcta

SEQ ID NO: 3894570 - DNA, 12 bp, Homo sapiens
gccagcctggga

SEQ ID NO: 3894571 - DNA, 20 bp, Homo sapiens
gccagcctgggactcccagt

SEQ ID NO: 3894572 - DNA, 21 bp, Homo sapiens
gccagcctgggactcccagtg

SEQ ID NO: 3894573 - DNA, 19 bp, Homo sapiens
gccagccttgcactgtggg

SEQ ID NO: 3894574 - DNA, 21 bp, Homo sapiens
gccagctcaggtgactggagc

SEQ ID NO: 3894575 - DNA, 16 bp, Homo sapiens
gccagctctagttttc

SEQ ID NO: 3894576 - DNA, 14 bp, Homo sapiens
gccagctgcatcta

SEQ ID NO: 3894577 - DNA, 15 bp, Homo sapiens
gccagctgccgacca

SEQ ID NO: 3894578 - DNA, 15 bp, Homo sapiens
gccagctgccttcct

SEQ ID NO: 3894579 - DNA, 22 bp, Homo sapiens
gccagctgccttcctcatcccc

SEQ ID NO: 3894580 - DNA, 15 bp, Homo sapiens
gccagctggtgctgc

SEQ ID NO: 3894581 - DNA, 19 bp, Homo sapiens
gccagctggtgctgcaagg

SEQ ID NO: 3894582 - DNA, 12 bp, Homo sapiens
gccaggacacct

SEQ ID NO: 3894583 - DNA, 19 bp, Homo sapiens
gccaggacacctgccccag

SEQ ID NO: 3894584 - DNA, 22 bp, Homo sapiens
gccaggacacctgccccagcgc

SEQ ID NO: 3894585 - DNA, 15 bp, Homo sapiens
gccaggacaggcccg

SEQ ID NO: 3894586 - DNA, 19 bp, Homo sapiens
gccaggactccccaggcca

SEQ ID NO: 3894587 - DNA, 10 bp, Homo sapiens
gccaggagag

SEQ ID NO: 3894588 - DNA, 17 bp, Homo sapiens
gccaggagctggaggag

SEQ ID NO: 3894589 - DNA, 13 bp, Homo sapiens
gccaggaggctgc

SEQ ID NO: 3894590 - DNA, 17 bp, Homo sapiens
gccaggaggctgcggcc

SEQ ID NO: 3894591 - DNA, 21 bp, Homo sapiens
gccaggaggctgcggcctagg

SEQ ID NO: 3894592 - DNA, 21 bp, Homo sapiens
gccaggagggacaaaggagcc

SEQ ID NO: 3894593 - DNA, 23 bp, Homo sapiens
gccaggagggacaaaggagcctg

SEQ ID NO: 3894594 - DNA, 14 bp, Homo sapiens
gccaggagtctgtg

SEQ ID NO: 3894595 - DNA, 21 bp, Homo sapiens
gccaggcacctggcctgctgg

SEQ ID NO: 3894596 - DNA, 23 bp, Homo sapiens
gccaggcacctggcctgctggga

SEQ ID NO: 3894597 - DNA, 19 bp, Homo sapiens
gccaggcccatctcaggtg

SEQ ID NO: 3894598 - DNA, 21 bp, Homo sapiens
gccaggcccatctcaggtgcc

SEQ ID NO: 3894599 - DNA, 23 bp, Homo sapiens
gccaggcccatctcaggtgccac

SEQ ID NO: 3894600 - DNA, 17 bp, Homo sapiens
gccaggcccggggctgg

SEQ ID NO: 3894601 - DNA, 15 bp, Homo sapiens
gccaggcgttggtgc

SEQ ID NO: 3894602 - DNA, 17 bp, Homo sapiens
gccaggcgttggtgcca

SEQ ID NO: 3894603 - DNA, 13 bp, Homo sapiens
gccaggctctgcc

SEQ ID NO: 3894604 - DNA, 14 bp, Homo sapiens
gccaggctctgcct

SEQ ID NO: 3894605 - DNA, 13 bp, Homo sapiens
gccagggcctggt

SEQ ID NO: 3894606 - DNA, 16 bp, Homo sapiens
gccagggcctggtgtg

SEQ ID NO: 3894607 - DNA, 16 bp, Homo sapiens
gccagggtgagagctg

SEQ ID NO: 3894608 - DNA, 19 bp, Homo sapiens
gccagggtttacccagtgg

SEQ ID NO: 3894609 - DNA, 18 bp, Homo sapiens
gccaggtggccactccag

SEQ ID NO: 3894610 - DNA, 22 bp, Homo sapiens
gccaggttagcctttgccctgt

SEQ ID NO: 3894611 - DNA, 21 bp, Homo sapiens
gccagtaaaaaaaaaaaatgg

SEQ ID NO: 3894612 - DNA, 13 bp, Homo sapiens
gccagtcctagag

SEQ ID NO: 3894613 - DNA, 18 bp, Homo sapiens
gccagtcctagagctcct

SEQ ID NO: 3894614 - DNA, 19 bp, Homo sapiens
gccagtcctagagctcctg

SEQ ID NO: 3894615 - DNA, 17 bp, Homo sapiens
gccagtctgggctgccg

SEQ ID NO: 3894616 - DNA, 19 bp, Homo sapiens
gccagtcttgcctaggcca

SEQ ID NO: 3894617 - DNA, 20 bp, Homo sapiens
gccagtcttgcctaggccaa

SEQ ID NO: 3894618 - DNA, 23 bp, Homo sapiens
gccagtcttgcctaggccaaatg

SEQ ID NO: 3894619 - DNA, 13 bp, Homo sapiens
gccagtgactttt

SEQ ID NO: 3894620 - DNA, 19 bp, Homo sapiens
gccagtgactttttctgag

SEQ ID NO: 3894621 - DNA, 14 bp, Homo sapiens
gccagtgagggctg

SEQ ID NO: 3894622 - DNA, 20 bp, Homo sapiens
gccagtgagggctgggccca

SEQ ID NO: 3894623 - DNA, 20 bp, Homo sapiens
gccagtgccttacctcctgc

SEQ ID NO: 3894624 - DNA, 22 bp, Homo sapiens
gccagtgccttacctcctgccc

SEQ ID NO: 3894625 - DNA, 17 bp, Homo sapiens
gccagtgtaaggcatag

SEQ ID NO: 3894626 - DNA, 22 bp, Homo sapiens
gccagttatggctataggtgct

SEQ ID NO: 3894627 - DNA, 17 bp, Homo sapiens
gccataccgctggggaa

SEQ ID NO: 3894628 - DNA, 13 bp, Homo sapiens
gccatagccccat

SEQ ID NO: 3894629 - DNA, 17 bp, Homo sapiens
gccatcaacaagagttg

SEQ ID NO: 3894630 - DNA, 16 bp, Homo sapiens
gccatcacaaggggaa

SEQ ID NO: 3894631 - DNA, 13 bp, Homo sapiens
gccatcagggtgg

SEQ ID NO: 3894632 - DNA, 23 bp, Homo sapiens
gccatcagggtgggccactctcc

SEQ ID NO: 3894633 - DNA, 17 bp, Homo sapiens
gccatcccgtcttctcc

SEQ ID NO: 3894634 - DNA, 16 bp, Homo sapiens
gccatccctgggcccc

SEQ ID NO: 3894635 - DNA, 19 bp, Homo sapiens
gccatccctgggcccctcc

SEQ ID NO: 3894636 - DNA, 20 bp, Homo sapiens
gccatccctgggcccctcca

SEQ ID NO: 3894637 - DNA, 21 bp, Homo sapiens
gccatccgggacgcttccaga

SEQ ID NO: 3894638 - DNA, 20 bp, Homo sapiens
gccatgaagtcaccgggatg

SEQ ID NO: 3894639 - DNA, 18 bp, Homo sapiens
gccatgatcgagccactg

SEQ ID NO: 3894640 - DNA, 21 bp, Homo sapiens
gccatgatggtgctgacctct

SEQ ID NO: 3894641 - DNA, 22 bp, Homo sapiens
gccatgatggtgctgacctctg

SEQ ID NO: 3894642 - DNA, 14 bp, Homo sapiens
gccatgcaattcat

SEQ ID NO: 3894643 - DNA, 14 bp, Homo sapiens
gccatgccaccctg

SEQ ID NO: 3894644 - DNA, 12 bp, Homo sapiens
gccatgccactg

SEQ ID NO: 3894645 - DNA, 20 bp, Homo sapiens
gccatgccactgccaggcac

SEQ ID NO: 3894646 - DNA, 23 bp, Homo sapiens
gccatgccactgccaggcacctg

SEQ ID NO: 3894647 - DNA, 13 bp, Homo sapiens
gccatgcctcatg

SEQ ID NO: 3894648 - DNA, 19 bp, Homo sapiens
gccatggagttgtgatcat

SEQ ID NO: 3894649 - DNA, 18 bp, Homo sapiens
gccatggctcaggcaagc

SEQ ID NO: 3894650 - DNA, 21 bp, Homo sapiens
gccatggctcaggcaagcccc

SEQ ID NO: 3894651 - DNA, 22 bp, Homo sapiens
gccatggctcaggcaagcccct

SEQ ID NO: 3894652 - DNA, 12 bp, Homo sapiens
gccatgggcctg

SEQ ID NO: 3894653 - DNA, 15 bp, Homo sapiens
gccatgggcctgctg

SEQ ID NO: 3894654 - DNA, 15 bp, Homo sapiens
gccatgggcctgggc

SEQ ID NO: 3894655 - DNA, 17 bp, Homo sapiens
gccatgggcctgggcct

SEQ ID NO: 3894656 - DNA, 21 bp, Homo sapiens
gccatgggcctgggcctgctt

SEQ ID NO: 3894657 - DNA, 15 bp, Homo sapiens
gccatgtggagtgga

SEQ ID NO: 3894658 - DNA, 18 bp, Homo sapiens
gccatgtttggttgtaaa

SEQ ID NO: 3894659 - DNA, 20 bp, Homo sapiens
gccatgtttggttgtaaatg

SEQ ID NO: 3894660 - DNA, 12 bp, Homo sapiens
gccattcccact

SEQ ID NO: 3894661 - DNA, 22 bp, Homo sapiens
gccatttaaagcttattaaaac

SEQ ID NO: 3894662 - DNA, 12 bp, Homo sapiens
gccatttctctg

SEQ ID NO: 3894663 - DNA, 22 bp, Homo sapiens
gccattttcttgcctgaggctc

SEQ ID NO: 3894664 - DNA, 17 bp, Homo sapiens
gccattttttgaggaga

SEQ ID NO: 3894665 - DNA, 17 bp, Homo sapiens
gcccaaagtctgtgtga

SEQ ID NO: 3894666 - DNA, 14 bp, Homo sapiens
gcccaaatttttct

SEQ ID NO: 3894667 - DNA, 20 bp, Homo sapiens
gcccaaccctgcccacttca

SEQ ID NO: 3894668 - DNA, 14 bp, Homo sapiens
gcccaacctgctct

SEQ ID NO: 3894669 - DNA, 17 bp, Homo sapiens
gcccaagaggtctgagc

SEQ ID NO: 3894670 - DNA, 19 bp, Homo sapiens
gcccaagaggtctgagccc

SEQ ID NO: 3894671 - DNA, 22 bp, Homo sapiens
gcccaagcctggtctcctccca

SEQ ID NO: 3894672 - DNA, 13 bp, Homo sapiens
gcccaaggctgca

SEQ ID NO: 3894673 - DNA, 13 bp, Homo sapiens
gcccaaggggact

SEQ ID NO: 3894674 - DNA, 21 bp, Homo sapiens
gcccaaggggacttgtgccag

SEQ ID NO: 3894675 - DNA, 20 bp, Homo sapiens
gcccaaggttaaaaagttca

SEQ ID NO: 3894676 - DNA, 14 bp, Homo sapiens
gcccacaaactgat

SEQ ID NO: 3894677 - DNA, 20 bp, Homo sapiens
gcccacaagccttactcacc

SEQ ID NO: 3894678 - DNA, 14 bp, Homo sapiens
gcccacacccctcc

SEQ ID NO: 3894679 - DNA, 12 bp, Homo sapiens
gcccacagggaa

SEQ ID NO: 3894680 - DNA, 17 bp, Homo sapiens
gcccaccaacatcccat

SEQ ID NO: 3894681 - DNA, 21 bp, Homo sapiens
gcccaccaacatcccattgcc

SEQ ID NO: 3894682 - DNA, 16 bp, Homo sapiens
gcccacctgcacgtga

SEQ ID NO: 3894683 - DNA, 16 bp, Homo sapiens
gcccacttcagcccag

SEQ ID NO: 3894684 - DNA, 16 bp, Homo sapiens
gcccagagaccccttc

SEQ ID NO: 3894685 - DNA, 18 bp, Homo sapiens
gcccagagaccccttcct

SEQ ID NO: 3894686 - DNA, 23 bp, Homo sapiens
gcccagagaccccttcctttcct

SEQ ID NO: 3894687 - DNA, 16 bp, Homo sapiens
gcccagcccagctggt

SEQ ID NO: 3894688 - DNA, 13 bp, Homo sapiens
gcccagcctaccc

SEQ ID NO: 3894689 - DNA, 12 bp, Homo sapiens
gcccagcctgtc

SEQ ID NO: 3894690 - DNA, 15 bp, Homo sapiens
gcccagcctgtcctg

SEQ ID NO: 3894691 - DNA, 16 bp, Homo sapiens
gcccagctacattcct

SEQ ID NO: 3894692 - DNA, 18 bp, Homo sapiens
gcccagctacattcctca

SEQ ID NO: 3894693 - DNA, 23 bp, Homo sapiens
gcccagctacattcctcagctgc

SEQ ID NO: 3894694 - DNA, 17 bp, Homo sapiens
gcccagctggtgggaag

SEQ ID NO: 3894695 - DNA, 14 bp, Homo sapiens
gcccagctgtagcc

SEQ ID NO: 3894696 - DNA, 13 bp, Homo sapiens
gcccagcttcctg

SEQ ID NO: 3894697 - DNA, 10 bp, Homo sapiens
gcccaggaga

SEQ ID NO: 3894698 - DNA, 19 bp, Homo sapiens
gcccaggagagccagccct

SEQ ID NO: 3894699 - DNA, 22 bp, Homo sapiens
gcccaggccgttccccttggct

SEQ ID NO: 3894700 - DNA, 15 bp, Homo sapiens
gcccaggctctggga

SEQ ID NO: 3894701 - DNA, 16 bp, Homo sapiens
gcccaggctctgggaa

SEQ ID NO: 3894702 - DNA, 13 bp, Homo sapiens
gcccaggctgaag

SEQ ID NO: 3894703 - DNA, 14 bp, Homo sapiens
gcccaggctggaga

SEQ ID NO: 3894704 - DNA, 16 bp, Homo sapiens
gcccaggctggcctga

SEQ ID NO: 3894705 - DNA, 20 bp, Homo sapiens
gcccagggagcaatgggagg

SEQ ID NO: 3894706 - DNA, 22 bp, Homo sapiens
gcccagtcattgggttttatca

SEQ ID NO: 3894707 - DNA, 19 bp, Homo sapiens
gcccataatagttagccct

SEQ ID NO: 3894708 - DNA, 21 bp, Homo sapiens
gcccataatagttagccctca

SEQ ID NO: 3894709 - DNA, 22 bp, Homo sapiens
gcccataatagttagccctcag

SEQ ID NO: 3894710 - DNA, 15 bp, Homo sapiens
gcccatacccctgcc

SEQ ID NO: 3894711 - DNA, 17 bp, Homo sapiens
gcccatacccctgcctg

SEQ ID NO: 3894712 - DNA, 18 bp, Homo sapiens
gcccatagaaacatgaca

SEQ ID NO: 3894713 - DNA, 21 bp, Homo sapiens
gcccatagaaacatgacactg

SEQ ID NO: 3894714 - DNA, 22 bp, Homo sapiens
gcccatagaaacatgacactga

SEQ ID NO: 3894715 - DNA, 22 bp, Homo sapiens
gcccatctatgtcccttgctgt

SEQ ID NO: 3894716 - DNA, 16 bp, Homo sapiens
gcccatctcaggtgcc

SEQ ID NO: 3894717 - DNA, 18 bp, Homo sapiens
gcccatctcaggtgccac

SEQ ID NO: 3894718 - DNA, 18 bp, Homo sapiens
gcccatgtgtcccctcac

SEQ ID NO: 3894719 - DNA, 17 bp, Homo sapiens
gcccattcgtctgtccc

SEQ ID NO: 3894720 - DNA, 21 bp, Homo sapiens
gcccattcgtctgtcccagag

SEQ ID NO: 3894721 - DNA, 14 bp, Homo sapiens
gccccaaaccaggg

SEQ ID NO: 3894722 - DNA, 17 bp, Homo sapiens
gccccaaaccagggtgc

SEQ ID NO: 3894723 - DNA, 23 bp, Homo sapiens
gccccaaaccagggtgcatggct

SEQ ID NO: 3894724 - DNA, 21 bp, Homo sapiens
gccccaaatatagcgttccca

SEQ ID NO: 3894725 - DNA, 17 bp, Homo sapiens
gccccaacccgtggagg

SEQ ID NO: 3894726 - DNA, 21 bp, Homo sapiens
gccccaacccgtggaggctgc

SEQ ID NO: 3894727 - DNA, 16 bp, Homo sapiens
gccccaactcctggaa

SEQ ID NO: 3894728 - DNA, 19 bp, Homo sapiens
gccccaactccttccagct

SEQ ID NO: 3894729 - DNA, 20 bp, Homo sapiens
gccccaactccttccagcta

SEQ ID NO: 3894730 - DNA, 17 bp, Homo sapiens
gccccaagcagccagcc

SEQ ID NO: 3894731 - DNA, 18 bp, Homo sapiens
gccccaagcagccagcca

SEQ ID NO: 3894732 - DNA, 20 bp, Homo sapiens
gccccaaggggcccacaaag

SEQ ID NO: 3894733 - DNA, 22 bp, Homo sapiens
gccccaaggggtttctgtttct

SEQ ID NO: 3894734 - DNA, 16 bp, Homo sapiens
gccccacagcacccag

SEQ ID NO: 3894735 - DNA, 14 bp, Homo sapiens
gccccaccacctag

SEQ ID NO: 3894736 - DNA, 18 bp, Homo sapiens
gccccagaaggcagggaa

SEQ ID NO: 3894737 - DNA, 12 bp, Homo sapiens
gccccagagccc

SEQ ID NO: 3894738 - DNA, 19 bp, Homo sapiens
gccccagatcaccagcccg

SEQ ID NO: 3894739 - DNA, 20 bp, Homo sapiens
gccccagatcaccagcccgg

SEQ ID NO: 3894740 - DNA, 15 bp, Homo sapiens
gccccagatctgcct

SEQ ID NO: 3894741 - DNA, 19 bp, Homo sapiens
gccccagatctgcctgggc

SEQ ID NO: 3894742 - DNA, 19 bp, Homo sapiens
gccccagcgcggcttggcc

SEQ ID NO: 3894743 - DNA, 15 bp, Homo sapiens
gccccaggccctccc

SEQ ID NO: 3894744 - DNA, 20 bp, Homo sapiens
gccccagggggcggggtgca

SEQ ID NO: 3894745 - DNA, 13 bp, Homo sapiens
gccccaggggtgc

SEQ ID NO: 3894746 - DNA, 14 bp, Homo sapiens
gccccagggttgaa

SEQ ID NO: 3894747 - DNA, 19 bp, Homo sapiens
gccccaggtgccaccaata

SEQ ID NO: 3894748 - DNA, 20 bp, Homo sapiens
gccccaggtgccaccaataa

SEQ ID NO: 3894749 - DNA, 16 bp, Homo sapiens
gccccagtagtcagaa

SEQ ID NO: 3894750 - DNA, 22 bp, Homo sapiens
gccccagtagtcagaagcaggt

SEQ ID NO: 3894751 - DNA, 21 bp, Homo sapiens
gccccataattttttttttcc

SEQ ID NO: 3894752 - DNA, 16 bp, Homo sapiens
gccccatgacctccag

SEQ ID NO: 3894753 - DNA, 17 bp, Homo sapiens
gccccatgacctccagc

SEQ ID NO: 3894754 - DNA, 13 bp, Homo sapiens
gccccatgctctg

SEQ ID NO: 3894755 - DNA, 16 bp, Homo sapiens
gccccatgctctgccc

SEQ ID NO: 3894756 - DNA, 15 bp, Homo sapiens
gcccccaagcctctg

SEQ ID NO: 3894757 - DNA, 12 bp, Homo sapiens
gcccccacccag

SEQ ID NO: 3894758 - DNA, 15 bp, Homo sapiens
gcccccatctcccca

SEQ ID NO: 3894759 - DNA, 19 bp, Homo sapiens
gcccccatctccccaggcc

SEQ ID NO: 3894760 - DNA, 23 bp, Homo sapiens
gcccccatctccccaggcctcca

SEQ ID NO: 3894761 - DNA, 14 bp, Homo sapiens
gccccccacctttg

SEQ ID NO: 3894762 - DNA, 20 bp, Homo sapiens
gccccccctcttttggcctt

SEQ ID NO: 3894763 - DNA, 16 bp, Homo sapiens
gcccccgacagcccag

SEQ ID NO: 3894764 - DNA, 20 bp, Homo sapiens
gccccctcatctcactgccc

SEQ ID NO: 3894765 - DNA, 14 bp, Homo sapiens
gccccctgtgccag

SEQ ID NO: 3894766 - DNA, 14 bp, Homo sapiens
gccccgcctccccg

SEQ ID NO: 3894767 - DNA, 14 bp, Homo sapiens
gccccgcttgtcca

SEQ ID NO: 3894768 - DNA, 16 bp, Homo sapiens
gccccgcttgtccagc

SEQ ID NO: 3894769 - DNA, 18 bp, Homo sapiens
gccccgcttgtccagcgc

SEQ ID NO: 3894770 - DNA, 20 bp, Homo sapiens
gccccgcttgtccagcgcct

SEQ ID NO: 3894771 - DNA, 18 bp, Homo sapiens
gccccgggctctggccac

SEQ ID NO: 3894772 - DNA, 13 bp, Homo sapiens
gccccggggctgg

SEQ ID NO: 3894773 - DNA, 14 bp, Homo sapiens
gccccggggctggc

SEQ ID NO: 3894774 - DNA, 19 bp, Homo sapiens
gccccgggtgcctcagagc

SEQ ID NO: 3894775 - DNA, 23 bp, Homo sapiens
gccccgggtgcctcagagcaggc

SEQ ID NO: 3894776 - DNA, 17 bp, Homo sapiens
gccccgttccctgtcag

SEQ ID NO: 3894777 - DNA, 18 bp, Homo sapiens
gccccgttccctgtcaga

SEQ ID NO: 3894778 - DNA, 14 bp, Homo sapiens
gcccctcaccccaa

SEQ ID NO: 3894779 - DNA, 16 bp, Homo sapiens
gcccctcaccccaagg

SEQ ID NO: 3894780 - DNA, 15 bp, Homo sapiens
gcccctcacctgggc

SEQ ID NO: 3894781 - DNA, 20 bp, Homo sapiens
gcccctcacctgggcctttc

SEQ ID NO: 3894782 - DNA, 16 bp, Homo sapiens
gcccctcagagaggca

SEQ ID NO: 3894783 - DNA, 17 bp, Homo sapiens
gcccctcagagaggcat

SEQ ID NO: 3894784 - DNA, 21 bp, Homo sapiens
gcccctcagcccttgccccca

SEQ ID NO: 3894785 - DNA, 21 bp, Homo sapiens
gcccctcatgtgtgctgtgct

SEQ ID NO: 3894786 - DNA, 16 bp, Homo sapiens
gcccctccacgcctcc

SEQ ID NO: 3894787 - DNA, 17 bp, Homo sapiens
gcccctccacgcctcct

SEQ ID NO: 3894788 - DNA, 20 bp, Homo sapiens
gcccctccacgcctcctggc

SEQ ID NO: 3894789 - DNA, 23 bp, Homo sapiens
gcccctccacgcctcctggccag

SEQ ID NO: 3894790 - DNA, 18 bp, Homo sapiens
gcccctccagaccctgcc

SEQ ID NO: 3894791 - DNA, 23 bp, Homo sapiens
gcccctccagaccctgcctgagc

SEQ ID NO: 3894792 - DNA, 19 bp, Homo sapiens
gcccctccctcctctggcc

SEQ ID NO: 3894793 - DNA, 15 bp, Homo sapiens
gcccctccctctgcc

SEQ ID NO: 3894794 - DNA, 16 bp, Homo sapiens
gcccctccctctgccc

SEQ ID NO: 3894795 - DNA, 17 bp, Homo sapiens
gcccctccctctgcccc

SEQ ID NO: 3894796 - DNA, 20 bp, Homo sapiens
gcccctccctctgccccaag

SEQ ID NO: 3894797 - DNA, 12 bp, Homo sapiens
gcccctcccttc

SEQ ID NO: 3894798 - DNA, 18 bp, Homo sapiens
gcccctcctctgccacct

SEQ ID NO: 3894799 - DNA, 22 bp, Homo sapiens
gcccctcgccttttaggctcag

SEQ ID NO: 3894800 - DNA, 15 bp, Homo sapiens
gcccctcgctgctgc

SEQ ID NO: 3894801 - DNA, 16 bp, Homo sapiens
gcccctcgctgctgct

SEQ ID NO: 3894802 - DNA, 16 bp, Homo sapiens
gcccctgaacaagaat

SEQ ID NO: 3894803 - DNA, 19 bp, Homo sapiens
gcccctgaggactggagac

SEQ ID NO: 3894804 - DNA, 20 bp, Homo sapiens
gcccctgcatccccttggct

SEQ ID NO: 3894805 - DNA, 16 bp, Homo sapiens
gcccctgcccccaaag

SEQ ID NO: 3894806 - DNA, 17 bp, Homo sapiens
gcccctgcccccaaagg

SEQ ID NO: 3894807 - DNA, 20 bp, Homo sapiens
gcccctgggatgggaccagg

SEQ ID NO: 3894808 - DNA, 16 bp, Homo sapiens
gccccttaagggttga

SEQ ID NO: 3894809 - DNA, 14 bp, Homo sapiens
gccccttccccaag

SEQ ID NO: 3894810 - DNA, 14 bp, Homo sapiens
gccccttggccctc

SEQ ID NO: 3894811 - DNA, 22 bp, Homo sapiens
gccccttgggcatccacccagt

SEQ ID NO: 3894812 - DNA, 18 bp, Homo sapiens
gccccttgtcctctcccg

SEQ ID NO: 3894813 - DNA, 14 bp, Homo sapiens
gcccgaagcccagt

SEQ ID NO: 3894814 - DNA, 15 bp, Homo sapiens
gcccgacagagagat

SEQ ID NO: 3894815 - DNA, 19 bp, Homo sapiens
gcccgacagagagatgaag

SEQ ID NO: 3894816 - DNA, 17 bp, Homo sapiens
gcccgacagcctggcac

SEQ ID NO: 3894817 - DNA, 19 bp, Homo sapiens
gcccgacagcctggcacag

SEQ ID NO: 3894818 - DNA, 19 bp, Homo sapiens
gcccgaccccatctcattc

SEQ ID NO: 3894819 - DNA, 14 bp, Homo sapiens
gcccgactagcagg

SEQ ID NO: 3894820 - DNA, 17 bp, Homo sapiens
gcccgagcagctgagca

SEQ ID NO: 3894821 - DNA, 19 bp, Homo sapiens
gcccgagcagctgagcagg

SEQ ID NO: 3894822 - DNA, 18 bp, Homo sapiens
gcccgaggaccgggctgg

SEQ ID NO: 3894823 - DNA, 15 bp, Homo sapiens
gcccgccagcctcag

SEQ ID NO: 3894824 - DNA, 14 bp, Homo sapiens
gcccggccagggcc

SEQ ID NO: 3894825 - DNA, 14 bp, Homo sapiens
gcccggcccagcct

SEQ ID NO: 3894826 - DNA, 14 bp, Homo sapiens
gcccggcctgctcc

SEQ ID NO: 3894827 - DNA, 21 bp, Homo sapiens
gcccggcgcggtggctcacgc

SEQ ID NO: 3894828 - DNA, 18 bp, Homo sapiens
gcccgtgaagcagtgcct

SEQ ID NO: 3894829 - DNA, 19 bp, Homo sapiens
gcccgtgaagcagtgcctc

SEQ ID NO: 3894830 - DNA, 21 bp, Homo sapiens
gcccgtgaagcagtgcctcga

SEQ ID NO: 3894831 - DNA, 22 bp, Homo sapiens
gcccgtgaagcagtgcctcgag

SEQ ID NO: 3894832 - DNA, 15 bp, Homo sapiens
gccctaaggatctct

SEQ ID NO: 3894833 - DNA, 19 bp, Homo sapiens
gccctacatcttcagctcc

SEQ ID NO: 3894834 - DNA, 21 bp, Homo sapiens
gccctacatcttcagctccca

SEQ ID NO: 3894835 - DNA, 19 bp, Homo sapiens
gccctagcgctctcttcca

SEQ ID NO: 3894836 - DNA, 21 bp, Homo sapiens
gccctagcgctctcttccaga

SEQ ID NO: 3894837 - DNA, 20 bp, Homo sapiens
gccctaggattcctccccca

SEQ ID NO: 3894838 - DNA, 17 bp, Homo sapiens
gccctatttttgcaatg

SEQ ID NO: 3894839 - DNA, 19 bp, Homo sapiens
gccctcaaacttgactcta

SEQ ID NO: 3894840 - DNA, 22 bp, Homo sapiens
gccctcagtcagttcccggagc

SEQ ID NO: 3894841 - DNA, 14 bp, Homo sapiens
gccctccatgggct

SEQ ID NO: 3894842 - DNA, 20 bp, Homo sapiens
gccctcccccttccccttct

SEQ ID NO: 3894843 - DNA, 21 bp, Homo sapiens
gccctccctgactccctgtgg

SEQ ID NO: 3894844 - DNA, 21 bp, Homo sapiens
gccctccctgcccctcccttc

SEQ ID NO: 3894845 - DNA, 13 bp, Homo sapiens
gccctccctgggg

SEQ ID NO: 3894846 - DNA, 16 bp, Homo sapiens
gccctccctgtcctcc

SEQ ID NO: 3894847 - DNA, 21 bp, Homo sapiens
gccctccctgtcctcctcgga

SEQ ID NO: 3894848 - DNA, 21 bp, Homo sapiens
gccctcgaaccaaggcagcct

SEQ ID NO: 3894849 - DNA, 12 bp, Homo sapiens
gccctgacctcc

SEQ ID NO: 3894850 - DNA, 15 bp, Homo sapiens
gccctgacctcccag

SEQ ID NO: 3894851 - DNA, 21 bp, Homo sapiens
gccctgagtggatctccaagg

SEQ ID NO: 3894852 - DNA, 22 bp, Homo sapiens
gccctgagtggatctccaagga

SEQ ID NO: 3894853 - DNA, 15 bp, Homo sapiens
gccctgccacctgtc

SEQ ID NO: 3894854 - DNA, 17 bp, Homo sapiens
gccctgccacctgtctg

SEQ ID NO: 3894855 - DNA, 20 bp, Homo sapiens
gccctgccacctgtctgtct

SEQ ID NO: 3894856 - DNA, 13 bp, Homo sapiens
gccctgccaggag

SEQ ID NO: 3894857 - DNA, 21 bp, Homo sapiens
gccctgccaggaggctgcggc

SEQ ID NO: 3894858 - DNA, 21 bp, Homo sapiens
gccctgcccccatctccccag

SEQ ID NO: 3894859 - DNA, 22 bp, Homo sapiens
gccctgcccccatctccccagg

SEQ ID NO: 3894860 - DNA, 14 bp, Homo sapiens
gccctgcctccctt

SEQ ID NO: 3894861 - DNA, 12 bp, Homo sapiens
gccctgcctgcc

SEQ ID NO: 3894862 - DNA, 14 bp, Homo sapiens
gccctgcctgccca

SEQ ID NO: 3894863 - DNA, 13 bp, Homo sapiens
gccctgcctggag

SEQ ID NO: 3894864 - DNA, 14 bp, Homo sapiens
gccctgcctggagg

SEQ ID NO: 3894865 - DNA, 16 bp, Homo sapiens
gccctgcctggaggac

SEQ ID NO: 3894866 - DNA, 20 bp, Homo sapiens
gccctgcctggaggacctga

SEQ ID NO: 3894867 - DNA, 21 bp, Homo sapiens
gccctgcctggaggacctgag

SEQ ID NO: 3894868 - DNA, 22 bp, Homo sapiens
gccctgcctggaggacctgagc

SEQ ID NO: 3894869 - DNA, 22 bp, Homo sapiens
gccctgcgaagtggctctcagg

SEQ ID NO: 3894870 - DNA, 16 bp, Homo sapiens
gccctgcgttggagcc

SEQ ID NO: 3894871 - DNA, 17 bp, Homo sapiens
gccctgcgttggagcca

SEQ ID NO: 3894872 - DNA, 20 bp, Homo sapiens
gccctgcgttggagccactc

SEQ ID NO: 3894873 - DNA, 23 bp, Homo sapiens
gccctgcgttggagccactcctg

SEQ ID NO: 3894874 - DNA, 13 bp, Homo sapiens
gccctgctctggg

SEQ ID NO: 3894875 - DNA, 21 bp, Homo sapiens
gccctgctgccgcctcccagc

SEQ ID NO: 3894876 - DNA, 17 bp, Homo sapiens
gccctgctgtgggagag

SEQ ID NO: 3894877 - DNA, 18 bp, Homo sapiens
gccctgctttgggctgcc

SEQ ID NO: 3894878 - DNA, 22 bp, Homo sapiens
gccctgctttgggctgccctgg

SEQ ID NO: 3894879 - DNA, 23 bp, Homo sapiens
gccctgctttgggctgccctggt

SEQ ID NO: 3894880 - DNA, 17 bp, Homo sapiens
gccctggcctgctgggc

SEQ ID NO: 3894881 - DNA, 20 bp, Homo sapiens
gccctgggaccgctacacca

SEQ ID NO: 3894882 - DNA, 18 bp, Homo sapiens
gccctgggcacccacctc

SEQ ID NO: 3894883 - DNA, 13 bp, Homo sapiens
gccctgggcctca

SEQ ID NO: 3894884 - DNA, 15 bp, Homo sapiens
gccctgggcctcagt

SEQ ID NO: 3894885 - DNA, 23 bp, Homo sapiens
gccctgggcctcagttcaacctg

SEQ ID NO: 3894886 - DNA, 14 bp, Homo sapiens
gccctgggggccag

SEQ ID NO: 3894887 - DNA, 16 bp, Homo sapiens
gccctggtgctgccac

SEQ ID NO: 3894888 - DNA, 17 bp, Homo sapiens
gccctgtcgagacactt

SEQ ID NO: 3894889 - DNA, 11 bp, Homo sapiens
gccctgtctgt

SEQ ID NO: 3894890 - DNA, 17 bp, Homo sapiens
gccctgttaaaagatga

SEQ ID NO: 3894891 - DNA, 17 bp, Homo sapiens
gccctgttgtgtataga

SEQ ID NO: 3894892 - DNA, 16 bp, Homo sapiens
gcccttcacagtgttt

SEQ ID NO: 3894893 - DNA, 22 bp, Homo sapiens
gcccttccatgtcgcctctgca

SEQ ID NO: 3894894 - DNA, 12 bp, Homo sapiens
gcccttccctgc

SEQ ID NO: 3894895 - DNA, 22 bp, Homo sapiens
gcccttcctcctgaagcctctg

SEQ ID NO: 3894896 - DNA, 14 bp, Homo sapiens
gcccttcctctcca

SEQ ID NO: 3894897 - DNA, 22 bp, Homo sapiens
gcccttcctctccactgccttc

SEQ ID NO: 3894898 - DNA, 12 bp, Homo sapiens
gcccttcctgga

SEQ ID NO: 3894899 - DNA, 19 bp, Homo sapiens
gcccttcctggacagctgt

SEQ ID NO: 3894900 - DNA, 23 bp, Homo sapiens
gcccttcctggacagctgtgcct

SEQ ID NO: 3894901 - DNA, 16 bp, Homo sapiens
gcccttcgctgccagg

SEQ ID NO: 3894902 - DNA, 19 bp, Homo sapiens
gcccttgcccccatccctc

SEQ ID NO: 3894903 - DNA, 19 bp, Homo sapiens
gcccttggggttcccccag

SEQ ID NO: 3894904 - DNA, 17 bp, Homo sapiens
gcccttgtcctgccagc

SEQ ID NO: 3894905 - DNA, 19 bp, Homo sapiens
gcccttgtcctgccagctg

SEQ ID NO: 3894906 - DNA, 20 bp, Homo sapiens
gcccttgtcctgccagctgc

SEQ ID NO: 3894907 - DNA, 20 bp, Homo sapiens
gcccttgtttggggcaggag

SEQ ID NO: 3894908 - DNA, 22 bp, Homo sapiens
gcccttgtttggggcaggagta

SEQ ID NO: 3894909 - DNA, 16 bp, Homo sapiens
gccctttgcaggccca

SEQ ID NO: 3894910 - DNA, 14 bp, Homo sapiens
gccgaagctaacag

SEQ ID NO: 3894911 - DNA, 19 bp, Homo sapiens
gccgaagctaacagggaag

SEQ ID NO: 3894912 - DNA, 17 bp, Homo sapiens
gccgaccagagccccac

SEQ ID NO: 3894913 - DNA, 19 bp, Homo sapiens
gccgacctcgtcctccccc

SEQ ID NO: 3894914 - DNA, 14 bp, Homo sapiens
gccgagcaaccgtg

SEQ ID NO: 3894915 - DNA, 20 bp, Homo sapiens
gccgagccgggcctggggct

SEQ ID NO: 3894916 - DNA, 13 bp, Homo sapiens
gccgagcctaatg

SEQ ID NO: 3894917 - DNA, 13 bp, Homo sapiens
gccgcaccccaga

SEQ ID NO: 3894918 - DNA, 16 bp, Homo sapiens
gccgcaccccagagtg

SEQ ID NO: 3894919 - DNA, 17 bp, Homo sapiens
gccgcagggacggggac

SEQ ID NO: 3894920 - DNA, 20 bp, Homo sapiens
gccgcatcttctccatctgg

SEQ ID NO: 3894921 - DNA, 18 bp, Homo sapiens
gccgcattccctgagtca

SEQ ID NO: 3894922 - DNA, 15 bp, Homo sapiens
gccgccatccgggac

SEQ ID NO: 3894923 - DNA, 17 bp, Homo sapiens
gccgccatccgggacgc

SEQ ID NO: 3894924 - DNA, 12 bp, Homo sapiens
gccgccctgggc

SEQ ID NO: 3894925 - DNA, 15 bp, Homo sapiens
gccgccctgggctgt

SEQ ID NO: 3894926 - DNA, 18 bp, Homo sapiens
gccgccgtctctgtcccg

SEQ ID NO: 3894927 - DNA, 12 bp, Homo sapiens
gccgcctcccag

SEQ ID NO: 3894928 - DNA, 14 bp, Homo sapiens
gccgcctcccagcc

SEQ ID NO: 3894929 - DNA, 19 bp, Homo sapiens
gccgctaggagagactgaa

SEQ ID NO: 3894930 - DNA, 19 bp, Homo sapiens
gccggaccaagatgggcac

SEQ ID NO: 3894931 - DNA, 23 bp, Homo sapiens
gccggaccgcgtagagagccggg

SEQ ID NO: 3894932 - DNA, 19 bp, Homo sapiens
gccggcaaccccagttctg

SEQ ID NO: 3894933 - DNA, 16 bp, Homo sapiens
gccggccagccttgca

SEQ ID NO: 3894934 - DNA, 15 bp, Homo sapiens
gccggccccccctct

SEQ ID NO: 3894935 - DNA, 15 bp, Homo sapiens
gccgggagaggactc

SEQ ID NO: 3894936 - DNA, 16 bp, Homo sapiens
gagcctgtgaacccag

SEQ ID NO: 3894937 - DNA, 12 bp, Homo sapiens
gagcgccctgca

SEQ ID NO: 3894938 - DNA, 20 bp, Homo sapiens
gagcgccctgcagaccctgc

SEQ ID NO: 3894939 - DNA, 21 bp, Homo sapiens
gagcgccctgcagaccctgcc

SEQ ID NO: 3894940 - DNA, 23 bp, Homo sapiens
gagcgccctgcagaccctgccct

SEQ ID NO: 3894941 - DNA, 14 bp, Homo sapiens
gagcggggaggtgc

SEQ ID NO: 3894942 - DNA, 16 bp, Homo sapiens
gagcggggaggtgcct

SEQ ID NO: 3894943 - DNA, 20 bp, Homo sapiens
gagctacctgtgtggacagg

SEQ ID NO: 3894944 - DNA, 21 bp, Homo sapiens
gagctagaacctggagggcta

SEQ ID NO: 3894945 - DNA, 15 bp, Homo sapiens
gagctagaagctgga

SEQ ID NO: 3894946 - DNA, 14 bp, Homo sapiens
gagctagcgctgcc

SEQ ID NO: 3894947 - DNA, 19 bp, Homo sapiens
gagctagcgctgccgcacc

SEQ ID NO: 3894948 - DNA, 12 bp, Homo sapiens
gagctaggagca

SEQ ID NO: 3894949 - DNA, 17 bp, Homo sapiens
gagctcacaaggcagca

SEQ ID NO: 3894950 - DNA, 18 bp, Homo sapiens
gagctcacagtacaatgt

SEQ ID NO: 3894951 - DNA, 14 bp, Homo sapiens
gagctcactcccac

SEQ ID NO: 3894952 - DNA, 14 bp, Homo sapiens
gagctcagaccccc

SEQ ID NO: 3894953 - DNA, 13 bp, Homo sapiens
gagctcccccttc

SEQ ID NO: 3894954 - DNA, 18 bp, Homo sapiens
gagctcccccttcccagt

SEQ ID NO: 3894955 - DNA, 22 bp, Homo sapiens
gagctccgctaagacctcccca

SEQ ID NO: 3894956 - DNA, 18 bp, Homo sapiens
gagctcgctcttgggagt

SEQ ID NO: 3894957 - DNA, 11 bp, Homo sapiens
gagctctgaga

SEQ ID NO: 3894958 - DNA, 14 bp, Homo sapiens
gagctctgagaggc

SEQ ID NO: 3894959 - DNA, 17 bp, Homo sapiens
gagctctgagaggccct

SEQ ID NO: 3894960 - DNA, 15 bp, Homo sapiens
gagctcttaatgttg

SEQ ID NO: 3894961 - DNA, 21 bp, Homo sapiens
gagctcttcaagctgtcccct

SEQ ID NO: 3894962 - DNA, 20 bp, Homo sapiens
gagctcttcggtttctgagc

SEQ ID NO: 3894963 - DNA, 12 bp, Homo sapiens
gagctcttggaa

SEQ ID NO: 3894964 - DNA, 13 bp, Homo sapiens
gagctcttggaag

SEQ ID NO: 3894965 - DNA, 23 bp, Homo sapiens
gagctgaacccattttgagtgac

SEQ ID NO: 3894966 - DNA, 13 bp, Homo sapiens
gagctgagatcgt

SEQ ID NO: 3894967 - DNA, 16 bp, Homo sapiens
gagctgagtcacctcc

SEQ ID NO: 3894968 - DNA, 18 bp, Homo sapiens
gagctgatttccaggccc

SEQ ID NO: 3894969 - DNA, 12 bp, Homo sapiens
gagctgccagcc

SEQ ID NO: 3894970 - DNA, 22 bp, Homo sapiens
gagctgctcctggctgaggggc

SEQ ID NO: 3894971 - DNA, 11 bp, Homo sapiens
gagctggaaat

SEQ ID NO: 3894972 - DNA, 13 bp, Homo sapiens
gagctggaaataa

SEQ ID NO: 3894973 - DNA, 20 bp, Homo sapiens
gagctggaaggcagggcaga

SEQ ID NO: 3894974 - DNA, 20 bp, Homo sapiens
gagctggcaaaggtggctct

SEQ ID NO: 3894975 - DNA, 19 bp, Homo sapiens
gagctggctttgccaagct

SEQ ID NO: 3894976 - DNA, 14 bp, Homo sapiens
gagctgggaaacag

SEQ ID NO: 3894977 - DNA, 19 bp, Homo sapiens
gagctgggaaacagggagc

SEQ ID NO: 3894978 - DNA, 21 bp, Homo sapiens
gagctgggaaacagggagccc

SEQ ID NO: 3894979 - DNA, 19 bp, Homo sapiens
gagctgggaagctgtactc

SEQ ID NO: 3894980 - DNA, 14 bp, Homo sapiens
gagctgggaggaaa

SEQ ID NO: 3894981 - DNA, 12 bp, Homo sapiens
gagctgggaggc

SEQ ID NO: 3894982 - DNA, 19 bp, Homo sapiens
gagctgtatatatatatgt

SEQ ID NO: 3894983 - DNA, 22 bp, Homo sapiens
gagctgttcacagccagactgg

SEQ ID NO: 3894984 - DNA, 15 bp, Homo sapiens
gagctgttggcctcg

SEQ ID NO: 3894985 - DNA, 14 bp, Homo sapiens
gagcttagccttgt

SEQ ID NO: 3894986 - DNA, 18 bp, Homo sapiens
gagcttagccttgtgccc

SEQ ID NO: 3894987 - DNA, 19 bp, Homo sapiens
gagcttagccttgtgccct

SEQ ID NO: 3894988 - DNA, 16 bp, Homo sapiens
gagcttattggccact

SEQ ID NO: 3894989 - DNA, 14 bp, Homo sapiens
gagcttcccaggat

SEQ ID NO: 3894990 - DNA, 15 bp, Homo sapiens
gagcttcccaggatc

SEQ ID NO: 3894991 - DNA, 20 bp, Homo sapiens
gagcttgggggatgactaga

SEQ ID NO: 3894992 - DNA, 17 bp, Homo sapiens
gagcttggtggctgagc

SEQ ID NO: 3894993 - DNA, 18 bp, Homo sapiens
gagctttcaaagaaggaa

SEQ ID NO: 3894994 - DNA, 22 bp, Homo sapiens
gagctttgttttatatatttat

SEQ ID NO: 3894995 - DNA, 14 bp, Homo sapiens
gaggaaaagtgcaa

SEQ ID NO: 3894996 - DNA, 13 bp, Homo sapiens
gaggaagagcagg

SEQ ID NO: 3894997 - DNA, 15 bp, Homo sapiens
gaggaagatgaagag

SEQ ID NO: 3894998 - DNA, 20 bp, Homo sapiens
gaggaagatgaagagaagct

SEQ ID NO: 3894999 - DNA, 13 bp, Homo sapiens
gaggaagggccag

SEQ ID NO: 3895000 - DNA, 20 bp, Homo sapiens
gaggaagggccaggagagag

SEQ ID NO: 3895001 - DNA, 13 bp, Homo sapiens
gaggaatatcaat

SEQ ID NO: 3895002 - DNA, 22 bp, Homo sapiens
gaggaatcatgtcaggcctgtg

SEQ ID NO: 3895003 - DNA, 19 bp, Homo sapiens
gaggaatcgccccagactc

SEQ ID NO: 3895004 - DNA, 20 bp, Homo sapiens
gaggacaaagagaataaaga

SEQ ID NO: 3895005 - DNA, 12 bp, Homo sapiens
gaggacacatgt

SEQ ID NO: 3895006 - DNA, 18 bp, Homo sapiens
gaggacacgtggcctgca

SEQ ID NO: 3895007 - DNA, 22 bp, Homo sapiens
gaggaccacactttgagaacct

SEQ ID NO: 3895008 - DNA, 23 bp, Homo sapiens
gaggaccacactttgagaacctg

SEQ ID NO: 3895009 - DNA, 21 bp, Homo sapiens
gaggacctgagcctgccgagc

SEQ ID NO: 3895010 - DNA, 23 bp, Homo sapiens
gaggacgtcatcggaggctgggc

SEQ ID NO: 3895011 - DNA, 18 bp, Homo sapiens
gaggactccctccatgtg

SEQ ID NO: 3895012 - DNA, 17 bp, Homo sapiens
gaggacttgtgtctctg

SEQ ID NO: 3895013 - DNA, 16 bp, Homo sapiens
gaggagaaactgagaa

SEQ ID NO: 3895014 - DNA, 12 bp, Homo sapiens
gaggagaaataa

SEQ ID NO: 3895015 - DNA, 13 bp, Homo sapiens
gaggagaaataaa

SEQ ID NO: 3895016 - DNA, 12 bp, Homo sapiens
gaggagaagaat

SEQ ID NO: 3895017 - DNA, 20 bp, Homo sapiens
gaggagaagaattttcagac

SEQ ID NO: 3895018 - DNA, 12 bp, Homo sapiens
gaggagaccctg

SEQ ID NO: 3895019 - DNA, 16 bp, Homo sapiens
gaggagaccctggaat

SEQ ID NO: 3895020 - DNA, 16 bp, Homo sapiens
gaggagcacctgaacc

SEQ ID NO: 3895021 - DNA, 15 bp, Homo sapiens
gaggagcttggggga

SEQ ID NO: 3895022 - DNA, 15 bp, Homo sapiens
gaaatcattgtagaa

SEQ ID NO: 3895023 - DNA, 15 bp, Homo sapiens
gaaatccaggtctcg

SEQ ID NO: 3895024 - DNA, 20 bp, Homo sapiens
gaaatctgtaattctattgt

SEQ ID NO: 3895025 - DNA, 12 bp, Homo sapiens
gaaatcttaaaa

SEQ ID NO: 3895026 - DNA, 22 bp, Homo sapiens
gaaatgacagaatgctgtttta

SEQ ID NO: 3895027 - DNA, 20 bp, Homo sapiens
gaaatgcattattttgaatg

SEQ ID NO: 3895028 - DNA, 20 bp, Homo sapiens
gaaatgctattgttgtgggc

SEQ ID NO: 3895029 - DNA, 12 bp, Homo sapiens
gaaatggagggt

SEQ ID NO: 3895030 - DNA, 15 bp, Homo sapiens
gaaatggagggtggg

SEQ ID NO: 3895031 - DNA, 16 bp, Homo sapiens
gaaatggagggtgggg

SEQ ID NO: 3895032 - DNA, 18 bp, Homo sapiens
gaaatgggagatggtcag

SEQ ID NO: 3895033 - DNA, 17 bp, Homo sapiens
gaaatgggctttaacaa

SEQ ID NO: 3895034 - DNA, 16 bp, Homo sapiens
gaaatggtatgagctg

SEQ ID NO: 3895035 - DNA, 22 bp, Homo sapiens
gaaatgtaagggaaactgccag

SEQ ID NO: 3895036 - DNA, 17 bp, Homo sapiens
gaaatgtgaagggtggg

SEQ ID NO: 3895037 - DNA, 17 bp, Homo sapiens
gaaattacacccaaaga

SEQ ID NO: 3895038 - DNA, 16 bp, Homo sapiens
gaaattactgaaaaca

SEQ ID NO: 3895039 - DNA, 13 bp, Homo sapiens
gaaattatttaat

SEQ ID NO: 3895040 - DNA, 17 bp, Homo sapiens
cttgccctgacctccca

SEQ ID NO: 3895041 - DNA, 14 bp, Homo sapiens
cttgccctgttaaa

SEQ ID NO: 3895042 - DNA, 15 bp, Homo sapiens
cttgcccttgccctg

SEQ ID NO: 3895043 - DNA, 16 bp, Homo sapiens
cttgcccttgccctga

SEQ ID NO: 3895044 - DNA, 23 bp, Homo sapiens
cttgccgagagaggcgcgtctgc

SEQ ID NO: 3895045 - DNA, 23 bp, Homo sapiens
cttgccgagcctaatgaaaggga

SEQ ID NO: 3895046 - DNA, 23 bp, Homo sapiens
cttgcctgaggctcaagaggccc

SEQ ID NO: 3895047 - DNA, 18 bp, Homo sapiens
cttgccttttaaaagaaa

SEQ ID NO: 3895048 - DNA, 20 bp, Homo sapiens
cttgcggaatcactctgtcc

SEQ ID NO: 3895049 - DNA, 13 bp, Homo sapiens
cttgcgtcctgca

SEQ ID NO: 3895050 - DNA, 15 bp, Homo sapiens
cttgcgtcctgcaga

SEQ ID NO: 3895051 - DNA, 19 bp, Homo sapiens
cttgcgtcctgcagaggac

SEQ ID NO: 3895052 - DNA, 14 bp, Homo sapiens
cttgctcagtgcct

SEQ ID NO: 3895053 - DNA, 15 bp, Homo sapiens
cttgctcagtgcctc

SEQ ID NO: 3895054 - DNA, 16 bp, Homo sapiens
cttgctcagtgcctcc

SEQ ID NO: 3895055 - DNA, 19 bp, Homo sapiens
cttgctcagtgcctcctgg

SEQ ID NO: 3895056 - DNA, 14 bp, Homo sapiens
cttgctccagggtc

SEQ ID NO: 3895057 - DNA, 22 bp, Homo sapiens
cttgctccagggtcttgggcta

SEQ ID NO: 3895058 - DNA, 22 bp, Homo sapiens
cttgctctctggccttttccta

SEQ ID NO: 3895059 - DNA, 12 bp, Homo sapiens
cttgctcttctt

SEQ ID NO: 3895060 - DNA, 17 bp, Homo sapiens
cttgctggacggggact

SEQ ID NO: 3895061 - DNA, 18 bp, Homo sapiens
cttgctgtaactcagaca

SEQ ID NO: 3895062 - DNA, 16 bp, Homo sapiens
cttgcttctgcagcaa

SEQ ID NO: 3895063 - DNA, 23 bp, Homo sapiens
cttgcttctgcagcaactcccac

SEQ ID NO: 3895064 - DNA, 13 bp, Homo sapiens
cttgctttgctgt

SEQ ID NO: 3895065 - DNA, 22 bp, Homo sapiens
cttggaaaaatccagaaagaaa

SEQ ID NO: 3895066 - DNA, 24 bp, Homo sapiens
cttggaaagctgatgatgtctctt

SEQ ID NO: 3895067 - DNA, 15 bp, Homo sapiens
cttggaactgaaggg

SEQ ID NO: 3895068 - DNA, 17 bp, Homo sapiens
cttggaagtgtgtggaa

SEQ ID NO: 3895069 - DNA, 17 bp, Homo sapiens
cttggacagtctgagct

SEQ ID NO: 3895070 - DNA, 13 bp, Homo sapiens
cttggacctctgc

SEQ ID NO: 3895071 - DNA, 16 bp, Homo sapiens
cttggacctctgctct

SEQ ID NO: 3895072 - DNA, 14 bp, Homo sapiens
cttggactattata

SEQ ID NO: 3895073 - DNA, 13 bp, Homo sapiens
cttggactcctcc

SEQ ID NO: 3895074 - DNA, 18 bp, Homo sapiens
cttggactcctcccacaa

SEQ ID NO: 3895075 - DNA, 19 bp, Homo sapiens
cttggacttcctggggccc

SEQ ID NO: 3895076 - DNA, 13 bp, Homo sapiens
cttggacttgagg

SEQ ID NO: 3895077 - DNA, 15 bp, Homo sapiens
cttggagagcagctg

SEQ ID NO: 3895078 - DNA, 22 bp, Homo sapiens
cttggagagggacgaagaaagg

SEQ ID NO: 3895079 - DNA, 22 bp, Homo sapiens
cttggagccaatggagactgtc

SEQ ID NO: 3895080 - DNA, 18 bp, Homo sapiens
cttggagcctgaacatga

SEQ ID NO: 3895081 - DNA, 13 bp, Homo sapiens
cttggagggatgg

SEQ ID NO: 3895082 - DNA, 20 bp, Homo sapiens
cttggcaacagaagcagttg

SEQ ID NO: 3895083 - DNA, 23 bp, Homo sapiens
cttggcagcttaacattgacttc

SEQ ID NO: 3895084 - DNA, 19 bp, Homo sapiens
cttggcctcccaaggtgct

SEQ ID NO: 3895085 - DNA, 17 bp, Homo sapiens
cttggctgtaatcagtt

SEQ ID NO: 3895086 - DNA, 18 bp, Homo sapiens
cttggcttttgcttggca

SEQ ID NO: 3895087 - DNA, 20 bp, Homo sapiens
cttggcttttgcttggcaga

SEQ ID NO: 3895088 - DNA, 21 bp, Homo sapiens
cttggcttttgcttggcagag

SEQ ID NO: 3895089 - DNA, 20 bp, Homo sapiens
cttgggcacccccagcctgg

SEQ ID NO: 3895090 - DNA, 21 bp, Homo sapiens
cttgggcacccccagcctggg

SEQ ID NO: 3895091 - DNA, 19 bp, Homo sapiens
cttgggcatccacccagtg

SEQ ID NO: 3895092 - DNA, 24 bp, Homo sapiens
cttgggcatccacccagtgctgcc

SEQ ID NO: 3895093 - DNA, 12 bp, Homo sapiens
cttgggctcctg

SEQ ID NO: 3895094 - DNA, 15 bp, Homo sapiens
cttgggctcctggct

SEQ ID NO: 3895095 - DNA, 16 bp, Homo sapiens
cttgggctcctggctg

SEQ ID NO: 3895096 - DNA, 14 bp, Homo sapiens
cttggggcctggct

SEQ ID NO: 3895097 - DNA, 15 bp, Homo sapiens
cttggggcctggctt

SEQ ID NO: 3895098 - DNA, 23 bp, Homo sapiens
cttggggcctggcttgctccagg

SEQ ID NO: 3895099 - DNA, 19 bp, Homo sapiens
cttggggctcgccccaccc

SEQ ID NO: 3895100 - DNA, 20 bp, Homo sapiens
cttggggggtgatgagggca

SEQ ID NO: 3895101 - DNA, 17 bp, Homo sapiens
cttggggtcccagggaa

SEQ ID NO: 3895102 - DNA, 15 bp, Homo sapiens
cttggggttccccca

SEQ ID NO: 3895103 - DNA, 22 bp, Homo sapiens
cttggggttcccccagacagag

SEQ ID NO: 3895104 - DNA, 22 bp, Homo sapiens
cttgggtcgccctaccctcact

SEQ ID NO: 3895105 - DNA, 20 bp, Homo sapiens
cttggtgaatttttttttcc

SEQ ID NO: 3895106 - DNA, 16 bp, Homo sapiens
cttggtgactgtccca

SEQ ID NO: 3895107 - DNA, 13 bp, Homo sapiens
cttggtggctgag

SEQ ID NO: 3895108 - DNA, 13 bp, Homo sapiens
cttggttggctgg

SEQ ID NO: 3895109 - DNA, 15 bp, Homo sapiens
cttggtttggggaga

SEQ ID NO: 3895110 - DNA, 16 bp, Homo sapiens
cttggtttggggagaa

SEQ ID NO: 3895111 - DNA, 17 bp, Homo sapiens
cttgtaaataaatagat

SEQ ID NO: 3895112 - DNA, 19 bp, Homo sapiens
cttgtaaataaatagattt

SEQ ID NO: 3895113 - DNA, 23 bp, Homo sapiens
cttgtaaataaatagatttgatt

SEQ ID NO: 3895114 - DNA, 15 bp, Homo sapiens
cttgtaactccacca

SEQ ID NO: 3895115 - DNA, 21 bp, Homo sapiens
cttgtaactccaccaacccat

SEQ ID NO: 3895116 - DNA, 12 bp, Homo sapiens
cttgtacaaaat

SEQ ID NO: 3895117 - DNA, 13 bp, Homo sapiens
cttgtacaaaata

SEQ ID NO: 3895118 - DNA, 14 bp, Homo sapiens
cttgtaccccatcc

SEQ ID NO: 3895119 - DNA, 17 bp, Homo sapiens
cttgtactatgttaata

SEQ ID NO: 3895120 - DNA, 14 bp, Homo sapiens
cttgtagaaatctg

SEQ ID NO: 3895121 - DNA, 22 bp, Homo sapiens
cttgtagaccactgtcctggct

SEQ ID NO: 3895122 - DNA, 14 bp, Homo sapiens
cttgtataaatgta

SEQ ID NO: 3895123 - DNA, 15 bp, Homo sapiens
cttgtataaatgtat

SEQ ID NO: 3895124 - DNA, 18 bp, Homo sapiens
cttgtataaatgtatata

SEQ ID NO: 3895125 - DNA, 15 bp, Homo sapiens
cttgtatagtgtaaa

SEQ ID NO: 3895126 - DNA, 13 bp, Homo sapiens
ctttccagttaag

SEQ ID NO: 3895127 - DNA, 17 bp, Homo sapiens
ctttcccatgatccaga

SEQ ID NO: 3895128 - DNA, 19 bp, Homo sapiens
ctttcccatgatccagaac

SEQ ID NO: 3895129 - DNA, 13 bp, Homo sapiens
ctttcccatgctg

SEQ ID NO: 3895130 - DNA, 15 bp, Homo sapiens
ctttccccacctctt

SEQ ID NO: 3895131 - DNA, 15 bp, Homo sapiens
ctttccgctgtcgcc

SEQ ID NO: 3895132 - DNA, 19 bp, Homo sapiens
ctttccgctgtcgccccag

SEQ ID NO: 3895133 - DNA, 21 bp, Homo sapiens
ctttccgctgtcgccccaggc

SEQ ID NO: 3895134 - DNA, 18 bp, Homo sapiens
ctttcctaaagtctctgc

SEQ ID NO: 3895135 - DNA, 20 bp, Homo sapiens
ctttcctattttcttttcca

SEQ ID NO: 3895136 - DNA, 22 bp, Homo sapiens
ctttcctccaaactcctgcctg

SEQ ID NO: 3895137 - DNA, 11 bp, Homo sapiens
ctttcctcccc

SEQ ID NO: 3895138 - DNA, 15 bp, Homo sapiens
ctttcctccccacct

SEQ ID NO: 3895139 - DNA, 20 bp, Homo sapiens
ctttcctccccaccttcccc

SEQ ID NO: 3895140 - DNA, 21 bp, Homo sapiens
ctttcctccccaccttcccca

SEQ ID NO: 3895141 - DNA, 18 bp, Homo sapiens
ctttcctctgcagcactt

SEQ ID NO: 3895142 - DNA, 16 bp, Homo sapiens
ctttcctgtgccaacc

SEQ ID NO: 3895143 - DNA, 11 bp, Homo sapiens
ctttccttcct

SEQ ID NO: 3895144 - DNA, 17 bp, Homo sapiens
ctttccttttcttcctt

SEQ ID NO: 3895145 - DNA, 18 bp, Homo sapiens
ctttccttttcttccttc

SEQ ID NO: 3895146 - DNA, 24 bp, Homo sapiens
ctttctcagggggtcagcagagtt

SEQ ID NO: 3895147 - DNA, 16 bp, Homo sapiens
ctttctccagccagca

SEQ ID NO: 3895148 - DNA, 20 bp, Homo sapiens
ctttctccagccagcaatga

SEQ ID NO: 3895149 - DNA, 13 bp, Homo sapiens
ctttctccctcac

SEQ ID NO: 3895150 - DNA, 21 bp, Homo sapiens
ctttctccggggtctgtgctg

SEQ ID NO: 3895151 - DNA, 11 bp, Homo sapiens
ctttctctgca

SEQ ID NO: 3895152 - DNA, 19 bp, Homo sapiens
ctttctctggctccagaat

SEQ ID NO: 3895153 - DNA, 16 bp, Homo sapiens
ctttctcttccctcct

SEQ ID NO: 3895154 - DNA, 21 bp, Homo sapiens
ctttctggccctttctggacc

SEQ ID NO: 3895155 - DNA, 21 bp, Homo sapiens
ctttctgtgtgcaccttacca

SEQ ID NO: 3895156 - DNA, 13 bp, Homo sapiens
ctttcttcctctg

SEQ ID NO: 3895157 - DNA, 15 bp, Homo sapiens
ctttcttcctctgct

SEQ ID NO: 3895158 - DNA, 20 bp, Homo sapiens
ctttcttctacaaccagagc

SEQ ID NO: 3895159 - DNA, 16 bp, Homo sapiens
ctttcttctattttat

SEQ ID NO: 3895160 - DNA, 15 bp, Homo sapiens
ctttctttacctgag

SEQ ID NO: 3895161 - DNA, 18 bp, Homo sapiens
ctttctttacctgagacc

SEQ ID NO: 3895162 - DNA, 13 bp, Homo sapiens
ctttctttttctg

SEQ ID NO: 3895163 - DNA, 14 bp, Homo sapiens
ctttctttttctgt

SEQ ID NO: 3895164 - DNA, 22 bp, Homo sapiens
ctttgaaacaagataactgaga

SEQ ID NO: 3895165 - DNA, 22 bp, Homo sapiens
ctttgaatacccccagagacct

SEQ ID NO: 3895166 - DNA, 16 bp, Homo sapiens
ctttgaatgctttttg

SEQ ID NO: 3895167 - DNA, 20 bp, Homo sapiens
ctttgaatggtcttctgcca

SEQ ID NO: 3895168 - DNA, 13 bp, Homo sapiens
ctttgacatgaaa

SEQ ID NO: 3895169 - DNA, 15 bp, Homo sapiens
ctttgacatgaaaag

SEQ ID NO: 3895170 - DNA, 16 bp, Homo sapiens
ctttgactcacctgtt

SEQ ID NO: 3895171 - DNA, 13 bp, Homo sapiens
ctttgagaaagaa

SEQ ID NO: 3895172 - DNA, 22 bp, Homo sapiens
ctttgagggacgatctttgaat

SEQ ID NO: 3895173 - DNA, 15 bp, Homo sapiens
ctttgaggttgcttt

SEQ ID NO: 3895174 - DNA, 21 bp, Homo sapiens
ctttgagtaccaaatccacaa

SEQ ID NO: 3895175 - DNA, 16 bp, Homo sapiens
ctttgatctctgctta

SEQ ID NO: 3895176 - DNA, 20 bp, Homo sapiens
ctttgatgcatttccacact

SEQ ID NO: 3895177 - DNA, 13 bp, Homo sapiens
ctttgcacatgtg

SEQ ID NO: 3895178 - DNA, 13 bp, Homo sapiens
ctttgcactgagg

SEQ ID NO: 3895179 - DNA, 15 bp, Homo sapiens
ctttgcactgagggc

SEQ ID NO: 3895180 - DNA, 18 bp, Homo sapiens
ctttgcactgagggccac

SEQ ID NO: 3895181 - DNA, 13 bp, Homo sapiens
ctttgcaggctct

SEQ ID NO: 3895182 - DNA, 20 bp, Homo sapiens
ctttgcaggctctgggctca

SEQ ID NO: 3895183 - DNA, 21 bp, Homo sapiens
ctttgcattccatgattttac

SEQ ID NO: 3895184 - DNA, 19 bp, Homo sapiens
ctttgccatgggcctgctg

SEQ ID NO: 3895185 - DNA, 20 bp, Homo sapiens
ctttgccatgggcctgctgc

SEQ ID NO: 3895186 - DNA, 17 bp, Homo sapiens
ctttgctacaataaatg

SEQ ID NO: 3895187 - DNA, 14 bp, Homo sapiens
ctttgctctttctt

SEQ ID NO: 3895188 - DNA, 17 bp, Homo sapiens
ctttggaagaaaaaatc

SEQ ID NO: 3895189 - DNA, 23 bp, Homo sapiens
ctttggacaactgacaatatgat

SEQ ID NO: 3895190 - DNA, 19 bp, Homo sapiens
ctgctcatcacccagtcct

SEQ ID NO: 3895191 - DNA, 22 bp, Homo sapiens
ctgctcatcacccagtcctggc

SEQ ID NO: 3895192 - DNA, 17 bp, Homo sapiens
ctgctcatccagggtgt

SEQ ID NO: 3895193 - DNA, 19 bp, Homo sapiens
ctgctcattccttctggag

SEQ ID NO: 3895194 - DNA, 21 bp, Homo sapiens
ctgctcccagcagccctaagg

SEQ ID NO: 3895195 - DNA, 15 bp, Homo sapiens
ctgctcccatctgca

SEQ ID NO: 3895196 - DNA, 18 bp, Homo sapiens
ctgctccccagccctggc

SEQ ID NO: 3895197 - DNA, 20 bp, Homo sapiens
ctgctccccagccctggctc

SEQ ID NO: 3895198 - DNA, 17 bp, Homo sapiens
ctgctcccccaccccct

SEQ ID NO: 3895199 - DNA, 13 bp, Homo sapiens
ctgctcctccagg

SEQ ID NO: 3895200 - DNA, 16 bp, Homo sapiens
ctgctcctccagggcc

SEQ ID NO: 3895201 - DNA, 17 bp, Homo sapiens
ctgctcctccagggcca

SEQ ID NO: 3895202 - DNA, 13 bp, Homo sapiens
ctgctcctcccaa

SEQ ID NO: 3895203 - DNA, 17 bp, Homo sapiens
ctgctcggggtgcacag

SEQ ID NO: 3895204 - DNA, 18 bp, Homo sapiens
ctgctcggggtgcacagg

SEQ ID NO: 3895205 - DNA, 22 bp, Homo sapiens
ctgctcggggtgcacaggaggg

SEQ ID NO: 3895206 - DNA, 13 bp, Homo sapiens
ctgctctagccag

SEQ ID NO: 3895207 - DNA, 17 bp, Homo sapiens
ctgctctagccaggagt

SEQ ID NO: 3895208 - DNA, 15 bp, Homo sapiens
ctgctctcatgcctg

SEQ ID NO: 3895209 - DNA, 15 bp, Homo sapiens
ctgctctcttcagga

SEQ ID NO: 3895210 - DNA, 18 bp, Homo sapiens
ctgctctcttcaggaggc

SEQ ID NO: 3895211 - DNA, 13 bp, Homo sapiens
ctgctctgaggct

SEQ ID NO: 3895212 - DNA, 22 bp, Homo sapiens
ctgctctgaggcttccagagag

SEQ ID NO: 3895213 - DNA, 18 bp, Homo sapiens
ctgctcttagtgcccgcc

SEQ ID NO: 3895214 - DNA, 19 bp, Homo sapiens
ctgctcttagtgcccgcct

SEQ ID NO: 3895215 - DNA, 22 bp, Homo sapiens
ctgctgaagaggcaagagacag

SEQ ID NO: 3895216 - DNA, 17 bp, Homo sapiens
ctgctgaagttctgagc

SEQ ID NO: 3895217 - DNA, 20 bp, Homo sapiens
ctgctgacctgatcacctct

SEQ ID NO: 3895218 - DNA, 15 bp, Homo sapiens
ctgctgagaacctgg

SEQ ID NO: 3895219 - DNA, 18 bp, Homo sapiens
ctgctgagaacctggcct

SEQ ID NO: 3895220 - DNA, 19 bp, Homo sapiens
ctgctgagaacctggcctt

SEQ ID NO: 3895221 - DNA, 20 bp, Homo sapiens
ctgctgagaacctggccttc

SEQ ID NO: 3895222 - DNA, 15 bp, Homo sapiens
ctgctgagagaccca

SEQ ID NO: 3895223 - DNA, 21 bp, Homo sapiens
ctgctgagctctgagaggccc

SEQ ID NO: 3895224 - DNA, 14 bp, Homo sapiens
ctgctgcaccagag

SEQ ID NO: 3895225 - DNA, 16 bp, Homo sapiens
ctgctgcaccagagtg

SEQ ID NO: 3895226 - DNA, 20 bp, Homo sapiens
ctgctgcatttgtgtcatct

SEQ ID NO: 3895227 - DNA, 15 bp, Homo sapiens
ctgctgcccagcctc

SEQ ID NO: 3895228 - DNA, 21 bp, Homo sapiens
ctgctgccgcctcccagcctg

SEQ ID NO: 3895229 - DNA, 16 bp, Homo sapiens
ctgctgcgtcagacca

SEQ ID NO: 3895230 - DNA, 22 bp, Homo sapiens
ctgctgctactacccgagccca

SEQ ID NO: 3895231 - DNA, 11 bp, Homo sapiens
ctgctgctcat

SEQ ID NO: 3895232 - DNA, 14 bp, Homo sapiens
ctgctgctgagaac

SEQ ID NO: 3895233 - DNA, 19 bp, Homo sapiens
ctgctgctgagaacctggc

SEQ ID NO: 3895234 - DNA, 22 bp, Homo sapiens
ctgctgctgagaacctggcctt

SEQ ID NO: 3895235 - DNA, 10 bp, Homo sapiens
ctgctgctgt

SEQ ID NO: 3895236 - DNA, 21 bp, Homo sapiens
ctgctgctgtaactgctgagc

SEQ ID NO: 3895237 - DNA, 13 bp, Homo sapiens
ctgctgctgtgtt

SEQ ID NO: 3895238 - DNA, 14 bp, Homo sapiens
ctgctggaaaccac

SEQ ID NO: 3895239 - DNA, 15 bp, Homo sapiens
ctgctggcacctcag

SEQ ID NO: 3895240 - DNA, 12 bp, Homo sapiens
ctgctggcctgg

SEQ ID NO: 3895241 - DNA, 13 bp, Homo sapiens
ctgctggcctgga

SEQ ID NO: 3895242 - DNA, 13 bp, Homo sapiens
ctgctggcctggc

SEQ ID NO: 3895243 - DNA, 13 bp, Homo sapiens
ctgctggctgcct

SEQ ID NO: 3895244 - DNA, 18 bp, Homo sapiens
ctgctgggaaccccgcag

SEQ ID NO: 3895245 - DNA, 22 bp, Homo sapiens
ctgctgggaaccccgcagcccg

SEQ ID NO: 3895246 - DNA, 16 bp, Homo sapiens
ctgctgggctctccac

SEQ ID NO: 3895247 - DNA, 21 bp, Homo sapiens
ctgctgggctctccacctcag

SEQ ID NO: 3895248 - DNA, 22 bp, Homo sapiens
ctgctgggctctccacctcagc

SEQ ID NO: 3895249 - DNA, 19 bp, Homo sapiens
ctgctggggcatgtgtgcc

SEQ ID NO: 3895250 - DNA, 19 bp, Homo sapiens
ctgctgtaactgctgagcc

SEQ ID NO: 3895251 - DNA, 22 bp, Homo sapiens
ctgctgtaactgctgagccact

SEQ ID NO: 3895252 - DNA, 23 bp, Homo sapiens
ctgctgtaactgctgagccactc

SEQ ID NO: 3895253 - DNA, 23 bp, Homo sapiens
ctgctgtgcaccttacattccta

SEQ ID NO: 3895254 - DNA, 13 bp, Homo sapiens
ctgctgtggcctc

SEQ ID NO: 3895255 - DNA, 20 bp, Homo sapiens
ctgctgttgctggactgagg

SEQ ID NO: 3895256 - DNA, 12 bp, Homo sapiens
ctgctgtttaag

SEQ ID NO: 3895257 - DNA, 13 bp, Homo sapiens
ctgcttacctgac

SEQ ID NO: 3895258 - DNA, 21 bp, Homo sapiens
ctgcttcatgctcagccctga

SEQ ID NO: 3895259 - DNA, 13 bp, Homo sapiens
ctgcttccttctg

SEQ ID NO: 3895260 - DNA, 20 bp, Homo sapiens
ctgcttccttctgcacccag

SEQ ID NO: 3895261 - DNA, 14 bp, Homo sapiens
ctgcttcttcatct

SEQ ID NO: 3895262 - DNA, 16 bp, Homo sapiens
ctgcttgactatcaca

SEQ ID NO: 3895263 - DNA, 17 bp, Homo sapiens
ctgctttgggctgccct

SEQ ID NO: 3895264 - DNA, 18 bp, Homo sapiens
ctgctttgggctgccctg

SEQ ID NO: 3895265 - DNA, 13 bp, Homo sapiens
ctgcttttccagg

SEQ ID NO: 3895266 - DNA, 17 bp, Homo sapiens
ctggaaaaaaaatatat

SEQ ID NO: 3895267 - DNA, 14 bp, Homo sapiens
ctggaaaagaggag

SEQ ID NO: 3895268 - DNA, 10 bp, Homo sapiens
ctggaaataa

SEQ ID NO: 3895269 - DNA, 18 bp, Homo sapiens
ctggaaattctggaactg

SEQ ID NO: 3895270 - DNA, 20 bp, Homo sapiens
ctggaacagcccattttatc

SEQ ID NO: 3895271 - DNA, 19 bp, Homo sapiens
ctggaaccagggaggagag

SEQ ID NO: 3895272 - DNA, 13 bp, Homo sapiens
ctggaaggcaggg

SEQ ID NO: 3895273 - DNA, 18 bp, Homo sapiens
ctggaaggcagggcagag

SEQ ID NO: 3895274 - DNA, 12 bp, Homo sapiens
ctggaaggctgg

SEQ ID NO: 3895275 - DNA, 13 bp, Homo sapiens
ctggaaggctggc

SEQ ID NO: 3895276 - DNA, 14 bp, Homo sapiens
ctggaaggctggct

SEQ ID NO: 3895277 - DNA, 15 bp, Homo sapiens
ctggaagggctagaa

SEQ ID NO: 3895278 - DNA, 21 bp, Homo sapiens
ctggaatcaatttcccagaag

SEQ ID NO: 3895279 - DNA, 19 bp, Homo sapiens
ctggaatctggagagctag

SEQ ID NO: 3895280 - DNA, 15 bp, Homo sapiens
ctggaattcagcacc

SEQ ID NO: 3895281 - DNA, 17 bp, Homo sapiens
ctggaattcagcaccct

SEQ ID NO: 3895282 - DNA, 23 bp, Homo sapiens
ctggaattcagcaccctgggtgc

SEQ ID NO: 3895283 - DNA, 15 bp, Homo sapiens
ctggacaacccagaa

SEQ ID NO: 3895284 - DNA, 17 bp, Homo sapiens
ctggacaagaagctgct

SEQ ID NO: 3895285 - DNA, 19 bp, Homo sapiens
ctggacaagaagctgctat

SEQ ID NO: 3895286 - DNA, 16 bp, Homo sapiens
ctggacagctgtgcct

SEQ ID NO: 3895287 - DNA, 22 bp, Homo sapiens
ctggaccaaccctgtttcctga

SEQ ID NO: 3895288 - DNA, 23 bp, Homo sapiens
ctggaccaaccctgtttcctgag

SEQ ID NO: 3895289 - DNA, 15 bp, Homo sapiens
ctggaccactgggca

SEQ ID NO: 3895290 - DNA, 17 bp, Homo sapiens
ctggaccgcttcccaga

SEQ ID NO: 3895291 - DNA, 20 bp, Homo sapiens
ctggacctatgtcctaagga

SEQ ID NO: 3895292 - DNA, 19 bp, Homo sapiens
ctggacctccccctcttgg

SEQ ID NO: 3895293 - DNA, 15 bp, Homo sapiens
ctggacctgagtcgg

SEQ ID NO: 3895294 - DNA, 17 bp, Homo sapiens
ctggaccttttgtctca

SEQ ID NO: 3895295 - DNA, 21 bp, Homo sapiens
ctggacgatagcttggaggga

SEQ ID NO: 3895296 - DNA, 20 bp, Homo sapiens
ctggactctaagctggagct

SEQ ID NO: 3895297 - DNA, 22 bp, Homo sapiens
ctggactctaagctggagctct

SEQ ID NO: 3895298 - DNA, 12 bp, Homo sapiens
ctggactgagga

SEQ ID NO: 3895299 - DNA, 13 bp, Homo sapiens
ctggactgaggac

SEQ ID NO: 3895300 - DNA, 18 bp, Homo sapiens
ctggactgtcatagaaat

SEQ ID NO: 3895301 - DNA, 19 bp, Homo sapiens
ctggagaactagaacctgg

SEQ ID NO: 3895302 - DNA, 14 bp, Homo sapiens
ctggagaactagag

SEQ ID NO: 3895303 - DNA, 19 bp, Homo sapiens
ctggagaagaccctccccg

SEQ ID NO: 3895304 - DNA, 18 bp, Homo sapiens
ctggagaagctcacccaa

SEQ ID NO: 3895305 - DNA, 23 bp, Homo sapiens
ctggagaccgcttcacccctgca

SEQ ID NO: 3895306 - DNA, 12 bp, Homo sapiens
ctggagagaagt

SEQ ID NO: 3895307 - DNA, 20 bp, Homo sapiens
ctggagagcatagggtctgg

SEQ ID NO: 3895308 - DNA, 22 bp, Homo sapiens
ctggagagccagaacctggagg

SEQ ID NO: 3895309 - DNA, 23 bp, Homo sapiens
ctggagagccagaacctggaggg

SEQ ID NO: 3895310 - DNA, 19 bp, Homo sapiens
ctggagagctagaacctgg

SEQ ID NO: 3895311 - DNA, 20 bp, Homo sapiens
ctggagagctagaacctgga

SEQ ID NO: 3895312 - DNA, 22 bp, Homo sapiens
ctggagagctagaacctggagg

SEQ ID NO: 3895313 - DNA, 18 bp, Homo sapiens
ctggagaggggcctggga

SEQ ID NO: 3895314 - DNA, 19 bp, Homo sapiens
ctggagatttcagttactt

SEQ ID NO: 3895315 - DNA, 14 bp, Homo sapiens
ctggagcaagaagg

SEQ ID NO: 3895316 - DNA, 20 bp, Homo sapiens
ctggagcaagaaggaaggag

SEQ ID NO: 3895317 - DNA, 16 bp, Homo sapiens
ctggagcaagagagag

SEQ ID NO: 3895318 - DNA, 17 bp, Homo sapiens
ctggagcaagagagagc

SEQ ID NO: 3895319 - DNA, 14 bp, Homo sapiens
ctggagccagagag

SEQ ID NO: 3895320 - DNA, 22 bp, Homo sapiens
ctggagcccgagggcctgacag

SEQ ID NO: 3895321 - DNA, 18 bp, Homo sapiens
ctggagctcttggaagag

SEQ ID NO: 3895322 - DNA, 13 bp, Homo sapiens
ctggagctggctt

SEQ ID NO: 3895323 - DNA, 20 bp, Homo sapiens
ctggaggacctgagcctgcc

SEQ ID NO: 3895324 - DNA, 22 bp, Homo sapiens
ctggaggacctgagcctgccga

SEQ ID NO: 3895325 - DNA, 17 bp, Homo sapiens
ctggaggatccctccat

SEQ ID NO: 3895326 - DNA, 22 bp, Homo sapiens
ctggaggcagggccttgcccag

SEQ ID NO: 3895327 - DNA, 23 bp, Homo sapiens
ctggaggctgcagagctgaccca

SEQ ID NO: 3895328 - DNA, 22 bp, Homo sapiens
ctggagggaatgaacctggagg

SEQ ID NO: 3895329 - DNA, 23 bp, Homo sapiens
gaactcatcctgtgtggggaggc

SEQ ID NO: 3895330 - DNA, 18 bp, Homo sapiens
gaactccactctccttcg

SEQ ID NO: 3895331 - DNA, 17 bp, Homo sapiens
gaactccttattttgta

SEQ ID NO: 3895332 - DNA, 16 bp, Homo sapiens
gaactctggcttccag

SEQ ID NO: 3895333 - DNA, 15 bp, Homo sapiens
gaactgaattaagtt

SEQ ID NO: 3895334 - DNA, 16 bp, Homo sapiens
gaactgagccaaacac

SEQ ID NO: 3895335 - DNA, 22 bp, Homo sapiens
gaactgagccaaacacactgta

SEQ ID NO: 3895336 - DNA, 12 bp, Homo sapiens
gaactgccccat

SEQ ID NO: 3895337 - DNA, 16 bp, Homo sapiens
gaactggacgcccagc

SEQ ID NO: 3895338 - DNA, 14 bp, Homo sapiens
gaactggccaagct

SEQ ID NO: 3895339 - DNA, 18 bp, Homo sapiens
gaactggccaagctgagg

SEQ ID NO: 3895340 - DNA, 20 bp, Homo sapiens
gaactggtcaccatgaaact

SEQ ID NO: 3895341 - DNA, 18 bp, Homo sapiens
gaactggttcaagagaca

SEQ ID NO: 3895342 - DNA, 19 bp, Homo sapiens
gaactgttgtttacttgtt

SEQ ID NO: 3895343 - DNA, 19 bp, Homo sapiens
gaacttacacttggagccc

SEQ ID NO: 3895344 - DNA, 14 bp, Homo sapiens
gaacttcaaaatgt

SEQ ID NO: 3895345 - DNA, 14 bp, Homo sapiens
gaacttctaatata

SEQ ID NO: 3895346 - DNA, 18 bp, Homo sapiens
gaacttgaggacacatgt

SEQ ID NO: 3895347 - DNA, 21 bp, Homo sapiens
gaacttgaggacacatgtcca

SEQ ID NO: 3895348 - DNA, 19 bp, Homo sapiens
gaacttggaaagaaatgcc

SEQ ID NO: 3895349 - DNA, 21 bp, Homo sapiens
gaactttctcttcatactttt

SEQ ID NO: 3895350 - DNA, 14 bp, Homo sapiens
gaactttgaaggac

SEQ ID NO: 3895351 - DNA, 14 bp, Homo sapiens
gaagaaaaatgttt

SEQ ID NO: 3895352 - DNA, 21 bp, Homo sapiens
gaagaaaactatcctgcgggt

SEQ ID NO: 3895353 - DNA, 20 bp, Homo sapiens
gaagaaacaggggatcaaag

SEQ ID NO: 3895354 - DNA, 14 bp, Homo sapiens
gaagaaaccccaag

SEQ ID NO: 3895355 - DNA, 15 bp, Homo sapiens
gaagaaaccccaagc

SEQ ID NO: 3895356 - DNA, 16 bp, Homo sapiens
gaagaaaccccaagca

SEQ ID NO: 3895357 - DNA, 21 bp, Homo sapiens
gaagaaatccataacaccccc

SEQ ID NO: 3895358 - DNA, 15 bp, Homo sapiens
gaagaaattcctgta

SEQ ID NO: 3895359 - DNA, 16 bp, Homo sapiens
gaagaacatccaagga

SEQ ID NO: 3895360 - DNA, 14 bp, Homo sapiens
gaagaagctgagga

SEQ ID NO: 3895361 - DNA, 14 bp, Homo sapiens
gaagaatattcagg

SEQ ID NO: 3895362 - DNA, 19 bp, Homo sapiens
gaagaatattcaggactta

SEQ ID NO: 3895363 - DNA, 20 bp, Homo sapiens
gaagaattgaacccaggagg

SEQ ID NO: 3895364 - DNA, 23 bp, Homo sapiens
gaagaccaatctcttgaatccca

SEQ ID NO: 3895365 - DNA, 15 bp, Homo sapiens
gaagacccacgtgct

SEQ ID NO: 3895366 - DNA, 18 bp, Homo sapiens
gaagacccagtgtaaaga

SEQ ID NO: 3895367 - DNA, 21 bp, Homo sapiens
gaagacgtgatgccaggacca

SEQ ID NO: 3895368 - DNA, 12 bp, Homo sapiens
gaagagaaggag

SEQ ID NO: 3895369 - DNA, 15 bp, Homo sapiens
gaagagaaggagcag

SEQ ID NO: 3895370 - DNA, 15 bp, Homo sapiens
gaagagaccacagca

SEQ ID NO: 3895371 - DNA, 13 bp, Homo sapiens
gaagagaggcacc

SEQ ID NO: 3895372 - DNA, 18 bp, Homo sapiens
gaagagcagcctgatggc

SEQ ID NO: 3895373 - DNA, 15 bp, Homo sapiens
gaagagcaggcacat

SEQ ID NO: 3895374 - DNA, 23 bp, Homo sapiens
gaagagcaggcacatggaggagc

SEQ ID NO: 3895375 - DNA, 13 bp, Homo sapiens
gaagagctgttca

SEQ ID NO: 3895376 - DNA, 20 bp, Homo sapiens
gaagagctgttcacagccag

SEQ ID NO: 3895377 - DNA, 19 bp, Homo sapiens
gaagagggcagtacctggg

SEQ ID NO: 3895378 - DNA, 19 bp, Homo sapiens
gaagagtttaactttgggc

SEQ ID NO: 3895379 - DNA, 23 bp, Homo sapiens
gaagataatgttctttaatgttg

SEQ ID NO: 3895380 - DNA, 17 bp, Homo sapiens
gaagatgaaagaggagg

SEQ ID NO: 3895381 - DNA, 14 bp, Homo sapiens
gaagatgaagagaa

SEQ ID NO: 3895382 - DNA, 12 bp, Homo sapiens
gaagatgccctc

SEQ ID NO: 3895383 - DNA, 15 bp, Homo sapiens
gaagatggtagcaga

SEQ ID NO: 3895384 - DNA, 19 bp, Homo sapiens
gaagatggtagcagataaa

SEQ ID NO: 3895385 - DNA, 20 bp, Homo sapiens
gaagatggtagcagataaag

SEQ ID NO: 3895386 - DNA, 16 bp, Homo sapiens
gaagcaaagcaccagc

SEQ ID NO: 3895387 - DNA, 13 bp, Homo sapiens
gaagcagcctcct

SEQ ID NO: 3895388 - DNA, 14 bp, Homo sapiens
gaagcagcctccta

SEQ ID NO: 3895389 - DNA, 20 bp, Homo sapiens
gaagcagcctcctaatttga

SEQ ID NO: 3895390 - DNA, 13 bp, Homo sapiens
gaagcaggcagag

SEQ ID NO: 3895391 - DNA, 16 bp, Homo sapiens
gaagcagtgagccgca

SEQ ID NO: 3895392 - DNA, 12 bp, Homo sapiens
gaagccaggagc

SEQ ID NO: 3895393 - DNA, 17 bp, Homo sapiens
gaagcccaggctgaaga

SEQ ID NO: 3895394 - DNA, 21 bp, Homo sapiens
gaagccccttgtcctctcccg

SEQ ID NO: 3895395 - DNA, 19 bp, Homo sapiens
gaagcctccgtcaggagag

SEQ ID NO: 3895396 - DNA, 15 bp, Homo sapiens
gaagcctctgccctg

SEQ ID NO: 3895397 - DNA, 21 bp, Homo sapiens
gaagcctctgccctgcctccc

SEQ ID NO: 3895398 - DNA, 12 bp, Homo sapiens
gaagcctggggg

SEQ ID NO: 3895399 - DNA, 20 bp, Homo sapiens
gaagcctgggggcctggctg

SEQ ID NO: 3895400 - DNA, 22 bp, Homo sapiens
gaagcctgttttgttggaaggt

SEQ ID NO: 3895401 - DNA, 18 bp, Homo sapiens
gaagctaacagggaaggc

SEQ ID NO: 3895402 - DNA, 19 bp, Homo sapiens
gaagctaacagggaaggca

SEQ ID NO: 3895403 - DNA, 21 bp, Homo sapiens
gaagctattgagaaagacctg

SEQ ID NO: 3895404 - DNA, 18 bp, Homo sapiens
gaagctattgatgtttcc

SEQ ID NO: 3895405 - DNA, 18 bp, Homo sapiens
gaagctccactgtcaccc

SEQ ID NO: 3895406 - DNA, 21 bp, Homo sapiens
gaagctcccagatgctgggga

SEQ ID NO: 3895407 - DNA, 12 bp, Homo sapiens
gaagctgagaag

SEQ ID NO: 3895408 - DNA, 22 bp, Homo sapiens
gaagctgagaagaagctgagga

SEQ ID NO: 3895409 - DNA, 14 bp, Homo sapiens
gaagctgagcaggc

SEQ ID NO: 3895410 - DNA, 15 bp, Homo sapiens
gaagctgagcaggcc

SEQ ID NO: 3895411 - DNA, 17 bp, Homo sapiens
gaagctgatgctttgct

SEQ ID NO: 3895412 - DNA, 17 bp, Homo sapiens
gaagctgggggaagggt

SEQ ID NO: 3895413 - DNA, 19 bp, Homo sapiens
gaagctgggggaagggtgg

SEQ ID NO: 3895414 - DNA, 16 bp, Homo sapiens
gaagctgtactcagag

SEQ ID NO: 3895415 - DNA, 20 bp, Homo sapiens
gaagctgtactcagagcaga

SEQ ID NO: 3895416 - DNA, 23 bp, Homo sapiens
gaagctgtgtccttgcacctgca

SEQ ID NO: 3895417 - DNA, 12 bp, Homo sapiens
gaagctttacca

SEQ ID NO: 3895418 - DNA, 22 bp, Homo sapiens
gaaggaactctggcttccaggt

SEQ ID NO: 3895419 - DNA, 18 bp, Homo sapiens
gaaggaagggacacacac

SEQ ID NO: 3895420 - DNA, 22 bp, Homo sapiens
gaaggaataaattgctccttga

SEQ ID NO: 3895421 - DNA, 16 bp, Homo sapiens
gaaggagaaaggagcc

SEQ ID NO: 3895422 - DNA, 21 bp, Homo sapiens
gaaggagaaaggagccggacc

SEQ ID NO: 3895423 - DNA, 17 bp, Homo sapiens
gaaggagaaggaaggag

SEQ ID NO: 3895424 - DNA, 17 bp, Homo sapiens
gaaggagactcacctct

SEQ ID NO: 3895425 - DNA, 20 bp, Homo sapiens
gaaggagactcacctctgcc

SEQ ID NO: 3895426 - DNA, 19 bp, Homo sapiens
gaaggaggagggcgcccat

SEQ ID NO: 3895427 - DNA, 13 bp, Homo sapiens
gaaggaggcagac

SEQ ID NO: 3895428 - DNA, 15 bp, Homo sapiens
gaaggagggcagagc

SEQ ID NO: 3895429 - DNA, 21 bp, Homo sapiens
gaaggataagagaaacaggcc

SEQ ID NO: 3895430 - DNA, 12 bp, Homo sapiens
gaaggcaaaaaa

SEQ ID NO: 3895431 - DNA, 15 bp, Homo sapiens
gaaggcaaatataag

SEQ ID NO: 3895432 - DNA, 23 bp, Homo sapiens
gaaggcaaatataagctgggaaa

SEQ ID NO: 3895433 - DNA, 21 bp, Homo sapiens
gaaggcacaggtgtaaatata

SEQ ID NO: 3895434 - DNA, 13 bp, Homo sapiens
gaaggcaggcagg

SEQ ID NO: 3895435 - DNA, 14 bp, Homo sapiens
gaaggcaggcaggg

SEQ ID NO: 3895436 - DNA, 17 bp, Homo sapiens
gaaggcaggcagggctc

SEQ ID NO: 3895437 - DNA, 19 bp, Homo sapiens
gaaggcaggcagggctctc

SEQ ID NO: 3895438 - DNA, 21 bp, Homo sapiens
gaaggcaggcagggctctcct

SEQ ID NO: 3895439 - DNA, 21 bp, Homo sapiens
gaaggcagggacagagatgga

SEQ ID NO: 3895440 - DNA, 16 bp, Homo sapiens
gaaggcagggaggagg

SEQ ID NO: 3895441 - DNA, 20 bp, Homo sapiens
gaaggcagggaggaggcaga

SEQ ID NO: 3895442 - DNA, 13 bp, Homo sapiens
gaaggcagggcag

SEQ ID NO: 3895443 - DNA, 18 bp, Homo sapiens
gaaggcgtgcaaggggct

SEQ ID NO: 3895444 - DNA, 17 bp, Homo sapiens
gaaggctactggcatta

SEQ ID NO: 3895445 - DNA, 14 bp, Homo sapiens
gaaggctggctgag

SEQ ID NO: 3895446 - DNA, 14 bp, Homo sapiens
gaaggctggggcca

SEQ ID NO: 3895447 - DNA, 14 bp, Homo sapiens
gaagggacacacac

SEQ ID NO: 3895448 - DNA, 15 bp, Homo sapiens
gaagggacacacaca

SEQ ID NO: 3895449 - DNA, 18 bp, Homo sapiens
gaagggagttgctcactc

SEQ ID NO: 3895450 - DNA, 12 bp, Homo sapiens
gaagggccagga

SEQ ID NO: 3895451 - DNA, 13 bp, Homo sapiens
gaagggccaggag

SEQ ID NO: 3895452 - DNA, 20 bp, Homo sapiens
gaagggctagaacctggagg

SEQ ID NO: 3895453 - DNA, 21 bp, Homo sapiens
gaaggggccccggggctggca

SEQ ID NO: 3895454 - DNA, 17 bp, Homo sapiens
gaagggggtccacccag

SEQ ID NO: 3895455 - DNA, 15 bp, Homo sapiens
gaaggggtgccctct

SEQ ID NO: 3895456 - DNA, 22 bp, Homo sapiens
gaagggttggtgggctggccca

SEQ ID NO: 3895457 - DNA, 21 bp, Homo sapiens
gaaggtcactcttcctgcaag

SEQ ID NO: 3895458 - DNA, 14 bp, Homo sapiens
gaaggtgctgagct

SEQ ID NO: 3895459 - DNA, 12 bp, Homo sapiens
gaaggttcctga

SEQ ID NO: 3895460 - DNA, 11 bp, Homo sapiens
gaagtaaattt

SEQ ID NO: 3895461 - DNA, 21 bp, Homo sapiens
gaagtaagagctaagttctaa

SEQ ID NO: 3895462 - DNA, 17 bp, Homo sapiens
gaagtaagtggggttgc

SEQ ID NO: 3895463 - DNA, 14 bp, Homo sapiens
gaagtatgtgtggg

SEQ ID NO: 3895464 - DNA, 23 bp, Homo sapiens
gaagtcgtccttactcctgtggg

SEQ ID NO: 3895465 - DNA, 15 bp, Homo sapiens
gaagtctaggagctg

SEQ ID NO: 3895466 - DNA, 20 bp, Homo sapiens
gaagtctaggagctgggagg

SEQ ID NO: 3895467 - DNA, 13 bp, Homo sapiens
gaagtgaaggaga

SEQ ID NO: 3895468 - DNA, 15 bp, Homo sapiens
gaagtgaaggagaaa

SEQ ID NO: 3895469 - DNA, 17 bp, Homo sapiens
gaagtgaaggagaaagg

SEQ ID NO: 3895470 - DNA, 16 bp, Homo sapiens
gaagtgagggctgggc

SEQ ID NO: 3895471 - DNA, 16 bp, Homo sapiens
gaagtgggccaggaca

SEQ ID NO: 3895472 - DNA, 18 bp, Homo sapiens
gaagtgggccaggacagg

SEQ ID NO: 3895473 - DNA, 19 bp, Homo sapiens
gaagtgggccaggacaggc

SEQ ID NO: 3895474 - DNA, 21 bp, Homo sapiens
gaagtgggccaggacaggccc

SEQ ID NO: 3895475 - DNA, 17 bp, Homo sapiens
gaagtgtgtggaaggca

SEQ ID NO: 3895476 - DNA, 23 bp, Homo sapiens
gaagttttcaggacttggtctga

SEQ ID NO: 3895477 - DNA, 14 bp, Homo sapiens
gaataaaaaccctg

SEQ ID NO: 3895478 - DNA, 15 bp, Homo sapiens
gaataaaaaccctgt

SEQ ID NO: 3895479 - DNA, 22 bp, Homo sapiens
gaataaaattgtaaaattgtat

SEQ ID NO: 3895480 - DNA, 11 bp, Homo sapiens
gaataaacttc

SEQ ID NO: 3895481 - DNA, 17 bp, Homo sapiens
gaataaacttcagcacc

SEQ ID NO: 3895482 - DNA, 20 bp, Homo sapiens
gaataaagttctgagtgttt

SEQ ID NO: 3895483 - DNA, 18 bp, Homo sapiens
gaataaatgttcaaactg

SEQ ID NO: 3895484 - DNA, 17 bp, Homo sapiens
gaataagaaagtttcac

SEQ ID NO: 3895485 - DNA, 16 bp, Homo sapiens
gaataagaatggagca

SEQ ID NO: 3895486 - DNA, 22 bp, Homo sapiens
gaataataattatccagagttt

SEQ ID NO: 3895487 - DNA, 13 bp, Homo sapiens
gaataatgtgtta

SEQ ID NO: 3895488 - DNA, 13 bp, Homo sapiens
gaatacagtgtta

SEQ ID NO: 3895489 - DNA, 20 bp, Homo sapiens
gaatacagtgttattttctt

SEQ ID NO: 3895490 - DNA, 14 bp, Homo sapiens
gaatacccccagag

SEQ ID NO: 3895491 - DNA, 21 bp, Homo sapiens
gaatacccccagagacctttt

SEQ ID NO: 3895492 - DNA, 22 bp, Homo sapiens
gaatagaaaagatgagaggcag

SEQ ID NO: 3895493 - DNA, 18 bp, Homo sapiens
gaatataaagttaaaaaa

SEQ ID NO: 3895494 - DNA, 12 bp, Homo sapiens
gaatatattata

SEQ ID NO: 3895495 - DNA, 14 bp, Homo sapiens
gaatatgacagctg

SEQ ID NO: 3895496 - DNA, 13 bp, Homo sapiens
gaatatggacaaa

SEQ ID NO: 3895497 - DNA, 13 bp, Homo sapiens
gaatattaatccc

SEQ ID NO: 3895498 - DNA, 11 bp, Homo sapiens
gaatattcagg

SEQ ID NO: 3895499 - DNA, 18 bp, Homo sapiens
gaatatttacaataaaga

SEQ ID NO: 3895500 - DNA, 18 bp, Homo sapiens
gaatatttcaaatgaaca

SEQ ID NO: 3895501 - DNA, 21 bp, Homo sapiens
gaatattttcattaaaagcta

SEQ ID NO: 3895502 - DNA, 20 bp, Homo sapiens
gaatcaagctagaaggccac

SEQ ID NO: 3895503 - DNA, 22 bp, Homo sapiens
gaatcaaggaatcctgagtctg

SEQ ID NO: 3895504 - DNA, 22 bp, Homo sapiens
gaatcaatttcccagaagggag

SEQ ID NO: 3895505 - DNA, 13 bp, Homo sapiens
gaatcagaaacag

SEQ ID NO: 3895506 - DNA, 20 bp, Homo sapiens
gaatcagctgctacaagaat

SEQ ID NO: 3895507 - DNA, 16 bp, Homo sapiens
gaatcaggttgacagt

SEQ ID NO: 3895508 - DNA, 17 bp, Homo sapiens
gaatcataattttcaag

SEQ ID NO: 3895509 - DNA, 20 bp, Homo sapiens
gaatcatgtcaggcctgtgt

SEQ ID NO: 3895510 - DNA, 14 bp, Homo sapiens
gaatcatgttggat

SEQ ID NO: 3895511 - DNA, 22 bp, Homo sapiens
gaatcatgttggatagtcagct

SEQ ID NO: 3895512 - DNA, 12 bp, Homo sapiens
gaatccctgcag

SEQ ID NO: 3895513 - DNA, 18 bp, Homo sapiens
gaatccctgcagcctggt

SEQ ID NO: 3895514 - DNA, 15 bp, Homo sapiens
gaatccgcctgcaga

SEQ ID NO: 3895515 - DNA, 14 bp, Homo sapiens
gaatcctgcctctc

SEQ ID NO: 3895516 - DNA, 16 bp, Homo sapiens
gaatctacagaacaaa

SEQ ID NO: 3895517 - DNA, 13 bp, Homo sapiens
gaatctatattta

SEQ ID NO: 3895518 - DNA, 20 bp, Homo sapiens
gaatctgataggaaaagaag

SEQ ID NO: 3895519 - DNA, 18 bp, Homo sapiens
gaatctgccattactctg

SEQ ID NO: 3895520 - DNA, 12 bp, Homo sapiens
gaatctgttact

SEQ ID NO: 3895521 - DNA, 13 bp, Homo sapiens
gaatcttactcct

SEQ ID NO: 3895522 - DNA, 16 bp, Homo sapiens
gaatgaattaaataaa

SEQ ID NO: 3895523 - DNA, 16 bp, Homo sapiens
gaatgaccagcatgat

SEQ ID NO: 3895524 - DNA, 23 bp, Homo sapiens
gaatgaggaataataagttaaac

SEQ ID NO: 3895525 - DNA, 22 bp, Homo sapiens
gaatgattccctcttgctattg

SEQ ID NO: 3895526 - DNA, 14 bp, Homo sapiens
gaatgatttcatgc

SEQ ID NO: 3895527 - DNA, 20 bp, Homo sapiens
gaatgatttccaaagagaaa

SEQ ID NO: 3895528 - DNA, 22 bp, Homo sapiens
gaatgatttccaaagagaaaaa

SEQ ID NO: 3895529 - DNA, 14 bp, Homo sapiens
gaatgatttttaga

SEQ ID NO: 3895530 - DNA, 22 bp, Homo sapiens
gaatgcacaccaaaaaaatact

SEQ ID NO: 3895531 - DNA, 19 bp, Homo sapiens
gaatgcagattcctgggcc

SEQ ID NO: 3895532 - DNA, 21 bp, Homo sapiens
gaatgcagattcctgggcctg

SEQ ID NO: 3895533 - DNA, 21 bp, Homo sapiens
gaatgcagggaagagggcagt

SEQ ID NO: 3895534 - DNA, 17 bp, Homo sapiens
gaatgcccacaggcaaa

SEQ ID NO: 3895535 - DNA, 21 bp, Homo sapiens
gaatgcctcaatgtgaccagg

SEQ ID NO: 3895536 - DNA, 21 bp, Homo sapiens
gaatgcggccgcattccctga

SEQ ID NO: 3895537 - DNA, 21 bp, Homo sapiens
gaatggagcagtacatgggaa

SEQ ID NO: 3895538 - DNA, 21 bp, Homo sapiens
gaatggcaaagcggttgcttc

SEQ ID NO: 3895539 - DNA, 13 bp, Homo sapiens
gaatggcaatggt

SEQ ID NO: 3895540 - DNA, 13 bp, Homo sapiens
gaatggtccaggg

SEQ ID NO: 3895541 - DNA, 14 bp, Homo sapiens
gaatggtccagggt

SEQ ID NO: 3895542 - DNA, 21 bp, Homo sapiens
gaatggtgtgggagagggatg

SEQ ID NO: 3895543 - DNA, 16 bp, Homo sapiens
gaatggttccatgcct

SEQ ID NO: 3895544 - DNA, 19 bp, Homo sapiens
gaatggttccatgcctgag

SEQ ID NO: 3895545 - DNA, 15 bp, Homo sapiens
gaatgtatctcctcc

SEQ ID NO: 3895546 - DNA, 11 bp, Homo sapiens
gaatgtctcag

SEQ ID NO: 3895547 - DNA, 22 bp, Homo sapiens
gaatgtctttgttggaaaagaa

SEQ ID NO: 3895548 - DNA, 22 bp, Homo sapiens
gaatgtggcccctgaacaagaa

SEQ ID NO: 3895549 - DNA, 16 bp, Homo sapiens
gaatgttactttggaa

SEQ ID NO: 3895550 - DNA, 15 bp, Homo sapiens
gaatgtttatgttct

SEQ ID NO: 3895551 - DNA, 14 bp, Homo sapiens
gaatgtttattcct

SEQ ID NO: 3895552 - DNA, 20 bp, Homo sapiens
gaattaattggctatatgga

SEQ ID NO: 3895553 - DNA, 22 bp, Homo sapiens
gaattaccttagattagctctg

SEQ ID NO: 3895554 - DNA, 18 bp, Homo sapiens
gaattatatctaatttat

SEQ ID NO: 3895555 - DNA, 20 bp, Homo sapiens
gaattatatctaatttatac

SEQ ID NO: 3895556 - DNA, 23 bp, Homo sapiens
gaattatatctaatttatacaaa

SEQ ID NO: 3895557 - DNA, 13 bp, Homo sapiens
gaattccaaggag

SEQ ID NO: 3895558 - DNA, 23 bp, Homo sapiens
gaattctaggcatcccaggggac

SEQ ID NO: 3895559 - DNA, 18 bp, Homo sapiens
gaattctgcaactagcca

SEQ ID NO: 3895560 - DNA, 17 bp, Homo sapiens
gaattctgtgaagaatg

SEQ ID NO: 3895561 - DNA, 19 bp, Homo sapiens
gaattctttacaataaaca

SEQ ID NO: 3895562 - DNA, 16 bp, Homo sapiens
gaattgaacccaggag

SEQ ID NO: 3895563 - DNA, 16 bp, Homo sapiens
gaattgagctgcagaa

SEQ ID NO: 3895564 - DNA, 16 bp, Homo sapiens
gaattgggagcttggg

SEQ ID NO: 3895565 - DNA, 18 bp, Homo sapiens
gaattgtccatgtgcttc

SEQ ID NO: 3895566 - DNA, 12 bp, Homo sapiens
gaattgtgcaaa

SEQ ID NO: 3895567 - DNA, 22 bp, Homo sapiens
gaattgtgcgacttcacaaaat

SEQ ID NO: 3895568 - DNA, 18 bp, Homo sapiens
gaatttaggataaagaat

SEQ ID NO: 3895569 - DNA, 19 bp, Homo sapiens
gaatttagtcacaccatct

SEQ ID NO: 3895570 - DNA, 17 bp, Homo sapiens
gaatttattattgttct

SEQ ID NO: 3895571 - DNA, 18 bp, Homo sapiens
gaatttcaggcattttgt

SEQ ID NO: 3895572 - DNA, 21 bp, Homo sapiens
gaatttcaggcattttgttct

SEQ ID NO: 3895573 - DNA, 19 bp, Homo sapiens
gaatttcttcactgttgaa

SEQ ID NO: 3895574 - DNA, 20 bp, Homo sapiens
gaatttcttcactgttgaaa

SEQ ID NO: 3895575 - DNA, 13 bp, Homo sapiens
gaatttgctgggg

SEQ ID NO: 3895576 - DNA, 18 bp, Homo sapiens
gaatttggatacactctc

SEQ ID NO: 3895577 - DNA, 21 bp, Homo sapiens
gaatttggtgtggctgtattc

SEQ ID NO: 3895578 - DNA, 13 bp, Homo sapiens
gaatttgtatttt

SEQ ID NO: 3895579 - DNA, 20 bp, Homo sapiens
gaatttttaatgacttttta

SEQ ID NO: 3895580 - DNA, 22 bp, Homo sapiens
gaatttttttttcctagccctc

SEQ ID NO: 3895581 - DNA, 17 bp, Homo sapiens
gacaaaaacagcctcac

SEQ ID NO: 3895582 - DNA, 16 bp, Homo sapiens
gacaaacacctcccag

SEQ ID NO: 3895583 - DNA, 14 bp, Homo sapiens
gacaaaggagcctg

SEQ ID NO: 3895584 - DNA, 16 bp, Homo sapiens
gacaaaggagcctgtg

SEQ ID NO: 3895585 - DNA, 18 bp, Homo sapiens
gacaaaggagcctgtgaa

SEQ ID NO: 3895586 - DNA, 20 bp, Homo sapiens
gacaaagttccaaaatgcca

SEQ ID NO: 3895587 - DNA, 22 bp, Homo sapiens
gacaacatttttggtgtatttg

SEQ ID NO: 3895588 - DNA, 12 bp, Homo sapiens
gacaacccagaa

SEQ ID NO: 3895589 - DNA, 23 bp, Homo sapiens
gacaacctgtgcagtcccgtgga

SEQ ID NO: 3895590 - DNA, 21 bp, Homo sapiens
gacaagaagctcccagatgct

SEQ ID NO: 3895591 - DNA, 15 bp, Homo sapiens
gacaagaagctgcta

SEQ ID NO: 3895592 - DNA, 17 bp, Homo sapiens
gacaagagctgctgtcc

SEQ ID NO: 3895593 - DNA, 23 bp, Homo sapiens
gacaagccaacttgtaaatacac

SEQ ID NO: 3895594 - DNA, 12 bp, Homo sapiens
gacaagccctgg

SEQ ID NO: 3895595 - DNA, 14 bp, Homo sapiens
gacaagccctggca

SEQ ID NO: 3895596 - DNA, 17 bp, Homo sapiens
gacaagccctggcaaca

SEQ ID NO: 3895597 - DNA, 15 bp, Homo sapiens
gacaagggctgacct

SEQ ID NO: 3895598 - DNA, 19 bp, Homo sapiens
gacaagggctgacctgcct

SEQ ID NO: 3895599 - DNA, 22 bp, Homo sapiens
gacaagggctgacctgcctctc

SEQ ID NO: 3895600 - DNA, 14 bp, Homo sapiens
gacaagtaatcact

SEQ ID NO: 3895601 - DNA, 23 bp, Homo sapiens
gacaagtaatcactaacccgttt

SEQ ID NO: 3895602 - DNA, 17 bp, Homo sapiens
gacaagtggagggggtg

SEQ ID NO: 3895603 - DNA, 13 bp, Homo sapiens
gacaataatttca

SEQ ID NO: 3895604 - DNA, 19 bp, Homo sapiens
gacaataatttcaggtttt

SEQ ID NO: 3895605 - DNA, 19 bp, Homo sapiens
gacaatcctgaagaaacca

SEQ ID NO: 3895606 - DNA, 21 bp, Homo sapiens
gacaatcctgaagaaaccaca

SEQ ID NO: 3895607 - DNA, 18 bp, Homo sapiens
gacaatgccttgggagag

SEQ ID NO: 3895608 - DNA, 19 bp, Homo sapiens
gacaatggaaactgtacca

SEQ ID NO: 3895609 - DNA, 21 bp, Homo sapiens
gacacacagtctcagtccaga

SEQ ID NO: 3895610 - DNA, 22 bp, Homo sapiens
gacacactgtaaacccctgggt

SEQ ID NO: 3895611 - DNA, 16 bp, Homo sapiens
gacacagacccacaca

SEQ ID NO: 3895612 - DNA, 21 bp, Homo sapiens
gacacagcgtccctagcagtg

SEQ ID NO: 3895613 - DNA, 15 bp, Homo sapiens
gacacaggcctgtgt

SEQ ID NO: 3895614 - DNA, 17 bp, Homo sapiens
gacacaggcctgtgtag

SEQ ID NO: 3895615 - DNA, 21 bp, Homo sapiens
gacacaggcctgtgtagctgt

SEQ ID NO: 3895616 - DNA, 11 bp, Homo sapiens
gacacagtgtt

SEQ ID NO: 3895617 - DNA, 14 bp, Homo sapiens
gacacatcaaatgc

SEQ ID NO: 3895618 - DNA, 13 bp, Homo sapiens
gacacatcccggc

SEQ ID NO: 3895619 - DNA, 21 bp, Homo sapiens
gacacatggctatcctagaga

SEQ ID NO: 3895620 - DNA, 19 bp, Homo sapiens
gacaccccttatccaggac

SEQ ID NO: 3895621 - DNA, 20 bp, Homo sapiens
gacaccccttatccaggact

SEQ ID NO: 3895622 - DNA, 13 bp, Homo sapiens
gacacctaccatg

SEQ ID NO: 3895623 - DNA, 16 bp, Homo sapiens
gacacctaccatgctg

SEQ ID NO: 3895624 - DNA, 19 bp, Homo sapiens
gacacctaccatgctgctt

SEQ ID NO: 3895625 - DNA, 19 bp, Homo sapiens
gacacctgcacctcccccc

SEQ ID NO: 3895626 - DNA, 18 bp, Homo sapiens
gacacctgccccagcgcg

SEQ ID NO: 3895627 - DNA, 13 bp, Homo sapiens
gacacctgccctg

SEQ ID NO: 3895628 - DNA, 14 bp, Homo sapiens
gacacctgccctgc

SEQ ID NO: 3895629 - DNA, 17 bp, Homo sapiens
gacactaagttatagta

SEQ ID NO: 3895630 - DNA, 21 bp, Homo sapiens
gacactctagtgacttcctgg

SEQ ID NO: 3895631 - DNA, 14 bp, Homo sapiens
gacactgctgcacc

SEQ ID NO: 3895632 - DNA, 15 bp, Homo sapiens
gacactgctgcacca

SEQ ID NO: 3895633 - DNA, 22 bp, Homo sapiens
gacacttgccttcttcacccag

SEQ ID NO: 3895634 - DNA, 16 bp, Homo sapiens
gacagaccccttggct

SEQ ID NO: 3895635 - DNA, 22 bp, Homo sapiens
gacagaccggggttcaagccat

SEQ ID NO: 3895636 - DNA, 22 bp, Homo sapiens
gacagactgcaagaggctcctg

SEQ ID NO: 3895637 - DNA, 18 bp, Homo sapiens
gacagagaaatgtgaagg

SEQ ID NO: 3895638 - DNA, 22 bp, Homo sapiens
gacagagacagaaacagagaga

SEQ ID NO: 3895639 - DNA, 13 bp, Homo sapiens
gacagagagagac

SEQ ID NO: 3895640 - DNA, 20 bp, Homo sapiens
gacagagaggagttgccagg

SEQ ID NO: 3895641 - DNA, 18 bp, Homo sapiens
gacagagcccccaagcct

SEQ ID NO: 3895642 - DNA, 19 bp, Homo sapiens
gacagagcccccaagcctc

SEQ ID NO: 3895643 - DNA, 16 bp, Homo sapiens
gacagagctggctgtc

SEQ ID NO: 3895644 - DNA, 18 bp, Homo sapiens
gacagatacatagatgga

SEQ ID NO: 3895645 - DNA, 18 bp, Homo sapiens
gacagatagacagtgctg

SEQ ID NO: 3895646 - DNA, 22 bp, Homo sapiens
gacagcataccttggactgact

SEQ ID NO: 3895647 - DNA, 10 bp, Homo sapiens
gacagcccag

SEQ ID NO: 3895648 - DNA, 11 bp, Homo sapiens
gacagccccag

SEQ ID NO: 3895649 - DNA, 15 bp, Homo sapiens
gacagccccagggcc

SEQ ID NO: 3895650 - DNA, 11 bp, Homo sapiens
gacagcctggc

SEQ ID NO: 3895651 - DNA, 19 bp, Homo sapiens
gacagcctggcacagggca

SEQ ID NO: 3895652 - DNA, 15 bp, Homo sapiens
gacagctgtccctgt

SEQ ID NO: 3895653 - DNA, 18 bp, Homo sapiens
gacagctgtccctgtcac

SEQ ID NO: 3895654 - DNA, 14 bp, Homo sapiens
gacagctgtgcctc

SEQ ID NO: 3895655 - DNA, 19 bp, Homo sapiens
gacagctgtgcctcgctcc

SEQ ID NO: 3895656 - DNA, 19 bp, Homo sapiens
gacaggaaaatcctctggc

SEQ ID NO: 3895657 - DNA, 15 bp, Homo sapiens
gacaggaaagccctc

SEQ ID NO: 3895658 - DNA, 20 bp, Homo sapiens
gacaggaaagccctccccct

SEQ ID NO: 3895659 - DNA, 23 bp, Homo sapiens
gacaggactaacactcagaagcc

SEQ ID NO: 3895660 - DNA, 24 bp, Homo sapiens
gacaggactaacactcagaagcct

SEQ ID NO: 3895661 - DNA, 11 bp, Homo sapiens
gacaggagaaa

SEQ ID NO: 3895662 - DNA, 22 bp, Homo sapiens
gacaggcccaagagatgaagag

SEQ ID NO: 3895663 - DNA, 16 bp, Homo sapiens
gacagggaagagcaga

SEQ ID NO: 3895664 - DNA, 15 bp, Homo sapiens
gacagggatgccaac

SEQ ID NO: 3895665 - DNA, 20 bp, Homo sapiens
gacagggcatggccaggtgg

SEQ ID NO: 3895666 - DNA, 20 bp, Homo sapiens
gacaggtctagactttctca

SEQ ID NO: 3895667 - DNA, 19 bp, Homo sapiens
gacaggttcccagcagctg

SEQ ID NO: 3895668 - DNA, 22 bp, Homo sapiens
gacaggttcccagcagctgggc

SEQ ID NO: 3895669 - DNA, 20 bp, Homo sapiens
gacagtgaattgacccatgt

SEQ ID NO: 3895670 - DNA, 22 bp, Homo sapiens
gacagtgaattgacccatgttc

SEQ ID NO: 3895671 - DNA, 17 bp, Homo sapiens
gacagtgctgccctgcg

SEQ ID NO: 3895672 - DNA, 23 bp, Homo sapiens
gacagtgttgaaaatgttcagaa

SEQ ID NO: 3895673 - DNA, 13 bp, Homo sapiens
gacagttggcaga

SEQ ID NO: 3895674 - DNA, 14 bp, Homo sapiens
gacagttggcagag

SEQ ID NO: 3895675 - DNA, 15 bp, Homo sapiens
gacagttggcagaga

SEQ ID NO: 3895676 - DNA, 17 bp, Homo sapiens
gacatacgaaacacaaa

SEQ ID NO: 3895677 - DNA, 16 bp, Homo sapiens
gacatatatattaaaa

SEQ ID NO: 3895678 - DNA, 17 bp, Homo sapiens
gacatatatattaaaat

SEQ ID NO: 3895679 - DNA, 21 bp, Homo sapiens
gacatcaaatttgccaccact

SEQ ID NO: 3895680 - DNA, 15 bp, Homo sapiens
gacatcacttgtaca

SEQ ID NO: 3895681 - DNA, 22 bp, Homo sapiens
gacatccatgtttgtaaaacta

SEQ ID NO: 3895682 - DNA, 14 bp, Homo sapiens
gacatgacaatgca

SEQ ID NO: 3895683 - DNA, 22 bp, Homo sapiens
gacatgacttttctggaagaca

SEQ ID NO: 3895684 - DNA, 18 bp, Homo sapiens
gacatgatactgatgcca

SEQ ID NO: 3895685 - DNA, 21 bp, Homo sapiens
gacatgatactgatgccatgt

SEQ ID NO: 3895686 - DNA, 14 bp, Homo sapiens
gacatgcactgacc

SEQ ID NO: 3895687 - DNA, 16 bp, Homo sapiens
gacatgccaccctctc

SEQ ID NO: 3895688 - DNA, 22 bp, Homo sapiens
gacatggagactcctgccctgt

SEQ ID NO: 3895689 - DNA, 14 bp, Homo sapiens
gacatggggcatag

SEQ ID NO: 3895690 - DNA, 15 bp, Homo sapiens
gacattaaacctgga

SEQ ID NO: 3895691 - DNA, 20 bp, Homo sapiens
gacattatgtgtgcatgtgt

SEQ ID NO: 3895692 - DNA, 23 bp, Homo sapiens
gacattcagtatataaaatatgt

SEQ ID NO: 3895693 - DNA, 20 bp, Homo sapiens
gacattccttgtcaccagca

SEQ ID NO: 3895694 - DNA, 18 bp, Homo sapiens
gacatttctaacatatgt

SEQ ID NO: 3895695 - DNA, 19 bp, Homo sapiens
gacatttctaacatatgta

SEQ ID NO: 3895696 - DNA, 22 bp, Homo sapiens
gacatttctaacatatgtatta

SEQ ID NO: 3895697 - DNA, 21 bp, Homo sapiens
gaccaaaggatccagagactt

SEQ ID NO: 3895698 - DNA, 16 bp, Homo sapiens
gaccaacatggagaaa

SEQ ID NO: 3895699 - DNA, 17 bp, Homo sapiens
gaccaacatggagaaac

SEQ ID NO: 3895700 - DNA, 16 bp, Homo sapiens
gaccaaccctgtttcc

SEQ ID NO: 3895701 - DNA, 16 bp, Homo sapiens
gaccaactggcttctg

SEQ ID NO: 3895702 - DNA, 17 bp, Homo sapiens
gaccaactggcttctgt

SEQ ID NO: 3895703 - DNA, 14 bp, Homo sapiens
gaccaagaaaaaga

SEQ ID NO: 3895704 - DNA, 16 bp, Homo sapiens
gaccaagagagaaaga

SEQ ID NO: 3895705 - DNA, 12 bp, Homo sapiens
gaccacacctcc

SEQ ID NO: 3895706 - DNA, 11 bp, Homo sapiens
gaccacacgct

SEQ ID NO: 3895707 - DNA, 20 bp, Homo sapiens
gaccacactttgagaacctg

SEQ ID NO: 3895708 - DNA, 13 bp, Homo sapiens
gaccacatgtgtt

SEQ ID NO: 3895709 - DNA, 10 bp, Homo sapiens
gaccacctgc

SEQ ID NO: 3895710 - DNA, 13 bp, Homo sapiens
gaccacctgccag

SEQ ID NO: 3895711 - DNA, 16 bp, Homo sapiens
gaccacctgccagcca

SEQ ID NO: 3895712 - DNA, 14 bp, Homo sapiens
gaccacctgcccaa

SEQ ID NO: 3895713 - DNA, 20 bp, Homo sapiens
gaccacggacgtttccatca

SEQ ID NO: 3895714 - DNA, 21 bp, Homo sapiens
gaccacggacgtttccatcag

SEQ ID NO: 3895715 - DNA, 19 bp, Homo sapiens
gaccacgggcctcagtttc

SEQ ID NO: 3895716 - DNA, 23 bp, Homo sapiens
gaccacgggcctcagtttcccca

SEQ ID NO: 3895717 - DNA, 13 bp, Homo sapiens
gaccagcctggcc

SEQ ID NO: 3895718 - DNA, 16 bp, Homo sapiens
gaccaggacaggacca

SEQ ID NO: 3895719 - DNA, 12 bp, Homo sapiens
gaccaggatcag

SEQ ID NO: 3895720 - DNA, 15 bp, Homo sapiens
gaccagtagacaact

SEQ ID NO: 3895721 - DNA, 13 bp, Homo sapiens
gaccatcctattt

SEQ ID NO: 3895722 - DNA, 12 bp, Homo sapiens
gaccatcctggc

SEQ ID NO: 3895723 - DNA, 14 bp, Homo sapiens
gaccatcctggccc

SEQ ID NO: 3895724 - DNA, 18 bp, Homo sapiens
gaccatcgtccttcctct

SEQ ID NO: 3895725 - DNA, 16 bp, Homo sapiens
gaccatgaagagactc

SEQ ID NO: 3895726 - DNA, 16 bp, Homo sapiens
gaccattgacctcagc

SEQ ID NO: 3895727 - DNA, 15 bp, Homo sapiens
gaccattgtcttcca

SEQ ID NO: 3895728 - DNA, 20 bp, Homo sapiens
gaccattgtcttccaacccc

SEQ ID NO: 3895729 - DNA, 23 bp, Homo sapiens
gaccattgtcttccaaccccagc

SEQ ID NO: 3895730 - DNA, 13 bp, Homo sapiens
gacccaaagacca

SEQ ID NO: 3895731 - DNA, 23 bp, Homo sapiens
gacccacatgccatttgtactga

SEQ ID NO: 3895732 - DNA, 23 bp, Homo sapiens
gacccacccatcttcctgctgct

SEQ ID NO: 3895733 - DNA, 18 bp, Homo sapiens
gacccacgtgctagggga

SEQ ID NO: 3895734 - DNA, 13 bp, Homo sapiens
gacccactcacac

SEQ ID NO: 3895735 - DNA, 13 bp, Homo sapiens
gacccagagtgga

SEQ ID NO: 3895736 - DNA, 16 bp, Homo sapiens
gacccagatcctcaca

SEQ ID NO: 3895737 - DNA, 21 bp, Homo sapiens
gacccagctactctgtccagg

SEQ ID NO: 3895738 - DNA, 11 bp, Homo sapiens
gacccaggccc

SEQ ID NO: 3895739 - DNA, 12 bp, Homo sapiens
gacccaggccct

SEQ ID NO: 3895740 - DNA, 18 bp, Homo sapiens
gacccaggccctccatgg

SEQ ID NO: 3895741 - DNA, 14 bp, Homo sapiens
gacccagtccctgg

SEQ ID NO: 3895742 - DNA, 12 bp, Homo sapiens
gacccagtgaga

SEQ ID NO: 3895743 - DNA, 23 bp, Homo sapiens
gacccagtgagattacagaggaa

SEQ ID NO: 3895744 - DNA, 19 bp, Homo sapiens
gaccccaaagagcctggag

SEQ ID NO: 3895745 - DNA, 18 bp, Homo sapiens
gaccccagcggctgagtc

SEQ ID NO: 3895746 - DNA, 19 bp, Homo sapiens
gaccccaggatcccagagc

SEQ ID NO: 3895747 - DNA, 16 bp, Homo sapiens
gaccccagggcacagg

SEQ ID NO: 3895748 - DNA, 19 bp, Homo sapiens
gaccccagggcacaggagc

SEQ ID NO: 3895749 - DNA, 12 bp, Homo sapiens
gaccccatctct

SEQ ID NO: 3895750 - DNA, 23 bp, Homo sapiens
gacccccactctcattccccagg

SEQ ID NO: 3895751 - DNA, 14 bp, Homo sapiens
gaccccctcccctg

SEQ ID NO: 3895752 - DNA, 21 bp, Homo sapiens
gaccccgcctcccagccccag

SEQ ID NO: 3895753 - DNA, 23 bp, Homo sapiens
gaccccgcctcccagccccaggg

SEQ ID NO: 3895754 - DNA, 23 bp, Homo sapiens
gacccctgcaccagcccttccct

SEQ ID NO: 3895755 - DNA, 17 bp, Homo sapiens
gaccccttcctttcctc

SEQ ID NO: 3895756 - DNA, 23 bp, Homo sapiens
gaccccttggcttttgcttggca

SEQ ID NO: 3895757 - DNA, 17 bp, Homo sapiens
gacccggaggggcctgg

SEQ ID NO: 3895758 - DNA, 18 bp, Homo sapiens
gacccggaggggcctggc

SEQ ID NO: 3895759 - DNA, 17 bp, Homo sapiens
gacccggcaccccctgc

SEQ ID NO: 3895760 - DNA, 14 bp, Homo sapiens
gaccctacaggaga

SEQ ID NO: 3895761 - DNA, 16 bp, Homo sapiens
gaccctaccccaccac

SEQ ID NO: 3895762 - DNA, 19 bp, Homo sapiens
gaccctccaccgcagaagg

SEQ ID NO: 3895763 - DNA, 15 bp, Homo sapiens
gaccctccccgcacc

SEQ ID NO: 3895764 - DNA, 18 bp, Homo sapiens
gaccctcctccactccac

SEQ ID NO: 3895765 - DNA, 21 bp, Homo sapiens
gaccctcctccactccacctc

SEQ ID NO: 3895766 - DNA, 23 bp, Homo sapiens
gaccctcctccactccacctcca

SEQ ID NO: 3895767 - DNA, 12 bp, Homo sapiens
gaccctcgcagc

SEQ ID NO: 3895768 - DNA, 20 bp, Homo sapiens
gaccctctgaatggtccagg

SEQ ID NO: 3895769 - DNA, 23 bp, Homo sapiens
gaccctctgaatggtccagggtt

SEQ ID NO: 3895770 - DNA, 19 bp, Homo sapiens
gaccctgagtccgggaggc

SEQ ID NO: 3895771 - DNA, 13 bp, Homo sapiens
gaccctgcccttg

SEQ ID NO: 3895772 - DNA, 15 bp, Homo sapiens
gaccctgcccttgtt

SEQ ID NO: 3895773 - DNA, 22 bp, Homo sapiens
gaccctgtaaagggtcagggtg

SEQ ID NO: 3895774 - DNA, 19 bp, Homo sapiens
gaccctgttttccacacca

SEQ ID NO: 3895775 - DNA, 17 bp, Homo sapiens
gacccttcagggccaga

SEQ ID NO: 3895776 - DNA, 15 bp, Homo sapiens
gacccttccagacat

SEQ ID NO: 3895777 - DNA, 20 bp, Homo sapiens
gacccttccagacatacgaa

SEQ ID NO: 3895778 - DNA, 23 bp, Homo sapiens
gacccttcccaatcagcactgaa

SEQ ID NO: 3895779 - DNA, 14 bp, Homo sapiens
gaccctttccttcc

SEQ ID NO: 3895780 - DNA, 23 bp, Homo sapiens
gaccctttccttccttccctggc

SEQ ID NO: 3895781 - DNA, 19 bp, Homo sapiens
gaccgctacaccactctgg

SEQ ID NO: 3895782 - DNA, 17 bp, Homo sapiens
gaccgcttcacccctgc

SEQ ID NO: 3895783 - DNA, 15 bp, Homo sapiens
gaccgcttcccagag

SEQ ID NO: 3895784 - DNA, 20 bp, Homo sapiens
gaccgggtgggcctggcctg

SEQ ID NO: 3895785 - DNA, 21 bp, Homo sapiens
gaccgggtgggcctggcctga

SEQ ID NO: 3895786 - DNA, 15 bp, Homo sapiens
gaccggtacagaaag

SEQ ID NO: 3895787 - DNA, 19 bp, Homo sapiens
gaccgttttcatcctggcc

SEQ ID NO: 3895788 - DNA, 21 bp, Homo sapiens
gaccgttttcatcctggcctc

SEQ ID NO: 3895789 - DNA, 14 bp, Homo sapiens
gacctagacctggg

SEQ ID NO: 3895790 - DNA, 17 bp, Homo sapiens
gacctagacctgggcca

SEQ ID NO: 3895791 - DNA, 18 bp, Homo sapiens
gacctcacagtgaccctt

SEQ ID NO: 3895792 - DNA, 23 bp, Homo sapiens
gacctcagctgcacattcctggc

SEQ ID NO: 3895793 - DNA, 19 bp, Homo sapiens
gacctccagctttcctgta

SEQ ID NO: 3895794 - DNA, 17 bp, Homo sapiens
gacctcctaacaagtag

SEQ ID NO: 3895795 - DNA, 16 bp, Homo sapiens
gacctcgtcctccccc

SEQ ID NO: 3895796 - DNA, 17 bp, Homo sapiens
gacctcgtttgggagtg

SEQ ID NO: 3895797 - DNA, 15 bp, Homo sapiens
gacctctgctctgag

SEQ ID NO: 3895798 - DNA, 21 bp, Homo sapiens
gacctgaagggtgacatccca

SEQ ID NO: 3895799 - DNA, 16 bp, Homo sapiens
gacctgaccggcacct

SEQ ID NO: 3895800 - DNA, 17 bp, Homo sapiens
gacctgaccggcacctg

SEQ ID NO: 3895801 - DNA, 11 bp, Homo sapiens
gacctgagcct

SEQ ID NO: 3895802 - DNA, 14 bp, Homo sapiens
gacctgaggctcct

SEQ ID NO: 3895803 - DNA, 22 bp, Homo sapiens
gacctgatcattacatggctgt

SEQ ID NO: 3895804 - DNA, 16 bp, Homo sapiens
gacctgcggctgctgt

SEQ ID NO: 3895805 - DNA, 17 bp, Homo sapiens
gacctgctgagctctga

SEQ ID NO: 3895806 - DNA, 15 bp, Homo sapiens
gacctgggccaaaag

SEQ ID NO: 3895807 - DNA, 22 bp, Homo sapiens
gacctgggccaaaagggcagcc

SEQ ID NO: 3895808 - DNA, 15 bp, Homo sapiens
gacctgtttagagaa

SEQ ID NO: 3895809 - DNA, 13 bp, Homo sapiens
gaccttagaaatc

SEQ ID NO: 3895810 - DNA, 19 bp, Homo sapiens
gaccttagaaatcattgta

SEQ ID NO: 3895811 - DNA, 23 bp, Homo sapiens
gaccttagaaatcattgtagaaa

SEQ ID NO: 3895812 - DNA, 12 bp, Homo sapiens
gaccttcctgcc

SEQ ID NO: 3895813 - DNA, 16 bp, Homo sapiens
gaccttttctctccca

SEQ ID NO: 3895814 - DNA, 23 bp, Homo sapiens
gacgatgccgtgtgtctcgtctc

SEQ ID NO: 3895815 - DNA, 20 bp, Homo sapiens
gacgcagccctgggggccag

SEQ ID NO: 3895816 - DNA, 23 bp, Homo sapiens
gacgcccctccctcctctggccc

SEQ ID NO: 3895817 - DNA, 14 bp, Homo sapiens
gacgcgcacacaca

SEQ ID NO: 3895818 - DNA, 14 bp, Homo sapiens
gacgcgtctcctgt

SEQ ID NO: 3895819 - DNA, 17 bp, Homo sapiens
gacgctcaagaatcctc

SEQ ID NO: 3895820 - DNA, 18 bp, Homo sapiens
gacgctgccgctgccgct

SEQ ID NO: 3895821 - DNA, 12 bp, Homo sapiens
gacgcttccaga

SEQ ID NO: 3895822 - DNA, 15 bp, Homo sapiens
gacgcttccagacca

SEQ ID NO: 3895823 - DNA, 17 bp, Homo sapiens
gacggacgtcctgctgg

SEQ ID NO: 3895824 - DNA, 15 bp, Homo sapiens
gacgggagcctcctc

SEQ ID NO: 3895825 - DNA, 15 bp, Homo sapiens
gacgggaggcctcag

SEQ ID NO: 3895826 - DNA, 16 bp, Homo sapiens
gacggtcccacactgg

SEQ ID NO: 3895827 - DNA, 21 bp, Homo sapiens
gacggtttcaaaccaggattt

SEQ ID NO: 3895828 - DNA, 23 bp, Homo sapiens
gacgtcatcggaggctgggcccc

SEQ ID NO: 3895829 - DNA, 18 bp, Homo sapiens
gacgtgaatgtctcagcg

SEQ ID NO: 3895830 - DNA, 19 bp, Homo sapiens
gacgtttttgtgctgtggg

SEQ ID NO: 3895831 - DNA, 20 bp, Homo sapiens
gacgtttttgtgctgtgggc

SEQ ID NO: 3895832 - DNA, 21 bp, Homo sapiens
gacgtttttgtgctgtgggca

SEQ ID NO: 3895833 - DNA, 12 bp, Homo sapiens
gactaaatgaaa

SEQ ID NO: 3895834 - DNA, 16 bp, Homo sapiens
gactaacactcagaag

SEQ ID NO: 3895835 - DNA, 22 bp, Homo sapiens
gactaacactcagaagcctggg

SEQ ID NO: 3895836 - DNA, 23 bp, Homo sapiens
gactaacactcagaagcctgggg

SEQ ID NO: 3895837 - DNA, 18 bp, Homo sapiens
gactaacataaaatctgt

SEQ ID NO: 3895838 - DNA, 22 bp, Homo sapiens
gactaacataaaatctgtgaat

SEQ ID NO: 3895839 - DNA, 14 bp, Homo sapiens
gactaagccctgtc

SEQ ID NO: 3895840 - DNA, 22 bp, Homo sapiens
gactaagccctgtcgagacact

SEQ ID NO: 3895841 - DNA, 20 bp, Homo sapiens
gactaatagagacacagaga

SEQ ID NO: 3895842 - DNA, 16 bp, Homo sapiens
gactaattaaaatctg

SEQ ID NO: 3895843 - DNA, 21 bp, Homo sapiens
gactaattcctgccctgccca

SEQ ID NO: 3895844 - DNA, 17 bp, Homo sapiens
gactagaggcagggagg

SEQ ID NO: 3895845 - DNA, 22 bp, Homo sapiens
gactatatacatgtgtgtatat

SEQ ID NO: 3895846 - DNA, 23 bp, Homo sapiens
gactatatacatgtgtgtatata

SEQ ID NO: 3895847 - DNA, 15 bp, Homo sapiens
gactatcacatacaa

SEQ ID NO: 3895848 - DNA, 12 bp, Homo sapiens
gactatggagcc

SEQ ID NO: 3895849 - DNA, 16 bp, Homo sapiens
gactattcaaacagtc

SEQ ID NO: 3895850 - DNA, 22 bp, Homo sapiens
gactattcaaacagtctcagga

SEQ ID NO: 3895851 - DNA, 17 bp, Homo sapiens
gactcaagggtccagaa

SEQ ID NO: 3895852 - DNA, 15 bp, Homo sapiens
gactcaataaaagaa

SEQ ID NO: 3895853 - DNA, 15 bp, Homo sapiens
gactcacaagaagac

SEQ ID NO: 3895854 - DNA, 12 bp, Homo sapiens
gactcacctctg

SEQ ID NO: 3895855 - DNA, 13 bp, Homo sapiens
gactcacctctgc

SEQ ID NO: 3895856 - DNA, 14 bp, Homo sapiens
gactcacctctgcc

SEQ ID NO: 3895857 - DNA, 17 bp, Homo sapiens
gactcacctctgcctca

SEQ ID NO: 3895858 - DNA, 17 bp, Homo sapiens
gactcacctgttacttg

SEQ ID NO: 3895859 - DNA, 15 bp, Homo sapiens
gactcagctccagaa

SEQ ID NO: 3895860 - DNA, 21 bp, Homo sapiens
gactcattttaaaaaatggaa

SEQ ID NO: 3895861 - DNA, 18 bp, Homo sapiens
gactccagaatctgctgt

SEQ ID NO: 3895862 - DNA, 16 bp, Homo sapiens
gactcccagtgaactt

SEQ ID NO: 3895863 - DNA, 15 bp, Homo sapiens
gactccccaggccag

SEQ ID NO: 3895864 - DNA, 11 bp, Homo sapiens
gactcctccca

SEQ ID NO: 3895865 - DNA, 14 bp, Homo sapiens
gactcctctgtcca

SEQ ID NO: 3895866 - DNA, 14 bp, Homo sapiens
gactcctgcttctt

SEQ ID NO: 3895867 - DNA, 22 bp, Homo sapiens
gactcctggtctgaaaatgttg

SEQ ID NO: 3895868 - DNA, 15 bp, Homo sapiens
gactcctttcctctg

SEQ ID NO: 3895869 - DNA, 16 bp, Homo sapiens
gactcctttcctctga

SEQ ID NO: 3895870 - DNA, 23 bp, Homo sapiens
gactctaaattctttatttctgt

SEQ ID NO: 3895871 - DNA, 13 bp, Homo sapiens
gactctgcccctt

SEQ ID NO: 3895872 - DNA, 21 bp, Homo sapiens
gactctgccttttttcacagc

SEQ ID NO: 3895873 - DNA, 22 bp, Homo sapiens
gactctgccttttttcacagcc

SEQ ID NO: 3895874 - DNA, 15 bp, Homo sapiens
gactctggaagcccc

SEQ ID NO: 3895875 - DNA, 17 bp, Homo sapiens
gactctggaagcccccc

SEQ ID NO: 3895876 - DNA, 19 bp, Homo sapiens
gactctgggtccctcggag

SEQ ID NO: 3895877 - DNA, 21 bp, Homo sapiens
gactctgggtccctcggagct

SEQ ID NO: 3895878 - DNA, 22 bp, Homo sapiens
gactctgtcaatttccctgact

SEQ ID NO: 3895879 - DNA, 12 bp, Homo sapiens
gactcttcctgc

SEQ ID NO: 3895880 - DNA, 14 bp, Homo sapiens
gactcttgttttca

SEQ ID NO: 3895881 - DNA, 19 bp, Homo sapiens
gactcttgttttcagtttc

SEQ ID NO: 3895882 - DNA, 23 bp, Homo sapiens
gactctttgacgggaggcctcag

SEQ ID NO: 3895883 - DNA, 22 bp, Homo sapiens
gactctttttagggccaggcag

SEQ ID NO: 3895884 - DNA, 18 bp, Homo sapiens
gactgaaagcagcagcta

SEQ ID NO: 3895885 - DNA, 15 bp, Homo sapiens
gactgaaggggcaca

SEQ ID NO: 3895886 - DNA, 24 bp, Homo sapiens
gactgaaggggcacaccactgccc

SEQ ID NO: 3895887 - DNA, 15 bp, Homo sapiens
gactgaatgtgccta

SEQ ID NO: 3895888 - DNA, 22 bp, Homo sapiens
gactgagactggcacttagccc

SEQ ID NO: 3895889 - DNA, 15 bp, Homo sapiens
gactgagaggcagaa

SEQ ID NO: 3895890 - DNA, 16 bp, Homo sapiens
gactgagcacctgctt

SEQ ID NO: 3895891 - DNA, 14 bp, Homo sapiens
gactgcagctgctg

SEQ ID NO: 3895892 - DNA, 15 bp, Homo sapiens
gactgcagctgctga

SEQ ID NO: 3895893 - DNA, 20 bp, Homo sapiens
gactgcgatcttcagagcag

SEQ ID NO: 3895894 - DNA, 15 bp, Homo sapiens
gactgctagggagtg

SEQ ID NO: 3895895 - DNA, 15 bp, Homo sapiens
gactgctccccagcc

SEQ ID NO: 3895896 - DNA, 20 bp, Homo sapiens
gactgctccccagccctggc

SEQ ID NO: 3895897 - DNA, 23 bp, Homo sapiens
gactggagaccgcttcacccctg

SEQ ID NO: 3895898 - DNA, 16 bp, Homo sapiens
gactggagcccgaggg

SEQ ID NO: 3895899 - DNA, 23 bp, Homo sapiens
gactggagtgaggcttccaggct

SEQ ID NO: 3895900 - DNA, 20 bp, Homo sapiens
gactggcacttagcccaaga

SEQ ID NO: 3895901 - DNA, 14 bp, Homo sapiens
gactggcaggtgca

SEQ ID NO: 3895902 - DNA, 18 bp, Homo sapiens
gactgggaccaggcacca

SEQ ID NO: 3895903 - DNA, 18 bp, Homo sapiens
gactggggatgtgggagg

SEQ ID NO: 3895904 - DNA, 17 bp, Homo sapiens
gactgggttttgtctct

SEQ ID NO: 3895905 - DNA, 16 bp, Homo sapiens
gactggtaagtaactg

SEQ ID NO: 3895906 - DNA, 17 bp, Homo sapiens
gactgtactcctcccag

SEQ ID NO: 3895907 - DNA, 11 bp, Homo sapiens
gactgtcccac

SEQ ID NO: 3895908 - DNA, 18 bp, Homo sapiens
gactgtcgtgtttacaaa

SEQ ID NO: 3895909 - DNA, 20 bp, Homo sapiens
gactgtgaaagtatgtgata

SEQ ID NO: 3895910 - DNA, 14 bp, Homo sapiens
gactgttcctgtct

SEQ ID NO: 3895911 - DNA, 14 bp, Homo sapiens
gacttaacggctcc

SEQ ID NO: 3895912 - DNA, 19 bp, Homo sapiens
gacttaacggctccaggat

SEQ ID NO: 3895913 - DNA, 13 bp, Homo sapiens
gacttcacactgc

SEQ ID NO: 3895914 - DNA, 17 bp, Homo sapiens
gacttcagaacatgctg

SEQ ID NO: 3895915 - DNA, 14 bp, Homo sapiens
gacttcagctctgt

SEQ ID NO: 3895916 - DNA, 18 bp, Homo sapiens
gacttcaggttgttctgt

SEQ ID NO: 3895917 - DNA, 16 bp, Homo sapiens
gacttcgactcaggat

SEQ ID NO: 3895918 - DNA, 24 bp, Homo sapiens
gacttctaagtaaaaccacagcag

SEQ ID NO: 3895919 - DNA, 14 bp, Homo sapiens
gacttctggaaggc

SEQ ID NO: 3895920 - DNA, 21 bp, Homo sapiens
gacttctggaaggctggctga

SEQ ID NO: 3895921 - DNA, 23 bp, Homo sapiens
gacttctgtcttcacaacagatt

SEQ ID NO: 3895922 - DNA, 23 bp, Homo sapiens
gacttgaggattttgagtatctc

SEQ ID NO: 3895923 - DNA, 15 bp, Homo sapiens
gacttgcacatctct

SEQ ID NO: 3895924 - DNA, 19 bp, Homo sapiens
gacttgggcacccccagcc

SEQ ID NO: 3895925 - DNA, 16 bp, Homo sapiens
gactttatacagaact

SEQ ID NO: 3895926 - DNA, 13 bp, Homo sapiens
gactttctgttgg

SEQ ID NO: 3895927 - DNA, 18 bp, Homo sapiens
gactttgatgcatttcca

SEQ ID NO: 3895928 - DNA, 17 bp, Homo sapiens
gacttttccaagccctt

SEQ ID NO: 3895929 - DNA, 19 bp, Homo sapiens
gacttttctggaagacatg

SEQ ID NO: 3895930 - DNA, 11 bp, Homo sapiens
gagaaaaacaa

SEQ ID NO: 3895931 - DNA, 22 bp, Homo sapiens
gagaaaacttatttgagtgatt

SEQ ID NO: 3895932 - DNA, 13 bp, Homo sapiens
gagaaacagagac

SEQ ID NO: 3895933 - DNA, 12 bp, Homo sapiens
gagaaaccctgt

SEQ ID NO: 3895934 - DNA, 11 bp, Homo sapiens
gagaaactgag

SEQ ID NO: 3895935 - DNA, 18 bp, Homo sapiens
gagaaagactattcaaac

SEQ ID NO: 3895936 - DNA, 15 bp, Homo sapiens
gagaaagactgatta

SEQ ID NO: 3895937 - DNA, 14 bp, Homo sapiens
gagaaaggagccgg

SEQ ID NO: 3895938 - DNA, 22 bp, Homo sapiens
gagaaataattgttgattaatt

SEQ ID NO: 3895939 - DNA, 17 bp, Homo sapiens
gagaaatcacaggggcg

SEQ ID NO: 3895940 - DNA, 20 bp, Homo sapiens
gagaaatgaatgctgagacc

SEQ ID NO: 3895941 - DNA, 19 bp, Homo sapiens
gagaaatgtgaagggtggg

SEQ ID NO: 3895942 - DNA, 21 bp, Homo sapiens
gagaaatgtgaagggtggggt

SEQ ID NO: 3895943 - DNA, 23 bp, Homo sapiens
gagaacaagtcacagctgcagct

SEQ ID NO: 3895944 - DNA, 22 bp, Homo sapiens
gagaagaaagaggtgaccccag

SEQ ID NO: 3895945 - DNA, 17 bp, Homo sapiens
gagaagaagctgaggat

SEQ ID NO: 3895946 - DNA, 20 bp, Homo sapiens
gagaagaattttcagacccc

SEQ ID NO: 3895947 - DNA, 19 bp, Homo sapiens
gagaagagagaaatagcct

SEQ ID NO: 3895948 - DNA, 15 bp, Homo sapiens
gagaagagctgttca

SEQ ID NO: 3895949 - DNA, 22 bp, Homo sapiens
gagaagagctgttcacagccag

SEQ ID NO: 3895950 - DNA, 13 bp, Homo sapiens
gagaagaggctgg

SEQ ID NO: 3895951 - DNA, 15 bp, Homo sapiens
gagaagagggcctgt

SEQ ID NO: 3895952 - DNA, 15 bp, Homo sapiens
gagaagcagcctcct

SEQ ID NO: 3895953 - DNA, 14 bp, Homo sapiens
gagaagcagtgagc

SEQ ID NO: 3895954 - DNA, 19 bp, Homo sapiens
gagaagccggctcttcaaa

SEQ ID NO: 3895955 - DNA, 20 bp, Homo sapiens
gagaagctaaaacctgagct

SEQ ID NO: 3895956 - DNA, 23 bp, Homo sapiens
gagaaggacccggaggggcctgg

SEQ ID NO: 3895957 - DNA, 11 bp, Homo sapiens
gagaaggagcc

SEQ ID NO: 3895958 - DNA, 13 bp, Homo sapiens
gagaaggcaggaa

SEQ ID NO: 3895959 - DNA, 14 bp, Homo sapiens
gagaaggcgaggag

SEQ ID NO: 3895960 - DNA, 15 bp, Homo sapiens
gagaaggcgaggaga

SEQ ID NO: 3895961 - DNA, 14 bp, Homo sapiens
gagaagggccagcc

SEQ ID NO: 3895962 - DNA, 18 bp, Homo sapiens
gagaagttttgtacagag

SEQ ID NO: 3895963 - DNA, 18 bp, Homo sapiens
gagaataagagaaagaaa

SEQ ID NO: 3895964 - DNA, 22 bp, Homo sapiens
gagaataagagaaagaaaatga

SEQ ID NO: 3895965 - DNA, 16 bp, Homo sapiens
gagaatatttcaaatg

SEQ ID NO: 3895966 - DNA, 22 bp, Homo sapiens
gagaatatttcaaatgaacacg

SEQ ID NO: 3895967 - DNA, 13 bp, Homo sapiens
gagaatcagggca

SEQ ID NO: 3895968 - DNA, 20 bp, Homo sapiens
gagaatcccactttctatag

SEQ ID NO: 3895969 - DNA, 16 bp, Homo sapiens
gagaatctgaagctat

SEQ ID NO: 3895970 - DNA, 18 bp, Homo sapiens
gagaatctggctcctgtt

SEQ ID NO: 3895971 - DNA, 23 bp, Homo sapiens
gagaatctggctcctgtttccat

SEQ ID NO: 3895972 - DNA, 19 bp, Homo sapiens
gagaatgcccaactcttca

SEQ ID NO: 3895973 - DNA, 21 bp, Homo sapiens
gagaattgtatcatttgaaca

SEQ ID NO: 3895974 - DNA, 22 bp, Homo sapiens
gagaattgtgcgacttcacaaa

SEQ ID NO: 3895975 - DNA, 19 bp, Homo sapiens
gagacaaacacctcccagg

SEQ ID NO: 3895976 - DNA, 14 bp, Homo sapiens
gagacaagccctgg

SEQ ID NO: 3895977 - DNA, 16 bp, Homo sapiens
gagacaagccctggca

SEQ ID NO: 3895978 - DNA, 17 bp, Homo sapiens
gagacacctgcacctcc

SEQ ID NO: 3895979 - DNA, 14 bp, Homo sapiens
gagacagaaacaga

SEQ ID NO: 3895980 - DNA, 14 bp, Homo sapiens
gagacagagagaga

SEQ ID NO: 3895981 - DNA, 21 bp, Homo sapiens
gagacagagcccccaagcctc

SEQ ID NO: 3895982 - DNA, 19 bp, Homo sapiens
gagacaggaaaatcctctg

SEQ ID NO: 3895983 - DNA, 15 bp, Homo sapiens
gagacaggagggcaa

SEQ ID NO: 3895984 - DNA, 17 bp, Homo sapiens
gagacagggcaatcttg

SEQ ID NO: 3895985 - DNA, 17 bp, Homo sapiens
gagacagttatttatag

SEQ ID NO: 3895986 - DNA, 13 bp, Homo sapiens
gagacatgtacct

SEQ ID NO: 3895987 - DNA, 14 bp, Homo sapiens
gagacattgcctcc

SEQ ID NO: 3895988 - DNA, 16 bp, Homo sapiens
gagaccaacctgacca

SEQ ID NO: 3895989 - DNA, 17 bp, Homo sapiens
gagaccaacctgaccaa

SEQ ID NO: 3895990 - DNA, 23 bp, Homo sapiens
gagaccaagactctgaaatctca

SEQ ID NO: 3895991 - DNA, 21 bp, Homo sapiens
gagaccacagcaattggctcc

SEQ ID NO: 3895992 - DNA, 21 bp, Homo sapiens
gagaccagttgggagcactgg

SEQ ID NO: 3895993 - DNA, 23 bp, Homo sapiens
gagaccagttgggagcactggag

SEQ ID NO: 3895994 - DNA, 18 bp, Homo sapiens
gagaccatcctggcccct

SEQ ID NO: 3895995 - DNA, 14 bp, Homo sapiens
gagaccccaggatc

SEQ ID NO: 3895996 - DNA, 13 bp, Homo sapiens
gagaccctggaat

SEQ ID NO: 3895997 - DNA, 14 bp, Homo sapiens
gagacctcagccat

SEQ ID NO: 3895998 - DNA, 19 bp, Homo sapiens
gagacctgacaagcactgc

SEQ ID NO: 3895999 - DNA, 13 bp, Homo sapiens
gagacctgaggca

SEQ ID NO: 3896000 - DNA, 20 bp, Homo sapiens
gagaccttttctctcccata

SEQ ID NO: 3896001 - DNA, 21 bp, Homo sapiens
gagaccttttctctcccatac

SEQ ID NO: 3896002 - DNA, 19 bp, Homo sapiens
gagacgcaagggagaagaa

SEQ ID NO: 3896003 - DNA, 23 bp, Homo sapiens
gagacgcagccctgggggccagc

SEQ ID NO: 3896004 - DNA, 16 bp, Homo sapiens
gagacgtgtacatagt

SEQ ID NO: 3896005 - DNA, 15 bp, Homo sapiens
gagactaagccctgt

SEQ ID NO: 3896006 - DNA, 21 bp, Homo sapiens
gagactatggagcctggcaca

SEQ ID NO: 3896007 - DNA, 18 bp, Homo sapiens
gagactcacctctgcctc

SEQ ID NO: 3896008 - DNA, 21 bp, Homo sapiens
gagactccagaatctgctgtt

SEQ ID NO: 3896009 - DNA, 16 bp, Homo sapiens
gagactctcttaggga

SEQ ID NO: 3896010 - DNA, 16 bp, Homo sapiens
gagactctggaagccc

SEQ ID NO: 3896011 - DNA, 18 bp, Homo sapiens
gagactgaaagcagcagc

SEQ ID NO: 3896012 - DNA, 19 bp, Homo sapiens
gagactgaaagcagcagct

SEQ ID NO: 3896013 - DNA, 17 bp, Homo sapiens
gagactgagaggcagaa

SEQ ID NO: 3896014 - DNA, 12 bp, Homo sapiens
gagactggagca

SEQ ID NO: 3896015 - DNA, 22 bp, Homo sapiens
gagactgtctcaagagggcact

SEQ ID NO: 3896016 - DNA, 18 bp, Homo sapiens
gagagaaaaagtgcccct

SEQ ID NO: 3896017 - DNA, 13 bp, Homo sapiens
gagagaagaaagt

SEQ ID NO: 3896018 - DNA, 12 bp, Homo sapiens
gagagaaggaca

SEQ ID NO: 3896019 - DNA, 21 bp, Homo sapiens
gagagacagagacagagagag

SEQ ID NO: 3896020 - DNA, 17 bp, Homo sapiens
gagagacattgcctcca

SEQ ID NO: 3896021 - DNA, 14 bp, Homo sapiens
gagagacccaagga

SEQ ID NO: 3896022 - DNA, 17 bp, Homo sapiens
gagagacgtgtacatag

SEQ ID NO: 3896023 - DNA, 16 bp, Homo sapiens
gagagactgaaagcag

SEQ ID NO: 3896024 - DNA, 16 bp, Homo sapiens
gagagactgagggaga

SEQ ID NO: 3896025 - DNA, 11 bp, Homo sapiens
gagagagactg

SEQ ID NO: 3896026 - DNA, 15 bp, Homo sapiens
gagagagaggcagaa

SEQ ID NO: 3896027 - DNA, 14 bp, Homo sapiens
gagagagaggttct

SEQ ID NO: 3896028 - DNA, 15 bp, Homo sapiens
gagagagaggttctg

SEQ ID NO: 3896029 - DNA, 18 bp, Homo sapiens
gagagaggttctggggag

SEQ ID NO: 3896030 - DNA, 12 bp, Homo sapiens
gagagccagccc

SEQ ID NO: 3896031 - DNA, 20 bp, Homo sapiens
gagagccagccctccctgtc

SEQ ID NO: 3896032 - DNA, 12 bp, Homo sapiens
gagagccctgct

SEQ ID NO: 3896033 - DNA, 16 bp, Homo sapiens
gagagccctgctgtgg

SEQ ID NO: 3896034 - DNA, 14 bp, Homo sapiens
gagagccctgggac

SEQ ID NO: 3896035 - DNA, 15 bp, Homo sapiens
gagagccctgggacc

SEQ ID NO: 3896036 - DNA, 19 bp, Homo sapiens
gagagcctcttagtgattg

SEQ ID NO: 3896037 - DNA, 20 bp, Homo sapiens
gagagctagaacccggcagg

SEQ ID NO: 3896038 - DNA, 16 bp, Homo sapiens
gagagctagaacctgg

SEQ ID NO: 3896039 - DNA, 18 bp, Homo sapiens
gagagctagaacctggag

SEQ ID NO: 3896040 - DNA, 22 bp, Homo sapiens
gagagctaggagcaaagcctgt

SEQ ID NO: 3896041 - DNA, 16 bp, Homo sapiens
gagagctcgctcttgg

SEQ ID NO: 3896042 - DNA, 18 bp, Homo sapiens
gagagcttagcctggagc

SEQ ID NO: 3896043 - DNA, 15 bp, Homo sapiens
gagaggaagatgaag

SEQ ID NO: 3896044 - DNA, 16 bp, Homo sapiens
gagaggactctgcctt

SEQ ID NO: 3896045 - DNA, 18 bp, Homo sapiens
gagaggagcacctgaacc

SEQ ID NO: 3896046 - DNA, 20 bp, Homo sapiens
gagaggcagaagaaccctgg

SEQ ID NO: 3896047 - DNA, 12 bp, Homo sapiens
gagaggccctgg

SEQ ID NO: 3896048 - DNA, 13 bp, Homo sapiens
gagaggccctgga

SEQ ID NO: 3896049 - DNA, 21 bp, Homo sapiens
gagaggccctggatcagcgtg

SEQ ID NO: 3896050 - DNA, 15 bp, Homo sapiens
gagaggccttttgga

SEQ ID NO: 3896051 - DNA, 18 bp, Homo sapiens
gagaggccttttggaatg

SEQ ID NO: 3896052 - DNA, 19 bp, Homo sapiens
gagaggcgcgtctgcccca

SEQ ID NO: 3896053 - DNA, 23 bp, Homo sapiens
gagaggcgcgtctgccccaccct

SEQ ID NO: 3896054 - DNA, 13 bp, Homo sapiens
gagaggcggcctc

SEQ ID NO: 3896055 - DNA, 14 bp, Homo sapiens
gagagggcagaggg

SEQ ID NO: 3896056 - DNA, 15 bp, Homo sapiens
gagagggcccagctg

SEQ ID NO: 3896057 - DNA, 21 bp, Homo sapiens
gagagggcccagctgtagcca

SEQ ID NO: 3896058 - DNA, 16 bp, Homo sapiens
gagaggggaagggcca

SEQ ID NO: 3896059 - DNA, 17 bp, Homo sapiens
gagaggggaagggccag

SEQ ID NO: 3896060 - DNA, 19 bp, Homo sapiens
gagaggggagacagggcaa

SEQ ID NO: 3896061 - DNA, 12 bp, Homo sapiens
gagaggggcctg

SEQ ID NO: 3896062 - DNA, 13 bp, Homo sapiens
gagaggggcctgg

SEQ ID NO: 3896063 - DNA, 15 bp, Homo sapiens
gagaggggcctggga

SEQ ID NO: 3896064 - DNA, 22 bp, Homo sapiens
gagaggggcctgggaaaggaaa

SEQ ID NO: 3896065 - DNA, 15 bp, Homo sapiens
gagaggtctcaggtt

SEQ ID NO: 3896066 - DNA, 14 bp, Homo sapiens
gagagtaccatgct

SEQ ID NO: 3896067 - DNA, 22 bp, Homo sapiens
gagagtagccgagagcctgctc

SEQ ID NO: 3896068 - DNA, 15 bp, Homo sapiens
gagagtcctctggat

SEQ ID NO: 3896069 - DNA, 16 bp, Homo sapiens
gagagttcaagcctgt

SEQ ID NO: 3896070 - DNA, 20 bp, Homo sapiens
gagagttcaagcctgtggga

SEQ ID NO: 3896071 - DNA, 13 bp, Homo sapiens
gagatataaaatc

SEQ ID NO: 3896072 - DNA, 11 bp, Homo sapiens
gagatatttac

SEQ ID NO: 3896073 - DNA, 22 bp, Homo sapiens
gagatatttatggggggagaac

SEQ ID NO: 3896074 - DNA, 13 bp, Homo sapiens
gagatcaggaaga

SEQ ID NO: 3896075 - DNA, 17 bp, Homo sapiens
gagatctccctccaggg

SEQ ID NO: 3896076 - DNA, 21 bp, Homo sapiens
gagatgaagagtgagagggca

SEQ ID NO: 3896077 - DNA, 16 bp, Homo sapiens
gagatgatgatgatga

SEQ ID NO: 3896078 - DNA, 12 bp, Homo sapiens
gagatgcagagg

SEQ ID NO: 3896079 - DNA, 20 bp, Homo sapiens
gagatgcatgcgcaggctca

SEQ ID NO: 3896080 - DNA, 15 bp, Homo sapiens
gagatgcctccaccg

SEQ ID NO: 3896081 - DNA, 20 bp, Homo sapiens
gagatggtaatctacagctc

SEQ ID NO: 3896082 - DNA, 23 bp, Homo sapiens
gagatggtcagtgtggagagggg

SEQ ID NO: 3896083 - DNA, 14 bp, Homo sapiens
gagattgggcctcc

SEQ ID NO: 3896084 - DNA, 18 bp, Homo sapiens
gagattttcttggcagta

SEQ ID NO: 3896085 - DNA, 22 bp, Homo sapiens
gagcaaagcctgttcatggcag

SEQ ID NO: 3896086 - DNA, 23 bp, Homo sapiens
gagcaaagcctgttcatggcaga

SEQ ID NO: 3896087 - DNA, 19 bp, Homo sapiens
gagcaaagtctaaagttta

SEQ ID NO: 3896088 - DNA, 19 bp, Homo sapiens
gagcaaatgtttctgcagt

SEQ ID NO: 3896089 - DNA, 16 bp, Homo sapiens
gagcaacccctgtacc

SEQ ID NO: 3896090 - DNA, 18 bp, Homo sapiens
gagcaacccctgtaccca

SEQ ID NO: 3896091 - DNA, 20 bp, Homo sapiens
gagcaacccctgtacccagc

SEQ ID NO: 3896092 - DNA, 23 bp, Homo sapiens
gagcaacccctgtacccagctcc

SEQ ID NO: 3896093 - DNA, 16 bp, Homo sapiens
gagcaaccgtggccct

SEQ ID NO: 3896094 - DNA, 16 bp, Homo sapiens
gagcaagagagggcaa

SEQ ID NO: 3896095 - DNA, 13 bp, Homo sapiens
gagcaagagctgg

SEQ ID NO: 3896096 - DNA, 14 bp, Homo sapiens
gagcaagagctggc

SEQ ID NO: 3896097 - DNA, 20 bp, Homo sapiens
gagcaagcatttatgtttat

SEQ ID NO: 3896098 - DNA, 23 bp, Homo sapiens
gagcacaagttccagctggtctt

SEQ ID NO: 3896099 - DNA, 20 bp, Homo sapiens
gagcacagaggggctagggg

SEQ ID NO: 3896100 - DNA, 16 bp, Homo sapiens
gagcacagccctggga

SEQ ID NO: 3896101 - DNA, 13 bp, Homo sapiens
gagcacaggcagc

SEQ ID NO: 3896102 - DNA, 17 bp, Homo sapiens
gagcaccccctcattcc

SEQ ID NO: 3896103 - DNA, 23 bp, Homo sapiens
gagcacctactttatgtatggag

SEQ ID NO: 3896104 - DNA, 23 bp, Homo sapiens
gagcacctgaaccccatgggctt

SEQ ID NO: 3896105 - DNA, 23 bp, Homo sapiens
gagcacctgcttcatgctcagcc

SEQ ID NO: 3896106 - DNA, 23 bp, Homo sapiens
gagcaccttaatattattggggt

SEQ ID NO: 3896107 - DNA, 12 bp, Homo sapiens
gagcactgccag

SEQ ID NO: 3896108 - DNA, 15 bp, Homo sapiens
gagcactgccaggag

SEQ ID NO: 3896109 - DNA, 16 bp, Homo sapiens
gagcactgccaggagg

SEQ ID NO: 3896110 - DNA, 18 bp, Homo sapiens
gagcactgccaggaggga

SEQ ID NO: 3896111 - DNA, 13 bp, Homo sapiens
gagcactgctcca

SEQ ID NO: 3896112 - DNA, 20 bp, Homo sapiens
gagcactggagtgcagggag

SEQ ID NO: 3896113 - DNA, 13 bp, Homo sapiens
gagcactggccag

SEQ ID NO: 3896114 - DNA, 18 bp, Homo sapiens
gagcactggccagagagg

SEQ ID NO: 3896115 - DNA, 22 bp, Homo sapiens
gagcactggccagagagggccc

SEQ ID NO: 3896116 - DNA, 16 bp, Homo sapiens
gagcacttgcgtcctg

SEQ ID NO: 3896117 - DNA, 19 bp, Homo sapiens
gagcacttgcgtcctgcag

SEQ ID NO: 3896118 - DNA, 14 bp, Homo sapiens
gagcacttgctgta

SEQ ID NO: 3896119 - DNA, 13 bp, Homo sapiens
gagcagaaataaa

SEQ ID NO: 3896120 - DNA, 13 bp, Homo sapiens
gagcagacagaga

SEQ ID NO: 3896121 - DNA, 16 bp, Homo sapiens
gagcagacagagaaat

SEQ ID NO: 3896122 - DNA, 17 bp, Homo sapiens
gagcagacagagaaatg

SEQ ID NO: 3896123 - DNA, 21 bp, Homo sapiens
gagcagagagcttagcctgga

SEQ ID NO: 3896124 - DNA, 16 bp, Homo sapiens
gagcagctgagcaggg

SEQ ID NO: 3896125 - DNA, 18 bp, Homo sapiens
gagcagctgagcagggcc

SEQ ID NO: 3896126 - DNA, 20 bp, Homo sapiens
gagcagctgagcagggccgg

SEQ ID NO: 3896127 - DNA, 14 bp, Homo sapiens
gagcagctggctct

SEQ ID NO: 3896128 - DNA, 16 bp, Homo sapiens
gagcagctggctctcc

SEQ ID NO: 3896129 - DNA, 17 bp, Homo sapiens
gagcagctggctctcca

SEQ ID NO: 3896130 - DNA, 19 bp, Homo sapiens
gagcaggcacatggaggag

SEQ ID NO: 3896131 - DNA, 19 bp, Homo sapiens
gagcaggccacgctcaggc

SEQ ID NO: 3896132 - DNA, 19 bp, Homo sapiens
gagcaggcccgacagagag

SEQ ID NO: 3896133 - DNA, 20 bp, Homo sapiens
gagcaggcccgacagagaga

SEQ ID NO: 3896134 - DNA, 18 bp, Homo sapiens
gagcaggctcagactctg

SEQ ID NO: 3896135 - DNA, 15 bp, Homo sapiens
gagcagggccgggga

SEQ ID NO: 3896136 - DNA, 20 bp, Homo sapiens
gagcaggggtccttggtgtg

SEQ ID NO: 3896137 - DNA, 13 bp, Homo sapiens
gagcatcatgcct

SEQ ID NO: 3896138 - DNA, 17 bp, Homo sapiens
gagcatcatgcctctga

SEQ ID NO: 3896139 - DNA, 19 bp, Homo sapiens
gagcatcgtgacccttcag

SEQ ID NO: 3896140 - DNA, 16 bp, Homo sapiens
gagcatgcacagctgc

SEQ ID NO: 3896141 - DNA, 19 bp, Homo sapiens
gagcatgcacagctgcttg

SEQ ID NO: 3896142 - DNA, 20 bp, Homo sapiens
gagcattacgtgagccaggt

SEQ ID NO: 3896143 - DNA, 18 bp, Homo sapiens
gagccaaacacactgtaa

SEQ ID NO: 3896144 - DNA, 19 bp, Homo sapiens
gagccaaacacactgtaaa

SEQ ID NO: 3896145 - DNA, 14 bp, Homo sapiens
gagccaacagcagc

SEQ ID NO: 3896146 - DNA, 15 bp, Homo sapiens
gagccactcctgtcc

SEQ ID NO: 3896147 - DNA, 16 bp, Homo sapiens
gagccactgcactcca

SEQ ID NO: 3896148 - DNA, 21 bp, Homo sapiens
gagccagaacctggagggcta

SEQ ID NO: 3896149 - DNA, 20 bp, Homo sapiens
gagccagccctccctgtcct

SEQ ID NO: 3896150 - DNA, 22 bp, Homo sapiens
gagccatgatcgagccactgca

SEQ ID NO: 3896151 - DNA, 13 bp, Homo sapiens
gagccatgggcct

SEQ ID NO: 3896152 - DNA, 14 bp, Homo sapiens
gagccatgggcctg

SEQ ID NO: 3896153 - DNA, 16 bp, Homo sapiens
gagccatgggcctggg

SEQ ID NO: 3896154 - DNA, 18 bp, Homo sapiens
gagccatgggcctgggcc

SEQ ID NO: 3896155 - DNA, 21 bp, Homo sapiens
gagccatgggcctgggcctgc

SEQ ID NO: 3896156 - DNA, 21 bp, Homo sapiens
gagccattttggggggccccc

SEQ ID NO: 3896157 - DNA, 18 bp, Homo sapiens
gagcccaagtgccatccc

SEQ ID NO: 3896158 - DNA, 19 bp, Homo sapiens
gagcccaagtgccatccca

SEQ ID NO: 3896159 - DNA, 19 bp, Homo sapiens
gagcccagctacattcctc

SEQ ID NO: 3896160 - DNA, 11 bp, Homo sapiens
gagcccaggga

SEQ ID NO: 3896161 - DNA, 15 bp, Homo sapiens
gagcccagggaggcc

SEQ ID NO: 3896162 - DNA, 14 bp, Homo sapiens
gagccccactcccg

SEQ ID NO: 3896163 - DNA, 13 bp, Homo sapiens
gagccccaggcct

SEQ ID NO: 3896164 - DNA, 13 bp, Homo sapiens
gagcccccaagcc

SEQ ID NO: 3896165 - DNA, 12 bp, Homo sapiens
gagcccccaagg

SEQ ID NO: 3896166 - DNA, 20 bp, Homo sapiens
gagccccccgtgtggcttac

SEQ ID NO: 3896167 - DNA, 15 bp, Homo sapiens
gagcccctccctgct

SEQ ID NO: 3896168 - DNA, 20 bp, Homo sapiens
gagcccgagggcctgacagg

SEQ ID NO: 3896169 - DNA, 12 bp, Homo sapiens
gagccctgggac

SEQ ID NO: 3896170 - DNA, 15 bp, Homo sapiens
gagccgggccccgga

SEQ ID NO: 3896171 - DNA, 13 bp, Homo sapiens
gagccgggcctgg

SEQ ID NO: 3896172 - DNA, 20 bp, Homo sapiens
gagccgggcctggggctcct

SEQ ID NO: 3896173 - DNA, 16 bp, Homo sapiens
gagcctaatgaaaggg

SEQ ID NO: 3896174 - DNA, 14 bp, Homo sapiens
gagcctagccacct

SEQ ID NO: 3896175 - DNA, 16 bp, Homo sapiens
gagcctagccacctcc

SEQ ID NO: 3896176 - DNA, 12 bp, Homo sapiens
gagcctccccct

SEQ ID NO: 3896177 - DNA, 15 bp, Homo sapiens
gagcctccccctcag

SEQ ID NO: 3896178 - DNA, 12 bp, Homo sapiens
gagcctcttagt

SEQ ID NO: 3896179 - DNA, 20 bp, Homo sapiens
gagcctcttctgccaagaga

SEQ ID NO: 3896180 - DNA, 15 bp, Homo sapiens
gagcctgccgagcaa

SEQ ID NO: 3896181 - DNA, 23 bp, Homo sapiens
gagcctgccgagcaaccgtggcc

SEQ ID NO: 3896182 - DNA, 17 bp, Homo sapiens
gagcctgctcccccacc

SEQ ID NO: 3896183 - DNA, 18 bp, Homo sapiens
gagcctgctcccccaccc

SEQ ID NO: 3896184 - DNA, 15 bp, Homo sapiens
gagcctggagaagct

SEQ ID NO: 3896185 - DNA, 18 bp, Homo sapiens
gagcctggcacaggactg

SEQ ID NO: 3896186 - DNA, 23 bp, Homo sapiens
gagcctggctccgtccaggagcc

SEQ ID NO: 3896187 - DNA, 20 bp, Homo sapiens
ctggtgctgccacacttcag

SEQ ID NO: 3896188 - DNA, 22 bp, Homo sapiens
ctggtgctgccacacttcaggc

SEQ ID NO: 3896189 - DNA, 18 bp, Homo sapiens
ctggtgctgtggccaggg

SEQ ID NO: 3896190 - DNA, 19 bp, Homo sapiens
ctggtgctgtggccagggt

SEQ ID NO: 3896191 - DNA, 13 bp, Homo sapiens
ctggtggcaccag

SEQ ID NO: 3896192 - DNA, 14 bp, Homo sapiens
ctggtggcaccaga

SEQ ID NO: 3896193 - DNA, 19 bp, Homo sapiens
ctggtggcaccagatgcaa

SEQ ID NO: 3896194 - DNA, 22 bp, Homo sapiens
ctggtggcccgacagcctggca

SEQ ID NO: 3896195 - DNA, 20 bp, Homo sapiens
ctggtgtgaggctgggccag

SEQ ID NO: 3896196 - DNA, 19 bp, Homo sapiens
ctggttcaagcgattctca

SEQ ID NO: 3896197 - DNA, 23 bp, Homo sapiens
ctggttggagagctagaacctgg

SEQ ID NO: 3896198 - DNA, 21 bp, Homo sapiens
ctggttgttgcaccatctgct

SEQ ID NO: 3896199 - DNA, 21 bp, Homo sapiens
ctgtaaaaagagagaaaactt

SEQ ID NO: 3896200 - DNA, 17 bp, Homo sapiens
ctgtaaacccctgggta

SEQ ID NO: 3896201 - DNA, 12 bp, Homo sapiens
ctgtaaatacaa

SEQ ID NO: 3896202 - DNA, 16 bp, Homo sapiens
ctgtaaatacaaaata

SEQ ID NO: 3896203 - DNA, 17 bp, Homo sapiens
ctgtaaatacaaaataa

SEQ ID NO: 3896204 - DNA, 22 bp, Homo sapiens
ctgtaaatacaaaataaaatta

SEQ ID NO: 3896205 - DNA, 15 bp, Homo sapiens
ctgtaaatatccaca

SEQ ID NO: 3896206 - DNA, 16 bp, Homo sapiens
ctgtaaatcacttgta

SEQ ID NO: 3896207 - DNA, 19 bp, Homo sapiens
ctgtaaatcacttgtaaat

SEQ ID NO: 3896208 - DNA, 21 bp, Homo sapiens
ctgtaaatcacttgtaaataa

SEQ ID NO: 3896209 - DNA, 22 bp, Homo sapiens
ctgtaaatcacttgtaaataaa

SEQ ID NO: 3896210 - DNA, 23 bp, Homo sapiens
ctgtaaatcacttgtaaataaat

SEQ ID NO: 3896211 - DNA, 20 bp, Homo sapiens
ctgtaacacaagccacagaa

SEQ ID NO: 3896212 - DNA, 22 bp, Homo sapiens
ctgtaacacaagccacagaagc

SEQ ID NO: 3896213 - DNA, 16 bp, Homo sapiens
ctgtaactgctgagcc

SEQ ID NO: 3896214 - DNA, 20 bp, Homo sapiens
ctgtaactgctgagccactc

SEQ ID NO: 3896215 - DNA, 21 bp, Homo sapiens
ctgtaagactcattccctaga

SEQ ID NO: 3896216 - DNA, 22 bp, Homo sapiens
ctgtaagcattctgagctgggc

SEQ ID NO: 3896217 - DNA, 16 bp, Homo sapiens
ctgtaagtttattttt

SEQ ID NO: 3896218 - DNA, 22 bp, Homo sapiens
ctgtaagtttattttttctaca

SEQ ID NO: 3896219 - DNA, 19 bp, Homo sapiens
ctgtaatgagaacttcaat

SEQ ID NO: 3896220 - DNA, 21 bp, Homo sapiens
ctgtaattaagtaaaccaaaa

SEQ ID NO: 3896221 - DNA, 17 bp, Homo sapiens
ctgtaattaatattcct

SEQ ID NO: 3896222 - DNA, 18 bp, Homo sapiens
ctgtaattaatattccta

SEQ ID NO: 3896223 - DNA, 21 bp, Homo sapiens
ctgtaattttgtttgtaatcc

SEQ ID NO: 3896224 - DNA, 14 bp, Homo sapiens
ctgtacaaaaacaa

SEQ ID NO: 3896225 - DNA, 15 bp, Homo sapiens
ctgtacatagatgta

SEQ ID NO: 3896226 - DNA, 15 bp, Homo sapiens
ctgtactcagagcag

SEQ ID NO: 3896227 - DNA, 19 bp, Homo sapiens
ctgtactcagagcagagca

SEQ ID NO: 3896228 - DNA, 21 bp, Homo sapiens
ctgtactcctcccaggcgccc

SEQ ID NO: 3896229 - DNA, 12 bp, Homo sapiens
ctgtactgcctg

SEQ ID NO: 3896230 - DNA, 15 bp, Homo sapiens
ctgtactgcctgctt

SEQ ID NO: 3896231 - DNA, 18 bp, Homo sapiens
ctgtactgcctgcttggg

SEQ ID NO: 3896232 - DNA, 19 bp, Homo sapiens
ctgtactgcctgcttgggg

SEQ ID NO: 3896233 - DNA, 12 bp, Homo sapiens
ctgtactgtaat

SEQ ID NO: 3896234 - DNA, 14 bp, Homo sapiens
ctgtactgtaattt

SEQ ID NO: 3896235 - DNA, 16 bp, Homo sapiens
ctgtacttaataaatt

SEQ ID NO: 3896236 - DNA, 17 bp, Homo sapiens
ctgtacttgatgacaga

SEQ ID NO: 3896237 - DNA, 21 bp, Homo sapiens
ctgtagacttactttcctatt

SEQ ID NO: 3896238 - DNA, 19 bp, Homo sapiens
ctgtagagttggaactgca

SEQ ID NO: 3896239 - DNA, 21 bp, Homo sapiens
ctgtagcagtgagaaaaagct

SEQ ID NO: 3896240 - DNA, 16 bp, Homo sapiens
ctgtagcatcttctgg

SEQ ID NO: 3896241 - DNA, 17 bp, Homo sapiens
ctgtagccatggctcag

SEQ ID NO: 3896242 - DNA, 21 bp, Homo sapiens
ctgtagccatggctcaggcaa

SEQ ID NO: 3896243 - DNA, 18 bp, Homo sapiens
ctgtagcttgttccctgt

SEQ ID NO: 3896244 - DNA, 14 bp, Homo sapiens
ctgtagggctggac

SEQ ID NO: 3896245 - DNA, 15 bp, Homo sapiens
ctgtagggctggacc

SEQ ID NO: 3896246 - DNA, 21 bp, Homo sapiens
ctgtagtagccctttctgtgt

SEQ ID NO: 3896247 - DNA, 14 bp, Homo sapiens
ctgtagtcccagcc

SEQ ID NO: 3896248 - DNA, 17 bp, Homo sapiens
ctgtagtgagaaactga

SEQ ID NO: 3896249 - DNA, 19 bp, Homo sapiens
ctgtagtgagaaactgatt

SEQ ID NO: 3896250 - DNA, 13 bp, Homo sapiens
ctgtagttaggaa

SEQ ID NO: 3896251 - DNA, 21 bp, Homo sapiens
ctgtagttaggaaataaaacc

SEQ ID NO: 3896252 - DNA, 21 bp, Homo sapiens
ctgtataaaatgcaaaataaa

SEQ ID NO: 3896253 - DNA, 19 bp, Homo sapiens
ctgtataaacattaaatgt

SEQ ID NO: 3896254 - DNA, 14 bp, Homo sapiens
ctgtataatctatt

SEQ ID NO: 3896255 - DNA, 18 bp, Homo sapiens
ctgtataatctatttaca

SEQ ID NO: 3896256 - DNA, 21 bp, Homo sapiens
ctgtataattctacaggatgg

SEQ ID NO: 3896257 - DNA, 20 bp, Homo sapiens
ctgtataatttaacagtgcc

SEQ ID NO: 3896258 - DNA, 20 bp, Homo sapiens
ctgtatataatactaaagtg

SEQ ID NO: 3896259 - DNA, 14 bp, Homo sapiens
ctgtatatacattt

SEQ ID NO: 3896260 - DNA, 13 bp, Homo sapiens
ctgtatattatgg

SEQ ID NO: 3896261 - DNA, 22 bp, Homo sapiens
ctgtatattatggtgtaatgca

SEQ ID NO: 3896262 - DNA, 18 bp, Homo sapiens
ctgtatgtgtctttatca

SEQ ID NO: 3896263 - DNA, 22 bp, Homo sapiens
ctgtattcagatcgtattaatt

SEQ ID NO: 3896264 - DNA, 15 bp, Homo sapiens
ctgtatttgttccca

SEQ ID NO: 3896265 - DNA, 16 bp, Homo sapiens
ctgtatttgttcccaa

SEQ ID NO: 3896266 - DNA, 16 bp, Homo sapiens
ctgtattttgccagac

SEQ ID NO: 3896267 - DNA, 17 bp, Homo sapiens
ctgtcaatttccctgac

SEQ ID NO: 3896268 - DNA, 18 bp, Homo sapiens
ctgtcaatttccctgact

SEQ ID NO: 3896269 - DNA, 19 bp, Homo sapiens
ctgtcaatttccctgactc

SEQ ID NO: 3896270 - DNA, 23 bp, Homo sapiens
ctgtcacacaaggctgggcacct

SEQ ID NO: 3896271 - DNA, 23 bp, Homo sapiens
ctgtcaccaagctcacagttcct

SEQ ID NO: 3896272 - DNA, 13 bp, Homo sapiens
ctgtcactgtggg

SEQ ID NO: 3896273 - DNA, 19 bp, Homo sapiens
ctgtcagagatctgggagg

SEQ ID NO: 3896274 - DNA, 13 bp, Homo sapiens
ctgtcagagctgt

SEQ ID NO: 3896275 - DNA, 24 bp, Homo sapiens
ctgtcagagctgttggcctcgcct

SEQ ID NO: 3896276 - DNA, 12 bp, Homo sapiens
ctgtcagaggct

SEQ ID NO: 3896277 - DNA, 17 bp, Homo sapiens
ctgtcagccagccgccc

SEQ ID NO: 3896278 - DNA, 20 bp, Homo sapiens
ctgtcagccagccgccctgg

SEQ ID NO: 3896279 - DNA, 21 bp, Homo sapiens
ctgtcagccagccgccctggg

SEQ ID NO: 3896280 - DNA, 21 bp, Homo sapiens
ctgtcaggacaccagcctggt

SEQ ID NO: 3896281 - DNA, 14 bp, Homo sapiens
ctgtcatagaaatt

SEQ ID NO: 3896282 - DNA, 16 bp, Homo sapiens
ctgtcatagaaattac

SEQ ID NO: 3896283 - DNA, 17 bp, Homo sapiens
ctgtcatctagcccctt

SEQ ID NO: 3896284 - DNA, 14 bp, Homo sapiens
ctgtcatctctctg

SEQ ID NO: 3896285 - DNA, 23 bp, Homo sapiens
ctgtcattcaggaccccaacccc

SEQ ID NO: 3896286 - DNA, 23 bp, Homo sapiens
ctgtccaacctaacccctttcct

SEQ ID NO: 3896287 - DNA, 12 bp, Homo sapiens
ctgtccactctc

SEQ ID NO: 3896288 - DNA, 23 bp, Homo sapiens
ctgtccactctcggggcccttgg

SEQ ID NO: 3896289 - DNA, 17 bp, Homo sapiens
ctgtccaggccactgtg

SEQ ID NO: 3896290 - DNA, 22 bp, Homo sapiens
ctgtccaggccactgtggccag

SEQ ID NO: 3896291 - DNA, 14 bp, Homo sapiens
ctgtcccaccaact

SEQ ID NO: 3896292 - DNA, 18 bp, Homo sapiens
ctgtcccaccaactctgc

SEQ ID NO: 3896293 - DNA, 20 bp, Homo sapiens
ctgtcccaccaactctgcac

SEQ ID NO: 3896294 - DNA, 15 bp, Homo sapiens
ctgtcccaccgggag

SEQ ID NO: 3896295 - DNA, 19 bp, Homo sapiens
ctgtcccaccgggagcctc

SEQ ID NO: 3896296 - DNA, 13 bp, Homo sapiens
ctgtcccagagct

SEQ ID NO: 3896297 - DNA, 22 bp, Homo sapiens
ctgtcccagagcttattggcca

SEQ ID NO: 3896298 - DNA, 23 bp, Homo sapiens
ctgtcccagagcttattggccac

SEQ ID NO: 3896299 - DNA, 23 bp, Homo sapiens
ctgtcccagaggttatctgcctg

SEQ ID NO: 3896300 - DNA, 15 bp, Homo sapiens
ctgtcccctctcccc

SEQ ID NO: 3896301 - DNA, 16 bp, Homo sapiens
ctgtcccctctgtcat

SEQ ID NO: 3896302 - DNA, 20 bp, Homo sapiens
ctgtcccctgaaaaactgat

SEQ ID NO: 3896303 - DNA, 22 bp, Homo sapiens
ctgtcccctggggtctctgctg

SEQ ID NO: 3896304 - DNA, 18 bp, Homo sapiens
ctgtcccggttcaccttg

SEQ ID NO: 3896305 - DNA, 19 bp, Homo sapiens
ctgtcccggttcaccttgc

SEQ ID NO: 3896306 - DNA, 14 bp, Homo sapiens
ctgtccctgcctca

SEQ ID NO: 3896307 - DNA, 17 bp, Homo sapiens
ctgtccctgtcaccaag

SEQ ID NO: 3896308 - DNA, 18 bp, Homo sapiens
ctgtccgcctctgcccgc

SEQ ID NO: 3896309 - DNA, 20 bp, Homo sapiens
ctgtccgcctctgcccgcag

SEQ ID NO: 3896310 - DNA, 17 bp, Homo sapiens
ctgtcctctcgagccca

SEQ ID NO: 3896311 - DNA, 20 bp, Homo sapiens
ctgtcctggtacagcagggt

SEQ ID NO: 3896312 - DNA, 18 bp, Homo sapiens
ctgtcgagacacttgcct

SEQ ID NO: 3896313 - DNA, 13 bp, Homo sapiens
ctgtcgccccagg

SEQ ID NO: 3896314 - DNA, 15 bp, Homo sapiens
ctgtcgctgggctgt

SEQ ID NO: 3896315 - DNA, 22 bp, Homo sapiens
ctgtctcaagagggcactggtg

SEQ ID NO: 3896316 - DNA, 18 bp, Homo sapiens
ctgtctcaagctcttcct

SEQ ID NO: 3896317 - DNA, 18 bp, Homo sapiens
ctgtctcgagcgccctgc

SEQ ID NO: 3896318 - DNA, 17 bp, Homo sapiens
ctgtctctagccacttt

SEQ ID NO: 3896319 - DNA, 12 bp, Homo sapiens
ctgtctctgcct

SEQ ID NO: 3896320 - DNA, 17 bp, Homo sapiens
ctgtctctgcctgcggc

SEQ ID NO: 3896321 - DNA, 16 bp, Homo sapiens
ctgtctggttttaaca

SEQ ID NO: 3896322 - DNA, 18 bp, Homo sapiens
ctgtctggttttaacaat

SEQ ID NO: 3896323 - DNA, 19 bp, Homo sapiens
ctgtctgtcaccagctatc

SEQ ID NO: 3896324 - DNA, 23 bp, Homo sapiens
ctgtctttctctaaatatgatta

SEQ ID NO: 3896325 - DNA, 21 bp, Homo sapiens
ctgtctttctggccctttctg

SEQ ID NO: 3896326 - DNA, 19 bp, Homo sapiens
ctgtgaacccaggacaagc

SEQ ID NO: 3896327 - DNA, 19 bp, Homo sapiens
ctgtgaagaatgaagtgga

SEQ ID NO: 3896328 - DNA, 14 bp, Homo sapiens
ctgtgaccccacct

SEQ ID NO: 3896329 - DNA, 15 bp, Homo sapiens
ctgtgacctgctgag

SEQ ID NO: 3896330 - DNA, 17 bp, Homo sapiens
ctgtgacctgctgagct

SEQ ID NO: 3896331 - DNA, 21 bp, Homo sapiens
ctgtgacctgctgagctctga

SEQ ID NO: 3896332 - DNA, 14 bp, Homo sapiens
ctgtgactgatgtt

SEQ ID NO: 3896333 - DNA, 13 bp, Homo sapiens
ctgtgagcccctg

SEQ ID NO: 3896334 - DNA, 15 bp, Homo sapiens
ctgtgagcccctggt

SEQ ID NO: 3896335 - DNA, 21 bp, Homo sapiens
ctgtgagcccctggtcctgag

SEQ ID NO: 3896336 - DNA, 17 bp, Homo sapiens
ctgtgaggggaaggcct

SEQ ID NO: 3896337 - DNA, 20 bp, Homo sapiens
ctgtgcaccttacattccta

SEQ ID NO: 3896338 - DNA, 17 bp, Homo sapiens
ctgtgcactagcctgtg

SEQ ID NO: 3896339 - DNA, 21 bp, Homo sapiens
ctgtgcactagcctgtgatta

SEQ ID NO: 3896340 - DNA, 15 bp, Homo sapiens
ctgtgcagcagccca

SEQ ID NO: 3896341 - DNA, 19 bp, Homo sapiens
ctgtgcagcagcccagctt

SEQ ID NO: 3896342 - DNA, 22 bp, Homo sapiens
ctgtgcagcagcccagcttcct

SEQ ID NO: 3896343 - DNA, 24 bp, Homo sapiens
ctgtgcagcagcccagcttcctgg

SEQ ID NO: 3896344 - DNA, 16 bp, Homo sapiens
ctgtgccaacctgatg

SEQ ID NO: 3896345 - DNA, 18 bp, Homo sapiens
ctgtgccaacctgatgcc

SEQ ID NO: 3896346 - DNA, 14 bp, Homo sapiens
ctgtgccctgcctt

SEQ ID NO: 3896347 - DNA, 13 bp, Homo sapiens
ctgtgcctcctca

SEQ ID NO: 3896348 - DNA, 16 bp, Homo sapiens
ctgtgcctcctcaccc

SEQ ID NO: 3896349 - DNA, 11 bp, Homo sapiens
ctgtgcctctg

SEQ ID NO: 3896350 - DNA, 16 bp, Homo sapiens
ctgtgcctctgcctgt

SEQ ID NO: 3896351 - DNA, 13 bp, Homo sapiens
ctgtgcctgctag

SEQ ID NO: 3896352 - DNA, 14 bp, Homo sapiens
ctgtgcctgctaga

SEQ ID NO: 3896353 - DNA, 16 bp, Homo sapiens
ctgtgcctgctagagc

SEQ ID NO: 3896354 - DNA, 17 bp, Homo sapiens
ctgtgcctgctagagca

SEQ ID NO: 3896355 - DNA, 11 bp, Homo sapiens
ctgtgcctttg

SEQ ID NO: 3896356 - DNA, 18 bp, Homo sapiens
ctgtgcctttgggaggca

SEQ ID NO: 3896357 - DNA, 16 bp, Homo sapiens
ctgtgctctggaggct

SEQ ID NO: 3896358 - DNA, 21 bp, Homo sapiens
ctgtgctgccctgctctgggg

SEQ ID NO: 3896359 - DNA, 18 bp, Homo sapiens
ctgtgctgtgcctgctag

SEQ ID NO: 3896360 - DNA, 13 bp, Homo sapiens
ctgtgcttacagt

SEQ ID NO: 3896361 - DNA, 12 bp, Homo sapiens
ctgtggaggcct

SEQ ID NO: 3896362 - DNA, 16 bp, Homo sapiens
ctgtggcagaaaagag

SEQ ID NO: 3896363 - DNA, 21 bp, Homo sapiens
ctgtggcagaaaagaggagac

SEQ ID NO: 3896364 - DNA, 21 bp, Homo sapiens
ctgtggcagaccgggggccag

SEQ ID NO: 3896365 - DNA, 15 bp, Homo sapiens
ctgtggccagagctg

SEQ ID NO: 3896366 - DNA, 17 bp, Homo sapiens
ctgtggccagagctgga

SEQ ID NO: 3896367 - DNA, 12 bp, Homo sapiens
ctgtggcctcac

SEQ ID NO: 3896368 - DNA, 17 bp, Homo sapiens
ctgtggcctgtgtccag

SEQ ID NO: 3896369 - DNA, 24 bp, Homo sapiens
ctgtggcctgtgtccagcagctgc

SEQ ID NO: 3896370 - DNA, 14 bp, Homo sapiens
ctgtggccttgccc

SEQ ID NO: 3896371 - DNA, 23 bp, Homo sapiens
ctgtgggaagagaagggaagcct

SEQ ID NO: 3896372 - DNA, 16 bp, Homo sapiens
ctgtgggagagcgaag

SEQ ID NO: 3896373 - DNA, 13 bp, Homo sapiens
ctgtgggagcctc

SEQ ID NO: 3896374 - DNA, 11 bp, Homo sapiens
ctgtgggcagc

SEQ ID NO: 3896375 - DNA, 12 bp, Homo sapiens
ctgtgggcagca

SEQ ID NO: 3896376 - DNA, 13 bp, Homo sapiens
ctgtgggcagcac

SEQ ID NO: 3896377 - DNA, 15 bp, Homo sapiens
ctgtgggcagcaccc

SEQ ID NO: 3896378 - DNA, 19 bp, Homo sapiens
ctgtgggcagcaccctccc

SEQ ID NO: 3896379 - DNA, 13 bp, Homo sapiens
ctgtgggccagga

SEQ ID NO: 3896380 - DNA, 15 bp, Homo sapiens
ctgtgggcttggcct

SEQ ID NO: 3896381 - DNA, 16 bp, Homo sapiens
ctgtgggcttggcctt

SEQ ID NO: 3896382 - DNA, 21 bp, Homo sapiens
ctgtggggaaccaattgcttt

SEQ ID NO: 3896383 - DNA, 13 bp, Homo sapiens
ctgtggggcctga

SEQ ID NO: 3896384 - DNA, 23 bp, Homo sapiens
ctgtgggggtggccatccctggg

SEQ ID NO: 3896385 - DNA, 17 bp, Homo sapiens
ctgtggtgacaggccca

SEQ ID NO: 3896386 - DNA, 20 bp, Homo sapiens
ctgtggtgggaacattcgag

SEQ ID NO: 3896387 - DNA, 17 bp, Homo sapiens
ctgtgtagctgtgacct

SEQ ID NO: 3896388 - DNA, 18 bp, Homo sapiens
ctgtgtagctgtgacctg

SEQ ID NO: 3896389 - DNA, 16 bp, Homo sapiens
ctgtgtcataccacaa

SEQ ID NO: 3896390 - DNA, 14 bp, Homo sapiens
ctgtgtccagcagc

SEQ ID NO: 3896391 - DNA, 21 bp, Homo sapiens
ctgtgtcccccccagtgcagg

SEQ ID NO: 3896392 - DNA, 15 bp, Homo sapiens
ctgtgtccttccctg

SEQ ID NO: 3896393 - DNA, 16 bp, Homo sapiens
ctgtgtccttgcacct

SEQ ID NO: 3896394 - DNA, 12 bp, Homo sapiens
ctgtgtgaaata

SEQ ID NO: 3896395 - DNA, 13 bp, Homo sapiens
ctgtgtgaagaaa

SEQ ID NO: 3896396 - DNA, 23 bp, Homo sapiens
ctgtgtgacagaatcttgtattt

SEQ ID NO: 3896397 - DNA, 15 bp, Homo sapiens
ctgtgtgatgaactt

SEQ ID NO: 3896398 - DNA, 13 bp, Homo sapiens
ctgtgtggggagg

SEQ ID NO: 3896399 - DNA, 15 bp, Homo sapiens
ctgtgtggggaggca

SEQ ID NO: 3896400 - DNA, 17 bp, Homo sapiens
ctgtgtggggaggcagc

SEQ ID NO: 3896401 - DNA, 21 bp, Homo sapiens
ctgtgtggggaggcagctcca

SEQ ID NO: 3896402 - DNA, 15 bp, Homo sapiens
ctgtgtggtatattt

SEQ ID NO: 3896403 - DNA, 23 bp, Homo sapiens
ctgtgttcattcttaccgagaaa

SEQ ID NO: 3896404 - DNA, 17 bp, Homo sapiens
ctgtgttcttgctgagc

SEQ ID NO: 3896405 - DNA, 14 bp, Homo sapiens
ctgtgttgaacaca

SEQ ID NO: 3896406 - DNA, 15 bp, Homo sapiens
ctgttaaaagatgaa

SEQ ID NO: 3896407 - DNA, 23 bp, Homo sapiens
ctgttaaaagatgaaaatatttg

SEQ ID NO: 3896408 - DNA, 16 bp, Homo sapiens
ctgttaaaatgtacac

SEQ ID NO: 3896409 - DNA, 17 bp, Homo sapiens
ctgttaaaatgtacact

SEQ ID NO: 3896410 - DNA, 23 bp, Homo sapiens
ctgttacataacaagaaaatcaa

SEQ ID NO: 3896411 - DNA, 19 bp, Homo sapiens
ctgttactattatctgtgc

SEQ ID NO: 3896412 - DNA, 21 bp, Homo sapiens
ctgttacttgaaataccagtg

SEQ ID NO: 3896413 - DNA, 14 bp, Homo sapiens
ctgttactttttag

SEQ ID NO: 3896414 - DNA, 21 bp, Homo sapiens
ctgttcaccttatgtattatt

SEQ ID NO: 3896415 - DNA, 21 bp, Homo sapiens
ctggagggctagaactggaga

SEQ ID NO: 3896416 - DNA, 20 bp, Homo sapiens
ctggagggctagaatctgga

SEQ ID NO: 3896417 - DNA, 20 bp, Homo sapiens
ctggagggctggaatctgga

SEQ ID NO: 3896418 - DNA, 22 bp, Homo sapiens
ctggaggtcacattcaggaaga

SEQ ID NO: 3896419 - DNA, 22 bp, Homo sapiens
ctggagtcccctgggcctggac

SEQ ID NO: 3896420 - DNA, 22 bp, Homo sapiens
ctggagtcccgtccctgcccag

SEQ ID NO: 3896421 - DNA, 15 bp, Homo sapiens
ctggagtctccagtg

SEQ ID NO: 3896422 - DNA, 16 bp, Homo sapiens
ctggagtgaggcttcc

SEQ ID NO: 3896423 - DNA, 19 bp, Homo sapiens
ctggagtgaggcttccagg

SEQ ID NO: 3896424 - DNA, 22 bp, Homo sapiens
ctggagtgaggcttccaggctc

SEQ ID NO: 3896425 - DNA, 24 bp, Homo sapiens
ctggagtgaggcttccaggctctt

SEQ ID NO: 3896426 - DNA, 14 bp, Homo sapiens
ctggagtgcagtgg

SEQ ID NO: 3896427 - DNA, 24 bp, Homo sapiens
ctggagtgcgctcttggtccctgg

SEQ ID NO: 3896428 - DNA, 14 bp, Homo sapiens
ctggatcagcgtgg

SEQ ID NO: 3896429 - DNA, 18 bp, Homo sapiens
ctggatcagcgtggcctt

SEQ ID NO: 3896430 - DNA, 19 bp, Homo sapiens
ctggatccatcaggccact

SEQ ID NO: 3896431 - DNA, 19 bp, Homo sapiens
ctggatcctgctgtggcct

SEQ ID NO: 3896432 - DNA, 23 bp, Homo sapiens
ctggatcctgctgtggcctcact

SEQ ID NO: 3896433 - DNA, 24 bp, Homo sapiens
ctggatcctgctgtggcctcactt

SEQ ID NO: 3896434 - DNA, 22 bp, Homo sapiens
ctggatcttcagaaggctagag

SEQ ID NO: 3896435 - DNA, 22 bp, Homo sapiens
ctggatctttcggactgaggcc

SEQ ID NO: 3896436 - DNA, 13 bp, Homo sapiens
ctggatgaaattt

SEQ ID NO: 3896437 - DNA, 13 bp, Homo sapiens
ctggatgaagatt

SEQ ID NO: 3896438 - DNA, 15 bp, Homo sapiens
ctggatggcaccaga

SEQ ID NO: 3896439 - DNA, 16 bp, Homo sapiens
ctggatggcaccagag

SEQ ID NO: 3896440 - DNA, 23 bp, Homo sapiens
ctggatggcaccagaggctgcag

SEQ ID NO: 3896441 - DNA, 17 bp, Homo sapiens
ctggatgggcattgggc

SEQ ID NO: 3896442 - DNA, 20 bp, Homo sapiens
ctggatgggcattgggctga

SEQ ID NO: 3896443 - DNA, 21 bp, Homo sapiens
ctggatgggcattgggctgac

SEQ ID NO: 3896444 - DNA, 21 bp, Homo sapiens
ctggatgtcccctgtcccacc

SEQ ID NO: 3896445 - DNA, 20 bp, Homo sapiens
ctggattggctataacatgt

SEQ ID NO: 3896446 - DNA, 22 bp, Homo sapiens
ctggcaacatagtgagatccca

SEQ ID NO: 3896447 - DNA, 16 bp, Homo sapiens
ctggcaagcagggaaa

SEQ ID NO: 3896448 - DNA, 17 bp, Homo sapiens
ctggcaagcagggaaag

SEQ ID NO: 3896449 - DNA, 22 bp, Homo sapiens
ctggcaagcagggaaagctcca

SEQ ID NO: 3896450 - DNA, 22 bp, Homo sapiens
ctggcaatgaaaaattctcagt

SEQ ID NO: 3896451 - DNA, 15 bp, Homo sapiens
ctggcacaggactga

SEQ ID NO: 3896452 - DNA, 23 bp, Homo sapiens
ctggcaccccggatcgaggacaa

SEQ ID NO: 3896453 - DNA, 12 bp, Homo sapiens
ctggcacctcag

SEQ ID NO: 3896454 - DNA, 12 bp, Homo sapiens
ctggcagccaca

SEQ ID NO: 3896455 - DNA, 15 bp, Homo sapiens
ctggcagccacactt

SEQ ID NO: 3896456 - DNA, 19 bp, Homo sapiens
ctggcagccgtgccttcag

SEQ ID NO: 3896457 - DNA, 20 bp, Homo sapiens
ctggcagccgtgccttcagc

SEQ ID NO: 3896458 - DNA, 22 bp, Homo sapiens
ctggcagccgtgccttcagctc

SEQ ID NO: 3896459 - DNA, 16 bp, Homo sapiens
ctggcagctcctctcc

SEQ ID NO: 3896460 - DNA, 20 bp, Homo sapiens
ctggcagctcctctccttgg

SEQ ID NO: 3896461 - DNA, 24 bp, Homo sapiens
ctggcagctcctctccttgggctc

SEQ ID NO: 3896462 - DNA, 15 bp, Homo sapiens
ctggcagctgagagc

SEQ ID NO: 3896463 - DNA, 17 bp, Homo sapiens
ctggcagggtgggatgg

SEQ ID NO: 3896464 - DNA, 14 bp, Homo sapiens
ctggcaggtgcaga

SEQ ID NO: 3896465 - DNA, 16 bp, Homo sapiens
ctggcaggtgcagatg

SEQ ID NO: 3896466 - DNA, 20 bp, Homo sapiens
ctggcaggtgcagatgggct

SEQ ID NO: 3896467 - DNA, 23 bp, Homo sapiens
ctggcaggtgcagatgggctgtt

SEQ ID NO: 3896468 - DNA, 21 bp, Homo sapiens
ctggcatgacactctagtgac

SEQ ID NO: 3896469 - DNA, 22 bp, Homo sapiens
ctggcatggtgctttcaggtct

SEQ ID NO: 3896470 - DNA, 14 bp, Homo sapiens
ctggcatgtcagag

SEQ ID NO: 3896471 - DNA, 17 bp, Homo sapiens
ctggcatgtcagagcca

SEQ ID NO: 3896472 - DNA, 16 bp, Homo sapiens
ctggcattacagctgg

SEQ ID NO: 3896473 - DNA, 18 bp, Homo sapiens
ctggcattggtctgctga

SEQ ID NO: 3896474 - DNA, 20 bp, Homo sapiens
ctggcattggtctgctgacc

SEQ ID NO: 3896475 - DNA, 16 bp, Homo sapiens
ctggccaagctgaggt

SEQ ID NO: 3896476 - DNA, 12 bp, Homo sapiens
ctggccaccctg

SEQ ID NO: 3896477 - DNA, 13 bp, Homo sapiens
ctggccagacgct

SEQ ID NO: 3896478 - DNA, 22 bp, Homo sapiens
ctggccagagagggcccagctg

SEQ ID NO: 3896479 - DNA, 21 bp, Homo sapiens
ctggccagcaccctctcctgg

SEQ ID NO: 3896480 - DNA, 13 bp, Homo sapiens
ctggccaggagct

SEQ ID NO: 3896481 - DNA, 16 bp, Homo sapiens
ctggccaggagctgga

SEQ ID NO: 3896482 - DNA, 15 bp, Homo sapiens
ctggccaggcatggc

SEQ ID NO: 3896483 - DNA, 18 bp, Homo sapiens
ctggccattttcttgcct

SEQ ID NO: 3896484 - DNA, 21 bp, Homo sapiens
ctggccattttcttgcctgag

SEQ ID NO: 3896485 - DNA, 17 bp, Homo sapiens
ctggcccagagctggaa

SEQ ID NO: 3896486 - DNA, 20 bp, Homo sapiens
ctggcccagccaactgcccc

SEQ ID NO: 3896487 - DNA, 22 bp, Homo sapiens
ctggcccagccaactgccccgg

SEQ ID NO: 3896488 - DNA, 17 bp, Homo sapiens
ctggcccagcctaccct

SEQ ID NO: 3896489 - DNA, 12 bp, Homo sapiens
ctggccccaccc

SEQ ID NO: 3896490 - DNA, 21 bp, Homo sapiens
ctggccccatgtctctcagaa

SEQ ID NO: 3896491 - DNA, 15 bp, Homo sapiens
ctggcccccctccag

SEQ ID NO: 3896492 - DNA, 17 bp, Homo sapiens
ctggcccccctccaggc

SEQ ID NO: 3896493 - DNA, 19 bp, Homo sapiens
ctggccccgggctctggcc

SEQ ID NO: 3896494 - DNA, 20 bp, Homo sapiens
ctggccccgggctctggcca

SEQ ID NO: 3896495 - DNA, 19 bp, Homo sapiens
ctggcccgcccctcgctgc

SEQ ID NO: 3896496 - DNA, 21 bp, Homo sapiens
ctggcccgcccctcgctgctg

SEQ ID NO: 3896497 - DNA, 22 bp, Homo sapiens
ctggcccgtcatgttcctcaaa

SEQ ID NO: 3896498 - DNA, 14 bp, Homo sapiens
ctggccctgccttc

SEQ ID NO: 3896499 - DNA, 16 bp, Homo sapiens
ctggcctcactggctg

SEQ ID NO: 3896500 - DNA, 21 bp, Homo sapiens
ctggcctcactggctggggca

SEQ ID NO: 3896501 - DNA, 13 bp, Homo sapiens
ctggcctcagcag

SEQ ID NO: 3896502 - DNA, 14 bp, Homo sapiens
ctggcctcctgcct

SEQ ID NO: 3896503 - DNA, 17 bp, Homo sapiens
ctggcctccttttgctg

SEQ ID NO: 3896504 - DNA, 15 bp, Homo sapiens
ctggcctctagaaca

SEQ ID NO: 3896505 - DNA, 20 bp, Homo sapiens
ctggcctctagaacacccac

SEQ ID NO: 3896506 - DNA, 22 bp, Homo sapiens
ctggcctctagaacacccactg

SEQ ID NO: 3896507 - DNA, 23 bp, Homo sapiens
ctggcctctagaacacccactgg

SEQ ID NO: 3896508 - DNA, 12 bp, Homo sapiens
ctggcctgagct

SEQ ID NO: 3896509 - DNA, 19 bp, Homo sapiens
ctggcctgagctggggcca

SEQ ID NO: 3896510 - DNA, 14 bp, Homo sapiens
ctggcctggatctc

SEQ ID NO: 3896511 - DNA, 19 bp, Homo sapiens
ctggcctggctccccacga

SEQ ID NO: 3896512 - DNA, 19 bp, Homo sapiens
ctggccttgtcaggaccca

SEQ ID NO: 3896513 - DNA, 16 bp, Homo sapiens
ctggcgactgcagctg

SEQ ID NO: 3896514 - DNA, 15 bp, Homo sapiens
ctggcggcgcagagg

SEQ ID NO: 3896515 - DNA, 14 bp, Homo sapiens
ctggcggcttcctg

SEQ ID NO: 3896516 - DNA, 15 bp, Homo sapiens
ctggcggcttcctgt

SEQ ID NO: 3896517 - DNA, 21 bp, Homo sapiens
ctggcggggcaggaggcctgg

SEQ ID NO: 3896518 - DNA, 13 bp, Homo sapiens
ctggctcacccct

SEQ ID NO: 3896519 - DNA, 14 bp, Homo sapiens
ctggctcacccctc

SEQ ID NO: 3896520 - DNA, 22 bp, Homo sapiens
ctggctcacccctctcccccgc

SEQ ID NO: 3896521 - DNA, 19 bp, Homo sapiens
ctggctcccacaggccctt

SEQ ID NO: 3896522 - DNA, 22 bp, Homo sapiens
ctggctcccacaggcccttcct

SEQ ID NO: 3896523 - DNA, 20 bp, Homo sapiens
ctggctcctccttcccctgt

SEQ ID NO: 3896524 - DNA, 15 bp, Homo sapiens
ctggctctccacctt

SEQ ID NO: 3896525 - DNA, 23 bp, Homo sapiens
ctggctgaccccaaagagcctgg

SEQ ID NO: 3896526 - DNA, 13 bp, Homo sapiens
ctggctgagctga

SEQ ID NO: 3896527 - DNA, 12 bp, Homo sapiens
ctggctgagggc

SEQ ID NO: 3896528 - DNA, 23 bp, Homo sapiens
ctggctgagggcagttcgcagcc

SEQ ID NO: 3896529 - DNA, 21 bp, Homo sapiens
ctggctgagtggaatgcaggg

SEQ ID NO: 3896530 - DNA, 22 bp, Homo sapiens
ctggctgagtggaatgcaggga

SEQ ID NO: 3896531 - DNA, 19 bp, Homo sapiens
ctgggcctgcttttccagg

SEQ ID NO: 3896532 - DNA, 20 bp, Homo sapiens
ctgggcctgcttttccagga

SEQ ID NO: 3896533 - DNA, 23 bp, Homo sapiens
ctgggcctgcttttccaggatcc

SEQ ID NO: 3896534 - DNA, 15 bp, Homo sapiens
ctgggcctgtgcagc

SEQ ID NO: 3896535 - DNA, 16 bp, Homo sapiens
ctgggcctttcctgtg

SEQ ID NO: 3896536 - DNA, 22 bp, Homo sapiens
ctgggcctttcctgtgccaacc

SEQ ID NO: 3896537 - DNA, 21 bp, Homo sapiens
ctgggcgacagagcgagactc

SEQ ID NO: 3896538 - DNA, 13 bp, Homo sapiens
ctgggctagggag

SEQ ID NO: 3896539 - DNA, 15 bp, Homo sapiens
ctgggctagggagaa

SEQ ID NO: 3896540 - DNA, 15 bp, Homo sapiens
ctgggctcagggctg

SEQ ID NO: 3896541 - DNA, 17 bp, Homo sapiens
ctgggctcctggaacca

SEQ ID NO: 3896542 - DNA, 14 bp, Homo sapiens
ctgggctctccacc

SEQ ID NO: 3896543 - DNA, 15 bp, Homo sapiens
ctgggctctccacct

SEQ ID NO: 3896544 - DNA, 18 bp, Homo sapiens
ctgggctctccacctcag

SEQ ID NO: 3896545 - DNA, 13 bp, Homo sapiens
ctgggctgtctgt

SEQ ID NO: 3896546 - DNA, 18 bp, Homo sapiens
ctgggctgtctgtcacca

SEQ ID NO: 3896547 - DNA, 20 bp, Homo sapiens
ctgggctgtctgtcaccagc

SEQ ID NO: 3896548 - DNA, 13 bp, Homo sapiens
ctggggaacagag

SEQ ID NO: 3896549 - DNA, 23 bp, Homo sapiens
ctggggaacagagcgggcctctt

SEQ ID NO: 3896550 - DNA, 13 bp, Homo sapiens
ctggggaggaagg

SEQ ID NO: 3896551 - DNA, 16 bp, Homo sapiens
ctggggatgtgggagg

SEQ ID NO: 3896552 - DNA, 21 bp, Homo sapiens
ctggggcagaggggcagccgc

SEQ ID NO: 3896553 - DNA, 22 bp, Homo sapiens
ctggggcagaggggcagccgct

SEQ ID NO: 3896554 - DNA, 18 bp, Homo sapiens
ctggggcatgtgtgcctg

SEQ ID NO: 3896555 - DNA, 20 bp, Homo sapiens
ctggggcatgtgtgcctgtg

SEQ ID NO: 3896556 - DNA, 23 bp, Homo sapiens
ctggggcatgtgtgcctgtggca

SEQ ID NO: 3896557 - DNA, 21 bp, Homo sapiens
ctggggccacaaatcaaagca

SEQ ID NO: 3896558 - DNA, 18 bp, Homo sapiens
ctggggccccgctgggat

SEQ ID NO: 3896559 - DNA, 14 bp, Homo sapiens
ctggggccctgggc

SEQ ID NO: 3896560 - DNA, 15 bp, Homo sapiens
ctggggccctgggcc

SEQ ID NO: 3896561 - DNA, 21 bp, Homo sapiens
ctggggcctggagaggggcct

SEQ ID NO: 3896562 - DNA, 17 bp, Homo sapiens
ctggggcctgtactgcc

SEQ ID NO: 3896563 - DNA, 18 bp, Homo sapiens
ctggggcctgtactgcct

SEQ ID NO: 3896564 - DNA, 21 bp, Homo sapiens
ctggggcctgtactgcctgct

SEQ ID NO: 3896565 - DNA, 16 bp, Homo sapiens
ctggggcttctcctga

SEQ ID NO: 3896566 - DNA, 19 bp, Homo sapiens
ctggggcttctcctgaccc

SEQ ID NO: 3896567 - DNA, 13 bp, Homo sapiens
ctgggggaagggt

SEQ ID NO: 3896568 - DNA, 20 bp, Homo sapiens
ctgggggcagtgactggcag

SEQ ID NO: 3896569 - DNA, 21 bp, Homo sapiens
ctgggggcagtgactggcagg

SEQ ID NO: 3896570 - DNA, 19 bp, Homo sapiens
ctgggggccagctggtgct

SEQ ID NO: 3896571 - DNA, 23 bp, Homo sapiens
ctgggggccagctggtgctgcaa

SEQ ID NO: 3896572 - DNA, 12 bp, Homo sapiens
ctgggggcctgg

SEQ ID NO: 3896573 - DNA, 13 bp, Homo sapiens
ctgggggcctggc

SEQ ID NO: 3896574 - DNA, 14 bp, Homo sapiens
ctgggggtggcagg

SEQ ID NO: 3896575 - DNA, 16 bp, Homo sapiens
ctgggggtggcaggca

SEQ ID NO: 3896576 - DNA, 13 bp, Homo sapiens
ctgggtaactgtc

SEQ ID NO: 3896577 - DNA, 20 bp, Homo sapiens
ctgggtaggtgttgaaaatg

SEQ ID NO: 3896578 - DNA, 23 bp, Homo sapiens
ctgggtccaattgtggcacttgg

SEQ ID NO: 3896579 - DNA, 14 bp, Homo sapiens
ctgggtccctcgga

SEQ ID NO: 3896580 - DNA, 22 bp, Homo sapiens
ctgggtccctcggagctgccag

SEQ ID NO: 3896581 - DNA, 15 bp, Homo sapiens
ctgggtctcactcct

SEQ ID NO: 3896582 - DNA, 19 bp, Homo sapiens
ctgggtgagaatcctgcct

SEQ ID NO: 3896583 - DNA, 21 bp, Homo sapiens
ctgggtgccgggctgcacaga

SEQ ID NO: 3896584 - DNA, 15 bp, Homo sapiens
ctgggtggctactct

SEQ ID NO: 3896585 - DNA, 13 bp, Homo sapiens
ctccagatctgca

SEQ ID NO: 3896586 - DNA, 19 bp, Homo sapiens
ctccagatctgcactgggt

SEQ ID NO: 3896587 - DNA, 21 bp, Homo sapiens
ctccagatctgcactgggtgt

SEQ ID NO: 3896588 - DNA, 17 bp, Homo sapiens
ctccagcatccagcctg

SEQ ID NO: 3896589 - DNA, 19 bp, Homo sapiens
ctccagcatccagcctgtg

SEQ ID NO: 3896590 - DNA, 21 bp, Homo sapiens
ctccagcatccagcctgtgtg

SEQ ID NO: 3896591 - DNA, 13 bp, Homo sapiens
ctccagcatcctg

SEQ ID NO: 3896592 - DNA, 13 bp, Homo sapiens
ctccagccagcaa

SEQ ID NO: 3896593 - DNA, 14 bp, Homo sapiens
ctccagcccacacc

SEQ ID NO: 3896594 - DNA, 19 bp, Homo sapiens
ctccagcccacacccctcc

SEQ ID NO: 3896595 - DNA, 23 bp, Homo sapiens
ctccagcccacacccctccaaag

SEQ ID NO: 3896596 - DNA, 15 bp, Homo sapiens
ctccagcctctcccg

SEQ ID NO: 3896597 - DNA, 18 bp, Homo sapiens
ctccagcctctcccggct

SEQ ID NO: 3896598 - DNA, 20 bp, Homo sapiens
ctccaggaatgcctcctccc

SEQ ID NO: 3896599 - DNA, 16 bp, Homo sapiens
ctccaggcaccatctc

SEQ ID NO: 3896600 - DNA, 16 bp, Homo sapiens
ctccaggcacccttct

SEQ ID NO: 3896601 - DNA, 21 bp, Homo sapiens
ctccaggcacccttctttcct

SEQ ID NO: 3896602 - DNA, 15 bp, Homo sapiens
ctccaggcatgctgg

SEQ ID NO: 3896603 - DNA, 14 bp, Homo sapiens
ctccagggcagcct

SEQ ID NO: 3896604 - DNA, 18 bp, Homo sapiens
ctccagggccacgtgcca

SEQ ID NO: 3896605 - DNA, 14 bp, Homo sapiens
ctccagggctgccc

SEQ ID NO: 3896606 - DNA, 20 bp, Homo sapiens
ctccaggtccggaggggttg

SEQ ID NO: 3896607 - DNA, 15 bp, Homo sapiens
ctccagtctcctgac

SEQ ID NO: 3896608 - DNA, 17 bp, Homo sapiens
ctccagtgagctggaat

SEQ ID NO: 3896609 - DNA, 23 bp, Homo sapiens
ctccagtgtgaatatatggtctg

SEQ ID NO: 3896610 - DNA, 14 bp, Homo sapiens
ctccagtgtgcgtt

SEQ ID NO: 3896611 - DNA, 14 bp, Homo sapiens
ctccataatgccac

SEQ ID NO: 3896612 - DNA, 16 bp, Homo sapiens
ctccatatctccttcc

SEQ ID NO: 3896613 - DNA, 15 bp, Homo sapiens
ctccatgcccaacct

SEQ ID NO: 3896614 - DNA, 16 bp, Homo sapiens
ctccatgcccaaccta

SEQ ID NO: 3896615 - DNA, 13 bp, Homo sapiens
ctccatgctgcct

SEQ ID NO: 3896616 - DNA, 15 bp, Homo sapiens
ctccatgctgcctcc

SEQ ID NO: 3896617 - DNA, 16 bp, Homo sapiens
ctccatgctgcctcca

SEQ ID NO: 3896618 - DNA, 17 bp, Homo sapiens
ctccatgctgcctccag

SEQ ID NO: 3896619 - DNA, 10 bp, Homo sapiens
ctccatggag

SEQ ID NO: 3896620 - DNA, 13 bp, Homo sapiens
ctccatggaggag

SEQ ID NO: 3896621 - DNA, 22 bp, Homo sapiens
ctccatggaggaggtgtcccaa

SEQ ID NO: 3896622 - DNA, 23 bp, Homo sapiens
ctccatggaggaggtgtcccaag

SEQ ID NO: 3896623 - DNA, 12 bp, Homo sapiens
ctccatggccac

SEQ ID NO: 3896624 - DNA, 17 bp, Homo sapiens
ctgccctgctctgggga

SEQ ID NO: 3896625 - DNA, 22 bp, Homo sapiens
ctgccctgctgccgcctcccag

SEQ ID NO: 3896626 - DNA, 12 bp, Homo sapiens
ctgccctggagg

SEQ ID NO: 3896627 - DNA, 19 bp, Homo sapiens
ctgccctggtgctgccaca

SEQ ID NO: 3896628 - DNA, 18 bp, Homo sapiens
ctgcccttcgctgccagg

SEQ ID NO: 3896629 - DNA, 22 bp, Homo sapiens
ctgcccttcgctgccaggacac

SEQ ID NO: 3896630 - DNA, 23 bp, Homo sapiens
ctgcccttcgctgccaggacacc

SEQ ID NO: 3896631 - DNA, 20 bp, Homo sapiens
ctgcccttgtttggggcagg

SEQ ID NO: 3896632 - DNA, 22 bp, Homo sapiens
ctgcccttgtttggggcaggag

SEQ ID NO: 3896633 - DNA, 16 bp, Homo sapiens
ctgccgaccagagccc

SEQ ID NO: 3896634 - DNA, 15 bp, Homo sapiens
ctgccgacctcgtcc

SEQ ID NO: 3896635 - DNA, 14 bp, Homo sapiens
ctgccgcaccccag

SEQ ID NO: 3896636 - DNA, 19 bp, Homo sapiens
ctgccgcctcccagcctgg

SEQ ID NO: 3896637 - DNA, 14 bp, Homo sapiens
ctgccgggttctag

SEQ ID NO: 3896638 - DNA, 15 bp, Homo sapiens
ctgcctaaggaggag

SEQ ID NO: 3896639 - DNA, 16 bp, Homo sapiens
ctgcctaagtggctgc

SEQ ID NO: 3896640 - DNA, 18 bp, Homo sapiens
ctgcctagaaaatgcaaa

SEQ ID NO: 3896641 - DNA, 19 bp, Homo sapiens
ctgcctaggaattcccagc

SEQ ID NO: 3896642 - DNA, 15 bp, Homo sapiens
ctgcctatccatcct

SEQ ID NO: 3896643 - DNA, 16 bp, Homo sapiens
ctgcctatccatcctg

SEQ ID NO: 3896644 - DNA, 16 bp, Homo sapiens
ctgcctcagcctctca

SEQ ID NO: 3896645 - DNA, 22 bp, Homo sapiens
ctgcctccagaatggtctttct

SEQ ID NO: 3896646 - DNA, 17 bp, Homo sapiens
ctgcctcccagccctgc

SEQ ID NO: 3896647 - DNA, 20 bp, Homo sapiens
ctgcctcccagccctgccag

SEQ ID NO: 3896648 - DNA, 16 bp, Homo sapiens
ctgcctcccattctga

SEQ ID NO: 3896649 - DNA, 23 bp, Homo sapiens
ctgcctccctctccatatctcct

SEQ ID NO: 3896650 - DNA, 15 bp, Homo sapiens
ctgcctccctttctg

SEQ ID NO: 3896651 - DNA, 19 bp, Homo sapiens
ctgcctctactgggaaggc

SEQ ID NO: 3896652 - DNA, 13 bp, Homo sapiens
ctgcctctcacac

SEQ ID NO: 3896653 - DNA, 17 bp, Homo sapiens
ctgcctctctgctccag

SEQ ID NO: 3896654 - DNA, 20 bp, Homo sapiens
ctgcctctgccatgcccaga

SEQ ID NO: 3896655 - DNA, 12 bp, Homo sapiens
ctgcctcttcct

SEQ ID NO: 3896656 - DNA, 13 bp, Homo sapiens
ctgcctgagccca

SEQ ID NO: 3896657 - DNA, 14 bp, Homo sapiens
ctgcctgagcccag

SEQ ID NO: 3896658 - DNA, 13 bp, Homo sapiens
ctgcctgcagcct

SEQ ID NO: 3896659 - DNA, 16 bp, Homo sapiens
ctgcctgcagcctccc

SEQ ID NO: 3896660 - DNA, 20 bp, Homo sapiens
ctgcctgcagtactttacct

SEQ ID NO: 3896661 - DNA, 12 bp, Homo sapiens
ctgcctgcttgg

SEQ ID NO: 3896662 - DNA, 18 bp, Homo sapiens
ctgcctggaggacctgag

SEQ ID NO: 3896663 - DNA, 19 bp, Homo sapiens
ctgcctggaggacctgagc

SEQ ID NO: 3896664 - DNA, 12 bp, Homo sapiens
ctgcctggcctg

SEQ ID NO: 3896665 - DNA, 13 bp, Homo sapiens
ctgcctggcctgg

SEQ ID NO: 3896666 - DNA, 11 bp, Homo sapiens
ctgcctgggcc

SEQ ID NO: 3896667 - DNA, 18 bp, Homo sapiens
ctgcctgggcctgtgcag

SEQ ID NO: 3896668 - DNA, 13 bp, Homo sapiens
ctgcctgtagtta

SEQ ID NO: 3896669 - DNA, 18 bp, Homo sapiens
ctgcctgtagttaggaaa

SEQ ID NO: 3896670 - DNA, 21 bp, Homo sapiens
ctgcctgtgcacggccagctg

SEQ ID NO: 3896671 - DNA, 13 bp, Homo sapiens
ctgcctgtgcatg

SEQ ID NO: 3896672 - DNA, 19 bp, Homo sapiens
ctgcctgtgcatgacctga

SEQ ID NO: 3896673 - DNA, 13 bp, Homo sapiens
ctgcctgtggcct

SEQ ID NO: 3896674 - DNA, 15 bp, Homo sapiens
ctgcctgttcccatt

SEQ ID NO: 3896675 - DNA, 23 bp, Homo sapiens
ccttggataatgctgttgcctca

SEQ ID NO: 3896676 - DNA, 19 bp, Homo sapiens
ccttggccgtgaggacacg

SEQ ID NO: 3896677 - DNA, 18 bp, Homo sapiens
ccttgggcatccacccag

SEQ ID NO: 3896678 - DNA, 13 bp, Homo sapiens
ccttgggctcctg

SEQ ID NO: 3896679 - DNA, 15 bp, Homo sapiens
ccttgggctcctggc

SEQ ID NO: 3896680 - DNA, 22 bp, Homo sapiens
ccttgggctcctggctgccagg

SEQ ID NO: 3896681 - DNA, 11 bp, Homo sapiens
ccttggggcac

SEQ ID NO: 3896682 - DNA, 14 bp, Homo sapiens
ccttggggcctggc

SEQ ID NO: 3896683 - DNA, 15 bp, Homo sapiens
ccttggggcctggct

SEQ ID NO: 3896684 - DNA, 23 bp, Homo sapiens
ccttggggtaagccagagcctgg

SEQ ID NO: 3896685 - DNA, 20 bp, Homo sapiens
ccttggggttcccccagaca

SEQ ID NO: 3896686 - DNA, 22 bp, Homo sapiens
ccttggggttcccccagacaga

SEQ ID NO: 3896687 - DNA, 15 bp, Homo sapiens
ccttgtaccccatcc

SEQ ID NO: 3896688 - DNA, 21 bp, Homo sapiens
ccttgtaccccatcccttcct

SEQ ID NO: 3896689 - DNA, 16 bp, Homo sapiens
ccttgtcactggtaga

SEQ ID NO: 3896690 - DNA, 21 bp, Homo sapiens
ccttgtcaggacccaggccgc

SEQ ID NO: 3896691 - DNA, 18 bp, Homo sapiens
ccttgtcctgccagctgc

SEQ ID NO: 3896692 - DNA, 20 bp, Homo sapiens
ccttgtcctgccagctgcct

SEQ ID NO: 3896693 - DNA, 12 bp, Homo sapiens
ccttgtctctca

SEQ ID NO: 3896694 - DNA, 17 bp, Homo sapiens
ccttgtgccctgccccc

SEQ ID NO: 3896695 - DNA, 12 bp, Homo sapiens
ccttgtgcttgg

SEQ ID NO: 3896696 - DNA, 14 bp, Homo sapiens
ccttgtgtttctgt

SEQ ID NO: 3896697 - DNA, 22 bp, Homo sapiens
ccttgtttcaatctttgctgta

SEQ ID NO: 3896698 - DNA, 16 bp, Homo sapiens
ccttgtttggggcagg

SEQ ID NO: 3896699 - DNA, 18 bp, Homo sapiens
cctttaaagtaaaggcct

SEQ ID NO: 3896700 - DNA, 15 bp, Homo sapiens
cctttacttgacctc

SEQ ID NO: 3896701 - DNA, 19 bp, Homo sapiens
cctttaggcagcctgccgc

SEQ ID NO: 3896702 - DNA, 19 bp, Homo sapiens
cctttatatttagtgaact

SEQ ID NO: 3896703 - DNA, 21 bp, Homo sapiens
cctttatgagtcagtctctct

SEQ ID NO: 3896704 - DNA, 14 bp, Homo sapiens
cctttattgcagtt

SEQ ID NO: 3896705 - DNA, 15 bp, Homo sapiens
cctttcaaggaaagt

SEQ ID NO: 3896706 - DNA, 17 bp, Homo sapiens
cctttcaaggaaagtga

SEQ ID NO: 3896707 - DNA, 21 bp, Homo sapiens
cctttcccatgatccagaact

SEQ ID NO: 3896708 - DNA, 14 bp, Homo sapiens
cctttccgctgtcg

SEQ ID NO: 3896709 - DNA, 13 bp, Homo sapiens
cctttccttcctt

SEQ ID NO: 3896710 - DNA, 20 bp, Homo sapiens
cctttctccagccagcaatg

SEQ ID NO: 3896711 - DNA, 20 bp, Homo sapiens
cctttctctatcccaagcca

SEQ ID NO: 3896712 - DNA, 13 bp, Homo sapiens
cgagtcacctgca

SEQ ID NO: 3896713 - DNA, 15 bp, Homo sapiens
cgagtcacctgcaag

SEQ ID NO: 3896714 - DNA, 16 bp, Homo sapiens
cgagtcacctgcaagc

SEQ ID NO: 3896715 - DNA, 20 bp, Homo sapiens
cgatacaccgggcctggaga

SEQ ID NO: 3896716 - DNA, 16 bp, Homo sapiens
cgatcaagtccagagc

SEQ ID NO: 3896717 - DNA, 17 bp, Homo sapiens
cgatcaagtccagagcc

SEQ ID NO: 3896718 - DNA, 21 bp, Homo sapiens
cgatcctggattcactcactc

SEQ ID NO: 3896719 - DNA, 15 bp, Homo sapiens
cgatctgtactgtaa

SEQ ID NO: 3896720 - DNA, 16 bp, Homo sapiens
cgatctgtactgtaat

SEQ ID NO: 3896721 - DNA, 19 bp, Homo sapiens
cgatgtacacacacagatg

SEQ ID NO: 3896722 - DNA, 13 bp, Homo sapiens
cgatgtggccctg

SEQ ID NO: 3896723 - DNA, 15 bp, Homo sapiens
cgatgtggccctggc

SEQ ID NO: 3896724 - DNA, 16 bp, Homo sapiens
cgatgtggccctggcc

SEQ ID NO: 3896725 - DNA, 13 bp, Homo sapiens
cgattaatttatg

SEQ ID NO: 3896726 - DNA, 18 bp, Homo sapiens
cgattaatttatggtttc

SEQ ID NO: 3896727 - DNA, 18 bp, Homo sapiens
cgattccctctcccaggc

SEQ ID NO: 3896728 - DNA, 19 bp, Homo sapiens
cgattccctctcccaggcc

SEQ ID NO: 3896729 - DNA, 21 bp, Homo sapiens
cgattccctctcccaggcccc

SEQ ID NO: 3896730 - DNA, 23 bp, Homo sapiens
cgattccctctcccaggccccat

SEQ ID NO: 3896731 - DNA, 17 bp, Homo sapiens
cgattcttgtgcctcag

SEQ ID NO: 3896732 - DNA, 18 bp, Homo sapiens
cgattcttgtgcctcagc

SEQ ID NO: 3896733 - DNA, 13 bp, Homo sapiens
cgattggctttaa

SEQ ID NO: 3896734 - DNA, 15 bp, Homo sapiens
cgattggctttaaac

SEQ ID NO: 3896735 - DNA, 21 bp, Homo sapiens
cgatttccctggttttagtct

SEQ ID NO: 3896736 - DNA, 14 bp, Homo sapiens
cgatttgtcccagg

SEQ ID NO: 3896737 - DNA, 18 bp, Homo sapiens
cgcaacaacaaggaccct

SEQ ID NO: 3896738 - DNA, 22 bp, Homo sapiens
cgcaacccgtgccaagtccagg

SEQ ID NO: 3896739 - DNA, 16 bp, Homo sapiens
cgcaacccttgctgct

SEQ ID NO: 3896740 - DNA, 18 bp, Homo sapiens
cgcaagggcatcaggcac

SEQ ID NO: 3896741 - DNA, 15 bp, Homo sapiens
cgcaagttcagggaa

SEQ ID NO: 3896742 - DNA, 19 bp, Homo sapiens
cgcacacatggacacagac

SEQ ID NO: 3896743 - DNA, 19 bp, Homo sapiens
cgcacatgccaatgcacgc

SEQ ID NO: 3896744 - DNA, 13 bp, Homo sapiens
cgcaccagctgct

SEQ ID NO: 3896745 - DNA, 14 bp, Homo sapiens
cgcaccccagagtg

SEQ ID NO: 3896746 - DNA, 17 bp, Homo sapiens
cgcaccgggccctcctt

SEQ ID NO: 3896747 - DNA, 16 bp, Homo sapiens
cgcacgcaacccttgc

SEQ ID NO: 3896748 - DNA, 18 bp, Homo sapiens
cgcagaggcggaaacctt

SEQ ID NO: 3896749 - DNA, 20 bp, Homo sapiens
cgcagcagctgggacccctc

SEQ ID NO: 3896750 - DNA, 16 bp, Homo sapiens
cgcagccaccctgagg

SEQ ID NO: 3896751 - DNA, 22 bp, Homo sapiens
cgcagccaccctgaggagtctg

SEQ ID NO: 3896752 - DNA, 21 bp, Homo sapiens
cgcagcccgtgaagcagtgcc

SEQ ID NO: 3896753 - DNA, 13 bp, Homo sapiens
cgcagccctgctt

SEQ ID NO: 3896754 - DNA, 18 bp, Homo sapiens
cgcagccctgggggccag

SEQ ID NO: 3896755 - DNA, 21 bp, Homo sapiens
cgcagccctgggggccagctg

SEQ ID NO: 3896756 - DNA, 19 bp, Homo sapiens
cgcagcctggcggggcagg

SEQ ID NO: 3896757 - DNA, 24 bp, Homo sapiens
cgcagcctggcggggcaggaggcc

SEQ ID NO: 3896758 - DNA, 15 bp, Homo sapiens
cgcaggaactcccag

SEQ ID NO: 3896759 - DNA, 18 bp, Homo sapiens
cgcaggaactcccagcaa

SEQ ID NO: 3896760 - DNA, 20 bp, Homo sapiens
cgcaggatccgctgccacca

SEQ ID NO: 3896761 - DNA, 20 bp, Homo sapiens
cgcagggaggatgccacagc

SEQ ID NO: 3896762 - DNA, 19 bp, Homo sapiens
cgcaggtctcagcccggga

SEQ ID NO: 3896763 - DNA, 17 bp, Homo sapiens
cgcagtccccagccctt

SEQ ID NO: 3896764 - DNA, 21 bp, Homo sapiens
cgcagtccccagcccttctgc

SEQ ID NO: 3896765 - DNA, 16 bp, Homo sapiens
cgcatcttctccatct

SEQ ID NO: 3896766 - DNA, 12 bp, Homo sapiens
cgcattccctga

SEQ ID NO: 3896767 - DNA, 15 bp, Homo sapiens
cgccaaacactccac

SEQ ID NO: 3896768 - DNA, 20 bp, Homo sapiens
cgccaaagtgcagcccttcc

SEQ ID NO: 3896769 - DNA, 14 bp, Homo sapiens
cgccaacgcacgca

SEQ ID NO: 3896770 - DNA, 23 bp, Homo sapiens
cgccaccatcctgcagcctcctc

SEQ ID NO: 3896771 - DNA, 20 bp, Homo sapiens
cgccaggaggtcctcctctc

SEQ ID NO: 3896772 - DNA, 13 bp, Homo sapiens
cgccatcagccca

SEQ ID NO: 3896773 - DNA, 21 bp, Homo sapiens
cgccatccgggacgcttccag

SEQ ID NO: 3896774 - DNA, 16 bp, Homo sapiens
cgcccaaggggacttg

SEQ ID NO: 3896775 - DNA, 18 bp, Homo sapiens
cgcccagctgaggctggg

SEQ ID NO: 3896776 - DNA, 22 bp, Homo sapiens
cgcccattcgtctgtcccagag

SEQ ID NO: 3896777 - DNA, 21 bp, Homo sapiens
cgccccagatcaccagcccgg

SEQ ID NO: 3896778 - DNA, 20 bp, Homo sapiens
cgcccccacaccccatctct

SEQ ID NO: 3896779 - DNA, 18 bp, Homo sapiens
cgcccctcgctgctgcta

SEQ ID NO: 3896780 - DNA, 16 bp, Homo sapiens
cgccctaccctcactc

SEQ ID NO: 3896781 - DNA, 16 bp, Homo sapiens
cgccctgcagaccctg

SEQ ID NO: 3896782 - DNA, 21 bp, Homo sapiens
cgccctggagtcccctgggcc

SEQ ID NO: 3896783 - DNA, 15 bp, Homo sapiens
cgccctgggctgtct

SEQ ID NO: 3896784 - DNA, 14 bp, Homo sapiens
cgccgggcaggcct

SEQ ID NO: 3896785 - DNA, 16 bp, Homo sapiens
cgccgggcaggcctgc

SEQ ID NO: 3896786 - DNA, 13 bp, Homo sapiens
cgcctaggcctgt

SEQ ID NO: 3896787 - DNA, 17 bp, Homo sapiens
cgcctcaatgtggttgc

SEQ ID NO: 3896788 - DNA, 21 bp, Homo sapiens
cgcctccatttttgttgttat

SEQ ID NO: 3896789 - DNA, 12 bp, Homo sapiens
cgcctcccagcc

SEQ ID NO: 3896790 - DNA, 10 bp, Homo sapiens
cgcctccccg

SEQ ID NO: 3896791 - DNA, 16 bp, Homo sapiens
cgcctctgcccgcaga

SEQ ID NO: 3896792 - DNA, 16 bp, Homo sapiens
cgcctcttttccctct

SEQ ID NO: 3896793 - DNA, 11 bp, Homo sapiens
cgcctgagccc

SEQ ID NO: 3896794 - DNA, 15 bp, Homo sapiens
cgcctgagcccaggg

SEQ ID NO: 3896795 - DNA, 21 bp, Homo sapiens
cgcctgagcccagggaggccg

SEQ ID NO: 3896796 - DNA, 14 bp, Homo sapiens
cgcctgcagaggac

SEQ ID NO: 3896797 - DNA, 19 bp, Homo sapiens
cgcctgccataccgctggg

SEQ ID NO: 3896798 - DNA, 15 bp, Homo sapiens
cgcctgccctccctg

SEQ ID NO: 3896799 - DNA, 18 bp, Homo sapiens
cgcctgccctccctgggg

SEQ ID NO: 3896800 - DNA, 17 bp, Homo sapiens
cgcctgcttgtccctgc

SEQ ID NO: 3896801 - DNA, 17 bp, Homo sapiens
cgcctgggcccaggctc

SEQ ID NO: 3896802 - DNA, 18 bp, Homo sapiens
cgcctgggcccaggctct

SEQ ID NO: 3896803 - DNA, 16 bp, Homo sapiens
cgcctgtaatcccagc

SEQ ID NO: 3896804 - DNA, 18 bp, Homo sapiens
cgcctgtaatcccagcac

SEQ ID NO: 3896805 - DNA, 16 bp, Homo sapiens
cgcctgtcctgcctct

SEQ ID NO: 3896806 - DNA, 15 bp, Homo sapiens
cgccttcctcctcca

SEQ ID NO: 3896807 - DNA, 16 bp, Homo sapiens
cgccttcctcctccac

SEQ ID NO: 3896808 - DNA, 18 bp, Homo sapiens
cgcgagactgagaggcag

SEQ ID NO: 3896809 - DNA, 11 bp, Homo sapiens
cgcgcacacac

SEQ ID NO: 3896810 - DNA, 16 bp, Homo sapiens
cgcggcttggccgcca

SEQ ID NO: 3896811 - DNA, 18 bp, Homo sapiens
cgcggcttggccgccatc

SEQ ID NO: 3896812 - DNA, 13 bp, Homo sapiens
cgcggtgctctgg

SEQ ID NO: 3896813 - DNA, 16 bp, Homo sapiens
cgcggtgctctggcgg

SEQ ID NO: 3896814 - DNA, 18 bp, Homo sapiens
cgcggtgctctggcggct

SEQ ID NO: 3896815 - DNA, 19 bp, Homo sapiens
cgcggtggctcacacctgt

SEQ ID NO: 3896816 - DNA, 20 bp, Homo sapiens
cgcggtggctcttgcctgta

SEQ ID NO: 3896817 - DNA, 13 bp, Homo sapiens
cgcgtagagagcc

SEQ ID NO: 3896818 - DNA, 15 bp, Homo sapiens
cgcgtctaccctggg

SEQ ID NO: 3896819 - DNA, 17 bp, Homo sapiens
cgcgtctaccctgggat

SEQ ID NO: 3896820 - DNA, 14 bp, Homo sapiens
cgcgtctgccccac

SEQ ID NO: 3896821 - DNA, 17 bp, Homo sapiens
cgctacaccactctggc

SEQ ID NO: 3896822 - DNA, 20 bp, Homo sapiens
cgctacaccactctggcagc

SEQ ID NO: 3896823 - DNA, 15 bp, Homo sapiens
cgctaggagagactg

SEQ ID NO: 3896824 - DNA, 14 bp, Homo sapiens
cgctatcttcacat

SEQ ID NO: 3896825 - DNA, 22 bp, Homo sapiens
cgctcagcaatagggtgcagtt

SEQ ID NO: 3896826 - DNA, 12 bp, Homo sapiens
cgctcagccctc

SEQ ID NO: 3896827 - DNA, 16 bp, Homo sapiens
cgctcagccctccctg

SEQ ID NO: 3896828 - DNA, 21 bp, Homo sapiens
cgctcagccctccctgcccct

SEQ ID NO: 3896829 - DNA, 11 bp, Homo sapiens
cgctcatctgg

SEQ ID NO: 3896830 - DNA, 19 bp, Homo sapiens
cgctcattttaggcctcct

SEQ ID NO: 3896831 - DNA, 18 bp, Homo sapiens
cgctcccccgcagtcccc

SEQ ID NO: 3896832 - DNA, 19 bp, Homo sapiens
cgctcccccgcagtcccca

SEQ ID NO: 3896833 - DNA, 13 bp, Homo sapiens
cgctcctttacct

SEQ ID NO: 3896834 - DNA, 17 bp, Homo sapiens
cgctctgctggcctggc

SEQ ID NO: 3896835 - DNA, 14 bp, Homo sapiens
cgctcttggtccct

SEQ ID NO: 3896836 - DNA, 17 bp, Homo sapiens
cgctgccaccacgtctg

SEQ ID NO: 3896837 - DNA, 21 bp, Homo sapiens
cgctgccaccacgtctgccag

SEQ ID NO: 3896838 - DNA, 12 bp, Homo sapiens
cgctgccaggac

SEQ ID NO: 3896839 - DNA, 14 bp, Homo sapiens
cgctgccaggacac

SEQ ID NO: 3896840 - DNA, 15 bp, Homo sapiens
cgctgccaggacacc

SEQ ID NO: 3896841 - DNA, 17 bp, Homo sapiens
cgctgccaggacacctg

SEQ ID NO: 3896842 - DNA, 22 bp, Homo sapiens
cgctgccaggacacctgcccca

SEQ ID NO: 3896843 - DNA, 15 bp, Homo sapiens
cgctgccgctgcacc

SEQ ID NO: 3896844 - DNA, 20 bp, Homo sapiens
cgctgccttttgctgctgct

SEQ ID NO: 3896845 - DNA, 16 bp, Homo sapiens
cgctgctctagctggc

SEQ ID NO: 3896846 - DNA, 20 bp, Homo sapiens
cgctgctctagctggcagga

SEQ ID NO: 3896847 - DNA, 18 bp, Homo sapiens
cctgtgctgacggaagcc

SEQ ID NO: 3896848 - DNA, 17 bp, Homo sapiens
cctgtgctgaggactcc

SEQ ID NO: 3896849 - DNA, 18 bp, Homo sapiens
cctgtggattccagcatt

SEQ ID NO: 3896850 - DNA, 22 bp, Homo sapiens
cctgtggcagaccgggggccag

SEQ ID NO: 3896851 - DNA, 12 bp, Homo sapiens
cctgtggccagg

SEQ ID NO: 3896852 - DNA, 13 bp, Homo sapiens
cctgtggccttgc

SEQ ID NO: 3896853 - DNA, 14 bp, Homo sapiens
cctgtggccttgcc

SEQ ID NO: 3896854 - DNA, 20 bp, Homo sapiens
cctgtgggccaggagctcag

SEQ ID NO: 3896855 - DNA, 22 bp, Homo sapiens
cctgtgggggtggccatccctg

SEQ ID NO: 3896856 - DNA, 17 bp, Homo sapiens
cctgtgtagctgtgacc

SEQ ID NO: 3896857 - DNA, 21 bp, Homo sapiens
cctgtgtggaagaaggaaaca

SEQ ID NO: 3896858 - DNA, 14 bp, Homo sapiens
cctgtgtggacagg

SEQ ID NO: 3896859 - DNA, 13 bp, Homo sapiens
cctgtgtggggag

SEQ ID NO: 3896860 - DNA, 15 bp, Homo sapiens
cctgtgtggggaggc

SEQ ID NO: 3896861 - DNA, 20 bp, Homo sapiens
cctgttaaaagatgaaaata

SEQ ID NO: 3896862 - DNA, 14 bp, Homo sapiens
cctgttacttacct

SEQ ID NO: 3896863 - DNA, 23 bp, Homo sapiens
cctgttacttgaaataccagtga

SEQ ID NO: 3896864 - DNA, 12 bp, Homo sapiens
cctgttcccatt

SEQ ID NO: 3896865 - DNA, 19 bp, Homo sapiens
cctgttggacccgctctgg

SEQ ID NO: 3896866 - DNA, 20 bp, Homo sapiens
cctgttgttcccatctgcgc

SEQ ID NO: 3896867 - DNA, 16 bp, Homo sapiens
cctgtttaatatttaa

SEQ ID NO: 3896868 - DNA, 15 bp, Homo sapiens
cctgttttaaattat

SEQ ID NO: 3896869 - DNA, 18 bp, Homo sapiens
cctgttttccacaccatc

SEQ ID NO: 3896870 - DNA, 18 bp, Homo sapiens
cctgttttgttggaaggt

SEQ ID NO: 3896871 - DNA, 16 bp, Homo sapiens
cctgtttttctgggtg

SEQ ID NO: 3896872 - DNA, 23 bp, Homo sapiens
ccttaaccctaaaattttaaggc

SEQ ID NO: 3896873 - DNA, 21 bp, Homo sapiens
ccttaacctctctaagccaca

SEQ ID NO: 3896874 - DNA, 22 bp, Homo sapiens
ccttaagggttgaaggcagtct

SEQ ID NO: 3896875 - DNA, 17 bp, Homo sapiens
ccttaattcactcccac

SEQ ID NO: 3896876 - DNA, 13 bp, Homo sapiens
ccttacattccta

SEQ ID NO: 3896877 - DNA, 15 bp, Homo sapiens
ccttaccaactttct

SEQ ID NO: 3896878 - DNA, 19 bp, Homo sapiens
ccttaccaactttctgtaa

SEQ ID NO: 3896879 - DNA, 16 bp, Homo sapiens
ccttacctcctgccca

SEQ ID NO: 3896880 - DNA, 17 bp, Homo sapiens
ccttacctcctgcccag

SEQ ID NO: 3896881 - DNA, 18 bp, Homo sapiens
ccttacctcctgcccagg

SEQ ID NO: 3896882 - DNA, 12 bp, Homo sapiens
ccttactcacct

SEQ ID NO: 3896883 - DNA, 16 bp, Homo sapiens
ccttactcacctctct

SEQ ID NO: 3896884 - DNA, 12 bp, Homo sapiens
ccttactcctgt

SEQ ID NO: 3896885 - DNA, 18 bp, Homo sapiens
ccttactctgagcccagg

SEQ ID NO: 3896886 - DNA, 12 bp, Homo sapiens
ccttactgcaga

SEQ ID NO: 3896887 - DNA, 21 bp, Homo sapiens
ccttagcacttctttcctctc

SEQ ID NO: 3896888 - DNA, 16 bp, Homo sapiens
ccttagtggctttttt

SEQ ID NO: 3896889 - DNA, 16 bp, Homo sapiens
ccttatgtaattattt

SEQ ID NO: 3896890 - DNA, 16 bp, Homo sapiens
ccttatttatatatca

SEQ ID NO: 3896891 - DNA, 22 bp, Homo sapiens
ccttatttatcaacatcttttt

SEQ ID NO: 3896892 - DNA, 14 bp, Homo sapiens
ccttcaacccgaga

SEQ ID NO: 3896893 - DNA, 19 bp, Homo sapiens
ccttcagggccagaaggag

SEQ ID NO: 3896894 - DNA, 16 bp, Homo sapiens
ccttcagtgcccacca

SEQ ID NO: 3896895 - DNA, 21 bp, Homo sapiens
ccttcataggcggtcatgtgt

SEQ ID NO: 3896896 - DNA, 22 bp, Homo sapiens
ccttcataggcggtcatgtgtg

SEQ ID NO: 3896897 - DNA, 18 bp, Homo sapiens
ccttcatcgaacaaactg

SEQ ID NO: 3896898 - DNA, 12 bp, Homo sapiens
ccttccacctcc

SEQ ID NO: 3896899 - DNA, 20 bp, Homo sapiens
ccttccatgtcgcctctgca

SEQ ID NO: 3896900 - DNA, 21 bp, Homo sapiens
ccttccatgtcgcctctgcat

SEQ ID NO: 3896901 - DNA, 18 bp, Homo sapiens
ccttcccaatcagcactg

SEQ ID NO: 3896902 - DNA, 17 bp, Homo sapiens
ccttcccagctctccct

SEQ ID NO: 3896903 - DNA, 20 bp, Homo sapiens
ccttcccccatcccctttcc

SEQ ID NO: 3896904 - DNA, 22 bp, Homo sapiens
ccttcccccatcccctttcctc

SEQ ID NO: 3896905 - DNA, 23 bp, Homo sapiens
ccttcccccatcccctttcctcc

SEQ ID NO: 3896906 - DNA, 22 bp, Homo sapiens
ccttccccttttgcctggctgt

SEQ ID NO: 3896907 - DNA, 13 bp, Homo sapiens
ccttccctccaaa

SEQ ID NO: 3896908 - DNA, 20 bp, Homo sapiens
ccttccctctttccccacct

SEQ ID NO: 3896909 - DNA, 14 bp, Homo sapiens
ccttccctgctttg

SEQ ID NO: 3896910 - DNA, 15 bp, Homo sapiens
ccttccgctccttta

SEQ ID NO: 3896911 - DNA, 18 bp, Homo sapiens
ccttccgctcctttacct

SEQ ID NO: 3896912 - DNA, 17 bp, Homo sapiens
ccttcctcctccacagt

SEQ ID NO: 3896913 - DNA, 17 bp, Homo sapiens
ccttcctctcaagctag

SEQ ID NO: 3896914 - DNA, 14 bp, Homo sapiens
ccttcctctccact

SEQ ID NO: 3896915 - DNA, 17 bp, Homo sapiens
ccttcctctccactgcc

SEQ ID NO: 3896916 - DNA, 17 bp, Homo sapiens
ccttcctgccaccagtc

SEQ ID NO: 3896917 - DNA, 23 bp, Homo sapiens
ccttcctgccccaactccttcca

SEQ ID NO: 3896918 - DNA, 22 bp, Homo sapiens
ccttcctggacagctgtgcctc

SEQ ID NO: 3896919 - DNA, 17 bp, Homo sapiens
ccttcctggcctcactg

SEQ ID NO: 3896920 - DNA, 20 bp, Homo sapiens
ccttcctggcctcactggct

SEQ ID NO: 3896921 - DNA, 16 bp, Homo sapiens
ccttcctgtcccacct

SEQ ID NO: 3896922 - DNA, 19 bp, Homo sapiens
ccttcctttaggtctggtt

SEQ ID NO: 3896923 - DNA, 19 bp, Homo sapiens
ccttcctttcctctgcagc

SEQ ID NO: 3896924 - DNA, 22 bp, Homo sapiens
ccttcgatacaccgggcctgga

SEQ ID NO: 3896925 - DNA, 23 bp, Homo sapiens
ccttcgatacaccgggcctggag

SEQ ID NO: 3896926 - DNA, 17 bp, Homo sapiens
ccttcgcggtggaaggc

SEQ ID NO: 3896927 - DNA, 13 bp, Homo sapiens
ccttcgctgccag

SEQ ID NO: 3896928 - DNA, 16 bp, Homo sapiens
ccttcgctgccaggac

SEQ ID NO: 3896929 - DNA, 18 bp, Homo sapiens
ccttcgctgccaggacac

SEQ ID NO: 3896930 - DNA, 19 bp, Homo sapiens
ccttcgctgccaggacacc

SEQ ID NO: 3896931 - DNA, 13 bp, Homo sapiens
ccttcgtgtctct

SEQ ID NO: 3896932 - DNA, 18 bp, Homo sapiens
ccttcgtgtctctcccac

SEQ ID NO: 3896933 - DNA, 13 bp, Homo sapiens
cctgcctctgcca

SEQ ID NO: 3896934 - DNA, 23 bp, Homo sapiens
cctgcctctgccatgcccagaga

SEQ ID NO: 3896935 - DNA, 19 bp, Homo sapiens
cctgcctgagcccaggagc

SEQ ID NO: 3896936 - DNA, 11 bp, Homo sapiens
cctgcctggag

SEQ ID NO: 3896937 - DNA, 13 bp, Homo sapiens
cctgcctggagga

SEQ ID NO: 3896938 - DNA, 23 bp, Homo sapiens
cctgcctggaggacctgagcctg

SEQ ID NO: 3896939 - DNA, 13 bp, Homo sapiens
cctgcctgggttt

SEQ ID NO: 3896940 - DNA, 14 bp, Homo sapiens
cctgcctgtgcatg

SEQ ID NO: 3896941 - DNA, 18 bp, Homo sapiens
cctgccttcttcggggaa

SEQ ID NO: 3896942 - DNA, 20 bp, Homo sapiens
cctgcgaagtggctctcagg

SEQ ID NO: 3896943 - DNA, 18 bp, Homo sapiens
cctgcgattttgcctgtg

SEQ ID NO: 3896944 - DNA, 17 bp, Homo sapiens
cctgcggccgggctgcc

SEQ ID NO: 3896945 - DNA, 18 bp, Homo sapiens
cctgcggccgggctgccc

SEQ ID NO: 3896946 - DNA, 16 bp, Homo sapiens
cctgcggctgctgtgt

SEQ ID NO: 3896947 - DNA, 16 bp, Homo sapiens
cctgcgggttttaatt

SEQ ID NO: 3896948 - DNA, 20 bp, Homo sapiens
cctgcgtcctgacgccctgc

SEQ ID NO: 3896949 - DNA, 17 bp, Homo sapiens
cctgcgtctgtttttaa

SEQ ID NO: 3896950 - DNA, 15 bp, Homo sapiens
cctgcgtgccgggag

SEQ ID NO: 3896951 - DNA, 16 bp, Homo sapiens
cctgcgttggagccac

SEQ ID NO: 3896952 - DNA, 20 bp, Homo sapiens
cctgcgttggagccactcct

SEQ ID NO: 3896953 - DNA, 17 bp, Homo sapiens
cctgctaatagctgcta

SEQ ID NO: 3896954 - DNA, 16 bp, Homo sapiens
cctgctacacaaaagc

SEQ ID NO: 3896955 - DNA, 17 bp, Homo sapiens
cctgctaccaaggccca

SEQ ID NO: 3896956 - DNA, 13 bp, Homo sapiens
cctgctagagcaa

SEQ ID NO: 3896957 - DNA, 23 bp, Homo sapiens
cctgctagagcaacccctgtacc

SEQ ID NO: 3896958 - DNA, 16 bp, Homo sapiens
cctgctagctgtagaa

SEQ ID NO: 3896959 - DNA, 15 bp, Homo sapiens
cctgctcccagcagc

SEQ ID NO: 3896960 - DNA, 16 bp, Homo sapiens
cctgctcccagcagcc

SEQ ID NO: 3896961 - DNA, 14 bp, Homo sapiens
cctgctcccccacc

SEQ ID NO: 3896962 - DNA, 16 bp, Homo sapiens
cctgctcccccacccc

SEQ ID NO: 3896963 - DNA, 19 bp, Homo sapiens
cctgctctcctcttgccac

SEQ ID NO: 3896964 - DNA, 15 bp, Homo sapiens
cctgctctggggatg

SEQ ID NO: 3896965 - DNA, 17 bp, Homo sapiens
cctgctgagagacccaa

SEQ ID NO: 3896966 - DNA, 21 bp, Homo sapiens
cctgctgagagacccaaggag

SEQ ID NO: 3896967 - DNA, 13 bp, Homo sapiens
cctgctgagctct

SEQ ID NO: 3896968 - DNA, 15 bp, Homo sapiens
cctgctgagctctga

SEQ ID NO: 3896969 - DNA, 19 bp, Homo sapiens
cctgctgagctctgagagg

SEQ ID NO: 3896970 - DNA, 15 bp, Homo sapiens
cctgctgcagcatga

SEQ ID NO: 3896971 - DNA, 14 bp, Homo sapiens
cctgctgccgcctc

SEQ ID NO: 3896972 - DNA, 23 bp, Homo sapiens
cctgctgccgcctcccagcctgg

SEQ ID NO: 3896973 - DNA, 15 bp, Homo sapiens
cctgctgctgacctg

SEQ ID NO: 3896974 - DNA, 21 bp, Homo sapiens
cctggcctcactggctggggc

SEQ ID NO: 3896975 - DNA, 13 bp, Homo sapiens
cctggcctgagct

SEQ ID NO: 3896976 - DNA, 15 bp, Homo sapiens
cctggcctgagctgg

SEQ ID NO: 3896977 - DNA, 16 bp, Homo sapiens
cctggcctgagctggg

SEQ ID NO: 3896978 - DNA, 18 bp, Homo sapiens
cctggcctgagctggggc

SEQ ID NO: 3896979 - DNA, 12 bp, Homo sapiens
cctggcctgctg

SEQ ID NO: 3896980 - DNA, 13 bp, Homo sapiens
cctggcctgctgg

SEQ ID NO: 3896981 - DNA, 14 bp, Homo sapiens
cctggcctgctggg

SEQ ID NO: 3896982 - DNA, 14 bp, Homo sapiens
cctggcctggctcc

SEQ ID NO: 3896983 - DNA, 19 bp, Homo sapiens
cctggccttgtcaggaccc

SEQ ID NO: 3896984 - DNA, 18 bp, Homo sapiens
cctggcggggcaggaggc

SEQ ID NO: 3896985 - DNA, 20 bp, Homo sapiens
cctggcggggcaggaggcct

SEQ ID NO: 3896986 - DNA, 23 bp, Homo sapiens
cctggcggggcaggaggcctggc

SEQ ID NO: 3896987 - DNA, 23 bp, Homo sapiens
cctggctcccacaggcccttcct

SEQ ID NO: 3896988 - DNA, 21 bp, Homo sapiens
cctggctccccacgagtcacc

SEQ ID NO: 3896989 - DNA, 23 bp, Homo sapiens
cctggctccccacgagtcacctg

SEQ ID NO: 3896990 - DNA, 18 bp, Homo sapiens
cctggctgacccctggcc

SEQ ID NO: 3896991 - DNA, 13 bp, Homo sapiens
cctggctggctga

SEQ ID NO: 3896992 - DNA, 19 bp, Homo sapiens
cctggctggctgagggcag

SEQ ID NO: 3896993 - DNA, 15 bp, Homo sapiens
cctggctgtggaggc

SEQ ID NO: 3896994 - DNA, 18 bp, Homo sapiens
cctggctgtggaggcctg

SEQ ID NO: 3896995 - DNA, 22 bp, Homo sapiens
cctggctgtggaggcctgatgc

SEQ ID NO: 3896996 - DNA, 20 bp, Homo sapiens
cctggcttcccatccccagc

SEQ ID NO: 3896997 - DNA, 23 bp, Homo sapiens
cctggcttcccatccccagcgat

SEQ ID NO: 3896998 - DNA, 16 bp, Homo sapiens
cctggcttgctccagg

SEQ ID NO: 3896999 - DNA, 19 bp, Homo sapiens
cctggcttgctccagggtc

SEQ ID NO: 3897000 - DNA, 20 bp, Homo sapiens
cctggcttgctccagggtct

SEQ ID NO: 3897001 - DNA, 18 bp, Homo sapiens
cctggcttgtaactccac

SEQ ID NO: 3897002 - DNA, 20 bp, Homo sapiens
cctggctttcccttccagtt

SEQ ID NO: 3897003 - DNA, 18 bp, Homo sapiens
cctggctttgacatgaaa

SEQ ID NO: 3897004 - DNA, 20 bp, Homo sapiens
cctggcttttcactgctggc

SEQ ID NO: 3897005 - DNA, 21 bp, Homo sapiens
cctggcttttcactgctggct

SEQ ID NO: 3897006 - DNA, 17 bp, Homo sapiens
cctgggaaaacagagga

SEQ ID NO: 3897007 - DNA, 18 bp, Homo sapiens
cctgggaaaacagaggaa

SEQ ID NO: 3897008 - DNA, 17 bp, Homo sapiens
cctgggaaatttctact

SEQ ID NO: 3897009 - DNA, 18 bp, Homo sapiens
cctgggaactcatcctgt

SEQ ID NO: 3897010 - DNA, 16 bp, Homo sapiens
cctgggactcccagtg

SEQ ID NO: 3897011 - DNA, 14 bp, Homo sapiens
cctgggaggcggag

SEQ ID NO: 3897012 - DNA, 23 bp, Homo sapiens
cctgggaggcggagagtacagtg

SEQ ID NO: 3897013 - DNA, 13 bp, Homo sapiens
cctgggaggcttt

SEQ ID NO: 3897014 - DNA, 16 bp, Homo sapiens
cctgggattcaggaaa

SEQ ID NO: 3897015 - DNA, 18 bp, Homo sapiens
cctgggattcaggaaaag

SEQ ID NO: 3897016 - DNA, 18 bp, Homo sapiens
cctgggcacccacctcca

SEQ ID NO: 3897017 - DNA, 20 bp, Homo sapiens
cctgggcacccacctccacc

SEQ ID NO: 3897018 - DNA, 11 bp, Homo sapiens
aaaaaaagaaa

SEQ ID NO: 3897019 - DNA, 16 bp, Homo sapiens
aaaaaaataatgtaag

SEQ ID NO: 3897020 - DNA, 12 bp, Homo sapiens
aaaaaaatgact

SEQ ID NO: 3897021 - DNA, 11 bp, Homo sapiens
aaaaaaatttg

SEQ ID NO: 3897022 - DNA, 12 bp, Homo sapiens
aaaaaagaaatg

SEQ ID NO: 3897023 - DNA, 17 bp, Homo sapiens
aaaaaatacaccacgaa

SEQ ID NO: 3897024 - DNA, 13 bp, Homo sapiens
aaaaaatacagta

SEQ ID NO: 3897025 - DNA, 13 bp, Homo sapiens
aaaaacaaaacaa

SEQ ID NO: 3897026 - DNA, 18 bp, Homo sapiens
aaaaacacggcagctgta

SEQ ID NO: 3897027 - DNA, 18 bp, Homo sapiens
aaaaaccactgaacattt

SEQ ID NO: 3897028 - DNA, 15 bp, Homo sapiens
aaaaaccagaatcat

SEQ ID NO: 3897029 - DNA, 23 bp, Homo sapiens
aaaaaccagaatcataattttca

SEQ ID NO: 3897030 - DNA, 20 bp, Homo sapiens
aaaaactctgggaaataaga

SEQ ID NO: 3897031 - DNA, 18 bp, Homo sapiens
aaaaacttgtaaatgctg

SEQ ID NO: 3897032 - DNA, 14 bp, Homo sapiens
aaaaagaaaagata

SEQ ID NO: 3897033 - DNA, 17 bp, Homo sapiens
aaaaagcatgactattt

SEQ ID NO: 3897034 - DNA, 18 bp, Homo sapiens
aaaaagctgaagcctatt

SEQ ID NO: 3897035 - DNA, 22 bp, Homo sapiens
aaaaaggatgaaagtctgagaa

SEQ ID NO: 3897036 - DNA, 21 bp, Homo sapiens
aaaaaggccagtggaaattca

SEQ ID NO: 3897037 - DNA, 17 bp, Homo sapiens
aaaaaggctagtttatt

SEQ ID NO: 3897038 - DNA, 22 bp, Homo sapiens
aaaaaggctagtttattttgtt

SEQ ID NO: 3897039 - DNA, 17 bp, Homo sapiens
aaaaaggtgtgtcaaag

SEQ ID NO: 3897040 - DNA, 18 bp, Homo sapiens
aaaaagtatacttttgtt

SEQ ID NO: 3897041 - DNA, 20 bp, Homo sapiens
aaaaagttgcagtctcagaa

SEQ ID NO: 3897042 - DNA, 17 bp, Homo sapiens
aaaaagtttacaagtgt

SEQ ID NO: 3897043 - DNA, 18 bp, Homo sapiens
aaaaagtttgccagaagt

SEQ ID NO: 3897044 - DNA, 18 bp, Homo sapiens
aaaaataaaaacataaaa

SEQ ID NO: 3897045 - DNA, 19 bp, Homo sapiens
aaaaataaactagtttcca

SEQ ID NO: 3897046 - DNA, 12 bp, Homo sapiens
aaaaatacagta

SEQ ID NO: 3897047 - DNA, 16 bp, Homo sapiens
aaaaatacagtaaagt

SEQ ID NO: 3897048 - DNA, 18 bp, Homo sapiens
aaaaatacagtaaagttt

SEQ ID NO: 3897049 - DNA, 14 bp, Homo sapiens
aaaaatacttgagc

SEQ ID NO: 3897050 - DNA, 16 bp, Homo sapiens
aaaaatccagaaagaa

SEQ ID NO: 3897051 - DNA, 12 bp, Homo sapiens
aaaaatctagtt

SEQ ID NO: 3897052 - DNA, 14 bp, Homo sapiens
aaaaatctagtttt

SEQ ID NO: 3897053 - DNA, 15 bp, Homo sapiens
aaaaatctagttttt

SEQ ID NO: 3897054 - DNA, 14 bp, Homo sapiens
aaaaatcttgggca

SEQ ID NO: 3897055 - DNA, 23 bp, Homo sapiens
aaaaatggaaacatttattcctt

SEQ ID NO: 3897056 - DNA, 19 bp, Homo sapiens
aaaaatggtggtttgtcat

SEQ ID NO: 3897057 - DNA, 16 bp, Homo sapiens
aaaacaaaaataaata

SEQ ID NO: 3897058 - DNA, 14 bp, Homo sapiens
aaaacaagaaagaa

SEQ ID NO: 3897059 - DNA, 18 bp, Homo sapiens
aaaacacagcaagggtga

SEQ ID NO: 3897060 - DNA, 18 bp, Homo sapiens
aaaacagcctcacagaag

SEQ ID NO: 3897061 - DNA, 20 bp, Homo sapiens
aaaacatatcaattcaacac

SEQ ID NO: 3897062 - DNA, 13 bp, Homo sapiens
aaaaccaatgatt

SEQ ID NO: 3897063 - DNA, 12 bp, Homo sapiens
aaaaccacagca

SEQ ID NO: 3897064 - DNA, 13 bp, Homo sapiens
aaaaccacagcag

SEQ ID NO: 3897065 - DNA, 18 bp, Homo sapiens
aaaaccactgaacatttg

SEQ ID NO: 3897066 - DNA, 12 bp, Homo sapiens
aaaaccagggat

SEQ ID NO: 3897067 - DNA, 22 bp, Homo sapiens
aaaaccatgcagcttcatcaat

SEQ ID NO: 3897068 - DNA, 17 bp, Homo sapiens
aaaaccatgtagtttta

SEQ ID NO: 3897069 - DNA, 18 bp, Homo sapiens
aaaactaaatctctaata

SEQ ID NO: 3897070 - DNA, 18 bp, Homo sapiens
aaagtgcaaagtgccctc

SEQ ID NO: 3897071 - DNA, 14 bp, Homo sapiens
aaagtgcaatgcgt

SEQ ID NO: 3897072 - DNA, 15 bp, Homo sapiens
aaagtgccactcatt

SEQ ID NO: 3897073 - DNA, 22 bp, Homo sapiens
aaagtgccagtttgcttagttc

SEQ ID NO: 3897074 - DNA, 16 bp, Homo sapiens
aaagtgcttagaaagt

SEQ ID NO: 3897075 - DNA, 16 bp, Homo sapiens
aaagtggctaattcaa

SEQ ID NO: 3897076 - DNA, 23 bp, Homo sapiens
aaagtggctcttctaacctcagc

SEQ ID NO: 3897077 - DNA, 14 bp, Homo sapiens
aaagtgtgagcagt

SEQ ID NO: 3897078 - DNA, 22 bp, Homo sapiens
aaagtgtgagcagtgagttaca

SEQ ID NO: 3897079 - DNA, 13 bp, Homo sapiens
aaagtgtttgcct

SEQ ID NO: 3897080 - DNA, 23 bp, Homo sapiens
aaagttatgagggtcagggcagt

SEQ ID NO: 3897081 - DNA, 14 bp, Homo sapiens
aaagttcagccaga

SEQ ID NO: 3897082 - DNA, 21 bp, Homo sapiens
aaagttccctacttcctgtga

SEQ ID NO: 3897083 - DNA, 12 bp, Homo sapiens
aaagttgctttg

SEQ ID NO: 3897084 - DNA, 18 bp, Homo sapiens
aaagttgctttgttatta

SEQ ID NO: 3897085 - DNA, 18 bp, Homo sapiens
aaagttgtgattccagat

SEQ ID NO: 3897086 - DNA, 13 bp, Homo sapiens
aaagtttaaaaaa

SEQ ID NO: 3897087 - DNA, 14 bp, Homo sapiens
aaagtttaaaaaat

SEQ ID NO: 3897088 - DNA, 16 bp, Homo sapiens
aaagtttaaaaaatac

SEQ ID NO: 3897089 - DNA, 18 bp, Homo sapiens
aaagtttaaaaaatacac

SEQ ID NO: 3897090 - DNA, 21 bp, Homo sapiens
aaagtttacagtaaataaatt

SEQ ID NO: 3897091 - DNA, 13 bp, Homo sapiens
aaagtttgccaga

SEQ ID NO: 3897092 - DNA, 15 bp, Homo sapiens
aaagttttcctgaga

SEQ ID NO: 3897093 - DNA, 21 bp, Homo sapiens
aaagttttgatgaaattcttg

SEQ ID NO: 3897094 - DNA, 17 bp, Homo sapiens
aaataaaaaaatacagt

SEQ ID NO: 3897095 - DNA, 15 bp, Homo sapiens
aaataaaaaccagaa

SEQ ID NO: 3897096 - DNA, 20 bp, Homo sapiens
aaataaaaaccagaatcata

SEQ ID NO: 3897097 - DNA, 12 bp, Homo sapiens
aaataaaaagta

SEQ ID NO: 3897098 - DNA, 22 bp, Homo sapiens
aaataaaaatcaacttgtgtac

SEQ ID NO: 3897099 - DNA, 14 bp, Homo sapiens
aaataaaaccagct

SEQ ID NO: 3897100 - DNA, 11 bp, Homo sapiens
aaataaaacct

SEQ ID NO: 3897101 - DNA, 14 bp, Homo sapiens
aaataaaacctttc

SEQ ID NO: 3897102 - DNA, 12 bp, Homo sapiens
aaataaaatgat

SEQ ID NO: 3897103 - DNA, 14 bp, Homo sapiens
aaataaaatgatgt

SEQ ID NO: 3897104 - DNA, 21 bp, Homo sapiens
aaataaacctggagatgatga

SEQ ID NO: 3897105 - DNA, 11 bp, Homo sapiens
aaataaactag

SEQ ID NO: 3897106 - DNA, 18 bp, Homo sapiens
aaataaagtatcatgcat

SEQ ID NO: 3897107 - DNA, 19 bp, Homo sapiens
aaataaagttggtcttttg

SEQ ID NO: 3897108 - DNA, 14 bp, Homo sapiens
aaataaatggaaat

SEQ ID NO: 3897109 - DNA, 21 bp, Homo sapiens
aaataaatgtatcatagaaat

SEQ ID NO: 3897110 - DNA, 15 bp, Homo sapiens
aaataaatgtgtaaa

SEQ ID NO: 3897111 - DNA, 12 bp, Homo sapiens
aaataaattcaa

SEQ ID NO: 3897112 - DNA, 16 bp, Homo sapiens
aaataaattgaaatat

SEQ ID NO: 3897113 - DNA, 13 bp, Homo sapiens
aaataaattttgt

SEQ ID NO: 3897114 - DNA, 19 bp, Homo sapiens
aaataaattttgtttcaga

SEQ ID NO: 3897115 - DNA, 20 bp, Homo sapiens
aaataaggggcacctgggaa

SEQ ID NO: 3897116 - DNA, 23 bp, Homo sapiens
aaataatgtaagggtctgttgta

SEQ ID NO: 3897117 - DNA, 18 bp, Homo sapiens
aaataatgttctgtcacg

SEQ ID NO: 3897118 - DNA, 17 bp, Homo sapiens
aaataatttaactaatt

SEQ ID NO: 3897119 - DNA, 18 bp, Homo sapiens
aaataatttaactaattt

SEQ ID NO: 3897120 - DNA, 12 bp, Homo sapiens
aaataattttaa

SEQ ID NO: 3897121 - DNA, 19 bp, Homo sapiens
aaatacacactcaaatcaa

SEQ ID NO: 3897122 - DNA, 16 bp, Homo sapiens
aaatacagacactaag

SEQ ID NO: 3897123 - DNA, 17 bp, Homo sapiens
aaatacagacactaagt

SEQ ID NO: 3897124 - DNA, 20 bp, Homo sapiens
aaatacagtaaagtttaaaa

SEQ ID NO: 3897125 - DNA, 21 bp, Homo sapiens
aaataccatgccatttaaagc

SEQ ID NO: 3897126 - DNA, 13 bp, Homo sapiens
aaatactacacat

SEQ ID NO: 3897127 - DNA, 15 bp, Homo sapiens
aaatactccaagctt

SEQ ID NO: 3897128 - DNA, 16 bp, Homo sapiens
aaatactccaagcttc

SEQ ID NO: 3897129 - DNA, 17 bp, Homo sapiens
aaatactccaagcttca

SEQ ID NO: 3897130 - DNA, 18 bp, Homo sapiens
aaatactccaagcttcaa

SEQ ID NO: 3897131 - DNA, 19 bp, Homo sapiens
aaatactccaagcttcaag

SEQ ID NO: 3897132 - DNA, 23 bp, Homo sapiens
aaatactccaagcttcaagtgat

SEQ ID NO: 3897133 - DNA, 15 bp, Homo sapiens
aaatactgctctgaa

SEQ ID NO: 3897134 - DNA, 23 bp, Homo sapiens
aaatactgctctgaatattttgt

SEQ ID NO: 3897135 - DNA, 15 bp, Homo sapiens
aaatactgtacatag

SEQ ID NO: 3897136 - DNA, 21 bp, Homo sapiens
aaatagatcctaggtgctgga

SEQ ID NO: 3897137 - DNA, 18 bp, Homo sapiens
aaatagatttgattattt

SEQ ID NO: 3897138 - DNA, 21 bp, Homo sapiens
aaatagccgggcatggtggcg

SEQ ID NO: 3897139 - DNA, 15 bp, Homo sapiens
aaatagcttctgttt

SEQ ID NO: 3897140 - DNA, 15 bp, Homo sapiens
aaatagcttgtatag

SEQ ID NO: 3897141 - DNA, 21 bp, Homo sapiens
aaatagtaggaccaatgttgt

SEQ ID NO: 3897142 - DNA, 16 bp, Homo sapiens
aaatagtattgaaagt

SEQ ID NO: 3897143 - DNA, 20 bp, Homo sapiens
aaatagtgcagaatctcata

SEQ ID NO: 3897144 - DNA, 21 bp, Homo sapiens
aaatagtgcagaatctcatag

SEQ ID NO: 3897145 - DNA, 16 bp, Homo sapiens
aaatagttgtccatat

SEQ ID NO: 3897146 - DNA, 14 bp, Homo sapiens
aaatataaacttgt

SEQ ID NO: 3897147 - DNA, 20 bp, Homo sapiens
aaatataaacttgtgtatga

SEQ ID NO: 3897148 - DNA, 22 bp, Homo sapiens
aaatataaatgcatgattttat

SEQ ID NO: 3897149 - DNA, 12 bp, Homo sapiens
aaatataaatta

SEQ ID NO: 3897150 - DNA, 14 bp, Homo sapiens
aaatataaattaag

SEQ ID NO: 3897151 - DNA, 15 bp, Homo sapiens
aaatataaattaaga

SEQ ID NO: 3897152 - DNA, 20 bp, Homo sapiens
aaatataaccattacatgtt

SEQ ID NO: 3897153 - DNA, 20 bp, Homo sapiens
aaatatacaaacatgtggca

SEQ ID NO: 3897154 - DNA, 13 bp, Homo sapiens
aaatatagtagca

SEQ ID NO: 3897155 - DNA, 16 bp, Homo sapiens
aaatatatataaatat

SEQ ID NO: 3897156 - DNA, 21 bp, Homo sapiens
aaatatatataaatatatatt

SEQ ID NO: 3897157 - DNA, 19 bp, Homo sapiens
aactacactaataaatgcc

SEQ ID NO: 3897158 - DNA, 13 bp, Homo sapiens
aactacagtggct

SEQ ID NO: 3897159 - DNA, 22 bp, Homo sapiens
aactaccgttcccaaattggtg

SEQ ID NO: 3897160 - DNA, 19 bp, Homo sapiens
aactacgcttgctcatttt

SEQ ID NO: 3897161 - DNA, 12 bp, Homo sapiens
aactactgtaat

SEQ ID NO: 3897162 - DNA, 18 bp, Homo sapiens
aactactttttatactcc

SEQ ID NO: 3897163 - DNA, 17 bp, Homo sapiens
aactagatctcctattt

SEQ ID NO: 3897164 - DNA, 14 bp, Homo sapiens
aactagccaaggct

SEQ ID NO: 3897165 - DNA, 15 bp, Homo sapiens
aactaggaagtggct

SEQ ID NO: 3897166 - DNA, 23 bp, Homo sapiens
aactagtaatgggccaattaaaa

SEQ ID NO: 3897167 - DNA, 15 bp, Homo sapiens
aactagtcctttact

SEQ ID NO: 3897168 - DNA, 13 bp, Homo sapiens
aactagtttccag

SEQ ID NO: 3897169 - DNA, 16 bp, Homo sapiens
aactatattttcttta

SEQ ID NO: 3897170 - DNA, 17 bp, Homo sapiens
aactatcaatatttaag

SEQ ID NO: 3897171 - DNA, 19 bp, Homo sapiens
aactatccaattaaaatta

SEQ ID NO: 3897172 - DNA, 13 bp, Homo sapiens
aactatgtgatgt

SEQ ID NO: 3897173 - DNA, 22 bp, Homo sapiens
aactatgtgatgttaactatta

SEQ ID NO: 3897174 - DNA, 22 bp, Homo sapiens
aactattattaataaattttaa

SEQ ID NO: 3897175 - DNA, 18 bp, Homo sapiens
aactatttgtctttcagg

SEQ ID NO: 3897176 - DNA, 15 bp, Homo sapiens
aactcaaaatatttg

SEQ ID NO: 3897177 - DNA, 16 bp, Homo sapiens
aactcagaatgctcta

SEQ ID NO: 3897178 - DNA, 16 bp, Homo sapiens
aactcagacattccaa

SEQ ID NO: 3897179 - DNA, 21 bp, Homo sapiens
aactcatttttgttttcatta

SEQ ID NO: 3897180 - DNA, 24 bp, Homo sapiens
aactcatttttgttttcattatct

SEQ ID NO: 3897181 - DNA, 15 bp, Homo sapiens
aactccaccaaccca

SEQ ID NO: 3897182 - DNA, 18 bp, Homo sapiens
aactccagtctcctgaca

SEQ ID NO: 3897183 - DNA, 20 bp, Homo sapiens
aactccagtctcctgacatt

SEQ ID NO: 3897184 - DNA, 20 bp, Homo sapiens
aactccctgaacctcagttt

SEQ ID NO: 3897185 - DNA, 12 bp, Homo sapiens
aactcctgcctg

SEQ ID NO: 3897186 - DNA, 16 bp, Homo sapiens
aactcctgcctgtgtt

SEQ ID NO: 3897187 - DNA, 17 bp, Homo sapiens
aactccttattttgtat

SEQ ID NO: 3897188 - DNA, 11 bp, Homo sapiens
aactctagcct

SEQ ID NO: 3897189 - DNA, 12 bp, Homo sapiens
aactctccactc

SEQ ID NO: 3897190 - DNA, 19 bp, Homo sapiens
aactctgaattttaaagca

SEQ ID NO: 3897191 - DNA, 22 bp, Homo sapiens
aactctgacaagggctgacctg

SEQ ID NO: 3897192 - DNA, 21 bp, Homo sapiens
aactctgcactccatggccac

SEQ ID NO: 3897193 - DNA, 20 bp, Homo sapiens
aactctggcttccaggtatc

SEQ ID NO: 3897194 - DNA, 16 bp, Homo sapiens
aactcttcaaggtctg

SEQ ID NO: 3897195 - DNA, 19 bp, Homo sapiens
aactcttcaaggtctgctt

SEQ ID NO: 3897196 - DNA, 22 bp, Homo sapiens
aactcttcattttgagtctcag

SEQ ID NO: 3897197 - DNA, 16 bp, Homo sapiens
aactgaaaaatgtcag

SEQ ID NO: 3897198 - DNA, 18 bp, Homo sapiens
aactgaaaactgtaaata

SEQ ID NO: 3897199 - DNA, 20 bp, Homo sapiens
aactgaaaagactcagtgtt

SEQ ID NO: 3897200 - DNA, 17 bp, Homo sapiens
aactgaagacctccaca

SEQ ID NO: 3897201 - DNA, 13 bp, Homo sapiens
aactgaagagaca

SEQ ID NO: 3897202 - DNA, 22 bp, Homo sapiens
aactgaatggaaggtttgtata

SEQ ID NO: 3897203 - DNA, 17 bp, Homo sapiens
aactgacaacctgtgca

SEQ ID NO: 3897204 - DNA, 13 bp, Homo sapiens
aactgacacagga

SEQ ID NO: 3897205 - DNA, 20 bp, Homo sapiens
aactgagatgtgaacacatc

SEQ ID NO: 3897206 - DNA, 20 bp, Homo sapiens
aactgagccaaacacactgt

SEQ ID NO: 3897207 - DNA, 13 bp, Homo sapiens
aactgaggaattt

SEQ ID NO: 3897208 - DNA, 14 bp, Homo sapiens
aactgaggagtagc

SEQ ID NO: 3897209 - DNA, 18 bp, Homo sapiens
aactgagtaaattggaaa

SEQ ID NO: 3897210 - DNA, 20 bp, Homo sapiens
aactgatgcgaaaacttgaa

SEQ ID NO: 3897211 - DNA, 17 bp, Homo sapiens
aactgatggaccgggtg

SEQ ID NO: 3897212 - DNA, 15 bp, Homo sapiens
aactgcaaagtgaag

SEQ ID NO: 3897213 - DNA, 16 bp, Homo sapiens
aactgcattagaaatt

SEQ ID NO: 3897214 - DNA, 14 bp, Homo sapiens
aactgcgtgccagt

SEQ ID NO: 3897215 - DNA, 22 bp, Homo sapiens
aactgcgtgccagtgtccccac

SEQ ID NO: 3897216 - DNA, 21 bp, Homo sapiens
aactgctaaatactgtacata

SEQ ID NO: 3897217 - DNA, 12 bp, Homo sapiens
aactgctgagcc

SEQ ID NO: 3897218 - DNA, 16 bp, Homo sapiens
aactgctgagccactc

SEQ ID NO: 3897219 - DNA, 17 bp, Homo sapiens
aactggacgcccagctg

SEQ ID NO: 3897220 - DNA, 16 bp, Homo sapiens
aactggccaagctgag

SEQ ID NO: 3897221 - DNA, 17 bp, Homo sapiens
aactggccaagctgagg

SEQ ID NO: 3897222 - DNA, 20 bp, Homo sapiens
aactggtccactcagggctg

SEQ ID NO: 3897223 - DNA, 22 bp, Homo sapiens
aactggttcaagagacactgct

SEQ ID NO: 3897224 - DNA, 10 bp, Homo sapiens
aactgtaaat

SEQ ID NO: 3897225 - DNA, 13 bp, Homo sapiens
aactgtaaataca

SEQ ID NO: 3897226 - DNA, 14 bp, Homo sapiens
aactgtaaatacaa

SEQ ID NO: 3897227 - DNA, 18 bp, Homo sapiens
aactgtaaatatgtttgt

SEQ ID NO: 3897228 - DNA, 18 bp, Homo sapiens
aactgtaaatcacttgta

SEQ ID NO: 3897229 - DNA, 20 bp, Homo sapiens
aactgtagataaagtggttt

SEQ ID NO: 3897230 - DNA, 20 bp, Homo sapiens
aactgtatcaaatctgtata

SEQ ID NO: 3897231 - DNA, 17 bp, Homo sapiens
aactgtcaagtcatgat

SEQ ID NO: 3897232 - DNA, 14 bp, Homo sapiens
aactgtgtgaacgc

SEQ ID NO: 3897233 - DNA, 18 bp, Homo sapiens
aactgtgtgaagaaatgg

SEQ ID NO: 3897234 - DNA, 17 bp, Homo sapiens
aactgtgttcattagaa

SEQ ID NO: 3897235 - DNA, 14 bp, Homo sapiens
aactgttctgtgtg

SEQ ID NO: 3897236 - DNA, 15 bp, Homo sapiens
aacttaaaagattca

SEQ ID NO: 3897237 - DNA, 14 bp, Homo sapiens
aacttaaaatattt

SEQ ID NO: 3897238 - DNA, 23 bp, Homo sapiens
aacttacattgtgaaacttctgt

SEQ ID NO: 3897239 - DNA, 15 bp, Homo sapiens
aacttagaataaaat

SEQ ID NO: 3897240 - DNA, 16 bp, Homo sapiens
aacttagaataaaatt

SEQ ID NO: 3897241 - DNA, 21 bp, Homo sapiens
aacttagaataaaattgtaaa

SEQ ID NO: 3897242 - DNA, 16 bp, Homo sapiens
aacttagcatgtgttg

SEQ ID NO: 3897243 - DNA, 19 bp, Homo sapiens
aacttagcatgtgttgaaa

SEQ ID NO: 3897244 - DNA, 13 bp, Homo sapiens
aagcttgtgagag

SEQ ID NO: 3897245 - DNA, 21 bp, Homo sapiens
aagctttgaatacccccagag

SEQ ID NO: 3897246 - DNA, 16 bp, Homo sapiens
aaggaaaaccagggat

SEQ ID NO: 3897247 - DNA, 16 bp, Homo sapiens
aaggaaccaccgaaga

SEQ ID NO: 3897248 - DNA, 20 bp, Homo sapiens
aaggaactctggcttccagg

SEQ ID NO: 3897249 - DNA, 16 bp, Homo sapiens
aaggaagctccactgt

SEQ ID NO: 3897250 - DNA, 20 bp, Homo sapiens
aaggaaggagactcacctct

SEQ ID NO: 3897251 - DNA, 15 bp, Homo sapiens
aaggaagggacacac

SEQ ID NO: 3897252 - DNA, 17 bp, Homo sapiens
aaggaaggttttctcca

SEQ ID NO: 3897253 - DNA, 23 bp, Homo sapiens
aaggaagttattaacgggcatgt

SEQ ID NO: 3897254 - DNA, 18 bp, Homo sapiens
aaggaatagccagagagg

SEQ ID NO: 3897255 - DNA, 21 bp, Homo sapiens
aaggaatagtcgcgcaagcat

SEQ ID NO: 3897256 - DNA, 20 bp, Homo sapiens
aaggaattctaggcatccca

SEQ ID NO: 3897257 - DNA, 13 bp, Homo sapiens
aaggacaatgcct

SEQ ID NO: 3897258 - DNA, 14 bp, Homo sapiens
aaggacacactaat

SEQ ID NO: 3897259 - DNA, 21 bp, Homo sapiens
aaggaccaactggcttctgtg

SEQ ID NO: 3897260 - DNA, 23 bp, Homo sapiens
aaggaccaactggcttctgtgca

SEQ ID NO: 3897261 - DNA, 13 bp, Homo sapiens
aaggacccaccca

SEQ ID NO: 3897262 - DNA, 22 bp, Homo sapiens
aaggaccctgttttccacacca

SEQ ID NO: 3897263 - DNA, 19 bp, Homo sapiens
aaggaccgtggccctgccc

SEQ ID NO: 3897264 - DNA, 13 bp, Homo sapiens
aaggagaaaggag

SEQ ID NO: 3897265 - DNA, 23 bp, Homo sapiens
aaggagaagactgggctagggag

SEQ ID NO: 3897266 - DNA, 15 bp, Homo sapiens
aaggagaaggaagga

SEQ ID NO: 3897267 - DNA, 21 bp, Homo sapiens
aaggagcctgtgaacccagga

SEQ ID NO: 3897268 - DNA, 21 bp, Homo sapiens
aaggagctgatttccaggccc

SEQ ID NO: 3897269 - DNA, 24 bp, Homo sapiens
aaggagctgatttccaggcccctg

SEQ ID NO: 3897270 - DNA, 18 bp, Homo sapiens
aaggaggcatgcctctga

SEQ ID NO: 3897271 - DNA, 16 bp, Homo sapiens
aaggagggcagagcca

SEQ ID NO: 3897272 - DNA, 19 bp, Homo sapiens
aaggagtgagatcattttc

SEQ ID NO: 3897273 - DNA, 13 bp, Homo sapiens
aaggagttaagag

SEQ ID NO: 3897274 - DNA, 20 bp, Homo sapiens
aaggagttcgtggctgcaaa

SEQ ID NO: 3897275 - DNA, 23 bp, Homo sapiens
aaggataagaaccacagaacact

SEQ ID NO: 3897276 - DNA, 13 bp, Homo sapiens
aaggatcagaatg

SEQ ID NO: 3897277 - DNA, 23 bp, Homo sapiens
aaggatccagagacttggggacc

SEQ ID NO: 3897278 - DNA, 15 bp, Homo sapiens
aaggatggcaagcac

SEQ ID NO: 3897279 - DNA, 20 bp, Homo sapiens
aaggatgtaaacagtgcctg

SEQ ID NO: 3897280 - DNA, 23 bp, Homo sapiens
aaggatgtaaacagtgcctgctg

SEQ ID NO: 3897281 - DNA, 18 bp, Homo sapiens
aaggatgttctggcttta

SEQ ID NO: 3897282 - DNA, 9 bp, Homo sapiens
aaggcaaag

SEQ ID NO: 3897283 - DNA, 12 bp, Homo sapiens
aaggcaactggg

SEQ ID NO: 3897284 - DNA, 20 bp, Homo sapiens
aaggcaagtttctagctaga

SEQ ID NO: 3897285 - DNA, 12 bp, Homo sapiens
aaggcacttgtc

SEQ ID NO: 3897286 - DNA, 14 bp, Homo sapiens
aaggcagcaaggcc

SEQ ID NO: 3897287 - DNA, 16 bp, Homo sapiens
aaggcagcaaggcccg

SEQ ID NO: 3897288 - DNA, 19 bp, Homo sapiens
aaggcagcctccagagcca

SEQ ID NO: 3897289 - DNA, 20 bp, Homo sapiens
aaggcagcctccagagccag

SEQ ID NO: 3897290 - DNA, 23 bp, Homo sapiens
aaggcagcctccagagccagcct

SEQ ID NO: 3897291 - DNA, 14 bp, Homo sapiens
aaggcagggaggag

SEQ ID NO: 3897292 - DNA, 17 bp, Homo sapiens
aaggcatctgacatgca

SEQ ID NO: 3897293 - DNA, 17 bp, Homo sapiens
aaggcccgagcagctga

SEQ ID NO: 3897294 - DNA, 18 bp, Homo sapiens
aaggcctcatctccttta

SEQ ID NO: 3897295 - DNA, 19 bp, Homo sapiens
aaggcctggaaccagggag

SEQ ID NO: 3897296 - DNA, 11 bp, Homo sapiens
aaggcctgggg

SEQ ID NO: 3897297 - DNA, 20 bp, Homo sapiens
aaggcgtgcaaggggctcag

SEQ ID NO: 3897298 - DNA, 23 bp, Homo sapiens
aaggctctgagcaaatgtggctc

SEQ ID NO: 3897299 - DNA, 21 bp, Homo sapiens
aaggctttgccatgggcctgc

SEQ ID NO: 3897300 - DNA, 14 bp, Homo sapiens
aagggacacacaca

SEQ ID NO: 3897301 - DNA, 18 bp, Homo sapiens
aagggacccgaagcccag

SEQ ID NO: 3897302 - DNA, 19 bp, Homo sapiens
aagggacccgaagcccagg

SEQ ID NO: 3897303 - DNA, 18 bp, Homo sapiens
aagggagagggagggagc

SEQ ID NO: 3897304 - DNA, 16 bp, Homo sapiens
aagggaggggtcctga

SEQ ID NO: 3897305 - DNA, 21 bp, Homo sapiens
aagggagttgctcactcagga

SEQ ID NO: 3897306 - DNA, 20 bp, Homo sapiens
aagggcaaaccatttcaaat

SEQ ID NO: 3897307 - DNA, 16 bp, Homo sapiens
aagggcatcaggcact

SEQ ID NO: 3897308 - DNA, 14 bp, Homo sapiens
aagggcatccttct

SEQ ID NO: 3897309 - DNA, 16 bp, Homo sapiens
aagggcattttaaaag

SEQ ID NO: 3897310 - DNA, 14 bp, Homo sapiens
aagggccaggagag

SEQ ID NO: 3897311 - DNA, 18 bp, Homo sapiens
aagggccagtctgggctg

SEQ ID NO: 3897312 - DNA, 19 bp, Homo sapiens
aagggctagaacctggagg

SEQ ID NO: 3897313 - DNA, 12 bp, Homo sapiens
aagggctccagc

SEQ ID NO: 3897314 - DNA, 15 bp, Homo sapiens
aagggctccagcatc

SEQ ID NO: 3897315 - DNA, 22 bp, Homo sapiens
aagggctccagcatccagcctg

SEQ ID NO: 3897316 - DNA, 23 bp, Homo sapiens
aagggctccagcatccagcctgt

SEQ ID NO: 3897317 - DNA, 23 bp, Homo sapiens
aaggggacgcgggctgtgcctta

SEQ ID NO: 3897318 - DNA, 17 bp, Homo sapiens
aaggggacttgtgccag

SEQ ID NO: 3897319 - DNA, 22 bp, Homo sapiens
aaggggagaagggccagcccta

SEQ ID NO: 3897320 - DNA, 21 bp, Homo sapiens
aaggggcacctgggaaaacag

SEQ ID NO: 3897321 - DNA, 22 bp, Homo sapiens
aaggggcccacaaaggggagaa

SEQ ID NO: 3897322 - DNA, 17 bp, Homo sapiens
aaggggccccggggctg

SEQ ID NO: 3897323 - DNA, 12 bp, Homo sapiens
aaggggctgctg

SEQ ID NO: 3897324 - DNA, 22 bp, Homo sapiens
aagggggcggcctatgacttgg

SEQ ID NO: 3897325 - DNA, 18 bp, Homo sapiens
aaggggtgccctctggat

SEQ ID NO: 3897326 - DNA, 22 bp, Homo sapiens
aaggggtgccctctggatcctg

SEQ ID NO: 3897327 - DNA, 13 bp, Homo sapiens
aagggtaaagaag

SEQ ID NO: 3897328 - DNA, 17 bp, Homo sapiens
aagggtctagggagaga

SEQ ID NO: 3897329 - DNA, 15 bp, Homo sapiens
aagggtctgataaac

SEQ ID NO: 3897330 - DNA, 19 bp, Homo sapiens
aataatgtgcaaattttgc

SEQ ID NO: 3897331 - DNA, 18 bp, Homo sapiens
aataatgtgttaaacatg

SEQ ID NO: 3897332 - DNA, 16 bp, Homo sapiens
aataattaggatctat

SEQ ID NO: 3897333 - DNA, 23 bp, Homo sapiens
aataattcttccagtgcaacaaa

SEQ ID NO: 3897334 - DNA, 17 bp, Homo sapiens
aataatttaactaattt

SEQ ID NO: 3897335 - DNA, 23 bp, Homo sapiens
aataatttaactaatttaaacca

SEQ ID NO: 3897336 - DNA, 16 bp, Homo sapiens
aataattttaaacaaa

SEQ ID NO: 3897337 - DNA, 21 bp, Homo sapiens
aatacaaaaaattagccgggc

SEQ ID NO: 3897338 - DNA, 17 bp, Homo sapiens
aatacacaagtaaacat

SEQ ID NO: 3897339 - DNA, 20 bp, Homo sapiens
aatacaccacctcactcctg

SEQ ID NO: 3897340 - DNA, 16 bp, Homo sapiens
aatacaccacgaattt

SEQ ID NO: 3897341 - DNA, 14 bp, Homo sapiens
aatacagtaaagtt

SEQ ID NO: 3897342 - DNA, 19 bp, Homo sapiens
aatacagtaaagtttaaaa

SEQ ID NO: 3897343 - DNA, 22 bp, Homo sapiens
aatacagtaaagtttaaaaaat

SEQ ID NO: 3897344 - DNA, 14 bp, Homo sapiens
aatacatgctgcta

SEQ ID NO: 3897345 - DNA, 19 bp, Homo sapiens
aataccactggttaaaata

SEQ ID NO: 3897346 - DNA, 17 bp, Homo sapiens
aataccagatcactcaa

SEQ ID NO: 3897347 - DNA, 18 bp, Homo sapiens
aataccatgccatttaaa

SEQ ID NO: 3897348 - DNA, 14 bp, Homo sapiens
aatacccccagaga

SEQ ID NO: 3897349 - DNA, 20 bp, Homo sapiens
aatacctttggaaaaatctt

SEQ ID NO: 3897350 - DNA, 16 bp, Homo sapiens
aatacgcactacatgt

SEQ ID NO: 3897351 - DNA, 14 bp, Homo sapiens
aatactaaaatatg

SEQ ID NO: 3897352 - DNA, 15 bp, Homo sapiens
aatactaaaatatgt

SEQ ID NO: 3897353 - DNA, 16 bp, Homo sapiens
aatactaaagtgtcta

SEQ ID NO: 3897354 - DNA, 18 bp, Homo sapiens
aatactaattgagaaaca

SEQ ID NO: 3897355 - DNA, 21 bp, Homo sapiens
aatactagaatggtagcacta

SEQ ID NO: 3897356 - DNA, 16 bp, Homo sapiens
aatactcacctcctcc

SEQ ID NO: 3897357 - DNA, 16 bp, Homo sapiens
aatactccaagcttca

SEQ ID NO: 3897358 - DNA, 17 bp, Homo sapiens
aatactccaagcttcaa

SEQ ID NO: 3897359 - DNA, 23 bp, Homo sapiens
aatactccaagcttcaagtgata

SEQ ID NO: 3897360 - DNA, 12 bp, Homo sapiens
aatactgtacat

SEQ ID NO: 3897361 - DNA, 15 bp, Homo sapiens
aatacttttttctag

SEQ ID NO: 3897362 - DNA, 17 bp, Homo sapiens
aatacttttttctagtt

SEQ ID NO: 3897363 - DNA, 20 bp, Homo sapiens
aatagaaaactgaaaatcta

SEQ ID NO: 3897364 - DNA, 16 bp, Homo sapiens
aatagactaaatgaaa

SEQ ID NO: 3897365 - DNA, 21 bp, Homo sapiens
aatagagtatggttgattccc

SEQ ID NO: 3897366 - DNA, 16 bp, Homo sapiens
aatagatgtgatcact

SEQ ID NO: 3897367 - DNA, 17 bp, Homo sapiens
aatagatttgattattt

SEQ ID NO: 3897368 - DNA, 22 bp, Homo sapiens
aatagccagagaggagcacctg

SEQ ID NO: 3897369 - DNA, 14 bp, Homo sapiens
aatagctattgcat

SEQ ID NO: 3897370 - DNA, 22 bp, Homo sapiens
aatagctattgcatgtaaaatg

SEQ ID NO: 3897371 - DNA, 19 bp, Homo sapiens
aatagcttgtatagtgtaa

SEQ ID NO: 3897372 - DNA, 19 bp, Homo sapiens
aataggatataaaacacat

SEQ ID NO: 3897373 - DNA, 15 bp, Homo sapiens
aataggttaatatca

SEQ ID NO: 3897374 - DNA, 16 bp, Homo sapiens
aatagtcaagaaaaat

SEQ ID NO: 3897375 - DNA, 14 bp, Homo sapiens
aatagtccaatatt

SEQ ID NO: 3897376 - DNA, 16 bp, Homo sapiens
aatagtccaatatttg

SEQ ID NO: 3897377 - DNA, 20 bp, Homo sapiens
aatagtctgtgtgcacaatg

SEQ ID NO: 3897378 - DNA, 13 bp, Homo sapiens
aatataaactgaa

SEQ ID NO: 3897379 - DNA, 12 bp, Homo sapiens
aatataaatgca

SEQ ID NO: 3897380 - DNA, 13 bp, Homo sapiens
aatataaatgcat

SEQ ID NO: 3897381 - DNA, 14 bp, Homo sapiens
aatataaatgcatg

SEQ ID NO: 3897382 - DNA, 17 bp, Homo sapiens
aatataaatgcatgatt

SEQ ID NO: 3897383 - DNA, 18 bp, Homo sapiens
aatataaattaagacttt

SEQ ID NO: 3897384 - DNA, 20 bp, Homo sapiens
aatataaccattacatgttt

SEQ ID NO: 3897385 - DNA, 21 bp, Homo sapiens
aatataaccattacatgttta

SEQ ID NO: 3897386 - DNA, 19 bp, Homo sapiens
aatataatggaagagaaat

SEQ ID NO: 3897387 - DNA, 23 bp, Homo sapiens
aatataatggaagagaaatctca

SEQ ID NO: 3897388 - DNA, 18 bp, Homo sapiens
aatatagagatatttttg

SEQ ID NO: 3897389 - DNA, 21 bp, Homo sapiens
aatatagatcagttataagta

SEQ ID NO: 3897390 - DNA, 14 bp, Homo sapiens
aatatagttctgat

SEQ ID NO: 3897391 - DNA, 18 bp, Homo sapiens
aatatataaaaagaaaag

SEQ ID NO: 3897392 - DNA, 21 bp, Homo sapiens
aatatataaaaagaaaagata

SEQ ID NO: 3897393 - DNA, 13 bp, Homo sapiens
aatatatataaat

SEQ ID NO: 3897394 - DNA, 16 bp, Homo sapiens
aatatatataaatata

SEQ ID NO: 3897395 - DNA, 20 bp, Homo sapiens
aatatatataaatatatatt

SEQ ID NO: 3897396 - DNA, 14 bp, Homo sapiens
aatatatatttttc

SEQ ID NO: 3897397 - DNA, 12 bp, Homo sapiens
aatatatgtctg

SEQ ID NO: 3897398 - DNA, 13 bp, Homo sapiens
aatatattataat

SEQ ID NO: 3897399 - DNA, 16 bp, Homo sapiens
aatatattataatctt

SEQ ID NO: 3897400 - DNA, 16 bp, Homo sapiens
aatatcaatgaagatt

SEQ ID NO: 3897401 - DNA, 18 bp, Homo sapiens
aatatccactgcaatact

SEQ ID NO: 3897402 - DNA, 18 bp, Homo sapiens
aatatctaataaaaagtc

SEQ ID NO: 3897403 - DNA, 12 bp, Homo sapiens
aatatgatttta

SEQ ID NO: 3897404 - DNA, 21 bp, Homo sapiens
aatatgattttttaaaagaaa

SEQ ID NO: 3897405 - DNA, 23 bp, Homo sapiens
aatatgattttttaaaagaaatt

SEQ ID NO: 3897406 - DNA, 15 bp, Homo sapiens
aatatgcaaagcact

SEQ ID NO: 3897407 - DNA, 17 bp, Homo sapiens
aatatgcaaagcactga

SEQ ID NO: 3897408 - DNA, 18 bp, Homo sapiens
aatatggaaccttccctc

SEQ ID NO: 3897409 - DNA, 21 bp, Homo sapiens
aatatggaaccttccctccaa

SEQ ID NO: 3897410 - DNA, 17 bp, Homo sapiens
aatatggactcagtttt

SEQ ID NO: 3897411 - DNA, 13 bp, Homo sapiens
aatatgtatgtct

SEQ ID NO: 3897412 - DNA, 20 bp, Homo sapiens
aatatgtctgccacagagag

SEQ ID NO: 3897413 - DNA, 18 bp, Homo sapiens
aatatgttgagtgttcat

SEQ ID NO: 3897414 - DNA, 22 bp, Homo sapiens
aatatgttgagtgttcatttta

SEQ ID NO: 3897415 - DNA, 16 bp, Homo sapiens
aatattaaatacagac

SEQ ID NO: 3897416 - DNA, 14 bp, Homo sapiens
aatattaccaaaaa

SEQ ID NO: 3897417 - DNA, 22 bp, Homo sapiens
aattcattaaatttctggattt

SEQ ID NO: 3897418 - DNA, 16 bp, Homo sapiens
aattcatttcacttta

SEQ ID NO: 3897419 - DNA, 19 bp, Homo sapiens
aattcatttcactttaaag

SEQ ID NO: 3897420 - DNA, 20 bp, Homo sapiens
aattcatttcactttaaagt

SEQ ID NO: 3897421 - DNA, 20 bp, Homo sapiens
aattcatttcatctactaca

SEQ ID NO: 3897422 - DNA, 21 bp, Homo sapiens
aattcctggcatgacactcta

SEQ ID NO: 3897423 - DNA, 23 bp, Homo sapiens
aattcctgggctcaagcagtcct

SEQ ID NO: 3897424 - DNA, 22 bp, Homo sapiens
aattctacaggatggggacact

SEQ ID NO: 3897425 - DNA, 21 bp, Homo sapiens
aattctcatgtgatcctttta

SEQ ID NO: 3897426 - DNA, 17 bp, Homo sapiens
aattctcttacccagaa

SEQ ID NO: 3897427 - DNA, 21 bp, Homo sapiens
aattctgcaactagccaaggc

SEQ ID NO: 3897428 - DNA, 21 bp, Homo sapiens
aattcttccagtgcaacaaaa

SEQ ID NO: 3897429 - DNA, 13 bp, Homo sapiens
aattcttgaagtt

SEQ ID NO: 3897430 - DNA, 17 bp, Homo sapiens
aattctttacaataaac

SEQ ID NO: 3897431 - DNA, 19 bp, Homo sapiens
aattctttacaataaacat

SEQ ID NO: 3897432 - DNA, 16 bp, Homo sapiens
aattctttatttctgt

SEQ ID NO: 3897433 - DNA, 15 bp, Homo sapiens
aattgagaagggaaa

SEQ ID NO: 3897434 - DNA, 21 bp, Homo sapiens
aattgatcataggtatttcaa

SEQ ID NO: 3897435 - DNA, 22 bp, Homo sapiens
aattgattattctgattccact

SEQ ID NO: 3897436 - DNA, 23 bp, Homo sapiens
aattgattattctgattccactt

SEQ ID NO: 3897437 - DNA, 21 bp, Homo sapiens
aattgattcaagattggacat

SEQ ID NO: 3897438 - DNA, 19 bp, Homo sapiens
aattgcacaatttgagcaa

SEQ ID NO: 3897439 - DNA, 21 bp, Homo sapiens
aattgcacaatttgagcaatt

SEQ ID NO: 3897440 - DNA, 20 bp, Homo sapiens
aattgctcctaagcttcaaa

SEQ ID NO: 3897441 - DNA, 15 bp, Homo sapiens
aattgcttacatttt

SEQ ID NO: 3897442 - DNA, 16 bp, Homo sapiens
aattgcttttgttgtg

SEQ ID NO: 3897443 - DNA, 20 bp, Homo sapiens
aattgcttttgttgtgactt

SEQ ID NO: 3897444 - DNA, 18 bp, Homo sapiens
aattggtgataagtggaa

SEQ ID NO: 3897445 - DNA, 15 bp, Homo sapiens
aattgtaaattttag

SEQ ID NO: 3897446 - DNA, 14 bp, Homo sapiens
aattgtatacattt

SEQ ID NO: 3897447 - DNA, 15 bp, Homo sapiens
aattgtatagagata

SEQ ID NO: 3897448 - DNA, 18 bp, Homo sapiens
aattgtatcatttgaaca

SEQ ID NO: 3897449 - DNA, 12 bp, Homo sapiens
aattgtatgtta

SEQ ID NO: 3897450 - DNA, 13 bp, Homo sapiens
aattgtattttat

SEQ ID NO: 3897451 - DNA, 15 bp, Homo sapiens
aattgtcaaatgtca

SEQ ID NO: 3897452 - DNA, 13 bp, Homo sapiens
aattgtccccagt

SEQ ID NO: 3897453 - DNA, 16 bp, Homo sapiens
aattgtgatgttttgt

SEQ ID NO: 3897454 - DNA, 21 bp, Homo sapiens
aattgtgatgttttgttcaaa

SEQ ID NO: 3897455 - DNA, 21 bp, Homo sapiens
aattgttgattaatttgagaa

SEQ ID NO: 3897456 - DNA, 20 bp, Homo sapiens
aattgtttaagtgttgtaaa

SEQ ID NO: 3897457 - DNA, 17 bp, Homo sapiens
aattgtttggcttcctc

SEQ ID NO: 3897458 - DNA, 20 bp, Homo sapiens
aattgtttgtaagtgaagtg

SEQ ID NO: 3897459 - DNA, 13 bp, Homo sapiens
aatttaaaaaata

SEQ ID NO: 3897460 - DNA, 14 bp, Homo sapiens
aatttaaaaaataa

SEQ ID NO: 3897461 - DNA, 18 bp, Homo sapiens
aatttaactaatttaaac

SEQ ID NO: 3897462 - DNA, 20 bp, Homo sapiens
aatttaactaatttaaacca

SEQ ID NO: 3897463 - DNA, 12 bp, Homo sapiens
aatttagaaaac

SEQ ID NO: 3897464 - DNA, 21 bp, Homo sapiens
aatttagaaaacattcatcca

SEQ ID NO: 3897465 - DNA, 14 bp, Homo sapiens
aatttataaaatta

SEQ ID NO: 3897466 - DNA, 15 bp, Homo sapiens
aatttataaaattag

SEQ ID NO: 3897467 - DNA, 21 bp, Homo sapiens
aatttataaaattagaaagca

SEQ ID NO: 3897468 - DNA, 12 bp, Homo sapiens
aatttatacaaa

SEQ ID NO: 3897469 - DNA, 16 bp, Homo sapiens
aatttatacaaaataa

SEQ ID NO: 3897470 - DNA, 17 bp, Homo sapiens
aatttatacaaaataat

SEQ ID NO: 3897471 - DNA, 18 bp, Homo sapiens
aatttatacaaaataatt

SEQ ID NO: 3897472 - DNA, 19 bp, Homo sapiens
aatttatacaaaataattt

SEQ ID NO: 3897473 - DNA, 16 bp, Homo sapiens
aatttattaagtctgg

SEQ ID NO: 3897474 - DNA, 19 bp, Homo sapiens
aatttattagttaatatat

SEQ ID NO: 3897475 - DNA, 15 bp, Homo sapiens
aatttcaaaagacat

SEQ ID NO: 3897476 - DNA, 14 bp, Homo sapiens
aatttcacattaat

SEQ ID NO: 3897477 - DNA, 23 bp, Homo sapiens
aatttcagtaggctttatgctgt

SEQ ID NO: 3897478 - DNA, 22 bp, Homo sapiens
aatttcatacctatcatcttaa

SEQ ID NO: 3897479 - DNA, 21 bp, Homo sapiens
aatttcccacaccccagcgcc

SEQ ID NO: 3897480 - DNA, 13 bp, Homo sapiens
aatttcccagaag

SEQ ID NO: 3897481 - DNA, 17 bp, Homo sapiens
aatttgagaattattcc

SEQ ID NO: 3897482 - DNA, 15 bp, Homo sapiens
aatttgagcaattca

SEQ ID NO: 3897483 - DNA, 18 bp, Homo sapiens
aatttgagcaattcattt

SEQ ID NO: 3897484 - DNA, 19 bp, Homo sapiens
aatttgagcaattcatttc

SEQ ID NO: 3897485 - DNA, 22 bp, Homo sapiens
aatttgagcaattcatttcact

SEQ ID NO: 3897486 - DNA, 13 bp, Homo sapiens
aatttgaggacaa

SEQ ID NO: 3897487 - DNA, 21 bp, Homo sapiens
aatttgatacatatgtgaata

SEQ ID NO: 3897488 - DNA, 15 bp, Homo sapiens
aatttgatttctatt

SEQ ID NO: 3897489 - DNA, 14 bp, Homo sapiens
aatttgcactgtta

SEQ ID NO: 3897490 - DNA, 12 bp, Homo sapiens
aatttgggcctc

SEQ ID NO: 3897491 - DNA, 21 bp, Homo sapiens
aatttggtgtggctgtattca

SEQ ID NO: 3897492 - DNA, 19 bp, Homo sapiens
aatttgtaattgcttacat

SEQ ID NO: 3897493 - DNA, 14 bp, Homo sapiens
aatttgtatctgaa

SEQ ID NO: 3897494 - DNA, 17 bp, Homo sapiens
aatttgtatctgaagga

SEQ ID NO: 3897495 - DNA, 12 bp, Homo sapiens
aatttgtatttt

SEQ ID NO: 3897496 - DNA, 22 bp, Homo sapiens
aatttgtccaatggctgtaaac

SEQ ID NO: 3897497 - DNA, 23 bp, Homo sapiens
aatttgtccaatggctgtaaact

SEQ ID NO: 3897498 - DNA, 14 bp, Homo sapiens
aattttaaacaaag

SEQ ID NO: 3897499 - DNA, 12 bp, Homo sapiens
aattttaaatta

SEQ ID NO: 3897500 - DNA, 19 bp, Homo sapiens
aattttacaattatggaaa

SEQ ID NO: 3897501 - DNA, 14 bp, Homo sapiens
aattttagagcata

SEQ ID NO: 3897502 - DNA, 12 bp, Homo sapiens
aattttatgaat

SEQ ID NO: 3897503 - DNA, 17 bp, Homo sapiens
acatacatacatatata

SEQ ID NO: 3897504 - DNA, 12 bp, Homo sapiens
acatacatatat

SEQ ID NO: 3897505 - DNA, 13 bp, Homo sapiens
acatacatatata

SEQ ID NO: 3897506 - DNA, 15 bp, Homo sapiens
acatacatatatatc

SEQ ID NO: 3897507 - DNA, 18 bp, Homo sapiens
acatagagatatgcacac

SEQ ID NO: 3897508 - DNA, 15 bp, Homo sapiens
acatagatggaccag

SEQ ID NO: 3897509 - DNA, 18 bp, Homo sapiens
acatagatgtatcattaa

SEQ ID NO: 3897510 - DNA, 21 bp, Homo sapiens
acatagatgtatcattaatgt

SEQ ID NO: 3897511 - DNA, 18 bp, Homo sapiens
acatagattaatggcact

SEQ ID NO: 3897512 - DNA, 16 bp, Homo sapiens
acatatacctataatg

SEQ ID NO: 3897513 - DNA, 19 bp, Homo sapiens
acatatacctataatgtgt

SEQ ID NO: 3897514 - DNA, 20 bp, Homo sapiens
acatatacctataatgtgtg

SEQ ID NO: 3897515 - DNA, 21 bp, Homo sapiens
acatatacctataatgtgtgt

SEQ ID NO: 3897516 - DNA, 22 bp, Homo sapiens
acatatacctataatgtgtgta

SEQ ID NO: 3897517 - DNA, 11 bp, Homo sapiens
acatatatata

SEQ ID NO: 3897518 - DNA, 18 bp, Homo sapiens
acatatatatatacacat

SEQ ID NO: 3897519 - DNA, 15 bp, Homo sapiens
acatatcaattcaac

SEQ ID NO: 3897520 - DNA, 19 bp, Homo sapiens
acatatcaattcaacacat

SEQ ID NO: 3897521 - DNA, 14 bp, Homo sapiens
acatatcagaaaag

SEQ ID NO: 3897522 - DNA, 16 bp, Homo sapiens
acatatcagaaaagta

SEQ ID NO: 3897523 - DNA, 20 bp, Homo sapiens
acatatcagaaaagtagaat

SEQ ID NO: 3897524 - DNA, 21 bp, Homo sapiens
acatatcagaaaagtagaatt

SEQ ID NO: 3897525 - DNA, 17 bp, Homo sapiens
acatatgggtgctggca

SEQ ID NO: 3897526 - DNA, 17 bp, Homo sapiens
acatatgtagactatat

SEQ ID NO: 3897527 - DNA, 20 bp, Homo sapiens
acatatgtagactatataca

SEQ ID NO: 3897528 - DNA, 13 bp, Homo sapiens
acatatgtgaata

SEQ ID NO: 3897529 - DNA, 20 bp, Homo sapiens
acatattataaataaatgcc

SEQ ID NO: 3897530 - DNA, 15 bp, Homo sapiens
acatcaagcatgcaa

SEQ ID NO: 3897531 - DNA, 22 bp, Homo sapiens
acatcaccgacgcgtctcctgt

SEQ ID NO: 3897532 - DNA, 15 bp, Homo sapiens
acatcacttgtacaa

SEQ ID NO: 3897533 - DNA, 22 bp, Homo sapiens
acatcagagtgacatccaggag

SEQ ID NO: 3897534 - DNA, 13 bp, Homo sapiens
acatccatgtcct

SEQ ID NO: 3897535 - DNA, 21 bp, Homo sapiens
acatccatgtcctatgtgtga

SEQ ID NO: 3897536 - DNA, 18 bp, Homo sapiens
acatccatgtttgtaaaa

SEQ ID NO: 3897537 - DNA, 20 bp, Homo sapiens
acatccattcccaagaaatg

SEQ ID NO: 3897538 - DNA, 21 bp, Homo sapiens
acatccattcccaagaaatgc

SEQ ID NO: 3897539 - DNA, 14 bp, Homo sapiens
acatcccactgcca

SEQ ID NO: 3897540 - DNA, 23 bp, Homo sapiens
acatcccaggaggggcctctgaa

SEQ ID NO: 3897541 - DNA, 17 bp, Homo sapiens
acatcccattgccctgg

SEQ ID NO: 3897542 - DNA, 18 bp, Homo sapiens
acatcccggcctcttcca

SEQ ID NO: 3897543 - DNA, 12 bp, Homo sapiens
acatccctgggc

SEQ ID NO: 3897544 - DNA, 19 bp, Homo sapiens
acatccctgggcctgctgc

SEQ ID NO: 3897545 - DNA, 16 bp, Homo sapiens
acatcttatttacttg

SEQ ID NO: 3897546 - DNA, 14 bp, Homo sapiens
acatctttcctgtc

SEQ ID NO: 3897547 - DNA, 18 bp, Homo sapiens
acatctttgaaaagaaaa

SEQ ID NO: 3897548 - DNA, 17 bp, Homo sapiens
acatctttttcctccct

SEQ ID NO: 3897549 - DNA, 20 bp, Homo sapiens
acatctttttcctccctttc

SEQ ID NO: 3897550 - DNA, 13 bp, Homo sapiens
acatgaaacagaa

SEQ ID NO: 3897551 - DNA, 22 bp, Homo sapiens
acatgaacacagctgctgaaga

SEQ ID NO: 3897552 - DNA, 11 bp, Homo sapiens
acatgacactg

SEQ ID NO: 3897553 - DNA, 12 bp, Homo sapiens
acatgacactga

SEQ ID NO: 3897554 - DNA, 16 bp, Homo sapiens
acatgacactgacctt

SEQ ID NO: 3897555 - DNA, 15 bp, Homo sapiens
acatgaccagaaaac

SEQ ID NO: 3897556 - DNA, 20 bp, Homo sapiens
acatgaccagaaaacaaatc

SEQ ID NO: 3897557 - DNA, 14 bp, Homo sapiens
acatgacgtaaaat

SEQ ID NO: 3897558 - DNA, 14 bp, Homo sapiens
acatgacttctgcc

SEQ ID NO: 3897559 - DNA, 19 bp, Homo sapiens
acatgaggactcatatatt

SEQ ID NO: 3897560 - DNA, 15 bp, Homo sapiens
acatgatacccctta

SEQ ID NO: 3897561 - DNA, 19 bp, Homo sapiens
acatgatttagggaagcag

SEQ ID NO: 3897562 - DNA, 21 bp, Homo sapiens
acatgatttagggaagcaggg

SEQ ID NO: 3897563 - DNA, 15 bp, Homo sapiens
acatgcaacccgaag

SEQ ID NO: 3897564 - DNA, 21 bp, Homo sapiens
acatgcaatttattaaaatga

SEQ ID NO: 3897565 - DNA, 18 bp, Homo sapiens
acatgcacatttatatat

SEQ ID NO: 3897566 - DNA, 19 bp, Homo sapiens
acatgcacatttatatata

SEQ ID NO: 3897567 - DNA, 18 bp, Homo sapiens
acatgccaccctctccat

SEQ ID NO: 3897568 - DNA, 15 bp, Homo sapiens
acatgccagcttcct

SEQ ID NO: 3897569 - DNA, 21 bp, Homo sapiens
acatgctgtgctctttgaaga

SEQ ID NO: 3897570 - DNA, 22 bp, Homo sapiens
acatgggaaaggaggcatgcct

SEQ ID NO: 3897571 - DNA, 19 bp, Homo sapiens
acatggggcatagaaactg

SEQ ID NO: 3897572 - DNA, 15 bp, Homo sapiens
acatgtactccagag

SEQ ID NO: 3897573 - DNA, 16 bp, Homo sapiens
acatgtgctattgaac

SEQ ID NO: 3897574 - DNA, 23 bp, Homo sapiens
acatgtgctattgaactgagcca

SEQ ID NO: 3897575 - DNA, 16 bp, Homo sapiens
acatgtgtctgtgtgg

SEQ ID NO: 3897576 - DNA, 13 bp, Homo sapiens
acatgtgtgtata

SEQ ID NO: 3897577 - DNA, 17 bp, Homo sapiens
acatgtgtgtatatatg

SEQ ID NO: 3897578 - DNA, 22 bp, Homo sapiens
acatgtgtgtatatatgtgtat

SEQ ID NO: 3897579 - DNA, 23 bp, Homo sapiens
acatgtgtgtatatatgtgtata

SEQ ID NO: 3897580 - DNA, 15 bp, Homo sapiens
acatgttatatattt

SEQ ID NO: 3897581 - DNA, 14 bp, Homo sapiens
acatgttgtaaatt

SEQ ID NO: 3897582 - DNA, 20 bp, Homo sapiens
acattaaaagaagactggaa

SEQ ID NO: 3897583 - DNA, 15 bp, Homo sapiens
acattaacatctatt

SEQ ID NO: 3897584 - DNA, 20 bp, Homo sapiens
acattaatggtctaaaaata

SEQ ID NO: 3897585 - DNA, 22 bp, Homo sapiens
acattaatgttaattcagcact

SEQ ID NO: 3897586 - DNA, 14 bp, Homo sapiens
acattacttgcaca

SEQ ID NO: 3897587 - DNA, 15 bp, Homo sapiens
acattacttgcacaa

SEQ ID NO: 3897588 - DNA, 16 bp, Homo sapiens
acattacttgcacaag

SEQ ID NO: 3897589 - DNA, 22 bp, Homo sapiens
acattatgtgtgcatgtgtgta

SEQ ID NO: 3897590 - DNA, 23 bp, Homo sapiens
accccgcctcccagccccagggg

SEQ ID NO: 3897591 - DNA, 17 bp, Homo sapiens
accccgcggtgctctgg

SEQ ID NO: 3897592 - DNA, 21 bp, Homo sapiens
accccgcggtgctctggcggc

SEQ ID NO: 3897593 - DNA, 22 bp, Homo sapiens
accccgcggtgctctggcggct

SEQ ID NO: 3897594 - DNA, 15 bp, Homo sapiens
accccggatcgagga

SEQ ID NO: 3897595 - DNA, 14 bp, Homo sapiens
accccgtgccaccc

SEQ ID NO: 3897596 - DNA, 17 bp, Homo sapiens
acccctcactctggcct

SEQ ID NO: 3897597 - DNA, 20 bp, Homo sapiens
acccctccaaagccccacct

SEQ ID NO: 3897598 - DNA, 14 bp, Homo sapiens
acccctgcctgggt

SEQ ID NO: 3897599 - DNA, 15 bp, Homo sapiens
acccctgcctgggtt

SEQ ID NO: 3897600 - DNA, 15 bp, Homo sapiens
acccctggcttttca

SEQ ID NO: 3897601 - DNA, 17 bp, Homo sapiens
acccctggcttttcact

SEQ ID NO: 3897602 - DNA, 18 bp, Homo sapiens
acccctggcttttcactg

SEQ ID NO: 3897603 - DNA, 20 bp, Homo sapiens
acccctggcttttcactgct

SEQ ID NO: 3897604 - DNA, 21 bp, Homo sapiens
acccctggcttttcactgctg

SEQ ID NO: 3897605 - DNA, 16 bp, Homo sapiens
acccctgtacccagct

SEQ ID NO: 3897606 - DNA, 17 bp, Homo sapiens
acccctgtacccagctc

SEQ ID NO: 3897607 - DNA, 17 bp, Homo sapiens
accccttatccaggact

SEQ ID NO: 3897608 - DNA, 23 bp, Homo sapiens
accccttggcttttgcttggcag

SEQ ID NO: 3897609 - DNA, 14 bp, Homo sapiens
acccgaagcccagg

SEQ ID NO: 3897610 - DNA, 18 bp, Homo sapiens
acccgaagcccaggctga

SEQ ID NO: 3897611 - DNA, 23 bp, Homo sapiens
acccgagcccagctacattcctc

SEQ ID NO: 3897612 - DNA, 13 bp, Homo sapiens
acccgctctggac

SEQ ID NO: 3897613 - DNA, 21 bp, Homo sapiens
acccggaggggcctggcagcc

SEQ ID NO: 3897614 - DNA, 22 bp, Homo sapiens
acccggcaccccctgcagcttg

SEQ ID NO: 3897615 - DNA, 22 bp, Homo sapiens
acccggcccagagaccccttcc

SEQ ID NO: 3897616 - DNA, 15 bp, Homo sapiens
accctaaaatgacag

SEQ ID NO: 3897617 - DNA, 16 bp, Homo sapiens
accctaagcctccttt

SEQ ID NO: 3897618 - DNA, 17 bp, Homo sapiens
accctacctgtgcctga

SEQ ID NO: 3897619 - DNA, 18 bp, Homo sapiens
accctacttcttttgctc

SEQ ID NO: 3897620 - DNA, 17 bp, Homo sapiens
accctcaaaccctgtgg

SEQ ID NO: 3897621 - DNA, 14 bp, Homo sapiens
accctcaaatgtca

SEQ ID NO: 3897622 - DNA, 19 bp, Homo sapiens
accctcaaatgtcagagct

SEQ ID NO: 3897623 - DNA, 18 bp, Homo sapiens
accctcagagccacccct

SEQ ID NO: 3897624 - DNA, 21 bp, Homo sapiens
accctccaccgcagaaggaag

SEQ ID NO: 3897625 - DNA, 13 bp, Homo sapiens
accctccagagtg

SEQ ID NO: 3897626 - DNA, 23 bp, Homo sapiens
accctccccaaaacctttcccca

SEQ ID NO: 3897627 - DNA, 23 bp, Homo sapiens
accctcgcagcaggtgcaagaga

SEQ ID NO: 3897628 - DNA, 15 bp, Homo sapiens
accctcgtggacacc

SEQ ID NO: 3897629 - DNA, 21 bp, Homo sapiens
accctctccatgcccaaccta

SEQ ID NO: 3897630 - DNA, 19 bp, Homo sapiens
accctctgaatggtccagg

SEQ ID NO: 3897631 - DNA, 22 bp, Homo sapiens
accctctgaatggtccagggtt

SEQ ID NO: 3897632 - DNA, 16 bp, Homo sapiens
accctctgggcagctg

SEQ ID NO: 3897633 - DNA, 21 bp, Homo sapiens
accctgaatggttccatgcct

SEQ ID NO: 3897634 - DNA, 17 bp, Homo sapiens
accctgaggagtctgag

SEQ ID NO: 3897635 - DNA, 18 bp, Homo sapiens
accctgaggcctctggaa

SEQ ID NO: 3897636 - DNA, 17 bp, Homo sapiens
accctgcctgagcccag

SEQ ID NO: 3897637 - DNA, 19 bp, Homo sapiens
accctgcctgagcccagga

SEQ ID NO: 3897638 - DNA, 10 bp, Homo sapiens
accctggaat

SEQ ID NO: 3897639 - DNA, 19 bp, Homo sapiens
accctggaattcagcaccc

SEQ ID NO: 3897640 - DNA, 16 bp, Homo sapiens
accctggcctgagaag

SEQ ID NO: 3897641 - DNA, 21 bp, Homo sapiens
accctggcttgcttgccgagc

SEQ ID NO: 3897642 - DNA, 20 bp, Homo sapiens
accctgggtgccattcccag

SEQ ID NO: 3897643 - DNA, 21 bp, Homo sapiens
accctgggtgccattcccagc

SEQ ID NO: 3897644 - DNA, 18 bp, Homo sapiens
accctggtgtctcctcca

SEQ ID NO: 3897645 - DNA, 17 bp, Homo sapiens
accctggttactctggt

SEQ ID NO: 3897646 - DNA, 16 bp, Homo sapiens
accctgttttccacac

SEQ ID NO: 3897647 - DNA, 17 bp, Homo sapiens
accctgttttccacacc

SEQ ID NO: 3897648 - DNA, 20 bp, Homo sapiens
accctgttttccacaccatc

SEQ ID NO: 3897649 - DNA, 17 bp, Homo sapiens
acccttcagggccagaa

SEQ ID NO: 3897650 - DNA, 23 bp, Homo sapiens
acccttcccaatcagcactgaaa

SEQ ID NO: 3897651 - DNA, 13 bp, Homo sapiens
acccttctcttct

SEQ ID NO: 3897652 - DNA, 16 bp, Homo sapiens
acccttctttcctctt

SEQ ID NO: 3897653 - DNA, 14 bp, Homo sapiens
acccttgcattaga

SEQ ID NO: 3897654 - DNA, 15 bp, Homo sapiens
acccttgcattagaa

SEQ ID NO: 3897655 - DNA, 16 bp, Homo sapiens
acccttgcattagaaa

SEQ ID NO: 3897656 - DNA, 18 bp, Homo sapiens
acccttgctgctgcccgc

SEQ ID NO: 3897657 - DNA, 14 bp, Homo sapiens
acccttgtacccca

SEQ ID NO: 3897658 - DNA, 17 bp, Homo sapiens
acccttgtaccccatcc

SEQ ID NO: 3897659 - DNA, 18 bp, Homo sapiens
acccttgtaccccatccc

SEQ ID NO: 3897660 - DNA, 18 bp, Homo sapiens
acccttttcctccagaca

SEQ ID NO: 3897661 - DNA, 16 bp, Homo sapiens
accgagaaaaggagaa

SEQ ID NO: 3897662 - DNA, 21 bp, Homo sapiens
accgagacggctggacctgca

SEQ ID NO: 3897663 - DNA, 17 bp, Homo sapiens
accgagagtagccgaga

SEQ ID NO: 3897664 - DNA, 17 bp, Homo sapiens
accgagtctctgtataa

SEQ ID NO: 3897665 - DNA, 15 bp, Homo sapiens
accgcagaaggaagg

SEQ ID NO: 3897666 - DNA, 23 bp, Homo sapiens
accgcagccagccggtgcctggc

SEQ ID NO: 3897667 - DNA, 16 bp, Homo sapiens
accgccgcagggacgg

SEQ ID NO: 3897668 - DNA, 20 bp, Homo sapiens
accgcgagactgagaggcag

SEQ ID NO: 3897669 - DNA, 19 bp, Homo sapiens
accgcgtagagagccgggc

SEQ ID NO: 3897670 - DNA, 17 bp, Homo sapiens
accgctacaccactctg

SEQ ID NO: 3897671 - DNA, 19 bp, Homo sapiens
accgctgcctaagtggctg

SEQ ID NO: 3897672 - DNA, 20 bp, Homo sapiens
accgctgcctaagtggctgc

SEQ ID NO: 3897673 - DNA, 21 bp, Homo sapiens
accgctgcctaagtggctgct

SEQ ID NO: 3897674 - DNA, 22 bp, Homo sapiens
accgctgccttttgctgctgct

SEQ ID NO: 3897675 - DNA, 16 bp, Homo sapiens
accgctggggaacaga

SEQ ID NO: 3897676 - DNA, 16 bp, Homo sapiens
acgttaaaagacagtg

SEQ ID NO: 3897677 - DNA, 14 bp, Homo sapiens
acgttatatattgt

SEQ ID NO: 3897678 - DNA, 15 bp, Homo sapiens
acgttatatattgta

SEQ ID NO: 3897679 - DNA, 19 bp, Homo sapiens
acgttatatattgtattaa

SEQ ID NO: 3897680 - DNA, 14 bp, Homo sapiens
acgttcctaagctg

SEQ ID NO: 3897681 - DNA, 18 bp, Homo sapiens
acgttccttactgcagaa

SEQ ID NO: 3897682 - DNA, 20 bp, Homo sapiens
acgttccttactgcagaata

SEQ ID NO: 3897683 - DNA, 21 bp, Homo sapiens
acgttccttactgcagaatag

SEQ ID NO: 3897684 - DNA, 16 bp, Homo sapiens
acgttctccagcccac

SEQ ID NO: 3897685 - DNA, 14 bp, Homo sapiens
actaaaaagtggct

SEQ ID NO: 3897686 - DNA, 20 bp, Homo sapiens
actaaaaagtggctaattca

SEQ ID NO: 3897687 - DNA, 14 bp, Homo sapiens
actaaaagaatttg

SEQ ID NO: 3897688 - DNA, 20 bp, Homo sapiens
actaaaagttcttctccaat

SEQ ID NO: 3897689 - DNA, 14 bp, Homo sapiens
actaaaatatttat

SEQ ID NO: 3897690 - DNA, 14 bp, Homo sapiens
actaaagtatgtaa

SEQ ID NO: 3897691 - DNA, 22 bp, Homo sapiens
actaaagtatgtaaagtatgta

SEQ ID NO: 3897692 - DNA, 13 bp, Homo sapiens
actaaatatatgt

SEQ ID NO: 3897693 - DNA, 17 bp, Homo sapiens
actaaatatatgtctgt

SEQ ID NO: 3897694 - DNA, 21 bp, Homo sapiens
actaaatatatgtctgtgtgt

SEQ ID NO: 3897695 - DNA, 14 bp, Homo sapiens
actaaatctctaat

SEQ ID NO: 3897696 - DNA, 16 bp, Homo sapiens
actaaatctctaatat

SEQ ID NO: 3897697 - DNA, 18 bp, Homo sapiens
actaaattgtatacattt

SEQ ID NO: 3897698 - DNA, 18 bp, Homo sapiens
actaacactcagaagcct

SEQ ID NO: 3897699 - DNA, 17 bp, Homo sapiens
actaacataaaatctgt

SEQ ID NO: 3897700 - DNA, 22 bp, Homo sapiens
actaagccctgtcgagacactt

SEQ ID NO: 3897701 - DNA, 17 bp, Homo sapiens
actaagctttctccttt

SEQ ID NO: 3897702 - DNA, 15 bp, Homo sapiens
actaattaaaatctg

SEQ ID NO: 3897703 - DNA, 17 bp, Homo sapiens
actaatttaaaccagca

SEQ ID NO: 3897704 - DNA, 15 bp, Homo sapiens
actacagaataatgt

SEQ ID NO: 3897705 - DNA, 19 bp, Homo sapiens
actacatgtggtttataga

SEQ ID NO: 3897706 - DNA, 21 bp, Homo sapiens
actaccaagaggccctgtctg

SEQ ID NO: 3897707 - DNA, 21 bp, Homo sapiens
actaccagctaactccagtct

SEQ ID NO: 3897708 - DNA, 16 bp, Homo sapiens
actacccgagcccagc

SEQ ID NO: 3897709 - DNA, 17 bp, Homo sapiens
actactgctgcaaagtg

SEQ ID NO: 3897710 - DNA, 14 bp, Homo sapiens
actactgtaattaa

SEQ ID NO: 3897711 - DNA, 17 bp, Homo sapiens
actacttcttggaaaaa

SEQ ID NO: 3897712 - DNA, 16 bp, Homo sapiens
actacttgttaccttt

SEQ ID NO: 3897713 - DNA, 16 bp, Homo sapiens
actactttttatactc

SEQ ID NO: 3897714 - DNA, 17 bp, Homo sapiens
actactttttatactcc

SEQ ID NO: 3897715 - DNA, 16 bp, Homo sapiens
actagaaagctctgca

SEQ ID NO: 3897716 - DNA, 18 bp, Homo sapiens
actagaatttgtattttg

SEQ ID NO: 3897717 - DNA, 19 bp, Homo sapiens
actagagctgggaaacagg

SEQ ID NO: 3897718 - DNA, 15 bp, Homo sapiens
actagagctttcttt

SEQ ID NO: 3897719 - DNA, 14 bp, Homo sapiens
actagaggcaggga

SEQ ID NO: 3897720 - DNA, 22 bp, Homo sapiens
actagggtcctggccctcttct

SEQ ID NO: 3897721 - DNA, 21 bp, Homo sapiens
actagggtgagggttttctgt

SEQ ID NO: 3897722 - DNA, 21 bp, Homo sapiens
actaggttctaggtcctggct

SEQ ID NO: 3897723 - DNA, 15 bp, Homo sapiens
actagtttccagtgg

SEQ ID NO: 3897724 - DNA, 20 bp, Homo sapiens
actataaacattaaaagaag

SEQ ID NO: 3897725 - DNA, 20 bp, Homo sapiens
actataaactactgtaatta

SEQ ID NO: 3897726 - DNA, 18 bp, Homo sapiens
actataaaggttgacaat

SEQ ID NO: 3897727 - DNA, 15 bp, Homo sapiens
actataatgtgatga

SEQ ID NO: 3897728 - DNA, 20 bp, Homo sapiens
actatagcccaggtcctctg

SEQ ID NO: 3897729 - DNA, 15 bp, Homo sapiens
actatatacatgtgt

SEQ ID NO: 3897730 - DNA, 21 bp, Homo sapiens
actatatacatgtgtgtatat

SEQ ID NO: 3897731 - DNA, 18 bp, Homo sapiens
actatcaatatttaagtt

SEQ ID NO: 3897732 - DNA, 11 bp, Homo sapiens
actatcacata

SEQ ID NO: 3897733 - DNA, 21 bp, Homo sapiens
actatcacatacaatttgcac

SEQ ID NO: 3897734 - DNA, 23 bp, Homo sapiens
actatcacatacaatttgcactg

SEQ ID NO: 3897735 - DNA, 22 bp, Homo sapiens
actatcagtttgtcctgtagag

SEQ ID NO: 3897736 - DNA, 15 bp, Homo sapiens
actatgatcacagtg

SEQ ID NO: 3897737 - DNA, 15 bp, Homo sapiens
actatgctatttctg

SEQ ID NO: 3897738 - DNA, 13 bp, Homo sapiens
actatgctgaaga

SEQ ID NO: 3897739 - DNA, 19 bp, Homo sapiens
actatggagcctggcacag

SEQ ID NO: 3897740 - DNA, 23 bp, Homo sapiens
actatggagcctggcacaggact

SEQ ID NO: 3897741 - DNA, 18 bp, Homo sapiens
actatggtatgctggcca

SEQ ID NO: 3897742 - DNA, 20 bp, Homo sapiens
actatggtatgctggccagc

SEQ ID NO: 3897743 - DNA, 21 bp, Homo sapiens
actatggtatgctggccagca

SEQ ID NO: 3897744 - DNA, 22 bp, Homo sapiens
actatggtatgctggccagcac

SEQ ID NO: 3897745 - DNA, 21 bp, Homo sapiens
actattcaaacagtctcagga

SEQ ID NO: 3897746 - DNA, 14 bp, Homo sapiens
actattgtttaaaa

SEQ ID NO: 3897747 - DNA, 15 bp, Homo sapiens
actatttaacttgag

SEQ ID NO: 3897748 - DNA, 12 bp, Homo sapiens
actatttatctg

SEQ ID NO: 3897749 - DNA, 22 bp, Homo sapiens
actatttcccttgaaattttaa

SEQ ID NO: 3897750 - DNA, 15 bp, Homo sapiens
actcaaaacttaaca

SEQ ID NO: 3897751 - DNA, 15 bp, Homo sapiens
actcaaaatatttgt

SEQ ID NO: 3897752 - DNA, 20 bp, Homo sapiens
actcaaaatatttgtacata

SEQ ID NO: 3897753 - DNA, 14 bp, Homo sapiens
actcaaatcaagaa

SEQ ID NO: 3897754 - DNA, 16 bp, Homo sapiens
actcaacaataaagac

SEQ ID NO: 3897755 - DNA, 20 bp, Homo sapiens
actcaatatgtgatttttgt

SEQ ID NO: 3897756 - DNA, 22 bp, Homo sapiens
actcaatatgtgatttttgtga

SEQ ID NO: 3897757 - DNA, 23 bp, Homo sapiens
actcaatctccccttgcactaaa

SEQ ID NO: 3897758 - DNA, 14 bp, Homo sapiens
actcacacaggcat

SEQ ID NO: 3897759 - DNA, 19 bp, Homo sapiens
actcacacaggcatttcct

SEQ ID NO: 3897760 - DNA, 12 bp, Homo sapiens
actcacccaagc

SEQ ID NO: 3897761 - DNA, 11 bp, Homo sapiens
actcacctctg

SEQ ID NO: 3897762 - DNA, 17 bp, Homo sapiens
actgttactttttagtc

SEQ ID NO: 3897763 - DNA, 20 bp, Homo sapiens
actgttactttttagtcttt

SEQ ID NO: 3897764 - DNA, 21 bp, Homo sapiens
actgttactttttagtctttt

SEQ ID NO: 3897765 - DNA, 16 bp, Homo sapiens
actgttattgaaaata

SEQ ID NO: 3897766 - DNA, 23 bp, Homo sapiens
actgttctgtgtgggtctgggga

SEQ ID NO: 3897767 - DNA, 13 bp, Homo sapiens
actgttgaaaatt

SEQ ID NO: 3897768 - DNA, 14 bp, Homo sapiens
actgttgaaaatta

SEQ ID NO: 3897769 - DNA, 12 bp, Homo sapiens
actgttgctcaa

SEQ ID NO: 3897770 - DNA, 15 bp, Homo sapiens
actgttgtacaagct

SEQ ID NO: 3897771 - DNA, 14 bp, Homo sapiens
acttaaaaaaatga

SEQ ID NO: 3897772 - DNA, 15 bp, Homo sapiens
acttaaaaaaatgac

SEQ ID NO: 3897773 - DNA, 13 bp, Homo sapiens
acttaaaaaactt

SEQ ID NO: 3897774 - DNA, 15 bp, Homo sapiens
acttaacggctccag

SEQ ID NO: 3897775 - DNA, 22 bp, Homo sapiens
acttaactgtgtgaagaaatgg

SEQ ID NO: 3897776 - DNA, 13 bp, Homo sapiens
acttaagagaaat

SEQ ID NO: 3897777 - DNA, 13 bp, Homo sapiens
acttaagcaaaag

SEQ ID NO: 3897778 - DNA, 16 bp, Homo sapiens
acttacacttggagcc

SEQ ID NO: 3897779 - DNA, 22 bp, Homo sapiens
acttacagagcgtggctgtgct

SEQ ID NO: 3897780 - DNA, 19 bp, Homo sapiens
acttacctaaacagatata

SEQ ID NO: 3897781 - DNA, 16 bp, Homo sapiens
acttactcccattttc

SEQ ID NO: 3897782 - DNA, 17 bp, Homo sapiens
acttagaataaaattgt

SEQ ID NO: 3897783 - DNA, 18 bp, Homo sapiens
acttagaataaaattgta

SEQ ID NO: 3897784 - DNA, 22 bp, Homo sapiens
acttagcccaagaggtctgagc

SEQ ID NO: 3897785 - DNA, 16 bp, Homo sapiens
acttagctatcagaag

SEQ ID NO: 3897786 - DNA, 20 bp, Homo sapiens
acttataagtgggagctaaa

SEQ ID NO: 3897787 - DNA, 15 bp, Homo sapiens
acttataccaaaggg

SEQ ID NO: 3897788 - DNA, 18 bp, Homo sapiens
acttatctagaaagaaaa

SEQ ID NO: 3897789 - DNA, 21 bp, Homo sapiens
acttatctagaaagaaaagac

SEQ ID NO: 3897790 - DNA, 19 bp, Homo sapiens
acttatgctagtttattgg

SEQ ID NO: 3897791 - DNA, 22 bp, Homo sapiens
acttattaatctgtatgaagat

SEQ ID NO: 3897792 - DNA, 19 bp, Homo sapiens
acttatttttgacagtgtt

SEQ ID NO: 3897793 - DNA, 13 bp, Homo sapiens
acttcacaaaatg

SEQ ID NO: 3897794 - DNA, 16 bp, Homo sapiens
acttcacactgcaaga

SEQ ID NO: 3897795 - DNA, 19 bp, Homo sapiens
acttcacactgcaagagcc

SEQ ID NO: 3897796 - DNA, 17 bp, Homo sapiens
acttcagaacatgctgg

SEQ ID NO: 3897797 - DNA, 19 bp, Homo sapiens
acttcagaacatgctggat

SEQ ID NO: 3897798 - DNA, 12 bp, Homo sapiens
acttcagcccag

SEQ ID NO: 3897799 - DNA, 13 bp, Homo sapiens
acttcagcccagc

SEQ ID NO: 3897800 - DNA, 12 bp, Homo sapiens
acttcaggtgct

SEQ ID NO: 3897801 - DNA, 17 bp, Homo sapiens
acttcaggttgttctgt

SEQ ID NO: 3897802 - DNA, 20 bp, Homo sapiens
acttccaaacctgacagatg

SEQ ID NO: 3897803 - DNA, 17 bp, Homo sapiens
acttccatgaggccaaa

SEQ ID NO: 3897804 - DNA, 19 bp, Homo sapiens
acttcccattttggaagtt

SEQ ID NO: 3897805 - DNA, 14 bp, Homo sapiens
acttccctgggaac

SEQ ID NO: 3897806 - DNA, 12 bp, Homo sapiens
acttcctcctga

SEQ ID NO: 3897807 - DNA, 18 bp, Homo sapiens
acttcctggggccccgct

SEQ ID NO: 3897808 - DNA, 22 bp, Homo sapiens
acttcctggtgaggcccagcct

SEQ ID NO: 3897809 - DNA, 20 bp, Homo sapiens
acttcgaccctttctctgag

SEQ ID NO: 3897810 - DNA, 15 bp, Homo sapiens
acttcgactcaggat

SEQ ID NO: 3897811 - DNA, 15 bp, Homo sapiens
acttctaaatgaagt

SEQ ID NO: 3897812 - DNA, 16 bp, Homo sapiens
acttctaaatgaagtg

SEQ ID NO: 3897813 - DNA, 13 bp, Homo sapiens
acttctaagtaaa

SEQ ID NO: 3897814 - DNA, 21 bp, Homo sapiens
acttctaagtaaaaccacagc

SEQ ID NO: 3897815 - DNA, 23 bp, Homo sapiens
acttctaagtaaaaccacagcag

SEQ ID NO: 3897816 - DNA, 11 bp, Homo sapiens
acttctaatat

SEQ ID NO: 3897817 - DNA, 22 bp, Homo sapiens
acttctaatatatttttatatt

SEQ ID NO: 3897818 - DNA, 18 bp, Homo sapiens
acttctcaggacacaggc

SEQ ID NO: 3897819 - DNA, 21 bp, Homo sapiens
acttctcaggacacaggcctg

SEQ ID NO: 3897820 - DNA, 22 bp, Homo sapiens
acttctcaggacacaggcctgt

SEQ ID NO: 3897821 - DNA, 12 bp, Homo sapiens
acttctgcagct

SEQ ID NO: 3897822 - DNA, 17 bp, Homo sapiens
acttctgccccagcttt

SEQ ID NO: 3897823 - DNA, 20 bp, Homo sapiens
acttctgccccagctttatc

SEQ ID NO: 3897824 - DNA, 13 bp, Homo sapiens
acttctggaaggc

SEQ ID NO: 3897825 - DNA, 22 bp, Homo sapiens
acttctgtcttcacaacagatt

SEQ ID NO: 3897826 - DNA, 20 bp, Homo sapiens
acttcttaaaggcctggaac

SEQ ID NO: 3897827 - DNA, 21 bp, Homo sapiens
acttcttaaaggcctggaacc

SEQ ID NO: 3897828 - DNA, 18 bp, Homo sapiens
acttcttgaaacagcctg

SEQ ID NO: 3897829 - DNA, 24 bp, Homo sapiens
acttcttgaaacagcctgggtgac

SEQ ID NO: 3897830 - DNA, 12 bp, Homo sapiens
acttcttggaaa

SEQ ID NO: 3897831 - DNA, 21 bp, Homo sapiens
acttcttggaaaaaaattaca

SEQ ID NO: 3897832 - DNA, 21 bp, Homo sapiens
acttcttggtttggggagaaa

SEQ ID NO: 3897833 - DNA, 20 bp, Homo sapiens
acttcttttgctcttagctg

SEQ ID NO: 3897834 - DNA, 20 bp, Homo sapiens
acttgaactttccaaaacct

SEQ ID NO: 3897835 - DNA, 23 bp, Homo sapiens
acttgaatctgttactgaaatga

SEQ ID NO: 3897836 - DNA, 19 bp, Homo sapiens
acttgacaacatcccacag

SEQ ID NO: 3897837 - DNA, 13 bp, Homo sapiens
acttgacattcct

SEQ ID NO: 3897838 - DNA, 20 bp, Homo sapiens
acttgagcaccgtcatggct

SEQ ID NO: 3897839 - DNA, 13 bp, Homo sapiens
acttgaggacaca

SEQ ID NO: 3897840 - DNA, 19 bp, Homo sapiens
acttgaggacacatgtcca

SEQ ID NO: 3897841 - DNA, 18 bp, Homo sapiens
acttgagttacaccagac

SEQ ID NO: 3897842 - DNA, 20 bp, Homo sapiens
acttgccttcttcacccagc

SEQ ID NO: 3897843 - DNA, 14 bp, Homo sapiens
acttgcgtcctgca

SEQ ID NO: 3897844 - DNA, 17 bp, Homo sapiens
acttgcgtcctgcagag

SEQ ID NO: 3897845 - DNA, 23 bp, Homo sapiens
acttgctctctggccttttccta

SEQ ID NO: 3897846 - DNA, 21 bp, Homo sapiens
acttggaaaaatccagaaaga

SEQ ID NO: 3897847 - DNA, 22 bp, Homo sapiens
acttggagagggacgaagaaag

SEQ ID NO: 3897848 - DNA, 13 bp, Homo sapiens
agaattttaaatt

SEQ ID NO: 3897849 - DNA, 18 bp, Homo sapiens
agaattttaaattataac

SEQ ID NO: 3897850 - DNA, 17 bp, Homo sapiens
agaattttagaagagat

SEQ ID NO: 3897851 - DNA, 20 bp, Homo sapiens
agaatttttaatgacttttt

SEQ ID NO: 3897852 - DNA, 21 bp, Homo sapiens
agaatttttaatgacttttta

SEQ ID NO: 3897853 - DNA, 17 bp, Homo sapiens
agacaaaccactgtaca

SEQ ID NO: 3897854 - DNA, 19 bp, Homo sapiens
agacaaaccactgtacata

SEQ ID NO: 3897855 - DNA, 21 bp, Homo sapiens
agacaaaccactgtacatata

SEQ ID NO: 3897856 - DNA, 17 bp, Homo sapiens
agacaactcttccattt

SEQ ID NO: 3897857 - DNA, 13 bp, Homo sapiens
agacaagccctgg

SEQ ID NO: 3897858 - DNA, 18 bp, Homo sapiens
agacaagccctggcaaca

SEQ ID NO: 3897859 - DNA, 14 bp, Homo sapiens
agacaattcagaag

SEQ ID NO: 3897860 - DNA, 21 bp, Homo sapiens
agacacagagtggagccctca

SEQ ID NO: 3897861 - DNA, 22 bp, Homo sapiens
agacacagagtggagccctcag

SEQ ID NO: 3897862 - DNA, 23 bp, Homo sapiens
agacacagagtggagccctcagt

SEQ ID NO: 3897863 - DNA, 15 bp, Homo sapiens
agacacagatacatg

SEQ ID NO: 3897864 - DNA, 18 bp, Homo sapiens
agacacagcgtccctagc

SEQ ID NO: 3897865 - DNA, 23 bp, Homo sapiens
agacacaggtgcctcacgcctgt

SEQ ID NO: 3897866 - DNA, 17 bp, Homo sapiens
agacacatcaaatgccc

SEQ ID NO: 3897867 - DNA, 20 bp, Homo sapiens
agacacattctcctgtgccc

SEQ ID NO: 3897868 - DNA, 18 bp, Homo sapiens
agacacccaagtccaggc

SEQ ID NO: 3897869 - DNA, 21 bp, Homo sapiens
agacaccttttgtatttaaaa

SEQ ID NO: 3897870 - DNA, 15 bp, Homo sapiens
agacactcccaggga

SEQ ID NO: 3897871 - DNA, 16 bp, Homo sapiens
agacactcccagggac

SEQ ID NO: 3897872 - DNA, 17 bp, Homo sapiens
agacactcccagggaca

SEQ ID NO: 3897873 - DNA, 21 bp, Homo sapiens
agacagaaaaaaataaaaaca

SEQ ID NO: 3897874 - DNA, 14 bp, Homo sapiens
agacagaaacagag

SEQ ID NO: 3897875 - DNA, 20 bp, Homo sapiens
agacagaaacagagagagac

SEQ ID NO: 3897876 - DNA, 23 bp, Homo sapiens
agacagaaacagagagagacaga

SEQ ID NO: 3897877 - DNA, 17 bp, Homo sapiens
agacagaacccctacat

SEQ ID NO: 3897878 - DNA, 15 bp, Homo sapiens
agacagaatgtcacc

SEQ ID NO: 3897879 - DNA, 19 bp, Homo sapiens
agacagaccccttggcttt

SEQ ID NO: 3897880 - DNA, 17 bp, Homo sapiens
agacagagagagactga

SEQ ID NO: 3897881 - DNA, 19 bp, Homo sapiens
agacagagcccccaagcct

SEQ ID NO: 3897882 - DNA, 20 bp, Homo sapiens
agacagagcccccaagcctc

SEQ ID NO: 3897883 - DNA, 16 bp, Homo sapiens
agacagatcccatcca

SEQ ID NO: 3897884 - DNA, 19 bp, Homo sapiens
agacaggaaaatcctctgg

SEQ ID NO: 3897885 - DNA, 14 bp, Homo sapiens
agacaggagaaatg

SEQ ID NO: 3897886 - DNA, 14 bp, Homo sapiens
agacaggagggcaa

SEQ ID NO: 3897887 - DNA, 23 bp, Homo sapiens
agacaggagggcaagggccatgc

SEQ ID NO: 3897888 - DNA, 15 bp, Homo sapiens
agacaggcccaagag

SEQ ID NO: 3897889 - DNA, 21 bp, Homo sapiens
agacaggcgctggacagaggg

SEQ ID NO: 3897890 - DNA, 22 bp, Homo sapiens
agacagggcaatcttgtccaca

SEQ ID NO: 3897891 - DNA, 18 bp, Homo sapiens
agacagtatatttatagt

SEQ ID NO: 3897892 - DNA, 22 bp, Homo sapiens
agacagtggatcatgaaaagtg

SEQ ID NO: 3897893 - DNA, 15 bp, Homo sapiens
agacagttcaagaaa

SEQ ID NO: 3897894 - DNA, 18 bp, Homo sapiens
agacatacgaaacacaaa

SEQ ID NO: 3897895 - DNA, 17 bp, Homo sapiens
agacatgaatgcacact

SEQ ID NO: 3897896 - DNA, 13 bp, Homo sapiens
agacatggagact

SEQ ID NO: 3897897 - DNA, 19 bp, Homo sapiens
agacatggagactcctgcc

SEQ ID NO: 3897898 - DNA, 22 bp, Homo sapiens
agacatggagactcctgccctg

SEQ ID NO: 3897899 - DNA, 17 bp, Homo sapiens
agacatgttgtaaatta

SEQ ID NO: 3897900 - DNA, 17 bp, Homo sapiens
agacatttttatttagt

SEQ ID NO: 3897901 - DNA, 14 bp, Homo sapiens
agaccaacctgacc

SEQ ID NO: 3897902 - DNA, 17 bp, Homo sapiens
agaccaagactctgaaa

SEQ ID NO: 3897903 - DNA, 17 bp, Homo sapiens
agaccacctctcaatat

SEQ ID NO: 3897904 - DNA, 12 bp, Homo sapiens
agaccacctgcc

SEQ ID NO: 3897905 - DNA, 14 bp, Homo sapiens
agaccacctgccag

SEQ ID NO: 3897906 - DNA, 18 bp, Homo sapiens
agaccactgtcctggctg

SEQ ID NO: 3897907 - DNA, 20 bp, Homo sapiens
agaccactgtcctggctgct

SEQ ID NO: 3897908 - DNA, 17 bp, Homo sapiens
agaccagactgtggaga

SEQ ID NO: 3897909 - DNA, 18 bp, Homo sapiens
agaccagggcttttccca

SEQ ID NO: 3897910 - DNA, 18 bp, Homo sapiens
agaccagttgggagcact

SEQ ID NO: 3897911 - DNA, 19 bp, Homo sapiens
agaccagttgggagcactg

SEQ ID NO: 3897912 - DNA, 20 bp, Homo sapiens
agaccagttgggagcactgg

SEQ ID NO: 3897913 - DNA, 21 bp, Homo sapiens
agaccagttgggagcactgga

SEQ ID NO: 3897914 - DNA, 23 bp, Homo sapiens
agaccagttgggagcactggagt

SEQ ID NO: 3897915 - DNA, 16 bp, Homo sapiens
agaccatcctggcccc

SEQ ID NO: 3897916 - DNA, 21 bp, Homo sapiens
agaccatcctggcccctccag

SEQ ID NO: 3897917 - DNA, 21 bp, Homo sapiens
agaccattgtcttccaacccc

SEQ ID NO: 3897918 - DNA, 16 bp, Homo sapiens
agacccaaggaggaaa

SEQ ID NO: 3897919 - DNA, 14 bp, Homo sapiens
agacccacacatgt

SEQ ID NO: 3897920 - DNA, 16 bp, Homo sapiens
agacccagtgtaaaga

SEQ ID NO: 3897921 - DNA, 23 bp, Homo sapiens
agacccagtgtaaagaataaatg

SEQ ID NO: 3897922 - DNA, 16 bp, Homo sapiens
agacccattcctattt

SEQ ID NO: 3897923 - DNA, 13 bp, Homo sapiens
agacccccactct

SEQ ID NO: 3897924 - DNA, 14 bp, Homo sapiens
agacccctggcttt

SEQ ID NO: 3897925 - DNA, 13 bp, Homo sapiens
agaccccttcctt

SEQ ID NO: 3897926 - DNA, 13 bp, Homo sapiens
agaccctgcctga

SEQ ID NO: 3897927 - DNA, 20 bp, Homo sapiens
agaccgggggccagacacag

SEQ ID NO: 3897928 - DNA, 18 bp, Homo sapiens
agacctagacctgggcca

SEQ ID NO: 3897929 - DNA, 14 bp, Homo sapiens
agacctcagccatg

SEQ ID NO: 3897930 - DNA, 13 bp, Homo sapiens
agacctccacatt

SEQ ID NO: 3897931 - DNA, 17 bp, Homo sapiens
agaccttttctctccca

SEQ ID NO: 3897932 - DNA, 21 bp, Homo sapiens
agacgcagccctgggggccag

SEQ ID NO: 3897933 - DNA, 23 bp, Homo sapiens
agacgcagccctgggggccagct

SEQ ID NO: 3897934 - DNA, 22 bp, Homo sapiens
agagtgaaataattaaaaacca

SEQ ID NO: 3897935 - DNA, 18 bp, Homo sapiens
agagtgactccaagaaca

SEQ ID NO: 3897936 - DNA, 15 bp, Homo sapiens
agagtgagaatctgg

SEQ ID NO: 3897937 - DNA, 17 bp, Homo sapiens
agagtggagccctcagt

SEQ ID NO: 3897938 - DNA, 16 bp, Homo sapiens
agagtggagtctgagt

SEQ ID NO: 3897939 - DNA, 17 bp, Homo sapiens
agagtggagtctgagtc

SEQ ID NO: 3897940 - DNA, 18 bp, Homo sapiens
agagtggagtctgagtct

SEQ ID NO: 3897941 - DNA, 24 bp, Homo sapiens
agagtggcccctcacctgggcctt

SEQ ID NO: 3897942 - DNA, 12 bp, Homo sapiens
agagtggctcct

SEQ ID NO: 3897943 - DNA, 15 bp, Homo sapiens
agagtggctcctccc

SEQ ID NO: 3897944 - DNA, 19 bp, Homo sapiens
agagttattgaatcttaat

SEQ ID NO: 3897945 - DNA, 21 bp, Homo sapiens
agagttgaccgttttcatcct

SEQ ID NO: 3897946 - DNA, 17 bp, Homo sapiens
agagttgctttaaagta

SEQ ID NO: 3897947 - DNA, 18 bp, Homo sapiens
agagttggctcaggcaga

SEQ ID NO: 3897948 - DNA, 14 bp, Homo sapiens
agagtttaacacaa

SEQ ID NO: 3897949 - DNA, 13 bp, Homo sapiens
agagtttgaagga

SEQ ID NO: 3897950 - DNA, 19 bp, Homo sapiens
agagtttgaaggaggtgag

SEQ ID NO: 3897951 - DNA, 11 bp, Homo sapiens
agataaagatg

SEQ ID NO: 3897952 - DNA, 21 bp, Homo sapiens
agataacaagatctttcagga

SEQ ID NO: 3897953 - DNA, 14 bp, Homo sapiens
agataactgagaat

SEQ ID NO: 3897954 - DNA, 14 bp, Homo sapiens
agataatcagcctc

SEQ ID NO: 3897955 - DNA, 15 bp, Homo sapiens
agataatcagcctct

SEQ ID NO: 3897956 - DNA, 15 bp, Homo sapiens
agatacactcctgct

SEQ ID NO: 3897957 - DNA, 23 bp, Homo sapiens
agatacagccccaaaccagggtg

SEQ ID NO: 3897958 - DNA, 16 bp, Homo sapiens
agataccatactcatt

SEQ ID NO: 3897959 - DNA, 15 bp, Homo sapiens
agatacggttgcttc

SEQ ID NO: 3897960 - DNA, 17 bp, Homo sapiens
agatagaaagcaataaa

SEQ ID NO: 3897961 - DNA, 16 bp, Homo sapiens
agatagccagacacat

SEQ ID NO: 3897962 - DNA, 17 bp, Homo sapiens
agatagccagacacatg

SEQ ID NO: 3897963 - DNA, 14 bp, Homo sapiens
agatagttaaaaga

SEQ ID NO: 3897964 - DNA, 21 bp, Homo sapiens
agatagttaaaagactgcagc

SEQ ID NO: 3897965 - DNA, 22 bp, Homo sapiens
agatagttaaaagactgcagct

SEQ ID NO: 3897966 - DNA, 23 bp, Homo sapiens
agatagttaaaagactgcagctg

SEQ ID NO: 3897967 - DNA, 12 bp, Homo sapiens
agatataaaatc

SEQ ID NO: 3897968 - DNA, 15 bp, Homo sapiens
agatatatttttcac

SEQ ID NO: 3897969 - DNA, 15 bp, Homo sapiens
agatatgagttgttt

SEQ ID NO: 3897970 - DNA, 17 bp, Homo sapiens
agatatttatatatatt

SEQ ID NO: 3897971 - DNA, 19 bp, Homo sapiens
agatattttttcagaaata

SEQ ID NO: 3897972 - DNA, 22 bp, Homo sapiens
agatattttttcagaaatatgt

SEQ ID NO: 3897973 - DNA, 23 bp, Homo sapiens
agatcaaatttcacgtcgtcttc

SEQ ID NO: 3897974 - DNA, 20 bp, Homo sapiens
agatcaattaattcttaata

SEQ ID NO: 3897975 - DNA, 21 bp, Homo sapiens
agatcaatttgtaattgctta

SEQ ID NO: 3897976 - DNA, 14 bp, Homo sapiens
agatcaccagcccg

SEQ ID NO: 3897977 - DNA, 14 bp, Homo sapiens
agatcagccacgga

SEQ ID NO: 3897978 - DNA, 21 bp, Homo sapiens
agatcagccacggagcctgga

SEQ ID NO: 3897979 - DNA, 13 bp, Homo sapiens
agatcaggaagag

SEQ ID NO: 3897980 - DNA, 14 bp, Homo sapiens
agatccacacacag

SEQ ID NO: 3897981 - DNA, 16 bp, Homo sapiens
agatccacacacagag

SEQ ID NO: 3897982 - DNA, 21 bp, Homo sapiens
agatccaccctcaaatgtcag

SEQ ID NO: 3897983 - DNA, 20 bp, Homo sapiens
agatccatttggacaaaatg

SEQ ID NO: 3897984 - DNA, 18 bp, Homo sapiens
agatcccatgtcacctca

SEQ ID NO: 3897985 - DNA, 19 bp, Homo sapiens
agatcccatgtcacctcag

SEQ ID NO: 3897986 - DNA, 22 bp, Homo sapiens
agatcccgcctcttcttcttca

SEQ ID NO: 3897987 - DNA, 16 bp, Homo sapiens
agatcctaactgagaa

SEQ ID NO: 3897988 - DNA, 17 bp, Homo sapiens
agatcctaggtgctgga

SEQ ID NO: 3897989 - DNA, 19 bp, Homo sapiens
agatcctaggtgctggatg

SEQ ID NO: 3897990 - DNA, 20 bp, Homo sapiens
agatcgcgccactgcactcc

SEQ ID NO: 3897991 - DNA, 19 bp, Homo sapiens
agatcgcttgagcccagga

SEQ ID NO: 3897992 - DNA, 14 bp, Homo sapiens
agatcgtattaatt

SEQ ID NO: 3897993 - DNA, 18 bp, Homo sapiens
agatcgtattaattatct

SEQ ID NO: 3897994 - DNA, 22 bp, Homo sapiens
agatcgtattaattatctgatc

SEQ ID NO: 3897995 - DNA, 18 bp, Homo sapiens
agatctccacggtcagat

SEQ ID NO: 3897996 - DNA, 15 bp, Homo sapiens
agatctccctccagg

SEQ ID NO: 3897997 - DNA, 16 bp, Homo sapiens
agatctccctccaggg

SEQ ID NO: 3897998 - DNA, 15 bp, Homo sapiens
agatctgaaaggcac

SEQ ID NO: 3897999 - DNA, 19 bp, Homo sapiens
agatctgaacacagtttag

SEQ ID NO: 3898000 - DNA, 16 bp, Homo sapiens
agatctgatggtgagc

SEQ ID NO: 3898001 - DNA, 18 bp, Homo sapiens
agatctgatggtgagctg

SEQ ID NO: 3898002 - DNA, 14 bp, Homo sapiens
agatctgcctgggc

SEQ ID NO: 3898003 - DNA, 15 bp, Homo sapiens
agatctgcctgggcc

SEQ ID NO: 3898004 - DNA, 17 bp, Homo sapiens
agatctgcctgggcctg

SEQ ID NO: 3898005 - DNA, 23 bp, Homo sapiens
agatctgcctgggcctgtgcagc

SEQ ID NO: 3898006 - DNA, 12 bp, Homo sapiens
agatctttcagg

SEQ ID NO: 3898007 - DNA, 21 bp, Homo sapiens
agatctttcaggaaagacgga

SEQ ID NO: 3898008 - DNA, 14 bp, Homo sapiens
agatgaagagaagc

SEQ ID NO: 3898009 - DNA, 16 bp, Homo sapiens
agatgaagagaagctg

SEQ ID NO: 3898010 - DNA, 19 bp, Homo sapiens
agatgaagagaagctgaga

SEQ ID NO: 3898011 - DNA, 19 bp, Homo sapiens
agatgaagagtgagagggc

SEQ ID NO: 3898012 - DNA, 21 bp, Homo sapiens
agatgagatttgccagcacag

SEQ ID NO: 3898013 - DNA, 22 bp, Homo sapiens
agatgatctctccacggtagca

SEQ ID NO: 3898014 - DNA, 12 bp, Homo sapiens
agatgattctgg

SEQ ID NO: 3898015 - DNA, 21 bp, Homo sapiens
agatgattctggctgaaaaag

SEQ ID NO: 3898016 - DNA, 17 bp, Homo sapiens
agatgcacacacagatg

SEQ ID NO: 3898017 - DNA, 15 bp, Homo sapiens
agatgccattcatag

SEQ ID NO: 3898018 - DNA, 16 bp, Homo sapiens
agatgccattcataga

SEQ ID NO: 3898019 - DNA, 15 bp, Homo sapiens
agatgcctccaccgc

SEQ ID NO: 3898020 - DNA, 17 bp, Homo sapiens
agatgcctccaccgctg

SEQ ID NO: 3898021 - DNA, 23 bp, Homo sapiens
agcaggactgaattgtccccagt

SEQ ID NO: 3898022 - DNA, 14 bp, Homo sapiens
agcaggcacatgga

SEQ ID NO: 3898023 - DNA, 16 bp, Homo sapiens
agcaggctactgtcag

SEQ ID NO: 3898024 - DNA, 22 bp, Homo sapiens
agcagggccggggaactggcca

SEQ ID NO: 3898025 - DNA, 23 bp, Homo sapiens
agcagggccggggaactggccaa

SEQ ID NO: 3898026 - DNA, 16 bp, Homo sapiens
agcagggctctgcccc

SEQ ID NO: 3898027 - DNA, 16 bp, Homo sapiens
agcagggctgctgtga

SEQ ID NO: 3898028 - DNA, 17 bp, Homo sapiens
agcaggtggtcctgaga

SEQ ID NO: 3898029 - DNA, 15 bp, Homo sapiens
agcaggttcttgatg

SEQ ID NO: 3898030 - DNA, 21 bp, Homo sapiens
agcagtaaactttctctgcaa

SEQ ID NO: 3898031 - DNA, 11 bp, Homo sapiens
agcagtacatg

SEQ ID NO: 3898032 - DNA, 15 bp, Homo sapiens
agcagtccaaagaac

SEQ ID NO: 3898033 - DNA, 21 bp, Homo sapiens
agcagtgagaaaaagctcctg

SEQ ID NO: 3898034 - DNA, 14 bp, Homo sapiens
agcagtgagccgca

SEQ ID NO: 3898035 - DNA, 17 bp, Homo sapiens
agcagtgagcttctatt

SEQ ID NO: 3898036 - DNA, 22 bp, Homo sapiens
agcagtgcctcgaggcaccggc

SEQ ID NO: 3898037 - DNA, 17 bp, Homo sapiens
agcagtgtgtccttggg

SEQ ID NO: 3898038 - DNA, 21 bp, Homo sapiens
agcagtgttccccatctgggt

SEQ ID NO: 3898039 - DNA, 22 bp, Homo sapiens
agcagttaactttaagactgag

SEQ ID NO: 3898040 - DNA, 16 bp, Homo sapiens
agcagttccatgaaga

SEQ ID NO: 3898041 - DNA, 19 bp, Homo sapiens
agcagttccatgaagacac

SEQ ID NO: 3898042 - DNA, 13 bp, Homo sapiens
agcagttgaaaag

SEQ ID NO: 3898043 - DNA, 16 bp, Homo sapiens
agcagttgaaaagact

SEQ ID NO: 3898044 - DNA, 21 bp, Homo sapiens
agcagttgaaaagactccaaa

SEQ ID NO: 3898045 - DNA, 18 bp, Homo sapiens
agcataatgctcccatct

SEQ ID NO: 3898046 - DNA, 22 bp, Homo sapiens
agcataatgctcccatctcctg

SEQ ID NO: 3898047 - DNA, 22 bp, Homo sapiens
agcataccagtactcagtatag

SEQ ID NO: 3898048 - DNA, 13 bp, Homo sapiens
agcatatttgaga

SEQ ID NO: 3898049 - DNA, 16 bp, Homo sapiens
agcatcaccatgcatg

SEQ ID NO: 3898050 - DNA, 13 bp, Homo sapiens
agcatcatgcctc

SEQ ID NO: 3898051 - DNA, 21 bp, Homo sapiens
agcatcatgcctctgaggcca

SEQ ID NO: 3898052 - DNA, 22 bp, Homo sapiens
agcatcatgcctctgaggccag

SEQ ID NO: 3898053 - DNA, 16 bp, Homo sapiens
agcatccagcctgtgt

SEQ ID NO: 3898054 - DNA, 19 bp, Homo sapiens
agcatcctgcttcctaggc

SEQ ID NO: 3898055 - DNA, 18 bp, Homo sapiens
agcatcgtgacccttcag

SEQ ID NO: 3898056 - DNA, 20 bp, Homo sapiens
agcatcgtgacccttcaggg

SEQ ID NO: 3898057 - DNA, 14 bp, Homo sapiens
agcatctcatgagt

SEQ ID NO: 3898058 - DNA, 15 bp, Homo sapiens
agcatcttctggagt

SEQ ID NO: 3898059 - DNA, 16 bp, Homo sapiens
agcatgcacagctgct

SEQ ID NO: 3898060 - DNA, 16 bp, Homo sapiens
agcatggactctgggt

SEQ ID NO: 3898061 - DNA, 20 bp, Homo sapiens
agcatggagagcctcttagt

SEQ ID NO: 3898062 - DNA, 21 bp, Homo sapiens
agcatgggactgtgcctttgg

SEQ ID NO: 3898063 - DNA, 17 bp, Homo sapiens
agcatgggtgtgccctt

SEQ ID NO: 3898064 - DNA, 21 bp, Homo sapiens
agcatggtcccacatccctgg

SEQ ID NO: 3898065 - DNA, 23 bp, Homo sapiens
agcatggtcccacatccctgggc

SEQ ID NO: 3898066 - DNA, 22 bp, Homo sapiens
agcattctcactcctacctggt

SEQ ID NO: 3898067 - DNA, 17 bp, Homo sapiens
agcattgtaaatgtgct

SEQ ID NO: 3898068 - DNA, 17 bp, Homo sapiens
agcatttgccattcctg

SEQ ID NO: 3898069 - DNA, 18 bp, Homo sapiens
agcatttgccattcctgg

SEQ ID NO: 3898070 - DNA, 20 bp, Homo sapiens
agcattttactacttgttac

SEQ ID NO: 3898071 - DNA, 14 bp, Homo sapiens
agccaaacacactg

SEQ ID NO: 3898072 - DNA, 15 bp, Homo sapiens
agccaaacacactgt

SEQ ID NO: 3898073 - DNA, 16 bp, Homo sapiens
agccaaacacagagcg

SEQ ID NO: 3898074 - DNA, 23 bp, Homo sapiens
agccaacaccctgtctaaaaaac

SEQ ID NO: 3898075 - DNA, 12 bp, Homo sapiens
agccaactccat

SEQ ID NO: 3898076 - DNA, 14 bp, Homo sapiens
agccaacttggctt

SEQ ID NO: 3898077 - DNA, 20 bp, Homo sapiens
agccaacttggctttcccgg

SEQ ID NO: 3898078 - DNA, 18 bp, Homo sapiens
agccaacttgtaaataca

SEQ ID NO: 3898079 - DNA, 19 bp, Homo sapiens
agccaagttatattgaata

SEQ ID NO: 3898080 - DNA, 19 bp, Homo sapiens
agccacacttctcaggaca

SEQ ID NO: 3898081 - DNA, 20 bp, Homo sapiens
agccacacttctcaggacac

SEQ ID NO: 3898082 - DNA, 23 bp, Homo sapiens
agccacacttctcaggacacagg

SEQ ID NO: 3898083 - DNA, 19 bp, Homo sapiens
agccacagaagccaggagc

SEQ ID NO: 3898084 - DNA, 20 bp, Homo sapiens
agccacagaagccaggagca

SEQ ID NO: 3898085 - DNA, 11 bp, Homo sapiens
agccacaggag

SEQ ID NO: 3898086 - DNA, 18 bp, Homo sapiens
agccaccctgaggagtct

SEQ ID NO: 3898087 - DNA, 18 bp, Homo sapiens
agccacctcccaccccac

SEQ ID NO: 3898088 - DNA, 15 bp, Homo sapiens
agccactaccttctg

SEQ ID NO: 3898089 - DNA, 17 bp, Homo sapiens
agccactaccttctgac

SEQ ID NO: 3898090 - DNA, 16 bp, Homo sapiens
agccactatgtccagc

SEQ ID NO: 3898091 - DNA, 14 bp, Homo sapiens
agccactcctgtcc

SEQ ID NO: 3898092 - DNA, 16 bp, Homo sapiens
agccactcctgtcccg

SEQ ID NO: 3898093 - DNA, 17 bp, Homo sapiens
agccactcctgtcccgc

SEQ ID NO: 3898094 - DNA, 22 bp, Homo sapiens
agccactcctgtcccgccttcc

SEQ ID NO: 3898095 - DNA, 23 bp, Homo sapiens
agccactcgcagtcgcaggatcc

SEQ ID NO: 3898096 - DNA, 13 bp, Homo sapiens
agccagacacatg

SEQ ID NO: 3898097 - DNA, 15 bp, Homo sapiens
agccagagaggagca

SEQ ID NO: 3898098 - DNA, 20 bp, Homo sapiens
agccagagaggagcacctga

SEQ ID NO: 3898099 - DNA, 13 bp, Homo sapiens
agccagatccacc

SEQ ID NO: 3898100 - DNA, 16 bp, Homo sapiens
agccagcccagcccag

SEQ ID NO: 3898101 - DNA, 18 bp, Homo sapiens
agccagcccagcccagct

SEQ ID NO: 3898102 - DNA, 22 bp, Homo sapiens
agccagccctccctgtcctcct

SEQ ID NO: 3898103 - DNA, 13 bp, Homo sapiens
agccagccctgcc

SEQ ID NO: 3898104 - DNA, 16 bp, Homo sapiens
agccagccctgcctgg

SEQ ID NO: 3898105 - DNA, 21 bp, Homo sapiens
agccagccctgcctggaggac

SEQ ID NO: 3898106 - DNA, 21 bp, Homo sapiens
agccagccgccctgggctgtc

SEQ ID NO: 3898107 - DNA, 19 bp, Homo sapiens
agctactctcttgccagca

SEQ ID NO: 3898108 - DNA, 12 bp, Homo sapiens
agctactctgtc

SEQ ID NO: 3898109 - DNA, 16 bp, Homo sapiens
agctactctgtccagg

SEQ ID NO: 3898110 - DNA, 22 bp, Homo sapiens
agctactctgtccaggccactg

SEQ ID NO: 3898111 - DNA, 23 bp, Homo sapiens
agctactctgtccaggccactgt

SEQ ID NO: 3898112 - DNA, 15 bp, Homo sapiens
agctacttaagagaa

SEQ ID NO: 3898113 - DNA, 16 bp, Homo sapiens
agctagaacccggcag

SEQ ID NO: 3898114 - DNA, 15 bp, Homo sapiens
agctagaacctggag

SEQ ID NO: 3898115 - DNA, 16 bp, Homo sapiens
agctagaacctggagg

SEQ ID NO: 3898116 - DNA, 19 bp, Homo sapiens
agctagaactttgaaggac

SEQ ID NO: 3898117 - DNA, 19 bp, Homo sapiens
agctagaagtgggccagga

SEQ ID NO: 3898118 - DNA, 18 bp, Homo sapiens
agctagccaactcctcct

SEQ ID NO: 3898119 - DNA, 20 bp, Homo sapiens
agctagccagagggtgggag

SEQ ID NO: 3898120 - DNA, 20 bp, Homo sapiens
agctagcgctgccgcacccc

SEQ ID NO: 3898121 - DNA, 12 bp, Homo sapiens
agctaggaatga

SEQ ID NO: 3898122 - DNA, 17 bp, Homo sapiens
agctaggagcaaagcct

SEQ ID NO: 3898123 - DNA, 18 bp, Homo sapiens
agctaggagcaaagcctg

SEQ ID NO: 3898124 - DNA, 13 bp, Homo sapiens
agctagggctgga

SEQ ID NO: 3898125 - DNA, 18 bp, Homo sapiens
agctagttcgtagctttc

SEQ ID NO: 3898126 - DNA, 19 bp, Homo sapiens
agctatgattatgccactg

SEQ ID NO: 3898127 - DNA, 16 bp, Homo sapiens
agctatgttccctcca

SEQ ID NO: 3898128 - DNA, 18 bp, Homo sapiens
agctatgttccctccagc

SEQ ID NO: 3898129 - DNA, 13 bp, Homo sapiens
agctattgatgtt

SEQ ID NO: 3898130 - DNA, 23 bp, Homo sapiens
agctattgatgtttccagaaaat

SEQ ID NO: 3898131 - DNA, 17 bp, Homo sapiens
agctattgcatgtaaaa

SEQ ID NO: 3898132 - DNA, 18 bp, Homo sapiens
agctattgcatgtaaaat

SEQ ID NO: 3898133 - DNA, 21 bp, Homo sapiens
agctattgcatgtaaaatgca

SEQ ID NO: 3898134 - DNA, 22 bp, Homo sapiens
agctattgcatgtaaaatgcag

SEQ ID NO: 3898135 - DNA, 20 bp, Homo sapiens
agctcaagcaggaagttcaa

SEQ ID NO: 3898136 - DNA, 18 bp, Homo sapiens
agctcaagtcttccctga

SEQ ID NO: 3898137 - DNA, 15 bp, Homo sapiens
agctcacaaggcagc

SEQ ID NO: 3898138 - DNA, 16 bp, Homo sapiens
agctcacaaggcagca

SEQ ID NO: 3898139 - DNA, 19 bp, Homo sapiens
agctcacaaggcagcaagg

SEQ ID NO: 3898140 - DNA, 17 bp, Homo sapiens
agctcacccaataaaca

SEQ ID NO: 3898141 - DNA, 15 bp, Homo sapiens
agctcagacccccac

SEQ ID NO: 3898142 - DNA, 23 bp, Homo sapiens
agctcaggaggcgaataaatgtt

SEQ ID NO: 3898143 - DNA, 19 bp, Homo sapiens
agctccaacagcttgacca

SEQ ID NO: 3898144 - DNA, 19 bp, Homo sapiens
agctccaccctcaccagga

SEQ ID NO: 3898145 - DNA, 22 bp, Homo sapiens
agctccaccctcaccaggatga

SEQ ID NO: 3898146 - DNA, 22 bp, Homo sapiens
agctccacggtgcgtggctgtg

SEQ ID NO: 3898147 - DNA, 18 bp, Homo sapiens
agctccactgtcaccctc

SEQ ID NO: 3898148 - DNA, 21 bp, Homo sapiens
agctccactgtcaccctccac

SEQ ID NO: 3898149 - DNA, 19 bp, Homo sapiens
agctccagaataccttctt

SEQ ID NO: 3898150 - DNA, 13 bp, Homo sapiens
agctccatctcca

SEQ ID NO: 3898151 - DNA, 23 bp, Homo sapiens
agctcccaccccacccccttcag

SEQ ID NO: 3898152 - DNA, 17 bp, Homo sapiens
agctcccagatgctggg

SEQ ID NO: 3898153 - DNA, 22 bp, Homo sapiens
agctcccctcggagaagagctg

SEQ ID NO: 3898154 - DNA, 19 bp, Homo sapiens
agctcccttcccctgcctg

SEQ ID NO: 3898155 - DNA, 16 bp, Homo sapiens
agctccgcctctgtcc

SEQ ID NO: 3898156 - DNA, 19 bp, Homo sapiens
agctcctctccttgggctc

SEQ ID NO: 3898157 - DNA, 22 bp, Homo sapiens
agctcctctccttgggctcctg

SEQ ID NO: 3898158 - DNA, 14 bp, Homo sapiens
agctcctctgctgc

SEQ ID NO: 3898159 - DNA, 24 bp, Homo sapiens
agctcctctgtctcgagcgccctg

SEQ ID NO: 3898160 - DNA, 17 bp, Homo sapiens
agctcctgtccctaccc

SEQ ID NO: 3898161 - DNA, 20 bp, Homo sapiens
agctcctgtccctacccact

SEQ ID NO: 3898162 - DNA, 22 bp, Homo sapiens
agctcctgtccctacccactct

SEQ ID NO: 3898163 - DNA, 13 bp, Homo sapiens
agctccttttgtc

SEQ ID NO: 3898164 - DNA, 17 bp, Homo sapiens
agctccttttgtcccca

SEQ ID NO: 3898165 - DNA, 18 bp, Homo sapiens
agctccttttgtccccag

SEQ ID NO: 3898166 - DNA, 23 bp, Homo sapiens
agctccttttgtccccagggccc

SEQ ID NO: 3898167 - DNA, 13 bp, Homo sapiens
agctcgctcttgg

SEQ ID NO: 3898168 - DNA, 15 bp, Homo sapiens
agctcgctcttggga

SEQ ID NO: 3898169 - DNA, 15 bp, Homo sapiens
agctctccctctggc

SEQ ID NO: 3898170 - DNA, 16 bp, Homo sapiens
agctctccctctggcc

SEQ ID NO: 3898171 - DNA, 18 bp, Homo sapiens
agctctccctctggccct

SEQ ID NO: 3898172 - DNA, 19 bp, Homo sapiens
agctctccctctggccctg

SEQ ID NO: 3898173 - DNA, 22 bp, Homo sapiens
agctctccctctggccctgcct

SEQ ID NO: 3898174 - DNA, 15 bp, Homo sapiens
agctctcctgctgca

SEQ ID NO: 3898175 - DNA, 18 bp, Homo sapiens
agctctctgtataaacat

SEQ ID NO: 3898176 - DNA, 21 bp, Homo sapiens
agctctctgtataaacattaa

SEQ ID NO: 3898177 - DNA, 18 bp, Homo sapiens
agctctgaacaaacactg

SEQ ID NO: 3898178 - DNA, 15 bp, Homo sapiens
agctctgagaggccc

SEQ ID NO: 3898179 - DNA, 18 bp, Homo sapiens
agctctgagaggccctgg

SEQ ID NO: 3898180 - DNA, 21 bp, Homo sapiens
agctctgagaggccctggatc

SEQ ID NO: 3898181 - DNA, 21 bp, Homo sapiens
agctctgcagagcaggaaaca

SEQ ID NO: 3898182 - DNA, 12 bp, Homo sapiens
agctctgcatta

SEQ ID NO: 3898183 - DNA, 13 bp, Homo sapiens
agctctgcattat

SEQ ID NO: 3898184 - DNA, 11 bp, Homo sapiens
agctctgcctc

SEQ ID NO: 3898185 - DNA, 12 bp, Homo sapiens
agctctggacca

SEQ ID NO: 3898186 - DNA, 22 bp, Homo sapiens
agctctgtagaaagaatgtgtt

SEQ ID NO: 3898187 - DNA, 19 bp, Homo sapiens
agctctgtggcctgtgtcc

SEQ ID NO: 3898188 - DNA, 17 bp, Homo sapiens
agctcttcactcagcca

SEQ ID NO: 3898189 - DNA, 18 bp, Homo sapiens
agctcttcggtttctgag

SEQ ID NO: 3898190 - DNA, 19 bp, Homo sapiens
agctcttctatttaaaaaa

SEQ ID NO: 3898191 - DNA, 23 bp, Homo sapiens
agctcttctatttaaaaaataaa

SEQ ID NO: 3898192 - DNA, 12 bp, Homo sapiens
agctcttggaag

SEQ ID NO: 3898193 - DNA, 15 bp, Homo sapiens
aggactgagactggc

SEQ ID NO: 3898194 - DNA, 14 bp, Homo sapiens
aggactgaggagtg

SEQ ID NO: 3898195 - DNA, 14 bp, Homo sapiens
aggacttcccgagc

SEQ ID NO: 3898196 - DNA, 14 bp, Homo sapiens
aggacttctgcagc

SEQ ID NO: 3898197 - DNA, 20 bp, Homo sapiens
aggacttggtctgatttcag

SEQ ID NO: 3898198 - DNA, 23 bp, Homo sapiens
aggacttggtctgatttcaggat

SEQ ID NO: 3898199 - DNA, 16 bp, Homo sapiens
aggacttgtgtctctg

SEQ ID NO: 3898200 - DNA, 20 bp, Homo sapiens
aggactttgatgcatttcca

SEQ ID NO: 3898201 - DNA, 13 bp, Homo sapiens
aggagaaactgag

SEQ ID NO: 3898202 - DNA, 13 bp, Homo sapiens
aggagaaaggagc

SEQ ID NO: 3898203 - DNA, 17 bp, Homo sapiens
aggagaaaggagccgga

SEQ ID NO: 3898204 - DNA, 11 bp, Homo sapiens
aggagaaataa

SEQ ID NO: 3898205 - DNA, 12 bp, Homo sapiens
aggagaaataaa

SEQ ID NO: 3898206 - DNA, 12 bp, Homo sapiens
aggagaaatgca

SEQ ID NO: 3898207 - DNA, 12 bp, Homo sapiens
aggagaccctgg

SEQ ID NO: 3898208 - DNA, 15 bp, Homo sapiens
aggagaccctggaat

SEQ ID NO: 3898209 - DNA, 13 bp, Homo sapiens
aggagactcacct

SEQ ID NO: 3898210 - DNA, 17 bp, Homo sapiens
aggagactcacctctgc

SEQ ID NO: 3898211 - DNA, 21 bp, Homo sapiens
aggagagagatctagaaagtg

SEQ ID NO: 3898212 - DNA, 18 bp, Homo sapiens
aggagaggggaagggcca

SEQ ID NO: 3898213 - DNA, 20 bp, Homo sapiens
aggagagtggttgttgccaa

SEQ ID NO: 3898214 - DNA, 12 bp, Homo sapiens
aggagatataaa

SEQ ID NO: 3898215 - DNA, 13 bp, Homo sapiens
aggagatataaaa

SEQ ID NO: 3898216 - DNA, 19 bp, Homo sapiens
aggagatataaaatctaga

SEQ ID NO: 3898217 - DNA, 14 bp, Homo sapiens
aggagcaaagcctg

SEQ ID NO: 3898218 - DNA, 19 bp, Homo sapiens
aggagcaaatgtttctgca

SEQ ID NO: 3898219 - DNA, 16 bp, Homo sapiens
aggagcacctgaaccc

SEQ ID NO: 3898220 - DNA, 14 bp, Homo sapiens
aggagcagacagag

SEQ ID NO: 3898221 - DNA, 16 bp, Homo sapiens
aggagcagacagagaa

SEQ ID NO: 3898222 - DNA, 16 bp, Homo sapiens
aggagcagcttcagtt

SEQ ID NO: 3898223 - DNA, 15 bp, Homo sapiens
aggagcaggaacaga

SEQ ID NO: 3898224 - DNA, 20 bp, Homo sapiens
aggagcaggaacagagactc

SEQ ID NO: 3898225 - DNA, 13 bp, Homo sapiens
aggagcccagagg

SEQ ID NO: 3898226 - DNA, 11 bp, Homo sapiens
aggagcctggc

SEQ ID NO: 3898227 - DNA, 14 bp, Homo sapiens
aggagctacctgtg

SEQ ID NO: 3898228 - DNA, 16 bp, Homo sapiens
aggagctacctgtgtg

SEQ ID NO: 3898229 - DNA, 17 bp, Homo sapiens
aggagctacctgtgtgg

SEQ ID NO: 3898230 - DNA, 23 bp, Homo sapiens
aggagctcttaactacagtggct

SEQ ID NO: 3898231 - DNA, 16 bp, Homo sapiens
aggagctgagtcacct

SEQ ID NO: 3898232 - DNA, 22 bp, Homo sapiens
aggagctgatttccaggcccct

SEQ ID NO: 3898233 - DNA, 14 bp, Homo sapiens
aggaggaaggcaaa

SEQ ID NO: 3898234 - DNA, 23 bp, Homo sapiens
aggaggaatcatgtcaggcctgt

SEQ ID NO: 3898235 - DNA, 14 bp, Homo sapiens
aggaggaggaaggc

SEQ ID NO: 3898236 - DNA, 16 bp, Homo sapiens
aggaggaggaaggcaa

SEQ ID NO: 3898237 - DNA, 16 bp, Homo sapiens
aggaggaggaggaagg

SEQ ID NO: 3898238 - DNA, 18 bp, Homo sapiens
aggaggcgaataaatgtt

SEQ ID NO: 3898239 - DNA, 17 bp, Homo sapiens
aggaggctgaggcagaa

SEQ ID NO: 3898240 - DNA, 19 bp, Homo sapiens
aggagggacaaaggagcct

SEQ ID NO: 3898241 - DNA, 22 bp, Homo sapiens
aggagggacaaaggagcctgtg

SEQ ID NO: 3898242 - DNA, 16 bp, Homo sapiens
aggagggcaagggcca

SEQ ID NO: 3898243 - DNA, 18 bp, Homo sapiens
aggagggcagagccatgg

SEQ ID NO: 3898244 - DNA, 14 bp, Homo sapiens
aggagggcgcccat

SEQ ID NO: 3898245 - DNA, 12 bp, Homo sapiens
aggaggggcctc

SEQ ID NO: 3898246 - DNA, 14 bp, Homo sapiens
aggaggggcctctg

SEQ ID NO: 3898247 - DNA, 20 bp, Homo sapiens
aggagggggtcgtggagagc

SEQ ID NO: 3898248 - DNA, 19 bp, Homo sapiens
aggagggtccccagctggt

SEQ ID NO: 3898249 - DNA, 15 bp, Homo sapiens
aggagggtggaggaa

SEQ ID NO: 3898250 - DNA, 16 bp, Homo sapiens
aggagggtggaggaag

SEQ ID NO: 3898251 - DNA, 21 bp, Homo sapiens
aggagggtggaggaaggtgct

SEQ ID NO: 3898252 - DNA, 22 bp, Homo sapiens
aggagggtggaggaaggtgctg

SEQ ID NO: 3898253 - DNA, 13 bp, Homo sapiens
aggaggtgaggga

SEQ ID NO: 3898254 - DNA, 19 bp, Homo sapiens
aggaggttggtgactgaaa

SEQ ID NO: 3898255 - DNA, 23 bp, Homo sapiens
aggaggttgtggatgctccaggg

SEQ ID NO: 3898256 - DNA, 23 bp, Homo sapiens
aggaggtttggggtctgccacca

SEQ ID NO: 3898257 - DNA, 13 bp, Homo sapiens
aggagtagctgag

SEQ ID NO: 3898258 - DNA, 15 bp, Homo sapiens
aggagtagctgagag

SEQ ID NO: 3898259 - DNA, 20 bp, Homo sapiens
aggagtagctgagaggaaga

SEQ ID NO: 3898260 - DNA, 14 bp, Homo sapiens
aggagtccagggcg

SEQ ID NO: 3898261 - DNA, 17 bp, Homo sapiens
aggagtccagggcggga

SEQ ID NO: 3898262 - DNA, 13 bp, Homo sapiens
aggagtctgaggt

SEQ ID NO: 3898263 - DNA, 15 bp, Homo sapiens
aggagtctgaggtcc

SEQ ID NO: 3898264 - DNA, 22 bp, Homo sapiens
aggagtctgaggtcctgagcac

SEQ ID NO: 3898265 - DNA, 23 bp, Homo sapiens
aggagtctgaggtcctgagcact

SEQ ID NO: 3898266 - DNA, 23 bp, Homo sapiens
aggagtggcagctgtcccctctc

SEQ ID NO: 3898267 - DNA, 20 bp, Homo sapiens
aggagttccttgatctgtat

SEQ ID NO: 3898268 - DNA, 14 bp, Homo sapiens
aggagttgccaggg

SEQ ID NO: 3898269 - DNA, 22 bp, Homo sapiens
aggagttggagaccaggcctga

SEQ ID NO: 3898270 - DNA, 16 bp, Homo sapiens
aggatactctgtcaga

SEQ ID NO: 3898271 - DNA, 15 bp, Homo sapiens
aggatccgctgccac

SEQ ID NO: 3898272 - DNA, 17 bp, Homo sapiens
aggatccgctgccacca

SEQ ID NO: 3898273 - DNA, 21 bp, Homo sapiens
aggatcctattctcaccagga

SEQ ID NO: 3898274 - DNA, 22 bp, Homo sapiens
aggatcctattctcaccaggaa

SEQ ID NO: 3898275 - DNA, 13 bp, Homo sapiens
aggatctctcagg

SEQ ID NO: 3898276 - DNA, 22 bp, Homo sapiens
aggatgaaggcgtgcaaggggc

SEQ ID NO: 3898277 - DNA, 16 bp, Homo sapiens
aggatgaccaggacta

SEQ ID NO: 3898278 - DNA, 16 bp, Homo sapiens
aggatgcaacaaatat

SEQ ID NO: 3898279 - DNA, 14 bp, Homo sapiens
aggatgccacagcc

SEQ ID NO: 3898280 - DNA, 20 bp, Homo sapiens
agggatcttgcattcccagt

SEQ ID NO: 3898281 - DNA, 15 bp, Homo sapiens
agggatgactaaaat

SEQ ID NO: 3898282 - DNA, 17 bp, Homo sapiens
agggatggagaggcggc

SEQ ID NO: 3898283 - DNA, 18 bp, Homo sapiens
agggcaaatgacatgcac

SEQ ID NO: 3898284 - DNA, 23 bp, Homo sapiens
agggcaaatgacatgcactgacc

SEQ ID NO: 3898285 - DNA, 22 bp, Homo sapiens
agggcaacaatacatgctgcta

SEQ ID NO: 3898286 - DNA, 20 bp, Homo sapiens
agggcaatcttgtccacagt

SEQ ID NO: 3898287 - DNA, 17 bp, Homo sapiens
agggcacaggagctacc

SEQ ID NO: 3898288 - DNA, 17 bp, Homo sapiens
agggcactggtggcccg

SEQ ID NO: 3898289 - DNA, 17 bp, Homo sapiens
agggcagaaggggaaga

SEQ ID NO: 3898290 - DNA, 18 bp, Homo sapiens
agggcagagccatgggcc

SEQ ID NO: 3898291 - DNA, 20 bp, Homo sapiens
agggcagagccatgggcctg

SEQ ID NO: 3898292 - DNA, 17 bp, Homo sapiens
agggcagaggctggagg

SEQ ID NO: 3898293 - DNA, 20 bp, Homo sapiens
agggcagaggctggaggcag

SEQ ID NO: 3898294 - DNA, 23 bp, Homo sapiens
agggcagagggaatgttccctgc

SEQ ID NO: 3898295 - DNA, 18 bp, Homo sapiens
agggcagcagccagccct

SEQ ID NO: 3898296 - DNA, 19 bp, Homo sapiens
agggcagcagccagccctg

SEQ ID NO: 3898297 - DNA, 21 bp, Homo sapiens
agggcagcagccagccctgcc

SEQ ID NO: 3898298 - DNA, 22 bp, Homo sapiens
agggcagcagccagccctgcct

SEQ ID NO: 3898299 - DNA, 12 bp, Homo sapiens
agggcagccagg

SEQ ID NO: 3898300 - DNA, 14 bp, Homo sapiens
agggcagccagggg

SEQ ID NO: 3898301 - DNA, 16 bp, Homo sapiens
agggcagccaggggct

SEQ ID NO: 3898302 - DNA, 18 bp, Homo sapiens
agggcagccaggggctgc

SEQ ID NO: 3898303 - DNA, 15 bp, Homo sapiens
agggcagtacctggg

SEQ ID NO: 3898304 - DNA, 21 bp, Homo sapiens
agggcagtgacaagtggaggg

SEQ ID NO: 3898305 - DNA, 17 bp, Homo sapiens
agggcagttcgcagcca

SEQ ID NO: 3898306 - DNA, 18 bp, Homo sapiens
agggcagttcgcagccac

SEQ ID NO: 3898307 - DNA, 17 bp, Homo sapiens
agggcatgcgcacaagg

SEQ ID NO: 3898308 - DNA, 20 bp, Homo sapiens
agggccacgtgccaggcccg

SEQ ID NO: 3898309 - DNA, 17 bp, Homo sapiens
agggccagaaggagggc

SEQ ID NO: 3898310 - DNA, 12 bp, Homo sapiens
agggccagccct

SEQ ID NO: 3898311 - DNA, 13 bp, Homo sapiens
agggccagcccta

SEQ ID NO: 3898312 - DNA, 22 bp, Homo sapiens
agggccagccctacatcttcag

SEQ ID NO: 3898313 - DNA, 18 bp, Homo sapiens
agggccatgctgaaggga

SEQ ID NO: 3898314 - DNA, 15 bp, Homo sapiens
agggcccagctgtag

SEQ ID NO: 3898315 - DNA, 17 bp, Homo sapiens
agggcccagctgtagcc

SEQ ID NO: 3898316 - DNA, 18 bp, Homo sapiens
agggccccagaaggcagg

SEQ ID NO: 3898317 - DNA, 13 bp, Homo sapiens
agggcctgctgga

SEQ ID NO: 3898318 - DNA, 14 bp, Homo sapiens
agggcctgggggca

SEQ ID NO: 3898319 - DNA, 21 bp, Homo sapiens
agggcctgggggcagtgactg

SEQ ID NO: 3898320 - DNA, 23 bp, Homo sapiens
agggcctgggggcagtgactggc

SEQ ID NO: 3898321 - DNA, 13 bp, Homo sapiens
agggcctggtgtg

SEQ ID NO: 3898322 - DNA, 21 bp, Homo sapiens
agggcctggtgtgaggctggg

SEQ ID NO: 3898323 - DNA, 12 bp, Homo sapiens
agggccttgccc

SEQ ID NO: 3898324 - DNA, 14 bp, Homo sapiens
agggccttgcccag

SEQ ID NO: 3898325 - DNA, 17 bp, Homo sapiens
agggccttgcccagaga

SEQ ID NO: 3898326 - DNA, 19 bp, Homo sapiens
agggccttgcccagagatg

SEQ ID NO: 3898327 - DNA, 23 bp, Homo sapiens
agggcgcccattcgtctgtccca

SEQ ID NO: 3898328 - DNA, 15 bp, Homo sapiens
agggcgggagtgggg

SEQ ID NO: 3898329 - DNA, 21 bp, Homo sapiens
agggcgtcgctggacaaccca

SEQ ID NO: 3898330 - DNA, 22 bp, Homo sapiens
agggcgtcgctggacaacccag

SEQ ID NO: 3898331 - DNA, 23 bp, Homo sapiens
agggctaagagctagcgctgccg

SEQ ID NO: 3898332 - DNA, 17 bp, Homo sapiens
agggctagaacctagaa

SEQ ID NO: 3898333 - DNA, 19 bp, Homo sapiens
agggctagaacctggaagg

SEQ ID NO: 3898334 - DNA, 17 bp, Homo sapiens
agggctagaacctggag

SEQ ID NO: 3898335 - DNA, 23 bp, Homo sapiens
agggctagaacctggaggggcta

SEQ ID NO: 3898336 - DNA, 18 bp, Homo sapiens
agggctagaactggagag

SEQ ID NO: 3898337 - DNA, 20 bp, Homo sapiens
agggctagaatctggagagc

SEQ ID NO: 3898338 - DNA, 20 bp, Homo sapiens
agggctagggaggtggggta

SEQ ID NO: 3898339 - DNA, 15 bp, Homo sapiens
agggctccagcatcc

SEQ ID NO: 3898340 - DNA, 21 bp, Homo sapiens
agggctccagcatccagcctg

SEQ ID NO: 3898341 - DNA, 17 bp, Homo sapiens
agggctccctcctggag

SEQ ID NO: 3898342 - DNA, 18 bp, Homo sapiens
agggctccctcctggagc

SEQ ID NO: 3898343 - DNA, 20 bp, Homo sapiens
agggctccctcctggagcat

SEQ ID NO: 3898344 - DNA, 22 bp, Homo sapiens
agggctccctcctggagcatcc

SEQ ID NO: 3898345 - DNA, 12 bp, Homo sapiens
agggctctcctg

SEQ ID NO: 3898346 - DNA, 14 bp, Homo sapiens
agggctctcctggc

SEQ ID NO: 3898347 - DNA, 16 bp, Homo sapiens
agggctctcctggctt

SEQ ID NO: 3898348 - DNA, 14 bp, Homo sapiens
agggctctgaggcg

SEQ ID NO: 3898349 - DNA, 22 bp, Homo sapiens
agggctgccactaacctgtaga

SEQ ID NO: 3898350 - DNA, 12 bp, Homo sapiens
agggctgcccct

SEQ ID NO: 3898351 - DNA, 14 bp, Homo sapiens
agggctgcccctgt

SEQ ID NO: 3898352 - DNA, 22 bp, Homo sapiens
agggctggactctggcacccag

SEQ ID NO: 3898353 - DNA, 14 bp, Homo sapiens
agggctgggcccac

SEQ ID NO: 3898354 - DNA, 20 bp, Homo sapiens
agggctgttggacagctgct

SEQ ID NO: 3898355 - DNA, 24 bp, Homo sapiens
agggctgttggacagctgcttgtg

SEQ ID NO: 3898356 - DNA, 19 bp, Homo sapiens
agggcttggtaaaacacag

SEQ ID NO: 3898357 - DNA, 20 bp, Homo sapiens
aggggaagtatgtgtgggta

SEQ ID NO: 3898358 - DNA, 18 bp, Homo sapiens
aggggaccatgaagagac

SEQ ID NO: 3898359 - DNA, 22 bp, Homo sapiens
aggggaccatgaagagactctc

SEQ ID NO: 3898360 - DNA, 18 bp, Homo sapiens
aggggacttgtgccagca

SEQ ID NO: 3898361 - DNA, 15 bp, Homo sapiens
aggggagaagggcca

SEQ ID NO: 3898362 - DNA, 19 bp, Homo sapiens
aggggagaagggccagccc

SEQ ID NO: 3898363 - DNA, 23 bp, Homo sapiens
aggggagaagggccagccctaca

SEQ ID NO: 3898364 - DNA, 16 bp, Homo sapiens
aggggagaggaaaagt

SEQ ID NO: 3898365 - DNA, 12 bp, Homo sapiens
aggggagtgtgg

SEQ ID NO: 3898366 - DNA, 16 bp, Homo sapiens
agtcacccttctgggc

SEQ ID NO: 3898367 - DNA, 14 bp, Homo sapiens
agtcacctcctcca

SEQ ID NO: 3898368 - DNA, 22 bp, Homo sapiens
agtcacctcctccactcactcc

SEQ ID NO: 3898369 - DNA, 14 bp, Homo sapiens
agtcacctgcaagc

SEQ ID NO: 3898370 - DNA, 19 bp, Homo sapiens
agtcacctgcaagccccag

SEQ ID NO: 3898371 - DNA, 10 bp, Homo sapiens
agtcactgtc

SEQ ID NO: 3898372 - DNA, 13 bp, Homo sapiens
agtcagaggagaa

SEQ ID NO: 3898373 - DNA, 18 bp, Homo sapiens
agtcagcccgaatgcctg

SEQ ID NO: 3898374 - DNA, 15 bp, Homo sapiens
agtcaggacctccgg

SEQ ID NO: 3898375 - DNA, 17 bp, Homo sapiens
agtcagtctctctctcc

SEQ ID NO: 3898376 - DNA, 22 bp, Homo sapiens
agtcagtgggaacgtgactgcc

SEQ ID NO: 3898377 - DNA, 19 bp, Homo sapiens
agtcagttcccggagcaca

SEQ ID NO: 3898378 - DNA, 21 bp, Homo sapiens
agtcagttcccggagcacagc

SEQ ID NO: 3898379 - DNA, 23 bp, Homo sapiens
agtcagttcccggagcacagccc

SEQ ID NO: 3898380 - DNA, 20 bp, Homo sapiens
agtcatgatctccctgccgc

SEQ ID NO: 3898381 - DNA, 20 bp, Homo sapiens
agtcattgggttttatcagt

SEQ ID NO: 3898382 - DNA, 16 bp, Homo sapiens
agtcatttattttaaa

SEQ ID NO: 3898383 - DNA, 22 bp, Homo sapiens
agtcatttattttaaaaaatga

SEQ ID NO: 3898384 - DNA, 16 bp, Homo sapiens
agtccaacctgcctgt

SEQ ID NO: 3898385 - DNA, 18 bp, Homo sapiens
agtccaacctgcctgtgc

SEQ ID NO: 3898386 - DNA, 13 bp, Homo sapiens
agtccaatatttg

SEQ ID NO: 3898387 - DNA, 17 bp, Homo sapiens
agtccacatcttctcag

SEQ ID NO: 3898388 - DNA, 18 bp, Homo sapiens
agtccagaataagtgctg

SEQ ID NO: 3898389 - DNA, 19 bp, Homo sapiens
agtccagaataagtgctgt

SEQ ID NO: 3898390 - DNA, 17 bp, Homo sapiens
agtccagatgccttcct

SEQ ID NO: 3898391 - DNA, 15 bp, Homo sapiens
agtccaggtcctggt

SEQ ID NO: 3898392 - DNA, 16 bp, Homo sapiens
agtccaggtcctggtg

SEQ ID NO: 3898393 - DNA, 17 bp, Homo sapiens
agtccaggtcctggtgg

SEQ ID NO: 3898394 - DNA, 15 bp, Homo sapiens
agtccccagcccttc

SEQ ID NO: 3898395 - DNA, 19 bp, Homo sapiens
agtccccatcagcaccatg

SEQ ID NO: 3898396 - DNA, 18 bp, Homo sapiens
agtccccgtcccccagaa

SEQ ID NO: 3898397 - DNA, 13 bp, Homo sapiens
agtcccctgggcc

SEQ ID NO: 3898398 - DNA, 16 bp, Homo sapiens
agtcccctgggcctgg

SEQ ID NO: 3898399 - DNA, 14 bp, Homo sapiens
agtcccgtggaggg

SEQ ID NO: 3898400 - DNA, 23 bp, Homo sapiens
agtccctcccatctctaccccaa

SEQ ID NO: 3898401 - DNA, 14 bp, Homo sapiens
agtccctgggggaa

SEQ ID NO: 3898402 - DNA, 17 bp, Homo sapiens
agtccctgggggaagcc

SEQ ID NO: 3898403 - DNA, 22 bp, Homo sapiens
agtccctgggggaagccctgga

SEQ ID NO: 3898404 - DNA, 23 bp, Homo sapiens
agtccgcaagttcagggaagcag

SEQ ID NO: 3898405 - DNA, 12 bp, Homo sapiens
agtcctagagct

SEQ ID NO: 3898406 - DNA, 15 bp, Homo sapiens
agtcctagagctcct

SEQ ID NO: 3898407 - DNA, 18 bp, Homo sapiens
agtcctcacagcctctcc

SEQ ID NO: 3898408 - DNA, 19 bp, Homo sapiens
agtcctcacagcctctccc

SEQ ID NO: 3898409 - DNA, 20 bp, Homo sapiens
agtcctcacagcctctccct

SEQ ID NO: 3898410 - DNA, 10 bp, Homo sapiens
agtcctggcc

SEQ ID NO: 3898411 - DNA, 13 bp, Homo sapiens
agtcctgtgaatt

SEQ ID NO: 3898412 - DNA, 14 bp, Homo sapiens
agtcctgtgaattt

SEQ ID NO: 3898413 - DNA, 23 bp, Homo sapiens
agtcctgtgaatttcttcactgt

SEQ ID NO: 3898414 - DNA, 18 bp, Homo sapiens
agtccttggtctgctggt

SEQ ID NO: 3898415 - DNA, 17 bp, Homo sapiens
agtcgagagggctgttg

SEQ ID NO: 3898416 - DNA, 23 bp, Homo sapiens
agtcgcaggatccgctgccacca

SEQ ID NO: 3898417 - DNA, 19 bp, Homo sapiens
agtcgctgtggttgtttta

SEQ ID NO: 3898418 - DNA, 13 bp, Homo sapiens
agtctaaagttta

SEQ ID NO: 3898419 - DNA, 20 bp, Homo sapiens
agtctaaagtttacagtaaa

SEQ ID NO: 3898420 - DNA, 15 bp, Homo sapiens
agtctacgttctcca

SEQ ID NO: 3898421 - DNA, 23 bp, Homo sapiens
agtctagaaaccagtatggaagg

SEQ ID NO: 3898422 - DNA, 18 bp, Homo sapiens
agtctaggagctgggagg

SEQ ID NO: 3898423 - DNA, 17 bp, Homo sapiens
agtctagtgaagatgtt

SEQ ID NO: 3898424 - DNA, 19 bp, Homo sapiens
agtctagtgaagatgttgt

SEQ ID NO: 3898425 - DNA, 15 bp, Homo sapiens
agtctattgtttgtt

SEQ ID NO: 3898426 - DNA, 19 bp, Homo sapiens
agtctcagaaagccttcca

SEQ ID NO: 3898427 - DNA, 22 bp, Homo sapiens
agtctcagtccagatgccttcc

SEQ ID NO: 3898428 - DNA, 17 bp, Homo sapiens
agtctcattctgttgcc

SEQ ID NO: 3898429 - DNA, 14 bp, Homo sapiens
agtctccttcccct

SEQ ID NO: 3898430 - DNA, 17 bp, Homo sapiens
agtctcctttgcactga

SEQ ID NO: 3898431 - DNA, 23 bp, Homo sapiens
agtctcctttgcactgagggcca

SEQ ID NO: 3898432 - DNA, 18 bp, Homo sapiens
agtctctatgatcttggc

SEQ ID NO: 3898433 - DNA, 13 bp, Homo sapiens
agtctcttctcca

SEQ ID NO: 3898434 - DNA, 14 bp, Homo sapiens
agtctcttctccac

SEQ ID NO: 3898435 - DNA, 17 bp, Homo sapiens
agtctcttctccactgg

SEQ ID NO: 3898436 - DNA, 22 bp, Homo sapiens
agtctcttggtgatggagtgtg

SEQ ID NO: 3898437 - DNA, 15 bp, Homo sapiens
agtctgagcccccgg

SEQ ID NO: 3898438 - DNA, 23 bp, Homo sapiens
agtctgagctgtaggtaaccggc

SEQ ID NO: 3898439 - DNA, 14 bp, Homo sapiens
agtctgaggtcctg

SEQ ID NO: 3898440 - DNA, 15 bp, Homo sapiens
agtctgaggtcctga

SEQ ID NO: 3898441 - DNA, 16 bp, Homo sapiens
agtctgaggtcctgag

SEQ ID NO: 3898442 - DNA, 16 bp, Homo sapiens
agtctgagtaaaatct

SEQ ID NO: 3898443 - DNA, 16 bp, Homo sapiens
agtctgagtcctgtct

SEQ ID NO: 3898444 - DNA, 15 bp, Homo sapiens
agtctgagtctgagt

SEQ ID NO: 3898445 - DNA, 17 bp, Homo sapiens
agtctgagtctgagtcc

SEQ ID NO: 3898446 - DNA, 16 bp, Homo sapiens
agtctgctatattttc

SEQ ID NO: 3898447 - DNA, 22 bp, Homo sapiens
agtctgggcaatgaaaccaaag

SEQ ID NO: 3898448 - DNA, 16 bp, Homo sapiens
agtctgggctgccggg

SEQ ID NO: 3898449 - DNA, 18 bp, Homo sapiens
agtctgtgtgatgaactt

SEQ ID NO: 3898450 - DNA, 19 bp, Homo sapiens
agtctgtgtgatgaacttt

SEQ ID NO: 3898451 - DNA, 21 bp, Homo sapiens
agtctgtgtgatgaactttct

SEQ ID NO: 3898452 - DNA, 20 bp, Homo sapiens
agtctgtgtttgaccttcac

SEQ ID NO: 3898453 - DNA, 14 bp, Homo sapiens
agtttgcagaaaag

SEQ ID NO: 3898454 - DNA, 20 bp, Homo sapiens
agtttgcagaaaagcacctg

SEQ ID NO: 3898455 - DNA, 22 bp, Homo sapiens
agtttggccgggtgcggtggct

SEQ ID NO: 3898456 - DNA, 15 bp, Homo sapiens
agtttgtacatgcat

SEQ ID NO: 3898457 - DNA, 14 bp, Homo sapiens
agtttgtataactt

SEQ ID NO: 3898458 - DNA, 17 bp, Homo sapiens
agtttgtataacttctt

SEQ ID NO: 3898459 - DNA, 21 bp, Homo sapiens
agtttgtatagagttcatccc

SEQ ID NO: 3898460 - DNA, 15 bp, Homo sapiens
agtttgttctccggg

SEQ ID NO: 3898461 - DNA, 21 bp, Homo sapiens
agtttgttctccgggtgtggc

SEQ ID NO: 3898462 - DNA, 20 bp, Homo sapiens
agtttgttttacaaattttt

SEQ ID NO: 3898463 - DNA, 20 bp, Homo sapiens
agttttaacagaaccagagg

SEQ ID NO: 3898464 - DNA, 13 bp, Homo sapiens
agttttcagcctt

SEQ ID NO: 3898465 - DNA, 11 bp, Homo sapiens
agttttcctga

SEQ ID NO: 3898466 - DNA, 17 bp, Homo sapiens
agttttctcctcccagg

SEQ ID NO: 3898467 - DNA, 19 bp, Homo sapiens
agttttctgagaaagacta

SEQ ID NO: 3898468 - DNA, 14 bp, Homo sapiens
agttttgatgaaat

SEQ ID NO: 3898469 - DNA, 18 bp, Homo sapiens
agttttgtataaataata

SEQ ID NO: 3898470 - DNA, 16 bp, Homo sapiens
agtttttactttctgt

SEQ ID NO: 3898471 - DNA, 17 bp, Homo sapiens
agtttttcagaaagcat

SEQ ID NO: 3898472 - DNA, 16 bp, Homo sapiens
agttttttttgtaaac

SEQ ID NO: 3898473 - DNA, 19 bp, Homo sapiens
ataaaaaaaagaaatgaaa

SEQ ID NO: 3898474 - DNA, 12 bp, Homo sapiens
ataaaaaaatac

SEQ ID NO: 3898475 - DNA, 12 bp, Homo sapiens
ataaaaaccaga

SEQ ID NO: 3898476 - DNA, 13 bp, Homo sapiens
ataaaaaccagaa

SEQ ID NO: 3898477 - DNA, 14 bp, Homo sapiens
ataaaaaccagaat

SEQ ID NO: 3898478 - DNA, 13 bp, Homo sapiens
ataaaaaccctgt

SEQ ID NO: 3898479 - DNA, 22 bp, Homo sapiens
ataaaaagaaaagataaagatg

SEQ ID NO: 3898480 - DNA, 19 bp, Homo sapiens
ataaaaataccttaaatct

SEQ ID NO: 3898481 - DNA, 19 bp, Homo sapiens
ataaaaatcatggcaacat

SEQ ID NO: 3898482 - DNA, 13 bp, Homo sapiens
ataaaacattatg

SEQ ID NO: 3898483 - DNA, 17 bp, Homo sapiens
ataaaacccagcatgta

SEQ ID NO: 3898484 - DNA, 14 bp, Homo sapiens
ataaaacctttcaa

SEQ ID NO: 3898485 - DNA, 15 bp, Homo sapiens
ataaaacctttcaaa

SEQ ID NO: 3898486 - DNA, 21 bp, Homo sapiens
ataaaacctttcaaatttcac

SEQ ID NO: 3898487 - DNA, 15 bp, Homo sapiens
ataaaactgctttgt

SEQ ID NO: 3898488 - DNA, 14 bp, Homo sapiens
ataaaacttatgct

SEQ ID NO: 3898489 - DNA, 18 bp, Homo sapiens
ataaaagcataaatgcaa

SEQ ID NO: 3898490 - DNA, 20 bp, Homo sapiens
ataaaagcataaatgcaaac

SEQ ID NO: 3898491 - DNA, 13 bp, Homo sapiens
ataaaatagtatt

SEQ ID NO: 3898492 - DNA, 16 bp, Homo sapiens
ataaaatagtattgaa

SEQ ID NO: 3898493 - DNA, 18 bp, Homo sapiens
ataaaatagttgtccata

SEQ ID NO: 3898494 - DNA, 15 bp, Homo sapiens
ataaaatatcctcag

SEQ ID NO: 3898495 - DNA, 19 bp, Homo sapiens
ataaaatgaggacatgttt

SEQ ID NO: 3898496 - DNA, 13 bp, Homo sapiens
ataaaattatgcc

SEQ ID NO: 3898497 - DNA, 16 bp, Homo sapiens
ataaaattatggtgaa

SEQ ID NO: 3898498 - DNA, 12 bp, Homo sapiens
ataaaattgtga

SEQ ID NO: 3898499 - DNA, 14 bp, Homo sapiens
ataaaattgtgatg

SEQ ID NO: 3898500 - DNA, 19 bp, Homo sapiens
ataaaattgtgatgttttg

SEQ ID NO: 3898501 - DNA, 12 bp, Homo sapiens
ataaacattaaa

SEQ ID NO: 3898502 - DNA, 16 bp, Homo sapiens
ataaacattaaaagaa

SEQ ID NO: 3898503 - DNA, 17 bp, Homo sapiens
ataaacattaaatgtct

SEQ ID NO: 3898504 - DNA, 21 bp, Homo sapiens
ataaacattaaatgtcttata

SEQ ID NO: 3898505 - DNA, 13 bp, Homo sapiens
ataaaccaaagga

SEQ ID NO: 3898506 - DNA, 20 bp, Homo sapiens
ataaaccaaaggacattatg

SEQ ID NO: 3898507 - DNA, 20 bp, Homo sapiens
ataaacgcgggaaaaaagat

SEQ ID NO: 3898508 - DNA, 14 bp, Homo sapiens
ataaactactgtaa

SEQ ID NO: 3898509 - DNA, 21 bp, Homo sapiens
ataaactactgtaattaagtg

SEQ ID NO: 3898510 - DNA, 17 bp, Homo sapiens
ataaactagtttccagt

SEQ ID NO: 3898511 - DNA, 14 bp, Homo sapiens
ataaactatcagtt

SEQ ID NO: 3898512 - DNA, 14 bp, Homo sapiens
ataaacttagaata

SEQ ID NO: 3898513 - DNA, 11 bp, Homo sapiens
ataaacttcag

SEQ ID NO: 3898514 - DNA, 21 bp, Homo sapiens
ataaagaactccttattttgt

SEQ ID NO: 3898515 - DNA, 22 bp, Homo sapiens
ataaagaactccttattttgta

SEQ ID NO: 3898516 - DNA, 23 bp, Homo sapiens
ataaagaactccttattttgtat

SEQ ID NO: 3898517 - DNA, 23 bp, Homo sapiens
ataaagatgatctactcagaaat

SEQ ID NO: 3898518 - DNA, 12 bp, Homo sapiens
ataaagcaaata

SEQ ID NO: 3898519 - DNA, 11 bp, Homo sapiens
ataaagctgga

SEQ ID NO: 3898520 - DNA, 21 bp, Homo sapiens
ataaagctggacaagaagctg

SEQ ID NO: 3898521 - DNA, 22 bp, Homo sapiens
ataaagctggacaagaagctgc

SEQ ID NO: 3898522 - DNA, 15 bp, Homo sapiens
ataaagtatcatgca

SEQ ID NO: 3898523 - DNA, 18 bp, Homo sapiens
ataaagtatcatgcattc

SEQ ID NO: 3898524 - DNA, 17 bp, Homo sapiens
ataaagttaaaaaaaag

SEQ ID NO: 3898525 - DNA, 15 bp, Homo sapiens
ataaataaatgccaa

SEQ ID NO: 3898526 - DNA, 15 bp, Homo sapiens
ataaataatctgtac

SEQ ID NO: 3898527 - DNA, 22 bp, Homo sapiens
ataaatagatttgattatttcc

SEQ ID NO: 3898528 - DNA, 18 bp, Homo sapiens
ataaatatatatttttca

SEQ ID NO: 3898529 - DNA, 20 bp, Homo sapiens
ataaatatatatttttcaac

SEQ ID NO: 3898530 - DNA, 22 bp, Homo sapiens
ataaatatatatttttcaacca

SEQ ID NO: 3898531 - DNA, 15 bp, Homo sapiens
ataaatccaaagtaa

SEQ ID NO: 3898532 - DNA, 23 bp, Homo sapiens
ataaatctgagcctaaatctaat

SEQ ID NO: 3898533 - DNA, 15 bp, Homo sapiens
ataaatgaatcttac

SEQ ID NO: 3898534 - DNA, 16 bp, Homo sapiens
ataaatgcatgatttt

SEQ ID NO: 3898535 - DNA, 20 bp, Homo sapiens
ataaatgccaactggtcact

SEQ ID NO: 3898536 - DNA, 14 bp, Homo sapiens
ataaatgctgaatg

SEQ ID NO: 3898537 - DNA, 14 bp, Homo sapiens
ataaatggaaatca

SEQ ID NO: 3898538 - DNA, 16 bp, Homo sapiens
ataaatggctggtttt

SEQ ID NO: 3898539 - DNA, 17 bp, Homo sapiens
ataaatgtatatacaca

SEQ ID NO: 3898540 - DNA, 21 bp, Homo sapiens
atacaatatataaaaatatat

SEQ ID NO: 3898541 - DNA, 15 bp, Homo sapiens
atacaatttgcactg

SEQ ID NO: 3898542 - DNA, 14 bp, Homo sapiens
atacacaacattta

SEQ ID NO: 3898543 - DNA, 17 bp, Homo sapiens
atacacacatatacata

SEQ ID NO: 3898544 - DNA, 19 bp, Homo sapiens
atacacacatatacatata

SEQ ID NO: 3898545 - DNA, 17 bp, Homo sapiens
atacacactcaaatcaa

SEQ ID NO: 3898546 - DNA, 13 bp, Homo sapiens
atacacatacata

SEQ ID NO: 3898547 - DNA, 18 bp, Homo sapiens
atacacatacatacacat

SEQ ID NO: 3898548 - DNA, 16 bp, Homo sapiens
atacacatacatacat

SEQ ID NO: 3898549 - DNA, 14 bp, Homo sapiens
atacaccgggcctg

SEQ ID NO: 3898550 - DNA, 18 bp, Homo sapiens
atacaccgggcctggaga

SEQ ID NO: 3898551 - DNA, 12 bp, Homo sapiens
atacactcctgc

SEQ ID NO: 3898552 - DNA, 14 bp, Homo sapiens
atacactcctgctg

SEQ ID NO: 3898553 - DNA, 17 bp, Homo sapiens
atacacttgtataaatg

SEQ ID NO: 3898554 - DNA, 18 bp, Homo sapiens
atacacttgtataaatgt

SEQ ID NO: 3898555 - DNA, 19 bp, Homo sapiens
atacacttgtataaatgta

SEQ ID NO: 3898556 - DNA, 22 bp, Homo sapiens
atacacttgtataaatgtatat

SEQ ID NO: 3898557 - DNA, 23 bp, Homo sapiens
atacagaaagatggatgtgcttt

SEQ ID NO: 3898558 - DNA, 14 bp, Homo sapiens
atacagaatgaatc

SEQ ID NO: 3898559 - DNA, 14 bp, Homo sapiens
atacagacactaag

SEQ ID NO: 3898560 - DNA, 18 bp, Homo sapiens
atacagacactaagttat

SEQ ID NO: 3898561 - DNA, 23 bp, Homo sapiens
atacagacactaagttatagtat

SEQ ID NO: 3898562 - DNA, 22 bp, Homo sapiens
atacagattctagccaaactat

SEQ ID NO: 3898563 - DNA, 18 bp, Homo sapiens
atacagtaaagtttaaaa

SEQ ID NO: 3898564 - DNA, 21 bp, Homo sapiens
atacagtaaagtttaaaaaat

SEQ ID NO: 3898565 - DNA, 15 bp, Homo sapiens
atacagtgttatttt

SEQ ID NO: 3898566 - DNA, 17 bp, Homo sapiens
atacatacacatacata

SEQ ID NO: 3898567 - DNA, 17 bp, Homo sapiens
atacatagtcacaaaaa

SEQ ID NO: 3898568 - DNA, 12 bp, Homo sapiens
atacatatatat

SEQ ID NO: 3898569 - DNA, 20 bp, Homo sapiens
atacatatatatatacacat

SEQ ID NO: 3898570 - DNA, 14 bp, Homo sapiens
atacatatatatct

SEQ ID NO: 3898571 - DNA, 13 bp, Homo sapiens
atacatatcagaa

SEQ ID NO: 3898572 - DNA, 17 bp, Homo sapiens
atacatatcagaaaagt

SEQ ID NO: 3898573 - DNA, 18 bp, Homo sapiens
atacatatcagaaaagta

SEQ ID NO: 3898574 - DNA, 20 bp, Homo sapiens
atacatatcagaaaagtaga

SEQ ID NO: 3898575 - DNA, 18 bp, Homo sapiens
atacatatgtagactata

SEQ ID NO: 3898576 - DNA, 14 bp, Homo sapiens
atacatattataaa

SEQ ID NO: 3898577 - DNA, 16 bp, Homo sapiens
atacatgactcagcat

SEQ ID NO: 3898578 - DNA, 15 bp, Homo sapiens
atacatggggaactg

SEQ ID NO: 3898579 - DNA, 12 bp, Homo sapiens
atacatgtgtgt

SEQ ID NO: 3898580 - DNA, 13 bp, Homo sapiens
atacatgtgtgta

SEQ ID NO: 3898581 - DNA, 14 bp, Homo sapiens
atacatgtgtgtat

SEQ ID NO: 3898582 - DNA, 17 bp, Homo sapiens
atacatgtgtgtatata

SEQ ID NO: 3898583 - DNA, 23 bp, Homo sapiens
atacatgtgtgtatatatgtgta

SEQ ID NO: 3898584 - DNA, 19 bp, Homo sapiens
atacattccctatcaaaac

SEQ ID NO: 3898585 - DNA, 17 bp, Homo sapiens
ataccaagtatttatta

SEQ ID NO: 3898586 - DNA, 20 bp, Homo sapiens
ataccaatgcttttatcaaa

SEQ ID NO: 3898587 - DNA, 19 bp, Homo sapiens
ataccagagacctgaggca

SEQ ID NO: 3898588 - DNA, 17 bp, Homo sapiens
ataccagtgaaccaaag

SEQ ID NO: 3898589 - DNA, 17 bp, Homo sapiens
ataccatacattatcat

SEQ ID NO: 3898590 - DNA, 21 bp, Homo sapiens
ataccatactcatttctaaaa

SEQ ID NO: 3898591 - DNA, 15 bp, Homo sapiens
ataccatgtctctaa

SEQ ID NO: 3898592 - DNA, 15 bp, Homo sapiens
atacccccagagacc

SEQ ID NO: 3898593 - DNA, 17 bp, Homo sapiens
atacccccagagacctt

SEQ ID NO: 3898594 - DNA, 15 bp, Homo sapiens
atacccctgcctggg

SEQ ID NO: 3898595 - DNA, 19 bp, Homo sapiens
atacccttctttaaatcaa

SEQ ID NO: 3898596 - DNA, 20 bp, Homo sapiens
atacccttctttaaatcaaa

SEQ ID NO: 3898597 - DNA, 17 bp, Homo sapiens
atacctataatgtgtgt

SEQ ID NO: 3898598 - DNA, 15 bp, Homo sapiens
atacctcaacctatg

SEQ ID NO: 3898599 - DNA, 15 bp, Homo sapiens
atacctctgaccaac

SEQ ID NO: 3898600 - DNA, 14 bp, Homo sapiens
ataccttcttcgct

SEQ ID NO: 3898601 - DNA, 16 bp, Homo sapiens
atacctttggaaaaat

SEQ ID NO: 3898602 - DNA, 14 bp, Homo sapiens
atacgaaacacaaa

SEQ ID NO: 3898603 - DNA, 18 bp, Homo sapiens
atactaaaaatcatgaga

SEQ ID NO: 3898604 - DNA, 21 bp, Homo sapiens
atactaaaagttcttctccaa

SEQ ID NO: 3898605 - DNA, 14 bp, Homo sapiens
atactaaagtgtct

SEQ ID NO: 3898606 - DNA, 18 bp, Homo sapiens
atactaaagtgtctatta

SEQ ID NO: 3898607 - DNA, 23 bp, Homo sapiens
atactagaaagctctgcatgtgt

SEQ ID NO: 3898608 - DNA, 17 bp, Homo sapiens
atactccaagcttcaag

SEQ ID NO: 3898609 - DNA, 13 bp, Homo sapiens
atactctgtcaga

SEQ ID NO: 3898610 - DNA, 14 bp, Homo sapiens
atactctgtcagat

SEQ ID NO: 3898611 - DNA, 15 bp, Homo sapiens
atactctgtcagatg

SEQ ID NO: 3898612 - DNA, 16 bp, Homo sapiens
atactctgtcagatgg

SEQ ID NO: 3898613 - DNA, 12 bp, Homo sapiens
atactgctctga

SEQ ID NO: 3898614 - DNA, 17 bp, Homo sapiens
atactgtacttaataaa

SEQ ID NO: 3898615 - DNA, 16 bp, Homo sapiens
atacttaagcaaaagt

SEQ ID NO: 3898616 - DNA, 10 bp, Homo sapiens
atacttgagc

SEQ ID NO: 3898617 - DNA, 18 bp, Homo sapiens
atacttgagctgtatata

SEQ ID NO: 3898618 - DNA, 14 bp, Homo sapiens
atactttttttcac

SEQ ID NO: 3898619 - DNA, 11 bp, Homo sapiens
atagaaacatg

SEQ ID NO: 3898620 - DNA, 16 bp, Homo sapiens
atagaaacatgacact

SEQ ID NO: 3898621 - DNA, 13 bp, Homo sapiens
atagaacagaact

SEQ ID NO: 3898622 - DNA, 14 bp, Homo sapiens
atagaatttccaat

SEQ ID NO: 3898623 - DNA, 20 bp, Homo sapiens
atagacagtatatttatagt

SEQ ID NO: 3898624 - DNA, 16 bp, Homo sapiens
atagacatttgtaaat

SEQ ID NO: 3898625 - DNA, 14 bp, Homo sapiens
atagagaaaaactt

SEQ ID NO: 3898626 - DNA, 17 bp, Homo sapiens
atagagagggggctctc

SEQ ID NO: 3898627 - DNA, 17 bp, Homo sapiens
atcacttgtaaataaat

SEQ ID NO: 3898628 - DNA, 22 bp, Homo sapiens
atcacttgtaaataaatagatt

SEQ ID NO: 3898629 - DNA, 14 bp, Homo sapiens
atcactttgttaaa

SEQ ID NO: 3898630 - DNA, 13 bp, Homo sapiens
atcacttttcagt

SEQ ID NO: 3898631 - DNA, 15 bp, Homo sapiens
atcacttttcagtga

SEQ ID NO: 3898632 - DNA, 14 bp, Homo sapiens
atcacttttctgta

SEQ ID NO: 3898633 - DNA, 14 bp, Homo sapiens
atcagaaaagtaga

SEQ ID NO: 3898634 - DNA, 18 bp, Homo sapiens
atcagaaaagtagaatta

SEQ ID NO: 3898635 - DNA, 20 bp, Homo sapiens
atcagaaaagtagaattata

SEQ ID NO: 3898636 - DNA, 21 bp, Homo sapiens
atcagaaatgtcatcaaatat

SEQ ID NO: 3898637 - DNA, 23 bp, Homo sapiens
atcagaagaccacaaaaattgac

SEQ ID NO: 3898638 - DNA, 14 bp, Homo sapiens
atcagaaggctggg

SEQ ID NO: 3898639 - DNA, 19 bp, Homo sapiens
atcagaaggctggggccag

SEQ ID NO: 3898640 - DNA, 18 bp, Homo sapiens
atcagaatcgctaataga

SEQ ID NO: 3898641 - DNA, 13 bp, Homo sapiens
atcagaatggaaa

SEQ ID NO: 3898642 - DNA, 16 bp, Homo sapiens
atcagaccctacccca

SEQ ID NO: 3898643 - DNA, 18 bp, Homo sapiens
atcagaccctaccccacc

SEQ ID NO: 3898644 - DNA, 19 bp, Homo sapiens
atcagaccctaccccacca

SEQ ID NO: 3898645 - DNA, 18 bp, Homo sapiens
atcagacctctgatccct

SEQ ID NO: 3898646 - DNA, 21 bp, Homo sapiens
atcagagctcttaatgttgct

SEQ ID NO: 3898647 - DNA, 16 bp, Homo sapiens
atcagagtgacatcca

SEQ ID NO: 3898648 - DNA, 13 bp, Homo sapiens
atcagcactgaaa

SEQ ID NO: 3898649 - DNA, 14 bp, Homo sapiens
atcagcactgaaaa

SEQ ID NO: 3898650 - DNA, 14 bp, Homo sapiens
atcagccatgtttg

SEQ ID NO: 3898651 - DNA, 12 bp, Homo sapiens
atcagcctgagt

SEQ ID NO: 3898652 - DNA, 20 bp, Homo sapiens
atcagcctgagtctcctgtg

SEQ ID NO: 3898653 - DNA, 20 bp, Homo sapiens
atcagctacttaagagaaat

SEQ ID NO: 3898654 - DNA, 19 bp, Homo sapiens
atcagctcccttcccctgc

SEQ ID NO: 3898655 - DNA, 22 bp, Homo sapiens
atcagctcccttcccctgcctg

SEQ ID NO: 3898656 - DNA, 17 bp, Homo sapiens
atcagctgctgaaacaa

SEQ ID NO: 3898657 - DNA, 21 bp, Homo sapiens
atcagctgctgaaacaacaaa

SEQ ID NO: 3898658 - DNA, 22 bp, Homo sapiens
atcagctgctgaaacaacaaat

SEQ ID NO: 3898659 - DNA, 23 bp, Homo sapiens
atcagctgctgaaacaacaaata

SEQ ID NO: 3898660 - DNA, 22 bp, Homo sapiens
atcagcttgccctgttaaaaga

SEQ ID NO: 3898661 - DNA, 13 bp, Homo sapiens
atcaggcacaggc

SEQ ID NO: 3898662 - DNA, 16 bp, Homo sapiens
atcaggcactggtggc

SEQ ID NO: 3898663 - DNA, 17 bp, Homo sapiens
atcaggcactggtggca

SEQ ID NO: 3898664 - DNA, 19 bp, Homo sapiens
atcaggcctaatctcatac

SEQ ID NO: 3898665 - DNA, 21 bp, Homo sapiens
atcaggtcattattttttaca

SEQ ID NO: 3898666 - DNA, 20 bp, Homo sapiens
atcaggtcctcagagaattt

SEQ ID NO: 3898667 - DNA, 16 bp, Homo sapiens
atcaggttgttaatgt

SEQ ID NO: 3898668 - DNA, 15 bp, Homo sapiens
atcagtgcagtgata

SEQ ID NO: 3898669 - DNA, 17 bp, Homo sapiens
atcagtgtcctcttgct

SEQ ID NO: 3898670 - DNA, 19 bp, Homo sapiens
atcagttactcagccctgg

SEQ ID NO: 3898671 - DNA, 15 bp, Homo sapiens
atcataattttcaag

SEQ ID NO: 3898672 - DNA, 12 bp, Homo sapiens
atcatagaaatg

SEQ ID NO: 3898673 - DNA, 13 bp, Homo sapiens
atcatattgtatg

SEQ ID NO: 3898674 - DNA, 20 bp, Homo sapiens
atcatcagcatacctttatt

SEQ ID NO: 3898675 - DNA, 14 bp, Homo sapiens
atcatcccagctgc

SEQ ID NO: 3898676 - DNA, 15 bp, Homo sapiens
atcatcgaaaattca

SEQ ID NO: 3898677 - DNA, 16 bp, Homo sapiens
atcatctgtgtgaaaa

SEQ ID NO: 3898678 - DNA, 17 bp, Homo sapiens
atcatgaaaagaggaac

SEQ ID NO: 3898679 - DNA, 20 bp, Homo sapiens
atcatgaaaagaggaacagg

SEQ ID NO: 3898680 - DNA, 18 bp, Homo sapiens
atcatgacatgttatata

SEQ ID NO: 3898681 - DNA, 14 bp, Homo sapiens
atcatgcctctgag

SEQ ID NO: 3898682 - DNA, 23 bp, Homo sapiens
atcatgcctctgaggccagcctg

SEQ ID NO: 3898683 - DNA, 19 bp, Homo sapiens
atcatggtcagctcacacc

SEQ ID NO: 3898684 - DNA, 20 bp, Homo sapiens
atcatggtcagctcacaccc

SEQ ID NO: 3898685 - DNA, 18 bp, Homo sapiens
atcatgtcaggcctgtgt

SEQ ID NO: 3898686 - DNA, 20 bp, Homo sapiens
atcatgttggccaggctggt

SEQ ID NO: 3898687 - DNA, 23 bp, Homo sapiens
atcattaaattggaattttctta

SEQ ID NO: 3898688 - DNA, 21 bp, Homo sapiens
atcattaatgtaggtttagat

SEQ ID NO: 3898689 - DNA, 14 bp, Homo sapiens
atcattcaaaacaa

SEQ ID NO: 3898690 - DNA, 14 bp, Homo sapiens
atcatttaagaagg

SEQ ID NO: 3898691 - DNA, 20 bp, Homo sapiens
atcatttctgcatcagctgc

SEQ ID NO: 3898692 - DNA, 13 bp, Homo sapiens
atcatttgcaatg

SEQ ID NO: 3898693 - DNA, 14 bp, Homo sapiens
atcatttttttaac

SEQ ID NO: 3898694 - DNA, 13 bp, Homo sapiens
atccaaggagaaa

SEQ ID NO: 3898695 - DNA, 22 bp, Homo sapiens
atccaagtattttatctgtgtt

SEQ ID NO: 3898696 - DNA, 17 bp, Homo sapiens
atccacaaagccgtgcc

SEQ ID NO: 3898697 - DNA, 20 bp, Homo sapiens
atccacacacagaggaagag

SEQ ID NO: 3898698 - DNA, 23 bp, Homo sapiens
atccacacacagaggaagagcag

SEQ ID NO: 3898699 - DNA, 23 bp, Homo sapiens
atccacccagtgctgccatgcca

SEQ ID NO: 3898700 - DNA, 15 bp, Homo sapiens
atccacgcacacatg

SEQ ID NO: 3898701 - DNA, 22 bp, Homo sapiens
atccagagtttagaggaaaaaa

SEQ ID NO: 3898702 - DNA, 13 bp, Homo sapiens
atccagcctgtgt

SEQ ID NO: 3898703 - DNA, 20 bp, Homo sapiens
atccagcctgtgtgttctgt

SEQ ID NO: 3898704 - DNA, 18 bp, Homo sapiens
atccaggtgggagagaca

SEQ ID NO: 3898705 - DNA, 14 bp, Homo sapiens
atccagtaagcaca

SEQ ID NO: 3898706 - DNA, 17 bp, Homo sapiens
atccagtaagcacatgt

SEQ ID NO: 3898707 - DNA, 16 bp, Homo sapiens
atccagttgcaataaa

SEQ ID NO: 3898708 - DNA, 19 bp, Homo sapiens
atccagttgcaataaaata

SEQ ID NO: 3898709 - DNA, 20 bp, Homo sapiens
atccagttgcaataaaatag

SEQ ID NO: 3898710 - DNA, 21 bp, Homo sapiens
atccagttgcaataaaatagt

SEQ ID NO: 3898711 - DNA, 20 bp, Homo sapiens
atccagtttgttctccgggt

SEQ ID NO: 3898712 - DNA, 19 bp, Homo sapiens
atccatgtcctatgtgtga

SEQ ID NO: 3898713 - DNA, 15 bp, Homo sapiens
atgaaacagatgata

SEQ ID NO: 3898714 - DNA, 23 bp, Homo sapiens
atgaaacagatgataaatattta

SEQ ID NO: 3898715 - DNA, 12 bp, Homo sapiens
atgaaagcatgt

SEQ ID NO: 3898716 - DNA, 20 bp, Homo sapiens
atgaaagggaaagtcagctt

SEQ ID NO: 3898717 - DNA, 21 bp, Homo sapiens
atgaaagggaaagtcagcttt

SEQ ID NO: 3898718 - DNA, 22 bp, Homo sapiens
atgaaagtgcaaagtgccctca

SEQ ID NO: 3898719 - DNA, 22 bp, Homo sapiens
atgaaataaattggtgataagt

SEQ ID NO: 3898720 - DNA, 17 bp, Homo sapiens
atgaaatgactgtctaa

SEQ ID NO: 3898721 - DNA, 18 bp, Homo sapiens
atgaaatgggctttaaca

SEQ ID NO: 3898722 - DNA, 11 bp, Homo sapiens
atgaaatgtct

SEQ ID NO: 3898723 - DNA, 18 bp, Homo sapiens
atgaaattcttgaagttc

SEQ ID NO: 3898724 - DNA, 16 bp, Homo sapiens
atgaacagcagaaaga

SEQ ID NO: 3898725 - DNA, 15 bp, Homo sapiens
atgaacttgaggaca

SEQ ID NO: 3898726 - DNA, 16 bp, Homo sapiens
atgaacttgaggacac

SEQ ID NO: 3898727 - DNA, 17 bp, Homo sapiens
atgaacttgaggacaca

SEQ ID NO: 3898728 - DNA, 21 bp, Homo sapiens
atgaagactgttaaatgaaac

SEQ ID NO: 3898729 - DNA, 21 bp, Homo sapiens
atgaagagaagctgagaagaa

SEQ ID NO: 3898730 - DNA, 21 bp, Homo sapiens
atgaagatgtctaatagttat

SEQ ID NO: 3898731 - DNA, 15 bp, Homo sapiens
atgaagggcccgaga

SEQ ID NO: 3898732 - DNA, 16 bp, Homo sapiens
atgaaggttaggattt

SEQ ID NO: 3898733 - DNA, 20 bp, Homo sapiens
atgaaggttaggatttaaca

SEQ ID NO: 3898734 - DNA, 18 bp, Homo sapiens
atgaagtcgttgtgaggg

SEQ ID NO: 3898735 - DNA, 18 bp, Homo sapiens
atgaagtgttagatagaa

SEQ ID NO: 3898736 - DNA, 17 bp, Homo sapiens
atgaataaagacaccta

SEQ ID NO: 3898737 - DNA, 22 bp, Homo sapiens
atgaatgataagcaggaaggat

SEQ ID NO: 3898738 - DNA, 15 bp, Homo sapiens
atgaatgatgtttta

SEQ ID NO: 3898739 - DNA, 13 bp, Homo sapiens
atgaatgccttcc

SEQ ID NO: 3898740 - DNA, 16 bp, Homo sapiens
atgaattaaataaacc

SEQ ID NO: 3898741 - DNA, 13 bp, Homo sapiens
atgaattgcattt

SEQ ID NO: 3898742 - DNA, 19 bp, Homo sapiens
atgacaacagaagcttcag

SEQ ID NO: 3898743 - DNA, 20 bp, Homo sapiens
atgacaagcaaggtttctgg

SEQ ID NO: 3898744 - DNA, 15 bp, Homo sapiens
atgacacggtaggcc

SEQ ID NO: 3898745 - DNA, 22 bp, Homo sapiens
atgacacggtaggccaagctga

SEQ ID NO: 3898746 - DNA, 23 bp, Homo sapiens
atgacacggtaggccaagctgaa

SEQ ID NO: 3898747 - DNA, 16 bp, Homo sapiens
atgacagctgtccctg

SEQ ID NO: 3898748 - DNA, 17 bp, Homo sapiens
atgacagctgtccctgt

SEQ ID NO: 3898749 - DNA, 14 bp, Homo sapiens
atgacatcacttgt

SEQ ID NO: 3898750 - DNA, 19 bp, Homo sapiens
atgacatcacttgtacaaa

SEQ ID NO: 3898751 - DNA, 16 bp, Homo sapiens
atgacatgccaccctc

SEQ ID NO: 3898752 - DNA, 23 bp, Homo sapiens
atgacatgttatatattttttgt

SEQ ID NO: 3898753 - DNA, 19 bp, Homo sapiens
atgacattgttaaaataaa

SEQ ID NO: 3898754 - DNA, 20 bp, Homo sapiens
atgaccaagaaaaagaaaaa

SEQ ID NO: 3898755 - DNA, 22 bp, Homo sapiens
atgaccaagaaaaagaaaaaaa

SEQ ID NO: 3898756 - DNA, 19 bp, Homo sapiens
atgaccacgggcctcagtt

SEQ ID NO: 3898757 - DNA, 13 bp, Homo sapiens
atgacccaaagac

SEQ ID NO: 3898758 - DNA, 15 bp, Homo sapiens
atgacccaaagacca

SEQ ID NO: 3898759 - DNA, 16 bp, Homo sapiens
atgacccaaagaccaa

SEQ ID NO: 3898760 - DNA, 13 bp, Homo sapiens
atgacctccagct

SEQ ID NO: 3898761 - DNA, 22 bp, Homo sapiens
atgactagaggcagggagggga

SEQ ID NO: 3898762 - DNA, 23 bp, Homo sapiens
atgactataaacattaaaagaag

SEQ ID NO: 3898763 - DNA, 22 bp, Homo sapiens
atgacttgggcacccccagcct

SEQ ID NO: 3898764 - DNA, 23 bp, Homo sapiens
atgacttgggcacccccagcctg

SEQ ID NO: 3898765 - DNA, 17 bp, Homo sapiens
atgacttttctggaaga

SEQ ID NO: 3898766 - DNA, 20 bp, Homo sapiens
atgacttttctggaagacat

SEQ ID NO: 3898767 - DNA, 22 bp, Homo sapiens
atgagaaactttgatctctgct

SEQ ID NO: 3898768 - DNA, 18 bp, Homo sapiens
atgagaagagggcctgtg

SEQ ID NO: 3898769 - DNA, 15 bp, Homo sapiens
atgagacttgctctc

SEQ ID NO: 3898770 - DNA, 13 bp, Homo sapiens
atgagatccttta

SEQ ID NO: 3898771 - DNA, 20 bp, Homo sapiens
atgagatttgccagcacagg

SEQ ID NO: 3898772 - DNA, 22 bp, Homo sapiens
atgagctcctcttcctggcttc

SEQ ID NO: 3898773 - DNA, 20 bp, Homo sapiens
atgagctctgaacaaacact

SEQ ID NO: 3898774 - DNA, 15 bp, Homo sapiens
atgagctgtatctgt

SEQ ID NO: 3898775 - DNA, 18 bp, Homo sapiens
atgagctgtatctgtaat

SEQ ID NO: 3898776 - DNA, 13 bp, Homo sapiens
atgaggacatgtt

SEQ ID NO: 3898777 - DNA, 15 bp, Homo sapiens
atgaggcctcttgga

SEQ ID NO: 3898778 - DNA, 17 bp, Homo sapiens
atgaggctattaaaaga

SEQ ID NO: 3898779 - DNA, 20 bp, Homo sapiens
atgagggactggaaccaggg

SEQ ID NO: 3898780 - DNA, 13 bp, Homo sapiens
atgagggcagcag

SEQ ID NO: 3898781 - DNA, 16 bp, Homo sapiens
atgagggcagcagcca

SEQ ID NO: 3898782 - DNA, 13 bp, Homo sapiens
atgaggtaattct

SEQ ID NO: 3898783 - DNA, 23 bp, Homo sapiens
atgagtatacaatatataaaaat

SEQ ID NO: 3898784 - DNA, 15 bp, Homo sapiens
atgagtggatggatg

SEQ ID NO: 3898785 - DNA, 22 bp, Homo sapiens
atgagttgttttcagactcaga

SEQ ID NO: 3898786 - DNA, 14 bp, Homo sapiens
atgataaagatgtc

SEQ ID NO: 3898787 - DNA, 18 bp, Homo sapiens
atgataaagatgtcaaat

SEQ ID NO: 3898788 - DNA, 20 bp, Homo sapiens
atgataaagatgtcaaatat

SEQ ID NO: 3898789 - DNA, 12 bp, Homo sapiens
atgatattttat

SEQ ID NO: 3898790 - DNA, 14 bp, Homo sapiens
atgatattttcaga

SEQ ID NO: 3898791 - DNA, 15 bp, Homo sapiens
atgatcacagtgact

SEQ ID NO: 3898792 - DNA, 22 bp, Homo sapiens
atgatcactaatactaattcat

SEQ ID NO: 3898793 - DNA, 14 bp, Homo sapiens
atgatcgtgcctat

SEQ ID NO: 3898794 - DNA, 14 bp, Homo sapiens
atgatctactcaga

SEQ ID NO: 3898795 - DNA, 15 bp, Homo sapiens
atgatctactcagaa

SEQ ID NO: 3898796 - DNA, 15 bp, Homo sapiens
atgatctccctgccg

SEQ ID NO: 3898797 - DNA, 22 bp, Homo sapiens
atgatcttgagatttcttttaa

SEQ ID NO: 3898798 - DNA, 13 bp, Homo sapiens
atgatgatgatga

SEQ ID NO: 3898799 - DNA, 22 bp, Homo sapiens
atgttaattcagcactgatttc

SEQ ID NO: 3898800 - DNA, 19 bp, Homo sapiens
atgttaggaaaatttcaca

SEQ ID NO: 3898801 - DNA, 16 bp, Homo sapiens
atgttagggtgctctg

SEQ ID NO: 3898802 - DNA, 13 bp, Homo sapiens
atgttatatattt

SEQ ID NO: 3898803 - DNA, 14 bp, Homo sapiens
atgttcaactggag

SEQ ID NO: 3898804 - DNA, 23 bp, Homo sapiens
atgttcagaaggttgctctagat

SEQ ID NO: 3898805 - DNA, 17 bp, Homo sapiens
atgttccaataaaactt

SEQ ID NO: 3898806 - DNA, 19 bp, Homo sapiens
atgttccaataaaacttta

SEQ ID NO: 3898807 - DNA, 19 bp, Homo sapiens
atgttccctgcaccctgga

SEQ ID NO: 3898808 - DNA, 15 bp, Homo sapiens
atgttccctttaaaa

SEQ ID NO: 3898809 - DNA, 16 bp, Homo sapiens
atgttcctagtgaaag

SEQ ID NO: 3898810 - DNA, 22 bp, Homo sapiens
atgttcctttggaagaaaaaat

SEQ ID NO: 3898811 - DNA, 16 bp, Homo sapiens
atgttctcagaatcag

SEQ ID NO: 3898812 - DNA, 17 bp, Homo sapiens
atgttctcagaatcagg

SEQ ID NO: 3898813 - DNA, 16 bp, Homo sapiens
atgttctggctttaca

SEQ ID NO: 3898814 - DNA, 21 bp, Homo sapiens
atgttctgtcacgtgaaatat

SEQ ID NO: 3898815 - DNA, 13 bp, Homo sapiens
atgttgaaatctt

SEQ ID NO: 3898816 - DNA, 20 bp, Homo sapiens
atgttgagggaacagacagg

SEQ ID NO: 3898817 - DNA, 13 bp, Homo sapiens
atgttgcatgcct

SEQ ID NO: 3898818 - DNA, 15 bp, Homo sapiens
atgttgctggactgt

SEQ ID NO: 3898819 - DNA, 20 bp, Homo sapiens
atgttgctgtgcacggtgga

SEQ ID NO: 3898820 - DNA, 19 bp, Homo sapiens
atgttggatagtcagctgt

SEQ ID NO: 3898821 - DNA, 17 bp, Homo sapiens
atgttggccaggctggt

SEQ ID NO: 3898822 - DNA, 14 bp, Homo sapiens
atgttgggatttat

SEQ ID NO: 3898823 - DNA, 15 bp, Homo sapiens
atgttgtcattatgt

SEQ ID NO: 3898824 - DNA, 19 bp, Homo sapiens
atgttgttcaaatgcattt

SEQ ID NO: 3898825 - DNA, 20 bp, Homo sapiens
atgtttaaactttgtgcctt

SEQ ID NO: 3898826 - DNA, 15 bp, Homo sapiens
atgtttacagaactg

SEQ ID NO: 3898827 - DNA, 16 bp, Homo sapiens
atgtttagattccagg

SEQ ID NO: 3898828 - DNA, 18 bp, Homo sapiens
atgtttattcctgataat

SEQ ID NO: 3898829 - DNA, 13 bp, Homo sapiens
atgtttccagaaa

SEQ ID NO: 3898830 - DNA, 16 bp, Homo sapiens
atgtttccagaaaata

SEQ ID NO: 3898831 - DNA, 18 bp, Homo sapiens
atgtttccagaaaatata

SEQ ID NO: 3898832 - DNA, 18 bp, Homo sapiens
atgtttgggcagaaggga

SEQ ID NO: 3898833 - DNA, 13 bp, Homo sapiens
atgtttgtgcctt

SEQ ID NO: 3898834 - DNA, 19 bp, Homo sapiens
atgtttgtgccttaaaagg

SEQ ID NO: 3898835 - DNA, 12 bp, Homo sapiens
atgttttgtaca

SEQ ID NO: 3898836 - DNA, 14 bp, Homo sapiens
atgttttgtacaat

SEQ ID NO: 3898837 - DNA, 19 bp, Homo sapiens
atgttttgtacaattacta

SEQ ID NO: 3898838 - DNA, 13 bp, Homo sapiens
atgttttgttcaa

SEQ ID NO: 3898839 - DNA, 18 bp, Homo sapiens
atgtttttgaaaagctaa

SEQ ID NO: 3898840 - DNA, 23 bp, Homo sapiens
attaaaaaaaagaagagccttgt

SEQ ID NO: 3898841 - DNA, 12 bp, Homo sapiens
attaaaaaacaa

SEQ ID NO: 3898842 - DNA, 14 bp, Homo sapiens
attaaaaatatgga

SEQ ID NO: 3898843 - DNA, 21 bp, Homo sapiens
attaaaaatatggaacttcta

SEQ ID NO: 3898844 - DNA, 16 bp, Homo sapiens
attaaaagaatatttt

SEQ ID NO: 3898845 - DNA, 14 bp, Homo sapiens
attaaaagaatttt

SEQ ID NO: 3898846 - DNA, 23 bp, Homo sapiens
attaaaatatatataaatatata

SEQ ID NO: 3898847 - DNA, 15 bp, Homo sapiens
attaaaatctggaaa

SEQ ID NO: 3898848 - DNA, 16 bp, Homo sapiens
attaaaatctggaaat

SEQ ID NO: 3898849 - DNA, 17 bp, Homo sapiens
attaaaatctggaaatc

SEQ ID NO: 3898850 - DNA, 22 bp, Homo sapiens
attaaaatgtaggaagaaaaat

SEQ ID NO: 3898851 - DNA, 12 bp, Homo sapiens
attaaaattaag

SEQ ID NO: 3898852 - DNA, 16 bp, Homo sapiens
attaaaattaaggtct

SEQ ID NO: 3898853 - DNA, 17 bp, Homo sapiens
attaaacgagataatgt

SEQ ID NO: 3898854 - DNA, 16 bp, Homo sapiens
attaaaggaaggaaaa

SEQ ID NO: 3898855 - DNA, 20 bp, Homo sapiens
attaaatacagacactaagt

SEQ ID NO: 3898856 - DNA, 21 bp, Homo sapiens
attaaatgtatatgtcattta

SEQ ID NO: 3898857 - DNA, 17 bp, Homo sapiens
attaaattggaattttc

SEQ ID NO: 3898858 - DNA, 18 bp, Homo sapiens
attaacaaaagattctgt

SEQ ID NO: 3898859 - DNA, 14 bp, Homo sapiens
attaacaaattatg

SEQ ID NO: 3898860 - DNA, 18 bp, Homo sapiens
attaacgggcatgtatta

SEQ ID NO: 3898861 - DNA, 15 bp, Homo sapiens
attaacttagcatgt

SEQ ID NO: 3898862 - DNA, 16 bp, Homo sapiens
attaagagatacattc

SEQ ID NO: 3898863 - DNA, 16 bp, Homo sapiens
attaagatacactcct

SEQ ID NO: 3898864 - DNA, 17 bp, Homo sapiens
attaagattgaggcctg

SEQ ID NO: 3898865 - DNA, 14 bp, Homo sapiens
attaagccaaacat

SEQ ID NO: 3898866 - DNA, 16 bp, Homo sapiens
attaaggtgatgtgat

SEQ ID NO: 3898867 - DNA, 22 bp, Homo sapiens
attaaggtttgccctgcctgca

SEQ ID NO: 3898868 - DNA, 21 bp, Homo sapiens
attaagtctgggatgtagaac

SEQ ID NO: 3898869 - DNA, 17 bp, Homo sapiens
attaagttattgatttt

SEQ ID NO: 3898870 - DNA, 16 bp, Homo sapiens
attaataaaaaatgga

SEQ ID NO: 3898871 - DNA, 19 bp, Homo sapiens
attaataaaaaatggaaag

SEQ ID NO: 3898872 - DNA, 13 bp, Homo sapiens
attaataaatttt

SEQ ID NO: 3898873 - DNA, 12 bp, Homo sapiens
attaatattcct

SEQ ID NO: 3898874 - DNA, 18 bp, Homo sapiens
attaatctttctttacct

SEQ ID NO: 3898875 - DNA, 12 bp, Homo sapiens
attaatgtgttg

SEQ ID NO: 3898876 - DNA, 18 bp, Homo sapiens
attaatgttaattcagca

SEQ ID NO: 3898877 - DNA, 13 bp, Homo sapiens
attaatttatggt

SEQ ID NO: 3898878 - DNA, 15 bp, Homo sapiens
attaatttatggttt

SEQ ID NO: 3898879 - DNA, 15 bp, Homo sapiens
attacagaggaagtt

SEQ ID NO: 3898880 - DNA, 17 bp, Homo sapiens
attacagaggaagttat

SEQ ID NO: 3898881 - DNA, 17 bp, Homo sapiens
attacataatcaaagct

SEQ ID NO: 3898882 - DNA, 14 bp, Homo sapiens
attacatctaatgc

SEQ ID NO: 3898883 - DNA, 22 bp, Homo sapiens
attacatttccaaatgaatgac

SEQ ID NO: 3898884 - DNA, 19 bp, Homo sapiens
attaccaaaaaagtatttt

SEQ ID NO: 3898885 - DNA, 20 bp, Homo sapiens
attaccatgagaagagggcc

SEQ ID NO: 3898886 - DNA, 22 bp, Homo sapiens
attgttgtgggctttctccggg

SEQ ID NO: 3898887 - DNA, 20 bp, Homo sapiens
attgtttaaaaacaggaaaa

SEQ ID NO: 3898888 - DNA, 15 bp, Homo sapiens
attgtttaaaatcat

SEQ ID NO: 3898889 - DNA, 10 bp, Homo sapiens
attgttttca

SEQ ID NO: 3898890 - DNA, 20 bp, Homo sapiens
atttaaaaaataaaaaaata

SEQ ID NO: 3898891 - DNA, 16 bp, Homo sapiens
atttaaaaataagaaa

SEQ ID NO: 3898892 - DNA, 13 bp, Homo sapiens
atttaaaatgatt

SEQ ID NO: 3898893 - DNA, 14 bp, Homo sapiens
atttaaaatgatta

SEQ ID NO: 3898894 - DNA, 16 bp, Homo sapiens
atttaaacagcagtgt

SEQ ID NO: 3898895 - DNA, 20 bp, Homo sapiens
atttaaacagcagtgttccc

SEQ ID NO: 3898896 - DNA, 13 bp, Homo sapiens
atttaaaccagca

SEQ ID NO: 3898897 - DNA, 21 bp, Homo sapiens
atttaaagacagggaagagca

SEQ ID NO: 3898898 - DNA, 20 bp, Homo sapiens
atttaaaggggagatactct

SEQ ID NO: 3898899 - DNA, 13 bp, Homo sapiens
atttaacaagatc

SEQ ID NO: 3898900 - DNA, 15 bp, Homo sapiens
atttaacactaaaaa

SEQ ID NO: 3898901 - DNA, 22 bp, Homo sapiens
atttaacatgcaacccgaaggt

SEQ ID NO: 3898902 - DNA, 13 bp, Homo sapiens
atttaactaattt

SEQ ID NO: 3898903 - DNA, 17 bp, Homo sapiens
atttaactaatttaaac

SEQ ID NO: 3898904 - DNA, 21 bp, Homo sapiens
atttaactaatttaaaccagc

SEQ ID NO: 3898905 - DNA, 22 bp, Homo sapiens
atttaacttgagggtaataaac

SEQ ID NO: 3898906 - DNA, 19 bp, Homo sapiens
atttaagcctcatatttaa

SEQ ID NO: 3898907 - DNA, 20 bp, Homo sapiens
atttaagccttttgtgtaat

SEQ ID NO: 3898908 - DNA, 18 bp, Homo sapiens
atttaagcttatgtcaga

SEQ ID NO: 3898909 - DNA, 12 bp, Homo sapiens
atttaagtttgt

SEQ ID NO: 3898910 - DNA, 16 bp, Homo sapiens
atttaataaatgtgcc

SEQ ID NO: 3898911 - DNA, 12 bp, Homo sapiens
atttaatgtttg

SEQ ID NO: 3898912 - DNA, 13 bp, Homo sapiens
atttaatgtttga

SEQ ID NO: 3898913 - DNA, 13 bp, Homo sapiens
atttaatgttttc

SEQ ID NO: 3898914 - DNA, 22 bp, Homo sapiens
atttaattttcctggaaagact

SEQ ID NO: 3898915 - DNA, 18 bp, Homo sapiens
atttaatttttacatgac

SEQ ID NO: 3898916 - DNA, 19 bp, Homo sapiens
atttacaataaatattctg

SEQ ID NO: 3898917 - DNA, 17 bp, Homo sapiens
atttaccacagcagctg

SEQ ID NO: 3898918 - DNA, 20 bp, Homo sapiens
atttaccttttctgttgtac

SEQ ID NO: 3898919 - DNA, 14 bp, Homo sapiens
atttactaaaagaa

SEQ ID NO: 3898920 - DNA, 21 bp, Homo sapiens
atttactaagccacaagaaat

SEQ ID NO: 3898921 - DNA, 23 bp, Homo sapiens
atttactaagccacaagaaattt

SEQ ID NO: 3898922 - DNA, 15 bp, Homo sapiens
atttacttgaaagat

SEQ ID NO: 3898923 - DNA, 20 bp, Homo sapiens
atttagaaaacattcatcca

SEQ ID NO: 3898924 - DNA, 14 bp, Homo sapiens
atttagaactgtat

SEQ ID NO: 3898925 - DNA, 13 bp, Homo sapiens
atttagaccctgt

SEQ ID NO: 3898926 - DNA, 18 bp, Homo sapiens
atttagaccctgtttcct

SEQ ID NO: 3898927 - DNA, 18 bp, Homo sapiens
atttagattgttaaaata

SEQ ID NO: 3898928 - DNA, 14 bp, Homo sapiens
atttagggaagcag

SEQ ID NO: 3898929 - DNA, 23 bp, Homo sapiens
atttagggaagcagggacacccc

SEQ ID NO: 3898930 - DNA, 22 bp, Homo sapiens
atttagtaatagtccaatattt

SEQ ID NO: 3898931 - DNA, 14 bp, Homo sapiens
atttagttttatgg

SEQ ID NO: 3898932 - DNA, 21 bp, Homo sapiens
atttagttttatggcatgatt

SEQ ID NO: 3898933 - DNA, 21 bp, Homo sapiens
atttataaaattagaaagcaa

SEQ ID NO: 3898934 - DNA, 15 bp, Homo sapiens
atttataaatgtgtg

SEQ ID NO: 3898935 - DNA, 14 bp, Homo sapiens
atttatacaaaata

SEQ ID NO: 3898936 - DNA, 20 bp, Homo sapiens
atttatatatatatgtatat

SEQ ID NO: 3898937 - DNA, 14 bp, Homo sapiens
atttatatatggca

SEQ ID NO: 3898938 - DNA, 23 bp, Homo sapiens
atttatatatggcatatttatat

SEQ ID NO: 3898939 - DNA, 13 bp, Homo sapiens
atttatatatttg

SEQ ID NO: 3898940 - DNA, 12 bp, Homo sapiens
atttatatctat

SEQ ID NO: 3898941 - DNA, 17 bp, Homo sapiens
atttatatctatagtag

SEQ ID NO: 3898942 - DNA, 14 bp, Homo sapiens
atttatatgttaat

SEQ ID NO: 3898943 - DNA, 18 bp, Homo sapiens
atttatattgtatattct

SEQ ID NO: 3898944 - DNA, 22 bp, Homo sapiens
atttatattgtatattctggaa

SEQ ID NO: 3898945 - DNA, 14 bp, Homo sapiens
atttatatttggaa

SEQ ID NO: 3898946 - DNA, 20 bp, Homo sapiens
atttatcctgaaatttcaga

SEQ ID NO: 3898947 - DNA, 16 bp, Homo sapiens
atttatctctatttaa

SEQ ID NO: 3898948 - DNA, 19 bp, Homo sapiens
atttatgcatggaaacctg

SEQ ID NO: 3898949 - DNA, 20 bp, Homo sapiens
atttatgcctctgtatttaa

SEQ ID NO: 3898950 - DNA, 18 bp, Homo sapiens
atttatggcttataaatg

SEQ ID NO: 3898951 - DNA, 21 bp, Homo sapiens
atttatggcttataaatgtgt

SEQ ID NO: 3898952 - DNA, 17 bp, Homo sapiens
atttatggtttctgcgt

SEQ ID NO: 3898953 - DNA, 22 bp, Homo sapiens
atttatggtttctgcgtgcttt

SEQ ID NO: 3898954 - DNA, 12 bp, Homo sapiens
atttatgtaaac

SEQ ID NO: 3898955 - DNA, 23 bp, Homo sapiens
atttatgtaaactgcattagaaa

SEQ ID NO: 3898956 - DNA, 14 bp, Homo sapiens
atttattagctgta

SEQ ID NO: 3898957 - DNA, 18 bp, Homo sapiens
atttattagctgtaaata

SEQ ID NO: 3898958 - DNA, 12 bp, Homo sapiens
atttattggggt

SEQ ID NO: 3898959 - DNA, 14 bp, Homo sapiens
atttatttcaaaaa

SEQ ID NO: 3898960 - DNA, 16 bp, Homo sapiens
atttatttcatccagt

SEQ ID NO: 3898961 - DNA, 21 bp, Homo sapiens
atttatttctttgtgataaca

SEQ ID NO: 3898962 - DNA, 22 bp, Homo sapiens
atttattttgaaatttgtttct

SEQ ID NO: 3898963 - DNA, 13 bp, Homo sapiens
atttcaaaagaca

SEQ ID NO: 3898964 - DNA, 17 bp, Homo sapiens
atttcaaaagacatgtt

SEQ ID NO: 3898965 - DNA, 11 bp, Homo sapiens
atttcaaatga

SEQ ID NO: 3898966 - DNA, 23 bp, Homo sapiens
atttcaacaagtagctaaagtct

SEQ ID NO: 3898967 - DNA, 18 bp, Homo sapiens
atttcaaccgcttgccat

SEQ ID NO: 3898968 - DNA, 13 bp, Homo sapiens
atttcaactccag

SEQ ID NO: 3898969 - DNA, 15 bp, Homo sapiens
atttcaactccagaa

SEQ ID NO: 3898970 - DNA, 13 bp, Homo sapiens
atttcaagaaaaa

SEQ ID NO: 3898971 - DNA, 23 bp, Homo sapiens
atttcaagaaaaaataaatggaa

SEQ ID NO: 3898972 - DNA, 20 bp, Homo sapiens
atttcacaacagatcaattt

SEQ ID NO: 3898973 - DNA, 11 bp, Homo sapiens
caaaggttttc

SEQ ID NO: 3898974 - DNA, 19 bp, Homo sapiens
caaaggttttcctcttcta

SEQ ID NO: 3898975 - DNA, 13 bp, Homo sapiens
caaagtctaaagt

SEQ ID NO: 3898976 - DNA, 17 bp, Homo sapiens
caaagtctaaagtttac

SEQ ID NO: 3898977 - DNA, 20 bp, Homo sapiens
caaagtctgatttgtgatga

SEQ ID NO: 3898978 - DNA, 13 bp, Homo sapiens
caaagtctgtgtg

SEQ ID NO: 3898979 - DNA, 16 bp, Homo sapiens
caaagtgcaaatactc

SEQ ID NO: 3898980 - DNA, 15 bp, Homo sapiens
caaagtgcagccctt

SEQ ID NO: 3898981 - DNA, 18 bp, Homo sapiens
caaagtgcagcccttcct

SEQ ID NO: 3898982 - DNA, 13 bp, Homo sapiens
caaagtgccctca

SEQ ID NO: 3898983 - DNA, 14 bp, Homo sapiens
caaagtgctgtacc

SEQ ID NO: 3898984 - DNA, 16 bp, Homo sapiens
caaataaaacctcagg

SEQ ID NO: 3898985 - DNA, 17 bp, Homo sapiens
caaataaactctaaaca

SEQ ID NO: 3898986 - DNA, 12 bp, Homo sapiens
caaataaatgtg

SEQ ID NO: 3898987 - DNA, 15 bp, Homo sapiens
caaatactccaagct

SEQ ID NO: 3898988 - DNA, 14 bp, Homo sapiens
caaatataaacttg

SEQ ID NO: 3898989 - DNA, 15 bp, Homo sapiens
caaatataaacttgt

SEQ ID NO: 3898990 - DNA, 14 bp, Homo sapiens
caaatatctcagag

SEQ ID NO: 3898991 - DNA, 12 bp, Homo sapiens
caaatatgcaaa

SEQ ID NO: 3898992 - DNA, 17 bp, Homo sapiens
caaatatgcaaagcact

SEQ ID NO: 3898993 - DNA, 15 bp, Homo sapiens
caaatattaccaaaa

SEQ ID NO: 3898994 - DNA, 23 bp, Homo sapiens
caaatattattcaagtgcctctt

SEQ ID NO: 3898995 - DNA, 21 bp, Homo sapiens
caaatattgttaccatgaaga

SEQ ID NO: 3898996 - DNA, 22 bp, Homo sapiens
caaatcaaagcaagggctccag

SEQ ID NO: 3898997 - DNA, 19 bp, Homo sapiens
caaatcaaccccagactca

SEQ ID NO: 3898998 - DNA, 15 bp, Homo sapiens
caaatcacacctctg

SEQ ID NO: 3898999 - DNA, 16 bp, Homo sapiens
caaatcacacctctgg

SEQ ID NO: 3899000 - DNA, 19 bp, Homo sapiens
caaatctatattaaagtgt

SEQ ID NO: 3899001 - DNA, 13 bp, Homo sapiens
caaatctattcag

SEQ ID NO: 3899002 - DNA, 16 bp, Homo sapiens
caaatctattcagaca

SEQ ID NO: 3899003 - DNA, 20 bp, Homo sapiens
caaatctattcagacaagca

SEQ ID NO: 3899004 - DNA, 23 bp, Homo sapiens
caaatctgtatatgttgtaataa

SEQ ID NO: 3899005 - DNA, 19 bp, Homo sapiens
caaatgaatgaccttgttg

SEQ ID NO: 3899006 - DNA, 15 bp, Homo sapiens
caaatgacatgcact

SEQ ID NO: 3899007 - DNA, 16 bp, Homo sapiens
caaatgacatgcactg

SEQ ID NO: 3899008 - DNA, 18 bp, Homo sapiens
caaatgacccaaagacca

SEQ ID NO: 3899009 - DNA, 22 bp, Homo sapiens
caaatgattttcatcaatttaa

SEQ ID NO: 3899010 - DNA, 18 bp, Homo sapiens
caaatgcacaagctcaga

SEQ ID NO: 3899011 - DNA, 17 bp, Homo sapiens
caaatgctgtagaatgc

SEQ ID NO: 3899012 - DNA, 22 bp, Homo sapiens
caaatggcagcagttccatgaa

SEQ ID NO: 3899013 - DNA, 22 bp, Homo sapiens
caaatgggtgatatcctgaaaa

SEQ ID NO: 3899014 - DNA, 14 bp, Homo sapiens
caaatgtcagagct

SEQ ID NO: 3899015 - DNA, 20 bp, Homo sapiens
caaatgtgatcaactgttca

SEQ ID NO: 3899016 - DNA, 16 bp, Homo sapiens
caaattactctttctc

SEQ ID NO: 3899017 - DNA, 14 bp, Homo sapiens
caaattatttgtgt

SEQ ID NO: 3899018 - DNA, 17 bp, Homo sapiens
caaattatttgtgtaat

SEQ ID NO: 3899019 - DNA, 22 bp, Homo sapiens
caaattattttaatattttgta

SEQ ID NO: 3899020 - DNA, 22 bp, Homo sapiens
caaattgctcctaagcttcaaa

SEQ ID NO: 3899021 - DNA, 17 bp, Homo sapiens
caaattggacagaagat

SEQ ID NO: 3899022 - DNA, 15 bp, Homo sapiens
caaattggtgtttct

SEQ ID NO: 3899023 - DNA, 16 bp, Homo sapiens
caaatttcaaaagaca

SEQ ID NO: 3899024 - DNA, 11 bp, Homo sapiens
caaatttcaca

SEQ ID NO: 3899025 - DNA, 23 bp, Homo sapiens
caaatttgccaccactagagctg

SEQ ID NO: 3899026 - DNA, 21 bp, Homo sapiens
caaattttgatgccaagaaag

SEQ ID NO: 3899027 - DNA, 15 bp, Homo sapiens
caaattttgcattgt

SEQ ID NO: 3899028 - DNA, 20 bp, Homo sapiens
caaattttgcatttagtttt

SEQ ID NO: 3899029 - DNA, 20 bp, Homo sapiens
caaatttttctcagtttgta

SEQ ID NO: 3899030 - DNA, 23 bp, Homo sapiens
caacaaagcgagatcccatctct

SEQ ID NO: 3899031 - DNA, 15 bp, Homo sapiens
caacaacaaaccaaa

SEQ ID NO: 3899032 - DNA, 14 bp, Homo sapiens
caacaacaacaata

SEQ ID NO: 3899033 - DNA, 15 bp, Homo sapiens
caacaacaacaataa

SEQ ID NO: 3899034 - DNA, 15 bp, Homo sapiens
caacaacaaggaccc

SEQ ID NO: 3899035 - DNA, 14 bp, Homo sapiens
caacaacatccatg

SEQ ID NO: 3899036 - DNA, 11 bp, Homo sapiens
caacaagaaca

SEQ ID NO: 3899037 - DNA, 13 bp, Homo sapiens
caacaagaacaac

SEQ ID NO: 3899038 - DNA, 17 bp, Homo sapiens
caacaagaacaacaaca

SEQ ID NO: 3899039 - DNA, 14 bp, Homo sapiens
caacaaggaccctg

SEQ ID NO: 3899040 - DNA, 20 bp, Homo sapiens
caacaatacaacaagaacaa

SEQ ID NO: 3899041 - DNA, 20 bp, Homo sapiens
caacacaagctggaagcaca

SEQ ID NO: 3899042 - DNA, 16 bp, Homo sapiens
caacacacctggtgaa

SEQ ID NO: 3899043 - DNA, 18 bp, Homo sapiens
caacacctccttgctttg

SEQ ID NO: 3899044 - DNA, 10 bp, Homo sapiens
caacagaaaa

SEQ ID NO: 3899045 - DNA, 17 bp, Homo sapiens
caacagagaaggcagga

SEQ ID NO: 3899046 - DNA, 16 bp, Homo sapiens
caacagcttgaccaga

SEQ ID NO: 3899047 - DNA, 18 bp, Homo sapiens
caacagcttgaccagacc

SEQ ID NO: 3899048 - DNA, 20 bp, Homo sapiens
caacagcttgaccagaccta

SEQ ID NO: 3899049 - DNA, 20 bp, Homo sapiens
caacaggctgttctgcactg

SEQ ID NO: 3899050 - DNA, 22 bp, Homo sapiens
caacaggctgttctgcactgaa

SEQ ID NO: 3899051 - DNA, 23 bp, Homo sapiens
caacaggtggcaggaccaggact

SEQ ID NO: 3899052 - DNA, 18 bp, Homo sapiens
caacagtcaaaacagaga

SEQ ID NO: 3899053 - DNA, 12 bp, Homo sapiens
caacagtgagtc

SEQ ID NO: 3899054 - DNA, 21 bp, Homo sapiens
caacataaggagaatgtatct

SEQ ID NO: 3899055 - DNA, 15 bp, Homo sapiens
caacatatcattttt

SEQ ID NO: 3899056 - DNA, 23 bp, Homo sapiens
caacatccatgtcctatgtgtga

SEQ ID NO: 3899057 - DNA, 15 bp, Homo sapiens
caacatcccattgcc

SEQ ID NO: 3899058 - DNA, 21 bp, Homo sapiens
caacattttatttaagaataa

SEQ ID NO: 3899059 - DNA, 14 bp, Homo sapiens
caaccaaccacaaa

SEQ ID NO: 3899060 - DNA, 14 bp, Homo sapiens
caatattaaataca

SEQ ID NO: 3899061 - DNA, 23 bp, Homo sapiens
caatattaaatacagacactaag

SEQ ID NO: 3899062 - DNA, 15 bp, Homo sapiens
caatattcaaatgcg

SEQ ID NO: 3899063 - DNA, 16 bp, Homo sapiens
caatcagcactgaaaa

SEQ ID NO: 3899064 - DNA, 14 bp, Homo sapiens
caatccaggtggga

SEQ ID NO: 3899065 - DNA, 23 bp, Homo sapiens
caatccatgttagtttttacttt

SEQ ID NO: 3899066 - DNA, 16 bp, Homo sapiens
caatcccaccaaccct

SEQ ID NO: 3899067 - DNA, 22 bp, Homo sapiens
caatcccaccaaccctcagagc

SEQ ID NO: 3899068 - DNA, 15 bp, Homo sapiens
caatcccctcattca

SEQ ID NO: 3899069 - DNA, 18 bp, Homo sapiens
caatcccgtgaaagaatt

SEQ ID NO: 3899070 - DNA, 22 bp, Homo sapiens
caatcctagaaccaagcttcag

SEQ ID NO: 3899071 - DNA, 20 bp, Homo sapiens
caatcctcaaacatggaaga

SEQ ID NO: 3899072 - DNA, 21 bp, Homo sapiens
caatccttcttatgtttgctt

SEQ ID NO: 3899073 - DNA, 15 bp, Homo sapiens
caatcctttgagtta

SEQ ID NO: 3899074 - DNA, 20 bp, Homo sapiens
caatctcaaattctcaacct

SEQ ID NO: 3899075 - DNA, 12 bp, Homo sapiens
caatctccaggg

SEQ ID NO: 3899076 - DNA, 15 bp, Homo sapiens
caatctgggactttc

SEQ ID NO: 3899077 - DNA, 15 bp, Homo sapiens
caatcttgtccacag

SEQ ID NO: 3899078 - DNA, 14 bp, Homo sapiens
caatctttgctgta

SEQ ID NO: 3899079 - DNA, 16 bp, Homo sapiens
caatcttttttactct

SEQ ID NO: 3899080 - DNA, 20 bp, Homo sapiens
caatgaaacagatgataaat

SEQ ID NO: 3899081 - DNA, 12 bp, Homo sapiens
caatgaaaccaa

SEQ ID NO: 3899082 - DNA, 13 bp, Homo sapiens
caatgaaaccaaa

SEQ ID NO: 3899083 - DNA, 20 bp, Homo sapiens
caatgacagggatgccaaca

SEQ ID NO: 3899084 - DNA, 12 bp, Homo sapiens
caatgagctgta

SEQ ID NO: 3899085 - DNA, 18 bp, Homo sapiens
caatgatgattaaacacc

SEQ ID NO: 3899086 - DNA, 20 bp, Homo sapiens
caatgatgattaaacacctg

SEQ ID NO: 3899087 - DNA, 22 bp, Homo sapiens
caatgatgattaaacacctgac

SEQ ID NO: 3899088 - DNA, 21 bp, Homo sapiens
caatgatggcaattttgtaac

SEQ ID NO: 3899089 - DNA, 21 bp, Homo sapiens
caatgatgtgagtacccagga

SEQ ID NO: 3899090 - DNA, 20 bp, Homo sapiens
caatgattattttcattaca

SEQ ID NO: 3899091 - DNA, 19 bp, Homo sapiens
caatgattcataacaatgt

SEQ ID NO: 3899092 - DNA, 16 bp, Homo sapiens
caatgcaatgaaacag

SEQ ID NO: 3899093 - DNA, 16 bp, Homo sapiens
caatgcacacacacag

SEQ ID NO: 3899094 - DNA, 17 bp, Homo sapiens
caatgcacacacacaga

SEQ ID NO: 3899095 - DNA, 13 bp, Homo sapiens
caatgcacatcca

SEQ ID NO: 3899096 - DNA, 18 bp, Homo sapiens
caatgcacatccattccc

SEQ ID NO: 3899097 - DNA, 16 bp, Homo sapiens
caatgcatgcagccac

SEQ ID NO: 3899098 - DNA, 20 bp, Homo sapiens
caatgcatgcagccactgtg

SEQ ID NO: 3899099 - DNA, 20 bp, Homo sapiens
caatgcattgtcttgtggag

SEQ ID NO: 3899100 - DNA, 17 bp, Homo sapiens
caatgcctctcccacga

SEQ ID NO: 3899101 - DNA, 12 bp, Homo sapiens
caatgccttggg

SEQ ID NO: 3899102 - DNA, 19 bp, Homo sapiens
caatgctttgggaggccaa

SEQ ID NO: 3899103 - DNA, 18 bp, Homo sapiens
caatggcagctagactgg

SEQ ID NO: 3899104 - DNA, 22 bp, Homo sapiens
caatggcagctagactggagtg

SEQ ID NO: 3899105 - DNA, 17 bp, Homo sapiens
caatggctaattcccag

SEQ ID NO: 3899106 - DNA, 17 bp, Homo sapiens
caatgggagggggctcc

SEQ ID NO: 3899107 - DNA, 22 bp, Homo sapiens
caatggtgttgccctgagtgga

SEQ ID NO: 3899108 - DNA, 18 bp, Homo sapiens
caatggtttacatgaaca

SEQ ID NO: 3899109 - DNA, 22 bp, Homo sapiens
caatgtacccaccgggccactc

SEQ ID NO: 3899110 - DNA, 13 bp, Homo sapiens
caatgtgaccagg

SEQ ID NO: 3899111 - DNA, 13 bp, Homo sapiens
caatgtttctttt

SEQ ID NO: 3899112 - DNA, 18 bp, Homo sapiens
caatgtttcttttatcac

SEQ ID NO: 3899113 - DNA, 22 bp, Homo sapiens
caatgttttcctttgtcatcat

SEQ ID NO: 3899114 - DNA, 17 bp, Homo sapiens
caatgtttttaaaaatc

SEQ ID NO: 3899115 - DNA, 19 bp, Homo sapiens
caattaaaatatatataaa

SEQ ID NO: 3899116 - DNA, 21 bp, Homo sapiens
caattaaaatatatataaata

SEQ ID NO: 3899117 - DNA, 14 bp, Homo sapiens
caattaaaattaag

SEQ ID NO: 3899118 - DNA, 16 bp, Homo sapiens
caattaaacagccaaa

SEQ ID NO: 3899119 - DNA, 13 bp, Homo sapiens
caattaattctta

SEQ ID NO: 3899120 - DNA, 19 bp, Homo sapiens
caattactaaattgtatac

SEQ ID NO: 3899121 - DNA, 21 bp, Homo sapiens
caattagcaattgactgtcac

SEQ ID NO: 3899122 - DNA, 14 bp, Homo sapiens
caattagtacagta

SEQ ID NO: 3899123 - DNA, 13 bp, Homo sapiens
caattatattgtc

SEQ ID NO: 3899124 - DNA, 23 bp, Homo sapiens
caattcaacacattacttgcaca

SEQ ID NO: 3899125 - DNA, 13 bp, Homo sapiens
caattcaggactg

SEQ ID NO: 3899126 - DNA, 18 bp, Homo sapiens
caattcaggactggctca

SEQ ID NO: 3899127 - DNA, 19 bp, Homo sapiens
caattcaggactggctcac

SEQ ID NO: 3899128 - DNA, 14 bp, Homo sapiens
caattcatttcact

SEQ ID NO: 3899129 - DNA, 16 bp, Homo sapiens
caattcatttcacttt

SEQ ID NO: 3899130 - DNA, 19 bp, Homo sapiens
caattcatttcactttaaa

SEQ ID NO: 3899131 - DNA, 22 bp, Homo sapiens
caattccgtcttcttaatctga

SEQ ID NO: 3899132 - DNA, 15 bp, Homo sapiens
caattctgacttctc

SEQ ID NO: 3899133 - DNA, 20 bp, Homo sapiens
caattgatacttcaggtgct

SEQ ID NO: 3899134 - DNA, 12 bp, Homo sapiens
caattgccctgt

SEQ ID NO: 3899135 - DNA, 13 bp, Homo sapiens
caattggctcctc

SEQ ID NO: 3899136 - DNA, 15 bp, Homo sapiens
caattggctcctcca

SEQ ID NO: 3899137 - DNA, 16 bp, Homo sapiens
caattggttaatcttt

SEQ ID NO: 3899138 - DNA, 24 bp, Homo sapiens
caattgtattttatatgagagaat

SEQ ID NO: 3899139 - DNA, 13 bp, Homo sapiens
caattgtcttttt

SEQ ID NO: 3899140 - DNA, 19 bp, Homo sapiens
caattgtgggatgtcctct

SEQ ID NO: 3899141 - DNA, 13 bp, Homo sapiens
caatttagaaaac

SEQ ID NO: 3899142 - DNA, 14 bp, Homo sapiens
caatttagaaaaca

SEQ ID NO: 3899143 - DNA, 15 bp, Homo sapiens
caatttagaaaacat

SEQ ID NO: 3899144 - DNA, 21 bp, Homo sapiens
caatttatatttaataaaatt

SEQ ID NO: 3899145 - DNA, 15 bp, Homo sapiens
caatttcctttatat

SEQ ID NO: 3899146 - DNA, 20 bp, Homo sapiens
caatttcctttatatttagt

SEQ ID NO: 3899147 - DNA, 18 bp, Homo sapiens
cacagactccctcccctg

SEQ ID NO: 3899148 - DNA, 17 bp, Homo sapiens
cacagacttctggaagg

SEQ ID NO: 3899149 - DNA, 16 bp, Homo sapiens
cacagagatatgcaca

SEQ ID NO: 3899150 - DNA, 16 bp, Homo sapiens
cacagaggaagagcag

SEQ ID NO: 3899151 - DNA, 20 bp, Homo sapiens
cacagagtggagccctcagt

SEQ ID NO: 3899152 - DNA, 20 bp, Homo sapiens
cacagatatacacatggatg

SEQ ID NO: 3899153 - DNA, 22 bp, Homo sapiens
cacagatatacacatggatgca

SEQ ID NO: 3899154 - DNA, 18 bp, Homo sapiens
cacagatatgcacacaca

SEQ ID NO: 3899155 - DNA, 16 bp, Homo sapiens
cacagatgcacacaca

SEQ ID NO: 3899156 - DNA, 20 bp, Homo sapiens
cacagatgcacacacagatg

SEQ ID NO: 3899157 - DNA, 16 bp, Homo sapiens
cacagatggtcacaca

SEQ ID NO: 3899158 - DNA, 22 bp, Homo sapiens
cacagatttttgggctccactc

SEQ ID NO: 3899159 - DNA, 22 bp, Homo sapiens
cacagcaagccggccccccctc

SEQ ID NO: 3899160 - DNA, 13 bp, Homo sapiens
cacagcacccagg

SEQ ID NO: 3899161 - DNA, 17 bp, Homo sapiens
cacagcacccaggctcc

SEQ ID NO: 3899162 - DNA, 18 bp, Homo sapiens
cacagcagcatcttcaaa

SEQ ID NO: 3899163 - DNA, 15 bp, Homo sapiens
cacagcagcccccca

SEQ ID NO: 3899164 - DNA, 20 bp, Homo sapiens
cacagcagccccccagcact

SEQ ID NO: 3899165 - DNA, 16 bp, Homo sapiens
cacagcagctgaacag

SEQ ID NO: 3899166 - DNA, 19 bp, Homo sapiens
cacagcagttgaaaagact

SEQ ID NO: 3899167 - DNA, 13 bp, Homo sapiens
cacagcccaagag

SEQ ID NO: 3899168 - DNA, 14 bp, Homo sapiens
cacagccccacagc

SEQ ID NO: 3899169 - DNA, 15 bp, Homo sapiens
cacagccccacagca

SEQ ID NO: 3899170 - DNA, 21 bp, Homo sapiens
cacagccccacagcacccagg

SEQ ID NO: 3899171 - DNA, 23 bp, Homo sapiens
cacagccccacagcacccaggct

SEQ ID NO: 3899172 - DNA, 15 bp, Homo sapiens
cacagccctgggagg

SEQ ID NO: 3899173 - DNA, 16 bp, Homo sapiens
cacagccctgggaggg

SEQ ID NO: 3899174 - DNA, 15 bp, Homo sapiens
cacagcctctccctt

SEQ ID NO: 3899175 - DNA, 14 bp, Homo sapiens
cacagcggcccctg

SEQ ID NO: 3899176 - DNA, 16 bp, Homo sapiens
cacagctcccacccca

SEQ ID NO: 3899177 - DNA, 15 bp, Homo sapiens
cacagctgctgaaga

SEQ ID NO: 3899178 - DNA, 13 bp, Homo sapiens
cacagctgcttgt

SEQ ID NO: 3899179 - DNA, 22 bp, Homo sapiens
cacagctgcttgtcctgctctc

SEQ ID NO: 3899180 - DNA, 15 bp, Homo sapiens
cacaggactctgcct

SEQ ID NO: 3899181 - DNA, 13 bp, Homo sapiens
cacaggagcagac

SEQ ID NO: 3899182 - DNA, 15 bp, Homo sapiens
cacaggagcatttgg

SEQ ID NO: 3899183 - DNA, 15 bp, Homo sapiens
cacaggagctacctg

SEQ ID NO: 3899184 - DNA, 23 bp, Homo sapiens
cacaggatcctattctcaccagg

SEQ ID NO: 3899185 - DNA, 16 bp, Homo sapiens
cacaggcaaaatcctt

SEQ ID NO: 3899186 - DNA, 11 bp, Homo sapiens
cacaggcagct

SEQ ID NO: 3899187 - DNA, 19 bp, Homo sapiens
cacaggcaggaagagagag

SEQ ID NO: 3899188 - DNA, 20 bp, Homo sapiens
cacaggcaggaagagagaga

SEQ ID NO: 3899189 - DNA, 19 bp, Homo sapiens
cacaggcatttcctgggtg

SEQ ID NO: 3899190 - DNA, 18 bp, Homo sapiens
cacaggcccttcctctcc

SEQ ID NO: 3899191 - DNA, 22 bp, Homo sapiens
cacaggcccttcctctccactg

SEQ ID NO: 3899192 - DNA, 17 bp, Homo sapiens
cacaggcccttggggtt

SEQ ID NO: 3899193 - DNA, 22 bp, Homo sapiens
cacaggcctgtgtagctgtgac

SEQ ID NO: 3899194 - DNA, 23 bp, Homo sapiens
cacaggcctgtgtagctgtgacc

SEQ ID NO: 3899195 - DNA, 19 bp, Homo sapiens
cacagggccccagaaggca

SEQ ID NO: 3899196 - DNA, 23 bp, Homo sapiens
cacaggggcaaagaactgcccca

SEQ ID NO: 3899197 - DNA, 16 bp, Homo sapiens
cacaggggcaggcctg

SEQ ID NO: 3899198 - DNA, 20 bp, Homo sapiens
cacaggggcaggcctgggac

SEQ ID NO: 3899199 - DNA, 14 bp, Homo sapiens
cacaggggccccag

SEQ ID NO: 3899200 - DNA, 15 bp, Homo sapiens
cacaggggcggggca

SEQ ID NO: 3899201 - DNA, 18 bp, Homo sapiens
cacaggggcggggcagga

SEQ ID NO: 3899202 - DNA, 20 bp, Homo sapiens
cacaggttccatagaactaa

SEQ ID NO: 3899203 - DNA, 18 bp, Homo sapiens
cacagtacaatgtttcag

SEQ ID NO: 3899204 - DNA, 20 bp, Homo sapiens
cacagtcattcacatcactg

SEQ ID NO: 3899205 - DNA, 13 bp, Homo sapiens
cacagtctcagtc

SEQ ID NO: 3899206 - DNA, 17 bp, Homo sapiens
cacagtctcagtccaga

SEQ ID NO: 3899207 - DNA, 19 bp, Homo sapiens
cacagtctcagtccagatg

SEQ ID NO: 3899208 - DNA, 20 bp, Homo sapiens
cacagtctcagtccagatgc

SEQ ID NO: 3899209 - DNA, 16 bp, Homo sapiens
cacagtgacccttccc

SEQ ID NO: 3899210 - DNA, 21 bp, Homo sapiens
cacagtgactttacaggaggt

SEQ ID NO: 3899211 - DNA, 19 bp, Homo sapiens
cacagtgcatctcagccca

SEQ ID NO: 3899212 - DNA, 17 bp, Homo sapiens
cacagtggcgagaggag

SEQ ID NO: 3899213 - DNA, 15 bp, Homo sapiens
cacagtgggtggcac

SEQ ID NO: 3899214 - DNA, 21 bp, Homo sapiens
cacagtgttccagctgcctgg

SEQ ID NO: 3899215 - DNA, 16 bp, Homo sapiens
cacagttcctcgccct

SEQ ID NO: 3899216 - DNA, 21 bp, Homo sapiens
cacagttgtctattctgagcc

SEQ ID NO: 3899217 - DNA, 20 bp, Homo sapiens
cacagtttgatgtcattaat

SEQ ID NO: 3899218 - DNA, 14 bp, Homo sapiens
cacagttttctgag

SEQ ID NO: 3899219 - DNA, 15 bp, Homo sapiens
cacagttttgaaaga

SEQ ID NO: 3899220 - DNA, 21 bp, Homo sapiens
cacagttttgaaagaaaaata

SEQ ID NO: 3899221 - DNA, 15 bp, Homo sapiens
cacatacaatttgca

SEQ ID NO: 3899222 - DNA, 13 bp, Homo sapiens
cacatacatacac

SEQ ID NO: 3899223 - DNA, 15 bp, Homo sapiens
cacatacatacatac

SEQ ID NO: 3899224 - DNA, 16 bp, Homo sapiens
cacatacatacataca

SEQ ID NO: 3899225 - DNA, 13 bp, Homo sapiens
cacataccctccc

SEQ ID NO: 3899226 - DNA, 16 bp, Homo sapiens
cacatacgtgttagga

SEQ ID NO: 3899227 - DNA, 20 bp, Homo sapiens
cacatacgtgttaggaggct

SEQ ID NO: 3899228 - DNA, 18 bp, Homo sapiens
cacatagagatatgcaca

SEQ ID NO: 3899229 - DNA, 20 bp, Homo sapiens
cacatagattaatggcactg

SEQ ID NO: 3899230 - DNA, 22 bp, Homo sapiens
cacatagattaatggcactgat

SEQ ID NO: 3899231 - DNA, 23 bp, Homo sapiens
cacatagctacccaaaagagaaa

SEQ ID NO: 3899232 - DNA, 21 bp, Homo sapiens
cacatagtgatggttcccctg

SEQ ID NO: 3899233 - DNA, 17 bp, Homo sapiens
cacggtgcgtggctgtg

SEQ ID NO: 3899234 - DNA, 23 bp, Homo sapiens
cacggtgcgtggctgtggcacag

SEQ ID NO: 3899235 - DNA, 15 bp, Homo sapiens
cacgtccccctgggg

SEQ ID NO: 3899236 - DNA, 16 bp, Homo sapiens
cacgtccccctggggc

SEQ ID NO: 3899237 - DNA, 20 bp, Homo sapiens
cacgtgaaatatttaagtat

SEQ ID NO: 3899238 - DNA, 16 bp, Homo sapiens
cacgtgccaggcccgg

SEQ ID NO: 3899239 - DNA, 19 bp, Homo sapiens
cacgtgctcgcagcctggc

SEQ ID NO: 3899240 - DNA, 16 bp, Homo sapiens
cactaaagtatgtaaa

SEQ ID NO: 3899241 - DNA, 18 bp, Homo sapiens
cactaacccgttttattc

SEQ ID NO: 3899242 - DNA, 14 bp, Homo sapiens
cactaacctgtaga

SEQ ID NO: 3899243 - DNA, 15 bp, Homo sapiens
cactaacctgtagaa

SEQ ID NO: 3899244 - DNA, 23 bp, Homo sapiens
cactaaggccgtgtctctgagga

SEQ ID NO: 3899245 - DNA, 14 bp, Homo sapiens
cactaagttatagt

SEQ ID NO: 3899246 - DNA, 21 bp, Homo sapiens
cactaccacgccaagctaatt

SEQ ID NO: 3899247 - DNA, 20 bp, Homo sapiens
cactaccttctgacctcccc

SEQ ID NO: 3899248 - DNA, 15 bp, Homo sapiens
cactagagctgggaa

SEQ ID NO: 3899249 - DNA, 20 bp, Homo sapiens
cactagggcagggacaggat

SEQ ID NO: 3899250 - DNA, 16 bp, Homo sapiens
cactatgctatttctg

SEQ ID NO: 3899251 - DNA, 20 bp, Homo sapiens
cactatggtatgctggccag

SEQ ID NO: 3899252 - DNA, 21 bp, Homo sapiens
cactatggtatgctggccagc

SEQ ID NO: 3899253 - DNA, 18 bp, Homo sapiens
cactatgtccagctagcc

SEQ ID NO: 3899254 - DNA, 17 bp, Homo sapiens
cactattacttgaactt

SEQ ID NO: 3899255 - DNA, 13 bp, Homo sapiens
cactattagagaa

SEQ ID NO: 3899256 - DNA, 22 bp, Homo sapiens
cactcaaaaaggtgtgtcaaag

SEQ ID NO: 3899257 - DNA, 14 bp, Homo sapiens
cactcaccagggtc

SEQ ID NO: 3899258 - DNA, 15 bp, Homo sapiens
cactcaccagggtcc

SEQ ID NO: 3899259 - DNA, 16 bp, Homo sapiens
cactcacccatgtgcc

SEQ ID NO: 3899260 - DNA, 14 bp, Homo sapiens
cactcactccagcc

SEQ ID NO: 3899261 - DNA, 21 bp, Homo sapiens
cactcagaaaagaaaaccatt

SEQ ID NO: 3899262 - DNA, 16 bp, Homo sapiens
cactcagaagcctggg

SEQ ID NO: 3899263 - DNA, 15 bp, Homo sapiens
cactcagcagccccc

SEQ ID NO: 3899264 - DNA, 20 bp, Homo sapiens
cactcagcagccccctgccc

SEQ ID NO: 3899265 - DNA, 14 bp, Homo sapiens
cactccagacccct

SEQ ID NO: 3899266 - DNA, 11 bp, Homo sapiens
cactccagccc

SEQ ID NO: 3899267 - DNA, 14 bp, Homo sapiens
cactccatggccac

SEQ ID NO: 3899268 - DNA, 15 bp, Homo sapiens
cactccatggccacc

SEQ ID NO: 3899269 - DNA, 16 bp, Homo sapiens
cactccatggccaccc

SEQ ID NO: 3899270 - DNA, 13 bp, Homo sapiens
cactccattccca

SEQ ID NO: 3899271 - DNA, 16 bp, Homo sapiens
cactcccccacctgac

SEQ ID NO: 3899272 - DNA, 17 bp, Homo sapiens
cactccccgcctgtcct

SEQ ID NO: 3899273 - DNA, 13 bp, Homo sapiens
cactccctgagct

SEQ ID NO: 3899274 - DNA, 10 bp, Homo sapiens
cactcctgct

SEQ ID NO: 3899275 - DNA, 13 bp, Homo sapiens
cactcctgctgtg

SEQ ID NO: 3899276 - DNA, 16 bp, Homo sapiens
cactcctgctgtgccc

SEQ ID NO: 3899277 - DNA, 12 bp, Homo sapiens
cactcctgtccc

SEQ ID NO: 3899278 - DNA, 13 bp, Homo sapiens
cactccttcctgc

SEQ ID NO: 3899279 - DNA, 17 bp, Homo sapiens
cactcgagaccatcctg

SEQ ID NO: 3899280 - DNA, 19 bp, Homo sapiens
cactcgagaccatcctggc

SEQ ID NO: 3899281 - DNA, 20 bp, Homo sapiens
cactcgagaccatcctggcc

SEQ ID NO: 3899282 - DNA, 23 bp, Homo sapiens
cactctagtgacttcctggtgag

SEQ ID NO: 3899283 - DNA, 12 bp, Homo sapiens
cactctcaggag

SEQ ID NO: 3899284 - DNA, 12 bp, Homo sapiens
cactctcccctc

SEQ ID NO: 3899285 - DNA, 17 bp, Homo sapiens
cactctcggggcccttg

SEQ ID NO: 3899286 - DNA, 13 bp, Homo sapiens
cactctgctctga

SEQ ID NO: 3899287 - DNA, 12 bp, Homo sapiens
cactctggcagc

SEQ ID NO: 3899288 - DNA, 13 bp, Homo sapiens
cactctggcagcc

SEQ ID NO: 3899289 - DNA, 16 bp, Homo sapiens
cactctggcagccaca

SEQ ID NO: 3899290 - DNA, 12 bp, Homo sapiens
cactctggcctc

SEQ ID NO: 3899291 - DNA, 22 bp, Homo sapiens
cactctgtcagccagccgccct

SEQ ID NO: 3899292 - DNA, 11 bp, Homo sapiens
cactcttccaa

SEQ ID NO: 3899293 - DNA, 16 bp, Homo sapiens
cactcttcttgagcag

SEQ ID NO: 3899294 - DNA, 12 bp, Homo sapiens
cactctttgcta

SEQ ID NO: 3899295 - DNA, 19 bp, Homo sapiens
cactctttgctacaataaa

SEQ ID NO: 3899296 - DNA, 22 bp, Homo sapiens
cactgaaaataccatcaggcct

SEQ ID NO: 3899297 - DNA, 16 bp, Homo sapiens
cactgaacatttgctt

SEQ ID NO: 3899298 - DNA, 18 bp, Homo sapiens
cactgacccttccagaca

SEQ ID NO: 3899299 - DNA, 19 bp, Homo sapiens
cactgacccttccagacat

SEQ ID NO: 3899300 - DNA, 20 bp, Homo sapiens
cactgaccttggagagacac

SEQ ID NO: 3899301 - DNA, 14 bp, Homo sapiens
cactgacttctaag

SEQ ID NO: 3899302 - DNA, 14 bp, Homo sapiens
cactgaggatgtga

SEQ ID NO: 3899303 - DNA, 13 bp, Homo sapiens
cactgagggccac

SEQ ID NO: 3899304 - DNA, 18 bp, Homo sapiens
cactgagggccacactat

SEQ ID NO: 3899305 - DNA, 13 bp, Homo sapiens
cactgagtggctt

SEQ ID NO: 3899306 - DNA, 17 bp, Homo sapiens
cactgataatatgtttg

SEQ ID NO: 3899307 - DNA, 19 bp, Homo sapiens
cactgatggacaaggaggt

SEQ ID NO: 3899308 - DNA, 22 bp, Homo sapiens
cactgatgttgttactgattct

SEQ ID NO: 3899309 - DNA, 21 bp, Homo sapiens
cactgatttcacaacagatca

SEQ ID NO: 3899310 - DNA, 14 bp, Homo sapiens
cactgatttggaga

SEQ ID NO: 3899311 - DNA, 21 bp, Homo sapiens
cactgcaacctcttcctcctg

SEQ ID NO: 3899312 - DNA, 18 bp, Homo sapiens
cactgcacagtgcatctc

SEQ ID NO: 3899313 - DNA, 19 bp, Homo sapiens
cactgcacagtgcatctca

SEQ ID NO: 3899314 - DNA, 16 bp, Homo sapiens
cactgcaggccccgct

SEQ ID NO: 3899315 - DNA, 15 bp, Homo sapiens
cactgccagcagctg

SEQ ID NO: 3899316 - DNA, 14 bp, Homo sapiens
cactgccaggaggg

SEQ ID NO: 3899317 - DNA, 15 bp, Homo sapiens
cactgccaggaggga

SEQ ID NO: 3899318 - DNA, 16 bp, Homo sapiens
cactgccaggagggac

SEQ ID NO: 3899319 - DNA, 22 bp, Homo sapiens
cactgccaggagggacaaagga

SEQ ID NO: 3899320 - DNA, 13 bp, Homo sapiens
cagagactctgga

SEQ ID NO: 3899321 - DNA, 14 bp, Homo sapiens
cagagagacagacc

SEQ ID NO: 3899322 - DNA, 13 bp, Homo sapiens
cagagagagacag

SEQ ID NO: 3899323 - DNA, 14 bp, Homo sapiens
cagagagagacaga

SEQ ID NO: 3899324 - DNA, 16 bp, Homo sapiens
cagagagagacagaga

SEQ ID NO: 3899325 - DNA, 15 bp, Homo sapiens
cagagaggaatcaga

SEQ ID NO: 3899326 - DNA, 15 bp, Homo sapiens
cagagaggagcacct

SEQ ID NO: 3899327 - DNA, 16 bp, Homo sapiens
cagagaggagcacctg

SEQ ID NO: 3899328 - DNA, 21 bp, Homo sapiens
cagagaggagcacctgaaccc

SEQ ID NO: 3899329 - DNA, 12 bp, Homo sapiens
cagagagggcag

SEQ ID NO: 3899330 - DNA, 18 bp, Homo sapiens
cagagagggcccagctgt

SEQ ID NO: 3899331 - DNA, 17 bp, Homo sapiens
cagagaggtctcaggtt

SEQ ID NO: 3899332 - DNA, 21 bp, Homo sapiens
cagagaggtctcaggttcttt

SEQ ID NO: 3899333 - DNA, 17 bp, Homo sapiens
cagagagtcctctggat

SEQ ID NO: 3899334 - DNA, 19 bp, Homo sapiens
cagagagtcctctggatgg

SEQ ID NO: 3899335 - DNA, 16 bp, Homo sapiens
cagagagtcctttggg

SEQ ID NO: 3899336 - DNA, 15 bp, Homo sapiens
cagagagtggctcct

SEQ ID NO: 3899337 - DNA, 21 bp, Homo sapiens
cagagatgcatgcgcaggctc

SEQ ID NO: 3899338 - DNA, 22 bp, Homo sapiens
cagagatgcatgcgcaggctca

SEQ ID NO: 3899339 - DNA, 14 bp, Homo sapiens
cagagatgcctcca

SEQ ID NO: 3899340 - DNA, 19 bp, Homo sapiens
cagagatgcctccaccgct

SEQ ID NO: 3899341 - DNA, 21 bp, Homo sapiens
cagagatgcctccaccgctgc

SEQ ID NO: 3899342 - DNA, 18 bp, Homo sapiens
cagagatttcctccatgg

SEQ ID NO: 3899343 - DNA, 18 bp, Homo sapiens
cagagcacagcagcccct

SEQ ID NO: 3899344 - DNA, 21 bp, Homo sapiens
cagagcactaggttcaattcc

SEQ ID NO: 3899345 - DNA, 18 bp, Homo sapiens
cagagcaggccacgctca

SEQ ID NO: 3899346 - DNA, 19 bp, Homo sapiens
cagagcattacgtgagcca

SEQ ID NO: 3899347 - DNA, 20 bp, Homo sapiens
cagagcattacgtgagccag

SEQ ID NO: 3899348 - DNA, 17 bp, Homo sapiens
cagagccagcctgggac

SEQ ID NO: 3899349 - DNA, 18 bp, Homo sapiens
cagagccagcctgggact

SEQ ID NO: 3899350 - DNA, 12 bp, Homo sapiens
cagagccaggct

SEQ ID NO: 3899351 - DNA, 15 bp, Homo sapiens
cagagccaggctctg

SEQ ID NO: 3899352 - DNA, 17 bp, Homo sapiens
cagagccaggctctgcc

SEQ ID NO: 3899353 - DNA, 13 bp, Homo sapiens
cagagccagtgaa

SEQ ID NO: 3899354 - DNA, 14 bp, Homo sapiens
cagagccagtgaag

SEQ ID NO: 3899355 - DNA, 13 bp, Homo sapiens
cagagccatgggc

SEQ ID NO: 3899356 - DNA, 21 bp, Homo sapiens
cagagccatgggcctgggcct

SEQ ID NO: 3899357 - DNA, 16 bp, Homo sapiens
cagagcccaagtgcca

SEQ ID NO: 3899358 - DNA, 19 bp, Homo sapiens
cagagcccaagtgccatcc

SEQ ID NO: 3899359 - DNA, 20 bp, Homo sapiens
cagagcccaagtgccatccc

SEQ ID NO: 3899360 - DNA, 21 bp, Homo sapiens
cagagcccaagtgccatccca

SEQ ID NO: 3899361 - DNA, 22 bp, Homo sapiens
cagagcccaagtgccatcccac

SEQ ID NO: 3899362 - DNA, 20 bp, Homo sapiens
cagagccccacacggaggca

SEQ ID NO: 3899363 - DNA, 14 bp, Homo sapiens
cagagccccactcc

SEQ ID NO: 3899364 - DNA, 18 bp, Homo sapiens
cagagcccccaagcctct

SEQ ID NO: 3899365 - DNA, 19 bp, Homo sapiens
cagagcccccaagcctctg

SEQ ID NO: 3899366 - DNA, 21 bp, Homo sapiens
cagagccggggcactttcaga

SEQ ID NO: 3899367 - DNA, 15 bp, Homo sapiens
cagagcctagccacc

SEQ ID NO: 3899368 - DNA, 16 bp, Homo sapiens
cagagcctagccacct

SEQ ID NO: 3899369 - DNA, 12 bp, Homo sapiens
cagagcctgggg

SEQ ID NO: 3899370 - DNA, 13 bp, Homo sapiens
cagagcctggggc

SEQ ID NO: 3899371 - DNA, 20 bp, Homo sapiens
cagagcctggggtgttctct

SEQ ID NO: 3899372 - DNA, 12 bp, Homo sapiens
cagagcgggcct

SEQ ID NO: 3899373 - DNA, 18 bp, Homo sapiens
cagagcgggcctcttccc

SEQ ID NO: 3899374 - DNA, 21 bp, Homo sapiens
cagagcgtggctgtgctctca

SEQ ID NO: 3899375 - DNA, 21 bp, Homo sapiens
cagagctcttcaagctgtccc

SEQ ID NO: 3899376 - DNA, 22 bp, Homo sapiens
cagagctgatggagaaggaagg

SEQ ID NO: 3899377 - DNA, 19 bp, Homo sapiens
cagagctgctattaaatta

SEQ ID NO: 3899378 - DNA, 13 bp, Homo sapiens
cagagctggaagg

SEQ ID NO: 3899379 - DNA, 23 bp, Homo sapiens
cagagctggaaggcagggcagag

SEQ ID NO: 3899380 - DNA, 23 bp, Homo sapiens
cagagctggcgactgcagctgca

SEQ ID NO: 3899381 - DNA, 14 bp, Homo sapiens
cagagctggctgtc

SEQ ID NO: 3899382 - DNA, 15 bp, Homo sapiens
cagagctgggaggca

SEQ ID NO: 3899383 - DNA, 22 bp, Homo sapiens
cagagctgtggactttgttcac

SEQ ID NO: 3899384 - DNA, 19 bp, Homo sapiens
cagagctgttggcctcgcc

SEQ ID NO: 3899385 - DNA, 21 bp, Homo sapiens
cagagctgttggcctcgcctg

SEQ ID NO: 3899386 - DNA, 18 bp, Homo sapiens
cagagcttattggccact

SEQ ID NO: 3899387 - DNA, 20 bp, Homo sapiens
cagagcttattggccactgg

SEQ ID NO: 3899388 - DNA, 14 bp, Homo sapiens
cagaggacagagct

SEQ ID NO: 3899389 - DNA, 22 bp, Homo sapiens
cagaggacagagctggctgtct

SEQ ID NO: 3899390 - DNA, 12 bp, Homo sapiens
cagaggaccaca

SEQ ID NO: 3899391 - DNA, 18 bp, Homo sapiens
cagaggaccacagtgggt

SEQ ID NO: 3899392 - DNA, 21 bp, Homo sapiens
cagaggaccacagtgggtggc

SEQ ID NO: 3899393 - DNA, 17 bp, Homo sapiens
cagaggagtccagggcg

SEQ ID NO: 3899394 - DNA, 21 bp, Homo sapiens
cagaggagtccagggcgggag

SEQ ID NO: 3899395 - DNA, 22 bp, Homo sapiens
cagaggatgttctggacctccc

SEQ ID NO: 3899396 - DNA, 18 bp, Homo sapiens
cagaggcggaaaccttgc

SEQ ID NO: 3899397 - DNA, 13 bp, Homo sapiens
cagaggctggagg

SEQ ID NO: 3899398 - DNA, 16 bp, Homo sapiens
cagaggctggaggcag

SEQ ID NO: 3899399 - DNA, 17 bp, Homo sapiens
cagaggctggaggcagg

SEQ ID NO: 3899400 - DNA, 19 bp, Homo sapiens
cagaggctggaggcagggc

SEQ ID NO: 3899401 - DNA, 20 bp, Homo sapiens
cagaggcttcttcagatcag

SEQ ID NO: 3899402 - DNA, 18 bp, Homo sapiens
cagagggaaggggcctac

SEQ ID NO: 3899403 - DNA, 13 bp, Homo sapiens
cagagggacaggg

SEQ ID NO: 3899404 - DNA, 14 bp, Homo sapiens
cagagggacagggt

SEQ ID NO: 3899405 - DNA, 16 bp, Homo sapiens
cagagggcagaggctg

SEQ ID NO: 3899406 - DNA, 22 bp, Homo sapiens
cagcccctcctctgccacctcc

SEQ ID NO: 3899407 - DNA, 13 bp, Homo sapiens
cagcccctgcaca

SEQ ID NO: 3899408 - DNA, 17 bp, Homo sapiens
cagcccgaagcccagtt

SEQ ID NO: 3899409 - DNA, 12 bp, Homo sapiens
cagcccggcctg

SEQ ID NO: 3899410 - DNA, 21 bp, Homo sapiens
cagcccgtgaagcagtgcctc

SEQ ID NO: 3899411 - DNA, 19 bp, Homo sapiens
cagccctaaggatctctca

SEQ ID NO: 3899412 - DNA, 21 bp, Homo sapiens
cagccctaaggatctctcagg

SEQ ID NO: 3899413 - DNA, 18 bp, Homo sapiens
cagccctacatcttcagc

SEQ ID NO: 3899414 - DNA, 20 bp, Homo sapiens
cagccctacatcttcagctc

SEQ ID NO: 3899415 - DNA, 23 bp, Homo sapiens
cagccctacatcttcagctccca

SEQ ID NO: 3899416 - DNA, 20 bp, Homo sapiens
cagccctatggatgtggggt

SEQ ID NO: 3899417 - DNA, 16 bp, Homo sapiens
cagccctccctgcccc

SEQ ID NO: 3899418 - DNA, 18 bp, Homo sapiens
cagccctccctgcccctc

SEQ ID NO: 3899419 - DNA, 13 bp, Homo sapiens
cagccctccctgt

SEQ ID NO: 3899420 - DNA, 16 bp, Homo sapiens
cagccctccctgtcct

SEQ ID NO: 3899421 - DNA, 20 bp, Homo sapiens
cagccctccctgtcctcctc

SEQ ID NO: 3899422 - DNA, 21 bp, Homo sapiens
cagccctccctgtcctcctcg

SEQ ID NO: 3899423 - DNA, 20 bp, Homo sapiens
cagccctgcctggaggacct

SEQ ID NO: 3899424 - DNA, 21 bp, Homo sapiens
cagccctgctttgggctgccc

SEQ ID NO: 3899425 - DNA, 22 bp, Homo sapiens
cagccctggcccagagctggaa

SEQ ID NO: 3899426 - DNA, 15 bp, Homo sapiens
cagccctggctctgc

SEQ ID NO: 3899427 - DNA, 16 bp, Homo sapiens
cagccctggctctgca

SEQ ID NO: 3899428 - DNA, 12 bp, Homo sapiens
cagccctgggag

SEQ ID NO: 3899429 - DNA, 11 bp, Homo sapiens
cagccctgggc

SEQ ID NO: 3899430 - DNA, 20 bp, Homo sapiens
cagccctgggccccaccacc

SEQ ID NO: 3899431 - DNA, 21 bp, Homo sapiens
cagccctgggccccaccacct

SEQ ID NO: 3899432 - DNA, 11 bp, Homo sapiens
cagccctgggg

SEQ ID NO: 3899433 - DNA, 19 bp, Homo sapiens
cagccctgggggccagctg

SEQ ID NO: 3899434 - DNA, 14 bp, Homo sapiens
cagcccttcctcct

SEQ ID NO: 3899435 - DNA, 12 bp, Homo sapiens
cagcccttctgc

SEQ ID NO: 3899436 - DNA, 16 bp, Homo sapiens
cagcccttctgccttt

SEQ ID NO: 3899437 - DNA, 12 bp, Homo sapiens
cagccgagccgg

SEQ ID NO: 3899438 - DNA, 14 bp, Homo sapiens
cagccgccctgggc

SEQ ID NO: 3899439 - DNA, 16 bp, Homo sapiens
cagccgccctgggctg

SEQ ID NO: 3899440 - DNA, 14 bp, Homo sapiens
cagccgctaggaga

SEQ ID NO: 3899441 - DNA, 15 bp, Homo sapiens
cagccgctaggagag

SEQ ID NO: 3899442 - DNA, 16 bp, Homo sapiens
cagccgctaggagaga

SEQ ID NO: 3899443 - DNA, 17 bp, Homo sapiens
cagccgctaggagagac

SEQ ID NO: 3899444 - DNA, 21 bp, Homo sapiens
cagccggcgtggcaaatataa

SEQ ID NO: 3899445 - DNA, 17 bp, Homo sapiens
cagccggtacctgggaa

SEQ ID NO: 3899446 - DNA, 14 bp, Homo sapiens
cagccgtgccttca

SEQ ID NO: 3899447 - DNA, 18 bp, Homo sapiens
cagccgtgccttcagctc

SEQ ID NO: 3899448 - DNA, 22 bp, Homo sapiens
cagcctacccttgtaccccatc

SEQ ID NO: 3899449 - DNA, 23 bp, Homo sapiens
cagcctacccttgtaccccatcc

SEQ ID NO: 3899450 - DNA, 14 bp, Homo sapiens
cagcctcacagaag

SEQ ID NO: 3899451 - DNA, 14 bp, Homo sapiens
cagcctcagtgcca

SEQ ID NO: 3899452 - DNA, 15 bp, Homo sapiens
cagcctcagtgccac

SEQ ID NO: 3899453 - DNA, 16 bp, Homo sapiens
cagcctcagtgccact

SEQ ID NO: 3899454 - DNA, 19 bp, Homo sapiens
cagcctcagtgccacttga

SEQ ID NO: 3899455 - DNA, 14 bp, Homo sapiens
cagcctccaagctc

SEQ ID NO: 3899456 - DNA, 18 bp, Homo sapiens
cagcctccaccttgctct

SEQ ID NO: 3899457 - DNA, 19 bp, Homo sapiens
cagcctccaccttgctctt

SEQ ID NO: 3899458 - DNA, 20 bp, Homo sapiens
cagcctccaccttgctcttc

SEQ ID NO: 3899459 - DNA, 13 bp, Homo sapiens
cagcctccagagc

SEQ ID NO: 3899460 - DNA, 15 bp, Homo sapiens
cagcctccagagcca

SEQ ID NO: 3899461 - DNA, 21 bp, Homo sapiens
cagcctccagagccagcctgg

SEQ ID NO: 3899462 - DNA, 14 bp, Homo sapiens
cagcctccatgctg

SEQ ID NO: 3899463 - DNA, 19 bp, Homo sapiens
cagcctcccagagtgctag

SEQ ID NO: 3899464 - DNA, 15 bp, Homo sapiens
cagcctccccctgct

SEQ ID NO: 3899465 - DNA, 16 bp, Homo sapiens
cagcctccccctgctg

SEQ ID NO: 3899466 - DNA, 19 bp, Homo sapiens
cagcctcccgagtagctgg

SEQ ID NO: 3899467 - DNA, 19 bp, Homo sapiens
cagcctcctaagcagctgg

SEQ ID NO: 3899468 - DNA, 20 bp, Homo sapiens
cagcctcctaagcagctggg

SEQ ID NO: 3899469 - DNA, 21 bp, Homo sapiens
cagcctcctaagcagctggga

SEQ ID NO: 3899470 - DNA, 14 bp, Homo sapiens
cagcctcctgggca

SEQ ID NO: 3899471 - DNA, 15 bp, Homo sapiens
cagcctctcccggct

SEQ ID NO: 3899472 - DNA, 21 bp, Homo sapiens
cagcctctcccggctgcctgc

SEQ ID NO: 3899473 - DNA, 22 bp, Homo sapiens
cagcctctcccggctgcctgcc

SEQ ID NO: 3899474 - DNA, 12 bp, Homo sapiens
cagcctctctgc

SEQ ID NO: 3899475 - DNA, 14 bp, Homo sapiens
cagcctctctgcta

SEQ ID NO: 3899476 - DNA, 22 bp, Homo sapiens
cagcctctgggccaagactcct

SEQ ID NO: 3899477 - DNA, 11 bp, Homo sapiens
cagcctcttaa

SEQ ID NO: 3899478 - DNA, 19 bp, Homo sapiens
cagcctcttaaagctgcct

SEQ ID NO: 3899479 - DNA, 20 bp, Homo sapiens
cagcctcttaaagctgcctg

SEQ ID NO: 3899480 - DNA, 10 bp, Homo sapiens
cagcctgagt

SEQ ID NO: 3899481 - DNA, 14 bp, Homo sapiens
cagcctgagtctcc

SEQ ID NO: 3899482 - DNA, 15 bp, Homo sapiens
cagcctgagtctcct

SEQ ID NO: 3899483 - DNA, 16 bp, Homo sapiens
cagcctgagtctcctg

SEQ ID NO: 3899484 - DNA, 18 bp, Homo sapiens
cagcctgagtctcctgtg

SEQ ID NO: 3899485 - DNA, 14 bp, Homo sapiens
cagcctgatggcca

SEQ ID NO: 3899486 - DNA, 16 bp, Homo sapiens
cagcctggcctcctgc

SEQ ID NO: 3899487 - DNA, 17 bp, Homo sapiens
cagcctggcctcctgcc

SEQ ID NO: 3899488 - DNA, 18 bp, Homo sapiens
cagcctggcctcctgcct

SEQ ID NO: 3899489 - DNA, 21 bp, Homo sapiens
cagcctggcctcctgcctcta

SEQ ID NO: 3899490 - DNA, 18 bp, Homo sapiens
cagcctgggactcccagt

SEQ ID NO: 3899491 - DNA, 13 bp, Homo sapiens
cagcctgggccta

SEQ ID NO: 3899492 - DNA, 20 bp, Homo sapiens
cagcctgggcctatggagag

SEQ ID NO: 3899493 - DNA, 16 bp, Homo sapiens
caggaggcgcagcccg

SEQ ID NO: 3899494 - DNA, 17 bp, Homo sapiens
caggaggcgcagcccga

SEQ ID NO: 3899495 - DNA, 23 bp, Homo sapiens
caggaggcgcagcccgaagccca

SEQ ID NO: 3899496 - DNA, 17 bp, Homo sapiens
caggaggctgaggcaga

SEQ ID NO: 3899497 - DNA, 12 bp, Homo sapiens
caggaggctgcg

SEQ ID NO: 3899498 - DNA, 16 bp, Homo sapiens
caggagggacaaagga

SEQ ID NO: 3899499 - DNA, 22 bp, Homo sapiens
caggagggacaaaggagcctgt

SEQ ID NO: 3899500 - DNA, 16 bp, Homo sapiens
caggagggcaagggcc

SEQ ID NO: 3899501 - DNA, 19 bp, Homo sapiens
caggagggcaagggccatg

SEQ ID NO: 3899502 - DNA, 19 bp, Homo sapiens
caggaggggcccacaatgg

SEQ ID NO: 3899503 - DNA, 16 bp, Homo sapiens
caggaggggcctctga

SEQ ID NO: 3899504 - DNA, 19 bp, Homo sapiens
caggagggggtcgtggaga

SEQ ID NO: 3899505 - DNA, 21 bp, Homo sapiens
caggagggggtcgtggagagc

SEQ ID NO: 3899506 - DNA, 16 bp, Homo sapiens
caggaggtcctcctct

SEQ ID NO: 3899507 - DNA, 19 bp, Homo sapiens
caggaggtcctcctctctc

SEQ ID NO: 3899508 - DNA, 19 bp, Homo sapiens
caggaggtggaggttgcag

SEQ ID NO: 3899509 - DNA, 20 bp, Homo sapiens
caggaggtggaggttgcagt

SEQ ID NO: 3899510 - DNA, 18 bp, Homo sapiens
caggaggtggctatggcc

SEQ ID NO: 3899511 - DNA, 23 bp, Homo sapiens
caggaggttgtggatgctccagg

SEQ ID NO: 3899512 - DNA, 15 bp, Homo sapiens
caggagtagctgagc

SEQ ID NO: 3899513 - DNA, 18 bp, Homo sapiens
caggagtagctgagctca

SEQ ID NO: 3899514 - DNA, 20 bp, Homo sapiens
caggagtagctgagctcaca

SEQ ID NO: 3899515 - DNA, 23 bp, Homo sapiens
caggagtatcttacctgtaaagt

SEQ ID NO: 3899516 - DNA, 18 bp, Homo sapiens
caggagttcaagaccagc

SEQ ID NO: 3899517 - DNA, 21 bp, Homo sapiens
caggagttcaagaccagcctg

SEQ ID NO: 3899518 - DNA, 19 bp, Homo sapiens
caggagttggagaccaggc

SEQ ID NO: 3899519 - DNA, 21 bp, Homo sapiens
caggagtttgagacaagccct

SEQ ID NO: 3899520 - DNA, 17 bp, Homo sapiens
caggatcagccccgctc

SEQ ID NO: 3899521 - DNA, 16 bp, Homo sapiens
caggatcccaagcgtc

SEQ ID NO: 3899522 - DNA, 23 bp, Homo sapiens
caggatcccaagcgtcccgtccc

SEQ ID NO: 3899523 - DNA, 15 bp, Homo sapiens
caggatcccagagct

SEQ ID NO: 3899524 - DNA, 19 bp, Homo sapiens
caggatccctcccagatcc

SEQ ID NO: 3899525 - DNA, 16 bp, Homo sapiens
caggatccgctgccac

SEQ ID NO: 3899526 - DNA, 17 bp, Homo sapiens
caggatccgctgccacc

SEQ ID NO: 3899527 - DNA, 23 bp, Homo sapiens
caggatggcccttcccactggag

SEQ ID NO: 3899528 - DNA, 16 bp, Homo sapiens
caggattttaatcttt

SEQ ID NO: 3899529 - DNA, 17 bp, Homo sapiens
caggattttgtgttttt

SEQ ID NO: 3899530 - DNA, 17 bp, Homo sapiens
caggcaaaacacgcaag

SEQ ID NO: 3899531 - DNA, 21 bp, Homo sapiens
caggcaaaacacgcaagggca

SEQ ID NO: 3899532 - DNA, 16 bp, Homo sapiens
caggcaagcccctcag

SEQ ID NO: 3899533 - DNA, 21 bp, Homo sapiens
caggcaagcccctcagccctt

SEQ ID NO: 3899534 - DNA, 24 bp, Homo sapiens
caggcaagcccctcagcccttgcc

SEQ ID NO: 3899535 - DNA, 15 bp, Homo sapiens
caggcacaggcagga

SEQ ID NO: 3899536 - DNA, 14 bp, Homo sapiens
caggcaccaggcag

SEQ ID NO: 3899537 - DNA, 18 bp, Homo sapiens
caggcaccccctggagag

SEQ ID NO: 3899538 - DNA, 13 bp, Homo sapiens
caggcacccttct

SEQ ID NO: 3899539 - DNA, 19 bp, Homo sapiens
caggcacctagcaattcca

SEQ ID NO: 3899540 - DNA, 12 bp, Homo sapiens
caggcacctggc

SEQ ID NO: 3899541 - DNA, 13 bp, Homo sapiens
caggcacctggcc

SEQ ID NO: 3899542 - DNA, 14 bp, Homo sapiens
caggcacctggcct

SEQ ID NO: 3899543 - DNA, 20 bp, Homo sapiens
caggcacctggcctgctggg

SEQ ID NO: 3899544 - DNA, 21 bp, Homo sapiens
caggcacctggcctgctggga

SEQ ID NO: 3899545 - DNA, 19 bp, Homo sapiens
caggcaccttagtggcttt

SEQ ID NO: 3899546 - DNA, 17 bp, Homo sapiens
caggcactgctgcccag

SEQ ID NO: 3899547 - DNA, 23 bp, Homo sapiens
caggcactgctgcccagcctcca

SEQ ID NO: 3899548 - DNA, 17 bp, Homo sapiens
caggcagacaagagctg

SEQ ID NO: 3899549 - DNA, 20 bp, Homo sapiens
caggcagacaagagctgctg

SEQ ID NO: 3899550 - DNA, 22 bp, Homo sapiens
caggcagacaagagctgctgtc

SEQ ID NO: 3899551 - DNA, 23 bp, Homo sapiens
caggcagacaagagctgctgtcc

SEQ ID NO: 3899552 - DNA, 19 bp, Homo sapiens
caggcagagcggggaggtg

SEQ ID NO: 3899553 - DNA, 20 bp, Homo sapiens
caggcagagcggggaggtgc

SEQ ID NO: 3899554 - DNA, 14 bp, Homo sapiens
caggcagaggatgt

SEQ ID NO: 3899555 - DNA, 11 bp, Homo sapiens
caggcagggct

SEQ ID NO: 3899556 - DNA, 17 bp, Homo sapiens
caggcagggctctcctg

SEQ ID NO: 3899557 - DNA, 18 bp, Homo sapiens
caggcaggggtgggagag

SEQ ID NO: 3899558 - DNA, 20 bp, Homo sapiens
caggcaggggtgggagagcc

SEQ ID NO: 3899559 - DNA, 14 bp, Homo sapiens
caggcaggtgcctg

SEQ ID NO: 3899560 - DNA, 18 bp, Homo sapiens
caggcaggtttgccagtg

SEQ ID NO: 3899561 - DNA, 11 bp, Homo sapiens
caggcatgctg

SEQ ID NO: 3899562 - DNA, 15 bp, Homo sapiens
caggcatgctggcct

SEQ ID NO: 3899563 - DNA, 14 bp, Homo sapiens
caggcatttcctgg

SEQ ID NO: 3899564 - DNA, 18 bp, Homo sapiens
caggcatttcctgggtgg

SEQ ID NO: 3899565 - DNA, 15 bp, Homo sapiens
caggccaccaggatg

SEQ ID NO: 3899566 - DNA, 18 bp, Homo sapiens
caggccacgctcaggccc

SEQ ID NO: 3899567 - DNA, 14 bp, Homo sapiens
caggccactgtggc

SEQ ID NO: 3899568 - DNA, 16 bp, Homo sapiens
caggccactgtggcca

SEQ ID NO: 3899569 - DNA, 17 bp, Homo sapiens
caggccactgtggccag

SEQ ID NO: 3899570 - DNA, 18 bp, Homo sapiens
caggccactgtggccaga

SEQ ID NO: 3899571 - DNA, 21 bp, Homo sapiens
caggccactgtggccagagct

SEQ ID NO: 3899572 - DNA, 16 bp, Homo sapiens
caggcccatctcaggt

SEQ ID NO: 3899573 - DNA, 17 bp, Homo sapiens
caggccccatgacctcc

SEQ ID NO: 3899574 - DNA, 20 bp, Homo sapiens
caggcccccaggtgccagtt

SEQ ID NO: 3899575 - DNA, 14 bp, Homo sapiens
caggcccctgagga

SEQ ID NO: 3899576 - DNA, 15 bp, Homo sapiens
caggcccgacagaga

SEQ ID NO: 3899577 - DNA, 18 bp, Homo sapiens
caggcccggcgcggtggc

SEQ ID NO: 3899578 - DNA, 20 bp, Homo sapiens
caggccctccatgggctagt

SEQ ID NO: 3899579 - DNA, 15 bp, Homo sapiens
cagtgcctcctggga

SEQ ID NO: 3899580 - DNA, 15 bp, Homo sapiens
cagtgcctcgaggca

SEQ ID NO: 3899581 - DNA, 18 bp, Homo sapiens
cagtgcctcgaggcaccg

SEQ ID NO: 3899582 - DNA, 11 bp, Homo sapiens
cagtgcctgct

SEQ ID NO: 3899583 - DNA, 13 bp, Homo sapiens
cagtgcctgctga

SEQ ID NO: 3899584 - DNA, 16 bp, Homo sapiens
cagtgcctggcaaggc

SEQ ID NO: 3899585 - DNA, 16 bp, Homo sapiens
cagtgctgattcagcc

SEQ ID NO: 3899586 - DNA, 14 bp, Homo sapiens
cagtgctgccatgc

SEQ ID NO: 3899587 - DNA, 17 bp, Homo sapiens
cagtgctgccatgccac

SEQ ID NO: 3899588 - DNA, 14 bp, Homo sapiens
cagtgctgccctgc

SEQ ID NO: 3899589 - DNA, 16 bp, Homo sapiens
cagtggagagtgttcc

SEQ ID NO: 3899590 - DNA, 20 bp, Homo sapiens
cagtggatcatgaaaagtgc

SEQ ID NO: 3899591 - DNA, 13 bp, Homo sapiens
cagtggctcgctc

SEQ ID NO: 3899592 - DNA, 21 bp, Homo sapiens
cagtgggaacgtgactgcccc

SEQ ID NO: 3899593 - DNA, 22 bp, Homo sapiens
cagtgggaacgtgactgcccca

SEQ ID NO: 3899594 - DNA, 13 bp, Homo sapiens
cagtgggtggcac

SEQ ID NO: 3899595 - DNA, 15 bp, Homo sapiens
cagtgggtggcacct

SEQ ID NO: 3899596 - DNA, 20 bp, Homo sapiens
cagtgggtggcacctcctga

SEQ ID NO: 3899597 - DNA, 17 bp, Homo sapiens
cagtggtaagctctggc

SEQ ID NO: 3899598 - DNA, 20 bp, Homo sapiens
cagtggtaagctctggcttt

SEQ ID NO: 3899599 - DNA, 18 bp, Homo sapiens
cagtggtcaaaccgcact

SEQ ID NO: 3899600 - DNA, 17 bp, Homo sapiens
cagtggtgaagaaaact

SEQ ID NO: 3899601 - DNA, 18 bp, Homo sapiens
cagtgtaaagaataaatg

SEQ ID NO: 3899602 - DNA, 20 bp, Homo sapiens
cagtgtcccctccactgtca

SEQ ID NO: 3899603 - DNA, 19 bp, Homo sapiens
cagtgtcctcttgctcaaa

SEQ ID NO: 3899604 - DNA, 18 bp, Homo sapiens
cagtgtgcgttggaatca

SEQ ID NO: 3899605 - DNA, 15 bp, Homo sapiens
cagtgtggagagggg

SEQ ID NO: 3899606 - DNA, 17 bp, Homo sapiens
cagtgtggagaggggtg

SEQ ID NO: 3899607 - DNA, 23 bp, Homo sapiens
cagtgtggagaggggtgcaccca

SEQ ID NO: 3899608 - DNA, 14 bp, Homo sapiens
cagtgttattttct

SEQ ID NO: 3899609 - DNA, 14 bp, Homo sapiens
cagtgttccccatc

SEQ ID NO: 3899610 - DNA, 14 bp, Homo sapiens
cagtgttggctgtg

SEQ ID NO: 3899611 - DNA, 24 bp, Homo sapiens
cagtgttttttcactttagctatg

SEQ ID NO: 3899612 - DNA, 18 bp, Homo sapiens
cagttacagggcccaggt

SEQ ID NO: 3899613 - DNA, 20 bp, Homo sapiens
cagttacagggcccaggtga

SEQ ID NO: 3899614 - DNA, 14 bp, Homo sapiens
cagttactcagccc

SEQ ID NO: 3899615 - DNA, 17 bp, Homo sapiens
cagttactcagccctgg

SEQ ID NO: 3899616 - DNA, 14 bp, Homo sapiens
cagttataattatt

SEQ ID NO: 3899617 - DNA, 16 bp, Homo sapiens
cagttatattctttaa

SEQ ID NO: 3899618 - DNA, 19 bp, Homo sapiens
cagttatggctataggtgc

SEQ ID NO: 3899619 - DNA, 18 bp, Homo sapiens
cagttcaaatcctcacca

SEQ ID NO: 3899620 - DNA, 23 bp, Homo sapiens
cagttcaacctggtggcaccaga

SEQ ID NO: 3899621 - DNA, 17 bp, Homo sapiens
cagttcccggagcacag

SEQ ID NO: 3899622 - DNA, 19 bp, Homo sapiens
cagttcccggagcacagcc

SEQ ID NO: 3899623 - DNA, 20 bp, Homo sapiens
cagttcccggagcacagccc

SEQ ID NO: 3899624 - DNA, 21 bp, Homo sapiens
cagttcccggagcacagccct

SEQ ID NO: 3899625 - DNA, 23 bp, Homo sapiens
cagttcccggagcacagccctgg

SEQ ID NO: 3899626 - DNA, 13 bp, Homo sapiens
cagttcgcagcca

SEQ ID NO: 3899627 - DNA, 16 bp, Homo sapiens
cagttcgcagccaccc

SEQ ID NO: 3899628 - DNA, 22 bp, Homo sapiens
cagttcgcagccaccctgagga

SEQ ID NO: 3899629 - DNA, 21 bp, Homo sapiens
cagttctacaagcatatttga

SEQ ID NO: 3899630 - DNA, 20 bp, Homo sapiens
cagttctgctcctctccagg

SEQ ID NO: 3899631 - DNA, 22 bp, Homo sapiens
cagttctgctcctctccaggca

SEQ ID NO: 3899632 - DNA, 12 bp, Homo sapiens
cagttcttggac

SEQ ID NO: 3899633 - DNA, 15 bp, Homo sapiens
cagttcttggacccc

SEQ ID NO: 3899634 - DNA, 14 bp, Homo sapiens
cagttgaaaagact

SEQ ID NO: 3899635 - DNA, 18 bp, Homo sapiens
cagttgaaaatggatttt

SEQ ID NO: 3899636 - DNA, 13 bp, Homo sapiens
cagttgcaataaa

SEQ ID NO: 3899637 - DNA, 15 bp, Homo sapiens
cagttgcaataaaat

SEQ ID NO: 3899638 - DNA, 17 bp, Homo sapiens
cagttgcaataaaatag

SEQ ID NO: 3899639 - DNA, 13 bp, Homo sapiens
cagttggcagaga

SEQ ID NO: 3899640 - DNA, 20 bp, Homo sapiens
cagttggcagagaaggcctc

SEQ ID NO: 3899641 - DNA, 14 bp, Homo sapiens
cagttgggagcact

SEQ ID NO: 3899642 - DNA, 15 bp, Homo sapiens
cagttgggagcactg

SEQ ID NO: 3899643 - DNA, 16 bp, Homo sapiens
cagttgggagcactgg

SEQ ID NO: 3899644 - DNA, 21 bp, Homo sapiens
cagttgggagcactggagtgc

SEQ ID NO: 3899645 - DNA, 20 bp, Homo sapiens
cagttgtctattctgagcct

SEQ ID NO: 3899646 - DNA, 21 bp, Homo sapiens
cagttgtctattctgagcctt

SEQ ID NO: 3899647 - DNA, 13 bp, Homo sapiens
cagtttagtgctt

SEQ ID NO: 3899648 - DNA, 15 bp, Homo sapiens
cagtttagtgcttta

SEQ ID NO: 3899649 - DNA, 21 bp, Homo sapiens
cagtttgcttagttctcactg

SEQ ID NO: 3899650 - DNA, 14 bp, Homo sapiens
cagtttgctttgta

SEQ ID NO: 3899651 - DNA, 14 bp, Homo sapiens
cagtttggaagtgt

SEQ ID NO: 3899652 - DNA, 16 bp, Homo sapiens
cagtttgttctccggg

SEQ ID NO: 3899653 - DNA, 15 bp, Homo sapiens
cagttttctgagaaa

SEQ ID NO: 3899654 - DNA, 19 bp, Homo sapiens
cagttttctgagaaagact

SEQ ID NO: 3899655 - DNA, 22 bp, Homo sapiens
cagtttttcggtgggacagccc

SEQ ID NO: 3899656 - DNA, 23 bp, Homo sapiens
cagtttttcggtgggacagcccc

SEQ ID NO: 3899657 - DNA, 12 bp, Homo sapiens
cataaaatatac

SEQ ID NO: 3899658 - DNA, 17 bp, Homo sapiens
cataaaatatacaaaca

SEQ ID NO: 3899659 - DNA, 20 bp, Homo sapiens
cataaaatatacaaacatgt

SEQ ID NO: 3899660 - DNA, 12 bp, Homo sapiens
cataaaatctgt

SEQ ID NO: 3899661 - DNA, 17 bp, Homo sapiens
cataaaatctgtgaatt

SEQ ID NO: 3899662 - DNA, 13 bp, Homo sapiens
cataaagcaaata

SEQ ID NO: 3899663 - DNA, 19 bp, Homo sapiens
cataaagtgccagtttgct

SEQ ID NO: 3899664 - DNA, 15 bp, Homo sapiens
cataacaacttcata

SEQ ID NO: 3899665 - DNA, 22 bp, Homo sapiens
cataaccatgtgaaaaggcaaa

SEQ ID NO: 3899666 - DNA, 21 bp, Homo sapiens
catgcagcttcatcaattttt

SEQ ID NO: 3899667 - DNA, 14 bp, Homo sapiens
catgcatcatctca

SEQ ID NO: 3899668 - DNA, 18 bp, Homo sapiens
catgccaaagcaaaagaa

SEQ ID NO: 3899669 - DNA, 19 bp, Homo sapiens
catgccaaagcaaaagaag

SEQ ID NO: 3899670 - DNA, 16 bp, Homo sapiens
catgccaccctctcca

SEQ ID NO: 3899671 - DNA, 13 bp, Homo sapiens
catgccactgcca

SEQ ID NO: 3899672 - DNA, 16 bp, Homo sapiens
catgccactgccaggc

SEQ ID NO: 3899673 - DNA, 17 bp, Homo sapiens
catgccactgccaggca

SEQ ID NO: 3899674 - DNA, 18 bp, Homo sapiens
catgccagcttcctgtgg

SEQ ID NO: 3899675 - DNA, 18 bp, Homo sapiens
catgccatccattctgcc

SEQ ID NO: 3899676 - DNA, 14 bp, Homo sapiens
catgccatctgttt

SEQ ID NO: 3899677 - DNA, 17 bp, Homo sapiens
catgccatttgtactga

SEQ ID NO: 3899678 - DNA, 11 bp, Homo sapiens
catgcccagag

SEQ ID NO: 3899679 - DNA, 11 bp, Homo sapiens
catgcctcagt

SEQ ID NO: 3899680 - DNA, 16 bp, Homo sapiens
catgcctcatgccaca

SEQ ID NO: 3899681 - DNA, 15 bp, Homo sapiens
catgcctctgaggcc

SEQ ID NO: 3899682 - DNA, 16 bp, Homo sapiens
catgcctctgaggcca

SEQ ID NO: 3899683 - DNA, 23 bp, Homo sapiens
catgcctctgaggccagcctggc

SEQ ID NO: 3899684 - DNA, 21 bp, Homo sapiens
catgcctctgatatgggactg

SEQ ID NO: 3899685 - DNA, 22 bp, Homo sapiens
catgcctctgatatgggactga

SEQ ID NO: 3899686 - DNA, 13 bp, Homo sapiens
catgcctgagggt

SEQ ID NO: 3899687 - DNA, 13 bp, Homo sapiens
catgcctgcctga

SEQ ID NO: 3899688 - DNA, 23 bp, Homo sapiens
catgcctggcccccctccaggca

SEQ ID NO: 3899689 - DNA, 17 bp, Homo sapiens
catgcgtatatgtgcgt

SEQ ID NO: 3899690 - DNA, 16 bp, Homo sapiens
catgctatctctgtgt

SEQ ID NO: 3899691 - DNA, 15 bp, Homo sapiens
catgctcagccctga

SEQ ID NO: 3899692 - DNA, 14 bp, Homo sapiens
catgctctctgcag

SEQ ID NO: 3899693 - DNA, 20 bp, Homo sapiens
catgctctctgcagccagcc

SEQ ID NO: 3899694 - DNA, 23 bp, Homo sapiens
catgctctctgcagccagcccag

SEQ ID NO: 3899695 - DNA, 13 bp, Homo sapiens
catgctctgcccc

SEQ ID NO: 3899696 - DNA, 18 bp, Homo sapiens
catgctctgccccaagcc

SEQ ID NO: 3899697 - DNA, 12 bp, Homo sapiens
catgctctggaa

SEQ ID NO: 3899698 - DNA, 14 bp, Homo sapiens
catgctctggaagc

SEQ ID NO: 3899699 - DNA, 19 bp, Homo sapiens
catgctctggaagcctgga

SEQ ID NO: 3899700 - DNA, 13 bp, Homo sapiens
catgctgaaggga

SEQ ID NO: 3899701 - DNA, 20 bp, Homo sapiens
catgctgctttttggcacag

SEQ ID NO: 3899702 - DNA, 16 bp, Homo sapiens
catgctggcctcccaa

SEQ ID NO: 3899703 - DNA, 16 bp, Homo sapiens
catgctggcggcgcag

SEQ ID NO: 3899704 - DNA, 18 bp, Homo sapiens
catgctggcggcgcagag

SEQ ID NO: 3899705 - DNA, 22 bp, Homo sapiens
catgctggcggcgcagagggaa

SEQ ID NO: 3899706 - DNA, 15 bp, Homo sapiens
catgctgtgctcttt

SEQ ID NO: 3899707 - DNA, 16 bp, Homo sapiens
catgcttcttccttac

SEQ ID NO: 3899708 - DNA, 18 bp, Homo sapiens
catgctttaaagtgtaat

SEQ ID NO: 3899709 - DNA, 19 bp, Homo sapiens
catgctttaaagtgtaata

SEQ ID NO: 3899710 - DNA, 12 bp, Homo sapiens
catgctttggca

SEQ ID NO: 3899711 - DNA, 19 bp, Homo sapiens
catgcttttgccactttgg

SEQ ID NO: 3899712 - DNA, 16 bp, Homo sapiens
catggaaaatgtcctg

SEQ ID NO: 3899713 - DNA, 17 bp, Homo sapiens
catggaaacctgaaaaa

SEQ ID NO: 3899714 - DNA, 16 bp, Homo sapiens
catggaatttgtaagt

SEQ ID NO: 3899715 - DNA, 21 bp, Homo sapiens
catggacaatataaactgaaa

SEQ ID NO: 3899716 - DNA, 22 bp, Homo sapiens
catggacaatataaactgaaaa

SEQ ID NO: 3899717 - DNA, 13 bp, Homo sapiens
catggacacagac

SEQ ID NO: 3899718 - DNA, 19 bp, Homo sapiens
catggacacagacccacac

SEQ ID NO: 3899719 - DNA, 22 bp, Homo sapiens
catggacacattttctcctagg

SEQ ID NO: 3899720 - DNA, 21 bp, Homo sapiens
catggacaccccttatccagg

SEQ ID NO: 3899721 - DNA, 22 bp, Homo sapiens
catggactctgggtttcatatc

SEQ ID NO: 3899722 - DNA, 12 bp, Homo sapiens
catggagaaaca

SEQ ID NO: 3899723 - DNA, 15 bp, Homo sapiens
catggagaaaccctg

SEQ ID NO: 3899724 - DNA, 17 bp, Homo sapiens
catggagaaaccctgtc

SEQ ID NO: 3899725 - DNA, 16 bp, Homo sapiens
catggagactcctgcc

SEQ ID NO: 3899726 - DNA, 20 bp, Homo sapiens
catggagactcctgccctgt

SEQ ID NO: 3899727 - DNA, 16 bp, Homo sapiens
catggagagcctctta

SEQ ID NO: 3899728 - DNA, 15 bp, Homo sapiens
catggatgcacgcac

SEQ ID NO: 3899729 - DNA, 16 bp, Homo sapiens
catggatttgatgaaa

SEQ ID NO: 3899730 - DNA, 12 bp, Homo sapiens
catggcaccagc

SEQ ID NO: 3899731 - DNA, 17 bp, Homo sapiens
catggcaccagccccct

SEQ ID NO: 3899732 - DNA, 20 bp, Homo sapiens
catggcagcatggagagcct

SEQ ID NO: 3899733 - DNA, 19 bp, Homo sapiens
catggccaccccgtgccac

SEQ ID NO: 3899734 - DNA, 22 bp, Homo sapiens
catggccacttgggtcttccct

SEQ ID NO: 3899735 - DNA, 14 bp, Homo sapiens
catggccaggtggc

SEQ ID NO: 3899736 - DNA, 15 bp, Homo sapiens
catggccaggtggcc

SEQ ID NO: 3899737 - DNA, 14 bp, Homo sapiens
catggccctggggt

SEQ ID NO: 3899738 - DNA, 21 bp, Homo sapiens
catggcctattatattaaaat

SEQ ID NO: 3899739 - DNA, 20 bp, Homo sapiens
catggcgtaatgggcctgcc

SEQ ID NO: 3899740 - DNA, 14 bp, Homo sapiens
catggctaactggc

SEQ ID NO: 3899741 - DNA, 21 bp, Homo sapiens
catggctatcctagagaggct

SEQ ID NO: 3899742 - DNA, 12 bp, Homo sapiens
catggctcaggc

SEQ ID NO: 3899743 - DNA, 20 bp, Homo sapiens
catggctcaggcaagcccct

SEQ ID NO: 3899744 - DNA, 17 bp, Homo sapiens
catggcttggggagcag

SEQ ID NO: 3899745 - DNA, 22 bp, Homo sapiens
catgggaaaggaggcatgcctc

SEQ ID NO: 3899746 - DNA, 14 bp, Homo sapiens
catgggaaagtgca

SEQ ID NO: 3899747 - DNA, 21 bp, Homo sapiens
catgggagctggttagaaatg

SEQ ID NO: 3899748 - DNA, 17 bp, Homo sapiens
catgggcattgggttct

SEQ ID NO: 3899749 - DNA, 10 bp, Homo sapiens
catgggcctg

SEQ ID NO: 3899750 - DNA, 15 bp, Homo sapiens
catgggcctgctgcg

SEQ ID NO: 3899751 - DNA, 22 bp, Homo sapiens
catgggcctgctgcgtcagacc

SEQ ID NO: 3899752 - DNA, 11 bp, Homo sapiens
catgggcctgg

SEQ ID NO: 3899753 - DNA, 17 bp, Homo sapiens
ccaagaaaaagaaaaaa

SEQ ID NO: 3899754 - DNA, 14 bp, Homo sapiens
ccaagaaagatcca

SEQ ID NO: 3899755 - DNA, 15 bp, Homo sapiens
ccaagagagaaagaa

SEQ ID NO: 3899756 - DNA, 17 bp, Homo sapiens
ccaagagcatcatgcct

SEQ ID NO: 3899757 - DNA, 19 bp, Homo sapiens
ccaagagcatcatgcctct

SEQ ID NO: 3899758 - DNA, 14 bp, Homo sapiens
ccaagaggtctgag

SEQ ID NO: 3899759 - DNA, 17 bp, Homo sapiens
ccaagaggtctgagccc

SEQ ID NO: 3899760 - DNA, 19 bp, Homo sapiens
ccaagattcaaagagacta

SEQ ID NO: 3899761 - DNA, 20 bp, Homo sapiens
ccaagcactcgagaccatcc

SEQ ID NO: 3899762 - DNA, 21 bp, Homo sapiens
ccaagcactcgagaccatcct

SEQ ID NO: 3899763 - DNA, 22 bp, Homo sapiens
ccaagcactcgagaccatcctg

SEQ ID NO: 3899764 - DNA, 14 bp, Homo sapiens
ccaagcagccagcc

SEQ ID NO: 3899765 - DNA, 16 bp, Homo sapiens
ccaagcagccagccag

SEQ ID NO: 3899766 - DNA, 21 bp, Homo sapiens
ccaagcagccgcagcgcagcc

SEQ ID NO: 3899767 - DNA, 22 bp, Homo sapiens
ccaagcataccaacacgagcag

SEQ ID NO: 3899768 - DNA, 19 bp, Homo sapiens
ccaagcctctgccccaagg

SEQ ID NO: 3899769 - DNA, 20 bp, Homo sapiens
ccaagcctctgccccaaggg

SEQ ID NO: 3899770 - DNA, 15 bp, Homo sapiens
ccaagcctggtctcc

SEQ ID NO: 3899771 - DNA, 13 bp, Homo sapiens
ccaagctgaggtg

SEQ ID NO: 3899772 - DNA, 15 bp, Homo sapiens
ccaagctgaggtgcc

SEQ ID NO: 3899773 - DNA, 17 bp, Homo sapiens
ccaagctgaggtgccca

SEQ ID NO: 3899774 - DNA, 20 bp, Homo sapiens
ccaagctgaggtgcccagga

SEQ ID NO: 3899775 - DNA, 21 bp, Homo sapiens
ccaagctgaggtgcccaggag

SEQ ID NO: 3899776 - DNA, 15 bp, Homo sapiens
ccaagctggcagctg

SEQ ID NO: 3899777 - DNA, 18 bp, Homo sapiens
ccaagctgttttcttcta

SEQ ID NO: 3899778 - DNA, 16 bp, Homo sapiens
ccaagcttcagagcct

SEQ ID NO: 3899779 - DNA, 19 bp, Homo sapiens
ccaagcttcagagcctagc

SEQ ID NO: 3899780 - DNA, 23 bp, Homo sapiens
ccaagcttcagagcctagccacc

SEQ ID NO: 3899781 - DNA, 15 bp, Homo sapiens
ccaagctttcttcta

SEQ ID NO: 3899782 - DNA, 17 bp, Homo sapiens
ccaagctttgaataccc

SEQ ID NO: 3899783 - DNA, 23 bp, Homo sapiens
ccaagctttgaatacccccagag

SEQ ID NO: 3899784 - DNA, 16 bp, Homo sapiens
ccaaggactctggcct

SEQ ID NO: 3899785 - DNA, 15 bp, Homo sapiens
ccaaggagaaacaga

SEQ ID NO: 3899786 - DNA, 22 bp, Homo sapiens
ccaaggagctgatttccaggcc

SEQ ID NO: 3899787 - DNA, 13 bp, Homo sapiens
ccaaggcagcctc

SEQ ID NO: 3899788 - DNA, 16 bp, Homo sapiens
ccaaggcagcctccag

SEQ ID NO: 3899789 - DNA, 19 bp, Homo sapiens
ccaaggcagcctccagagc

SEQ ID NO: 3899790 - DNA, 11 bp, Homo sapiens
ccaaggcaggt

SEQ ID NO: 3899791 - DNA, 14 bp, Homo sapiens
ccaaggggcccaca

SEQ ID NO: 3899792 - DNA, 17 bp, Homo sapiens
ccaaggggcccacaaag

SEQ ID NO: 3899793 - DNA, 22 bp, Homo sapiens
ccaagtccaacctgcctgtgca

SEQ ID NO: 3899794 - DNA, 16 bp, Homo sapiens
ccaagtccacctgcct

SEQ ID NO: 3899795 - DNA, 15 bp, Homo sapiens
ccaagtccaggtcct

SEQ ID NO: 3899796 - DNA, 16 bp, Homo sapiens
ccaagtccaggtcctg

SEQ ID NO: 3899797 - DNA, 17 bp, Homo sapiens
ccaagtccaggtcctgg

SEQ ID NO: 3899798 - DNA, 18 bp, Homo sapiens
ccaagtccaggtcctggt

SEQ ID NO: 3899799 - DNA, 16 bp, Homo sapiens
ccaagtctacttcact

SEQ ID NO: 3899800 - DNA, 22 bp, Homo sapiens
ccaagtgccatcccacattcgg

SEQ ID NO: 3899801 - DNA, 18 bp, Homo sapiens
ccaagtgggggcagaggg

SEQ ID NO: 3899802 - DNA, 18 bp, Homo sapiens
ccaagttcctgcactcca

SEQ ID NO: 3899803 - DNA, 14 bp, Homo sapiens
ccaataaaaatcct

SEQ ID NO: 3899804 - DNA, 13 bp, Homo sapiens
ccaataaagctgg

SEQ ID NO: 3899805 - DNA, 14 bp, Homo sapiens
ccaataaagctgga

SEQ ID NO: 3899806 - DNA, 15 bp, Homo sapiens
ccaatcagcactgaa

SEQ ID NO: 3899807 - DNA, 18 bp, Homo sapiens
ccaatcagcactgaaaat

SEQ ID NO: 3899808 - DNA, 19 bp, Homo sapiens
ccaatccaggtgggagaga

SEQ ID NO: 3899809 - DNA, 22 bp, Homo sapiens
ccaatcctttccaccctattcc

SEQ ID NO: 3899810 - DNA, 21 bp, Homo sapiens
ccaatgcatgcagccactgtg

SEQ ID NO: 3899811 - DNA, 15 bp, Homo sapiens
ccaatggctgtaaac

SEQ ID NO: 3899812 - DNA, 15 bp, Homo sapiens
ccaatgtacccaccg

SEQ ID NO: 3899813 - DNA, 14 bp, Homo sapiens
ccaattaaaatata

SEQ ID NO: 3899814 - DNA, 15 bp, Homo sapiens
ccaattaaaattaag

SEQ ID NO: 3899815 - DNA, 16 bp, Homo sapiens
ccacaaaggggagaag

SEQ ID NO: 3899816 - DNA, 23 bp, Homo sapiens
ccacaaatcaaagcaagggctcc

SEQ ID NO: 3899817 - DNA, 12 bp, Homo sapiens
ccacaactgaca

SEQ ID NO: 3899818 - DNA, 19 bp, Homo sapiens
ccacaactgacacaggaaa

SEQ ID NO: 3899819 - DNA, 19 bp, Homo sapiens
ccacaagattcccagagac

SEQ ID NO: 3899820 - DNA, 21 bp, Homo sapiens
ccacaagattcccagagacag

SEQ ID NO: 3899821 - DNA, 24 bp, Homo sapiens
ccacaagattcccagagacaggaa

SEQ ID NO: 3899822 - DNA, 14 bp, Homo sapiens
ccacaatgcctctc

SEQ ID NO: 3899823 - DNA, 16 bp, Homo sapiens
ccacaatgcctctccc

SEQ ID NO: 3899824 - DNA, 18 bp, Homo sapiens
ccacaatgcctctcccac

SEQ ID NO: 3899825 - DNA, 19 bp, Homo sapiens
ccacaatgcctctcccacg

SEQ ID NO: 3899826 - DNA, 17 bp, Homo sapiens
ccacacacagaggaaga

SEQ ID NO: 3899827 - DNA, 18 bp, Homo sapiens
ccacacacagaggaagag

SEQ ID NO: 3899828 - DNA, 14 bp, Homo sapiens
ccacacccctccaa

SEQ ID NO: 3899829 - DNA, 14 bp, Homo sapiens
ccacacctccctac

SEQ ID NO: 3899830 - DNA, 16 bp, Homo sapiens
ccacacctccctgaac

SEQ ID NO: 3899831 - DNA, 12 bp, Homo sapiens
ccacacctgagc

SEQ ID NO: 3899832 - DNA, 15 bp, Homo sapiens
ccacacgtgctcgca

SEQ ID NO: 3899833 - DNA, 16 bp, Homo sapiens
ccacacgtgctcgcag

SEQ ID NO: 3899834 - DNA, 18 bp, Homo sapiens
ccacactattaccatgag

SEQ ID NO: 3899835 - DNA, 20 bp, Homo sapiens
ccacactattaccatgagaa

SEQ ID NO: 3899836 - DNA, 13 bp, Homo sapiens
ccacactccccgc

SEQ ID NO: 3899837 - DNA, 19 bp, Homo sapiens
ccacactccccgcctgtcc

SEQ ID NO: 3899838 - DNA, 13 bp, Homo sapiens
ccacactggtgac

SEQ ID NO: 3899839 - DNA, 14 bp, Homo sapiens
ccacactggtgact

SEQ ID NO: 3899840 - DNA, 23 bp, Homo sapiens
cccagctgtctgtgtcagcctgt

SEQ ID NO: 3899841 - DNA, 15 bp, Homo sapiens
cccagctttatctgt

SEQ ID NO: 3899842 - DNA, 14 bp, Homo sapiens
cccaggagagccag

SEQ ID NO: 3899843 - DNA, 15 bp, Homo sapiens
cccaggagagccagc

SEQ ID NO: 3899844 - DNA, 23 bp, Homo sapiens
cccaggagagccagccctccctg

SEQ ID NO: 3899845 - DNA, 20 bp, Homo sapiens
cccaggaggcggaggttgca

SEQ ID NO: 3899846 - DNA, 13 bp, Homo sapiens
cccaggaggggcc

SEQ ID NO: 3899847 - DNA, 23 bp, Homo sapiens
cccaggaggtggaggttgcagtg

SEQ ID NO: 3899848 - DNA, 22 bp, Homo sapiens
cccaggagtggaggaggcctgg

SEQ ID NO: 3899849 - DNA, 23 bp, Homo sapiens
cccaggagtttgagacaagccct

SEQ ID NO: 3899850 - DNA, 16 bp, Homo sapiens
cccaggcatcccatcc

SEQ ID NO: 3899851 - DNA, 13 bp, Homo sapiens
cccaggccaggcc

SEQ ID NO: 3899852 - DNA, 22 bp, Homo sapiens
cccaggccaggccaccaggatg

SEQ ID NO: 3899853 - DNA, 22 bp, Homo sapiens
cccaggccccatgacctccagc

SEQ ID NO: 3899854 - DNA, 13 bp, Homo sapiens
cccaggccctcca

SEQ ID NO: 3899855 - DNA, 18 bp, Homo sapiens
cccaggccctccatgggc

SEQ ID NO: 3899856 - DNA, 19 bp, Homo sapiens
cccaggccctccatgggct

SEQ ID NO: 3899857 - DNA, 20 bp, Homo sapiens
cccaggccctccatgggcta

SEQ ID NO: 3899858 - DNA, 15 bp, Homo sapiens
cccaggccgcctgcc

SEQ ID NO: 3899859 - DNA, 12 bp, Homo sapiens
cccaggcctcca

SEQ ID NO: 3899860 - DNA, 22 bp, Homo sapiens
cccaggcctccagcctctcccg

SEQ ID NO: 3899861 - DNA, 13 bp, Homo sapiens
cccaggcctctgt

SEQ ID NO: 3899862 - DNA, 18 bp, Homo sapiens
cccaggcgccccttcccc

SEQ ID NO: 3899863 - DNA, 15 bp, Homo sapiens
cccaggctccatggg

SEQ ID NO: 3899864 - DNA, 20 bp, Homo sapiens
cccaggctctggagccagag

SEQ ID NO: 3899865 - DNA, 15 bp, Homo sapiens
cccaggctgaagagt

SEQ ID NO: 3899866 - DNA, 20 bp, Homo sapiens
cccaggctgcactgcagtga

SEQ ID NO: 3899867 - DNA, 15 bp, Homo sapiens
cccagggcacaggag

SEQ ID NO: 3899868 - DNA, 16 bp, Homo sapiens
cccagggcacaggagc

SEQ ID NO: 3899869 - DNA, 18 bp, Homo sapiens
cccagggcacaggagcta

SEQ ID NO: 3899870 - DNA, 14 bp, Homo sapiens
cccagggcccctcc

SEQ ID NO: 3899871 - DNA, 11 bp, Homo sapiens
cccagggccct

SEQ ID NO: 3899872 - DNA, 21 bp, Homo sapiens
cccagggctaccctcccccag

SEQ ID NO: 3899873 - DNA, 19 bp, Homo sapiens
cccagggctccctcctgga

SEQ ID NO: 3899874 - DNA, 22 bp, Homo sapiens
cccaggggagagggtctggaga

SEQ ID NO: 3899875 - DNA, 23 bp, Homo sapiens
cccaggggagagggtctggagaa

SEQ ID NO: 3899876 - DNA, 24 bp, Homo sapiens
cccaggggagagggtctggagaag

SEQ ID NO: 3899877 - DNA, 17 bp, Homo sapiens
cccaggggcccacaggg

SEQ ID NO: 3899878 - DNA, 13 bp, Homo sapiens
cccaggtccttcc

SEQ ID NO: 3899879 - DNA, 19 bp, Homo sapiens
cccaggtgagctgaagaca

SEQ ID NO: 3899880 - DNA, 21 bp, Homo sapiens
cccaggtggattttgtggagg

SEQ ID NO: 3899881 - DNA, 17 bp, Homo sapiens
cccagtcattctgggaa

SEQ ID NO: 3899882 - DNA, 23 bp, Homo sapiens
cccagtccccgtgccccgcctcc

SEQ ID NO: 3899883 - DNA, 13 bp, Homo sapiens
cccagtccgccaa

SEQ ID NO: 3899884 - DNA, 13 bp, Homo sapiens
cccagtcctggcc

SEQ ID NO: 3899885 - DNA, 21 bp, Homo sapiens
cccagtctacgttctccagcc

SEQ ID NO: 3899886 - DNA, 22 bp, Homo sapiens
cccagtctacgttctccagccc

SEQ ID NO: 3899887 - DNA, 22 bp, Homo sapiens
cccagtggaacagtcacccttc

SEQ ID NO: 3899888 - DNA, 16 bp, Homo sapiens
cccagtgggacagagg

SEQ ID NO: 3899889 - DNA, 21 bp, Homo sapiens
cccagttctacaagcatattt

SEQ ID NO: 3899890 - DNA, 16 bp, Homo sapiens
cccagttctgctcctc

SEQ ID NO: 3899891 - DNA, 23 bp, Homo sapiens
cccagttctgctcctctccaggc

SEQ ID NO: 3899892 - DNA, 22 bp, Homo sapiens
cccagtttcccttctatgcagt

SEQ ID NO: 3899893 - DNA, 22 bp, Homo sapiens
cccataattttttttttccttt

SEQ ID NO: 3899894 - DNA, 15 bp, Homo sapiens
cccataccatcactg

SEQ ID NO: 3899895 - DNA, 22 bp, Homo sapiens
cccatagaaacatgacactgac

SEQ ID NO: 3899896 - DNA, 13 bp, Homo sapiens
cccatagcgctgg

SEQ ID NO: 3899897 - DNA, 16 bp, Homo sapiens
cccatatttcatcgtg

SEQ ID NO: 3899898 - DNA, 22 bp, Homo sapiens
cccatcacctactcacacaggc

SEQ ID NO: 3899899 - DNA, 13 bp, Homo sapiens
cccatcactggag

SEQ ID NO: 3899900 - DNA, 20 bp, Homo sapiens
cccatcactggagcaccagg

SEQ ID NO: 3899901 - DNA, 14 bp, Homo sapiens
cccatcagaaggag

SEQ ID NO: 3899902 - DNA, 14 bp, Homo sapiens
cccatcccctttcc

SEQ ID NO: 3899903 - DNA, 16 bp, Homo sapiens
cccatcccctttcctc

SEQ ID NO: 3899904 - DNA, 19 bp, Homo sapiens
cccatcccctttcctcccc

SEQ ID NO: 3899905 - DNA, 19 bp, Homo sapiens
cccatcctaccaatgcatg

SEQ ID NO: 3899906 - DNA, 21 bp, Homo sapiens
cccatcctaccaatgcatgca

SEQ ID NO: 3899907 - DNA, 15 bp, Homo sapiens
cccatctcaggtgcc

SEQ ID NO: 3899908 - DNA, 16 bp, Homo sapiens
cccatctcaggtgcca

SEQ ID NO: 3899909 - DNA, 23 bp, Homo sapiens
cccatctcaggtgccactccctg

SEQ ID NO: 3899910 - DNA, 16 bp, Homo sapiens
cccatctccccaggcc

SEQ ID NO: 3899911 - DNA, 19 bp, Homo sapiens
cccatctccccaggcctcc

SEQ ID NO: 3899912 - DNA, 14 bp, Homo sapiens
cccatgacctccag

SEQ ID NO: 3899913 - DNA, 14 bp, Homo sapiens
cccatgatccagaa

SEQ ID NO: 3899914 - DNA, 13 bp, Homo sapiens
cccatgctctgcc

SEQ ID NO: 3899915 - DNA, 16 bp, Homo sapiens
cccatgctctgcccca

SEQ ID NO: 3899916 - DNA, 17 bp, Homo sapiens
cccatgctctgccccaa

SEQ ID NO: 3899917 - DNA, 20 bp, Homo sapiens
cccatgctctgccccaagcc

SEQ ID NO: 3899918 - DNA, 21 bp, Homo sapiens
cccatgctgaattattttgtt

SEQ ID NO: 3899919 - DNA, 16 bp, Homo sapiens
cccatgggcttggact

SEQ ID NO: 3899920 - DNA, 15 bp, Homo sapiens
cccatgtcacctcag

SEQ ID NO: 3899921 - DNA, 17 bp, Homo sapiens
cccatgtcacctcagct

SEQ ID NO: 3899922 - DNA, 15 bp, Homo sapiens
cccatgtggctgaag

SEQ ID NO: 3899923 - DNA, 16 bp, Homo sapiens
cccatgtggctgaaga

SEQ ID NO: 3899924 - DNA, 22 bp, Homo sapiens
cccatgtgtcccctcactctgt

SEQ ID NO: 3899925 - DNA, 20 bp, Homo sapiens
cccatgtgtgactccagcct

SEQ ID NO: 3899926 - DNA, 18 bp, Homo sapiens
ccccttgaatctgcaggg

SEQ ID NO: 3899927 - DNA, 13 bp, Homo sapiens
ccccttgggcatc

SEQ ID NO: 3899928 - DNA, 14 bp, Homo sapiens
cccctttcctcccc

SEQ ID NO: 3899929 - DNA, 17 bp, Homo sapiens
ccccttttgcctggctg

SEQ ID NO: 3899930 - DNA, 19 bp, Homo sapiens
ccccttttgcctggctgtg

SEQ ID NO: 3899931 - DNA, 23 bp, Homo sapiens
ccccttttgcctggctgtggagg

SEQ ID NO: 3899932 - DNA, 17 bp, Homo sapiens
cccgaatttagtcacac

SEQ ID NO: 3899933 - DNA, 19 bp, Homo sapiens
cccgacactgctgcaccag

SEQ ID NO: 3899934 - DNA, 22 bp, Homo sapiens
cccgacactgctgcaccagagt

SEQ ID NO: 3899935 - DNA, 23 bp, Homo sapiens
cccgacactgctgcaccagagtg

SEQ ID NO: 3899936 - DNA, 14 bp, Homo sapiens
cccgacagagagat

SEQ ID NO: 3899937 - DNA, 13 bp, Homo sapiens
cccgacagcccag

SEQ ID NO: 3899938 - DNA, 16 bp, Homo sapiens
cccgacagcccagcct

SEQ ID NO: 3899939 - DNA, 14 bp, Homo sapiens
cccgacagcctggc

SEQ ID NO: 3899940 - DNA, 18 bp, Homo sapiens
cccgacagcctggcacag

SEQ ID NO: 3899941 - DNA, 12 bp, Homo sapiens
cccgactcctca

SEQ ID NO: 3899942 - DNA, 14 bp, Homo sapiens
cccgactcctcaaa

SEQ ID NO: 3899943 - DNA, 15 bp, Homo sapiens
cccgagcagctgagc

SEQ ID NO: 3899944 - DNA, 16 bp, Homo sapiens
cccgagcagctgagca

SEQ ID NO: 3899945 - DNA, 19 bp, Homo sapiens
cccgagcagctgagcaggg

SEQ ID NO: 3899946 - DNA, 21 bp, Homo sapiens
cccgagcagctgagcagggcc

SEQ ID NO: 3899947 - DNA, 22 bp, Homo sapiens
cccgagcagctgagcagggccg

SEQ ID NO: 3899948 - DNA, 12 bp, Homo sapiens
cccgagcccagc

SEQ ID NO: 3899949 - DNA, 19 bp, Homo sapiens
cccgagtttggtccctggg

SEQ ID NO: 3899950 - DNA, 19 bp, Homo sapiens
cccgcaccccccaagctgt

SEQ ID NO: 3899951 - DNA, 16 bp, Homo sapiens
cccgccacggccaccc

SEQ ID NO: 3899952 - DNA, 17 bp, Homo sapiens
cccgccacggccaccct

SEQ ID NO: 3899953 - DNA, 16 bp, Homo sapiens
cccgcccctcgctgct

SEQ ID NO: 3899954 - DNA, 20 bp, Homo sapiens
cccgccttcctcctccacag

SEQ ID NO: 3899955 - DNA, 23 bp, Homo sapiens
cccgccttcctcctccacagtgc

SEQ ID NO: 3899956 - DNA, 16 bp, Homo sapiens
cccgcgggcctggaca

SEQ ID NO: 3899957 - DNA, 15 bp, Homo sapiens
cccgcgggtagatgc

SEQ ID NO: 3899958 - DNA, 19 bp, Homo sapiens
cccgcggtgctctggcggc

SEQ ID NO: 3899959 - DNA, 15 bp, Homo sapiens
cccgctcagccctcc

SEQ ID NO: 3899960 - DNA, 23 bp, Homo sapiens
cccgctcagccctccctgcccct

SEQ ID NO: 3899961 - DNA, 20 bp, Homo sapiens
cccgctcctcccctcttgag

SEQ ID NO: 3899962 - DNA, 11 bp, Homo sapiens
cccgctctgga

SEQ ID NO: 3899963 - DNA, 14 bp, Homo sapiens
cccgctctggacca

SEQ ID NO: 3899964 - DNA, 14 bp, Homo sapiens
cccgcttgtccagc

SEQ ID NO: 3899965 - DNA, 18 bp, Homo sapiens
cccgcttgtccagcgcct

SEQ ID NO: 3899966 - DNA, 13 bp, Homo sapiens
cccggagcacagc

SEQ ID NO: 3899967 - DNA, 17 bp, Homo sapiens
cccggagcacagccctg

SEQ ID NO: 3899968 - DNA, 22 bp, Homo sapiens
cccggagcacagccctgggagg

SEQ ID NO: 3899969 - DNA, 18 bp, Homo sapiens
cccggaggggcctggcag

SEQ ID NO: 3899970 - DNA, 15 bp, Homo sapiens
cccggcaccccctgc

SEQ ID NO: 3899971 - DNA, 18 bp, Homo sapiens
cccggcaccccctgcagc

SEQ ID NO: 3899972 - DNA, 19 bp, Homo sapiens
cccggcaccccctgcagct

SEQ ID NO: 3899973 - DNA, 14 bp, Homo sapiens
cccggccagggcct

SEQ ID NO: 3899974 - DNA, 13 bp, Homo sapiens
cccggcccagcct

SEQ ID NO: 3899975 - DNA, 11 bp, Homo sapiens
cccggcctctt

SEQ ID NO: 3899976 - DNA, 17 bp, Homo sapiens
cccggcctcttccaccc

SEQ ID NO: 3899977 - DNA, 19 bp, Homo sapiens
cccggcctcttccacccat

SEQ ID NO: 3899978 - DNA, 18 bp, Homo sapiens
cccggcctgctcccagca

SEQ ID NO: 3899979 - DNA, 22 bp, Homo sapiens
cccggcgcggtggctcacgcct

SEQ ID NO: 3899980 - DNA, 14 bp, Homo sapiens
cccggctgcctgcc

SEQ ID NO: 3899981 - DNA, 15 bp, Homo sapiens
cccgggctctggcca

SEQ ID NO: 3899982 - DNA, 16 bp, Homo sapiens
cccgggctctggccac

SEQ ID NO: 3899983 - DNA, 17 bp, Homo sapiens
cccggggcaaggtctcc

SEQ ID NO: 3899984 - DNA, 16 bp, Homo sapiens
cccggggctggcaagc

SEQ ID NO: 3899985 - DNA, 22 bp, Homo sapiens
cccggggctggcaagcagggaa

SEQ ID NO: 3899986 - DNA, 23 bp, Homo sapiens
cccggggctggcaagcagggaaa

SEQ ID NO: 3899987 - DNA, 17 bp, Homo sapiens
cccggttcaccttgccg

SEQ ID NO: 3899988 - DNA, 22 bp, Homo sapiens
cccgtaggcagcctctctgcta

SEQ ID NO: 3899989 - DNA, 15 bp, Homo sapiens
cccgtgaagcagtgc

SEQ ID NO: 3899990 - DNA, 18 bp, Homo sapiens
cccgtgaagcagtgcctc

SEQ ID NO: 3899991 - DNA, 18 bp, Homo sapiens
cccgtgcagtacaggcaa

SEQ ID NO: 3899992 - DNA, 15 bp, Homo sapiens
cccgtgccaagtcca

SEQ ID NO: 3899993 - DNA, 12 bp, Homo sapiens
cccgtgccaccc

SEQ ID NO: 3899994 - DNA, 17 bp, Homo sapiens
cccgtggaggctgctcg

SEQ ID NO: 3899995 - DNA, 16 bp, Homo sapiens
cccgttccctgtcaga

SEQ ID NO: 3899996 - DNA, 20 bp, Homo sapiens
cccgttccctgtcagaggct

SEQ ID NO: 3899997 - DNA, 11 bp, Homo sapiens
ccctaaaataa

SEQ ID NO: 3899998 - DNA, 14 bp, Homo sapiens
ccctaaaataaaaa

SEQ ID NO: 3899999 - DNA, 12 bp, Homo sapiens
ccctaaactgta

SEQ ID NO: 3900000 - DNA, 23 bp, Homo sapiens
ccctaacgggggtgcggcaggag

SEQ ID NO: 3900001 - DNA, 14 bp, Homo sapiens
ccctaagagagcac

SEQ ID NO: 3900002 - DNA, 15 bp, Homo sapiens
ccctacatcttcagc

SEQ ID NO: 3900003 - DNA, 21 bp, Homo sapiens
ccctacatcttcagctcccat

SEQ ID NO: 3900004 - DNA, 16 bp, Homo sapiens
ccctacccactctttg

SEQ ID NO: 3900005 - DNA, 16 bp, Homo sapiens
ccctactcccctgggc

SEQ ID NO: 3900006 - DNA, 22 bp, Homo sapiens
ccctagatctttctattccaaa

SEQ ID NO: 3900007 - DNA, 14 bp, Homo sapiens
ccctaggctgagct

SEQ ID NO: 3900008 - DNA, 13 bp, Homo sapiens
ccctatagagagg

SEQ ID NO: 3900009 - DNA, 15 bp, Homo sapiens
ccctatcaaaacata

SEQ ID NO: 3900010 - DNA, 18 bp, Homo sapiens
ccctatccacccagccca

SEQ ID NO: 3900011 - DNA, 19 bp, Homo sapiens
ccctatccacccagcccat

SEQ ID NO: 3900012 - DNA, 16 bp, Homo sapiens
ccctatggatgtgggg

SEQ ID NO: 3900013 - DNA, 14 bp, Homo sapiens
ccgcattccctgag

SEQ ID NO: 3900014 - DNA, 15 bp, Homo sapiens
ccgcattccctgagt

SEQ ID NO: 3900015 - DNA, 16 bp, Homo sapiens
ccgccaaacactccac

SEQ ID NO: 3900016 - DNA, 21 bp, Homo sapiens
ccgccatccgggacgcttcca

SEQ ID NO: 3900017 - DNA, 23 bp, Homo sapiens
ccgcccaaagagaaatcacaggg

SEQ ID NO: 3900018 - DNA, 16 bp, Homo sapiens
ccgcccaaggctgcag

SEQ ID NO: 3900019 - DNA, 18 bp, Homo sapiens
ccgcccctcgctgctgct

SEQ ID NO: 3900020 - DNA, 17 bp, Homo sapiens
ccgcctcccagccccag

SEQ ID NO: 3900021 - DNA, 14 bp, Homo sapiens
ccgcctcccagcct

SEQ ID NO: 3900022 - DNA, 14 bp, Homo sapiens
ccgcctctgcccgc

SEQ ID NO: 3900023 - DNA, 21 bp, Homo sapiens
ccgcctgcagaggacagagct

SEQ ID NO: 3900024 - DNA, 16 bp, Homo sapiens
ccgcctgtcctgcctc

SEQ ID NO: 3900025 - DNA, 18 bp, Homo sapiens
ccgcctgtcctgcctctc

SEQ ID NO: 3900026 - DNA, 16 bp, Homo sapiens
ccgccttcctcctcca

SEQ ID NO: 3900027 - DNA, 13 bp, Homo sapiens
ccgcgcatctctt

SEQ ID NO: 3900028 - DNA, 14 bp, Homo sapiens
ccgcggtgctctgg

SEQ ID NO: 3900029 - DNA, 15 bp, Homo sapiens
ccgcggtgctctggc

SEQ ID NO: 3900030 - DNA, 13 bp, Homo sapiens
ccgcgtagagagc

SEQ ID NO: 3900031 - DNA, 20 bp, Homo sapiens
ccgcgtagctgggactacag

SEQ ID NO: 3900032 - DNA, 18 bp, Homo sapiens
ccgctaagacctccccac

SEQ ID NO: 3900033 - DNA, 20 bp, Homo sapiens
ccgctacaccactctggcag

SEQ ID NO: 3900034 - DNA, 13 bp, Homo sapiens
ccgctcagccctc

SEQ ID NO: 3900035 - DNA, 15 bp, Homo sapiens
ccgctcagccctccc

SEQ ID NO: 3900036 - DNA, 22 bp, Homo sapiens
ccgctcagccctccctgcccct

SEQ ID NO: 3900037 - DNA, 19 bp, Homo sapiens
ccgctcctttacctaccac

SEQ ID NO: 3900038 - DNA, 15 bp, Homo sapiens
ccgctgcaccacggc

SEQ ID NO: 3900039 - DNA, 22 bp, Homo sapiens
ccgctgccaccacgtctgccag

SEQ ID NO: 3900040 - DNA, 14 bp, Homo sapiens
ccgctggggaacag

SEQ ID NO: 3900041 - DNA, 15 bp, Homo sapiens
ccgctgtcgccccag

SEQ ID NO: 3900042 - DNA, 19 bp, Homo sapiens
ccgctgtcgccccaggccc

SEQ ID NO: 3900043 - DNA, 21 bp, Homo sapiens
ccgctgtcgccccaggccctc

SEQ ID NO: 3900044 - DNA, 15 bp, Homo sapiens
ccgctgtgagcccct

SEQ ID NO: 3900045 - DNA, 19 bp, Homo sapiens
ccgctgtgagcccctggtc

SEQ ID NO: 3900046 - DNA, 14 bp, Homo sapiens
ccgctgttcaccca

SEQ ID NO: 3900047 - DNA, 15 bp, Homo sapiens
ccgctgttcacccac

SEQ ID NO: 3900048 - DNA, 17 bp, Homo sapiens
ccgcttgtccagcgcct

SEQ ID NO: 3900049 - DNA, 16 bp, Homo sapiens
ccggaatgaccagcat

SEQ ID NO: 3900050 - DNA, 20 bp, Homo sapiens
ccggactgcaagcagggctc

SEQ ID NO: 3900051 - DNA, 17 bp, Homo sapiens
ccggagcacagccctgg

SEQ ID NO: 3900052 - DNA, 17 bp, Homo sapiens
ccggaggggcctggcag

SEQ ID NO: 3900053 - DNA, 19 bp, Homo sapiens
ccggaggggttgcggggga

SEQ ID NO: 3900054 - DNA, 21 bp, Homo sapiens
ccggagtaatcaggcagcctt

SEQ ID NO: 3900055 - DNA, 16 bp, Homo sapiens
ccggatcgaggacaag

SEQ ID NO: 3900056 - DNA, 23 bp, Homo sapiens
ccggcaaccccagttctgctcct

SEQ ID NO: 3900057 - DNA, 17 bp, Homo sapiens
ccggcaccccctgcagc

SEQ ID NO: 3900058 - DNA, 19 bp, Homo sapiens
ccggcaccccctgcagctt

SEQ ID NO: 3900059 - DNA, 13 bp, Homo sapiens
ccggccagggcct

SEQ ID NO: 3900060 - DNA, 15 bp, Homo sapiens
ccggccagggcctgg

SEQ ID NO: 3900061 - DNA, 17 bp, Homo sapiens
ccggccagggcctggtg

SEQ ID NO: 3900062 - DNA, 16 bp, Homo sapiens
ccggcccagagacccc

SEQ ID NO: 3900063 - DNA, 19 bp, Homo sapiens
ccggcccagagaccccttc

SEQ ID NO: 3900064 - DNA, 20 bp, Homo sapiens
ccggcccagagaccccttcc

SEQ ID NO: 3900065 - DNA, 17 bp, Homo sapiens
ccggcccaggcctccac

SEQ ID NO: 3900066 - DNA, 14 bp, Homo sapiens
ccggcctcttccac

SEQ ID NO: 3900067 - DNA, 21 bp, Homo sapiens
ccggcctgatgacagagcgag

SEQ ID NO: 3900068 - DNA, 18 bp, Homo sapiens
ccggctcccttctacagc

SEQ ID NO: 3900069 - DNA, 15 bp, Homo sapiens
ccggctcctgtcatc

SEQ ID NO: 3900070 - DNA, 16 bp, Homo sapiens
ccgggacgcttccaga

SEQ ID NO: 3900071 - DNA, 18 bp, Homo sapiens
ccgggagcctccccctca

SEQ ID NO: 3900072 - DNA, 20 bp, Homo sapiens
ccgggagcctccccctcaga

SEQ ID NO: 3900073 - DNA, 13 bp, Homo sapiens
ccgggccactcct

SEQ ID NO: 3900074 - DNA, 20 bp, Homo sapiens
ccgggccactccttcctgcc

SEQ ID NO: 3900075 - DNA, 15 bp, Homo sapiens
ccgggcctgaaccac

SEQ ID NO: 3900076 - DNA, 16 bp, Homo sapiens
ccgggctctggccacc

SEQ ID NO: 3900077 - DNA, 17 bp, Homo sapiens
ccgggctctggccaccc

SEQ ID NO: 3900078 - DNA, 22 bp, Homo sapiens
ccgggctgcccttcgctgccag

SEQ ID NO: 3900079 - DNA, 18 bp, Homo sapiens
ccgggctgggagctctgc

SEQ ID NO: 3900080 - DNA, 19 bp, Homo sapiens
ccgggctgggagctctgca

SEQ ID NO: 3900081 - DNA, 20 bp, Homo sapiens
ccggggaacccagccctggg

SEQ ID NO: 3900082 - DNA, 19 bp, Homo sapiens
ccggggaactggccaagct

SEQ ID NO: 3900083 - DNA, 23 bp, Homo sapiens
ccggggcaaggtctccttactct

SEQ ID NO: 3900084 - DNA, 16 bp, Homo sapiens
ccggggcactttcaga

SEQ ID NO: 3900085 - DNA, 19 bp, Homo sapiens
ccggggcccctcaccccaa

SEQ ID NO: 3900086 - DNA, 19 bp, Homo sapiens
ccggggctggcaagcaggg

SEQ ID NO: 3900087 - DNA, 19 bp, Homo sapiens
ccggggctggcggctactc

SEQ ID NO: 3900088 - DNA, 14 bp, Homo sapiens
ccggggtctgtgct

SEQ ID NO: 3900089 - DNA, 19 bp, Homo sapiens
ccggggttcaagccatggc

SEQ ID NO: 3900090 - DNA, 16 bp, Homo sapiens
ccgggtgccattccca

SEQ ID NO: 3900091 - DNA, 20 bp, Homo sapiens
ccgggtgcctcagagcaggc

SEQ ID NO: 3900092 - DNA, 22 bp, Homo sapiens
ccgggtgcctcagagcaggctc

SEQ ID NO: 3900093 - DNA, 15 bp, Homo sapiens
ccgggtgggcctggc

SEQ ID NO: 3900094 - DNA, 17 bp, Homo sapiens
ccgggtgggcctggcct

SEQ ID NO: 3900095 - DNA, 20 bp, Homo sapiens
ccgggtgggcctggcctgag

SEQ ID NO: 3900096 - DNA, 19 bp, Homo sapiens
ccgggtgtgcctgccctgg

SEQ ID NO: 3900097 - DNA, 14 bp, Homo sapiens
ccgggtgtggcctc

SEQ ID NO: 3900098 - DNA, 20 bp, Homo sapiens
ccgggtgtggcctcagccct

SEQ ID NO: 3900099 - DNA, 14 bp, Homo sapiens
cctccgtgctgggc

SEQ ID NO: 3900100 - DNA, 19 bp, Homo sapiens
cctccgtttatgggccttg

SEQ ID NO: 3900101 - DNA, 21 bp, Homo sapiens
cctccgtttatgggccttgct

SEQ ID NO: 3900102 - DNA, 17 bp, Homo sapiens
cctcctaagcagctggg

SEQ ID NO: 3900103 - DNA, 18 bp, Homo sapiens
cctcctagaggtgggcag

SEQ ID NO: 3900104 - DNA, 21 bp, Homo sapiens
cctcctagaggtgggcagctg

SEQ ID NO: 3900105 - DNA, 19 bp, Homo sapiens
cctcctatcagaagtttct

SEQ ID NO: 3900106 - DNA, 15 bp, Homo sapiens
cctcctcaccccgtc

SEQ ID NO: 3900107 - DNA, 14 bp, Homo sapiens
cctcctccactcac

SEQ ID NO: 3900108 - DNA, 15 bp, Homo sapiens
cctcctccactcact

SEQ ID NO: 3900109 - DNA, 15 bp, Homo sapiens
cctcctccactccac

SEQ ID NO: 3900110 - DNA, 14 bp, Homo sapiens
cctcctctgccacc

SEQ ID NO: 3900111 - DNA, 15 bp, Homo sapiens
cctcctgaagcctct

SEQ ID NO: 3900112 - DNA, 16 bp, Homo sapiens
cctcctgaagcctctg

SEQ ID NO: 3900113 - DNA, 16 bp, Homo sapiens
cctcctgacctgaggc

SEQ ID NO: 3900114 - DNA, 18 bp, Homo sapiens
cctcctgatggccaagag

SEQ ID NO: 3900115 - DNA, 23 bp, Homo sapiens
cctcctgcccaggagagccagcc

SEQ ID NO: 3900116 - DNA, 12 bp, Homo sapiens
cctcctgcctct

SEQ ID NO: 3900117 - DNA, 12 bp, Homo sapiens
cctcctggccag

SEQ ID NO: 3900118 - DNA, 13 bp, Homo sapiens
cctcctggccaga

SEQ ID NO: 3900119 - DNA, 22 bp, Homo sapiens
cctcctggccagacgctgccgc

SEQ ID NO: 3900120 - DNA, 16 bp, Homo sapiens
cctcctggccggggcc

SEQ ID NO: 3900121 - DNA, 23 bp, Homo sapiens
cctcctggccggggcccctcacc

SEQ ID NO: 3900122 - DNA, 20 bp, Homo sapiens
cctcctgtgtggaagaagga

SEQ ID NO: 3900123 - DNA, 13 bp, Homo sapiens
cctccttcccctg

SEQ ID NO: 3900124 - DNA, 13 bp, Homo sapiens
cctccttcccgcc

SEQ ID NO: 3900125 - DNA, 16 bp, Homo sapiens
cctccttcccgccgcc

SEQ ID NO: 3900126 - DNA, 22 bp, Homo sapiens
cctccttgctctgcaggcacct

SEQ ID NO: 3900127 - DNA, 15 bp, Homo sapiens
cctcgaaccaaggca

SEQ ID NO: 3900128 - DNA, 16 bp, Homo sapiens
cctcgaaccaaggcag

SEQ ID NO: 3900129 - DNA, 17 bp, Homo sapiens
cctcgaaccaaggcagc

SEQ ID NO: 3900130 - DNA, 19 bp, Homo sapiens
cctcgaaccaaggcagcct

SEQ ID NO: 3900131 - DNA, 22 bp, Homo sapiens
cctcgaaccaaggcagcctcca

SEQ ID NO: 3900132 - DNA, 19 bp, Homo sapiens
cctcgaggctcttccatcc

SEQ ID NO: 3900133 - DNA, 23 bp, Homo sapiens
cctcgcaacccgtgccaagtcca

SEQ ID NO: 3900134 - DNA, 15 bp, Homo sapiens
cctcgcaggtctcag

SEQ ID NO: 3900135 - DNA, 14 bp, Homo sapiens
cctcgccctgggtc

SEQ ID NO: 3900136 - DNA, 16 bp, Homo sapiens
cctcgcctaggcctgt

SEQ ID NO: 3900137 - DNA, 14 bp, Homo sapiens
cctcgcctctccca

SEQ ID NO: 3900138 - DNA, 16 bp, Homo sapiens
cctcgcctgggcccag

SEQ ID NO: 3900139 - DNA, 21 bp, Homo sapiens
cctcgctccccactctgctct

SEQ ID NO: 3900140 - DNA, 23 bp, Homo sapiens
cctcgctccccactctgctctga

SEQ ID NO: 3900141 - DNA, 12 bp, Homo sapiens
cctcgctgctgc

SEQ ID NO: 3900142 - DNA, 15 bp, Homo sapiens
cctcgctgctgctac

SEQ ID NO: 3900143 - DNA, 16 bp, Homo sapiens
cctcgctgctgctact

SEQ ID NO: 3900144 - DNA, 21 bp, Homo sapiens
cctcgctgctgctactacccg

SEQ ID NO: 3900145 - DNA, 15 bp, Homo sapiens
cctcggtactcccat

SEQ ID NO: 3900146 - DNA, 15 bp, Homo sapiens
cctcgtaccagccag

SEQ ID NO: 3900147 - DNA, 17 bp, Homo sapiens
cctcgtccacaggggca

SEQ ID NO: 3900148 - DNA, 22 bp, Homo sapiens
cctcgtccacaggggcaggcct

SEQ ID NO: 3900149 - DNA, 17 bp, Homo sapiens
cctcgtcccctgcctca

SEQ ID NO: 3900150 - DNA, 15 bp, Homo sapiens
cctcgtggacacctg

SEQ ID NO: 3900151 - DNA, 16 bp, Homo sapiens
cctcgtggacacctgc

SEQ ID NO: 3900152 - DNA, 17 bp, Homo sapiens
cctcgtggacacctgcc

SEQ ID NO: 3900153 - DNA, 20 bp, Homo sapiens
cctcgtggacacctgccctg

SEQ ID NO: 3900154 - DNA, 22 bp, Homo sapiens
cctcgtggacacctgccctgcc

SEQ ID NO: 3900155 - DNA, 19 bp, Homo sapiens
cctctaagccactcttcca

SEQ ID NO: 3900156 - DNA, 22 bp, Homo sapiens
cctctactgggaaggctacttc

SEQ ID NO: 3900157 - DNA, 17 bp, Homo sapiens
cctctagaacacccact

SEQ ID NO: 3900158 - DNA, 17 bp, Homo sapiens
cctctagtgctactgct

SEQ ID NO: 3900159 - DNA, 23 bp, Homo sapiens
cctctcatcagtgtcctcttgct

SEQ ID NO: 3900160 - DNA, 18 bp, Homo sapiens
cctctccaattgtaaaaa

SEQ ID NO: 3900161 - DNA, 14 bp, Homo sapiens
cctctccactgcct

SEQ ID NO: 3900162 - DNA, 16 bp, Homo sapiens
cctctccactgccttc

SEQ ID NO: 3900163 - DNA, 14 bp, Homo sapiens
cctctccaggcacc

SEQ ID NO: 3900164 - DNA, 14 bp, Homo sapiens
cctctccatgccca

SEQ ID NO: 3900165 - DNA, 16 bp, Homo sapiens
cctctccatgcccaac

SEQ ID NO: 3900166 - DNA, 12 bp, Homo sapiens
cctctcccaggc

SEQ ID NO: 3900167 - DNA, 13 bp, Homo sapiens
cctctcccaggcc

SEQ ID NO: 3900168 - DNA, 23 bp, Homo sapiens
cctctcccaggccccatgacctc

SEQ ID NO: 3900169 - DNA, 19 bp, Homo sapiens
cctctcccctctgccctgt

SEQ ID NO: 3900170 - DNA, 22 bp, Homo sapiens
cctctcccgcgggcctggacac

SEQ ID NO: 3900171 - DNA, 12 bp, Homo sapiens
cctctcccggct

SEQ ID NO: 3900172 - DNA, 14 bp, Homo sapiens
cctctccctgggga

SEQ ID NO: 3900173 - DNA, 12 bp, Homo sapiens
cctctcctgcct

SEQ ID NO: 3900174 - DNA, 13 bp, Homo sapiens
cctctcctgccta

SEQ ID NO: 3900175 - DNA, 14 bp, Homo sapiens
cctctcctgcctac

SEQ ID NO: 3900176 - DNA, 16 bp, Homo sapiens
cctctcctgcctactc

SEQ ID NO: 3900177 - DNA, 17 bp, Homo sapiens
cctctcctgcctactca

SEQ ID NO: 3900178 - DNA, 12 bp, Homo sapiens
cctctcctgggg

SEQ ID NO: 3900179 - DNA, 14 bp, Homo sapiens
cctctcctgggggt

SEQ ID NO: 3900180 - DNA, 17 bp, Homo sapiens
cctctccttccttaccc

SEQ ID NO: 3900181 - DNA, 19 bp, Homo sapiens
cctctctcaggagtatctt

SEQ ID NO: 3900182 - DNA, 16 bp, Homo sapiens
cctctctgccaccacc

SEQ ID NO: 3900183 - DNA, 16 bp, Homo sapiens
cctctctgctccagag

SEQ ID NO: 3900184 - DNA, 13 bp, Homo sapiens
cctctgaccaaca

SEQ ID NO: 3900185 - DNA, 20 bp, Homo sapiens
cctctgaccaacaggctgtt

SEQ ID NO: 3900186 - DNA, 16 bp, Homo sapiens
cctgcccctcccttca

SEQ ID NO: 3900187 - DNA, 18 bp, Homo sapiens
cctgcccctcccttcaac

SEQ ID NO: 3900188 - DNA, 21 bp, Homo sapiens
cctgccctcctacagcactcc

SEQ ID NO: 3900189 - DNA, 15 bp, Homo sapiens
cctgccctctctcag

SEQ ID NO: 3900190 - DNA, 18 bp, Homo sapiens
cctgccctgccacctgtc

SEQ ID NO: 3900191 - DNA, 21 bp, Homo sapiens
cctgccctgccacctgtctgt

SEQ ID NO: 3900192 - DNA, 15 bp, Homo sapiens
cctgccctgccccca

SEQ ID NO: 3900193 - DNA, 21 bp, Homo sapiens
cctgcccttgtttggggcagg

SEQ ID NO: 3900194 - DNA, 22 bp, Homo sapiens
cctgccgagcaaccgtggccct

SEQ ID NO: 3900195 - DNA, 14 bp, Homo sapiens
cctgccgcccaaag

SEQ ID NO: 3900196 - DNA, 16 bp, Homo sapiens
cctgcctcatccacca

SEQ ID NO: 3900197 - DNA, 15 bp, Homo sapiens
cctgcctcccagccc

SEQ ID NO: 3900198 - DNA, 19 bp, Homo sapiens
cctgcctccctttctggga

SEQ ID NO: 3900199 - DNA, 17 bp, Homo sapiens
cctgcctctcacacaca

SEQ ID NO: 3900200 - DNA, 13 bp, Homo sapiens
cctgcctctcccc

SEQ ID NO: 3900201 - DNA, 10 bp, Homo sapiens
cctgcctctg

SEQ ID NO: 3900202 - DNA, 13 bp, Homo sapiens
cctgcctgagccc

SEQ ID NO: 3900203 - DNA, 22 bp, Homo sapiens
cctgcctgataccctgcttggt

SEQ ID NO: 3900204 - DNA, 21 bp, Homo sapiens
cctgcctggaggacctgagcc

SEQ ID NO: 3900205 - DNA, 24 bp, Homo sapiens
cctgcctggaggacctgagcctgc

SEQ ID NO: 3900206 - DNA, 23 bp, Homo sapiens
cctgcctgggttttctaactgta

SEQ ID NO: 3900207 - DNA, 22 bp, Homo sapiens
cctgcctgttcccattcttgca

SEQ ID NO: 3900208 - DNA, 21 bp, Homo sapiens
cctgcctttgaaattccccca

SEQ ID NO: 3900209 - DNA, 16 bp, Homo sapiens
cctgcggccgggctgc

SEQ ID NO: 3900210 - DNA, 20 bp, Homo sapiens
cctgcggctgctgtgtgcct

SEQ ID NO: 3900211 - DNA, 14 bp, Homo sapiens
cctgcgttggagcc

SEQ ID NO: 3900212 - DNA, 18 bp, Homo sapiens
cctgcgttggagccactc

SEQ ID NO: 3900213 - DNA, 19 bp, Homo sapiens
cctgcgttggagccactcc

SEQ ID NO: 3900214 - DNA, 23 bp, Homo sapiens
cctgcgttggagccactcctgtc

SEQ ID NO: 3900215 - DNA, 20 bp, Homo sapiens
cctgctactcctgtgctctg

SEQ ID NO: 3900216 - DNA, 23 bp, Homo sapiens
cctgctcccagcagccctaagga

SEQ ID NO: 3900217 - DNA, 23 bp, Homo sapiens
cctgctcccccaccccctcccca

SEQ ID NO: 3900218 - DNA, 13 bp, Homo sapiens
cctgctcctccca

SEQ ID NO: 3900219 - DNA, 18 bp, Homo sapiens
cctgctctcctcttgcca

SEQ ID NO: 3900220 - DNA, 13 bp, Homo sapiens
cctgctctcttca

SEQ ID NO: 3900221 - DNA, 16 bp, Homo sapiens
cctgctctcttcagga

SEQ ID NO: 3900222 - DNA, 11 bp, Homo sapiens
cctgctgagct

SEQ ID NO: 3900223 - DNA, 21 bp, Homo sapiens
cctgctgagctctgagaggcc

SEQ ID NO: 3900224 - DNA, 24 bp, Homo sapiens
cctgctgagctctgagaggccctg

SEQ ID NO: 3900225 - DNA, 18 bp, Homo sapiens
cctgctgccgcctcccag

SEQ ID NO: 3900226 - DNA, 21 bp, Homo sapiens
cctgctgccgcctcccagcct

SEQ ID NO: 3900227 - DNA, 17 bp, Homo sapiens
cctgctgcgtcagacca

SEQ ID NO: 3900228 - DNA, 18 bp, Homo sapiens
cctgctgcgtcagaccag

SEQ ID NO: 3900229 - DNA, 18 bp, Homo sapiens
cctgctgctgacctgatc

SEQ ID NO: 3900230 - DNA, 14 bp, Homo sapiens
cctgctgctgagaa

SEQ ID NO: 3900231 - DNA, 21 bp, Homo sapiens
cctgctgctgagaacctggcc

SEQ ID NO: 3900232 - DNA, 23 bp, Homo sapiens
cctgctgctgagaacctggcctt

SEQ ID NO: 3900233 - DNA, 24 bp, Homo sapiens
cctgctgctgagaacctggccttc

SEQ ID NO: 3900234 - DNA, 11 bp, Homo sapiens
cctgctgctgt

SEQ ID NO: 3900235 - DNA, 22 bp, Homo sapiens
cctgctgctgtaactgctgagc

SEQ ID NO: 3900236 - DNA, 22 bp, Homo sapiens
cctgctggaaaccacacttctt

SEQ ID NO: 3900237 - DNA, 13 bp, Homo sapiens
cctgctggcacct

SEQ ID NO: 3900238 - DNA, 12 bp, Homo sapiens
cctgctgggctc

SEQ ID NO: 3900239 - DNA, 17 bp, Homo sapiens
cctgctgggctctccac

SEQ ID NO: 3900240 - DNA, 23 bp, Homo sapiens
cctgctgggctctccacctcagc

SEQ ID NO: 3900241 - DNA, 24 bp, Homo sapiens
cctgctgggctctccacctcagcc

SEQ ID NO: 3900242 - DNA, 15 bp, Homo sapiens
cctgctgggtaaact

SEQ ID NO: 3900243 - DNA, 15 bp, Homo sapiens
cctgctgtggcctca

SEQ ID NO: 3900244 - DNA, 18 bp, Homo sapiens
cctgctgtggcctcactt

SEQ ID NO: 3900245 - DNA, 14 bp, Homo sapiens
cctgcttcatgctc

SEQ ID NO: 3900246 - DNA, 16 bp, Homo sapiens
cctgcttcatgctcag

SEQ ID NO: 3900247 - DNA, 12 bp, Homo sapiens
cctgcttcctag

SEQ ID NO: 3900248 - DNA, 22 bp, Homo sapiens
cctgcttcctaggccccagagc

SEQ ID NO: 3900249 - DNA, 17 bp, Homo sapiens
cctgctttgggctgccc

SEQ ID NO: 3900250 - DNA, 18 bp, Homo sapiens
cctgctttgggctgccct

SEQ ID NO: 3900251 - DNA, 23 bp, Homo sapiens
cctgctttgggctgccctggtgc

SEQ ID NO: 3900252 - DNA, 22 bp, Homo sapiens
cctgcttttccaggatcctgca

SEQ ID NO: 3900253 - DNA, 12 bp, Homo sapiens
cctggaaatgtg

SEQ ID NO: 3900254 - DNA, 19 bp, Homo sapiens
cctggaaattctggaactg

SEQ ID NO: 3900255 - DNA, 14 bp, Homo sapiens
cctggaaccaatcc

SEQ ID NO: 3900256 - DNA, 16 bp, Homo sapiens
cctggaaccagggagg

SEQ ID NO: 3900257 - DNA, 11 bp, Homo sapiens
cctggaagggc

SEQ ID NO: 3900258 - DNA, 18 bp, Homo sapiens
cctggaattcagcaccct

SEQ ID NO: 3900259 - DNA, 22 bp, Homo sapiens
cctggaattcagcaccctgggt

SEQ ID NO: 3900260 - DNA, 15 bp, Homo sapiens
cctggacagctgtgc

SEQ ID NO: 3900261 - DNA, 20 bp, Homo sapiens
cctggacctgagtcggcccc

SEQ ID NO: 3900262 - DNA, 12 bp, Homo sapiens
cctggagaacta

SEQ ID NO: 3900263 - DNA, 11 bp, Homo sapiens
cctggagaagc

SEQ ID NO: 3900264 - DNA, 17 bp, Homo sapiens
cctggagaagctgatgc

SEQ ID NO: 3900265 - DNA, 21 bp, Homo sapiens
cctggagagccagaacctgga

SEQ ID NO: 3900266 - DNA, 21 bp, Homo sapiens
cctggagagctagaacctgga

SEQ ID NO: 3900267 - DNA, 22 bp, Homo sapiens
cctggagagctagaacctggag

SEQ ID NO: 3900268 - DNA, 15 bp, Homo sapiens
cctggagatgatgat

SEQ ID NO: 3900269 - DNA, 16 bp, Homo sapiens
cctggagcatcccagg

SEQ ID NO: 3900270 - DNA, 17 bp, Homo sapiens
cctggagcatcccaggc

SEQ ID NO: 3900271 - DNA, 18 bp, Homo sapiens
cctggaggacctgagcct

SEQ ID NO: 3900272 - DNA, 12 bp, Homo sapiens
ccttcagtgccc

SEQ ID NO: 3900273 - DNA, 14 bp, Homo sapiens
ccttcagtgcccac

SEQ ID NO: 3900274 - DNA, 18 bp, Homo sapiens
ccttccatgtcgcctctg

SEQ ID NO: 3900275 - DNA, 20 bp, Homo sapiens
ccttcccaatcagcactgaa

SEQ ID NO: 3900276 - DNA, 14 bp, Homo sapiens
ccttcccagctctc

SEQ ID NO: 3900277 - DNA, 19 bp, Homo sapiens
ccttcccaggagtggagga

SEQ ID NO: 3900278 - DNA, 15 bp, Homo sapiens
ccttcccatgccctg

SEQ ID NO: 3900279 - DNA, 14 bp, Homo sapiens
ccttccccagactc

SEQ ID NO: 3900280 - DNA, 23 bp, Homo sapiens
ccttccccagactcagctccaga

SEQ ID NO: 3900281 - DNA, 19 bp, Homo sapiens
ccttccccctccaatccca

SEQ ID NO: 3900282 - DNA, 14 bp, Homo sapiens
ccttccccttctgt

SEQ ID NO: 3900283 - DNA, 18 bp, Homo sapiens
ccttccccttctgtgtca

SEQ ID NO: 3900284 - DNA, 15 bp, Homo sapiens
ccttccctctttcta

SEQ ID NO: 3900285 - DNA, 20 bp, Homo sapiens
ccttccctgctttgaggaca

SEQ ID NO: 3900286 - DNA, 20 bp, Homo sapiens
ccttccgctcctttacctac

SEQ ID NO: 3900287 - DNA, 12 bp, Homo sapiens
ccttcctcatcc

SEQ ID NO: 3900288 - DNA, 12 bp, Homo sapiens
ccttcctcccca

SEQ ID NO: 3900289 - DNA, 13 bp, Homo sapiens
ccttcctcctcca

SEQ ID NO: 3900290 - DNA, 16 bp, Homo sapiens
ccttcctcctccacag

SEQ ID NO: 3900291 - DNA, 20 bp, Homo sapiens
ccttcctcctccacagtgct

SEQ ID NO: 3900292 - DNA, 20 bp, Homo sapiens
ccttcctcctgaagcctctg

SEQ ID NO: 3900293 - DNA, 15 bp, Homo sapiens
ccttcctctccactg

SEQ ID NO: 3900294 - DNA, 20 bp, Homo sapiens
ccttcctctccactgccttc

SEQ ID NO: 3900295 - DNA, 17 bp, Homo sapiens
ccttcctgagacctcgc

SEQ ID NO: 3900296 - DNA, 14 bp, Homo sapiens
ccttcctgccacca

SEQ ID NO: 3900297 - DNA, 16 bp, Homo sapiens
ccttcctggacagctg

SEQ ID NO: 3900298 - DNA, 20 bp, Homo sapiens
ccttcctggacagctgtgcc

SEQ ID NO: 3900299 - DNA, 13 bp, Homo sapiens
ccttcctggcctc

SEQ ID NO: 3900300 - DNA, 14 bp, Homo sapiens
ccttcctggcctca

SEQ ID NO: 3900301 - DNA, 15 bp, Homo sapiens
ccttcctggcctcac

SEQ ID NO: 3900302 - DNA, 18 bp, Homo sapiens
ccttcctggcctcactgg

SEQ ID NO: 3900303 - DNA, 19 bp, Homo sapiens
ccttcctggggcatctggc

SEQ ID NO: 3900304 - DNA, 17 bp, Homo sapiens
ccttccttaagccagga

SEQ ID NO: 3900305 - DNA, 14 bp, Homo sapiens
ccttccttccctgg

SEQ ID NO: 3900306 - DNA, 15 bp, Homo sapiens
ccttccttccctggc

SEQ ID NO: 3900307 - DNA, 12 bp, Homo sapiens
ccttcctttcct

SEQ ID NO: 3900308 - DNA, 14 bp, Homo sapiens
ccttcctttcctct

SEQ ID NO: 3900309 - DNA, 17 bp, Homo sapiens
ccttcctttcctctgca

SEQ ID NO: 3900310 - DNA, 22 bp, Homo sapiens
ccttcctttcctctgcagcact

SEQ ID NO: 3900311 - DNA, 20 bp, Homo sapiens
ccttcgaggttgccccttcc

SEQ ID NO: 3900312 - DNA, 20 bp, Homo sapiens
ccttcgcggtggaaggcccg

SEQ ID NO: 3900313 - DNA, 14 bp, Homo sapiens
ccttcgctgccagg

SEQ ID NO: 3900314 - DNA, 22 bp, Homo sapiens
ccttcgctgccaggacacctgc

SEQ ID NO: 3900315 - DNA, 15 bp, Homo sapiens
ccttctccctgggaa

SEQ ID NO: 3900316 - DNA, 14 bp, Homo sapiens
ccttctgcacccag

SEQ ID NO: 3900317 - DNA, 14 bp, Homo sapiens
ccttctgcttctcc

SEQ ID NO: 3900318 - DNA, 20 bp, Homo sapiens
ccttctgggcagaccttgac

SEQ ID NO: 3900319 - DNA, 21 bp, Homo sapiens
ccttctgtggctcacagaacc

SEQ ID NO: 3900320 - DNA, 19 bp, Homo sapiens
ccttcttattctcactcca

SEQ ID NO: 3900321 - DNA, 23 bp, Homo sapiens
ccttcttcacccagctaatctgt

SEQ ID NO: 3900322 - DNA, 18 bp, Homo sapiens
ccttcttccctgttttaa

SEQ ID NO: 3900323 - DNA, 13 bp, Homo sapiens
ccttcttcgctgc

SEQ ID NO: 3900324 - DNA, 18 bp, Homo sapiens
ccttcttggcttctggga

SEQ ID NO: 3900325 - DNA, 21 bp, Homo sapiens
ccttctttaaatcaaaagctg

SEQ ID NO: 3900326 - DNA, 18 bp, Homo sapiens
ccttgaactgttctggcc

SEQ ID NO: 3900327 - DNA, 15 bp, Homo sapiens
ccttgaatctgcagg

SEQ ID NO: 3900328 - DNA, 16 bp, Homo sapiens
ccttgacaacagactg

SEQ ID NO: 3900329 - DNA, 16 bp, Homo sapiens
ccttgagacctcagcc

SEQ ID NO: 3900330 - DNA, 18 bp, Homo sapiens
ccttgagacctcagccat

SEQ ID NO: 3900331 - DNA, 13 bp, Homo sapiens
ccttgagcactca

SEQ ID NO: 3900332 - DNA, 14 bp, Homo sapiens
ccttgatctgtata

SEQ ID NO: 3900333 - DNA, 12 bp, Homo sapiens
ccttgcacctgc

SEQ ID NO: 3900334 - DNA, 14 bp, Homo sapiens
ccttgcacctgcat

SEQ ID NO: 3900335 - DNA, 13 bp, Homo sapiens
ccttgcactgtgg

SEQ ID NO: 3900336 - DNA, 21 bp, Homo sapiens
ccttgcaggtcggtttggttt

SEQ ID NO: 3900337 - DNA, 11 bp, Homo sapiens
ccttgcatcaa

SEQ ID NO: 3900338 - DNA, 18 bp, Homo sapiens
ccttgccaagctttcttc

SEQ ID NO: 3900339 - DNA, 19 bp, Homo sapiens
ccttgccaagctttcttct

SEQ ID NO: 3900340 - DNA, 12 bp, Homo sapiens
ccttgcccagag

SEQ ID NO: 3900341 - DNA, 17 bp, Homo sapiens
ccttgcccccatccctc

SEQ ID NO: 3900342 - DNA, 12 bp, Homo sapiens
ccttgccctgac

SEQ ID NO: 3900343 - DNA, 15 bp, Homo sapiens
ccttgccctgacctc

SEQ ID NO: 3900344 - DNA, 16 bp, Homo sapiens
ccttgccctgacctcc

SEQ ID NO: 3900345 - DNA, 23 bp, Homo sapiens
ccttgccctgacctcccagccct

SEQ ID NO: 3900346 - DNA, 15 bp, Homo sapiens
ccttgcccttgccct

SEQ ID NO: 3900347 - DNA, 19 bp, Homo sapiens
ccttgccttttaaaagaaa

SEQ ID NO: 3900348 - DNA, 23 bp, Homo sapiens
ccttgctcaccaagctgttccac

SEQ ID NO: 3900349 - DNA, 19 bp, Homo sapiens
ccttgctcagtgcctcctg

SEQ ID NO: 3900350 - DNA, 20 bp, Homo sapiens
ccttgctctcccctgccctg

SEQ ID NO: 3900351 - DNA, 20 bp, Homo sapiens
ccttgctcttctttctgaga

SEQ ID NO: 3900352 - DNA, 18 bp, Homo sapiens
ccttgcttatgacatcac

SEQ ID NO: 3900353 - DNA, 20 bp, Homo sapiens
ccttggaaagttcagccaga

SEQ ID NO: 3900354 - DNA, 16 bp, Homo sapiens
ccttggactcctccca

SEQ ID NO: 3900355 - DNA, 15 bp, Homo sapiens
ccttggacttgagga

SEQ ID NO: 3900356 - DNA, 19 bp, Homo sapiens
ccttggagagacacagcgt

SEQ ID NO: 3900357 - DNA, 15 bp, Homo sapiens
ccttggagagcagct

SEQ ID NO: 3900358 - DNA, 23 bp, Homo sapiens
ccttgggaggttttattctgact

SEQ ID NO: 3900359 - DNA, 12 bp, Homo sapiens
cgacagagagat

SEQ ID NO: 3900360 - DNA, 11 bp, Homo sapiens
cgacagcccag

SEQ ID NO: 3900361 - DNA, 13 bp, Homo sapiens
cgacagcctggca

SEQ ID NO: 3900362 - DNA, 15 bp, Homo sapiens
cgacagttctgaact

SEQ ID NO: 3900363 - DNA, 12 bp, Homo sapiens
cgaccacctgcc

SEQ ID NO: 3900364 - DNA, 15 bp, Homo sapiens
cgaccctttctctga

SEQ ID NO: 3900365 - DNA, 22 bp, Homo sapiens
cgacctcgtcctccccctgcca

SEQ ID NO: 3900366 - DNA, 23 bp, Homo sapiens
cgacctcgtcctccccctgccag

SEQ ID NO: 3900367 - DNA, 15 bp, Homo sapiens
cgacgcgtctcctgt

SEQ ID NO: 3900368 - DNA, 19 bp, Homo sapiens
cgacggtttcaaaccagga

SEQ ID NO: 3900369 - DNA, 13 bp, Homo sapiens
cgactagcaggca

SEQ ID NO: 3900370 - DNA, 11 bp, Homo sapiens
cgactcaggat

SEQ ID NO: 3900371 - DNA, 14 bp, Homo sapiens
cgactcttcctgca

SEQ ID NO: 3900372 - DNA, 15 bp, Homo sapiens
cgactcttcctgcaa

SEQ ID NO: 3900373 - DNA, 21 bp, Homo sapiens
cgactgttgtacaagctcagg

SEQ ID NO: 3900374 - DNA, 15 bp, Homo sapiens
cgagaaaaggagaaa

SEQ ID NO: 3900375 - DNA, 17 bp, Homo sapiens
cgagaccaacctgacca

SEQ ID NO: 3900376 - DNA, 17 bp, Homo sapiens
cgagaccatcctggccc

SEQ ID NO: 3900377 - DNA, 20 bp, Homo sapiens
cgagaccatcctggcccctc

SEQ ID NO: 3900378 - DNA, 17 bp, Homo sapiens
cgagacggctggacctg

SEQ ID NO: 3900379 - DNA, 22 bp, Homo sapiens
cgagagaggcgcgtctgcccca

SEQ ID NO: 3900380 - DNA, 13 bp, Homo sapiens
cgagagcctgctc

SEQ ID NO: 3900381 - DNA, 14 bp, Homo sapiens
cgagagcctgctcc

SEQ ID NO: 3900382 - DNA, 20 bp, Homo sapiens
cgagagcctgctcccccacc

SEQ ID NO: 3900383 - DNA, 15 bp, Homo sapiens
cgagaggcagagaaa

SEQ ID NO: 3900384 - DNA, 17 bp, Homo sapiens
cgagaggtccctgctta

SEQ ID NO: 3900385 - DNA, 19 bp, Homo sapiens
cgagcaaagtctaaagttt

SEQ ID NO: 3900386 - DNA, 23 bp, Homo sapiens
cgagcaaccgtggcccttcctgg

SEQ ID NO: 3900387 - DNA, 14 bp, Homo sapiens
cgagcactggccag

SEQ ID NO: 3900388 - DNA, 17 bp, Homo sapiens
cgagcactggccagaga

SEQ ID NO: 3900389 - DNA, 15 bp, Homo sapiens
cgagcagctgagcag

SEQ ID NO: 3900390 - DNA, 19 bp, Homo sapiens
cgagcagctgagcagggcc

SEQ ID NO: 3900391 - DNA, 14 bp, Homo sapiens
cgagcccagctaca

SEQ ID NO: 3900392 - DNA, 15 bp, Homo sapiens
cgagcctaatgaaag

SEQ ID NO: 3900393 - DNA, 16 bp, Homo sapiens
cgagcgccctgcagac

SEQ ID NO: 3900394 - DNA, 19 bp, Homo sapiens
cgagcgccctgcagaccct

SEQ ID NO: 3900395 - DNA, 23 bp, Homo sapiens
cgagcgctttctggaaaagagga

SEQ ID NO: 3900396 - DNA, 21 bp, Homo sapiens
cgagctactctcttgccagca

SEQ ID NO: 3900397 - DNA, 22 bp, Homo sapiens
cgaggaccctggttactctggt

SEQ ID NO: 3900398 - DNA, 17 bp, Homo sapiens
cgaggcaccggcgctgc

SEQ ID NO: 3900399 - DNA, 19 bp, Homo sapiens
cgaggcaccggcgctgcag

SEQ ID NO: 3900400 - DNA, 20 bp, Homo sapiens
cgaggtagagtttgaaggag

SEQ ID NO: 3900401 - DNA, 16 bp, Homo sapiens
cgaggtcaacagagaa

SEQ ID NO: 3900402 - DNA, 22 bp, Homo sapiens
cgaggtggatcacagaggcttc

SEQ ID NO: 3900403 - DNA, 16 bp, Homo sapiens
cgaggtgtcaccctgc

SEQ ID NO: 3900404 - DNA, 16 bp, Homo sapiens
cgagtcaatcccctca

SEQ ID NO: 3900405 - DNA, 21 bp, Homo sapiens
cgagtctcttctccactggat

SEQ ID NO: 3900406 - DNA, 16 bp, Homo sapiens
cgagtttggtccctgg

SEQ ID NO: 3900407 - DNA, 18 bp, Homo sapiens
cgatacaccgggcctgga

SEQ ID NO: 3900408 - DNA, 19 bp, Homo sapiens
cgatcggggcactgcaggg

SEQ ID NO: 3900409 - DNA, 20 bp, Homo sapiens
cgatcttggctcactgcaac

SEQ ID NO: 3900410 - DNA, 22 bp, Homo sapiens
cgatgccgtgtgtctcgtctcc

SEQ ID NO: 3900411 - DNA, 17 bp, Homo sapiens
cgatgtcaaggactcct

SEQ ID NO: 3900412 - DNA, 18 bp, Homo sapiens
cgatgtgcgcacacacag

SEQ ID NO: 3900413 - DNA, 11 bp, Homo sapiens
cgatgtggccc

SEQ ID NO: 3900414 - DNA, 15 bp, Homo sapiens
cgattaatttatggt

SEQ ID NO: 3900415 - DNA, 13 bp, Homo sapiens
cgattttgcctgt

SEQ ID NO: 3900416 - DNA, 19 bp, Homo sapiens
cgcaaagggctgaaagcca

SEQ ID NO: 3900417 - DNA, 13 bp, Homo sapiens
cgcaacccgtgcc

SEQ ID NO: 3900418 - DNA, 20 bp, Homo sapiens
cgcaagggcatcaggcactg

SEQ ID NO: 3900419 - DNA, 15 bp, Homo sapiens
cgcaagtctgcagcc

SEQ ID NO: 3900420 - DNA, 13 bp, Homo sapiens
cgcaatgtggcat

SEQ ID NO: 3900421 - DNA, 21 bp, Homo sapiens
cgcaattgtgggatgtcctct

SEQ ID NO: 3900422 - DNA, 16 bp, Homo sapiens
cgcacaaggctgacca

SEQ ID NO: 3900423 - DNA, 21 bp, Homo sapiens
cgcacaaggctgaccaagaga

SEQ ID NO: 3900424 - DNA, 13 bp, Homo sapiens
cgcacatgttatc

SEQ ID NO: 3900425 - DNA, 16 bp, Homo sapiens
cgcaccagctgctctg

SEQ ID NO: 3900426 - DNA, 18 bp, Homo sapiens
cgcaccagctgctctgcc

SEQ ID NO: 3900427 - DNA, 20 bp, Homo sapiens
cgcaccagctgctctgcccc

SEQ ID NO: 3900428 - DNA, 21 bp, Homo sapiens
cgcacgcaacccttgctgctg

SEQ ID NO: 3900429 - DNA, 12 bp, Homo sapiens
cgcactgtggat

SEQ ID NO: 3900430 - DNA, 23 bp, Homo sapiens
cgcagaggcggaaaccttgcagc

SEQ ID NO: 3900431 - DNA, 15 bp, Homo sapiens
cgcagcaggtgcaag

SEQ ID NO: 3900432 - DNA, 19 bp, Homo sapiens
cgcagcaggtgcaagagac

SEQ ID NO: 3900433 - DNA, 17 bp, Homo sapiens
cgcagccaccctgagga

SEQ ID NO: 3900434 - DNA, 19 bp, Homo sapiens
cgcagcccgtgaagcagtg

SEQ ID NO: 3900435 - DNA, 23 bp, Homo sapiens
cgcagcccgtgaagcagtgcctc

SEQ ID NO: 3900436 - DNA, 24 bp, Homo sapiens
cgcagccctgctttgggctgccct

SEQ ID NO: 3900437 - DNA, 18 bp, Homo sapiens
cgcagcctggcggggcag

SEQ ID NO: 3900438 - DNA, 21 bp, Homo sapiens
cgcagcctggcggggcaggag

SEQ ID NO: 3900439 - DNA, 23 bp, Homo sapiens
cgcagcctggcggggcaggaggc

SEQ ID NO: 3900440 - DNA, 17 bp, Homo sapiens
cgcaggaactcccagca

SEQ ID NO: 3900441 - DNA, 16 bp, Homo sapiens
cgcagggaggatgcca

SEQ ID NO: 3900442 - DNA, 18 bp, Homo sapiens
cgcagggaggatgccaca

SEQ ID NO: 3900443 - DNA, 16 bp, Homo sapiens
cgcagtcgcaggatcc

SEQ ID NO: 3900444 - DNA, 14 bp, Homo sapiens
cgcatcttctccat

SEQ ID NO: 3900445 - DNA, 21 bp, Homo sapiens
cgcatcttctccatctggcag

SEQ ID NO: 3900446 - DNA, 19 bp, Homo sapiens
cggaaggggacgcgggctg

SEQ ID NO: 3900447 - DNA, 15 bp, Homo sapiens
cggaccaagatgggc

SEQ ID NO: 3900448 - DNA, 14 bp, Homo sapiens
cggacctttcagct

SEQ ID NO: 3900449 - DNA, 16 bp, Homo sapiens
cggacgtcctgctggc

SEQ ID NO: 3900450 - DNA, 20 bp, Homo sapiens
cggacgtcctgctggcacct

SEQ ID NO: 3900451 - DNA, 19 bp, Homo sapiens
cggacgttggttctgcact

SEQ ID NO: 3900452 - DNA, 18 bp, Homo sapiens
cggacgtttccatcaggt

SEQ ID NO: 3900453 - DNA, 23 bp, Homo sapiens
cggagaagagctgttcacagcca

SEQ ID NO: 3900454 - DNA, 17 bp, Homo sapiens
cggagcacagccctggg

SEQ ID NO: 3900455 - DNA, 19 bp, Homo sapiens
cggagcacagccctgggag

SEQ ID NO: 3900456 - DNA, 19 bp, Homo sapiens
cggagcaggggtctgagcc

SEQ ID NO: 3900457 - DNA, 14 bp, Homo sapiens
cggagccccaggcc

SEQ ID NO: 3900458 - DNA, 15 bp, Homo sapiens
cggagcttgcagtga

SEQ ID NO: 3900459 - DNA, 14 bp, Homo sapiens
cggaggctgggccc

SEQ ID NO: 3900460 - DNA, 18 bp, Homo sapiens
cggaggctgggcccctgg

SEQ ID NO: 3900461 - DNA, 19 bp, Homo sapiens
cggaggctgggcccctggg

SEQ ID NO: 3900462 - DNA, 20 bp, Homo sapiens
cggaggctgggcccctggga

SEQ ID NO: 3900463 - DNA, 22 bp, Homo sapiens
cggaggctgggcccctgggatg

SEQ ID NO: 3900464 - DNA, 15 bp, Homo sapiens
cggaggggcctggca

SEQ ID NO: 3900465 - DNA, 23 bp, Homo sapiens
cggaggggttgcgggggagctgg

SEQ ID NO: 3900466 - DNA, 15 bp, Homo sapiens
cggaggtggtggagg

SEQ ID NO: 3900467 - DNA, 19 bp, Homo sapiens
cggagtaatcaggcagcct

SEQ ID NO: 3900468 - DNA, 18 bp, Homo sapiens
cggagtacagacgtctca

SEQ ID NO: 3900469 - DNA, 18 bp, Homo sapiens
cggatcaccgagagtagc

SEQ ID NO: 3900470 - DNA, 23 bp, Homo sapiens
cggatcaccgagagtagccgaga

SEQ ID NO: 3900471 - DNA, 15 bp, Homo sapiens
cggatcgaggacaag

SEQ ID NO: 3900472 - DNA, 15 bp, Homo sapiens
cggatctcactcagc

SEQ ID NO: 3900473 - DNA, 13 bp, Homo sapiens
cggatgcacagag

SEQ ID NO: 3900474 - DNA, 15 bp, Homo sapiens
cggatgcacagagat

SEQ ID NO: 3900475 - DNA, 14 bp, Homo sapiens
cggatggcagattg

SEQ ID NO: 3900476 - DNA, 23 bp, Homo sapiens
cggcaaccccagttctgctcctc

SEQ ID NO: 3900477 - DNA, 22 bp, Homo sapiens
cggcaactaagcagtccctgag

SEQ ID NO: 3900478 - DNA, 22 bp, Homo sapiens
cggcacctgcgagaggtccctg

SEQ ID NO: 3900479 - DNA, 13 bp, Homo sapiens
cggcacctgggcc

SEQ ID NO: 3900480 - DNA, 20 bp, Homo sapiens
cggcacctgggccctggggc

SEQ ID NO: 3900481 - DNA, 22 bp, Homo sapiens
cggcacctgggccctggggcct

SEQ ID NO: 3900482 - DNA, 23 bp, Homo sapiens
cggcacgccaacagcccccccct

SEQ ID NO: 3900483 - DNA, 16 bp, Homo sapiens
cggcacgtcccatgtg

SEQ ID NO: 3900484 - DNA, 18 bp, Homo sapiens
cggcaggagcaggaacag

SEQ ID NO: 3900485 - DNA, 19 bp, Homo sapiens
cggcaggagcaggaacaga

SEQ ID NO: 3900486 - DNA, 20 bp, Homo sapiens
cggcaggctgggttcattcc

SEQ ID NO: 3900487 - DNA, 16 bp, Homo sapiens
cggcagggtgggggag

SEQ ID NO: 3900488 - DNA, 13 bp, Homo sapiens
cggccagggcctg

SEQ ID NO: 3900489 - DNA, 12 bp, Homo sapiens
cggcccacagct

SEQ ID NO: 3900490 - DNA, 15 bp, Homo sapiens
cggcccacagctccc

SEQ ID NO: 3900491 - DNA, 12 bp, Homo sapiens
cggcccagagac

SEQ ID NO: 3900492 - DNA, 20 bp, Homo sapiens
cggcccagagaccccttcct

SEQ ID NO: 3900493 - DNA, 23 bp, Homo sapiens
cggccccccctcttttggccttg

SEQ ID NO: 3900494 - DNA, 22 bp, Homo sapiens
cggcccctgcatccccttggct

SEQ ID NO: 3900495 - DNA, 14 bp, Homo sapiens
cggccctatgcatg

SEQ ID NO: 3900496 - DNA, 16 bp, Homo sapiens
cggccgcattccctga

SEQ ID NO: 3900497 - DNA, 14 bp, Homo sapiens
cggccgggctgccc

SEQ ID NO: 3900498 - DNA, 19 bp, Homo sapiens
cggccgggctgcccttcgc

SEQ ID NO: 3900499 - DNA, 14 bp, Homo sapiens
cggcctccactccc

SEQ ID NO: 3900500 - DNA, 21 bp, Homo sapiens
cggcctccactcccccacctg

SEQ ID NO: 3900501 - DNA, 22 bp, Homo sapiens
cggcctccactcccccacctga

SEQ ID NO: 3900502 - DNA, 13 bp, Homo sapiens
cggcctcttccac

SEQ ID NO: 3900503 - DNA, 17 bp, Homo sapiens
cggcctcttccacccat

SEQ ID NO: 3900504 - DNA, 13 bp, Homo sapiens
cggcgccaccatc

SEQ ID NO: 3900505 - DNA, 20 bp, Homo sapiens
cggcggccctcaaaagcact

SEQ ID NO: 3900506 - DNA, 21 bp, Homo sapiens
cggcggccctcaaaagcactt

SEQ ID NO: 3900507 - DNA, 13 bp, Homo sapiens
cggctactcagca

SEQ ID NO: 3900508 - DNA, 16 bp, Homo sapiens
cggctactcagcagcc

SEQ ID NO: 3900509 - DNA, 19 bp, Homo sapiens
cggctactcagcagccctc

SEQ ID NO: 3900510 - DNA, 14 bp, Homo sapiens
cggctccaggtccg

SEQ ID NO: 3900511 - DNA, 23 bp, Homo sapiens
cggcttagacttcgactcaggat

SEQ ID NO: 3900512 - DNA, 17 bp, Homo sapiens
cggcttggccgccatcc

SEQ ID NO: 3900513 - DNA, 18 bp, Homo sapiens
cggcttggccgccatccg

SEQ ID NO: 3900514 - DNA, 17 bp, Homo sapiens
cgggaaagaatataaag

SEQ ID NO: 3900515 - DNA, 12 bp, Homo sapiens
cgggaaattatt

SEQ ID NO: 3900516 - DNA, 18 bp, Homo sapiens
cgggaccattgacctcag

SEQ ID NO: 3900517 - DNA, 22 bp, Homo sapiens
cgggaccattgacctcagctgc

SEQ ID NO: 3900518 - DNA, 13 bp, Homo sapiens
cgggacgcttcca

SEQ ID NO: 3900519 - DNA, 16 bp, Homo sapiens
cgggacgcttccagac

SEQ ID NO: 3900520 - DNA, 19 bp, Homo sapiens
cgggacgcttccagaccac

SEQ ID NO: 3900521 - DNA, 21 bp, Homo sapiens
cgggacgcttccagaccacct

SEQ ID NO: 3900522 - DNA, 12 bp, Homo sapiens
cgggagcctccc

SEQ ID NO: 3900523 - DNA, 14 bp, Homo sapiens
cgggagcctccccc

SEQ ID NO: 3900524 - DNA, 14 bp, Homo sapiens
cgggagcctcctct

SEQ ID NO: 3900525 - DNA, 15 bp, Homo sapiens
cgggagcctcctctg

SEQ ID NO: 3900526 - DNA, 15 bp, Homo sapiens
cgggaggcaccagct

SEQ ID NO: 3900527 - DNA, 16 bp, Homo sapiens
cgggaggcaccagctc

SEQ ID NO: 3900528 - DNA, 17 bp, Homo sapiens
cgggaggcaccagctct

SEQ ID NO: 3900529 - DNA, 18 bp, Homo sapiens
cgggaggcaccagctctg

SEQ ID NO: 3900530 - DNA, 20 bp, Homo sapiens
cgggaggcaccagctctgtg

SEQ ID NO: 3900531 - DNA, 15 bp, Homo sapiens
cgggaggcctcagtt

SEQ ID NO: 3900532 - DNA, 19 bp, Homo sapiens
cgggaggctgagacaggag

SEQ ID NO: 3900533 - DNA, 16 bp, Homo sapiens
cgtcctgtcccagagg

SEQ ID NO: 3900534 - DNA, 15 bp, Homo sapiens
cgtccttactcctgt

SEQ ID NO: 3900535 - DNA, 17 bp, Homo sapiens
cgtccttactcctgtgg

SEQ ID NO: 3900536 - DNA, 22 bp, Homo sapiens
cgtccttactcctgtgggagcc

SEQ ID NO: 3900537 - DNA, 15 bp, Homo sapiens
cgtctccctaaaata

SEQ ID NO: 3900538 - DNA, 17 bp, Homo sapiens
cgtctgactccagagtc

SEQ ID NO: 3900539 - DNA, 23 bp, Homo sapiens
cgtctgactccagagtctgagcc

SEQ ID NO: 3900540 - DNA, 12 bp, Homo sapiens
cgtctgccaggc

SEQ ID NO: 3900541 - DNA, 13 bp, Homo sapiens
cgtctgccaggcc

SEQ ID NO: 3900542 - DNA, 15 bp, Homo sapiens
cgtctgccaggccca

SEQ ID NO: 3900543 - DNA, 16 bp, Homo sapiens
cgtctgccaggcccat

SEQ ID NO: 3900544 - DNA, 15 bp, Homo sapiens
cgtctgccccaccct

SEQ ID NO: 3900545 - DNA, 18 bp, Homo sapiens
cgtctgccccaccctcaa

SEQ ID NO: 3900546 - DNA, 22 bp, Homo sapiens
cgtctgcctggaaattctggaa

SEQ ID NO: 3900547 - DNA, 13 bp, Homo sapiens
cgtcttctccaac

SEQ ID NO: 3900548 - DNA, 22 bp, Homo sapiens
cgtcttgggtcgccctaccctc

SEQ ID NO: 3900549 - DNA, 18 bp, Homo sapiens
cgtgaaagaattattttt

SEQ ID NO: 3900550 - DNA, 16 bp, Homo sapiens
cgtgaaagcagatgag

SEQ ID NO: 3900551 - DNA, 16 bp, Homo sapiens
cgtgaagcagtgcctc

SEQ ID NO: 3900552 - DNA, 22 bp, Homo sapiens
cgtgaatatcgagaactgccat

SEQ ID NO: 3900553 - DNA, 14 bp, Homo sapiens
cgtgacccttcagg

SEQ ID NO: 3900554 - DNA, 18 bp, Homo sapiens
cgtgacccttcagggcca

SEQ ID NO: 3900555 - DNA, 15 bp, Homo sapiens
cgtgactcacccaag

SEQ ID NO: 3900556 - DNA, 13 bp, Homo sapiens
cgtgactgcccca

SEQ ID NO: 3900557 - DNA, 23 bp, Homo sapiens
cgtgactgccccaactcctggaa

SEQ ID NO: 3900558 - DNA, 12 bp, Homo sapiens
cgtgagccaggt

SEQ ID NO: 3900559 - DNA, 15 bp, Homo sapiens
cgtgccaagtccagg

SEQ ID NO: 3900560 - DNA, 21 bp, Homo sapiens
cgtgccaagtccaggtcctgg

SEQ ID NO: 3900561 - DNA, 19 bp, Homo sapiens
cgtgccaggcccggggctg

SEQ ID NO: 3900562 - DNA, 16 bp, Homo sapiens
cgtgccagtgtcccca

SEQ ID NO: 3900563 - DNA, 19 bp, Homo sapiens
cgtgcccaggggcccacag

SEQ ID NO: 3900564 - DNA, 20 bp, Homo sapiens
cgtgccctgacccctgcacc

SEQ ID NO: 3900565 - DNA, 19 bp, Homo sapiens
cgtgcgtgttagtgtgtgt

SEQ ID NO: 3900566 - DNA, 16 bp, Homo sapiens
cgtgctcgcagcctgg

SEQ ID NO: 3900567 - DNA, 18 bp, Homo sapiens
cgtgctcttctgttctca

SEQ ID NO: 3900568 - DNA, 19 bp, Homo sapiens
cgtgctcttctgttctcaa

SEQ ID NO: 3900569 - DNA, 15 bp, Homo sapiens
cgtggacacctgccc

SEQ ID NO: 3900570 - DNA, 19 bp, Homo sapiens
cgtggagagctaggagcaa

SEQ ID NO: 3900571 - DNA, 18 bp, Homo sapiens
cgtggagcagaatcagta

SEQ ID NO: 3900572 - DNA, 14 bp, Homo sapiens
cgtggaggctgctc

SEQ ID NO: 3900573 - DNA, 13 bp, Homo sapiens
cgtggcaaatata

SEQ ID NO: 3900574 - DNA, 14 bp, Homo sapiens
cgtggcaaatataa

SEQ ID NO: 3900575 - DNA, 15 bp, Homo sapiens
cgtggcccttcctgg

SEQ ID NO: 3900576 - DNA, 18 bp, Homo sapiens
cgtggcccttcctggaca

SEQ ID NO: 3900577 - DNA, 17 bp, Homo sapiens
cgtggctgtggcacaga

SEQ ID NO: 3900578 - DNA, 20 bp, Homo sapiens
cgtggcttcccgctcagccc

SEQ ID NO: 3900579 - DNA, 17 bp, Homo sapiens
cgtgggagagagacgtg

SEQ ID NO: 3900580 - DNA, 17 bp, Homo sapiens
cgtgggtatttcctgct

SEQ ID NO: 3900581 - DNA, 17 bp, Homo sapiens
cgtggtagaagccagta

SEQ ID NO: 3900582 - DNA, 17 bp, Homo sapiens
cgtggtctccttgcact

SEQ ID NO: 3900583 - DNA, 13 bp, Homo sapiens
cgtggttccaaga

SEQ ID NO: 3900584 - DNA, 14 bp, Homo sapiens
cgtggttccaagaa

SEQ ID NO: 3900585 - DNA, 18 bp, Homo sapiens
cgtgtcccaaggagctga

SEQ ID NO: 3900586 - DNA, 17 bp, Homo sapiens
cgtgtccccggcctcag

SEQ ID NO: 3900587 - DNA, 23 bp, Homo sapiens
cgtgtctctcccaccccggcctc

SEQ ID NO: 3900588 - DNA, 14 bp, Homo sapiens
cgtgtctctgagga

SEQ ID NO: 3900589 - DNA, 19 bp, Homo sapiens
cgtgttaggaggctgcatg

SEQ ID NO: 3900590 - DNA, 21 bp, Homo sapiens
cgtgttaggaggctgcatgct

SEQ ID NO: 3900591 - DNA, 20 bp, Homo sapiens
cgtgttagtgtgtgtgcatg

SEQ ID NO: 3900592 - DNA, 14 bp, Homo sapiens
cgtgtttacaaaag

SEQ ID NO: 3900593 - DNA, 14 bp, Homo sapiens
cgttccccttggct

SEQ ID NO: 3900594 - DNA, 18 bp, Homo sapiens
cgttctccagcccacacc

SEQ ID NO: 3900595 - DNA, 18 bp, Homo sapiens
cgttctgctggcctggat

SEQ ID NO: 3900596 - DNA, 19 bp, Homo sapiens
cgttggaatcacctggagg

SEQ ID NO: 3900597 - DNA, 23 bp, Homo sapiens
cgttggaatcacctggagggctt

SEQ ID NO: 3900598 - DNA, 11 bp, Homo sapiens
cgttggagcca

SEQ ID NO: 3900599 - DNA, 19 bp, Homo sapiens
cgtttagtttctagaggcc

SEQ ID NO: 3900600 - DNA, 16 bp, Homo sapiens
cgtttatgggccttgc

SEQ ID NO: 3900601 - DNA, 13 bp, Homo sapiens
cgtttattgctta

SEQ ID NO: 3900602 - DNA, 18 bp, Homo sapiens
cgtttattgcttaatccc

SEQ ID NO: 3900603 - DNA, 17 bp, Homo sapiens
cgttttcatcctggcct

SEQ ID NO: 3900604 - DNA, 13 bp, Homo sapiens
cgtttttgtgctg

SEQ ID NO: 3900605 - DNA, 22 bp, Homo sapiens
ctaaaaaacataaatttcttta

SEQ ID NO: 3900606 - DNA, 14 bp, Homo sapiens
ctaaaaataaaatg

SEQ ID NO: 3900607 - DNA, 13 bp, Homo sapiens
ctaaaaataagct

SEQ ID NO: 3900608 - DNA, 17 bp, Homo sapiens
ctaaaaataagctttat

SEQ ID NO: 3900609 - DNA, 13 bp, Homo sapiens
ctaaaactatggt

SEQ ID NO: 3900610 - DNA, 10 bp, Homo sapiens
ctaaaagaat

SEQ ID NO: 3900611 - DNA, 12 bp, Homo sapiens
ctaaaataaaaa

SEQ ID NO: 3900612 - DNA, 16 bp, Homo sapiens
ctaaaataaaaaccag

SEQ ID NO: 3900613 - DNA, 15 bp, Homo sapiens
ctaaaatatttattt

SEQ ID NO: 3900614 - DNA, 17 bp, Homo sapiens
ctaaacccaaataaatg

SEQ ID NO: 3900615 - DNA, 18 bp, Homo sapiens
ctaaacccccgctccaga

SEQ ID NO: 3900616 - DNA, 22 bp, Homo sapiens
ctaaacgactccgagaacaaca

SEQ ID NO: 3900617 - DNA, 20 bp, Homo sapiens
ctaaagtatgtaaagtatgt

SEQ ID NO: 3900618 - DNA, 22 bp, Homo sapiens
ctaaagtgtctattagttttct

SEQ ID NO: 3900619 - DNA, 24 bp, Homo sapiens
ctaaagtttacagtaaataaattg

SEQ ID NO: 3900620 - DNA, 22 bp, Homo sapiens
ctacagacgattaacacaccac

SEQ ID NO: 3900621 - DNA, 13 bp, Homo sapiens
ctacagattttag

SEQ ID NO: 3900622 - DNA, 18 bp, Homo sapiens
ctacagcctcagaaacca

SEQ ID NO: 3900623 - DNA, 19 bp, Homo sapiens
ctacagctaatcagcattc

SEQ ID NO: 3900624 - DNA, 22 bp, Homo sapiens
ctacagctaatcagcattctca

SEQ ID NO: 3900625 - DNA, 19 bp, Homo sapiens
ctacagctcacctctgaag

SEQ ID NO: 3900626 - DNA, 21 bp, Homo sapiens
ctacaggagagggaagagtgc

SEQ ID NO: 3900627 - DNA, 20 bp, Homo sapiens
ctacaggcccggcccagcct

SEQ ID NO: 3900628 - DNA, 15 bp, Homo sapiens
ctacagtgttttcct

SEQ ID NO: 3900629 - DNA, 20 bp, Homo sapiens
ctacagttgttttttgaaaa

SEQ ID NO: 3900630 - DNA, 10 bp, Homo sapiens
ctacatgaaa

SEQ ID NO: 3900631 - DNA, 14 bp, Homo sapiens
ctacatgaaacaga

SEQ ID NO: 3900632 - DNA, 15 bp, Homo sapiens
ctacatgaaacagaa

SEQ ID NO: 3900633 - DNA, 15 bp, Homo sapiens
ctacattcctcagct

SEQ ID NO: 3900634 - DNA, 16 bp, Homo sapiens
ctacattcctcagctg

SEQ ID NO: 3900635 - DNA, 14 bp, Homo sapiens
ctacattctcatct

SEQ ID NO: 3900636 - DNA, 13 bp, Homo sapiens
ctaccaaatataa

SEQ ID NO: 3900637 - DNA, 13 bp, Homo sapiens
ctaccaatgcatg

SEQ ID NO: 3900638 - DNA, 19 bp, Homo sapiens
ctaccaatgccaagataat

SEQ ID NO: 3900639 - DNA, 20 bp, Homo sapiens
ctaccaccttccctctttct

SEQ ID NO: 3900640 - DNA, 14 bp, Homo sapiens
ctacccaaccactc

SEQ ID NO: 3900641 - DNA, 16 bp, Homo sapiens
ctacccactctttgct

SEQ ID NO: 3900642 - DNA, 13 bp, Homo sapiens
ctaccccaccacg

SEQ ID NO: 3900643 - DNA, 14 bp, Homo sapiens
ctacccgagcccag

SEQ ID NO: 3900644 - DNA, 19 bp, Homo sapiens
ctacccgagcccagctaca

SEQ ID NO: 3900645 - DNA, 17 bp, Homo sapiens
ctacccgcatcttctgt

SEQ ID NO: 3900646 - DNA, 14 bp, Homo sapiens
ctacccggcccaga

SEQ ID NO: 3900647 - DNA, 14 bp, Homo sapiens
ctaccctcccccag

SEQ ID NO: 3900648 - DNA, 17 bp, Homo sapiens
ctacccttgtaccccat

SEQ ID NO: 3900649 - DNA, 23 bp, Homo sapiens
ctacccttgtaccccatcccttc

SEQ ID NO: 3900650 - DNA, 22 bp, Homo sapiens
ctacctcactattcaagtatta

SEQ ID NO: 3900651 - DNA, 13 bp, Homo sapiens
ctacctgaggcct

SEQ ID NO: 3900652 - DNA, 14 bp, Homo sapiens
ctacctgccctctc

SEQ ID NO: 3900653 - DNA, 19 bp, Homo sapiens
ctacctgccctctctcagt

SEQ ID NO: 3900654 - DNA, 13 bp, Homo sapiens
ctacctgtgcctg

SEQ ID NO: 3900655 - DNA, 17 bp, Homo sapiens
ctacctgtgtggacagg

SEQ ID NO: 3900656 - DNA, 15 bp, Homo sapiens
ctaccttctgacctc

SEQ ID NO: 3900657 - DNA, 14 bp, Homo sapiens
ctacctttttttct

SEQ ID NO: 3900658 - DNA, 13 bp, Homo sapiens
ctacgccaaagtg

SEQ ID NO: 3900659 - DNA, 14 bp, Homo sapiens
ctacgctctccttt

SEQ ID NO: 3900660 - DNA, 17 bp, Homo sapiens
ctacgtacatgtgaggc

SEQ ID NO: 3900661 - DNA, 13 bp, Homo sapiens
ctacgtataaata

SEQ ID NO: 3900662 - DNA, 16 bp, Homo sapiens
ctacgttctccagccc

SEQ ID NO: 3900663 - DNA, 12 bp, Homo sapiens
ctactaaagtgc

SEQ ID NO: 3900664 - DNA, 20 bp, Homo sapiens
ctactaattatatagtatac

SEQ ID NO: 3900665 - DNA, 16 bp, Homo sapiens
ctactacccgagccca

SEQ ID NO: 3900666 - DNA, 15 bp, Homo sapiens
ctactactcaattgt

SEQ ID NO: 3900667 - DNA, 15 bp, Homo sapiens
ctactactttgtgtt

SEQ ID NO: 3900668 - DNA, 15 bp, Homo sapiens
ctactcacacaggca

SEQ ID NO: 3900669 - DNA, 16 bp, Homo sapiens
ctactcagcagccctc

SEQ ID NO: 3900670 - DNA, 20 bp, Homo sapiens
ctactcagcagccctcctca

SEQ ID NO: 3900671 - DNA, 20 bp, Homo sapiens
ctactcagctctcctgctgc

SEQ ID NO: 3900672 - DNA, 16 bp, Homo sapiens
ctactcaggaggctga

SEQ ID NO: 3900673 - DNA, 14 bp, Homo sapiens
ctactcattgtctc

SEQ ID NO: 3900674 - DNA, 14 bp, Homo sapiens
ctactcccctgggc

SEQ ID NO: 3900675 - DNA, 16 bp, Homo sapiens
ctactcctgtgctctg

SEQ ID NO: 3900676 - DNA, 22 bp, Homo sapiens
ctactcgggaggctgaggcagg

SEQ ID NO: 3900677 - DNA, 23 bp, Homo sapiens
ctactcgggaggctgaggcagga

SEQ ID NO: 3900678 - DNA, 15 bp, Homo sapiens
ctactctcttgccag

SEQ ID NO: 3900679 - DNA, 14 bp, Homo sapiens
ctactctgtccagg

SEQ ID NO: 3900680 - DNA, 15 bp, Homo sapiens
ctactctgtccaggc

SEQ ID NO: 3900681 - DNA, 19 bp, Homo sapiens
ctactctgtccaggccact

SEQ ID NO: 3900682 - DNA, 20 bp, Homo sapiens
ctactctgtgccagagcctg

SEQ ID NO: 3900683 - DNA, 21 bp, Homo sapiens
ctactctgtgccagagcctgg

SEQ ID NO: 3900684 - DNA, 22 bp, Homo sapiens
ctactctgtgccagagcctggg

SEQ ID NO: 3900685 - DNA, 17 bp, Homo sapiens
ctactgataaagaaaga

SEQ ID NO: 3900686 - DNA, 16 bp, Homo sapiens
ctactgctgcaaagtg

SEQ ID NO: 3900687 - DNA, 17 bp, Homo sapiens
ctactgctgcaaagtgc

SEQ ID NO: 3900688 - DNA, 18 bp, Homo sapiens
ctactgctgcaaagtgca

SEQ ID NO: 3900689 - DNA, 19 bp, Homo sapiens
ctactggcattaattatta

SEQ ID NO: 3900690 - DNA, 17 bp, Homo sapiens
ctactggtcttgtggaa

SEQ ID NO: 3900691 - DNA, 18 bp, Homo sapiens
ctacttcttggaaaaaaa

SEQ ID NO: 3900692 - DNA, 23 bp, Homo sapiens
ctacttgttacctttcccatgct

SEQ ID NO: 3900693 - DNA, 18 bp, Homo sapiens
ctacttttgcatgaaaat

SEQ ID NO: 3900694 - DNA, 15 bp, Homo sapiens
ctactttttatactc

SEQ ID NO: 3900695 - DNA, 16 bp, Homo sapiens
ctagaaacagatcttg

SEQ ID NO: 3900696 - DNA, 22 bp, Homo sapiens
ctagaaagaaaagaccctgaga

SEQ ID NO: 3900697 - DNA, 22 bp, Homo sapiens
ctagaaagctctgcatgtgtgt

SEQ ID NO: 3900698 - DNA, 15 bp, Homo sapiens
ctagaaatatgattt

SEQ ID NO: 3900699 - DNA, 17 bp, Homo sapiens
ctagaaatatgatttta

SEQ ID NO: 3900700 - DNA, 14 bp, Homo sapiens
ctagaacacaggca

SEQ ID NO: 3900701 - DNA, 16 bp, Homo sapiens
ctagaacacccactgg

SEQ ID NO: 3900702 - DNA, 19 bp, Homo sapiens
ctagaacacccactggcca

SEQ ID NO: 3900703 - DNA, 22 bp, Homo sapiens
ctagaacatgcacatttatata

SEQ ID NO: 3900704 - DNA, 20 bp, Homo sapiens
ctagaaccaagcttcagagc

SEQ ID NO: 3900705 - DNA, 21 bp, Homo sapiens
ctagaaccaagcttcagagcc

SEQ ID NO: 3900706 - DNA, 18 bp, Homo sapiens
ctagaacctggaagggct

SEQ ID NO: 3900707 - DNA, 20 bp, Homo sapiens
ctattgatgtttccagaaaa

SEQ ID NO: 3900708 - DNA, 16 bp, Homo sapiens
ctattgcatgtaaaat

SEQ ID NO: 3900709 - DNA, 21 bp, Homo sapiens
ctattgcatgtaaaatgcagt

SEQ ID NO: 3900710 - DNA, 22 bp, Homo sapiens
ctattgtcccctagcaaggcat

SEQ ID NO: 3900711 - DNA, 17 bp, Homo sapiens
ctatttaaaaaataaaa

SEQ ID NO: 3900712 - DNA, 22 bp, Homo sapiens
ctatttaactggcttcagcctc

SEQ ID NO: 3900713 - DNA, 15 bp, Homo sapiens
ctatttaatatttat

SEQ ID NO: 3900714 - DNA, 11 bp, Homo sapiens
ctatttatgaa

SEQ ID NO: 3900715 - DNA, 22 bp, Homo sapiens
ctatttattaagttctcaatgt

SEQ ID NO: 3900716 - DNA, 13 bp, Homo sapiens
ctatttcattttt

SEQ ID NO: 3900717 - DNA, 22 bp, Homo sapiens
ctatttctacacagtgggaact

SEQ ID NO: 3900718 - DNA, 12 bp, Homo sapiens
ctatttctacat

SEQ ID NO: 3900719 - DNA, 17 bp, Homo sapiens
ctatttctggcctcagc

SEQ ID NO: 3900720 - DNA, 18 bp, Homo sapiens
ctatttctggcctcagca

SEQ ID NO: 3900721 - DNA, 20 bp, Homo sapiens
ctatttgagcatgcacagct

SEQ ID NO: 3900722 - DNA, 15 bp, Homo sapiens
ctatttgttcagaga

SEQ ID NO: 3900723 - DNA, 18 bp, Homo sapiens
ctatttgtttacatgcag

SEQ ID NO: 3900724 - DNA, 23 bp, Homo sapiens
ctatttgttttcttctgtatgtt

SEQ ID NO: 3900725 - DNA, 21 bp, Homo sapiens
ctattttcttacagtggagtg

SEQ ID NO: 3900726 - DNA, 14 bp, Homo sapiens
ctatttttcaaatt

SEQ ID NO: 3900727 - DNA, 12 bp, Homo sapiens
ctcaaaaagttt

SEQ ID NO: 3900728 - DNA, 13 bp, Homo sapiens
ctcaaaagcactt

SEQ ID NO: 3900729 - DNA, 22 bp, Homo sapiens
ctcaaaagcacttgttccttct

SEQ ID NO: 3900730 - DNA, 23 bp, Homo sapiens
ctcaaaataaggggcacctggga

SEQ ID NO: 3900731 - DNA, 13 bp, Homo sapiens
ctcaaaatatttg

SEQ ID NO: 3900732 - DNA, 14 bp, Homo sapiens
ctcaaaccctgtgg

SEQ ID NO: 3900733 - DNA, 13 bp, Homo sapiens
ctcaaactgggta

SEQ ID NO: 3900734 - DNA, 16 bp, Homo sapiens
ctcaaatctattcaga

SEQ ID NO: 3900735 - DNA, 17 bp, Homo sapiens
ctcaaatgctaaatgca

SEQ ID NO: 3900736 - DNA, 11 bp, Homo sapiens
ctcaaatgctg

SEQ ID NO: 3900737 - DNA, 17 bp, Homo sapiens
ctcaaatgtcagagcta

SEQ ID NO: 3900738 - DNA, 12 bp, Homo sapiens
ctcaacaataaa

SEQ ID NO: 3900739 - DNA, 23 bp, Homo sapiens
ctcaacctaccaccccttcctgt

SEQ ID NO: 3900740 - DNA, 15 bp, Homo sapiens
ctcaactactcagct

SEQ ID NO: 3900741 - DNA, 21 bp, Homo sapiens
ctcaagaagacatggagactc

SEQ ID NO: 3900742 - DNA, 18 bp, Homo sapiens
ctcaagaggcccagggag

SEQ ID NO: 3900743 - DNA, 17 bp, Homo sapiens
ctcaagctagccagagg

SEQ ID NO: 3900744 - DNA, 20 bp, Homo sapiens
ctcaagctcttccttactcc

SEQ ID NO: 3900745 - DNA, 15 bp, Homo sapiens
ctcaagggtccagaa

SEQ ID NO: 3900746 - DNA, 18 bp, Homo sapiens
ctcaagtttttcagaaag

SEQ ID NO: 3900747 - DNA, 19 bp, Homo sapiens
ctcaagtttttcagaaagc

SEQ ID NO: 3900748 - DNA, 14 bp, Homo sapiens
ctcaatcagtgcag

SEQ ID NO: 3900749 - DNA, 18 bp, Homo sapiens
ctcaatgtgaccaggggt

SEQ ID NO: 3900750 - DNA, 18 bp, Homo sapiens
ctcaattgttcttttcct

SEQ ID NO: 3900751 - DNA, 22 bp, Homo sapiens
ctcacaaaccatgcaaatgcta

SEQ ID NO: 3900752 - DNA, 15 bp, Homo sapiens
ctcacaaggcagcaa

SEQ ID NO: 3900753 - DNA, 13 bp, Homo sapiens
ctcacacccagag

SEQ ID NO: 3900754 - DNA, 13 bp, Homo sapiens
ctcacagaagaat

SEQ ID NO: 3900755 - DNA, 15 bp, Homo sapiens
ctcacagcctctccc

SEQ ID NO: 3900756 - DNA, 17 bp, Homo sapiens
ctcacagcctctccctt

SEQ ID NO: 3900757 - DNA, 18 bp, Homo sapiens
ctcacagcctctccctta

SEQ ID NO: 3900758 - DNA, 20 bp, Homo sapiens
ctcacagcctctcccttaat

SEQ ID NO: 3900759 - DNA, 18 bp, Homo sapiens
ctcacaggagcagacaga

SEQ ID NO: 3900760 - DNA, 20 bp, Homo sapiens
ctcacaggagcagacagaga

SEQ ID NO: 3900761 - DNA, 22 bp, Homo sapiens
ctcacaggagcagacagagaaa

SEQ ID NO: 3900762 - DNA, 12 bp, Homo sapiens
ctcacagtgacc

SEQ ID NO: 3900763 - DNA, 19 bp, Homo sapiens
ctcacagtgacccttccca

SEQ ID NO: 3900764 - DNA, 12 bp, Homo sapiens
ctcaccagggtc

SEQ ID NO: 3900765 - DNA, 13 bp, Homo sapiens
ctcaccagggtcc

SEQ ID NO: 3900766 - DNA, 20 bp, Homo sapiens
ctcaccagtgtcccctccac

SEQ ID NO: 3900767 - DNA, 12 bp, Homo sapiens
ctcaccccaagg

SEQ ID NO: 3900768 - DNA, 15 bp, Homo sapiens
ctcaccccaaggggt

SEQ ID NO: 3900769 - DNA, 17 bp, Homo sapiens
ctcacccccaggtgttg

SEQ ID NO: 3900770 - DNA, 20 bp, Homo sapiens
ctcacccccaggtgttgcca

SEQ ID NO: 3900771 - DNA, 21 bp, Homo sapiens
ctcacccgccccactccctcc

SEQ ID NO: 3900772 - DNA, 12 bp, Homo sapiens
ctcacctctgcc

SEQ ID NO: 3900773 - DNA, 13 bp, Homo sapiens
ctcacctctgcct

SEQ ID NO: 3900774 - DNA, 18 bp, Homo sapiens
ctcacctctgcctcaatg

SEQ ID NO: 3900775 - DNA, 21 bp, Homo sapiens
ctcacgcctgtaatcccagca

SEQ ID NO: 3900776 - DNA, 23 bp, Homo sapiens
ctcacgcctgtaatcccagcagt

SEQ ID NO: 3900777 - DNA, 13 bp, Homo sapiens
ctcacgctctgga

SEQ ID NO: 3900778 - DNA, 14 bp, Homo sapiens
ctcactatctctag

SEQ ID NO: 3900779 - DNA, 20 bp, Homo sapiens
ctcactatggtatgctggcc

SEQ ID NO: 3900780 - DNA, 12 bp, Homo sapiens
ctcactcaggac

SEQ ID NO: 3900781 - DNA, 14 bp, Homo sapiens
ctcactcaggactt

SEQ ID NO: 3900782 - DNA, 16 bp, Homo sapiens
ctcactccaccaccca

SEQ ID NO: 3900783 - DNA, 13 bp, Homo sapiens
ctcactcctacct

SEQ ID NO: 3900784 - DNA, 19 bp, Homo sapiens
ctcactcctacctggtaat

SEQ ID NO: 3900785 - DNA, 12 bp, Homo sapiens
ctcactcctgag

SEQ ID NO: 3900786 - DNA, 11 bp, Homo sapiens
ctcactcctgc

SEQ ID NO: 3900787 - DNA, 20 bp, Homo sapiens
ctcactcctgttacttacct

SEQ ID NO: 3900788 - DNA, 11 bp, Homo sapiens
ctcactctgtc

SEQ ID NO: 3900789 - DNA, 12 bp, Homo sapiens
ctcactctgtca

SEQ ID NO: 3900790 - DNA, 18 bp, Homo sapiens
ctcactctgtcagccagc

SEQ ID NO: 3900791 - DNA, 23 bp, Homo sapiens
ctcactgcaacctcttcctcctg

SEQ ID NO: 3900792 - DNA, 16 bp, Homo sapiens
ctcactgctcaagaag

SEQ ID NO: 3900793 - DNA, 20 bp, Homo sapiens
ctcactgctcaagaagacat

SEQ ID NO: 3900794 - DNA, 23 bp, Homo sapiens
ctcataacatctttgaaaagaaa

SEQ ID NO: 3900795 - DNA, 21 bp, Homo sapiens
ctcatacctctgaccaacagg

SEQ ID NO: 3900796 - DNA, 13 bp, Homo sapiens
ctcatatatttaa

SEQ ID NO: 3900797 - DNA, 22 bp, Homo sapiens
ctcatatgcgtcccaagcagcc

SEQ ID NO: 3900798 - DNA, 17 bp, Homo sapiens
ctcatatgtagccctca

SEQ ID NO: 3900799 - DNA, 21 bp, Homo sapiens
ctcatattttgtatatatctg

SEQ ID NO: 3900800 - DNA, 16 bp, Homo sapiens
ctcatcacccagtcct

SEQ ID NO: 3900801 - DNA, 18 bp, Homo sapiens
ctcatcacccagtcctgg

SEQ ID NO: 3900802 - DNA, 20 bp, Homo sapiens
ctcatcacccagtcctggcc

SEQ ID NO: 3900803 - DNA, 14 bp, Homo sapiens
ctcatcatattgta

SEQ ID NO: 3900804 - DNA, 19 bp, Homo sapiens
ctcatccccagtcccaatg

SEQ ID NO: 3900805 - DNA, 22 bp, Homo sapiens
ctcatcccctcgtcctgtccca

SEQ ID NO: 3900806 - DNA, 14 bp, Homo sapiens
ctcatcctccttct

SEQ ID NO: 3900807 - DNA, 15 bp, Homo sapiens
ctcatcctgtgtggg

SEQ ID NO: 3900808 - DNA, 18 bp, Homo sapiens
ctcatctaaaatttttct

SEQ ID NO: 3900809 - DNA, 19 bp, Homo sapiens
ctcatctactcattgtctc

SEQ ID NO: 3900810 - DNA, 14 bp, Homo sapiens
ctcatgccacacct

SEQ ID NO: 3900811 - DNA, 14 bp, Homo sapiens
ctcatgcctggccc

SEQ ID NO: 3900812 - DNA, 22 bp, Homo sapiens
ctcatgcctggcccccctccag

SEQ ID NO: 3900813 - DNA, 19 bp, Homo sapiens
ctcatggcgtaatgggcct

SEQ ID NO: 3900814 - DNA, 21 bp, Homo sapiens
ctcatggcgtaatgggcctgc

SEQ ID NO: 3900815 - DNA, 19 bp, Homo sapiens
ctcatgttgttcccacaca

SEQ ID NO: 3900816 - DNA, 22 bp, Homo sapiens
ctcattcaggaaaactgacaga

SEQ ID NO: 3900817 - DNA, 14 bp, Homo sapiens
ctcattccccaggt

SEQ ID NO: 3900818 - DNA, 12 bp, Homo sapiens
ctcattcctgta

SEQ ID NO: 3900819 - DNA, 23 bp, Homo sapiens
ctcattctgttgcccaggctggc

SEQ ID NO: 3900820 - DNA, 12 bp, Homo sapiens
ctcattgtctca

SEQ ID NO: 3900821 - DNA, 19 bp, Homo sapiens
ctcattgtctcagtgctgg

SEQ ID NO: 3900822 - DNA, 13 bp, Homo sapiens
ctcatttaatcct

SEQ ID NO: 3900823 - DNA, 19 bp, Homo sapiens
ctcatttaatcctcccttc

SEQ ID NO: 3900824 - DNA, 18 bp, Homo sapiens
ctcattttcaatgcacat

SEQ ID NO: 3900825 - DNA, 13 bp, Homo sapiens
ctccaaagaaatg

SEQ ID NO: 3900826 - DNA, 21 bp, Homo sapiens
ctccaaatattattcaagtgc

SEQ ID NO: 3900827 - DNA, 21 bp, Homo sapiens
ctccaacaccacctctccaga

SEQ ID NO: 3900828 - DNA, 20 bp, Homo sapiens
ctccaacccaacctcatcct

SEQ ID NO: 3900829 - DNA, 17 bp, Homo sapiens
ctccaacgttaaaagac

SEQ ID NO: 3900830 - DNA, 18 bp, Homo sapiens
ctccaagatttcagaagc

SEQ ID NO: 3900831 - DNA, 20 bp, Homo sapiens
ctccaagccattcacttccc

SEQ ID NO: 3900832 - DNA, 19 bp, Homo sapiens
ctccaagctccatctccac

SEQ ID NO: 3900833 - DNA, 15 bp, Homo sapiens
ctccaaggaccaggt

SEQ ID NO: 3900834 - DNA, 13 bp, Homo sapiens
ctccaattgtaaa

SEQ ID NO: 3900835 - DNA, 13 bp, Homo sapiens
ctccaccacccaa

SEQ ID NO: 3900836 - DNA, 14 bp, Homo sapiens
ctccaccacccaaa

SEQ ID NO: 3900837 - DNA, 16 bp, Homo sapiens
ctccacccactgtccg

SEQ ID NO: 3900838 - DNA, 15 bp, Homo sapiens
ctccaccccctccag

SEQ ID NO: 3900839 - DNA, 17 bp, Homo sapiens
ctccaccgcagaaggaa

SEQ ID NO: 3900840 - DNA, 14 bp, Homo sapiens
ctccaccgctgcct

SEQ ID NO: 3900841 - DNA, 13 bp, Homo sapiens
ctccacctcagcc

SEQ ID NO: 3900842 - DNA, 16 bp, Homo sapiens
ctccacctcagccttg

SEQ ID NO: 3900843 - DNA, 17 bp, Homo sapiens
ctccacctcagccttgg

SEQ ID NO: 3900844 - DNA, 14 bp, Homo sapiens
ctccacgcctcctg

SEQ ID NO: 3900845 - DNA, 13 bp, Homo sapiens
ctccactccaagg

SEQ ID NO: 3900846 - DNA, 11 bp, Homo sapiens
ctccactgcct

SEQ ID NO: 3900847 - DNA, 14 bp, Homo sapiens
ctccactgccttcg

SEQ ID NO: 3900848 - DNA, 16 bp, Homo sapiens
ctccactgccttcgat

SEQ ID NO: 3900849 - DNA, 9 bp, Homo sapiens
ctccactgt

SEQ ID NO: 3900850 - DNA, 11 bp, Homo sapiens
ctccactgtca

SEQ ID NO: 3900851 - DNA, 13 bp, Homo sapiens
ctccactgtcaca

SEQ ID NO: 3900852 - DNA, 22 bp, Homo sapiens
ctccagaagtggggctctggga

SEQ ID NO: 3900853 - DNA, 18 bp, Homo sapiens
ctccagaataccttcttc

SEQ ID NO: 3900854 - DNA, 16 bp, Homo sapiens
ctccagaatctgctgt

SEQ ID NO: 3900855 - DNA, 18 bp, Homo sapiens
ctccagaatctgctgttg

SEQ ID NO: 3900856 - DNA, 15 bp, Homo sapiens
ctccagacagataca

SEQ ID NO: 3900857 - DNA, 22 bp, Homo sapiens
ctccagacagatacagccccaa

SEQ ID NO: 3900858 - DNA, 14 bp, Homo sapiens
ctccagacccctgg

SEQ ID NO: 3900859 - DNA, 19 bp, Homo sapiens
ctccagacccctggctttt

SEQ ID NO: 3900860 - DNA, 20 bp, Homo sapiens
ctccagacccctggcttttc

SEQ ID NO: 3900861 - DNA, 21 bp, Homo sapiens
ctccagacccctggcttttca

SEQ ID NO: 3900862 - DNA, 18 bp, Homo sapiens
ctccagaccctgcctgag

SEQ ID NO: 3900863 - DNA, 19 bp, Homo sapiens
ctccagagacaggaaagaa

SEQ ID NO: 3900864 - DNA, 11 bp, Homo sapiens
ctccagagcca

SEQ ID NO: 3900865 - DNA, 13 bp, Homo sapiens
ctccagagccagc

SEQ ID NO: 3900866 - DNA, 16 bp, Homo sapiens
ctccagagccagcctg

SEQ ID NO: 3900867 - DNA, 17 bp, Homo sapiens
ctccagagccagcctgg

SEQ ID NO: 3900868 - DNA, 19 bp, Homo sapiens
ctccagagccagcctggga

SEQ ID NO: 3900869 - DNA, 20 bp, Homo sapiens
ctccagagccagcctgggac

SEQ ID NO: 3900870 - DNA, 17 bp, Homo sapiens
ctccagagtctgagccc

SEQ ID NO: 3900871 - DNA, 20 bp, Homo sapiens
ctccagagtctgagcccccg

SEQ ID NO: 3900872 - DNA, 18 bp, Homo sapiens
ctccagatctgcactggg

SEQ ID NO: 3900873 - DNA, 15 bp, Homo sapiens
ctccagcatccagcc

SEQ ID NO: 3900874 - DNA, 18 bp, Homo sapiens
ctccagcatccagcctgt

SEQ ID NO: 3900875 - DNA, 20 bp, Homo sapiens
ctccagcatccagcctgtgt

SEQ ID NO: 3900876 - DNA, 23 bp, Homo sapiens
ctccagccagcaatgatgtccag

SEQ ID NO: 3900877 - DNA, 16 bp, Homo sapiens
ctccagcccacacccc

SEQ ID NO: 3900878 - DNA, 13 bp, Homo sapiens
ctccagccctgtc

SEQ ID NO: 3900879 - DNA, 16 bp, Homo sapiens
ctccagcctctcccgg

SEQ ID NO: 3900880 - DNA, 20 bp, Homo sapiens
ctccagcctctcccggctgc

SEQ ID NO: 3900881 - DNA, 19 bp, Homo sapiens
ctccctaaggaatctgaaa

SEQ ID NO: 3900882 - DNA, 13 bp, Homo sapiens
ctccctcattcca

SEQ ID NO: 3900883 - DNA, 19 bp, Homo sapiens
ctccctcctaacctagaga

SEQ ID NO: 3900884 - DNA, 12 bp, Homo sapiens
ctccctcctgga

SEQ ID NO: 3900885 - DNA, 15 bp, Homo sapiens
ctccctcctggagca

SEQ ID NO: 3900886 - DNA, 18 bp, Homo sapiens
ctccctctggccctgcct

SEQ ID NO: 3900887 - DNA, 20 bp, Homo sapiens
ctccctctggccctgccttc

SEQ ID NO: 3900888 - DNA, 15 bp, Homo sapiens
ctccctcttccttcc

SEQ ID NO: 3900889 - DNA, 19 bp, Homo sapiens
ctccctgaacctcagtttc

SEQ ID NO: 3900890 - DNA, 18 bp, Homo sapiens
ctccctgactccctgtgg

SEQ ID NO: 3900891 - DNA, 20 bp, Homo sapiens
ctccctgactccctgtgggg

SEQ ID NO: 3900892 - DNA, 17 bp, Homo sapiens
ctccctgagctttgggg

SEQ ID NO: 3900893 - DNA, 18 bp, Homo sapiens
ctccctgcccctcccttc

SEQ ID NO: 3900894 - DNA, 22 bp, Homo sapiens
ctccctggagtgcagtttccaa

SEQ ID NO: 3900895 - DNA, 23 bp, Homo sapiens
ctccctggatcagaacaggagct

SEQ ID NO: 3900896 - DNA, 15 bp, Homo sapiens
ctccctggctctcag

SEQ ID NO: 3900897 - DNA, 14 bp, Homo sapiens
ctccctgtcctcct

SEQ ID NO: 3900898 - DNA, 15 bp, Homo sapiens
ctccctgtcctcctc

SEQ ID NO: 3900899 - DNA, 16 bp, Homo sapiens
ctccctgtcctcctcg

SEQ ID NO: 3900900 - DNA, 18 bp, Homo sapiens
ctccctgtcctcctcgga

SEQ ID NO: 3900901 - DNA, 24 bp, Homo sapiens
ctccctgtgggggtggccatccct

SEQ ID NO: 3900902 - DNA, 19 bp, Homo sapiens
ctccctgttatctgctaga

SEQ ID NO: 3900903 - DNA, 23 bp, Homo sapiens
ctcccttaggcattatttaatgt

SEQ ID NO: 3900904 - DNA, 12 bp, Homo sapiens
ctcccttcaacc

SEQ ID NO: 3900905 - DNA, 21 bp, Homo sapiens
ctcccttcaaccattccccat

SEQ ID NO: 3900906 - DNA, 18 bp, Homo sapiens
ctcccttcccctgcctgg

SEQ ID NO: 3900907 - DNA, 15 bp, Homo sapiens
ctcccttcctggcct

SEQ ID NO: 3900908 - DNA, 14 bp, Homo sapiens
ctcccttcttccct

SEQ ID NO: 3900909 - DNA, 21 bp, Homo sapiens
ctcccttgctcagtgcctcct

SEQ ID NO: 3900910 - DNA, 18 bp, Homo sapiens
ctcccttttctttttccc

SEQ ID NO: 3900911 - DNA, 15 bp, Homo sapiens
ctccggggagagcag

SEQ ID NO: 3900912 - DNA, 13 bp, Homo sapiens
ctccggggtctgt

SEQ ID NO: 3900913 - DNA, 21 bp, Homo sapiens
ctccggggtctgtgctgtgcc

SEQ ID NO: 3900914 - DNA, 18 bp, Homo sapiens
ctccgggtgtggcctcag

SEQ ID NO: 3900915 - DNA, 23 bp, Homo sapiens
ctccgggtgtggcctcagccctc

SEQ ID NO: 3900916 - DNA, 20 bp, Homo sapiens
ctccggtaaaacaccggaga

SEQ ID NO: 3900917 - DNA, 19 bp, Homo sapiens
ctccgtccaggagcctggc

SEQ ID NO: 3900918 - DNA, 22 bp, Homo sapiens
ctccgtccaggagcctgtgcct

SEQ ID NO: 3900919 - DNA, 20 bp, Homo sapiens
ctccgtttatgggccttgct

SEQ ID NO: 3900920 - DNA, 20 bp, Homo sapiens
ctcctaaacccccgctccag

SEQ ID NO: 3900921 - DNA, 18 bp, Homo sapiens
ctcctacagcactccacc

SEQ ID NO: 3900922 - DNA, 20 bp, Homo sapiens
ctcctacagcactccacctt

SEQ ID NO: 3900923 - DNA, 15 bp, Homo sapiens
ctcctacctgctgct

SEQ ID NO: 3900924 - DNA, 15 bp, Homo sapiens
ctcctactttacact

SEQ ID NO: 3900925 - DNA, 21 bp, Homo sapiens
ctcctagaggtgggcagctgg

SEQ ID NO: 3900926 - DNA, 22 bp, Homo sapiens
ctcctagaggtgggcagctggg

SEQ ID NO: 3900927 - DNA, 14 bp, Homo sapiens
ctcctagctccacc

SEQ ID NO: 3900928 - DNA, 14 bp, Homo sapiens
ctcctaggagaagc

SEQ ID NO: 3900929 - DNA, 14 bp, Homo sapiens
ctcctatccttgga

SEQ ID NO: 3900930 - DNA, 19 bp, Homo sapiens
ctcctattttaattggaat

SEQ ID NO: 3900931 - DNA, 14 bp, Homo sapiens
ctcctcacccccag

SEQ ID NO: 3900932 - DNA, 17 bp, Homo sapiens
ctcctcacccccagctt

SEQ ID NO: 3900933 - DNA, 11 bp, Homo sapiens
ctcctcagact

SEQ ID NO: 3900934 - DNA, 14 bp, Homo sapiens
ctcctccacagtgc

SEQ ID NO: 3900935 - DNA, 17 bp, Homo sapiens
ctcctccacagtgctgc

SEQ ID NO: 3900936 - DNA, 20 bp, Homo sapiens
ctcctccacagtgctgcttc

SEQ ID NO: 3900937 - DNA, 13 bp, Homo sapiens
ctcctccactcac

SEQ ID NO: 3900938 - DNA, 16 bp, Homo sapiens
ctcctccactccacct

SEQ ID NO: 3900939 - DNA, 14 bp, Homo sapiens
ctcctccagggcca

SEQ ID NO: 3900940 - DNA, 13 bp, Homo sapiens
ctcctcccacaat

SEQ ID NO: 3900941 - DNA, 17 bp, Homo sapiens
ctcctcccaggcgcccc

SEQ ID NO: 3900942 - DNA, 14 bp, Homo sapiens
ctcctcccatggcc

SEQ ID NO: 3900943 - DNA, 15 bp, Homo sapiens
ctcctcccatggcct

SEQ ID NO: 3900944 - DNA, 19 bp, Homo sapiens
ctcctcggccccctccatc

SEQ ID NO: 3900945 - DNA, 12 bp, Homo sapiens
ctcctctccagg

SEQ ID NO: 3900946 - DNA, 21 bp, Homo sapiens
ctcctctccttgggctcctgg

SEQ ID NO: 3900947 - DNA, 22 bp, Homo sapiens
ctcctctccttgggctcctggc

SEQ ID NO: 3900948 - DNA, 17 bp, Homo sapiens
ctcctctgccacctccc

SEQ ID NO: 3900949 - DNA, 14 bp, Homo sapiens
ctcctctgctgctc

SEQ ID NO: 3900950 - DNA, 13 bp, Homo sapiens
ctcctctgcttgc

SEQ ID NO: 3900951 - DNA, 16 bp, Homo sapiens
ctcctctggcccagcc

SEQ ID NO: 3900952 - DNA, 22 bp, Homo sapiens
ctcctctggcccagcctaccct

SEQ ID NO: 3900953 - DNA, 19 bp, Homo sapiens
ctcctcttgccactgcctc

SEQ ID NO: 3900954 - DNA, 19 bp, Homo sapiens
ctcctgaagcctctgccct

SEQ ID NO: 3900955 - DNA, 23 bp, Homo sapiens
ctcctgacccagtccccgtgccc

SEQ ID NO: 3900956 - DNA, 14 bp, Homo sapiens
ctcctgacctgagg

SEQ ID NO: 3900957 - DNA, 18 bp, Homo sapiens
ctcctgagaaggcgagga

SEQ ID NO: 3900958 - DNA, 17 bp, Homo sapiens
ctcctgatggccaagag

SEQ ID NO: 3900959 - DNA, 12 bp, Homo sapiens
ctcctgcccagg

SEQ ID NO: 3900960 - DNA, 13 bp, Homo sapiens
ctcctgcccagga

SEQ ID NO: 3900961 - DNA, 17 bp, Homo sapiens
ctcctgcccaggagagc

SEQ ID NO: 3900962 - DNA, 13 bp, Homo sapiens
ctcctgccctgtt

SEQ ID NO: 3900963 - DNA, 14 bp, Homo sapiens
ctcctgcctactca

SEQ ID NO: 3900964 - DNA, 14 bp, Homo sapiens
ctcctgcctgtagc

SEQ ID NO: 3900965 - DNA, 12 bp, Homo sapiens
ctcctgcctgtg

SEQ ID NO: 3900966 - DNA, 20 bp, Homo sapiens
ctcctggaagctgtgtcctt

SEQ ID NO: 3900967 - DNA, 23 bp, Homo sapiens
ctcctggaagctgtgtccttgca

SEQ ID NO: 3900968 - DNA, 20 bp, Homo sapiens
ctcgggtccgattaatttat

SEQ ID NO: 3900969 - DNA, 14 bp, Homo sapiens
ctcgtaactggttt

SEQ ID NO: 3900970 - DNA, 14 bp, Homo sapiens
ctcgtaccagccag

SEQ ID NO: 3900971 - DNA, 16 bp, Homo sapiens
ctcgtaccagccagga

SEQ ID NO: 3900972 - DNA, 18 bp, Homo sapiens
ctcgtatatgtctcaggt

SEQ ID NO: 3900973 - DNA, 20 bp, Homo sapiens
ctcgtatatgtctcaggtcc

SEQ ID NO: 3900974 - DNA, 22 bp, Homo sapiens
ctcgtccacaggggcaggcctg

SEQ ID NO: 3900975 - DNA, 23 bp, Homo sapiens
ctcgtccacaggggcaggcctgg

SEQ ID NO: 3900976 - DNA, 17 bp, Homo sapiens
ctcgtcctccccctgcc

SEQ ID NO: 3900977 - DNA, 18 bp, Homo sapiens
ctcgtcctccccctgcca

SEQ ID NO: 3900978 - DNA, 17 bp, Homo sapiens
ctcgtcctgtcccagag

SEQ ID NO: 3900979 - DNA, 17 bp, Homo sapiens
ctcgtgccatgatctgt

SEQ ID NO: 3900980 - DNA, 19 bp, Homo sapiens
ctcgtgccatgatctgtat

SEQ ID NO: 3900981 - DNA, 17 bp, Homo sapiens
ctcgtggacacctgccc

SEQ ID NO: 3900982 - DNA, 14 bp, Homo sapiens
ctcgtgtgatttcc

SEQ ID NO: 3900983 - DNA, 19 bp, Homo sapiens
ctctaaacccaaataaatg

SEQ ID NO: 3900984 - DNA, 15 bp, Homo sapiens
ctctaacgcctgagc

SEQ ID NO: 3900985 - DNA, 18 bp, Homo sapiens
ctctaacgcctgagccca

SEQ ID NO: 3900986 - DNA, 21 bp, Homo sapiens
ctctaacgcctgagcccaggg

SEQ ID NO: 3900987 - DNA, 21 bp, Homo sapiens
ctctaagccacagcttcttca

SEQ ID NO: 3900988 - DNA, 17 bp, Homo sapiens
ctctaattggaagaaat

SEQ ID NO: 3900989 - DNA, 16 bp, Homo sapiens
ctctacaaactcccac

SEQ ID NO: 3900990 - DNA, 21 bp, Homo sapiens
ctctacagctaatcagcattc

SEQ ID NO: 3900991 - DNA, 21 bp, Homo sapiens
ctctacccggcccagagaccc

SEQ ID NO: 3900992 - DNA, 16 bp, Homo sapiens
ctctactgggaaggct

SEQ ID NO: 3900993 - DNA, 19 bp, Homo sapiens
ctctactgggaaggctact

SEQ ID NO: 3900994 - DNA, 16 bp, Homo sapiens
ctctacttagcatgtc

SEQ ID NO: 3900995 - DNA, 17 bp, Homo sapiens
ctctacttagcatgtcc

SEQ ID NO: 3900996 - DNA, 20 bp, Homo sapiens
ctctacttagcatgtcccta

SEQ ID NO: 3900997 - DNA, 21 bp, Homo sapiens
ctctagaacacccactggcca

SEQ ID NO: 3900998 - DNA, 22 bp, Homo sapiens
ctctagaacacccactggccag

SEQ ID NO: 3900999 - DNA, 16 bp, Homo sapiens
ctctagacactgccac

SEQ ID NO: 3901000 - DNA, 13 bp, Homo sapiens
ctctagagaacat

SEQ ID NO: 3901001 - DNA, 21 bp, Homo sapiens
ctctagccaggagtctgtgct

SEQ ID NO: 3901002 - DNA, 22 bp, Homo sapiens
ctctagccaggagtctgtgctc

SEQ ID NO: 3901003 - DNA, 15 bp, Homo sapiens
ctctagcctgggcca

SEQ ID NO: 3901004 - DNA, 13 bp, Homo sapiens
ctctagctggcag

SEQ ID NO: 3901005 - DNA, 16 bp, Homo sapiens
ctctagctggcaggac

SEQ ID NO: 3901006 - DNA, 20 bp, Homo sapiens
ctctagtcttgctttgctgt

SEQ ID NO: 3901007 - DNA, 19 bp, Homo sapiens
ctctagtttctttctgtta

SEQ ID NO: 3901008 - DNA, 21 bp, Homo sapiens
ctctagtttctttctgttatt

SEQ ID NO: 3901009 - DNA, 21 bp, Homo sapiens
ctctagttttcagccttggga

SEQ ID NO: 3901010 - DNA, 19 bp, Homo sapiens
ctctatgccccaaatatag

SEQ ID NO: 3901011 - DNA, 13 bp, Homo sapiens
ctctatttaatat

SEQ ID NO: 3901012 - DNA, 10 bp, Homo sapiens
ctctcaatat

SEQ ID NO: 3901013 - DNA, 15 bp, Homo sapiens
ctctcaatatgctta

SEQ ID NO: 3901014 - DNA, 16 bp, Homo sapiens
ctctcaatatgcttac

SEQ ID NO: 3901015 - DNA, 18 bp, Homo sapiens
ctctcaatattcaataaa

SEQ ID NO: 3901016 - DNA, 21 bp, Homo sapiens
ctctcactaaactttacccaa

SEQ ID NO: 3901017 - DNA, 17 bp, Homo sapiens
ctctcagaattcttcag

SEQ ID NO: 3901018 - DNA, 19 bp, Homo sapiens
ctctcaggagcacaggcag

SEQ ID NO: 3901019 - DNA, 21 bp, Homo sapiens
ctctcaggagcacaggcagct

SEQ ID NO: 3901020 - DNA, 20 bp, Homo sapiens
ctctcaggaggcgcagcccg

SEQ ID NO: 3901021 - DNA, 18 bp, Homo sapiens
ctctcatcgccagacaac

SEQ ID NO: 3901022 - DNA, 16 bp, Homo sapiens
ctctcattccccaggt

SEQ ID NO: 3901023 - DNA, 16 bp, Homo sapiens
ctctcattctctttct

SEQ ID NO: 3901024 - DNA, 19 bp, Homo sapiens
ctctccaaaggggctgctg

SEQ ID NO: 3901025 - DNA, 14 bp, Homo sapiens
ctctccaacctgga

SEQ ID NO: 3901026 - DNA, 15 bp, Homo sapiens
ctctccaattgtaaa

SEQ ID NO: 3901027 - DNA, 12 bp, Homo sapiens
ctctccacctca

SEQ ID NO: 3901028 - DNA, 14 bp, Homo sapiens
ctctccacctcagc

SEQ ID NO: 3901029 - DNA, 23 bp, Homo sapiens
ctctccacggtagcacttgacct

SEQ ID NO: 3901030 - DNA, 13 bp, Homo sapiens
ctctccactccat

SEQ ID NO: 3901031 - DNA, 15 bp, Homo sapiens
ctctccactgccttc

SEQ ID NO: 3901032 - DNA, 16 bp, Homo sapiens
ctctccactgccttcg

SEQ ID NO: 3901033 - DNA, 13 bp, Homo sapiens
ctctccaggcacc

SEQ ID NO: 3901034 - DNA, 18 bp, Homo sapiens
ctctccaggcacccttct

SEQ ID NO: 3901035 - DNA, 15 bp, Homo sapiens
ctctccatatctcct

SEQ ID NO: 3901036 - DNA, 15 bp, Homo sapiens
ctctccatgcccaac

SEQ ID NO: 3901037 - DNA, 13 bp, Homo sapiens
ctctcccaccccg

SEQ ID NO: 3901038 - DNA, 15 bp, Homo sapiens
ctctcccaccccggc

SEQ ID NO: 3901039 - DNA, 12 bp, Homo sapiens
ctctcccaggcc

SEQ ID NO: 3901040 - DNA, 14 bp, Homo sapiens
ctctcccaggcccc

SEQ ID NO: 3901041 - DNA, 16 bp, Homo sapiens
ctctcccaggccccat

SEQ ID NO: 3901042 - DNA, 19 bp, Homo sapiens
ctctcccaggccccatgac

SEQ ID NO: 3901043 - DNA, 18 bp, Homo sapiens
ctctcccataccatcact

SEQ ID NO: 3901044 - DNA, 19 bp, Homo sapiens
ctctcccataccatcactg

SEQ ID NO: 3901045 - DNA, 22 bp, Homo sapiens
ctctcccccgcccaaggctgca

SEQ ID NO: 3901046 - DNA, 14 bp, Homo sapiens
ctctccccctttca

SEQ ID NO: 3901047 - DNA, 18 bp, Homo sapiens
ctctcccctcatggagaa

SEQ ID NO: 3901048 - DNA, 22 bp, Homo sapiens
ctctcccctccctcttccttcc

SEQ ID NO: 3901049 - DNA, 15 bp, Homo sapiens
ctctcccctctgccc

SEQ ID NO: 3901050 - DNA, 19 bp, Homo sapiens
ctctcccctctgccctgta

SEQ ID NO: 3901051 - DNA, 15 bp, Homo sapiens
ctctcccctgccctg

SEQ ID NO: 3901052 - DNA, 16 bp, Homo sapiens
ctctcccctgccctgc

SEQ ID NO: 3901053 - DNA, 17 bp, Homo sapiens
ctctcccctgccctgct

SEQ ID NO: 3901054 - DNA, 18 bp, Homo sapiens
ctctcccggctgcctgcc

SEQ ID NO: 3901055 - DNA, 21 bp, Homo sapiens
ctctggaagagaggaatgcct

SEQ ID NO: 3901056 - DNA, 16 bp, Homo sapiens
ctctggaagcccccca

SEQ ID NO: 3901057 - DNA, 16 bp, Homo sapiens
ctctggaagcctggac

SEQ ID NO: 3901058 - DNA, 14 bp, Homo sapiens
ctctggagccagag

SEQ ID NO: 3901059 - DNA, 17 bp, Homo sapiens
ctctggatccctggagg

SEQ ID NO: 3901060 - DNA, 17 bp, Homo sapiens
ctctggatcctgctgtg

SEQ ID NO: 3901061 - DNA, 15 bp, Homo sapiens
ctctggatggcacca

SEQ ID NO: 3901062 - DNA, 11 bp, Homo sapiens
ctctggccacc

SEQ ID NO: 3901063 - DNA, 16 bp, Homo sapiens
ctctggccaccctggc

SEQ ID NO: 3901064 - DNA, 18 bp, Homo sapiens
ctctggccaccctggccc

SEQ ID NO: 3901065 - DNA, 22 bp, Homo sapiens
ctctggccaccctggcccgccc

SEQ ID NO: 3901066 - DNA, 14 bp, Homo sapiens
ctctggccaggcat

SEQ ID NO: 3901067 - DNA, 18 bp, Homo sapiens
ctctggccctgccttctt

SEQ ID NO: 3901068 - DNA, 15 bp, Homo sapiens
ctctggccttttcct

SEQ ID NO: 3901069 - DNA, 22 bp, Homo sapiens
ctctggcggcttcctgtccact

SEQ ID NO: 3901070 - DNA, 12 bp, Homo sapiens
ctctggcttcca

SEQ ID NO: 3901071 - DNA, 13 bp, Homo sapiens
ctctggcttccag

SEQ ID NO: 3901072 - DNA, 18 bp, Homo sapiens
ctctggcttccaggtatc

SEQ ID NO: 3901073 - DNA, 14 bp, Homo sapiens
ctctgggaaggggt

SEQ ID NO: 3901074 - DNA, 24 bp, Homo sapiens
ctctgggaaggggtgccctctgga

SEQ ID NO: 3901075 - DNA, 12 bp, Homo sapiens
ctctgggcagct

SEQ ID NO: 3901076 - DNA, 17 bp, Homo sapiens
ctctgggccaagactcc

SEQ ID NO: 3901077 - DNA, 14 bp, Homo sapiens
ctctgggctcaggg

SEQ ID NO: 3901078 - DNA, 16 bp, Homo sapiens
ctctgggctcagggct

SEQ ID NO: 3901079 - DNA, 20 bp, Homo sapiens
ctctgggctcagggctggag

SEQ ID NO: 3901080 - DNA, 15 bp, Homo sapiens
ctctggggccctggg

SEQ ID NO: 3901081 - DNA, 21 bp, Homo sapiens
ctctggggccctgggcctcag

SEQ ID NO: 3901082 - DNA, 22 bp, Homo sapiens
ctctggggccctgggcctcagt

SEQ ID NO: 3901083 - DNA, 13 bp, Homo sapiens
ctctgtataaaca

SEQ ID NO: 3901084 - DNA, 18 bp, Homo sapiens
ctctgtataaacattaaa

SEQ ID NO: 3901085 - DNA, 15 bp, Homo sapiens
ctctgtcaatgaaaa

SEQ ID NO: 3901086 - DNA, 23 bp, Homo sapiens
ctctgtcagatgggaagacatga

SEQ ID NO: 3901087 - DNA, 16 bp, Homo sapiens
ctctgtccaggccact

SEQ ID NO: 3901088 - DNA, 22 bp, Homo sapiens
ctctgtccaggccactgtggcc

SEQ ID NO: 3901089 - DNA, 13 bp, Homo sapiens
ctctgtctcgagc

SEQ ID NO: 3901090 - DNA, 19 bp, Homo sapiens
ctctgtgccagagcctggg

SEQ ID NO: 3901091 - DNA, 18 bp, Homo sapiens
ctctgtgctttgactcac

SEQ ID NO: 3901092 - DNA, 19 bp, Homo sapiens
ctctgtggcctgtgtccag

SEQ ID NO: 3901093 - DNA, 13 bp, Homo sapiens
ctcttaatgttgc

SEQ ID NO: 3901094 - DNA, 18 bp, Homo sapiens
ctcttaccgtagcctccg

SEQ ID NO: 3901095 - DNA, 21 bp, Homo sapiens
ctcttaggtctaatgatattt

SEQ ID NO: 3901096 - DNA, 20 bp, Homo sapiens
ctcttagtgattgtgtctgc

SEQ ID NO: 3901097 - DNA, 15 bp, Homo sapiens
ctcttagtgcccgcc

SEQ ID NO: 3901098 - DNA, 17 bp, Homo sapiens
ctcttcaactgaccagc

SEQ ID NO: 3901099 - DNA, 18 bp, Homo sapiens
ctcttcaccccccactca

SEQ ID NO: 3901100 - DNA, 23 bp, Homo sapiens
ctcttcagaatatggacaaagaa

SEQ ID NO: 3901101 - DNA, 13 bp, Homo sapiens
ctcttcaggaggc

SEQ ID NO: 3901102 - DNA, 19 bp, Homo sapiens
ctcttcaggaggccctggt

SEQ ID NO: 3901103 - DNA, 13 bp, Homo sapiens
ctcttcatacttt

SEQ ID NO: 3901104 - DNA, 19 bp, Homo sapiens
ctcttcatactttttttca

SEQ ID NO: 3901105 - DNA, 15 bp, Homo sapiens
ctcttccccttgccc

SEQ ID NO: 3901106 - DNA, 18 bp, Homo sapiens
ctcttccccttgcccttg

SEQ ID NO: 3901107 - DNA, 19 bp, Homo sapiens
ctcttccccttgcccttgc

SEQ ID NO: 3901108 - DNA, 15 bp, Homo sapiens
ctcttccctcagttt

SEQ ID NO: 3901109 - DNA, 12 bp, Homo sapiens
ctcttccctcct

SEQ ID NO: 3901110 - DNA, 15 bp, Homo sapiens
ctcttccctccttcc

SEQ ID NO: 3901111 - DNA, 22 bp, Homo sapiens
ctcttcctacccaaccactcaa

SEQ ID NO: 3901112 - DNA, 23 bp, Homo sapiens
ctcttcctcctggttcaagcgat

SEQ ID NO: 3901113 - DNA, 13 bp, Homo sapiens
ctcttcctctgtt

SEQ ID NO: 3901114 - DNA, 15 bp, Homo sapiens
ctcttcctctgttct

SEQ ID NO: 3901115 - DNA, 19 bp, Homo sapiens
ctcttcctggacctgagtc

SEQ ID NO: 3901116 - DNA, 10 bp, Homo sapiens
ctcttcctgt

SEQ ID NO: 3901117 - DNA, 20 bp, Homo sapiens
ctcttccttcccccatcccc

SEQ ID NO: 3901118 - DNA, 23 bp, Homo sapiens
ctcttccttccgctcctttacct

SEQ ID NO: 3901119 - DNA, 19 bp, Homo sapiens
ctcttctatttaaaaaata

SEQ ID NO: 3901120 - DNA, 14 bp, Homo sapiens
ctcttctccactgg

SEQ ID NO: 3901121 - DNA, 17 bp, Homo sapiens
ctcttctccactggatg

SEQ ID NO: 3901122 - DNA, 21 bp, Homo sapiens
ctcttctctattcctgaccct

SEQ ID NO: 3901123 - DNA, 22 bp, Homo sapiens
ctcttcttattcatgctttctc

SEQ ID NO: 3901124 - DNA, 17 bp, Homo sapiens
ctcttcttcttcagaag

SEQ ID NO: 3901125 - DNA, 14 bp, Homo sapiens
ctcttctttctgag

SEQ ID NO: 3901126 - DNA, 16 bp, Homo sapiens
ctcttctttctgagag

SEQ ID NO: 3901127 - DNA, 18 bp, Homo sapiens
ctcttgccactgcctctt

SEQ ID NO: 3901128 - DNA, 22 bp, Homo sapiens
ctcttgccactgcctcttcctc

SEQ ID NO: 3901129 - DNA, 12 bp, Homo sapiens
ctcttgcctgta

SEQ ID NO: 3901130 - DNA, 20 bp, Homo sapiens
ctcttgctcaaaaatctgtt

SEQ ID NO: 3901131 - DNA, 12 bp, Homo sapiens
ctcttggacctc

SEQ ID NO: 3901132 - DNA, 16 bp, Homo sapiens
ctcttgttttcagttt

SEQ ID NO: 3901133 - DNA, 19 bp, Homo sapiens
ctctttatttctagcagag

SEQ ID NO: 3901134 - DNA, 20 bp, Homo sapiens
ctctttatttctagcagagt

SEQ ID NO: 3901135 - DNA, 17 bp, Homo sapiens
ctctttcagagaggtct

SEQ ID NO: 3901136 - DNA, 22 bp, Homo sapiens
ctctttcagagaggtctcaggt

SEQ ID NO: 3901137 - DNA, 14 bp, Homo sapiens
ctctttccccacct

SEQ ID NO: 3901138 - DNA, 20 bp, Homo sapiens
ctctttccccacctcttcct

SEQ ID NO: 3901139 - DNA, 16 bp, Homo sapiens
ctctttctctccttct

SEQ ID NO: 3901140 - DNA, 14 bp, Homo sapiens
ctctttcttctttg

SEQ ID NO: 3901141 - DNA, 20 bp, Homo sapiens
ctctttctttttctgtctct

SEQ ID NO: 3901142 - DNA, 22 bp, Homo sapiens
ctgacatctcctctatcacatt

SEQ ID NO: 3901143 - DNA, 13 bp, Homo sapiens
ctgacatgtctca

SEQ ID NO: 3901144 - DNA, 19 bp, Homo sapiens
ctgacatttctaacatatg

SEQ ID NO: 3901145 - DNA, 12 bp, Homo sapiens
ctgaccaacagg

SEQ ID NO: 3901146 - DNA, 13 bp, Homo sapiens
ctgaccaacaggc

SEQ ID NO: 3901147 - DNA, 19 bp, Homo sapiens
ctgaccaacagttccttca

SEQ ID NO: 3901148 - DNA, 14 bp, Homo sapiens
ctgaccaagagaga

SEQ ID NO: 3901149 - DNA, 17 bp, Homo sapiens
ctgaccagcctccatgc

SEQ ID NO: 3901150 - DNA, 21 bp, Homo sapiens
ctgaccagcctccatgctgcc

SEQ ID NO: 3901151 - DNA, 12 bp, Homo sapiens
ctgacccagtcc

SEQ ID NO: 3901152 - DNA, 16 bp, Homo sapiens
ctgacccagtccctgg

SEQ ID NO: 3901153 - DNA, 20 bp, Homo sapiens
ctgaccccaaagagcctgga

SEQ ID NO: 3901154 - DNA, 23 bp, Homo sapiens
ctgaccccaaagagcctggagaa

SEQ ID NO: 3901155 - DNA, 18 bp, Homo sapiens
ctgaccccatcacctact

SEQ ID NO: 3901156 - DNA, 15 bp, Homo sapiens
ctgaccccctcccct

SEQ ID NO: 3901157 - DNA, 16 bp, Homo sapiens
ctgaccccctcccctg

SEQ ID NO: 3901158 - DNA, 18 bp, Homo sapiens
ctgaccctccctacctga

SEQ ID NO: 3901159 - DNA, 14 bp, Homo sapiens
ctgacccttccaga

SEQ ID NO: 3901160 - DNA, 16 bp, Homo sapiens
ctgacccttccagaca

SEQ ID NO: 3901161 - DNA, 12 bp, Homo sapiens
ctgacctcccag

SEQ ID NO: 3901162 - DNA, 13 bp, Homo sapiens
ctgacctcccagc

SEQ ID NO: 3901163 - DNA, 19 bp, Homo sapiens
ctgaccttggagagacaca

SEQ ID NO: 3901164 - DNA, 18 bp, Homo sapiens
ctgacctttgtcatcttt

SEQ ID NO: 3901165 - DNA, 21 bp, Homo sapiens
ctgacggaagccaacttggct

SEQ ID NO: 3901166 - DNA, 13 bp, Homo sapiens
ctgactcacaaga

SEQ ID NO: 3901167 - DNA, 14 bp, Homo sapiens
ctgactcagtccag

SEQ ID NO: 3901168 - DNA, 12 bp, Homo sapiens
ctgactccagag

SEQ ID NO: 3901169 - DNA, 21 bp, Homo sapiens
ctgactccagagtctgagccc

SEQ ID NO: 3901170 - DNA, 19 bp, Homo sapiens
ctgactccatatggaggcc

SEQ ID NO: 3901171 - DNA, 20 bp, Homo sapiens
ctgactccatatggaggcct

SEQ ID NO: 3901172 - DNA, 15 bp, Homo sapiens
ctgactccctgtggg

SEQ ID NO: 3901173 - DNA, 17 bp, Homo sapiens
ctgactccctgtggggg

SEQ ID NO: 3901174 - DNA, 19 bp, Homo sapiens
ctgactgatgttgagggaa

SEQ ID NO: 3901175 - DNA, 18 bp, Homo sapiens
ctgactgggaccaggcac

SEQ ID NO: 3901176 - DNA, 17 bp, Homo sapiens
ctgactgtactcctccc

SEQ ID NO: 3901177 - DNA, 13 bp, Homo sapiens
ctgacttctccca

SEQ ID NO: 3901178 - DNA, 15 bp, Homo sapiens
ctgactttgctcttt

SEQ ID NO: 3901179 - DNA, 18 bp, Homo sapiens
ctgactttgctctttctt

SEQ ID NO: 3901180 - DNA, 23 bp, Homo sapiens
ctgagaaagactattcaaacagt

SEQ ID NO: 3901181 - DNA, 17 bp, Homo sapiens
ctgagaacctggccttc

SEQ ID NO: 3901182 - DNA, 20 bp, Homo sapiens
ctgagaacctggccttcagt

SEQ ID NO: 3901183 - DNA, 11 bp, Homo sapiens
ctgagaagaag

SEQ ID NO: 3901184 - DNA, 17 bp, Homo sapiens
ctgagaagaagctgagg

SEQ ID NO: 3901185 - DNA, 19 bp, Homo sapiens
ctgagaagaagctgaggat

SEQ ID NO: 3901186 - DNA, 18 bp, Homo sapiens
ctgagaaggcgaggagag

SEQ ID NO: 3901187 - DNA, 22 bp, Homo sapiens
ctgagaccatttaacatgcaac

SEQ ID NO: 3901188 - DNA, 12 bp, Homo sapiens
ctgagactccag

SEQ ID NO: 3901189 - DNA, 13 bp, Homo sapiens
ctgagactccaga

SEQ ID NO: 3901190 - DNA, 15 bp, Homo sapiens
ctgagagacccaagg

SEQ ID NO: 3901191 - DNA, 13 bp, Homo sapiens
ctgagagactttt

SEQ ID NO: 3901192 - DNA, 16 bp, Homo sapiens
ctgagagccctgctgt

SEQ ID NO: 3901193 - DNA, 13 bp, Homo sapiens
ctgagaggccctg

SEQ ID NO: 3901194 - DNA, 19 bp, Homo sapiens
ctgagagtctgaaagacag

SEQ ID NO: 3901195 - DNA, 20 bp, Homo sapiens
ctgagagtctgaaagacaga

SEQ ID NO: 3901196 - DNA, 22 bp, Homo sapiens
ctgagagtctgaaagacagaat

SEQ ID NO: 3901197 - DNA, 18 bp, Homo sapiens
ctgagagttggctcaggc

SEQ ID NO: 3901198 - DNA, 19 bp, Homo sapiens
ctgagagttggctcaggca

SEQ ID NO: 3901199 - DNA, 21 bp, Homo sapiens
ctgagagttggctcaggcaga

SEQ ID NO: 3901200 - DNA, 22 bp, Homo sapiens
ctgagagttggctcaggcagac

SEQ ID NO: 3901201 - DNA, 14 bp, Homo sapiens
ctgagatcgtgccg

SEQ ID NO: 3901202 - DNA, 19 bp, Homo sapiens
ctgagatctccctccaggg

SEQ ID NO: 3901203 - DNA, 20 bp, Homo sapiens
ctgagatgtgaacacatcag

SEQ ID NO: 3901204 - DNA, 20 bp, Homo sapiens
ctgagcaaatgtggctcctg

SEQ ID NO: 3901205 - DNA, 15 bp, Homo sapiens
ctgagcaagagctgg

SEQ ID NO: 3901206 - DNA, 14 bp, Homo sapiens
ctgagcaccccctc

SEQ ID NO: 3901207 - DNA, 15 bp, Homo sapiens
ctgagcactgccagg

SEQ ID NO: 3901208 - DNA, 17 bp, Homo sapiens
ctgagcactgccaggag

SEQ ID NO: 3901209 - DNA, 19 bp, Homo sapiens
ctgagcactgccaggaggg

SEQ ID NO: 3901210 - DNA, 16 bp, Homo sapiens
ctgagcaggattttaa

SEQ ID NO: 3901211 - DNA, 12 bp, Homo sapiens
ctgagcagggcc

SEQ ID NO: 3901212 - DNA, 21 bp, Homo sapiens
ctgagccaaacacactgtaaa

SEQ ID NO: 3901213 - DNA, 18 bp, Homo sapiens
ctgagccacagccgtgct

SEQ ID NO: 3901214 - DNA, 12 bp, Homo sapiens
ctgagcccaggg

SEQ ID NO: 3901215 - DNA, 14 bp, Homo sapiens
ctgagcccagggag

SEQ ID NO: 3901216 - DNA, 22 bp, Homo sapiens
ctgagcccagggaggccgaagc

SEQ ID NO: 3901217 - DNA, 16 bp, Homo sapiens
ctgagcccccggctag

SEQ ID NO: 3901218 - DNA, 13 bp, Homo sapiens
ctgagccctggtg

SEQ ID NO: 3901219 - DNA, 19 bp, Homo sapiens
ctgagcctaaatctaatca

SEQ ID NO: 3901220 - DNA, 15 bp, Homo sapiens
ctgagcctgccgagc

SEQ ID NO: 3901221 - DNA, 19 bp, Homo sapiens
ctgagcctggcccatagaa

SEQ ID NO: 3901222 - DNA, 22 bp, Homo sapiens
ctgagcctggcccatagaaaca

SEQ ID NO: 3901223 - DNA, 13 bp, Homo sapiens
ctgagctcaagtg

SEQ ID NO: 3901224 - DNA, 22 bp, Homo sapiens
ctgagctcacaaggcagcaagg

SEQ ID NO: 3901225 - DNA, 23 bp, Homo sapiens
ctgagctcacaaggcagcaaggc

SEQ ID NO: 3901226 - DNA, 13 bp, Homo sapiens
ctgagctctgaga

SEQ ID NO: 3901227 - DNA, 15 bp, Homo sapiens
ctgagctctgagagg

SEQ ID NO: 3901228 - DNA, 18 bp, Homo sapiens
ctgagctctgagaggccc

SEQ ID NO: 3901229 - DNA, 22 bp, Homo sapiens
ctgatgttcctttggaagaaaa

SEQ ID NO: 3901230 - DNA, 22 bp, Homo sapiens
ctgatgttgagggaacagacag

SEQ ID NO: 3901231 - DNA, 21 bp, Homo sapiens
ctgattatcctataggcagac

SEQ ID NO: 3901232 - DNA, 23 bp, Homo sapiens
ctgattcagcctggccatcccca

SEQ ID NO: 3901233 - DNA, 18 bp, Homo sapiens
ctgattctcctgtcagag

SEQ ID NO: 3901234 - DNA, 13 bp, Homo sapiens
ctgattctgggat

SEQ ID NO: 3901235 - DNA, 16 bp, Homo sapiens
ctgattctgggatgct

SEQ ID NO: 3901236 - DNA, 12 bp, Homo sapiens
ctgatttaatgt

SEQ ID NO: 3901237 - DNA, 18 bp, Homo sapiens
ctgatttaatgttttctg

SEQ ID NO: 3901238 - DNA, 17 bp, Homo sapiens
ctgatttccaggcccct

SEQ ID NO: 3901239 - DNA, 22 bp, Homo sapiens
ctgatttccaggcccctgagga

SEQ ID NO: 3901240 - DNA, 14 bp, Homo sapiens
ctgcaaaagtggaa

SEQ ID NO: 3901241 - DNA, 20 bp, Homo sapiens
ctgcaaactcactgctcaag

SEQ ID NO: 3901242 - DNA, 21 bp, Homo sapiens
ctgcaacctccacctcctgag

SEQ ID NO: 3901243 - DNA, 18 bp, Homo sapiens
ctgcaacctcttcctcct

SEQ ID NO: 3901244 - DNA, 18 bp, Homo sapiens
ctgcaactagccaaggct

SEQ ID NO: 3901245 - DNA, 21 bp, Homo sapiens
ctgcaactagccaaggctagt

SEQ ID NO: 3901246 - DNA, 15 bp, Homo sapiens
ctgcaagaggctcct

SEQ ID NO: 3901247 - DNA, 16 bp, Homo sapiens
ctgcaagaggctcctg

SEQ ID NO: 3901248 - DNA, 19 bp, Homo sapiens
ctgcaagcagggctctgcc

SEQ ID NO: 3901249 - DNA, 22 bp, Homo sapiens
ctgcaagccccagggcctgggg

SEQ ID NO: 3901250 - DNA, 17 bp, Homo sapiens
ctgcaatgggcactggg

SEQ ID NO: 3901251 - DNA, 20 bp, Homo sapiens
ctgcaattgcttaggatgtt

SEQ ID NO: 3901252 - DNA, 14 bp, Homo sapiens
ctgcacacacagct

SEQ ID NO: 3901253 - DNA, 17 bp, Homo sapiens
ctgcacacacagctcct

SEQ ID NO: 3901254 - DNA, 12 bp, Homo sapiens
ctgcacattcct

SEQ ID NO: 3901255 - DNA, 15 bp, Homo sapiens
ctgcacattcctggc

SEQ ID NO: 3901256 - DNA, 21 bp, Homo sapiens
ctgcacattcctggccccggg

SEQ ID NO: 3901257 - DNA, 20 bp, Homo sapiens
ctgcaccagcccttccctgc

SEQ ID NO: 3901258 - DNA, 11 bp, Homo sapiens
ctgcacccagg

SEQ ID NO: 3901259 - DNA, 15 bp, Homo sapiens
ctgcaccctggaaag

SEQ ID NO: 3901260 - DNA, 14 bp, Homo sapiens
ctgcacctcccccc

SEQ ID NO: 3901261 - DNA, 21 bp, Homo sapiens
ctgcacctccccccactgcag

SEQ ID NO: 3901262 - DNA, 12 bp, Homo sapiens
ctgcactccatg

SEQ ID NO: 3901263 - DNA, 22 bp, Homo sapiens
ctgcactccatggccaccccgt

SEQ ID NO: 3901264 - DNA, 11 bp, Homo sapiens
ctgcactgaaa

SEQ ID NO: 3901265 - DNA, 20 bp, Homo sapiens
ctgcactgacccacagcctc

SEQ ID NO: 3901266 - DNA, 13 bp, Homo sapiens
ctgcactgcagtg

SEQ ID NO: 3901267 - DNA, 12 bp, Homo sapiens
ctgcactgtcaa

SEQ ID NO: 3901268 - DNA, 21 bp, Homo sapiens
ctgcagaacgtattggtccag

SEQ ID NO: 3901269 - DNA, 13 bp, Homo sapiens
ctgcagaaggcca

SEQ ID NO: 3901270 - DNA, 14 bp, Homo sapiens
ctgcagaccctgcc

SEQ ID NO: 3901271 - DNA, 17 bp, Homo sapiens
ctgcagaccctgccctt

SEQ ID NO: 3901272 - DNA, 15 bp, Homo sapiens
ctgcagagctatggt

SEQ ID NO: 3901273 - DNA, 16 bp, Homo sapiens
ctgcagagctgaccca

SEQ ID NO: 3901274 - DNA, 17 bp, Homo sapiens
ctgcagagctgacccag

SEQ ID NO: 3901275 - DNA, 14 bp, Homo sapiens
ctgcagaggaccac

SEQ ID NO: 3901276 - DNA, 16 bp, Homo sapiens
ctgcagaggaccacag

SEQ ID NO: 3901277 - DNA, 12 bp, Homo sapiens
ctgcagaggacg

SEQ ID NO: 3901278 - DNA, 19 bp, Homo sapiens
ctgcagatagccagacaca

SEQ ID NO: 3901279 - DNA, 14 bp, Homo sapiens
ctgcagcaactccc

SEQ ID NO: 3901280 - DNA, 15 bp, Homo sapiens
ctgcagcaactccca

SEQ ID NO: 3901281 - DNA, 18 bp, Homo sapiens
ctgcagcaactcccacga

SEQ ID NO: 3901282 - DNA, 12 bp, Homo sapiens
ctgcagcacttt

SEQ ID NO: 3901283 - DNA, 19 bp, Homo sapiens
ctgcagcactttaaccctc

SEQ ID NO: 3901284 - DNA, 12 bp, Homo sapiens
ctgcagccagcc

SEQ ID NO: 3901285 - DNA, 15 bp, Homo sapiens
ctgcagccagcccag

SEQ ID NO: 3901286 - DNA, 16 bp, Homo sapiens
ctgcagccagcccagc

SEQ ID NO: 3901287 - DNA, 18 bp, Homo sapiens
ctgcagccagcccagccc

SEQ ID NO: 3901288 - DNA, 22 bp, Homo sapiens
ctgcagccagcccagcccagct

SEQ ID NO: 3901289 - DNA, 18 bp, Homo sapiens
ctgcagcctccttctcct

SEQ ID NO: 3901290 - DNA, 15 bp, Homo sapiens
ctgcagctgctgaag

SEQ ID NO: 3901291 - DNA, 12 bp, Homo sapiens
ctgcagctgggc

SEQ ID NO: 3901292 - DNA, 14 bp, Homo sapiens
ctgcagctgggccc

SEQ ID NO: 3901293 - DNA, 15 bp, Homo sapiens
ctgcagctgggcccc

SEQ ID NO: 3901294 - DNA, 16 bp, Homo sapiens
ctgcagctgggcccca

SEQ ID NO: 3901295 - DNA, 20 bp, Homo sapiens
ctgcagctgggccccatgct

SEQ ID NO: 3901296 - DNA, 15 bp, Homo sapiens
ctgcagcttcctgtc

SEQ ID NO: 3901297 - DNA, 11 bp, Homo sapiens
ctgcagcttgt

SEQ ID NO: 3901298 - DNA, 17 bp, Homo sapiens
ctgcagcttgtagccag

SEQ ID NO: 3901299 - DNA, 19 bp, Homo sapiens
ctgcagcttgtagccagcc

SEQ ID NO: 3901300 - DNA, 11 bp, Homo sapiens
ctgcaggcccc

SEQ ID NO: 3901301 - DNA, 20 bp, Homo sapiens
ctgcaggccccgcttgtcca

SEQ ID NO: 3901302 - DNA, 23 bp, Homo sapiens
ctgcaggccccgcttgtccagcg

SEQ ID NO: 3901303 - DNA, 15 bp, Homo sapiens
ctgcagggagcaact

SEQ ID NO: 3901304 - DNA, 20 bp, Homo sapiens
ctgcagggagcaactctcca

SEQ ID NO: 3901305 - DNA, 23 bp, Homo sapiens
ctgcagggggtgtgtctgctcag

SEQ ID NO: 3901306 - DNA, 15 bp, Homo sapiens
ctgcaggtacttcct

SEQ ID NO: 3901307 - DNA, 19 bp, Homo sapiens
ctgcaggtacttcctcctg

SEQ ID NO: 3901308 - DNA, 20 bp, Homo sapiens
ctgcagtagtctctgtgctt

SEQ ID NO: 3901309 - DNA, 23 bp, Homo sapiens
ctgcagtagtctctgtgctttga

SEQ ID NO: 3901310 - DNA, 16 bp, Homo sapiens
ctgcagttgggccagc

SEQ ID NO: 3901311 - DNA, 16 bp, Homo sapiens
ctgcatatcggaggtg

SEQ ID NO: 3901312 - DNA, 19 bp, Homo sapiens
ctgcatatcggaggtggtg

SEQ ID NO: 3901313 - DNA, 23 bp, Homo sapiens
ctgcatatcggaggtggtggagg

SEQ ID NO: 3901314 - DNA, 16 bp, Homo sapiens
ctgcatccccttggct

SEQ ID NO: 3901315 - DNA, 22 bp, Homo sapiens
ctgcatccggagaattgcctct

SEQ ID NO: 3901316 - DNA, 16 bp, Homo sapiens
ctgccctggtgctgcc

SEQ ID NO: 3901317 - DNA, 17 bp, Homo sapiens
ctgccctggtgctgcca

SEQ ID NO: 3901318 - DNA, 21 bp, Homo sapiens
ctgccctggtgctgccacact

SEQ ID NO: 3901319 - DNA, 23 bp, Homo sapiens
ctgccctggtgctgccacacttc

SEQ ID NO: 3901320 - DNA, 11 bp, Homo sapiens
ctgccctgtat

SEQ ID NO: 3901321 - DNA, 13 bp, Homo sapiens
ctgccctgtatat

SEQ ID NO: 3901322 - DNA, 21 bp, Homo sapiens
ctgccctgttgtgtatagatg

SEQ ID NO: 3901323 - DNA, 17 bp, Homo sapiens
ctgccgacctcgtcctc

SEQ ID NO: 3901324 - DNA, 15 bp, Homo sapiens
ctgccgcctcccagc

SEQ ID NO: 3901325 - DNA, 16 bp, Homo sapiens
ctgccgcctcccagcc

SEQ ID NO: 3901326 - DNA, 18 bp, Homo sapiens
ctgccgcctcccagcctg

SEQ ID NO: 3901327 - DNA, 18 bp, Homo sapiens
ctgccggtcacccaggct

SEQ ID NO: 3901328 - DNA, 14 bp, Homo sapiens
ctgcctaagtggct

SEQ ID NO: 3901329 - DNA, 15 bp, Homo sapiens
ctgcctaagtggctg

SEQ ID NO: 3901330 - DNA, 19 bp, Homo sapiens
ctgcctaagtggctgctga

SEQ ID NO: 3901331 - DNA, 17 bp, Homo sapiens
ctgcctatccatcctgc

SEQ ID NO: 3901332 - DNA, 19 bp, Homo sapiens
ctgcctatttattggggtg

SEQ ID NO: 3901333 - DNA, 21 bp, Homo sapiens
ctgcctcaatgtgaatcagac

SEQ ID NO: 3901334 - DNA, 14 bp, Homo sapiens
ctgcctccagaatg

SEQ ID NO: 3901335 - DNA, 18 bp, Homo sapiens
ctgcctccattctgacca

SEQ ID NO: 3901336 - DNA, 18 bp, Homo sapiens
ctgcctccctctccatat

SEQ ID NO: 3901337 - DNA, 16 bp, Homo sapiens
ctgcctccctttctgg

SEQ ID NO: 3901338 - DNA, 20 bp, Homo sapiens
ctgcctccctttctgggagg

SEQ ID NO: 3901339 - DNA, 13 bp, Homo sapiens
ctgcctcctcttc

SEQ ID NO: 3901340 - DNA, 14 bp, Homo sapiens
ctgcctcctcttca

SEQ ID NO: 3901341 - DNA, 24 bp, Homo sapiens
ctgcctcctcttcaactgaccagc

SEQ ID NO: 3901342 - DNA, 21 bp, Homo sapiens
ctgcctctcacacacatagat

SEQ ID NO: 3901343 - DNA, 16 bp, Homo sapiens
ctgcctctctgctcca

SEQ ID NO: 3901344 - DNA, 12 bp, Homo sapiens
ctgcctgagccc

SEQ ID NO: 3901345 - DNA, 21 bp, Homo sapiens
ctgcctgcagtactttacctc

SEQ ID NO: 3901346 - DNA, 13 bp, Homo sapiens
ctgcctgcccact

SEQ ID NO: 3901347 - DNA, 19 bp, Homo sapiens
ctgcctgcccacttagccg

SEQ ID NO: 3901348 - DNA, 16 bp, Homo sapiens
ctgcctgccttggcct

SEQ ID NO: 3901349 - DNA, 14 bp, Homo sapiens
ctgcctgcggccca

SEQ ID NO: 3901350 - DNA, 21 bp, Homo sapiens
ctgcctggaaattctggaact

SEQ ID NO: 3901351 - DNA, 22 bp, Homo sapiens
ctgcctggaaattctggaactg

SEQ ID NO: 3901352 - DNA, 11 bp, Homo sapiens
ctgcctggagg

SEQ ID NO: 3901353 - DNA, 12 bp, Homo sapiens
ctgcctggagga

SEQ ID NO: 3901354 - DNA, 16 bp, Homo sapiens
ctgcctggaggacctg

SEQ ID NO: 3901355 - DNA, 20 bp, Homo sapiens
ctgcctggaggacctgagcc

SEQ ID NO: 3901356 - DNA, 23 bp, Homo sapiens
ctgcctggaggacctgagcctgc

SEQ ID NO: 3901357 - DNA, 21 bp, Homo sapiens
ctgcctggaggatccctccat

SEQ ID NO: 3901358 - DNA, 22 bp, Homo sapiens
ctgcctggaggatccctccatc

SEQ ID NO: 3901359 - DNA, 14 bp, Homo sapiens
ctgcctggcctggc

SEQ ID NO: 3901360 - DNA, 15 bp, Homo sapiens
ctgcctggcctggct

SEQ ID NO: 3901361 - DNA, 18 bp, Homo sapiens
ctgcctggcctggctccc

SEQ ID NO: 3901362 - DNA, 19 bp, Homo sapiens
ctgcctggcctggctcccc

SEQ ID NO: 3901363 - DNA, 13 bp, Homo sapiens
ctgcctgggcctg

SEQ ID NO: 3901364 - DNA, 15 bp, Homo sapiens
ctgcctgggcctgtg

SEQ ID NO: 3901365 - DNA, 19 bp, Homo sapiens
ctgcctgggcctgtgcagc

SEQ ID NO: 3901366 - DNA, 21 bp, Homo sapiens
ctgcctgggttttctaactgt

SEQ ID NO: 3901367 - DNA, 17 bp, Homo sapiens
ctgcctgtagttaggaa

SEQ ID NO: 3901368 - DNA, 18 bp, Homo sapiens
ctgcctgtgcatgacctg

SEQ ID NO: 3901369 - DNA, 19 bp, Homo sapiens
ctgcctgtgtttgtgtgga

SEQ ID NO: 3901370 - DNA, 24 bp, Homo sapiens
ctgccttcttcggggaactcctgg

SEQ ID NO: 3901371 - DNA, 13 bp, Homo sapiens
ctgccttgccatg

SEQ ID NO: 3901372 - DNA, 21 bp, Homo sapiens
ctgcctttgaaattcccccac

SEQ ID NO: 3901373 - DNA, 17 bp, Homo sapiens
ctgccttttttcacagc

SEQ ID NO: 3901374 - DNA, 18 bp, Homo sapiens
ctgccttttttcacagcc

SEQ ID NO: 3901375 - DNA, 21 bp, Homo sapiens
ctgccttttttcacagcccgg

SEQ ID NO: 3901376 - DNA, 20 bp, Homo sapiens
ctgcgagctccttgggtcct

SEQ ID NO: 3901377 - DNA, 14 bp, Homo sapiens
ctgcggccgggctg

SEQ ID NO: 3901378 - DNA, 15 bp, Homo sapiens
ctgcggccgggctgc

SEQ ID NO: 3901379 - DNA, 16 bp, Homo sapiens
ctgcggccgggctgcc

SEQ ID NO: 3901380 - DNA, 15 bp, Homo sapiens
ctgcgggtctgaagg

SEQ ID NO: 3901381 - DNA, 19 bp, Homo sapiens
ctgcggtggtgccagaggt

SEQ ID NO: 3901382 - DNA, 20 bp, Homo sapiens
ctgcggtggtgccagaggtt

SEQ ID NO: 3901383 - DNA, 20 bp, Homo sapiens
ctgcgtcagaccagtactgg

SEQ ID NO: 3901384 - DNA, 19 bp, Homo sapiens
ctgcgtcgaactgtcctgg

SEQ ID NO: 3901385 - DNA, 19 bp, Homo sapiens
ctgcgtgccagtgtcccca

SEQ ID NO: 3901386 - DNA, 21 bp, Homo sapiens
ctgcgtgctttatttatggct

SEQ ID NO: 3901387 - DNA, 19 bp, Homo sapiens
ctgcgttggagccactcct

SEQ ID NO: 3901388 - DNA, 21 bp, Homo sapiens
ctgcgttggagccactcctgt

SEQ ID NO: 3901389 - DNA, 17 bp, Homo sapiens
ctgctaaatactgtaca

SEQ ID NO: 3901390 - DNA, 21 bp, Homo sapiens
ctgctaaatactgtacataga

SEQ ID NO: 3901391 - DNA, 17 bp, Homo sapiens
ctgctactacccgagcc

SEQ ID NO: 3901392 - DNA, 20 bp, Homo sapiens
ctgctactacccgagcccag

SEQ ID NO: 3901393 - DNA, 15 bp, Homo sapiens
ctgctaggcgagtgc

SEQ ID NO: 3901394 - DNA, 19 bp, Homo sapiens
ctgctaggcgagtgccagg

SEQ ID NO: 3901395 - DNA, 20 bp, Homo sapiens
ctgctaggcgagtgccagga

SEQ ID NO: 3901396 - DNA, 20 bp, Homo sapiens
ctgctatatgccttaagcca

SEQ ID NO: 3901397 - DNA, 17 bp, Homo sapiens
ctgctatattttcatga

SEQ ID NO: 3901398 - DNA, 15 bp, Homo sapiens
ctgctcataacatct

SEQ ID NO: 3901399 - DNA, 15 bp, Homo sapiens
ctgctcatcacccag

SEQ ID NO: 3901400 - DNA, 16 bp, Homo sapiens
ctgctcatcacccagt

SEQ ID NO: 3901401 - DNA, 12 bp, Homo sapiens
ctgctcatcatt

SEQ ID NO: 3901402 - DNA, 13 bp, Homo sapiens
ctggaagagagga

SEQ ID NO: 3901403 - DNA, 12 bp, Homo sapiens
ctggaagcacat

SEQ ID NO: 3901404 - DNA, 15 bp, Homo sapiens
ctggaagcacatgtt

SEQ ID NO: 3901405 - DNA, 16 bp, Homo sapiens
ctggaagctgagcagg

SEQ ID NO: 3901406 - DNA, 18 bp, Homo sapiens
ctggaagctgagcaggcc

SEQ ID NO: 3901407 - DNA, 16 bp, Homo sapiens
ctggaaggcagggcag

SEQ ID NO: 3901408 - DNA, 15 bp, Homo sapiens
ctggaaggctggctg

SEQ ID NO: 3901409 - DNA, 18 bp, Homo sapiens
ctggaaggctggctgagt

SEQ ID NO: 3901410 - DNA, 15 bp, Homo sapiens
ctggaatacatgaaa

SEQ ID NO: 3901411 - DNA, 19 bp, Homo sapiens
ctggaatcaatttcccaga

SEQ ID NO: 3901412 - DNA, 17 bp, Homo sapiens
ctggaatcgatctgtac

SEQ ID NO: 3901413 - DNA, 22 bp, Homo sapiens
ctggaatcgatctgtactgtaa

SEQ ID NO: 3901414 - DNA, 20 bp, Homo sapiens
ctggaatctggagagctaga

SEQ ID NO: 3901415 - DNA, 21 bp, Homo sapiens
ctggaatggaattcagtaaca

SEQ ID NO: 3901416 - DNA, 16 bp, Homo sapiens
ctggaattcagcaccc

SEQ ID NO: 3901417 - DNA, 18 bp, Homo sapiens
ctggaattcagcaccctg

SEQ ID NO: 3901418 - DNA, 16 bp, Homo sapiens
ctggacaacccagaac

SEQ ID NO: 3901419 - DNA, 15 bp, Homo sapiens
ctggacaagaagctg

SEQ ID NO: 3901420 - DNA, 16 bp, Homo sapiens
ctggacaagaagctgc

SEQ ID NO: 3901421 - DNA, 18 bp, Homo sapiens
ctggacaagaagctgcta

SEQ ID NO: 3901422 - DNA, 11 bp, Homo sapiens
ctggacaagcc

SEQ ID NO: 3901423 - DNA, 15 bp, Homo sapiens
ctggacaagccaact

SEQ ID NO: 3901424 - DNA, 21 bp, Homo sapiens
ctggacaagccaacttgtaaa

SEQ ID NO: 3901425 - DNA, 13 bp, Homo sapiens
ctggacagctgtg

SEQ ID NO: 3901426 - DNA, 17 bp, Homo sapiens
ctggacagctgtgcctc

SEQ ID NO: 3901427 - DNA, 20 bp, Homo sapiens
ctggacagctgtgcctcgct

SEQ ID NO: 3901428 - DNA, 18 bp, Homo sapiens
ctggaccccgcctcccag

SEQ ID NO: 3901429 - DNA, 20 bp, Homo sapiens
ctggacctccccctcttggt

SEQ ID NO: 3901430 - DNA, 16 bp, Homo sapiens
ctggacctctgcttcc

SEQ ID NO: 3901431 - DNA, 17 bp, Homo sapiens
ctggacgcccagctgag

SEQ ID NO: 3901432 - DNA, 14 bp, Homo sapiens
ctggactcctctgt

SEQ ID NO: 3901433 - DNA, 19 bp, Homo sapiens
ctggactcctctgtccagg

SEQ ID NO: 3901434 - DNA, 14 bp, Homo sapiens
ctggactctggcac

SEQ ID NO: 3901435 - DNA, 20 bp, Homo sapiens
ctggactgtcatagaaatta

SEQ ID NO: 3901436 - DNA, 13 bp, Homo sapiens
ctggagaactaga

SEQ ID NO: 3901437 - DNA, 14 bp, Homo sapiens
ctggagaagcagtg

SEQ ID NO: 3901438 - DNA, 21 bp, Homo sapiens
ctggagaagcagtgagccgca

SEQ ID NO: 3901439 - DNA, 15 bp, Homo sapiens
ctggagaagctgatg

SEQ ID NO: 3901440 - DNA, 20 bp, Homo sapiens
ctggagatcctaactgagaa

SEQ ID NO: 3901441 - DNA, 14 bp, Homo sapiens
ctggagatgatgat

SEQ ID NO: 3901442 - DNA, 16 bp, Homo sapiens
ctggagatgatgatga

SEQ ID NO: 3901443 - DNA, 23 bp, Homo sapiens
ctggagcaagaaggaaggaggca

SEQ ID NO: 3901444 - DNA, 19 bp, Homo sapiens
ctggagcaagagagagctc

SEQ ID NO: 3901445 - DNA, 23 bp, Homo sapiens
ctggagcaccaggcacgaaccca

SEQ ID NO: 3901446 - DNA, 15 bp, Homo sapiens
ctggagcatcccagg

SEQ ID NO: 3901447 - DNA, 16 bp, Homo sapiens
ctggagcatctgactc

SEQ ID NO: 3901448 - DNA, 13 bp, Homo sapiens
ctggagctcttgg

SEQ ID NO: 3901449 - DNA, 21 bp, Homo sapiens
ctggagctcttggaagagctc

SEQ ID NO: 3901450 - DNA, 17 bp, Homo sapiens
ctggaggacctgagcct

SEQ ID NO: 3901451 - DNA, 22 bp, Homo sapiens
ctggaggactagaacctggagg

SEQ ID NO: 3901452 - DNA, 17 bp, Homo sapiens
ctggaggattttccagt

SEQ ID NO: 3901453 - DNA, 13 bp, Homo sapiens
ctggaggcagggc

SEQ ID NO: 3901454 - DNA, 14 bp, Homo sapiens
ctggaggcagggcc

SEQ ID NO: 3901455 - DNA, 15 bp, Homo sapiens
ctggaggcagggcct

SEQ ID NO: 3901456 - DNA, 16 bp, Homo sapiens
ctggaggcagggcctt

SEQ ID NO: 3901457 - DNA, 19 bp, Homo sapiens
ctggaggcagggccttgcc

SEQ ID NO: 3901458 - DNA, 23 bp, Homo sapiens
ctggaggcagggccttgcccaga

SEQ ID NO: 3901459 - DNA, 19 bp, Homo sapiens
ctggagggctagaacctgg

SEQ ID NO: 3901460 - DNA, 20 bp, Homo sapiens
ctggagggctagaacctgga

SEQ ID NO: 3901461 - DNA, 21 bp, Homo sapiens
ctggagggctagaacctggag

SEQ ID NO: 3901462 - DNA, 22 bp, Homo sapiens
ctggagggctagaacctggaga

SEQ ID NO: 3901463 - DNA, 22 bp, Homo sapiens
ctggagggctagaatctggaga

SEQ ID NO: 3901464 - DNA, 19 bp, Homo sapiens
ctggagggctggaatctgg

SEQ ID NO: 3901465 - DNA, 19 bp, Homo sapiens
ctggaggtcacattcagga

SEQ ID NO: 3901466 - DNA, 20 bp, Homo sapiens
ctggaggtgggagacaagga

SEQ ID NO: 3901467 - DNA, 13 bp, Homo sapiens
ctggagtgaggct

SEQ ID NO: 3901468 - DNA, 20 bp, Homo sapiens
ctggagtgaggcttccaggc

SEQ ID NO: 3901469 - DNA, 18 bp, Homo sapiens
ctggagtgcgctcttggt

SEQ ID NO: 3901470 - DNA, 18 bp, Homo sapiens
ctggatacagaatgaatc

SEQ ID NO: 3901471 - DNA, 15 bp, Homo sapiens
ctggatcagaacagg

SEQ ID NO: 3901472 - DNA, 16 bp, Homo sapiens
ctggatcagcgtggcc

SEQ ID NO: 3901473 - DNA, 17 bp, Homo sapiens
ctggatcctgctgtggc

SEQ ID NO: 3901474 - DNA, 20 bp, Homo sapiens
ctggatcctgctgtggcctc

SEQ ID NO: 3901475 - DNA, 21 bp, Homo sapiens
ctggatcctgctgtggcctca

SEQ ID NO: 3901476 - DNA, 15 bp, Homo sapiens
ctggatctccccact

SEQ ID NO: 3901477 - DNA, 23 bp, Homo sapiens
ctggatgaagattctcctgtgct

SEQ ID NO: 3901478 - DNA, 20 bp, Homo sapiens
ctggatgtcccctgtcccac

SEQ ID NO: 3901479 - DNA, 21 bp, Homo sapiens
ctggattaatgttttgtacaa

SEQ ID NO: 3901480 - DNA, 19 bp, Homo sapiens
ctggattgttgacatgagt

SEQ ID NO: 3901481 - DNA, 20 bp, Homo sapiens
ctggattttcccctgaagac

SEQ ID NO: 3901482 - DNA, 22 bp, Homo sapiens
ctggcaaaggtggctctccagt

SEQ ID NO: 3901483 - DNA, 14 bp, Homo sapiens
ctggcaagcaggga

SEQ ID NO: 3901484 - DNA, 19 bp, Homo sapiens
ctggcaagctagaacctgg

SEQ ID NO: 3901485 - DNA, 19 bp, Homo sapiens
ctggcaatgtttatttcat

SEQ ID NO: 3901486 - DNA, 20 bp, Homo sapiens
ctggcacagttttctgagaa

SEQ ID NO: 3901487 - DNA, 22 bp, Homo sapiens
ctggcacagttttctgagaaag

SEQ ID NO: 3901488 - DNA, 18 bp, Homo sapiens
ctgggaaaacagaggaat

SEQ ID NO: 3901489 - DNA, 19 bp, Homo sapiens
ctgggaaaacagaggaatc

SEQ ID NO: 3901490 - DNA, 20 bp, Homo sapiens
ctgggaaaggacccacccat

SEQ ID NO: 3901491 - DNA, 16 bp, Homo sapiens
ctgggaaataagagag

SEQ ID NO: 3901492 - DNA, 22 bp, Homo sapiens
ctgggaaatttctacttatcct

SEQ ID NO: 3901493 - DNA, 19 bp, Homo sapiens
ctgggaaccccgcagcccg

SEQ ID NO: 3901494 - DNA, 16 bp, Homo sapiens
ctgggaactcatcctg

SEQ ID NO: 3901495 - DNA, 21 bp, Homo sapiens
ctgggaagctgtactcagagc

SEQ ID NO: 3901496 - DNA, 22 bp, Homo sapiens
ctgggaagctgtactcagagca

SEQ ID NO: 3901497 - DNA, 23 bp, Homo sapiens
ctgggaagctgtactcagagcag

SEQ ID NO: 3901498 - DNA, 13 bp, Homo sapiens
ctgggaaggagga

SEQ ID NO: 3901499 - DNA, 16 bp, Homo sapiens
ctgggaaggctacttc

SEQ ID NO: 3901500 - DNA, 22 bp, Homo sapiens
ctgggaaggggtgccctctgga

SEQ ID NO: 3901501 - DNA, 21 bp, Homo sapiens
ctgggacccagctactctgtc

SEQ ID NO: 3901502 - DNA, 16 bp, Homo sapiens
ctgggaccccagctag

SEQ ID NO: 3901503 - DNA, 22 bp, Homo sapiens
ctgggaccccagctagggctgg

SEQ ID NO: 3901504 - DNA, 14 bp, Homo sapiens
ctgggaccctttcc

SEQ ID NO: 3901505 - DNA, 16 bp, Homo sapiens
ctgggaccgctacacc

SEQ ID NO: 3901506 - DNA, 24 bp, Homo sapiens
ctgggaccgctacaccactctggc

SEQ ID NO: 3901507 - DNA, 14 bp, Homo sapiens
ctgggagctctgca

SEQ ID NO: 3901508 - DNA, 15 bp, Homo sapiens
ctgggagctctgcag

SEQ ID NO: 3901509 - DNA, 17 bp, Homo sapiens
ctgggaggcagaacagg

SEQ ID NO: 3901510 - DNA, 13 bp, Homo sapiens
ctgggaggcatgg

SEQ ID NO: 3901511 - DNA, 22 bp, Homo sapiens
ctgggaggcatggccctggggt

SEQ ID NO: 3901512 - DNA, 13 bp, Homo sapiens
ctgggagggggct

SEQ ID NO: 3901513 - DNA, 14 bp, Homo sapiens
ctgggagtgttctg

SEQ ID NO: 3901514 - DNA, 16 bp, Homo sapiens
ctgggatggaccctcg

SEQ ID NO: 3901515 - DNA, 15 bp, Homo sapiens
ctgggatgggaccag

SEQ ID NO: 3901516 - DNA, 17 bp, Homo sapiens
ctgggatgggaccaggg

SEQ ID NO: 3901517 - DNA, 19 bp, Homo sapiens
ctgggatgggaccagggat

SEQ ID NO: 3901518 - DNA, 20 bp, Homo sapiens
ctgggatgggaccagggatg

SEQ ID NO: 3901519 - DNA, 16 bp, Homo sapiens
ctgggatgtagaactt

SEQ ID NO: 3901520 - DNA, 15 bp, Homo sapiens
ctgggattcccacca

SEQ ID NO: 3901521 - DNA, 22 bp, Homo sapiens
ctgggatttcttcgctgctcta

SEQ ID NO: 3901522 - DNA, 19 bp, Homo sapiens
ctgggcaaacccttctctt

SEQ ID NO: 3901523 - DNA, 20 bp, Homo sapiens
ctgggcaaacccttctcttc

SEQ ID NO: 3901524 - DNA, 21 bp, Homo sapiens
ctgggcaaacccttctcttct

SEQ ID NO: 3901525 - DNA, 18 bp, Homo sapiens
ctgggcaatgaaaccaaa

SEQ ID NO: 3901526 - DNA, 16 bp, Homo sapiens
ctgggcacctctagtg

SEQ ID NO: 3901527 - DNA, 17 bp, Homo sapiens
ctgggcacctctagtgc

SEQ ID NO: 3901528 - DNA, 16 bp, Homo sapiens
ctgggcatcttctggc

SEQ ID NO: 3901529 - DNA, 19 bp, Homo sapiens
ctgggcatcttctggcttg

SEQ ID NO: 3901530 - DNA, 18 bp, Homo sapiens
ctgggccaaaagggcagc

SEQ ID NO: 3901531 - DNA, 21 bp, Homo sapiens
ctgggccaaaagggcagccag

SEQ ID NO: 3901532 - DNA, 16 bp, Homo sapiens
ctgggccagcctcagc

SEQ ID NO: 3901533 - DNA, 17 bp, Homo sapiens
ctgggccagcctcagct

SEQ ID NO: 3901534 - DNA, 15 bp, Homo sapiens
ctgggcccaggctct

SEQ ID NO: 3901535 - DNA, 18 bp, Homo sapiens
ctgggcccaggctctggg

SEQ ID NO: 3901536 - DNA, 13 bp, Homo sapiens
ctgggccccacca

SEQ ID NO: 3901537 - DNA, 14 bp, Homo sapiens
ctgggccccaccac

SEQ ID NO: 3901538 - DNA, 16 bp, Homo sapiens
ctgggccccaccacct

SEQ ID NO: 3901539 - DNA, 14 bp, Homo sapiens
ctgggccccaccta

SEQ ID NO: 3901540 - DNA, 15 bp, Homo sapiens
ctgggccccatgctc

SEQ ID NO: 3901541 - DNA, 18 bp, Homo sapiens
ctgggccccatgctctgc

SEQ ID NO: 3901542 - DNA, 22 bp, Homo sapiens
ctgggccctggggcctgtactg

SEQ ID NO: 3901543 - DNA, 15 bp, Homo sapiens
ctgggccggccagcc

SEQ ID NO: 3901544 - DNA, 12 bp, Homo sapiens
ctgggcctatgg

SEQ ID NO: 3901545 - DNA, 19 bp, Homo sapiens
ctgggcctatggagagccc

SEQ ID NO: 3901546 - DNA, 20 bp, Homo sapiens
ctgggcctcagttcaacctg

SEQ ID NO: 3901547 - DNA, 13 bp, Homo sapiens
ctgggcctgctgc

SEQ ID NO: 3901548 - DNA, 16 bp, Homo sapiens
ctgggcctgctgctga

SEQ ID NO: 3901549 - DNA, 19 bp, Homo sapiens
ctgggcctgctgctgagaa

SEQ ID NO: 3901550 - DNA, 23 bp, Homo sapiens
ctgggcctggaccgcttcccaga

SEQ ID NO: 3901551 - DNA, 16 bp, Homo sapiens
ctgggcctgtgcagca

SEQ ID NO: 3901552 - DNA, 18 bp, Homo sapiens
ctgggcctgtgcagcagc

SEQ ID NO: 3901553 - DNA, 20 bp, Homo sapiens
ctgggcctgtgcagcagccc

SEQ ID NO: 3901554 - DNA, 23 bp, Homo sapiens
ctgggcctgtgcagcagcccagc

SEQ ID NO: 3901555 - DNA, 13 bp, Homo sapiens
ctgggcctttcct

SEQ ID NO: 3901556 - DNA, 21 bp, Homo sapiens
ctgggcctttcctgtgccaac

SEQ ID NO: 3901557 - DNA, 23 bp, Homo sapiens
ctgggcgaatctacagaacaaag

SEQ ID NO: 3901558 - DNA, 22 bp, Homo sapiens
ctgggctagggagaatgcagag

SEQ ID NO: 3901559 - DNA, 13 bp, Homo sapiens
ctgggctcagggc

SEQ ID NO: 3901560 - DNA, 17 bp, Homo sapiens
ctgggctcagggctgga

SEQ ID NO: 3901561 - DNA, 20 bp, Homo sapiens
ctgggctcagggctggagtg

SEQ ID NO: 3901562 - DNA, 14 bp, Homo sapiens
ctgggctcctggaa

SEQ ID NO: 3901563 - DNA, 12 bp, Homo sapiens
ctgggctctcca

SEQ ID NO: 3901564 - DNA, 16 bp, Homo sapiens
ctgggctctccacctc

SEQ ID NO: 3901565 - DNA, 20 bp, Homo sapiens
ctgggctctccacctcagcc

SEQ ID NO: 3901566 - DNA, 17 bp, Homo sapiens
ctgggctgtctgtcacc

SEQ ID NO: 3901567 - DNA, 15 bp, Homo sapiens
ctgggctgtgggtgc

SEQ ID NO: 3901568 - DNA, 23 bp, Homo sapiens
ctgggcttgtagaccactgtcct

SEQ ID NO: 3901569 - DNA, 19 bp, Homo sapiens
ctggggaacagagcgggcc

SEQ ID NO: 3901570 - DNA, 17 bp, Homo sapiens
ctggggaggaagggcca

SEQ ID NO: 3901571 - DNA, 19 bp, Homo sapiens
ctggggaggaagggccagg

SEQ ID NO: 3901572 - DNA, 20 bp, Homo sapiens
ctggggaggaagggccagga

SEQ ID NO: 3901573 - DNA, 18 bp, Homo sapiens
ctggggagggagagcacc

SEQ ID NO: 3901574 - DNA, 14 bp, Homo sapiens
ctgtaaatcacttg

SEQ ID NO: 3901575 - DNA, 17 bp, Homo sapiens
ctgtaaatcacttgtaa

SEQ ID NO: 3901576 - DNA, 20 bp, Homo sapiens
ctgtaaatcacttgtaaata

SEQ ID NO: 3901577 - DNA, 18 bp, Homo sapiens
ctgtaacacaagccacag

SEQ ID NO: 3901578 - DNA, 19 bp, Homo sapiens
ctgtaacacaagccacaga

SEQ ID NO: 3901579 - DNA, 19 bp, Homo sapiens
ctgtaactcagacattcca

SEQ ID NO: 3901580 - DNA, 14 bp, Homo sapiens
ctgtaagtttattt

SEQ ID NO: 3901581 - DNA, 21 bp, Homo sapiens
ctgtaagtttattttttctac

SEQ ID NO: 3901582 - DNA, 16 bp, Homo sapiens
ctgtaatcccagcact

SEQ ID NO: 3901583 - DNA, 19 bp, Homo sapiens
ctgtaatcccagctactca

SEQ ID NO: 3901584 - DNA, 18 bp, Homo sapiens
ctgtaattaagtaaacca

SEQ ID NO: 3901585 - DNA, 17 bp, Homo sapiens
ctgtaattttgtttgta

SEQ ID NO: 3901586 - DNA, 18 bp, Homo sapiens
ctgtaattttgtttgtaa

SEQ ID NO: 3901587 - DNA, 19 bp, Homo sapiens
ctgtaattttgtttgtaat

SEQ ID NO: 3901588 - DNA, 13 bp, Homo sapiens
ctgtacaaaaaca

SEQ ID NO: 3901589 - DNA, 16 bp, Homo sapiens
ctgtacaaaaacaaaa

SEQ ID NO: 3901590 - DNA, 19 bp, Homo sapiens
ctgtacatagatgtatcat

SEQ ID NO: 3901591 - DNA, 22 bp, Homo sapiens
ctgtacatatatatgccttatg

SEQ ID NO: 3901592 - DNA, 15 bp, Homo sapiens
ctgtaccaagcccct

SEQ ID NO: 3901593 - DNA, 22 bp, Homo sapiens
ctgtaccaagccccttggccct

SEQ ID NO: 3901594 - DNA, 17 bp, Homo sapiens
ctgtacccaatttaatt

SEQ ID NO: 3901595 - DNA, 20 bp, Homo sapiens
ctgtacccaatttaattcca

SEQ ID NO: 3901596 - DNA, 13 bp, Homo sapiens
ctgtacccagctc

SEQ ID NO: 3901597 - DNA, 14 bp, Homo sapiens
ctgtacccagctcc

SEQ ID NO: 3901598 - DNA, 15 bp, Homo sapiens
ctgtacccagctcct

SEQ ID NO: 3901599 - DNA, 16 bp, Homo sapiens
ctgtacccttccacct

SEQ ID NO: 3901600 - DNA, 17 bp, Homo sapiens
ctgtacccttccacctc

SEQ ID NO: 3901601 - DNA, 15 bp, Homo sapiens
ctgtactcctcccag

SEQ ID NO: 3901602 - DNA, 13 bp, Homo sapiens
ctgtactgcctgc

SEQ ID NO: 3901603 - DNA, 16 bp, Homo sapiens
ctgtactgcctgcttg

SEQ ID NO: 3901604 - DNA, 17 bp, Homo sapiens
ctgtactgcctgcttgg

SEQ ID NO: 3901605 - DNA, 18 bp, Homo sapiens
ctgtacttaataaattca

SEQ ID NO: 3901606 - DNA, 15 bp, Homo sapiens
ctgtagcatcttctg

SEQ ID NO: 3901607 - DNA, 20 bp, Homo sapiens
ctgtagcatcttctggagtc

SEQ ID NO: 3901608 - DNA, 14 bp, Homo sapiens
ctgtagccatggct

SEQ ID NO: 3901609 - DNA, 15 bp, Homo sapiens
ctgtagccatggctc

SEQ ID NO: 3901610 - DNA, 16 bp, Homo sapiens
ctgtagccatggctca

SEQ ID NO: 3901611 - DNA, 20 bp, Homo sapiens
ctgtagccatggctcaggca

SEQ ID NO: 3901612 - DNA, 23 bp, Homo sapiens
ctgtagccatggctcaggcaagc

SEQ ID NO: 3901613 - DNA, 20 bp, Homo sapiens
ctgtagctctgcctccctct

SEQ ID NO: 3901614 - DNA, 21 bp, Homo sapiens
ctgtagggctggacctatgtc

SEQ ID NO: 3901615 - DNA, 14 bp, Homo sapiens
ctgtaggttgctta

SEQ ID NO: 3901616 - DNA, 18 bp, Homo sapiens
ctgtagtagccctttctg

SEQ ID NO: 3901617 - DNA, 18 bp, Homo sapiens
ctgtagtcccagccactc

SEQ ID NO: 3901618 - DNA, 14 bp, Homo sapiens
ctgtagttaggaaa

SEQ ID NO: 3901619 - DNA, 17 bp, Homo sapiens
ctgtagttaggaaataa

SEQ ID NO: 3901620 - DNA, 18 bp, Homo sapiens
ctgtagttaggaaataaa

SEQ ID NO: 3901621 - DNA, 22 bp, Homo sapiens
ctgtagttaggaaataaaacct

SEQ ID NO: 3901622 - DNA, 15 bp, Homo sapiens
ctgtatagtactggc

SEQ ID NO: 3901623 - DNA, 16 bp, Homo sapiens
ctgtatagttaggata

SEQ ID NO: 3901624 - DNA, 21 bp, Homo sapiens
ctgtatagttaggatagcatt

SEQ ID NO: 3901625 - DNA, 18 bp, Homo sapiens
ctgtatataatactaaag

SEQ ID NO: 3901626 - DNA, 18 bp, Homo sapiens
ctgtatatacaataacat

SEQ ID NO: 3901627 - DNA, 23 bp, Homo sapiens
ctgtatatacaataacataattt

SEQ ID NO: 3901628 - DNA, 15 bp, Homo sapiens
ctgtatatgttgtaa

SEQ ID NO: 3901629 - DNA, 17 bp, Homo sapiens
ctgtatatgttgtaata

SEQ ID NO: 3901630 - DNA, 16 bp, Homo sapiens
ctgtatattatggtgt

SEQ ID NO: 3901631 - DNA, 20 bp, Homo sapiens
ctgtatattatggtgtaatg

SEQ ID NO: 3901632 - DNA, 15 bp, Homo sapiens
ctgtatctgtaatta

SEQ ID NO: 3901633 - DNA, 12 bp, Homo sapiens
ctgtattcagat

SEQ ID NO: 3901634 - DNA, 13 bp, Homo sapiens
ctgtattcagatc

SEQ ID NO: 3901635 - DNA, 20 bp, Homo sapiens
ctgtatttaatggtttttat

SEQ ID NO: 3901636 - DNA, 18 bp, Homo sapiens
ctgtcaagtcatgatgga

SEQ ID NO: 3901637 - DNA, 18 bp, Homo sapiens
ctgtcacacaaggctggg

SEQ ID NO: 3901638 - DNA, 14 bp, Homo sapiens
ctgtcaccctccac

SEQ ID NO: 3901639 - DNA, 16 bp, Homo sapiens
ctgtcacgtgaaatat

SEQ ID NO: 3901640 - DNA, 17 bp, Homo sapiens
ctgtcactgctctggac

SEQ ID NO: 3901641 - DNA, 12 bp, Homo sapiens
ctgtcagagctg

SEQ ID NO: 3901642 - DNA, 21 bp, Homo sapiens
ctgtcagagctgttggcctcg

SEQ ID NO: 3901643 - DNA, 15 bp, Homo sapiens
ctgtcagaggctaag

SEQ ID NO: 3901644 - DNA, 22 bp, Homo sapiens
ctgtcagatgggaagacatgaa

SEQ ID NO: 3901645 - DNA, 12 bp, Homo sapiens
ctgtcagccagc

SEQ ID NO: 3901646 - DNA, 19 bp, Homo sapiens
ctgtcatcactccctggat

SEQ ID NO: 3901647 - DNA, 14 bp, Homo sapiens
ctgtcatctagccc

SEQ ID NO: 3901648 - DNA, 18 bp, Homo sapiens
ctgtcatctagccccttc

SEQ ID NO: 3901649 - DNA, 13 bp, Homo sapiens
ctgtcatctctct

SEQ ID NO: 3901650 - DNA, 17 bp, Homo sapiens
ctgtcatctctctgggg

SEQ ID NO: 3901651 - DNA, 17 bp, Homo sapiens
ctgtcattcaaatgggt

SEQ ID NO: 3901652 - DNA, 19 bp, Homo sapiens
ctgtcattcaaatgggtga

SEQ ID NO: 3901653 - DNA, 13 bp, Homo sapiens
ctgtcattcagga

SEQ ID NO: 3901654 - DNA, 16 bp, Homo sapiens
ctgtccaacctaaccc

SEQ ID NO: 3901655 - DNA, 16 bp, Homo sapiens
ctgtccaggacatgat

SEQ ID NO: 3901656 - DNA, 17 bp, Homo sapiens
ctgtccaggcactgctg

SEQ ID NO: 3901657 - DNA, 21 bp, Homo sapiens
ctgtccaggcactgctgccca

SEQ ID NO: 3901658 - DNA, 20 bp, Homo sapiens
ctgtccaggccactgtggcc

SEQ ID NO: 3901659 - DNA, 22 bp, Homo sapiens
ctgtcccaccgggagcctcccc

SEQ ID NO: 3901660 - DNA, 13 bp, Homo sapiens
ctgtcccacctct

SEQ ID NO: 3901661 - DNA, 22 bp, Homo sapiens
ctgtgctgccctgctctgggga

SEQ ID NO: 3901662 - DNA, 13 bp, Homo sapiens
ctgtgctgtgcct

SEQ ID NO: 3901663 - DNA, 14 bp, Homo sapiens
ctgtgctgtgcctg

SEQ ID NO: 3901664 - DNA, 16 bp, Homo sapiens
ctgtgctgtgcctgct

SEQ ID NO: 3901665 - DNA, 19 bp, Homo sapiens
ctgtgcttacagtgactgt

SEQ ID NO: 3901666 - DNA, 17 bp, Homo sapiens
ctgtgcttcaattaata

SEQ ID NO: 3901667 - DNA, 18 bp, Homo sapiens
ctgtgcttcaattaataa

SEQ ID NO: 3901668 - DNA, 18 bp, Homo sapiens
ctgtgctttgactcacct

SEQ ID NO: 3901669 - DNA, 19 bp, Homo sapiens
ctgtgctttgactcacctg

SEQ ID NO: 3901670 - DNA, 17 bp, Homo sapiens
ctgtgcttttaaatgca

SEQ ID NO: 3901671 - DNA, 13 bp, Homo sapiens
ctgtggagaaata

SEQ ID NO: 3901672 - DNA, 14 bp, Homo sapiens
ctgtggagagaaag

SEQ ID NO: 3901673 - DNA, 14 bp, Homo sapiens
ctgtggaggcctga

SEQ ID NO: 3901674 - DNA, 15 bp, Homo sapiens
ctgtggaggcctgat

SEQ ID NO: 3901675 - DNA, 21 bp, Homo sapiens
ctgtggaggcctgatgctgcc

SEQ ID NO: 3901676 - DNA, 22 bp, Homo sapiens
ctgtggaggtacactcttatag

SEQ ID NO: 3901677 - DNA, 12 bp, Homo sapiens
ctgtggcacaga

SEQ ID NO: 3901678 - DNA, 22 bp, Homo sapiens
ctgtggcacagacttctggaag

SEQ ID NO: 3901679 - DNA, 19 bp, Homo sapiens
ctgtggcagaaaagaggag

SEQ ID NO: 3901680 - DNA, 20 bp, Homo sapiens
ctgtggcagaccgggggcca

SEQ ID NO: 3901681 - DNA, 22 bp, Homo sapiens
ctgtggcagaccgggggccaga

SEQ ID NO: 3901682 - DNA, 13 bp, Homo sapiens
ctgtggccagagc

SEQ ID NO: 3901683 - DNA, 14 bp, Homo sapiens
ctgtggccagagct

SEQ ID NO: 3901684 - DNA, 19 bp, Homo sapiens
ctgtggcctcacttccctg

SEQ ID NO: 3901685 - DNA, 14 bp, Homo sapiens
ctgtggcctgtgtc

SEQ ID NO: 3901686 - DNA, 20 bp, Homo sapiens
ctgtggcctgtgtccagcag

SEQ ID NO: 3901687 - DNA, 21 bp, Homo sapiens
ctgtggcctgtgtccagcagc

SEQ ID NO: 3901688 - DNA, 17 bp, Homo sapiens
ctgtggccttgcccgcc

SEQ ID NO: 3901689 - DNA, 14 bp, Homo sapiens
ctgtggcggtgcct

SEQ ID NO: 3901690 - DNA, 14 bp, Homo sapiens
ctgtgggagcctcg

SEQ ID NO: 3901691 - DNA, 14 bp, Homo sapiens
ctgtgggagcctgc

SEQ ID NO: 3901692 - DNA, 14 bp, Homo sapiens
ctgtgggcagcacc

SEQ ID NO: 3901693 - DNA, 17 bp, Homo sapiens
ctgtgggcagcaccctc

SEQ ID NO: 3901694 - DNA, 23 bp, Homo sapiens
ctgtgggcagcaccctcccccgc

SEQ ID NO: 3901695 - DNA, 20 bp, Homo sapiens
ctgtgggccaggagctcagc

SEQ ID NO: 3901696 - DNA, 21 bp, Homo sapiens
ctgtgggcttggccttgtgtc

SEQ ID NO: 3901697 - DNA, 14 bp, Homo sapiens
ctgtgggggtggcc

SEQ ID NO: 3901698 - DNA, 16 bp, Homo sapiens
ctgtgggggtggccat

SEQ ID NO: 3901699 - DNA, 17 bp, Homo sapiens
ctgtgggggtggccatc

SEQ ID NO: 3901700 - DNA, 13 bp, Homo sapiens
ctgtggtgacagg

SEQ ID NO: 3901701 - DNA, 15 bp, Homo sapiens
ctgtgtactctttat

SEQ ID NO: 3901702 - DNA, 15 bp, Homo sapiens
ctgtgtccagcagct

SEQ ID NO: 3901703 - DNA, 18 bp, Homo sapiens
ctgtgtccagcagctgcg

SEQ ID NO: 3901704 - DNA, 16 bp, Homo sapiens
ctgtgtcccttttgca

SEQ ID NO: 3901705 - DNA, 16 bp, Homo sapiens
ctgtgtccttccctgc

SEQ ID NO: 3901706 - DNA, 18 bp, Homo sapiens
ctgtgtccttgcacctgc

SEQ ID NO: 3901707 - DNA, 13 bp, Homo sapiens
ctgtgtgaaaatg

SEQ ID NO: 3901708 - DNA, 15 bp, Homo sapiens
ctgtgtgaagaaatg

SEQ ID NO: 3901709 - DNA, 18 bp, Homo sapiens
ctgtgtgatgaactttct

SEQ ID NO: 3901710 - DNA, 21 bp, Homo sapiens
ctgtgtgcaccttaccaactt

SEQ ID NO: 3901711 - DNA, 17 bp, Homo sapiens
ctgtgtgcagtgaaggt

SEQ ID NO: 3901712 - DNA, 20 bp, Homo sapiens
ctgtgtggggaggcagctcc

SEQ ID NO: 3901713 - DNA, 18 bp, Homo sapiens
ctgtgtgtctgatgtttg

SEQ ID NO: 3901714 - DNA, 14 bp, Homo sapiens
ctgtgttcacactg

SEQ ID NO: 3901715 - DNA, 14 bp, Homo sapiens
ctgtgttcattctt

SEQ ID NO: 3901716 - DNA, 23 bp, Homo sapiens
ctgtgtttgaccttcacatttgt

SEQ ID NO: 3901717 - DNA, 16 bp, Homo sapiens
ctgttaaaagatgaaa

SEQ ID NO: 3901718 - DNA, 18 bp, Homo sapiens
ctgttaaaatgtacactg

SEQ ID NO: 3901719 - DNA, 18 bp, Homo sapiens
ctgttaagcaattccttt

SEQ ID NO: 3901720 - DNA, 20 bp, Homo sapiens
ctgttacataacaagaaaat

SEQ ID NO: 3901721 - DNA, 21 bp, Homo sapiens
ctgttacataacaagaaaatc

SEQ ID NO: 3901722 - DNA, 13 bp, Homo sapiens
ctgttactgaaat

SEQ ID NO: 3901723 - DNA, 12 bp, Homo sapiens
ctgttacttttt

SEQ ID NO: 3901724 - DNA, 20 bp, Homo sapiens
ctgttactttttagtctttt

SEQ ID NO: 3901725 - DNA, 16 bp, Homo sapiens
ctgttattgaaaatat

SEQ ID NO: 3901726 - DNA, 23 bp, Homo sapiens
ctgttattgcactatgaaaatca

SEQ ID NO: 3901727 - DNA, 23 bp, Homo sapiens
ctgttcaatgtttttaaaaatct

SEQ ID NO: 3901728 - DNA, 22 bp, Homo sapiens
ctgttcacagccagactggcac

SEQ ID NO: 3901729 - DNA, 12 bp, Homo sapiens
ctgttcacccac

SEQ ID NO: 3901730 - DNA, 17 bp, Homo sapiens
ctgttcaccttatgtat

SEQ ID NO: 3901731 - DNA, 18 bp, Homo sapiens
ctgttcaccttatgtatt

SEQ ID NO: 3901732 - DNA, 16 bp, Homo sapiens
ctgttcacttttcctc

SEQ ID NO: 3901733 - DNA, 17 bp, Homo sapiens
ctgttcacttttcctcc

SEQ ID NO: 3901734 - DNA, 14 bp, Homo sapiens
ctgttcatggcaga

SEQ ID NO: 3901735 - DNA, 18 bp, Homo sapiens
ctgttcccattcttgcat

SEQ ID NO: 3901736 - DNA, 18 bp, Homo sapiens
ctgttctatcccacccaa

SEQ ID NO: 3901737 - DNA, 14 bp, Homo sapiens
ctgttctgcactga

SEQ ID NO: 3901738 - DNA, 14 bp, Homo sapiens
ctgttctggcctca

SEQ ID NO: 3901739 - DNA, 19 bp, Homo sapiens
ctgttctggcctcagacca

SEQ ID NO: 3901740 - DNA, 14 bp, Homo sapiens
ctgttgaaaattat

SEQ ID NO: 3901741 - DNA, 17 bp, Homo sapiens
ctgttgatcccacttca

SEQ ID NO: 3901742 - DNA, 21 bp, Homo sapiens
ctgttgatcccacttcactgt

SEQ ID NO: 3901743 - DNA, 17 bp, Homo sapiens
ctgttgcccaggctggc

SEQ ID NO: 3901744 - DNA, 20 bp, Homo sapiens
ctgttgcccaggctggcctg

SEQ ID NO: 3901745 - DNA, 14 bp, Homo sapiens
ctgttgctagaagt

SEQ ID NO: 3901746 - DNA, 19 bp, Homo sapiens
ctgttgctggactgaggac

SEQ ID NO: 3901747 - DNA, 18 bp, Homo sapiens
ctgttggacccgctctgg

SEQ ID NO: 3901748 - DNA, 22 bp, Homo sapiens
cttcaagtgatatatgtattta

SEQ ID NO: 3901749 - DNA, 22 bp, Homo sapiens
cttcacaacctccgtgctgggc

SEQ ID NO: 3901750 - DNA, 18 bp, Homo sapiens
cttcacactgcaagagcc

SEQ ID NO: 3901751 - DNA, 21 bp, Homo sapiens
cttcacactgcaagagccttg

SEQ ID NO: 3901752 - DNA, 15 bp, Homo sapiens
cttcacccctgcact

SEQ ID NO: 3901753 - DNA, 18 bp, Homo sapiens
cttcacctttggtgcaga

SEQ ID NO: 3901754 - DNA, 18 bp, Homo sapiens
cttcactgttgaaaatta

SEQ ID NO: 3901755 - DNA, 15 bp, Homo sapiens
cttcactttaattct

SEQ ID NO: 3901756 - DNA, 16 bp, Homo sapiens
cttcactttaattctc

SEQ ID NO: 3901757 - DNA, 21 bp, Homo sapiens
cttcactttaattctcatgtg

SEQ ID NO: 3901758 - DNA, 16 bp, Homo sapiens
cttcagaacatgctgg

SEQ ID NO: 3901759 - DNA, 19 bp, Homo sapiens
cttcagaacatgctggata

SEQ ID NO: 3901760 - DNA, 11 bp, Homo sapiens
cttcagagcct

SEQ ID NO: 3901761 - DNA, 15 bp, Homo sapiens
cttcagagcctagcc

SEQ ID NO: 3901762 - DNA, 18 bp, Homo sapiens
cttcagagcctagccacc

SEQ ID NO: 3901763 - DNA, 19 bp, Homo sapiens
cttcagagcctagccacct

SEQ ID NO: 3901764 - DNA, 21 bp, Homo sapiens
cttcagagcctagccacctcc

SEQ ID NO: 3901765 - DNA, 22 bp, Homo sapiens
cttcagagcctagccacctccc

SEQ ID NO: 3901766 - DNA, 21 bp, Homo sapiens
cttcagagctcttcaagctgt

SEQ ID NO: 3901767 - DNA, 17 bp, Homo sapiens
cttcagatcagtgcttg

SEQ ID NO: 3901768 - DNA, 10 bp, Homo sapiens
cttcagcacc

SEQ ID NO: 3901769 - DNA, 15 bp, Homo sapiens
cttcagccacctctc

SEQ ID NO: 3901770 - DNA, 23 bp, Homo sapiens
cttcagcgagacccttgcattag

SEQ ID NO: 3901771 - DNA, 13 bp, Homo sapiens
cttcagctcccat

SEQ ID NO: 3901772 - DNA, 16 bp, Homo sapiens
cttcagctcccatagc

SEQ ID NO: 3901773 - DNA, 19 bp, Homo sapiens
cttcaggctcttctccttt

SEQ ID NO: 3901774 - DNA, 23 bp, Homo sapiens
cttcagggccagaaggagggcag

SEQ ID NO: 3901775 - DNA, 20 bp, Homo sapiens
cttcagggtatcccagaccc

SEQ ID NO: 3901776 - DNA, 19 bp, Homo sapiens
cttcagggtgagtgaatgg

SEQ ID NO: 3901777 - DNA, 13 bp, Homo sapiens
cttcaggtgcttt

SEQ ID NO: 3901778 - DNA, 21 bp, Homo sapiens
cttcaggtgcttttgatgtga

SEQ ID NO: 3901779 - DNA, 13 bp, Homo sapiens
cttcagtgcccac

SEQ ID NO: 3901780 - DNA, 17 bp, Homo sapiens
cttcagtgcccaccaac

SEQ ID NO: 3901781 - DNA, 17 bp, Homo sapiens
cttcagtggagaattat

SEQ ID NO: 3901782 - DNA, 13 bp, Homo sapiens
cttcagtgggaga

SEQ ID NO: 3901783 - DNA, 18 bp, Homo sapiens
cttcagtgggagaaaaca

SEQ ID NO: 3901784 - DNA, 17 bp, Homo sapiens
cttcagtgtatggaaat

SEQ ID NO: 3901785 - DNA, 23 bp, Homo sapiens
cttcataggcggtcatgtgtgca

SEQ ID NO: 3901786 - DNA, 13 bp, Homo sapiens
cttcatcaatttt

SEQ ID NO: 3901787 - DNA, 17 bp, Homo sapiens
cttcatcaatttttata

SEQ ID NO: 3901788 - DNA, 20 bp, Homo sapiens
cttcatcgaacaaactgatg

SEQ ID NO: 3901789 - DNA, 19 bp, Homo sapiens
cttcatctggattccagag

SEQ ID NO: 3901790 - DNA, 11 bp, Homo sapiens
cttcatgcctc

SEQ ID NO: 3901791 - DNA, 17 bp, Homo sapiens
cttcatgcctcagtttc

SEQ ID NO: 3901792 - DNA, 19 bp, Homo sapiens
cttcatgcctcagtttccc

SEQ ID NO: 3901793 - DNA, 15 bp, Homo sapiens
cttcatgctcagccc

SEQ ID NO: 3901794 - DNA, 19 bp, Homo sapiens
cttcatgctcagccctgac

SEQ ID NO: 3901795 - DNA, 18 bp, Homo sapiens
cttcatggtgactaacag

SEQ ID NO: 3901796 - DNA, 19 bp, Homo sapiens
cttcattttgagtctcagg

SEQ ID NO: 3901797 - DNA, 20 bp, Homo sapiens
cttccaaccccagctggcct

SEQ ID NO: 3901798 - DNA, 21 bp, Homo sapiens
cttccaaccccagctggcctc

SEQ ID NO: 3901799 - DNA, 23 bp, Homo sapiens
cttccaccgggcctgaaccacag

SEQ ID NO: 3901800 - DNA, 15 bp, Homo sapiens
cttccacctcctaga

SEQ ID NO: 3901801 - DNA, 18 bp, Homo sapiens
cttccagaagatgccctc

SEQ ID NO: 3901802 - DNA, 13 bp, Homo sapiens
cttccagaccacc

SEQ ID NO: 3901803 - DNA, 18 bp, Homo sapiens
cttccagaccacctgcca

SEQ ID NO: 3901804 - DNA, 19 bp, Homo sapiens
cttccagaccacctgccag

SEQ ID NO: 3901805 - DNA, 20 bp, Homo sapiens
cttccagaccacctgccagc

SEQ ID NO: 3901806 - DNA, 22 bp, Homo sapiens
cttccagaccacctgccagcca

SEQ ID NO: 3901807 - DNA, 20 bp, Homo sapiens
cttccaggagcccagagggc

SEQ ID NO: 3901808 - DNA, 12 bp, Homo sapiens
cttccaggctct

SEQ ID NO: 3901809 - DNA, 13 bp, Homo sapiens
cttccaggctctt

SEQ ID NO: 3901810 - DNA, 14 bp, Homo sapiens
cttccaggctcttc

SEQ ID NO: 3901811 - DNA, 23 bp, Homo sapiens
cttccaggctcttcctggacctg

SEQ ID NO: 3901812 - DNA, 19 bp, Homo sapiens
cttccaggtatctccagga

SEQ ID NO: 3901813 - DNA, 21 bp, Homo sapiens
cttccagtgttggctgtgtga

SEQ ID NO: 3901814 - DNA, 21 bp, Homo sapiens
cttccatccccaaactgtgcc

SEQ ID NO: 3901815 - DNA, 19 bp, Homo sapiens
cttccatgtcgcctctgca

SEQ ID NO: 3901816 - DNA, 16 bp, Homo sapiens
cttcccagaggcagag

SEQ ID NO: 3901817 - DNA, 14 bp, Homo sapiens
cttcccagctctcc

SEQ ID NO: 3901818 - DNA, 21 bp, Homo sapiens
cttcccagctctccctctggc

SEQ ID NO: 3901819 - DNA, 11 bp, Homo sapiens
cttcccatcac

SEQ ID NO: 3901820 - DNA, 17 bp, Homo sapiens
cttcccatcactggagc

SEQ ID NO: 3901821 - DNA, 14 bp, Homo sapiens
cttcccatccccag

SEQ ID NO: 3901822 - DNA, 15 bp, Homo sapiens
cttcccatccccagc

SEQ ID NO: 3901823 - DNA, 16 bp, Homo sapiens
cttccccaaataatat

SEQ ID NO: 3901824 - DNA, 22 bp, Homo sapiens
cttccccaccccagtttttgtt

SEQ ID NO: 3901825 - DNA, 13 bp, Homo sapiens
cttccccagactc

SEQ ID NO: 3901826 - DNA, 18 bp, Homo sapiens
cttccccatctccatttc

SEQ ID NO: 3901827 - DNA, 13 bp, Homo sapiens
cttcccccatccc

SEQ ID NO: 3901828 - DNA, 12 bp, Homo sapiens
cttccccctcca

SEQ ID NO: 3901829 - DNA, 14 bp, Homo sapiens
cttcccctgcctgg

SEQ ID NO: 3901830 - DNA, 13 bp, Homo sapiens
cttccccttctgt

SEQ ID NO: 3901831 - DNA, 18 bp, Homo sapiens
cttccccttctgtgtcac

SEQ ID NO: 3901832 - DNA, 22 bp, Homo sapiens
cttccccttgcccttgccctga

SEQ ID NO: 3901833 - DNA, 23 bp, Homo sapiens
cttccccttgcccttgccctgac

SEQ ID NO: 3901834 - DNA, 15 bp, Homo sapiens
cttcttaaaggcctg

SEQ ID NO: 3901835 - DNA, 19 bp, Homo sapiens
cttcttaaaggcctggaac

SEQ ID NO: 3901836 - DNA, 17 bp, Homo sapiens
cttcttattctcactcc

SEQ ID NO: 3901837 - DNA, 20 bp, Homo sapiens
cttcttattctcactccacc

SEQ ID NO: 3901838 - DNA, 22 bp, Homo sapiens
cttcttcaagcacctgcagatt

SEQ ID NO: 3901839 - DNA, 14 bp, Homo sapiens
cttcttcacccagc

SEQ ID NO: 3901840 - DNA, 23 bp, Homo sapiens
cttcttcacccagctaatctgta

SEQ ID NO: 3901841 - DNA, 19 bp, Homo sapiens
cttcttcacccgctgcagc

SEQ ID NO: 3901842 - DNA, 17 bp, Homo sapiens
cttcttcagccacctct

SEQ ID NO: 3901843 - DNA, 15 bp, Homo sapiens
cttcttcatcttgac

SEQ ID NO: 3901844 - DNA, 18 bp, Homo sapiens
cttcttcatctttaaaat

SEQ ID NO: 3901845 - DNA, 20 bp, Homo sapiens
cttcttccccaggtccttcc

SEQ ID NO: 3901846 - DNA, 21 bp, Homo sapiens
cttcttccctgttttaaatta

SEQ ID NO: 3901847 - DNA, 14 bp, Homo sapiens
cttcttcttcagaa

SEQ ID NO: 3901848 - DNA, 20 bp, Homo sapiens
cttcttgaaacagcctgggt

SEQ ID NO: 3901849 - DNA, 15 bp, Homo sapiens
cttcttgagcagacc

SEQ ID NO: 3901850 - DNA, 12 bp, Homo sapiens
cttcttggcttc

SEQ ID NO: 3901851 - DNA, 17 bp, Homo sapiens
cttcttggtttggggag

SEQ ID NO: 3901852 - DNA, 18 bp, Homo sapiens
cttcttggtttggggaga

SEQ ID NO: 3901853 - DNA, 20 bp, Homo sapiens
cttcttggtttggggagaaa

SEQ ID NO: 3901854 - DNA, 20 bp, Homo sapiens
cttcttgtgaaaccacaggc

SEQ ID NO: 3901855 - DNA, 13 bp, Homo sapiens
cttctttaaatca

SEQ ID NO: 3901856 - DNA, 18 bp, Homo sapiens
cttctttaaatcaaaagc

SEQ ID NO: 3901857 - DNA, 17 bp, Homo sapiens
cttctttaattgatcta

SEQ ID NO: 3901858 - DNA, 15 bp, Homo sapiens
cttctttcctcttcc

SEQ ID NO: 3901859 - DNA, 19 bp, Homo sapiens
cttctttctcttccctcct

SEQ ID NO: 3901860 - DNA, 20 bp, Homo sapiens
cttctttttattttcttttg

SEQ ID NO: 3901861 - DNA, 23 bp, Homo sapiens
cttctttttattttcttttgtaa

SEQ ID NO: 3901862 - DNA, 19 bp, Homo sapiens
cttgaaaacctcatttacc

SEQ ID NO: 3901863 - DNA, 20 bp, Homo sapiens
cttgaaaattttattaaaaa

SEQ ID NO: 3901864 - DNA, 19 bp, Homo sapiens
cttgaaattttaaactata

SEQ ID NO: 3901865 - DNA, 23 bp, Homo sapiens
cttgaacccaggtctccctggat

SEQ ID NO: 3901866 - DNA, 23 bp, Homo sapiens
cttgaactgttctggcctcagac

SEQ ID NO: 3901867 - DNA, 14 bp, Homo sapiens
cttgaactttccaa

SEQ ID NO: 3901868 - DNA, 16 bp, Homo sapiens
cttgaagtaaccttat

SEQ ID NO: 3901869 - DNA, 15 bp, Homo sapiens
cttgacaacagactg

SEQ ID NO: 3901870 - DNA, 15 bp, Homo sapiens
cttgacaacatccca

SEQ ID NO: 3901871 - DNA, 19 bp, Homo sapiens
cttgacacggtgaaatcca

SEQ ID NO: 3901872 - DNA, 14 bp, Homo sapiens
cttgacattcaagg

SEQ ID NO: 3901873 - DNA, 21 bp, Homo sapiens
cttgaccagacctagacctgg

SEQ ID NO: 3901874 - DNA, 12 bp, Homo sapiens
cttgacctccta

SEQ ID NO: 3901875 - DNA, 18 bp, Homo sapiens
cttgaccttttcgacgct

SEQ ID NO: 3901876 - DNA, 17 bp, Homo sapiens
cttgactatcacataca

SEQ ID NO: 3901877 - DNA, 18 bp, Homo sapiens
cttgactatcacatacaa

SEQ ID NO: 3901878 - DNA, 20 bp, Homo sapiens
cttgactatcacatacaatt

SEQ ID NO: 3901879 - DNA, 23 bp, Homo sapiens
cttgactatcacatacaatttgc

SEQ ID NO: 3901880 - DNA, 13 bp, Homo sapiens
cttgactccttgt

SEQ ID NO: 3901881 - DNA, 19 bp, Homo sapiens
cttgactctactgatctga

SEQ ID NO: 3901882 - DNA, 14 bp, Homo sapiens
cttgagacctcagc

SEQ ID NO: 3901883 - DNA, 15 bp, Homo sapiens
cttgagacctcagcc

SEQ ID NO: 3901884 - DNA, 18 bp, Homo sapiens
cttgagacctcagccatg

SEQ ID NO: 3901885 - DNA, 20 bp, Homo sapiens
cttgagagaaaaagtgcccc

SEQ ID NO: 3901886 - DNA, 22 bp, Homo sapiens
cttgagagtatcaggtctccca

SEQ ID NO: 3901887 - DNA, 13 bp, Homo sapiens
cttgagcccagga

SEQ ID NO: 3901888 - DNA, 20 bp, Homo sapiens
cttgagcccaggagtttgag

SEQ ID NO: 3901889 - DNA, 12 bp, Homo sapiens
cttgaggacaca

SEQ ID NO: 3901890 - DNA, 18 bp, Homo sapiens
cttgaggacacatgtcca

SEQ ID NO: 3901891 - DNA, 17 bp, Homo sapiens
cttgatatagaaagctg

SEQ ID NO: 3901892 - DNA, 20 bp, Homo sapiens
cttgatctgtatatacaata

SEQ ID NO: 3901893 - DNA, 22 bp, Homo sapiens
cttgatctgtatatacaataac

SEQ ID NO: 3901894 - DNA, 21 bp, Homo sapiens
cttgatgtcatgtacttcctg

SEQ ID NO: 3901895 - DNA, 15 bp, Homo sapiens
cttgcaagaggaggt

SEQ ID NO: 3901896 - DNA, 16 bp, Homo sapiens
cttgcacaagcttgta

SEQ ID NO: 3901897 - DNA, 19 bp, Homo sapiens
cttgcacaagcttgtatat

SEQ ID NO: 3901898 - DNA, 20 bp, Homo sapiens
cttgcacaagcttgtatata

SEQ ID NO: 3901899 - DNA, 15 bp, Homo sapiens
cttgcacatctctgc

SEQ ID NO: 3901900 - DNA, 18 bp, Homo sapiens
cttgcacccctcactctg

SEQ ID NO: 3901901 - DNA, 12 bp, Homo sapiens
cttgcacctgca

SEQ ID NO: 3901902 - DNA, 21 bp, Homo sapiens
cttgcactaaagtatgtaaag

SEQ ID NO: 3901903 - DNA, 17 bp, Homo sapiens
cttgcactgtgggggct

SEQ ID NO: 3901904 - DNA, 13 bp, Homo sapiens
cttgcattagaaa

SEQ ID NO: 3901905 - DNA, 12 bp, Homo sapiens
cttgcattccca

SEQ ID NO: 3901906 - DNA, 21 bp, Homo sapiens
cttgccaaattccatgtccct

SEQ ID NO: 3901907 - DNA, 22 bp, Homo sapiens
cttgccaaattccatgtccctg

SEQ ID NO: 3901908 - DNA, 20 bp, Homo sapiens
cttgccaagctttcttctac

SEQ ID NO: 3901909 - DNA, 16 bp, Homo sapiens
cttgccaggctccctt

SEQ ID NO: 3901910 - DNA, 21 bp, Homo sapiens
cttgcccagagatgcctccac

SEQ ID NO: 3901911 - DNA, 19 bp, Homo sapiens
cttgccccctcatctcact

SEQ ID NO: 3901912 - DNA, 21 bp, Homo sapiens
cttgcccctccagagacagga

SEQ ID NO: 3901913 - DNA, 15 bp, Homo sapiens
cttgccctgacctcc

SEQ ID NO: 3901914 - DNA, 22 bp, Homo sapiens
cttgccctgttaaaagatgaaa

SEQ ID NO: 3901915 - DNA, 17 bp, Homo sapiens
cttgcccttgccctgac

SEQ ID NO: 3901916 - DNA, 13 bp, Homo sapiens
cttgccgagagag

SEQ ID NO: 3901917 - DNA, 16 bp, Homo sapiens
cttgccgagagaggcg

SEQ ID NO: 3901918 - DNA, 18 bp, Homo sapiens
cttgcctaggccaaatgc

SEQ ID NO: 3901919 - DNA, 13 bp, Homo sapiens
cttgcctctctca

SEQ ID NO: 3901920 - DNA, 15 bp, Homo sapiens
cttgtcactatgcta

SEQ ID NO: 3901921 - DNA, 23 bp, Homo sapiens
cttgtcactggtagaccaaaata

SEQ ID NO: 3901922 - DNA, 22 bp, Homo sapiens
cttgtcagaattggcctcagtg

SEQ ID NO: 3901923 - DNA, 17 bp, Homo sapiens
cttgtcaggacccaggc

SEQ ID NO: 3901924 - DNA, 23 bp, Homo sapiens
cttgtcatccataaagcaagctc

SEQ ID NO: 3901925 - DNA, 23 bp, Homo sapiens
cttgtcatggaaaatgtcctgtg

SEQ ID NO: 3901926 - DNA, 14 bp, Homo sapiens
cttgtccagcgcct

SEQ ID NO: 3901927 - DNA, 18 bp, Homo sapiens
cttgtccagcgcctagtg

SEQ ID NO: 3901928 - DNA, 16 bp, Homo sapiens
cttgtcctgccagctg

SEQ ID NO: 3901929 - DNA, 18 bp, Homo sapiens
cttgtcctgccagctgcc

SEQ ID NO: 3901930 - DNA, 19 bp, Homo sapiens
cttgtcctgccagctgcct

SEQ ID NO: 3901931 - DNA, 21 bp, Homo sapiens
cttgtcctgctctcttcagga

SEQ ID NO: 3901932 - DNA, 15 bp, Homo sapiens
cttgtctgaggcctc

SEQ ID NO: 3901933 - DNA, 21 bp, Homo sapiens
cttgtctgaggcctcatccct

SEQ ID NO: 3901934 - DNA, 22 bp, Homo sapiens
cttgtctgaggcctcatccctc

SEQ ID NO: 3901935 - DNA, 15 bp, Homo sapiens
cttgtgactgaaggg

SEQ ID NO: 3901936 - DNA, 15 bp, Homo sapiens
cttgtgattctggga

SEQ ID NO: 3901937 - DNA, 16 bp, Homo sapiens
cttgtgattctgggat

SEQ ID NO: 3901938 - DNA, 13 bp, Homo sapiens
cttgtgccctgcc

SEQ ID NO: 3901939 - DNA, 14 bp, Homo sapiens
cttgtgccctgccc

SEQ ID NO: 3901940 - DNA, 21 bp, Homo sapiens
cttgtgccctgcccccatctc

SEQ ID NO: 3901941 - DNA, 23 bp, Homo sapiens
cttgtgctgagaatagtgtctga

SEQ ID NO: 3901942 - DNA, 14 bp, Homo sapiens
cttgtggtttatgt

SEQ ID NO: 3901943 - DNA, 14 bp, Homo sapiens
cttgtgtcagagac

SEQ ID NO: 3901944 - DNA, 14 bp, Homo sapiens
cttgtgtcagagct

SEQ ID NO: 3901945 - DNA, 18 bp, Homo sapiens
cttgttaatgctttctga

SEQ ID NO: 3901946 - DNA, 22 bp, Homo sapiens
cttgttacctttcccatgctga

SEQ ID NO: 3901947 - DNA, 23 bp, Homo sapiens
cttgttacctttcccatgctgaa

SEQ ID NO: 3901948 - DNA, 15 bp, Homo sapiens
cttgttccttctgct

SEQ ID NO: 3901949 - DNA, 16 bp, Homo sapiens
cttgttccttctgctt

SEQ ID NO: 3901950 - DNA, 22 bp, Homo sapiens
cttgttgcagagatttcctcca

SEQ ID NO: 3901951 - DNA, 19 bp, Homo sapiens
cttgttgcatgatgtattt

SEQ ID NO: 3901952 - DNA, 21 bp, Homo sapiens
cttgttgctgattcaagaaac

SEQ ID NO: 3901953 - DNA, 21 bp, Homo sapiens
cttgttgtttttaagtcctgt

SEQ ID NO: 3901954 - DNA, 14 bp, Homo sapiens
cttgtttggggcag

SEQ ID NO: 3901955 - DNA, 17 bp, Homo sapiens
cttgtttggggcaggag

SEQ ID NO: 3901956 - DNA, 14 bp, Homo sapiens
cttgtttgttttct

SEQ ID NO: 3901957 - DNA, 21 bp, Homo sapiens
cttgtttttgctactaattat

SEQ ID NO: 3901958 - DNA, 15 bp, Homo sapiens
ctttaaaagatgaaa

SEQ ID NO: 3901959 - DNA, 15 bp, Homo sapiens
ctttaaaataaaaaa

SEQ ID NO: 3901960 - DNA, 21 bp, Homo sapiens
ctttaaactaccctccagagt

SEQ ID NO: 3901961 - DNA, 20 bp, Homo sapiens
ctttaaagacttaagattaa

SEQ ID NO: 3901962 - DNA, 16 bp, Homo sapiens
ctttaaagtacctgta

SEQ ID NO: 3901963 - DNA, 20 bp, Homo sapiens
ctttaaagtatgtcttgttt

SEQ ID NO: 3901964 - DNA, 21 bp, Homo sapiens
ctttaacaaaacaagaaagaa

SEQ ID NO: 3901965 - DNA, 23 bp, Homo sapiens
ctttaacaaaacaagaaagaaac

SEQ ID NO: 3901966 - DNA, 15 bp, Homo sapiens
ctttaagagagaaat

SEQ ID NO: 3901967 - DNA, 17 bp, Homo sapiens
ctttaagagagaaatct

SEQ ID NO: 3901968 - DNA, 18 bp, Homo sapiens
ctttaatactcacctcct

SEQ ID NO: 3901969 - DNA, 15 bp, Homo sapiens
ctttacctaccacct

SEQ ID NO: 3901970 - DNA, 22 bp, Homo sapiens
ctttacctaccaccttccctct

SEQ ID NO: 3901971 - DNA, 16 bp, Homo sapiens
ctttacctgagaccag

SEQ ID NO: 3901972 - DNA, 17 bp, Homo sapiens
ctttactcccttcctgg

SEQ ID NO: 3901973 - DNA, 18 bp, Homo sapiens
ctttactcccttcctggc

SEQ ID NO: 3901974 - DNA, 19 bp, Homo sapiens
ctttactcccttcctggcc

SEQ ID NO: 3901975 - DNA, 18 bp, Homo sapiens
ctttagaatgagagtgtg

SEQ ID NO: 3901976 - DNA, 15 bp, Homo sapiens
ctttagctatgtgga

SEQ ID NO: 3901977 - DNA, 16 bp, Homo sapiens
ctttaggcagcctgcc

SEQ ID NO: 3901978 - DNA, 20 bp, Homo sapiens
ctttatcaccaggatgtcac

SEQ ID NO: 3901979 - DNA, 14 bp, Homo sapiens
ctttatcttgacat

SEQ ID NO: 3901980 - DNA, 14 bp, Homo sapiens
ctttatttctagca

SEQ ID NO: 3901981 - DNA, 20 bp, Homo sapiens
ctttatttctagcagagtga

SEQ ID NO: 3901982 - DNA, 21 bp, Homo sapiens
ctttcaaagaaggaattctag

SEQ ID NO: 3901983 - DNA, 18 bp, Homo sapiens
ctttcaattgtattttat

SEQ ID NO: 3901984 - DNA, 14 bp, Homo sapiens
ctttcacaaaaaag

SEQ ID NO: 3901985 - DNA, 20 bp, Homo sapiens
ctttcacaaaattttattcc

SEQ ID NO: 3901986 - DNA, 14 bp, Homo sapiens
ctttcacaaccttc

SEQ ID NO: 3901987 - DNA, 14 bp, Homo sapiens
ctttcagagccagt

SEQ ID NO: 3901988 - DNA, 15 bp, Homo sapiens
ctttcagagccagtg

SEQ ID NO: 3901989 - DNA, 20 bp, Homo sapiens
ctttcagagccagtgaagga

SEQ ID NO: 3901990 - DNA, 17 bp, Homo sapiens
ctttcagcactcagaaa

SEQ ID NO: 3901991 - DNA, 21 bp, Homo sapiens
ctttcagcattaggcttttaa

SEQ ID NO: 3901992 - DNA, 13 bp, Homo sapiens
ctttcagctgtga

SEQ ID NO: 3901993 - DNA, 20 bp, Homo sapiens
ctttcaggagggtccccagc

SEQ ID NO: 3901994 - DNA, 20 bp, Homo sapiens
ctttcccaagtattgcgaat

SEQ ID NO: 3901995 - DNA, 15 bp, Homo sapiens
ctttcccatgctgaa

SEQ ID NO: 3901996 - DNA, 18 bp, Homo sapiens
ctttcccatgctgaatta

SEQ ID NO: 3901997 - DNA, 14 bp, Homo sapiens
ctttccccacctct

SEQ ID NO: 3901998 - DNA, 17 bp, Homo sapiens
ctttccccacctcttcc

SEQ ID NO: 3901999 - DNA, 19 bp, Homo sapiens
ctttccccacctcttcctt

SEQ ID NO: 3902000 - DNA, 16 bp, Homo sapiens
ctttccccagacacat

SEQ ID NO: 3902001 - DNA, 21 bp, Homo sapiens
ctttccccgggggaggaaggg

SEQ ID NO: 3902002 - DNA, 22 bp, Homo sapiens
ctttccccgggggaggaagggg

SEQ ID NO: 3902003 - DNA, 16 bp, Homo sapiens
ctttcccctcagagct

SEQ ID NO: 3902004 - DNA, 20 bp, Homo sapiens
ctttccgctgtcgccccagg

SEQ ID NO: 3902005 - DNA, 21 bp, Homo sapiens
ctttccgtctccctaaaataa

SEQ ID NO: 3902006 - DNA, 17 bp, Homo sapiens
cttttatccacttacct

SEQ ID NO: 3902007 - DNA, 18 bp, Homo sapiens
cttttatgttatttatat

SEQ ID NO: 3902008 - DNA, 16 bp, Homo sapiens
cttttattgtataaac

SEQ ID NO: 3902009 - DNA, 21 bp, Homo sapiens
cttttattgtataaactatca

SEQ ID NO: 3902010 - DNA, 16 bp, Homo sapiens
cttttcactgctggct

SEQ ID NO: 3902011 - DNA, 17 bp, Homo sapiens
cttttcactgctggctg

SEQ ID NO: 3902012 - DNA, 22 bp, Homo sapiens
cttttcagtgttttttcacttt

SEQ ID NO: 3902013 - DNA, 18 bp, Homo sapiens
cttttccaggagttctga

SEQ ID NO: 3902014 - DNA, 20 bp, Homo sapiens
cttttcctattttcagccca

SEQ ID NO: 3902015 - DNA, 13 bp, Homo sapiens
cttttcctccaga

SEQ ID NO: 3902016 - DNA, 20 bp, Homo sapiens
cttttcgcttgcttctgcag

SEQ ID NO: 3902017 - DNA, 21 bp, Homo sapiens
cttttcgcttgcttctgcagc

SEQ ID NO: 3902018 - DNA, 24 bp, Homo sapiens
cttttcgcttgcttctgcagcaac

SEQ ID NO: 3902019 - DNA, 13 bp, Homo sapiens
cttttctttttcc

SEQ ID NO: 3902020 - DNA, 14 bp, Homo sapiens
cttttgactctttt

SEQ ID NO: 3902021 - DNA, 17 bp, Homo sapiens
cttttgatggggagaaa

SEQ ID NO: 3902022 - DNA, 19 bp, Homo sapiens
cttttgatggggagaaagg

SEQ ID NO: 3902023 - DNA, 20 bp, Homo sapiens
cttttgccactttggcttct

SEQ ID NO: 3902024 - DNA, 21 bp, Homo sapiens
cttttgcccttcacagtgttt

SEQ ID NO: 3902025 - DNA, 22 bp, Homo sapiens
cttttgctcttagctgtctgct

SEQ ID NO: 3902026 - DNA, 14 bp, Homo sapiens
cttttgctgtcttt

SEQ ID NO: 3902027 - DNA, 17 bp, Homo sapiens
cttttggataatatcca

SEQ ID NO: 3902028 - DNA, 19 bp, Homo sapiens
cttttgggggttggatggg

SEQ ID NO: 3902029 - DNA, 18 bp, Homo sapiens
cttttgtccccagggccc

SEQ ID NO: 3902030 - DNA, 18 bp, Homo sapiens
cttttgtgtaataagaaa

SEQ ID NO: 3902031 - DNA, 14 bp, Homo sapiens
cttttgtgtacagt

SEQ ID NO: 3902032 - DNA, 21 bp, Homo sapiens
cttttgtttaaatataaatgt

SEQ ID NO: 3902033 - DNA, 18 bp, Homo sapiens
ctttttataatgtggatt

SEQ ID NO: 3902034 - DNA, 12 bp, Homo sapiens
ctttttatactc

SEQ ID NO: 3902035 - DNA, 18 bp, Homo sapiens
ctttttatactccataca

SEQ ID NO: 3902036 - DNA, 21 bp, Homo sapiens
ctttttcagagttgctttaaa

SEQ ID NO: 3902037 - DNA, 13 bp, Homo sapiens
ctttttctggaaa

SEQ ID NO: 3902038 - DNA, 14 bp, Homo sapiens
ctttttctggaaat

SEQ ID NO: 3902039 - DNA, 16 bp, Homo sapiens
ctttttctgtctctct

SEQ ID NO: 3902040 - DNA, 18 bp, Homo sapiens
ctttttctttataaactt

SEQ ID NO: 3902041 - DNA, 11 bp, Homo sapiens
ctttttgaatg

SEQ ID NO: 3902042 - DNA, 21 bp, Homo sapiens
cttttttattctgttttcttg

SEQ ID NO: 3902043 - DNA, 21 bp, Homo sapiens
cttttttcaactggctgggac

SEQ ID NO: 3902044 - DNA, 13 bp, Homo sapiens
cttttttcctcct

SEQ ID NO: 3902045 - DNA, 15 bp, Homo sapiens
cttttttcttgagta

SEQ ID NO: 3902046 - DNA, 14 bp, Homo sapiens
ctttttttctctcc

SEQ ID NO: 3902047 - DNA, 15 bp, Homo sapiens
ctttttttctttggt

SEQ ID NO: 3902048 - DNA, 23 bp, Homo sapiens
cttttttttatacacaacattta

SEQ ID NO: 3902049 - DNA, 18 bp, Homo sapiens
gaaaaaaagtttgccaga

SEQ ID NO: 3902050 - DNA, 19 bp, Homo sapiens
gaaaaaaattacaaaatga

SEQ ID NO: 3902051 - DNA, 21 bp, Homo sapiens
gaaaaaataattgatttcaag

SEQ ID NO: 3902052 - DNA, 18 bp, Homo sapiens
gaaaaacacggcagctgt

SEQ ID NO: 3902053 - DNA, 15 bp, Homo sapiens
gaaaaaccaatgatt

SEQ ID NO: 3902054 - DNA, 20 bp, Homo sapiens
gaaaaactgatcaaaaataa

SEQ ID NO: 3902055 - DNA, 22 bp, Homo sapiens
gaaaaactgatcaaaaataaac

SEQ ID NO: 3902056 - DNA, 23 bp, Homo sapiens
gaaaaactgatcaaaaataaact

SEQ ID NO: 3902057 - DNA, 22 bp, Homo sapiens
gaaaaataccatgtctctaagc

SEQ ID NO: 3902058 - DNA, 18 bp, Homo sapiens
gaaaaatccagaaagaaa

SEQ ID NO: 3902059 - DNA, 22 bp, Homo sapiens
gaaaacaggacttaaaatgaca

SEQ ID NO: 3902060 - DNA, 19 bp, Homo sapiens
gaaaacagtcgatcaaggg

SEQ ID NO: 3902061 - DNA, 19 bp, Homo sapiens
gaaaacatcactgaaatgc

SEQ ID NO: 3902062 - DNA, 15 bp, Homo sapiens
gaaaacattcatcca

SEQ ID NO: 3902063 - DNA, 18 bp, Homo sapiens
gaaaacatttcaaagctg

SEQ ID NO: 3902064 - DNA, 19 bp, Homo sapiens
gaaaaccaagccgtggctt

SEQ ID NO: 3902065 - DNA, 12 bp, Homo sapiens
gaaaacccagag

SEQ ID NO: 3902066 - DNA, 15 bp, Homo sapiens
gaaaacccagagagg

SEQ ID NO: 3902067 - DNA, 22 bp, Homo sapiens
gaaaacccagagaggaatcaga

SEQ ID NO: 3902068 - DNA, 17 bp, Homo sapiens
gaaaacgggaaagaata

SEQ ID NO: 3902069 - DNA, 20 bp, Homo sapiens
gaaaacgggaaagaatataa

SEQ ID NO: 3902070 - DNA, 17 bp, Homo sapiens
gaaaactcattactttt

SEQ ID NO: 3902071 - DNA, 20 bp, Homo sapiens
gaaaactcctttagcaggtg

SEQ ID NO: 3902072 - DNA, 18 bp, Homo sapiens
gaaaactgaaaatctaat

SEQ ID NO: 3902073 - DNA, 14 bp, Homo sapiens
gaaaacttatttga

SEQ ID NO: 3902074 - DNA, 16 bp, Homo sapiens
gaaaacttatttgagt

SEQ ID NO: 3902075 - DNA, 15 bp, Homo sapiens
gaaaacttgaatctg

SEQ ID NO: 3902076 - DNA, 18 bp, Homo sapiens
gaaaagaatacagaaaga

SEQ ID NO: 3902077 - DNA, 16 bp, Homo sapiens
gaaaagaccctgagac

SEQ ID NO: 3902078 - DNA, 22 bp, Homo sapiens
gaaaagaccctgagactccaga

SEQ ID NO: 3902079 - DNA, 12 bp, Homo sapiens
gaaaagaggagt

SEQ ID NO: 3902080 - DNA, 13 bp, Homo sapiens
gaaaagataaaga

SEQ ID NO: 3902081 - DNA, 16 bp, Homo sapiens
gaaaagatgagaggca

SEQ ID NO: 3902082 - DNA, 18 bp, Homo sapiens
gaaaagcaattgccctgt

SEQ ID NO: 3902083 - DNA, 19 bp, Homo sapiens
gaaaagcaattgccctgta

SEQ ID NO: 3902084 - DNA, 21 bp, Homo sapiens
gaaaagcccagtgacctgacc

SEQ ID NO: 3902085 - DNA, 12 bp, Homo sapiens
gaaaaggcaaaa

SEQ ID NO: 3902086 - DNA, 14 bp, Homo sapiens
gaaaaggcctgggg

SEQ ID NO: 3902087 - DNA, 14 bp, Homo sapiens
gaaaagtacattta

SEQ ID NO: 3902088 - DNA, 16 bp, Homo sapiens
gaaaagtacatttaat

SEQ ID NO: 3902089 - DNA, 13 bp, Homo sapiens
gaaaagtagaatt

SEQ ID NO: 3902090 - DNA, 18 bp, Homo sapiens
gaaaagtagaattatatc

SEQ ID NO: 3902091 - DNA, 21 bp, Homo sapiens
gaaaagtagaattatatctaa

SEQ ID NO: 3902092 - DNA, 14 bp, Homo sapiens
gaaatatgatttta

SEQ ID NO: 3902093 - DNA, 20 bp, Homo sapiens
gaaatcaaatatgcaaagca

SEQ ID NO: 3902094 - DNA, 19 bp, Homo sapiens
gaaatcacaggggcggggc

SEQ ID NO: 3902095 - DNA, 22 bp, Homo sapiens
gaaatcacaggggcggggcagg

SEQ ID NO: 3902096 - DNA, 20 bp, Homo sapiens
gaaatccagtttcccaccac

SEQ ID NO: 3902097 - DNA, 22 bp, Homo sapiens
gaaatccctgtttaatatttaa

SEQ ID NO: 3902098 - DNA, 14 bp, Homo sapiens
gaaatcttaaaaac

SEQ ID NO: 3902099 - DNA, 14 bp, Homo sapiens
gaaatgcaaaaatc

SEQ ID NO: 3902100 - DNA, 23 bp, Homo sapiens
gaaatgcatccattcctcaggga

SEQ ID NO: 3902101 - DNA, 22 bp, Homo sapiens
gaaatgcttgtggattgagggt

SEQ ID NO: 3902102 - DNA, 20 bp, Homo sapiens
gaaatggaatcagcttttaa

SEQ ID NO: 3902103 - DNA, 17 bp, Homo sapiens
gaaatggagggtggggc

SEQ ID NO: 3902104 - DNA, 19 bp, Homo sapiens
gaaatggagggtggggccg

SEQ ID NO: 3902105 - DNA, 15 bp, Homo sapiens
gaaatgggagatggt

SEQ ID NO: 3902106 - DNA, 17 bp, Homo sapiens
gaaatggtatgagctga

SEQ ID NO: 3902107 - DNA, 21 bp, Homo sapiens
gaaatggtatgagctgagggg

SEQ ID NO: 3902108 - DNA, 16 bp, Homo sapiens
gaaattagctgtgtga

SEQ ID NO: 3902109 - DNA, 19 bp, Homo sapiens
gaaattagctgtgtgaaat

SEQ ID NO: 3902110 - DNA, 18 bp, Homo sapiens
gaaattatgtatgtttac

SEQ ID NO: 3902111 - DNA, 21 bp, Homo sapiens
gaaattatgtatgtttacata

SEQ ID NO: 3902112 - DNA, 12 bp, Homo sapiens
gaaattcctgta

SEQ ID NO: 3902113 - DNA, 15 bp, Homo sapiens
gaaattcctgtagca

SEQ ID NO: 3902114 - DNA, 16 bp, Homo sapiens
gaaattcctgtagcat

SEQ ID NO: 3902115 - DNA, 14 bp, Homo sapiens
gaaattccttccca

SEQ ID NO: 3902116 - DNA, 22 bp, Homo sapiens
gaaattgtttaagtgttgtaaa

SEQ ID NO: 3902117 - DNA, 19 bp, Homo sapiens
gaaatttattagttaatat

SEQ ID NO: 3902118 - DNA, 14 bp, Homo sapiens
gaaatttgatttct

SEQ ID NO: 3902119 - DNA, 14 bp, Homo sapiens
gaaattttatttag

SEQ ID NO: 3902120 - DNA, 18 bp, Homo sapiens
gaaattttctagactttc

SEQ ID NO: 3902121 - DNA, 13 bp, Homo sapiens
gaaattttgtcca

SEQ ID NO: 3902122 - DNA, 18 bp, Homo sapiens
gaaattttgtccatttta

SEQ ID NO: 3902123 - DNA, 13 bp, Homo sapiens
gaacaaactgatg

SEQ ID NO: 3902124 - DNA, 14 bp, Homo sapiens
gaacaaactgatgc

SEQ ID NO: 3902125 - DNA, 20 bp, Homo sapiens
gaacaacaacaacaataaca

SEQ ID NO: 3902126 - DNA, 21 bp, Homo sapiens
gaacaactaggcttcagcata

SEQ ID NO: 3902127 - DNA, 19 bp, Homo sapiens
gaacaagtcacagctgcag

SEQ ID NO: 3902128 - DNA, 20 bp, Homo sapiens
gaacaagtcacagctgcagc

SEQ ID NO: 3902129 - DNA, 23 bp, Homo sapiens
gaacaatagctattgcatgtaaa

SEQ ID NO: 3902130 - DNA, 17 bp, Homo sapiens
gaacacactcagcagcc

SEQ ID NO: 3902131 - DNA, 14 bp, Homo sapiens
gaacacccactggc

SEQ ID NO: 3902132 - DNA, 15 bp, Homo sapiens
gaacacccactggcc

SEQ ID NO: 3902133 - DNA, 18 bp, Homo sapiens
gaacacccactggccagt

SEQ ID NO: 3902134 - DNA, 21 bp, Homo sapiens
gaacacctttgttttgcactg

SEQ ID NO: 3902135 - DNA, 16 bp, Homo sapiens
gaacagacaggagaaa

SEQ ID NO: 3902136 - DNA, 18 bp, Homo sapiens
gaacagacaggagaaatg

SEQ ID NO: 3902137 - DNA, 19 bp, Homo sapiens
gaacaggcaagtgaagaaa

SEQ ID NO: 3902138 - DNA, 16 bp, Homo sapiens
gaacaggtggatgtat

SEQ ID NO: 3902139 - DNA, 14 bp, Homo sapiens
gaacagtaactgcc

SEQ ID NO: 3902140 - DNA, 15 bp, Homo sapiens
gaacataaaatacaa

SEQ ID NO: 3902141 - DNA, 22 bp, Homo sapiens
gaacataaagcaaatagacaca

SEQ ID NO: 3902142 - DNA, 23 bp, Homo sapiens
gaacatccaaggagaaacagaga

SEQ ID NO: 3902143 - DNA, 18 bp, Homo sapiens
gaacatgcacatttatat

SEQ ID NO: 3902144 - DNA, 20 bp, Homo sapiens
gaacatgccctcagctaagc

SEQ ID NO: 3902145 - DNA, 13 bp, Homo sapiens
gaacatttgcttt

SEQ ID NO: 3902146 - DNA, 14 bp, Homo sapiens
gaaccaagcttcag

SEQ ID NO: 3902147 - DNA, 17 bp, Homo sapiens
gaaccaagcttcagagc

SEQ ID NO: 3902148 - DNA, 20 bp, Homo sapiens
gaaccaagcttcagagccta

SEQ ID NO: 3902149 - DNA, 17 bp, Homo sapiens
gaaccaaggcagcctcc

SEQ ID NO: 3902150 - DNA, 23 bp, Homo sapiens
gaaccaaggcagcctccagagcc

SEQ ID NO: 3902151 - DNA, 22 bp, Homo sapiens
gaaccacagcggaggagctccg

SEQ ID NO: 3902152 - DNA, 13 bp, Homo sapiens
gaacccacctgct

SEQ ID NO: 3902153 - DNA, 15 bp, Homo sapiens
gaacccacctgctga

SEQ ID NO: 3902154 - DNA, 19 bp, Homo sapiens
gaacccacctgctgagaga

SEQ ID NO: 3902155 - DNA, 14 bp, Homo sapiens
gaacccagccctgg

SEQ ID NO: 3902156 - DNA, 12 bp, Homo sapiens
gaacccaggaca

SEQ ID NO: 3902157 - DNA, 19 bp, Homo sapiens
gaacccaggacaagcatgg

SEQ ID NO: 3902158 - DNA, 15 bp, Homo sapiens
gaaccccatgggctt

SEQ ID NO: 3902159 - DNA, 16 bp, Homo sapiens
gaaccccatgggcttg

SEQ ID NO: 3902160 - DNA, 13 bp, Homo sapiens
gaaccccgcagcc

SEQ ID NO: 3902161 - DNA, 21 bp, Homo sapiens
gaacccctacatgaaacagaa

SEQ ID NO: 3902162 - DNA, 10 bp, Homo sapiens
gaacccctgt

SEQ ID NO: 3902163 - DNA, 12 bp, Homo sapiens
gaacccctgtgt

SEQ ID NO: 3902164 - DNA, 16 bp, Homo sapiens
gaacccttttcctcca

SEQ ID NO: 3902165 - DNA, 14 bp, Homo sapiens
gaacctagaagggc

SEQ ID NO: 3902166 - DNA, 14 bp, Homo sapiens
gaacctcaaactgg

SEQ ID NO: 3902167 - DNA, 16 bp, Homo sapiens
gaacctggagggctag

SEQ ID NO: 3902168 - DNA, 17 bp, Homo sapiens
gaacctggaggggctag

SEQ ID NO: 3902169 - DNA, 13 bp, Homo sapiens
gaacctggccttc

SEQ ID NO: 3902170 - DNA, 14 bp, Homo sapiens
gaacctgtactggg

SEQ ID NO: 3902171 - DNA, 15 bp, Homo sapiens
gaacctgtagagcta

SEQ ID NO: 3902172 - DNA, 10 bp, Homo sapiens
gaaccttccc

SEQ ID NO: 3902173 - DNA, 21 bp, Homo sapiens
gaaccttggtaaattgtaaac

SEQ ID NO: 3902174 - DNA, 14 bp, Homo sapiens
gaacgagcactggc

SEQ ID NO: 3902175 - DNA, 17 bp, Homo sapiens
gaacgagcactggccag

SEQ ID NO: 3902176 - DNA, 15 bp, Homo sapiens
gaacggaagggttgg

SEQ ID NO: 3902177 - DNA, 22 bp, Homo sapiens
gaacggagccccaggcctctgt

SEQ ID NO: 3902178 - DNA, 14 bp, Homo sapiens
gaacggggagaaaa

SEQ ID NO: 3902179 - DNA, 21 bp, Homo sapiens
gaagctgatgctttgcttcaa

SEQ ID NO: 3902180 - DNA, 22 bp, Homo sapiens
gaagctgtacccaatttaattc

SEQ ID NO: 3902181 - DNA, 23 bp, Homo sapiens
gaagctgtactcagagcagagca

SEQ ID NO: 3902182 - DNA, 23 bp, Homo sapiens
gaagctgtagtagccctttctgt

SEQ ID NO: 3902183 - DNA, 18 bp, Homo sapiens
gaagctttaccagctgaa

SEQ ID NO: 3902184 - DNA, 16 bp, Homo sapiens
gaaggaaggaggcaga

SEQ ID NO: 3902185 - DNA, 18 bp, Homo sapiens
gaaggaaggaggcagact

SEQ ID NO: 3902186 - DNA, 20 bp, Homo sapiens
gaaggaaggcagggaggagg

SEQ ID NO: 3902187 - DNA, 15 bp, Homo sapiens
gaaggaatagccaga

SEQ ID NO: 3902188 - DNA, 12 bp, Homo sapiens
gaaggagaaagg

SEQ ID NO: 3902189 - DNA, 18 bp, Homo sapiens
gaaggagaaaggagccgg

SEQ ID NO: 3902190 - DNA, 22 bp, Homo sapiens
gaaggagactcacctctgcctc

SEQ ID NO: 3902191 - DNA, 23 bp, Homo sapiens
gaaggagactcacctctgcctca

SEQ ID NO: 3902192 - DNA, 17 bp, Homo sapiens
gaaggaggcagactgat

SEQ ID NO: 3902193 - DNA, 14 bp, Homo sapiens
gaaggagggcagag

SEQ ID NO: 3902194 - DNA, 17 bp, Homo sapiens
gaaggagggcagagcca

SEQ ID NO: 3902195 - DNA, 20 bp, Homo sapiens
gaaggagggcagagccatgg

SEQ ID NO: 3902196 - DNA, 21 bp, Homo sapiens
gaaggagggcagagccatggg

SEQ ID NO: 3902197 - DNA, 13 bp, Homo sapiens
gaaggaggtgagg

SEQ ID NO: 3902198 - DNA, 18 bp, Homo sapiens
gaaggcaaagcccctgga

SEQ ID NO: 3902199 - DNA, 18 bp, Homo sapiens
gaaggcaaatataagctg

SEQ ID NO: 3902200 - DNA, 13 bp, Homo sapiens
gaaggcagctgct

SEQ ID NO: 3902201 - DNA, 15 bp, Homo sapiens
gaaggcagctgctct

SEQ ID NO: 3902202 - DNA, 22 bp, Homo sapiens
gaaggcaggcagggctctcctg

SEQ ID NO: 3902203 - DNA, 23 bp, Homo sapiens
gaaggcaggcagggctctcctgg

SEQ ID NO: 3902204 - DNA, 23 bp, Homo sapiens
gaaggcagggacagagatggagg

SEQ ID NO: 3902205 - DNA, 14 bp, Homo sapiens
gaaggcagggagga

SEQ ID NO: 3902206 - DNA, 14 bp, Homo sapiens
gaaggcagggcaga

SEQ ID NO: 3902207 - DNA, 16 bp, Homo sapiens
gaaggcagtctgaacc

SEQ ID NO: 3902208 - DNA, 21 bp, Homo sapiens
gaaggcctcttgtgctcacgc

SEQ ID NO: 3902209 - DNA, 21 bp, Homo sapiens
gaaggctacttcggggctggg

SEQ ID NO: 3902210 - DNA, 20 bp, Homo sapiens
gaaggctgcctaaggaggag

SEQ ID NO: 3902211 - DNA, 15 bp, Homo sapiens
gaaggctggctgagt

SEQ ID NO: 3902212 - DNA, 16 bp, Homo sapiens
gaaggctggggccagt

SEQ ID NO: 3902213 - DNA, 19 bp, Homo sapiens
gaaggctggggccagtgta

SEQ ID NO: 3902214 - DNA, 23 bp, Homo sapiens
gaaggctttgccatgggcctgct

SEQ ID NO: 3902215 - DNA, 14 bp, Homo sapiens
gaagggaaatctta

SEQ ID NO: 3902216 - DNA, 18 bp, Homo sapiens
gaagggaccttgaagggt

SEQ ID NO: 3902217 - DNA, 12 bp, Homo sapiens
gaagggagaagg

SEQ ID NO: 3902218 - DNA, 16 bp, Homo sapiens
gaagggaggggtcctg

SEQ ID NO: 3902219 - DNA, 16 bp, Homo sapiens
gaagggccagccctac

SEQ ID NO: 3902220 - DNA, 18 bp, Homo sapiens
gaagggccaggagagaga

SEQ ID NO: 3902221 - DNA, 21 bp, Homo sapiens
gaagggccaggagagagatct

SEQ ID NO: 3902222 - DNA, 18 bp, Homo sapiens
gaagggccagtctgggct

SEQ ID NO: 3902223 - DNA, 19 bp, Homo sapiens
gaagggccagtctgggctg

SEQ ID NO: 3902224 - DNA, 20 bp, Homo sapiens
gaagggctagaacctggaga

SEQ ID NO: 3902225 - DNA, 20 bp, Homo sapiens
gaaggggacgcgggctgtgc

SEQ ID NO: 3902226 - DNA, 13 bp, Homo sapiens
gaaggggcacacc

SEQ ID NO: 3902227 - DNA, 22 bp, Homo sapiens
gaaggggcacaccactgccctg

SEQ ID NO: 3902228 - DNA, 19 bp, Homo sapiens
gaaggggccccggggctgg

SEQ ID NO: 3902229 - DNA, 22 bp, Homo sapiens
gaagggggattggagggaagac

SEQ ID NO: 3902230 - DNA, 16 bp, Homo sapiens
gaaggggtgccctctg

SEQ ID NO: 3902231 - DNA, 19 bp, Homo sapiens
gaagggtggtctgagcacc

SEQ ID NO: 3902232 - DNA, 22 bp, Homo sapiens
gaagggtggtctgagcaccccc

SEQ ID NO: 3902233 - DNA, 18 bp, Homo sapiens
gaagggttggtgggctgg

SEQ ID NO: 3902234 - DNA, 21 bp, Homo sapiens
gaagggttggtgggctggccc

SEQ ID NO: 3902235 - DNA, 23 bp, Homo sapiens
gaagggttggtgggctggcccag

SEQ ID NO: 3902236 - DNA, 20 bp, Homo sapiens
gaaggtttggtgtgtggaga

SEQ ID NO: 3902237 - DNA, 15 bp, Homo sapiens
gaaggtttgtatatt

SEQ ID NO: 3902238 - DNA, 16 bp, Homo sapiens
gaagtaacttttacaa

SEQ ID NO: 3902239 - DNA, 19 bp, Homo sapiens
gaagtagtttgtataactt

SEQ ID NO: 3902240 - DNA, 11 bp, Homo sapiens
gaagtatgtgt

SEQ ID NO: 3902241 - DNA, 20 bp, Homo sapiens
gaagtcagcccgaatgcctg

SEQ ID NO: 3902242 - DNA, 17 bp, Homo sapiens
gaagtccccaggtcatg

SEQ ID NO: 3902243 - DNA, 22 bp, Homo sapiens
gaagtcgtccttactcctgtgg

SEQ ID NO: 3902244 - DNA, 18 bp, Homo sapiens
gaagtcttacttaaaaaa

SEQ ID NO: 3902245 - DNA, 18 bp, Homo sapiens
gaagtctttgttgcacca

SEQ ID NO: 3902246 - DNA, 14 bp, Homo sapiens
gaagtgaaggagaa

SEQ ID NO: 3902247 - DNA, 17 bp, Homo sapiens
gaagtgaataactgcaa

SEQ ID NO: 3902248 - DNA, 14 bp, Homo sapiens
gaagtgctccccac

SEQ ID NO: 3902249 - DNA, 22 bp, Homo sapiens
gaagtggaccaggacaggacca

SEQ ID NO: 3902250 - DNA, 19 bp, Homo sapiens
gaagtgttcaagaaataaa

SEQ ID NO: 3902251 - DNA, 19 bp, Homo sapiens
gaagttacacaattaattg

SEQ ID NO: 3902252 - DNA, 23 bp, Homo sapiens
gaagttattaacgggcatgtatt

SEQ ID NO: 3902253 - DNA, 13 bp, Homo sapiens
gaagttctgagcc

SEQ ID NO: 3902254 - DNA, 19 bp, Homo sapiens
gaagtttgatattaaagga

SEQ ID NO: 3902255 - DNA, 12 bp, Homo sapiens
gaataaacttca

SEQ ID NO: 3902256 - DNA, 13 bp, Homo sapiens
gaataaacttcag

SEQ ID NO: 3902257 - DNA, 14 bp, Homo sapiens
gaataaacttcagc

SEQ ID NO: 3902258 - DNA, 15 bp, Homo sapiens
gaataaacttcagca

SEQ ID NO: 3902259 - DNA, 17 bp, Homo sapiens
gaataaagcctgctttt

SEQ ID NO: 3902260 - DNA, 12 bp, Homo sapiens
gaataaatgttc

SEQ ID NO: 3902261 - DNA, 15 bp, Homo sapiens
gaataaatgttcaaa

SEQ ID NO: 3902262 - DNA, 14 bp, Homo sapiens
gaataagtgctgtt

SEQ ID NO: 3902263 - DNA, 12 bp, Homo sapiens
gaataatagaag

SEQ ID NO: 3902264 - DNA, 15 bp, Homo sapiens
gaataatagaagaac

SEQ ID NO: 3902265 - DNA, 20 bp, Homo sapiens
gacaaagaggcctttaacca

SEQ ID NO: 3902266 - DNA, 15 bp, Homo sapiens
gacaaaggagcctgt

SEQ ID NO: 3902267 - DNA, 18 bp, Homo sapiens
gacaaaggttttcctctt

SEQ ID NO: 3902268 - DNA, 12 bp, Homo sapiens
gacaacagaagc

SEQ ID NO: 3902269 - DNA, 16 bp, Homo sapiens
gacaacatcccacagt

SEQ ID NO: 3902270 - DNA, 16 bp, Homo sapiens
gacaagaaatccctgt

SEQ ID NO: 3902271 - DNA, 17 bp, Homo sapiens
gacaagaaggccactgg

SEQ ID NO: 3902272 - DNA, 13 bp, Homo sapiens
gacaagagctgct

SEQ ID NO: 3902273 - DNA, 12 bp, Homo sapiens
gacaagcagagg

SEQ ID NO: 3902274 - DNA, 15 bp, Homo sapiens
gacaagccctggcaa

SEQ ID NO: 3902275 - DNA, 12 bp, Homo sapiens
gacaagggctga

SEQ ID NO: 3902276 - DNA, 21 bp, Homo sapiens
gacaagggctgacctgcctct

SEQ ID NO: 3902277 - DNA, 20 bp, Homo sapiens
gacaatatgattttaaattt

SEQ ID NO: 3902278 - DNA, 21 bp, Homo sapiens
gacaatccactctcaggaggc

SEQ ID NO: 3902279 - DNA, 21 bp, Homo sapiens
gacaatccccacataccatct

SEQ ID NO: 3902280 - DNA, 15 bp, Homo sapiens
gacaatcctgaagaa

SEQ ID NO: 3902281 - DNA, 13 bp, Homo sapiens
gacaatggcagct

SEQ ID NO: 3902282 - DNA, 15 bp, Homo sapiens
gacaatggcagctag

SEQ ID NO: 3902283 - DNA, 21 bp, Homo sapiens
gacaatggcagctagactgga

SEQ ID NO: 3902284 - DNA, 15 bp, Homo sapiens
gacaattgtcttttt

SEQ ID NO: 3902285 - DNA, 22 bp, Homo sapiens
gacaatttatatttaataaaat

SEQ ID NO: 3902286 - DNA, 10 bp, Homo sapiens
gacacacaca

SEQ ID NO: 3902287 - DNA, 15 bp, Homo sapiens
gacacacacacacac

SEQ ID NO: 3902288 - DNA, 10 bp, Homo sapiens
gacacactgt

SEQ ID NO: 3902289 - DNA, 21 bp, Homo sapiens
gacacagagtggagccctcag

SEQ ID NO: 3902290 - DNA, 18 bp, Homo sapiens
gacacagatacatgggga

SEQ ID NO: 3902291 - DNA, 13 bp, Homo sapiens
gacacagcgtccc

SEQ ID NO: 3902292 - DNA, 22 bp, Homo sapiens
gacacagcgtccctagcagtga

SEQ ID NO: 3902293 - DNA, 14 bp, Homo sapiens
gacacaggcctgtg

SEQ ID NO: 3902294 - DNA, 16 bp, Homo sapiens
gacacatcccggcctc

SEQ ID NO: 3902295 - DNA, 19 bp, Homo sapiens
gacacattttctcctagga

SEQ ID NO: 3902296 - DNA, 15 bp, Homo sapiens
gacacccattttcac

SEQ ID NO: 3902297 - DNA, 17 bp, Homo sapiens
gacaccccttatccagg

SEQ ID NO: 3902298 - DNA, 21 bp, Homo sapiens
gacaccccttatccaggactc

SEQ ID NO: 3902299 - DNA, 17 bp, Homo sapiens
gacaccgtttgtccccc

SEQ ID NO: 3902300 - DNA, 17 bp, Homo sapiens
gacacctactgagtggc

SEQ ID NO: 3902301 - DNA, 14 bp, Homo sapiens
gacacctgccccag

SEQ ID NO: 3902302 - DNA, 15 bp, Homo sapiens
gacacctgccccagc

SEQ ID NO: 3902303 - DNA, 15 bp, Homo sapiens
gacacctgccctgcc

SEQ ID NO: 3902304 - DNA, 22 bp, Homo sapiens
gacacctgccctgccctgccac

SEQ ID NO: 3902305 - DNA, 16 bp, Homo sapiens
gacacggtaggccaag

SEQ ID NO: 3902306 - DNA, 18 bp, Homo sapiens
gacacggtgaaatccagg

SEQ ID NO: 3902307 - DNA, 22 bp, Homo sapiens
gacacggtgaaatccaggtctc

SEQ ID NO: 3902308 - DNA, 16 bp, Homo sapiens
gacacgtggcctgcac

SEQ ID NO: 3902309 - DNA, 13 bp, Homo sapiens
gacactcccaggg

SEQ ID NO: 3902310 - DNA, 16 bp, Homo sapiens
gacactgccacacagg

SEQ ID NO: 3902311 - DNA, 20 bp, Homo sapiens
gacactgctgcaccagagtg

SEQ ID NO: 3902312 - DNA, 21 bp, Homo sapiens
gacactgctgcaccagagtga

SEQ ID NO: 3902313 - DNA, 23 bp, Homo sapiens
gacacttgccttcttcacccagc

SEQ ID NO: 3902314 - DNA, 14 bp, Homo sapiens
gacagaaaaaaata

SEQ ID NO: 3902315 - DNA, 20 bp, Homo sapiens
gacagaaaaaaataaaaaca

SEQ ID NO: 3902316 - DNA, 16 bp, Homo sapiens
gacagaaacagagaga

SEQ ID NO: 3902317 - DNA, 18 bp, Homo sapiens
gacagaaacagagagaga

SEQ ID NO: 3902318 - DNA, 19 bp, Homo sapiens
gacagaaacagagagagac

SEQ ID NO: 3902319 - DNA, 20 bp, Homo sapiens
gacagaacccctacatgaaa

SEQ ID NO: 3902320 - DNA, 20 bp, Homo sapiens
gacagagaaatgtgaagggt

SEQ ID NO: 3902321 - DNA, 22 bp, Homo sapiens
gacagagacacctgcacctccc

SEQ ID NO: 3902322 - DNA, 16 bp, Homo sapiens
gacagagacagagaga

SEQ ID NO: 3902323 - DNA, 15 bp, Homo sapiens
gacagagagagactg

SEQ ID NO: 3902324 - DNA, 17 bp, Homo sapiens
gacagagagagactgag

SEQ ID NO: 3902325 - DNA, 16 bp, Homo sapiens
gacagagcccccaagc

SEQ ID NO: 3902326 - DNA, 21 bp, Homo sapiens
gacagagcccccaagcctctg

SEQ ID NO: 3902327 - DNA, 17 bp, Homo sapiens
gacagagccctgtgagg

SEQ ID NO: 3902328 - DNA, 20 bp, Homo sapiens
gacagagctggctgtcttcc

SEQ ID NO: 3902329 - DNA, 12 bp, Homo sapiens
gacagaggaggg

SEQ ID NO: 3902330 - DNA, 13 bp, Homo sapiens
gacagataactct

SEQ ID NO: 3902331 - DNA, 18 bp, Homo sapiens
gacagatgtcagccgagc

SEQ ID NO: 3902332 - DNA, 16 bp, Homo sapiens
gacagcaggtgggaaa

SEQ ID NO: 3902333 - DNA, 11 bp, Homo sapiens
gacagccaggt

SEQ ID NO: 3902334 - DNA, 14 bp, Homo sapiens
gacagccccagggc

SEQ ID NO: 3902335 - DNA, 12 bp, Homo sapiens
gacagcctggca

SEQ ID NO: 3902336 - DNA, 20 bp, Homo sapiens
gacagcctgtggcggtgcct

SEQ ID NO: 3902337 - DNA, 22 bp, Homo sapiens
gacagcctgtggcggtgcctgg

SEQ ID NO: 3902338 - DNA, 14 bp, Homo sapiens
gacagctgacagat

SEQ ID NO: 3902339 - DNA, 13 bp, Homo sapiens
gacaggaaagaat

SEQ ID NO: 3902340 - DNA, 16 bp, Homo sapiens
gacaggaaagccctcc

SEQ ID NO: 3902341 - DNA, 17 bp, Homo sapiens
gacaggagggcaagggc

SEQ ID NO: 3902342 - DNA, 21 bp, Homo sapiens
gacaggaggggcccacaatgg

SEQ ID NO: 3902343 - DNA, 11 bp, Homo sapiens
gacaggcccaa

SEQ ID NO: 3902344 - DNA, 15 bp, Homo sapiens
gacaggcccaagaga

SEQ ID NO: 3902345 - DNA, 19 bp, Homo sapiens
gacaggcgctggacagagg

SEQ ID NO: 3902346 - DNA, 16 bp, Homo sapiens
gacaggtaaatgggca

SEQ ID NO: 3902347 - DNA, 15 bp, Homo sapiens
gacaggtctagactt

SEQ ID NO: 3902348 - DNA, 15 bp, Homo sapiens
gacaggttcccagca

SEQ ID NO: 3902349 - DNA, 16 bp, Homo sapiens
gacaggttcccagcag

SEQ ID NO: 3902350 - DNA, 17 bp, Homo sapiens
gacaggttcccagcagc

SEQ ID NO: 3902351 - DNA, 18 bp, Homo sapiens
gacaggttcccagcagct

SEQ ID NO: 3902352 - DNA, 14 bp, Homo sapiens
gactatcacataca

SEQ ID NO: 3902353 - DNA, 16 bp, Homo sapiens
gactatcacatacaat

SEQ ID NO: 3902354 - DNA, 20 bp, Homo sapiens
gactatcacatacaatttgc

SEQ ID NO: 3902355 - DNA, 16 bp, Homo sapiens
gactatggagcctggc

SEQ ID NO: 3902356 - DNA, 15 bp, Homo sapiens
gactattcaaacagt

SEQ ID NO: 3902357 - DNA, 16 bp, Homo sapiens
gactatttaacttgag

SEQ ID NO: 3902358 - DNA, 14 bp, Homo sapiens
gactatttccacca

SEQ ID NO: 3902359 - DNA, 15 bp, Homo sapiens
gactcacctctgcct

SEQ ID NO: 3902360 - DNA, 18 bp, Homo sapiens
gactcacctctgcctcaa

SEQ ID NO: 3902361 - DNA, 17 bp, Homo sapiens
gactcaggatccagtcc

SEQ ID NO: 3902362 - DNA, 17 bp, Homo sapiens
gactcatggcttagaaa

SEQ ID NO: 3902363 - DNA, 12 bp, Homo sapiens
gactccaaagaa

SEQ ID NO: 3902364 - DNA, 15 bp, Homo sapiens
gactccaaagaaatg

SEQ ID NO: 3902365 - DNA, 18 bp, Homo sapiens
gactccaaagaaatgtaa

SEQ ID NO: 3902366 - DNA, 17 bp, Homo sapiens
gactccaagaacaattg

SEQ ID NO: 3902367 - DNA, 12 bp, Homo sapiens
gactccagagtc

SEQ ID NO: 3902368 - DNA, 20 bp, Homo sapiens
gactccagagtctgagcccc

SEQ ID NO: 3902369 - DNA, 23 bp, Homo sapiens
gactccagcgcctgccctccctg

SEQ ID NO: 3902370 - DNA, 16 bp, Homo sapiens
gactccccaggccagg

SEQ ID NO: 3902371 - DNA, 18 bp, Homo sapiens
gactccccaggccaggcc

SEQ ID NO: 3902372 - DNA, 19 bp, Homo sapiens
gactccctccatgtggccc

SEQ ID NO: 3902373 - DNA, 12 bp, Homo sapiens
gactccctgtgg

SEQ ID NO: 3902374 - DNA, 14 bp, Homo sapiens
gactccctgtgggg

SEQ ID NO: 3902375 - DNA, 23 bp, Homo sapiens
gactccctgtgggggtggccatc

SEQ ID NO: 3902376 - DNA, 13 bp, Homo sapiens
gactcctcccaca

SEQ ID NO: 3902377 - DNA, 11 bp, Homo sapiens
gactcctctgt

SEQ ID NO: 3902378 - DNA, 14 bp, Homo sapiens
gactcctgccctgt

SEQ ID NO: 3902379 - DNA, 16 bp, Homo sapiens
gactcctgtgcaactt

SEQ ID NO: 3902380 - DNA, 16 bp, Homo sapiens
gactctaagctggagc

SEQ ID NO: 3902381 - DNA, 15 bp, Homo sapiens
gactctgaaaaacat

SEQ ID NO: 3902382 - DNA, 13 bp, Homo sapiens
gactctggcctcc

SEQ ID NO: 3902383 - DNA, 13 bp, Homo sapiens
gactcttcctgca

SEQ ID NO: 3902384 - DNA, 16 bp, Homo sapiens
gactcttcctgcaaag

SEQ ID NO: 3902385 - DNA, 14 bp, Homo sapiens
gactgaaagcagca

SEQ ID NO: 3902386 - DNA, 16 bp, Homo sapiens
gactgaaagcagcagc

SEQ ID NO: 3902387 - DNA, 17 bp, Homo sapiens
gactgaaagcagcagct

SEQ ID NO: 3902388 - DNA, 13 bp, Homo sapiens
gactgaaggggca

SEQ ID NO: 3902389 - DNA, 16 bp, Homo sapiens
gactgaaggggcacac

SEQ ID NO: 3902390 - DNA, 21 bp, Homo sapiens
gactgacaagaagctcccaga

SEQ ID NO: 3902391 - DNA, 16 bp, Homo sapiens
gactgagactggcact

SEQ ID NO: 3902392 - DNA, 14 bp, Homo sapiens
gactgagcacctgc

SEQ ID NO: 3902393 - DNA, 13 bp, Homo sapiens
gactgaggagtgg

SEQ ID NO: 3902394 - DNA, 21 bp, Homo sapiens
gactgatgttgagggaacaga

SEQ ID NO: 3902395 - DNA, 13 bp, Homo sapiens
gactgcagctgct

SEQ ID NO: 3902396 - DNA, 20 bp, Homo sapiens
gactgccagtccccctgccc

SEQ ID NO: 3902397 - DNA, 19 bp, Homo sapiens
gactgctccccagccctgg

SEQ ID NO: 3902398 - DNA, 20 bp, Homo sapiens
gactggagaccgcttcaccc

SEQ ID NO: 3902399 - DNA, 21 bp, Homo sapiens
gactggagaccgcttcacccc

SEQ ID NO: 3902400 - DNA, 14 bp, Homo sapiens
gactggagcatctg

SEQ ID NO: 3902401 - DNA, 21 bp, Homo sapiens
gactggagcccgagggcctga

SEQ ID NO: 3902402 - DNA, 21 bp, Homo sapiens
gactggagtgaggcttccagg

SEQ ID NO: 3902403 - DNA, 18 bp, Homo sapiens
gactggcacagttttctg

SEQ ID NO: 3902404 - DNA, 23 bp, Homo sapiens
gactggcaggtgcagatgggctg

SEQ ID NO: 3902405 - DNA, 16 bp, Homo sapiens
gactgggaccaggcac

SEQ ID NO: 3902406 - DNA, 17 bp, Homo sapiens
gactggggatgtgggag

SEQ ID NO: 3902407 - DNA, 23 bp, Homo sapiens
gactggggatgtgggagggagca

SEQ ID NO: 3902408 - DNA, 19 bp, Homo sapiens
gactggtgctataggctgg

SEQ ID NO: 3902409 - DNA, 22 bp, Homo sapiens
gactggtgctataggctggaga

SEQ ID NO: 3902410 - DNA, 23 bp, Homo sapiens
gactggtgctataggctggagaa

SEQ ID NO: 3902411 - DNA, 23 bp, Homo sapiens
gactgtactcctcccaggcgccc

SEQ ID NO: 3902412 - DNA, 16 bp, Homo sapiens
gactgtcgtgtttaca

SEQ ID NO: 3902413 - DNA, 17 bp, Homo sapiens
gactgtcgtgtttacaa

SEQ ID NO: 3902414 - DNA, 19 bp, Homo sapiens
gactgtcgtgtttacaaaa

SEQ ID NO: 3902415 - DNA, 22 bp, Homo sapiens
gactgtctcaagagggcactgg

SEQ ID NO: 3902416 - DNA, 19 bp, Homo sapiens
gacttaaaatattcctgca

SEQ ID NO: 3902417 - DNA, 16 bp, Homo sapiens
gacttaacggctccag

SEQ ID NO: 3902418 - DNA, 14 bp, Homo sapiens
gacttaagattaaa

SEQ ID NO: 3902419 - DNA, 15 bp, Homo sapiens
gacttcacaaaatgc

SEQ ID NO: 3902420 - DNA, 18 bp, Homo sapiens
gacttcagaacatgctgg

SEQ ID NO: 3902421 - DNA, 21 bp, Homo sapiens
gacttcagaacatgctggata

SEQ ID NO: 3902422 - DNA, 18 bp, Homo sapiens
gacttcctcgcctctccc

SEQ ID NO: 3902423 - DNA, 19 bp, Homo sapiens
gacttcctcgcctctccca

SEQ ID NO: 3902424 - DNA, 13 bp, Homo sapiens
gacttcctggggc

SEQ ID NO: 3902425 - DNA, 15 bp, Homo sapiens
gacttcctggggccc

SEQ ID NO: 3902426 - DNA, 16 bp, Homo sapiens
gacttctaagtaaaac

SEQ ID NO: 3902427 - DNA, 23 bp, Homo sapiens
gacttctaagtaaaaccacagca

SEQ ID NO: 3902428 - DNA, 19 bp, Homo sapiens
gacttctggaaggctggct

SEQ ID NO: 3902429 - DNA, 20 bp, Homo sapiens
gacttctgtcttcacaacag

SEQ ID NO: 3902430 - DNA, 19 bp, Homo sapiens
gacttgaggattttgagta

SEQ ID NO: 3902431 - DNA, 20 bp, Homo sapiens
gacttgcacatctctgcagt

SEQ ID NO: 3902432 - DNA, 14 bp, Homo sapiens
gacttggtctgatt

SEQ ID NO: 3902433 - DNA, 10 bp, Homo sapiens
gacttgtgcc

SEQ ID NO: 3902434 - DNA, 16 bp, Homo sapiens
gacttgtgtctctgtg

SEQ ID NO: 3902435 - DNA, 13 bp, Homo sapiens
gactttttataat

SEQ ID NO: 3902436 - DNA, 22 bp, Homo sapiens
gactttttataatgtggatttc

SEQ ID NO: 3902437 - DNA, 12 bp, Homo sapiens
gagaaaaaccaa

SEQ ID NO: 3902438 - DNA, 17 bp, Homo sapiens
gagaaaaactttcattt

SEQ ID NO: 3902439 - DNA, 16 bp, Homo sapiens
gagactggtcctgtgt

SEQ ID NO: 3902440 - DNA, 17 bp, Homo sapiens
gagacttggggaccaga

SEQ ID NO: 3902441 - DNA, 13 bp, Homo sapiens
gagacttgtatga

SEQ ID NO: 3902442 - DNA, 20 bp, Homo sapiens
gagagaaaacttatttgagt

SEQ ID NO: 3902443 - DNA, 15 bp, Homo sapiens
gagagaagaaagtgt

SEQ ID NO: 3902444 - DNA, 16 bp, Homo sapiens
gagagaagccacgctg

SEQ ID NO: 3902445 - DNA, 19 bp, Homo sapiens
gagagaatatttcaaatga

SEQ ID NO: 3902446 - DNA, 14 bp, Homo sapiens
gagagaatctgcct

SEQ ID NO: 3902447 - DNA, 19 bp, Homo sapiens
gagagacccaaggaggaaa

SEQ ID NO: 3902448 - DNA, 17 bp, Homo sapiens
gagagactgaaagcagc

SEQ ID NO: 3902449 - DNA, 18 bp, Homo sapiens
gagagactgaaagcagca

SEQ ID NO: 3902450 - DNA, 22 bp, Homo sapiens
gagagagactgagggagagact

SEQ ID NO: 3902451 - DNA, 18 bp, Homo sapiens
gagagaggatgcagaggg

SEQ ID NO: 3902452 - DNA, 12 bp, Homo sapiens
gagagaggggaa

SEQ ID NO: 3902453 - DNA, 22 bp, Homo sapiens
gagagaggttctggggaggaag

SEQ ID NO: 3902454 - DNA, 13 bp, Homo sapiens
gagagcacttgaa

SEQ ID NO: 3902455 - DNA, 14 bp, Homo sapiens
gagagcagaaataa

SEQ ID NO: 3902456 - DNA, 11 bp, Homo sapiens
gagagcagctg

SEQ ID NO: 3902457 - DNA, 11 bp, Homo sapiens
gagagccagcc

SEQ ID NO: 3902458 - DNA, 12 bp, Homo sapiens
gagagccagctc

SEQ ID NO: 3902459 - DNA, 14 bp, Homo sapiens
gagagccagctctc

SEQ ID NO: 3902460 - DNA, 16 bp, Homo sapiens
gagagccctggtccta

SEQ ID NO: 3902461 - DNA, 14 bp, Homo sapiens
gagagcctcttagt

SEQ ID NO: 3902462 - DNA, 14 bp, Homo sapiens
gagagcctgctccc

SEQ ID NO: 3902463 - DNA, 17 bp, Homo sapiens
gagagcctgctccccca

SEQ ID NO: 3902464 - DNA, 22 bp, Homo sapiens
gagagcctgctcccccaccccc

SEQ ID NO: 3902465 - DNA, 23 bp, Homo sapiens
gagagcctgctcccccaccccct

SEQ ID NO: 3902466 - DNA, 19 bp, Homo sapiens
gagagctagaacctggaga

SEQ ID NO: 3902467 - DNA, 13 bp, Homo sapiens
gagagctaggagc

SEQ ID NO: 3902468 - DNA, 19 bp, Homo sapiens
gagagctaggagcaaagcc

SEQ ID NO: 3902469 - DNA, 12 bp, Homo sapiens
gagaggaagatg

SEQ ID NO: 3902470 - DNA, 18 bp, Homo sapiens
gagaggaagatgaagaga

SEQ ID NO: 3902471 - DNA, 15 bp, Homo sapiens
gagaggatgcagagg

SEQ ID NO: 3902472 - DNA, 16 bp, Homo sapiens
gagaggatgcagaggg

SEQ ID NO: 3902473 - DNA, 22 bp, Homo sapiens
gagaggcagacttccctgaatg

SEQ ID NO: 3902474 - DNA, 16 bp, Homo sapiens
gagaggcagagaaaga

SEQ ID NO: 3902475 - DNA, 18 bp, Homo sapiens
gagaggccttttgtttaa

SEQ ID NO: 3902476 - DNA, 17 bp, Homo sapiens
gagagggacgaagaaag

SEQ ID NO: 3902477 - DNA, 17 bp, Homo sapiens
gagagggcccagctgta

SEQ ID NO: 3902478 - DNA, 19 bp, Homo sapiens
gagagggcccagctgtagc

SEQ ID NO: 3902479 - DNA, 14 bp, Homo sapiens
gagaggggcctggg

SEQ ID NO: 3902480 - DNA, 16 bp, Homo sapiens
gagagggggctctcca

SEQ ID NO: 3902481 - DNA, 14 bp, Homo sapiens
gagaggggtttggg

SEQ ID NO: 3902482 - DNA, 15 bp, Homo sapiens
gagaggtccctgctt

SEQ ID NO: 3902483 - DNA, 17 bp, Homo sapiens
gagaggttctggggagg

SEQ ID NO: 3902484 - DNA, 19 bp, Homo sapiens
gagaggttctggggaggaa

SEQ ID NO: 3902485 - DNA, 22 bp, Homo sapiens
gagaggttctggggaggaaggg

SEQ ID NO: 3902486 - DNA, 16 bp, Homo sapiens
gagagtaccatgctgg

SEQ ID NO: 3902487 - DNA, 16 bp, Homo sapiens
gagagttggctcaggc

SEQ ID NO: 3902488 - DNA, 18 bp, Homo sapiens
gagagttggctcaggcag

SEQ ID NO: 3902489 - DNA, 21 bp, Homo sapiens
gagagttggctcaggcagaca

SEQ ID NO: 3902490 - DNA, 22 bp, Homo sapiens
gagatatgcacacacacggatg

SEQ ID NO: 3902491 - DNA, 16 bp, Homo sapiens
gagatatgcagaagga

SEQ ID NO: 3902492 - DNA, 20 bp, Homo sapiens
gagatcaggaagagaaggag

SEQ ID NO: 3902493 - DNA, 17 bp, Homo sapiens
gagatcccgcctcttct

SEQ ID NO: 3902494 - DNA, 19 bp, Homo sapiens
gagatcttacaggtatcag

SEQ ID NO: 3902495 - DNA, 22 bp, Homo sapiens
gagatcttacaggtatcaggca

SEQ ID NO: 3902496 - DNA, 16 bp, Homo sapiens
gagatgcagaggtaaa

SEQ ID NO: 3902497 - DNA, 14 bp, Homo sapiens
gagatgcctccacc

SEQ ID NO: 3902498 - DNA, 18 bp, Homo sapiens
gagatggacccctccctt

SEQ ID NO: 3902499 - DNA, 17 bp, Homo sapiens
gagatgtaaaaggtatt

SEQ ID NO: 3902500 - DNA, 15 bp, Homo sapiens
gagattatgttcttt

SEQ ID NO: 3902501 - DNA, 22 bp, Homo sapiens
gagatttaccagggatgtagat

SEQ ID NO: 3902502 - DNA, 13 bp, Homo sapiens
gagatttcagtta

SEQ ID NO: 3902503 - DNA, 19 bp, Homo sapiens
gagatttgccagcacaggg

SEQ ID NO: 3902504 - DNA, 16 bp, Homo sapiens
gagattttcttggcag

SEQ ID NO: 3902505 - DNA, 15 bp, Homo sapiens
gagcaaatgtttctg

SEQ ID NO: 3902506 - DNA, 13 bp, Homo sapiens
gagcaacccctgt

SEQ ID NO: 3902507 - DNA, 21 bp, Homo sapiens
gagcaacccctgtacccagct

SEQ ID NO: 3902508 - DNA, 22 bp, Homo sapiens
gagcaacccctgtacccagctc

SEQ ID NO: 3902509 - DNA, 23 bp, Homo sapiens
gagcaaccgtggcccttcctgga

SEQ ID NO: 3902510 - DNA, 23 bp, Homo sapiens
gagcaagaaggaaggaggcagac

SEQ ID NO: 3902511 - DNA, 18 bp, Homo sapiens
gagcaagagagggcaagt

SEQ ID NO: 3902512 - DNA, 20 bp, Homo sapiens
gagcaaggacaacctgcccc

SEQ ID NO: 3902513 - DNA, 15 bp, Homo sapiens
gagcaatgggagggg

SEQ ID NO: 3902514 - DNA, 16 bp, Homo sapiens
gagcaattcatttcac

SEQ ID NO: 3902515 - DNA, 17 bp, Homo sapiens
gagcaattcatttcact

SEQ ID NO: 3902516 - DNA, 19 bp, Homo sapiens
gagcaattcatttcacttt

SEQ ID NO: 3902517 - DNA, 22 bp, Homo sapiens
gagcaattcatttcactttaaa

SEQ ID NO: 3902518 - DNA, 18 bp, Homo sapiens
gagcacaagttccagctg

SEQ ID NO: 3902519 - DNA, 12 bp, Homo sapiens
gagcacagccct

SEQ ID NO: 3902520 - DNA, 14 bp, Homo sapiens
gagcacaggcagct

SEQ ID NO: 3902521 - DNA, 13 bp, Homo sapiens
gagcaccctctcc

SEQ ID NO: 3902522 - DNA, 20 bp, Homo sapiens
gagcacctgaaccccatggg

SEQ ID NO: 3902523 - DNA, 12 bp, Homo sapiens
gagcacctgctt

SEQ ID NO: 3902524 - DNA, 20 bp, Homo sapiens
gagcactgccaggagggaca

SEQ ID NO: 3902525 - DNA, 12 bp, Homo sapiens
gagcactggcca

SEQ ID NO: 3902526 - DNA, 22 bp, Homo sapiens
gagctagaacctagaagggcta

SEQ ID NO: 3902527 - DNA, 17 bp, Homo sapiens
gagctagaacctggaga

SEQ ID NO: 3902528 - DNA, 18 bp, Homo sapiens
gagctaggagcaaagcct

SEQ ID NO: 3902529 - DNA, 14 bp, Homo sapiens
gagctcccccttcc

SEQ ID NO: 3902530 - DNA, 23 bp, Homo sapiens
gagctccgctaagacctccccac

SEQ ID NO: 3902531 - DNA, 15 bp, Homo sapiens
gagctcctgtcccta

SEQ ID NO: 3902532 - DNA, 17 bp, Homo sapiens
gagctcctgtccctacc

SEQ ID NO: 3902533 - DNA, 18 bp, Homo sapiens
gagctcctgtccctaccc

SEQ ID NO: 3902534 - DNA, 20 bp, Homo sapiens
gagctcctgtccctacccac

SEQ ID NO: 3902535 - DNA, 22 bp, Homo sapiens
gagctcctgtccctacccactc

SEQ ID NO: 3902536 - DNA, 23 bp, Homo sapiens
gagctcctgtccctacccactct

SEQ ID NO: 3902537 - DNA, 15 bp, Homo sapiens
gagctcgctcttggg

SEQ ID NO: 3902538 - DNA, 15 bp, Homo sapiens
gagctctgagaggcc

SEQ ID NO: 3902539 - DNA, 19 bp, Homo sapiens
gagctctgagaggccctgg

SEQ ID NO: 3902540 - DNA, 22 bp, Homo sapiens
gagctctgagaggccctggatc

SEQ ID NO: 3902541 - DNA, 16 bp, Homo sapiens
gagctctgcagagcag

SEQ ID NO: 3902542 - DNA, 19 bp, Homo sapiens
gagctgaacccattttgag

SEQ ID NO: 3902543 - DNA, 17 bp, Homo sapiens
gagctgagtcacctcct

SEQ ID NO: 3902544 - DNA, 21 bp, Homo sapiens
gagctgagtcacctcctccac

SEQ ID NO: 3902545 - DNA, 15 bp, Homo sapiens
gagctgatggagaag

SEQ ID NO: 3902546 - DNA, 19 bp, Homo sapiens
gagctgatggagaaggaag

SEQ ID NO: 3902547 - DNA, 19 bp, Homo sapiens
gagctgatttccaggcccc

SEQ ID NO: 3902548 - DNA, 21 bp, Homo sapiens
gagctgatttccaggcccctg

SEQ ID NO: 3902549 - DNA, 14 bp, Homo sapiens
gagctgctctgcta

SEQ ID NO: 3902550 - DNA, 12 bp, Homo sapiens
gagctgctgtcc

SEQ ID NO: 3902551 - DNA, 22 bp, Homo sapiens
gagctggaaataaacctggaga

SEQ ID NO: 3902552 - DNA, 23 bp, Homo sapiens
gagctggaaataaacctggagat

SEQ ID NO: 3902553 - DNA, 14 bp, Homo sapiens
gagctggaaggcag

SEQ ID NO: 3902554 - DNA, 17 bp, Homo sapiens
gagctggaaggcagggc

SEQ ID NO: 3902555 - DNA, 19 bp, Homo sapiens
gagctggaaggcagggcag

SEQ ID NO: 3902556 - DNA, 21 bp, Homo sapiens
gagctggaaggcagggcagag

SEQ ID NO: 3902557 - DNA, 23 bp, Homo sapiens
gagctggaattctaaatgctggt

SEQ ID NO: 3902558 - DNA, 18 bp, Homo sapiens
gagctgggaaacagggag

SEQ ID NO: 3902559 - DNA, 18 bp, Homo sapiens
gagctgggaggcatggcc

SEQ ID NO: 3902560 - DNA, 17 bp, Homo sapiens
gagctggggcctggaga

SEQ ID NO: 3902561 - DNA, 22 bp, Homo sapiens
gagctggggcctggagaggggc

SEQ ID NO: 3902562 - DNA, 23 bp, Homo sapiens
gagctggggcctggagaggggcc

SEQ ID NO: 3902563 - DNA, 15 bp, Homo sapiens
gagctggggtacagg

SEQ ID NO: 3902564 - DNA, 21 bp, Homo sapiens
gagctgtatatatatatgtgt

SEQ ID NO: 3902565 - DNA, 22 bp, Homo sapiens
gagctgtatatatatatgtgtg

SEQ ID NO: 3902566 - DNA, 23 bp, Homo sapiens
gagctgtatatatatatgtgtgt

SEQ ID NO: 3902567 - DNA, 21 bp, Homo sapiens
gagctgttggcctcgcctggg

SEQ ID NO: 3902568 - DNA, 17 bp, Homo sapiens
gagcttagccttgtgcc

SEQ ID NO: 3902569 - DNA, 21 bp, Homo sapiens
gagcttagccttgtgccctgc

SEQ ID NO: 3902570 - DNA, 19 bp, Homo sapiens
gagcttattggccactggg

SEQ ID NO: 3902571 - DNA, 23 bp, Homo sapiens
gagcttgtatatacttcactcac

SEQ ID NO: 3902572 - DNA, 23 bp, Homo sapiens
gagctttggggacagttggcaga

SEQ ID NO: 3902573 - DNA, 21 bp, Homo sapiens
gaggaaaaccaagccgtggct

SEQ ID NO: 3902574 - DNA, 15 bp, Homo sapiens
gaggaaaacgggaaa

SEQ ID NO: 3902575 - DNA, 20 bp, Homo sapiens
gaggaaaagtgcaatgcgtg

SEQ ID NO: 3902576 - DNA, 17 bp, Homo sapiens
gaggaacaggtggatgt

SEQ ID NO: 3902577 - DNA, 13 bp, Homo sapiens
gaggaagaatggt

SEQ ID NO: 3902578 - DNA, 17 bp, Homo sapiens
gaggaagagcaggcaca

SEQ ID NO: 3902579 - DNA, 21 bp, Homo sapiens
gaggaagatgaagagaagctg

SEQ ID NO: 3902580 - DNA, 10 bp, Homo sapiens
gaggaaggca

SEQ ID NO: 3902581 - DNA, 19 bp, Homo sapiens
gaggaagggccaggagaga

SEQ ID NO: 3902582 - DNA, 13 bp, Homo sapiens
gaggaaggtgctg

SEQ ID NO: 3902583 - DNA, 22 bp, Homo sapiens
gaggaataagaatggagcagta

SEQ ID NO: 3902584 - DNA, 21 bp, Homo sapiens
gaggaataagctcccagggcc

SEQ ID NO: 3902585 - DNA, 21 bp, Homo sapiens
gaggaatcatgtcaggcctgt

SEQ ID NO: 3902586 - DNA, 13 bp, Homo sapiens
gaggacacatgtc

SEQ ID NO: 3902587 - DNA, 17 bp, Homo sapiens
gaggacacgtggcctgc

SEQ ID NO: 3902588 - DNA, 16 bp, Homo sapiens
gaggacatggagagag

SEQ ID NO: 3902589 - DNA, 18 bp, Homo sapiens
gaggaccacagtgggtgg

SEQ ID NO: 3902590 - DNA, 18 bp, Homo sapiens
gaggacctgagcctgccg

SEQ ID NO: 3902591 - DNA, 16 bp, Homo sapiens
gaggactagaacctgg

SEQ ID NO: 3902592 - DNA, 21 bp, Homo sapiens
gaggactccctccatgtggcc

SEQ ID NO: 3902593 - DNA, 16 bp, Homo sapiens
gaggactccgggacca

SEQ ID NO: 3902594 - DNA, 13 bp, Homo sapiens
gaggactgagact

SEQ ID NO: 3902595 - DNA, 14 bp, Homo sapiens
gaggacttgtgtct

SEQ ID NO: 3902596 - DNA, 20 bp, Homo sapiens
gaggagagtggttgttgcca

SEQ ID NO: 3902597 - DNA, 13 bp, Homo sapiens
gaggagcacctga

SEQ ID NO: 3902598 - DNA, 14 bp, Homo sapiens
gaggagcagagggc

SEQ ID NO: 3902599 - DNA, 17 bp, Homo sapiens
gaggaggaaggcaaagc

SEQ ID NO: 3902600 - DNA, 12 bp, Homo sapiens
gaggagggtgcc

SEQ ID NO: 3902601 - DNA, 15 bp, Homo sapiens
gaggagggtgccctc

SEQ ID NO: 3902602 - DNA, 23 bp, Homo sapiens
gaggagtagctgagaggaagatg

SEQ ID NO: 3902603 - DNA, 22 bp, Homo sapiens
gaggagtctgaggtcctgagca

SEQ ID NO: 3902604 - DNA, 23 bp, Homo sapiens
gaggagtctgaggtcctgagcac

SEQ ID NO: 3902605 - DNA, 21 bp, Homo sapiens
gaggatccctccatccggctc

SEQ ID NO: 3902606 - DNA, 19 bp, Homo sapiens
gaggatcctcacaggagca

SEQ ID NO: 3902607 - DNA, 21 bp, Homo sapiens
gaggatgccacagccccacag

SEQ ID NO: 3902608 - DNA, 13 bp, Homo sapiens
gaggatggagaga

SEQ ID NO: 3902609 - DNA, 14 bp, Homo sapiens
gaggatggagagag

SEQ ID NO: 3902610 - DNA, 17 bp, Homo sapiens
gaggatttcaagcctgc

SEQ ID NO: 3902611 - DNA, 22 bp, Homo sapiens
gaggattttccagttctgacac

SEQ ID NO: 3902612 - DNA, 14 bp, Homo sapiens
gaggggtaggcaga

SEQ ID NO: 3902613 - DNA, 18 bp, Homo sapiens
gaggggtaggcagagcct

SEQ ID NO: 3902614 - DNA, 15 bp, Homo sapiens
gaggggtgcacccac

SEQ ID NO: 3902615 - DNA, 13 bp, Homo sapiens
gagggtcagggca

SEQ ID NO: 3902616 - DNA, 15 bp, Homo sapiens
gagggtctggagaag

SEQ ID NO: 3902617 - DNA, 24 bp, Homo sapiens
gagggtctggagaagcagtgagcc

SEQ ID NO: 3902618 - DNA, 13 bp, Homo sapiens
gagggtggagact

SEQ ID NO: 3902619 - DNA, 23 bp, Homo sapiens
gagggtggaggaaggtgctgagc

SEQ ID NO: 3902620 - DNA, 17 bp, Homo sapiens
gagggtggggccgggtg

SEQ ID NO: 3902621 - DNA, 15 bp, Homo sapiens
gagggttgctatttg

SEQ ID NO: 3902622 - DNA, 21 bp, Homo sapiens
gagggttgtactattgtttaa

SEQ ID NO: 3902623 - DNA, 14 bp, Homo sapiens
gaggtagcgagctg

SEQ ID NO: 3902624 - DNA, 19 bp, Homo sapiens
gaggtagcgagctgctctg

SEQ ID NO: 3902625 - DNA, 21 bp, Homo sapiens
gaggtagcgagctgctctgct

SEQ ID NO: 3902626 - DNA, 21 bp, Homo sapiens
gaggtaggtggatcacctgag

SEQ ID NO: 3902627 - DNA, 15 bp, Homo sapiens
gaggtcaacagagaa

SEQ ID NO: 3902628 - DNA, 22 bp, Homo sapiens
gaggtcacattcaggaagatga

SEQ ID NO: 3902629 - DNA, 14 bp, Homo sapiens
gaggtcactgggtt

SEQ ID NO: 3902630 - DNA, 20 bp, Homo sapiens
gaggtccctgcttacctgac

SEQ ID NO: 3902631 - DNA, 18 bp, Homo sapiens
gaggtcctgagcactgcc

SEQ ID NO: 3902632 - DNA, 19 bp, Homo sapiens
gaggtctgagccctggtgt

SEQ ID NO: 3902633 - DNA, 15 bp, Homo sapiens
gaggtgagaccacct

SEQ ID NO: 3902634 - DNA, 14 bp, Homo sapiens
gaggtgcccaggag

SEQ ID NO: 3902635 - DNA, 22 bp, Homo sapiens
gaggtggattcctgggcaagaa

SEQ ID NO: 3902636 - DNA, 15 bp, Homo sapiens
gaggtgggagacaag

SEQ ID NO: 3902637 - DNA, 15 bp, Homo sapiens
gaggtgggcagctgg

SEQ ID NO: 3902638 - DNA, 18 bp, Homo sapiens
gaggtgggcagctgggcc

SEQ ID NO: 3902639 - DNA, 15 bp, Homo sapiens
gaggtgtcaccctgc

SEQ ID NO: 3902640 - DNA, 19 bp, Homo sapiens
gaggtgtcaccctgcagag

SEQ ID NO: 3902641 - DNA, 20 bp, Homo sapiens
gaggtgtcaccctgcagagc

SEQ ID NO: 3902642 - DNA, 15 bp, Homo sapiens
gaggtgtcccaagct

SEQ ID NO: 3902643 - DNA, 14 bp, Homo sapiens
gaggttatctgcct

SEQ ID NO: 3902644 - DNA, 15 bp, Homo sapiens
gaggttgcagtgagc

SEQ ID NO: 3902645 - DNA, 14 bp, Homo sapiens
gaggttggtgactg

SEQ ID NO: 3902646 - DNA, 21 bp, Homo sapiens
gaggttgtggatgctccaggg

SEQ ID NO: 3902647 - DNA, 18 bp, Homo sapiens
gaggttttattctgactt

SEQ ID NO: 3902648 - DNA, 19 bp, Homo sapiens
gagtaccttctacaggccc

SEQ ID NO: 3902649 - DNA, 18 bp, Homo sapiens
gagtagatggtgaaattt

SEQ ID NO: 3902650 - DNA, 22 bp, Homo sapiens
gagtagcaagttctagagaaga

SEQ ID NO: 3902651 - DNA, 15 bp, Homo sapiens
gagtagctgagagga

SEQ ID NO: 3902652 - DNA, 17 bp, Homo sapiens
gagtattaagaatgcag

SEQ ID NO: 3902653 - DNA, 14 bp, Homo sapiens
gagtcaactggagc

SEQ ID NO: 3902654 - DNA, 18 bp, Homo sapiens
gagtcaattggaaagact

SEQ ID NO: 3902655 - DNA, 13 bp, Homo sapiens
gagtcacctcctc

SEQ ID NO: 3902656 - DNA, 23 bp, Homo sapiens
gagtcacctcctccactcactcc

SEQ ID NO: 3902657 - DNA, 14 bp, Homo sapiens
gagtcacctgcaag

SEQ ID NO: 3902658 - DNA, 16 bp, Homo sapiens
gagtcacctgcaagcc

SEQ ID NO: 3902659 - DNA, 22 bp, Homo sapiens
gagtcacctgcaagccccaggg

SEQ ID NO: 3902660 - DNA, 23 bp, Homo sapiens
gagtcacctgcaagccccagggc

SEQ ID NO: 3902661 - DNA, 16 bp, Homo sapiens
gagtcagaggagaaga

SEQ ID NO: 3902662 - DNA, 18 bp, Homo sapiens
gagtcagtctctctctcc

SEQ ID NO: 3902663 - DNA, 16 bp, Homo sapiens
gagtcatgatctccct

SEQ ID NO: 3902664 - DNA, 20 bp, Homo sapiens
gagtcatgatctccctgccg

SEQ ID NO: 3902665 - DNA, 12 bp, Homo sapiens
gagtccagggcg

SEQ ID NO: 3902666 - DNA, 17 bp, Homo sapiens
gagtcctgtctctgcct

SEQ ID NO: 3902667 - DNA, 18 bp, Homo sapiens
gagtcggccccacatggg

SEQ ID NO: 3902668 - DNA, 23 bp, Homo sapiens
gagtcgtcatcacttttcagtga

SEQ ID NO: 3902669 - DNA, 21 bp, Homo sapiens
gagtctcattctgttgcccag

SEQ ID NO: 3902670 - DNA, 12 bp, Homo sapiens
gagtctcttctc

SEQ ID NO: 3902671 - DNA, 16 bp, Homo sapiens
gagtctcttctccact

SEQ ID NO: 3902672 - DNA, 18 bp, Homo sapiens
gagtctcttctccactgg

SEQ ID NO: 3902673 - DNA, 22 bp, Homo sapiens
gagtctgaaagacagaatgtca

SEQ ID NO: 3902674 - DNA, 19 bp, Homo sapiens
gagtctgaggtcctgagca

SEQ ID NO: 3902675 - DNA, 22 bp, Homo sapiens
gagtctgaggtcctgagcactg

SEQ ID NO: 3902676 - DNA, 14 bp, Homo sapiens
gagtctgagtcctg

SEQ ID NO: 3902677 - DNA, 18 bp, Homo sapiens
gagtctgagtcctgtctc

SEQ ID NO: 3902678 - DNA, 18 bp, Homo sapiens
gagtctgagtctgagtcc

SEQ ID NO: 3902679 - DNA, 21 bp, Homo sapiens
gagtctgctatattttcatga

SEQ ID NO: 3902680 - DNA, 14 bp, Homo sapiens
gagtctgtgctctt

SEQ ID NO: 3902681 - DNA, 23 bp, Homo sapiens
gagtcttggcctgcctcccagcc

SEQ ID NO: 3902682 - DNA, 17 bp, Homo sapiens
gagtctttaatcccagt

SEQ ID NO: 3902683 - DNA, 19 bp, Homo sapiens
gagtgaaagggctatggca

SEQ ID NO: 3902684 - DNA, 24 bp, Homo sapiens
gagtgaaataattaaaaaccactg

SEQ ID NO: 3902685 - DNA, 18 bp, Homo sapiens
gagtgacgggagcctcct

SEQ ID NO: 3902686 - DNA, 15 bp, Homo sapiens
gagtgactcgagggt

SEQ ID NO: 3902687 - DNA, 15 bp, Homo sapiens
gagtgaggcttccag

SEQ ID NO: 3902688 - DNA, 19 bp, Homo sapiens
gagtgcaggcctgctcagg

SEQ ID NO: 3902689 - DNA, 23 bp, Homo sapiens
gagtgcagtagtaattgatttga

SEQ ID NO: 3902690 - DNA, 14 bp, Homo sapiens
gagtgccaggactc

SEQ ID NO: 3902691 - DNA, 21 bp, Homo sapiens
gagtgcgctcttggtccctgg

SEQ ID NO: 3902692 - DNA, 12 bp, Homo sapiens
gagtggagtctg

SEQ ID NO: 3902693 - DNA, 12 bp, Homo sapiens
gagtggatggat

SEQ ID NO: 3902694 - DNA, 19 bp, Homo sapiens
gagtggatggatggacaga

SEQ ID NO: 3902695 - DNA, 13 bp, Homo sapiens
gagtggcagccat

SEQ ID NO: 3902696 - DNA, 24 bp, Homo sapiens
gagtggcagccatgcctcatgcca

SEQ ID NO: 3902697 - DNA, 14 bp, Homo sapiens
gagtgtgcagactg

SEQ ID NO: 3902698 - DNA, 18 bp, Homo sapiens
gatcccatccatcagctc

SEQ ID NO: 3902699 - DNA, 17 bp, Homo sapiens
gatcccatgtcacctca

SEQ ID NO: 3902700 - DNA, 18 bp, Homo sapiens
gatcccatgtcacctcag

SEQ ID NO: 3902701 - DNA, 22 bp, Homo sapiens
gatcccatgtcacctcagctga

SEQ ID NO: 3902702 - DNA, 21 bp, Homo sapiens
gatcccgcctcttcttcttca

SEQ ID NO: 3902703 - DNA, 18 bp, Homo sapiens
gatccctccatccggctc

SEQ ID NO: 3902704 - DNA, 20 bp, Homo sapiens
gatccctccatccggctcct

SEQ ID NO: 3902705 - DNA, 13 bp, Homo sapiens
gatccgctgccac

SEQ ID NO: 3902706 - DNA, 14 bp, Homo sapiens
gatcctaggtgctg

SEQ ID NO: 3902707 - DNA, 20 bp, Homo sapiens
gatcctattctcaccaggaa

SEQ ID NO: 3902708 - DNA, 19 bp, Homo sapiens
gatcctcacaaccacctaa

SEQ ID NO: 3902709 - DNA, 15 bp, Homo sapiens
gatcctcacaggagc

SEQ ID NO: 3902710 - DNA, 21 bp, Homo sapiens
gatcctgcaggaacgagcact

SEQ ID NO: 3902711 - DNA, 22 bp, Homo sapiens
gatcctgcaggaacgagcactg

SEQ ID NO: 3902712 - DNA, 23 bp, Homo sapiens
gatcctgcaggaacgagcactgg

SEQ ID NO: 3902713 - DNA, 14 bp, Homo sapiens
gatcctgctgtggc

SEQ ID NO: 3902714 - DNA, 21 bp, Homo sapiens
gatcctgctgtggcctcactt

SEQ ID NO: 3902715 - DNA, 19 bp, Homo sapiens
gatcctggattcactcact

SEQ ID NO: 3902716 - DNA, 14 bp, Homo sapiens
gatccttttatgtt

SEQ ID NO: 3902717 - DNA, 14 bp, Homo sapiens
gatcgcttgagccc

SEQ ID NO: 3902718 - DNA, 15 bp, Homo sapiens
gatcgcttgagccca

SEQ ID NO: 3902719 - DNA, 16 bp, Homo sapiens
gatcgcttgagcccag

SEQ ID NO: 3902720 - DNA, 17 bp, Homo sapiens
gatcggagcctcctctc

SEQ ID NO: 3902721 - DNA, 21 bp, Homo sapiens
gatcgtattaattatctgatc

SEQ ID NO: 3902722 - DNA, 21 bp, Homo sapiens
gatctagaatgtgttttctga

SEQ ID NO: 3902723 - DNA, 13 bp, Homo sapiens
gatctagcttcat

SEQ ID NO: 3902724 - DNA, 16 bp, Homo sapiens
gatctatgcaattttt

SEQ ID NO: 3902725 - DNA, 20 bp, Homo sapiens
gatctccaaggaccaggtta

SEQ ID NO: 3902726 - DNA, 15 bp, Homo sapiens
gatctccctccaggg

SEQ ID NO: 3902727 - DNA, 12 bp, Homo sapiens
gatctccctgcc

SEQ ID NO: 3902728 - DNA, 14 bp, Homo sapiens
gatctctcaggagc

SEQ ID NO: 3902729 - DNA, 16 bp, Homo sapiens
gatctctcaggagcac

SEQ ID NO: 3902730 - DNA, 18 bp, Homo sapiens
gatctctcaggagcacag

SEQ ID NO: 3902731 - DNA, 20 bp, Homo sapiens
gatctctcaggagcacaggc

SEQ ID NO: 3902732 - DNA, 12 bp, Homo sapiens
gatctctgctta

SEQ ID NO: 3902733 - DNA, 18 bp, Homo sapiens
gatctgatggtgagctgg

SEQ ID NO: 3902734 - DNA, 21 bp, Homo sapiens
gatctgcctgggcctgtgcag

SEQ ID NO: 3902735 - DNA, 23 bp, Homo sapiens
gatctgcctgggcctgtgcagca

SEQ ID NO: 3902736 - DNA, 22 bp, Homo sapiens
gatctgggaccctttccttcct

SEQ ID NO: 3902737 - DNA, 23 bp, Homo sapiens
gatctgggaccctttccttcctt

SEQ ID NO: 3902738 - DNA, 15 bp, Homo sapiens
gatctgtactgtaat

SEQ ID NO: 3902739 - DNA, 17 bp, Homo sapiens
gatctgtactgtaattt

SEQ ID NO: 3902740 - DNA, 17 bp, Homo sapiens
gatctgtcccctctccc

SEQ ID NO: 3902741 - DNA, 20 bp, Homo sapiens
gatctgtcccctctcccctc

SEQ ID NO: 3902742 - DNA, 15 bp, Homo sapiens
gatcttcagaaggct

SEQ ID NO: 3902743 - DNA, 19 bp, Homo sapiens
gatcttgagatttctttta

SEQ ID NO: 3902744 - DNA, 12 bp, Homo sapiens
gatctttcagga

SEQ ID NO: 3902745 - DNA, 17 bp, Homo sapiens
gatgaaattgaacctgg

SEQ ID NO: 3902746 - DNA, 13 bp, Homo sapiens
gatgaactttctc

SEQ ID NO: 3902747 - DNA, 11 bp, Homo sapiens
gatgaagagaa

SEQ ID NO: 3902748 - DNA, 14 bp, Homo sapiens
gatgacagagcgag

SEQ ID NO: 3902749 - DNA, 16 bp, Homo sapiens
gatgactagaggcagg

SEQ ID NO: 3902750 - DNA, 13 bp, Homo sapiens
gatgagagtggct

SEQ ID NO: 3902751 - DNA, 20 bp, Homo sapiens
gatgagatttgccagcacag

SEQ ID NO: 3902752 - DNA, 23 bp, Homo sapiens
gatgagccgctgtgagcccctgg

SEQ ID NO: 3902753 - DNA, 22 bp, Homo sapiens
gatgaggcctcttggacctctg

SEQ ID NO: 3902754 - DNA, 21 bp, Homo sapiens
gatgagggcagcagccagccc

SEQ ID NO: 3902755 - DNA, 23 bp, Homo sapiens
gatgaggggcttcctgggtcctg

SEQ ID NO: 3902756 - DNA, 14 bp, Homo sapiens
gatgagggtgactg

SEQ ID NO: 3902757 - DNA, 15 bp, Homo sapiens
gatgataaatattta

SEQ ID NO: 3902758 - DNA, 15 bp, Homo sapiens
gatgatctactcaga

SEQ ID NO: 3902759 - DNA, 16 bp, Homo sapiens
gatgatctttaaaata

SEQ ID NO: 3902760 - DNA, 14 bp, Homo sapiens
gatgatgtctcttg

SEQ ID NO: 3902761 - DNA, 20 bp, Homo sapiens
gatgatgtctcttgtagaag

SEQ ID NO: 3902762 - DNA, 19 bp, Homo sapiens
gatgattaaacacctgaca

SEQ ID NO: 3902763 - DNA, 20 bp, Homo sapiens
gatgatttgctatcaaaata

SEQ ID NO: 3902764 - DNA, 17 bp, Homo sapiens
gatgcaagatatttata

SEQ ID NO: 3902765 - DNA, 16 bp, Homo sapiens
gatgcacacacagata

SEQ ID NO: 3902766 - DNA, 14 bp, Homo sapiens
gatgcacagagata

SEQ ID NO: 3902767 - DNA, 13 bp, Homo sapiens
gatgcatgcgcag

SEQ ID NO: 3902768 - DNA, 15 bp, Homo sapiens
gatgccacagcccca

SEQ ID NO: 3902769 - DNA, 16 bp, Homo sapiens
gatgccacagccccac

SEQ ID NO: 3902770 - DNA, 24 bp, Homo sapiens
gatgccacttcccagaggcagagc

SEQ ID NO: 3902771 - DNA, 13 bp, Homo sapiens
gatgccccttccc

SEQ ID NO: 3902772 - DNA, 16 bp, Homo sapiens
gatgcctccaccgctg

SEQ ID NO: 3902773 - DNA, 17 bp, Homo sapiens
gatgcctccaccgctgc

SEQ ID NO: 3902774 - DNA, 20 bp, Homo sapiens
gatgcctccaccgctgccta

SEQ ID NO: 3902775 - DNA, 22 bp, Homo sapiens
gatgccttgagtctttaatccc

SEQ ID NO: 3902776 - DNA, 20 bp, Homo sapiens
gatgcgaaaacttgaatctg

SEQ ID NO: 3902777 - DNA, 20 bp, Homo sapiens
gatgctggtaccactggaat

SEQ ID NO: 3902778 - DNA, 23 bp, Homo sapiens
gatgctttgtttctttcatatga

SEQ ID NO: 3902779 - DNA, 15 bp, Homo sapiens
gatggaaagaaagca

SEQ ID NO: 3902780 - DNA, 16 bp, Homo sapiens
gatggaatagaaaaga

SEQ ID NO: 3902781 - DNA, 12 bp, Homo sapiens
gatggacagaat

SEQ ID NO: 3902782 - DNA, 15 bp, Homo sapiens
gatggacagaatgat

SEQ ID NO: 3902783 - DNA, 16 bp, Homo sapiens
gatggaccagtagaca

SEQ ID NO: 3902784 - DNA, 14 bp, Homo sapiens
gatggacccctccc

SEQ ID NO: 3902785 - DNA, 18 bp, Homo sapiens
gatttcatctgagtgtgg

SEQ ID NO: 3902786 - DNA, 18 bp, Homo sapiens
gatttcatgctatctctg

SEQ ID NO: 3902787 - DNA, 19 bp, Homo sapiens
gatttcctattttaaaacc

SEQ ID NO: 3902788 - DNA, 13 bp, Homo sapiens
gatttctcctgac

SEQ ID NO: 3902789 - DNA, 11 bp, Homo sapiens
gatttctctga

SEQ ID NO: 3902790 - DNA, 19 bp, Homo sapiens
gatttcttcgctgctctag

SEQ ID NO: 3902791 - DNA, 18 bp, Homo sapiens
gatttcttttaaagaagt

SEQ ID NO: 3902792 - DNA, 13 bp, Homo sapiens
gatttgacccact

SEQ ID NO: 3902793 - DNA, 15 bp, Homo sapiens
gatttgccagcacag

SEQ ID NO: 3902794 - DNA, 21 bp, Homo sapiens
gatttggaagagaggcacctg

SEQ ID NO: 3902795 - DNA, 18 bp, Homo sapiens
gattttcctgaatattaa

SEQ ID NO: 3902796 - DNA, 12 bp, Homo sapiens
gattttctagac

SEQ ID NO: 3902797 - DNA, 14 bp, Homo sapiens
gattttgagtatct

SEQ ID NO: 3902798 - DNA, 12 bp, Homo sapiens
gattttgcacaa

SEQ ID NO: 3902799 - DNA, 12 bp, Homo sapiens
gattttgtacag

SEQ ID NO: 3902800 - DNA, 17 bp, Homo sapiens
gattttgtacagaattt

SEQ ID NO: 3902801 - DNA, 14 bp, Homo sapiens
gatttttaaattat

SEQ ID NO: 3902802 - DNA, 15 bp, Homo sapiens
gatttttacaataat

SEQ ID NO: 3902803 - DNA, 15 bp, Homo sapiens
gattttttaaaagaa

SEQ ID NO: 3902804 - DNA, 16 bp, Homo sapiens
gatttttttgttgttg

SEQ ID NO: 3902805 - DNA, 14 bp, Homo sapiens
gcaaaaatataaaa

SEQ ID NO: 3902806 - DNA, 20 bp, Homo sapiens
gcaaaacctgcagttcctga

SEQ ID NO: 3902807 - DNA, 16 bp, Homo sapiens
gcaaaagaagtaaaag

SEQ ID NO: 3902808 - DNA, 18 bp, Homo sapiens
gcaaaataaatgttttta

SEQ ID NO: 3902809 - DNA, 13 bp, Homo sapiens
gcaaaataatttt

SEQ ID NO: 3902810 - DNA, 15 bp, Homo sapiens
gcaaaataattttaa

SEQ ID NO: 3902811 - DNA, 20 bp, Homo sapiens
gcaaaataattttaaacaaa

SEQ ID NO: 3902812 - DNA, 19 bp, Homo sapiens
gcaaacactgtgtatttat

SEQ ID NO: 3902813 - DNA, 14 bp, Homo sapiens
gcaaaccaggactc

SEQ ID NO: 3902814 - DNA, 17 bp, Homo sapiens
gcaaactcactgctcaa

SEQ ID NO: 3902815 - DNA, 16 bp, Homo sapiens
gcaaagaactgcccca

SEQ ID NO: 3902816 - DNA, 13 bp, Homo sapiens
gcaaagcaccagc

SEQ ID NO: 3902817 - DNA, 23 bp, Homo sapiens
gcaaagcactgacttctaagtaa

SEQ ID NO: 3902818 - DNA, 11 bp, Homo sapiens
gcaaagcctgt

SEQ ID NO: 3902819 - DNA, 15 bp, Homo sapiens
gcaaagggctgaaag

SEQ ID NO: 3902820 - DNA, 18 bp, Homo sapiens
gcaaaggtggctctccag

SEQ ID NO: 3902821 - DNA, 15 bp, Homo sapiens
gcaaagtctaaagtt

SEQ ID NO: 3902822 - DNA, 13 bp, Homo sapiens
gcaaagtgcaaat

SEQ ID NO: 3902823 - DNA, 23 bp, Homo sapiens
gcaaagtgttttctcagaacagc

SEQ ID NO: 3902824 - DNA, 11 bp, Homo sapiens
gcaaatataaa

SEQ ID NO: 3902825 - DNA, 16 bp, Homo sapiens
gcaaatcaaccccaga

SEQ ID NO: 3902826 - DNA, 12 bp, Homo sapiens
gcaaattagtaa

SEQ ID NO: 3902827 - DNA, 16 bp, Homo sapiens
gcaaatttcaaaagac

SEQ ID NO: 3902828 - DNA, 22 bp, Homo sapiens
gcaaatttcaaaagacatgttg

SEQ ID NO: 3902829 - DNA, 15 bp, Homo sapiens
gcaacaaaatcaatt

SEQ ID NO: 3902830 - DNA, 12 bp, Homo sapiens
gcaacaagagca

SEQ ID NO: 3902831 - DNA, 22 bp, Homo sapiens
gcaacaatacatgctgctaatt

SEQ ID NO: 3902832 - DNA, 16 bp, Homo sapiens
gcaacacaagctggaa

SEQ ID NO: 3902833 - DNA, 17 bp, Homo sapiens
gcaacacaagctggaag

SEQ ID NO: 3902834 - DNA, 19 bp, Homo sapiens
gcaacacaagctggaagca

SEQ ID NO: 3902835 - DNA, 17 bp, Homo sapiens
gcaacactctatattta

SEQ ID NO: 3902836 - DNA, 15 bp, Homo sapiens
gcaacagaaaaatgg

SEQ ID NO: 3902837 - DNA, 17 bp, Homo sapiens
gcaacagaaaaatggag

SEQ ID NO: 3902838 - DNA, 19 bp, Homo sapiens
gcaacatctcgagccccct

SEQ ID NO: 3902839 - DNA, 23 bp, Homo sapiens
gcaacattttatttaagaataaa

SEQ ID NO: 3902840 - DNA, 15 bp, Homo sapiens
gcaaccacacacctc

SEQ ID NO: 3902841 - DNA, 13 bp, Homo sapiens
gcaacccctgtac

SEQ ID NO: 3902842 - DNA, 14 bp, Homo sapiens
gcaacccctgtacc

SEQ ID NO: 3902843 - DNA, 19 bp, Homo sapiens
gcaacccctgtacccagct

SEQ ID NO: 3902844 - DNA, 23 bp, Homo sapiens
gcaaccgtggcccttcctggaca

SEQ ID NO: 3902845 - DNA, 18 bp, Homo sapiens
gcaacctccacctcctga

SEQ ID NO: 3902846 - DNA, 12 bp, Homo sapiens
gcaacctcccaa

SEQ ID NO: 3902847 - DNA, 13 bp, Homo sapiens
gcaacctgttctt

SEQ ID NO: 3902848 - DNA, 20 bp, Homo sapiens
gcaacctgttcttcctacca

SEQ ID NO: 3902849 - DNA, 20 bp, Homo sapiens
gcaagagacagagcccccaa

SEQ ID NO: 3902850 - DNA, 20 bp, Homo sapiens
gcaagagactctggcctcca

SEQ ID NO: 3902851 - DNA, 13 bp, Homo sapiens
gcaagagccttgg

SEQ ID NO: 3902852 - DNA, 23 bp, Homo sapiens
gcaagagccttggtgtccacctg

SEQ ID NO: 3902853 - DNA, 13 bp, Homo sapiens
gcaagatgaattt

SEQ ID NO: 3902854 - DNA, 12 bp, Homo sapiens
gcaagatgtggg

SEQ ID NO: 3902855 - DNA, 16 bp, Homo sapiens
gcaagatgtgggcagt

SEQ ID NO: 3902856 - DNA, 14 bp, Homo sapiens
gcaagattgcttaa

SEQ ID NO: 3902857 - DNA, 16 bp, Homo sapiens
gcaagatttaacacta

SEQ ID NO: 3902858 - DNA, 22 bp, Homo sapiens
gcaagattttccacaagattcc

SEQ ID NO: 3902859 - DNA, 16 bp, Homo sapiens
gcaagcagcctcctgg

SEQ ID NO: 3902860 - DNA, 20 bp, Homo sapiens
gcaagcatttatgtttattt

SEQ ID NO: 3902861 - DNA, 15 bp, Homo sapiens
gcaagccccagggcc

SEQ ID NO: 3902862 - DNA, 16 bp, Homo sapiens
gcaagcccctcagccc

SEQ ID NO: 3902863 - DNA, 19 bp, Homo sapiens
gcaagcctgtaatcccagc

SEQ ID NO: 3902864 - DNA, 16 bp, Homo sapiens
gcaagcgcagggagga

SEQ ID NO: 3902865 - DNA, 19 bp, Homo sapiens
gcaagctagaacctggagg

SEQ ID NO: 3902866 - DNA, 14 bp, Homo sapiens
gcaaggcccgagca

SEQ ID NO: 3902867 - DNA, 17 bp, Homo sapiens
gcaaggcccgagcagct

SEQ ID NO: 3902868 - DNA, 22 bp, Homo sapiens
gcaaggcccgagcagctgagca

SEQ ID NO: 3902869 - DNA, 23 bp, Homo sapiens
gcaaggcccgagcagctgagcag

SEQ ID NO: 3902870 - DNA, 19 bp, Homo sapiens
gcaagggagaagaaatcca

SEQ ID NO: 3902871 - DNA, 10 bp, Homo sapiens
gcaagggctc

SEQ ID NO: 3902872 - DNA, 18 bp, Homo sapiens
gcaccagcttctccaggc

SEQ ID NO: 3902873 - DNA, 20 bp, Homo sapiens
gcaccaggcacgaacccacc

SEQ ID NO: 3902874 - DNA, 23 bp, Homo sapiens
gcaccaggcacgaacccacctgc

SEQ ID NO: 3902875 - DNA, 14 bp, Homo sapiens
gcaccatctgcttg

SEQ ID NO: 3902876 - DNA, 15 bp, Homo sapiens
gcacccactcaccag

SEQ ID NO: 3902877 - DNA, 21 bp, Homo sapiens
gcacccagaaattccttccca

SEQ ID NO: 3902878 - DNA, 19 bp, Homo sapiens
gcacccaggctccatgggg

SEQ ID NO: 3902879 - DNA, 19 bp, Homo sapiens
gcacccccagcctgggcct

SEQ ID NO: 3902880 - DNA, 21 bp, Homo sapiens
gcacccccagcctgggcctat

SEQ ID NO: 3902881 - DNA, 23 bp, Homo sapiens
gcacccccagcctgggcctatgg

SEQ ID NO: 3902882 - DNA, 14 bp, Homo sapiens
gcaccccctgcagc

SEQ ID NO: 3902883 - DNA, 19 bp, Homo sapiens
gcaccccctgcagcttgta

SEQ ID NO: 3902884 - DNA, 16 bp, Homo sapiens
gcaccctctcctgggg

SEQ ID NO: 3902885 - DNA, 17 bp, Homo sapiens
gcaccctctcctggggg

SEQ ID NO: 3902886 - DNA, 22 bp, Homo sapiens
gcaccctggaaaggggagttga

SEQ ID NO: 3902887 - DNA, 15 bp, Homo sapiens
gcaccctgggtgcca

SEQ ID NO: 3902888 - DNA, 22 bp, Homo sapiens
gcaccctgggtgccattcccag

SEQ ID NO: 3902889 - DNA, 15 bp, Homo sapiens
gcacccttctgctgt

SEQ ID NO: 3902890 - DNA, 16 bp, Homo sapiens
gcacccttctttcctc

SEQ ID NO: 3902891 - DNA, 21 bp, Homo sapiens
gcacccttctttcctcttccc

SEQ ID NO: 3902892 - DNA, 12 bp, Homo sapiens
gcaccggcgctg

SEQ ID NO: 3902893 - DNA, 18 bp, Homo sapiens
gcaccggcgctgcaggta

SEQ ID NO: 3902894 - DNA, 18 bp, Homo sapiens
gcacctccccccactgca

SEQ ID NO: 3902895 - DNA, 16 bp, Homo sapiens
gcacctcctgagaagg

SEQ ID NO: 3902896 - DNA, 24 bp, Homo sapiens
gcacctgaaccccatgggcttgga

SEQ ID NO: 3902897 - DNA, 17 bp, Homo sapiens
gcacctgcagattctga

SEQ ID NO: 3902898 - DNA, 22 bp, Homo sapiens
gcacctgcatccgtagttccct

SEQ ID NO: 3902899 - DNA, 23 bp, Homo sapiens
gcacctgcgagaggtccctgctt

SEQ ID NO: 3902900 - DNA, 18 bp, Homo sapiens
  misc_feature (9)..(9): n is a, c, g or t
gcacctgcnttgtccctg

SEQ ID NO: 3902901 - DNA, 13 bp, Homo sapiens
gcacctggcctgc

SEQ ID NO: 3902902 - DNA, 17 bp, Homo sapiens
gcacctggcctgctggg

SEQ ID NO: 3902903 - DNA, 18 bp, Homo sapiens
gcacctggcctgctggga

SEQ ID NO: 3902904 - DNA, 20 bp, Homo sapiens
gcacctggcctgctgggaac

SEQ ID NO: 3902905 - DNA, 20 bp, Homo sapiens
gcacctgggaaaacagagga

SEQ ID NO: 3902906 - DNA, 15 bp, Homo sapiens
gcacctgggccctgg

SEQ ID NO: 3902907 - DNA, 17 bp, Homo sapiens
gcacctgggccctgggg

SEQ ID NO: 3902908 - DNA, 22 bp, Homo sapiens
gcacctggtttctgttctgttg

SEQ ID NO: 3902909 - DNA, 19 bp, Homo sapiens
gcaccttaccaactttctg

SEQ ID NO: 3902910 - DNA, 21 bp, Homo sapiens
gcaccttaccaactttctgta

SEQ ID NO: 3902911 - DNA, 22 bp, Homo sapiens
gcacctttccttcaagccagca

SEQ ID NO: 3902912 - DNA, 22 bp, Homo sapiens
gcaccttttataccagagacct

SEQ ID NO: 3902913 - DNA, 19 bp, Homo sapiens
gcacgaacccacctgctga

SEQ ID NO: 3902914 - DNA, 23 bp, Homo sapiens
gcacgaacccacctgctgagaga

SEQ ID NO: 3902915 - DNA, 20 bp, Homo sapiens
gcacgcaacccttgctgctg

SEQ ID NO: 3902916 - DNA, 20 bp, Homo sapiens
gcacggtggacccagacaca

SEQ ID NO: 3902917 - DNA, 16 bp, Homo sapiens
gcacgtcttgctattt

SEQ ID NO: 3902918 - DNA, 19 bp, Homo sapiens
gcactaaagtatgtaaagt

SEQ ID NO: 3902919 - DNA, 19 bp, Homo sapiens
gcactaaggccgtgtctct

SEQ ID NO: 3902920 - DNA, 23 bp, Homo sapiens
gcactaaggccgtgtctctgagg

SEQ ID NO: 3902921 - DNA, 11 bp, Homo sapiens
gcactccagaa

SEQ ID NO: 3902922 - DNA, 14 bp, Homo sapiens
gcactccatggcca

SEQ ID NO: 3902923 - DNA, 15 bp, Homo sapiens
gcactccatggccac

SEQ ID NO: 3902924 - DNA, 18 bp, Homo sapiens
gcactccatggccacccc

SEQ ID NO: 3902925 - DNA, 23 bp, Homo sapiens
gcactccctaaccaaatgctgtc

SEQ ID NO: 3902926 - DNA, 22 bp, Homo sapiens
gcactccctaagaaaccccagg

SEQ ID NO: 3902927 - DNA, 17 bp, Homo sapiens
gcactccggcctgatga

SEQ ID NO: 3902928 - DNA, 18 bp, Homo sapiens
gcactcgagaccatcctg

SEQ ID NO: 3902929 - DNA, 21 bp, Homo sapiens
gcactcgagaccatcctggcc

SEQ ID NO: 3902930 - DNA, 17 bp, Homo sapiens
gcactgacccttccaga

SEQ ID NO: 3902931 - DNA, 11 bp, Homo sapiens
gcactgagggc

SEQ ID NO: 3902932 - DNA, 12 bp, Homo sapiens
gcactgagggcc

SEQ ID NO: 3902933 - DNA, 12 bp, Homo sapiens
gcactgatttca

SEQ ID NO: 3902934 - DNA, 13 bp, Homo sapiens
gcactgcaggggc

SEQ ID NO: 3902935 - DNA, 14 bp, Homo sapiens
gcactgcagtgatg

SEQ ID NO: 3902936 - DNA, 14 bp, Homo sapiens
gcactgccaggagg

SEQ ID NO: 3902937 - DNA, 23 bp, Homo sapiens
gcactgccaggagggacaaagga

SEQ ID NO: 3902938 - DNA, 20 bp, Homo sapiens
gcactgctaggcgagtgcca

SEQ ID NO: 3902939 - DNA, 14 bp, Homo sapiens
gcactgctgcccag

SEQ ID NO: 3902940 - DNA, 20 bp, Homo sapiens
gcactgctgcccagcctcca

SEQ ID NO: 3902941 - DNA, 12 bp, Homo sapiens
gcactggccaga

SEQ ID NO: 3902942 - DNA, 21 bp, Homo sapiens
gcactggccagagagggccca

SEQ ID NO: 3902943 - DNA, 14 bp, Homo sapiens
gcactggccccacc

SEQ ID NO: 3902944 - DNA, 14 bp, Homo sapiens
gcactggtggcccg

SEQ ID NO: 3902945 - DNA, 24 bp, Homo sapiens
gcactggtggcccgacagcctggc

SEQ ID NO: 3902946 - DNA, 18 bp, Homo sapiens
gcactgtgggggctggtc

SEQ ID NO: 3902947 - DNA, 17 bp, Homo sapiens
gcacttagctatcagaa

SEQ ID NO: 3902948 - DNA, 13 bp, Homo sapiens
gcacttgtcacta

SEQ ID NO: 3902949 - DNA, 18 bp, Homo sapiens
gcactttaaccctctctt

SEQ ID NO: 3902950 - DNA, 15 bp, Homo sapiens
gcagaaaagaggaga

SEQ ID NO: 3902951 - DNA, 17 bp, Homo sapiens
gcagaaaagcacctgcc

SEQ ID NO: 3902952 - DNA, 20 bp, Homo sapiens
gcagaaaagcacctgccgac

SEQ ID NO: 3902953 - DNA, 13 bp, Homo sapiens
gcagaaaagtgct

SEQ ID NO: 3902954 - DNA, 14 bp, Homo sapiens
gcagaaaagtgctt

SEQ ID NO: 3902955 - DNA, 19 bp, Homo sapiens
gcagaaaagtgcttagaaa

SEQ ID NO: 3902956 - DNA, 21 bp, Homo sapiens
gcagaaaagtgcttagaaagt

SEQ ID NO: 3902957 - DNA, 23 bp, Homo sapiens
gcagaaaagtgcttagaaagtta

SEQ ID NO: 3902958 - DNA, 16 bp, Homo sapiens
gcagccgccgggcagg

SEQ ID NO: 3902959 - DNA, 16 bp, Homo sapiens
gcagcctccagagcca

SEQ ID NO: 3902960 - DNA, 19 bp, Homo sapiens
gcagcctccagagccagcc

SEQ ID NO: 3902961 - DNA, 20 bp, Homo sapiens
gcagcctccagagccagcct

SEQ ID NO: 3902962 - DNA, 23 bp, Homo sapiens
gcagcctgatggccaagggggtg

SEQ ID NO: 3902963 - DNA, 18 bp, Homo sapiens
gcagcctggcggggcagg

SEQ ID NO: 3902964 - DNA, 22 bp, Homo sapiens
gcagcctggtagaattgggaag

SEQ ID NO: 3902965 - DNA, 16 bp, Homo sapiens
gcagcgcgtgcacagc

SEQ ID NO: 3902966 - DNA, 17 bp, Homo sapiens
gcagctagactggagtg

SEQ ID NO: 3902967 - DNA, 19 bp, Homo sapiens
gcagctagactggagtgag

SEQ ID NO: 3902968 - DNA, 22 bp, Homo sapiens
gcagctagactggagtgaggct

SEQ ID NO: 3902969 - DNA, 14 bp, Homo sapiens
gcagctaggactga

SEQ ID NO: 3902970 - DNA, 16 bp, Homo sapiens
gcagctaggactgagg

SEQ ID NO: 3902971 - DNA, 18 bp, Homo sapiens
gcagctaggactgaggag

SEQ ID NO: 3902972 - DNA, 12 bp, Homo sapiens
gcagctccaaca

SEQ ID NO: 3902973 - DNA, 15 bp, Homo sapiens
gcagctccaacagct

SEQ ID NO: 3902974 - DNA, 24 bp, Homo sapiens
gcagctccaacagcttgaccagac

SEQ ID NO: 3902975 - DNA, 15 bp, Homo sapiens
gcagctctttcttct

SEQ ID NO: 3902976 - DNA, 15 bp, Homo sapiens
gcagctgagagccct

SEQ ID NO: 3902977 - DNA, 16 bp, Homo sapiens
gcagctgagagccctg

SEQ ID NO: 3902978 - DNA, 14 bp, Homo sapiens
gcagctgagcaggg

SEQ ID NO: 3902979 - DNA, 16 bp, Homo sapiens
gcagctgagcagggcc

SEQ ID NO: 3902980 - DNA, 16 bp, Homo sapiens
gcagctgcaccatcac

SEQ ID NO: 3902981 - DNA, 14 bp, Homo sapiens
gcagctgcgggtct

SEQ ID NO: 3902982 - DNA, 17 bp, Homo sapiens
gcagctgcgggtctgaa

SEQ ID NO: 3902983 - DNA, 13 bp, Homo sapiens
gcagctgctctta

SEQ ID NO: 3902984 - DNA, 15 bp, Homo sapiens
gcagctggctctcca

SEQ ID NO: 3902985 - DNA, 19 bp, Homo sapiens
gcagctgggacccctccca

SEQ ID NO: 3902986 - DNA, 22 bp, Homo sapiens
gcagctgggacccctcccaacc

SEQ ID NO: 3902987 - DNA, 14 bp, Homo sapiens
gcagctgggcccca

SEQ ID NO: 3902988 - DNA, 17 bp, Homo sapiens
gcagctgggccccacct

SEQ ID NO: 3902989 - DNA, 14 bp, Homo sapiens
gcagctgggccggc

SEQ ID NO: 3902990 - DNA, 16 bp, Homo sapiens
gcagctgggccggcca

SEQ ID NO: 3902991 - DNA, 17 bp, Homo sapiens
gcagctgggccggccag

SEQ ID NO: 3902992 - DNA, 18 bp, Homo sapiens
gcagctgtagctcccgag

SEQ ID NO: 3902993 - DNA, 17 bp, Homo sapiens
gcagctgtcccctctcc

SEQ ID NO: 3902994 - DNA, 21 bp, Homo sapiens
gcagctgtcccctctccctgg

SEQ ID NO: 3902995 - DNA, 22 bp, Homo sapiens
gcagcttcatcaatttttatac

SEQ ID NO: 3902996 - DNA, 23 bp, Homo sapiens
gcagcttcatcaatttttataca

SEQ ID NO: 3902997 - DNA, 13 bp, Homo sapiens
gcagcttcctgtc

SEQ ID NO: 3902998 - DNA, 14 bp, Homo sapiens
gcagcttgtagcca

SEQ ID NO: 3902999 - DNA, 17 bp, Homo sapiens
gcagcttgtagccagcc

SEQ ID NO: 3903000 - DNA, 14 bp, Homo sapiens
gcaggaacgagcac

SEQ ID NO: 3903001 - DNA, 16 bp, Homo sapiens
gcaggaacgagcactg

SEQ ID NO: 3903002 - DNA, 19 bp, Homo sapiens
gcaggaacgagcactggcc

SEQ ID NO: 3903003 - DNA, 22 bp, Homo sapiens
gcaggaacgagcactggccaga

SEQ ID NO: 3903004 - DNA, 12 bp, Homo sapiens
gcaggaccagga

SEQ ID NO: 3903005 - DNA, 14 bp, Homo sapiens
gcaggagcaggaac

SEQ ID NO: 3903006 - DNA, 21 bp, Homo sapiens
gcaggagcaggaacagagact

SEQ ID NO: 3903007 - DNA, 19 bp, Homo sapiens
gcaggagtagctgagctca

SEQ ID NO: 3903008 - DNA, 18 bp, Homo sapiens
gcaggatccgctgccacc

SEQ ID NO: 3903009 - DNA, 19 bp, Homo sapiens
gcaggatccgctgccacca

SEQ ID NO: 3903010 - DNA, 17 bp, Homo sapiens
gcaggcacacagcagcc

SEQ ID NO: 3903011 - DNA, 14 bp, Homo sapiens
gcaggcagagcggg

SEQ ID NO: 3903012 - DNA, 20 bp, Homo sapiens
gcaggcagagcggggaggtg

SEQ ID NO: 3903013 - DNA, 23 bp, Homo sapiens
gcaggcagagcggggaggtgcct

SEQ ID NO: 3903014 - DNA, 15 bp, Homo sapiens
gcaggcagggctctc

SEQ ID NO: 3903015 - DNA, 20 bp, Homo sapiens
gcaggccaagtcaggccctt

SEQ ID NO: 3903016 - DNA, 13 bp, Homo sapiens
gcaggcccgacag

SEQ ID NO: 3903017 - DNA, 17 bp, Homo sapiens
gcaggcccgacagagag

SEQ ID NO: 3903018 - DNA, 21 bp, Homo sapiens
gcaggcccgacagagagatga

SEQ ID NO: 3903019 - DNA, 18 bp, Homo sapiens
gcaggcctgggacccagc

SEQ ID NO: 3903020 - DNA, 20 bp, Homo sapiens
gcaggcctgggacccagcta

SEQ ID NO: 3903021 - DNA, 17 bp, Homo sapiens
gcaggctcagactctgg

SEQ ID NO: 3903022 - DNA, 16 bp, Homo sapiens
gcaggctccccctgcc

SEQ ID NO: 3903023 - DNA, 19 bp, Homo sapiens
gcaggctctgggctcaggg

SEQ ID NO: 3903024 - DNA, 23 bp, Homo sapiens
gcaggctctgggctcagggctgg

SEQ ID NO: 3903025 - DNA, 15 bp, Homo sapiens
gcaggctggctggcc

SEQ ID NO: 3903026 - DNA, 15 bp, Homo sapiens
gcagggaaagctcca

SEQ ID NO: 3903027 - DNA, 17 bp, Homo sapiens
gcagggaaagctccacg

SEQ ID NO: 3903028 - DNA, 14 bp, Homo sapiens
gcagggaagagggc

SEQ ID NO: 3903029 - DNA, 16 bp, Homo sapiens
gcagggaagagggcag

SEQ ID NO: 3903030 - DNA, 17 bp, Homo sapiens
gcagggaagagggcagt

SEQ ID NO: 3903031 - DNA, 21 bp, Homo sapiens
gcagggacaaagaggccttta

SEQ ID NO: 3903032 - DNA, 22 bp, Homo sapiens
gcagggagaggagtgactgagc

SEQ ID NO: 3903033 - DNA, 18 bp, Homo sapiens
gcagggagcaactctcca

SEQ ID NO: 3903034 - DNA, 16 bp, Homo sapiens
gcagggagctgggctt

SEQ ID NO: 3903035 - DNA, 15 bp, Homo sapiens
gcagggaggatgcca

SEQ ID NO: 3903036 - DNA, 15 bp, Homo sapiens
gcagggatttgagga

SEQ ID NO: 3903037 - DNA, 22 bp, Homo sapiens
gcagggcaaatgacatgcactg

SEQ ID NO: 3903038 - DNA, 14 bp, Homo sapiens
gcagggcagaggga

SEQ ID NO: 3903039 - DNA, 13 bp, Homo sapiens
gcagggccgggga

SEQ ID NO: 3903040 - DNA, 22 bp, Homo sapiens
gcagggccggggaactggccaa

SEQ ID NO: 3903041 - DNA, 19 bp, Homo sapiens
gcagggccttgcccagaga

SEQ ID NO: 3903042 - DNA, 15 bp, Homo sapiens
gcagggctctcctgg

SEQ ID NO: 3903043 - DNA, 16 bp, Homo sapiens
gcagggctctcctggc

SEQ ID NO: 3903044 - DNA, 16 bp, Homo sapiens
gcagggctctgcccca

SEQ ID NO: 3903045 - DNA, 14 bp, Homo sapiens
gcatgacactctag

SEQ ID NO: 3903046 - DNA, 21 bp, Homo sapiens
gcatgagggatcacagggccc

SEQ ID NO: 3903047 - DNA, 18 bp, Homo sapiens
gcatgatctgaaaaatac

SEQ ID NO: 3903048 - DNA, 20 bp, Homo sapiens
gcatgatgttaaccagaata

SEQ ID NO: 3903049 - DNA, 17 bp, Homo sapiens
gcatgatttatatatgg

SEQ ID NO: 3903050 - DNA, 16 bp, Homo sapiens
gcatgattttatacat

SEQ ID NO: 3903051 - DNA, 21 bp, Homo sapiens
gcatgcctctgatatgggact

SEQ ID NO: 3903052 - DNA, 21 bp, Homo sapiens
gcatgcgcacaaggctgacca

SEQ ID NO: 3903053 - DNA, 14 bp, Homo sapiens
gcatgcgcaggctc

SEQ ID NO: 3903054 - DNA, 13 bp, Homo sapiens
gcatgctctctgc

SEQ ID NO: 3903055 - DNA, 15 bp, Homo sapiens
gcatgctctctgcag

SEQ ID NO: 3903056 - DNA, 12 bp, Homo sapiens
gcatgctctgga

SEQ ID NO: 3903057 - DNA, 14 bp, Homo sapiens
gcatgctctggaag

SEQ ID NO: 3903058 - DNA, 20 bp, Homo sapiens
gcatggcaaggactgcaggg

SEQ ID NO: 3903059 - DNA, 13 bp, Homo sapiens
gcatggccaggtg

SEQ ID NO: 3903060 - DNA, 15 bp, Homo sapiens
gcatggcttggggag

SEQ ID NO: 3903061 - DNA, 16 bp, Homo sapiens
gcatggcttggggagc

SEQ ID NO: 3903062 - DNA, 18 bp, Homo sapiens
gcatggcttggggagcag

SEQ ID NO: 3903063 - DNA, 20 bp, Homo sapiens
gcatggcttggggagcagag

SEQ ID NO: 3903064 - DNA, 14 bp, Homo sapiens
gcatggtgctttca

SEQ ID NO: 3903065 - DNA, 19 bp, Homo sapiens
gcatggttccttccctggg

SEQ ID NO: 3903066 - DNA, 15 bp, Homo sapiens
gcatgtaggagaatc

SEQ ID NO: 3903067 - DNA, 21 bp, Homo sapiens
gcatgtatgtgcacatgtgtc

SEQ ID NO: 3903068 - DNA, 15 bp, Homo sapiens
gcatgtgtgcctgtg

SEQ ID NO: 3903069 - DNA, 18 bp, Homo sapiens
gcatgtgtgcctgtggca

SEQ ID NO: 3903070 - DNA, 15 bp, Homo sapiens
gcatgtgtgtataag

SEQ ID NO: 3903071 - DNA, 16 bp, Homo sapiens
gcatgtgttgtacaat

SEQ ID NO: 3903072 - DNA, 20 bp, Homo sapiens
gcattaaattttaaggtaga

SEQ ID NO: 3903073 - DNA, 18 bp, Homo sapiens
gcattacgtgagccaggt

SEQ ID NO: 3903074 - DNA, 13 bp, Homo sapiens
gcattagaaatta

SEQ ID NO: 3903075 - DNA, 16 bp, Homo sapiens
gcattattcctccagg

SEQ ID NO: 3903076 - DNA, 16 bp, Homo sapiens
gcattatttaatgttt

SEQ ID NO: 3903077 - DNA, 15 bp, Homo sapiens
gcattcaataaatat

SEQ ID NO: 3903078 - DNA, 15 bp, Homo sapiens
gcattcagcacaccc

SEQ ID NO: 3903079 - DNA, 20 bp, Homo sapiens
gcattcagcacaccccaagg

SEQ ID NO: 3903080 - DNA, 13 bp, Homo sapiens
gcattccatgatt

SEQ ID NO: 3903081 - DNA, 14 bp, Homo sapiens
gcattccatgattt

SEQ ID NO: 3903082 - DNA, 16 bp, Homo sapiens
gcattccatgatttta

SEQ ID NO: 3903083 - DNA, 20 bp, Homo sapiens
gcattccatgattttacaga

SEQ ID NO: 3903084 - DNA, 22 bp, Homo sapiens
gcattccatgattttacagaga

SEQ ID NO: 3903085 - DNA, 13 bp, Homo sapiens
gcattcccagtgg

SEQ ID NO: 3903086 - DNA, 14 bp, Homo sapiens
gcattccctgagtc

SEQ ID NO: 3903087 - DNA, 21 bp, Homo sapiens
gcattcctaagaagtccccag

SEQ ID NO: 3903088 - DNA, 19 bp, Homo sapiens
gcattcctacaaagatgtt

SEQ ID NO: 3903089 - DNA, 15 bp, Homo sapiens
gcattctcactccta

SEQ ID NO: 3903090 - DNA, 18 bp, Homo sapiens
gcattctcactcctacct

SEQ ID NO: 3903091 - DNA, 16 bp, Homo sapiens
gcattcttttaaagtt

SEQ ID NO: 3903092 - DNA, 16 bp, Homo sapiens
gcattgaatatattat

SEQ ID NO: 3903093 - DNA, 13 bp, Homo sapiens
gcattgcatggac

SEQ ID NO: 3903094 - DNA, 20 bp, Homo sapiens
gcattgggctgacacctacc

SEQ ID NO: 3903095 - DNA, 19 bp, Homo sapiens
gcattggggggccgggcag

SEQ ID NO: 3903096 - DNA, 16 bp, Homo sapiens
gcattgtaaatgtgct

SEQ ID NO: 3903097 - DNA, 17 bp, Homo sapiens
gcattgttattgtggaa

SEQ ID NO: 3903098 - DNA, 22 bp, Homo sapiens
gcatttagttttatggcatgat

SEQ ID NO: 3903099 - DNA, 17 bp, Homo sapiens
gcatttataaatgtgtg

SEQ ID NO: 3903100 - DNA, 15 bp, Homo sapiens
gcatttccacactgt

SEQ ID NO: 3903101 - DNA, 20 bp, Homo sapiens
gcatttccacactgtcagag

SEQ ID NO: 3903102 - DNA, 21 bp, Homo sapiens
gcatttcctgggtggctactc

SEQ ID NO: 3903103 - DNA, 15 bp, Homo sapiens
gcatttgccattcct

SEQ ID NO: 3903104 - DNA, 16 bp, Homo sapiens
gcatttgccattcctg

SEQ ID NO: 3903105 - DNA, 22 bp, Homo sapiens
gcattttaaaagcaattatatt

SEQ ID NO: 3903106 - DNA, 14 bp, Homo sapiens
gcattttcccagat

SEQ ID NO: 3903107 - DNA, 23 bp, Homo sapiens
gcattttcctcgcctaggcctgt

SEQ ID NO: 3903108 - DNA, 22 bp, Homo sapiens
gcattttgggggtttttaatct

SEQ ID NO: 3903109 - DNA, 20 bp, Homo sapiens
gcatttttgatttatgcatg

SEQ ID NO: 3903110 - DNA, 20 bp, Homo sapiens
gccaaaaaggaccaactggc

SEQ ID NO: 3903111 - DNA, 14 bp, Homo sapiens
gccaaaagggcagc

SEQ ID NO: 3903112 - DNA, 19 bp, Homo sapiens
gccaaaaggtttcatgtag

SEQ ID NO: 3903113 - DNA, 11 bp, Homo sapiens
gccaaattatt

SEQ ID NO: 3903114 - DNA, 21 bp, Homo sapiens
gccaacctgatgccccttccc

SEQ ID NO: 3903115 - DNA, 15 bp, Homo sapiens
gccaactaagccctc

SEQ ID NO: 3903116 - DNA, 23 bp, Homo sapiens
gccaactaagccctcgaaccaag

SEQ ID NO: 3903117 - DNA, 14 bp, Homo sapiens
gccaactcctcctt

SEQ ID NO: 3903118 - DNA, 16 bp, Homo sapiens
gccaactcctccttgc

SEQ ID NO: 3903119 - DNA, 14 bp, Homo sapiens
gccaacttggcttt

SEQ ID NO: 3903120 - DNA, 14 bp, Homo sapiens
gccaacttgtaaat

SEQ ID NO: 3903121 - DNA, 15 bp, Homo sapiens
gccaacttgtaaata

SEQ ID NO: 3903122 - DNA, 13 bp, Homo sapiens
gccaagagagaca

SEQ ID NO: 3903123 - DNA, 18 bp, Homo sapiens
gccaagctgaggtgccca

SEQ ID NO: 3903124 - DNA, 23 bp, Homo sapiens
gccaagctgaggtgcccaggaga

SEQ ID NO: 3903125 - DNA, 16 bp, Homo sapiens
gccaagctttcttcta

SEQ ID NO: 3903126 - DNA, 18 bp, Homo sapiens
gccaagtccaggtcctgg

SEQ ID NO: 3903127 - DNA, 19 bp, Homo sapiens
gccaagtccaggtcctggt

SEQ ID NO: 3903128 - DNA, 22 bp, Homo sapiens
gccaagtccaggtcctggtggg

SEQ ID NO: 3903129 - DNA, 16 bp, Homo sapiens
gccaattaaaatatat

SEQ ID NO: 3903130 - DNA, 17 bp, Homo sapiens
gccaattaaaatatata

SEQ ID NO: 3903131 - DNA, 21 bp, Homo sapiens
gccaattaaaatatatataaa

SEQ ID NO: 3903132 - DNA, 10 bp, Homo sapiens
gccagctctc

SEQ ID NO: 3903133 - DNA, 17 bp, Homo sapiens
gccagctctctctaccc

SEQ ID NO: 3903134 - DNA, 19 bp, Homo sapiens
gccagctgcatctactcag

SEQ ID NO: 3903135 - DNA, 22 bp, Homo sapiens
gccagctgcatctactcaggcc

SEQ ID NO: 3903136 - DNA, 12 bp, Homo sapiens
gccagctgcctt

SEQ ID NO: 3903137 - DNA, 14 bp, Homo sapiens
gccagctgccttcc

SEQ ID NO: 3903138 - DNA, 13 bp, Homo sapiens
gccaggacacctg

SEQ ID NO: 3903139 - DNA, 14 bp, Homo sapiens
gccaggacacctgc

SEQ ID NO: 3903140 - DNA, 20 bp, Homo sapiens
gccaggacacctgccccagc

SEQ ID NO: 3903141 - DNA, 14 bp, Homo sapiens
gccaggacaggccc

SEQ ID NO: 3903142 - DNA, 15 bp, Homo sapiens
gccaggactccccag

SEQ ID NO: 3903143 - DNA, 11 bp, Homo sapiens
gccaggagaga

SEQ ID NO: 3903144 - DNA, 12 bp, Homo sapiens
gccaggagagag

SEQ ID NO: 3903145 - DNA, 15 bp, Homo sapiens
gccaggagcaaatgt

SEQ ID NO: 3903146 - DNA, 13 bp, Homo sapiens
gccaggagctgga

SEQ ID NO: 3903147 - DNA, 13 bp, Homo sapiens
gccaggagggaca

SEQ ID NO: 3903148 - DNA, 22 bp, Homo sapiens
gccaggagggacaaaggagcct

SEQ ID NO: 3903149 - DNA, 20 bp, Homo sapiens
gccaggaggttggtgactga

SEQ ID NO: 3903150 - DNA, 17 bp, Homo sapiens
gccaggagtctgtgctc

SEQ ID NO: 3903151 - DNA, 23 bp, Homo sapiens
gccaggagttgacgcatcctgca

SEQ ID NO: 3903152 - DNA, 15 bp, Homo sapiens
gccaggcacctggcc

SEQ ID NO: 3903153 - DNA, 20 bp, Homo sapiens
gccaggcacctggcctgctg

SEQ ID NO: 3903154 - DNA, 22 bp, Homo sapiens
gccaggcaggggtgggagagcc

SEQ ID NO: 3903155 - DNA, 18 bp, Homo sapiens
gccaggcaggtgcctgga

SEQ ID NO: 3903156 - DNA, 15 bp, Homo sapiens
gccaggccaccagga

SEQ ID NO: 3903157 - DNA, 16 bp, Homo sapiens
gccaggcccggggctg

SEQ ID NO: 3903158 - DNA, 18 bp, Homo sapiens
gccaggcccggggctggc

SEQ ID NO: 3903159 - DNA, 20 bp, Homo sapiens
gccaggcgttggtgccactt

SEQ ID NO: 3903160 - DNA, 20 bp, Homo sapiens
gccaggctccctttctcttc

SEQ ID NO: 3903161 - DNA, 21 bp, Homo sapiens
gccaggctgtaagcattctga

SEQ ID NO: 3903162 - DNA, 18 bp, Homo sapiens
gccagggattgaggagga

SEQ ID NO: 3903163 - DNA, 14 bp, Homo sapiens
gccagggcctggtg

SEQ ID NO: 3903164 - DNA, 15 bp, Homo sapiens
gccaggggctgctca

SEQ ID NO: 3903165 - DNA, 17 bp, Homo sapiens
gccagggtgagagctgc

SEQ ID NO: 3903166 - DNA, 23 bp, Homo sapiens
gccagggtgagagctgctctgga

SEQ ID NO: 3903167 - DNA, 15 bp, Homo sapiens
gccagtcctagagct

SEQ ID NO: 3903168 - DNA, 22 bp, Homo sapiens
gccagtcctagagctcctgtcc

SEQ ID NO: 3903169 - DNA, 16 bp, Homo sapiens
gccagtctgggctgcc

SEQ ID NO: 3903170 - DNA, 17 bp, Homo sapiens
gccagtcttgcctaggc

SEQ ID NO: 3903171 - DNA, 18 bp, Homo sapiens
gccagtcttgcctaggcc

SEQ ID NO: 3903172 - DNA, 15 bp, Homo sapiens
gccagtgactttttc

SEQ ID NO: 3903173 - DNA, 15 bp, Homo sapiens
gccagtgagggctgg

SEQ ID NO: 3903174 - DNA, 11 bp, Homo sapiens
gccagtgcctt

SEQ ID NO: 3903175 - DNA, 21 bp, Homo sapiens
gccagtgccttacctcctgcc

SEQ ID NO: 3903176 - DNA, 20 bp, Homo sapiens
gccagtttgcttagttctca

SEQ ID NO: 3903177 - DNA, 21 bp, Homo sapiens
gccatcacaaggggaacgcag

SEQ ID NO: 3903178 - DNA, 13 bp, Homo sapiens
gccatcccacatt

SEQ ID NO: 3903179 - DNA, 13 bp, Homo sapiens
gccatccctgggc

SEQ ID NO: 3903180 - DNA, 18 bp, Homo sapiens
gccatccctgggcccctc

SEQ ID NO: 3903181 - DNA, 21 bp, Homo sapiens
gccatccctgggcccctccac

SEQ ID NO: 3903182 - DNA, 18 bp, Homo sapiens
gccatccgggacgcttcc

SEQ ID NO: 3903183 - DNA, 22 bp, Homo sapiens
gccatccgggacgcttccagac

SEQ ID NO: 3903184 - DNA, 20 bp, Homo sapiens
gccatgaggagttgctgttt

SEQ ID NO: 3903185 - DNA, 14 bp, Homo sapiens
gccatgccactgcc

SEQ ID NO: 3903186 - DNA, 12 bp, Homo sapiens
gccatgcccaga

SEQ ID NO: 3903187 - DNA, 15 bp, Homo sapiens
gccatgcccagagaa

SEQ ID NO: 3903188 - DNA, 15 bp, Homo sapiens
gccatgcctcatgcc

SEQ ID NO: 3903189 - DNA, 20 bp, Homo sapiens
gccatggctcaggcaagccc

SEQ ID NO: 3903190 - DNA, 13 bp, Homo sapiens
gccatgggcctgc

SEQ ID NO: 3903191 - DNA, 16 bp, Homo sapiens
gccatgggcctgctgc

SEQ ID NO: 3903192 - DNA, 14 bp, Homo sapiens
gccatgggcctggg

SEQ ID NO: 3903193 - DNA, 19 bp, Homo sapiens
gccatgggcctgggcctgc

SEQ ID NO: 3903194 - DNA, 17 bp, Homo sapiens
gccatggtgacacacag

SEQ ID NO: 3903195 - DNA, 20 bp, Homo sapiens
gccatgtttagattccagga

SEQ ID NO: 3903196 - DNA, 13 bp, Homo sapiens
gccatttctctgc

SEQ ID NO: 3903197 - DNA, 14 bp, Homo sapiens
gccatttgtactga

SEQ ID NO: 3903198 - DNA, 17 bp, Homo sapiens
gccattttcttgcctga

SEQ ID NO: 3903199 - DNA, 21 bp, Homo sapiens
gcccaaagagaaatcacaggg

SEQ ID NO: 3903200 - DNA, 17 bp, Homo sapiens
gcccaagaggactgaga

SEQ ID NO: 3903201 - DNA, 14 bp, Homo sapiens
gcccaagaggtctg

SEQ ID NO: 3903202 - DNA, 10 bp, Homo sapiens
gcccaaggct

SEQ ID NO: 3903203 - DNA, 16 bp, Homo sapiens
gcccaagtgccatccc

SEQ ID NO: 3903204 - DNA, 20 bp, Homo sapiens
gcccaagtgccatcccacat

SEQ ID NO: 3903205 - DNA, 16 bp, Homo sapiens
gcccacaaaggggaga

SEQ ID NO: 3903206 - DNA, 12 bp, Homo sapiens
gcccacacccct

SEQ ID NO: 3903207 - DNA, 13 bp, Homo sapiens
gcccacacccctc

SEQ ID NO: 3903208 - DNA, 16 bp, Homo sapiens
gcccacagctcccacc

SEQ ID NO: 3903209 - DNA, 15 bp, Homo sapiens
gcccacatcccaggc

SEQ ID NO: 3903210 - DNA, 23 bp, Homo sapiens
gcccagaattcccagctgtctgt

SEQ ID NO: 3903211 - DNA, 16 bp, Homo sapiens
gcccagagatgcctcc

SEQ ID NO: 3903212 - DNA, 19 bp, Homo sapiens
gcccagagatgcctccacc

SEQ ID NO: 3903213 - DNA, 12 bp, Homo sapiens
gcccagagggcc

SEQ ID NO: 3903214 - DNA, 15 bp, Homo sapiens
gcccagcccagctgg

SEQ ID NO: 3903215 - DNA, 15 bp, Homo sapiens
gcccagcctagccca

SEQ ID NO: 3903216 - DNA, 16 bp, Homo sapiens
gcccagcctgtcctgg

SEQ ID NO: 3903217 - DNA, 18 bp, Homo sapiens
gcccagcctgtcctggta

SEQ ID NO: 3903218 - DNA, 15 bp, Homo sapiens
gcccagctacattcc

SEQ ID NO: 3903219 - DNA, 13 bp, Homo sapiens
gccccctggatgg

SEQ ID NO: 3903220 - DNA, 16 bp, Homo sapiens
gccccctggatgtccc

SEQ ID NO: 3903221 - DNA, 21 bp, Homo sapiens
gccccctggatgtcccctgtc

SEQ ID NO: 3903222 - DNA, 17 bp, Homo sapiens
gccccctgtgccagctc

SEQ ID NO: 3903223 - DNA, 13 bp, Homo sapiens
gccccgctgggat

SEQ ID NO: 3903224 - DNA, 23 bp, Homo sapiens
gccccgctgggatttcttcgctg

SEQ ID NO: 3903225 - DNA, 19 bp, Homo sapiens
gccccgggctctggccacc

SEQ ID NO: 3903226 - DNA, 20 bp, Homo sapiens
gccccgggctctggccaccc

SEQ ID NO: 3903227 - DNA, 19 bp, Homo sapiens
gccccggggctggcaagca

SEQ ID NO: 3903228 - DNA, 23 bp, Homo sapiens
gccccggggctggcaagcaggga

SEQ ID NO: 3903229 - DNA, 20 bp, Homo sapiens
gccccgggtgcctcagagca

SEQ ID NO: 3903230 - DNA, 13 bp, Homo sapiens
gccccgttccctg

SEQ ID NO: 3903231 - DNA, 16 bp, Homo sapiens
gccccgttccctgtca

SEQ ID NO: 3903232 - DNA, 21 bp, Homo sapiens
gccccgttccctgtcagaggc

SEQ ID NO: 3903233 - DNA, 19 bp, Homo sapiens
gcccctagtgctattctgt

SEQ ID NO: 3903234 - DNA, 15 bp, Homo sapiens
gcccctcaccccaag

SEQ ID NO: 3903235 - DNA, 16 bp, Homo sapiens
gcccctcacctgggcc

SEQ ID NO: 3903236 - DNA, 17 bp, Homo sapiens
gcccctcacctgggcct

SEQ ID NO: 3903237 - DNA, 18 bp, Homo sapiens
gcccctcacctgggcctt

SEQ ID NO: 3903238 - DNA, 17 bp, Homo sapiens
gcccctcagcccttgcc

SEQ ID NO: 3903239 - DNA, 18 bp, Homo sapiens
gcccctcagcccttgccc

SEQ ID NO: 3903240 - DNA, 16 bp, Homo sapiens
gcccctccccagccct

SEQ ID NO: 3903241 - DNA, 22 bp, Homo sapiens
gcccctccctcctctggcccag

SEQ ID NO: 3903242 - DNA, 12 bp, Homo sapiens
gcccctcctctg

SEQ ID NO: 3903243 - DNA, 13 bp, Homo sapiens
gcccctcctctgc

SEQ ID NO: 3903244 - DNA, 16 bp, Homo sapiens
gcccctcctctgccac

SEQ ID NO: 3903245 - DNA, 17 bp, Homo sapiens
gcccctcgctgctgcta

SEQ ID NO: 3903246 - DNA, 15 bp, Homo sapiens
gcccctgaggactgg

SEQ ID NO: 3903247 - DNA, 13 bp, Homo sapiens
gcccctgcacaaa

SEQ ID NO: 3903248 - DNA, 14 bp, Homo sapiens
gcccctgcatcccc

SEQ ID NO: 3903249 - DNA, 16 bp, Homo sapiens
gcccctggtcctgagg

SEQ ID NO: 3903250 - DNA, 16 bp, Homo sapiens
gccccttccccatctc

SEQ ID NO: 3903251 - DNA, 13 bp, Homo sapiens
gccccttgggcat

SEQ ID NO: 3903252 - DNA, 21 bp, Homo sapiens
gccccttgggcatccacccag

SEQ ID NO: 3903253 - DNA, 23 bp, Homo sapiens
gccccttgggcatccacccagtg

SEQ ID NO: 3903254 - DNA, 13 bp, Homo sapiens
gcccgaaagctga

SEQ ID NO: 3903255 - DNA, 18 bp, Homo sapiens
gcccgaagcccagtttcc

SEQ ID NO: 3903256 - DNA, 15 bp, Homo sapiens
gcccgactagcaggc

SEQ ID NO: 3903257 - DNA, 13 bp, Homo sapiens
gcccgagcagctg

SEQ ID NO: 3903258 - DNA, 16 bp, Homo sapiens
gcccgagcagctgagc

SEQ ID NO: 3903259 - DNA, 23 bp, Homo sapiens
gcccgagcagctgagcagggccg

SEQ ID NO: 3903260 - DNA, 17 bp, Homo sapiens
gcccgaggaccgggctg

SEQ ID NO: 3903261 - DNA, 12 bp, Homo sapiens
gcccgcagagcc

SEQ ID NO: 3903262 - DNA, 14 bp, Homo sapiens
gcccgccagcctca

SEQ ID NO: 3903263 - DNA, 22 bp, Homo sapiens
gcccggcctgctcccagcagcc

SEQ ID NO: 3903264 - DNA, 12 bp, Homo sapiens
gcccgggacagg

SEQ ID NO: 3903265 - DNA, 16 bp, Homo sapiens
gccctaacgggggtgc

SEQ ID NO: 3903266 - DNA, 20 bp, Homo sapiens
gccctacatcttcagctccc

SEQ ID NO: 3903267 - DNA, 23 bp, Homo sapiens
gccctacatcttcagctcccata

SEQ ID NO: 3903268 - DNA, 15 bp, Homo sapiens
gccctaccctcactc

SEQ ID NO: 3903269 - DNA, 14 bp, Homo sapiens
gccctatggatgtg

SEQ ID NO: 3903270 - DNA, 12 bp, Homo sapiens
gccctcagaaca

SEQ ID NO: 3903271 - DNA, 21 bp, Homo sapiens
gccctcagtcagttcccggag

SEQ ID NO: 3903272 - DNA, 23 bp, Homo sapiens
gccctcagtcagttcccggagca

SEQ ID NO: 3903273 - DNA, 24 bp, Homo sapiens
gccctcccagcaagtttcaccttg

SEQ ID NO: 3903274 - DNA, 20 bp, Homo sapiens
gccctccctgactccctgtg

SEQ ID NO: 3903275 - DNA, 20 bp, Homo sapiens
gccctccctggggtccttgc

SEQ ID NO: 3903276 - DNA, 21 bp, Homo sapiens
gccctccgagccgcgccaacg

SEQ ID NO: 3903277 - DNA, 14 bp, Homo sapiens
gccctcctcacccc

SEQ ID NO: 3903278 - DNA, 22 bp, Homo sapiens
gccctcgaaccaaggcagcctc

SEQ ID NO: 3903279 - DNA, 20 bp, Homo sapiens
gccctctcccatgcacacaa

SEQ ID NO: 3903280 - DNA, 16 bp, Homo sapiens
gccctctggatcctgc

SEQ ID NO: 3903281 - DNA, 18 bp, Homo sapiens
gccctgaaggttcctgag

SEQ ID NO: 3903282 - DNA, 13 bp, Homo sapiens
gccctgacctccc

SEQ ID NO: 3903283 - DNA, 19 bp, Homo sapiens
gccctgacctcccagccct

SEQ ID NO: 3903284 - DNA, 13 bp, Homo sapiens
gccctgcagaccc

SEQ ID NO: 3903285 - DNA, 16 bp, Homo sapiens
gccctgcagaccctgc

SEQ ID NO: 3903286 - DNA, 19 bp, Homo sapiens
gccctgcagaccctgccct

SEQ ID NO: 3903287 - DNA, 14 bp, Homo sapiens
gccctgccaggagg

SEQ ID NO: 3903288 - DNA, 15 bp, Homo sapiens
gccctgccaggaggc

SEQ ID NO: 3903289 - DNA, 12 bp, Homo sapiens
gccctgccatta

SEQ ID NO: 3903290 - DNA, 20 bp, Homo sapiens
gccctgccctctccttcctt

SEQ ID NO: 3903291 - DNA, 16 bp, Homo sapiens
gccctgcctccctttc

SEQ ID NO: 3903292 - DNA, 17 bp, Homo sapiens
gccctgcctgcccactt

SEQ ID NO: 3903293 - DNA, 11 bp, Homo sapiens
gccctgcctgg

SEQ ID NO: 3903294 - DNA, 15 bp, Homo sapiens
gccctgcctggagga

SEQ ID NO: 3903295 - DNA, 19 bp, Homo sapiens
gccctgcctggaggacctg

SEQ ID NO: 3903296 - DNA, 14 bp, Homo sapiens
gccctgccttcagc

SEQ ID NO: 3903297 - DNA, 14 bp, Homo sapiens
gccctgcggagacc

SEQ ID NO: 3903298 - DNA, 18 bp, Homo sapiens
gccctgcgttggagccac

SEQ ID NO: 3903299 - DNA, 16 bp, Homo sapiens
gccctgctctggggat

SEQ ID NO: 3903300 - DNA, 23 bp, Homo sapiens
gccctgctgccgcctcccagcct

SEQ ID NO: 3903301 - DNA, 22 bp, Homo sapiens
gccctgctgtgggagagcgaag

SEQ ID NO: 3903302 - DNA, 20 bp, Homo sapiens
gccctgctttgggctgccct

SEQ ID NO: 3903303 - DNA, 21 bp, Homo sapiens
gccctgctttgggctgccctg

SEQ ID NO: 3903304 - DNA, 14 bp, Homo sapiens
gccctggagggagg

SEQ ID NO: 3903305 - DNA, 20 bp, Homo sapiens
gccctggatcagcgtggcct

SEQ ID NO: 3903306 - DNA, 16 bp, Homo sapiens
gcctaagtggctgctg

SEQ ID NO: 3903307 - DNA, 22 bp, Homo sapiens
gcctaatctcatacctctgacc

SEQ ID NO: 3903308 - DNA, 15 bp, Homo sapiens
gcctaatggagaaga

SEQ ID NO: 3903309 - DNA, 22 bp, Homo sapiens
gcctaattcctggcatgacact

SEQ ID NO: 3903310 - DNA, 22 bp, Homo sapiens
gcctacccttgtaccccatccc

SEQ ID NO: 3903311 - DNA, 18 bp, Homo sapiens
gcctagccacctcccacc

SEQ ID NO: 3903312 - DNA, 19 bp, Homo sapiens
gcctagccacctcccaccc

SEQ ID NO: 3903313 - DNA, 14 bp, Homo sapiens
gcctagcccacttg

SEQ ID NO: 3903314 - DNA, 17 bp, Homo sapiens
gcctaggaattcccagc

SEQ ID NO: 3903315 - DNA, 22 bp, Homo sapiens
gcctagtggggtctccctctcc

SEQ ID NO: 3903316 - DNA, 23 bp, Homo sapiens
gcctagtggggtctccctctcct

SEQ ID NO: 3903317 - DNA, 16 bp, Homo sapiens
gcctatccatcctgcg

SEQ ID NO: 3903318 - DNA, 14 bp, Homo sapiens
gcctatctgagact

SEQ ID NO: 3903319 - DNA, 17 bp, Homo sapiens
gcctatgacttgggcac

SEQ ID NO: 3903320 - DNA, 16 bp, Homo sapiens
gcctatggagagccct

SEQ ID NO: 3903321 - DNA, 18 bp, Homo sapiens
gcctatggagagccctgg

SEQ ID NO: 3903322 - DNA, 21 bp, Homo sapiens
gcctatggagagccctgggac

SEQ ID NO: 3903323 - DNA, 20 bp, Homo sapiens
gcctattatattaaaatatg

SEQ ID NO: 3903324 - DNA, 14 bp, Homo sapiens
gcctatttattggg

SEQ ID NO: 3903325 - DNA, 15 bp, Homo sapiens
gcctatttattgggg

SEQ ID NO: 3903326 - DNA, 19 bp, Homo sapiens
gcctatttattggggatct

SEQ ID NO: 3903327 - DNA, 17 bp, Homo sapiens
gcctcaagaacaccttt

SEQ ID NO: 3903328 - DNA, 15 bp, Homo sapiens
gcctcacacccagag

SEQ ID NO: 3903329 - DNA, 13 bp, Homo sapiens
gcctcacagaaga

SEQ ID NO: 3903330 - DNA, 15 bp, Homo sapiens
gcctcactggctggg

SEQ ID NO: 3903331 - DNA, 16 bp, Homo sapiens
gcctcactggctgggg

SEQ ID NO: 3903332 - DNA, 22 bp, Homo sapiens
gcctcactggctggggcagagg

SEQ ID NO: 3903333 - DNA, 17 bp, Homo sapiens
gcctcacttccctggga

SEQ ID NO: 3903334 - DNA, 19 bp, Homo sapiens
gcctcacttccctgggaac

SEQ ID NO: 3903335 - DNA, 17 bp, Homo sapiens
gcctcagaaaccagact

SEQ ID NO: 3903336 - DNA, 12 bp, Homo sapiens
gcctcagaccaa

SEQ ID NO: 3903337 - DNA, 15 bp, Homo sapiens
gcctcagagcaggct

SEQ ID NO: 3903338 - DNA, 14 bp, Homo sapiens
gcctcagctcagcc

SEQ ID NO: 3903339 - DNA, 16 bp, Homo sapiens
gcctcagctcagcctc

SEQ ID NO: 3903340 - DNA, 22 bp, Homo sapiens
gcctcagtaagtatctggagga

SEQ ID NO: 3903341 - DNA, 16 bp, Homo sapiens
gcctcagtgccacttg

SEQ ID NO: 3903342 - DNA, 20 bp, Homo sapiens
gcctcagtttctccatcagc

SEQ ID NO: 3903343 - DNA, 22 bp, Homo sapiens
gcctcatatttaaagacaggga

SEQ ID NO: 3903344 - DNA, 24 bp, Homo sapiens
gcctcatccctcggaagccgtctg

SEQ ID NO: 3903345 - DNA, 22 bp, Homo sapiens
gcctcatctataacatgcattt

SEQ ID NO: 3903346 - DNA, 14 bp, Homo sapiens
gcctccacgggggc

SEQ ID NO: 3903347 - DNA, 13 bp, Homo sapiens
gcctccactcccc

SEQ ID NO: 3903348 - DNA, 13 bp, Homo sapiens
gcctccagagcca

SEQ ID NO: 3903349 - DNA, 14 bp, Homo sapiens
gcctccagagccag

SEQ ID NO: 3903350 - DNA, 17 bp, Homo sapiens
gcctccagagccagcct

SEQ ID NO: 3903351 - DNA, 18 bp, Homo sapiens
gcctccagagccagcctg

SEQ ID NO: 3903352 - DNA, 21 bp, Homo sapiens
gcctccagagccagcctggga

SEQ ID NO: 3903353 - DNA, 16 bp, Homo sapiens
gcctccagcctctccc

SEQ ID NO: 3903354 - DNA, 22 bp, Homo sapiens
gcctccagcctctcccggctgc

SEQ ID NO: 3903355 - DNA, 11 bp, Homo sapiens
gcctccatgct

SEQ ID NO: 3903356 - DNA, 13 bp, Homo sapiens
gcctcccagagtg

SEQ ID NO: 3903357 - DNA, 18 bp, Homo sapiens
gcctcccagccctgccag

SEQ ID NO: 3903358 - DNA, 21 bp, Homo sapiens
gcctcccagccctgccaggag

SEQ ID NO: 3903359 - DNA, 16 bp, Homo sapiens
gcctccccacatatgg

SEQ ID NO: 3903360 - DNA, 12 bp, Homo sapiens
gcctccccacct

SEQ ID NO: 3903361 - DNA, 14 bp, Homo sapiens
gcctccccctcaga

SEQ ID NO: 3903362 - DNA, 15 bp, Homo sapiens
gcctccccctcagat

SEQ ID NO: 3903363 - DNA, 22 bp, Homo sapiens
gcctccccctcagatgatctct

SEQ ID NO: 3903364 - DNA, 16 bp, Homo sapiens
gcctccccctgctgct

SEQ ID NO: 3903365 - DNA, 13 bp, Homo sapiens
gcctccctcaacc

SEQ ID NO: 3903366 - DNA, 14 bp, Homo sapiens
gcctccctcctcgt

SEQ ID NO: 3903367 - DNA, 16 bp, Homo sapiens
gcctccctggtccctt

SEQ ID NO: 3903368 - DNA, 14 bp, Homo sapiens
gcctccgtcaggag

SEQ ID NO: 3903369 - DNA, 18 bp, Homo sapiens
gcctccgtttatgggcct

SEQ ID NO: 3903370 - DNA, 19 bp, Homo sapiens
gcctccgtttatgggcctt

SEQ ID NO: 3903371 - DNA, 21 bp, Homo sapiens
gcctccgtttatgggccttgc

SEQ ID NO: 3903372 - DNA, 19 bp, Homo sapiens
gcctcctcacccccagctt

SEQ ID NO: 3903373 - DNA, 13 bp, Homo sapiens
gcctcctcctgac

SEQ ID NO: 3903374 - DNA, 12 bp, Homo sapiens
gcctcctgcctc

SEQ ID NO: 3903375 - DNA, 11 bp, Homo sapiens
gcctcctggcc

SEQ ID NO: 3903376 - DNA, 13 bp, Homo sapiens
gcctcctggccag

SEQ ID NO: 3903377 - DNA, 14 bp, Homo sapiens
gcctcctgggacca

SEQ ID NO: 3903378 - DNA, 14 bp, Homo sapiens
gcctcgaggcaccg

SEQ ID NO: 3903379 - DNA, 12 bp, Homo sapiens
gcctcgcaaccc

SEQ ID NO: 3903380 - DNA, 13 bp, Homo sapiens
gcctcgcctgggc

SEQ ID NO: 3903381 - DNA, 17 bp, Homo sapiens
gcctcgcctgggcccag

SEQ ID NO: 3903382 - DNA, 18 bp, Homo sapiens
gcctcgcctgggcccagg

SEQ ID NO: 3903383 - DNA, 22 bp, Homo sapiens
gcctcgcctgggcccaggctct

SEQ ID NO: 3903384 - DNA, 20 bp, Homo sapiens
gcctcgctccccactctgct

SEQ ID NO: 3903385 - DNA, 22 bp, Homo sapiens
gcctcgggacacctgccctgcc

SEQ ID NO: 3903386 - DNA, 14 bp, Homo sapiens
gcctcgtaccagcc

SEQ ID NO: 3903387 - DNA, 15 bp, Homo sapiens
gcctctactgggaag

SEQ ID NO: 3903388 - DNA, 16 bp, Homo sapiens
gcctctactgggaagg

SEQ ID NO: 3903389 - DNA, 18 bp, Homo sapiens
gcctctactgggaaggct

SEQ ID NO: 3903390 - DNA, 15 bp, Homo sapiens
gcctctagaacaccc

SEQ ID NO: 3903391 - DNA, 18 bp, Homo sapiens
gcctctagaacacccact

SEQ ID NO: 3903392 - DNA, 22 bp, Homo sapiens
gcctctagaacacccactggcc

SEQ ID NO: 3903393 - DNA, 16 bp, Homo sapiens
gcctggcacaggactg

SEQ ID NO: 3903394 - DNA, 17 bp, Homo sapiens
gcctggcacaggactga

SEQ ID NO: 3903395 - DNA, 22 bp, Homo sapiens
gcctggcagccgtgccttcagc

SEQ ID NO: 3903396 - DNA, 15 bp, Homo sapiens
gcctggcccccctcc

SEQ ID NO: 3903397 - DNA, 20 bp, Homo sapiens
gcctggcccccctccaggca

SEQ ID NO: 3903398 - DNA, 16 bp, Homo sapiens
gcctggcctcctgcct

SEQ ID NO: 3903399 - DNA, 16 bp, Homo sapiens
gcctggcctgagctgg

SEQ ID NO: 3903400 - DNA, 20 bp, Homo sapiens
gcctggcctgagctggggcc

SEQ ID NO: 3903401 - DNA, 15 bp, Homo sapiens
gcctggcctggctcc

SEQ ID NO: 3903402 - DNA, 18 bp, Homo sapiens
gcctggccttgtcaggac

SEQ ID NO: 3903403 - DNA, 13 bp, Homo sapiens
gcctggctcccca

SEQ ID NO: 3903404 - DNA, 21 bp, Homo sapiens
gcctggctggctgagggcagt

SEQ ID NO: 3903405 - DNA, 17 bp, Homo sapiens
gcctggctgtggaggcc

SEQ ID NO: 3903406 - DNA, 18 bp, Homo sapiens
gcctggctgtggaggcct

SEQ ID NO: 3903407 - DNA, 19 bp, Homo sapiens
gcctggctgtggaggcctg

SEQ ID NO: 3903408 - DNA, 14 bp, Homo sapiens
gcctggcttgctcc

SEQ ID NO: 3903409 - DNA, 19 bp, Homo sapiens
gcctggcttgctccagggt

SEQ ID NO: 3903410 - DNA, 15 bp, Homo sapiens
gcctgggaaaggaaa

SEQ ID NO: 3903411 - DNA, 16 bp, Homo sapiens
gcctgggaaaggaaaa

SEQ ID NO: 3903412 - DNA, 17 bp, Homo sapiens
gcctgggaaaggaaaac

SEQ ID NO: 3903413 - DNA, 22 bp, Homo sapiens
gcctgggaaaggaaaaccaggg

SEQ ID NO: 3903414 - DNA, 16 bp, Homo sapiens
gcctgggacccagcta

SEQ ID NO: 3903415 - DNA, 18 bp, Homo sapiens
gcctgggactcccagtga

SEQ ID NO: 3903416 - DNA, 16 bp, Homo sapiens
gcctgggcccaggctc

SEQ ID NO: 3903417 - DNA, 20 bp, Homo sapiens
gcctgggcccaggctctggg

SEQ ID NO: 3903418 - DNA, 23 bp, Homo sapiens
gcctgggcccaggctctgggaag

SEQ ID NO: 3903419 - DNA, 19 bp, Homo sapiens
gcctgggcctatggagagc

SEQ ID NO: 3903420 - DNA, 13 bp, Homo sapiens
gcctgggcctgtg

SEQ ID NO: 3903421 - DNA, 19 bp, Homo sapiens
gcctgggcctgtgcagcag

SEQ ID NO: 3903422 - DNA, 20 bp, Homo sapiens
gcctgggcctgtgcagcagc

SEQ ID NO: 3903423 - DNA, 22 bp, Homo sapiens
gcctgggcctgtgcagcagccc

SEQ ID NO: 3903424 - DNA, 23 bp, Homo sapiens
gcctggggctcctttctccagcc

SEQ ID NO: 3903425 - DNA, 17 bp, Homo sapiens
gcctgggggcagtgact

SEQ ID NO: 3903426 - DNA, 20 bp, Homo sapiens
gcctgggggcagtgactggc

SEQ ID NO: 3903427 - DNA, 21 bp, Homo sapiens
gcctgggggcagtgactggca

SEQ ID NO: 3903428 - DNA, 23 bp, Homo sapiens
gcctgggggcagtgactggcagg

SEQ ID NO: 3903429 - DNA, 23 bp, Homo sapiens
gcctgggtgagaatcctgcctct

SEQ ID NO: 3903430 - DNA, 23 bp, Homo sapiens
gcctgggtggcagagtgagactc

SEQ ID NO: 3903431 - DNA, 15 bp, Homo sapiens
gcctgggtggggctg

SEQ ID NO: 3903432 - DNA, 22 bp, Homo sapiens
gcctgggtggggctgctcctcc

SEQ ID NO: 3903433 - DNA, 23 bp, Homo sapiens
gcctgggtggggctgctcctcca

SEQ ID NO: 3903434 - DNA, 21 bp, Homo sapiens
gcctgggttttctaactgtaa

SEQ ID NO: 3903435 - DNA, 15 bp, Homo sapiens
gcctgtaatcccagc

SEQ ID NO: 3903436 - DNA, 18 bp, Homo sapiens
gcctgtaatcccagcact

SEQ ID NO: 3903437 - DNA, 18 bp, Homo sapiens
gcctgtaatcccagctac

SEQ ID NO: 3903438 - DNA, 13 bp, Homo sapiens
gcctgtactgcct

SEQ ID NO: 3903439 - DNA, 18 bp, Homo sapiens
gcctgtactgcctgcttg

SEQ ID NO: 3903440 - DNA, 20 bp, Homo sapiens
gcctgtactgcctgcttggg

SEQ ID NO: 3903441 - DNA, 14 bp, Homo sapiens
gcctgtagcagtga

SEQ ID NO: 3903442 - DNA, 17 bp, Homo sapiens
gcctgtagttaggaaat

SEQ ID NO: 3903443 - DNA, 22 bp, Homo sapiens
gcctgtagttaggaaataaaac

SEQ ID NO: 3903444 - DNA, 16 bp, Homo sapiens
gcctgtcccccaaggt

SEQ ID NO: 3903445 - DNA, 16 bp, Homo sapiens
gcctgtcctggtacag

SEQ ID NO: 3903446 - DNA, 14 bp, Homo sapiens
gcctgtgaacccag

SEQ ID NO: 3903447 - DNA, 15 bp, Homo sapiens
gcctgtgaacccagg

SEQ ID NO: 3903448 - DNA, 22 bp, Homo sapiens
gcctgtgaataaaaaccctgta

SEQ ID NO: 3903449 - DNA, 18 bp, Homo sapiens
gcctgtgaggcaggggcg

SEQ ID NO: 3903450 - DNA, 17 bp, Homo sapiens
gcctgtgcagcagccca

SEQ ID NO: 3903451 - DNA, 20 bp, Homo sapiens
gcctgtgcagcagcccagct

SEQ ID NO: 3903452 - DNA, 19 bp, Homo sapiens
gcctgtgcctcctcacccc

SEQ ID NO: 3903453 - DNA, 15 bp, Homo sapiens
gcctgtggagagaaa

SEQ ID NO: 3903454 - DNA, 12 bp, Homo sapiens
gcctgtggcaga

SEQ ID NO: 3903455 - DNA, 21 bp, Homo sapiens
gcctgtggcagaaaagaggag

SEQ ID NO: 3903456 - DNA, 18 bp, Homo sapiens
gcctgtggcggtgcctgg

SEQ ID NO: 3903457 - DNA, 15 bp, Homo sapiens
gcctgtgggagtaga

SEQ ID NO: 3903458 - DNA, 15 bp, Homo sapiens
gcctgtgtagctgtg

SEQ ID NO: 3903459 - DNA, 15 bp, Homo sapiens
gcctgtgtccagcag

SEQ ID NO: 3903460 - DNA, 17 bp, Homo sapiens
gcctgtgtccagcagct

SEQ ID NO: 3903461 - DNA, 19 bp, Homo sapiens
gcctgttcccattcttgca

SEQ ID NO: 3903462 - DNA, 23 bp, Homo sapiens
gcctgttcccattcttgcatggc

SEQ ID NO: 3903463 - DNA, 21 bp, Homo sapiens
gcctgttggacccgctctgga

SEQ ID NO: 3903464 - DNA, 20 bp, Homo sapiens
gccttaaaaggagagaagaa

SEQ ID NO: 3903465 - DNA, 22 bp, Homo sapiens
gccttaaaaggagagaagaaag

SEQ ID NO: 3903466 - DNA, 16 bp, Homo sapiens
gccttacctcctgccc

SEQ ID NO: 3903467 - DNA, 19 bp, Homo sapiens
gccttacctcctgcccagg

SEQ ID NO: 3903468 - DNA, 22 bp, Homo sapiens
gccttatgtaattattttcttt

SEQ ID NO: 3903469 - DNA, 21 bp, Homo sapiens
gccttcataggcggtcatgtg

SEQ ID NO: 3903470 - DNA, 22 bp, Homo sapiens
gccttcataggcggtcatgtgt

SEQ ID NO: 3903471 - DNA, 20 bp, Homo sapiens
gccttccccttttgcctggc

SEQ ID NO: 3903472 - DNA, 21 bp, Homo sapiens
gccttccccttttgcctggct

SEQ ID NO: 3903473 - DNA, 22 bp, Homo sapiens
gccttccccttttgcctggctg

SEQ ID NO: 3903474 - DNA, 24 bp, Homo sapiens
gccttccccttttgcctggctgtg

SEQ ID NO: 3903475 - DNA, 16 bp, Homo sapiens
gccttcctcatcccct

SEQ ID NO: 3903476 - DNA, 17 bp, Homo sapiens
gccttcctcatcccctc

SEQ ID NO: 3903477 - DNA, 22 bp, Homo sapiens
gccttcctcctccacagtgctg

SEQ ID NO: 3903478 - DNA, 16 bp, Homo sapiens
gccttctcaaacttta

SEQ ID NO: 3903479 - DNA, 15 bp, Homo sapiens
gcgtctaccctggga

SEQ ID NO: 3903480 - DNA, 21 bp, Homo sapiens
gcgtctcctgtttttctgggt

SEQ ID NO: 3903481 - DNA, 17 bp, Homo sapiens
gcgtctgccccaccctc

SEQ ID NO: 3903482 - DNA, 23 bp, Homo sapiens
gcgtgcacatatgggtgctggca

SEQ ID NO: 3903483 - DNA, 17 bp, Homo sapiens
gcgtgctttatttatgg

SEQ ID NO: 3903484 - DNA, 17 bp, Homo sapiens
gcgtggcaaatataaaa

SEQ ID NO: 3903485 - DNA, 12 bp, Homo sapiens
gcgtggctgtgg

SEQ ID NO: 3903486 - DNA, 23 bp, Homo sapiens
gcgtggtggcgggcacctgtagt

SEQ ID NO: 3903487 - DNA, 22 bp, Homo sapiens
gcgttattggtcggcagccttc

SEQ ID NO: 3903488 - DNA, 20 bp, Homo sapiens
gcgttggaatcacctggagg

SEQ ID NO: 3903489 - DNA, 22 bp, Homo sapiens
gcgtttagtttctagaggcctc

SEQ ID NO: 3903490 - DNA, 14 bp, Homo sapiens
gcgtttttttacaa

SEQ ID NO: 3903491 - DNA, 20 bp, Homo sapiens
gcgtttttttacaacattca

SEQ ID NO: 3903492 - DNA, 16 bp, Homo sapiens
gctaaatactgtacat

SEQ ID NO: 3903493 - DNA, 21 bp, Homo sapiens
gctaaatgcaaacactgtgta

SEQ ID NO: 3903494 - DNA, 12 bp, Homo sapiens
gctaactggaag

SEQ ID NO: 3903495 - DNA, 22 bp, Homo sapiens
gctaagatgagatttgccagca

SEQ ID NO: 3903496 - DNA, 23 bp, Homo sapiens
gctaagatgagatttgccagcac

SEQ ID NO: 3903497 - DNA, 22 bp, Homo sapiens
gctaagggtaagggagagggag

SEQ ID NO: 3903498 - DNA, 17 bp, Homo sapiens
gctaatcagcattctca

SEQ ID NO: 3903499 - DNA, 23 bp, Homo sapiens
gctaatgaagctattgagaaaga

SEQ ID NO: 3903500 - DNA, 21 bp, Homo sapiens
gctaatgaagggaaaggatat

SEQ ID NO: 3903501 - DNA, 14 bp, Homo sapiens
gctaattcaattta

SEQ ID NO: 3903502 - DNA, 22 bp, Homo sapiens
gctaatttttatatttttagaa

SEQ ID NO: 3903503 - DNA, 17 bp, Homo sapiens
gctacaaaaacacagca

SEQ ID NO: 3903504 - DNA, 19 bp, Homo sapiens
gctacaaaaacacagcaag

SEQ ID NO: 3903505 - DNA, 12 bp, Homo sapiens
gctacaataaat

SEQ ID NO: 3903506 - DNA, 14 bp, Homo sapiens
gctacaataaatgc

SEQ ID NO: 3903507 - DNA, 16 bp, Homo sapiens
gctacacaaaagccaa

SEQ ID NO: 3903508 - DNA, 17 bp, Homo sapiens
gctacaccactctggca

SEQ ID NO: 3903509 - DNA, 18 bp, Homo sapiens
gctacaccactctggcag

SEQ ID NO: 3903510 - DNA, 19 bp, Homo sapiens
gctacaccactctggcagc

SEQ ID NO: 3903511 - DNA, 21 bp, Homo sapiens
gctacaccactctggcagcca

SEQ ID NO: 3903512 - DNA, 12 bp, Homo sapiens
gctacattcctc

SEQ ID NO: 3903513 - DNA, 15 bp, Homo sapiens
gctacattcctcagc

SEQ ID NO: 3903514 - DNA, 16 bp, Homo sapiens
gctacattcctcagct

SEQ ID NO: 3903515 - DNA, 23 bp, Homo sapiens
gctacccaaaagagaaaaaaaat

SEQ ID NO: 3903516 - DNA, 14 bp, Homo sapiens
gctacctgtgtgga

SEQ ID NO: 3903517 - DNA, 18 bp, Homo sapiens
gctacctgtgtggacagg

SEQ ID NO: 3903518 - DNA, 20 bp, Homo sapiens
gctacctgtgtggacaggac

SEQ ID NO: 3903519 - DNA, 21 bp, Homo sapiens
gctactacccgagcccagcta

SEQ ID NO: 3903520 - DNA, 11 bp, Homo sapiens
gctactcagca

SEQ ID NO: 3903521 - DNA, 16 bp, Homo sapiens
gctactcagcagccct

SEQ ID NO: 3903522 - DNA, 21 bp, Homo sapiens
gctactcagcagccctcctca

SEQ ID NO: 3903523 - DNA, 16 bp, Homo sapiens
gctactcaggaggctg

SEQ ID NO: 3903524 - DNA, 13 bp, Homo sapiens
gctactcctgtgc

SEQ ID NO: 3903525 - DNA, 22 bp, Homo sapiens
gctactcgggaggctgaggcag

SEQ ID NO: 3903526 - DNA, 12 bp, Homo sapiens
gctactctgtcc

SEQ ID NO: 3903527 - DNA, 14 bp, Homo sapiens
gctactctgtccag

SEQ ID NO: 3903528 - DNA, 20 bp, Homo sapiens
gctactctgtccaggccact

SEQ ID NO: 3903529 - DNA, 14 bp, Homo sapiens
gctactctgtgcca

SEQ ID NO: 3903530 - DNA, 15 bp, Homo sapiens
gctactctgtgccag

SEQ ID NO: 3903531 - DNA, 16 bp, Homo sapiens
gctactctgtgccaga

SEQ ID NO: 3903532 - DNA, 22 bp, Homo sapiens
gctactctgtgccagagcctgg

SEQ ID NO: 3903533 - DNA, 16 bp, Homo sapiens
gctactgatttttgtg

SEQ ID NO: 3903534 - DNA, 12 bp, Homo sapiens
gctactggcagc

SEQ ID NO: 3903535 - DNA, 13 bp, Homo sapiens
gctactggcagct

SEQ ID NO: 3903536 - DNA, 16 bp, Homo sapiens
gctactggcagctcct

SEQ ID NO: 3903537 - DNA, 22 bp, Homo sapiens
gctacttgggaggctgaggcag

SEQ ID NO: 3903538 - DNA, 18 bp, Homo sapiens
gctagaaccaagaagggc

SEQ ID NO: 3903539 - DNA, 20 bp, Homo sapiens
gctagaaccaagaagggcta

SEQ ID NO: 3903540 - DNA, 18 bp, Homo sapiens
gctagaacctagaagggc

SEQ ID NO: 3903541 - DNA, 19 bp, Homo sapiens
gctagaacctggaagggct

SEQ ID NO: 3903542 - DNA, 20 bp, Homo sapiens
gctagaacctggaagggcta

SEQ ID NO: 3903543 - DNA, 19 bp, Homo sapiens
gctagaacctggagagcta

SEQ ID NO: 3903544 - DNA, 19 bp, Homo sapiens
gctagaacctggagggctg

SEQ ID NO: 3903545 - DNA, 15 bp, Homo sapiens
gctagaaggccacat

SEQ ID NO: 3903546 - DNA, 13 bp, Homo sapiens
gctagagaagggg

SEQ ID NO: 3903547 - DNA, 20 bp, Homo sapiens
gctagagatatggcagcgaa

SEQ ID NO: 3903548 - DNA, 18 bp, Homo sapiens
gctagccaactcctcctt

SEQ ID NO: 3903549 - DNA, 21 bp, Homo sapiens
gctagcgctgccgcaccccag

SEQ ID NO: 3903550 - DNA, 23 bp, Homo sapiens
gctagcgctgccgcaccccagag

SEQ ID NO: 3903551 - DNA, 12 bp, Homo sapiens
gctaggaatgaa

SEQ ID NO: 3903552 - DNA, 12 bp, Homo sapiens
gctaggactgag

SEQ ID NO: 3903553 - DNA, 14 bp, Homo sapiens
gctaggactgagga

SEQ ID NO: 3903554 - DNA, 17 bp, Homo sapiens
gctaggactgaggagtg

SEQ ID NO: 3903555 - DNA, 17 bp, Homo sapiens
gctaggagcaaagcctg

SEQ ID NO: 3903556 - DNA, 20 bp, Homo sapiens
gctaggcgagtgccaggact

SEQ ID NO: 3903557 - DNA, 18 bp, Homo sapiens
gctagggagaatgcagag

SEQ ID NO: 3903558 - DNA, 16 bp, Homo sapiens
gctaggggctggtcct

SEQ ID NO: 3903559 - DNA, 19 bp, Homo sapiens
gctagtactggggagaaat

SEQ ID NO: 3903560 - DNA, 16 bp, Homo sapiens
gctagtgtgagtggca

SEQ ID NO: 3903561 - DNA, 19 bp, Homo sapiens
gctagtgtgagtggcagcc

SEQ ID NO: 3903562 - DNA, 23 bp, Homo sapiens
gctagtgtgagtggcagccatgc

SEQ ID NO: 3903563 - DNA, 13 bp, Homo sapiens
gctataaatatat

SEQ ID NO: 3903564 - DNA, 15 bp, Homo sapiens
gctataaatatataa

SEQ ID NO: 3903565 - DNA, 22 bp, Homo sapiens
gctcccatagcgctggctcagg

SEQ ID NO: 3903566 - DNA, 13 bp, Homo sapiens
gctcccatctcct

SEQ ID NO: 3903567 - DNA, 21 bp, Homo sapiens
gctccccacacgtgctcgcag

SEQ ID NO: 3903568 - DNA, 22 bp, Homo sapiens
gctccccacacgtgctcgcagc

SEQ ID NO: 3903569 - DNA, 12 bp, Homo sapiens
gctccccacgag

SEQ ID NO: 3903570 - DNA, 23 bp, Homo sapiens
gctccccacgagtcacctgcaag

SEQ ID NO: 3903571 - DNA, 14 bp, Homo sapiens
gctccccactctgc

SEQ ID NO: 3903572 - DNA, 18 bp, Homo sapiens
gctccccactctgctctg

SEQ ID NO: 3903573 - DNA, 19 bp, Homo sapiens
gctccccagccctggctct

SEQ ID NO: 3903574 - DNA, 20 bp, Homo sapiens
gctccccagccctggctctg

SEQ ID NO: 3903575 - DNA, 21 bp, Homo sapiens
gctccccagccctggctctgc

SEQ ID NO: 3903576 - DNA, 14 bp, Homo sapiens
gctcccccaccccc

SEQ ID NO: 3903577 - DNA, 20 bp, Homo sapiens
gctcccccaccccctcccca

SEQ ID NO: 3903578 - DNA, 15 bp, Homo sapiens
gctcccccgcagtcc

SEQ ID NO: 3903579 - DNA, 19 bp, Homo sapiens
gctccccctgcctttgaaa

SEQ ID NO: 3903580 - DNA, 14 bp, Homo sapiens
gctcccgagctact

SEQ ID NO: 3903581 - DNA, 17 bp, Homo sapiens
gctcccgagctactctc

SEQ ID NO: 3903582 - DNA, 19 bp, Homo sapiens
gctcccgagctactctctt

SEQ ID NO: 3903583 - DNA, 15 bp, Homo sapiens
gctccctcctggagc

SEQ ID NO: 3903584 - DNA, 23 bp, Homo sapiens
gctccctgtagctctgcctccct

SEQ ID NO: 3903585 - DNA, 17 bp, Homo sapiens
gctcctcccctcttgag

SEQ ID NO: 3903586 - DNA, 15 bp, Homo sapiens
gctcctccttcccct

SEQ ID NO: 3903587 - DNA, 17 bp, Homo sapiens
gctcctctccaggcacc

SEQ ID NO: 3903588 - DNA, 23 bp, Homo sapiens
gctcctctccttgggctcctggc

SEQ ID NO: 3903589 - DNA, 22 bp, Homo sapiens
gctcctctgtctcgagcgccct

SEQ ID NO: 3903590 - DNA, 20 bp, Homo sapiens
gctcctcttaccgtagcctc

SEQ ID NO: 3903591 - DNA, 22 bp, Homo sapiens
gctcctcttaccgtagcctccg

SEQ ID NO: 3903592 - DNA, 23 bp, Homo sapiens
gctcctcttaccgtagcctccgt

SEQ ID NO: 3903593 - DNA, 17 bp, Homo sapiens
gctcctggctgccaggc

SEQ ID NO: 3903594 - DNA, 12 bp, Homo sapiens
gctcctgtccct

SEQ ID NO: 3903595 - DNA, 18 bp, Homo sapiens
gctcctgtccctacccac

SEQ ID NO: 3903596 - DNA, 21 bp, Homo sapiens
gctcctgtccctacccactct

SEQ ID NO: 3903597 - DNA, 22 bp, Homo sapiens
gctcctgtcctcccatcccctg

SEQ ID NO: 3903598 - DNA, 13 bp, Homo sapiens
gctcctgtttcca

SEQ ID NO: 3903599 - DNA, 17 bp, Homo sapiens
gctcctttctccagcca

SEQ ID NO: 3903600 - DNA, 18 bp, Homo sapiens
gctcctttctccagccag

SEQ ID NO: 3903601 - DNA, 19 bp, Homo sapiens
gctcctttctccagccagc

SEQ ID NO: 3903602 - DNA, 17 bp, Homo sapiens
gctccttttgtccccag

SEQ ID NO: 3903603 - DNA, 13 bp, Homo sapiens
gctcgcagcctgg

SEQ ID NO: 3903604 - DNA, 16 bp, Homo sapiens
gctcgcccacaaactg

SEQ ID NO: 3903605 - DNA, 15 bp, Homo sapiens
gctcgccccacccag

SEQ ID NO: 3903606 - DNA, 22 bp, Homo sapiens
gctcgctccctgtagctctgcc

SEQ ID NO: 3903607 - DNA, 23 bp, Homo sapiens
gctcgctccctgtagctctgcct

SEQ ID NO: 3903608 - DNA, 15 bp, Homo sapiens
gctcgcttctcctcc

SEQ ID NO: 3903609 - DNA, 19 bp, Homo sapiens
gctcgcttctcctccaggt

SEQ ID NO: 3903610 - DNA, 18 bp, Homo sapiens
gctctaacgcctgagccc

SEQ ID NO: 3903611 - DNA, 20 bp, Homo sapiens
gctctaacgcctgagcccag

SEQ ID NO: 3903612 - DNA, 23 bp, Homo sapiens
gctctaacgcctgagcccaggga

SEQ ID NO: 3903613 - DNA, 15 bp, Homo sapiens
gctctacttcttttt

SEQ ID NO: 3903614 - DNA, 18 bp, Homo sapiens
gctctagccaggagtctg

SEQ ID NO: 3903615 - DNA, 24 bp, Homo sapiens
gctctagccaggagtctgtgctct

SEQ ID NO: 3903616 - DNA, 13 bp, Homo sapiens
gctctagctggca

SEQ ID NO: 3903617 - DNA, 18 bp, Homo sapiens
gctctagctggcaggaca

SEQ ID NO: 3903618 - DNA, 19 bp, Homo sapiens
gctctagttttcagccttg

SEQ ID NO: 3903619 - DNA, 22 bp, Homo sapiens
gctctatttcctcccccagtta

SEQ ID NO: 3903620 - DNA, 19 bp, Homo sapiens
gctctcaggggccagtgag

SEQ ID NO: 3903621 - DNA, 16 bp, Homo sapiens
gctctcatgcctgcct

SEQ ID NO: 3903622 - DNA, 16 bp, Homo sapiens
gctctccaaaggggct

SEQ ID NO: 3903623 - DNA, 20 bp, Homo sapiens
gctctccaaaggggctgctg

SEQ ID NO: 3903624 - DNA, 23 bp, Homo sapiens
gctctccaaaggggctgctgggg

SEQ ID NO: 3903625 - DNA, 17 bp, Homo sapiens
gctctccacctcagcct

SEQ ID NO: 3903626 - DNA, 19 bp, Homo sapiens
gctctcccctgccctgctg

SEQ ID NO: 3903627 - DNA, 17 bp, Homo sapiens
gctctccctctggccct

SEQ ID NO: 3903628 - DNA, 17 bp, Homo sapiens
gctctcctaccccacct

SEQ ID NO: 3903629 - DNA, 18 bp, Homo sapiens
gctctcctaccccacctc

SEQ ID NO: 3903630 - DNA, 12 bp, Homo sapiens
gctctcctggct

SEQ ID NO: 3903631 - DNA, 15 bp, Homo sapiens
gctctcctggcttcc

SEQ ID NO: 3903632 - DNA, 23 bp, Homo sapiens
gctctctctacccggcccagaga

SEQ ID NO: 3903633 - DNA, 18 bp, Homo sapiens
gctctctgtataaacatt

SEQ ID NO: 3903634 - DNA, 14 bp, Homo sapiens
gctctcttcaggag

SEQ ID NO: 3903635 - DNA, 15 bp, Homo sapiens
gctctgacccagtga

SEQ ID NO: 3903636 - DNA, 16 bp, Homo sapiens
gctctgagaggccctg

SEQ ID NO: 3903637 - DNA, 23 bp, Homo sapiens
gctctgagaggccctggatcagc

SEQ ID NO: 3903638 - DNA, 10 bp, Homo sapiens
gctctgaggc

SEQ ID NO: 3903639 - DNA, 19 bp, Homo sapiens
gctctgaggcttccagaga

SEQ ID NO: 3903640 - DNA, 20 bp, Homo sapiens
gctctgaggcttccagagag

SEQ ID NO: 3903641 - DNA, 11 bp, Homo sapiens
gctctgatgca

SEQ ID NO: 3903642 - DNA, 12 bp, Homo sapiens
gctctgccccag

SEQ ID NO: 3903643 - DNA, 20 bp, Homo sapiens
gctctgccccagaggcctct

SEQ ID NO: 3903644 - DNA, 22 bp, Homo sapiens
gctctgccccttgggcatccac

SEQ ID NO: 3903645 - DNA, 17 bp, Homo sapiens
gctctgctggcctggcc

SEQ ID NO: 3903646 - DNA, 21 bp, Homo sapiens
gctctggaaaatgtgacccag

SEQ ID NO: 3903647 - DNA, 22 bp, Homo sapiens
gctctggaaaatgtgacccaga

SEQ ID NO: 3903648 - DNA, 14 bp, Homo sapiens
gctctggagccaga

SEQ ID NO: 3903649 - DNA, 16 bp, Homo sapiens
gctctggagccagaga

SEQ ID NO: 3903650 - DNA, 22 bp, Homo sapiens
gctctggagccagagagacaga

SEQ ID NO: 3903651 - DNA, 18 bp, Homo sapiens
gctctggataacaagact

SEQ ID NO: 3903652 - DNA, 12 bp, Homo sapiens
gctctggccacc

SEQ ID NO: 3903653 - DNA, 15 bp, Homo sapiens
gctctggccaccctg

SEQ ID NO: 3903654 - DNA, 21 bp, Homo sapiens
gctctggccaccctggcccgc

SEQ ID NO: 3903655 - DNA, 11 bp, Homo sapiens
gctctgggaag

SEQ ID NO: 3903656 - DNA, 17 bp, Homo sapiens
gctctgggctcagggct

SEQ ID NO: 3903657 - DNA, 18 bp, Homo sapiens
gctctgggctcagggctg

SEQ ID NO: 3903658 - DNA, 19 bp, Homo sapiens
gctctgggctcagggctgg

SEQ ID NO: 3903659 - DNA, 21 bp, Homo sapiens
gctctgtagaaagaatgtgtt

SEQ ID NO: 3903660 - DNA, 17 bp, Homo sapiens
gctctgtggcctgtgtc

SEQ ID NO: 3903661 - DNA, 12 bp, Homo sapiens
gctcttaatgtt

SEQ ID NO: 3903662 - DNA, 19 bp, Homo sapiens
gctcttagctttctcaggg

SEQ ID NO: 3903663 - DNA, 21 bp, Homo sapiens
gctcttatgtggattaaacga

SEQ ID NO: 3903664 - DNA, 18 bp, Homo sapiens
gctcttcactcagccaca

SEQ ID NO: 3903665 - DNA, 17 bp, Homo sapiens
gctcttccaaagctcct

SEQ ID NO: 3903666 - DNA, 16 bp, Homo sapiens
gctcttcctggacctg

SEQ ID NO: 3903667 - DNA, 20 bp, Homo sapiens
gctcttcctggacctgagtc

SEQ ID NO: 3903668 - DNA, 15 bp, Homo sapiens
gctcttctatttaaa

SEQ ID NO: 3903669 - DNA, 21 bp, Homo sapiens
gctcttctatttaaaaaataa

SEQ ID NO: 3903670 - DNA, 17 bp, Homo sapiens
gctcttctcctttcaca

SEQ ID NO: 3903671 - DNA, 23 bp, Homo sapiens
gctcttctgttctcaaatgctaa

SEQ ID NO: 3903672 - DNA, 18 bp, Homo sapiens
gctcttggaagagctctt

SEQ ID NO: 3903673 - DNA, 13 bp, Homo sapiens
gctcttggcattt

SEQ ID NO: 3903674 - DNA, 16 bp, Homo sapiens
gctcttggtccctggt

SEQ ID NO: 3903675 - DNA, 19 bp, Homo sapiens
gctcttggtccctggtccc

SEQ ID NO: 3903676 - DNA, 12 bp, Homo sapiens
gctctttcaggg

SEQ ID NO: 3903677 - DNA, 20 bp, Homo sapiens
gctctttggggtcagccagg

SEQ ID NO: 3903678 - DNA, 24 bp, Homo sapiens
gctcttttggtggggagcacttgc

SEQ ID NO: 3903679 - DNA, 16 bp, Homo sapiens
gctgaaacaacaaata

SEQ ID NO: 3903680 - DNA, 17 bp, Homo sapiens
gctgaacggggagaaaa

SEQ ID NO: 3903681 - DNA, 20 bp, Homo sapiens
gctgaagcctatttatttga

SEQ ID NO: 3903682 - DNA, 16 bp, Homo sapiens
gctgaagtgaaggaga

SEQ ID NO: 3903683 - DNA, 17 bp, Homo sapiens
gctgaagtgaaggagaa

SEQ ID NO: 3903684 - DNA, 20 bp, Homo sapiens
gctgaagtgaaggagaaagg

SEQ ID NO: 3903685 - DNA, 15 bp, Homo sapiens
gctgaagttctgagc

SEQ ID NO: 3903686 - DNA, 16 bp, Homo sapiens
gctgaagttctgagcc

SEQ ID NO: 3903687 - DNA, 13 bp, Homo sapiens
gctgaattatttt

SEQ ID NO: 3903688 - DNA, 23 bp, Homo sapiens
gctgaattattttgttgtgattt

SEQ ID NO: 3903689 - DNA, 17 bp, Homo sapiens
gctgacacctaccatgc

SEQ ID NO: 3903690 - DNA, 18 bp, Homo sapiens
gctgacacctaccatgct

SEQ ID NO: 3903691 - DNA, 20 bp, Homo sapiens
gctgacacctaccatgctgc

SEQ ID NO: 3903692 - DNA, 21 bp, Homo sapiens
gctgacacctaccatgctgct

SEQ ID NO: 3903693 - DNA, 11 bp, Homo sapiens
gctgacagata

SEQ ID NO: 3903694 - DNA, 13 bp, Homo sapiens
gctgacagctgct

SEQ ID NO: 3903695 - DNA, 14 bp, Homo sapiens
gctgacatctcctc

SEQ ID NO: 3903696 - DNA, 13 bp, Homo sapiens
gctgaccaagaga

SEQ ID NO: 3903697 - DNA, 15 bp, Homo sapiens
gctgacccagtccct

SEQ ID NO: 3903698 - DNA, 19 bp, Homo sapiens
gctgaccccaaagagcctg

SEQ ID NO: 3903699 - DNA, 13 bp, Homo sapiens
gctgacctctggt

SEQ ID NO: 3903700 - DNA, 22 bp, Homo sapiens
gctgacctgcctctcacacaca

SEQ ID NO: 3903701 - DNA, 14 bp, Homo sapiens
gctgagaacctggc

SEQ ID NO: 3903702 - DNA, 18 bp, Homo sapiens
gctgagaacctggccttc

SEQ ID NO: 3903703 - DNA, 14 bp, Homo sapiens
gctgagaagaagct

SEQ ID NO: 3903704 - DNA, 15 bp, Homo sapiens
gctgagaagaagctg

SEQ ID NO: 3903705 - DNA, 16 bp, Homo sapiens
gctgagaagaagctga

SEQ ID NO: 3903706 - DNA, 21 bp, Homo sapiens
gctgagaggaagatgaagaga

SEQ ID NO: 3903707 - DNA, 21 bp, Homo sapiens
gctgagagtctgaaagacaga

SEQ ID NO: 3903708 - DNA, 15 bp, Homo sapiens
gctgagcaggcccga

SEQ ID NO: 3903709 - DNA, 17 bp, Homo sapiens
gctgagccactcgcagt

SEQ ID NO: 3903710 - DNA, 16 bp, Homo sapiens
gctgagctcacaaggc

SEQ ID NO: 3903711 - DNA, 13 bp, Homo sapiens
gctgagctctgag

SEQ ID NO: 3903712 - DNA, 20 bp, Homo sapiens
gctgagctctgagaggccct

SEQ ID NO: 3903713 - DNA, 22 bp, Homo sapiens
gctgagcttagccttgtgccct

SEQ ID NO: 3903714 - DNA, 23 bp, Homo sapiens
gctgagcttagccttgtgccctg

SEQ ID NO: 3903715 - DNA, 14 bp, Homo sapiens
gctgaggactccct

SEQ ID NO: 3903716 - DNA, 21 bp, Homo sapiens
gctgaggactccctccatgtg

SEQ ID NO: 3903717 - DNA, 17 bp, Homo sapiens
gctgaggatcctcacag

SEQ ID NO: 3903718 - DNA, 21 bp, Homo sapiens
gctgaggatcctcacaggagc

SEQ ID NO: 3903719 - DNA, 15 bp, Homo sapiens
gctgaggatgacaga

SEQ ID NO: 3903720 - DNA, 18 bp, Homo sapiens
gctgaggatttcaagcct

SEQ ID NO: 3903721 - DNA, 20 bp, Homo sapiens
gctgaggatttcaagcctgc

SEQ ID NO: 3903722 - DNA, 23 bp, Homo sapiens
gctgaggctctgacccagtgaga

SEQ ID NO: 3903723 - DNA, 20 bp, Homo sapiens
gctgagtggaatgcagggaa

SEQ ID NO: 3903724 - DNA, 23 bp, Homo sapiens
gctgagttacttgtctgaggcct

SEQ ID NO: 3903725 - DNA, 20 bp, Homo sapiens
gctgatattatggcaagtga

SEQ ID NO: 3903726 - DNA, 13 bp, Homo sapiens
gctgattcaagaa

SEQ ID NO: 3903727 - DNA, 15 bp, Homo sapiens
gctgatttccaggcc

SEQ ID NO: 3903728 - DNA, 19 bp, Homo sapiens
gctgatttccaggcccctg

SEQ ID NO: 3903729 - DNA, 20 bp, Homo sapiens
gctgatttccaggcccctga

SEQ ID NO: 3903730 - DNA, 22 bp, Homo sapiens
gctgcaaaagaagtttctggag

SEQ ID NO: 3903731 - DNA, 15 bp, Homo sapiens
gctgcaccatcacac

SEQ ID NO: 3903732 - DNA, 12 bp, Homo sapiens
gctgcagctggg

SEQ ID NO: 3903733 - DNA, 19 bp, Homo sapiens
gctgcagctgggccccatg

SEQ ID NO: 3903734 - DNA, 13 bp, Homo sapiens
gctgcagcttcct

SEQ ID NO: 3903735 - DNA, 14 bp, Homo sapiens
gctgcagcttcctg

SEQ ID NO: 3903736 - DNA, 21 bp, Homo sapiens
gctgcaggtacttcctcctga

SEQ ID NO: 3903737 - DNA, 22 bp, Homo sapiens
gctgcaggtacttcctcctgat

SEQ ID NO: 3903738 - DNA, 22 bp, Homo sapiens
gctgggaaacagggagccccta

SEQ ID NO: 3903739 - DNA, 22 bp, Homo sapiens
gctgggaaccccgcagcccgtg

SEQ ID NO: 3903740 - DNA, 23 bp, Homo sapiens
gctgggaagctgtactcagagca

SEQ ID NO: 3903741 - DNA, 12 bp, Homo sapiens
gctgggacccct

SEQ ID NO: 3903742 - DNA, 20 bp, Homo sapiens
gctgggaggcatggccctgg

SEQ ID NO: 3903743 - DNA, 20 bp, Homo sapiens
gctgggcaaacccttctctt

SEQ ID NO: 3903744 - DNA, 17 bp, Homo sapiens
gctgggcacctctagtg

SEQ ID NO: 3903745 - DNA, 13 bp, Homo sapiens
gctgggccagcct

SEQ ID NO: 3903746 - DNA, 17 bp, Homo sapiens
gctgggcccctgggatg

SEQ ID NO: 3903747 - DNA, 16 bp, Homo sapiens
gctgggccggccagcc

SEQ ID NO: 3903748 - DNA, 14 bp, Homo sapiens
gctgggctctccac

SEQ ID NO: 3903749 - DNA, 19 bp, Homo sapiens
gctgggctctccacctcag

SEQ ID NO: 3903750 - DNA, 18 bp, Homo sapiens
gctggggaacagagcggg

SEQ ID NO: 3903751 - DNA, 22 bp, Homo sapiens
gctggggcagaggggcagccgc

SEQ ID NO: 3903752 - DNA, 13 bp, Homo sapiens
gctggggccacaa

SEQ ID NO: 3903753 - DNA, 15 bp, Homo sapiens
gctgggggaagggtg

SEQ ID NO: 3903754 - DNA, 19 bp, Homo sapiens
gctgggggtgggggcgggt

SEQ ID NO: 3903755 - DNA, 21 bp, Homo sapiens
gctgggtaaactgtggatgat

SEQ ID NO: 3903756 - DNA, 14 bp, Homo sapiens
gctggtaaactatt

SEQ ID NO: 3903757 - DNA, 14 bp, Homo sapiens
gctggtagagcagg

SEQ ID NO: 3903758 - DNA, 19 bp, Homo sapiens
gctggtcgtgaactcctga

SEQ ID NO: 3903759 - DNA, 15 bp, Homo sapiens
gctggtctaggagct

SEQ ID NO: 3903760 - DNA, 20 bp, Homo sapiens
gctggtctattttgattttg

SEQ ID NO: 3903761 - DNA, 20 bp, Homo sapiens
gctggtgcagagctgaagat

SEQ ID NO: 3903762 - DNA, 15 bp, Homo sapiens
gctggtgctgtggcc

SEQ ID NO: 3903763 - DNA, 17 bp, Homo sapiens
gctggtgctgtggccag

SEQ ID NO: 3903764 - DNA, 14 bp, Homo sapiens
gctgtaaaatcttg

SEQ ID NO: 3903765 - DNA, 14 bp, Homo sapiens
gctgtaactgctga

SEQ ID NO: 3903766 - DNA, 18 bp, Homo sapiens
gctgtaactgctgagcca

SEQ ID NO: 3903767 - DNA, 19 bp, Homo sapiens
gctgtaactgctgagccac

SEQ ID NO: 3903768 - DNA, 17 bp, Homo sapiens
gctgtacccttccacct

SEQ ID NO: 3903769 - DNA, 14 bp, Homo sapiens
gctgtactcagagc

SEQ ID NO: 3903770 - DNA, 16 bp, Homo sapiens
gctgtactcagagcag

SEQ ID NO: 3903771 - DNA, 17 bp, Homo sapiens
gctgtactcagagcaga

SEQ ID NO: 3903772 - DNA, 15 bp, Homo sapiens
gctgtagctcccgag

SEQ ID NO: 3903773 - DNA, 18 bp, Homo sapiens
gctgtatttgttcagtga

SEQ ID NO: 3903774 - DNA, 18 bp, Homo sapiens
gctgtcataagaatgaat

SEQ ID NO: 3903775 - DNA, 19 bp, Homo sapiens
gctgtcattcaggacccca

SEQ ID NO: 3903776 - DNA, 17 bp, Homo sapiens
gctgtcctctcgagccc

SEQ ID NO: 3903777 - DNA, 20 bp, Homo sapiens
gctgtcctctcgagcccaga

SEQ ID NO: 3903778 - DNA, 14 bp, Homo sapiens
gctgtcgccccagg

SEQ ID NO: 3903779 - DNA, 18 bp, Homo sapiens
gctgtcgccccaggccct

SEQ ID NO: 3903780 - DNA, 19 bp, Homo sapiens
gctgtcgccccaggccctc

SEQ ID NO: 3903781 - DNA, 14 bp, Homo sapiens
gctgtctccaggat

SEQ ID NO: 3903782 - DNA, 18 bp, Homo sapiens
gctgtctccataatgcca

SEQ ID NO: 3903783 - DNA, 21 bp, Homo sapiens
gctgtctgtcaccagctatct

SEQ ID NO: 3903784 - DNA, 13 bp, Homo sapiens
gctgtctttctct

SEQ ID NO: 3903785 - DNA, 18 bp, Homo sapiens
gctgtgaacattgtctgg

SEQ ID NO: 3903786 - DNA, 16 bp, Homo sapiens
gctgtgaactcagagc

SEQ ID NO: 3903787 - DNA, 19 bp, Homo sapiens
gctgtgaactcagagcccc

SEQ ID NO: 3903788 - DNA, 20 bp, Homo sapiens
gctgtgaatttgtgtaagga

SEQ ID NO: 3903789 - DNA, 13 bp, Homo sapiens
gctgtgacctgct

SEQ ID NO: 3903790 - DNA, 14 bp, Homo sapiens
gctgtgacctgctg

SEQ ID NO: 3903791 - DNA, 15 bp, Homo sapiens
gctgtgacctgctga

SEQ ID NO: 3903792 - DNA, 22 bp, Homo sapiens
gctgtgacctgctgagctctga

SEQ ID NO: 3903793 - DNA, 23 bp, Homo sapiens
gctgtgacctgctgagctctgag

SEQ ID NO: 3903794 - DNA, 12 bp, Homo sapiens
gctgtgagcccc

SEQ ID NO: 3903795 - DNA, 16 bp, Homo sapiens
gctgtgagcccctggt

SEQ ID NO: 3903796 - DNA, 18 bp, Homo sapiens
gctgtgaggcccctggac

SEQ ID NO: 3903797 - DNA, 23 bp, Homo sapiens
gctgtgcctcgctccccactctg

SEQ ID NO: 3903798 - DNA, 15 bp, Homo sapiens
gctgtgcctgctaga

SEQ ID NO: 3903799 - DNA, 14 bp, Homo sapiens
gctgtggaggcctg

SEQ ID NO: 3903800 - DNA, 13 bp, Homo sapiens
gctgtggccaggg

SEQ ID NO: 3903801 - DNA, 17 bp, Homo sapiens
gctgtggccagggtgag

SEQ ID NO: 3903802 - DNA, 14 bp, Homo sapiens
gctgtgggcagcac

SEQ ID NO: 3903803 - DNA, 20 bp, Homo sapiens
gctgtggttcctaagcctgt

SEQ ID NO: 3903804 - DNA, 18 bp, Homo sapiens
gctgtgtccttgcacctg

SEQ ID NO: 3903805 - DNA, 23 bp, Homo sapiens
gctgtgtccttgcacctgcatcc

SEQ ID NO: 3903806 - DNA, 23 bp, Homo sapiens
gctgttcacagccagactggcac

SEQ ID NO: 3903807 - DNA, 21 bp, Homo sapiens
gctgttgatgaggcctcttgg

SEQ ID NO: 3903808 - DNA, 14 bp, Homo sapiens
gctgttggcctcgc

SEQ ID NO: 3903809 - DNA, 21 bp, Homo sapiens
gctgttggcctcgcctgggcc

SEQ ID NO: 3903810 - DNA, 11 bp, Homo sapiens
gctgtttcctt

SEQ ID NO: 3903811 - DNA, 14 bp, Homo sapiens
gctgtttctggaaa

SEQ ID NO: 3903812 - DNA, 21 bp, Homo sapiens
gctgtttgtgtgtctgggttg

SEQ ID NO: 3903813 - DNA, 21 bp, Homo sapiens
gctgtttgtttgacaaagaaa

SEQ ID NO: 3903814 - DNA, 20 bp, Homo sapiens
gcttaaaatatgtatgtcta

SEQ ID NO: 3903815 - DNA, 22 bp, Homo sapiens
gcttaacctttccgctgtcgcc

SEQ ID NO: 3903816 - DNA, 21 bp, Homo sapiens
gcttaaggagaggagaaactg

SEQ ID NO: 3903817 - DNA, 23 bp, Homo sapiens
gcttaaggagaggagaaactgag

SEQ ID NO: 3903818 - DNA, 12 bp, Homo sapiens
gcttaatgttta

SEQ ID NO: 3903819 - DNA, 23 bp, Homo sapiens
gcttaatgtttattcctgataat

SEQ ID NO: 3903820 - DNA, 16 bp, Homo sapiens
gcttacagtgactgtc

SEQ ID NO: 3903821 - DNA, 14 bp, Homo sapiens
gcttacatttttac

SEQ ID NO: 3903822 - DNA, 23 bp, Homo sapiens
gcttacccttcacctttggtgca

SEQ ID NO: 3903823 - DNA, 12 bp, Homo sapiens
gcttacctgacg

SEQ ID NO: 3903824 - DNA, 16 bp, Homo sapiens
gctttgcagaccgcat

SEQ ID NO: 3903825 - DNA, 17 bp, Homo sapiens
gctttgcaggctctggg

SEQ ID NO: 3903826 - DNA, 16 bp, Homo sapiens
gctttgctaccaaagc

SEQ ID NO: 3903827 - DNA, 17 bp, Homo sapiens
gctttgggaggccaagg

SEQ ID NO: 3903828 - DNA, 18 bp, Homo sapiens
gctttgggaggccaaggc

SEQ ID NO: 3903829 - DNA, 18 bp, Homo sapiens
gctttgggctgccctggt

SEQ ID NO: 3903830 - DNA, 22 bp, Homo sapiens
gctttgggctttgcaggctctg

SEQ ID NO: 3903831 - DNA, 20 bp, Homo sapiens
gctttggggacagttggcag

SEQ ID NO: 3903832 - DNA, 18 bp, Homo sapiens
gctttgtatccatgaggg

SEQ ID NO: 3903833 - DNA, 12 bp, Homo sapiens
gcttttaagaaa

SEQ ID NO: 3903834 - DNA, 19 bp, Homo sapiens
gcttttaagaaacacaggg

SEQ ID NO: 3903835 - DNA, 15 bp, Homo sapiens
gcttttaataaaatt

SEQ ID NO: 3903836 - DNA, 15 bp, Homo sapiens
gcttttattgtataa

SEQ ID NO: 3903837 - DNA, 12 bp, Homo sapiens
gcttttcactgc

SEQ ID NO: 3903838 - DNA, 14 bp, Homo sapiens
gcttttcactgctg

SEQ ID NO: 3903839 - DNA, 16 bp, Homo sapiens
gcttttcatggaagtg

SEQ ID NO: 3903840 - DNA, 20 bp, Homo sapiens
gcttttccaggatcctgcag

SEQ ID NO: 3903841 - DNA, 21 bp, Homo sapiens
gcttttccaggatcctgcagg

SEQ ID NO: 3903842 - DNA, 22 bp, Homo sapiens
gcttttccccggtcccttgaga

SEQ ID NO: 3903843 - DNA, 18 bp, Homo sapiens
gcttttgccactttggct

SEQ ID NO: 3903844 - DNA, 13 bp, Homo sapiens
gcttttgctgggg

SEQ ID NO: 3903845 - DNA, 20 bp, Homo sapiens
gcttttgttgtgacttttta

SEQ ID NO: 3903846 - DNA, 16 bp, Homo sapiens
gctttttgtcttttct

SEQ ID NO: 3903847 - DNA, 14 bp, Homo sapiens
ggaaaaaaaatata

SEQ ID NO: 3903848 - DNA, 15 bp, Homo sapiens
ggaaaaatcttgggc

SEQ ID NO: 3903849 - DNA, 14 bp, Homo sapiens
ggaaaaccagggat

SEQ ID NO: 3903850 - DNA, 16 bp, Homo sapiens
ggaaaactgacagagg

SEQ ID NO: 3903851 - DNA, 14 bp, Homo sapiens
ggaaaagaatacag

SEQ ID NO: 3903852 - DNA, 17 bp, Homo sapiens
ggaaaagaccagggctt

SEQ ID NO: 3903853 - DNA, 19 bp, Homo sapiens
ggaaaagggtcttcttggc

SEQ ID NO: 3903854 - DNA, 15 bp, Homo sapiens
ggaaaagtacattta

SEQ ID NO: 3903855 - DNA, 16 bp, Homo sapiens
ggaaaagtcaacatct

SEQ ID NO: 3903856 - DNA, 22 bp, Homo sapiens
ggaaacaccgagtctctgtata

SEQ ID NO: 3903857 - DNA, 15 bp, Homo sapiens
ggaaacaggaccaca

SEQ ID NO: 3903858 - DNA, 15 bp, Homo sapiens
ggaaacagggcagtg

SEQ ID NO: 3903859 - DNA, 22 bp, Homo sapiens
ggaaacccaaggaacaagagaa

SEQ ID NO: 3903860 - DNA, 14 bp, Homo sapiens
ggaaaccttgcagc

SEQ ID NO: 3903861 - DNA, 23 bp, Homo sapiens
ggaaacgaacccactgtgcttac

SEQ ID NO: 3903862 - DNA, 13 bp, Homo sapiens
ggaaactgccagc

SEQ ID NO: 3903863 - DNA, 16 bp, Homo sapiens
ggaaagccctccccct

SEQ ID NO: 3903864 - DNA, 23 bp, Homo sapiens
ggaaagctcagctactgattttt

SEQ ID NO: 3903865 - DNA, 13 bp, Homo sapiens
ggaaaggacccac

SEQ ID NO: 3903866 - DNA, 16 bp, Homo sapiens
ggaaaggatattttct

SEQ ID NO: 3903867 - DNA, 15 bp, Homo sapiens
ggaaataaaaccttt

SEQ ID NO: 3903868 - DNA, 17 bp, Homo sapiens
ggaaatcaaatatgcaa

SEQ ID NO: 3903869 - DNA, 15 bp, Homo sapiens
ggaacagacaggaga

SEQ ID NO: 3903870 - DNA, 12 bp, Homo sapiens
ggaacagagact

SEQ ID NO: 3903871 - DNA, 17 bp, Homo sapiens
ggaacagagactctgga

SEQ ID NO: 3903872 - DNA, 13 bp, Homo sapiens
ggaacagagcggg

SEQ ID NO: 3903873 - DNA, 22 bp, Homo sapiens
ggaacagctcttcactcagcca

SEQ ID NO: 3903874 - DNA, 23 bp, Homo sapiens
ggaacatgtcggagtagaaattg

SEQ ID NO: 3903875 - DNA, 23 bp, Homo sapiens
ggaaccaccgaagaggaagcaag

SEQ ID NO: 3903876 - DNA, 17 bp, Homo sapiens
ggaaccagggagaccga

SEQ ID NO: 3903877 - DNA, 16 bp, Homo sapiens
ggaaccagggaggaga

SEQ ID NO: 3903878 - DNA, 17 bp, Homo sapiens
ggaaccagggaggagag

SEQ ID NO: 3903879 - DNA, 19 bp, Homo sapiens
ggaaccagggaggagagga

SEQ ID NO: 3903880 - DNA, 13 bp, Homo sapiens
ggaaccctcccca

SEQ ID NO: 3903881 - DNA, 18 bp, Homo sapiens
ggaacccttttcctccag

SEQ ID NO: 3903882 - DNA, 22 bp, Homo sapiens
ggaacctagtactctctgctct

SEQ ID NO: 3903883 - DNA, 23 bp, Homo sapiens
ggaacgcagaggcggaaaccttg

SEQ ID NO: 3903884 - DNA, 17 bp, Homo sapiens
ggaacgtgactgcccca

SEQ ID NO: 3903885 - DNA, 22 bp, Homo sapiens
ggaactagagggatacactgaa

SEQ ID NO: 3903886 - DNA, 23 bp, Homo sapiens
ggaactcatcctgtgtggggagg

SEQ ID NO: 3903887 - DNA, 13 bp, Homo sapiens
ggaactcccagca

SEQ ID NO: 3903888 - DNA, 15 bp, Homo sapiens
ggaactcctggaaat

SEQ ID NO: 3903889 - DNA, 12 bp, Homo sapiens
ggaactctgaca

SEQ ID NO: 3903890 - DNA, 19 bp, Homo sapiens
ggaactctgacaagggctg

SEQ ID NO: 3903891 - DNA, 21 bp, Homo sapiens
ggaactctgacaagggctgac

SEQ ID NO: 3903892 - DNA, 21 bp, Homo sapiens
ggaactgaagggggcggccta

SEQ ID NO: 3903893 - DNA, 14 bp, Homo sapiens
ggaactggccaagc

SEQ ID NO: 3903894 - DNA, 11 bp, Homo sapiens
ggaagaaacag

SEQ ID NO: 3903895 - DNA, 21 bp, Homo sapiens
ggaagaaacaggggatcaaag

SEQ ID NO: 3903896 - DNA, 16 bp, Homo sapiens
ggaagaaattcctgta

SEQ ID NO: 3903897 - DNA, 22 bp, Homo sapiens
ggaagaagagatcaggaagaga

SEQ ID NO: 3903898 - DNA, 12 bp, Homo sapiens
ggaagagaagga

SEQ ID NO: 3903899 - DNA, 14 bp, Homo sapiens
ggaagagagagaga

SEQ ID NO: 3903900 - DNA, 15 bp, Homo sapiens
ggaagagaggcacct

SEQ ID NO: 3903901 - DNA, 21 bp, Homo sapiens
ggaagagaggcacctgctgga

SEQ ID NO: 3903902 - DNA, 15 bp, Homo sapiens
ggaagagcagcctga

SEQ ID NO: 3903903 - DNA, 19 bp, Homo sapiens
ggaagagcagcctgatggc

SEQ ID NO: 3903904 - DNA, 14 bp, Homo sapiens
ggaagagcaggcac

SEQ ID NO: 3903905 - DNA, 13 bp, Homo sapiens
ggaagatgaagag

SEQ ID NO: 3903906 - DNA, 22 bp, Homo sapiens
ggaagatgaagagaagctgaga

SEQ ID NO: 3903907 - DNA, 15 bp, Homo sapiens
ggaagatggtagcag

SEQ ID NO: 3903908 - DNA, 18 bp, Homo sapiens
ggaagatggtagcagata

SEQ ID NO: 3903909 - DNA, 12 bp, Homo sapiens
ggaagcaggcag

SEQ ID NO: 3903910 - DNA, 18 bp, Homo sapiens
ggaagccaacttggcttt

SEQ ID NO: 3903911 - DNA, 22 bp, Homo sapiens
ggaccaaccctgtttcctgagt

SEQ ID NO: 3903912 - DNA, 20 bp, Homo sapiens
ggaccacagtgggtggcacc

SEQ ID NO: 3903913 - DNA, 16 bp, Homo sapiens
ggaccagtcccagagc

SEQ ID NO: 3903914 - DNA, 12 bp, Homo sapiens
ggacccaccaaa

SEQ ID NO: 3903915 - DNA, 21 bp, Homo sapiens
ggacccagctactctgtccag

SEQ ID NO: 3903916 - DNA, 18 bp, Homo sapiens
ggacccaggccctccatg

SEQ ID NO: 3903917 - DNA, 18 bp, Homo sapiens
ggaccccagctagggctg

SEQ ID NO: 3903918 - DNA, 22 bp, Homo sapiens
ggaccccctgagtcaactggag

SEQ ID NO: 3903919 - DNA, 23 bp, Homo sapiens
ggaccccgcctcccagccccagg

SEQ ID NO: 3903920 - DNA, 13 bp, Homo sapiens
ggacccctcccaa

SEQ ID NO: 3903921 - DNA, 15 bp, Homo sapiens
ggacccctcccaacc

SEQ ID NO: 3903922 - DNA, 23 bp, Homo sapiens
ggacccctcccttgctcagtgcc

SEQ ID NO: 3903923 - DNA, 17 bp, Homo sapiens
ggacccgctctggacca

SEQ ID NO: 3903924 - DNA, 19 bp, Homo sapiens
ggacccgctctggaccaac

SEQ ID NO: 3903925 - DNA, 20 bp, Homo sapiens
ggacccggaggggcctggca

SEQ ID NO: 3903926 - DNA, 15 bp, Homo sapiens
ggaccctcgcagcag

SEQ ID NO: 3903927 - DNA, 17 bp, Homo sapiens
ggaccctcgcagcaggt

SEQ ID NO: 3903928 - DNA, 21 bp, Homo sapiens
ggaccctttccttccttccct

SEQ ID NO: 3903929 - DNA, 22 bp, Homo sapiens
ggaccctttccttccttccctg

SEQ ID NO: 3903930 - DNA, 17 bp, Homo sapiens
ggaccgcgtagagagcc

SEQ ID NO: 3903931 - DNA, 21 bp, Homo sapiens
ggaccgctacaccactctggc

SEQ ID NO: 3903932 - DNA, 18 bp, Homo sapiens
ggaccgcttcccagaggc

SEQ ID NO: 3903933 - DNA, 15 bp, Homo sapiens
ggaccgggctggggt

SEQ ID NO: 3903934 - DNA, 16 bp, Homo sapiens
ggaccgggtgggcctg

SEQ ID NO: 3903935 - DNA, 17 bp, Homo sapiens
ggaccggtacagaaagg

SEQ ID NO: 3903936 - DNA, 21 bp, Homo sapiens
ggacctatgtcctaaggacac

SEQ ID NO: 3903937 - DNA, 14 bp, Homo sapiens
ggacctctgctctg

SEQ ID NO: 3903938 - DNA, 21 bp, Homo sapiens
ggacctgaagggtgacatccc

SEQ ID NO: 3903939 - DNA, 12 bp, Homo sapiens
ggacctgagcct

SEQ ID NO: 3903940 - DNA, 19 bp, Homo sapiens
ggacctgagcctgccgagc

SEQ ID NO: 3903941 - DNA, 17 bp, Homo sapiens
ggacctgagtctgctat

SEQ ID NO: 3903942 - DNA, 20 bp, Homo sapiens
ggacgcccagctgaggctgg

SEQ ID NO: 3903943 - DNA, 16 bp, Homo sapiens
ggacgcttccagacca

SEQ ID NO: 3903944 - DNA, 20 bp, Homo sapiens
ggacgcttccagaccacctg

SEQ ID NO: 3903945 - DNA, 23 bp, Homo sapiens
ggacgcttccagaccacctgcca

SEQ ID NO: 3903946 - DNA, 19 bp, Homo sapiens
ggacggaaggtcagttgcc

SEQ ID NO: 3903947 - DNA, 20 bp, Homo sapiens
ggactaacactcagaagcct

SEQ ID NO: 3903948 - DNA, 21 bp, Homo sapiens
ggactaacactcagaagcctg

SEQ ID NO: 3903949 - DNA, 22 bp, Homo sapiens
ggactaacactcagaagcctgg

SEQ ID NO: 3903950 - DNA, 14 bp, Homo sapiens
ggactagaacctgg

SEQ ID NO: 3903951 - DNA, 15 bp, Homo sapiens
ggactatagcccagg

SEQ ID NO: 3903952 - DNA, 13 bp, Homo sapiens
ggactccagttca

SEQ ID NO: 3903953 - DNA, 19 bp, Homo sapiens
ggactccctccatgtggcc

SEQ ID NO: 3903954 - DNA, 14 bp, Homo sapiens
ggactcctctgtcc

SEQ ID NO: 3903955 - DNA, 17 bp, Homo sapiens
ggactctaagctggagc

SEQ ID NO: 3903956 - DNA, 22 bp, Homo sapiens
ggactgacaagaagctcccaga

SEQ ID NO: 3903957 - DNA, 11 bp, Homo sapiens
ggactgaggac

SEQ ID NO: 3903958 - DNA, 22 bp, Homo sapiens
ggactgcaagcagggctctgcc

SEQ ID NO: 3903959 - DNA, 14 bp, Homo sapiens
ggactggctcaccc

SEQ ID NO: 3903960 - DNA, 12 bp, Homo sapiens
ggactgggaggt

SEQ ID NO: 3903961 - DNA, 23 bp, Homo sapiens
ggactggggatgtgggagggagc

SEQ ID NO: 3903962 - DNA, 15 bp, Homo sapiens
ggactgtcatagaaa

SEQ ID NO: 3903963 - DNA, 20 bp, Homo sapiens
ggactgtcgctgcttcgtgg

SEQ ID NO: 3903964 - DNA, 20 bp, Homo sapiens
ggacttaacggctccaggat

SEQ ID NO: 3903965 - DNA, 15 bp, Homo sapiens
ggacttcctggggcc

SEQ ID NO: 3903966 - DNA, 15 bp, Homo sapiens
ggacttgaacccagg

SEQ ID NO: 3903967 - DNA, 13 bp, Homo sapiens
ggacttgtgccag

SEQ ID NO: 3903968 - DNA, 16 bp, Homo sapiens
ggacttgtgtctctgt

SEQ ID NO: 3903969 - DNA, 14 bp, Homo sapiens
ggagaaacagagac

SEQ ID NO: 3903970 - DNA, 20 bp, Homo sapiens
ggagaaatgcatccattcct

SEQ ID NO: 3903971 - DNA, 23 bp, Homo sapiens
ggagaaatgcatccattcctcag

SEQ ID NO: 3903972 - DNA, 13 bp, Homo sapiens
ggagaactagaga

SEQ ID NO: 3903973 - DNA, 22 bp, Homo sapiens
ggagaagaattttcagacccca

SEQ ID NO: 3903974 - DNA, 14 bp, Homo sapiens
ggagaagacccacg

SEQ ID NO: 3903975 - DNA, 22 bp, Homo sapiens
ggagaaggaaggagactcacct

SEQ ID NO: 3903976 - DNA, 20 bp, Homo sapiens
ggagaaggatctagaatgtg

SEQ ID NO: 3903977 - DNA, 15 bp, Homo sapiens
ggagacaagaaatcc

SEQ ID NO: 3903978 - DNA, 14 bp, Homo sapiens
ggagacagagacag

SEQ ID NO: 3903979 - DNA, 15 bp, Homo sapiens
ggagacagagacaga

SEQ ID NO: 3903980 - DNA, 12 bp, Homo sapiens
ggagaccctgga

SEQ ID NO: 3903981 - DNA, 21 bp, Homo sapiens
ggagaccgcttcacccctgca

SEQ ID NO: 3903982 - DNA, 23 bp, Homo sapiens
ggagaccgcttcacccctgcact

SEQ ID NO: 3903983 - DNA, 16 bp, Homo sapiens
ggagactaagccctgt

SEQ ID NO: 3903984 - DNA, 9 bp, Homo sapiens
ggagactca

SEQ ID NO: 3903985 - DNA, 21 bp, Homo sapiens
ggagactcacctctgcctcaa

SEQ ID NO: 3903986 - DNA, 17 bp, Homo sapiens
ggagactcctgccctgt

SEQ ID NO: 3903987 - DNA, 16 bp, Homo sapiens
ggagactgtctcaaga

SEQ ID NO: 3903988 - DNA, 15 bp, Homo sapiens
ggagagaagaaagtg

SEQ ID NO: 3903989 - DNA, 14 bp, Homo sapiens
ggagagacacagcg

SEQ ID NO: 3903990 - DNA, 15 bp, Homo sapiens
ggagagacactccca

SEQ ID NO: 3903991 - DNA, 18 bp, Homo sapiens
ggagagactgaaagcagc

SEQ ID NO: 3903992 - DNA, 13 bp, Homo sapiens
ggagagagactca

SEQ ID NO: 3903993 - DNA, 12 bp, Homo sapiens
ggagagcagctg

SEQ ID NO: 3903994 - DNA, 14 bp, Homo sapiens
ggagagcagctggc

SEQ ID NO: 3903995 - DNA, 12 bp, Homo sapiens
ggagagccagcc

SEQ ID NO: 3903996 - DNA, 23 bp, Homo sapiens
ggagagccagccctccctgtcct

SEQ ID NO: 3903997 - DNA, 22 bp, Homo sapiens
ggagagctagaacccggcaggc

SEQ ID NO: 3903998 - DNA, 12 bp, Homo sapiens
ggagggagccgg

SEQ ID NO: 3903999 - DNA, 22 bp, Homo sapiens
ggagggatggagaggcggcctc

SEQ ID NO: 3904000 - DNA, 23 bp, Homo sapiens
ggagggcaagggccatgctgaag

SEQ ID NO: 3904001 - DNA, 14 bp, Homo sapiens
ggagggcagagcca

SEQ ID NO: 3904002 - DNA, 19 bp, Homo sapiens
ggagggctagaacctggag

SEQ ID NO: 3904003 - DNA, 23 bp, Homo sapiens
ggagggctagaacctggcaggtt

SEQ ID NO: 3904004 - DNA, 19 bp, Homo sapiens
ggagggctagaactggaga

SEQ ID NO: 3904005 - DNA, 20 bp, Homo sapiens
ggagggctagaatctggaga

SEQ ID NO: 3904006 - DNA, 22 bp, Homo sapiens
ggagggctagaatctggagagc

SEQ ID NO: 3904007 - DNA, 12 bp, Homo sapiens
ggagggctctga

SEQ ID NO: 3904008 - DNA, 13 bp, Homo sapiens
ggagggctctgag

SEQ ID NO: 3904009 - DNA, 16 bp, Homo sapiens
ggagggctctgaggcg

SEQ ID NO: 3904010 - DNA, 18 bp, Homo sapiens
ggagggctctgaggcgcc

SEQ ID NO: 3904011 - DNA, 20 bp, Homo sapiens
ggagggctggaatctggaga

SEQ ID NO: 3904012 - DNA, 22 bp, Homo sapiens
ggagggcttggtaaaacacaga

SEQ ID NO: 3904013 - DNA, 21 bp, Homo sapiens
ggaggggactatttatgaagg

SEQ ID NO: 3904014 - DNA, 18 bp, Homo sapiens
ggaggggcctggcagccg

SEQ ID NO: 3904015 - DNA, 18 bp, Homo sapiens
ggagggggaatgtagtga

SEQ ID NO: 3904016 - DNA, 23 bp, Homo sapiens
ggagggggtgtctggaagctgag

SEQ ID NO: 3904017 - DNA, 23 bp, Homo sapiens
ggaggggttgcgggggagctgga

SEQ ID NO: 3904018 - DNA, 12 bp, Homo sapiens
ggagggtagggg

SEQ ID NO: 3904019 - DNA, 13 bp, Homo sapiens
ggagggtagggga

SEQ ID NO: 3904020 - DNA, 13 bp, Homo sapiens
ggagggtggggcc

SEQ ID NO: 3904021 - DNA, 18 bp, Homo sapiens
ggagggtggggccgggtg

SEQ ID NO: 3904022 - DNA, 19 bp, Homo sapiens
ggaggtcacattcaggaag

SEQ ID NO: 3904023 - DNA, 20 bp, Homo sapiens
ggaggtcacattcaggaaga

SEQ ID NO: 3904024 - DNA, 23 bp, Homo sapiens
ggaggtcacattcaggaagatga

SEQ ID NO: 3904025 - DNA, 22 bp, Homo sapiens
ggaggtcgaccccaaagcccct

SEQ ID NO: 3904026 - DNA, 17 bp, Homo sapiens
ggaggtgagaccacctc

SEQ ID NO: 3904027 - DNA, 13 bp, Homo sapiens
ggaggtgagggat

SEQ ID NO: 3904028 - DNA, 17 bp, Homo sapiens
ggaggtgcctgagctgg

SEQ ID NO: 3904029 - DNA, 20 bp, Homo sapiens
ggaggtgcctgagctggggc

SEQ ID NO: 3904030 - DNA, 21 bp, Homo sapiens
ggaggtgcctgagctggggcc

SEQ ID NO: 3904031 - DNA, 14 bp, Homo sapiens
ggaggtggtggagg

SEQ ID NO: 3904032 - DNA, 14 bp, Homo sapiens
ggaggttggtgact

SEQ ID NO: 3904033 - DNA, 16 bp, Homo sapiens
ggagtaatcaggcagc

SEQ ID NO: 3904034 - DNA, 16 bp, Homo sapiens
ggagtagctgagagga

SEQ ID NO: 3904035 - DNA, 21 bp, Homo sapiens
ggagtagctgagaggaagatg

SEQ ID NO: 3904036 - DNA, 17 bp, Homo sapiens
ggagtagctgagctcac

SEQ ID NO: 3904037 - DNA, 21 bp, Homo sapiens
ggagtctccagtggttgctgt

SEQ ID NO: 3904038 - DNA, 16 bp, Homo sapiens
ggagtctgaggtcctg

SEQ ID NO: 3904039 - DNA, 21 bp, Homo sapiens
ggagtctgaggtcctgagcac

SEQ ID NO: 3904040 - DNA, 23 bp, Homo sapiens
ggagtctgaggtcctgagcactg

SEQ ID NO: 3904041 - DNA, 19 bp, Homo sapiens
ggagtctgagtctgagtcc

SEQ ID NO: 3904042 - DNA, 16 bp, Homo sapiens
ggagtctgtgctcttt

SEQ ID NO: 3904043 - DNA, 18 bp, Homo sapiens
ggagtgcagggaggagag

SEQ ID NO: 3904044 - DNA, 23 bp, Homo sapiens
ggagtgcgctcttggtccctggt

SEQ ID NO: 3904045 - DNA, 22 bp, Homo sapiens
ggagtggacattcaaaaacctg

SEQ ID NO: 3904046 - DNA, 18 bp, Homo sapiens
ggagtgtgggtgatcaga

SEQ ID NO: 3904047 - DNA, 13 bp, Homo sapiens
ggagtgttctgtg

SEQ ID NO: 3904048 - DNA, 19 bp, Homo sapiens
ggagtgttctgtgggcttg

SEQ ID NO: 3904049 - DNA, 17 bp, Homo sapiens
ggagtgttctgtttccc

SEQ ID NO: 3904050 - DNA, 22 bp, Homo sapiens
ggagttacattaatgttaattc

SEQ ID NO: 3904051 - DNA, 18 bp, Homo sapiens
ggagttcaagaccagcct

SEQ ID NO: 3904052 - DNA, 19 bp, Homo sapiens
ggagttccatgaagaccac

SEQ ID NO: 3904053 - DNA, 19 bp, Homo sapiens
ggagttgacgcatcctgca

SEQ ID NO: 3904054 - DNA, 19 bp, Homo sapiens
ggagttgagtacagtgagg

SEQ ID NO: 3904055 - DNA, 17 bp, Homo sapiens
ggagtttgagacaagcc

SEQ ID NO: 3904056 - DNA, 18 bp, Homo sapiens
ggataacaaaatcacaag

SEQ ID NO: 3904057 - DNA, 17 bp, Homo sapiens
ggataacagaggcagga

SEQ ID NO: 3904058 - DNA, 19 bp, Homo sapiens
ggataatagacacatcaaa

SEQ ID NO: 3904059 - DNA, 20 bp, Homo sapiens
ggataatgctgttgcctcat

SEQ ID NO: 3904060 - DNA, 20 bp, Homo sapiens
ggatcacaagaatcacctca

SEQ ID NO: 3904061 - DNA, 17 bp, Homo sapiens
ggatcagaacagcagag

SEQ ID NO: 3904062 - DNA, 15 bp, Homo sapiens
ggatcagcgtggcct

SEQ ID NO: 3904063 - DNA, 17 bp, Homo sapiens
ggatcagcgtggccttg

SEQ ID NO: 3904064 - DNA, 19 bp, Homo sapiens
ggatcagcgtggccttgtt

SEQ ID NO: 3904065 - DNA, 14 bp, Homo sapiens
ggatccacacctgg

SEQ ID NO: 3904066 - DNA, 23 bp, Homo sapiens
ggatcccagagcttcccaggatc

SEQ ID NO: 3904067 - DNA, 16 bp, Homo sapiens
ggatccgctgccacca

SEQ ID NO: 3904068 - DNA, 17 bp, Homo sapiens
ggatccgctgccaccac

SEQ ID NO: 3904069 - DNA, 16 bp, Homo sapiens
ggatcctcacaggagc

SEQ ID NO: 3904070 - DNA, 13 bp, Homo sapiens
ggatcctgcagga

SEQ ID NO: 3904071 - DNA, 18 bp, Homo sapiens
ggatcctgctgtggcctc

SEQ ID NO: 3904072 - DNA, 19 bp, Homo sapiens
ggatcctgctgtggcctca

SEQ ID NO: 3904073 - DNA, 13 bp, Homo sapiens
ggatctatgcaat

SEQ ID NO: 3904074 - DNA, 14 bp, Homo sapiens
ggatctatgcaatt

SEQ ID NO: 3904075 - DNA, 23 bp, Homo sapiens
ggatctatgcaatttttaaacta

SEQ ID NO: 3904076 - DNA, 14 bp, Homo sapiens
ggatctccccactc

SEQ ID NO: 3904077 - DNA, 22 bp, Homo sapiens
ggatctgcattccccgctgccc

SEQ ID NO: 3904078 - DNA, 19 bp, Homo sapiens
ggatctgggaccctttcct

SEQ ID NO: 3904079 - DNA, 16 bp, Homo sapiens
ggatcttgcattccca

SEQ ID NO: 3904080 - DNA, 18 bp, Homo sapiens
ggatgactagaggcaggg

SEQ ID NO: 3904081 - DNA, 19 bp, Homo sapiens
ggatgcacggcggcagggt

SEQ ID NO: 3904082 - DNA, 20 bp, Homo sapiens
ggatgcacggcggcagggtg

SEQ ID NO: 3904083 - DNA, 19 bp, Homo sapiens
ggatgccacagccccacag

SEQ ID NO: 3904084 - DNA, 15 bp, Homo sapiens
ggcagaaaagaggag

SEQ ID NO: 3904085 - DNA, 23 bp, Homo sapiens
ggcagaaaagaggagaccctgga

SEQ ID NO: 3904086 - DNA, 15 bp, Homo sapiens
ggcagaagtcagccc

SEQ ID NO: 3904087 - DNA, 18 bp, Homo sapiens
ggcagacaagagctgctg

SEQ ID NO: 3904088 - DNA, 19 bp, Homo sapiens
ggcagaccgggggccagac

SEQ ID NO: 3904089 - DNA, 20 bp, Homo sapiens
ggcagagaagaaagaacgga

SEQ ID NO: 3904090 - DNA, 18 bp, Homo sapiens
ggcagagaccccaggatc

SEQ ID NO: 3904091 - DNA, 24 bp, Homo sapiens
ggcagagaccccaggatcccagag

SEQ ID NO: 3904092 - DNA, 18 bp, Homo sapiens
ggcagagccatgggcctg

SEQ ID NO: 3904093 - DNA, 19 bp, Homo sapiens
ggcagagccatgggcctgg

SEQ ID NO: 3904094 - DNA, 22 bp, Homo sapiens
ggcagagccatgggcctgggcc

SEQ ID NO: 3904095 - DNA, 23 bp, Homo sapiens
ggcagagccatgggcctgggcct

SEQ ID NO: 3904096 - DNA, 18 bp, Homo sapiens
ggcagagcggggaggtgc

SEQ ID NO: 3904097 - DNA, 19 bp, Homo sapiens
ggcagagcggggaggtgcc

SEQ ID NO: 3904098 - DNA, 21 bp, Homo sapiens
ggcagagcggggaggtgcctg

SEQ ID NO: 3904099 - DNA, 14 bp, Homo sapiens
ggcagaggcagaca

SEQ ID NO: 3904100 - DNA, 19 bp, Homo sapiens
ggcagaggctggaggcagg

SEQ ID NO: 3904101 - DNA, 23 bp, Homo sapiens
ggcagaggctggaggcagggcct

SEQ ID NO: 3904102 - DNA, 20 bp, Homo sapiens
ggcagagggcagaggctgga

SEQ ID NO: 3904103 - DNA, 17 bp, Homo sapiens
ggcagaggggcagccgc

SEQ ID NO: 3904104 - DNA, 12 bp, Homo sapiens
ggcagcaaggcc

SEQ ID NO: 3904105 - DNA, 13 bp, Homo sapiens
ggcagcaaggccc

SEQ ID NO: 3904106 - DNA, 18 bp, Homo sapiens
ggcagcaaggcccgagca

SEQ ID NO: 3904107 - DNA, 19 bp, Homo sapiens
ggcagcaaggcccgagcag

SEQ ID NO: 3904108 - DNA, 21 bp, Homo sapiens
ggcagcaaggcccgagcagct

SEQ ID NO: 3904109 - DNA, 15 bp, Homo sapiens
ggcagcaccctcccc

SEQ ID NO: 3904110 - DNA, 16 bp, Homo sapiens
ggcagcaccctccccc

SEQ ID NO: 3904111 - DNA, 20 bp, Homo sapiens
ggcagcaccctcccccgcag

SEQ ID NO: 3904112 - DNA, 23 bp, Homo sapiens
ggcagcagccagccctgcctgga

SEQ ID NO: 3904113 - DNA, 21 bp, Homo sapiens
ggcagcagttccatgaagaca

SEQ ID NO: 3904114 - DNA, 21 bp, Homo sapiens
ggcagccacacttctcaggac

SEQ ID NO: 3904115 - DNA, 13 bp, Homo sapiens
ggcagccaggggc

SEQ ID NO: 3904116 - DNA, 19 bp, Homo sapiens
ggcagccatgcctcatgcc

SEQ ID NO: 3904117 - DNA, 21 bp, Homo sapiens
ggcagccatgcctcatgccac

SEQ ID NO: 3904118 - DNA, 21 bp, Homo sapiens
ggcagccgctaggagagactg

SEQ ID NO: 3904119 - DNA, 23 bp, Homo sapiens
ggcagccgctaggagagactgaa

SEQ ID NO: 3904120 - DNA, 22 bp, Homo sapiens
ggcagcctccaccttgctcttc

SEQ ID NO: 3904121 - DNA, 14 bp, Homo sapiens
ggcagcctccagag

SEQ ID NO: 3904122 - DNA, 16 bp, Homo sapiens
ggcagcctccagagcc

SEQ ID NO: 3904123 - DNA, 18 bp, Homo sapiens
ggcagcctccagagccag

SEQ ID NO: 3904124 - DNA, 20 bp, Homo sapiens
ggcagcctccagagccagcc

SEQ ID NO: 3904125 - DNA, 23 bp, Homo sapiens
ggcagcctccagagccagcctgg

SEQ ID NO: 3904126 - DNA, 11 bp, Homo sapiens
ggcagcctgcc

SEQ ID NO: 3904127 - DNA, 18 bp, Homo sapiens
ggcagctagactggagtg

SEQ ID NO: 3904128 - DNA, 14 bp, Homo sapiens
ggcagctccaacag

SEQ ID NO: 3904129 - DNA, 15 bp, Homo sapiens
ggcagctccaacagc

SEQ ID NO: 3904130 - DNA, 22 bp, Homo sapiens
ggcagctccaacagcttgacca

SEQ ID NO: 3904131 - DNA, 14 bp, Homo sapiens
ggcagctcctctcc

SEQ ID NO: 3904132 - DNA, 18 bp, Homo sapiens
ggcagctcctctccttgg

SEQ ID NO: 3904133 - DNA, 16 bp, Homo sapiens
ggcagctcctctgtct

SEQ ID NO: 3904134 - DNA, 18 bp, Homo sapiens
ggcagctcctctgtctcg

SEQ ID NO: 3904135 - DNA, 22 bp, Homo sapiens
ggcagctgagagccctgctgtg

SEQ ID NO: 3904136 - DNA, 22 bp, Homo sapiens
ggcagctgctcttagtgcccgc

SEQ ID NO: 3904137 - DNA, 23 bp, Homo sapiens
ggcagctgctcttagtgcccgcc

SEQ ID NO: 3904138 - DNA, 21 bp, Homo sapiens
ggcagctgggccccacctact

SEQ ID NO: 3904139 - DNA, 23 bp, Homo sapiens
ggcagctgtcatggaaaagccca

SEQ ID NO: 3904140 - DNA, 21 bp, Homo sapiens
ggcagcttaacattgacttct

SEQ ID NO: 3904141 - DNA, 16 bp, Homo sapiens
ggcaggaagagagaga

SEQ ID NO: 3904142 - DNA, 22 bp, Homo sapiens
ggcaggacacatcccggcctct

SEQ ID NO: 3904143 - DNA, 15 bp, Homo sapiens
ggcaggaccaggact

SEQ ID NO: 3904144 - DNA, 16 bp, Homo sapiens
ggcaggagcaggaaca

SEQ ID NO: 3904145 - DNA, 15 bp, Homo sapiens
ggcaggaggcctggc

SEQ ID NO: 3904146 - DNA, 16 bp, Homo sapiens
ggcaggaggcctggcc

SEQ ID NO: 3904147 - DNA, 18 bp, Homo sapiens
ggcaggagtagctgagct

SEQ ID NO: 3904148 - DNA, 19 bp, Homo sapiens
ggcaggagtagctgagctc

SEQ ID NO: 3904149 - DNA, 16 bp, Homo sapiens
ggcaggagtggcagct

SEQ ID NO: 3904150 - DNA, 18 bp, Homo sapiens
ggcaggcacacagcagcc

SEQ ID NO: 3904151 - DNA, 20 bp, Homo sapiens
ggcaggcacacagcagcccc

SEQ ID NO: 3904152 - DNA, 20 bp, Homo sapiens
ggcaggcagatcacaaggtc

SEQ ID NO: 3904153 - DNA, 22 bp, Homo sapiens
ggcaggcagggctctcctggct

SEQ ID NO: 3904154 - DNA, 14 bp, Homo sapiens
ggcaggcctgggac

SEQ ID NO: 3904155 - DNA, 14 bp, Homo sapiens
ggcaggctccccct

SEQ ID NO: 3904156 - DNA, 16 bp, Homo sapiens
ggcaggctggctggcc

SEQ ID NO: 3904157 - DNA, 14 bp, Homo sapiens
ggcagggaaactgg

SEQ ID NO: 3904158 - DNA, 14 bp, Homo sapiens
ggcagggcagaggg

SEQ ID NO: 3904159 - DNA, 12 bp, Homo sapiens
ggcagggctctc

SEQ ID NO: 3904160 - DNA, 13 bp, Homo sapiens
ggcagggctctcc

SEQ ID NO: 3904161 - DNA, 16 bp, Homo sapiens
ggcaggggtgggagag

SEQ ID NO: 3904162 - DNA, 20 bp, Homo sapiens
ggcaggtagatcgcttgagc

SEQ ID NO: 3904163 - DNA, 20 bp, Homo sapiens
ggcaggttagaacctagaag

SEQ ID NO: 3904164 - DNA, 23 bp, Homo sapiens
ggcagtagctgtggtgaggtggg

SEQ ID NO: 3904165 - DNA, 24 bp, Homo sapiens
ggcagtgaacacactcagcagccc

SEQ ID NO: 3904166 - DNA, 22 bp, Homo sapiens
ggcagtgacaagtggagggggt

SEQ ID NO: 3904167 - DNA, 14 bp, Homo sapiens
ggcagtgactggca

SEQ ID NO: 3904168 - DNA, 15 bp, Homo sapiens
ggcagtgactggcag

SEQ ID NO: 3904169 - DNA, 16 bp, Homo sapiens
ggcagtgactggcagg

SEQ ID NO: 3904170 - DNA, 16 bp, Homo sapiens
ggcccacaaaggggag

SEQ ID NO: 3904171 - DNA, 17 bp, Homo sapiens
ggcccacagctcccacc

SEQ ID NO: 3904172 - DNA, 18 bp, Homo sapiens
ggcccacagctcccaccc

SEQ ID NO: 3904173 - DNA, 20 bp, Homo sapiens
ggcccacagggaaccctgct

SEQ ID NO: 3904174 - DNA, 16 bp, Homo sapiens
ggcccagagacccctt

SEQ ID NO: 3904175 - DNA, 22 bp, Homo sapiens
ggcccagagaccccttcctttc

SEQ ID NO: 3904176 - DNA, 22 bp, Homo sapiens
ggcccagagctggaacactctc

SEQ ID NO: 3904177 - DNA, 15 bp, Homo sapiens
ggcccagcctgtcct

SEQ ID NO: 3904178 - DNA, 15 bp, Homo sapiens
ggcccagctgtagcc

SEQ ID NO: 3904179 - DNA, 18 bp, Homo sapiens
ggcccagctgtagccatg

SEQ ID NO: 3904180 - DNA, 17 bp, Homo sapiens
ggcccagtatgagccct

SEQ ID NO: 3904181 - DNA, 22 bp, Homo sapiens
ggcccagtatgagccctagaag

SEQ ID NO: 3904182 - DNA, 19 bp, Homo sapiens
ggcccatagaaacatgaca

SEQ ID NO: 3904183 - DNA, 21 bp, Homo sapiens
ggcccatctcaggtgccactc

SEQ ID NO: 3904184 - DNA, 22 bp, Homo sapiens
ggcccatctcaggtgccactcc

SEQ ID NO: 3904185 - DNA, 13 bp, Homo sapiens
ggccccacatggg

SEQ ID NO: 3904186 - DNA, 21 bp, Homo sapiens
ggccccacctacttgtgactg

SEQ ID NO: 3904187 - DNA, 13 bp, Homo sapiens
ggccccagatctg

SEQ ID NO: 3904188 - DNA, 15 bp, Homo sapiens
ggccccagatctgcc

SEQ ID NO: 3904189 - DNA, 20 bp, Homo sapiens
ggccccagatctgcctgggc

SEQ ID NO: 3904190 - DNA, 13 bp, Homo sapiens
ggccccaggccct

SEQ ID NO: 3904191 - DNA, 17 bp, Homo sapiens
ggccccagggctaccct

SEQ ID NO: 3904192 - DNA, 13 bp, Homo sapiens
ggccccagggttg

SEQ ID NO: 3904193 - DNA, 14 bp, Homo sapiens
ggccccagggttga

SEQ ID NO: 3904194 - DNA, 16 bp, Homo sapiens
ggccccatgacctcca

SEQ ID NO: 3904195 - DNA, 18 bp, Homo sapiens
ggccccatgacctccagc

SEQ ID NO: 3904196 - DNA, 13 bp, Homo sapiens
ggccccatgctct

SEQ ID NO: 3904197 - DNA, 14 bp, Homo sapiens
ggccccatgctctg

SEQ ID NO: 3904198 - DNA, 16 bp, Homo sapiens
ggccccatgctctgcc

SEQ ID NO: 3904199 - DNA, 12 bp, Homo sapiens
ggcccccctcca

SEQ ID NO: 3904200 - DNA, 19 bp, Homo sapiens
ggcccccctccaggcatgc

SEQ ID NO: 3904201 - DNA, 17 bp, Homo sapiens
ggcccccctccttgctc

SEQ ID NO: 3904202 - DNA, 14 bp, Homo sapiens
ggccccctgtgcca

SEQ ID NO: 3904203 - DNA, 15 bp, Homo sapiens
ggccccctgtgccag

SEQ ID NO: 3904204 - DNA, 16 bp, Homo sapiens
ggccccctgtgccagc

SEQ ID NO: 3904205 - DNA, 20 bp, Homo sapiens
ggccccctgtgccagctcag

SEQ ID NO: 3904206 - DNA, 21 bp, Homo sapiens
ggccccctgtgccagctcagg

SEQ ID NO: 3904207 - DNA, 18 bp, Homo sapiens
ggccccgggctctggcca

SEQ ID NO: 3904208 - DNA, 23 bp, Homo sapiens
ggccccgggctctggccaccctg

SEQ ID NO: 3904209 - DNA, 14 bp, Homo sapiens
ggccccggggctgg

SEQ ID NO: 3904210 - DNA, 20 bp, Homo sapiens
ggcccctccagaccctgcct

SEQ ID NO: 3904211 - DNA, 18 bp, Homo sapiens
ggcccctccctctgcccc

SEQ ID NO: 3904212 - DNA, 16 bp, Homo sapiens
ggcccctgaggactgg

SEQ ID NO: 3904213 - DNA, 19 bp, Homo sapiens
ggcccctgaggactggaga

SEQ ID NO: 3904214 - DNA, 17 bp, Homo sapiens
ggcccctgcatcccctt

SEQ ID NO: 3904215 - DNA, 14 bp, Homo sapiens
ggcccgaaagctga

SEQ ID NO: 3904216 - DNA, 13 bp, Homo sapiens
ggcccgacagaga

SEQ ID NO: 3904217 - DNA, 15 bp, Homo sapiens
ggcccgacagagaga

SEQ ID NO: 3904218 - DNA, 16 bp, Homo sapiens
ggcccgacagagagat

SEQ ID NO: 3904219 - DNA, 15 bp, Homo sapiens
ggcccgacagcctgg

SEQ ID NO: 3904220 - DNA, 16 bp, Homo sapiens
ggcccgacagcctggc

SEQ ID NO: 3904221 - DNA, 14 bp, Homo sapiens
ggcccgagcagctg

SEQ ID NO: 3904222 - DNA, 15 bp, Homo sapiens
ggcccgagcagctga

SEQ ID NO: 3904223 - DNA, 20 bp, Homo sapiens
ggcccgagcagctgagcagg

SEQ ID NO: 3904224 - DNA, 21 bp, Homo sapiens
ggcccggagtaatcaggcagc

SEQ ID NO: 3904225 - DNA, 23 bp, Homo sapiens
ggcccggcgcggtggctcacgcc

SEQ ID NO: 3904226 - DNA, 19 bp, Homo sapiens
ggcccggggctggcggcta

SEQ ID NO: 3904227 - DNA, 15 bp, Homo sapiens
ggcccgtcatgttcc

SEQ ID NO: 3904228 - DNA, 22 bp, Homo sapiens
ggccctaacgggggtgcggcag

SEQ ID NO: 3904229 - DNA, 15 bp, Homo sapiens
ggccctaagatgcct

SEQ ID NO: 3904230 - DNA, 22 bp, Homo sapiens
ggccctccctgactccctgtgg

SEQ ID NO: 3904231 - DNA, 18 bp, Homo sapiens
ggccctgaaggttcctga

SEQ ID NO: 3904232 - DNA, 20 bp, Homo sapiens
ggccctggatcagcgtggcc

SEQ ID NO: 3904233 - DNA, 12 bp, Homo sapiens
ggccctggcctg

SEQ ID NO: 3904234 - DNA, 14 bp, Homo sapiens
ggccctggcctgct

SEQ ID NO: 3904235 - DNA, 13 bp, Homo sapiens
ggccctggctccc

SEQ ID NO: 3904236 - DNA, 13 bp, Homo sapiens
ggccctgggcctc

SEQ ID NO: 3904237 - DNA, 14 bp, Homo sapiens
ggccctggggcctg

SEQ ID NO: 3904238 - DNA, 17 bp, Homo sapiens
ggccctggggcctgtac

SEQ ID NO: 3904239 - DNA, 15 bp, Homo sapiens
ggccctggggtccca

SEQ ID NO: 3904240 - DNA, 15 bp, Homo sapiens
ggcccttcctctcca

SEQ ID NO: 3904241 - DNA, 17 bp, Homo sapiens
ggcccttcctctccact

SEQ ID NO: 3904242 - DNA, 19 bp, Homo sapiens
ggcccttcctggacagctg

SEQ ID NO: 3904243 - DNA, 23 bp, Homo sapiens
ggcccttcctggacagctgtgcc

SEQ ID NO: 3904244 - DNA, 18 bp, Homo sapiens
ggcccttggggcctggct

SEQ ID NO: 3904245 - DNA, 15 bp, Homo sapiens
ggcccttgtcctgcc

SEQ ID NO: 3904246 - DNA, 17 bp, Homo sapiens
ggcccttgtcctgccag

SEQ ID NO: 3904247 - DNA, 21 bp, Homo sapiens
ggcccttgtcctgccagctgc

SEQ ID NO: 3904248 - DNA, 23 bp, Homo sapiens
ggcccttgtcctgccagctgcct

SEQ ID NO: 3904249 - DNA, 22 bp, Homo sapiens
ggccgagtaccttaatctgcca

SEQ ID NO: 3904250 - DNA, 18 bp, Homo sapiens
ggccgcaagcgcagggag

SEQ ID NO: 3904251 - DNA, 20 bp, Homo sapiens
ggccgcaagcgcagggagga

SEQ ID NO: 3904252 - DNA, 15 bp, Homo sapiens
ggccgcattccctga

SEQ ID NO: 3904253 - DNA, 16 bp, Homo sapiens
ggccgcattccctgag

SEQ ID NO: 3904254 - DNA, 17 bp, Homo sapiens
ggccgcattccctgagt

SEQ ID NO: 3904255 - DNA, 14 bp, Homo sapiens
ggccgccatccggg

SEQ ID NO: 3904256 - DNA, 15 bp, Homo sapiens
ggccgccatccggga

SEQ ID NO: 3904257 - DNA, 21 bp, Homo sapiens
ggcctgtgtagctgtgacctg

SEQ ID NO: 3904258 - DNA, 19 bp, Homo sapiens
ggcctgtgtccagcagctg

SEQ ID NO: 3904259 - DNA, 23 bp, Homo sapiens
ggccttccccttttgcctggctg

SEQ ID NO: 3904260 - DNA, 15 bp, Homo sapiens
ggccttccctcccca

SEQ ID NO: 3904261 - DNA, 13 bp, Homo sapiens
ggccttgcccaga

SEQ ID NO: 3904262 - DNA, 22 bp, Homo sapiens
ggccttgcccgccagcctcagt

SEQ ID NO: 3904263 - DNA, 19 bp, Homo sapiens
ggccttgtcaggacccagg

SEQ ID NO: 3904264 - DNA, 22 bp, Homo sapiens
ggccttgtcaggacccaggccg

SEQ ID NO: 3904265 - DNA, 16 bp, Homo sapiens
ggcctttaaagactta

SEQ ID NO: 3904266 - DNA, 12 bp, Homo sapiens
ggccttttccta

SEQ ID NO: 3904267 - DNA, 18 bp, Homo sapiens
ggcgaataaatgttcaaa

SEQ ID NO: 3904268 - DNA, 15 bp, Homo sapiens
ggcgatcaagtccag

SEQ ID NO: 3904269 - DNA, 21 bp, Homo sapiens
ggcgcccattcgtctgtccca

SEQ ID NO: 3904270 - DNA, 23 bp, Homo sapiens
ggcgccccaacccgtggaggctg

SEQ ID NO: 3904271 - DNA, 15 bp, Homo sapiens
ggcgcgggaggcacc

SEQ ID NO: 3904272 - DNA, 14 bp, Homo sapiens
ggcgcgtctgcccc

SEQ ID NO: 3904273 - DNA, 17 bp, Homo sapiens
ggcgcgtctgccccacc

SEQ ID NO: 3904274 - DNA, 20 bp, Homo sapiens
ggcgcgtctgccccaccctc

SEQ ID NO: 3904275 - DNA, 11 bp, Homo sapiens
ggcgctcagga

SEQ ID NO: 3904276 - DNA, 15 bp, Homo sapiens
ggcgctcaggaccca

SEQ ID NO: 3904277 - DNA, 18 bp, Homo sapiens
ggcgctcaggacccaggc

SEQ ID NO: 3904278 - DNA, 19 bp, Homo sapiens
ggcgctcaggacccaggcc

SEQ ID NO: 3904279 - DNA, 18 bp, Homo sapiens
ggcggaaaccttgcagca

SEQ ID NO: 3904280 - DNA, 12 bp, Homo sapiens
ggcggcagggtg

SEQ ID NO: 3904281 - DNA, 18 bp, Homo sapiens
ggcggcagggtgggggag

SEQ ID NO: 3904282 - DNA, 20 bp, Homo sapiens
ggcggctactcagcagccct

SEQ ID NO: 3904283 - DNA, 23 bp, Homo sapiens
ggcggctactcagcagccctcct

SEQ ID NO: 3904284 - DNA, 14 bp, Homo sapiens
ggcggctccaggtc

SEQ ID NO: 3904285 - DNA, 17 bp, Homo sapiens
ggcggcttcctgtccac

SEQ ID NO: 3904286 - DNA, 17 bp, Homo sapiens
ggcgggagtgggggctg

SEQ ID NO: 3904287 - DNA, 13 bp, Homo sapiens
ggcggggcaggag

SEQ ID NO: 3904288 - DNA, 16 bp, Homo sapiens
ggcggggcaggaggcc

SEQ ID NO: 3904289 - DNA, 18 bp, Homo sapiens
ggcgggggagccaacagc

SEQ ID NO: 3904290 - DNA, 15 bp, Homo sapiens
ggcgtaatgggcctg

SEQ ID NO: 3904291 - DNA, 14 bp, Homo sapiens
ggctaactctggca

SEQ ID NO: 3904292 - DNA, 15 bp, Homo sapiens
ggctactcagcagcc

SEQ ID NO: 3904293 - DNA, 21 bp, Homo sapiens
ggctactcagcagccctcctc

SEQ ID NO: 3904294 - DNA, 19 bp, Homo sapiens
ggctactctcctcggcccc

SEQ ID NO: 3904295 - DNA, 18 bp, Homo sapiens
ggctactctgtgccagag

SEQ ID NO: 3904296 - DNA, 22 bp, Homo sapiens
ggctactctgtgccagagcctg

SEQ ID NO: 3904297 - DNA, 16 bp, Homo sapiens
ggctactggcagctcc

SEQ ID NO: 3904298 - DNA, 23 bp, Homo sapiens
ggctacttcggggctgggaagtc

SEQ ID NO: 3904299 - DNA, 18 bp, Homo sapiens
ggctagaacctggagggc

SEQ ID NO: 3904300 - DNA, 14 bp, Homo sapiens
ggctagtcagagag

SEQ ID NO: 3904301 - DNA, 20 bp, Homo sapiens
ggctagtgtgagtggcagcc

SEQ ID NO: 3904302 - DNA, 23 bp, Homo sapiens
ggctagtgtgagtggcagccatg

SEQ ID NO: 3904303 - DNA, 24 bp, Homo sapiens
ggctagtgtgagtggcagccatgc

SEQ ID NO: 3904304 - DNA, 23 bp, Homo sapiens
ggctataggtgctacaaaaacac

SEQ ID NO: 3904305 - DNA, 18 bp, Homo sapiens
ggctatcctagagaggct

SEQ ID NO: 3904306 - DNA, 22 bp, Homo sapiens
ggctatttaaaagtataaaact

SEQ ID NO: 3904307 - DNA, 18 bp, Homo sapiens
ggctatttgttcagagag

SEQ ID NO: 3904308 - DNA, 14 bp, Homo sapiens
ggctcaagaggccc

SEQ ID NO: 3904309 - DNA, 20 bp, Homo sapiens
ggctcaagaggcccagggag

SEQ ID NO: 3904310 - DNA, 23 bp, Homo sapiens
ggctcaagaggcccagggagcaa

SEQ ID NO: 3904311 - DNA, 19 bp, Homo sapiens
ggctcacccaagcaaggcc

SEQ ID NO: 3904312 - DNA, 22 bp, Homo sapiens
ggctcacgcctgtaatcccagc

SEQ ID NO: 3904313 - DNA, 14 bp, Homo sapiens
ggctcaggcaagcc

SEQ ID NO: 3904314 - DNA, 15 bp, Homo sapiens
ggctcaggcaagccc

SEQ ID NO: 3904315 - DNA, 20 bp, Homo sapiens
ggctcaggcaagcccctcag

SEQ ID NO: 3904316 - DNA, 22 bp, Homo sapiens
ggctcatggcgtaatgggcctg

SEQ ID NO: 3904317 - DNA, 19 bp, Homo sapiens
ggctccagcatccagcctg

SEQ ID NO: 3904318 - DNA, 13 bp, Homo sapiens
ggctccaggtccg

SEQ ID NO: 3904319 - DNA, 16 bp, Homo sapiens
ggctccatggaggagg

SEQ ID NO: 3904320 - DNA, 21 bp, Homo sapiens
ggctccccacgagtcacctgc

SEQ ID NO: 3904321 - DNA, 22 bp, Homo sapiens
ggctccccacgagtcacctgca

SEQ ID NO: 3904322 - DNA, 18 bp, Homo sapiens
ggctccctcctggagcat

SEQ ID NO: 3904323 - DNA, 14 bp, Homo sapiens
ggctcctcacatag

SEQ ID NO: 3904324 - DNA, 20 bp, Homo sapiens
ggctcctccatctagagatt

SEQ ID NO: 3904325 - DNA, 12 bp, Homo sapiens
ggctcctggctg

SEQ ID NO: 3904326 - DNA, 15 bp, Homo sapiens
ggctcctggctgcca

SEQ ID NO: 3904327 - DNA, 16 bp, Homo sapiens
ggctcctggctgccag

SEQ ID NO: 3904328 - DNA, 20 bp, Homo sapiens
ggctcctggctgccaggcgt

SEQ ID NO: 3904329 - DNA, 23 bp, Homo sapiens
ggctcctgtgctactttgccttt

SEQ ID NO: 3904330 - DNA, 18 bp, Homo sapiens
ggctcgccccacccaggg

SEQ ID NO: 3904331 - DNA, 19 bp, Homo sapiens
ggctctaacgcctgagccc

SEQ ID NO: 3904332 - DNA, 22 bp, Homo sapiens
ggctctaacgcctgagcccagg

SEQ ID NO: 3904333 - DNA, 23 bp, Homo sapiens
ggctctaacgcctgagcccaggg

SEQ ID NO: 3904334 - DNA, 19 bp, Homo sapiens
ggctctccaaaggggctgc

SEQ ID NO: 3904335 - DNA, 12 bp, Homo sapiens
ggctctccacct

SEQ ID NO: 3904336 - DNA, 13 bp, Homo sapiens
ggctctccacctc

SEQ ID NO: 3904337 - DNA, 18 bp, Homo sapiens
ggctctccacctcagcct

SEQ ID NO: 3904338 - DNA, 20 bp, Homo sapiens
ggctctccacctcagccttg

SEQ ID NO: 3904339 - DNA, 22 bp, Homo sapiens
ggctctccacctcagccttgga

SEQ ID NO: 3904340 - DNA, 21 bp, Homo sapiens
ggctctccaccttgttacaca

SEQ ID NO: 3904341 - DNA, 12 bp, Homo sapiens
ggctctgaggcg

SEQ ID NO: 3904342 - DNA, 14 bp, Homo sapiens
ggctctgaggcgcc

SEQ ID NO: 3904343 - DNA, 22 bp, Homo sapiens
ggcttttcgcttgcttctgcag

SEQ ID NO: 3904344 - DNA, 16 bp, Homo sapiens
ggcttttggtggtccc

SEQ ID NO: 3904345 - DNA, 14 bp, Homo sapiens
gggaaaacagagga

SEQ ID NO: 3904346 - DNA, 19 bp, Homo sapiens
gggaaaggaaaaccaggga

SEQ ID NO: 3904347 - DNA, 15 bp, Homo sapiens
gggaaaggatatttt

SEQ ID NO: 3904348 - DNA, 22 bp, Homo sapiens
gggaaaggctctgaaagccagc

SEQ ID NO: 3904349 - DNA, 23 bp, Homo sapiens
gggaaagtcagctttcagagcca

SEQ ID NO: 3904350 - DNA, 13 bp, Homo sapiens
gggaaatggaggg

SEQ ID NO: 3904351 - DNA, 21 bp, Homo sapiens
gggaacaaatcacacctctgg

SEQ ID NO: 3904352 - DNA, 22 bp, Homo sapiens
gggaacaaatcacacctctggg

SEQ ID NO: 3904353 - DNA, 23 bp, Homo sapiens
gggaacaaatcacacctctgggc

SEQ ID NO: 3904354 - DNA, 15 bp, Homo sapiens
gggaacagacaggag

SEQ ID NO: 3904355 - DNA, 16 bp, Homo sapiens
gggaacagacaggaga

SEQ ID NO: 3904356 - DNA, 19 bp, Homo sapiens
gggaacagagcgggcctct

SEQ ID NO: 3904357 - DNA, 15 bp, Homo sapiens
gggaaccccgcagcc

SEQ ID NO: 3904358 - DNA, 12 bp, Homo sapiens
gggaaccctgct

SEQ ID NO: 3904359 - DNA, 20 bp, Homo sapiens
gggaacctagtactctctgc

SEQ ID NO: 3904360 - DNA, 17 bp, Homo sapiens
gggaacgtgactgcccc

SEQ ID NO: 3904361 - DNA, 18 bp, Homo sapiens
gggaactccactctcctt

SEQ ID NO: 3904362 - DNA, 14 bp, Homo sapiens
gggaactctgacaa

SEQ ID NO: 3904363 - DNA, 19 bp, Homo sapiens
gggaactctgacaagggct

SEQ ID NO: 3904364 - DNA, 12 bp, Homo sapiens
gggaactggcca

SEQ ID NO: 3904365 - DNA, 15 bp, Homo sapiens
gggaactggccaagc

SEQ ID NO: 3904366 - DNA, 16 bp, Homo sapiens
gggaactggccaagct

SEQ ID NO: 3904367 - DNA, 18 bp, Homo sapiens
gggaactggccaagctga

SEQ ID NO: 3904368 - DNA, 16 bp, Homo sapiens
gggaagaaagagaagg

SEQ ID NO: 3904369 - DNA, 15 bp, Homo sapiens
gggaagagaagggaa

SEQ ID NO: 3904370 - DNA, 17 bp, Homo sapiens
gggaagagaagggaagc

SEQ ID NO: 3904371 - DNA, 14 bp, Homo sapiens
gggaagatggtagc

SEQ ID NO: 3904372 - DNA, 16 bp, Homo sapiens
gggaagatggtagcag

SEQ ID NO: 3904373 - DNA, 15 bp, Homo sapiens
gggaaggcaggcagg

SEQ ID NO: 3904374 - DNA, 21 bp, Homo sapiens
gggaaggctacttcggggctg

SEQ ID NO: 3904375 - DNA, 16 bp, Homo sapiens
gggaagggagagcggg

SEQ ID NO: 3904376 - DNA, 13 bp, Homo sapiens
gggaagggccagt

SEQ ID NO: 3904377 - DNA, 16 bp, Homo sapiens
gggaagggccagtctg

SEQ ID NO: 3904378 - DNA, 22 bp, Homo sapiens
gggaagggccagtctgggctgc

SEQ ID NO: 3904379 - DNA, 21 bp, Homo sapiens
gggaagtcttacttaaaaaaa

SEQ ID NO: 3904380 - DNA, 14 bp, Homo sapiens
gggaagtgaagccc

SEQ ID NO: 3904381 - DNA, 15 bp, Homo sapiens
gggaagtgctcccca

SEQ ID NO: 3904382 - DNA, 16 bp, Homo sapiens
gggaagtgctccccac

SEQ ID NO: 3904383 - DNA, 12 bp, Homo sapiens
gggaatccgcct

SEQ ID NO: 3904384 - DNA, 20 bp, Homo sapiens
gggaatggatggggagaatg

SEQ ID NO: 3904385 - DNA, 17 bp, Homo sapiens
gggaatgttccctgcac

SEQ ID NO: 3904386 - DNA, 21 bp, Homo sapiens
gggaatgttccctgcaccctg

SEQ ID NO: 3904387 - DNA, 16 bp, Homo sapiens
gggacaaaggagcctg

SEQ ID NO: 3904388 - DNA, 17 bp, Homo sapiens
gggacaaaggagcctgt

SEQ ID NO: 3904389 - DNA, 13 bp, Homo sapiens
gggacaacatttt

SEQ ID NO: 3904390 - DNA, 11 bp, Homo sapiens
gggacacacac

SEQ ID NO: 3904391 - DNA, 16 bp, Homo sapiens
gggacaccccccgccc

SEQ ID NO: 3904392 - DNA, 17 bp, Homo sapiens
gggacacctgccctgcc

SEQ ID NO: 3904393 - DNA, 18 bp, Homo sapiens
gggacagagacacctgca

SEQ ID NO: 3904394 - DNA, 16 bp, Homo sapiens
gggacagttggcagag

SEQ ID NO: 3904395 - DNA, 19 bp, Homo sapiens
gggacagttggcagagaag

SEQ ID NO: 3904396 - DNA, 14 bp, Homo sapiens
gggaccaggcacca

SEQ ID NO: 3904397 - DNA, 17 bp, Homo sapiens
gggaccatggacacatt

SEQ ID NO: 3904398 - DNA, 22 bp, Homo sapiens
gggacccagctactctgtccag

SEQ ID NO: 3904399 - DNA, 18 bp, Homo sapiens
gggaccccctggccctgc

SEQ ID NO: 3904400 - DNA, 16 bp, Homo sapiens
gggacccgaagcccag

SEQ ID NO: 3904401 - DNA, 21 bp, Homo sapiens
gggaccgctacaccactctgg

SEQ ID NO: 3904402 - DNA, 18 bp, Homo sapiens
gggaccggtacagaaagg

SEQ ID NO: 3904403 - DNA, 13 bp, Homo sapiens
gggaccttagaaa

SEQ ID NO: 3904404 - DNA, 17 bp, Homo sapiens
gggacgcgcacacacac

SEQ ID NO: 3904405 - DNA, 11 bp, Homo sapiens
gggacgcttcc

SEQ ID NO: 3904406 - DNA, 15 bp, Homo sapiens
gggacgcttccagac

SEQ ID NO: 3904407 - DNA, 16 bp, Homo sapiens
gggacgcttccagacc

SEQ ID NO: 3904408 - DNA, 20 bp, Homo sapiens
gggacgcttccagaccacct

SEQ ID NO: 3904409 - DNA, 19 bp, Homo sapiens
gggactcaagggtccagaa

SEQ ID NO: 3904410 - DNA, 15 bp, Homo sapiens
gggactgtcgctgct

SEQ ID NO: 3904411 - DNA, 15 bp, Homo sapiens
gggagaaagggcaaa

SEQ ID NO: 3904412 - DNA, 16 bp, Homo sapiens
gggagaagaaatccat

SEQ ID NO: 3904413 - DNA, 22 bp, Homo sapiens
gggagacaccgcgcatctcttc

SEQ ID NO: 3904414 - DNA, 12 bp, Homo sapiens
gggagagactct

SEQ ID NO: 3904415 - DNA, 15 bp, Homo sapiens
gggagagccagctct

SEQ ID NO: 3904416 - DNA, 14 bp, Homo sapiens
gggagaggactctg

SEQ ID NO: 3904417 - DNA, 14 bp, Homo sapiens
gggagaggggagac

SEQ ID NO: 3904418 - DNA, 15 bp, Homo sapiens
gggagagggtctgga

SEQ ID NO: 3904419 - DNA, 15 bp, Homo sapiens
gggagatggtcagtg

SEQ ID NO: 3904420 - DNA, 22 bp, Homo sapiens
gggagatggtcagtgtggagag

SEQ ID NO: 3904421 - DNA, 22 bp, Homo sapiens
gggagcacttgcgtcctgcaga

SEQ ID NO: 3904422 - DNA, 23 bp, Homo sapiens
gggagcacttgcgtcctgcagag

SEQ ID NO: 3904423 - DNA, 20 bp, Homo sapiens
gggagcagagtataggatgg

SEQ ID NO: 3904424 - DNA, 16 bp, Homo sapiens
gggagcatggctgtga

SEQ ID NO: 3904425 - DNA, 16 bp, Homo sapiens
gggagccaacagcagc

SEQ ID NO: 3904426 - DNA, 19 bp, Homo sapiens
gggagcccctaggaaagca

SEQ ID NO: 3904427 - DNA, 20 bp, Homo sapiens
gggagcctccccctcagatg

SEQ ID NO: 3904428 - DNA, 15 bp, Homo sapiens
gggagctggaaataa

SEQ ID NO: 3904429 - DNA, 19 bp, Homo sapiens
gggagctggttagaaatgc

SEQ ID NO: 3904430 - DNA, 21 bp, Homo sapiens
gggccactccttcctgcccca

SEQ ID NO: 3904431 - DNA, 17 bp, Homo sapiens
gggccactctcccctcc

SEQ ID NO: 3904432 - DNA, 18 bp, Homo sapiens
gggccactctcccctccc

SEQ ID NO: 3904433 - DNA, 12 bp, Homo sapiens
gggccactgcca

SEQ ID NO: 3904434 - DNA, 14 bp, Homo sapiens
gggccagacacaga

SEQ ID NO: 3904435 - DNA, 17 bp, Homo sapiens
gggccagcctcagctca

SEQ ID NO: 3904436 - DNA, 14 bp, Homo sapiens
gggccaggagagag

SEQ ID NO: 3904437 - DNA, 15 bp, Homo sapiens
gggccaggagctcag

SEQ ID NO: 3904438 - DNA, 11 bp, Homo sapiens
gggccaggcag

SEQ ID NO: 3904439 - DNA, 23 bp, Homo sapiens
gggccaggcaggtgcctggacat

SEQ ID NO: 3904440 - DNA, 20 bp, Homo sapiens
gggccagtctgggctgccgg

SEQ ID NO: 3904441 - DNA, 18 bp, Homo sapiens
gggccagtgagggctggg

SEQ ID NO: 3904442 - DNA, 18 bp, Homo sapiens
gggcccacaaaggggaga

SEQ ID NO: 3904443 - DNA, 21 bp, Homo sapiens
gggcccacaaaggggagaagg

SEQ ID NO: 3904444 - DNA, 19 bp, Homo sapiens
gggcccaggctctgggaag

SEQ ID NO: 3904445 - DNA, 22 bp, Homo sapiens
gggcccataatagttagccctc

SEQ ID NO: 3904446 - DNA, 15 bp, Homo sapiens
gggccccaccaccta

SEQ ID NO: 3904447 - DNA, 22 bp, Homo sapiens
gggccccacctacttgtgactg

SEQ ID NO: 3904448 - DNA, 18 bp, Homo sapiens
gggccccagaaggcaggg

SEQ ID NO: 3904449 - DNA, 20 bp, Homo sapiens
gggccccagatctgcctggg

SEQ ID NO: 3904450 - DNA, 19 bp, Homo sapiens
gggcccccctccttgctct

SEQ ID NO: 3904451 - DNA, 21 bp, Homo sapiens
gggcccccctccttgctctgc

SEQ ID NO: 3904452 - DNA, 15 bp, Homo sapiens
gggccccggggctgg

SEQ ID NO: 3904453 - DNA, 16 bp, Homo sapiens
gggccccggggctggc

SEQ ID NO: 3904454 - DNA, 19 bp, Homo sapiens
gggccccggggctggcaag

SEQ ID NO: 3904455 - DNA, 13 bp, Homo sapiens
gggcccctccacg

SEQ ID NO: 3904456 - DNA, 18 bp, Homo sapiens
gggcccctccacgcctcc

SEQ ID NO: 3904457 - DNA, 16 bp, Homo sapiens
gggcccctccctctgc

SEQ ID NO: 3904458 - DNA, 18 bp, Homo sapiens
gggcccctccctctgccc

SEQ ID NO: 3904459 - DNA, 22 bp, Homo sapiens
gggcccggagtaatcaggcagc

SEQ ID NO: 3904460 - DNA, 13 bp, Homo sapiens
gggccctgggcct

SEQ ID NO: 3904461 - DNA, 17 bp, Homo sapiens
gggccctgggcctcagt

SEQ ID NO: 3904462 - DNA, 12 bp, Homo sapiens
gggccctggggc

SEQ ID NO: 3904463 - DNA, 15 bp, Homo sapiens
gggccctggggcctg

SEQ ID NO: 3904464 - DNA, 18 bp, Homo sapiens
gggccctggggcctgtac

SEQ ID NO: 3904465 - DNA, 13 bp, Homo sapiens
gggccggccagcc

SEQ ID NO: 3904466 - DNA, 20 bp, Homo sapiens
gggccgggcaggtcctgccc

SEQ ID NO: 3904467 - DNA, 23 bp, Homo sapiens
gggccgggcaggtcctgcccatg

SEQ ID NO: 3904468 - DNA, 13 bp, Homo sapiens
gggccgtgcccag

SEQ ID NO: 3904469 - DNA, 21 bp, Homo sapiens
gggcctatggagagccctggg

SEQ ID NO: 3904470 - DNA, 15 bp, Homo sapiens
gggcctcagtttccc

SEQ ID NO: 3904471 - DNA, 16 bp, Homo sapiens
gggcctcagtttcccc

SEQ ID NO: 3904472 - DNA, 18 bp, Homo sapiens
gggcctcagtttccccat

SEQ ID NO: 3904473 - DNA, 21 bp, Homo sapiens
gggcctctgaaatttcccaca

SEQ ID NO: 3904474 - DNA, 13 bp, Homo sapiens
gggcctcttccct

SEQ ID NO: 3904475 - DNA, 17 bp, Homo sapiens
gggcctcttccctcagt

SEQ ID NO: 3904476 - DNA, 20 bp, Homo sapiens
gggcctgacaggttcccagc

SEQ ID NO: 3904477 - DNA, 23 bp, Homo sapiens
gggcctgacaggttcccagcagc

SEQ ID NO: 3904478 - DNA, 12 bp, Homo sapiens
gggcctgctgcg

SEQ ID NO: 3904479 - DNA, 20 bp, Homo sapiens
gggcctgctgcgtcagacca

SEQ ID NO: 3904480 - DNA, 13 bp, Homo sapiens
gggcctgctgctg

SEQ ID NO: 3904481 - DNA, 19 bp, Homo sapiens
gggcctgctgctgagaacc

SEQ ID NO: 3904482 - DNA, 13 bp, Homo sapiens
gggcctggagagg

SEQ ID NO: 3904483 - DNA, 14 bp, Homo sapiens
gggcctggagaggg

SEQ ID NO: 3904484 - DNA, 18 bp, Homo sapiens
gggcctggagaggggcct

SEQ ID NO: 3904485 - DNA, 13 bp, Homo sapiens
gggcctggcctga

SEQ ID NO: 3904486 - DNA, 14 bp, Homo sapiens
gggcctggcctgag

SEQ ID NO: 3904487 - DNA, 13 bp, Homo sapiens
gggcctggctggc

SEQ ID NO: 3904488 - DNA, 15 bp, Homo sapiens
gggcctggctggctg

SEQ ID NO: 3904489 - DNA, 23 bp, Homo sapiens
gggcctggctggctgagggcagt

SEQ ID NO: 3904490 - DNA, 17 bp, Homo sapiens
gggcctggcttgctcca

SEQ ID NO: 3904491 - DNA, 22 bp, Homo sapiens
gggcctggcttgctccagggtc

SEQ ID NO: 3904492 - DNA, 22 bp, Homo sapiens
gggcctgggaaaggaaaaccag

SEQ ID NO: 3904493 - DNA, 20 bp, Homo sapiens
gggcctgggggcagtgactg

SEQ ID NO: 3904494 - DNA, 16 bp, Homo sapiens
gggcctgtactgcctg

SEQ ID NO: 3904495 - DNA, 21 bp, Homo sapiens
gggcctgtgcagcagcccagc

SEQ ID NO: 3904496 - DNA, 15 bp, Homo sapiens
gggccttgcccagag

SEQ ID NO: 3904497 - DNA, 17 bp, Homo sapiens
gggccttgcccagagat

SEQ ID NO: 3904498 - DNA, 20 bp, Homo sapiens
gggcgatcaagtccagagcc

SEQ ID NO: 3904499 - DNA, 22 bp, Homo sapiens
gggcgcctgtagtcccagccac

SEQ ID NO: 3904500 - DNA, 17 bp, Homo sapiens
gggcgctcaggacccag

SEQ ID NO: 3904501 - DNA, 20 bp, Homo sapiens
gggcgctcaggacccaggcc

SEQ ID NO: 3904502 - DNA, 22 bp, Homo sapiens
gggcggcctatgacttgggcac

SEQ ID NO: 3904503 - DNA, 20 bp, Homo sapiens
gggcgtggaccacccgccct

SEQ ID NO: 3904504 - DNA, 14 bp, Homo sapiens
gggctactggcagc

SEQ ID NO: 3904505 - DNA, 14 bp, Homo sapiens
gggctagaacctgg

SEQ ID NO: 3904506 - DNA, 17 bp, Homo sapiens
gggctagaacctggagg

SEQ ID NO: 3904507 - DNA, 18 bp, Homo sapiens
gggctaggggctggtcct

SEQ ID NO: 3904508 - DNA, 22 bp, Homo sapiens
gggctaggggctggtccttctc

SEQ ID NO: 3904509 - DNA, 22 bp, Homo sapiens
gggctagtgtgagtggcagcca

SEQ ID NO: 3904510 - DNA, 23 bp, Homo sapiens
gggctagtgtgagtggcagccat

SEQ ID NO: 3904511 - DNA, 16 bp, Homo sapiens
gggctatggcaagggg

SEQ ID NO: 3904512 - DNA, 14 bp, Homo sapiens
gggctcagggctgg

SEQ ID NO: 3904513 - DNA, 16 bp, Homo sapiens
gggctccagcatccag

SEQ ID NO: 3904514 - DNA, 23 bp, Homo sapiens
gggctccagcatccagcctgtgt

SEQ ID NO: 3904515 - DNA, 16 bp, Homo sapiens
gggctccatggaggag

SEQ ID NO: 3904516 - DNA, 20 bp, Homo sapiens
ggggctgctcatcacccagt

SEQ ID NO: 3904517 - DNA, 14 bp, Homo sapiens
ggggctgctcctcc

SEQ ID NO: 3904518 - DNA, 11 bp, Homo sapiens
ggggctgctgg

SEQ ID NO: 3904519 - DNA, 19 bp, Homo sapiens
ggggctggcggctactcag

SEQ ID NO: 3904520 - DNA, 15 bp, Homo sapiens
gggggatgggccagg

SEQ ID NO: 3904521 - DNA, 11 bp, Homo sapiens
gggggcagagg

SEQ ID NO: 3904522 - DNA, 13 bp, Homo sapiens
gggggcagagggc

SEQ ID NO: 3904523 - DNA, 14 bp, Homo sapiens
gggggccagacaca

SEQ ID NO: 3904524 - DNA, 17 bp, Homo sapiens
gggggccagctggtgct

SEQ ID NO: 3904525 - DNA, 20 bp, Homo sapiens
gggggccagctggtgctgca

SEQ ID NO: 3904526 - DNA, 14 bp, Homo sapiens
gggggccgggcagg

SEQ ID NO: 3904527 - DNA, 13 bp, Homo sapiens
gggggcctggctg

SEQ ID NO: 3904528 - DNA, 12 bp, Homo sapiens
gggggcgctcag

SEQ ID NO: 3904529 - DNA, 22 bp, Homo sapiens
gggggcgctcaggacccaggcc

SEQ ID NO: 3904530 - DNA, 23 bp, Homo sapiens
gggggcgctcaggacccaggccc

SEQ ID NO: 3904531 - DNA, 15 bp, Homo sapiens
gggggcggcctatga

SEQ ID NO: 3904532 - DNA, 21 bp, Homo sapiens
gggggctatttctctccccac

SEQ ID NO: 3904533 - DNA, 18 bp, Homo sapiens
gggggtgcggcaggagca

SEQ ID NO: 3904534 - DNA, 10 bp, Homo sapiens
gggggtggca

SEQ ID NO: 3904535 - DNA, 12 bp, Homo sapiens
gggggtggcagg

SEQ ID NO: 3904536 - DNA, 18 bp, Homo sapiens
gggggtttttactccagt

SEQ ID NO: 3904537 - DNA, 24 bp, Homo sapiens
gggggtttttactccagtggtgaa

SEQ ID NO: 3904538 - DNA, 18 bp, Homo sapiens
ggggtaagccagagcctg

SEQ ID NO: 3904539 - DNA, 18 bp, Homo sapiens
ggggtattttaggcaggg

SEQ ID NO: 3904540 - DNA, 18 bp, Homo sapiens
ggggtccacccagcaaag

SEQ ID NO: 3904541 - DNA, 19 bp, Homo sapiens
ggggtcgtggagagctagg

SEQ ID NO: 3904542 - DNA, 20 bp, Homo sapiens
ggggtctccctctcctgcct

SEQ ID NO: 3904543 - DNA, 18 bp, Homo sapiens
ggggtctgtatatacatt

SEQ ID NO: 3904544 - DNA, 22 bp, Homo sapiens
ggggtctttgtgagagtgagct

SEQ ID NO: 3904545 - DNA, 18 bp, Homo sapiens
ggggtgatttcagagagg

SEQ ID NO: 3904546 - DNA, 13 bp, Homo sapiens
ggggtgcacagga

SEQ ID NO: 3904547 - DNA, 22 bp, Homo sapiens
ggggtgcatcccccagcactga

SEQ ID NO: 3904548 - DNA, 18 bp, Homo sapiens
ggggtgcggcaggagcag

SEQ ID NO: 3904549 - DNA, 14 bp, Homo sapiens
ggggtgtctggaag

SEQ ID NO: 3904550 - DNA, 17 bp, Homo sapiens
ggggttcagcccctcct

SEQ ID NO: 3904551 - DNA, 22 bp, Homo sapiens
ggggttcagcccctcctctgcc

SEQ ID NO: 3904552 - DNA, 23 bp, Homo sapiens
ggggttcagcccctcctctgcca

SEQ ID NO: 3904553 - DNA, 13 bp, Homo sapiens
ggggttcccccag

SEQ ID NO: 3904554 - DNA, 20 bp, Homo sapiens
ggggttctttcttcctctgc

SEQ ID NO: 3904555 - DNA, 14 bp, Homo sapiens
gggtaagccagagc

SEQ ID NO: 3904556 - DNA, 13 bp, Homo sapiens
gggtaaggtgcct

SEQ ID NO: 3904557 - DNA, 17 bp, Homo sapiens
gggtacatttctctgag

SEQ ID NO: 3904558 - DNA, 15 bp, Homo sapiens
gggtagaggagggca

SEQ ID NO: 3904559 - DNA, 22 bp, Homo sapiens
gggtagcaggtaccactgattt

SEQ ID NO: 3904560 - DNA, 16 bp, Homo sapiens
gggtagggcagcagat

SEQ ID NO: 3904561 - DNA, 17 bp, Homo sapiens
gggtattagcacctctt

SEQ ID NO: 3904562 - DNA, 17 bp, Homo sapiens
gggtcagccagggccag

SEQ ID NO: 3904563 - DNA, 12 bp, Homo sapiens
gggtcaggctcc

SEQ ID NO: 3904564 - DNA, 19 bp, Homo sapiens
gggtccgattaatttatgg

SEQ ID NO: 3904565 - DNA, 19 bp, Homo sapiens
gggtccgcaccagctgctc

SEQ ID NO: 3904566 - DNA, 20 bp, Homo sapiens
gggtcgtcaccacctctcct

SEQ ID NO: 3904567 - DNA, 20 bp, Homo sapiens
gggtctgccaccatcctgct

SEQ ID NO: 3904568 - DNA, 15 bp, Homo sapiens
gggtctggctgagct

SEQ ID NO: 3904569 - DNA, 18 bp, Homo sapiens
gggtctgtgctgtgcctg

SEQ ID NO: 3904570 - DNA, 19 bp, Homo sapiens
gggtctgtgctgtgcctgc

SEQ ID NO: 3904571 - DNA, 17 bp, Homo sapiens
gggtcttgggctactgg

SEQ ID NO: 3904572 - DNA, 22 bp, Homo sapiens
gggtcttgggctactggcagct

SEQ ID NO: 3904573 - DNA, 23 bp, Homo sapiens
gggtgatcagaaggctggggcca

SEQ ID NO: 3904574 - DNA, 14 bp, Homo sapiens
gggtgatgagggca

SEQ ID NO: 3904575 - DNA, 16 bp, Homo sapiens
gggtgatttcagagag

SEQ ID NO: 3904576 - DNA, 14 bp, Homo sapiens
gggtgcacaggagg

SEQ ID NO: 3904577 - DNA, 14 bp, Homo sapiens
gggtgcacccactc

SEQ ID NO: 3904578 - DNA, 21 bp, Homo sapiens
gggtgcatggcttggggagca

SEQ ID NO: 3904579 - DNA, 22 bp, Homo sapiens
gggtgcatggcttggggagcag

SEQ ID NO: 3904580 - DNA, 18 bp, Homo sapiens
gggtgcctcagagcaggc

SEQ ID NO: 3904581 - DNA, 19 bp, Homo sapiens
gggtgcctcagagcaggct

SEQ ID NO: 3904582 - DNA, 22 bp, Homo sapiens
gggtgcctcagagcaggctcag

SEQ ID NO: 3904583 - DNA, 20 bp, Homo sapiens
gggtggacgcaattgtggga

SEQ ID NO: 3904584 - DNA, 16 bp, Homo sapiens
gggtggcacctcctga

SEQ ID NO: 3904585 - DNA, 13 bp, Homo sapiens
gggtggccatccc

SEQ ID NO: 3904586 - DNA, 12 bp, Homo sapiens
gggtgggcctgg

SEQ ID NO: 3904587 - DNA, 14 bp, Homo sapiens
gggtgggcctggcc

SEQ ID NO: 3904588 - DNA, 23 bp, Homo sapiens
gggtgggcctggcctgagctggg

SEQ ID NO: 3904589 - DNA, 21 bp, Homo sapiens
gggtggtctgagcaccccctc

SEQ ID NO: 3904590 - DNA, 15 bp, Homo sapiens
gggtgtggcctcagc

SEQ ID NO: 3904591 - DNA, 18 bp, Homo sapiens
gggtgtggcctcagccct

SEQ ID NO: 3904592 - DNA, 19 bp, Homo sapiens
gggtgtggcctcagccctc

SEQ ID NO: 3904593 - DNA, 19 bp, Homo sapiens
gggttcactagagctggga

SEQ ID NO: 3904594 - DNA, 16 bp, Homo sapiens
gggttcagcccctcct

SEQ ID NO: 3904595 - DNA, 22 bp, Homo sapiens
gggttcagcccctcctctgcca

SEQ ID NO: 3904596 - DNA, 19 bp, Homo sapiens
gggttctttcttcctctgc

SEQ ID NO: 3904597 - DNA, 19 bp, Homo sapiens
gggttctttggaaggagtg

SEQ ID NO: 3904598 - DNA, 17 bp, Homo sapiens
gggttgaaggcagtctg

SEQ ID NO: 3904599 - DNA, 22 bp, Homo sapiens
gggttgaaggcagtctgaaccc

SEQ ID NO: 3904600 - DNA, 22 bp, Homo sapiens
gggttgcgggggagctggaaat

SEQ ID NO: 3904601 - DNA, 15 bp, Homo sapiens
gggttggttggggtg

SEQ ID NO: 3904602 - DNA, 14 bp, Homo sapiens
ggtctagggagaga

SEQ ID NO: 3904603 - DNA, 23 bp, Homo sapiens
ggtctcactatgttgcccaggct

SEQ ID NO: 3904604 - DNA, 14 bp, Homo sapiens
ggtctccctctcct

SEQ ID NO: 3904605 - DNA, 18 bp, Homo sapiens
ggtctccctctcctgcct

SEQ ID NO: 3904606 - DNA, 19 bp, Homo sapiens
ggtctccctctcctgccta

SEQ ID NO: 3904607 - DNA, 23 bp, Homo sapiens
ggtctccttactctgagcccagg

SEQ ID NO: 3904608 - DNA, 21 bp, Homo sapiens
ggtctgaaggaatagccagag

SEQ ID NO: 3904609 - DNA, 18 bp, Homo sapiens
ggtctgagcaccccctca

SEQ ID NO: 3904610 - DNA, 18 bp, Homo sapiens
ggtctgtatatacatttc

SEQ ID NO: 3904611 - DNA, 14 bp, Homo sapiens
ggtctgtcccacca

SEQ ID NO: 3904612 - DNA, 20 bp, Homo sapiens
ggtctgtgctgtgcctgcta

SEQ ID NO: 3904613 - DNA, 16 bp, Homo sapiens
ggtcttcttgtgtcct

SEQ ID NO: 3904614 - DNA, 21 bp, Homo sapiens
ggtcttcttgtgtcctgatga

SEQ ID NO: 3904615 - DNA, 16 bp, Homo sapiens
ggtcttgggctactgg

SEQ ID NO: 3904616 - DNA, 20 bp, Homo sapiens
ggtcttgggctactggcagc

SEQ ID NO: 3904617 - DNA, 15 bp, Homo sapiens
ggtctttttaaacca

SEQ ID NO: 3904618 - DNA, 20 bp, Homo sapiens
ggtgaaaatgccagtctgtg

SEQ ID NO: 3904619 - DNA, 18 bp, Homo sapiens
ggtgaaaccctgtctcta

SEQ ID NO: 3904620 - DNA, 14 bp, Homo sapiens
ggtgaaatccaggt

SEQ ID NO: 3904621 - DNA, 10 bp, Homo sapiens
ggtgaaatta

SEQ ID NO: 3904622 - DNA, 16 bp, Homo sapiens
ggtgaagaaaactcct

SEQ ID NO: 3904623 - DNA, 15 bp, Homo sapiens
ggtgacagtggagga

SEQ ID NO: 3904624 - DNA, 13 bp, Homo sapiens
ggtgacatcccag

SEQ ID NO: 3904625 - DNA, 22 bp, Homo sapiens
ggtgaccccagggcacaggagc

SEQ ID NO: 3904626 - DNA, 22 bp, Homo sapiens
ggtgacccggcaccccctgcag

SEQ ID NO: 3904627 - DNA, 21 bp, Homo sapiens
ggtgacggtcctttaggcagc

SEQ ID NO: 3904628 - DNA, 22 bp, Homo sapiens
ggtgacggtcctttaggcagcc

SEQ ID NO: 3904629 - DNA, 23 bp, Homo sapiens
ggtgacggtcctttaggcagcct

SEQ ID NO: 3904630 - DNA, 23 bp, Homo sapiens
ggtgactgtcccaccgggagcct

SEQ ID NO: 3904631 - DNA, 14 bp, Homo sapiens
ggtgaggcccagcc

SEQ ID NO: 3904632 - DNA, 12 bp, Homo sapiens
ggtgataagtgg

SEQ ID NO: 3904633 - DNA, 14 bp, Homo sapiens
ggtgataagtggaa

SEQ ID NO: 3904634 - DNA, 15 bp, Homo sapiens
ggtgatcagaaggct

SEQ ID NO: 3904635 - DNA, 17 bp, Homo sapiens
ggtgatcagaaggctgg

SEQ ID NO: 3904636 - DNA, 15 bp, Homo sapiens
ggtgatgagggcagc

SEQ ID NO: 3904637 - DNA, 19 bp, Homo sapiens
ggtgatgagggcagcagcc

SEQ ID NO: 3904638 - DNA, 15 bp, Homo sapiens
ggtgatttcagagag

SEQ ID NO: 3904639 - DNA, 12 bp, Homo sapiens
ggtgcaaatcct

SEQ ID NO: 3904640 - DNA, 14 bp, Homo sapiens
ggtgcaagagacag

SEQ ID NO: 3904641 - DNA, 14 bp, Homo sapiens
ggtgcacaggaggg

SEQ ID NO: 3904642 - DNA, 19 bp, Homo sapiens
ggtgcacccactcaccagg

SEQ ID NO: 3904643 - DNA, 20 bp, Homo sapiens
ggtgcacttttctgtgtcat

SEQ ID NO: 3904644 - DNA, 18 bp, Homo sapiens
ggtgcagaggtgagcaga

SEQ ID NO: 3904645 - DNA, 16 bp, Homo sapiens
ggtgcagatgggctgt

SEQ ID NO: 3904646 - DNA, 21 bp, Homo sapiens
ggtgcatttgagagaagccac

SEQ ID NO: 3904647 - DNA, 12 bp, Homo sapiens
ggtgccaccaat

SEQ ID NO: 3904648 - DNA, 23 bp, Homo sapiens
ggtgccacttcttaaaggcctgg

SEQ ID NO: 3904649 - DNA, 18 bp, Homo sapiens
ggtgccaggctgtaagca

SEQ ID NO: 3904650 - DNA, 17 bp, Homo sapiens
ggtgccatgtggagtgg

SEQ ID NO: 3904651 - DNA, 21 bp, Homo sapiens
ggtgcccacaaaatagagatt

SEQ ID NO: 3904652 - DNA, 13 bp, Homo sapiens
ggtgcccaggaga

SEQ ID NO: 3904653 - DNA, 13 bp, Homo sapiens
ggtgccctctgga

SEQ ID NO: 3904654 - DNA, 17 bp, Homo sapiens
ggtgccctctggatcct

SEQ ID NO: 3904655 - DNA, 20 bp, Homo sapiens
ggtgccctctggatcctgct

SEQ ID NO: 3904656 - DNA, 17 bp, Homo sapiens
ggtgcctcagagcaggc

SEQ ID NO: 3904657 - DNA, 18 bp, Homo sapiens
ggtgcctcagagcaggct

SEQ ID NO: 3904658 - DNA, 22 bp, Homo sapiens
ggtgcctgagctggggcctgga

SEQ ID NO: 3904659 - DNA, 22 bp, Homo sapiens
ggtgcctgcctctgccatgccc

SEQ ID NO: 3904660 - DNA, 24 bp, Homo sapiens
ggtgcctgcctctgccatgcccag

SEQ ID NO: 3904661 - DNA, 18 bp, Homo sapiens
ggtgcctgggtggggctg

SEQ ID NO: 3904662 - DNA, 19 bp, Homo sapiens
ggtgcctgggtggggctgc

SEQ ID NO: 3904663 - DNA, 23 bp, Homo sapiens
ggtgcctgggtggggctgctcct

SEQ ID NO: 3904664 - DNA, 17 bp, Homo sapiens
ggtgcctgtgaggcagg

SEQ ID NO: 3904665 - DNA, 11 bp, Homo sapiens
ggtgcctgtgg

SEQ ID NO: 3904666 - DNA, 14 bp, Homo sapiens
ggtgcggcaggagc

SEQ ID NO: 3904667 - DNA, 18 bp, Homo sapiens
ggtgcggcaggagcagga

SEQ ID NO: 3904668 - DNA, 15 bp, Homo sapiens
ggtgcgtggctgtgg

SEQ ID NO: 3904669 - DNA, 20 bp, Homo sapiens
ggtgcgtggctgtggcacag

SEQ ID NO: 3904670 - DNA, 17 bp, Homo sapiens
ggtgctataggctggag

SEQ ID NO: 3904671 - DNA, 21 bp, Homo sapiens
ggtgctataggctggagaagc

SEQ ID NO: 3904672 - DNA, 14 bp, Homo sapiens
ggtgctcgcttctc

SEQ ID NO: 3904673 - DNA, 19 bp, Homo sapiens
ggtgctctggcggcttcct

SEQ ID NO: 3904674 - DNA, 18 bp, Homo sapiens
ggtggaagccctccttcc

SEQ ID NO: 3904675 - DNA, 21 bp, Homo sapiens
ggtggaagggggtgtgcgtgc

SEQ ID NO: 3904676 - DNA, 16 bp, Homo sapiens
ggtggagaagtgtcgt

SEQ ID NO: 3904677 - DNA, 12 bp, Homo sapiens
ggtggaggagga

SEQ ID NO: 3904678 - DNA, 21 bp, Homo sapiens
ggtggcaccagatgcaacctc

SEQ ID NO: 3904679 - DNA, 20 bp, Homo sapiens
ggtggcacctcctgagaagg

SEQ ID NO: 3904680 - DNA, 15 bp, Homo sapiens
ggtggcaggaccagg

SEQ ID NO: 3904681 - DNA, 20 bp, Homo sapiens
ggtggcaggcacacagcagc

SEQ ID NO: 3904682 - DNA, 21 bp, Homo sapiens
ggtggcaggcacacagcagcc

SEQ ID NO: 3904683 - DNA, 23 bp, Homo sapiens
ggtggccactccagacccctggc

SEQ ID NO: 3904684 - DNA, 19 bp, Homo sapiens
ggtggccatccctgggccc

SEQ ID NO: 3904685 - DNA, 17 bp, Homo sapiens
ggtggcccgacagcctg

SEQ ID NO: 3904686 - DNA, 14 bp, Homo sapiens
ggtggctactctgt

SEQ ID NO: 3904687 - DNA, 14 bp, Homo sapiens
ggtggctcacacct

SEQ ID NO: 3904688 - DNA, 17 bp, Homo sapiens
gtaaacagtgcctgctg

SEQ ID NO: 3904689 - DNA, 22 bp, Homo sapiens
gtaaactataaactactgtaat

SEQ ID NO: 3904690 - DNA, 16 bp, Homo sapiens
gtaaactgtggatgat

SEQ ID NO: 3904691 - DNA, 15 bp, Homo sapiens
gtaaagaataaatga

SEQ ID NO: 3904692 - DNA, 23 bp, Homo sapiens
gtaaagtgataatttctggaatt

SEQ ID NO: 3904693 - DNA, 13 bp, Homo sapiens
gtaaataaataga

SEQ ID NO: 3904694 - DNA, 13 bp, Homo sapiens
gtaaatacaaaat

SEQ ID NO: 3904695 - DNA, 14 bp, Homo sapiens
gtaaatacaaaata

SEQ ID NO: 3904696 - DNA, 14 bp, Homo sapiens
gtaaatacatgtgt

SEQ ID NO: 3904697 - DNA, 19 bp, Homo sapiens
gtaaatatgtttgtgcctt

SEQ ID NO: 3904698 - DNA, 11 bp, Homo sapiens
gtaaatattta

SEQ ID NO: 3904699 - DNA, 15 bp, Homo sapiens
gtaaatcacttgtaa

SEQ ID NO: 3904700 - DNA, 20 bp, Homo sapiens
gtaaatcacttgtaaataaa

SEQ ID NO: 3904701 - DNA, 21 bp, Homo sapiens
gtaaatcacttgtaaataaat

SEQ ID NO: 3904702 - DNA, 24 bp, Homo sapiens
gtaaatcacttgtaaataaataga

SEQ ID NO: 3904703 - DNA, 16 bp, Homo sapiens
gtaaatgaccaagaaa

SEQ ID NO: 3904704 - DNA, 22 bp, Homo sapiens
gtaaatggagcttgtacatatt

SEQ ID NO: 3904705 - DNA, 17 bp, Homo sapiens
gtaaatgtccaaaatgt

SEQ ID NO: 3904706 - DNA, 17 bp, Homo sapiens
gtaaatgtttaggtttt

SEQ ID NO: 3904707 - DNA, 13 bp, Homo sapiens
gtaaattggaaac

SEQ ID NO: 3904708 - DNA, 19 bp, Homo sapiens
gtaaatttagcatatcaat

SEQ ID NO: 3904709 - DNA, 18 bp, Homo sapiens
gtaaattttgtatgaaaa

SEQ ID NO: 3904710 - DNA, 20 bp, Homo sapiens
gtaacacaagccacagaagc

SEQ ID NO: 3904711 - DNA, 22 bp, Homo sapiens
gtaacacagctgagagactttt

SEQ ID NO: 3904712 - DNA, 11 bp, Homo sapiens
gtaacatcctt

SEQ ID NO: 3904713 - DNA, 17 bp, Homo sapiens
gtaactactttttatac

SEQ ID NO: 3904714 - DNA, 19 bp, Homo sapiens
gtaactatcaatatttaag

SEQ ID NO: 3904715 - DNA, 14 bp, Homo sapiens
gtaactcagacatt

SEQ ID NO: 3904716 - DNA, 18 bp, Homo sapiens
gtaactcagacattccaa

SEQ ID NO: 3904717 - DNA, 12 bp, Homo sapiens
gtaactccacca

SEQ ID NO: 3904718 - DNA, 15 bp, Homo sapiens
gtaactgctgagcca

SEQ ID NO: 3904719 - DNA, 16 bp, Homo sapiens
gtaactgctgagccac

SEQ ID NO: 3904720 - DNA, 22 bp, Homo sapiens
gtaactgctgagccactcgcag

SEQ ID NO: 3904721 - DNA, 18 bp, Homo sapiens
gtaactgtcaagtcatga

SEQ ID NO: 3904722 - DNA, 11 bp, Homo sapiens
gtaacttcaaa

SEQ ID NO: 3904723 - DNA, 18 bp, Homo sapiens
gtaacttttacaaaacat

SEQ ID NO: 3904724 - DNA, 15 bp, Homo sapiens
gtaacttttgtaaga

SEQ ID NO: 3904725 - DNA, 17 bp, Homo sapiens
gtaacttttgtaagaca

SEQ ID NO: 3904726 - DNA, 16 bp, Homo sapiens
gtaagaccccatctct

SEQ ID NO: 3904727 - DNA, 14 bp, Homo sapiens
gtaagccagagcct

SEQ ID NO: 3904728 - DNA, 17 bp, Homo sapiens
gtaagcctccctcctcg

SEQ ID NO: 3904729 - DNA, 17 bp, Homo sapiens
gtaagggaaactgccag

SEQ ID NO: 3904730 - DNA, 24 bp, Homo sapiens
gtaagggtctgttgtaaatgacca

SEQ ID NO: 3904731 - DNA, 16 bp, Homo sapiens
gtaagtaccacatcta

SEQ ID NO: 3904732 - DNA, 14 bp, Homo sapiens
gtaataaaacccag

SEQ ID NO: 3904733 - DNA, 23 bp, Homo sapiens
gtaataaaacccagcatgtacaa

SEQ ID NO: 3904734 - DNA, 13 bp, Homo sapiens
gtaataagaaagt

SEQ ID NO: 3904735 - DNA, 15 bp, Homo sapiens
gtaatagaaaactga

SEQ ID NO: 3904736 - DNA, 13 bp, Homo sapiens
gtaatatattgct

SEQ ID NO: 3904737 - DNA, 15 bp, Homo sapiens
gtaatatattgctgc

SEQ ID NO: 3904738 - DNA, 16 bp, Homo sapiens
gtaatatattgctgct

SEQ ID NO: 3904739 - DNA, 11 bp, Homo sapiens
gtaatcaggca

SEQ ID NO: 3904740 - DNA, 16 bp, Homo sapiens
gtaatcccagcacttt

SEQ ID NO: 3904741 - DNA, 18 bp, Homo sapiens
gtaatcctgtatattatg

SEQ ID NO: 3904742 - DNA, 15 bp, Homo sapiens
gtaatgagggactgg

SEQ ID NO: 3904743 - DNA, 13 bp, Homo sapiens
gtaatgcacaatt

SEQ ID NO: 3904744 - DNA, 20 bp, Homo sapiens
gtaatgcttagagaatgttc

SEQ ID NO: 3904745 - DNA, 16 bp, Homo sapiens
gtaatggaactgaccc

SEQ ID NO: 3904746 - DNA, 21 bp, Homo sapiens
gtaatgggccaattaaaatat

SEQ ID NO: 3904747 - DNA, 15 bp, Homo sapiens
gtaatgggcctgccc

SEQ ID NO: 3904748 - DNA, 12 bp, Homo sapiens
gtaatgtcacca

SEQ ID NO: 3904749 - DNA, 21 bp, Homo sapiens
gtaattcctctcactaaactt

SEQ ID NO: 3904750 - DNA, 22 bp, Homo sapiens
gtaattctccctaaggaatctg

SEQ ID NO: 3904751 - DNA, 17 bp, Homo sapiens
gtaattgcatttctgct

SEQ ID NO: 3904752 - DNA, 22 bp, Homo sapiens
gtaattgcttacatttttacaa

SEQ ID NO: 3904753 - DNA, 23 bp, Homo sapiens
gtaattgcttacatttttacaat

SEQ ID NO: 3904754 - DNA, 15 bp, Homo sapiens
gtaatttataaaatt

SEQ ID NO: 3904755 - DNA, 18 bp, Homo sapiens
gtaatttataaaattaga

SEQ ID NO: 3904756 - DNA, 15 bp, Homo sapiens
gtaattttgtttgta

SEQ ID NO: 3904757 - DNA, 18 bp, Homo sapiens
gtaattttgtttgtaatc

SEQ ID NO: 3904758 - DNA, 22 bp, Homo sapiens
gtacaaaagtaccatagaacag

SEQ ID NO: 3904759 - DNA, 21 bp, Homo sapiens
gtacaagttttgtataaataa

SEQ ID NO: 3904760 - DNA, 15 bp, Homo sapiens
gtacaatgtttcaga

SEQ ID NO: 3904761 - DNA, 21 bp, Homo sapiens
gtacaattactaaattgtata

SEQ ID NO: 3904762 - DNA, 20 bp, Homo sapiens
gtacacagctctagacactg

SEQ ID NO: 3904763 - DNA, 16 bp, Homo sapiens
gtacagaatttttaat

SEQ ID NO: 3904764 - DNA, 22 bp, Homo sapiens
gtacagagtggcccctcacctg

SEQ ID NO: 3904765 - DNA, 24 bp, Homo sapiens
gtacaggcaaaacacgcaagggca

SEQ ID NO: 3904766 - DNA, 23 bp, Homo sapiens
gtacagttcagttcctctttgca

SEQ ID NO: 3904767 - DNA, 17 bp, Homo sapiens
gtacatagttatttatt

SEQ ID NO: 3904768 - DNA, 18 bp, Homo sapiens
gtacatatgtaaaataaa

SEQ ID NO: 3904769 - DNA, 22 bp, Homo sapiens
gtacatgaagagcagctggtca

SEQ ID NO: 3904770 - DNA, 14 bp, Homo sapiens
gtacatttccctgt

SEQ ID NO: 3904771 - DNA, 16 bp, Homo sapiens
gtacatttccctgtgc

SEQ ID NO: 3904772 - DNA, 17 bp, Homo sapiens
gtacatttctctgagca

SEQ ID NO: 3904773 - DNA, 22 bp, Homo sapiens
gtaccaagccccttggccctct

SEQ ID NO: 3904774 - DNA, 16 bp, Homo sapiens
gtaccagcaatatgta

SEQ ID NO: 3904775 - DNA, 13 bp, Homo sapiens
gtatacacacata

SEQ ID NO: 3904776 - DNA, 14 bp, Homo sapiens
gtataccatacatt

SEQ ID NO: 3904777 - DNA, 22 bp, Homo sapiens
gtatagacagcacttggctcct

SEQ ID NO: 3904778 - DNA, 18 bp, Homo sapiens
gtatagatgcaagatatt

SEQ ID NO: 3904779 - DNA, 19 bp, Homo sapiens
gtatataatactaaagtgt

SEQ ID NO: 3904780 - DNA, 15 bp, Homo sapiens
gtatatacacatata

SEQ ID NO: 3904781 - DNA, 20 bp, Homo sapiens
gtatatactatacaacaatg

SEQ ID NO: 3904782 - DNA, 14 bp, Homo sapiens
gtatatagtatatt

SEQ ID NO: 3904783 - DNA, 16 bp, Homo sapiens
gtatatagtatattta

SEQ ID NO: 3904784 - DNA, 15 bp, Homo sapiens
gtatatatatatagt

SEQ ID NO: 3904785 - DNA, 23 bp, Homo sapiens
gtatatatatatagtaactactt

SEQ ID NO: 3904786 - DNA, 22 bp, Homo sapiens
gtatatatctgcttcagtggag

SEQ ID NO: 3904787 - DNA, 16 bp, Homo sapiens
gtatatatgtgtatat

SEQ ID NO: 3904788 - DNA, 16 bp, Homo sapiens
gtatatatgtgtgttt

SEQ ID NO: 3904789 - DNA, 19 bp, Homo sapiens
gtatatatgtgtgtttaaa

SEQ ID NO: 3904790 - DNA, 17 bp, Homo sapiens
gtatatctggacaagcc

SEQ ID NO: 3904791 - DNA, 18 bp, Homo sapiens
gtatatctggacaagcca

SEQ ID NO: 3904792 - DNA, 21 bp, Homo sapiens
gtatatctggacaagccaact

SEQ ID NO: 3904793 - DNA, 18 bp, Homo sapiens
gtatatgatctaatacaa

SEQ ID NO: 3904794 - DNA, 14 bp, Homo sapiens
gtatatgtatatat

SEQ ID NO: 3904795 - DNA, 14 bp, Homo sapiens
gtatatgtcattta

SEQ ID NO: 3904796 - DNA, 16 bp, Homo sapiens
gtatatgtcatttatt

SEQ ID NO: 3904797 - DNA, 18 bp, Homo sapiens
gtatatgtgcgtctctct

SEQ ID NO: 3904798 - DNA, 17 bp, Homo sapiens
gtatatgttgtaataaa

SEQ ID NO: 3904799 - DNA, 18 bp, Homo sapiens
gtatattatggtgtaatg

SEQ ID NO: 3904800 - DNA, 14 bp, Homo sapiens
gtatattctggaaa

SEQ ID NO: 3904801 - DNA, 13 bp, Homo sapiens
gtatatttatact

SEQ ID NO: 3904802 - DNA, 16 bp, Homo sapiens
gtatatttgtgtatgt

SEQ ID NO: 3904803 - DNA, 14 bp, Homo sapiens
gtatcaaatctgta

SEQ ID NO: 3904804 - DNA, 18 bp, Homo sapiens
gtatcaatccttgttcag

SEQ ID NO: 3904805 - DNA, 14 bp, Homo sapiens
gtatcaggcacagg

SEQ ID NO: 3904806 - DNA, 18 bp, Homo sapiens
gtatcaggcacaggcagg

SEQ ID NO: 3904807 - DNA, 19 bp, Homo sapiens
gtatcaggcacaggcagga

SEQ ID NO: 3904808 - DNA, 20 bp, Homo sapiens
gtatcaggcacaggcaggaa

SEQ ID NO: 3904809 - DNA, 19 bp, Homo sapiens
gtatccactttgcacagct

SEQ ID NO: 3904810 - DNA, 20 bp, Homo sapiens
gtatccagtgatgtgctgga

SEQ ID NO: 3904811 - DNA, 14 bp, Homo sapiens
gtatcccactagcc

SEQ ID NO: 3904812 - DNA, 17 bp, Homo sapiens
gtatcccagacccctct

SEQ ID NO: 3904813 - DNA, 19 bp, Homo sapiens
gtatcgctgccttgccatg

SEQ ID NO: 3904814 - DNA, 15 bp, Homo sapiens
gtatctctctgccta

SEQ ID NO: 3904815 - DNA, 14 bp, Homo sapiens
gtatctgaaggaga

SEQ ID NO: 3904816 - DNA, 20 bp, Homo sapiens
gtatcttacctgtaaagtct

SEQ ID NO: 3904817 - DNA, 16 bp, Homo sapiens
gtatcttctgcagaca

SEQ ID NO: 3904818 - DNA, 16 bp, Homo sapiens
gtatgaacttgaggac

SEQ ID NO: 3904819 - DNA, 23 bp, Homo sapiens
gtatgaacttgaggacacatgtc

SEQ ID NO: 3904820 - DNA, 16 bp, Homo sapiens
gtatgagtaggtttgg

SEQ ID NO: 3904821 - DNA, 15 bp, Homo sapiens
gtatgcagggagctg

SEQ ID NO: 3904822 - DNA, 13 bp, Homo sapiens
gtatgctggccag

SEQ ID NO: 3904823 - DNA, 20 bp, Homo sapiens
gtatgctggccagcaccctc

SEQ ID NO: 3904824 - DNA, 23 bp, Homo sapiens
gtatgctggccagcaccctctcc

SEQ ID NO: 3904825 - DNA, 14 bp, Homo sapiens
gtatggttctcaga

SEQ ID NO: 3904826 - DNA, 15 bp, Homo sapiens
gtatggttctcagat

SEQ ID NO: 3904827 - DNA, 14 bp, Homo sapiens
gtatgtatacacac

SEQ ID NO: 3904828 - DNA, 17 bp, Homo sapiens
gtatgtatacacacata

SEQ ID NO: 3904829 - DNA, 13 bp, Homo sapiens
gtatgtatctatt

SEQ ID NO: 3904830 - DNA, 23 bp, Homo sapiens
gtatgtgaaagtgtaaaatagaa

SEQ ID NO: 3904831 - DNA, 17 bp, Homo sapiens
gtatgtgcacatgtgtc

SEQ ID NO: 3904832 - DNA, 11 bp, Homo sapiens
gtatgtgtggg

SEQ ID NO: 3904833 - DNA, 12 bp, Homo sapiens
gtatgtgtgtgg

SEQ ID NO: 3904834 - DNA, 19 bp, Homo sapiens
gtattaggggtaatatatt

SEQ ID NO: 3904835 - DNA, 18 bp, Homo sapiens
gtattatcacatcaagca

SEQ ID NO: 3904836 - DNA, 21 bp, Homo sapiens
gtattatcacatcaagcatgc

SEQ ID NO: 3904837 - DNA, 19 bp, Homo sapiens
gtattcagatcgtattaat

SEQ ID NO: 3904838 - DNA, 21 bp, Homo sapiens
gtattcagatcgtattaatta

SEQ ID NO: 3904839 - DNA, 20 bp, Homo sapiens
gtattccttttgtgtacagt

SEQ ID NO: 3904840 - DNA, 14 bp, Homo sapiens
gtattcttgtcaaa

SEQ ID NO: 3904841 - DNA, 16 bp, Homo sapiens
gtattgcgaatgtgca

SEQ ID NO: 3904842 - DNA, 19 bp, Homo sapiens
gtatttaaaaccttgattt

SEQ ID NO: 3904843 - DNA, 13 bp, Homo sapiens
gtatttatcttta

SEQ ID NO: 3904844 - DNA, 18 bp, Homo sapiens
gtatttgtacaaatactg

SEQ ID NO: 3904845 - DNA, 17 bp, Homo sapiens
gtatttgtatgtactgt

SEQ ID NO: 3904846 - DNA, 15 bp, Homo sapiens
gtattttaaaagcca

SEQ ID NO: 3904847 - DNA, 22 bp, Homo sapiens
gtattttatctgtgttgtctct

SEQ ID NO: 3904848 - DNA, 20 bp, Homo sapiens
gtatttttcaggtaggccct

SEQ ID NO: 3904849 - DNA, 14 bp, Homo sapiens
gtcaaaaggtgcct

SEQ ID NO: 3904850 - DNA, 15 bp, Homo sapiens
gtcaaaaggtgcctg

SEQ ID NO: 3904851 - DNA, 22 bp, Homo sapiens
gtcaaaccgcactcacccatgt

SEQ ID NO: 3904852 - DNA, 13 bp, Homo sapiens
gtcaaagtaaaac

SEQ ID NO: 3904853 - DNA, 17 bp, Homo sapiens
gtcaacactcttcttga

SEQ ID NO: 3904854 - DNA, 19 bp, Homo sapiens
gtcaacagagaaggcagga

SEQ ID NO: 3904855 - DNA, 22 bp, Homo sapiens
gtcaacagagaaggcaggaatg

SEQ ID NO: 3904856 - DNA, 16 bp, Homo sapiens
gtcaacatcttctctc

SEQ ID NO: 3904857 - DNA, 13 bp, Homo sapiens
gtcaactggagca

SEQ ID NO: 3904858 - DNA, 22 bp, Homo sapiens
gtcaagattttttttgtaactt

SEQ ID NO: 3904859 - DNA, 14 bp, Homo sapiens
gtcaagtcatgatg

SEQ ID NO: 3904860 - DNA, 22 bp, Homo sapiens
gtcaatcccctcattcaggaaa

SEQ ID NO: 3904861 - DNA, 21 bp, Homo sapiens
gtcaatttgtatatcatgaaa

SEQ ID NO: 3904862 - DNA, 17 bp, Homo sapiens
gtccagtgacctgctgg

SEQ ID NO: 3904863 - DNA, 16 bp, Homo sapiens
gtccatatcagacctc

SEQ ID NO: 3904864 - DNA, 17 bp, Homo sapiens
gtccatatcagacctct

SEQ ID NO: 3904865 - DNA, 14 bp, Homo sapiens
gtccatggcaccag

SEQ ID NO: 3904866 - DNA, 16 bp, Homo sapiens
gtccatggcaccagcc

SEQ ID NO: 3904867 - DNA, 14 bp, Homo sapiens
gtccatgtgcttcc

SEQ ID NO: 3904868 - DNA, 16 bp, Homo sapiens
gtcccaaacagagggc

SEQ ID NO: 3904869 - DNA, 13 bp, Homo sapiens
gtcccaaggagct

SEQ ID NO: 3904870 - DNA, 15 bp, Homo sapiens
gtcccaaggagctga

SEQ ID NO: 3904871 - DNA, 13 bp, Homo sapiens
gtcccacatccct

SEQ ID NO: 3904872 - DNA, 14 bp, Homo sapiens
gtcccacatccctg

SEQ ID NO: 3904873 - DNA, 15 bp, Homo sapiens
gtcccacatccctgg

SEQ ID NO: 3904874 - DNA, 17 bp, Homo sapiens
gtcccacatccctgggc

SEQ ID NO: 3904875 - DNA, 19 bp, Homo sapiens
gtcccacatccctgggcct

SEQ ID NO: 3904876 - DNA, 20 bp, Homo sapiens
gtcccacatccctgggcctg

SEQ ID NO: 3904877 - DNA, 23 bp, Homo sapiens
gtcccacatccctgggcctgctg

SEQ ID NO: 3904878 - DNA, 18 bp, Homo sapiens
gtcccaccgggagcctcc

SEQ ID NO: 3904879 - DNA, 12 bp, Homo sapiens
gtcccacctctt

SEQ ID NO: 3904880 - DNA, 21 bp, Homo sapiens
gtcccacctcttctcttcctg

SEQ ID NO: 3904881 - DNA, 22 bp, Homo sapiens
gtcccacctcttctcttcctgt

SEQ ID NO: 3904882 - DNA, 22 bp, Homo sapiens
gtcccacgaatttgctggggaa

SEQ ID NO: 3904883 - DNA, 18 bp, Homo sapiens
gtcccagaaccacactgt

SEQ ID NO: 3904884 - DNA, 22 bp, Homo sapiens
gtcccagaggttatctgcctgg

SEQ ID NO: 3904885 - DNA, 12 bp, Homo sapiens
gtccccagccct

SEQ ID NO: 3904886 - DNA, 16 bp, Homo sapiens
gtccccagggcccctc

SEQ ID NO: 3904887 - DNA, 22 bp, Homo sapiens
gtccccagggcccctccctctg

SEQ ID NO: 3904888 - DNA, 19 bp, Homo sapiens
gtccccatggcaccctgct

SEQ ID NO: 3904889 - DNA, 15 bp, Homo sapiens
gtccccgtgccccgc

SEQ ID NO: 3904890 - DNA, 22 bp, Homo sapiens
gtcccctctcccctcatggaga

SEQ ID NO: 3904891 - DNA, 12 bp, Homo sapiens
gtcccctgcctc

SEQ ID NO: 3904892 - DNA, 23 bp, Homo sapiens
gtcccctgctactcctgtgctct

SEQ ID NO: 3904893 - DNA, 13 bp, Homo sapiens
gtcccctgtccca

SEQ ID NO: 3904894 - DNA, 23 bp, Homo sapiens
gtcccgcttattctcctccctgt

SEQ ID NO: 3904895 - DNA, 21 bp, Homo sapiens
gtcccgtgcagcttctgtcct

SEQ ID NO: 3904896 - DNA, 13 bp, Homo sapiens
gtccctacccact

SEQ ID NO: 3904897 - DNA, 23 bp, Homo sapiens
gtccctacccactctttgctaca

SEQ ID NO: 3904898 - DNA, 21 bp, Homo sapiens
gtccctaccgagtctcttctc

SEQ ID NO: 3904899 - DNA, 23 bp, Homo sapiens
gtccctaccgagtctcttctcca

SEQ ID NO: 3904900 - DNA, 15 bp, Homo sapiens
gtccctcgtccacag

SEQ ID NO: 3904901 - DNA, 18 bp, Homo sapiens
gtccctgccccagcaaga

SEQ ID NO: 3904902 - DNA, 12 bp, Homo sapiens
gtccctgctcct

SEQ ID NO: 3904903 - DNA, 13 bp, Homo sapiens
gtccctgctcctc

SEQ ID NO: 3904904 - DNA, 12 bp, Homo sapiens
gtccctggtccc

SEQ ID NO: 3904905 - DNA, 15 bp, Homo sapiens
gtccctggtccctcg

SEQ ID NO: 3904906 - DNA, 22 bp, Homo sapiens
gtccctggtccctcgtccacag

SEQ ID NO: 3904907 - DNA, 20 bp, Homo sapiens
gtcccttgagacctcagcca

SEQ ID NO: 3904908 - DNA, 22 bp, Homo sapiens
gtcccttgagacctcagccatg

SEQ ID NO: 3904909 - DNA, 21 bp, Homo sapiens
gtcccttggaaagttcagcca

SEQ ID NO: 3904910 - DNA, 23 bp, Homo sapiens
gtcccttggaaagttcagccaga

SEQ ID NO: 3904911 - DNA, 14 bp, Homo sapiens
gtccgcaccagctg

SEQ ID NO: 3904912 - DNA, 24 bp, Homo sapiens
gtccggtgtccttttcactacacc

SEQ ID NO: 3904913 - DNA, 14 bp, Homo sapiens
gtccgtttactcca

SEQ ID NO: 3904914 - DNA, 16 bp, Homo sapiens
gtcctatcgactttat

SEQ ID NO: 3904915 - DNA, 15 bp, Homo sapiens
gtcctcacagcctct

SEQ ID NO: 3904916 - DNA, 20 bp, Homo sapiens
gtcctcagagaatttctacc

SEQ ID NO: 3904917 - DNA, 22 bp, Homo sapiens
gtcctccaacaataaagagctc

SEQ ID NO: 3904918 - DNA, 16 bp, Homo sapiens
gtcctcccatcccctg

SEQ ID NO: 3904919 - DNA, 17 bp, Homo sapiens
gtcctcccatcccctgg

SEQ ID NO: 3904920 - DNA, 17 bp, Homo sapiens
gtcctccccctgccagt

SEQ ID NO: 3904921 - DNA, 22 bp, Homo sapiens
gtcctccccctgccagtgcctt

SEQ ID NO: 3904922 - DNA, 21 bp, Homo sapiens
gtcctctcccctctgccctgt

SEQ ID NO: 3904923 - DNA, 23 bp, Homo sapiens
gtcctctcccgcgggcctggaca

SEQ ID NO: 3904924 - DNA, 18 bp, Homo sapiens
gtcctctggatggcacca

SEQ ID NO: 3904925 - DNA, 13 bp, Homo sapiens
gtcctgagcactg

SEQ ID NO: 3904926 - DNA, 17 bp, Homo sapiens
gtcctgagcactgccag

SEQ ID NO: 3904927 - DNA, 20 bp, Homo sapiens
gtcctgagcactgccaggag

SEQ ID NO: 3904928 - DNA, 21 bp, Homo sapiens
gtcctgagcactgccaggagg

SEQ ID NO: 3904929 - DNA, 22 bp, Homo sapiens
gtcctgagcactgccaggaggg

SEQ ID NO: 3904930 - DNA, 23 bp, Homo sapiens
gtcctgagcactgccaggaggga

SEQ ID NO: 3904931 - DNA, 17 bp, Homo sapiens
gtcctgcaatctccagg

SEQ ID NO: 3904932 - DNA, 13 bp, Homo sapiens
gtcctgcagagga

SEQ ID NO: 3904933 - DNA, 12 bp, Homo sapiens
gtcctgccagct

SEQ ID NO: 3904934 - DNA, 21 bp, Homo sapiens
gtcctgccagctgccttcctc

SEQ ID NO: 3904935 - DNA, 16 bp, Homo sapiens
gtcctgcccaatgcct

SEQ ID NO: 3904936 - DNA, 14 bp, Homo sapiens
gtcctgcccatgtg

SEQ ID NO: 3904937 - DNA, 17 bp, Homo sapiens
gtcctgcccatgtgtcc

SEQ ID NO: 3904938 - DNA, 21 bp, Homo sapiens
gtcctgcccatgtgtcccctc

SEQ ID NO: 3904939 - DNA, 12 bp, Homo sapiens
gtcctgcctctc

SEQ ID NO: 3904940 - DNA, 20 bp, Homo sapiens
gtcctgcctctctgctccag

SEQ ID NO: 3904941 - DNA, 22 bp, Homo sapiens
gtcctgcctctctgctccagag

SEQ ID NO: 3904942 - DNA, 17 bp, Homo sapiens
gtcctgctctcttcagg

SEQ ID NO: 3904943 - DNA, 16 bp, Homo sapiens
gtcctggtacagcagg

SEQ ID NO: 3904944 - DNA, 16 bp, Homo sapiens
gtcctgtctctgcctg

SEQ ID NO: 3904945 - DNA, 14 bp, Homo sapiens
gtccttcagagctc

SEQ ID NO: 3904946 - DNA, 16 bp, Homo sapiens
gtccttcctctcaagc

SEQ ID NO: 3904947 - DNA, 15 bp, Homo sapiens
gtccttctcattcat

SEQ ID NO: 3904948 - DNA, 21 bp, Homo sapiens
gtcttaattaaaagaatattt

SEQ ID NO: 3904949 - DNA, 22 bp, Homo sapiens
gtcttagaagtggaccaggaca

SEQ ID NO: 3904950 - DNA, 14 bp, Homo sapiens
gtcttatttcctca

SEQ ID NO: 3904951 - DNA, 15 bp, Homo sapiens
gtcttcaattaaaag

SEQ ID NO: 3904952 - DNA, 13 bp, Homo sapiens
gtcttcacaacct

SEQ ID NO: 3904953 - DNA, 18 bp, Homo sapiens
gtcttccaaccccagctg

SEQ ID NO: 3904954 - DNA, 19 bp, Homo sapiens
gtcttccaaccccagctgg

SEQ ID NO: 3904955 - DNA, 20 bp, Homo sapiens
gtcttcttacttggaactga

SEQ ID NO: 3904956 - DNA, 21 bp, Homo sapiens
gtcttcttcacccgctgcagc

SEQ ID NO: 3904957 - DNA, 15 bp, Homo sapiens
gtcttcttggcagct

SEQ ID NO: 3904958 - DNA, 20 bp, Homo sapiens
gtcttgcaagcagcctcctg

SEQ ID NO: 3904959 - DNA, 18 bp, Homo sapiens
gtcttgggctactggcag

SEQ ID NO: 3904960 - DNA, 19 bp, Homo sapiens
gtcttgggctactggcagc

SEQ ID NO: 3904961 - DNA, 16 bp, Homo sapiens
gtctttgcacatgtga

SEQ ID NO: 3904962 - DNA, 18 bp, Homo sapiens
gtctttgtaatgtcacca

SEQ ID NO: 3904963 - DNA, 21 bp, Homo sapiens
gtcttttgggagtggcccctg

SEQ ID NO: 3904964 - DNA, 16 bp, Homo sapiens
gtgaaaatgaggagga

SEQ ID NO: 3904965 - DNA, 21 bp, Homo sapiens
gtgaaagagagtaccatgctg

SEQ ID NO: 3904966 - DNA, 19 bp, Homo sapiens
gtgaaagatgcaagcacct

SEQ ID NO: 3904967 - DNA, 21 bp, Homo sapiens
gtgaaataattaaaaaccact

SEQ ID NO: 3904968 - DNA, 11 bp, Homo sapiens
gtgaaatccag

SEQ ID NO: 3904969 - DNA, 21 bp, Homo sapiens
gtgaacaactatttataaact

SEQ ID NO: 3904970 - DNA, 22 bp, Homo sapiens
gtgaaccaaagagactggagca

SEQ ID NO: 3904971 - DNA, 15 bp, Homo sapiens
gtgaacccaggacaa

SEQ ID NO: 3904972 - DNA, 20 bp, Homo sapiens
gtgaactaagttttttactt

SEQ ID NO: 3904973 - DNA, 19 bp, Homo sapiens
gtgaactatttctacacag

SEQ ID NO: 3904974 - DNA, 18 bp, Homo sapiens
gtgaactgcgtgccagtg

SEQ ID NO: 3904975 - DNA, 21 bp, Homo sapiens
gtgaacttacacttggagccc

SEQ ID NO: 3904976 - DNA, 23 bp, Homo sapiens
gtgaagaaaagtgaatgctcaag

SEQ ID NO: 3904977 - DNA, 22 bp, Homo sapiens
gtgaagcagtgcctcgaggcac

SEQ ID NO: 3904978 - DNA, 14 bp, Homo sapiens
gtgaagggtggggt

SEQ ID NO: 3904979 - DNA, 18 bp, Homo sapiens
gtgaataaacttcagcac

SEQ ID NO: 3904980 - DNA, 14 bp, Homo sapiens
gtgaatcagagcac

SEQ ID NO: 3904981 - DNA, 11 bp, Homo sapiens
gtgaattctgc

SEQ ID NO: 3904982 - DNA, 19 bp, Homo sapiens
gtgaatttcttcactgttg

SEQ ID NO: 3904983 - DNA, 17 bp, Homo sapiens
gtgaatttttttttcct

SEQ ID NO: 3904984 - DNA, 15 bp, Homo sapiens
gtgacaagtggaggg

SEQ ID NO: 3904985 - DNA, 21 bp, Homo sapiens
gtgacagacattttcaataat

SEQ ID NO: 3904986 - DNA, 14 bp, Homo sapiens
gtgacatccaggag

SEQ ID NO: 3904987 - DNA, 20 bp, Homo sapiens
gtgacatcccaggaggggcc

SEQ ID NO: 3904988 - DNA, 22 bp, Homo sapiens
gtgacatcccaggaggggcctc

SEQ ID NO: 3904989 - DNA, 19 bp, Homo sapiens
gtgacccaatgctcctgga

SEQ ID NO: 3904990 - DNA, 14 bp, Homo sapiens
gtgacccacatgcc

SEQ ID NO: 3904991 - DNA, 14 bp, Homo sapiens
gtgaccccagggca

SEQ ID NO: 3904992 - DNA, 21 bp, Homo sapiens
gtgacccggcaccccctgcag

SEQ ID NO: 3904993 - DNA, 13 bp, Homo sapiens
gtgaccctctgaa

SEQ ID NO: 3904994 - DNA, 23 bp, Homo sapiens
gtgacccttcccaatcagcactg

SEQ ID NO: 3904995 - DNA, 13 bp, Homo sapiens
gtgacctgctgag

SEQ ID NO: 3904996 - DNA, 16 bp, Homo sapiens
gtgacctgctgagctc

SEQ ID NO: 3904997 - DNA, 21 bp, Homo sapiens
gtgacctgctgagctctgaga

SEQ ID NO: 3904998 - DNA, 13 bp, Homo sapiens
gtgacggtcccac

SEQ ID NO: 3904999 - DNA, 24 bp, Homo sapiens
gtgacggtcctttaggcagcctgc

SEQ ID NO: 3905000 - DNA, 14 bp, Homo sapiens
gtgactccagcctg

SEQ ID NO: 3905001 - DNA, 20 bp, Homo sapiens
gtgactctttttagggccag

SEQ ID NO: 3905002 - DNA, 19 bp, Homo sapiens
gtgactgaatttgggcctc

SEQ ID NO: 3905003 - DNA, 21 bp, Homo sapiens
gtgactgaatttgggcctctt

SEQ ID NO: 3905004 - DNA, 17 bp, Homo sapiens
gtgactgcgatcttcag

SEQ ID NO: 3905005 - DNA, 12 bp, Homo sapiens
gtgactgtccca

SEQ ID NO: 3905006 - DNA, 23 bp, Homo sapiens
gtgactgtcccaccgggagcctc

SEQ ID NO: 3905007 - DNA, 16 bp, Homo sapiens
gtgactgtcgtgttta

SEQ ID NO: 3905008 - DNA, 19 bp, Homo sapiens
gtgactgtcgtgtttacaa

SEQ ID NO: 3905009 - DNA, 20 bp, Homo sapiens
gtgactgtcgtgtttacaaa

SEQ ID NO: 3905010 - DNA, 15 bp, Homo sapiens
gtgactttttagcca

SEQ ID NO: 3905011 - DNA, 18 bp, Homo sapiens
gtgagaatcctgcctctc

SEQ ID NO: 3905012 - DNA, 20 bp, Homo sapiens
gtgagaatcctgcctctccc

SEQ ID NO: 3905013 - DNA, 11 bp, Homo sapiens
gtgagagctgg

SEQ ID NO: 3905014 - DNA, 20 bp, Homo sapiens
gtgagccaggtaatgaggga

SEQ ID NO: 3905015 - DNA, 12 bp, Homo sapiens
gtgagccgcatc

SEQ ID NO: 3905016 - DNA, 14 bp, Homo sapiens
gtgaggaagcctaa

SEQ ID NO: 3905017 - DNA, 12 bp, Homo sapiens
gtgaggagggtg

SEQ ID NO: 3905018 - DNA, 14 bp, Homo sapiens
gtgaggcctggcca

SEQ ID NO: 3905019 - DNA, 15 bp, Homo sapiens
gtgaggcttccaggc

SEQ ID NO: 3905020 - DNA, 12 bp, Homo sapiens
gtgagggctggg

SEQ ID NO: 3905021 - DNA, 16 bp, Homo sapiens
gtgagggctgggcagc

SEQ ID NO: 3905022 - DNA, 22 bp, Homo sapiens
gtgagtgactcggtgtaaaacc

SEQ ID NO: 3905023 - DNA, 22 bp, Homo sapiens
gtgagtgcttgtcatggaaaat

SEQ ID NO: 3905024 - DNA, 13 bp, Homo sapiens
gtgagtggcagcc

SEQ ID NO: 3905025 - DNA, 14 bp, Homo sapiens
gtgataagtggaaa

SEQ ID NO: 3905026 - DNA, 19 bp, Homo sapiens
gtgataagtggaaaaaaga

SEQ ID NO: 3905027 - DNA, 20 bp, Homo sapiens
gtgatacatgtactccagag

SEQ ID NO: 3905028 - DNA, 16 bp, Homo sapiens
gtgatatatgtattta

SEQ ID NO: 3905029 - DNA, 17 bp, Homo sapiens
gtgatatatgtatttat

SEQ ID NO: 3905030 - DNA, 14 bp, Homo sapiens
gtgatatcacctct

SEQ ID NO: 3905031 - DNA, 20 bp, Homo sapiens
gtgatatcacctctcttcag

SEQ ID NO: 3905032 - DNA, 16 bp, Homo sapiens
gtgatatcctgaaaaa

SEQ ID NO: 3905033 - DNA, 17 bp, Homo sapiens
gtgatcaactgttcagg

SEQ ID NO: 3905034 - DNA, 14 bp, Homo sapiens
gtgccttacctcct

SEQ ID NO: 3905035 - DNA, 20 bp, Homo sapiens
gtgccttacctcctgcccag

SEQ ID NO: 3905036 - DNA, 21 bp, Homo sapiens
gtgccttacctcctgcccagg

SEQ ID NO: 3905037 - DNA, 16 bp, Homo sapiens
gtgcctttctctggct

SEQ ID NO: 3905038 - DNA, 19 bp, Homo sapiens
gtgcctttctctggctcca

SEQ ID NO: 3905039 - DNA, 22 bp, Homo sapiens
gtgcgacttcacaaaatgcaag

SEQ ID NO: 3905040 - DNA, 14 bp, Homo sapiens
gtgcggcaggagca

SEQ ID NO: 3905041 - DNA, 14 bp, Homo sapiens
gtgcgtggctgtgg

SEQ ID NO: 3905042 - DNA, 21 bp, Homo sapiens
gtgcgtgttagtgtgtgtgca

SEQ ID NO: 3905043 - DNA, 20 bp, Homo sapiens
gtgctaagggtaagggagag

SEQ ID NO: 3905044 - DNA, 20 bp, Homo sapiens
gtgctacaaaaacacagcaa

SEQ ID NO: 3905045 - DNA, 22 bp, Homo sapiens
gtgctacaaaaacacagcaagg

SEQ ID NO: 3905046 - DNA, 20 bp, Homo sapiens
gtgctacgtacatgtgaggc

SEQ ID NO: 3905047 - DNA, 19 bp, Homo sapiens
gtgctataggctggagaag

SEQ ID NO: 3905048 - DNA, 20 bp, Homo sapiens
gtgctatatatataaatatt

SEQ ID NO: 3905049 - DNA, 13 bp, Homo sapiens
gtgctattctgtg

SEQ ID NO: 3905050 - DNA, 17 bp, Homo sapiens
gtgctattctgtgttga

SEQ ID NO: 3905051 - DNA, 18 bp, Homo sapiens
gtgctattgaactgagcc

SEQ ID NO: 3905052 - DNA, 18 bp, Homo sapiens
gtgctcacgactcttcct

SEQ ID NO: 3905053 - DNA, 20 bp, Homo sapiens
gtgctcacgactcttcctgc

SEQ ID NO: 3905054 - DNA, 14 bp, Homo sapiens
gtgctcacgctccc

SEQ ID NO: 3905055 - DNA, 17 bp, Homo sapiens
gtgctcacgctcccccg

SEQ ID NO: 3905056 - DNA, 16 bp, Homo sapiens
gtgctcgcagcctggc

SEQ ID NO: 3905057 - DNA, 18 bp, Homo sapiens
gtgctcgcagcctggcgg

SEQ ID NO: 3905058 - DNA, 15 bp, Homo sapiens
gtgctctcaccagct

SEQ ID NO: 3905059 - DNA, 13 bp, Homo sapiens
gtgctctggcggc

SEQ ID NO: 3905060 - DNA, 11 bp, Homo sapiens
gtgctctgtga

SEQ ID NO: 3905061 - DNA, 14 bp, Homo sapiens
gtgctgacctctgg

SEQ ID NO: 3905062 - DNA, 11 bp, Homo sapiens
gtgctgagctt

SEQ ID NO: 3905063 - DNA, 13 bp, Homo sapiens
gtgctgccatgcc

SEQ ID NO: 3905064 - DNA, 22 bp, Homo sapiens
gtgctgccatgccactgccagg

SEQ ID NO: 3905065 - DNA, 20 bp, Homo sapiens
gtgctggaggattttccagt

SEQ ID NO: 3905066 - DNA, 16 bp, Homo sapiens
gtgctgtacccttcca

SEQ ID NO: 3905067 - DNA, 17 bp, Homo sapiens
gtgctgtcctctgaagg

SEQ ID NO: 3905068 - DNA, 12 bp, Homo sapiens
gtgctgtgcctg

SEQ ID NO: 3905069 - DNA, 13 bp, Homo sapiens
gtgctgtgcctgc

SEQ ID NO: 3905070 - DNA, 14 bp, Homo sapiens
gtgctgtgcctgct

SEQ ID NO: 3905071 - DNA, 20 bp, Homo sapiens
gtgctgtgcctgctagagca

SEQ ID NO: 3905072 - DNA, 14 bp, Homo sapiens
gtgctgtggccagg

SEQ ID NO: 3905073 - DNA, 23 bp, Homo sapiens
gtgctgtggccagggtgagagct

SEQ ID NO: 3905074 - DNA, 12 bp, Homo sapiens
gtgctgtgggca

SEQ ID NO: 3905075 - DNA, 13 bp, Homo sapiens
gtgctgtgggcag

SEQ ID NO: 3905076 - DNA, 12 bp, Homo sapiens
gtgctgtttgag

SEQ ID NO: 3905077 - DNA, 15 bp, Homo sapiens
gtgctgtttgagatg

SEQ ID NO: 3905078 - DNA, 20 bp, Homo sapiens
gtgctgtttgagatgtgatg

SEQ ID NO: 3905079 - DNA, 15 bp, Homo sapiens
gtgcttcaattaata

SEQ ID NO: 3905080 - DNA, 21 bp, Homo sapiens
gtgcttccctaggctgagctg

SEQ ID NO: 3905081 - DNA, 20 bp, Homo sapiens
gtgctttcaggtctggggct

SEQ ID NO: 3905082 - DNA, 14 bp, Homo sapiens
gtgcttttgatgtg

SEQ ID NO: 3905083 - DNA, 17 bp, Homo sapiens
gtggaaaaaagagaaaa

SEQ ID NO: 3905084 - DNA, 20 bp, Homo sapiens
gtggaaaagaatccctgcag

SEQ ID NO: 3905085 - DNA, 22 bp, Homo sapiens
gtggaacagtcacccttctggg

SEQ ID NO: 3905086 - DNA, 16 bp, Homo sapiens
gtggaagagcagcctg

SEQ ID NO: 3905087 - DNA, 17 bp, Homo sapiens
gtggaagggggtgtgcg

SEQ ID NO: 3905088 - DNA, 18 bp, Homo sapiens
gtggaatgcagggaagag

SEQ ID NO: 3905089 - DNA, 18 bp, Homo sapiens
gtggacacctgccctgcc

SEQ ID NO: 3905090 - DNA, 12 bp, Homo sapiens
gtggacaggact

SEQ ID NO: 3905091 - DNA, 18 bp, Homo sapiens
gtggaccaggacaggacc

SEQ ID NO: 3905092 - DNA, 14 bp, Homo sapiens
gtggactgcgctgg

SEQ ID NO: 3905093 - DNA, 22 bp, Homo sapiens
gtggagaaataaaaatacctct

SEQ ID NO: 3905094 - DNA, 12 bp, Homo sapiens
gtggaggaaggt

SEQ ID NO: 3905095 - DNA, 13 bp, Homo sapiens
gtggaggaggagg

SEQ ID NO: 3905096 - DNA, 15 bp, Homo sapiens
gtggaggcctgatgc

SEQ ID NO: 3905097 - DNA, 18 bp, Homo sapiens
gtggaggcctgatgctgc

SEQ ID NO: 3905098 - DNA, 19 bp, Homo sapiens
gtggaggcctgatgctgcc

SEQ ID NO: 3905099 - DNA, 20 bp, Homo sapiens
gtggaggcctgatgctgccc

SEQ ID NO: 3905100 - DNA, 21 bp, Homo sapiens
gtggaggggtgacagtggagg

SEQ ID NO: 3905101 - DNA, 12 bp, Homo sapiens
gtggagtctcat

SEQ ID NO: 3905102 - DNA, 13 bp, Homo sapiens
gtggatcacagag

SEQ ID NO: 3905103 - DNA, 15 bp, Homo sapiens
gtggatcacagaggc

SEQ ID NO: 3905104 - DNA, 17 bp, Homo sapiens
gtggatctccaaggacc

SEQ ID NO: 3905105 - DNA, 19 bp, Homo sapiens
gtggatctccaaggaccag

SEQ ID NO: 3905106 - DNA, 23 bp, Homo sapiens
gtggatctccaaggaccaggtta

SEQ ID NO: 3905107 - DNA, 17 bp, Homo sapiens
gtggatctgtccaagga

SEQ ID NO: 3905108 - DNA, 16 bp, Homo sapiens
gtggatggaggagaaa

SEQ ID NO: 3905109 - DNA, 15 bp, Homo sapiens
gtggatggatggaca

SEQ ID NO: 3905110 - DNA, 21 bp, Homo sapiens
gtggatggatggacagaatga

SEQ ID NO: 3905111 - DNA, 20 bp, Homo sapiens
gtggattagctagaatgcac

SEQ ID NO: 3905112 - DNA, 17 bp, Homo sapiens
gtggattatttcatttt

SEQ ID NO: 3905113 - DNA, 15 bp, Homo sapiens
gtggattttcctgaa

SEQ ID NO: 3905114 - DNA, 14 bp, Homo sapiens
gtggcaaagtgctg

SEQ ID NO: 3905115 - DNA, 16 bp, Homo sapiens
gtggcaaagtgctgta

SEQ ID NO: 3905116 - DNA, 18 bp, Homo sapiens
gtggcaaagtgctgtacc

SEQ ID NO: 3905117 - DNA, 20 bp, Homo sapiens
gtggcaaagtgctgtaccct

SEQ ID NO: 3905118 - DNA, 15 bp, Homo sapiens
gtggcaaatataaaa

SEQ ID NO: 3905119 - DNA, 16 bp, Homo sapiens
gtggcaaatataaaac

SEQ ID NO: 3905120 - DNA, 12 bp, Homo sapiens
gtggcacctcct

SEQ ID NO: 3905121 - DNA, 14 bp, Homo sapiens
gtggtgtgtgtgct

SEQ ID NO: 3905122 - DNA, 22 bp, Homo sapiens
gtggttccaagaaagatccacc

SEQ ID NO: 3905123 - DNA, 23 bp, Homo sapiens
gtggttccaagaaagatccaccc

SEQ ID NO: 3905124 - DNA, 15 bp, Homo sapiens
gtgtaaagaataaat

SEQ ID NO: 3905125 - DNA, 16 bp, Homo sapiens
gtgtaaagaataaatg

SEQ ID NO: 3905126 - DNA, 20 bp, Homo sapiens
gtgtagctcctctgctgctc

SEQ ID NO: 3905127 - DNA, 19 bp, Homo sapiens
gtgtagctgtgacctgctg

SEQ ID NO: 3905128 - DNA, 14 bp, Homo sapiens
gtgtagctttgctc

SEQ ID NO: 3905129 - DNA, 19 bp, Homo sapiens
gtgtagtggaagagcagcc

SEQ ID NO: 3905130 - DNA, 20 bp, Homo sapiens
gtgtagtggaagagcagcct

SEQ ID NO: 3905131 - DNA, 21 bp, Homo sapiens
gtgtagtggaagagcagcctg

SEQ ID NO: 3905132 - DNA, 22 bp, Homo sapiens
gtgtatatatgtgtatatatac

SEQ ID NO: 3905133 - DNA, 13 bp, Homo sapiens
gtgtatatcagaa

SEQ ID NO: 3905134 - DNA, 19 bp, Homo sapiens
gtgtatggaaataaatgta

SEQ ID NO: 3905135 - DNA, 20 bp, Homo sapiens
gtgtatgtatacacacatat

SEQ ID NO: 3905136 - DNA, 17 bp, Homo sapiens
gtgtatttattgaagaa

SEQ ID NO: 3905137 - DNA, 10 bp, Homo sapiens
gtgtcacagt

SEQ ID NO: 3905138 - DNA, 14 bp, Homo sapiens
gtgtcaccctgcag

SEQ ID NO: 3905139 - DNA, 17 bp, Homo sapiens
gtgtcaccctgcagagc

SEQ ID NO: 3905140 - DNA, 21 bp, Homo sapiens
gtgtcaggcaggtttgccagt

SEQ ID NO: 3905141 - DNA, 20 bp, Homo sapiens
gtgtcccctcactctgtcag

SEQ ID NO: 3905142 - DNA, 12 bp, Homo sapiens
gtgtcctctccc

SEQ ID NO: 3905143 - DNA, 17 bp, Homo sapiens
gtgtccttggggcacag

SEQ ID NO: 3905144 - DNA, 23 bp, Homo sapiens
gtgtcgctctgctggcctggccg

SEQ ID NO: 3905145 - DNA, 13 bp, Homo sapiens
gtgtctgaagact

SEQ ID NO: 3905146 - DNA, 15 bp, Homo sapiens
gtgtctgatgtttgt

SEQ ID NO: 3905147 - DNA, 21 bp, Homo sapiens
gtgtctgcacccaggggtggg

SEQ ID NO: 3905148 - DNA, 20 bp, Homo sapiens
gtgtctgcattgttattgtg

SEQ ID NO: 3905149 - DNA, 19 bp, Homo sapiens
gtgtctggaagctgagcag

SEQ ID NO: 3905150 - DNA, 20 bp, Homo sapiens
gtgtctggaagctgagcagg

SEQ ID NO: 3905151 - DNA, 13 bp, Homo sapiens
gtgtctgtgtggt

SEQ ID NO: 3905152 - DNA, 17 bp, Homo sapiens
gtgtcttttccactcct

SEQ ID NO: 3905153 - DNA, 11 bp, Homo sapiens
gtgtgaagaaa

SEQ ID NO: 3905154 - DNA, 13 bp, Homo sapiens
gtgtgaagaaatg

SEQ ID NO: 3905155 - DNA, 23 bp, Homo sapiens
gtgtgactctcttggattattta

SEQ ID NO: 3905156 - DNA, 18 bp, Homo sapiens
gtgtgagtggcagccatg

SEQ ID NO: 3905157 - DNA, 19 bp, Homo sapiens
gtgtgagtggcagccatgc

SEQ ID NO: 3905158 - DNA, 22 bp, Homo sapiens
gtgtgatgaactttctcttcat

SEQ ID NO: 3905159 - DNA, 21 bp, Homo sapiens
gtgtgatgaatagcgaatcat

SEQ ID NO: 3905160 - DNA, 13 bp, Homo sapiens
gtgtgcagactga

SEQ ID NO: 3905161 - DNA, 14 bp, Homo sapiens
gtgtgcagactgat

SEQ ID NO: 3905162 - DNA, 13 bp, Homo sapiens
gtgtgcatgtatg

SEQ ID NO: 3905163 - DNA, 16 bp, Homo sapiens
gtgtgcatgtatgtgc

SEQ ID NO: 3905164 - DNA, 17 bp, Homo sapiens
gtgtgcatgtgtgtata

SEQ ID NO: 3905165 - DNA, 19 bp, Homo sapiens
gtgtgcatgtgtgtgtctg

SEQ ID NO: 3905166 - DNA, 21 bp, Homo sapiens
gtgtgccatagagtttaacac

SEQ ID NO: 3905167 - DNA, 14 bp, Homo sapiens
gtgtgcccttgggg

SEQ ID NO: 3905168 - DNA, 13 bp, Homo sapiens
gtgtgcctgccct

SEQ ID NO: 3905169 - DNA, 15 bp, Homo sapiens
gtgtgcctgccctgg

SEQ ID NO: 3905170 - DNA, 23 bp, Homo sapiens
gtgtgcctgccctggagggaggc

SEQ ID NO: 3905171 - DNA, 13 bp, Homo sapiens
gtgtgcctgtggc

SEQ ID NO: 3905172 - DNA, 14 bp, Homo sapiens
gtgtgcctgtggca

SEQ ID NO: 3905173 - DNA, 16 bp, Homo sapiens
gtgtgcctgtggcaga

SEQ ID NO: 3905174 - DNA, 19 bp, Homo sapiens
gtgtgcgtgcgtgtgcgtg

SEQ ID NO: 3905175 - DNA, 12 bp, Homo sapiens
gtgtgctgtcct

SEQ ID NO: 3905176 - DNA, 11 bp, Homo sapiens
gtgtggcctca

SEQ ID NO: 3905177 - DNA, 16 bp, Homo sapiens
gtgtggcctcagccct

SEQ ID NO: 3905178 - DNA, 17 bp, Homo sapiens
gtgtggcctcagccctc

SEQ ID NO: 3905179 - DNA, 21 bp, Homo sapiens
gtgtggcctcagccctcagaa

SEQ ID NO: 3905180 - DNA, 13 bp, Homo sapiens
gtgtggctgtctg

SEQ ID NO: 3905181 - DNA, 14 bp, Homo sapiens
gtgtggggaggcag

SEQ ID NO: 3905182 - DNA, 13 bp, Homo sapiens
gtgtggtggctca

SEQ ID NO: 3905183 - DNA, 23 bp, Homo sapiens
gtgtggtgggttctttggaagga

SEQ ID NO: 3905184 - DNA, 20 bp, Homo sapiens
gtgtgtatgtatacacacat

SEQ ID NO: 3905185 - DNA, 17 bp, Homo sapiens
gtgtgtctgtctttgtg

SEQ ID NO: 3905186 - DNA, 15 bp, Homo sapiens
gtgtgtgtatgtata

SEQ ID NO: 3905187 - DNA, 9 bp, Homo sapiens
gtgtgtgtg

SEQ ID NO: 3905188 - DNA, 15 bp, Homo sapiens
gtgtgtgtgtgtgtg

SEQ ID NO: 3905189 - DNA, 18 bp, Homo sapiens
gtgtgtttaaataaagta

SEQ ID NO: 3905190 - DNA, 19 bp, Homo sapiens
gtgtgtttaaataaagtat

SEQ ID NO: 3905191 - DNA, 23 bp, Homo sapiens
gtgtgtttccagatcgatcctgg

SEQ ID NO: 3905192 - DNA, 23 bp, Homo sapiens
gtgttacacagcccaagaggact

SEQ ID NO: 3905193 - DNA, 16 bp, Homo sapiens
gtgttaggaggctgca

SEQ ID NO: 3905194 - DNA, 18 bp, Homo sapiens
gtgttagtgtgtgtgcat

SEQ ID NO: 3905195 - DNA, 14 bp, Homo sapiens
gtgttcaagaaata

SEQ ID NO: 3905196 - DNA, 15 bp, Homo sapiens
gtgttcaagaaataa

SEQ ID NO: 3905197 - DNA, 19 bp, Homo sapiens
gtgttcacactgtaaacat

SEQ ID NO: 3905198 - DNA, 19 bp, Homo sapiens
gtgttctgtgggcttggcc

SEQ ID NO: 3905199 - DNA, 12 bp, Homo sapiens
gtgttgcagaga

SEQ ID NO: 3905200 - DNA, 21 bp, Homo sapiens
gtgttggctctgctggtcact

SEQ ID NO: 3905201 - DNA, 15 bp, Homo sapiens
gtgttggctgtgtga

SEQ ID NO: 3905202 - DNA, 11 bp, Homo sapiens
gtgtttaaata

SEQ ID NO: 3905203 - DNA, 16 bp, Homo sapiens
gtgtttgtgagcatgg

SEQ ID NO: 3905204 - DNA, 20 bp, Homo sapiens
gttaaaagactgcagctgct

SEQ ID NO: 3905205 - DNA, 14 bp, Homo sapiens
gttaaaagatgaaa

SEQ ID NO: 3905206 - DNA, 17 bp, Homo sapiens
gttaaaatataaattaa

SEQ ID NO: 3905207 - DNA, 14 bp, Homo sapiens
gttaacttgtatat

SEQ ID NO: 3905208 - DNA, 12 bp, Homo sapiens
gttccctgcacc

SEQ ID NO: 3905209 - DNA, 14 bp, Homo sapiens
gttccctgcaccct

SEQ ID NO: 3905210 - DNA, 17 bp, Homo sapiens
gttccctgcaccctgga

SEQ ID NO: 3905211 - DNA, 16 bp, Homo sapiens
gttccctgtcagaggc

SEQ ID NO: 3905212 - DNA, 13 bp, Homo sapiens
gttcctcgccctg

SEQ ID NO: 3905213 - DNA, 12 bp, Homo sapiens
gttcctgcactc

SEQ ID NO: 3905214 - DNA, 14 bp, Homo sapiens
gttcctgcactcca

SEQ ID NO: 3905215 - DNA, 17 bp, Homo sapiens
gttcctgtggccaggag

SEQ ID NO: 3905216 - DNA, 15 bp, Homo sapiens
gttccttacctttac

SEQ ID NO: 3905217 - DNA, 15 bp, Homo sapiens
gttccttccctggga

SEQ ID NO: 3905218 - DNA, 17 bp, Homo sapiens
gttccttccctgggaag

SEQ ID NO: 3905219 - DNA, 12 bp, Homo sapiens
gttccttctgct

SEQ ID NO: 3905220 - DNA, 23 bp, Homo sapiens
gttccttgatctgtatatacaat

SEQ ID NO: 3905221 - DNA, 19 bp, Homo sapiens
gttcgagaccaacctgacc

SEQ ID NO: 3905222 - DNA, 15 bp, Homo sapiens
gttcgcagccaccct

SEQ ID NO: 3905223 - DNA, 19 bp, Homo sapiens
gttcgcagccaccctgagg

SEQ ID NO: 3905224 - DNA, 20 bp, Homo sapiens
gttcgcagccaccctgagga

SEQ ID NO: 3905225 - DNA, 23 bp, Homo sapiens
gttctagagaagaggctggtgct

SEQ ID NO: 3905226 - DNA, 14 bp, Homo sapiens
gttctagtctcctt

SEQ ID NO: 3905227 - DNA, 21 bp, Homo sapiens
gttctatataaggaggaaaac

SEQ ID NO: 3905228 - DNA, 16 bp, Homo sapiens
gttctcaatgtgaaaa

SEQ ID NO: 3905229 - DNA, 23 bp, Homo sapiens
gttctcaatgtgaaaaatgtgtc

SEQ ID NO: 3905230 - DNA, 18 bp, Homo sapiens
gttctcagatcttgacag

SEQ ID NO: 3905231 - DNA, 18 bp, Homo sapiens
gttctccgggtgtggcct

SEQ ID NO: 3905232 - DNA, 22 bp, Homo sapiens
gttctccgggtgtggcctcagc

SEQ ID NO: 3905233 - DNA, 23 bp, Homo sapiens
gttctccgggtgtggcctcagcc

SEQ ID NO: 3905234 - DNA, 16 bp, Homo sapiens
gttctgctcctctcca

SEQ ID NO: 3905235 - DNA, 18 bp, Homo sapiens
gttctgctcctctccagg

SEQ ID NO: 3905236 - DNA, 19 bp, Homo sapiens
gttctgctggcctggatct

SEQ ID NO: 3905237 - DNA, 17 bp, Homo sapiens
gttctggggaggaaggg

SEQ ID NO: 3905238 - DNA, 12 bp, Homo sapiens
gttctgtatttt

SEQ ID NO: 3905239 - DNA, 18 bp, Homo sapiens
gttctgtgggcttggcct

SEQ ID NO: 3905240 - DNA, 20 bp, Homo sapiens
gttctgtgggcttggccttg

SEQ ID NO: 3905241 - DNA, 13 bp, Homo sapiens
gttctgtgtgggt

SEQ ID NO: 3905242 - DNA, 17 bp, Homo sapiens
gttctgtgtgggtctgg

SEQ ID NO: 3905243 - DNA, 20 bp, Homo sapiens
gttctgtgtgggtctgggga

SEQ ID NO: 3905244 - DNA, 20 bp, Homo sapiens
gttctgttgatcccacttca

SEQ ID NO: 3905245 - DNA, 22 bp, Homo sapiens
gttcttacctgtatgtctccag

SEQ ID NO: 3905246 - DNA, 19 bp, Homo sapiens
gttcttgagtagatctgct

SEQ ID NO: 3905247 - DNA, 22 bp, Homo sapiens
gttcttgagtagatctgcttct

SEQ ID NO: 3905248 - DNA, 18 bp, Homo sapiens
gttcttggtgactgtccc

SEQ ID NO: 3905249 - DNA, 12 bp, Homo sapiens
gttcttgtctga

SEQ ID NO: 3905250 - DNA, 15 bp, Homo sapiens
gttctttctggagtc

SEQ ID NO: 3905251 - DNA, 17 bp, Homo sapiens
gttctttcttcctctgc

SEQ ID NO: 3905252 - DNA, 21 bp, Homo sapiens
gttcttttttgttacagctat

SEQ ID NO: 3905253 - DNA, 20 bp, Homo sapiens
gttgaaaaatctagtttttt

SEQ ID NO: 3905254 - DNA, 22 bp, Homo sapiens
gttgaaaagactccaaagaaat

SEQ ID NO: 3905255 - DNA, 20 bp, Homo sapiens
gttgaaattatgtatgttta

SEQ ID NO: 3905256 - DNA, 19 bp, Homo sapiens
gttgaccgttttcatcctg

SEQ ID NO: 3905257 - DNA, 14 bp, Homo sapiens
gttgactttcaggt

SEQ ID NO: 3905258 - DNA, 17 bp, Homo sapiens
gttgagggaacagacag

SEQ ID NO: 3905259 - DNA, 23 bp, Homo sapiens
gttgagggaacagacaggagaaa

SEQ ID NO: 3905260 - DNA, 20 bp, Homo sapiens
gttgaggtggaagccctcct

SEQ ID NO: 3905261 - DNA, 20 bp, Homo sapiens
gttgatcactggcaatgaaa

SEQ ID NO: 3905262 - DNA, 15 bp, Homo sapiens
gttgatgaggcctct

SEQ ID NO: 3905263 - DNA, 15 bp, Homo sapiens
gttgattcccagcat

SEQ ID NO: 3905264 - DNA, 13 bp, Homo sapiens
gttgcaaccactg

SEQ ID NO: 3905265 - DNA, 17 bp, Homo sapiens
gttgcaagtactgctgt

SEQ ID NO: 3905266 - DNA, 12 bp, Homo sapiens
gttgcaataaaa

SEQ ID NO: 3905267 - DNA, 16 bp, Homo sapiens
gttgcaccatctgctt

SEQ ID NO: 3905268 - DNA, 23 bp, Homo sapiens
gttgcacctcaggcagaggatgt

SEQ ID NO: 3905269 - DNA, 13 bp, Homo sapiens
gttgcagtgagct

SEQ ID NO: 3905270 - DNA, 18 bp, Homo sapiens
gttgccaactaagccctc

SEQ ID NO: 3905271 - DNA, 12 bp, Homo sapiens
gttgccatttct

SEQ ID NO: 3905272 - DNA, 18 bp, Homo sapiens
gttgccttagcacttctt

SEQ ID NO: 3905273 - DNA, 16 bp, Homo sapiens
gttgctcactcaggac

SEQ ID NO: 3905274 - DNA, 16 bp, Homo sapiens
gttgctggactgagga

SEQ ID NO: 3905275 - DNA, 19 bp, Homo sapiens
gttgctgtcataagaatga

SEQ ID NO: 3905276 - DNA, 22 bp, Homo sapiens
gttgcttagatgagggtgactg

SEQ ID NO: 3905277 - DNA, 14 bp, Homo sapiens
gttgcttctggctc

SEQ ID NO: 3905278 - DNA, 22 bp, Homo sapiens
gttgcttctggctcctccttcc

SEQ ID NO: 3905279 - DNA, 23 bp, Homo sapiens
gttgcttcttctacttcagtctt

SEQ ID NO: 3905280 - DNA, 23 bp, Homo sapiens
gttgctttaaagtacctgtagtg

SEQ ID NO: 3905281 - DNA, 16 bp, Homo sapiens
gttggaaagcaggtgg

SEQ ID NO: 3905282 - DNA, 20 bp, Homo sapiens
gttggatgggaagatggtag

SEQ ID NO: 3905283 - DNA, 14 bp, Homo sapiens
gttggcagagaagg

SEQ ID NO: 3905284 - DNA, 18 bp, Homo sapiens
gttggcagagaaggcctc

SEQ ID NO: 3905285 - DNA, 17 bp, Homo sapiens
gttggccaggctggtct

SEQ ID NO: 3905286 - DNA, 16 bp, Homo sapiens
gttgggagcactggag

SEQ ID NO: 3905287 - DNA, 11 bp, Homo sapiens
gttggtgactg

SEQ ID NO: 3905288 - DNA, 16 bp, Homo sapiens
gttgtaaacaggaagc

SEQ ID NO: 3905289 - DNA, 16 bp, Homo sapiens
gttgtaatagtccatg

SEQ ID NO: 3905290 - DNA, 19 bp, Homo sapiens
gttgtactattgtttaaaa

SEQ ID NO: 3905291 - DNA, 19 bp, Homo sapiens
gttgtagttcttgtgcatg

SEQ ID NO: 3905292 - DNA, 16 bp, Homo sapiens
gttgtcaatattaaat

SEQ ID NO: 3905293 - DNA, 17 bp, Homo sapiens
gttgtcaatattaaata

SEQ ID NO: 3905294 - DNA, 16 bp, Homo sapiens
gttttctcctcccagg

SEQ ID NO: 3905295 - DNA, 16 bp, Homo sapiens
gttttctgagaaagac

SEQ ID NO: 3905296 - DNA, 22 bp, Homo sapiens
gttttcttcaagggaagaaaca

SEQ ID NO: 3905297 - DNA, 23 bp, Homo sapiens
gttttcttcaagggaagaaacac

SEQ ID NO: 3905298 - DNA, 12 bp, Homo sapiens
gttttcttccca

SEQ ID NO: 3905299 - DNA, 14 bp, Homo sapiens
gttttctttgaatg

SEQ ID NO: 3905300 - DNA, 18 bp, Homo sapiens
gttttctttgtaaaggtc

SEQ ID NO: 3905301 - DNA, 13 bp, Homo sapiens
gttttgaaatgct

SEQ ID NO: 3905302 - DNA, 16 bp, Homo sapiens
gttttgacggatgatt

SEQ ID NO: 3905303 - DNA, 19 bp, Homo sapiens
gttttgcacgtcttgctat

SEQ ID NO: 3905304 - DNA, 18 bp, Homo sapiens
gttttgcactgacaagat

SEQ ID NO: 3905305 - DNA, 22 bp, Homo sapiens
gttttgtataaataataaagaa

SEQ ID NO: 3905306 - DNA, 18 bp, Homo sapiens
gttttgtcctttgagaaa

SEQ ID NO: 3905307 - DNA, 21 bp, Homo sapiens
gttttgtcctttgagaaagaa

SEQ ID NO: 3905308 - DNA, 17 bp, Homo sapiens
gttttgtctctgcatct

SEQ ID NO: 3905309 - DNA, 16 bp, Homo sapiens
gtttttaagtcctgta

SEQ ID NO: 3905310 - DNA, 14 bp, Homo sapiens
gtttttactccagt

SEQ ID NO: 3905311 - DNA, 17 bp, Homo sapiens
gtttttactttctgttg

SEQ ID NO: 3905312 - DNA, 19 bp, Homo sapiens
gtttttatgatatccctga

SEQ ID NO: 3905313 - DNA, 16 bp, Homo sapiens
gtttttgaaaagctaa

SEQ ID NO: 3905314 - DNA, 12 bp, Homo sapiens
gtttttgtgctg

SEQ ID NO: 3905315 - DNA, 12 bp, Homo sapiens
gttttttgaaaa

SEQ ID NO: 3905316 - DNA, 12 bp, Homo sapiens
taaaaaaaagaa

SEQ ID NO: 3905317 - DNA, 13 bp, Homo sapiens
taaaaaaatacag

SEQ ID NO: 3905318 - DNA, 16 bp, Homo sapiens
taaaaaaatacagtaa

SEQ ID NO: 3905319 - DNA, 20 bp, Homo sapiens
taaaaaaatacagtaaagtt

SEQ ID NO: 3905320 - DNA, 15 bp, Homo sapiens
taaaaaatggaaaga

SEQ ID NO: 3905321 - DNA, 14 bp, Homo sapiens
taaaaacaggaaaa

SEQ ID NO: 3905322 - DNA, 13 bp, Homo sapiens
taaaaacataaaa

SEQ ID NO: 3905323 - DNA, 23 bp, Homo sapiens
taaaaagaaaagataaagatgat

SEQ ID NO: 3905324 - DNA, 23 bp, Homo sapiens
taaaaagactattaagagcaata

SEQ ID NO: 3905325 - DNA, 20 bp, Homo sapiens
taaaaagagagaaaacttat

SEQ ID NO: 3905326 - DNA, 13 bp, Homo sapiens
taaaaagatttgt

SEQ ID NO: 3905327 - DNA, 15 bp, Homo sapiens
taaaaataaaatgat

SEQ ID NO: 3905328 - DNA, 16 bp, Homo sapiens
taaaaataaaatgatg

SEQ ID NO: 3905329 - DNA, 11 bp, Homo sapiens
taaaaatgcaa

SEQ ID NO: 3905330 - DNA, 15 bp, Homo sapiens
taaaacaatttattt

SEQ ID NO: 3905331 - DNA, 23 bp, Homo sapiens
taaaacatgaaaattatctccct

SEQ ID NO: 3905332 - DNA, 12 bp, Homo sapiens
taaaacattatg

SEQ ID NO: 3905333 - DNA, 19 bp, Homo sapiens
taaaaccatgcagcttcat

SEQ ID NO: 3905334 - DNA, 19 bp, Homo sapiens
taaaacccagcatgtacaa

SEQ ID NO: 3905335 - DNA, 17 bp, Homo sapiens
taaaacctagaacttca

SEQ ID NO: 3905336 - DNA, 23 bp, Homo sapiens
taaaacctagaacttcaaaatgt

SEQ ID NO: 3905337 - DNA, 23 bp, Homo sapiens
taaaacctcagggacaacatttt

SEQ ID NO: 3905338 - DNA, 11 bp, Homo sapiens
taaaacctttc

SEQ ID NO: 3905339 - DNA, 23 bp, Homo sapiens
taaaactatggttcccaataaaa

SEQ ID NO: 3905340 - DNA, 18 bp, Homo sapiens
taaaactcagttaaaatg

SEQ ID NO: 3905341 - DNA, 13 bp, Homo sapiens
taaaacttgctgc

SEQ ID NO: 3905342 - DNA, 17 bp, Homo sapiens
taaaagaacagtaaaca

SEQ ID NO: 3905343 - DNA, 23 bp, Homo sapiens
taaaagaatattttaacttcctt

SEQ ID NO: 3905344 - DNA, 16 bp, Homo sapiens
taaaagactgcagctg

SEQ ID NO: 3905345 - DNA, 17 bp, Homo sapiens
taaaagcataaatgcaa

SEQ ID NO: 3905346 - DNA, 18 bp, Homo sapiens
taaaagcataaatgcaaa

SEQ ID NO: 3905347 - DNA, 15 bp, Homo sapiens
taaaagccacataga

SEQ ID NO: 3905348 - DNA, 13 bp, Homo sapiens
taaaagtaaacat

SEQ ID NO: 3905349 - DNA, 14 bp, Homo sapiens
taaaagtgtgagca

SEQ ID NO: 3905350 - DNA, 14 bp, Homo sapiens
taaaagttgtgatt

SEQ ID NO: 3905351 - DNA, 15 bp, Homo sapiens
taaaataaaaaccag

SEQ ID NO: 3905352 - DNA, 20 bp, Homo sapiens
taaaataaaaaccagaatca

SEQ ID NO: 3905353 - DNA, 21 bp, Homo sapiens
taaaatagcaacactctatat

SEQ ID NO: 3905354 - DNA, 18 bp, Homo sapiens
taaaatatacaaacatgt

SEQ ID NO: 3905355 - DNA, 20 bp, Homo sapiens
taaaatatacaaacatgtgg

SEQ ID NO: 3905356 - DNA, 15 bp, Homo sapiens
taaaatatatataaa

SEQ ID NO: 3905357 - DNA, 18 bp, Homo sapiens
taaaatatggctataaat

SEQ ID NO: 3905358 - DNA, 17 bp, Homo sapiens
taaaatatttttgaaag

SEQ ID NO: 3905359 - DNA, 14 bp, Homo sapiens
taaaatctggaaat

SEQ ID NO: 3905360 - DNA, 23 bp, Homo sapiens
taaaatctggaaatctgttttgt

SEQ ID NO: 3905361 - DNA, 13 bp, Homo sapiens
taaaatctgtgaa

SEQ ID NO: 3905362 - DNA, 14 bp, Homo sapiens
taaaatctgtgaat

SEQ ID NO: 3905363 - DNA, 16 bp, Homo sapiens
taaaatgaaatgtttt

SEQ ID NO: 3905364 - DNA, 15 bp, Homo sapiens
taaaatgattgtaaa

SEQ ID NO: 3905365 - DNA, 16 bp, Homo sapiens
taaaatgattgtaaaa

SEQ ID NO: 3905366 - DNA, 14 bp, Homo sapiens
taaaatgcagtcca

SEQ ID NO: 3905367 - DNA, 19 bp, Homo sapiens
taaaatgcagtccagaata

SEQ ID NO: 3905368 - DNA, 19 bp, Homo sapiens
taaaatgtacactggatat

SEQ ID NO: 3905369 - DNA, 14 bp, Homo sapiens
taaaattatggtga

SEQ ID NO: 3905370 - DNA, 21 bp, Homo sapiens
taaaattgacaacattttatt

SEQ ID NO: 3905371 - DNA, 14 bp, Homo sapiens
taaaattgcacttt

SEQ ID NO: 3905372 - DNA, 14 bp, Homo sapiens
taaaattgtataga

SEQ ID NO: 3905373 - DNA, 23 bp, Homo sapiens
taaaattgtatagagatatgcag

SEQ ID NO: 3905374 - DNA, 12 bp, Homo sapiens
taaaattgtgat

SEQ ID NO: 3905375 - DNA, 13 bp, Homo sapiens
taaacaaaggttg

SEQ ID NO: 3905376 - DNA, 22 bp, Homo sapiens
taaacacccatgaatcaaagac

SEQ ID NO: 3905377 - DNA, 14 bp, Homo sapiens
taaacacctgacac

SEQ ID NO: 3905378 - DNA, 16 bp, Homo sapiens
taaacactgtaatctt

SEQ ID NO: 3905379 - DNA, 17 bp, Homo sapiens
taaacactgtaatctta

SEQ ID NO: 3905380 - DNA, 16 bp, Homo sapiens
taaacagatataaatg

SEQ ID NO: 3905381 - DNA, 15 bp, Homo sapiens
taaatctagtttact

SEQ ID NO: 3905382 - DNA, 22 bp, Homo sapiens
taaatctgagatctccctccag

SEQ ID NO: 3905383 - DNA, 17 bp, Homo sapiens
taaatgaatcttactcc

SEQ ID NO: 3905384 - DNA, 14 bp, Homo sapiens
taaatgaccaagaa

SEQ ID NO: 3905385 - DNA, 15 bp, Homo sapiens
taaatgaccaagaaa

SEQ ID NO: 3905386 - DNA, 16 bp, Homo sapiens
taaatgcaaacactgt

SEQ ID NO: 3905387 - DNA, 18 bp, Homo sapiens
taaatgcaaacactgtgt

SEQ ID NO: 3905388 - DNA, 19 bp, Homo sapiens
taaatgccaacataccctt

SEQ ID NO: 3905389 - DNA, 17 bp, Homo sapiens
taaatgctcgtgtgatt

SEQ ID NO: 3905390 - DNA, 16 bp, Homo sapiens
taaatggagcttgtac

SEQ ID NO: 3905391 - DNA, 18 bp, Homo sapiens
taaatgtatatacacata

SEQ ID NO: 3905392 - DNA, 13 bp, Homo sapiens
taaatgtcttata

SEQ ID NO: 3905393 - DNA, 14 bp, Homo sapiens
taaatgtcttatat

SEQ ID NO: 3905394 - DNA, 16 bp, Homo sapiens
taaatgtgccttcatt

SEQ ID NO: 3905395 - DNA, 16 bp, Homo sapiens
taaatgtgcttttaaa

SEQ ID NO: 3905396 - DNA, 17 bp, Homo sapiens
taaatgtgtaaatgtgg

SEQ ID NO: 3905397 - DNA, 12 bp, Homo sapiens
taaatgtgtggt

SEQ ID NO: 3905398 - DNA, 16 bp, Homo sapiens
taaatgttcaaactgt

SEQ ID NO: 3905399 - DNA, 14 bp, Homo sapiens
taaatgttgaaatc

SEQ ID NO: 3905400 - DNA, 20 bp, Homo sapiens
taaatgtttttattaacaat

SEQ ID NO: 3905401 - DNA, 13 bp, Homo sapiens
taaattaagactt

SEQ ID NO: 3905402 - DNA, 16 bp, Homo sapiens
taaattataagatgtc

SEQ ID NO: 3905403 - DNA, 19 bp, Homo sapiens
taaattatttttaagaaat

SEQ ID NO: 3905404 - DNA, 16 bp, Homo sapiens
taaattcaaaccattt

SEQ ID NO: 3905405 - DNA, 17 bp, Homo sapiens
taaattcacaatagaaa

SEQ ID NO: 3905406 - DNA, 18 bp, Homo sapiens
taaattcagatatatttt

SEQ ID NO: 3905407 - DNA, 16 bp, Homo sapiens
taaattgatgttgctg

SEQ ID NO: 3905408 - DNA, 16 bp, Homo sapiens
taaattggaattttct

SEQ ID NO: 3905409 - DNA, 16 bp, Homo sapiens
taaattggtgataagt

SEQ ID NO: 3905410 - DNA, 21 bp, Homo sapiens
taaattggtgataagtggaaa

SEQ ID NO: 3905411 - DNA, 22 bp, Homo sapiens
taaattggtgataagtggaaaa

SEQ ID NO: 3905412 - DNA, 17 bp, Homo sapiens
taaattgtaaattttag

SEQ ID NO: 3905413 - DNA, 15 bp, Homo sapiens
taaatttgtccaatg

SEQ ID NO: 3905414 - DNA, 18 bp, Homo sapiens
taaattttagagcatacc

SEQ ID NO: 3905415 - DNA, 17 bp, Homo sapiens
taaattttgtatgaaaa

SEQ ID NO: 3905416 - DNA, 13 bp, Homo sapiens
taaatttttgtca

SEQ ID NO: 3905417 - DNA, 18 bp, Homo sapiens
taaatttttgtcatttta

SEQ ID NO: 3905418 - DNA, 13 bp, Homo sapiens
taacaaacaaaat

SEQ ID NO: 3905419 - DNA, 23 bp, Homo sapiens
taacaacaatggtttacatgaac

SEQ ID NO: 3905420 - DNA, 17 bp, Homo sapiens
taacaactaatcaagag

SEQ ID NO: 3905421 - DNA, 16 bp, Homo sapiens
taacaagatctttcag

SEQ ID NO: 3905422 - DNA, 17 bp, Homo sapiens
taacaagatctttcagg

SEQ ID NO: 3905423 - DNA, 15 bp, Homo sapiens
taacaatttccttta

SEQ ID NO: 3905424 - DNA, 18 bp, Homo sapiens
taacaattttaatgctat

SEQ ID NO: 3905425 - DNA, 23 bp, Homo sapiens
taacacaagtcctgtgaatttct

SEQ ID NO: 3905426 - DNA, 14 bp, Homo sapiens
taacactcagaagc

SEQ ID NO: 3905427 - DNA, 17 bp, Homo sapiens
taacagaaccagagggt

SEQ ID NO: 3905428 - DNA, 16 bp, Homo sapiens
taacagggaaggcagg

SEQ ID NO: 3905429 - DNA, 19 bp, Homo sapiens
taacagggaaggcaggcag

SEQ ID NO: 3905430 - DNA, 22 bp, Homo sapiens
taacagggaaggcaggcagggc

SEQ ID NO: 3905431 - DNA, 23 bp, Homo sapiens
taacagtatttgtacaaatactg

SEQ ID NO: 3905432 - DNA, 16 bp, Homo sapiens
taacataaaatctgtg

SEQ ID NO: 3905433 - DNA, 19 bp, Homo sapiens
taacataatttgtacatat

SEQ ID NO: 3905434 - DNA, 14 bp, Homo sapiens
taacatatgtatta

SEQ ID NO: 3905435 - DNA, 22 bp, Homo sapiens
taacatatttactaagccacaa

SEQ ID NO: 3905436 - DNA, 23 bp, Homo sapiens
taacatatttactaagccacaag

SEQ ID NO: 3905437 - DNA, 14 bp, Homo sapiens
taacattgacttct

SEQ ID NO: 3905438 - DNA, 16 bp, Homo sapiens
taaccagtacttctaa

SEQ ID NO: 3905439 - DNA, 17 bp, Homo sapiens
taaccagtacttctaag

SEQ ID NO: 3905440 - DNA, 18 bp, Homo sapiens
taaccagtacttctaaga

SEQ ID NO: 3905441 - DNA, 21 bp, Homo sapiens
taaccagtacttctaagagca

SEQ ID NO: 3905442 - DNA, 18 bp, Homo sapiens
taacccccagtgccacag

SEQ ID NO: 3905443 - DNA, 19 bp, Homo sapiens
taacccccagtgccacaga

SEQ ID NO: 3905444 - DNA, 16 bp, Homo sapiens
taacccctttcctgcg

SEQ ID NO: 3905445 - DNA, 15 bp, Homo sapiens
taacctactagacaa

SEQ ID NO: 3905446 - DNA, 21 bp, Homo sapiens
taacctcagccaaacacagag

SEQ ID NO: 3905447 - DNA, 13 bp, Homo sapiens
taacctggcttat

SEQ ID NO: 3905448 - DNA, 17 bp, Homo sapiens
taacgccctatttttgc

SEQ ID NO: 3905449 - DNA, 18 bp, Homo sapiens
taacgcctgagcccaggg

SEQ ID NO: 3905450 - DNA, 19 bp, Homo sapiens
taacgcctgagcccaggga

SEQ ID NO: 3905451 - DNA, 12 bp, Homo sapiens
taacggctccag

SEQ ID NO: 3905452 - DNA, 15 bp, Homo sapiens
taacggctccaggat

SEQ ID NO: 3905453 - DNA, 16 bp, Homo sapiens
taacgggcatgtatta

SEQ ID NO: 3905454 - DNA, 17 bp, Homo sapiens
taactaatgctaagaaa

SEQ ID NO: 3905455 - DNA, 14 bp, Homo sapiens
taactaatttaaac

SEQ ID NO: 3905456 - DNA, 16 bp, Homo sapiens
taactacactaataaa

SEQ ID NO: 3905457 - DNA, 17 bp, Homo sapiens
taactactttttatact

SEQ ID NO: 3905458 - DNA, 17 bp, Homo sapiens
taactagtttaattaac

SEQ ID NO: 3905459 - DNA, 18 bp, Homo sapiens
taactatcaatatttaag

SEQ ID NO: 3905460 - DNA, 11 bp, Homo sapiens
taactccacca

SEQ ID NO: 3905461 - DNA, 14 bp, Homo sapiens
taactccagtgaag

SEQ ID NO: 3905462 - DNA, 16 bp, Homo sapiens
taactgaaggagaagg

SEQ ID NO: 3905463 - DNA, 20 bp, Homo sapiens
taactgcaattttaattgat

SEQ ID NO: 3905464 - DNA, 11 bp, Homo sapiens
taactggctgt

SEQ ID NO: 3905465 - DNA, 13 bp, Homo sapiens
taactgtaaatca

SEQ ID NO: 3905466 - DNA, 16 bp, Homo sapiens
taactgtaaatcactt

SEQ ID NO: 3905467 - DNA, 19 bp, Homo sapiens
taactgtaaatcacttgta

SEQ ID NO: 3905468 - DNA, 14 bp, Homo sapiens
taatcagcctctta

SEQ ID NO: 3905469 - DNA, 12 bp, Homo sapiens
taatcaggcagc

SEQ ID NO: 3905470 - DNA, 19 bp, Homo sapiens
taatcaggtcctcagagaa

SEQ ID NO: 3905471 - DNA, 20 bp, Homo sapiens
taatcaggttgttaatgttg

SEQ ID NO: 3905472 - DNA, 13 bp, Homo sapiens
taatcccagcact

SEQ ID NO: 3905473 - DNA, 20 bp, Homo sapiens
taatcccagctactcaggag

SEQ ID NO: 3905474 - DNA, 22 bp, Homo sapiens
taatcggcccacagctcccacc

SEQ ID NO: 3905475 - DNA, 21 bp, Homo sapiens
taatctctaaatcaagtattt

SEQ ID NO: 3905476 - DNA, 15 bp, Homo sapiens
taatctggactcctc

SEQ ID NO: 3905477 - DNA, 22 bp, Homo sapiens
taatctggactcctctgtccag

SEQ ID NO: 3905478 - DNA, 16 bp, Homo sapiens
taatctgtagggctgg

SEQ ID NO: 3905479 - DNA, 22 bp, Homo sapiens
taatgaagggaaaggatatttt

SEQ ID NO: 3905480 - DNA, 20 bp, Homo sapiens
taatgacacggtaggccaag

SEQ ID NO: 3905481 - DNA, 18 bp, Homo sapiens
taatgactttttataatg

SEQ ID NO: 3905482 - DNA, 13 bp, Homo sapiens
taatgcaaattaa

SEQ ID NO: 3905483 - DNA, 20 bp, Homo sapiens
taatgcatgtggtatgagta

SEQ ID NO: 3905484 - DNA, 14 bp, Homo sapiens
taatgctgttgcct

SEQ ID NO: 3905485 - DNA, 17 bp, Homo sapiens
taatgctgttgcctcat

SEQ ID NO: 3905486 - DNA, 18 bp, Homo sapiens
taatggaaacatttacaa

SEQ ID NO: 3905487 - DNA, 14 bp, Homo sapiens
taatggaagagaaa

SEQ ID NO: 3905488 - DNA, 17 bp, Homo sapiens
taatggaagagaaatct

SEQ ID NO: 3905489 - DNA, 12 bp, Homo sapiens
taatggagaaga

SEQ ID NO: 3905490 - DNA, 18 bp, Homo sapiens
taatgggccaattaaaat

SEQ ID NO: 3905491 - DNA, 19 bp, Homo sapiens
taatgggccaattaaaata

SEQ ID NO: 3905492 - DNA, 13 bp, Homo sapiens
taatggtctaaaa

SEQ ID NO: 3905493 - DNA, 22 bp, Homo sapiens
taatggtttttatttctcgggt

SEQ ID NO: 3905494 - DNA, 22 bp, Homo sapiens
taatgtaagggtctgttgtaaa

SEQ ID NO: 3905495 - DNA, 16 bp, Homo sapiens
taatgtacaagttttg

SEQ ID NO: 3905496 - DNA, 18 bp, Homo sapiens
taatgtacaagttttgta

SEQ ID NO: 3905497 - DNA, 20 bp, Homo sapiens
taatgtaggtttagatatat

SEQ ID NO: 3905498 - DNA, 15 bp, Homo sapiens
taatgtcaccacctt

SEQ ID NO: 3905499 - DNA, 19 bp, Homo sapiens
taatgtgccccatgtccaa

SEQ ID NO: 3905500 - DNA, 17 bp, Homo sapiens
taatgtggatttcctat

SEQ ID NO: 3905501 - DNA, 15 bp, Homo sapiens
taatgtgtgtatgtg

SEQ ID NO: 3905502 - DNA, 16 bp, Homo sapiens
taatgtgtgtatgtgt

SEQ ID NO: 3905503 - DNA, 19 bp, Homo sapiens
taatgtgtgtatgtgtatt

SEQ ID NO: 3905504 - DNA, 22 bp, Homo sapiens
taatgttctctgggtaggtgtt

SEQ ID NO: 3905505 - DNA, 20 bp, Homo sapiens
taatgttgggatttatatct

SEQ ID NO: 3905506 - DNA, 21 bp, Homo sapiens
taatgttgggatttatatcta

SEQ ID NO: 3905507 - DNA, 12 bp, Homo sapiens
taatgttttgta

SEQ ID NO: 3905508 - DNA, 14 bp, Homo sapiens
taatgttttgtaca

SEQ ID NO: 3905509 - DNA, 17 bp, Homo sapiens
taatgttttgtacaatt

SEQ ID NO: 3905510 - DNA, 17 bp, Homo sapiens
taattaactatgtgatg

SEQ ID NO: 3905511 - DNA, 12 bp, Homo sapiens
taattaagtaaa

SEQ ID NO: 3905512 - DNA, 23 bp, Homo sapiens
taattaatgtgtgtctgaagact

SEQ ID NO: 3905513 - DNA, 20 bp, Homo sapiens
taattagaacaatagctatt

SEQ ID NO: 3905514 - DNA, 16 bp, Homo sapiens
taattaggttaacatt

SEQ ID NO: 3905515 - DNA, 16 bp, Homo sapiens
taattcataattagaa

SEQ ID NO: 3905516 - DNA, 21 bp, Homo sapiens
taattcataattagaacaata

SEQ ID NO: 3905517 - DNA, 12 bp, Homo sapiens
taattcttaata

SEQ ID NO: 3905518 - DNA, 19 bp, Homo sapiens
taattcttaataggcttta

SEQ ID NO: 3905519 - DNA, 19 bp, Homo sapiens
taattgatcaaattcattt

SEQ ID NO: 3905520 - DNA, 18 bp, Homo sapiens
taattgcttaaaagacat

SEQ ID NO: 3905521 - DNA, 15 bp, Homo sapiens
taattggaattctgg

SEQ ID NO: 3905522 - DNA, 19 bp, Homo sapiens
taatttaaaccagcagaaa

SEQ ID NO: 3905523 - DNA, 21 bp, Homo sapiens
taatttaaaccagcagaaaag

SEQ ID NO: 3905524 - DNA, 21 bp, Homo sapiens
taatttaactaatttaaacca

SEQ ID NO: 3905525 - DNA, 21 bp, Homo sapiens
taatttataaaagaataaaat

SEQ ID NO: 3905526 - DNA, 14 bp, Homo sapiens
taatttatacaaaa

SEQ ID NO: 3905527 - DNA, 18 bp, Homo sapiens
taatttatatttgaaatt

SEQ ID NO: 3905528 - DNA, 13 bp, Homo sapiens
taatttatggttt

SEQ ID NO: 3905529 - DNA, 15 bp, Homo sapiens
taatttatttcatcc

SEQ ID NO: 3905530 - DNA, 12 bp, Homo sapiens
taatttgagaat

SEQ ID NO: 3905531 - DNA, 13 bp, Homo sapiens
taatttgagaatt

SEQ ID NO: 3905532 - DNA, 21 bp, Homo sapiens
taatttgtacatatgtaaaat

SEQ ID NO: 3905533 - DNA, 22 bp, Homo sapiens
taattttcaagagaagaaaaaa

SEQ ID NO: 3905534 - DNA, 22 bp, Homo sapiens
taatttttacatgaccagaaaa

SEQ ID NO: 3905535 - DNA, 22 bp, Homo sapiens
taattttttttttccttttaaa

SEQ ID NO: 3905536 - DNA, 13 bp, Homo sapiens
tacaaaaacaaaa

SEQ ID NO: 3905537 - DNA, 13 bp, Homo sapiens
tacaaaaacacag

SEQ ID NO: 3905538 - DNA, 16 bp, Homo sapiens
tacaaaaacacagcaa

SEQ ID NO: 3905539 - DNA, 17 bp, Homo sapiens
tacaaaaacacagcaag

SEQ ID NO: 3905540 - DNA, 18 bp, Homo sapiens
tacaaaataaaattatgg

SEQ ID NO: 3905541 - DNA, 19 bp, Homo sapiens
tacaaaataaacaaataac

SEQ ID NO: 3905542 - DNA, 16 bp, Homo sapiens
tacaaaataatttaac

SEQ ID NO: 3905543 - DNA, 17 bp, Homo sapiens
tacaaagctgaagaaaa

SEQ ID NO: 3905544 - DNA, 15 bp, Homo sapiens
tacaacaagaacaac

SEQ ID NO: 3905545 - DNA, 19 bp, Homo sapiens
tacaacaagagtttatttc

SEQ ID NO: 3905546 - DNA, 13 bp, Homo sapiens
tacaaccagagcc

SEQ ID NO: 3905547 - DNA, 15 bp, Homo sapiens
tacaaccagagcccc

SEQ ID NO: 3905548 - DNA, 17 bp, Homo sapiens
tacaagaattgtccatg

SEQ ID NO: 3905549 - DNA, 21 bp, Homo sapiens
tacaagcatttgccctgtgga

SEQ ID NO: 3905550 - DNA, 16 bp, Homo sapiens
tacaaggatcagaatg

SEQ ID NO: 3905551 - DNA, 13 bp, Homo sapiens
tacaagtgtatat

SEQ ID NO: 3905552 - DNA, 21 bp, Homo sapiens
tacaagtgtatatcagaaaag

SEQ ID NO: 3905553 - DNA, 16 bp, Homo sapiens
tacaataaataatctg

SEQ ID NO: 3905554 - DNA, 13 bp, Homo sapiens
tacaataacataa

SEQ ID NO: 3905555 - DNA, 16 bp, Homo sapiens
tacattttatttatta

SEQ ID NO: 3905556 - DNA, 18 bp, Homo sapiens
taccaaatagcttctgtt

SEQ ID NO: 3905557 - DNA, 16 bp, Homo sapiens
taccaaatataaactt

SEQ ID NO: 3905558 - DNA, 23 bp, Homo sapiens
taccaaatataaacttgtgtatg

SEQ ID NO: 3905559 - DNA, 13 bp, Homo sapiens
taccaactttctg

SEQ ID NO: 3905560 - DNA, 16 bp, Homo sapiens
taccaaggcccagcta

SEQ ID NO: 3905561 - DNA, 11 bp, Homo sapiens
taccaatgcat

SEQ ID NO: 3905562 - DNA, 12 bp, Homo sapiens
taccaatgcatg

SEQ ID NO: 3905563 - DNA, 13 bp, Homo sapiens
taccaatgcatgc

SEQ ID NO: 3905564 - DNA, 16 bp, Homo sapiens
taccaccccttcctgt

SEQ ID NO: 3905565 - DNA, 13 bp, Homo sapiens
taccaccttccct

SEQ ID NO: 3905566 - DNA, 16 bp, Homo sapiens
taccagatatttgaat

SEQ ID NO: 3905567 - DNA, 15 bp, Homo sapiens
taccagatcactcaa

SEQ ID NO: 3905568 - DNA, 16 bp, Homo sapiens
taccagtgaaccaaag

SEQ ID NO: 3905569 - DNA, 20 bp, Homo sapiens
taccataagggactgtgcca

SEQ ID NO: 3905570 - DNA, 14 bp, Homo sapiens
taccatagaacaga

SEQ ID NO: 3905571 - DNA, 18 bp, Homo sapiens
taccatatgtctgcttct

SEQ ID NO: 3905572 - DNA, 16 bp, Homo sapiens
taccatgccatttaaa

SEQ ID NO: 3905573 - DNA, 13 bp, Homo sapiens
taccatgctgctt

SEQ ID NO: 3905574 - DNA, 15 bp, Homo sapiens
taccatttcagagag

SEQ ID NO: 3905575 - DNA, 16 bp, Homo sapiens
taccatttcagagagg

SEQ ID NO: 3905576 - DNA, 13 bp, Homo sapiens
tacccaaccactc

SEQ ID NO: 3905577 - DNA, 21 bp, Homo sapiens
tacccaaccactcaaattaat

SEQ ID NO: 3905578 - DNA, 20 bp, Homo sapiens
tacccaccgggccactcctt

SEQ ID NO: 3905579 - DNA, 15 bp, Homo sapiens
tacccagagaatata

SEQ ID NO: 3905580 - DNA, 20 bp, Homo sapiens
tacccagagaatatatacat

SEQ ID NO: 3905581 - DNA, 13 bp, Homo sapiens
tacccagagcatt

SEQ ID NO: 3905582 - DNA, 16 bp, Homo sapiens
taccccaagtccacct

SEQ ID NO: 3905583 - DNA, 17 bp, Homo sapiens
taccccacctcatgcct

SEQ ID NO: 3905584 - DNA, 18 bp, Homo sapiens
taccccacctcatgcctg

SEQ ID NO: 3905585 - DNA, 14 bp, Homo sapiens
tacccccagagacc

SEQ ID NO: 3905586 - DNA, 15 bp, Homo sapiens
tacccccagagacct

SEQ ID NO: 3905587 - DNA, 13 bp, Homo sapiens
tacccgagcccag

SEQ ID NO: 3905588 - DNA, 14 bp, Homo sapiens
taccctccagagtg

SEQ ID NO: 3905589 - DNA, 21 bp, Homo sapiens
tacccttctttaaatcaaaag

SEQ ID NO: 3905590 - DNA, 21 bp, Homo sapiens
taccgagtctcttctccactg

SEQ ID NO: 3905591 - DNA, 12 bp, Homo sapiens
taccgctgggga

SEQ ID NO: 3905592 - DNA, 22 bp, Homo sapiens
tacctacataggcaaattggaa

SEQ ID NO: 3905593 - DNA, 16 bp, Homo sapiens
tacctaccaccttccc

SEQ ID NO: 3905594 - DNA, 14 bp, Homo sapiens
tacctatgtgacag

SEQ ID NO: 3905595 - DNA, 19 bp, Homo sapiens
tacctcattcgcctgtggg

SEQ ID NO: 3905596 - DNA, 11 bp, Homo sapiens
tacctcctgcc

SEQ ID NO: 3905597 - DNA, 16 bp, Homo sapiens
tacctcctgcccagga

SEQ ID NO: 3905598 - DNA, 15 bp, Homo sapiens
tacctcgaggctctt

SEQ ID NO: 3905599 - DNA, 19 bp, Homo sapiens
tacctctttattttttgat

SEQ ID NO: 3905600 - DNA, 21 bp, Homo sapiens
tacctgaggcctatctgagac

SEQ ID NO: 3905601 - DNA, 21 bp, Homo sapiens
tacctgcatgtgttgtacaat

SEQ ID NO: 3905602 - DNA, 16 bp, Homo sapiens
tacctgccctctctca

SEQ ID NO: 3905603 - DNA, 13 bp, Homo sapiens
tacctgctgctgc

SEQ ID NO: 3905604 - DNA, 19 bp, Homo sapiens
tacctgggaaaggacccac

SEQ ID NO: 3905605 - DNA, 12 bp, Homo sapiens
tacctgtgcctg

SEQ ID NO: 3905606 - DNA, 16 bp, Homo sapiens
taccttagattagctc

SEQ ID NO: 3905607 - DNA, 20 bp, Homo sapiens
taccttagattagctctgga

SEQ ID NO: 3905608 - DNA, 18 bp, Homo sapiens
taccttccttaagccagg

SEQ ID NO: 3905609 - DNA, 22 bp, Homo sapiens
taccttctcaaaagattgtttt

SEQ ID NO: 3905610 - DNA, 15 bp, Homo sapiens
taccttcttcgctgc

SEQ ID NO: 3905611 - DNA, 15 bp, Homo sapiens
taccttgaccatcgt

SEQ ID NO: 3905612 - DNA, 15 bp, Homo sapiens
tacctttaaaatcat

SEQ ID NO: 3905613 - DNA, 16 bp, Homo sapiens
tacctttacataattg

SEQ ID NO: 3905614 - DNA, 16 bp, Homo sapiens
tacctttcccatgctg

SEQ ID NO: 3905615 - DNA, 19 bp, Homo sapiens
tacctttcccatgctgaat

SEQ ID NO: 3905616 - DNA, 22 bp, Homo sapiens
tacctttggaaaaatcttgggc

SEQ ID NO: 3905617 - DNA, 23 bp, Homo sapiens
tacctttgttcccaaatttcata

SEQ ID NO: 3905618 - DNA, 16 bp, Homo sapiens
taccttttctgttgta

SEQ ID NO: 3905619 - DNA, 21 bp, Homo sapiens
tacgccaaagtgcagcccttc

SEQ ID NO: 3905620 - DNA, 13 bp, Homo sapiens
tacgctctccttt

SEQ ID NO: 3905621 - DNA, 19 bp, Homo sapiens
tacgctctcctttctttct

SEQ ID NO: 3905622 - DNA, 20 bp, Homo sapiens
tacggagggaggacatcata

SEQ ID NO: 3905623 - DNA, 17 bp, Homo sapiens
tacgtataaatatgaaa

SEQ ID NO: 3905624 - DNA, 14 bp, Homo sapiens
tacgttatatattg

SEQ ID NO: 3905625 - DNA, 20 bp, Homo sapiens
tacgttctccagcccacacc

SEQ ID NO: 3905626 - DNA, 21 bp, Homo sapiens
tactacagttgttttttgaaa

SEQ ID NO: 3905627 - DNA, 23 bp, Homo sapiens
tactacagttgttttttgaaaac

SEQ ID NO: 3905628 - DNA, 15 bp, Homo sapiens
tactacccgagccca

SEQ ID NO: 3905629 - DNA, 16 bp, Homo sapiens
tactacttcttggaaa

SEQ ID NO: 3905630 - DNA, 20 bp, Homo sapiens
tactacttcttggaaaaaaa

SEQ ID NO: 3905631 - DNA, 22 bp, Homo sapiens
tactacttgttacctttcccat

SEQ ID NO: 3905632 - DNA, 13 bp, Homo sapiens
tactactttgtgt

SEQ ID NO: 3905633 - DNA, 20 bp, Homo sapiens
tactacttttgcatgaaaat

SEQ ID NO: 3905634 - DNA, 20 bp, Homo sapiens
tactagcttttcaaacaaga

SEQ ID NO: 3905635 - DNA, 22 bp, Homo sapiens
tactagttttccttgaaaaaaa

SEQ ID NO: 3905636 - DNA, 14 bp, Homo sapiens
tactatctgtgaag

SEQ ID NO: 3905637 - DNA, 13 bp, Homo sapiens
tactcacctcctc

SEQ ID NO: 3905638 - DNA, 18 bp, Homo sapiens
tactcacctctctctaag

SEQ ID NO: 3905639 - DNA, 14 bp, Homo sapiens
tactcagcagccct

SEQ ID NO: 3905640 - DNA, 16 bp, Homo sapiens
tactcagcagccctcc

SEQ ID NO: 3905641 - DNA, 18 bp, Homo sapiens
tactcagcagccctcctc

SEQ ID NO: 3905642 - DNA, 16 bp, Homo sapiens
tagaaattgttcctga

SEQ ID NO: 3905643 - DNA, 13 bp, Homo sapiens
tagaacaatagct

SEQ ID NO: 3905644 - DNA, 22 bp, Homo sapiens
tagaacaatagctattgcatgt

SEQ ID NO: 3905645 - DNA, 15 bp, Homo sapiens
tagaacacccactgg

SEQ ID NO: 3905646 - DNA, 17 bp, Homo sapiens
tagaacacccactggcc

SEQ ID NO: 3905647 - DNA, 19 bp, Homo sapiens
tagaacacccactggccag

SEQ ID NO: 3905648 - DNA, 17 bp, Homo sapiens
tagaacacccctgtgca

SEQ ID NO: 3905649 - DNA, 18 bp, Homo sapiens
tagaaccaagcttcagag

SEQ ID NO: 3905650 - DNA, 21 bp, Homo sapiens
tagaaccaagcttcagagcct

SEQ ID NO: 3905651 - DNA, 16 bp, Homo sapiens
tagaacctggaagggc

SEQ ID NO: 3905652 - DNA, 22 bp, Homo sapiens
tagaacctggagagctagaacc

SEQ ID NO: 3905653 - DNA, 13 bp, Homo sapiens
tagaacctggagg

SEQ ID NO: 3905654 - DNA, 22 bp, Homo sapiens
tagaacttcaaaatgttcgtat

SEQ ID NO: 3905655 - DNA, 23 bp, Homo sapiens
tagaacttcaagaagtaagagct

SEQ ID NO: 3905656 - DNA, 22 bp, Homo sapiens
tagaagaacatccaaggagaaa

SEQ ID NO: 3905657 - DNA, 10 bp, Homo sapiens
tagaagccag

SEQ ID NO: 3905658 - DNA, 16 bp, Homo sapiens
tagaagtgggccagga

SEQ ID NO: 3905659 - DNA, 12 bp, Homo sapiens
tagaatgaaaat

SEQ ID NO: 3905660 - DNA, 22 bp, Homo sapiens
tagaatgcacaccaaaaaaata

SEQ ID NO: 3905661 - DNA, 19 bp, Homo sapiens
tagaatgcatgtaaggtct

SEQ ID NO: 3905662 - DNA, 20 bp, Homo sapiens
tagaatgtgttttctgaata

SEQ ID NO: 3905663 - DNA, 19 bp, Homo sapiens
tagaattatatctaattta

SEQ ID NO: 3905664 - DNA, 17 bp, Homo sapiens
tagaattttagaagaga

SEQ ID NO: 3905665 - DNA, 18 bp, Homo sapiens
tagacaactcttccattt

SEQ ID NO: 3905666 - DNA, 22 bp, Homo sapiens
tagacaactggtccactcaggg

SEQ ID NO: 3905667 - DNA, 18 bp, Homo sapiens
tagacacccattttcaca

SEQ ID NO: 3905668 - DNA, 19 bp, Homo sapiens
tagactatatacatgtgtg

SEQ ID NO: 3905669 - DNA, 20 bp, Homo sapiens
tagactatatacatgtgtgt

SEQ ID NO: 3905670 - DNA, 15 bp, Homo sapiens
tagactcctgcttct

SEQ ID NO: 3905671 - DNA, 16 bp, Homo sapiens
tagactcctgcttctt

SEQ ID NO: 3905672 - DNA, 17 bp, Homo sapiens
tagactggagtgaggct

SEQ ID NO: 3905673 - DNA, 23 bp, Homo sapiens
tagactggagtgaggcttccagg

SEQ ID NO: 3905674 - DNA, 20 bp, Homo sapiens
tagacttcgactcaggatcc

SEQ ID NO: 3905675 - DNA, 22 bp, Homo sapiens
tagacttcgactcaggatccag

SEQ ID NO: 3905676 - DNA, 20 bp, Homo sapiens
tagagaagccggctcttcaa

SEQ ID NO: 3905677 - DNA, 19 bp, Homo sapiens
tagagacggggtttcacca

SEQ ID NO: 3905678 - DNA, 17 bp, Homo sapiens
tagagagcagaaataaa

SEQ ID NO: 3905679 - DNA, 13 bp, Homo sapiens
tagagagggggct

SEQ ID NO: 3905680 - DNA, 17 bp, Homo sapiens
tagagaggtagcgagct

SEQ ID NO: 3905681 - DNA, 20 bp, Homo sapiens
tagagcacctagtccagtga

SEQ ID NO: 3905682 - DNA, 12 bp, Homo sapiens
tagagcagccca

SEQ ID NO: 3905683 - DNA, 19 bp, Homo sapiens
tagagccccccgtgtggct

SEQ ID NO: 3905684 - DNA, 12 bp, Homo sapiens
tagagctcctgt

SEQ ID NO: 3905685 - DNA, 17 bp, Homo sapiens
tagagctcctgtcccta

SEQ ID NO: 3905686 - DNA, 18 bp, Homo sapiens
tagagctcctgtccctac

SEQ ID NO: 3905687 - DNA, 19 bp, Homo sapiens
tagagctcctgtccctacc

SEQ ID NO: 3905688 - DNA, 12 bp, Homo sapiens
tagagctgggaa

SEQ ID NO: 3905689 - DNA, 22 bp, Homo sapiens
tagaggaaaaaaatgactaaaa

SEQ ID NO: 3905690 - DNA, 23 bp, Homo sapiens
tagaggtaccagcaatatgtaaa

SEQ ID NO: 3905691 - DNA, 14 bp, Homo sapiens
tagaggtgggcagc

SEQ ID NO: 3905692 - DNA, 19 bp, Homo sapiens
tagaggtgggcagctgggc

SEQ ID NO: 3905693 - DNA, 22 bp, Homo sapiens
tagatagttaaaagactgcagc

SEQ ID NO: 3905694 - DNA, 19 bp, Homo sapiens
tagatcccatgtcacctca

SEQ ID NO: 3905695 - DNA, 19 bp, Homo sapiens
tagatcgcttgagcccagg

SEQ ID NO: 3905696 - DNA, 22 bp, Homo sapiens
tagatctcctatttttcagaat

SEQ ID NO: 3905697 - DNA, 21 bp, Homo sapiens
tagatgagattgttttatcat

SEQ ID NO: 3905698 - DNA, 14 bp, Homo sapiens
tagatgctgactgt

SEQ ID NO: 3905699 - DNA, 18 bp, Homo sapiens
tagatggaccagtagaca

SEQ ID NO: 3905700 - DNA, 16 bp, Homo sapiens
tagatgggtctggctg

SEQ ID NO: 3905701 - DNA, 15 bp, Homo sapiens
tagatgtatcattaa

SEQ ID NO: 3905702 - DNA, 20 bp, Homo sapiens
tagatgtgcaagtcttgtca

SEQ ID NO: 3905703 - DNA, 15 bp, Homo sapiens
tagattaatggcact

SEQ ID NO: 3905704 - DNA, 17 bp, Homo sapiens
tagattaatggcactga

SEQ ID NO: 3905705 - DNA, 18 bp, Homo sapiens
tagattaatggcactgat

SEQ ID NO: 3905706 - DNA, 18 bp, Homo sapiens
tagattagctctggacca

SEQ ID NO: 3905707 - DNA, 21 bp, Homo sapiens
tagattcctcttgcctctctc

SEQ ID NO: 3905708 - DNA, 23 bp, Homo sapiens
tagattcctcttgcctctctcag

SEQ ID NO: 3905709 - DNA, 19 bp, Homo sapiens
tagattctccaaatgattt

SEQ ID NO: 3905710 - DNA, 21 bp, Homo sapiens
tagattgagaagttttgtaca

SEQ ID NO: 3905711 - DNA, 16 bp, Homo sapiens
tagcaagacctgttgg

SEQ ID NO: 3905712 - DNA, 24 bp, Homo sapiens
tagcaagattgcttaaaatagcaa

SEQ ID NO: 3905713 - DNA, 21 bp, Homo sapiens
tagcaagttctagagaagagg

SEQ ID NO: 3905714 - DNA, 18 bp, Homo sapiens
tagcacaaactttaaatt

SEQ ID NO: 3905715 - DNA, 20 bp, Homo sapiens
tagcactgggaactctggct

SEQ ID NO: 3905716 - DNA, 17 bp, Homo sapiens
tagcagcaaaaatataa

SEQ ID NO: 3905717 - DNA, 22 bp, Homo sapiens
tagcatcttctggagtctccag

SEQ ID NO: 3905718 - DNA, 23 bp, Homo sapiens
tagcatcttctggagtctccagt

SEQ ID NO: 3905719 - DNA, 14 bp, Homo sapiens
tagcattgaacatt

SEQ ID NO: 3905720 - DNA, 19 bp, Homo sapiens
tagcattgaacatttctta

SEQ ID NO: 3905721 - DNA, 16 bp, Homo sapiens
tagccaactcctcctt

SEQ ID NO: 3905722 - DNA, 13 bp, Homo sapiens
tagccacctccca

SEQ ID NO: 3905723 - DNA, 20 bp, Homo sapiens
tagccacctcccaccccact

SEQ ID NO: 3905724 - DNA, 17 bp, Homo sapiens
tagccagagaggagcac

SEQ ID NO: 3905725 - DNA, 19 bp, Homo sapiens
tagccagagaggagcacct

SEQ ID NO: 3905726 - DNA, 20 bp, Homo sapiens
tagccagagggtgggagcct

SEQ ID NO: 3905727 - DNA, 18 bp, Homo sapiens
tagccaggagtctgtgct

SEQ ID NO: 3905728 - DNA, 15 bp, Homo sapiens
tagggaagcagggac

SEQ ID NO: 3905729 - DNA, 21 bp, Homo sapiens
tagggaatatgtaagtcagga

SEQ ID NO: 3905730 - DNA, 13 bp, Homo sapiens
tagggacttaaaa

SEQ ID NO: 3905731 - DNA, 23 bp, Homo sapiens
tagggccagctcacaagcccagg

SEQ ID NO: 3905732 - DNA, 14 bp, Homo sapiens
tagggctggaccta

SEQ ID NO: 3905733 - DNA, 17 bp, Homo sapiens
taggggagtgtgggtga

SEQ ID NO: 3905734 - DNA, 17 bp, Homo sapiens
taggggtcaggctccat

SEQ ID NO: 3905735 - DNA, 21 bp, Homo sapiens
taggggtccacgggaagcctc

SEQ ID NO: 3905736 - DNA, 15 bp, Homo sapiens
tagggtaaggtgcct

SEQ ID NO: 3905737 - DNA, 11 bp, Homo sapiens
taggtaaatct

SEQ ID NO: 3905738 - DNA, 18 bp, Homo sapiens
taggtattaaagatgtgt

SEQ ID NO: 3905739 - DNA, 15 bp, Homo sapiens
taggtccaagggcca

SEQ ID NO: 3905740 - DNA, 15 bp, Homo sapiens
taggtgccaggctgt

SEQ ID NO: 3905741 - DNA, 20 bp, Homo sapiens
taggtgctacaaaaacacag

SEQ ID NO: 3905742 - DNA, 22 bp, Homo sapiens
taggtgctacaaaaacacagca

SEQ ID NO: 3905743 - DNA, 20 bp, Homo sapiens
taggtggtgttgagaaagaa

SEQ ID NO: 3905744 - DNA, 15 bp, Homo sapiens
taggtttttttgtat

SEQ ID NO: 3905745 - DNA, 22 bp, Homo sapiens
tagtaactactttttatactcc

SEQ ID NO: 3905746 - DNA, 19 bp, Homo sapiens
tagtaagcctccctcctcg

SEQ ID NO: 3905747 - DNA, 20 bp, Homo sapiens
tagtaatagtccaatatttg

SEQ ID NO: 3905748 - DNA, 16 bp, Homo sapiens
tagtaatgggccaatt

SEQ ID NO: 3905749 - DNA, 22 bp, Homo sapiens
tagtaatgggccaattaaaata

SEQ ID NO: 3905750 - DNA, 23 bp, Homo sapiens
tagtaatgggccaattaaaatat

SEQ ID NO: 3905751 - DNA, 21 bp, Homo sapiens
tagtacagtagcttaaataaa

SEQ ID NO: 3905752 - DNA, 23 bp, Homo sapiens
tagtacagtagcttaaataaatt

SEQ ID NO: 3905753 - DNA, 22 bp, Homo sapiens
tagtaccctatagagagggggc

SEQ ID NO: 3905754 - DNA, 22 bp, Homo sapiens
tagtagtcaattagtacagtag

SEQ ID NO: 3905755 - DNA, 23 bp, Homo sapiens
tagtagtcaattagtacagtagc

SEQ ID NO: 3905756 - DNA, 14 bp, Homo sapiens
tagtataccataca

SEQ ID NO: 3905757 - DNA, 13 bp, Homo sapiens
tagtatatttata

SEQ ID NO: 3905758 - DNA, 14 bp, Homo sapiens
tagtatcttttaaa

SEQ ID NO: 3905759 - DNA, 15 bp, Homo sapiens
tagtatggttctcag

SEQ ID NO: 3905760 - DNA, 19 bp, Homo sapiens
tagtcagaagcaggttctt

SEQ ID NO: 3905761 - DNA, 22 bp, Homo sapiens
tagtcagaagcaggttcttgat

SEQ ID NO: 3905762 - DNA, 21 bp, Homo sapiens
tagtcatagaaatacctcatt

SEQ ID NO: 3905763 - DNA, 19 bp, Homo sapiens
tagtcatttattttaaaaa

SEQ ID NO: 3905764 - DNA, 17 bp, Homo sapiens
tagtccttggtctgctg

SEQ ID NO: 3905765 - DNA, 18 bp, Homo sapiens
tagtctcctttgcactga

SEQ ID NO: 3905766 - DNA, 21 bp, Homo sapiens
tagtctcctttgcactgaggg

SEQ ID NO: 3905767 - DNA, 17 bp, Homo sapiens
tagtctgtgtgcacaat

SEQ ID NO: 3905768 - DNA, 17 bp, Homo sapiens
tagtcttgctttgctgt

SEQ ID NO: 3905769 - DNA, 15 bp, Homo sapiens
tagtgacccacatgc

SEQ ID NO: 3905770 - DNA, 14 bp, Homo sapiens
tagtgatggttccc

SEQ ID NO: 3905771 - DNA, 14 bp, Homo sapiens
tagtgcccgcctag

SEQ ID NO: 3905772 - DNA, 21 bp, Homo sapiens
tagtgctattctgtgttgaac

SEQ ID NO: 3905773 - DNA, 21 bp, Homo sapiens
tagtggaagagcagcctgatg

SEQ ID NO: 3905774 - DNA, 14 bp, Homo sapiens
tagtggcttcaaaa

SEQ ID NO: 3905775 - DNA, 16 bp, Homo sapiens
tagtggggtaattctg

SEQ ID NO: 3905776 - DNA, 18 bp, Homo sapiens
tagtggggtctccctctc

SEQ ID NO: 3905777 - DNA, 23 bp, Homo sapiens
tagtggggtctccctctcctgcc

SEQ ID NO: 3905778 - DNA, 19 bp, Homo sapiens
tagtgtaaaataagaatga

SEQ ID NO: 3905779 - DNA, 22 bp, Homo sapiens
tagtgtaaaataagaatgattt

SEQ ID NO: 3905780 - DNA, 17 bp, Homo sapiens
tagtgtgagtggcagcc

SEQ ID NO: 3905781 - DNA, 13 bp, Homo sapiens
tagtgtgtcagag

SEQ ID NO: 3905782 - DNA, 19 bp, Homo sapiens
tagtgtgtgtgcatgtgtg

SEQ ID NO: 3905783 - DNA, 23 bp, Homo sapiens
tagttaaaagactgcagctgctg

SEQ ID NO: 3905784 - DNA, 15 bp, Homo sapiens
tagttagccctcagt

SEQ ID NO: 3905785 - DNA, 20 bp, Homo sapiens
tagttaggatagcatttttg

SEQ ID NO: 3905786 - DNA, 20 bp, Homo sapiens
tagttaggtgtgccaaacta

SEQ ID NO: 3905787 - DNA, 15 bp, Homo sapiens
tagttatagtttcag

SEQ ID NO: 3905788 - DNA, 16 bp, Homo sapiens
tagttatagtttcaga

SEQ ID NO: 3905789 - DNA, 15 bp, Homo sapiens
tagttgaaaaatcta

SEQ ID NO: 3905790 - DNA, 15 bp, Homo sapiens
tagttggtgttcaaa

SEQ ID NO: 3905791 - DNA, 21 bp, Homo sapiens
tagtttacttcctaaatttca

SEQ ID NO: 3905792 - DNA, 14 bp, Homo sapiens
tagtttattttgtt

SEQ ID NO: 3905793 - DNA, 17 bp, Homo sapiens
tagtttcagtaaataat

SEQ ID NO: 3905794 - DNA, 16 bp, Homo sapiens
tagtttctagaggcct

SEQ ID NO: 3905795 - DNA, 18 bp, Homo sapiens
tagtttgtataacttctt

SEQ ID NO: 3905796 - DNA, 18 bp, Homo sapiens
tagttttatggcatgatt

SEQ ID NO: 3905797 - DNA, 16 bp, Homo sapiens
tagttttctttgtaaa

SEQ ID NO: 3905798 - DNA, 11 bp, Homo sapiens
tataaaaacaa

SEQ ID NO: 3905799 - DNA, 16 bp, Homo sapiens
tataaaaatatatata

SEQ ID NO: 3905800 - DNA, 21 bp, Homo sapiens
tataaaactcagttaaaatgt

SEQ ID NO: 3905801 - DNA, 16 bp, Homo sapiens
tataaaagacaaaact

SEQ ID NO: 3905802 - DNA, 19 bp, Homo sapiens
tataaaatgcaaaataaat

SEQ ID NO: 3905803 - DNA, 17 bp, Homo sapiens
tataaacattaaaagaa

SEQ ID NO: 3905804 - DNA, 16 bp, Homo sapiens
tataaactactgtaat

SEQ ID NO: 3905805 - DNA, 15 bp, Homo sapiens
tataaactagatctc

SEQ ID NO: 3905806 - DNA, 21 bp, Homo sapiens
tataaactttagagtagcatg

SEQ ID NO: 3905807 - DNA, 11 bp, Homo sapiens
tataaatgcat

SEQ ID NO: 3905808 - DNA, 17 bp, Homo sapiens
tataaatgcatgatttt

SEQ ID NO: 3905809 - DNA, 19 bp, Homo sapiens
tataaatgcatgattttat

SEQ ID NO: 3905810 - DNA, 16 bp, Homo sapiens
tataaatgtatataca

SEQ ID NO: 3905811 - DNA, 13 bp, Homo sapiens
tataaatgtgtgg

SEQ ID NO: 3905812 - DNA, 11 bp, Homo sapiens
tataaattaag

SEQ ID NO: 3905813 - DNA, 12 bp, Homo sapiens
tataaccccacc

SEQ ID NO: 3905814 - DNA, 21 bp, Homo sapiens
tatatagtatatttatactct

SEQ ID NO: 3905815 - DNA, 17 bp, Homo sapiens
tatatatacacatacat

SEQ ID NO: 3905816 - DNA, 22 bp, Homo sapiens
tatatatacacatacatacaca

SEQ ID NO: 3905817 - DNA, 15 bp, Homo sapiens
tatatatacatatgt

SEQ ID NO: 3905818 - DNA, 14 bp, Homo sapiens
tatatatataaata

SEQ ID NO: 3905819 - DNA, 16 bp, Homo sapiens
tatatatatacacata

SEQ ID NO: 3905820 - DNA, 14 bp, Homo sapiens
tatatatatagtaa

SEQ ID NO: 3905821 - DNA, 14 bp, Homo sapiens
tatatatatatgtg

SEQ ID NO: 3905822 - DNA, 14 bp, Homo sapiens
tatatatatattta

SEQ ID NO: 3905823 - DNA, 14 bp, Homo sapiens
tatatatatgtata

SEQ ID NO: 3905824 - DNA, 18 bp, Homo sapiens
tatatatgccttatgtaa

SEQ ID NO: 3905825 - DNA, 14 bp, Homo sapiens
tatatatggcatat

SEQ ID NO: 3905826 - DNA, 17 bp, Homo sapiens
tatatatggcatattta

SEQ ID NO: 3905827 - DNA, 23 bp, Homo sapiens
tatatatggcatatttatattgt

SEQ ID NO: 3905828 - DNA, 14 bp, Homo sapiens
tatatatgtatatg

SEQ ID NO: 3905829 - DNA, 20 bp, Homo sapiens
tatatatgtatatgtatata

SEQ ID NO: 3905830 - DNA, 22 bp, Homo sapiens
tatatatgtgtatatatacata

SEQ ID NO: 3905831 - DNA, 20 bp, Homo sapiens
tatatatttttcaaccagca

SEQ ID NO: 3905832 - DNA, 22 bp, Homo sapiens
tatatatttttggttgtcaata

SEQ ID NO: 3905833 - DNA, 21 bp, Homo sapiens
tatatcaaggatgttctggct

SEQ ID NO: 3905834 - DNA, 19 bp, Homo sapiens
tatatcagaatctgtgtga

SEQ ID NO: 3905835 - DNA, 15 bp, Homo sapiens
tatatcagcctgagt

SEQ ID NO: 3905836 - DNA, 14 bp, Homo sapiens
tatatcccagaaat

SEQ ID NO: 3905837 - DNA, 12 bp, Homo sapiens
tatatctaattt

SEQ ID NO: 3905838 - DNA, 15 bp, Homo sapiens
tatatctaatttata

SEQ ID NO: 3905839 - DNA, 18 bp, Homo sapiens
tatatctaatttatacaa

SEQ ID NO: 3905840 - DNA, 20 bp, Homo sapiens
tatatctaatttatacaaaa

SEQ ID NO: 3905841 - DNA, 19 bp, Homo sapiens
tatatctatagtagtcaat

SEQ ID NO: 3905842 - DNA, 19 bp, Homo sapiens
tatatgaggacttgtgtct

SEQ ID NO: 3905843 - DNA, 19 bp, Homo sapiens
tatatgatctaatacaaag

SEQ ID NO: 3905844 - DNA, 23 bp, Homo sapiens
tatatgatctaatacaaagatga

SEQ ID NO: 3905845 - DNA, 15 bp, Homo sapiens
tatatgatttatagt

SEQ ID NO: 3905846 - DNA, 14 bp, Homo sapiens
tatatgtatatgta

SEQ ID NO: 3905847 - DNA, 14 bp, Homo sapiens
tatatgtctgtgtg

SEQ ID NO: 3905848 - DNA, 14 bp, Homo sapiens
tatatgtgtatata

SEQ ID NO: 3905849 - DNA, 17 bp, Homo sapiens
tatatgtgtatatatac

SEQ ID NO: 3905850 - DNA, 13 bp, Homo sapiens
tatatgtgtgtgt

SEQ ID NO: 3905851 - DNA, 19 bp, Homo sapiens
tatatgtgtgtttaaataa

SEQ ID NO: 3905852 - DNA, 15 bp, Homo sapiens
tatatgttgtaataa

SEQ ID NO: 3905853 - DNA, 13 bp, Homo sapiens
tatattaaagtgt

SEQ ID NO: 3905854 - DNA, 17 bp, Homo sapiens
tatattataataatgtt

SEQ ID NO: 3905855 - DNA, 19 bp, Homo sapiens
tatattatggtgtaatgca

SEQ ID NO: 3905856 - DNA, 22 bp, Homo sapiens
tatattatggtgtaatgcacaa

SEQ ID NO: 3905857 - DNA, 24 bp, Homo sapiens
tatattatggtgtaatgcacaatt

SEQ ID NO: 3905858 - DNA, 18 bp, Homo sapiens
tatattccaccattcaca

SEQ ID NO: 3905859 - DNA, 22 bp, Homo sapiens
tatattccgggtgccattccca

SEQ ID NO: 3905860 - DNA, 13 bp, Homo sapiens
tatattgaatata

SEQ ID NO: 3905861 - DNA, 15 bp, Homo sapiens
tatattgaatatatc

SEQ ID NO: 3905862 - DNA, 18 bp, Homo sapiens
tatattggtaacatcctt

SEQ ID NO: 3905863 - DNA, 21 bp, Homo sapiens
tatattggtaacatcctttct

SEQ ID NO: 3905864 - DNA, 14 bp, Homo sapiens
tatattgtatattc

SEQ ID NO: 3905865 - DNA, 17 bp, Homo sapiens
tatattgtatattctgg

SEQ ID NO: 3905866 - DNA, 18 bp, Homo sapiens
tatattgtatattctgga

SEQ ID NO: 3905867 - DNA, 15 bp, Homo sapiens
tatattgtattaagg

SEQ ID NO: 3905868 - DNA, 21 bp, Homo sapiens
tatattgtcctcccctatttt

SEQ ID NO: 3905869 - DNA, 22 bp, Homo sapiens
tatattgtcctcccctatttta

SEQ ID NO: 3905870 - DNA, 21 bp, Homo sapiens
tatatttaaaggggagatact

SEQ ID NO: 3905871 - DNA, 21 bp, Homo sapiens
tatatttagattgttaaaata

SEQ ID NO: 3905872 - DNA, 18 bp, Homo sapiens
tatatttagttatagttt

SEQ ID NO: 3905873 - DNA, 13 bp, Homo sapiens
tatatttatactc

SEQ ID NO: 3905874 - DNA, 18 bp, Homo sapiens
tatatttggaaagagacc

SEQ ID NO: 3905875 - DNA, 24 bp, Homo sapiens
tatattttcatgacttttccatgt

SEQ ID NO: 3905876 - DNA, 13 bp, Homo sapiens
tatatttttatat

SEQ ID NO: 3905877 - DNA, 21 bp, Homo sapiens
tatatttttcaaccagcattt

SEQ ID NO: 3905878 - DNA, 21 bp, Homo sapiens
tatatttttgatggtaagact

SEQ ID NO: 3905879 - DNA, 16 bp, Homo sapiens
tatcaaaacatatcaa

SEQ ID NO: 3905880 - DNA, 20 bp, Homo sapiens
tatcaaaacatatcaattca

SEQ ID NO: 3905881 - DNA, 18 bp, Homo sapiens
tatcaaaataaattgaaa

SEQ ID NO: 3905882 - DNA, 21 bp, Homo sapiens
tatcaaaataaattgaaatat

SEQ ID NO: 3905883 - DNA, 13 bp, Homo sapiens
tatcaatagtcaa

SEQ ID NO: 3905884 - DNA, 16 bp, Homo sapiens
tatcaattcaacacat

SEQ ID NO: 3905885 - DNA, 14 bp, Homo sapiens
tatcacaaatctta

SEQ ID NO: 3905886 - DNA, 20 bp, Homo sapiens
tatcacaaatcttaacttga

SEQ ID NO: 3905887 - DNA, 18 bp, Homo sapiens
tatcacatacaatttgca

SEQ ID NO: 3905888 - DNA, 18 bp, Homo sapiens
tatcacatcaagcatgca

SEQ ID NO: 3905889 - DNA, 21 bp, Homo sapiens
tatcacatcaagcatgcaata

SEQ ID NO: 3905890 - DNA, 22 bp, Homo sapiens
tatcacatcaagcatgcaataa

SEQ ID NO: 3905891 - DNA, 13 bp, Homo sapiens
tatcacccaggct

SEQ ID NO: 3905892 - DNA, 14 bp, Homo sapiens
tatcacccaggctg

SEQ ID NO: 3905893 - DNA, 12 bp, Homo sapiens
tatcagaaaagt

SEQ ID NO: 3905894 - DNA, 16 bp, Homo sapiens
tatcagaaaagtagaa

SEQ ID NO: 3905895 - DNA, 14 bp, Homo sapiens
tatcagaagaccac

SEQ ID NO: 3905896 - DNA, 14 bp, Homo sapiens
tatcagaatctgtg

SEQ ID NO: 3905897 - DNA, 18 bp, Homo sapiens
tatcagacctctgatccc

SEQ ID NO: 3905898 - DNA, 15 bp, Homo sapiens
tatcagagctcttaa

SEQ ID NO: 3905899 - DNA, 13 bp, Homo sapiens
tatcaggcacagg

SEQ ID NO: 3905900 - DNA, 19 bp, Homo sapiens
tatcaggcacaggcaggaa

SEQ ID NO: 3905901 - DNA, 18 bp, Homo sapiens
tatgtaaagtatgtaaac

SEQ ID NO: 3905902 - DNA, 19 bp, Homo sapiens
tatgtaaagtatgtaaaca

SEQ ID NO: 3905903 - DNA, 13 bp, Homo sapiens
tatgtagaaatat

SEQ ID NO: 3905904 - DNA, 17 bp, Homo sapiens
tatgtagactatataca

SEQ ID NO: 3905905 - DNA, 18 bp, Homo sapiens
tatgtagactatatacat

SEQ ID NO: 3905906 - DNA, 18 bp, Homo sapiens
tatgtagcccggccaggg

SEQ ID NO: 3905907 - DNA, 17 bp, Homo sapiens
tatgtagctttatcctt

SEQ ID NO: 3905908 - DNA, 9 bp, Homo sapiens
tatgtatac

SEQ ID NO: 3905909 - DNA, 16 bp, Homo sapiens
tatgtatacacacata

SEQ ID NO: 3905910 - DNA, 22 bp, Homo sapiens
tatgtatacacacatatacata

SEQ ID NO: 3905911 - DNA, 17 bp, Homo sapiens
tatgtatgtttacatat

SEQ ID NO: 3905912 - DNA, 21 bp, Homo sapiens
tatgtattaagccaaacatga

SEQ ID NO: 3905913 - DNA, 21 bp, Homo sapiens
tatgtatttattgtcattact

SEQ ID NO: 3905914 - DNA, 19 bp, Homo sapiens
tatgtcatcatacatgact

SEQ ID NO: 3905915 - DNA, 16 bp, Homo sapiens
tatgtctaaagagctt

SEQ ID NO: 3905916 - DNA, 12 bp, Homo sapiens
tatgtctattta

SEQ ID NO: 3905917 - DNA, 14 bp, Homo sapiens
tatgtctgcttctg

SEQ ID NO: 3905918 - DNA, 22 bp, Homo sapiens
tatgtgaaagtgtaaaatagaa

SEQ ID NO: 3905919 - DNA, 16 bp, Homo sapiens
tatgtgcgtctctctt

SEQ ID NO: 3905920 - DNA, 18 bp, Homo sapiens
tatgtgcgtctctctttc

SEQ ID NO: 3905921 - DNA, 21 bp, Homo sapiens
tatgtggcgtatcatgcaagt

SEQ ID NO: 3905922 - DNA, 14 bp, Homo sapiens
tatgtgtatatata

SEQ ID NO: 3905923 - DNA, 22 bp, Homo sapiens
tatgtgtatatatacatacact

SEQ ID NO: 3905924 - DNA, 17 bp, Homo sapiens
tatgtgtatttgtatgt

SEQ ID NO: 3905925 - DNA, 21 bp, Homo sapiens
tatgtgtgcatgtgtgtataa

SEQ ID NO: 3905926 - DNA, 14 bp, Homo sapiens
tatgtgtgtgtgtg

SEQ ID NO: 3905927 - DNA, 13 bp, Homo sapiens
tatgtgtgtttaa

SEQ ID NO: 3905928 - DNA, 23 bp, Homo sapiens
tatgttctagtgatttcctgtat

SEQ ID NO: 3905929 - DNA, 14 bp, Homo sapiens
tatgtttacatatc

SEQ ID NO: 3905930 - DNA, 14 bp, Homo sapiens
tatgtttgtgcctt

SEQ ID NO: 3905931 - DNA, 12 bp, Homo sapiens
tattaaaactca

SEQ ID NO: 3905932 - DNA, 16 bp, Homo sapiens
tattaaaactcatttt

SEQ ID NO: 3905933 - DNA, 22 bp, Homo sapiens
tattaaaatatggctataaata

SEQ ID NO: 3905934 - DNA, 17 bp, Homo sapiens
tattaaaatgattgtaa

SEQ ID NO: 3905935 - DNA, 19 bp, Homo sapiens
tattaaaatgattgtaaaa

SEQ ID NO: 3905936 - DNA, 17 bp, Homo sapiens
tattaaacttgtcagaa

SEQ ID NO: 3905937 - DNA, 18 bp, Homo sapiens
tattaaacttgtcagaat

SEQ ID NO: 3905938 - DNA, 13 bp, Homo sapiens
tattaaagatgtg

SEQ ID NO: 3905939 - DNA, 16 bp, Homo sapiens
tattaaagatgtgttg

SEQ ID NO: 3905940 - DNA, 18 bp, Homo sapiens
tattaacaaattatgtta

SEQ ID NO: 3905941 - DNA, 21 bp, Homo sapiens
tattaagtctgggatgtagaa

SEQ ID NO: 3905942 - DNA, 20 bp, Homo sapiens
tattaataaattttaacatt

SEQ ID NO: 3905943 - DNA, 16 bp, Homo sapiens
tattaataccaaatat

SEQ ID NO: 3905944 - DNA, 22 bp, Homo sapiens
tattaatattgtgcttaaatta

SEQ ID NO: 3905945 - DNA, 15 bp, Homo sapiens
tattacagtagtgca

SEQ ID NO: 3905946 - DNA, 15 bp, Homo sapiens
tattacatctaatgc

SEQ ID NO: 3905947 - DNA, 19 bp, Homo sapiens
tattaccaaaaaagtattt

SEQ ID NO: 3905948 - DNA, 20 bp, Homo sapiens
tattaccaaaaaagtatttt

SEQ ID NO: 3905949 - DNA, 21 bp, Homo sapiens
tattacttgaactttccaaaa

SEQ ID NO: 3905950 - DNA, 21 bp, Homo sapiens
tattacttgtttgtaagattt

SEQ ID NO: 3905951 - DNA, 22 bp, Homo sapiens
tattagctgtaaatacatgtgt

SEQ ID NO: 3905952 - DNA, 21 bp, Homo sapiens
tattagttaggtgtgccaaac

SEQ ID NO: 3905953 - DNA, 20 bp, Homo sapiens
tattagttttctttgtaaag

SEQ ID NO: 3905954 - DNA, 21 bp, Homo sapiens
tattagttttctttgtaaagg

SEQ ID NO: 3905955 - DNA, 13 bp, Homo sapiens
tattataaataaa

SEQ ID NO: 3905956 - DNA, 17 bp, Homo sapiens
tattataaataaatgcc

SEQ ID NO: 3905957 - DNA, 19 bp, Homo sapiens
tattataaataaatgccaa

SEQ ID NO: 3905958 - DNA, 23 bp, Homo sapiens
tattataatataatatggaacct

SEQ ID NO: 3905959 - DNA, 12 bp, Homo sapiens
tattataattta

SEQ ID NO: 3905960 - DNA, 12 bp, Homo sapiens
tattatgctacc

SEQ ID NO: 3905961 - DNA, 19 bp, Homo sapiens
tattatggtgtaatgcaca

SEQ ID NO: 3905962 - DNA, 20 bp, Homo sapiens
tattatggtgtaatgcacaa

SEQ ID NO: 3905963 - DNA, 11 bp, Homo sapiens
tattattgggg

SEQ ID NO: 3905964 - DNA, 16 bp, Homo sapiens
tattattttctatagc

SEQ ID NO: 3905965 - DNA, 20 bp, Homo sapiens
tattattttctatagctctt

SEQ ID NO: 3905966 - DNA, 17 bp, Homo sapiens
tattattttttccacat

SEQ ID NO: 3905967 - DNA, 23 bp, Homo sapiens
tattcaaacagtctcaggaaatc

SEQ ID NO: 3905968 - DNA, 15 bp, Homo sapiens
tattcaagtgcctct

SEQ ID NO: 3905969 - DNA, 17 bp, Homo sapiens
tattcaagtgcctcttg

SEQ ID NO: 3905970 - DNA, 14 bp, Homo sapiens
tattcaataaagct

SEQ ID NO: 3905971 - DNA, 15 bp, Homo sapiens
tattcactgtaagtt

SEQ ID NO: 3905972 - DNA, 12 bp, Homo sapiens
tattcaggactt

SEQ ID NO: 3905973 - DNA, 18 bp, Homo sapiens
tattcatgctttctcctt

SEQ ID NO: 3905974 - DNA, 19 bp, Homo sapiens
tattcatgtaataaatctg

SEQ ID NO: 3905975 - DNA, 16 bp, Homo sapiens
tattcatttaaaatga

SEQ ID NO: 3905976 - DNA, 17 bp, Homo sapiens
tattccaccattcacat

SEQ ID NO: 3905977 - DNA, 18 bp, Homo sapiens
tattccctgttaaaattt

SEQ ID NO: 3905978 - DNA, 16 bp, Homo sapiens
tattcctgaccctccc

SEQ ID NO: 3905979 - DNA, 17 bp, Homo sapiens
tattcctgaccctccct

SEQ ID NO: 3905980 - DNA, 22 bp, Homo sapiens
tattcctgaccctccctacctg

SEQ ID NO: 3905981 - DNA, 20 bp, Homo sapiens
tattcctgcatttgtgaaat

SEQ ID NO: 3905982 - DNA, 21 bp, Homo sapiens
tattccttttgtgtacagtgt

SEQ ID NO: 3905983 - DNA, 22 bp, Homo sapiens
tattctaaagctttctgacaag

SEQ ID NO: 3905984 - DNA, 14 bp, Homo sapiens
tattctcaccagga

SEQ ID NO: 3905985 - DNA, 16 bp, Homo sapiens
tattctcctccctgtt

SEQ ID NO: 3905986 - DNA, 16 bp, Homo sapiens
tattctcctcctccct

SEQ ID NO: 3905987 - DNA, 14 bp, Homo sapiens
tcaaaacatatcaa

SEQ ID NO: 3905988 - DNA, 18 bp, Homo sapiens
tcaaaacatatcaattca

SEQ ID NO: 3905989 - DNA, 21 bp, Homo sapiens
tcaaaacatatcaattcaaca

SEQ ID NO: 3905990 - DNA, 20 bp, Homo sapiens
tcaaaacctttcaaatatca

SEQ ID NO: 3905991 - DNA, 19 bp, Homo sapiens
tcaaaagaatcagaaacag

SEQ ID NO: 3905992 - DNA, 21 bp, Homo sapiens
tcaaaagcacttgttccttct

SEQ ID NO: 3905993 - DNA, 20 bp, Homo sapiens
tcaaaagtggattttcctga

SEQ ID NO: 3905994 - DNA, 21 bp, Homo sapiens
tcaaaataccatgccatttaa

SEQ ID NO: 3905995 - DNA, 16 bp, Homo sapiens
tcaaaatatttgtaca

SEQ ID NO: 3905996 - DNA, 18 bp, Homo sapiens
tcaaaatatttgtacata

SEQ ID NO: 3905997 - DNA, 19 bp, Homo sapiens
tcaaaatatttgtacatag

SEQ ID NO: 3905998 - DNA, 20 bp, Homo sapiens
tcaaacagtctcaggaaatc

SEQ ID NO: 3905999 - DNA, 18 bp, Homo sapiens
tcaaacatggaagatgaa

SEQ ID NO: 3906000 - DNA, 15 bp, Homo sapiens
tcaaaccataaactt

SEQ ID NO: 3906001 - DNA, 16 bp, Homo sapiens
tcaaaccataaacttc

SEQ ID NO: 3906002 - DNA, 18 bp, Homo sapiens
tcaaaccataaacttcat

SEQ ID NO: 3906003 - DNA, 20 bp, Homo sapiens
tcaaaccccgaccacctgcc

SEQ ID NO: 3906004 - DNA, 19 bp, Homo sapiens
tcaaactggggcctccctg

SEQ ID NO: 3906005 - DNA, 12 bp, Homo sapiens
tcaaagaaatgc

SEQ ID NO: 3906006 - DNA, 16 bp, Homo sapiens
tcaaagagaaaactta

SEQ ID NO: 3906007 - DNA, 13 bp, Homo sapiens
tcaaagcaagggc

SEQ ID NO: 3906008 - DNA, 18 bp, Homo sapiens
tcaaagccggttgcagag

SEQ ID NO: 3906009 - DNA, 14 bp, Homo sapiens
tcaaagtaaaactt

SEQ ID NO: 3906010 - DNA, 19 bp, Homo sapiens
tcaaagtaaaacttgctgc

SEQ ID NO: 3906011 - DNA, 16 bp, Homo sapiens
tcaaagttgtagttct

SEQ ID NO: 3906012 - DNA, 23 bp, Homo sapiens
tcaaagttgtagttcttgtgcat

SEQ ID NO: 3906013 - DNA, 20 bp, Homo sapiens
tcaaatcaagaaacttaagg

SEQ ID NO: 3906014 - DNA, 13 bp, Homo sapiens
tcaaatcctcacc

SEQ ID NO: 3906015 - DNA, 14 bp, Homo sapiens
tcaaatccttgagc

SEQ ID NO: 3906016 - DNA, 14 bp, Homo sapiens
tcaaatctattcag

SEQ ID NO: 3906017 - DNA, 15 bp, Homo sapiens
tcaaatctattcaga

SEQ ID NO: 3906018 - DNA, 16 bp, Homo sapiens
tcaaatgacccaaaga

SEQ ID NO: 3906019 - DNA, 17 bp, Homo sapiens
tcaaatgacccaaagac

SEQ ID NO: 3906020 - DNA, 21 bp, Homo sapiens
tcaaatgtcattatgtagaaa

SEQ ID NO: 3906021 - DNA, 15 bp, Homo sapiens
tcaaattgttaggaa

SEQ ID NO: 3906022 - DNA, 15 bp, Homo sapiens
tcaaatttgccacca

SEQ ID NO: 3906023 - DNA, 16 bp, Homo sapiens
tcaacaacaaaccaaa

SEQ ID NO: 3906024 - DNA, 14 bp, Homo sapiens
tcaacaaccatgcc

SEQ ID NO: 3906025 - DNA, 14 bp, Homo sapiens
tcaacaataaagac

SEQ ID NO: 3906026 - DNA, 17 bp, Homo sapiens
tcaacaataaagactga

SEQ ID NO: 3906027 - DNA, 21 bp, Homo sapiens
tcaacacattacttgcacaag

SEQ ID NO: 3906028 - DNA, 17 bp, Homo sapiens
tcaacagagaaggcagg

SEQ ID NO: 3906029 - DNA, 15 bp, Homo sapiens
tcaacatatcatttt

SEQ ID NO: 3906030 - DNA, 18 bp, Homo sapiens
tcaacattcaaagcagca

SEQ ID NO: 3906031 - DNA, 11 bp, Homo sapiens
tcaaccagcat

SEQ ID NO: 3906032 - DNA, 18 bp, Homo sapiens
tcaaccatcaatggaaac

SEQ ID NO: 3906033 - DNA, 20 bp, Homo sapiens
tcaaccccaccacttctttt

SEQ ID NO: 3906034 - DNA, 14 bp, Homo sapiens
tcaaccccagactc

SEQ ID NO: 3906035 - DNA, 17 bp, Homo sapiens
tcaaccgcttgccatat

SEQ ID NO: 3906036 - DNA, 18 bp, Homo sapiens
tcaacctaccaccccttc

SEQ ID NO: 3906037 - DNA, 20 bp, Homo sapiens
tcaacctaccaccccttcct

SEQ ID NO: 3906038 - DNA, 21 bp, Homo sapiens
tcaacctggtggcaccagatg

SEQ ID NO: 3906039 - DNA, 14 bp, Homo sapiens
tcaacgcagccctg

SEQ ID NO: 3906040 - DNA, 18 bp, Homo sapiens
tcaacgcagccctgcttt

SEQ ID NO: 3906041 - DNA, 11 bp, Homo sapiens
tcaactccaga

SEQ ID NO: 3906042 - DNA, 12 bp, Homo sapiens
tcaactccagaa

SEQ ID NO: 3906043 - DNA, 14 bp, Homo sapiens
tcaactccagaagt

SEQ ID NO: 3906044 - DNA, 23 bp, Homo sapiens
tcaactggagcaagaaggaagga

SEQ ID NO: 3906045 - DNA, 17 bp, Homo sapiens
tcaactggctgggacat

SEQ ID NO: 3906046 - DNA, 17 bp, Homo sapiens
tcaacttggaaaaagaa

SEQ ID NO: 3906047 - DNA, 21 bp, Homo sapiens
tcaactttagtatttttacta

SEQ ID NO: 3906048 - DNA, 21 bp, Homo sapiens
tcaagaaaaattattgtataa

SEQ ID NO: 3906049 - DNA, 13 bp, Homo sapiens
tcaagaaactgag

SEQ ID NO: 3906050 - DNA, 22 bp, Homo sapiens
tcaagaaactgaggaattttct

SEQ ID NO: 3906051 - DNA, 12 bp, Homo sapiens
tcaagaagacat

SEQ ID NO: 3906052 - DNA, 12 bp, Homo sapiens
tcaagactgaaa

SEQ ID NO: 3906053 - DNA, 15 bp, Homo sapiens
tcaagagaagaaaaa

SEQ ID NO: 3906054 - DNA, 18 bp, Homo sapiens
tcaagagaagaaaaaatt

SEQ ID NO: 3906055 - DNA, 12 bp, Homo sapiens
tcaagaggccca

SEQ ID NO: 3906056 - DNA, 16 bp, Homo sapiens
tcaagaggcccaggga

SEQ ID NO: 3906057 - DNA, 17 bp, Homo sapiens
tcaagaggcccagggag

SEQ ID NO: 3906058 - DNA, 22 bp, Homo sapiens
tcaagagtgcagttgattctga

SEQ ID NO: 3906059 - DNA, 22 bp, Homo sapiens
tcaagatgatgatgatctttaa

SEQ ID NO: 3906060 - DNA, 20 bp, Homo sapiens
tcaagattttttttgtaact

SEQ ID NO: 3906061 - DNA, 22 bp, Homo sapiens
tcaagattttttttgtaacttc

SEQ ID NO: 3906062 - DNA, 16 bp, Homo sapiens
tcaagcacctgcagat

SEQ ID NO: 3906063 - DNA, 15 bp, Homo sapiens
tcaagcctgtgaata

SEQ ID NO: 3906064 - DNA, 13 bp, Homo sapiens
tcaagcctgtggg

SEQ ID NO: 3906065 - DNA, 14 bp, Homo sapiens
tcaagcctgtggga

SEQ ID NO: 3906066 - DNA, 15 bp, Homo sapiens
tcaagcgattcttct

SEQ ID NO: 3906067 - DNA, 15 bp, Homo sapiens
tcaagctagccagag

SEQ ID NO: 3906068 - DNA, 13 bp, Homo sapiens
tcaagctgtcccc

SEQ ID NO: 3906069 - DNA, 18 bp, Homo sapiens
tcaagctgtcccctctgt

SEQ ID NO: 3906070 - DNA, 20 bp, Homo sapiens
tcaagctgtcccctctgtca

SEQ ID NO: 3906071 - DNA, 16 bp, Homo sapiens
tcaaggaatcctgagt

SEQ ID NO: 3906072 - DNA, 14 bp, Homo sapiens
tcaaggactcctgt

SEQ ID NO: 3906073 - DNA, 18 bp, Homo sapiens
tcaaggagatataaaatc

SEQ ID NO: 3906074 - DNA, 20 bp, Homo sapiens
tcaccagtgtcccctccact

SEQ ID NO: 3906075 - DNA, 22 bp, Homo sapiens
tcacccacagggctaagagcta

SEQ ID NO: 3906076 - DNA, 17 bp, Homo sapiens
tcacccagctaatctgt

SEQ ID NO: 3906077 - DNA, 12 bp, Homo sapiens
tcacccaggctc

SEQ ID NO: 3906078 - DNA, 17 bp, Homo sapiens
tcacccagtcctggcca

SEQ ID NO: 3906079 - DNA, 13 bp, Homo sapiens
tcacccccagctt

SEQ ID NO: 3906080 - DNA, 14 bp, Homo sapiens
tcaccctccacctc

SEQ ID NO: 3906081 - DNA, 13 bp, Homo sapiens
tcaccctgcagag

SEQ ID NO: 3906082 - DNA, 17 bp, Homo sapiens
tcaccgtggaccttcct

SEQ ID NO: 3906083 - DNA, 20 bp, Homo sapiens
tcaccgtggaccttcctgcc

SEQ ID NO: 3906084 - DNA, 14 bp, Homo sapiens
tcacctcagctgat

SEQ ID NO: 3906085 - DNA, 19 bp, Homo sapiens
tcacctcctccactcactc

SEQ ID NO: 3906086 - DNA, 16 bp, Homo sapiens
tcacctctcttcagcc

SEQ ID NO: 3906087 - DNA, 22 bp, Homo sapiens
tcacctctcttcagcccctagt

SEQ ID NO: 3906088 - DNA, 12 bp, Homo sapiens
tcacctctgcct

SEQ ID NO: 3906089 - DNA, 14 bp, Homo sapiens
tcacctctgcctca

SEQ ID NO: 3906090 - DNA, 15 bp, Homo sapiens
tcacctgatcatata

SEQ ID NO: 3906091 - DNA, 14 bp, Homo sapiens
tcacctgcaagccc

SEQ ID NO: 3906092 - DNA, 17 bp, Homo sapiens
tcacctgcaagccccag

SEQ ID NO: 3906093 - DNA, 20 bp, Homo sapiens
tcacctgcaagccccagggc

SEQ ID NO: 3906094 - DNA, 22 bp, Homo sapiens
tcacctgcaagccccagggcct

SEQ ID NO: 3906095 - DNA, 23 bp, Homo sapiens
tcacctgcaagccccagggcctg

SEQ ID NO: 3906096 - DNA, 13 bp, Homo sapiens
tcacctgggcctt

SEQ ID NO: 3906097 - DNA, 16 bp, Homo sapiens
tcacctgggcctttcc

SEQ ID NO: 3906098 - DNA, 21 bp, Homo sapiens
tcacctgggcctttcctgtgc

SEQ ID NO: 3906099 - DNA, 23 bp, Homo sapiens
tcacctgttactgaaagtggttt

SEQ ID NO: 3906100 - DNA, 17 bp, Homo sapiens
tcaccttatgtattatt

SEQ ID NO: 3906101 - DNA, 19 bp, Homo sapiens
tcaccttatgtattatttt

SEQ ID NO: 3906102 - DNA, 18 bp, Homo sapiens
tcaccttcaccttcatcc

SEQ ID NO: 3906103 - DNA, 20 bp, Homo sapiens
tcaccttgccgagagaggcg

SEQ ID NO: 3906104 - DNA, 16 bp, Homo sapiens
tcacctttggtgcaga

SEQ ID NO: 3906105 - DNA, 20 bp, Homo sapiens
tcacctttttgacttttcca

SEQ ID NO: 3906106 - DNA, 23 bp, Homo sapiens
tcacgatgaaattgaacctggtt

SEQ ID NO: 3906107 - DNA, 20 bp, Homo sapiens
tcacgcctgtaatcccagca

SEQ ID NO: 3906108 - DNA, 22 bp, Homo sapiens
tcacgtgaaatatttaagtata

SEQ ID NO: 3906109 - DNA, 13 bp, Homo sapiens
tcactaaacttta

SEQ ID NO: 3906110 - DNA, 23 bp, Homo sapiens
tcactaccctaatagactaaatg

SEQ ID NO: 3906111 - DNA, 20 bp, Homo sapiens
tcactatggtatgctggcca

SEQ ID NO: 3906112 - DNA, 15 bp, Homo sapiens
tcactccaccaccca

SEQ ID NO: 3906113 - DNA, 10 bp, Homo sapiens
tcactcctgt

SEQ ID NO: 3906114 - DNA, 14 bp, Homo sapiens
tcactctggcctca

SEQ ID NO: 3906115 - DNA, 20 bp, Homo sapiens
tcactctgtcagccagccgc

SEQ ID NO: 3906116 - DNA, 19 bp, Homo sapiens
tcactcttcctgcaaggac

SEQ ID NO: 3906117 - DNA, 15 bp, Homo sapiens
tcactgattgggtgc

SEQ ID NO: 3906118 - DNA, 23 bp, Homo sapiens
tcactgattgggtgccatgtgga

SEQ ID NO: 3906119 - DNA, 24 bp, Homo sapiens
tcactgattgggtgccatgtggag

SEQ ID NO: 3906120 - DNA, 22 bp, Homo sapiens
tcactgcaacctcttcctcctg

SEQ ID NO: 3906121 - DNA, 12 bp, Homo sapiens
tcactgctggct

SEQ ID NO: 3906122 - DNA, 17 bp, Homo sapiens
tcactggagcaccaggc

SEQ ID NO: 3906123 - DNA, 22 bp, Homo sapiens
tcactggagttacattaatgtt

SEQ ID NO: 3906124 - DNA, 19 bp, Homo sapiens
tcactggctggggcagagg

SEQ ID NO: 3906125 - DNA, 14 bp, Homo sapiens
tcactgtcttcaca

SEQ ID NO: 3906126 - DNA, 20 bp, Homo sapiens
tcacttataccaaagggaaa

SEQ ID NO: 3906127 - DNA, 16 bp, Homo sapiens
tcacttccctgggaac

SEQ ID NO: 3906128 - DNA, 12 bp, Homo sapiens
tcacttgtaaat

SEQ ID NO: 3906129 - DNA, 15 bp, Homo sapiens
tcacttgtaaataaa

SEQ ID NO: 3906130 - DNA, 14 bp, Homo sapiens
tcacttgtacaaaa

SEQ ID NO: 3906131 - DNA, 13 bp, Homo sapiens
tcacttttcagtg

SEQ ID NO: 3906132 - DNA, 18 bp, Homo sapiens
tcacttttcctccctcag

SEQ ID NO: 3906133 - DNA, 21 bp, Homo sapiens
tcacttttctgtaacgcctgc

SEQ ID NO: 3906134 - DNA, 17 bp, Homo sapiens
tcagaaaagaaaaccat

SEQ ID NO: 3906135 - DNA, 18 bp, Homo sapiens
tcagaaaagaaaaccatt

SEQ ID NO: 3906136 - DNA, 18 bp, Homo sapiens
tcagaaaagtagaattat

SEQ ID NO: 3906137 - DNA, 21 bp, Homo sapiens
tcagaaaagtagaattatatc

SEQ ID NO: 3906138 - DNA, 18 bp, Homo sapiens
tcagaaaccaaacagttt

SEQ ID NO: 3906139 - DNA, 14 bp, Homo sapiens
tcagaaagagcaag

SEQ ID NO: 3906140 - DNA, 23 bp, Homo sapiens
tcagaaagagcaagtctggatct

SEQ ID NO: 3906141 - DNA, 18 bp, Homo sapiens
tcagaaagggagggctct

SEQ ID NO: 3906142 - DNA, 19 bp, Homo sapiens
tcagaaagggagggctctg

SEQ ID NO: 3906143 - DNA, 22 bp, Homo sapiens
tcagaaagggagggctctgagg

SEQ ID NO: 3906144 - DNA, 23 bp, Homo sapiens
tcagaaataaaatgaaatgtctt

SEQ ID NO: 3906145 - DNA, 14 bp, Homo sapiens
tcagaacatgctgg

SEQ ID NO: 3906146 - DNA, 14 bp, Homo sapiens
tcagaagataactt

SEQ ID NO: 3906147 - DNA, 12 bp, Homo sapiens
tcagaagcctgg

SEQ ID NO: 3906148 - DNA, 19 bp, Homo sapiens
tcagaagcctgggggcctg

SEQ ID NO: 3906149 - DNA, 14 bp, Homo sapiens
tcagaagcctttgg

SEQ ID NO: 3906150 - DNA, 12 bp, Homo sapiens
tcagaaggagaa

SEQ ID NO: 3906151 - DNA, 14 bp, Homo sapiens
tcagaaggagaagg

SEQ ID NO: 3906152 - DNA, 18 bp, Homo sapiens
tcagaaggctggggccag

SEQ ID NO: 3906153 - DNA, 20 bp, Homo sapiens
tcagaaggctggggccagtg

SEQ ID NO: 3906154 - DNA, 15 bp, Homo sapiens
tcagaaggggacctg

SEQ ID NO: 3906155 - DNA, 19 bp, Homo sapiens
tcagaagtttctcagctcc

SEQ ID NO: 3906156 - DNA, 17 bp, Homo sapiens
tcagaagtttggcaata

SEQ ID NO: 3906157 - DNA, 14 bp, Homo sapiens
tcagaatctgtgtg

SEQ ID NO: 3906158 - DNA, 14 bp, Homo sapiens
tcagaatgctctac

SEQ ID NO: 3906159 - DNA, 23 bp, Homo sapiens
tcagaatttctttgtcattcaag

SEQ ID NO: 3906160 - DNA, 23 bp, Homo sapiens
tcaggacccaggccctccatggg

SEQ ID NO: 3906161 - DNA, 14 bp, Homo sapiens
tcaggaccttttga

SEQ ID NO: 3906162 - DNA, 20 bp, Homo sapiens
tcaggacttaacggctccag

SEQ ID NO: 3906163 - DNA, 18 bp, Homo sapiens
tcaggagcacaggcagct

SEQ ID NO: 3906164 - DNA, 15 bp, Homo sapiens
tcaggaggccctggt

SEQ ID NO: 3906165 - DNA, 20 bp, Homo sapiens
tcaggaggcgaataaatgtt

SEQ ID NO: 3906166 - DNA, 16 bp, Homo sapiens
tcaggaggcgcagccc

SEQ ID NO: 3906167 - DNA, 18 bp, Homo sapiens
tcaggaggcgcagcccga

SEQ ID NO: 3906168 - DNA, 23 bp, Homo sapiens
tcaggaggcgcagcccgaagccc

SEQ ID NO: 3906169 - DNA, 12 bp, Homo sapiens
tcaggaggctga

SEQ ID NO: 3906170 - DNA, 18 bp, Homo sapiens
tcaggaggctgaggcaga

SEQ ID NO: 3906171 - DNA, 22 bp, Homo sapiens
tcaggaggctgaggcagaagaa

SEQ ID NO: 3906172 - DNA, 21 bp, Homo sapiens
tcaggagttcaagaccagcct

SEQ ID NO: 3906173 - DNA, 17 bp, Homo sapiens
tcaggatcaagaaagtg

SEQ ID NO: 3906174 - DNA, 20 bp, Homo sapiens
tcaggcaagcccctcagccc

SEQ ID NO: 3906175 - DNA, 22 bp, Homo sapiens
tcaggcaagcccctcagccctt

SEQ ID NO: 3906176 - DNA, 17 bp, Homo sapiens
tcaggcacaggcaggaa

SEQ ID NO: 3906177 - DNA, 20 bp, Homo sapiens
tcaggcacaggcaggaagag

SEQ ID NO: 3906178 - DNA, 23 bp, Homo sapiens
tcaggcacaggcaggaagagaga

SEQ ID NO: 3906179 - DNA, 23 bp, Homo sapiens
tcaggcagaggatgttctggacc

SEQ ID NO: 3906180 - DNA, 14 bp, Homo sapiens
tcaggcaggtttgc

SEQ ID NO: 3906181 - DNA, 16 bp, Homo sapiens
tcaggcaggtttgcca

SEQ ID NO: 3906182 - DNA, 20 bp, Homo sapiens
tcaggccaagaccccagctt

SEQ ID NO: 3906183 - DNA, 20 bp, Homo sapiens
tcaggcccggcatgcgggcc

SEQ ID NO: 3906184 - DNA, 15 bp, Homo sapiens
tcaggctccattagg

SEQ ID NO: 3906185 - DNA, 20 bp, Homo sapiens
tcaggctccattaggatttg

SEQ ID NO: 3906186 - DNA, 16 bp, Homo sapiens
tcaggcttgaaatgca

SEQ ID NO: 3906187 - DNA, 18 bp, Homo sapiens
tcaggcttggaatgaatt

SEQ ID NO: 3906188 - DNA, 13 bp, Homo sapiens
tcagggaaatgga

SEQ ID NO: 3906189 - DNA, 20 bp, Homo sapiens
tcagggaaatggagggtggg

SEQ ID NO: 3906190 - DNA, 17 bp, Homo sapiens
tcagggaagcaggcaga

SEQ ID NO: 3906191 - DNA, 15 bp, Homo sapiens
tcagggatcttgcat

SEQ ID NO: 3906192 - DNA, 16 bp, Homo sapiens
tcagggccagaaggag

SEQ ID NO: 3906193 - DNA, 23 bp, Homo sapiens
tcagggctggagtgcgctcttgg

SEQ ID NO: 3906194 - DNA, 18 bp, Homo sapiens
tcagggtatcccagaccc

SEQ ID NO: 3906195 - DNA, 13 bp, Homo sapiens
tcaggtaggccct

SEQ ID NO: 3906196 - DNA, 15 bp, Homo sapiens
tcaggtaggcccttg

SEQ ID NO: 3906197 - DNA, 21 bp, Homo sapiens
tcaggtaggcccttgtcctgc

SEQ ID NO: 3906198 - DNA, 16 bp, Homo sapiens
tcaggtcctcagagaa

SEQ ID NO: 3906199 - DNA, 21 bp, Homo sapiens
tcaggtctcccacgtgggaga

SEQ ID NO: 3906200 - DNA, 13 bp, Homo sapiens
tcaggtgaaaatg

SEQ ID NO: 3906201 - DNA, 16 bp, Homo sapiens
tcaggtgactggagcc

SEQ ID NO: 3906202 - DNA, 18 bp, Homo sapiens
tcaggtgcttttgatgtg

SEQ ID NO: 3906203 - DNA, 19 bp, Homo sapiens
tcaggtgcttttgatgtga

SEQ ID NO: 3906204 - DNA, 21 bp, Homo sapiens
tcaggtgcttttgatgtgaaa

SEQ ID NO: 3906205 - DNA, 14 bp, Homo sapiens
tcaggttccatccc

SEQ ID NO: 3906206 - DNA, 13 bp, Homo sapiens
tcaggttgacagt

SEQ ID NO: 3906207 - DNA, 22 bp, Homo sapiens
tcaggttgtctgaagtcactgc

SEQ ID NO: 3906208 - DNA, 17 bp, Homo sapiens
tcaggttgttctgtata

SEQ ID NO: 3906209 - DNA, 18 bp, Homo sapiens
tcaggttgttctgtataa

SEQ ID NO: 3906210 - DNA, 14 bp, Homo sapiens
tcaggtttcttaaa

SEQ ID NO: 3906211 - DNA, 18 bp, Homo sapiens
tcagtaatttgaggacaa

SEQ ID NO: 3906212 - DNA, 16 bp, Homo sapiens
tcagtaggtccaaggg

SEQ ID NO: 3906213 - DNA, 20 bp, Homo sapiens
tcagtattttggagaaatta

SEQ ID NO: 3906214 - DNA, 23 bp, Homo sapiens
tcagtattttggagaaattattt

SEQ ID NO: 3906215 - DNA, 22 bp, Homo sapiens
tcagtcagttcccggagcacag

SEQ ID NO: 3906216 - DNA, 15 bp, Homo sapiens
tcagtctagctttta

SEQ ID NO: 3906217 - DNA, 17 bp, Homo sapiens
tcagtctagtgaagatg

SEQ ID NO: 3906218 - DNA, 19 bp, Homo sapiens
tcagtgatacgtacagcca

SEQ ID NO: 3906219 - DNA, 13 bp, Homo sapiens
tcagtgcccacca

SEQ ID NO: 3906220 - DNA, 13 bp, Homo sapiens
tcagtgcctcctg

SEQ ID NO: 3906221 - DNA, 22 bp, Homo sapiens
tcagtgggaacgtgactgcccc

SEQ ID NO: 3906222 - DNA, 23 bp, Homo sapiens
tcagtgggaacgtgactgcccca

SEQ ID NO: 3906223 - DNA, 20 bp, Homo sapiens
tcagtgggacaaaccagagc

SEQ ID NO: 3906224 - DNA, 12 bp, Homo sapiens
tcagtgggagaa

SEQ ID NO: 3906225 - DNA, 21 bp, Homo sapiens
tcagtgtatggaaataaatgt

SEQ ID NO: 3906226 - DNA, 19 bp, Homo sapiens
tcagtgtcctcttgctcaa

SEQ ID NO: 3906227 - DNA, 14 bp, Homo sapiens
tcagttactcagcc

SEQ ID NO: 3906228 - DNA, 15 bp, Homo sapiens
tcagttacttacctg

SEQ ID NO: 3906229 - DNA, 18 bp, Homo sapiens
tcagttatattctttaaa

SEQ ID NO: 3906230 - DNA, 13 bp, Homo sapiens
tcagttattcaga

SEQ ID NO: 3906231 - DNA, 17 bp, Homo sapiens
tcagttcaacctggtgg

SEQ ID NO: 3906232 - DNA, 14 bp, Homo sapiens
tcagttcccggagc

SEQ ID NO: 3906233 - DNA, 21 bp, Homo sapiens
tcagttcccggagcacagccc

SEQ ID NO: 3906234 - DNA, 22 bp, Homo sapiens
tcagttcccggagcacagccct

SEQ ID NO: 3906235 - DNA, 16 bp, Homo sapiens
tcagttcctctttgca

SEQ ID NO: 3906236 - DNA, 20 bp, Homo sapiens
tcagttgtacgtaatgtatt

SEQ ID NO: 3906237 - DNA, 18 bp, Homo sapiens
tcagtttgtcctgtagag

SEQ ID NO: 3906238 - DNA, 13 bp, Homo sapiens
tcataacatcttt

SEQ ID NO: 3906239 - DNA, 20 bp, Homo sapiens
tcataacatctttgaaaaga

SEQ ID NO: 3906240 - DNA, 21 bp, Homo sapiens
tcataacatctttgaaaagaa

SEQ ID NO: 3906241 - DNA, 14 bp, Homo sapiens
tcataacttgctga

SEQ ID NO: 3906242 - DNA, 19 bp, Homo sapiens
tcataaggaagttattaac

SEQ ID NO: 3906243 - DNA, 18 bp, Homo sapiens
tcataaggcctgccctcc

SEQ ID NO: 3906244 - DNA, 15 bp, Homo sapiens
tcataattagaacaa

SEQ ID NO: 3906245 - DNA, 19 bp, Homo sapiens
tcataattagaacaatagc

SEQ ID NO: 3906246 - DNA, 16 bp, Homo sapiens
tcattcatttattcat

SEQ ID NO: 3906247 - DNA, 15 bp, Homo sapiens
tcattcccagagtca

SEQ ID NO: 3906248 - DNA, 12 bp, Homo sapiens
tcattccccagg

SEQ ID NO: 3906249 - DNA, 23 bp, Homo sapiens
tcattccccaggtggctgaccca

SEQ ID NO: 3906250 - DNA, 16 bp, Homo sapiens
tcattccccggccctc

SEQ ID NO: 3906251 - DNA, 23 bp, Homo sapiens
tcattccttgagaaaaacaatga

SEQ ID NO: 3906252 - DNA, 11 bp, Homo sapiens
tcattctcttt

SEQ ID NO: 3906253 - DNA, 15 bp, Homo sapiens
tcattctgttgccca

SEQ ID NO: 3906254 - DNA, 17 bp, Homo sapiens
tcattctgttgcccagg

SEQ ID NO: 3906255 - DNA, 20 bp, Homo sapiens
tcattctgttgcccaggctg

SEQ ID NO: 3906256 - DNA, 22 bp, Homo sapiens
tcattgtagaaacacagttttg

SEQ ID NO: 3906257 - DNA, 15 bp, Homo sapiens
tcattgtatatatgt

SEQ ID NO: 3906258 - DNA, 23 bp, Homo sapiens
tcatttaaaaaaaaaatttgttt

SEQ ID NO: 3906259 - DNA, 14 bp, Homo sapiens
tcatttaaaatgat

SEQ ID NO: 3906260 - DNA, 17 bp, Homo sapiens
tcatttaaaatgattag

SEQ ID NO: 3906261 - DNA, 20 bp, Homo sapiens
tcatttattttaaaaaatga

SEQ ID NO: 3906262 - DNA, 14 bp, Homo sapiens
tcatttcactttaa

SEQ ID NO: 3906263 - DNA, 17 bp, Homo sapiens
tcatttcatctactaca

SEQ ID NO: 3906264 - DNA, 15 bp, Homo sapiens
tcatttctactgtga

SEQ ID NO: 3906265 - DNA, 16 bp, Homo sapiens
tcatttgcaagctgag

SEQ ID NO: 3906266 - DNA, 13 bp, Homo sapiens
tcatttgcttttt

SEQ ID NO: 3906267 - DNA, 19 bp, Homo sapiens
tcattttaaaatctgattt

SEQ ID NO: 3906268 - DNA, 20 bp, Homo sapiens
tcattttaagaagacatgac

SEQ ID NO: 3906269 - DNA, 22 bp, Homo sapiens
tcattttaggcctcctctctgc

SEQ ID NO: 3906270 - DNA, 15 bp, Homo sapiens
tcattttagtgactg

SEQ ID NO: 3906271 - DNA, 16 bp, Homo sapiens
tcattttagtgactgt

SEQ ID NO: 3906272 - DNA, 20 bp, Homo sapiens
tcattttgtaacaaatgaac

SEQ ID NO: 3906273 - DNA, 17 bp, Homo sapiens
tccaaactcctgcctgt

SEQ ID NO: 3906274 - DNA, 12 bp, Homo sapiens
tccaaagaaatg

SEQ ID NO: 3906275 - DNA, 23 bp, Homo sapiens
tccaaaggaagtctaggagctgg

SEQ ID NO: 3906276 - DNA, 18 bp, Homo sapiens
tccaaaggggctgctggg

SEQ ID NO: 3906277 - DNA, 16 bp, Homo sapiens
tccaaatattattcaa

SEQ ID NO: 3906278 - DNA, 16 bp, Homo sapiens
tccaaatgaatgacct

SEQ ID NO: 3906279 - DNA, 20 bp, Homo sapiens
tccaaatgagacacattaaa

SEQ ID NO: 3906280 - DNA, 22 bp, Homo sapiens
tccaaatgaggatatcatcttt

SEQ ID NO: 3906281 - DNA, 19 bp, Homo sapiens
tccaacagctcaagtcttc

SEQ ID NO: 3906282 - DNA, 15 bp, Homo sapiens
tccaacccatgatga

SEQ ID NO: 3906283 - DNA, 19 bp, Homo sapiens
tccaactgtgttcattaga

SEQ ID NO: 3906284 - DNA, 23 bp, Homo sapiens
tccaagcataccaacacgagcag

SEQ ID NO: 3906285 - DNA, 23 bp, Homo sapiens
tccaagcgaggtcaacagagaag

SEQ ID NO: 3906286 - DNA, 18 bp, Homo sapiens
tccaagctccatctccac

SEQ ID NO: 3906287 - DNA, 13 bp, Homo sapiens
tccaagtatttta

SEQ ID NO: 3906288 - DNA, 21 bp, Homo sapiens
tccaagtattttatctgtgtt

SEQ ID NO: 3906289 - DNA, 14 bp, Homo sapiens
tccaagtcaacact

SEQ ID NO: 3906290 - DNA, 20 bp, Homo sapiens
tccaagtccaacctgcctgt

SEQ ID NO: 3906291 - DNA, 14 bp, Homo sapiens
tccaagttcctgca

SEQ ID NO: 3906292 - DNA, 19 bp, Homo sapiens
tccaagttcctgcactcca

SEQ ID NO: 3906293 - DNA, 21 bp, Homo sapiens
tccaagttcctgcactccaga

SEQ ID NO: 3906294 - DNA, 22 bp, Homo sapiens
tccaagttcctgcactccagaa

SEQ ID NO: 3906295 - DNA, 22 bp, Homo sapiens
tccaatcccatagatgggtctg

SEQ ID NO: 3906296 - DNA, 19 bp, Homo sapiens
tccaatctgctcagcaggc

SEQ ID NO: 3906297 - DNA, 19 bp, Homo sapiens
tccaatggctgtaaactat

SEQ ID NO: 3906298 - DNA, 21 bp, Homo sapiens
tccaatggctgtaaactataa

SEQ ID NO: 3906299 - DNA, 16 bp, Homo sapiens
tccaattaaaattaag

SEQ ID NO: 3906300 - DNA, 12 bp, Homo sapiens
tccaattgtaaa

SEQ ID NO: 3906301 - DNA, 16 bp, Homo sapiens
tccacaagattcccag

SEQ ID NO: 3906302 - DNA, 19 bp, Homo sapiens
tccacaagattcccagaga

SEQ ID NO: 3906303 - DNA, 13 bp, Homo sapiens
tccacacacagag

SEQ ID NO: 3906304 - DNA, 14 bp, Homo sapiens
tccacacacagagg

SEQ ID NO: 3906305 - DNA, 20 bp, Homo sapiens
tccacagaaacattttcatt

SEQ ID NO: 3906306 - DNA, 18 bp, Homo sapiens
tccacagccaacaaacat

SEQ ID NO: 3906307 - DNA, 13 bp, Homo sapiens
tccacaggggcag

SEQ ID NO: 3906308 - DNA, 22 bp, Homo sapiens
tccacaggggcaggcctgggac

SEQ ID NO: 3906309 - DNA, 23 bp, Homo sapiens
tccacaggggcaggcctgggacc

SEQ ID NO: 3906310 - DNA, 14 bp, Homo sapiens
tccacagtgctgct

SEQ ID NO: 3906311 - DNA, 22 bp, Homo sapiens
tccacagtgctgcttctcttgg

SEQ ID NO: 3906312 - DNA, 22 bp, Homo sapiens
tccacagttcgacctgcggctg

SEQ ID NO: 3906313 - DNA, 18 bp, Homo sapiens
tccacatctttaagtatt

SEQ ID NO: 3906314 - DNA, 13 bp, Homo sapiens
tccaccacccaaa

SEQ ID NO: 3906315 - DNA, 12 bp, Homo sapiens
tccacccactgt

SEQ ID NO: 3906316 - DNA, 12 bp, Homo sapiens
tccacccagcaa

SEQ ID NO: 3906317 - DNA, 20 bp, Homo sapiens
tccacccaggctgcactgca

SEQ ID NO: 3906318 - DNA, 14 bp, Homo sapiens
tccacccagtgctg

SEQ ID NO: 3906319 - DNA, 13 bp, Homo sapiens
tccacccattccc

SEQ ID NO: 3906320 - DNA, 21 bp, Homo sapiens
tccacccccgccacggccacc

SEQ ID NO: 3906321 - DNA, 19 bp, Homo sapiens
tccaccccctccagctcca

SEQ ID NO: 3906322 - DNA, 17 bp, Homo sapiens
tccaccgcagaaggaag

SEQ ID NO: 3906323 - DNA, 15 bp, Homo sapiens
tccaccgggcctgaa

SEQ ID NO: 3906324 - DNA, 23 bp, Homo sapiens
tccaccgggcctgaaccacagcg

SEQ ID NO: 3906325 - DNA, 12 bp, Homo sapiens
tccacctcagcc

SEQ ID NO: 3906326 - DNA, 14 bp, Homo sapiens
tccacctcagcctt

SEQ ID NO: 3906327 - DNA, 17 bp, Homo sapiens
tccacctctccttggaa

SEQ ID NO: 3906328 - DNA, 23 bp, Homo sapiens
tccacctgcctatccatcctgcg

SEQ ID NO: 3906329 - DNA, 16 bp, Homo sapiens
tccaccttcccatgcc

SEQ ID NO: 3906330 - DNA, 13 bp, Homo sapiens
tccaccttgctct

SEQ ID NO: 3906331 - DNA, 15 bp, Homo sapiens
tccacggtgcgtggc

SEQ ID NO: 3906332 - DNA, 13 bp, Homo sapiens
tccagggctgccc

SEQ ID NO: 3906333 - DNA, 22 bp, Homo sapiens
tccagggtcttgggctactggc

SEQ ID NO: 3906334 - DNA, 15 bp, Homo sapiens
tccaggtatctccag

SEQ ID NO: 3906335 - DNA, 16 bp, Homo sapiens
tccaggtatctccagg

SEQ ID NO: 3906336 - DNA, 21 bp, Homo sapiens
tccaggtcctggtggggcagc

SEQ ID NO: 3906337 - DNA, 22 bp, Homo sapiens
tccaggtcctggtggggcagct

SEQ ID NO: 3906338 - DNA, 14 bp, Homo sapiens
tccagtaagcacat

SEQ ID NO: 3906339 - DNA, 16 bp, Homo sapiens
tccagtctcctgacat

SEQ ID NO: 3906340 - DNA, 14 bp, Homo sapiens
tccagtgagctgga

SEQ ID NO: 3906341 - DNA, 15 bp, Homo sapiens
tccagtgcaaccaca

SEQ ID NO: 3906342 - DNA, 23 bp, Homo sapiens
tccagtggctcgctccctgtagc

SEQ ID NO: 3906343 - DNA, 12 bp, Homo sapiens
tccagtggtgaa

SEQ ID NO: 3906344 - DNA, 19 bp, Homo sapiens
tccagtggtgaagaaaact

SEQ ID NO: 3906345 - DNA, 19 bp, Homo sapiens
tccagtggttgctgttgat

SEQ ID NO: 3906346 - DNA, 19 bp, Homo sapiens
tccagtgttggctgtgtga

SEQ ID NO: 3906347 - DNA, 17 bp, Homo sapiens
tccagttgcaataaaat

SEQ ID NO: 3906348 - DNA, 19 bp, Homo sapiens
tccagttgcaataaaatag

SEQ ID NO: 3906349 - DNA, 14 bp, Homo sapiens
tccagtttcccacc

SEQ ID NO: 3906350 - DNA, 22 bp, Homo sapiens
tccataatctggactcctctgt

SEQ ID NO: 3906351 - DNA, 23 bp, Homo sapiens
tccataatctggactcctctgtc

SEQ ID NO: 3906352 - DNA, 14 bp, Homo sapiens
tccataatgccact

SEQ ID NO: 3906353 - DNA, 16 bp, Homo sapiens
tccataatgccactgg

SEQ ID NO: 3906354 - DNA, 17 bp, Homo sapiens
tccataggaatcatgtt

SEQ ID NO: 3906355 - DNA, 20 bp, Homo sapiens
tccataggaatcatgttgga

SEQ ID NO: 3906356 - DNA, 15 bp, Homo sapiens
tccatctggcagggt

SEQ ID NO: 3906357 - DNA, 20 bp, Homo sapiens
tccatgaagaccacatccac

SEQ ID NO: 3906358 - DNA, 21 bp, Homo sapiens
tccatgcagactcctcagatc

SEQ ID NO: 3906359 - DNA, 13 bp, Homo sapiens
tccatgcccaacc

SEQ ID NO: 3906360 - DNA, 21 bp, Homo sapiens
tccatggacaatataaactga

SEQ ID NO: 3906361 - DNA, 13 bp, Homo sapiens
tccatggcaccag

SEQ ID NO: 3906362 - DNA, 14 bp, Homo sapiens
tccatggcaccagc

SEQ ID NO: 3906363 - DNA, 22 bp, Homo sapiens
tccatgtgcttccctaggctga

SEQ ID NO: 3906364 - DNA, 11 bp, Homo sapiens
tccatgtggcc

SEQ ID NO: 3906365 - DNA, 21 bp, Homo sapiens
tccatgtggccccaggtgcca

SEQ ID NO: 3906366 - DNA, 18 bp, Homo sapiens
tccatgtggttcttcaaa

SEQ ID NO: 3906367 - DNA, 18 bp, Homo sapiens
tccatgttagtttttact

SEQ ID NO: 3906368 - DNA, 16 bp, Homo sapiens
tccatgtttgtaaaac

SEQ ID NO: 3906369 - DNA, 22 bp, Homo sapiens
tccattaacttagcatgtgttg

SEQ ID NO: 3906370 - DNA, 14 bp, Homo sapiens
tccattaggatttg

SEQ ID NO: 3906371 - DNA, 20 bp, Homo sapiens
tccattcccaactagacatt

SEQ ID NO: 3906372 - DNA, 15 bp, Homo sapiens
tccattcctcaggga

SEQ ID NO: 3906373 - DNA, 13 bp, Homo sapiens
tccattgctgttg

SEQ ID NO: 3906374 - DNA, 19 bp, Homo sapiens
tccattgcttattcttgag

SEQ ID NO: 3906375 - DNA, 20 bp, Homo sapiens
tccatttcgcccctcattta

SEQ ID NO: 3906376 - DNA, 22 bp, Homo sapiens
tccatttctcaatcagtgcagt

SEQ ID NO: 3906377 - DNA, 20 bp, Homo sapiens
tccatttggacaaaatggaa

SEQ ID NO: 3906378 - DNA, 15 bp, Homo sapiens
tcccaaacagagggc

SEQ ID NO: 3906379 - DNA, 20 bp, Homo sapiens
tcccaaacagagggccacac

SEQ ID NO: 3906380 - DNA, 22 bp, Homo sapiens
tcccaaattggtgtttctgaat

SEQ ID NO: 3906381 - DNA, 23 bp, Homo sapiens
tcccaacctcaatgccctgccat

SEQ ID NO: 3906382 - DNA, 14 bp, Homo sapiens
tcccaaggagctga

SEQ ID NO: 3906383 - DNA, 22 bp, Homo sapiens
tcccaaggctctgagcaaatgt

SEQ ID NO: 3906384 - DNA, 20 bp, Homo sapiens
tcccaaggtgctaggattac

SEQ ID NO: 3906385 - DNA, 11 bp, Homo sapiens
tcccaataaaa

SEQ ID NO: 3906386 - DNA, 17 bp, Homo sapiens
tcccaataaagctggac

SEQ ID NO: 3906387 - DNA, 13 bp, Homo sapiens
tcccaatcagcac

SEQ ID NO: 3906388 - DNA, 14 bp, Homo sapiens
tcccaatcagcact

SEQ ID NO: 3906389 - DNA, 20 bp, Homo sapiens
tcccaatgcacatccattcc

SEQ ID NO: 3906390 - DNA, 18 bp, Homo sapiens
tcccacactggtgactgc

SEQ ID NO: 3906391 - DNA, 15 bp, Homo sapiens
tcccacaggcccttc

SEQ ID NO: 3906392 - DNA, 22 bp, Homo sapiens
tcccacaggcccttcctctcca

SEQ ID NO: 3906393 - DNA, 11 bp, Homo sapiens
tcccacagtgg

SEQ ID NO: 3906394 - DNA, 14 bp, Homo sapiens
tcccacatccctgg

SEQ ID NO: 3906395 - DNA, 17 bp, Homo sapiens
tcccacatccctgggcc

SEQ ID NO: 3906396 - DNA, 20 bp, Homo sapiens
tcccacatccctgggcctgc

SEQ ID NO: 3906397 - DNA, 23 bp, Homo sapiens
tcccacatccctgggcctgctgc

SEQ ID NO: 3906398 - DNA, 13 bp, Homo sapiens
tcccaccaactct

SEQ ID NO: 3906399 - DNA, 18 bp, Homo sapiens
tcccaccaaggtcttcag

SEQ ID NO: 3906400 - DNA, 20 bp, Homo sapiens
tcccaccaccttggactcct

SEQ ID NO: 3906401 - DNA, 16 bp, Homo sapiens
tcccacccaacagctc

SEQ ID NO: 3906402 - DNA, 20 bp, Homo sapiens
tcccaccccacccccttcag

SEQ ID NO: 3906403 - DNA, 21 bp, Homo sapiens
tcccaccccactccagccctg

SEQ ID NO: 3906404 - DNA, 19 bp, Homo sapiens
tcccaccccggcctccact

SEQ ID NO: 3906405 - DNA, 16 bp, Homo sapiens
tcccacgatgtcaagg

SEQ ID NO: 3906406 - DNA, 16 bp, Homo sapiens
tcccactatggtggga

SEQ ID NO: 3906407 - DNA, 17 bp, Homo sapiens
tcccagaaccacactgt

SEQ ID NO: 3906408 - DNA, 20 bp, Homo sapiens
tcccagagacaggaaaatcc

SEQ ID NO: 3906409 - DNA, 16 bp, Homo sapiens
tcccagagcaaaataa

SEQ ID NO: 3906410 - DNA, 19 bp, Homo sapiens
tcccagagcttattggcca

SEQ ID NO: 3906411 - DNA, 15 bp, Homo sapiens
tcccagagcttccca

SEQ ID NO: 3906412 - DNA, 18 bp, Homo sapiens
tcccagagcttcccagga

SEQ ID NO: 3906413 - DNA, 22 bp, Homo sapiens
tcccagaggccaggaatctgcc

SEQ ID NO: 3906414 - DNA, 19 bp, Homo sapiens
tcccagaggttatctgcct

SEQ ID NO: 3906415 - DNA, 20 bp, Homo sapiens
tcccagaggttatctgcctg

SEQ ID NO: 3906416 - DNA, 21 bp, Homo sapiens
tcccagaggttatctgcctgg

SEQ ID NO: 3906417 - DNA, 24 bp, Homo sapiens
tcccagaggttatctgcctggcct

SEQ ID NO: 3906418 - DNA, 13 bp, Homo sapiens
tccccggcctcag

SEQ ID NO: 3906419 - DNA, 22 bp, Homo sapiens
tccccggtcccttgagacctca

SEQ ID NO: 3906420 - DNA, 17 bp, Homo sapiens
tcccctatccacccagc

SEQ ID NO: 3906421 - DNA, 20 bp, Homo sapiens
tcccctatccacccagccca

SEQ ID NO: 3906422 - DNA, 19 bp, Homo sapiens
tcccctcactgatggacaa

SEQ ID NO: 3906423 - DNA, 22 bp, Homo sapiens
tcccctcatggagaaacatcct

SEQ ID NO: 3906424 - DNA, 12 bp, Homo sapiens
tcccctccctct

SEQ ID NO: 3906425 - DNA, 14 bp, Homo sapiens
tcccctccctcttc

SEQ ID NO: 3906426 - DNA, 18 bp, Homo sapiens
tcccctccctcttccttc

SEQ ID NO: 3906427 - DNA, 16 bp, Homo sapiens
tcccctcggagaagag

SEQ ID NO: 3906428 - DNA, 20 bp, Homo sapiens
tcccctcgtcctgtcccaga

SEQ ID NO: 3906429 - DNA, 21 bp, Homo sapiens
tcccctctgtgtcctctcccc

SEQ ID NO: 3906430 - DNA, 16 bp, Homo sapiens
tcccctgccctgctgc

SEQ ID NO: 3906431 - DNA, 11 bp, Homo sapiens
tcccctgcctc

SEQ ID NO: 3906432 - DNA, 16 bp, Homo sapiens
tcccctggactgggag

SEQ ID NO: 3906433 - DNA, 17 bp, Homo sapiens
tcccctgtcccaccaac

SEQ ID NO: 3906434 - DNA, 18 bp, Homo sapiens
tcccctgtcccaccaact

SEQ ID NO: 3906435 - DNA, 19 bp, Homo sapiens
tcccctgtcccaccaactc

SEQ ID NO: 3906436 - DNA, 15 bp, Homo sapiens
tcccctgtcttctct

SEQ ID NO: 3906437 - DNA, 19 bp, Homo sapiens
tcccctgtcttctctcaaa

SEQ ID NO: 3906438 - DNA, 19 bp, Homo sapiens
tccccttgcccttgccctg

SEQ ID NO: 3906439 - DNA, 22 bp, Homo sapiens
tccccttggcttcctccgtcca

SEQ ID NO: 3906440 - DNA, 15 bp, Homo sapiens
tccccttttgcctgg

SEQ ID NO: 3906441 - DNA, 16 bp, Homo sapiens
tccccttttgcctggc

SEQ ID NO: 3906442 - DNA, 17 bp, Homo sapiens
tccccttttgcctggct

SEQ ID NO: 3906443 - DNA, 18 bp, Homo sapiens
tccccttttgcctggctg

SEQ ID NO: 3906444 - DNA, 19 bp, Homo sapiens
tcccgagcaaagtctaaag

SEQ ID NO: 3906445 - DNA, 21 bp, Homo sapiens
tcccgccaggaggtcctcctc

SEQ ID NO: 3906446 - DNA, 14 bp, Homo sapiens
tcccgctcagccct

SEQ ID NO: 3906447 - DNA, 21 bp, Homo sapiens
tcccggactgcaagcagggct

SEQ ID NO: 3906448 - DNA, 15 bp, Homo sapiens
tcccggagcacagcc

SEQ ID NO: 3906449 - DNA, 17 bp, Homo sapiens
tcccggagcacagccct

SEQ ID NO: 3906450 - DNA, 18 bp, Homo sapiens
tcccggagcacagccctg

SEQ ID NO: 3906451 - DNA, 19 bp, Homo sapiens
tcccggagcacagccctgg

SEQ ID NO: 3906452 - DNA, 18 bp, Homo sapiens
tcccggccaggcgggaga

SEQ ID NO: 3906453 - DNA, 15 bp, Homo sapiens
tcccggctgcctgcc

SEQ ID NO: 3906454 - DNA, 18 bp, Homo sapiens
tcccggctgcctgccgcc

SEQ ID NO: 3906455 - DNA, 17 bp, Homo sapiens
tcccgggggcactgcct

SEQ ID NO: 3906456 - DNA, 19 bp, Homo sapiens
tcccgtgaaagaattattt

SEQ ID NO: 3906457 - DNA, 17 bp, Homo sapiens
tcccgtgaaattgatgc

SEQ ID NO: 3906458 - DNA, 15 bp, Homo sapiens
tccctaaaataaaaa

SEQ ID NO: 3906459 - DNA, 20 bp, Homo sapiens
tccctaaaataaaaaccaga

SEQ ID NO: 3906460 - DNA, 19 bp, Homo sapiens
tccctaagaaaccccaggg

SEQ ID NO: 3906461 - DNA, 18 bp, Homo sapiens
tccctacccactctttgc

SEQ ID NO: 3906462 - DNA, 19 bp, Homo sapiens
tccctaccgagtctcttct

SEQ ID NO: 3906463 - DNA, 21 bp, Homo sapiens
tccctaccgagtctcttctcc

SEQ ID NO: 3906464 - DNA, 18 bp, Homo sapiens
tccctactcccctgggca

SEQ ID NO: 3906465 - DNA, 16 bp, Homo sapiens
tccctacttcctgtga

SEQ ID NO: 3906466 - DNA, 17 bp, Homo sapiens
tccctacttcctgtgac

SEQ ID NO: 3906467 - DNA, 16 bp, Homo sapiens
tccctagcagtgaact

SEQ ID NO: 3906468 - DNA, 14 bp, Homo sapiens
tccctagctgagga

SEQ ID NO: 3906469 - DNA, 14 bp, Homo sapiens
tccctatcaaaaca

SEQ ID NO: 3906470 - DNA, 13 bp, Homo sapiens
tccctcaaatgac

SEQ ID NO: 3906471 - DNA, 20 bp, Homo sapiens
tccctcaaatgcgcgtgtgc

SEQ ID NO: 3906472 - DNA, 21 bp, Homo sapiens
tccctcaaatgcgcgtgtgca

SEQ ID NO: 3906473 - DNA, 13 bp, Homo sapiens
tccctcccctgcc

SEQ ID NO: 3906474 - DNA, 16 bp, Homo sapiens
tccctcctctggccca

SEQ ID NO: 3906475 - DNA, 16 bp, Homo sapiens
tccctcctggagcatc

SEQ ID NO: 3906476 - DNA, 18 bp, Homo sapiens
tccctcctggagcatccc

SEQ ID NO: 3906477 - DNA, 12 bp, Homo sapiens
tccctccttccc

SEQ ID NO: 3906478 - DNA, 17 bp, Homo sapiens
tccctccttcccttctc

SEQ ID NO: 3906479 - DNA, 13 bp, Homo sapiens
tccctctcccagg

SEQ ID NO: 3906480 - DNA, 14 bp, Homo sapiens
tccctctcctgcct

SEQ ID NO: 3906481 - DNA, 16 bp, Homo sapiens
tccctctcctgcctac

SEQ ID NO: 3906482 - DNA, 21 bp, Homo sapiens
tccctctgagaattccaagga

SEQ ID NO: 3906483 - DNA, 19 bp, Homo sapiens
tccctctgccccaagcagc

SEQ ID NO: 3906484 - DNA, 22 bp, Homo sapiens
tccctctgccccaagcagccag

SEQ ID NO: 3906485 - DNA, 20 bp, Homo sapiens
tccctctggccctgccttct

SEQ ID NO: 3906486 - DNA, 18 bp, Homo sapiens
tccctcttccttccccca

SEQ ID NO: 3906487 - DNA, 16 bp, Homo sapiens
tccctctttctacatt

SEQ ID NO: 3906488 - DNA, 15 bp, Homo sapiens
tccctgaacctcagt

SEQ ID NO: 3906489 - DNA, 16 bp, Homo sapiens
tccctgactccctgtg

SEQ ID NO: 3906490 - DNA, 11 bp, Homo sapiens
tccctgagcag

SEQ ID NO: 3906491 - DNA, 14 bp, Homo sapiens
tccctgagtcacca

SEQ ID NO: 3906492 - DNA, 16 bp, Homo sapiens
tccctgagtcaccagg

SEQ ID NO: 3906493 - DNA, 21 bp, Homo sapiens
tccctgagtcaccaggaatgt

SEQ ID NO: 3906494 - DNA, 11 bp, Homo sapiens
tccctgcaccc

SEQ ID NO: 3906495 - DNA, 13 bp, Homo sapiens
tccctgcaccctg

SEQ ID NO: 3906496 - DNA, 17 bp, Homo sapiens
tccctgcaccctggaaa

SEQ ID NO: 3906497 - DNA, 16 bp, Homo sapiens
tccctgcatccaatct

SEQ ID NO: 3906498 - DNA, 14 bp, Homo sapiens
tccctgcccctccc

SEQ ID NO: 3906499 - DNA, 20 bp, Homo sapiens
tccctgcccctcccttcaac

SEQ ID NO: 3906500 - DNA, 17 bp, Homo sapiens
tccctgcttacctgacg

SEQ ID NO: 3906501 - DNA, 21 bp, Homo sapiens
tccctggatgtgtggggcatg

SEQ ID NO: 3906502 - DNA, 22 bp, Homo sapiens
tccctggatgtgtggggcatgg

SEQ ID NO: 3906503 - DNA, 16 bp, Homo sapiens
tccctggcatgtcaga

SEQ ID NO: 3906504 - DNA, 16 bp, Homo sapiens
tccctggctctcagaa

SEQ ID NO: 3906505 - DNA, 19 bp, Homo sapiens
tcctatccttggagagcag

SEQ ID NO: 3906506 - DNA, 15 bp, Homo sapiens
tcctattctcaccag

SEQ ID NO: 3906507 - DNA, 15 bp, Homo sapiens
tcctcacaggagcag

SEQ ID NO: 3906508 - DNA, 20 bp, Homo sapiens
tcctcacaggagcagacaga

SEQ ID NO: 3906509 - DNA, 20 bp, Homo sapiens
tcctcacccccagctttgct

SEQ ID NO: 3906510 - DNA, 20 bp, Homo sapiens
tcctcaccccgtctggggtt

SEQ ID NO: 3906511 - DNA, 16 bp, Homo sapiens
tcctcagggacagaga

SEQ ID NO: 3906512 - DNA, 22 bp, Homo sapiens
tcctcagggacagagacacctg

SEQ ID NO: 3906513 - DNA, 24 bp, Homo sapiens
tcctcagggacagagacacctgca

SEQ ID NO: 3906514 - DNA, 21 bp, Homo sapiens
tcctcaggggtggagaagtgt

SEQ ID NO: 3906515 - DNA, 23 bp, Homo sapiens
tcctcatcccctcgtcctgtccc

SEQ ID NO: 3906516 - DNA, 17 bp, Homo sapiens
tcctccaaactcctgcc

SEQ ID NO: 3906517 - DNA, 23 bp, Homo sapiens
tcctccaaaggaagtctaggagc

SEQ ID NO: 3906518 - DNA, 22 bp, Homo sapiens
tcctccaacgttaaaagacagt

SEQ ID NO: 3906519 - DNA, 13 bp, Homo sapiens
tcctccacagtgc

SEQ ID NO: 3906520 - DNA, 18 bp, Homo sapiens
tcctccactcactccagc

SEQ ID NO: 3906521 - DNA, 16 bp, Homo sapiens
tcctccactccacctc

SEQ ID NO: 3906522 - DNA, 13 bp, Homo sapiens
tcctccagggcca

SEQ ID NO: 3906523 - DNA, 15 bp, Homo sapiens
tcctccattgctgtt

SEQ ID NO: 3906524 - DNA, 13 bp, Homo sapiens
tcctcccaggcgc

SEQ ID NO: 3906525 - DNA, 19 bp, Homo sapiens
tcctcccaggcgccccttc

SEQ ID NO: 3906526 - DNA, 23 bp, Homo sapiens
tcctcccatcccctggactggga

SEQ ID NO: 3906527 - DNA, 13 bp, Homo sapiens
tcctcccatggcc

SEQ ID NO: 3906528 - DNA, 20 bp, Homo sapiens
tcctcccatggccttccctc

SEQ ID NO: 3906529 - DNA, 19 bp, Homo sapiens
tcctccccaccttccccag

SEQ ID NO: 3906530 - DNA, 20 bp, Homo sapiens
tcctccccaccttccccaga

SEQ ID NO: 3906531 - DNA, 14 bp, Homo sapiens
tcctcccccagagc

SEQ ID NO: 3906532 - DNA, 15 bp, Homo sapiens
tcctcccccagagcc

SEQ ID NO: 3906533 - DNA, 24 bp, Homo sapiens
tcctccccctgccagtgccttacc

SEQ ID NO: 3906534 - DNA, 15 bp, Homo sapiens
tcctcccctcttgag

SEQ ID NO: 3906535 - DNA, 15 bp, Homo sapiens
tcctccctcagtgcc

SEQ ID NO: 3906536 - DNA, 19 bp, Homo sapiens
tcctccctgggcagaaagt

SEQ ID NO: 3906537 - DNA, 20 bp, Homo sapiens
tcctccctgttatctgctag

SEQ ID NO: 3906538 - DNA, 14 bp, Homo sapiens
tcctccgtccaccc

SEQ ID NO: 3906539 - DNA, 21 bp, Homo sapiens
tcctccgtccacccaggctgc

SEQ ID NO: 3906540 - DNA, 16 bp, Homo sapiens
tcctcctccacagtgc

SEQ ID NO: 3906541 - DNA, 16 bp, Homo sapiens
tcctcctctctctact

SEQ ID NO: 3906542 - DNA, 23 bp, Homo sapiens
tcctcctgatggccaagagcatc

SEQ ID NO: 3906543 - DNA, 15 bp, Homo sapiens
tcctccttcccctgt

SEQ ID NO: 3906544 - DNA, 13 bp, Homo sapiens
tcctcgccctggg

SEQ ID NO: 3906545 - DNA, 14 bp, Homo sapiens
tcctcgcctaggcc

SEQ ID NO: 3906546 - DNA, 19 bp, Homo sapiens
tcctcggatcaccgagagt

SEQ ID NO: 3906547 - DNA, 15 bp, Homo sapiens
tcctcgtcccctgcc

SEQ ID NO: 3906548 - DNA, 16 bp, Homo sapiens
tcctcgtcccctgcct

SEQ ID NO: 3906549 - DNA, 20 bp, Homo sapiens
tcctctaagccactcttcca

SEQ ID NO: 3906550 - DNA, 21 bp, Homo sapiens
tcctctaagccactcttccaa

SEQ ID NO: 3906551 - DNA, 13 bp, Homo sapiens
tcctctccactgc

SEQ ID NO: 3906552 - DNA, 15 bp, Homo sapiens
tcctctccaggcacc

SEQ ID NO: 3906553 - DNA, 19 bp, Homo sapiens
tcctctcccctctgccctg

SEQ ID NO: 3906554 - DNA, 20 bp, Homo sapiens
tcctctcccctctgccctgt

SEQ ID NO: 3906555 - DNA, 16 bp, Homo sapiens
tcctctccttgggctc

SEQ ID NO: 3906556 - DNA, 20 bp, Homo sapiens
tcctctccttgggctcctgg

SEQ ID NO: 3906557 - DNA, 21 bp, Homo sapiens
tcctctccttgggctcctggc

SEQ ID NO: 3906558 - DNA, 22 bp, Homo sapiens
tcctctccttgggctcctggct

SEQ ID NO: 3906559 - DNA, 23 bp, Homo sapiens
tcctctccttgggctcctggctg

SEQ ID NO: 3906560 - DNA, 22 bp, Homo sapiens
tcctctcgagcccagatggaaa

SEQ ID NO: 3906561 - DNA, 15 bp, Homo sapiens
tcctctgatacccag

SEQ ID NO: 3906562 - DNA, 16 bp, Homo sapiens
tcctctgattatcagg

SEQ ID NO: 3906563 - DNA, 12 bp, Homo sapiens
tcctctgccacc

SEQ ID NO: 3906564 - DNA, 22 bp, Homo sapiens
tcctctgccacctcccctatcc

SEQ ID NO: 3906565 - DNA, 19 bp, Homo sapiens
tcctctggatggcaccaga

SEQ ID NO: 3906566 - DNA, 12 bp, Homo sapiens
tcctctggccca

SEQ ID NO: 3906567 - DNA, 15 bp, Homo sapiens
tcctctggcccagcc

SEQ ID NO: 3906568 - DNA, 21 bp, Homo sapiens
tcctctggcccagcctaccct

SEQ ID NO: 3906569 - DNA, 23 bp, Homo sapiens
tcctctggctggctaactggaag

SEQ ID NO: 3906570 - DNA, 18 bp, Homo sapiens
tcctcttgcctctctcag

SEQ ID NO: 3906571 - DNA, 21 bp, Homo sapiens
tcctgaagccagatccaccct

SEQ ID NO: 3906572 - DNA, 13 bp, Homo sapiens
tcctgaagcctct

SEQ ID NO: 3906573 - DNA, 15 bp, Homo sapiens
tcctgacccagtccc

SEQ ID NO: 3906574 - DNA, 15 bp, Homo sapiens
tcctgaccctcccta

SEQ ID NO: 3906575 - DNA, 14 bp, Homo sapiens
tcctgacctgaggc

SEQ ID NO: 3906576 - DNA, 21 bp, Homo sapiens
tcctgactccagtgagctgga

SEQ ID NO: 3906577 - DNA, 23 bp, Homo sapiens
tcctgactcggtcaaaatatttt

SEQ ID NO: 3906578 - DNA, 17 bp, Homo sapiens
tcctgagaaggcgagga

SEQ ID NO: 3906579 - DNA, 18 bp, Homo sapiens
tcctgagaaggcgaggag

SEQ ID NO: 3906580 - DNA, 23 bp, Homo sapiens
tcctgagaaggcgaggagagtgg

SEQ ID NO: 3906581 - DNA, 16 bp, Homo sapiens
tcctgagcactgccag

SEQ ID NO: 3906582 - DNA, 17 bp, Homo sapiens
tcctgagcactgccagg

SEQ ID NO: 3906583 - DNA, 13 bp, Homo sapiens
tcctgaggctgag

SEQ ID NO: 3906584 - DNA, 17 bp, Homo sapiens
tcctgataataattgat

SEQ ID NO: 3906585 - DNA, 14 bp, Homo sapiens
tcctgatggccaag

SEQ ID NO: 3906586 - DNA, 15 bp, Homo sapiens
tcctgatggccaaga

SEQ ID NO: 3906587 - DNA, 17 bp, Homo sapiens
tcctgatttctctgaac

SEQ ID NO: 3906588 - DNA, 18 bp, Homo sapiens
tcctgatttctctgaaca

SEQ ID NO: 3906589 - DNA, 17 bp, Homo sapiens
tcctgcaatctccaggg

SEQ ID NO: 3906590 - DNA, 21 bp, Homo sapiens
tcctgcaatctccagggctgc

SEQ ID NO: 3906591 - DNA, 14 bp, Homo sapiens
tccttccttccctg

SEQ ID NO: 3906592 - DNA, 18 bp, Homo sapiens
tccttcgtgtctctccca

SEQ ID NO: 3906593 - DNA, 21 bp, Homo sapiens
tccttctcgtttgctctagtc

SEQ ID NO: 3906594 - DNA, 15 bp, Homo sapiens
tccttctttctcttc

SEQ ID NO: 3906595 - DNA, 21 bp, Homo sapiens
tccttgaaaaaaagttgcttt

SEQ ID NO: 3906596 - DNA, 23 bp, Homo sapiens
tccttgaaaaaaagttgctttgt

SEQ ID NO: 3906597 - DNA, 13 bp, Homo sapiens
tccttgagcattt

SEQ ID NO: 3906598 - DNA, 16 bp, Homo sapiens
tccttgatctgtatat

SEQ ID NO: 3906599 - DNA, 22 bp, Homo sapiens
tccttgatctgtatatacaata

SEQ ID NO: 3906600 - DNA, 14 bp, Homo sapiens
tccttgcacccctc

SEQ ID NO: 3906601 - DNA, 21 bp, Homo sapiens
tccttgcacccctcactctgg

SEQ ID NO: 3906602 - DNA, 14 bp, Homo sapiens
tccttgcacctgca

SEQ ID NO: 3906603 - DNA, 17 bp, Homo sapiens
tccttgcatcaattttt

SEQ ID NO: 3906604 - DNA, 16 bp, Homo sapiens
tccttgctctgcaggc

SEQ ID NO: 3906605 - DNA, 20 bp, Homo sapiens
tccttggagagcagctggct

SEQ ID NO: 3906606 - DNA, 12 bp, Homo sapiens
tccttgggctcc

SEQ ID NO: 3906607 - DNA, 15 bp, Homo sapiens
tccttggtctgctgg

SEQ ID NO: 3906608 - DNA, 16 bp, Homo sapiens
tccttggtctgctggt

SEQ ID NO: 3906609 - DNA, 21 bp, Homo sapiens
tccttggtgtgaccctctgaa

SEQ ID NO: 3906610 - DNA, 14 bp, Homo sapiens
tccttgtctctcat

SEQ ID NO: 3906611 - DNA, 16 bp, Homo sapiens
tccttgtctctcattc

SEQ ID NO: 3906612 - DNA, 17 bp, Homo sapiens
tcctttaaatccttcca

SEQ ID NO: 3906613 - DNA, 24 bp, Homo sapiens
tcctttcaggagggtccccagctg

SEQ ID NO: 3906614 - DNA, 18 bp, Homo sapiens
tcctttcatccccacctt

SEQ ID NO: 3906615 - DNA, 12 bp, Homo sapiens
tcctttcctctg

SEQ ID NO: 3906616 - DNA, 13 bp, Homo sapiens
tcctttcctctga

SEQ ID NO: 3906617 - DNA, 18 bp, Homo sapiens
tcctttctccagccagca

SEQ ID NO: 3906618 - DNA, 14 bp, Homo sapiens
tcctttgagaaaga

SEQ ID NO: 3906619 - DNA, 16 bp, Homo sapiens
tcctttgagaatgtga

SEQ ID NO: 3906620 - DNA, 18 bp, Homo sapiens
tcctttgagaatgtgatt

SEQ ID NO: 3906621 - DNA, 17 bp, Homo sapiens
tcctttgcattccatga

SEQ ID NO: 3906622 - DNA, 12 bp, Homo sapiens
tccttttatgtt

SEQ ID NO: 3906623 - DNA, 15 bp, Homo sapiens
tccttttatgttatt

SEQ ID NO: 3906624 - DNA, 18 bp, Homo sapiens
tccttttcttccttcttt

SEQ ID NO: 3906625 - DNA, 14 bp, Homo sapiens
tccttttgatgggg

SEQ ID NO: 3906626 - DNA, 16 bp, Homo sapiens
tccttttgctgtcttt

SEQ ID NO: 3906627 - DNA, 18 bp, Homo sapiens
tccttttgtccccagggc

SEQ ID NO: 3906628 - DNA, 18 bp, Homo sapiens
tcctttttcaacttggaa

SEQ ID NO: 3906629 - DNA, 19 bp, Homo sapiens
tcctttttctttataaact

SEQ ID NO: 3906630 - DNA, 22 bp, Homo sapiens
tcctttttgcagtatatttctg

SEQ ID NO: 3906631 - DNA, 14 bp, Homo sapiens
tccttttttaaaag

SEQ ID NO: 3906632 - DNA, 15 bp, Homo sapiens
tcgaaaattcatttc

SEQ ID NO: 3906633 - DNA, 24 bp, Homo sapiens
tcgaaaattcatttcacattaatg

SEQ ID NO: 3906634 - DNA, 14 bp, Homo sapiens
tcgaacaaactgat

SEQ ID NO: 3906635 - DNA, 12 bp, Homo sapiens
tcgaaccaaggc

SEQ ID NO: 3906636 - DNA, 13 bp, Homo sapiens
tcgaaccaaggca

SEQ ID NO: 3906637 - DNA, 19 bp, Homo sapiens
tcgaaccaaggcagcctcc

SEQ ID NO: 3906638 - DNA, 21 bp, Homo sapiens
tcgaaccaaggcagcctccag

SEQ ID NO: 3906639 - DNA, 21 bp, Homo sapiens
tcgactcaggatccagtccct

SEQ ID NO: 3906640 - DNA, 21 bp, Homo sapiens
tcgagaccatcctggcccctc

SEQ ID NO: 3906641 - DNA, 14 bp, Homo sapiens
tcgagccccctgga

SEQ ID NO: 3906642 - DNA, 17 bp, Homo sapiens
tcgagcgccctgcagac

SEQ ID NO: 3906643 - DNA, 19 bp, Homo sapiens
tcgagcgccctgcagaccc

SEQ ID NO: 3906644 - DNA, 12 bp, Homo sapiens
tcgaggacaagt

SEQ ID NO: 3906645 - DNA, 23 bp, Homo sapiens
tcgaggacaagtgagagagcaag

SEQ ID NO: 3906646 - DNA, 20 bp, Homo sapiens
tcgaggcaccggcgctgcag

SEQ ID NO: 3906647 - DNA, 22 bp, Homo sapiens
tcgaggcaccggcgctgcaggt

SEQ ID NO: 3906648 - DNA, 21 bp, Homo sapiens
tcgaggtagagtttgaaggag

SEQ ID NO: 3906649 - DNA, 14 bp, Homo sapiens
tcgaggtgtcaccc

SEQ ID NO: 3906650 - DNA, 17 bp, Homo sapiens
tcgaggtgtcaccctgc

SEQ ID NO: 3906651 - DNA, 23 bp, Homo sapiens
tcgaggtgtcaccctgcagagct

SEQ ID NO: 3906652 - DNA, 22 bp, Homo sapiens
tcgaggttgccccttccccatc

SEQ ID NO: 3906653 - DNA, 14 bp, Homo sapiens
tcgagtcaaaatgt

SEQ ID NO: 3906654 - DNA, 15 bp, Homo sapiens
tcgatctgtactgta

SEQ ID NO: 3906655 - DNA, 16 bp, Homo sapiens
tcgcagccaccctgag

SEQ ID NO: 3906656 - DNA, 17 bp, Homo sapiens
tcgcagccaccctgagg

SEQ ID NO: 3906657 - DNA, 20 bp, Homo sapiens
tcgcagccaccctgaggagt

SEQ ID NO: 3906658 - DNA, 21 bp, Homo sapiens
tcgcagccaccctgaggagtc

SEQ ID NO: 3906659 - DNA, 23 bp, Homo sapiens
tcgcagccaccctgaggagtctg

SEQ ID NO: 3906660 - DNA, 22 bp, Homo sapiens
tcgcagcctggcggggcaggag

SEQ ID NO: 3906661 - DNA, 22 bp, Homo sapiens
tcgcaggatccgctgccaccac

SEQ ID NO: 3906662 - DNA, 18 bp, Homo sapiens
tcgccccagatcaccagc

SEQ ID NO: 3906663 - DNA, 20 bp, Homo sapiens
tcgccccagatcaccagccc

SEQ ID NO: 3906664 - DNA, 12 bp, Homo sapiens
tcgccctaccct

SEQ ID NO: 3906665 - DNA, 15 bp, Homo sapiens
tcgccgtctgtgaat

SEQ ID NO: 3906666 - DNA, 19 bp, Homo sapiens
tcgcctgggcccaggctct

SEQ ID NO: 3906667 - DNA, 22 bp, Homo sapiens
tcgcctgggcccaggctctggg

SEQ ID NO: 3906668 - DNA, 12 bp, Homo sapiens
tcgcctgtggga

SEQ ID NO: 3906669 - DNA, 16 bp, Homo sapiens
tcgcctgtgggaagag

SEQ ID NO: 3906670 - DNA, 18 bp, Homo sapiens
tcgctccccactctgctc

SEQ ID NO: 3906671 - DNA, 22 bp, Homo sapiens
tcgctccctgtagctctgcctc

SEQ ID NO: 3906672 - DNA, 17 bp, Homo sapiens
tcgctctgctggcctgg

SEQ ID NO: 3906673 - DNA, 23 bp, Homo sapiens
tcgctctgctggcctggccggca

SEQ ID NO: 3906674 - DNA, 11 bp, Homo sapiens
tcgctgccagg

SEQ ID NO: 3906675 - DNA, 13 bp, Homo sapiens
tcgctgccaggac

SEQ ID NO: 3906676 - DNA, 24 bp, Homo sapiens
tcgctgccaggacacctgccccag

SEQ ID NO: 3906677 - DNA, 23 bp, Homo sapiens
tctagctagaaatatgattttat

SEQ ID NO: 3906678 - DNA, 15 bp, Homo sapiens
tctagctggcaggac

SEQ ID NO: 3906679 - DNA, 17 bp, Homo sapiens
tctagctggcaggacac

SEQ ID NO: 3906680 - DNA, 19 bp, Homo sapiens
tctagcttcatgcctcagt

SEQ ID NO: 3906681 - DNA, 22 bp, Homo sapiens
tctagcttcatgcctcagtttc

SEQ ID NO: 3906682 - DNA, 23 bp, Homo sapiens
tctagcttcatgcctcagtttcc

SEQ ID NO: 3906683 - DNA, 20 bp, Homo sapiens
tctaggagctgggaggaaaa

SEQ ID NO: 3906684 - DNA, 19 bp, Homo sapiens
tctaggagctgtctccagg

SEQ ID NO: 3906685 - DNA, 19 bp, Homo sapiens
tctaggggtcaggctccat

SEQ ID NO: 3906686 - DNA, 15 bp, Homo sapiens
tctagtgacttcctg

SEQ ID NO: 3906687 - DNA, 12 bp, Homo sapiens
tctagtttactt

SEQ ID NO: 3906688 - DNA, 15 bp, Homo sapiens
tctagtttcagtaaa

SEQ ID NO: 3906689 - DNA, 17 bp, Homo sapiens
tctagttttttttgtaa

SEQ ID NO: 3906690 - DNA, 20 bp, Homo sapiens
tctatacctgtctcctttct

SEQ ID NO: 3906691 - DNA, 12 bp, Homo sapiens
tctatagctctt

SEQ ID NO: 3906692 - DNA, 15 bp, Homo sapiens
tctatagctcttcta

SEQ ID NO: 3906693 - DNA, 18 bp, Homo sapiens
tctatagctcttctattt

SEQ ID NO: 3906694 - DNA, 19 bp, Homo sapiens
tctatagtagtcaattagt

SEQ ID NO: 3906695 - DNA, 18 bp, Homo sapiens
tctatataaggaggaaaa

SEQ ID NO: 3906696 - DNA, 16 bp, Homo sapiens
tctatattggaatctg

SEQ ID NO: 3906697 - DNA, 22 bp, Homo sapiens
tctatcacattacatcatcctc

SEQ ID NO: 3906698 - DNA, 20 bp, Homo sapiens
tctatcaggaaaacaaatca

SEQ ID NO: 3906699 - DNA, 22 bp, Homo sapiens
tctatgcaaatgcctccaagcc

SEQ ID NO: 3906700 - DNA, 13 bp, Homo sapiens
tctatgcaatttt

SEQ ID NO: 3906701 - DNA, 22 bp, Homo sapiens
tctatgcaatttttaaactagt

SEQ ID NO: 3906702 - DNA, 23 bp, Homo sapiens
tctatgcaatttttaaactagta

SEQ ID NO: 3906703 - DNA, 19 bp, Homo sapiens
tctatgcagtattgccaca

SEQ ID NO: 3906704 - DNA, 16 bp, Homo sapiens
tctattaagatttcca

SEQ ID NO: 3906705 - DNA, 18 bp, Homo sapiens
tctattaagatttccaag

SEQ ID NO: 3906706 - DNA, 20 bp, Homo sapiens
tctattagttttctttgtaa

SEQ ID NO: 3906707 - DNA, 17 bp, Homo sapiens
tctattataaaaccatg

SEQ ID NO: 3906708 - DNA, 16 bp, Homo sapiens
tctattcaaaaggaaa

SEQ ID NO: 3906709 - DNA, 19 bp, Homo sapiens
tctattcctgaccctccct

SEQ ID NO: 3906710 - DNA, 16 bp, Homo sapiens
tctattctgagccttg

SEQ ID NO: 3906711 - DNA, 17 bp, Homo sapiens
tctattctgagccttga

SEQ ID NO: 3906712 - DNA, 13 bp, Homo sapiens
tctattgaaaaat

SEQ ID NO: 3906713 - DNA, 16 bp, Homo sapiens
tctattgtttattctt

SEQ ID NO: 3906714 - DNA, 17 bp, Homo sapiens
tctattgtttattcttt

SEQ ID NO: 3906715 - DNA, 13 bp, Homo sapiens
tctatttaaaaaa

SEQ ID NO: 3906716 - DNA, 16 bp, Homo sapiens
tctatttaaaaaataa

SEQ ID NO: 3906717 - DNA, 14 bp, Homo sapiens
tctatttattaagt

SEQ ID NO: 3906718 - DNA, 23 bp, Homo sapiens
tctcaacctaccaccccttcctg

SEQ ID NO: 3906719 - DNA, 19 bp, Homo sapiens
tctcaagagggcactggtg

SEQ ID NO: 3906720 - DNA, 17 bp, Homo sapiens
tctcaagctagccagag

SEQ ID NO: 3906721 - DNA, 15 bp, Homo sapiens
tctcaatcagtgcag

SEQ ID NO: 3906722 - DNA, 16 bp, Homo sapiens
tctcaatcagtgcagt

SEQ ID NO: 3906723 - DNA, 12 bp, Homo sapiens
tctcacaaacat

SEQ ID NO: 3906724 - DNA, 12 bp, Homo sapiens
tctcaccaggaa

SEQ ID NO: 3906725 - DNA, 20 bp, Homo sapiens
tctcacgggcagtagctgtg

SEQ ID NO: 3906726 - DNA, 14 bp, Homo sapiens
tctcactccaccac

SEQ ID NO: 3906727 - DNA, 15 bp, Homo sapiens
tctcactccaccacc

SEQ ID NO: 3906728 - DNA, 18 bp, Homo sapiens
tctcactccaccacccaa

SEQ ID NO: 3906729 - DNA, 16 bp, Homo sapiens
tctcactcctacctgg

SEQ ID NO: 3906730 - DNA, 20 bp, Homo sapiens
tctcagaggctatagctggg

SEQ ID NO: 3906731 - DNA, 15 bp, Homo sapiens
tctcagatcttgaca

SEQ ID NO: 3906732 - DNA, 16 bp, Homo sapiens
tctcagatcttgacag

SEQ ID NO: 3906733 - DNA, 22 bp, Homo sapiens
tctcagcgaggtgtaaagttgt

SEQ ID NO: 3906734 - DNA, 12 bp, Homo sapiens
tctcaggaaatc

SEQ ID NO: 3906735 - DNA, 23 bp, Homo sapiens
tctcaggaaatcaaatatgcaaa

SEQ ID NO: 3906736 - DNA, 16 bp, Homo sapiens
tctcaggacacaggcc

SEQ ID NO: 3906737 - DNA, 20 bp, Homo sapiens
tctcaggagcacaggcagct

SEQ ID NO: 3906738 - DNA, 21 bp, Homo sapiens
tctcaggtcactccagtgtta

SEQ ID NO: 3906739 - DNA, 21 bp, Homo sapiens
tctcaggtgccactccctgag

SEQ ID NO: 3906740 - DNA, 22 bp, Homo sapiens
tctcaggtgccactccctgagc

SEQ ID NO: 3906741 - DNA, 23 bp, Homo sapiens
tctcaggtgccactccctgagct

SEQ ID NO: 3906742 - DNA, 16 bp, Homo sapiens
tctcagttattcagat

SEQ ID NO: 3906743 - DNA, 15 bp, Homo sapiens
tctcatacctctgac

SEQ ID NO: 3906744 - DNA, 16 bp, Homo sapiens
tctcatacctctgacc

SEQ ID NO: 3906745 - DNA, 21 bp, Homo sapiens
tctcatactcccccacagttt

SEQ ID NO: 3906746 - DNA, 23 bp, Homo sapiens
tctcataggaaaagtacatttaa

SEQ ID NO: 3906747 - DNA, 18 bp, Homo sapiens
tctcatatgtagccctca

SEQ ID NO: 3906748 - DNA, 23 bp, Homo sapiens
tctcatccccagtcccaatgcac

SEQ ID NO: 3906749 - DNA, 19 bp, Homo sapiens
tctcatcgccagacaactg

SEQ ID NO: 3906750 - DNA, 15 bp, Homo sapiens
tctcatgatttacag

SEQ ID NO: 3906751 - DNA, 14 bp, Homo sapiens
tctcatgcctgcct

SEQ ID NO: 3906752 - DNA, 16 bp, Homo sapiens
tctcatgtctcagcct

SEQ ID NO: 3906753 - DNA, 16 bp, Homo sapiens
tctcatgtgatccttt

SEQ ID NO: 3906754 - DNA, 22 bp, Homo sapiens
tctcatgttgaagccactgcct

SEQ ID NO: 3906755 - DNA, 19 bp, Homo sapiens
tctcattccaacagtgagt

SEQ ID NO: 3906756 - DNA, 21 bp, Homo sapiens
tctcattctctttctttttct

SEQ ID NO: 3906757 - DNA, 14 bp, Homo sapiens
tctcattctgttgc

SEQ ID NO: 3906758 - DNA, 18 bp, Homo sapiens
tctcattctgttgcccag

SEQ ID NO: 3906759 - DNA, 17 bp, Homo sapiens
tctccaaaggggctgct

SEQ ID NO: 3906760 - DNA, 20 bp, Homo sapiens
tctccaaaggggctgctggg

SEQ ID NO: 3906761 - DNA, 22 bp, Homo sapiens
tctccaaaggggctgctggggc

SEQ ID NO: 3906762 - DNA, 17 bp, Homo sapiens
tctccacctcagccttg

SEQ ID NO: 3906763 - DNA, 18 bp, Homo sapiens
tctctggggccctgggcc

SEQ ID NO: 3906764 - DNA, 20 bp, Homo sapiens
tctctggggccctgggcctc

SEQ ID NO: 3906765 - DNA, 22 bp, Homo sapiens
tctctggggccctgggcctcag

SEQ ID NO: 3906766 - DNA, 21 bp, Homo sapiens
tctctgtataaacattaaatg

SEQ ID NO: 3906767 - DNA, 22 bp, Homo sapiens
tctctgtataaacattaaatgt

SEQ ID NO: 3906768 - DNA, 22 bp, Homo sapiens
tctctgtataatctatttacat

SEQ ID NO: 3906769 - DNA, 18 bp, Homo sapiens
tctctgtgtgcacaaata

SEQ ID NO: 3906770 - DNA, 20 bp, Homo sapiens
tctcttaccgcgagactgag

SEQ ID NO: 3906771 - DNA, 22 bp, Homo sapiens
tctcttccagaagatgccctcc

SEQ ID NO: 3906772 - DNA, 23 bp, Homo sapiens
tctcttccagaagatgccctcca

SEQ ID NO: 3906773 - DNA, 20 bp, Homo sapiens
tctcttccctaatcctccaa

SEQ ID NO: 3906774 - DNA, 11 bp, Homo sapiens
tctcttcctac

SEQ ID NO: 3906775 - DNA, 12 bp, Homo sapiens
tctcttcctgta

SEQ ID NO: 3906776 - DNA, 15 bp, Homo sapiens
tctcttctccactgg

SEQ ID NO: 3906777 - DNA, 22 bp, Homo sapiens
tctcttctctattcctgaccct

SEQ ID NO: 3906778 - DNA, 21 bp, Homo sapiens
tctctttctttttctgtctct

SEQ ID NO: 3906779 - DNA, 23 bp, Homo sapiens
tctgaaagcacaggagacactgt

SEQ ID NO: 3906780 - DNA, 22 bp, Homo sapiens
tctgaaagtatattttcctccc

SEQ ID NO: 3906781 - DNA, 16 bp, Homo sapiens
tctgaaatttcccaca

SEQ ID NO: 3906782 - DNA, 14 bp, Homo sapiens
tctgaacaaacact

SEQ ID NO: 3906783 - DNA, 16 bp, Homo sapiens
tctgaacaaacactga

SEQ ID NO: 3906784 - DNA, 21 bp, Homo sapiens
tctgaacaaacactgaatcat

SEQ ID NO: 3906785 - DNA, 21 bp, Homo sapiens
tctgaacacatactagaaagc

SEQ ID NO: 3906786 - DNA, 23 bp, Homo sapiens
tctgaaggaatagccagagagga

SEQ ID NO: 3906787 - DNA, 16 bp, Homo sapiens
tctgaataacatttgt

SEQ ID NO: 3906788 - DNA, 13 bp, Homo sapiens
tctgaatggtcca

SEQ ID NO: 3906789 - DNA, 12 bp, Homo sapiens
tctgacaagggc

SEQ ID NO: 3906790 - DNA, 13 bp, Homo sapiens
tctgacaagggct

SEQ ID NO: 3906791 - DNA, 23 bp, Homo sapiens
tctgacaagggctgacctgcctc

SEQ ID NO: 3906792 - DNA, 23 bp, Homo sapiens
tctgacagttactcttcagtttt

SEQ ID NO: 3906793 - DNA, 13 bp, Homo sapiens
tctgacattcatt

SEQ ID NO: 3906794 - DNA, 18 bp, Homo sapiens
tctgaccatttcaggggt

SEQ ID NO: 3906795 - DNA, 14 bp, Homo sapiens
tctgacccagtgag

SEQ ID NO: 3906796 - DNA, 12 bp, Homo sapiens
tctgactccaga

SEQ ID NO: 3906797 - DNA, 15 bp, Homo sapiens
tctgactccagagtc

SEQ ID NO: 3906798 - DNA, 16 bp, Homo sapiens
tctgactccagagtct

SEQ ID NO: 3906799 - DNA, 22 bp, Homo sapiens
tctgactccagagtctgagccc

SEQ ID NO: 3906800 - DNA, 14 bp, Homo sapiens
tctgacttctccca

SEQ ID NO: 3906801 - DNA, 14 bp, Homo sapiens
tctgagaaagacta

SEQ ID NO: 3906802 - DNA, 20 bp, Homo sapiens
tctgagaatgcccaactctt

SEQ ID NO: 3906803 - DNA, 16 bp, Homo sapiens
tctgagaggccctgga

SEQ ID NO: 3906804 - DNA, 18 bp, Homo sapiens
tctgagaggccctggatc

SEQ ID NO: 3906805 - DNA, 17 bp, Homo sapiens
tctgagatctccctcca

SEQ ID NO: 3906806 - DNA, 15 bp, Homo sapiens
tctgagcaagagctg

SEQ ID NO: 3906807 - DNA, 17 bp, Homo sapiens
tctgagcaagagctggc

SEQ ID NO: 3906808 - DNA, 20 bp, Homo sapiens
tctgagcaccccctcattcc

SEQ ID NO: 3906809 - DNA, 22 bp, Homo sapiens
tctgagcagtcagggtgggaag

SEQ ID NO: 3906810 - DNA, 16 bp, Homo sapiens
tctgagcataatgctc

SEQ ID NO: 3906811 - DNA, 18 bp, Homo sapiens
tctgagcccccggctagt

SEQ ID NO: 3906812 - DNA, 23 bp, Homo sapiens
tctgagcccccggctagtaccct

SEQ ID NO: 3906813 - DNA, 20 bp, Homo sapiens
tctgagccctggtgtgtttc

SEQ ID NO: 3906814 - DNA, 20 bp, Homo sapiens
tctgagcctaaatctaatca

SEQ ID NO: 3906815 - DNA, 13 bp, Homo sapiens
tctgaggccagcc

SEQ ID NO: 3906816 - DNA, 20 bp, Homo sapiens
tctgaggccagcctggcctc

SEQ ID NO: 3906817 - DNA, 18 bp, Homo sapiens
tctgaggccccaggccct

SEQ ID NO: 3906818 - DNA, 21 bp, Homo sapiens
tctgaggccccttaactcatc

SEQ ID NO: 3906819 - DNA, 14 bp, Homo sapiens
tctgaggcctcatc

SEQ ID NO: 3906820 - DNA, 21 bp, Homo sapiens
tctgaggcctcatccctcgga

SEQ ID NO: 3906821 - DNA, 21 bp, Homo sapiens
tctgaggcgccccaacccgtg

SEQ ID NO: 3906822 - DNA, 14 bp, Homo sapiens
tctgaggcttccag

SEQ ID NO: 3906823 - DNA, 15 bp, Homo sapiens
tctgaggcttccaga

SEQ ID NO: 3906824 - DNA, 19 bp, Homo sapiens
tctgaggggcaactgagtc

SEQ ID NO: 3906825 - DNA, 19 bp, Homo sapiens
tctgaggtcctgagcactg

SEQ ID NO: 3906826 - DNA, 12 bp, Homo sapiens
tctgagtcctgt

SEQ ID NO: 3906827 - DNA, 21 bp, Homo sapiens
tctgagtcctgtctctgcctg

SEQ ID NO: 3906828 - DNA, 13 bp, Homo sapiens
tctgagtctgagt

SEQ ID NO: 3906829 - DNA, 17 bp, Homo sapiens
tctgagtctgagtcctg

SEQ ID NO: 3906830 - DNA, 24 bp, Homo sapiens
tctgagtttcattctcctgcctgt

SEQ ID NO: 3906831 - DNA, 19 bp, Homo sapiens
tctgataaaattgtgatgt

SEQ ID NO: 3906832 - DNA, 16 bp, Homo sapiens
tctgatacccagagca

SEQ ID NO: 3906833 - DNA, 15 bp, Homo sapiens
tctgataggaaaaga

SEQ ID NO: 3906834 - DNA, 14 bp, Homo sapiens
tctgatatgggact

SEQ ID NO: 3906835 - DNA, 20 bp, Homo sapiens
tctgatcgggataacaaaat

SEQ ID NO: 3906836 - DNA, 23 bp, Homo sapiens
tctgatcgggataacaaaatcac

SEQ ID NO: 3906837 - DNA, 17 bp, Homo sapiens
tctgatggtgagctggg

SEQ ID NO: 3906838 - DNA, 18 bp, Homo sapiens
tctgatggtgagctggga

SEQ ID NO: 3906839 - DNA, 18 bp, Homo sapiens
tctgattatcaggtactg

SEQ ID NO: 3906840 - DNA, 17 bp, Homo sapiens
tctgattggctcaccca

SEQ ID NO: 3906841 - DNA, 13 bp, Homo sapiens
tctgatttcagga

SEQ ID NO: 3906842 - DNA, 15 bp, Homo sapiens
tctgcaactagccaa

SEQ ID NO: 3906843 - DNA, 18 bp, Homo sapiens
tctgcaactagccaaggc

SEQ ID NO: 3906844 - DNA, 21 bp, Homo sapiens
tctgcaatgggcactgggatg

SEQ ID NO: 3906845 - DNA, 18 bp, Homo sapiens
tctgcactccatggccac

SEQ ID NO: 3906846 - DNA, 20 bp, Homo sapiens
tctgcactccatggccaccc

SEQ ID NO: 3906847 - DNA, 21 bp, Homo sapiens
tctgcactccatggccacccc

SEQ ID NO: 3906848 - DNA, 13 bp, Homo sapiens
tctgcactgaaaa

SEQ ID NO: 3906849 - DNA, 16 bp, Homo sapiens
tctgggaccctttcct

SEQ ID NO: 3906850 - DNA, 13 bp, Homo sapiens
tctgggaggcaga

SEQ ID NO: 3906851 - DNA, 13 bp, Homo sapiens
tctgggaggtctc

SEQ ID NO: 3906852 - DNA, 19 bp, Homo sapiens
tctgggaggtctccactga

SEQ ID NO: 3906853 - DNA, 20 bp, Homo sapiens
tctgggagtgttctgtttcc

SEQ ID NO: 3906854 - DNA, 14 bp, Homo sapiens
tctgggatggaccc

SEQ ID NO: 3906855 - DNA, 23 bp, Homo sapiens
tctgggatgtagaacttcaagaa

SEQ ID NO: 3906856 - DNA, 23 bp, Homo sapiens
tctgggcagtaaatccacagcca

SEQ ID NO: 3906857 - DNA, 13 bp, Homo sapiens
tctgggctcaggg

SEQ ID NO: 3906858 - DNA, 14 bp, Homo sapiens
tctgggctcagggc

SEQ ID NO: 3906859 - DNA, 15 bp, Homo sapiens
tctgggctcagggct

SEQ ID NO: 3906860 - DNA, 21 bp, Homo sapiens
tctggggaggaagggccagga

SEQ ID NO: 3906861 - DNA, 13 bp, Homo sapiens
tctggggccctgg

SEQ ID NO: 3906862 - DNA, 18 bp, Homo sapiens
tctggggccctgggcctc

SEQ ID NO: 3906863 - DNA, 16 bp, Homo sapiens
tctggggttcagcccc

SEQ ID NO: 3906864 - DNA, 18 bp, Homo sapiens
tctggggttcagcccctc

SEQ ID NO: 3906865 - DNA, 20 bp, Homo sapiens
tctgggttgcttatttccct

SEQ ID NO: 3906866 - DNA, 13 bp, Homo sapiens
tctggttgcttca

SEQ ID NO: 3906867 - DNA, 15 bp, Homo sapiens
tctggttttaacaat

SEQ ID NO: 3906868 - DNA, 20 bp, Homo sapiens
tctgtaacgcctgcttgtcc

SEQ ID NO: 3906869 - DNA, 20 bp, Homo sapiens
tctgtaatggaactgacccc

SEQ ID NO: 3906870 - DNA, 14 bp, Homo sapiens
tctgtactgtaatt

SEQ ID NO: 3906871 - DNA, 23 bp, Homo sapiens
tctgtataaacattaaatgtctt

SEQ ID NO: 3906872 - DNA, 15 bp, Homo sapiens
tctgtatatacaata

SEQ ID NO: 3906873 - DNA, 17 bp, Homo sapiens
tctgtatatacatttca

SEQ ID NO: 3906874 - DNA, 18 bp, Homo sapiens
tctgtatttaatggtttt

SEQ ID NO: 3906875 - DNA, 16 bp, Homo sapiens
tctgtcacgtgaaata

SEQ ID NO: 3906876 - DNA, 18 bp, Homo sapiens
tctgtcagatgggaagac

SEQ ID NO: 3906877 - DNA, 17 bp, Homo sapiens
tctgtcatctctctggg

SEQ ID NO: 3906878 - DNA, 22 bp, Homo sapiens
tctgtcatctctctggggccct

SEQ ID NO: 3906879 - DNA, 23 bp, Homo sapiens
tctgtcatctctctggggccctg

SEQ ID NO: 3906880 - DNA, 13 bp, Homo sapiens
tctgtccaaggaa

SEQ ID NO: 3906881 - DNA, 16 bp, Homo sapiens
tctgtccaggccactg

SEQ ID NO: 3906882 - DNA, 14 bp, Homo sapiens
tctgtcccctctcc

SEQ ID NO: 3906883 - DNA, 17 bp, Homo sapiens
tctgtcccctctcccct

SEQ ID NO: 3906884 - DNA, 20 bp, Homo sapiens
tctgtcccggttcaccttgc

SEQ ID NO: 3906885 - DNA, 22 bp, Homo sapiens
tctgtctcgagcgccctgcaga

SEQ ID NO: 3906886 - DNA, 23 bp, Homo sapiens
tctgtctctagtttctttctgtt

SEQ ID NO: 3906887 - DNA, 18 bp, Homo sapiens
tctgtctctcttgctttg

SEQ ID NO: 3906888 - DNA, 15 bp, Homo sapiens
tctgtctgtcccaaa

SEQ ID NO: 3906889 - DNA, 16 bp, Homo sapiens
tctgtctgtcccaaag

SEQ ID NO: 3906890 - DNA, 17 bp, Homo sapiens
tctgtgcactagcctgt

SEQ ID NO: 3906891 - DNA, 20 bp, Homo sapiens
tctgtgcactagcctgtgat

SEQ ID NO: 3906892 - DNA, 16 bp, Homo sapiens
tctgtgccagagcctg

SEQ ID NO: 3906893 - DNA, 23 bp, Homo sapiens
tctgtgccagagcctggggctct

SEQ ID NO: 3906894 - DNA, 15 bp, Homo sapiens
tctgtgctgccctgc

SEQ ID NO: 3906895 - DNA, 13 bp, Homo sapiens
tctgtgctgtgcc

SEQ ID NO: 3906896 - DNA, 14 bp, Homo sapiens
tctgtgctgtgcct

SEQ ID NO: 3906897 - DNA, 19 bp, Homo sapiens
tctgtgctgtgcctgctag

SEQ ID NO: 3906898 - DNA, 20 bp, Homo sapiens
tctgtgctgtgcctgctaga

SEQ ID NO: 3906899 - DNA, 14 bp, Homo sapiens
tctgtgtccaatta

SEQ ID NO: 3906900 - DNA, 22 bp, Homo sapiens
tctgtgtccaattatgcactgg

SEQ ID NO: 3906901 - DNA, 13 bp, Homo sapiens
tctgtgtgaaaat

SEQ ID NO: 3906902 - DNA, 18 bp, Homo sapiens
tctgtgtgcaccttacca

SEQ ID NO: 3906903 - DNA, 22 bp, Homo sapiens
tctgtgtgcaccttaccaactt

SEQ ID NO: 3906904 - DNA, 12 bp, Homo sapiens
tctgttactgaa

SEQ ID NO: 3906905 - DNA, 14 bp, Homo sapiens
tctgttatcctgct

SEQ ID NO: 3906906 - DNA, 19 bp, Homo sapiens
tctgttcacttttcctccc

SEQ ID NO: 3906907 - DNA, 22 bp, Homo sapiens
tctgttcacttttcctccctca

SEQ ID NO: 3906908 - DNA, 20 bp, Homo sapiens
tctgttccccatggccactt

SEQ ID NO: 3906909 - DNA, 23 bp, Homo sapiens
tctgttctgttgatcccacttca

SEQ ID NO: 3906910 - DNA, 17 bp, Homo sapiens
tctgttgatcccacttc

SEQ ID NO: 3906911 - DNA, 20 bp, Homo sapiens
tctgttgatcccacttcact

SEQ ID NO: 3906912 - DNA, 20 bp, Homo sapiens
tctgttgcccaggctggcct

SEQ ID NO: 3906913 - DNA, 22 bp, Homo sapiens
tctgtttctattctctcctcag

SEQ ID NO: 3906914 - DNA, 23 bp, Homo sapiens
tcttaaaagttgtgattccagat

SEQ ID NO: 3906915 - DNA, 19 bp, Homo sapiens
tcttaaagctgcctgtagt

SEQ ID NO: 3906916 - DNA, 12 bp, Homo sapiens
tcttaaatgaca

SEQ ID NO: 3906917 - DNA, 18 bp, Homo sapiens
tcttaaatgacagtgaat

SEQ ID NO: 3906918 - DNA, 21 bp, Homo sapiens
tcttaagccttttgctcacaa

SEQ ID NO: 3906919 - DNA, 14 bp, Homo sapiens
tcttaattaaaaga

SEQ ID NO: 3906920 - DNA, 19 bp, Homo sapiens
tcttacaaaaacaagacac

SEQ ID NO: 3906921 - DNA, 17 bp, Homo sapiens
tcttacaaccaagaaca

SEQ ID NO: 3906922 - DNA, 14 bp, Homo sapiens
tcttacagtggagt

SEQ ID NO: 3906923 - DNA, 14 bp, Homo sapiens
tcttaccgagaaaa

SEQ ID NO: 3906924 - DNA, 23 bp, Homo sapiens
tcttacctgtatgtctccagtat

SEQ ID NO: 3906925 - DNA, 15 bp, Homo sapiens
tcttacttggaactg

SEQ ID NO: 3906926 - DNA, 19 bp, Homo sapiens
tcttagaagtggaccagga

SEQ ID NO: 3906927 - DNA, 18 bp, Homo sapiens
tcttagctgtctgctcag

SEQ ID NO: 3906928 - DNA, 19 bp, Homo sapiens
tcttaggagcagagctctg

SEQ ID NO: 3906929 - DNA, 12 bp, Homo sapiens
tcttatgatttt

SEQ ID NO: 3906930 - DNA, 20 bp, Homo sapiens
tcttatgatttttaaaagtt

SEQ ID NO: 3906931 - DNA, 17 bp, Homo sapiens
tcttatgcttataatat

SEQ ID NO: 3906932 - DNA, 21 bp, Homo sapiens
tcttattcatgctttctcctt

SEQ ID NO: 3906933 - DNA, 22 bp, Homo sapiens
tcttattcatgctttctccttt

SEQ ID NO: 3906934 - DNA, 16 bp, Homo sapiens
tcttattcccaaacta

SEQ ID NO: 3906935 - DNA, 14 bp, Homo sapiens
tctttaacctcatc

SEQ ID NO: 3906936 - DNA, 15 bp, Homo sapiens
tctttaagtattgtt

SEQ ID NO: 3906937 - DNA, 21 bp, Homo sapiens
tctttactcccttcctggcct

SEQ ID NO: 3906938 - DNA, 12 bp, Homo sapiens
tctttactttta

SEQ ID NO: 3906939 - DNA, 20 bp, Homo sapiens
tctttcaggggggttgtgag

SEQ ID NO: 3906940 - DNA, 18 bp, Homo sapiens
tctttcccctcagagctc

SEQ ID NO: 3906941 - DNA, 19 bp, Homo sapiens
tctttcccctcagagctct

SEQ ID NO: 3906942 - DNA, 21 bp, Homo sapiens
tctttcctctccaattgtaaa

SEQ ID NO: 3906943 - DNA, 13 bp, Homo sapiens
tctttccttgtct

SEQ ID NO: 3906944 - DNA, 16 bp, Homo sapiens
tctttccttgtctctc

SEQ ID NO: 3906945 - DNA, 17 bp, Homo sapiens
tctttccttgtctctca

SEQ ID NO: 3906946 - DNA, 19 bp, Homo sapiens
tctttctaatgtgtgaatc

SEQ ID NO: 3906947 - DNA, 13 bp, Homo sapiens
tctttctggagtc

SEQ ID NO: 3906948 - DNA, 13 bp, Homo sapiens
tctttctgttatt

SEQ ID NO: 3906949 - DNA, 17 bp, Homo sapiens
tctttcttactattggt

SEQ ID NO: 3906950 - DNA, 23 bp, Homo sapiens
tctttctttttctggaaattttg

SEQ ID NO: 3906951 - DNA, 15 bp, Homo sapiens
tctttctttttctgt

SEQ ID NO: 3906952 - DNA, 18 bp, Homo sapiens
tctttctttttctgtctc

SEQ ID NO: 3906953 - DNA, 20 bp, Homo sapiens
tctttctttttctgtctctc

SEQ ID NO: 3906954 - DNA, 22 bp, Homo sapiens
tctttgagaaaggattaagata

SEQ ID NO: 3906955 - DNA, 12 bp, Homo sapiens
tctttgatggac

SEQ ID NO: 3906956 - DNA, 12 bp, Homo sapiens
tctttgcatgga

SEQ ID NO: 3906957 - DNA, 15 bp, Homo sapiens
tctttgcatggaatt

SEQ ID NO: 3906958 - DNA, 20 bp, Homo sapiens
tctttgtgacaggaaagccc

SEQ ID NO: 3906959 - DNA, 22 bp, Homo sapiens
tctttgtgacaggaaagccctc

SEQ ID NO: 3906960 - DNA, 18 bp, Homo sapiens
tctttgttggaaaagaat

SEQ ID NO: 3906961 - DNA, 21 bp, Homo sapiens
tcttttaaaatgaaatgtttt

SEQ ID NO: 3906962 - DNA, 20 bp, Homo sapiens
tcttttccactcctatggaa

SEQ ID NO: 3906963 - DNA, 13 bp, Homo sapiens
tcttttctctgtg

SEQ ID NO: 3906964 - DNA, 14 bp, Homo sapiens
tcttttggccttgt

SEQ ID NO: 3906965 - DNA, 15 bp, Homo sapiens
tctttttctgtctct

SEQ ID NO: 3906966 - DNA, 15 bp, Homo sapiens
tctttttttctttgg

SEQ ID NO: 3906967 - DNA, 16 bp, Homo sapiens
tgaaaaaaagtttaca

SEQ ID NO: 3906968 - DNA, 17 bp, Homo sapiens
tgaaaaaaagtttacaa

SEQ ID NO: 3906969 - DNA, 17 bp, Homo sapiens
tgaaaaacacggcagct

SEQ ID NO: 3906970 - DNA, 22 bp, Homo sapiens
tgaaaaacacggcagctgtagc

SEQ ID NO: 3906971 - DNA, 12 bp, Homo sapiens
tgaaaaacttcc

SEQ ID NO: 3906972 - DNA, 9 bp, Homo sapiens
tgaaaaaga

SEQ ID NO: 3906973 - DNA, 16 bp, Homo sapiens
tgaaaaatatgtgctt

SEQ ID NO: 3906974 - DNA, 19 bp, Homo sapiens
tgaaaacatttcaaagctg

SEQ ID NO: 3906975 - DNA, 14 bp, Homo sapiens
tgaaaacccagaga

SEQ ID NO: 3906976 - DNA, 17 bp, Homo sapiens
tgaaaactgtaaataca

SEQ ID NO: 3906977 - DNA, 18 bp, Homo sapiens
tgaaaactgtaaatacaa

SEQ ID NO: 3906978 - DNA, 16 bp, Homo sapiens
tgaaaagactccaaag

SEQ ID NO: 3906979 - DNA, 17 bp, Homo sapiens
tgaaaagactccaaaga

SEQ ID NO: 3906980 - DNA, 22 bp, Homo sapiens
tgaaaagactccaaagaaatgt

SEQ ID NO: 3906981 - DNA, 22 bp, Homo sapiens
tgaaaagataggtttgagttca

SEQ ID NO: 3906982 - DNA, 18 bp, Homo sapiens
tgaaaataccatcaggcc

SEQ ID NO: 3906983 - DNA, 17 bp, Homo sapiens
tgaaaatatatttaata

SEQ ID NO: 3906984 - DNA, 22 bp, Homo sapiens
tgaaaatatttgtatcacaaat

SEQ ID NO: 3906985 - DNA, 14 bp, Homo sapiens
tgaaaatcaaagta

SEQ ID NO: 3906986 - DNA, 15 bp, Homo sapiens
tgaaaatctaatatt

SEQ ID NO: 3906987 - DNA, 21 bp, Homo sapiens
tgaaaatctaatattaaaaat

SEQ ID NO: 3906988 - DNA, 22 bp, Homo sapiens
tgaaaatgagcctgtaatcctc

SEQ ID NO: 3906989 - DNA, 15 bp, Homo sapiens
tgaaaatgaggagga

SEQ ID NO: 3906990 - DNA, 21 bp, Homo sapiens
tgaaaatgggttggtgcttct

SEQ ID NO: 3906991 - DNA, 20 bp, Homo sapiens
tgaaaattaggatttcatga

SEQ ID NO: 3906992 - DNA, 18 bp, Homo sapiens
tgaaaattattttaaaca

SEQ ID NO: 3906993 - DNA, 16 bp, Homo sapiens
tgaaacagaaacaaaa

SEQ ID NO: 3906994 - DNA, 20 bp, Homo sapiens
tgaaacagatgataaatatt

SEQ ID NO: 3906995 - DNA, 13 bp, Homo sapiens
tgaaacagcctgg

SEQ ID NO: 3906996 - DNA, 21 bp, Homo sapiens
tgaaacattcacacagggctc

SEQ ID NO: 3906997 - DNA, 22 bp, Homo sapiens
tgaaactgagatgtgaacacat

SEQ ID NO: 3906998 - DNA, 18 bp, Homo sapiens
tgaaagagaaagactgat

SEQ ID NO: 3906999 - DNA, 21 bp, Homo sapiens
tgaaagagagtaccatgctgg

SEQ ID NO: 3907000 - DNA, 18 bp, Homo sapiens
tgaaagaggcagcttgaa

SEQ ID NO: 3907001 - DNA, 23 bp, Homo sapiens
tgaaagatggctgtgcctctgcc

SEQ ID NO: 3907002 - DNA, 18 bp, Homo sapiens
tgaaaggaagctccactg

SEQ ID NO: 3907003 - DNA, 21 bp, Homo sapiens
tgaaataaattggtgataagt

SEQ ID NO: 3907004 - DNA, 13 bp, Homo sapiens
tgaaataattaaa

SEQ ID NO: 3907005 - DNA, 19 bp, Homo sapiens
tgaaatacacaagtaaaca

SEQ ID NO: 3907006 - DNA, 16 bp, Homo sapiens
tgaaatctcagaattc

SEQ ID NO: 3907007 - DNA, 19 bp, Homo sapiens
tgaaatctcagaattcctt

SEQ ID NO: 3907008 - DNA, 19 bp, Homo sapiens
tgaaatcttaaaaacctgc

SEQ ID NO: 3907009 - DNA, 16 bp, Homo sapiens
tgaaatgactgtctaa

SEQ ID NO: 3907010 - DNA, 15 bp, Homo sapiens
tgaaatgggagatgg

SEQ ID NO: 3907011 - DNA, 15 bp, Homo sapiens
tgaaatgggctttaa

SEQ ID NO: 3907012 - DNA, 16 bp, Homo sapiens
tgaaatgggctttaac

SEQ ID NO: 3907013 - DNA, 14 bp, Homo sapiens
tgaaattactgaaa

SEQ ID NO: 3907014 - DNA, 18 bp, Homo sapiens
tgaaattatgtatgttta

SEQ ID NO: 3907015 - DNA, 19 bp, Homo sapiens
tgaaattatgtatgtttac

SEQ ID NO: 3907016 - DNA, 15 bp, Homo sapiens
tgaaattgaacctgg

SEQ ID NO: 3907017 - DNA, 18 bp, Homo sapiens
tgaaattgtttaagtgtt

SEQ ID NO: 3907018 - DNA, 20 bp, Homo sapiens
tgaaatttattagttaatat

SEQ ID NO: 3907019 - DNA, 17 bp, Homo sapiens
tgaaattttctagactt

SEQ ID NO: 3907020 - DNA, 18 bp, Homo sapiens
tgaaattttctagacttt

SEQ ID NO: 3907021 - DNA, 22 bp, Homo sapiens
tgaacaatacgtgaaagatgca

SEQ ID NO: 3907022 - DNA, 23 bp, Homo sapiens
tgaatttcttcactgttgaaaat

SEQ ID NO: 3907023 - DNA, 16 bp, Homo sapiens
tgaattttgttgctgt

SEQ ID NO: 3907024 - DNA, 16 bp, Homo sapiens
tgaatttttttttcct

SEQ ID NO: 3907025 - DNA, 19 bp, Homo sapiens
tgaatttttttttcctagc

SEQ ID NO: 3907026 - DNA, 20 bp, Homo sapiens
tgaatttttttttcctagcc

SEQ ID NO: 3907027 - DNA, 15 bp, Homo sapiens
tgacaaagaaaccca

SEQ ID NO: 3907028 - DNA, 17 bp, Homo sapiens
tgacaaagaaacccaag

SEQ ID NO: 3907029 - DNA, 16 bp, Homo sapiens
tgacaaagttacaaat

SEQ ID NO: 3907030 - DNA, 23 bp, Homo sapiens
tgacaagaatggaatagaaatgt

SEQ ID NO: 3907031 - DNA, 16 bp, Homo sapiens
tgacaagataaaggaa

SEQ ID NO: 3907032 - DNA, 22 bp, Homo sapiens
tgacaagggctgacctgcctct

SEQ ID NO: 3907033 - DNA, 16 bp, Homo sapiens
tgacaaggtagacatg

SEQ ID NO: 3907034 - DNA, 14 bp, Homo sapiens
tgacaataaatgtg

SEQ ID NO: 3907035 - DNA, 16 bp, Homo sapiens
tgacaatcctgaagaa

SEQ ID NO: 3907036 - DNA, 23 bp, Homo sapiens
tgacaatcctgaagaaaccacag

SEQ ID NO: 3907037 - DNA, 19 bp, Homo sapiens
tgacaatgcaatgaaacag

SEQ ID NO: 3907038 - DNA, 16 bp, Homo sapiens
tgacacaggaaaccaa

SEQ ID NO: 3907039 - DNA, 21 bp, Homo sapiens
tgacacataatttgaatggtg

SEQ ID NO: 3907040 - DNA, 17 bp, Homo sapiens
tgacacattctcttttt

SEQ ID NO: 3907041 - DNA, 18 bp, Homo sapiens
tgacaccgtccctcagtg

SEQ ID NO: 3907042 - DNA, 19 bp, Homo sapiens
tgacaccgtccctcagtga

SEQ ID NO: 3907043 - DNA, 17 bp, Homo sapiens
tgacacctaccatgctg

SEQ ID NO: 3907044 - DNA, 18 bp, Homo sapiens
tgacacctaccatgctgc

SEQ ID NO: 3907045 - DNA, 16 bp, Homo sapiens
tgacacctccatttct

SEQ ID NO: 3907046 - DNA, 11 bp, Homo sapiens
tgacactgacc

SEQ ID NO: 3907047 - DNA, 23 bp, Homo sapiens
tgacactgaccttggagagacac

SEQ ID NO: 3907048 - DNA, 14 bp, Homo sapiens
tgacagactctcgt

SEQ ID NO: 3907049 - DNA, 12 bp, Homo sapiens
tgacagctgtcc

SEQ ID NO: 3907050 - DNA, 21 bp, Homo sapiens
tgacagctgtccctgtcacca

SEQ ID NO: 3907051 - DNA, 16 bp, Homo sapiens
tgacaggaaagccctc

SEQ ID NO: 3907052 - DNA, 21 bp, Homo sapiens
tgacaggaaagccctccccct

SEQ ID NO: 3907053 - DNA, 14 bp, Homo sapiens
tgacaggcccagtg

SEQ ID NO: 3907054 - DNA, 17 bp, Homo sapiens
tgacaggttcccagcag

SEQ ID NO: 3907055 - DNA, 18 bp, Homo sapiens
tgacaggttcccagcagc

SEQ ID NO: 3907056 - DNA, 21 bp, Homo sapiens
tgacagtcccttgctgacatg

SEQ ID NO: 3907057 - DNA, 24 bp, Homo sapiens
tgacagtgtgggaggcctcgtacc

SEQ ID NO: 3907058 - DNA, 19 bp, Homo sapiens
tgacagtgttgaaaatgtt

SEQ ID NO: 3907059 - DNA, 23 bp, Homo sapiens
tgacatcacttgtacaaaataaa

SEQ ID NO: 3907060 - DNA, 19 bp, Homo sapiens
tgacatcatgttagtcttt

SEQ ID NO: 3907061 - DNA, 13 bp, Homo sapiens
tgacatcccagga

SEQ ID NO: 3907062 - DNA, 14 bp, Homo sapiens
tgacatcccaggag

SEQ ID NO: 3907063 - DNA, 12 bp, Homo sapiens
tgacatctcttt

SEQ ID NO: 3907064 - DNA, 13 bp, Homo sapiens
tgacatctctttg

SEQ ID NO: 3907065 - DNA, 12 bp, Homo sapiens
tgacatcttatt

SEQ ID NO: 3907066 - DNA, 17 bp, Homo sapiens
tgacatcttatttactt

SEQ ID NO: 3907067 - DNA, 12 bp, Homo sapiens
tgacatgccacc

SEQ ID NO: 3907068 - DNA, 15 bp, Homo sapiens
tgacatgccaccctc

SEQ ID NO: 3907069 - DNA, 19 bp, Homo sapiens
tgacatgccaccctctcca

SEQ ID NO: 3907070 - DNA, 19 bp, Homo sapiens
tgacatgccatccattctg

SEQ ID NO: 3907071 - DNA, 18 bp, Homo sapiens
tgacatgttatatatttt

SEQ ID NO: 3907072 - DNA, 21 bp, Homo sapiens
tgacattaagacacacctctg

SEQ ID NO: 3907073 - DNA, 20 bp, Homo sapiens
tgacattccttgtcaccagc

SEQ ID NO: 3907074 - DNA, 21 bp, Homo sapiens
tgacattccttgtcaccagca

SEQ ID NO: 3907075 - DNA, 22 bp, Homo sapiens
tgacattgtagagcttctggca

SEQ ID NO: 3907076 - DNA, 20 bp, Homo sapiens
tgacatttctaacatatgta

SEQ ID NO: 3907077 - DNA, 18 bp, Homo sapiens
tgacatttgacagtgtgg

SEQ ID NO: 3907078 - DNA, 19 bp, Homo sapiens
tgacatttgacagtgtggg

SEQ ID NO: 3907079 - DNA, 17 bp, Homo sapiens
tgaccaacagttccttc

SEQ ID NO: 3907080 - DNA, 16 bp, Homo sapiens
tgaccaacatggagaa

SEQ ID NO: 3907081 - DNA, 16 bp, Homo sapiens
tgaccaagagagaaag

SEQ ID NO: 3907082 - DNA, 17 bp, Homo sapiens
tgaccaagagagaaaga

SEQ ID NO: 3907083 - DNA, 20 bp, Homo sapiens
tgaccacggacgtttccatc

SEQ ID NO: 3907084 - DNA, 14 bp, Homo sapiens
tgaccacgggcctc

SEQ ID NO: 3907085 - DNA, 22 bp, Homo sapiens
tgaccagaaaacaaatcttcaa

SEQ ID NO: 3907086 - DNA, 14 bp, Homo sapiens
tgaccagacctaga

SEQ ID NO: 3907087 - DNA, 16 bp, Homo sapiens
tgaccagacctagacc

SEQ ID NO: 3907088 - DNA, 22 bp, Homo sapiens
tgaccagcctccatgctgcctc

SEQ ID NO: 3907089 - DNA, 12 bp, Homo sapiens
tgaccatgtact

SEQ ID NO: 3907090 - DNA, 16 bp, Homo sapiens
tgacccaagaggtggg

SEQ ID NO: 3907091 - DNA, 18 bp, Homo sapiens
tgacccaatgctcctgga

SEQ ID NO: 3907092 - DNA, 13 bp, Homo sapiens
tgacccacagcct

SEQ ID NO: 3907093 - DNA, 19 bp, Homo sapiens
tgacccacagcctctgcct

SEQ ID NO: 3907094 - DNA, 20 bp, Homo sapiens
tgacccacagcctctgcctg

SEQ ID NO: 3907095 - DNA, 15 bp, Homo sapiens
tgacccacatgccat

SEQ ID NO: 3907096 - DNA, 14 bp, Homo sapiens
tgacccagtccctg

SEQ ID NO: 3907097 - DNA, 15 bp, Homo sapiens
tgacccagtccctgg

SEQ ID NO: 3907098 - DNA, 15 bp, Homo sapiens
tgaccccctcccctg

SEQ ID NO: 3907099 - DNA, 22 bp, Homo sapiens
tgaccctccaccgcagaaggaa

SEQ ID NO: 3907100 - DNA, 14 bp, Homo sapiens
tgaccctccctacc

SEQ ID NO: 3907101 - DNA, 14 bp, Homo sapiens
tgacccttcagggc

SEQ ID NO: 3907102 - DNA, 20 bp, Homo sapiens
tgacccttcagggccagaag

SEQ ID NO: 3907103 - DNA, 20 bp, Homo sapiens
tgacccttccagacatacga

SEQ ID NO: 3907104 - DNA, 21 bp, Homo sapiens
tgacccttccagacatacgaa

SEQ ID NO: 3907105 - DNA, 21 bp, Homo sapiens
tgacccttcccaatcagcact

SEQ ID NO: 3907106 - DNA, 13 bp, Homo sapiens
tgaccggcacctg

SEQ ID NO: 3907107 - DNA, 16 bp, Homo sapiens
tgaccggcacctgcga

SEQ ID NO: 3907108 - DNA, 13 bp, Homo sapiens
tgacctcagctgc

SEQ ID NO: 3907109 - DNA, 13 bp, Homo sapiens
tgacctccagctt

SEQ ID NO: 3907110 - DNA, 18 bp, Homo sapiens
tgacctccagctttcctg

SEQ ID NO: 3907111 - DNA, 23 bp, Homo sapiens
tgacctcccagccctatggatgt

SEQ ID NO: 3907112 - DNA, 16 bp, Homo sapiens
tgacctgatcacctct

SEQ ID NO: 3907113 - DNA, 22 bp, Homo sapiens
tgacctgctgagctctgagagg

SEQ ID NO: 3907114 - DNA, 12 bp, Homo sapiens
tgacgcatcctg

SEQ ID NO: 3907115 - DNA, 12 bp, Homo sapiens
tgacgccctgcg

SEQ ID NO: 3907116 - DNA, 22 bp, Homo sapiens
tgacgccctgcgttggagccac

SEQ ID NO: 3907117 - DNA, 16 bp, Homo sapiens
tgacggacgtcctgct

SEQ ID NO: 3907118 - DNA, 19 bp, Homo sapiens
tgacggatgattggattat

SEQ ID NO: 3907119 - DNA, 16 bp, Homo sapiens
tgacgggaggcctcag

SEQ ID NO: 3907120 - DNA, 17 bp, Homo sapiens
tgacgggaggcctcagt

SEQ ID NO: 3907121 - DNA, 19 bp, Homo sapiens
tgacggtcccacactggtg

SEQ ID NO: 3907122 - DNA, 20 bp, Homo sapiens
tgacggtcctttaggcagcc

SEQ ID NO: 3907123 - DNA, 21 bp, Homo sapiens
tgactataaacattaaaagaa

SEQ ID NO: 3907124 - DNA, 15 bp, Homo sapiens
tgactatcacataca

SEQ ID NO: 3907125 - DNA, 20 bp, Homo sapiens
tgactatcacatacaatttg

SEQ ID NO: 3907126 - DNA, 22 bp, Homo sapiens
tgactatcacatacaatttgca

SEQ ID NO: 3907127 - DNA, 23 bp, Homo sapiens
tgactatcacatacaatttgcac

SEQ ID NO: 3907128 - DNA, 20 bp, Homo sapiens
tgactcacaagaagaccaga

SEQ ID NO: 3907129 - DNA, 12 bp, Homo sapiens
tgactcacccaa

SEQ ID NO: 3907130 - DNA, 21 bp, Homo sapiens
tgactcagcatacctgctggt

SEQ ID NO: 3907131 - DNA, 19 bp, Homo sapiens
tgactccaagaacaattgt

SEQ ID NO: 3907132 - DNA, 14 bp, Homo sapiens
tgactccagagtct

SEQ ID NO: 3907133 - DNA, 21 bp, Homo sapiens
tgactccagagtctgagcccc

SEQ ID NO: 3907134 - DNA, 20 bp, Homo sapiens
tgactccagcctgccctcag

SEQ ID NO: 3907135 - DNA, 13 bp, Homo sapiens
tgactccctgtgg

SEQ ID NO: 3907136 - DNA, 20 bp, Homo sapiens
tgactcggtgtaaaaccatg

SEQ ID NO: 3907137 - DNA, 18 bp, Homo sapiens
tgactgaaggggcacacc

SEQ ID NO: 3907138 - DNA, 20 bp, Homo sapiens
tgactgaatttgggcctctt

SEQ ID NO: 3907139 - DNA, 11 bp, Homo sapiens
tgactgagctt

SEQ ID NO: 3907140 - DNA, 20 bp, Homo sapiens
tgactgccccaactcctgga

SEQ ID NO: 3907141 - DNA, 20 bp, Homo sapiens
tgactgctccccagccctgg

SEQ ID NO: 3907142 - DNA, 21 bp, Homo sapiens
tgactgggtttctctgtatag

SEQ ID NO: 3907143 - DNA, 14 bp, Homo sapiens
tgactgtaattaat

SEQ ID NO: 3907144 - DNA, 13 bp, Homo sapiens
tgactgtcactgt

SEQ ID NO: 3907145 - DNA, 22 bp, Homo sapiens
tgactgtcccaccgggagcctc

SEQ ID NO: 3907146 - DNA, 18 bp, Homo sapiens
tgactgtcgtgtttacaa

SEQ ID NO: 3907147 - DNA, 19 bp, Homo sapiens
tgactgtcgtgtttacaaa

SEQ ID NO: 3907148 - DNA, 21 bp, Homo sapiens
tgacttcctcgcctctcccac

SEQ ID NO: 3907149 - DNA, 14 bp, Homo sapiens
tgacttcctggtga

SEQ ID NO: 3907150 - DNA, 17 bp, Homo sapiens
tgacttcctggtgaggc

SEQ ID NO: 3907151 - DNA, 23 bp, Homo sapiens
tgacttctaagtaaaaccacagc

SEQ ID NO: 3907152 - DNA, 21 bp, Homo sapiens
tgacttcttggtttggggaga

SEQ ID NO: 3907153 - DNA, 16 bp, Homo sapiens
tgacttgcacatctct

SEQ ID NO: 3907154 - DNA, 17 bp, Homo sapiens
tgacttgggcaccccca

SEQ ID NO: 3907155 - DNA, 14 bp, Homo sapiens
tgactttagaaaca

SEQ ID NO: 3907156 - DNA, 18 bp, Homo sapiens
tgacttttccaagccctt

SEQ ID NO: 3907157 - DNA, 19 bp, Homo sapiens
tgacttttccatgtatcta

SEQ ID NO: 3907158 - DNA, 13 bp, Homo sapiens
tgactttttataa

SEQ ID NO: 3907159 - DNA, 21 bp, Homo sapiens
tgagaaactttgatctctgct

SEQ ID NO: 3907160 - DNA, 17 bp, Homo sapiens
tgagaaagactattcaa

SEQ ID NO: 3907161 - DNA, 19 bp, Homo sapiens
tgagaaagggtagaattct

SEQ ID NO: 3907162 - DNA, 22 bp, Homo sapiens
tgagaacaagtcacagctgcag

SEQ ID NO: 3907163 - DNA, 12 bp, Homo sapiens
tgagaacctggc

SEQ ID NO: 3907164 - DNA, 23 bp, Homo sapiens
tgagaagagggcctgtgggagcc

SEQ ID NO: 3907165 - DNA, 16 bp, Homo sapiens
tgagaagggaaatctt

SEQ ID NO: 3907166 - DNA, 18 bp, Homo sapiens
tgagaagttttgtacaga

SEQ ID NO: 3907167 - DNA, 14 bp, Homo sapiens
tgagaatcctgcct

SEQ ID NO: 3907168 - DNA, 15 bp, Homo sapiens
tgagaatcctgcctc

SEQ ID NO: 3907169 - DNA, 17 bp, Homo sapiens
tgagaatcctgcctctc

SEQ ID NO: 3907170 - DNA, 12 bp, Homo sapiens
tgagaattattc

SEQ ID NO: 3907171 - DNA, 15 bp, Homo sapiens
tgagaattccaagga

SEQ ID NO: 3907172 - DNA, 20 bp, Homo sapiens
tgagaatttggatacactct

SEQ ID NO: 3907173 - DNA, 15 bp, Homo sapiens
tgagaattttaaatt

SEQ ID NO: 3907174 - DNA, 23 bp, Homo sapiens
tgagaattttaaattataactta

SEQ ID NO: 3907175 - DNA, 12 bp, Homo sapiens
tgagacaagccc

SEQ ID NO: 3907176 - DNA, 13 bp, Homo sapiens
tgagacaagccct

SEQ ID NO: 3907177 - DNA, 23 bp, Homo sapiens
tgagacacagagtggagccctca

SEQ ID NO: 3907178 - DNA, 12 bp, Homo sapiens
tgagaccagttg

SEQ ID NO: 3907179 - DNA, 21 bp, Homo sapiens
tgagaccagttgggagcactg

SEQ ID NO: 3907180 - DNA, 23 bp, Homo sapiens
tgagaccctcgccacggggaggg

SEQ ID NO: 3907181 - DNA, 20 bp, Homo sapiens
tgagacctcgccggccttgt

SEQ ID NO: 3907182 - DNA, 23 bp, Homo sapiens
tgagacggcagagaccccaggat

SEQ ID NO: 3907183 - DNA, 15 bp, Homo sapiens
tgagactcgtctcaa

SEQ ID NO: 3907184 - DNA, 17 bp, Homo sapiens
tgagagaagccacgctg

SEQ ID NO: 3907185 - DNA, 22 bp, Homo sapiens
tgagagaagccacgctgtcctc

SEQ ID NO: 3907186 - DNA, 19 bp, Homo sapiens
tgagagaattgtatcattt

SEQ ID NO: 3907187 - DNA, 12 bp, Homo sapiens
tgagagactttt

SEQ ID NO: 3907188 - DNA, 19 bp, Homo sapiens
tgagagccctgctgtggga

SEQ ID NO: 3907189 - DNA, 16 bp, Homo sapiens
tgagagctgctctgga

SEQ ID NO: 3907190 - DNA, 19 bp, Homo sapiens
tgagagctgctctggaaaa

SEQ ID NO: 3907191 - DNA, 21 bp, Homo sapiens
tgagaggaagatgaagagaag

SEQ ID NO: 3907192 - DNA, 17 bp, Homo sapiens
tgagaggccctggatca

SEQ ID NO: 3907193 - DNA, 23 bp, Homo sapiens
tgagaggccctggatcagcgtgg

SEQ ID NO: 3907194 - DNA, 17 bp, Homo sapiens
tgagagtatcaggtctc

SEQ ID NO: 3907195 - DNA, 20 bp, Homo sapiens
tgagagtctgaaagacagaa

SEQ ID NO: 3907196 - DNA, 18 bp, Homo sapiens
tgagatttgccagcacag

SEQ ID NO: 3907197 - DNA, 22 bp, Homo sapiens
tgagatttgccagcacaggggc

SEQ ID NO: 3907198 - DNA, 15 bp, Homo sapiens
tgagcaaatgtggct

SEQ ID NO: 3907199 - DNA, 14 bp, Homo sapiens
tgagcaattcattt

SEQ ID NO: 3907200 - DNA, 17 bp, Homo sapiens
tgagcactgccaggagg

SEQ ID NO: 3907201 - DNA, 19 bp, Homo sapiens
tgagcactgccaggaggga

SEQ ID NO: 3907202 - DNA, 11 bp, Homo sapiens
tgagcagaccg

SEQ ID NO: 3907203 - DNA, 15 bp, Homo sapiens
tgagcaggattttaa

SEQ ID NO: 3907204 - DNA, 19 bp, Homo sapiens
tgagcaggcccgacagaga

SEQ ID NO: 3907205 - DNA, 15 bp, Homo sapiens
tgagcataatgctcc

SEQ ID NO: 3907206 - DNA, 21 bp, Homo sapiens
tgagcattttatatccacatc

SEQ ID NO: 3907207 - DNA, 19 bp, Homo sapiens
tgagccaaacacactgtaa

SEQ ID NO: 3907208 - DNA, 20 bp, Homo sapiens
tgagccaaacacactgtaaa

SEQ ID NO: 3907209 - DNA, 22 bp, Homo sapiens
tgagccactcgcagtcgcagga

SEQ ID NO: 3907210 - DNA, 23 bp, Homo sapiens
tgagccatgatcgagccactgca

SEQ ID NO: 3907211 - DNA, 13 bp, Homo sapiens
tgagcccaggagt

SEQ ID NO: 3907212 - DNA, 22 bp, Homo sapiens
tgagcccaggagtttgagacaa

SEQ ID NO: 3907213 - DNA, 14 bp, Homo sapiens
tgagcccaggccgt

SEQ ID NO: 3907214 - DNA, 13 bp, Homo sapiens
tgagcccagggag

SEQ ID NO: 3907215 - DNA, 15 bp, Homo sapiens
tgagcccccggctag

SEQ ID NO: 3907216 - DNA, 20 bp, Homo sapiens
tgagcctaaatctaatcagg

SEQ ID NO: 3907217 - DNA, 13 bp, Homo sapiens
tgagcctgccgag

SEQ ID NO: 3907218 - DNA, 19 bp, Homo sapiens
tgagcctgtaatcctcagc

SEQ ID NO: 3907219 - DNA, 22 bp, Homo sapiens
tgagctagaagctggaggacta

SEQ ID NO: 3907220 - DNA, 23 bp, Homo sapiens
tgagctatgattatgccactgct

SEQ ID NO: 3907221 - DNA, 16 bp, Homo sapiens
tgagctcagaccccca

SEQ ID NO: 3907222 - DNA, 18 bp, Homo sapiens
tgagctcagacccccact

SEQ ID NO: 3907223 - DNA, 20 bp, Homo sapiens
tgagctctgaacaaacactg

SEQ ID NO: 3907224 - DNA, 12 bp, Homo sapiens
tgagctctgaga

SEQ ID NO: 3907225 - DNA, 17 bp, Homo sapiens
tgagctctgagaggccc

SEQ ID NO: 3907226 - DNA, 18 bp, Homo sapiens
tgagctctgagaggccct

SEQ ID NO: 3907227 - DNA, 21 bp, Homo sapiens
tgagctctgagaggccctgga

SEQ ID NO: 3907228 - DNA, 12 bp, Homo sapiens
tgagctgggaag

SEQ ID NO: 3907229 - DNA, 21 bp, Homo sapiens
tgagctgggaagctgtactca

SEQ ID NO: 3907230 - DNA, 20 bp, Homo sapiens
tgagctggggcctggagagg

SEQ ID NO: 3907231 - DNA, 22 bp, Homo sapiens
tgagctgtatatatatatgtgt

SEQ ID NO: 3907232 - DNA, 17 bp, Homo sapiens
tgagcttttcatggaag

SEQ ID NO: 3907233 - DNA, 17 bp, Homo sapiens
tgaggaaagcacacagt

SEQ ID NO: 3907234 - DNA, 18 bp, Homo sapiens
tgaggaattttctttgtg

SEQ ID NO: 3907235 - DNA, 15 bp, Homo sapiens
tgaggacaaagagaa

SEQ ID NO: 3907236 - DNA, 13 bp, Homo sapiens
tgaggacacatgt

SEQ ID NO: 3907237 - DNA, 16 bp, Homo sapiens
tgaggacacatgtcca

SEQ ID NO: 3907238 - DNA, 21 bp, Homo sapiens
tgaggacatggagagagactc

SEQ ID NO: 3907239 - DNA, 20 bp, Homo sapiens
tgaggactcatatatttaag

SEQ ID NO: 3907240 - DNA, 16 bp, Homo sapiens
tgaggagagaaggaca

SEQ ID NO: 3907241 - DNA, 17 bp, Homo sapiens
tgaggagggtggaggaa

SEQ ID NO: 3907242 - DNA, 18 bp, Homo sapiens
tgaggagggtggaggaag

SEQ ID NO: 3907243 - DNA, 20 bp, Homo sapiens
tgaggagtagctgagaggaa

SEQ ID NO: 3907244 - DNA, 14 bp, Homo sapiens
tgaggagtctgagg

SEQ ID NO: 3907245 - DNA, 15 bp, Homo sapiens
tgaggagtctgaggt

SEQ ID NO: 3907246 - DNA, 16 bp, Homo sapiens
tgaggagtctgaggtc

SEQ ID NO: 3907247 - DNA, 19 bp, Homo sapiens
tgaggatcctcacaggagc

SEQ ID NO: 3907248 - DNA, 24 bp, Homo sapiens
tgaggatcctcacaggagcagaca

SEQ ID NO: 3907249 - DNA, 23 bp, Homo sapiens
tgaggatctagcttcatgcctca

SEQ ID NO: 3907250 - DNA, 13 bp, Homo sapiens
tgaggatgacaga

SEQ ID NO: 3907251 - DNA, 17 bp, Homo sapiens
tgaggatgtgagcctga

SEQ ID NO: 3907252 - DNA, 16 bp, Homo sapiens
tgaggatttcaagcct

SEQ ID NO: 3907253 - DNA, 21 bp, Homo sapiens
tgaggcaaaggccagcagcag

SEQ ID NO: 3907254 - DNA, 16 bp, Homo sapiens
tgaggcactgataata

SEQ ID NO: 3907255 - DNA, 18 bp, Homo sapiens
tgaggcagggcaaatgac

SEQ ID NO: 3907256 - DNA, 12 bp, Homo sapiens
tgaggccagcct

SEQ ID NO: 3907257 - DNA, 15 bp, Homo sapiens
tgaggccagcctggc

SEQ ID NO: 3907258 - DNA, 17 bp, Homo sapiens
tgaggccagcctggcct

SEQ ID NO: 3907259 - DNA, 18 bp, Homo sapiens
tgaggccagcctggcctc

SEQ ID NO: 3907260 - DNA, 17 bp, Homo sapiens
tgaggcccagcctgtcc

SEQ ID NO: 3907261 - DNA, 19 bp, Homo sapiens
tgaggcccagcctgtcctg

SEQ ID NO: 3907262 - DNA, 19 bp, Homo sapiens
tgaggcctaaaagtaaaca

SEQ ID NO: 3907263 - DNA, 21 bp, Homo sapiens
tgaggcctcttggacctctgc

SEQ ID NO: 3907264 - DNA, 17 bp, Homo sapiens
tgaggcctgccctcagg

SEQ ID NO: 3907265 - DNA, 17 bp, Homo sapiens
tgaggcctggccaggca

SEQ ID NO: 3907266 - DNA, 16 bp, Homo sapiens
tgaggctcaagaggcc

SEQ ID NO: 3907267 - DNA, 19 bp, Homo sapiens
tgaggctcaagaggcccag

SEQ ID NO: 3907268 - DNA, 20 bp, Homo sapiens
tgaggctcaagaggcccagg

SEQ ID NO: 3907269 - DNA, 21 bp, Homo sapiens
tgaggctcaagaggcccaggg

SEQ ID NO: 3907270 - DNA, 21 bp, Homo sapiens
tgaggctctgacccagtgaga

SEQ ID NO: 3907271 - DNA, 22 bp, Homo sapiens
tgaggctgggccagcctcagct

SEQ ID NO: 3907272 - DNA, 15 bp, Homo sapiens
tgaggcttccaggct

SEQ ID NO: 3907273 - DNA, 17 bp, Homo sapiens
tgaggcttccaggctct

SEQ ID NO: 3907274 - DNA, 18 bp, Homo sapiens
tgaggcttccaggctctt

SEQ ID NO: 3907275 - DNA, 20 bp, Homo sapiens
tgaggcttccaggctcttcc

SEQ ID NO: 3907276 - DNA, 21 bp, Homo sapiens
tgaggcttccaggctcttcct

SEQ ID NO: 3907277 - DNA, 16 bp, Homo sapiens
tgagggaacagacagg

SEQ ID NO: 3907278 - DNA, 20 bp, Homo sapiens
tgagggaacagacaggagaa

SEQ ID NO: 3907279 - DNA, 14 bp, Homo sapiens
tgagggcagcagcc

SEQ ID NO: 3907280 - DNA, 15 bp, Homo sapiens
tgagggcagcagcca

SEQ ID NO: 3907281 - DNA, 23 bp, Homo sapiens
tgagggcagcagccagccctgcc

SEQ ID NO: 3907282 - DNA, 19 bp, Homo sapiens
tgagggcagtggggagcat

SEQ ID NO: 3907283 - DNA, 18 bp, Homo sapiens
tgagggcagttcgcagcc

SEQ ID NO: 3907284 - DNA, 11 bp, Homo sapiens
tgagggctggg

SEQ ID NO: 3907285 - DNA, 21 bp, Homo sapiens
tgagggtaataaacttagaat

SEQ ID NO: 3907286 - DNA, 15 bp, Homo sapiens
tgaggtcactgggtt

SEQ ID NO: 3907287 - DNA, 15 bp, Homo sapiens
tgaggtcctgagcac

SEQ ID NO: 3907288 - DNA, 21 bp, Homo sapiens
tgaggtcctgagcactgccag

SEQ ID NO: 3907289 - DNA, 17 bp, Homo sapiens
tgaggtgaaatgggaga

SEQ ID NO: 3907290 - DNA, 20 bp, Homo sapiens
tgaggtggaagccctccttc

SEQ ID NO: 3907291 - DNA, 15 bp, Homo sapiens
tgaggttaaaatata

SEQ ID NO: 3907292 - DNA, 16 bp, Homo sapiens
tgaggttaaaatataa

SEQ ID NO: 3907293 - DNA, 14 bp, Homo sapiens
tgagtaaattggaa

SEQ ID NO: 3907294 - DNA, 15 bp, Homo sapiens
tgagtacagcagaaa

SEQ ID NO: 3907295 - DNA, 18 bp, Homo sapiens
tgagtacagtgaggaggg

SEQ ID NO: 3907296 - DNA, 19 bp, Homo sapiens
tgagtacagtgaggagggt

SEQ ID NO: 3907297 - DNA, 21 bp, Homo sapiens
tgagtacagtgaggagggtgg

SEQ ID NO: 3907298 - DNA, 21 bp, Homo sapiens
tgagtactagaatttgtattt

SEQ ID NO: 3907299 - DNA, 15 bp, Homo sapiens
tgagtatacaatata

SEQ ID NO: 3907300 - DNA, 15 bp, Homo sapiens
tgagtcaaaagcctg

SEQ ID NO: 3907301 - DNA, 18 bp, Homo sapiens
tgagtcaaaagcctgggt

SEQ ID NO: 3907302 - DNA, 13 bp, Homo sapiens
tgagtcaccagga

SEQ ID NO: 3907303 - DNA, 13 bp, Homo sapiens
tgagtcacctcct

SEQ ID NO: 3907304 - DNA, 14 bp, Homo sapiens
tgagtcacctcctc

SEQ ID NO: 3907305 - DNA, 15 bp, Homo sapiens
tgagtcacctcctcc

SEQ ID NO: 3907306 - DNA, 16 bp, Homo sapiens
tgagtcctgtctctgc

SEQ ID NO: 3907307 - DNA, 23 bp, Homo sapiens
tgagtcggccccacatgggaacc

SEQ ID NO: 3907308 - DNA, 20 bp, Homo sapiens
tgagtctcttttttattctg

SEQ ID NO: 3907309 - DNA, 15 bp, Homo sapiens
tgagtctgagtcctg

SEQ ID NO: 3907310 - DNA, 21 bp, Homo sapiens
tgagtctgagtcctgtctctg

SEQ ID NO: 3907311 - DNA, 17 bp, Homo sapiens
tgagtgaatggcaaagc

SEQ ID NO: 3907312 - DNA, 23 bp, Homo sapiens
tgagtgagaggcgacaggagtat

SEQ ID NO: 3907313 - DNA, 15 bp, Homo sapiens
tgagtggatggatgg

SEQ ID NO: 3907314 - DNA, 18 bp, Homo sapiens
tgagtggatggatggaca

SEQ ID NO: 3907315 - DNA, 15 bp, Homo sapiens
tgagtggcagccatg

SEQ ID NO: 3907316 - DNA, 18 bp, Homo sapiens
tgagtgtcttaattaaaa

SEQ ID NO: 3907317 - DNA, 23 bp, Homo sapiens
tgagtgttcattttagtgactgt

SEQ ID NO: 3907318 - DNA, 21 bp, Homo sapiens
tgagttacttgtctgaggcct

SEQ ID NO: 3907319 - DNA, 14 bp, Homo sapiens
tgagttattttaat

SEQ ID NO: 3907320 - DNA, 13 bp, Homo sapiens
tgagttggacaca

SEQ ID NO: 3907321 - DNA, 18 bp, Homo sapiens
tgagtttcattctcctgc

SEQ ID NO: 3907322 - DNA, 21 bp, Homo sapiens
tgataaacattaaacactgta

SEQ ID NO: 3907323 - DNA, 11 bp, Homo sapiens
tgataaatatt

SEQ ID NO: 3907324 - DNA, 17 bp, Homo sapiens
tgataacaacctggaga

SEQ ID NO: 3907325 - DNA, 16 bp, Homo sapiens
tgataagcaggaagga

SEQ ID NO: 3907326 - DNA, 12 bp, Homo sapiens
tgataagtggaa

SEQ ID NO: 3907327 - DNA, 13 bp, Homo sapiens
tgatacccagagc

SEQ ID NO: 3907328 - DNA, 19 bp, Homo sapiens
tgataccctgcttggtcaa

SEQ ID NO: 3907329 - DNA, 16 bp, Homo sapiens
tgatactgcaataaat

SEQ ID NO: 3907330 - DNA, 16 bp, Homo sapiens
tgatacttcaggtgct

SEQ ID NO: 3907331 - DNA, 20 bp, Homo sapiens
tgatatcacctctcttcagc

SEQ ID NO: 3907332 - DNA, 16 bp, Homo sapiens
tgatattaaaggagtt

SEQ ID NO: 3907333 - DNA, 14 bp, Homo sapiens
tgatcaaaaataaa

SEQ ID NO: 3907334 - DNA, 16 bp, Homo sapiens
tgatcaaaaataaact

SEQ ID NO: 3907335 - DNA, 17 bp, Homo sapiens
tgatcaaaaataaacta

SEQ ID NO: 3907336 - DNA, 16 bp, Homo sapiens
tgatcaaattcatttt

SEQ ID NO: 3907337 - DNA, 22 bp, Homo sapiens
tgatcaaattcatttttttcac

SEQ ID NO: 3907338 - DNA, 23 bp, Homo sapiens
tgatcaaattcatttttttcact

SEQ ID NO: 3907339 - DNA, 20 bp, Homo sapiens
tgatcacagtggcgagagga

SEQ ID NO: 3907340 - DNA, 21 bp, Homo sapiens
tgatcactttgttaaaaatat

SEQ ID NO: 3907341 - DNA, 21 bp, Homo sapiens
tgatcagaaggctggggccag

SEQ ID NO: 3907342 - DNA, 14 bp, Homo sapiens
tgatcatggtcagc

SEQ ID NO: 3907343 - DNA, 19 bp, Homo sapiens
tgatcatggtcagctcaca

SEQ ID NO: 3907344 - DNA, 21 bp, Homo sapiens
tgatcattacatggctgtggt

SEQ ID NO: 3907345 - DNA, 23 bp, Homo sapiens
tgatccctttcccatgatccaga

SEQ ID NO: 3907346 - DNA, 20 bp, Homo sapiens
tgatcctaactgaagagaca

SEQ ID NO: 3907347 - DNA, 20 bp, Homo sapiens
tgatccttttatgttattta

SEQ ID NO: 3907348 - DNA, 15 bp, Homo sapiens
tgatcgagccactgc

SEQ ID NO: 3907349 - DNA, 21 bp, Homo sapiens
tgatctatagatgacctagaa

SEQ ID NO: 3907350 - DNA, 16 bp, Homo sapiens
tgatctccctgccgcc

SEQ ID NO: 3907351 - DNA, 14 bp, Homo sapiens
tgatctctccacgg

SEQ ID NO: 3907352 - DNA, 15 bp, Homo sapiens
tgatctgtatataca

SEQ ID NO: 3907353 - DNA, 19 bp, Homo sapiens
tgatctgtatatacaataa

SEQ ID NO: 3907354 - DNA, 15 bp, Homo sapiens
tgatctgtatttaat

SEQ ID NO: 3907355 - DNA, 15 bp, Homo sapiens
tgatctgtcccctct

SEQ ID NO: 3907356 - DNA, 16 bp, Homo sapiens
tgatgaaaataataaa

SEQ ID NO: 3907357 - DNA, 17 bp, Homo sapiens
tgatgaaattcttgaag

SEQ ID NO: 3907358 - DNA, 14 bp, Homo sapiens
tgatgaactttctc

SEQ ID NO: 3907359 - DNA, 15 bp, Homo sapiens
tgatgacagagcgag

SEQ ID NO: 3907360 - DNA, 18 bp, Homo sapiens
tgatgaggcctcttggac

SEQ ID NO: 3907361 - DNA, 22 bp, Homo sapiens
tgatgaggcctcttggacctct

SEQ ID NO: 3907362 - DNA, 13 bp, Homo sapiens
tgatgagggcagc

SEQ ID NO: 3907363 - DNA, 15 bp, Homo sapiens
tgatgagggcagcag

SEQ ID NO: 3907364 - DNA, 23 bp, Homo sapiens
tgatgagggcagcagccagccct

SEQ ID NO: 3907365 - DNA, 17 bp, Homo sapiens
tgatgatctttaaaata

SEQ ID NO: 3907366 - DNA, 16 bp, Homo sapiens
tgatgatgatgatgat

SEQ ID NO: 3907367 - DNA, 17 bp, Homo sapiens
tgatgatgatgatgatg

SEQ ID NO: 3907368 - DNA, 19 bp, Homo sapiens
tgatgatgtctcttgtaga

SEQ ID NO: 3907369 - DNA, 22 bp, Homo sapiens
tgatgattaaacacctgacaca

SEQ ID NO: 3907370 - DNA, 22 bp, Homo sapiens
tgatgcatcagaaagggagggc

SEQ ID NO: 3907371 - DNA, 15 bp, Homo sapiens
tgatgcatttccaca

SEQ ID NO: 3907372 - DNA, 16 bp, Homo sapiens
tgatgcatttccacac

SEQ ID NO: 3907373 - DNA, 20 bp, Homo sapiens
tgatgccacttcccagaggc

SEQ ID NO: 3907374 - DNA, 16 bp, Homo sapiens
tgatgcgaaaacttga

SEQ ID NO: 3907375 - DNA, 21 bp, Homo sapiens
tgatgcgaaaacttgaatctg

SEQ ID NO: 3907376 - DNA, 14 bp, Homo sapiens
tgatgctcaggctt

SEQ ID NO: 3907377 - DNA, 11 bp, Homo sapiens
tgatgctgccc

SEQ ID NO: 3907378 - DNA, 22 bp, Homo sapiens
tgatgctgccccgttccctgtc

SEQ ID NO: 3907379 - DNA, 18 bp, Homo sapiens
tgatggaccgggtgggcc

SEQ ID NO: 3907380 - DNA, 19 bp, Homo sapiens
tgatggaccgggtgggcct

SEQ ID NO: 3907381 - DNA, 16 bp, Homo sapiens
tgatggccaagagcat

SEQ ID NO: 3907382 - DNA, 15 bp, Homo sapiens
tgatggccaaggggg

SEQ ID NO: 3907383 - DNA, 21 bp, Homo sapiens
tgatggcgcgggaggcaccag

SEQ ID NO: 3907384 - DNA, 23 bp, Homo sapiens
tgatggcgcgggaggcaccagct

SEQ ID NO: 3907385 - DNA, 13 bp, Homo sapiens
tgatggggagaaa

SEQ ID NO: 3907386 - DNA, 13 bp, Homo sapiens
tgatggtgagctg

SEQ ID NO: 3907387 - DNA, 15 bp, Homo sapiens
tgatggtgctgacct

SEQ ID NO: 3907388 - DNA, 13 bp, Homo sapiens
tgatgtacatgtg

SEQ ID NO: 3907389 - DNA, 16 bp, Homo sapiens
tgatgtacatgtgtag

SEQ ID NO: 3907390 - DNA, 21 bp, Homo sapiens
tgatgtcatgtacttcctgtg

SEQ ID NO: 3907391 - DNA, 17 bp, Homo sapiens
tgatgtcattaatgtgt

SEQ ID NO: 3907392 - DNA, 16 bp, Homo sapiens
tgatgtctcttgtaga

SEQ ID NO: 3907393 - DNA, 22 bp, Homo sapiens
tgatgtgctggagctggctttg

SEQ ID NO: 3907394 - DNA, 23 bp, Homo sapiens
tgatgttaactattattaataaa

SEQ ID NO: 3907395 - DNA, 13 bp, Homo sapiens
tgatgtttccaga

SEQ ID NO: 3907396 - DNA, 15 bp, Homo sapiens
tgatgtttccagaaa

SEQ ID NO: 3907397 - DNA, 15 bp, Homo sapiens
tgatgttttgttcaa

SEQ ID NO: 3907398 - DNA, 16 bp, Homo sapiens
tgatgttttgttcaaa

SEQ ID NO: 3907399 - DNA, 12 bp, Homo sapiens
tgattaaacacc

SEQ ID NO: 3907400 - DNA, 15 bp, Homo sapiens
tgattaaacacctga

SEQ ID NO: 3907401 - DNA, 17 bp, Homo sapiens
tgattaaacacctgaca

SEQ ID NO: 3907402 - DNA, 19 bp, Homo sapiens
tgattaaacacctgacaca

SEQ ID NO: 3907403 - DNA, 11 bp, Homo sapiens
tgattatcagg

SEQ ID NO: 3907404 - DNA, 20 bp, Homo sapiens
tgattattttcattacaatg

SEQ ID NO: 3907405 - DNA, 21 bp, Homo sapiens
tgattattttcattacaatgg

SEQ ID NO: 3907406 - DNA, 17 bp, Homo sapiens
tgattcactattagaga

SEQ ID NO: 3907407 - DNA, 15 bp, Homo sapiens
tgattcataacaatg

SEQ ID NO: 3907408 - DNA, 19 bp, Homo sapiens
tgattcatgccaattagca

SEQ ID NO: 3907409 - DNA, 22 bp, Homo sapiens
tgattccttgatggagatattt

SEQ ID NO: 3907410 - DNA, 20 bp, Homo sapiens
tgattccttttgatggggag

SEQ ID NO: 3907411 - DNA, 23 bp, Homo sapiens
tgattccttttgatggggagaaa

SEQ ID NO: 3907412 - DNA, 23 bp, Homo sapiens
tgattctcctgtcagagatctgg

SEQ ID NO: 3907413 - DNA, 12 bp, Homo sapiens
tgattctgggat

SEQ ID NO: 3907414 - DNA, 22 bp, Homo sapiens
tgattctgggatggaccctcgc

SEQ ID NO: 3907415 - DNA, 16 bp, Homo sapiens
tgattggattattcat

SEQ ID NO: 3907416 - DNA, 19 bp, Homo sapiens
tgattggattattcattta

SEQ ID NO: 3907417 - DNA, 21 bp, Homo sapiens
tgattggattattcatttaaa

SEQ ID NO: 3907418 - DNA, 14 bp, Homo sapiens
tgattgggtgccat

SEQ ID NO: 3907419 - DNA, 12 bp, Homo sapiens
tgattgtaaaat

SEQ ID NO: 3907420 - DNA, 17 bp, Homo sapiens
tgattgtaaaatagctt

SEQ ID NO: 3907421 - DNA, 18 bp, Homo sapiens
tgatttaaatttataatt

SEQ ID NO: 3907422 - DNA, 15 bp, Homo sapiens
tgatttaatgttttc

SEQ ID NO: 3907423 - DNA, 16 bp, Homo sapiens
tgatttaatgttttct

SEQ ID NO: 3907424 - DNA, 22 bp, Homo sapiens
tgatttaatgttttctgctgtt

SEQ ID NO: 3907425 - DNA, 17 bp, Homo sapiens
tgatttatatatggcat

SEQ ID NO: 3907426 - DNA, 21 bp, Homo sapiens
tgatttatatatggcatattt

SEQ ID NO: 3907427 - DNA, 20 bp, Homo sapiens
tgatttatgatcacttggaa

SEQ ID NO: 3907428 - DNA, 18 bp, Homo sapiens
tgatttcaggatactctg

SEQ ID NO: 3907429 - DNA, 14 bp, Homo sapiens
tgatttcagggaaa

SEQ ID NO: 3907430 - DNA, 14 bp, Homo sapiens
tgatttccaaagag

SEQ ID NO: 3907431 - DNA, 16 bp, Homo sapiens
tgatttccaagtaata

SEQ ID NO: 3907432 - DNA, 12 bp, Homo sapiens
tgatttccaggc

SEQ ID NO: 3907433 - DNA, 15 bp, Homo sapiens
tgatttgacccactc

SEQ ID NO: 3907434 - DNA, 20 bp, Homo sapiens
tgatttggaagagaggcacc

SEQ ID NO: 3907435 - DNA, 22 bp, Homo sapiens
tgatttggaagagaggcacctg

SEQ ID NO: 3907436 - DNA, 15 bp, Homo sapiens
tgatttgtactgaaa

SEQ ID NO: 3907437 - DNA, 14 bp, Homo sapiens
tgattttacagaga

SEQ ID NO: 3907438 - DNA, 13 bp, Homo sapiens
tgattttatacat

SEQ ID NO: 3907439 - DNA, 14 bp, Homo sapiens
tgattttatacata

SEQ ID NO: 3907440 - DNA, 18 bp, Homo sapiens
tgattttatacatagtca

SEQ ID NO: 3907441 - DNA, 22 bp, Homo sapiens
tgattttatacatagtcacaaa

SEQ ID NO: 3907442 - DNA, 12 bp, Homo sapiens
tgattttgtaca

SEQ ID NO: 3907443 - DNA, 17 bp, Homo sapiens
tgattttgtcactgtct

SEQ ID NO: 3907444 - DNA, 13 bp, Homo sapiens
tgattttttaaaa

SEQ ID NO: 3907445 - DNA, 16 bp, Homo sapiens
tgatttttttttttca

SEQ ID NO: 3907446 - DNA, 12 bp, Homo sapiens
tgcaaaaaatag

SEQ ID NO: 3907447 - DNA, 13 bp, Homo sapiens
tgcaaaaatataa

SEQ ID NO: 3907448 - DNA, 23 bp, Homo sapiens
tgcaaaagactaatttaaaaaat

SEQ ID NO: 3907449 - DNA, 15 bp, Homo sapiens
tgcaaaataaatgtt

SEQ ID NO: 3907450 - DNA, 22 bp, Homo sapiens
tgcaaagcactgacttctaagt

SEQ ID NO: 3907451 - DNA, 22 bp, Homo sapiens
tgcaaaggtctttttaaaccag

SEQ ID NO: 3907452 - DNA, 12 bp, Homo sapiens
tgcaaagtgcaa

SEQ ID NO: 3907453 - DNA, 14 bp, Homo sapiens
tgcaaagtgcaaat

SEQ ID NO: 3907454 - DNA, 15 bp, Homo sapiens
tgcaaagtgccctca

SEQ ID NO: 3907455 - DNA, 21 bp, Homo sapiens
tgcaaagtgttttctcagaac

SEQ ID NO: 3907456 - DNA, 17 bp, Homo sapiens
tgcaaatactccaagct

SEQ ID NO: 3907457 - DNA, 15 bp, Homo sapiens
tgcaaattttgcatt

SEQ ID NO: 3907458 - DNA, 15 bp, Homo sapiens
tgcaaccactgcaac

SEQ ID NO: 3907459 - DNA, 20 bp, Homo sapiens
tgcaacctccacctcctgag

SEQ ID NO: 3907460 - DNA, 23 bp, Homo sapiens
tgcaacctcttcctcctggttca

SEQ ID NO: 3907461 - DNA, 17 bp, Homo sapiens
tgcaacttctttttatt

SEQ ID NO: 3907462 - DNA, 17 bp, Homo sapiens
tgcaagagacagagccc

SEQ ID NO: 3907463 - DNA, 18 bp, Homo sapiens
tgcaagagacagagcccc

SEQ ID NO: 3907464 - DNA, 19 bp, Homo sapiens
tgcaagagacagagccccc

SEQ ID NO: 3907465 - DNA, 12 bp, Homo sapiens
tgcaagaggagg

SEQ ID NO: 3907466 - DNA, 14 bp, Homo sapiens
tgcaagcagcctcc

SEQ ID NO: 3907467 - DNA, 18 bp, Homo sapiens
tgcaagcagcctcctggg

SEQ ID NO: 3907468 - DNA, 16 bp, Homo sapiens
tgcaagggccagagtt

SEQ ID NO: 3907469 - DNA, 19 bp, Homo sapiens
tgcaaggggctcagcaagg

SEQ ID NO: 3907470 - DNA, 19 bp, Homo sapiens
tgcaagtactgctgtaaat

SEQ ID NO: 3907471 - DNA, 18 bp, Homo sapiens
tgcaagtcatacttagga

SEQ ID NO: 3907472 - DNA, 16 bp, Homo sapiens
tgcaagtgagaagctg

SEQ ID NO: 3907473 - DNA, 13 bp, Homo sapiens
tgcaatgaaacag

SEQ ID NO: 3907474 - DNA, 15 bp, Homo sapiens
tgcaatgggcactgg

SEQ ID NO: 3907475 - DNA, 14 bp, Homo sapiens
tgcacaagctcaga

SEQ ID NO: 3907476 - DNA, 18 bp, Homo sapiens
tgcacaagcttgtatata

SEQ ID NO: 3907477 - DNA, 9 bp, Homo sapiens
tgcacaatt

SEQ ID NO: 3907478 - DNA, 13 bp, Homo sapiens
tgcacaatttaga

SEQ ID NO: 3907479 - DNA, 14 bp, Homo sapiens
tgcacaatttagaa

SEQ ID NO: 3907480 - DNA, 11 bp, Homo sapiens
tgcacaatttg

SEQ ID NO: 3907481 - DNA, 12 bp, Homo sapiens
tgcacaatttga

SEQ ID NO: 3907482 - DNA, 15 bp, Homo sapiens
tgcacaatttgagca

SEQ ID NO: 3907483 - DNA, 16 bp, Homo sapiens
tgcacaatttgagcaa

SEQ ID NO: 3907484 - DNA, 20 bp, Homo sapiens
tgcacaatttgagcaattca

SEQ ID NO: 3907485 - DNA, 21 bp, Homo sapiens
tgcacaatttgagcaattcat

SEQ ID NO: 3907486 - DNA, 22 bp, Homo sapiens
tgcacaatttgagcaattcatt

SEQ ID NO: 3907487 - DNA, 19 bp, Homo sapiens
tgcacacacagatgcacac

SEQ ID NO: 3907488 - DNA, 23 bp, Homo sapiens
tgcacacacagatgcacacacag

SEQ ID NO: 3907489 - DNA, 21 bp, Homo sapiens
tgcacacacatggatgagcac

SEQ ID NO: 3907490 - DNA, 17 bp, Homo sapiens
tgcacacagaaatatat

SEQ ID NO: 3907491 - DNA, 22 bp, Homo sapiens
tgcacaccaaaaaaatacttga

SEQ ID NO: 3907492 - DNA, 15 bp, Homo sapiens
tgcacacggatgcac

SEQ ID NO: 3907493 - DNA, 18 bp, Homo sapiens
tgcacagagatatgcaca

SEQ ID NO: 3907494 - DNA, 19 bp, Homo sapiens
tgcacagagatatgcacac

SEQ ID NO: 3907495 - DNA, 20 bp, Homo sapiens
tgcacagcgcgggcggaggc

SEQ ID NO: 3907496 - DNA, 23 bp, Homo sapiens
tgcacagcgcgggcggaggcggc

SEQ ID NO: 3907497 - DNA, 15 bp, Homo sapiens
tgcacagctgcttgt

SEQ ID NO: 3907498 - DNA, 18 bp, Homo sapiens
tgcacagctgcttgtcct

SEQ ID NO: 3907499 - DNA, 19 bp, Homo sapiens
tgcacagctgcttgtcctg

SEQ ID NO: 3907500 - DNA, 23 bp, Homo sapiens
tgcacagctgcttgtcctgctct

SEQ ID NO: 3907501 - DNA, 15 bp, Homo sapiens
tgcacaggagggggt

SEQ ID NO: 3907502 - DNA, 17 bp, Homo sapiens
tgcacagtgcatctcag

SEQ ID NO: 3907503 - DNA, 16 bp, Homo sapiens
tgcacatatgggtgct

SEQ ID NO: 3907504 - DNA, 13 bp, Homo sapiens
tgcacatccattc

SEQ ID NO: 3907505 - DNA, 17 bp, Homo sapiens
tgcacattcctggcccc

SEQ ID NO: 3907506 - DNA, 12 bp, Homo sapiens
tgcaccagagtg

SEQ ID NO: 3907507 - DNA, 21 bp, Homo sapiens
tgcaccagcccttccctgctt

SEQ ID NO: 3907508 - DNA, 23 bp, Homo sapiens
tgcaccagcccttccctgctttg

SEQ ID NO: 3907509 - DNA, 14 bp, Homo sapiens
tgcaccatctgctt

SEQ ID NO: 3907510 - DNA, 20 bp, Homo sapiens
tgcacccactcaccagggtc

SEQ ID NO: 3907511 - DNA, 15 bp, Homo sapiens
tgcacccaggggtgg

SEQ ID NO: 3907512 - DNA, 15 bp, Homo sapiens
tgcacctccccccac

SEQ ID NO: 3907513 - DNA, 17 bp, Homo sapiens
tgcacctccccccactg

SEQ ID NO: 3907514 - DNA, 19 bp, Homo sapiens
tgcacctccccccactgca

SEQ ID NO: 3907515 - DNA, 11 bp, Homo sapiens
tgcacctgcat

SEQ ID NO: 3907516 - DNA, 18 bp, Homo sapiens
tgcacctgcatccgtagt

SEQ ID NO: 3907517 - DNA, 20 bp, Homo sapiens
  misc_feature (10)..(10): n is a, c, g or t
tgcacctgcnttgtccctgg

SEQ ID NO: 3907518 - DNA, 12 bp, Homo sapiens
tgcacctgtgca

SEQ ID NO: 3907519 - DNA, 16 bp, Homo sapiens
tgcaccttacattcct

SEQ ID NO: 3907520 - DNA, 20 bp, Homo sapiens
tgcacgaactggactgtgtg

SEQ ID NO: 3907521 - DNA, 15 bp, Homo sapiens
tgcacgaccttggga

SEQ ID NO: 3907522 - DNA, 23 bp, Homo sapiens
tgcacgtgctcttctgttctcaa

SEQ ID NO: 3907523 - DNA, 18 bp, Homo sapiens
tgcactaaagtatgtaaa

SEQ ID NO: 3907524 - DNA, 15 bp, Homo sapiens
tgcactcagcttttt

SEQ ID NO: 3907525 - DNA, 12 bp, Homo sapiens
tgcactccagaa

SEQ ID NO: 3907526 - DNA, 18 bp, Homo sapiens
tgcactccagcctgggca

SEQ ID NO: 3907527 - DNA, 14 bp, Homo sapiens
tgcactccctaaga

SEQ ID NO: 3907528 - DNA, 17 bp, Homo sapiens
tgcactgagggccacac

SEQ ID NO: 3907529 - DNA, 12 bp, Homo sapiens
tgcactggccac

SEQ ID NO: 3907530 - DNA, 15 bp, Homo sapiens
tgcactggccccacc

SEQ ID NO: 3907531 - DNA, 16 bp, Homo sapiens
tgcactggccccaccc

SEQ ID NO: 3907532 - DNA, 16 bp, Homo sapiens
tgcactgggtgtggcc

SEQ ID NO: 3907533 - DNA, 16 bp, Homo sapiens
tgcagaaaagcacctg

SEQ ID NO: 3907534 - DNA, 18 bp, Homo sapiens
tgcagaaaagcacctgcc

SEQ ID NO: 3907535 - DNA, 19 bp, Homo sapiens
tgcagaaaagcacctgccg

SEQ ID NO: 3907536 - DNA, 13 bp, Homo sapiens
tgcagaaggccaa

SEQ ID NO: 3907537 - DNA, 13 bp, Homo sapiens
tgcagacactgtg

SEQ ID NO: 3907538 - DNA, 14 bp, Homo sapiens
tgcagactcctcag

SEQ ID NO: 3907539 - DNA, 19 bp, Homo sapiens
tgcagagacgcaagggaga

SEQ ID NO: 3907540 - DNA, 15 bp, Homo sapiens
tgcagagagaagcct

SEQ ID NO: 3907541 - DNA, 21 bp, Homo sapiens
tgcagagcaggaaacatgact

SEQ ID NO: 3907542 - DNA, 15 bp, Homo sapiens
tgcagagctgaagat

SEQ ID NO: 3907543 - DNA, 18 bp, Homo sapiens
tgcagaggacagagctgg

SEQ ID NO: 3907544 - DNA, 15 bp, Homo sapiens
tgcagaggaccacag

SEQ ID NO: 3907545 - DNA, 18 bp, Homo sapiens
tgcagaggatttaactgt

SEQ ID NO: 3907546 - DNA, 16 bp, Homo sapiens
tgcagaggtgagcaga

SEQ ID NO: 3907547 - DNA, 20 bp, Homo sapiens
tgcagatagccagacacatg

SEQ ID NO: 3907548 - DNA, 16 bp, Homo sapiens
tgcagattcctgggcc

SEQ ID NO: 3907549 - DNA, 20 bp, Homo sapiens
tgcagattcctgggcctgtc

SEQ ID NO: 3907550 - DNA, 21 bp, Homo sapiens
tgcagattcctgggcctgtcc

SEQ ID NO: 3907551 - DNA, 22 bp, Homo sapiens
tgcagattcctgggcctgtccc

SEQ ID NO: 3907552 - DNA, 12 bp, Homo sapiens
tgcagcaactcc

SEQ ID NO: 3907553 - DNA, 16 bp, Homo sapiens
tgcagcaactcccacg

SEQ ID NO: 3907554 - DNA, 19 bp, Homo sapiens
tgcagcaactcccacgact

SEQ ID NO: 3907555 - DNA, 23 bp, Homo sapiens
tgcagcactttaaccctctcttc

SEQ ID NO: 3907556 - DNA, 20 bp, Homo sapiens
tgcagcagcccagcttcctg

SEQ ID NO: 3907557 - DNA, 12 bp, Homo sapiens
tgcagccagccc

SEQ ID NO: 3907558 - DNA, 15 bp, Homo sapiens
tgcagccagcccagc

SEQ ID NO: 3907559 - DNA, 17 bp, Homo sapiens
tgcagccagcccagccc

SEQ ID NO: 3907560 - DNA, 21 bp, Homo sapiens
tgcagccagcccagcccagct

SEQ ID NO: 3907561 - DNA, 12 bp, Homo sapiens
tgcagcccttcc

SEQ ID NO: 3907562 - DNA, 13 bp, Homo sapiens
tgcagcccttcct

SEQ ID NO: 3907563 - DNA, 15 bp, Homo sapiens
tgcagcccttcctcc

SEQ ID NO: 3907564 - DNA, 18 bp, Homo sapiens
tgcagcccttcctcctga

SEQ ID NO: 3907565 - DNA, 22 bp, Homo sapiens
tgcagcctcccccacaaataat

SEQ ID NO: 3907566 - DNA, 14 bp, Homo sapiens
tgcagcctcctcct

SEQ ID NO: 3907567 - DNA, 16 bp, Homo sapiens
tgcagcctcctcctga

SEQ ID NO: 3907568 - DNA, 19 bp, Homo sapiens
tgcagcctcctcctgacca

SEQ ID NO: 3907569 - DNA, 20 bp, Homo sapiens
tgcagctctttcttctttga

SEQ ID NO: 3907570 - DNA, 20 bp, Homo sapiens
tgcagctgctgaagttctga

SEQ ID NO: 3907571 - DNA, 13 bp, Homo sapiens
tgcagctgggccc

SEQ ID NO: 3907572 - DNA, 11 bp, Homo sapiens
tgcagcttcat

SEQ ID NO: 3907573 - DNA, 18 bp, Homo sapiens
tgcagcttcatcaatttt

SEQ ID NO: 3907574 - DNA, 11 bp, Homo sapiens
tgcagcttcct

SEQ ID NO: 3907575 - DNA, 13 bp, Homo sapiens
tgcagcttcctgt

SEQ ID NO: 3907576 - DNA, 18 bp, Homo sapiens
tgcagcttcctgtcaaca

SEQ ID NO: 3907577 - DNA, 15 bp, Homo sapiens
tgcagcttctgtcct

SEQ ID NO: 3907578 - DNA, 14 bp, Homo sapiens
tgcagcttgtagcc

SEQ ID NO: 3907579 - DNA, 22 bp, Homo sapiens
tgcagcttgtagccagccgggg

SEQ ID NO: 3907580 - DNA, 15 bp, Homo sapiens
tgcagctttacatgc

SEQ ID NO: 3907581 - DNA, 17 bp, Homo sapiens
tgcaggaacgagcactg

SEQ ID NO: 3907582 - DNA, 16 bp, Homo sapiens
tgcaggcaccttagtg

SEQ ID NO: 3907583 - DNA, 16 bp, Homo sapiens
tgcaggcccagcagac

SEQ ID NO: 3907584 - DNA, 17 bp, Homo sapiens
tgcaggcccagcagact

SEQ ID NO: 3907585 - DNA, 11 bp, Homo sapiens
tgcaggctctg

SEQ ID NO: 3907586 - DNA, 14 bp, Homo sapiens
tgcaggctctgggc

SEQ ID NO: 3907587 - DNA, 17 bp, Homo sapiens
tgcaggctctgggctca

SEQ ID NO: 3907588 - DNA, 19 bp, Homo sapiens
tgcaggctctgggctcagg

SEQ ID NO: 3907589 - DNA, 23 bp, Homo sapiens
tgcaggctctgggctcagggctg

SEQ ID NO: 3907590 - DNA, 18 bp, Homo sapiens
tgcagggaagagggcagt

SEQ ID NO: 3907591 - DNA, 23 bp, Homo sapiens
tgcagggagctgggcttccagaa

SEQ ID NO: 3907592 - DNA, 19 bp, Homo sapiens
tgcagggggtgtgtctgct

SEQ ID NO: 3907593 - DNA, 20 bp, Homo sapiens
tgcaggtacttcctcctgat

SEQ ID NO: 3907594 - DNA, 14 bp, Homo sapiens
tgcagtacaggcaa

SEQ ID NO: 3907595 - DNA, 21 bp, Homo sapiens
tgcagtagtctctgtgctttg

SEQ ID NO: 3907596 - DNA, 14 bp, Homo sapiens
tgcagtattgccac

SEQ ID NO: 3907597 - DNA, 22 bp, Homo sapiens
tgcagtattgccacaatgcctc

SEQ ID NO: 3907598 - DNA, 12 bp, Homo sapiens
tgcagtccagaa

SEQ ID NO: 3907599 - DNA, 16 bp, Homo sapiens
tgcagtccagaataag

SEQ ID NO: 3907600 - DNA, 17 bp, Homo sapiens
tgcagtccagaataagt

SEQ ID NO: 3907601 - DNA, 24 bp, Homo sapiens
tgcagtcccgtggagggtagggga

SEQ ID NO: 3907602 - DNA, 14 bp, Homo sapiens
tgcagttcctgagt

SEQ ID NO: 3907603 - DNA, 16 bp, Homo sapiens
tgcagttgacagcagg

SEQ ID NO: 3907604 - DNA, 12 bp, Homo sapiens
tgcataagatta

SEQ ID NO: 3907605 - DNA, 22 bp, Homo sapiens
tgcataagattaaaggaaggaa

SEQ ID NO: 3907606 - DNA, 23 bp, Homo sapiens
tgcataagattaaaggaaggaaa

SEQ ID NO: 3907607 - DNA, 22 bp, Homo sapiens
tgcatcaatttttcttatttca

SEQ ID NO: 3907608 - DNA, 16 bp, Homo sapiens
tgcatcacctctgtaa

SEQ ID NO: 3907609 - DNA, 18 bp, Homo sapiens
tgcatcagaaagggaggg

SEQ ID NO: 3907610 - DNA, 23 bp, Homo sapiens
tgcatcagaaagggagggctctg

SEQ ID NO: 3907611 - DNA, 19 bp, Homo sapiens
tgcatcagctgctgaaaca

SEQ ID NO: 3907612 - DNA, 16 bp, Homo sapiens
tgcatccattcctcag

SEQ ID NO: 3907613 - DNA, 19 bp, Homo sapiens
tgcatccattcctcaggga

SEQ ID NO: 3907614 - DNA, 20 bp, Homo sapiens
tgcatccattcctcagggac

SEQ ID NO: 3907615 - DNA, 19 bp, Homo sapiens
tgcatctgggattcccacc

SEQ ID NO: 3907616 - DNA, 11 bp, Homo sapiens
tgcatgaaaat

SEQ ID NO: 3907617 - DNA, 16 bp, Homo sapiens
tgcatgattttataca

SEQ ID NO: 3907618 - DNA, 21 bp, Homo sapiens
tgcatgattttatacatagtc

SEQ ID NO: 3907619 - DNA, 18 bp, Homo sapiens
tgcatgcagccactgtgc

SEQ ID NO: 3907620 - DNA, 16 bp, Homo sapiens
tgcatgcgcaggctca

SEQ ID NO: 3907621 - DNA, 18 bp, Homo sapiens
tgcatggaaatgtcctcc

SEQ ID NO: 3907622 - DNA, 23 bp, Homo sapiens
tgcatggacaccccttatccagg

SEQ ID NO: 3907623 - DNA, 18 bp, Homo sapiens
tgcatggcttggggagca

SEQ ID NO: 3907624 - DNA, 23 bp, Homo sapiens
tgcatggtgcagttgacagcagg

SEQ ID NO: 3907625 - DNA, 16 bp, Homo sapiens
tgcatgtaaaatgcag

SEQ ID NO: 3907626 - DNA, 13 bp, Homo sapiens
tgcatgtatgtgt

SEQ ID NO: 3907627 - DNA, 16 bp, Homo sapiens
tgcatgtatgtgtgtg

SEQ ID NO: 3907628 - DNA, 17 bp, Homo sapiens
tgcatgtgagcacatgc

SEQ ID NO: 3907629 - DNA, 19 bp, Homo sapiens
tgcatgtgagcacatgcgt

SEQ ID NO: 3907630 - DNA, 19 bp, Homo sapiens
tgcatgtgtgtataagtgc

SEQ ID NO: 3907631 - DNA, 20 bp, Homo sapiens
tgcatgtgtgtgtctgtctt

SEQ ID NO: 3907632 - DNA, 14 bp, Homo sapiens
tgcattaacttaaa

SEQ ID NO: 3907633 - DNA, 17 bp, Homo sapiens
tgcattaacttaaaaga

SEQ ID NO: 3907634 - DNA, 14 bp, Homo sapiens
tgcattagaaatta

SEQ ID NO: 3907635 - DNA, 23 bp, Homo sapiens
tgcattagaaattagctgtgtga

SEQ ID NO: 3907636 - DNA, 21 bp, Homo sapiens
tgcattagagcccatttcaat

SEQ ID NO: 3907637 - DNA, 17 bp, Homo sapiens
tgcattccatgatttta

SEQ ID NO: 3907638 - DNA, 21 bp, Homo sapiens
tgcattccatgattttacaga

SEQ ID NO: 3907639 - DNA, 14 bp, Homo sapiens
tgcattgaatatat

SEQ ID NO: 3907640 - DNA, 16 bp, Homo sapiens
tgcattgaatatatta

SEQ ID NO: 3907641 - DNA, 17 bp, Homo sapiens
tgcattgtcttgtggag

SEQ ID NO: 3907642 - DNA, 17 bp, Homo sapiens
tgcattgttattgtgga

SEQ ID NO: 3907643 - DNA, 20 bp, Homo sapiens
tgcatttataaatgtgtggt

SEQ ID NO: 3907644 - DNA, 13 bp, Homo sapiens
tgcatttcctgac

SEQ ID NO: 3907645 - DNA, 17 bp, Homo sapiens
tgccaaagcaaaagaag

SEQ ID NO: 3907646 - DNA, 18 bp, Homo sapiens
tgccaaattgtagttctt

SEQ ID NO: 3907647 - DNA, 23 bp, Homo sapiens
tgccaacaccttcttggcttctg

SEQ ID NO: 3907648 - DNA, 20 bp, Homo sapiens
tgccaacctgatgccccttc

SEQ ID NO: 3907649 - DNA, 14 bp, Homo sapiens
tgccaactggtcac

SEQ ID NO: 3907650 - DNA, 20 bp, Homo sapiens
tgccaaggtgtggcctgcac

SEQ ID NO: 3907651 - DNA, 13 bp, Homo sapiens
tgccaagtccagg

SEQ ID NO: 3907652 - DNA, 15 bp, Homo sapiens
tgccaagtccaggtc

SEQ ID NO: 3907653 - DNA, 15 bp, Homo sapiens
tgccaattagcaatt

SEQ ID NO: 3907654 - DNA, 23 bp, Homo sapiens
tgccacaatgcctctcccacgat

SEQ ID NO: 3907655 - DNA, 13 bp, Homo sapiens
tgccacacttcag

SEQ ID NO: 3907656 - DNA, 23 bp, Homo sapiens
tgccacacttcaggctcttctcc

SEQ ID NO: 3907657 - DNA, 11 bp, Homo sapiens
tgccacagccc

SEQ ID NO: 3907658 - DNA, 19 bp, Homo sapiens
tgccacagccccacagcac

SEQ ID NO: 3907659 - DNA, 12 bp, Homo sapiens
tgccaccaataa

SEQ ID NO: 3907660 - DNA, 14 bp, Homo sapiens
tgccaccaataaaa

SEQ ID NO: 3907661 - DNA, 18 bp, Homo sapiens
tgccaccacgtctgccag

SEQ ID NO: 3907662 - DNA, 20 bp, Homo sapiens
tgccaccacgtctgccaggc

SEQ ID NO: 3907663 - DNA, 23 bp, Homo sapiens
tgccaccacgtctgccaggccca

SEQ ID NO: 3907664 - DNA, 20 bp, Homo sapiens
tgccaccactagagctgaga

SEQ ID NO: 3907665 - DNA, 22 bp, Homo sapiens
tgccacccgtaggcagcctctc

SEQ ID NO: 3907666 - DNA, 18 bp, Homo sapiens
tgccaccctctccatgcc

SEQ ID NO: 3907667 - DNA, 18 bp, Homo sapiens
tgccacctcccctatcca

SEQ ID NO: 3907668 - DNA, 11 bp, Homo sapiens
tgccacctgtc

SEQ ID NO: 3907669 - DNA, 15 bp, Homo sapiens
tgccacctgtctgtc

SEQ ID NO: 3907670 - DNA, 18 bp, Homo sapiens
tgccactcattcctgtag

SEQ ID NO: 3907671 - DNA, 16 bp, Homo sapiens
tgccactccctgagct

SEQ ID NO: 3907672 - DNA, 18 bp, Homo sapiens
tgccactgccaggcacct

SEQ ID NO: 3907673 - DNA, 21 bp, Homo sapiens
tgccactgccaggcacctggc

SEQ ID NO: 3907674 - DNA, 13 bp, Homo sapiens
tgccactgcctct

SEQ ID NO: 3907675 - DNA, 18 bp, Homo sapiens
tgccacttcccagaggca

SEQ ID NO: 3907676 - DNA, 19 bp, Homo sapiens
tgccacttgacattccttg

SEQ ID NO: 3907677 - DNA, 19 bp, Homo sapiens
tgccactttggcttctcct

SEQ ID NO: 3907678 - DNA, 22 bp, Homo sapiens
tgccagagacggaagccttttt

SEQ ID NO: 3907679 - DNA, 11 bp, Homo sapiens
tgccagagcct

SEQ ID NO: 3907680 - DNA, 15 bp, Homo sapiens
tgccagagcctgggg

SEQ ID NO: 3907681 - DNA, 16 bp, Homo sapiens
tgccagagcctggggc

SEQ ID NO: 3907682 - DNA, 20 bp, Homo sapiens
tgccagagcctggggctcta

SEQ ID NO: 3907683 - DNA, 20 bp, Homo sapiens
tgccagagctttgttttata

SEQ ID NO: 3907684 - DNA, 14 bp, Homo sapiens
tgccagcacagggg

SEQ ID NO: 3907685 - DNA, 17 bp, Homo sapiens
tgccagcacaggggccc

SEQ ID NO: 3907686 - DNA, 18 bp, Homo sapiens
tgccagcacaggggcccc

SEQ ID NO: 3907687 - DNA, 21 bp, Homo sapiens
tgccagcacaggggccccaga

SEQ ID NO: 3907688 - DNA, 21 bp, Homo sapiens
tgccagcagctgtttctggaa

SEQ ID NO: 3907689 - DNA, 11 bp, Homo sapiens
tgccagccatc

SEQ ID NO: 3907690 - DNA, 21 bp, Homo sapiens
tgccagccgtgatgctcaggc

SEQ ID NO: 3907691 - DNA, 17 bp, Homo sapiens
tgccagctgccttcctc

SEQ ID NO: 3907692 - DNA, 22 bp, Homo sapiens
tgccagctgccttcctcatccc

SEQ ID NO: 3907693 - DNA, 14 bp, Homo sapiens
tgccaggacacctg

SEQ ID NO: 3907694 - DNA, 15 bp, Homo sapiens
tgccaggacacctgc

SEQ ID NO: 3907695 - DNA, 20 bp, Homo sapiens
tgccaggacacctgccccag

SEQ ID NO: 3907696 - DNA, 12 bp, Homo sapiens
tgccaggactcc

SEQ ID NO: 3907697 - DNA, 17 bp, Homo sapiens
tgccaggaggctgcggc

SEQ ID NO: 3907698 - DNA, 22 bp, Homo sapiens
tgccaggagggacaaaggagcc

SEQ ID NO: 3907699 - DNA, 15 bp, Homo sapiens
tgccaggcacctggc

SEQ ID NO: 3907700 - DNA, 20 bp, Homo sapiens
tgccaggcacctggcctgct

SEQ ID NO: 3907701 - DNA, 23 bp, Homo sapiens
tgccaggcacctggcctgctggg

SEQ ID NO: 3907702 - DNA, 14 bp, Homo sapiens
tgccaggcccgggg

SEQ ID NO: 3907703 - DNA, 18 bp, Homo sapiens
tgccaggcgttggtgcca

SEQ ID NO: 3907704 - DNA, 20 bp, Homo sapiens
tgccaggcgttggtgccact

SEQ ID NO: 3907705 - DNA, 16 bp, Homo sapiens
tgccaggctgtaagca

SEQ ID NO: 3907706 - DNA, 21 bp, Homo sapiens
tgccaggctgtaagcattctg

SEQ ID NO: 3907707 - DNA, 23 bp, Homo sapiens
tgccagggcaggctaccccttca

SEQ ID NO: 3907708 - DNA, 17 bp, Homo sapiens
tgccagtccccctgccc

SEQ ID NO: 3907709 - DNA, 19 bp, Homo sapiens
tgccagtccccctgcccca

SEQ ID NO: 3907710 - DNA, 15 bp, Homo sapiens
tgccagtgaagactt

SEQ ID NO: 3907711 - DNA, 17 bp, Homo sapiens
tgccagtgaagacttct

SEQ ID NO: 3907712 - DNA, 11 bp, Homo sapiens
tgccagtgcct

SEQ ID NO: 3907713 - DNA, 15 bp, Homo sapiens
tgccagtgccttacc

SEQ ID NO: 3907714 - DNA, 21 bp, Homo sapiens
tgccagtgccttacctcctgc

SEQ ID NO: 3907715 - DNA, 23 bp, Homo sapiens
tgccagttgaaaatggattttta

SEQ ID NO: 3907716 - DNA, 13 bp, Homo sapiens
tgccatagagttt

SEQ ID NO: 3907717 - DNA, 15 bp, Homo sapiens
tgccatctgttttca

SEQ ID NO: 3907718 - DNA, 21 bp, Homo sapiens
tgccatgccactgccaggcac

SEQ ID NO: 3907719 - DNA, 14 bp, Homo sapiens
tgccatgcccagag

SEQ ID NO: 3907720 - DNA, 17 bp, Homo sapiens
tgccatgtggagtggac

SEQ ID NO: 3907721 - DNA, 16 bp, Homo sapiens
tgccattcatagagag

SEQ ID NO: 3907722 - DNA, 14 bp, Homo sapiens
tgccatttctctgc

SEQ ID NO: 3907723 - DNA, 16 bp, Homo sapiens
tgccatttctctgctt

SEQ ID NO: 3907724 - DNA, 18 bp, Homo sapiens
tgcccaacctgctctcct

SEQ ID NO: 3907725 - DNA, 22 bp, Homo sapiens
tgcccaacctgctctcctcttg

SEQ ID NO: 3907726 - DNA, 20 bp, Homo sapiens
tgcccaatgctttgggaggc

SEQ ID NO: 3907727 - DNA, 17 bp, Homo sapiens
tgcccaccaacatccca

SEQ ID NO: 3907728 - DNA, 17 bp, Homo sapiens
tgcccactgtctctcct

SEQ ID NO: 3907729 - DNA, 17 bp, Homo sapiens
tgcccacttcagcccag

SEQ ID NO: 3907730 - DNA, 18 bp, Homo sapiens
tgcccacttcagcccagc

SEQ ID NO: 3907731 - DNA, 23 bp, Homo sapiens
tgcccagaattcccagctgtctg

SEQ ID NO: 3907732 - DNA, 16 bp, Homo sapiens
tgcccagagaatcagg

SEQ ID NO: 3907733 - DNA, 11 bp, Homo sapiens
tgcccagagat

SEQ ID NO: 3907734 - DNA, 16 bp, Homo sapiens
tgcccagagatgcctc

SEQ ID NO: 3907735 - DNA, 19 bp, Homo sapiens
tgcccagagatgcctccac

SEQ ID NO: 3907736 - DNA, 11 bp, Homo sapiens
tgcccaggaga

SEQ ID NO: 3907737 - DNA, 16 bp, Homo sapiens
tgcccaggagagccag

SEQ ID NO: 3907738 - DNA, 17 bp, Homo sapiens
tgcccaggagagccagc

SEQ ID NO: 3907739 - DNA, 19 bp, Homo sapiens
tgcccaggagagccagccc

SEQ ID NO: 3907740 - DNA, 20 bp, Homo sapiens
tgcccaggagagccagccct

SEQ ID NO: 3907741 - DNA, 21 bp, Homo sapiens
tgcccaggagagccagccctc

SEQ ID NO: 3907742 - DNA, 15 bp, Homo sapiens
tgcccaggcctgcct

SEQ ID NO: 3907743 - DNA, 16 bp, Homo sapiens
tgcccaggctggcctg

SEQ ID NO: 3907744 - DNA, 21 bp, Homo sapiens
tgcccagtcgatatctcactt

SEQ ID NO: 3907745 - DNA, 18 bp, Homo sapiens
tgcccatacccctgcctg

SEQ ID NO: 3907746 - DNA, 22 bp, Homo sapiens
tgcccatacccctgcctgggtt

SEQ ID NO: 3907747 - DNA, 23 bp, Homo sapiens
tgcccatcatacgcatggtcctg

SEQ ID NO: 3907748 - DNA, 22 bp, Homo sapiens
tgccccaactccttccagctag

SEQ ID NO: 3907749 - DNA, 15 bp, Homo sapiens
tgccccaagcagcca

SEQ ID NO: 3907750 - DNA, 17 bp, Homo sapiens
tgccccatctcctccca

SEQ ID NO: 3907751 - DNA, 15 bp, Homo sapiens
tgcccccatccctcg

SEQ ID NO: 3907752 - DNA, 17 bp, Homo sapiens
tgcccccatctccccag

SEQ ID NO: 3907753 - DNA, 19 bp, Homo sapiens
tgcccccatctccccaggc

SEQ ID NO: 3907754 - DNA, 20 bp, Homo sapiens
tgcccccatctccccaggcc

SEQ ID NO: 3907755 - DNA, 22 bp, Homo sapiens
tgcccccatctccccaggcctc

SEQ ID NO: 3907756 - DNA, 16 bp, Homo sapiens
tgcccccatctttcct

SEQ ID NO: 3907757 - DNA, 17 bp, Homo sapiens
tgcccctccccagccct

SEQ ID NO: 3907758 - DNA, 21 bp, Homo sapiens
tgcccctgtaggttgcttaaa

SEQ ID NO: 3907759 - DNA, 22 bp, Homo sapiens
tgccccttaagggttgaaggca

SEQ ID NO: 3907760 - DNA, 16 bp, Homo sapiens
tgccccttccccatct

SEQ ID NO: 3907761 - DNA, 13 bp, Homo sapiens
tgccccttgggca

SEQ ID NO: 3907762 - DNA, 21 bp, Homo sapiens
tgccccttgggcatccaccca

SEQ ID NO: 3907763 - DNA, 15 bp, Homo sapiens
tgcccgccagcctca

SEQ ID NO: 3907764 - DNA, 18 bp, Homo sapiens
tgccctcattttatgtca

SEQ ID NO: 3907765 - DNA, 16 bp, Homo sapiens
tgccctccctggggtc

SEQ ID NO: 3907766 - DNA, 15 bp, Homo sapiens
tgccctctccttcct

SEQ ID NO: 3907767 - DNA, 12 bp, Homo sapiens
tgccctctggat

SEQ ID NO: 3907768 - DNA, 15 bp, Homo sapiens
tgccctctggatcct

SEQ ID NO: 3907769 - DNA, 22 bp, Homo sapiens
tgccctctggatcctgctgtgg

SEQ ID NO: 3907770 - DNA, 16 bp, Homo sapiens
tgccctgacccctgca

SEQ ID NO: 3907771 - DNA, 12 bp, Homo sapiens
tgccctgacctc

SEQ ID NO: 3907772 - DNA, 14 bp, Homo sapiens
tgccctgacctccc

SEQ ID NO: 3907773 - DNA, 15 bp, Homo sapiens
tgccctgacctccca

SEQ ID NO: 3907774 - DNA, 20 bp, Homo sapiens
tgccctgacctcccagccct

SEQ ID NO: 3907775 - DNA, 21 bp, Homo sapiens
tgccctgacctcccagcccta

SEQ ID NO: 3907776 - DNA, 23 bp, Homo sapiens
tgccctgagtggatctccaagga

SEQ ID NO: 3907777 - DNA, 21 bp, Homo sapiens
tgccctgccacctgtctgtct

SEQ ID NO: 3907778 - DNA, 13 bp, Homo sapiens
tgccctgcctccc

SEQ ID NO: 3907779 - DNA, 13 bp, Homo sapiens
tgccctgcctgca

SEQ ID NO: 3907780 - DNA, 16 bp, Homo sapiens
tgccctgcctgcccac

SEQ ID NO: 3907781 - DNA, 17 bp, Homo sapiens
tgccctgctctggggat

SEQ ID NO: 3907782 - DNA, 23 bp, Homo sapiens
tgccctgctgccgcctcccagcc

SEQ ID NO: 3907783 - DNA, 17 bp, Homo sapiens
tgccctggtgctgccac

SEQ ID NO: 3907784 - DNA, 20 bp, Homo sapiens
tgccctggtgctgccacact

SEQ ID NO: 3907785 - DNA, 20 bp, Homo sapiens
tgccctgtatataatactaa

SEQ ID NO: 3907786 - DNA, 24 bp, Homo sapiens
tgccctgtatataatactaaagtg

SEQ ID NO: 3907787 - DNA, 20 bp, Homo sapiens
tgccctgttgtgtatagatg

SEQ ID NO: 3907788 - DNA, 14 bp, Homo sapiens
tgcccttcgctgcc

SEQ ID NO: 3907789 - DNA, 17 bp, Homo sapiens
tgcccttcgctgccagg

SEQ ID NO: 3907790 - DNA, 19 bp, Homo sapiens
tgcccttcgctgccaggac

SEQ ID NO: 3907791 - DNA, 21 bp, Homo sapiens
tgcccttcgctgccaggacac

SEQ ID NO: 3907792 - DNA, 22 bp, Homo sapiens
tgcccttcgctgccaggacacc

SEQ ID NO: 3907793 - DNA, 17 bp, Homo sapiens
tgcccttgccctgacct

SEQ ID NO: 3907794 - DNA, 23 bp, Homo sapiens
tgcccttgtttggggcaggagta

SEQ ID NO: 3907795 - DNA, 14 bp, Homo sapiens
tgccgacctcgtcc

SEQ ID NO: 3907796 - DNA, 20 bp, Homo sapiens
tgccgagcaaccgtggccct

SEQ ID NO: 3907797 - DNA, 12 bp, Homo sapiens
tgccgcacccca

SEQ ID NO: 3907798 - DNA, 19 bp, Homo sapiens
tgccgccgtctctgtcccg

SEQ ID NO: 3907799 - DNA, 14 bp, Homo sapiens
tgccgctgcaccac

SEQ ID NO: 3907800 - DNA, 17 bp, Homo sapiens
tgccgctgcaccacggc

SEQ ID NO: 3907801 - DNA, 16 bp, Homo sapiens
tgccgctgccgctgca

SEQ ID NO: 3907802 - DNA, 18 bp, Homo sapiens
tgccgctgccgctgcacc

SEQ ID NO: 3907803 - DNA, 18 bp, Homo sapiens
tgccgggttttatatttt

SEQ ID NO: 3907804 - DNA, 21 bp, Homo sapiens
tgccgtgtgtctcgtctcctg

SEQ ID NO: 3907805 - DNA, 19 bp, Homo sapiens
tgccgttactctccaacct

SEQ ID NO: 3907806 - DNA, 17 bp, Homo sapiens
tgcctaagtggctgctg

SEQ ID NO: 3907807 - DNA, 15 bp, Homo sapiens
tgcctaatggagaag

SEQ ID NO: 3907808 - DNA, 14 bp, Homo sapiens
tgcctaattcctgg

SEQ ID NO: 3907809 - DNA, 18 bp, Homo sapiens
tgcctatttattcattca

SEQ ID NO: 3907810 - DNA, 22 bp, Homo sapiens
tgcctatttattcattcagtga

SEQ ID NO: 3907811 - DNA, 24 bp, Homo sapiens
tgcctcaatgtgaatcagacccta

SEQ ID NO: 3907812 - DNA, 17 bp, Homo sapiens
tgcctcagtttccccat

SEQ ID NO: 3907813 - DNA, 14 bp, Homo sapiens
tgcctcatgccaca

SEQ ID NO: 3907814 - DNA, 20 bp, Homo sapiens
tgcctccaccgctgcctaag

SEQ ID NO: 3907815 - DNA, 11 bp, Homo sapiens
tgcctccacct

SEQ ID NO: 3907816 - DNA, 12 bp, Homo sapiens
tgcctcccagcc

SEQ ID NO: 3907817 - DNA, 15 bp, Homo sapiens
tgcctccctttctgg

SEQ ID NO: 3907818 - DNA, 14 bp, Homo sapiens
tgcctcctcttcaa

SEQ ID NO: 3907819 - DNA, 13 bp, Homo sapiens
tgcctcctggccg

SEQ ID NO: 3907820 - DNA, 17 bp, Homo sapiens
tgcctcctgggaccatg

SEQ ID NO: 3907821 - DNA, 21 bp, Homo sapiens
tgcctcgaggcaccggcgctg

SEQ ID NO: 3907822 - DNA, 19 bp, Homo sapiens
tgcctctactgggaaggct

SEQ ID NO: 3907823 - DNA, 13 bp, Homo sapiens
tgcctctcacaca

SEQ ID NO: 3907824 - DNA, 15 bp, Homo sapiens
tgcctctctgctcca

SEQ ID NO: 3907825 - DNA, 17 bp, Homo sapiens
tgcctctctgctccaga

SEQ ID NO: 3907826 - DNA, 19 bp, Homo sapiens
tgcctctctgctccagaga

SEQ ID NO: 3907827 - DNA, 12 bp, Homo sapiens
tgcctctgaggc

SEQ ID NO: 3907828 - DNA, 15 bp, Homo sapiens
tgcctctgaggccag

SEQ ID NO: 3907829 - DNA, 23 bp, Homo sapiens
tgcctctgaggccagcctggcct

SEQ ID NO: 3907830 - DNA, 20 bp, Homo sapiens
tgcctctgatatgggactga

SEQ ID NO: 3907831 - DNA, 21 bp, Homo sapiens
tgcctctgatatgggactgag

SEQ ID NO: 3907832 - DNA, 13 bp, Homo sapiens
tgcctctgcctgt

SEQ ID NO: 3907833 - DNA, 14 bp, Homo sapiens
tgcctctgcctgtc

SEQ ID NO: 3907834 - DNA, 18 bp, Homo sapiens
tgcctcttgttgcagaga

SEQ ID NO: 3907835 - DNA, 23 bp, Homo sapiens
tgcctgaccctacttcttttgct

SEQ ID NO: 3907836 - DNA, 20 bp, Homo sapiens
tgcctgagctggggcctgga

SEQ ID NO: 3907837 - DNA, 20 bp, Homo sapiens
tgcctgaggctcaagaggcc

SEQ ID NO: 3907838 - DNA, 11 bp, Homo sapiens
tgcctgagggt

SEQ ID NO: 3907839 - DNA, 14 bp, Homo sapiens
tgcctgagggtgga

SEQ ID NO: 3907840 - DNA, 18 bp, Homo sapiens
tgcctgagggtggagact

SEQ ID NO: 3907841 - DNA, 16 bp, Homo sapiens
tgcctgcagagagaag

SEQ ID NO: 3907842 - DNA, 18 bp, Homo sapiens
tgcctgcagagagaagcc

SEQ ID NO: 3907843 - DNA, 20 bp, Homo sapiens
tgcctgcagcctcccccaca

SEQ ID NO: 3907844 - DNA, 11 bp, Homo sapiens
tgcctgccctg

SEQ ID NO: 3907845 - DNA, 12 bp, Homo sapiens
tgcctgccctgg

SEQ ID NO: 3907846 - DNA, 13 bp, Homo sapiens
tgcctgcctctgc

SEQ ID NO: 3907847 - DNA, 12 bp, Homo sapiens
tgcctgctagag

SEQ ID NO: 3907848 - DNA, 18 bp, Homo sapiens
tgcctgctagagcaaccc

SEQ ID NO: 3907849 - DNA, 10 bp, Homo sapiens
tgcctgctga

SEQ ID NO: 3907850 - DNA, 21 bp, Homo sapiens
tgcctggacatttgccttgct

SEQ ID NO: 3907851 - DNA, 18 bp, Homo sapiens
tgcctggaggacctgagc

SEQ ID NO: 3907852 - DNA, 19 bp, Homo sapiens
tgcctggaggatccctcca

SEQ ID NO: 3907853 - DNA, 12 bp, Homo sapiens
tgcctggccccc

SEQ ID NO: 3907854 - DNA, 16 bp, Homo sapiens
tgcctggcccccctcc

SEQ ID NO: 3907855 - DNA, 19 bp, Homo sapiens
tgcctggcccccctccagg

SEQ ID NO: 3907856 - DNA, 20 bp, Homo sapiens
tgcctggcccccctccaggc

SEQ ID NO: 3907857 - DNA, 14 bp, Homo sapiens
tgcctgggcctgtg

SEQ ID NO: 3907858 - DNA, 21 bp, Homo sapiens
tgcctgggcctgtgcagcagc

SEQ ID NO: 3907859 - DNA, 22 bp, Homo sapiens
tgcctgggcctgtgcagcagcc

SEQ ID NO: 3907860 - DNA, 16 bp, Homo sapiens
tgcctgggtggggctg

SEQ ID NO: 3907861 - DNA, 23 bp, Homo sapiens
tgcctgggtggggctgctcctcc

SEQ ID NO: 3907862 - DNA, 21 bp, Homo sapiens
tgcctgggttttctaactgta

SEQ ID NO: 3907863 - DNA, 19 bp, Homo sapiens
tgcctggtgcactgtgtct

SEQ ID NO: 3907864 - DNA, 17 bp, Homo sapiens
tgcctgtgaggcagggg

SEQ ID NO: 3907865 - DNA, 14 bp, Homo sapiens
tgcctgttcccatt

SEQ ID NO: 3907866 - DNA, 13 bp, Homo sapiens
tgccttaaagaaa

SEQ ID NO: 3907867 - DNA, 23 bp, Homo sapiens
tgccttacctcctgcccaggaga

SEQ ID NO: 3907868 - DNA, 17 bp, Homo sapiens
tgccttagaacctttct

SEQ ID NO: 3907869 - DNA, 16 bp, Homo sapiens
tgccttagcacttctt

SEQ ID NO: 3907870 - DNA, 17 bp, Homo sapiens
tgccttagcacttcttt

SEQ ID NO: 3907871 - DNA, 18 bp, Homo sapiens
tgccttatgtaattattt

SEQ ID NO: 3907872 - DNA, 17 bp, Homo sapiens
tgccttcagctctacag

SEQ ID NO: 3907873 - DNA, 17 bp, Homo sapiens
tgccttctccctgggaa

SEQ ID NO: 3907874 - DNA, 23 bp, Homo sapiens
tgccttcttcggggaactcctgg

SEQ ID NO: 3907875 - DNA, 19 bp, Homo sapiens
tgcctttctctggctccag

SEQ ID NO: 3907876 - DNA, 20 bp, Homo sapiens
tgcctttgaaattcccccac

SEQ ID NO: 3907877 - DNA, 22 bp, Homo sapiens
tgccttttatagctattactgt

SEQ ID NO: 3907878 - DNA, 19 bp, Homo sapiens
tgcgaaaacttgaatctgt

SEQ ID NO: 3907879 - DNA, 22 bp, Homo sapiens
tgcgaaacaacttgtgttctat

SEQ ID NO: 3907880 - DNA, 17 bp, Homo sapiens
tgcgcaacaacaaggac

SEQ ID NO: 3907881 - DNA, 13 bp, Homo sapiens
tgcgcaatgtggc

SEQ ID NO: 3907882 - DNA, 22 bp, Homo sapiens
tgcgcacacacagatatgcaca

SEQ ID NO: 3907883 - DNA, 21 bp, Homo sapiens
tgcgctcattttaggcctcct

SEQ ID NO: 3907884 - DNA, 11 bp, Homo sapiens
tgcggcaggag

SEQ ID NO: 3907885 - DNA, 16 bp, Homo sapiens
tgcggcaggagcagga

SEQ ID NO: 3907886 - DNA, 17 bp, Homo sapiens
tgcggcaggagcaggaa

SEQ ID NO: 3907887 - DNA, 18 bp, Homo sapiens
tgcggccgcattccctga

SEQ ID NO: 3907888 - DNA, 15 bp, Homo sapiens
tgcggccgggctgcc

SEQ ID NO: 3907889 - DNA, 17 bp, Homo sapiens
tgcggccttccaccggg

SEQ ID NO: 3907890 - DNA, 19 bp, Homo sapiens
tgcggccttccaccgggcc

SEQ ID NO: 3907891 - DNA, 17 bp, Homo sapiens
tgcgggcttttccccgg

SEQ ID NO: 3907892 - DNA, 18 bp, Homo sapiens
tgcgggggagctggaaat

SEQ ID NO: 3907893 - DNA, 15 bp, Homo sapiens
tgcgggtctgaagga

SEQ ID NO: 3907894 - DNA, 18 bp, Homo sapiens
tgcgtcctgacgccctgc

SEQ ID NO: 3907895 - DNA, 14 bp, Homo sapiens
tgcgtcctgcagag

SEQ ID NO: 3907896 - DNA, 23 bp, Homo sapiens
tgcgtgcacatatgggtgctggc

SEQ ID NO: 3907897 - DNA, 12 bp, Homo sapiens
tgcgtgtgtgca

SEQ ID NO: 3907898 - DNA, 20 bp, Homo sapiens
tgcgtgtgtgcatgtatgtg

SEQ ID NO: 3907899 - DNA, 23 bp, Homo sapiens
tgcgttggaatcacctggagggc

SEQ ID NO: 3907900 - DNA, 14 bp, Homo sapiens
tgcgttggagccac

SEQ ID NO: 3907901 - DNA, 19 bp, Homo sapiens
tgcgttggagccactcctg

SEQ ID NO: 3907902 - DNA, 14 bp, Homo sapiens
tgctaaaacttcac

SEQ ID NO: 3907903 - DNA, 22 bp, Homo sapiens
tgctaaacgactccgagaacaa

SEQ ID NO: 3907904 - DNA, 18 bp, Homo sapiens
tgctaaatactgtacata

SEQ ID NO: 3907905 - DNA, 19 bp, Homo sapiens
tgctaaatactgtacatag

SEQ ID NO: 3907906 - DNA, 12 bp, Homo sapiens
tgctaaatagtt

SEQ ID NO: 3907907 - DNA, 11 bp, Homo sapiens
tgctaagaaat

SEQ ID NO: 3907908 - DNA, 12 bp, Homo sapiens
tgctaagaaatg

SEQ ID NO: 3907909 - DNA, 22 bp, Homo sapiens
tgctaagaaatgctgaaaatca

SEQ ID NO: 3907910 - DNA, 18 bp, Homo sapiens
tgctaatttatcctgaaa

SEQ ID NO: 3907911 - DNA, 14 bp, Homo sapiens
tgctacaaaaacac

SEQ ID NO: 3907912 - DNA, 18 bp, Homo sapiens
tgctacaaaaacacagca

SEQ ID NO: 3907913 - DNA, 12 bp, Homo sapiens
tgctacaataaa

SEQ ID NO: 3907914 - DNA, 13 bp, Homo sapiens
tgctacaataaat

SEQ ID NO: 3907915 - DNA, 14 bp, Homo sapiens
tgctacaataaatg

SEQ ID NO: 3907916 - DNA, 16 bp, Homo sapiens
tgctacaataaatgct

SEQ ID NO: 3907917 - DNA, 18 bp, Homo sapiens
tgctaccaaggcccagct

SEQ ID NO: 3907918 - DNA, 21 bp, Homo sapiens
tgctaccaaggcccagctatg

SEQ ID NO: 3907919 - DNA, 14 bp, Homo sapiens
tgctagacagccag

SEQ ID NO: 3907920 - DNA, 17 bp, Homo sapiens
tgctagagcaacccctg

SEQ ID NO: 3907921 - DNA, 17 bp, Homo sapiens
tgctaggcgagtgccag

SEQ ID NO: 3907922 - DNA, 15 bp, Homo sapiens
tgctaggggatgagg

SEQ ID NO: 3907923 - DNA, 18 bp, Homo sapiens
tgctagtttattggaagt

SEQ ID NO: 3907924 - DNA, 20 bp, Homo sapiens
tgctataggctggagaagct

SEQ ID NO: 3907925 - DNA, 12 bp, Homo sapiens
tgctatatatat

SEQ ID NO: 3907926 - DNA, 16 bp, Homo sapiens
tgctatatatataaat

SEQ ID NO: 3907927 - DNA, 18 bp, Homo sapiens
tgctatattttcatgact

SEQ ID NO: 3907928 - DNA, 21 bp, Homo sapiens
tgctatcaaaataaattgaaa

SEQ ID NO: 3907929 - DNA, 20 bp, Homo sapiens
tgctatctctgtgtgcacaa

SEQ ID NO: 3907930 - DNA, 15 bp, Homo sapiens
tgctatgccaagcca

SEQ ID NO: 3907931 - DNA, 21 bp, Homo sapiens
tgctattatgtaacatccaga

SEQ ID NO: 3907932 - DNA, 23 bp, Homo sapiens
tgctattatgtaacatccagaag

SEQ ID NO: 3907933 - DNA, 21 bp, Homo sapiens
tgctattctgtgttgaacaca

SEQ ID NO: 3907934 - DNA, 14 bp, Homo sapiens
tgctattgaactga

SEQ ID NO: 3907935 - DNA, 16 bp, Homo sapiens
tgctattgaactgagc

SEQ ID NO: 3907936 - DNA, 17 bp, Homo sapiens
tgctattgaactgagcc

SEQ ID NO: 3907937 - DNA, 15 bp, Homo sapiens
tgctatttctggcct

SEQ ID NO: 3907938 - DNA, 16 bp, Homo sapiens
tgctatttctggcctc

SEQ ID NO: 3907939 - DNA, 17 bp, Homo sapiens
tgctatttgagcatgca

SEQ ID NO: 3907940 - DNA, 19 bp, Homo sapiens
tgctatttgttgtttttaa

SEQ ID NO: 3907941 - DNA, 18 bp, Homo sapiens
tgctcaaatcatttaaga

SEQ ID NO: 3907942 - DNA, 21 bp, Homo sapiens
tgctcaaatctattcagacaa

SEQ ID NO: 3907943 - DNA, 19 bp, Homo sapiens
tgctcacgactcttcctgc

SEQ ID NO: 3907944 - DNA, 23 bp, Homo sapiens
tgctcacgactcttcctgcaaag

SEQ ID NO: 3907945 - DNA, 22 bp, Homo sapiens
tgctcagccctgactggtgcta

SEQ ID NO: 3907946 - DNA, 15 bp, Homo sapiens
tgctcagtgcctcct

SEQ ID NO: 3907947 - DNA, 16 bp, Homo sapiens
tgctcataacatcttt

SEQ ID NO: 3907948 - DNA, 18 bp, Homo sapiens
tgctcataacatctttga

SEQ ID NO: 3907949 - DNA, 15 bp, Homo sapiens
tgctcatcacccagt

SEQ ID NO: 3907950 - DNA, 23 bp, Homo sapiens
tgctcatcacccagtcctggcca

SEQ ID NO: 3907951 - DNA, 18 bp, Homo sapiens
tgctcattccttctggag

SEQ ID NO: 3907952 - DNA, 15 bp, Homo sapiens
tgctccagggcagcc

SEQ ID NO: 3907953 - DNA, 12 bp, Homo sapiens
tgctccagggtc

SEQ ID NO: 3907954 - DNA, 14 bp, Homo sapiens
tgctccagggtctt

SEQ ID NO: 3907955 - DNA, 16 bp, Homo sapiens
tgctccagggtcttgg

SEQ ID NO: 3907956 - DNA, 16 bp, Homo sapiens
tgctcccccaccccct

SEQ ID NO: 3907957 - DNA, 21 bp, Homo sapiens
tgctcccccaccccctcccca

SEQ ID NO: 3907958 - DNA, 18 bp, Homo sapiens
tgctcctagtttgacctc

SEQ ID NO: 3907959 - DNA, 13 bp, Homo sapiens
tgctcctccaggg

SEQ ID NO: 3907960 - DNA, 22 bp, Homo sapiens
tgctcctccagggccacgtgcc

SEQ ID NO: 3907961 - DNA, 15 bp, Homo sapiens
tgctcctctccaggc

SEQ ID NO: 3907962 - DNA, 16 bp, Homo sapiens
tgctcctctccaggca

SEQ ID NO: 3907963 - DNA, 15 bp, Homo sapiens
tgctcgcagcctggc

SEQ ID NO: 3907964 - DNA, 16 bp, Homo sapiens
tgctcgcagcctggcg

SEQ ID NO: 3907965 - DNA, 19 bp, Homo sapiens
tgctcgcccacaaactgat

SEQ ID NO: 3907966 - DNA, 17 bp, Homo sapiens
tgctcggggtgcacagg

SEQ ID NO: 3907967 - DNA, 18 bp, Homo sapiens
tgctcggggtgcacagga

SEQ ID NO: 3907968 - DNA, 21 bp, Homo sapiens
tgctcggggtgcacaggaggg

SEQ ID NO: 3907969 - DNA, 22 bp, Homo sapiens
tgctcggggtgcacaggagggg

SEQ ID NO: 3907970 - DNA, 14 bp, Homo sapiens
tgctctagccagga

SEQ ID NO: 3907971 - DNA, 22 bp, Homo sapiens
tgctctagccaggagtctgtgc

SEQ ID NO: 3907972 - DNA, 23 bp, Homo sapiens
tgctctagccaggagtctgtgct

SEQ ID NO: 3907973 - DNA, 12 bp, Homo sapiens
tgctctagctgg

SEQ ID NO: 3907974 - DNA, 15 bp, Homo sapiens
tgctctagctggcag

SEQ ID NO: 3907975 - DNA, 23 bp, Homo sapiens
tgctctagtcttgctttgctgtc

SEQ ID NO: 3907976 - DNA, 13 bp, Homo sapiens
tgctctcccctgc

SEQ ID NO: 3907977 - DNA, 14 bp, Homo sapiens
tgctctcccctgcc

SEQ ID NO: 3907978 - DNA, 22 bp, Homo sapiens
tgctctcctaccccacctcatg

SEQ ID NO: 3907979 - DNA, 15 bp, Homo sapiens
tgctctctgcagcca

SEQ ID NO: 3907980 - DNA, 17 bp, Homo sapiens
tgctctgatgcatcaga

SEQ ID NO: 3907981 - DNA, 18 bp, Homo sapiens
tgctctgccccaagcccc

SEQ ID NO: 3907982 - DNA, 14 bp, Homo sapiens
tgctctgccccttg

SEQ ID NO: 3907983 - DNA, 20 bp, Homo sapiens
tgctctgccccttgggcatc

SEQ ID NO: 3907984 - DNA, 16 bp, Homo sapiens
tgctctggaagagagg

SEQ ID NO: 3907985 - DNA, 13 bp, Homo sapiens
tgctctggaagcc

SEQ ID NO: 3907986 - DNA, 23 bp, Homo sapiens
tgctctggcggcttcctgtccac

SEQ ID NO: 3907987 - DNA, 21 bp, Homo sapiens
tgctcttagtgcccgcctagg

SEQ ID NO: 3907988 - DNA, 22 bp, Homo sapiens
tgctcttctacgtataaatatg

SEQ ID NO: 3907989 - DNA, 15 bp, Homo sapiens
tgctcttctttctga

SEQ ID NO: 3907990 - DNA, 16 bp, Homo sapiens
tgctcttctttctgag

SEQ ID NO: 3907991 - DNA, 17 bp, Homo sapiens
tgctcttggaaagctga

SEQ ID NO: 3907992 - DNA, 14 bp, Homo sapiens
tgctgaagaggcaa

SEQ ID NO: 3907993 - DNA, 15 bp, Homo sapiens
tgctgaagttctgag

SEQ ID NO: 3907994 - DNA, 14 bp, Homo sapiens
tgctgaattatttt

SEQ ID NO: 3907995 - DNA, 19 bp, Homo sapiens
tgctgacatggctttgctt

SEQ ID NO: 3907996 - DNA, 21 bp, Homo sapiens
tgctgactgtactcctcccag

SEQ ID NO: 3907997 - DNA, 22 bp, Homo sapiens
tgctgactgtactcctcccagg

SEQ ID NO: 3907998 - DNA, 18 bp, Homo sapiens
tgctgagaacctggcctt

SEQ ID NO: 3907999 - DNA, 22 bp, Homo sapiens
tgctgagagacccaaggaggaa

SEQ ID NO: 3908000 - DNA, 13 bp, Homo sapiens
tgctgagctctga

SEQ ID NO: 3908001 - DNA, 10 bp, Homo sapiens
tgctgagctt

SEQ ID NO: 3908002 - DNA, 18 bp, Homo sapiens
tgctgagcttagccttgt

SEQ ID NO: 3908003 - DNA, 17 bp, Homo sapiens
tgctgaggtaataatta

SEQ ID NO: 3908004 - DNA, 18 bp, Homo sapiens
tgctgatcaatgaaatgc

SEQ ID NO: 3908005 - DNA, 15 bp, Homo sapiens
tgctgattcaagaaa

SEQ ID NO: 3908006 - DNA, 18 bp, Homo sapiens
tgctgattcaagaaacag

SEQ ID NO: 3908007 - DNA, 16 bp, Homo sapiens
tgctgattcagcctgg

SEQ ID NO: 3908008 - DNA, 15 bp, Homo sapiens
tgctgcaaagtgcaa

SEQ ID NO: 3908009 - DNA, 18 bp, Homo sapiens
tgctgccatgccactgcc

SEQ ID NO: 3908010 - DNA, 14 bp, Homo sapiens
tgctgcccagcctc

SEQ ID NO: 3908011 - DNA, 16 bp, Homo sapiens
tgctgcccagcctcca

SEQ ID NO: 3908012 - DNA, 21 bp, Homo sapiens
tgctgccccgttccctgtcag

SEQ ID NO: 3908013 - DNA, 22 bp, Homo sapiens
tgctgccccgttccctgtcaga

SEQ ID NO: 3908014 - DNA, 18 bp, Homo sapiens
tgctgccctgctctgggg

SEQ ID NO: 3908015 - DNA, 14 bp, Homo sapiens
tgctgcctccagaa

SEQ ID NO: 3908016 - DNA, 11 bp, Homo sapiens
tgctgctccta

SEQ ID NO: 3908017 - DNA, 18 bp, Homo sapiens
tgctgctgagaacctggc

SEQ ID NO: 3908018 - DNA, 19 bp, Homo sapiens
tgctgctgagaacctggcc

SEQ ID NO: 3908019 - DNA, 20 bp, Homo sapiens
tgctgctgtaactgctgagc

SEQ ID NO: 3908020 - DNA, 22 bp, Homo sapiens
tgctgctgtaactgctgagcca

SEQ ID NO: 3908021 - DNA, 17 bp, Homo sapiens
tgctgctttttggcaca

SEQ ID NO: 3908022 - DNA, 16 bp, Homo sapiens
tgctggaaaccacact

SEQ ID NO: 3908023 - DNA, 16 bp, Homo sapiens
tgctggactgaggacc

SEQ ID NO: 3908024 - DNA, 13 bp, Homo sapiens
tgctggccagcac

SEQ ID NO: 3908025 - DNA, 19 bp, Homo sapiens
tgctggccagcaccctctc

SEQ ID NO: 3908026 - DNA, 21 bp, Homo sapiens
tgctggcctcccaataaagct

SEQ ID NO: 3908027 - DNA, 22 bp, Homo sapiens
tgctggcctcccaataaagctg

SEQ ID NO: 3908028 - DNA, 16 bp, Homo sapiens
tgctggcggcgcagag

SEQ ID NO: 3908029 - DNA, 21 bp, Homo sapiens
tgctgggaaccccgcagcccg

SEQ ID NO: 3908030 - DNA, 19 bp, Homo sapiens
tgctgggcattttcccaga

SEQ ID NO: 3908031 - DNA, 18 bp, Homo sapiens
tgctgggctctccacctc

SEQ ID NO: 3908032 - DNA, 22 bp, Homo sapiens
tgctgggctctccacctcagcc

SEQ ID NO: 3908033 - DNA, 18 bp, Homo sapiens
tgctggggcatgtgtgcc

SEQ ID NO: 3908034 - DNA, 21 bp, Homo sapiens
tgctggggcatgtgtgcctgt

SEQ ID NO: 3908035 - DNA, 16 bp, Homo sapiens
tgctgggtaaactgtg

SEQ ID NO: 3908036 - DNA, 18 bp, Homo sapiens
tgctgtaactgctgagcc

SEQ ID NO: 3908037 - DNA, 21 bp, Homo sapiens
tgctgtacccttccacctcct

SEQ ID NO: 3908038 - DNA, 18 bp, Homo sapiens
tgctgtcctgttttactg

SEQ ID NO: 3908039 - DNA, 23 bp, Homo sapiens
tgctgtctccataatgccactgg

SEQ ID NO: 3908040 - DNA, 15 bp, Homo sapiens
tgctgtctttctcta

SEQ ID NO: 3908041 - DNA, 11 bp, Homo sapiens
tgctgtgcctg

SEQ ID NO: 3908042 - DNA, 18 bp, Homo sapiens
tgctgtgcctgctagagc

SEQ ID NO: 3908043 - DNA, 18 bp, Homo sapiens
tgctgtgctctttgaaga

SEQ ID NO: 3908044 - DNA, 23 bp, Homo sapiens
tgctgtggccagggtgagagctg

SEQ ID NO: 3908045 - DNA, 13 bp, Homo sapiens
tgctgtggcctca

SEQ ID NO: 3908046 - DNA, 10 bp, Homo sapiens
tgctgtgggc

SEQ ID NO: 3908047 - DNA, 13 bp, Homo sapiens
tgctgtgggcagc

SEQ ID NO: 3908048 - DNA, 16 bp, Homo sapiens
tgctgtgggcagcacc

SEQ ID NO: 3908049 - DNA, 13 bp, Homo sapiens
tgctgtgtgcctt

SEQ ID NO: 3908050 - DNA, 13 bp, Homo sapiens
tgctgtgtttatg

SEQ ID NO: 3908051 - DNA, 12 bp, Homo sapiens
tgctgtttcctt

SEQ ID NO: 3908052 - DNA, 14 bp, Homo sapiens
tgctgtttcctttt

SEQ ID NO: 3908053 - DNA, 13 bp, Homo sapiens
tgctgtttgagat

SEQ ID NO: 3908054 - DNA, 12 bp, Homo sapiens
tgcttaaaagac

SEQ ID NO: 3908055 - DNA, 14 bp, Homo sapiens
tgcttaaaagacat

SEQ ID NO: 3908056 - DNA, 13 bp, Homo sapiens
tgcttacagtgac

SEQ ID NO: 3908057 - DNA, 17 bp, Homo sapiens
tgcttacatttttacaa

SEQ ID NO: 3908058 - DNA, 18 bp, Homo sapiens
tgcttacatttttacaat

SEQ ID NO: 3908059 - DNA, 20 bp, Homo sapiens
tgcttacatttttacaataa

SEQ ID NO: 3908060 - DNA, 12 bp, Homo sapiens
tgcttagaaagt

SEQ ID NO: 3908061 - DNA, 13 bp, Homo sapiens
tgcttagaaagtt

SEQ ID NO: 3908062 - DNA, 18 bp, Homo sapiens
tgcttagcctcctgacct

SEQ ID NO: 3908063 - DNA, 19 bp, Homo sapiens
tgcttagcctcctgacctg

SEQ ID NO: 3908064 - DNA, 23 bp, Homo sapiens
tgcttaggatgtttttcatgaaa

SEQ ID NO: 3908065 - DNA, 15 bp, Homo sapiens
tgcttatttccctca

SEQ ID NO: 3908066 - DNA, 16 bp, Homo sapiens
tgcttcaagtgttgct

SEQ ID NO: 3908067 - DNA, 18 bp, Homo sapiens
tgcttcagtggagaatta

SEQ ID NO: 3908068 - DNA, 15 bp, Homo sapiens
tgcttctagtatttt

SEQ ID NO: 3908069 - DNA, 17 bp, Homo sapiens
tgcttctgcagcaactc

SEQ ID NO: 3908070 - DNA, 19 bp, Homo sapiens
tgcttctgcagcaactccc

SEQ ID NO: 3908071 - DNA, 20 bp, Homo sapiens
tgcttctgcagcaactccca

SEQ ID NO: 3908072 - DNA, 14 bp, Homo sapiens
tgcttctgtccagg

SEQ ID NO: 3908073 - DNA, 18 bp, Homo sapiens
tgcttctgtccaggacat

SEQ ID NO: 3908074 - DNA, 23 bp, Homo sapiens
tgcttctgttgtaatagtccatg

SEQ ID NO: 3908075 - DNA, 20 bp, Homo sapiens
tgcttcttcatcttgacatg

SEQ ID NO: 3908076 - DNA, 22 bp, Homo sapiens
tgcttgctggtactaagaggct

SEQ ID NO: 3908077 - DNA, 13 bp, Homo sapiens
tgcttggcagaga

SEQ ID NO: 3908078 - DNA, 20 bp, Homo sapiens
tgcttggggggtgatgaggg

SEQ ID NO: 3908079 - DNA, 17 bp, Homo sapiens
tgcttgtcctgctctct

SEQ ID NO: 3908080 - DNA, 21 bp, Homo sapiens
tgcttgtgatttttgaacaat

SEQ ID NO: 3908081 - DNA, 15 bp, Homo sapiens
tgctttaaagtgtaa

SEQ ID NO: 3908082 - DNA, 21 bp, Homo sapiens
tgctttacctttaaaatcatt

SEQ ID NO: 3908083 - DNA, 15 bp, Homo sapiens
tgctttatttatggc

SEQ ID NO: 3908084 - DNA, 15 bp, Homo sapiens
tgctttccctcccca

SEQ ID NO: 3908085 - DNA, 23 bp, Homo sapiens
tgctttctgaagctttaccagct

SEQ ID NO: 3908086 - DNA, 23 bp, Homo sapiens
tgctttgctgtctggtgtagctc

SEQ ID NO: 3908087 - DNA, 13 bp, Homo sapiens
tgctttgcttttt

SEQ ID NO: 3908088 - DNA, 19 bp, Homo sapiens
tgctttgggaggccaaggc

SEQ ID NO: 3908089 - DNA, 20 bp, Homo sapiens
tgctttgggaggccaaggca

SEQ ID NO: 3908090 - DNA, 16 bp, Homo sapiens
tgctttgggctgccct

SEQ ID NO: 3908091 - DNA, 19 bp, Homo sapiens
tgctttgggctgccctggt

SEQ ID NO: 3908092 - DNA, 12 bp, Homo sapiens
tgctttgggctt

SEQ ID NO: 3908093 - DNA, 19 bp, Homo sapiens
tgctttgggctttgcaggc

SEQ ID NO: 3908094 - DNA, 19 bp, Homo sapiens
tgctttgtatccatgaggg

SEQ ID NO: 3908095 - DNA, 15 bp, Homo sapiens
tgctttgtcatccat

SEQ ID NO: 3908096 - DNA, 19 bp, Homo sapiens
tgctttgttctttatttgt

SEQ ID NO: 3908097 - DNA, 22 bp, Homo sapiens
tgcttttccaggatcctgcagg

SEQ ID NO: 3908098 - DNA, 23 bp, Homo sapiens
tgcttttccaggatcctgcagga

SEQ ID NO: 3908099 - DNA, 14 bp, Homo sapiens
tgcttttgatgtga

SEQ ID NO: 3908100 - DNA, 14 bp, Homo sapiens
tgcttttgccactt

SEQ ID NO: 3908101 - DNA, 14 bp, Homo sapiens
tgcttttgctgggg

SEQ ID NO: 3908102 - DNA, 15 bp, Homo sapiens
tgctttttcaccaga

SEQ ID NO: 3908103 - DNA, 14 bp, Homo sapiens
tgctttttccagat

SEQ ID NO: 3908104 - DNA, 23 bp, Homo sapiens
tggaaaaacatctgaaagccacg

SEQ ID NO: 3908105 - DNA, 21 bp, Homo sapiens
tggaaaaagaaagaaacactc

SEQ ID NO: 3908106 - DNA, 19 bp, Homo sapiens
tggaaaaatccagaaagaa

SEQ ID NO: 3908107 - DNA, 16 bp, Homo sapiens
tggaaaagaggagttt

SEQ ID NO: 3908108 - DNA, 15 bp, Homo sapiens
tggaaacattttctt

SEQ ID NO: 3908109 - DNA, 15 bp, Homo sapiens
tggaaaccacacttc

SEQ ID NO: 3908110 - DNA, 19 bp, Homo sapiens
tggaaaccacacttcttga

SEQ ID NO: 3908111 - DNA, 17 bp, Homo sapiens
tggaaacctgaaaaaaa

SEQ ID NO: 3908112 - DNA, 10 bp, Homo sapiens
tggaaagaga

SEQ ID NO: 3908113 - DNA, 19 bp, Homo sapiens
tggaaaggtcattgtggct

SEQ ID NO: 3908114 - DNA, 20 bp, Homo sapiens
tggaaataaacctggagatg

SEQ ID NO: 3908115 - DNA, 23 bp, Homo sapiens
tggaaataaatgtatcatagaaa

SEQ ID NO: 3908116 - DNA, 22 bp, Homo sapiens
tggaaatatcagttactcagcc

SEQ ID NO: 3908117 - DNA, 18 bp, Homo sapiens
tggaaatcatcgaaaatt

SEQ ID NO: 3908118 - DNA, 20 bp, Homo sapiens
tggaaatgtcctccaacaat

SEQ ID NO: 3908119 - DNA, 21 bp, Homo sapiens
tggaacaaaagttcgaaagaa

SEQ ID NO: 3908120 - DNA, 18 bp, Homo sapiens
tggaacagtcacccttct

SEQ ID NO: 3908121 - DNA, 21 bp, Homo sapiens
tggaacatgtcggagtagaaa

SEQ ID NO: 3908122 - DNA, 17 bp, Homo sapiens
tggaaccagggaggaga

SEQ ID NO: 3908123 - DNA, 18 bp, Homo sapiens
tggaaccagggaggagag

SEQ ID NO: 3908124 - DNA, 14 bp, Homo sapiens
tggaaccttccctc

SEQ ID NO: 3908125 - DNA, 15 bp, Homo sapiens
tggaactgaaggggg

SEQ ID NO: 3908126 - DNA, 16 bp, Homo sapiens
tggaactgaagggggc

SEQ ID NO: 3908127 - DNA, 20 bp, Homo sapiens
tggaactgaagggggcggcc

SEQ ID NO: 3908128 - DNA, 14 bp, Homo sapiens
tggaacttctaata

SEQ ID NO: 3908129 - DNA, 15 bp, Homo sapiens
tggaacttctaatat

SEQ ID NO: 3908130 - DNA, 18 bp, Homo sapiens
tggaacttctaatatatt

SEQ ID NO: 3908131 - DNA, 20 bp, Homo sapiens
tggaagaaattcctgtagca

SEQ ID NO: 3908132 - DNA, 13 bp, Homo sapiens
tggaagagaggca

SEQ ID NO: 3908133 - DNA, 15 bp, Homo sapiens
tggaagagaggcacc

SEQ ID NO: 3908134 - DNA, 23 bp, Homo sapiens
tggaagagaggcacctgctggaa

SEQ ID NO: 3908135 - DNA, 16 bp, Homo sapiens
tggaagagcagcctga

SEQ ID NO: 3908136 - DNA, 18 bp, Homo sapiens
tggaagagcagcctgatg

SEQ ID NO: 3908137 - DNA, 14 bp, Homo sapiens
tggaagattttaaa

SEQ ID NO: 3908138 - DNA, 14 bp, Homo sapiens
tggaagccccccac

SEQ ID NO: 3908139 - DNA, 15 bp, Homo sapiens
tggaagccctccttc

SEQ ID NO: 3908140 - DNA, 11 bp, Homo sapiens
tggaagctgag

SEQ ID NO: 3908141 - DNA, 15 bp, Homo sapiens
tggaagctgagcagg

SEQ ID NO: 3908142 - DNA, 19 bp, Homo sapiens
tggaagctgagcaggcccg

SEQ ID NO: 3908143 - DNA, 17 bp, Homo sapiens
tggaaggcagggacaga

SEQ ID NO: 3908144 - DNA, 15 bp, Homo sapiens
tggaaggcagggcag

SEQ ID NO: 3908145 - DNA, 14 bp, Homo sapiens
tggaaggctggctg

SEQ ID NO: 3908146 - DNA, 14 bp, Homo sapiens
tggaaggctttgcc

SEQ ID NO: 3908147 - DNA, 23 bp, Homo sapiens
tggaagggggtgtgcgtgcgtgt

SEQ ID NO: 3908148 - DNA, 20 bp, Homo sapiens
tggaaggtttggtgtgtgga

SEQ ID NO: 3908149 - DNA, 19 bp, Homo sapiens
tggaagtcgtttcaggaca

SEQ ID NO: 3908150 - DNA, 22 bp, Homo sapiens
tggaagtcgtttcaggacatgg

SEQ ID NO: 3908151 - DNA, 15 bp, Homo sapiens
tggaagttttcagga

SEQ ID NO: 3908152 - DNA, 15 bp, Homo sapiens
tggaatacagtgtta

SEQ ID NO: 3908153 - DNA, 22 bp, Homo sapiens
tggaatacagtgttattttctt

SEQ ID NO: 3908154 - DNA, 23 bp, Homo sapiens
tggaatcaatttcccagaaggga

SEQ ID NO: 3908155 - DNA, 16 bp, Homo sapiens
tggaatcacctggagg

SEQ ID NO: 3908156 - DNA, 18 bp, Homo sapiens
tggaatcacctggagggc

SEQ ID NO: 3908157 - DNA, 19 bp, Homo sapiens
tggaatcacctggagggct

SEQ ID NO: 3908158 - DNA, 17 bp, Homo sapiens
tggaatcagcttttaat

SEQ ID NO: 3908159 - DNA, 13 bp, Homo sapiens
tggaatctggaga

SEQ ID NO: 3908160 - DNA, 17 bp, Homo sapiens
tggaatgaattaaataa

SEQ ID NO: 3908161 - DNA, 21 bp, Homo sapiens
tggaatgtggcccctgaacaa

SEQ ID NO: 3908162 - DNA, 18 bp, Homo sapiens
tggaattcagcaccctgg

SEQ ID NO: 3908163 - DNA, 13 bp, Homo sapiens
tggacaaaatgga

SEQ ID NO: 3908164 - DNA, 15 bp, Homo sapiens
tggacaagaagctgc

SEQ ID NO: 3908165 - DNA, 16 bp, Homo sapiens
tggacaagaagctgct

SEQ ID NO: 3908166 - DNA, 17 bp, Homo sapiens
tggacaagaagctgcta

SEQ ID NO: 3908167 - DNA, 16 bp, Homo sapiens
tggacaagtttcccaa

SEQ ID NO: 3908168 - DNA, 17 bp, Homo sapiens
tggacaatataaactga

SEQ ID NO: 3908169 - DNA, 15 bp, Homo sapiens
tggacacactgtaaa

SEQ ID NO: 3908170 - DNA, 20 bp, Homo sapiens
tggacacactgtaaacccct

SEQ ID NO: 3908171 - DNA, 21 bp, Homo sapiens
tggacacattttctcctagga

SEQ ID NO: 3908172 - DNA, 21 bp, Homo sapiens
tggacaccccttatccaggac

SEQ ID NO: 3908173 - DNA, 17 bp, Homo sapiens
tggacacctgccctgcc

SEQ ID NO: 3908174 - DNA, 16 bp, Homo sapiens
tggacagctgcttgtg

SEQ ID NO: 3908175 - DNA, 17 bp, Homo sapiens
tggacatttgccttgct

SEQ ID NO: 3908176 - DNA, 21 bp, Homo sapiens
tggaccaaccctgtttcctga

SEQ ID NO: 3908177 - DNA, 23 bp, Homo sapiens
tggaccacccgccctggcagttg

SEQ ID NO: 3908178 - DNA, 15 bp, Homo sapiens
tggaccactgggcaa

SEQ ID NO: 3908179 - DNA, 19 bp, Homo sapiens
tggaccactgggcaatgat

SEQ ID NO: 3908180 - DNA, 13 bp, Homo sapiens
tggaccaggacag

SEQ ID NO: 3908181 - DNA, 19 bp, Homo sapiens
tggaccaggacaggaccag

SEQ ID NO: 3908182 - DNA, 17 bp, Homo sapiens
tggaccagtagacaact

SEQ ID NO: 3908183 - DNA, 19 bp, Homo sapiens
tggaccccgcctcccagcc

SEQ ID NO: 3908184 - DNA, 15 bp, Homo sapiens
tggacccgctctgga

SEQ ID NO: 3908185 - DNA, 16 bp, Homo sapiens
tggaccctccacttca

SEQ ID NO: 3908186 - DNA, 16 bp, Homo sapiens
tggaccgcttcccaga

SEQ ID NO: 3908187 - DNA, 17 bp, Homo sapiens
tggaccgggtgggcctg

SEQ ID NO: 3908188 - DNA, 18 bp, Homo sapiens
tggaccgggtgggcctgg

SEQ ID NO: 3908189 - DNA, 20 bp, Homo sapiens
tggaccgggtgggcctggcc

SEQ ID NO: 3908190 - DNA, 22 bp, Homo sapiens
tggaccgggtgggcctggcctg

SEQ ID NO: 3908191 - DNA, 23 bp, Homo sapiens
tggaccgggtgggcctggcctga

SEQ ID NO: 3908192 - DNA, 19 bp, Homo sapiens
tggacctatgtcctaagga

SEQ ID NO: 3908193 - DNA, 12 bp, Homo sapiens
tggaccttcctg

SEQ ID NO: 3908194 - DNA, 16 bp, Homo sapiens
tggacggggactgggg

SEQ ID NO: 3908195 - DNA, 21 bp, Homo sapiens
tggactaaccccaacgcacag

SEQ ID NO: 3908196 - DNA, 18 bp, Homo sapiens
tggactattataatttaa

SEQ ID NO: 3908197 - DNA, 22 bp, Homo sapiens
tggactctaagctggagctctt

SEQ ID NO: 3908198 - DNA, 15 bp, Homo sapiens
tggactgcgctggac

SEQ ID NO: 3908199 - DNA, 15 bp, Homo sapiens
tggactgtcatagaa

SEQ ID NO: 3908200 - DNA, 21 bp, Homo sapiens
tggactgtcatagaaattaca

SEQ ID NO: 3908201 - DNA, 11 bp, Homo sapiens
tggacttcaaa

SEQ ID NO: 3908202 - DNA, 15 bp, Homo sapiens
tggacttcctggggc

SEQ ID NO: 3908203 - DNA, 16 bp, Homo sapiens
tggacttccttggttt

SEQ ID NO: 3908204 - DNA, 16 bp, Homo sapiens
tggagaaaccctgtct

SEQ ID NO: 3908205 - DNA, 21 bp, Homo sapiens
tggagaaataaaaatacctct

SEQ ID NO: 3908206 - DNA, 23 bp, Homo sapiens
tggagaaataaaaatacctcttt

SEQ ID NO: 3908207 - DNA, 14 bp, Homo sapiens
tggagaactagaga

SEQ ID NO: 3908208 - DNA, 13 bp, Homo sapiens
tggagaagcagtg

SEQ ID NO: 3908209 - DNA, 13 bp, Homo sapiens
tggagaaggaagg

SEQ ID NO: 3908210 - DNA, 14 bp, Homo sapiens
tggagaaggaaggc

SEQ ID NO: 3908211 - DNA, 23 bp, Homo sapiens
tggagacactcctataaggagag

SEQ ID NO: 3908212 - DNA, 22 bp, Homo sapiens
tggagaccgcttcacccctgca

SEQ ID NO: 3908213 - DNA, 18 bp, Homo sapiens
tggagactcctgccctgt

SEQ ID NO: 3908214 - DNA, 17 bp, Homo sapiens
tggagactgtctcaaga

SEQ ID NO: 3908215 - DNA, 12 bp, Homo sapiens
tggagagaaggc

SEQ ID NO: 3908216 - DNA, 12 bp, Homo sapiens
tggagagagggg

SEQ ID NO: 3908217 - DNA, 12 bp, Homo sapiens
tggagagcagct

SEQ ID NO: 3908218 - DNA, 14 bp, Homo sapiens
tggagagcagctgg

SEQ ID NO: 3908219 - DNA, 20 bp, Homo sapiens
tggagagcctcttagtgatt

SEQ ID NO: 3908220 - DNA, 20 bp, Homo sapiens
tggagagctagaacctggag

SEQ ID NO: 3908221 - DNA, 15 bp, Homo sapiens
tggagagctaggagc

SEQ ID NO: 3908222 - DNA, 23 bp, Homo sapiens
tggagagctaggagcaaagcctg

SEQ ID NO: 3908223 - DNA, 14 bp, Homo sapiens
tggagaggcggcct

SEQ ID NO: 3908224 - DNA, 18 bp, Homo sapiens
tggagagggacgaagaaa

SEQ ID NO: 3908225 - DNA, 15 bp, Homo sapiens
tggagaggggcctgg

SEQ ID NO: 3908226 - DNA, 18 bp, Homo sapiens
tggagaggggcctgggaa

SEQ ID NO: 3908227 - DNA, 15 bp, Homo sapiens
tggagatgatgatga

SEQ ID NO: 3908228 - DNA, 16 bp, Homo sapiens
tggagcaagagagagc

SEQ ID NO: 3908229 - DNA, 21 bp, Homo sapiens
tggagcaagtgacatgccatc

SEQ ID NO: 3908230 - DNA, 14 bp, Homo sapiens
tggagcatcccagg

SEQ ID NO: 3908231 - DNA, 14 bp, Homo sapiens
tggagccactcctg

SEQ ID NO: 3908232 - DNA, 19 bp, Homo sapiens
tggagccactcctgtcccg

SEQ ID NO: 3908233 - DNA, 22 bp, Homo sapiens
tggagcccgagggcctgacagg

SEQ ID NO: 3908234 - DNA, 16 bp, Homo sapiens
tggagcctgaacatga

SEQ ID NO: 3908235 - DNA, 19 bp, Homo sapiens
tggagcctggcacaggact

SEQ ID NO: 3908236 - DNA, 21 bp, Homo sapiens
tggagcctggcacaggactga

SEQ ID NO: 3908237 - DNA, 23 bp, Homo sapiens
tggaggaaaaccaagccgtggct

SEQ ID NO: 3908238 - DNA, 20 bp, Homo sapiens
tggaggaaaatccatggata

SEQ ID NO: 3908239 - DNA, 14 bp, Homo sapiens
tggaggacctgagc

SEQ ID NO: 3908240 - DNA, 17 bp, Homo sapiens
tggaggacctgagcctg

SEQ ID NO: 3908241 - DNA, 19 bp, Homo sapiens
tggaggacctgagcctgcc

SEQ ID NO: 3908242 - DNA, 17 bp, Homo sapiens
tggaggaggaggaggag

SEQ ID NO: 3908243 - DNA, 19 bp, Homo sapiens
tggaggaggtgtcccaagc

SEQ ID NO: 3908244 - DNA, 15 bp, Homo sapiens
tggaggatggagaga

SEQ ID NO: 3908245 - DNA, 17 bp, Homo sapiens
tggaggcaaatttcagc

SEQ ID NO: 3908246 - DNA, 23 bp, Homo sapiens
tggaggcaggctccccctgcctt

SEQ ID NO: 3908247 - DNA, 18 bp, Homo sapiens
tggaggcctcacacccag

SEQ ID NO: 3908248 - DNA, 18 bp, Homo sapiens
tggaggcctgatgctgcc

SEQ ID NO: 3908249 - DNA, 20 bp, Homo sapiens
tggaggcctgatgctgcccc

SEQ ID NO: 3908250 - DNA, 19 bp, Homo sapiens
tggagggaatgaacctgga

SEQ ID NO: 3908251 - DNA, 20 bp, Homo sapiens
tggagggaatgaacctggag

SEQ ID NO: 3908252 - DNA, 13 bp, Homo sapiens
tggagggatgcca

SEQ ID NO: 3908253 - DNA, 20 bp, Homo sapiens
tggagggctagaacctggag

SEQ ID NO: 3908254 - DNA, 21 bp, Homo sapiens
tggagggctagaacctggaga

SEQ ID NO: 3908255 - DNA, 22 bp, Homo sapiens
tggagggctagaacctggagag

SEQ ID NO: 3908256 - DNA, 21 bp, Homo sapiens
tggagggctagaactggagag

SEQ ID NO: 3908257 - DNA, 23 bp, Homo sapiens
tggagggctagaatctggagagc

SEQ ID NO: 3908258 - DNA, 21 bp, Homo sapiens
tggagggggtgtctggaagct

SEQ ID NO: 3908259 - DNA, 13 bp, Homo sapiens
tggagggtggggc

SEQ ID NO: 3908260 - DNA, 14 bp, Homo sapiens
tggaggtacactct

SEQ ID NO: 3908261 - DNA, 20 bp, Homo sapiens
tggaggtcacattcaggaag

SEQ ID NO: 3908262 - DNA, 22 bp, Homo sapiens
tggaggtcacattcaggaagat

SEQ ID NO: 3908263 - DNA, 23 bp, Homo sapiens
tggaggtgggagacaaggaacca

SEQ ID NO: 3908264 - DNA, 17 bp, Homo sapiens
tggagtctccagtggtt

SEQ ID NO: 3908265 - DNA, 21 bp, Homo sapiens
tggagtctgagtctgagtcct

SEQ ID NO: 3908266 - DNA, 17 bp, Homo sapiens
tggagtgaggcttccag

SEQ ID NO: 3908267 - DNA, 21 bp, Homo sapiens
tggagtgaggcttccaggctc

SEQ ID NO: 3908268 - DNA, 12 bp, Homo sapiens
tggagtgcgctc

SEQ ID NO: 3908269 - DNA, 18 bp, Homo sapiens
tggataatgctgttgcct

SEQ ID NO: 3908270 - DNA, 16 bp, Homo sapiens
tggatactatatgata

SEQ ID NO: 3908271 - DNA, 19 bp, Homo sapiens
tggatatgttgttaaacac

SEQ ID NO: 3908272 - DNA, 20 bp, Homo sapiens
tggatcctgctgtggcctca

SEQ ID NO: 3908273 - DNA, 14 bp, Homo sapiens
tggatctccaagga

SEQ ID NO: 3908274 - DNA, 21 bp, Homo sapiens
tggatctgggaccctttcctt

SEQ ID NO: 3908275 - DNA, 18 bp, Homo sapiens
tggatgaaattttctaga

SEQ ID NO: 3908276 - DNA, 19 bp, Homo sapiens
tggatgaagattctcctgt

SEQ ID NO: 3908277 - DNA, 23 bp, Homo sapiens
tggatgaagattctcctgtgcta

SEQ ID NO: 3908278 - DNA, 13 bp, Homo sapiens
tggatgaccagaa

SEQ ID NO: 3908279 - DNA, 15 bp, Homo sapiens
tggatggaaggagac

SEQ ID NO: 3908280 - DNA, 15 bp, Homo sapiens
tggatggaggagaaa

SEQ ID NO: 3908281 - DNA, 18 bp, Homo sapiens
tggatggaggagaaataa

SEQ ID NO: 3908282 - DNA, 17 bp, Homo sapiens
tggatgggagtgagaca

SEQ ID NO: 3908283 - DNA, 18 bp, Homo sapiens
tggatgggcattgggctg

SEQ ID NO: 3908284 - DNA, 22 bp, Homo sapiens
tggatgggcattgggctgacac

SEQ ID NO: 3908285 - DNA, 23 bp, Homo sapiens
tggatgtggggtccccatcatcc

SEQ ID NO: 3908286 - DNA, 19 bp, Homo sapiens
tggattagctagaatgcac

SEQ ID NO: 3908287 - DNA, 22 bp, Homo sapiens
tggattatagagtatactaaaa

SEQ ID NO: 3908288 - DNA, 14 bp, Homo sapiens
tggattattcattt

SEQ ID NO: 3908289 - DNA, 20 bp, Homo sapiens
tggattattcatttaaaatg

SEQ ID NO: 3908290 - DNA, 22 bp, Homo sapiens
tggattcctaagcagtgcttgt

SEQ ID NO: 3908291 - DNA, 19 bp, Homo sapiens
tggatttcctattttaaaa

SEQ ID NO: 3908292 - DNA, 21 bp, Homo sapiens
tggatttcctattttaaaacc

SEQ ID NO: 3908293 - DNA, 14 bp, Homo sapiens
tggatttctttaga

SEQ ID NO: 3908294 - DNA, 14 bp, Homo sapiens
tggcaaagtgctgt

SEQ ID NO: 3908295 - DNA, 12 bp, Homo sapiens
tggcaaatataa

SEQ ID NO: 3908296 - DNA, 14 bp, Homo sapiens
tggcaaatataaaa

SEQ ID NO: 3908297 - DNA, 13 bp, Homo sapiens
tggcaacagaagc

SEQ ID NO: 3908298 - DNA, 15 bp, Homo sapiens
tggcaacagaagcag

SEQ ID NO: 3908299 - DNA, 15 bp, Homo sapiens
tggcaagaaagctgg

SEQ ID NO: 3908300 - DNA, 16 bp, Homo sapiens
tggcaagggggcgggg

SEQ ID NO: 3908301 - DNA, 14 bp, Homo sapiens
tggcaattttgtaa

SEQ ID NO: 3908302 - DNA, 15 bp, Homo sapiens
tggcaattttgtaac

SEQ ID NO: 3908303 - DNA, 15 bp, Homo sapiens
tggcacaggactgat

SEQ ID NO: 3908304 - DNA, 22 bp, Homo sapiens
tggcacagttttctgagaaaga

SEQ ID NO: 3908305 - DNA, 20 bp, Homo sapiens
tggcaccagaggctgcagaa

SEQ ID NO: 3908306 - DNA, 20 bp, Homo sapiens
tggcaccagatgcaacctca

SEQ ID NO: 3908307 - DNA, 13 bp, Homo sapiens
tggcaccagcccc

SEQ ID NO: 3908308 - DNA, 17 bp, Homo sapiens
tggcaccagccccctgg

SEQ ID NO: 3908309 - DNA, 20 bp, Homo sapiens
tggcaccagccccctggatg

SEQ ID NO: 3908310 - DNA, 13 bp, Homo sapiens
tggcacctcctga

SEQ ID NO: 3908311 - DNA, 14 bp, Homo sapiens
tggcacctcctgag

SEQ ID NO: 3908312 - DNA, 17 bp, Homo sapiens
tggcacctcctgagaag

SEQ ID NO: 3908313 - DNA, 12 bp, Homo sapiens
tggcagaaaaga

SEQ ID NO: 3908314 - DNA, 19 bp, Homo sapiens
tggcagaaaagaggagacc

SEQ ID NO: 3908315 - DNA, 23 bp, Homo sapiens
tggcagaaaagaggagaccctgg

SEQ ID NO: 3908316 - DNA, 18 bp, Homo sapiens
tggcagaccgggggccag

SEQ ID NO: 3908317 - DNA, 19 bp, Homo sapiens
tggcagagaaggcctcttg

SEQ ID NO: 3908318 - DNA, 21 bp, Homo sapiens
tggcagataatcagcctctta

SEQ ID NO: 3908319 - DNA, 15 bp, Homo sapiens
tggcagatgtaggag

SEQ ID NO: 3908320 - DNA, 20 bp, Homo sapiens
tggcagatgtaggagggact

SEQ ID NO: 3908321 - DNA, 22 bp, Homo sapiens
tggcagatttagtgaaagctag

SEQ ID NO: 3908322 - DNA, 18 bp, Homo sapiens
tggcagcagttccatgaa

SEQ ID NO: 3908323 - DNA, 19 bp, Homo sapiens
tggcagccacacttctcag

SEQ ID NO: 3908324 - DNA, 12 bp, Homo sapiens
tggcagccatgc

SEQ ID NO: 3908325 - DNA, 15 bp, Homo sapiens
tggcagccatgcctc

SEQ ID NO: 3908326 - DNA, 21 bp, Homo sapiens
tggcagccatgcctcatgcca

SEQ ID NO: 3908327 - DNA, 16 bp, Homo sapiens
tggcagccgtgccttc

SEQ ID NO: 3908328 - DNA, 18 bp, Homo sapiens
tggcagccgtgccttcag

SEQ ID NO: 3908329 - DNA, 19 bp, Homo sapiens
tggcagccgtgccttcagc

SEQ ID NO: 3908330 - DNA, 20 bp, Homo sapiens
tggcagccgtgccttcagct

SEQ ID NO: 3908331 - DNA, 23 bp, Homo sapiens
tggcagccgtgccttcagctcta

SEQ ID NO: 3908332 - DNA, 15 bp, Homo sapiens
tggcagctagactgg

SEQ ID NO: 3908333 - DNA, 16 bp, Homo sapiens
tggcagctcctctcct

SEQ ID NO: 3908334 - DNA, 16 bp, Homo sapiens
tggcagctgagagccc

SEQ ID NO: 3908335 - DNA, 17 bp, Homo sapiens
tggcagctgagagccct

SEQ ID NO: 3908336 - DNA, 19 bp, Homo sapiens
tggcagctgagagccctgc

SEQ ID NO: 3908337 - DNA, 18 bp, Homo sapiens
tggcagctgtcattcagg

SEQ ID NO: 3908338 - DNA, 17 bp, Homo sapiens
tggcaggacacatcccg

SEQ ID NO: 3908339 - DNA, 19 bp, Homo sapiens
tggcaggacacatcccggc

SEQ ID NO: 3908340 - DNA, 20 bp, Homo sapiens
tggcaggcacacagcagccc

SEQ ID NO: 3908341 - DNA, 21 bp, Homo sapiens
tggcaggcacacagcagcccc

SEQ ID NO: 3908342 - DNA, 23 bp, Homo sapiens
tggcaggcacacagcagcccccc

SEQ ID NO: 3908343 - DNA, 16 bp, Homo sapiens
tggcagggtgggatgg

SEQ ID NO: 3908344 - DNA, 21 bp, Homo sapiens
tggcagtattccatgggatgt

SEQ ID NO: 3908345 - DNA, 15 bp, Homo sapiens
tggcatatttatatt

SEQ ID NO: 3908346 - DNA, 18 bp, Homo sapiens
tggcatgatttatatatg

SEQ ID NO: 3908347 - DNA, 21 bp, Homo sapiens
tggcatgatttatatatggca

SEQ ID NO: 3908348 - DNA, 20 bp, Homo sapiens
tggcatgtcagagccaggct

SEQ ID NO: 3908349 - DNA, 21 bp, Homo sapiens
tggcatgtcagagccaggctc

SEQ ID NO: 3908350 - DNA, 17 bp, Homo sapiens
tggcattggtctgctga

SEQ ID NO: 3908351 - DNA, 17 bp, Homo sapiens
tggcattttcctcgcct

SEQ ID NO: 3908352 - DNA, 18 bp, Homo sapiens
tggccaaattatttgtgt

SEQ ID NO: 3908353 - DNA, 13 bp, Homo sapiens
tggccaagctgag

SEQ ID NO: 3908354 - DNA, 14 bp, Homo sapiens
tggccaagctgagg

SEQ ID NO: 3908355 - DNA, 19 bp, Homo sapiens
tggccacccaacagcacca

SEQ ID NO: 3908356 - DNA, 18 bp, Homo sapiens
tggccaccccgtgccacc

SEQ ID NO: 3908357 - DNA, 22 bp, Homo sapiens
tggccacccgttctgctggcct

SEQ ID NO: 3908358 - DNA, 16 bp, Homo sapiens
tggccaccctggcccg

SEQ ID NO: 3908359 - DNA, 17 bp, Homo sapiens
tggccactccagacccc

SEQ ID NO: 3908360 - DNA, 19 bp, Homo sapiens
tggccactgggtctcactc

SEQ ID NO: 3908361 - DNA, 21 bp, Homo sapiens
tggccacttgggtcttccctg

SEQ ID NO: 3908362 - DNA, 21 bp, Homo sapiens
tggccagacacaggtgcctca

SEQ ID NO: 3908363 - DNA, 12 bp, Homo sapiens
tggccagagctg

SEQ ID NO: 3908364 - DNA, 20 bp, Homo sapiens
tggccagagctggaaggcag

SEQ ID NO: 3908365 - DNA, 17 bp, Homo sapiens
tggccagagctgggagg

SEQ ID NO: 3908366 - DNA, 18 bp, Homo sapiens
tggccagagctgggaggc

SEQ ID NO: 3908367 - DNA, 17 bp, Homo sapiens
tggccaggagctggagg

SEQ ID NO: 3908368 - DNA, 20 bp, Homo sapiens
tggccaggcaccccctggag

SEQ ID NO: 3908369 - DNA, 19 bp, Homo sapiens
tggccagggtgagagctgc

SEQ ID NO: 3908370 - DNA, 19 bp, Homo sapiens
tggccagtcctagagctcc

SEQ ID NO: 3908371 - DNA, 20 bp, Homo sapiens
tggccagtcctagagctcct

SEQ ID NO: 3908372 - DNA, 21 bp, Homo sapiens
tggccagtcctagagctcctg

SEQ ID NO: 3908373 - DNA, 15 bp, Homo sapiens
tggccatccctgggc

SEQ ID NO: 3908374 - DNA, 16 bp, Homo sapiens
tggccatccctgggcc

SEQ ID NO: 3908375 - DNA, 17 bp, Homo sapiens
tggccatccctgggccc

SEQ ID NO: 3908376 - DNA, 23 bp, Homo sapiens
tggccatccctgggcccctccac

SEQ ID NO: 3908377 - DNA, 17 bp, Homo sapiens
tggccattttcttgcct

SEQ ID NO: 3908378 - DNA, 20 bp, Homo sapiens
tggccattttcttgcctgag

SEQ ID NO: 3908379 - DNA, 22 bp, Homo sapiens
tggccattttcttgcctgaggc

SEQ ID NO: 3908380 - DNA, 19 bp, Homo sapiens
tggcccaagcctggtctcc

SEQ ID NO: 3908381 - DNA, 23 bp, Homo sapiens
tggcccatagaaacatgacactg

SEQ ID NO: 3908382 - DNA, 13 bp, Homo sapiens
tggccccagggtt

SEQ ID NO: 3908383 - DNA, 14 bp, Homo sapiens
tggccccagggttg

SEQ ID NO: 3908384 - DNA, 14 bp, Homo sapiens
tggccccaggtgcc

SEQ ID NO: 3908385 - DNA, 18 bp, Homo sapiens
tggccccaggtgccacca

SEQ ID NO: 3908386 - DNA, 19 bp, Homo sapiens
tggccccatgtctctcaga

SEQ ID NO: 3908387 - DNA, 14 bp, Homo sapiens
tggcccccctccag

SEQ ID NO: 3908388 - DNA, 15 bp, Homo sapiens
tggcccccctccagg

SEQ ID NO: 3908389 - DNA, 17 bp, Homo sapiens
tggccccctgtgccagc

SEQ ID NO: 3908390 - DNA, 15 bp, Homo sapiens
tggccccgcagtgcc

SEQ ID NO: 3908391 - DNA, 19 bp, Homo sapiens
tggccccgggctctggcca

SEQ ID NO: 3908392 - DNA, 20 bp, Homo sapiens
tggccccgggctctggccac

SEQ ID NO: 3908393 - DNA, 19 bp, Homo sapiens
tggcccctgcccccaaagg

SEQ ID NO: 3908394 - DNA, 14 bp, Homo sapiens
tggcccgacagcct

SEQ ID NO: 3908395 - DNA, 15 bp, Homo sapiens
tggcccgacagcctg

SEQ ID NO: 3908396 - DNA, 18 bp, Homo sapiens
tggcccgacagcctggca

SEQ ID NO: 3908397 - DNA, 21 bp, Homo sapiens
tggcccgcccctcgctgctgc

SEQ ID NO: 3908398 - DNA, 13 bp, Homo sapiens
tggccctcttctt

SEQ ID NO: 3908399 - DNA, 16 bp, Homo sapiens
tggccctgccttcttc

SEQ ID NO: 3908400 - DNA, 14 bp, Homo sapiens
tggccctggcctgc

SEQ ID NO: 3908401 - DNA, 15 bp, Homo sapiens
tggccctggcctgct

SEQ ID NO: 3908402 - DNA, 17 bp, Homo sapiens
tggcctattatattaaa

SEQ ID NO: 3908403 - DNA, 15 bp, Homo sapiens
tggcctcactggctg

SEQ ID NO: 3908404 - DNA, 21 bp, Homo sapiens
tggcctcacttccctgggaac

SEQ ID NO: 3908405 - DNA, 12 bp, Homo sapiens
tggcctcagccc

SEQ ID NO: 3908406 - DNA, 13 bp, Homo sapiens
tggcctcagccct

SEQ ID NO: 3908407 - DNA, 13 bp, Homo sapiens
tggcctcctgcct

SEQ ID NO: 3908408 - DNA, 17 bp, Homo sapiens
tggcctccttttgctgt

SEQ ID NO: 3908409 - DNA, 14 bp, Homo sapiens
tggcctcgcctggg

SEQ ID NO: 3908410 - DNA, 15 bp, Homo sapiens
tggcctcgcctgggc

SEQ ID NO: 3908411 - DNA, 16 bp, Homo sapiens
tggcctcgcctgggcc

SEQ ID NO: 3908412 - DNA, 21 bp, Homo sapiens
tggcctcgcctgggcccaggc

SEQ ID NO: 3908413 - DNA, 22 bp, Homo sapiens
tggcctcgcctgggcccaggct

SEQ ID NO: 3908414 - DNA, 22 bp, Homo sapiens
tggcctctagaacacccactgg

SEQ ID NO: 3908415 - DNA, 18 bp, Homo sapiens
tggcctgagctggggcca

SEQ ID NO: 3908416 - DNA, 19 bp, Homo sapiens
tggcctgcggccgggctgc

SEQ ID NO: 3908417 - DNA, 13 bp, Homo sapiens
tggcctgctggga

SEQ ID NO: 3908418 - DNA, 12 bp, Homo sapiens
tggcctggatct

SEQ ID NO: 3908419 - DNA, 12 bp, Homo sapiens
tggcctggctcc

SEQ ID NO: 3908420 - DNA, 14 bp, Homo sapiens
tggcctgtgtccag

SEQ ID NO: 3908421 - DNA, 17 bp, Homo sapiens
tggcctgtgtccagcag

SEQ ID NO: 3908422 - DNA, 18 bp, Homo sapiens
tggcctgtgtccagcagc

SEQ ID NO: 3908423 - DNA, 21 bp, Homo sapiens
tggcctgtgtccagcagctgc

SEQ ID NO: 3908424 - DNA, 21 bp, Homo sapiens
tggccttccccttttgcctgg

SEQ ID NO: 3908425 - DNA, 23 bp, Homo sapiens
tggccttccccttttgcctggct

SEQ ID NO: 3908426 - DNA, 17 bp, Homo sapiens
tggccttgtcaggaccc

SEQ ID NO: 3908427 - DNA, 18 bp, Homo sapiens
tggccttgtcaggaccca

SEQ ID NO: 3908428 - DNA, 23 bp, Homo sapiens
tggccttgtcaggacccaggccg

SEQ ID NO: 3908429 - DNA, 18 bp, Homo sapiens
tggccttgtgtcagagct

SEQ ID NO: 3908430 - DNA, 19 bp, Homo sapiens
tggccttgttctgtcacca

SEQ ID NO: 3908431 - DNA, 16 bp, Homo sapiens
tggccttttcctattt

SEQ ID NO: 3908432 - DNA, 13 bp, Homo sapiens
tggcgagaggaga

SEQ ID NO: 3908433 - DNA, 13 bp, Homo sapiens
tggcgcgggaggc

SEQ ID NO: 3908434 - DNA, 17 bp, Homo sapiens
tggcggctactcagcag

SEQ ID NO: 3908435 - DNA, 21 bp, Homo sapiens
tggcggctactcagcagccct

SEQ ID NO: 3908436 - DNA, 14 bp, Homo sapiens
tggcggggcaggag

SEQ ID NO: 3908437 - DNA, 15 bp, Homo sapiens
tggcggggcaggagg

SEQ ID NO: 3908438 - DNA, 15 bp, Homo sapiens
tggcgtaatgggcct

SEQ ID NO: 3908439 - DNA, 17 bp, Homo sapiens
tggctaattcaatttat

SEQ ID NO: 3908440 - DNA, 15 bp, Homo sapiens
tggctaattcccaga

SEQ ID NO: 3908441 - DNA, 16 bp, Homo sapiens
tggctactctgtgcca

SEQ ID NO: 3908442 - DNA, 17 bp, Homo sapiens
tggctactctgtgccag

SEQ ID NO: 3908443 - DNA, 20 bp, Homo sapiens
tggctactctgtgccagagc

SEQ ID NO: 3908444 - DNA, 15 bp, Homo sapiens
tggctataggtgcta

SEQ ID NO: 3908445 - DNA, 18 bp, Homo sapiens
tggctatcctagagaggc

SEQ ID NO: 3908446 - DNA, 20 bp, Homo sapiens
tggctatcctagagaggctg

SEQ ID NO: 3908447 - DNA, 15 bp, Homo sapiens
tggctcacccaagca

SEQ ID NO: 3908448 - DNA, 13 bp, Homo sapiens
tggctcaggcaag

SEQ ID NO: 3908449 - DNA, 14 bp, Homo sapiens
tggctcaggcaagc

SEQ ID NO: 3908450 - DNA, 18 bp, Homo sapiens
tggctcaggcaagcccct

SEQ ID NO: 3908451 - DNA, 21 bp, Homo sapiens
tggctcaggcaagcccctcag

SEQ ID NO: 3908452 - DNA, 22 bp, Homo sapiens
tggctcatggcgtaatgggcct

SEQ ID NO: 3908453 - DNA, 19 bp, Homo sapiens
tggctcctcccggtgccca

SEQ ID NO: 3908454 - DNA, 15 bp, Homo sapiens
tggctcctgtttcca

SEQ ID NO: 3908455 - DNA, 15 bp, Homo sapiens
tggctcgctccctgt

SEQ ID NO: 3908456 - DNA, 23 bp, Homo sapiens
tggctcgctccctgtagctctgc

SEQ ID NO: 3908457 - DNA, 19 bp, Homo sapiens
tggctcttctaacctcagc

SEQ ID NO: 3908458 - DNA, 13 bp, Homo sapiens
tggctgaagacat

SEQ ID NO: 3908459 - DNA, 16 bp, Homo sapiens
tggctgacccagtccc

SEQ ID NO: 3908460 - DNA, 21 bp, Homo sapiens
tggctgacccagtccctgggg

SEQ ID NO: 3908461 - DNA, 22 bp, Homo sapiens
tggctgaccccaaagagcctgg

SEQ ID NO: 3908462 - DNA, 13 bp, Homo sapiens
tggctgagggcag

SEQ ID NO: 3908463 - DNA, 22 bp, Homo sapiens
tggctgagggcagttcgcagcc

SEQ ID NO: 3908464 - DNA, 22 bp, Homo sapiens
tggctggatgaaattttctaga

SEQ ID NO: 3908465 - DNA, 14 bp, Homo sapiens
tggctggctgaggg

SEQ ID NO: 3908466 - DNA, 18 bp, Homo sapiens
tggctggctgagggcagt

SEQ ID NO: 3908467 - DNA, 16 bp, Homo sapiens
tggctggggcagaggg

SEQ ID NO: 3908468 - DNA, 17 bp, Homo sapiens
tggctgtaatcagttat

SEQ ID NO: 3908469 - DNA, 14 bp, Homo sapiens
tggctgtattcaga

SEQ ID NO: 3908470 - DNA, 15 bp, Homo sapiens
tggctgtgaggcccc

SEQ ID NO: 3908471 - DNA, 18 bp, Homo sapiens
tggctgtgcctctgcctg

SEQ ID NO: 3908472 - DNA, 14 bp, Homo sapiens
tggctgtggaggcc

SEQ ID NO: 3908473 - DNA, 20 bp, Homo sapiens
tggctgtggaggcctgatgc

SEQ ID NO: 3908474 - DNA, 17 bp, Homo sapiens
tggctgtggcacagact

SEQ ID NO: 3908475 - DNA, 23 bp, Homo sapiens
tggctgtggttcctaagcctgtt

SEQ ID NO: 3908476 - DNA, 17 bp, Homo sapiens
tggcttcaaaatagaga

SEQ ID NO: 3908477 - DNA, 14 bp, Homo sapiens
tggcttcccatccc

SEQ ID NO: 3908478 - DNA, 17 bp, Homo sapiens
tggcttcccgctcagcc

SEQ ID NO: 3908479 - DNA, 11 bp, Homo sapiens
tggcttcctcc

SEQ ID NO: 3908480 - DNA, 22 bp, Homo sapiens
tggcttcctccgtccacccagg

SEQ ID NO: 3908481 - DNA, 23 bp, Homo sapiens
tggcttcctccgtccacccaggc

SEQ ID NO: 3908482 - DNA, 14 bp, Homo sapiens
tggcttcctcctga

SEQ ID NO: 3908483 - DNA, 19 bp, Homo sapiens
tggcttctagatctggaac

SEQ ID NO: 3908484 - DNA, 16 bp, Homo sapiens
tggcttctgggacctg

SEQ ID NO: 3908485 - DNA, 22 bp, Homo sapiens
tggcttctgtgcactagcctgt

SEQ ID NO: 3908486 - DNA, 14 bp, Homo sapiens
tggcttgctccagg

SEQ ID NO: 3908487 - DNA, 16 bp, Homo sapiens
tggcttgctccagggt

SEQ ID NO: 3908488 - DNA, 15 bp, Homo sapiens
tggcttggggagcag

SEQ ID NO: 3908489 - DNA, 17 bp, Homo sapiens
tggcttgtaactccacc

SEQ ID NO: 3908490 - DNA, 17 bp, Homo sapiens
tggctttacattttatt

SEQ ID NO: 3908491 - DNA, 14 bp, Homo sapiens
tggctttcccttcc

SEQ ID NO: 3908492 - DNA, 18 bp, Homo sapiens
tggctttgacatgaaaag

SEQ ID NO: 3908493 - DNA, 15 bp, Homo sapiens
tggcttttcactgct

SEQ ID NO: 3908494 - DNA, 18 bp, Homo sapiens
tggcttttcactgctggc

SEQ ID NO: 3908495 - DNA, 22 bp, Homo sapiens
tggcttttcactgctggctgcc

SEQ ID NO: 3908496 - DNA, 22 bp, Homo sapiens
tggcttttcgcttgcttctgca

SEQ ID NO: 3908497 - DNA, 21 bp, Homo sapiens
tgggaaaaaagttttgatgaa

SEQ ID NO: 3908498 - DNA, 22 bp, Homo sapiens
tgggaaaaaagttttgatgaaa

SEQ ID NO: 3908499 - DNA, 15 bp, Homo sapiens
tgggaaaacagagga

SEQ ID NO: 3908500 - DNA, 13 bp, Homo sapiens
tgggaaaggaaaa

SEQ ID NO: 3908501 - DNA, 22 bp, Homo sapiens
tgggaaatggtatgagctgagg

SEQ ID NO: 3908502 - DNA, 20 bp, Homo sapiens
tgggaacccaagtccaagca

SEQ ID NO: 3908503 - DNA, 14 bp, Homo sapiens
tgggaaccccgcag

SEQ ID NO: 3908504 - DNA, 20 bp, Homo sapiens
tgggaaccccgcagcccgtg

SEQ ID NO: 3908505 - DNA, 19 bp, Homo sapiens
tgggaacccgactgtgaaa

SEQ ID NO: 3908506 - DNA, 15 bp, Homo sapiens
tgggaaccctcccca

SEQ ID NO: 3908507 - DNA, 16 bp, Homo sapiens
tgggaacgtgactgcc

SEQ ID NO: 3908508 - DNA, 13 bp, Homo sapiens
tgggaactctgac

SEQ ID NO: 3908509 - DNA, 16 bp, Homo sapiens
tgggaactctgacaag

SEQ ID NO: 3908510 - DNA, 22 bp, Homo sapiens
tgggaactctgacaagggctga

SEQ ID NO: 3908511 - DNA, 17 bp, Homo sapiens
tgggaagatggtagcag

SEQ ID NO: 3908512 - DNA, 21 bp, Homo sapiens
tgggaagccatattcacacct

SEQ ID NO: 3908513 - DNA, 21 bp, Homo sapiens
tgggaagctgtactcagagca

SEQ ID NO: 3908514 - DNA, 23 bp, Homo sapiens
tgggaagctgtactcagagcaga

SEQ ID NO: 3908515 - DNA, 24 bp, Homo sapiens
tgggaagctgtactcagagcagag

SEQ ID NO: 3908516 - DNA, 17 bp, Homo sapiens
tgggaagcttgctggct

SEQ ID NO: 3908517 - DNA, 14 bp, Homo sapiens
tgggaaggctaagt

SEQ ID NO: 3908518 - DNA, 23 bp, Homo sapiens
tgggaaggctacttcggggctgg

SEQ ID NO: 3908519 - DNA, 13 bp, Homo sapiens
tgggacagcccca

SEQ ID NO: 3908520 - DNA, 17 bp, Homo sapiens
tgggacagccccagggc

SEQ ID NO: 3908521 - DNA, 19 bp, Homo sapiens
tgggacagccccagggccc

SEQ ID NO: 3908522 - DNA, 20 bp, Homo sapiens
tgggacagccccagggccct

SEQ ID NO: 3908523 - DNA, 14 bp, Homo sapiens
tgggaccaggcacc

SEQ ID NO: 3908524 - DNA, 20 bp, Homo sapiens
tgggacccagctactctgtc

SEQ ID NO: 3908525 - DNA, 14 bp, Homo sapiens
tgggacccctccca

SEQ ID NO: 3908526 - DNA, 20 bp, Homo sapiens
tgggacccctcccaacctca

SEQ ID NO: 3908527 - DNA, 21 bp, Homo sapiens
tgggacccctcccaacctcaa

SEQ ID NO: 3908528 - DNA, 22 bp, Homo sapiens
tgggacccctcccaacctcaat

SEQ ID NO: 3908529 - DNA, 14 bp, Homo sapiens
tgggaccctttcct

SEQ ID NO: 3908530 - DNA, 17 bp, Homo sapiens
tgggaccctttccttcc

SEQ ID NO: 3908531 - DNA, 15 bp, Homo sapiens
tgggaccgctacacc

SEQ ID NO: 3908532 - DNA, 21 bp, Homo sapiens
tgggaccgctacaccactctg

SEQ ID NO: 3908533 - DNA, 18 bp, Homo sapiens
tgggactagagctttctt

SEQ ID NO: 3908534 - DNA, 20 bp, Homo sapiens
tgggactgagcctggcccat

SEQ ID NO: 3908535 - DNA, 17 bp, Homo sapiens
tgggactgtgcctttgg

SEQ ID NO: 3908536 - DNA, 18 bp, Homo sapiens
tgggagaatgtcagttca

SEQ ID NO: 3908537 - DNA, 21 bp, Homo sapiens
tgggagacaagaaatccctgt

SEQ ID NO: 3908538 - DNA, 17 bp, Homo sapiens
tgggagacaaggaacca

SEQ ID NO: 3908539 - DNA, 14 bp, Homo sapiens
tgggagagccagct

SEQ ID NO: 3908540 - DNA, 16 bp, Homo sapiens
tgggagagccagctct

SEQ ID NO: 3908541 - DNA, 13 bp, Homo sapiens
tgggagcactgga

SEQ ID NO: 3908542 - DNA, 16 bp, Homo sapiens
tgggagcttgggaatg

SEQ ID NO: 3908543 - DNA, 20 bp, Homo sapiens
tgggaggaaaagaaaagagg

SEQ ID NO: 3908544 - DNA, 13 bp, Homo sapiens
tgggaggcagcat

SEQ ID NO: 3908545 - DNA, 18 bp, Homo sapiens
tgggaggcatggccctgg

SEQ ID NO: 3908546 - DNA, 12 bp, Homo sapiens
tgggaggccaag

SEQ ID NO: 3908547 - DNA, 18 bp, Homo sapiens
tgggaggccaaggcaggt

SEQ ID NO: 3908548 - DNA, 22 bp, Homo sapiens
tgggaggcctcgtaccagccag

SEQ ID NO: 3908549 - DNA, 22 bp, Homo sapiens
tgggaggcggagagtacagtga

SEQ ID NO: 3908550 - DNA, 17 bp, Homo sapiens
tgggagggagcagacag

SEQ ID NO: 3908551 - DNA, 14 bp, Homo sapiens
tgggagggatgaga

SEQ ID NO: 3908552 - DNA, 18 bp, Homo sapiens
tgggagggggctccatgg

SEQ ID NO: 3908553 - DNA, 13 bp, Homo sapiens
tgggaggtcgagg

SEQ ID NO: 3908554 - DNA, 20 bp, Homo sapiens
tgggagtcaggacctccggg

SEQ ID NO: 3908555 - DNA, 15 bp, Homo sapiens
tgggagtggcccctg

SEQ ID NO: 3908556 - DNA, 14 bp, Homo sapiens
tgggagtgttctgt

SEQ ID NO: 3908557 - DNA, 21 bp, Homo sapiens
tgggatgagaatgaaagctta

SEQ ID NO: 3908558 - DNA, 16 bp, Homo sapiens
tgggatgagccgctgt

SEQ ID NO: 3908559 - DNA, 16 bp, Homo sapiens
tgggatggaggagaag

SEQ ID NO: 3908560 - DNA, 16 bp, Homo sapiens
tgggatggatgctggg

SEQ ID NO: 3908561 - DNA, 22 bp, Homo sapiens
tgggatgtcctctttactccct

SEQ ID NO: 3908562 - DNA, 19 bp, Homo sapiens
tgggatttcttcgctgctc

SEQ ID NO: 3908563 - DNA, 21 bp, Homo sapiens
tgggatttcttcgctgctcta

SEQ ID NO: 3908564 - DNA, 19 bp, Homo sapiens
tgggcaatgaaaccaaagc

SEQ ID NO: 3908565 - DNA, 15 bp, Homo sapiens
tgggcacatgaggag

SEQ ID NO: 3908566 - DNA, 18 bp, Homo sapiens
tgggcacatgaggagggt

SEQ ID NO: 3908567 - DNA, 15 bp, Homo sapiens
tgggcacccacctcc

SEQ ID NO: 3908568 - DNA, 18 bp, Homo sapiens
tgggcacccacctccacc

SEQ ID NO: 3908569 - DNA, 18 bp, Homo sapiens
tgggcacccccagcctgg

SEQ ID NO: 3908570 - DNA, 19 bp, Homo sapiens
tgggcacccccagcctggg

SEQ ID NO: 3908571 - DNA, 22 bp, Homo sapiens
tgggcacccccagcctgggcct

SEQ ID NO: 3908572 - DNA, 12 bp, Homo sapiens
tgggcagcaccc

SEQ ID NO: 3908573 - DNA, 13 bp, Homo sapiens
tgggcagcaccct

SEQ ID NO: 3908574 - DNA, 12 bp, Homo sapiens
tgggcagctggg

SEQ ID NO: 3908575 - DNA, 14 bp, Homo sapiens
tgggcagctgggcc

SEQ ID NO: 3908576 - DNA, 17 bp, Homo sapiens
tgggcagtgcctcctgg

SEQ ID NO: 3908577 - DNA, 19 bp, Homo sapiens
tgggcagtgcctcctggga

SEQ ID NO: 3908578 - DNA, 15 bp, Homo sapiens
tgggcatccacccag

SEQ ID NO: 3908579 - DNA, 21 bp, Homo sapiens
tgggcatccacccagtgctgc

SEQ ID NO: 3908580 - DNA, 23 bp, Homo sapiens
tgggcatccacccagtgctgcca

SEQ ID NO: 3908581 - DNA, 16 bp, Homo sapiens
tgggcatcttctggct

SEQ ID NO: 3908582 - DNA, 19 bp, Homo sapiens
tgggcattgggttctaaag

SEQ ID NO: 3908583 - DNA, 19 bp, Homo sapiens
tgggccaaaagggcagcca

SEQ ID NO: 3908584 - DNA, 20 bp, Homo sapiens
tgggccaaaagggcagccag

SEQ ID NO: 3908585 - DNA, 18 bp, Homo sapiens
tgggccaaggtgtttcca

SEQ ID NO: 3908586 - DNA, 20 bp, Homo sapiens
tgggccactctcccctccct

SEQ ID NO: 3908587 - DNA, 13 bp, Homo sapiens
tgggccactgcca

SEQ ID NO: 3908588 - DNA, 13 bp, Homo sapiens
tgggccagagaag

SEQ ID NO: 3908589 - DNA, 14 bp, Homo sapiens
tgggccagcctcag

SEQ ID NO: 3908590 - DNA, 15 bp, Homo sapiens
tgggccagcctcagc

SEQ ID NO: 3908591 - DNA, 17 bp, Homo sapiens
tgggccagcctcagctc

SEQ ID NO: 3908592 - DNA, 13 bp, Homo sapiens
tgggcccaggctc

SEQ ID NO: 3908593 - DNA, 16 bp, Homo sapiens
tgggcccaggctctgg

SEQ ID NO: 3908594 - DNA, 19 bp, Homo sapiens
tgggcccaggctctgggaa

SEQ ID NO: 3908595 - DNA, 21 bp, Homo sapiens
tgggcccaggctctgggaagg

SEQ ID NO: 3908596 - DNA, 13 bp, Homo sapiens
tgggccccatgct

SEQ ID NO: 3908597 - DNA, 17 bp, Homo sapiens
tgggccccatgctctgc

SEQ ID NO: 3908598 - DNA, 17 bp, Homo sapiens
tgggcccctccacgcct

SEQ ID NO: 3908599 - DNA, 23 bp, Homo sapiens
tgggcccctccacgcctcctggc

SEQ ID NO: 3908600 - DNA, 14 bp, Homo sapiens
tgggccctggggcc

SEQ ID NO: 3908601 - DNA, 16 bp, Homo sapiens
tgggccctggggcctg

SEQ ID NO: 3908602 - DNA, 19 bp, Homo sapiens
tgggccctggggcctgtac

SEQ ID NO: 3908603 - DNA, 14 bp, Homo sapiens
tgggccggccagcc

SEQ ID NO: 3908604 - DNA, 17 bp, Homo sapiens
tgggcctatggagagcc

SEQ ID NO: 3908605 - DNA, 22 bp, Homo sapiens
tgggcctatggagagccctggg

SEQ ID NO: 3908606 - DNA, 20 bp, Homo sapiens
tgggcctcagttcaacctgg

SEQ ID NO: 3908607 - DNA, 20 bp, Homo sapiens
tgggcctcctctccctgcac

SEQ ID NO: 3908608 - DNA, 12 bp, Homo sapiens
tgggcctgctgc

SEQ ID NO: 3908609 - DNA, 15 bp, Homo sapiens
tgggcctgctgctga

SEQ ID NO: 3908610 - DNA, 23 bp, Homo sapiens
tgggcctgctgctgagaacctgg

SEQ ID NO: 3908611 - DNA, 23 bp, Homo sapiens
tgggcctgcttttccaggatcct

SEQ ID NO: 3908612 - DNA, 18 bp, Homo sapiens
tgggcctggcctgagctg

SEQ ID NO: 3908613 - DNA, 12 bp, Homo sapiens
tgggcctgggcc

SEQ ID NO: 3908614 - DNA, 13 bp, Homo sapiens
tgggcctgtcccc

SEQ ID NO: 3908615 - DNA, 12 bp, Homo sapiens
tgggcctgtgca

SEQ ID NO: 3908616 - DNA, 15 bp, Homo sapiens
tgggcctgtgcagca

SEQ ID NO: 3908617 - DNA, 16 bp, Homo sapiens
tgggcctgtgcagcag

SEQ ID NO: 3908618 - DNA, 21 bp, Homo sapiens
tgggcctgtgcagcagcccag

SEQ ID NO: 3908619 - DNA, 16 bp, Homo sapiens
tgggccttgctttggg

SEQ ID NO: 3908620 - DNA, 17 bp, Homo sapiens
tgggccttgctttgggc

SEQ ID NO: 3908621 - DNA, 18 bp, Homo sapiens
tgggccttgctttgggct

SEQ ID NO: 3908622 - DNA, 13 bp, Homo sapiens
tgggcctttcctg

SEQ ID NO: 3908623 - DNA, 17 bp, Homo sapiens
tgggctaattaaataaa

SEQ ID NO: 3908624 - DNA, 14 bp, Homo sapiens
tgggctcagggctg

SEQ ID NO: 3908625 - DNA, 14 bp, Homo sapiens
tgggctcctggctg

SEQ ID NO: 3908626 - DNA, 17 bp, Homo sapiens
tgggctcctggctgcca

SEQ ID NO: 3908627 - DNA, 20 bp, Homo sapiens
tgggctcctggctgccaggc

SEQ ID NO: 3908628 - DNA, 21 bp, Homo sapiens
tgggctcctggctgccaggcg

SEQ ID NO: 3908629 - DNA, 15 bp, Homo sapiens
tgggctctccacctc

SEQ ID NO: 3908630 - DNA, 20 bp, Homo sapiens
tgggctctccacctcagcct

SEQ ID NO: 3908631 - DNA, 14 bp, Homo sapiens
tgggctgccctggt

SEQ ID NO: 3908632 - DNA, 19 bp, Homo sapiens
tgggctgccctggtgctgc

SEQ ID NO: 3908633 - DNA, 20 bp, Homo sapiens
tgggctgccctggtgctgcc

SEQ ID NO: 3908634 - DNA, 15 bp, Homo sapiens
tgggctgtcaacatt

SEQ ID NO: 3908635 - DNA, 16 bp, Homo sapiens
tgggctttaacaaaac

SEQ ID NO: 3908636 - DNA, 15 bp, Homo sapiens
tgggctttgcaggct

SEQ ID NO: 3908637 - DNA, 17 bp, Homo sapiens
tgggctttgcaggctct

SEQ ID NO: 3908638 - DNA, 19 bp, Homo sapiens
tgggctttgcaggctctgg

SEQ ID NO: 3908639 - DNA, 21 bp, Homo sapiens
tgggctttgcaggctctgggc

SEQ ID NO: 3908640 - DNA, 20 bp, Homo sapiens
tggggaagtgctccccacac

SEQ ID NO: 3908641 - DNA, 12 bp, Homo sapiens
tggggacactaa

SEQ ID NO: 3908642 - DNA, 18 bp, Homo sapiens
tggggacagttggcagag

SEQ ID NO: 3908643 - DNA, 23 bp, Homo sapiens
tggggagaaataaattttgtttc

SEQ ID NO: 3908644 - DNA, 12 bp, Homo sapiens
tggggaggaagg

SEQ ID NO: 3908645 - DNA, 12 bp, Homo sapiens
tggggaggcagc

SEQ ID NO: 3908646 - DNA, 22 bp, Homo sapiens
tggggagggggaagagaaattt

SEQ ID NO: 3908647 - DNA, 14 bp, Homo sapiens
tggggatgtgggag

SEQ ID NO: 3908648 - DNA, 14 bp, Homo sapiens
tggggcagaggggc

SEQ ID NO: 3908649 - DNA, 19 bp, Homo sapiens
tggggcaggagtagctgag

SEQ ID NO: 3908650 - DNA, 20 bp, Homo sapiens
tggggcaggagtagctgagc

SEQ ID NO: 3908651 - DNA, 11 bp, Homo sapiens
tggggcagtgg

SEQ ID NO: 3908652 - DNA, 16 bp, Homo sapiens
tggggcatagaaactg

SEQ ID NO: 3908653 - DNA, 18 bp, Homo sapiens
tggggcatagaactccgg

SEQ ID NO: 3908654 - DNA, 17 bp, Homo sapiens
tggggcatgtgtgcctg

SEQ ID NO: 3908655 - DNA, 18 bp, Homo sapiens
tggggcatgtgtgcctgt

SEQ ID NO: 3908656 - DNA, 13 bp, Homo sapiens
tggggccagtgta

SEQ ID NO: 3908657 - DNA, 22 bp, Homo sapiens
tggggccagtgtaaggcatagg

SEQ ID NO: 3908658 - DNA, 16 bp, Homo sapiens
tggggccccgctggga

SEQ ID NO: 3908659 - DNA, 15 bp, Homo sapiens
tggggccctgggcct

SEQ ID NO: 3908660 - DNA, 11 bp, Homo sapiens
tggggcctgta

SEQ ID NO: 3908661 - DNA, 19 bp, Homo sapiens
tggggcctgtactgcctgc

SEQ ID NO: 3908662 - DNA, 11 bp, Homo sapiens
tggggctcctt

SEQ ID NO: 3908663 - DNA, 23 bp, Homo sapiens
tggggctcctttctccagccagc

SEQ ID NO: 3908664 - DNA, 15 bp, Homo sapiens
tggggctcgtggcct

SEQ ID NO: 3908665 - DNA, 20 bp, Homo sapiens
tggggctcgtggccttcccc

SEQ ID NO: 3908666 - DNA, 11 bp, Homo sapiens
tggggctgaac

SEQ ID NO: 3908667 - DNA, 17 bp, Homo sapiens
tggggctgctcctccag

SEQ ID NO: 3908668 - DNA, 21 bp, Homo sapiens
tggggctgctcctccagggcc

SEQ ID NO: 3908669 - DNA, 16 bp, Homo sapiens
tgggggaagccctgga

SEQ ID NO: 3908670 - DNA, 12 bp, Homo sapiens
tgggggagggag

SEQ ID NO: 3908671 - DNA, 17 bp, Homo sapiens
tgggggagggaggttcc

SEQ ID NO: 3908672 - DNA, 21 bp, Homo sapiens
tgggggccagctggtgctgca

SEQ ID NO: 3908673 - DNA, 12 bp, Homo sapiens
tgggggcctggc

SEQ ID NO: 3908674 - DNA, 19 bp, Homo sapiens
tgggggcgggggagccaac

SEQ ID NO: 3908675 - DNA, 17 bp, Homo sapiens
tggggggccgggcaggt

SEQ ID NO: 3908676 - DNA, 19 bp, Homo sapiens
tggggggtgatgagggcag

SEQ ID NO: 3908677 - DNA, 24 bp, Homo sapiens
tggggggtgatgagggcagcagcc

SEQ ID NO: 3908678 - DNA, 14 bp, Homo sapiens
tgggggtggcaggc

SEQ ID NO: 3908679 - DNA, 19 bp, Homo sapiens
tgggggtggccatccctgg

SEQ ID NO: 3908680 - DNA, 21 bp, Homo sapiens
tgggggtggccatccctgggc

SEQ ID NO: 3908681 - DNA, 11 bp, Homo sapiens
tgggggtgggg

SEQ ID NO: 3908682 - DNA, 19 bp, Homo sapiens
tgggggttctttcttcctc

SEQ ID NO: 3908683 - DNA, 22 bp, Homo sapiens
tgggggttctttcttcctctgc

SEQ ID NO: 3908684 - DNA, 17 bp, Homo sapiens
tgggggttggatgggaa

SEQ ID NO: 3908685 - DNA, 15 bp, Homo sapiens
tggggtaagccagag

SEQ ID NO: 3908686 - DNA, 16 bp, Homo sapiens
tggggtaagccagagc

SEQ ID NO: 3908687 - DNA, 22 bp, Homo sapiens
tggggtaagccagagcctgggg

SEQ ID NO: 3908688 - DNA, 15 bp, Homo sapiens
tggggtcagccaggg

SEQ ID NO: 3908689 - DNA, 21 bp, Homo sapiens
tggggtcagccagggccaggg

SEQ ID NO: 3908690 - DNA, 22 bp, Homo sapiens
tggggtctccctctcctgccta

SEQ ID NO: 3908691 - DNA, 22 bp, Homo sapiens
tggggtgacccggcaccccctg

SEQ ID NO: 3908692 - DNA, 12 bp, Homo sapiens
tggggtggggca

SEQ ID NO: 3908693 - DNA, 15 bp, Homo sapiens
tggggttcagcccct

SEQ ID NO: 3908694 - DNA, 22 bp, Homo sapiens
tggggttcagcccctcctctgc

SEQ ID NO: 3908695 - DNA, 15 bp, Homo sapiens
tgggtaactgtcaag

SEQ ID NO: 3908696 - DNA, 20 bp, Homo sapiens
tgggtactactgctgcaaag

SEQ ID NO: 3908697 - DNA, 13 bp, Homo sapiens
tgggtattaaact

SEQ ID NO: 3908698 - DNA, 16 bp, Homo sapiens
tgggtatttcctgcta

SEQ ID NO: 3908699 - DNA, 19 bp, Homo sapiens
tgggtccaggaaggcagct

SEQ ID NO: 3908700 - DNA, 21 bp, Homo sapiens
tgggtccaggaaggcagctgc

SEQ ID NO: 3908701 - DNA, 23 bp, Homo sapiens
tgggtccaggaaggcagctgctc

SEQ ID NO: 3908702 - DNA, 17 bp, Homo sapiens
tgggtctggctgagctg

SEQ ID NO: 3908703 - DNA, 14 bp, Homo sapiens
tgggtctggggagg

SEQ ID NO: 3908704 - DNA, 18 bp, Homo sapiens
tgggtctggggagggaga

SEQ ID NO: 3908705 - DNA, 18 bp, Homo sapiens
tgggtgagaatcctgcct

SEQ ID NO: 3908706 - DNA, 22 bp, Homo sapiens
tgggtgaggatccctgaaggcc

SEQ ID NO: 3908707 - DNA, 19 bp, Homo sapiens
tgggtgatcagaaggctgg

SEQ ID NO: 3908708 - DNA, 16 bp, Homo sapiens
tgggtggcacctcctg

SEQ ID NO: 3908709 - DNA, 23 bp, Homo sapiens
tgggtggctactctgtgccagag

SEQ ID NO: 3908710 - DNA, 20 bp, Homo sapiens
tgggtggggaggaaatagaa

SEQ ID NO: 3908711 - DNA, 19 bp, Homo sapiens
tgggttatttttgtccctg

SEQ ID NO: 3908712 - DNA, 15 bp, Homo sapiens
tgggttcactagagc

SEQ ID NO: 3908713 - DNA, 19 bp, Homo sapiens
tgggttcactagagctggg

SEQ ID NO: 3908714 - DNA, 21 bp, Homo sapiens
tgggttcattccccggccctc

SEQ ID NO: 3908715 - DNA, 23 bp, Homo sapiens
tgggttcctttttcaacttggaa

SEQ ID NO: 3908716 - DNA, 17 bp, Homo sapiens
tgggttctttggaagga

SEQ ID NO: 3908717 - DNA, 19 bp, Homo sapiens
tgggttttctaactgtaaa

SEQ ID NO: 3908718 - DNA, 20 bp, Homo sapiens
tgggttttctaactgtaaat

SEQ ID NO: 3908719 - DNA, 13 bp, Homo sapiens
tggtaaactattt

SEQ ID NO: 3908720 - DNA, 21 bp, Homo sapiens
tggtaaactatttgtctttca

SEQ ID NO: 3908721 - DNA, 13 bp, Homo sapiens
tggtaattgttgc

SEQ ID NO: 3908722 - DNA, 19 bp, Homo sapiens
tggtaatttgtatctgaag

SEQ ID NO: 3908723 - DNA, 21 bp, Homo sapiens
tggtaatttgtatctgaagga

SEQ ID NO: 3908724 - DNA, 22 bp, Homo sapiens
tggtaatttgtatctgaaggag

SEQ ID NO: 3908725 - DNA, 18 bp, Homo sapiens
tggtacggagatgtttca

SEQ ID NO: 3908726 - DNA, 18 bp, Homo sapiens
tggtagaattgggaagct

SEQ ID NO: 3908727 - DNA, 15 bp, Homo sapiens
tggtaggatttatat

SEQ ID NO: 3908728 - DNA, 17 bp, Homo sapiens
tggtagggacttaaaaa

SEQ ID NO: 3908729 - DNA, 21 bp, Homo sapiens
tggtatgaacttgaggacaca

SEQ ID NO: 3908730 - DNA, 22 bp, Homo sapiens
tggtatgaacttgaggacacat

SEQ ID NO: 3908731 - DNA, 15 bp, Homo sapiens
tggtatgagctgagg

SEQ ID NO: 3908732 - DNA, 16 bp, Homo sapiens
tggtatgagctgaggg

SEQ ID NO: 3908733 - DNA, 15 bp, Homo sapiens
tggtatgctggccag

SEQ ID NO: 3908734 - DNA, 16 bp, Homo sapiens
tggtatgctggccagc

SEQ ID NO: 3908735 - DNA, 19 bp, Homo sapiens
tggtatgtagcccggccag

SEQ ID NO: 3908736 - DNA, 17 bp, Homo sapiens
tggtcaaaagctggatt

SEQ ID NO: 3908737 - DNA, 14 bp, Homo sapiens
tggtcaaaccgcac

SEQ ID NO: 3908738 - DNA, 17 bp, Homo sapiens
tggtcaaaccgcactca

SEQ ID NO: 3908739 - DNA, 20 bp, Homo sapiens
tggtcaaaccgcactcaccc

SEQ ID NO: 3908740 - DNA, 20 bp, Homo sapiens
tggtcacagccatgaagtca

SEQ ID NO: 3908741 - DNA, 23 bp, Homo sapiens
tggtcacaggactctgcctcctc

SEQ ID NO: 3908742 - DNA, 13 bp, Homo sapiens
tggtcatggacag

SEQ ID NO: 3908743 - DNA, 22 bp, Homo sapiens
tggtccagcttgctcttcagtg

SEQ ID NO: 3908744 - DNA, 13 bp, Homo sapiens
tggtcccacatcc

SEQ ID NO: 3908745 - DNA, 14 bp, Homo sapiens
tggtccctcgtcca

SEQ ID NO: 3908746 - DNA, 15 bp, Homo sapiens
tggtcccttcttccc

SEQ ID NO: 3908747 - DNA, 15 bp, Homo sapiens
tggtccggtgtcctt

SEQ ID NO: 3908748 - DNA, 20 bp, Homo sapiens
tggtcctgagggtccccacc

SEQ ID NO: 3908749 - DNA, 20 bp, Homo sapiens
tggtccttctcgtttgctct

SEQ ID NO: 3908750 - DNA, 15 bp, Homo sapiens
tggtctaggagctgt

SEQ ID NO: 3908751 - DNA, 12 bp, Homo sapiens
tggtctcagaaa

SEQ ID NO: 3908752 - DNA, 18 bp, Homo sapiens
tggtctcgaactcctgac

SEQ ID NO: 3908753 - DNA, 21 bp, Homo sapiens
tggtctctcgggccccccaca

SEQ ID NO: 3908754 - DNA, 16 bp, Homo sapiens
tggtctgatttcagga

SEQ ID NO: 3908755 - DNA, 22 bp, Homo sapiens
tggtctgctggtgtcattgctg

SEQ ID NO: 3908756 - DNA, 13 bp, Homo sapiens
tggtcttcactgc

SEQ ID NO: 3908757 - DNA, 15 bp, Homo sapiens
tggtcttcactgcca

SEQ ID NO: 3908758 - DNA, 24 bp, Homo sapiens
tggtgaaaccctgtctctactaaa

SEQ ID NO: 3908759 - DNA, 18 bp, Homo sapiens
tggtgaaatttattagtt

SEQ ID NO: 3908760 - DNA, 13 bp, Homo sapiens
tggtgaagagtag

SEQ ID NO: 3908761 - DNA, 13 bp, Homo sapiens
tggtgacacacag

SEQ ID NO: 3908762 - DNA, 14 bp, Homo sapiens
tggtgacacacagc

SEQ ID NO: 3908763 - DNA, 17 bp, Homo sapiens
tggtgacatgtgcctgt

SEQ ID NO: 3908764 - DNA, 14 bp, Homo sapiens
tggtgactgaacga

SEQ ID NO: 3908765 - DNA, 18 bp, Homo sapiens
tggtgactgcgatcttca

SEQ ID NO: 3908766 - DNA, 13 bp, Homo sapiens
tggtgactgtccc

SEQ ID NO: 3908767 - DNA, 13 bp, Homo sapiens
tggtgagctggga

SEQ ID NO: 3908768 - DNA, 15 bp, Homo sapiens
tggtgaggcccagcc

SEQ ID NO: 3908769 - DNA, 19 bp, Homo sapiens
tggtgaggcccagcctgtc

SEQ ID NO: 3908770 - DNA, 12 bp, Homo sapiens
tggtgatggagt

SEQ ID NO: 3908771 - DNA, 14 bp, Homo sapiens
tggtgcaaatccta

SEQ ID NO: 3908772 - DNA, 20 bp, Homo sapiens
tggtgcagaaaaaaaaaaag

SEQ ID NO: 3908773 - DNA, 18 bp, Homo sapiens
tggtgcagaggtgagcag

SEQ ID NO: 3908774 - DNA, 23 bp, Homo sapiens
tggtgcagaggtgagcagaggag

SEQ ID NO: 3908775 - DNA, 22 bp, Homo sapiens
tggtgcctatttattcattcag

SEQ ID NO: 3908776 - DNA, 18 bp, Homo sapiens
tggtgcctgcctctgcca

SEQ ID NO: 3908777 - DNA, 15 bp, Homo sapiens
tggtgctgacctctg

SEQ ID NO: 3908778 - DNA, 13 bp, Homo sapiens
tggtgctgccaca

SEQ ID NO: 3908779 - DNA, 18 bp, Homo sapiens
tggtgctgccacacttca

SEQ ID NO: 3908780 - DNA, 21 bp, Homo sapiens
tggtggcccgacagcctggca

SEQ ID NO: 3908781 - DNA, 16 bp, Homo sapiens
tggtggcgcaagcctg

SEQ ID NO: 3908782 - DNA, 14 bp, Homo sapiens
tggtggctcatggc

SEQ ID NO: 3908783 - DNA, 18 bp, Homo sapiens
tggtgggaaccctcccca

SEQ ID NO: 3908784 - DNA, 21 bp, Homo sapiens
tggtgggaagcgtctgtccgt

SEQ ID NO: 3908785 - DNA, 12 bp, Homo sapiens
tggtgtaatgca

SEQ ID NO: 3908786 - DNA, 23 bp, Homo sapiens
tggtgtaatgcacaatttagaaa

SEQ ID NO: 3908787 - DNA, 13 bp, Homo sapiens
tggtgtccacctg

SEQ ID NO: 3908788 - DNA, 14 bp, Homo sapiens
tggtgtccacctgg

SEQ ID NO: 3908789 - DNA, 15 bp, Homo sapiens
tggtgtccacctggc

SEQ ID NO: 3908790 - DNA, 18 bp, Homo sapiens
tggtgtccagacagagcc

SEQ ID NO: 3908791 - DNA, 20 bp, Homo sapiens
tggttaaaataaagcctatt

SEQ ID NO: 3908792 - DNA, 14 bp, Homo sapiens
tggttagaaatgca

SEQ ID NO: 3908793 - DNA, 16 bp, Homo sapiens
tggttcagctaagcta

SEQ ID NO: 3908794 - DNA, 20 bp, Homo sapiens
tggttccaagaaagatccac

SEQ ID NO: 3908795 - DNA, 22 bp, Homo sapiens
tggttccatgcctgagggtgga

SEQ ID NO: 3908796 - DNA, 19 bp, Homo sapiens
tggttcccaataaaagtga

SEQ ID NO: 3908797 - DNA, 11 bp, Homo sapiens
tggttcccctg

SEQ ID NO: 3908798 - DNA, 19 bp, Homo sapiens
tggttcccctgttcactct

SEQ ID NO: 3908799 - DNA, 16 bp, Homo sapiens
tggttcctaagcctgt

SEQ ID NO: 3908800 - DNA, 22 bp, Homo sapiens
tggttgaggtggaagccctcct

SEQ ID NO: 3908801 - DNA, 18 bp, Homo sapiens
tggttgcttaactggctg

SEQ ID NO: 3908802 - DNA, 16 bp, Homo sapiens
tggttggagagctaga

SEQ ID NO: 3908803 - DNA, 17 bp, Homo sapiens
tggttggggtggggcag

SEQ ID NO: 3908804 - DNA, 22 bp, Homo sapiens
tggttggtaacacaaattttca

SEQ ID NO: 3908805 - DNA, 15 bp, Homo sapiens
tggttgtcaatatta

SEQ ID NO: 3908806 - DNA, 15 bp, Homo sapiens
tggttgttgccaact

SEQ ID NO: 3908807 - DNA, 11 bp, Homo sapiens
tggtttacatg

SEQ ID NO: 3908808 - DNA, 21 bp, Homo sapiens
tggtttatagagggccaagac

SEQ ID NO: 3908809 - DNA, 20 bp, Homo sapiens
tggtttccacgatgaaaaac

SEQ ID NO: 3908810 - DNA, 21 bp, Homo sapiens
tggtttgtcatatattcatgt

SEQ ID NO: 3908811 - DNA, 18 bp, Homo sapiens
tggttttaacaatttcct

SEQ ID NO: 3908812 - DNA, 13 bp, Homo sapiens
tgtaaaaacaaaa

SEQ ID NO: 3908813 - DNA, 17 bp, Homo sapiens
tgtaaaaacaaaaagac

SEQ ID NO: 3908814 - DNA, 19 bp, Homo sapiens
tgtaaaaccatgtagtttt

SEQ ID NO: 3908815 - DNA, 21 bp, Homo sapiens
tgtaaaaccatgtagttttaa

SEQ ID NO: 3908816 - DNA, 22 bp, Homo sapiens
tgtaaaagtactctgaaaagca

SEQ ID NO: 3908817 - DNA, 14 bp, Homo sapiens
tgtaaaataaaatt

SEQ ID NO: 3908818 - DNA, 17 bp, Homo sapiens
tgtaaaatatctacctg

SEQ ID NO: 3908819 - DNA, 21 bp, Homo sapiens
tgtaaaatgcagtccagaata

SEQ ID NO: 3908820 - DNA, 19 bp, Homo sapiens
tgtaaacagtgcctgctga

SEQ ID NO: 3908821 - DNA, 13 bp, Homo sapiens
tgtaaactataaa

SEQ ID NO: 3908822 - DNA, 21 bp, Homo sapiens
tgtaaactcaaaacttaacat

SEQ ID NO: 3908823 - DNA, 18 bp, Homo sapiens
tgtaaactgcattagaaa

SEQ ID NO: 3908824 - DNA, 14 bp, Homo sapiens
tgtaaataaataga

SEQ ID NO: 3908825 - DNA, 21 bp, Homo sapiens
tgtaaatacagtggatctcaa

SEQ ID NO: 3908826 - DNA, 15 bp, Homo sapiens
tgtaaatacatgtgt

SEQ ID NO: 3908827 - DNA, 11 bp, Homo sapiens
tgtaaatatag

SEQ ID NO: 3908828 - DNA, 20 bp, Homo sapiens
tgtaaatatgtttgtgcctt

SEQ ID NO: 3908829 - DNA, 11 bp, Homo sapiens
tgtaaatcact

SEQ ID NO: 3908830 - DNA, 13 bp, Homo sapiens
tgtaaatcacttg

SEQ ID NO: 3908831 - DNA, 22 bp, Homo sapiens
tgtaaatcacttgtaaataaat

SEQ ID NO: 3908832 - DNA, 19 bp, Homo sapiens
tgtaaatcctttttcttta

SEQ ID NO: 3908833 - DNA, 22 bp, Homo sapiens
tgtaaatgaccaagaaaaagaa

SEQ ID NO: 3908834 - DNA, 12 bp, Homo sapiens
tgtaaattttag

SEQ ID NO: 3908835 - DNA, 16 bp, Homo sapiens
tgtaacacaagccaca

SEQ ID NO: 3908836 - DNA, 21 bp, Homo sapiens
tgtaacacaagccacagaagc

SEQ ID NO: 3908837 - DNA, 21 bp, Homo sapiens
tgtaacacagctgagagactt

SEQ ID NO: 3908838 - DNA, 14 bp, Homo sapiens
tgtaactacactaa

SEQ ID NO: 3908839 - DNA, 13 bp, Homo sapiens
tgtaactcagaca

SEQ ID NO: 3908840 - DNA, 16 bp, Homo sapiens
tgtaactgctgagcca

SEQ ID NO: 3908841 - DNA, 19 bp, Homo sapiens
tgtaactgctgagccactc

SEQ ID NO: 3908842 - DNA, 14 bp, Homo sapiens
tgtaacttcaaata

SEQ ID NO: 3908843 - DNA, 15 bp, Homo sapiens
tgtaacttttgtaag

SEQ ID NO: 3908844 - DNA, 21 bp, Homo sapiens
tgtaagacaaaggttttcctc

SEQ ID NO: 3908845 - DNA, 18 bp, Homo sapiens
tgtaagggaaactgccag

SEQ ID NO: 3908846 - DNA, 19 bp, Homo sapiens
tgtaagggaaactgccagc

SEQ ID NO: 3908847 - DNA, 17 bp, Homo sapiens
tgtaagggtctgttgta

SEQ ID NO: 3908848 - DNA, 23 bp, Homo sapiens
tgtaagggtctgttgtaaatgac

SEQ ID NO: 3908849 - DNA, 22 bp, Homo sapiens
tgtaaggtcttcttgtgtcctg

SEQ ID NO: 3908850 - DNA, 23 bp, Homo sapiens
tgtaaggtcttcttgtgtcctga

SEQ ID NO: 3908851 - DNA, 14 bp, Homo sapiens
tgtaagtcaggagt

SEQ ID NO: 3908852 - DNA, 22 bp, Homo sapiens
tgtaagtttattttttctacac

SEQ ID NO: 3908853 - DNA, 16 bp, Homo sapiens
tgtaatagaaaactga

SEQ ID NO: 3908854 - DNA, 13 bp, Homo sapiens
tgtaatagtccat

SEQ ID NO: 3908855 - DNA, 20 bp, Homo sapiens
tgtaatcctcagctgacaca

SEQ ID NO: 3908856 - DNA, 12 bp, Homo sapiens
tgtaatcctgta

SEQ ID NO: 3908857 - DNA, 18 bp, Homo sapiens
tgtaatcttaaaagtgta

SEQ ID NO: 3908858 - DNA, 14 bp, Homo sapiens
tgtaatgcacaatt

SEQ ID NO: 3908859 - DNA, 15 bp, Homo sapiens
tgtaatgcacaattt

SEQ ID NO: 3908860 - DNA, 20 bp, Homo sapiens
tgtaatgcacaatttagaaa

SEQ ID NO: 3908861 - DNA, 16 bp, Homo sapiens
tgtaatgtcaccacct

SEQ ID NO: 3908862 - DNA, 20 bp, Homo sapiens
tgtaattaagtaaaccaaaa

SEQ ID NO: 3908863 - DNA, 18 bp, Homo sapiens
tgtaattgcttacatttt

SEQ ID NO: 3908864 - DNA, 15 bp, Homo sapiens
tgtacaaaaacaaaa

SEQ ID NO: 3908865 - DNA, 17 bp, Homo sapiens
tgtacaaaataaacaaa

SEQ ID NO: 3908866 - DNA, 12 bp, Homo sapiens
tgtacaaatact

SEQ ID NO: 3908867 - DNA, 17 bp, Homo sapiens
tgtacagagtggcccct

SEQ ID NO: 3908868 - DNA, 23 bp, Homo sapiens
tgtacagttaactctcccaggtg

SEQ ID NO: 3908869 - DNA, 20 bp, Homo sapiens
tgtacagttcagttcctctt

SEQ ID NO: 3908870 - DNA, 22 bp, Homo sapiens
tgtacatagatgtatcattaat

SEQ ID NO: 3908871 - DNA, 19 bp, Homo sapiens
tgtacatatgtaaaataaa

SEQ ID NO: 3908872 - DNA, 17 bp, Homo sapiens
tgtacattccctgcatc

SEQ ID NO: 3908873 - DNA, 13 bp, Homo sapiens
tgtacccagctcc

SEQ ID NO: 3908874 - DNA, 13 bp, Homo sapiens
tgtaccccatccc

SEQ ID NO: 3908875 - DNA, 14 bp, Homo sapiens
tgtaccccatccct

SEQ ID NO: 3908876 - DNA, 18 bp, Homo sapiens
tgtaccgcgtctaccctg

SEQ ID NO: 3908877 - DNA, 21 bp, Homo sapiens
tgtaccgcgtctaccctggga

SEQ ID NO: 3908878 - DNA, 14 bp, Homo sapiens
tgtacgtaatgtat

SEQ ID NO: 3908879 - DNA, 12 bp, Homo sapiens
tgtactatgtta

SEQ ID NO: 3908880 - DNA, 22 bp, Homo sapiens
tgtactattgtttaaaaacagg

SEQ ID NO: 3908881 - DNA, 14 bp, Homo sapiens
tgtactcagagcag

SEQ ID NO: 3908882 - DNA, 20 bp, Homo sapiens
tgtactctttatttctagca

SEQ ID NO: 3908883 - DNA, 20 bp, Homo sapiens
tgtactgaaaaatggtaatt

SEQ ID NO: 3908884 - DNA, 15 bp, Homo sapiens
tgtactgcctgcttg

SEQ ID NO: 3908885 - DNA, 22 bp, Homo sapiens
tgtactgtaattttgtttgtaa

SEQ ID NO: 3908886 - DNA, 20 bp, Homo sapiens
tgtacttaataaattcagat

SEQ ID NO: 3908887 - DNA, 22 bp, Homo sapiens
tgtacttaataaattcagatat

SEQ ID NO: 3908888 - DNA, 17 bp, Homo sapiens
tgtacttcctgtgtact

SEQ ID NO: 3908889 - DNA, 21 bp, Homo sapiens
tgtagaaacacagttttgaaa

SEQ ID NO: 3908890 - DNA, 13 bp, Homo sapiens
tgtagaaatctgt

SEQ ID NO: 3908891 - DNA, 12 bp, Homo sapiens
tgtagaaatgta

SEQ ID NO: 3908892 - DNA, 21 bp, Homo sapiens
tgtagactatatacatgtgtg

SEQ ID NO: 3908893 - DNA, 23 bp, Homo sapiens
tgtagactatatacatgtgtgta

SEQ ID NO: 3908894 - DNA, 18 bp, Homo sapiens
tgtagacttactttccta

SEQ ID NO: 3908895 - DNA, 16 bp, Homo sapiens
tgtagcatcttctgga

SEQ ID NO: 3908896 - DNA, 14 bp, Homo sapiens
tgtagccagccggg

SEQ ID NO: 3908897 - DNA, 18 bp, Homo sapiens
tgtagccatggctcaggc

SEQ ID NO: 3908898 - DNA, 14 bp, Homo sapiens
tgtagcccggccag

SEQ ID NO: 3908899 - DNA, 23 bp, Homo sapiens
tgtagctcccgagctactctctt

SEQ ID NO: 3908900 - DNA, 14 bp, Homo sapiens
tgtagctgtgacct

SEQ ID NO: 3908901 - DNA, 16 bp, Homo sapiens
tgtagctgtgacctgc

SEQ ID NO: 3908902 - DNA, 18 bp, Homo sapiens
tgtagctgtgacctgctg

SEQ ID NO: 3908903 - DNA, 12 bp, Homo sapiens
tgtagctttgct

SEQ ID NO: 3908904 - DNA, 19 bp, Homo sapiens
tgtaggagggactgtcgct

SEQ ID NO: 3908905 - DNA, 14 bp, Homo sapiens
tgtaggcagggaac

SEQ ID NO: 3908906 - DNA, 18 bp, Homo sapiens
tgtagggtaaggtgcctt

SEQ ID NO: 3908907 - DNA, 16 bp, Homo sapiens
tgtaggtattaaagat

SEQ ID NO: 3908908 - DNA, 11 bp, Homo sapiens
tgtaggttgct

SEQ ID NO: 3908909 - DNA, 17 bp, Homo sapiens
tgtagtgagaaactgat

SEQ ID NO: 3908910 - DNA, 23 bp, Homo sapiens
tgtagtgatgttgtttgggagag

SEQ ID NO: 3908911 - DNA, 15 bp, Homo sapiens
tgtagtggaagagca

SEQ ID NO: 3908912 - DNA, 18 bp, Homo sapiens
tgtagtggaagagcagcc

SEQ ID NO: 3908913 - DNA, 21 bp, Homo sapiens
tgtagtggaagagcagcctga

SEQ ID NO: 3908914 - DNA, 15 bp, Homo sapiens
tgtagtgtgtcagag

SEQ ID NO: 3908915 - DNA, 18 bp, Homo sapiens
tgtagttaaagggcagaa

SEQ ID NO: 3908916 - DNA, 12 bp, Homo sapiens
tgtagttaggaa

SEQ ID NO: 3908917 - DNA, 15 bp, Homo sapiens
tgtagttaggaaata

SEQ ID NO: 3908918 - DNA, 13 bp, Homo sapiens
tgtataaataata

SEQ ID NO: 3908919 - DNA, 20 bp, Homo sapiens
tgtataaataataaagaact

SEQ ID NO: 3908920 - DNA, 21 bp, Homo sapiens
tgtataaataataaagaactc

SEQ ID NO: 3908921 - DNA, 21 bp, Homo sapiens
tgtataaatctttcttttgat

SEQ ID NO: 3908922 - DNA, 20 bp, Homo sapiens
tgtataaatgtatatacaca

SEQ ID NO: 3908923 - DNA, 21 bp, Homo sapiens
tgtataaatgtatatacacat

SEQ ID NO: 3908924 - DNA, 18 bp, Homo sapiens
tgtataagtgcacacaga

SEQ ID NO: 3908925 - DNA, 22 bp, Homo sapiens
tgtataagtgcacacagaaata

SEQ ID NO: 3908926 - DNA, 23 bp, Homo sapiens
tgtataagtgcacacagaaatat

SEQ ID NO: 3908927 - DNA, 17 bp, Homo sapiens
tgtataatttaacagtg

SEQ ID NO: 3908928 - DNA, 14 bp, Homo sapiens
tgtatacacacata

SEQ ID NO: 3908929 - DNA, 23 bp, Homo sapiens
tgtatacacacatatacatatat

SEQ ID NO: 3908930 - DNA, 19 bp, Homo sapiens
tgtatagatgcaagatatt

SEQ ID NO: 3908931 - DNA, 23 bp, Homo sapiens
tgtatagcaccaaaaaatggagg

SEQ ID NO: 3908932 - DNA, 19 bp, Homo sapiens
tgtatataatactaaagtg

SEQ ID NO: 3908933 - DNA, 17 bp, Homo sapiens
tgtatatacaataacat

SEQ ID NO: 3908934 - DNA, 18 bp, Homo sapiens
tgtatatacaataacata

SEQ ID NO: 3908935 - DNA, 17 bp, Homo sapiens
tgtatatacacatatac

SEQ ID NO: 3908936 - DNA, 18 bp, Homo sapiens
tgtatatacacatatacc

SEQ ID NO: 3908937 - DNA, 19 bp, Homo sapiens
tgtatatacacatatacct

SEQ ID NO: 3908938 - DNA, 13 bp, Homo sapiens
tgtatatacatat

SEQ ID NO: 3908939 - DNA, 21 bp, Homo sapiens
tgtatatacatattataaata

SEQ ID NO: 3908940 - DNA, 21 bp, Homo sapiens
tgtatatactatacaacaatg

SEQ ID NO: 3908941 - DNA, 19 bp, Homo sapiens
tgtatatatacatacactt

SEQ ID NO: 3908942 - DNA, 14 bp, Homo sapiens
tgtatatatatata

SEQ ID NO: 3908943 - DNA, 17 bp, Homo sapiens
tgtatatatatatgtgt

SEQ ID NO: 3908944 - DNA, 19 bp, Homo sapiens
tgtatatatatatgtgtgt

SEQ ID NO: 3908945 - DNA, 12 bp, Homo sapiens
tgtatatatgtg

SEQ ID NO: 3908946 - DNA, 22 bp, Homo sapiens
tgtatatatgtgtatatataca

SEQ ID NO: 3908947 - DNA, 14 bp, Homo sapiens
tgtatatatgtgtg

SEQ ID NO: 3908948 - DNA, 18 bp, Homo sapiens
tgtatatcagaaaaggga

SEQ ID NO: 3908949 - DNA, 14 bp, Homo sapiens
tgtatatgtatata

SEQ ID NO: 3908950 - DNA, 23 bp, Homo sapiens
tgtatattatggtgtaatgcaca

SEQ ID NO: 3908951 - DNA, 15 bp, Homo sapiens
tgtatattccaccat

SEQ ID NO: 3908952 - DNA, 14 bp, Homo sapiens
tgtatattctggaa

SEQ ID NO: 3908953 - DNA, 19 bp, Homo sapiens
tgtatattgtcagatattt

SEQ ID NO: 3908954 - DNA, 14 bp, Homo sapiens
tgtatcaaatctgt

SEQ ID NO: 3908955 - DNA, 17 bp, Homo sapiens
tgtatcaaatctgtata

SEQ ID NO: 3908956 - DNA, 17 bp, Homo sapiens
tgtatcatttgaacaac

SEQ ID NO: 3908957 - DNA, 14 bp, Homo sapiens
tgtatccagtgatg

SEQ ID NO: 3908958 - DNA, 18 bp, Homo sapiens
tgtatccagtgatgtgct

SEQ ID NO: 3908959 - DNA, 21 bp, Homo sapiens
tgtatcccccccctgtatagt

SEQ ID NO: 3908960 - DNA, 13 bp, Homo sapiens
tgtatctcctcct

SEQ ID NO: 3908961 - DNA, 22 bp, Homo sapiens
tgtatctgaaggagattttcct

SEQ ID NO: 3908962 - DNA, 19 bp, Homo sapiens
tgtatgtaagtaattgcat

SEQ ID NO: 3908963 - DNA, 17 bp, Homo sapiens
tgtatgtctaattgagt

SEQ ID NO: 3908964 - DNA, 19 bp, Homo sapiens
tgtatgtgaaagtgtaaaa

SEQ ID NO: 3908965 - DNA, 13 bp, Homo sapiens
tgtatgtgtgtgg

SEQ ID NO: 3908966 - DNA, 11 bp, Homo sapiens
tgtatgtttac

SEQ ID NO: 3908967 - DNA, 18 bp, Homo sapiens
tgtattaagccaaacatg

SEQ ID NO: 3908968 - DNA, 22 bp, Homo sapiens
tgtattgaacttggaaagaaat

SEQ ID NO: 3908969 - DNA, 17 bp, Homo sapiens
tgtatttattgtcatta

SEQ ID NO: 3908970 - DNA, 16 bp, Homo sapiens
tgtattttttaaagct

SEQ ID NO: 3908971 - DNA, 16 bp, Homo sapiens
tgtcaaatatctcaga

SEQ ID NO: 3908972 - DNA, 15 bp, Homo sapiens
tgtcaaatcatggcc

SEQ ID NO: 3908973 - DNA, 23 bp, Homo sapiens
tgtcaaatgtcattatgtagaaa

SEQ ID NO: 3908974 - DNA, 14 bp, Homo sapiens
tgtcaatattaaat

SEQ ID NO: 3908975 - DNA, 18 bp, Homo sapiens
tgtcaatattaaatacag

SEQ ID NO: 3908976 - DNA, 21 bp, Homo sapiens
tgtcaatattaaatacagaca

SEQ ID NO: 3908977 - DNA, 23 bp, Homo sapiens
tgtcaatattaaatacagacact

SEQ ID NO: 3908978 - DNA, 19 bp, Homo sapiens
tgtcaatttccctgactcc

SEQ ID NO: 3908979 - DNA, 15 bp, Homo sapiens
tgtcacacagggcag

SEQ ID NO: 3908980 - DNA, 13 bp, Homo sapiens
tgtcacagctctg

SEQ ID NO: 3908981 - DNA, 12 bp, Homo sapiens
tgtcacagttct

SEQ ID NO: 3908982 - DNA, 23 bp, Homo sapiens
tgtcaccaatgtacccaccgggc

SEQ ID NO: 3908983 - DNA, 18 bp, Homo sapiens
tgtcaccaccttcccagc

SEQ ID NO: 3908984 - DNA, 19 bp, Homo sapiens
tgtcaccaccttcccagct

SEQ ID NO: 3908985 - DNA, 19 bp, Homo sapiens
tgtcaccagcaacatctcg

SEQ ID NO: 3908986 - DNA, 15 bp, Homo sapiens
tgtcaccagctatct

SEQ ID NO: 3908987 - DNA, 19 bp, Homo sapiens
tgtcaccagctatctgtca

SEQ ID NO: 3908988 - DNA, 22 bp, Homo sapiens
tgtcaccagctgccaaaatcgt

SEQ ID NO: 3908989 - DNA, 18 bp, Homo sapiens
tgtcaccctccacctctt

SEQ ID NO: 3908990 - DNA, 17 bp, Homo sapiens
tgtcaccctgcagagct

SEQ ID NO: 3908991 - DNA, 21 bp, Homo sapiens
tgtcaccgtggaccttcctgc

SEQ ID NO: 3908992 - DNA, 13 bp, Homo sapiens
tgtcacctcagct

SEQ ID NO: 3908993 - DNA, 15 bp, Homo sapiens
tgtcacctcagctga

SEQ ID NO: 3908994 - DNA, 17 bp, Homo sapiens
tgtcacgtgaaatattt

SEQ ID NO: 3908995 - DNA, 23 bp, Homo sapiens
tgtcactggtagaccaaaataaa

SEQ ID NO: 3908996 - DNA, 21 bp, Homo sapiens
tgtcactgtcttcacaacctc

SEQ ID NO: 3908997 - DNA, 22 bp, Homo sapiens
tgtcactttttaaaccactgta

SEQ ID NO: 3908998 - DNA, 18 bp, Homo sapiens
tgtcagagatctgggagg

SEQ ID NO: 3908999 - DNA, 21 bp, Homo sapiens
tgtcagagctatgttccctcc

SEQ ID NO: 3909000 - DNA, 16 bp, Homo sapiens
tgtcagagctgggagt

SEQ ID NO: 3909001 - DNA, 18 bp, Homo sapiens
tgtcagagctgttggcct

SEQ ID NO: 3909002 - DNA, 20 bp, Homo sapiens
tgtcagagctgttggcctcg

SEQ ID NO: 3909003 - DNA, 23 bp, Homo sapiens
tgtcagatattttttcagaaata

SEQ ID NO: 3909004 - DNA, 13 bp, Homo sapiens
tgtcagccagccg

SEQ ID NO: 3909005 - DNA, 16 bp, Homo sapiens
tgtcagccagccgccc

SEQ ID NO: 3909006 - DNA, 19 bp, Homo sapiens
tgtcagccagccgccctgg

SEQ ID NO: 3909007 - DNA, 22 bp, Homo sapiens
tgtcagccagccgccctgggct

SEQ ID NO: 3909008 - DNA, 23 bp, Homo sapiens
tgtcagccgagccgggcctgggg

SEQ ID NO: 3909009 - DNA, 12 bp, Homo sapiens
tgtcagccttgc

SEQ ID NO: 3909010 - DNA, 23 bp, Homo sapiens
tgtcagctcccctcggagaagag

SEQ ID NO: 3909011 - DNA, 15 bp, Homo sapiens
tgtcaggacccaggc

SEQ ID NO: 3909012 - DNA, 16 bp, Homo sapiens
tgtcataagaatgaat

SEQ ID NO: 3909013 - DNA, 14 bp, Homo sapiens
tgtcatcaaatatt

SEQ ID NO: 3909014 - DNA, 13 bp, Homo sapiens
tgtcatcactccc

SEQ ID NO: 3909015 - DNA, 14 bp, Homo sapiens
tgtcatcactccct

SEQ ID NO: 3909016 - DNA, 16 bp, Homo sapiens
tgtcatcagaagataa

SEQ ID NO: 3909017 - DNA, 17 bp, Homo sapiens
tgtcatcagaagataac

SEQ ID NO: 3909018 - DNA, 19 bp, Homo sapiens
tgtcatcattgtatatatg

SEQ ID NO: 3909019 - DNA, 17 bp, Homo sapiens
tgtcatccatgcgtgca

SEQ ID NO: 3909020 - DNA, 16 bp, Homo sapiens
tgtcatctagcccctt

SEQ ID NO: 3909021 - DNA, 14 bp, Homo sapiens
tgtcatctgaggag

SEQ ID NO: 3909022 - DNA, 15 bp, Homo sapiens
tgtcatctgaggagt

SEQ ID NO: 3909023 - DNA, 16 bp, Homo sapiens
tgtcatgaattcttat

SEQ ID NO: 3909024 - DNA, 21 bp, Homo sapiens
tgtcatgaattcttatgctta

SEQ ID NO: 3909025 - DNA, 19 bp, Homo sapiens
tgtcatggaaaatgtcctg

SEQ ID NO: 3909026 - DNA, 20 bp, Homo sapiens
tgtcattactgcctttggaa

SEQ ID NO: 3909027 - DNA, 19 bp, Homo sapiens
tgtcattcaagcctgtgaa

SEQ ID NO: 3909028 - DNA, 12 bp, Homo sapiens
tgtcattcagga

SEQ ID NO: 3909029 - DNA, 15 bp, Homo sapiens
tgtccaacctaaccc

SEQ ID NO: 3909030 - DNA, 21 bp, Homo sapiens
tgtccaacctaacccctttcc

SEQ ID NO: 3909031 - DNA, 22 bp, Homo sapiens
tgtccaacctaacccctttcct

SEQ ID NO: 3909032 - DNA, 20 bp, Homo sapiens
tgtccaatggctgtaaacta

SEQ ID NO: 3909033 - DNA, 18 bp, Homo sapiens
tgtccagaccattgtctt

SEQ ID NO: 3909034 - DNA, 14 bp, Homo sapiens
tgtccagactgtgg

SEQ ID NO: 3909035 - DNA, 14 bp, Homo sapiens
tgtccagcagctgc

SEQ ID NO: 3909036 - DNA, 22 bp, Homo sapiens
tgtccagcagctgcgggtctga

SEQ ID NO: 3909037 - DNA, 19 bp, Homo sapiens
tgtccaggcactgctgccc

SEQ ID NO: 3909038 - DNA, 20 bp, Homo sapiens
tgtccatatcagacctctga

SEQ ID NO: 3909039 - DNA, 21 bp, Homo sapiens
tgtccatatcagacctctgat

SEQ ID NO: 3909040 - DNA, 23 bp, Homo sapiens
tgtccatatcagacctctgatcc

SEQ ID NO: 3909041 - DNA, 16 bp, Homo sapiens
tgtccatattttcaca

SEQ ID NO: 3909042 - DNA, 16 bp, Homo sapiens
tgtcccaccgggagcc

SEQ ID NO: 3909043 - DNA, 12 bp, Homo sapiens
tgtcccacctct

SEQ ID NO: 3909044 - DNA, 22 bp, Homo sapiens
tgtcccagagcttattggccac

SEQ ID NO: 3909045 - DNA, 13 bp, Homo sapiens
tgtccccagggcc

SEQ ID NO: 3909046 - DNA, 23 bp, Homo sapiens
tgtcccccaaggttttggagtca

SEQ ID NO: 3909047 - DNA, 21 bp, Homo sapiens
tgtccccctgagatcagagtc

SEQ ID NO: 3909048 - DNA, 23 bp, Homo sapiens
tgtccccctgagatcagagtcct

SEQ ID NO: 3909049 - DNA, 16 bp, Homo sapiens
tgtccccggcctcagc

SEQ ID NO: 3909050 - DNA, 16 bp, Homo sapiens
tgtcccctcactctgt

SEQ ID NO: 3909051 - DNA, 17 bp, Homo sapiens
tgtcccctctcccctca

SEQ ID NO: 3909052 - DNA, 14 bp, Homo sapiens
tgtcccctctgtca

SEQ ID NO: 3909053 - DNA, 14 bp, Homo sapiens
tgtcccctgtccca

SEQ ID NO: 3909054 - DNA, 23 bp, Homo sapiens
tgtcccgccttcctcctccacag

SEQ ID NO: 3909055 - DNA, 14 bp, Homo sapiens
tgtccctacccact

SEQ ID NO: 3909056 - DNA, 22 bp, Homo sapiens
tgtccctaccgagtctcttctc

SEQ ID NO: 3909057 - DNA, 12 bp, Homo sapiens
tgtccctgctcc

SEQ ID NO: 3909058 - DNA, 16 bp, Homo sapiens
tgtccctgctcctccc

SEQ ID NO: 3909059 - DNA, 17 bp, Homo sapiens
tgtccctggtgcagagg

SEQ ID NO: 3909060 - DNA, 13 bp, Homo sapiens
tgtccctgtcacc

SEQ ID NO: 3909061 - DNA, 18 bp, Homo sapiens
tgtccctgtttcaaactg

SEQ ID NO: 3909062 - DNA, 21 bp, Homo sapiens
tgtcccttttgcataagatta

SEQ ID NO: 3909063 - DNA, 13 bp, Homo sapiens
tgtcctatgtgtg

SEQ ID NO: 3909064 - DNA, 14 bp, Homo sapiens
tgtcctatgtgtga

SEQ ID NO: 3909065 - DNA, 21 bp, Homo sapiens
tgtcctccaacaataaagagc

SEQ ID NO: 3909066 - DNA, 18 bp, Homo sapiens
tgtcctcccatcccctgg

SEQ ID NO: 3909067 - DNA, 22 bp, Homo sapiens
tgtcctctcccctctgccctgt

SEQ ID NO: 3909068 - DNA, 13 bp, Homo sapiens
tgtcctctcgagc

SEQ ID NO: 3909069 - DNA, 23 bp, Homo sapiens
tgtcctcttgctcaaaaatctgt

SEQ ID NO: 3909070 - DNA, 12 bp, Homo sapiens
tgtcctgccagc

SEQ ID NO: 3909071 - DNA, 23 bp, Homo sapiens
tgtcctggctgctctcatgcctg

SEQ ID NO: 3909072 - DNA, 15 bp, Homo sapiens
tgtccttcagagctc

SEQ ID NO: 3909073 - DNA, 14 bp, Homo sapiens
tgtccttccctgca

SEQ ID NO: 3909074 - DNA, 22 bp, Homo sapiens
tgtccttccctgcatttctgag

SEQ ID NO: 3909075 - DNA, 18 bp, Homo sapiens
tgtccttggaagtttcat

SEQ ID NO: 3909076 - DNA, 22 bp, Homo sapiens
tgtcctttgagaaagaaataat

SEQ ID NO: 3909077 - DNA, 15 bp, Homo sapiens
tgtcgccccaggccc

SEQ ID NO: 3909078 - DNA, 21 bp, Homo sapiens
tgtcgccccaggccctccctg

SEQ ID NO: 3909079 - DNA, 17 bp, Homo sapiens
tgtcgctctgctggcct

SEQ ID NO: 3909080 - DNA, 12 bp, Homo sapiens
tgtcgctgcttc

SEQ ID NO: 3909081 - DNA, 17 bp, Homo sapiens
tgtcggagtagaaattg

SEQ ID NO: 3909082 - DNA, 22 bp, Homo sapiens
tgtctagaggtgagaccaaagg

SEQ ID NO: 3909083 - DNA, 17 bp, Homo sapiens
tgtctattctgagcctt

SEQ ID NO: 3909084 - DNA, 20 bp, Homo sapiens
tgtctcaagagggcactggt

SEQ ID NO: 3909085 - DNA, 18 bp, Homo sapiens
tgtctccaggatggtgca

SEQ ID NO: 3909086 - DNA, 17 bp, Homo sapiens
tgtctccataatgccac

SEQ ID NO: 3909087 - DNA, 14 bp, Homo sapiens
tgtctcgtctcctg

SEQ ID NO: 3909088 - DNA, 20 bp, Homo sapiens
tgtctcgtctcctgacatgt

SEQ ID NO: 3909089 - DNA, 22 bp, Homo sapiens
tgtctctagccgggccatgctt

SEQ ID NO: 3909090 - DNA, 13 bp, Homo sapiens
tgtctctcagaat

SEQ ID NO: 3909091 - DNA, 11 bp, Homo sapiens
tgtctctccca

SEQ ID NO: 3909092 - DNA, 18 bp, Homo sapiens
tgtctctcccaccccggc

SEQ ID NO: 3909093 - DNA, 15 bp, Homo sapiens
tgtctctcttgcttt

SEQ ID NO: 3909094 - DNA, 20 bp, Homo sapiens
tgtctcttcctctgttctat

SEQ ID NO: 3909095 - DNA, 14 bp, Homo sapiens
tgtctgccacagag

SEQ ID NO: 3909096 - DNA, 13 bp, Homo sapiens
tgtctggaagctg

SEQ ID NO: 3909097 - DNA, 14 bp, Homo sapiens
tgtctggaagctga

SEQ ID NO: 3909098 - DNA, 19 bp, Homo sapiens
tgtctggctgaggatttca

SEQ ID NO: 3909099 - DNA, 21 bp, Homo sapiens
tgtctgtcaccagctatctgt

SEQ ID NO: 3909100 - DNA, 15 bp, Homo sapiens
tgtctgtctgtccca

SEQ ID NO: 3909101 - DNA, 15 bp, Homo sapiens
tgtctgtgtcagcct

SEQ ID NO: 3909102 - DNA, 14 bp, Homo sapiens
tgtcttcacaacct

SEQ ID NO: 3909103 - DNA, 15 bp, Homo sapiens
tgtcttcactcttca

SEQ ID NO: 3909104 - DNA, 15 bp, Homo sapiens
tgtcttccaacccca

SEQ ID NO: 3909105 - DNA, 19 bp, Homo sapiens
tgtcttccaaccccagctg

SEQ ID NO: 3909106 - DNA, 23 bp, Homo sapiens
tgtcttccaaccccagctggcct

SEQ ID NO: 3909107 - DNA, 11 bp, Homo sapiens
tgtcttctctc

SEQ ID NO: 3909108 - DNA, 12 bp, Homo sapiens
tgtcttctctca

SEQ ID NO: 3909109 - DNA, 21 bp, Homo sapiens
tgtcttctctcaaagggaagc

SEQ ID NO: 3909110 - DNA, 19 bp, Homo sapiens
tgtctttcagcattaggct

SEQ ID NO: 3909111 - DNA, 13 bp, Homo sapiens
tgtctttgtggga

SEQ ID NO: 3909112 - DNA, 16 bp, Homo sapiens
tgtcttttccactcct

SEQ ID NO: 3909113 - DNA, 13 bp, Homo sapiens
tgtgaaaatgggt

SEQ ID NO: 3909114 - DNA, 21 bp, Homo sapiens
tgtgaacccaggacaagcatg

SEQ ID NO: 3909115 - DNA, 13 bp, Homo sapiens
tgtgaagggtggg

SEQ ID NO: 3909116 - DNA, 14 bp, Homo sapiens
tgtgaatagtctgt

SEQ ID NO: 3909117 - DNA, 18 bp, Homo sapiens
tgtgaattaaaaaagctc

SEQ ID NO: 3909118 - DNA, 18 bp, Homo sapiens
tgtgaattctgtgaagaa

SEQ ID NO: 3909119 - DNA, 19 bp, Homo sapiens
tgtgaattctgtgaagaat

SEQ ID NO: 3909120 - DNA, 12 bp, Homo sapiens
tgtgacaaaatt

SEQ ID NO: 3909121 - DNA, 22 bp, Homo sapiens
tgtgacagaatcttgtatttgg

SEQ ID NO: 3909122 - DNA, 23 bp, Homo sapiens
tgtgacaggaaagccctccccct

SEQ ID NO: 3909123 - DNA, 15 bp, Homo sapiens
tgtgaccaggggtga

SEQ ID NO: 3909124 - DNA, 16 bp, Homo sapiens
tgtgacccagggtgca

SEQ ID NO: 3909125 - DNA, 18 bp, Homo sapiens
tgtgacttcagctctgtt

SEQ ID NO: 3909126 - DNA, 13 bp, Homo sapiens
tgtgagagctggt

SEQ ID NO: 3909127 - DNA, 19 bp, Homo sapiens
tgtgagcaagcatttatgt

SEQ ID NO: 3909128 - DNA, 14 bp, Homo sapiens
tgtgagcttctaca

SEQ ID NO: 3909129 - DNA, 12 bp, Homo sapiens
tgtgaggcaggg

SEQ ID NO: 3909130 - DNA, 21 bp, Homo sapiens
tgtgaggctgggccagcctca

SEQ ID NO: 3909131 - DNA, 14 bp, Homo sapiens
tgtgagtggcagcc

SEQ ID NO: 3909132 - DNA, 16 bp, Homo sapiens
tgtgagtggcagccat

SEQ ID NO: 3909133 - DNA, 20 bp, Homo sapiens
tgtgagtggcagccatgcct

SEQ ID NO: 3909134 - DNA, 17 bp, Homo sapiens
tgtgatcactgagacag

SEQ ID NO: 3909135 - DNA, 17 bp, Homo sapiens
tgtgatttagaactgta

SEQ ID NO: 3909136 - DNA, 15 bp, Homo sapiens
tgtgatttcctacag

SEQ ID NO: 3909137 - DNA, 17 bp, Homo sapiens
tgtgatttcctacagaa

SEQ ID NO: 3909138 - DNA, 15 bp, Homo sapiens
tgtgattttgtacag

SEQ ID NO: 3909139 - DNA, 15 bp, Homo sapiens
tgtgcaaattttgca

SEQ ID NO: 3909140 - DNA, 17 bp, Homo sapiens
tgtgcaaattttgcatt

SEQ ID NO: 3909141 - DNA, 19 bp, Homo sapiens
tgtgcaaattttgcattta

SEQ ID NO: 3909142 - DNA, 21 bp, Homo sapiens
tgtgcaccttacattcctaga

SEQ ID NO: 3909143 - DNA, 18 bp, Homo sapiens
tgtgcactagcctgtgat

SEQ ID NO: 3909144 - DNA, 13 bp, Homo sapiens
tgtgcagcagccc

SEQ ID NO: 3909145 - DNA, 14 bp, Homo sapiens
tgtgcagcagccca

SEQ ID NO: 3909146 - DNA, 22 bp, Homo sapiens
tgtgcagtcccgtggagggtag

SEQ ID NO: 3909147 - DNA, 13 bp, Homo sapiens
tgtgcatgtatgt

SEQ ID NO: 3909148 - DNA, 18 bp, Homo sapiens
tgtgcatgtatgtgtgtg

SEQ ID NO: 3909149 - DNA, 14 bp, Homo sapiens
tgtgcatgtgagca

SEQ ID NO: 3909150 - DNA, 16 bp, Homo sapiens
tgtgcatgtgtgtata

SEQ ID NO: 3909151 - DNA, 15 bp, Homo sapiens
tgtgcatgtgtgtgt

SEQ ID NO: 3909152 - DNA, 22 bp, Homo sapiens
tgtgcatgtgtgtgtctgtctt

SEQ ID NO: 3909153 - DNA, 17 bp, Homo sapiens
tgtgccaacctgatgcc

SEQ ID NO: 3909154 - DNA, 17 bp, Homo sapiens
tgtgccagagcctgggg

SEQ ID NO: 3909155 - DNA, 11 bp, Homo sapiens
tgtgccagctc

SEQ ID NO: 3909156 - DNA, 20 bp, Homo sapiens
tgtgccatagagtttaacac

SEQ ID NO: 3909157 - DNA, 21 bp, Homo sapiens
tgtgccatagagtttaacaca

SEQ ID NO: 3909158 - DNA, 22 bp, Homo sapiens
tgtgcccctcagagaggcatgt

SEQ ID NO: 3909159 - DNA, 13 bp, Homo sapiens
tgtgccctgcctt

SEQ ID NO: 3909160 - DNA, 18 bp, Homo sapiens
tgtgccctgccttcagct

SEQ ID NO: 3909161 - DNA, 14 bp, Homo sapiens
tgtgcctcctcacc

SEQ ID NO: 3909162 - DNA, 15 bp, Homo sapiens
tgtgcctcctcaccc

SEQ ID NO: 3909163 - DNA, 14 bp, Homo sapiens
tgtgcctctgcctg

SEQ ID NO: 3909164 - DNA, 15 bp, Homo sapiens
tgtgcctctgcctgt

SEQ ID NO: 3909165 - DNA, 15 bp, Homo sapiens
tgtgcctgaccctac

SEQ ID NO: 3909166 - DNA, 14 bp, Homo sapiens
tgtgcctgtggcag

SEQ ID NO: 3909167 - DNA, 17 bp, Homo sapiens
tgtgcctttgggaggca

SEQ ID NO: 3909168 - DNA, 18 bp, Homo sapiens
tgtgccttttatagctat

SEQ ID NO: 3909169 - DNA, 14 bp, Homo sapiens
tgtgcgtctctctt

SEQ ID NO: 3909170 - DNA, 22 bp, Homo sapiens
tgtgcgtgcgtgttagtgtgtg

SEQ ID NO: 3909171 - DNA, 23 bp, Homo sapiens
tgtgcgtgcgtgttagtgtgtgt

SEQ ID NO: 3909172 - DNA, 14 bp, Homo sapiens
tgtgcgtgtgtgca

SEQ ID NO: 3909173 - DNA, 17 bp, Homo sapiens
tgtgctgaggactccct

SEQ ID NO: 3909174 - DNA, 15 bp, Homo sapiens
tgtgctgccctgctc

SEQ ID NO: 3909175 - DNA, 21 bp, Homo sapiens
tgtgctgccctgctctgggga

SEQ ID NO: 3909176 - DNA, 14 bp, Homo sapiens
tgtgctgtgcctgc

SEQ ID NO: 3909177 - DNA, 15 bp, Homo sapiens
tgtgctgtgcctgct

SEQ ID NO: 3909178 - DNA, 15 bp, Homo sapiens
tgtgctgtgggcagc

SEQ ID NO: 3909179 - DNA, 22 bp, Homo sapiens
tgtgctgtgggcagcaccctcc

SEQ ID NO: 3909180 - DNA, 17 bp, Homo sapiens
tgtgctgtgtctgcacc

SEQ ID NO: 3909181 - DNA, 14 bp, Homo sapiens
tgtgcttacagtga

SEQ ID NO: 3909182 - DNA, 13 bp, Homo sapiens
tgtggaaggcagg

SEQ ID NO: 3909183 - DNA, 21 bp, Homo sapiens
tgtggagaggggtgcacccac

SEQ ID NO: 3909184 - DNA, 22 bp, Homo sapiens
tgtggatgctccagggcagcct

SEQ ID NO: 3909185 - DNA, 16 bp, Homo sapiens
tgtggattccagcatt

SEQ ID NO: 3909186 - DNA, 18 bp, Homo sapiens
tgtggatttcctatttta

SEQ ID NO: 3909187 - DNA, 23 bp, Homo sapiens
tgtggatttcctattttaaaacc

SEQ ID NO: 3909188 - DNA, 18 bp, Homo sapiens
tgtggcagaccgggggcc

SEQ ID NO: 3909189 - DNA, 21 bp, Homo sapiens
tgtggcagaccgggggccaga

SEQ ID NO: 3909190 - DNA, 22 bp, Homo sapiens
tgtggcagaccgggggccagac

SEQ ID NO: 3909191 - DNA, 14 bp, Homo sapiens
tgtggcattggggg

SEQ ID NO: 3909192 - DNA, 13 bp, Homo sapiens
tgtggccagagct

SEQ ID NO: 3909193 - DNA, 15 bp, Homo sapiens
tgtggccccaggtgc

SEQ ID NO: 3909194 - DNA, 12 bp, Homo sapiens
tgtggccctggc

SEQ ID NO: 3909195 - DNA, 17 bp, Homo sapiens
tgtggccctggcctgct

SEQ ID NO: 3909196 - DNA, 18 bp, Homo sapiens
tgtggcctcacttccctg

SEQ ID NO: 3909197 - DNA, 13 bp, Homo sapiens
tgtggcctcagcc

SEQ ID NO: 3909198 - DNA, 15 bp, Homo sapiens
tgtggcctcagccct

SEQ ID NO: 3909199 - DNA, 23 bp, Homo sapiens
tgtggcctgtgtccagcagctgc

SEQ ID NO: 3909200 - DNA, 21 bp, Homo sapiens
tgtggccttgcccgccagcct

SEQ ID NO: 3909201 - DNA, 11 bp, Homo sapiens
tgtgggaagag

SEQ ID NO: 3909202 - DNA, 15 bp, Homo sapiens
tgtgggaagggagag

SEQ ID NO: 3909203 - DNA, 13 bp, Homo sapiens
tgtgggaggaaga

SEQ ID NO: 3909204 - DNA, 13 bp, Homo sapiens
tgtgggcagcacc

SEQ ID NO: 3909205 - DNA, 19 bp, Homo sapiens
tgtgggcagcaccctcccc

SEQ ID NO: 3909206 - DNA, 13 bp, Homo sapiens
tgtgggccaggag

SEQ ID NO: 3909207 - DNA, 14 bp, Homo sapiens
tgtgggggtggcca

SEQ ID NO: 3909208 - DNA, 16 bp, Homo sapiens
tgtggtacaatctcaa

SEQ ID NO: 3909209 - DNA, 16 bp, Homo sapiens
tgtggtatatttgtgt

SEQ ID NO: 3909210 - DNA, 20 bp, Homo sapiens
tgtggtatatttgtgtatgt

SEQ ID NO: 3909211 - DNA, 18 bp, Homo sapiens
tgtggttcctaagcctgt

SEQ ID NO: 3909212 - DNA, 21 bp, Homo sapiens
tgtgtaaagtgtaaatccttt

SEQ ID NO: 3909213 - DNA, 20 bp, Homo sapiens
tgtgtaaatggagcttgtac

SEQ ID NO: 3909214 - DNA, 21 bp, Homo sapiens
tgtgtaacaattttaatgcta

SEQ ID NO: 3909215 - DNA, 16 bp, Homo sapiens
tgtgtaatagaaaact

SEQ ID NO: 3909216 - DNA, 19 bp, Homo sapiens
tgtgtacagtgtgtaaagt

SEQ ID NO: 3909217 - DNA, 19 bp, Homo sapiens
tgtgtagctgtgacctgct

SEQ ID NO: 3909218 - DNA, 14 bp, Homo sapiens
tgtgtagctttgct

SEQ ID NO: 3909219 - DNA, 20 bp, Homo sapiens
tgtgtagggcttttttttga

SEQ ID NO: 3909220 - DNA, 14 bp, Homo sapiens
tgtgtatatataca

SEQ ID NO: 3909221 - DNA, 16 bp, Homo sapiens
tgtgtatgtatacaca

SEQ ID NO: 3909222 - DNA, 14 bp, Homo sapiens
tgtgtattctggct

SEQ ID NO: 3909223 - DNA, 14 bp, Homo sapiens
tgtgtattgaagaa

SEQ ID NO: 3909224 - DNA, 12 bp, Homo sapiens
tgtgtcccctca

SEQ ID NO: 3909225 - DNA, 14 bp, Homo sapiens
tgtgtcccctcact

SEQ ID NO: 3909226 - DNA, 18 bp, Homo sapiens
tgtgtcccctcactctgt

SEQ ID NO: 3909227 - DNA, 16 bp, Homo sapiens
tgtgtccttccctgca

SEQ ID NO: 3909228 - DNA, 22 bp, Homo sapiens
tgtgtgaaaggaagctccactg

SEQ ID NO: 3909229 - DNA, 17 bp, Homo sapiens
tgtgtgaattctgcaac

SEQ ID NO: 3909230 - DNA, 19 bp, Homo sapiens
tgtgtgacagaatcttgta

SEQ ID NO: 3909231 - DNA, 17 bp, Homo sapiens
tgtgtgagcaagcattt

SEQ ID NO: 3909232 - DNA, 15 bp, Homo sapiens
tgtgtgcatgtatgt

SEQ ID NO: 3909233 - DNA, 19 bp, Homo sapiens
tgtgtgcatgtatgtgtgt

SEQ ID NO: 3909234 - DNA, 19 bp, Homo sapiens
tgtgtgcatgtgtgtataa

SEQ ID NO: 3909235 - DNA, 24 bp, Homo sapiens
tgtgtgcatgtgtgtgtctgtctt

SEQ ID NO: 3909236 - DNA, 17 bp, Homo sapiens
tgtgtgcctgtggcaga

SEQ ID NO: 3909237 - DNA, 22 bp, Homo sapiens
tgtgtggaaggcagggacagag

SEQ ID NO: 3909238 - DNA, 23 bp, Homo sapiens
tgtgtgtaggtattaaagatgtg

SEQ ID NO: 3909239 - DNA, 13 bp, Homo sapiens
tgtgtgtctgtct

SEQ ID NO: 3909240 - DNA, 13 bp, Homo sapiens
tgtgtgtgcatgt

SEQ ID NO: 3909241 - DNA, 18 bp, Homo sapiens
tgtgtgtgcatgtatgtg

SEQ ID NO: 3909242 - DNA, 9 bp, Homo sapiens
tgtgtgtgt

SEQ ID NO: 3909243 - DNA, 12 bp, Homo sapiens
tgtgtgtgtgca

SEQ ID NO: 3909244 - DNA, 14 bp, Homo sapiens
tgtgtgtgtgtttg

SEQ ID NO: 3909245 - DNA, 19 bp, Homo sapiens
tgtgtgtttaaataaagta

SEQ ID NO: 3909246 - DNA, 22 bp, Homo sapiens
tgtgtgtttaaataaagtatca

SEQ ID NO: 3909247 - DNA, 10 bp, Homo sapiens
tgtgtgtttg

SEQ ID NO: 3909248 - DNA, 16 bp, Homo sapiens
tgtgttaaacatgcta

SEQ ID NO: 3909249 - DNA, 13 bp, Homo sapiens
tgtgttcattctt

SEQ ID NO: 3909250 - DNA, 12 bp, Homo sapiens
tgtgtttaaata

SEQ ID NO: 3909251 - DNA, 14 bp, Homo sapiens
tgtgtttgtgagca

SEQ ID NO: 3909252 - DNA, 14 bp, Homo sapiens
tgtgttttctgaat

SEQ ID NO: 3909253 - DNA, 21 bp, Homo sapiens
tgttaaaaatattttctgaat

SEQ ID NO: 3909254 - DNA, 21 bp, Homo sapiens
tgttaaaagatgaaaatattt

SEQ ID NO: 3909255 - DNA, 18 bp, Homo sapiens
tgttaaaatagacaactc

SEQ ID NO: 3909256 - DNA, 16 bp, Homo sapiens
tgttaaaatgtacact

SEQ ID NO: 3909257 - DNA, 18 bp, Homo sapiens
tgttaaacacgtgtctat

SEQ ID NO: 3909258 - DNA, 18 bp, Homo sapiens
tgttaactattattaata

SEQ ID NO: 3909259 - DNA, 20 bp, Homo sapiens
tgttaatggtgcaaatccta

SEQ ID NO: 3909260 - DNA, 22 bp, Homo sapiens
tgttacataacaagaaaatcaa

SEQ ID NO: 3909261 - DNA, 20 bp, Homo sapiens
tgttacctttcccatgctga

SEQ ID NO: 3909262 - DNA, 12 bp, Homo sapiens
tgttactgaaat

SEQ ID NO: 3909263 - DNA, 18 bp, Homo sapiens
tgttactgattctcctgt

SEQ ID NO: 3909264 - DNA, 14 bp, Homo sapiens
tgttacttacctaa

SEQ ID NO: 3909265 - DNA, 18 bp, Homo sapiens
tgttacttacctaaacag

SEQ ID NO: 3909266 - DNA, 12 bp, Homo sapiens
tgttagagaggt

SEQ ID NO: 3909267 - DNA, 21 bp, Homo sapiens
tgttagagaggtagcgagctg

SEQ ID NO: 3909268 - DNA, 17 bp, Homo sapiens
tgttagccccataattt

SEQ ID NO: 3909269 - DNA, 16 bp, Homo sapiens
tgttaggaaaatttca

SEQ ID NO: 3909270 - DNA, 19 bp, Homo sapiens
tgttaggaggctgcatgct

SEQ ID NO: 3909271 - DNA, 15 bp, Homo sapiens
tgttagtgtgtgtgc

SEQ ID NO: 3909272 - DNA, 17 bp, Homo sapiens
tgttagtgtgtgtgcat

SEQ ID NO: 3909273 - DNA, 21 bp, Homo sapiens
tgttagtgtgtgtgcatgtgt

SEQ ID NO: 3909274 - DNA, 21 bp, Homo sapiens
tgttagttattttaggagaca

SEQ ID NO: 3909275 - DNA, 23 bp, Homo sapiens
tgttatcctgctagctgtagaaa

SEQ ID NO: 3909276 - DNA, 17 bp, Homo sapiens
tgttatgtatatagatg

SEQ ID NO: 3909277 - DNA, 19 bp, Homo sapiens
tgttatgtatatagatgtg

SEQ ID NO: 3909278 - DNA, 13 bp, Homo sapiens
tgttattgtggaa

SEQ ID NO: 3909279 - DNA, 17 bp, Homo sapiens
tgttatttgtacagttc

SEQ ID NO: 3909280 - DNA, 19 bp, Homo sapiens
tgttattttctttgaaatt

SEQ ID NO: 3909281 - DNA, 19 bp, Homo sapiens
tgttcaaaaaaacactagt

SEQ ID NO: 3909282 - DNA, 16 bp, Homo sapiens
tgttcaaatgcatttt

SEQ ID NO: 3909283 - DNA, 16 bp, Homo sapiens
tgttcaatgcaaagta

SEQ ID NO: 3909284 - DNA, 18 bp, Homo sapiens
tgttcaccttatgtatta

SEQ ID NO: 3909285 - DNA, 15 bp, Homo sapiens
tgttcagaagaaatt

SEQ ID NO: 3909286 - DNA, 22 bp, Homo sapiens
tgttcagaaggttgctctagat

SEQ ID NO: 3909287 - DNA, 14 bp, Homo sapiens
tgttcatggcagat

SEQ ID NO: 3909288 - DNA, 18 bp, Homo sapiens
tgttcattttagtgactg

SEQ ID NO: 3909289 - DNA, 16 bp, Homo sapiens
tgttcccaagagcatc

SEQ ID NO: 3909290 - DNA, 13 bp, Homo sapiens
tgttcccacacac

SEQ ID NO: 3909291 - DNA, 15 bp, Homo sapiens
tgttccctgcaccct

SEQ ID NO: 3909292 - DNA, 14 bp, Homo sapiens
tgttcctagtgaaa

SEQ ID NO: 3909293 - DNA, 18 bp, Homo sapiens
tgttcctagtgaaagagg

SEQ ID NO: 3909294 - DNA, 16 bp, Homo sapiens
tgttctggacctcccc

SEQ ID NO: 3909295 - DNA, 18 bp, Homo sapiens
tgttctgtaatggaactg

SEQ ID NO: 3909296 - DNA, 22 bp, Homo sapiens
tgttctgtaatggaactgaccc

SEQ ID NO: 3909297 - DNA, 22 bp, Homo sapiens
tgttctgtgtgggtctggggag

SEQ ID NO: 3909298 - DNA, 22 bp, Homo sapiens
tgttcttacctgtatgtctcca

SEQ ID NO: 3909299 - DNA, 21 bp, Homo sapiens
tgttcttgctgagcaccctct

SEQ ID NO: 3909300 - DNA, 13 bp, Homo sapiens
tgttgaaaatgag

SEQ ID NO: 3909301 - DNA, 21 bp, Homo sapiens
tgttgaaaatgagcctgtaat

SEQ ID NO: 3909302 - DNA, 14 bp, Homo sapiens
tgttgaaaatgttc

SEQ ID NO: 3909303 - DNA, 21 bp, Homo sapiens
tgttgaaaattattttaaaca

SEQ ID NO: 3909304 - DNA, 22 bp, Homo sapiens
tgttgaatgcccacaggcaaat

SEQ ID NO: 3909305 - DNA, 23 bp, Homo sapiens
tgttgcaccatggacttttctca

SEQ ID NO: 3909306 - DNA, 18 bp, Homo sapiens
tgttgcagggaagtctta

SEQ ID NO: 3909307 - DNA, 19 bp, Homo sapiens
tgttgccaactaagccctc

SEQ ID NO: 3909308 - DNA, 17 bp, Homo sapiens
tgttgccacctgttaaa

SEQ ID NO: 3909309 - DNA, 19 bp, Homo sapiens
tgttgcccaggctgctctt

SEQ ID NO: 3909310 - DNA, 15 bp, Homo sapiens
tgttgccttagcact

SEQ ID NO: 3909311 - DNA, 18 bp, Homo sapiens
tgttgcgcacatccctgc

SEQ ID NO: 3909312 - DNA, 23 bp, Homo sapiens
tgttgctcaaatctattcagaca

SEQ ID NO: 3909313 - DNA, 14 bp, Homo sapiens
tgttgctcttggaa

SEQ ID NO: 3909314 - DNA, 18 bp, Homo sapiens
tgttgctcttggaaagct

SEQ ID NO: 3909315 - DNA, 21 bp, Homo sapiens
tgttggaaaagaatacagaaa

SEQ ID NO: 3909316 - DNA, 12 bp, Homo sapiens
tgttggaatgaa

SEQ ID NO: 3909317 - DNA, 14 bp, Homo sapiens
tgttggcctcgcct

SEQ ID NO: 3909318 - DNA, 22 bp, Homo sapiens
tgttggttaccctcctagcttt

SEQ ID NO: 3909319 - DNA, 16 bp, Homo sapiens
tgttgtaaataaaagt

SEQ ID NO: 3909320 - DNA, 13 bp, Homo sapiens
tgttgtaaattag

SEQ ID NO: 3909321 - DNA, 15 bp, Homo sapiens
tgttgtaaattagga

SEQ ID NO: 3909322 - DNA, 15 bp, Homo sapiens
tgttgtaatagtcca

SEQ ID NO: 3909323 - DNA, 22 bp, Homo sapiens
tgttgtacatacagaggtaact

SEQ ID NO: 3909324 - DNA, 14 bp, Homo sapiens
tgttgttcccacac

SEQ ID NO: 3909325 - DNA, 15 bp, Homo sapiens
tgttgttcccacaca

SEQ ID NO: 3909326 - DNA, 15 bp, Homo sapiens
tgttgttccttttga

SEQ ID NO: 3909327 - DNA, 22 bp, Homo sapiens
tgttgttctcctccattgctgt

SEQ ID NO: 3909328 - DNA, 11 bp, Homo sapiens
tgttgttttgt

SEQ ID NO: 3909329 - DNA, 14 bp, Homo sapiens
tgtttaaataaagt

SEQ ID NO: 3909330 - DNA, 20 bp, Homo sapiens
tgtttaaataaagtatcatg

SEQ ID NO: 3909331 - DNA, 14 bp, Homo sapiens
tgtttaaattgtaa

SEQ ID NO: 3909332 - DNA, 15 bp, Homo sapiens
tgtttaagtggcttt

SEQ ID NO: 3909333 - DNA, 15 bp, Homo sapiens
tgtttaatatttaaa

SEQ ID NO: 3909334 - DNA, 21 bp, Homo sapiens
tgtttacaaaaggcagccctt

SEQ ID NO: 3909335 - DNA, 22 bp, Homo sapiens
tgtttagaacactggtttaaag

SEQ ID NO: 3909336 - DNA, 14 bp, Homo sapiens
tgtttattaacaaa

SEQ ID NO: 3909337 - DNA, 16 bp, Homo sapiens
tgtttattaacaaatt

SEQ ID NO: 3909338 - DNA, 13 bp, Homo sapiens
tgtttattcctga

SEQ ID NO: 3909339 - DNA, 15 bp, Homo sapiens
tgtttcaaactgagt

SEQ ID NO: 3909340 - DNA, 16 bp, Homo sapiens
tgtttccagaaaatat

SEQ ID NO: 3909341 - DNA, 21 bp, Homo sapiens
tgtttccagaaaatataaatg

SEQ ID NO: 3909342 - DNA, 15 bp, Homo sapiens
tgtttccatttctca

SEQ ID NO: 3909343 - DNA, 11 bp, Homo sapiens
tgtttcctttt

SEQ ID NO: 3909344 - DNA, 15 bp, Homo sapiens
tgtttctaaaactat

SEQ ID NO: 3909345 - DNA, 18 bp, Homo sapiens
tgtttctggaaatggctg

SEQ ID NO: 3909346 - DNA, 21 bp, Homo sapiens
tgtttgacaaagaaacccaag

SEQ ID NO: 3909347 - DNA, 16 bp, Homo sapiens
tgtttgagatgtgatg

SEQ ID NO: 3909348 - DNA, 18 bp, Homo sapiens
tgtttgagatgtgatgct

SEQ ID NO: 3909349 - DNA, 12 bp, Homo sapiens
tgtttgagcgca

SEQ ID NO: 3909350 - DNA, 23 bp, Homo sapiens
tgtttgagctcagacccccactc

SEQ ID NO: 3909351 - DNA, 14 bp, Homo sapiens
tgtttgaggttaaa

SEQ ID NO: 3909352 - DNA, 16 bp, Homo sapiens
tgtttgatttagtaat

SEQ ID NO: 3909353 - DNA, 16 bp, Homo sapiens
tgtttgggcagaaggg

SEQ ID NO: 3909354 - DNA, 23 bp, Homo sapiens
tgtttggggcaggagtagctgag

SEQ ID NO: 3909355 - DNA, 16 bp, Homo sapiens
tgtttggttgtaaatg

SEQ ID NO: 3909356 - DNA, 18 bp, Homo sapiens
tgtttggttgtaaatgct

SEQ ID NO: 3909357 - DNA, 15 bp, Homo sapiens
tgtttgtaaattaat

SEQ ID NO: 3909358 - DNA, 19 bp, Homo sapiens
tgtttgtaaattaatactt

SEQ ID NO: 3909359 - DNA, 17 bp, Homo sapiens
tgtttgtaagtgaagtg

SEQ ID NO: 3909360 - DNA, 18 bp, Homo sapiens
tgtttgtagccaatacat

SEQ ID NO: 3909361 - DNA, 16 bp, Homo sapiens
tgtttgtgtgcatgaa

SEQ ID NO: 3909362 - DNA, 12 bp, Homo sapiens
tgttttaaatta

SEQ ID NO: 3909363 - DNA, 23 bp, Homo sapiens
tgttttacaaatttttcctgcaa

SEQ ID NO: 3909364 - DNA, 20 bp, Homo sapiens
tgttttacaagaattgtcca

SEQ ID NO: 3909365 - DNA, 12 bp, Homo sapiens
tgttttatcatg

SEQ ID NO: 3909366 - DNA, 23 bp, Homo sapiens
tgttttatcatgacatgttatat

SEQ ID NO: 3909367 - DNA, 14 bp, Homo sapiens
tgttttatgttcta

SEQ ID NO: 3909368 - DNA, 18 bp, Homo sapiens
tgttttattttttattgt

SEQ ID NO: 3909369 - DNA, 23 bp, Homo sapiens
tgttttattttttattgttttca

SEQ ID NO: 3909370 - DNA, 15 bp, Homo sapiens
tgttttcagactcag

SEQ ID NO: 3909371 - DNA, 14 bp, Homo sapiens
tgttttctgctgtt

SEQ ID NO: 3909372 - DNA, 11 bp, Homo sapiens
tgttttcttct

SEQ ID NO: 3909373 - DNA, 20 bp, Homo sapiens
tgttttgcacgtcttgctat

SEQ ID NO: 3909374 - DNA, 17 bp, Homo sapiens
tgttttgtacaattact

SEQ ID NO: 3909375 - DNA, 18 bp, Homo sapiens
tgttttgtatatgatcta

SEQ ID NO: 3909376 - DNA, 17 bp, Homo sapiens
tgttttgtcttacaaag

SEQ ID NO: 3909377 - DNA, 10 bp, Homo sapiens
tgtttttaaa

SEQ ID NO: 3909378 - DNA, 12 bp, Homo sapiens
tgtttttctggg

SEQ ID NO: 3909379 - DNA, 14 bp, Homo sapiens
tgttttttgaaaac

SEQ ID NO: 3909380 - DNA, 16 bp, Homo sapiens
tgttttttgaaaacat

SEQ ID NO: 3909381 - DNA, 11 bp, Homo sapiens
ttaaaaaacaa

SEQ ID NO: 3909382 - DNA, 20 bp, Homo sapiens
ttaaaaaataaaaaaataca

SEQ ID NO: 3909383 - DNA, 21 bp, Homo sapiens
ttaaaaaataaaaaaatacag

SEQ ID NO: 3909384 - DNA, 18 bp, Homo sapiens
ttaaaaacagctgtaact

SEQ ID NO: 3909385 - DNA, 12 bp, Homo sapiens
ttaaaagaaatt

SEQ ID NO: 3909386 - DNA, 16 bp, Homo sapiens
ttaaaagaaatttatt

SEQ ID NO: 3909387 - DNA, 13 bp, Homo sapiens
ttaaaagacagtg

SEQ ID NO: 3909388 - DNA, 17 bp, Homo sapiens
ttaaaagccacatagag

SEQ ID NO: 3909389 - DNA, 14 bp, Homo sapiens
ttaaaagtaaatgt

SEQ ID NO: 3909390 - DNA, 23 bp, Homo sapiens
ttaaaagtgttgattacataatc

SEQ ID NO: 3909391 - DNA, 18 bp, Homo sapiens
ttaaaatacacactcaaa

SEQ ID NO: 3909392 - DNA, 21 bp, Homo sapiens
ttaaaatatatataaatatat

SEQ ID NO: 3909393 - DNA, 16 bp, Homo sapiens
ttaaaatattcctgca

SEQ ID NO: 3909394 - DNA, 14 bp, Homo sapiens
ttaaaatattttat

SEQ ID NO: 3909395 - DNA, 17 bp, Homo sapiens
ttaaaatcattcaatat

SEQ ID NO: 3909396 - DNA, 17 bp, Homo sapiens
ttaaaatctggaaatct

SEQ ID NO: 3909397 - DNA, 17 bp, Homo sapiens
ttaaaatgctgttttgt

SEQ ID NO: 3909398 - DNA, 17 bp, Homo sapiens
ttaaaatgtaggaagaa

SEQ ID NO: 3909399 - DNA, 22 bp, Homo sapiens
ttaaaattaaagtatacatttt

SEQ ID NO: 3909400 - DNA, 16 bp, Homo sapiens
ttaaacacctgacaca

SEQ ID NO: 3909401 - DNA, 17 bp, Homo sapiens
ttaaacacctgacacat

SEQ ID NO: 3909402 - DNA, 18 bp, Homo sapiens
ttaaacacctgacacatc

SEQ ID NO: 3909403 - DNA, 16 bp, Homo sapiens
ttaaacacgtgtctat

SEQ ID NO: 3909404 - DNA, 16 bp, Homo sapiens
ttaaacactgtaatct

SEQ ID NO: 3909405 - DNA, 12 bp, Homo sapiens
ttaaacagcagt

SEQ ID NO: 3909406 - DNA, 14 bp, Homo sapiens
ttaaacagcagtgt

SEQ ID NO: 3909407 - DNA, 13 bp, Homo sapiens
ttaaaccagcaga

SEQ ID NO: 3909408 - DNA, 16 bp, Homo sapiens
ttaaaccagcagaaaa

SEQ ID NO: 3909409 - DNA, 20 bp, Homo sapiens
ttaaaccagcagaaaagtgc

SEQ ID NO: 3909410 - DNA, 15 bp, Homo sapiens
ttaaacctggatact

SEQ ID NO: 3909411 - DNA, 18 bp, Homo sapiens
ttaaactgttctgtgtgg

SEQ ID NO: 3909412 - DNA, 18 bp, Homo sapiens
ttaaagaagtaaatttgt

SEQ ID NO: 3909413 - DNA, 19 bp, Homo sapiens
ttaaagacttaagattaaa

SEQ ID NO: 3909414 - DNA, 23 bp, Homo sapiens
ttaaagagcatggaaaaatactg

SEQ ID NO: 3909415 - DNA, 15 bp, Homo sapiens
ttaaagcaacatttt

SEQ ID NO: 3909416 - DNA, 18 bp, Homo sapiens
ttaaagctgcctgtagtt

SEQ ID NO: 3909417 - DNA, 23 bp, Homo sapiens
ttaaaggaaaagtcaacatcttc

SEQ ID NO: 3909418 - DNA, 15 bp, Homo sapiens
ttaaaggaaggaaaa

SEQ ID NO: 3909419 - DNA, 22 bp, Homo sapiens
ttaaagggcagaaggggaagat

SEQ ID NO: 3909420 - DNA, 22 bp, Homo sapiens
ttaaagggtagcctacaaatgt

SEQ ID NO: 3909421 - DNA, 15 bp, Homo sapiens
ttaaaggtagagatg

SEQ ID NO: 3909422 - DNA, 16 bp, Homo sapiens
ttaaagtaaaggcctc

SEQ ID NO: 3909423 - DNA, 14 bp, Homo sapiens
ttaaataaattcaa

SEQ ID NO: 3909424 - DNA, 16 bp, Homo sapiens
ttaaatacagacacta

SEQ ID NO: 3909425 - DNA, 18 bp, Homo sapiens
ttaaatacagacactaag

SEQ ID NO: 3909426 - DNA, 19 bp, Homo sapiens
ttaaatacgcactacatgt

SEQ ID NO: 3909427 - DNA, 19 bp, Homo sapiens
ttaaatataaatgtttgtc

SEQ ID NO: 3909428 - DNA, 17 bp, Homo sapiens
ttaaatcaaaagctgct

SEQ ID NO: 3909429 - DNA, 18 bp, Homo sapiens
ttaaatcaaaagctgctt

SEQ ID NO: 3909430 - DNA, 23 bp, Homo sapiens
ttaaatcaaaagctgcttgacta

SEQ ID NO: 3909431 - DNA, 19 bp, Homo sapiens
ttaaatgtcttatatagca

SEQ ID NO: 3909432 - DNA, 14 bp, Homo sapiens
ttaaatgttgaaat

SEQ ID NO: 3909433 - DNA, 16 bp, Homo sapiens
ttaaattataagatgt

SEQ ID NO: 3909434 - DNA, 16 bp, Homo sapiens
ttaaattgtaaatttt

SEQ ID NO: 3909435 - DNA, 17 bp, Homo sapiens
ttaaattttaaggtaga

SEQ ID NO: 3909436 - DNA, 18 bp, Homo sapiens
ttaacaaaagattctgta

SEQ ID NO: 3909437 - DNA, 16 bp, Homo sapiens
ttaacagtcatttaaa

SEQ ID NO: 3909438 - DNA, 17 bp, Homo sapiens
ttaacatatttactaag

SEQ ID NO: 3909439 - DNA, 22 bp, Homo sapiens
ttaacatcatcaggcttggaat

SEQ ID NO: 3909440 - DNA, 17 bp, Homo sapiens
ttaacattaacatctat

SEQ ID NO: 3909441 - DNA, 10 bp, Homo sapiens
ttaacatttt

SEQ ID NO: 3909442 - DNA, 13 bp, Homo sapiens
ttaaccagaataa

SEQ ID NO: 3909443 - DNA, 13 bp, Homo sapiens
ttaaccctctctt

SEQ ID NO: 3909444 - DNA, 16 bp, Homo sapiens
ttaacctgaattattc

SEQ ID NO: 3909445 - DNA, 19 bp, Homo sapiens
ttaacctttccgctgtcgc

SEQ ID NO: 3909446 - DNA, 23 bp, Homo sapiens
ttaactcatctgttatcctgcta

SEQ ID NO: 3909447 - DNA, 17 bp, Homo sapiens
ttaactgtgtgaagaaa

SEQ ID NO: 3909448 - DNA, 22 bp, Homo sapiens
ttaacttgtcaaaaaacaaaaa

SEQ ID NO: 3909449 - DNA, 16 bp, Homo sapiens
ttaagacacacctctg

SEQ ID NO: 3909450 - DNA, 12 bp, Homo sapiens
ttaagagaaatg

SEQ ID NO: 3909451 - DNA, 13 bp, Homo sapiens
ttaagagaaatgg

SEQ ID NO: 3909452 - DNA, 19 bp, Homo sapiens
ttaagagtgaaataattaa

SEQ ID NO: 3909453 - DNA, 15 bp, Homo sapiens
ttaagatacactcct

SEQ ID NO: 3909454 - DNA, 18 bp, Homo sapiens
ttaagatacactcctgct

SEQ ID NO: 3909455 - DNA, 13 bp, Homo sapiens
ttaagattaaatt

SEQ ID NO: 3909456 - DNA, 19 bp, Homo sapiens
ttaagcctcatatttaaag

SEQ ID NO: 3909457 - DNA, 22 bp, Homo sapiens
ttaagcctcatatttaaagaca

SEQ ID NO: 3909458 - DNA, 17 bp, Homo sapiens
ttaaggacttctgcagc

SEQ ID NO: 3909459 - DNA, 20 bp, Homo sapiens
ttaaggattgtgatattttt

SEQ ID NO: 3909460 - DNA, 17 bp, Homo sapiens
ttaaggtgggtccagga

SEQ ID NO: 3909461 - DNA, 21 bp, Homo sapiens
ttaaggtttgccctgcctgca

SEQ ID NO: 3909462 - DNA, 14 bp, Homo sapiens
ttaagtatatagta

SEQ ID NO: 3909463 - DNA, 21 bp, Homo sapiens
ttaagtgttgtaaatatttat

SEQ ID NO: 3909464 - DNA, 14 bp, Homo sapiens
ttaagttagagaat

SEQ ID NO: 3909465 - DNA, 23 bp, Homo sapiens
ttaagttagagaatatatttttg

SEQ ID NO: 3909466 - DNA, 19 bp, Homo sapiens
ttaagttctcaatgtgaaa

SEQ ID NO: 3909467 - DNA, 13 bp, Homo sapiens
ttaataaaattga

SEQ ID NO: 3909468 - DNA, 16 bp, Homo sapiens
ttaatactcacctcct

SEQ ID NO: 3909469 - DNA, 21 bp, Homo sapiens
ttaatagacagtagccaagtt

SEQ ID NO: 3909470 - DNA, 22 bp, Homo sapiens
ttaatagcttttattgtataaa

SEQ ID NO: 3909471 - DNA, 12 bp, Homo sapiens
ttaatatttaaa

SEQ ID NO: 3909472 - DNA, 18 bp, Homo sapiens
ttaatatttaaacagcag

SEQ ID NO: 3909473 - DNA, 19 bp, Homo sapiens
ttaatatttgctgacagct

SEQ ID NO: 3909474 - DNA, 16 bp, Homo sapiens
ttaatcagacaaagta

SEQ ID NO: 3909475 - DNA, 22 bp, Homo sapiens
ttaatcattttgcctcttttct

SEQ ID NO: 3909476 - DNA, 14 bp, Homo sapiens
ttaatctttcctga

SEQ ID NO: 3909477 - DNA, 22 bp, Homo sapiens
ttaatgtgttgggaaaaaggcc

SEQ ID NO: 3909478 - DNA, 22 bp, Homo sapiens
ttaatgttgggatttatatcta

SEQ ID NO: 3909479 - DNA, 13 bp, Homo sapiens
ttaatgttttgta

SEQ ID NO: 3909480 - DNA, 13 bp, Homo sapiens
ttaattatctgat

SEQ ID NO: 3909481 - DNA, 16 bp, Homo sapiens
ttaattatctgatcgg

SEQ ID NO: 3909482 - DNA, 15 bp, Homo sapiens
ttaattcactcccac

SEQ ID NO: 3909483 - DNA, 17 bp, Homo sapiens
ttaattctcatgtgatc

SEQ ID NO: 3909484 - DNA, 14 bp, Homo sapiens
ttaatttaaagcca

SEQ ID NO: 3909485 - DNA, 12 bp, Homo sapiens
ttaatttatggt

SEQ ID NO: 3909486 - DNA, 13 bp, Homo sapiens
ttaatttatttca

SEQ ID NO: 3909487 - DNA, 16 bp, Homo sapiens
ttaatttgatacaaaa

SEQ ID NO: 3909488 - DNA, 15 bp, Homo sapiens
ttacaaaaggcagcc

SEQ ID NO: 3909489 - DNA, 18 bp, Homo sapiens
ttacaaatttttcctgca

SEQ ID NO: 3909490 - DNA, 16 bp, Homo sapiens
ttacaaccaagaacat

SEQ ID NO: 3909491 - DNA, 19 bp, Homo sapiens
ttacaaggcacttgtcact

SEQ ID NO: 3909492 - DNA, 16 bp, Homo sapiens
ttacaagtgtatatca

SEQ ID NO: 3909493 - DNA, 23 bp, Homo sapiens
ttacaataaaatcttgaaaatgc

SEQ ID NO: 3909494 - DNA, 13 bp, Homo sapiens
ttacaataaatat

SEQ ID NO: 3909495 - DNA, 19 bp, Homo sapiens
ttacaataaatattctgca

SEQ ID NO: 3909496 - DNA, 13 bp, Homo sapiens
ttacacaattaat

SEQ ID NO: 3909497 - DNA, 16 bp, Homo sapiens
ttacacaattaattgt

SEQ ID NO: 3909498 - DNA, 17 bp, Homo sapiens
ttacacaattaattgtc

SEQ ID NO: 3909499 - DNA, 16 bp, Homo sapiens
ttacacacacagatgt

SEQ ID NO: 3909500 - DNA, 17 bp, Homo sapiens
ttacacagcccaagagg

SEQ ID NO: 3909501 - DNA, 16 bp, Homo sapiens
ttacactctctgtaca

SEQ ID NO: 3909502 - DNA, 11 bp, Homo sapiens
ttacagaactg

SEQ ID NO: 3909503 - DNA, 22 bp, Homo sapiens
ttacagagaatctgaagctatt

SEQ ID NO: 3909504 - DNA, 16 bp, Homo sapiens
ttacagaggaagttat

SEQ ID NO: 3909505 - DNA, 16 bp, Homo sapiens
ttacagggcccaggtg

SEQ ID NO: 3909506 - DNA, 17 bp, Homo sapiens
ttacagggcccaggtga

SEQ ID NO: 3909507 - DNA, 16 bp, Homo sapiens
ttacagtaaataaatt

SEQ ID NO: 3909508 - DNA, 22 bp, Homo sapiens
ttacagtaaataaattgtttga

SEQ ID NO: 3909509 - DNA, 17 bp, Homo sapiens
ttacagtcaattttaca

SEQ ID NO: 3909510 - DNA, 17 bp, Homo sapiens
ttacagtgtagcttgcc

SEQ ID NO: 3909511 - DNA, 22 bp, Homo sapiens
ttacataatcaaagctacctgt

SEQ ID NO: 3909512 - DNA, 16 bp, Homo sapiens
ttacatctaatgcttc

SEQ ID NO: 3909513 - DNA, 12 bp, Homo sapiens
ttacatgaacac

SEQ ID NO: 3909514 - DNA, 14 bp, Homo sapiens
ttacatgaacacag

SEQ ID NO: 3909515 - DNA, 16 bp, Homo sapiens
ttacatgaccagaaaa

SEQ ID NO: 3909516 - DNA, 23 bp, Homo sapiens
ttacatgcaatttattaaaatga

SEQ ID NO: 3909517 - DNA, 14 bp, Homo sapiens
ttacattaatgtta

SEQ ID NO: 3909518 - DNA, 13 bp, Homo sapiens
ttacatttttaca

SEQ ID NO: 3909519 - DNA, 16 bp, Homo sapiens
ttaccaactttctgta

SEQ ID NO: 3909520 - DNA, 11 bp, Homo sapiens
ttaccatgaga

SEQ ID NO: 3909521 - DNA, 22 bp, Homo sapiens
ttacccagagaatatatacatt

SEQ ID NO: 3909522 - DNA, 18 bp, Homo sapiens
ttaccctaaaacatgtgt

SEQ ID NO: 3909523 - DNA, 15 bp, Homo sapiens
ttaccgtagcctccg

SEQ ID NO: 3909524 - DNA, 16 bp, Homo sapiens
ttacctaaacagatat

SEQ ID NO: 3909525 - DNA, 18 bp, Homo sapiens
ttacctaccaccttccct

SEQ ID NO: 3909526 - DNA, 13 bp, Homo sapiens
ttacctcctgccc

SEQ ID NO: 3909527 - DNA, 14 bp, Homo sapiens
ttacctcctgccca

SEQ ID NO: 3909528 - DNA, 13 bp, Homo sapiens
ttacctgacacaa

SEQ ID NO: 3909529 - DNA, 22 bp, Homo sapiens
ttacctgcatgtgttgtacaat

SEQ ID NO: 3909530 - DNA, 15 bp, Homo sapiens
ttacctgccacttcc

SEQ ID NO: 3909531 - DNA, 21 bp, Homo sapiens
ttaccttagattagctctgga

SEQ ID NO: 3909532 - DNA, 20 bp, Homo sapiens
ttacggagggaggacatcat

SEQ ID NO: 3909533 - DNA, 12 bp, Homo sapiens
ttacgtgagcca

SEQ ID NO: 3909534 - DNA, 22 bp, Homo sapiens
ttactaaagatatcagagctct

SEQ ID NO: 3909535 - DNA, 18 bp, Homo sapiens
ttactaagccacaagaaa

SEQ ID NO: 3909536 - DNA, 20 bp, Homo sapiens
ttactaagccacaagaaatt

SEQ ID NO: 3909537 - DNA, 21 bp, Homo sapiens
ttactaagccacaagaaattt

SEQ ID NO: 3909538 - DNA, 22 bp, Homo sapiens
ttactaagccacaagaaatttg

SEQ ID NO: 3909539 - DNA, 20 bp, Homo sapiens
ttactacttcttggaaaaaa

SEQ ID NO: 3909540 - DNA, 16 bp, Homo sapiens
ttactacttgttacct

SEQ ID NO: 3909541 - DNA, 19 bp, Homo sapiens
ttactacttgttacctttc

SEQ ID NO: 3909542 - DNA, 15 bp, Homo sapiens
ttactagcttttcaa

SEQ ID NO: 3909543 - DNA, 16 bp, Homo sapiens
ttactatgcacaattt

SEQ ID NO: 3909544 - DNA, 14 bp, Homo sapiens
ttactcccttcctg

SEQ ID NO: 3909545 - DNA, 16 bp, Homo sapiens
ttactcccttcctggc

SEQ ID NO: 3909546 - DNA, 19 bp, Homo sapiens
ttactcccttcctggcctc

SEQ ID NO: 3909547 - DNA, 19 bp, Homo sapiens
ttactcctgtgggagcctc

SEQ ID NO: 3909548 - DNA, 18 bp, Homo sapiens
ttactctgagcccaggcc

SEQ ID NO: 3909549 - DNA, 15 bp, Homo sapiens
ttactggaccccgcc

SEQ ID NO: 3909550 - DNA, 22 bp, Homo sapiens
ttactgtctggttttaacaatt

SEQ ID NO: 3909551 - DNA, 15 bp, Homo sapiens
ttactgttgcactga

SEQ ID NO: 3909552 - DNA, 13 bp, Homo sapiens
ttacttacctgca

SEQ ID NO: 3909553 - DNA, 15 bp, Homo sapiens
ttacttcctaaattt

SEQ ID NO: 3909554 - DNA, 18 bp, Homo sapiens
ttacttcgtgcgcaacaa

SEQ ID NO: 3909555 - DNA, 13 bp, Homo sapiens
ttacttgaaagat

SEQ ID NO: 3909556 - DNA, 12 bp, Homo sapiens
ttacttgcacaa

SEQ ID NO: 3909557 - DNA, 18 bp, Homo sapiens
ttacttgtagaaatctgt

SEQ ID NO: 3909558 - DNA, 20 bp, Homo sapiens
ttacttgtagaaatctgtaa

SEQ ID NO: 3909559 - DNA, 22 bp, Homo sapiens
ttacttgtagaaatctgtaatt

SEQ ID NO: 3909560 - DNA, 16 bp, Homo sapiens
ttacttgtctgaggcc

SEQ ID NO: 3909561 - DNA, 21 bp, Homo sapiens
ttactttaatactcacctcct

SEQ ID NO: 3909562 - DNA, 19 bp, Homo sapiens
ttacttttgttctgtattt

SEQ ID NO: 3909563 - DNA, 20 bp, Homo sapiens
ttagaaaagcaaagggtgct

SEQ ID NO: 3909564 - DNA, 17 bp, Homo sapiens
ttagaaacatggttttg

SEQ ID NO: 3909565 - DNA, 13 bp, Homo sapiens
ttagaaatagaca

SEQ ID NO: 3909566 - DNA, 15 bp, Homo sapiens
ttagaaatagacagt

SEQ ID NO: 3909567 - DNA, 17 bp, Homo sapiens
ttagaaattgcatttcc

SEQ ID NO: 3909568 - DNA, 19 bp, Homo sapiens
ttagaattttagaagagat

SEQ ID NO: 3909569 - DNA, 21 bp, Homo sapiens
ttagacttcgactcaggatcc

SEQ ID NO: 3909570 - DNA, 21 bp, Homo sapiens
ttagatatataactttagaaa

SEQ ID NO: 3909571 - DNA, 14 bp, Homo sapiens
ttagattagctctg

SEQ ID NO: 3909572 - DNA, 16 bp, Homo sapiens
ttagattagctctgga

SEQ ID NO: 3909573 - DNA, 17 bp, Homo sapiens
ttagcatgtgttgaaaa

SEQ ID NO: 3909574 - DNA, 13 bp, Homo sapiens
ttagcccaagagg

SEQ ID NO: 3909575 - DNA, 10 bp, Homo sapiens
ttagcctgga

SEQ ID NO: 3909576 - DNA, 12 bp, Homo sapiens
ttagcctggagc

SEQ ID NO: 3909577 - DNA, 23 bp, Homo sapiens
ttagcctggagcacctttccttc

SEQ ID NO: 3909578 - DNA, 13 bp, Homo sapiens
ttagctgtaaata

SEQ ID NO: 3909579 - DNA, 13 bp, Homo sapiens
ttagctttctcag

SEQ ID NO: 3909580 - DNA, 15 bp, Homo sapiens
ttaggaaataaaacc

SEQ ID NO: 3909581 - DNA, 18 bp, Homo sapiens
ttaggaaataaaaccttt

SEQ ID NO: 3909582 - DNA, 20 bp, Homo sapiens
ttaggaaataaaacctttca

SEQ ID NO: 3909583 - DNA, 18 bp, Homo sapiens
ttaggcagggatttgagg

SEQ ID NO: 3909584 - DNA, 14 bp, Homo sapiens
ttaggcatgcctaa

SEQ ID NO: 3909585 - DNA, 13 bp, Homo sapiens
ttaggcattattt

SEQ ID NO: 3909586 - DNA, 17 bp, Homo sapiens
ttaggcattatttaatg

SEQ ID NO: 3909587 - DNA, 14 bp, Homo sapiens
ttagggagagaaga

SEQ ID NO: 3909588 - DNA, 19 bp, Homo sapiens
ttaggggaagtatgtgtgg

SEQ ID NO: 3909589 - DNA, 12 bp, Homo sapiens
ttaggtctggtt

SEQ ID NO: 3909590 - DNA, 20 bp, Homo sapiens
ttagtcacaccatcttaaat

SEQ ID NO: 3909591 - DNA, 18 bp, Homo sapiens
ttagtcttttactccttt

SEQ ID NO: 3909592 - DNA, 14 bp, Homo sapiens
ttagtgctttacat

SEQ ID NO: 3909593 - DNA, 16 bp, Homo sapiens
ttagtgtgtgtgcatg

SEQ ID NO: 3909594 - DNA, 13 bp, Homo sapiens
ttagttaatatat

SEQ ID NO: 3909595 - DNA, 18 bp, Homo sapiens
ttagttatagtttcagat

SEQ ID NO: 3909596 - DNA, 14 bp, Homo sapiens
ttataaataaacat

SEQ ID NO: 3909597 - DNA, 13 bp, Homo sapiens
ttataaataaatg

SEQ ID NO: 3909598 - DNA, 18 bp, Homo sapiens
ttataactgaaggagaag

SEQ ID NO: 3909599 - DNA, 13 bp, Homo sapiens
ttataacttaaaa

SEQ ID NO: 3909600 - DNA, 17 bp, Homo sapiens
ttataacttaaaatatt

SEQ ID NO: 3909601 - DNA, 18 bp, Homo sapiens
ttataagtagcaggccaa

SEQ ID NO: 3909602 - DNA, 18 bp, Homo sapiens
ttataatgtggatttcct

SEQ ID NO: 3909603 - DNA, 14 bp, Homo sapiens
ttatacaaaataat

SEQ ID NO: 3909604 - DNA, 17 bp, Homo sapiens
ttatacaaaataattta

SEQ ID NO: 3909605 - DNA, 20 bp, Homo sapiens
ttatacaaaataatttaact

SEQ ID NO: 3909606 - DNA, 21 bp, Homo sapiens
ttatacaaaataatttaacta

SEQ ID NO: 3909607 - DNA, 17 bp, Homo sapiens
ttatacacaacatttat

SEQ ID NO: 3909608 - DNA, 21 bp, Homo sapiens
ttatacatagtcacaaaaatg

SEQ ID NO: 3909609 - DNA, 22 bp, Homo sapiens
ttatacatagtcacaaaaatgg

SEQ ID NO: 3909610 - DNA, 17 bp, Homo sapiens
ttatacatatcagaaaa

SEQ ID NO: 3909611 - DNA, 20 bp, Homo sapiens
ttatacatatcagaaaagta

SEQ ID NO: 3909612 - DNA, 16 bp, Homo sapiens
ttatactcaaaattca

SEQ ID NO: 3909613 - DNA, 17 bp, Homo sapiens
ttatactccatacataa

SEQ ID NO: 3909614 - DNA, 21 bp, Homo sapiens
ttatagcacaaactttaaatt

SEQ ID NO: 3909615 - DNA, 22 bp, Homo sapiens
ttatagccacatccctttgaaa

SEQ ID NO: 3909616 - DNA, 22 bp, Homo sapiens
ttatatattggtaacatccttt

SEQ ID NO: 3909617 - DNA, 13 bp, Homo sapiens
ttatatattgtat

SEQ ID NO: 3909618 - DNA, 15 bp, Homo sapiens
ttatatcagcctgag

SEQ ID NO: 3909619 - DNA, 17 bp, Homo sapiens
ttatatctaatttatac

SEQ ID NO: 3909620 - DNA, 20 bp, Homo sapiens
ttatatctaatttatacaaa

SEQ ID NO: 3909621 - DNA, 21 bp, Homo sapiens
ttatatctaatttatacaaaa

SEQ ID NO: 3909622 - DNA, 22 bp, Homo sapiens
ttatatctaatttatacaaaat

SEQ ID NO: 3909623 - DNA, 23 bp, Homo sapiens
ttatatctaatttatacaaaata

SEQ ID NO: 3909624 - DNA, 16 bp, Homo sapiens
ttatattgtatattct

SEQ ID NO: 3909625 - DNA, 21 bp, Homo sapiens
ttatattgtatattctggaaa

SEQ ID NO: 3909626 - DNA, 22 bp, Homo sapiens
ttatattgtatattctggaaaa

SEQ ID NO: 3909627 - DNA, 12 bp, Homo sapiens
ttatattgtcct

SEQ ID NO: 3909628 - DNA, 19 bp, Homo sapiens
ttatatttagttatagttt

SEQ ID NO: 3909629 - DNA, 13 bp, Homo sapiens
ttatatttggaaa

SEQ ID NO: 3909630 - DNA, 13 bp, Homo sapiens
ttatcaaaagaca

SEQ ID NO: 3909631 - DNA, 12 bp, Homo sapiens
ttatcaaaatct

SEQ ID NO: 3909632 - DNA, 15 bp, Homo sapiens
ttatcacttttctgt

SEQ ID NO: 3909633 - DNA, 22 bp, Homo sapiens
ttatcagctacttaagagaaat

SEQ ID NO: 3909634 - DNA, 23 bp, Homo sapiens
ttatcagtgatggtctcacagag

SEQ ID NO: 3909635 - DNA, 18 bp, Homo sapiens
ttatccaggactctgtca

SEQ ID NO: 3909636 - DNA, 21 bp, Homo sapiens
ttatcctgctagctgtagaaa

SEQ ID NO: 3909637 - DNA, 22 bp, Homo sapiens
ttatccttaggaaaatgcttct

SEQ ID NO: 3909638 - DNA, 23 bp, Homo sapiens
ttatccttaggaaaatgcttctg

SEQ ID NO: 3909639 - DNA, 15 bp, Homo sapiens
ttatctctatttaat

SEQ ID NO: 3909640 - DNA, 22 bp, Homo sapiens
ttatctgatcgggataacaaaa

SEQ ID NO: 3909641 - DNA, 18 bp, Homo sapiens
ttatctgcctggcctggc

SEQ ID NO: 3909642 - DNA, 11 bp, Homo sapiens
ttatctgtgtt

SEQ ID NO: 3909643 - DNA, 16 bp, Homo sapiens
ttatgacatcacttgt

SEQ ID NO: 3909644 - DNA, 18 bp, Homo sapiens
ttatgacatcacttgtac

SEQ ID NO: 3909645 - DNA, 21 bp, Homo sapiens
ttatgacatcacttgtacaaa

SEQ ID NO: 3909646 - DNA, 23 bp, Homo sapiens
ttatgacatcacttgtacaaaat

SEQ ID NO: 3909647 - DNA, 21 bp, Homo sapiens
ttatgagatgatgaaaataat

SEQ ID NO: 3909648 - DNA, 23 bp, Homo sapiens
ttatgagatgatgaaaataataa

SEQ ID NO: 3909649 - DNA, 16 bp, Homo sapiens
ttatgctaactgtaga

SEQ ID NO: 3909650 - DNA, 19 bp, Homo sapiens
ttatggaagattttaaatt

SEQ ID NO: 3909651 - DNA, 21 bp, Homo sapiens
ttatggcaagtgatatcacct

SEQ ID NO: 3909652 - DNA, 13 bp, Homo sapiens
ttatggcatgatt

SEQ ID NO: 3909653 - DNA, 10 bp, Homo sapiens
ttatggtgaa

SEQ ID NO: 3909654 - DNA, 14 bp, Homo sapiens
ttatggtgtaatgc

SEQ ID NO: 3909655 - DNA, 17 bp, Homo sapiens
ttatggtgtaatgcaca

SEQ ID NO: 3909656 - DNA, 18 bp, Homo sapiens
ttatgtaattattttctt

SEQ ID NO: 3909657 - DNA, 12 bp, Homo sapiens
ttatgtagaaat

SEQ ID NO: 3909658 - DNA, 16 bp, Homo sapiens
ttatgtatatagatgt

SEQ ID NO: 3909659 - DNA, 18 bp, Homo sapiens
ttatgtgtgcatgtgtgt

SEQ ID NO: 3909660 - DNA, 12 bp, Homo sapiens
ttatgttaaaat

SEQ ID NO: 3909661 - DNA, 16 bp, Homo sapiens
ttatgttctcagaatc

SEQ ID NO: 3909662 - DNA, 21 bp, Homo sapiens
ttatgttgttcaaatgcattt

SEQ ID NO: 3909663 - DNA, 19 bp, Homo sapiens
ttattaacaaattatgtta

SEQ ID NO: 3909664 - DNA, 21 bp, Homo sapiens
ttattaacgggcatgtattat

SEQ ID NO: 3909665 - DNA, 22 bp, Homo sapiens
ttattaagtctgggatgtagaa

SEQ ID NO: 3909666 - DNA, 14 bp, Homo sapiens
ttattaattcatta

SEQ ID NO: 3909667 - DNA, 12 bp, Homo sapiens
ttattacattta

SEQ ID NO: 3909668 - DNA, 12 bp, Homo sapiens
ttattagctgta

SEQ ID NO: 3909669 - DNA, 11 bp, Homo sapiens
ttattattaga

SEQ ID NO: 3909670 - DNA, 16 bp, Homo sapiens
ttattcaagttattgt

SEQ ID NO: 3909671 - DNA, 23 bp, Homo sapiens
ttattcaataaaaaaaagaaatg

SEQ ID NO: 3909672 - DNA, 17 bp, Homo sapiens
ttattcatgccatctgt

SEQ ID NO: 3909673 - DNA, 12 bp, Homo sapiens
ttattcatttaa

SEQ ID NO: 3909674 - DNA, 17 bp, Homo sapiens
ttattcatttaaaatga

SEQ ID NO: 3909675 - DNA, 19 bp, Homo sapiens
ttattccctttcacaaaat

SEQ ID NO: 3909676 - DNA, 20 bp, Homo sapiens
ttattcctatatagtttatt

SEQ ID NO: 3909677 - DNA, 22 bp, Homo sapiens
ttattcctatatagtttattga

SEQ ID NO: 3909678 - DNA, 17 bp, Homo sapiens
ttattcctgataataat

SEQ ID NO: 3909679 - DNA, 21 bp, Homo sapiens
ttattcctgataataattgat

SEQ ID NO: 3909680 - DNA, 17 bp, Homo sapiens
ttattctcactccacca

SEQ ID NO: 3909681 - DNA, 13 bp, Homo sapiens
ttattgaagaaac

SEQ ID NO: 3909682 - DNA, 14 bp, Homo sapiens
ttattgcttaatcc

SEQ ID NO: 3909683 - DNA, 12 bp, Homo sapiens
ttattggccact

SEQ ID NO: 3909684 - DNA, 19 bp, Homo sapiens
ttattgtacagctgtttaa

SEQ ID NO: 3909685 - DNA, 22 bp, Homo sapiens
ttattgtataaactatcagttt

SEQ ID NO: 3909686 - DNA, 23 bp, Homo sapiens
ttattgtgttgccttagcacttc

SEQ ID NO: 3909687 - DNA, 19 bp, Homo sapiens
ttatttaaatgttgaaatc

SEQ ID NO: 3909688 - DNA, 22 bp, Homo sapiens
ttatttaaatgttgaaatctta

SEQ ID NO: 3909689 - DNA, 20 bp, Homo sapiens
ttatttaagaataaagtctt

SEQ ID NO: 3909690 - DNA, 13 bp, Homo sapiens
ttatttacttgta

SEQ ID NO: 3909691 - DNA, 14 bp, Homo sapiens
ttatttatagtcat

SEQ ID NO: 3909692 - DNA, 14 bp, Homo sapiens
ttatttatgcctct

SEQ ID NO: 3909693 - DNA, 23 bp, Homo sapiens
ttatttatggcttataaatgtgt

SEQ ID NO: 3909694 - DNA, 15 bp, Homo sapiens
ttatttattggagat

SEQ ID NO: 3909695 - DNA, 15 bp, Homo sapiens
ttatttatttatgga

SEQ ID NO: 3909696 - DNA, 22 bp, Homo sapiens
ttatttcaaccgcttgccatat

SEQ ID NO: 3909697 - DNA, 14 bp, Homo sapiens
ttatttcatccagt

SEQ ID NO: 3909698 - DNA, 12 bp, Homo sapiens
ttatttctagca

SEQ ID NO: 3909699 - DNA, 13 bp, Homo sapiens
ttatttctttgtg

SEQ ID NO: 3909700 - DNA, 16 bp, Homo sapiens
ttatttgtgtaataga

SEQ ID NO: 3909701 - DNA, 12 bp, Homo sapiens
ttattttcactg

SEQ ID NO: 3909702 - DNA, 12 bp, Homo sapiens
ttattttcatta

SEQ ID NO: 3909703 - DNA, 20 bp, Homo sapiens
ttattttgtttaagtggctt

SEQ ID NO: 3909704 - DNA, 22 bp, Homo sapiens
ttatttttctaaggttctcata

SEQ ID NO: 3909705 - DNA, 19 bp, Homo sapiens
ttatttttgtccctgctcc

SEQ ID NO: 3909706 - DNA, 13 bp, Homo sapiens
ttattttttattg

SEQ ID NO: 3909707 - DNA, 14 bp, Homo sapiens
ttcaaaaacctggt

SEQ ID NO: 3909708 - DNA, 14 bp, Homo sapiens
ttcaaacaagaatg

SEQ ID NO: 3909709 - DNA, 16 bp, Homo sapiens
ttcaaaccaggatttt

SEQ ID NO: 3909710 - DNA, 16 bp, Homo sapiens
ttcaaaccatttaatt

SEQ ID NO: 3909711 - DNA, 20 bp, Homo sapiens
ttcaaaccatttaattcata

SEQ ID NO: 3909712 - DNA, 13 bp, Homo sapiens
ttcaaagagacta

SEQ ID NO: 3909713 - DNA, 23 bp, Homo sapiens
ttcaaagagactaatagagacac

SEQ ID NO: 3909714 - DNA, 12 bp, Homo sapiens
ttcaaagctgag

SEQ ID NO: 3909715 - DNA, 23 bp, Homo sapiens
ttcaaatggcagcagttccatga

SEQ ID NO: 3909716 - DNA, 14 bp, Homo sapiens
ttcaaccagcattt

SEQ ID NO: 3909717 - DNA, 21 bp, Homo sapiens
ttcaaccagcattttactact

SEQ ID NO: 3909718 - DNA, 15 bp, Homo sapiens
ttcaaccattcccca

SEQ ID NO: 3909719 - DNA, 17 bp, Homo sapiens
ttcaaccattccccatg

SEQ ID NO: 3909720 - DNA, 18 bp, Homo sapiens
ttcaaccgcttgccatat

SEQ ID NO: 3909721 - DNA, 22 bp, Homo sapiens
ttcaacctggtggcaccagatg

SEQ ID NO: 3909722 - DNA, 16 bp, Homo sapiens
ttcaacgcagccctgc

SEQ ID NO: 3909723 - DNA, 12 bp, Homo sapiens
ttcaactccaga

SEQ ID NO: 3909724 - DNA, 17 bp, Homo sapiens
ttcaactgaccagcctc

SEQ ID NO: 3909725 - DNA, 23 bp, Homo sapiens
ttcaagaaaaaataaatggaaat

SEQ ID NO: 3909726 - DNA, 13 bp, Homo sapiens
ttcaagaaactga

SEQ ID NO: 3909727 - DNA, 14 bp, Homo sapiens
ttcaagaccagcct

SEQ ID NO: 3909728 - DNA, 18 bp, Homo sapiens
ttcaagaccttctcccca

SEQ ID NO: 3909729 - DNA, 14 bp, Homo sapiens
ttcaagacttgata

SEQ ID NO: 3909730 - DNA, 16 bp, Homo sapiens
ttcaagagacactgct

SEQ ID NO: 3909731 - DNA, 14 bp, Homo sapiens
ttcaagcctgtggg

SEQ ID NO: 3909732 - DNA, 15 bp, Homo sapiens
ttcaagcgattctca

SEQ ID NO: 3909733 - DNA, 22 bp, Homo sapiens
ttcaagcgattcttgtgcctca

SEQ ID NO: 3909734 - DNA, 20 bp, Homo sapiens
ttcaagctgtcccctctgtc

SEQ ID NO: 3909735 - DNA, 19 bp, Homo sapiens
ttcaaggagtatgcaggga

SEQ ID NO: 3909736 - DNA, 22 bp, Homo sapiens
ttcaaggtggccaaattatttg

SEQ ID NO: 3909737 - DNA, 17 bp, Homo sapiens
ttcaagtgcctcttgtt

SEQ ID NO: 3909738 - DNA, 20 bp, Homo sapiens
ttcaagttattgtacagctg

SEQ ID NO: 3909739 - DNA, 23 bp, Homo sapiens
ttcaataaaaaaaagaaatgaaa

SEQ ID NO: 3909740 - DNA, 12 bp, Homo sapiens
ttcaataaagct

SEQ ID NO: 3909741 - DNA, 16 bp, Homo sapiens
ttcaatctttgctgta

SEQ ID NO: 3909742 - DNA, 17 bp, Homo sapiens
ttcaatgacctgtattt

SEQ ID NO: 3909743 - DNA, 17 bp, Homo sapiens
ttcaatgcaaagtaaaa

SEQ ID NO: 3909744 - DNA, 13 bp, Homo sapiens
ttcaattcagtgc

SEQ ID NO: 3909745 - DNA, 13 bp, Homo sapiens
ttcaattctcaaa

SEQ ID NO: 3909746 - DNA, 21 bp, Homo sapiens
ttcacaacataaggagaatgt

SEQ ID NO: 3909747 - DNA, 13 bp, Homo sapiens
ttcacaatagaaa

SEQ ID NO: 3909748 - DNA, 19 bp, Homo sapiens
ttcacacctcacgctctgg

SEQ ID NO: 3909749 - DNA, 11 bp, Homo sapiens
ttcacacctta

SEQ ID NO: 3909750 - DNA, 13 bp, Homo sapiens
ttcacagtttttc

SEQ ID NO: 3909751 - DNA, 15 bp, Homo sapiens
ttcacataccctccc

SEQ ID NO: 3909752 - DNA, 15 bp, Homo sapiens
ttcacatttgatgta

SEQ ID NO: 3909753 - DNA, 20 bp, Homo sapiens
ttcaccagcaactctgactc

SEQ ID NO: 3909754 - DNA, 18 bp, Homo sapiens
ttcacccagctaatctgt

SEQ ID NO: 3909755 - DNA, 22 bp, Homo sapiens
ttcaccccccactcaccagtgt

SEQ ID NO: 3909756 - DNA, 23 bp, Homo sapiens
ttcaccccccactcaccagtgtc

SEQ ID NO: 3909757 - DNA, 12 bp, Homo sapiens
ttcacccctgca

SEQ ID NO: 3909758 - DNA, 14 bp, Homo sapiens
ttcacccctgcact

SEQ ID NO: 3909759 - DNA, 21 bp, Homo sapiens
ttcacctgggcgccaactgct

SEQ ID NO: 3909760 - DNA, 23 bp, Homo sapiens
ttcaccttatgtattattttcta

SEQ ID NO: 3909761 - DNA, 19 bp, Homo sapiens
ttcactcactgtcaatgat

SEQ ID NO: 3909762 - DNA, 15 bp, Homo sapiens
ttcactgctggctgc

SEQ ID NO: 3909763 - DNA, 16 bp, Homo sapiens
ttcactgctggctgcc

SEQ ID NO: 3909764 - DNA, 19 bp, Homo sapiens
ttcactgctggctgcctta

SEQ ID NO: 3909765 - DNA, 21 bp, Homo sapiens
ttcactgttgaaaattatttt

SEQ ID NO: 3909766 - DNA, 15 bp, Homo sapiens
ttcactttaaagtct

SEQ ID NO: 3909767 - DNA, 13 bp, Homo sapiens
ttcactttaattc

SEQ ID NO: 3909768 - DNA, 19 bp, Homo sapiens
ttcagaaagcattacattt

SEQ ID NO: 3909769 - DNA, 17 bp, Homo sapiens
ttcagaacatgctggat

SEQ ID NO: 3909770 - DNA, 13 bp, Homo sapiens
ttcagaagaaatt

SEQ ID NO: 3909771 - DNA, 20 bp, Homo sapiens
ttcagaagtttggcaatagt

SEQ ID NO: 3909772 - DNA, 20 bp, Homo sapiens
ttcagacaagcaacaggttt

SEQ ID NO: 3909773 - DNA, 13 bp, Homo sapiens
ttcagaccccagc

SEQ ID NO: 3909774 - DNA, 12 bp, Homo sapiens
ttcagactcaga

SEQ ID NO: 3909775 - DNA, 13 bp, Homo sapiens
ttcagagaatatc

SEQ ID NO: 3909776 - DNA, 20 bp, Homo sapiens
ttcagagagggcagaggggt

SEQ ID NO: 3909777 - DNA, 13 bp, Homo sapiens
ttcagagcctagc

SEQ ID NO: 3909778 - DNA, 19 bp, Homo sapiens
ttcagagcctagccacctc

SEQ ID NO: 3909779 - DNA, 20 bp, Homo sapiens
ttcagagcctagccacctcc

SEQ ID NO: 3909780 - DNA, 13 bp, Homo sapiens
ttcagatcgtatt

SEQ ID NO: 3909781 - DNA, 22 bp, Homo sapiens
ttcagattcccagagcaaaata

SEQ ID NO: 3909782 - DNA, 13 bp, Homo sapiens
ttcagcaactcag

SEQ ID NO: 3909783 - DNA, 14 bp, Homo sapiens
ttcagcacacccca

SEQ ID NO: 3909784 - DNA, 17 bp, Homo sapiens
ttcagcaccctgggtgc

SEQ ID NO: 3909785 - DNA, 15 bp, Homo sapiens
ttcagcactcagaaa

SEQ ID NO: 3909786 - DNA, 16 bp, Homo sapiens
ttcagcattaggcttt

SEQ ID NO: 3909787 - DNA, 19 bp, Homo sapiens
ttcagcattattcctccag

SEQ ID NO: 3909788 - DNA, 11 bp, Homo sapiens
ttcagcccagc

SEQ ID NO: 3909789 - DNA, 18 bp, Homo sapiens
ttcagcccctcctctgcc

SEQ ID NO: 3909790 - DNA, 18 bp, Homo sapiens
ttcagcgagacccttgca

SEQ ID NO: 3909791 - DNA, 16 bp, Homo sapiens
ttcagctctctgtata

SEQ ID NO: 3909792 - DNA, 17 bp, Homo sapiens
ttcagctctctgtataa

SEQ ID NO: 3909793 - DNA, 20 bp, Homo sapiens
ttcagctgtgaacatggact

SEQ ID NO: 3909794 - DNA, 23 bp, Homo sapiens
ttcagctgtgaacatggactctt

SEQ ID NO: 3909795 - DNA, 18 bp, Homo sapiens
ttcaggaaaaggcctggg

SEQ ID NO: 3909796 - DNA, 20 bp, Homo sapiens
ttcaggacatggggcataga

SEQ ID NO: 3909797 - DNA, 21 bp, Homo sapiens
ttcaggacttaacggctccag

SEQ ID NO: 3909798 - DNA, 19 bp, Homo sapiens
ttcaggaggccctggtgtc

SEQ ID NO: 3909799 - DNA, 21 bp, Homo sapiens
ttcaggagggtccccagctgg

SEQ ID NO: 3909800 - DNA, 17 bp, Homo sapiens
ttcaggatactctgtca

SEQ ID NO: 3909801 - DNA, 21 bp, Homo sapiens
ttcaggatactctgtcagatg

SEQ ID NO: 3909802 - DNA, 15 bp, Homo sapiens
ttcaggcattttgtt

SEQ ID NO: 3909803 - DNA, 21 bp, Homo sapiens
ttcagggaaatggagggtggg

SEQ ID NO: 3909804 - DNA, 13 bp, Homo sapiens
ttcagggaagcag

SEQ ID NO: 3909805 - DNA, 18 bp, Homo sapiens
ttcagggaagcaggcaga

SEQ ID NO: 3909806 - DNA, 23 bp, Homo sapiens
ttcagggccagaaggagggcaga

SEQ ID NO: 3909807 - DNA, 14 bp, Homo sapiens
ttcaggtactaaat

SEQ ID NO: 3909808 - DNA, 14 bp, Homo sapiens
ttcaggtaggccct

SEQ ID NO: 3909809 - DNA, 15 bp, Homo sapiens
ttcaggtaggccctt

SEQ ID NO: 3909810 - DNA, 14 bp, Homo sapiens
ttcaggtgaaaatg

SEQ ID NO: 3909811 - DNA, 20 bp, Homo sapiens
ttcaggtttcttaaaaacag

SEQ ID NO: 3909812 - DNA, 15 bp, Homo sapiens
ttcaggttttgtaaa

SEQ ID NO: 3909813 - DNA, 17 bp, Homo sapiens
ttcagtaaataatgaaa

SEQ ID NO: 3909814 - DNA, 17 bp, Homo sapiens
ttcagtattttggagaa

SEQ ID NO: 3909815 - DNA, 18 bp, Homo sapiens
ttcagtattttggagaaa

SEQ ID NO: 3909816 - DNA, 10 bp, Homo sapiens
ttcagtgccc

SEQ ID NO: 3909817 - DNA, 14 bp, Homo sapiens
ttcagtgcccacca

SEQ ID NO: 3909818 - DNA, 16 bp, Homo sapiens
ttcagtggtcctgtca

SEQ ID NO: 3909819 - DNA, 20 bp, Homo sapiens
ttcagtgtatggaaataaat

SEQ ID NO: 3909820 - DNA, 20 bp, Homo sapiens
ttcagttgaattcatgtgaa

SEQ ID NO: 3909821 - DNA, 16 bp, Homo sapiens
ttcagttgatcactgg

SEQ ID NO: 3909822 - DNA, 19 bp, Homo sapiens
ttcagttggctgacttcca

SEQ ID NO: 3909823 - DNA, 15 bp, Homo sapiens
ttcataaagaattgt

SEQ ID NO: 3909824 - DNA, 13 bp, Homo sapiens
ttcataacaatgt

SEQ ID NO: 3909825 - DNA, 16 bp, Homo sapiens
ttcataaggcctgccc

SEQ ID NO: 3909826 - DNA, 15 bp, Homo sapiens
ttcataattagaaca

SEQ ID NO: 3909827 - DNA, 18 bp, Homo sapiens
ttcatatatgaggacttg

SEQ ID NO: 3909828 - DNA, 13 bp, Homo sapiens
ttcatatccagct

SEQ ID NO: 3909829 - DNA, 12 bp, Homo sapiens
ttcatcaattta

SEQ ID NO: 3909830 - DNA, 19 bp, Homo sapiens
ttcatcaatttttatacat

SEQ ID NO: 3909831 - DNA, 20 bp, Homo sapiens
ttcatcaatttttatacata

SEQ ID NO: 3909832 - DNA, 21 bp, Homo sapiens
ttcatcaatttttatacatat

SEQ ID NO: 3909833 - DNA, 20 bp, Homo sapiens
ttcatccagttgcaataaaa

SEQ ID NO: 3909834 - DNA, 22 bp, Homo sapiens
ttcatccagttgcaataaaata

SEQ ID NO: 3909835 - DNA, 23 bp, Homo sapiens
ttcatccagtttgttctccgggt

SEQ ID NO: 3909836 - DNA, 24 bp, Homo sapiens
ttcatcccaaaggacagccgcctg

SEQ ID NO: 3909837 - DNA, 16 bp, Homo sapiens
ttcatcccagccccaa

SEQ ID NO: 3909838 - DNA, 16 bp, Homo sapiens
ttcatcctggcctcct

SEQ ID NO: 3909839 - DNA, 14 bp, Homo sapiens
ttcatctactacag

SEQ ID NO: 3909840 - DNA, 14 bp, Homo sapiens
ttcatctccagtgt

SEQ ID NO: 3909841 - DNA, 17 bp, Homo sapiens
ttcatgaacttggctgt

SEQ ID NO: 3909842 - DNA, 23 bp, Homo sapiens
ttcatgccgtggtaagtaccaca

SEQ ID NO: 3909843 - DNA, 14 bp, Homo sapiens
ttcatgcctcagtt

SEQ ID NO: 3909844 - DNA, 17 bp, Homo sapiens
ttcatgcctcagtttcc

SEQ ID NO: 3909845 - DNA, 18 bp, Homo sapiens
ttcatgctatctctgtgt

SEQ ID NO: 3909846 - DNA, 13 bp, Homo sapiens
ttcatgtaataaa

SEQ ID NO: 3909847 - DNA, 15 bp, Homo sapiens
ttcatgtaataaatc

SEQ ID NO: 3909848 - DNA, 18 bp, Homo sapiens
ttcatgtaataaatctga

SEQ ID NO: 3909849 - DNA, 17 bp, Homo sapiens
ttcatgtttgtaaatta

SEQ ID NO: 3909850 - DNA, 15 bp, Homo sapiens
ttcattaaaagctac

SEQ ID NO: 3909851 - DNA, 20 bp, Homo sapiens
ttcattacaatggaaacaat

SEQ ID NO: 3909852 - DNA, 14 bp, Homo sapiens
ttcattatctcaaa

SEQ ID NO: 3909853 - DNA, 15 bp, Homo sapiens
ttcattctcctgcct

SEQ ID NO: 3909854 - DNA, 16 bp, Homo sapiens
ttcattgctggagaca

SEQ ID NO: 3909855 - DNA, 17 bp, Homo sapiens
ttcatttaaaatgatta

SEQ ID NO: 3909856 - DNA, 16 bp, Homo sapiens
ttcatttcactttaaa

SEQ ID NO: 3909857 - DNA, 15 bp, Homo sapiens
ttcattttaatttat

SEQ ID NO: 3909858 - DNA, 17 bp, Homo sapiens
ttcattttagtgactgt

SEQ ID NO: 3909859 - DNA, 23 bp, Homo sapiens
ttcatttttttcactggagttac

SEQ ID NO: 3909860 - DNA, 16 bp, Homo sapiens
ttccaaacctgacaga

SEQ ID NO: 3909861 - DNA, 11 bp, Homo sapiens
ttccaaagctc

SEQ ID NO: 3909862 - DNA, 23 bp, Homo sapiens
ttccaacagctcaagtcttccct

SEQ ID NO: 3909863 - DNA, 12 bp, Homo sapiens
ttccaaccccag

SEQ ID NO: 3909864 - DNA, 16 bp, Homo sapiens
ttccaaccccagctgg

SEQ ID NO: 3909865 - DNA, 16 bp, Homo sapiens
ttccaaggagttccat

SEQ ID NO: 3909866 - DNA, 23 bp, Homo sapiens
ttccaagggtatgggaagccata

SEQ ID NO: 3909867 - DNA, 20 bp, Homo sapiens
ttccacaaatctatattaaa

SEQ ID NO: 3909868 - DNA, 20 bp, Homo sapiens
ttccacaagattcccagaga

SEQ ID NO: 3909869 - DNA, 19 bp, Homo sapiens
ttccacactgtcagagctg

SEQ ID NO: 3909870 - DNA, 17 bp, Homo sapiens
ttccactggctccacat

SEQ ID NO: 3909871 - DNA, 12 bp, Homo sapiens
ttccagaaaata

SEQ ID NO: 3909872 - DNA, 17 bp, Homo sapiens
ttccagaaaatataaat

SEQ ID NO: 3909873 - DNA, 17 bp, Homo sapiens
ttccagaagatgccctc

SEQ ID NO: 3909874 - DNA, 12 bp, Homo sapiens
ttccagaccacc

SEQ ID NO: 3909875 - DNA, 22 bp, Homo sapiens
ttccagaccacctgccagccat

SEQ ID NO: 3909876 - DNA, 23 bp, Homo sapiens
ttccagactgcttccaattttct

SEQ ID NO: 3909877 - DNA, 20 bp, Homo sapiens
ttccagagagtcctctggat

SEQ ID NO: 3909878 - DNA, 18 bp, Homo sapiens
ttccagagagtggctcct

SEQ ID NO: 3909879 - DNA, 19 bp, Homo sapiens
ttccagagagtggctcctc

SEQ ID NO: 3909880 - DNA, 19 bp, Homo sapiens
ttccagaggctattatttt

SEQ ID NO: 3909881 - DNA, 14 bp, Homo sapiens
ttccagctgcctgg

SEQ ID NO: 3909882 - DNA, 15 bp, Homo sapiens
ttccagctgcctggg

SEQ ID NO: 3909883 - DNA, 11 bp, Homo sapiens
ttccagctggt

SEQ ID NO: 3909884 - DNA, 13 bp, Homo sapiens
ttccaggcccctg

SEQ ID NO: 3909885 - DNA, 23 bp, Homo sapiens
ttccagggcatccgcagcccagg

SEQ ID NO: 3909886 - DNA, 15 bp, Homo sapiens
ttccagtagttgaac

SEQ ID NO: 3909887 - DNA, 14 bp, Homo sapiens
ttccataaccccag

SEQ ID NO: 3909888 - DNA, 22 bp, Homo sapiens
ttccataaccccaggcatccca

SEQ ID NO: 3909889 - DNA, 18 bp, Homo sapiens
ttccataggaatcatgtt

SEQ ID NO: 3909890 - DNA, 22 bp, Homo sapiens
ttccatcacccgtacaggcaat

SEQ ID NO: 3909891 - DNA, 13 bp, Homo sapiens
ttccatgcctgag

SEQ ID NO: 3909892 - DNA, 20 bp, Homo sapiens
ttccatgtcgcctctgcatt

SEQ ID NO: 3909893 - DNA, 20 bp, Homo sapiens
ttcccaaactacagaataat

SEQ ID NO: 3909894 - DNA, 20 bp, Homo sapiens
ttcccaaattccctggacct

SEQ ID NO: 3909895 - DNA, 20 bp, Homo sapiens
ttcccaagagcatcatgcct

SEQ ID NO: 3909896 - DNA, 22 bp, Homo sapiens
ttcccaagagcatcatgcctct

SEQ ID NO: 3909897 - DNA, 12 bp, Homo sapiens
ttcccaataaaa

SEQ ID NO: 3909898 - DNA, 15 bp, Homo sapiens
ttcccaatcagcact

SEQ ID NO: 3909899 - DNA, 17 bp, Homo sapiens
ttcccaccgccctccct

SEQ ID NO: 3909900 - DNA, 22 bp, Homo sapiens
ttcccaccgccctccctcccca

SEQ ID NO: 3909901 - DNA, 19 bp, Homo sapiens
ttcccactaagctttctcc

SEQ ID NO: 3909902 - DNA, 21 bp, Homo sapiens
ttcccagagtgtgaaacttcc

SEQ ID NO: 3909903 - DNA, 21 bp, Homo sapiens
ttcccagcattcagtggtcct

SEQ ID NO: 3909904 - DNA, 20 bp, Homo sapiens
ttcccagctctccctctggc

SEQ ID NO: 3909905 - DNA, 23 bp, Homo sapiens
ttcccagctctccctctggccct

SEQ ID NO: 3909906 - DNA, 13 bp, Homo sapiens
ttcccatccccag

SEQ ID NO: 3909907 - DNA, 15 bp, Homo sapiens
ttcccatccccagcg

SEQ ID NO: 3909908 - DNA, 11 bp, Homo sapiens
ttcccatctgc

SEQ ID NO: 3909909 - DNA, 17 bp, Homo sapiens
ttcccatgctgaattat

SEQ ID NO: 3909910 - DNA, 23 bp, Homo sapiens
ttcccattactttaatactcacc

SEQ ID NO: 3909911 - DNA, 20 bp, Homo sapiens
ttcccattgcatcacctctg

SEQ ID NO: 3909912 - DNA, 13 bp, Homo sapiens
ttcccattttgga

SEQ ID NO: 3909913 - DNA, 16 bp, Homo sapiens
ttccccacctcttcct

SEQ ID NO: 3909914 - DNA, 17 bp, Homo sapiens
ttccccagactcagctc

SEQ ID NO: 3909915 - DNA, 18 bp, Homo sapiens
ttccccatctccatttca

SEQ ID NO: 3909916 - DNA, 15 bp, Homo sapiens
ttccccatctgggtc

SEQ ID NO: 3909917 - DNA, 11 bp, Homo sapiens
ttccccatggg

SEQ ID NO: 3909918 - DNA, 22 bp, Homo sapiens
ttcccccttactacttcttgga

SEQ ID NO: 3909919 - DNA, 16 bp, Homo sapiens
ttccccggtcccttga

SEQ ID NO: 3909920 - DNA, 17 bp, Homo sapiens
ttccccggtcccttgag

SEQ ID NO: 3909921 - DNA, 16 bp, Homo sapiens
ttcccctcagagctct

SEQ ID NO: 3909922 - DNA, 18 bp, Homo sapiens
ttcccctctgtgtcctct

SEQ ID NO: 3909923 - DNA, 14 bp, Homo sapiens
ttccccttggcttc

SEQ ID NO: 3909924 - DNA, 17 bp, Homo sapiens
ttcccctttccccactc

SEQ ID NO: 3909925 - DNA, 17 bp, Homo sapiens
ttccccttttgcctggc

SEQ ID NO: 3909926 - DNA, 23 bp, Homo sapiens
ttcccgagcaaagtctaaagttt

SEQ ID NO: 3909927 - DNA, 22 bp, Homo sapiens
ttcccgccaggaggtcctcctc

SEQ ID NO: 3909928 - DNA, 12 bp, Homo sapiens
ttcccgctcagc

SEQ ID NO: 3909929 - DNA, 15 bp, Homo sapiens
ttcccgctcagccct

SEQ ID NO: 3909930 - DNA, 16 bp, Homo sapiens
ttcccgctcagccctc

SEQ ID NO: 3909931 - DNA, 21 bp, Homo sapiens
ttcccggactgcaagcagggc

SEQ ID NO: 3909932 - DNA, 18 bp, Homo sapiens
ttcccggagcacagccct

SEQ ID NO: 3909933 - DNA, 23 bp, Homo sapiens
ttcccggagcacagccctgggag

SEQ ID NO: 3909934 - DNA, 22 bp, Homo sapiens
ttcccgtggtctccttgcactt

SEQ ID NO: 3909935 - DNA, 15 bp, Homo sapiens
ttccctaactctcgg

SEQ ID NO: 3909936 - DNA, 13 bp, Homo sapiens
ttccctacttcct

SEQ ID NO: 3909937 - DNA, 17 bp, Homo sapiens
ttccctacttcctgtga

SEQ ID NO: 3909938 - DNA, 15 bp, Homo sapiens
ttccctatcaaaaca

SEQ ID NO: 3909939 - DNA, 16 bp, Homo sapiens
ttccctatcaaaacat

SEQ ID NO: 3909940 - DNA, 13 bp, Homo sapiens
ttccctccttccc

SEQ ID NO: 3909941 - DNA, 14 bp, Homo sapiens
ttccctccttccct

SEQ ID NO: 3909942 - DNA, 19 bp, Homo sapiens
ttccctccttcccttctct

SEQ ID NO: 3909943 - DNA, 14 bp, Homo sapiens
ttccctctcccagg

SEQ ID NO: 3909944 - DNA, 16 bp, Homo sapiens
ttccctctcccaggcc

SEQ ID NO: 3909945 - DNA, 17 bp, Homo sapiens
ttccctctttccccacc

SEQ ID NO: 3909946 - DNA, 19 bp, Homo sapiens
ttccctgaaaacccagaga

SEQ ID NO: 3909947 - DNA, 11 bp, Homo sapiens
ttccctgcacc

SEQ ID NO: 3909948 - DNA, 12 bp, Homo sapiens
ttccctgctttg

SEQ ID NO: 3909949 - DNA, 12 bp, Homo sapiens
ttccctgggaac

SEQ ID NO: 3909950 - DNA, 23 bp, Homo sapiens
ttccctgggggcagatatttccc

SEQ ID NO: 3909951 - DNA, 11 bp, Homo sapiens
ttccctgtgct

SEQ ID NO: 3909952 - DNA, 16 bp, Homo sapiens
ttccctgttttaaatt

SEQ ID NO: 3909953 - DNA, 14 bp, Homo sapiens
ttcccttctatgca

SEQ ID NO: 3909954 - DNA, 15 bp, Homo sapiens
ttcccttctatgcag

SEQ ID NO: 3909955 - DNA, 22 bp, Homo sapiens
ttcccttctctccttccctctt

SEQ ID NO: 3909956 - DNA, 17 bp, Homo sapiens
ttcccttggatgtagtc

SEQ ID NO: 3909957 - DNA, 15 bp, Homo sapiens
ttccgctcctttacc

SEQ ID NO: 3909958 - DNA, 16 bp, Homo sapiens
ttccgctcctttacct

SEQ ID NO: 3909959 - DNA, 22 bp, Homo sapiens
ttccgctgtcgccccaggccct

SEQ ID NO: 3909960 - DNA, 19 bp, Homo sapiens
ttcctaaaaataagcttta

SEQ ID NO: 3909961 - DNA, 19 bp, Homo sapiens
ttcctaagaagtccccagg

SEQ ID NO: 3909962 - DNA, 15 bp, Homo sapiens
ttcctacaaaatgga

SEQ ID NO: 3909963 - DNA, 20 bp, Homo sapiens
ttcctagactaattaaaatc

SEQ ID NO: 3909964 - DNA, 22 bp, Homo sapiens
ttcctatatagtttattgacaa

SEQ ID NO: 3909965 - DNA, 22 bp, Homo sapiens
ttcctatctgtatgtctgccta

SEQ ID NO: 3909966 - DNA, 15 bp, Homo sapiens
ttcctatttcttata

SEQ ID NO: 3909967 - DNA, 16 bp, Homo sapiens
ttcctattttaaaacc

SEQ ID NO: 3909968 - DNA, 21 bp, Homo sapiens
ttcctattttaaaaccatgca

SEQ ID NO: 3909969 - DNA, 17 bp, Homo sapiens
ttcctattttcagccca

SEQ ID NO: 3909970 - DNA, 13 bp, Homo sapiens
ttcctcagctgcc

SEQ ID NO: 3909971 - DNA, 19 bp, Homo sapiens
ttcctcatctgcagaatgg

SEQ ID NO: 3909972 - DNA, 18 bp, Homo sapiens
ttcctccaaactcctgcc

SEQ ID NO: 3909973 - DNA, 19 bp, Homo sapiens
ttcctccccaccttcccca

SEQ ID NO: 3909974 - DNA, 23 bp, Homo sapiens
ttcctccccaccttccccagact

SEQ ID NO: 3909975 - DNA, 20 bp, Homo sapiens
ttcctccgtccacccaggct

SEQ ID NO: 3909976 - DNA, 19 bp, Homo sapiens
ttcctcctccacagtgctg

SEQ ID NO: 3909977 - DNA, 21 bp, Homo sapiens
ttcctcctccacagtgctgct

SEQ ID NO: 3909978 - DNA, 16 bp, Homo sapiens
ttcctcctgaagcctc

SEQ ID NO: 3909979 - DNA, 18 bp, Homo sapiens
ttcctcctgaagcctctg

SEQ ID NO: 3909980 - DNA, 13 bp, Homo sapiens
ttcctcctgtgta

SEQ ID NO: 3909981 - DNA, 14 bp, Homo sapiens
ttcctcgccctggg

SEQ ID NO: 3909982 - DNA, 16 bp, Homo sapiens
ttcctctccactgcct

SEQ ID NO: 3909983 - DNA, 18 bp, Homo sapiens
ttcctctccactgccttc

SEQ ID NO: 3909984 - DNA, 21 bp, Homo sapiens
ttcctctgtttctccttctga

SEQ ID NO: 3909985 - DNA, 18 bp, Homo sapiens
ttcctcttgcctctctca

SEQ ID NO: 3909986 - DNA, 12 bp, Homo sapiens
ttcctctttgca

SEQ ID NO: 3909987 - DNA, 15 bp, Homo sapiens
ttcctctttgcatgg

SEQ ID NO: 3909988 - DNA, 17 bp, Homo sapiens
ttcctctttgcatggaa

SEQ ID NO: 3909989 - DNA, 13 bp, Homo sapiens
ttcctgaagccag

SEQ ID NO: 3909990 - DNA, 15 bp, Homo sapiens
ttcctgaccctccct

SEQ ID NO: 3909991 - DNA, 17 bp, Homo sapiens
ttcctgatgtgccagaa

SEQ ID NO: 3909992 - DNA, 15 bp, Homo sapiens
ttcctgcaaagggaa

SEQ ID NO: 3909993 - DNA, 11 bp, Homo sapiens
ttcctgcactc

SEQ ID NO: 3909994 - DNA, 14 bp, Homo sapiens
ttcctgcactccag

SEQ ID NO: 3909995 - DNA, 15 bp, Homo sapiens
ttcctgcatttgtga

SEQ ID NO: 3909996 - DNA, 20 bp, Homo sapiens
ttcctggacagctgtgcctc

SEQ ID NO: 3909997 - DNA, 10 bp, Homo sapiens
ttcctggcct

SEQ ID NO: 3909998 - DNA, 14 bp, Homo sapiens
ttcctggcttctta

SEQ ID NO: 3909999 - DNA, 11 bp, Homo sapiens
ttcctgggcct

SEQ ID NO: 3910000 - DNA, 15 bp, Homo sapiens
ttcctggggccccgc

SEQ ID NO: 3910001 - DNA, 20 bp, Homo sapiens
ttcctggggtggattcctaa

SEQ ID NO: 3910002 - DNA, 16 bp, Homo sapiens
ttcctgggtggctact

SEQ ID NO: 3910003 - DNA, 17 bp, Homo sapiens
ttcctgggtggctactc

SEQ ID NO: 3910004 - DNA, 22 bp, Homo sapiens
ttcctgggtggctactctgtgc

SEQ ID NO: 3910005 - DNA, 19 bp, Homo sapiens
ttcctggtgaggcccagcc

SEQ ID NO: 3910006 - DNA, 21 bp, Homo sapiens
ttcctgtaacacaagccacag

SEQ ID NO: 3910007 - DNA, 20 bp, Homo sapiens
ttcctgtatttgttcccaag

SEQ ID NO: 3910008 - DNA, 21 bp, Homo sapiens
ttcctgtatttgttcccaaga

SEQ ID NO: 3910009 - DNA, 14 bp, Homo sapiens
ttcctgtcccacct

SEQ ID NO: 3910010 - DNA, 17 bp, Homo sapiens
ttcctgtgggccaggag

SEQ ID NO: 3910011 - DNA, 23 bp, Homo sapiens
ttcctgtgggccaggagctcagc

SEQ ID NO: 3910012 - DNA, 23 bp, Homo sapiens
ttcctgttcaccttatgtattat

SEQ ID NO: 3910013 - DNA, 15 bp, Homo sapiens
ttccttcagcttcca

SEQ ID NO: 3910014 - DNA, 13 bp, Homo sapiens
ttccttcccactc

SEQ ID NO: 3910015 - DNA, 13 bp, Homo sapiens
ttccttccctggc

SEQ ID NO: 3910016 - DNA, 14 bp, Homo sapiens
ttccttccctggct

SEQ ID NO: 3910017 - DNA, 19 bp, Homo sapiens
ttccttccgctcctttacc

SEQ ID NO: 3910018 - DNA, 14 bp, Homo sapiens
ttccttccttccct

SEQ ID NO: 3910019 - DNA, 15 bp, Homo sapiens
ttccttctgcaccca

SEQ ID NO: 3910020 - DNA, 18 bp, Homo sapiens
ttccttctttctcttccc

SEQ ID NO: 3910021 - DNA, 17 bp, Homo sapiens
ttccttggactcatttt

SEQ ID NO: 3910022 - DNA, 20 bp, Homo sapiens
ttccttggactcattttaaa

SEQ ID NO: 3910023 - DNA, 13 bp, Homo sapiens
ttccttgtcacca

SEQ ID NO: 3910024 - DNA, 16 bp, Homo sapiens
ttccttgtcaccagca

SEQ ID NO: 3910025 - DNA, 15 bp, Homo sapiens
ttccttgtctctcat

SEQ ID NO: 3910026 - DNA, 14 bp, Homo sapiens
ttcctttatattta

SEQ ID NO: 3910027 - DNA, 11 bp, Homo sapiens
ttcctttcctc

SEQ ID NO: 3910028 - DNA, 21 bp, Homo sapiens
ttcctttcctctgcagcactt

SEQ ID NO: 3910029 - DNA, 16 bp, Homo sapiens
ttcctttggaagaaaa

SEQ ID NO: 3910030 - DNA, 15 bp, Homo sapiens
ttccttttgatgggg

SEQ ID NO: 3910031 - DNA, 20 bp, Homo sapiens
ttccttttgatggggagaaa

SEQ ID NO: 3910032 - DNA, 15 bp, Homo sapiens
ttcgaggtgtcaccc

SEQ ID NO: 3910033 - DNA, 16 bp, Homo sapiens
ttcgaggtgtcaccct

SEQ ID NO: 3910034 - DNA, 18 bp, Homo sapiens
ttcgcagccaccctgagg

SEQ ID NO: 3910035 - DNA, 17 bp, Homo sapiens
ttcgcctgtgggaagag

SEQ ID NO: 3910036 - DNA, 14 bp, Homo sapiens
ttcgctgccaggac

SEQ ID NO: 3910037 - DNA, 17 bp, Homo sapiens
ttcgctgccaggacacc

SEQ ID NO: 3910038 - DNA, 23 bp, Homo sapiens
ttcgctgccaggacacctgcccc

SEQ ID NO: 3910039 - DNA, 17 bp, Homo sapiens
ttcgcttgcttctgcag

SEQ ID NO: 3910040 - DNA, 17 bp, Homo sapiens
ttcggggaactcctgga

SEQ ID NO: 3910041 - DNA, 17 bp, Homo sapiens
ttcggggctgggaagtc

SEQ ID NO: 3910042 - DNA, 18 bp, Homo sapiens
ttcgggggaataaagaca

SEQ ID NO: 3910043 - DNA, 16 bp, Homo sapiens
ttcggtgggacagccc

SEQ ID NO: 3910044 - DNA, 16 bp, Homo sapiens
ttcggtttctgagcat

SEQ ID NO: 3910045 - DNA, 12 bp, Homo sapiens
ttcgtctgtccc

SEQ ID NO: 3910046 - DNA, 13 bp, Homo sapiens
ttcgtctgtccca

SEQ ID NO: 3910047 - DNA, 18 bp, Homo sapiens
ttcgtctgtcccagagct

SEQ ID NO: 3910048 - DNA, 13 bp, Homo sapiens
ttcgtggctgcaa

SEQ ID NO: 3910049 - DNA, 19 bp, Homo sapiens
ttctaaaatataatcaacc

SEQ ID NO: 3910050 - DNA, 16 bp, Homo sapiens
ttctaaagctttctga

SEQ ID NO: 3910051 - DNA, 14 bp, Homo sapiens
ttctaaatgaagtg

SEQ ID NO: 3910052 - DNA, 18 bp, Homo sapiens
ttctaaatgctggtctag

SEQ ID NO: 3910053 - DNA, 15 bp, Homo sapiens
ttctaactgtaaatc

SEQ ID NO: 3910054 - DNA, 16 bp, Homo sapiens
ttctaactgtaaatca

SEQ ID NO: 3910055 - DNA, 21 bp, Homo sapiens
ttctaactgtaaatcacttgt

SEQ ID NO: 3910056 - DNA, 19 bp, Homo sapiens
ttctaagtaaaaccacagc

SEQ ID NO: 3910057 - DNA, 20 bp, Homo sapiens
ttctaagtaaaaccacagca

SEQ ID NO: 3910058 - DNA, 22 bp, Homo sapiens
ttctaatatatttttatattta

SEQ ID NO: 3910059 - DNA, 18 bp, Homo sapiens
ttctacaaccagagcccc

SEQ ID NO: 3910060 - DNA, 23 bp, Homo sapiens
ttctacaaccagagccccccaca

SEQ ID NO: 3910061 - DNA, 18 bp, Homo sapiens
ttctacaagcatatttga

SEQ ID NO: 3910062 - DNA, 22 bp, Homo sapiens
ttctacacagtaaaaacttgta

SEQ ID NO: 3910063 - DNA, 18 bp, Homo sapiens
ttctaccatttcagagag

SEQ ID NO: 3910064 - DNA, 21 bp, Homo sapiens
ttctacctgtgttcattctta

SEQ ID NO: 3910065 - DNA, 22 bp, Homo sapiens
ttctacgtataaatatgaaatg

SEQ ID NO: 3910066 - DNA, 13 bp, Homo sapiens
ttctactgtgact

SEQ ID NO: 3910067 - DNA, 14 bp, Homo sapiens
ttctagagaagagg

SEQ ID NO: 3910068 - DNA, 22 bp, Homo sapiens
ttctagagaagaggctggtgct

SEQ ID NO: 3910069 - DNA, 17 bp, Homo sapiens
ttctagctagaaatatg

SEQ ID NO: 3910070 - DNA, 22 bp, Homo sapiens
ttctaggaaacccaaggaacaa

SEQ ID NO: 3910071 - DNA, 17 bp, Homo sapiens
ttctaggtcctggcttc

SEQ ID NO: 3910072 - DNA, 22 bp, Homo sapiens
ttctagtctcctttgcactgag

SEQ ID NO: 3910073 - DNA, 17 bp, Homo sapiens
ttctagtgatttcctgt

SEQ ID NO: 3910074 - DNA, 20 bp, Homo sapiens
ttctagtgatttcctgtata

SEQ ID NO: 3910075 - DNA, 20 bp, Homo sapiens
ttctattctctcctcagact

SEQ ID NO: 3910076 - DNA, 16 bp, Homo sapiens
ttctatttaaaaaata

SEQ ID NO: 3910077 - DNA, 13 bp, Homo sapiens
ttctattttgtaa

SEQ ID NO: 3910078 - DNA, 16 bp, Homo sapiens
ttctattttgtaaact

SEQ ID NO: 3910079 - DNA, 18 bp, Homo sapiens
ttctcaaatgctaaatgc

SEQ ID NO: 3910080 - DNA, 19 bp, Homo sapiens
ttctcaatcactgctcccc

SEQ ID NO: 3910081 - DNA, 23 bp, Homo sapiens
ttctcaattattggcctgctaat

SEQ ID NO: 3910082 - DNA, 12 bp, Homo sapiens
ttctcaccagga

SEQ ID NO: 3910083 - DNA, 13 bp, Homo sapiens
ttctcagaacagc

SEQ ID NO: 3910084 - DNA, 17 bp, Homo sapiens
ttctcagggggtcagca

SEQ ID NO: 3910085 - DNA, 16 bp, Homo sapiens
ttctcatcatattgta

SEQ ID NO: 3910086 - DNA, 23 bp, Homo sapiens
ttctcatcatattgtatgtaagt

SEQ ID NO: 3910087 - DNA, 17 bp, Homo sapiens
ttctcatgatttacaga

SEQ ID NO: 3910088 - DNA, 14 bp, Homo sapiens
ttctcatgtctcag

SEQ ID NO: 3910089 - DNA, 17 bp, Homo sapiens
ttctccagcccacaccc

SEQ ID NO: 3910090 - DNA, 21 bp, Homo sapiens
ttctccagcccacacccctcc

SEQ ID NO: 3910091 - DNA, 22 bp, Homo sapiens
ttctccagcccacacccctcca

SEQ ID NO: 3910092 - DNA, 20 bp, Homo sapiens
ttctcccccgacactgctgc

SEQ ID NO: 3910093 - DNA, 12 bp, Homo sapiens
ttctccctcacc

SEQ ID NO: 3910094 - DNA, 21 bp, Homo sapiens
ttctccctcacccccaggtgt

SEQ ID NO: 3910095 - DNA, 16 bp, Homo sapiens
ttctccggggtctgtg

SEQ ID NO: 3910096 - DNA, 19 bp, Homo sapiens
ttctccggggtctgtgctg

SEQ ID NO: 3910097 - DNA, 20 bp, Homo sapiens
ttctccggggtctgtgctgt

SEQ ID NO: 3910098 - DNA, 23 bp, Homo sapiens
ttctccggggtctgtgctgtgcc

SEQ ID NO: 3910099 - DNA, 20 bp, Homo sapiens
ttctctacagacttctccag

SEQ ID NO: 3910100 - DNA, 17 bp, Homo sapiens
ttctctccttccctctt

SEQ ID NO: 3910101 - DNA, 18 bp, Homo sapiens
ttctctccttcttccctg

SEQ ID NO: 3910102 - DNA, 12 bp, Homo sapiens
ttctctggctcc

SEQ ID NO: 3910103 - DNA, 23 bp, Homo sapiens
ttctctgggtaggtgttgaaaat

SEQ ID NO: 3910104 - DNA, 18 bp, Homo sapiens
ttctgaagtctactttgt

SEQ ID NO: 3910105 - DNA, 17 bp, Homo sapiens
ttctgaataacatttgt

SEQ ID NO: 3910106 - DNA, 21 bp, Homo sapiens
ttctgacccaagaggtgggga

SEQ ID NO: 3910107 - DNA, 20 bp, Homo sapiens
ttctgacttctcccatctag

SEQ ID NO: 3910108 - DNA, 21 bp, Homo sapiens
ttctgagaaagactattcaaa

SEQ ID NO: 3910109 - DNA, 20 bp, Homo sapiens
ttctgagcttttcatggaag

SEQ ID NO: 3910110 - DNA, 14 bp, Homo sapiens
ttctgagtgttttt

SEQ ID NO: 3910111 - DNA, 19 bp, Homo sapiens
ttctgagtttcattctcct

SEQ ID NO: 3910112 - DNA, 18 bp, Homo sapiens
ttctgatgggtcccaaaa

SEQ ID NO: 3910113 - DNA, 18 bp, Homo sapiens
ttctgatttttttgttgt

SEQ ID NO: 3910114 - DNA, 13 bp, Homo sapiens
ttctgcacccaga

SEQ ID NO: 3910115 - DNA, 12 bp, Homo sapiens
ttctgcactgaa

SEQ ID NO: 3910116 - DNA, 14 bp, Homo sapiens
ttctgcactgaaaa

SEQ ID NO: 3910117 - DNA, 20 bp, Homo sapiens
ttctgcagtagtctctgtgc

SEQ ID NO: 3910118 - DNA, 21 bp, Homo sapiens
ttctgcagtagtctctgtgct

SEQ ID NO: 3910119 - DNA, 23 bp, Homo sapiens
ttctgcatcagctgctgaaacaa

SEQ ID NO: 3910120 - DNA, 23 bp, Homo sapiens
ttctgcattttattctggatgga

SEQ ID NO: 3910121 - DNA, 16 bp, Homo sapiens
ttctgccccagcttta

SEQ ID NO: 3910122 - DNA, 11 bp, Homo sapiens
ttctgctcctc

SEQ ID NO: 3910123 - DNA, 14 bp, Homo sapiens
ttctgctcctctcc

SEQ ID NO: 3910124 - DNA, 16 bp, Homo sapiens
ttctgctcctctccag

SEQ ID NO: 3910125 - DNA, 21 bp, Homo sapiens
ttctgctcttccaaagctcct

SEQ ID NO: 3910126 - DNA, 12 bp, Homo sapiens
ttctgctggcct

SEQ ID NO: 3910127 - DNA, 13 bp, Homo sapiens
ttctgctggcctg

SEQ ID NO: 3910128 - DNA, 15 bp, Homo sapiens
ttctgctggcctgga

SEQ ID NO: 3910129 - DNA, 10 bp, Homo sapiens
ttctggaaat

SEQ ID NO: 3910130 - DNA, 19 bp, Homo sapiens
ttctggaaattttgtccat

SEQ ID NO: 3910131 - DNA, 22 bp, Homo sapiens
ttctggaccagatcctactctt

SEQ ID NO: 3910132 - DNA, 21 bp, Homo sapiens
ttctggattttcccctgaaga

SEQ ID NO: 3910133 - DNA, 17 bp, Homo sapiens
ttctggctcctccttcc

SEQ ID NO: 3910134 - DNA, 21 bp, Homo sapiens
ttctggtatgaacttgaggac

SEQ ID NO: 3910135 - DNA, 22 bp, Homo sapiens
ttctggtatgaacttgaggaca

SEQ ID NO: 3910136 - DNA, 18 bp, Homo sapiens
ttctggtcttcactgcca

SEQ ID NO: 3910137 - DNA, 19 bp, Homo sapiens
ttctgtaaactcaaaactt

SEQ ID NO: 3910138 - DNA, 12 bp, Homo sapiens
ttctgtccagga

SEQ ID NO: 3910139 - DNA, 13 bp, Homo sapiens
ttctgtctctctt

SEQ ID NO: 3910140 - DNA, 19 bp, Homo sapiens
ttctgtgggcttggccttg

SEQ ID NO: 3910141 - DNA, 22 bp, Homo sapiens
ttctgtgtcacagttcttggtg

SEQ ID NO: 3910142 - DNA, 15 bp, Homo sapiens
ttctgttctgttgat

SEQ ID NO: 3910143 - DNA, 24 bp, Homo sapiens
ttctgttgatcccacttcactgtg

SEQ ID NO: 3910144 - DNA, 13 bp, Homo sapiens
ttctgttgcccag

SEQ ID NO: 3910145 - DNA, 17 bp, Homo sapiens
ttctgttgcccaggctg

SEQ ID NO: 3910146 - DNA, 18 bp, Homo sapiens
ttcttaaaaacagctgta

SEQ ID NO: 3910147 - DNA, 14 bp, Homo sapiens
ttcttaaaggcctg

SEQ ID NO: 3910148 - DNA, 16 bp, Homo sapiens
ttcttaaaggcctgga

SEQ ID NO: 3910149 - DNA, 19 bp, Homo sapiens
ttcttaagatttctcctga

SEQ ID NO: 3910150 - DNA, 22 bp, Homo sapiens
ttcttaaggattgtgatatttt

SEQ ID NO: 3910151 - DNA, 13 bp, Homo sapiens
ttcttacagactg

SEQ ID NO: 3910152 - DNA, 18 bp, Homo sapiens
ttcttaccgagaaaagga

SEQ ID NO: 3910153 - DNA, 16 bp, Homo sapiens
ttcttatcttctgcaa

SEQ ID NO: 3910154 - DNA, 20 bp, Homo sapiens
ttcttcaagcacctgcagat

SEQ ID NO: 3910155 - DNA, 14 bp, Homo sapiens
ttcttcacccagct

SEQ ID NO: 3910156 - DNA, 17 bp, Homo sapiens
ttcttcagatcagtgct

SEQ ID NO: 3910157 - DNA, 14 bp, Homo sapiens
ttcttcagccacct

SEQ ID NO: 3910158 - DNA, 13 bp, Homo sapiens
ttcttcctctgct

SEQ ID NO: 3910159 - DNA, 22 bp, Homo sapiens
ttcttccttaattcactcccac

SEQ ID NO: 3910160 - DNA, 23 bp, Homo sapiens
ttcttcgaggtggatcacagagg

SEQ ID NO: 3910161 - DNA, 14 bp, Homo sapiens
ttcttcgctgctct

SEQ ID NO: 3910162 - DNA, 20 bp, Homo sapiens
ttcttcgctgctctagctgg

SEQ ID NO: 3910163 - DNA, 17 bp, Homo sapiens
ttcttctaaaattgaag

SEQ ID NO: 3910164 - DNA, 17 bp, Homo sapiens
ttcttctacaaccagag

SEQ ID NO: 3910165 - DNA, 15 bp, Homo sapiens
ttcttcttcagaaga

SEQ ID NO: 3910166 - DNA, 16 bp, Homo sapiens
ttcttggaaaaaaatt

SEQ ID NO: 3910167 - DNA, 19 bp, Homo sapiens
ttcttggcttctgggacct

SEQ ID NO: 3910168 - DNA, 17 bp, Homo sapiens
ttcttggggtcccaggg

SEQ ID NO: 3910169 - DNA, 18 bp, Homo sapiens
ttcttggtgactgtccca

SEQ ID NO: 3910170 - DNA, 19 bp, Homo sapiens
ttcttgtctgattggctca

SEQ ID NO: 3910171 - DNA, 23 bp, Homo sapiens
ttcttgtgcatgtttactttatt

SEQ ID NO: 3910172 - DNA, 15 bp, Homo sapiens
ttcttgtgcctcagc

SEQ ID NO: 3910173 - DNA, 15 bp, Homo sapiens
ttcttgttgttctgt

SEQ ID NO: 3910174 - DNA, 14 bp, Homo sapiens
ttctttaaatcaaa

SEQ ID NO: 3910175 - DNA, 16 bp, Homo sapiens
ttctttaaatcaaaag

SEQ ID NO: 3910176 - DNA, 14 bp, Homo sapiens
ttctttataaactt

SEQ ID NO: 3910177 - DNA, 23 bp, Homo sapiens
ttctttctcttccctccttccct

SEQ ID NO: 3910178 - DNA, 12 bp, Homo sapiens
ttctttctgaga

SEQ ID NO: 3910179 - DNA, 15 bp, Homo sapiens
ttctttcttcctctg

SEQ ID NO: 3910180 - DNA, 11 bp, Homo sapiens
ttctttgaatg

SEQ ID NO: 3910181 - DNA, 21 bp, Homo sapiens
ttcttttaaaggggcagaaaa

SEQ ID NO: 3910182 - DNA, 21 bp, Homo sapiens
ttcttttgcccttcacagtgt

SEQ ID NO: 3910183 - DNA, 14 bp, Homo sapiens
ttctttttttgtga

SEQ ID NO: 3910184 - DNA, 18 bp, Homo sapiens
ttgaaaacataatctgca

SEQ ID NO: 3910185 - DNA, 18 bp, Homo sapiens
ttgaaaagactccaaaga

SEQ ID NO: 3910186 - DNA, 15 bp, Homo sapiens
ttgaaaattatttta

SEQ ID NO: 3910187 - DNA, 20 bp, Homo sapiens
ttgaaaattattttaaacaa

SEQ ID NO: 3910188 - DNA, 22 bp, Homo sapiens
ttgaaaattattttaaacaaaa

SEQ ID NO: 3910189 - DNA, 22 bp, Homo sapiens
ttgaaactgtaaatatgtttgt

SEQ ID NO: 3910190 - DNA, 19 bp, Homo sapiens
ttgaaatataatgcaaacc

SEQ ID NO: 3910191 - DNA, 23 bp, Homo sapiens
ttgaaattatgtatgtttacata

SEQ ID NO: 3910192 - DNA, 15 bp, Homo sapiens
ttgaacccctgtgtc

SEQ ID NO: 3910193 - DNA, 22 bp, Homo sapiens
ttgaactgagccaaacacactg

SEQ ID NO: 3910194 - DNA, 18 bp, Homo sapiens
ttgaagtggccagatgag

SEQ ID NO: 3910195 - DNA, 21 bp, Homo sapiens
ttgaagttcatggtgatcagt

SEQ ID NO: 3910196 - DNA, 19 bp, Homo sapiens
ttgaatacccccagagacc

SEQ ID NO: 3910197 - DNA, 20 bp, Homo sapiens
ttgaatgctttttgaatgtt

SEQ ID NO: 3910198 - DNA, 15 bp, Homo sapiens
ttgaatggtgcagaa

SEQ ID NO: 3910199 - DNA, 16 bp, Homo sapiens
ttgacaacattttatt

SEQ ID NO: 3910200 - DNA, 14 bp, Homo sapiens
ttgacagtatattt

SEQ ID NO: 3910201 - DNA, 15 bp, Homo sapiens
ttgacagtatatttg

SEQ ID NO: 3910202 - DNA, 19 bp, Homo sapiens
ttgacagtgttgaaaatgt

SEQ ID NO: 3910203 - DNA, 21 bp, Homo sapiens
ttgaccagacctagacctggg

SEQ ID NO: 3910204 - DNA, 15 bp, Homo sapiens
ttgacctcagctgca

SEQ ID NO: 3910205 - DNA, 18 bp, Homo sapiens
ttgacctcagctgcacat

SEQ ID NO: 3910206 - DNA, 15 bp, Homo sapiens
ttgacgccaccataa

SEQ ID NO: 3910207 - DNA, 15 bp, Homo sapiens
ttgacggatgattgg

SEQ ID NO: 3910208 - DNA, 19 bp, Homo sapiens
ttgacgggaggcctcagtt

SEQ ID NO: 3910209 - DNA, 13 bp, Homo sapiens
ttgactatcacat

SEQ ID NO: 3910210 - DNA, 14 bp, Homo sapiens
ttgactatcacata

SEQ ID NO: 3910211 - DNA, 23 bp, Homo sapiens
ttgactgggtttctctgtatagt

SEQ ID NO: 3910212 - DNA, 13 bp, Homo sapiens
ttgactttcaggt

SEQ ID NO: 3910213 - DNA, 15 bp, Homo sapiens
ttgactttcaggtac

SEQ ID NO: 3910214 - DNA, 12 bp, Homo sapiens
ttgagaaagaaa

SEQ ID NO: 3910215 - DNA, 13 bp, Homo sapiens
ttgagaattattc

SEQ ID NO: 3910216 - DNA, 14 bp, Homo sapiens
ttgagacaagccct

SEQ ID NO: 3910217 - DNA, 20 bp, Homo sapiens
ttgagacaagccctggcaac

SEQ ID NO: 3910218 - DNA, 14 bp, Homo sapiens
ttgagacctcagcc

SEQ ID NO: 3910219 - DNA, 18 bp, Homo sapiens
ttgagcaattcatttcac

SEQ ID NO: 3910220 - DNA, 19 bp, Homo sapiens
ttgagcaattcatttcact

SEQ ID NO: 3910221 - DNA, 22 bp, Homo sapiens
ttgagcaattcatttcacttta

SEQ ID NO: 3910222 - DNA, 22 bp, Homo sapiens
ttgagcatgcacagctgcttgt

SEQ ID NO: 3910223 - DNA, 11 bp, Homo sapiens
ttgagcccagg

SEQ ID NO: 3910224 - DNA, 22 bp, Homo sapiens
ttgagctgtatatatatatgtg

SEQ ID NO: 3910225 - DNA, 15 bp, Homo sapiens
ttgaggacaaagaga

SEQ ID NO: 3910226 - DNA, 14 bp, Homo sapiens
ttgaggacacatgt

SEQ ID NO: 3910227 - DNA, 19 bp, Homo sapiens
ttgaggagcagcttcagtt

SEQ ID NO: 3910228 - DNA, 19 bp, Homo sapiens
ttgaggcctgccctcaggg

SEQ ID NO: 3910229 - DNA, 18 bp, Homo sapiens
ttgagggtaataaactta

SEQ ID NO: 3910230 - DNA, 19 bp, Homo sapiens
ttgaggtggaagccctcct

SEQ ID NO: 3910231 - DNA, 17 bp, Homo sapiens
ttgagtctcttttttat

SEQ ID NO: 3910232 - DNA, 14 bp, Homo sapiens
ttgagtgactcgag

SEQ ID NO: 3910233 - DNA, 20 bp, Homo sapiens
ttgagtgcaacaagagcaaa

SEQ ID NO: 3910234 - DNA, 18 bp, Homo sapiens
ttgagttggacacactgt

SEQ ID NO: 3910235 - DNA, 15 bp, Homo sapiens
ttgatcccacttcac

SEQ ID NO: 3910236 - DNA, 21 bp, Homo sapiens
ttgatccctgttacccagaga

SEQ ID NO: 3910237 - DNA, 13 bp, Homo sapiens
ttgatctctgctt

SEQ ID NO: 3910238 - DNA, 12 bp, Homo sapiens
ttgatggggaga

SEQ ID NO: 3910239 - DNA, 14 bp, Homo sapiens
ttgatggggagaaa

SEQ ID NO: 3910240 - DNA, 11 bp, Homo sapiens
ttgatgtacat

SEQ ID NO: 3910241 - DNA, 16 bp, Homo sapiens
ttgatgtcagccttgc

SEQ ID NO: 3910242 - DNA, 17 bp, Homo sapiens
ttgatgtcagccttgca

SEQ ID NO: 3910243 - DNA, 21 bp, Homo sapiens
ttgatgtcatgtacttcctgt

SEQ ID NO: 3910244 - DNA, 14 bp, Homo sapiens
ttgatgtttccaga

SEQ ID NO: 3910245 - DNA, 15 bp, Homo sapiens
ttgatgtttccagaa

SEQ ID NO: 3910246 - DNA, 21 bp, Homo sapiens
ttgatgtttccagaaaatata

SEQ ID NO: 3910247 - DNA, 20 bp, Homo sapiens
ttgattacataatcaaagct

SEQ ID NO: 3910248 - DNA, 20 bp, Homo sapiens
ttgattattctgattccact

SEQ ID NO: 3910249 - DNA, 12 bp, Homo sapiens
ttgattcttcct

SEQ ID NO: 3910250 - DNA, 12 bp, Homo sapiens
ttgcaaacttta

SEQ ID NO: 3910251 - DNA, 18 bp, Homo sapiens
ttgcaagatttaacacta

SEQ ID NO: 3910252 - DNA, 13 bp, Homo sapiens
ttgcaataaaata

SEQ ID NO: 3910253 - DNA, 15 bp, Homo sapiens
ttgcaataaaatagt

SEQ ID NO: 3910254 - DNA, 11 bp, Homo sapiens
ttgcacaattt

SEQ ID NO: 3910255 - DNA, 13 bp, Homo sapiens
ttgcacatctctg

SEQ ID NO: 3910256 - DNA, 14 bp, Homo sapiens
ttgcacatctctgc

SEQ ID NO: 3910257 - DNA, 15 bp, Homo sapiens
ttgcacatgtgacca

SEQ ID NO: 3910258 - DNA, 13 bp, Homo sapiens
ttgcacccctcac

SEQ ID NO: 3910259 - DNA, 22 bp, Homo sapiens
ttgcacccctcactctggcctc

SEQ ID NO: 3910260 - DNA, 24 bp, Homo sapiens
ttgcacccctcactctggcctcag

SEQ ID NO: 3910261 - DNA, 18 bp, Homo sapiens
ttgcacgtcttgctattt

SEQ ID NO: 3910262 - DNA, 19 bp, Homo sapiens
ttgcactaaagtatgtaaa

SEQ ID NO: 3910263 - DNA, 19 bp, Homo sapiens
ttgcactatgaaaatcagt

SEQ ID NO: 3910264 - DNA, 18 bp, Homo sapiens
ttgcactcagcttttttc

SEQ ID NO: 3910265 - DNA, 17 bp, Homo sapiens
ttgcagaaaagcacctg

SEQ ID NO: 3910266 - DNA, 19 bp, Homo sapiens
ttgcagagatttcctccat

SEQ ID NO: 3910267 - DNA, 12 bp, Homo sapiens
ttgcagcatttt

SEQ ID NO: 3910268 - DNA, 17 bp, Homo sapiens
ttgcagcatttttattt

SEQ ID NO: 3910269 - DNA, 16 bp, Homo sapiens
ttgcagttcaaatcct

SEQ ID NO: 3910270 - DNA, 20 bp, Homo sapiens
ttgcatcacctctgtaattt

SEQ ID NO: 3910271 - DNA, 15 bp, Homo sapiens
ttgcatcagtattaa

SEQ ID NO: 3910272 - DNA, 14 bp, Homo sapiens
ttgcatgtaaaatg

SEQ ID NO: 3910273 - DNA, 19 bp, Homo sapiens
ttgcatgtaaaatgcagtc

SEQ ID NO: 3910274 - DNA, 23 bp, Homo sapiens
ttgcatgtaaaatgcagtccaga

SEQ ID NO: 3910275 - DNA, 16 bp, Homo sapiens
ttgcattgtgtgagct

SEQ ID NO: 3910276 - DNA, 24 bp, Homo sapiens
ttgcatttagttttatggcatgat

SEQ ID NO: 3910277 - DNA, 16 bp, Homo sapiens
ttgcatttgtcaaagc

SEQ ID NO: 3910278 - DNA, 21 bp, Homo sapiens
ttgccacaatgcctctcccac

SEQ ID NO: 3910279 - DNA, 19 bp, Homo sapiens
ttgccaccactagagctga

SEQ ID NO: 3910280 - DNA, 17 bp, Homo sapiens
ttgccactttggcttct

SEQ ID NO: 3910281 - DNA, 24 bp, Homo sapiens
ttgccactttggcttctcctgtga

SEQ ID NO: 3910282 - DNA, 13 bp, Homo sapiens
ttgccagcacagg

SEQ ID NO: 3910283 - DNA, 17 bp, Homo sapiens
ttgccagcacaggggcc

SEQ ID NO: 3910284 - DNA, 21 bp, Homo sapiens
ttgccagcacaggggccccag

SEQ ID NO: 3910285 - DNA, 12 bp, Homo sapiens
ttgccaggctag

SEQ ID NO: 3910286 - DNA, 17 bp, Homo sapiens
ttgccatagccccatat

SEQ ID NO: 3910287 - DNA, 14 bp, Homo sapiens
ttgccatgggcctg

SEQ ID NO: 3910288 - DNA, 17 bp, Homo sapiens
ttgcccagagatgcctc

SEQ ID NO: 3910289 - DNA, 19 bp, Homo sapiens
ttgcccagagatgcctcca

SEQ ID NO: 3910290 - DNA, 19 bp, Homo sapiens
ttgccccttccccatctcc

SEQ ID NO: 3910291 - DNA, 23 bp, Homo sapiens
ttgcccgccagcctcagtgccac

SEQ ID NO: 3910292 - DNA, 21 bp, Homo sapiens
ttgccctgacctcccagccct

SEQ ID NO: 3910293 - DNA, 14 bp, Homo sapiens
ttgccctgcctgca

SEQ ID NO: 3910294 - DNA, 10 bp, Homo sapiens
ttgccctggt

SEQ ID NO: 3910295 - DNA, 14 bp, Homo sapiens
ttgcccttcacagt

SEQ ID NO: 3910296 - DNA, 17 bp, Homo sapiens
ttgcccttcacagtgtt

SEQ ID NO: 3910297 - DNA, 18 bp, Homo sapiens
ttgcccttgccctgacct

SEQ ID NO: 3910298 - DNA, 13 bp, Homo sapiens
ttgcctgaggctc

SEQ ID NO: 3910299 - DNA, 23 bp, Homo sapiens
ttgcctgaggctcaagaggccca

SEQ ID NO: 3910300 - DNA, 20 bp, Homo sapiens
ttgcctgcagagagaagcct

SEQ ID NO: 3910301 - DNA, 11 bp, Homo sapiens
ttgcctggctg

SEQ ID NO: 3910302 - DNA, 12 bp, Homo sapiens
ttgcctggctgt

SEQ ID NO: 3910303 - DNA, 18 bp, Homo sapiens
ttgccttagcacttcttt

SEQ ID NO: 3910304 - DNA, 19 bp, Homo sapiens
ttgccttcttcacccagct

SEQ ID NO: 3910305 - DNA, 21 bp, Homo sapiens
ttgcgggggagctggaaataa

SEQ ID NO: 3910306 - DNA, 16 bp, Homo sapiens
ttgctacaataaatgc

SEQ ID NO: 3910307 - DNA, 17 bp, Homo sapiens
ttgctacaataaatgct

SEQ ID NO: 3910308 - DNA, 21 bp, Homo sapiens
ttgctatcaaaataaattgaa

SEQ ID NO: 3910309 - DNA, 20 bp, Homo sapiens
ttgctcactcaggactttga

SEQ ID NO: 3910310 - DNA, 21 bp, Homo sapiens
ttgctcagtgcctcctggccg

SEQ ID NO: 3910311 - DNA, 11 bp, Homo sapiens
ttgctccaggg

SEQ ID NO: 3910312 - DNA, 14 bp, Homo sapiens
ttgctccagggtct

SEQ ID NO: 3910313 - DNA, 12 bp, Homo sapiens
ttgctccttgac

SEQ ID NO: 3910314 - DNA, 19 bp, Homo sapiens
ttgctgacatggctttgct

SEQ ID NO: 3910315 - DNA, 19 bp, Homo sapiens
ttgctgattcaagaaacag

SEQ ID NO: 3910316 - DNA, 23 bp, Homo sapiens
ttgctggacggggactggggatg

SEQ ID NO: 3910317 - DNA, 23 bp, Homo sapiens
ttgctggactgtcatagaaatta

SEQ ID NO: 3910318 - DNA, 14 bp, Homo sapiens
ttgcttaaaatttt

SEQ ID NO: 3910319 - DNA, 15 bp, Homo sapiens
ttgcttaactggctg

SEQ ID NO: 3910320 - DNA, 18 bp, Homo sapiens
ttgcttacatttttacaa

SEQ ID NO: 3910321 - DNA, 15 bp, Homo sapiens
ttgcttattcttgag

SEQ ID NO: 3910322 - DNA, 13 bp, Homo sapiens
ttgcttctgcagc

SEQ ID NO: 3910323 - DNA, 24 bp, Homo sapiens
ttgcttctgcagcaactcccacga

SEQ ID NO: 3910324 - DNA, 15 bp, Homo sapiens
ttgcttgccgagcct

SEQ ID NO: 3910325 - DNA, 22 bp, Homo sapiens
ttgcttgccgagcctaatgaaa

SEQ ID NO: 3910326 - DNA, 16 bp, Homo sapiens
ttgcttggactattat

SEQ ID NO: 3910327 - DNA, 23 bp, Homo sapiens
ttgctttaaagtacctgtagtga

SEQ ID NO: 3910328 - DNA, 23 bp, Homo sapiens
ttgctttgggctttgcaggctct

SEQ ID NO: 3910329 - DNA, 13 bp, Homo sapiens
ttggaaaaaaatt

SEQ ID NO: 3910330 - DNA, 16 bp, Homo sapiens
ttggaaacattttctt

SEQ ID NO: 3910331 - DNA, 16 bp, Homo sapiens
ttggaaagctgatgat

SEQ ID NO: 3910332 - DNA, 17 bp, Homo sapiens
ttggaaaggtttcaaga

SEQ ID NO: 3910333 - DNA, 23 bp, Homo sapiens
ttggaagagaggcacctgctgga

SEQ ID NO: 3910334 - DNA, 13 bp, Homo sapiens
ttggaagtttcat

SEQ ID NO: 3910335 - DNA, 13 bp, Homo sapiens
ttggacacagtgt

SEQ ID NO: 3910336 - DNA, 14 bp, Homo sapiens
ttggacacagtgtt

SEQ ID NO: 3910337 - DNA, 16 bp, Homo sapiens
ttggacccgctctgga

SEQ ID NO: 3910338 - DNA, 15 bp, Homo sapiens
ttggacctctgctct

SEQ ID NO: 3910339 - DNA, 21 bp, Homo sapiens
ttggacctctgctctgaggct

SEQ ID NO: 3910340 - DNA, 13 bp, Homo sapiens
ttggactattata

SEQ ID NO: 3910341 - DNA, 12 bp, Homo sapiens
ttggacttcctt

SEQ ID NO: 3910342 - DNA, 15 bp, Homo sapiens
ttggagagcagctgg

SEQ ID NO: 3910343 - DNA, 20 bp, Homo sapiens
ttggagagtaaaaactgaat

SEQ ID NO: 3910344 - DNA, 20 bp, Homo sapiens
ttggagataatctagaacac

SEQ ID NO: 3910345 - DNA, 14 bp, Homo sapiens
ttggagcccgtgca

SEQ ID NO: 3910346 - DNA, 22 bp, Homo sapiens
ttggataatgctgttgcctcat

SEQ ID NO: 3910347 - DNA, 21 bp, Homo sapiens
ttggatacaaggatcagaatg

SEQ ID NO: 3910348 - DNA, 17 bp, Homo sapiens
ttggatagtcagctgta

SEQ ID NO: 3910349 - DNA, 14 bp, Homo sapiens
ttggatgtggagct

SEQ ID NO: 3910350 - DNA, 14 bp, Homo sapiens
ttggcaacagaagc

SEQ ID NO: 3910351 - DNA, 15 bp, Homo sapiens
ttggcacagaaacac

SEQ ID NO: 3910352 - DNA, 23 bp, Homo sapiens
ttggcagcttaacattgacttct

SEQ ID NO: 3910353 - DNA, 19 bp, Homo sapiens
ttggcatggatttctgtct

SEQ ID NO: 3910354 - DNA, 12 bp, Homo sapiens
ttggccactggg

SEQ ID NO: 3910355 - DNA, 20 bp, Homo sapiens
ttggccactgggtctcactc

SEQ ID NO: 3910356 - DNA, 22 bp, Homo sapiens
ttggccctctcccatgcacaca

SEQ ID NO: 3910357 - DNA, 13 bp, Homo sapiens
ttggcctcgcctg

SEQ ID NO: 3910358 - DNA, 17 bp, Homo sapiens
ttggcctcgcctgggcc

SEQ ID NO: 3910359 - DNA, 23 bp, Homo sapiens
ttggcgatgaggtaattctccct

SEQ ID NO: 3910360 - DNA, 20 bp, Homo sapiens
ttggctcaggcagacaagag

SEQ ID NO: 3910361 - DNA, 16 bp, Homo sapiens
ttggctcttaaggctt

SEQ ID NO: 3910362 - DNA, 23 bp, Homo sapiens
ttggctggatgaaattttctaga

SEQ ID NO: 3910363 - DNA, 17 bp, Homo sapiens
ttggctgtgaggcccct

SEQ ID NO: 3910364 - DNA, 18 bp, Homo sapiens
ttggcttctcctgtgacc

SEQ ID NO: 3910365 - DNA, 22 bp, Homo sapiens
ttggctttaaacacccttcaca

SEQ ID NO: 3910366 - DNA, 20 bp, Homo sapiens
ttggcttttgcttggcagag

SEQ ID NO: 3910367 - DNA, 18 bp, Homo sapiens
ttgggaatggatcctgga

SEQ ID NO: 3910368 - DNA, 11 bp, Homo sapiens
ttgggagcact

SEQ ID NO: 3910369 - DNA, 22 bp, Homo sapiens
ttgggagcactggagtgcaggg

SEQ ID NO: 3910370 - DNA, 17 bp, Homo sapiens
ttgggagcttgggaatg

SEQ ID NO: 3910371 - DNA, 15 bp, Homo sapiens
ttgggaggccaaggc

SEQ ID NO: 3910372 - DNA, 16 bp, Homo sapiens
ttgggaggccaaggca

SEQ ID NO: 3910373 - DNA, 17 bp, Homo sapiens
ttgggatcagcctccgc

SEQ ID NO: 3910374 - DNA, 22 bp, Homo sapiens
ttgggatgagaatgaaagctta

SEQ ID NO: 3910375 - DNA, 18 bp, Homo sapiens
ttgggcacccccagcctg

SEQ ID NO: 3910376 - DNA, 23 bp, Homo sapiens
ttgggcacccccagcctgggcct

SEQ ID NO: 3910377 - DNA, 19 bp, Homo sapiens
ttgggcagaagggagaagg

SEQ ID NO: 3910378 - DNA, 15 bp, Homo sapiens
ttgggctactggcag

SEQ ID NO: 3910379 - DNA, 19 bp, Homo sapiens
ttgggctactggcagctcc

SEQ ID NO: 3910380 - DNA, 20 bp, Homo sapiens
ttgggctactggcagctcct

SEQ ID NO: 3910381 - DNA, 24 bp, Homo sapiens
ttgggctactggcagctcctctcc

SEQ ID NO: 3910382 - DNA, 15 bp, Homo sapiens
ttgggctcctggctg

SEQ ID NO: 3910383 - DNA, 16 bp, Homo sapiens
ttgggctcctggctgc

SEQ ID NO: 3910384 - DNA, 19 bp, Homo sapiens
ttgggctcctggctgccag

SEQ ID NO: 3910385 - DNA, 20 bp, Homo sapiens
ttgggctcctggctgccagg

SEQ ID NO: 3910386 - DNA, 21 bp, Homo sapiens
ttgggctcctggctgccaggc

SEQ ID NO: 3910387 - DNA, 13 bp, Homo sapiens
ttggggggccggg

SEQ ID NO: 3910388 - DNA, 20 bp, Homo sapiens
ttggggggccgggcaggtcc

SEQ ID NO: 3910389 - DNA, 15 bp, Homo sapiens
ttgggggtttttaat

SEQ ID NO: 3910390 - DNA, 15 bp, Homo sapiens
ttgggttttatcagt

SEQ ID NO: 3910391 - DNA, 22 bp, Homo sapiens
ttggtaaattgtaaacagctaa

SEQ ID NO: 3910392 - DNA, 21 bp, Homo sapiens
ttggtaggcttatcaaaatct

SEQ ID NO: 3910393 - DNA, 17 bp, Homo sapiens
ttggtatcaagaaagtc

SEQ ID NO: 3910394 - DNA, 13 bp, Homo sapiens
ttggtccctgggg

SEQ ID NO: 3910395 - DNA, 12 bp, Homo sapiens
ttggtccctggt

SEQ ID NO: 3910396 - DNA, 15 bp, Homo sapiens
ttggtccctggtccc

SEQ ID NO: 3910397 - DNA, 18 bp, Homo sapiens
ttggtctctatttcattt

SEQ ID NO: 3910398 - DNA, 14 bp, Homo sapiens
ttggtgactgtccc

SEQ ID NO: 3910399 - DNA, 13 bp, Homo sapiens
ttggtgggctggc

SEQ ID NO: 3910400 - DNA, 17 bp, Homo sapiens
ttggttagaacctccta

SEQ ID NO: 3910401 - DNA, 14 bp, Homo sapiens
ttggttggggtggg

SEQ ID NO: 3910402 - DNA, 12 bp, Homo sapiens
ttggttgtcaat

SEQ ID NO: 3910403 - DNA, 19 bp, Homo sapiens
ttggtttggacacagtgtt

SEQ ID NO: 3910404 - DNA, 14 bp, Homo sapiens
ttgtaaaactacac

SEQ ID NO: 3910405 - DNA, 20 bp, Homo sapiens
ttgtaaaagaacagtaaaca

SEQ ID NO: 3910406 - DNA, 15 bp, Homo sapiens
ttgtaaaatagcttg

SEQ ID NO: 3910407 - DNA, 21 bp, Homo sapiens
ttgtaaaatagcttgtatagt

SEQ ID NO: 3910408 - DNA, 22 bp, Homo sapiens
ttgtaaactgtatcaaatctgt

SEQ ID NO: 3910409 - DNA, 14 bp, Homo sapiens
ttgtaaaggtcaga

SEQ ID NO: 3910410 - DNA, 15 bp, Homo sapiens
ttgtaaaggtcagag

SEQ ID NO: 3910411 - DNA, 21 bp, Homo sapiens
ttgtaaataaaagtatttaat

SEQ ID NO: 3910412 - DNA, 17 bp, Homo sapiens
ttgtaaataaatagatt

SEQ ID NO: 3910413 - DNA, 11 bp, Homo sapiens
ttgtaaataca

SEQ ID NO: 3910414 - DNA, 13 bp, Homo sapiens
ttgtaaatacacc

SEQ ID NO: 3910415 - DNA, 13 bp, Homo sapiens
ttgtaaatattta

SEQ ID NO: 3910416 - DNA, 20 bp, Homo sapiens
ttgtaaattaggaggctcaa

SEQ ID NO: 3910417 - DNA, 22 bp, Homo sapiens
ttgtaagacaaaggttttcctc

SEQ ID NO: 3910418 - DNA, 12 bp, Homo sapiens
ttgtaatagtcc

SEQ ID NO: 3910419 - DNA, 14 bp, Homo sapiens
ttgtacaagctcag

SEQ ID NO: 3910420 - DNA, 15 bp, Homo sapiens
ttgtacaagctcagg

SEQ ID NO: 3910421 - DNA, 16 bp, Homo sapiens
ttgtacagaattttta

SEQ ID NO: 3910422 - DNA, 16 bp, Homo sapiens
ttgtacagctgtttaa

SEQ ID NO: 3910423 - DNA, 16 bp, Homo sapiens
ttgtacagttcagttc

SEQ ID NO: 3910424 - DNA, 16 bp, Homo sapiens
ttgtacatattggaaa

SEQ ID NO: 3910425 - DNA, 11 bp, Homo sapiens
ttgtaccccat

SEQ ID NO: 3910426 - DNA, 15 bp, Homo sapiens
ttgtaccccatccct

SEQ ID NO: 3910427 - DNA, 19 bp, Homo sapiens
ttgtaccccatcccttcct

SEQ ID NO: 3910428 - DNA, 16 bp, Homo sapiens
ttgtacctatgtgaca

SEQ ID NO: 3910429 - DNA, 14 bp, Homo sapiens
ttgtacgtaatgta

SEQ ID NO: 3910430 - DNA, 15 bp, Homo sapiens
ttgtacgttatatat

SEQ ID NO: 3910431 - DNA, 18 bp, Homo sapiens
ttgtacgttatatattgt

SEQ ID NO: 3910432 - DNA, 20 bp, Homo sapiens
ttgtacgttatatattgtat

SEQ ID NO: 3910433 - DNA, 13 bp, Homo sapiens
ttgtactatgtta

SEQ ID NO: 3910434 - DNA, 19 bp, Homo sapiens
ttgtactcttgctttttca

SEQ ID NO: 3910435 - DNA, 14 bp, Homo sapiens
ttgtagaaatctgt

SEQ ID NO: 3910436 - DNA, 20 bp, Homo sapiens
ttgtagaagatggactctga

SEQ ID NO: 3910437 - DNA, 19 bp, Homo sapiens
ttgtaggggtcaaagaaat

SEQ ID NO: 3910438 - DNA, 14 bp, Homo sapiens
ttgtataacttctt

SEQ ID NO: 3910439 - DNA, 14 bp, Homo sapiens
ttgtatagtaaagt

SEQ ID NO: 3910440 - DNA, 15 bp, Homo sapiens
ttgtatagtaaagtg

SEQ ID NO: 3910441 - DNA, 14 bp, Homo sapiens
ttgtatagtgtaaa

SEQ ID NO: 3910442 - DNA, 15 bp, Homo sapiens
ttgtatagtgtaaaa

SEQ ID NO: 3910443 - DNA, 23 bp, Homo sapiens
ttgtatagttttataaaactcag

SEQ ID NO: 3910444 - DNA, 14 bp, Homo sapiens
ttgtatatacatat

SEQ ID NO: 3910445 - DNA, 15 bp, Homo sapiens
ttgtatatacatatt

SEQ ID NO: 3910446 - DNA, 23 bp, Homo sapiens
ttgtatatacatattataaataa

SEQ ID NO: 3910447 - DNA, 20 bp, Homo sapiens
ttgtatatacttcactcact

SEQ ID NO: 3910448 - DNA, 16 bp, Homo sapiens
ttgtatatgatctaat

SEQ ID NO: 3910449 - DNA, 21 bp, Homo sapiens
ttgtatattatggaagatttt

SEQ ID NO: 3910450 - DNA, 18 bp, Homo sapiens
ttgtatattgtaggaatc

SEQ ID NO: 3910451 - DNA, 19 bp, Homo sapiens
ttgtatcatttgaacaact

SEQ ID NO: 3910452 - DNA, 12 bp, Homo sapiens
ttgtatgtaagt

SEQ ID NO: 3910453 - DNA, 15 bp, Homo sapiens
ttgtatgtatctatt

SEQ ID NO: 3910454 - DNA, 12 bp, Homo sapiens
ttgtatgttaaa

SEQ ID NO: 3910455 - DNA, 16 bp, Homo sapiens
ttgtattacatctaat

SEQ ID NO: 3910456 - DNA, 18 bp, Homo sapiens
ttgtattttaaaacataa

SEQ ID NO: 3910457 - DNA, 13 bp, Homo sapiens
ttgtcaaatgtca

SEQ ID NO: 3910458 - DNA, 16 bp, Homo sapiens
ttgtcactatgctatt

SEQ ID NO: 3910459 - DNA, 21 bp, Homo sapiens
ttgtcattcaagcctgtgaat

SEQ ID NO: 3910460 - DNA, 22 bp, Homo sapiens
ttgtccaatggctgtaaactat

SEQ ID NO: 3910461 - DNA, 22 bp, Homo sapiens
ttgtccacagtctcccattctc

SEQ ID NO: 3910462 - DNA, 22 bp, Homo sapiens
ttgtccatatcagacctctgat

SEQ ID NO: 3910463 - DNA, 15 bp, Homo sapiens
ttgtccatgtgcttc

SEQ ID NO: 3910464 - DNA, 19 bp, Homo sapiens
ttgtcctgccagctgcctt

SEQ ID NO: 3910465 - DNA, 20 bp, Homo sapiens
ttgtcctttgagaaagaaat

SEQ ID NO: 3910466 - DNA, 15 bp, Homo sapiens
ttgtcgggacagaga

SEQ ID NO: 3910467 - DNA, 20 bp, Homo sapiens
ttgtctagaggtgagaccaa

SEQ ID NO: 3910468 - DNA, 19 bp, Homo sapiens
ttgtctattctgagccttg

SEQ ID NO: 3910469 - DNA, 19 bp, Homo sapiens
ttgtctcctacctgctgct

SEQ ID NO: 3910470 - DNA, 11 bp, Homo sapiens
ttgtctctcat

SEQ ID NO: 3910471 - DNA, 14 bp, Homo sapiens
ttgtctctgcatct

SEQ ID NO: 3910472 - DNA, 17 bp, Homo sapiens
ttgtctgaagtcactgc

SEQ ID NO: 3910473 - DNA, 18 bp, Homo sapiens
ttgtctgaagtcactgca

SEQ ID NO: 3910474 - DNA, 20 bp, Homo sapiens
ttgtctgaagtcactgcaca

SEQ ID NO: 3910475 - DNA, 21 bp, Homo sapiens
ttgtctgaggcctcatccctc

SEQ ID NO: 3910476 - DNA, 23 bp, Homo sapiens
ttgtctggataccagatatttga

SEQ ID NO: 3910477 - DNA, 17 bp, Homo sapiens
ttgtcttccaaccccag

SEQ ID NO: 3910478 - DNA, 19 bp, Homo sapiens
ttgtcttccaaccccagct

SEQ ID NO: 3910479 - DNA, 23 bp, Homo sapiens
ttgtctttgtaatgtcaccacct

SEQ ID NO: 3910480 - DNA, 15 bp, Homo sapiens
ttgtgaaaccacagg

SEQ ID NO: 3910481 - DNA, 14 bp, Homo sapiens
ttgtgaaatgatgg

SEQ ID NO: 3910482 - DNA, 17 bp, Homo sapiens
ttgtgacaggaaagccc

SEQ ID NO: 3910483 - DNA, 22 bp, Homo sapiens
ttgtgagtgactcggtgtaaaa

SEQ ID NO: 3910484 - DNA, 16 bp, Homo sapiens
ttgtgattttgtacag

SEQ ID NO: 3910485 - DNA, 17 bp, Homo sapiens
ttgtgattttgtacaga

SEQ ID NO: 3910486 - DNA, 19 bp, Homo sapiens
ttgtgcatgtttactttat

SEQ ID NO: 3910487 - DNA, 17 bp, Homo sapiens
ttgtgctgtgggcagca

SEQ ID NO: 3910488 - DNA, 22 bp, Homo sapiens
ttgtgctgtgggcagcaccctc

SEQ ID NO: 3910489 - DNA, 14 bp, Homo sapiens
ttgtgcttaaatta

SEQ ID NO: 3910490 - DNA, 21 bp, Homo sapiens
ttgtggaaaatgaaaattagg

SEQ ID NO: 3910491 - DNA, 15 bp, Homo sapiens
ttgtgtacagttatt

SEQ ID NO: 3910492 - DNA, 11 bp, Homo sapiens
ttgtgtatgtg

SEQ ID NO: 3910493 - DNA, 16 bp, Homo sapiens
ttgtgttctgagtgaa

SEQ ID NO: 3910494 - DNA, 16 bp, Homo sapiens
ttgttacctttcccat

SEQ ID NO: 3910495 - DNA, 15 bp, Homo sapiens
ttgttcaaatgcatt

SEQ ID NO: 3910496 - DNA, 15 bp, Homo sapiens
ttgttcccacacaca

SEQ ID NO: 3910497 - DNA, 14 bp, Homo sapiens
ttgttctttaaaat

SEQ ID NO: 3910498 - DNA, 14 bp, Homo sapiens
ttgttctttatttg

SEQ ID NO: 3910499 - DNA, 16 bp, Homo sapiens
ttgttgattttctaga

SEQ ID NO: 3910500 - DNA, 14 bp, Homo sapiens
ttgttgcaaaggtc

SEQ ID NO: 3910501 - DNA, 19 bp, Homo sapiens
ttgttgcaagtactgctgt

SEQ ID NO: 3910502 - DNA, 18 bp, Homo sapiens
ttgttgctccctgtgaca

SEQ ID NO: 3910503 - DNA, 20 bp, Homo sapiens
ttgttgggcttgggggaaaa

SEQ ID NO: 3910504 - DNA, 17 bp, Homo sapiens
ttgtttaaaatcatttc

SEQ ID NO: 3910505 - DNA, 15 bp, Homo sapiens
ttgtttaaatataaa

SEQ ID NO: 3910506 - DNA, 20 bp, Homo sapiens
ttgtttgagcgcagagtaaa

SEQ ID NO: 3910507 - DNA, 12 bp, Homo sapiens
ttgtttgtaatc

SEQ ID NO: 3910508 - DNA, 19 bp, Homo sapiens
ttgttttatcatgacatgt

SEQ ID NO: 3910509 - DNA, 19 bp, Homo sapiens
tttaaaaaataaaaaaata

SEQ ID NO: 3910510 - DNA, 20 bp, Homo sapiens
tttaaaaaataactaccaag

SEQ ID NO: 3910511 - DNA, 19 bp, Homo sapiens
tttaaaaaccaatcatttt

SEQ ID NO: 3910512 - DNA, 15 bp, Homo sapiens
tttaaaaccatgcag

SEQ ID NO: 3910513 - DNA, 20 bp, Homo sapiens
tttaaaagcaattatattgt

SEQ ID NO: 3910514 - DNA, 19 bp, Homo sapiens
tttaaaatacacactcaaa

SEQ ID NO: 3910515 - DNA, 16 bp, Homo sapiens
tttaaaatcattcaat

SEQ ID NO: 3910516 - DNA, 16 bp, Homo sapiens
tttaaaatcatttctg

SEQ ID NO: 3910517 - DNA, 20 bp, Homo sapiens
tttaaaatctgatttaatgt

SEQ ID NO: 3910518 - DNA, 14 bp, Homo sapiens
tttaaaatgattag

SEQ ID NO: 3910519 - DNA, 12 bp, Homo sapiens
tttaaaccagca

SEQ ID NO: 3910520 - DNA, 19 bp, Homo sapiens
tttaaaccagcagaaaagt

SEQ ID NO: 3910521 - DNA, 21 bp, Homo sapiens
tttaaactaccctccagagtg

SEQ ID NO: 3910522 - DNA, 19 bp, Homo sapiens
tttaaagaagtaaatttgt

SEQ ID NO: 3910523 - DNA, 20 bp, Homo sapiens
tttaaagaagtaaatttgtc

SEQ ID NO: 3910524 - DNA, 22 bp, Homo sapiens
tttaaaggggcagaaaaactct

SEQ ID NO: 3910525 - DNA, 14 bp, Homo sapiens
tttaaaggtagaga

SEQ ID NO: 3910526 - DNA, 19 bp, Homo sapiens
tttaaaggtagagatgtgt

SEQ ID NO: 3910527 - DNA, 12 bp, Homo sapiens
tttaaagtctat

SEQ ID NO: 3910528 - DNA, 19 bp, Homo sapiens
tttaaagtctttccgtctc

SEQ ID NO: 3910529 - DNA, 21 bp, Homo sapiens
tttaaataaagtatcatgcat

SEQ ID NO: 3910530 - DNA, 17 bp, Homo sapiens
tttaaatataaatgttt

SEQ ID NO: 3910531 - DNA, 14 bp, Homo sapiens
tttaaatcaaaagc

SEQ ID NO: 3910532 - DNA, 17 bp, Homo sapiens
tttaaatcaaaagctgc

SEQ ID NO: 3910533 - DNA, 18 bp, Homo sapiens
tttaaatcaaaagctgct

SEQ ID NO: 3910534 - DNA, 20 bp, Homo sapiens
tttaaatgatgattccttga

SEQ ID NO: 3910535 - DNA, 12 bp, Homo sapiens
tttaacaaaaca

SEQ ID NO: 3910536 - DNA, 22 bp, Homo sapiens
tttaacaaaacaagaaagaaac

SEQ ID NO: 3910537 - DNA, 16 bp, Homo sapiens
tttaacaaaagcaaga

SEQ ID NO: 3910538 - DNA, 19 bp, Homo sapiens
tttaacacaagtcctgtga

SEQ ID NO: 3910539 - DNA, 19 bp, Homo sapiens
tttaacacataactagaaa

SEQ ID NO: 3910540 - DNA, 16 bp, Homo sapiens
tttaacagtcatttaa

SEQ ID NO: 3910541 - DNA, 17 bp, Homo sapiens
tttaacagtcatttaaa

SEQ ID NO: 3910542 - DNA, 22 bp, Homo sapiens
tttaagagtgaaataattaaaa

SEQ ID NO: 3910543 - DNA, 19 bp, Homo sapiens
tttaagcctcatatttaaa

SEQ ID NO: 3910544 - DNA, 17 bp, Homo sapiens
tttaagccttttgtgta

SEQ ID NO: 3910545 - DNA, 13 bp, Homo sapiens
tttaagctgtaaa

SEQ ID NO: 3910546 - DNA, 14 bp, Homo sapiens
tttaagctgtaaaa

SEQ ID NO: 3910547 - DNA, 15 bp, Homo sapiens
tttaagcttgaagat

SEQ ID NO: 3910548 - DNA, 17 bp, Homo sapiens
tttaagggtttgtggaa

SEQ ID NO: 3910549 - DNA, 16 bp, Homo sapiens
tttaagtatatagtat

SEQ ID NO: 3910550 - DNA, 20 bp, Homo sapiens
tttaagtttgttgctgtcaa

SEQ ID NO: 3910551 - DNA, 20 bp, Homo sapiens
tttaatacctttggaaaaat

SEQ ID NO: 3910552 - DNA, 12 bp, Homo sapiens
tttaatatttaa

SEQ ID NO: 3910553 - DNA, 15 bp, Homo sapiens
tttaatatttaaaca

SEQ ID NO: 3910554 - DNA, 14 bp, Homo sapiens
tttaatgttttctg

SEQ ID NO: 3910555 - DNA, 20 bp, Homo sapiens
tttaattaactatgtgatgt

SEQ ID NO: 3910556 - DNA, 17 bp, Homo sapiens
tttaattcataattaga

SEQ ID NO: 3910557 - DNA, 18 bp, Homo sapiens
tttaattcataattagaa

SEQ ID NO: 3910558 - DNA, 17 bp, Homo sapiens
tttaatttatatttgaa

SEQ ID NO: 3910559 - DNA, 23 bp, Homo sapiens
tttaatttatatttgaaatttta

SEQ ID NO: 3910560 - DNA, 14 bp, Homo sapiens
tttaatttatttca

SEQ ID NO: 3910561 - DNA, 19 bp, Homo sapiens
tttacaaatttttcctgca

SEQ ID NO: 3910562 - DNA, 16 bp, Homo sapiens
tttacaataaataatc

SEQ ID NO: 3910563 - DNA, 19 bp, Homo sapiens
tttacaataaatattctgc

SEQ ID NO: 3910564 - DNA, 13 bp, Homo sapiens
tttacagctgcct

SEQ ID NO: 3910565 - DNA, 15 bp, Homo sapiens
tttacagctgcctgc

SEQ ID NO: 3910566 - DNA, 16 bp, Homo sapiens
tttacagctttacaca

SEQ ID NO: 3910567 - DNA, 19 bp, Homo sapiens
tttacagctttacacacac

SEQ ID NO: 3910568 - DNA, 18 bp, Homo sapiens
tttacatagttcttacta

SEQ ID NO: 3910569 - DNA, 13 bp, Homo sapiens
tttacattttatt

SEQ ID NO: 3910570 - DNA, 18 bp, Homo sapiens
tttacattttatttatta

SEQ ID NO: 3910571 - DNA, 18 bp, Homo sapiens
tttacccaaaaactaaat

SEQ ID NO: 3910572 - DNA, 22 bp, Homo sapiens
tttacccagtgggacagaggag

SEQ ID NO: 3910573 - DNA, 19 bp, Homo sapiens
tttacctaccaccttccct

SEQ ID NO: 3910574 - DNA, 21 bp, Homo sapiens
tttacctaccaccttccctct

SEQ ID NO: 3910575 - DNA, 20 bp, Homo sapiens
tttactaagccacaagaaat

SEQ ID NO: 3910576 - DNA, 21 bp, Homo sapiens
tttactaagccacaagaaatt

SEQ ID NO: 3910577 - DNA, 14 bp, Homo sapiens
tttactacttgtta

SEQ ID NO: 3910578 - DNA, 13 bp, Homo sapiens
tttactccagtgg

SEQ ID NO: 3910579 - DNA, 19 bp, Homo sapiens
tttactcctttgcattcca

SEQ ID NO: 3910580 - DNA, 16 bp, Homo sapiens
tttactgtgcatacat

SEQ ID NO: 3910581 - DNA, 18 bp, Homo sapiens
tttacttgcattgaatat

SEQ ID NO: 3910582 - DNA, 11 bp, Homo sapiens
tttagccagtg

SEQ ID NO: 3910583 - DNA, 23 bp, Homo sapiens
tttaggatgtaactttataaata

SEQ ID NO: 3910584 - DNA, 13 bp, Homo sapiens
tttagggaagcag

SEQ ID NO: 3910585 - DNA, 14 bp, Homo sapiens
tttagggccaggca

SEQ ID NO: 3910586 - DNA, 16 bp, Homo sapiens
tttagggccaggcagg

SEQ ID NO: 3910587 - DNA, 18 bp, Homo sapiens
tttaggggaagtatgtgt

SEQ ID NO: 3910588 - DNA, 22 bp, Homo sapiens
tttaggtttttgtttgtttcct

SEQ ID NO: 3910589 - DNA, 21 bp, Homo sapiens
tttagtaaatcctattatgtg

SEQ ID NO: 3910590 - DNA, 13 bp, Homo sapiens
tttagttatagtt

SEQ ID NO: 3910591 - DNA, 14 bp, Homo sapiens
tttagtttactcaa

SEQ ID NO: 3910592 - DNA, 23 bp, Homo sapiens
tttataaaagaataaaattgcac

SEQ ID NO: 3910593 - DNA, 14 bp, Homo sapiens
tttataaaattaga

SEQ ID NO: 3910594 - DNA, 14 bp, Homo sapiens
tttataaactagat

SEQ ID NO: 3910595 - DNA, 19 bp, Homo sapiens
tttataactagtcctttac

SEQ ID NO: 3910596 - DNA, 13 bp, Homo sapiens
tttatacaaaata

SEQ ID NO: 3910597 - DNA, 16 bp, Homo sapiens
tttatacaaaataatt

SEQ ID NO: 3910598 - DNA, 13 bp, Homo sapiens
tttatacatatca

SEQ ID NO: 3910599 - DNA, 16 bp, Homo sapiens
tttatacatatcagaa

SEQ ID NO: 3910600 - DNA, 21 bp, Homo sapiens
tttatactctagaacatgcac

SEQ ID NO: 3910601 - DNA, 19 bp, Homo sapiens
tttatagtttgtacatgca

SEQ ID NO: 3910602 - DNA, 13 bp, Homo sapiens
tttatatatatat

SEQ ID NO: 3910603 - DNA, 12 bp, Homo sapiens
tttatatatttg

SEQ ID NO: 3910604 - DNA, 14 bp, Homo sapiens
tttatatctatagt

SEQ ID NO: 3910605 - DNA, 17 bp, Homo sapiens
tttatattgtatattct

SEQ ID NO: 3910606 - DNA, 21 bp, Homo sapiens
tttatatttaatttttacatg

SEQ ID NO: 3910607 - DNA, 14 bp, Homo sapiens
tttatatttggaaa

SEQ ID NO: 3910608 - DNA, 14 bp, Homo sapiens
tttatcatgacatg

SEQ ID NO: 3910609 - DNA, 19 bp, Homo sapiens
tttatcctgaaatttcaga

SEQ ID NO: 3910610 - DNA, 17 bp, Homo sapiens
tttatctctatttaata

SEQ ID NO: 3910611 - DNA, 21 bp, Homo sapiens
tttatctgtattttttacagt

SEQ ID NO: 3910612 - DNA, 16 bp, Homo sapiens
tttatgatatccctga

SEQ ID NO: 3910613 - DNA, 22 bp, Homo sapiens
tttatgtaaactgcattagaaa

SEQ ID NO: 3910614 - DNA, 14 bp, Homo sapiens
tttatgtctaaaga

SEQ ID NO: 3910615 - DNA, 14 bp, Homo sapiens
tttattaaaatgat

SEQ ID NO: 3910616 - DNA, 19 bp, Homo sapiens
tttattaaagcaacatttt

SEQ ID NO: 3910617 - DNA, 18 bp, Homo sapiens
tttattaattcattaaat

SEQ ID NO: 3910618 - DNA, 13 bp, Homo sapiens
tttattagctgta

SEQ ID NO: 3910619 - DNA, 17 bp, Homo sapiens
tttattcaagttattgt

SEQ ID NO: 3910620 - DNA, 15 bp, Homo sapiens
tttattcactgtaag

SEQ ID NO: 3910621 - DNA, 13 bp, Homo sapiens
tttattcattcag

SEQ ID NO: 3910622 - DNA, 22 bp, Homo sapiens
tttatttaaactgttctgtgtg

SEQ ID NO: 3910623 - DNA, 14 bp, Homo sapiens
tttatttatggctt

SEQ ID NO: 3910624 - DNA, 18 bp, Homo sapiens
tttcaaaagacatgttgt

SEQ ID NO: 3910625 - DNA, 23 bp, Homo sapiens
tttcaacaagaatattgtatgtt

SEQ ID NO: 3910626 - DNA, 20 bp, Homo sapiens
tttcaaccaactatttttga

SEQ ID NO: 3910627 - DNA, 12 bp, Homo sapiens
tttcaaccagca

SEQ ID NO: 3910628 - DNA, 14 bp, Homo sapiens
tttcaaccagcatt

SEQ ID NO: 3910629 - DNA, 19 bp, Homo sapiens
tttcaaccagcattttact

SEQ ID NO: 3910630 - DNA, 18 bp, Homo sapiens
tttcaaccgcttgccata

SEQ ID NO: 3910631 - DNA, 15 bp, Homo sapiens
tttcaacgcagccct

SEQ ID NO: 3910632 - DNA, 17 bp, Homo sapiens
tttcaagaaactgagga

SEQ ID NO: 3910633 - DNA, 19 bp, Homo sapiens
tttcaagaaactgaggaat

SEQ ID NO: 3910634 - DNA, 16 bp, Homo sapiens
tttcaagacttgatac

SEQ ID NO: 3910635 - DNA, 20 bp, Homo sapiens
tttcaagagaagaaaaaatt

SEQ ID NO: 3910636 - DNA, 13 bp, Homo sapiens
tttcacaacagat

SEQ ID NO: 3910637 - DNA, 20 bp, Homo sapiens
tttcacaggtgtggtgtaat

SEQ ID NO: 3910638 - DNA, 15 bp, Homo sapiens
tttcacagtttttcc

SEQ ID NO: 3910639 - DNA, 16 bp, Homo sapiens
tttcactttagctatg

SEQ ID NO: 3910640 - DNA, 15 bp, Homo sapiens
tttcagaattttgta

SEQ ID NO: 3910641 - DNA, 13 bp, Homo sapiens
tttcagagccagt

SEQ ID NO: 3910642 - DNA, 16 bp, Homo sapiens
tttcagatatatatca

SEQ ID NO: 3910643 - DNA, 16 bp, Homo sapiens
tttcagctctctgtat

SEQ ID NO: 3910644 - DNA, 21 bp, Homo sapiens
tttcagctctctgtataaaca

SEQ ID NO: 3910645 - DNA, 22 bp, Homo sapiens
tttcaggagggtccccagctgg

SEQ ID NO: 3910646 - DNA, 23 bp, Homo sapiens
tttcaggagggtccccagctggt

SEQ ID NO: 3910647 - DNA, 20 bp, Homo sapiens
tttcaggatactctgtcaga

SEQ ID NO: 3910648 - DNA, 17 bp, Homo sapiens
tttcaggcattttgttc

SEQ ID NO: 3910649 - DNA, 23 bp, Homo sapiens
tttcagggcgataaaactaaata

SEQ ID NO: 3910650 - DNA, 23 bp, Homo sapiens
tttcagggggcctttaaagactt

SEQ ID NO: 3910651 - DNA, 14 bp, Homo sapiens
tttcataaggcctg

SEQ ID NO: 3910652 - DNA, 14 bp, Homo sapiens
tttcatcaatttaa

SEQ ID NO: 3910653 - DNA, 21 bp, Homo sapiens
tttcatccagtttgttctccg

SEQ ID NO: 3910654 - DNA, 17 bp, Homo sapiens
tttcatcctggcctcct

SEQ ID NO: 3910655 - DNA, 12 bp, Homo sapiens
tttcatggaagt

SEQ ID NO: 3910656 - DNA, 15 bp, Homo sapiens
tttcatggaggggaa

SEQ ID NO: 3910657 - DNA, 14 bp, Homo sapiens
tttcattacaatgg

SEQ ID NO: 3910658 - DNA, 15 bp, Homo sapiens
tttcattttaattta

SEQ ID NO: 3910659 - DNA, 22 bp, Homo sapiens
tttcattttgtaacaaatgaac

SEQ ID NO: 3910660 - DNA, 14 bp, Homo sapiens
tttccaagtaatat

SEQ ID NO: 3910661 - DNA, 21 bp, Homo sapiens
tttccaagtaatataatggaa

SEQ ID NO: 3910662 - DNA, 19 bp, Homo sapiens
tttccaagttcctgcactc

SEQ ID NO: 3910663 - DNA, 23 bp, Homo sapiens
tttccaagttcctgcactccaga

SEQ ID NO: 3910664 - DNA, 19 bp, Homo sapiens
tttccacaccatcaccctc

SEQ ID NO: 3910665 - DNA, 20 bp, Homo sapiens
tttccacagttgctgctcct

SEQ ID NO: 3910666 - DNA, 20 bp, Homo sapiens
tttccaccatcaaatgctgt

SEQ ID NO: 3910667 - DNA, 19 bp, Homo sapiens
tttccacgatgaaaaactt

SEQ ID NO: 3910668 - DNA, 19 bp, Homo sapiens
tttccagaaaatataaatg

SEQ ID NO: 3910669 - DNA, 24 bp, Homo sapiens
tttccagaaaatataaatgcatga

SEQ ID NO: 3910670 - DNA, 19 bp, Homo sapiens
tttccagaggctattattt

SEQ ID NO: 3910671 - DNA, 19 bp, Homo sapiens
tttccaggcccctgaggac

SEQ ID NO: 3910672 - DNA, 16 bp, Homo sapiens
tttccagttaaggacc

SEQ ID NO: 3910673 - DNA, 15 bp, Homo sapiens
tttccagttctgaca

SEQ ID NO: 3910674 - DNA, 17 bp, Homo sapiens
tttccatgaagtttgaa

SEQ ID NO: 3910675 - DNA, 22 bp, Homo sapiens
tttccattcatgccaaagcaaa

SEQ ID NO: 3910676 - DNA, 11 bp, Homo sapiens
tttccatttct

SEQ ID NO: 3910677 - DNA, 13 bp, Homo sapiens
tttcccaccacct

SEQ ID NO: 3910678 - DNA, 19 bp, Homo sapiens
tttcccaccaccttggact

SEQ ID NO: 3910679 - DNA, 22 bp, Homo sapiens
tttcccaccaccttggactcct

SEQ ID NO: 3910680 - DNA, 13 bp, Homo sapiens
tttcccatgctga

SEQ ID NO: 3910681 - DNA, 18 bp, Homo sapiens
tttcccatgctgaattat

SEQ ID NO: 3910682 - DNA, 19 bp, Homo sapiens
tttcccatgctgaattatt

SEQ ID NO: 3910683 - DNA, 14 bp, Homo sapiens
tttccccaaagtct

SEQ ID NO: 3910684 - DNA, 17 bp, Homo sapiens
tttccccacctcttcct

SEQ ID NO: 3910685 - DNA, 20 bp, Homo sapiens
tttccccgggggaggaaggg

SEQ ID NO: 3910686 - DNA, 21 bp, Homo sapiens
tttcccgagcaaagtctaaag

SEQ ID NO: 3910687 - DNA, 22 bp, Homo sapiens
tttccgctgtcgccccaggccc

SEQ ID NO: 3910688 - DNA, 15 bp, Homo sapiens
tttcctacaaaatgg

SEQ ID NO: 3910689 - DNA, 17 bp, Homo sapiens
tttcctacagaaatact

SEQ ID NO: 3910690 - DNA, 22 bp, Homo sapiens
tttcctagactaattaaaatct

SEQ ID NO: 3910691 - DNA, 17 bp, Homo sapiens
tttcctatctgtatgtc

SEQ ID NO: 3910692 - DNA, 17 bp, Homo sapiens
tttcctccagacagata

SEQ ID NO: 3910693 - DNA, 12 bp, Homo sapiens
tttcctccccac

SEQ ID NO: 3910694 - DNA, 13 bp, Homo sapiens
tttcctccctcag

SEQ ID NO: 3910695 - DNA, 18 bp, Homo sapiens
tttcctcgcctaggcctg

SEQ ID NO: 3910696 - DNA, 22 bp, Homo sapiens
tttcctgggtggctactctgtg

SEQ ID NO: 3910697 - DNA, 13 bp, Homo sapiens
tttccttcagtgc

SEQ ID NO: 3910698 - DNA, 14 bp, Homo sapiens
tttccttgtctctc

SEQ ID NO: 3910699 - DNA, 19 bp, Homo sapiens
tttcctttatatttagtga

SEQ ID NO: 3910700 - DNA, 20 bp, Homo sapiens
tttcgacgcttaacctttcc

SEQ ID NO: 3910701 - DNA, 15 bp, Homo sapiens
tttcgcttgcttctg

SEQ ID NO: 3910702 - DNA, 18 bp, Homo sapiens
tttcgcttgcttctgcag

SEQ ID NO: 3910703 - DNA, 13 bp, Homo sapiens
tttctaaaactat

SEQ ID NO: 3910704 - DNA, 22 bp, Homo sapiens
tttctaacagtatttgtacaaa

SEQ ID NO: 3910705 - DNA, 19 bp, Homo sapiens
tttctaactgtaaatcact

SEQ ID NO: 3910706 - DNA, 20 bp, Homo sapiens
tttctaactgtaaatcactt

SEQ ID NO: 3910707 - DNA, 22 bp, Homo sapiens
tttctaactgtaaatcacttgt

SEQ ID NO: 3910708 - DNA, 16 bp, Homo sapiens
tttctacttatcctca

SEQ ID NO: 3910709 - DNA, 23 bp, Homo sapiens
tttctagacttcagaacatgctg

SEQ ID NO: 3910710 - DNA, 16 bp, Homo sapiens
tttctagactttctgt

SEQ ID NO: 3910711 - DNA, 13 bp, Homo sapiens
tttctatagctct

SEQ ID NO: 3910712 - DNA, 14 bp, Homo sapiens
tttctatcacatat

SEQ ID NO: 3910713 - DNA, 13 bp, Homo sapiens
tttctattccaaa

SEQ ID NO: 3910714 - DNA, 17 bp, Homo sapiens
tttctcaatcagtgcag

SEQ ID NO: 3910715 - DNA, 20 bp, Homo sapiens
tttctcaatcagtgcagtga

SEQ ID NO: 3910716 - DNA, 16 bp, Homo sapiens
tttctcagtttgtata

SEQ ID NO: 3910717 - DNA, 23 bp, Homo sapiens
tttctccatattagatttaccca

SEQ ID NO: 3910718 - DNA, 17 bp, Homo sapiens
tttctcccagtcattta

SEQ ID NO: 3910719 - DNA, 21 bp, Homo sapiens
tttctcccccgacactgctgc

SEQ ID NO: 3910720 - DNA, 13 bp, Homo sapiens
tttctccctcacc

SEQ ID NO: 3910721 - DNA, 19 bp, Homo sapiens
tttctcctactttacactc

SEQ ID NO: 3910722 - DNA, 19 bp, Homo sapiens
tttctcgtggtagaagcca

SEQ ID NO: 3910723 - DNA, 13 bp, Homo sapiens
tttctctcccata

SEQ ID NO: 3910724 - DNA, 21 bp, Homo sapiens
tttctctccttcttccctgtt

SEQ ID NO: 3910725 - DNA, 20 bp, Homo sapiens
tttctcttccctccttccct

SEQ ID NO: 3910726 - DNA, 18 bp, Homo sapiens
tttctgaagctttaccag

SEQ ID NO: 3910727 - DNA, 20 bp, Homo sapiens
tttctgaccaatcactgagt

SEQ ID NO: 3910728 - DNA, 13 bp, Homo sapiens
tttctgagaaaga

SEQ ID NO: 3910729 - DNA, 15 bp, Homo sapiens
tttctgagaaagact

SEQ ID NO: 3910730 - DNA, 16 bp, Homo sapiens
tttctgagcttttcat

SEQ ID NO: 3910731 - DNA, 18 bp, Homo sapiens
tttctgaggagaaacaaa

SEQ ID NO: 3910732 - DNA, 14 bp, Homo sapiens
tttctgcatcagct

SEQ ID NO: 3910733 - DNA, 21 bp, Homo sapiens
tttctggaatacatgaaatat

SEQ ID NO: 3910734 - DNA, 11 bp, Homo sapiens
tttctggagtc

SEQ ID NO: 3910735 - DNA, 23 bp, Homo sapiens
tttctggtgcctatttattcatt

SEQ ID NO: 3910736 - DNA, 13 bp, Homo sapiens
tttctgtctctct

SEQ ID NO: 3910737 - DNA, 17 bp, Homo sapiens
tttctgtctctcttgct

SEQ ID NO: 3910738 - DNA, 22 bp, Homo sapiens
tttctgtgtgcaccttaccaac

SEQ ID NO: 3910739 - DNA, 14 bp, Homo sapiens
tttctgttgccaca

SEQ ID NO: 3910740 - DNA, 17 bp, Homo sapiens
tttcttatcttctgcaa

SEQ ID NO: 3910741 - DNA, 13 bp, Homo sapiens
tttcttcctctgc

SEQ ID NO: 3910742 - DNA, 13 bp, Homo sapiens
tttcttcgctgct

SEQ ID NO: 3910743 - DNA, 18 bp, Homo sapiens
tttcttctacaaccagag

SEQ ID NO: 3910744 - DNA, 21 bp, Homo sapiens
tttcttctacaaccagagccc

SEQ ID NO: 3910745 - DNA, 22 bp, Homo sapiens
tttcttgactcttgttttcagt

SEQ ID NO: 3910746 - DNA, 16 bp, Homo sapiens
tttctttgaatgcttt

SEQ ID NO: 3910747 - DNA, 15 bp, Homo sapiens
tttctttgtaaaggt

SEQ ID NO: 3910748 - DNA, 17 bp, Homo sapiens
tttctttgtgataacaa

SEQ ID NO: 3910749 - DNA, 16 bp, Homo sapiens
tttcttttaaagaagt

SEQ ID NO: 3910750 - DNA, 15 bp, Homo sapiens
tttctttttctggaa

SEQ ID NO: 3910751 - DNA, 17 bp, Homo sapiens
tttctttttctgtctct

SEQ ID NO: 3910752 - DNA, 18 bp, Homo sapiens
tttctttttctgtctctc

SEQ ID NO: 3910753 - DNA, 17 bp, Homo sapiens
tttctttttttaaattg

SEQ ID NO: 3910754 - DNA, 16 bp, Homo sapiens
tttgaatacccccaga

SEQ ID NO: 3910755 - DNA, 13 bp, Homo sapiens
tttgaatatcatt

SEQ ID NO: 3910756 - DNA, 17 bp, Homo sapiens
tttgaatggtgcagaaa

SEQ ID NO: 3910757 - DNA, 14 bp, Homo sapiens
tttgacggatgatt

SEQ ID NO: 3910758 - DNA, 17 bp, Homo sapiens
tttgacgggaggcctca

SEQ ID NO: 3910759 - DNA, 14 bp, Homo sapiens
tttgagaattattc

SEQ ID NO: 3910760 - DNA, 14 bp, Homo sapiens
tttgaggattcctg

SEQ ID NO: 3910761 - DNA, 21 bp, Homo sapiens
tttgatagcagaagaaaaagt

SEQ ID NO: 3910762 - DNA, 13 bp, Homo sapiens
tttgatcaaatct

SEQ ID NO: 3910763 - DNA, 14 bp, Homo sapiens
tttgatggggagaa

SEQ ID NO: 3910764 - DNA, 12 bp, Homo sapiens
tttgcacagctc

SEQ ID NO: 3910765 - DNA, 16 bp, Homo sapiens
tttgcacagctctccg

SEQ ID NO: 3910766 - DNA, 16 bp, Homo sapiens
tttgcaggctctgggc

SEQ ID NO: 3910767 - DNA, 14 bp, Homo sapiens
tttgcattgtgtga

SEQ ID NO: 3910768 - DNA, 17 bp, Homo sapiens
tttgcatttagttttat

SEQ ID NO: 3910769 - DNA, 22 bp, Homo sapiens
tttgccaagcttgtgagagctg

SEQ ID NO: 3910770 - DNA, 18 bp, Homo sapiens
tttgccactttggcttct

SEQ ID NO: 3910771 - DNA, 15 bp, Homo sapiens
tttgccattcctgga

SEQ ID NO: 3910772 - DNA, 12 bp, Homo sapiens
tttgccttttgc

SEQ ID NO: 3910773 - DNA, 15 bp, Homo sapiens
tttgctacaataaat

SEQ ID NO: 3910774 - DNA, 18 bp, Homo sapiens
tttgctacaataaatgct

SEQ ID NO: 3910775 - DNA, 11 bp, Homo sapiens
tttggaaaaat

SEQ ID NO: 3910776 - DNA, 12 bp, Homo sapiens
tttggaaaaatc

SEQ ID NO: 3910777 - DNA, 14 bp, Homo sapiens
tttggaaagagacc

SEQ ID NO: 3910778 - DNA, 15 bp, Homo sapiens
tttggaaagagacca

SEQ ID NO: 3910779 - DNA, 23 bp, Homo sapiens
tttggaagagaggcacctgctgg

SEQ ID NO: 3910780 - DNA, 16 bp, Homo sapiens
tttggactgttttgtt

SEQ ID NO: 3910781 - DNA, 12 bp, Homo sapiens
tttggagtgtgt

SEQ ID NO: 3910782 - DNA, 14 bp, Homo sapiens
tttggctctttcag

SEQ ID NO: 3910783 - DNA, 12 bp, Homo sapiens
tttgggaagggg

SEQ ID NO: 3910784 - DNA, 14 bp, Homo sapiens
tttgggctgccctg

SEQ ID NO: 3910785 - DNA, 22 bp, Homo sapiens
tttgggggttggatgggaagat

SEQ ID NO: 3910786 - DNA, 17 bp, Homo sapiens
tttgggttgtgacccag

SEQ ID NO: 3910787 - DNA, 19 bp, Homo sapiens
tttggtgtaggtaaatcta

SEQ ID NO: 3910788 - DNA, 21 bp, Homo sapiens
tttgtaaaagaacagtaaaca

SEQ ID NO: 3910789 - DNA, 23 bp, Homo sapiens
tttgtaaaagaacagtaaacatt

SEQ ID NO: 3910790 - DNA, 14 bp, Homo sapiens
tttgtaacttcaaa

SEQ ID NO: 3910791 - DNA, 20 bp, Homo sapiens
tttgtaataaaaggtatgaa

SEQ ID NO: 3910792 - DNA, 20 bp, Homo sapiens
tttgtaattgcttacatttt

SEQ ID NO: 3910793 - DNA, 12 bp, Homo sapiens
tttgtacagaat

SEQ ID NO: 3910794 - DNA, 19 bp, Homo sapiens
tttgtacagaatttttaat

SEQ ID NO: 3910795 - DNA, 19 bp, Homo sapiens
tttgtacgttatatattgt

SEQ ID NO: 3910796 - DNA, 15 bp, Homo sapiens
tttgtactgaaaaat

SEQ ID NO: 3910797 - DNA, 17 bp, Homo sapiens
tttgtatagtaaagtga

SEQ ID NO: 3910798 - DNA, 14 bp, Homo sapiens
tttgtatatcatga

SEQ ID NO: 3910799 - DNA, 16 bp, Homo sapiens
tttgtatgcactttgt

SEQ ID NO: 3910800 - DNA, 17 bp, Homo sapiens
tttgtattacatctaat

SEQ ID NO: 3910801 - DNA, 10 bp, Homo sapiens
tttgtatttt

SEQ ID NO: 3910802 - DNA, 19 bp, Homo sapiens
tttgtcatatattcatgta

SEQ ID NO: 3910803 - DNA, 22 bp, Homo sapiens
tttgtcatatattcatgtaata

SEQ ID NO: 3910804 - DNA, 12 bp, Homo sapiens
tttgtcatttta

SEQ ID NO: 3910805 - DNA, 18 bp, Homo sapiens
tttgtcattttaaaatct

SEQ ID NO: 3910806 - DNA, 19 bp, Homo sapiens
tttgtccattttaaaaacc

SEQ ID NO: 3910807 - DNA, 16 bp, Homo sapiens
tttgtccccagggccc

SEQ ID NO: 3910808 - DNA, 18 bp, Homo sapiens
tttgtctctgagaacaga

SEQ ID NO: 3910809 - DNA, 23 bp, Homo sapiens
tttgtgccttaaaaggagagaag

SEQ ID NO: 3910810 - DNA, 14 bp, Homo sapiens
tttgtgctgtgggc

SEQ ID NO: 3910811 - DNA, 22 bp, Homo sapiens
tttgtgctgtgggcagcaccct

SEQ ID NO: 3910812 - DNA, 16 bp, Homo sapiens
tttgtggaggactttg

SEQ ID NO: 3910813 - DNA, 14 bp, Homo sapiens
tttgtggtcacagc

SEQ ID NO: 3910814 - DNA, 17 bp, Homo sapiens
tttgttatagaatactt

SEQ ID NO: 3910815 - DNA, 15 bp, Homo sapiens
tttgttcccaagagc

SEQ ID NO: 3910816 - DNA, 14 bp, Homo sapiens
tttgttctgtattt

SEQ ID NO: 3910817 - DNA, 14 bp, Homo sapiens
tttgttgctgtttt

SEQ ID NO: 3910818 - DNA, 13 bp, Homo sapiens
tttgttgtgactg

SEQ ID NO: 3910819 - DNA, 13 bp, Homo sapiens
tttgttgtgactt

SEQ ID NO: 3910820 - DNA, 22 bp, Homo sapiens
tttgttgtgattttgtacagaa

SEQ ID NO: 3910821 - DNA, 15 bp, Homo sapiens
tttgtttcctttgtt

SEQ ID NO: 3910822 - DNA, 17 bp, Homo sapiens
tttgtttctgagaaaag

SEQ ID NO: 3910823 - DNA, 13 bp, Homo sapiens
tttgtttgtaatc

SEQ ID NO: 3910824 - DNA, 12 bp, Homo sapiens
tttgttttaatt

SEQ ID NO: 3910825 - DNA, 16 bp, Homo sapiens
tttgtttttttccaac

SEQ ID NO: 3910826 - DNA, 22 bp, Homo sapiens
ttttaaaaaatgaaaataagtg

SEQ ID NO: 3910827 - DNA, 17 bp, Homo sapiens
ttttaaaaccatgcagc

SEQ ID NO: 3910828 - DNA, 21 bp, Homo sapiens
ttttaaaagcaattatattgt

SEQ ID NO: 3910829 - DNA, 18 bp, Homo sapiens
ttttaaaagtaaatgtac

SEQ ID NO: 3910830 - DNA, 19 bp, Homo sapiens
ttttaaaatctgatttaat

SEQ ID NO: 3910831 - DNA, 23 bp, Homo sapiens
ttttaaacaaaatagaagctgta

SEQ ID NO: 3910832 - DNA, 19 bp, Homo sapiens
ttttaaacagtgagcctga

SEQ ID NO: 3910833 - DNA, 14 bp, Homo sapiens
ttttaaactagtaa

SEQ ID NO: 3910834 - DNA, 17 bp, Homo sapiens
ttttaaagaagtaaatt

SEQ ID NO: 3910835 - DNA, 20 bp, Homo sapiens
ttttaaaggtagagatgtgt

SEQ ID NO: 3910836 - DNA, 19 bp, Homo sapiens
ttttaaatgcataaatgca

SEQ ID NO: 3910837 - DNA, 13 bp, Homo sapiens
ttttaaatgttca

SEQ ID NO: 3910838 - DNA, 21 bp, Homo sapiens
ttttaaattataacttaaaat

SEQ ID NO: 3910839 - DNA, 16 bp, Homo sapiens
ttttaacaaaagcaag

SEQ ID NO: 3910840 - DNA, 12 bp, Homo sapiens
ttttaacatttt

SEQ ID NO: 3910841 - DNA, 16 bp, Homo sapiens
ttttaacttaaatttt

SEQ ID NO: 3910842 - DNA, 12 bp, Homo sapiens
ttttaagaaaca

SEQ ID NO: 3910843 - DNA, 23 bp, Homo sapiens
ttttaagggtttgtggaaaatga

SEQ ID NO: 3910844 - DNA, 16 bp, Homo sapiens
ttttaatgacttttta

SEQ ID NO: 3910845 - DNA, 12 bp, Homo sapiens
ttttacaataat

SEQ ID NO: 3910846 - DNA, 17 bp, Homo sapiens
ttttacagagaatctga

SEQ ID NO: 3910847 - DNA, 19 bp, Homo sapiens
ttttacagctttacacaca

SEQ ID NO: 3910848 - DNA, 19 bp, Homo sapiens
ttttacctgggatatgaca

SEQ ID NO: 3910849 - DNA, 15 bp, Homo sapiens
ttttactccagtggt

SEQ ID NO: 3910850 - DNA, 20 bp, Homo sapiens
ttttagaattttagaagaga

SEQ ID NO: 3910851 - DNA, 18 bp, Homo sapiens
ttttagatactttgctag

SEQ ID NO: 3910852 - DNA, 18 bp, Homo sapiens
ttttagatgcaatgtgat

SEQ ID NO: 3910853 - DNA, 14 bp, Homo sapiens
ttttaggaaacctg

SEQ ID NO: 3910854 - DNA, 19 bp, Homo sapiens
ttttaggcagggatttgag

SEQ ID NO: 3910855 - DNA, 14 bp, Homo sapiens
ttttataagcaaat

SEQ ID NO: 3910856 - DNA, 17 bp, Homo sapiens
ttttatacatagtcaca

SEQ ID NO: 3910857 - DNA, 19 bp, Homo sapiens
ttttatacatatcagaaaa

SEQ ID NO: 3910858 - DNA, 20 bp, Homo sapiens
ttttatacatatcagaaaag

SEQ ID NO: 3910859 - DNA, 10 bp, Homo sapiens
ttttatacca

SEQ ID NO: 3910860 - DNA, 23 bp, Homo sapiens
ttttatatttagttatagtttca

SEQ ID NO: 3910861 - DNA, 15 bp, Homo sapiens
ttttatggcatgatt

SEQ ID NO: 3910862 - DNA, 18 bp, Homo sapiens
ttttatggcatgatttat

SEQ ID NO: 3910863 - DNA, 16 bp, Homo sapiens
ttttattaaagcaaca

SEQ ID NO: 3910864 - DNA, 14 bp, Homo sapiens
ttttattctgactt

SEQ ID NO: 3910865 - DNA, 19 bp, Homo sapiens
ttttattgagaattttaaa

SEQ ID NO: 3910866 - DNA, 14 bp, Homo sapiens
ttttattgttttca

SEQ ID NO: 3910867 - DNA, 13 bp, Homo sapiens
ttttatttagttc

SEQ ID NO: 3910868 - DNA, 21 bp, Homo sapiens
ttttatttctcgggtgcattt

SEQ ID NO: 3910869 - DNA, 14 bp, Homo sapiens
ttttcaagaaactg

SEQ ID NO: 3910870 - DNA, 15 bp, Homo sapiens
ttttcaagaaactga

SEQ ID NO: 3910871 - DNA, 20 bp, Homo sapiens
ttttcaagagaagaaaaaat

SEQ ID NO: 3910872 - DNA, 21 bp, Homo sapiens
ttttcaagagaagaaaaaatt

SEQ ID NO: 3910873 - DNA, 21 bp, Homo sapiens
ttttcactggagttacattaa

SEQ ID NO: 3910874 - DNA, 17 bp, Homo sapiens
ttttcactttagctatg

SEQ ID NO: 3910875 - DNA, 19 bp, Homo sapiens
ttttcagcccatatttcat

SEQ ID NO: 3910876 - DNA, 22 bp, Homo sapiens
ttttcaggtaggcccttgtcct

SEQ ID NO: 3910877 - DNA, 16 bp, Homo sapiens
ttttcaggtttcttaa

SEQ ID NO: 3910878 - DNA, 23 bp, Homo sapiens
ttttcagtattttggagaaatta

SEQ ID NO: 3910879 - DNA, 17 bp, Homo sapiens
ttttcataacttgctga

SEQ ID NO: 3910880 - DNA, 15 bp, Homo sapiens
ttttcatctgttgtt

SEQ ID NO: 3910881 - DNA, 18 bp, Homo sapiens
ttttcattgaacagcaaa

SEQ ID NO: 3910882 - DNA, 13 bp, Homo sapiens
ttttccaagccct

SEQ ID NO: 3910883 - DNA, 16 bp, Homo sapiens
ttttcccagtaatttg

SEQ ID NO: 3910884 - DNA, 19 bp, Homo sapiens
ttttccccggtcccttgag

SEQ ID NO: 3910885 - DNA, 23 bp, Homo sapiens
ttttcccgagcaaagtctaaagt

SEQ ID NO: 3910886 - DNA, 17 bp, Homo sapiens
ttttcctagccctctca

SEQ ID NO: 3910887 - DNA, 18 bp, Homo sapiens
ttttcctattttcagccc

SEQ ID NO: 3910888 - DNA, 22 bp, Homo sapiens
ttttcctgaatattaatcccag

SEQ ID NO: 3910889 - DNA, 13 bp, Homo sapiens
ttttctaactgta

SEQ ID NO: 3910890 - DNA, 15 bp, Homo sapiens
ttttctaactgtaaa

SEQ ID NO: 3910891 - DNA, 16 bp, Homo sapiens
ttttctaactgtaaat

SEQ ID NO: 3910892 - DNA, 18 bp, Homo sapiens
ttttctaactgtaaatca

SEQ ID NO: 3910893 - DNA, 19 bp, Homo sapiens
ttttctaactgtaaatcac

SEQ ID NO: 3910894 - DNA, 20 bp, Homo sapiens
ttttctacacagtaaaaact

SEQ ID NO: 3910895 - DNA, 18 bp, Homo sapiens
ttttctagactttctgtt

SEQ ID NO: 3910896 - DNA, 15 bp, Homo sapiens
ttttctagtttcagt

SEQ ID NO: 3910897 - DNA, 20 bp, Homo sapiens
ttttctagtttcagtaaata

SEQ ID NO: 3910898 - DNA, 18 bp, Homo sapiens
ttttctcagaacagctga

SEQ ID NO: 3910899 - DNA, 15 bp, Homo sapiens
ttttctccaccaact

SEQ ID NO: 3910900 - DNA, 14 bp, Homo sapiens
ttttctcctaggag

SEQ ID NO: 3910901 - DNA, 19 bp, Homo sapiens
ttttctcctcccaggaact

SEQ ID NO: 3910902 - DNA, 14 bp, Homo sapiens
ttttctctcccata

SEQ ID NO: 3910903 - DNA, 11 bp, Homo sapiens
ttttctggaaa

SEQ ID NO: 3910904 - DNA, 21 bp, Homo sapiens
ttttcttccttctttctcttc

SEQ ID NO: 3910905 - DNA, 18 bp, Homo sapiens
ttttctttctttttctgg

SEQ ID NO: 3910906 - DNA, 12 bp, Homo sapiens
ttttctttgtgt

SEQ ID NO: 3910907 - DNA, 19 bp, Homo sapiens
ttttctttgtgtagctttg

SEQ ID NO: 3910908 - DNA, 19 bp, Homo sapiens
ttttgaagtagtttgtata

SEQ ID NO: 3910909 - DNA, 15 bp, Homo sapiens
ttttgacggatgatt

SEQ ID NO: 3910910 - DNA, 20 bp, Homo sapiens
ttttgacggatgattggatt

SEQ ID NO: 3910911 - DNA, 11 bp, Homo sapiens
ttttgactctt

SEQ ID NO: 3910912 - DNA, 14 bp, Homo sapiens
ttttgagtctcagg

SEQ ID NO: 3910913 - DNA, 21 bp, Homo sapiens
ttttgcacgtcttgctatttg

SEQ ID NO: 3910914 - DNA, 17 bp, Homo sapiens
ttttgcataagattaaa

SEQ ID NO: 3910915 - DNA, 22 bp, Homo sapiens
ttttgcataagattaaaggaag

SEQ ID NO: 3910916 - DNA, 20 bp, Homo sapiens
ttttgcatctcacaaacata

SEQ ID NO: 3910917 - DNA, 19 bp, Homo sapiens
ttttgcatttgaataaagc

SEQ ID NO: 3910918 - DNA, 22 bp, Homo sapiens
ttttgcctggctgtggaggcct

SEQ ID NO: 3910919 - DNA, 11 bp, Homo sapiens
ttttgctgtct

SEQ ID NO: 3910920 - DNA, 18 bp, Homo sapiens
ttttggggggtaatcagc

SEQ ID NO: 3910921 - DNA, 22 bp, Homo sapiens
ttttggttgtcaatattaaata

SEQ ID NO: 3910922 - DNA, 15 bp, Homo sapiens
ttttgtaacaaatga

SEQ ID NO: 3910923 - DNA, 14 bp, Homo sapiens
ttttgtaagacaaa

SEQ ID NO: 3910924 - DNA, 12 bp, Homo sapiens
ttttgtacagaa

SEQ ID NO: 3910925 - DNA, 21 bp, Homo sapiens
ttttgtattacatctaatgct

SEQ ID NO: 3910926 - DNA, 21 bp, Homo sapiens
ttttgtgatgtcccaacttgt

SEQ ID NO: 3910927 - DNA, 13 bp, Homo sapiens
ttttgtgtacagt

SEQ ID NO: 3910928 - DNA, 14 bp, Homo sapiens
ttttgttatagaat

SEQ ID NO: 3910929 - DNA, 16 bp, Homo sapiens
ttttgttatagaatac

SEQ ID NO: 3910930 - DNA, 16 bp, Homo sapiens
ttttgtttgtaatcct

SEQ ID NO: 3910931 - DNA, 12 bp, Homo sapiens
tttttaaattat

SEQ ID NO: 3910932 - DNA, 19 bp, Homo sapiens
tttttaatgactttttata

SEQ ID NO: 3910933 - DNA, 13 bp, Homo sapiens
tttttacaataaa

SEQ ID NO: 3910934 - DNA, 13 bp, Homo sapiens
tttttatacatat

SEQ ID NO: 3910935 - DNA, 12 bp, Homo sapiens
tttttatactcc

SEQ ID NO: 3910936 - DNA, 19 bp, Homo sapiens
tttttcaaagatgtgttgc

SEQ ID NO: 3910937 - DNA, 14 bp, Homo sapiens
tttttccaactgtg

SEQ ID NO: 3910938 - DNA, 15 bp, Homo sapiens
tttttccccaaagtc

SEQ ID NO: 3910939 - DNA, 16 bp, Homo sapiens
tttttccccaaagtct

SEQ ID NO: 3910940 - DNA, 18 bp, Homo sapiens
tttttcctagccctctca

SEQ ID NO: 3910941 - DNA, 22 bp, Homo sapiens
tttttctacacagtaaaaactt

SEQ ID NO: 3910942 - DNA, 17 bp, Homo sapiens
tttttctttataaactt

SEQ ID NO: 3910943 - DNA, 13 bp, Homo sapiens
tttttgtaaactg

SEQ ID NO: 3910944 - DNA, 14 bp, Homo sapiens
tttttgtaaactgt

SEQ ID NO: 3910945 - DNA, 23 bp, Homo sapiens
tttttgtacgttatatattgtat

SEQ ID NO: 3910946 - DNA, 16 bp, Homo sapiens
tttttgtccctgctcc

SEQ ID NO: 3910947 - DNA, 20 bp, Homo sapiens
tttttgtttctgagaaaaga

SEQ ID NO: 3910948 - DNA, 12 bp, Homo sapiens
ttttttaatgta

SEQ ID NO: 3910949 - DNA, 13 bp, Homo sapiens
ttttttattctgt

SEQ ID NO: 3910950 - DNA, 10 bp, Homo sapiens
tttttttcca

SEQ ID NO: 3910951 - DNA, 12 bp, Homo sapiens
tttttttgagat

SEQ ID NO: 3910952 - DNA, 13 bp, Homo sapiens
tttttttgtaaac

SEQ ID NO: 3910953 - DNA, 14 bp, Homo sapiens
tttttttgtaactt

SEQ ID NO: 3910954 - DNA, 22 bp, Homo sapiens
cagccctacatcttcagctccc

SEQ ID NO: 3910955 - DNA, 17 bp, Homo sapiens
cagccctccctgcccct

SEQ ID NO: 3910956 - DNA, 22 bp, Homo sapiens
cagccctccctgcccctccctt

SEQ ID NO: 3910957 - DNA, 18 bp, Homo sapiens
cagccctccctgtcctcc

SEQ ID NO: 3910958 - DNA, 16 bp, Homo sapiens
cagccctcctcacccc

SEQ ID NO: 3910959 - DNA, 12 bp, Homo sapiens
cagccctgccag

SEQ ID NO: 3910960 - DNA, 13 bp, Homo sapiens
cagccctgccagg

SEQ ID NO: 3910961 - DNA, 14 bp, Homo sapiens
cagccctgccagga

SEQ ID NO: 3910962 - DNA, 16 bp, Homo sapiens
cagccctgccaggagg

SEQ ID NO: 3910963 - DNA, 15 bp, Homo sapiens
cagccctgcctggag

SEQ ID NO: 3910964 - DNA, 13 bp, Homo sapiens
cagccctgctttg

SEQ ID NO: 3910965 - DNA, 20 bp, Homo sapiens
cagccctgctttgggctgcc

SEQ ID NO: 3910966 - DNA, 23 bp, Homo sapiens
cagccctgctttgggctgccctg

SEQ ID NO: 3910967 - DNA, 12 bp, Homo sapiens
cagccctggctc

SEQ ID NO: 3910968 - DNA, 12 bp, Homo sapiens
cagccctgggcc

SEQ ID NO: 3910969 - DNA, 19 bp, Homo sapiens
cagccctgggccccaccac

SEQ ID NO: 3910970 - DNA, 16 bp, Homo sapiens
cagccctgggggccag

SEQ ID NO: 3910971 - DNA, 17 bp, Homo sapiens
cagccctgggggccagc

SEQ ID NO: 3910972 - DNA, 23 bp, Homo sapiens
cagccctgtcccctgaaaaactg

SEQ ID NO: 3910973 - DNA, 15 bp, Homo sapiens
cagcccttccctgct

SEQ ID NO: 3910974 - DNA, 16 bp, Homo sapiens
cagcccttccctgctt

SEQ ID NO: 3910975 - DNA, 17 bp, Homo sapiens
cagcccttccctgcttt

SEQ ID NO: 3910976 - DNA, 16 bp, Homo sapiens
cagcccttcctcctga

SEQ ID NO: 3910977 - DNA, 18 bp, Homo sapiens
cagcccttcctcctgaag

SEQ ID NO: 3910978 - DNA, 15 bp, Homo sapiens
cagcccttctgcctt

SEQ ID NO: 3910979 - DNA, 18 bp, Homo sapiens
cagcccttctgcctttct

SEQ ID NO: 3910980 - DNA, 21 bp, Homo sapiens
cagcccttgcccccatccctc

SEQ ID NO: 3910981 - DNA, 14 bp, Homo sapiens
cagccgagccgggc

SEQ ID NO: 3910982 - DNA, 16 bp, Homo sapiens
cagccgcagcgcagcc

SEQ ID NO: 3910983 - DNA, 18 bp, Homo sapiens
cagccgccatcagcccaa

SEQ ID NO: 3910984 - DNA, 13 bp, Homo sapiens
cagccgccctggg

SEQ ID NO: 3910985 - DNA, 18 bp, Homo sapiens
cagccgccgggcaggcct

SEQ ID NO: 3910986 - DNA, 15 bp, Homo sapiens
cagccggtacctggg

SEQ ID NO: 3910987 - DNA, 19 bp, Homo sapiens
cagccggtacctgggaagg

SEQ ID NO: 3910988 - DNA, 13 bp, Homo sapiens
cagccggtgcctg

SEQ ID NO: 3910989 - DNA, 16 bp, Homo sapiens
cagccgtgatgctcag

SEQ ID NO: 3910990 - DNA, 16 bp, Homo sapiens
cagccgtgccttcagc

SEQ ID NO: 3910991 - DNA, 14 bp, Homo sapiens
cagcctcagctcag

SEQ ID NO: 3910992 - DNA, 16 bp, Homo sapiens
cagcctcagctcagcc

SEQ ID NO: 3910993 - DNA, 12 bp, Homo sapiens
cagcctccagag

SEQ ID NO: 3910994 - DNA, 14 bp, Homo sapiens
cagcctccagagcc

SEQ ID NO: 3910995 - DNA, 19 bp, Homo sapiens
cagcctccagagccagcct

SEQ ID NO: 3910996 - DNA, 15 bp, Homo sapiens
cagcctccatgctgc

SEQ ID NO: 3910997 - DNA, 19 bp, Homo sapiens
cagcctcccaagtagctgg

SEQ ID NO: 3910998 - DNA, 16 bp, Homo sapiens
cagcggcccctgcatc

SEQ ID NO: 3910999 - DNA, 20 bp, Homo sapiens
cagcggcccctgcatcccct

SEQ ID NO: 3911000 - DNA, 22 bp, Homo sapiens
cagcgtcccctgctactcctgt

SEQ ID NO: 3911001 - DNA, 12 bp, Homo sapiens
cagcgtggcctt

SEQ ID NO: 3911002 - DNA, 18 bp, Homo sapiens
cagcgtggccttgttctg

SEQ ID NO: 3911003 - DNA, 21 bp, Homo sapiens
cagcgtttagtttctagaggc

SEQ ID NO: 3911004 - DNA, 22 bp, Homo sapiens
cagctaaagcccaacctcctga

SEQ ID NO: 3911005 - DNA, 18 bp, Homo sapiens
cagctaactccagtctcc

SEQ ID NO: 3911006 - DNA, 19 bp, Homo sapiens
cagctaatcagcattctca

SEQ ID NO: 3911007 - DNA, 16 bp, Homo sapiens
cagctaatctgtaggg

SEQ ID NO: 3911008 - DNA, 19 bp, Homo sapiens
cagctaatctgtagggctg

SEQ ID NO: 3911009 - DNA, 13 bp, Homo sapiens
cagctactcagga

SEQ ID NO: 3911010 - DNA, 16 bp, Homo sapiens
cagctactcaggaggc

SEQ ID NO: 3911011 - DNA, 18 bp, Homo sapiens
cagctactcaggaggctg

SEQ ID NO: 3911012 - DNA, 21 bp, Homo sapiens
cagctactctgtccaggccac

SEQ ID NO: 3911013 - DNA, 22 bp, Homo sapiens
cagctactctgtccaggccact

SEQ ID NO: 3911014 - DNA, 14 bp, Homo sapiens
cagctagactggag

SEQ ID NO: 3911015 - DNA, 21 bp, Homo sapiens
cagctagactggagtgaggct

SEQ ID NO: 3911016 - DNA, 20 bp, Homo sapiens
cagctagccaactcctcctt

SEQ ID NO: 3911017 - DNA, 22 bp, Homo sapiens
cagctagccaactcctccttgc

SEQ ID NO: 3911018 - DNA, 16 bp, Homo sapiens
cagctaggactgagga

SEQ ID NO: 3911019 - DNA, 17 bp, Homo sapiens
cagctaggactgaggag

SEQ ID NO: 3911020 - DNA, 20 bp, Homo sapiens
cagctaggactgaggagtgg

SEQ ID NO: 3911021 - DNA, 20 bp, Homo sapiens
cagctagtgacccacatgcc

SEQ ID NO: 3911022 - DNA, 22 bp, Homo sapiens
cagctcaagtcttccctgatca

SEQ ID NO: 3911023 - DNA, 15 bp, Homo sapiens
cagctcagcctcccc

SEQ ID NO: 3911024 - DNA, 20 bp, Homo sapiens
cagctcagcctccccctgct

SEQ ID NO: 3911025 - DNA, 23 bp, Homo sapiens
cagctcagcctccccctgctgct

SEQ ID NO: 3911026 - DNA, 16 bp, Homo sapiens
cagctcaggtgactgg

SEQ ID NO: 3911027 - DNA, 20 bp, Homo sapiens
cagctcaggtgactggagcc

SEQ ID NO: 3911028 - DNA, 16 bp, Homo sapiens
cagctccaacagcttg

SEQ ID NO: 3911029 - DNA, 17 bp, Homo sapiens
cagctccaacagcttga

SEQ ID NO: 3911030 - DNA, 19 bp, Homo sapiens
cagctccagaataccttct

SEQ ID NO: 3911031 - DNA, 12 bp, Homo sapiens
cagctcccaccc

SEQ ID NO: 3911032 - DNA, 14 bp, Homo sapiens
cagctcccacccca

SEQ ID NO: 3911033 - DNA, 19 bp, Homo sapiens
cagctcccatagcgctggc

SEQ ID NO: 3911034 - DNA, 21 bp, Homo sapiens
cagctcccttcccctgcctgg

SEQ ID NO: 3911035 - DNA, 21 bp, Homo sapiens
cagctcctctccttgggctcc

SEQ ID NO: 3911036 - DNA, 22 bp, Homo sapiens
cagctccttttgtccccagggc

SEQ ID NO: 3911037 - DNA, 12 bp, Homo sapiens
cagctctccctc

SEQ ID NO: 3911038 - DNA, 17 bp, Homo sapiens
cagctctccctctggcc

SEQ ID NO: 3911039 - DNA, 20 bp, Homo sapiens
cagctctccctctggccctg

SEQ ID NO: 3911040 - DNA, 21 bp, Homo sapiens
cagctctccctctggccctgc

SEQ ID NO: 3911041 - DNA, 13 bp, Homo sapiens
cagctctctgtat

SEQ ID NO: 3911042 - DNA, 13 bp, Homo sapiens
cagctctgtggcc

SEQ ID NO: 3911043 - DNA, 16 bp, Homo sapiens
cagctctgtggcctgt

SEQ ID NO: 3911044 - DNA, 17 bp, Homo sapiens
cagctctgtggcctgtg

SEQ ID NO: 3911045 - DNA, 22 bp, Homo sapiens
cagctctgtggcctgtgtccag

SEQ ID NO: 3911046 - DNA, 16 bp, Homo sapiens
ttagtaaatccttatt

SEQ ID NO: 3911047 - DNA, 23 bp, Homo sapiens
ttagtaaatccttatttatatat

SEQ ID NO: 3911048 - DNA, 22 bp, Homo sapiens
ttagtaataaaacccagcatgt

SEQ ID NO: 3911049 - DNA, 18 bp, Homo sapiens
ttagtacagtagcttaaa

SEQ ID NO: 3911050 - DNA, 11 bp, Homo sapiens
ttagtgactgt

SEQ ID NO: 3911051 - DNA, 14 bp, Homo sapiens
ttagtgcctgtgtg

SEQ ID NO: 3911052 - DNA, 12 bp, Homo sapiens
ttagtggctttt

SEQ ID NO: 3911053 - DNA, 19 bp, Homo sapiens
ttagtgtgtgtgcatgtgt

SEQ ID NO: 3911054 - DNA, 21 bp, Homo sapiens
ttagtgtgtgtgcatgtgtgt

SEQ ID NO: 3911055 - DNA, 22 bp, Homo sapiens
ttagttatagtttcagatatat

SEQ ID NO: 3911056 - DNA, 17 bp, Homo sapiens
ttagttttatggcatga

SEQ ID NO: 3911057 - DNA, 21 bp, Homo sapiens
ttagttttatggcatgattta

SEQ ID NO: 3911058 - DNA, 17 bp, Homo sapiens
ttataaactagatctcc

SEQ ID NO: 3911059 - DNA, 22 bp, Homo sapiens
ttataaagataaaatatcctca

SEQ ID NO: 3911060 - DNA, 15 bp, Homo sapiens
ttataaataaatgcc

SEQ ID NO: 3911061 - DNA, 16 bp, Homo sapiens
ttataaataaatgcca

SEQ ID NO: 3911062 - DNA, 18 bp, Homo sapiens
ttataaataaatgccaac

SEQ ID NO: 3911063 - DNA, 17 bp, Homo sapiens
ttataaatccaaagtaa

SEQ ID NO: 3911064 - DNA, 21 bp, Homo sapiens
ttataaatgtgtattctggct

SEQ ID NO: 3911065 - DNA, 15 bp, Homo sapiens
ttataacttaaaaaa

SEQ ID NO: 3911066 - DNA, 23 bp, Homo sapiens
ttataagcaaatttcaaaagaca

SEQ ID NO: 3911067 - DNA, 19 bp, Homo sapiens
ttataataatgttctctgg

SEQ ID NO: 3911068 - DNA, 21 bp, Homo sapiens
ttataatataatatggaacct

SEQ ID NO: 3911069 - DNA, 20 bp, Homo sapiens
ttataatcttccatacttct

SEQ ID NO: 3911070 - DNA, 20 bp, Homo sapiens
ttataatgtggatttcctat

SEQ ID NO: 3911071 - DNA, 22 bp, Homo sapiens
ttataatgtggatttcctattt

SEQ ID NO: 3911072 - DNA, 12 bp, Homo sapiens
ttatacatagtc

SEQ ID NO: 3911073 - DNA, 17 bp, Homo sapiens
ttatacatagtcacaaa

SEQ ID NO: 3911074 - DNA, 16 bp, Homo sapiens
ttataccaaagggaaa

SEQ ID NO: 3911075 - DNA, 18 bp, Homo sapiens
ttatactaccaagtgacc

SEQ ID NO: 3911076 - DNA, 22 bp, Homo sapiens
ttatactgtacttaataaattc

SEQ ID NO: 3911077 - DNA, 14 bp, Homo sapiens
ttatagaaagttca

SEQ ID NO: 3911078 - DNA, 14 bp, Homo sapiens
ttatagaatacttt

SEQ ID NO: 3911079 - DNA, 15 bp, Homo sapiens
ttatagaatactttt

SEQ ID NO: 3911080 - DNA, 22 bp, Homo sapiens
ttatagtcatttattttaaaaa

SEQ ID NO: 3911081 - DNA, 20 bp, Homo sapiens
ttatagtttgctttgctttt

SEQ ID NO: 3911082 - DNA, 16 bp, Homo sapiens
ttatatatatatgtat

SEQ ID NO: 3911083 - DNA, 16 bp, Homo sapiens
ttatatatcagttata

SEQ ID NO: 3911084 - DNA, 16 bp, Homo sapiens
ttatatcagcctgagt

SEQ ID NO: 3911085 - DNA, 14 bp, Homo sapiens
ttatatctaattta

SEQ ID NO: 3911086 - DNA, 18 bp, Homo sapiens
ttatatctaatttataca

SEQ ID NO: 3911087 - DNA, 15 bp, Homo sapiens
ttatatctatagtag

SEQ ID NO: 3911088 - DNA, 22 bp, Homo sapiens
ttatatgacaatcctgaagaaa

SEQ ID NO: 3911089 - DNA, 18 bp, Homo sapiens
ttatatgagagaatcaca

SEQ ID NO: 3911090 - DNA, 16 bp, Homo sapiens
ttatatgttaatttgt

SEQ ID NO: 3911091 - DNA, 21 bp, Homo sapiens
ttatatgttaatttgttatgt

SEQ ID NO: 3911092 - DNA, 14 bp, Homo sapiens
ttatattctttaaa

SEQ ID NO: 3911093 - DNA, 15 bp, Homo sapiens
ttatattctttaaat

SEQ ID NO: 3911094 - DNA, 17 bp, Homo sapiens
ttatatttagttatagt

SEQ ID NO: 3911095 - DNA, 14 bp, Homo sapiens
ttatatttggaaag

SEQ ID NO: 3911096 - DNA, 12 bp, Homo sapiens
ttatcacatcaa

SEQ ID NO: 3911097 - DNA, 14 bp, Homo sapiens
ttatcagccatgtt

SEQ ID NO: 3911098 - DNA, 19 bp, Homo sapiens
ttatccacagaaacatttt

SEQ ID NO: 3911099 - DNA, 12 bp, Homo sapiens
ttatccaggact

SEQ ID NO: 3911100 - DNA, 17 bp, Homo sapiens
ttatcctgaaatttcag

SEQ ID NO: 3911101 - DNA, 23 bp, Homo sapiens
ttcatgtaataaatctgagccta

SEQ ID NO: 3911102 - DNA, 15 bp, Homo sapiens
ttcatgtgaaaataa

SEQ ID NO: 3911103 - DNA, 15 bp, Homo sapiens
ttcatgtttgtaaat

SEQ ID NO: 3911104 - DNA, 13 bp, Homo sapiens
ttcattctcctgc

SEQ ID NO: 3911105 - DNA, 13 bp, Homo sapiens
ttcatttaaaatg

SEQ ID NO: 3911106 - DNA, 15 bp, Homo sapiens
ttcatttcactttaa

SEQ ID NO: 3911107 - DNA, 20 bp, Homo sapiens
ttcatttgagttattttaat

SEQ ID NO: 3911108 - DNA, 16 bp, Homo sapiens
ttccaaaacctaaaga

SEQ ID NO: 3911109 - DNA, 19 bp, Homo sapiens
ttccaaataaggatttgtt

SEQ ID NO: 3911110 - DNA, 14 bp, Homo sapiens
ttccaacagtgagt

SEQ ID NO: 3911111 - DNA, 18 bp, Homo sapiens
ttccaaccccagctggcc

SEQ ID NO: 3911112 - DNA, 21 bp, Homo sapiens
ttccaagaaagatccaccctc

SEQ ID NO: 3911113 - DNA, 17 bp, Homo sapiens
ttccaagcccttttaca

SEQ ID NO: 3911114 - DNA, 13 bp, Homo sapiens
ttccaagtaatat

SEQ ID NO: 3911115 - DNA, 22 bp, Homo sapiens
ttccaagttcctgcactccaga

SEQ ID NO: 3911116 - DNA, 14 bp, Homo sapiens
ttccacccattccc

SEQ ID NO: 3911117 - DNA, 14 bp, Homo sapiens
ttccacgatgaaaa

SEQ ID NO: 3911118 - DNA, 19 bp, Homo sapiens
ttccacgatgaaaaacttc

SEQ ID NO: 3911119 - DNA, 19 bp, Homo sapiens
ttccacgtccccctggggc

SEQ ID NO: 3911120 - DNA, 15 bp, Homo sapiens
ttccactactgtgta

SEQ ID NO: 3911121 - DNA, 16 bp, Homo sapiens
ttccactactgtgtag

SEQ ID NO: 3911122 - DNA, 20 bp, Homo sapiens
ttccactcctatggaaaagg

SEQ ID NO: 3911123 - DNA, 21 bp, Homo sapiens
ttccacttagaaattgcattt

SEQ ID NO: 3911124 - DNA, 11 bp, Homo sapiens
ttccagaaaat

SEQ ID NO: 3911125 - DNA, 19 bp, Homo sapiens
ttccagaaaatataaatgc

SEQ ID NO: 3911126 - DNA, 23 bp, Homo sapiens
ttccagaaaatataaatgcatga

SEQ ID NO: 3911127 - DNA, 19 bp, Homo sapiens
ttccagaagatgccctcca

SEQ ID NO: 3911128 - DNA, 15 bp, Homo sapiens
ttccagaccacctgc

SEQ ID NO: 3911129 - DNA, 18 bp, Homo sapiens
ttccagagcactgctcca

SEQ ID NO: 3911130 - DNA, 20 bp, Homo sapiens
ttccagaggctattattttc

SEQ ID NO: 3911131 - DNA, 18 bp, Homo sapiens
ttccagataaccagctgt

SEQ ID NO: 3911132 - DNA, 17 bp, Homo sapiens
ttccagattcttccact

SEQ ID NO: 3911133 - DNA, 23 bp, Homo sapiens
ttccagctagtgacccacatgcc

SEQ ID NO: 3911134 - DNA, 17 bp, Homo sapiens
ttccaggagttctgaag

SEQ ID NO: 3911135 - DNA, 16 bp, Homo sapiens
ttccaggcccctgagg

SEQ ID NO: 3911136 - DNA, 20 bp, Homo sapiens
ttacagaacacgctttcaca

SEQ ID NO: 3911137 - DNA, 21 bp, Homo sapiens
ttacagagaatctgaagctat

SEQ ID NO: 3911138 - DNA, 20 bp, Homo sapiens
ttacagctatgcactgtaaa

SEQ ID NO: 3911139 - DNA, 14 bp, Homo sapiens
ttacagctgcctgc

SEQ ID NO: 3911140 - DNA, 21 bp, Homo sapiens
ttacaggaggttgtggatgct

SEQ ID NO: 3911141 - DNA, 17 bp, Homo sapiens
ttacataatcaaagcta

SEQ ID NO: 3911142 - DNA, 22 bp, Homo sapiens
ttacatatcacctcatggccta

SEQ ID NO: 3911143 - DNA, 14 bp, Homo sapiens
ttacatctgtttta

SEQ ID NO: 3911144 - DNA, 17 bp, Homo sapiens
ttacatgaattgcattt

SEQ ID NO: 3911145 - DNA, 18 bp, Homo sapiens
ttacattaaaacaaaaaa

SEQ ID NO: 3911146 - DNA, 16 bp, Homo sapiens
ttacattaatgttaat

SEQ ID NO: 3911147 - DNA, 13 bp, Homo sapiens
ttacattcctaga

SEQ ID NO: 3911148 - DNA, 12 bp, Homo sapiens
ttacattttccc

SEQ ID NO: 3911149 - DNA, 14 bp, Homo sapiens
ttacatttttacaa

SEQ ID NO: 3911150 - DNA, 15 bp, Homo sapiens
ttacatttttacaat

SEQ ID NO: 3911151 - DNA, 18 bp, Homo sapiens
ttacatttttacaataaa

SEQ ID NO: 3911152 - DNA, 21 bp, Homo sapiens
ttacatttttacaataaataa

SEQ ID NO: 3911153 - DNA, 18 bp, Homo sapiens
ttaccaactttctgtaaa

SEQ ID NO: 3911154 - DNA, 21 bp, Homo sapiens
ttaccaatttaactagtcctg

SEQ ID NO: 3911155 - DNA, 20 bp, Homo sapiens
ttaccatgagaagagggcct

SEQ ID NO: 3911156 - DNA, 21 bp, Homo sapiens
ttacccagtgggacagaggag

SEQ ID NO: 3911157 - DNA, 22 bp, Homo sapiens
ttaccctgcgattttgcctgtg

SEQ ID NO: 3911158 - DNA, 21 bp, Homo sapiens
ttacctaaacagatataaatg

SEQ ID NO: 3911159 - DNA, 12 bp, Homo sapiens
ttacctcctgcc

SEQ ID NO: 3911160 - DNA, 19 bp, Homo sapiens
ttacctcctgcccaggaga

SEQ ID NO: 3911161 - DNA, 20 bp, Homo sapiens
ttacctgacggacgtcctgc

SEQ ID NO: 3911162 - DNA, 19 bp, Homo sapiens
ttaccttagattagctctg

SEQ ID NO: 3911163 - DNA, 21 bp, Homo sapiens
ttacggagggaggacatcata

SEQ ID NO: 3911164 - DNA, 13 bp, Homo sapiens
ttactacagttgt

SEQ ID NO: 3911165 - DNA, 21 bp, Homo sapiens
ttactacttgttacctttccc

SEQ ID NO: 3911166 - DNA, 17 bp, Homo sapiens
ttactattatctgtgct

SEQ ID NO: 3911167 - DNA, 14 bp, Homo sapiens
ttactcacctctct

SEQ ID NO: 3911168 - DNA, 13 bp, Homo sapiens
ttactcagccctg

SEQ ID NO: 3911169 - DNA, 22 bp, Homo sapiens
ttactcagccctgggccccacc

SEQ ID NO: 3911170 - DNA, 19 bp, Homo sapiens
ttactctccaacctggaca

SEQ ID NO: 3911171 - DNA, 13 bp, Homo sapiens
ttactctgagccc

SEQ ID NO: 3911172 - DNA, 15 bp, Homo sapiens
ttactctgagcccag

SEQ ID NO: 3911173 - DNA, 17 bp, Homo sapiens
ttactcttatcattttt

SEQ ID NO: 3911174 - DNA, 14 bp, Homo sapiens
ttactcttcagttt

SEQ ID NO: 3911175 - DNA, 20 bp, Homo sapiens
ttactgaaaacaaaatatct

SEQ ID NO: 3911176 - DNA, 13 bp, Homo sapiens
ttactgaaatgag

SEQ ID NO: 3911177 - DNA, 11 bp, Homo sapiens
ttacttacctg

SEQ ID NO: 3911178 - DNA, 19 bp, Homo sapiens
ttacttcactttaattctc

SEQ ID NO: 3911179 - DNA, 22 bp, Homo sapiens
ttacttccacagaatacaagcc

SEQ ID NO: 3911180 - DNA, 17 bp, Homo sapiens
ttacttgaactttccaa

SEQ ID NO: 3911181 - DNA, 19 bp, Homo sapiens
ttacttgcacaagcttgta

SEQ ID NO: 3911182 - DNA, 16 bp, Homo sapiens
ttacttgtagaaatct

SEQ ID NO: 3911183 - DNA, 20 bp, Homo sapiens
ttacttgtttgtaagattta

SEQ ID NO: 3911184 - DNA, 18 bp, Homo sapiens
ttactttaaaataaaaaa

SEQ ID NO: 3911185 - DNA, 18 bp, Homo sapiens
ttactttctgttgccaca

SEQ ID NO: 3911186 - DNA, 21 bp, Homo sapiens
ttactttggaatgactataaa

SEQ ID NO: 3911187 - DNA, 17 bp, Homo sapiens
ttacttttaaacagtga

SEQ ID NO: 3911188 - DNA, 20 bp, Homo sapiens
ttacttttgtcttcctcact

SEQ ID NO: 3911189 - DNA, 21 bp, Homo sapiens
ttactttttagtcttttactc

SEQ ID NO: 3911190 - DNA, 17 bp, Homo sapiens
ttagaaaacattcatcc

SEQ ID NO: 3911191 - DNA, 23 bp, Homo sapiens
ttagaaacaaatttttttcttgt

SEQ ID NO: 3911192 - DNA, 16 bp, Homo sapiens
ttagaaatgcagaatc

SEQ ID NO: 3911193 - DNA, 22 bp, Homo sapiens
ttagaacaatagctattgcatg

SEQ ID NO: 3911194 - DNA, 20 bp, Homo sapiens
ttagaacactggtttaaagg

SEQ ID NO: 3911195 - DNA, 18 bp, Homo sapiens
ttagaacaggcaagtgaa

SEQ ID NO: 3911196 - DNA, 14 bp, Homo sapiens
ttagaataaaattg

SEQ ID NO: 3911197 - DNA, 12 bp, Homo sapiens
ttagaatgaaaa

SEQ ID NO: 3911198 - DNA, 11 bp, Homo sapiens
ttagaccctgt

SEQ ID NO: 3911199 - DNA, 16 bp, Homo sapiens
ttagagaatatatttt

SEQ ID NO: 3911200 - DNA, 20 bp, Homo sapiens
ttagagaggtagcgagctgc

SEQ ID NO: 3911201 - DNA, 17 bp, Homo sapiens
ttagattagctctggac

SEQ ID NO: 3911202 - DNA, 16 bp, Homo sapiens
ttagattccaggatca

SEQ ID NO: 3911203 - DNA, 20 bp, Homo sapiens
ttagcatgcctccaaaaatt

SEQ ID NO: 3911204 - DNA, 17 bp, Homo sapiens
ttagcccaagaggtctg

SEQ ID NO: 3911205 - DNA, 22 bp, Homo sapiens
ttagcccaagaggtctgagccc

SEQ ID NO: 3911206 - DNA, 18 bp, Homo sapiens
ttagcctttgccctgtca

SEQ ID NO: 3911207 - DNA, 20 bp, Homo sapiens
ttagctgtaaatacatgtgt

SEQ ID NO: 3911208 - DNA, 14 bp, Homo sapiens
ttaggaaacctggc

SEQ ID NO: 3911209 - DNA, 17 bp, Homo sapiens
ttaggaaataaaacctt

SEQ ID NO: 3911210 - DNA, 21 bp, Homo sapiens
ttaggaaataaaacctttcaa

SEQ ID NO: 3911211 - DNA, 21 bp, Homo sapiens
ttaggaggctgcatgctctgg

SEQ ID NO: 3911212 - DNA, 19 bp, Homo sapiens
ttaggatctatgcaatttt

SEQ ID NO: 3911213 - DNA, 13 bp, Homo sapiens
ttaggcagcctgc

SEQ ID NO: 3911214 - DNA, 18 bp, Homo sapiens
ttaggcattatttaatgt

SEQ ID NO: 3911215 - DNA, 22 bp, Homo sapiens
ttaggcgcccatggtacaagga

SEQ ID NO: 3911216 - DNA, 18 bp, Homo sapiens
ttaggcttttaagaaaca

SEQ ID NO: 3911217 - DNA, 15 bp, Homo sapiens
ttagggagagaagat

SEQ ID NO: 3911218 - DNA, 22 bp, Homo sapiens
ttagggcatcctgcccctcgcc

SEQ ID NO: 3911219 - DNA, 19 bp, Homo sapiens
ttaggtttttttgtatagt

SEQ ID NO: 3911220 - DNA, 18 bp, Homo sapiens
ttagtaaagtcaaggaga

SEQ ID NO: 3911221 - DNA, 19 bp, Homo sapiens
ttagtaatagtccaatatt

SEQ ID NO: 3911222 - DNA, 14 bp, Homo sapiens
ttagtacagtagct

SEQ ID NO: 3911223 - DNA, 14 bp, Homo sapiens
ttagtatttttact

SEQ ID NO: 3911224 - DNA, 16 bp, Homo sapiens
ttagtgctttacatgc

SEQ ID NO: 3911225 - DNA, 15 bp, Homo sapiens
ttagtgtgtgtgcat

SEQ ID NO: 3911226 - DNA, 22 bp, Homo sapiens
ttagtgtgtgtgcatgtgtgtg

SEQ ID NO: 3911227 - DNA, 18 bp, Homo sapiens
ggaagaaattcctgtagc

SEQ ID NO: 3911228 - DNA, 23 bp, Homo sapiens
ggaagaaattcctgtagcatctt

SEQ ID NO: 3911229 - DNA, 21 bp, Homo sapiens
ggaagaagagatcaggaagag

SEQ ID NO: 3911230 - DNA, 19 bp, Homo sapiens
ggaagacaggtctagactt

SEQ ID NO: 3911231 - DNA, 13 bp, Homo sapiens
ggaagagaaggga

SEQ ID NO: 3911232 - DNA, 16 bp, Homo sapiens
ggaagagaagggaagc

SEQ ID NO: 3911233 - DNA, 19 bp, Homo sapiens
ggaagagagagagagaggt

SEQ ID NO: 3911234 - DNA, 18 bp, Homo sapiens
ggaagagaggcacctgct

SEQ ID NO: 3911235 - DNA, 19 bp, Homo sapiens
ggaagagaggcacctgctg

SEQ ID NO: 3911236 - DNA, 19 bp, Homo sapiens
ggaagagcagaacggagcc

SEQ ID NO: 3911237 - DNA, 15 bp, Homo sapiens
ggaagagcaggcaca

SEQ ID NO: 3911238 - DNA, 21 bp, Homo sapiens
ggaagagcaggcacatggagg

SEQ ID NO: 3911239 - DNA, 20 bp, Homo sapiens
ggaagagggcagtacctggg

SEQ ID NO: 3911240 - DNA, 14 bp, Homo sapiens
ggaagatgaagaga

SEQ ID NO: 3911241 - DNA, 18 bp, Homo sapiens
ggaagatgaagagaagct

SEQ ID NO: 3911242 - DNA, 20 bp, Homo sapiens
ggaagatgaagagaagctga

SEQ ID NO: 3911243 - DNA, 18 bp, Homo sapiens
ggaagattttaaattcac

SEQ ID NO: 3911244 - DNA, 15 bp, Homo sapiens
ggaagcaagaaagcc

SEQ ID NO: 3911245 - DNA, 14 bp, Homo sapiens
ggaagcaggcagag

SEQ ID NO: 3911246 - DNA, 21 bp, Homo sapiens
ggaagcatgtaggagaatcca

SEQ ID NO: 3911247 - DNA, 11 bp, Homo sapiens
ggaagcccccc

SEQ ID NO: 3911248 - DNA, 16 bp, Homo sapiens
ggaagccctccttcca

SEQ ID NO: 3911249 - DNA, 11 bp, Homo sapiens
ggaagccctgg

SEQ ID NO: 3911250 - DNA, 23 bp, Homo sapiens
ggaagccctggatttcagaaaga

SEQ ID NO: 3911251 - DNA, 18 bp, Homo sapiens
ggaagcctccgtcaggag

SEQ ID NO: 3911252 - DNA, 19 bp, Homo sapiens
ggaagcctccgtcaggaga

SEQ ID NO: 3911253 - DNA, 23 bp, Homo sapiens
ggaagctccactgtcaccctcca

SEQ ID NO: 3911254 - DNA, 14 bp, Homo sapiens
ggaagctgagcagg

SEQ ID NO: 3911255 - DNA, 16 bp, Homo sapiens
ggaagctgagcaggcc

SEQ ID NO: 3911256 - DNA, 18 bp, Homo sapiens
ggaagctgtactcagagc

SEQ ID NO: 3911257 - DNA, 15 bp, Homo sapiens
ggaaggagactcacc

SEQ ID NO: 3911258 - DNA, 20 bp, Homo sapiens
ggaaggagactcacctctgc

SEQ ID NO: 3911259 - DNA, 15 bp, Homo sapiens
ggaaggagacttagg

SEQ ID NO: 3911260 - DNA, 14 bp, Homo sapiens
ggaaggaggcagac

SEQ ID NO: 3911261 - DNA, 13 bp, Homo sapiens
ggaaggagtgaga

SEQ ID NO: 3911262 - DNA, 13 bp, Homo sapiens
ggaaggcaaagcc

SEQ ID NO: 3911263 - DNA, 12 bp, Homo sapiens
ggaaggcagctg

SEQ ID NO: 3911264 - DNA, 14 bp, Homo sapiens
ggaaggcagctgct

SEQ ID NO: 3911265 - DNA, 16 bp, Homo sapiens
ggaaggcaggcagggc

SEQ ID NO: 3911266 - DNA, 20 bp, Homo sapiens
ggaaggctacttcggggctg

SEQ ID NO: 3911267 - DNA, 12 bp, Homo sapiens
ggaaggctggct

SEQ ID NO: 3911268 - DNA, 13 bp, Homo sapiens
ggaaggctggctg

SEQ ID NO: 3911269 - DNA, 15 bp, Homo sapiens
ggaagggacacacac

SEQ ID NO: 3911270 - DNA, 16 bp, Homo sapiens
ggaagggaggggtcct

SEQ ID NO: 3911271 - DNA, 12 bp, Homo sapiens
ggaagggccagg

SEQ ID NO: 3911272 - DNA, 22 bp, Homo sapiens
ggaagggccaggagagagatct

SEQ ID NO: 3911273 - DNA, 16 bp, Homo sapiens
ggaaggggtgccctct

SEQ ID NO: 3911274 - DNA, 21 bp, Homo sapiens
ggaaggtcagttgccatggtt

SEQ ID NO: 3911275 - DNA, 18 bp, Homo sapiens
ggaagtcgtttcaggaca

SEQ ID NO: 3911276 - DNA, 17 bp, Homo sapiens
ggaagtctaggagctgg

SEQ ID NO: 3911277 - DNA, 13 bp, Homo sapiens
ggaagtgaagccc

SEQ ID NO: 3911278 - DNA, 22 bp, Homo sapiens
ggaagtgaatccttaaccctaa

SEQ ID NO: 3911279 - DNA, 19 bp, Homo sapiens
ggaagtgctccccacacgt

SEQ ID NO: 3911280 - DNA, 12 bp, Homo sapiens
ggaagtgttcaa

SEQ ID NO: 3911281 - DNA, 18 bp, Homo sapiens
ggaagtttcatatattgt

SEQ ID NO: 3911282 - DNA, 11 bp, Homo sapiens
ggaagttttca

SEQ ID NO: 3911283 - DNA, 18 bp, Homo sapiens
ggaataagctcccagggc

SEQ ID NO: 3911284 - DNA, 12 bp, Homo sapiens
ggaatacagtgt

SEQ ID NO: 3911285 - DNA, 18 bp, Homo sapiens
ggaatagaaaagatgaga

SEQ ID NO: 3911286 - DNA, 22 bp, Homo sapiens
ggaatagaaaagatgagaggca

SEQ ID NO: 3911287 - DNA, 17 bp, Homo sapiens
ggaatagccagagagga

SEQ ID NO: 3911288 - DNA, 23 bp, Homo sapiens
ggaatatgttcaatgcaaagtaa

SEQ ID NO: 3911289 - DNA, 18 bp, Homo sapiens
ggaatcaatttcccagaa

SEQ ID NO: 3911290 - DNA, 19 bp, Homo sapiens
ggaatcaatttcccagaag

SEQ ID NO: 3911291 - DNA, 15 bp, Homo sapiens
ggaatcacctggagg

SEQ ID NO: 3911292 - DNA, 18 bp, Homo sapiens
ggaatcacctggagggct

SEQ ID NO: 3911293 - DNA, 17 bp, Homo sapiens
ggaatcagcttttaata

SEQ ID NO: 3911294 - DNA, 17 bp, Homo sapiens
ggaatccgcctgcagag

SEQ ID NO: 3911295 - DNA, 19 bp, Homo sapiens
ggaatccgcctgcagagga

SEQ ID NO: 3911296 - DNA, 18 bp, Homo sapiens
ggaatcgatctgtactgt

SEQ ID NO: 3911297 - DNA, 16 bp, Homo sapiens
ggaatctacctgtggt

SEQ ID NO: 3911298 - DNA, 13 bp, Homo sapiens
ggaatctggagag

SEQ ID NO: 3911299 - DNA, 19 bp, Homo sapiens
ggaatctggagagctagaa

SEQ ID NO: 3911300 - DNA, 21 bp, Homo sapiens
ggaatgaccacgggcctcagt

SEQ ID NO: 3911301 - DNA, 21 bp, Homo sapiens
ggaatgcagggaagagggcag

SEQ ID NO: 3911302 - DNA, 21 bp, Homo sapiens
ggaatggaaaaagcagaaggc

SEQ ID NO: 3911303 - DNA, 17 bp, Homo sapiens
ggaatggatggggagaa

SEQ ID NO: 3911304 - DNA, 20 bp, Homo sapiens
ggaatgttccctgcaccctg

SEQ ID NO: 3911305 - DNA, 19 bp, Homo sapiens
ggaatgtttgggcagaagg

SEQ ID NO: 3911306 - DNA, 20 bp, Homo sapiens
ggaattcagcaccctgggtg

SEQ ID NO: 3911307 - DNA, 17 bp, Homo sapiens
ggaattgattcaagatt

SEQ ID NO: 3911308 - DNA, 12 bp, Homo sapiens
ggacaacatttt

SEQ ID NO: 3911309 - DNA, 13 bp, Homo sapiens
ggacaacccagaa

SEQ ID NO: 3911310 - DNA, 13 bp, Homo sapiens
ggacaagaagctg

SEQ ID NO: 3911311 - DNA, 14 bp, Homo sapiens
ggacaagaagctgc

SEQ ID NO: 3911312 - DNA, 15 bp, Homo sapiens
ggacaagaagctgct

SEQ ID NO: 3911313 - DNA, 12 bp, Homo sapiens
ttagttaatatt

SEQ ID NO: 3911314 - DNA, 10 bp, Homo sapiens
ttataaaatt

SEQ ID NO: 3911315 - DNA, 23 bp, Homo sapiens
ttataaagataaaatatcctcag

SEQ ID NO: 3911316 - DNA, 17 bp, Homo sapiens
ttataaataaatgccaa

SEQ ID NO: 3911317 - DNA, 14 bp, Homo sapiens
ttataagcagattt

SEQ ID NO: 3911318 - DNA, 21 bp, Homo sapiens
ttataatgtggatttcctatt

SEQ ID NO: 3911319 - DNA, 21 bp, Homo sapiens
ttataatttttttattactga

SEQ ID NO: 3911320 - DNA, 15 bp, Homo sapiens
ttatacaaaataatt

SEQ ID NO: 3911321 - DNA, 16 bp, Homo sapiens
ttatacacaacattta

SEQ ID NO: 3911322 - DNA, 18 bp, Homo sapiens
ttatacagctcagctttt

SEQ ID NO: 3911323 - DNA, 14 bp, Homo sapiens
ttatacatatcaga

SEQ ID NO: 3911324 - DNA, 16 bp, Homo sapiens
ttatacatatcagaaa

SEQ ID NO: 3911325 - DNA, 18 bp, Homo sapiens
ttatacatatcagaaaag

SEQ ID NO: 3911326 - DNA, 19 bp, Homo sapiens
ttatagagggccaagactt

SEQ ID NO: 3911327 - DNA, 16 bp, Homo sapiens
ttataggatcatttgt

SEQ ID NO: 3911328 - DNA, 18 bp, Homo sapiens
ttatagtatatctggaca

SEQ ID NO: 3911329 - DNA, 12 bp, Homo sapiens
ttatagtttgta

SEQ ID NO: 3911330 - DNA, 15 bp, Homo sapiens
ttatagtttgtacat

SEQ ID NO: 3911331 - DNA, 16 bp, Homo sapiens
ttatagtttgtacatg

SEQ ID NO: 3911332 - DNA, 18 bp, Homo sapiens
ttatataggttgtgcaaa

SEQ ID NO: 3911333 - DNA, 14 bp, Homo sapiens
ttatatatatatgt

SEQ ID NO: 3911334 - DNA, 15 bp, Homo sapiens
ttatatatggcatat

SEQ ID NO: 3911335 - DNA, 11 bp, Homo sapiens
ttatatattgt

SEQ ID NO: 3911336 - DNA, 18 bp, Homo sapiens
ttatatattgtattaagg

SEQ ID NO: 3911337 - DNA, 21 bp, Homo sapiens
ttatatcatcagcataccttt

SEQ ID NO: 3911338 - DNA, 16 bp, Homo sapiens
ttatattctttaaatt

SEQ ID NO: 3911339 - DNA, 17 bp, Homo sapiens
ttatattgtatattctg

SEQ ID NO: 3911340 - DNA, 18 bp, Homo sapiens
ttatatttagttatagtt

SEQ ID NO: 3911341 - DNA, 17 bp, Homo sapiens
ttatatttggaaagaga

SEQ ID NO: 3911342 - DNA, 19 bp, Homo sapiens
ttatatttggaaagagacc

SEQ ID NO: 3911343 - DNA, 18 bp, Homo sapiens
ttatcaaacttgtgctga

SEQ ID NO: 3911344 - DNA, 19 bp, Homo sapiens
ttatcagtgcttaatgtga

SEQ ID NO: 3911345 - DNA, 17 bp, Homo sapiens
ttatcagttaacattaa

SEQ ID NO: 3911346 - DNA, 16 bp, Homo sapiens
ttatcctgaaatttca

SEQ ID NO: 3911347 - DNA, 11 bp, Homo sapiens
ttatctcaaaa

SEQ ID NO: 3911348 - DNA, 19 bp, Homo sapiens
ttatctctatttaatattt

SEQ ID NO: 3911349 - DNA, 18 bp, Homo sapiens
ttatctgagttttattga

SEQ ID NO: 3911350 - DNA, 14 bp, Homo sapiens
ttatctgcctggcc

SEQ ID NO: 3911351 - DNA, 15 bp, Homo sapiens
ttatctgcctggcct

SEQ ID NO: 3911352 - DNA, 20 bp, Homo sapiens
ttatctgcctggcctggctc

SEQ ID NO: 3911353 - DNA, 21 bp, Homo sapiens
ttatctgcctggcctggctcc

SEQ ID NO: 3911354 - DNA, 20 bp, Homo sapiens
ttatctgtattttttacagt

SEQ ID NO: 3911355 - DNA, 19 bp, Homo sapiens
ttatctgtgaccacacgct

SEQ ID NO: 3911356 - DNA, 15 bp, Homo sapiens
ttatctgtgttgtct

SEQ ID NO: 3911357 - DNA, 13 bp, Homo sapiens
ttatcttactttt

SEQ ID NO: 3911358 - DNA, 16 bp, Homo sapiens
ttatctttacttttaa

SEQ ID NO: 3911359 - DNA, 11 bp, Homo sapiens
ttatgaaatgg

SEQ ID NO: 3911360 - DNA, 15 bp, Homo sapiens
ttatgagtttgctta

SEQ ID NO: 3911361 - DNA, 22 bp, Homo sapiens
ttatggaagattttaaattcac

SEQ ID NO: 3911362 - DNA, 18 bp, Homo sapiens
ttatggcaagtgatatca

SEQ ID NO: 3911363 - DNA, 17 bp, Homo sapiens
ttatggctataggtgct

SEQ ID NO: 3911364 - DNA, 22 bp, Homo sapiens
ttatggtcaatcccaaaagtca

SEQ ID NO: 3911365 - DNA, 11 bp, Homo sapiens
ttatggtgaaa

SEQ ID NO: 3911366 - DNA, 13 bp, Homo sapiens
ttatggtttctgc

SEQ ID NO: 3911367 - DNA, 17 bp, Homo sapiens
ttatgtaacatccagaa

SEQ ID NO: 3911368 - DNA, 18 bp, Homo sapiens
ttatgtaacatccagaag

SEQ ID NO: 3911369 - DNA, 13 bp, Homo sapiens
ttatgtagaaata

SEQ ID NO: 3911370 - DNA, 21 bp, Homo sapiens
ttatgtatatactatacaaca

SEQ ID NO: 3911371 - DNA, 18 bp, Homo sapiens
ttatgtatatagatgtgc

SEQ ID NO: 3911372 - DNA, 23 bp, Homo sapiens
ttatgtattattttctatagctc

SEQ ID NO: 3911373 - DNA, 17 bp, Homo sapiens
ttatgtcatcatacatg

SEQ ID NO: 3911374 - DNA, 13 bp, Homo sapiens
ttatgtctaaaga

SEQ ID NO: 3911375 - DNA, 17 bp, Homo sapiens
ttatgtctatttaagcc

SEQ ID NO: 3911376 - DNA, 21 bp, Homo sapiens
ttattaaaatgattgtaaaat

SEQ ID NO: 3911377 - DNA, 13 bp, Homo sapiens
ttattaaagcaac

SEQ ID NO: 3911378 - DNA, 16 bp, Homo sapiens
ttattaataccaaata

SEQ ID NO: 3911379 - DNA, 15 bp, Homo sapiens
ttattaattcattaa

SEQ ID NO: 3911380 - DNA, 21 bp, Homo sapiens
ttattagattctccaaatgat

SEQ ID NO: 3911381 - DNA, 15 bp, Homo sapiens
ttattagttaatata

SEQ ID NO: 3911382 - DNA, 13 bp, Homo sapiens
ttattcatttaaa

SEQ ID NO: 3911383 - DNA, 16 bp, Homo sapiens
ttattcatttaaaatg

SEQ ID NO: 3911384 - DNA, 18 bp, Homo sapiens
ttattcatttaaaatgat

SEQ ID NO: 3911385 - DNA, 20 bp, Homo sapiens
ttattcctgataataattga

SEQ ID NO: 3911386 - DNA, 19 bp, Homo sapiens
ttattgaagatttaccata

SEQ ID NO: 3911387 - DNA, 22 bp, Homo sapiens
ttattgacaataatttcaggtt

SEQ ID NO: 3911388 - DNA, 13 bp, Homo sapiens
ttattgagaattt

SEQ ID NO: 3911389 - DNA, 19 bp, Homo sapiens
ttattgagaattttaaatt

SEQ ID NO: 3911390 - DNA, 17 bp, Homo sapiens
ttattgatttttgtaat

SEQ ID NO: 3911391 - DNA, 19 bp, Homo sapiens
ttattggaagtgttcaaga

SEQ ID NO: 3911392 - DNA, 17 bp, Homo sapiens
ttattgtttaaaatcat

SEQ ID NO: 3911393 - DNA, 13 bp, Homo sapiens
ttatttaatgttt

SEQ ID NO: 3911394 - DNA, 23 bp, Homo sapiens
ttcagagcctagccacctcccac

SEQ ID NO: 3911395 - DNA, 15 bp, Homo sapiens
ttcagatatatatca

SEQ ID NO: 3911396 - DNA, 14 bp, Homo sapiens
ttcagattcccaga

SEQ ID NO: 3911397 - DNA, 15 bp, Homo sapiens
ttcagcacaccccaa

SEQ ID NO: 3911398 - DNA, 17 bp, Homo sapiens
ttcagcacaccccaagg

SEQ ID NO: 3911399 - DNA, 10 bp, Homo sapiens
ttcagcacca

SEQ ID NO: 3911400 - DNA, 13 bp, Homo sapiens
ttcagcaccctgg

SEQ ID NO: 3911401 - DNA, 17 bp, Homo sapiens
ccacctaggccactcct

SEQ ID NO: 3911402 - DNA, 20 bp, Homo sapiens
ccacctaggccactcctcca

SEQ ID NO: 3911403 - DNA, 22 bp, Homo sapiens
ccacctaggccactcctccaaa

SEQ ID NO: 3911404 - DNA, 15 bp, Homo sapiens
ccacctcactcctgt

SEQ ID NO: 3911405 - DNA, 14 bp, Homo sapiens
ccacctcagccttg

SEQ ID NO: 3911406 - DNA, 15 bp, Homo sapiens
ccacctccacccact

SEQ ID NO: 3911407 - DNA, 22 bp, Homo sapiens
ccacctccacccccgccacggc

SEQ ID NO: 3911408 - DNA, 12 bp, Homo sapiens
ccacctcccacc

SEQ ID NO: 3911409 - DNA, 19 bp, Homo sapiens
ccacctcccaccccactcc

SEQ ID NO: 3911410 - DNA, 16 bp, Homo sapiens
ccacctctccttggaa

SEQ ID NO: 3911411 - DNA, 17 bp, Homo sapiens
ccacctctgctgcctcc

SEQ ID NO: 3911412 - DNA, 13 bp, Homo sapiens
ccacctcttcctt

SEQ ID NO: 3911413 - DNA, 19 bp, Homo sapiens
ccacctcttctcttcctgt

SEQ ID NO: 3911414 - DNA, 16 bp, Homo sapiens
ccacctgccagccatc

SEQ ID NO: 3911415 - DNA, 16 bp, Homo sapiens
ccacctgcctatccat

SEQ ID NO: 3911416 - DNA, 15 bp, Homo sapiens
ccacctgctgagaga

SEQ ID NO: 3911417 - DNA, 22 bp, Homo sapiens
ccacctgctgagagacccaagg

SEQ ID NO: 3911418 - DNA, 23 bp, Homo sapiens
ccacctgctgagagacccaagga

SEQ ID NO: 3911419 - DNA, 21 bp, Homo sapiens
ccacctggccccatgtctctc

SEQ ID NO: 3911420 - DNA, 12 bp, Homo sapiens
ccacctgtctgt

SEQ ID NO: 3911421 - DNA, 14 bp, Homo sapiens
ccacctgtctgtct

SEQ ID NO: 3911422 - DNA, 22 bp, Homo sapiens
ccacctgtctgtctgtctgtcc

SEQ ID NO: 3911423 - DNA, 15 bp, Homo sapiens
ccaccttcccagctc

SEQ ID NO: 3911424 - DNA, 11 bp, Homo sapiens
ccaccttcccc

SEQ ID NO: 3911425 - DNA, 20 bp, Homo sapiens
ccaccttccccagactcagc

SEQ ID NO: 3911426 - DNA, 19 bp, Homo sapiens
ccaccttgccaagctttct

SEQ ID NO: 3911427 - DNA, 16 bp, Homo sapiens
ccaccttggactcctc

SEQ ID NO: 3911428 - DNA, 20 bp, Homo sapiens
ccaccttggactcctcccac

SEQ ID NO: 3911429 - DNA, 16 bp, Homo sapiens
ccacgaacgctcttag

SEQ ID NO: 3911430 - DNA, 19 bp, Homo sapiens
ccacgaatttgctggggaa

SEQ ID NO: 3911431 - DNA, 16 bp, Homo sapiens
ccacgagtcacctgca

SEQ ID NO: 3911432 - DNA, 13 bp, Homo sapiens
ccacgatgtcaag

SEQ ID NO: 3911433 - DNA, 19 bp, Homo sapiens
ccacgcccgactagcaggc

SEQ ID NO: 3911434 - DNA, 14 bp, Homo sapiens
ccacgcctcctggc

SEQ ID NO: 3911435 - DNA, 18 bp, Homo sapiens
ccacgcctcctggccaga

SEQ ID NO: 3911436 - DNA, 12 bp, Homo sapiens
ccacgctgtcct

SEQ ID NO: 3911437 - DNA, 21 bp, Homo sapiens
ccacgctgtcctctcgagccc

SEQ ID NO: 3911438 - DNA, 19 bp, Homo sapiens
ccacggacgtttccatcag

SEQ ID NO: 3911439 - DNA, 19 bp, Homo sapiens
ccacggcacctgggccctg

SEQ ID NO: 3911440 - DNA, 20 bp, Homo sapiens
ccacggcacctgggccctgg

SEQ ID NO: 3911441 - DNA, 12 bp, Homo sapiens
ccacggccaccc

SEQ ID NO: 3911442 - DNA, 13 bp, Homo sapiens
ccacggccaccct

SEQ ID NO: 3911443 - DNA, 15 bp, Homo sapiens
ccacggccaccctcc

SEQ ID NO: 3911444 - DNA, 22 bp, Homo sapiens
ccacggccaccctccttcccgc

SEQ ID NO: 3911445 - DNA, 19 bp, Homo sapiens
ccacgggcctcagtttccc

SEQ ID NO: 3911446 - DNA, 20 bp, Homo sapiens
ccacggtgcgtggctgtggc

SEQ ID NO: 3911447 - DNA, 24 bp, Homo sapiens
ccacggtgcgtggctgtggcacag

SEQ ID NO: 3911448 - DNA, 14 bp, Homo sapiens
ccacgtctgccagg

SEQ ID NO: 3911449 - DNA, 15 bp, Homo sapiens
ccacgtctgccaggc

SEQ ID NO: 3911450 - DNA, 16 bp, Homo sapiens
ccacgtctgccaggcc

SEQ ID NO: 3911451 - DNA, 23 bp, Homo sapiens
ccacgtgaatggccctagaactg

SEQ ID NO: 3911452 - DNA, 17 bp, Homo sapiens
ccacgtgagagaatctg

SEQ ID NO: 3911453 - DNA, 23 bp, Homo sapiens
ccacgtgagagaatctgcctgtg

SEQ ID NO: 3911454 - DNA, 15 bp, Homo sapiens
ccacgtgccaggccc

SEQ ID NO: 3911455 - DNA, 23 bp, Homo sapiens
ccacgtgccaggcccggggctgg

SEQ ID NO: 3911456 - DNA, 15 bp, Homo sapiens
ccacgttccttactg

SEQ ID NO: 3911457 - DNA, 20 bp, Homo sapiens
ccacgttccttactgcagaa

SEQ ID NO: 3911458 - DNA, 17 bp, Homo sapiens
ccactaagctttctcct

SEQ ID NO: 3911459 - DNA, 20 bp, Homo sapiens
ccactaccttctgacctccc

SEQ ID NO: 3911460 - DNA, 22 bp, Homo sapiens
ccactaccttctgacctcccca

SEQ ID NO: 3911461 - DNA, 21 bp, Homo sapiens
ccactactgtgtagactcctg

SEQ ID NO: 3911462 - DNA, 22 bp, Homo sapiens
ccactagggtcctggccctctt

SEQ ID NO: 3911463 - DNA, 18 bp, Homo sapiens
ccactaggttctaggtcc

SEQ ID NO: 3911464 - DNA, 21 bp, Homo sapiens
ccactatgtccagctagccaa

SEQ ID NO: 3911465 - DNA, 18 bp, Homo sapiens
ccactcaatatgtgattt

SEQ ID NO: 3911466 - DNA, 12 bp, Homo sapiens
ccactcactcca

SEQ ID NO: 3911467 - DNA, 14 bp, Homo sapiens
ccactcactccagc

SEQ ID NO: 3911468 - DNA, 18 bp, Homo sapiens
ccactcagggctgccact

SEQ ID NO: 3911469 - DNA, 16 bp, Homo sapiens
ccactcagttgttcct

SEQ ID NO: 3911470 - DNA, 17 bp, Homo sapiens
ccactccagacccctgg

SEQ ID NO: 3911471 - DNA, 21 bp, Homo sapiens
ccactccagacccctggcttt

SEQ ID NO: 3911472 - DNA, 17 bp, Homo sapiens
ccactcccaaagctcag

SEQ ID NO: 3911473 - DNA, 15 bp, Homo sapiens
ccactcccccacctg

SEQ ID NO: 3911474 - DNA, 18 bp, Homo sapiens
ccactccctcctaaccta

SEQ ID NO: 3911475 - DNA, 15 bp, Homo sapiens
ccactccctgagctt

SEQ ID NO: 3911476 - DNA, 17 bp, Homo sapiens
ccactcctatggaaaag

SEQ ID NO: 3911477 - DNA, 16 bp, Homo sapiens
ccactcctccaaagga

SEQ ID NO: 3911478 - DNA, 21 bp, Homo sapiens
ccactcctgtcccgccttcct

SEQ ID NO: 3911479 - DNA, 17 bp, Homo sapiens
ccactcgcagtcgcagg

SEQ ID NO: 3911480 - DNA, 23 bp, Homo sapiens
ccactcgggaggctgagacagga

SEQ ID NO: 3911481 - DNA, 23 bp, Homo sapiens
ccactctaggggtcaggctccat

SEQ ID NO: 3911482 - DNA, 13 bp, Homo sapiens
ccactctcaggag

SEQ ID NO: 3911483 - DNA, 18 bp, Homo sapiens
ccactctcattccccagg

SEQ ID NO: 3911484 - DNA, 23 bp, Homo sapiens
ccactctcccctccctcttcctt

SEQ ID NO: 3911485 - DNA, 12 bp, Homo sapiens
ccactctggcag

SEQ ID NO: 3911486 - DNA, 18 bp, Homo sapiens
ccactctggcagccacac

SEQ ID NO: 3911487 - DNA, 16 bp, Homo sapiens
cccaaagtctgtgtga

SEQ ID NO: 3911488 - DNA, 15 bp, Homo sapiens
cccaacaacatccat

SEQ ID NO: 3911489 - DNA, 18 bp, Homo sapiens
cccaacagaaggaaggag

SEQ ID NO: 3911490 - DNA, 18 bp, Homo sapiens
cccaacccgtggaggctg

SEQ ID NO: 3911491 - DNA, 20 bp, Homo sapiens
cccaacccgtggaggctgct

SEQ ID NO: 3911492 - DNA, 21 bp, Homo sapiens
cccaacccgtggaggctgctc

SEQ ID NO: 3911493 - DNA, 13 bp, Homo sapiens
cccaacctcaatg

SEQ ID NO: 3911494 - DNA, 19 bp, Homo sapiens
cccaacctcaatgccctgc

SEQ ID NO: 3911495 - DNA, 15 bp, Homo sapiens
cccaacgcacaggaa

SEQ ID NO: 3911496 - DNA, 14 bp, Homo sapiens
cccaacgggaagca

SEQ ID NO: 3911497 - DNA, 12 bp, Homo sapiens
cccaactcctgg

SEQ ID NO: 3911498 - DNA, 17 bp, Homo sapiens
cccaactcctggaagct

SEQ ID NO: 3911499 - DNA, 17 bp, Homo sapiens
cccaactgctctgccca

SEQ ID NO: 3911500 - DNA, 17 bp, Homo sapiens
cccaagagatgaagagt

SEQ ID NO: 3911501 - DNA, 17 bp, Homo sapiens
cccaagaggtctgagcc

SEQ ID NO: 3911502 - DNA, 20 bp, Homo sapiens
cccaagaggtctgagccctg

SEQ ID NO: 3911503 - DNA, 22 bp, Homo sapiens
cccaagaggtctgagccctggt

SEQ ID NO: 3911504 - DNA, 19 bp, Homo sapiens
cccaagcagcattcagcac

SEQ ID NO: 3911505 - DNA, 16 bp, Homo sapiens
cccaagcagccagcca

SEQ ID NO: 3911506 - DNA, 22 bp, Homo sapiens
cccaagctttgaatacccccag

SEQ ID NO: 3911507 - DNA, 23 bp, Homo sapiens
cccaagctttgaatacccccaga

SEQ ID NO: 3911508 - DNA, 17 bp, Homo sapiens
cccaaggaacaagagaa

SEQ ID NO: 3911509 - DNA, 14 bp, Homo sapiens
cccaaggactctgg

SEQ ID NO: 3911510 - DNA, 18 bp, Homo sapiens
cccaaggactctggcctc

SEQ ID NO: 3911511 - DNA, 23 bp, Homo sapiens
cccaaggagctgatttccaggcc

SEQ ID NO: 3911512 - DNA, 12 bp, Homo sapiens
cccaataaaagt

SEQ ID NO: 3911513 - DNA, 13 bp, Homo sapiens
cccaatcatttgc

SEQ ID NO: 3911514 - DNA, 14 bp, Homo sapiens
cccaatgctttggg

SEQ ID NO: 3911515 - DNA, 16 bp, Homo sapiens
cccaattcaggactgg

SEQ ID NO: 3911516 - DNA, 13 bp, Homo sapiens
cccacaaactgat

SEQ ID NO: 3911517 - DNA, 13 bp, Homo sapiens
cccacaaagggga

SEQ ID NO: 3911518 - DNA, 15 bp, Homo sapiens
cccacaaaggggaga

SEQ ID NO: 3911519 - DNA, 22 bp, Homo sapiens
cccacaaataatgaacagcaga

SEQ ID NO: 3911520 - DNA, 20 bp, Homo sapiens
cccacaagccttactcacct

SEQ ID NO: 3911521 - DNA, 14 bp, Homo sapiens
cccacaatgatgat

SEQ ID NO: 3911522 - DNA, 20 bp, Homo sapiens
cccacacatgtttacagaac

SEQ ID NO: 3911523 - DNA, 21 bp, Homo sapiens
cccacacatgtttacagaact

SEQ ID NO: 3911524 - DNA, 17 bp, Homo sapiens
cccacacccctccaaag

SEQ ID NO: 3911525 - DNA, 18 bp, Homo sapiens
cccacacctccctactcc

SEQ ID NO: 3911526 - DNA, 21 bp, Homo sapiens
cccacacgtgctcgcagcctg

SEQ ID NO: 3911527 - DNA, 18 bp, Homo sapiens
cccacagacagatcccat

SEQ ID NO: 3911528 - DNA, 20 bp, Homo sapiens
cccacagagatgcatgcgca

SEQ ID NO: 3911529 - DNA, 14 bp, Homo sapiens
cccacagcacccag

SEQ ID NO: 3911530 - DNA, 16 bp, Homo sapiens
cccacagcacccaggc

SEQ ID NO: 3911531 - DNA, 18 bp, Homo sapiens
cccacagcacccaggctc

SEQ ID NO: 3911532 - DNA, 18 bp, Homo sapiens
cccacagcctctgcctgt

SEQ ID NO: 3911533 - DNA, 12 bp, Homo sapiens
cccacagctccc

SEQ ID NO: 3911534 - DNA, 15 bp, Homo sapiens
cccacagctcccacc

SEQ ID NO: 3911535 - DNA, 17 bp, Homo sapiens
cccacagctcccacccc

SEQ ID NO: 3911536 - DNA, 22 bp, Homo sapiens
cccacagtcctcacagcctctc

SEQ ID NO: 3911537 - DNA, 19 bp, Homo sapiens
cccacatagtgatggttcc

SEQ ID NO: 3911538 - DNA, 13 bp, Homo sapiens
cccacatcccagg

SEQ ID NO: 3911539 - DNA, 20 bp, Homo sapiens
cccacatcccaggcttcacc

SEQ ID NO: 3911540 - DNA, 13 bp, Homo sapiens
cccacatccctgg

SEQ ID NO: 3911541 - DNA, 21 bp, Homo sapiens
cccacatccctgggcctgctg

SEQ ID NO: 3911542 - DNA, 20 bp, Homo sapiens
cccacattcggaccctgccc

SEQ ID NO: 3911543 - DNA, 19 bp, Homo sapiens
cccacattggacttccttg

SEQ ID NO: 3911544 - DNA, 16 bp, Homo sapiens
cccaccaaactgcaca

SEQ ID NO: 3911545 - DNA, 15 bp, Homo sapiens
cccaccaactctgca

SEQ ID NO: 3911546 - DNA, 18 bp, Homo sapiens
cccaccaactctgcactc

SEQ ID NO: 3911547 - DNA, 20 bp, Homo sapiens
cccaccacctaggccactcc

SEQ ID NO: 3911548 - DNA, 21 bp, Homo sapiens
cccaccacctaggccactcct

SEQ ID NO: 3911549 - DNA, 18 bp, Homo sapiens
cccaccaccttggactcc

SEQ ID NO: 3911550 - DNA, 20 bp, Homo sapiens
cccaccaccttggactcctc

SEQ ID NO: 3911551 - DNA, 23 bp, Homo sapiens
cccaccaccttggactcctccca

SEQ ID NO: 3911552 - DNA, 17 bp, Homo sapiens
cccacccatcttcctgc

SEQ ID NO: 3911553 - DNA, 21 bp, Homo sapiens
cccacccatcttcctgctgct

SEQ ID NO: 3911554 - DNA, 15 bp, Homo sapiens
cccaccccactccag

SEQ ID NO: 3911555 - DNA, 19 bp, Homo sapiens
cccaccccactccagccct

SEQ ID NO: 3911556 - DNA, 17 bp, Homo sapiens
cccaccccctccccagg

SEQ ID NO: 3911557 - DNA, 19 bp, Homo sapiens
cccaccccctccccagggg

SEQ ID NO: 3911558 - DNA, 23 bp, Homo sapiens
cccacccccttcagtgcccacca

SEQ ID NO: 3911559 - DNA, 19 bp, Homo sapiens
cccaccctcaaaccctgtg

SEQ ID NO: 3911560 - DNA, 23 bp, Homo sapiens
cccaccctcgtggacacctgccc

SEQ ID NO: 3911561 - DNA, 21 bp, Homo sapiens
cccaccgggagcctccccctc

SEQ ID NO: 3911562 - DNA, 19 bp, Homo sapiens
cccaccgggccactccttc

SEQ ID NO: 3911563 - DNA, 17 bp, Homo sapiens
cccacctcttccttccg

SEQ ID NO: 3911564 - DNA, 17 bp, Homo sapiens
cccacctgacaatggca

SEQ ID NO: 3911565 - DNA, 21 bp, Homo sapiens
cccacctgacaatggcagcta

SEQ ID NO: 3911566 - DNA, 13 bp, Homo sapiens
cccacctgctgag

SEQ ID NO: 3911567 - DNA, 17 bp, Homo sapiens
cccacctttaagtcctc

SEQ ID NO: 3911568 - DNA, 18 bp, Homo sapiens
cccacctttaagtcctct

SEQ ID NO: 3911569 - DNA, 19 bp, Homo sapiens
cccacctttgggatcagcc

SEQ ID NO: 3911570 - DNA, 20 bp, Homo sapiens
cccacgactgttgtacaagc

SEQ ID NO: 3911571 - DNA, 13 bp, Homo sapiens
cccacgagtcacc

SEQ ID NO: 3911572 - DNA, 15 bp, Homo sapiens
cccacgagtcacctg

SEQ ID NO: 3911573 - DNA, 15 bp, Homo sapiens
cggcctgctcccagc

SEQ ID NO: 3911574 - DNA, 13 bp, Homo sapiens
cggcgcggtggct

SEQ ID NO: 3911575 - DNA, 21 bp, Homo sapiens
cggcggtggactgcgctggac

SEQ ID NO: 3911576 - DNA, 16 bp, Homo sapiens
cggctaactctggcac

SEQ ID NO: 3911577 - DNA, 20 bp, Homo sapiens
cggctactcagcagccctcc

SEQ ID NO: 3911578 - DNA, 16 bp, Homo sapiens
cggctccaggtccgga

SEQ ID NO: 3911579 - DNA, 20 bp, Homo sapiens
cggctccaggtccggagggg

SEQ ID NO: 3911580 - DNA, 23 bp, Homo sapiens
cggctgagtcatgatctccctgc

SEQ ID NO: 3911581 - DNA, 11 bp, Homo sapiens
cggctgcctgc

SEQ ID NO: 3911582 - DNA, 22 bp, Homo sapiens
cggctgcctgccgcccaaagag

SEQ ID NO: 3911583 - DNA, 19 bp, Homo sapiens
cggcttattagtgaaactg

SEQ ID NO: 3911584 - DNA, 14 bp, Homo sapiens
cggcttggccgcca

SEQ ID NO: 3911585 - DNA, 15 bp, Homo sapiens
cggcttggccgccat

SEQ ID NO: 3911586 - DNA, 18 bp, Homo sapiens
cgggacacctgccctgcc

SEQ ID NO: 3911587 - DNA, 12 bp, Homo sapiens
cgggacagagag

SEQ ID NO: 3911588 - DNA, 17 bp, Homo sapiens
cgggaccattgacctca

SEQ ID NO: 3911589 - DNA, 12 bp, Homo sapiens
cgggacgcttcc

SEQ ID NO: 3911590 - DNA, 22 bp, Homo sapiens
cgggacgcttccagaccacctg

SEQ ID NO: 3911591 - DNA, 21 bp, Homo sapiens
cgggagatggacccctccctt

SEQ ID NO: 3911592 - DNA, 18 bp, Homo sapiens
cgggagcctccccctcag

SEQ ID NO: 3911593 - DNA, 19 bp, Homo sapiens
cgggaggcaccagctctgt

SEQ ID NO: 3911594 - DNA, 21 bp, Homo sapiens
cgggaggcaccagctctgtgg

SEQ ID NO: 3911595 - DNA, 16 bp, Homo sapiens
cgggaggcctcagttc

SEQ ID NO: 3911596 - DNA, 18 bp, Homo sapiens
cgggaggctgagacagga

SEQ ID NO: 3911597 - DNA, 22 bp, Homo sapiens
cgggccactccttcctgcccca

SEQ ID NO: 3911598 - DNA, 13 bp, Homo sapiens
cgggcctcagttt

SEQ ID NO: 3911599 - DNA, 14 bp, Homo sapiens
cgggcctcttccct

SEQ ID NO: 3911600 - DNA, 18 bp, Homo sapiens
cgggcctcttccctcagt

SEQ ID NO: 3911601 - DNA, 16 bp, Homo sapiens
cgggcctggagaacta

SEQ ID NO: 3911602 - DNA, 15 bp, Homo sapiens
cgggcggaggcggct

SEQ ID NO: 3911603 - DNA, 15 bp, Homo sapiens
cgggctctgacagcc

SEQ ID NO: 3911604 - DNA, 14 bp, Homo sapiens
cgggctctggccac

SEQ ID NO: 3911605 - DNA, 23 bp, Homo sapiens
cgggctgcccttcgctgccagga

SEQ ID NO: 3911606 - DNA, 14 bp, Homo sapiens
cgggctgtgcctta

SEQ ID NO: 3911607 - DNA, 15 bp, Homo sapiens
cgggcttttccccgg

SEQ ID NO: 3911608 - DNA, 15 bp, Homo sapiens
cggggaactcctgga

SEQ ID NO: 3911609 - DNA, 15 bp, Homo sapiens
cggggaactggccaa

SEQ ID NO: 3911610 - DNA, 17 bp, Homo sapiens
cggggaactggccaagc

SEQ ID NO: 3911611 - DNA, 15 bp, Homo sapiens
cggggagggggacgc

SEQ ID NO: 3911612 - DNA, 22 bp, Homo sapiens
cggggaggtgcctgagctgggg

SEQ ID NO: 3911613 - DNA, 15 bp, Homo sapiens
cggggcactgcaggg

SEQ ID NO: 3911614 - DNA, 16 bp, Homo sapiens
cggggcaggaggcctg

SEQ ID NO: 3911615 - DNA, 18 bp, Homo sapiens
cggggcccttggggcctg

SEQ ID NO: 3911616 - DNA, 22 bp, Homo sapiens
cggggcccttggggcctggctt

SEQ ID NO: 3911617 - DNA, 13 bp, Homo sapiens
cgggggagctgga

SEQ ID NO: 3911618 - DNA, 16 bp, Homo sapiens
cgggggagctggaaat

SEQ ID NO: 3911619 - DNA, 18 bp, Homo sapiens
cgggggagctggaaataa

SEQ ID NO: 3911620 - DNA, 14 bp, Homo sapiens
cgggggaggaaggg

SEQ ID NO: 3911621 - DNA, 18 bp, Homo sapiens
cgggggccagacacagat

SEQ ID NO: 3911622 - DNA, 18 bp, Homo sapiens
cgggggcccgaaagctga

SEQ ID NO: 3911623 - DNA, 21 bp, Homo sapiens
cgggggtgcggcaggagcagg

SEQ ID NO: 3911624 - DNA, 16 bp, Homo sapiens
cggggtattttaggca

SEQ ID NO: 3911625 - DNA, 23 bp, Homo sapiens
cggggtctgtgctgtgcctgcta

SEQ ID NO: 3911626 - DNA, 16 bp, Homo sapiens
cggggtgcacaggagg

SEQ ID NO: 3911627 - DNA, 18 bp, Homo sapiens
cggggtgcacaggagggg

SEQ ID NO: 3911628 - DNA, 20 bp, Homo sapiens
cgggtgcctcagagcaggct

SEQ ID NO: 3911629 - DNA, 23 bp, Homo sapiens
cgggtggaaaagaatccctgcag

SEQ ID NO: 3911630 - DNA, 13 bp, Homo sapiens
cgggtgggcctgg

SEQ ID NO: 3911631 - DNA, 14 bp, Homo sapiens
cgggtgggcctggc

SEQ ID NO: 3911632 - DNA, 17 bp, Homo sapiens
cgggtgtgcctgccctg

SEQ ID NO: 3911633 - DNA, 18 bp, Homo sapiens
cgggtgtgcctgccctgg

SEQ ID NO: 3911634 - DNA, 14 bp, Homo sapiens
cgggtgtggcctca

SEQ ID NO: 3911635 - DNA, 15 bp, Homo sapiens
cgggtgtggcctcag

SEQ ID NO: 3911636 - DNA, 18 bp, Homo sapiens
cgggtgtggcctcagccc

SEQ ID NO: 3911637 - DNA, 19 bp, Homo sapiens
cgggtgtggcctcagccct

SEQ ID NO: 3911638 - DNA, 16 bp, Homo sapiens
cgggttgtgtgtctgt

SEQ ID NO: 3911639 - DNA, 22 bp, Homo sapiens
cggtcaaaatattttttaaagt

SEQ ID NO: 3911640 - DNA, 19 bp, Homo sapiens
cggtcagatttgctgttca

SEQ ID NO: 3911641 - DNA, 19 bp, Homo sapiens
cggtcccttgagacctcag

SEQ ID NO: 3911642 - DNA, 22 bp, Homo sapiens
cggtcccttgagacctcagcca

SEQ ID NO: 3911643 - DNA, 19 bp, Homo sapiens
cggtcctttaggcagcctg

SEQ ID NO: 3911644 - DNA, 11 bp, Homo sapiens
cggtgcctggc

SEQ ID NO: 3911645 - DNA, 19 bp, Homo sapiens
cggtgcctgggtggggctg

SEQ ID NO: 3911646 - DNA, 16 bp, Homo sapiens
cggtggacccagacac

SEQ ID NO: 3911647 - DNA, 19 bp, Homo sapiens
cggtgggacagccccaggg

SEQ ID NO: 3911648 - DNA, 20 bp, Homo sapiens
cggtgggacagccccagggc

SEQ ID NO: 3911649 - DNA, 18 bp, Homo sapiens
ctatggatgtggggtccc

SEQ ID NO: 3911650 - DNA, 18 bp, Homo sapiens
ctatggtatgctggccag

SEQ ID NO: 3911651 - DNA, 19 bp, Homo sapiens
ctatggtatgctggccagc

SEQ ID NO: 3911652 - DNA, 18 bp, Homo sapiens
ctatggttcccaataaaa

SEQ ID NO: 3911653 - DNA, 19 bp, Homo sapiens
ctatgtcaatttgtatatc

SEQ ID NO: 3911654 - DNA, 21 bp, Homo sapiens
ctatgtcctaaggacacacta

SEQ ID NO: 3911655 - DNA, 22 bp, Homo sapiens
ctatgtcctaaggacacactaa

SEQ ID NO: 3911656 - DNA, 23 bp, Homo sapiens
ctatgtcctaaggacacactaat

SEQ ID NO: 3911657 - DNA, 19 bp, Homo sapiens
ctatgttccaataaaactt

SEQ ID NO: 3911658 - DNA, 13 bp, Homo sapiens
ctatgttccctcc

SEQ ID NO: 3911659 - DNA, 21 bp, Homo sapiens
ctatgttgcccaggctgctct

SEQ ID NO: 3911660 - DNA, 17 bp, Homo sapiens
ctattaccatgagaaga

SEQ ID NO: 3911661 - DNA, 15 bp, Homo sapiens
ctattacttgaactt

SEQ ID NO: 3911662 - DNA, 18 bp, Homo sapiens
ctattacttgaactttcc

SEQ ID NO: 3911663 - DNA, 14 bp, Homo sapiens
ctattataaaacca

SEQ ID NO: 3911664 - DNA, 16 bp, Homo sapiens
ctattataaaaccatg

SEQ ID NO: 3911665 - DNA, 17 bp, Homo sapiens
ctattataatttaatgc

SEQ ID NO: 3911666 - DNA, 15 bp, Homo sapiens
ctattatctgtgctt

SEQ ID NO: 3911667 - DNA, 20 bp, Homo sapiens
ctattatgtaacatccagaa

SEQ ID NO: 3911668 - DNA, 16 bp, Homo sapiens
ctattcaaacagtctc

SEQ ID NO: 3911669 - DNA, 13 bp, Homo sapiens
ctattcagacaag

SEQ ID NO: 3911670 - DNA, 14 bp, Homo sapiens
ctattcagacaagc

SEQ ID NO: 3911671 - DNA, 17 bp, Homo sapiens
ctattcagacaagcaac

SEQ ID NO: 3911672 - DNA, 16 bp, Homo sapiens
ctattctcaccaggaa

SEQ ID NO: 3911673 - DNA, 18 bp, Homo sapiens
ctattctctcctcagact

SEQ ID NO: 3911674 - DNA, 14 bp, Homo sapiens
ctattgaaattact

SEQ ID NO: 3911675 - DNA, 14 bp, Homo sapiens
ctattgagaaagac

SEQ ID NO: 3911676 - DNA, 18 bp, Homo sapiens
ctattgatgtttccagaa

SEQ ID NO: 3911677 - DNA, 23 bp, Homo sapiens
ctattgatgtttccagaaaatat

SEQ ID NO: 3911678 - DNA, 19 bp, Homo sapiens
ctattgcatgtaaaatgca

SEQ ID NO: 3911679 - DNA, 20 bp, Homo sapiens
ctattgcatgtaaaatgcag

SEQ ID NO: 3911680 - DNA, 15 bp, Homo sapiens
ctattgttgtgggct

SEQ ID NO: 3911681 - DNA, 16 bp, Homo sapiens
ctattgttgtgggctt

SEQ ID NO: 3911682 - DNA, 22 bp, Homo sapiens
ctattgtttaaaaacaggaaaa

SEQ ID NO: 3911683 - DNA, 22 bp, Homo sapiens
ctattgtttattctttttaaag

SEQ ID NO: 3911684 - DNA, 23 bp, Homo sapiens
ctatttaaaaaataaaaaaatac

SEQ ID NO: 3911685 - DNA, 17 bp, Homo sapiens
ctatttaaaagtataaa

SEQ ID NO: 3911686 - DNA, 21 bp, Homo sapiens
ctatttaaaagtataaaactg

SEQ ID NO: 3911687 - DNA, 11 bp, Homo sapiens
ctatttattgg

SEQ ID NO: 3911688 - DNA, 16 bp, Homo sapiens
ctatttattggggtgc

SEQ ID NO: 3911689 - DNA, 22 bp, Homo sapiens
ctatttatttttgcaaaccctg

SEQ ID NO: 3911690 - DNA, 22 bp, Homo sapiens
ctatttccccaggggaaaatga

SEQ ID NO: 3911691 - DNA, 23 bp, Homo sapiens
ctatttccccaggggaaaatgaa

SEQ ID NO: 3911692 - DNA, 16 bp, Homo sapiens
ctatttctctccccac

SEQ ID NO: 3911693 - DNA, 14 bp, Homo sapiens
ctattttaaaacca

SEQ ID NO: 3911694 - DNA, 18 bp, Homo sapiens
ctattttaaaaccatgca

SEQ ID NO: 3911695 - DNA, 16 bp, Homo sapiens
ctattttatttgtatt

SEQ ID NO: 3911696 - DNA, 13 bp, Homo sapiens
ctatttttgagga

SEQ ID NO: 3911697 - DNA, 13 bp, Homo sapiens
ctcaaactcaagg

SEQ ID NO: 3911698 - DNA, 20 bp, Homo sapiens
ctcaaactcctggactcatg

SEQ ID NO: 3911699 - DNA, 14 bp, Homo sapiens
ctcaaagagactcc

SEQ ID NO: 3911700 - DNA, 13 bp, Homo sapiens
ctcaaatctattc

SEQ ID NO: 3911701 - DNA, 23 bp, Homo sapiens
ctcaaattaatctttctttacct

SEQ ID NO: 3911702 - DNA, 14 bp, Homo sapiens
ctcaacaataaaac

SEQ ID NO: 3911703 - DNA, 14 bp, Homo sapiens
ctcaacaataaaga

SEQ ID NO: 3911704 - DNA, 18 bp, Homo sapiens
ctcaaccccaccacttct

SEQ ID NO: 3911705 - DNA, 20 bp, Homo sapiens
ctcaacctaccaccccttcc

SEQ ID NO: 3911706 - DNA, 20 bp, Homo sapiens
ctcaagaagacatggagact

SEQ ID NO: 3911707 - DNA, 16 bp, Homo sapiens
ctcaagaggcccaggg

SEQ ID NO: 3911708 - DNA, 17 bp, Homo sapiens
ctcaagaggcccaggga

SEQ ID NO: 3911709 - DNA, 20 bp, Homo sapiens
ctcaagaggcccagggagca

SEQ ID NO: 3911710 - DNA, 19 bp, Homo sapiens
ctcaagagggcactggtgg

SEQ ID NO: 3911711 - DNA, 16 bp, Homo sapiens
ctcaagcagtcctccc

SEQ ID NO: 3911712 - DNA, 20 bp, Homo sapiens
ctcaagtctagaaaccagta

SEQ ID NO: 3911713 - DNA, 16 bp, Homo sapiens
ctcaagtcttccctga

SEQ ID NO: 3911714 - DNA, 18 bp, Homo sapiens
ctcaagtcttccctgatc

SEQ ID NO: 3911715 - DNA, 17 bp, Homo sapiens
ctcaatattcaataaag

SEQ ID NO: 3911716 - DNA, 14 bp, Homo sapiens
ctcaatcactgctc

SEQ ID NO: 3911717 - DNA, 23 bp, Homo sapiens
ctcaatcactgctcccccgtgtg

SEQ ID NO: 3911718 - DNA, 16 bp, Homo sapiens
ctcaatcagtgcagtg

SEQ ID NO: 3911719 - DNA, 21 bp, Homo sapiens
ctcaatcttcggggtgtgatg

SEQ ID NO: 3911720 - DNA, 14 bp, Homo sapiens
ctcaatgccctgcc

SEQ ID NO: 3911721 - DNA, 17 bp, Homo sapiens
ctcaatgccctgccatt

SEQ ID NO: 3911722 - DNA, 17 bp, Homo sapiens
ctcaatggacttcaaat

SEQ ID NO: 3911723 - DNA, 18 bp, Homo sapiens
ctcaatggacttcaaatt

SEQ ID NO: 3911724 - DNA, 11 bp, Homo sapiens
ctcaatgtgaa

SEQ ID NO: 3911725 - DNA, 13 bp, Homo sapiens
ctcaatgtgaaaa

SEQ ID NO: 3911726 - DNA, 20 bp, Homo sapiens
ctcaatgtgaatcagaccct

SEQ ID NO: 3911727 - DNA, 21 bp, Homo sapiens
ctcaatgtgaatcagacccta

SEQ ID NO: 3911728 - DNA, 15 bp, Homo sapiens
ctcacaagaagacca

SEQ ID NO: 3911729 - DNA, 17 bp, Homo sapiens
ctcacaagaagaccaga

SEQ ID NO: 3911730 - DNA, 13 bp, Homo sapiens
ctcacaagcccag

SEQ ID NO: 3911731 - DNA, 14 bp, Homo sapiens
ctcacaagcccagg

SEQ ID NO: 3911732 - DNA, 19 bp, Homo sapiens
ctcacaaggcagcaaggcc

SEQ ID NO: 3911733 - DNA, 20 bp, Homo sapiens
ctcacaaggcagcaaggccc

SEQ ID NO: 3911734 - DNA, 21 bp, Homo sapiens
ctcacaaggcagcaaggcccg

SEQ ID NO: 3911735 - DNA, 14 bp, Homo sapiens
ctaagctttctcct

SEQ ID NO: 3911736 - DNA, 16 bp, Homo sapiens
ctaagctttctccttt

SEQ ID NO: 3911737 - DNA, 15 bp, Homo sapiens
ctaaggaatctgaaa

SEQ ID NO: 3911738 - DNA, 14 bp, Homo sapiens
ctaaggacacacta

SEQ ID NO: 3911739 - DNA, 12 bp, Homo sapiens
ctaaggatctct

SEQ ID NO: 3911740 - DNA, 20 bp, Homo sapiens
ctaaggatctctcaggagca

SEQ ID NO: 3911741 - DNA, 22 bp, Homo sapiens
ctaagtaaaaccacagcagttg

SEQ ID NO: 3911742 - DNA, 13 bp, Homo sapiens
ctactcacacagg

SEQ ID NO: 3911743 - DNA, 15 bp, Homo sapiens
ctactcagcagccct

SEQ ID NO: 3911744 - DNA, 19 bp, Homo sapiens
ctactcagcagccctcctc

SEQ ID NO: 3911745 - DNA, 22 bp, Homo sapiens
ctactctcaggatcaagaaagt

SEQ ID NO: 3911746 - DNA, 17 bp, Homo sapiens
ctactctcctcggcccc

SEQ ID NO: 3911747 - DNA, 23 bp, Homo sapiens
ctactctcttgccagcattttca

SEQ ID NO: 3911748 - DNA, 16 bp, Homo sapiens
ctactctgtccaggcc

SEQ ID NO: 3911749 - DNA, 17 bp, Homo sapiens
ctactctgtgccagagc

SEQ ID NO: 3911750 - DNA, 14 bp, Homo sapiens
ctactgagaaactt

SEQ ID NO: 3911751 - DNA, 14 bp, Homo sapiens
ctactgcagcttta

SEQ ID NO: 3911752 - DNA, 14 bp, Homo sapiens
ctactgctgcaaag

SEQ ID NO: 3911753 - DNA, 11 bp, Homo sapiens
ctactggcagc

SEQ ID NO: 3911754 - DNA, 14 bp, Homo sapiens
ctactggcagctcc

SEQ ID NO: 3911755 - DNA, 12 bp, Homo sapiens
ctactgtaatta

SEQ ID NO: 3911756 - DNA, 15 bp, Homo sapiens
ctactgtaattaagt

SEQ ID NO: 3911757 - DNA, 13 bp, Homo sapiens
ctactgtgactga

SEQ ID NO: 3911758 - DNA, 17 bp, Homo sapiens
ctacttcggggctggga

SEQ ID NO: 3911759 - DNA, 22 bp, Homo sapiens
ctacttcttttgctcttagctg

SEQ ID NO: 3911760 - DNA, 18 bp, Homo sapiens
ctacttgtgactgaaggg

SEQ ID NO: 3911761 - DNA, 14 bp, Homo sapiens
ctactttttatact

SEQ ID NO: 3911762 - DNA, 16 bp, Homo sapiens
ctagaaaccagtatgg

SEQ ID NO: 3911763 - DNA, 22 bp, Homo sapiens
ctagaaaccagtatggaaggga

SEQ ID NO: 3911764 - DNA, 14 bp, Homo sapiens
ctagaaagaaaaga

SEQ ID NO: 3911765 - DNA, 23 bp, Homo sapiens
ctagaaagaaaagaccctgagac

SEQ ID NO: 3911766 - DNA, 21 bp, Homo sapiens
ctagaacacaggcaaaatcct

SEQ ID NO: 3911767 - DNA, 15 bp, Homo sapiens
ctagaacacccactg

SEQ ID NO: 3911768 - DNA, 22 bp, Homo sapiens
ctagaaccaagcttcagagcct

SEQ ID NO: 3911769 - DNA, 14 bp, Homo sapiens
ctagaacctggagg

SEQ ID NO: 3911770 - DNA, 13 bp, Homo sapiens
ctagaaggccaca

SEQ ID NO: 3911771 - DNA, 19 bp, Homo sapiens
ctagaaggccacatgtcac

SEQ ID NO: 3911772 - DNA, 20 bp, Homo sapiens
ctagaagtgggccaggacag

SEQ ID NO: 3911773 - DNA, 20 bp, Homo sapiens
ctagaatctggagagctaga

SEQ ID NO: 3911774 - DNA, 17 bp, Homo sapiens
ctagaatttgtattttg

SEQ ID NO: 3911775 - DNA, 19 bp, Homo sapiens
ctagaatttgtattttgct

SEQ ID NO: 3911776 - DNA, 13 bp, Homo sapiens
ctagacctgggcc

SEQ ID NO: 3911777 - DNA, 20 bp, Homo sapiens
ctagactaattaaaatctgg

SEQ ID NO: 3911778 - DNA, 23 bp, Homo sapiens
ctagactaattaaaatctggaaa

SEQ ID NO: 3911779 - DNA, 16 bp, Homo sapiens
ctagactggagtgagg

SEQ ID NO: 3911780 - DNA, 19 bp, Homo sapiens
ctagactggagtgaggctt

SEQ ID NO: 3911781 - DNA, 12 bp, Homo sapiens
ctagactttctc

SEQ ID NO: 3911782 - DNA, 14 bp, Homo sapiens
ctagactttctgtt

SEQ ID NO: 3911783 - DNA, 15 bp, Homo sapiens
ctagagaagaggctg

SEQ ID NO: 3911784 - DNA, 12 bp, Homo sapiens
ctagagagcaga

SEQ ID NO: 3911785 - DNA, 20 bp, Homo sapiens
ctagagaggctggcaaggag

SEQ ID NO: 3911786 - DNA, 22 bp, Homo sapiens
ctagagcaacccctgtacccag

SEQ ID NO: 3911787 - DNA, 16 bp, Homo sapiens
ctagagctcctgtccc

SEQ ID NO: 3911788 - DNA, 20 bp, Homo sapiens
ctagagctcctgtccctacc

SEQ ID NO: 3911789 - DNA, 22 bp, Homo sapiens
ctagagctcctgtccctaccca

SEQ ID NO: 3911790 - DNA, 24 bp, Homo sapiens
ctagagctcctgtccctacccact

SEQ ID NO: 3911791 - DNA, 17 bp, Homo sapiens
ctagagctgagagtctg

SEQ ID NO: 3911792 - DNA, 21 bp, Homo sapiens
ctagagctgggaaacagggag

SEQ ID NO: 3911793 - DNA, 14 bp, Homo sapiens
ctagagctttcttt

SEQ ID NO: 3911794 - DNA, 22 bp, Homo sapiens
ctagagctttctttcacaaaaa

SEQ ID NO: 3911795 - DNA, 11 bp, Homo sapiens
ctagaggcctc

SEQ ID NO: 3911796 - DNA, 14 bp, Homo sapiens
ctagaggtgggcag

SEQ ID NO: 3911797 - DNA, 16 bp, Homo sapiens
ctagaggtgggcagct

SEQ ID NO: 3911798 - DNA, 18 bp, Homo sapiens
ctagaggtgggcagctgg

SEQ ID NO: 3911799 - DNA, 21 bp, Homo sapiens
ctagaggtgggcagctgggcc

SEQ ID NO: 3911800 - DNA, 18 bp, Homo sapiens
ctagatcaattaattctt

SEQ ID NO: 3911801 - DNA, 21 bp, Homo sapiens
ctagatccacacacagaggaa

SEQ ID NO: 3911802 - DNA, 20 bp, Homo sapiens
ctagatcttacatctgcagc

SEQ ID NO: 3911803 - DNA, 24 bp, Homo sapiens
ctagattgagagaagagacaaaca

SEQ ID NO: 3911804 - DNA, 15 bp, Homo sapiens
ctagcaggcatgccg

SEQ ID NO: 3911805 - DNA, 22 bp, Homo sapiens
ctagccacctcccaccccactc

SEQ ID NO: 3911806 - DNA, 14 bp, Homo sapiens
ctagccaggagtct

SEQ ID NO: 3911807 - DNA, 17 bp, Homo sapiens
ctagccaggagtctgtg

SEQ ID NO: 3911808 - DNA, 19 bp, Homo sapiens
ctagccaggagtctgtgct

SEQ ID NO: 3911809 - DNA, 14 bp, Homo sapiens
ctagccctccctgg

SEQ ID NO: 3911810 - DNA, 15 bp, Homo sapiens
ctagcctgggccaga

SEQ ID NO: 3911811 - DNA, 19 bp, Homo sapiens
ctagccttgaggagtgtga

SEQ ID NO: 3911812 - DNA, 16 bp, Homo sapiens
ctagcgctctcttcca

SEQ ID NO: 3911813 - DNA, 16 bp, Homo sapiens
ctagcgctgccgcacc

SEQ ID NO: 3911814 - DNA, 17 bp, Homo sapiens
ctagctagaaatatgat

SEQ ID NO: 3911815 - DNA, 21 bp, Homo sapiens
ctagcttcatgcctcagtttc

SEQ ID NO: 3911816 - DNA, 16 bp, Homo sapiens
ctaggaatgaaatcct

SEQ ID NO: 3911817 - DNA, 14 bp, Homo sapiens
ctaggactgaggag

SEQ ID NO: 3911818 - DNA, 20 bp, Homo sapiens
ctaggagagactgaaagcag

SEQ ID NO: 3911819 - DNA, 13 bp, Homo sapiens
ctaggagcaaagc

SEQ ID NO: 3911820 - DNA, 16 bp, Homo sapiens
ctaggagcaaagcctg

SEQ ID NO: 3911821 - DNA, 15 bp, Homo sapiens
ctaggagctgggagg

SEQ ID NO: 3911822 - DNA, 22 bp, Homo sapiens
ctaggagttgagtacagtgagg

SEQ ID NO: 3911823 - DNA, 17 bp, Homo sapiens
ctaggattacaggcctt

SEQ ID NO: 3911824 - DNA, 17 bp, Homo sapiens
ctaggattcctccccca

SEQ ID NO: 3911825 - DNA, 20 bp, Homo sapiens
ctaggccaaatgcacaagct

SEQ ID NO: 3911826 - DNA, 13 bp, Homo sapiens
ctaggctccaccc

SEQ ID NO: 3911827 - DNA, 16 bp, Homo sapiens
ctaggctgttttctcc

SEQ ID NO: 3911828 - DNA, 16 bp, Homo sapiens
ctaggggtcaggctcc

SEQ ID NO: 3911829 - DNA, 18 bp, Homo sapiens
ctaggggtcaggctccat

SEQ ID NO: 3911830 - DNA, 17 bp, Homo sapiens
ctagggtcctggccctc

SEQ ID NO: 3911831 - DNA, 12 bp, Homo sapiens
ctaggtgctgga

SEQ ID NO: 3911832 - DNA, 13 bp, Homo sapiens
ctaggtgctggat

SEQ ID NO: 3911833 - DNA, 21 bp, Homo sapiens
ctagtaatgggccaattaaaa

SEQ ID NO: 3911834 - DNA, 22 bp, Homo sapiens
ctagtactctctgctctagcca

SEQ ID NO: 3911835 - DNA, 18 bp, Homo sapiens
ctagtcagagagagtgtt

SEQ ID NO: 3911836 - DNA, 23 bp, Homo sapiens
ctagtcatagaaatacctcattc

SEQ ID NO: 3911837 - DNA, 14 bp, Homo sapiens
ctagtccagtgacc

SEQ ID NO: 3911838 - DNA, 18 bp, Homo sapiens
ctagtccttggtctgctg

SEQ ID NO: 3911839 - DNA, 23 bp, Homo sapiens
ctagtctcctttgcactgagggc

SEQ ID NO: 3911840 - DNA, 19 bp, Homo sapiens
ctagtgaaagaggcagctt

SEQ ID NO: 3911841 - DNA, 17 bp, Homo sapiens
ctagtgacccacatgcc

SEQ ID NO: 3911842 - DNA, 18 bp, Homo sapiens
ctagtgacccacatgcca

SEQ ID NO: 3911843 - DNA, 19 bp, Homo sapiens
ctagtgctattctgtgttg

SEQ ID NO: 3911844 - DNA, 21 bp, Homo sapiens
ctagtggggtctccctctcct

SEQ ID NO: 3911845 - DNA, 14 bp, Homo sapiens
ctagtgttgcttgg

SEQ ID NO: 3911846 - DNA, 15 bp, Homo sapiens
ctagtttctttctgt

SEQ ID NO: 3911847 - DNA, 18 bp, Homo sapiens
ctagttttttttgtaaac

SEQ ID NO: 3911848 - DNA, 21 bp, Homo sapiens
  misc_feature (4)..(4): n is a, c, g or t
  misc_feature (11)..(11): n is a, c, g or t
ctanccccccnacccccagtg

SEQ ID NO: 3911849 - DNA, 12 bp, Homo sapiens
ctataaacatta

SEQ ID NO: 3911850 - DNA, 17 bp, Homo sapiens
ctataaactactgtaat

SEQ ID NO: 3911851 - DNA, 21 bp, Homo sapiens
ctataaggagagttcaagcct

SEQ ID NO: 3911852 - DNA, 20 bp, Homo sapiens
ctataatggaaacatttaca

SEQ ID NO: 3911853 - DNA, 13 bp, Homo sapiens
ctataatgtgtgt

SEQ ID NO: 3911854 - DNA, 16 bp, Homo sapiens
ctataatgtgtgtatg

SEQ ID NO: 3911855 - DNA, 20 bp, Homo sapiens
ctataccatatgtctgcttc

SEQ ID NO: 3911856 - DNA, 21 bp, Homo sapiens
ctataccatatgtctgcttct

SEQ ID NO: 3911857 - DNA, 17 bp, Homo sapiens
ctatacccattcttcag

SEQ ID NO: 3911858 - DNA, 12 bp, Homo sapiens
ctatagagaaaa

SEQ ID NO: 3911859 - DNA, 17 bp, Homo sapiens
ctataggctggagaagc

SEQ ID NO: 3911860 - DNA, 17 bp, Homo sapiens
ctatatacatgtgtgta

SEQ ID NO: 3911861 - DNA, 14 bp, Homo sapiens
ctatatcatgcttt

SEQ ID NO: 3911862 - DNA, 20 bp, Homo sapiens
ctatatcatgctttaaagtg

SEQ ID NO: 3911863 - DNA, 15 bp, Homo sapiens
ctatatgaaaaacaa

SEQ ID NO: 3911864 - DNA, 19 bp, Homo sapiens
ctatatgatttatagtttg

SEQ ID NO: 3911865 - DNA, 13 bp, Homo sapiens
ctatatggcaaga

SEQ ID NO: 3911866 - DNA, 19 bp, Homo sapiens
ctatatggcaagaaagctg

SEQ ID NO: 3911867 - DNA, 22 bp, Homo sapiens
ctatatttagattgttaaaata

SEQ ID NO: 3911868 - DNA, 14 bp, Homo sapiens
ctatcaaaacatat

SEQ ID NO: 3911869 - DNA, 17 bp, Homo sapiens
ctatcaaaacatatcaa

SEQ ID NO: 3911870 - DNA, 19 bp, Homo sapiens
ctatcaaaacatatcaatt

SEQ ID NO: 3911871 - DNA, 22 bp, Homo sapiens
ctatcaaaacatatcaattcaa

SEQ ID NO: 3911872 - DNA, 14 bp, Homo sapiens
ctatcaatagtcaa

SEQ ID NO: 3911873 - DNA, 21 bp, Homo sapiens
ctatcaatagtcaagaaaaat

SEQ ID NO: 3911874 - DNA, 18 bp, Homo sapiens
ctatcaatatataaattt

SEQ ID NO: 3911875 - DNA, 18 bp, Homo sapiens
ctatcaatatttaagttt

SEQ ID NO: 3911876 - DNA, 13 bp, Homo sapiens
ctatcacatacaa

SEQ ID NO: 3911877 - DNA, 14 bp, Homo sapiens
ctatcacccaggct

SEQ ID NO: 3911878 - DNA, 13 bp, Homo sapiens
ctatcagaagacc

SEQ ID NO: 3911879 - DNA, 14 bp, Homo sapiens
ctatcatggagtga

SEQ ID NO: 3911880 - DNA, 13 bp, Homo sapiens
ctatccatcctgc

SEQ ID NO: 3911881 - DNA, 14 bp, Homo sapiens
ctatccatcctgcg

SEQ ID NO: 3911882 - DNA, 19 bp, Homo sapiens
ctatcctagagaggctggc

SEQ ID NO: 3911883 - DNA, 20 bp, Homo sapiens
ctatcctagagaggctggca

SEQ ID NO: 3911884 - DNA, 19 bp, Homo sapiens
ctatcctgaaaattctgta

SEQ ID NO: 3911885 - DNA, 18 bp, Homo sapiens
ctatctctagagtgagaa

SEQ ID NO: 3911886 - DNA, 21 bp, Homo sapiens
ctatctctgtgtgcacaaata

SEQ ID NO: 3911887 - DNA, 22 bp, Homo sapiens
ctatctgtcatctctctggggc

SEQ ID NO: 3911888 - DNA, 19 bp, Homo sapiens
ctatctgtgaagttacact

SEQ ID NO: 3911889 - DNA, 12 bp, Homo sapiens
ctatcttctcca

SEQ ID NO: 3911890 - DNA, 12 bp, Homo sapiens
ctatgaaaatca

SEQ ID NO: 3911891 - DNA, 16 bp, Homo sapiens
ctatgactgctcccca

SEQ ID NO: 3911892 - DNA, 17 bp, Homo sapiens
ctatgatcacagtgact

SEQ ID NO: 3911893 - DNA, 11 bp, Homo sapiens
ctatgcaattt

SEQ ID NO: 3911894 - DNA, 13 bp, Homo sapiens
ctatgcaattttt

SEQ ID NO: 3911895 - DNA, 14 bp, Homo sapiens
ctatgcaattttta

SEQ ID NO: 3911896 - DNA, 15 bp, Homo sapiens
ctatgcaatttttaa

SEQ ID NO: 3911897 - DNA, 17 bp, Homo sapiens
ctatgcaatttttaaac

SEQ ID NO: 3911898 - DNA, 24 bp, Homo sapiens
ctatgcagtattgccacaatgcct

SEQ ID NO: 3911899 - DNA, 17 bp, Homo sapiens
ctatgccccaaatatag

SEQ ID NO: 3911900 - DNA, 21 bp, Homo sapiens
ctatggaaaagggtcttcttg

SEQ ID NO: 3911901 - DNA, 14 bp, Homo sapiens
ctatggagagccct

SEQ ID NO: 3911902 - DNA, 16 bp, Homo sapiens
ctatggagagccctgg

SEQ ID NO: 3911903 - DNA, 17 bp, Homo sapiens
ctatggagagccctggg

SEQ ID NO: 3911904 - DNA, 18 bp, Homo sapiens
ctatggagagccctggga

SEQ ID NO: 3911905 - DNA, 23 bp, Homo sapiens
ctatggagcctggcacaggactg

SEQ ID NO: 3911906 - DNA, 14 bp, Homo sapiens
cgagcagctgagca

SEQ ID NO: 3911907 - DNA, 18 bp, Homo sapiens
cgagcagggtgctgtggg

SEQ ID NO: 3911908 - DNA, 15 bp, Homo sapiens
cgagccgggcctggg

SEQ ID NO: 3911909 - DNA, 14 bp, Homo sapiens
cgagcgccctgcag

SEQ ID NO: 3911910 - DNA, 15 bp, Homo sapiens
cgagcgccctgcaga

SEQ ID NO: 3911911 - DNA, 21 bp, Homo sapiens
cgagcgccctgcagaccctgc

SEQ ID NO: 3911912 - DNA, 19 bp, Homo sapiens
cgagcgctatcttcacata

SEQ ID NO: 3911913 - DNA, 18 bp, Homo sapiens
cgagcgctttctggaaaa

SEQ ID NO: 3911914 - DNA, 16 bp, Homo sapiens
cgaggcaccggcgctg

SEQ ID NO: 3911915 - DNA, 21 bp, Homo sapiens
cgaggcaccggcgctgcaggt

SEQ ID NO: 3911916 - DNA, 22 bp, Homo sapiens
cgaggcaccggcgctgcaggta

SEQ ID NO: 3911917 - DNA, 15 bp, Homo sapiens
cgagggcctgacagg

SEQ ID NO: 3911918 - DNA, 21 bp, Homo sapiens
cgaggtcaacagagaaggcag

SEQ ID NO: 3911919 - DNA, 23 bp, Homo sapiens
cgaggtcaacagagaaggcagga

SEQ ID NO: 3911920 - DNA, 14 bp, Homo sapiens
cgaggtccagaccc

SEQ ID NO: 3911921 - DNA, 20 bp, Homo sapiens
cgaggtggatcacagaggct

SEQ ID NO: 3911922 - DNA, 19 bp, Homo sapiens
cgaggtgtcaccctgcaga

SEQ ID NO: 3911923 - DNA, 20 bp, Homo sapiens
cgaggtgtcaccctgcagag

SEQ ID NO: 3911924 - DNA, 23 bp, Homo sapiens
cgaggtgtcaccctgcagagcta

SEQ ID NO: 3911925 - DNA, 13 bp, Homo sapiens
cgaggttgcccct

SEQ ID NO: 3911926 - DNA, 20 bp, Homo sapiens
cgagtcacctgcaagcccca

SEQ ID NO: 3911927 - DNA, 17 bp, Homo sapiens
cgagtctcttctccact

SEQ ID NO: 3911928 - DNA, 17 bp, Homo sapiens
cgagtttggtccctggg

SEQ ID NO: 3911929 - DNA, 20 bp, Homo sapiens
cgataaaactaaatatatgt

SEQ ID NO: 3911930 - DNA, 21 bp, Homo sapiens
cgatacaccgggcctggagaa

SEQ ID NO: 3911931 - DNA, 16 bp, Homo sapiens
cgatgtacacacacag

SEQ ID NO: 3911932 - DNA, 17 bp, Homo sapiens
cgatgtggccctggcct

SEQ ID NO: 3911933 - DNA, 18 bp, Homo sapiens
cgatgtggccctggcctg

SEQ ID NO: 3911934 - DNA, 16 bp, Homo sapiens
cgcaacaacaaggacc

SEQ ID NO: 3911935 - DNA, 14 bp, Homo sapiens
cgcaacccgtgcca

SEQ ID NO: 3911936 - DNA, 19 bp, Homo sapiens
cgcaacccgtgccaagtcc

SEQ ID NO: 3911937 - DNA, 17 bp, Homo sapiens
cgcaacccttgctgctg

SEQ ID NO: 3911938 - DNA, 20 bp, Homo sapiens
cgcaacccttgctgctgccc

SEQ ID NO: 3911939 - DNA, 21 bp, Homo sapiens
cgcaagcctgtaatcccagct

SEQ ID NO: 3911940 - DNA, 17 bp, Homo sapiens
cgcaagcgcagggagga

SEQ ID NO: 3911941 - DNA, 16 bp, Homo sapiens
cgcaagggagaagaaa

SEQ ID NO: 3911942 - DNA, 14 bp, Homo sapiens
cgcaagtctgcagc

SEQ ID NO: 3911943 - DNA, 22 bp, Homo sapiens
cgcaattgtgggatgtcctctt

SEQ ID NO: 3911944 - DNA, 12 bp, Homo sapiens
cgcacacacacc

SEQ ID NO: 3911945 - DNA, 19 bp, Homo sapiens
cgcaccagctgctctgccc

SEQ ID NO: 3911946 - DNA, 23 bp, Homo sapiens
cgcaccagctgctctgccccttg

SEQ ID NO: 3911947 - DNA, 17 bp, Homo sapiens
cgcaccccccaagctgt

SEQ ID NO: 3911948 - DNA, 13 bp, Homo sapiens
cgcagaaggaagg

SEQ ID NO: 3911949 - DNA, 14 bp, Homo sapiens
cgcagaggcggaaa

SEQ ID NO: 3911950 - DNA, 19 bp, Homo sapiens
cgcagaggcggaaaccttg

SEQ ID NO: 3911951 - DNA, 20 bp, Homo sapiens
cgcagaggcggaaaccttgc

SEQ ID NO: 3911952 - DNA, 10 bp, Homo sapiens
cgcagcagct

SEQ ID NO: 3911953 - DNA, 17 bp, Homo sapiens
cgcagcccgaagcccag

SEQ ID NO: 3911954 - DNA, 17 bp, Homo sapiens
cgcagcccgtgaagcag

SEQ ID NO: 3911955 - DNA, 20 bp, Homo sapiens
cgcagccctgggggccagct

SEQ ID NO: 3911956 - DNA, 22 bp, Homo sapiens
cgcagccctgggggccagctgg

SEQ ID NO: 3911957 - DNA, 15 bp, Homo sapiens
cgcaggatccgctgc

SEQ ID NO: 3911958 - DNA, 18 bp, Homo sapiens
cgcaggatccgctgccac

SEQ ID NO: 3911959 - DNA, 18 bp, Homo sapiens
cgcaggcccccaggtgcc

SEQ ID NO: 3911960 - DNA, 21 bp, Homo sapiens
cgcagggaggatgccacagcc

SEQ ID NO: 3911961 - DNA, 13 bp, Homo sapiens
cgcagtccccagc

SEQ ID NO: 3911962 - DNA, 23 bp, Homo sapiens
cgcagtcgcaggatccgctgcca

SEQ ID NO: 3911963 - DNA, 14 bp, Homo sapiens
cgcagtctggcctg

SEQ ID NO: 3911964 - DNA, 13 bp, Homo sapiens
cgcatcttctcca

SEQ ID NO: 3911965 - DNA, 21 bp, Homo sapiens
cgcatgtgccagttggggccc

SEQ ID NO: 3911966 - DNA, 13 bp, Homo sapiens
cgcattccctgag

SEQ ID NO: 3911967 - DNA, 12 bp, Homo sapiens
cgccacggccac

SEQ ID NO: 3911968 - DNA, 15 bp, Homo sapiens
cgccacggccaccct

SEQ ID NO: 3911969 - DNA, 17 bp, Homo sapiens
cgccaggaggtcctcct

SEQ ID NO: 3911970 - DNA, 19 bp, Homo sapiens
cgccaggaggtcctcctct

SEQ ID NO: 3911971 - DNA, 16 bp, Homo sapiens
cgccagtttcaccatt

SEQ ID NO: 3911972 - DNA, 14 bp, Homo sapiens
cgccatcagcccaa

SEQ ID NO: 3911973 - DNA, 23 bp, Homo sapiens
cgccatccgggacgcttccagac

SEQ ID NO: 3911974 - DNA, 22 bp, Homo sapiens
cgcccacaagccttactcacct

SEQ ID NO: 3911975 - DNA, 17 bp, Homo sapiens
cgcccattcgtctgtcc

SEQ ID NO: 3911976 - DNA, 19 bp, Homo sapiens
cgcccattcgtctgtccca

SEQ ID NO: 3911977 - DNA, 23 bp, Homo sapiens
cgcccattcgtctgtcccagagc

SEQ ID NO: 3911978 - DNA, 12 bp, Homo sapiens
cgccccaggccc

SEQ ID NO: 3911979 - DNA, 21 bp, Homo sapiens
cgcccctcatttatccctcaa

SEQ ID NO: 3911980 - DNA, 11 bp, Homo sapiens
cgccctgcaga

SEQ ID NO: 3911981 - DNA, 22 bp, Homo sapiens
cgccctgggctgtctgtcacca

SEQ ID NO: 3911982 - DNA, 20 bp, Homo sapiens
cgcctagtggggtctccctc

SEQ ID NO: 3911983 - DNA, 21 bp, Homo sapiens
cgcctagtggggtctccctct

SEQ ID NO: 3911984 - DNA, 14 bp, Homo sapiens
cgcctcccagcctg

SEQ ID NO: 3911985 - DNA, 15 bp, Homo sapiens
cgcctcccagcctgg

SEQ ID NO: 3911986 - DNA, 22 bp, Homo sapiens
cgcctccccgaaacaggctact

SEQ ID NO: 3911987 - DNA, 12 bp, Homo sapiens
cgcctcctggcc

SEQ ID NO: 3911988 - DNA, 14 bp, Homo sapiens
cgcctcctggccag

SEQ ID NO: 3911989 - DNA, 20 bp, Homo sapiens
cgcctcttttccctctctag

SEQ ID NO: 3911990 - DNA, 14 bp, Homo sapiens
cgcctgagcccagg

SEQ ID NO: 3911991 - DNA, 19 bp, Homo sapiens
cgcctgagcccagggaggc

SEQ ID NO: 3911992 - DNA, 20 bp, Homo sapiens
cgcctgagcccagggaggcc

SEQ ID NO: 3911993 - DNA, 20 bp, Homo sapiens
cgcctgggcccaggctctgg

SEQ ID NO: 3911994 - DNA, 23 bp, Homo sapiens
cgcctgggcccaggctctgggaa

SEQ ID NO: 3911995 - DNA, 17 bp, Homo sapiens
cgcctgtaatcccagca

SEQ ID NO: 3911996 - DNA, 19 bp, Homo sapiens
cgcctgtaatcccagcact

SEQ ID NO: 3911997 - DNA, 18 bp, Homo sapiens
cgcctgtagtcccagcca

SEQ ID NO: 3911998 - DNA, 18 bp, Homo sapiens
cgcgaagtgggcattgca

SEQ ID NO: 3911999 - DNA, 15 bp, Homo sapiens
cgcgagactgagagg

SEQ ID NO: 3912000 - DNA, 18 bp, Homo sapiens
cgcgcatctcttcctgat

SEQ ID NO: 3912001 - DNA, 22 bp, Homo sapiens
cgcgcgaagtgggcattgcaaa

SEQ ID NO: 3912002 - DNA, 13 bp, Homo sapiens
cgcggcttggccg

SEQ ID NO: 3912003 - DNA, 21 bp, Homo sapiens
cgcggcttggccgccatccgg

SEQ ID NO: 3912004 - DNA, 16 bp, Homo sapiens
cgcgggaggcaccagc

SEQ ID NO: 3912005 - DNA, 21 bp, Homo sapiens
cgcgggaggcaccagctctgt

SEQ ID NO: 3912006 - DNA, 15 bp, Homo sapiens
cgcgggtagatgccg

SEQ ID NO: 3912007 - DNA, 14 bp, Homo sapiens
cgcgtctaccctgg

SEQ ID NO: 3912008 - DNA, 15 bp, Homo sapiens
cgcgtctgccccacc

SEQ ID NO: 3912009 - DNA, 17 bp, Homo sapiens
cgcgtctgccccaccct

SEQ ID NO: 3912010 - DNA, 16 bp, Homo sapiens
cgctacaccactctgg

SEQ ID NO: 3912011 - DNA, 18 bp, Homo sapiens
cgctcaagaatcctctgg

SEQ ID NO: 3912012 - DNA, 22 bp, Homo sapiens
cgctcacctttgtttagaacac

SEQ ID NO: 3912013 - DNA, 14 bp, Homo sapiens
cgctcaggacccag

SEQ ID NO: 3912014 - DNA, 15 bp, Homo sapiens
cgctcaggacccagg

SEQ ID NO: 3912015 - DNA, 24 bp, Homo sapiens
cgctcatctggcttttcgcttgct

SEQ ID NO: 3912016 - DNA, 16 bp, Homo sapiens
cgctccccactctgct

SEQ ID NO: 3912017 - DNA, 17 bp, Homo sapiens
cgctccccactctgctc

SEQ ID NO: 3912018 - DNA, 20 bp, Homo sapiens
cgctcccccgcagtccccag

SEQ ID NO: 3912019 - DNA, 17 bp, Homo sapiens
cgctcctcccctcttga

SEQ ID NO: 3912020 - DNA, 22 bp, Homo sapiens
cgctcctttacctaccaccttc

SEQ ID NO: 3912021 - DNA, 17 bp, Homo sapiens
cgctctcctttctttct

SEQ ID NO: 3912022 - DNA, 15 bp, Homo sapiens
cgctctgctggcctg

SEQ ID NO: 3912023 - DNA, 16 bp, Homo sapiens
cgctctgctggcctgg

SEQ ID NO: 3912024 - DNA, 18 bp, Homo sapiens
cgctctgctggcctggcc

SEQ ID NO: 3912025 - DNA, 12 bp, Homo sapiens
cgctctggacat

SEQ ID NO: 3912026 - DNA, 21 bp, Homo sapiens
cgctcttagctttctcagggg

SEQ ID NO: 3912027 - DNA, 14 bp, Homo sapiens
cgctcttgggagtc

SEQ ID NO: 3912028 - DNA, 18 bp, Homo sapiens
cgctgccaccacgtctgc

SEQ ID NO: 3912029 - DNA, 22 bp, Homo sapiens
cgctgccaccacgtctgccagg

SEQ ID NO: 3912030 - DNA, 9 bp, Homo sapiens
cgctgccag

SEQ ID NO: 3912031 - DNA, 11 bp, Homo sapiens
cgctgccagga

SEQ ID NO: 3912032 - DNA, 13 bp, Homo sapiens
cgctgccaggaca

SEQ ID NO: 3912033 - DNA, 18 bp, Homo sapiens
cgctgccaggacacctgc

SEQ ID NO: 3912034 - DNA, 20 bp, Homo sapiens
cgctgccaggacacctgccc

SEQ ID NO: 3912035 - DNA, 20 bp, Homo sapiens
cgctgccgcaccccagagtg

SEQ ID NO: 3912036 - DNA, 21 bp, Homo sapiens
cgctgccgcaccccagagtgt

SEQ ID NO: 3912037 - DNA, 18 bp, Homo sapiens
cgctgccgctgcaccacg

SEQ ID NO: 3912038 - DNA, 15 bp, Homo sapiens
cgctgccgctgccgc

SEQ ID NO: 3912039 - DNA, 18 bp, Homo sapiens
cgctgccgctgccgctgc

SEQ ID NO: 3912040 - DNA, 20 bp, Homo sapiens
cgctgcctaagtggctgctg

SEQ ID NO: 3912041 - DNA, 15 bp, Homo sapiens
cgctgctagagaagg

SEQ ID NO: 3912042 - DNA, 18 bp, Homo sapiens
cgctgctctagctggcag

SEQ ID NO: 3912043 - DNA, 15 bp, Homo sapiens
cgctggctcaggaag

SEQ ID NO: 3912044 - DNA, 16 bp, Homo sapiens
cgctggctcaggaaga

SEQ ID NO: 3912045 - DNA, 21 bp, Homo sapiens
cgctgggatttcttcgctgct

SEQ ID NO: 3912046 - DNA, 13 bp, Homo sapiens
cgctggggaacag

SEQ ID NO: 3912047 - DNA, 16 bp, Homo sapiens
cgctgtcctctcgagc

SEQ ID NO: 3912048 - DNA, 23 bp, Homo sapiens
cgctgtcctctcgagcccagatg

SEQ ID NO: 3912049 - DNA, 16 bp, Homo sapiens
cgctgtcgccccaggc

SEQ ID NO: 3912050 - DNA, 18 bp, Homo sapiens
cgctgtgaaaatgaggag

SEQ ID NO: 3912051 - DNA, 14 bp, Homo sapiens
cgcttccagaccac

SEQ ID NO: 3912052 - DNA, 20 bp, Homo sapiens
cgcttccagaccacctgcca

SEQ ID NO: 3912053 - DNA, 15 bp, Homo sapiens
cgcttcccagaggcc

SEQ ID NO: 3912054 - DNA, 20 bp, Homo sapiens
cgcttgtccagcgcctagtg

SEQ ID NO: 3912055 - DNA, 12 bp, Homo sapiens
cggaaaccttgc

SEQ ID NO: 3912056 - DNA, 17 bp, Homo sapiens
cggaaaccttgcagcat

SEQ ID NO: 3912057 - DNA, 12 bp, Homo sapiens
cggaaatgaagg

SEQ ID NO: 3912058 - DNA, 21 bp, Homo sapiens
cggaagaagagatcaggaaga

SEQ ID NO: 3912059 - DNA, 21 bp, Homo sapiens
cggaagccgtctgactccaga

SEQ ID NO: 3912060 - DNA, 21 bp, Homo sapiens
cggaagggttggtgggctggc

SEQ ID NO: 3912061 - DNA, 15 bp, Homo sapiens
cggaaggtcagttgc

SEQ ID NO: 3912062 - DNA, 20 bp, Homo sapiens
cggacccaccaaactgcaca

SEQ ID NO: 3912063 - DNA, 13 bp, Homo sapiens
cggaccgcgtaga

SEQ ID NO: 3912064 - DNA, 15 bp, Homo sapiens
cggagaccctgagtc

SEQ ID NO: 3912065 - DNA, 16 bp, Homo sapiens
cggagcacagccctgg

SEQ ID NO: 3912066 - DNA, 18 bp, Homo sapiens
cggaggcggctccaggtc

SEQ ID NO: 3912067 - DNA, 13 bp, Homo sapiens
cggaggctgggcc

SEQ ID NO: 3912068 - DNA, 15 bp, Homo sapiens
cggaggggttgcggg

SEQ ID NO: 3912069 - DNA, 17 bp, Homo sapiens
cggaggtggtggaggag

SEQ ID NO: 3912070 - DNA, 18 bp, Homo sapiens
cggaggtggtggaggagg

SEQ ID NO: 3912071 - DNA, 13 bp, Homo sapiens
cggagtagaaatt

SEQ ID NO: 3912072 - DNA, 19 bp, Homo sapiens
cggcaactaagcagtccct

SEQ ID NO: 3912073 - DNA, 19 bp, Homo sapiens
cggcacctgggccctgggg

SEQ ID NO: 3912074 - DNA, 23 bp, Homo sapiens
cggcacctgggccctggggcctg

SEQ ID NO: 3912075 - DNA, 15 bp, Homo sapiens
cggcacgtcccatgt

SEQ ID NO: 3912076 - DNA, 14 bp, Homo sapiens
cggcagctgtagct

SEQ ID NO: 3912077 - DNA, 15 bp, Homo sapiens
cggcaggagcaggaa

SEQ ID NO: 3912078 - DNA, 16 bp, Homo sapiens
ctcccaggccccatga

SEQ ID NO: 3912079 - DNA, 21 bp, Homo sapiens
ctcccaggccccatgacctcc

SEQ ID NO: 3912080 - DNA, 14 bp, Homo sapiens
ctcccaggcgcccc

SEQ ID NO: 3912081 - DNA, 16 bp, Homo sapiens
ctcccataccatcact

SEQ ID NO: 3912082 - DNA, 22 bp, Homo sapiens
ctcccatagcgctggctcagga

SEQ ID NO: 3912083 - DNA, 23 bp, Homo sapiens
ctcccatagcgctggctcaggaa

SEQ ID NO: 3912084 - DNA, 14 bp, Homo sapiens
ctcccatggccttc

SEQ ID NO: 3912085 - DNA, 21 bp, Homo sapiens
ctcccatgttgcatgcctatg

SEQ ID NO: 3912086 - DNA, 13 bp, Homo sapiens
ctccccacagtcc

SEQ ID NO: 3912087 - DNA, 21 bp, Homo sapiens
ctccccacagtcctcacagcc

SEQ ID NO: 3912088 - DNA, 16 bp, Homo sapiens
ctccccacccccgctg

SEQ ID NO: 3912089 - DNA, 17 bp, Homo sapiens
ctccccaccttccccag

SEQ ID NO: 3912090 - DNA, 16 bp, Homo sapiens
ctccccacgagtcacc

SEQ ID NO: 3912091 - DNA, 20 bp, Homo sapiens
ctccccacgagtcacctgca

SEQ ID NO: 3912092 - DNA, 21 bp, Homo sapiens
ctccccactctgctctgatgc

SEQ ID NO: 3912093 - DNA, 22 bp, Homo sapiens
ctccccactctgctctgatgca

SEQ ID NO: 3912094 - DNA, 13 bp, Homo sapiens
ctccccagccctg

SEQ ID NO: 3912095 - DNA, 14 bp, Homo sapiens
ctccccagcccttt

SEQ ID NO: 3912096 - DNA, 16 bp, Homo sapiens
ctccccaggcctccag

SEQ ID NO: 3912097 - DNA, 14 bp, Homo sapiens
ctcccccaccccct

SEQ ID NO: 3912098 - DNA, 13 bp, Homo sapiens
ctcccccacctga

SEQ ID NO: 3912099 - DNA, 12 bp, Homo sapiens
ctcccccagagc

SEQ ID NO: 3912100 - DNA, 14 bp, Homo sapiens
ctcccccagagcca

SEQ ID NO: 3912101 - DNA, 13 bp, Homo sapiens
ctccccccactgc

SEQ ID NO: 3912102 - DNA, 19 bp, Homo sapiens
ctcccccgacactgctgca

SEQ ID NO: 3912103 - DNA, 21 bp, Homo sapiens
ctcccccgacactgctgcacc

SEQ ID NO: 3912104 - DNA, 22 bp, Homo sapiens
ctcccccgacactgctgcacca

SEQ ID NO: 3912105 - DNA, 21 bp, Homo sapiens
ctcccccgcagtccccagccc

SEQ ID NO: 3912106 - DNA, 13 bp, Homo sapiens
ctccccctgccag

SEQ ID NO: 3912107 - DNA, 18 bp, Homo sapiens
ctccccctgccagtgcct

SEQ ID NO: 3912108 - DNA, 14 bp, Homo sapiens
ctccccctgctgct

SEQ ID NO: 3912109 - DNA, 23 bp, Homo sapiens
ctcccctatccacccagcccatt

SEQ ID NO: 3912110 - DNA, 19 bp, Homo sapiens
ctcccctattttaagacgt

SEQ ID NO: 3912111 - DNA, 15 bp, Homo sapiens
ctcccctctgccctg

SEQ ID NO: 3912112 - DNA, 16 bp, Homo sapiens
ctcccctgccctgctg

SEQ ID NO: 3912113 - DNA, 13 bp, Homo sapiens
ctcccggctgcct

SEQ ID NO: 3912114 - DNA, 15 bp, Homo sapiens
ctcccggtgcccaag

SEQ ID NO: 3912115 - DNA, 21 bp, Homo sapiens
ctcccggtgcccaagaataga

SEQ ID NO: 3912116 - DNA, 15 bp, Homo sapiens
ctccctaaaataaaa

SEQ ID NO: 3912117 - DNA, 17 bp, Homo sapiens
ctccctaaaataaaaac

SEQ ID NO: 3912118 - DNA, 23 bp, Homo sapiens
ctccctaaaataaaaaccagaat

SEQ ID NO: 3912119 - DNA, 18 bp, Homo sapiens
ctccctaagaaaccccag

SEQ ID NO: 3912120 - DNA, 18 bp, Homo sapiens
ctccctacctgaggccta

SEQ ID NO: 3912121 - DNA, 14 bp, Homo sapiens
ctccctactcccct

SEQ ID NO: 3912122 - DNA, 19 bp, Homo sapiens
ctccctattaacctagaga

SEQ ID NO: 3912123 - DNA, 14 bp, Homo sapiens
ctccctcaacccca

SEQ ID NO: 3912124 - DNA, 14 bp, Homo sapiens
ctccctcagtgccc

SEQ ID NO: 3912125 - DNA, 23 bp, Homo sapiens
ctccctcagtgccctcattttat

SEQ ID NO: 3912126 - DNA, 22 bp, Homo sapiens
ctccctccagggaatccgcctg

SEQ ID NO: 3912127 - DNA, 12 bp, Homo sapiens
ctccctcccaca

SEQ ID NO: 3912128 - DNA, 11 bp, Homo sapiens
ctccctcctcg

SEQ ID NO: 3912129 - DNA, 15 bp, Homo sapiens
ctccctctcctgcct

SEQ ID NO: 3912130 - DNA, 21 bp, Homo sapiens
ctccctctgccccaagcagcc

SEQ ID NO: 3912131 - DNA, 22 bp, Homo sapiens
ctccctctgccccaagcagcca

SEQ ID NO: 3912132 - DNA, 21 bp, Homo sapiens
ctccctgaacctcagtttcct

SEQ ID NO: 3912133 - DNA, 17 bp, Homo sapiens
ctccctgactccctgtg

SEQ ID NO: 3912134 - DNA, 19 bp, Homo sapiens
ctccctgactccctgtggg

SEQ ID NO: 3912135 - DNA, 17 bp, Homo sapiens
ctccctgcccctccctt

SEQ ID NO: 3912136 - DNA, 20 bp, Homo sapiens
ctccctgcccctcccttcaa

SEQ ID NO: 3912137 - DNA, 21 bp, Homo sapiens
ctccctgcccctcccttcaac

SEQ ID NO: 3912138 - DNA, 14 bp, Homo sapiens
ctccctggcatgtc

SEQ ID NO: 3912139 - DNA, 16 bp, Homo sapiens
ctccctggctctcaga

SEQ ID NO: 3912140 - DNA, 18 bp, Homo sapiens
ctccctgtagctctgcct

SEQ ID NO: 3912141 - DNA, 20 bp, Homo sapiens
ctccctgtagctctgcctcc

SEQ ID NO: 3912142 - DNA, 21 bp, Homo sapiens
ctccctgtgggggtggccatc

SEQ ID NO: 3912143 - DNA, 20 bp, Homo sapiens
ctccctgttatctgctagat

SEQ ID NO: 3912144 - DNA, 20 bp, Homo sapiens
ctcccttcaaccattcccca

SEQ ID NO: 3912145 - DNA, 18 bp, Homo sapiens
ctcccttcctggcctcac

SEQ ID NO: 3912146 - DNA, 16 bp, Homo sapiens
ctcccttctacagcct

SEQ ID NO: 3912147 - DNA, 18 bp, Homo sapiens
ctcccttgctcagtgcct

SEQ ID NO: 3912148 - DNA, 24 bp, Homo sapiens
ctcccttgctcagtgcctcctggc

SEQ ID NO: 3912149 - DNA, 15 bp, Homo sapiens
ctccgagaacaacag

SEQ ID NO: 3912150 - DNA, 16 bp, Homo sapiens
ctccgcacacctgtgg

SEQ ID NO: 3912151 - DNA, 13 bp, Homo sapiens
ctccgctaagacc

SEQ ID NO: 3912152 - DNA, 20 bp, Homo sapiens
ctccgctaagacctccccac

SEQ ID NO: 3912153 - DNA, 16 bp, Homo sapiens
ctccggaatgaccagc

SEQ ID NO: 3912154 - DNA, 22 bp, Homo sapiens
ctccggcctgatgacagagcga

SEQ ID NO: 3912155 - DNA, 17 bp, Homo sapiens
ctccggggtctgtgctg

SEQ ID NO: 3912156 - DNA, 22 bp, Homo sapiens
ctccggggtctgtgctgtgcct

SEQ ID NO: 3912157 - DNA, 16 bp, Homo sapiens
ctccgggtgtggcctc

SEQ ID NO: 3912158 - DNA, 19 bp, Homo sapiens
ctccgggtgtggcctcagc

SEQ ID NO: 3912159 - DNA, 21 bp, Homo sapiens
ctccgggtgtggcctcagccc

SEQ ID NO: 3912160 - DNA, 19 bp, Homo sapiens
ctccgtcatgaatgccttc

SEQ ID NO: 3912161 - DNA, 18 bp, Homo sapiens
ctccgtccacccaggctg

SEQ ID NO: 3912162 - DNA, 23 bp, Homo sapiens
ctccgtccacccaggctgcactg

SEQ ID NO: 3912163 - DNA, 18 bp, Homo sapiens
ctccgtccaggagcctgg

SEQ ID NO: 3912164 - DNA, 13 bp, Homo sapiens
ctccgtggagcag

SEQ ID NO: 3912165 - DNA, 19 bp, Homo sapiens
ctccgtttatgggccttgc

SEQ ID NO: 3912166 - DNA, 21 bp, Homo sapiens
ctcctaaacccccgctccaga

SEQ ID NO: 3912167 - DNA, 22 bp, Homo sapiens
ctcctaaacccccgctccagat

SEQ ID NO: 3912168 - DNA, 22 bp, Homo sapiens
ctcctaatttgatcacagtggc

SEQ ID NO: 3912169 - DNA, 16 bp, Homo sapiens
ctcctacctgctgctg

SEQ ID NO: 3912170 - DNA, 14 bp, Homo sapiens
ctcctactttacac

SEQ ID NO: 3912171 - DNA, 16 bp, Homo sapiens
ctcctactttacactc

SEQ ID NO: 3912172 - DNA, 23 bp, Homo sapiens
ctcctagtttgacctcacagtga

SEQ ID NO: 3912173 - DNA, 15 bp, Homo sapiens
ctcctatcttctcca

SEQ ID NO: 3912174 - DNA, 16 bp, Homo sapiens
ctcctatcttctccat

SEQ ID NO: 3912175 - DNA, 22 bp, Homo sapiens
ctcctatggaaaagggtcttct

SEQ ID NO: 3912176 - DNA, 15 bp, Homo sapiens
ctcctatttatgaaa

SEQ ID NO: 3912177 - DNA, 15 bp, Homo sapiens
ctcctccacagtgct

SEQ ID NO: 3912178 - DNA, 18 bp, Homo sapiens
ctcctccacagtgctgct

SEQ ID NO: 3912179 - DNA, 15 bp, Homo sapiens
ctcctccactccacc

SEQ ID NO: 3912180 - DNA, 17 bp, Homo sapiens
ctcctccactccacctc

SEQ ID NO: 3912181 - DNA, 13 bp, Homo sapiens
ctcctccagggcc

SEQ ID NO: 3912182 - DNA, 22 bp, Homo sapiens
ctcctccagggccacgtgccag

SEQ ID NO: 3912183 - DNA, 20 bp, Homo sapiens
ctcctcccacaatctgggac

SEQ ID NO: 3912184 - DNA, 12 bp, Homo sapiens
ctcctcccagga

SEQ ID NO: 3912185 - DNA, 14 bp, Homo sapiens
ctcctcccggtgcc

SEQ ID NO: 3912186 - DNA, 14 bp, Homo sapiens
ctcctccttcccct

SEQ ID NO: 3912187 - DNA, 15 bp, Homo sapiens
ctcctccttcccctg

SEQ ID NO: 3912188 - DNA, 18 bp, Homo sapiens
ctcctcggccccctccat

SEQ ID NO: 3912189 - DNA, 11 bp, Homo sapiens
ctcctctccag

SEQ ID NO: 3912190 - DNA, 12 bp, Homo sapiens
ctcctctgccac

SEQ ID NO: 3912191 - DNA, 15 bp, Homo sapiens
ctcctctgccacctc

SEQ ID NO: 3912192 - DNA, 15 bp, Homo sapiens
ctcctctgctgctcc

SEQ ID NO: 3912193 - DNA, 23 bp, Homo sapiens
ctcctctgcttgcatcacttggg

SEQ ID NO: 3912194 - DNA, 13 bp, Homo sapiens
ctcctctggccca

SEQ ID NO: 3912195 - DNA, 12 bp, Homo sapiens
ctcctctgtcca

SEQ ID NO: 3912196 - DNA, 21 bp, Homo sapiens
ctcctcttaccgtagcctccg

SEQ ID NO: 3912197 - DNA, 12 bp, Homo sapiens
ctcctcttgcca

SEQ ID NO: 3912198 - DNA, 18 bp, Homo sapiens
ctcctcttgccactgcct

SEQ ID NO: 3912199 - DNA, 16 bp, Homo sapiens
ctcctgaagcctctgc

SEQ ID NO: 3912200 - DNA, 19 bp, Homo sapiens
ctcctgactccagtgagct

SEQ ID NO: 3912201 - DNA, 14 bp, Homo sapiens
ctcctgatggccaa

SEQ ID NO: 3912202 - DNA, 17 bp, Homo sapiens
ctcctgatttctctgaa

SEQ ID NO: 3912203 - DNA, 18 bp, Homo sapiens
ctcctgatttctctgaac

SEQ ID NO: 3912204 - DNA, 19 bp, Homo sapiens
ctcctgatttctctgaaca

SEQ ID NO: 3912205 - DNA, 14 bp, Homo sapiens
ctcctgattttgta

SEQ ID NO: 3912206 - DNA, 15 bp, Homo sapiens
ctcctgattttgtag

SEQ ID NO: 3912207 - DNA, 15 bp, Homo sapiens
ctcctgcccaggaga

SEQ ID NO: 3912208 - DNA, 12 bp, Homo sapiens
ctcctgccctgt

SEQ ID NO: 3912209 - DNA, 12 bp, Homo sapiens
ctcctgcctcta

SEQ ID NO: 3912210 - DNA, 15 bp, Homo sapiens
ctcctgcctctactg

SEQ ID NO: 3912211 - DNA, 22 bp, Homo sapiens
ctcctgcctctactgggaaggc

SEQ ID NO: 3912212 - DNA, 15 bp, Homo sapiens
ctcctgcctgtagca

SEQ ID NO: 3912213 - DNA, 16 bp, Homo sapiens
ctcctgcctgtagcag

SEQ ID NO: 3912214 - DNA, 19 bp, Homo sapiens
ctcctgcgtctgtttttaa

SEQ ID NO: 3912215 - DNA, 17 bp, Homo sapiens
ctcctggaagctgtgtc

SEQ ID NO: 3912216 - DNA, 15 bp, Homo sapiens
ctcctggccagacgc

SEQ ID NO: 3912217 - DNA, 13 bp, Homo sapiens
ctcctggctgcca

SEQ ID NO: 3912218 - DNA, 21 bp, Homo sapiens
ctcctggcttcccatccccag

SEQ ID NO: 3912219 - DNA, 17 bp, Homo sapiens
ctcctgggggtggcagg

SEQ ID NO: 3912220 - DNA, 22 bp, Homo sapiens
ctcctggttcaagcgattctca

SEQ ID NO: 3912221 - DNA, 15 bp, Homo sapiens
ctcctgtccctaccc

SEQ ID NO: 3912222 - DNA, 12 bp, Homo sapiens
ctcctgtcctcc

SEQ ID NO: 3912223 - DNA, 13 bp, Homo sapiens
ctcctgtcctccc

SEQ ID NO: 3912224 - DNA, 15 bp, Homo sapiens
ctcctgtcctcccat

SEQ ID NO: 3912225 - DNA, 20 bp, Homo sapiens
ctcctgtcctcccatcccct

SEQ ID NO: 3912226 - DNA, 19 bp, Homo sapiens
ctcctgtgcccctcagaga

SEQ ID NO: 3912227 - DNA, 21 bp, Homo sapiens
ctcctgtgcccctcagagagg

SEQ ID NO: 3912228 - DNA, 11 bp, Homo sapiens
ctcctgtgcta

SEQ ID NO: 3912229 - DNA, 14 bp, Homo sapiens
ctcctgtgctctgg

SEQ ID NO: 3912230 - DNA, 22 bp, Homo sapiens
ctcctgtgctggactgtttcct

SEQ ID NO: 3912231 - DNA, 13 bp, Homo sapiens
ctcctgtgggagc

SEQ ID NO: 3912232 - DNA, 15 bp, Homo sapiens
ctcctgtgggagcct

SEQ ID NO: 3912233 - DNA, 17 bp, Homo sapiens
ctcctgtgggagcctcg

SEQ ID NO: 3912234 - DNA, 12 bp, Homo sapiens
ctcctgtttcca

SEQ ID NO: 3912235 - DNA, 21 bp, Homo sapiens
ctccttactctgagcccaggc

SEQ ID NO: 3912236 - DNA, 16 bp, Homo sapiens
ctccttattttgtatt

SEQ ID NO: 3912237 - DNA, 16 bp, Homo sapiens
ctccttccagctagtg

SEQ ID NO: 3912238 - DNA, 16 bp, Homo sapiens
ctccttcccctgtggt

SEQ ID NO: 3912239 - DNA, 21 bp, Homo sapiens
ctccttcccgccgcccgaccc

SEQ ID NO: 3912240 - DNA, 16 bp, Homo sapiens
ctccttcccttctctc

SEQ ID NO: 3912241 - DNA, 21 bp, Homo sapiens
ctccttcctgccccaactcct

SEQ ID NO: 3912242 - DNA, 21 bp, Homo sapiens
ctccttcgtgtctctcccacc

SEQ ID NO: 3912243 - DNA, 21 bp, Homo sapiens
ctccttgggctcctggctgcc

SEQ ID NO: 3912244 - DNA, 21 bp, Homo sapiens
ctcctttctccagccagcaat

SEQ ID NO: 3912245 - DNA, 14 bp, Homo sapiens
ctgagagcagatgg

SEQ ID NO: 3912246 - DNA, 21 bp, Homo sapiens
ctgagagccctgctgtgggag

SEQ ID NO: 3912247 - DNA, 14 bp, Homo sapiens
ctgagagctcacag

SEQ ID NO: 3912248 - DNA, 15 bp, Homo sapiens
ctgagaggaagatga

SEQ ID NO: 3912249 - DNA, 19 bp, Homo sapiens
ctgagaggaagatgaagag

SEQ ID NO: 3912250 - DNA, 14 bp, Homo sapiens
ctgagaggccctgg

SEQ ID NO: 3912251 - DNA, 16 bp, Homo sapiens
ctgagaggccctggat

SEQ ID NO: 3912252 - DNA, 20 bp, Homo sapiens
ctgagagttggctcaggcag

SEQ ID NO: 3912253 - DNA, 18 bp, Homo sapiens
ctgagatctccctccagg

SEQ ID NO: 3912254 - DNA, 16 bp, Homo sapiens
ctgagatgtgaacaca

SEQ ID NO: 3912255 - DNA, 12 bp, Homo sapiens
ctgagcaagagc

SEQ ID NO: 3912256 - DNA, 16 bp, Homo sapiens
ctgagcaagagctggc

SEQ ID NO: 3912257 - DNA, 20 bp, Homo sapiens
ctgagcaagagctggcaaag

SEQ ID NO: 3912258 - DNA, 16 bp, Homo sapiens
ctgagcactgccagga

SEQ ID NO: 3912259 - DNA, 21 bp, Homo sapiens
ctgagcaggcccgacagagag

SEQ ID NO: 3912260 - DNA, 13 bp, Homo sapiens
ctgagcagggccg

SEQ ID NO: 3912261 - DNA, 16 bp, Homo sapiens
ctgagcagggccgggg

SEQ ID NO: 3912262 - DNA, 13 bp, Homo sapiens
ctgagcccaggag

SEQ ID NO: 3912263 - DNA, 15 bp, Homo sapiens
ctgagcccaggagct

SEQ ID NO: 3912264 - DNA, 16 bp, Homo sapiens
ctgagcccaggccgtt

SEQ ID NO: 3912265 - DNA, 15 bp, Homo sapiens
ctgagcccagggagg

SEQ ID NO: 3912266 - DNA, 16 bp, Homo sapiens
ctgagcccagggaggc

SEQ ID NO: 3912267 - DNA, 19 bp, Homo sapiens
ctgagcccagggaggccga

SEQ ID NO: 3912268 - DNA, 17 bp, Homo sapiens
ctgagcccccggctagt

SEQ ID NO: 3912269 - DNA, 22 bp, Homo sapiens
ctgagcccccggctagtaccct

SEQ ID NO: 3912270 - DNA, 22 bp, Homo sapiens
ctcaccaggggtgctatgacat

SEQ ID NO: 3912271 - DNA, 21 bp, Homo sapiens
ctcaccagggtccgcaccagc

SEQ ID NO: 3912272 - DNA, 16 bp, Homo sapiens
ctcacccatgtgccaa

SEQ ID NO: 3912273 - DNA, 14 bp, Homo sapiens
ctcacccccagctt

SEQ ID NO: 3912274 - DNA, 17 bp, Homo sapiens
ctcacccccagctttgc

SEQ ID NO: 3912275 - DNA, 18 bp, Homo sapiens
ctcacccctctcccccgc

SEQ ID NO: 3912276 - DNA, 14 bp, Homo sapiens
ctcacctctctcta

SEQ ID NO: 3912277 - DNA, 19 bp, Homo sapiens
ctcacctgagtcaccctac

SEQ ID NO: 3912278 - DNA, 17 bp, Homo sapiens
ctcacctgggcctttcc

SEQ ID NO: 3912279 - DNA, 21 bp, Homo sapiens
ctcacctgggcctttcctgtg

SEQ ID NO: 3912280 - DNA, 22 bp, Homo sapiens
ctcacctgggcctttcctgtgc

SEQ ID NO: 3912281 - DNA, 16 bp, Homo sapiens
ctcacgactcttcctg

SEQ ID NO: 3912282 - DNA, 17 bp, Homo sapiens
ctcacgactcttcctgc

SEQ ID NO: 3912283 - DNA, 19 bp, Homo sapiens
ctcacgcctgtaatcccag

SEQ ID NO: 3912284 - DNA, 15 bp, Homo sapiens
ctcacgctctggaca

SEQ ID NO: 3912285 - DNA, 16 bp, Homo sapiens
ctcactcactcattcc

SEQ ID NO: 3912286 - DNA, 12 bp, Homo sapiens
ctcactccacca

SEQ ID NO: 3912287 - DNA, 17 bp, Homo sapiens
ctcactccaccacccaa

SEQ ID NO: 3912288 - DNA, 13 bp, Homo sapiens
ctcactccagccc

SEQ ID NO: 3912289 - DNA, 14 bp, Homo sapiens
ctcactccagccca

SEQ ID NO: 3912290 - DNA, 11 bp, Homo sapiens
ctcactcctgt

SEQ ID NO: 3912291 - DNA, 14 bp, Homo sapiens
ctcactctggcctc

SEQ ID NO: 3912292 - DNA, 15 bp, Homo sapiens
ctcactctgtcagcc

SEQ ID NO: 3912293 - DNA, 19 bp, Homo sapiens
ctcactctgtcagccagcc

SEQ ID NO: 3912294 - DNA, 12 bp, Homo sapiens
ctcactgctcaa

SEQ ID NO: 3912295 - DNA, 21 bp, Homo sapiens
ctcactgctcaagaagacatg

SEQ ID NO: 3912296 - DNA, 21 bp, Homo sapiens
ctcacttataccaaagggaaa

SEQ ID NO: 3912297 - DNA, 13 bp, Homo sapiens
ctcacttccctgg

SEQ ID NO: 3912298 - DNA, 14 bp, Homo sapiens
ctcacttccctggg

SEQ ID NO: 3912299 - DNA, 19 bp, Homo sapiens
ctcagaaaagaaaaccatt

SEQ ID NO: 3912300 - DNA, 22 bp, Homo sapiens
ctcagaaaagaaaaccatttta

SEQ ID NO: 3912301 - DNA, 14 bp, Homo sapiens
ctcagaacagctga

SEQ ID NO: 3912302 - DNA, 23 bp, Homo sapiens
ctcagaagcctgggggcctggct

SEQ ID NO: 3912303 - DNA, 14 bp, Homo sapiens
ctcagaatgctcta

SEQ ID NO: 3912304 - DNA, 17 bp, Homo sapiens
ctcagacaatccactct

SEQ ID NO: 3912305 - DNA, 14 bp, Homo sapiens
ctcagactgctcaa

SEQ ID NO: 3912306 - DNA, 15 bp, Homo sapiens
ctcagacttgccagg

SEQ ID NO: 3912307 - DNA, 14 bp, Homo sapiens
ctcagagaggcatg

SEQ ID NO: 3912308 - DNA, 17 bp, Homo sapiens
ctcagagcccctccctg

SEQ ID NO: 3912309 - DNA, 19 bp, Homo sapiens
ctcagagcccctccctgct

SEQ ID NO: 3912310 - DNA, 20 bp, Homo sapiens
ctcagagcccctccctgcta

SEQ ID NO: 3912311 - DNA, 20 bp, Homo sapiens
ctcagaggctatagctggga

SEQ ID NO: 3912312 - DNA, 15 bp, Homo sapiens
ctcagcaaggtgtga

SEQ ID NO: 3912313 - DNA, 14 bp, Homo sapiens
ctcagcagccccct

SEQ ID NO: 3912314 - DNA, 14 bp, Homo sapiens
ctcagcagccctcc

SEQ ID NO: 3912315 - DNA, 17 bp, Homo sapiens
ctcagcagccctcctca

SEQ ID NO: 3912316 - DNA, 13 bp, Homo sapiens
ctcagcaggaacc

SEQ ID NO: 3912317 - DNA, 14 bp, Homo sapiens
ctcagcaggaacct

SEQ ID NO: 3912318 - DNA, 16 bp, Homo sapiens
ctcagccaaacacaga

SEQ ID NO: 3912319 - DNA, 17 bp, Homo sapiens
ctcagccaaacacagag

SEQ ID NO: 3912320 - DNA, 14 bp, Homo sapiens
ctcagccacacccc

SEQ ID NO: 3912321 - DNA, 15 bp, Homo sapiens
ctcagccacacccca

SEQ ID NO: 3912322 - DNA, 21 bp, Homo sapiens
ctcagccatgaggagttgctg

SEQ ID NO: 3912323 - DNA, 19 bp, Homo sapiens
ctcagcccacatagtgatg

SEQ ID NO: 3912324 - DNA, 18 bp, Homo sapiens
ctcagccctgactggtgc

SEQ ID NO: 3912325 - DNA, 11 bp, Homo sapiens
ctcagccctgg

SEQ ID NO: 3912326 - DNA, 19 bp, Homo sapiens
ctcagccctgggccccacc

SEQ ID NO: 3912327 - DNA, 21 bp, Homo sapiens
ctcagccctgggccccaccac

SEQ ID NO: 3912328 - DNA, 20 bp, Homo sapiens
ctcagcctcctaagcagctg

SEQ ID NO: 3912329 - DNA, 15 bp, Homo sapiens
ctcagccttggataa

SEQ ID NO: 3912330 - DNA, 14 bp, Homo sapiens
ctcagcgaatgaat

SEQ ID NO: 3912331 - DNA, 13 bp, Homo sapiens
ctcagctccagaa

SEQ ID NO: 3912332 - DNA, 13 bp, Homo sapiens
ctcagctgcacat

SEQ ID NO: 3912333 - DNA, 23 bp, Homo sapiens
ctcagctgcacattcctggcccc

SEQ ID NO: 3912334 - DNA, 14 bp, Homo sapiens
ctcagcttttttct

SEQ ID NO: 3912335 - DNA, 18 bp, Homo sapiens
ctcaggaagaaaccccaa

SEQ ID NO: 3912336 - DNA, 16 bp, Homo sapiens
ctcaggacacaggcct

SEQ ID NO: 3912337 - DNA, 20 bp, Homo sapiens
ctcaggacacaggcctgtgt

SEQ ID NO: 3912338 - DNA, 22 bp, Homo sapiens
ctcaggagcacaggcagctgga

SEQ ID NO: 3912339 - DNA, 19 bp, Homo sapiens
ctcaggaggcgaataaatg

SEQ ID NO: 3912340 - DNA, 19 bp, Homo sapiens
ctcaggaggctgaggcaga

SEQ ID NO: 3912341 - DNA, 20 bp, Homo sapiens
ctcaggaggctgaggcagaa

SEQ ID NO: 3912342 - DNA, 23 bp, Homo sapiens
ctcaggaggctgaggcagaagaa

SEQ ID NO: 3912343 - DNA, 16 bp, Homo sapiens
ctcaggcaagcccctc

SEQ ID NO: 3912344 - DNA, 22 bp, Homo sapiens
ctcaggcaagcccctcagccct

SEQ ID NO: 3912345 - DNA, 14 bp, Homo sapiens
ctcaggcagacaag

SEQ ID NO: 3912346 - DNA, 17 bp, Homo sapiens
ctcaggcagacaagagc

SEQ ID NO: 3912347 - DNA, 21 bp, Homo sapiens
ctcaggcagacaagagctgct

SEQ ID NO: 3912348 - DNA, 20 bp, Homo sapiens
ctcaggcagaggatgttctg

SEQ ID NO: 3912349 - DNA, 21 bp, Homo sapiens
ctcaggcagaggatgttctgg

SEQ ID NO: 3912350 - DNA, 15 bp, Homo sapiens
ctctgaatattttgt

SEQ ID NO: 3912351 - DNA, 22 bp, Homo sapiens
ctctgaatctgataggaaaaga

SEQ ID NO: 3912352 - DNA, 17 bp, Homo sapiens
ctctgaatggtccaggg

SEQ ID NO: 3912353 - DNA, 17 bp, Homo sapiens
ctctgacaagggctgac

SEQ ID NO: 3912354 - DNA, 22 bp, Homo sapiens
ctctgacagccctgcggagacc

SEQ ID NO: 3912355 - DNA, 13 bp, Homo sapiens
ctctgagaggccc

SEQ ID NO: 3912356 - DNA, 15 bp, Homo sapiens
ctctgagaggccctg

SEQ ID NO: 3912357 - DNA, 15 bp, Homo sapiens
ctctgaggccagcct

SEQ ID NO: 3912358 - DNA, 19 bp, Homo sapiens
ctctgaggccagcctggcc

SEQ ID NO: 3912359 - DNA, 21 bp, Homo sapiens
ctctgaggccagcctggcctc

SEQ ID NO: 3912360 - DNA, 22 bp, Homo sapiens
ctctgaggcgccccaacccgtg

SEQ ID NO: 3912361 - DNA, 23 bp, Homo sapiens
ctctgaggcgccccaacccgtgg

SEQ ID NO: 3912362 - DNA, 21 bp, Homo sapiens
ctctgaggcttccagagagtc

SEQ ID NO: 3912363 - DNA, 17 bp, Homo sapiens
ctctgatccttcttcct

SEQ ID NO: 3912364 - DNA, 15 bp, Homo sapiens
ctctgatgcatcaga

SEQ ID NO: 3912365 - DNA, 13 bp, Homo sapiens
ctgatgctgcccc

SEQ ID NO: 3912366 - DNA, 19 bp, Homo sapiens
ctgatgctgccccgttccc

SEQ ID NO: 3912367 - DNA, 22 bp, Homo sapiens
ctgatgctttgcttcaaatcca

SEQ ID NO: 3912368 - DNA, 14 bp, Homo sapiens
ctgatggacaagga

SEQ ID NO: 3912369 - DNA, 20 bp, Homo sapiens
ctgatggaccgggtgggcct

SEQ ID NO: 3912370 - DNA, 21 bp, Homo sapiens
ctgatggaccgggtgggcctg

SEQ ID NO: 3912371 - DNA, 13 bp, Homo sapiens
ctgatggagaagg

SEQ ID NO: 3912372 - DNA, 22 bp, Homo sapiens
ctgatggcacttagctatcaga

SEQ ID NO: 3912373 - DNA, 15 bp, Homo sapiens
ctgatggccaagggg

SEQ ID NO: 3912374 - DNA, 18 bp, Homo sapiens
ctgatggccaagggggtg

SEQ ID NO: 3912375 - DNA, 21 bp, Homo sapiens
ctgatggccaagggggtggac

SEQ ID NO: 3912376 - DNA, 16 bp, Homo sapiens
ctgatgggacatcaaa

SEQ ID NO: 3912377 - DNA, 16 bp, Homo sapiens
ctgatggtacaggaaa

SEQ ID NO: 3912378 - DNA, 17 bp, Homo sapiens
ctgatggtgagctggga

SEQ ID NO: 3912379 - DNA, 18 bp, Homo sapiens
ctgatggtgagctgggaa

SEQ ID NO: 3912380 - DNA, 19 bp, Homo sapiens
ctgatggtgagctgggaag

SEQ ID NO: 3912381 - DNA, 16 bp, Homo sapiens
ctgatggtgctcacga

SEQ ID NO: 3912382 - DNA, 12 bp, Homo sapiens
ctgatgtttgtt

SEQ ID NO: 3912383 - DNA, 17 bp, Homo sapiens
ctgattcaagaaacaga

SEQ ID NO: 3912384 - DNA, 14 bp, Homo sapiens
ctgattctgggatg

SEQ ID NO: 3912385 - DNA, 14 bp, Homo sapiens
ctgattggctcacc

SEQ ID NO: 3912386 - DNA, 15 bp, Homo sapiens
ctgattgggtgccat

SEQ ID NO: 3912387 - DNA, 23 bp, Homo sapiens
ctgattgggtgccatgtggagtg

SEQ ID NO: 3912388 - DNA, 13 bp, Homo sapiens
ctgatttcacaac

SEQ ID NO: 3912389 - DNA, 12 bp, Homo sapiens
ctgatttctcac

SEQ ID NO: 3912390 - DNA, 23 bp, Homo sapiens
ctgatttctctgaacagaaaaca

SEQ ID NO: 3912391 - DNA, 18 bp, Homo sapiens
ctgattttcaaagctttt

SEQ ID NO: 3912392 - DNA, 18 bp, Homo sapiens
ctgattttgtagttaatt

SEQ ID NO: 3912393 - DNA, 18 bp, Homo sapiens
ctgattttgtcactgtct

SEQ ID NO: 3912394 - DNA, 19 bp, Homo sapiens
ctgattttgtcactgtctt

SEQ ID NO: 3912395 - DNA, 19 bp, Homo sapiens
ctgcaaagggaactgaaga

SEQ ID NO: 3912396 - DNA, 20 bp, Homo sapiens
ctgcaacctcttcctcctgg

SEQ ID NO: 3912397 - DNA, 17 bp, Homo sapiens
ctgcaacggcttagact

SEQ ID NO: 3912398 - DNA, 15 bp, Homo sapiens
ctgcaagagccttgg

SEQ ID NO: 3912399 - DNA, 17 bp, Homo sapiens
ctgcaagagccttggtg

SEQ ID NO: 3912400 - DNA, 18 bp, Homo sapiens
ctgcaagaggctcctgtc

SEQ ID NO: 3912401 - DNA, 15 bp, Homo sapiens
ctgcaagatttcaca

SEQ ID NO: 3912402 - DNA, 14 bp, Homo sapiens
ctgcaagcagggct

SEQ ID NO: 3912403 - DNA, 16 bp, Homo sapiens
ctgcaagccccagggc

SEQ ID NO: 3912404 - DNA, 18 bp, Homo sapiens
ctgcaagccccagggcct

SEQ ID NO: 3912405 - DNA, 15 bp, Homo sapiens
ctgcaagggccagag

SEQ ID NO: 3912406 - DNA, 19 bp, Homo sapiens
ctgcaagtgacatctcttt

SEQ ID NO: 3912407 - DNA, 20 bp, Homo sapiens
ctgcaatactaattgagaaa

SEQ ID NO: 3912408 - DNA, 15 bp, Homo sapiens
ctgcaatctccaggg

SEQ ID NO: 3912409 - DNA, 16 bp, Homo sapiens
ctgcaatctccagggc

SEQ ID NO: 3912410 - DNA, 21 bp, Homo sapiens
ctgcaatctccagggctgccc

SEQ ID NO: 3912411 - DNA, 22 bp, Homo sapiens
ctgcaatctccagggctgcccc

SEQ ID NO: 3912412 - DNA, 15 bp, Homo sapiens
ctgcaatgttttcct

SEQ ID NO: 3912413 - DNA, 13 bp, Homo sapiens
ctgcacaaagccc

SEQ ID NO: 3912414 - DNA, 18 bp, Homo sapiens
ctgcacaaagcccttcca

SEQ ID NO: 3912415 - DNA, 21 bp, Homo sapiens
ctgcacaaagcccttccatgt

SEQ ID NO: 3912416 - DNA, 16 bp, Homo sapiens
ctgcacacacagctcc

SEQ ID NO: 3912417 - DNA, 13 bp, Homo sapiens
ctgcacagcggcc

SEQ ID NO: 3912418 - DNA, 18 bp, Homo sapiens
ctgcacagtgcatctcag

SEQ ID NO: 3912419 - DNA, 17 bp, Homo sapiens
ctgcacattcctggccc

SEQ ID NO: 3912420 - DNA, 18 bp, Homo sapiens
ctgcacattcctggcccc

SEQ ID NO: 3912421 - DNA, 22 bp, Homo sapiens
ctgcacattcctggccccgggc

SEQ ID NO: 3912422 - DNA, 23 bp, Homo sapiens
ctgcaccagcccttccctgcttt

SEQ ID NO: 3912423 - DNA, 20 bp, Homo sapiens
ctctggtggtgcttttgtat

SEQ ID NO: 3912424 - DNA, 17 bp, Homo sapiens
ctctgtacaaaaacaaa

SEQ ID NO: 3912425 - DNA, 22 bp, Homo sapiens
ctctgtataatctatttacata

SEQ ID NO: 3912426 - DNA, 14 bp, Homo sapiens
ctctgtcagccagc

SEQ ID NO: 3912427 - DNA, 23 bp, Homo sapiens
ctctgtcagccagccgccctggg

SEQ ID NO: 3912428 - DNA, 20 bp, Homo sapiens
ctctgtcatcactccctgga

SEQ ID NO: 3912429 - DNA, 21 bp, Homo sapiens
ctctgtcatcactccctggat

SEQ ID NO: 3912430 - DNA, 17 bp, Homo sapiens
ctctgtccaggccactg

SEQ ID NO: 3912431 - DNA, 21 bp, Homo sapiens
ctctgtccaggccactgtggc

SEQ ID NO: 3912432 - DNA, 24 bp, Homo sapiens
ctctgtccaggccactgtggccag

SEQ ID NO: 3912433 - DNA, 20 bp, Homo sapiens
ctctgtctcgagcgccctgc

SEQ ID NO: 3912434 - DNA, 21 bp, Homo sapiens
ctctgtctcgagcgccctgca

SEQ ID NO: 3912435 - DNA, 22 bp, Homo sapiens
ctctgtctcgagcgccctgcag

SEQ ID NO: 3912436 - DNA, 16 bp, Homo sapiens
ctctgtgccagagcct

SEQ ID NO: 3912437 - DNA, 18 bp, Homo sapiens
ctctgtgccagagcctgg

SEQ ID NO: 3912438 - DNA, 21 bp, Homo sapiens
ctctgtgccagagcctggggc

SEQ ID NO: 3912439 - DNA, 23 bp, Homo sapiens
ctctgtgctttgactcacctgtt

SEQ ID NO: 3912440 - DNA, 18 bp, Homo sapiens
ctgagtggatctccaagg

SEQ ID NO: 3912441 - DNA, 18 bp, Homo sapiens
ctgagtgtgggcttctga

SEQ ID NO: 3912442 - DNA, 15 bp, Homo sapiens
ctgagttacttgtct

SEQ ID NO: 3912443 - DNA, 22 bp, Homo sapiens
ctgagttacttgtctgaggcct

SEQ ID NO: 3912444 - DNA, 23 bp, Homo sapiens
ctgagttacttgtctgaggcctc

SEQ ID NO: 3912445 - DNA, 21 bp, Homo sapiens
ctgagtttcattctcctgcct

SEQ ID NO: 3912446 - DNA, 12 bp, Homo sapiens
ctgataaaatac

SEQ ID NO: 3912447 - DNA, 22 bp, Homo sapiens
ctgataaacattaaacactgta

SEQ ID NO: 3912448 - DNA, 21 bp, Homo sapiens
ctgataatatgtttgaggtta

SEQ ID NO: 3912449 - DNA, 16 bp, Homo sapiens
ctgataggaaaagaag

SEQ ID NO: 3912450 - DNA, 16 bp, Homo sapiens
ctgatatgggactgag

SEQ ID NO: 3912451 - DNA, 16 bp, Homo sapiens
ctgatattatggcaag

SEQ ID NO: 3912452 - DNA, 14 bp, Homo sapiens
ctgatcaaaaataa

SEQ ID NO: 3912453 - DNA, 16 bp, Homo sapiens
ctgatcaaaaataaac

SEQ ID NO: 3912454 - DNA, 20 bp, Homo sapiens
ctgatcaaaaataaactagt

SEQ ID NO: 3912455 - DNA, 17 bp, Homo sapiens
ctgatcacctctggctt

SEQ ID NO: 3912456 - DNA, 18 bp, Homo sapiens
ctgatcatggtcagctca

SEQ ID NO: 3912457 - DNA, 20 bp, Homo sapiens
ctgatcatggtcagctcaca

SEQ ID NO: 3912458 - DNA, 21 bp, Homo sapiens
ctgatcatggtcagctcacac

SEQ ID NO: 3912459 - DNA, 18 bp, Homo sapiens
ctgatccctttcccatga

SEQ ID NO: 3912460 - DNA, 21 bp, Homo sapiens
ctgatcgggataacaaaatca

SEQ ID NO: 3912461 - DNA, 15 bp, Homo sapiens
ctgatgacagagcga

SEQ ID NO: 3912462 - DNA, 19 bp, Homo sapiens
ctgatgacctaacctaagc

SEQ ID NO: 3912463 - DNA, 14 bp, Homo sapiens
ctgatgcatcagaa

SEQ ID NO: 3912464 - DNA, 21 bp, Homo sapiens
ctgatgcatcagaaagggagg

SEQ ID NO: 3912465 - DNA, 22 bp, Homo sapiens
ctgatgcatcagaaagggaggg

SEQ ID NO: 3912466 - DNA, 14 bp, Homo sapiens
gcacatgaggaggg

SEQ ID NO: 3912467 - DNA, 16 bp, Homo sapiens
gcacatgaggagggtg

SEQ ID NO: 3912468 - DNA, 20 bp, Homo sapiens
gcacatgccaatgcacgcac

SEQ ID NO: 3912469 - DNA, 22 bp, Homo sapiens
gcacatggaggagcttggggga

SEQ ID NO: 3912470 - DNA, 12 bp, Homo sapiens
gcacattcttaa

SEQ ID NO: 3912471 - DNA, 19 bp, Homo sapiens
gcacattcttaaaggaaaa

SEQ ID NO: 3912472 - DNA, 14 bp, Homo sapiens
gcacatttatatat

SEQ ID NO: 3912473 - DNA, 20 bp, Homo sapiens
gcacatttatatatatatgt

SEQ ID NO: 3912474 - DNA, 21 bp, Homo sapiens
gcaccaattgtacattccctg

SEQ ID NO: 3912475 - DNA, 20 bp, Homo sapiens
gcaccacggcgtttttttac

SEQ ID NO: 3912476 - DNA, 18 bp, Homo sapiens
gcaccactgtgtatttaa

SEQ ID NO: 3912477 - DNA, 12 bp, Homo sapiens
gcaccagaatgc

SEQ ID NO: 3912478 - DNA, 15 bp, Homo sapiens
gcaccagaggctgca

SEQ ID NO: 3912479 - DNA, 23 bp, Homo sapiens
gcaccagagtgaaagggctatgg

SEQ ID NO: 3912480 - DNA, 17 bp, Homo sapiens
gcaccagatgcaacctc

SEQ ID NO: 3912481 - DNA, 19 bp, Homo sapiens
gcaccagccccctggatgg

SEQ ID NO: 3912482 - DNA, 16 bp, Homo sapiens
gcaccagcccttccct

SEQ ID NO: 3912483 - DNA, 17 bp, Homo sapiens
gcaccagctctgtggcc

SEQ ID NO: 3912484 - DNA, 18 bp, Homo sapiens
gcaccagctctgtggcct

SEQ ID NO: 3912485 - DNA, 11 bp, Homo sapiens
gcaccagctgc

SEQ ID NO: 3912486 - DNA, 13 bp, Homo sapiens
gcaccagctgctc

SEQ ID NO: 3912487 - DNA, 19 bp, Homo sapiens
gcaccagctgctctgcccc

SEQ ID NO: 3912488 - DNA, 20 bp, Homo sapiens
gcaccagctgctctgcccct

SEQ ID NO: 3912489 - DNA, 21 bp, Homo sapiens
gcaccagctgctctgcccctt

SEQ ID NO: 3912490 - DNA, 16 bp, Homo sapiens
gcaccagcttctccag

SEQ ID NO: 3912491 - DNA, 16 bp, Homo sapiens
gcaccatcacacatgc

SEQ ID NO: 3912492 - DNA, 19 bp, Homo sapiens
gcaccatggaggcaggctc

SEQ ID NO: 3912493 - DNA, 14 bp, Homo sapiens
gcacccacctccac

SEQ ID NO: 3912494 - DNA, 18 bp, Homo sapiens
gcacccacctccaccccc

SEQ ID NO: 3912495 - DNA, 17 bp, Homo sapiens
gcacccactcaccaggg

SEQ ID NO: 3912496 - DNA, 13 bp, Homo sapiens
gcacccaggctcc

SEQ ID NO: 3912497 - DNA, 16 bp, Homo sapiens
gcacccaggctccatg

SEQ ID NO: 3912498 - DNA, 18 bp, Homo sapiens
gcacccaggctccatggg

SEQ ID NO: 3912499 - DNA, 14 bp, Homo sapiens
gcaccccccaagct

SEQ ID NO: 3912500 - DNA, 20 bp, Homo sapiens
gcaccccctcattcccctcg

SEQ ID NO: 3912501 - DNA, 24 bp, Homo sapiens
gcaccccctgcagcttgtagccag

SEQ ID NO: 3912502 - DNA, 13 bp, Homo sapiens
gcacccctgtctc

SEQ ID NO: 3912503 - DNA, 15 bp, Homo sapiens
gcaccctctcctggg

SEQ ID NO: 3912504 - DNA, 18 bp, Homo sapiens
gcaccctctcctgggggt

SEQ ID NO: 3912505 - DNA, 22 bp, Homo sapiens
gcaccctctcctgggggtggca

SEQ ID NO: 3912506 - DNA, 18 bp, Homo sapiens
gcaccctggaaaggggag

SEQ ID NO: 3912507 - DNA, 17 bp, Homo sapiens
gcacccttctttcctct

SEQ ID NO: 3912508 - DNA, 15 bp, Homo sapiens
gcaccggcgctgcag

SEQ ID NO: 3912509 - DNA, 21 bp, Homo sapiens
gcaccgtcatggcttaatgtt

SEQ ID NO: 3912510 - DNA, 21 bp, Homo sapiens
gcacctaaaccaccagtgccc

SEQ ID NO: 3912511 - DNA, 23 bp, Homo sapiens
gcacctaaaccaccagtgcccaa

SEQ ID NO: 3912512 - DNA, 19 bp, Homo sapiens
gcacctatcacccaggctg

SEQ ID NO: 3912513 - DNA, 20 bp, Homo sapiens
gcacctcagacaatccactc

SEQ ID NO: 3912514 - DNA, 17 bp, Homo sapiens
gcacctccccccactgc

SEQ ID NO: 3912515 - DNA, 21 bp, Homo sapiens
gcacctccccccactgcaggc

SEQ ID NO: 3912516 - DNA, 20 bp, Homo sapiens
gcacctcctgagaaggcgag

SEQ ID NO: 3912517 - DNA, 19 bp, Homo sapiens
gcacctgaaccccatgggc

SEQ ID NO: 3912518 - DNA, 17 bp, Homo sapiens
gcacctgaccagaatgc

SEQ ID NO: 3912519 - DNA, 21 bp, Homo sapiens
gcacctgccgacctcgtcctc

SEQ ID NO: 3912520 - DNA, 11 bp, Homo sapiens
gcacctgctgg

SEQ ID NO: 3912521 - DNA, 12 bp, Homo sapiens
gcacctgctgga

SEQ ID NO: 3912522 - DNA, 16 bp, Homo sapiens
gcacctggcctgctgg

SEQ ID NO: 3912523 - DNA, 16 bp, Homo sapiens
gcacctgggccctggg

SEQ ID NO: 3912524 - DNA, 18 bp, Homo sapiens
gcacctgggccctggggc

SEQ ID NO: 3912525 - DNA, 15 bp, Homo sapiens
gcaccttacattcct

SEQ ID NO: 3912526 - DNA, 16 bp, Homo sapiens
gcaccttacattccta

SEQ ID NO: 3912527 - DNA, 17 bp, Homo sapiens
gcaccttacattcctag

SEQ ID NO: 3912528 - DNA, 13 bp, Homo sapiens
gcaccttagtggc

SEQ ID NO: 3912529 - DNA, 15 bp, Homo sapiens
gcacgaacccacctg

SEQ ID NO: 3912530 - DNA, 16 bp, Homo sapiens
gcacgattttgcacaa

SEQ ID NO: 3912531 - DNA, 17 bp, Homo sapiens
gcacgtcttgctatttg

SEQ ID NO: 3912532 - DNA, 19 bp, Homo sapiens
gcacgtgatctgctggcct

SEQ ID NO: 3912533 - DNA, 23 bp, Homo sapiens
gcactaaaacccatcttccccgg

SEQ ID NO: 3912534 - DNA, 21 bp, Homo sapiens
gagagatctagaaagtgggtt

SEQ ID NO: 3912535 - DNA, 14 bp, Homo sapiens
gagagcagagggtt

SEQ ID NO: 3912536 - DNA, 10 bp, Homo sapiens
gagagcagct

SEQ ID NO: 3912537 - DNA, 12 bp, Homo sapiens
gagagcagctgg

SEQ ID NO: 3912538 - DNA, 19 bp, Homo sapiens
gagagcagctggctctcca

SEQ ID NO: 3912539 - DNA, 21 bp, Homo sapiens
gatatatatttactaaaagaa

SEQ ID NO: 3912540 - DNA, 15 bp, Homo sapiens
gatatatgtatttat

SEQ ID NO: 3912541 - DNA, 23 bp, Homo sapiens
gatatatgtatttattgtcatta

SEQ ID NO: 3912542 - DNA, 23 bp, Homo sapiens
gatatctgaacacatactagaaa

SEQ ID NO: 3912543 - DNA, 14 bp, Homo sapiens
gatatgcagaagga

SEQ ID NO: 3912544 - DNA, 17 bp, Homo sapiens
gatatgttgttaaacac

SEQ ID NO: 3912545 - DNA, 21 bp, Homo sapiens
gatattttcaacgcagccctg

SEQ ID NO: 3912546 - DNA, 22 bp, Homo sapiens
gatatttttgtacgttatatat

SEQ ID NO: 3912547 - DNA, 23 bp, Homo sapiens
gatcaaaaataaactagtttcca

SEQ ID NO: 3912548 - DNA, 22 bp, Homo sapiens
gatcaaaccccgaccacctgcc

SEQ ID NO: 3912549 - DNA, 14 bp, Homo sapiens
gatcaaagttcctg

SEQ ID NO: 3912550 - DNA, 16 bp, Homo sapiens
gatcaaagttcctgtt

SEQ ID NO: 3912551 - DNA, 18 bp, Homo sapiens
gatcaaagttcctgttca

SEQ ID NO: 3912552 - DNA, 14 bp, Homo sapiens
gatcaagaaagtgt

SEQ ID NO: 3912553 - DNA, 22 bp, Homo sapiens
gatcacagtggcgagaggagag

SEQ ID NO: 3912554 - DNA, 14 bp, Homo sapiens
gatcaccagcccgg

SEQ ID NO: 3912555 - DNA, 15 bp, Homo sapiens
gatcaccagcccggc

SEQ ID NO: 3912556 - DNA, 18 bp, Homo sapiens
gatcaccagcccggcctg

SEQ ID NO: 3912557 - DNA, 13 bp, Homo sapiens
gatcagaaggctg

SEQ ID NO: 3912558 - DNA, 15 bp, Homo sapiens
gatcagaaggctggg

SEQ ID NO: 3912559 - DNA, 21 bp, Homo sapiens
gatcagaaggctggggccagt

SEQ ID NO: 3912560 - DNA, 17 bp, Homo sapiens
gatcagccccgctcctc

SEQ ID NO: 3912561 - DNA, 22 bp, Homo sapiens
gatcatggtcagctcacaccct

SEQ ID NO: 3912562 - DNA, 19 bp, Homo sapiens
gatcattacatggctgtgg

SEQ ID NO: 3912563 - DNA, 23 bp, Homo sapiens
gatcattttcttatcttctgcaa

SEQ ID NO: 3912564 - DNA, 16 bp, Homo sapiens
gatccacacacagagg

SEQ ID NO: 3912565 - DNA, 19 bp, Homo sapiens
gatccacacacagaggaag

SEQ ID NO: 3912566 - DNA, 19 bp, Homo sapiens
gatccaccctcaaatgtca

SEQ ID NO: 3912567 - DNA, 19 bp, Homo sapiens
gatccaggaagcatgagtg

SEQ ID NO: 3912568 - DNA, 19 bp, Homo sapiens
gatccatgtagcaggactg

SEQ ID NO: 3912569 - DNA, 19 bp, Homo sapiens
gatccatttggacaaaatg

SEQ ID NO: 3912570 - DNA, 18 bp, Homo sapiens
gatcccacttcactgtga

SEQ ID NO: 3912571 - DNA, 21 bp, Homo sapiens
gatcccatccatcagctccct

SEQ ID NO: 3912572 - DNA, 21 bp, Homo sapiens
gatcccatgtcacctcagctg

SEQ ID NO: 3912573 - DNA, 14 bp, Homo sapiens
gatcccccaggttc

SEQ ID NO: 3912574 - DNA, 14 bp, Homo sapiens
gatccgctgccacc

SEQ ID NO: 3912575 - DNA, 19 bp, Homo sapiens
gatcctaactgaagagaca

SEQ ID NO: 3912576 - DNA, 20 bp, Homo sapiens
gatcctaactgaagagacag

SEQ ID NO: 3912577 - DNA, 19 bp, Homo sapiens
gatcctactcttcctttct

SEQ ID NO: 3912578 - DNA, 16 bp, Homo sapiens
gatcctaggtgctgga

SEQ ID NO: 3912579 - DNA, 18 bp, Homo sapiens
gatcctattctcaccagg

SEQ ID NO: 3912580 - DNA, 18 bp, Homo sapiens
gatcctcacaggagcaga

SEQ ID NO: 3912581 - DNA, 22 bp, Homo sapiens
gatcctcacaggagcagacaga

SEQ ID NO: 3912582 - DNA, 11 bp, Homo sapiens
gatcctgcagg

SEQ ID NO: 3912583 - DNA, 20 bp, Homo sapiens
gatcctgctgtggcctcact

SEQ ID NO: 3912584 - DNA, 22 bp, Homo sapiens
gatccttgtctttactgacaag

SEQ ID NO: 3912585 - DNA, 15 bp, Homo sapiens
gatcgagccactgca

SEQ ID NO: 3912586 - DNA, 17 bp, Homo sapiens
gatcgcttgagcccagg

SEQ ID NO: 3912587 - DNA, 20 bp, Homo sapiens
gatcgcttgagcccaggagt

SEQ ID NO: 3912588 - DNA, 18 bp, Homo sapiens
gatcgggataacaaaatc

SEQ ID NO: 3912589 - DNA, 23 bp, Homo sapiens
gatcgtgccgttactctccaacc

SEQ ID NO: 3912590 - DNA, 20 bp, Homo sapiens
gatctagaatgtgttttctg

SEQ ID NO: 3912591 - DNA, 22 bp, Homo sapiens
gatctagaatgtgttttctgaa

SEQ ID NO: 3912592 - DNA, 21 bp, Homo sapiens
gatctagcttcatgcctcagt

SEQ ID NO: 3912593 - DNA, 22 bp, Homo sapiens
gatctagcttcatgcctcagtt

SEQ ID NO: 3912594 - DNA, 15 bp, Homo sapiens
gatctatagatgacc

SEQ ID NO: 3912595 - DNA, 22 bp, Homo sapiens
gatctatgcaatttttaaacta

SEQ ID NO: 3912596 - DNA, 13 bp, Homo sapiens
gatctccaaggac

SEQ ID NO: 3912597 - DNA, 16 bp, Homo sapiens
gatctccaaggaccag

SEQ ID NO: 3912598 - DNA, 13 bp, Homo sapiens
gatctccctgccg

SEQ ID NO: 3912599 - DNA, 14 bp, Homo sapiens
gatctccctgccgc

SEQ ID NO: 3912600 - DNA, 12 bp, Homo sapiens
gatctctcagga

SEQ ID NO: 3912601 - DNA, 19 bp, Homo sapiens
gatctctcaggagcacagg

SEQ ID NO: 3912602 - DNA, 23 bp, Homo sapiens
gatctctcaggagcacaggcagc

SEQ ID NO: 3912603 - DNA, 15 bp, Homo sapiens
gatctgatggtgagc

SEQ ID NO: 3912604 - DNA, 15 bp, Homo sapiens
gatctgcactgggtg

SEQ ID NO: 3912605 - DNA, 20 bp, Homo sapiens
gatctgcctgggcctgtgca

SEQ ID NO: 3912606 - DNA, 13 bp, Homo sapiens
gatctgcttcttc

SEQ ID NO: 3912607 - DNA, 15 bp, Homo sapiens
gatctgcttcttcat

SEQ ID NO: 3912608 - DNA, 21 bp, Homo sapiens
gatctgggaggtctccactga

SEQ ID NO: 3912609 - DNA, 23 bp, Homo sapiens
gatctgggaggtctccactgagg

SEQ ID NO: 3912610 - DNA, 18 bp, Homo sapiens
gatctgtactgtaatttt

SEQ ID NO: 3912611 - DNA, 20 bp, Homo sapiens
gatctgtatatacaataaca

SEQ ID NO: 3912612 - DNA, 15 bp, Homo sapiens
gatctgtccaaggaa

SEQ ID NO: 3912613 - DNA, 18 bp, Homo sapiens
gatctgtcccctctcccc

SEQ ID NO: 3912614 - DNA, 19 bp, Homo sapiens
gatctgtcccctctcccct

SEQ ID NO: 3912615 - DNA, 14 bp, Homo sapiens
gatgaaaatatttg

SEQ ID NO: 3912616 - DNA, 20 bp, Homo sapiens
gatgaaatttatttccatct

SEQ ID NO: 3912617 - DNA, 16 bp, Homo sapiens
gatgaagagaagctga

SEQ ID NO: 3912618 - DNA, 21 bp, Homo sapiens
gatgaagagaagctgagaaga

SEQ ID NO: 3912619 - DNA, 21 bp, Homo sapiens
gatgaagagagagagggcctg

SEQ ID NO: 3912620 - DNA, 23 bp, Homo sapiens
gatgaaggcgtgcaaggggctca

SEQ ID NO: 3912621 - DNA, 14 bp, Homo sapiens
gatgaccaggacta

SEQ ID NO: 3912622 - DNA, 12 bp, Homo sapiens
gatgactaaaat

SEQ ID NO: 3912623 - DNA, 15 bp, Homo sapiens
gatgactaaaatatt

SEQ ID NO: 3912624 - DNA, 18 bp, Homo sapiens
gatgactaaaatatttat

SEQ ID NO: 3912625 - DNA, 18 bp, Homo sapiens
gattaaacacctgacaca

SEQ ID NO: 3912626 - DNA, 19 bp, Homo sapiens
gattaaacacctgacacat

SEQ ID NO: 3912627 - DNA, 12 bp, Homo sapiens
gattaaaggaag

SEQ ID NO: 3912628 - DNA, 16 bp, Homo sapiens
gattaatgttttgtac

SEQ ID NO: 3912629 - DNA, 19 bp, Homo sapiens
gattaatgttttgtacaat

SEQ ID NO: 3912630 - DNA, 13 bp, Homo sapiens
gattaatttatgg

SEQ ID NO: 3912631 - DNA, 14 bp, Homo sapiens
gattaatttatggt

SEQ ID NO: 3912632 - DNA, 21 bp, Homo sapiens
gattaattttaacttaaattt

SEQ ID NO: 3912633 - DNA, 13 bp, Homo sapiens
gattacagaggaa

SEQ ID NO: 3912634 - DNA, 22 bp, Homo sapiens
gattacataatcaaagctacct

SEQ ID NO: 3912635 - DNA, 20 bp, Homo sapiens
gattactttaaaataaaaaa

SEQ ID NO: 3912636 - DNA, 13 bp, Homo sapiens
gattagctctgga

SEQ ID NO: 3912637 - DNA, 17 bp, Homo sapiens
gattagggagagaagat

SEQ ID NO: 3912638 - DNA, 13 bp, Homo sapiens
gattatatgacaa

SEQ ID NO: 3912639 - DNA, 10 bp, Homo sapiens
gattatcagg

SEQ ID NO: 3912640 - DNA, 19 bp, Homo sapiens
gattattcatttaaaatga

SEQ ID NO: 3912641 - DNA, 17 bp, Homo sapiens
gattcaggaaaaggcct

SEQ ID NO: 3912642 - DNA, 23 bp, Homo sapiens
gattcaggaaaaggcctggggtg

SEQ ID NO: 3912643 - DNA, 11 bp, Homo sapiens
gattcataaca

SEQ ID NO: 3912644 - DNA, 21 bp, Homo sapiens
gattcatgccaattagcaatt

SEQ ID NO: 3912645 - DNA, 19 bp, Homo sapiens
gattccagagagtggctcc

SEQ ID NO: 3912646 - DNA, 16 bp, Homo sapiens
gattccagcatttgcc

SEQ ID NO: 3912647 - DNA, 16 bp, Homo sapiens
gattcccaccaaggtc

SEQ ID NO: 3912648 - DNA, 14 bp, Homo sapiens
gattcccagagaca

SEQ ID NO: 3912649 - DNA, 19 bp, Homo sapiens
gattcccagagacaggaaa

SEQ ID NO: 3912650 - DNA, 21 bp, Homo sapiens
gattcccagagacaggaaaat

SEQ ID NO: 3912651 - DNA, 18 bp, Homo sapiens
gattcctcccccagagcc

SEQ ID NO: 3912652 - DNA, 19 bp, Homo sapiens
gattcctcttgcctctctc

SEQ ID NO: 3912653 - DNA, 23 bp, Homo sapiens
gattctcatgtctcagcctcctc

SEQ ID NO: 3912654 - DNA, 16 bp, Homo sapiens
gattctcctgtgctag

SEQ ID NO: 3912655 - DNA, 11 bp, Homo sapiens
gattctgggat

SEQ ID NO: 3912656 - DNA, 16 bp, Homo sapiens
gattcttgtgcctcag

SEQ ID NO: 3912657 - DNA, 22 bp, Homo sapiens
gattgatcggagcctcctctct

SEQ ID NO: 3912658 - DNA, 18 bp, Homo sapiens
gattgctgataataaatt

SEQ ID NO: 3912659 - DNA, 18 bp, Homo sapiens
gattgcttaaaatagcaa

SEQ ID NO: 3912660 - DNA, 17 bp, Homo sapiens
gattgcttcttgtgaaa

SEQ ID NO: 3912661 - DNA, 23 bp, Homo sapiens
gattgggtgccatgtggagtgga

SEQ ID NO: 3912662 - DNA, 19 bp, Homo sapiens
gatttaacagtcatttaaa

SEQ ID NO: 3912663 - DNA, 14 bp, Homo sapiens
gatttaatgttttc

SEQ ID NO: 3912664 - DNA, 15 bp, Homo sapiens
gatttaatgttttct

SEQ ID NO: 3912665 - DNA, 16 bp, Homo sapiens
gatttaccttttctgt

SEQ ID NO: 3912666 - DNA, 15 bp, Homo sapiens
gatttagaactgtat

SEQ ID NO: 3912667 - DNA, 16 bp, Homo sapiens
gatttagggaagcagg

SEQ ID NO: 3912668 - DNA, 22 bp, Homo sapiens
gatttagtgaaagctagagata

SEQ ID NO: 3912669 - DNA, 21 bp, Homo sapiens
gatttatagtttgtacatgca

SEQ ID NO: 3912670 - DNA, 13 bp, Homo sapiens
gatttatatctat

SEQ ID NO: 3912671 - DNA, 12 bp, Homo sapiens
gatttcaacata

SEQ ID NO: 3912672 - DNA, 14 bp, Homo sapiens
gatttcaacatatc

SEQ ID NO: 3912673 - DNA, 12 bp, Homo sapiens
gatttcaagaaa

SEQ ID NO: 3912674 - DNA, 15 bp, Homo sapiens
gatttcaagcctgcc

SEQ ID NO: 3912675 - DNA, 19 bp, Homo sapiens
gatttcagaagccaagttt

SEQ ID NO: 3912676 - DNA, 19 bp, Homo sapiens
gatttcagggaaatggagg

SEQ ID NO: 3912677 - DNA, 17 bp, Homo sapiens
gatttccaggcccctga

SEQ ID NO: 3912678 - DNA, 18 bp, Homo sapiens
gatttcctacagaaatac

SEQ ID NO: 3912679 - DNA, 22 bp, Homo sapiens
gatttcctacagaaatactgct

SEQ ID NO: 3912680 - DNA, 20 bp, Homo sapiens
gatttcctattttaaaacca

SEQ ID NO: 3912681 - DNA, 14 bp, Homo sapiens
gatttcttttaaag

SEQ ID NO: 3912682 - DNA, 17 bp, Homo sapiens
gatttgccagcacaggg

SEQ ID NO: 3912683 - DNA, 18 bp, Homo sapiens
gatttgctatcaaaataa

SEQ ID NO: 3912684 - DNA, 19 bp, Homo sapiens
gatttggaagagaggcacc

SEQ ID NO: 3912685 - DNA, 14 bp, Homo sapiens
gatttgtcccaggt

SEQ ID NO: 3912686 - DNA, 13 bp, Homo sapiens
gattttacagaga

SEQ ID NO: 3912687 - DNA, 15 bp, Homo sapiens
gattttacagagaat

SEQ ID NO: 3912688 - DNA, 15 bp, Homo sapiens
gattttatacatagt

SEQ ID NO: 3912689 - DNA, 21 bp, Homo sapiens
gattttatacatagtcacaaa

SEQ ID NO: 3912690 - DNA, 19 bp, Homo sapiens
gattttcaaagctttttcc

SEQ ID NO: 3912691 - DNA, 18 bp, Homo sapiens
gattttcatcaatttaaa

SEQ ID NO: 3912692 - DNA, 14 bp, Homo sapiens
gattttgtacagaa

SEQ ID NO: 3912693 - DNA, 18 bp, Homo sapiens
gattttgtacagaatttt

SEQ ID NO: 3912694 - DNA, 16 bp, Homo sapiens
gattttttaaaagaaa

SEQ ID NO: 3912695 - DNA, 20 bp, Homo sapiens
gattttttacagctgcctgc

SEQ ID NO: 3912696 - DNA, 12 bp, Homo sapiens
gattttttggat

SEQ ID NO: 3912697 - DNA, 21 bp, Homo sapiens
gattttttttgtaacttcaaa

SEQ ID NO: 3912698 - DNA, 11 bp, Homo sapiens
gcaaaaatata

SEQ ID NO: 3912699 - DNA, 18 bp, Homo sapiens
gcaaaagaagtaaaagct

SEQ ID NO: 3912700 - DNA, 17 bp, Homo sapiens
gcaaacacacaaaggta

SEQ ID NO: 3912701 - DNA, 16 bp, Homo sapiens
gcaaacactgtgtatt

SEQ ID NO: 3912702 - DNA, 19 bp, Homo sapiens
gcaaactcactgctcaaga

SEQ ID NO: 3912703 - DNA, 17 bp, Homo sapiens
gcaaagaactgccccat

SEQ ID NO: 3912704 - DNA, 21 bp, Homo sapiens
gcaaagcaccagcttctccag

SEQ ID NO: 3912705 - DNA, 22 bp, Homo sapiens
gcaaagcaccagcttctccagg

SEQ ID NO: 3912706 - DNA, 23 bp, Homo sapiens
gcaaagcaccagcttctccaggc

SEQ ID NO: 3912707 - DNA, 12 bp, Homo sapiens
gcaaagcctgtt

SEQ ID NO: 3912708 - DNA, 20 bp, Homo sapiens
gcaaagcctgttcatggcag

SEQ ID NO: 3912709 - DNA, 19 bp, Homo sapiens
gcaaagggctgaaagccat

SEQ ID NO: 3912710 - DNA, 15 bp, Homo sapiens
gcaaagtgccctcat

SEQ ID NO: 3912711 - DNA, 20 bp, Homo sapiens
gcaaatactccaagcttcaa

SEQ ID NO: 3912712 - DNA, 20 bp, Homo sapiens
gcaaatttcaaaagacatgt

SEQ ID NO: 3912713 - DNA, 16 bp, Homo sapiens
gcaacaaatatttata

SEQ ID NO: 3912714 - DNA, 23 bp, Homo sapiens
gcaacacaagctggaagcacatg

SEQ ID NO: 3912715 - DNA, 20 bp, Homo sapiens
gcaacacctccttgctttgc

SEQ ID NO: 3912716 - DNA, 20 bp, Homo sapiens
gcaaccccagttctgctcct

SEQ ID NO: 3912717 - DNA, 24 bp, Homo sapiens
gcaaccccagttctgctcctctcc

SEQ ID NO: 3912718 - DNA, 15 bp, Homo sapiens
gcaacccgtgccaag

SEQ ID NO: 3912719 - DNA, 22 bp, Homo sapiens
gcaacccgtgccaagtccaggt

SEQ ID NO: 3912720 - DNA, 13 bp, Homo sapiens
gcaacccttgctg

SEQ ID NO: 3912721 - DNA, 17 bp, Homo sapiens
gcaacccttgctgctgc

SEQ ID NO: 3912722 - DNA, 20 bp, Homo sapiens
gcaaccgtggcccttcctgg

SEQ ID NO: 3912723 - DNA, 22 bp, Homo sapiens
gcaaccgtggcccttcctggac

SEQ ID NO: 3912724 - DNA, 19 bp, Homo sapiens
gcaacctccacctcctgag

SEQ ID NO: 3912725 - DNA, 17 bp, Homo sapiens
gcaacctcccaacccag

SEQ ID NO: 3912726 - DNA, 17 bp, Homo sapiens
gcaactcccacgactgt

SEQ ID NO: 3912727 - DNA, 18 bp, Homo sapiens
gcaagaacctaaagtagc

SEQ ID NO: 3912728 - DNA, 15 bp, Homo sapiens
gcaagacctgttggt

SEQ ID NO: 3912729 - DNA, 15 bp, Homo sapiens
gcaagagaaaataaa

SEQ ID NO: 3912730 - DNA, 13 bp, Homo sapiens
gcaagagacagaa

SEQ ID NO: 3912731 - DNA, 22 bp, Homo sapiens
gcaagagccttggtgtccacct

SEQ ID NO: 3912732 - DNA, 16 bp, Homo sapiens
gcaagatatttatata

SEQ ID NO: 3912733 - DNA, 13 bp, Homo sapiens
gcaagattgctta

SEQ ID NO: 3912734 - DNA, 18 bp, Homo sapiens
gcaagcacgggacaggag

SEQ ID NO: 3912735 - DNA, 18 bp, Homo sapiens
gcaagcagcctcctgggc

SEQ ID NO: 3912736 - DNA, 21 bp, Homo sapiens
gcaagcagcctcctgggcagt

SEQ ID NO: 3912737 - DNA, 14 bp, Homo sapiens
gcaagcccctcagc

SEQ ID NO: 3912738 - DNA, 17 bp, Homo sapiens
gcaagcccctcagccct

SEQ ID NO: 3912739 - DNA, 18 bp, Homo sapiens
gcaagcccctcagccctt

SEQ ID NO: 3912740 - DNA, 20 bp, Homo sapiens
gcaagcctgtaatcccagct

SEQ ID NO: 3912741 - DNA, 17 bp, Homo sapiens
gcaagcgcagggaggat

SEQ ID NO: 3912742 - DNA, 14 bp, Homo sapiens
gcaagggcatcagg

SEQ ID NO: 3912743 - DNA, 19 bp, Homo sapiens
gcaagggcatcaggcactg

SEQ ID NO: 3912744 - DNA, 15 bp, Homo sapiens
gcaagggccatgctg

SEQ ID NO: 3912745 - DNA, 19 bp, Homo sapiens
gcaagggccatgctgaagg

SEQ ID NO: 3912746 - DNA, 16 bp, Homo sapiens
gcaagggctccagcat

SEQ ID NO: 3912747 - DNA, 22 bp, Homo sapiens
gcaagggctccagcatccagcc

SEQ ID NO: 3912748 - DNA, 13 bp, Homo sapiens
gcaaggggctcag

SEQ ID NO: 3912749 - DNA, 20 bp, Homo sapiens
gcaaggggctcagcaaggtg

SEQ ID NO: 3912750 - DNA, 15 bp, Homo sapiens
gcaagggggcggggc

SEQ ID NO: 3912751 - DNA, 21 bp, Homo sapiens
gcaagggggtgtcatctgagg

SEQ ID NO: 3912752 - DNA, 15 bp, Homo sapiens
gcaagtcatacttag

SEQ ID NO: 3912753 - DNA, 17 bp, Homo sapiens
gcaagtcgagagggctg

SEQ ID NO: 3912754 - DNA, 13 bp, Homo sapiens
gcaagtgaagaaa

SEQ ID NO: 3912755 - DNA, 18 bp, Homo sapiens
gcaagtgatatcacctct

SEQ ID NO: 3912756 - DNA, 20 bp, Homo sapiens
gcaagttcagggaagcaggc

SEQ ID NO: 3912757 - DNA, 23 bp, Homo sapiens
gcaagttcagggaagcaggcaga

SEQ ID NO: 3912758 - DNA, 24 bp, Homo sapiens
gcaataattaggatctatgcaatt

SEQ ID NO: 3912759 - DNA, 14 bp, Homo sapiens
gcaatatctttaat

SEQ ID NO: 3912760 - DNA, 20 bp, Homo sapiens
gcaatccatgttagttttta

SEQ ID NO: 3912761 - DNA, 22 bp, Homo sapiens
gcaatccatgttagtttttact

SEQ ID NO: 3912762 - DNA, 16 bp, Homo sapiens
gcaatgaaaaattctc

SEQ ID NO: 3912763 - DNA, 14 bp, Homo sapiens
gcaatgaaaccaaa

SEQ ID NO: 3912764 - DNA, 20 bp, Homo sapiens
gcaatgaaaccaaagccagg

SEQ ID NO: 3912765 - DNA, 18 bp, Homo sapiens
gcaatgggagggggctcc

SEQ ID NO: 3912766 - DNA, 14 bp, Homo sapiens
gcaattatattgtc

SEQ ID NO: 3912767 - DNA, 14 bp, Homo sapiens
gcaattcatcccag

SEQ ID NO: 3912768 - DNA, 17 bp, Homo sapiens
gcaatttattaaaatga

SEQ ID NO: 3912769 - DNA, 15 bp, Homo sapiens
gcaatttcccctctg

SEQ ID NO: 3912770 - DNA, 23 bp, Homo sapiens
gcaatttttccatgaagtttgaa

SEQ ID NO: 3912771 - DNA, 13 bp, Homo sapiens
gcacaaatattta

SEQ ID NO: 3912772 - DNA, 16 bp, Homo sapiens
gcacaaatatttattt

SEQ ID NO: 3912773 - DNA, 12 bp, Homo sapiens
gcacaagctcag

SEQ ID NO: 3912774 - DNA, 20 bp, Homo sapiens
gcacaagcttgtatatacat

SEQ ID NO: 3912775 - DNA, 19 bp, Homo sapiens
gcacaaggctgaccaagag

SEQ ID NO: 3912776 - DNA, 19 bp, Homo sapiens
gcacaatgggcaattctga

SEQ ID NO: 3912777 - DNA, 19 bp, Homo sapiens
gcacaatttagaaaacatt

SEQ ID NO: 3912778 - DNA, 11 bp, Homo sapiens
gcacaatttga

SEQ ID NO: 3912779 - DNA, 17 bp, Homo sapiens
gcacacaaacacctcct

SEQ ID NO: 3912780 - DNA, 15 bp, Homo sapiens
gcacacaatgctatt

SEQ ID NO: 3912781 - DNA, 20 bp, Homo sapiens
gcacacacaccggtcaccga

SEQ ID NO: 3912782 - DNA, 20 bp, Homo sapiens
gcacacacacggatgcacac

SEQ ID NO: 3912783 - DNA, 23 bp, Homo sapiens
gcacacacagatatacacatgga

SEQ ID NO: 3912784 - DNA, 20 bp, Homo sapiens
gcacacacagatatgcacac

SEQ ID NO: 3912785 - DNA, 15 bp, Homo sapiens
gcacacacagctcct

SEQ ID NO: 3912786 - DNA, 17 bp, Homo sapiens
gcacacagaaatatata

SEQ ID NO: 3912787 - DNA, 22 bp, Homo sapiens
gcacacagaaatatatatacat

SEQ ID NO: 3912788 - DNA, 12 bp, Homo sapiens
gcacacagcagc

SEQ ID NO: 3912789 - DNA, 13 bp, Homo sapiens
gcacacagcagcc

SEQ ID NO: 3912790 - DNA, 15 bp, Homo sapiens
gcacacagcagcccc

SEQ ID NO: 3912791 - DNA, 12 bp, Homo sapiens
gcacaccactgc

SEQ ID NO: 3912792 - DNA, 17 bp, Homo sapiens
gcacaccactgccctgc

SEQ ID NO: 3912793 - DNA, 20 bp, Homo sapiens
gcacaccactgccctgcctg

SEQ ID NO: 3912794 - DNA, 13 bp, Homo sapiens
gcacacggatgca

SEQ ID NO: 3912795 - DNA, 15 bp, Homo sapiens
gcacagccaaggact

SEQ ID NO: 3912796 - DNA, 12 bp, Homo sapiens
gcacagccctgg

SEQ ID NO: 3912797 - DNA, 19 bp, Homo sapiens
gcacagcgcgggcggaggc

SEQ ID NO: 3912798 - DNA, 22 bp, Homo sapiens
gcacagcgcgggcggaggcggc

SEQ ID NO: 3912799 - DNA, 17 bp, Homo sapiens
gagcaggaacagagact

SEQ ID NO: 3912800 - DNA, 15 bp, Homo sapiens
gagcaggccacgctc

SEQ ID NO: 3912801 - DNA, 23 bp, Homo sapiens
gagcaggccacgctcaggcccgg

SEQ ID NO: 3912802 - DNA, 12 bp, Homo sapiens
gagcaggcccga

SEQ ID NO: 3912803 - DNA, 18 bp, Homo sapiens
gagcaggcccgacagaga

SEQ ID NO: 3912804 - DNA, 16 bp, Homo sapiens
gagcaggctcagactc

SEQ ID NO: 3912805 - DNA, 16 bp, Homo sapiens
gagcagggccggggaa

SEQ ID NO: 3912806 - DNA, 22 bp, Homo sapiens
gagcagtggccgcaagcgcagg

SEQ ID NO: 3912807 - DNA, 14 bp, Homo sapiens
gagcatcatgcctc

SEQ ID NO: 3912808 - DNA, 16 bp, Homo sapiens
gagcatcatgcctctg

SEQ ID NO: 3912809 - DNA, 22 bp, Homo sapiens
gagcatcatgcctctgaggcca

SEQ ID NO: 3912810 - DNA, 23 bp, Homo sapiens
gagcatcatgcctctgaggccag

SEQ ID NO: 3912811 - DNA, 24 bp, Homo sapiens
gagcatcatgcctctgaggccagc

SEQ ID NO: 3912812 - DNA, 17 bp, Homo sapiens
gagcatgcacagctgct

SEQ ID NO: 3912813 - DNA, 21 bp, Homo sapiens
gagcatggctgtgaggatggg

SEQ ID NO: 3912814 - DNA, 17 bp, Homo sapiens
gagcattacgtgagcca

SEQ ID NO: 3912815 - DNA, 18 bp, Homo sapiens
gagcattacgtgagccag

SEQ ID NO: 3912816 - DNA, 21 bp, Homo sapiens
gagccaactcactcttatgaa

SEQ ID NO: 3912817 - DNA, 23 bp, Homo sapiens
gagccaactcactcttatgaaat

SEQ ID NO: 3912818 - DNA, 17 bp, Homo sapiens
gagccactacctttgtc

SEQ ID NO: 3912819 - DNA, 21 bp, Homo sapiens
gagccactcgcagtcgcagga

SEQ ID NO: 3912820 - DNA, 14 bp, Homo sapiens
gagccagccctccc

SEQ ID NO: 3912821 - DNA, 16 bp, Homo sapiens
gagccagccctccctg

SEQ ID NO: 3912822 - DNA, 21 bp, Homo sapiens
gagccagccctccctgtcctc

SEQ ID NO: 3912823 - DNA, 15 bp, Homo sapiens
gagccagcctgctcc

SEQ ID NO: 3912824 - DNA, 15 bp, Homo sapiens
gagccagcctgggac

SEQ ID NO: 3912825 - DNA, 19 bp, Homo sapiens
gagccaggctctgcctgga

SEQ ID NO: 3912826 - DNA, 19 bp, Homo sapiens
gagccaggtaatgagggac

SEQ ID NO: 3912827 - DNA, 22 bp, Homo sapiens
gagccatgggcctgggcctgct

SEQ ID NO: 3912828 - DNA, 14 bp, Homo sapiens
gagcccaagtgcca

SEQ ID NO: 3912829 - DNA, 15 bp, Homo sapiens
gagcccaagtgccat

SEQ ID NO: 3912830 - DNA, 17 bp, Homo sapiens
gagcccaagtgccatcc

SEQ ID NO: 3912831 - DNA, 21 bp, Homo sapiens
gagcccacgcccgactagcag

SEQ ID NO: 3912832 - DNA, 14 bp, Homo sapiens
gagcccagagggcc

SEQ ID NO: 3912833 - DNA, 14 bp, Homo sapiens
gagcccagctacat

SEQ ID NO: 3912834 - DNA, 18 bp, Homo sapiens
gagcccagctacattcct

SEQ ID NO: 3912835 - DNA, 20 bp, Homo sapiens
gagcccagctacattcctca

SEQ ID NO: 3912836 - DNA, 21 bp, Homo sapiens
gagcccagctacattcctcag

SEQ ID NO: 3912837 - DNA, 24 bp, Homo sapiens
gagcccaggagctgagtcacctcc

SEQ ID NO: 3912838 - DNA, 12 bp, Homo sapiens
gagcccaggccg

SEQ ID NO: 3912839 - DNA, 17 bp, Homo sapiens
gagcccagggaggccga

SEQ ID NO: 3912840 - DNA, 20 bp, Homo sapiens
gagcccagggaggccgaagc

SEQ ID NO: 3912841 - DNA, 17 bp, Homo sapiens
gagccccaggcctctgt

SEQ ID NO: 3912842 - DNA, 12 bp, Homo sapiens
gagccccctgga

SEQ ID NO: 3912843 - DNA, 16 bp, Homo sapiens
gagcccctccctgcta

SEQ ID NO: 3912844 - DNA, 12 bp, Homo sapiens
gagcccctggtc

SEQ ID NO: 3912845 - DNA, 20 bp, Homo sapiens
gagcccctggtcctgagggt

SEQ ID NO: 3912846 - DNA, 15 bp, Homo sapiens
gagccctgctgtggg

SEQ ID NO: 3912847 - DNA, 16 bp, Homo sapiens
gagccctgctgtggga

SEQ ID NO: 3912848 - DNA, 17 bp, Homo sapiens
gagccctgctgtgggag

SEQ ID NO: 3912849 - DNA, 12 bp, Homo sapiens
gagccctggtcc

SEQ ID NO: 3912850 - DNA, 19 bp, Homo sapiens
gagccggggcactttcaga

SEQ ID NO: 3912851 - DNA, 20 bp, Homo sapiens
gagcctcgcaacccgtgcca

SEQ ID NO: 3912852 - DNA, 21 bp, Homo sapiens
gagcctgccgagcaaccgtgg

SEQ ID NO: 3912853 - DNA, 19 bp, Homo sapiens
gagcctgctcccccacccc

SEQ ID NO: 3912854 - DNA, 19 bp, Homo sapiens
gagcctggcacaggactga

SEQ ID NO: 3912855 - DNA, 18 bp, Homo sapiens
gagcctggcccatagaaa

SEQ ID NO: 3912856 - DNA, 23 bp, Homo sapiens
gagcctggggctctaacgcctga

SEQ ID NO: 3912857 - DNA, 17 bp, Homo sapiens
gagcctgtgaacccagg

SEQ ID NO: 3912858 - DNA, 20 bp, Homo sapiens
gagcctgtgaacccaggaca

SEQ ID NO: 3912859 - DNA, 21 bp, Homo sapiens
gagcgaagggggtcaaaggaa

SEQ ID NO: 3912860 - DNA, 16 bp, Homo sapiens
gagcgccctgcagacc

SEQ ID NO: 3912861 - DNA, 13 bp, Homo sapiens
gagcggggaggtg

SEQ ID NO: 3912862 - DNA, 15 bp, Homo sapiens
gagctaagttctaag

SEQ ID NO: 3912863 - DNA, 15 bp, Homo sapiens
gagctactctcttgc

SEQ ID NO: 3912864 - DNA, 19 bp, Homo sapiens
gagctagaacctggagagc

SEQ ID NO: 3912865 - DNA, 18 bp, Homo sapiens
gagctagaagctggagga

SEQ ID NO: 3912866 - DNA, 23 bp, Homo sapiens
gagctagcgctgccgcaccccag

SEQ ID NO: 3912867 - DNA, 17 bp, Homo sapiens
gagctaggagcaaagcc

SEQ ID NO: 3912868 - DNA, 19 bp, Homo sapiens
gagctaggagcaaagcctg

SEQ ID NO: 3912869 - DNA, 20 bp, Homo sapiens
gagctaggagcaaagcctgt

SEQ ID NO: 3912870 - DNA, 21 bp, Homo sapiens
gagctaggagcaaagcctgtt

SEQ ID NO: 3912871 - DNA, 16 bp, Homo sapiens
gagctcacaaggcagc

SEQ ID NO: 3912872 - DNA, 18 bp, Homo sapiens
gagctcacaaggcagcaa

SEQ ID NO: 3912873 - DNA, 20 bp, Homo sapiens
gagctcacaaggcagcaagg

SEQ ID NO: 3912874 - DNA, 22 bp, Homo sapiens
gagctcacaaggcagcaaggcc

SEQ ID NO: 3912875 - DNA, 23 bp, Homo sapiens
gagctcacaaggcagcaaggccc

SEQ ID NO: 3912876 - DNA, 19 bp, Homo sapiens
gagctccgctaagacctcc

SEQ ID NO: 3912877 - DNA, 16 bp, Homo sapiens
gagctcctgtccctac

SEQ ID NO: 3912878 - DNA, 13 bp, Homo sapiens
gagctctgagagg

SEQ ID NO: 3912879 - DNA, 16 bp, Homo sapiens
gagctctgagaggccc

SEQ ID NO: 3912880 - DNA, 18 bp, Homo sapiens
gagctctgagaggccctg

SEQ ID NO: 3912881 - DNA, 20 bp, Homo sapiens
gagctctgagaggccctgga

SEQ ID NO: 3912882 - DNA, 23 bp, Homo sapiens
gagctctgagaggccctggatca

SEQ ID NO: 3912883 - DNA, 20 bp, Homo sapiens
gagctcttcaagctgtcccc

SEQ ID NO: 3912884 - DNA, 22 bp, Homo sapiens
gagctcttcaagctgtcccctc

SEQ ID NO: 3912885 - DNA, 21 bp, Homo sapiens
gagctcttcggtttctgagca

SEQ ID NO: 3912886 - DNA, 22 bp, Homo sapiens
gagctcttcggtttctgagcat

SEQ ID NO: 3912887 - DNA, 22 bp, Homo sapiens
gagctgaacccattttgagtga

SEQ ID NO: 3912888 - DNA, 15 bp, Homo sapiens
gagctgatttccagg

SEQ ID NO: 3912889 - DNA, 16 bp, Homo sapiens
gagctgatttccaggc

SEQ ID NO: 3912890 - DNA, 20 bp, Homo sapiens
gagctgatttccaggcccct

SEQ ID NO: 3912891 - DNA, 14 bp, Homo sapiens
gagctgccagccgg

SEQ ID NO: 3912892 - DNA, 13 bp, Homo sapiens
gagctgctctgct

SEQ ID NO: 3912893 - DNA, 12 bp, Homo sapiens
gagctggaaata

SEQ ID NO: 3912894 - DNA, 15 bp, Homo sapiens
gagctggaaggcagg

SEQ ID NO: 3912895 - DNA, 16 bp, Homo sapiens
gagctggaaggcaggg

SEQ ID NO: 3912896 - DNA, 16 bp, Homo sapiens
gagctggctgtcttcc

SEQ ID NO: 3912897 - DNA, 17 bp, Homo sapiens
gagctgggaggaaaaga

SEQ ID NO: 3912898 - DNA, 13 bp, Homo sapiens
gagctggggccac

SEQ ID NO: 3912899 - DNA, 17 bp, Homo sapiens
gagctgttcacagccag

SEQ ID NO: 3912900 - DNA, 20 bp, Homo sapiens
gagctgttcacagccagact

SEQ ID NO: 3912901 - DNA, 20 bp, Homo sapiens
gagcttagccttgtgccctg

SEQ ID NO: 3912902 - DNA, 22 bp, Homo sapiens
gagcttagccttgtgccctgcc

SEQ ID NO: 3912903 - DNA, 15 bp, Homo sapiens
gagcttattggccac

SEQ ID NO: 3912904 - DNA, 20 bp, Homo sapiens
gagcttctacagattttaga

SEQ ID NO: 3912905 - DNA, 22 bp, Homo sapiens
gagcttctgggaagacaactag

SEQ ID NO: 3912906 - DNA, 16 bp, Homo sapiens
gagcttggtggctgag

SEQ ID NO: 3912907 - DNA, 16 bp, Homo sapiens
gagctttagcttctct

SEQ ID NO: 3912908 - DNA, 21 bp, Homo sapiens
gaggaaaaacgatcgctgtga

SEQ ID NO: 3912909 - DNA, 23 bp, Homo sapiens
gaggaaaaccaagccgtggcttc

SEQ ID NO: 3912910 - DNA, 19 bp, Homo sapiens
gaggaagagcaggcacatg

SEQ ID NO: 3912911 - DNA, 16 bp, Homo sapiens
gaggaagatgaagaga

SEQ ID NO: 3912912 - DNA, 19 bp, Homo sapiens
gaggaagatgaagagaagc

SEQ ID NO: 3912913 - DNA, 22 bp, Homo sapiens
gaggaagatgaagagaagctga

SEQ ID NO: 3912914 - DNA, 13 bp, Homo sapiens
gaggaaggcaaag

SEQ ID NO: 3912915 - DNA, 15 bp, Homo sapiens
gaggaagggccagga

SEQ ID NO: 3912916 - DNA, 17 bp, Homo sapiens
gaggaagggccaggaga

SEQ ID NO: 3912917 - DNA, 21 bp, Homo sapiens
gaggaagggccaggagagaga

SEQ ID NO: 3912918 - DNA, 22 bp, Homo sapiens
gaggaagggccaggagagagat

SEQ ID NO: 3912919 - DNA, 15 bp, Homo sapiens
gaggaaggtgctgag

SEQ ID NO: 3912920 - DNA, 18 bp, Homo sapiens
gaggaaggtgctgagctt

SEQ ID NO: 3912921 - DNA, 20 bp, Homo sapiens
gaggaatcatgtcaggcctg

SEQ ID NO: 3912922 - DNA, 22 bp, Homo sapiens
gaggaattttctttgtgtagct

SEQ ID NO: 3912923 - DNA, 12 bp, Homo sapiens
gaggacaagtga

SEQ ID NO: 3912924 - DNA, 11 bp, Homo sapiens
gaggacacatg

SEQ ID NO: 3912925 - DNA, 14 bp, Homo sapiens
gaggacacatgtcc

SEQ ID NO: 3912926 - DNA, 11 bp, Homo sapiens
gaggacatcat

SEQ ID NO: 3912927 - DNA, 17 bp, Homo sapiens
gaggacatggagagaga

SEQ ID NO: 3912928 - DNA, 20 bp, Homo sapiens
gaggaccctggttactctgg

SEQ ID NO: 3912929 - DNA, 13 bp, Homo sapiens
gaggaccgggctg

SEQ ID NO: 3912930 - DNA, 12 bp, Homo sapiens
gaggacctgagc

SEQ ID NO: 3912931 - DNA, 13 bp, Homo sapiens
gaggacctgagcc

SEQ ID NO: 3912932 - DNA, 14 bp, Homo sapiens
gaggacctgagcct

SEQ ID NO: 3912933 - DNA, 16 bp, Homo sapiens
gaggacctgagcctgc

SEQ ID NO: 3912934 - DNA, 17 bp, Homo sapiens
gaggacctgagcctgcc

SEQ ID NO: 3912935 - DNA, 22 bp, Homo sapiens
gaggacctgagcctgccgagca

SEQ ID NO: 3912936 - DNA, 18 bp, Homo sapiens
gaggactagaacctggag

SEQ ID NO: 3912937 - DNA, 13 bp, Homo sapiens
gaggactccctcc

SEQ ID NO: 3912938 - DNA, 18 bp, Homo sapiens
gaggactccgggaccatt

SEQ ID NO: 3912939 - DNA, 23 bp, Homo sapiens
gaggactccgggaccattgacct

SEQ ID NO: 3912940 - DNA, 16 bp, Homo sapiens
gaggacttgtgtctct

SEQ ID NO: 3912941 - DNA, 22 bp, Homo sapiens
gaggacttgtgtctctgtgctt

SEQ ID NO: 3912942 - DNA, 22 bp, Homo sapiens
gaggagaagaattttcagaccc

SEQ ID NO: 3912943 - DNA, 13 bp, Homo sapiens
gaggagaccctgg

SEQ ID NO: 3912944 - DNA, 12 bp, Homo sapiens
gaggagagaagg

SEQ ID NO: 3912945 - DNA, 20 bp, Homo sapiens
gaggagaggggaagggccag

SEQ ID NO: 3912946 - DNA, 11 bp, Homo sapiens
gaggaggagga

SEQ ID NO: 3912947 - DNA, 15 bp, Homo sapiens
gaggaggaggaaggc

SEQ ID NO: 3912948 - DNA, 16 bp, Homo sapiens
gaggaggaggaaggca

SEQ ID NO: 3912949 - DNA, 14 bp, Homo sapiens
gaggaggaggagga

SEQ ID NO: 3912950 - DNA, 16 bp, Homo sapiens
gaggaggaggaggaag

SEQ ID NO: 3912951 - DNA, 21 bp, Homo sapiens
gaggaggattgcttcttgtga

SEQ ID NO: 3912952 - DNA, 20 bp, Homo sapiens
gaggaggcagagaagaaaga

SEQ ID NO: 3912953 - DNA, 21 bp, Homo sapiens
gaggaggcctgggggcaggga

SEQ ID NO: 3912954 - DNA, 15 bp, Homo sapiens
gaggagtagctgaga

SEQ ID NO: 3912955 - DNA, 17 bp, Homo sapiens
gaggagtagctgagagg

SEQ ID NO: 3912956 - DNA, 19 bp, Homo sapiens
gaggagtagctgagaggaa

SEQ ID NO: 3912957 - DNA, 20 bp, Homo sapiens
gaggagtagctgagaggaag

SEQ ID NO: 3912958 - DNA, 13 bp, Homo sapiens
gaggagtctgagg

SEQ ID NO: 3912959 - DNA, 19 bp, Homo sapiens
gaggagtctgaggtcctga

SEQ ID NO: 3912960 - DNA, 16 bp, Homo sapiens
gaggagtttcgaggta

SEQ ID NO: 3912961 - DNA, 20 bp, Homo sapiens
gaggagtttcgaggtagagt

SEQ ID NO: 3912962 - DNA, 18 bp, Homo sapiens
gaggatcacagtgctgag

SEQ ID NO: 3912963 - DNA, 13 bp, Homo sapiens
gagggctgccctg

SEQ ID NO: 3912964 - DNA, 12 bp, Homo sapiens
gaggggaaggcc

SEQ ID NO: 3912965 - DNA, 18 bp, Homo sapiens
gaggggaataatagaaga

SEQ ID NO: 3912966 - DNA, 13 bp, Homo sapiens
gaggggcctggca

SEQ ID NO: 3912967 - DNA, 13 bp, Homo sapiens
gaggggcctggga

SEQ ID NO: 3912968 - DNA, 13 bp, Homo sapiens
gaggggctgaatg

SEQ ID NO: 3912969 - DNA, 16 bp, Homo sapiens
gagggggctccatgga

SEQ ID NO: 3912970 - DNA, 16 bp, Homo sapiens
cttagattagctctgg

SEQ ID NO: 3912971 - DNA, 17 bp, Homo sapiens
cttagattagctctgga

SEQ ID NO: 3912972 - DNA, 16 bp, Homo sapiens
cttagcacttctttcc

SEQ ID NO: 3912973 - DNA, 22 bp, Homo sapiens
cttagcatgcctccaaaaattc

SEQ ID NO: 3912974 - DNA, 18 bp, Homo sapiens
cttagcatgtgttgaaaa

SEQ ID NO: 3912975 - DNA, 14 bp, Homo sapiens
cttagcccaagagg

SEQ ID NO: 3912976 - DNA, 18 bp, Homo sapiens
cttagcccaagaggtctg

SEQ ID NO: 3912977 - DNA, 18 bp, Homo sapiens
cttagccgtccatggcac

SEQ ID NO: 3912978 - DNA, 14 bp, Homo sapiens
cttagcctcctgac

SEQ ID NO: 3912979 - DNA, 21 bp, Homo sapiens
cttagcctcctgacctgaggc

SEQ ID NO: 3912980 - DNA, 14 bp, Homo sapiens
cttagcctggagca

SEQ ID NO: 3912981 - DNA, 11 bp, Homo sapiens
cttagccttgt

SEQ ID NO: 3912982 - DNA, 23 bp, Homo sapiens
cttagccttgtgccctgccccca

SEQ ID NO: 3912983 - DNA, 16 bp, Homo sapiens
cttagctttctcaggg

SEQ ID NO: 3912984 - DNA, 18 bp, Homo sapiens
cttaggtgccaggctgta

SEQ ID NO: 3912985 - DNA, 22 bp, Homo sapiens
cttagtggcttttttcctcctg

SEQ ID NO: 3912986 - DNA, 13 bp, Homo sapiens
cttataaatgtgt

SEQ ID NO: 3912987 - DNA, 23 bp, Homo sapiens
cttataaatgtgtattctggctg

SEQ ID NO: 3912988 - DNA, 13 bp, Homo sapiens
cttataagcccag

SEQ ID NO: 3912989 - DNA, 19 bp, Homo sapiens
cttatatagcagcaaaaat

SEQ ID NO: 3912990 - DNA, 21 bp, Homo sapiens
cttatatagcagcaaaaatat

SEQ ID NO: 3912991 - DNA, 21 bp, Homo sapiens
cttatatcatcagcatacctt

SEQ ID NO: 3912992 - DNA, 13 bp, Homo sapiens
cttatccaggact

SEQ ID NO: 3912993 - DNA, 22 bp, Homo sapiens
cttatgacatcacttgtacaaa

SEQ ID NO: 3912994 - DNA, 15 bp, Homo sapiens
cttatgcctatacct

SEQ ID NO: 3912995 - DNA, 11 bp, Homo sapiens
cttattagaac

SEQ ID NO: 3912996 - DNA, 17 bp, Homo sapiens
cttattagaacaggcaa

SEQ ID NO: 3912997 - DNA, 20 bp, Homo sapiens
cttattcatgctttctcctt

SEQ ID NO: 3912998 - DNA, 22 bp, Homo sapiens
cttattcatgctttctcctttt

SEQ ID NO: 3912999 - DNA, 19 bp, Homo sapiens
cttattcccaactgctctg

SEQ ID NO: 3913000 - DNA, 14 bp, Homo sapiens
cttattcccatgtg

SEQ ID NO: 3913001 - DNA, 13 bp, Homo sapiens
cttattggccact

SEQ ID NO: 3913002 - DNA, 16 bp, Homo sapiens
cttattggccactggg

SEQ ID NO: 3913003 - DNA, 22 bp, Homo sapiens
cttatttacttgtagaaatctg

SEQ ID NO: 3913004 - DNA, 14 bp, Homo sapiens
cttatttcatttct

SEQ ID NO: 3913005 - DNA, 18 bp, Homo sapiens
cttatttccctcatcttg

SEQ ID NO: 3913006 - DNA, 14 bp, Homo sapiens
cttattttcaagaa

SEQ ID NO: 3913007 - DNA, 18 bp, Homo sapiens
cttattttcaagaaactg

SEQ ID NO: 3913008 - DNA, 17 bp, Homo sapiens
cttatttttgacagtgt

SEQ ID NO: 3913009 - DNA, 19 bp, Homo sapiens
cttcaaatatagagatatt

SEQ ID NO: 3913010 - DNA, 14 bp, Homo sapiens
cttcaaatccatcc

SEQ ID NO: 3913011 - DNA, 16 bp, Homo sapiens
cttcaaatccatccag

SEQ ID NO: 3913012 - DNA, 20 bp, Homo sapiens
cttcaactgaccagcctcca

SEQ ID NO: 3913013 - DNA, 15 bp, Homo sapiens
cttcaagcacctgca

SEQ ID NO: 3913014 - DNA, 20 bp, Homo sapiens
cttcaaggtgtaaaatatct

SEQ ID NO: 3913015 - DNA, 16 bp, Homo sapiens
cttcaagtgatatatg

SEQ ID NO: 3913016 - DNA, 21 bp, Homo sapiens
cttcaagtgatatatgtattt

SEQ ID NO: 3913017 - DNA, 16 bp, Homo sapiens
cttcaataaattaagt

SEQ ID NO: 3913018 - DNA, 14 bp, Homo sapiens
cttcacaacagatt

SEQ ID NO: 3913019 - DNA, 19 bp, Homo sapiens
cttcacaacctccgtgctg

SEQ ID NO: 3913020 - DNA, 14 bp, Homo sapiens
gaatgaattaaata

SEQ ID NO: 3913021 - DNA, 21 bp, Homo sapiens
gaatgaccacgggcctcagtt

SEQ ID NO: 3913022 - DNA, 22 bp, Homo sapiens
gaatgaccacgggcctcagttt

SEQ ID NO: 3913023 - DNA, 17 bp, Homo sapiens
gaatgactataaacatt

SEQ ID NO: 3913024 - DNA, 11 bp, Homo sapiens
gaatgagcctc

SEQ ID NO: 3913025 - DNA, 13 bp, Homo sapiens
gaatgagcctcgg

SEQ ID NO: 3913026 - DNA, 23 bp, Homo sapiens
gaatgatggacttttgggggttg

SEQ ID NO: 3913027 - DNA, 16 bp, Homo sapiens
ctgtggtgatgttgcc

SEQ ID NO: 3913028 - DNA, 19 bp, Homo sapiens
ctgtggttcctaagcctgt

SEQ ID NO: 3913029 - DNA, 20 bp, Homo sapiens
ctgtggttcctaagcctgtt

SEQ ID NO: 3913030 - DNA, 21 bp, Homo sapiens
ctgtggttgttttagctcctt

SEQ ID NO: 3913031 - DNA, 21 bp, Homo sapiens
ctgtgtagactcctgcttctt

SEQ ID NO: 3913032 - DNA, 15 bp, Homo sapiens
ctgtgtagctgtgac

SEQ ID NO: 3913033 - DNA, 16 bp, Homo sapiens
ctgtgtccagcagctg

SEQ ID NO: 3913034 - DNA, 13 bp, Homo sapiens
ctgtgtcctctcc

SEQ ID NO: 3913035 - DNA, 14 bp, Homo sapiens
ctgtgtcctctccc

SEQ ID NO: 3913036 - DNA, 19 bp, Homo sapiens
ctgtgtccttgcacctgca

SEQ ID NO: 3913037 - DNA, 19 bp, Homo sapiens
ctgtgtgaaataccagtgt

SEQ ID NO: 3913038 - DNA, 21 bp, Homo sapiens
ctgtgtgaaataccagtgtgg

SEQ ID NO: 3913039 - DNA, 18 bp, Homo sapiens
ctgtgtgaagttacacaa

SEQ ID NO: 3913040 - DNA, 16 bp, Homo sapiens
ctgtgtgatgaacttt

SEQ ID NO: 3913041 - DNA, 19 bp, Homo sapiens
ctgtgtgatgaactttctc

SEQ ID NO: 3913042 - DNA, 16 bp, Homo sapiens
ctgtgtgcacaaatat

SEQ ID NO: 3913043 - DNA, 14 bp, Homo sapiens
ctgtgtgccttcgc

SEQ ID NO: 3913044 - DNA, 16 bp, Homo sapiens
ctgtgtggggaggcag

SEQ ID NO: 3913045 - DNA, 17 bp, Homo sapiens
ctgtgtgggtctgggga

SEQ ID NO: 3913046 - DNA, 19 bp, Homo sapiens
ctgtgtgggtctggggagg

SEQ ID NO: 3913047 - DNA, 18 bp, Homo sapiens
ctgtgttcacactgtaaa

SEQ ID NO: 3913048 - DNA, 20 bp, Homo sapiens
ctgtgttcttgctgagcacc

SEQ ID NO: 3913049 - DNA, 23 bp, Homo sapiens
ctgtgtttttgctatcacacagt

SEQ ID NO: 3913050 - DNA, 20 bp, Homo sapiens
ctgttaaaagatgaaaatat

SEQ ID NO: 3913051 - DNA, 21 bp, Homo sapiens
ctgttaaaagatgaaaatatt

SEQ ID NO: 3913052 - DNA, 15 bp, Homo sapiens
ctgttacttacctaa

SEQ ID NO: 3913053 - DNA, 19 bp, Homo sapiens
ctgttacttacctaaacag

SEQ ID NO: 3913054 - DNA, 20 bp, Homo sapiens
ctgttattgaaaatatattt

SEQ ID NO: 3913055 - DNA, 22 bp, Homo sapiens
ctgttcaatgtttttaaaaatc

SEQ ID NO: 3913056 - DNA, 19 bp, Homo sapiens
ctgttcacagccagactgg

SEQ ID NO: 3913057 - DNA, 18 bp, Homo sapiens
ctgttcacccacagggct

SEQ ID NO: 3913058 - DNA, 13 bp, Homo sapiens
ctgttcactctac

SEQ ID NO: 3913059 - DNA, 15 bp, Homo sapiens
ctgttcactctactt

SEQ ID NO: 3913060 - DNA, 17 bp, Homo sapiens
ctgttccacttctctag

SEQ ID NO: 3913061 - DNA, 12 bp, Homo sapiens
ctgttctcaaat

SEQ ID NO: 3913062 - DNA, 16 bp, Homo sapiens
ctgttctgcactgaaa

SEQ ID NO: 3913063 - DNA, 15 bp, Homo sapiens
ctgttctgtgtgggt

SEQ ID NO: 3913064 - DNA, 12 bp, Homo sapiens
ctgttgaaaatt

SEQ ID NO: 3913065 - DNA, 21 bp, Homo sapiens
ctgttgaaaattattttaaac

SEQ ID NO: 3913066 - DNA, 22 bp, Homo sapiens
ctgttgagtgcaacaagagcaa

SEQ ID NO: 3913067 - DNA, 22 bp, Homo sapiens
ctgttgatcccacttcactgtg

SEQ ID NO: 3913068 - DNA, 18 bp, Homo sapiens
ctgttgcacctcaggcag

SEQ ID NO: 3913069 - DNA, 13 bp, Homo sapiens
ctgttgccacaac

SEQ ID NO: 3913070 - DNA, 14 bp, Homo sapiens
ctgttgcctcatct

SEQ ID NO: 3913071 - DNA, 15 bp, Homo sapiens
ctgttgctgaagtca

SEQ ID NO: 3913072 - DNA, 18 bp, Homo sapiens
ctgttggacagctgcttg

SEQ ID NO: 3913073 - DNA, 19 bp, Homo sapiens
ctgttggacagctgcttgt

SEQ ID NO: 3913074 - DNA, 22 bp, Homo sapiens
ctgttggacccgctctggacca

SEQ ID NO: 3913075 - DNA, 18 bp, Homo sapiens
ctgttggttagctggaca

SEQ ID NO: 3913076 - DNA, 14 bp, Homo sapiens
ctgttgtaaatgac

SEQ ID NO: 3913077 - DNA, 18 bp, Homo sapiens
ctgttgtaaatgaccaag

SEQ ID NO: 3913078 - DNA, 12 bp, Homo sapiens
ctgttgtaatag

SEQ ID NO: 3913079 - DNA, 12 bp, Homo sapiens
ctgttgtacaag

SEQ ID NO: 3913080 - DNA, 14 bp, Homo sapiens
ctgttgtacaagct

SEQ ID NO: 3913081 - DNA, 21 bp, Homo sapiens
ctgttgtacgtaaagcttaaa

SEQ ID NO: 3913082 - DNA, 15 bp, Homo sapiens
ctgttgtagaataat

SEQ ID NO: 3913083 - DNA, 17 bp, Homo sapiens
ctgttgttcccatctgc

SEQ ID NO: 3913084 - DNA, 21 bp, Homo sapiens
ctgtttaatatttaaacagca

SEQ ID NO: 3913085 - DNA, 13 bp, Homo sapiens
ctgtttcctttta

SEQ ID NO: 3913086 - DNA, 16 bp, Homo sapiens
ctgtttgagatgtgat

SEQ ID NO: 3913087 - DNA, 24 bp, Homo sapiens
ctgttttaaaaacaaagaaataaa

SEQ ID NO: 3913088 - DNA, 12 bp, Homo sapiens
ctgttttcttct

SEQ ID NO: 3913089 - DNA, 18 bp, Homo sapiens
ctgttttcttctattcca

SEQ ID NO: 3913090 - DNA, 15 bp, Homo sapiens
ctgtttttctgggtg

SEQ ID NO: 3913091 - DNA, 18 bp, Homo sapiens
cttaaaaaacttgtaaat

SEQ ID NO: 3913092 - DNA, 21 bp, Homo sapiens
cttaaaaggagagaagaaagt

SEQ ID NO: 3913093 - DNA, 13 bp, Homo sapiens
cttaaaataactt

SEQ ID NO: 3913094 - DNA, 14 bp, Homo sapiens
cttaaacctgggag

SEQ ID NO: 3913095 - DNA, 13 bp, Homo sapiens
cttaaaggaaaag

SEQ ID NO: 3913096 - DNA, 20 bp, Homo sapiens
cttaaaggcaccatctaata

SEQ ID NO: 3913097 - DNA, 15 bp, Homo sapiens
cttaaataaattcaa

SEQ ID NO: 3913098 - DNA, 16 bp, Homo sapiens
cttaaataaattcaaa

SEQ ID NO: 3913099 - DNA, 17 bp, Homo sapiens
cttaaataaattcaaac

SEQ ID NO: 3913100 - DNA, 21 bp, Homo sapiens
cttaaattgcttttgttgtga

SEQ ID NO: 3913101 - DNA, 13 bp, Homo sapiens
cttaacatattta

SEQ ID NO: 3913102 - DNA, 17 bp, Homo sapiens
cttaactcatctgttat

SEQ ID NO: 3913103 - DNA, 13 bp, Homo sapiens
cttaactggctgt

SEQ ID NO: 3913104 - DNA, 18 bp, Homo sapiens
cttaactgtgtgaagaaa

SEQ ID NO: 3913105 - DNA, 20 bp, Homo sapiens
cttaactgtgtgaagaaatg

SEQ ID NO: 3913106 - DNA, 22 bp, Homo sapiens
cttaactgtgtgaagaaatgga

SEQ ID NO: 3913107 - DNA, 16 bp, Homo sapiens
cttaagagaaatggca

SEQ ID NO: 3913108 - DNA, 20 bp, Homo sapiens
cttaaggattgtgatatttt

SEQ ID NO: 3913109 - DNA, 18 bp, Homo sapiens
cttaataaattcagatat

SEQ ID NO: 3913110 - DNA, 22 bp, Homo sapiens
cttaatcaagaatattcaaatg

SEQ ID NO: 3913111 - DNA, 22 bp, Homo sapiens
cttaatcaggtcctcagagaat

SEQ ID NO: 3913112 - DNA, 16 bp, Homo sapiens
cttaattaaaagaata

SEQ ID NO: 3913113 - DNA, 17 bp, Homo sapiens
ctgtctgtcctggaggt

SEQ ID NO: 3913114 - DNA, 14 bp, Homo sapiens
ctgtctgtctgtcc

SEQ ID NO: 3913115 - DNA, 17 bp, Homo sapiens
ctgtctgtctgtcccaa

SEQ ID NO: 3913116 - DNA, 14 bp, Homo sapiens
ctgtctgtctgtct

SEQ ID NO: 3913117 - DNA, 15 bp, Homo sapiens
ctgtcttcacaacct

SEQ ID NO: 3913118 - DNA, 16 bp, Homo sapiens
ctgtcttccactgtac

SEQ ID NO: 3913119 - DNA, 17 bp, Homo sapiens
ctgtcttctctcaaagg

SEQ ID NO: 3913120 - DNA, 14 bp, Homo sapiens
ctgtgaaagtatgt

SEQ ID NO: 3913121 - DNA, 19 bp, Homo sapiens
ctgtgaaagtatgtgatat

SEQ ID NO: 3913122 - DNA, 16 bp, Homo sapiens
ctgtgaacccaggaca

SEQ ID NO: 3913123 - DNA, 15 bp, Homo sapiens
ctgtgaactcagagc

SEQ ID NO: 3913124 - DNA, 15 bp, Homo sapiens
ctgtgaagaatgaag

SEQ ID NO: 3913125 - DNA, 21 bp, Homo sapiens
ctgtgaataaaaaccctgtat

SEQ ID NO: 3913126 - DNA, 23 bp, Homo sapiens
ctgtgaattgagctgcagaaacg

SEQ ID NO: 3913127 - DNA, 19 bp, Homo sapiens
ctgtgaatttgtgtaagga

SEQ ID NO: 3913128 - DNA, 15 bp, Homo sapiens
ctgtgaccacacgct

SEQ ID NO: 3913129 - DNA, 19 bp, Homo sapiens
ctgtgacctgctgagctct

SEQ ID NO: 3913130 - DNA, 23 bp, Homo sapiens
ctgtgactgccaaggtgtggcct

SEQ ID NO: 3913131 - DNA, 17 bp, Homo sapiens
ctgtgacttcagctctg

SEQ ID NO: 3913132 - DNA, 17 bp, Homo sapiens
ctgtgaggaaagcacac

SEQ ID NO: 3913133 - DNA, 13 bp, Homo sapiens
ctgtgaggcaggg

SEQ ID NO: 3913134 - DNA, 14 bp, Homo sapiens
ctgtgaggcagggg

SEQ ID NO: 3913135 - DNA, 18 bp, Homo sapiens
ctgtgaggcccctggaca

SEQ ID NO: 3913136 - DNA, 15 bp, Homo sapiens
ctgtgaggggaaggc

SEQ ID NO: 3913137 - DNA, 22 bp, Homo sapiens
ctgtgaggtaactgggatcgca

SEQ ID NO: 3913138 - DNA, 18 bp, Homo sapiens
ctgtgatgctttgaagta

SEQ ID NO: 3913139 - DNA, 16 bp, Homo sapiens
ctgtgcaaatccttga

SEQ ID NO: 3913140 - DNA, 20 bp, Homo sapiens
ctgtgcactagcctgtgatt

SEQ ID NO: 3913141 - DNA, 13 bp, Homo sapiens
ctgtgcagcagcc

SEQ ID NO: 3913142 - DNA, 14 bp, Homo sapiens
ctgtgcagcagccc

SEQ ID NO: 3913143 - DNA, 16 bp, Homo sapiens
ctgtgcagcagcccag

SEQ ID NO: 3913144 - DNA, 17 bp, Homo sapiens
ctgtgcagcagcccagc

SEQ ID NO: 3913145 - DNA, 14 bp, Homo sapiens
ctgtgcatgacctg

SEQ ID NO: 3913146 - DNA, 16 bp, Homo sapiens
ctgtgccagagcctgg

SEQ ID NO: 3913147 - DNA, 18 bp, Homo sapiens
ctgtgccagagcctgggg

SEQ ID NO: 3913148 - DNA, 20 bp, Homo sapiens
ctgtgccagagcctggggct

SEQ ID NO: 3913149 - DNA, 21 bp, Homo sapiens
ctgtgccagagcctggggctc

SEQ ID NO: 3913150 - DNA, 14 bp, Homo sapiens
ctgtgccagctcag

SEQ ID NO: 3913151 - DNA, 16 bp, Homo sapiens
ctgtgccagctcaggt

SEQ ID NO: 3913152 - DNA, 20 bp, Homo sapiens
ctgccccagcgcggcttggc

SEQ ID NO: 3913153 - DNA, 23 bp, Homo sapiens
ctgccccagcgcggcttggccgc

SEQ ID NO: 3913154 - DNA, 16 bp, Homo sapiens
ctgccccagctttatc

SEQ ID NO: 3913155 - DNA, 24 bp, Homo sapiens
ctgccccagctttatctgtcacac

SEQ ID NO: 3913156 - DNA, 19 bp, Homo sapiens
ctgccccagtagtcagaag

SEQ ID NO: 3913157 - DNA, 13 bp, Homo sapiens
ctgccccatctcc

SEQ ID NO: 3913158 - DNA, 16 bp, Homo sapiens
ctgccccatctcctcc

SEQ ID NO: 3913159 - DNA, 12 bp, Homo sapiens
ctgcccccacga

SEQ ID NO: 3913160 - DNA, 21 bp, Homo sapiens
ctgcccccacgagggtcagga

SEQ ID NO: 3913161 - DNA, 18 bp, Homo sapiens
ctgcccccgacagcccag

SEQ ID NO: 3913162 - DNA, 19 bp, Homo sapiens
ctgccccgggtgcctcaga

SEQ ID NO: 3913163 - DNA, 22 bp, Homo sapiens
ctgccccgttccctgtcagagg

SEQ ID NO: 3913164 - DNA, 23 bp, Homo sapiens
ctgccccgttccctgtcagaggc

SEQ ID NO: 3913165 - DNA, 18 bp, Homo sapiens
ctgcccctccccagccct

SEQ ID NO: 3913166 - DNA, 13 bp, Homo sapiens
ctgcccctgtagg

SEQ ID NO: 3913167 - DNA, 14 bp, Homo sapiens
ctgcccgcagagcc

SEQ ID NO: 3913168 - DNA, 17 bp, Homo sapiens
ctgcccgcagagcccac

SEQ ID NO: 3913169 - DNA, 21 bp, Homo sapiens
ctgccctagcgctctcttcca

SEQ ID NO: 3913170 - DNA, 13 bp, Homo sapiens
ctgccctcaggga

SEQ ID NO: 3913171 - DNA, 18 bp, Homo sapiens
ctgccctctccttcctta

SEQ ID NO: 3913172 - DNA, 22 bp, Homo sapiens
ctgccctctctcagttattcag

SEQ ID NO: 3913173 - DNA, 14 bp, Homo sapiens
ctgccctgccacct

SEQ ID NO: 3913174 - DNA, 21 bp, Homo sapiens
ctgccctgccacctgtctgtc

SEQ ID NO: 3913175 - DNA, 11 bp, Homo sapiens
ctgccctgccc

SEQ ID NO: 3913176 - DNA, 14 bp, Homo sapiens
ctgccctgccctgc

SEQ ID NO: 3913177 - DNA, 13 bp, Homo sapiens
ctgccctgcctcc

SEQ ID NO: 3913178 - DNA, 14 bp, Homo sapiens
ctgccctgcctccc

SEQ ID NO: 3913179 - DNA, 15 bp, Homo sapiens
ctgccctgcctccct

SEQ ID NO: 3913180 - DNA, 21 bp, Homo sapiens
ctgccctgcctccctttctgg

SEQ ID NO: 3913181 - DNA, 15 bp, Homo sapiens
ctgccctgctctggg

SEQ ID NO: 3913182 - DNA, 16 bp, Homo sapiens
ctgccctgctctgggg

SEQ ID NO: 3913183 - DNA, 17 bp, Homo sapiens
ctgccctggagggaggc

SEQ ID NO: 3913184 - DNA, 13 bp, Homo sapiens
ctgccctggtgct

SEQ ID NO: 3913185 - DNA, 14 bp, Homo sapiens
ctgccctggtgctg

SEQ ID NO: 3913186 - DNA, 18 bp, Homo sapiens
ctgccctggtgctgccac

SEQ ID NO: 3913187 - DNA, 20 bp, Homo sapiens
ctgccctggtgctgccacac

SEQ ID NO: 3913188 - DNA, 13 bp, Homo sapiens
ctgccctgtaccc

SEQ ID NO: 3913189 - DNA, 14 bp, Homo sapiens
ctgccctgtatata

SEQ ID NO: 3913190 - DNA, 19 bp, Homo sapiens
ctgccctgtatataatact

SEQ ID NO: 3913191 - DNA, 19 bp, Homo sapiens
ctgccctgttgtgtataga

SEQ ID NO: 3913192 - DNA, 15 bp, Homo sapiens
ctgcccttcgctgcc

SEQ ID NO: 3913193 - DNA, 17 bp, Homo sapiens
ctgcccttcgctgccag

SEQ ID NO: 3913194 - DNA, 20 bp, Homo sapiens
ctgcccttcgctgccaggac

SEQ ID NO: 3913195 - DNA, 13 bp, Homo sapiens
ctgccgaccagag

SEQ ID NO: 3913196 - DNA, 15 bp, Homo sapiens
ctgccgaccagagcc

SEQ ID NO: 3913197 - DNA, 15 bp, Homo sapiens
ctgccgcaccccaga

SEQ ID NO: 3913198 - DNA, 16 bp, Homo sapiens
ctgccgcaccccagag

SEQ ID NO: 3913199 - DNA, 15 bp, Homo sapiens
ctgccgcccaaagag

SEQ ID NO: 3913200 - DNA, 19 bp, Homo sapiens
ctgccgctgccgctgcacc

SEQ ID NO: 3913201 - DNA, 20 bp, Homo sapiens
ctgccgggttctagtctcct

SEQ ID NO: 3913202 - DNA, 18 bp, Homo sapiens
ctgcctaagtggctgctg

SEQ ID NO: 3913203 - DNA, 20 bp, Homo sapiens
ctgcctaagtggctgctgac

SEQ ID NO: 3913204 - DNA, 13 bp, Homo sapiens
ctgcctactcacg

SEQ ID NO: 3913205 - DNA, 21 bp, Homo sapiens
cttccggaagaaaaagagcca

SEQ ID NO: 3913206 - DNA, 23 bp, Homo sapiens
cttcctagttttctcctcccagg

SEQ ID NO: 3913207 - DNA, 15 bp, Homo sapiens
cttcctccctcattc

SEQ ID NO: 3913208 - DNA, 13 bp, Homo sapiens
cttcctccgtcca

SEQ ID NO: 3913209 - DNA, 16 bp, Homo sapiens
cttcctccgtccaccc

SEQ ID NO: 3913210 - DNA, 18 bp, Homo sapiens
cttcctccgtccacccag

SEQ ID NO: 3913211 - DNA, 13 bp, Homo sapiens
cttcctcctccac

SEQ ID NO: 3913212 - DNA, 21 bp, Homo sapiens
cttcctcctccacagtgctgc

SEQ ID NO: 3913213 - DNA, 23 bp, Homo sapiens
cttcctcctccacagtgctgctt

SEQ ID NO: 3913214 - DNA, 10 bp, Homo sapiens
cttcctcctg

SEQ ID NO: 3913215 - DNA, 18 bp, Homo sapiens
cttcctcctgaagcctct

SEQ ID NO: 3913216 - DNA, 22 bp, Homo sapiens
cttcctcctgaagcctctgccc

SEQ ID NO: 3913217 - DNA, 22 bp, Homo sapiens
cttcctctcaagctagccagag

SEQ ID NO: 3913218 - DNA, 21 bp, Homo sapiens
cttcctctccactgccttcga

SEQ ID NO: 3913219 - DNA, 16 bp, Homo sapiens
cttcctgccaccagtc

SEQ ID NO: 3913220 - DNA, 12 bp, Homo sapiens
cttcctgctgct

SEQ ID NO: 3913221 - DNA, 13 bp, Homo sapiens
cttcctggacagc

SEQ ID NO: 3913222 - DNA, 22 bp, Homo sapiens
cttcctggacagctgtgcctcg

SEQ ID NO: 3913223 - DNA, 13 bp, Homo sapiens
cttcctggacctg

SEQ ID NO: 3913224 - DNA, 15 bp, Homo sapiens
cttcctggacctgag

SEQ ID NO: 3913225 - DNA, 18 bp, Homo sapiens
cttcctggacctgagtcg

SEQ ID NO: 3913226 - DNA, 11 bp, Homo sapiens
cttcctggcct

SEQ ID NO: 3913227 - DNA, 19 bp, Homo sapiens
cttcctggcctcactggct

SEQ ID NO: 3913228 - DNA, 20 bp, Homo sapiens
cttcctggcctcactggctg

SEQ ID NO: 3913229 - DNA, 23 bp, Homo sapiens
cttcctggggcatctggcgaatc

SEQ ID NO: 3913230 - DNA, 19 bp, Homo sapiens
cttcctggtgaggcccagc

SEQ ID NO: 3913231 - DNA, 23 bp, Homo sapiens
cttcctggtgaggcccagcctgt

SEQ ID NO: 3913232 - DNA, 21 bp, Homo sapiens
cttcctgtcccacctcttctc

SEQ ID NO: 3913233 - DNA, 12 bp, Homo sapiens
cttccttccccc

SEQ ID NO: 3913234 - DNA, 13 bp, Homo sapiens
cttccttccccca

SEQ ID NO: 3913235 - DNA, 18 bp, Homo sapiens
cttccttccgctccttta

SEQ ID NO: 3913236 - DNA, 19 bp, Homo sapiens
cttccttggactcatttta

SEQ ID NO: 3913237 - DNA, 20 bp, Homo sapiens
cttccttggactcattttaa

SEQ ID NO: 3913238 - DNA, 13 bp, Homo sapiens
cttcctttcctct

SEQ ID NO: 3913239 - DNA, 23 bp, Homo sapiens
cttcgaggtggatcacagaggct

SEQ ID NO: 3913240 - DNA, 18 bp, Homo sapiens
cttcgctgccaggacacc

SEQ ID NO: 3913241 - DNA, 19 bp, Homo sapiens
cttcgctgccaggacacct

SEQ ID NO: 3913242 - DNA, 22 bp, Homo sapiens
cttcgctgccaggacacctgcc

SEQ ID NO: 3913243 - DNA, 21 bp, Homo sapiens
cttcgctgctctagctggcag

SEQ ID NO: 3913244 - DNA, 19 bp, Homo sapiens
cttcggggaactcctggaa

SEQ ID NO: 3913245 - DNA, 14 bp, Homo sapiens
cttcggggctggga

SEQ ID NO: 3913246 - DNA, 15 bp, Homo sapiens
cttcggggctgggaa

SEQ ID NO: 3913247 - DNA, 16 bp, Homo sapiens
cttctaacctcagcca

SEQ ID NO: 3913248 - DNA, 22 bp, Homo sapiens
cttctaacctcagccaaacaca

SEQ ID NO: 3913249 - DNA, 13 bp, Homo sapiens
cttctaagtaaaa

SEQ ID NO: 3913250 - DNA, 17 bp, Homo sapiens
cttctaagtaaaaccac

SEQ ID NO: 3913251 - DNA, 21 bp, Homo sapiens
cttctaagtaaaaccacagca

SEQ ID NO: 3913252 - DNA, 22 bp, Homo sapiens
cttctaagtaaaaccacagcag

SEQ ID NO: 3913253 - DNA, 15 bp, Homo sapiens
cttctacaaccagag

SEQ ID NO: 3913254 - DNA, 17 bp, Homo sapiens
cttctacaaccagagcc

SEQ ID NO: 3913255 - DNA, 20 bp, Homo sapiens
cttctacaaccagagccccc

SEQ ID NO: 3913256 - DNA, 15 bp, Homo sapiens
cttctagatctggaa

SEQ ID NO: 3913257 - DNA, 13 bp, Homo sapiens
cttctattaaatg

SEQ ID NO: 3913258 - DNA, 16 bp, Homo sapiens
cttctattaaatgtat

SEQ ID NO: 3913259 - DNA, 19 bp, Homo sapiens
cttctcaggacacaggcct

SEQ ID NO: 3913260 - DNA, 21 bp, Homo sapiens
cttctcaggacacaggcctgt

SEQ ID NO: 3913261 - DNA, 15 bp, Homo sapiens
cttctccactggatg

SEQ ID NO: 3913262 - DNA, 13 bp, Homo sapiens
cttctccctggct

SEQ ID NO: 3913263 - DNA, 13 bp, Homo sapiens
cttctcctccagg

SEQ ID NO: 3913264 - DNA, 20 bp, Homo sapiens
cttctcctgaagttcagcca

SEQ ID NO: 3913265 - DNA, 16 bp, Homo sapiens
cttctcgtttgctcta

SEQ ID NO: 3913266 - DNA, 13 bp, Homo sapiens
cttctctcaaagg

SEQ ID NO: 3913267 - DNA, 20 bp, Homo sapiens
cttctctcaaagggaagctg

SEQ ID NO: 3913268 - DNA, 14 bp, Homo sapiens
cttctctccttccc

SEQ ID NO: 3913269 - DNA, 21 bp, Homo sapiens
cttctctccttccctctttcc

SEQ ID NO: 3913270 - DNA, 18 bp, Homo sapiens
cttctctgccaagccctc

SEQ ID NO: 3913271 - DNA, 21 bp, Homo sapiens
cttctgcacccagaaattcct

SEQ ID NO: 3913272 - DNA, 17 bp, Homo sapiens
cttctgcagcaactccc

SEQ ID NO: 3913273 - DNA, 19 bp, Homo sapiens
cttctgcagcaactcccac

SEQ ID NO: 3913274 - DNA, 13 bp, Homo sapiens
cttctgccttttt

SEQ ID NO: 3913275 - DNA, 20 bp, Homo sapiens
cttctggagtctccagtggt

SEQ ID NO: 3913276 - DNA, 15 bp, Homo sapiens
cttctgtccaggaca

SEQ ID NO: 3913277 - DNA, 22 bp, Homo sapiens
cttctgtgcactagcctgtgat

SEQ ID NO: 3913278 - DNA, 23 bp, Homo sapiens
cttctgtgcactagcctgtgatt

SEQ ID NO: 3913279 - DNA, 15 bp, Homo sapiens
cttctgtggctcaca

SEQ ID NO: 3913280 - DNA, 15 bp, Homo sapiens
cttctgttctcaaat

SEQ ID NO: 3913281 - DNA, 14 bp, Homo sapiens
cttcttaaaggcct

SEQ ID NO: 3913282 - DNA, 22 bp, Homo sapiens
cttcttacttggaactgaaggg

SEQ ID NO: 3913283 - DNA, 22 bp, Homo sapiens
cttcttattctcactccaccac

SEQ ID NO: 3913284 - DNA, 22 bp, Homo sapiens
cttcttcacccagctaatctgt

SEQ ID NO: 3913285 - DNA, 16 bp, Homo sapiens
cttcttcatcttgaca

SEQ ID NO: 3913286 - DNA, 12 bp, Homo sapiens
cttcttccctgt

SEQ ID NO: 3913287 - DNA, 20 bp, Homo sapiens
cttcttccctgttttaaatt

SEQ ID NO: 3913288 - DNA, 20 bp, Homo sapiens
cttcttcgcaaactgatgga

SEQ ID NO: 3913289 - DNA, 20 bp, Homo sapiens
cttcttcggggaactcctgg

SEQ ID NO: 3913290 - DNA, 21 bp, Homo sapiens
cttcttcggggaactcctgga

SEQ ID NO: 3913291 - DNA, 15 bp, Homo sapiens
cttcagtgcccacca

SEQ ID NO: 3913292 - DNA, 22 bp, Homo sapiens
cttcataggcggtcatgtgtgc

SEQ ID NO: 3913293 - DNA, 22 bp, Homo sapiens
cttcatcaatttttatacatat

SEQ ID NO: 3913294 - DNA, 14 bp, Homo sapiens
cttcatccctttcc

SEQ ID NO: 3913295 - DNA, 19 bp, Homo sapiens
cttcatcgaacaaactgat

SEQ ID NO: 3913296 - DNA, 14 bp, Homo sapiens
cttcatgcctcagt

SEQ ID NO: 3913297 - DNA, 15 bp, Homo sapiens
cttcatgcctcagtt

SEQ ID NO: 3913298 - DNA, 22 bp, Homo sapiens
cttcatgcctcagtttccccat

SEQ ID NO: 3913299 - DNA, 13 bp, Homo sapiens
cttcattaaagtc

SEQ ID NO: 3913300 - DNA, 21 bp, Homo sapiens
cttccaaagacaagaaaagag

SEQ ID NO: 3913301 - DNA, 13 bp, Homo sapiens
cttccaaccccag

SEQ ID NO: 3913302 - DNA, 14 bp, Homo sapiens
cttccaaccccagc

SEQ ID NO: 3913303 - DNA, 22 bp, Homo sapiens
cttccaaccccagctggcctct

SEQ ID NO: 3913304 - DNA, 21 bp, Homo sapiens
cttccacccattcccccatgt

SEQ ID NO: 3913305 - DNA, 17 bp, Homo sapiens
cttccacctcctagagg

SEQ ID NO: 3913306 - DNA, 14 bp, Homo sapiens
cttccactggctcc

SEQ ID NO: 3913307 - DNA, 12 bp, Homo sapiens
cttccagacata

SEQ ID NO: 3913308 - DNA, 15 bp, Homo sapiens
cttccagaccacctg

SEQ ID NO: 3913309 - DNA, 18 bp, Homo sapiens
cttccaggagcccagagg

SEQ ID NO: 3913310 - DNA, 15 bp, Homo sapiens
cttccaggctcttcc

SEQ ID NO: 3913311 - DNA, 21 bp, Homo sapiens
cttccaggctcttcctggacc

SEQ ID NO: 3913312 - DNA, 20 bp, Homo sapiens
cttccaggtatctccaggat

SEQ ID NO: 3913313 - DNA, 22 bp, Homo sapiens
cttccagtggctcgctccctgt

SEQ ID NO: 3913314 - DNA, 12 bp, Homo sapiens
cttccagtgttg

SEQ ID NO: 3913315 - DNA, 17 bp, Homo sapiens
cttccatgtcgcctctg

SEQ ID NO: 3913316 - DNA, 18 bp, Homo sapiens
cttccatgtcgcctctgc

SEQ ID NO: 3913317 - DNA, 20 bp, Homo sapiens
cttcccaatcagcactgaaa

SEQ ID NO: 3913318 - DNA, 14 bp, Homo sapiens
cttcccactggagg

SEQ ID NO: 3913319 - DNA, 15 bp, Homo sapiens
cttcccactggaggt

SEQ ID NO: 3913320 - DNA, 13 bp, Homo sapiens
cttcccagaggcc

SEQ ID NO: 3913321 - DNA, 15 bp, Homo sapiens
cttcccagctctccc

SEQ ID NO: 3913322 - DNA, 22 bp, Homo sapiens
cttcccagctctccctctggcc

SEQ ID NO: 3913323 - DNA, 12 bp, Homo sapiens
cttcccaggatc

SEQ ID NO: 3913324 - DNA, 16 bp, Homo sapiens
cttcccatcactggag

SEQ ID NO: 3913325 - DNA, 12 bp, Homo sapiens
cttccccagact

SEQ ID NO: 3913326 - DNA, 17 bp, Homo sapiens
cttccccagactcagct

SEQ ID NO: 3913327 - DNA, 18 bp, Homo sapiens
cttccccagactcagctc

SEQ ID NO: 3913328 - DNA, 14 bp, Homo sapiens
cttccccatctcca

SEQ ID NO: 3913329 - DNA, 20 bp, Homo sapiens
cttccccatctccatttcac

SEQ ID NO: 3913330 - DNA, 21 bp, Homo sapiens
cttcccccatcccctttcctc

SEQ ID NO: 3913331 - DNA, 23 bp, Homo sapiens
cttcccccatcccctttcctccc

SEQ ID NO: 3913332 - DNA, 12 bp, Homo sapiens
cttccccttgcc

SEQ ID NO: 3913333 - DNA, 13 bp, Homo sapiens
cttccccttgccc

SEQ ID NO: 3913334 - DNA, 14 bp, Homo sapiens
cttccccttgccct

SEQ ID NO: 3913335 - DNA, 16 bp, Homo sapiens
cttccccttttgcctg

SEQ ID NO: 3913336 - DNA, 18 bp, Homo sapiens
cttcccgctcagccctcc

SEQ ID NO: 3913337 - DNA, 19 bp, Homo sapiens
cttccctccccacagtcct

SEQ ID NO: 3913338 - DNA, 12 bp, Homo sapiens
cttccctccttc

SEQ ID NO: 3913339 - DNA, 14 bp, Homo sapiens
cttccctccttccc

SEQ ID NO: 3913340 - DNA, 16 bp, Homo sapiens
cttccctccttccctt

SEQ ID NO: 3913341 - DNA, 17 bp, Homo sapiens
cttccctgctttgagga

SEQ ID NO: 3913342 - DNA, 10 bp, Homo sapiens
cttccctggc

SEQ ID NO: 3913343 - DNA, 11 bp, Homo sapiens
cttccctggct

SEQ ID NO: 3913344 - DNA, 12 bp, Homo sapiens
cttccctggctt

SEQ ID NO: 3913345 - DNA, 16 bp, Homo sapiens
cttccctgggaactca

SEQ ID NO: 3913346 - DNA, 20 bp, Homo sapiens
cttccctgggaactcatcct

SEQ ID NO: 3913347 - DNA, 19 bp, Homo sapiens
cttccctgggaaggctaag

SEQ ID NO: 3913348 - DNA, 15 bp, Homo sapiens
cttccctgttttaaa

SEQ ID NO: 3913349 - DNA, 14 bp, Homo sapiens
cttccgctccttta

SEQ ID NO: 3913350 - DNA, 12 bp, Homo sapiens
ctttgatttcca

SEQ ID NO: 3913351 - DNA, 15 bp, Homo sapiens
ctttgcacatgtgac

SEQ ID NO: 3913352 - DNA, 16 bp, Homo sapiens
ctttgcacatgtgacc

SEQ ID NO: 3913353 - DNA, 17 bp, Homo sapiens
ctttgcacatgtgacca

SEQ ID NO: 3913354 - DNA, 23 bp, Homo sapiens
ctttgcactgagggccacactat

SEQ ID NO: 3913355 - DNA, 20 bp, Homo sapiens
ctttgcaggcccagcagact

SEQ ID NO: 3913356 - DNA, 16 bp, Homo sapiens
ctttgcaggctctggg

SEQ ID NO: 3913357 - DNA, 18 bp, Homo sapiens
ctttgcaggctctgggct

SEQ ID NO: 3913358 - DNA, 21 bp, Homo sapiens
ctttgcatggaatttgtaagt

SEQ ID NO: 3913359 - DNA, 13 bp, Homo sapiens
ctttgctacaata

SEQ ID NO: 3913360 - DNA, 15 bp, Homo sapiens
ctttgctacaataaa

SEQ ID NO: 3913361 - DNA, 13 bp, Homo sapiens
ctttgctgtctgg

SEQ ID NO: 3913362 - DNA, 20 bp, Homo sapiens
ctttgcttcaaatccatcca

SEQ ID NO: 3913363 - DNA, 20 bp, Homo sapiens
ctttgctttttaattgagga

SEQ ID NO: 3913364 - DNA, 15 bp, Homo sapiens
ctttggaagaaaaaa

SEQ ID NO: 3913365 - DNA, 15 bp, Homo sapiens
ctttggcttctcctg

SEQ ID NO: 3913366 - DNA, 17 bp, Homo sapiens
ctttggcttctcctgtg

SEQ ID NO: 3913367 - DNA, 18 bp, Homo sapiens
ctttggcttctcctgtga

SEQ ID NO: 3913368 - DNA, 13 bp, Homo sapiens
ctttgggaagggg

SEQ ID NO: 3913369 - DNA, 21 bp, Homo sapiens
gaaaactgtaaatacaaaata

SEQ ID NO: 3913370 - DNA, 19 bp, Homo sapiens
gaaaacttagaaataagaa

SEQ ID NO: 3913371 - DNA, 15 bp, Homo sapiens
gaaaacttatttgag

SEQ ID NO: 3913372 - DNA, 14 bp, Homo sapiens
gaaaacttgaatct

SEQ ID NO: 3913373 - DNA, 19 bp, Homo sapiens
gaaaagaacgtattttaaa

SEQ ID NO: 3913374 - DNA, 14 bp, Homo sapiens
gaaaagaaggctgc

SEQ ID NO: 3913375 - DNA, 22 bp, Homo sapiens
gaaaagaatccctgcagcctgg

SEQ ID NO: 3913376 - DNA, 15 bp, Homo sapiens
gaaaagaccagggct

SEQ ID NO: 3913377 - DNA, 14 bp, Homo sapiens
gaaaagactccaaa

SEQ ID NO: 3913378 - DNA, 17 bp, Homo sapiens
gaaaagactccaaagaa

SEQ ID NO: 3913379 - DNA, 18 bp, Homo sapiens
gaaaagactccaaagaaa

SEQ ID NO: 3913380 - DNA, 20 bp, Homo sapiens
gaaaagaggagtttcgaggt

SEQ ID NO: 3913381 - DNA, 21 bp, Homo sapiens
gaaaagaggtggattcctggg

SEQ ID NO: 3913382 - DNA, 14 bp, Homo sapiens
gaaaagcacctgcc

SEQ ID NO: 3913383 - DNA, 16 bp, Homo sapiens
gaaaagcacctgccga

SEQ ID NO: 3913384 - DNA, 19 bp, Homo sapiens
gaaaagcagacgcagcagc

SEQ ID NO: 3913385 - DNA, 12 bp, Homo sapiens
gaaaagcccagt

SEQ ID NO: 3913386 - DNA, 19 bp, Homo sapiens
gaaaagggaagttgtgcct

SEQ ID NO: 3913387 - DNA, 20 bp, Homo sapiens
gaaaagtagaattatatcta

SEQ ID NO: 3913388 - DNA, 14 bp, Homo sapiens
gaaaagtgcaatgc

SEQ ID NO: 3913389 - DNA, 18 bp, Homo sapiens
gaaaataaattttgaatg

SEQ ID NO: 3913390 - DNA, 19 bp, Homo sapiens
gaaaataaattttgaatgt

SEQ ID NO: 3913391 - DNA, 18 bp, Homo sapiens
gaaaatataaatgcatga

SEQ ID NO: 3913392 - DNA, 20 bp, Homo sapiens
gaaaatataaatgcatgatt

SEQ ID NO: 3913393 - DNA, 21 bp, Homo sapiens
gaaaatataaatgcatgattt

SEQ ID NO: 3913394 - DNA, 22 bp, Homo sapiens
gaaaatataaatgcatgatttt

SEQ ID NO: 3913395 - DNA, 22 bp, Homo sapiens
gaaaatatatttaatacctttg

SEQ ID NO: 3913396 - DNA, 21 bp, Homo sapiens
gaaaatcagttatattcttta

SEQ ID NO: 3913397 - DNA, 13 bp, Homo sapiens
gaaaatcctctgg

SEQ ID NO: 3913398 - DNA, 20 bp, Homo sapiens
gaaaatctaatattaaaaat

SEQ ID NO: 3913399 - DNA, 21 bp, Homo sapiens
gaaaatctaatattaaaaata

SEQ ID NO: 3913400 - DNA, 15 bp, Homo sapiens
gaaaatgtcctgtgg

SEQ ID NO: 3913401 - DNA, 18 bp, Homo sapiens
gaaaattaggatttcatg

SEQ ID NO: 3913402 - DNA, 12 bp, Homo sapiens
gaaaattagtaa

SEQ ID NO: 3913403 - DNA, 21 bp, Homo sapiens
gaaaattcctattgattttct

SEQ ID NO: 3913404 - DNA, 17 bp, Homo sapiens
gaaacaaatttttttct

SEQ ID NO: 3913405 - DNA, 14 bp, Homo sapiens
gaaacacagggttt

SEQ ID NO: 3913406 - DNA, 21 bp, Homo sapiens
gaaacactcaacaataaagac

SEQ ID NO: 3913407 - DNA, 17 bp, Homo sapiens
gaaacagagacaggccc

SEQ ID NO: 3913408 - DNA, 14 bp, Homo sapiens
gaaacagagagaga

SEQ ID NO: 3913409 - DNA, 21 bp, Homo sapiens
gaaacagataccatactcatt

SEQ ID NO: 3913410 - DNA, 17 bp, Homo sapiens
gaaacagatgataaata

SEQ ID NO: 3913411 - DNA, 12 bp, Homo sapiens
gaaacagcctgg

SEQ ID NO: 3913412 - DNA, 22 bp, Homo sapiens
gaaacagggagcccctaggaaa

SEQ ID NO: 3913413 - DNA, 22 bp, Homo sapiens
gaaacaggggatcaaagttcct

SEQ ID NO: 3913414 - DNA, 13 bp, Homo sapiens
gaaacatgacact

SEQ ID NO: 3913415 - DNA, 20 bp, Homo sapiens
gaaacatgactcgtatatgt

SEQ ID NO: 3913416 - DNA, 22 bp, Homo sapiens
gaaacattcacacagggctctt

SEQ ID NO: 3913417 - DNA, 19 bp, Homo sapiens
gaaacattccgaagaggga

SEQ ID NO: 3913418 - DNA, 19 bp, Homo sapiens
gaaacatttacaataaata

SEQ ID NO: 3913419 - DNA, 22 bp, Homo sapiens
gaaacatttacaataaatattc

SEQ ID NO: 3913420 - DNA, 13 bp, Homo sapiens
gaaacattttcat

SEQ ID NO: 3913421 - DNA, 13 bp, Homo sapiens
gaaacattttctt

SEQ ID NO: 3913422 - DNA, 21 bp, Homo sapiens
gaaaccacacttcttgaaaca

SEQ ID NO: 3913423 - DNA, 21 bp, Homo sapiens
gaaaccacaggcccttggggt

SEQ ID NO: 3913424 - DNA, 22 bp, Homo sapiens
gaaaccacaggcccttggggtt

SEQ ID NO: 3913425 - DNA, 17 bp, Homo sapiens
gaaaccagtatggaagg

SEQ ID NO: 3913426 - DNA, 20 bp, Homo sapiens
gaaaccagtatggaagggag

SEQ ID NO: 3913427 - DNA, 12 bp, Homo sapiens
gaaaccttgcag

SEQ ID NO: 3913428 - DNA, 15 bp, Homo sapiens
gaaaccttgcagcat

SEQ ID NO: 3913429 - DNA, 16 bp, Homo sapiens
gaaaccttgcagcatt

SEQ ID NO: 3913430 - DNA, 23 bp, Homo sapiens
gaaacgaacccactgtgcttaca

SEQ ID NO: 3913431 - DNA, 20 bp, Homo sapiens
gaaacgaagccatctttctt

SEQ ID NO: 3913432 - DNA, 22 bp, Homo sapiens
gaaacgtacttaactgtgtgaa

SEQ ID NO: 3913433 - DNA, 22 bp, Homo sapiens
gaaactcaaccatcaatggaaa

SEQ ID NO: 3913434 - DNA, 20 bp, Homo sapiens
gaaactcaccatgtaaaaga

SEQ ID NO: 3913435 - DNA, 22 bp, Homo sapiens
gaaactccgtcttagaagtgga

SEQ ID NO: 3913436 - DNA, 18 bp, Homo sapiens
gaaactccttttgctgtc

SEQ ID NO: 3913437 - DNA, 19 bp, Homo sapiens
gaagggcatccttctgcct

SEQ ID NO: 3913438 - DNA, 13 bp, Homo sapiens
gaagggccagccc

SEQ ID NO: 3913439 - DNA, 15 bp, Homo sapiens
gaagggccagcccta

SEQ ID NO: 3913440 - DNA, 17 bp, Homo sapiens
gaagggccagccctaca

SEQ ID NO: 3913441 - DNA, 14 bp, Homo sapiens
gaagggccaggaga

SEQ ID NO: 3913442 - DNA, 17 bp, Homo sapiens
gaagggccaggagagag

SEQ ID NO: 3913443 - DNA, 11 bp, Homo sapiens
gaagggccagt

SEQ ID NO: 3913444 - DNA, 19 bp, Homo sapiens
gaagggctagaacctggag

SEQ ID NO: 3913445 - DNA, 22 bp, Homo sapiens
gaagggctagaacctggagagc

SEQ ID NO: 3913446 - DNA, 23 bp, Homo sapiens
gaaggggcacaccactgccctgc

SEQ ID NO: 3913447 - DNA, 14 bp, Homo sapiens
gaaggggccccggg

SEQ ID NO: 3913448 - DNA, 20 bp, Homo sapiens
gaaggggccccggggctggc

SEQ ID NO: 3913449 - DNA, 16 bp, Homo sapiens
gaagggggaagtctct

SEQ ID NO: 3913450 - DNA, 14 bp, Homo sapiens
gaagggggcggcct

SEQ ID NO: 3913451 - DNA, 18 bp, Homo sapiens
gaagggggtccacccagc

SEQ ID NO: 3913452 - DNA, 16 bp, Homo sapiens
gaagggggtgtgcgtg

SEQ ID NO: 3913453 - DNA, 21 bp, Homo sapiens
gaagggggtgtgcgtgcgtgt

SEQ ID NO: 3913454 - DNA, 13 bp, Homo sapiens
gaagggtaaagaa

SEQ ID NO: 3913455 - DNA, 15 bp, Homo sapiens
gaagggtgacatccc

SEQ ID NO: 3913456 - DNA, 17 bp, Homo sapiens
gaagggtgacatcccag

SEQ ID NO: 3913457 - DNA, 12 bp, Homo sapiens
gaagggtggggt

SEQ ID NO: 3913458 - DNA, 19 bp, Homo sapiens
gaagggttggtgggctggc

SEQ ID NO: 3913459 - DNA, 23 bp, Homo sapiens
gaaggtcactcttcctgcaagga

SEQ ID NO: 3913460 - DNA, 22 bp, Homo sapiens
gaaggtgccccaaaatgcaaga

SEQ ID NO: 3913461 - DNA, 22 bp, Homo sapiens
gaaggtgctgagcttagccttg

SEQ ID NO: 3913462 - DNA, 16 bp, Homo sapiens
gaaggtttgtatattg

SEQ ID NO: 3913463 - DNA, 13 bp, Homo sapiens
gaagtatgtgtgg

SEQ ID NO: 3913464 - DNA, 15 bp, Homo sapiens
gaagtcactgcacag

SEQ ID NO: 3913465 - DNA, 16 bp, Homo sapiens
gaagtcattgtcgctc

SEQ ID NO: 3913466 - DNA, 20 bp, Homo sapiens
gaagtcattgtcgctcagca

SEQ ID NO: 3913467 - DNA, 21 bp, Homo sapiens
gaagtcattgtcgctcagcaa

SEQ ID NO: 3913468 - DNA, 24 bp, Homo sapiens
gaagtcgtccttactcctgtggga

SEQ ID NO: 3913469 - DNA, 19 bp, Homo sapiens
gaagtcgtttcaggacatg

SEQ ID NO: 3913470 - DNA, 12 bp, Homo sapiens
gaagtgaagccc

SEQ ID NO: 3913471 - DNA, 21 bp, Homo sapiens
gaagtgaaggagaaaggagcc

SEQ ID NO: 3913472 - DNA, 18 bp, Homo sapiens
gaagtgcaaatttgatac

SEQ ID NO: 3913473 - DNA, 13 bp, Homo sapiens
gaagtgctcccca

SEQ ID NO: 3913474 - DNA, 16 bp, Homo sapiens
gaagtgctccccacac

SEQ ID NO: 3913475 - DNA, 16 bp, Homo sapiens
gaagtggaccaggaca

SEQ ID NO: 3913476 - DNA, 15 bp, Homo sapiens
gaagtggctctcagg

SEQ ID NO: 3913477 - DNA, 15 bp, Homo sapiens
gaagtgtgtttcctt

SEQ ID NO: 3913478 - DNA, 10 bp, Homo sapiens
gaagtgttca

SEQ ID NO: 3913479 - DNA, 17 bp, Homo sapiens
gaagtgttcaagaaata

SEQ ID NO: 3913480 - DNA, 13 bp, Homo sapiens
gaagttttcagga

SEQ ID NO: 3913481 - DNA, 15 bp, Homo sapiens
gaagttttgtacaga

SEQ ID NO: 3913482 - DNA, 13 bp, Homo sapiens
gaataaaattgta

SEQ ID NO: 3913483 - DNA, 16 bp, Homo sapiens
gaataaacttcagcac

SEQ ID NO: 3913484 - DNA, 14 bp, Homo sapiens
gaataaagacacct

SEQ ID NO: 3913485 - DNA, 13 bp, Homo sapiens
gaataaagttctg

SEQ ID NO: 3913486 - DNA, 14 bp, Homo sapiens
gaataaagttctga

SEQ ID NO: 3913487 - DNA, 11 bp, Homo sapiens
gaataaatgtt

SEQ ID NO: 3913488 - DNA, 15 bp, Homo sapiens
gaataaattgctcct

SEQ ID NO: 3913489 - DNA, 23 bp, Homo sapiens
gaataagaaaacaatcacactca

SEQ ID NO: 3913490 - DNA, 19 bp, Homo sapiens
gaataagtgctgtttgaga

SEQ ID NO: 3913491 - DNA, 22 bp, Homo sapiens
gaataataattaggttaacatt

SEQ ID NO: 3913492 - DNA, 17 bp, Homo sapiens
gaatacccccagagacc

SEQ ID NO: 3913493 - DNA, 15 bp, Homo sapiens
gaatagccagagagg

SEQ ID NO: 3913494 - DNA, 19 bp, Homo sapiens
gaatagcgaatcatctcaa

SEQ ID NO: 3913495 - DNA, 18 bp, Homo sapiens
gaatagtcgcgcaagcat

SEQ ID NO: 3913496 - DNA, 11 bp, Homo sapiens
gaatatattat

SEQ ID NO: 3913497 - DNA, 16 bp, Homo sapiens
gaatatggacaaagaa

SEQ ID NO: 3913498 - DNA, 12 bp, Homo sapiens
gaatattcagga

SEQ ID NO: 3913499 - DNA, 15 bp, Homo sapiens
gaatattcaggactt

SEQ ID NO: 3913500 - DNA, 17 bp, Homo sapiens
gaatcaaagacatggaa

SEQ ID NO: 3913501 - DNA, 22 bp, Homo sapiens
gaatcaaagcagttaactttaa

SEQ ID NO: 3913502 - DNA, 22 bp, Homo sapiens
gaatcaagctagaaggccacat

SEQ ID NO: 3913503 - DNA, 20 bp, Homo sapiens
gaatcaattgtctatatgga

SEQ ID NO: 3913504 - DNA, 17 bp, Homo sapiens
gaatcaatttcccagaa

SEQ ID NO: 3913505 - DNA, 16 bp, Homo sapiens
gaatcacacaagtttg

SEQ ID NO: 3913506 - DNA, 18 bp, Homo sapiens
gaatcagaccctacccca

SEQ ID NO: 3913507 - DNA, 22 bp, Homo sapiens
gaatcagaccctaccccaccac

SEQ ID NO: 3913508 - DNA, 10 bp, Homo sapiens
gaatcataat

SEQ ID NO: 3913509 - DNA, 21 bp, Homo sapiens
gaatcatgtcaggcctgtgtg

SEQ ID NO: 3913510 - DNA, 15 bp, Homo sapiens
gaatccacccatcct

SEQ ID NO: 3913511 - DNA, 20 bp, Homo sapiens
gaatcctaggctccacccca

SEQ ID NO: 3913512 - DNA, 13 bp, Homo sapiens
gaatcctttgaga

SEQ ID NO: 3913513 - DNA, 19 bp, Homo sapiens
gaatcgatctgtactgtaa

SEQ ID NO: 3913514 - DNA, 15 bp, Homo sapiens
gaatcgtttcaaatg

SEQ ID NO: 3913515 - DNA, 17 bp, Homo sapiens
gaatcgtttcaaatgga

SEQ ID NO: 3913516 - DNA, 19 bp, Homo sapiens
gaatctacagaacaaagaa

SEQ ID NO: 3913517 - DNA, 15 bp, Homo sapiens
gaatctacctgtggt

SEQ ID NO: 3913518 - DNA, 20 bp, Homo sapiens
gaatctgaaagtatattttc

SEQ ID NO: 3913519 - DNA, 12 bp, Homo sapiens
gaatctgcaggg

SEQ ID NO: 3913520 - DNA, 19 bp, Homo sapiens
gaatctgcctgtggccttg

SEQ ID NO: 3913521 - DNA, 15 bp, Homo sapiens
gaatctgctgttgcc

SEQ ID NO: 3913522 - DNA, 15 bp, Homo sapiens
gaatgaaaactcatt

SEQ ID NO: 3913523 - DNA, 23 bp, Homo sapiens
gaatgaaatcctgcttcagtgta

SEQ ID NO: 3913524 - DNA, 13 bp, Homo sapiens
gaagagggcctgt

SEQ ID NO: 3913525 - DNA, 21 bp, Homo sapiens
gaagagtttaactttgggccc

SEQ ID NO: 3913526 - DNA, 13 bp, Homo sapiens
gaagatgaaagag

SEQ ID NO: 3913527 - DNA, 13 bp, Homo sapiens
gaagatgaagaga

SEQ ID NO: 3913528 - DNA, 18 bp, Homo sapiens
gaagatggactctgaaaa

SEQ ID NO: 3913529 - DNA, 17 bp, Homo sapiens
gaagattctcctgtgct

SEQ ID NO: 3913530 - DNA, 12 bp, Homo sapiens
gaagatttacct

SEQ ID NO: 3913531 - DNA, 14 bp, Homo sapiens
gaagcaagaaagcc

SEQ ID NO: 3913532 - DNA, 20 bp, Homo sapiens
gaagcacagagggctaggga

SEQ ID NO: 3913533 - DNA, 14 bp, Homo sapiens
gaagcacatgttta

SEQ ID NO: 3913534 - DNA, 17 bp, Homo sapiens
gcttctgcagcaactcc

SEQ ID NO: 3913535 - DNA, 18 bp, Homo sapiens
gcttctgcagcaactccc

SEQ ID NO: 3913536 - DNA, 22 bp, Homo sapiens
gcttctgtgcactagcctgtga

SEQ ID NO: 3913537 - DNA, 15 bp, Homo sapiens
gcttctgttgcgcca

SEQ ID NO: 3913538 - DNA, 19 bp, Homo sapiens
gcttctgttgcgccactga

SEQ ID NO: 3913539 - DNA, 15 bp, Homo sapiens
gcttctgttgtaata

SEQ ID NO: 3913540 - DNA, 19 bp, Homo sapiens
gcttctgttgtaatagtcc

SEQ ID NO: 3913541 - DNA, 19 bp, Homo sapiens
gcttcttcatcttgacatg

SEQ ID NO: 3913542 - DNA, 12 bp, Homo sapiens
gcttgaccagac

SEQ ID NO: 3913543 - DNA, 15 bp, Homo sapiens
gcttgaccagaccta

SEQ ID NO: 3913544 - DNA, 22 bp, Homo sapiens
gcttgaccagacctagacctgg

SEQ ID NO: 3913545 - DNA, 21 bp, Homo sapiens
gcttgactggatggaaggaga

SEQ ID NO: 3913546 - DNA, 14 bp, Homo sapiens
gcttgagcccagga

SEQ ID NO: 3913547 - DNA, 14 bp, Homo sapiens
gcttgcttctgcag

SEQ ID NO: 3913548 - DNA, 15 bp, Homo sapiens
gcttgcttctgcagc

SEQ ID NO: 3913549 - DNA, 24 bp, Homo sapiens
gcttgggggatgactagaggcagg

SEQ ID NO: 3913550 - DNA, 14 bp, Homo sapiens
gcttggggggtgat

SEQ ID NO: 3913551 - DNA, 20 bp, Homo sapiens
gcttgggtggtgggtgctgg

SEQ ID NO: 3913552 - DNA, 17 bp, Homo sapiens
gcttggtaaaacacaga

SEQ ID NO: 3913553 - DNA, 16 bp, Homo sapiens
gcttggtggggctcgt

SEQ ID NO: 3913554 - DNA, 19 bp, Homo sapiens
gcttggtggggctcgtggc

SEQ ID NO: 3913555 - DNA, 16 bp, Homo sapiens
gcttgtaactccacca

SEQ ID NO: 3913556 - DNA, 22 bp, Homo sapiens
gcttgtaactccaccaacccat

SEQ ID NO: 3913557 - DNA, 17 bp, Homo sapiens
gcttgtagaccactgtc

SEQ ID NO: 3913558 - DNA, 19 bp, Homo sapiens
gcttgtagaccactgtcct

SEQ ID NO: 3913559 - DNA, 16 bp, Homo sapiens
gcttgtatatacatat

SEQ ID NO: 3913560 - DNA, 17 bp, Homo sapiens
gcttgtatatacatatt

SEQ ID NO: 3913561 - DNA, 15 bp, Homo sapiens
gcttgtccagcgcct

SEQ ID NO: 3913562 - DNA, 14 bp, Homo sapiens
gcttgtgagagctg

SEQ ID NO: 3913563 - DNA, 22 bp, Homo sapiens
gcttgttgtttttaagtcctgt

SEQ ID NO: 3913564 - DNA, 21 bp, Homo sapiens
gctttaacaaaacaagaaaga

SEQ ID NO: 3913565 - DNA, 22 bp, Homo sapiens
gctttaacaaaacaagaaagaa

SEQ ID NO: 3913566 - DNA, 23 bp, Homo sapiens
gctttagtcctagaggacctgag

SEQ ID NO: 3913567 - DNA, 21 bp, Homo sapiens
gctttatttatggcttataaa

SEQ ID NO: 3913568 - DNA, 15 bp, Homo sapiens
gctttcaattgtatt

SEQ ID NO: 3913569 - DNA, 16 bp, Homo sapiens
gctttcagagccagtg

SEQ ID NO: 3913570 - DNA, 17 bp, Homo sapiens
gctttcagagccagtga

SEQ ID NO: 3913571 - DNA, 12 bp, Homo sapiens
gctttctcaggg

SEQ ID NO: 3913572 - DNA, 15 bp, Homo sapiens
gctttctccggggtc

SEQ ID NO: 3913573 - DNA, 19 bp, Homo sapiens
gctttctgaagctttacca

SEQ ID NO: 3913574 - DNA, 22 bp, Homo sapiens
gctttcttctacaaccagagcc

SEQ ID NO: 3913575 - DNA, 21 bp, Homo sapiens
gctttctttcacaaaaaagaa

SEQ ID NO: 3913576 - DNA, 17 bp, Homo sapiens
gctttgaatacccccag

SEQ ID NO: 3913577 - DNA, 19 bp, Homo sapiens
gctttgaatacccccagag

SEQ ID NO: 3913578 - DNA, 17 bp, Homo sapiens
gctttgacatgaaaaga

SEQ ID NO: 3913579 - DNA, 14 bp, Homo sapiens
gctttgcaggctct

SEQ ID NO: 3913580 - DNA, 15 bp, Homo sapiens
gctttgcaggctctg

SEQ ID NO: 3913581 - DNA, 16 bp, Homo sapiens
gctttgcaggctctgg

SEQ ID NO: 3913582 - DNA, 18 bp, Homo sapiens
gctttgcaggctctgggc

SEQ ID NO: 3913583 - DNA, 19 bp, Homo sapiens
gctttgcaggctctgggct

SEQ ID NO: 3913584 - DNA, 21 bp, Homo sapiens
gctttgcaggctctgggctca

SEQ ID NO: 3913585 - DNA, 22 bp, Homo sapiens
gctttgcaggctctgggctcag

SEQ ID NO: 3913586 - DNA, 21 bp, Homo sapiens
gctttgcttatggtaataaaa

SEQ ID NO: 3913587 - DNA, 15 bp, Homo sapiens
gctttgggctgccct

SEQ ID NO: 3913588 - DNA, 20 bp, Homo sapiens
gctttgggctttgcaggctc

SEQ ID NO: 3913589 - DNA, 23 bp, Homo sapiens
gctttggggacagttggcagaga

SEQ ID NO: 3913590 - DNA, 14 bp, Homo sapiens
gctttgttttatat

SEQ ID NO: 3913591 - DNA, 15 bp, Homo sapiens
gctttgttttatata

SEQ ID NO: 3913592 - DNA, 23 bp, Homo sapiens
gcttttaataaaattgacaacat

SEQ ID NO: 3913593 - DNA, 13 bp, Homo sapiens
gcttttcactgct

SEQ ID NO: 3913594 - DNA, 22 bp, Homo sapiens
gcttttcactgctggctgcctt

SEQ ID NO: 3913595 - DNA, 23 bp, Homo sapiens
gcttttcactgctggctgcctta

SEQ ID NO: 3913596 - DNA, 19 bp, Homo sapiens
gcttttccaggatcctgca

SEQ ID NO: 3913597 - DNA, 23 bp, Homo sapiens
gcttttccaggatcctgcaggaa

SEQ ID NO: 3913598 - DNA, 18 bp, Homo sapiens
gcttttccccggtccctt

SEQ ID NO: 3913599 - DNA, 18 bp, Homo sapiens
gcttttgttgtgactttt

SEQ ID NO: 3913600 - DNA, 13 bp, Homo sapiens
gctttttccagag

SEQ ID NO: 3913601 - DNA, 12 bp, Homo sapiens
ggaaaaaaatta

SEQ ID NO: 3913602 - DNA, 15 bp, Homo sapiens
ggaaaaaagttttga

SEQ ID NO: 3913603 - DNA, 15 bp, Homo sapiens
ggaaaaatccagaaa

SEQ ID NO: 3913604 - DNA, 17 bp, Homo sapiens
ggaaaaatcttgggcaa

SEQ ID NO: 3913605 - DNA, 20 bp, Homo sapiens
ggaaaacaaatcactgtatt

SEQ ID NO: 3913606 - DNA, 15 bp, Homo sapiens
ggaaaaccagggata

SEQ ID NO: 3913607 - DNA, 18 bp, Homo sapiens
ggaaaagaatacagaaag

SEQ ID NO: 3913608 - DNA, 22 bp, Homo sapiens
ggaaaagaatccctgcagcctg

SEQ ID NO: 3913609 - DNA, 13 bp, Homo sapiens
ggaaaaggcctgg

SEQ ID NO: 3913610 - DNA, 17 bp, Homo sapiens
ggaaaaggcctggggtg

SEQ ID NO: 3913611 - DNA, 14 bp, Homo sapiens
ggaaaccaaaggaa

SEQ ID NO: 3913612 - DNA, 16 bp, Homo sapiens
ggaaagacgtttttgt

SEQ ID NO: 3913613 - DNA, 12 bp, Homo sapiens
ggaaagccctcc

SEQ ID NO: 3913614 - DNA, 20 bp, Homo sapiens
ggaaagctgatgatgtctct

SEQ ID NO: 3913615 - DNA, 21 bp, Homo sapiens
ggaaaggtttcaagacttgat

SEQ ID NO: 3913616 - DNA, 19 bp, Homo sapiens
ggaaataaaacctttcaaa

SEQ ID NO: 3913617 - DNA, 16 bp, Homo sapiens
ggaaatatcagttact

SEQ ID NO: 3913618 - DNA, 19 bp, Homo sapiens
ggaaatcatcgaaaattca

SEQ ID NO: 3913619 - DNA, 15 bp, Homo sapiens
ggaaatctgttttgt

SEQ ID NO: 3913620 - DNA, 13 bp, Homo sapiens
ggaaatggagggt

SEQ ID NO: 3913621 - DNA, 17 bp, Homo sapiens
ggaaatgtcaacaagta

SEQ ID NO: 3913622 - DNA, 21 bp, Homo sapiens
ggaacactggaaaataaattt

SEQ ID NO: 3913623 - DNA, 13 bp, Homo sapiens
ggaacagacagga

SEQ ID NO: 3913624 - DNA, 13 bp, Homo sapiens
ggaacagagactc

SEQ ID NO: 3913625 - DNA, 16 bp, Homo sapiens
ggaaccccgcagcccg

SEQ ID NO: 3913626 - DNA, 17 bp, Homo sapiens
ggaaccccgcagcccgt

SEQ ID NO: 3913627 - DNA, 18 bp, Homo sapiens
ggaaccccgcagcccgtg

SEQ ID NO: 3913628 - DNA, 17 bp, Homo sapiens
ggaacccgactgtgaaa

SEQ ID NO: 3913629 - DNA, 19 bp, Homo sapiens
ggaacccttttcctccaga

SEQ ID NO: 3913630 - DNA, 23 bp, Homo sapiens
ggaacccttttcctccagacaga

SEQ ID NO: 3913631 - DNA, 18 bp, Homo sapiens
ggaacctagtactctctg

SEQ ID NO: 3913632 - DNA, 13 bp, Homo sapiens
ggaacctcaaact

SEQ ID NO: 3913633 - DNA, 18 bp, Homo sapiens
ggaacctcaaactgggta

SEQ ID NO: 3913634 - DNA, 15 bp, Homo sapiens
ggaaccttccctcca

SEQ ID NO: 3913635 - DNA, 13 bp, Homo sapiens
ggaactcatcctg

SEQ ID NO: 3913636 - DNA, 21 bp, Homo sapiens
ggaactcatcctgtgtgggga

SEQ ID NO: 3913637 - DNA, 22 bp, Homo sapiens
ggaactcatcctgtgtggggag

SEQ ID NO: 3913638 - DNA, 14 bp, Homo sapiens
ggaactccactctc

SEQ ID NO: 3913639 - DNA, 11 bp, Homo sapiens
ggaactcccag

SEQ ID NO: 3913640 - DNA, 15 bp, Homo sapiens
ggaactgtggctttg

SEQ ID NO: 3913641 - DNA, 16 bp, Homo sapiens
ggaagaaaccccaagc

SEQ ID NO: 3913642 - DNA, 19 bp, Homo sapiens
ggaagaaagagaaggagcc

SEQ ID NO: 3913643 - DNA, 19 bp, Homo sapiens
ggaagaaattcctgtagca

SEQ ID NO: 3913644 - DNA, 20 bp, Homo sapiens
ggaagaagagatcaggaaga

SEQ ID NO: 3913645 - DNA, 20 bp, Homo sapiens
ggaagaagccccgtttccag

SEQ ID NO: 3913646 - DNA, 13 bp, Homo sapiens
ggaagacaggtct

SEQ ID NO: 3913647 - DNA, 12 bp, Homo sapiens
ggaagagagaga

SEQ ID NO: 3913648 - DNA, 12 bp, Homo sapiens
ggaagagaggca

SEQ ID NO: 3913649 - DNA, 14 bp, Homo sapiens
ggaagagaggcacc

SEQ ID NO: 3913650 - DNA, 17 bp, Homo sapiens
ggaagagaggcacctgc

SEQ ID NO: 3913651 - DNA, 12 bp, Homo sapiens
ggaagagcagcc

SEQ ID NO: 3913652 - DNA, 14 bp, Homo sapiens
ggaagagcagcctg

SEQ ID NO: 3913653 - DNA, 21 bp, Homo sapiens
ggaagagggcagtacctggga

SEQ ID NO: 3913654 - DNA, 15 bp, Homo sapiens
ggaagatgaagagaa

SEQ ID NO: 3913655 - DNA, 14 bp, Homo sapiens
ggaagatggtagca

SEQ ID NO: 3913656 - DNA, 21 bp, Homo sapiens
ggaagatttaccttttctgtt

SEQ ID NO: 3913657 - DNA, 11 bp, Homo sapiens
ggaagcaggca

SEQ ID NO: 3913658 - DNA, 15 bp, Homo sapiens
ggaagcaggcagagc

SEQ ID NO: 3913659 - DNA, 11 bp, Homo sapiens
ggaagcaggga

SEQ ID NO: 3913660 - DNA, 17 bp, Homo sapiens
ggaagcagggacacccc

SEQ ID NO: 3913661 - DNA, 23 bp, Homo sapiens
ggaagccccccacctttctcgct

SEQ ID NO: 3913662 - DNA, 17 bp, Homo sapiens
ggaagccctccttccac

SEQ ID NO: 3913663 - DNA, 15 bp, Homo sapiens
ggaagccctggattt

SEQ ID NO: 3913664 - DNA, 17 bp, Homo sapiens
ggaagccgtctgactcc

SEQ ID NO: 3913665 - DNA, 20 bp, Homo sapiens
ggaagccgtctgactccaga

SEQ ID NO: 3913666 - DNA, 21 bp, Homo sapiens
ggaagccgtctgactccagag

SEQ ID NO: 3913667 - DNA, 15 bp, Homo sapiens
ggaagcctcttcagg

SEQ ID NO: 3913668 - DNA, 20 bp, Homo sapiens
ggaagcctggactctaagct

SEQ ID NO: 3913669 - DNA, 14 bp, Homo sapiens
ggaagctccactgt

SEQ ID NO: 3913670 - DNA, 18 bp, Homo sapiens
ggaagctgagcaggcccg

SEQ ID NO: 3913671 - DNA, 16 bp, Homo sapiens
ggaagctgggggaagg

SEQ ID NO: 3913672 - DNA, 22 bp, Homo sapiens
ggaagctgggggaagggtggtc

SEQ ID NO: 3913673 - DNA, 23 bp, Homo sapiens
ggaagctgtactcagagcagagc

SEQ ID NO: 3913674 - DNA, 16 bp, Homo sapiens
ggaaggaactctggct

SEQ ID NO: 3913675 - DNA, 17 bp, Homo sapiens
ggaaggaactctggctt

SEQ ID NO: 3913676 - DNA, 22 bp, Homo sapiens
ggaaggagactcacctctgcct

SEQ ID NO: 3913677 - DNA, 14 bp, Homo sapiens
ggaaggcaggcagg

SEQ ID NO: 3913678 - DNA, 17 bp, Homo sapiens
ggaaggcaggcagggct

SEQ ID NO: 3913679 - DNA, 17 bp, Homo sapiens
ggaaggcagggaggagg

SEQ ID NO: 3913680 - DNA, 13 bp, Homo sapiens
ggaaggcagggca

SEQ ID NO: 3913681 - DNA, 14 bp, Homo sapiens
ggaaggcagggcag

SEQ ID NO: 3913682 - DNA, 17 bp, Homo sapiens
ggaaggcagggcagagg

SEQ ID NO: 3913683 - DNA, 18 bp, Homo sapiens
ggaaggcagggcagaggg

SEQ ID NO: 3913684 - DNA, 20 bp, Homo sapiens
ggaaggcagggcagagggaa

SEQ ID NO: 3913685 - DNA, 14 bp, Homo sapiens
ggaaggccttttca

SEQ ID NO: 3913686 - DNA, 21 bp, Homo sapiens
ggaaggctaagttcagttctg

SEQ ID NO: 3913687 - DNA, 22 bp, Homo sapiens
ggaaggctacttcggggctggg

SEQ ID NO: 3913688 - DNA, 23 bp, Homo sapiens
ggaaggctacttcggggctggga

SEQ ID NO: 3913689 - DNA, 14 bp, Homo sapiens
ggaaggctggctga

SEQ ID NO: 3913690 - DNA, 17 bp, Homo sapiens
ggaagggcatccttctg

SEQ ID NO: 3913691 - DNA, 11 bp, Homo sapiens
ggaagggccag

SEQ ID NO: 3913692 - DNA, 17 bp, Homo sapiens
ggaagggccaggagaga

SEQ ID NO: 3913693 - DNA, 12 bp, Homo sapiens
ggaagggccagt

SEQ ID NO: 3913694 - DNA, 21 bp, Homo sapiens
ggaagggccagtctgggctgc

SEQ ID NO: 3913695 - DNA, 16 bp, Homo sapiens
ggaagggggtccaccc

SEQ ID NO: 3913696 - DNA, 23 bp, Homo sapiens
ggaagggttggtgggctggccca

SEQ ID NO: 3913697 - DNA, 15 bp, Homo sapiens
ggaaggtgctgagct

SEQ ID NO: 3913698 - DNA, 16 bp, Homo sapiens
ggaaggtgctgagctt

SEQ ID NO: 3913699 - DNA, 19 bp, Homo sapiens
ggaaggtttggtgtgtgga

SEQ ID NO: 3913700 - DNA, 12 bp, Homo sapiens
ggaagtatgtgt

SEQ ID NO: 3913701 - DNA, 20 bp, Homo sapiens
ggaagtcgtttcaggacatg

SEQ ID NO: 3913702 - DNA, 15 bp, Homo sapiens
ggaagtgaagcccct

SEQ ID NO: 3913703 - DNA, 15 bp, Homo sapiens
ggaagtgctccccac

SEQ ID NO: 3913704 - DNA, 18 bp, Homo sapiens
ggaagtggcagtgaaaaa

SEQ ID NO: 3913705 - DNA, 22 bp, Homo sapiens
ggaagtggctgagtcaggactt

SEQ ID NO: 3913706 - DNA, 16 bp, Homo sapiens
ggaagtgttcaagaaa

SEQ ID NO: 3913707 - DNA, 23 bp, Homo sapiens
ggaagttattaacgggcatgtat

SEQ ID NO: 3913708 - DNA, 21 bp, Homo sapiens
ggaatagcccgaggaccgggc

SEQ ID NO: 3913709 - DNA, 16 bp, Homo sapiens
ggaatcaatttcccag

SEQ ID NO: 3913710 - DNA, 23 bp, Homo sapiens
ggaatcagacttcacactgcaag

SEQ ID NO: 3913711 - DNA, 18 bp, Homo sapiens
ggaatcatgtcaggcctg

SEQ ID NO: 3913712 - DNA, 20 bp, Homo sapiens
ggaatccgcctgcagaggac

SEQ ID NO: 3913713 - DNA, 20 bp, Homo sapiens
ggaatcgatctgtactgtaa

SEQ ID NO: 3913714 - DNA, 17 bp, Homo sapiens
ggaatcgccccagactc

SEQ ID NO: 3913715 - DNA, 20 bp, Homo sapiens
ggaatctgaaagtatatttt

SEQ ID NO: 3913716 - DNA, 12 bp, Homo sapiens
ggaatgcaggga

SEQ ID NO: 3913717 - DNA, 20 bp, Homo sapiens
ggaatgcagggaagagggca

SEQ ID NO: 3913718 - DNA, 22 bp, Homo sapiens
ggaatgcggccgcattccctga

SEQ ID NO: 3913719 - DNA, 17 bp, Homo sapiens
ggaatgttccctgcacc

SEQ ID NO: 3913720 - DNA, 19 bp, Homo sapiens
ggaatgttccctgcaccct

SEQ ID NO: 3913721 - DNA, 15 bp, Homo sapiens
ggaattcagcaccct

SEQ ID NO: 3913722 - DNA, 20 bp, Homo sapiens
ggaattctttacaataaaca

SEQ ID NO: 3913723 - DNA, 21 bp, Homo sapiens
ggaattctttacaataaacat

SEQ ID NO: 3913724 - DNA, 12 bp, Homo sapiens
ggaatttgtaag

SEQ ID NO: 3913725 - DNA, 19 bp, Homo sapiens
ggaatttgtaagtttatgt

SEQ ID NO: 3913726 - DNA, 11 bp, Homo sapiens
ggacaaaatgg

SEQ ID NO: 3913727 - DNA, 13 bp, Homo sapiens
ggacaaaggagcc

SEQ ID NO: 3913728 - DNA, 16 bp, Homo sapiens
ggacaaaggagcctgt

SEQ ID NO: 3913729 - DNA, 18 bp, Homo sapiens
ggacaaaggagcctgtga

SEQ ID NO: 3913730 - DNA, 12 bp, Homo sapiens
ggacaacccaga

SEQ ID NO: 3913731 - DNA, 20 bp, Homo sapiens
ggacaacctgcccctcccca

SEQ ID NO: 3913732 - DNA, 16 bp, Homo sapiens
ggacaagaagctgcta

SEQ ID NO: 3913733 - DNA, 20 bp, Homo sapiens
ggacaagccaacttgtaaat

SEQ ID NO: 3913734 - DNA, 19 bp, Homo sapiens
ggacacactgtaaacccct

SEQ ID NO: 3913735 - DNA, 23 bp, Homo sapiens
ggacacactgtaaacccctgggt

SEQ ID NO: 3913736 - DNA, 16 bp, Homo sapiens
ggacacaggcctgtgt

SEQ ID NO: 3913737 - DNA, 14 bp, Homo sapiens
ggacacatcccggc

SEQ ID NO: 3913738 - DNA, 20 bp, Homo sapiens
ggacacatcccggcctcttc

SEQ ID NO: 3913739 - DNA, 22 bp, Homo sapiens
ggacacatcccggcctcttcca

SEQ ID NO: 3913740 - DNA, 13 bp, Homo sapiens
ggacacatgtcca

SEQ ID NO: 3913741 - DNA, 22 bp, Homo sapiens
ggacaccccccgccccccacct

SEQ ID NO: 3913742 - DNA, 21 bp, Homo sapiens
ggacaccccttatccaggact

SEQ ID NO: 3913743 - DNA, 16 bp, Homo sapiens
ggacacctgccccagc

SEQ ID NO: 3913744 - DNA, 19 bp, Homo sapiens
ggacacctgccccagcgcg

SEQ ID NO: 3913745 - DNA, 21 bp, Homo sapiens
ggacacctgccccagcgcggc

SEQ ID NO: 3913746 - DNA, 15 bp, Homo sapiens
ggacacctgccctgc

SEQ ID NO: 3913747 - DNA, 14 bp, Homo sapiens
ggacagagacacct

SEQ ID NO: 3913748 - DNA, 20 bp, Homo sapiens
ggacagagacacctgcacct

SEQ ID NO: 3913749 - DNA, 18 bp, Homo sapiens
ggacagccccagggccct

SEQ ID NO: 3913750 - DNA, 12 bp, Homo sapiens
ggacagctgtgc

SEQ ID NO: 3913751 - DNA, 15 bp, Homo sapiens
ggacagctgtgcctc

SEQ ID NO: 3913752 - DNA, 17 bp, Homo sapiens
ggacagctgtgcctcgc

SEQ ID NO: 3913753 - DNA, 11 bp, Homo sapiens
ggacaggcccg

SEQ ID NO: 3913754 - DNA, 15 bp, Homo sapiens
ggacagttggcagag

SEQ ID NO: 3913755 - DNA, 21 bp, Homo sapiens
ggacatggggcatagaaactg

SEQ ID NO: 3913756 - DNA, 23 bp, Homo sapiens
ggaccaactggcttctgtgcact

SEQ ID NO: 3913757 - DNA, 16 bp, Homo sapiens
ggaccaagatgggcac

SEQ ID NO: 3913758 - DNA, 13 bp, Homo sapiens
ggaccacacctcc

SEQ ID NO: 3913759 - DNA, 21 bp, Homo sapiens
ggaccacacctccctgaacca

SEQ ID NO: 3913760 - DNA, 21 bp, Homo sapiens
ggaccacactttgagaacctg

SEQ ID NO: 3913761 - DNA, 17 bp, Homo sapiens
ggaccacagtgggtggc

SEQ ID NO: 3913762 - DNA, 21 bp, Homo sapiens
ggaccaggactatagcccagg

SEQ ID NO: 3913763 - DNA, 16 bp, Homo sapiens
ggaccagtagacaact

SEQ ID NO: 3913764 - DNA, 18 bp, Homo sapiens
ggaccattgacctcagct

SEQ ID NO: 3913765 - DNA, 19 bp, Homo sapiens
ggaccattgacctcagctg

SEQ ID NO: 3913766 - DNA, 18 bp, Homo sapiens
ggacccaccaaactgcac

SEQ ID NO: 3913767 - DNA, 20 bp, Homo sapiens
ggacccagctactctgtcca

SEQ ID NO: 3913768 - DNA, 22 bp, Homo sapiens
ggacccaggccctccatgggct

SEQ ID NO: 3913769 - DNA, 20 bp, Homo sapiens
ggacccaggccgcctgccat

SEQ ID NO: 3913770 - DNA, 20 bp, Homo sapiens
ggaccccagctagggctgga

SEQ ID NO: 3913771 - DNA, 18 bp, Homo sapiens
ggaccccgcctcccagcc

SEQ ID NO: 3913772 - DNA, 21 bp, Homo sapiens
ggacccctcccttgctcagtg

SEQ ID NO: 3913773 - DNA, 21 bp, Homo sapiens
ggacccggaggggcctggcag

SEQ ID NO: 3913774 - DNA, 20 bp, Homo sapiens
ggaccctcgcagcaggtgca

SEQ ID NO: 3913775 - DNA, 12 bp, Homo sapiens
ggaccctgccca

SEQ ID NO: 3913776 - DNA, 17 bp, Homo sapiens
ggaccctgttttccaca

SEQ ID NO: 3913777 - DNA, 12 bp, Homo sapiens
ggaccctttcct

SEQ ID NO: 3913778 - DNA, 16 bp, Homo sapiens
ggaccctttccttcct

SEQ ID NO: 3913779 - DNA, 15 bp, Homo sapiens
ggaccgggtgggcct

SEQ ID NO: 3913780 - DNA, 17 bp, Homo sapiens
ggaccgggtgggcctgg

SEQ ID NO: 3913781 - DNA, 18 bp, Homo sapiens
ggaccgggtgggcctggc

SEQ ID NO: 3913782 - DNA, 19 bp, Homo sapiens
ggaccgggtgggcctggcc

SEQ ID NO: 3913783 - DNA, 20 bp, Homo sapiens
ggaccgggtgggcctggcct

SEQ ID NO: 3913784 - DNA, 21 bp, Homo sapiens
ggaccgggtgggcctggcctg

SEQ ID NO: 3913785 - DNA, 22 bp, Homo sapiens
ggaccgggtgggcctggcctga

SEQ ID NO: 3913786 - DNA, 20 bp, Homo sapiens
ggaccgtggccctgccctct

SEQ ID NO: 3913787 - DNA, 15 bp, Homo sapiens
ggacctccccctctt

SEQ ID NO: 3913788 - DNA, 23 bp, Homo sapiens
ggacctgaagggtgacatcccag

SEQ ID NO: 3913789 - DNA, 20 bp, Homo sapiens
ggacctgagcctgccgagca

SEQ ID NO: 3913790 - DNA, 23 bp, Homo sapiens
ggacctgagcctgccgagcaacc

SEQ ID NO: 3913791 - DNA, 14 bp, Homo sapiens
ggaggggcctggca

SEQ ID NO: 3913792 - DNA, 16 bp, Homo sapiens
ggagggggcgctcagg

SEQ ID NO: 3913793 - DNA, 18 bp, Homo sapiens
ggagggggcgctcaggac

SEQ ID NO: 3913794 - DNA, 21 bp, Homo sapiens
ggagggggcgctcaggaccca

SEQ ID NO: 3913795 - DNA, 21 bp, Homo sapiens
ggagggggtgtctggaagctg

SEQ ID NO: 3913796 - DNA, 12 bp, Homo sapiens
ggagggtggggc

SEQ ID NO: 3913797 - DNA, 13 bp, Homo sapiens
ggaggtcctcctc

SEQ ID NO: 3913798 - DNA, 16 bp, Homo sapiens
ggaggtgcctgagctg

SEQ ID NO: 3913799 - DNA, 22 bp, Homo sapiens
ggaggtgcctgagctggggcct

SEQ ID NO: 3913800 - DNA, 20 bp, Homo sapiens
ggaggtggaggttgcagtga

SEQ ID NO: 3913801 - DNA, 12 bp, Homo sapiens
ggaggtggtgga

SEQ ID NO: 3913802 - DNA, 21 bp, Homo sapiens
ggaggttgcagtgagctgaga

SEQ ID NO: 3913803 - DNA, 16 bp, Homo sapiens
ggaggttggtgactga

SEQ ID NO: 3913804 - DNA, 19 bp, Homo sapiens
ggagtagctgagaggaaga

SEQ ID NO: 3913805 - DNA, 16 bp, Homo sapiens
ggagtagctgagctca

SEQ ID NO: 3913806 - DNA, 23 bp, Homo sapiens
ggagtcagtaggtccaagggcca

SEQ ID NO: 3913807 - DNA, 13 bp, Homo sapiens
ggagtctgaggtc

SEQ ID NO: 3913808 - DNA, 18 bp, Homo sapiens
ggagtctgaggtcctgag

SEQ ID NO: 3913809 - DNA, 14 bp, Homo sapiens
ggagtctgagtctg

SEQ ID NO: 3913810 - DNA, 18 bp, Homo sapiens
ggagtctgagtctgagtc

SEQ ID NO: 3913811 - DNA, 12 bp, Homo sapiens
ggagtgcagtgg

SEQ ID NO: 3913812 - DNA, 20 bp, Homo sapiens
ggagttcagtggtgtgatct

SEQ ID NO: 3913813 - DNA, 15 bp, Homo sapiens
ggagttccatgaaga

SEQ ID NO: 3913814 - DNA, 19 bp, Homo sapiens
ggagttgagtcacaagagg

SEQ ID NO: 3913815 - DNA, 15 bp, Homo sapiens
ggagttgctcactca

SEQ ID NO: 3913816 - DNA, 20 bp, Homo sapiens
ggagtttgagacaagccctg

SEQ ID NO: 3913817 - DNA, 21 bp, Homo sapiens
ggataacaaaatcacaagcaa

SEQ ID NO: 3913818 - DNA, 22 bp, Homo sapiens
ggataacaaaatcacaagcaat

SEQ ID NO: 3913819 - DNA, 14 bp, Homo sapiens
ggatcacagggccc

SEQ ID NO: 3913820 - DNA, 20 bp, Homo sapiens
ggatccagagacttggggac

SEQ ID NO: 3913821 - DNA, 18 bp, Homo sapiens
ggatccctccatccggct

SEQ ID NO: 3913822 - DNA, 14 bp, Homo sapiens
ggatcctattctca

SEQ ID NO: 3913823 - DNA, 21 bp, Homo sapiens
ggatcctattctcaccaggaa

SEQ ID NO: 3913824 - DNA, 23 bp, Homo sapiens
ggatcctcacaggagcagacaga

SEQ ID NO: 3913825 - DNA, 12 bp, Homo sapiens
ggatcctgcagg

SEQ ID NO: 3913826 - DNA, 20 bp, Homo sapiens
ggatcctgctgtggcctcac

SEQ ID NO: 3913827 - DNA, 23 bp, Homo sapiens
ggatctagcttcatgcctcagtt

SEQ ID NO: 3913828 - DNA, 19 bp, Homo sapiens
ggatctatgcaatttttaa

SEQ ID NO: 3913829 - DNA, 21 bp, Homo sapiens
ggatctccaaggaccaggtta

SEQ ID NO: 3913830 - DNA, 21 bp, Homo sapiens
ggatctctcaggagcacaggc

SEQ ID NO: 3913831 - DNA, 17 bp, Homo sapiens
ggatcttgcattcccag

SEQ ID NO: 3913832 - DNA, 22 bp, Homo sapiens
ggatcttgcattcccagtggtc

SEQ ID NO: 3913833 - DNA, 19 bp, Homo sapiens
ggatgactagaggcaggga

SEQ ID NO: 3913834 - DNA, 17 bp, Homo sapiens
ggatgattggattattc

SEQ ID NO: 3913835 - DNA, 12 bp, Homo sapiens
ggatgcagaggg

SEQ ID NO: 3913836 - DNA, 13 bp, Homo sapiens
ggatgcagagggg

SEQ ID NO: 3913837 - DNA, 20 bp, Homo sapiens
ggatgccaacaccttcttgg

SEQ ID NO: 3913838 - DNA, 20 bp, Homo sapiens
ggatgccacagccccacagc

SEQ ID NO: 3913839 - DNA, 23 bp, Homo sapiens
ggatgcgtgccctgacccctgca

SEQ ID NO: 3913840 - DNA, 15 bp, Homo sapiens
ggatgctccagggca

SEQ ID NO: 3913841 - DNA, 18 bp, Homo sapiens
ggatgctccagggcagcc

SEQ ID NO: 3913842 - DNA, 20 bp, Homo sapiens
ggatggacagaatgatggac

SEQ ID NO: 3913843 - DNA, 21 bp, Homo sapiens
ggatggaccctcgcagcaggt

SEQ ID NO: 3913844 - DNA, 16 bp, Homo sapiens
ggatggagagagggga

SEQ ID NO: 3913845 - DNA, 13 bp, Homo sapiens
ggatggatggaca

SEQ ID NO: 3913846 - DNA, 15 bp, Homo sapiens
ggatggatggacaga

SEQ ID NO: 3913847 - DNA, 17 bp, Homo sapiens
ggatggatggacagaat

SEQ ID NO: 3913848 - DNA, 20 bp, Homo sapiens
ggatgggaagatggtagcag

SEQ ID NO: 3913849 - DNA, 19 bp, Homo sapiens
ggatgggatcccaggccag

SEQ ID NO: 3913850 - DNA, 21 bp, Homo sapiens
ggatgggatcccaggccaggg

SEQ ID NO: 3913851 - DNA, 19 bp, Homo sapiens
ggatgggggatgggccagg

SEQ ID NO: 3913852 - DNA, 17 bp, Homo sapiens
ggatggtttgagctcag

SEQ ID NO: 3913853 - DNA, 17 bp, Homo sapiens
ggatgtaaacagtgcct

SEQ ID NO: 3913854 - DNA, 18 bp, Homo sapiens
ggatgtaaacagtgcctg

SEQ ID NO: 3913855 - DNA, 19 bp, Homo sapiens
ggatgtaaacagtgcctgc

SEQ ID NO: 3913856 - DNA, 17 bp, Homo sapiens
ggatgtcccctgtccca

SEQ ID NO: 3913857 - DNA, 20 bp, Homo sapiens
ggatgtcccctgtcccacca

SEQ ID NO: 3913858 - DNA, 23 bp, Homo sapiens
ggatgtcctctttactcccttcc

SEQ ID NO: 3913859 - DNA, 18 bp, Homo sapiens
ggatgtggagctcctgct

SEQ ID NO: 3913860 - DNA, 22 bp, Homo sapiens
ggatgtggggtccccatcatcc

SEQ ID NO: 3913861 - DNA, 17 bp, Homo sapiens
ggatgtgtggggcatgg

SEQ ID NO: 3913862 - DNA, 21 bp, Homo sapiens
ggattattcatttaaaatgat

SEQ ID NO: 3913863 - DNA, 19 bp, Homo sapiens
ggattcaggaaaaggcctg

SEQ ID NO: 3913864 - DNA, 14 bp, Homo sapiens
ggattgaggaggac

SEQ ID NO: 3913865 - DNA, 20 bp, Homo sapiens
ggattgatcggagcctcctc

SEQ ID NO: 3913866 - DNA, 15 bp, Homo sapiens
ggattgttcctgtca

SEQ ID NO: 3913867 - DNA, 21 bp, Homo sapiens
ggatttaacagtcatttaaaa

SEQ ID NO: 3913868 - DNA, 22 bp, Homo sapiens
ggattttaacaaaagcaagact

SEQ ID NO: 3913869 - DNA, 19 bp, Homo sapiens
ggcaaaacacgcaagggca

SEQ ID NO: 3913870 - DNA, 18 bp, Homo sapiens
ggcaaagaactgccccat

SEQ ID NO: 3913871 - DNA, 20 bp, Homo sapiens
ggcaaaggtggctctccagt

SEQ ID NO: 3913872 - DNA, 18 bp, Homo sapiens
ggcaaatgacatgcactg

SEQ ID NO: 3913873 - DNA, 19 bp, Homo sapiens
ggcaaatgacatgcactga

SEQ ID NO: 3913874 - DNA, 23 bp, Homo sapiens
ggcaaattattttaatattttgt

SEQ ID NO: 3913875 - DNA, 20 bp, Homo sapiens
ggcaacacctccttgctttg

SEQ ID NO: 3913876 - DNA, 16 bp, Homo sapiens
ggagcagacagagaaa

SEQ ID NO: 3913877 - DNA, 20 bp, Homo sapiens
ggagcagacaggaggaatca

SEQ ID NO: 3913878 - DNA, 17 bp, Homo sapiens
ggagcagagctctgccg

SEQ ID NO: 3913879 - DNA, 19 bp, Homo sapiens
ggagcagagctgatggaga

SEQ ID NO: 3913880 - DNA, 20 bp, Homo sapiens
ggagcagagtataggatgga

SEQ ID NO: 3913881 - DNA, 18 bp, Homo sapiens
ggagcaggaacagagact

SEQ ID NO: 3913882 - DNA, 21 bp, Homo sapiens
ggagcaggaacagagactctg

SEQ ID NO: 3913883 - DNA, 13 bp, Homo sapiens
ggagcatcccagg

SEQ ID NO: 3913884 - DNA, 14 bp, Homo sapiens
ggagcatctgactc

SEQ ID NO: 3913885 - DNA, 15 bp, Homo sapiens
ggagcattgggacct

SEQ ID NO: 3913886 - DNA, 15 bp, Homo sapiens
ggagcatttggagag

SEQ ID NO: 3913887 - DNA, 19 bp, Homo sapiens
ggagcatttggagagaagg

SEQ ID NO: 3913888 - DNA, 15 bp, Homo sapiens
ggagccaacagcagc

SEQ ID NO: 3913889 - DNA, 11 bp, Homo sapiens
ggagccactcc

SEQ ID NO: 3913890 - DNA, 18 bp, Homo sapiens
ggagccactcctgtcccg

SEQ ID NO: 3913891 - DNA, 20 bp, Homo sapiens
ggagccactcctgtcccgcc

SEQ ID NO: 3913892 - DNA, 14 bp, Homo sapiens
ggagccccaggcct

SEQ ID NO: 3913893 - DNA, 22 bp, Homo sapiens
ggagccccaggcctctgtgtcc

SEQ ID NO: 3913894 - DNA, 21 bp, Homo sapiens
ggagcccctaggaaagcagtg

SEQ ID NO: 3913895 - DNA, 18 bp, Homo sapiens
ggagccggaccaagatgg

SEQ ID NO: 3913896 - DNA, 19 bp, Homo sapiens
ggagcctggcacaggactg

SEQ ID NO: 3913897 - DNA, 20 bp, Homo sapiens
ggagcctggcacaggactga

SEQ ID NO: 3913898 - DNA, 18 bp, Homo sapiens
ggagcctgtgaacccagg

SEQ ID NO: 3913899 - DNA, 21 bp, Homo sapiens
ggagcctgtgaacccaggaca

SEQ ID NO: 3913900 - DNA, 22 bp, Homo sapiens
ggagcctgtgaacccaggacaa

SEQ ID NO: 3913901 - DNA, 14 bp, Homo sapiens
ggagctacctgtgt

SEQ ID NO: 3913902 - DNA, 19 bp, Homo sapiens
ggagctacctgtgtggaca

SEQ ID NO: 3913903 - DNA, 23 bp, Homo sapiens
ggagctacctgtgtggacaggac

SEQ ID NO: 3913904 - DNA, 16 bp, Homo sapiens
ggagctgagtcacctc

SEQ ID NO: 3913905 - DNA, 18 bp, Homo sapiens
ggagctgagtcacctcct

SEQ ID NO: 3913906 - DNA, 20 bp, Homo sapiens
ggagctgatttccaggcccc

SEQ ID NO: 3913907 - DNA, 14 bp, Homo sapiens
ggagctggaaataa

SEQ ID NO: 3913908 - DNA, 23 bp, Homo sapiens
ggagctggaaataaacctggaga

SEQ ID NO: 3913909 - DNA, 12 bp, Homo sapiens
ggagctggcttt

SEQ ID NO: 3913910 - DNA, 13 bp, Homo sapiens
ggagcttgcagtg

SEQ ID NO: 3913911 - DNA, 20 bp, Homo sapiens
ggagctttcaaagaaggaat

SEQ ID NO: 3913912 - DNA, 16 bp, Homo sapiens
ggaggaagggccagga

SEQ ID NO: 3913913 - DNA, 18 bp, Homo sapiens
ggaggaagggccaggaga

SEQ ID NO: 3913914 - DNA, 20 bp, Homo sapiens
ggaggaagggccaggagaga

SEQ ID NO: 3913915 - DNA, 23 bp, Homo sapiens
ggaggaataagctcccagggcct

SEQ ID NO: 3913916 - DNA, 17 bp, Homo sapiens
ggaggacctgagcctgc

SEQ ID NO: 3913917 - DNA, 19 bp, Homo sapiens
ggaggacctgagcctgccg

SEQ ID NO: 3913918 - DNA, 21 bp, Homo sapiens
ggaggactagaacctggaggg

SEQ ID NO: 3913919 - DNA, 15 bp, Homo sapiens
ggaggaggaaggcaa

SEQ ID NO: 3913920 - DNA, 11 bp, Homo sapiens
ggaggaggagg

SEQ ID NO: 3913921 - DNA, 13 bp, Homo sapiens
ggaggaggaggaa

SEQ ID NO: 3913922 - DNA, 12 bp, Homo sapiens
ggaggaggcctg

SEQ ID NO: 3913923 - DNA, 14 bp, Homo sapiens
ggaggatccctcca

SEQ ID NO: 3913924 - DNA, 15 bp, Homo sapiens
ggaggatccctccat

SEQ ID NO: 3913925 - DNA, 14 bp, Homo sapiens
ggaggatgccacag

SEQ ID NO: 3913926 - DNA, 19 bp, Homo sapiens
ggaggatgccacagcccca

SEQ ID NO: 3913927 - DNA, 20 bp, Homo sapiens
ggaggcaccagctctgtggc

SEQ ID NO: 3913928 - DNA, 21 bp, Homo sapiens
ggaggcaccagctctgtggcc

SEQ ID NO: 3913929 - DNA, 18 bp, Homo sapiens
ggaggcagctccaacagc

SEQ ID NO: 3913930 - DNA, 19 bp, Homo sapiens
ggaggcagggccttgccca

SEQ ID NO: 3913931 - DNA, 14 bp, Homo sapiens
ggaggcatctgcac

SEQ ID NO: 3913932 - DNA, 16 bp, Homo sapiens
ggaggcatggccctgg

SEQ ID NO: 3913933 - DNA, 15 bp, Homo sapiens
ggaggccaaggcagg

SEQ ID NO: 3913934 - DNA, 19 bp, Homo sapiens
ggaggcctgatgctgcccc

SEQ ID NO: 3913935 - DNA, 14 bp, Homo sapiens
ggaggcctggcctt

SEQ ID NO: 3913936 - DNA, 15 bp, Homo sapiens
ggaggcggctccagg

SEQ ID NO: 3913937 - DNA, 20 bp, Homo sapiens
ggaggctgcagagctgaccc

SEQ ID NO: 3913938 - DNA, 21 bp, Homo sapiens
ggaggctgcagagctgaccca

SEQ ID NO: 3913939 - DNA, 16 bp, Homo sapiens
ggaggctgcatgctct

SEQ ID NO: 3913940 - DNA, 12 bp, Homo sapiens
ggaggctgctcg

SEQ ID NO: 3913941 - DNA, 12 bp, Homo sapiens
ggaggctgggcc

SEQ ID NO: 3913942 - DNA, 17 bp, Homo sapiens
ggaggctgggcccctgg

SEQ ID NO: 3913943 - DNA, 23 bp, Homo sapiens
ggaggctgggcccctgggatggg

SEQ ID NO: 3913944 - DNA, 21 bp, Homo sapiens
ggagggaatgaacctggaggg

SEQ ID NO: 3913945 - DNA, 17 bp, Homo sapiens
ggagggacaaaggagcc

SEQ ID NO: 3913946 - DNA, 18 bp, Homo sapiens
ggagggacaaaggagcct

SEQ ID NO: 3913947 - DNA, 22 bp, Homo sapiens
ggagggacaaaggagcctgtga

SEQ ID NO: 3913948 - DNA, 16 bp, Homo sapiens
ggagggagcagacagg

SEQ ID NO: 3913949 - DNA, 21 bp, Homo sapiens
ggagggcaagggccatgctga

SEQ ID NO: 3913950 - DNA, 13 bp, Homo sapiens
ggagggcagagcc

SEQ ID NO: 3913951 - DNA, 17 bp, Homo sapiens
ggagggcagagccatgg

SEQ ID NO: 3913952 - DNA, 22 bp, Homo sapiens
ggagggcagagccatgggcctg

SEQ ID NO: 3913953 - DNA, 17 bp, Homo sapiens
ggagggcgtgactcacc

SEQ ID NO: 3913954 - DNA, 16 bp, Homo sapiens
ggagggctagaaccta

SEQ ID NO: 3913955 - DNA, 21 bp, Homo sapiens
ggagggctagaacctggaagg

SEQ ID NO: 3913956 - DNA, 20 bp, Homo sapiens
ggagggctagaacctggaga

SEQ ID NO: 3913957 - DNA, 22 bp, Homo sapiens
ggagggctagaacctggagagc

SEQ ID NO: 3913958 - DNA, 14 bp, Homo sapiens
ggagggctggaatc

SEQ ID NO: 3913959 - DNA, 16 bp, Homo sapiens
ggagggctggaatctg

SEQ ID NO: 3913960 - DNA, 17 bp, Homo sapiens
ggacctttcagctgtga

SEQ ID NO: 3913961 - DNA, 13 bp, Homo sapiens
ggacgcgggctgt

SEQ ID NO: 3913962 - DNA, 19 bp, Homo sapiens
ggacgcgggctgtgcctta

SEQ ID NO: 3913963 - DNA, 12 bp, Homo sapiens
ggacgcttccag

SEQ ID NO: 3913964 - DNA, 15 bp, Homo sapiens
ggacgcttccagacc

SEQ ID NO: 3913965 - DNA, 18 bp, Homo sapiens
ggacgcttccagaccacc

SEQ ID NO: 3913966 - DNA, 19 bp, Homo sapiens
ggacgcttccagaccacct

SEQ ID NO: 3913967 - DNA, 14 bp, Homo sapiens
ggacgtcctgctgg

SEQ ID NO: 3913968 - DNA, 18 bp, Homo sapiens
ggactaacactcagaagc

SEQ ID NO: 3913969 - DNA, 18 bp, Homo sapiens
ggactagaaaaacttggg

SEQ ID NO: 3913970 - DNA, 17 bp, Homo sapiens
ggactagaacctggagg

SEQ ID NO: 3913971 - DNA, 13 bp, Homo sapiens
ggactcccagtga

SEQ ID NO: 3913972 - DNA, 14 bp, Homo sapiens
ggactccccaggcc

SEQ ID NO: 3913973 - DNA, 16 bp, Homo sapiens
ggactccccaggccag

SEQ ID NO: 3913974 - DNA, 18 bp, Homo sapiens
ggactccccaggccaggc

SEQ ID NO: 3913975 - DNA, 19 bp, Homo sapiens
ggactccccaggccaggcc

SEQ ID NO: 3913976 - DNA, 15 bp, Homo sapiens
ggactcctcccacaa

SEQ ID NO: 3913977 - DNA, 12 bp, Homo sapiens
ggactcctctgt

SEQ ID NO: 3913978 - DNA, 18 bp, Homo sapiens
ggactctaagctggagct

SEQ ID NO: 3913979 - DNA, 18 bp, Homo sapiens
ggactctgccccttctgt

SEQ ID NO: 3913980 - DNA, 11 bp, Homo sapiens
ggactctgcct

SEQ ID NO: 3913981 - DNA, 17 bp, Homo sapiens
ggactgagcctggccca

SEQ ID NO: 3913982 - DNA, 15 bp, Homo sapiens
ggactggaaccaggg

SEQ ID NO: 3913983 - DNA, 18 bp, Homo sapiens
ggactggaaccagggaga

SEQ ID NO: 3913984 - DNA, 22 bp, Homo sapiens
ggactggcgagtccagagagga

SEQ ID NO: 3913985 - DNA, 11 bp, Homo sapiens
ggactgggagg

SEQ ID NO: 3913986 - DNA, 17 bp, Homo sapiens
ggactggggatgtggga

SEQ ID NO: 3913987 - DNA, 17 bp, Homo sapiens
ggacttaacggctccag

SEQ ID NO: 3913988 - DNA, 19 bp, Homo sapiens
ggacttaacggctccagga

SEQ ID NO: 3913989 - DNA, 14 bp, Homo sapiens
ggacttttgggggt

SEQ ID NO: 3913990 - DNA, 13 bp, Homo sapiens
ggagaaaacactt

SEQ ID NO: 3913991 - DNA, 16 bp, Homo sapiens
ggagaaataaattttg

SEQ ID NO: 3913992 - DNA, 13 bp, Homo sapiens
ggagaaataattg

SEQ ID NO: 3913993 - DNA, 18 bp, Homo sapiens
ggagaactagaacctgga

SEQ ID NO: 3913994 - DNA, 15 bp, Homo sapiens
ggagaagcagtgagc

SEQ ID NO: 3913995 - DNA, 16 bp, Homo sapiens
ggagaagctgatgctt

SEQ ID NO: 3913996 - DNA, 17 bp, Homo sapiens
ggagaaggaaggagact

SEQ ID NO: 3913997 - DNA, 14 bp, Homo sapiens
ggagaaggatctag

SEQ ID NO: 3913998 - DNA, 13 bp, Homo sapiens
ggagaagggccag

SEQ ID NO: 3913999 - DNA, 14 bp, Homo sapiens
ggagaagggccagc

SEQ ID NO: 3914000 - DNA, 18 bp, Homo sapiens
ggagaagggccagcccta

SEQ ID NO: 3914001 - DNA, 13 bp, Homo sapiens
ggagacagggcaa

SEQ ID NO: 3914002 - DNA, 16 bp, Homo sapiens
ggagaccctgagtccg

SEQ ID NO: 3914003 - DNA, 13 bp, Homo sapiens
ggagactcacctc

SEQ ID NO: 3914004 - DNA, 20 bp, Homo sapiens
ggagactggtcctgtgtgca

SEQ ID NO: 3914005 - DNA, 14 bp, Homo sapiens
ggagagaagaaagt

SEQ ID NO: 3914006 - DNA, 15 bp, Homo sapiens
ggagagactgaaagc

SEQ ID NO: 3914007 - DNA, 12 bp, Homo sapiens
ggagagagggga

SEQ ID NO: 3914008 - DNA, 21 bp, Homo sapiens
ggagagaggggaataatagaa

SEQ ID NO: 3914009 - DNA, 20 bp, Homo sapiens
ggagagatcatagctcactg

SEQ ID NO: 3914010 - DNA, 11 bp, Homo sapiens
ggagagcagct

SEQ ID NO: 3914011 - DNA, 15 bp, Homo sapiens
ggagagccagccctc

SEQ ID NO: 3914012 - DNA, 21 bp, Homo sapiens
ggagagccagccctccctgtc

SEQ ID NO: 3914013 - DNA, 17 bp, Homo sapiens
ggagagccagctctctc

SEQ ID NO: 3914014 - DNA, 12 bp, Homo sapiens
ggagagccctgg

SEQ ID NO: 3914015 - DNA, 15 bp, Homo sapiens
ggagagcggctgccc

SEQ ID NO: 3914016 - DNA, 16 bp, Homo sapiens
ggagagctagaacctg

SEQ ID NO: 3914017 - DNA, 18 bp, Homo sapiens
ggagagctagaacctgga

SEQ ID NO: 3914018 - DNA, 20 bp, Homo sapiens
ggagagctagaacctggaga

SEQ ID NO: 3914019 - DNA, 22 bp, Homo sapiens
ggagagctagaacctggagagc

SEQ ID NO: 3914020 - DNA, 22 bp, Homo sapiens
ggagagctagaacctggagggc

SEQ ID NO: 3914021 - DNA, 14 bp, Homo sapiens
ggagagctaggagc

SEQ ID NO: 3914022 - DNA, 13 bp, Homo sapiens
ggagaggactctg

SEQ ID NO: 3914023 - DNA, 17 bp, Homo sapiens
ggagaggcggcctcgtg

SEQ ID NO: 3914024 - DNA, 18 bp, Homo sapiens
ggagaggggaagggccag

SEQ ID NO: 3914025 - DNA, 21 bp, Homo sapiens
ggagaggggtgcacccactca

SEQ ID NO: 3914026 - DNA, 18 bp, Homo sapiens
ggagagtggttgttgcca

SEQ ID NO: 3914027 - DNA, 22 bp, Homo sapiens
ggagagttcaagcctgtgggag

SEQ ID NO: 3914028 - DNA, 22 bp, Homo sapiens
ggagatatttatggggggagaa

SEQ ID NO: 3914029 - DNA, 18 bp, Homo sapiens
ggagatcgagaccatcct

SEQ ID NO: 3914030 - DNA, 12 bp, Homo sapiens
ggagatgatgat

SEQ ID NO: 3914031 - DNA, 15 bp, Homo sapiens
ggagatgatgatgat

SEQ ID NO: 3914032 - DNA, 18 bp, Homo sapiens
ggagatggacccctccct

SEQ ID NO: 3914033 - DNA, 21 bp, Homo sapiens
ggagatttcagttacttacct

SEQ ID NO: 3914034 - DNA, 16 bp, Homo sapiens
ggagattttccttcct

SEQ ID NO: 3914035 - DNA, 23 bp, Homo sapiens
ggagcaaagcctgttcatggcag

SEQ ID NO: 3914036 - DNA, 24 bp, Homo sapiens
ggagcaaagcctgttcatggcaga

SEQ ID NO: 3914037 - DNA, 15 bp, Homo sapiens
ggagcaaatgtttct

SEQ ID NO: 3914038 - DNA, 16 bp, Homo sapiens
ggagcacagccctggg

SEQ ID NO: 3914039 - DNA, 17 bp, Homo sapiens
ggagcacagccctggga

SEQ ID NO: 3914040 - DNA, 18 bp, Homo sapiens
ggagcacagccctgggag

SEQ ID NO: 3914041 - DNA, 14 bp, Homo sapiens
ggagcacaggcagc

SEQ ID NO: 3914042 - DNA, 13 bp, Homo sapiens
ggagcactggagt

SEQ ID NO: 3914043 - DNA, 19 bp, Homo sapiens
gctgtgctctcaccagctg

SEQ ID NO: 3914044 - DNA, 12 bp, Homo sapiens
gctgtggaggcc

SEQ ID NO: 3914045 - DNA, 13 bp, Homo sapiens
gctgtggaggcct

SEQ ID NO: 3914046 - DNA, 15 bp, Homo sapiens
gctgtggaggcctga

SEQ ID NO: 3914047 - DNA, 16 bp, Homo sapiens
gctgtggaggcctgat

SEQ ID NO: 3914048 - DNA, 22 bp, Homo sapiens
gctgtggaggcctgatgctgcc

SEQ ID NO: 3914049 - DNA, 20 bp, Homo sapiens
gctgtggcctcacttccctg

SEQ ID NO: 3914050 - DNA, 23 bp, Homo sapiens
gctgtggcctcacttccctggga

SEQ ID NO: 3914051 - DNA, 16 bp, Homo sapiens
gctgtgggcagcaccc

SEQ ID NO: 3914052 - DNA, 18 bp, Homo sapiens
gctgtggggcatagaact

SEQ ID NO: 3914053 - DNA, 14 bp, Homo sapiens
gctgtgtccttgca

SEQ ID NO: 3914054 - DNA, 16 bp, Homo sapiens
gctgttcacagccaga

SEQ ID NO: 3914055 - DNA, 22 bp, Homo sapiens
gctgttcacccacagggctaag

SEQ ID NO: 3914056 - DNA, 17 bp, Homo sapiens
gctgttccacttctcta

SEQ ID NO: 3914057 - DNA, 15 bp, Homo sapiens
gctgttctgcactga

SEQ ID NO: 3914058 - DNA, 14 bp, Homo sapiens
gctgttgccatagc

SEQ ID NO: 3914059 - DNA, 15 bp, Homo sapiens
gctgttgccatagcc

SEQ ID NO: 3914060 - DNA, 16 bp, Homo sapiens
gctgttgccatagccc

SEQ ID NO: 3914061 - DNA, 17 bp, Homo sapiens
gctgttggacagctgct

SEQ ID NO: 3914062 - DNA, 20 bp, Homo sapiens
gctgttggcctcgcctgggc

SEQ ID NO: 3914063 - DNA, 16 bp, Homo sapiens
gctgttgttgcaggga

SEQ ID NO: 3914064 - DNA, 18 bp, Homo sapiens
gctgtttatttattcact

SEQ ID NO: 3914065 - DNA, 20 bp, Homo sapiens
gctgtttgtttgacaaagaa

SEQ ID NO: 3914066 - DNA, 16 bp, Homo sapiens
gcttaaaatatgtatg

SEQ ID NO: 3914067 - DNA, 17 bp, Homo sapiens
gcttaaattgcttttgt

SEQ ID NO: 3914068 - DNA, 20 bp, Homo sapiens
gcttaacattgacttcttgg

SEQ ID NO: 3914069 - DNA, 14 bp, Homo sapiens
gcttaatgtttatt

SEQ ID NO: 3914070 - DNA, 12 bp, Homo sapiens
gcttacctgaca

SEQ ID NO: 3914071 - DNA, 16 bp, Homo sapiens
gcttacctgacacaag

SEQ ID NO: 3914072 - DNA, 18 bp, Homo sapiens
gcttagaaagttattgtg

SEQ ID NO: 3914073 - DNA, 23 bp, Homo sapiens
gcttagacttcgactcaggatcc

SEQ ID NO: 3914074 - DNA, 18 bp, Homo sapiens
gcttagagaatgttctcc

SEQ ID NO: 3914075 - DNA, 13 bp, Homo sapiens
gcttagccttgtg

SEQ ID NO: 3914076 - DNA, 12 bp, Homo sapiens
gcttaggatgtt

SEQ ID NO: 3914077 - DNA, 13 bp, Homo sapiens
gcttataaatgtg

SEQ ID NO: 3914078 - DNA, 18 bp, Homo sapiens
gcttatgacatcacttgt

SEQ ID NO: 3914079 - DNA, 23 bp, Homo sapiens
gcttatgacatcacttgtacaaa

SEQ ID NO: 3914080 - DNA, 16 bp, Homo sapiens
gcttcaaaatagagaa

SEQ ID NO: 3914081 - DNA, 22 bp, Homo sapiens
gcttcaacattctttgcaagat

SEQ ID NO: 3914082 - DNA, 23 bp, Homo sapiens
gcttcaagtgatatatgtattta

SEQ ID NO: 3914083 - DNA, 17 bp, Homo sapiens
gcttcacccctgcactt

SEQ ID NO: 3914084 - DNA, 20 bp, Homo sapiens
gcttcacccctgcacttcag

SEQ ID NO: 3914085 - DNA, 22 bp, Homo sapiens
gcttcaccctgaatggttccat

SEQ ID NO: 3914086 - DNA, 14 bp, Homo sapiens
gcttcaccttggag

SEQ ID NO: 3914087 - DNA, 19 bp, Homo sapiens
gcttcaccttggagcctga

SEQ ID NO: 3914088 - DNA, 17 bp, Homo sapiens
gcttcagaattaaaact

SEQ ID NO: 3914089 - DNA, 17 bp, Homo sapiens
gcttcagagcctagcca

SEQ ID NO: 3914090 - DNA, 19 bp, Homo sapiens
gcttcagagcctagccacc

SEQ ID NO: 3914091 - DNA, 14 bp, Homo sapiens
gcttcagtggagaa

SEQ ID NO: 3914092 - DNA, 15 bp, Homo sapiens
gcttcagttgttttc

SEQ ID NO: 3914093 - DNA, 21 bp, Homo sapiens
gcttcatcaatttttatacat

SEQ ID NO: 3914094 - DNA, 22 bp, Homo sapiens
gcttcatcaatttttatacata

SEQ ID NO: 3914095 - DNA, 14 bp, Homo sapiens
gcttcatgcctcag

SEQ ID NO: 3914096 - DNA, 22 bp, Homo sapiens
gcttcatgcctcagtttcccca

SEQ ID NO: 3914097 - DNA, 23 bp, Homo sapiens
gcttcatgcctcagtttccccat

SEQ ID NO: 3914098 - DNA, 11 bp, Homo sapiens
gcttccagacc

SEQ ID NO: 3914099 - DNA, 14 bp, Homo sapiens
gcttccagaccacc

SEQ ID NO: 3914100 - DNA, 17 bp, Homo sapiens
gcttccagaccacctgc

SEQ ID NO: 3914101 - DNA, 22 bp, Homo sapiens
gcttccagaccacctgccagcc

SEQ ID NO: 3914102 - DNA, 20 bp, Homo sapiens
gcttccagagagtcctctgg

SEQ ID NO: 3914103 - DNA, 13 bp, Homo sapiens
gcttcccagaggc

SEQ ID NO: 3914104 - DNA, 17 bp, Homo sapiens
gcttcccagaggccagg

SEQ ID NO: 3914105 - DNA, 20 bp, Homo sapiens
gcttcccaggatccctccca

SEQ ID NO: 3914106 - DNA, 20 bp, Homo sapiens
gcttcctccgtccacccagg

SEQ ID NO: 3914107 - DNA, 22 bp, Homo sapiens
gcttcctccgtccacccaggct

SEQ ID NO: 3914108 - DNA, 11 bp, Homo sapiens
gcttcctcctg

SEQ ID NO: 3914109 - DNA, 12 bp, Homo sapiens
gcttcctggtgt

SEQ ID NO: 3914110 - DNA, 17 bp, Homo sapiens
gcttcctgtccactctc

SEQ ID NO: 3914111 - DNA, 19 bp, Homo sapiens
gcttcctgtccactctcgg

SEQ ID NO: 3914112 - DNA, 18 bp, Homo sapiens
gcttctagatctggaacc

SEQ ID NO: 3914113 - DNA, 12 bp, Homo sapiens
gcttctcatccc

SEQ ID NO: 3914114 - DNA, 17 bp, Homo sapiens
gggccactccttcctgc

SEQ ID NO: 3914115 - DNA, 19 bp, Homo sapiens
gggccactctcccctccct

SEQ ID NO: 3914116 - DNA, 11 bp, Homo sapiens
gggccactgcc

SEQ ID NO: 3914117 - DNA, 17 bp, Homo sapiens
gggccactgccagcagc

SEQ ID NO: 3914118 - DNA, 20 bp, Homo sapiens
gggccagaaggagggcagag

SEQ ID NO: 3914119 - DNA, 21 bp, Homo sapiens
gggccagaaggagggcagagc

SEQ ID NO: 3914120 - DNA, 12 bp, Homo sapiens
gggccagacaca

SEQ ID NO: 3914121 - DNA, 16 bp, Homo sapiens
gggccagacacagata

SEQ ID NO: 3914122 - DNA, 23 bp, Homo sapiens
gggccagagttccacaaatctat

SEQ ID NO: 3914123 - DNA, 22 bp, Homo sapiens
gggccagccctacatcttcagc

SEQ ID NO: 3914124 - DNA, 22 bp, Homo sapiens
gggccagcctcagctcagcctc

SEQ ID NO: 3914125 - DNA, 11 bp, Homo sapiens
gggccagctgg

SEQ ID NO: 3914126 - DNA, 20 bp, Homo sapiens
gggccagctggtgctgcaag

SEQ ID NO: 3914127 - DNA, 17 bp, Homo sapiens
gggccaggacaggcccg

SEQ ID NO: 3914128 - DNA, 13 bp, Homo sapiens
gggccaggcaggt

SEQ ID NO: 3914129 - DNA, 23 bp, Homo sapiens
gggccaggggtctccctggagtg

SEQ ID NO: 3914130 - DNA, 15 bp, Homo sapiens
gggccagtctgggct

SEQ ID NO: 3914131 - DNA, 17 bp, Homo sapiens
gggccagtgagggctgg

SEQ ID NO: 3914132 - DNA, 12 bp, Homo sapiens
gggcccagctgt

SEQ ID NO: 3914133 - DNA, 16 bp, Homo sapiens
gggcccagctgtagcc

SEQ ID NO: 3914134 - DNA, 13 bp, Homo sapiens
gggacgaagaaag

SEQ ID NO: 3914135 - DNA, 19 bp, Homo sapiens
gggacgcttccagaccacc

SEQ ID NO: 3914136 - DNA, 22 bp, Homo sapiens
gggacgcttccagaccacctgc

SEQ ID NO: 3914137 - DNA, 19 bp, Homo sapiens
gggagaagggccagcccta

SEQ ID NO: 3914138 - DNA, 18 bp, Homo sapiens
gggagagagacgtgtaca

SEQ ID NO: 3914139 - DNA, 17 bp, Homo sapiens
gggagagtgcaggcctg

SEQ ID NO: 3914140 - DNA, 15 bp, Homo sapiens
gggagcaactctcca

SEQ ID NO: 3914141 - DNA, 11 bp, Homo sapiens
gggagcactgg

SEQ ID NO: 3914142 - DNA, 16 bp, Homo sapiens
gggagcactggagtgc

SEQ ID NO: 3914143 - DNA, 16 bp, Homo sapiens
gggagcagacaggagg

SEQ ID NO: 3914144 - DNA, 16 bp, Homo sapiens
gggagcagagtatagg

SEQ ID NO: 3914145 - DNA, 14 bp, Homo sapiens
gggagccaacagca

SEQ ID NO: 3914146 - DNA, 15 bp, Homo sapiens
gggagccaacagcag

SEQ ID NO: 3914147 - DNA, 14 bp, Homo sapiens
gggagcccctagga

SEQ ID NO: 3914148 - DNA, 16 bp, Homo sapiens
gggaggaagggccagg

SEQ ID NO: 3914149 - DNA, 19 bp, Homo sapiens
gggaggaagggccaggaga

SEQ ID NO: 3914150 - DNA, 14 bp, Homo sapiens
gggaggagaatgag

SEQ ID NO: 3914151 - DNA, 20 bp, Homo sapiens
gggaggatgccacagcccca

SEQ ID NO: 3914152 - DNA, 21 bp, Homo sapiens
gggaggatgccacagccccac

SEQ ID NO: 3914153 - DNA, 22 bp, Homo sapiens
ggccacactattaccatgagaa

SEQ ID NO: 3914154 - DNA, 11 bp, Homo sapiens
ggccaccagga

SEQ ID NO: 3914155 - DNA, 21 bp, Homo sapiens
ggccacccgttctgctggcct

SEQ ID NO: 3914156 - DNA, 16 bp, Homo sapiens
ggccaccctccttccc

SEQ ID NO: 3914157 - DNA, 14 bp, Homo sapiens
ggccaccctggccc

SEQ ID NO: 3914158 - DNA, 11 bp, Homo sapiens
ggccacgtgcc

SEQ ID NO: 3914159 - DNA, 13 bp, Homo sapiens
ggccactcctcca

SEQ ID NO: 3914160 - DNA, 16 bp, Homo sapiens
ggccactccttcctgc

SEQ ID NO: 3914161 - DNA, 20 bp, Homo sapiens
ggccactctcccctccctct

SEQ ID NO: 3914162 - DNA, 21 bp, Homo sapiens
ggccactctcccctccctctt

SEQ ID NO: 3914163 - DNA, 22 bp, Homo sapiens
ggccactgggtctcactcctga

SEQ ID NO: 3914164 - DNA, 13 bp, Homo sapiens
ggccactgtggcc

SEQ ID NO: 3914165 - DNA, 15 bp, Homo sapiens
ggccactgtggccag

SEQ ID NO: 3914166 - DNA, 23 bp, Homo sapiens
ggccagaaactccttttgctgtc

SEQ ID NO: 3914167 - DNA, 15 bp, Homo sapiens
ggccagaaggagggc

SEQ ID NO: 3914168 - DNA, 19 bp, Homo sapiens
ggccagaaggagggcagag

SEQ ID NO: 3914169 - DNA, 22 bp, Homo sapiens
ggccagaaggagggcagagcca

SEQ ID NO: 3914170 - DNA, 23 bp, Homo sapiens
ggccagaaggagggcagagccat

SEQ ID NO: 3914171 - DNA, 17 bp, Homo sapiens
ggccagacgctgccgct

SEQ ID NO: 3914172 - DNA, 23 bp, Homo sapiens
ggccagagaagataatgttcttt

SEQ ID NO: 3914173 - DNA, 15 bp, Homo sapiens
ggccagagagggccc

SEQ ID NO: 3914174 - DNA, 16 bp, Homo sapiens
ggccagagagggccca

SEQ ID NO: 3914175 - DNA, 18 bp, Homo sapiens
ggccagagagggcccagc

SEQ ID NO: 3914176 - DNA, 20 bp, Homo sapiens
ggccagagctggaaggcagg

SEQ ID NO: 3914177 - DNA, 22 bp, Homo sapiens
ggccagagctggaaggcagggc

SEQ ID NO: 3914178 - DNA, 16 bp, Homo sapiens
ggccagagctgggagg

SEQ ID NO: 3914179 - DNA, 16 bp, Homo sapiens
ggccagcaccctctcc

SEQ ID NO: 3914180 - DNA, 23 bp, Homo sapiens
ggccagcaccctctcctgggggt

SEQ ID NO: 3914181 - DNA, 14 bp, Homo sapiens
ggccagcctggcct

SEQ ID NO: 3914182 - DNA, 17 bp, Homo sapiens
ggccagcctggcctcct

SEQ ID NO: 3914183 - DNA, 19 bp, Homo sapiens
ggccagcctggcctcctgc

SEQ ID NO: 3914184 - DNA, 21 bp, Homo sapiens
ggccagcctggcctcctgcct

SEQ ID NO: 3914185 - DNA, 16 bp, Homo sapiens
ggccagctggtgctgc

SEQ ID NO: 3914186 - DNA, 16 bp, Homo sapiens
ggccaggacaggcccg

SEQ ID NO: 3914187 - DNA, 14 bp, Homo sapiens
ggccaggagctcag

SEQ ID NO: 3914188 - DNA, 16 bp, Homo sapiens
ggccaggccaccagga

SEQ ID NO: 3914189 - DNA, 18 bp, Homo sapiens
ggccagggaaagcccgtg

SEQ ID NO: 3914190 - DNA, 16 bp, Homo sapiens
ggccagggcctggtgt

SEQ ID NO: 3914191 - DNA, 18 bp, Homo sapiens
ggccagggcctggtgtga

SEQ ID NO: 3914192 - DNA, 17 bp, Homo sapiens
ggccaggggtctccctg

SEQ ID NO: 3914193 - DNA, 18 bp, Homo sapiens
ggccagtcctagagctcc

SEQ ID NO: 3914194 - DNA, 21 bp, Homo sapiens
ggccagtcctagagctcctgt

SEQ ID NO: 3914195 - DNA, 22 bp, Homo sapiens
ggccagtcctagagctcctgtc

SEQ ID NO: 3914196 - DNA, 15 bp, Homo sapiens
ggccagtctgggctg

SEQ ID NO: 3914197 - DNA, 17 bp, Homo sapiens
ggccagtctgggctgcc

SEQ ID NO: 3914198 - DNA, 15 bp, Homo sapiens
ggccagtgagggctg

SEQ ID NO: 3914199 - DNA, 22 bp, Homo sapiens
ggccagtgagggctgggcccac

SEQ ID NO: 3914200 - DNA, 14 bp, Homo sapiens
ggccatcagggtgg

SEQ ID NO: 3914201 - DNA, 17 bp, Homo sapiens
ggccatgctgaagggac

SEQ ID NO: 3914202 - DNA, 20 bp, Homo sapiens
ggccatgctttccttttctt

SEQ ID NO: 3914203 - DNA, 16 bp, Homo sapiens
ggccattttcttgcct

SEQ ID NO: 3914204 - DNA, 20 bp, Homo sapiens
ggcccacaaaggggagaagg

SEQ ID NO: 3914205 - DNA, 18 bp, Homo sapiens
ggcccagagaccccttcc

SEQ ID NO: 3914206 - DNA, 14 bp, Homo sapiens
ggcccagctgtagc

SEQ ID NO: 3914207 - DNA, 19 bp, Homo sapiens
ggcccagctgtagccatgg

SEQ ID NO: 3914208 - DNA, 20 bp, Homo sapiens
ggcccagctgtagccatggc

SEQ ID NO: 3914209 - DNA, 12 bp, Homo sapiens
ggcccagggagc

SEQ ID NO: 3914210 - DNA, 22 bp, Homo sapiens
ggcccataccttctggttgctt

SEQ ID NO: 3914211 - DNA, 23 bp, Homo sapiens
ggcccatagaaacatgacactga

SEQ ID NO: 3914212 - DNA, 20 bp, Homo sapiens
ggcccatctcaggtgccact

SEQ ID NO: 3914213 - DNA, 16 bp, Homo sapiens
ggccccacatgggaac

SEQ ID NO: 3914214 - DNA, 15 bp, Homo sapiens
ggccccaccacctag

SEQ ID NO: 3914215 - DNA, 19 bp, Homo sapiens
ggccccagaaggcagggaa

SEQ ID NO: 3914216 - DNA, 17 bp, Homo sapiens
ggccccagatctgcctg

SEQ ID NO: 3914217 - DNA, 19 bp, Homo sapiens
ggccccagatctgcctggg

SEQ ID NO: 3914218 - DNA, 23 bp, Homo sapiens
ggccccagatctgcctgggcctg

SEQ ID NO: 3914219 - DNA, 14 bp, Homo sapiens
ggccccaggtgcca

SEQ ID NO: 3914220 - DNA, 17 bp, Homo sapiens
ggccccatgctctgccc

SEQ ID NO: 3914221 - DNA, 20 bp, Homo sapiens
ggccccccacacgcgtgtgt

SEQ ID NO: 3914222 - DNA, 23 bp, Homo sapiens
ggcccccctccaggcatgctggc

SEQ ID NO: 3914223 - DNA, 19 bp, Homo sapiens
ggccccgcttgtccagcgc

SEQ ID NO: 3914224 - DNA, 22 bp, Homo sapiens
ggctcaggaagaaaccccaagc

SEQ ID NO: 3914225 - DNA, 19 bp, Homo sapiens
ggctcaggcaagcccctca

SEQ ID NO: 3914226 - DNA, 17 bp, Homo sapiens
ggctcaggcagacaaga

SEQ ID NO: 3914227 - DNA, 16 bp, Homo sapiens
ggctcagggctggagt

SEQ ID NO: 3914228 - DNA, 17 bp, Homo sapiens
ggctcagggctggagtg

SEQ ID NO: 3914229 - DNA, 23 bp, Homo sapiens
ggctcatggcgtaatgggcctgc

SEQ ID NO: 3914230 - DNA, 14 bp, Homo sapiens
ggctccagcatcca

SEQ ID NO: 3914231 - DNA, 12 bp, Homo sapiens
ggctccatggag

SEQ ID NO: 3914232 - DNA, 18 bp, Homo sapiens
ggctcccacaggcccttc

SEQ ID NO: 3914233 - DNA, 19 bp, Homo sapiens
ggctcccacaggcccttcc

SEQ ID NO: 3914234 - DNA, 23 bp, Homo sapiens
ggctccccacgagtcacctgcaa

SEQ ID NO: 3914235 - DNA, 15 bp, Homo sapiens
ggctccctcctggag

SEQ ID NO: 3914236 - DNA, 17 bp, Homo sapiens
ggctcctcccggtgccc

SEQ ID NO: 3914237 - DNA, 17 bp, Homo sapiens
ggctcctggctgccagg

SEQ ID NO: 3914238 - DNA, 18 bp, Homo sapiens
ggctcctggctgccaggc

SEQ ID NO: 3914239 - DNA, 16 bp, Homo sapiens
gggctatttctctccc

SEQ ID NO: 3914240 - DNA, 17 bp, Homo sapiens
gggctatttctctcccc

SEQ ID NO: 3914241 - DNA, 18 bp, Homo sapiens
gggctcaagcagtcctcc

SEQ ID NO: 3914242 - DNA, 17 bp, Homo sapiens
gggctcagcaaggtgtg

SEQ ID NO: 3914243 - DNA, 13 bp, Homo sapiens
gggctcagggctg

SEQ ID NO: 3914244 - DNA, 13 bp, Homo sapiens
gggctccagcatc

SEQ ID NO: 3914245 - DNA, 17 bp, Homo sapiens
gggctccagcatccagc

SEQ ID NO: 3914246 - DNA, 20 bp, Homo sapiens
gggctccagcatccagcctg

SEQ ID NO: 3914247 - DNA, 21 bp, Homo sapiens
gggctccagcatccagcctgt

SEQ ID NO: 3914248 - DNA, 22 bp, Homo sapiens
gggctccagcatccagcctgtg

SEQ ID NO: 3914249 - DNA, 13 bp, Homo sapiens
gggctccatggag

SEQ ID NO: 3914250 - DNA, 14 bp, Homo sapiens
gggctccatggagg

SEQ ID NO: 3914251 - DNA, 21 bp, Homo sapiens
gggctccctcctggagcatcc

SEQ ID NO: 3914252 - DNA, 19 bp, Homo sapiens
gggctcctggctgccaggc

SEQ ID NO: 3914253 - DNA, 18 bp, Homo sapiens
gggctcctttctccagcc

SEQ ID NO: 3914254 - DNA, 15 bp, Homo sapiens
gggctctaacgcctg

SEQ ID NO: 3914255 - DNA, 16 bp, Homo sapiens
gggctctaacgcctga

SEQ ID NO: 3914256 - DNA, 22 bp, Homo sapiens
gggctctaacgcctgagcccag

SEQ ID NO: 3914257 - DNA, 18 bp, Homo sapiens
gggctctccaaaggggct

SEQ ID NO: 3914258 - DNA, 23 bp, Homo sapiens
gggctctccaaaggggctgctgg

SEQ ID NO: 3914259 - DNA, 13 bp, Homo sapiens
gggctctccacct

SEQ ID NO: 3914260 - DNA, 18 bp, Homo sapiens
gggctctccacctcagcc

SEQ ID NO: 3914261 - DNA, 14 bp, Homo sapiens
ggggccctgggcct

SEQ ID NO: 3914262 - DNA, 20 bp, Homo sapiens
ggggcccttggggcctggct

SEQ ID NO: 3914263 - DNA, 16 bp, Homo sapiens
ggggccgggcaggtcc

SEQ ID NO: 3914264 - DNA, 17 bp, Homo sapiens
ggggccgggcaggtcct

SEQ ID NO: 3914265 - DNA, 23 bp, Homo sapiens
ggggccgggcaggtcctgcccat

SEQ ID NO: 3914266 - DNA, 13 bp, Homo sapiens
ggggcctggcttg

SEQ ID NO: 3914267 - DNA, 18 bp, Homo sapiens
ggggcctgggaaaggaaa

SEQ ID NO: 3914268 - DNA, 20 bp, Homo sapiens
ggggcgctcaggacccaggc

SEQ ID NO: 3914269 - DNA, 21 bp, Homo sapiens
ggggcgctcaggacccaggcc

SEQ ID NO: 3914270 - DNA, 21 bp, Homo sapiens
ggggctagaacctagagaagc

SEQ ID NO: 3914271 - DNA, 18 bp, Homo sapiens
ggggctccatggaggagg

SEQ ID NO: 3914272 - DNA, 21 bp, Homo sapiens
ggggctcctttctccagccag

SEQ ID NO: 3914273 - DNA, 22 bp, Homo sapiens
ggggctcctttctccagccagc

SEQ ID NO: 3914274 - DNA, 17 bp, Homo sapiens
ggggctcgccccaccca

SEQ ID NO: 3914275 - DNA, 18 bp, Homo sapiens
ggggctgaacggggagaa

SEQ ID NO: 3914276 - DNA, 17 bp, Homo sapiens
ggggcttgcaagaggag

SEQ ID NO: 3914277 - DNA, 16 bp, Homo sapiens
gggggagccaacagca

SEQ ID NO: 3914278 - DNA, 12 bp, Homo sapiens
gggggcagaggg

SEQ ID NO: 3914279 - DNA, 13 bp, Homo sapiens
gggggccagacac

SEQ ID NO: 3914280 - DNA, 16 bp, Homo sapiens
gggggccagacacaga

SEQ ID NO: 3914281 - DNA, 12 bp, Homo sapiens
gggggccgggca

SEQ ID NO: 3914282 - DNA, 23 bp, Homo sapiens
gggggccgggcaggtcctgccca

SEQ ID NO: 3914283 - DNA, 11 bp, Homo sapiens
gggggcctggc

SEQ ID NO: 3914284 - DNA, 15 bp, Homo sapiens
gggggcctggctggc

SEQ ID NO: 3914285 - DNA, 20 bp, Homo sapiens
gggggcctggctggctgagg

SEQ ID NO: 3914286 - DNA, 13 bp, Homo sapiens
gggggttggatgg

SEQ ID NO: 3914287 - DNA, 19 bp, Homo sapiens
ggggtacaggtttggggag

SEQ ID NO: 3914288 - DNA, 19 bp, Homo sapiens
ggggtacatttctctgagc

SEQ ID NO: 3914289 - DNA, 16 bp, Homo sapiens
gtcattactgcctttg

SEQ ID NO: 3914290 - DNA, 14 bp, Homo sapiens
gtcattatgtagaa

SEQ ID NO: 3914291 - DNA, 15 bp, Homo sapiens
gtcattttaaaatct

SEQ ID NO: 3914292 - DNA, 21 bp, Homo sapiens
gtcattttaaaatctgattta

SEQ ID NO: 3914293 - DNA, 17 bp, Homo sapiens
gtccaacctaacccctt

SEQ ID NO: 3914294 - DNA, 21 bp, Homo sapiens
gtccaacctaacccctttcct

SEQ ID NO: 3914295 - DNA, 13 bp, Homo sapiens
gtccaagggccat

SEQ ID NO: 3914296 - DNA, 19 bp, Homo sapiens
gtccaatggctgtaaacta

SEQ ID NO: 3914297 - DNA, 15 bp, Homo sapiens
gtccacaggggcagg

SEQ ID NO: 3914298 - DNA, 17 bp, Homo sapiens
gtccacaggggcaggcc

SEQ ID NO: 3914299 - DNA, 18 bp, Homo sapiens
gtccacaggggcaggcct

SEQ ID NO: 3914300 - DNA, 20 bp, Homo sapiens
gtccacaggggcaggcctgg

SEQ ID NO: 3914301 - DNA, 16 bp, Homo sapiens
gtccacagtctcccat

SEQ ID NO: 3914302 - DNA, 19 bp, Homo sapiens
gtccacagtctcccattct

SEQ ID NO: 3914303 - DNA, 11 bp, Homo sapiens
gtccacccagc

SEQ ID NO: 3914304 - DNA, 12 bp, Homo sapiens
gtccacccaggc

SEQ ID NO: 3914305 - DNA, 15 bp, Homo sapiens
gtccacccaggctgc

SEQ ID NO: 3914306 - DNA, 17 bp, Homo sapiens
gtccactctcggggccc

SEQ ID NO: 3914307 - DNA, 20 bp, Homo sapiens
gtccactctcggggcccttg

SEQ ID NO: 3914308 - DNA, 15 bp, Homo sapiens
gtccagaagaatatt

SEQ ID NO: 3914309 - DNA, 20 bp, Homo sapiens
gtccagaccattgtcttcca

SEQ ID NO: 3914310 - DNA, 14 bp, Homo sapiens
gtccagaggctgca

SEQ ID NO: 3914311 - DNA, 14 bp, Homo sapiens
gtccagcagctgcg

SEQ ID NO: 3914312 - DNA, 20 bp, Homo sapiens
gtccagcagctgcgggtctg

SEQ ID NO: 3914313 - DNA, 14 bp, Homo sapiens
gtccagcttgctct

SEQ ID NO: 3914314 - DNA, 16 bp, Homo sapiens
gtccaggaaggcagct

SEQ ID NO: 3914315 - DNA, 18 bp, Homo sapiens
gtccaggaaggcagctgc

SEQ ID NO: 3914316 - DNA, 22 bp, Homo sapiens
gtccaggaaggcagctgctctt

SEQ ID NO: 3914317 - DNA, 13 bp, Homo sapiens
gtccaggagcctg

SEQ ID NO: 3914318 - DNA, 14 bp, Homo sapiens
gtccaggccactgt

SEQ ID NO: 3914319 - DNA, 15 bp, Homo sapiens
gtccaggccactgtg

SEQ ID NO: 3914320 - DNA, 17 bp, Homo sapiens
gtccaggccactgtggc

SEQ ID NO: 3914321 - DNA, 21 bp, Homo sapiens
gtccaggccactgtggccaga

SEQ ID NO: 3914322 - DNA, 21 bp, Homo sapiens
gtccagggcgggagtgggggc

SEQ ID NO: 3914323 - DNA, 15 bp, Homo sapiens
gtccaggtcctggtg

SEQ ID NO: 3914324 - DNA, 16 bp, Homo sapiens
gtccaggtcctggtgg

SEQ ID NO: 3914325 - DNA, 23 bp, Homo sapiens
gtccaggtcctggtggggcagct

SEQ ID NO: 3914326 - DNA, 21 bp, Homo sapiens
gtccatttgggtacgtctggg

SEQ ID NO: 3914327 - DNA, 23 bp, Homo sapiens
gtcccaaggagctgatttccagg

SEQ ID NO: 3914328 - DNA, 22 bp, Homo sapiens
gtcccaccaactctgcactcca

SEQ ID NO: 3914329 - DNA, 23 bp, Homo sapiens
gtcccaccaactctgcactccat

SEQ ID NO: 3914330 - DNA, 13 bp, Homo sapiens
gtcccacctcttc

SEQ ID NO: 3914331 - DNA, 14 bp, Homo sapiens
gtcccacctcttct

SEQ ID NO: 3914332 - DNA, 23 bp, Homo sapiens
gtcccacctcttctcttcctgta

SEQ ID NO: 3914333 - DNA, 20 bp, Homo sapiens
gtcccacgaatttgctgggg

SEQ ID NO: 3914334 - DNA, 21 bp, Homo sapiens
gtcccagagcttattggccac

SEQ ID NO: 3914335 - DNA, 12 bp, Homo sapiens
gtcccagggaag

SEQ ID NO: 3914336 - DNA, 24 bp, Homo sapiens
gtcccagggaagaggaatcgcccc

SEQ ID NO: 3914337 - DNA, 16 bp, Homo sapiens
gtcccatgtgcatgga

SEQ ID NO: 3914338 - DNA, 23 bp, Homo sapiens
gtccccagctggtccagggcctg

SEQ ID NO: 3914339 - DNA, 13 bp, Homo sapiens
gtccccagggccc

SEQ ID NO: 3914340 - DNA, 18 bp, Homo sapiens
gtccccagtttgcagaaa

SEQ ID NO: 3914341 - DNA, 15 bp, Homo sapiens
gtccccatcatccca

SEQ ID NO: 3914342 - DNA, 19 bp, Homo sapiens
gtccccatcatcccagctg

SEQ ID NO: 3914343 - DNA, 22 bp, Homo sapiens
gtccccctggggcttctcctga

SEQ ID NO: 3914344 - DNA, 22 bp, Homo sapiens
gtccccgtgccccgcctccccg

SEQ ID NO: 3914345 - DNA, 17 bp, Homo sapiens
gtcccctcactctgtca

SEQ ID NO: 3914346 - DNA, 19 bp, Homo sapiens
gtcccctcactctgtcagc

SEQ ID NO: 3914347 - DNA, 20 bp, Homo sapiens
gtcccctgctactcctgtgc

SEQ ID NO: 3914348 - DNA, 12 bp, Homo sapiens
gtcccctgtccc

SEQ ID NO: 3914349 - DNA, 15 bp, Homo sapiens
gtcccctgtcccacc

SEQ ID NO: 3914350 - DNA, 19 bp, Homo sapiens
gtcccgccttcctcctcca

SEQ ID NO: 3914351 - DNA, 22 bp, Homo sapiens
gtcccgccttcctcctccacag

SEQ ID NO: 3914352 - DNA, 14 bp, Homo sapiens
gtccctacccactc

SEQ ID NO: 3914353 - DNA, 15 bp, Homo sapiens
gtccctacccactct

SEQ ID NO: 3914354 - DNA, 16 bp, Homo sapiens
gtccctcggagctgcc

SEQ ID NO: 3914355 - DNA, 19 bp, Homo sapiens
gtccctcggagctgccagc

SEQ ID NO: 3914356 - DNA, 14 bp, Homo sapiens
gtccctgctcctcc

SEQ ID NO: 3914357 - DNA, 15 bp, Homo sapiens
gtccctgctcctccc

SEQ ID NO: 3914358 - DNA, 17 bp, Homo sapiens
gtccctgcttacctgac

SEQ ID NO: 3914359 - DNA, 24 bp, Homo sapiens
gtccctggtccctcgtccacaggg

SEQ ID NO: 3914360 - DNA, 18 bp, Homo sapiens
gtcccttgctgacatggc

SEQ ID NO: 3914361 - DNA, 20 bp, Homo sapiens
gtcccttggaaagttcagcc

SEQ ID NO: 3914362 - DNA, 17 bp, Homo sapiens
gtccgattaatttatgg

SEQ ID NO: 3914363 - DNA, 20 bp, Homo sapiens
gtccgcaagttcagggaagc

SEQ ID NO: 3914364 - DNA, 15 bp, Homo sapiens
gtccgcaccagctgc

SEQ ID NO: 3914365 - DNA, 18 bp, Homo sapiens
gtccgcaccagctgctct

SEQ ID NO: 3914366 - DNA, 22 bp, Homo sapiens
gtccgcaccagctgctctgccc

SEQ ID NO: 3914367 - DNA, 23 bp, Homo sapiens
gtccgcaccagctgctctgcccc

SEQ ID NO: 3914368 - DNA, 22 bp, Homo sapiens
gtccgcctctgcccgcagagcc

SEQ ID NO: 3914369 - DNA, 16 bp, Homo sapiens
gtcctaactggtatag

SEQ ID NO: 3914370 - DNA, 17 bp, Homo sapiens
gtcctacagtggctgtc

SEQ ID NO: 3914371 - DNA, 15 bp, Homo sapiens
gtcctagagctcctg

SEQ ID NO: 3914372 - DNA, 17 bp, Homo sapiens
gtcctagagctcctgtc

SEQ ID NO: 3914373 - DNA, 19 bp, Homo sapiens
gtcctagagctcctgtccc

SEQ ID NO: 3914374 - DNA, 20 bp, Homo sapiens
gtcctagagctcctgtccct

SEQ ID NO: 3914375 - DNA, 17 bp, Homo sapiens
gtagactatatacatgt

SEQ ID NO: 3914376 - DNA, 14 bp, Homo sapiens
gtagactcctgctt

SEQ ID NO: 3914377 - DNA, 21 bp, Homo sapiens
gtagactcctgcttcttcaag

SEQ ID NO: 3914378 - DNA, 14 bp, Homo sapiens
gtagagagccgggc

SEQ ID NO: 3914379 - DNA, 12 bp, Homo sapiens
gtagagatgtgt

SEQ ID NO: 3914380 - DNA, 13 bp, Homo sapiens
gtagagatgtgtg

SEQ ID NO: 3914381 - DNA, 17 bp, Homo sapiens
gtagatcagtggtctcc

SEQ ID NO: 3914382 - DNA, 15 bp, Homo sapiens
gtagatgccggcagg

SEQ ID NO: 3914383 - DNA, 22 bp, Homo sapiens
gtagcaggatgaggaacctcaa

SEQ ID NO: 3914384 - DNA, 16 bp, Homo sapiens
gtagcatcttctggag

SEQ ID NO: 3914385 - DNA, 12 bp, Homo sapiens
gtagcatgagag

SEQ ID NO: 3914386 - DNA, 15 bp, Homo sapiens
gtagcatggactctg

SEQ ID NO: 3914387 - DNA, 16 bp, Homo sapiens
gtagcatggactctgg

SEQ ID NO: 3914388 - DNA, 19 bp, Homo sapiens
gtagccaagttatattgaa

SEQ ID NO: 3914389 - DNA, 21 bp, Homo sapiens
gtagccagccggggcgagtgg

SEQ ID NO: 3914390 - DNA, 19 bp, Homo sapiens
gtagcccggccagggcctg

SEQ ID NO: 3914391 - DNA, 19 bp, Homo sapiens
gtagcctccgtttatgggc

SEQ ID NO: 3914392 - DNA, 15 bp, Homo sapiens
gtagcgagctgctct

SEQ ID NO: 3914393 - DNA, 13 bp, Homo sapiens
gtagctctgcctc

SEQ ID NO: 3914394 - DNA, 21 bp, Homo sapiens
gtagctgagctcacaaggcag

SEQ ID NO: 3914395 - DNA, 19 bp, Homo sapiens
gtagctgtgacctgctgag

SEQ ID NO: 3914396 - DNA, 16 bp, Homo sapiens
gtagcttaaataaatt

SEQ ID NO: 3914397 - DNA, 19 bp, Homo sapiens
gtagcttacctgacacaag

SEQ ID NO: 3914398 - DNA, 17 bp, Homo sapiens
gtagctttcccaaataa

SEQ ID NO: 3914399 - DNA, 12 bp, Homo sapiens
gtaggaatcctt

SEQ ID NO: 3914400 - DNA, 15 bp, Homo sapiens
gtaggaccaatgttg

SEQ ID NO: 3914401 - DNA, 14 bp, Homo sapiens
gtaggagcaagaga

SEQ ID NO: 3914402 - DNA, 14 bp, Homo sapiens
gtaggaggtttgga

SEQ ID NO: 3914403 - DNA, 17 bp, Homo sapiens
gtaggcatgagggatca

SEQ ID NO: 3914404 - DNA, 23 bp, Homo sapiens
gtaggccaagctgaagtgaagga

SEQ ID NO: 3914405 - DNA, 21 bp, Homo sapiens
gtaggcccttgtcctgccagc

SEQ ID NO: 3914406 - DNA, 17 bp, Homo sapiens
gtagggtaaggtgcctt

SEQ ID NO: 3914407 - DNA, 17 bp, Homo sapiens
gtagtggaagagcagcc

SEQ ID NO: 3914408 - DNA, 11 bp, Homo sapiens
gtagttaggaa

SEQ ID NO: 3914409 - DNA, 15 bp, Homo sapiens
gtagttaggaaataa

SEQ ID NO: 3914410 - DNA, 20 bp, Homo sapiens
gtagttaggaaataaaacct

SEQ ID NO: 3914411 - DNA, 15 bp, Homo sapiens
gtagttcttgtgcat

SEQ ID NO: 3914412 - DNA, 11 bp, Homo sapiens
gtagtttttca

SEQ ID NO: 3914413 - DNA, 19 bp, Homo sapiens
gtataaataataaagaact

SEQ ID NO: 3914414 - DNA, 17 bp, Homo sapiens
gtataaatatgaaatga

SEQ ID NO: 3914415 - DNA, 13 bp, Homo sapiens
gtataaatgtata

SEQ ID NO: 3914416 - DNA, 14 bp, Homo sapiens
gtataaatgtatat

SEQ ID NO: 3914417 - DNA, 18 bp, Homo sapiens
gtataaatgtatatacac

SEQ ID NO: 3914418 - DNA, 17 bp, Homo sapiens
gtataagtgcacacaga

SEQ ID NO: 3914419 - DNA, 17 bp, Homo sapiens
gtatacaatatataaaa

SEQ ID NO: 3914420 - DNA, 19 bp, Homo sapiens
gtatacaatatataaaaat

SEQ ID NO: 3914421 - DNA, 21 bp, Homo sapiens
gtatacaatatataaaaatat

SEQ ID NO: 3914422 - DNA, 15 bp, Homo sapiens
gtatacacacatata

SEQ ID NO: 3914423 - DNA, 23 bp, Homo sapiens
gtatacacacatatacatatata

SEQ ID NO: 3914424 - DNA, 16 bp, Homo sapiens
gtatacttttgtttca

SEQ ID NO: 3914425 - DNA, 15 bp, Homo sapiens
gtatagagatatgca

SEQ ID NO: 3914426 - DNA, 16 bp, Homo sapiens
gtatagatgcaagata

SEQ ID NO: 3914427 - DNA, 20 bp, Homo sapiens
gtatagctgacatctcctct

SEQ ID NO: 3914428 - DNA, 15 bp, Homo sapiens
gtataggatggattg

SEQ ID NO: 3914429 - DNA, 13 bp, Homo sapiens
gtatagtgtaaaa

SEQ ID NO: 3914430 - DNA, 16 bp, Homo sapiens
gtatatacacatatac

SEQ ID NO: 3914431 - DNA, 21 bp, Homo sapiens
gtatatacatattataaataa

SEQ ID NO: 3914432 - DNA, 13 bp, Homo sapiens
gtatatacatttc

SEQ ID NO: 3914433 - DNA, 15 bp, Homo sapiens
gtatatactatacaa

SEQ ID NO: 3914434 - DNA, 19 bp, Homo sapiens
gtatatacttcactcactt

SEQ ID NO: 3914435 - DNA, 18 bp, Homo sapiens
gtatatagtatatttata

SEQ ID NO: 3914436 - DNA, 13 bp, Homo sapiens
gtatatatacata

SEQ ID NO: 3914437 - DNA, 15 bp, Homo sapiens
gtatatatacataca

SEQ ID NO: 3914438 - DNA, 21 bp, Homo sapiens
gtatatatatatagtaactac

SEQ ID NO: 3914439 - DNA, 17 bp, Homo sapiens
gtatatatatatgtgtg

SEQ ID NO: 3914440 - DNA, 13 bp, Homo sapiens
gtatatatgtgtg

SEQ ID NO: 3914441 - DNA, 14 bp, Homo sapiens
gtatatcagaaaag

SEQ ID NO: 3914442 - DNA, 15 bp, Homo sapiens
gtatatgtctcaggt

SEQ ID NO: 3914443 - DNA, 15 bp, Homo sapiens
gtatattacctcaaa

SEQ ID NO: 3914444 - DNA, 19 bp, Homo sapiens
gtatattatggtgtaatgc

SEQ ID NO: 3914445 - DNA, 15 bp, Homo sapiens
gtatattccaccatt

SEQ ID NO: 3914446 - DNA, 15 bp, Homo sapiens
gtatattctggaaaa

SEQ ID NO: 3914447 - DNA, 14 bp, Homo sapiens
gtatatttatactc

SEQ ID NO: 3914448 - DNA, 15 bp, Homo sapiens
gtatatttatactct

SEQ ID NO: 3914449 - DNA, 19 bp, Homo sapiens
gtatatttgtgtatgtgta

SEQ ID NO: 3914450 - DNA, 13 bp, Homo sapiens
gtatcaaatctgt

SEQ ID NO: 3914451 - DNA, 21 bp, Homo sapiens
gtatcattttgcacgtgctct

SEQ ID NO: 3914452 - DNA, 20 bp, Homo sapiens
gtatcctgataaacattaaa

SEQ ID NO: 3914453 - DNA, 13 bp, Homo sapiens
gtatctctctgcc

SEQ ID NO: 3914454 - DNA, 11 bp, Homo sapiens
gtatctgaagg

SEQ ID NO: 3914455 - DNA, 22 bp, Homo sapiens
gtatgaaagatggctgtgcctc

SEQ ID NO: 3914456 - DNA, 23 bp, Homo sapiens
gtatgaaagatggctgtgcctct

SEQ ID NO: 3914457 - DNA, 15 bp, Homo sapiens
gtatgaacttgagga

SEQ ID NO: 3914458 - DNA, 19 bp, Homo sapiens
gtatgaacttgaggacaca

SEQ ID NO: 3914459 - DNA, 18 bp, Homo sapiens
gtatgaataaagacacct

SEQ ID NO: 3914460 - DNA, 19 bp, Homo sapiens
gtatgatttttacaataat

SEQ ID NO: 3914461 - DNA, 19 bp, Homo sapiens
gtatgctggccagcaccct

SEQ ID NO: 3914462 - DNA, 14 bp, Homo sapiens
gtatttgaaactga

SEQ ID NO: 3914463 - DNA, 16 bp, Homo sapiens
gtattttcattttaat

SEQ ID NO: 3914464 - DNA, 14 bp, Homo sapiens
gtattttggagaaa

SEQ ID NO: 3914465 - DNA, 15 bp, Homo sapiens
gtatttttactatta

SEQ ID NO: 3914466 - DNA, 15 bp, Homo sapiens
gtattttttaaagct

SEQ ID NO: 3914467 - DNA, 23 bp, Homo sapiens
gtattttttttactgtgcataca

SEQ ID NO: 3914468 - DNA, 15 bp, Homo sapiens
gtcaaaagctggatt

SEQ ID NO: 3914469 - DNA, 18 bp, Homo sapiens
gtcaaagcattgagatct

SEQ ID NO: 3914470 - DNA, 22 bp, Homo sapiens
gtcaaatcatggccaaatcgca

SEQ ID NO: 3914471 - DNA, 19 bp, Homo sapiens
gtcaaatgtcattatgtag

SEQ ID NO: 3914472 - DNA, 21 bp, Homo sapiens
gtcaacaagtatgaataaaga

SEQ ID NO: 3914473 - DNA, 14 bp, Homo sapiens
gtcaacactcttct

SEQ ID NO: 3914474 - DNA, 19 bp, Homo sapiens
gtcaacactcttcttgagc

SEQ ID NO: 3914475 - DNA, 23 bp, Homo sapiens
gtcaacagagaaggcaggaatgt

SEQ ID NO: 3914476 - DNA, 20 bp, Homo sapiens
gtcaactggagcaagaagga

SEQ ID NO: 3914477 - DNA, 14 bp, Homo sapiens
gtcaatattaaata

SEQ ID NO: 3914478 - DNA, 17 bp, Homo sapiens
gtcaatattaaatacag

SEQ ID NO: 3914479 - DNA, 18 bp, Homo sapiens
gtcaatattaaatacaga

SEQ ID NO: 3914480 - DNA, 17 bp, Homo sapiens
gtcaatcccaaaagtca

SEQ ID NO: 3914481 - DNA, 17 bp, Homo sapiens
gtcacaagagcccagca

SEQ ID NO: 3914482 - DNA, 14 bp, Homo sapiens
gtcacacagggcag

SEQ ID NO: 3914483 - DNA, 15 bp, Homo sapiens
gtcacaccatcttaa

SEQ ID NO: 3914484 - DNA, 16 bp, Homo sapiens
gtcacagctgcagctg

SEQ ID NO: 3914485 - DNA, 19 bp, Homo sapiens
gtcacagctgcagctgggc

SEQ ID NO: 3914486 - DNA, 20 bp, Homo sapiens
gtcacagctgcagctgggcc

SEQ ID NO: 3914487 - DNA, 19 bp, Homo sapiens
gtcacatatacaaaagcaa

SEQ ID NO: 3914488 - DNA, 17 bp, Homo sapiens
gtcaccaagctcacagt

SEQ ID NO: 3914489 - DNA, 19 bp, Homo sapiens
gtcaccaatgtacccaccg

SEQ ID NO: 3914490 - DNA, 22 bp, Homo sapiens
gtcaccaatgtacccaccgggc

SEQ ID NO: 3914491 - DNA, 13 bp, Homo sapiens
gtcaccacctctc

SEQ ID NO: 3914492 - DNA, 19 bp, Homo sapiens
gtcaccaccttcccagctc

SEQ ID NO: 3914493 - DNA, 14 bp, Homo sapiens
gtcaccagcaacat

SEQ ID NO: 3914494 - DNA, 16 bp, Homo sapiens
gtcaccctccacctct

SEQ ID NO: 3914495 - DNA, 16 bp, Homo sapiens
gtcacccttctgggca

SEQ ID NO: 3914496 - DNA, 17 bp, Homo sapiens
gtcacccttctgggcaa

SEQ ID NO: 3914497 - DNA, 15 bp, Homo sapiens
gtcacctcctccact

SEQ ID NO: 3914498 - DNA, 16 bp, Homo sapiens
gtcacctcctccactc

SEQ ID NO: 3914499 - DNA, 23 bp, Homo sapiens
gtcacctgcaagccccagggcct

SEQ ID NO: 3914500 - DNA, 19 bp, Homo sapiens
gtcactcttcctgcaagga

SEQ ID NO: 3914501 - DNA, 20 bp, Homo sapiens
gtcactgcacagtgcatctc

SEQ ID NO: 3914502 - DNA, 19 bp, Homo sapiens
gtcactggaccactgggca

SEQ ID NO: 3914503 - DNA, 17 bp, Homo sapiens
gtcactgttccttgtca

SEQ ID NO: 3914504 - DNA, 19 bp, Homo sapiens
gtcactgtttattttttta

SEQ ID NO: 3914505 - DNA, 14 bp, Homo sapiens
gtcacttccagtgt

SEQ ID NO: 3914506 - DNA, 22 bp, Homo sapiens
gtcacttccagtgttggctgtg

SEQ ID NO: 3914507 - DNA, 17 bp, Homo sapiens
gtcagaagcaggttctt

SEQ ID NO: 3914508 - DNA, 17 bp, Homo sapiens
gtcagagctgttggcct

SEQ ID NO: 3914509 - DNA, 18 bp, Homo sapiens
gtcagagtaacatgccag

SEQ ID NO: 3914510 - DNA, 18 bp, Homo sapiens
gtcagatgggaagacatg

SEQ ID NO: 3914511 - DNA, 11 bp, Homo sapiens
gtcagccagcc

SEQ ID NO: 3914512 - DNA, 12 bp, Homo sapiens
gtcagccagccg

SEQ ID NO: 3914513 - DNA, 16 bp, Homo sapiens
gtcagccagggccagg

SEQ ID NO: 3914514 - DNA, 18 bp, Homo sapiens
gtcagcccgaatgcctgt

SEQ ID NO: 3914515 - DNA, 16 bp, Homo sapiens
gtcagccgagccgggc

SEQ ID NO: 3914516 - DNA, 22 bp, Homo sapiens
gtcctagagctcctgtccctac

SEQ ID NO: 3914517 - DNA, 13 bp, Homo sapiens
gtcctatgtgtga

SEQ ID NO: 3914518 - DNA, 19 bp, Homo sapiens
gtcctcaaaataaggggca

SEQ ID NO: 3914519 - DNA, 17 bp, Homo sapiens
gtcctcacagcctctcc

SEQ ID NO: 3914520 - DNA, 18 bp, Homo sapiens
gtcctcacagcctctccc

SEQ ID NO: 3914521 - DNA, 21 bp, Homo sapiens
gtcctccaacaataaagagct

SEQ ID NO: 3914522 - DNA, 14 bp, Homo sapiens
gtcctccacaataa

SEQ ID NO: 3914523 - DNA, 13 bp, Homo sapiens
gtcctccatttca

SEQ ID NO: 3914524 - DNA, 19 bp, Homo sapiens
gtcctccatttcaactcca

SEQ ID NO: 3914525 - DNA, 16 bp, Homo sapiens
gtcctccccctgccag

SEQ ID NO: 3914526 - DNA, 19 bp, Homo sapiens
gtcctccccctgccagtgc

SEQ ID NO: 3914527 - DNA, 20 bp, Homo sapiens
gtcctccccctgccagtgcc

SEQ ID NO: 3914528 - DNA, 13 bp, Homo sapiens
gtcctcccgggag

SEQ ID NO: 3914529 - DNA, 21 bp, Homo sapiens
gtcctcctcggatcaccgaga

SEQ ID NO: 3914530 - DNA, 11 bp, Homo sapiens
gtcctctggat

SEQ ID NO: 3914531 - DNA, 21 bp, Homo sapiens
gtcctctggatggcaccagag

SEQ ID NO: 3914532 - DNA, 21 bp, Homo sapiens
gtcctctttactcccttcctg

SEQ ID NO: 3914533 - DNA, 14 bp, Homo sapiens
gtcctgacgccctg

SEQ ID NO: 3914534 - DNA, 14 bp, Homo sapiens
gtcctgagcactgc

SEQ ID NO: 3914535 - DNA, 18 bp, Homo sapiens
gtcctgagcactgccagg

SEQ ID NO: 3914536 - DNA, 19 bp, Homo sapiens
gtcctgagcactgccagga

SEQ ID NO: 3914537 - DNA, 18 bp, Homo sapiens
gtcctgagggtccccacc

SEQ ID NO: 3914538 - DNA, 19 bp, Homo sapiens
gtcctgagtcttggcctgc

SEQ ID NO: 3914539 - DNA, 12 bp, Homo sapiens
gtcctgcagagg

SEQ ID NO: 3914540 - DNA, 14 bp, Homo sapiens
gtcctgccagctgc

SEQ ID NO: 3914541 - DNA, 17 bp, Homo sapiens
gtcctgccagctgcctt

SEQ ID NO: 3914542 - DNA, 21 bp, Homo sapiens
gtcctgcccccgacagcccag

SEQ ID NO: 3914543 - DNA, 22 bp, Homo sapiens
gtcctgcccccgacagcccagc

SEQ ID NO: 3914544 - DNA, 23 bp, Homo sapiens
gtcctgcccccgacagcccagcc

SEQ ID NO: 3914545 - DNA, 16 bp, Homo sapiens
gtcctgcctctctgct

SEQ ID NO: 3914546 - DNA, 21 bp, Homo sapiens
gtcctgctctcttcaggaggc

SEQ ID NO: 3914547 - DNA, 16 bp, Homo sapiens
gtcctgctggcacctc

SEQ ID NO: 3914548 - DNA, 14 bp, Homo sapiens
gtcctggctgctct

SEQ ID NO: 3914549 - DNA, 12 bp, Homo sapiens
gtcctggcttct

SEQ ID NO: 3914550 - DNA, 18 bp, Homo sapiens
gtcctggtacagcagggt

SEQ ID NO: 3914551 - DNA, 21 bp, Homo sapiens
gtcctggtacagcagggtctt

SEQ ID NO: 3914552 - DNA, 18 bp, Homo sapiens
gtcctggtggggcagctc

SEQ ID NO: 3914553 - DNA, 22 bp, Homo sapiens
gtcctggtggggcagctcctct

SEQ ID NO: 3914554 - DNA, 11 bp, Homo sapiens
gtcctgtccca

SEQ ID NO: 3914555 - DNA, 13 bp, Homo sapiens
gtcctgtcccaga

SEQ ID NO: 3914556 - DNA, 16 bp, Homo sapiens
gtcctgtcccagaggt

SEQ ID NO: 3914557 - DNA, 23 bp, Homo sapiens
gtccttcctttaggtctggttgt

SEQ ID NO: 3914558 - DNA, 18 bp, Homo sapiens
gtccttctcgtttgctct

SEQ ID NO: 3914559 - DNA, 15 bp, Homo sapiens
gtcctttaggcagcc

SEQ ID NO: 3914560 - DNA, 19 bp, Homo sapiens
gttgccaactaagccctcg

SEQ ID NO: 3914561 - DNA, 13 bp, Homo sapiens
gttgcccaggctg

SEQ ID NO: 3914562 - DNA, 17 bp, Homo sapiens
gttgcccaggctgctct

SEQ ID NO: 3914563 - DNA, 18 bp, Homo sapiens
gttgcccaggctggcctg

SEQ ID NO: 3914564 - DNA, 14 bp, Homo sapiens
gttgccccttcccc

SEQ ID NO: 3914565 - DNA, 18 bp, Homo sapiens
gttgcgccactgagacgg

SEQ ID NO: 3914566 - DNA, 16 bp, Homo sapiens
gttgcgggggagctgg

SEQ ID NO: 3914567 - DNA, 17 bp, Homo sapiens
gttgcgggggagctgga

SEQ ID NO: 3914568 - DNA, 19 bp, Homo sapiens
gttgcgggggagctggaaa

SEQ ID NO: 3914569 - DNA, 14 bp, Homo sapiens
gttgctatttgttg

SEQ ID NO: 3914570 - DNA, 20 bp, Homo sapiens
gttgctcaaatctattcaga

SEQ ID NO: 3914571 - DNA, 20 bp, Homo sapiens
gttgctgattcaagaaacag

SEQ ID NO: 3914572 - DNA, 18 bp, Homo sapiens
gttggaatcacctggagg

SEQ ID NO: 3914573 - DNA, 20 bp, Homo sapiens
gttattaacgggcatgtatt

SEQ ID NO: 3914574 - DNA, 13 bp, Homo sapiens
gttattctcttca

SEQ ID NO: 3914575 - DNA, 13 bp, Homo sapiens
gttattgtgttgc

SEQ ID NO: 3914576 - DNA, 14 bp, Homo sapiens
gttatttatatatt

SEQ ID NO: 3914577 - DNA, 19 bp, Homo sapiens
gttatttgttattttcagt

SEQ ID NO: 3914578 - DNA, 14 bp, Homo sapiens
gttattttcagtat

SEQ ID NO: 3914579 - DNA, 16 bp, Homo sapiens
gttatttttatatcag

SEQ ID NO: 3914580 - DNA, 17 bp, Homo sapiens
gttatttttgtccctgc

SEQ ID NO: 3914581 - DNA, 13 bp, Homo sapiens
gttcaagcctgtg

SEQ ID NO: 3914582 - DNA, 15 bp, Homo sapiens
gttcaattccctgaa

SEQ ID NO: 3914583 - DNA, 17 bp, Homo sapiens
gttcaattccctgaagg

SEQ ID NO: 3914584 - DNA, 13 bp, Homo sapiens
gttcaccttatgt

SEQ ID NO: 3914585 - DNA, 16 bp, Homo sapiens
gttcaccttatgtatt

SEQ ID NO: 3914586 - DNA, 17 bp, Homo sapiens
gttcaccttatgtatta

SEQ ID NO: 3914587 - DNA, 21 bp, Homo sapiens
gttcagccagaatcttcgtcc

SEQ ID NO: 3914588 - DNA, 23 bp, Homo sapiens
gtgtctcaatctgatctgagtga

SEQ ID NO: 3914589 - DNA, 20 bp, Homo sapiens
gtgtctctcccaccccggcc

SEQ ID NO: 3914590 - DNA, 14 bp, Homo sapiens
gtgtctgcacccag

SEQ ID NO: 3914591 - DNA, 16 bp, Homo sapiens
gtgtctgtctttgtgg

SEQ ID NO: 3914592 - DNA, 11 bp, Homo sapiens
gtgtctgtgtg

SEQ ID NO: 3914593 - DNA, 21 bp, Homo sapiens
gtgtgaaaggaagctccactg

SEQ ID NO: 3914594 - DNA, 17 bp, Homo sapiens
gtgtgaagttacacaat

SEQ ID NO: 3914595 - DNA, 13 bp, Homo sapiens
gtgtgagcagtga

SEQ ID NO: 3914596 - DNA, 14 bp, Homo sapiens
gtgtgagtggcagc

SEQ ID NO: 3914597 - DNA, 17 bp, Homo sapiens
gtgtgagtggcagccat

SEQ ID NO: 3914598 - DNA, 20 bp, Homo sapiens
gtgtgcacaaatatttattt

SEQ ID NO: 3914599 - DNA, 22 bp, Homo sapiens
gtgtgcaccttaccaactttct

SEQ ID NO: 3914600 - DNA, 13 bp, Homo sapiens
gtgtgcagtgaag

SEQ ID NO: 3914601 - DNA, 14 bp, Homo sapiens
gtgtgcatgtgtgt

SEQ ID NO: 3914602 - DNA, 16 bp, Homo sapiens
gtgtgcatgtgtgtat

SEQ ID NO: 3914603 - DNA, 14 bp, Homo sapiens
gtgtgcctgccctg

SEQ ID NO: 3914604 - DNA, 15 bp, Homo sapiens
gtgtgcctgtggcag

SEQ ID NO: 3914605 - DNA, 14 bp, Homo sapiens
taaagtttaaaaaa

SEQ ID NO: 3914606 - DNA, 13 bp, Homo sapiens
taaataaaccctt

SEQ ID NO: 3914607 - DNA, 14 bp, Homo sapiens
taaataaagtatca

SEQ ID NO: 3914608 - DNA, 15 bp, Homo sapiens
taaataaagtatcat

SEQ ID NO: 3914609 - DNA, 20 bp, Homo sapiens
taaataaagtatcatgcatt

SEQ ID NO: 3914610 - DNA, 21 bp, Homo sapiens
taaataaagtatcatgcattc

SEQ ID NO: 3914611 - DNA, 13 bp, Homo sapiens
taaataaatagat

SEQ ID NO: 3914612 - DNA, 14 bp, Homo sapiens
taaataaatgccaa

SEQ ID NO: 3914613 - DNA, 17 bp, Homo sapiens
taaataaattcaaacca

SEQ ID NO: 3914614 - DNA, 12 bp, Homo sapiens
taaataaattgt

SEQ ID NO: 3914615 - DNA, 20 bp, Homo sapiens
taaataaattgtttgaccat

SEQ ID NO: 3914616 - DNA, 14 bp, Homo sapiens
taaatacagacact

SEQ ID NO: 3914617 - DNA, 12 bp, Homo sapiens
taaatacatgtg

SEQ ID NO: 3914618 - DNA, 17 bp, Homo sapiens
taaatactgatatttca

SEQ ID NO: 3914619 - DNA, 13 bp, Homo sapiens
taaatactgtaca

SEQ ID NO: 3914620 - DNA, 14 bp, Homo sapiens
taaatactgtacat

SEQ ID NO: 3914621 - DNA, 18 bp, Homo sapiens
taaatactgtacatagat

SEQ ID NO: 3914622 - DNA, 22 bp, Homo sapiens
taaatagagttccaaataagga

SEQ ID NO: 3914623 - DNA, 18 bp, Homo sapiens
taaatagatttgattatt

SEQ ID NO: 3914624 - DNA, 15 bp, Homo sapiens
taaatagcattctct

SEQ ID NO: 3914625 - DNA, 17 bp, Homo sapiens
taaatataaatgtttaa

SEQ ID NO: 3914626 - DNA, 19 bp, Homo sapiens
taaatatatatttttcaac

SEQ ID NO: 3914627 - DNA, 22 bp, Homo sapiens
taaatatccacagactccctcc

SEQ ID NO: 3914628 - DNA, 21 bp, Homo sapiens
taaatatgaaatgataaagat

SEQ ID NO: 3914629 - DNA, 22 bp, Homo sapiens
taaatatttggtctctatttca

SEQ ID NO: 3914630 - DNA, 15 bp, Homo sapiens
taaatcacttgtaaa

SEQ ID NO: 3914631 - DNA, 19 bp, Homo sapiens
taaatcacttgtaaataaa

SEQ ID NO: 3914632 - DNA, 15 bp, Homo sapiens
taaatccacagccaa

SEQ ID NO: 3914633 - DNA, 14 bp, Homo sapiens
taaatctctaatat

SEQ ID NO: 3914634 - DNA, 15 bp, Homo sapiens
taaatctctaatatg

SEQ ID NO: 3914635 - DNA, 16 bp, Homo sapiens
taaatgaatcttactc

SEQ ID NO: 3914636 - DNA, 13 bp, Homo sapiens
taaatgaccaaga

SEQ ID NO: 3914637 - DNA, 20 bp, Homo sapiens
taaatgcaaacactgtgtat

SEQ ID NO: 3914638 - DNA, 16 bp, Homo sapiens
taaatgcataaatgca

SEQ ID NO: 3914639 - DNA, 15 bp, Homo sapiens
taaatgcatgatttt

SEQ ID NO: 3914640 - DNA, 16 bp, Homo sapiens
taaatgcatgatttta

SEQ ID NO: 3914641 - DNA, 21 bp, Homo sapiens
taaatgcatgattttatacat

SEQ ID NO: 3914642 - DNA, 14 bp, Homo sapiens
taaatgcattatag

SEQ ID NO: 3914643 - DNA, 17 bp, Homo sapiens
taaatgctttatgcaaa

SEQ ID NO: 3914644 - DNA, 11 bp, Homo sapiens
taaatggaaat

SEQ ID NO: 3914645 - DNA, 20 bp, Homo sapiens
taaatggagcttgtacatat

SEQ ID NO: 3914646 - DNA, 17 bp, Homo sapiens
taaatggggctcacaaa

SEQ ID NO: 3914647 - DNA, 20 bp, Homo sapiens
taaatggtgggaaccctccc

SEQ ID NO: 3914648 - DNA, 23 bp, Homo sapiens
taaatggtgggaaccctccccaa

SEQ ID NO: 3914649 - DNA, 21 bp, Homo sapiens
taaatgtaccttcagaataag

SEQ ID NO: 3914650 - DNA, 13 bp, Homo sapiens
taaatgtatatac

SEQ ID NO: 3914651 - DNA, 14 bp, Homo sapiens
taaatgtatataca

SEQ ID NO: 3914652 - DNA, 20 bp, Homo sapiens
taaatgtgtggtgctaactg

SEQ ID NO: 3914653 - DNA, 12 bp, Homo sapiens
taaatgtttaaa

SEQ ID NO: 3914654 - DNA, 13 bp, Homo sapiens
taaatgttttaca

SEQ ID NO: 3914655 - DNA, 21 bp, Homo sapiens
taaatgttttacaagaattgt

SEQ ID NO: 3914656 - DNA, 14 bp, Homo sapiens
taaattaagacttt

SEQ ID NO: 3914657 - DNA, 17 bp, Homo sapiens
taaattaagactttaaa

SEQ ID NO: 3914658 - DNA, 22 bp, Homo sapiens
taaattaggaggctcaacaata

SEQ ID NO: 3914659 - DNA, 14 bp, Homo sapiens
taaattatttttat

SEQ ID NO: 3914660 - DNA, 21 bp, Homo sapiens
taaattctttatttctgtcat

SEQ ID NO: 3914661 - DNA, 20 bp, Homo sapiens
taaattgaaatataatgcaa

SEQ ID NO: 3914662 - DNA, 23 bp, Homo sapiens
taaattgcttttgttgtgacttt

SEQ ID NO: 3914663 - DNA, 20 bp, Homo sapiens
taaattggaaacattttctt

SEQ ID NO: 3914664 - DNA, 17 bp, Homo sapiens
taaattggtgataagtg

SEQ ID NO: 3914665 - DNA, 20 bp, Homo sapiens
taaattggtgataagtggaa

SEQ ID NO: 3914666 - DNA, 23 bp, Homo sapiens
taaattggtgataagtggaaaaa

SEQ ID NO: 3914667 - DNA, 23 bp, Homo sapiens
taaattgtttggcttcctcctga

SEQ ID NO: 3914668 - DNA, 20 bp, Homo sapiens
taaatttaataaaaacttca

SEQ ID NO: 3914669 - DNA, 17 bp, Homo sapiens
taaatttatttcaaaaa

SEQ ID NO: 3914670 - DNA, 16 bp, Homo sapiens
taaattttgaatgttt

SEQ ID NO: 3914671 - DNA, 17 bp, Homo sapiens
taaattttgtttcagaa

SEQ ID NO: 3914672 - DNA, 14 bp, Homo sapiens
taaatttttgtcat

SEQ ID NO: 3914673 - DNA, 14 bp, Homo sapiens
taacaaaacaagaa

SEQ ID NO: 3914674 - DNA, 15 bp, Homo sapiens
taacaaaacaagaaa

SEQ ID NO: 3914675 - DNA, 14 bp, Homo sapiens
taacaaaatcacaa

SEQ ID NO: 3914676 - DNA, 20 bp, Homo sapiens
taacaaactacatgtaatcc

SEQ ID NO: 3914677 - DNA, 11 bp, Homo sapiens
taacaacaatg

SEQ ID NO: 3914678 - DNA, 17 bp, Homo sapiens
taacaaccaaccaacca

SEQ ID NO: 3914679 - DNA, 14 bp, Homo sapiens
taacaactccctga

SEQ ID NO: 3914680 - DNA, 12 bp, Homo sapiens
taacaaggtgtc

SEQ ID NO: 3914681 - DNA, 19 bp, Homo sapiens
taacaaggtgtcttttcca

SEQ ID NO: 3914682 - DNA, 19 bp, Homo sapiens
taaaatataaattaagact

SEQ ID NO: 3914683 - DNA, 16 bp, Homo sapiens
taaaatatatataaat

SEQ ID NO: 3914684 - DNA, 17 bp, Homo sapiens
taaaatatatataaata

SEQ ID NO: 3914685 - DNA, 16 bp, Homo sapiens
taaaatatcctcaggg

SEQ ID NO: 3914686 - DNA, 14 bp, Homo sapiens
taaaatatggctat

SEQ ID NO: 3914687 - DNA, 15 bp, Homo sapiens
taaaatcattcaata

SEQ ID NO: 3914688 - DNA, 20 bp, Homo sapiens
taaaatcattcaatatctga

SEQ ID NO: 3914689 - DNA, 13 bp, Homo sapiens
taaaatcatttct

SEQ ID NO: 3914690 - DNA, 16 bp, Homo sapiens
taaaatctgatttaat

SEQ ID NO: 3914691 - DNA, 17 bp, Homo sapiens
taaaatctgatttaatg

SEQ ID NO: 3914692 - DNA, 21 bp, Homo sapiens
taaaatctgatttaatgtttt

SEQ ID NO: 3914693 - DNA, 16 bp, Homo sapiens
taaaatctggaaatct

SEQ ID NO: 3914694 - DNA, 16 bp, Homo sapiens
taaaatgaaatgtctt

SEQ ID NO: 3914695 - DNA, 14 bp, Homo sapiens
taaaatgattgtaa

SEQ ID NO: 3914696 - DNA, 22 bp, Homo sapiens
taaaatgattgtaaaatagctt

SEQ ID NO: 3914697 - DNA, 17 bp, Homo sapiens
taaaatgcagtccagaa

SEQ ID NO: 3914698 - DNA, 18 bp, Homo sapiens
taaaatgcagtccagaat

SEQ ID NO: 3914699 - DNA, 15 bp, Homo sapiens
taaaattatggtgaa

SEQ ID NO: 3914700 - DNA, 22 bp, Homo sapiens
taaaattgacaacattttatta

SEQ ID NO: 3914701 - DNA, 16 bp, Homo sapiens
taaaattgtaaaattg

SEQ ID NO: 3914702 - DNA, 19 bp, Homo sapiens
taaaattgtaaaattgtat

SEQ ID NO: 3914703 - DNA, 17 bp, Homo sapiens
taaaattgtgatgtttt

SEQ ID NO: 3914704 - DNA, 18 bp, Homo sapiens
taaaattgtgatgttttg

SEQ ID NO: 3914705 - DNA, 22 bp, Homo sapiens
taaacaatttctgcattcttaa

SEQ ID NO: 3914706 - DNA, 23 bp, Homo sapiens
taaacacagaggttttaaacagt

SEQ ID NO: 3914707 - DNA, 11 bp, Homo sapiens
taaacacctga

SEQ ID NO: 3914708 - DNA, 15 bp, Homo sapiens
taaacacgtgtctat

SEQ ID NO: 3914709 - DNA, 16 bp, Homo sapiens
taaacacgtgtctata

SEQ ID NO: 3914710 - DNA, 13 bp, Homo sapiens
taaacactgtaat

SEQ ID NO: 3914711 - DNA, 23 bp, Homo sapiens
taaacagactatttaacttgagg

SEQ ID NO: 3914712 - DNA, 21 bp, Homo sapiens
taaacagatataaatggctgg

SEQ ID NO: 3914713 - DNA, 17 bp, Homo sapiens
taaacagtgcctgctga

SEQ ID NO: 3914714 - DNA, 18 bp, Homo sapiens
taaacagtgcctgctgaa

SEQ ID NO: 3914715 - DNA, 17 bp, Homo sapiens
taaacattaaatgtctt

SEQ ID NO: 3914716 - DNA, 18 bp, Homo sapiens
taaacattaaatgtctta

SEQ ID NO: 3914717 - DNA, 21 bp, Homo sapiens
taaacattaaatgtcttatat

SEQ ID NO: 3914718 - DNA, 22 bp, Homo sapiens
taaaccagcagaaaagtgctta

SEQ ID NO: 3914719 - DNA, 18 bp, Homo sapiens
taaaccagtttagatttc

SEQ ID NO: 3914720 - DNA, 19 bp, Homo sapiens
taaaccagtttagatttca

SEQ ID NO: 3914721 - DNA, 14 bp, Homo sapiens
taaacccaaataaa

SEQ ID NO: 3914722 - DNA, 17 bp, Homo sapiens
taaacccccgctccaga

SEQ ID NO: 3914723 - DNA, 21 bp, Homo sapiens
taaactactgtaattaagtgc

SEQ ID NO: 3914724 - DNA, 22 bp, Homo sapiens
taaactagatctcctatttttc

SEQ ID NO: 3914725 - DNA, 15 bp, Homo sapiens
taaactataaactac

SEQ ID NO: 3914726 - DNA, 19 bp, Homo sapiens
taaactataaactactgta

SEQ ID NO: 3914727 - DNA, 20 bp, Homo sapiens
taaactataaactactgtaa

SEQ ID NO: 3914728 - DNA, 14 bp, Homo sapiens
taaactatattttc

SEQ ID NO: 3914729 - DNA, 13 bp, Homo sapiens
taaactatcagtt

SEQ ID NO: 3914730 - DNA, 20 bp, Homo sapiens
taaactcaaaacttaacata

SEQ ID NO: 3914731 - DNA, 22 bp, Homo sapiens
taaactcaaaatatttgtacat

SEQ ID NO: 3914732 - DNA, 16 bp, Homo sapiens
taaactgaaaaatgtc

SEQ ID NO: 3914733 - DNA, 17 bp, Homo sapiens
taaactgaaaaatgtca

SEQ ID NO: 3914734 - DNA, 12 bp, Homo sapiens
taaacttcagca

SEQ ID NO: 3914735 - DNA, 20 bp, Homo sapiens
taaactttacccaaaaacta

SEQ ID NO: 3914736 - DNA, 11 bp, Homo sapiens
taaagaaagtc

SEQ ID NO: 3914737 - DNA, 17 bp, Homo sapiens
taaagaaagtcgaatta

SEQ ID NO: 3914738 - DNA, 23 bp, Homo sapiens
taaagaactccttattttgtatt

SEQ ID NO: 3914739 - DNA, 20 bp, Homo sapiens
taaagaatatttacaataaa

SEQ ID NO: 3914740 - DNA, 21 bp, Homo sapiens
taaagacagggaagagcagaa

SEQ ID NO: 3914741 - DNA, 20 bp, Homo sapiens
taaagacttaagattaaatt

SEQ ID NO: 3914742 - DNA, 15 bp, Homo sapiens
taaagacttcatgtt

SEQ ID NO: 3914743 - DNA, 16 bp, Homo sapiens
taaagacttcatgttc

SEQ ID NO: 3914744 - DNA, 12 bp, Homo sapiens
taaagagttctt

SEQ ID NO: 3914745 - DNA, 17 bp, Homo sapiens
taaagataaagccagaa

SEQ ID NO: 3914746 - DNA, 14 bp, Homo sapiens
taaagatgtcaaat

SEQ ID NO: 3914747 - DNA, 16 bp, Homo sapiens
taaagcagtagacaat

SEQ ID NO: 3914748 - DNA, 21 bp, Homo sapiens
taaagcatcagagatggtaat

SEQ ID NO: 3914749 - DNA, 22 bp, Homo sapiens
taaagcccataaggccagaaac

SEQ ID NO: 3914750 - DNA, 16 bp, Homo sapiens
taaagcctgcttttta

SEQ ID NO: 3914751 - DNA, 16 bp, Homo sapiens
taaagctgcctgtagt

SEQ ID NO: 3914752 - DNA, 20 bp, Homo sapiens
taaagctggacaagaagctg

SEQ ID NO: 3914753 - DNA, 21 bp, Homo sapiens
taaagctggacaagaagctgc

SEQ ID NO: 3914754 - DNA, 16 bp, Homo sapiens
taaaggagttaagagt

SEQ ID NO: 3914755 - DNA, 19 bp, Homo sapiens
taaaggcaccatctaatag

SEQ ID NO: 3914756 - DNA, 19 bp, Homo sapiens
taaaggcctggaaccaggg

SEQ ID NO: 3914757 - DNA, 17 bp, Homo sapiens
gtttctgagaaaagaac

SEQ ID NO: 3914758 - DNA, 14 bp, Homo sapiens
gtttctgcagtagt

SEQ ID NO: 3914759 - DNA, 18 bp, Homo sapiens
gtttctgcggccttccac

SEQ ID NO: 3914760 - DNA, 13 bp, Homo sapiens
gtttctgcgtgct

SEQ ID NO: 3914761 - DNA, 21 bp, Homo sapiens
gtttcttggggtcccagggaa

SEQ ID NO: 3914762 - DNA, 15 bp, Homo sapiens
gtttctttctgttat

SEQ ID NO: 3914763 - DNA, 18 bp, Homo sapiens
gtttgaaagtgaataaac

SEQ ID NO: 3914764 - DNA, 19 bp, Homo sapiens
gtttgaaagtgaataaact

SEQ ID NO: 3914765 - DNA, 15 bp, Homo sapiens
gtttgacattgtatg

SEQ ID NO: 3914766 - DNA, 13 bp, Homo sapiens
gtttgacctcaca

SEQ ID NO: 3914767 - DNA, 18 bp, Homo sapiens
gtttgagacaagccctgg

SEQ ID NO: 3914768 - DNA, 21 bp, Homo sapiens
gtttgagacaagccctggcaa

SEQ ID NO: 3914769 - DNA, 16 bp, Homo sapiens
gtttgagctcagaccc

SEQ ID NO: 3914770 - DNA, 16 bp, Homo sapiens
gtttgaggttaaaata

SEQ ID NO: 3914771 - DNA, 19 bp, Homo sapiens
gtttgaggttaaaatataa

SEQ ID NO: 3914772 - DNA, 16 bp, Homo sapiens
gtttgccctgcctgca

SEQ ID NO: 3914773 - DNA, 20 bp, Homo sapiens
gtttgctttgtatgcacttt

SEQ ID NO: 3914774 - DNA, 16 bp, Homo sapiens
gtttggacacagtgtt

SEQ ID NO: 3914775 - DNA, 15 bp, Homo sapiens
gtttggcaatagttt

SEQ ID NO: 3914776 - DNA, 13 bp, Homo sapiens
gtttggggagaaa

SEQ ID NO: 3914777 - DNA, 17 bp, Homo sapiens
gtttggggcaggagtag

SEQ ID NO: 3914778 - DNA, 19 bp, Homo sapiens
gtttggtgtaggtaaatct

SEQ ID NO: 3914779 - DNA, 17 bp, Homo sapiens
gtttgtcatatattcat

SEQ ID NO: 3914780 - DNA, 22 bp, Homo sapiens
gtttgtgagcatgggtgtgccc

SEQ ID NO: 3914781 - DNA, 13 bp, Homo sapiens
gtttgttttacaa

SEQ ID NO: 3914782 - DNA, 11 bp, Homo sapiens
gttttaaatta

SEQ ID NO: 3914783 - DNA, 20 bp, Homo sapiens
gttttaaccagtacttctaa

SEQ ID NO: 3914784 - DNA, 19 bp, Homo sapiens
gttttacaaatttttcctg

SEQ ID NO: 3914785 - DNA, 21 bp, Homo sapiens
gttttagctccttgactcctt

SEQ ID NO: 3914786 - DNA, 18 bp, Homo sapiens
gttttatactgtacttaa

SEQ ID NO: 3914787 - DNA, 19 bp, Homo sapiens
gttttatatttttatagac

SEQ ID NO: 3914788 - DNA, 11 bp, Homo sapiens
gttttatcagt

SEQ ID NO: 3914789 - DNA, 14 bp, Homo sapiens
gttttatcatgaca

SEQ ID NO: 3914790 - DNA, 15 bp, Homo sapiens
gttttcatcctggcc

SEQ ID NO: 3914791 - DNA, 23 bp, Homo sapiens
gttttcccgagcaaagtctaaag

SEQ ID NO: 3914792 - DNA, 19 bp, Homo sapiens
gttttcctttgtcatcatt

SEQ ID NO: 3914793 - DNA, 15 bp, Homo sapiens
gttttctaactgtaa

SEQ ID NO: 3914794 - DNA, 20 bp, Homo sapiens
gttttctaactgtaaatcac

SEQ ID NO: 3914795 - DNA, 23 bp, Homo sapiens
gttttctaactgtaaatcacttg

SEQ ID NO: 3914796 - DNA, 15 bp, Homo sapiens
gttttctgagaaaga

SEQ ID NO: 3914797 - DNA, 15 bp, Homo sapiens
gttttctgctgttta

SEQ ID NO: 3914798 - DNA, 20 bp, Homo sapiens
gttttcttcccatcactgga

SEQ ID NO: 3914799 - DNA, 15 bp, Homo sapiens
gttttctttgtaaag

SEQ ID NO: 3914800 - DNA, 19 bp, Homo sapiens
gttttctttgtaaaggtca

SEQ ID NO: 3914801 - DNA, 14 bp, Homo sapiens
gttttgaaagaaaa

SEQ ID NO: 3914802 - DNA, 17 bp, Homo sapiens
gttttgaactaataaaa

SEQ ID NO: 3914803 - DNA, 16 bp, Homo sapiens
gttttgatatgagtat

SEQ ID NO: 3914804 - DNA, 21 bp, Homo sapiens
gttttgatgaaattcttgaag

SEQ ID NO: 3914805 - DNA, 21 bp, Homo sapiens
gtttttaagggtttgtggaaa

SEQ ID NO: 3914806 - DNA, 15 bp, Homo sapiens
gtttttaagtcctgt

SEQ ID NO: 3914807 - DNA, 11 bp, Homo sapiens
gtttttagttt

SEQ ID NO: 3914808 - DNA, 20 bp, Homo sapiens
gtttttatgatatccctgat

SEQ ID NO: 3914809 - DNA, 19 bp, Homo sapiens
gtttttttgtatagtaaag

SEQ ID NO: 3914810 - DNA, 16 bp, Homo sapiens
taaaaaaaagaaatga

SEQ ID NO: 3914811 - DNA, 12 bp, Homo sapiens
taaaaaaaagcc

SEQ ID NO: 3914812 - DNA, 21 bp, Homo sapiens
taaaaaaacaatcatttgctt

SEQ ID NO: 3914813 - DNA, 12 bp, Homo sapiens
taaaaaatacac

SEQ ID NO: 3914814 - DNA, 15 bp, Homo sapiens
taaaaaatgaaaata

SEQ ID NO: 3914815 - DNA, 16 bp, Homo sapiens
taaaaaattaaagccc

SEQ ID NO: 3914816 - DNA, 18 bp, Homo sapiens
taaaaaattaaagcccat

SEQ ID NO: 3914817 - DNA, 15 bp, Homo sapiens
taaaaacataaaata

SEQ ID NO: 3914818 - DNA, 17 bp, Homo sapiens
taaaaacataaaatata

SEQ ID NO: 3914819 - DNA, 17 bp, Homo sapiens
taaaaaccaatcatttt

SEQ ID NO: 3914820 - DNA, 17 bp, Homo sapiens
taaaaaccagaatcata

SEQ ID NO: 3914821 - DNA, 18 bp, Homo sapiens
taaaaaccagaatcataa

SEQ ID NO: 3914822 - DNA, 21 bp, Homo sapiens
taaaaaccagaatcataattt

SEQ ID NO: 3914823 - DNA, 17 bp, Homo sapiens
taaaaacttcagaaaaa

SEQ ID NO: 3914824 - DNA, 17 bp, Homo sapiens
taaaaagaaaagataaa

SEQ ID NO: 3914825 - DNA, 13 bp, Homo sapiens
taaaaatatatat

SEQ ID NO: 3914826 - DNA, 19 bp, Homo sapiens
taaaaatatggaacttcta

SEQ ID NO: 3914827 - DNA, 15 bp, Homo sapiens
taaaacacatcaagt

SEQ ID NO: 3914828 - DNA, 14 bp, Homo sapiens
taaaaccacagcag

SEQ ID NO: 3914829 - DNA, 22 bp, Homo sapiens
taaaaccatgcagcttcatcaa

SEQ ID NO: 3914830 - DNA, 15 bp, Homo sapiens
taaaacccagcatgt

SEQ ID NO: 3914831 - DNA, 14 bp, Homo sapiens
taaaaccttgattt

SEQ ID NO: 3914832 - DNA, 14 bp, Homo sapiens
taaaacctttcaaa

SEQ ID NO: 3914833 - DNA, 21 bp, Homo sapiens
taaaacctttcaaatttcaca

SEQ ID NO: 3914834 - DNA, 20 bp, Homo sapiens
taaaactaaatatatgtctg

SEQ ID NO: 3914835 - DNA, 18 bp, Homo sapiens
taaaactatggttcccaa

SEQ ID NO: 3914836 - DNA, 21 bp, Homo sapiens
taaaactatggttcccaataa

SEQ ID NO: 3914837 - DNA, 22 bp, Homo sapiens
taaaactatggttcccaataaa

SEQ ID NO: 3914838 - DNA, 17 bp, Homo sapiens
taaaagaatattcagag

SEQ ID NO: 3914839 - DNA, 18 bp, Homo sapiens
taaaagactgcagctgct

SEQ ID NO: 3914840 - DNA, 15 bp, Homo sapiens
taaaagcataaatgc

SEQ ID NO: 3914841 - DNA, 13 bp, Homo sapiens
taaaagccacata

SEQ ID NO: 3914842 - DNA, 14 bp, Homo sapiens
taaaaggagagaag

SEQ ID NO: 3914843 - DNA, 14 bp, Homo sapiens
tattaataaatttt

SEQ ID NO: 3914844 - DNA, 15 bp, Homo sapiens
tattaataaatttta

SEQ ID NO: 3914845 - DNA, 22 bp, Homo sapiens
tattaataaattttaacatttt

SEQ ID NO: 3914846 - DNA, 15 bp, Homo sapiens
tattaattatctgat

SEQ ID NO: 3914847 - DNA, 15 bp, Homo sapiens
tattaccatgagaag

SEQ ID NO: 3914848 - DNA, 14 bp, Homo sapiens
tattacctcaaatt

SEQ ID NO: 3914849 - DNA, 22 bp, Homo sapiens
tattactatgactgctccccag

SEQ ID NO: 3914850 - DNA, 18 bp, Homo sapiens
tattactgtctggtttta

SEQ ID NO: 3914851 - DNA, 12 bp, Homo sapiens
tattacttgaac

SEQ ID NO: 3914852 - DNA, 21 bp, Homo sapiens
tattacttgttgcaaaggtct

SEQ ID NO: 3914853 - DNA, 18 bp, Homo sapiens
tattaggggtaatatatt

SEQ ID NO: 3914854 - DNA, 13 bp, Homo sapiens
tattagttaatat

SEQ ID NO: 3914855 - DNA, 14 bp, Homo sapiens
tattataaataaat

SEQ ID NO: 3914856 - DNA, 15 bp, Homo sapiens
tattataacttaaaa

SEQ ID NO: 3914857 - DNA, 21 bp, Homo sapiens
tattataataatgttctctgg

SEQ ID NO: 3914858 - DNA, 15 bp, Homo sapiens
tattataatttaatg

SEQ ID NO: 3914859 - DNA, 14 bp, Homo sapiens
tattatcacatcaa

SEQ ID NO: 3914860 - DNA, 19 bp, Homo sapiens
tattatgaggctattaaaa

SEQ ID NO: 3914861 - DNA, 20 bp, Homo sapiens
tattatgaggctattaaaag

SEQ ID NO: 3914862 - DNA, 21 bp, Homo sapiens
tattatggaagattttaaatt

SEQ ID NO: 3914863 - DNA, 17 bp, Homo sapiens
tattatggtgtaatgca

SEQ ID NO: 3914864 - DNA, 22 bp, Homo sapiens
tattatggtgtaatgcacaatt

SEQ ID NO: 3914865 - DNA, 20 bp, Homo sapiens
tattatgtaacatccagaag

SEQ ID NO: 3914866 - DNA, 13 bp, Homo sapiens
tattatgtgttca

SEQ ID NO: 3914867 - DNA, 16 bp, Homo sapiens
tattattcaagtgcct

SEQ ID NO: 3914868 - DNA, 16 bp, Homo sapiens
tattattcccattcta

SEQ ID NO: 3914869 - DNA, 14 bp, Homo sapiens
tattattgaagatt

SEQ ID NO: 3914870 - DNA, 20 bp, Homo sapiens
tattcaagttattgtacagc

SEQ ID NO: 3914871 - DNA, 23 bp, Homo sapiens
tattcaataaaaaaaagaaatga

SEQ ID NO: 3914872 - DNA, 13 bp, Homo sapiens
tattcaataaagc

SEQ ID NO: 3914873 - DNA, 20 bp, Homo sapiens
tattcactgtaagtttattt

SEQ ID NO: 3914874 - DNA, 14 bp, Homo sapiens
tattcagacaagca

SEQ ID NO: 3914875 - DNA, 18 bp, Homo sapiens
tattcagacaagcaacag

SEQ ID NO: 3914876 - DNA, 17 bp, Homo sapiens
tattcagagaatatcaa

SEQ ID NO: 3914877 - DNA, 20 bp, Homo sapiens
tattcatgggtgtcagcttt

SEQ ID NO: 3914878 - DNA, 13 bp, Homo sapiens
tattcatgtaata

SEQ ID NO: 3914879 - DNA, 14 bp, Homo sapiens
tattcatgtaataa

SEQ ID NO: 3914880 - DNA, 16 bp, Homo sapiens
tattcatgtaataaat

SEQ ID NO: 3914881 - DNA, 17 bp, Homo sapiens
tattcatgtaataaatc

SEQ ID NO: 3914882 - DNA, 20 bp, Homo sapiens
tattcattcagtgagacaca

SEQ ID NO: 3914883 - DNA, 22 bp, Homo sapiens
tattcccaactgctctgcccac

SEQ ID NO: 3914884 - DNA, 17 bp, Homo sapiens
tattccccattcttcct

SEQ ID NO: 3914885 - DNA, 21 bp, Homo sapiens
tattcctatatagtttattga

SEQ ID NO: 3914886 - DNA, 22 bp, Homo sapiens
tattcctatatagtttattgac

SEQ ID NO: 3914887 - DNA, 17 bp, Homo sapiens
tattcctatctgtggat

SEQ ID NO: 3914888 - DNA, 19 bp, Homo sapiens
tattcctgcatttgtgaaa

SEQ ID NO: 3914889 - DNA, 22 bp, Homo sapiens
tattccttgatactaaaagttc

SEQ ID NO: 3914890 - DNA, 19 bp, Homo sapiens
tattccttttgtgtacagt

SEQ ID NO: 3914891 - DNA, 13 bp, Homo sapiens
tattctcactcca

SEQ ID NO: 3914892 - DNA, 16 bp, Homo sapiens
tattctcactccacca

SEQ ID NO: 3914893 - DNA, 19 bp, Homo sapiens
tattctcactccaccaccc

SEQ ID NO: 3914894 - DNA, 11 bp, Homo sapiens
tattctgagcc

SEQ ID NO: 3914895 - DNA, 14 bp, Homo sapiens
tattctgattccac

SEQ ID NO: 3914896 - DNA, 22 bp, Homo sapiens
tattctgggctcctggaaccaa

SEQ ID NO: 3914897 - DNA, 17 bp, Homo sapiens
tattctgttttcttgtt

SEQ ID NO: 3914898 - DNA, 19 bp, Homo sapiens
tattgaaattactgaaaac

SEQ ID NO: 3914899 - DNA, 15 bp, Homo sapiens
tattgaactgagcca

SEQ ID NO: 3914900 - DNA, 13 bp, Homo sapiens
tattgaagaaaca

SEQ ID NO: 3914901 - DNA, 21 bp, Homo sapiens
tattgaatatatcagaatctg

SEQ ID NO: 3914902 - DNA, 18 bp, Homo sapiens
tattgagaattttaaatt

SEQ ID NO: 3914903 - DNA, 14 bp, Homo sapiens
tattgatgtttcca

SEQ ID NO: 3914904 - DNA, 19 bp, Homo sapiens
tattgcactatgaaaatca

SEQ ID NO: 3914905 - DNA, 18 bp, Homo sapiens
tattgcactcagcttttt

SEQ ID NO: 3914906 - DNA, 18 bp, Homo sapiens
tattgcatgtaaaatgca

SEQ ID NO: 3914907 - DNA, 15 bp, Homo sapiens
tattggaccagaagt

SEQ ID NO: 3914908 - DNA, 16 bp, Homo sapiens
tattggaccagaagtc

SEQ ID NO: 3914909 - DNA, 17 bp, Homo sapiens
tattgggagggatgaga

SEQ ID NO: 3914910 - DNA, 22 bp, Homo sapiens
tattggggttggttggggtggg

SEQ ID NO: 3914911 - DNA, 13 bp, Homo sapiens
tattggtccagct

SEQ ID NO: 3914912 - DNA, 20 bp, Homo sapiens
tattgtacactaacatattt

SEQ ID NO: 3914913 - DNA, 20 bp, Homo sapiens
tattgtacagctgtttaaga

SEQ ID NO: 3914914 - DNA, 17 bp, Homo sapiens
tattgtatattctggaa

SEQ ID NO: 3914915 - DNA, 12 bp, Homo sapiens
tattgtattaag

SEQ ID NO: 3914916 - DNA, 17 bp, Homo sapiens
tattgtccttcagagct

SEQ ID NO: 3914917 - DNA, 18 bp, Homo sapiens
tattgtccttcagagctc

SEQ ID NO: 3914918 - DNA, 22 bp, Homo sapiens
tattgtgcctatgataaattca

SEQ ID NO: 3914919 - DNA, 17 bp, Homo sapiens
tattgtttaaaatcatt

SEQ ID NO: 3914920 - DNA, 22 bp, Homo sapiens
tattgtttattctttttaaagt

SEQ ID NO: 3914921 - DNA, 16 bp, Homo sapiens
tattgttttatgttct

SEQ ID NO: 3914922 - DNA, 23 bp, Homo sapiens
tatttaaaagtataaaactgctt

SEQ ID NO: 3914923 - DNA, 14 bp, Homo sapiens
tatttaaagacagg

SEQ ID NO: 3914924 - DNA, 22 bp, Homo sapiens
tatttaaagacagggaagagca

SEQ ID NO: 3914925 - DNA, 14 bp, Homo sapiens
tatttaacttgagg

SEQ ID NO: 3914926 - DNA, 21 bp, Homo sapiens
tatttaacttgagggtaataa

SEQ ID NO: 3914927 - DNA, 13 bp, Homo sapiens
tatttaagaataa

SEQ ID NO: 3914928 - DNA, 16 bp, Homo sapiens
tatttaagcttatgtc

SEQ ID NO: 3914929 - DNA, 21 bp, Homo sapiens
tatatttaatacctttggaaa

SEQ ID NO: 3914930 - DNA, 19 bp, Homo sapiens
tatatttaatttttacatg

SEQ ID NO: 3914931 - DNA, 21 bp, Homo sapiens
tatatttagaccctgtttcct

SEQ ID NO: 3914932 - DNA, 14 bp, Homo sapiens
tatatttatactct

SEQ ID NO: 3914933 - DNA, 22 bp, Homo sapiens
tatatttatcaaacttgtgctg

SEQ ID NO: 3914934 - DNA, 14 bp, Homo sapiens
tatatttgaaattt

SEQ ID NO: 3914935 - DNA, 11 bp, Homo sapiens
tatatttggaa

SEQ ID NO: 3914936 - DNA, 17 bp, Homo sapiens
tatatttggaaagagac

SEQ ID NO: 3914937 - DNA, 12 bp, Homo sapiens
tatattttcctc

SEQ ID NO: 3914938 - DNA, 18 bp, Homo sapiens
tatatttttcaaccagca

SEQ ID NO: 3914939 - DNA, 15 bp, Homo sapiens
tatatttttcacagt

SEQ ID NO: 3914940 - DNA, 15 bp, Homo sapiens
tatcaaaacatatca

SEQ ID NO: 3914941 - DNA, 19 bp, Homo sapiens
tatcaaaacatatcaattc

SEQ ID NO: 3914942 - DNA, 22 bp, Homo sapiens
tatcaaaacatatcaattcaac

SEQ ID NO: 3914943 - DNA, 12 bp, Homo sapiens
tatcaaaagaca

SEQ ID NO: 3914944 - DNA, 20 bp, Homo sapiens
tatcaaacagaattttaaag

SEQ ID NO: 3914945 - DNA, 14 bp, Homo sapiens
tatcaaacttgtgc

SEQ ID NO: 3914946 - DNA, 15 bp, Homo sapiens
tatcaatagtcaaga

SEQ ID NO: 3914947 - DNA, 13 bp, Homo sapiens
tatcaattacagt

SEQ ID NO: 3914948 - DNA, 17 bp, Homo sapiens
tatcaattcaacacatt

SEQ ID NO: 3914949 - DNA, 20 bp, Homo sapiens
tatcaattcaacacattact

SEQ ID NO: 3914950 - DNA, 16 bp, Homo sapiens
tatcacaaatcttaac

SEQ ID NO: 3914951 - DNA, 14 bp, Homo sapiens
tatcacatacaatt

SEQ ID NO: 3914952 - DNA, 17 bp, Homo sapiens
tatcacatacaatttgc

SEQ ID NO: 3914953 - DNA, 22 bp, Homo sapiens
tatcacatacaatttgcactgt

SEQ ID NO: 3914954 - DNA, 14 bp, Homo sapiens
tatcacctcatggc

SEQ ID NO: 3914955 - DNA, 16 bp, Homo sapiens
tatcacctctcttcag

SEQ ID NO: 3914956 - DNA, 23 bp, Homo sapiens
tatcacgtacaccatatgcaagt

SEQ ID NO: 3914957 - DNA, 19 bp, Homo sapiens
tatcagaaaagtagaatta

SEQ ID NO: 3914958 - DNA, 22 bp, Homo sapiens
tatcagaaaagtagaattatat

SEQ ID NO: 3914959 - DNA, 16 bp, Homo sapiens
tatcagaatctgtgtg

SEQ ID NO: 3914960 - DNA, 14 bp, Homo sapiens
tatcagacctctga

SEQ ID NO: 3914961 - DNA, 22 bp, Homo sapiens
tatcagagctcttaatgttgct

SEQ ID NO: 3914962 - DNA, 18 bp, Homo sapiens
tatcagctacttaagaga

SEQ ID NO: 3914963 - DNA, 20 bp, Homo sapiens
tatcagctacttaagagaaa

SEQ ID NO: 3914964 - DNA, 21 bp, Homo sapiens
tatcagctacttaagagaaat

SEQ ID NO: 3914965 - DNA, 15 bp, Homo sapiens
tatcaggcacaggca

SEQ ID NO: 3914966 - DNA, 17 bp, Homo sapiens
tatcaggcacaggcagg

SEQ ID NO: 3914967 - DNA, 23 bp, Homo sapiens
tatcaggtctcccacgtgggaga

SEQ ID NO: 3914968 - DNA, 18 bp, Homo sapiens
tatcagttactcagccct

SEQ ID NO: 3914969 - DNA, 14 bp, Homo sapiens
tatcatagaaatgt

SEQ ID NO: 3914970 - DNA, 18 bp, Homo sapiens
tatcatagaaatgtaact

SEQ ID NO: 3914971 - DNA, 21 bp, Homo sapiens
tatcatcagcatacctttatt

SEQ ID NO: 3914972 - DNA, 17 bp, Homo sapiens
tatcatgaaacacttct

SEQ ID NO: 3914973 - DNA, 23 bp, Homo sapiens
tatcatgaaacacttctcatcat

SEQ ID NO: 3914974 - DNA, 23 bp, Homo sapiens
tatcatgctttaaagtgtaataa

SEQ ID NO: 3914975 - DNA, 21 bp, Homo sapiens
tatcattaatgtaggtttaga

SEQ ID NO: 3914976 - DNA, 15 bp, Homo sapiens
tatccaccactttaa

SEQ ID NO: 3914977 - DNA, 12 bp, Homo sapiens
tatccacccagc

SEQ ID NO: 3914978 - DNA, 19 bp, Homo sapiens
tatccacccagcccattct

SEQ ID NO: 3914979 - DNA, 18 bp, Homo sapiens
tatccactttgcacagct

SEQ ID NO: 3914980 - DNA, 11 bp, Homo sapiens
tatccaggact

SEQ ID NO: 3914981 - DNA, 19 bp, Homo sapiens
tatccagtgatgtgctgga

SEQ ID NO: 3914982 - DNA, 17 bp, Homo sapiens
tatcccaaacttcggaa

SEQ ID NO: 3914983 - DNA, 20 bp, Homo sapiens
tatcccacccaacagctcag

SEQ ID NO: 3914984 - DNA, 23 bp, Homo sapiens
tatcccacccaacagctcagaga

SEQ ID NO: 3914985 - DNA, 18 bp, Homo sapiens
tatcctgctagctgtaga

SEQ ID NO: 3914986 - DNA, 18 bp, Homo sapiens
tatccttaggaaaatgct

SEQ ID NO: 3914987 - DNA, 22 bp, Homo sapiens
tatccttaggaaaatgcttctg

SEQ ID NO: 3914988 - DNA, 16 bp, Homo sapiens
tatccttggagagcag

SEQ ID NO: 3914989 - DNA, 17 bp, Homo sapiens
tatccttggagagcagc

SEQ ID NO: 3914990 - DNA, 18 bp, Homo sapiens
tatccttggagagcagct

SEQ ID NO: 3914991 - DNA, 15 bp, Homo sapiens
tatctaatttataca

SEQ ID NO: 3914992 - DNA, 18 bp, Homo sapiens
tatctaatttatacaaaa

SEQ ID NO: 3914993 - DNA, 16 bp, Homo sapiens
tatctacccagaatta

SEQ ID NO: 3914994 - DNA, 19 bp, Homo sapiens
tatctacctgccctctctc

SEQ ID NO: 3914995 - DNA, 20 bp, Homo sapiens
tatctactgataaagaaaga

SEQ ID NO: 3914996 - DNA, 18 bp, Homo sapiens
tatctagaaagaaaagac

SEQ ID NO: 3914997 - DNA, 22 bp, Homo sapiens
tatctatagtagtcaattagta

SEQ ID NO: 3914998 - DNA, 21 bp, Homo sapiens
tatctatggccctgcaaaaat

SEQ ID NO: 3914999 - DNA, 23 bp, Homo sapiens
tatctccttcccctacacctccc

SEQ ID NO: 3915000 - DNA, 18 bp, Homo sapiens
tatctctatttaatattt

SEQ ID NO: 3915001 - DNA, 13 bp, Homo sapiens
tatctctctgcct

SEQ ID NO: 3915002 - DNA, 11 bp, Homo sapiens
tatctgcattt

SEQ ID NO: 3915003 - DNA, 18 bp, Homo sapiens
tatctgcatttataaatg

SEQ ID NO: 3915004 - DNA, 14 bp, Homo sapiens
tatctgcctggcct

SEQ ID NO: 3915005 - DNA, 18 bp, Homo sapiens
tatctgcctggcctggct

SEQ ID NO: 3915006 - DNA, 18 bp, Homo sapiens
tatctggacaagccaact

SEQ ID NO: 3915007 - DNA, 14 bp, Homo sapiens
tatcttcacatagt

SEQ ID NO: 3915008 - DNA, 14 bp, Homo sapiens
tatcttgaatttca

SEQ ID NO: 3915009 - DNA, 23 bp, Homo sapiens
tatcttttctattgtttattctt

SEQ ID NO: 3915010 - DNA, 18 bp, Homo sapiens
tatgaaaaacaaaaataa

SEQ ID NO: 3915011 - DNA, 20 bp, Homo sapiens
tatgaaagatggctgtgcct

SEQ ID NO: 3915012 - DNA, 23 bp, Homo sapiens
tcatcaggcttggaatgaattct

SEQ ID NO: 3915013 - DNA, 20 bp, Homo sapiens
tcatcatattgtatgtaagt

SEQ ID NO: 3915014 - DNA, 19 bp, Homo sapiens
tcatcattgtatatatgtg

SEQ ID NO: 3915015 - DNA, 14 bp, Homo sapiens
tcatccagttgcaa

SEQ ID NO: 3915016 - DNA, 15 bp, Homo sapiens
tcatccagttgcaat

SEQ ID NO: 3915017 - DNA, 16 bp, Homo sapiens
tcatccagttgcaata

SEQ ID NO: 3915018 - DNA, 13 bp, Homo sapiens
tcaaatctattca

SEQ ID NO: 3915019 - DNA, 17 bp, Homo sapiens
tcaaatctattcagaca

SEQ ID NO: 3915020 - DNA, 21 bp, Homo sapiens
tcaaatgacccaaagaccaat

SEQ ID NO: 3915021 - DNA, 23 bp, Homo sapiens
tcaaatgcgcgtgtgcacgtgtg

SEQ ID NO: 3915022 - DNA, 16 bp, Homo sapiens
tcaaatgctaaatgca

SEQ ID NO: 3915023 - DNA, 16 bp, Homo sapiens
tcaaatgtcagagcta

SEQ ID NO: 3915024 - DNA, 19 bp, Homo sapiens
tcaaatgtcattatgtaga

SEQ ID NO: 3915025 - DNA, 20 bp, Homo sapiens
tcaaatgtcattatgtagaa

SEQ ID NO: 3915026 - DNA, 16 bp, Homo sapiens
tcaaattttgcattgt

SEQ ID NO: 3915027 - DNA, 20 bp, Homo sapiens
tcaaattttgcattgtgtga

SEQ ID NO: 3915028 - DNA, 17 bp, Homo sapiens
tcaacaacaaaccaaaa

SEQ ID NO: 3915029 - DNA, 15 bp, Homo sapiens
tcaacaataaaacat

SEQ ID NO: 3915030 - DNA, 14 bp, Homo sapiens
tcaacacattactt

SEQ ID NO: 3915031 - DNA, 17 bp, Homo sapiens
tcaacacattacttgca

SEQ ID NO: 3915032 - DNA, 14 bp, Homo sapiens
tcaacactcttctt

SEQ ID NO: 3915033 - DNA, 13 bp, Homo sapiens
tcaacatatcatt

SEQ ID NO: 3915034 - DNA, 19 bp, Homo sapiens
tcaacattcaaagcagcag

SEQ ID NO: 3915035 - DNA, 15 bp, Homo sapiens
tcaaccaatgtagaa

SEQ ID NO: 3915036 - DNA, 24 bp, Homo sapiens
tcaaccagaaaacttagaaataag

SEQ ID NO: 3915037 - DNA, 14 bp, Homo sapiens
tcaaccagcatttt

SEQ ID NO: 3915038 - DNA, 18 bp, Homo sapiens
tcaaccattccccatggg

SEQ ID NO: 3915039 - DNA, 21 bp, Homo sapiens
tcaacctaccaccccttcctg

SEQ ID NO: 3915040 - DNA, 19 bp, Homo sapiens
tcaacctggtggcaccaga

SEQ ID NO: 3915041 - DNA, 12 bp, Homo sapiens
tcaactggctgg

SEQ ID NO: 3915042 - DNA, 16 bp, Homo sapiens
tcaactggctgggaca

SEQ ID NO: 3915043 - DNA, 21 bp, Homo sapiens
tcaacttggaaaaagaaagaa

SEQ ID NO: 3915044 - DNA, 16 bp, Homo sapiens
tcaagaaaaaataaat

SEQ ID NO: 3915045 - DNA, 18 bp, Homo sapiens
tcaagaaaaattattgta

SEQ ID NO: 3915046 - DNA, 17 bp, Homo sapiens
tcaagaaactgaggaat

SEQ ID NO: 3915047 - DNA, 18 bp, Homo sapiens
tcaagaaactgaggaatt

SEQ ID NO: 3915048 - DNA, 20 bp, Homo sapiens
tcaagaaactgaggaatttt

SEQ ID NO: 3915049 - DNA, 23 bp, Homo sapiens
tcaagaaactgaggaattttctt

SEQ ID NO: 3915050 - DNA, 21 bp, Homo sapiens
tcaagaaagcttcaaactgca

SEQ ID NO: 3915051 - DNA, 15 bp, Homo sapiens
tcaagaatattcaaa

SEQ ID NO: 3915052 - DNA, 14 bp, Homo sapiens
tcaagaatcctctg

SEQ ID NO: 3915053 - DNA, 14 bp, Homo sapiens
tcaagaccagcctg

SEQ ID NO: 3915054 - DNA, 11 bp, Homo sapiens
tcaagaggccc

SEQ ID NO: 3915055 - DNA, 13 bp, Homo sapiens
tcaagaggcccag

SEQ ID NO: 3915056 - DNA, 20 bp, Homo sapiens
tcaagattatattataataa

SEQ ID NO: 3915057 - DNA, 21 bp, Homo sapiens
tcaagattttttttgtaactt

SEQ ID NO: 3915058 - DNA, 16 bp, Homo sapiens
tcaagcactaaaaagt

SEQ ID NO: 3915059 - DNA, 13 bp, Homo sapiens
tcaagcatgcaat

SEQ ID NO: 3915060 - DNA, 19 bp, Homo sapiens
tcaagccagcaacacagag

SEQ ID NO: 3915061 - DNA, 15 bp, Homo sapiens
tcaagcgattctcat

SEQ ID NO: 3915062 - DNA, 20 bp, Homo sapiens
tcaagcgattcttgtgcctc

SEQ ID NO: 3915063 - DNA, 18 bp, Homo sapiens
tcaagctagaaggccaca

SEQ ID NO: 3915064 - DNA, 19 bp, Homo sapiens
tcaagctgtcccctctgtc

SEQ ID NO: 3915065 - DNA, 21 bp, Homo sapiens
tcaagctgtcccctctgtcat

SEQ ID NO: 3915066 - DNA, 15 bp, Homo sapiens
tcaaggaatcctgag

SEQ ID NO: 3915067 - DNA, 17 bp, Homo sapiens
tcaaggaccacatgtgt

SEQ ID NO: 3915068 - DNA, 17 bp, Homo sapiens
tcaaggagatataaaat

SEQ ID NO: 3915069 - DNA, 13 bp, Homo sapiens
tcaagggaagaaa

SEQ ID NO: 3915070 - DNA, 15 bp, Homo sapiens
tcaagggtccagaag

SEQ ID NO: 3915071 - DNA, 14 bp, Homo sapiens
tcaaggtctgcttt

SEQ ID NO: 3915072 - DNA, 15 bp, Homo sapiens
tcaaggtctgctttt

SEQ ID NO: 3915073 - DNA, 20 bp, Homo sapiens
tcaaggtggccaaattattt

SEQ ID NO: 3915074 - DNA, 23 bp, Homo sapiens
tcaagtcatgatggagacttcag

SEQ ID NO: 3915075 - DNA, 11 bp, Homo sapiens
tcaagtccaga

SEQ ID NO: 3915076 - DNA, 12 bp, Homo sapiens
tcaagtccagag

SEQ ID NO: 3915077 - DNA, 12 bp, Homo sapiens
tcaagtcttccc

SEQ ID NO: 3915078 - DNA, 13 bp, Homo sapiens
tcaagtgatatat

SEQ ID NO: 3915079 - DNA, 16 bp, Homo sapiens
tcaagtgatatatgta

SEQ ID NO: 3915080 - DNA, 21 bp, Homo sapiens
tcaagtgatatatgtatttat

SEQ ID NO: 3915081 - DNA, 19 bp, Homo sapiens
tcaagtgcatgctctctgc

SEQ ID NO: 3915082 - DNA, 15 bp, Homo sapiens
tcaagttgaggggct

SEQ ID NO: 3915083 - DNA, 17 bp, Homo sapiens
tcaagttgaggggcttc

SEQ ID NO: 3915084 - DNA, 16 bp, Homo sapiens
tcaatattaaatacag

SEQ ID NO: 3915085 - DNA, 19 bp, Homo sapiens
tcaatattaaatacagaca

SEQ ID NO: 3915086 - DNA, 22 bp, Homo sapiens
tcaatattaaatacagacacta

SEQ ID NO: 3915087 - DNA, 15 bp, Homo sapiens
tcaatattcaataaa

SEQ ID NO: 3915088 - DNA, 15 bp, Homo sapiens
tcaatcactgctccc

SEQ ID NO: 3915089 - DNA, 14 bp, Homo sapiens
tcaatcagtgcagt

SEQ ID NO: 3915090 - DNA, 16 bp, Homo sapiens
tcaatcatctgtgtga

SEQ ID NO: 3915091 - DNA, 19 bp, Homo sapiens
tcaatcccaaaagtcacca

SEQ ID NO: 3915092 - DNA, 17 bp, Homo sapiens
tcaatcccctcattcag

SEQ ID NO: 3915093 - DNA, 20 bp, Homo sapiens
tcaatcccctcattcaggaa

SEQ ID NO: 3915094 - DNA, 22 bp, Homo sapiens
tcaatcccctcattcaggaaaa

SEQ ID NO: 3915095 - DNA, 20 bp, Homo sapiens
tcaatcttcggggtgtgatg

SEQ ID NO: 3915096 - DNA, 14 bp, Homo sapiens
tcaatgacctgtat

SEQ ID NO: 3915097 - DNA, 16 bp, Homo sapiens
tcaatgcattgtcttg

SEQ ID NO: 3915098 - DNA, 12 bp, Homo sapiens
tcaatgccctgc

SEQ ID NO: 3915099 - DNA, 15 bp, Homo sapiens
tcaatggacttcaaa

SEQ ID NO: 3915100 - DNA, 12 bp, Homo sapiens
tcaatgtgaaaa

SEQ ID NO: 3915101 - DNA, 15 bp, Homo sapiens
tcagactctgggtcc

SEQ ID NO: 3915102 - DNA, 15 bp, Homo sapiens
tcagacttacttact

SEQ ID NO: 3915103 - DNA, 15 bp, Homo sapiens
tcagacttttatcaa

SEQ ID NO: 3915104 - DNA, 22 bp, Homo sapiens
tagcctccgtttatgggccttg

SEQ ID NO: 3915105 - DNA, 17 bp, Homo sapiens
tagcctcctgacctgag

SEQ ID NO: 3915106 - DNA, 20 bp, Homo sapiens
tagcctcgccgtctgtgaat

SEQ ID NO: 3915107 - DNA, 14 bp, Homo sapiens
tagcctgggccaga

SEQ ID NO: 3915108 - DNA, 16 bp, Homo sapiens
tagcctgggccagaga

SEQ ID NO: 3915109 - DNA, 21 bp, Homo sapiens
tagtcttgctttgctgtctgg

SEQ ID NO: 3915110 - DNA, 15 bp, Homo sapiens
tagtcttttactcct

SEQ ID NO: 3915111 - DNA, 18 bp, Homo sapiens
tagtgatggttcccctgt

SEQ ID NO: 3915112 - DNA, 22 bp, Homo sapiens
tagtgctatatatataaatatt

SEQ ID NO: 3915113 - DNA, 17 bp, Homo sapiens
tagtgctattctgtgtt

SEQ ID NO: 3915114 - DNA, 14 bp, Homo sapiens
tagtggaagagcag

SEQ ID NO: 3915115 - DNA, 16 bp, Homo sapiens
tagtggaagagcagcc

SEQ ID NO: 3915116 - DNA, 19 bp, Homo sapiens
tagtggaagagcagcctga

SEQ ID NO: 3915117 - DNA, 23 bp, Homo sapiens
tagtggaagagcagcctgatggc

SEQ ID NO: 3915118 - DNA, 15 bp, Homo sapiens
tagtggcaataagtt

SEQ ID NO: 3915119 - DNA, 20 bp, Homo sapiens
tagtggggtctccctctcct

SEQ ID NO: 3915120 - DNA, 22 bp, Homo sapiens
tagtggggtctccctctcctgc

SEQ ID NO: 3915121 - DNA, 20 bp, Homo sapiens
tagtgtaggtcagcgtgctt

SEQ ID NO: 3915122 - DNA, 19 bp, Homo sapiens
tagtgtgagtggcagccat

SEQ ID NO: 3915123 - DNA, 12 bp, Homo sapiens
tagtgtgtgtgc

SEQ ID NO: 3915124 - DNA, 15 bp, Homo sapiens
tagtgtgtgtgcatg

SEQ ID NO: 3915125 - DNA, 16 bp, Homo sapiens
tagttaggaaataaaa

SEQ ID NO: 3915126 - DNA, 22 bp, Homo sapiens
tagttaggaaataaaacctttc

SEQ ID NO: 3915127 - DNA, 23 bp, Homo sapiens
tagttaggaaataaaacctttca

SEQ ID NO: 3915128 - DNA, 15 bp, Homo sapiens
tagttaggatagcat

SEQ ID NO: 3915129 - DNA, 21 bp, Homo sapiens
tagttaggtgtgccaaactac

SEQ ID NO: 3915130 - DNA, 15 bp, Homo sapiens
tagttattgttttat

SEQ ID NO: 3915131 - DNA, 21 bp, Homo sapiens
tagttattgttttatgttcta

SEQ ID NO: 3915132 - DNA, 17 bp, Homo sapiens
tagttatttacttgaaa

SEQ ID NO: 3915133 - DNA, 23 bp, Homo sapiens
tagttccctgaaaacccagagag

SEQ ID NO: 3915134 - DNA, 17 bp, Homo sapiens
tagttcctttatttaat

SEQ ID NO: 3915135 - DNA, 22 bp, Homo sapiens
tagttctatcaggaaaacaaat

SEQ ID NO: 3915136 - DNA, 15 bp, Homo sapiens
tagtttaattaacta

SEQ ID NO: 3915137 - DNA, 23 bp, Homo sapiens
tagtttaattaactatgtgatgt

SEQ ID NO: 3915138 - DNA, 18 bp, Homo sapiens
tagtttattggaagtgtt

SEQ ID NO: 3915139 - DNA, 18 bp, Homo sapiens
tagtttcagatatatatc

SEQ ID NO: 3915140 - DNA, 17 bp, Homo sapiens
tagtttctagaggcctc

SEQ ID NO: 3915141 - DNA, 20 bp, Homo sapiens
tagtttgacctcacagtgac

SEQ ID NO: 3915142 - DNA, 14 bp, Homo sapiens
tagtttgttttaca

SEQ ID NO: 3915143 - DNA, 20 bp, Homo sapiens
tagttttatggcatgattta

SEQ ID NO: 3915144 - DNA, 14 bp, Homo sapiens
tagtttttcagcta

SEQ ID NO: 3915145 - DNA, 19 bp, Homo sapiens
tataaaaagaaaagataaa

SEQ ID NO: 3915146 - DNA, 23 bp, Homo sapiens
tataaaaagaaaagataaagatg

SEQ ID NO: 3915147 - DNA, 15 bp, Homo sapiens
tataaaacacatcaa

SEQ ID NO: 3915148 - DNA, 16 bp, Homo sapiens
tataaaactgctttgt

SEQ ID NO: 3915149 - DNA, 21 bp, Homo sapiens
tataaaatgcaaaataaatgt

SEQ ID NO: 3915150 - DNA, 18 bp, Homo sapiens
tataaacattaaatgtct

SEQ ID NO: 3915151 - DNA, 18 bp, Homo sapiens
tataaactactgtaatta

SEQ ID NO: 3915152 - DNA, 22 bp, Homo sapiens
tataaactttagagtagcatga

SEQ ID NO: 3915153 - DNA, 15 bp, Homo sapiens
tataaagataaaata

SEQ ID NO: 3915154 - DNA, 21 bp, Homo sapiens
tataaagataaaatatcctca

SEQ ID NO: 3915155 - DNA, 13 bp, Homo sapiens
tataaataaatgc

SEQ ID NO: 3915156 - DNA, 14 bp, Homo sapiens
tataaataaatgcc

SEQ ID NO: 3915157 - DNA, 13 bp, Homo sapiens
tataaataataaa

SEQ ID NO: 3915158 - DNA, 19 bp, Homo sapiens
tataaataataaagaactc

SEQ ID NO: 3915159 - DNA, 12 bp, Homo sapiens
tataaatatata

SEQ ID NO: 3915160 - DNA, 18 bp, Homo sapiens
tataaatgtatatacaca

SEQ ID NO: 3915161 - DNA, 20 bp, Homo sapiens
tataaatgtatatacacata

SEQ ID NO: 3915162 - DNA, 23 bp, Homo sapiens
tataaatgtatatacacatatac

SEQ ID NO: 3915163 - DNA, 12 bp, Homo sapiens
tataaatgttta

SEQ ID NO: 3915164 - DNA, 18 bp, Homo sapiens
tataaattaagactttaa

SEQ ID NO: 3915165 - DNA, 16 bp, Homo sapiens
tataaccattacatgt

SEQ ID NO: 3915166 - DNA, 18 bp, Homo sapiens
tataactagtcctttact

SEQ ID NO: 3915167 - DNA, 13 bp, Homo sapiens
tataactttagaa

SEQ ID NO: 3915168 - DNA, 12 bp, Homo sapiens
tataagcccagc

SEQ ID NO: 3915169 - DNA, 23 bp, Homo sapiens
tataaggagagttcaagcctgtg

SEQ ID NO: 3915170 - DNA, 17 bp, Homo sapiens
tataaggtttaaaaaga

SEQ ID NO: 3915171 - DNA, 21 bp, Homo sapiens
tataagtgcacacagaaatat

SEQ ID NO: 3915172 - DNA, 18 bp, Homo sapiens
tataataatgttctctgg

SEQ ID NO: 3915173 - DNA, 13 bp, Homo sapiens
tataatactaaag

SEQ ID NO: 3915174 - DNA, 20 bp, Homo sapiens
tataatactaaagtgtctat

SEQ ID NO: 3915175 - DNA, 15 bp, Homo sapiens
tataatctatttaca

SEQ ID NO: 3915176 - DNA, 22 bp, Homo sapiens
tataatggaaacatttacaata

SEQ ID NO: 3915177 - DNA, 21 bp, Homo sapiens
tataatggaagagaaatctca

SEQ ID NO: 3915178 - DNA, 22 bp, Homo sapiens
tataatgtggatttcctatttt

SEQ ID NO: 3915179 - DNA, 12 bp, Homo sapiens
tataatgtgtgt

SEQ ID NO: 3915180 - DNA, 19 bp, Homo sapiens
tataatgtgtgtatgtgta

SEQ ID NO: 3915181 - DNA, 16 bp, Homo sapiens
tataatttaatgcatg

SEQ ID NO: 3915182 - DNA, 17 bp, Homo sapiens
tataattttatgaatgt

SEQ ID NO: 3915183 - DNA, 19 bp, Homo sapiens
tataatttttaaagtatat

SEQ ID NO: 3915184 - DNA, 13 bp, Homo sapiens
tatacaacaatgt

SEQ ID NO: 3915185 - DNA, 13 bp, Homo sapiens
tatacaatatata

SEQ ID NO: 3915186 - DNA, 15 bp, Homo sapiens
tatacaatatataaa

SEQ ID NO: 3915187 - DNA, 22 bp, Homo sapiens
tatacacacatatacatatata

SEQ ID NO: 3915188 - DNA, 12 bp, Homo sapiens
tatacacataca

SEQ ID NO: 3915189 - DNA, 13 bp, Homo sapiens
tatacacatacat

SEQ ID NO: 3915190 - DNA, 19 bp, Homo sapiens
tatacatacacttgtataa

SEQ ID NO: 3915191 - DNA, 12 bp, Homo sapiens
tatacatatata

SEQ ID NO: 3915192 - DNA, 19 bp, Homo sapiens
tactgcagctttacatgca

SEQ ID NO: 3915193 - DNA, 23 bp, Homo sapiens
tactgcagctttacatgcaattt

SEQ ID NO: 3915194 - DNA, 19 bp, Homo sapiens
tactgcccaggcctgcctg

SEQ ID NO: 3915195 - DNA, 21 bp, Homo sapiens
tactgcccaggcctgcctgtt

SEQ ID NO: 3915196 - DNA, 22 bp, Homo sapiens
tactgcccaggcctgcctgttc

SEQ ID NO: 3915197 - DNA, 20 bp, Homo sapiens
tactggaccccgcctcccag

SEQ ID NO: 3915198 - DNA, 22 bp, Homo sapiens
tactggaccccgcctcccagcc

SEQ ID NO: 3915199 - DNA, 11 bp, Homo sapiens
tactggcagct

SEQ ID NO: 3915200 - DNA, 19 bp, Homo sapiens
tactggcagctcctctcct

SEQ ID NO: 3915201 - DNA, 18 bp, Homo sapiens
tactggcattaattatta

SEQ ID NO: 3915202 - DNA, 23 bp, Homo sapiens
tactgggttatttttgtccctgc

SEQ ID NO: 3915203 - DNA, 18 bp, Homo sapiens
tactggtcttgtggaatt

SEQ ID NO: 3915204 - DNA, 20 bp, Homo sapiens
tactgtaattttgtttgtaa

SEQ ID NO: 3915205 - DNA, 17 bp, Homo sapiens
tactgtacatagatgta

SEQ ID NO: 3915206 - DNA, 17 bp, Homo sapiens
tactgtagctgatgaaa

SEQ ID NO: 3915207 - DNA, 16 bp, Homo sapiens
tactgtctggttttaa

SEQ ID NO: 3915208 - DNA, 22 bp, Homo sapiens
tactgtctggttttaacaattt

SEQ ID NO: 3915209 - DNA, 19 bp, Homo sapiens
tactgtgtagactcctgct

SEQ ID NO: 3915210 - DNA, 17 bp, Homo sapiens
tacttaactgtgtgaag

SEQ ID NO: 3915211 - DNA, 13 bp, Homo sapiens
tacttaagagaaa

SEQ ID NO: 3915212 - DNA, 14 bp, Homo sapiens
tacttaataaattc

SEQ ID NO: 3915213 - DNA, 19 bp, Homo sapiens
tacttaataaattcagata

SEQ ID NO: 3915214 - DNA, 16 bp, Homo sapiens
tacttacctaaacaga

SEQ ID NO: 3915215 - DNA, 13 bp, Homo sapiens
tacttattcttcc

SEQ ID NO: 3915216 - DNA, 23 bp, Homo sapiens
tacttcccattttggaagttttc

SEQ ID NO: 3915217 - DNA, 17 bp, Homo sapiens
tacttcctcctgatggc

SEQ ID NO: 3915218 - DNA, 23 bp, Homo sapiens
tacttcctgtgacttcagctctg

SEQ ID NO: 3915219 - DNA, 12 bp, Homo sapiens
tacttctaagag

SEQ ID NO: 3915220 - DNA, 16 bp, Homo sapiens
tacttcttggaaaaaa

SEQ ID NO: 3915221 - DNA, 11 bp, Homo sapiens
tacttgcacaa

SEQ ID NO: 3915222 - DNA, 14 bp, Homo sapiens
tacttgcacaagct

SEQ ID NO: 3915223 - DNA, 14 bp, Homo sapiens
tacttgtctgaggc

SEQ ID NO: 3915224 - DNA, 17 bp, Homo sapiens
tacttgtgactgaaggg

SEQ ID NO: 3915225 - DNA, 21 bp, Homo sapiens
tactttacactctctgtacaa

SEQ ID NO: 3915226 - DNA, 23 bp, Homo sapiens
tactttgatattttcaacgcagc

SEQ ID NO: 3915227 - DNA, 17 bp, Homo sapiens
tactttgccttttgcaa

SEQ ID NO: 3915228 - DNA, 20 bp, Homo sapiens
tactttgccttttgcaaact

SEQ ID NO: 3915229 - DNA, 17 bp, Homo sapiens
tacttttgcatgaaaat

SEQ ID NO: 3915230 - DNA, 16 bp, Homo sapiens
tactttttatactcca

SEQ ID NO: 3915231 - DNA, 14 bp, Homo sapiens
tagaaaacattcat

SEQ ID NO: 3915232 - DNA, 21 bp, Homo sapiens
tagaaaagaaaaaaaaaatat

SEQ ID NO: 3915233 - DNA, 16 bp, Homo sapiens
tagaaaagatgagagg

SEQ ID NO: 3915234 - DNA, 19 bp, Homo sapiens
tagaaaatgcaaaatgaaa

SEQ ID NO: 3915235 - DNA, 17 bp, Homo sapiens
tagaaaccagtatggaa

SEQ ID NO: 3915236 - DNA, 20 bp, Homo sapiens
tagaaactgaggagtagctg

SEQ ID NO: 3915237 - DNA, 21 bp, Homo sapiens
tagaaagctctgcatgtgtgt

SEQ ID NO: 3915238 - DNA, 23 bp, Homo sapiens
tagaaagttattgtgttgcctta

SEQ ID NO: 3915239 - DNA, 15 bp, Homo sapiens
tagaaatacctcatt

SEQ ID NO: 3915240 - DNA, 14 bp, Homo sapiens
tagaaatatgattt

SEQ ID NO: 3915241 - DNA, 14 bp, Homo sapiens
tagaaatgtatcct

SEQ ID NO: 3915242 - DNA, 18 bp, Homo sapiens
tagaaatgtatcctgata

SEQ ID NO: 3915243 - DNA, 18 bp, Homo sapiens
tagaaattagctgtgtga

SEQ ID NO: 3915244 - DNA, 17 bp, Homo sapiens
tagaacaatagctattg

SEQ ID NO: 3915245 - DNA, 16 bp, Homo sapiens
tagaacacccactggc

SEQ ID NO: 3915246 - DNA, 16 bp, Homo sapiens
tagaacataaagcaaa

SEQ ID NO: 3915247 - DNA, 22 bp, Homo sapiens
tagaacataaagcaaatagaca

SEQ ID NO: 3915248 - DNA, 20 bp, Homo sapiens
tagaacatgcacatttatat

SEQ ID NO: 3915249 - DNA, 21 bp, Homo sapiens
tagaacatgcacatttatata

SEQ ID NO: 3915250 - DNA, 22 bp, Homo sapiens
tagaacatggagagctagaacc

SEQ ID NO: 3915251 - DNA, 17 bp, Homo sapiens
tagaaccaagcttcaga

SEQ ID NO: 3915252 - DNA, 20 bp, Homo sapiens
tagaaccaagcttcagagcc

SEQ ID NO: 3915253 - DNA, 22 bp, Homo sapiens
tagaacccggcaggctagaacc

SEQ ID NO: 3915254 - DNA, 16 bp, Homo sapiens
tagaacctagaagggc

SEQ ID NO: 3915255 - DNA, 17 bp, Homo sapiens
tagaacctggaagggct

SEQ ID NO: 3915256 - DNA, 22 bp, Homo sapiens
tagaacctggagggctagaacc

SEQ ID NO: 3915257 - DNA, 22 bp, Homo sapiens
tagaactggagaggctagaacc

SEQ ID NO: 3915258 - DNA, 19 bp, Homo sapiens
tagaactgtatgtcagaca

SEQ ID NO: 3915259 - DNA, 19 bp, Homo sapiens
tagaagatggactctgaaa

SEQ ID NO: 3915260 - DNA, 16 bp, Homo sapiens
tagaagcgctcatctg

SEQ ID NO: 3915261 - DNA, 19 bp, Homo sapiens
tagaagcgctcatctggct

SEQ ID NO: 3915262 - DNA, 16 bp, Homo sapiens
tagaagctgtagtagc

SEQ ID NO: 3915263 - DNA, 19 bp, Homo sapiens
tagaaggccacatgtcacc

SEQ ID NO: 3915264 - DNA, 22 bp, Homo sapiens
tagaagggctagaacctggaga

SEQ ID NO: 3915265 - DNA, 24 bp, Homo sapiens
tagaagggctagaacctggagagc

SEQ ID NO: 3915266 - DNA, 20 bp, Homo sapiens
tagaagtgggccaggacagg

SEQ ID NO: 3915267 - DNA, 14 bp, Homo sapiens
tagaataaaattgt

SEQ ID NO: 3915268 - DNA, 12 bp, Homo sapiens
tagaatactttt

SEQ ID NO: 3915269 - DNA, 21 bp, Homo sapiens
tagaatgatttcatgctatct

SEQ ID NO: 3915270 - DNA, 14 bp, Homo sapiens
tagaattatatcta

SEQ ID NO: 3915271 - DNA, 15 bp, Homo sapiens
tagaattatatctaa

SEQ ID NO: 3915272 - DNA, 16 bp, Homo sapiens
tagaattatatctaat

SEQ ID NO: 3915273 - DNA, 17 bp, Homo sapiens
tagaattatatctaatt

SEQ ID NO: 3915274 - DNA, 18 bp, Homo sapiens
tagaattatatctaattt

SEQ ID NO: 3915275 - DNA, 23 bp, Homo sapiens
tagaatttgtattttgcttaaaa

SEQ ID NO: 3915276 - DNA, 17 bp, Homo sapiens
tagacacccattttcac

SEQ ID NO: 3915277 - DNA, 16 bp, Homo sapiens
tagacagtgctgccct

SEQ ID NO: 3915278 - DNA, 20 bp, Homo sapiens
tagacagtgctgccctgcga

SEQ ID NO: 3915279 - DNA, 13 bp, Homo sapiens
tagaccaaaataa

SEQ ID NO: 3915280 - DNA, 12 bp, Homo sapiens
tagacctgggcc

SEQ ID NO: 3915281 - DNA, 13 bp, Homo sapiens
tagacctgggcca

SEQ ID NO: 3915282 - DNA, 24 bp, Homo sapiens
tagactaattaaaatctggaaatc

SEQ ID NO: 3915283 - DNA, 22 bp, Homo sapiens
tagactatatacatgtgtgtat

SEQ ID NO: 3915284 - DNA, 21 bp, Homo sapiens
tagactggagtgaggcttcca

SEQ ID NO: 3915285 - DNA, 18 bp, Homo sapiens
tagacttcgactcaggat

SEQ ID NO: 3915286 - DNA, 19 bp, Homo sapiens
tagactttctcagtgggac

SEQ ID NO: 3915287 - DNA, 11 bp, Homo sapiens
tagactttctg

SEQ ID NO: 3915288 - DNA, 14 bp, Homo sapiens
tagagagcagaaat

SEQ ID NO: 3915289 - DNA, 15 bp, Homo sapiens
tagagagcagaaata

SEQ ID NO: 3915290 - DNA, 20 bp, Homo sapiens
tagagaggtagcgagctgct

SEQ ID NO: 3915291 - DNA, 20 bp, Homo sapiens
tagagattgccccagagccc

SEQ ID NO: 3915292 - DNA, 20 bp, Homo sapiens
tagagctcctgtccctaccc

SEQ ID NO: 3915293 - DNA, 16 bp, Homo sapiens
tagagctgggaaacag

SEQ ID NO: 3915294 - DNA, 23 bp, Homo sapiens
tagagctttctttcacaaaaaag

SEQ ID NO: 3915295 - DNA, 17 bp, Homo sapiens
tagaggaaaaaaatgac

SEQ ID NO: 3915296 - DNA, 18 bp, Homo sapiens
tagaggaaaaaaatgact

SEQ ID NO: 3915297 - DNA, 21 bp, Homo sapiens
tagaggcatgaacacacatgg

SEQ ID NO: 3915298 - DNA, 23 bp, Homo sapiens
tagagggaggagaatgagcctcg

SEQ ID NO: 3915299 - DNA, 16 bp, Homo sapiens
tagaggtgggcagctg

SEQ ID NO: 3915300 - DNA, 18 bp, Homo sapiens
tagaggtgggcagctggg

SEQ ID NO: 3915301 - DNA, 19 bp, Homo sapiens
tagaggttttgttgtttta

SEQ ID NO: 3915302 - DNA, 14 bp, Homo sapiens
tagagttcatccca

SEQ ID NO: 3915303 - DNA, 12 bp, Homo sapiens
tagagtttaaca

SEQ ID NO: 3915304 - DNA, 14 bp, Homo sapiens
tagatatataactt

SEQ ID NO: 3915305 - DNA, 14 bp, Homo sapiens
tagatcaattaatt

SEQ ID NO: 3915306 - DNA, 22 bp, Homo sapiens
tagatccatttggacaaaatgg

SEQ ID NO: 3915307 - DNA, 23 bp, Homo sapiens
tagatccatttggacaaaatgga

SEQ ID NO: 3915308 - DNA, 18 bp, Homo sapiens
tagatcctaggtgctgga

SEQ ID NO: 3915309 - DNA, 19 bp, Homo sapiens
tagatctccaggagaactg

SEQ ID NO: 3915310 - DNA, 23 bp, Homo sapiens
tagatctcctatttttcagaatg

SEQ ID NO: 3915311 - DNA, 17 bp, Homo sapiens
tagatgagggtgactgt

SEQ ID NO: 3915312 - DNA, 19 bp, Homo sapiens
tagatgcaagatatttata

SEQ ID NO: 3915313 - DNA, 23 bp, Homo sapiens
tagatgctgactgtactcctccc

SEQ ID NO: 3915314 - DNA, 13 bp, Homo sapiens
tagatggaccagt

SEQ ID NO: 3915315 - DNA, 20 bp, Homo sapiens
tagatggaccagtagacaac

SEQ ID NO: 3915316 - DNA, 20 bp, Homo sapiens
tagatgggtctggctgagct

SEQ ID NO: 3915317 - DNA, 22 bp, Homo sapiens
tagatgggtctggctgagctga

SEQ ID NO: 3915318 - DNA, 20 bp, Homo sapiens
tagattacctgatcatggtc

SEQ ID NO: 3915319 - DNA, 14 bp, Homo sapiens
tagattacctgcca

SEQ ID NO: 3915320 - DNA, 22 bp, Homo sapiens
tagattcctcttgcctctctca

SEQ ID NO: 3915321 - DNA, 20 bp, Homo sapiens
tagattctacatattcttta

SEQ ID NO: 3915322 - DNA, 16 bp, Homo sapiens
tagattgttaaaataa

SEQ ID NO: 3915323 - DNA, 18 bp, Homo sapiens
tagatttgattatttcct

SEQ ID NO: 3915324 - DNA, 18 bp, Homo sapiens
tagatttgtattttaaaa

SEQ ID NO: 3915325 - DNA, 16 bp, Homo sapiens
tagattttagttcact

SEQ ID NO: 3915326 - DNA, 19 bp, Homo sapiens
tagcaagacctgttggtta

SEQ ID NO: 3915327 - DNA, 22 bp, Homo sapiens
tagcagaagaaaaagttgcagt

SEQ ID NO: 3915328 - DNA, 18 bp, Homo sapiens
tagcagataaagacagct

SEQ ID NO: 3915329 - DNA, 21 bp, Homo sapiens
tagcagcaaaaatataaaata

SEQ ID NO: 3915330 - DNA, 20 bp, Homo sapiens
tagcagggcatggctgggaa

SEQ ID NO: 3915331 - DNA, 15 bp, Homo sapiens
tagcaggtggtcctg

SEQ ID NO: 3915332 - DNA, 22 bp, Homo sapiens
tagcaggtggtcctgagacctg

SEQ ID NO: 3915333 - DNA, 23 bp, Homo sapiens
tagcagtccaaagaacaagaaat

SEQ ID NO: 3915334 - DNA, 13 bp, Homo sapiens
tagcatcttctgg

SEQ ID NO: 3915335 - DNA, 13 bp, Homo sapiens
tagcattgaacat

SEQ ID NO: 3915336 - DNA, 16 bp, Homo sapiens
tagcattgaagtgtcg

SEQ ID NO: 3915337 - DNA, 18 bp, Homo sapiens
tagcatttttattcatgc

SEQ ID NO: 3915338 - DNA, 14 bp, Homo sapiens
tagcatttttgatt

SEQ ID NO: 3915339 - DNA, 17 bp, Homo sapiens
tagccaagttatattga

SEQ ID NO: 3915340 - DNA, 19 bp, Homo sapiens
tagccaagttatattgaat

SEQ ID NO: 3915341 - DNA, 19 bp, Homo sapiens
tagccacatccctttgaaa

SEQ ID NO: 3915342 - DNA, 16 bp, Homo sapiens
tagccacctcccaccc

SEQ ID NO: 3915343 - DNA, 18 bp, Homo sapiens
tagccacctcccacccca

SEQ ID NO: 3915344 - DNA, 21 bp, Homo sapiens
tagccactttggtcccgtgca

SEQ ID NO: 3915345 - DNA, 14 bp, Homo sapiens
tagccagacacatg

SEQ ID NO: 3915346 - DNA, 15 bp, Homo sapiens
tagccagagaggagc

SEQ ID NO: 3915347 - DNA, 15 bp, Homo sapiens
tagccatggctcagg

SEQ ID NO: 3915348 - DNA, 20 bp, Homo sapiens
tagcccaagaggtctgagcc

SEQ ID NO: 3915349 - DNA, 19 bp, Homo sapiens
tagcccaggtcctctgata

SEQ ID NO: 3915350 - DNA, 13 bp, Homo sapiens
tagcccgaggacc

SEQ ID NO: 3915351 - DNA, 18 bp, Homo sapiens
tagcccgaggaccgggct

SEQ ID NO: 3915352 - DNA, 12 bp, Homo sapiens
tagccctcagtc

SEQ ID NO: 3915353 - DNA, 15 bp, Homo sapiens
tagccgagagcctgc

SEQ ID NO: 3915354 - DNA, 17 bp, Homo sapiens
tagccgagagcctgctc

SEQ ID NO: 3915355 - DNA, 18 bp, Homo sapiens
tagccgagagcctgctcc

SEQ ID NO: 3915356 - DNA, 16 bp, Homo sapiens
tagccgtccatggcac

SEQ ID NO: 3915357 - DNA, 20 bp, Homo sapiens
tagccgtccatggcaccagc

SEQ ID NO: 3915358 - DNA, 23 bp, Homo sapiens
tcctccgtccacccaggctgcac

SEQ ID NO: 3915359 - DNA, 15 bp, Homo sapiens
tcctcctccacagtg

SEQ ID NO: 3915360 - DNA, 18 bp, Homo sapiens
tcctcctccacagtgctg

SEQ ID NO: 3915361 - DNA, 17 bp, Homo sapiens
tcctcctgaagcctctg

SEQ ID NO: 3915362 - DNA, 24 bp, Homo sapiens
tcctcctgaagcctctgccctgcc

SEQ ID NO: 3915363 - DNA, 13 bp, Homo sapiens
tcctcctgatggc

SEQ ID NO: 3915364 - DNA, 18 bp, Homo sapiens
tcctccttataagcccag

SEQ ID NO: 3915365 - DNA, 15 bp, Homo sapiens
tcctcggccccctcc

SEQ ID NO: 3915366 - DNA, 19 bp, Homo sapiens
tcctcggccccctccatcg

SEQ ID NO: 3915367 - DNA, 17 bp, Homo sapiens
tcctcggtactcccata

SEQ ID NO: 3915368 - DNA, 22 bp, Homo sapiens
tcctctcaagctagccagaggg

SEQ ID NO: 3915369 - DNA, 18 bp, Homo sapiens
tcctctcactaaacttta

SEQ ID NO: 3915370 - DNA, 12 bp, Homo sapiens
tcctctccactg

SEQ ID NO: 3915371 - DNA, 15 bp, Homo sapiens
tcctctccactgcct

SEQ ID NO: 3915372 - DNA, 11 bp, Homo sapiens
tcctctccagg

SEQ ID NO: 3915373 - DNA, 14 bp, Homo sapiens
tcctctccaggcac

SEQ ID NO: 3915374 - DNA, 17 bp, Homo sapiens
tcctctcctagcccctg

SEQ ID NO: 3915375 - DNA, 13 bp, Homo sapiens
tcctctcgagccc

SEQ ID NO: 3915376 - DNA, 15 bp, Homo sapiens
tcctctcgagcccag

SEQ ID NO: 3915377 - DNA, 19 bp, Homo sapiens
tcctctctcaggtcactcc

SEQ ID NO: 3915378 - DNA, 13 bp, Homo sapiens
tcctctctgccac

SEQ ID NO: 3915379 - DNA, 17 bp, Homo sapiens
tcctctgaggaagaagg

SEQ ID NO: 3915380 - DNA, 15 bp, Homo sapiens
tcctctgattatcag

SEQ ID NO: 3915381 - DNA, 14 bp, Homo sapiens
tcctctgccacctc

SEQ ID NO: 3915382 - DNA, 15 bp, Homo sapiens
tcctctgccacctcc

SEQ ID NO: 3915383 - DNA, 18 bp, Homo sapiens
tcctctgccacctcccct

SEQ ID NO: 3915384 - DNA, 10 bp, Homo sapiens
tcctctgcct

SEQ ID NO: 3915385 - DNA, 14 bp, Homo sapiens
tcctctgctgctcc

SEQ ID NO: 3915386 - DNA, 17 bp, Homo sapiens
tcctctggatggcacca

SEQ ID NO: 3915387 - DNA, 9 bp, Homo sapiens
tcctctggc

SEQ ID NO: 3915388 - DNA, 18 bp, Homo sapiens
tcctctggcccagcctac

SEQ ID NO: 3915389 - DNA, 23 bp, Homo sapiens
tcctctggggttcatctagggac

SEQ ID NO: 3915390 - DNA, 15 bp, Homo sapiens
tcctctgtctcgagc

SEQ ID NO: 3915391 - DNA, 15 bp, Homo sapiens
tcctcttccccttgc

SEQ ID NO: 3915392 - DNA, 16 bp, Homo sapiens
tcctcttccccttgcc

SEQ ID NO: 3915393 - DNA, 19 bp, Homo sapiens
tcctcttccccttgccctt

SEQ ID NO: 3915394 - DNA, 21 bp, Homo sapiens
tcctctttctctccttcttcc

SEQ ID NO: 3915395 - DNA, 14 bp, Homo sapiens
tcctctttgcatgg

SEQ ID NO: 3915396 - DNA, 15 bp, Homo sapiens
tcctgaaatttcaga

SEQ ID NO: 3915397 - DNA, 12 bp, Homo sapiens
tcctgaagccag

SEQ ID NO: 3915398 - DNA, 14 bp, Homo sapiens
tcctgaagccagat

SEQ ID NO: 3915399 - DNA, 19 bp, Homo sapiens
tcctgaagcctctgccctg

SEQ ID NO: 3915400 - DNA, 21 bp, Homo sapiens
tcctgaatttattattgttct

SEQ ID NO: 3915401 - DNA, 14 bp, Homo sapiens
tcctgacattaaga

SEQ ID NO: 3915402 - DNA, 15 bp, Homo sapiens
tcctgacgccctgcg

SEQ ID NO: 3915403 - DNA, 19 bp, Homo sapiens
tcctgactccagtgagctg

SEQ ID NO: 3915404 - DNA, 12 bp, Homo sapiens
tcctgagcactg

SEQ ID NO: 3915405 - DNA, 15 bp, Homo sapiens
tcctgagcactgcca

SEQ ID NO: 3915406 - DNA, 21 bp, Homo sapiens
tcctgagcactgccaggaggg

SEQ ID NO: 3915407 - DNA, 22 bp, Homo sapiens
tcctgagcactgccaggaggga

SEQ ID NO: 3915408 - DNA, 18 bp, Homo sapiens
tcctgataaacattaaac

SEQ ID NO: 3915409 - DNA, 18 bp, Homo sapiens
tcctgataataattgatc

SEQ ID NO: 3915410 - DNA, 16 bp, Homo sapiens
tcctgatggccaagag

SEQ ID NO: 3915411 - DNA, 18 bp, Homo sapiens
tcctgatggccaagagca

SEQ ID NO: 3915412 - DNA, 23 bp, Homo sapiens
tcctgatggtacaggaaagctca

SEQ ID NO: 3915413 - DNA, 15 bp, Homo sapiens
tcctgcaatctccag

SEQ ID NO: 3915414 - DNA, 16 bp, Homo sapiens
tcctgcaatctccagg

SEQ ID NO: 3915415 - DNA, 12 bp, Homo sapiens
tcctgcactcca

SEQ ID NO: 3915416 - DNA, 15 bp, Homo sapiens
tcctgcactccagaa

SEQ ID NO: 3915417 - DNA, 22 bp, Homo sapiens
tccttcccccatcccctttcct

SEQ ID NO: 3915418 - DNA, 17 bp, Homo sapiens
tccttcccctttcccca

SEQ ID NO: 3915419 - DNA, 15 bp, Homo sapiens
tccttccctaaagac

SEQ ID NO: 3915420 - DNA, 22 bp, Homo sapiens
tccttccctctttccccacctc

SEQ ID NO: 3915421 - DNA, 12 bp, Homo sapiens
tccttccctggc

SEQ ID NO: 3915422 - DNA, 14 bp, Homo sapiens
tccttccctgggaa

SEQ ID NO: 3915423 - DNA, 18 bp, Homo sapiens
tccttccgctcctttacc

SEQ ID NO: 3915424 - DNA, 23 bp, Homo sapiens
tccttcctacacccttggacttg

SEQ ID NO: 3915425 - DNA, 14 bp, Homo sapiens
tccttcctctcaag

SEQ ID NO: 3915426 - DNA, 13 bp, Homo sapiens
tccttcttccctg

SEQ ID NO: 3915427 - DNA, 15 bp, Homo sapiens
tccttgcacccctca

SEQ ID NO: 3915428 - DNA, 14 bp, Homo sapiens
tccttgctctgcag

SEQ ID NO: 3915429 - DNA, 15 bp, Homo sapiens
tccttgctttgctgt

SEQ ID NO: 3915430 - DNA, 16 bp, Homo sapiens
tccttggaagtttcat

SEQ ID NO: 3915431 - DNA, 14 bp, Homo sapiens
tccttggagagcag

SEQ ID NO: 3915432 - DNA, 16 bp, Homo sapiens
tccttggagagcagct

SEQ ID NO: 3915433 - DNA, 16 bp, Homo sapiens
tccttgggctcctggc

SEQ ID NO: 3915434 - DNA, 18 bp, Homo sapiens
tccttgggctcctggctg

SEQ ID NO: 3915435 - DNA, 19 bp, Homo sapiens
tccttgggctcctggctgc

SEQ ID NO: 3915436 - DNA, 21 bp, Homo sapiens
tccttgggctcctggctgcca

SEQ ID NO: 3915437 - DNA, 22 bp, Homo sapiens
tccttgggctcctggctgccag

SEQ ID NO: 3915438 - DNA, 14 bp, Homo sapiens
tccttgggtcctgc

SEQ ID NO: 3915439 - DNA, 17 bp, Homo sapiens
tccttgtggtttatgtc

SEQ ID NO: 3915440 - DNA, 16 bp, Homo sapiens
tcctttaggcagcctg

SEQ ID NO: 3915441 - DNA, 21 bp, Homo sapiens
tcctttaggcagcctgccgcc

SEQ ID NO: 3915442 - DNA, 15 bp, Homo sapiens
tcctttattgcagtt

SEQ ID NO: 3915443 - DNA, 16 bp, Homo sapiens
tcctttcacaaccttc

SEQ ID NO: 3915444 - DNA, 13 bp, Homo sapiens
tcccctctcccct

SEQ ID NO: 3915445 - DNA, 16 bp, Homo sapiens
tcccctctgccctgta

SEQ ID NO: 3915446 - DNA, 23 bp, Homo sapiens
tcccctgccctgctgccgcctcc

SEQ ID NO: 3915447 - DNA, 22 bp, Homo sapiens
tcccctgggcatcttctggctt

SEQ ID NO: 3915448 - DNA, 15 bp, Homo sapiens
tcccctgggcctgga

SEQ ID NO: 3915449 - DNA, 18 bp, Homo sapiens
tccccttgcccttgccct

SEQ ID NO: 3915450 - DNA, 19 bp, Homo sapiens
tccccttgtgtcagagaca

SEQ ID NO: 3915451 - DNA, 13 bp, Homo sapiens
tcccctttattaa

SEQ ID NO: 3915452 - DNA, 19 bp, Homo sapiens
tccccttttgcctggctgt

SEQ ID NO: 3915453 - DNA, 21 bp, Homo sapiens
tcccgagctactctcttgcca

SEQ ID NO: 3915454 - DNA, 19 bp, Homo sapiens
tcccgccaggaggtcctcc

SEQ ID NO: 3915455 - DNA, 19 bp, Homo sapiens
tcccgcctcttcttcttca

SEQ ID NO: 3915456 - DNA, 21 bp, Homo sapiens
tcccgcctcttcttcttcaga

SEQ ID NO: 3915457 - DNA, 21 bp, Homo sapiens
tcccgcgggcctggacactta

SEQ ID NO: 3915458 - DNA, 15 bp, Homo sapiens
tcccgctcagccctc

SEQ ID NO: 3915459 - DNA, 20 bp, Homo sapiens
tcccgctcagccctccctgc

SEQ ID NO: 3915460 - DNA, 14 bp, Homo sapiens
tcccggagcacagc

SEQ ID NO: 3915461 - DNA, 19 bp, Homo sapiens
tccgggacgcttccagacc

SEQ ID NO: 3915462 - DNA, 16 bp, Homo sapiens
tccgggtgccattccc

SEQ ID NO: 3915463 - DNA, 16 bp, Homo sapiens
tccgggtgtggcctca

SEQ ID NO: 3915464 - DNA, 17 bp, Homo sapiens
tccgggtgtggcctcag

SEQ ID NO: 3915465 - DNA, 22 bp, Homo sapiens
tccgggtgtggcctcagccctc

SEQ ID NO: 3915466 - DNA, 14 bp, Homo sapiens
tccgtccacccagg

SEQ ID NO: 3915467 - DNA, 18 bp, Homo sapiens
tccgtccacccaggctgc

SEQ ID NO: 3915468 - DNA, 20 bp, Homo sapiens
tccgtccacccaggctgcac

SEQ ID NO: 3915469 - DNA, 22 bp, Homo sapiens
tccgtccacccaggctgcactg

SEQ ID NO: 3915470 - DNA, 16 bp, Homo sapiens
tccgtttatgggcctt

SEQ ID NO: 3915471 - DNA, 22 bp, Homo sapiens
tcctaaacccccgctccagatc

SEQ ID NO: 3915472 - DNA, 18 bp, Homo sapiens
tcctaactgaagagacag

SEQ ID NO: 3915473 - DNA, 14 bp, Homo sapiens
tcctaagcagctgg

SEQ ID NO: 3915474 - DNA, 15 bp, Homo sapiens
tcctaagcagctggg

SEQ ID NO: 3915475 - DNA, 12 bp, Homo sapiens
tcctaaggacac

SEQ ID NO: 3915476 - DNA, 16 bp, Homo sapiens
tcctaaggacacacta

SEQ ID NO: 3915477 - DNA, 18 bp, Homo sapiens
tcctaaggacacactaat

SEQ ID NO: 3915478 - DNA, 14 bp, Homo sapiens
tcctacaaagatgt

SEQ ID NO: 3915479 - DNA, 15 bp, Homo sapiens
tcctacaaagatgtt

SEQ ID NO: 3915480 - DNA, 18 bp, Homo sapiens
tcctacacccttggactt

SEQ ID NO: 3915481 - DNA, 21 bp, Homo sapiens
tcctacagaaatactgctctg

SEQ ID NO: 3915482 - DNA, 22 bp, Homo sapiens
tcctacagaaatactgctctga

SEQ ID NO: 3915483 - DNA, 14 bp, Homo sapiens
tcctaccaatgcat

SEQ ID NO: 3915484 - DNA, 17 bp, Homo sapiens
tcctaccaatgcatgca

SEQ ID NO: 3915485 - DNA, 16 bp, Homo sapiens
tcctacccaaccactc

SEQ ID NO: 3915486 - DNA, 23 bp, Homo sapiens
tcctaccccacctcatgcctggc

SEQ ID NO: 3915487 - DNA, 20 bp, Homo sapiens
tcctacctgctgctgctatt

SEQ ID NO: 3915488 - DNA, 19 bp, Homo sapiens
tcctagaaccaagcttcag

SEQ ID NO: 3915489 - DNA, 20 bp, Homo sapiens
tcctagaaccaagcttcaga

SEQ ID NO: 3915490 - DNA, 22 bp, Homo sapiens
tcctagactaattaaaatctgg

SEQ ID NO: 3915491 - DNA, 13 bp, Homo sapiens
tcctagagctcct

SEQ ID NO: 3915492 - DNA, 14 bp, Homo sapiens
tcctagagctcctg

SEQ ID NO: 3915493 - DNA, 15 bp, Homo sapiens
tcctagaggtgggca

SEQ ID NO: 3915494 - DNA, 19 bp, Homo sapiens
tcctagaggtgggcagctg

SEQ ID NO: 3915495 - DNA, 20 bp, Homo sapiens
tcctagaggtgggcagctgg

SEQ ID NO: 3915496 - DNA, 21 bp, Homo sapiens
tcctagaggtgggcagctggg

SEQ ID NO: 3915497 - DNA, 14 bp, Homo sapiens
tcctaggtgctgga

SEQ ID NO: 3915498 - DNA, 16 bp, Homo sapiens
tcctatacatttctgt

SEQ ID NO: 3915499 - DNA, 18 bp, Homo sapiens
tcctatatagtttattga

SEQ ID NO: 3915500 - DNA, 15 bp, Homo sapiens
tcctatcgactttat

SEQ ID NO: 3915501 - DNA, 22 bp, Homo sapiens
tcctatctgtatgtctgcctaa

SEQ ID NO: 3915502 - DNA, 18 bp, Homo sapiens
tcctatgtcaatttgtat

SEQ ID NO: 3915503 - DNA, 22 bp, Homo sapiens
tcctatgtcaatttgtatatca

SEQ ID NO: 3915504 - DNA, 24 bp, Homo sapiens
tcctatgtcaatttgtatatcatg

SEQ ID NO: 3915505 - DNA, 18 bp, Homo sapiens
tcctattctcaccaggaa

SEQ ID NO: 3915506 - DNA, 15 bp, Homo sapiens
tcctatttcttatag

SEQ ID NO: 3915507 - DNA, 16 bp, Homo sapiens
tcctatttgcactgta

SEQ ID NO: 3915508 - DNA, 18 bp, Homo sapiens
tcctatttggggcttgca

SEQ ID NO: 3915509 - DNA, 12 bp, Homo sapiens
tcctattttaaa

SEQ ID NO: 3915510 - DNA, 17 bp, Homo sapiens
tcctattttaaaaccat

SEQ ID NO: 3915511 - DNA, 18 bp, Homo sapiens
tcctcaaaataaggggca

SEQ ID NO: 3915512 - DNA, 19 bp, Homo sapiens
tcctcaacaacaaaccaaa

SEQ ID NO: 3915513 - DNA, 12 bp, Homo sapiens
tcctcacagcct

SEQ ID NO: 3915514 - DNA, 17 bp, Homo sapiens
tcctcacaggagcagac

SEQ ID NO: 3915515 - DNA, 21 bp, Homo sapiens
tcctcacaggagcagacagag

SEQ ID NO: 3915516 - DNA, 15 bp, Homo sapiens
tcctcaccatccaca

SEQ ID NO: 3915517 - DNA, 16 bp, Homo sapiens
tcctcacccccagctt

SEQ ID NO: 3915518 - DNA, 18 bp, Homo sapiens
tcctcagggacagagaca

SEQ ID NO: 3915519 - DNA, 14 bp, Homo sapiens
tcctcaggggtgga

SEQ ID NO: 3915520 - DNA, 17 bp, Homo sapiens
tcctcaggggtggagaa

SEQ ID NO: 3915521 - DNA, 17 bp, Homo sapiens
tcctcaggtagtactgg

SEQ ID NO: 3915522 - DNA, 13 bp, Homo sapiens
tcctcatctgcag

SEQ ID NO: 3915523 - DNA, 19 bp, Homo sapiens
tcctccaaactcctgcctg

SEQ ID NO: 3915524 - DNA, 23 bp, Homo sapiens
tcctccaacgttaaaagacagtg

SEQ ID NO: 3915525 - DNA, 18 bp, Homo sapiens
tgtatgtgcacatgtgtc

SEQ ID NO: 3915526 - DNA, 23 bp, Homo sapiens
tgtatgtgcacatgtgtctgtgt

SEQ ID NO: 3915527 - DNA, 18 bp, Homo sapiens
tgtatgtgtctttatcag

SEQ ID NO: 3915528 - DNA, 19 bp, Homo sapiens
tgtatgttcagaagaaatt

SEQ ID NO: 3915529 - DNA, 16 bp, Homo sapiens
tgtatgtttacatatc

SEQ ID NO: 3915530 - DNA, 17 bp, Homo sapiens
tgtattaagggcatttt

SEQ ID NO: 3915531 - DNA, 19 bp, Homo sapiens
tgtattacatctaatgctt

SEQ ID NO: 3915532 - DNA, 17 bp, Homo sapiens
tgtattattttctatag

SEQ ID NO: 3915533 - DNA, 22 bp, Homo sapiens
tgtattcagatcgtattaatta

SEQ ID NO: 3915534 - DNA, 15 bp, Homo sapiens
tgtatttatatgtta

SEQ ID NO: 3915535 - DNA, 17 bp, Homo sapiens
tgtatttatatgttaat

SEQ ID NO: 3915536 - DNA, 13 bp, Homo sapiens
tgtatttattgtc

SEQ ID NO: 3915537 - DNA, 19 bp, Homo sapiens
tgtatttattgtcattact

SEQ ID NO: 3915538 - DNA, 17 bp, Homo sapiens
tgtatttgtatgtactg

SEQ ID NO: 3915539 - DNA, 13 bp, Homo sapiens
tgtattttcaact

SEQ ID NO: 3915540 - DNA, 14 bp, Homo sapiens
tgtattttcaactt

SEQ ID NO: 3915541 - DNA, 17 bp, Homo sapiens
tgtattttttaaagcta

SEQ ID NO: 3915542 - DNA, 18 bp, Homo sapiens
tgtcaaagattttacctg

SEQ ID NO: 3915543 - DNA, 22 bp, Homo sapiens
tgtcaaatgtcattatgtagaa

SEQ ID NO: 3915544 - DNA, 15 bp, Homo sapiens
tgtcaactatgatat

SEQ ID NO: 3915545 - DNA, 15 bp, Homo sapiens
tgtcaagtacaagca

SEQ ID NO: 3915546 - DNA, 23 bp, Homo sapiens
tgtcaatacccctgttaagcaat

SEQ ID NO: 3915547 - DNA, 13 bp, Homo sapiens
tgtcaatattaaa

SEQ ID NO: 3915548 - DNA, 19 bp, Homo sapiens
tgtcaatattaaatacaga

SEQ ID NO: 3915549 - DNA, 17 bp, Homo sapiens
tgtcaatgattattttc

SEQ ID NO: 3915550 - DNA, 22 bp, Homo sapiens
tgtcaatttgtatatcatgaaa

SEQ ID NO: 3915551 - DNA, 16 bp, Homo sapiens
tgtcacacaaggctgg

SEQ ID NO: 3915552 - DNA, 22 bp, Homo sapiens
tgtcaccctccacctcttcacc

SEQ ID NO: 3915553 - DNA, 16 bp, Homo sapiens
tgtcaccctgcagagc

SEQ ID NO: 3915554 - DNA, 23 bp, Homo sapiens
tgtcaccgtgagcagctttggaa

SEQ ID NO: 3915555 - DNA, 18 bp, Homo sapiens
tgtcaccgtggaccttcc

SEQ ID NO: 3915556 - DNA, 19 bp, Homo sapiens
tgtcaccgtggaccttcct

SEQ ID NO: 3915557 - DNA, 12 bp, Homo sapiens
tgtcacctcagc

SEQ ID NO: 3915558 - DNA, 19 bp, Homo sapiens
tgtcacctcagctgatatt

SEQ ID NO: 3915559 - DNA, 22 bp, Homo sapiens
tgtcagaattggcctcagtgta

SEQ ID NO: 3915560 - DNA, 23 bp, Homo sapiens
tgtcagagacagaccccttggct

SEQ ID NO: 3915561 - DNA, 18 bp, Homo sapiens
tgtcagagccaggctctg

SEQ ID NO: 3915562 - DNA, 19 bp, Homo sapiens
tgtcagagccaggctctgc

SEQ ID NO: 3915563 - DNA, 11 bp, Homo sapiens
tgtcagagcta

SEQ ID NO: 3915564 - DNA, 22 bp, Homo sapiens
tgtcagagctatgttccctcca

SEQ ID NO: 3915565 - DNA, 12 bp, Homo sapiens
tgtcagaggcta

SEQ ID NO: 3915566 - DNA, 16 bp, Homo sapiens
tgtcagagttctgctc

SEQ ID NO: 3915567 - DNA, 20 bp, Homo sapiens
tgtcagatattttttcagaa

SEQ ID NO: 3915568 - DNA, 21 bp, Homo sapiens
tgtcagatattttttcagaaa

SEQ ID NO: 3915569 - DNA, 11 bp, Homo sapiens
tgtcagccagc

SEQ ID NO: 3915570 - DNA, 11 bp, Homo sapiens
tgtcagccttg

SEQ ID NO: 3915571 - DNA, 13 bp, Homo sapiens
tgtcagccttgca

SEQ ID NO: 3915572 - DNA, 18 bp, Homo sapiens
tgtcagcttttgcttcat

SEQ ID NO: 3915573 - DNA, 14 bp, Homo sapiens
tgtcaggacccagg

SEQ ID NO: 3915574 - DNA, 12 bp, Homo sapiens
tgtcaggcaggt

SEQ ID NO: 3915575 - DNA, 14 bp, Homo sapiens
tgtcaggcctgtgt

SEQ ID NO: 3915576 - DNA, 17 bp, Homo sapiens
tgtcataagaatgaata

SEQ ID NO: 3915577 - DNA, 17 bp, Homo sapiens
tgtcatagaaagtgcca

SEQ ID NO: 3915578 - DNA, 15 bp, Homo sapiens
tgtcatagaaattac

SEQ ID NO: 3915579 - DNA, 18 bp, Homo sapiens
tgtcatatagctggttat

SEQ ID NO: 3915580 - DNA, 18 bp, Homo sapiens
tgtcatatattcatgtaa

SEQ ID NO: 3915581 - DNA, 21 bp, Homo sapiens
tgtcatatattcatgtaataa

SEQ ID NO: 3915582 - DNA, 21 bp, Homo sapiens
tgtcatatgtaggtgtctgca

SEQ ID NO: 3915583 - DNA, 17 bp, Homo sapiens
tgtcatcactccctgga

SEQ ID NO: 3915584 - DNA, 18 bp, Homo sapiens
tgtcatcactccctggat

SEQ ID NO: 3915585 - DNA, 22 bp, Homo sapiens
tgtcatcattgtatatatgtgt

SEQ ID NO: 3915586 - DNA, 18 bp, Homo sapiens
tgtcatccccttgtgtca

SEQ ID NO: 3915587 - DNA, 22 bp, Homo sapiens
tgtcatctctctggggccctgg

SEQ ID NO: 3915588 - DNA, 19 bp, Homo sapiens
tgtcatgaattcttatgct

SEQ ID NO: 3915589 - DNA, 17 bp, Homo sapiens
tgtcatggaaaagccca

SEQ ID NO: 3915590 - DNA, 18 bp, Homo sapiens
tgtcatgtacttcctgtg

SEQ ID NO: 3915591 - DNA, 22 bp, Homo sapiens
tgtcatgtacttcctgtgtact

SEQ ID NO: 3915592 - DNA, 17 bp, Homo sapiens
tgtcattactgcctttg

SEQ ID NO: 3915593 - DNA, 23 bp, Homo sapiens
tgtcattactgcctttggaagaa

SEQ ID NO: 3915594 - DNA, 23 bp, Homo sapiens
tgtcattcaagcctgtgaataaa

SEQ ID NO: 3915595 - DNA, 23 bp, Homo sapiens
tgtcattcaggaccccaacccct

SEQ ID NO: 3915596 - DNA, 16 bp, Homo sapiens
tgtcattgctgtagga

SEQ ID NO: 3915597 - DNA, 22 bp, Homo sapiens
tgtcattttaaaatctgattta

SEQ ID NO: 3915598 - DNA, 23 bp, Homo sapiens
tgtcattttaaaatctgatttaa

SEQ ID NO: 3915599 - DNA, 21 bp, Homo sapiens
tgtccaattatgcactggcca

SEQ ID NO: 3915600 - DNA, 16 bp, Homo sapiens
tgtccaattctcttta

SEQ ID NO: 3915601 - DNA, 19 bp, Homo sapiens
tgtccacagtctcccattc

SEQ ID NO: 3915602 - DNA, 17 bp, Homo sapiens
tgtccacctcaccaggg

SEQ ID NO: 3915603 - DNA, 15 bp, Homo sapiens
tgtccacctggcccc

SEQ ID NO: 3915604 - DNA, 21 bp, Homo sapiens
tgtccactctcggggcccttg

SEQ ID NO: 3915605 - DNA, 22 bp, Homo sapiens
tgtccagaccattgtcttccaa

SEQ ID NO: 3915606 - DNA, 17 bp, Homo sapiens
tgtccagactgtgggtg

SEQ ID NO: 3915607 - DNA, 13 bp, Homo sapiens
tgtccagcagctg

SEQ ID NO: 3915608 - DNA, 15 bp, Homo sapiens
tgtccagcagctgcg

SEQ ID NO: 3915609 - DNA, 21 bp, Homo sapiens
tgtccaggaaaccctggcttg

SEQ ID NO: 3915610 - DNA, 18 bp, Homo sapiens
tgtgcagtattttattaa

SEQ ID NO: 3915611 - DNA, 16 bp, Homo sapiens
tgtgcagtcccgtgga

SEQ ID NO: 3915612 - DNA, 23 bp, Homo sapiens
tgtgcagtcccgtggagggtagg

SEQ ID NO: 3915613 - DNA, 17 bp, Homo sapiens
tgtgcatgaaagagaaa

SEQ ID NO: 3915614 - DNA, 20 bp, Homo sapiens
tgtgcatggaaatgtcctcc

SEQ ID NO: 3915615 - DNA, 17 bp, Homo sapiens
tgtgcatgtgtgtataa

SEQ ID NO: 3915616 - DNA, 19 bp, Homo sapiens
tgtgcatgtgtgtgtctgt

SEQ ID NO: 3915617 - DNA, 22 bp, Homo sapiens
tgtgcatgtttactttattaga

SEQ ID NO: 3915618 - DNA, 16 bp, Homo sapiens
tgtgccagagcctggg

SEQ ID NO: 3915619 - DNA, 18 bp, Homo sapiens
tgtgccagctcaggtgac

SEQ ID NO: 3915620 - DNA, 18 bp, Homo sapiens
tgtgccatagagtttaac

SEQ ID NO: 3915621 - DNA, 20 bp, Homo sapiens
tgtgcccacatcccaggctt

SEQ ID NO: 3915622 - DNA, 12 bp, Homo sapiens
tgtgcccttggg

SEQ ID NO: 3915623 - DNA, 17 bp, Homo sapiens
tgtgccgtgaactgcgt

SEQ ID NO: 3915624 - DNA, 21 bp, Homo sapiens
tgtgccgtgaactgcgtgcca

SEQ ID NO: 3915625 - DNA, 14 bp, Homo sapiens
tgtgcctcagcctc

SEQ ID NO: 3915626 - DNA, 12 bp, Homo sapiens
tgtgcctctgcc

SEQ ID NO: 3915627 - DNA, 12 bp, Homo sapiens
tgtgcctgccct

SEQ ID NO: 3915628 - DNA, 17 bp, Homo sapiens
tgtgcctgctagagcaa

SEQ ID NO: 3915629 - DNA, 13 bp, Homo sapiens
tgtgcctgtggca

SEQ ID NO: 3915630 - DNA, 15 bp, Homo sapiens
tgtgcctgtggcaga

SEQ ID NO: 3915631 - DNA, 21 bp, Homo sapiens
tgtgccttaaaaggagagaag

SEQ ID NO: 3915632 - DNA, 16 bp, Homo sapiens
tgtccaggccactgtg

SEQ ID NO: 3915633 - DNA, 18 bp, Homo sapiens
tgtccaggccactgtggc

SEQ ID NO: 3915634 - DNA, 20 bp, Homo sapiens
tgtccaggccactgtggcca

SEQ ID NO: 3915635 - DNA, 16 bp, Homo sapiens
tgtcccaacttgtaaa

SEQ ID NO: 3915636 - DNA, 15 bp, Homo sapiens
tgtcccaaggagctg

SEQ ID NO: 3915637 - DNA, 16 bp, Homo sapiens
tgtcccaaggagctga

SEQ ID NO: 3915638 - DNA, 20 bp, Homo sapiens
tgtcccaccaactctgcact

SEQ ID NO: 3915639 - DNA, 22 bp, Homo sapiens
tgtcccaccgggagcctccccc

SEQ ID NO: 3915640 - DNA, 23 bp, Homo sapiens
tgtcccagagcttattggccact

SEQ ID NO: 3915641 - DNA, 24 bp, Homo sapiens
tgtcccagaggttatctgcctggc

SEQ ID NO: 3915642 - DNA, 17 bp, Homo sapiens
tgtcccaggtcctcact

SEQ ID NO: 3915643 - DNA, 21 bp, Homo sapiens
tgtccccacgtatgtcggcac

SEQ ID NO: 3915644 - DNA, 12 bp, Homo sapiens
tgtccccagggc

SEQ ID NO: 3915645 - DNA, 14 bp, Homo sapiens
tgtccccagggccc

SEQ ID NO: 3915646 - DNA, 17 bp, Homo sapiens
tgtccccagggcccctc

SEQ ID NO: 3915647 - DNA, 13 bp, Homo sapiens
tgtcccccaaggt

SEQ ID NO: 3915648 - DNA, 14 bp, Homo sapiens
tgtcccccccagtg

SEQ ID NO: 3915649 - DNA, 14 bp, Homo sapiens
tgtcccccggggca

SEQ ID NO: 3915650 - DNA, 14 bp, Homo sapiens
tgtccccctgagat

SEQ ID NO: 3915651 - DNA, 20 bp, Homo sapiens
tgtccccctgagatcagagt

SEQ ID NO: 3915652 - DNA, 22 bp, Homo sapiens
tgtccccggggtattagcacct

SEQ ID NO: 3915653 - DNA, 18 bp, Homo sapiens
tgtcccctcactctgtca

SEQ ID NO: 3915654 - DNA, 23 bp, Homo sapiens
tgtcccctcactctgtcagccag

SEQ ID NO: 3915655 - DNA, 18 bp, Homo sapiens
tgtcccctccactgtcac

SEQ ID NO: 3915656 - DNA, 13 bp, Homo sapiens
tgtcccctctccc

SEQ ID NO: 3915657 - DNA, 14 bp, Homo sapiens
tgtcccctcttgac

SEQ ID NO: 3915658 - DNA, 15 bp, Homo sapiens
tgtcccgccttcctc

SEQ ID NO: 3915659 - DNA, 20 bp, Homo sapiens
tgtccctaccgagtctcttc

SEQ ID NO: 3915660 - DNA, 14 bp, Homo sapiens
tgtccctgctcctc

SEQ ID NO: 3915661 - DNA, 23 bp, Homo sapiens
tgtccgcctctgcccgcagagcc

SEQ ID NO: 3915662 - DNA, 14 bp, Homo sapiens
tgtcctatgtcaat

SEQ ID NO: 3915663 - DNA, 22 bp, Homo sapiens
tgtcctatgtgtgactctaaat

SEQ ID NO: 3915664 - DNA, 17 bp, Homo sapiens
tgtcctcccatcccctg

SEQ ID NO: 3915665 - DNA, 19 bp, Homo sapiens
tgtcctcccatcccctgga

SEQ ID NO: 3915666 - DNA, 10 bp, Homo sapiens
tgtcctcctc

SEQ ID NO: 3915667 - DNA, 16 bp, Homo sapiens
tgtcctctcccctctg

SEQ ID NO: 3915668 - DNA, 23 bp, Homo sapiens
tgtcctctcccgcgggcctggac

SEQ ID NO: 3915669 - DNA, 16 bp, Homo sapiens
tgtcctctcgagccca

SEQ ID NO: 3915670 - DNA, 22 bp, Homo sapiens
tgtcctctttactcccttcctg

SEQ ID NO: 3915671 - DNA, 14 bp, Homo sapiens
tgtcctgccagctg

SEQ ID NO: 3915672 - DNA, 16 bp, Homo sapiens
tgtcctgccagctgcc

SEQ ID NO: 3915673 - DNA, 17 bp, Homo sapiens
tgtcctgccagctgcct

SEQ ID NO: 3915674 - DNA, 22 bp, Homo sapiens
tgtcctgccagctgccttcctc

SEQ ID NO: 3915675 - DNA, 13 bp, Homo sapiens
tgtcctgcctctc

SEQ ID NO: 3915676 - DNA, 17 bp, Homo sapiens
tgtcctgctctcttcag

SEQ ID NO: 3915677 - DNA, 15 bp, Homo sapiens
tgtcctggtacagca

SEQ ID NO: 3915678 - DNA, 19 bp, Homo sapiens
tgtcctggtacagcagggt

SEQ ID NO: 3915679 - DNA, 14 bp, Homo sapiens
tgtccttcagagct

SEQ ID NO: 3915680 - DNA, 13 bp, Homo sapiens
tgtccttgcacct

SEQ ID NO: 3915681 - DNA, 15 bp, Homo sapiens
tgtccttgcacctgc

SEQ ID NO: 3915682 - DNA, 17 bp, Homo sapiens
tgtccttggggcacagt

SEQ ID NO: 3915683 - DNA, 17 bp, Homo sapiens
tgtcctttgagaaagaa

SEQ ID NO: 3915684 - DNA, 19 bp, Homo sapiens
tgtcctttgagaaagaaat

SEQ ID NO: 3915685 - DNA, 15 bp, Homo sapiens
tgtcgagacacttgc

SEQ ID NO: 3915686 - DNA, 16 bp, Homo sapiens
tgtcgccccaggccct

SEQ ID NO: 3915687 - DNA, 17 bp, Homo sapiens
tgtcgccccaggccctc

SEQ ID NO: 3915688 - DNA, 13 bp, Homo sapiens
tgtcgcctctgca

SEQ ID NO: 3915689 - DNA, 14 bp, Homo sapiens
tgtcgcctctgcat

SEQ ID NO: 3915690 - DNA, 15 bp, Homo sapiens
tgtcgtgtttacaaa

SEQ ID NO: 3915691 - DNA, 16 bp, Homo sapiens
tgtcgtgtttacaaaa

SEQ ID NO: 3915692 - DNA, 23 bp, Homo sapiens
tgtcgtgtttacaaaaggcagcc

SEQ ID NO: 3915693 - DNA, 19 bp, Homo sapiens
tgtctattcaaaatatcaa

SEQ ID NO: 3915694 - DNA, 15 bp, Homo sapiens
tgtctattctgagcc

SEQ ID NO: 3915695 - DNA, 18 bp, Homo sapiens
tgtctattctgagccttg

SEQ ID NO: 3915696 - DNA, 17 bp, Homo sapiens
tgtctcaagagggcact

SEQ ID NO: 3915697 - DNA, 14 bp, Homo sapiens
tgtctcacagacgc

SEQ ID NO: 3915698 - DNA, 14 bp, Homo sapiens
tgtctcacatggga

SEQ ID NO: 3915699 - DNA, 16 bp, Homo sapiens
tgtctcaggtccctgc

SEQ ID NO: 3915700 - DNA, 19 bp, Homo sapiens
tgtctccataatgccactg

SEQ ID NO: 3915701 - DNA, 20 bp, Homo sapiens
tgtctcctacctgctgctgc

SEQ ID NO: 3915702 - DNA, 22 bp, Homo sapiens
tgtctcctacctgctgctgcta

SEQ ID NO: 3915703 - DNA, 18 bp, Homo sapiens
tgtctcctggtctgtgct

SEQ ID NO: 3915704 - DNA, 19 bp, Homo sapiens
tgtctcgagcgccctgcag

SEQ ID NO: 3915705 - DNA, 16 bp, Homo sapiens
tgtctctagccacttt

SEQ ID NO: 3915706 - DNA, 22 bp, Homo sapiens
tgtctctagtttctttctgtta

SEQ ID NO: 3915707 - DNA, 10 bp, Homo sapiens
tgtctctctt

SEQ ID NO: 3915708 - DNA, 15 bp, Homo sapiens
tgtctcttcctctgt

SEQ ID NO: 3915709 - DNA, 14 bp, Homo sapiens
tgtctcttgtagaa

SEQ ID NO: 3915710 - DNA, 18 bp, Homo sapiens
tgtctcttgtagaagatg

SEQ ID NO: 3915711 - DNA, 17 bp, Homo sapiens
tgtctgaagtcactgca

SEQ ID NO: 3915712 - DNA, 18 bp, Homo sapiens
tgtctgaagtcactgcac

SEQ ID NO: 3915713 - DNA, 20 bp, Homo sapiens
tgtctgaagtcactgcacag

SEQ ID NO: 3915714 - DNA, 13 bp, Homo sapiens
tgtctgaggcctc

SEQ ID NO: 3915715 - DNA, 19 bp, Homo sapiens
tgtctgattggctcaccca

SEQ ID NO: 3915716 - DNA, 15 bp, Homo sapiens
tgtctgcattgttat

SEQ ID NO: 3915717 - DNA, 21 bp, Homo sapiens
tgtctggtggtggcaccatct

SEQ ID NO: 3915718 - DNA, 19 bp, Homo sapiens
ttcctcttccccttgccct

SEQ ID NO: 3915719 - DNA, 20 bp, Homo sapiens
ttcctcttctattttgtaaa

SEQ ID NO: 3915720 - DNA, 19 bp, Homo sapiens
ttcctcttgcctctctcag

SEQ ID NO: 3915721 - DNA, 19 bp, Homo sapiens
ttcctctttctctccttct

SEQ ID NO: 3915722 - DNA, 23 bp, Homo sapiens
ttcctgaagccagatccacccta

SEQ ID NO: 3915723 - DNA, 21 bp, Homo sapiens
ttcctgaccctccctacctga

SEQ ID NO: 3915724 - DNA, 19 bp, Homo sapiens
ttcctgaggatctagcttc

SEQ ID NO: 3915725 - DNA, 19 bp, Homo sapiens
ttcctgatggtacaggaaa

SEQ ID NO: 3915726 - DNA, 15 bp, Homo sapiens
ttcctgcactccaga

SEQ ID NO: 3915727 - DNA, 18 bp, Homo sapiens
ttcctgcatttgtgaaat

SEQ ID NO: 3915728 - DNA, 12 bp, Homo sapiens
ttcctgccacca

SEQ ID NO: 3915729 - DNA, 18 bp, Homo sapiens
ttcctgccaccagtcact

SEQ ID NO: 3915730 - DNA, 15 bp, Homo sapiens
ttcctggacagctgt

SEQ ID NO: 3915731 - DNA, 17 bp, Homo sapiens
ttcctggacagctgtgc

SEQ ID NO: 3915732 - DNA, 23 bp, Homo sapiens
ttcctggccccgggctctggcca

SEQ ID NO: 3915733 - DNA, 24 bp, Homo sapiens
ttcctggccccgggctctggccac

SEQ ID NO: 3915734 - DNA, 20 bp, Homo sapiens
ttcctggcctcactggctgg

SEQ ID NO: 3915735 - DNA, 21 bp, Homo sapiens
ttcctggcctcactggctggg

SEQ ID NO: 3915736 - DNA, 14 bp, Homo sapiens
ttcctgggcaagaa

SEQ ID NO: 3915737 - DNA, 16 bp, Homo sapiens
ttcctgggcctgtccc

SEQ ID NO: 3915738 - DNA, 23 bp, Homo sapiens
ttcctgggtggctactctgtgcc

SEQ ID NO: 3915739 - DNA, 22 bp, Homo sapiens
ttcctggtgaggcccagcctgt

SEQ ID NO: 3915740 - DNA, 22 bp, Homo sapiens
ttcctgtaacacaagccacaga

SEQ ID NO: 3915741 - DNA, 14 bp, Homo sapiens
ttcctgtggccagg

SEQ ID NO: 3915742 - DNA, 19 bp, Homo sapiens
ttcctgtggccaggaggtt

SEQ ID NO: 3915743 - DNA, 20 bp, Homo sapiens
ttcctgttcaccttatgtat

SEQ ID NO: 3915744 - DNA, 15 bp, Homo sapiens
ttccttaagccagga

SEQ ID NO: 3915745 - DNA, 22 bp, Homo sapiens
ttccttcagtgcatctgggaag

SEQ ID NO: 3915746 - DNA, 13 bp, Homo sapiens
ttccttctggagg

SEQ ID NO: 3915747 - DNA, 15 bp, Homo sapiens
ttcctttcctctgca

SEQ ID NO: 3915748 - DNA, 16 bp, Homo sapiens
ttcctttctaaatctg

SEQ ID NO: 3915749 - DNA, 20 bp, Homo sapiens
ttccttttaaaacacttcca

SEQ ID NO: 3915750 - DNA, 21 bp, Homo sapiens
ttccttttaaaacacttccat

SEQ ID NO: 3915751 - DNA, 20 bp, Homo sapiens
ttccttttattctgtacctt

SEQ ID NO: 3915752 - DNA, 18 bp, Homo sapiens
ttccttttctaactctcc

SEQ ID NO: 3915753 - DNA, 16 bp, Homo sapiens
ttccttttcttccttc

SEQ ID NO: 3915754 - DNA, 18 bp, Homo sapiens
ttccttttcttccttctt

SEQ ID NO: 3915755 - DNA, 15 bp, Homo sapiens
ttccttttgaaagaa

SEQ ID NO: 3915756 - DNA, 23 bp, Homo sapiens
ttccttttgaaagaatcagtctt

SEQ ID NO: 3915757 - DNA, 24 bp, Homo sapiens
ttcgcagccaccctgaggagtctg

SEQ ID NO: 3915758 - DNA, 12 bp, Homo sapiens
ttcgcctgtggg

SEQ ID NO: 3915759 - DNA, 12 bp, Homo sapiens
ttcgctgccagg

SEQ ID NO: 3915760 - DNA, 15 bp, Homo sapiens
ttcgctgccaggaca

SEQ ID NO: 3915761 - DNA, 21 bp, Homo sapiens
ttcgctgccaggacacctgcc

SEQ ID NO: 3915762 - DNA, 22 bp, Homo sapiens
ttcgctgccaggacacctgccc

SEQ ID NO: 3915763 - DNA, 19 bp, Homo sapiens
ttcgctgctagagaagggg

SEQ ID NO: 3915764 - DNA, 14 bp, Homo sapiens
ttcgctgctctagc

SEQ ID NO: 3915765 - DNA, 19 bp, Homo sapiens
ttcgctgctctagctggca

SEQ ID NO: 3915766 - DNA, 18 bp, Homo sapiens
ttcgcttgcttctgcagc

SEQ ID NO: 3915767 - DNA, 18 bp, Homo sapiens
ttcggaagggaaaacagt

SEQ ID NO: 3915768 - DNA, 19 bp, Homo sapiens
ttcggtgggacagccccag

SEQ ID NO: 3915769 - DNA, 18 bp, Homo sapiens
ttcgtcatttgcaagctg

SEQ ID NO: 3915770 - DNA, 20 bp, Homo sapiens
ttcgtgtagtggaagagcag

SEQ ID NO: 3915771 - DNA, 21 bp, Homo sapiens
ttcgtgtctctcccaccccgg

SEQ ID NO: 3915772 - DNA, 13 bp, Homo sapiens
ttctaacctcagc

SEQ ID NO: 3915773 - DNA, 15 bp, Homo sapiens
ttctaactccagtga

SEQ ID NO: 3915774 - DNA, 14 bp, Homo sapiens
ttctaactgtaaat

SEQ ID NO: 3915775 - DNA, 17 bp, Homo sapiens
ttctaactgtaaatcac

SEQ ID NO: 3915776 - DNA, 19 bp, Homo sapiens
ttctaactgtaaatcactt

SEQ ID NO: 3915777 - DNA, 22 bp, Homo sapiens
ttctaactgtaaatcacttgta

SEQ ID NO: 3915778 - DNA, 16 bp, Homo sapiens
ttctaagagcatagaa

SEQ ID NO: 3915779 - DNA, 15 bp, Homo sapiens
ttctaagtaaaacca

SEQ ID NO: 3915780 - DNA, 21 bp, Homo sapiens
ttctaagttcatgtttgtaaa

SEQ ID NO: 3915781 - DNA, 13 bp, Homo sapiens
ttctacaaccaga

SEQ ID NO: 3915782 - DNA, 15 bp, Homo sapiens
ttctacaaccagagc

SEQ ID NO: 3915783 - DNA, 15 bp, Homo sapiens
ttctacaagcatatt

SEQ ID NO: 3915784 - DNA, 16 bp, Homo sapiens
ttctacaagcatattt

SEQ ID NO: 3915785 - DNA, 13 bp, Homo sapiens
ttctacacagtaa

SEQ ID NO: 3915786 - DNA, 22 bp, Homo sapiens
ttctacacagtgggaactctga

SEQ ID NO: 3915787 - DNA, 15 bp, Homo sapiens
ttctaccatttcaga

SEQ ID NO: 3915788 - DNA, 19 bp, Homo sapiens
ttctacttgcactagcatg

SEQ ID NO: 3915789 - DNA, 16 bp, Homo sapiens
ttctagctagaaatat

SEQ ID NO: 3915790 - DNA, 18 bp, Homo sapiens
ttctaggtcctggcttct

SEQ ID NO: 3915791 - DNA, 21 bp, Homo sapiens
ttctagtctcctttgcactga

SEQ ID NO: 3915792 - DNA, 19 bp, Homo sapiens
ttctataaaatactggtat

SEQ ID NO: 3915793 - DNA, 18 bp, Homo sapiens
ttctatataaggaggaaa

SEQ ID NO: 3915794 - DNA, 17 bp, Homo sapiens
ttctatcacatatttga

SEQ ID NO: 3915795 - DNA, 17 bp, Homo sapiens
ttctatttaaaaaataa

SEQ ID NO: 3915796 - DNA, 16 bp, Homo sapiens
ttctcaaagaatctca

SEQ ID NO: 3915797 - DNA, 15 bp, Homo sapiens
ttctcaacctaccac

SEQ ID NO: 3915798 - DNA, 13 bp, Homo sapiens
ttctcaccaggaa

SEQ ID NO: 3915799 - DNA, 18 bp, Homo sapiens
ttctcactcctacctggt

SEQ ID NO: 3915800 - DNA, 16 bp, Homo sapiens
ttctcaggacacaggc

SEQ ID NO: 3915801 - DNA, 21 bp, Homo sapiens
ttctcatcatattgtatgtaa

SEQ ID NO: 3915802 - DNA, 17 bp, Homo sapiens
ttctcatgtgatccttt

SEQ ID NO: 3915803 - DNA, 16 bp, Homo sapiens
ttaaaatatatataaa

SEQ ID NO: 3915804 - DNA, 17 bp, Homo sapiens
ttaaaatatatataaat

SEQ ID NO: 3915805 - DNA, 18 bp, Homo sapiens
ttaaaatatatataaata

SEQ ID NO: 3915806 - DNA, 19 bp, Homo sapiens
ttaaaatattcctgcattt

SEQ ID NO: 3915807 - DNA, 14 bp, Homo sapiens
ttaaaatcatttct

SEQ ID NO: 3915808 - DNA, 22 bp, Homo sapiens
ttaaaatcatttctgcatcagc

SEQ ID NO: 3915809 - DNA, 14 bp, Homo sapiens
ttaaaatctgattt

SEQ ID NO: 3915810 - DNA, 13 bp, Homo sapiens
ttaaaatgtacac

SEQ ID NO: 3915811 - DNA, 19 bp, Homo sapiens
ttaaaattttacttttgtt

SEQ ID NO: 3915812 - DNA, 14 bp, Homo sapiens
ttaaacaaaggttg

SEQ ID NO: 3915813 - DNA, 14 bp, Homo sapiens
ttaaacactgtaat

SEQ ID NO: 3915814 - DNA, 17 bp, Homo sapiens
ttaaacactgtaatctt

SEQ ID NO: 3915815 - DNA, 17 bp, Homo sapiens
ttaaacagactttagct

SEQ ID NO: 3915816 - DNA, 18 bp, Homo sapiens
ttaaacagtgagcctgaa

SEQ ID NO: 3915817 - DNA, 19 bp, Homo sapiens
ttaaaccagcagaaaagtg

SEQ ID NO: 3915818 - DNA, 21 bp, Homo sapiens
ttaaaccagcagaaaagtgct

SEQ ID NO: 3915819 - DNA, 18 bp, Homo sapiens
ttaaacctctcttctacc

SEQ ID NO: 3915820 - DNA, 16 bp, Homo sapiens
ttaaacttgtcagaat

SEQ ID NO: 3915821 - DNA, 11 bp, Homo sapiens
ttaaagaaagt

SEQ ID NO: 3915822 - DNA, 11 bp, Homo sapiens
ttaaagactta

SEQ ID NO: 3915823 - DNA, 18 bp, Homo sapiens
ttaaagacttaagattaa

SEQ ID NO: 3915824 - DNA, 22 bp, Homo sapiens
ttaaagccacaaccacatacaa

SEQ ID NO: 3915825 - DNA, 14 bp, Homo sapiens
ttaaagctgcctgt

SEQ ID NO: 3915826 - DNA, 15 bp, Homo sapiens
ttaaagctgcctgta

SEQ ID NO: 3915827 - DNA, 20 bp, Homo sapiens
ttaaagcttattaaaactca

SEQ ID NO: 3915828 - DNA, 22 bp, Homo sapiens
ttaaaggaaaagtcaacatctt

SEQ ID NO: 3915829 - DNA, 18 bp, Homo sapiens
ttaaaggtagagatgtgt

SEQ ID NO: 3915830 - DNA, 22 bp, Homo sapiens
tgtgtaggtattaaagatgtgt

SEQ ID NO: 3915831 - DNA, 21 bp, Homo sapiens
tgtgtatagatgcaagatatt

SEQ ID NO: 3915832 - DNA, 13 bp, Homo sapiens
tgtgtatatatac

SEQ ID NO: 3915833 - DNA, 13 bp, Homo sapiens
tgtgtattctggc

SEQ ID NO: 3915834 - DNA, 15 bp, Homo sapiens
tgtgtcacagctctg

SEQ ID NO: 3915835 - DNA, 16 bp, Homo sapiens
tgtgtccagcagctgc

SEQ ID NO: 3915836 - DNA, 13 bp, Homo sapiens
tgtgtcccctcac

SEQ ID NO: 3915837 - DNA, 17 bp, Homo sapiens
tgtgtcccctcactctg

SEQ ID NO: 3915838 - DNA, 19 bp, Homo sapiens
tgtgtcccctcactctgtc

SEQ ID NO: 3915839 - DNA, 12 bp, Homo sapiens
tgtgtcctctcc

SEQ ID NO: 3915840 - DNA, 14 bp, Homo sapiens
tgtgtcctctcccc

SEQ ID NO: 3915841 - DNA, 21 bp, Homo sapiens
tgtgtcctctcccctctgccc

SEQ ID NO: 3915842 - DNA, 14 bp, Homo sapiens
tgtgtccttccctg

SEQ ID NO: 3915843 - DNA, 18 bp, Homo sapiens
tgtgtccttggggcacag

SEQ ID NO: 3915844 - DNA, 14 bp, Homo sapiens
tgtgtctgctcagt

SEQ ID NO: 3915845 - DNA, 20 bp, Homo sapiens
tgtgtctgtgtggtatattt

SEQ ID NO: 3915846 - DNA, 20 bp, Homo sapiens
tgtgtgaaataccagtgtgg

SEQ ID NO: 3915847 - DNA, 12 bp, Homo sapiens
tgtgtgaagaaa

SEQ ID NO: 3915848 - DNA, 14 bp, Homo sapiens
tgtgtgaagaaatg

SEQ ID NO: 3915849 - DNA, 17 bp, Homo sapiens
tgtgtgaagttacacaa

SEQ ID NO: 3915850 - DNA, 16 bp, Homo sapiens
tgtgtgatgaactttc

SEQ ID NO: 3915851 - DNA, 22 bp, Homo sapiens
tgtgtgcaccttaccaactttc

SEQ ID NO: 3915852 - DNA, 16 bp, Homo sapiens
tgtgtgcatgtatgtg

SEQ ID NO: 3915853 - DNA, 12 bp, Homo sapiens
tgtgtgcatgtg

SEQ ID NO: 3915854 - DNA, 22 bp, Homo sapiens
ttctggaaaaaaaatatatata

SEQ ID NO: 3915855 - DNA, 11 bp, Homo sapiens
ttctggaaatt

SEQ ID NO: 3915856 - DNA, 15 bp, Homo sapiens
ttctggaaattttgt

SEQ ID NO: 3915857 - DNA, 18 bp, Homo sapiens
ttctggaaggctggctga

SEQ ID NO: 3915858 - DNA, 19 bp, Homo sapiens
ttctggaaggctggctgag

SEQ ID NO: 3915859 - DNA, 23 bp, Homo sapiens
ttctggagcaagagagagctcgc

SEQ ID NO: 3915860 - DNA, 23 bp, Homo sapiens
ttctggattttcccctgaagact

SEQ ID NO: 3915861 - DNA, 12 bp, Homo sapiens
ttctggcctcag

SEQ ID NO: 3915862 - DNA, 14 bp, Homo sapiens
ttctggcctcagca

SEQ ID NO: 3915863 - DNA, 20 bp, Homo sapiens
ttctggcttccttctctcaa

SEQ ID NO: 3915864 - DNA, 21 bp, Homo sapiens
ttctggggaggaagggccagg

SEQ ID NO: 3915865 - DNA, 14 bp, Homo sapiens
ttctgggtggcctc

SEQ ID NO: 3915866 - DNA, 16 bp, Homo sapiens
ttctggttgcttcaga

SEQ ID NO: 3915867 - DNA, 16 bp, Homo sapiens
ttctgtaggttctgtg

SEQ ID NO: 3915868 - DNA, 14 bp, Homo sapiens
ttctgtctctcttg

SEQ ID NO: 3915869 - DNA, 14 bp, Homo sapiens
ttctgtctttagat

SEQ ID NO: 3915870 - DNA, 12 bp, Homo sapiens
ttctgtggctca

SEQ ID NO: 3915871 - DNA, 23 bp, Homo sapiens
ttctgtgtgcaccttaccaactt

SEQ ID NO: 3915872 - DNA, 16 bp, Homo sapiens
ttctgttgtaatagtc

SEQ ID NO: 3915873 - DNA, 22 bp, Homo sapiens
ttctgtttctattctctcctca

SEQ ID NO: 3915874 - DNA, 15 bp, Homo sapiens
ttcttaaaggaaaag

SEQ ID NO: 3915875 - DNA, 19 bp, Homo sapiens
ttcttaaaggcctggaacc

SEQ ID NO: 3915876 - DNA, 20 bp, Homo sapiens
ttcttaaggattgtgatatt

SEQ ID NO: 3915877 - DNA, 16 bp, Homo sapiens
ttcttacataattttt

SEQ ID NO: 3915878 - DNA, 15 bp, Homo sapiens
ttcttacctgtatgt

SEQ ID NO: 3915879 - DNA, 13 bp, Homo sapiens
ttcttatgatttt

SEQ ID NO: 3915880 - DNA, 15 bp, Homo sapiens
ttcttatttcatttc

SEQ ID NO: 3915881 - DNA, 23 bp, Homo sapiens
ttcttcagccacctctctttttc

SEQ ID NO: 3915882 - DNA, 13 bp, Homo sapiens
ttcttcatcttga

SEQ ID NO: 3915883 - DNA, 14 bp, Homo sapiens
ttcttcatcttgac

SEQ ID NO: 3915884 - DNA, 20 bp, Homo sapiens
ttcttcattcaatacaagtg

SEQ ID NO: 3915885 - DNA, 11 bp, Homo sapiens
ttcttcctctg

SEQ ID NO: 3915886 - DNA, 16 bp, Homo sapiens
ttcttcgctgctctag

SEQ ID NO: 3915887 - DNA, 14 bp, Homo sapiens
ttcttctaaaattg

SEQ ID NO: 3915888 - DNA, 19 bp, Homo sapiens
ttcttctacaaccagagcc

SEQ ID NO: 3915889 - DNA, 20 bp, Homo sapiens
ttcttctacaaccagagccc

SEQ ID NO: 3915890 - DNA, 17 bp, Homo sapiens
ttcttgaagttcatggt

SEQ ID NO: 3915891 - DNA, 15 bp, Homo sapiens
ttcttgaatatctgc

SEQ ID NO: 3915892 - DNA, 15 bp, Homo sapiens
ttcttgagtagatct

SEQ ID NO: 3915893 - DNA, 14 bp, Homo sapiens
ttcttgatgtcatg

SEQ ID NO: 3915894 - DNA, 18 bp, Homo sapiens
ttaatctttgtgacagga

SEQ ID NO: 3915895 - DNA, 12 bp, Homo sapiens
ttaatgactttt

SEQ ID NO: 3915896 - DNA, 14 bp, Homo sapiens
ttaatgacttttta

SEQ ID NO: 3915897 - DNA, 20 bp, Homo sapiens
ttaatgcatgttaggaaaat

SEQ ID NO: 3915898 - DNA, 23 bp, Homo sapiens
ttaatgttgggatttatatctat

SEQ ID NO: 3915899 - DNA, 16 bp, Homo sapiens
ttaatgttttctgctg

SEQ ID NO: 3915900 - DNA, 23 bp, Homo sapiens
ttaattaactatgtgatgttaac

SEQ ID NO: 3915901 - DNA, 15 bp, Homo sapiens
ttaattatcttttct

SEQ ID NO: 3915902 - DNA, 14 bp, Homo sapiens
ttaattattaatac

SEQ ID NO: 3915903 - DNA, 16 bp, Homo sapiens
ttaatttatatttgaa

SEQ ID NO: 3915904 - DNA, 19 bp, Homo sapiens
ttaatttatatttgaaatt

SEQ ID NO: 3915905 - DNA, 20 bp, Homo sapiens
ttaattttcctggaaagact

SEQ ID NO: 3915906 - DNA, 16 bp, Homo sapiens
ttaattttttttaatg

SEQ ID NO: 3915907 - DNA, 19 bp, Homo sapiens
ttacaaaaggcagcccttt

SEQ ID NO: 3915908 - DNA, 14 bp, Homo sapiens
ttacaacagtaaca

SEQ ID NO: 3915909 - DNA, 18 bp, Homo sapiens
ttacaacagtaacacatc

SEQ ID NO: 3915910 - DNA, 16 bp, Homo sapiens
ttacaagaattgtcca

SEQ ID NO: 3915911 - DNA, 16 bp, Homo sapiens
ttacacagcccaagag

SEQ ID NO: 3915912 - DNA, 21 bp, Homo sapiens
ttacacttggagcccgtgcag

SEQ ID NO: 3915913 - DNA, 13 bp, Homo sapiens
ttacagctgcctg

SEQ ID NO: 3915914 - DNA, 22 bp, Homo sapiens
ttacagctttacacacacagat

SEQ ID NO: 3915915 - DNA, 15 bp, Homo sapiens
ttacagtaaataaat

SEQ ID NO: 3915916 - DNA, 17 bp, Homo sapiens
ttacagtaaataaattg

SEQ ID NO: 3915917 - DNA, 12 bp, Homo sapiens
ttacagtgactg

SEQ ID NO: 3915918 - DNA, 16 bp, Homo sapiens
ttacatcatcctcctt

SEQ ID NO: 3915919 - DNA, 13 bp, Homo sapiens
ttacatccttaaa

SEQ ID NO: 3915920 - DNA, 21 bp, Homo sapiens
ttacatctgttttaaatttat

SEQ ID NO: 3915921 - DNA, 10 bp, Homo sapiens
ttacatgacc

SEQ ID NO: 3915922 - DNA, 18 bp, Homo sapiens
ttgacaaggtagacatgg

SEQ ID NO: 3915923 - DNA, 20 bp, Homo sapiens
ttgacacggtgaaatccagg

SEQ ID NO: 3915924 - DNA, 20 bp, Homo sapiens
ttgacataacactataaagg

SEQ ID NO: 3915925 - DNA, 11 bp, Homo sapiens
ttgacattcct

SEQ ID NO: 3915926 - DNA, 21 bp, Homo sapiens
ttgacattgtatgtatctatt

SEQ ID NO: 3915927 - DNA, 12 bp, Homo sapiens
ttgaccagacct

SEQ ID NO: 3915928 - DNA, 14 bp, Homo sapiens
ttgacccactcaca

SEQ ID NO: 3915929 - DNA, 20 bp, Homo sapiens
ttgacccactcacacttgga

SEQ ID NO: 3915930 - DNA, 22 bp, Homo sapiens
ttgacctcacagtgacccttcc

SEQ ID NO: 3915931 - DNA, 16 bp, Homo sapiens
ttgacctcagctgcac

SEQ ID NO: 3915932 - DNA, 20 bp, Homo sapiens
ttgactatcacatacaattt

SEQ ID NO: 3915933 - DNA, 21 bp, Homo sapiens
ttgactatcacatacaatttg

SEQ ID NO: 3915934 - DNA, 14 bp, Homo sapiens
ttgacttcttggtt

SEQ ID NO: 3915935 - DNA, 12 bp, Homo sapiens
ttgactttcagg

SEQ ID NO: 3915936 - DNA, 21 bp, Homo sapiens
ttgactttcaggtactaaata

SEQ ID NO: 3915937 - DNA, 21 bp, Homo sapiens
ttgagaaaggattaagataca

SEQ ID NO: 3915938 - DNA, 23 bp, Homo sapiens
ttgagaagggaaatcttagcatg

SEQ ID NO: 3915939 - DNA, 16 bp, Homo sapiens
ttgagaagttttgtac

SEQ ID NO: 3915940 - DNA, 19 bp, Homo sapiens
ttgagaagttttgtacaga

SEQ ID NO: 3915941 - DNA, 15 bp, Homo sapiens
ttgagaatgtgattc

SEQ ID NO: 3915942 - DNA, 13 bp, Homo sapiens
ttgagaattttaa

SEQ ID NO: 3915943 - DNA, 17 bp, Homo sapiens
ttgagacctcagccatg

SEQ ID NO: 3915944 - DNA, 13 bp, Homo sapiens
ttgagagaagcca

SEQ ID NO: 3915945 - DNA, 15 bp, Homo sapiens
ttgagatttctttta

SEQ ID NO: 3915946 - DNA, 20 bp, Homo sapiens
ttgagcaattcatttcactt

SEQ ID NO: 3915947 - DNA, 16 bp, Homo sapiens
ttgagcactcagtcta

SEQ ID NO: 3915948 - DNA, 23 bp, Homo sapiens
ttgagctcagacccccactctca

SEQ ID NO: 3915949 - DNA, 23 bp, Homo sapiens
ttgagctgtatatatatatgtgt

SEQ ID NO: 3915950 - DNA, 15 bp, Homo sapiens
ttgaggacacatgtc

SEQ ID NO: 3915951 - DNA, 17 bp, Homo sapiens
ttgaggattttgagtat

SEQ ID NO: 3915952 - DNA, 21 bp, Homo sapiens
ttgaggcaaaggccagcagca

SEQ ID NO: 3915953 - DNA, 20 bp, Homo sapiens
ttgagggacgatctttgaat

SEQ ID NO: 3915954 - DNA, 22 bp, Homo sapiens
ttgaggtggaagccctccttcc

SEQ ID NO: 3915955 - DNA, 18 bp, Homo sapiens
ttgaggttaaaatataaa

SEQ ID NO: 3915956 - DNA, 19 bp, Homo sapiens
ttgagtacagtgaggaggg

SEQ ID NO: 3915957 - DNA, 21 bp, Homo sapiens
ttgagtcaaaagcctgggtga

SEQ ID NO: 3915958 - DNA, 17 bp, Homo sapiens
ttgagtctcaggccctg

SEQ ID NO: 3915959 - DNA, 16 bp, Homo sapiens
ttgagtgcaacaagag

SEQ ID NO: 3915960 - DNA, 16 bp, Homo sapiens
ttgagttcaaattttg

SEQ ID NO: 3915961 - DNA, 14 bp, Homo sapiens
ttgagttggacaca

SEQ ID NO: 3915962 - DNA, 17 bp, Homo sapiens
ttgagttggacacactg

SEQ ID NO: 3915963 - DNA, 17 bp, Homo sapiens
ttgtccttcagagctct

SEQ ID NO: 3915964 - DNA, 19 bp, Homo sapiens
ttgtcctttgagaaagaaa

SEQ ID NO: 3915965 - DNA, 21 bp, Homo sapiens
ttgtctgaagtcactgcacag

SEQ ID NO: 3915966 - DNA, 13 bp, Homo sapiens
ttgtctgaggcct

SEQ ID NO: 3915967 - DNA, 19 bp, Homo sapiens
ttgtctgaggcctcatccc

SEQ ID NO: 3915968 - DNA, 13 bp, Homo sapiens
ttgtcttccaacc

SEQ ID NO: 3915969 - DNA, 13 bp, Homo sapiens
ttgtcttgtggag

SEQ ID NO: 3915970 - DNA, 13 bp, Homo sapiens
ttgtctttcagga

SEQ ID NO: 3915971 - DNA, 23 bp, Homo sapiens
ttgtgaaaccacaggcccttggg

SEQ ID NO: 3915972 - DNA, 21 bp, Homo sapiens
ttgtgacaggaaagccctccc

SEQ ID NO: 3915973 - DNA, 22 bp, Homo sapiens
ttgtgacaggaaagccctcccc

SEQ ID NO: 3915974 - DNA, 18 bp, Homo sapiens
ttgtgatgtcccaacttg

SEQ ID NO: 3915975 - DNA, 14 bp, Homo sapiens
ttgtgcatgtttac

SEQ ID NO: 3915976 - DNA, 22 bp, Homo sapiens
ttgtgccctgcccccatctccc

SEQ ID NO: 3915977 - DNA, 12 bp, Homo sapiens
ttgtgcctcagc

SEQ ID NO: 3915978 - DNA, 16 bp, Homo sapiens
ttgtgccttttatagc

SEQ ID NO: 3915979 - DNA, 14 bp, Homo sapiens
ttgtgctgtgggca

SEQ ID NO: 3915980 - DNA, 15 bp, Homo sapiens
ttgtgctgtgggcag

SEQ ID NO: 3915981 - DNA, 16 bp, Homo sapiens
ttgtggcccaagcctg

SEQ ID NO: 3915982 - DNA, 19 bp, Homo sapiens
ttgtgtaatagaaaactga

SEQ ID NO: 3915983 - DNA, 21 bp, Homo sapiens
ttgtgtaatagaaaactgaaa

SEQ ID NO: 3915984 - DNA, 15 bp, Homo sapiens
ttgtgtacagtgtgt

SEQ ID NO: 3915985 - DNA, 12 bp, Homo sapiens
ttgtgtatgtgt

SEQ ID NO: 3915986 - DNA, 17 bp, Homo sapiens
ttgttaaaaatattttc

SEQ ID NO: 3915987 - DNA, 16 bp, Homo sapiens
ttgttaaaataactag

SEQ ID NO: 3915988 - DNA, 12 bp, Homo sapiens
ttgttaaacacg

SEQ ID NO: 3915989 - DNA, 17 bp, Homo sapiens
ttgttaatggtgcaaat

SEQ ID NO: 3915990 - DNA, 11 bp, Homo sapiens
ttgttaatgtt

SEQ ID NO: 3915991 - DNA, 21 bp, Homo sapiens
ttgttaatgttgggatttata

SEQ ID NO: 3915992 - DNA, 13 bp, Homo sapiens
ttgttatgtatat

SEQ ID NO: 3915993 - DNA, 21 bp, Homo sapiens
ttgttatgtatatagatgtgc

SEQ ID NO: 3915994 - DNA, 22 bp, Homo sapiens
ttgttatgtatatagatgtgca

SEQ ID NO: 3915995 - DNA, 17 bp, Homo sapiens
ttgttattgtggaagat

SEQ ID NO: 3915996 - DNA, 22 bp, Homo sapiens
ttgttctccgggtgtggcctca

SEQ ID NO: 3915997 - DNA, 23 bp, Homo sapiens
ttgttctcctccattgctgttgt

SEQ ID NO: 3915998 - DNA, 12 bp, Homo sapiens
ttgttgccaact

SEQ ID NO: 3915999 - DNA, 22 bp, Homo sapiens
ttgttgctccctgtgacaaaat

SEQ ID NO: 3916000 - DNA, 21 bp, Homo sapiens
ttgttgtgattttgtacagaa

SEQ ID NO: 3916001 - DNA, 14 bp, Homo sapiens
aaacataagtgcaa

SEQ ID NO: 3916002 - DNA, 13 bp, Homo sapiens
aaacataattctt

SEQ ID NO: 3916003 - DNA, 16 bp, Homo sapiens
aaacatagcttgtaac

SEQ ID NO: 3916004 - DNA, 14 bp, Homo sapiens
aaacatatcaattc

SEQ ID NO: 3916005 - DNA, 21 bp, Homo sapiens
aaacatatcaattcaacacat

SEQ ID NO: 3916006 - DNA, 13 bp, Homo sapiens
aaacatgacactg

SEQ ID NO: 3916007 - DNA, 18 bp, Homo sapiens
aaacatgtacaaaatcga

SEQ ID NO: 3916008 - DNA, 12 bp, Homo sapiens
aaacattaaaca

SEQ ID NO: 3916009 - DNA, 18 bp, Homo sapiens
aaacattaaacactgtaa

SEQ ID NO: 3916010 - DNA, 21 bp, Homo sapiens
aaacattaaacactgtaatct

SEQ ID NO: 3916011 - DNA, 16 bp, Homo sapiens
aaacattaaatgtctt

SEQ ID NO: 3916012 - DNA, 15 bp, Homo sapiens
aaacattaagattga

SEQ ID NO: 3916013 - DNA, 13 bp, Homo sapiens
aaacatttacaat

SEQ ID NO: 3916014 - DNA, 16 bp, Homo sapiens
aaacattttctttctt

SEQ ID NO: 3916015 - DNA, 18 bp, Homo sapiens
aaacattttctttctttt

SEQ ID NO: 3916016 - DNA, 22 bp, Homo sapiens
aaaccaaaaaggctagtttatt

SEQ ID NO: 3916017 - DNA, 13 bp, Homo sapiens
aaaccaaaggaca

SEQ ID NO: 3916018 - DNA, 16 bp, Homo sapiens
aaaccaagccgtggct

SEQ ID NO: 3916019 - DNA, 16 bp, Homo sapiens
aaaccacacttcttga

SEQ ID NO: 3916020 - DNA, 16 bp, Homo sapiens
aaaccacagcagttga

SEQ ID NO: 3916021 - DNA, 20 bp, Homo sapiens
aaaccacaggttccatagaa

SEQ ID NO: 3916022 - DNA, 23 bp, Homo sapiens
aaaccaccagtgcccaaagtctg

SEQ ID NO: 3916023 - DNA, 15 bp, Homo sapiens
aaaccagcagaaaag

SEQ ID NO: 3916024 - DNA, 19 bp, Homo sapiens
aaaccagcagaaaagtgct

SEQ ID NO: 3916025 - DNA, 13 bp, Homo sapiens
aaaccagggatag

SEQ ID NO: 3916026 - DNA, 16 bp, Homo sapiens
aaaccagtatggaagg

SEQ ID NO: 3916027 - DNA, 20 bp, Homo sapiens
aaaccagtatggaagggagg

SEQ ID NO: 3916028 - DNA, 22 bp, Homo sapiens
aaaccagtatggaagggagggg

SEQ ID NO: 3916029 - DNA, 21 bp, Homo sapiens
aaaccagttaagaatggaaga

SEQ ID NO: 3916030 - DNA, 15 bp, Homo sapiens
aaaccatgcaaatgc

SEQ ID NO: 3916031 - DNA, 16 bp, Homo sapiens
aaaccatgcagcttca

SEQ ID NO: 3916032 - DNA, 19 bp, Homo sapiens
aaaccatgcagcttcatca

SEQ ID NO: 3916033 - DNA, 18 bp, Homo sapiens
aaaccatttaattcataa

SEQ ID NO: 3916034 - DNA, 19 bp, Homo sapiens
aaaccatttaattcataat

SEQ ID NO: 3916035 - DNA, 17 bp, Homo sapiens
aaacccaaataaatgtg

SEQ ID NO: 3916036 - DNA, 23 bp, Homo sapiens
aaacccaaataaatgtgtaaatg

SEQ ID NO: 3916037 - DNA, 15 bp, Homo sapiens
aaaccccaagcagca

SEQ ID NO: 3916038 - DNA, 23 bp, Homo sapiens
aaaccccatttgctttcttttct

SEQ ID NO: 3916039 - DNA, 13 bp, Homo sapiens
aaacccttctctt

SEQ ID NO: 3916040 - DNA, 17 bp, Homo sapiens
aaacccttctcttctcc

SEQ ID NO: 3916041 - DNA, 14 bp, Homo sapiens
aaaccgtaatttta

SEQ ID NO: 3916042 - DNA, 16 bp, Homo sapiens
aaaccgtaattttatt

SEQ ID NO: 3916043 - DNA, 19 bp, Homo sapiens
aaacctagaacttcaaaat

SEQ ID NO: 3916044 - DNA, 21 bp, Homo sapiens
aaacctcagtcatattcttat

SEQ ID NO: 3916045 - DNA, 16 bp, Homo sapiens
aaacctgaaaaaaagt

SEQ ID NO: 3916046 - DNA, 17 bp, Homo sapiens
aaacctggagatgatga

SEQ ID NO: 3916047 - DNA, 13 bp, Homo sapiens
aaaccttgattta

SEQ ID NO: 3916048 - DNA, 13 bp, Homo sapiens
aaaccttgcagca

SEQ ID NO: 3916049 - DNA, 14 bp, Homo sapiens
aaaccttgcagcat

SEQ ID NO: 3916050 - DNA, 17 bp, Homo sapiens
aaacctttcaaatttca

SEQ ID NO: 3916051 - DNA, 19 bp, Homo sapiens
aaacctttccccagacaca

SEQ ID NO: 3916052 - DNA, 20 bp, Homo sapiens
aaacctttccccagacacat

SEQ ID NO: 3916053 - DNA, 18 bp, Homo sapiens
aaacgaagccatctttct

SEQ ID NO: 3916054 - DNA, 18 bp, Homo sapiens
aaacgactccgagaacaa

SEQ ID NO: 3916055 - DNA, 13 bp, Homo sapiens
aaacgcagacact

SEQ ID NO: 3916056 - DNA, 20 bp, Homo sapiens
aaacgcctcttttccctctc

SEQ ID NO: 3916057 - DNA, 13 bp, Homo sapiens
aaactaaatctct

SEQ ID NO: 3916058 - DNA, 14 bp, Homo sapiens
aaactaacaaccaa

SEQ ID NO: 3916059 - DNA, 14 bp, Homo sapiens
aaactagtttccag

SEQ ID NO: 3916060 - DNA, 15 bp, Homo sapiens
aaactagtttccagt

SEQ ID NO: 3916061 - DNA, 17 bp, Homo sapiens
aaactataaactactgt

SEQ ID NO: 3916062 - DNA, 18 bp, Homo sapiens
aaactataaactactgta

SEQ ID NO: 3916063 - DNA, 22 bp, Homo sapiens
aaactataaactactgtaatta

SEQ ID NO: 3916064 - DNA, 11 bp, Homo sapiens
aaactatcagt

SEQ ID NO: 3916065 - DNA, 16 bp, Homo sapiens
aaactatcagtttgtc

SEQ ID NO: 3916066 - DNA, 23 bp, Homo sapiens
aaactatccaattaaaattaagg

SEQ ID NO: 3916067 - DNA, 18 bp, Homo sapiens
aaactcaaaacttaacat

SEQ ID NO: 3916068 - DNA, 19 bp, Homo sapiens
aaactccgtcttagaagtg

SEQ ID NO: 3916069 - DNA, 11 bp, Homo sapiens
aaactcctgcc

SEQ ID NO: 3916070 - DNA, 20 bp, Homo sapiens
aaactctaaacattaatcaa

SEQ ID NO: 3916071 - DNA, 14 bp, Homo sapiens
aaactctgggaaat

SEQ ID NO: 3916072 - DNA, 16 bp, Homo sapiens
aaactgaaaaatgtca

SEQ ID NO: 3916073 - DNA, 18 bp, Homo sapiens
aaactgaaaaattttatt

SEQ ID NO: 3916074 - DNA, 13 bp, Homo sapiens
aaactgaaaatct

SEQ ID NO: 3916075 - DNA, 19 bp, Homo sapiens
aaactgaaaatctaatatt

SEQ ID NO: 3916076 - DNA, 14 bp, Homo sapiens
aaactgaatggaag

SEQ ID NO: 3916077 - DNA, 22 bp, Homo sapiens
aaactgacaacctgtgcagtcc

SEQ ID NO: 3916078 - DNA, 21 bp, Homo sapiens
aaactgagatgtgaacacatc

SEQ ID NO: 3916079 - DNA, 23 bp, Homo sapiens
aaactgaggagtagctgagagga

SEQ ID NO: 3916080 - DNA, 21 bp, Homo sapiens
aaactgatcaaaaataaacta

SEQ ID NO: 3916081 - DNA, 21 bp, Homo sapiens
aaactgatgcgaaaacttgaa

SEQ ID NO: 3916082 - DNA, 17 bp, Homo sapiens
aaactgatttctcacgg

SEQ ID NO: 3916083 - DNA, 14 bp, Homo sapiens
aaactgccagcaac

SEQ ID NO: 3916084 - DNA, 15 bp, Homo sapiens
aaactgccagcaacg

SEQ ID NO: 3916085 - DNA, 14 bp, Homo sapiens
aaactggggcttgc

SEQ ID NO: 3916086 - DNA, 18 bp, Homo sapiens
aaactgtatcaaatctgt

SEQ ID NO: 3916087 - DNA, 17 bp, Homo sapiens
aaactgtgccctgcctt

SEQ ID NO: 3916088 - DNA, 13 bp, Homo sapiens
aaatggtgggaac

SEQ ID NO: 3916089 - DNA, 19 bp, Homo sapiens
aaatggtttttgcaagatt

SEQ ID NO: 3916090 - DNA, 17 bp, Homo sapiens
aaatgtaaaagtactct

SEQ ID NO: 3916091 - DNA, 18 bp, Homo sapiens
aaatgtaacttttgtaag

SEQ ID NO: 3916092 - DNA, 16 bp, Homo sapiens
aaatgtaagggaaact

SEQ ID NO: 3916093 - DNA, 22 bp, Homo sapiens
aaatgtaagggaaactgccagc

SEQ ID NO: 3916094 - DNA, 20 bp, Homo sapiens
aaatgtatcctgataaacat

SEQ ID NO: 3916095 - DNA, 18 bp, Homo sapiens
aaatgtcattatgtagaa

SEQ ID NO: 3916096 - DNA, 13 bp, Homo sapiens
aaatgtctgtttc

SEQ ID NO: 3916097 - DNA, 16 bp, Homo sapiens
aaatgtgaagggtggg

SEQ ID NO: 3916098 - DNA, 17 bp, Homo sapiens
aaatgtgaagggtgggg

SEQ ID NO: 3916099 - DNA, 18 bp, Homo sapiens
aaatgtgccttcattttt

SEQ ID NO: 3916100 - DNA, 21 bp, Homo sapiens
aaatgtgctaaagttggaaag

SEQ ID NO: 3916101 - DNA, 12 bp, Homo sapiens
aaatgtgtaaat

SEQ ID NO: 3916102 - DNA, 19 bp, Homo sapiens
aaatgtgtaaatgtggaca

SEQ ID NO: 3916103 - DNA, 15 bp, Homo sapiens
aaatgttcaaactgt

SEQ ID NO: 3916104 - DNA, 21 bp, Homo sapiens
aaatgttcagaaggttgctct

SEQ ID NO: 3916105 - DNA, 18 bp, Homo sapiens
aaatgttcatcaattccc

SEQ ID NO: 3916106 - DNA, 14 bp, Homo sapiens
aaatgttgaaatct

SEQ ID NO: 3916107 - DNA, 23 bp, Homo sapiens
aaatgttgatcttccactgcaaa

SEQ ID NO: 3916108 - DNA, 15 bp, Homo sapiens
aaatgtttctgcagt

SEQ ID NO: 3916109 - DNA, 13 bp, Homo sapiens
aaattaaacttta

SEQ ID NO: 3916110 - DNA, 12 bp, Homo sapiens
aaattaaagccc

SEQ ID NO: 3916111 - DNA, 16 bp, Homo sapiens
aaattaatacttcatt

SEQ ID NO: 3916112 - DNA, 16 bp, Homo sapiens
aaattacacccaaaga

SEQ ID NO: 3916113 - DNA, 19 bp, Homo sapiens
aaattaccagagttgttct

SEQ ID NO: 3916114 - DNA, 23 bp, Homo sapiens
aaattagaaaccttaatatgtgg

SEQ ID NO: 3916115 - DNA, 20 bp, Homo sapiens
aaattagaaagcaacttatc

SEQ ID NO: 3916116 - DNA, 19 bp, Homo sapiens
aaattagctgtgtgaaata

SEQ ID NO: 3916117 - DNA, 19 bp, Homo sapiens
aaattaggatttcatgatt

SEQ ID NO: 3916118 - DNA, 15 bp, Homo sapiens
aaattagtaattgta

SEQ ID NO: 3916119 - DNA, 16 bp, Homo sapiens
aaattataacttaaaa

SEQ ID NO: 3916120 - DNA, 17 bp, Homo sapiens
aaattataacttaaaat

SEQ ID NO: 3916121 - DNA, 19 bp, Homo sapiens
aaattatgtatgtttacat

SEQ ID NO: 3916122 - DNA, 17 bp, Homo sapiens
aaattattatgactcaa

SEQ ID NO: 3916123 - DNA, 13 bp, Homo sapiens
aaattatttgtgt

SEQ ID NO: 3916124 - DNA, 16 bp, Homo sapiens
aaattatttgtgtaat

SEQ ID NO: 3916125 - DNA, 15 bp, Homo sapiens
aaattattttaaaca

SEQ ID NO: 3916126 - DNA, 16 bp, Homo sapiens
aaattattttaaacaa

SEQ ID NO: 3916127 - DNA, 22 bp, Homo sapiens
aaattcaaaccatttaattcat

SEQ ID NO: 3916128 - DNA, 16 bp, Homo sapiens
aaattcacaatagaaa

SEQ ID NO: 3916129 - DNA, 16 bp, Homo sapiens
aaattcatttcacatt

SEQ ID NO: 3916130 - DNA, 17 bp, Homo sapiens
aaattcatttcacatta

SEQ ID NO: 3916131 - DNA, 14 bp, Homo sapiens
aaattcctgtagca

SEQ ID NO: 3916132 - DNA, 20 bp, Homo sapiens
aaattctcagtcagtaattg

SEQ ID NO: 3916133 - DNA, 21 bp, Homo sapiens
aaattgagaagggaaatctta

SEQ ID NO: 3916134 - DNA, 9 bp, Homo sapiens
aaattgcac

SEQ ID NO: 3916135 - DNA, 22 bp, Homo sapiens
aaattgcctccttatttatcaa

SEQ ID NO: 3916136 - DNA, 19 bp, Homo sapiens
aaattgctattttatttgt

SEQ ID NO: 3916137 - DNA, 20 bp, Homo sapiens
aaattgctattttatttgta

SEQ ID NO: 3916138 - DNA, 18 bp, Homo sapiens
aaattgcttttgttgtga

SEQ ID NO: 3916139 - DNA, 18 bp, Homo sapiens
aaattggtacttgtttca

SEQ ID NO: 3916140 - DNA, 20 bp, Homo sapiens
aaattggtatcaagaaagtc

SEQ ID NO: 3916141 - DNA, 15 bp, Homo sapiens
aaattggtgataagt

SEQ ID NO: 3916142 - DNA, 16 bp, Homo sapiens
aaattggtgataagtg

SEQ ID NO: 3916143 - DNA, 20 bp, Homo sapiens
aaattggtgataagtggaaa

SEQ ID NO: 3916144 - DNA, 18 bp, Homo sapiens
aaattgtatacattttgt

SEQ ID NO: 3916145 - DNA, 19 bp, Homo sapiens
aaattgtatacattttgtt

SEQ ID NO: 3916146 - DNA, 20 bp, Homo sapiens
aaattgtatacattttgtta

SEQ ID NO: 3916147 - DNA, 17 bp, Homo sapiens
aaattgtgatgttttgt

SEQ ID NO: 3916148 - DNA, 21 bp, Homo sapiens
aaatttaataaaaacttcaga

SEQ ID NO: 3916149 - DNA, 12 bp, Homo sapiens
aaatttcaaaag

SEQ ID NO: 3916150 - DNA, 13 bp, Homo sapiens
aaatttcaaaaga

SEQ ID NO: 3916151 - DNA, 16 bp, Homo sapiens
aaatttcaaaagacat

SEQ ID NO: 3916152 - DNA, 14 bp, Homo sapiens
aaatttgaagtaaa

SEQ ID NO: 3916153 - DNA, 22 bp, Homo sapiens
aaatttgttttgacggatgatt

SEQ ID NO: 3916154 - DNA, 11 bp, Homo sapiens
aaattttagag

SEQ ID NO: 3916155 - DNA, 16 bp, Homo sapiens
aaattttatttagttc

SEQ ID NO: 3916156 - DNA, 20 bp, Homo sapiens
aaattttctagactttctgt

SEQ ID NO: 3916157 - DNA, 12 bp, Homo sapiens
aaattttgcatt

SEQ ID NO: 3916158 - DNA, 13 bp, Homo sapiens
aaattttgtttca

SEQ ID NO: 3916159 - DNA, 23 bp, Homo sapiens
aaattttgtttcagaattttgta

SEQ ID NO: 3916160 - DNA, 14 bp, Homo sapiens
aaatttttcctgca

SEQ ID NO: 3916161 - DNA, 12 bp, Homo sapiens
aaatttttgtca

SEQ ID NO: 3916162 - DNA, 20 bp, Homo sapiens
aacaaaaaaaaaccatgcat

SEQ ID NO: 3916163 - DNA, 20 bp, Homo sapiens
aacaaaacaacaacaataca

SEQ ID NO: 3916164 - DNA, 21 bp, Homo sapiens
aacaaactatgatcacagtga

SEQ ID NO: 3916165 - DNA, 19 bp, Homo sapiens
aacaaagagaaaaaataca

SEQ ID NO: 3916166 - DNA, 16 bp, Homo sapiens
aacaaaggttgagatg

SEQ ID NO: 3916167 - DNA, 19 bp, Homo sapiens
aacaaatgaacgatatgta

SEQ ID NO: 3916168 - DNA, 20 bp, Homo sapiens
aacaaattatgttacatctg

SEQ ID NO: 3916169 - DNA, 14 bp, Homo sapiens
aacaacaacaacaa

SEQ ID NO: 3916170 - DNA, 13 bp, Homo sapiens
aacaacaacaata

SEQ ID NO: 3916171 - DNA, 16 bp, Homo sapiens
aacaacaacaatacaa

SEQ ID NO: 3916172 - DNA, 10 bp, Homo sapiens
aacaacaata

SEQ ID NO: 3916173 - DNA, 15 bp, Homo sapiens
aacaacaataacaac

SEQ ID NO: 3916174 - DNA, 23 bp, Homo sapiens
aacaacaatggtttacatgaaca

SEQ ID NO: 3916175 - DNA, 23 bp, Homo sapiens
aactgtaaatcacttgtaaataa

SEQ ID NO: 3916176 - DNA, 14 bp, Homo sapiens
aactgtatgtcaga

SEQ ID NO: 3916177 - DNA, 14 bp, Homo sapiens
aactgtatgtgtct

SEQ ID NO: 3916178 - DNA, 18 bp, Homo sapiens
aactgtctaatgacacgg

SEQ ID NO: 3916179 - DNA, 16 bp, Homo sapiens
aactgtgaacctggag

SEQ ID NO: 3916180 - DNA, 16 bp, Homo sapiens
aactgtgtgaagaaat

SEQ ID NO: 3916181 - DNA, 17 bp, Homo sapiens
aactgtgtgaagaaatg

SEQ ID NO: 3916182 - DNA, 14 bp, Homo sapiens
aacttaacatattt

SEQ ID NO: 3916183 - DNA, 18 bp, Homo sapiens
aacttacacttggagccc

SEQ ID NO: 3916184 - DNA, 19 bp, Homo sapiens
aacttagaataaaattgta

SEQ ID NO: 3916185 - DNA, 16 bp, Homo sapiens
aacttcaaatatagag

SEQ ID NO: 3916186 - DNA, 13 bp, Homo sapiens
aacttcaagaagt

SEQ ID NO: 3916187 - DNA, 22 bp, Homo sapiens
aacttccttggactcattttaa

SEQ ID NO: 3916188 - DNA, 23 bp, Homo sapiens
aacttccttggactcattttaaa

SEQ ID NO: 3916189 - DNA, 14 bp, Homo sapiens
aacttgaggacaca

SEQ ID NO: 3916190 - DNA, 15 bp, Homo sapiens
aacttgaggacacat

SEQ ID NO: 3916191 - DNA, 16 bp, Homo sapiens
aacttgaggacacatg

SEQ ID NO: 3916192 - DNA, 20 bp, Homo sapiens
aacttgctgaatttcaggca

SEQ ID NO: 3916193 - DNA, 22 bp, Homo sapiens
aacttgcttagtatggttctca

SEQ ID NO: 3916194 - DNA, 16 bp, Homo sapiens
aacttggaaaaagaaa

SEQ ID NO: 3916195 - DNA, 19 bp, Homo sapiens
aacttggaaaaagaaagaa

SEQ ID NO: 3916196 - DNA, 14 bp, Homo sapiens
aacttggagtttca

SEQ ID NO: 3916197 - DNA, 14 bp, Homo sapiens
aacttgtaaataca

SEQ ID NO: 3916198 - DNA, 18 bp, Homo sapiens
aacttgtaaatgctgtca

SEQ ID NO: 3916199 - DNA, 13 bp, Homo sapiens
aacttgtatattc

SEQ ID NO: 3916200 - DNA, 21 bp, Homo sapiens
aacttgtcctatgtcaatttg

SEQ ID NO: 3916201 - DNA, 13 bp, Homo sapiens
aacttgtgttcta

SEQ ID NO: 3916202 - DNA, 15 bp, Homo sapiens
aacttgtgttctatt

SEQ ID NO: 3916203 - DNA, 14 bp, Homo sapiens
aactttagaaataa

SEQ ID NO: 3916204 - DNA, 16 bp, Homo sapiens
aactttagaaataaga

SEQ ID NO: 3916205 - DNA, 11 bp, Homo sapiens
aactttctgta

SEQ ID NO: 3916206 - DNA, 12 bp, Homo sapiens
aactttgatctc

SEQ ID NO: 3916207 - DNA, 11 bp, Homo sapiens
aacttttgtaa

SEQ ID NO: 3916208 - DNA, 15 bp, Homo sapiens
aagaaaaaaaaagca

SEQ ID NO: 3916209 - DNA, 14 bp, Homo sapiens
aagaaaactaacaa

SEQ ID NO: 3916210 - DNA, 19 bp, Homo sapiens
aagaaaattagtaattgta

SEQ ID NO: 3916211 - DNA, 14 bp, Homo sapiens
aagaaacactcaac

SEQ ID NO: 3916212 - DNA, 14 bp, Homo sapiens
aagaaacaggggat

SEQ ID NO: 3916213 - DNA, 20 bp, Homo sapiens
aagaaaccacaggttccata

SEQ ID NO: 3916214 - DNA, 16 bp, Homo sapiens
aagaaactgaggaatt

SEQ ID NO: 3916215 - DNA, 20 bp, Homo sapiens
aagaaactgaggaattttct

SEQ ID NO: 3916216 - DNA, 14 bp, Homo sapiens
aagaaagaaacact

SEQ ID NO: 3916217 - DNA, 14 bp, Homo sapiens
aagaaagaacggaa

SEQ ID NO: 3916218 - DNA, 17 bp, Homo sapiens
aagaaagagaaggagcc

SEQ ID NO: 3916219 - DNA, 23 bp, Homo sapiens
aagaaagaggtgaccccagggca

SEQ ID NO: 3916220 - DNA, 18 bp, Homo sapiens
aagaaagtgcagaatcaa

SEQ ID NO: 3916221 - DNA, 13 bp, Homo sapiens
aagaaataaaaat

SEQ ID NO: 3916222 - DNA, 14 bp, Homo sapiens
aagaaatccctgtt

SEQ ID NO: 3916223 - DNA, 16 bp, Homo sapiens
aagaaattgcctcctt

SEQ ID NO: 3916224 - DNA, 15 bp, Homo sapiens
aagaaatttattact

SEQ ID NO: 3916225 - DNA, 18 bp, Homo sapiens
aagaaatttattacttgt

SEQ ID NO: 3916226 - DNA, 16 bp, Homo sapiens
aagaaatttgatttct

SEQ ID NO: 3916227 - DNA, 18 bp, Homo sapiens
aagaacatccaaggagaa

SEQ ID NO: 3916228 - DNA, 16 bp, Homo sapiens
aagaactccttatttt

SEQ ID NO: 3916229 - DNA, 17 bp, Homo sapiens
aagaactccttattttg

SEQ ID NO: 3916230 - DNA, 20 bp, Homo sapiens
aagaactccttattttgtat

SEQ ID NO: 3916231 - DNA, 18 bp, Homo sapiens
aagaactgccccatctcc

SEQ ID NO: 3916232 - DNA, 21 bp, Homo sapiens
aagaagaccagactgtggaga

SEQ ID NO: 3916233 - DNA, 16 bp, Homo sapiens
aagaagctcccagatg

SEQ ID NO: 3916234 - DNA, 14 bp, Homo sapiens
aagaagctgaggat

SEQ ID NO: 3916235 - DNA, 21 bp, Homo sapiens
aagaagctttaatatttaaat

SEQ ID NO: 3916236 - DNA, 20 bp, Homo sapiens
aagaaggcacaggtgtaaat

SEQ ID NO: 3916237 - DNA, 14 bp, Homo sapiens
aagaagtaaaagct

SEQ ID NO: 3916238 - DNA, 15 bp, Homo sapiens
aagaagtaggcatga

SEQ ID NO: 3916239 - DNA, 17 bp, Homo sapiens
aagaagtccccaggtca

SEQ ID NO: 3916240 - DNA, 20 bp, Homo sapiens
aagaagtttctggagcaaga

SEQ ID NO: 3916241 - DNA, 12 bp, Homo sapiens
aagaataaagtc

SEQ ID NO: 3916242 - DNA, 14 bp, Homo sapiens
aagaatacagaaag

SEQ ID NO: 3916243 - DNA, 21 bp, Homo sapiens
aagaatattcagagaatatca

SEQ ID NO: 3916244 - DNA, 16 bp, Homo sapiens
aagaattgaacccagg

SEQ ID NO: 3916245 - DNA, 19 bp, Homo sapiens
aagaattgaacccaggagg

SEQ ID NO: 3916246 - DNA, 20 bp, Homo sapiens
aagaattgaacccaggaggt

SEQ ID NO: 3916247 - DNA, 22 bp, Homo sapiens
aagacaaaccactgtacatata

SEQ ID NO: 3916248 - DNA, 14 bp, Homo sapiens
aagacagctgacag

SEQ ID NO: 3916249 - DNA, 17 bp, Homo sapiens
aagacagctgacagata

SEQ ID NO: 3916250 - DNA, 19 bp, Homo sapiens
aagacaggtctagactttc

SEQ ID NO: 3916251 - DNA, 17 bp, Homo sapiens
aagacagtggatcatga

SEQ ID NO: 3916252 - DNA, 16 bp, Homo sapiens
aagacatgttgtaaat

SEQ ID NO: 3916253 - DNA, 21 bp, Homo sapiens
aagaccagggcttttcccagg

SEQ ID NO: 3916254 - DNA, 17 bp, Homo sapiens
aagacgcctttctcctc

SEQ ID NO: 3916255 - DNA, 18 bp, Homo sapiens
aagacgtgaatgtctcag

SEQ ID NO: 3916256 - DNA, 19 bp, Homo sapiens
aagactaatttaaaaaata

SEQ ID NO: 3916257 - DNA, 21 bp, Homo sapiens
aagactattaagagcaataaa

SEQ ID NO: 3916258 - DNA, 13 bp, Homo sapiens
aagactattcaaa

SEQ ID NO: 3916259 - DNA, 21 bp, Homo sapiens
aagactcaagtgggaacgact

SEQ ID NO: 3916260 - DNA, 23 bp, Homo sapiens
aagactcaagtgggaacgactgg

SEQ ID NO: 3916261 - DNA, 16 bp, Homo sapiens
aagactccaaagaaat

SEQ ID NO: 3916262 - DNA, 17 bp, Homo sapiens
aagtccacctgcctatc

SEQ ID NO: 3916263 - DNA, 12 bp, Homo sapiens
aagtccagagcc

SEQ ID NO: 3916264 - DNA, 23 bp, Homo sapiens
aagtccccgtcccccagaacctc

SEQ ID NO: 3916265 - DNA, 18 bp, Homo sapiens
aagtcctatcgactttat

SEQ ID NO: 3916266 - DNA, 19 bp, Homo sapiens
aagtcgtccttactcctgt

SEQ ID NO: 3916267 - DNA, 20 bp, Homo sapiens
aagtcgtccttactcctgtg

SEQ ID NO: 3916268 - DNA, 11 bp, Homo sapiens
aagtctaaagt

SEQ ID NO: 3916269 - DNA, 13 bp, Homo sapiens
aagtctaaagttt

SEQ ID NO: 3916270 - DNA, 14 bp, Homo sapiens
aagtctaaagttta

SEQ ID NO: 3916271 - DNA, 19 bp, Homo sapiens
aagtctaggagctgggagg

SEQ ID NO: 3916272 - DNA, 16 bp, Homo sapiens
aagtctattgtttgtt

SEQ ID NO: 3916273 - DNA, 23 bp, Homo sapiens
aagtctattgtttgttgtgcttg

SEQ ID NO: 3916274 - DNA, 14 bp, Homo sapiens
aagtctctgctgct

SEQ ID NO: 3916275 - DNA, 20 bp, Homo sapiens
aagtctgggatgtagaactt

SEQ ID NO: 3916276 - DNA, 18 bp, Homo sapiens
aagtcttccctgatcaag

SEQ ID NO: 3916277 - DNA, 16 bp, Homo sapiens
aagtcttgtcagaatt

SEQ ID NO: 3916278 - DNA, 16 bp, Homo sapiens
aagtcttttttgatca

SEQ ID NO: 3916279 - DNA, 14 bp, Homo sapiens
aagtgaataaactt

SEQ ID NO: 3916280 - DNA, 15 bp, Homo sapiens
aagtgaataaacttc

SEQ ID NO: 3916281 - DNA, 13 bp, Homo sapiens
aagtgactaccag

SEQ ID NO: 3916282 - DNA, 21 bp, Homo sapiens
aagtgagggctgggcagctga

SEQ ID NO: 3916283 - DNA, 13 bp, Homo sapiens
aagtgatatatgt

SEQ ID NO: 3916284 - DNA, 18 bp, Homo sapiens
aagtgatatatgtattta

SEQ ID NO: 3916285 - DNA, 18 bp, Homo sapiens
aagtgatctgtcccctct

SEQ ID NO: 3916286 - DNA, 18 bp, Homo sapiens
aagtgcaaagtgccctca

SEQ ID NO: 3916287 - DNA, 21 bp, Homo sapiens
aagtgcaaatactccaagctt

SEQ ID NO: 3916288 - DNA, 17 bp, Homo sapiens
aagtgcaatttcccctc

SEQ ID NO: 3916289 - DNA, 17 bp, Homo sapiens
aagtgcacacagaaata

SEQ ID NO: 3916290 - DNA, 20 bp, Homo sapiens
aagtgcacacagaaatatat

SEQ ID NO: 3916291 - DNA, 22 bp, Homo sapiens
aagtgcacacagaaatatatat

SEQ ID NO: 3916292 - DNA, 17 bp, Homo sapiens
aagtgcagcccttcctc

SEQ ID NO: 3916293 - DNA, 12 bp, Homo sapiens
aagtgccagaaa

SEQ ID NO: 3916294 - DNA, 10 bp, Homo sapiens
aagtgccatc

SEQ ID NO: 3916295 - DNA, 12 bp, Homo sapiens
aagtgccatccc

SEQ ID NO: 3916296 - DNA, 13 bp, Homo sapiens
aagtgccatccca

SEQ ID NO: 3916297 - DNA, 14 bp, Homo sapiens
aagtgcctcttgtt

SEQ ID NO: 3916298 - DNA, 23 bp, Homo sapiens
aagtgctatgccaagccatgtct

SEQ ID NO: 3916299 - DNA, 12 bp, Homo sapiens
aagtgctcccca

SEQ ID NO: 3916300 - DNA, 14 bp, Homo sapiens
aagtgcttagaaag

SEQ ID NO: 3916301 - DNA, 11 bp, Homo sapiens
aagtggaaaaa

SEQ ID NO: 3916302 - DNA, 13 bp, Homo sapiens
aagtggaaaaaag

SEQ ID NO: 3916303 - DNA, 19 bp, Homo sapiens
aagtggaaaaaagagaaaa

SEQ ID NO: 3916304 - DNA, 20 bp, Homo sapiens
aagtggaccaggacaggacc

SEQ ID NO: 3916305 - DNA, 12 bp, Homo sapiens
aagtggaggggg

SEQ ID NO: 3916306 - DNA, 14 bp, Homo sapiens
aagtggatggaagt

SEQ ID NO: 3916307 - DNA, 16 bp, Homo sapiens
aagtggatggaagtgt

SEQ ID NO: 3916308 - DNA, 12 bp, Homo sapiens
aagtggctgctg

SEQ ID NO: 3916309 - DNA, 19 bp, Homo sapiens
aagtgggggcagagggcag

SEQ ID NO: 3916310 - DNA, 15 bp, Homo sapiens
aagtggggtgcatcc

SEQ ID NO: 3916311 - DNA, 15 bp, Homo sapiens
aagtgtaagcacttc

SEQ ID NO: 3916312 - DNA, 17 bp, Homo sapiens
aagtgtgtttccttcag

SEQ ID NO: 3916313 - DNA, 18 bp, Homo sapiens
aagtgttgctcttggaaa

SEQ ID NO: 3916314 - DNA, 20 bp, Homo sapiens
aagtgttgtaaatatttatg

SEQ ID NO: 3916315 - DNA, 22 bp, Homo sapiens
aagtgttttctcagaacagctg

SEQ ID NO: 3916316 - DNA, 22 bp, Homo sapiens
aagttaaaagtgttgattacat

SEQ ID NO: 3916317 - DNA, 13 bp, Homo sapiens
aagttaacagaga

SEQ ID NO: 3916318 - DNA, 19 bp, Homo sapiens
aagttatattgaatatatc

SEQ ID NO: 3916319 - DNA, 22 bp, Homo sapiens
aagttattaacgggcatgtatt

SEQ ID NO: 3916320 - DNA, 20 bp, Homo sapiens
aagttattgtacagctgttt

SEQ ID NO: 3916321 - DNA, 17 bp, Homo sapiens
aagttccagctggtctt

SEQ ID NO: 3916322 - DNA, 17 bp, Homo sapiens
aagttccctacttcctg

SEQ ID NO: 3916323 - DNA, 13 bp, Homo sapiens
aagttcctgcact

SEQ ID NO: 3916324 - DNA, 17 bp, Homo sapiens
aagttcctgcactccag

SEQ ID NO: 3916325 - DNA, 19 bp, Homo sapiens
aagttcctgcactccagaa

SEQ ID NO: 3916326 - DNA, 22 bp, Homo sapiens
aagttcctgttcaccttatgta

SEQ ID NO: 3916327 - DNA, 17 bp, Homo sapiens
aagttctagagaagagg

SEQ ID NO: 3916328 - DNA, 16 bp, Homo sapiens
aagttctcaatgtgaa

SEQ ID NO: 3916329 - DNA, 19 bp, Homo sapiens
aagttgtgccttttatagc

SEQ ID NO: 3916330 - DNA, 20 bp, Homo sapiens
aagttgtgccttttatagct

SEQ ID NO: 3916331 - DNA, 20 bp, Homo sapiens
aagttgttcacatatatgta

SEQ ID NO: 3916332 - DNA, 13 bp, Homo sapiens
aagtttaaaaaat

SEQ ID NO: 3916333 - DNA, 20 bp, Homo sapiens
aagtttattttttctacaca

SEQ ID NO: 3916334 - DNA, 22 bp, Homo sapiens
aagtttattttttctacacagt

SEQ ID NO: 3916335 - DNA, 15 bp, Homo sapiens
aagttttgagtttct

SEQ ID NO: 3916336 - DNA, 19 bp, Homo sapiens
aagttttgatgaaattctt

SEQ ID NO: 3916337 - DNA, 14 bp, Homo sapiens
aagttttgtacaga

SEQ ID NO: 3916338 - DNA, 20 bp, Homo sapiens
aagttttgtataaataataa

SEQ ID NO: 3916339 - DNA, 17 bp, Homo sapiens
aataaaaaaatacagta

SEQ ID NO: 3916340 - DNA, 21 bp, Homo sapiens
aataaaaaccagaatcataat

SEQ ID NO: 3916341 - DNA, 21 bp, Homo sapiens
aataaaaatcaacttgtgtac

SEQ ID NO: 3916342 - DNA, 14 bp, Homo sapiens
aataaaacattatg

SEQ ID NO: 3916343 - DNA, 12 bp, Homo sapiens
aataaaaccttt

SEQ ID NO: 3916344 - DNA, 14 bp, Homo sapiens
aataaaacctttca

SEQ ID NO: 3916345 - DNA, 22 bp, Homo sapiens
aataaaacttatgctagtttat

SEQ ID NO: 3916346 - DNA, 16 bp, Homo sapiens
aataaaatcttgaaaa

SEQ ID NO: 3916347 - DNA, 14 bp, Homo sapiens
aataaaatgatgta

SEQ ID NO: 3916348 - DNA, 15 bp, Homo sapiens
aataaaattgcactt

SEQ ID NO: 3916349 - DNA, 20 bp, Homo sapiens
caggaaagccctcccccttc

SEQ ID NO: 3916350 - DNA, 19 bp, Homo sapiens
caggaaagctcagctactg

SEQ ID NO: 3916351 - DNA, 19 bp, Homo sapiens
caggaaatcaaatatgcaa

SEQ ID NO: 3916352 - DNA, 22 bp, Homo sapiens
caggaaatcaaatatgcaaagc

SEQ ID NO: 3916353 - DNA, 22 bp, Homo sapiens
caggaacacccgactcctcaaa

SEQ ID NO: 3916354 - DNA, 20 bp, Homo sapiens
caggaacagagactctggaa

SEQ ID NO: 3916355 - DNA, 23 bp, Homo sapiens
caggaacagagactctggaagcc

SEQ ID NO: 3916356 - DNA, 15 bp, Homo sapiens
caggaacgagcactg

SEQ ID NO: 3916357 - DNA, 21 bp, Homo sapiens
caggaacgagcactggccaga

SEQ ID NO: 3916358 - DNA, 12 bp, Homo sapiens
caggaactgggc

SEQ ID NO: 3916359 - DNA, 16 bp, Homo sapiens
caggaagaaaccccaa

SEQ ID NO: 3916360 - DNA, 20 bp, Homo sapiens
caggaagaaaccccaagcag

SEQ ID NO: 3916361 - DNA, 22 bp, Homo sapiens
caggaagaaaccccaagcagca

SEQ ID NO: 3916362 - DNA, 14 bp, Homo sapiens
caggaagagaagga

SEQ ID NO: 3916363 - DNA, 15 bp, Homo sapiens
caggaagagaaggag

SEQ ID NO: 3916364 - DNA, 17 bp, Homo sapiens
caggaagagaaggagca

SEQ ID NO: 3916365 - DNA, 21 bp, Homo sapiens
caggaagggggtccacccagc

SEQ ID NO: 3916366 - DNA, 21 bp, Homo sapiens
caggaatgccaaggagacatc

SEQ ID NO: 3916367 - DNA, 14 bp, Homo sapiens
caggacaagcatgg

SEQ ID NO: 3916368 - DNA, 13 bp, Homo sapiens
caggacacaggcc

SEQ ID NO: 3916369 - DNA, 14 bp, Homo sapiens
caggacacaggcct

SEQ ID NO: 3916370 - DNA, 15 bp, Homo sapiens
caggacacaggcctg

SEQ ID NO: 3916371 - DNA, 18 bp, Homo sapiens
caggacacaggcctgtgt

SEQ ID NO: 3916372 - DNA, 22 bp, Homo sapiens
caggacacaggcctgtgtagct

SEQ ID NO: 3916373 - DNA, 21 bp, Homo sapiens
caggacacatcccggcctctt

SEQ ID NO: 3916374 - DNA, 22 bp, Homo sapiens
caggacacatcccggcctcttc

SEQ ID NO: 3916375 - DNA, 14 bp, Homo sapiens
caggacaccagcct

SEQ ID NO: 3916376 - DNA, 12 bp, Homo sapiens
caggacacctgc

SEQ ID NO: 3916377 - DNA, 14 bp, Homo sapiens
caccctgcagagct

SEQ ID NO: 3916378 - DNA, 21 bp, Homo sapiens
caccctggattgatcggagcc

SEQ ID NO: 3916379 - DNA, 20 bp, Homo sapiens
cacccttcacataccctccc

SEQ ID NO: 3916380 - DNA, 15 bp, Homo sapiens
cacccttctttcctc

SEQ ID NO: 3916381 - DNA, 17 bp, Homo sapiens
caccgacgcgtctcctg

SEQ ID NO: 3916382 - DNA, 18 bp, Homo sapiens
caccgacgcgtctcctgt

SEQ ID NO: 3916383 - DNA, 19 bp, Homo sapiens
caccgacgcgtctcctgtt

SEQ ID NO: 3916384 - DNA, 19 bp, Homo sapiens
caccgagacggctggacct

SEQ ID NO: 3916385 - DNA, 18 bp, Homo sapiens
caccgagagtagccgaga

SEQ ID NO: 3916386 - DNA, 13 bp, Homo sapiens
caccgcagaagga

SEQ ID NO: 3916387 - DNA, 12 bp, Homo sapiens
caccgctgccta

SEQ ID NO: 3916388 - DNA, 21 bp, Homo sapiens
caccgctgccttttgctgctg

SEQ ID NO: 3916389 - DNA, 17 bp, Homo sapiens
caccgggagcctccccc

SEQ ID NO: 3916390 - DNA, 12 bp, Homo sapiens
caccgggccact

SEQ ID NO: 3916391 - DNA, 19 bp, Homo sapiens
caccgggccactccttcct

SEQ ID NO: 3916392 - DNA, 16 bp, Homo sapiens
caccgtccctcagtga

SEQ ID NO: 3916393 - DNA, 16 bp, Homo sapiens
caccgtggaccttcct

SEQ ID NO: 3916394 - DNA, 17 bp, Homo sapiens
caccgtggaccttcctg

SEQ ID NO: 3916395 - DNA, 14 bp, Homo sapiens
cacctaccatgctg

SEQ ID NO: 3916396 - DNA, 17 bp, Homo sapiens
cacctaccatgctgctt

SEQ ID NO: 3916397 - DNA, 20 bp, Homo sapiens
cacctagcaattccatcacc

SEQ ID NO: 3916398 - DNA, 16 bp, Homo sapiens
cacctaggccactcct

SEQ ID NO: 3916399 - DNA, 17 bp, Homo sapiens
cacctatcacccaggct

SEQ ID NO: 3916400 - DNA, 12 bp, Homo sapiens
cacctcagcctt

SEQ ID NO: 3916401 - DNA, 13 bp, Homo sapiens
cacctcagccttg

SEQ ID NO: 3916402 - DNA, 15 bp, Homo sapiens
cacctcagccttgga

SEQ ID NO: 3916403 - DNA, 12 bp, Homo sapiens
cacctcagctga

SEQ ID NO: 3916404 - DNA, 16 bp, Homo sapiens
cacctcatgcctggcc

SEQ ID NO: 3916405 - DNA, 19 bp, Homo sapiens
cacctcatgcctggccccc

SEQ ID NO: 3916406 - DNA, 22 bp, Homo sapiens
cacctccacccccgccacggcc

SEQ ID NO: 3916407 - DNA, 24 bp, Homo sapiens
cacctccacccccgccacggccac

SEQ ID NO: 3916408 - DNA, 14 bp, Homo sapiens
cacctcccacccca

SEQ ID NO: 3916409 - DNA, 18 bp, Homo sapiens
cacctcccaccccactcc

SEQ ID NO: 3916410 - DNA, 20 bp, Homo sapiens
cacctcccaccccactccag

SEQ ID NO: 3916411 - DNA, 10 bp, Homo sapiens
cacctcccag

SEQ ID NO: 3916412 - DNA, 14 bp, Homo sapiens
cacctccccccact

SEQ ID NO: 3916413 - DNA, 22 bp, Homo sapiens
cacctccccccactgcaggccc

SEQ ID NO: 3916414 - DNA, 14 bp, Homo sapiens
cacctcccctatcc

SEQ ID NO: 3916415 - DNA, 14 bp, Homo sapiens
cacctcctgagaag

SEQ ID NO: 3916416 - DNA, 12 bp, Homo sapiens
cacctcctgagt

SEQ ID NO: 3916417 - DNA, 20 bp, Homo sapiens
cacctcctgagttcaagcga

SEQ ID NO: 3916418 - DNA, 21 bp, Homo sapiens
cacctctcaatattcaataaa

SEQ ID NO: 3916419 - DNA, 13 bp, Homo sapiens
cacctctggcttt

SEQ ID NO: 3916420 - DNA, 19 bp, Homo sapiens
cacctctggctttgtctct

SEQ ID NO: 3916421 - DNA, 13 bp, Homo sapiens
cacctctgtaatt

SEQ ID NO: 3916422 - DNA, 14 bp, Homo sapiens
cacctctgtaattt

SEQ ID NO: 3916423 - DNA, 18 bp, Homo sapiens
cacctcttctcttcctgt

SEQ ID NO: 3916424 - DNA, 15 bp, Homo sapiens
cacctcttctgccag

SEQ ID NO: 3916425 - DNA, 15 bp, Homo sapiens
cacctgaaccccatg

SEQ ID NO: 3916426 - DNA, 19 bp, Homo sapiens
cacctgaaccccatgggct

SEQ ID NO: 3916427 - DNA, 11 bp, Homo sapiens
cacctgacaca

SEQ ID NO: 3916428 - DNA, 13 bp, Homo sapiens
cacctgcaagccc

SEQ ID NO: 3916429 - DNA, 16 bp, Homo sapiens
cacctgcaagccccag

SEQ ID NO: 3916430 - DNA, 18 bp, Homo sapiens
cacctgcaagccccaggg

SEQ ID NO: 3916431 - DNA, 19 bp, Homo sapiens
cacctgcaagccccagggc

SEQ ID NO: 3916432 - DNA, 11 bp, Homo sapiens
cacctgcacct

SEQ ID NO: 3916433 - DNA, 13 bp, Homo sapiens
cacctgcacctcc

SEQ ID NO: 3916434 - DNA, 19 bp, Homo sapiens
cacctgcacctccccccac

SEQ ID NO: 3916435 - DNA, 13 bp, Homo sapiens
cacctgccagcca

SEQ ID NO: 3916436 - DNA, 19 bp, Homo sapiens
cactaccttctgacctccc

SEQ ID NO: 3916437 - DNA, 14 bp, Homo sapiens
cactacctttgtcc

SEQ ID NO: 3916438 - DNA, 20 bp, Homo sapiens
cactacctttgtccaggcct

SEQ ID NO: 3916439 - DNA, 14 bp, Homo sapiens
cactagagctggga

SEQ ID NO: 3916440 - DNA, 17 bp, Homo sapiens
cactagcattttcttga

SEQ ID NO: 3916441 - DNA, 21 bp, Homo sapiens
cactagcctctccaggaatgc

SEQ ID NO: 3916442 - DNA, 21 bp, Homo sapiens
cactagggcagggacaggata

SEQ ID NO: 3916443 - DNA, 15 bp, Homo sapiens
cactatgaaaatcag

SEQ ID NO: 3916444 - DNA, 17 bp, Homo sapiens
cactatgttgcccaggc

SEQ ID NO: 3916445 - DNA, 18 bp, Homo sapiens
cactatgttgcccaggct

SEQ ID NO: 3916446 - DNA, 19 bp, Homo sapiens
cactatttatctgtgcaaa

SEQ ID NO: 3916447 - DNA, 16 bp, Homo sapiens
cactcaaattaatctt

SEQ ID NO: 3916448 - DNA, 19 bp, Homo sapiens
cactcaaattaatctttct

SEQ ID NO: 3916449 - DNA, 20 bp, Homo sapiens
cactcaaattaatctttctt

SEQ ID NO: 3916450 - DNA, 24 bp, Homo sapiens
cactcaccagggtccgcaccagct

SEQ ID NO: 3916451 - DNA, 22 bp, Homo sapiens
cactcacccatgtgccaaggtg

SEQ ID NO: 3916452 - DNA, 15 bp, Homo sapiens
cactcactccagccc

SEQ ID NO: 3916453 - DNA, 13 bp, Homo sapiens
cactcagaagcct

SEQ ID NO: 3916454 - DNA, 14 bp, Homo sapiens
cactcagaagcctg

SEQ ID NO: 3916455 - DNA, 15 bp, Homo sapiens
cactcagaagcctgg

SEQ ID NO: 3916456 - DNA, 17 bp, Homo sapiens
cactcagaagcctgggg

SEQ ID NO: 3916457 - DNA, 13 bp, Homo sapiens
cactcagcagccc

SEQ ID NO: 3916458 - DNA, 14 bp, Homo sapiens
cactcagcagcccc

SEQ ID NO: 3916459 - DNA, 14 bp, Homo sapiens
cactcaggactttg

SEQ ID NO: 3916460 - DNA, 21 bp, Homo sapiens
cactcatgttgttcccacaca

SEQ ID NO: 3916461 - DNA, 13 bp, Homo sapiens
cactcattcctgt

SEQ ID NO: 3916462 - DNA, 20 bp, Homo sapiens
cactcattccttcactcatc

SEQ ID NO: 3916463 - DNA, 18 bp, Homo sapiens
cactccaccccctccagc

SEQ ID NO: 3916464 - DNA, 20 bp, Homo sapiens
caggatactctgtcagatgg

SEQ ID NO: 3916465 - DNA, 23 bp, Homo sapiens
caggatactctgtcagatgggaa

SEQ ID NO: 3916466 - DNA, 19 bp, Homo sapiens
caggatcctattctcacca

SEQ ID NO: 3916467 - DNA, 21 bp, Homo sapiens
caggatcctattctcaccagg

SEQ ID NO: 3916468 - DNA, 15 bp, Homo sapiens
caggatcctgcagga

SEQ ID NO: 3916469 - DNA, 21 bp, Homo sapiens
caggatgacacctccatttct

SEQ ID NO: 3916470 - DNA, 23 bp, Homo sapiens
caggatgaggaacctcaaactgg

SEQ ID NO: 3916471 - DNA, 14 bp, Homo sapiens
caggatggggacac

SEQ ID NO: 3916472 - DNA, 15 bp, Homo sapiens
caggatggtgcagga

SEQ ID NO: 3916473 - DNA, 23 bp, Homo sapiens
caggattcctctctcaggtcact

SEQ ID NO: 3916474 - DNA, 18 bp, Homo sapiens
caggcaaaatccttgctt

SEQ ID NO: 3916475 - DNA, 17 bp, Homo sapiens
caggcaagcccctcagc

SEQ ID NO: 3916476 - DNA, 18 bp, Homo sapiens
caggcaagcccctcagcc

SEQ ID NO: 3916477 - DNA, 22 bp, Homo sapiens
caggcaagcccctcagcccttg

SEQ ID NO: 3916478 - DNA, 23 bp, Homo sapiens
caggcaagcccctcagcccttgc

SEQ ID NO: 3916479 - DNA, 12 bp, Homo sapiens
caggcaattccg

SEQ ID NO: 3916480 - DNA, 15 bp, Homo sapiens
caggcacacagcagc

SEQ ID NO: 3916481 - DNA, 17 bp, Homo sapiens
caggcacacagcagccc

SEQ ID NO: 3916482 - DNA, 14 bp, Homo sapiens
caggcacaggcagg

SEQ ID NO: 3916483 - DNA, 21 bp, Homo sapiens
caggcacaggcaggaagagag

SEQ ID NO: 3916484 - DNA, 17 bp, Homo sapiens
caggcaccccctggaga

SEQ ID NO: 3916485 - DNA, 16 bp, Homo sapiens
caggcacccttctttc

SEQ ID NO: 3916486 - DNA, 21 bp, Homo sapiens
caggcacccttctttcctctt

SEQ ID NO: 3916487 - DNA, 23 bp, Homo sapiens
caggcacccttctttcctcttcc

SEQ ID NO: 3916488 - DNA, 16 bp, Homo sapiens
caggcacgaacccacc

SEQ ID NO: 3916489 - DNA, 17 bp, Homo sapiens
caggcacgaacccacct

SEQ ID NO: 3916490 - DNA, 19 bp, Homo sapiens
caggcacgaacccacctgc

SEQ ID NO: 3916491 - DNA, 14 bp, Homo sapiens
caggcagacaagag

SEQ ID NO: 3916492 - DNA, 23 bp, Homo sapiens
caggcagagatcaggtgggcaga

SEQ ID NO: 3916493 - DNA, 13 bp, Homo sapiens
caggcagagcggg

SEQ ID NO: 3916494 - DNA, 16 bp, Homo sapiens
caggcagagcggggag

SEQ ID NO: 3916495 - DNA, 22 bp, Homo sapiens
caggcagagcggggaggtgcct

SEQ ID NO: 3916496 - DNA, 22 bp, Homo sapiens
caggcagaggatgttctggacc

SEQ ID NO: 3916497 - DNA, 18 bp, Homo sapiens
caggcagcgatggtctca

SEQ ID NO: 3916498 - DNA, 18 bp, Homo sapiens
caggcagctggatgagac

SEQ ID NO: 3916499 - DNA, 14 bp, Homo sapiens
caggcaggaagaga

SEQ ID NO: 3916500 - DNA, 15 bp, Homo sapiens
caggcaggaagagag

SEQ ID NO: 3916501 - DNA, 16 bp, Homo sapiens
caggcaggaagagaga

SEQ ID NO: 3916502 - DNA, 12 bp, Homo sapiens
caggcagggctc

SEQ ID NO: 3916503 - DNA, 14 bp, Homo sapiens
caggcagggctctc

SEQ ID NO: 3916504 - DNA, 18 bp, Homo sapiens
caggcagggctctcctgg

SEQ ID NO: 3916505 - DNA, 23 bp, Homo sapiens
caggcagggctctcctggcttcc

SEQ ID NO: 3916506 - DNA, 16 bp, Homo sapiens
caggcaggtgcctgga

SEQ ID NO: 3916507 - DNA, 13 bp, Homo sapiens
caggcaggtttgc

SEQ ID NO: 3916508 - DNA, 14 bp, Homo sapiens
caggcaggtttgcc

SEQ ID NO: 3916509 - DNA, 15 bp, Homo sapiens
caggcatcccatccc

SEQ ID NO: 3916510 - DNA, 19 bp, Homo sapiens
caggcatgctggcctccca

SEQ ID NO: 3916511 - DNA, 15 bp, Homo sapiens
caggcatttcctggg

SEQ ID NO: 3916512 - DNA, 16 bp, Homo sapiens
caggcatttcctgggt

SEQ ID NO: 3916513 - DNA, 15 bp, Homo sapiens
caggccacgctcagg

SEQ ID NO: 3916514 - DNA, 17 bp, Homo sapiens
caggccacgctcaggcc

SEQ ID NO: 3916515 - DNA, 19 bp, Homo sapiens
caggccactgtggccagag

SEQ ID NO: 3916516 - DNA, 20 bp, Homo sapiens
caggccactgtggccagagc

SEQ ID NO: 3916517 - DNA, 14 bp, Homo sapiens
caggccaggccacc

SEQ ID NO: 3916518 - DNA, 16 bp, Homo sapiens
caggccaggccaccag

SEQ ID NO: 3916519 - DNA, 18 bp, Homo sapiens
caggccaggccaccagga

SEQ ID NO: 3916520 - DNA, 18 bp, Homo sapiens
caggcccaagagatgaag

SEQ ID NO: 3916521 - DNA, 19 bp, Homo sapiens
caggcccaagagatgaaga

SEQ ID NO: 3916522 - DNA, 22 bp, Homo sapiens
caggcccatctcaggtgccact

SEQ ID NO: 3916523 - DNA, 24 bp, Homo sapiens
caggcccatctcaggtgccactcc

SEQ ID NO: 3916524 - DNA, 12 bp, Homo sapiens
caggccccaagg

SEQ ID NO: 3916525 - DNA, 16 bp, Homo sapiens
caggccccatgacctc

SEQ ID NO: 3916526 - DNA, 19 bp, Homo sapiens
caggccccatgacctccag

SEQ ID NO: 3916527 - DNA, 20 bp, Homo sapiens
caggccccatgacctccagc

SEQ ID NO: 3916528 - DNA, 22 bp, Homo sapiens
caggccccatgacctccagctt

SEQ ID NO: 3916529 - DNA, 14 bp, Homo sapiens
caggcccccaggtg

SEQ ID NO: 3916530 - DNA, 18 bp, Homo sapiens
caggccccgcttgtccag

SEQ ID NO: 3916531 - DNA, 16 bp, Homo sapiens
caggcccctgaggact

SEQ ID NO: 3916532 - DNA, 18 bp, Homo sapiens
caggcccctgaggactgg

SEQ ID NO: 3916533 - DNA, 19 bp, Homo sapiens
caggcccctgaggactgga

SEQ ID NO: 3916534 - DNA, 17 bp, Homo sapiens
caggcccgacagagaga

SEQ ID NO: 3916535 - DNA, 16 bp, Homo sapiens
caggcccggggctggc

SEQ ID NO: 3916536 - DNA, 19 bp, Homo sapiens
caggccctaagatgccttg

SEQ ID NO: 3916537 - DNA, 14 bp, Homo sapiens
caggccctccatgg

SEQ ID NO: 3916538 - DNA, 19 bp, Homo sapiens
caggccctccctgactccc

SEQ ID NO: 3916539 - DNA, 22 bp, Homo sapiens
caggccctccctgactccctgt

SEQ ID NO: 3916540 - DNA, 21 bp, Homo sapiens
caggcccttattttcaagaaa

SEQ ID NO: 3916541 - DNA, 20 bp, Homo sapiens
caggcccttcctctccactg

SEQ ID NO: 3916542 - DNA, 12 bp, Homo sapiens
caggcccttggg

SEQ ID NO: 3916543 - DNA, 15 bp, Homo sapiens
caggccgcctgccat

SEQ ID NO: 3916544 - DNA, 14 bp, Homo sapiens
caggcctccagcct

SEQ ID NO: 3916545 - DNA, 13 bp, Homo sapiens
caggcctctgtgt

SEQ ID NO: 3916546 - DNA, 14 bp, Homo sapiens
caggcctctgtgtc

SEQ ID NO: 3916547 - DNA, 17 bp, Homo sapiens
caggcctctgtgtcctt

SEQ ID NO: 3916548 - DNA, 20 bp, Homo sapiens
caggcctgcctgttcccatt

SEQ ID NO: 3916549 - DNA, 16 bp, Homo sapiens
caggcctgtgtagctg

SEQ ID NO: 3916550 - DNA, 12 bp, Homo sapiens
caggcctgtgtg

SEQ ID NO: 3916551 - DNA, 17 bp, Homo sapiens
caggcgctggacagagg

SEQ ID NO: 3916552 - DNA, 19 bp, Homo sapiens
caggcgttggtgccacttc

SEQ ID NO: 3916553 - DNA, 14 bp, Homo sapiens
caggctaccccttc

SEQ ID NO: 3916554 - DNA, 16 bp, Homo sapiens
caggctagagtgcagt

SEQ ID NO: 3916555 - DNA, 15 bp, Homo sapiens
caggctatttgttca

SEQ ID NO: 3916556 - DNA, 19 bp, Homo sapiens
caggctatttgttcagaga

SEQ ID NO: 3916557 - DNA, 14 bp, Homo sapiens
caggctcagactct

SEQ ID NO: 3916558 - DNA, 20 bp, Homo sapiens
caggctccctttctcttctt

SEQ ID NO: 3916559 - DNA, 14 bp, Homo sapiens
caggctctgcctgg

SEQ ID NO: 3916560 - DNA, 17 bp, Homo sapiens
caggctctggagccaga

SEQ ID NO: 3916561 - DNA, 12 bp, Homo sapiens
caggctctgggc

SEQ ID NO: 3916562 - DNA, 16 bp, Homo sapiens
caggctctgggctcag

SEQ ID NO: 3916563 - DNA, 18 bp, Homo sapiens
caggctctgggctcaggg

SEQ ID NO: 3916564 - DNA, 20 bp, Homo sapiens
caggctctgggctcagggct

SEQ ID NO: 3916565 - DNA, 18 bp, Homo sapiens
caggctcttcctggacct

SEQ ID NO: 3916566 - DNA, 22 bp, Homo sapiens
caggctcttcctggacctgagt

SEQ ID NO: 3916567 - DNA, 23 bp, Homo sapiens
caggctcttcctggacctgagtc

SEQ ID NO: 3916568 - DNA, 12 bp, Homo sapiens
caggctcttctc

SEQ ID NO: 3916569 - DNA, 15 bp, Homo sapiens
caggctcttctcctt

SEQ ID NO: 3916570 - DNA, 22 bp, Homo sapiens
caggctctttggggtcagccag

SEQ ID NO: 3916571 - DNA, 23 bp, Homo sapiens
caggctctttggggtcagccagg

SEQ ID NO: 3916572 - DNA, 12 bp, Homo sapiens
caggctgaagag

SEQ ID NO: 3916573 - DNA, 15 bp, Homo sapiens
caggctgcactgcag

SEQ ID NO: 3916574 - DNA, 18 bp, Homo sapiens
caggctgcactgcagtga

SEQ ID NO: 3916575 - DNA, 21 bp, Homo sapiens
caggctgcactgcagtgatgg

SEQ ID NO: 3916576 - DNA, 15 bp, Homo sapiens
caggctggagatcct

SEQ ID NO: 3916577 - DNA, 20 bp, Homo sapiens
caggctggtctcgaactcct

SEQ ID NO: 3916578 - DNA, 21 bp, Homo sapiens
caggctgttctgcactgaaaa

SEQ ID NO: 3916579 - DNA, 15 bp, Homo sapiens
caggcttcaccctga

SEQ ID NO: 3916580 - DNA, 14 bp, Homo sapiens
caggcttgccaccg

SEQ ID NO: 3916581 - DNA, 18 bp, Homo sapiens
caggcttggaatgaattc

SEQ ID NO: 3916582 - DNA, 19 bp, Homo sapiens
cagggaaatggagggtggg

SEQ ID NO: 3916583 - DNA, 17 bp, Homo sapiens
cagggaagagcagaacg

SEQ ID NO: 3916584 - DNA, 12 bp, Homo sapiens
cagggaagaggg

SEQ ID NO: 3916585 - DNA, 14 bp, Homo sapiens
cagggaagagggca

SEQ ID NO: 3916586 - DNA, 15 bp, Homo sapiens
cagggaagagggcag

SEQ ID NO: 3916587 - DNA, 20 bp, Homo sapiens
cagggaagagggcagtacct

SEQ ID NO: 3916588 - DNA, 12 bp, Homo sapiens
cagggaagcagg

SEQ ID NO: 3916589 - DNA, 14 bp, Homo sapiens
cagggaagcaggca

SEQ ID NO: 3916590 - DNA, 15 bp, Homo sapiens
cagggaagcaggcag

SEQ ID NO: 3916591 - DNA, 16 bp, Homo sapiens
cagggaaggcaggcag

SEQ ID NO: 3916592 - DNA, 20 bp, Homo sapiens
cagggaaggcaggcagggct

SEQ ID NO: 3916593 - DNA, 22 bp, Homo sapiens
cagggaagtcttacttaaaaaa

SEQ ID NO: 3916594 - DNA, 17 bp, Homo sapiens
cagggacaaagaggcct

SEQ ID NO: 3916595 - DNA, 19 bp, Homo sapiens
cagggacagagacacctgc

SEQ ID NO: 3916596 - DNA, 13 bp, Homo sapiens
cagggacagagat

SEQ ID NO: 3916597 - DNA, 23 bp, Homo sapiens
cagggagcaactctccactccat

SEQ ID NO: 3916598 - DNA, 13 bp, Homo sapiens
cagggagcaatgg

SEQ ID NO: 3916599 - DNA, 22 bp, Homo sapiens
cagggaggagaggggaagggcc

SEQ ID NO: 3916600 - DNA, 16 bp, Homo sapiens
cagggaggatgccaca

SEQ ID NO: 3916601 - DNA, 17 bp, Homo sapiens
cagggaggatgccacag

SEQ ID NO: 3916602 - DNA, 18 bp, Homo sapiens
cagggaggatgccacagc

SEQ ID NO: 3916603 - DNA, 19 bp, Homo sapiens
cagggaggatgccacagcc

SEQ ID NO: 3916604 - DNA, 21 bp, Homo sapiens
cagggaggatgccacagcccc

SEQ ID NO: 3916605 - DNA, 23 bp, Homo sapiens
cagggatgccaacaccttcttgg

SEQ ID NO: 3916606 - DNA, 23 bp, Homo sapiens
cagggatgggggatgggccaggg

SEQ ID NO: 3916607 - DNA, 14 bp, Homo sapiens
cagggcaaatgaca

SEQ ID NO: 3916608 - DNA, 22 bp, Homo sapiens
cagggcaaatgacatgcactga

SEQ ID NO: 3916609 - DNA, 23 bp, Homo sapiens
cagggcaaatgacatgcactgac

SEQ ID NO: 3916610 - DNA, 13 bp, Homo sapiens
cagggcacaggag

SEQ ID NO: 3916611 - DNA, 12 bp, Homo sapiens
cagggcagaggg

SEQ ID NO: 3916612 - DNA, 11 bp, Homo sapiens
cagggcagcct

SEQ ID NO: 3916613 - DNA, 15 bp, Homo sapiens
cagggccacgtgcca

SEQ ID NO: 3916614 - DNA, 23 bp, Homo sapiens
cagggccagaaggagggcagagc

SEQ ID NO: 3916615 - DNA, 14 bp, Homo sapiens
cagggcccaggtga

SEQ ID NO: 3916616 - DNA, 13 bp, Homo sapiens
cagggccccagaa

SEQ ID NO: 3916617 - DNA, 15 bp, Homo sapiens
cagggccccagaagg

SEQ ID NO: 3916618 - DNA, 17 bp, Homo sapiens
cagggccccagaaggca

SEQ ID NO: 3916619 - DNA, 19 bp, Homo sapiens
cagggcccctccctctgcc

SEQ ID NO: 3916620 - DNA, 21 bp, Homo sapiens
cagggccctaacgggggtgcg

SEQ ID NO: 3916621 - DNA, 12 bp, Homo sapiens
cagggccgggga

SEQ ID NO: 3916622 - DNA, 22 bp, Homo sapiens
cagggccggggaactggccaag

SEQ ID NO: 3916623 - DNA, 12 bp, Homo sapiens
cagggcctgggg

SEQ ID NO: 3916624 - DNA, 16 bp, Homo sapiens
cagggcctgggggcag

SEQ ID NO: 3916625 - DNA, 12 bp, Homo sapiens
cagggcctggtg

SEQ ID NO: 3916626 - DNA, 21 bp, Homo sapiens
cagggcctggtgtgaggctgg

SEQ ID NO: 3916627 - DNA, 14 bp, Homo sapiens
cagggcctgtctca

SEQ ID NO: 3916628 - DNA, 13 bp, Homo sapiens
cagggccttgccc

SEQ ID NO: 3916629 - DNA, 16 bp, Homo sapiens
cagggccttgcccaga

SEQ ID NO: 3916630 - DNA, 24 bp, Homo sapiens
cagggccttgcccagagatgcctc

SEQ ID NO: 3916631 - DNA, 13 bp, Homo sapiens
cagggcgcaagcc

SEQ ID NO: 3916632 - DNA, 15 bp, Homo sapiens
cagggctaccctccc

SEQ ID NO: 3916633 - DNA, 12 bp, Homo sapiens
cagggctccctc

SEQ ID NO: 3916634 - DNA, 20 bp, Homo sapiens
cagggctccctcctggagca

SEQ ID NO: 3916635 - DNA, 15 bp, Homo sapiens
cagggctctcctggc

SEQ ID NO: 3916636 - DNA, 18 bp, Homo sapiens
cagggctctcctggcttc

SEQ ID NO: 3916637 - DNA, 19 bp, Homo sapiens
cagggctctcctggcttcc

SEQ ID NO: 3916638 - DNA, 15 bp, Homo sapiens
cagggctctgcccca

SEQ ID NO: 3916639 - DNA, 19 bp, Homo sapiens
cagggctctgccccagagg

SEQ ID NO: 3916640 - DNA, 20 bp, Homo sapiens
cagggctgccactaacctgt

SEQ ID NO: 3916641 - DNA, 21 bp, Homo sapiens
cagggctgccactaacctgta

SEQ ID NO: 3916642 - DNA, 12 bp, Homo sapiens
cagggctgcccc

SEQ ID NO: 3916643 - DNA, 15 bp, Homo sapiens
cagggctgcccctgt

SEQ ID NO: 3916644 - DNA, 23 bp, Homo sapiens
cagggctgcccctgtaggttgct

SEQ ID NO: 3916645 - DNA, 16 bp, Homo sapiens
caggggaaaatgaagg

SEQ ID NO: 3916646 - DNA, 17 bp, Homo sapiens
caggggagagggtctgg

SEQ ID NO: 3916647 - DNA, 13 bp, Homo sapiens
caggggatcaaag

SEQ ID NO: 3916648 - DNA, 16 bp, Homo sapiens
caggggcaggcctggg

SEQ ID NO: 3916649 - DNA, 17 bp, Homo sapiens
caggggcaggcctggga

SEQ ID NO: 3916650 - DNA, 21 bp, Homo sapiens
caggggccagtgagggctggg

SEQ ID NO: 3916651 - DNA, 12 bp, Homo sapiens
caggggccccag

SEQ ID NO: 3916652 - DNA, 15 bp, Homo sapiens
caggggccccagatc

SEQ ID NO: 3916653 - DNA, 16 bp, Homo sapiens
caggggccccagatct

SEQ ID NO: 3916654 - DNA, 17 bp, Homo sapiens
caggggccccagatctg

SEQ ID NO: 3916655 - DNA, 22 bp, Homo sapiens
caggggccccagatctgcctgg

SEQ ID NO: 3916656 - DNA, 13 bp, Homo sapiens
caggggcggggca

SEQ ID NO: 3916657 - DNA, 15 bp, Homo sapiens
caggggcggggcagg

SEQ ID NO: 3916658 - DNA, 17 bp, Homo sapiens
caggggcggggcaggaa

SEQ ID NO: 3916659 - DNA, 19 bp, Homo sapiens
caggggcggggcaggaatg

SEQ ID NO: 3916660 - DNA, 16 bp, Homo sapiens
caggggctgctcatca

SEQ ID NO: 3916661 - DNA, 20 bp, Homo sapiens
caggggctgctcatcaccca

SEQ ID NO: 3916662 - DNA, 21 bp, Homo sapiens
caggggctgctcatcacccag

SEQ ID NO: 3916663 - DNA, 22 bp, Homo sapiens
caggggctgctcatcacccagt

SEQ ID NO: 3916664 - DNA, 21 bp, Homo sapiens
cagggggcctttaaagactta

SEQ ID NO: 3916665 - DNA, 19 bp, Homo sapiens
caggggggttgtgaggcct

SEQ ID NO: 3916666 - DNA, 21 bp, Homo sapiens
caggggtatatttagaccctg

SEQ ID NO: 3916667 - DNA, 17 bp, Homo sapiens
cactccagacccctggc

SEQ ID NO: 3916668 - DNA, 16 bp, Homo sapiens
cactccagccctgtcc

SEQ ID NO: 3916669 - DNA, 23 bp, Homo sapiens
cactccatggccaccccgtgcca

SEQ ID NO: 3916670 - DNA, 15 bp, Homo sapiens
cactccattcccaac

SEQ ID NO: 3916671 - DNA, 13 bp, Homo sapiens
cactcccagggac

SEQ ID NO: 3916672 - DNA, 14 bp, Homo sapiens
cactcccataagct

SEQ ID NO: 3916673 - DNA, 22 bp, Homo sapiens
cactccccgcctgtcctgcctc

SEQ ID NO: 3916674 - DNA, 20 bp, Homo sapiens
cactccctaaccaaatgctg

SEQ ID NO: 3916675 - DNA, 22 bp, Homo sapiens
cactccctaaccaaatgctgtc

SEQ ID NO: 3916676 - DNA, 20 bp, Homo sapiens
cactccctaagaaaccccag

SEQ ID NO: 3916677 - DNA, 21 bp, Homo sapiens
cactccctaagaaaccccagg

SEQ ID NO: 3916678 - DNA, 14 bp, Homo sapiens
cactccctcctaac

SEQ ID NO: 3916679 - DNA, 12 bp, Homo sapiens
cactccctgagc

SEQ ID NO: 3916680 - DNA, 13 bp, Homo sapiens
cactcctacctgg

SEQ ID NO: 3916681 - DNA, 15 bp, Homo sapiens
cactcctccaaagga

SEQ ID NO: 3916682 - DNA, 16 bp, Homo sapiens
cactcctgtcccgcct

SEQ ID NO: 3916683 - DNA, 18 bp, Homo sapiens
cactcctgtcccgccttc

SEQ ID NO: 3916684 - DNA, 18 bp, Homo sapiens
cactcctgttacttacct

SEQ ID NO: 3916685 - DNA, 15 bp, Homo sapiens
cactccttcctgccc

SEQ ID NO: 3916686 - DNA, 21 bp, Homo sapiens
cactccttcctgccccaactc

SEQ ID NO: 3916687 - DNA, 22 bp, Homo sapiens
cactcgagaccatcctggcccc

SEQ ID NO: 3916688 - DNA, 18 bp, Homo sapiens
cactcgggaggctgagac

SEQ ID NO: 3916689 - DNA, 22 bp, Homo sapiens
cactcgggaggctgagacagga

SEQ ID NO: 3916690 - DNA, 17 bp, Homo sapiens
cactctaggggtcaggc

SEQ ID NO: 3916691 - DNA, 19 bp, Homo sapiens
cactctaggggtcaggctc

SEQ ID NO: 3916692 - DNA, 19 bp, Homo sapiens
cactctagtgacttcctgg

SEQ ID NO: 3916693 - DNA, 21 bp, Homo sapiens
cactctagtgacttcctggtg

SEQ ID NO: 3916694 - DNA, 18 bp, Homo sapiens
cactctcattccccaggt

SEQ ID NO: 3916695 - DNA, 13 bp, Homo sapiens
cactctcccctcc

SEQ ID NO: 3916696 - DNA, 16 bp, Homo sapiens
cactctcccctccctc

SEQ ID NO: 3916697 - DNA, 18 bp, Homo sapiens
cactctcccctccctctt

SEQ ID NO: 3916698 - DNA, 21 bp, Homo sapiens
cactctcccctccctcttcct

SEQ ID NO: 3916699 - DNA, 23 bp, Homo sapiens
cactctcggggcccttggggcct

SEQ ID NO: 3916700 - DNA, 15 bp, Homo sapiens
cactctctgtacaaa

SEQ ID NO: 3916701 - DNA, 16 bp, Homo sapiens
cactctctgtacaaaa

SEQ ID NO: 3916702 - DNA, 12 bp, Homo sapiens
cactctgctctg

SEQ ID NO: 3916703 - DNA, 17 bp, Homo sapiens
cactctgctctgatgca

SEQ ID NO: 3916704 - DNA, 18 bp, Homo sapiens
cactctggcagccacact

SEQ ID NO: 3916705 - DNA, 12 bp, Homo sapiens
cactctgtcagc

SEQ ID NO: 3916706 - DNA, 14 bp, Homo sapiens
cactctgtcagcca

SEQ ID NO: 3916707 - DNA, 17 bp, Homo sapiens
cactctgtcagccagcc

SEQ ID NO: 3916708 - DNA, 18 bp, Homo sapiens
cactctgtcagccagccg

SEQ ID NO: 3916709 - DNA, 15 bp, Homo sapiens
cactcttatgaaatg

SEQ ID NO: 3916710 - DNA, 17 bp, Homo sapiens
cactcttcctgcaagga

SEQ ID NO: 3916711 - DNA, 18 bp, Homo sapiens
cactcttcttgagcagac

SEQ ID NO: 3916712 - DNA, 14 bp, Homo sapiens
cactctttgctaca

SEQ ID NO: 3916713 - DNA, 20 bp, Homo sapiens
cactctttgctacaataaat

SEQ ID NO: 3916714 - DNA, 22 bp, Homo sapiens
cactctttgctacaataaatgc

SEQ ID NO: 3916715 - DNA, 22 bp, Homo sapiens
cactgaaaacatttcaaagctg

SEQ ID NO: 3916716 - DNA, 21 bp, Homo sapiens
cactgaaaaggttcttcatcc

SEQ ID NO: 3916717 - DNA, 19 bp, Homo sapiens
cactgaagttaacagagac

SEQ ID NO: 3916718 - DNA, 14 bp, Homo sapiens
cactgacccacagc

SEQ ID NO: 3916719 - DNA, 22 bp, Homo sapiens
cactgacccacagcctctgcct

SEQ ID NO: 3916720 - DNA, 15 bp, Homo sapiens
cactgacccttccag

SEQ ID NO: 3916721 - DNA, 21 bp, Homo sapiens
cactgacccttccagacatac

SEQ ID NO: 3916722 - DNA, 20 bp, Homo sapiens
cactgacttctaagtaaaac

SEQ ID NO: 3916723 - DNA, 21 bp, Homo sapiens
cactgacttctaagtaaaacc

SEQ ID NO: 3916724 - DNA, 22 bp, Homo sapiens
cactgattgggtgccatgtgga

SEQ ID NO: 3916725 - DNA, 13 bp, Homo sapiens
cactgatttcaca

SEQ ID NO: 3916726 - DNA, 22 bp, Homo sapiens
cactgcaacctccacctcctga

SEQ ID NO: 3916727 - DNA, 23 bp, Homo sapiens
cactgcaacctcttcctcctggt

SEQ ID NO: 3916728 - DNA, 20 bp, Homo sapiens
cactgcaacttctacctccg

SEQ ID NO: 3916729 - DNA, 17 bp, Homo sapiens
cactgcaagagccttgg

SEQ ID NO: 3916730 - DNA, 18 bp, Homo sapiens
cactgcaagagccttggt

SEQ ID NO: 3916731 - DNA, 19 bp, Homo sapiens
cactgcaagagccttggtg

SEQ ID NO: 3916732 - DNA, 22 bp, Homo sapiens
cactgcacagtgcatctcagcc

SEQ ID NO: 3916733 - DNA, 18 bp, Homo sapiens
cactgcactccagcctgg

SEQ ID NO: 3916734 - DNA, 22 bp, Homo sapiens
cactgcagatagccagacacat

SEQ ID NO: 3916735 - DNA, 14 bp, Homo sapiens
cactgccagcagct

SEQ ID NO: 3916736 - DNA, 17 bp, Homo sapiens
cactgccaggagggaca

SEQ ID NO: 3916737 - DNA, 11 bp, Homo sapiens
cactgccaggc

SEQ ID NO: 3916738 - DNA, 12 bp, Homo sapiens
cactgccaggca

SEQ ID NO: 3916739 - DNA, 13 bp, Homo sapiens
cactgccaggcac

SEQ ID NO: 3916740 - DNA, 18 bp, Homo sapiens
cactgccaggcacctggc

SEQ ID NO: 3916741 - DNA, 19 bp, Homo sapiens
cactgccaggcacctggcc

SEQ ID NO: 3916742 - DNA, 21 bp, Homo sapiens
cactgccaggcacctggcctg

SEQ ID NO: 3916743 - DNA, 14 bp, Homo sapiens
cactgccctgcctg

SEQ ID NO: 3916744 - DNA, 20 bp, Homo sapiens
cactgccttcgatacaccgg

SEQ ID NO: 3916745 - DNA, 20 bp, Homo sapiens
cactgctaggcgagtgccag

SEQ ID NO: 3916746 - DNA, 12 bp, Homo sapiens
cactgctgcacc

SEQ ID NO: 3916747 - DNA, 16 bp, Homo sapiens
cactgctggctgcctt

SEQ ID NO: 3916748 - DNA, 22 bp, Homo sapiens
cactggaacagcccattttatc

SEQ ID NO: 3916749 - DNA, 21 bp, Homo sapiens
cactggagcaccaggcacgaa

SEQ ID NO: 3916750 - DNA, 16 bp, Homo sapiens
cactggagtgcaggga

SEQ ID NO: 3916751 - DNA, 23 bp, Homo sapiens
cactggatcttcagaaggctaga

SEQ ID NO: 3916752 - DNA, 13 bp, Homo sapiens
cactggccaccca

SEQ ID NO: 3916753 - DNA, 13 bp, Homo sapiens
cactggccagaga

SEQ ID NO: 3916754 - DNA, 14 bp, Homo sapiens
cactggccagagag

SEQ ID NO: 3916755 - DNA, 20 bp, Homo sapiens
cactggccagagagggccca

SEQ ID NO: 3916756 - DNA, 14 bp, Homo sapiens
cactggccagtcct

SEQ ID NO: 3916757 - DNA, 16 bp, Homo sapiens
cactggccccaccctc

SEQ ID NO: 3916758 - DNA, 23 bp, Homo sapiens
cactggcgcatcatatgcagtga

SEQ ID NO: 3916759 - DNA, 14 bp, Homo sapiens
cactggctggggca

SEQ ID NO: 3916760 - DNA, 15 bp, Homo sapiens
cactggctggggcag

SEQ ID NO: 3916761 - DNA, 19 bp, Homo sapiens
cactggctggggcagaggg

SEQ ID NO: 3916762 - DNA, 23 bp, Homo sapiens
cactgggatgagccgctgtgagc

SEQ ID NO: 3916763 - DNA, 15 bp, Homo sapiens
cactgggttgacttt

SEQ ID NO: 3916764 - DNA, 18 bp, Homo sapiens
cactgtaaacccctgggt

SEQ ID NO: 3916765 - DNA, 22 bp, Homo sapiens
cactgtaagactcattccctag

SEQ ID NO: 3916766 - DNA, 18 bp, Homo sapiens
cactgtagaatgatttca

SEQ ID NO: 3916767 - DNA, 21 bp, Homo sapiens
cactgtattttcattttaatt

SEQ ID NO: 3916768 - DNA, 15 bp, Homo sapiens
cactgtcagagctgt

SEQ ID NO: 3916769 - DNA, 23 bp, Homo sapiens
cactgtcagagctgttggcctcg

SEQ ID NO: 3916770 - DNA, 18 bp, Homo sapiens
cactgtccctcaaatgac

SEQ ID NO: 3916771 - DNA, 12 bp, Homo sapiens
cactgtccgcct

SEQ ID NO: 3916772 - DNA, 20 bp, Homo sapiens
cactgtctcctggtctgtgc

SEQ ID NO: 3916773 - DNA, 17 bp, Homo sapiens
cactgtgaggggaaggc

SEQ ID NO: 3916774 - DNA, 20 bp, Homo sapiens
cactgtgaggggaaggcctt

SEQ ID NO: 3916775 - DNA, 19 bp, Homo sapiens
cactgtgcttacagtgact

SEQ ID NO: 3916776 - DNA, 12 bp, Homo sapiens
cactgtggccag

SEQ ID NO: 3916777 - DNA, 19 bp, Homo sapiens
cactgtggccagagctgga

SEQ ID NO: 3916778 - DNA, 15 bp, Homo sapiens
cactgtgtatttaac

SEQ ID NO: 3916779 - DNA, 22 bp, Homo sapiens
cactgttgagttggacacactg

SEQ ID NO: 3916780 - DNA, 11 bp, Homo sapiens
cacttatacca

SEQ ID NO: 3916781 - DNA, 11 bp, Homo sapiens
cacttatatat

SEQ ID NO: 3916782 - DNA, 13 bp, Homo sapiens
cacttcactgtga

SEQ ID NO: 3916783 - DNA, 14 bp, Homo sapiens
cacttccagtgttg

SEQ ID NO: 3916784 - DNA, 23 bp, Homo sapiens
cacttccagtgttggctgtgtga

SEQ ID NO: 3916785 - DNA, 20 bp, Homo sapiens
cacttccataatctggactc

SEQ ID NO: 3916786 - DNA, 22 bp, Homo sapiens
cacttccctgggaactcatcct

SEQ ID NO: 3916787 - DNA, 22 bp, Homo sapiens
cacttctcaggacacaggcctg

SEQ ID NO: 3916788 - DNA, 17 bp, Homo sapiens
cacttctcatcatattg

SEQ ID NO: 3916789 - DNA, 23 bp, Homo sapiens
cacttctcatcatattgtatgta

SEQ ID NO: 3916790 - DNA, 17 bp, Homo sapiens
cacttcttaaaggcctg

SEQ ID NO: 3916791 - DNA, 18 bp, Homo sapiens
cacttcttgaaacagcct

SEQ ID NO: 3916792 - DNA, 21 bp, Homo sapiens
cacttcttgaaacagcctggg

SEQ ID NO: 3916793 - DNA, 14 bp, Homo sapiens
cacttctttcctct

SEQ ID NO: 3916794 - DNA, 18 bp, Homo sapiens
cacttgagttcaggagtt

SEQ ID NO: 3916795 - DNA, 19 bp, Homo sapiens
cacttgatgacccccaacc

SEQ ID NO: 3916796 - DNA, 18 bp, Homo sapiens
cacttgcgtcctgcagag

SEQ ID NO: 3916797 - DNA, 12 bp, Homo sapiens
cacttggagccc

SEQ ID NO: 3916798 - DNA, 14 bp, Homo sapiens
cacttggctgctca

SEQ ID NO: 3916799 - DNA, 22 bp, Homo sapiens
cacttggggcaccttgctcctc

SEQ ID NO: 3916800 - DNA, 21 bp, Homo sapiens
cacttggggtcaccaccctcc

SEQ ID NO: 3916801 - DNA, 12 bp, Homo sapiens
cacttgtaaata

SEQ ID NO: 3916802 - DNA, 12 bp, Homo sapiens
cacttgtataaa

SEQ ID NO: 3916803 - DNA, 15 bp, Homo sapiens
cacttgtataaatgt

SEQ ID NO: 3916804 - DNA, 16 bp, Homo sapiens
cactttaaagtctttc

SEQ ID NO: 3916805 - DNA, 16 bp, Homo sapiens
cactttaaccctctct

SEQ ID NO: 3916806 - DNA, 18 bp, Homo sapiens
cactttaaccctctcttc

SEQ ID NO: 3916807 - DNA, 19 bp, Homo sapiens
cactttaaccctctcttcc

SEQ ID NO: 3916808 - DNA, 17 bp, Homo sapiens
cactttgcacagctctc

SEQ ID NO: 3916809 - DNA, 13 bp, Homo sapiens
cactttggcttct

SEQ ID NO: 3916810 - DNA, 13 bp, Homo sapiens
cacttttcagtga

SEQ ID NO: 3916811 - DNA, 22 bp, Homo sapiens
cacttttctttattgctgtgaa

SEQ ID NO: 3916812 - DNA, 16 bp, Homo sapiens
cagaaaaactctggga

SEQ ID NO: 3916813 - DNA, 14 bp, Homo sapiens
cagaaaacaaatct

SEQ ID NO: 3916814 - DNA, 23 bp, Homo sapiens
cagaaaacaaatcttcaaggtgt

SEQ ID NO: 3916815 - DNA, 14 bp, Homo sapiens
cagaaaagaaaacc

SEQ ID NO: 3916816 - DNA, 16 bp, Homo sapiens
cagaaaagaaaaccat

SEQ ID NO: 3916817 - DNA, 17 bp, Homo sapiens
cagaaaagaaaaccatt

SEQ ID NO: 3916818 - DNA, 19 bp, Homo sapiens
cagaaaagaggagaccctg

SEQ ID NO: 3916819 - DNA, 17 bp, Homo sapiens
cagaaaagcacctgccg

SEQ ID NO: 3916820 - DNA, 12 bp, Homo sapiens
cagaaaagtaga

SEQ ID NO: 3916821 - DNA, 16 bp, Homo sapiens
cagaaaagtagaatta

SEQ ID NO: 3916822 - DNA, 22 bp, Homo sapiens
cagaaaagtagaattatatcta

SEQ ID NO: 3916823 - DNA, 12 bp, Homo sapiens
cagaaaagtgct

SEQ ID NO: 3916824 - DNA, 22 bp, Homo sapiens
cagaaactcaaccatcaatgga

SEQ ID NO: 3916825 - DNA, 21 bp, Homo sapiens
cagaaactccttttgctgtct

SEQ ID NO: 3916826 - DNA, 19 bp, Homo sapiens
cagaaagatggatgtgctt

SEQ ID NO: 3916827 - DNA, 21 bp, Homo sapiens
cagaaagatggatgtgctttg

SEQ ID NO: 3916828 - DNA, 13 bp, Homo sapiens
cagaaagccttcc

SEQ ID NO: 3916829 - DNA, 23 bp, Homo sapiens
cagaaagtggccatgccaccctg

SEQ ID NO: 3916830 - DNA, 13 bp, Homo sapiens
cagaaatatatat

SEQ ID NO: 3916831 - DNA, 23 bp, Homo sapiens
cagaaattagaaaccttaatatg

SEQ ID NO: 3916832 - DNA, 15 bp, Homo sapiens
cagaaatttttattt

SEQ ID NO: 3916833 - DNA, 19 bp, Homo sapiens
cagaaatttttatttttct

SEQ ID NO: 3916834 - DNA, 20 bp, Homo sapiens
cagaacactgggtagtagct

SEQ ID NO: 3916835 - DNA, 14 bp, Homo sapiens
cagaacatgctgga

SEQ ID NO: 3916836 - DNA, 16 bp, Homo sapiens
cagaacatgtgggagg

SEQ ID NO: 3916837 - DNA, 20 bp, Homo sapiens
cagaacatgtgggaggaaga

SEQ ID NO: 3916838 - DNA, 23 bp, Homo sapiens
cagaacccctacatgaaacagaa

SEQ ID NO: 3916839 - DNA, 22 bp, Homo sapiens
cagaacccttggagccaatgga

SEQ ID NO: 3916840 - DNA, 21 bp, Homo sapiens
cagaacctggagggctagaac

SEQ ID NO: 3916841 - DNA, 19 bp, Homo sapiens
cagaactgaggtcactggg

SEQ ID NO: 3916842 - DNA, 20 bp, Homo sapiens
cagaactgaggtcactgggt

SEQ ID NO: 3916843 - DNA, 15 bp, Homo sapiens
cagaagaaaaagttg

SEQ ID NO: 3916844 - DNA, 15 bp, Homo sapiens
cagaagaatattcag

SEQ ID NO: 3916845 - DNA, 17 bp, Homo sapiens
cagaagaatattcagga

SEQ ID NO: 3916846 - DNA, 21 bp, Homo sapiens
cagaagaattgaacccaggag

SEQ ID NO: 3916847 - DNA, 19 bp, Homo sapiens
cagaagacactgcaaaggc

SEQ ID NO: 3916848 - DNA, 16 bp, Homo sapiens
cagaagcaggttcttg

SEQ ID NO: 3916849 - DNA, 23 bp, Homo sapiens
cagaagcagttgagtcgtcatca

SEQ ID NO: 3916850 - DNA, 20 bp, Homo sapiens
cagaagccccatttgcacag

SEQ ID NO: 3916851 - DNA, 12 bp, Homo sapiens
cagaagcctggg

SEQ ID NO: 3916852 - DNA, 13 bp, Homo sapiens
cagaagcctgggg

SEQ ID NO: 3916853 - DNA, 23 bp, Homo sapiens
cagaagcctgggggcctggctgg

SEQ ID NO: 3916854 - DNA, 24 bp, Homo sapiens
cagaagcctgggggcctggctggc

SEQ ID NO: 3916855 - DNA, 17 bp, Homo sapiens
cagaagctaagctgcag

SEQ ID NO: 3916856 - DNA, 11 bp, Homo sapiens
cagaaggaagg

SEQ ID NO: 3916857 - DNA, 15 bp, Homo sapiens
cagaaggaaggagga

SEQ ID NO: 3916858 - DNA, 15 bp, Homo sapiens
cagaaggaaggcagg

SEQ ID NO: 3916859 - DNA, 18 bp, Homo sapiens
cagaaggagaaggaagga

SEQ ID NO: 3916860 - DNA, 20 bp, Homo sapiens
cagaaggagaaggaaggaga

SEQ ID NO: 3916861 - DNA, 13 bp, Homo sapiens
cagaaggagggca

SEQ ID NO: 3916862 - DNA, 22 bp, Homo sapiens
cagaaggagggcagagccatgg

SEQ ID NO: 3916863 - DNA, 11 bp, Homo sapiens
cagaaggctgg

SEQ ID NO: 3916864 - DNA, 18 bp, Homo sapiens
cagaaggctggggccagt

SEQ ID NO: 3916865 - DNA, 19 bp, Homo sapiens
cagaaggctggggccagtg

SEQ ID NO: 3916866 - DNA, 19 bp, Homo sapiens
cagaagggagttgctcact

SEQ ID NO: 3916867 - DNA, 21 bp, Homo sapiens
cagaagggagttgctcactca

SEQ ID NO: 3916868 - DNA, 23 bp, Homo sapiens
cagaagggagttgctcactcagg

SEQ ID NO: 3916869 - DNA, 17 bp, Homo sapiens
cagaagggggagaccaa

SEQ ID NO: 3916870 - DNA, 18 bp, Homo sapiens
cagaagtggggctctggg

SEQ ID NO: 3916871 - DNA, 19 bp, Homo sapiens
cagaagtggggctctggga

SEQ ID NO: 3916872 - DNA, 19 bp, Homo sapiens
cagaagtttctcagctccc

SEQ ID NO: 3916873 - DNA, 12 bp, Homo sapiens
cagaataagtgc

SEQ ID NO: 3916874 - DNA, 16 bp, Homo sapiens
cagaataagtgctgtt

SEQ ID NO: 3916875 - DNA, 21 bp, Homo sapiens
cagaataccttcttcgctgct

SEQ ID NO: 3916876 - DNA, 21 bp, Homo sapiens
cagaatagatctgatggtgag

SEQ ID NO: 3916877 - DNA, 21 bp, Homo sapiens
cagaatatttatccttcacca

SEQ ID NO: 3916878 - DNA, 14 bp, Homo sapiens
cagaatcataattt

SEQ ID NO: 3916879 - DNA, 16 bp, Homo sapiens
cagaatctgctgttgc

SEQ ID NO: 3916880 - DNA, 21 bp, Homo sapiens
cagaatctgctgttgccatag

SEQ ID NO: 3916881 - DNA, 15 bp, Homo sapiens
cagaatcttcgtcct

SEQ ID NO: 3916882 - DNA, 13 bp, Homo sapiens
cagaatcttgtat

SEQ ID NO: 3916883 - DNA, 15 bp, Homo sapiens
cagaatgctcttcta

SEQ ID NO: 3916884 - DNA, 18 bp, Homo sapiens
cagaatgctgttttaaaa

SEQ ID NO: 3916885 - DNA, 15 bp, Homo sapiens
cagaattcccagctg

SEQ ID NO: 3916886 - DNA, 23 bp, Homo sapiens
cagaattcccagctgtctgtgtc

SEQ ID NO: 3916887 - DNA, 13 bp, Homo sapiens
cagaattgatcat

SEQ ID NO: 3916888 - DNA, 19 bp, Homo sapiens
cagaattgtgcaaatggaa

SEQ ID NO: 3916889 - DNA, 19 bp, Homo sapiens
cagaatttctttgtcattc

SEQ ID NO: 3916890 - DNA, 22 bp, Homo sapiens
cagaatttctttgtcattcaag

SEQ ID NO: 3916891 - DNA, 19 bp, Homo sapiens
cagacaaaaacagcctcac

SEQ ID NO: 3916892 - DNA, 21 bp, Homo sapiens
cagacaaaaacagcctcacag

SEQ ID NO: 3916893 - DNA, 21 bp, Homo sapiens
cagacaaagtaattcctctca

SEQ ID NO: 3916894 - DNA, 17 bp, Homo sapiens
cagagccatgggcctgg

SEQ ID NO: 3916895 - DNA, 23 bp, Homo sapiens
cagagccatgggcctgggcctgc

SEQ ID NO: 3916896 - DNA, 18 bp, Homo sapiens
cagagcccaagtgccatc

SEQ ID NO: 3916897 - DNA, 13 bp, Homo sapiens
cagagccccacac

SEQ ID NO: 3916898 - DNA, 23 bp, Homo sapiens
cagagccccacacggaggcatct

SEQ ID NO: 3916899 - DNA, 15 bp, Homo sapiens
cagagccccactccc

SEQ ID NO: 3916900 - DNA, 23 bp, Homo sapiens
cagagccccactcccggccaggc

SEQ ID NO: 3916901 - DNA, 15 bp, Homo sapiens
cagagcccccaagcc

SEQ ID NO: 3916902 - DNA, 21 bp, Homo sapiens
cagagcccccaagcctctgcc

SEQ ID NO: 3916903 - DNA, 22 bp, Homo sapiens
cagagcccccaagcctctgccc

SEQ ID NO: 3916904 - DNA, 20 bp, Homo sapiens
cagagcccccaaggactctg

SEQ ID NO: 3916905 - DNA, 14 bp, Homo sapiens
cagagcccctccct

SEQ ID NO: 3916906 - DNA, 15 bp, Homo sapiens
cagagcctaagaaaa

SEQ ID NO: 3916907 - DNA, 18 bp, Homo sapiens
cagagcctagccacctcc

SEQ ID NO: 3916908 - DNA, 16 bp, Homo sapiens
cagagcctttggatga

SEQ ID NO: 3916909 - DNA, 19 bp, Homo sapiens
cagagcctttggatgacca

SEQ ID NO: 3916910 - DNA, 14 bp, Homo sapiens
cagagcgggagtga

SEQ ID NO: 3916911 - DNA, 15 bp, Homo sapiens
cagagcgggcctctt

SEQ ID NO: 3916912 - DNA, 23 bp, Homo sapiens
cagagcgggcctcttccctcagt

SEQ ID NO: 3916913 - DNA, 14 bp, Homo sapiens
cagagcggggaggt

SEQ ID NO: 3916914 - DNA, 15 bp, Homo sapiens
cagagctcttatgtg

SEQ ID NO: 3916915 - DNA, 18 bp, Homo sapiens
cagagctcttcaagctgt

SEQ ID NO: 3916916 - DNA, 20 bp, Homo sapiens
cagagctcttcaagctgtcc

SEQ ID NO: 3916917 - DNA, 13 bp, Homo sapiens
cagagctgaccca

SEQ ID NO: 3916918 - DNA, 19 bp, Homo sapiens
cagagctgatggagaagga

SEQ ID NO: 3916919 - DNA, 21 bp, Homo sapiens
cagagctgatggagaaggaag

SEQ ID NO: 3916920 - DNA, 14 bp, Homo sapiens
cagagctggaaggc

SEQ ID NO: 3916921 - DNA, 23 bp, Homo sapiens
cagagctgggaggcatggccctg

SEQ ID NO: 3916922 - DNA, 13 bp, Homo sapiens
cagagcttcccag

SEQ ID NO: 3916923 - DNA, 12 bp, Homo sapiens
cacagcctctcc

SEQ ID NO: 3916924 - DNA, 14 bp, Homo sapiens
cacagcctctccct

SEQ ID NO: 3916925 - DNA, 18 bp, Homo sapiens
cacagcgcgggcggaggc

SEQ ID NO: 3916926 - DNA, 20 bp, Homo sapiens
cacagcggggccccagggct

SEQ ID NO: 3916927 - DNA, 14 bp, Homo sapiens
cacagctcccaccc

SEQ ID NO: 3916928 - DNA, 17 bp, Homo sapiens
cacagctcccaccccac

SEQ ID NO: 3916929 - DNA, 12 bp, Homo sapiens
cacagctgcagc

SEQ ID NO: 3916930 - DNA, 19 bp, Homo sapiens
cacagctgcagctgggccc

SEQ ID NO: 3916931 - DNA, 20 bp, Homo sapiens
cacagctgctgaagaggcaa

SEQ ID NO: 3916932 - DNA, 23 bp, Homo sapiens
cacaggaaaccaacacccaaagc

SEQ ID NO: 3916933 - DNA, 14 bp, Homo sapiens
cacaggagcagaca

SEQ ID NO: 3916934 - DNA, 16 bp, Homo sapiens
cacaggagcagacaga

SEQ ID NO: 3916935 - DNA, 18 bp, Homo sapiens
cacaggagcagacagaga

SEQ ID NO: 3916936 - DNA, 20 bp, Homo sapiens
cacaggagcagacagagaaa

SEQ ID NO: 3916937 - DNA, 21 bp, Homo sapiens
cacaggagcagacagagaaat

SEQ ID NO: 3916938 - DNA, 23 bp, Homo sapiens
cacaggagggggtcgtggagagc

SEQ ID NO: 3916939 - DNA, 20 bp, Homo sapiens
cacaggatcctattctcacc

SEQ ID NO: 3916940 - DNA, 20 bp, Homo sapiens
cacaggcaaaatccttgctt

SEQ ID NO: 3916941 - DNA, 21 bp, Homo sapiens
cacaggcagctggatgagact

SEQ ID NO: 3916942 - DNA, 17 bp, Homo sapiens
cacaggcaggaagagag

SEQ ID NO: 3916943 - DNA, 15 bp, Homo sapiens
cacaggcatttcctg

SEQ ID NO: 3916944 - DNA, 23 bp, Homo sapiens
cacaggcatttcctgggtggcta

SEQ ID NO: 3916945 - DNA, 17 bp, Homo sapiens
cacaggcccttcctctc

SEQ ID NO: 3916946 - DNA, 18 bp, Homo sapiens
cacaggcctgtgtagctg

SEQ ID NO: 3916947 - DNA, 22 bp, Homo sapiens
cacagggccccagaaggcaggg

SEQ ID NO: 3916948 - DNA, 13 bp, Homo sapiens
cacagggctaaga

SEQ ID NO: 3916949 - DNA, 13 bp, Homo sapiens
cacagggctcttt

SEQ ID NO: 3916950 - DNA, 23 bp, Homo sapiens
cacagggctctttgatggaccca

SEQ ID NO: 3916951 - DNA, 22 bp, Homo sapiens
cacaggggcaaagaactgcccc

SEQ ID NO: 3916952 - DNA, 13 bp, Homo sapiens
cacaggggcaggc

SEQ ID NO: 3916953 - DNA, 14 bp, Homo sapiens
cacaggggcaggcc

SEQ ID NO: 3916954 - DNA, 18 bp, Homo sapiens
cacaggggcaggcctggg

SEQ ID NO: 3916955 - DNA, 13 bp, Homo sapiens
cacaggggcccca

SEQ ID NO: 3916956 - DNA, 15 bp, Homo sapiens
cacagggttttgtat

SEQ ID NO: 3916957 - DNA, 16 bp, Homo sapiens
cacaggtgtaaatata

SEQ ID NO: 3916958 - DNA, 15 bp, Homo sapiens
cacaggtgtttatac

SEQ ID NO: 3916959 - DNA, 14 bp, Homo sapiens
cacagtcctcacag

SEQ ID NO: 3916960 - DNA, 20 bp, Homo sapiens
cacagtcctcacagcctctc

SEQ ID NO: 3916961 - DNA, 11 bp, Homo sapiens
cacagtgctgc

SEQ ID NO: 3916962 - DNA, 12 bp, Homo sapiens
cacagtgctgct

SEQ ID NO: 3916963 - DNA, 13 bp, Homo sapiens
cacagtgctgctt

SEQ ID NO: 3916964 - DNA, 14 bp, Homo sapiens
cacagtgggaactc

SEQ ID NO: 3916965 - DNA, 18 bp, Homo sapiens
cacagtgggtggcacctc

SEQ ID NO: 3916966 - DNA, 20 bp, Homo sapiens
cacagtgggtggcacctcct

SEQ ID NO: 3916967 - DNA, 22 bp, Homo sapiens
cacagtgggtggcacctcctga

SEQ ID NO: 3916968 - DNA, 23 bp, Homo sapiens
cacagtgggtggcacctcctgag

SEQ ID NO: 3916969 - DNA, 20 bp, Homo sapiens
cacagttcctcgccctgggt

SEQ ID NO: 3916970 - DNA, 19 bp, Homo sapiens
cacagttcgacctgcggct

SEQ ID NO: 3916971 - DNA, 18 bp, Homo sapiens
cacagttcttggtgactg

SEQ ID NO: 3916972 - DNA, 22 bp, Homo sapiens
cacagttgtctattctgagcct

SEQ ID NO: 3916973 - DNA, 23 bp, Homo sapiens
cacagttgtctattctgagcctt

SEQ ID NO: 3916974 - DNA, 21 bp, Homo sapiens
cacagttttctgagaaagact

SEQ ID NO: 3916975 - DNA, 17 bp, Homo sapiens
cacagttttgaaagaaa

SEQ ID NO: 3916976 - DNA, 17 bp, Homo sapiens
cacatacaatttgcact

SEQ ID NO: 3916977 - DNA, 16 bp, Homo sapiens
cacatacatacacata

SEQ ID NO: 3916978 - DNA, 20 bp, Homo sapiens
cacatacatacacatacata

SEQ ID NO: 3916979 - DNA, 17 bp, Homo sapiens
cacatacatacatacat

SEQ ID NO: 3916980 - DNA, 20 bp, Homo sapiens
cacatagttctccagttgta

SEQ ID NO: 3916981 - DNA, 13 bp, Homo sapiens
cacatatacatat

SEQ ID NO: 3916982 - DNA, 14 bp, Homo sapiens
cacatatacatata

SEQ ID NO: 3916983 - DNA, 15 bp, Homo sapiens
cacatatacatatat

SEQ ID NO: 3916984 - DNA, 16 bp, Homo sapiens
cacatatacatatata

SEQ ID NO: 3916985 - DNA, 17 bp, Homo sapiens
cacatatacatatatat

SEQ ID NO: 3916986 - DNA, 18 bp, Homo sapiens
cacatatacatatatata

SEQ ID NO: 3916987 - DNA, 22 bp, Homo sapiens
cacatatacctataatgtgtgt

SEQ ID NO: 3916988 - DNA, 14 bp, Homo sapiens
cacatatggcacaa

SEQ ID NO: 3916989 - DNA, 15 bp, Homo sapiens
cacatatttgatagt

SEQ ID NO: 3916990 - DNA, 13 bp, Homo sapiens
cacatcagcttgc

SEQ ID NO: 3916991 - DNA, 22 bp, Homo sapiens
cacatcccaggcttcaccctga

SEQ ID NO: 3916992 - DNA, 19 bp, Homo sapiens
cacatcccggcctcttcca

SEQ ID NO: 3916993 - DNA, 20 bp, Homo sapiens
cacatcccggcctcttccac

SEQ ID NO: 3916994 - DNA, 15 bp, Homo sapiens
cacatctttcctgtc

SEQ ID NO: 3916995 - DNA, 13 bp, Homo sapiens
cacatgaggaggg

SEQ ID NO: 3916996 - DNA, 21 bp, Homo sapiens
cacatgcgtatatgtgcgtct

SEQ ID NO: 3916997 - DNA, 16 bp, Homo sapiens
cacatggacacagacc

SEQ ID NO: 3916998 - DNA, 22 bp, Homo sapiens
cacatggctatcctagagaggc

SEQ ID NO: 3916999 - DNA, 19 bp, Homo sapiens
cacatgtgtctgtgtggta

SEQ ID NO: 3917000 - DNA, 23 bp, Homo sapiens
cacatgtgttctctattttgcct

SEQ ID NO: 3917001 - DNA, 17 bp, Homo sapiens
cacattacttgcacaag

SEQ ID NO: 3917002 - DNA, 18 bp, Homo sapiens
cacattatgttagagagg

SEQ ID NO: 3917003 - DNA, 21 bp, Homo sapiens
cacattatgttagagaggtag

SEQ ID NO: 3917004 - DNA, 23 bp, Homo sapiens
cacattcctggccccgggctctg

SEQ ID NO: 3917005 - DNA, 23 bp, Homo sapiens
cacattcggaccctgcccatacc

SEQ ID NO: 3917006 - DNA, 14 bp, Homo sapiens
cacattggacttcc

SEQ ID NO: 3917007 - DNA, 17 bp, Homo sapiens
cacatttgatgtacatg

SEQ ID NO: 3917008 - DNA, 18 bp, Homo sapiens
cacatttgatgtacatgt

SEQ ID NO: 3917009 - DNA, 17 bp, Homo sapiens
caagttccagctggtct

SEQ ID NO: 3917010 - DNA, 16 bp, Homo sapiens
caagttcctgcactcc

SEQ ID NO: 3917011 - DNA, 18 bp, Homo sapiens
caagttcctgcactccag

SEQ ID NO: 3917012 - DNA, 13 bp, Homo sapiens
caagttctagaga

SEQ ID NO: 3917013 - DNA, 16 bp, Homo sapiens
caagttctagagaaga

SEQ ID NO: 3917014 - DNA, 18 bp, Homo sapiens
caagttctagagaagagg

SEQ ID NO: 3917015 - DNA, 19 bp, Homo sapiens
caagttctagagaagaggc

SEQ ID NO: 3917016 - DNA, 21 bp, Homo sapiens
caagttctagagaagaggctg

SEQ ID NO: 3917017 - DNA, 23 bp, Homo sapiens
caagttctagagaagaggctggt

SEQ ID NO: 3917018 - DNA, 15 bp, Homo sapiens
caagttgagaacaaa

SEQ ID NO: 3917019 - DNA, 23 bp, Homo sapiens
caagtttctagctagaaatatga

SEQ ID NO: 3917020 - DNA, 14 bp, Homo sapiens
caagttttgtataa

SEQ ID NO: 3917021 - DNA, 17 bp, Homo sapiens
caagttttgtataaata

SEQ ID NO: 3917022 - DNA, 19 bp, Homo sapiens
caagttttgtataaataat

SEQ ID NO: 3917023 - DNA, 17 bp, Homo sapiens
caagtttttctaacagt

SEQ ID NO: 3917024 - DNA, 19 bp, Homo sapiens
caataaaaaaaagaaatga

SEQ ID NO: 3917025 - DNA, 12 bp, Homo sapiens
caataaaacatt

SEQ ID NO: 3917026 - DNA, 18 bp, Homo sapiens
caataaaagtgactctca

SEQ ID NO: 3917027 - DNA, 13 bp, Homo sapiens
caataaaatagta

SEQ ID NO: 3917028 - DNA, 17 bp, Homo sapiens
caataaaatagtattga

SEQ ID NO: 3917029 - DNA, 12 bp, Homo sapiens
caataaagagct

SEQ ID NO: 3917030 - DNA, 14 bp, Homo sapiens
caataaagagctca

SEQ ID NO: 3917031 - DNA, 15 bp, Homo sapiens
caataaagctgctga

SEQ ID NO: 3917032 - DNA, 13 bp, Homo sapiens
caataaagctgga

SEQ ID NO: 3917033 - DNA, 19 bp, Homo sapiens
caataaagctggacaagaa

SEQ ID NO: 3917034 - DNA, 22 bp, Homo sapiens
caataaagctggacaagaagct

SEQ ID NO: 3917035 - DNA, 13 bp, Homo sapiens
caataaatgctga

SEQ ID NO: 3917036 - DNA, 17 bp, Homo sapiens
caataaatgtgcttatg

SEQ ID NO: 3917037 - DNA, 17 bp, Homo sapiens
caataatgtgcaaattt

SEQ ID NO: 3917038 - DNA, 18 bp, Homo sapiens
caatacaacaagaacaac

SEQ ID NO: 3917039 - DNA, 22 bp, Homo sapiens
caatacacataagaccgtgtcc

SEQ ID NO: 3917040 - DNA, 17 bp, Homo sapiens
caataccagatcactca

SEQ ID NO: 3917041 - DNA, 17 bp, Homo sapiens
caatactaattgagaaa

SEQ ID NO: 3917042 - DNA, 15 bp, Homo sapiens
caatagctattgcat

SEQ ID NO: 3917043 - DNA, 21 bp, Homo sapiens
caatagctattgcatgtaaaa

SEQ ID NO: 3917044 - DNA, 17 bp, Homo sapiens
caatagtccccatcagc

SEQ ID NO: 3917045 - DNA, 16 bp, Homo sapiens
caatagtttgcataga

SEQ ID NO: 3917046 - DNA, 16 bp, Homo sapiens
caatatataaaaatat

SEQ ID NO: 3917047 - DNA, 21 bp, Homo sapiens
caatatgtaaatagtgcagaa

SEQ ID NO: 3917048 - DNA, 15 bp, Homo sapiens
caatattaaatacag

SEQ ID NO: 3917049 - DNA, 20 bp, Homo sapiens
caatattaaatacagacact

SEQ ID NO: 3917050 - DNA, 13 bp, Homo sapiens
caatattcaaatg

SEQ ID NO: 3917051 - DNA, 14 bp, Homo sapiens
caatattcaataaa

SEQ ID NO: 3917052 - DNA, 20 bp, Homo sapiens
caatatttaagtttgttgct

SEQ ID NO: 3917053 - DNA, 16 bp, Homo sapiens
caatatttactcatca

SEQ ID NO: 3917054 - DNA, 17 bp, Homo sapiens
caatcagcactgaaaat

SEQ ID NO: 3917055 - DNA, 19 bp, Homo sapiens
caatcatctgtgtgaaaat

SEQ ID NO: 3917056 - DNA, 20 bp, Homo sapiens
caatcatctgtgtgaaaatg

SEQ ID NO: 3917057 - DNA, 15 bp, Homo sapiens
caatcatgagtcaga

SEQ ID NO: 3917058 - DNA, 16 bp, Homo sapiens
caatccactctcagga

SEQ ID NO: 3917059 - DNA, 22 bp, Homo sapiens
caatccatgttagtttttactt

SEQ ID NO: 3917060 - DNA, 17 bp, Homo sapiens
caatcccaccaaccctc

SEQ ID NO: 3917061 - DNA, 22 bp, Homo sapiens
caatcccctcattcaggaaaac

SEQ ID NO: 3917062 - DNA, 15 bp, Homo sapiens
caatcccgtgaaaga

SEQ ID NO: 3917063 - DNA, 18 bp, Homo sapiens
caatcctagaaccaagct

SEQ ID NO: 3917064 - DNA, 21 bp, Homo sapiens
caatcctagaaccaagcttca

SEQ ID NO: 3917065 - DNA, 20 bp, Homo sapiens
caatcctgcccccagccatg

SEQ ID NO: 3917066 - DNA, 12 bp, Homo sapiens
caatcctttcca

SEQ ID NO: 3917067 - DNA, 19 bp, Homo sapiens
caatctccagggctgcccc

SEQ ID NO: 3917068 - DNA, 20 bp, Homo sapiens
caatctccagggctgcccct

SEQ ID NO: 3917069 - DNA, 18 bp, Homo sapiens
caatctttccttgtctct

SEQ ID NO: 3917070 - DNA, 22 bp, Homo sapiens
caatgaaatacacaagtaaaca

SEQ ID NO: 3917071 - DNA, 21 bp, Homo sapiens
caatgaaatgctctcctttcc

SEQ ID NO: 3917072 - DNA, 13 bp, Homo sapiens
caatgatggcaat

SEQ ID NO: 3917073 - DNA, 20 bp, Homo sapiens
caatgatgtgagtacccagg

SEQ ID NO: 3917074 - DNA, 15 bp, Homo sapiens
caatgattcataaca

SEQ ID NO: 3917075 - DNA, 14 bp, Homo sapiens
caatgcacatccat

SEQ ID NO: 3917076 - DNA, 13 bp, Homo sapiens
caatgccctgcca

SEQ ID NO: 3917077 - DNA, 13 bp, Homo sapiens
caatgcctctccc

SEQ ID NO: 3917078 - DNA, 15 bp, Homo sapiens
caatgcctctcccac

SEQ ID NO: 3917079 - DNA, 21 bp, Homo sapiens
caatgccttgacaacagactg

SEQ ID NO: 3917080 - DNA, 23 bp, Homo sapiens
caatgccttgacaacagactgaa

SEQ ID NO: 3917081 - DNA, 14 bp, Homo sapiens
caatgcgtgttgta

SEQ ID NO: 3917082 - DNA, 20 bp, Homo sapiens
caatgctattgaaattactg

SEQ ID NO: 3917083 - DNA, 20 bp, Homo sapiens
caatgctttgggaggccaag

SEQ ID NO: 3917084 - DNA, 13 bp, Homo sapiens
caatggaaacaat

SEQ ID NO: 3917085 - DNA, 19 bp, Homo sapiens
caatggaaacagggcagtg

SEQ ID NO: 3917086 - DNA, 20 bp, Homo sapiens
caatggcagctagactggag

SEQ ID NO: 3917087 - DNA, 23 bp, Homo sapiens
caatggcagctagactggagtga

SEQ ID NO: 3917088 - DNA, 23 bp, Homo sapiens
caatggctaattcccagagtgtg

SEQ ID NO: 3917089 - DNA, 18 bp, Homo sapiens
caatgggagggggctcca

SEQ ID NO: 3917090 - DNA, 21 bp, Homo sapiens
caatgggagggggctccatgg

SEQ ID NO: 3917091 - DNA, 24 bp, Homo sapiens
caatgggagggggctccatggagg

SEQ ID NO: 3917092 - DNA, 17 bp, Homo sapiens
caatgtacccaccgggc

SEQ ID NO: 3917093 - DNA, 19 bp, Homo sapiens
caatgtacccaccgggcca

SEQ ID NO: 3917094 - DNA, 17 bp, Homo sapiens
caatgtagaaagctttg

SEQ ID NO: 3917095 - DNA, 14 bp, Homo sapiens
cacacacagatatg

SEQ ID NO: 3917096 - DNA, 19 bp, Homo sapiens
cacacacagatatgcacac

SEQ ID NO: 3917097 - DNA, 14 bp, Homo sapiens
cacacacagctcct

SEQ ID NO: 3917098 - DNA, 13 bp, Homo sapiens
cacacacatagat

SEQ ID NO: 3917099 - DNA, 14 bp, Homo sapiens
cacacacctcacca

SEQ ID NO: 3917100 - DNA, 15 bp, Homo sapiens
cacacacggatgcac

SEQ ID NO: 3917101 - DNA, 24 bp, Homo sapiens
cacacacggatgcacacacagatg

SEQ ID NO: 3917102 - DNA, 13 bp, Homo sapiens
cacacagctcctc

SEQ ID NO: 3917103 - DNA, 10 bp, Homo sapiens
cacacaggca

SEQ ID NO: 3917104 - DNA, 16 bp, Homo sapiens
cacacaggcatttcct

SEQ ID NO: 3917105 - DNA, 17 bp, Homo sapiens
cacacaggcatttcctg

SEQ ID NO: 3917106 - DNA, 18 bp, Homo sapiens
cacacaggcatttcctgg

SEQ ID NO: 3917107 - DNA, 19 bp, Homo sapiens
cacacaggcatttcctggg

SEQ ID NO: 3917108 - DNA, 18 bp, Homo sapiens
cacacagtctcagtccag

SEQ ID NO: 3917109 - DNA, 17 bp, Homo sapiens
cacacatatacatatat

SEQ ID NO: 3917110 - DNA, 15 bp, Homo sapiens
cacacatggatgcac

SEQ ID NO: 3917111 - DNA, 18 bp, Homo sapiens
cacacatggctaattttt

SEQ ID NO: 3917112 - DNA, 15 bp, Homo sapiens
cacaccaatgcgcac

SEQ ID NO: 3917113 - DNA, 16 bp, Homo sapiens
cacaccactgccctgc

SEQ ID NO: 3917114 - DNA, 14 bp, Homo sapiens
cacaccatcaccct

SEQ ID NO: 3917115 - DNA, 13 bp, Homo sapiens
cacaccccaaggg

SEQ ID NO: 3917116 - DNA, 18 bp, Homo sapiens
cacaccccaagggacaac

SEQ ID NO: 3917117 - DNA, 13 bp, Homo sapiens
cacaccccagcgc

SEQ ID NO: 3917118 - DNA, 23 bp, Homo sapiens
cacaccccagcgcctgtgctgag

SEQ ID NO: 3917119 - DNA, 18 bp, Homo sapiens
cacaccccatctctcttc

SEQ ID NO: 3917120 - DNA, 15 bp, Homo sapiens
catctgagcaagagc

SEQ ID NO: 3917121 - DNA, 15 bp, Homo sapiens
catctgcagctcttt

SEQ ID NO: 3917122 - DNA, 15 bp, Homo sapiens
catctgggattccca

SEQ ID NO: 3917123 - DNA, 15 bp, Homo sapiens
catctgggtccttgc

SEQ ID NO: 3917124 - DNA, 17 bp, Homo sapiens
catctgtccctgcctca

SEQ ID NO: 3917125 - DNA, 12 bp, Homo sapiens
catcttaaatga

SEQ ID NO: 3917126 - DNA, 15 bp, Homo sapiens
catcttaaatgacag

SEQ ID NO: 3917127 - DNA, 16 bp, Homo sapiens
catcttaaatgacagt

SEQ ID NO: 3917128 - DNA, 14 bp, Homo sapiens
catcttcagctccc

SEQ ID NO: 3917129 - DNA, 16 bp, Homo sapiens
catcttctccatctgg

SEQ ID NO: 3917130 - DNA, 17 bp, Homo sapiens
catcttctccatctggc

SEQ ID NO: 3917131 - DNA, 22 bp, Homo sapiens
catcttctggagtctccagtgg

SEQ ID NO: 3917132 - DNA, 12 bp, Homo sapiens
catcttctggct

SEQ ID NO: 3917133 - DNA, 13 bp, Homo sapiens
catcttctggctt

SEQ ID NO: 3917134 - DNA, 17 bp, Homo sapiens
catcttctggcttgact

SEQ ID NO: 3917135 - DNA, 12 bp, Homo sapiens
catcttgccccc

SEQ ID NO: 3917136 - DNA, 13 bp, Homo sapiens
catcttgccccct

SEQ ID NO: 3917137 - DNA, 20 bp, Homo sapiens
catcttgccccctcatctca

SEQ ID NO: 3917138 - DNA, 21 bp, Homo sapiens
catctttcctccaaactcctg

SEQ ID NO: 3917139 - DNA, 13 bp, Homo sapiens
catctttcctgtc

SEQ ID NO: 3917140 - DNA, 23 bp, Homo sapiens
catctttcttctattttattccc

SEQ ID NO: 3917141 - DNA, 13 bp, Homo sapiens
catcttttctaat

SEQ ID NO: 3917142 - DNA, 21 bp, Homo sapiens
catgaaaaacacggcagctgt

SEQ ID NO: 3917143 - DNA, 22 bp, Homo sapiens
catgaaaaacacggcagctgta

SEQ ID NO: 3917144 - DNA, 19 bp, Homo sapiens
catgaaaattatctccctt

SEQ ID NO: 3917145 - DNA, 13 bp, Homo sapiens
catgaacacagct

SEQ ID NO: 3917146 - DNA, 15 bp, Homo sapiens
catgaagacacgctt

SEQ ID NO: 3917147 - DNA, 12 bp, Homo sapiens
catgacaaagtt

SEQ ID NO: 3917148 - DNA, 12 bp, Homo sapiens
catgacactgac

SEQ ID NO: 3917149 - DNA, 13 bp, Homo sapiens
catgacactgacc

SEQ ID NO: 3917150 - DNA, 16 bp, Homo sapiens
catgacatgttatata

SEQ ID NO: 3917151 - DNA, 12 bp, Homo sapiens
catgaccagcaa

SEQ ID NO: 3917152 - DNA, 13 bp, Homo sapiens
catgacctccagc

SEQ ID NO: 3917153 - DNA, 14 bp, Homo sapiens
catgacctccagct

SEQ ID NO: 3917154 - DNA, 17 bp, Homo sapiens
catgacctccagctttc

SEQ ID NO: 3917155 - DNA, 14 bp, Homo sapiens
catgactatttcca

SEQ ID NO: 3917156 - DNA, 23 bp, Homo sapiens
catgactcgtatatgtctcaggt

SEQ ID NO: 3917157 - DNA, 17 bp, Homo sapiens
catgagaaaatcagtaa

SEQ ID NO: 3917158 - DNA, 14 bp, Homo sapiens
catgagaagagggc

SEQ ID NO: 3917159 - DNA, 15 bp, Homo sapiens
catgagaagagggcc

SEQ ID NO: 3917160 - DNA, 18 bp, Homo sapiens
catgagaagagggcctgt

SEQ ID NO: 3917161 - DNA, 15 bp, Homo sapiens
catgaggagttgctg

SEQ ID NO: 3917162 - DNA, 16 bp, Homo sapiens
catgaggagttgctgt

SEQ ID NO: 3917163 - DNA, 17 bp, Homo sapiens
catgagtggatggatgg

SEQ ID NO: 3917164 - DNA, 21 bp, Homo sapiens
catgagtggatggatggacag

SEQ ID NO: 3917165 - DNA, 14 bp, Homo sapiens
catgatacccctta

SEQ ID NO: 3917166 - DNA, 20 bp, Homo sapiens
catgatctccctgccgcctc

SEQ ID NO: 3917167 - DNA, 23 bp, Homo sapiens
catgatctgtatttaatggtttt

SEQ ID NO: 3917168 - DNA, 21 bp, Homo sapiens
catgattcatgccaattagca

SEQ ID NO: 3917169 - DNA, 21 bp, Homo sapiens
catgattggtttctaggcagt

SEQ ID NO: 3917170 - DNA, 20 bp, Homo sapiens
catgatttacagagaagtga

SEQ ID NO: 3917171 - DNA, 18 bp, Homo sapiens
catgatttagggaagcag

SEQ ID NO: 3917172 - DNA, 20 bp, Homo sapiens
catgatttagggaagcaggg

SEQ ID NO: 3917173 - DNA, 21 bp, Homo sapiens
catgatttagggaagcaggga

SEQ ID NO: 3917174 - DNA, 15 bp, Homo sapiens
catgatttatatatg

SEQ ID NO: 3917175 - DNA, 20 bp, Homo sapiens
catgatttatatatggcata

SEQ ID NO: 3917176 - DNA, 12 bp, Homo sapiens
catgattttaca

SEQ ID NO: 3917177 - DNA, 15 bp, Homo sapiens
catgattttatacat

SEQ ID NO: 3917178 - DNA, 18 bp, Homo sapiens
catgattttatacatagt

SEQ ID NO: 3917179 - DNA, 20 bp, Homo sapiens
catgattttatacatagtca

SEQ ID NO: 3917180 - DNA, 17 bp, Homo sapiens
catgcaagtgctatgcc

SEQ ID NO: 3917181 - DNA, 17 bp, Homo sapiens
catgcacacaaacacct

SEQ ID NO: 3917182 - DNA, 14 bp, Homo sapiens
catgcacagctgct

SEQ ID NO: 3917183 - DNA, 16 bp, Homo sapiens
catgcacagctgcttg

SEQ ID NO: 3917184 - DNA, 13 bp, Homo sapiens
catgcacatttat

SEQ ID NO: 3917185 - DNA, 12 bp, Homo sapiens
catgcactgacc

SEQ ID NO: 3917186 - DNA, 18 bp, Homo sapiens
catgcagactcctcagat

SEQ ID NO: 3917187 - DNA, 22 bp, Homo sapiens
catgcagcctaaggctgtatga

SEQ ID NO: 3917188 - DNA, 12 bp, Homo sapiens
catgccaccctc

SEQ ID NO: 3917189 - DNA, 19 bp, Homo sapiens
catgccaccctctccatgc

SEQ ID NO: 3917190 - DNA, 20 bp, Homo sapiens
catgccactgccaggcacct

SEQ ID NO: 3917191 - DNA, 22 bp, Homo sapiens
catgccagggattgaggaggac

SEQ ID NO: 3917192 - DNA, 18 bp, Homo sapiens
catgccatttgtactgac

SEQ ID NO: 3917193 - DNA, 19 bp, Homo sapiens
catgccatttgtactgacc

SEQ ID NO: 3917194 - DNA, 13 bp, Homo sapiens
catgcccaaccta

SEQ ID NO: 3917195 - DNA, 20 bp, Homo sapiens
catgccgcggtaggtaaggg

SEQ ID NO: 3917196 - DNA, 16 bp, Homo sapiens
catgcctcaagaacac

SEQ ID NO: 3917197 - DNA, 13 bp, Homo sapiens
catgcctcagttt

SEQ ID NO: 3917198 - DNA, 13 bp, Homo sapiens
catgcctcatgcc

SEQ ID NO: 3917199 - DNA, 14 bp, Homo sapiens
catgcctcatgcca

SEQ ID NO: 3917200 - DNA, 14 bp, Homo sapiens
catgcctctgaggc

SEQ ID NO: 3917201 - DNA, 17 bp, Homo sapiens
catgcctctgaggccag

SEQ ID NO: 3917202 - DNA, 18 bp, Homo sapiens
catgcctctgaggccagc

SEQ ID NO: 3917203 - DNA, 20 bp, Homo sapiens
catgcctctgaggccagcct

SEQ ID NO: 3917204 - DNA, 12 bp, Homo sapiens
catgcctctgat

SEQ ID NO: 3917205 - DNA, 11 bp, Homo sapiens
catgcctgagg

SEQ ID NO: 3917206 - DNA, 20 bp, Homo sapiens
catgcctgagggtggagact

SEQ ID NO: 3917207 - DNA, 17 bp, Homo sapiens
catgcctggcccccctc

SEQ ID NO: 3917208 - DNA, 18 bp, Homo sapiens
catgcctggcccccctcc

SEQ ID NO: 3917209 - DNA, 23 bp, Homo sapiens
catgctcagccctgactggtgct

SEQ ID NO: 3917210 - DNA, 13 bp, Homo sapiens
catgctctctgca

SEQ ID NO: 3917211 - DNA, 16 bp, Homo sapiens
catgctctctgcagcc

SEQ ID NO: 3917212 - DNA, 12 bp, Homo sapiens
catgctctgccc

SEQ ID NO: 3917213 - DNA, 22 bp, Homo sapiens
catgctctgccccaagccccca

SEQ ID NO: 3917214 - DNA, 17 bp, Homo sapiens
catgctctggaagcctg

SEQ ID NO: 3917215 - DNA, 19 bp, Homo sapiens
catgctgaagggaccttga

SEQ ID NO: 3917216 - DNA, 21 bp, Homo sapiens
catgctgctttttggcacagt

SEQ ID NO: 3917217 - DNA, 20 bp, Homo sapiens
catgctggcctcccaataaa

SEQ ID NO: 3917218 - DNA, 13 bp, Homo sapiens
catgctgtgctct

SEQ ID NO: 3917219 - DNA, 22 bp, Homo sapiens
catgctgtgctctttgaagaga

SEQ ID NO: 3917220 - DNA, 14 bp, Homo sapiens
catgctttaaagtg

SEQ ID NO: 3917221 - DNA, 15 bp, Homo sapiens
catgctttaaagtgt

SEQ ID NO: 3917222 - DNA, 20 bp, Homo sapiens
catgctttcctaaagtctct

SEQ ID NO: 3917223 - DNA, 14 bp, Homo sapiens
catgctttctcctt

SEQ ID NO: 3917224 - DNA, 15 bp, Homo sapiens
catgctttctccttt

SEQ ID NO: 3917225 - DNA, 16 bp, Homo sapiens
catgctttctcctttt

SEQ ID NO: 3917226 - DNA, 17 bp, Homo sapiens
catgctttctccttttt

SEQ ID NO: 3917227 - DNA, 15 bp, Homo sapiens
catggaaaagcccag

SEQ ID NO: 3917228 - DNA, 16 bp, Homo sapiens
catggaaaagcccagt

SEQ ID NO: 3917229 - DNA, 17 bp, Homo sapiens
catggaaaagcccagtg

SEQ ID NO: 3917230 - DNA, 21 bp, Homo sapiens
catggaaaatgtcctgtggtg

SEQ ID NO: 3917231 - DNA, 18 bp, Homo sapiens
catggaaacctgaaaaaa

SEQ ID NO: 3917232 - DNA, 23 bp, Homo sapiens
catggacaccccttatccaggac

SEQ ID NO: 3917233 - DNA, 11 bp, Homo sapiens
catggagaaac

SEQ ID NO: 3917234 - DNA, 19 bp, Homo sapiens
catggagactcctgccctg

SEQ ID NO: 3917235 - DNA, 13 bp, Homo sapiens
catggagctgagg

SEQ ID NO: 3917236 - DNA, 20 bp, Homo sapiens
catggaggcaggctccccct

SEQ ID NO: 3917237 - DNA, 23 bp, Homo sapiens
catggagtgagcagtagaagcct

SEQ ID NO: 3917238 - DNA, 15 bp, Homo sapiens
catggatgagagtcc

SEQ ID NO: 3917239 - DNA, 13 bp, Homo sapiens
catggatgcacac

SEQ ID NO: 3917240 - DNA, 22 bp, Homo sapiens
catggcaccagccccctggatg

SEQ ID NO: 3917241 - DNA, 19 bp, Homo sapiens
catggcagatgtaggaggg

SEQ ID NO: 3917242 - DNA, 12 bp, Homo sapiens
catggccacccc

SEQ ID NO: 3917243 - DNA, 23 bp, Homo sapiens
catggcgtaatgggcctgcccaa

SEQ ID NO: 3917244 - DNA, 16 bp, Homo sapiens
catggctaactggcga

SEQ ID NO: 3917245 - DNA, 20 bp, Homo sapiens
catggctatcctagagaggc

SEQ ID NO: 3917246 - DNA, 17 bp, Homo sapiens
catggctcaggcaagcc

SEQ ID NO: 3917247 - DNA, 17 bp, Homo sapiens
catggcttaatgtttat

SEQ ID NO: 3917248 - DNA, 14 bp, Homo sapiens
catggcttggggag

SEQ ID NO: 3917249 - DNA, 18 bp, Homo sapiens
catggcttggggagcaga

SEQ ID NO: 3917250 - DNA, 21 bp, Homo sapiens
catgggaaaggaggcatgcct

SEQ ID NO: 3917251 - DNA, 13 bp, Homo sapiens
catgggagggagg

SEQ ID NO: 3917252 - DNA, 17 bp, Homo sapiens
catgggcccaggaatgc

SEQ ID NO: 3917253 - DNA, 19 bp, Homo sapiens
catgggcctgggcctgctt

SEQ ID NO: 3917254 - DNA, 23 bp, Homo sapiens
catgggctagtgtgagtggcagc

SEQ ID NO: 3917255 - DNA, 13 bp, Homo sapiens
catgggcttggac

SEQ ID NO: 3917256 - DNA, 13 bp, Homo sapiens
catggggcataga

SEQ ID NO: 3917257 - DNA, 22 bp, Homo sapiens
catggggcatagaaactgagga

SEQ ID NO: 3917258 - DNA, 18 bp, Homo sapiens
catgggtgtcagctttgc

SEQ ID NO: 3917259 - DNA, 16 bp, Homo sapiens
catggtcccacatccc

SEQ ID NO: 3917260 - DNA, 18 bp, Homo sapiens
catggtcccacatccctg

SEQ ID NO: 3917261 - DNA, 22 bp, Homo sapiens
catggtctctcgggccccccac

SEQ ID NO: 3917262 - DNA, 14 bp, Homo sapiens
catggtgacacaca

SEQ ID NO: 3917263 - DNA, 21 bp, Homo sapiens
catggtgacacacagcagcac

SEQ ID NO: 3917264 - DNA, 20 bp, Homo sapiens
catggtggcgcaagcctgta

SEQ ID NO: 3917265 - DNA, 16 bp, Homo sapiens
catggtgtccagacag

SEQ ID NO: 3917266 - DNA, 14 bp, Homo sapiens
catgtaaaagagtc

SEQ ID NO: 3917267 - DNA, 13 bp, Homo sapiens
catgtaaaatgca

SEQ ID NO: 3917268 - DNA, 19 bp, Homo sapiens
catgtaaggaagggactga

SEQ ID NO: 3917269 - DNA, 13 bp, Homo sapiens
catgtactccaga

SEQ ID NO: 3917270 - DNA, 15 bp, Homo sapiens
catgtacttcctgtg

SEQ ID NO: 3917271 - DNA, 17 bp, Homo sapiens
catgtacttcctgtgta

SEQ ID NO: 3917272 - DNA, 14 bp, Homo sapiens
catgtagctgagtt

SEQ ID NO: 3917273 - DNA, 14 bp, Homo sapiens
catgtagttttaac

SEQ ID NO: 3917274 - DNA, 17 bp, Homo sapiens
catgtatgtgcacatgt

SEQ ID NO: 3917275 - DNA, 17 bp, Homo sapiens
catgtattatcacatca

SEQ ID NO: 3917276 - DNA, 12 bp, Homo sapiens
catgtcacctca

SEQ ID NO: 3917277 - DNA, 16 bp, Homo sapiens
catgtcacctcagctg

SEQ ID NO: 3917278 - DNA, 14 bp, Homo sapiens
catgtcctatgtgt

SEQ ID NO: 3917279 - DNA, 16 bp, Homo sapiens
catgtcctatgtgtga

SEQ ID NO: 3917280 - DNA, 14 bp, Homo sapiens
catgtcgcctctgc

SEQ ID NO: 3917281 - DNA, 15 bp, Homo sapiens
catgtcgcctctgca

SEQ ID NO: 3917282 - DNA, 20 bp, Homo sapiens
catgtcggagtagaaattgt

SEQ ID NO: 3917283 - DNA, 22 bp, Homo sapiens
catgtgaaaaggcaaaaagcat

SEQ ID NO: 3917284 - DNA, 19 bp, Homo sapiens
catgtgaattctgtgaaga

SEQ ID NO: 3917285 - DNA, 22 bp, Homo sapiens
catgtgaattctgtgaagaatg

SEQ ID NO: 3917286 - DNA, 22 bp, Homo sapiens
catgtgaggactgggggcacct

SEQ ID NO: 3917287 - DNA, 12 bp, Homo sapiens
catgtgatcctt

SEQ ID NO: 3917288 - DNA, 21 bp, Homo sapiens
catgtgcatggaaatgtcctc

SEQ ID NO: 3917289 - DNA, 17 bp, Homo sapiens
catgtggaatataaaga

SEQ ID NO: 3917290 - DNA, 13 bp, Homo sapiens
catgtggagtgga

SEQ ID NO: 3917291 - DNA, 11 bp, Homo sapiens
catgtggctga

SEQ ID NO: 3917292 - DNA, 15 bp, Homo sapiens
catgtggtttataga

SEQ ID NO: 3917293 - DNA, 15 bp, Homo sapiens
catgtgtcccctcac

SEQ ID NO: 3917294 - DNA, 12 bp, Homo sapiens
catgtgtgcatg

SEQ ID NO: 3917295 - DNA, 13 bp, Homo sapiens
catgtgtgcatgt

SEQ ID NO: 3917296 - DNA, 15 bp, Homo sapiens
catgtgtgcatgtga

SEQ ID NO: 3917297 - DNA, 18 bp, Homo sapiens
catgtgtgcatgtgagca

SEQ ID NO: 3917298 - DNA, 13 bp, Homo sapiens
catgtgtgcctgt

SEQ ID NO: 3917299 - DNA, 16 bp, Homo sapiens
catgtgtgcctgtggc

SEQ ID NO: 3917300 - DNA, 18 bp, Homo sapiens
catgtgtggatgtgtaaa

SEQ ID NO: 3917301 - DNA, 14 bp, Homo sapiens
catgtgtgtatata

SEQ ID NO: 3917302 - DNA, 13 bp, Homo sapiens
catgtgtgtgtct

SEQ ID NO: 3917303 - DNA, 16 bp, Homo sapiens
catgtgtgtgtctgtc

SEQ ID NO: 3917304 - DNA, 18 bp, Homo sapiens
catgtgtgtgtctgtctt

SEQ ID NO: 3917305 - DNA, 14 bp, Homo sapiens
catgtgttgaaaaa

SEQ ID NO: 3917306 - DNA, 15 bp, Homo sapiens
catgtgttgtacaat

SEQ ID NO: 3917307 - DNA, 14 bp, Homo sapiens
catgttaggaaaat

SEQ ID NO: 3917308 - DNA, 13 bp, Homo sapiens
catgttatatatt

SEQ ID NO: 3917309 - DNA, 20 bp, Homo sapiens
catgttatatattttttgta

SEQ ID NO: 3917310 - DNA, 17 bp, Homo sapiens
catgttccctttaaaat

SEQ ID NO: 3917311 - DNA, 14 bp, Homo sapiens
catgttggccaggc

SEQ ID NO: 3917312 - DNA, 19 bp, Homo sapiens
catgtttaaattgtaaatt

SEQ ID NO: 3917313 - DNA, 15 bp, Homo sapiens
catgtttacagaact

SEQ ID NO: 3917314 - DNA, 19 bp, Homo sapiens
catgtttacttttcagggc

SEQ ID NO: 3917315 - DNA, 16 bp, Homo sapiens
catgtttgagctcaga

SEQ ID NO: 3917316 - DNA, 13 bp, Homo sapiens
catgtttgtaaat

SEQ ID NO: 3917317 - DNA, 20 bp, Homo sapiens
cattaaattggaattttctt

SEQ ID NO: 3917318 - DNA, 12 bp, Homo sapiens
cattaaatttct

SEQ ID NO: 3917319 - DNA, 17 bp, Homo sapiens
cattaacttagcatgtg

SEQ ID NO: 3917320 - DNA, 16 bp, Homo sapiens
cattaatatttgctga

SEQ ID NO: 3917321 - DNA, 18 bp, Homo sapiens
cattaatcaatcatctgt

SEQ ID NO: 3917322 - DNA, 22 bp, Homo sapiens
cattaatcaatcatctgtgtga

SEQ ID NO: 3917323 - DNA, 23 bp, Homo sapiens
cattaatcaatcatctgtgtgaa

SEQ ID NO: 3917324 - DNA, 16 bp, Homo sapiens
cattaatcaccaaagt

SEQ ID NO: 3917325 - DNA, 15 bp, Homo sapiens
cattaattattaata

SEQ ID NO: 3917326 - DNA, 20 bp, Homo sapiens
cattaattattattgctgtt

SEQ ID NO: 3917327 - DNA, 13 bp, Homo sapiens
cattacaatggaa

SEQ ID NO: 3917328 - DNA, 15 bp, Homo sapiens
cattacatggctgtg

SEQ ID NO: 3917329 - DNA, 11 bp, Homo sapiens
cattacatgtt

SEQ ID NO: 3917330 - DNA, 14 bp, Homo sapiens
cattacatgtttaa

SEQ ID NO: 3917331 - DNA, 15 bp, Homo sapiens
cattacatgtttaaa

SEQ ID NO: 3917332 - DNA, 14 bp, Homo sapiens
cattacttgcacaa

SEQ ID NO: 3917333 - DNA, 15 bp, Homo sapiens
cattacttgcacaag

SEQ ID NO: 3917334 - DNA, 18 bp, Homo sapiens
cattagcagtttgctttg

SEQ ID NO: 3917335 - DNA, 13 bp, Homo sapiens
cattatctcaaaa

SEQ ID NO: 3917336 - DNA, 20 bp, Homo sapiens
cattatgtgtgcatgtgtgt

SEQ ID NO: 3917337 - DNA, 16 bp, Homo sapiens
cattatgttagagagg

SEQ ID NO: 3917338 - DNA, 15 bp, Homo sapiens
cattatttaatgttt

SEQ ID NO: 3917339 - DNA, 23 bp, Homo sapiens
cattcaactttagtatttttact

SEQ ID NO: 3917340 - DNA, 17 bp, Homo sapiens
cattcaagcctgtgaat

SEQ ID NO: 3917341 - DNA, 18 bp, Homo sapiens
cattcaagcctgtgaata

SEQ ID NO: 3917342 - DNA, 17 bp, Homo sapiens
cattcacatttgatgta

SEQ ID NO: 3917343 - DNA, 19 bp, Homo sapiens
cattcacatttgatgtaca

SEQ ID NO: 3917344 - DNA, 19 bp, Homo sapiens
cattcagcacaccccaagg

SEQ ID NO: 3917345 - DNA, 13 bp, Homo sapiens
cattcaggaaaac

SEQ ID NO: 3917346 - DNA, 17 bp, Homo sapiens
cattcaggaagatgaaa

SEQ ID NO: 3917347 - DNA, 23 bp, Homo sapiens
cattcaggaccccaacccctctc

SEQ ID NO: 3917348 - DNA, 18 bp, Homo sapiens
cattcaggtgttctcttc

SEQ ID NO: 3917349 - DNA, 14 bp, Homo sapiens
cattcagtgagaca

SEQ ID NO: 3917350 - DNA, 16 bp, Homo sapiens
cattcagtgagacaca

SEQ ID NO: 3917351 - DNA, 20 bp, Homo sapiens
cattcagtgagacacagagt

SEQ ID NO: 3917352 - DNA, 23 bp, Homo sapiens
cattcatccagttgcaataaaat

SEQ ID NO: 3917353 - DNA, 21 bp, Homo sapiens
cattcatgccaaagcaaaaga

SEQ ID NO: 3917354 - DNA, 20 bp, Homo sapiens
cattccaagtcaacactctt

SEQ ID NO: 3917355 - DNA, 22 bp, Homo sapiens
cattccaccttcccatgccctg

SEQ ID NO: 3917356 - DNA, 11 bp, Homo sapiens
cattccatgat

SEQ ID NO: 3917357 - DNA, 13 bp, Homo sapiens
cattccatgattt

SEQ ID NO: 3917358 - DNA, 14 bp, Homo sapiens
cattccatgatttt

SEQ ID NO: 3917359 - DNA, 16 bp, Homo sapiens
cattccatgattttac

SEQ ID NO: 3917360 - DNA, 20 bp, Homo sapiens
cattcccactaagctttctc

SEQ ID NO: 3917361 - DNA, 23 bp, Homo sapiens
cattcccactaagctttctcctt

SEQ ID NO: 3917362 - DNA, 12 bp, Homo sapiens
cattcccagcgt

SEQ ID NO: 3917363 - DNA, 20 bp, Homo sapiens
cattcccattggttctccta

SEQ ID NO: 3917364 - DNA, 13 bp, Homo sapiens
cattccccaggtg

SEQ ID NO: 3917365 - DNA, 23 bp, Homo sapiens
cattccccaggtggctgacccag

SEQ ID NO: 3917366 - DNA, 16 bp, Homo sapiens
cattccccgctgccca

SEQ ID NO: 3917367 - DNA, 17 bp, Homo sapiens
cattccccgctgcccaa

SEQ ID NO: 3917368 - DNA, 20 bp, Homo sapiens
cattcccctcgtgtgactct

SEQ ID NO: 3917369 - DNA, 17 bp, Homo sapiens
cattccctatcaaaaca

SEQ ID NO: 3917370 - DNA, 24 bp, Homo sapiens
cattccctatcaaaacatatcaat

SEQ ID NO: 3917371 - DNA, 18 bp, Homo sapiens
cattccctgagtcaccag

SEQ ID NO: 3917372 - DNA, 12 bp, Homo sapiens
cattcctcagct

SEQ ID NO: 3917373 - DNA, 13 bp, Homo sapiens
cattcctcaggga

SEQ ID NO: 3917374 - DNA, 13 bp, Homo sapiens
cattcctggcccc

SEQ ID NO: 3917375 - DNA, 23 bp, Homo sapiens
cattcgaggtgtcaccctgcaga

SEQ ID NO: 3917376 - DNA, 16 bp, Homo sapiens
cattcggaccctgccc

SEQ ID NO: 3917377 - DNA, 14 bp, Homo sapiens
cattctcactccta

SEQ ID NO: 3917378 - DNA, 21 bp, Homo sapiens
cattctcatatgtagccctca

SEQ ID NO: 3917379 - DNA, 13 bp, Homo sapiens
cattctcctgcct

SEQ ID NO: 3917380 - DNA, 12 bp, Homo sapiens
cattctctctcc

SEQ ID NO: 3917381 - DNA, 18 bp, Homo sapiens
cattctctttctttttct

SEQ ID NO: 3917382 - DNA, 13 bp, Homo sapiens
cattctgagctgg

SEQ ID NO: 3917383 - DNA, 16 bp, Homo sapiens
cattctgttgcccagg

SEQ ID NO: 3917384 - DNA, 19 bp, Homo sapiens
cattctgttgcccaggctg

SEQ ID NO: 3917385 - DNA, 23 bp, Homo sapiens
cattcttaaaggaaaagtcaaca

SEQ ID NO: 3917386 - DNA, 21 bp, Homo sapiens
cattcttaagatttctcctga

SEQ ID NO: 3917387 - DNA, 17 bp, Homo sapiens
cattcttcagtgcctag

SEQ ID NO: 3917388 - DNA, 19 bp, Homo sapiens
cattctttcccctcagagc

SEQ ID NO: 3917389 - DNA, 14 bp, Homo sapiens
cattgacttcttgg

SEQ ID NO: 3917390 - DNA, 22 bp, Homo sapiens
cattgcatcacctctgtaattt

SEQ ID NO: 3917391 - DNA, 13 bp, Homo sapiens
cattgctgttgtt

SEQ ID NO: 3917392 - DNA, 18 bp, Homo sapiens
cattgctgttgttgcagg

SEQ ID NO: 3917393 - DNA, 21 bp, Homo sapiens
cattgcttattcttgagcaca

SEQ ID NO: 3917394 - DNA, 14 bp, Homo sapiens
cattggtctgctga

SEQ ID NO: 3917395 - DNA, 21 bp, Homo sapiens
cattgtagaaacacagttttg

SEQ ID NO: 3917396 - DNA, 21 bp, Homo sapiens
cattgtagagcttctggcact

SEQ ID NO: 3917397 - DNA, 19 bp, Homo sapiens
cattgtagagcttggtggc

SEQ ID NO: 3917398 - DNA, 17 bp, Homo sapiens
cattgtatatatgtgtg

SEQ ID NO: 3917399 - DNA, 22 bp, Homo sapiens
cattgtatatatgtgtgtttaa

SEQ ID NO: 3917400 - DNA, 15 bp, Homo sapiens
cattgtatgtatcta

SEQ ID NO: 3917401 - DNA, 15 bp, Homo sapiens
cattgtcttccaacc

SEQ ID NO: 3917402 - DNA, 17 bp, Homo sapiens
cattgttgctccctgtg

SEQ ID NO: 3917403 - DNA, 17 bp, Homo sapiens
cattgtttattaacaaa

SEQ ID NO: 3917404 - DNA, 15 bp, Homo sapiens
catttaaaatgatta

SEQ ID NO: 3917405 - DNA, 17 bp, Homo sapiens
catttaaaatgattaga

SEQ ID NO: 3917406 - DNA, 14 bp, Homo sapiens
catttaattcataa

SEQ ID NO: 3917407 - DNA, 16 bp, Homo sapiens
catttaattcataatt

SEQ ID NO: 3917408 - DNA, 20 bp, Homo sapiens
catttaattcataattagaa

SEQ ID NO: 3917409 - DNA, 23 bp, Homo sapiens
catttacaataaatattctgcat

SEQ ID NO: 3917410 - DNA, 15 bp, Homo sapiens
catttataaatgtgt

SEQ ID NO: 3917411 - DNA, 22 bp, Homo sapiens
catttatacatcacctttttga

SEQ ID NO: 3917412 - DNA, 14 bp, Homo sapiens
catttatatatata

SEQ ID NO: 3917413 - DNA, 19 bp, Homo sapiens
catttatatatatatgtat

SEQ ID NO: 3917414 - DNA, 14 bp, Homo sapiens
catttatgtttatt

SEQ ID NO: 3917415 - DNA, 16 bp, Homo sapiens
catttcaaagctgagt

SEQ ID NO: 3917416 - DNA, 16 bp, Homo sapiens
catttcaactccagaa

SEQ ID NO: 3917417 - DNA, 17 bp, Homo sapiens
catttcaactccagaag

SEQ ID NO: 3917418 - DNA, 13 bp, Homo sapiens
catttcactttaa

SEQ ID NO: 3917419 - DNA, 17 bp, Homo sapiens
catttcactttaaagtc

SEQ ID NO: 3917420 - DNA, 17 bp, Homo sapiens
catttccacactgtcag

SEQ ID NO: 3917421 - DNA, 21 bp, Homo sapiens
catttcctgggtggctactct

SEQ ID NO: 3917422 - DNA, 22 bp, Homo sapiens
catttcctgggtggctactctg

SEQ ID NO: 3917423 - DNA, 22 bp, Homo sapiens
catttctaaaagaatattcaga

SEQ ID NO: 3917424 - DNA, 18 bp, Homo sapiens
catttctaacatatgtat

SEQ ID NO: 3917425 - DNA, 18 bp, Homo sapiens
catttctcaatcagtgca

SEQ ID NO: 3917426 - DNA, 15 bp, Homo sapiens
catttcttatgattt

SEQ ID NO: 3917427 - DNA, 23 bp, Homo sapiens
catttgagagaagccacgctgtc

SEQ ID NO: 3917428 - DNA, 18 bp, Homo sapiens
catttgatgtacatgtgt

SEQ ID NO: 3917429 - DNA, 20 bp, Homo sapiens
catttgatgtacatgtgtag

SEQ ID NO: 3917430 - DNA, 12 bp, Homo sapiens
catttgccctgt

SEQ ID NO: 3917431 - DNA, 14 bp, Homo sapiens
catttgccttgctg

SEQ ID NO: 3917432 - DNA, 17 bp, Homo sapiens
catttggacaaaatgga

SEQ ID NO: 3917433 - DNA, 23 bp, Homo sapiens
catttgtataatgggaagcctgt

SEQ ID NO: 3917434 - DNA, 20 bp, Homo sapiens
catttgtcaaagcattgaga

SEQ ID NO: 3917435 - DNA, 14 bp, Homo sapiens
catttgtgaaatga

SEQ ID NO: 3917436 - DNA, 20 bp, Homo sapiens
cattttaaaaaccaatcatt

SEQ ID NO: 3917437 - DNA, 18 bp, Homo sapiens
cattttaagaagacatga

SEQ ID NO: 3917438 - DNA, 19 bp, Homo sapiens
cattttaagaagacatgac

SEQ ID NO: 3917439 - DNA, 20 bp, Homo sapiens
cattttaagaagacatgaca

SEQ ID NO: 3917440 - DNA, 17 bp, Homo sapiens
cattttactacttgtta

SEQ ID NO: 3917441 - DNA, 15 bp, Homo sapiens
cattttagtgactgt

SEQ ID NO: 3917442 - DNA, 21 bp, Homo sapiens
cattttatttattagctgtaa

SEQ ID NO: 3917443 - DNA, 13 bp, Homo sapiens
cattttcaataat

SEQ ID NO: 3917444 - DNA, 22 bp, Homo sapiens
cattttcctcgcctaggcctgt

SEQ ID NO: 3917445 - DNA, 21 bp, Homo sapiens
cattttcgctttcctctggtt

SEQ ID NO: 3917446 - DNA, 14 bp, Homo sapiens
cattttcttgcctg

SEQ ID NO: 3917447 - DNA, 17 bp, Homo sapiens
cattttgagtgactcga

SEQ ID NO: 3917448 - DNA, 13 bp, Homo sapiens
cattttgcctttc

SEQ ID NO: 3917449 - DNA, 22 bp, Homo sapiens
cattttggaagttttcaggact

SEQ ID NO: 3917450 - DNA, 20 bp, Homo sapiens
cattttgggggtttttaatc

SEQ ID NO: 3917451 - DNA, 18 bp, Homo sapiens
cattttgtaacaaatgaa

SEQ ID NO: 3917452 - DNA, 17 bp, Homo sapiens
cattttgttatagaata

SEQ ID NO: 3917453 - DNA, 15 bp, Homo sapiens
catttttacaataaa

SEQ ID NO: 3917454 - DNA, 21 bp, Homo sapiens
catttttttttttgtttctga

SEQ ID NO: 3917455 - DNA, 17 bp, Homo sapiens
ccaaaagggcagccagg

SEQ ID NO: 3917456 - DNA, 20 bp, Homo sapiens
ccaaaagggcagccaggggc

SEQ ID NO: 3917457 - DNA, 21 bp, Homo sapiens
ccaaaagggcagccaggggct

SEQ ID NO: 3917458 - DNA, 17 bp, Homo sapiens
ccaaaagttttcctgag

SEQ ID NO: 3917459 - DNA, 18 bp, Homo sapiens
ccaaaagttttcctgaga

SEQ ID NO: 3917460 - DNA, 18 bp, Homo sapiens
ccaaacacactgtaaata

SEQ ID NO: 3917461 - DNA, 14 bp, Homo sapiens
ccaaactcctgcct

SEQ ID NO: 3917462 - DNA, 15 bp, Homo sapiens
ccaaactgtgccctg

SEQ ID NO: 3917463 - DNA, 18 bp, Homo sapiens
ccaaactgtgccctgcct

SEQ ID NO: 3917464 - DNA, 19 bp, Homo sapiens
ccaaactgtgccctgcctt

SEQ ID NO: 3917465 - DNA, 20 bp, Homo sapiens
ccaaactgtgccctgccttc

SEQ ID NO: 3917466 - DNA, 20 bp, Homo sapiens
ccaaagagactggagcatct

SEQ ID NO: 3917467 - DNA, 12 bp, Homo sapiens
ccaaagagcctg

SEQ ID NO: 3917468 - DNA, 15 bp, Homo sapiens
ccaaagagcctggag

SEQ ID NO: 3917469 - DNA, 16 bp, Homo sapiens
ccaaagagcctggaga

SEQ ID NO: 3917470 - DNA, 14 bp, Homo sapiens
ccaaaggctccctg

SEQ ID NO: 3917471 - DNA, 17 bp, Homo sapiens
ccaaaggggctgctggg

SEQ ID NO: 3917472 - DNA, 20 bp, Homo sapiens
ccaaagtattaatgtacaga

SEQ ID NO: 3917473 - DNA, 16 bp, Homo sapiens
ccaaagtcttaaaata

SEQ ID NO: 3917474 - DNA, 21 bp, Homo sapiens
ccaaagtgcagcccttcctcc

SEQ ID NO: 3917475 - DNA, 23 bp, Homo sapiens
ccaaagtgcagcccttcctcctg

SEQ ID NO: 3917476 - DNA, 13 bp, Homo sapiens
ccaaataaatgtg

SEQ ID NO: 3917477 - DNA, 18 bp, Homo sapiens
ccaaataaatgtgtaaat

SEQ ID NO: 3917478 - DNA, 19 bp, Homo sapiens
ccaaataaatgtgtaaatg

SEQ ID NO: 3917479 - DNA, 14 bp, Homo sapiens
ccaaatataaactt

SEQ ID NO: 3917480 - DNA, 18 bp, Homo sapiens
ccaaatatagcgttccca

SEQ ID NO: 3917481 - DNA, 20 bp, Homo sapiens
ccaaatattattcaagtgcc

SEQ ID NO: 3917482 - DNA, 20 bp, Homo sapiens
ccaaatattttagccttaaa

SEQ ID NO: 3917483 - DNA, 17 bp, Homo sapiens
ccaaatccacaagccat

SEQ ID NO: 3917484 - DNA, 22 bp, Homo sapiens
ccaaatgctgtctccataatgc

SEQ ID NO: 3917485 - DNA, 21 bp, Homo sapiens
ccaaatgtgatcaactgttca

SEQ ID NO: 3917486 - DNA, 12 bp, Homo sapiens
ccaaattatttg

SEQ ID NO: 3917487 - DNA, 17 bp, Homo sapiens
ccaaattatttgtgtaa

SEQ ID NO: 3917488 - DNA, 18 bp, Homo sapiens
ccaaattatttgtgtaat

SEQ ID NO: 3917489 - DNA, 16 bp, Homo sapiens
ccaaattccctggacc

SEQ ID NO: 3917490 - DNA, 16 bp, Homo sapiens
ccaacaaacctgcttg

SEQ ID NO: 3917491 - DNA, 15 bp, Homo sapiens
ccaacaataaagagc

SEQ ID NO: 3917492 - DNA, 17 bp, Homo sapiens
ccaacaataaagagctc

SEQ ID NO: 3917493 - DNA, 21 bp, Homo sapiens
ccaacaatggggtgggcccat

SEQ ID NO: 3917494 - DNA, 21 bp, Homo sapiens
ccaacacaatctttccttgtc

SEQ ID NO: 3917495 - DNA, 18 bp, Homo sapiens
ccaacagaaggaaggagg

SEQ ID NO: 3917496 - DNA, 14 bp, Homo sapiens
ccaacaggtggcag

SEQ ID NO: 3917497 - DNA, 23 bp, Homo sapiens
ccaacaggtggcaggaccaggac

SEQ ID NO: 3917498 - DNA, 21 bp, Homo sapiens
ccaacatcccattgccctggt

SEQ ID NO: 3917499 - DNA, 15 bp, Homo sapiens
ccaaccccagctggc

SEQ ID NO: 3917500 - DNA, 22 bp, Homo sapiens
ccaaccccgcggtgctctggcg

SEQ ID NO: 3917501 - DNA, 14 bp, Homo sapiens
ccaacccgtggagg

SEQ ID NO: 3917502 - DNA, 14 bp, Homo sapiens
ccaaccctcagagc

SEQ ID NO: 3917503 - DNA, 16 bp, Homo sapiens
ccaaccctgtttcctg

SEQ ID NO: 3917504 - DNA, 18 bp, Homo sapiens
ccaacctaacccctttcc

SEQ ID NO: 3917505 - DNA, 18 bp, Homo sapiens
ccaacctcaatgccctgc

SEQ ID NO: 3917506 - DNA, 20 bp, Homo sapiens
ccaacctcaatgccctgcca

SEQ ID NO: 3917507 - DNA, 12 bp, Homo sapiens
ccaacctgacca

SEQ ID NO: 3917508 - DNA, 18 bp, Homo sapiens
ccaacctgatgccccttc

SEQ ID NO: 3917509 - DNA, 20 bp, Homo sapiens
ccaacctgatgccccttccc

SEQ ID NO: 3917510 - DNA, 15 bp, Homo sapiens
ccaacgcacaggaaa

SEQ ID NO: 3917511 - DNA, 13 bp, Homo sapiens
ccaactcctcctt

SEQ ID NO: 3917512 - DNA, 13 bp, Homo sapiens
ccaactctgcact

SEQ ID NO: 3917513 - DNA, 14 bp, Homo sapiens
ccaactctgcactc

SEQ ID NO: 3917514 - DNA, 15 bp, Homo sapiens
ccaactctgcactcc

SEQ ID NO: 3917515 - DNA, 20 bp, Homo sapiens
ccaactctgcactccatggc

SEQ ID NO: 3917516 - DNA, 14 bp, Homo sapiens
ccaactggtcactg

SEQ ID NO: 3917517 - DNA, 11 bp, Homo sapiens
ccaacttgtaa

SEQ ID NO: 3917518 - DNA, 17 bp, Homo sapiens
ccaacttgtaaatacac

SEQ ID NO: 3917519 - DNA, 14 bp, Homo sapiens
ccaagaacattatc

SEQ ID NO: 3917520 - DNA, 13 bp, Homo sapiens
ccaagaagggcta

SEQ ID NO: 3917521 - DNA, 14 bp, Homo sapiens
ccaagaccccagct

SEQ ID NO: 3917522 - DNA, 22 bp, Homo sapiens
ccaagacttggcaacagaagca

SEQ ID NO: 3917523 - DNA, 12 bp, Homo sapiens
ccaagagagaaa

SEQ ID NO: 3917524 - DNA, 14 bp, Homo sapiens
ccaagagatgaaga

SEQ ID NO: 3917525 - DNA, 16 bp, Homo sapiens
ccaagaggtctgagcc

SEQ ID NO: 3917526 - DNA, 19 bp, Homo sapiens
ccaagaggtctgagccctg

SEQ ID NO: 3917527 - DNA, 16 bp, Homo sapiens
ccaagatcgcgccact

SEQ ID NO: 3917528 - DNA, 19 bp, Homo sapiens
ccaagatgggcacatgagg

SEQ ID NO: 3917529 - DNA, 17 bp, Homo sapiens
ccaagattcaaagagac

SEQ ID NO: 3917530 - DNA, 15 bp, Homo sapiens
ccaagcagccagcca

SEQ ID NO: 3917531 - DNA, 14 bp, Homo sapiens
ccaagccatggtga

SEQ ID NO: 3917532 - DNA, 11 bp, Homo sapiens
ccaagcccttt

SEQ ID NO: 3917533 - DNA, 21 bp, Homo sapiens
ccaagcccttttacagctctt

SEQ ID NO: 3917534 - DNA, 16 bp, Homo sapiens
ccaagcctctgcccca

SEQ ID NO: 3917535 - DNA, 21 bp, Homo sapiens
ccaagcctctgccccaagggg

SEQ ID NO: 3917536 - DNA, 21 bp, Homo sapiens
ccaagcgaggtcaacagagaa

SEQ ID NO: 3917537 - DNA, 18 bp, Homo sapiens
ccaagctcacagttcctc

SEQ ID NO: 3917538 - DNA, 19 bp, Homo sapiens
ccaagctcacagttcctcg

SEQ ID NO: 3917539 - DNA, 22 bp, Homo sapiens
ccaagctcacagttcctcgccc

SEQ ID NO: 3917540 - DNA, 23 bp, Homo sapiens
ccaagctgaagtgaaggagaaag

SEQ ID NO: 3917541 - DNA, 12 bp, Homo sapiens
ccaagctgaggt

SEQ ID NO: 3917542 - DNA, 12 bp, Homo sapiens
ccaagctggcag

SEQ ID NO: 3917543 - DNA, 14 bp, Homo sapiens
ccaagctgttttct

SEQ ID NO: 3917544 - DNA, 15 bp, Homo sapiens
ccaagcttcaagtga

SEQ ID NO: 3917545 - DNA, 12 bp, Homo sapiens
ccaagcttcaga

SEQ ID NO: 3917546 - DNA, 13 bp, Homo sapiens
ccaagcttcagag

SEQ ID NO: 3917547 - DNA, 14 bp, Homo sapiens
ccaagcttcagagc

SEQ ID NO: 3917548 - DNA, 18 bp, Homo sapiens
ccaagcttcagagcctag

SEQ ID NO: 3917549 - DNA, 23 bp, Homo sapiens
ccaagcttgtgagagctggttgc

SEQ ID NO: 3917550 - DNA, 22 bp, Homo sapiens
ccaagctttgaatacccccaga

SEQ ID NO: 3917551 - DNA, 21 bp, Homo sapiens
ccaaggagaaacagagacagg

SEQ ID NO: 3917552 - DNA, 15 bp, Homo sapiens
cagtggcgagaggag

SEQ ID NO: 3917553 - DNA, 18 bp, Homo sapiens
cagtggctcgctccctgt

SEQ ID NO: 3917554 - DNA, 20 bp, Homo sapiens
cagtggctcgctccctgtag

SEQ ID NO: 3917555 - DNA, 20 bp, Homo sapiens
cagtgggaacgtgactgccc

SEQ ID NO: 3917556 - DNA, 11 bp, Homo sapiens
cagtgggacaa

SEQ ID NO: 3917557 - DNA, 16 bp, Homo sapiens
cagtgggacagggcat

SEQ ID NO: 3917558 - DNA, 22 bp, Homo sapiens
cagtgggaggtgagaccacctc

SEQ ID NO: 3917559 - DNA, 22 bp, Homo sapiens
cagtgggtggcacctcctgaga

SEQ ID NO: 3917560 - DNA, 23 bp, Homo sapiens
cagtgggtggcacctcctgagaa

SEQ ID NO: 3917561 - DNA, 15 bp, Homo sapiens
cagtgggtgggagct

SEQ ID NO: 3917562 - DNA, 13 bp, Homo sapiens
cagtggttgctgt

SEQ ID NO: 3917563 - DNA, 11 bp, Homo sapiens
cagtgtaaaga

SEQ ID NO: 3917564 - DNA, 19 bp, Homo sapiens
cagtgtaaagaataaatga

SEQ ID NO: 3917565 - DNA, 20 bp, Homo sapiens
cagtgtaaagaataaatgaa

SEQ ID NO: 3917566 - DNA, 16 bp, Homo sapiens
cagtgtcccctccact

SEQ ID NO: 3917567 - DNA, 18 bp, Homo sapiens
cagtgtcctcttgctcaa

SEQ ID NO: 3917568 - DNA, 19 bp, Homo sapiens
cagtgtgaatatatggtct

SEQ ID NO: 3917569 - DNA, 21 bp, Homo sapiens
cagtgtgtccttggggcacag

SEQ ID NO: 3917570 - DNA, 22 bp, Homo sapiens
cagtgtgtccttggggcacagt

SEQ ID NO: 3917571 - DNA, 16 bp, Homo sapiens
cagtgttacttttaat

SEQ ID NO: 3917572 - DNA, 20 bp, Homo sapiens
cagtgttacttttaattcct

SEQ ID NO: 3917573 - DNA, 21 bp, Homo sapiens
cagtgttccccatctgggtcc

SEQ ID NO: 3917574 - DNA, 20 bp, Homo sapiens
cagtgttggctgtgtgacag

SEQ ID NO: 3917575 - DNA, 17 bp, Homo sapiens
cagtgttttagctgttt

SEQ ID NO: 3917576 - DNA, 22 bp, Homo sapiens
cagtgttttttcactttagcta

SEQ ID NO: 3917577 - DNA, 15 bp, Homo sapiens
cagttactcagccct

SEQ ID NO: 3917578 - DNA, 16 bp, Homo sapiens
cagttacttacctgca

SEQ ID NO: 3917579 - DNA, 18 bp, Homo sapiens
cagttatattctttaaat

SEQ ID NO: 3917580 - DNA, 17 bp, Homo sapiens
cagttcaacctggtggc

SEQ ID NO: 3917581 - DNA, 21 bp, Homo sapiens
cagttcagagttgtacactgt

SEQ ID NO: 3917582 - DNA, 22 bp, Homo sapiens
cagttcatgtatgttcagaaga

SEQ ID NO: 3917583 - DNA, 22 bp, Homo sapiens
cagttcccggagcacagccctg

SEQ ID NO: 3917584 - DNA, 15 bp, Homo sapiens
cagttcctctttgca

SEQ ID NO: 3917585 - DNA, 18 bp, Homo sapiens
cagttcctctttgcatgg

SEQ ID NO: 3917586 - DNA, 23 bp, Homo sapiens
cagttcctctttgcatggaattt

SEQ ID NO: 3917587 - DNA, 14 bp, Homo sapiens
cagttcgcagccac

SEQ ID NO: 3917588 - DNA, 19 bp, Homo sapiens
cagttcgcagccaccctga

SEQ ID NO: 3917589 - DNA, 23 bp, Homo sapiens
cagttcttggtgactgtcccacc

SEQ ID NO: 3917590 - DNA, 22 bp, Homo sapiens
cagttgaaaagactccaaagaa

SEQ ID NO: 3917591 - DNA, 17 bp, Homo sapiens
cagttgattctgaatct

SEQ ID NO: 3917592 - DNA, 16 bp, Homo sapiens
cagttgcaataaaata

SEQ ID NO: 3917593 - DNA, 19 bp, Homo sapiens
cagttgcaataaaatagta

SEQ ID NO: 3917594 - DNA, 22 bp, Homo sapiens
cagttgcaataaaatagtattg

SEQ ID NO: 3917595 - DNA, 23 bp, Homo sapiens
cagttgtctattctgagccttga

SEQ ID NO: 3917596 - DNA, 14 bp, Homo sapiens
cagttgttatttag

SEQ ID NO: 3917597 - DNA, 13 bp, Homo sapiens
cagttgttttccc

SEQ ID NO: 3917598 - DNA, 18 bp, Homo sapiens
cagtttcaattcagtgct

SEQ ID NO: 3917599 - DNA, 11 bp, Homo sapiens
cagtttcccca

SEQ ID NO: 3917600 - DNA, 22 bp, Homo sapiens
cagtttgcagaaaagcacctgc

SEQ ID NO: 3917601 - DNA, 21 bp, Homo sapiens
cagtttgctttgtatgcactt

SEQ ID NO: 3917602 - DNA, 19 bp, Homo sapiens
cagtttggaagtgttaact

SEQ ID NO: 3917603 - DNA, 20 bp, Homo sapiens
cagttttctgagaaagacta

SEQ ID NO: 3917604 - DNA, 19 bp, Homo sapiens
cataaaatgggtgatatgc

SEQ ID NO: 3917605 - DNA, 20 bp, Homo sapiens
cataaatgttcagcttcaga

SEQ ID NO: 3917606 - DNA, 22 bp, Homo sapiens
cataaccccaggcatcccatcc

SEQ ID NO: 3917607 - DNA, 19 bp, Homo sapiens
cataactagtttaattaac

SEQ ID NO: 3917608 - DNA, 20 bp, Homo sapiens
cataagaccctaagcctcct

SEQ ID NO: 3917609 - DNA, 21 bp, Homo sapiens
cataagaccgtgtcccaagga

SEQ ID NO: 3917610 - DNA, 16 bp, Homo sapiens
cataagctaagcctta

SEQ ID NO: 3917611 - DNA, 14 bp, Homo sapiens
cataaggagaatgt

SEQ ID NO: 3917612 - DNA, 17 bp, Homo sapiens
cataaggccagaaactc

SEQ ID NO: 3917613 - DNA, 21 bp, Homo sapiens
cataaggccagaaactccttt

SEQ ID NO: 3917614 - DNA, 22 bp, Homo sapiens
cataaggccagaaactcctttt

SEQ ID NO: 3917615 - DNA, 16 bp, Homo sapiens
cataatctcattcaaa

SEQ ID NO: 3917616 - DNA, 23 bp, Homo sapiens
cataatctggactcctctgtcca

SEQ ID NO: 3917617 - DNA, 21 bp, Homo sapiens
cataatttgtacatatgtaaa

SEQ ID NO: 3917618 - DNA, 12 bp, Homo sapiens
cataattttcaa

SEQ ID NO: 3917619 - DNA, 15 bp, Homo sapiens
catacaacacaaaga

SEQ ID NO: 3917620 - DNA, 17 bp, Homo sapiens
catacaacacaaagaga

SEQ ID NO: 3917621 - DNA, 22 bp, Homo sapiens
catacaatttgcactgttactt

SEQ ID NO: 3917622 - DNA, 18 bp, Homo sapiens
catacatacacatacata

SEQ ID NO: 3917623 - DNA, 20 bp, Homo sapiens
catacatacacatacataca

SEQ ID NO: 3917624 - DNA, 15 bp, Homo sapiens
catacatacatacat

SEQ ID NO: 3917625 - DNA, 17 bp, Homo sapiens
catacatacatacatac

SEQ ID NO: 3917626 - DNA, 18 bp, Homo sapiens
catacatacatacatata

SEQ ID NO: 3917627 - DNA, 12 bp, Homo sapiens
cataccatcact

SEQ ID NO: 3917628 - DNA, 17 bp, Homo sapiens
cataccatcactgagtg

SEQ ID NO: 3917629 - DNA, 14 bp, Homo sapiens
catacccctgcctg

SEQ ID NO: 3917630 - DNA, 14 bp, Homo sapiens
catacccttcttta

SEQ ID NO: 3917631 - DNA, 19 bp, Homo sapiens
cataccttctggttgcttc

SEQ ID NO: 3917632 - DNA, 22 bp, Homo sapiens
cataccttctggttgcttcaga

SEQ ID NO: 3917633 - DNA, 16 bp, Homo sapiens
cataccttggactgac

SEQ ID NO: 3917634 - DNA, 19 bp, Homo sapiens
catacctttattgtgatct

SEQ ID NO: 3917635 - DNA, 18 bp, Homo sapiens
catactcatttctaaaag

SEQ ID NO: 3917636 - DNA, 20 bp, Homo sapiens
catactcatttctaaaagaa

SEQ ID NO: 3917637 - DNA, 15 bp, Homo sapiens
catagaaacatgaca

SEQ ID NO: 3917638 - DNA, 20 bp, Homo sapiens
catagaaacatgacactgac

SEQ ID NO: 3917639 - DNA, 22 bp, Homo sapiens
catagaaactgaggagtagctg

SEQ ID NO: 3917640 - DNA, 23 bp, Homo sapiens
catagaaactgaggagtagctga

SEQ ID NO: 3917641 - DNA, 23 bp, Homo sapiens
catagatggaccagtagacaact

SEQ ID NO: 3917642 - DNA, 18 bp, Homo sapiens
catagatgtatcattaat

SEQ ID NO: 3917643 - DNA, 18 bp, Homo sapiens
catagattaatggcactg

SEQ ID NO: 3917644 - DNA, 20 bp, Homo sapiens
catagattaatggcactgat

SEQ ID NO: 3917645 - DNA, 23 bp, Homo sapiens
catagcaagattgcttaaaatag

SEQ ID NO: 3917646 - DNA, 21 bp, Homo sapiens
catagcatagctagagattgg

SEQ ID NO: 3917647 - DNA, 17 bp, Homo sapiens
catagcgctggctcagg

SEQ ID NO: 3917648 - DNA, 18 bp, Homo sapiens
catagcgctggctcagga

SEQ ID NO: 3917649 - DNA, 21 bp, Homo sapiens
catagctacccaaaagagaaa

SEQ ID NO: 3917650 - DNA, 22 bp, Homo sapiens
catagctacccaaaagagaaaa

SEQ ID NO: 3917651 - DNA, 19 bp, Homo sapiens
cataggaaaagtacattta

SEQ ID NO: 3917652 - DNA, 22 bp, Homo sapiens
cataggaaaagtacatttaata

SEQ ID NO: 3917653 - DNA, 19 bp, Homo sapiens
cataggcggtcatgtgtgc

SEQ ID NO: 3917654 - DNA, 22 bp, Homo sapiens
cataggttcacaccattttgtt

SEQ ID NO: 3917655 - DNA, 20 bp, Homo sapiens
catagtaagaccccatctct

SEQ ID NO: 3917656 - DNA, 15 bp, Homo sapiens
catagtgagatccca

SEQ ID NO: 3917657 - DNA, 19 bp, Homo sapiens
catagtgatggttcccctg

SEQ ID NO: 3917658 - DNA, 19 bp, Homo sapiens
catagttatttacttgaaa

SEQ ID NO: 3917659 - DNA, 23 bp, Homo sapiens
catagttatttacttgaaagatg

SEQ ID NO: 3917660 - DNA, 16 bp, Homo sapiens
catagtttgttcaaat

SEQ ID NO: 3917661 - DNA, 18 bp, Homo sapiens
catatacatatatatata

SEQ ID NO: 3917662 - DNA, 19 bp, Homo sapiens
catatacctataatgtgtg

SEQ ID NO: 3917663 - DNA, 20 bp, Homo sapiens
catatacctataatgtgtgt

SEQ ID NO: 3917664 - DNA, 14 bp, Homo sapiens
catatatatctgat

SEQ ID NO: 3917665 - DNA, 15 bp, Homo sapiens
catatatattaaaat

SEQ ID NO: 3917666 - DNA, 13 bp, Homo sapiens
catatatcttatg

SEQ ID NO: 3917667 - DNA, 19 bp, Homo sapiens
catatattcatgtaataaa

SEQ ID NO: 3917668 - DNA, 21 bp, Homo sapiens
catatattcatgtaataaatc

SEQ ID NO: 3917669 - DNA, 15 bp, Homo sapiens
catatcaattcaaca

SEQ ID NO: 3917670 - DNA, 12 bp, Homo sapiens
catatcagaaaa

SEQ ID NO: 3917671 - DNA, 14 bp, Homo sapiens
catatcagaaaagt

SEQ ID NO: 3917672 - DNA, 15 bp, Homo sapiens
catatcagacctctg

SEQ ID NO: 3917673 - DNA, 14 bp, Homo sapiens
catatcggaggtgg

SEQ ID NO: 3917674 - DNA, 21 bp, Homo sapiens
catatcggaggtggtggagga

SEQ ID NO: 3917675 - DNA, 14 bp, Homo sapiens
catatctccttccc

SEQ ID NO: 3917676 - DNA, 11 bp, Homo sapiens
catatgaaaaa

SEQ ID NO: 3917677 - DNA, 20 bp, Homo sapiens
catatgcgtcccaagcagcc

SEQ ID NO: 3917678 - DNA, 14 bp, Homo sapiens
catatgggtgctgg

SEQ ID NO: 3917679 - DNA, 15 bp, Homo sapiens
catatgggtgctggc

SEQ ID NO: 3917680 - DNA, 14 bp, Homo sapiens
catatgtaaaataa

SEQ ID NO: 3917681 - DNA, 17 bp, Homo sapiens
catatgtagccctcatg

SEQ ID NO: 3917682 - DNA, 17 bp, Homo sapiens
catatgtctgcttctgt

SEQ ID NO: 3917683 - DNA, 12 bp, Homo sapiens
catattataaat

SEQ ID NO: 3917684 - DNA, 19 bp, Homo sapiens
catattataaataaatgcc

SEQ ID NO: 3917685 - DNA, 14 bp, Homo sapiens
catattcacacctc

SEQ ID NO: 3917686 - DNA, 21 bp, Homo sapiens
catattgagcacttgctgtat

SEQ ID NO: 3917687 - DNA, 14 bp, Homo sapiens
catattggtattca

SEQ ID NO: 3917688 - DNA, 14 bp, Homo sapiens
catattgtatgtaa

SEQ ID NO: 3917689 - DNA, 19 bp, Homo sapiens
catatttatattgtatatt

SEQ ID NO: 3917690 - DNA, 21 bp, Homo sapiens
catatttatattgtatattct

SEQ ID NO: 3917691 - DNA, 12 bp, Homo sapiens
catatttgagaa

SEQ ID NO: 3917692 - DNA, 23 bp, Homo sapiens
catcaagcatgcaataatgtgca

SEQ ID NO: 3917693 - DNA, 11 bp, Homo sapiens
catcaattccc

SEQ ID NO: 3917694 - DNA, 15 bp, Homo sapiens
catcaatttttatac

SEQ ID NO: 3917695 - DNA, 18 bp, Homo sapiens
catcaatttttatacata

SEQ ID NO: 3917696 - DNA, 21 bp, Homo sapiens
catcaatttttatacatatca

SEQ ID NO: 3917697 - DNA, 23 bp, Homo sapiens
catcaatttttatacatatcaga

SEQ ID NO: 3917698 - DNA, 14 bp, Homo sapiens
catcacctactcac

SEQ ID NO: 3917699 - DNA, 20 bp, Homo sapiens
catcacctactcacacaggc

SEQ ID NO: 3917700 - DNA, 16 bp, Homo sapiens
catcactgagtggctt

SEQ ID NO: 3917701 - DNA, 17 bp, Homo sapiens
catcactgagtggcttg

SEQ ID NO: 3917702 - DNA, 17 bp, Homo sapiens
catcacttttcagtgat

SEQ ID NO: 3917703 - DNA, 16 bp, Homo sapiens
catcagaaagggaggg

SEQ ID NO: 3917704 - DNA, 21 bp, Homo sapiens
catcagaaagggagggctctg

SEQ ID NO: 3917705 - DNA, 15 bp, Homo sapiens
catcagaaggagaag

SEQ ID NO: 3917706 - DNA, 23 bp, Homo sapiens
catcagaaggagaaggaaggaga

SEQ ID NO: 3917707 - DNA, 13 bp, Homo sapiens
catcagcaccatg

SEQ ID NO: 3917708 - DNA, 13 bp, Homo sapiens
catcagctgctga

SEQ ID NO: 3917709 - DNA, 17 bp, Homo sapiens
catcagctgctgaaaca

SEQ ID NO: 3917710 - DNA, 18 bp, Homo sapiens
catcagctgctgaaacaa

SEQ ID NO: 3917711 - DNA, 20 bp, Homo sapiens
catcagcttgccctgttaaa

SEQ ID NO: 3917712 - DNA, 16 bp, Homo sapiens
catcaggcactggtgg

SEQ ID NO: 3917713 - DNA, 14 bp, Homo sapiens
catcagggcttgat

SEQ ID NO: 3917714 - DNA, 13 bp, Homo sapiens
catcagggtgggc

SEQ ID NO: 3917715 - DNA, 17 bp, Homo sapiens
catcaggttccatcccg

SEQ ID NO: 3917716 - DNA, 20 bp, Homo sapiens
catcagtattaatactaaaa

SEQ ID NO: 3917717 - DNA, 12 bp, Homo sapiens
catcataaccat

SEQ ID NO: 3917718 - DNA, 22 bp, Homo sapiens
catcatatgacatgccaccctc

SEQ ID NO: 3917719 - DNA, 12 bp, Homo sapiens
catcatattgta

SEQ ID NO: 3917720 - DNA, 21 bp, Homo sapiens
catcatcaggcttggaatgaa

SEQ ID NO: 3917721 - DNA, 15 bp, Homo sapiens
catcatcccagctgc

SEQ ID NO: 3917722 - DNA, 13 bp, Homo sapiens
catcatcctcctt

SEQ ID NO: 3917723 - DNA, 13 bp, Homo sapiens
catcatgcctctg

SEQ ID NO: 3917724 - DNA, 17 bp, Homo sapiens
catcatgcctctgaggc

SEQ ID NO: 3917725 - DNA, 20 bp, Homo sapiens
catcatgcctctgaggccag

SEQ ID NO: 3917726 - DNA, 21 bp, Homo sapiens
catcatgcttacaaaaaagaa

SEQ ID NO: 3917727 - DNA, 13 bp, Homo sapiens
catcattgtatat

SEQ ID NO: 3917728 - DNA, 15 bp, Homo sapiens
catcattgtatatat

SEQ ID NO: 3917729 - DNA, 23 bp, Homo sapiens
catccaaggagaaacagagacag

SEQ ID NO: 3917730 - DNA, 18 bp, Homo sapiens
catccacacacgcaggaa

SEQ ID NO: 3917731 - DNA, 14 bp, Homo sapiens
catccaccaatctc

SEQ ID NO: 3917732 - DNA, 13 bp, Homo sapiens
catccagcctgtg

SEQ ID NO: 3917733 - DNA, 16 bp, Homo sapiens
catccagcctgtgtgt

SEQ ID NO: 3917734 - DNA, 13 bp, Homo sapiens
catccagttcatg

SEQ ID NO: 3917735 - DNA, 16 bp, Homo sapiens
catccagttgcaataa

SEQ ID NO: 3917736 - DNA, 16 bp, Homo sapiens
catccagtttgttctc

SEQ ID NO: 3917737 - DNA, 15 bp, Homo sapiens
catccatcagctccc

SEQ ID NO: 3917738 - DNA, 16 bp, Homo sapiens
catccatgtcctatgt

SEQ ID NO: 3917739 - DNA, 18 bp, Homo sapiens
catccatgtcctatgtgt

SEQ ID NO: 3917740 - DNA, 15 bp, Homo sapiens
catccatgtttgtaa

SEQ ID NO: 3917741 - DNA, 19 bp, Homo sapiens
catccatgtttgtaaaact

SEQ ID NO: 3917742 - DNA, 14 bp, Homo sapiens
catccattcccaag

SEQ ID NO: 3917743 - DNA, 17 bp, Homo sapiens
catccattcctcaggga

SEQ ID NO: 3917744 - DNA, 12 bp, Homo sapiens
catcccacatga

SEQ ID NO: 3917745 - DNA, 21 bp, Homo sapiens
catcccaggaggggcctctga

SEQ ID NO: 3917746 - DNA, 11 bp, Homo sapiens
catcccatccc

SEQ ID NO: 3917747 - DNA, 19 bp, Homo sapiens
catcccatctaagctgcag

SEQ ID NO: 3917748 - DNA, 20 bp, Homo sapiens
catcccatctaagctgcagc

SEQ ID NO: 3917749 - DNA, 21 bp, Homo sapiens
catcccatctaagctgcagct

SEQ ID NO: 3917750 - DNA, 15 bp, Homo sapiens
catcccatgtattta

SEQ ID NO: 3917751 - DNA, 12 bp, Homo sapiens
catccccacctt

SEQ ID NO: 3917752 - DNA, 16 bp, Homo sapiens
catcccccagcactga

SEQ ID NO: 3917753 - DNA, 20 bp, Homo sapiens
catcccctcgtcctgtccca

SEQ ID NO: 3917754 - DNA, 15 bp, Homo sapiens
catcccctttattaa

SEQ ID NO: 3917755 - DNA, 21 bp, Homo sapiens
catcccctttcctccccacct

SEQ ID NO: 3917756 - DNA, 13 bp, Homo sapiens
catcccggcctct

SEQ ID NO: 3917757 - DNA, 21 bp, Homo sapiens
catcccggcctcttccaccca

SEQ ID NO: 3917758 - DNA, 12 bp, Homo sapiens
catccctgggcc

SEQ ID NO: 3917759 - DNA, 24 bp, Homo sapiens
catccctgggcccctccacgcctc

SEQ ID NO: 3917760 - DNA, 15 bp, Homo sapiens
catccctgggcctgc

SEQ ID NO: 3917761 - DNA, 20 bp, Homo sapiens
catccctgggcctgctgctg

SEQ ID NO: 3917762 - DNA, 22 bp, Homo sapiens
catccctgggcctgctgctgag

SEQ ID NO: 3917763 - DNA, 21 bp, Homo sapiens
catcccttccctgtccacctc

SEQ ID NO: 3917764 - DNA, 17 bp, Homo sapiens
catcccttcctccccag

SEQ ID NO: 3917765 - DNA, 14 bp, Homo sapiens
catccgcagcccag

SEQ ID NO: 3917766 - DNA, 15 bp, Homo sapiens
catccgcagcccagg

SEQ ID NO: 3917767 - DNA, 13 bp, Homo sapiens
catccggctcctg

SEQ ID NO: 3917768 - DNA, 14 bp, Homo sapiens
catccggctcctgt

SEQ ID NO: 3917769 - DNA, 19 bp, Homo sapiens
catccgggacgcttccaga

SEQ ID NO: 3917770 - DNA, 22 bp, Homo sapiens
catccgggacgcttccagacca

SEQ ID NO: 3917771 - DNA, 23 bp, Homo sapiens
catccgggacgcttccagaccac

SEQ ID NO: 3917772 - DNA, 24 bp, Homo sapiens
catccgggacgcttccagaccacc

SEQ ID NO: 3917773 - DNA, 16 bp, Homo sapiens
catccgtagttccctg

SEQ ID NO: 3917774 - DNA, 17 bp, Homo sapiens
catccgtagttccctga

SEQ ID NO: 3917775 - DNA, 21 bp, Homo sapiens
catccgtagttccctgaaaac

SEQ ID NO: 3917776 - DNA, 16 bp, Homo sapiens
catcctcctcccaact

SEQ ID NO: 3917777 - DNA, 17 bp, Homo sapiens
catcctggcccctccag

SEQ ID NO: 3917778 - DNA, 16 bp, Homo sapiens
catcctggcctccttt

SEQ ID NO: 3917779 - DNA, 16 bp, Homo sapiens
catcctgtgtggggag

SEQ ID NO: 3917780 - DNA, 17 bp, Homo sapiens
catcctgtgtggggagg

SEQ ID NO: 3917781 - DNA, 21 bp, Homo sapiens
catcggaggctgggcccctgg

SEQ ID NO: 3917782 - DNA, 15 bp, Homo sapiens
catcgtccttcctct

SEQ ID NO: 3917783 - DNA, 18 bp, Homo sapiens
catcgtgacccttcaggg

SEQ ID NO: 3917784 - DNA, 20 bp, Homo sapiens
catcgtgacccttcagggcc

SEQ ID NO: 3917785 - DNA, 21 bp, Homo sapiens
catcgtgacccttcagggcca

SEQ ID NO: 3917786 - DNA, 17 bp, Homo sapiens
catctaagctgcagctt

SEQ ID NO: 3917787 - DNA, 16 bp, Homo sapiens
catctacaagcatttg

SEQ ID NO: 3917788 - DNA, 23 bp, Homo sapiens
catctactcattgtctcagtgct

SEQ ID NO: 3917789 - DNA, 18 bp, Homo sapiens
catctattataaaaccat

SEQ ID NO: 3917790 - DNA, 13 bp, Homo sapiens
catctcagcccac

SEQ ID NO: 3917791 - DNA, 20 bp, Homo sapiens
catctcagcctaccatgaga

SEQ ID NO: 3917792 - DNA, 16 bp, Homo sapiens
catctcaggtgccact

SEQ ID NO: 3917793 - DNA, 17 bp, Homo sapiens
catctcaggtgccactc

SEQ ID NO: 3917794 - DNA, 20 bp, Homo sapiens
catctcatttaatcctccct

SEQ ID NO: 3917795 - DNA, 17 bp, Homo sapiens
catctccatcttgaagg

SEQ ID NO: 3917796 - DNA, 13 bp, Homo sapiens
catctccatttca

SEQ ID NO: 3917797 - DNA, 15 bp, Homo sapiens
catctccccaggcct

SEQ ID NO: 3917798 - DNA, 17 bp, Homo sapiens
catctccccaggcctcc

SEQ ID NO: 3917799 - DNA, 18 bp, Homo sapiens
catctccccaggcctcca

SEQ ID NO: 3917800 - DNA, 20 bp, Homo sapiens
catctccccaggcctccagc

SEQ ID NO: 3917801 - DNA, 22 bp, Homo sapiens
catctccccaggcctccagcct

SEQ ID NO: 3917802 - DNA, 15 bp, Homo sapiens
catctcctctatcac

SEQ ID NO: 3917803 - DNA, 14 bp, Homo sapiens
catctcctgatttc

SEQ ID NO: 3917804 - DNA, 20 bp, Homo sapiens
catctctctggggccctggg

SEQ ID NO: 3917805 - DNA, 12 bp, Homo sapiens
catctctcttcc

SEQ ID NO: 3917806 - DNA, 14 bp, Homo sapiens
catctgaaagccac

SEQ ID NO: 3917807 - DNA, 12 bp, Homo sapiens
catctgactcac

SEQ ID NO: 3917808 - DNA, 18 bp, Homo sapiens
catctgactcacaagaag

SEQ ID NO: 3917809 - DNA, 16 bp, Homo sapiens
caggggtctccctgga

SEQ ID NO: 3917810 - DNA, 14 bp, Homo sapiens
caggggtctgagcc

SEQ ID NO: 3917811 - DNA, 15 bp, Homo sapiens
caggggtctgagcca

SEQ ID NO: 3917812 - DNA, 20 bp, Homo sapiens
caggggtgatttcagagagg

SEQ ID NO: 3917813 - DNA, 13 bp, Homo sapiens
caggggtgggaga

SEQ ID NO: 3917814 - DNA, 15 bp, Homo sapiens
caggggtgggagagc

SEQ ID NO: 3917815 - DNA, 16 bp, Homo sapiens
caggggtgggagagcc

SEQ ID NO: 3917816 - DNA, 21 bp, Homo sapiens
caggggtgggagagccagctc

SEQ ID NO: 3917817 - DNA, 22 bp, Homo sapiens
caggggtgggagagccagctct

SEQ ID NO: 3917818 - DNA, 23 bp, Homo sapiens
caggggtgggagagccagctctc

SEQ ID NO: 3917819 - DNA, 14 bp, Homo sapiens
cagggtgagagctg

SEQ ID NO: 3917820 - DNA, 21 bp, Homo sapiens
cagggtgcatggcttggggag

SEQ ID NO: 3917821 - DNA, 13 bp, Homo sapiens
cagggtgctgtgg

SEQ ID NO: 3917822 - DNA, 21 bp, Homo sapiens
cagggtggccccctgtgccag

SEQ ID NO: 3917823 - DNA, 23 bp, Homo sapiens
cagggtggccccctgtgccagct

SEQ ID NO: 3917824 - DNA, 17 bp, Homo sapiens
cagggtgggaagaaaga

SEQ ID NO: 3917825 - DNA, 17 bp, Homo sapiens
cagggtgggatggagga

SEQ ID NO: 3917826 - DNA, 18 bp, Homo sapiens
cagggtgggatggaggag

SEQ ID NO: 3917827 - DNA, 23 bp, Homo sapiens
cagggtgggccactctcccctcc

SEQ ID NO: 3917828 - DNA, 19 bp, Homo sapiens
cagggtttacccagtggga

SEQ ID NO: 3917829 - DNA, 17 bp, Homo sapiens
caggtaatgagggactg

SEQ ID NO: 3917830 - DNA, 17 bp, Homo sapiens
caggtacttcctcctga

SEQ ID NO: 3917831 - DNA, 22 bp, Homo sapiens
caggtagatcgcttgagcccag

SEQ ID NO: 3917832 - DNA, 23 bp, Homo sapiens
caggtaggcccttgtcctgccag

SEQ ID NO: 3917833 - DNA, 13 bp, Homo sapiens
caggtagtactgg

SEQ ID NO: 3917834 - DNA, 16 bp, Homo sapiens
caggtatctccaggat

SEQ ID NO: 3917835 - DNA, 19 bp, Homo sapiens
caggtcatctcctttcatc

SEQ ID NO: 3917836 - DNA, 13 bp, Homo sapiens
caggtcctgccca

SEQ ID NO: 3917837 - DNA, 21 bp, Homo sapiens
caggtcctggtggggcagctc

SEQ ID NO: 3917838 - DNA, 23 bp, Homo sapiens
caggtcctggtggggcagctcct

SEQ ID NO: 3917839 - DNA, 22 bp, Homo sapiens
caggtccttcctttaggtctgg

SEQ ID NO: 3917840 - DNA, 12 bp, Homo sapiens
caggtctcccac

SEQ ID NO: 3917841 - DNA, 13 bp, Homo sapiens
caggtctggggct

SEQ ID NO: 3917842 - DNA, 13 bp, Homo sapiens
caggtgaaaatgt

SEQ ID NO: 3917843 - DNA, 17 bp, Homo sapiens
caggtgaaaatgttcat

SEQ ID NO: 3917844 - DNA, 13 bp, Homo sapiens
caggtgcaagaga

SEQ ID NO: 3917845 - DNA, 16 bp, Homo sapiens
caggtgcaagagacag

SEQ ID NO: 3917846 - DNA, 17 bp, Homo sapiens
caggtgcaagagacaga

SEQ ID NO: 3917847 - DNA, 15 bp, Homo sapiens
caggtggctgaccca

SEQ ID NO: 3917848 - DNA, 13 bp, Homo sapiens
caggtgggagaga

SEQ ID NO: 3917849 - DNA, 15 bp, Homo sapiens
caggtgggagagaca

SEQ ID NO: 3917850 - DNA, 20 bp, Homo sapiens
caggtggtcctgagacctga

SEQ ID NO: 3917851 - DNA, 21 bp, Homo sapiens
caggtgtaaatatagtagcag

SEQ ID NO: 3917852 - DNA, 13 bp, Homo sapiens
caggtgtggtggc

SEQ ID NO: 3917853 - DNA, 14 bp, Homo sapiens
caggtgttgccatt

SEQ ID NO: 3917854 - DNA, 23 bp, Homo sapiens
caggtgttgccatttctctgctt

SEQ ID NO: 3917855 - DNA, 15 bp, Homo sapiens
caggttcccagcagc

SEQ ID NO: 3917856 - DNA, 16 bp, Homo sapiens
caggttcccagcagct

SEQ ID NO: 3917857 - DNA, 22 bp, Homo sapiens
caggttcccagcagctgggccg

SEQ ID NO: 3917858 - DNA, 15 bp, Homo sapiens
caggtttgccagtga

SEQ ID NO: 3917859 - DNA, 15 bp, Homo sapiens
caggttttgtaaaga

SEQ ID NO: 3917860 - DNA, 20 bp, Homo sapiens
cagtaaaaacttgtactatg

SEQ ID NO: 3917861 - DNA, 22 bp, Homo sapiens
cagtaaaaacttgtactatgtt

SEQ ID NO: 3917862 - DNA, 19 bp, Homo sapiens
cagtaaactttctctgcaa

SEQ ID NO: 3917863 - DNA, 15 bp, Homo sapiens
cagtaaagtttaaaa

SEQ ID NO: 3917864 - DNA, 18 bp, Homo sapiens
cagtaaagtttaaaaaat

SEQ ID NO: 3917865 - DNA, 14 bp, Homo sapiens
cagtaaataaattg

SEQ ID NO: 3917866 - DNA, 15 bp, Homo sapiens
cagtaaataaattgt

SEQ ID NO: 3917867 - DNA, 16 bp, Homo sapiens
cagtaaataaattgtt

SEQ ID NO: 3917868 - DNA, 14 bp, Homo sapiens
cagtaaatccacag

SEQ ID NO: 3917869 - DNA, 22 bp, Homo sapiens
cagtaaatccacagccaacaaa

SEQ ID NO: 3917870 - DNA, 18 bp, Homo sapiens
cagtaagtatctggagga

SEQ ID NO: 3917871 - DNA, 13 bp, Homo sapiens
cagtacctgggaa

SEQ ID NO: 3917872 - DNA, 18 bp, Homo sapiens
cagtacctgggaaaggac

SEQ ID NO: 3917873 - DNA, 21 bp, Homo sapiens
cagtacctgggaaaggaccca

SEQ ID NO: 3917874 - DNA, 12 bp, Homo sapiens
cagtacttctaa

SEQ ID NO: 3917875 - DNA, 19 bp, Homo sapiens
cagtagacaatccccacat

SEQ ID NO: 3917876 - DNA, 23 bp, Homo sapiens
cagtagaggcatgaacacacatg

SEQ ID NO: 3917877 - DNA, 15 bp, Homo sapiens
cagtagcttaaataa

SEQ ID NO: 3917878 - DNA, 16 bp, Homo sapiens
cagtagcttaaataaa

SEQ ID NO: 3917879 - DNA, 19 bp, Homo sapiens
cagtaggtccaagggccat

SEQ ID NO: 3917880 - DNA, 16 bp, Homo sapiens
cagtagtctctgtgct

SEQ ID NO: 3917881 - DNA, 17 bp, Homo sapiens
cagtagtctctgtgctt

SEQ ID NO: 3917882 - DNA, 16 bp, Homo sapiens
cagtataaaagacaaa

SEQ ID NO: 3917883 - DNA, 22 bp, Homo sapiens
cagtatatttatagtcacaaga

SEQ ID NO: 3917884 - DNA, 14 bp, Homo sapiens
cagtatatttgaaa

SEQ ID NO: 3917885 - DNA, 16 bp, Homo sapiens
cagtatccactttgca

SEQ ID NO: 3917886 - DNA, 21 bp, Homo sapiens
cagtatgaatgatgttttaga

SEQ ID NO: 3917887 - DNA, 20 bp, Homo sapiens
cagtattaatactaaaatat

SEQ ID NO: 3917888 - DNA, 22 bp, Homo sapiens
cagtattaatactaaaatatgt

SEQ ID NO: 3917889 - DNA, 18 bp, Homo sapiens
cagtattattgagctcta

SEQ ID NO: 3917890 - DNA, 16 bp, Homo sapiens
cagtattcttgtcaaa

SEQ ID NO: 3917891 - DNA, 19 bp, Homo sapiens
cagtattcttgtcaaaaaa

SEQ ID NO: 3917892 - DNA, 13 bp, Homo sapiens
cagtattgccaca

SEQ ID NO: 3917893 - DNA, 21 bp, Homo sapiens
cagtattgccacaatgcctct

SEQ ID NO: 3917894 - DNA, 19 bp, Homo sapiens
cagtatttgtacaaatact

SEQ ID NO: 3917895 - DNA, 11 bp, Homo sapiens
cagtattttat

SEQ ID NO: 3917896 - DNA, 18 bp, Homo sapiens
cagtattttattaaagca

SEQ ID NO: 3917897 - DNA, 17 bp, Homo sapiens
cagtattttggagaaat

SEQ ID NO: 3917898 - DNA, 16 bp, Homo sapiens
cagtcacccttctggg

SEQ ID NO: 3917899 - DNA, 15 bp, Homo sapiens
cagtcagttcccgga

SEQ ID NO: 3917900 - DNA, 17 bp, Homo sapiens
cagtcagttcccggagc

SEQ ID NO: 3917901 - DNA, 19 bp, Homo sapiens
cagtcagttcccggagcac

SEQ ID NO: 3917902 - DNA, 20 bp, Homo sapiens
cagtcagttcccggagcaca

SEQ ID NO: 3917903 - DNA, 16 bp, Homo sapiens
cagtccagaataagtg

SEQ ID NO: 3917904 - DNA, 19 bp, Homo sapiens
cagtccagaataagtgctg

SEQ ID NO: 3917905 - DNA, 17 bp, Homo sapiens
cagtccccagcccttct

SEQ ID NO: 3917906 - DNA, 11 bp, Homo sapiens
cagtccccagt

SEQ ID NO: 3917907 - DNA, 23 bp, Homo sapiens
cagtccccgtgaaggagagccct

SEQ ID NO: 3917908 - DNA, 18 bp, Homo sapiens
cagtccccgtgccccgcc

SEQ ID NO: 3917909 - DNA, 21 bp, Homo sapiens
cagtccctgggggaagccctg

SEQ ID NO: 3917910 - DNA, 19 bp, Homo sapiens
cagtccgccaaacactcca

SEQ ID NO: 3917911 - DNA, 14 bp, Homo sapiens
cagtcctagagctc

SEQ ID NO: 3917912 - DNA, 16 bp, Homo sapiens
cagtcctagagctcct

SEQ ID NO: 3917913 - DNA, 19 bp, Homo sapiens
cagtcctagagctcctgtc

SEQ ID NO: 3917914 - DNA, 19 bp, Homo sapiens
cagtcctcacagcctctcc

SEQ ID NO: 3917915 - DNA, 20 bp, Homo sapiens
cagtcctcacagcctctccc

SEQ ID NO: 3917916 - DNA, 21 bp, Homo sapiens
cagtcgcaggatccgctgcca

SEQ ID NO: 3917917 - DNA, 17 bp, Homo sapiens
cagtctcagtccagatg

SEQ ID NO: 3917918 - DNA, 16 bp, Homo sapiens
cagtctctctctccct

SEQ ID NO: 3917919 - DNA, 15 bp, Homo sapiens
cagtctgatctgtga

SEQ ID NO: 3917920 - DNA, 15 bp, Homo sapiens
cagtctggcctgggc

SEQ ID NO: 3917921 - DNA, 21 bp, Homo sapiens
cagtctgttccccatggccac

SEQ ID NO: 3917922 - DNA, 18 bp, Homo sapiens
cagtcttgcctaggccaa

SEQ ID NO: 3917923 - DNA, 14 bp, Homo sapiens
cagtgaaccaaaga

SEQ ID NO: 3917924 - DNA, 20 bp, Homo sapiens
cagtgaacttacacttggag

SEQ ID NO: 3917925 - DNA, 17 bp, Homo sapiens
cagtgaagacttcttgg

SEQ ID NO: 3917926 - DNA, 22 bp, Homo sapiens
cagtgaatagtaacaataaata

SEQ ID NO: 3917927 - DNA, 20 bp, Homo sapiens
cagtgaattgacccatgttc

SEQ ID NO: 3917928 - DNA, 18 bp, Homo sapiens
cagtgacaaattgtaact

SEQ ID NO: 3917929 - DNA, 14 bp, Homo sapiens
cagtgacaagtgga

SEQ ID NO: 3917930 - DNA, 14 bp, Homo sapiens
cagtgacctgaccg

SEQ ID NO: 3917931 - DNA, 15 bp, Homo sapiens
cagtgacctgaccgg

SEQ ID NO: 3917932 - DNA, 21 bp, Homo sapiens
cagtgacctgaccggcacctg

SEQ ID NO: 3917933 - DNA, 13 bp, Homo sapiens
cagtgactggcag

SEQ ID NO: 3917934 - DNA, 18 bp, Homo sapiens
cagtgactggcaggtgca

SEQ ID NO: 3917935 - DNA, 17 bp, Homo sapiens
cagtgactttacaggag

SEQ ID NO: 3917936 - DNA, 21 bp, Homo sapiens
cagtgagaaaaagctcctgtc

SEQ ID NO: 3917937 - DNA, 22 bp, Homo sapiens
cagtgagaaaaagctcctgtcc

SEQ ID NO: 3917938 - DNA, 18 bp, Homo sapiens
cagtgagacacagagtgg

SEQ ID NO: 3917939 - DNA, 19 bp, Homo sapiens
cagtgagacacagagtgga

SEQ ID NO: 3917940 - DNA, 19 bp, Homo sapiens
cagtgagccgcatcttctc

SEQ ID NO: 3917941 - DNA, 13 bp, Homo sapiens
cagtgagctgaga

SEQ ID NO: 3917942 - DNA, 21 bp, Homo sapiens
cagtgaggagggtggaggaag

SEQ ID NO: 3917943 - DNA, 19 bp, Homo sapiens
cagtgagggctgggcccac

SEQ ID NO: 3917944 - DNA, 15 bp, Homo sapiens
cagtgagtcctcctc

SEQ ID NO: 3917945 - DNA, 19 bp, Homo sapiens
cagtgagtcctcctcttcc

SEQ ID NO: 3917946 - DNA, 14 bp, Homo sapiens
cagtgatgtgctgg

SEQ ID NO: 3917947 - DNA, 21 bp, Homo sapiens
cagtgatgtgctggagctggc

SEQ ID NO: 3917948 - DNA, 19 bp, Homo sapiens
cagtgcaagagactctggc

SEQ ID NO: 3917949 - DNA, 22 bp, Homo sapiens
cagtgcaagagactctggcctc

SEQ ID NO: 3917950 - DNA, 23 bp, Homo sapiens
cagtgcacacggatgcacagaga

SEQ ID NO: 3917951 - DNA, 17 bp, Homo sapiens
cagtgcagtgatacatg

SEQ ID NO: 3917952 - DNA, 12 bp, Homo sapiens
cagtgcatctca

SEQ ID NO: 3917953 - DNA, 15 bp, Homo sapiens
cagtgcatctcagcc

SEQ ID NO: 3917954 - DNA, 16 bp, Homo sapiens
cagtgcatctcagccc

SEQ ID NO: 3917955 - DNA, 14 bp, Homo sapiens
cagtgccacagaga

SEQ ID NO: 3917956 - DNA, 16 bp, Homo sapiens
cagtgccacagagaag

SEQ ID NO: 3917957 - DNA, 21 bp, Homo sapiens
cagtgccacttgacattcctt

SEQ ID NO: 3917958 - DNA, 16 bp, Homo sapiens
cagtgcctcctggccg

SEQ ID NO: 3917959 - DNA, 19 bp, Homo sapiens
cagtgcctcctgggaccat

SEQ ID NO: 3917960 - DNA, 14 bp, Homo sapiens
cagtgcctggcaag

SEQ ID NO: 3917961 - DNA, 17 bp, Homo sapiens
cagtgccttacctcctg

SEQ ID NO: 3917962 - DNA, 18 bp, Homo sapiens
cagtgccttacctcctgc

SEQ ID NO: 3917963 - DNA, 20 bp, Homo sapiens
cagtgccttacctcctgccc

SEQ ID NO: 3917964 - DNA, 22 bp, Homo sapiens
cagtgctctcctaccccacctc

SEQ ID NO: 3917965 - DNA, 13 bp, Homo sapiens
cagtgctgccatg

SEQ ID NO: 3917966 - DNA, 15 bp, Homo sapiens
cagtgctgccatgcc

SEQ ID NO: 3917967 - DNA, 16 bp, Homo sapiens
cagtgctgccatgcca

SEQ ID NO: 3917968 - DNA, 18 bp, Homo sapiens
cagtgctgccatgccact

SEQ ID NO: 3917969 - DNA, 20 bp, Homo sapiens
cagtgctgccatgccactgc

SEQ ID NO: 3917970 - DNA, 23 bp, Homo sapiens
cagtgctgccatgccactgccag

SEQ ID NO: 3917971 - DNA, 13 bp, Homo sapiens
cagtgctgccctg

SEQ ID NO: 3917972 - DNA, 16 bp, Homo sapiens
cagtgctgccctgcga

SEQ ID NO: 3917973 - DNA, 11 bp, Homo sapiens
cagtgctgctt

SEQ ID NO: 3917974 - DNA, 15 bp, Homo sapiens
cagtgctgtacttga

SEQ ID NO: 3917975 - DNA, 12 bp, Homo sapiens
cagtggaaattt

SEQ ID NO: 3917976 - DNA, 14 bp, Homo sapiens
cagtggagaattat

SEQ ID NO: 3917977 - DNA, 11 bp, Homo sapiens
cagtggagtga

SEQ ID NO: 3917978 - DNA, 18 bp, Homo sapiens
cagtggatcatgaaaagt

SEQ ID NO: 3917979 - DNA, 22 bp, Homo sapiens
cagtggccgcaagcgcagggag

SEQ ID NO: 3917980 - DNA, 14 bp, Homo sapiens
cagtggcgagagga

SEQ ID NO: 3917981 - DNA, 13 bp, Homo sapiens
cctgggcagaaag

SEQ ID NO: 3917982 - DNA, 23 bp, Homo sapiens
cctgggccaaaagggcagccagg

SEQ ID NO: 3917983 - DNA, 13 bp, Homo sapiens
cctgggccagaga

SEQ ID NO: 3917984 - DNA, 19 bp, Homo sapiens
cctgggcccaggctctggg

SEQ ID NO: 3917985 - DNA, 18 bp, Homo sapiens
cctgggccctggggcctg

SEQ ID NO: 3917986 - DNA, 21 bp, Homo sapiens
cctgggcctatggagagccct

SEQ ID NO: 3917987 - DNA, 23 bp, Homo sapiens
cctgggcctatggagagccctgg

SEQ ID NO: 3917988 - DNA, 14 bp, Homo sapiens
cctgggcctcagtt

SEQ ID NO: 3917989 - DNA, 22 bp, Homo sapiens
cctgggcctcagttcaacctgg

SEQ ID NO: 3917990 - DNA, 18 bp, Homo sapiens
cctgggcctgctgctgag

SEQ ID NO: 3917991 - DNA, 20 bp, Homo sapiens
cctgggcctgctgctgagaa

SEQ ID NO: 3917992 - DNA, 13 bp, Homo sapiens
cctgggcctgctt

SEQ ID NO: 3917993 - DNA, 21 bp, Homo sapiens
cctgggcctgcttttccagga

SEQ ID NO: 3917994 - DNA, 15 bp, Homo sapiens
cctgggcctgtgcag

SEQ ID NO: 3917995 - DNA, 12 bp, Homo sapiens
cctggggccccg

SEQ ID NO: 3917996 - DNA, 16 bp, Homo sapiens
cctggggcctgtactg

SEQ ID NO: 3917997 - DNA, 20 bp, Homo sapiens
cctggggcctgtactgcctg

SEQ ID NO: 3917998 - DNA, 21 bp, Homo sapiens
cctggggctcctttctccagc

SEQ ID NO: 3917999 - DNA, 12 bp, Homo sapiens
cctggggctcta

SEQ ID NO: 3918000 - DNA, 20 bp, Homo sapiens
cctggggctctaacgcctga

SEQ ID NO: 3918001 - DNA, 17 bp, Homo sapiens
cctgggggaagccctgg

SEQ ID NO: 3918002 - DNA, 19 bp, Homo sapiens
cctgggggaagccctggat

SEQ ID NO: 3918003 - DNA, 19 bp, Homo sapiens
cctgggggcagggagagga

SEQ ID NO: 3918004 - DNA, 19 bp, Homo sapiens
cctgggggcagtgactggc

SEQ ID NO: 3918005 - DNA, 21 bp, Homo sapiens
cctgggggcagtgactggcag

SEQ ID NO: 3918006 - DNA, 22 bp, Homo sapiens
cctgggggcagtgactggcagg

SEQ ID NO: 3918007 - DNA, 23 bp, Homo sapiens
cctgggggcagtgactggcaggt

SEQ ID NO: 3918008 - DNA, 12 bp, Homo sapiens
cctgggggccag

SEQ ID NO: 3918009 - DNA, 18 bp, Homo sapiens
cctgggggccagctggtg

SEQ ID NO: 3918010 - DNA, 19 bp, Homo sapiens
cctgggggccagctggtgc

SEQ ID NO: 3918011 - DNA, 17 bp, Homo sapiens
cctgggggcctggctgg

SEQ ID NO: 3918012 - DNA, 14 bp, Homo sapiens
cctgggggtggcag

SEQ ID NO: 3918013 - DNA, 22 bp, Homo sapiens
cctggggtccttgctgcaggcc

SEQ ID NO: 3918014 - DNA, 15 bp, Homo sapiens
cctggggtgacccgg

SEQ ID NO: 3918015 - DNA, 18 bp, Homo sapiens
cctggggtgacccggcac

SEQ ID NO: 3918016 - DNA, 21 bp, Homo sapiens
cctgggtgagaatcctgcctc

SEQ ID NO: 3918017 - DNA, 22 bp, Homo sapiens
cctgggtgccattcccagcgtt

SEQ ID NO: 3918018 - DNA, 14 bp, Homo sapiens
cctgggtggctact

SEQ ID NO: 3918019 - DNA, 19 bp, Homo sapiens
cctgggtggctactctgtg

SEQ ID NO: 3918020 - DNA, 20 bp, Homo sapiens
cctgggtggctactctgtgc

SEQ ID NO: 3918021 - DNA, 21 bp, Homo sapiens
cctgggtggctactctgtgcc

SEQ ID NO: 3918022 - DNA, 22 bp, Homo sapiens
cctgggtggggctgctcctcca

SEQ ID NO: 3918023 - DNA, 13 bp, Homo sapiens
cctgggttttcta

SEQ ID NO: 3918024 - DNA, 18 bp, Homo sapiens
cctgggttttctaactgt

SEQ ID NO: 3918025 - DNA, 19 bp, Homo sapiens
cctgggttttctaactgta

SEQ ID NO: 3918026 - DNA, 16 bp, Homo sapiens
cctggtacagcagggt

SEQ ID NO: 3918027 - DNA, 18 bp, Homo sapiens
cctggtagaattgggaag

SEQ ID NO: 3918028 - DNA, 23 bp, Homo sapiens
cctggtcacaggactctgcctcc

SEQ ID NO: 3918029 - DNA, 19 bp, Homo sapiens
cctggtccctcgtccacag

SEQ ID NO: 3918030 - DNA, 22 bp, Homo sapiens
cctggtctgtgctgccctgctc

SEQ ID NO: 3918031 - DNA, 16 bp, Homo sapiens
cctggtctttcctctg

SEQ ID NO: 3918032 - DNA, 20 bp, Homo sapiens
cctggtgaggcccagcctgt

SEQ ID NO: 3918033 - DNA, 14 bp, Homo sapiens
cctggtgatcacgt

SEQ ID NO: 3918034 - DNA, 15 bp, Homo sapiens
cctggtgcagaggtg

SEQ ID NO: 3918035 - DNA, 16 bp, Homo sapiens
cctggtgcttctcctc

SEQ ID NO: 3918036 - DNA, 13 bp, Homo sapiens
cctggtggcacca

SEQ ID NO: 3918037 - DNA, 15 bp, Homo sapiens
cctggtggcaccaga

SEQ ID NO: 3918038 - DNA, 18 bp, Homo sapiens
cctggtggcaccagatgc

SEQ ID NO: 3918039 - DNA, 23 bp, Homo sapiens
cctggtggcaccagatgcaacct

SEQ ID NO: 3918040 - DNA, 16 bp, Homo sapiens
cctggtggggcagctc

SEQ ID NO: 3918041 - DNA, 21 bp, Homo sapiens
cctggtggggcagctcctctg

SEQ ID NO: 3918042 - DNA, 23 bp, Homo sapiens
cctggtggggcagctcctctgtc

SEQ ID NO: 3918043 - DNA, 16 bp, Homo sapiens
cctggtgtcaggcagg

SEQ ID NO: 3918044 - DNA, 13 bp, Homo sapiens
cctggtgtgaggc

SEQ ID NO: 3918045 - DNA, 21 bp, Homo sapiens
cctggtgtgaggctgggccag

SEQ ID NO: 3918046 - DNA, 18 bp, Homo sapiens
cctgtaaagggtcagggt

SEQ ID NO: 3918047 - DNA, 18 bp, Homo sapiens
cctgtaacacaagccaca

SEQ ID NO: 3918048 - DNA, 18 bp, Homo sapiens
cctgtaatcccagcactt

SEQ ID NO: 3918049 - DNA, 15 bp, Homo sapiens
cctgtaatcccagct

SEQ ID NO: 3918050 - DNA, 14 bp, Homo sapiens
cctgtacccagctc

SEQ ID NO: 3918051 - DNA, 15 bp, Homo sapiens
cctgtacccagctcc

SEQ ID NO: 3918052 - DNA, 16 bp, Homo sapiens
cctgtacccagctcct

SEQ ID NO: 3918053 - DNA, 17 bp, Homo sapiens
cctgtacccagctcctt

SEQ ID NO: 3918054 - DNA, 14 bp, Homo sapiens
cctgtaccccagca

SEQ ID NO: 3918055 - DNA, 13 bp, Homo sapiens
cctgtactgcctg

SEQ ID NO: 3918056 - DNA, 15 bp, Homo sapiens
cctgtactgcctgct

SEQ ID NO: 3918057 - DNA, 20 bp, Homo sapiens
cctgtactgggttatttttg

SEQ ID NO: 3918058 - DNA, 13 bp, Homo sapiens
cctgtagcagtga

SEQ ID NO: 3918059 - DNA, 16 bp, Homo sapiens
cctgtagctctgcctc

SEQ ID NO: 3918060 - DNA, 13 bp, Homo sapiens
cctgtaggttgct

SEQ ID NO: 3918061 - DNA, 13 bp, Homo sapiens
cctgtagtgagaa

SEQ ID NO: 3918062 - DNA, 16 bp, Homo sapiens
cctgtagtgccccctc

SEQ ID NO: 3918063 - DNA, 23 bp, Homo sapiens
cctgtagtgccccctctaacccc

SEQ ID NO: 3918064 - DNA, 17 bp, Homo sapiens
cctgtagttaggaaata

SEQ ID NO: 3918065 - DNA, 17 bp, Homo sapiens
cctgtatagacagcact

SEQ ID NO: 3918066 - DNA, 17 bp, Homo sapiens
cctgtatattatggtgt

SEQ ID NO: 3918067 - DNA, 19 bp, Homo sapiens
cctgtatttgttcccaaga

SEQ ID NO: 3918068 - DNA, 22 bp, Homo sapiens
cctgtatttgttcccaagagca

SEQ ID NO: 3918069 - DNA, 12 bp, Homo sapiens
cctgtcagaggc

SEQ ID NO: 3918070 - DNA, 13 bp, Homo sapiens
cctgtcagaggct

SEQ ID NO: 3918071 - DNA, 16 bp, Homo sapiens
cctgtcagaggctaag

SEQ ID NO: 3918072 - DNA, 20 bp, Homo sapiens
cctgtcatggtgtccagaca

SEQ ID NO: 3918073 - DNA, 19 bp, Homo sapiens
cctgtccaacctaacccct

SEQ ID NO: 3918074 - DNA, 17 bp, Homo sapiens
cctgtccacctcaccag

SEQ ID NO: 3918075 - DNA, 20 bp, Homo sapiens
cctgtcccaccaactctgca

SEQ ID NO: 3918076 - DNA, 14 bp, Homo sapiens
cctgtcccacctct

SEQ ID NO: 3918077 - DNA, 15 bp, Homo sapiens
cctgtcccccaaggt

SEQ ID NO: 3918078 - DNA, 20 bp, Homo sapiens
cctgtcccctgaaaaactga

SEQ ID NO: 3918079 - DNA, 14 bp, Homo sapiens
cctgtcccgccttc

SEQ ID NO: 3918080 - DNA, 16 bp, Homo sapiens
cctgtcccgccttcct

SEQ ID NO: 3918081 - DNA, 17 bp, Homo sapiens
cctgtccctacccactc

SEQ ID NO: 3918082 - DNA, 19 bp, Homo sapiens
cctgtccctacccactctt

SEQ ID NO: 3918083 - DNA, 22 bp, Homo sapiens
cctgtcctcaaaataaggggca

SEQ ID NO: 3918084 - DNA, 21 bp, Homo sapiens
cctgtcctcccatcccctgga

SEQ ID NO: 3918085 - DNA, 22 bp, Homo sapiens
cctgtcctcccatcccctggac

SEQ ID NO: 3918086 - DNA, 23 bp, Homo sapiens
cctgtcctcctcggatcaccgag

SEQ ID NO: 3918087 - DNA, 20 bp, Homo sapiens
cctgtcgagacacttgcctt

SEQ ID NO: 3918088 - DNA, 13 bp, Homo sapiens
cctgtctctgcct

SEQ ID NO: 3918089 - DNA, 19 bp, Homo sapiens
cctgtctgtcgctgggctg

SEQ ID NO: 3918090 - DNA, 20 bp, Homo sapiens
cctgtctgtcgctgggctgt

SEQ ID NO: 3918091 - DNA, 22 bp, Homo sapiens
cctgtctgtcgctgggctgtgg

SEQ ID NO: 3918092 - DNA, 21 bp, Homo sapiens
cctgtctgtctgtctgtccca

SEQ ID NO: 3918093 - DNA, 22 bp, Homo sapiens
cctgtctgtctgtctgtcccaa

SEQ ID NO: 3918094 - DNA, 17 bp, Homo sapiens
cctgtgaacccaggaca

SEQ ID NO: 3918095 - DNA, 20 bp, Homo sapiens
cctgtgaataaaaaccctgt

SEQ ID NO: 3918096 - DNA, 20 bp, Homo sapiens
cctgtgaggtaactgggatc

SEQ ID NO: 3918097 - DNA, 15 bp, Homo sapiens
cctgtgcagcagccc

SEQ ID NO: 3918098 - DNA, 17 bp, Homo sapiens
cctgtgcagcagcccag

SEQ ID NO: 3918099 - DNA, 23 bp, Homo sapiens
cctgtgcagcagcccagcttcct

SEQ ID NO: 3918100 - DNA, 20 bp, Homo sapiens
cctgtgcccctcagagaggc

SEQ ID NO: 3918101 - DNA, 22 bp, Homo sapiens
cctgtgcccctcagagaggcat

SEQ ID NO: 3918102 - DNA, 15 bp, Homo sapiens
cctgtgcctcctcac

SEQ ID NO: 3918103 - DNA, 17 bp, Homo sapiens
cctgtgctactttgcct

SEQ ID NO: 3918104 - DNA, 13 bp, Homo sapiens
cctgtgctctgga

SEQ ID NO: 3918105 - DNA, 18 bp, Homo sapiens
cctgtgctctggaggctg

SEQ ID NO: 3918106 - DNA, 22 bp, Homo sapiens
ccttcgtgtctctcccaccccg

SEQ ID NO: 3918107 - DNA, 15 bp, Homo sapiens
ccttctatgcagtat

SEQ ID NO: 3918108 - DNA, 16 bp, Homo sapiens
ccttctctatatcatg

SEQ ID NO: 3918109 - DNA, 15 bp, Homo sapiens
ccttctctccttccc

SEQ ID NO: 3918110 - DNA, 18 bp, Homo sapiens
ccttctctccttccctct

SEQ ID NO: 3918111 - DNA, 14 bp, Homo sapiens
ccttctggttgctt

SEQ ID NO: 3918112 - DNA, 16 bp, Homo sapiens
ccttctggttgcttca

SEQ ID NO: 3918113 - DNA, 18 bp, Homo sapiens
ccttctgtttccatagga

SEQ ID NO: 3918114 - DNA, 18 bp, Homo sapiens
ccttcttattctcactcc

SEQ ID NO: 3918115 - DNA, 14 bp, Homo sapiens
ccttcttcacccag

SEQ ID NO: 3918116 - DNA, 21 bp, Homo sapiens
ccttcttggcttctgggacct

SEQ ID NO: 3918117 - DNA, 14 bp, Homo sapiens
ccttctttaaatca

SEQ ID NO: 3918118 - DNA, 16 bp, Homo sapiens
ccttctttaaatcaaa

SEQ ID NO: 3918119 - DNA, 18 bp, Homo sapiens
ccttctttaaatcaaaag

SEQ ID NO: 3918120 - DNA, 23 bp, Homo sapiens
ccttctttaaatcaaaagctgct

SEQ ID NO: 3918121 - DNA, 16 bp, Homo sapiens
ccttctttctcttccc

SEQ ID NO: 3918122 - DNA, 12 bp, Homo sapiens
ccttgaaaaaaa

SEQ ID NO: 3918123 - DNA, 20 bp, Homo sapiens
ccttgacgtcaagtctcctt

SEQ ID NO: 3918124 - DNA, 14 bp, Homo sapiens
ccttgagacctcag

SEQ ID NO: 3918125 - DNA, 17 bp, Homo sapiens
ccttgagacctcagcca

SEQ ID NO: 3918126 - DNA, 18 bp, Homo sapiens
ccttgcacactcagaagc

SEQ ID NO: 3918127 - DNA, 13 bp, Homo sapiens
ccttgcacccctc

SEQ ID NO: 3918128 - DNA, 14 bp, Homo sapiens
ccttgcacccctca

SEQ ID NO: 3918129 - DNA, 13 bp, Homo sapiens
ccttgcacctgca

SEQ ID NO: 3918130 - DNA, 16 bp, Homo sapiens
ccttgcacctgcatcc

SEQ ID NO: 3918131 - DNA, 10 bp, Homo sapiens
ccttgcagca

SEQ ID NO: 3918132 - DNA, 23 bp, Homo sapiens
ccttgccaaattccatgtccctg

SEQ ID NO: 3918133 - DNA, 16 bp, Homo sapiens
ccttgccaagctttct

SEQ ID NO: 3918134 - DNA, 11 bp, Homo sapiens
ccttgcccaga

SEQ ID NO: 3918135 - DNA, 14 bp, Homo sapiens
ccttgcccagagat

SEQ ID NO: 3918136 - DNA, 23 bp, Homo sapiens
ccttgcccagagatgcctccacc

SEQ ID NO: 3918137 - DNA, 20 bp, Homo sapiens
ccttgcccccatccctcgga

SEQ ID NO: 3918138 - DNA, 18 bp, Homo sapiens
ccttgcccttgccctgac

SEQ ID NO: 3918139 - DNA, 18 bp, Homo sapiens
ccttgccttttaaaagaa

SEQ ID NO: 3918140 - DNA, 18 bp, Homo sapiens
ccttgctcaccaagctgt

SEQ ID NO: 3918141 - DNA, 18 bp, Homo sapiens
ccttgctcagtgcctcct

SEQ ID NO: 3918142 - DNA, 18 bp, Homo sapiens
ccttgctcgctgtaaaat

SEQ ID NO: 3918143 - DNA, 19 bp, Homo sapiens
ccttgctcttctttctgag

SEQ ID NO: 3918144 - DNA, 13 bp, Homo sapiens
ccttgctgctgcc

SEQ ID NO: 3918145 - DNA, 22 bp, Homo sapiens
ccttgctggacggggactgggg

SEQ ID NO: 3918146 - DNA, 15 bp, Homo sapiens
ccttggaagtttcat

SEQ ID NO: 3918147 - DNA, 15 bp, Homo sapiens
ccttggactcatttt

SEQ ID NO: 3918148 - DNA, 13 bp, Homo sapiens
ccttggacttgag

SEQ ID NO: 3918149 - DNA, 16 bp, Homo sapiens
ccttggagagacacag

SEQ ID NO: 3918150 - DNA, 17 bp, Homo sapiens
ccttggagagacacagc

SEQ ID NO: 3918151 - DNA, 17 bp, Homo sapiens
ccttggagagcagctgg

SEQ ID NO: 3918152 - DNA, 13 bp, Homo sapiens
ccttggagcctga

SEQ ID NO: 3918153 - DNA, 17 bp, Homo sapiens
cctgctgctgagaacct

SEQ ID NO: 3918154 - DNA, 14 bp, Homo sapiens
cctgctggcacctc

SEQ ID NO: 3918155 - DNA, 21 bp, Homo sapiens
cctgctgggaaccccgcagcc

SEQ ID NO: 3918156 - DNA, 16 bp, Homo sapiens
cctgctgggctctcca

SEQ ID NO: 3918157 - DNA, 19 bp, Homo sapiens
cctgctgggctctccacct

SEQ ID NO: 3918158 - DNA, 22 bp, Homo sapiens
cctgctgggctctccacctcag

SEQ ID NO: 3918159 - DNA, 14 bp, Homo sapiens
cctgctgtggcctc

SEQ ID NO: 3918160 - DNA, 20 bp, Homo sapiens
cctgctgtggcctcacttcc

SEQ ID NO: 3918161 - DNA, 14 bp, Homo sapiens
cctgcttacctgac

SEQ ID NO: 3918162 - DNA, 15 bp, Homo sapiens
cctgcttgtccctgc

SEQ ID NO: 3918163 - DNA, 18 bp, Homo sapiens
cctgctttgaggacaaag

SEQ ID NO: 3918164 - DNA, 20 bp, Homo sapiens
cctgctttgggctgccctgg

SEQ ID NO: 3918165 - DNA, 23 bp, Homo sapiens
cctgcttttccaggatcctgcag

SEQ ID NO: 3918166 - DNA, 19 bp, Homo sapiens
cctggaaaggggagttgag

SEQ ID NO: 3918167 - DNA, 22 bp, Homo sapiens
cctggaaatatcagttactcag

SEQ ID NO: 3918168 - DNA, 15 bp, Homo sapiens
cctggaaccagggag

SEQ ID NO: 3918169 - DNA, 13 bp, Homo sapiens
cctggaagctgtg

SEQ ID NO: 3918170 - DNA, 18 bp, Homo sapiens
cctggaagctgtgtcctt

SEQ ID NO: 3918171 - DNA, 23 bp, Homo sapiens
cctggaagctgtgtccttgcacc

SEQ ID NO: 3918172 - DNA, 13 bp, Homo sapiens
cctggaagggcta

SEQ ID NO: 3918173 - DNA, 24 bp, Homo sapiens
cctggaagggctagaacctgtaga

SEQ ID NO: 3918174 - DNA, 18 bp, Homo sapiens
cctggaatcaaggaatcc

SEQ ID NO: 3918175 - DNA, 23 bp, Homo sapiens
cctggaattcagcaccctgggtg

SEQ ID NO: 3918176 - DNA, 13 bp, Homo sapiens
cctggacagctgt

SEQ ID NO: 3918177 - DNA, 14 bp, Homo sapiens
cctggacagctgtg

SEQ ID NO: 3918178 - DNA, 16 bp, Homo sapiens
cctggacagctgtgcc

SEQ ID NO: 3918179 - DNA, 19 bp, Homo sapiens
cctggacagctgtgcctcg

SEQ ID NO: 3918180 - DNA, 20 bp, Homo sapiens
cctggacagctgtgcctcgc

SEQ ID NO: 3918181 - DNA, 21 bp, Homo sapiens
cctggacagctgtgcctcgct

SEQ ID NO: 3918182 - DNA, 20 bp, Homo sapiens
cctggacatttgccttgctg

SEQ ID NO: 3918183 - DNA, 18 bp, Homo sapiens
cctggaccgcttcccaga

SEQ ID NO: 3918184 - DNA, 20 bp, Homo sapiens
cctggactctaagctggagc

SEQ ID NO: 3918185 - DNA, 21 bp, Homo sapiens
cctggactctaagctggagct

SEQ ID NO: 3918186 - DNA, 13 bp, Homo sapiens
cctggactgggag

SEQ ID NO: 3918187 - DNA, 17 bp, Homo sapiens
cctggactgggaggtag

SEQ ID NO: 3918188 - DNA, 22 bp, Homo sapiens
cctggagagccagaacctggag

SEQ ID NO: 3918189 - DNA, 13 bp, Homo sapiens
cctggagagctag

SEQ ID NO: 3918190 - DNA, 12 bp, Homo sapiens
cctggagagggg

SEQ ID NO: 3918191 - DNA, 13 bp, Homo sapiens
cctggagaggggc

SEQ ID NO: 3918192 - DNA, 15 bp, Homo sapiens
cctggagaggggcct

SEQ ID NO: 3918193 - DNA, 21 bp, Homo sapiens
cctggagatgacttgaggcct

SEQ ID NO: 3918194 - DNA, 13 bp, Homo sapiens
cctggagatgatg

SEQ ID NO: 3918195 - DNA, 14 bp, Homo sapiens
cctggagatgatga

SEQ ID NO: 3918196 - DNA, 15 bp, Homo sapiens
cctggaggacctgag

SEQ ID NO: 3918197 - DNA, 21 bp, Homo sapiens
cctggaggacctgagcctgcc

SEQ ID NO: 3918198 - DNA, 19 bp, Homo sapiens
cctggaggatccctccatc

SEQ ID NO: 3918199 - DNA, 20 bp, Homo sapiens
cctggaggatccctccatcc

SEQ ID NO: 3918200 - DNA, 12 bp, Homo sapiens
cctggaggatga

SEQ ID NO: 3918201 - DNA, 21 bp, Homo sapiens
cctggagggctagaacctgga

SEQ ID NO: 3918202 - DNA, 23 bp, Homo sapiens
cctggagggctagaacctggaga

SEQ ID NO: 3918203 - DNA, 22 bp, Homo sapiens
cctggaggggctagaacctaga

SEQ ID NO: 3918204 - DNA, 18 bp, Homo sapiens
cctggaggggctgaatgt

SEQ ID NO: 3918205 - DNA, 15 bp, Homo sapiens
cctggagtataatat

SEQ ID NO: 3918206 - DNA, 17 bp, Homo sapiens
cctggagtctcttggtg

SEQ ID NO: 3918207 - DNA, 17 bp, Homo sapiens
cctggatcagcgtggcc

SEQ ID NO: 3918208 - DNA, 16 bp, Homo sapiens
cctggatgggcattgg

SEQ ID NO: 3918209 - DNA, 20 bp, Homo sapiens
cctggatgtcccctgtccca

SEQ ID NO: 3918210 - DNA, 21 bp, Homo sapiens
cctggatgtcccctgtcccac

SEQ ID NO: 3918211 - DNA, 18 bp, Homo sapiens
cctggatgtgtggggcat

SEQ ID NO: 3918212 - DNA, 22 bp, Homo sapiens
cctggcaagctagaacctggag

SEQ ID NO: 3918213 - DNA, 24 bp, Homo sapiens
cctggcacaggactgattctggga

SEQ ID NO: 3918214 - DNA, 17 bp, Homo sapiens
cctggcacagggcagtg

SEQ ID NO: 3918215 - DNA, 22 bp, Homo sapiens
cctggcagccgtgccttcagct

SEQ ID NO: 3918216 - DNA, 15 bp, Homo sapiens
cctggcaggaagtct

SEQ ID NO: 3918217 - DNA, 21 bp, Homo sapiens
cctggcaggttagaacctaga

SEQ ID NO: 3918218 - DNA, 22 bp, Homo sapiens
cctggcatgtcagagccaggct

SEQ ID NO: 3918219 - DNA, 13 bp, Homo sapiens
cctggccaggcac

SEQ ID NO: 3918220 - DNA, 20 bp, Homo sapiens
cctggccattttcttgcctg

SEQ ID NO: 3918221 - DNA, 18 bp, Homo sapiens
cctggcccatagaaacat

SEQ ID NO: 3918222 - DNA, 22 bp, Homo sapiens
cctggcccatagaaacatgaca

SEQ ID NO: 3918223 - DNA, 23 bp, Homo sapiens
cctggcccatagaaacatgacac

SEQ ID NO: 3918224 - DNA, 17 bp, Homo sapiens
cctggccccatgtctct

SEQ ID NO: 3918225 - DNA, 20 bp, Homo sapiens
cctggccccatgtctctcag

SEQ ID NO: 3918226 - DNA, 21 bp, Homo sapiens
cctggccccatgtctctcaga

SEQ ID NO: 3918227 - DNA, 23 bp, Homo sapiens
cctggcccccctccaggcatgct

SEQ ID NO: 3918228 - DNA, 21 bp, Homo sapiens
cctggccccgggctctggcca

SEQ ID NO: 3918229 - DNA, 23 bp, Homo sapiens
cctggccccgggctctggccacc

SEQ ID NO: 3918230 - DNA, 12 bp, Homo sapiens
cctggcccctcc

SEQ ID NO: 3918231 - DNA, 22 bp, Homo sapiens
cctggcccctccagaccctgcc

SEQ ID NO: 3918232 - DNA, 14 bp, Homo sapiens
cctggccctcttct

SEQ ID NO: 3918233 - DNA, 12 bp, Homo sapiens
cctggccctgcc

SEQ ID NO: 3918234 - DNA, 19 bp, Homo sapiens
cctggccggcaaccccagt

SEQ ID NO: 3918235 - DNA, 22 bp, Homo sapiens
cctggccggcaaccccagttct

SEQ ID NO: 3918236 - DNA, 21 bp, Homo sapiens
cctggccggcccaggcctcca

SEQ ID NO: 3918237 - DNA, 17 bp, Homo sapiens
cctggcctcaagcaatc

SEQ ID NO: 3918238 - DNA, 18 bp, Homo sapiens
cctggcctcactggctgg

SEQ ID NO: 3918239 - DNA, 13 bp, Homo sapiens
cctcctccactca

SEQ ID NO: 3918240 - DNA, 12 bp, Homo sapiens
cctcctcctgac

SEQ ID NO: 3918241 - DNA, 15 bp, Homo sapiens
cctcctctctgccac

SEQ ID NO: 3918242 - DNA, 18 bp, Homo sapiens
cctcctctctgccaccac

SEQ ID NO: 3918243 - DNA, 18 bp, Homo sapiens
cctcctctgccacctccc

SEQ ID NO: 3918244 - DNA, 21 bp, Homo sapiens
cctcctctgccacctccccta

SEQ ID NO: 3918245 - DNA, 17 bp, Homo sapiens
cctcctctggcccagcc

SEQ ID NO: 3918246 - DNA, 19 bp, Homo sapiens
cctcctctggcccagccta

SEQ ID NO: 3918247 - DNA, 22 bp, Homo sapiens
cctcctgaagcctctgccctgc

SEQ ID NO: 3918248 - DNA, 18 bp, Homo sapiens
cctcctgacctgaggctc

SEQ ID NO: 3918249 - DNA, 16 bp, Homo sapiens
cctcctgcccaggaga

SEQ ID NO: 3918250 - DNA, 16 bp, Homo sapiens
cctcctggccagacgc

SEQ ID NO: 3918251 - DNA, 17 bp, Homo sapiens
cctcctgggaccatgga

SEQ ID NO: 3918252 - DNA, 18 bp, Homo sapiens
cctccttataagcccagc

SEQ ID NO: 3918253 - DNA, 12 bp, Homo sapiens
cctccttcccgc

SEQ ID NO: 3918254 - DNA, 11 bp, Homo sapiens
cctccttccct

SEQ ID NO: 3918255 - DNA, 19 bp, Homo sapiens
cctccttcccttctctcct

SEQ ID NO: 3918256 - DNA, 20 bp, Homo sapiens
cctcgaaccaaggcagcctc

SEQ ID NO: 3918257 - DNA, 23 bp, Homo sapiens
cctcgaaccaaggcagcctccag

SEQ ID NO: 3918258 - DNA, 20 bp, Homo sapiens
cctcgaggcaccggcgctgc

SEQ ID NO: 3918259 - DNA, 19 bp, Homo sapiens
cctcgcaggtctcagcccg

SEQ ID NO: 3918260 - DNA, 17 bp, Homo sapiens
cctcgccacggggaggg

SEQ ID NO: 3918261 - DNA, 17 bp, Homo sapiens
cctcgccggccttgttt

SEQ ID NO: 3918262 - DNA, 17 bp, Homo sapiens
cctcgcctaggcctgtg

SEQ ID NO: 3918263 - DNA, 13 bp, Homo sapiens
cctcgcctgggcc

SEQ ID NO: 3918264 - DNA, 14 bp, Homo sapiens
cctcgcctgggccc

SEQ ID NO: 3918265 - DNA, 21 bp, Homo sapiens
cctcgcctgggcccaggctct

SEQ ID NO: 3918266 - DNA, 19 bp, Homo sapiens
cctcgccttttaggctcag

SEQ ID NO: 3918267 - DNA, 17 bp, Homo sapiens
cctcgctccccactctg

SEQ ID NO: 3918268 - DNA, 19 bp, Homo sapiens
cctcgctccccactctgct

SEQ ID NO: 3918269 - DNA, 22 bp, Homo sapiens
cctcggaagccgtctgactcca

SEQ ID NO: 3918270 - DNA, 14 bp, Homo sapiens
cctcggagaagagc

SEQ ID NO: 3918271 - DNA, 20 bp, Homo sapiens
cctcggtgatgcggacatct

SEQ ID NO: 3918272 - DNA, 14 bp, Homo sapiens
cctcgtaccagcca

SEQ ID NO: 3918273 - DNA, 18 bp, Homo sapiens
cctcgtaccagccaggat

SEQ ID NO: 3918274 - DNA, 14 bp, Homo sapiens
cctcgtccacaggg

SEQ ID NO: 3918275 - DNA, 23 bp, Homo sapiens
cctcgtccacaggggcaggcctg

SEQ ID NO: 3918276 - DNA, 15 bp, Homo sapiens
cctcgtcctccccct

SEQ ID NO: 3918277 - DNA, 17 bp, Homo sapiens
cctcgtcctccccctgc

SEQ ID NO: 3918278 - DNA, 19 bp, Homo sapiens
cctcgtcctccccctgcca

SEQ ID NO: 3918279 - DNA, 14 bp, Homo sapiens
cctcgtcctgtccc

SEQ ID NO: 3918280 - DNA, 18 bp, Homo sapiens
cctcgtcctgtcccagag

SEQ ID NO: 3918281 - DNA, 21 bp, Homo sapiens
cctcgtggacacctgccctgc

SEQ ID NO: 3918282 - DNA, 22 bp, Homo sapiens
cctctaacccccagtgccacag

SEQ ID NO: 3918283 - DNA, 23 bp, Homo sapiens
cctctaacccccagtgccacaga

SEQ ID NO: 3918284 - DNA, 14 bp, Homo sapiens
cctctaagccactc

SEQ ID NO: 3918285 - DNA, 21 bp, Homo sapiens
cctctaattctcttacccaga

SEQ ID NO: 3918286 - DNA, 22 bp, Homo sapiens
cctctaattctcttacccagaa

SEQ ID NO: 3918287 - DNA, 14 bp, Homo sapiens
cctctactgggaag

SEQ ID NO: 3918288 - DNA, 15 bp, Homo sapiens
cctctagaacaccca

SEQ ID NO: 3918289 - DNA, 19 bp, Homo sapiens
cctctagaacacccactgg

SEQ ID NO: 3918290 - DNA, 20 bp, Homo sapiens
cctctagaacacccactggc

SEQ ID NO: 3918291 - DNA, 17 bp, Homo sapiens
cctctcaagctagccag

SEQ ID NO: 3918292 - DNA, 18 bp, Homo sapiens
cctctcaatattcaataa

SEQ ID NO: 3918293 - DNA, 22 bp, Homo sapiens
cctctcaatattcaataaagct

SEQ ID NO: 3918294 - DNA, 13 bp, Homo sapiens
cctctcacacaca

SEQ ID NO: 3918295 - DNA, 14 bp, Homo sapiens
cctctcacacacat

SEQ ID NO: 3918296 - DNA, 19 bp, Homo sapiens
cctctccaattgtaaaaaa

SEQ ID NO: 3918297 - DNA, 12 bp, Homo sapiens
cctctccactgc

SEQ ID NO: 3918298 - DNA, 11 bp, Homo sapiens
cctctccaggc

SEQ ID NO: 3918299 - DNA, 17 bp, Homo sapiens
cctctccaggcaccctt

SEQ ID NO: 3918300 - DNA, 16 bp, Homo sapiens
cctctcccaggcccca

SEQ ID NO: 3918301 - DNA, 17 bp, Homo sapiens
cctctcccaggccccat

SEQ ID NO: 3918302 - DNA, 21 bp, Homo sapiens
cctctcccgcgggcctggaca

SEQ ID NO: 3918303 - DNA, 18 bp, Homo sapiens
cctctcccggctgcctgc

SEQ ID NO: 3918304 - DNA, 20 bp, Homo sapiens
cctctcccggctgcctgccg

SEQ ID NO: 3918305 - DNA, 22 bp, Homo sapiens
cctctcccggctgcctgccgcc

SEQ ID NO: 3918306 - DNA, 23 bp, Homo sapiens
cctctcccggctgcctgccgccc

SEQ ID NO: 3918307 - DNA, 11 bp, Homo sapiens
cctctcctgcc

SEQ ID NO: 3918308 - DNA, 18 bp, Homo sapiens
cctctccttgggctcctg

SEQ ID NO: 3918309 - DNA, 21 bp, Homo sapiens
cctctccttgggctcctggct

SEQ ID NO: 3918310 - DNA, 23 bp, Homo sapiens
cctctccttgggctcctggctgc

SEQ ID NO: 3918311 - DNA, 16 bp, Homo sapiens
cctctctaagccacag

SEQ ID NO: 3918312 - DNA, 23 bp, Homo sapiens
cctctctaagccacagcttcttc

SEQ ID NO: 3918313 - DNA, 14 bp, Homo sapiens
cctctctgctccag

SEQ ID NO: 3918314 - DNA, 11 bp, Homo sapiens
cctctcttccc

SEQ ID NO: 3918315 - DNA, 18 bp, Homo sapiens
cctctgaaatttcccaca

SEQ ID NO: 3918316 - DNA, 18 bp, Homo sapiens
cctctgaccaacaggctg

SEQ ID NO: 3918317 - DNA, 14 bp, Homo sapiens
cctctgaggccagc

SEQ ID NO: 3918318 - DNA, 18 bp, Homo sapiens
cctctgaggccagcctgg

SEQ ID NO: 3918319 - DNA, 20 bp, Homo sapiens
cctctgaggccagcctggcc

SEQ ID NO: 3918320 - DNA, 21 bp, Homo sapiens
cctctgaggccagcctggcct

SEQ ID NO: 3918321 - DNA, 18 bp, Homo sapiens
cctctgatacccagagca

SEQ ID NO: 3918322 - DNA, 19 bp, Homo sapiens
cctctgatacccagagcat

SEQ ID NO: 3918323 - DNA, 18 bp, Homo sapiens
cctctgatatgggactga

SEQ ID NO: 3918324 - DNA, 16 bp, Homo sapiens
cctctgattatcaggt

SEQ ID NO: 3918325 - DNA, 14 bp, Homo sapiens
cctctgccacctcc

SEQ ID NO: 3918326 - DNA, 17 bp, Homo sapiens
cctctgccatgcccaga

SEQ ID NO: 3918327 - DNA, 16 bp, Homo sapiens
cctctgccccaagcag

SEQ ID NO: 3918328 - DNA, 18 bp, Homo sapiens
cctctgccccaagcagcc

SEQ ID NO: 3918329 - DNA, 15 bp, Homo sapiens
cctctgcccgcagag

SEQ ID NO: 3918330 - DNA, 17 bp, Homo sapiens
cctctgcccgcagagcc

SEQ ID NO: 3918331 - DNA, 12 bp, Homo sapiens
cctctgccctgt

SEQ ID NO: 3918332 - DNA, 11 bp, Homo sapiens
cctctgcctca

SEQ ID NO: 3918333 - DNA, 14 bp, Homo sapiens
cctctgcctcaatg

SEQ ID NO: 3918334 - DNA, 14 bp, Homo sapiens
cctctgctctgagg

SEQ ID NO: 3918335 - DNA, 20 bp, Homo sapiens
cctctgctctgaggcttcca

SEQ ID NO: 3918336 - DNA, 22 bp, Homo sapiens
cctctgctctgaggcttccaga

SEQ ID NO: 3918337 - DNA, 22 bp, Homo sapiens
cctctgctgctcccatctgcac

SEQ ID NO: 3918338 - DNA, 18 bp, Homo sapiens
cctctggatccctggagg

SEQ ID NO: 3918339 - DNA, 16 bp, Homo sapiens
cctctggatggcacca

SEQ ID NO: 3918340 - DNA, 20 bp, Homo sapiens
cctctggcccagcctaccct

SEQ ID NO: 3918341 - DNA, 12 bp, Homo sapiens
cctctggccctg

SEQ ID NO: 3918342 - DNA, 13 bp, Homo sapiens
cctctggccctgc

SEQ ID NO: 3918343 - DNA, 15 bp, Homo sapiens
cctctggccctgcct

SEQ ID NO: 3918344 - DNA, 22 bp, Homo sapiens
cctctggctggctaactggaag

SEQ ID NO: 3918345 - DNA, 16 bp, Homo sapiens
cctctggggttcatct

SEQ ID NO: 3918346 - DNA, 19 bp, Homo sapiens
cctctgtcatcactccctg

SEQ ID NO: 3918347 - DNA, 17 bp, Homo sapiens
cctctgtccaggcactg

SEQ ID NO: 3918348 - DNA, 18 bp, Homo sapiens
cctctgtctcgagcgccc

SEQ ID NO: 3918349 - DNA, 23 bp, Homo sapiens
cctctgtctcgagcgccctgcag

SEQ ID NO: 3918350 - DNA, 17 bp, Homo sapiens
cctcttaaagctgcctg

SEQ ID NO: 3918351 - DNA, 20 bp, Homo sapiens
cctcttaaagctgcctgtag

SEQ ID NO: 3918352 - DNA, 21 bp, Homo sapiens
cctcttaatgtatgattacat

SEQ ID NO: 3918353 - DNA, 17 bp, Homo sapiens
cctcttaccgtagcctc

SEQ ID NO: 3918354 - DNA, 19 bp, Homo sapiens
cctcttaccgtagcctccg

SEQ ID NO: 3918355 - DNA, 17 bp, Homo sapiens
cctcttccccttgccct

SEQ ID NO: 3918356 - DNA, 21 bp, Homo sapiens
cctcttccccttgcccttgcc

SEQ ID NO: 3918357 - DNA, 18 bp, Homo sapiens
cctcttccgtgacgtcac

SEQ ID NO: 3918358 - DNA, 16 bp, Homo sapiens
cctcttcctccctcat

SEQ ID NO: 3918359 - DNA, 12 bp, Homo sapiens
cctcttccttcc

SEQ ID NO: 3918360 - DNA, 13 bp, Homo sapiens
cctcttccttccc

SEQ ID NO: 3918361 - DNA, 14 bp, Homo sapiens
cctcttccttcccc

SEQ ID NO: 3918362 - DNA, 14 bp, Homo sapiens
cctcttctcttcct

SEQ ID NO: 3918363 - DNA, 23 bp, Homo sapiens
cctcttgccactgcctcttcctc

SEQ ID NO: 3918364 - DNA, 16 bp, Homo sapiens
cctcttgcctctctca

SEQ ID NO: 3918365 - DNA, 18 bp, Homo sapiens
cctcttgcctctctcagg

SEQ ID NO: 3918366 - DNA, 21 bp, Homo sapiens
cctcttggacctctgctctga

SEQ ID NO: 3918367 - DNA, 18 bp, Homo sapiens
cctctttaacctcatcta

SEQ ID NO: 3918368 - DNA, 20 bp, Homo sapiens
cctgcactgacccacagcct

SEQ ID NO: 3918369 - DNA, 17 bp, Homo sapiens
cctgcagaccctgccct

SEQ ID NO: 3918370 - DNA, 11 bp, Homo sapiens
cctgcagagag

SEQ ID NO: 3918371 - DNA, 16 bp, Homo sapiens
cctgcagagagaagcc

SEQ ID NO: 3918372 - DNA, 18 bp, Homo sapiens
cctgcagaggacagagct

SEQ ID NO: 3918373 - DNA, 19 bp, Homo sapiens
cctgcagaggaccacagtg

SEQ ID NO: 3918374 - DNA, 21 bp, Homo sapiens
cctgcagaggaccacagtggg

SEQ ID NO: 3918375 - DNA, 18 bp, Homo sapiens
cctgcagcctcctcctga

SEQ ID NO: 3918376 - DNA, 19 bp, Homo sapiens
cctgcagcctcctcctgac

SEQ ID NO: 3918377 - DNA, 16 bp, Homo sapiens
cctgcagcttgtagcc

SEQ ID NO: 3918378 - DNA, 18 bp, Homo sapiens
cctgcagcttgtagccag

SEQ ID NO: 3918379 - DNA, 19 bp, Homo sapiens
cctgcagcttgtagccagc

SEQ ID NO: 3918380 - DNA, 20 bp, Homo sapiens
cctgcaggaacgagcactgg

SEQ ID NO: 3918381 - DNA, 18 bp, Homo sapiens
cctgcagtactttacctc

SEQ ID NO: 3918382 - DNA, 24 bp, Homo sapiens
cctgcatccccttggctgtgaggc

SEQ ID NO: 3918383 - DNA, 19 bp, Homo sapiens
cctgcatccgtagttccct

SEQ ID NO: 3918384 - DNA, 19 bp, Homo sapiens
cctgcatgtgttgtacaat

SEQ ID NO: 3918385 - DNA, 14 bp, Homo sapiens
cctgcatttctgag

SEQ ID NO: 3918386 - DNA, 14 bp, Homo sapiens
cctgccaccagtca

SEQ ID NO: 3918387 - DNA, 18 bp, Homo sapiens
cctgccagccatcacaag

SEQ ID NO: 3918388 - DNA, 19 bp, Homo sapiens
cctgccagccatcacaagg

SEQ ID NO: 3918389 - DNA, 14 bp, Homo sapiens
cctgccagctgcct

SEQ ID NO: 3918390 - DNA, 18 bp, Homo sapiens
cctgccagtgccttacct

SEQ ID NO: 3918391 - DNA, 19 bp, Homo sapiens
cctgccagttgaaaatgga

SEQ ID NO: 3918392 - DNA, 18 bp, Homo sapiens
cctgccataccgctgggg

SEQ ID NO: 3918393 - DNA, 22 bp, Homo sapiens
cctgcccaggagagccagccct

SEQ ID NO: 3918394 - DNA, 22 bp, Homo sapiens
cctgcccatacccctgcctggg

SEQ ID NO: 3918395 - DNA, 22 bp, Homo sapiens
cctgcccatgtgtcccctcact

SEQ ID NO: 3918396 - DNA, 15 bp, Homo sapiens
cctgccccaactcct

SEQ ID NO: 3918397 - DNA, 13 bp, Homo sapiens
cctgccccagcgc

SEQ ID NO: 3918398 - DNA, 15 bp, Homo sapiens
cctgccccagcgcgg

SEQ ID NO: 3918399 - DNA, 14 bp, Homo sapiens
cctgcccccaaagg

SEQ ID NO: 3918400 - DNA, 14 bp, Homo sapiens
cctgcccccatctc

SEQ ID NO: 3918401 - DNA, 20 bp, Homo sapiens
cctgcccccatctccccagg

SEQ ID NO: 3918402 - DNA, 14 bp, Homo sapiens
cctgccctgccacc

SEQ ID NO: 3918403 - DNA, 15 bp, Homo sapiens
cctgccctgccctgc

SEQ ID NO: 3918404 - DNA, 13 bp, Homo sapiens
cctgccctgctgc

SEQ ID NO: 3918405 - DNA, 20 bp, Homo sapiens
cctgccctgctgccgcctcc

SEQ ID NO: 3918406 - DNA, 16 bp, Homo sapiens
cctgcctcccagccct

SEQ ID NO: 3918407 - DNA, 21 bp, Homo sapiens
cctgcctcccagccctgccag

SEQ ID NO: 3918408 - DNA, 16 bp, Homo sapiens
cctgcctctccccaaa

SEQ ID NO: 3918409 - DNA, 19 bp, Homo sapiens
cctgcctctctgctccaga

SEQ ID NO: 3918410 - DNA, 12 bp, Homo sapiens
ccagcaccctct

SEQ ID NO: 3918411 - DNA, 23 bp, Homo sapiens
ccagcaccctctcctgggggtgg

SEQ ID NO: 3918412 - DNA, 19 bp, Homo sapiens
ccagcactttgggaggcca

SEQ ID NO: 3918413 - DNA, 12 bp, Homo sapiens
ccagcagcccta

SEQ ID NO: 3918414 - DNA, 19 bp, Homo sapiens
ccagcagcggtaccccagg

SEQ ID NO: 3918415 - DNA, 23 bp, Homo sapiens
ccagcagctgcgggtctgaagga

SEQ ID NO: 3918416 - DNA, 17 bp, Homo sapiens
ccagcaggtgtggtggc

SEQ ID NO: 3918417 - DNA, 15 bp, Homo sapiens
ccagcatccagcctg

SEQ ID NO: 3918418 - DNA, 18 bp, Homo sapiens
ccagcatccagcctgtgt

SEQ ID NO: 3918419 - DNA, 13 bp, Homo sapiens
ccagcatcctgct

SEQ ID NO: 3918420 - DNA, 14 bp, Homo sapiens
ccagcatttgccat

SEQ ID NO: 3918421 - DNA, 14 bp, Homo sapiens
ccagcattttacta

SEQ ID NO: 3918422 - DNA, 20 bp, Homo sapiens
ccagccactcgggaggctga

SEQ ID NO: 3918423 - DNA, 16 bp, Homo sapiens
ccagccagtcttgcct

SEQ ID NO: 3918424 - DNA, 16 bp, Homo sapiens
ccagccatcacaaggg

SEQ ID NO: 3918425 - DNA, 20 bp, Homo sapiens
ccagccatcacaaggggaac

SEQ ID NO: 3918426 - DNA, 15 bp, Homo sapiens
ccagcccacacccct

SEQ ID NO: 3918427 - DNA, 21 bp, Homo sapiens
ccagcccattctctctcctgt

SEQ ID NO: 3918428 - DNA, 22 bp, Homo sapiens
ccagcccattctctctcctgtc

SEQ ID NO: 3918429 - DNA, 21 bp, Homo sapiens
ccagcccattttgaggccaga

SEQ ID NO: 3918430 - DNA, 22 bp, Homo sapiens
ccagccccctaagagagcacct

SEQ ID NO: 3918431 - DNA, 23 bp, Homo sapiens
ccagccccctggatgggcattgg

SEQ ID NO: 3918432 - DNA, 23 bp, Homo sapiens
ccagccccgttttaaggacatta

SEQ ID NO: 3918433 - DNA, 20 bp, Homo sapiens
ccagcccgcccaaggggact

SEQ ID NO: 3918434 - DNA, 13 bp, Homo sapiens
ccagcccggcctg

SEQ ID NO: 3918435 - DNA, 18 bp, Homo sapiens
ccagccctacatcttcag

SEQ ID NO: 3918436 - DNA, 19 bp, Homo sapiens
ccagccctacatcttcagc

SEQ ID NO: 3918437 - DNA, 23 bp, Homo sapiens
ccagccctacatcttcagctccc

SEQ ID NO: 3918438 - DNA, 15 bp, Homo sapiens
ccagccctatggatg

SEQ ID NO: 3918439 - DNA, 13 bp, Homo sapiens
ccagccctccctg

SEQ ID NO: 3918440 - DNA, 15 bp, Homo sapiens
ccagccctgccagga

SEQ ID NO: 3918441 - DNA, 14 bp, Homo sapiens
ccagccctgcctgg

SEQ ID NO: 3918442 - DNA, 16 bp, Homo sapiens
ccagccctgcctggag

SEQ ID NO: 3918443 - DNA, 22 bp, Homo sapiens
ccagccctgcctggaggacctg

SEQ ID NO: 3918444 - DNA, 12 bp, Homo sapiens
ccagccctgggg

SEQ ID NO: 3918445 - DNA, 17 bp, Homo sapiens
ccagcccttccctgctt

SEQ ID NO: 3918446 - DNA, 15 bp, Homo sapiens
ccagcccttctgcct

SEQ ID NO: 3918447 - DNA, 19 bp, Homo sapiens
ccagcccttctgcctttct

SEQ ID NO: 3918448 - DNA, 18 bp, Homo sapiens
ccagccctttgcaggccc

SEQ ID NO: 3918449 - DNA, 17 bp, Homo sapiens
ccagccgccctgggctg

SEQ ID NO: 3918450 - DNA, 18 bp, Homo sapiens
ccagccgtgatgctcagg

SEQ ID NO: 3918451 - DNA, 21 bp, Homo sapiens
ccagccgtgatgctcaggctt

SEQ ID NO: 3918452 - DNA, 23 bp, Homo sapiens
ccagccgtgatgctcaggcttga

SEQ ID NO: 3918453 - DNA, 13 bp, Homo sapiens
ccagcctcagctc

SEQ ID NO: 3918454 - DNA, 15 bp, Homo sapiens
ccagcctcagctcag

SEQ ID NO: 3918455 - DNA, 22 bp, Homo sapiens
ccagcctcagctcagcctcccc

SEQ ID NO: 3918456 - DNA, 18 bp, Homo sapiens
ccagcctcagtgccactt

SEQ ID NO: 3918457 - DNA, 19 bp, Homo sapiens
ccagcctcagtgccacttg

SEQ ID NO: 3918458 - DNA, 21 bp, Homo sapiens
ccagcctccaagctccatctc

SEQ ID NO: 3918459 - DNA, 23 bp, Homo sapiens
ccagcctctcccggctgcctgcc

SEQ ID NO: 3918460 - DNA, 14 bp, Homo sapiens
ccagcctggcctcc

SEQ ID NO: 3918461 - DNA, 16 bp, Homo sapiens
ccagcctggcctcctg

SEQ ID NO: 3918462 - DNA, 22 bp, Homo sapiens
ccagcctggcctcctgcctcta

SEQ ID NO: 3918463 - DNA, 14 bp, Homo sapiens
ccagcctgggactc

SEQ ID NO: 3918464 - DNA, 12 bp, Homo sapiens
ccagcctgggcc

SEQ ID NO: 3918465 - DNA, 17 bp, Homo sapiens
ccagcctgggcctatgg

SEQ ID NO: 3918466 - DNA, 21 bp, Homo sapiens
ccagcctgggcctatggagag

SEQ ID NO: 3918467 - DNA, 22 bp, Homo sapiens
ccagcgcctgccctccctgggg

SEQ ID NO: 3918468 - DNA, 15 bp, Homo sapiens
ccagcgcctgtgctg

SEQ ID NO: 3918469 - DNA, 19 bp, Homo sapiens
ccagcgcggcttggccgcc

SEQ ID NO: 3918470 - DNA, 20 bp, Homo sapiens
ccagcgcggcttggccgcca

SEQ ID NO: 3918471 - DNA, 13 bp, Homo sapiens
ccagcggctgagt

SEQ ID NO: 3918472 - DNA, 23 bp, Homo sapiens
ccagcgtttagtttctagaggcc

SEQ ID NO: 3918473 - DNA, 17 bp, Homo sapiens
ccagctaatctgtaggg

SEQ ID NO: 3918474 - DNA, 21 bp, Homo sapiens
ccagctaatctgtagggctgg

SEQ ID NO: 3918475 - DNA, 23 bp, Homo sapiens
ccagctaatctgtagggctggac

SEQ ID NO: 3918476 - DNA, 13 bp, Homo sapiens
ccagctacattcc

SEQ ID NO: 3918477 - DNA, 20 bp, Homo sapiens
ccagctacattcctcagctg

SEQ ID NO: 3918478 - DNA, 13 bp, Homo sapiens
ccagctactcagg

SEQ ID NO: 3918479 - DNA, 20 bp, Homo sapiens
ccagctactcaggaggctga

SEQ ID NO: 3918480 - DNA, 20 bp, Homo sapiens
ccagctactctgtccaggcc

SEQ ID NO: 3918481 - DNA, 20 bp, Homo sapiens
ccagctagtgacccacatgc

SEQ ID NO: 3918482 - DNA, 21 bp, Homo sapiens
ccagctagtgacccacatgcc

SEQ ID NO: 3918483 - DNA, 22 bp, Homo sapiens
ccagctagtgacccacatgcca

SEQ ID NO: 3918484 - DNA, 14 bp, Homo sapiens
ccagctatctgtca

SEQ ID NO: 3918485 - DNA, 21 bp, Homo sapiens
ccagctatctgtcatctctct

SEQ ID NO: 3918486 - DNA, 18 bp, Homo sapiens
ccagctatggccccaggg

SEQ ID NO: 3918487 - DNA, 14 bp, Homo sapiens
ccagctcaggtgac

SEQ ID NO: 3918488 - DNA, 14 bp, Homo sapiens
ccagctccagtttc

SEQ ID NO: 3918489 - DNA, 23 bp, Homo sapiens
ccagctccttttgtccccagggc

SEQ ID NO: 3918490 - DNA, 14 bp, Homo sapiens
ccagctctccctct

SEQ ID NO: 3918491 - DNA, 17 bp, Homo sapiens
ccagctctccctctggc

SEQ ID NO: 3918492 - DNA, 16 bp, Homo sapiens
ccagctctctctaccc

SEQ ID NO: 3918493 - DNA, 13 bp, Homo sapiens
ccagctctgtggc

SEQ ID NO: 3918494 - DNA, 15 bp, Homo sapiens
ccagctctgtggcct

SEQ ID NO: 3918495 - DNA, 17 bp, Homo sapiens
ccagctctgtggcctgt

SEQ ID NO: 3918496 - DNA, 14 bp, Homo sapiens
ccagctgaggctgg

SEQ ID NO: 3918497 - DNA, 12 bp, Homo sapiens
ccagctgcagat

SEQ ID NO: 3918498 - DNA, 13 bp, Homo sapiens
ccagctgcctggg

SEQ ID NO: 3918499 - DNA, 20 bp, Homo sapiens
ccagctgccttcctcatccc

SEQ ID NO: 3918500 - DNA, 13 bp, Homo sapiens
ccagctgctctgc

SEQ ID NO: 3918501 - DNA, 16 bp, Homo sapiens
ccagctgctgctctga

SEQ ID NO: 3918502 - DNA, 21 bp, Homo sapiens
ccagctggtcttttgggagtg

SEQ ID NO: 3918503 - DNA, 14 bp, Homo sapiens
ccagctggtgctgc

SEQ ID NO: 3918504 - DNA, 21 bp, Homo sapiens
ccagctggtgctgcaaggaag

SEQ ID NO: 3918505 - DNA, 14 bp, Homo sapiens
ccagctgtagccat

SEQ ID NO: 3918506 - DNA, 17 bp, Homo sapiens
ccagctgtagccatggc

SEQ ID NO: 3918507 - DNA, 23 bp, Homo sapiens
ccagcttcattatgcagctgagg

SEQ ID NO: 3918508 - DNA, 13 bp, Homo sapiens
ccagcttcctggt

SEQ ID NO: 3918509 - DNA, 15 bp, Homo sapiens
ccagcttcctggtgt

SEQ ID NO: 3918510 - DNA, 15 bp, Homo sapiens
ccagcttcctgtggg

SEQ ID NO: 3918511 - DNA, 21 bp, Homo sapiens
ccagcttcctgtgggccagga

SEQ ID NO: 3918512 - DNA, 16 bp, Homo sapiens
ccagcttctccaggct

SEQ ID NO: 3918513 - DNA, 18 bp, Homo sapiens
ccagcttctccaggctct

SEQ ID NO: 3918514 - DNA, 20 bp, Homo sapiens
ccagctttatctgtcacaca

SEQ ID NO: 3918515 - DNA, 16 bp, Homo sapiens
ccaggaaggcagctgc

SEQ ID NO: 3918516 - DNA, 21 bp, Homo sapiens
ccaggaagggggtccacccag

SEQ ID NO: 3918517 - DNA, 16 bp, Homo sapiens
ccaggaatctgccatt

SEQ ID NO: 3918518 - DNA, 20 bp, Homo sapiens
ccaggaatgttaaagtcagt

SEQ ID NO: 3918519 - DNA, 15 bp, Homo sapiens
ccaggacaagcatgg

SEQ ID NO: 3918520 - DNA, 20 bp, Homo sapiens
ccaggacaagcatggtccca

SEQ ID NO: 3918521 - DNA, 13 bp, Homo sapiens
ccaggacacctgc

SEQ ID NO: 3918522 - DNA, 14 bp, Homo sapiens
ccaggacacctgcc

SEQ ID NO: 3918523 - DNA, 18 bp, Homo sapiens
ccaggacacctgccccag

SEQ ID NO: 3918524 - DNA, 23 bp, Homo sapiens
ccaggacacctgccccagcgcgg

SEQ ID NO: 3918525 - DNA, 14 bp, Homo sapiens
ccaggacaggacca

SEQ ID NO: 3918526 - DNA, 19 bp, Homo sapiens
ccaggactatagcccaggt

SEQ ID NO: 3918527 - DNA, 22 bp, Homo sapiens
ccaggactatagcccaggtcct

SEQ ID NO: 3918528 - DNA, 15 bp, Homo sapiens
ccaggactccccagg

SEQ ID NO: 3918529 - DNA, 17 bp, Homo sapiens
ccaggactccccaggcc

SEQ ID NO: 3918530 - DNA, 22 bp, Homo sapiens
ccaggagagagatctagaaagt

SEQ ID NO: 3918531 - DNA, 16 bp, Homo sapiens
ccaggagagccagccc

SEQ ID NO: 3918532 - DNA, 23 bp, Homo sapiens
ccaggagcaaatgtttctgcagt

SEQ ID NO: 3918533 - DNA, 17 bp, Homo sapiens
ccaggagctgagtcacc

SEQ ID NO: 3918534 - DNA, 20 bp, Homo sapiens
ccaggagctgagtcacctcc

SEQ ID NO: 3918535 - DNA, 22 bp, Homo sapiens
ccaggagctgagtcacctcctc

SEQ ID NO: 3918536 - DNA, 12 bp, Homo sapiens
ccaggagctgga

SEQ ID NO: 3918537 - DNA, 22 bp, Homo sapiens
ccaggagggacaaaggagcctg

SEQ ID NO: 3918538 - DNA, 23 bp, Homo sapiens
ccaggagggacaaaggagcctgt

SEQ ID NO: 3918539 - DNA, 13 bp, Homo sapiens
ccaggaggggcct

SEQ ID NO: 3918540 - DNA, 17 bp, Homo sapiens
ccaggaggggcctctga

SEQ ID NO: 3918541 - DNA, 16 bp, Homo sapiens
ccaggaggtcctcctc

SEQ ID NO: 3918542 - DNA, 17 bp, Homo sapiens
ccaggaggtcctcctct

SEQ ID NO: 3918543 - DNA, 15 bp, Homo sapiens
ccaggagtctgtgct

SEQ ID NO: 3918544 - DNA, 16 bp, Homo sapiens
ccaggagtctgtgctc

SEQ ID NO: 3918545 - DNA, 16 bp, Homo sapiens
ccaggagttgacgcat

SEQ ID NO: 3918546 - DNA, 22 bp, Homo sapiens
ccaggagtttgagacaagccct

SEQ ID NO: 3918547 - DNA, 23 bp, Homo sapiens
ccaggagtttgagacaagccctg

SEQ ID NO: 3918548 - DNA, 15 bp, Homo sapiens
ccaggatcccagagc

SEQ ID NO: 3918549 - DNA, 16 bp, Homo sapiens
ccaggatcccagagct

SEQ ID NO: 3918550 - DNA, 14 bp, Homo sapiens
ccaggatcctgcag

SEQ ID NO: 3918551 - DNA, 15 bp, Homo sapiens
ccaggatcctgcagg

SEQ ID NO: 3918552 - DNA, 18 bp, Homo sapiens
ccaggatcctgcaggaac

SEQ ID NO: 3918553 - DNA, 17 bp, Homo sapiens
ccaggatgacacctcca

SEQ ID NO: 3918554 - DNA, 20 bp, Homo sapiens
ccaggatggtgcaggatggc

SEQ ID NO: 3918555 - DNA, 15 bp, Homo sapiens
ccaggattcctctct

SEQ ID NO: 3918556 - DNA, 16 bp, Homo sapiens
ccaggattgaagagca

SEQ ID NO: 3918557 - DNA, 15 bp, Homo sapiens
ccaggattttgtgtt

SEQ ID NO: 3918558 - DNA, 15 bp, Homo sapiens
ccaggcaccaggcag

SEQ ID NO: 3918559 - DNA, 15 bp, Homo sapiens
ccaggcaccatctcc

SEQ ID NO: 3918560 - DNA, 16 bp, Homo sapiens
ccaggcaccccctgga

SEQ ID NO: 3918561 - DNA, 17 bp, Homo sapiens
ccaggcaccccctggag

SEQ ID NO: 3918562 - DNA, 18 bp, Homo sapiens
ccaggcaccccctggaga

SEQ ID NO: 3918563 - DNA, 19 bp, Homo sapiens
ccaggcaccccctggagag

SEQ ID NO: 3918564 - DNA, 14 bp, Homo sapiens
ccaggcacccttct

SEQ ID NO: 3918565 - DNA, 13 bp, Homo sapiens
ccaggcacctggc

SEQ ID NO: 3918566 - DNA, 18 bp, Homo sapiens
ccaggcacctggcctgct

SEQ ID NO: 3918567 - DNA, 20 bp, Homo sapiens
ccaggcacctggcctgctgg

SEQ ID NO: 3918568 - DNA, 21 bp, Homo sapiens
ccaggcacctggcctgctggg

SEQ ID NO: 3918569 - DNA, 22 bp, Homo sapiens
ccaggcacctggcctgctggga

SEQ ID NO: 3918570 - DNA, 21 bp, Homo sapiens
ccaggcacgaacccacctgct

SEQ ID NO: 3918571 - DNA, 18 bp, Homo sapiens
ccaggcaggggtgggaga

SEQ ID NO: 3918572 - DNA, 18 bp, Homo sapiens
ccaggccaggccaccagg

SEQ ID NO: 3918573 - DNA, 21 bp, Homo sapiens
ccaggcccatctcaggtgcca

SEQ ID NO: 3918574 - DNA, 23 bp, Homo sapiens
ccaggcccatctcaggtgccact

SEQ ID NO: 3918575 - DNA, 21 bp, Homo sapiens
ccaggccccatgacctccagc

SEQ ID NO: 3918576 - DNA, 14 bp, Homo sapiens
ccaggcccctgagg

SEQ ID NO: 3918577 - DNA, 22 bp, Homo sapiens
ccaggccctaggattcctcccc

SEQ ID NO: 3918578 - DNA, 17 bp, Homo sapiens
ccaggccctccatgggc

SEQ ID NO: 3918579 - DNA, 17 bp, Homo sapiens
ccaggccctccctgact

SEQ ID NO: 3918580 - DNA, 18 bp, Homo sapiens
ccaggccgcctgccatac

SEQ ID NO: 3918581 - DNA, 18 bp, Homo sapiens
ccaaggagtaagtacaaa

SEQ ID NO: 3918582 - DNA, 21 bp, Homo sapiens
ccaaggcagcctccagagcca

SEQ ID NO: 3918583 - DNA, 22 bp, Homo sapiens
ccaaggcagcctccagagccag

SEQ ID NO: 3918584 - DNA, 16 bp, Homo sapiens
ccaaggctctgagcaa

SEQ ID NO: 3918585 - DNA, 17 bp, Homo sapiens
ccaaggggacttgtgcc

SEQ ID NO: 3918586 - DNA, 13 bp, Homo sapiens
ccaaggggcccac

SEQ ID NO: 3918587 - DNA, 15 bp, Homo sapiens
ccaaggggcccacaa

SEQ ID NO: 3918588 - DNA, 17 bp, Homo sapiens
ccaaggtcttcagccat

SEQ ID NO: 3918589 - DNA, 20 bp, Homo sapiens
ccaaggtgctaggattacag

SEQ ID NO: 3918590 - DNA, 16 bp, Homo sapiens
ccaagtaatataatgg

SEQ ID NO: 3918591 - DNA, 20 bp, Homo sapiens
ccaagtattttatctgtgtt

SEQ ID NO: 3918592 - DNA, 17 bp, Homo sapiens
ccaagtcaacactcttc

SEQ ID NO: 3918593 - DNA, 18 bp, Homo sapiens
ccaagtcaacactcttct

SEQ ID NO: 3918594 - DNA, 19 bp, Homo sapiens
ccaagtcaacactcttctt

SEQ ID NO: 3918595 - DNA, 20 bp, Homo sapiens
ccaagtccaacctgcctgtg

SEQ ID NO: 3918596 - DNA, 19 bp, Homo sapiens
ccaagtccaggtcctggtg

SEQ ID NO: 3918597 - DNA, 13 bp, Homo sapiens
ccaagtggctccc

SEQ ID NO: 3918598 - DNA, 12 bp, Homo sapiens
ccaagttatatt

SEQ ID NO: 3918599 - DNA, 21 bp, Homo sapiens
ccaagttcctgcactccagaa

SEQ ID NO: 3918600 - DNA, 21 bp, Homo sapiens
ccaataaaagtgactctcagc

SEQ ID NO: 3918601 - DNA, 23 bp, Homo sapiens
ccaatacatggtgtatagcacca

SEQ ID NO: 3918602 - DNA, 22 bp, Homo sapiens
ccaatattggagcatatcaaaa

SEQ ID NO: 3918603 - DNA, 16 bp, Homo sapiens
ccaatcagcactgaaa

SEQ ID NO: 3918604 - DNA, 17 bp, Homo sapiens
ccaatcagcactgaaaa

SEQ ID NO: 3918605 - DNA, 13 bp, Homo sapiens
ccaatccaggtgg

SEQ ID NO: 3918606 - DNA, 20 bp, Homo sapiens
ccaatgattcataacaatgt

SEQ ID NO: 3918607 - DNA, 14 bp, Homo sapiens
ccaatgctcctgga

SEQ ID NO: 3918608 - DNA, 17 bp, Homo sapiens
ccaatgctttgggaggc

SEQ ID NO: 3918609 - DNA, 24 bp, Homo sapiens
ccaatgctttgggaggccaaggca

SEQ ID NO: 3918610 - DNA, 18 bp, Homo sapiens
ccaatgcttttatcaaac

SEQ ID NO: 3918611 - DNA, 18 bp, Homo sapiens
ccaatggctgtaaactat

SEQ ID NO: 3918612 - DNA, 17 bp, Homo sapiens
ccaattatgcactggcc

SEQ ID NO: 3918613 - DNA, 17 bp, Homo sapiens
ccaattgtacattccct

SEQ ID NO: 3918614 - DNA, 19 bp, Homo sapiens
ccaattgtacattccctgc

SEQ ID NO: 3918615 - DNA, 19 bp, Homo sapiens
ccacaaatcaaagcaaggg

SEQ ID NO: 3918616 - DNA, 20 bp, Homo sapiens
ccacaaatcaaagcaagggc

SEQ ID NO: 3918617 - DNA, 21 bp, Homo sapiens
ccacaaatcaaagcaagggct

SEQ ID NO: 3918618 - DNA, 15 bp, Homo sapiens
ccacaaatctatatt

SEQ ID NO: 3918619 - DNA, 17 bp, Homo sapiens
ccacaactgacacagga

SEQ ID NO: 3918620 - DNA, 15 bp, Homo sapiens
ccacaagaaatttga

SEQ ID NO: 3918621 - DNA, 21 bp, Homo sapiens
ccacaagaaatttgatttcta

SEQ ID NO: 3918622 - DNA, 15 bp, Homo sapiens
ccacaagattcccag

SEQ ID NO: 3918623 - DNA, 16 bp, Homo sapiens
ccacaagattcccaga

SEQ ID NO: 3918624 - DNA, 18 bp, Homo sapiens
ccacaagattcccagaga

SEQ ID NO: 3918625 - DNA, 21 bp, Homo sapiens
ccacaatgcctctcccacgat

SEQ ID NO: 3918626 - DNA, 22 bp, Homo sapiens
ccacacacagaggaagagcagg

SEQ ID NO: 3918627 - DNA, 15 bp, Homo sapiens
ccacacacgcaggaa

SEQ ID NO: 3918628 - DNA, 21 bp, Homo sapiens
ccacaccatcaccctctgggc

SEQ ID NO: 3918629 - DNA, 15 bp, Homo sapiens
ccacaccccagcgcc

SEQ ID NO: 3918630 - DNA, 22 bp, Homo sapiens
ccacaccccagcgcctgtgctg

SEQ ID NO: 3918631 - DNA, 16 bp, Homo sapiens
ccacacccctccaaag

SEQ ID NO: 3918632 - DNA, 21 bp, Homo sapiens
ccacacccctccaaagcccca

SEQ ID NO: 3918633 - DNA, 15 bp, Homo sapiens
ccacacctccctact

SEQ ID NO: 3918634 - DNA, 14 bp, Homo sapiens
ccacacctccctga

SEQ ID NO: 3918635 - DNA, 17 bp, Homo sapiens
ccacactgtcagagctg

SEQ ID NO: 3918636 - DNA, 22 bp, Homo sapiens
ccacacttcaggctcttctcct

SEQ ID NO: 3918637 - DNA, 15 bp, Homo sapiens
ccacacttctcagga

SEQ ID NO: 3918638 - DNA, 22 bp, Homo sapiens
ccacacttctcaggacacaggc

SEQ ID NO: 3918639 - DNA, 18 bp, Homo sapiens
ccacactttgagaacctg

SEQ ID NO: 3918640 - DNA, 22 bp, Homo sapiens
ccacactttgagaacctgtgct

SEQ ID NO: 3918641 - DNA, 20 bp, Homo sapiens
ccacagaagccaggagcaaa

SEQ ID NO: 3918642 - DNA, 21 bp, Homo sapiens
ccacagaagccaggagcaaat

SEQ ID NO: 3918643 - DNA, 21 bp, Homo sapiens
ccacagaatacaagccactac

SEQ ID NO: 3918644 - DNA, 14 bp, Homo sapiens
ccacagagatgcat

SEQ ID NO: 3918645 - DNA, 14 bp, Homo sapiens
ccacagcacccagg

SEQ ID NO: 3918646 - DNA, 19 bp, Homo sapiens
ccacagcacccaggctcca

SEQ ID NO: 3918647 - DNA, 23 bp, Homo sapiens
ccacagcacccaggctccatggg

SEQ ID NO: 3918648 - DNA, 12 bp, Homo sapiens
ccacagcagttg

SEQ ID NO: 3918649 - DNA, 23 bp, Homo sapiens
ccacagcagttgaaaagactcca

SEQ ID NO: 3918650 - DNA, 17 bp, Homo sapiens
ccacagccaacaaacat

SEQ ID NO: 3918651 - DNA, 15 bp, Homo sapiens
ccacagccccacagc

SEQ ID NO: 3918652 - DNA, 17 bp, Homo sapiens
ccacagccccacagcac

SEQ ID NO: 3918653 - DNA, 17 bp, Homo sapiens
ccacagcctctgcctgt

SEQ ID NO: 3918654 - DNA, 13 bp, Homo sapiens
ccacagctcccac

SEQ ID NO: 3918655 - DNA, 16 bp, Homo sapiens
ccacagctcccacccc

SEQ ID NO: 3918656 - DNA, 16 bp, Homo sapiens
ccacaggcccttcctc

SEQ ID NO: 3918657 - DNA, 17 bp, Homo sapiens
ccacaggcccttggggt

SEQ ID NO: 3918658 - DNA, 17 bp, Homo sapiens
ccacaggggcaggcctg

SEQ ID NO: 3918659 - DNA, 13 bp, Homo sapiens
ccacagtctccca

SEQ ID NO: 3918660 - DNA, 22 bp, Homo sapiens
ccacagtgggtggcacctcctg

SEQ ID NO: 3918661 - DNA, 14 bp, Homo sapiens
ccacagttttgcct

SEQ ID NO: 3918662 - DNA, 20 bp, Homo sapiens
ccacatacaacacaaagaga

SEQ ID NO: 3918663 - DNA, 23 bp, Homo sapiens
ccacatagtgatggttcccctgt

SEQ ID NO: 3918664 - DNA, 12 bp, Homo sapiens
ccacatcccagg

SEQ ID NO: 3918665 - DNA, 18 bp, Homo sapiens
ccacatcccaggcttcac

SEQ ID NO: 3918666 - DNA, 13 bp, Homo sapiens
ccacatccctggg

SEQ ID NO: 3918667 - DNA, 17 bp, Homo sapiens
ccacatccctgggcctg

SEQ ID NO: 3918668 - DNA, 17 bp, Homo sapiens
ccacatccctttgaaac

SEQ ID NO: 3918669 - DNA, 22 bp, Homo sapiens
ccacatgccatttgtactgacc

SEQ ID NO: 3918670 - DNA, 24 bp, Homo sapiens
ccaccaaactgcacacacagctcc

SEQ ID NO: 3918671 - DNA, 15 bp, Homo sapiens
ccaccaacatcccat

SEQ ID NO: 3918672 - DNA, 13 bp, Homo sapiens
ccaccaactctgc

SEQ ID NO: 3918673 - DNA, 15 bp, Homo sapiens
ccaccaccagaaagc

SEQ ID NO: 3918674 - DNA, 13 bp, Homo sapiens
ccaccaccctgag

SEQ ID NO: 3918675 - DNA, 12 bp, Homo sapiens
ccaccacctagg

SEQ ID NO: 3918676 - DNA, 12 bp, Homo sapiens
ccaccaccttgg

SEQ ID NO: 3918677 - DNA, 19 bp, Homo sapiens
ccaccacgatgtggccctg

SEQ ID NO: 3918678 - DNA, 14 bp, Homo sapiens
ccaccacgtctgcc

SEQ ID NO: 3918679 - DNA, 17 bp, Homo sapiens
ccaccacgtctgccagg

SEQ ID NO: 3918680 - DNA, 18 bp, Homo sapiens
ccaccacgtctgccaggc

SEQ ID NO: 3918681 - DNA, 16 bp, Homo sapiens
ccaccactagagctga

SEQ ID NO: 3918682 - DNA, 14 bp, Homo sapiens
ccaccagtcactgt

SEQ ID NO: 3918683 - DNA, 14 bp, Homo sapiens
ccaccatcctgcag

SEQ ID NO: 3918684 - DNA, 14 bp, Homo sapiens
ccacccaacagctc

SEQ ID NO: 3918685 - DNA, 11 bp, Homo sapiens
ccacccagccc

SEQ ID NO: 3918686 - DNA, 14 bp, Homo sapiens
ccacccaggctgca

SEQ ID NO: 3918687 - DNA, 22 bp, Homo sapiens
ccacccaggctgcactgcagtg

SEQ ID NO: 3918688 - DNA, 21 bp, Homo sapiens
ccacccagggctccctcctgg

SEQ ID NO: 3918689 - DNA, 23 bp, Homo sapiens
ccacccagggctccctcctggag

SEQ ID NO: 3918690 - DNA, 20 bp, Homo sapiens
ccacccagtgctgccatgcc

SEQ ID NO: 3918691 - DNA, 16 bp, Homo sapiens
ccaccccactccagcc

SEQ ID NO: 3918692 - DNA, 14 bp, Homo sapiens
ccacccccatgcag

SEQ ID NO: 3918693 - DNA, 18 bp, Homo sapiens
ccacccccgccacggcca

SEQ ID NO: 3918694 - DNA, 20 bp, Homo sapiens
ccacccccgctgggggtggg

SEQ ID NO: 3918695 - DNA, 15 bp, Homo sapiens
ccaccccctccagct

SEQ ID NO: 3918696 - DNA, 16 bp, Homo sapiens
ccaccccctccccagg

SEQ ID NO: 3918697 - DNA, 17 bp, Homo sapiens
ccaccccctccccaggg

SEQ ID NO: 3918698 - DNA, 12 bp, Homo sapiens
ccacccccttca

SEQ ID NO: 3918699 - DNA, 20 bp, Homo sapiens
ccacccccttcagtgcccac

SEQ ID NO: 3918700 - DNA, 22 bp, Homo sapiens
ccacccccttcagtgcccacca

SEQ ID NO: 3918701 - DNA, 17 bp, Homo sapiens
ccaccccggcctccact

SEQ ID NO: 3918702 - DNA, 17 bp, Homo sapiens
ccaccccgtgccacccg

SEQ ID NO: 3918703 - DNA, 13 bp, Homo sapiens
ccaccccttcctg

SEQ ID NO: 3918704 - DNA, 16 bp, Homo sapiens
ccacccgtaggcagcc

SEQ ID NO: 3918705 - DNA, 23 bp, Homo sapiens
ccacccgtaggcagcctctctgc

SEQ ID NO: 3918706 - DNA, 22 bp, Homo sapiens
ccacccgttctgctggcctgga

SEQ ID NO: 3918707 - DNA, 18 bp, Homo sapiens
ccaccctaaaatgacagc

SEQ ID NO: 3918708 - DNA, 18 bp, Homo sapiens
ccaccctcgtggacacct

SEQ ID NO: 3918709 - DNA, 19 bp, Homo sapiens
ccaccctcgtggacacctg

SEQ ID NO: 3918710 - DNA, 20 bp, Homo sapiens
ccaccctcgtggacacctgc

SEQ ID NO: 3918711 - DNA, 22 bp, Homo sapiens
ccaccctcgtggacacctgccc

SEQ ID NO: 3918712 - DNA, 16 bp, Homo sapiens
ccaccctctccatgcc

SEQ ID NO: 3918713 - DNA, 13 bp, Homo sapiens
ccaccctggcccg

SEQ ID NO: 3918714 - DNA, 13 bp, Homo sapiens
ccaccgctgccta

SEQ ID NO: 3918715 - DNA, 14 bp, Homo sapiens
ccaccgggagcctc

SEQ ID NO: 3918716 - DNA, 17 bp, Homo sapiens
ccaccgggagcctcccc

SEQ ID NO: 3918717 - DNA, 18 bp, Homo sapiens
ccaccgggccactccttc

SEQ ID NO: 3918718 - DNA, 21 bp, Homo sapiens
ccaccgggccactccttcctg

SEQ ID NO: 3918719 - DNA, 19 bp, Homo sapiens
ccaccgggctgggagctct

SEQ ID NO: 3918720 - DNA, 21 bp, Homo sapiens
ccaccggggaacccagccctg

SEQ ID NO: 3918721 - DNA, 18 bp, Homo sapiens
ccacctaggccactcctc

SEQ ID NO: 3918722 - DNA, 16 bp, Homo sapiens
ccacctcactcctgtt

SEQ ID NO: 3918723 - DNA, 18 bp, Homo sapiens
ccacctcagcctcccaga

SEQ ID NO: 3918724 - DNA, 14 bp, Homo sapiens
ccacctccaccccc

SEQ ID NO: 3918725 - DNA, 17 bp, Homo sapiens
ccacctcccaccccact

SEQ ID NO: 3918726 - DNA, 21 bp, Homo sapiens
ccacctcccaccccactccag

SEQ ID NO: 3918727 - DNA, 18 bp, Homo sapiens
ccacctcctagaggtggg

SEQ ID NO: 3918728 - DNA, 14 bp, Homo sapiens
ccacctctcaatat

SEQ ID NO: 3918729 - DNA, 15 bp, Homo sapiens
ccacctctctttttc

SEQ ID NO: 3918730 - DNA, 18 bp, Homo sapiens
ccacctgacaatggcagc

SEQ ID NO: 3918731 - DNA, 21 bp, Homo sapiens
ccacctgacaatggcagctag

SEQ ID NO: 3918732 - DNA, 14 bp, Homo sapiens
ccacctgcctatcc

SEQ ID NO: 3918733 - DNA, 16 bp, Homo sapiens
ccacctgtctgtctgt

SEQ ID NO: 3918734 - DNA, 22 bp, Homo sapiens
ccacctgttaaaatgtacactg

SEQ ID NO: 3918735 - DNA, 11 bp, Homo sapiens
ccaccttccca

SEQ ID NO: 3918736 - DNA, 14 bp, Homo sapiens
ccaccttcccagct

SEQ ID NO: 3918737 - DNA, 16 bp, Homo sapiens
ccaccttcccagctct

SEQ ID NO: 3918738 - DNA, 21 bp, Homo sapiens
ccaccttcccagctctccctc

SEQ ID NO: 3918739 - DNA, 14 bp, Homo sapiens
ccaccttcccatgc

SEQ ID NO: 3918740 - DNA, 12 bp, Homo sapiens
ccaccttcccca

SEQ ID NO: 3918741 - DNA, 16 bp, Homo sapiens
ccaccttccccagact

SEQ ID NO: 3918742 - DNA, 22 bp, Homo sapiens
ccaccttccccagactcagctc

SEQ ID NO: 3918743 - DNA, 17 bp, Homo sapiens
ccaccttggactcctcc

SEQ ID NO: 3918744 - DNA, 19 bp, Homo sapiens
ccaccttggactcctccca

SEQ ID NO: 3918745 - DNA, 23 bp, Homo sapiens
ccaccttggactcctcccacaat

SEQ ID NO: 3918746 - DNA, 19 bp, Homo sapiens
ccacctttgggatcagcct

SEQ ID NO: 3918747 - DNA, 22 bp, Homo sapiens
ccacctttgggatcagcctccg

SEQ ID NO: 3918748 - DNA, 22 bp, Homo sapiens
ccacgaatttggtgtggctgta

SEQ ID NO: 3918749 - DNA, 18 bp, Homo sapiens
ccacgagtcacctgcaag

SEQ ID NO: 3918750 - DNA, 19 bp, Homo sapiens
ccacgagtcacctgcaagc

SEQ ID NO: 3918751 - DNA, 17 bp, Homo sapiens
ccacgatgtggccctgg

SEQ ID NO: 3918752 - DNA, 20 bp, Homo sapiens
ccacgatgtggccctggcct

SEQ ID NO: 3918753 - DNA, 17 bp, Homo sapiens
ccacgcacacatggaca

SEQ ID NO: 3918754 - DNA, 20 bp, Homo sapiens
ccacgcccgactagcaggca

SEQ ID NO: 3918755 - DNA, 14 bp, Homo sapiens
ccacgctgtcctct

SEQ ID NO: 3918756 - DNA, 16 bp, Homo sapiens
ccacggccaccctcct

SEQ ID NO: 3918757 - DNA, 17 bp, Homo sapiens
ccacggccaccctcctt

SEQ ID NO: 3918758 - DNA, 12 bp, Homo sapiens
ccacggccttgt

SEQ ID NO: 3918759 - DNA, 15 bp, Homo sapiens
ccacgggcctcagtt

SEQ ID NO: 3918760 - DNA, 17 bp, Homo sapiens
ccacgggcctcagtttc

SEQ ID NO: 3918761 - DNA, 18 bp, Homo sapiens
ccacgggcctcagtttcc

SEQ ID NO: 3918762 - DNA, 17 bp, Homo sapiens
ccacggtgcgtggctgt

SEQ ID NO: 3918763 - DNA, 19 bp, Homo sapiens
ccacggtgcgtggctgtgg

SEQ ID NO: 3918764 - DNA, 15 bp, Homo sapiens
ccacgtccccctggg

SEQ ID NO: 3918765 - DNA, 18 bp, Homo sapiens
ccacgtgagagaatctgc

SEQ ID NO: 3918766 - DNA, 20 bp, Homo sapiens
ccacgtgagagaatctgcct

SEQ ID NO: 3918767 - DNA, 14 bp, Homo sapiens
ccacgtgccaggcc

SEQ ID NO: 3918768 - DNA, 16 bp, Homo sapiens
ccacgtgccaggcccg

SEQ ID NO: 3918769 - DNA, 18 bp, Homo sapiens
ccacgtggtgtccctgcg

SEQ ID NO: 3918770 - DNA, 21 bp, Homo sapiens
ccacgttccttactgcagaat

SEQ ID NO: 3918771 - DNA, 18 bp, Homo sapiens
ccactaagctttctcctt

SEQ ID NO: 3918772 - DNA, 21 bp, Homo sapiens
ccactaagctttctcctttga

SEQ ID NO: 3918773 - DNA, 14 bp, Homo sapiens
ccactacctttgtc

SEQ ID NO: 3918774 - DNA, 20 bp, Homo sapiens
ccactagggtcctggccctc

SEQ ID NO: 3918775 - DNA, 20 bp, Homo sapiens
ccactcaatgacatcatgtt

SEQ ID NO: 3918776 - DNA, 13 bp, Homo sapiens
ccactcaccaggg

SEQ ID NO: 3918777 - DNA, 15 bp, Homo sapiens
ccactcaccagggtc

SEQ ID NO: 3918778 - DNA, 20 bp, Homo sapiens
ccactccacctccacccact

SEQ ID NO: 3918779 - DNA, 12 bp, Homo sapiens
ccactccagccc

SEQ ID NO: 3918780 - DNA, 16 bp, Homo sapiens
ccactccagccctgtc

SEQ ID NO: 3918781 - DNA, 13 bp, Homo sapiens
ccactccctgagc

SEQ ID NO: 3918782 - DNA, 14 bp, Homo sapiens
ccactccctgagct

SEQ ID NO: 3918783 - DNA, 14 bp, Homo sapiens
ccactcctgtcccg

SEQ ID NO: 3918784 - DNA, 20 bp, Homo sapiens
ccactcctgtcccgccttcc

SEQ ID NO: 3918785 - DNA, 13 bp, Homo sapiens
ccactccttcctg

SEQ ID NO: 3918786 - DNA, 14 bp, Homo sapiens
ccactccttcctgc

SEQ ID NO: 3918787 - DNA, 18 bp, Homo sapiens
ccactccttcctgcccca

SEQ ID NO: 3918788 - DNA, 23 bp, Homo sapiens
ccactctcaggaggcgcagcccg

SEQ ID NO: 3918789 - DNA, 17 bp, Homo sapiens
ccactctcattccccag

SEQ ID NO: 3918790 - DNA, 16 bp, Homo sapiens
ccactctcccctccct

SEQ ID NO: 3918791 - DNA, 22 bp, Homo sapiens
ccactctcccctccctcttcct

SEQ ID NO: 3918792 - DNA, 16 bp, Homo sapiens
ccactctggcagccac

SEQ ID NO: 3918793 - DNA, 12 bp, Homo sapiens
ccactctttgct

SEQ ID NO: 3918794 - DNA, 22 bp, Homo sapiens
ccactctttgctacaataaatg

SEQ ID NO: 3918795 - DNA, 14 bp, Homo sapiens
ccactgccagcagc

SEQ ID NO: 3918796 - DNA, 13 bp, Homo sapiens
ccactgccaggca

SEQ ID NO: 3918797 - DNA, 14 bp, Homo sapiens
ccactgccaggcac

SEQ ID NO: 3918798 - DNA, 15 bp, Homo sapiens
ccactgccaggcacc

SEQ ID NO: 3918799 - DNA, 18 bp, Homo sapiens
ccactgccaggcacctgg

SEQ ID NO: 3918800 - DNA, 21 bp, Homo sapiens
ccactgccaggcacctggcct

SEQ ID NO: 3918801 - DNA, 24 bp, Homo sapiens
ccactgccaggcacctggcctgct

SEQ ID NO: 3918802 - DNA, 12 bp, Homo sapiens
ccactgccctgc

SEQ ID NO: 3918803 - DNA, 17 bp, Homo sapiens
ccactgccctgcctgcc

SEQ ID NO: 3918804 - DNA, 11 bp, Homo sapiens
ccactgcctct

SEQ ID NO: 3918805 - DNA, 23 bp, Homo sapiens
ccactggactgggttttgtctct

SEQ ID NO: 3918806 - DNA, 15 bp, Homo sapiens
ccactggccagtcct

SEQ ID NO: 3918807 - DNA, 16 bp, Homo sapiens
ccactgggtctcactc

SEQ ID NO: 3918808 - DNA, 19 bp, Homo sapiens
ccactggttaaaataaagc

SEQ ID NO: 3918809 - DNA, 17 bp, Homo sapiens
ccactgtcaccctccac

SEQ ID NO: 3918810 - DNA, 22 bp, Homo sapiens
ccactgtccgcctctgcccgca

SEQ ID NO: 3918811 - DNA, 14 bp, Homo sapiens
ccactgtcctggct

SEQ ID NO: 3918812 - DNA, 12 bp, Homo sapiens
ccactgtggcca

SEQ ID NO: 3918813 - DNA, 14 bp, Homo sapiens
ccactgtggccaga

SEQ ID NO: 3918814 - DNA, 19 bp, Homo sapiens
ccacttagaaattgcattt

SEQ ID NO: 3918815 - DNA, 21 bp, Homo sapiens
ccacttagaaattgcatttcc

SEQ ID NO: 3918816 - DNA, 15 bp, Homo sapiens
ccacttcagcccagc

SEQ ID NO: 3918817 - DNA, 22 bp, Homo sapiens
ccacttctgcgatatttttcca

SEQ ID NO: 3918818 - DNA, 16 bp, Homo sapiens
ccacttcttttataac

SEQ ID NO: 3918819 - DNA, 15 bp, Homo sapiens
ccacttgacattcct

SEQ ID NO: 3918820 - DNA, 16 bp, Homo sapiens
ccacttgacattcctt

SEQ ID NO: 3918821 - DNA, 15 bp, Homo sapiens
ccacttggctgctca

SEQ ID NO: 3918822 - DNA, 17 bp, Homo sapiens
ccacttgggtcttccct

SEQ ID NO: 3918823 - DNA, 14 bp, Homo sapiens
ccacttgtcatcca

SEQ ID NO: 3918824 - DNA, 21 bp, Homo sapiens
ccactttggtcccgtgcagct

SEQ ID NO: 3918825 - DNA, 16 bp, Homo sapiens
ccagaaaatataaatg

SEQ ID NO: 3918826 - DNA, 17 bp, Homo sapiens
ccagaaaatataaatgc

SEQ ID NO: 3918827 - DNA, 13 bp, Homo sapiens
ccagaaattagaa

SEQ ID NO: 3918828 - DNA, 17 bp, Homo sapiens
ccagaaattccttccca

SEQ ID NO: 3918829 - DNA, 17 bp, Homo sapiens
ccagaaccacactgttg

SEQ ID NO: 3918830 - DNA, 23 bp, Homo sapiens
ccagaactgaggtcactgggttc

SEQ ID NO: 3918831 - DNA, 20 bp, Homo sapiens
ccagaagaatattcaggact

SEQ ID NO: 3918832 - DNA, 18 bp, Homo sapiens
ccagaaggagggcagagc

SEQ ID NO: 3918833 - DNA, 23 bp, Homo sapiens
ccagaaggagggcagagccatgg

SEQ ID NO: 3918834 - DNA, 15 bp, Homo sapiens
ccagaagtccctccc

SEQ ID NO: 3918835 - DNA, 20 bp, Homo sapiens
ccagaagtttgtcaagtcaa

SEQ ID NO: 3918836 - DNA, 14 bp, Homo sapiens
ccagaataagtgct

SEQ ID NO: 3918837 - DNA, 23 bp, Homo sapiens
ccagaatctgctgttgccatagc

SEQ ID NO: 3918838 - DNA, 20 bp, Homo sapiens
ccagaatcttcgtcctgccc

SEQ ID NO: 3918839 - DNA, 21 bp, Homo sapiens
ccagaatcttcgtcctgcccc

SEQ ID NO: 3918840 - DNA, 11 bp, Homo sapiens
ccagacacatt

SEQ ID NO: 3918841 - DNA, 13 bp, Homo sapiens
ccagacagataca

SEQ ID NO: 3918842 - DNA, 12 bp, Homo sapiens
ccagaccacctg

SEQ ID NO: 3918843 - DNA, 14 bp, Homo sapiens
ccagaccacctgcc

SEQ ID NO: 3918844 - DNA, 17 bp, Homo sapiens
ccagaccacctgccagc

SEQ ID NO: 3918845 - DNA, 18 bp, Homo sapiens
ccagaccacctgccagcc

SEQ ID NO: 3918846 - DNA, 22 bp, Homo sapiens
ccagaccacctgccagccatca

SEQ ID NO: 3918847 - DNA, 12 bp, Homo sapiens
ccagacccctct

SEQ ID NO: 3918848 - DNA, 17 bp, Homo sapiens
ccagacccctggctttt

SEQ ID NO: 3918849 - DNA, 12 bp, Homo sapiens
ccagaccctgcc

SEQ ID NO: 3918850 - DNA, 16 bp, Homo sapiens
ccagaccctgcctgag

SEQ ID NO: 3918851 - DNA, 21 bp, Homo sapiens
ccagaccctgcctgagcccag

SEQ ID NO: 3918852 - DNA, 13 bp, Homo sapiens
ccagacctagacc

SEQ ID NO: 3918853 - DNA, 14 bp, Homo sapiens
ccagaccttttatc

SEQ ID NO: 3918854 - DNA, 13 bp, Homo sapiens
ccagactcagctc

SEQ ID NO: 3918855 - DNA, 19 bp, Homo sapiens
ccagactcctttcctctga

SEQ ID NO: 3918856 - DNA, 22 bp, Homo sapiens
ccagactgcttccaattttctg

SEQ ID NO: 3918857 - DNA, 12 bp, Homo sapiens
ccagactgtgga

SEQ ID NO: 3918858 - DNA, 13 bp, Homo sapiens
ccagactgtggag

SEQ ID NO: 3918859 - DNA, 16 bp, Homo sapiens
ccagactgtggagaaa

SEQ ID NO: 3918860 - DNA, 16 bp, Homo sapiens
ccagactttctacacc

SEQ ID NO: 3918861 - DNA, 19 bp, Homo sapiens
ccagagaatcagggcaggc

SEQ ID NO: 3918862 - DNA, 18 bp, Homo sapiens
ccagagaccccttccttt

SEQ ID NO: 3918863 - DNA, 22 bp, Homo sapiens
ccagagaccttttctctcccat

SEQ ID NO: 3918864 - DNA, 21 bp, Homo sapiens
ccagagagaggatgcagaggg

SEQ ID NO: 3918865 - DNA, 16 bp, Homo sapiens
ccagagaggaatcaga

SEQ ID NO: 3918866 - DNA, 19 bp, Homo sapiens
ccagagaggagcacctgaa

SEQ ID NO: 3918867 - DNA, 16 bp, Homo sapiens
ccagagagggcccagc

SEQ ID NO: 3918868 - DNA, 19 bp, Homo sapiens
ccagagagggcccagctgt

SEQ ID NO: 3918869 - DNA, 14 bp, Homo sapiens
ccagagagtcctct

SEQ ID NO: 3918870 - DNA, 17 bp, Homo sapiens
ccagagagtcctctgga

SEQ ID NO: 3918871 - DNA, 18 bp, Homo sapiens
ccagagagtcctctggat

SEQ ID NO: 3918872 - DNA, 15 bp, Homo sapiens
ccagagagtggctcc

SEQ ID NO: 3918873 - DNA, 15 bp, Homo sapiens
ccagagatgcctcca

SEQ ID NO: 3918874 - DNA, 23 bp, Homo sapiens
ccagagcacaagttccagctggt

SEQ ID NO: 3918875 - DNA, 17 bp, Homo sapiens
ccagagccactaccttt

SEQ ID NO: 3918876 - DNA, 12 bp, Homo sapiens
ccagagccagcc

SEQ ID NO: 3918877 - DNA, 19 bp, Homo sapiens
ccagagccagcctgggact

SEQ ID NO: 3918878 - DNA, 16 bp, Homo sapiens
ccagagcccaagtgcc

SEQ ID NO: 3918879 - DNA, 15 bp, Homo sapiens
ccagagccccactcc

SEQ ID NO: 3918880 - DNA, 22 bp, Homo sapiens
ccagagccggggcactttcaga

SEQ ID NO: 3918881 - DNA, 18 bp, Homo sapiens
ccagagcctggggctcta

SEQ ID NO: 3918882 - DNA, 13 bp, Homo sapiens
ccagagctggaag

SEQ ID NO: 3918883 - DNA, 17 bp, Homo sapiens
ccagagctggaaggcag

SEQ ID NO: 3918884 - DNA, 19 bp, Homo sapiens
ccagagctggaaggcaggg

SEQ ID NO: 3918885 - DNA, 20 bp, Homo sapiens
ccagagctggaaggcagggc

SEQ ID NO: 3918886 - DNA, 22 bp, Homo sapiens
ccagagctggaaggcagggcag

SEQ ID NO: 3918887 - DNA, 14 bp, Homo sapiens
ccagagctgggagg

SEQ ID NO: 3918888 - DNA, 18 bp, Homo sapiens
ccagagcttattggccac

SEQ ID NO: 3918889 - DNA, 19 bp, Homo sapiens
ccagagcttattggccact

SEQ ID NO: 3918890 - DNA, 20 bp, Homo sapiens
ccagagcttattggccactg

SEQ ID NO: 3918891 - DNA, 22 bp, Homo sapiens
ccagaggccaggaatctgccat

SEQ ID NO: 3918892 - DNA, 19 bp, Homo sapiens
ccagaggctattattttca

SEQ ID NO: 3918893 - DNA, 13 bp, Homo sapiens
ccagagggacagg

SEQ ID NO: 3918894 - DNA, 15 bp, Homo sapiens
ccagagggccaagag

SEQ ID NO: 3918895 - DNA, 20 bp, Homo sapiens
ccagagggtagggcagcaga

SEQ ID NO: 3918896 - DNA, 21 bp, Homo sapiens
ccagagggtagggcagcagat

SEQ ID NO: 3918897 - DNA, 20 bp, Homo sapiens
ccagaggttatctgcctggc

SEQ ID NO: 3918898 - DNA, 23 bp, Homo sapiens
ccagaggttatctgcctggcctg

SEQ ID NO: 3918899 - DNA, 14 bp, Homo sapiens
ccagagtctgagcc

SEQ ID NO: 3918900 - DNA, 15 bp, Homo sapiens
ccagagtctgagccc

SEQ ID NO: 3918901 - DNA, 16 bp, Homo sapiens
ccagagtctgagcccc

SEQ ID NO: 3918902 - DNA, 17 bp, Homo sapiens
ccagagtctgagccccc

SEQ ID NO: 3918903 - DNA, 23 bp, Homo sapiens
ccagagtctgagcccccggctag

SEQ ID NO: 3918904 - DNA, 12 bp, Homo sapiens
ccagagtgtgaa

SEQ ID NO: 3918905 - DNA, 21 bp, Homo sapiens
ccagatcaccagcccggcctg

SEQ ID NO: 3918906 - DNA, 17 bp, Homo sapiens
ccagatcctcacaacca

SEQ ID NO: 3918907 - DNA, 17 bp, Homo sapiens
ccagatcctctgctgac

SEQ ID NO: 3918908 - DNA, 19 bp, Homo sapiens
ccagatctgcactgggtgt

SEQ ID NO: 3918909 - DNA, 14 bp, Homo sapiens
ccagatctgcctgg

SEQ ID NO: 3918910 - DNA, 16 bp, Homo sapiens
ccagatctgcctgggc

SEQ ID NO: 3918911 - DNA, 17 bp, Homo sapiens
ccagatctgcctgggcc

SEQ ID NO: 3918912 - DNA, 14 bp, Homo sapiens
ccagatgcaacctc

SEQ ID NO: 3918913 - DNA, 17 bp, Homo sapiens
ccagatgcaacctcact

SEQ ID NO: 3918914 - DNA, 13 bp, Homo sapiens
ccagatgccttcc

SEQ ID NO: 3918915 - DNA, 19 bp, Homo sapiens
ccagattcttccactggct

SEQ ID NO: 3918916 - DNA, 24 bp, Homo sapiens
ccagattttttacagctgcctgca

SEQ ID NO: 3918917 - DNA, 19 bp, Homo sapiens
ccagcaaaccaggactctg

SEQ ID NO: 3918918 - DNA, 15 bp, Homo sapiens
ccagcaacacaagct

SEQ ID NO: 3918919 - DNA, 19 bp, Homo sapiens
ccagcaacatctcgagccc

SEQ ID NO: 3918920 - DNA, 23 bp, Homo sapiens
ccagcaacatctcgagccccctg

SEQ ID NO: 3918921 - DNA, 17 bp, Homo sapiens
ccagcaagtttcacctt

SEQ ID NO: 3918922 - DNA, 14 bp, Homo sapiens
ccagcacaggggcc

SEQ ID NO: 3918923 - DNA, 24 bp, Homo sapiens
ccagcacaggggccccagatctgc

SEQ ID NO: 3918924 - DNA, 20 bp, Homo sapiens
ccaggccgcctgccataccg

SEQ ID NO: 3918925 - DNA, 21 bp, Homo sapiens
ccaggccgttccccttggctt

SEQ ID NO: 3918926 - DNA, 22 bp, Homo sapiens
ccaggccgttccccttggcttc

SEQ ID NO: 3918927 - DNA, 18 bp, Homo sapiens
ccaggcctccagcctctc

SEQ ID NO: 3918928 - DNA, 16 bp, Homo sapiens
ccaggcctctgtgtcc

SEQ ID NO: 3918929 - DNA, 13 bp, Homo sapiens
ccaggctccatgg

SEQ ID NO: 3918930 - DNA, 19 bp, Homo sapiens
ccaggctccatggggaagt

SEQ ID NO: 3918931 - DNA, 21 bp, Homo sapiens
ccaggctccctttctcttctt

SEQ ID NO: 3918932 - DNA, 17 bp, Homo sapiens
ccaggctctgggaaggg

SEQ ID NO: 3918933 - DNA, 14 bp, Homo sapiens
ccaggctcttcctg

SEQ ID NO: 3918934 - DNA, 18 bp, Homo sapiens
ccaggctcttcctggacc

SEQ ID NO: 3918935 - DNA, 22 bp, Homo sapiens
ccaggctctttggggtcagcca

SEQ ID NO: 3918936 - DNA, 13 bp, Homo sapiens
ccaggctgaagag

SEQ ID NO: 3918937 - DNA, 13 bp, Homo sapiens
ccaggctgcactg

SEQ ID NO: 3918938 - DNA, 21 bp, Homo sapiens
ccaggctggtctcgaactcct

SEQ ID NO: 3918939 - DNA, 22 bp, Homo sapiens
ccagggactcagcgtcccctgc

SEQ ID NO: 3918940 - DNA, 23 bp, Homo sapiens
ccagggagcaatgggagggggct

SEQ ID NO: 3918941 - DNA, 13 bp, Homo sapiens
ccagggcacagga

SEQ ID NO: 3918942 - DNA, 16 bp, Homo sapiens
ccagggcacaggagct

SEQ ID NO: 3918943 - DNA, 17 bp, Homo sapiens
ccagggcacaggagcta

SEQ ID NO: 3918944 - DNA, 18 bp, Homo sapiens
ccagggcaggctacccct

SEQ ID NO: 3918945 - DNA, 14 bp, Homo sapiens
ccagggccctaacg

SEQ ID NO: 3918946 - DNA, 17 bp, Homo sapiens
ccagggcctactgccac

SEQ ID NO: 3918947 - DNA, 15 bp, Homo sapiens
ccagggcctgggaaa

SEQ ID NO: 3918948 - DNA, 13 bp, Homo sapiens
ccagggcctgggg

SEQ ID NO: 3918949 - DNA, 13 bp, Homo sapiens
ccagggcctggtg

SEQ ID NO: 3918950 - DNA, 18 bp, Homo sapiens
ccagggctcaaaaagttt

SEQ ID NO: 3918951 - DNA, 21 bp, Homo sapiens
ccagggctccctcctggagca

SEQ ID NO: 3918952 - DNA, 13 bp, Homo sapiens
ccagggctgcccc

SEQ ID NO: 3918953 - DNA, 19 bp, Homo sapiens
ccagggctgcccctgtagg

SEQ ID NO: 3918954 - DNA, 19 bp, Homo sapiens
ccagggcttttcccaggaa

SEQ ID NO: 3918955 - DNA, 23 bp, Homo sapiens
ccaggggctgctcatcacccagt

SEQ ID NO: 3918956 - DNA, 19 bp, Homo sapiens
ccaggggtctccctggagt

SEQ ID NO: 3918957 - DNA, 16 bp, Homo sapiens
ccagggtccgcaccag

SEQ ID NO: 3918958 - DNA, 21 bp, Homo sapiens
ccagggtccgcaccagctgct

SEQ ID NO: 3918959 - DNA, 22 bp, Homo sapiens
ccagggtccgcaccagctgctc

SEQ ID NO: 3918960 - DNA, 23 bp, Homo sapiens
ccagggtcttgggctactggcag

SEQ ID NO: 3918961 - DNA, 22 bp, Homo sapiens
ccagggtgagagctgctctgga

SEQ ID NO: 3918962 - DNA, 23 bp, Homo sapiens
ccagggtgcatggcttggggagc

SEQ ID NO: 3918963 - DNA, 16 bp, Homo sapiens
ccaggtaatgagggac

SEQ ID NO: 3918964 - DNA, 18 bp, Homo sapiens
ccaggtatctccaggatt

SEQ ID NO: 3918965 - DNA, 10 bp, Homo sapiens
ccaggtcctc

SEQ ID NO: 3918966 - DNA, 12 bp, Homo sapiens
ccaggtcctggt

SEQ ID NO: 3918967 - DNA, 14 bp, Homo sapiens
ccaggtccttcctt

SEQ ID NO: 3918968 - DNA, 12 bp, Homo sapiens
ccaggtgagctg

SEQ ID NO: 3918969 - DNA, 16 bp, Homo sapiens
ccaggtgccaccaata

SEQ ID NO: 3918970 - DNA, 18 bp, Homo sapiens
ccaggtgccaccaataaa

SEQ ID NO: 3918971 - DNA, 19 bp, Homo sapiens
ccaggtgccaccaataaaa

SEQ ID NO: 3918972 - DNA, 20 bp, Homo sapiens
ccaggtggctgacccagtcc

SEQ ID NO: 3918973 - DNA, 23 bp, Homo sapiens
ccaggtgtggctgtcaggacacc

SEQ ID NO: 3918974 - DNA, 16 bp, Homo sapiens
ccagtacttctaagag

SEQ ID NO: 3918975 - DNA, 14 bp, Homo sapiens
ccagtatggaaggg

SEQ ID NO: 3918976 - DNA, 20 bp, Homo sapiens
ccagtcacctcttctgccag

SEQ ID NO: 3918977 - DNA, 15 bp, Homo sapiens
ccagtccccgtgccc

SEQ ID NO: 3918978 - DNA, 17 bp, Homo sapiens
ccagtccccgtgccccg

SEQ ID NO: 3918979 - DNA, 19 bp, Homo sapiens
ccagtccctgggggaagcc

SEQ ID NO: 3918980 - DNA, 15 bp, Homo sapiens
ccagtcctagagctc

SEQ ID NO: 3918981 - DNA, 22 bp, Homo sapiens
ccagtcctagagctcctgtccc

SEQ ID NO: 3918982 - DNA, 23 bp, Homo sapiens
ccagtcctagagctcctgtccct

SEQ ID NO: 3918983 - DNA, 24 bp, Homo sapiens
ccagtcctagagctcctgtcccta

SEQ ID NO: 3918984 - DNA, 14 bp, Homo sapiens
ccagtctaaaaata

SEQ ID NO: 3918985 - DNA, 19 bp, Homo sapiens
ccagtctacgttctccagc

SEQ ID NO: 3918986 - DNA, 23 bp, Homo sapiens
ccagtctacgttctccagcccac

SEQ ID NO: 3918987 - DNA, 15 bp, Homo sapiens
ccagtctcctgacat

SEQ ID NO: 3918988 - DNA, 16 bp, Homo sapiens
ccagtctgggctgccg

SEQ ID NO: 3918989 - DNA, 19 bp, Homo sapiens
ccagtctgggctgccgggt

SEQ ID NO: 3918990 - DNA, 12 bp, Homo sapiens
ccagtcttgcct

SEQ ID NO: 3918991 - DNA, 16 bp, Homo sapiens
ccagtcttgcctaggc

SEQ ID NO: 3918992 - DNA, 21 bp, Homo sapiens
ccagtgaacttacacttggag

SEQ ID NO: 3918993 - DNA, 22 bp, Homo sapiens
ccagtgaacttacacttggagc

SEQ ID NO: 3918994 - DNA, 23 bp, Homo sapiens
ccagtgaacttacacttggagcc

SEQ ID NO: 3918995 - DNA, 18 bp, Homo sapiens
ccagtgacctgctgggta

SEQ ID NO: 3918996 - DNA, 20 bp, Homo sapiens
ccagtgacctgctgggtaaa

SEQ ID NO: 3918997 - DNA, 14 bp, Homo sapiens
ccagtgagggctgg

SEQ ID NO: 3918998 - DNA, 15 bp, Homo sapiens
ccagtgagggctggg

SEQ ID NO: 3918999 - DNA, 16 bp, Homo sapiens
ccagtgatgtgctgga

SEQ ID NO: 3919000 - DNA, 18 bp, Homo sapiens
ccagtgatgtgctggagc

SEQ ID NO: 3919001 - DNA, 20 bp, Homo sapiens
ccagtgatgtgctggagctg

SEQ ID NO: 3919002 - DNA, 12 bp, Homo sapiens
ccagtgccacag

SEQ ID NO: 3919003 - DNA, 16 bp, Homo sapiens
ccagtgccacagagaa

SEQ ID NO: 3919004 - DNA, 19 bp, Homo sapiens
ccagtgcccaaagtctgtg

SEQ ID NO: 3919005 - DNA, 22 bp, Homo sapiens
ccagtgcccaaagtctgtgtga

SEQ ID NO: 3919006 - DNA, 14 bp, Homo sapiens
ccagtgctgccatg

SEQ ID NO: 3919007 - DNA, 15 bp, Homo sapiens
ccagtgctgccatgc

SEQ ID NO: 3919008 - DNA, 12 bp, Homo sapiens
ccagtgggacag

SEQ ID NO: 3919009 - DNA, 16 bp, Homo sapiens
ccagtgtcccctccac

SEQ ID NO: 3919010 - DNA, 23 bp, Homo sapiens
ccagtgttggctgtgtgacagaa

SEQ ID NO: 3919011 - DNA, 22 bp, Homo sapiens
ccagttctggccaggagctgga

SEQ ID NO: 3919012 - DNA, 15 bp, Homo sapiens
ccagttgcaataaaa

SEQ ID NO: 3919013 - DNA, 18 bp, Homo sapiens
ccagttgggagcactgga

SEQ ID NO: 3919014 - DNA, 13 bp, Homo sapiens
ccagtttcccacc

SEQ ID NO: 3919015 - DNA, 13 bp, Homo sapiens
ccagtttgcagaa

SEQ ID NO: 3919016 - DNA, 18 bp, Homo sapiens
ccataatagttagccctc

SEQ ID NO: 3919017 - DNA, 19 bp, Homo sapiens
ccataatagttagccctca

SEQ ID NO: 3919018 - DNA, 12 bp, Homo sapiens
ccataatgccac

SEQ ID NO: 3919019 - DNA, 13 bp, Homo sapiens
ccataatgccact

SEQ ID NO: 3919020 - DNA, 14 bp, Homo sapiens
ccataatgccactg

SEQ ID NO: 3919021 - DNA, 20 bp, Homo sapiens
ccataccatcactgagtggc

SEQ ID NO: 3919022 - DNA, 18 bp, Homo sapiens
ccatacccctgcctgggt

SEQ ID NO: 3919023 - DNA, 14 bp, Homo sapiens
ccatactcatttct

SEQ ID NO: 3919024 - DNA, 17 bp, Homo sapiens
ccatacttttgagaggg

SEQ ID NO: 3919025 - DNA, 13 bp, Homo sapiens
ccatagaaacatg

SEQ ID NO: 3919026 - DNA, 21 bp, Homo sapiens
ccatagaaacatgacactgac

SEQ ID NO: 3919027 - DNA, 12 bp, Homo sapiens
ccatagaacaga

SEQ ID NO: 3919028 - DNA, 16 bp, Homo sapiens
ccatagagtttaacac

SEQ ID NO: 3919029 - DNA, 21 bp, Homo sapiens
ccatagcaagattgcttaaaa

SEQ ID NO: 3919030 - DNA, 16 bp, Homo sapiens
ccatagcgctggctca

SEQ ID NO: 3919031 - DNA, 16 bp, Homo sapiens
ccatatggaggcctga

SEQ ID NO: 3919032 - DNA, 15 bp, Homo sapiens
ccatatgtctgcttc

SEQ ID NO: 3919033 - DNA, 18 bp, Homo sapiens
ccatatgtctgcttctgt

SEQ ID NO: 3919034 - DNA, 22 bp, Homo sapiens
ccatatgtgtgaattctgcaac

SEQ ID NO: 3919035 - DNA, 22 bp, Homo sapiens
ccatattggcatggatttctgt

SEQ ID NO: 3919036 - DNA, 16 bp, Homo sapiens
ccatcaatggaaacag

SEQ ID NO: 3919037 - DNA, 17 bp, Homo sapiens
ccatcaatggaaacagg

SEQ ID NO: 3919038 - DNA, 19 bp, Homo sapiens
ccatcaccctctgggcagc

SEQ ID NO: 3919039 - DNA, 13 bp, Homo sapiens
ccatcactgagtg

SEQ ID NO: 3919040 - DNA, 12 bp, Homo sapiens
ccatcagctccc

SEQ ID NO: 3919041 - DNA, 13 bp, Homo sapiens
ccatcagggtggg

SEQ ID NO: 3919042 - DNA, 24 bp, Homo sapiens
ccatcagggtgggccactctcccc

SEQ ID NO: 3919043 - DNA, 20 bp, Homo sapiens
ccatcatatgacatgccacc

SEQ ID NO: 3919044 - DNA, 14 bp, Homo sapiens
ccatcatcccagct

SEQ ID NO: 3919045 - DNA, 13 bp, Homo sapiens
ccatcccacattc

SEQ ID NO: 3919046 - DNA, 13 bp, Homo sapiens
ccatccccagcga

SEQ ID NO: 3919047 - DNA, 15 bp, Homo sapiens
ccatcccctggactg

SEQ ID NO: 3919048 - DNA, 15 bp, Homo sapiens
ccatcccctttcctc

SEQ ID NO: 3919049 - DNA, 18 bp, Homo sapiens
ccatccctcggacccacc

SEQ ID NO: 3919050 - DNA, 12 bp, Homo sapiens
ccatccctgggc

SEQ ID NO: 3919051 - DNA, 13 bp, Homo sapiens
ccatccctgggcc

SEQ ID NO: 3919052 - DNA, 19 bp, Homo sapiens
ccatccgggacgcttccag

SEQ ID NO: 3919053 - DNA, 15 bp, Homo sapiens
ccatcctaccaatgc

SEQ ID NO: 3919054 - DNA, 14 bp, Homo sapiens
ccatcctggcccct

SEQ ID NO: 3919055 - DNA, 19 bp, Homo sapiens
ccatcctggcccctccaga

SEQ ID NO: 3919056 - DNA, 13 bp, Homo sapiens
ccatccttggcct

SEQ ID NO: 3919057 - DNA, 15 bp, Homo sapiens
ccatctaagctgcag

SEQ ID NO: 3919058 - DNA, 16 bp, Homo sapiens
ccatctaagctgcagc

SEQ ID NO: 3919059 - DNA, 17 bp, Homo sapiens
ccatctaagctgcagct

SEQ ID NO: 3919060 - DNA, 22 bp, Homo sapiens
ccatctcaggtgccactccctg

SEQ ID NO: 3919061 - DNA, 23 bp, Homo sapiens
ccatctcaggtgccactccctga

SEQ ID NO: 3919062 - DNA, 18 bp, Homo sapiens
ccatctccagcatcctgc

SEQ ID NO: 3919063 - DNA, 18 bp, Homo sapiens
ccatctccccaggcctcc

SEQ ID NO: 3919064 - DNA, 20 bp, Homo sapiens
ccatctccccaggcctccag

SEQ ID NO: 3919065 - DNA, 13 bp, Homo sapiens
ccatctcctccca

SEQ ID NO: 3919066 - DNA, 18 bp, Homo sapiens
ccatctcctcccatggcc

SEQ ID NO: 3919067 - DNA, 14 bp, Homo sapiens
ccatctctcttccc

SEQ ID NO: 3919068 - DNA, 16 bp, Homo sapiens
ccatgaatcaaagaca

SEQ ID NO: 3919069 - DNA, 17 bp, Homo sapiens
ccatgaatcaaagacat

SEQ ID NO: 3919070 - DNA, 20 bp, Homo sapiens
ccatgacctccagctttcct

SEQ ID NO: 3919071 - DNA, 21 bp, Homo sapiens
ccatgagaagagggcctgtgg

SEQ ID NO: 3919072 - DNA, 22 bp, Homo sapiens
ccatgagaataagagaaagaaa

SEQ ID NO: 3919073 - DNA, 20 bp, Homo sapiens
ccatgaggagttgctgtttg

SEQ ID NO: 3919074 - DNA, 19 bp, Homo sapiens
ccatgatctgtatttaatg

SEQ ID NO: 3919075 - DNA, 17 bp, Homo sapiens
ccatgcaattcatccca

SEQ ID NO: 3919076 - DNA, 11 bp, Homo sapiens
ccatgcagcct

SEQ ID NO: 3919077 - DNA, 14 bp, Homo sapiens
ccatgcagcttcat

SEQ ID NO: 3919078 - DNA, 19 bp, Homo sapiens
ccatgcagcttcatcaatt

SEQ ID NO: 3919079 - DNA, 12 bp, Homo sapiens
ccatgccactgc

SEQ ID NO: 3919080 - DNA, 15 bp, Homo sapiens
ccatgccactgccag

SEQ ID NO: 3919081 - DNA, 17 bp, Homo sapiens
ccatgccactgccaggc

SEQ ID NO: 3919082 - DNA, 18 bp, Homo sapiens
ccatgccactgccaggca

SEQ ID NO: 3919083 - DNA, 14 bp, Homo sapiens
ccatgcccaaccta

SEQ ID NO: 3919084 - DNA, 14 bp, Homo sapiens
ccatgcctcatgcc

SEQ ID NO: 3919085 - DNA, 16 bp, Homo sapiens
ccatgcctcatgccac

SEQ ID NO: 3919086 - DNA, 23 bp, Homo sapiens
ccatgcctcatgccacaccttct

SEQ ID NO: 3919087 - DNA, 13 bp, Homo sapiens
ccatgctctgccc

SEQ ID NO: 3919088 - DNA, 16 bp, Homo sapiens
ccatgctgaagggacc

SEQ ID NO: 3919089 - DNA, 14 bp, Homo sapiens
ccatgctgaattat

SEQ ID NO: 3919090 - DNA, 21 bp, Homo sapiens
ccatgctgctttttggcacag

SEQ ID NO: 3919091 - DNA, 20 bp, Homo sapiens
ccatgctggcggcgcagagg

SEQ ID NO: 3919092 - DNA, 17 bp, Homo sapiens
ccatgctttccttttct

SEQ ID NO: 3919093 - DNA, 18 bp, Homo sapiens
ccatgctttccttttctt

SEQ ID NO: 3919094 - DNA, 20 bp, Homo sapiens
ccatgctttccttttcttcc

SEQ ID NO: 3919095 - DNA, 22 bp, Homo sapiens
ccatgctttccttttcttcctt

SEQ ID NO: 3919096 - DNA, 13 bp, Homo sapiens
ccatggacacatt

SEQ ID NO: 3919097 - DNA, 22 bp, Homo sapiens
ccatggaggcaggctccccctg

SEQ ID NO: 3919098 - DNA, 15 bp, Homo sapiens
ccatggcaccagccc

SEQ ID NO: 3919099 - DNA, 13 bp, Homo sapiens
ccatggccacccc

SEQ ID NO: 3919100 - DNA, 17 bp, Homo sapiens
ccatggcctctggccag

SEQ ID NO: 3919101 - DNA, 21 bp, Homo sapiens
ccatggccttccctccccaca

SEQ ID NO: 3919102 - DNA, 17 bp, Homo sapiens
ccatggctcaggcaagc

SEQ ID NO: 3919103 - DNA, 22 bp, Homo sapiens
ccatgggagctggttagaaatg

SEQ ID NO: 3919104 - DNA, 11 bp, Homo sapiens
ccatgggcctg

SEQ ID NO: 3919105 - DNA, 13 bp, Homo sapiens
ccatgggcctgct

SEQ ID NO: 3919106 - DNA, 21 bp, Homo sapiens
ccatgggcctgctgcgtcaga

SEQ ID NO: 3919107 - DNA, 13 bp, Homo sapiens
ccatgggcctggg

SEQ ID NO: 3919108 - DNA, 16 bp, Homo sapiens
ccatgggcctgggcct

SEQ ID NO: 3919109 - DNA, 17 bp, Homo sapiens
ccatgggctagtgtgag

SEQ ID NO: 3919110 - DNA, 20 bp, Homo sapiens
ccatgggctagtgtgagtgg

SEQ ID NO: 3919111 - DNA, 20 bp, Homo sapiens
ccatggggaagtgctcccca

SEQ ID NO: 3919112 - DNA, 14 bp, Homo sapiens
ccatggtggaaggg

SEQ ID NO: 3919113 - DNA, 23 bp, Homo sapiens
ccatgtatttatctctatttaat

SEQ ID NO: 3919114 - DNA, 13 bp, Homo sapiens
ccatgtcacctca

SEQ ID NO: 3919115 - DNA, 16 bp, Homo sapiens
ccatgtcctatgtgtg

SEQ ID NO: 3919116 - DNA, 19 bp, Homo sapiens
ccatgtcctatgtgtgact

SEQ ID NO: 3919117 - DNA, 12 bp, Homo sapiens
ccatgtcgcctc

SEQ ID NO: 3919118 - DNA, 15 bp, Homo sapiens
ccatgtcgcctctgc

SEQ ID NO: 3919119 - DNA, 19 bp, Homo sapiens
ccatgtcgcctctgcattc

SEQ ID NO: 3919120 - DNA, 16 bp, Homo sapiens
ccatgtctctcagaat

SEQ ID NO: 3919121 - DNA, 13 bp, Homo sapiens
ccatgtggctgaa

SEQ ID NO: 3919122 - DNA, 12 bp, Homo sapiens
ccatgtgtcccc

SEQ ID NO: 3919123 - DNA, 13 bp, Homo sapiens
ccatgtgtcccct

SEQ ID NO: 3919124 - DNA, 15 bp, Homo sapiens
ccatgtgtcccctca

SEQ ID NO: 3919125 - DNA, 17 bp, Homo sapiens
ccatgtgtcccctcact

SEQ ID NO: 3919126 - DNA, 20 bp, Homo sapiens
ccatgtgtcccctcactctg

SEQ ID NO: 3919127 - DNA, 12 bp, Homo sapiens
ccatgtgtgctg

SEQ ID NO: 3919128 - DNA, 13 bp, Homo sapiens
ccatgtgtgctgt

SEQ ID NO: 3919129 - DNA, 19 bp, Homo sapiens
ccatgttatgtgactatct

SEQ ID NO: 3919130 - DNA, 21 bp, Homo sapiens
ccatgtttgagctcagacccc

SEQ ID NO: 3919131 - DNA, 20 bp, Homo sapiens
ccattaaatccgcaaacagc

SEQ ID NO: 3919132 - DNA, 22 bp, Homo sapiens
ccattcacatttgatgtacatg

SEQ ID NO: 3919133 - DNA, 18 bp, Homo sapiens
ccattcatgccaaagcaa

SEQ ID NO: 3919134 - DNA, 21 bp, Homo sapiens
ccattcccaagaaatgctttg

SEQ ID NO: 3919135 - DNA, 14 bp, Homo sapiens
ccattcccccatgt

SEQ ID NO: 3919136 - DNA, 12 bp, Homo sapiens
ccattcctcagg

SEQ ID NO: 3919137 - DNA, 16 bp, Homo sapiens
ccattcgtctgtccca

SEQ ID NO: 3919138 - DNA, 16 bp, Homo sapiens
ccattctctctcctgt

SEQ ID NO: 3919139 - DNA, 14 bp, Homo sapiens
ccattcttcctagt

SEQ ID NO: 3919140 - DNA, 14 bp, Homo sapiens
ccattgacctcagc

SEQ ID NO: 3919141 - DNA, 21 bp, Homo sapiens
ccattgacctcagctgcacat

SEQ ID NO: 3919142 - DNA, 22 bp, Homo sapiens
ccattgacctcagctgcacatt

SEQ ID NO: 3919143 - DNA, 20 bp, Homo sapiens
ccattgcatcacctctgtaa

SEQ ID NO: 3919144 - DNA, 14 bp, Homo sapiens
ccattgtcttccaa

SEQ ID NO: 3919145 - DNA, 22 bp, Homo sapiens
ccattgtcttccaaccccagct

SEQ ID NO: 3919146 - DNA, 23 bp, Homo sapiens
ccattgtcttccaaccccagctg

SEQ ID NO: 3919147 - DNA, 18 bp, Homo sapiens
ccattgttccttaccttt

SEQ ID NO: 3919148 - DNA, 19 bp, Homo sapiens
ccattgttccttaccttta

SEQ ID NO: 3919149 - DNA, 22 bp, Homo sapiens
ccatttaaagcttattaaaact

SEQ ID NO: 3919150 - DNA, 14 bp, Homo sapiens
ccatttcaactcca

SEQ ID NO: 3919151 - DNA, 16 bp, Homo sapiens
ccatttcaactccaga

SEQ ID NO: 3919152 - DNA, 21 bp, Homo sapiens
ccatttgcacaggttttcagc

SEQ ID NO: 3919153 - DNA, 12 bp, Homo sapiens
ccattttcgctt

SEQ ID NO: 3919154 - DNA, 16 bp, Homo sapiens
ccattttgaggccaga

SEQ ID NO: 3919155 - DNA, 23 bp, Homo sapiens
cccaaaagtcaaaaggtgcctgt

SEQ ID NO: 3919156 - DNA, 12 bp, Homo sapiens
cccaaaccaggg

SEQ ID NO: 3919157 - DNA, 15 bp, Homo sapiens
cccaaaccagggtgc

SEQ ID NO: 3919158 - DNA, 15 bp, Homo sapiens
cccaaacccatcaga

SEQ ID NO: 3919159 - DNA, 17 bp, Homo sapiens
cccaaacccatcagaca

SEQ ID NO: 3919160 - DNA, 22 bp, Homo sapiens
cccaaactgttcaagaaataat

SEQ ID NO: 3919161 - DNA, 18 bp, Homo sapiens
cccaaagagcctggagaa

SEQ ID NO: 3919162 - DNA, 18 bp, Homo sapiens
cccaaattccctggacct

SEQ ID NO: 3919163 - DNA, 21 bp, Homo sapiens
cccaaattccctggacctctg

SEQ ID NO: 3919164 - DNA, 15 bp, Homo sapiens
cccaacacaatcttt

SEQ ID NO: 3919165 - DNA, 20 bp, Homo sapiens
cccaaccccgcggtgctctg

SEQ ID NO: 3919166 - DNA, 22 bp, Homo sapiens
cccaaccccgcggtgctctggc

SEQ ID NO: 3919167 - DNA, 23 bp, Homo sapiens
cccaacccgtggaggctgctcgg

SEQ ID NO: 3919168 - DNA, 20 bp, Homo sapiens
cccaacctcaatgccctgcc

SEQ ID NO: 3919169 - DNA, 21 bp, Homo sapiens
cccaacctgctctcctcttgc

SEQ ID NO: 3919170 - DNA, 13 bp, Homo sapiens
cccaactcctgga

SEQ ID NO: 3919171 - DNA, 23 bp, Homo sapiens
cccaactcctggaagctgtgtcc

SEQ ID NO: 3919172 - DNA, 15 bp, Homo sapiens
cccaactgctctgcc

SEQ ID NO: 3919173 - DNA, 20 bp, Homo sapiens
cccaagaatagatgctgact

SEQ ID NO: 3919174 - DNA, 18 bp, Homo sapiens
cccaagagcatcatgcct

SEQ ID NO: 3919175 - DNA, 20 bp, Homo sapiens
cccaagagcatcatgcctct

SEQ ID NO: 3919176 - DNA, 21 bp, Homo sapiens
cccaagagcatcatgcctctg

SEQ ID NO: 3919177 - DNA, 22 bp, Homo sapiens
cccaagagcatcatgcctctga

SEQ ID NO: 3919178 - DNA, 14 bp, Homo sapiens
cccaagaggactga

SEQ ID NO: 3919179 - DNA, 14 bp, Homo sapiens
cccaagaggtctga

SEQ ID NO: 3919180 - DNA, 16 bp, Homo sapiens
cccaagaggtctgagc

SEQ ID NO: 3919181 - DNA, 12 bp, Homo sapiens
cccaagcagcca

SEQ ID NO: 3919182 - DNA, 17 bp, Homo sapiens
cccaagcagccagccag

SEQ ID NO: 3919183 - DNA, 19 bp, Homo sapiens
cccaagcagccgcagcgca

SEQ ID NO: 3919184 - DNA, 22 bp, Homo sapiens
cccaagccatggtgacacacag

SEQ ID NO: 3919185 - DNA, 14 bp, Homo sapiens
cccaagcctctgcc

SEQ ID NO: 3919186 - DNA, 20 bp, Homo sapiens
cccaagcctctgccccaagg

SEQ ID NO: 3919187 - DNA, 12 bp, Homo sapiens
cccaaggagctg

SEQ ID NO: 3919188 - DNA, 22 bp, Homo sapiens
cccaaggagctgatttccaggc

SEQ ID NO: 3919189 - DNA, 22 bp, Homo sapiens
cccaaggggtctgtatatacat

SEQ ID NO: 3919190 - DNA, 17 bp, Homo sapiens
cccaaggggtttctgtt

SEQ ID NO: 3919191 - DNA, 21 bp, Homo sapiens
cccaagtattgcgaatgtgca

SEQ ID NO: 3919192 - DNA, 12 bp, Homo sapiens
cccaagtgccat

SEQ ID NO: 3919193 - DNA, 14 bp, Homo sapiens
cccaagtgggggca

SEQ ID NO: 3919194 - DNA, 11 bp, Homo sapiens
cccaataaaag

SEQ ID NO: 3919195 - DNA, 14 bp, Homo sapiens
cccaataaaagtga

SEQ ID NO: 3919196 - DNA, 19 bp, Homo sapiens
cccaataaaagtgactctc

SEQ ID NO: 3919197 - DNA, 21 bp, Homo sapiens
cccaataaacattaagattga

SEQ ID NO: 3919198 - DNA, 15 bp, Homo sapiens
cccaataaagctgga

SEQ ID NO: 3919199 - DNA, 15 bp, Homo sapiens
cccaatcagcactga

SEQ ID NO: 3919200 - DNA, 16 bp, Homo sapiens
cccaatcagcactgaa

SEQ ID NO: 3919201 - DNA, 12 bp, Homo sapiens
cccaatgctcct

SEQ ID NO: 3919202 - DNA, 17 bp, Homo sapiens
cccaatgctcctggagg

SEQ ID NO: 3919203 - DNA, 14 bp, Homo sapiens
cccaattcaggact

SEQ ID NO: 3919204 - DNA, 20 bp, Homo sapiens
cccaattcaggactggctca

SEQ ID NO: 3919205 - DNA, 12 bp, Homo sapiens
cccacaaagggg

SEQ ID NO: 3919206 - DNA, 22 bp, Homo sapiens
cccacacgtgctcgcagcctgg

SEQ ID NO: 3919207 - DNA, 17 bp, Homo sapiens
cccacagcacccaggct

SEQ ID NO: 3919208 - DNA, 14 bp, Homo sapiens
cccacagctcccac

SEQ ID NO: 3919209 - DNA, 19 bp, Homo sapiens
cccacagctcccaccccac

SEQ ID NO: 3919210 - DNA, 21 bp, Homo sapiens
cccacagtcctcacagcctct

SEQ ID NO: 3919211 - DNA, 16 bp, Homo sapiens
cccacatatggcacaa

SEQ ID NO: 3919212 - DNA, 16 bp, Homo sapiens
cccacatccctgggcc

SEQ ID NO: 3919213 - DNA, 17 bp, Homo sapiens
cccacatccctgggcct

SEQ ID NO: 3919214 - DNA, 20 bp, Homo sapiens
cccacatccctgggcctgct

SEQ ID NO: 3919215 - DNA, 23 bp, Homo sapiens
cccacatccctgggcctgctgct

SEQ ID NO: 3919216 - DNA, 24 bp, Homo sapiens
cccacatccctgggcctgctgctg

SEQ ID NO: 3919217 - DNA, 18 bp, Homo sapiens
cccacattcggaccctgc

SEQ ID NO: 3919218 - DNA, 19 bp, Homo sapiens
cccacatttacctcgaggc

SEQ ID NO: 3919219 - DNA, 21 bp, Homo sapiens
cccacatttacctcgaggctc

SEQ ID NO: 3919220 - DNA, 14 bp, Homo sapiens
cccaccaactctgc

SEQ ID NO: 3919221 - DNA, 17 bp, Homo sapiens
cccaccaactctgcact

SEQ ID NO: 3919222 - DNA, 16 bp, Homo sapiens
cccaccacctaggcca

SEQ ID NO: 3919223 - DNA, 19 bp, Homo sapiens
cccaccacgatgtggccct

SEQ ID NO: 3919224 - DNA, 20 bp, Homo sapiens
cccaccacgtgctcaatcat

SEQ ID NO: 3919225 - DNA, 23 bp, Homo sapiens
cccacccagggctccctcctgga

SEQ ID NO: 3919226 - DNA, 12 bp, Homo sapiens
cccacccagtcc

SEQ ID NO: 3919227 - DNA, 14 bp, Homo sapiens
cccacccatcttcc

SEQ ID NO: 3919228 - DNA, 16 bp, Homo sapiens
cccacccatcttcctg

SEQ ID NO: 3919229 - DNA, 22 bp, Homo sapiens
cccacccatcttcctgctgctg

SEQ ID NO: 3919230 - DNA, 15 bp, Homo sapiens
cccaccccaccccct

SEQ ID NO: 3919231 - DNA, 21 bp, Homo sapiens
cccaccctcaaaccctgtggg

SEQ ID NO: 3919232 - DNA, 22 bp, Homo sapiens
cccaccctcgtggacacctgcc

SEQ ID NO: 3919233 - DNA, 16 bp, Homo sapiens
cccaccgggagcctcc

SEQ ID NO: 3919234 - DNA, 17 bp, Homo sapiens
cccaccgggccactcct

SEQ ID NO: 3919235 - DNA, 18 bp, Homo sapiens
cccaccgggccactcctt

SEQ ID NO: 3919236 - DNA, 22 bp, Homo sapiens
cccaccgggccactccttcctg

SEQ ID NO: 3919237 - DNA, 23 bp, Homo sapiens
cccaccgggctgggagctctgca

SEQ ID NO: 3919238 - DNA, 21 bp, Homo sapiens
cccaccgtcttgggtcgccct

SEQ ID NO: 3919239 - DNA, 18 bp, Homo sapiens
cccacctacttgtgactg

SEQ ID NO: 3919240 - DNA, 23 bp, Homo sapiens
cccacctcatgcctggcccccct

SEQ ID NO: 3919241 - DNA, 14 bp, Homo sapiens
cccacctccacccc

SEQ ID NO: 3919242 - DNA, 22 bp, Homo sapiens
cccacctcttccttccgctcct

SEQ ID NO: 3919243 - DNA, 13 bp, Homo sapiens
cccaccttcccca

SEQ ID NO: 3919244 - DNA, 18 bp, Homo sapiens
cccaccttccccagactc

SEQ ID NO: 3919245 - DNA, 15 bp, Homo sapiens
cccacctttctcgct

SEQ ID NO: 3919246 - DNA, 17 bp, Homo sapiens
cccacgaacgctcttag

SEQ ID NO: 3919247 - DNA, 16 bp, Homo sapiens
cccacgagggtcagga

SEQ ID NO: 3919248 - DNA, 14 bp, Homo sapiens
cccacgagtcacct

SEQ ID NO: 3919249 - DNA, 23 bp, Homo sapiens
cccacgtgagagaatctgcctgt

SEQ ID NO: 3919250 - DNA, 17 bp, Homo sapiens
cccactatcctcactcc

SEQ ID NO: 3919251 - DNA, 15 bp, Homo sapiens
cccactcacacttgg

SEQ ID NO: 3919252 - DNA, 12 bp, Homo sapiens
cccactccagcc

SEQ ID NO: 3919253 - DNA, 13 bp, Homo sapiens
cccactccagccc

SEQ ID NO: 3919254 - DNA, 14 bp, Homo sapiens
cccactccagccct

SEQ ID NO: 3919255 - DNA, 18 bp, Homo sapiens
cccactccagccctgtcc

SEQ ID NO: 3919256 - DNA, 16 bp, Homo sapiens
cccactcccaggacca

SEQ ID NO: 3919257 - DNA, 21 bp, Homo sapiens
cccactctcattccccaggtg

SEQ ID NO: 3919258 - DNA, 16 bp, Homo sapiens
cccactctgctctgat

SEQ ID NO: 3919259 - DNA, 12 bp, Homo sapiens
cccactggccag

SEQ ID NO: 3919260 - DNA, 14 bp, Homo sapiens
cccactggccagtc

SEQ ID NO: 3919261 - DNA, 21 bp, Homo sapiens
cccactggccagtcctagagc

SEQ ID NO: 3919262 - DNA, 14 bp, Homo sapiens
cccacttccattcc

SEQ ID NO: 3919263 - DNA, 16 bp, Homo sapiens
cccacttgtcatccat

SEQ ID NO: 3919264 - DNA, 16 bp, Homo sapiens
cccagaaattccttcc

SEQ ID NO: 3919265 - DNA, 22 bp, Homo sapiens
cccagaacccttcctgagacct

SEQ ID NO: 3919266 - DNA, 13 bp, Homo sapiens
cccagaaggcagg

SEQ ID NO: 3919267 - DNA, 11 bp, Homo sapiens
cccagacacat

SEQ ID NO: 3919268 - DNA, 20 bp, Homo sapiens
cccagacacatcgcactgtg

SEQ ID NO: 3919269 - DNA, 14 bp, Homo sapiens
cccagacccctctc

SEQ ID NO: 3919270 - DNA, 17 bp, Homo sapiens
cccagagaccccttcct

SEQ ID NO: 3919271 - DNA, 12 bp, Homo sapiens
cccagagacctt

SEQ ID NO: 3919272 - DNA, 22 bp, Homo sapiens
cccagagaccttttctctccca

SEQ ID NO: 3919273 - DNA, 19 bp, Homo sapiens
cccagagatgcctccaccg

SEQ ID NO: 3919274 - DNA, 21 bp, Homo sapiens
cccagagcattacgtgagcca

SEQ ID NO: 3919275 - DNA, 14 bp, Homo sapiens
cccagagccccact

SEQ ID NO: 3919276 - DNA, 15 bp, Homo sapiens
cccagagccccactc

SEQ ID NO: 3919277 - DNA, 19 bp, Homo sapiens
cccagagcttattggccac

SEQ ID NO: 3919278 - DNA, 21 bp, Homo sapiens
cccagagcttattggccactg

SEQ ID NO: 3919279 - DNA, 17 bp, Homo sapiens
cccagagcttcccagga

SEQ ID NO: 3919280 - DNA, 18 bp, Homo sapiens
cccagagcttcccaggat

SEQ ID NO: 3919281 - DNA, 22 bp, Homo sapiens
cccagaggccaggaatctgcca

SEQ ID NO: 3919282 - DNA, 17 bp, Homo sapiens
cccagagggccaagaga

SEQ ID NO: 3919283 - DNA, 20 bp, Homo sapiens
cccagagggtagggcagcag

SEQ ID NO: 3919284 - DNA, 21 bp, Homo sapiens
cccagagggtagggcagcaga

SEQ ID NO: 3919285 - DNA, 22 bp, Homo sapiens
cccagaggtgacccaatgctcc

SEQ ID NO: 3919286 - DNA, 21 bp, Homo sapiens
cccagaggttatctgcctggc

SEQ ID NO: 3919287 - DNA, 23 bp, Homo sapiens
cccagaggttatctgcctggcct

SEQ ID NO: 3919288 - DNA, 12 bp, Homo sapiens
cccagatcctca

SEQ ID NO: 3919289 - DNA, 16 bp, Homo sapiens
cccagatctgcctggg

SEQ ID NO: 3919290 - DNA, 18 bp, Homo sapiens
cccagatctgcctgggcc

SEQ ID NO: 3919291 - DNA, 19 bp, Homo sapiens
cccagatctgcctgggcct

SEQ ID NO: 3919292 - DNA, 20 bp, Homo sapiens
cccagcaacacaagctggaa

SEQ ID NO: 3919293 - DNA, 20 bp, Homo sapiens
cccagcactaaggccgtgtc

SEQ ID NO: 3919294 - DNA, 16 bp, Homo sapiens
cccagcacttttggag

SEQ ID NO: 3919295 - DNA, 23 bp, Homo sapiens
cccagcacttttggaggccaagg

SEQ ID NO: 3919296 - DNA, 20 bp, Homo sapiens
cccagcagctgggccggcca

SEQ ID NO: 3919297 - DNA, 22 bp, Homo sapiens
cccagcagctgggccggccagc

SEQ ID NO: 3919298 - DNA, 13 bp, Homo sapiens
cccagcagggcct

SEQ ID NO: 3919299 - DNA, 21 bp, Homo sapiens
cccagcccattctctctcctg

SEQ ID NO: 3919300 - DNA, 21 bp, Homo sapiens
cccagccccctaagagagcac

SEQ ID NO: 3919301 - DNA, 17 bp, Homo sapiens
cccagccctgccaggag

SEQ ID NO: 3919302 - DNA, 18 bp, Homo sapiens
cccagccctggctctgca

SEQ ID NO: 3919303 - DNA, 14 bp, Homo sapiens
cccagcccttctgc

SEQ ID NO: 3919304 - DNA, 18 bp, Homo sapiens
cccagcccttctgccttt

SEQ ID NO: 3919305 - DNA, 15 bp, Homo sapiens
cccagcctagcccac

SEQ ID NO: 3919306 - DNA, 20 bp, Homo sapiens
cccagcctccaagctccatc

SEQ ID NO: 3919307 - DNA, 10 bp, Homo sapiens
cccagcctgg

SEQ ID NO: 3919308 - DNA, 13 bp, Homo sapiens
cccagcctgggcc

SEQ ID NO: 3919309 - DNA, 15 bp, Homo sapiens
cccagcctgtcctgg

SEQ ID NO: 3919310 - DNA, 20 bp, Homo sapiens
cccagcctgtcctggtacag

SEQ ID NO: 3919311 - DNA, 14 bp, Homo sapiens
cccagcgcggcttg

SEQ ID NO: 3919312 - DNA, 19 bp, Homo sapiens
cccagctaatctgtagggc

SEQ ID NO: 3919313 - DNA, 14 bp, Homo sapiens
cccagctaattttt

SEQ ID NO: 3919314 - DNA, 17 bp, Homo sapiens
cccagctacattcctca

SEQ ID NO: 3919315 - DNA, 14 bp, Homo sapiens
cccagctactcagg

SEQ ID NO: 3919316 - DNA, 20 bp, Homo sapiens
cccagctactcaggaggctg

SEQ ID NO: 3919317 - DNA, 16 bp, Homo sapiens
cccagctactctgtcc

SEQ ID NO: 3919318 - DNA, 17 bp, Homo sapiens
cccagctactctgtcca

SEQ ID NO: 3919319 - DNA, 17 bp, Homo sapiens
cccagctagggctggac

SEQ ID NO: 3919320 - DNA, 22 bp, Homo sapiens
cccagctccttttgtccccagg

SEQ ID NO: 3919321 - DNA, 23 bp, Homo sapiens
cccagctccttttgtccccaggg

SEQ ID NO: 3919322 - DNA, 16 bp, Homo sapiens
cccagctctccctctg

SEQ ID NO: 3919323 - DNA, 17 bp, Homo sapiens
cccagctctccctctgg

SEQ ID NO: 3919324 - DNA, 18 bp, Homo sapiens
cccagctctccctctggc

SEQ ID NO: 3919325 - DNA, 23 bp, Homo sapiens
cccagctctccctctggccctgc

SEQ ID NO: 3919326 - DNA, 16 bp, Homo sapiens
cccagctggcctctag

SEQ ID NO: 3919327 - DNA, 22 bp, Homo sapiens
cccagctggtgggaagcgtctg

SEQ ID NO: 3919328 - DNA, 16 bp, Homo sapiens
cccagctgtagccatg

SEQ ID NO: 3919329 - DNA, 20 bp, Homo sapiens
cccagctgtagccatggctc

SEQ ID NO: 3919330 - DNA, 20 bp, Homo sapiens
cccagctttatctgtcacac

SEQ ID NO: 3919331 - DNA, 21 bp, Homo sapiens
cccagctttatctgtcacaca

SEQ ID NO: 3919332 - DNA, 22 bp, Homo sapiens
cccaggaatgccaaggagacat

SEQ ID NO: 3919333 - DNA, 15 bp, Homo sapiens
cccaggagacagttc

SEQ ID NO: 3919334 - DNA, 17 bp, Homo sapiens
cccaggagacagttcaa

SEQ ID NO: 3919335 - DNA, 18 bp, Homo sapiens
cccaggagctgagtcacc

SEQ ID NO: 3919336 - DNA, 21 bp, Homo sapiens
cccaggagctgagtcacctcc

SEQ ID NO: 3919337 - DNA, 17 bp, Homo sapiens
cccaggaggggcctctg

SEQ ID NO: 3919338 - DNA, 18 bp, Homo sapiens
cccaggaggggcctctga

SEQ ID NO: 3919339 - DNA, 18 bp, Homo sapiens
cccaggatcccagagctt

SEQ ID NO: 3919340 - DNA, 17 bp, Homo sapiens
cccaggatccctcccag

SEQ ID NO: 3919341 - DNA, 21 bp, Homo sapiens
cccaggatccctcccagatcc

SEQ ID NO: 3919342 - DNA, 14 bp, Homo sapiens
cccaggccccatga

SEQ ID NO: 3919343 - DNA, 20 bp, Homo sapiens
cccaggccccatgacctcca

SEQ ID NO: 3919344 - DNA, 16 bp, Homo sapiens
cccaggccctccatgg

SEQ ID NO: 3919345 - DNA, 15 bp, Homo sapiens
cccaggccctccctg

SEQ ID NO: 3919346 - DNA, 17 bp, Homo sapiens
cccaggccctccctgac

SEQ ID NO: 3919347 - DNA, 16 bp, Homo sapiens
cccaggccgcctgcca

SEQ ID NO: 3919348 - DNA, 17 bp, Homo sapiens
cccaggccgcctgccat

SEQ ID NO: 3919349 - DNA, 15 bp, Homo sapiens
cccaggcctccagcc

SEQ ID NO: 3919350 - DNA, 18 bp, Homo sapiens
cccaggcctccagcctct

SEQ ID NO: 3919351 - DNA, 15 bp, Homo sapiens
cccaggcctgcctgt

SEQ ID NO: 3919352 - DNA, 16 bp, Homo sapiens
cccaggcctgcctgtt

SEQ ID NO: 3919353 - DNA, 14 bp, Homo sapiens
cccaggctccatgg

SEQ ID NO: 3919354 - DNA, 16 bp, Homo sapiens
cccaggctctgggaag

SEQ ID NO: 3919355 - DNA, 20 bp, Homo sapiens
cccaggctctgggaaggggt

SEQ ID NO: 3919356 - DNA, 14 bp, Homo sapiens
cccaggctgaagag

SEQ ID NO: 3919357 - DNA, 14 bp, Homo sapiens
cccaggctgcactg

SEQ ID NO: 3919358 - DNA, 15 bp, Homo sapiens
cccaggctgcactgc

SEQ ID NO: 3919359 - DNA, 16 bp, Homo sapiens
cccaggctgcactgca

SEQ ID NO: 3919360 - DNA, 23 bp, Homo sapiens
cccagggacaaaacactgtgtcc

SEQ ID NO: 3919361 - DNA, 20 bp, Homo sapiens
cccagggacaagggaaggaa

SEQ ID NO: 3919362 - DNA, 19 bp, Homo sapiens
cccagggagcaatgggagg

SEQ ID NO: 3919363 - DNA, 18 bp, Homo sapiens
cccagggaggccgaagct

SEQ ID NO: 3919364 - DNA, 11 bp, Homo sapiens
cccagggcaca

SEQ ID NO: 3919365 - DNA, 14 bp, Homo sapiens
cccagggcacagga

SEQ ID NO: 3919366 - DNA, 12 bp, Homo sapiens
cccagggcaggg

SEQ ID NO: 3919367 - DNA, 12 bp, Homo sapiens
cccagggcccta

SEQ ID NO: 3919368 - DNA, 12 bp, Homo sapiens
cccagggcctgg

SEQ ID NO: 3919369 - DNA, 20 bp, Homo sapiens
cccagggcctgggggcagtg

SEQ ID NO: 3919370 - DNA, 24 bp, Homo sapiens
cccagggcctgggggcagtgactg

SEQ ID NO: 3919371 - DNA, 21 bp, Homo sapiens
cccaggggagagggtctggag

SEQ ID NO: 3919372 - DNA, 18 bp, Homo sapiens
cccaggggcccacaggga

SEQ ID NO: 3919373 - DNA, 13 bp, Homo sapiens
cccaggtcctcac

SEQ ID NO: 3919374 - DNA, 15 bp, Homo sapiens
cccaggtcctctgat

SEQ ID NO: 3919375 - DNA, 18 bp, Homo sapiens
cccaggtgccaccaataa

SEQ ID NO: 3919376 - DNA, 16 bp, Homo sapiens
cccaggtggctgaccc

SEQ ID NO: 3919377 - DNA, 18 bp, Homo sapiens
cccaggtggctgacccag

SEQ ID NO: 3919378 - DNA, 22 bp, Homo sapiens
cccaggtggctgacccagtccc

SEQ ID NO: 3919379 - DNA, 13 bp, Homo sapiens
cccagtagtcaga

SEQ ID NO: 3919380 - DNA, 13 bp, Homo sapiens
cccagtccccgtg

SEQ ID NO: 3919381 - DNA, 13 bp, Homo sapiens
cccagtccctggg

SEQ ID NO: 3919382 - DNA, 16 bp, Homo sapiens
cccagtccctggggga

SEQ ID NO: 3919383 - DNA, 15 bp, Homo sapiens
cccagtgccacagag

SEQ ID NO: 3919384 - DNA, 16 bp, Homo sapiens
cccagtgccacagaga

SEQ ID NO: 3919385 - DNA, 20 bp, Homo sapiens
cccagtgctgccatgccact

SEQ ID NO: 3919386 - DNA, 20 bp, Homo sapiens
cccagtgtaaagaataaatg

SEQ ID NO: 3919387 - DNA, 22 bp, Homo sapiens
cccagtgtaaagaataaatgaa

SEQ ID NO: 3919388 - DNA, 15 bp, Homo sapiens
cccagttctgctcct

SEQ ID NO: 3919389 - DNA, 20 bp, Homo sapiens
cccagttctgctcctctcca

SEQ ID NO: 3919390 - DNA, 16 bp, Homo sapiens
cccagtttcccttcta

SEQ ID NO: 3919391 - DNA, 15 bp, Homo sapiens
cccagtttgcagaaa

SEQ ID NO: 3919392 - DNA, 16 bp, Homo sapiens
cccagtttgcagaaaa

SEQ ID NO: 3919393 - DNA, 21 bp, Homo sapiens
cccataatagttagccctcag

SEQ ID NO: 3919394 - DNA, 23 bp, Homo sapiens
cccataattttttttttcctttt

SEQ ID NO: 3919395 - DNA, 21 bp, Homo sapiens
cccatacccctgcctgggttt

SEQ ID NO: 3919396 - DNA, 17 bp, Homo sapiens
cccatagaaacatgaca

SEQ ID NO: 3919397 - DNA, 16 bp, Homo sapiens
cccatagcgctggctc

SEQ ID NO: 3919398 - DNA, 13 bp, Homo sapiens
cccatatttcatc

SEQ ID NO: 3919399 - DNA, 18 bp, Homo sapiens
cccatcagcaccatggag

SEQ ID NO: 3919400 - DNA, 12 bp, Homo sapiens
cccatcatccca

SEQ ID NO: 3919401 - DNA, 14 bp, Homo sapiens
cccatccagttcat

SEQ ID NO: 3919402 - DNA, 21 bp, Homo sapiens
cccatccagttcatgagaatc

SEQ ID NO: 3919403 - DNA, 14 bp, Homo sapiens
cccatccatcagct

SEQ ID NO: 3919404 - DNA, 16 bp, Homo sapiens
cccatccatcagctcc

SEQ ID NO: 3919405 - DNA, 17 bp, Homo sapiens
cccatccatcagctccc

SEQ ID NO: 3919406 - DNA, 13 bp, Homo sapiens
cccatccccagcg

SEQ ID NO: 3919407 - DNA, 21 bp, Homo sapiens
cccatcccctggactgggagg

SEQ ID NO: 3919408 - DNA, 17 bp, Homo sapiens
cccatccctcggaccca

SEQ ID NO: 3919409 - DNA, 17 bp, Homo sapiens
cccatcccttcctcccc

SEQ ID NO: 3919410 - DNA, 20 bp, Homo sapiens
cccatcctaccaatgcatgc

SEQ ID NO: 3919411 - DNA, 21 bp, Homo sapiens
cccatctaagctgcagcttcc

SEQ ID NO: 3919412 - DNA, 22 bp, Homo sapiens
cccatctaagctgcagcttcct

SEQ ID NO: 3919413 - DNA, 19 bp, Homo sapiens
cccatctcaggtgccactc

SEQ ID NO: 3919414 - DNA, 14 bp, Homo sapiens
cccatctccccagg

SEQ ID NO: 3919415 - DNA, 14 bp, Homo sapiens
cccatctctcttcc

SEQ ID NO: 3919416 - DNA, 18 bp, Homo sapiens
cccatctcttcctaccca

SEQ ID NO: 3919417 - DNA, 22 bp, Homo sapiens
cccatctgggtccttgcacccc

SEQ ID NO: 3919418 - DNA, 17 bp, Homo sapiens
cccatcttcctgctgct

SEQ ID NO: 3919419 - DNA, 19 bp, Homo sapiens
cccatcttcctgctgctgt

SEQ ID NO: 3919420 - DNA, 20 bp, Homo sapiens
cccatcttcctgctgctgta

SEQ ID NO: 3919421 - DNA, 16 bp, Homo sapiens
cccatgaatcaaagac

SEQ ID NO: 3919422 - DNA, 15 bp, Homo sapiens
cccatgacctccagc

SEQ ID NO: 3919423 - DNA, 13 bp, Homo sapiens
cccatgatccaga

SEQ ID NO: 3919424 - DNA, 22 bp, Homo sapiens
cccatgcacacaaacacctcct

SEQ ID NO: 3919425 - DNA, 14 bp, Homo sapiens
cccatgctctgccc

SEQ ID NO: 3919426 - DNA, 12 bp, Homo sapiens
cccatgtcacct

SEQ ID NO: 3919427 - DNA, 13 bp, Homo sapiens
cccatgtcacctc

SEQ ID NO: 3919428 - DNA, 14 bp, Homo sapiens
cccatgtcacctca

SEQ ID NO: 3919429 - DNA, 13 bp, Homo sapiens
cccatgtggctga

SEQ ID NO: 3919430 - DNA, 17 bp, Homo sapiens
cccatgtggctgaagac

SEQ ID NO: 3919431 - DNA, 17 bp, Homo sapiens
cccatgtgtcccctcac

SEQ ID NO: 3919432 - DNA, 20 bp, Homo sapiens
cccatgttgcatgcctatgt

SEQ ID NO: 3919433 - DNA, 20 bp, Homo sapiens
cccatgtttaaactttgtgc

SEQ ID NO: 3919434 - DNA, 22 bp, Homo sapiens
cccattctcatatgtagccctc

SEQ ID NO: 3919435 - DNA, 20 bp, Homo sapiens
cccattctctctcctgtcca

SEQ ID NO: 3919436 - DNA, 20 bp, Homo sapiens
cccattcttcctagttttct

SEQ ID NO: 3919437 - DNA, 14 bp, Homo sapiens
cccattgccctggt

SEQ ID NO: 3919438 - DNA, 14 bp, Homo sapiens
ccccaaagagcctg

SEQ ID NO: 3919439 - DNA, 20 bp, Homo sapiens
ccccaaagagcctggagaag

SEQ ID NO: 3919440 - DNA, 22 bp, Homo sapiens
ccccaacatctccctcccacat

SEQ ID NO: 3919441 - DNA, 22 bp, Homo sapiens
ccccaactccttccagctagtg

SEQ ID NO: 3919442 - DNA, 20 bp, Homo sapiens
ccccaagcagcattcagcac

SEQ ID NO: 3919443 - DNA, 13 bp, Homo sapiens
ccccaagcagcca

SEQ ID NO: 3919444 - DNA, 15 bp, Homo sapiens
ccccaagcagccagc

SEQ ID NO: 3919445 - DNA, 22 bp, Homo sapiens
ccccaagccatggtgacacaca

SEQ ID NO: 3919446 - DNA, 16 bp, Homo sapiens
ccccaagctgttttct

SEQ ID NO: 3919447 - DNA, 22 bp, Homo sapiens
ccccacacgtgctcgcagcctg

SEQ ID NO: 3919448 - DNA, 16 bp, Homo sapiens
ccccacagcacccagg

SEQ ID NO: 3919449 - DNA, 21 bp, Homo sapiens
ccccacagcacccaggctcca

SEQ ID NO: 3919450 - DNA, 12 bp, Homo sapiens
ccccacagtcct

SEQ ID NO: 3919451 - DNA, 13 bp, Homo sapiens
ccccacataccat

SEQ ID NO: 3919452 - DNA, 17 bp, Homo sapiens
ccccaccacttctttta

SEQ ID NO: 3919453 - DNA, 17 bp, Homo sapiens
ccccaccccctccccag

SEQ ID NO: 3919454 - DNA, 22 bp, Homo sapiens
ccccaccctcgtggacacctgc

SEQ ID NO: 3919455 - DNA, 23 bp, Homo sapiens
ccccaccctcgtggacacctgcc

SEQ ID NO: 3919456 - DNA, 23 bp, Homo sapiens
ccccacctgacaatggcagctag

SEQ ID NO: 3919457 - DNA, 16 bp, Homo sapiens
ccccaccttccccaga

SEQ ID NO: 3919458 - DNA, 14 bp, Homo sapiens
ccccacctttggga

SEQ ID NO: 3919459 - DNA, 22 bp, Homo sapiens
ccccacgagtcacctgcaagcc

SEQ ID NO: 3919460 - DNA, 12 bp, Homo sapiens
ccccactccagc

SEQ ID NO: 3919461 - DNA, 23 bp, Homo sapiens
ccccactccctggctctcagaag

SEQ ID NO: 3919462 - DNA, 15 bp, Homo sapiens
ccccactctcattcc

SEQ ID NO: 3919463 - DNA, 12 bp, Homo sapiens
ccccactctgct

SEQ ID NO: 3919464 - DNA, 15 bp, Homo sapiens
ccccactctgctctg

SEQ ID NO: 3919465 - DNA, 20 bp, Homo sapiens
ccccagactcaaactcaagg

SEQ ID NO: 3919466 - DNA, 17 bp, Homo sapiens
ccccagactcagctcca

SEQ ID NO: 3919467 - DNA, 19 bp, Homo sapiens
ccccagagcacaagttcca

SEQ ID NO: 3919468 - DNA, 15 bp, Homo sapiens
ccccagagccactac

SEQ ID NO: 3919469 - DNA, 15 bp, Homo sapiens
ccccagatctgcctg

SEQ ID NO: 3919470 - DNA, 24 bp, Homo sapiens
ccccagatctgcctgggcctgtgc

SEQ ID NO: 3919471 - DNA, 22 bp, Homo sapiens
ccccagcactaaggccgtgtct

SEQ ID NO: 3919472 - DNA, 19 bp, Homo sapiens
ccccagccatggtgaggaa

SEQ ID NO: 3919473 - DNA, 20 bp, Homo sapiens
ccccagccatggtgaggaag

SEQ ID NO: 3919474 - DNA, 11 bp, Homo sapiens
ccccagccctt

SEQ ID NO: 3919475 - DNA, 11 bp, Homo sapiens
ccccagctggc

SEQ ID NO: 3919476 - DNA, 14 bp, Homo sapiens
ccccagctggcctc

SEQ ID NO: 3919477 - DNA, 11 bp, Homo sapiens
ccccagctggt

SEQ ID NO: 3919478 - DNA, 17 bp, Homo sapiens
ccccagctggtccaggg

SEQ ID NO: 3919479 - DNA, 17 bp, Homo sapiens
ccccaggatcccagagc

SEQ ID NO: 3919480 - DNA, 13 bp, Homo sapiens
ccccaggccaggc

SEQ ID NO: 3919481 - DNA, 14 bp, Homo sapiens
ccccaggcctccag

SEQ ID NO: 3919482 - DNA, 11 bp, Homo sapiens
ccccagggcac

SEQ ID NO: 3919483 - DNA, 19 bp, Homo sapiens
ccccagggcacaggagcta

SEQ ID NO: 3919484 - DNA, 23 bp, Homo sapiens
ccccagggcccctccctctgccc

SEQ ID NO: 3919485 - DNA, 17 bp, Homo sapiens
ccccagggcctgggggc

SEQ ID NO: 3919486 - DNA, 17 bp, Homo sapiens
ccccaggggaaaatgaa

SEQ ID NO: 3919487 - DNA, 20 bp, Homo sapiens
ccccaggtggctgacccagt

SEQ ID NO: 3919488 - DNA, 15 bp, Homo sapiens
ccccagtgccacaga

SEQ ID NO: 3919489 - DNA, 15 bp, Homo sapiens
ccccagttctgctcc

SEQ ID NO: 3919490 - DNA, 18 bp, Homo sapiens
ccccagttctgctcctct

SEQ ID NO: 3919491 - DNA, 20 bp, Homo sapiens
ccccagttctgctcctctcc

SEQ ID NO: 3919492 - DNA, 23 bp, Homo sapiens
ccccagttctgctcctctccagg

SEQ ID NO: 3919493 - DNA, 23 bp, Homo sapiens
ccccagtttgcagaaaagcacct

SEQ ID NO: 3919494 - DNA, 13 bp, Homo sapiens
ccccatcccacat

SEQ ID NO: 3919495 - DNA, 19 bp, Homo sapiens
ccccatctgggtccttgca

SEQ ID NO: 3919496 - DNA, 14 bp, Homo sapiens
ccccatgctctgcc

SEQ ID NO: 3919497 - DNA, 22 bp, Homo sapiens
ccccatgctctgccccaagccc

SEQ ID NO: 3919498 - DNA, 17 bp, Homo sapiens
ccccatgtctctcagaa

SEQ ID NO: 3919499 - DNA, 21 bp, Homo sapiens
ccccattcttcctagttttct

SEQ ID NO: 3919500 - DNA, 20 bp, Homo sapiens
ccccatttgctttcttttct

SEQ ID NO: 3919501 - DNA, 12 bp, Homo sapiens
cccccaaaaaaa

SEQ ID NO: 3919502 - DNA, 23 bp, Homo sapiens
cccccaaccaagtggctcccaca

SEQ ID NO: 3919503 - DNA, 12 bp, Homo sapiens
cccccaagttct

SEQ ID NO: 3919504 - DNA, 20 bp, Homo sapiens
cccccacctctgctgcctcc

SEQ ID NO: 3919505 - DNA, 13 bp, Homo sapiens
cccccacctgaca

SEQ ID NO: 3919506 - DNA, 14 bp, Homo sapiens
cccccactgcaggc

SEQ ID NO: 3919507 - DNA, 15 bp, Homo sapiens
cccccagcctgggcc

SEQ ID NO: 3919508 - DNA, 21 bp, Homo sapiens
cccccagtgccacagagaaga

SEQ ID NO: 3919509 - DNA, 18 bp, Homo sapiens
cccccatctccccaggcc

SEQ ID NO: 3919510 - DNA, 13 bp, Homo sapiens
cccccgacactgc

SEQ ID NO: 3919511 - DNA, 17 bp, Homo sapiens
cccccgacactgctgca

SEQ ID NO: 3919512 - DNA, 16 bp, Homo sapiens
cccccgacagcccagc

SEQ ID NO: 3919513 - DNA, 22 bp, Homo sapiens
cccccgcagtccccagcccttc

SEQ ID NO: 3919514 - DNA, 23 bp, Homo sapiens
cccccgcagtccccagcccttct

SEQ ID NO: 3919515 - DNA, 13 bp, Homo sapiens
cccccgccacggc

SEQ ID NO: 3919516 - DNA, 15 bp, Homo sapiens
cccccgccacggcca

SEQ ID NO: 3919517 - DNA, 13 bp, Homo sapiens
cccccgctccaga

SEQ ID NO: 3919518 - DNA, 20 bp, Homo sapiens
ccccctccaggcatgctggc

SEQ ID NO: 3919519 - DNA, 14 bp, Homo sapiens
ccccctctaacccc

SEQ ID NO: 3919520 - DNA, 16 bp, Homo sapiens
ccccctgccagtgcct

SEQ ID NO: 3919521 - DNA, 14 bp, Homo sapiens
ccccctgctgctca

SEQ ID NO: 3919522 - DNA, 17 bp, Homo sapiens
ccccctgctgctcatcc

SEQ ID NO: 3919523 - DNA, 18 bp, Homo sapiens
ccccctggatgtcccctg

SEQ ID NO: 3919524 - DNA, 19 bp, Homo sapiens
ccccctggggcttctcctg

SEQ ID NO: 3919525 - DNA, 10 bp, Homo sapiens
ccccctgtgc

SEQ ID NO: 3919526 - DNA, 19 bp, Homo sapiens
ccccctgtgccagctcagg

SEQ ID NO: 3919527 - DNA, 21 bp, Homo sapiens
ccccctgtgccagctcaggtg

SEQ ID NO: 3919528 - DNA, 15 bp, Homo sapiens
cccccttcagtgccc

SEQ ID NO: 3919529 - DNA, 16 bp, Homo sapiens
cccccttccccttctg

SEQ ID NO: 3919530 - DNA, 12 bp, Homo sapiens
ccccgacactgc

SEQ ID NO: 3919531 - DNA, 16 bp, Homo sapiens
ccccgacagcccagcc

SEQ ID NO: 3919532 - DNA, 15 bp, Homo sapiens
ccccgcctcccagcc

SEQ ID NO: 3919533 - DNA, 22 bp, Homo sapiens
ccccgcctgtcctgcctctctg

SEQ ID NO: 3919534 - DNA, 19 bp, Homo sapiens
ccccgcttgtccagcgcct

SEQ ID NO: 3919535 - DNA, 17 bp, Homo sapiens
ccccgggctctggccac

SEQ ID NO: 3919536 - DNA, 20 bp, Homo sapiens
ccccgggctctggccaccct

SEQ ID NO: 3919537 - DNA, 16 bp, Homo sapiens
ccccggggctggcaag

SEQ ID NO: 3919538 - DNA, 21 bp, Homo sapiens
ccccggggtattagcacctct

SEQ ID NO: 3919539 - DNA, 16 bp, Homo sapiens
ccccggtcccttgaga

SEQ ID NO: 3919540 - DNA, 22 bp, Homo sapiens
ccccgtctggggttcagcccct

SEQ ID NO: 3919541 - DNA, 14 bp, Homo sapiens
ccccgtgtggctta

SEQ ID NO: 3919542 - DNA, 16 bp, Homo sapiens
cccctatccacccagc

SEQ ID NO: 3919543 - DNA, 18 bp, Homo sapiens
cccctcacctgggccttt

SEQ ID NO: 3919544 - DNA, 22 bp, Homo sapiens
cccctcactctgtcagccagcc

SEQ ID NO: 3919545 - DNA, 20 bp, Homo sapiens
cccctcagatgatctctcca

SEQ ID NO: 3919546 - DNA, 21 bp, Homo sapiens
cccctcagatgatctctccac

SEQ ID NO: 3919547 - DNA, 13 bp, Homo sapiens
cccctcagccctt

SEQ ID NO: 3919548 - DNA, 19 bp, Homo sapiens
cccctccacgcctcctggc

SEQ ID NO: 3919549 - DNA, 16 bp, Homo sapiens
cccctccagaccctgc

SEQ ID NO: 3919550 - DNA, 11 bp, Homo sapiens
cccctccaggc

SEQ ID NO: 3919551 - DNA, 16 bp, Homo sapiens
cccctccaggcatgct

SEQ ID NO: 3919552 - DNA, 22 bp, Homo sapiens
cccctccaggcatgctggcctc

SEQ ID NO: 3919553 - DNA, 11 bp, Homo sapiens
cccctcccagc

SEQ ID NO: 3919554 - DNA, 14 bp, Homo sapiens
cccctccccagccc

SEQ ID NO: 3919555 - DNA, 13 bp, Homo sapiens
cccctcccctgaa

SEQ ID NO: 3919556 - DNA, 16 bp, Homo sapiens
cccctccctctgcccc

SEQ ID NO: 3919557 - DNA, 14 bp, Homo sapiens
cccctccctcttcc

SEQ ID NO: 3919558 - DNA, 11 bp, Homo sapiens
cccctcctctg

SEQ ID NO: 3919559 - DNA, 13 bp, Homo sapiens
cccctcctctgcc

SEQ ID NO: 3919560 - DNA, 21 bp, Homo sapiens
cccctcgccttttaggctcag

SEQ ID NO: 3919561 - DNA, 21 bp, Homo sapiens
cccctcgtcctgtcccagagg

SEQ ID NO: 3919562 - DNA, 19 bp, Homo sapiens
cccctctcccctcatggag

SEQ ID NO: 3919563 - DNA, 13 bp, Homo sapiens
cccctctccctgg

SEQ ID NO: 3919564 - DNA, 19 bp, Homo sapiens
cccctctgtgtcctctccc

SEQ ID NO: 3919565 - DNA, 20 bp, Homo sapiens
cccctgagtcaactggagca

SEQ ID NO: 3919566 - DNA, 22 bp, Homo sapiens
cccctgcagcttgtagccagcc

SEQ ID NO: 3919567 - DNA, 14 bp, Homo sapiens
cccctgccctgctg

SEQ ID NO: 3919568 - DNA, 15 bp, Homo sapiens
cccctgccctgctgc

SEQ ID NO: 3919569 - DNA, 18 bp, Homo sapiens
cccctgctactcctgtgc

SEQ ID NO: 3919570 - DNA, 20 bp, Homo sapiens
cccctggatgtcccctgtcc

SEQ ID NO: 3919571 - DNA, 21 bp, Homo sapiens
cccctggatgtcccctgtccc

SEQ ID NO: 3919572 - DNA, 19 bp, Homo sapiens
cccctggggcttctcctga

SEQ ID NO: 3919573 - DNA, 17 bp, Homo sapiens
cccctgtcccaccaact

SEQ ID NO: 3919574 - DNA, 22 bp, Homo sapiens
cccctgtcccaccaactctgca

SEQ ID NO: 3919575 - DNA, 17 bp, Homo sapiens
cccctgtgccagctcag

SEQ ID NO: 3919576 - DNA, 16 bp, Homo sapiens
cccctgtggcagaccg

SEQ ID NO: 3919577 - DNA, 16 bp, Homo sapiens
ccccttatccaggact

SEQ ID NO: 3919578 - DNA, 17 bp, Homo sapiens
ccccttccccatctcca

SEQ ID NO: 3919579 - DNA, 16 bp, Homo sapiens
ccccttccccttctgt

SEQ ID NO: 3919580 - DNA, 13 bp, Homo sapiens
ccccttcctttcc

SEQ ID NO: 3919581 - DNA, 14 bp, Homo sapiens
ccccttcctttcct

SEQ ID NO: 3919582 - DNA, 21 bp, Homo sapiens
ccccttcctttcctctgcagc

SEQ ID NO: 3919583 - DNA, 19 bp, Homo sapiens
ccccttcgaggttgcccct

SEQ ID NO: 3919584 - DNA, 23 bp, Homo sapiens
ccccttcgaggttgccccttccc

SEQ ID NO: 3919585 - DNA, 17 bp, Homo sapiens
ccccttctgtgtcacag

SEQ ID NO: 3919586 - DNA, 19 bp, Homo sapiens
ccccttgcccttgccctga

SEQ ID NO: 3919587 - DNA, 22 bp, Homo sapiens
ccccttggcttttgcttggcag

SEQ ID NO: 3919588 - DNA, 16 bp, Homo sapiens
ccccttttgcctggct

SEQ ID NO: 3919589 - DNA, 11 bp, Homo sapiens
cccgaagccca

SEQ ID NO: 3919590 - DNA, 12 bp, Homo sapiens
cccgaagcccag

SEQ ID NO: 3919591 - DNA, 13 bp, Homo sapiens
cccgaagcccagt

SEQ ID NO: 3919592 - DNA, 15 bp, Homo sapiens
cccgacactgctgca

SEQ ID NO: 3919593 - DNA, 18 bp, Homo sapiens
cccgacactgctgcacca

SEQ ID NO: 3919594 - DNA, 14 bp, Homo sapiens
cccgacagcccagc

SEQ ID NO: 3919595 - DNA, 21 bp, Homo sapiens
cccgagcccagctacattcct

SEQ ID NO: 3919596 - DNA, 23 bp, Homo sapiens
cccgagctactctcttgccagca

SEQ ID NO: 3919597 - DNA, 17 bp, Homo sapiens
cccgaggaccgggctgg

SEQ ID NO: 3919598 - DNA, 22 bp, Homo sapiens
cccgcagcccgtgaagcagtgc

SEQ ID NO: 3919599 - DNA, 18 bp, Homo sapiens
cccgcagtccccagccct

SEQ ID NO: 3919600 - DNA, 11 bp, Homo sapiens
cccgcagtgcc

SEQ ID NO: 3919601 - DNA, 18 bp, Homo sapiens
cccgccacggccaccctc

SEQ ID NO: 3919602 - DNA, 15 bp, Homo sapiens
cccgccagcctcagt

SEQ ID NO: 3919603 - DNA, 16 bp, Homo sapiens
cccgccagcctcagtg

SEQ ID NO: 3919604 - DNA, 13 bp, Homo sapiens
cccgcccaaggct

SEQ ID NO: 3919605 - DNA, 14 bp, Homo sapiens
cccgcccctcgctg

SEQ ID NO: 3919606 - DNA, 22 bp, Homo sapiens
cccgcccctcgctgctgctact

SEQ ID NO: 3919607 - DNA, 16 bp, Homo sapiens
cccgccttcctcctcc

SEQ ID NO: 3919608 - DNA, 17 bp, Homo sapiens
cccgccttcctcctcca

SEQ ID NO: 3919609 - DNA, 19 bp, Homo sapiens
cccgccttcctcctccaca

SEQ ID NO: 3919610 - DNA, 15 bp, Homo sapiens
cccgcggtgctctgg

SEQ ID NO: 3919611 - DNA, 16 bp, Homo sapiens
cccgcggtgctctggc

SEQ ID NO: 3919612 - DNA, 20 bp, Homo sapiens
cccgcggtgctctggcggct

SEQ ID NO: 3919613 - DNA, 12 bp, Homo sapiens
cccgctcagccc

SEQ ID NO: 3919614 - DNA, 13 bp, Homo sapiens
cccgctcagccct

SEQ ID NO: 3919615 - DNA, 21 bp, Homo sapiens
cccgctgggatttcttcgctg

SEQ ID NO: 3919616 - DNA, 15 bp, Homo sapiens
cccgcttgtccagcg

SEQ ID NO: 3919617 - DNA, 15 bp, Homo sapiens
cccggagcacagccc

SEQ ID NO: 3919618 - DNA, 16 bp, Homo sapiens
cccggagcacagccct

SEQ ID NO: 3919619 - DNA, 21 bp, Homo sapiens
cccggagcacagccctgggag

SEQ ID NO: 3919620 - DNA, 18 bp, Homo sapiens
cccggatcgaggacaagt

SEQ ID NO: 3919621 - DNA, 17 bp, Homo sapiens
cccggcaccccctgcag

SEQ ID NO: 3919622 - DNA, 15 bp, Homo sapiens
cccggccagggcctg

SEQ ID NO: 3919623 - DNA, 16 bp, Homo sapiens
cccggccagggcctgg

SEQ ID NO: 3919624 - DNA, 17 bp, Homo sapiens
cccggccagggcctggt

SEQ ID NO: 3919625 - DNA, 14 bp, Homo sapiens
cccggcctcttcca

SEQ ID NO: 3919626 - DNA, 20 bp, Homo sapiens
cccgggctctggccaccctg

SEQ ID NO: 3919627 - DNA, 12 bp, Homo sapiens
cccggggctggc

SEQ ID NO: 3919628 - DNA, 17 bp, Homo sapiens
cccggggctggcaagca

SEQ ID NO: 3919629 - DNA, 22 bp, Homo sapiens
cccgggtgtgcctgccctggag

SEQ ID NO: 3919630 - DNA, 16 bp, Homo sapiens
cccgtaggcagcctct

SEQ ID NO: 3919631 - DNA, 11 bp, Homo sapiens
cccgtccctgc

SEQ ID NO: 3919632 - DNA, 20 bp, Homo sapiens
cccgtctggggttcagcccc

SEQ ID NO: 3919633 - DNA, 14 bp, Homo sapiens
cccgtgaagcagtg

SEQ ID NO: 3919634 - DNA, 19 bp, Homo sapiens
cccgtgaagcagtgcctcg

SEQ ID NO: 3919635 - DNA, 21 bp, Homo sapiens
cccgtgccaagtccaggtcct

SEQ ID NO: 3919636 - DNA, 13 bp, Homo sapiens
cccgtggaggctg

SEQ ID NO: 3919637 - DNA, 18 bp, Homo sapiens
cccgtggtctccttgcac

SEQ ID NO: 3919638 - DNA, 23 bp, Homo sapiens
ccctaaggaatctgaaagtatat

SEQ ID NO: 3919639 - DNA, 23 bp, Homo sapiens
ccctacatcttcagctcccatag

SEQ ID NO: 3919640 - DNA, 12 bp, Homo sapiens
ccctacccactc

SEQ ID NO: 3919641 - DNA, 13 bp, Homo sapiens
ccctacccactct

SEQ ID NO: 3919642 - DNA, 14 bp, Homo sapiens
ccctaccccaccac

SEQ ID NO: 3919643 - DNA, 18 bp, Homo sapiens
ccctaccgagtctcttct

SEQ ID NO: 3919644 - DNA, 21 bp, Homo sapiens
ccctaccgagtctcttctcca

SEQ ID NO: 3919645 - DNA, 19 bp, Homo sapiens
ccctactagagacctctca

SEQ ID NO: 3919646 - DNA, 13 bp, Homo sapiens
ccctagcagtgaa

SEQ ID NO: 3919647 - DNA, 22 bp, Homo sapiens
ccctagctgggcaaacccttct

SEQ ID NO: 3919648 - DNA, 21 bp, Homo sapiens
ccctatagagagggggctctc

SEQ ID NO: 3919649 - DNA, 12 bp, Homo sapiens
ccctatcaaaac

SEQ ID NO: 3919650 - DNA, 21 bp, Homo sapiens
ccctatcaaaacatatcaatt

SEQ ID NO: 3919651 - DNA, 17 bp, Homo sapiens
ccctatccctgtacaga

SEQ ID NO: 3919652 - DNA, 13 bp, Homo sapiens
ccctattaaccta

SEQ ID NO: 3919653 - DNA, 12 bp, Homo sapiens
ccctattttaag

SEQ ID NO: 3919654 - DNA, 19 bp, Homo sapiens
ccctcaaatgacccaaaga

SEQ ID NO: 3919655 - DNA, 18 bp, Homo sapiens
ccctcacccccaggtgtt

SEQ ID NO: 3919656 - DNA, 16 bp, Homo sapiens
ccctcacctgggcctt

SEQ ID NO: 3919657 - DNA, 14 bp, Homo sapiens
ccctcactctggcc

SEQ ID NO: 3919658 - DNA, 18 bp, Homo sapiens
ccctcactctgtcagcca

SEQ ID NO: 3919659 - DNA, 23 bp, Homo sapiens
ccctcactctgtcagccagccgc

SEQ ID NO: 3919660 - DNA, 13 bp, Homo sapiens
ccctcagagaggc

SEQ ID NO: 3919661 - DNA, 13 bp, Homo sapiens
ccctcagcccttg

SEQ ID NO: 3919662 - DNA, 13 bp, Homo sapiens
ccctcagtgatac

SEQ ID NO: 3919663 - DNA, 20 bp, Homo sapiens
ccctcagtttttcggtggga

SEQ ID NO: 3919664 - DNA, 18 bp, Homo sapiens
ccctcatggagaaacatc

SEQ ID NO: 3919665 - DNA, 20 bp, Homo sapiens
ccctcatggagaaacatcct

SEQ ID NO: 3919666 - DNA, 21 bp, Homo sapiens
ccctcatggagaaacatccta

SEQ ID NO: 3919667 - DNA, 16 bp, Homo sapiens
ccctcattcaggaaaa

SEQ ID NO: 3919668 - DNA, 13 bp, Homo sapiens
ccctcattcccct

SEQ ID NO: 3919669 - DNA, 21 bp, Homo sapiens
ccctccacgcctcctggccag

SEQ ID NO: 3919670 - DNA, 14 bp, Homo sapiens
ccctccagaccctg

SEQ ID NO: 3919671 - DNA, 19 bp, Homo sapiens
ccctccagagacaggaaag

SEQ ID NO: 3919672 - DNA, 13 bp, Homo sapiens
ccctccagctcca

SEQ ID NO: 3919673 - DNA, 14 bp, Homo sapiens
ccctccagctccag

SEQ ID NO: 3919674 - DNA, 11 bp, Homo sapiens
ccctccaggca

SEQ ID NO: 3919675 - DNA, 16 bp, Homo sapiens
ccctcccaacctcaat

SEQ ID NO: 3919676 - DNA, 12 bp, Homo sapiens
ccctcccagatc

SEQ ID NO: 3919677 - DNA, 21 bp, Homo sapiens
ccctccccacagtcctcacag

SEQ ID NO: 3919678 - DNA, 15 bp, Homo sapiens
ccctccccagccctt

SEQ ID NO: 3919679 - DNA, 16 bp, Homo sapiens
ccctccccatcccatg

SEQ ID NO: 3919680 - DNA, 13 bp, Homo sapiens
ccctccctacctg

SEQ ID NO: 3919681 - DNA, 14 bp, Homo sapiens
ccctccctgcccct

SEQ ID NO: 3919682 - DNA, 14 bp, Homo sapiens
ccctccctggcatg

SEQ ID NO: 3919683 - DNA, 11 bp, Homo sapiens
ccctccctgtc

SEQ ID NO: 3919684 - DNA, 13 bp, Homo sapiens
ccctccctgtcct

SEQ ID NO: 3919685 - DNA, 14 bp, Homo sapiens
ccctcccttcaacc

SEQ ID NO: 3919686 - DNA, 18 bp, Homo sapiens
ccctcccttgctcagtgc

SEQ ID NO: 3919687 - DNA, 13 bp, Homo sapiens
ccctccgagccgc

SEQ ID NO: 3919688 - DNA, 18 bp, Homo sapiens
ccctcctagctccaccct

SEQ ID NO: 3919689 - DNA, 16 bp, Homo sapiens
ccctcctccactccac

SEQ ID NO: 3919690 - DNA, 12 bp, Homo sapiens
ccctcctctgcc

SEQ ID NO: 3919691 - DNA, 16 bp, Homo sapiens
ccctcctctgccacct

SEQ ID NO: 3919692 - DNA, 15 bp, Homo sapiens
ccctcctctggccca

SEQ ID NO: 3919693 - DNA, 19 bp, Homo sapiens
ccctcctctggcccagcct

SEQ ID NO: 3919694 - DNA, 11 bp, Homo sapiens
ccctccttccc

SEQ ID NO: 3919695 - DNA, 17 bp, Homo sapiens
ccctccttcccttctct

SEQ ID NO: 3919696 - DNA, 17 bp, Homo sapiens
ccctcgaaccaaggcag

SEQ ID NO: 3919697 - DNA, 15 bp, Homo sapiens
ccctcgcagcaggtg

SEQ ID NO: 3919698 - DNA, 17 bp, Homo sapiens
ccctcggaagccgtctg

SEQ ID NO: 3919699 - DNA, 21 bp, Homo sapiens
ccctcggaagccgtctgactc

SEQ ID NO: 3919700 - DNA, 19 bp, Homo sapiens
ccctcgtccacaggggcag

SEQ ID NO: 3919701 - DNA, 23 bp, Homo sapiens
ccctcgtccacaggggcaggcct

SEQ ID NO: 3919702 - DNA, 16 bp, Homo sapiens
ccctcgtcctgtccca

SEQ ID NO: 3919703 - DNA, 18 bp, Homo sapiens
ccctcgtggacacctgcc

SEQ ID NO: 3919704 - DNA, 23 bp, Homo sapiens
ccctcgtggacacctgccctgcc

SEQ ID NO: 3919705 - DNA, 16 bp, Homo sapiens
ccctctcacccgggac

SEQ ID NO: 3919706 - DNA, 12 bp, Homo sapiens
ccctctcccagg

SEQ ID NO: 3919707 - DNA, 20 bp, Homo sapiens
ccctctcccaggccccatga

SEQ ID NO: 3919708 - DNA, 11 bp, Homo sapiens
ccctctcctgc

SEQ ID NO: 3919709 - DNA, 12 bp, Homo sapiens
ccctctcctggg

SEQ ID NO: 3919710 - DNA, 14 bp, Homo sapiens
ccctctccttcctt

SEQ ID NO: 3919711 - DNA, 15 bp, Homo sapiens
ccctctccttcctta

SEQ ID NO: 3919712 - DNA, 19 bp, Homo sapiens
ccctctgaatggtccaggg

SEQ ID NO: 3919713 - DNA, 20 bp, Homo sapiens
ccctctgagaattccaagga

SEQ ID NO: 3919714 - DNA, 23 bp, Homo sapiens
ccctctgccccaagcagccagcc

SEQ ID NO: 3919715 - DNA, 17 bp, Homo sapiens
ccctctgccctgtatat

SEQ ID NO: 3919716 - DNA, 23 bp, Homo sapiens
ccctctgtcatcactccctggat

SEQ ID NO: 3919717 - DNA, 16 bp, Homo sapiens
ccctcttccttccccc

SEQ ID NO: 3919718 - DNA, 15 bp, Homo sapiens
ccctctttctacatt

SEQ ID NO: 3919719 - DNA, 15 bp, Homo sapiens
ccctcttttggcctt

SEQ ID NO: 3919720 - DNA, 17 bp, Homo sapiens
ccctcttttggccttgt

SEQ ID NO: 3919721 - DNA, 16 bp, Homo sapiens
ccctgaaaacccagag

SEQ ID NO: 3919722 - DNA, 18 bp, Homo sapiens
ccctgaaaacccagagag

SEQ ID NO: 3919723 - DNA, 19 bp, Homo sapiens
ccctgaaaacgaaggggcc

SEQ ID NO: 3919724 - DNA, 15 bp, Homo sapiens
ccctgaacctcagtt

SEQ ID NO: 3919725 - DNA, 17 bp, Homo sapiens
ccctgaacctcagtttc

SEQ ID NO: 3919726 - DNA, 19 bp, Homo sapiens
ccctgaaggttcctgagga

SEQ ID NO: 3919727 - DNA, 16 bp, Homo sapiens
ccctgacccctgcacc

SEQ ID NO: 3919728 - DNA, 11 bp, Homo sapiens
ccctgacctcc

SEQ ID NO: 3919729 - DNA, 17 bp, Homo sapiens
ccctgacctcccagccc

SEQ ID NO: 3919730 - DNA, 18 bp, Homo sapiens
ccctgacctcccagccct

SEQ ID NO: 3919731 - DNA, 19 bp, Homo sapiens
ccctgacctcccagcccta

SEQ ID NO: 3919732 - DNA, 14 bp, Homo sapiens
ccctgactggtgct

SEQ ID NO: 3919733 - DNA, 14 bp, Homo sapiens
ccctgagactccag

SEQ ID NO: 3919734 - DNA, 19 bp, Homo sapiens
ccctgagactccagaatct

SEQ ID NO: 3919735 - DNA, 17 bp, Homo sapiens
ccctgaggggtccctga

SEQ ID NO: 3919736 - DNA, 19 bp, Homo sapiens
ccctgataacaacctggag

SEQ ID NO: 3919737 - DNA, 23 bp, Homo sapiens
ccctgcaccagcccttccctgct

SEQ ID NO: 3919738 - DNA, 14 bp, Homo sapiens
ccctgcaccctgga

SEQ ID NO: 3919739 - DNA, 16 bp, Homo sapiens
ccctgcaccctggaaa

SEQ ID NO: 3919740 - DNA, 17 bp, Homo sapiens
ccctgcacttcagacac

SEQ ID NO: 3919741 - DNA, 15 bp, Homo sapiens
ccctgcagaccctgc

SEQ ID NO: 3919742 - DNA, 17 bp, Homo sapiens
ccctgcagaccctgccc

SEQ ID NO: 3919743 - DNA, 13 bp, Homo sapiens
ccctgcagagcta

SEQ ID NO: 3919744 - DNA, 21 bp, Homo sapiens
ccctgcagagctatggtgagg

SEQ ID NO: 3919745 - DNA, 19 bp, Homo sapiens
ccctgcatccaatctgctc

SEQ ID NO: 3919746 - DNA, 16 bp, Homo sapiens
ccctgccacctgtctg

SEQ ID NO: 3919747 - DNA, 15 bp, Homo sapiens
ccctgccagtgcctt

SEQ ID NO: 3919748 - DNA, 21 bp, Homo sapiens
ccctgcccatacccctgcctg

SEQ ID NO: 3919749 - DNA, 22 bp, Homo sapiens
ccctgcccatacccctgcctgg

SEQ ID NO: 3919750 - DNA, 23 bp, Homo sapiens
ccctgcccatacccctgcctggg

SEQ ID NO: 3919751 - DNA, 22 bp, Homo sapiens
ccctgcccccaaaggtggtctg

SEQ ID NO: 3919752 - DNA, 19 bp, Homo sapiens
ccctgcccccatctcccca

SEQ ID NO: 3919753 - DNA, 19 bp, Homo sapiens
ccctgcccctcccttcaac

SEQ ID NO: 3919754 - DNA, 11 bp, Homo sapiens
ccctgccctgc

SEQ ID NO: 3919755 - DNA, 17 bp, Homo sapiens
ccctgccctgccacctg

SEQ ID NO: 3919756 - DNA, 18 bp, Homo sapiens
ccctgccctgccacctgt

SEQ ID NO: 3919757 - DNA, 22 bp, Homo sapiens
ccctgcctccctttctgggagg

SEQ ID NO: 3919758 - DNA, 16 bp, Homo sapiens
ccctgcctgagcccag

SEQ ID NO: 3919759 - DNA, 12 bp, Homo sapiens
ccctgcctgccc

SEQ ID NO: 3919760 - DNA, 11 bp, Homo sapiens
ccctgcctgga

SEQ ID NO: 3919761 - DNA, 17 bp, Homo sapiens
ccctgcctggaggacct

SEQ ID NO: 3919762 - DNA, 19 bp, Homo sapiens
ccctgcctggaggacctga

SEQ ID NO: 3919763 - DNA, 22 bp, Homo sapiens
ccctgcctggaggacctgagcc

SEQ ID NO: 3919764 - DNA, 14 bp, Homo sapiens
ccctgccttcagct

SEQ ID NO: 3919765 - DNA, 23 bp, Homo sapiens
ccctgcctttgaaattcccccac

SEQ ID NO: 3919766 - DNA, 21 bp, Homo sapiens
ccctgcgaagtggctctcagg

SEQ ID NO: 3919767 - DNA, 13 bp, Homo sapiens
ccctgcggagacc

SEQ ID NO: 3919768 - DNA, 21 bp, Homo sapiens
ccctgcgtcctgacgccctgc

SEQ ID NO: 3919769 - DNA, 18 bp, Homo sapiens
ccctgcgttggagccact

SEQ ID NO: 3919770 - DNA, 19 bp, Homo sapiens
ccctgcgttggagccactc

SEQ ID NO: 3919771 - DNA, 18 bp, Homo sapiens
ccctgctaccaaggccca

SEQ ID NO: 3919772 - DNA, 21 bp, Homo sapiens
ccctgctaccaaggcccagct

SEQ ID NO: 3919773 - DNA, 18 bp, Homo sapiens
ccctgctactcctgtgct

SEQ ID NO: 3919774 - DNA, 15 bp, Homo sapiens
ccctgctcctcccaa

SEQ ID NO: 3919775 - DNA, 13 bp, Homo sapiens
ccctgctctgggg

SEQ ID NO: 3919776 - DNA, 23 bp, Homo sapiens
ccctgctgccgcctcccagcctg

SEQ ID NO: 3919777 - DNA, 16 bp, Homo sapiens
ccctgcttacctgacg

SEQ ID NO: 3919778 - DNA, 13 bp, Homo sapiens
ccctgcttggtca

SEQ ID NO: 3919779 - DNA, 17 bp, Homo sapiens
ccctgctttgggctgcc

SEQ ID NO: 3919780 - DNA, 18 bp, Homo sapiens
ccctgctttgggctgccc

SEQ ID NO: 3919781 - DNA, 22 bp, Homo sapiens
ccctgctttgggctgccctggt

SEQ ID NO: 3919782 - DNA, 19 bp, Homo sapiens
ccctggaaaggggagttga

SEQ ID NO: 3919783 - DNA, 20 bp, Homo sapiens
ccctggaattcagcaccctg

SEQ ID NO: 3919784 - DNA, 13 bp, Homo sapiens
ccctggactggga

SEQ ID NO: 3919785 - DNA, 14 bp, Homo sapiens
ccctggactgggag

SEQ ID NO: 3919786 - DNA, 12 bp, Homo sapiens
ccctggaggggc

SEQ ID NO: 3919787 - DNA, 15 bp, Homo sapiens
ccctggagtgcagtt

SEQ ID NO: 3919788 - DNA, 23 bp, Homo sapiens
ccctggatgggcattgggctgac

SEQ ID NO: 3919789 - DNA, 20 bp, Homo sapiens
ccctggatgtgtggggcatg

SEQ ID NO: 3919790 - DNA, 16 bp, Homo sapiens
ccctggcatgtcagag

SEQ ID NO: 3919791 - DNA, 16 bp, Homo sapiens
ccctggcccgcccctc

SEQ ID NO: 3919792 - DNA, 11 bp, Homo sapiens
ccctggcctga

SEQ ID NO: 3919793 - DNA, 13 bp, Homo sapiens
ccctggcctgctg

SEQ ID NO: 3919794 - DNA, 22 bp, Homo sapiens
ccctggcctgtggagagaaagc

SEQ ID NO: 3919795 - DNA, 10 bp, Homo sapiens
ccctggctga

SEQ ID NO: 3919796 - DNA, 23 bp, Homo sapiens
ccctggctgaccccaaagagcct

SEQ ID NO: 3919797 - DNA, 20 bp, Homo sapiens
ccctggcttgtaactccacc

SEQ ID NO: 3919798 - DNA, 23 bp, Homo sapiens
ccctggcttgtaactccaccaac

SEQ ID NO: 3919799 - DNA, 13 bp, Homo sapiens
ccctgggaactca

SEQ ID NO: 3919800 - DNA, 18 bp, Homo sapiens
ccctgggaactcatcctg

SEQ ID NO: 3919801 - DNA, 19 bp, Homo sapiens
ccctgggatgggaccaggg

SEQ ID NO: 3919802 - DNA, 19 bp, Homo sapiens
ccctgggcatcttctggct

SEQ ID NO: 3919803 - DNA, 22 bp, Homo sapiens
ccctgggccccaccacctaggc

SEQ ID NO: 3919804 - DNA, 15 bp, Homo sapiens
ccctgggcccctcca

SEQ ID NO: 3919805 - DNA, 16 bp, Homo sapiens
ccctgggcccctccac

SEQ ID NO: 3919806 - DNA, 14 bp, Homo sapiens
ccctgggcctgctg

SEQ ID NO: 3919807 - DNA, 16 bp, Homo sapiens
ccctgggcctgctgct

SEQ ID NO: 3919808 - DNA, 24 bp, Homo sapiens
ccctgggcctggaccgcttcccag

SEQ ID NO: 3919809 - DNA, 19 bp, Homo sapiens
ccctgggctgtctgtcacc

SEQ ID NO: 3919810 - DNA, 20 bp, Homo sapiens
ccctgggctgtctgtcacca

SEQ ID NO: 3919811 - DNA, 21 bp, Homo sapiens
ccctggggcctgtactgcctg

SEQ ID NO: 3919812 - DNA, 15 bp, Homo sapiens
ccctggggcttctcc

SEQ ID NO: 3919813 - DNA, 19 bp, Homo sapiens
ccctggggcttctcctgac

SEQ ID NO: 3919814 - DNA, 17 bp, Homo sapiens
ccctgggggaagccctg

SEQ ID NO: 3919815 - DNA, 15 bp, Homo sapiens
ccctgggggccagct

SEQ ID NO: 3919816 - DNA, 18 bp, Homo sapiens
ccctggggtatgagctgc

SEQ ID NO: 3919817 - DNA, 22 bp, Homo sapiens
ccctggggtatgagctgccaag

SEQ ID NO: 3919818 - DNA, 13 bp, Homo sapiens
ccctgggtgccat

SEQ ID NO: 3919819 - DNA, 14 bp, Homo sapiens
ccctgggtgccatt

SEQ ID NO: 3919820 - DNA, 20 bp, Homo sapiens
ccctgggtgccattcccagc

SEQ ID NO: 3919821 - DNA, 20 bp, Homo sapiens
ccctgtaaagggtcagggtg

SEQ ID NO: 3919822 - DNA, 13 bp, Homo sapiens
ccctgtcagaggc

SEQ ID NO: 3919823 - DNA, 21 bp, Homo sapiens
ccctgtcccaccaactctgca

SEQ ID NO: 3919824 - DNA, 20 bp, Homo sapiens
ccctgtcgagacacttgcct

SEQ ID NO: 3919825 - DNA, 14 bp, Homo sapiens
ccctgtctaaaaaa

SEQ ID NO: 3919826 - DNA, 18 bp, Homo sapiens
ccctgtcttctctcaaag

SEQ ID NO: 3919827 - DNA, 14 bp, Homo sapiens
ccctgtgacaaaat

SEQ ID NO: 3919828 - DNA, 13 bp, Homo sapiens
ccctgtgccagct

SEQ ID NO: 3919829 - DNA, 14 bp, Homo sapiens
ccctgtgccagctc

SEQ ID NO: 3919830 - DNA, 21 bp, Homo sapiens
ccctgtgccagctcaggtgac

SEQ ID NO: 3919831 - DNA, 13 bp, Homo sapiens
ccctgtggcagac

SEQ ID NO: 3919832 - DNA, 18 bp, Homo sapiens
ccctgtggggcctgatgg

SEQ ID NO: 3919833 - DNA, 12 bp, Homo sapiens
ccctgtgggggt

SEQ ID NO: 3919834 - DNA, 22 bp, Homo sapiens
ccctgtgggggtggccatccct

SEQ ID NO: 3919835 - DNA, 24 bp, Homo sapiens
ccctgtgggggtggccatccctgg

SEQ ID NO: 3919836 - DNA, 16 bp, Homo sapiens
ccctgtttaatattta

SEQ ID NO: 3919837 - DNA, 14 bp, Homo sapiens
ccctgttttccaca

SEQ ID NO: 3919838 - DNA, 14 bp, Homo sapiens
cctcccccttcccc

SEQ ID NO: 3919839 - DNA, 15 bp, Homo sapiens
cctccccgcaccccc

SEQ ID NO: 3919840 - DNA, 21 bp, Homo sapiens
cctccccgcaccccccaagct

SEQ ID NO: 3919841 - DNA, 17 bp, Homo sapiens
cctcccctatccaccca

SEQ ID NO: 3919842 - DNA, 14 bp, Homo sapiens
cctcccctcttgag

SEQ ID NO: 3919843 - DNA, 16 bp, Homo sapiens
cctcccggtgcccaag

SEQ ID NO: 3919844 - DNA, 15 bp, Homo sapiens
cctccctactcccct

SEQ ID NO: 3919845 - DNA, 18 bp, Homo sapiens
cctccctactcccctggg

SEQ ID NO: 3919846 - DNA, 11 bp, Homo sapiens
cctccctcctc

SEQ ID NO: 3919847 - DNA, 16 bp, Homo sapiens
cctccctcctctggcc

SEQ ID NO: 3919848 - DNA, 17 bp, Homo sapiens
cctccctcctctggccc

SEQ ID NO: 3919849 - DNA, 13 bp, Homo sapiens
cctccctctccat

SEQ ID NO: 3919850 - DNA, 14 bp, Homo sapiens
cctccctctccata

SEQ ID NO: 3919851 - DNA, 13 bp, Homo sapiens
cctccctctgccc

SEQ ID NO: 3919852 - DNA, 12 bp, Homo sapiens
cctccctcttcc

SEQ ID NO: 3919853 - DNA, 21 bp, Homo sapiens
cctccctgctaccaaggccca

SEQ ID NO: 3919854 - DNA, 12 bp, Homo sapiens
cctccctgtcct

SEQ ID NO: 3919855 - DNA, 16 bp, Homo sapiens
cctccggggagagcag

SEQ ID NO: 3919856 - DNA, 19 bp, Homo sapiens
cctccggggagagcagagg

SEQ ID NO: 3919857 - DNA, 14 bp, Homo sapiens
cctccgtcaggaga

SEQ ID NO: 3919858 - DNA, 13 bp, Homo sapiens
cctccgtccaccc

SEQ ID NO: 3919859 - DNA, 15 bp, Homo sapiens
cctccgtccacccag

SEQ ID NO: 3919860 - DNA, 17 bp, Homo sapiens
cctccgtccacccaggc

SEQ ID NO: 3919861 - DNA, 18 bp, Homo sapiens
cctccgtccaggagcctg

SEQ ID NO: 3919862 - DNA, 17 bp, Homo sapiens
cctccgtttatgggcct

SEQ ID NO: 3919863 - DNA, 20 bp, Homo sapiens
cctccgtttatgggccttgc

SEQ ID NO: 3919864 - DNA, 22 bp, Homo sapiens
cctccgtttatgggccttgctt

SEQ ID NO: 3919865 - DNA, 18 bp, Homo sapiens
cctcctaagcagctggga

SEQ ID NO: 3919866 - DNA, 19 bp, Homo sapiens
cctcctaagcagctgggac

SEQ ID NO: 3919867 - DNA, 23 bp, Homo sapiens
cctcctaatttgatcacagtggc

SEQ ID NO: 3919868 - DNA, 20 bp, Homo sapiens
cctcctagaggtgggcagct

SEQ ID NO: 3919869 - DNA, 22 bp, Homo sapiens
cctcctagaggtgggcagctgg

SEQ ID NO: 3919870 - DNA, 23 bp, Homo sapiens
cctcctagaggtgggcagctggg

SEQ ID NO: 3919871 - DNA, 17 bp, Homo sapiens
cctcctagcaagacctg

SEQ ID NO: 3919872 - DNA, 19 bp, Homo sapiens
cctcctatccttggagagc

SEQ ID NO: 3919873 - DNA, 23 bp, Homo sapiens
cctcctatccttggagagcagct

SEQ ID NO: 3919874 - DNA, 14 bp, Homo sapiens
cctcctccacagtg

SEQ ID NO: 3919875 - DNA, 18 bp, Homo sapiens
cctcctccacagtgctgc

SEQ ID NO: 3919876 - DNA, 20 bp, Homo sapiens
cctcctccacagtgctgctt

SEQ ID NO: 3919877 - DNA, 12 bp, Homo sapiens
cctcctccactc

SEQ ID NO: 3919878 - DNA, 21 bp, Homo sapiens
agcccggccagggcctggtgt

SEQ ID NO: 3919879 - DNA, 11 bp, Homo sapiens
agcccggcctg

SEQ ID NO: 3919880 - DNA, 20 bp, Homo sapiens
agcccggcctgctcccagca

SEQ ID NO: 3919881 - DNA, 21 bp, Homo sapiens
agcccgggtgtgcctgccctg

SEQ ID NO: 3919882 - DNA, 23 bp, Homo sapiens
agcccgggtgtgcctgccctgga

SEQ ID NO: 3919883 - DNA, 20 bp, Homo sapiens
agcccgtgaagcagtgcctc

SEQ ID NO: 3919884 - DNA, 21 bp, Homo sapiens
agccctaaggatctctcagga

SEQ ID NO: 3919885 - DNA, 22 bp, Homo sapiens
agccctacatcttcagctccca

SEQ ID NO: 3919886 - DNA, 13 bp, Homo sapiens
agccctatggatg

SEQ ID NO: 3919887 - DNA, 16 bp, Homo sapiens
agccctatggatgtgg

SEQ ID NO: 3919888 - DNA, 23 bp, Homo sapiens
agccctcatgataatctgggcat

SEQ ID NO: 3919889 - DNA, 12 bp, Homo sapiens
agccctccctgc

SEQ ID NO: 3919890 - DNA, 23 bp, Homo sapiens
agccctccctgcccctcccttca

SEQ ID NO: 3919891 - DNA, 22 bp, Homo sapiens
agccctccctggcatgtcagag

SEQ ID NO: 3919892 - DNA, 16 bp, Homo sapiens
agccctccctgtcctc

SEQ ID NO: 3919893 - DNA, 21 bp, Homo sapiens
agccctccctgtcctcctcgg

SEQ ID NO: 3919894 - DNA, 12 bp, Homo sapiens
agccctcctcac

SEQ ID NO: 3919895 - DNA, 12 bp, Homo sapiens
agccctccttcc

SEQ ID NO: 3919896 - DNA, 22 bp, Homo sapiens
agccctcgaaccaaggcagcct

SEQ ID NO: 3919897 - DNA, 24 bp, Homo sapiens
agccctcgaaccaaggcagcctcc

SEQ ID NO: 3919898 - DNA, 12 bp, Homo sapiens
agccctgccagg

SEQ ID NO: 3919899 - DNA, 13 bp, Homo sapiens
agccctgccagga

SEQ ID NO: 3919900 - DNA, 15 bp, Homo sapiens
agccctgccaggagg

SEQ ID NO: 3919901 - DNA, 17 bp, Homo sapiens
agccctgcctggaggac

SEQ ID NO: 3919902 - DNA, 19 bp, Homo sapiens
agccctgcctggaggacct

SEQ ID NO: 3919903 - DNA, 20 bp, Homo sapiens
agccctgcctggaggacctg

SEQ ID NO: 3919904 - DNA, 21 bp, Homo sapiens
agccctgcctggaggacctga

SEQ ID NO: 3919905 - DNA, 15 bp, Homo sapiens
agccctgctgtggga

SEQ ID NO: 3919906 - DNA, 17 bp, Homo sapiens
agccctgctgtgggaga

SEQ ID NO: 3919907 - DNA, 19 bp, Homo sapiens
agccctgctttgggctgcc

SEQ ID NO: 3919908 - DNA, 21 bp, Homo sapiens
agccctgctttgggctgccct

SEQ ID NO: 3919909 - DNA, 22 bp, Homo sapiens
agccctgctttgggctgccctg

SEQ ID NO: 3919910 - DNA, 14 bp, Homo sapiens
agccctggctctgc

SEQ ID NO: 3919911 - DNA, 15 bp, Homo sapiens
agccctgggggccag

SEQ ID NO: 3919912 - DNA, 18 bp, Homo sapiens
agccctgtcgagacactt

SEQ ID NO: 3919913 - DNA, 14 bp, Homo sapiens
agcccttcatttgg

SEQ ID NO: 3919914 - DNA, 19 bp, Homo sapiens
agcccttccatgtcgcctc

SEQ ID NO: 3919915 - DNA, 22 bp, Homo sapiens
agcccttccatgtcgcctctgc

SEQ ID NO: 3919916 - DNA, 23 bp, Homo sapiens
agcccttccatgtcgcctctgca

SEQ ID NO: 3919917 - DNA, 14 bp, Homo sapiens
agcccttccctgct

SEQ ID NO: 3919918 - DNA, 15 bp, Homo sapiens
agcccttccctgctt

SEQ ID NO: 3919919 - DNA, 15 bp, Homo sapiens
agcccttcctcctga

SEQ ID NO: 3919920 - DNA, 14 bp, Homo sapiens
agcccttctgcctt

SEQ ID NO: 3919921 - DNA, 22 bp, Homo sapiens
agcccttgcccccatccctcgg

SEQ ID NO: 3919922 - DNA, 21 bp, Homo sapiens
agccctttacttgacctccta

SEQ ID NO: 3919923 - DNA, 12 bp, Homo sapiens
agccctttctgt

SEQ ID NO: 3919924 - DNA, 13 bp, Homo sapiens
agccctttctgtg

SEQ ID NO: 3919925 - DNA, 16 bp, Homo sapiens
agccctttctgtgtgc

SEQ ID NO: 3919926 - DNA, 18 bp, Homo sapiens
agccctttctgtgtgcac

SEQ ID NO: 3919927 - DNA, 18 bp, Homo sapiens
agccgcaaatcaacccca

SEQ ID NO: 3919928 - DNA, 20 bp, Homo sapiens
agccgcaaatcaaccccaga

SEQ ID NO: 3919929 - DNA, 15 bp, Homo sapiens
agccgcagcgcagcc

SEQ ID NO: 3919930 - DNA, 21 bp, Homo sapiens
agccgcatcttctccatctgg

SEQ ID NO: 3919931 - DNA, 12 bp, Homo sapiens
agccgccctggg

SEQ ID NO: 3919932 - DNA, 22 bp, Homo sapiens
agccgccctgggctgtctgtca

SEQ ID NO: 3919933 - DNA, 24 bp, Homo sapiens
agccgccctgggctgtctgtcacc

SEQ ID NO: 3919934 - DNA, 18 bp, Homo sapiens
agccgccgggcaggcctg

SEQ ID NO: 3919935 - DNA, 19 bp, Homo sapiens
agccgctaggagagactga

SEQ ID NO: 3919936 - DNA, 19 bp, Homo sapiens
agccgctgtgagcccctgg

SEQ ID NO: 3919937 - DNA, 20 bp, Homo sapiens
agccggaccaagatgggcac

SEQ ID NO: 3919938 - DNA, 23 bp, Homo sapiens
agccggaccaagatgggcacatg

SEQ ID NO: 3919939 - DNA, 19 bp, Homo sapiens
agccggcgtggcaaatata

SEQ ID NO: 3919940 - DNA, 16 bp, Homo sapiens
agccggctcttcaaag

SEQ ID NO: 3919941 - DNA, 19 bp, Homo sapiens
agccgggcacccccaacct

SEQ ID NO: 3919942 - DNA, 19 bp, Homo sapiens
agccgggcctggggctcct

SEQ ID NO: 3919943 - DNA, 13 bp, Homo sapiens
agccggtgcctgg

SEQ ID NO: 3919944 - DNA, 19 bp, Homo sapiens
agccgtctgactccagagt

SEQ ID NO: 3919945 - DNA, 21 bp, Homo sapiens
agccgtctgactccagagtct

SEQ ID NO: 3919946 - DNA, 17 bp, Homo sapiens
agccgtgatgctcaggc

SEQ ID NO: 3919947 - DNA, 19 bp, Homo sapiens
agccgtgatgctcaggctt

SEQ ID NO: 3919948 - DNA, 15 bp, Homo sapiens
agccgtgccttcagc

SEQ ID NO: 3919949 - DNA, 21 bp, Homo sapiens
agccgtggcttcccgctcagc

SEQ ID NO: 3919950 - DNA, 19 bp, Homo sapiens
agcctaaataaaaagtata

SEQ ID NO: 3919951 - DNA, 19 bp, Homo sapiens
agcctaaatctaatcaggt

SEQ ID NO: 3919952 - DNA, 15 bp, Homo sapiens
agcctaatacaacat

SEQ ID NO: 3919953 - DNA, 14 bp, Homo sapiens
agcctaatgaaagg

SEQ ID NO: 3919954 - DNA, 12 bp, Homo sapiens
agcctagccacc

SEQ ID NO: 3919955 - DNA, 13 bp, Homo sapiens
agcctagccacct

SEQ ID NO: 3919956 - DNA, 22 bp, Homo sapiens
agcctagccacctcccacccca

SEQ ID NO: 3919957 - DNA, 22 bp, Homo sapiens
agcctatttatttgaaagtcct

SEQ ID NO: 3919958 - DNA, 17 bp, Homo sapiens
agcctcagctcagcctc

SEQ ID NO: 3919959 - DNA, 17 bp, Homo sapiens
agcctcatatttaaaga

SEQ ID NO: 3919960 - DNA, 19 bp, Homo sapiens
agcctcatatttaaagaca

SEQ ID NO: 3919961 - DNA, 19 bp, Homo sapiens
agcctccaccttgctcttc

SEQ ID NO: 3919962 - DNA, 20 bp, Homo sapiens
agcctccatgctgcctccag

SEQ ID NO: 3919963 - DNA, 13 bp, Homo sapiens
agcctcccagagt

SEQ ID NO: 3919964 - DNA, 19 bp, Homo sapiens
agcgccctgcagaccctgc

SEQ ID NO: 3919965 - DNA, 23 bp, Homo sapiens
agcgcctagtggggtctccctct

SEQ ID NO: 3919966 - DNA, 24 bp, Homo sapiens
agcgcctgtgctgaggactccctc

SEQ ID NO: 3919967 - DNA, 12 bp, Homo sapiens
agcgcgggcgga

SEQ ID NO: 3919968 - DNA, 18 bp, Homo sapiens
agcgcgggcggaggcggc

SEQ ID NO: 3919969 - DNA, 19 bp, Homo sapiens
agcggttgcttctggctcc

SEQ ID NO: 3919970 - DNA, 17 bp, Homo sapiens
agcgtccctagcagtga

SEQ ID NO: 3919971 - DNA, 17 bp, Homo sapiens
agcgtggctgtgctctc

SEQ ID NO: 3919972 - DNA, 21 bp, Homo sapiens
agctaacagggaaggcaggca

SEQ ID NO: 3919973 - DNA, 23 bp, Homo sapiens
agctaacagggaaggcaggcagg

SEQ ID NO: 3919974 - DNA, 21 bp, Homo sapiens
agctaatcagcattctcactc

SEQ ID NO: 3919975 - DNA, 15 bp, Homo sapiens
acctgggatatgaca

SEQ ID NO: 3919976 - DNA, 14 bp, Homo sapiens
acctgggccctggg

SEQ ID NO: 3919977 - DNA, 15 bp, Homo sapiens
acctgggccctgggg

SEQ ID NO: 3919978 - DNA, 16 bp, Homo sapiens
acctgggccctggggc

SEQ ID NO: 3919979 - DNA, 18 bp, Homo sapiens
acctgggccctggggcct

SEQ ID NO: 3919980 - DNA, 22 bp, Homo sapiens
acctggtcacaggactctgcct

SEQ ID NO: 3919981 - DNA, 20 bp, Homo sapiens
acctggtggcaccagatgca

SEQ ID NO: 3919982 - DNA, 15 bp, Homo sapiens
acctgtaatcccagc

SEQ ID NO: 3919983 - DNA, 16 bp, Homo sapiens
acctgtaatcccagca

SEQ ID NO: 3919984 - DNA, 11 bp, Homo sapiens
acctgtctgtc

SEQ ID NO: 3919985 - DNA, 17 bp, Homo sapiens
acctgtctgtcgctggg

SEQ ID NO: 3919986 - DNA, 14 bp, Homo sapiens
acctgtctgtctgt

SEQ ID NO: 3919987 - DNA, 18 bp, Homo sapiens
acctgtctgtctgtctgt

SEQ ID NO: 3919988 - DNA, 20 bp, Homo sapiens
acctgtctgtctgtctgtcc

SEQ ID NO: 3919989 - DNA, 18 bp, Homo sapiens
acctgtgcagtcccgtgg

SEQ ID NO: 3919990 - DNA, 22 bp, Homo sapiens
acctgtgcagtcccgtggaggg

SEQ ID NO: 3919991 - DNA, 16 bp, Homo sapiens
acctgtgtggacagga

SEQ ID NO: 3919992 - DNA, 18 bp, Homo sapiens
acctgttaaaatgtacac

SEQ ID NO: 3919993 - DNA, 19 bp, Homo sapiens
acctgttactattatctgt

SEQ ID NO: 3919994 - DNA, 20 bp, Homo sapiens
acctgttggttagctggaca

SEQ ID NO: 3919995 - DNA, 14 bp, Homo sapiens
acctgttttcttca

SEQ ID NO: 3919996 - DNA, 12 bp, Homo sapiens
accttacattcc

SEQ ID NO: 3919997 - DNA, 13 bp, Homo sapiens
accttacattcct

SEQ ID NO: 3919998 - DNA, 23 bp, Homo sapiens
accttacattcctagagagcaga

SEQ ID NO: 3919999 - DNA, 15 bp, Homo sapiens
accttaccaactttc

SEQ ID NO: 3920000 - DNA, 19 bp, Homo sapiens
accttaccaactttctgta

SEQ ID NO: 3920001 - DNA, 22 bp, Homo sapiens
accttagaaatcattgtagaaa

SEQ ID NO: 3920002 - DNA, 22 bp, Homo sapiens
accttagctggcattacagctg

SEQ ID NO: 3920003 - DNA, 14 bp, Homo sapiens
accttagtggcttt

SEQ ID NO: 3920004 - DNA, 13 bp, Homo sapiens
accttatgtatta

SEQ ID NO: 3920005 - DNA, 15 bp, Homo sapiens
accttatgtattatt

SEQ ID NO: 3920006 - DNA, 18 bp, Homo sapiens
accttcccagctctccct

SEQ ID NO: 3920007 - DNA, 17 bp, Homo sapiens
accttcccatgccctgg

SEQ ID NO: 3920008 - DNA, 9 bp, Homo sapiens
accttcccc

SEQ ID NO: 3920009 - DNA, 15 bp, Homo sapiens
accttccccagactc

SEQ ID NO: 3920010 - DNA, 20 bp, Homo sapiens
accttccccagactcagctc

SEQ ID NO: 3920011 - DNA, 9 bp, Homo sapiens
accttccct

SEQ ID NO: 3920012 - DNA, 13 bp, Homo sapiens
accttccctccaa

SEQ ID NO: 3920013 - DNA, 11 bp, Homo sapiens
accttcctgcc

SEQ ID NO: 3920014 - DNA, 17 bp, Homo sapiens
accttccttaagccagg

SEQ ID NO: 3920015 - DNA, 19 bp, Homo sapiens
accttctggcttccttctc

SEQ ID NO: 3920016 - DNA, 19 bp, Homo sapiens
accttctggttgcttcaga

SEQ ID NO: 3920017 - DNA, 15 bp, Homo sapiens
accttctgtggctca

SEQ ID NO: 3920018 - DNA, 16 bp, Homo sapiens
accttcttggcttctg

SEQ ID NO: 3920019 - DNA, 19 bp, Homo sapiens
accttcttggcttctggga

SEQ ID NO: 3920020 - DNA, 11 bp, Homo sapiens
accttgcagca

SEQ ID NO: 3920021 - DNA, 20 bp, Homo sapiens
accttgccaagctttcttct

SEQ ID NO: 3920022 - DNA, 16 bp, Homo sapiens
accttggactcctccc

SEQ ID NO: 3920023 - DNA, 17 bp, Homo sapiens
accttgggacctgttta

SEQ ID NO: 3920024 - DNA, 18 bp, Homo sapiens
accttgggtttgtatttt

SEQ ID NO: 3920025 - DNA, 16 bp, Homo sapiens
accttggtaaattgta

SEQ ID NO: 3920026 - DNA, 20 bp, Homo sapiens
acctttaaagtaaaggcctc

SEQ ID NO: 3920027 - DNA, 16 bp, Homo sapiens
acctttacataattgc

SEQ ID NO: 3920028 - DNA, 16 bp, Homo sapiens
acctttattgtgatct

SEQ ID NO: 3920029 - DNA, 17 bp, Homo sapiens
acctttcagctgtgaac

SEQ ID NO: 3920030 - DNA, 17 bp, Homo sapiens
acctttccccagacaca

SEQ ID NO: 3920031 - DNA, 19 bp, Homo sapiens
acctttccgctgtcgcccc

SEQ ID NO: 3920032 - DNA, 14 bp, Homo sapiens
acctttggaaaaat

SEQ ID NO: 3920033 - DNA, 15 bp, Homo sapiens
acctttggtgcagag

SEQ ID NO: 3920034 - DNA, 17 bp, Homo sapiens
acctttggtgcagaggt

SEQ ID NO: 3920035 - DNA, 18 bp, Homo sapiens
acctttgttttgcactga

SEQ ID NO: 3920036 - DNA, 14 bp, Homo sapiens
acgaacccacctgc

SEQ ID NO: 3920037 - DNA, 16 bp, Homo sapiens
acgaacccacctgctg

SEQ ID NO: 3920038 - DNA, 17 bp, Homo sapiens
acgaacggaagggttgg

SEQ ID NO: 3920039 - DNA, 17 bp, Homo sapiens
acgaagccatctttctt

SEQ ID NO: 3920040 - DNA, 22 bp, Homo sapiens
acgaaggggccccggggctggc

SEQ ID NO: 3920041 - DNA, 22 bp, Homo sapiens
acgaatttggtgtggctgtatt

SEQ ID NO: 3920042 - DNA, 19 bp, Homo sapiens
acgagaccctacaggagag

SEQ ID NO: 3920043 - DNA, 20 bp, Homo sapiens
acgagagagtcttccaggta

SEQ ID NO: 3920044 - DNA, 14 bp, Homo sapiens
acgagcactggcca

SEQ ID NO: 3920045 - DNA, 18 bp, Homo sapiens
acgagcactggccagaga

SEQ ID NO: 3920046 - DNA, 19 bp, Homo sapiens
acgagcactggccagagag

SEQ ID NO: 3920047 - DNA, 19 bp, Homo sapiens
actgggttttgtctctgca

SEQ ID NO: 3920048 - DNA, 19 bp, Homo sapiens
actggtccactcagggctg

SEQ ID NO: 3920049 - DNA, 14 bp, Homo sapiens
actggtcctgtgtg

SEQ ID NO: 3920050 - DNA, 23 bp, Homo sapiens
actggtgctataggctggagaag

SEQ ID NO: 3920051 - DNA, 12 bp, Homo sapiens
actggtggcccg

SEQ ID NO: 3920052 - DNA, 20 bp, Homo sapiens
actggtttatccacccacaa

SEQ ID NO: 3920053 - DNA, 14 bp, Homo sapiens
actgtaaacccctg

SEQ ID NO: 3920054 - DNA, 12 bp, Homo sapiens
actgtaaataca

SEQ ID NO: 3920055 - DNA, 19 bp, Homo sapiens
actgtaaatatccacagac

SEQ ID NO: 3920056 - DNA, 19 bp, Homo sapiens
actgtaaatatgtttgtgc

SEQ ID NO: 3920057 - DNA, 18 bp, Homo sapiens
actgtaaatcacttgtaa

SEQ ID NO: 3920058 - DNA, 21 bp, Homo sapiens
actgtaaatcacttgtaaata

SEQ ID NO: 3920059 - DNA, 22 bp, Homo sapiens
actgtaaatcacttgtaaataa

SEQ ID NO: 3920060 - DNA, 15 bp, Homo sapiens
actgtaatcttaaaa

SEQ ID NO: 3920061 - DNA, 17 bp, Homo sapiens
actgtaatcttaaaagt

SEQ ID NO: 3920062 - DNA, 17 bp, Homo sapiens
actgtaattaagtgcaa

SEQ ID NO: 3920063 - DNA, 19 bp, Homo sapiens
actgtaattaagtgcaatt

SEQ ID NO: 3920064 - DNA, 12 bp, Homo sapiens
actgtacataga

SEQ ID NO: 3920065 - DNA, 13 bp, Homo sapiens
actgtactcctcc

SEQ ID NO: 3920066 - DNA, 15 bp, Homo sapiens
actgtcaagtcatga

SEQ ID NO: 3920067 - DNA, 17 bp, Homo sapiens
actgtcaccctccacct

SEQ ID NO: 3920068 - DNA, 21 bp, Homo sapiens
actgtcagagctgttggcctc

SEQ ID NO: 3920069 - DNA, 22 bp, Homo sapiens
actgtcagagctgttggcctcg

SEQ ID NO: 3920070 - DNA, 22 bp, Homo sapiens
actgtcagctcccctcggagaa

SEQ ID NO: 3920071 - DNA, 20 bp, Homo sapiens
actgtccctcaaatgaccca

SEQ ID NO: 3920072 - DNA, 23 bp, Homo sapiens
actgtccctcaaatgacccaaag

SEQ ID NO: 3920073 - DNA, 13 bp, Homo sapiens
actgtcgctgctt

SEQ ID NO: 3920074 - DNA, 16 bp, Homo sapiens
actgtcgtgtttacaa

SEQ ID NO: 3920075 - DNA, 20 bp, Homo sapiens
actgtctcaagagggcactg

SEQ ID NO: 3920076 - DNA, 21 bp, Homo sapiens
actgtctcaagagggcactgg

SEQ ID NO: 3920077 - DNA, 20 bp, Homo sapiens
actgtctcctggtctgtgct

SEQ ID NO: 3920078 - DNA, 13 bp, Homo sapiens
actgtgaaagtat

SEQ ID NO: 3920079 - DNA, 20 bp, Homo sapiens
actgtgaaagtatgtgatat

SEQ ID NO: 3920080 - DNA, 13 bp, Homo sapiens
actgtgtgaagaa

SEQ ID NO: 3920081 - DNA, 19 bp, Homo sapiens
actgtgttggccaggctgg

SEQ ID NO: 3920082 - DNA, 19 bp, Homo sapiens
actgttattgaaaatatat

SEQ ID NO: 3920083 - DNA, 20 bp, Homo sapiens
actgttctggcctcagacca

SEQ ID NO: 3920084 - DNA, 13 bp, Homo sapiens
actgttctgtgtg

SEQ ID NO: 3920085 - DNA, 23 bp, Homo sapiens
actgttgaaaattattttaaaca

SEQ ID NO: 3920086 - DNA, 22 bp, Homo sapiens
actgttgagttggacacactgt

SEQ ID NO: 3920087 - DNA, 16 bp, Homo sapiens
acttaaaaaaatgaca

SEQ ID NO: 3920088 - DNA, 17 bp, Homo sapiens
acttaaaagattcacta

SEQ ID NO: 3920089 - DNA, 20 bp, Homo sapiens
acttaaaatattcctgcatt

SEQ ID NO: 3920090 - DNA, 22 bp, Homo sapiens
acttaaaatattcctgcatttg

SEQ ID NO: 3920091 - DNA, 14 bp, Homo sapiens
acttaacatattta

SEQ ID NO: 3920092 - DNA, 12 bp, Homo sapiens
acttaagagaaa

SEQ ID NO: 3920093 - DNA, 13 bp, Homo sapiens
acttaagattaaa

SEQ ID NO: 3920094 - DNA, 11 bp, Homo sapiens
acttacctgca

SEQ ID NO: 3920095 - DNA, 16 bp, Homo sapiens
acttagaaattgcatt

SEQ ID NO: 3920096 - DNA, 15 bp, Homo sapiens
acttagcccaagagg

SEQ ID NO: 3920097 - DNA, 21 bp, Homo sapiens
acttagccgtccatggcacca

SEQ ID NO: 3920098 - DNA, 16 bp, Homo sapiens
acttataccaaaggga

SEQ ID NO: 3920099 - DNA, 11 bp, Homo sapiens
acttatttgag

SEQ ID NO: 3920100 - DNA, 12 bp, Homo sapiens
acttatttgagt

SEQ ID NO: 3920101 - DNA, 22 bp, Homo sapiens
acttatttttgacagtgttgaa

SEQ ID NO: 3920102 - DNA, 15 bp, Homo sapiens
acttcaaatatagag

SEQ ID NO: 3920103 - DNA, 14 bp, Homo sapiens
acttcacactgcaa

SEQ ID NO: 3920104 - DNA, 12 bp, Homo sapiens
acttcactgtga

SEQ ID NO: 3920105 - DNA, 13 bp, Homo sapiens
acttcactgtgag

SEQ ID NO: 3920106 - DNA, 20 bp, Homo sapiens
acttcagaacatgctggata

SEQ ID NO: 3920107 - DNA, 11 bp, Homo sapiens
acttcagcacc

SEQ ID NO: 3920108 - DNA, 13 bp, Homo sapiens
acttcagctctgt

SEQ ID NO: 3920109 - DNA, 14 bp, Homo sapiens
acttcagctctgtt

SEQ ID NO: 3920110 - DNA, 20 bp, Homo sapiens
acttcaggctcttctccttt

SEQ ID NO: 3920111 - DNA, 19 bp, Homo sapiens
acttcataaatgttcagct

SEQ ID NO: 3920112 - DNA, 22 bp, Homo sapiens
acttcatggcctttgataaatg

SEQ ID NO: 3920113 - DNA, 21 bp, Homo sapiens
acttccagtgttggctgtgtg

SEQ ID NO: 3920114 - DNA, 22 bp, Homo sapiens
acttccagtgttggctgtgtga

SEQ ID NO: 3920115 - DNA, 20 bp, Homo sapiens
acttcctcctgatggccaag

SEQ ID NO: 3920116 - DNA, 23 bp, Homo sapiens
acttcctcctgatggccaagagc

SEQ ID NO: 3920117 - DNA, 15 bp, Homo sapiens
acttcctgtgacttc

SEQ ID NO: 3920118 - DNA, 13 bp, Homo sapiens
acttcctgtgtac

SEQ ID NO: 3920119 - DNA, 13 bp, Homo sapiens
acttccttggttt

SEQ ID NO: 3920120 - DNA, 23 bp, Homo sapiens
acttcgtgcgcaacaacaaggac

SEQ ID NO: 3920121 - DNA, 18 bp, Homo sapiens
acttctaagtaaaaccac

SEQ ID NO: 3920122 - DNA, 17 bp, Homo sapiens
acttctcaggacacagg

SEQ ID NO: 3920123 - DNA, 23 bp, Homo sapiens
acttctcatcatattgtatgtaa

SEQ ID NO: 3920124 - DNA, 11 bp, Homo sapiens
acttctctaga

SEQ ID NO: 3920125 - DNA, 17 bp, Homo sapiens
acttctggaaggctggc

SEQ ID NO: 3920126 - DNA, 20 bp, Homo sapiens
acttctggaaggctggctga

SEQ ID NO: 3920127 - DNA, 21 bp, Homo sapiens
acttctggaaggctggctgag

SEQ ID NO: 3920128 - DNA, 22 bp, Homo sapiens
acttctggaaggctggctgagt

SEQ ID NO: 3920129 - DNA, 16 bp, Homo sapiens
acttcttaaaagttgt

SEQ ID NO: 3920130 - DNA, 17 bp, Homo sapiens
acttcttgaaacagcct

SEQ ID NO: 3920131 - DNA, 16 bp, Homo sapiens
acttcttggaaaaaaa

SEQ ID NO: 3920132 - DNA, 22 bp, Homo sapiens
acttcttggtttggggagaaat

SEQ ID NO: 3920133 - DNA, 15 bp, Homo sapiens
acttcttttataact

SEQ ID NO: 3920134 - DNA, 21 bp, Homo sapiens
agaaactgaggagtagctgag

SEQ ID NO: 3920135 - DNA, 21 bp, Homo sapiens
agaaagaaaagaccctgagac

SEQ ID NO: 3920136 - DNA, 16 bp, Homo sapiens
agaaagaaaatgaaga

SEQ ID NO: 3920137 - DNA, 22 bp, Homo sapiens
agaaagaaaattagtaattgta

SEQ ID NO: 3920138 - DNA, 14 bp, Homo sapiens
agaaagaatgtgtt

SEQ ID NO: 3920139 - DNA, 20 bp, Homo sapiens
agaaagactattcaaacagt

SEQ ID NO: 3920140 - DNA, 18 bp, Homo sapiens
agaaagactggacgggga

SEQ ID NO: 3920141 - DNA, 12 bp, Homo sapiens
agaaagcaataa

SEQ ID NO: 3920142 - DNA, 16 bp, Homo sapiens
agaaagctctgcatgt

SEQ ID NO: 3920143 - DNA, 16 bp, Homo sapiens
agaaagctggtaaact

SEQ ID NO: 3920144 - DNA, 16 bp, Homo sapiens
agaaagggagggctct

SEQ ID NO: 3920145 - DNA, 19 bp, Homo sapiens
agaaagggagggctctgag

SEQ ID NO: 3920146 - DNA, 16 bp, Homo sapiens
agaaagtgcagaatca

SEQ ID NO: 3920147 - DNA, 18 bp, Homo sapiens
agaaatactgctctgaat

SEQ ID NO: 3920148 - DNA, 19 bp, Homo sapiens
agaaatactgctctgaata

SEQ ID NO: 3920149 - DNA, 13 bp, Homo sapiens
agaaatatatata

SEQ ID NO: 3920150 - DNA, 16 bp, Homo sapiens
agaaatatatatacat

SEQ ID NO: 3920151 - DNA, 18 bp, Homo sapiens
agaaatatatatacatat

SEQ ID NO: 3920152 - DNA, 19 bp, Homo sapiens
agaaatatatatacatatg

SEQ ID NO: 3920153 - DNA, 13 bp, Homo sapiens
agaaatatgattt

SEQ ID NO: 3920154 - DNA, 15 bp, Homo sapiens
agaaatatgtggttt

SEQ ID NO: 3920155 - DNA, 16 bp, Homo sapiens
agaaatcacaggggcg

SEQ ID NO: 3920156 - DNA, 22 bp, Homo sapiens
agaaatcacaggggcggggcag

SEQ ID NO: 3920157 - DNA, 16 bp, Homo sapiens
agaaatcattgtagaa

SEQ ID NO: 3920158 - DNA, 18 bp, Homo sapiens
agaaatgcatccattcct

SEQ ID NO: 3920159 - DNA, 12 bp, Homo sapiens
agaaatgctttg

SEQ ID NO: 3920160 - DNA, 18 bp, Homo sapiens
agaaatgtgaagggtggg

SEQ ID NO: 3920161 - DNA, 14 bp, Homo sapiens
agaaattatttaat

SEQ ID NO: 3920162 - DNA, 13 bp, Homo sapiens
agaaattcctgta

SEQ ID NO: 3920163 - DNA, 17 bp, Homo sapiens
agaaattccttcccact

SEQ ID NO: 3920164 - DNA, 20 bp, Homo sapiens
agaaattgcatttcctgaca

SEQ ID NO: 3920165 - DNA, 16 bp, Homo sapiens
agaaattgcctcctta

SEQ ID NO: 3920166 - DNA, 16 bp, Homo sapiens
agaaattgttcctgat

SEQ ID NO: 3920167 - DNA, 19 bp, Homo sapiens
agaaattgttcctgatgtg

SEQ ID NO: 3920168 - DNA, 16 bp, Homo sapiens
agaaatttgatttcta

SEQ ID NO: 3920169 - DNA, 20 bp, Homo sapiens
agaaatttgatttctattca

SEQ ID NO: 3920170 - DNA, 22 bp, Homo sapiens
agaaatttttatttttctaagg

SEQ ID NO: 3920171 - DNA, 17 bp, Homo sapiens
agaacaacaacaacaat

SEQ ID NO: 3920172 - DNA, 21 bp, Homo sapiens
agaacaagtcacagctgcagc

SEQ ID NO: 3920173 - DNA, 22 bp, Homo sapiens
agaacaagtcacagctgcagct

SEQ ID NO: 3920174 - DNA, 16 bp, Homo sapiens
agaacaatagctattg

SEQ ID NO: 3920175 - DNA, 19 bp, Homo sapiens
agaacaatagctattgcat

SEQ ID NO: 3920176 - DNA, 13 bp, Homo sapiens
agaacaattgtcc

SEQ ID NO: 3920177 - DNA, 17 bp, Homo sapiens
agaacacccactggcca

SEQ ID NO: 3920178 - DNA, 18 bp, Homo sapiens
agaacacccactggccag

SEQ ID NO: 3920179 - DNA, 21 bp, Homo sapiens
agaacacctttgttttgcact

SEQ ID NO: 3920180 - DNA, 11 bp, Homo sapiens
agaacactggt

SEQ ID NO: 3920181 - DNA, 13 bp, Homo sapiens
agaacagtaaaca

SEQ ID NO: 3920182 - DNA, 15 bp, Homo sapiens
agaacatccaaggag

SEQ ID NO: 3920183 - DNA, 13 bp, Homo sapiens
agaacatgcacat

SEQ ID NO: 3920184 - DNA, 18 bp, Homo sapiens
agaacatggcctaagggc

SEQ ID NO: 3920185 - DNA, 19 bp, Homo sapiens
agaaccaagcttcagagcc

SEQ ID NO: 3920186 - DNA, 21 bp, Homo sapiens
agaaccaagcttcagagccta

SEQ ID NO: 3920187 - DNA, 17 bp, Homo sapiens
agaaccacttggctgct

SEQ ID NO: 3920188 - DNA, 15 bp, Homo sapiens
agaacctggaagggc

SEQ ID NO: 3920189 - DNA, 21 bp, Homo sapiens
agaacctgtgctctaagtgaa

SEQ ID NO: 3920190 - DNA, 13 bp, Homo sapiens
agaacggaagaag

SEQ ID NO: 3920191 - DNA, 16 bp, Homo sapiens
agaactactaaagtgc

SEQ ID NO: 3920192 - DNA, 17 bp, Homo sapiens
agaactagaacctggag

SEQ ID NO: 3920193 - DNA, 18 bp, Homo sapiens
agaactccttattttgta

SEQ ID NO: 3920194 - DNA, 20 bp, Homo sapiens
agaactgaggtcactgggtt

SEQ ID NO: 3920195 - DNA, 21 bp, Homo sapiens
agaactgctaaatactgtaca

SEQ ID NO: 3920196 - DNA, 18 bp, Homo sapiens
agaactggacgcccagct

SEQ ID NO: 3920197 - DNA, 19 bp, Homo sapiens
agaactgtatgtcagacat

SEQ ID NO: 3920198 - DNA, 18 bp, Homo sapiens
agaagaaagaacggaaga

SEQ ID NO: 3920199 - DNA, 18 bp, Homo sapiens
agaagaaattctgtcata

SEQ ID NO: 3920200 - DNA, 13 bp, Homo sapiens
agaagaacatcca

SEQ ID NO: 3920201 - DNA, 13 bp, Homo sapiens
agaagaagctgag

SEQ ID NO: 3920202 - DNA, 14 bp, Homo sapiens
agaagaatattcag

SEQ ID NO: 3920203 - DNA, 19 bp, Homo sapiens
agaagaatattcaggactt

SEQ ID NO: 3920204 - DNA, 19 bp, Homo sapiens
agaagaatccgagtgtttg

SEQ ID NO: 3920205 - DNA, 19 bp, Homo sapiens
agaagaattgaacccagga

SEQ ID NO: 3920206 - DNA, 20 bp, Homo sapiens
agaagaattgaacccaggag

SEQ ID NO: 3920207 - DNA, 23 bp, Homo sapiens
agaagaattttcagaccccagcg

SEQ ID NO: 3920208 - DNA, 12 bp, Homo sapiens
agaagagacagg

SEQ ID NO: 3920209 - DNA, 17 bp, Homo sapiens
agaagagatcaggaaga

SEQ ID NO: 3920210 - DNA, 22 bp, Homo sapiens
agaagaggctggtgctgtggcc

SEQ ID NO: 3920211 - DNA, 14 bp, Homo sapiens
agaagagggcctgt

SEQ ID NO: 3920212 - DNA, 15 bp, Homo sapiens
agaagatgccctcca

SEQ ID NO: 3920213 - DNA, 17 bp, Homo sapiens
agaagcagtgtttctac

SEQ ID NO: 3920214 - DNA, 20 bp, Homo sapiens
agaagccaggagcaaatgtt

SEQ ID NO: 3920215 - DNA, 16 bp, Homo sapiens
agaagccggctcttca

SEQ ID NO: 3920216 - DNA, 12 bp, Homo sapiens
agaagcctgggg

SEQ ID NO: 3920217 - DNA, 20 bp, Homo sapiens
agaagcctgggggcctggct

SEQ ID NO: 3920218 - DNA, 23 bp, Homo sapiens
agaagcgggacgagaccctacag

SEQ ID NO: 3920219 - DNA, 21 bp, Homo sapiens
agaagctcccagatgctgggg

SEQ ID NO: 3920220 - DNA, 15 bp, Homo sapiens
agaagctgagaagaa

SEQ ID NO: 3920221 - DNA, 16 bp, Homo sapiens
agaagctgagaagaag

SEQ ID NO: 3920222 - DNA, 12 bp, Homo sapiens
agaagctgagga

SEQ ID NO: 3920223 - DNA, 16 bp, Homo sapiens
agaagctggaggacta

SEQ ID NO: 3920224 - DNA, 13 bp, Homo sapiens
agaagctgtagta

SEQ ID NO: 3920225 - DNA, 19 bp, Homo sapiens
agaaggaaggaggcagact

SEQ ID NO: 3920226 - DNA, 13 bp, Homo sapiens
agaaggaagggca

SEQ ID NO: 3920227 - DNA, 15 bp, Homo sapiens
agaaggagaaggaag

SEQ ID NO: 3920228 - DNA, 12 bp, Homo sapiens
agaaggagggca

SEQ ID NO: 3920229 - DNA, 19 bp, Homo sapiens
agaaggagggcagagccat

SEQ ID NO: 3920230 - DNA, 21 bp, Homo sapiens
agaaggagggcagagccatgg

SEQ ID NO: 3920231 - DNA, 22 bp, Homo sapiens
agaaggcacaggtgtaaatata

SEQ ID NO: 3920232 - DNA, 15 bp, Homo sapiens
agaaggcagggaaag

SEQ ID NO: 3920233 - DNA, 13 bp, Homo sapiens
agaaggccaagaa

SEQ ID NO: 3920234 - DNA, 14 bp, Homo sapiens
agaaggccacatgt

SEQ ID NO: 3920235 - DNA, 23 bp, Homo sapiens
agaaggcccataccttctggttg

SEQ ID NO: 3920236 - DNA, 19 bp, Homo sapiens
agaaggcctcttgtgctca

SEQ ID NO: 3920237 - DNA, 15 bp, Homo sapiens
agaaggcgaggagag

SEQ ID NO: 3920238 - DNA, 13 bp, Homo sapiens
agaaggctggggc

SEQ ID NO: 3920239 - DNA, 15 bp, Homo sapiens
agaaggctggggcca

SEQ ID NO: 3920240 - DNA, 14 bp, Homo sapiens
agaagggagaagga

SEQ ID NO: 3920241 - DNA, 16 bp, Homo sapiens
agaagggagttgctca

SEQ ID NO: 3920242 - DNA, 22 bp, Homo sapiens
agaagggagttgctcactcagg

SEQ ID NO: 3920243 - DNA, 23 bp, Homo sapiens
agaagggagttgctcactcagga

SEQ ID NO: 3920244 - DNA, 12 bp, Homo sapiens
agaagggccagc

SEQ ID NO: 3920245 - DNA, 13 bp, Homo sapiens
agaagggccagcc

SEQ ID NO: 3920246 - DNA, 15 bp, Homo sapiens
agaagggccagccct

SEQ ID NO: 3920247 - DNA, 17 bp, Homo sapiens
agaagggccagccctac

SEQ ID NO: 3920248 - DNA, 14 bp, Homo sapiens
agaagggctagaac

SEQ ID NO: 3920249 - DNA, 16 bp, Homo sapiens
agaaggttgctctaga

SEQ ID NO: 3920250 - DNA, 15 bp, Homo sapiens
agaagtaaatttgtc

SEQ ID NO: 3920251 - DNA, 17 bp, Homo sapiens
agaagtaaatttgtcca

SEQ ID NO: 3920252 - DNA, 20 bp, Homo sapiens
agaagtaaatttgtccaatg

SEQ ID NO: 3920253 - DNA, 17 bp, Homo sapiens
agaagtggaccaggaca

SEQ ID NO: 3920254 - DNA, 17 bp, Homo sapiens
agaagtgtcgttttcat

SEQ ID NO: 3920255 - DNA, 22 bp, Homo sapiens
agaagtttctggagcaagagag

SEQ ID NO: 3920256 - DNA, 16 bp, Homo sapiens
agaagttttgtacaga

SEQ ID NO: 3920257 - DNA, 21 bp, Homo sapiens
agaataaagttctgagtgttt

SEQ ID NO: 3920258 - DNA, 13 bp, Homo sapiens
agaataaatgaat

SEQ ID NO: 3920259 - DNA, 14 bp, Homo sapiens
agaataaatgaatc

SEQ ID NO: 3920260 - DNA, 14 bp, Homo sapiens
agaataagagaaag

SEQ ID NO: 3920261 - DNA, 19 bp, Homo sapiens
agaatacttttttctagtt

SEQ ID NO: 3920262 - DNA, 20 bp, Homo sapiens
agaatagatctgatggtgag

SEQ ID NO: 3920263 - DNA, 13 bp, Homo sapiens
agaatatatacat

SEQ ID NO: 3920264 - DNA, 16 bp, Homo sapiens
agaatatatttttgat

SEQ ID NO: 3920265 - DNA, 15 bp, Homo sapiens
agaatattcaaatgt

SEQ ID NO: 3920266 - DNA, 18 bp, Homo sapiens
agaatattcagagaatat

SEQ ID NO: 3920267 - DNA, 13 bp, Homo sapiens
agaatattcagga

SEQ ID NO: 3920268 - DNA, 14 bp, Homo sapiens
agaatcaaaactct

SEQ ID NO: 3920269 - DNA, 17 bp, Homo sapiens
agaatcagggcaggctt

SEQ ID NO: 3920270 - DNA, 19 bp, Homo sapiens
agaatcagtcttgcagctg

SEQ ID NO: 3920271 - DNA, 17 bp, Homo sapiens
agaatcataattttcaa

SEQ ID NO: 3920272 - DNA, 14 bp, Homo sapiens
agaatccctgcagc

SEQ ID NO: 3920273 - DNA, 16 bp, Homo sapiens
agaatccctgcagcct

SEQ ID NO: 3920274 - DNA, 16 bp, Homo sapiens
agaatctgaagctatt

SEQ ID NO: 3920275 - DNA, 18 bp, Homo sapiens
agaatctgctgttgccat

SEQ ID NO: 3920276 - DNA, 20 bp, Homo sapiens
agaatctgctgttgccatag

SEQ ID NO: 3920277 - DNA, 16 bp, Homo sapiens
agaatctggctcctgt

SEQ ID NO: 3920278 - DNA, 22 bp, Homo sapiens
agaatgatggacttttgggggt

SEQ ID NO: 3920279 - DNA, 20 bp, Homo sapiens
agaatgcagattcctgggcc

SEQ ID NO: 3920280 - DNA, 21 bp, Homo sapiens
agaatgcagattcctgggcct

SEQ ID NO: 3920281 - DNA, 22 bp, Homo sapiens
agaatgcagattcctgggcctg

SEQ ID NO: 3920282 - DNA, 23 bp, Homo sapiens
agaatgcagattcctgggcctgt

SEQ ID NO: 3920283 - DNA, 15 bp, Homo sapiens
agaatgcccaactct

SEQ ID NO: 3920284 - DNA, 23 bp, Homo sapiens
agaatgctctacttctttttctt

SEQ ID NO: 3920285 - DNA, 16 bp, Homo sapiens
agaattatatctaatt

SEQ ID NO: 3920286 - DNA, 21 bp, Homo sapiens
agaattatatctaatttatac

SEQ ID NO: 3920287 - DNA, 22 bp, Homo sapiens
agaattatatctaatttataca

SEQ ID NO: 3920288 - DNA, 17 bp, Homo sapiens
agaattatttttgtgtt

SEQ ID NO: 3920289 - DNA, 18 bp, Homo sapiens
agaattcacaccttaggt

SEQ ID NO: 3920290 - DNA, 20 bp, Homo sapiens
agaattccaaggagttccat

SEQ ID NO: 3920291 - DNA, 15 bp, Homo sapiens
agaattctagaaaat

SEQ ID NO: 3920292 - DNA, 15 bp, Homo sapiens
agaattgtatcattt

SEQ ID NO: 3920293 - DNA, 23 bp, Homo sapiens
agaattgtccatgtgcttcccta

SEQ ID NO: 3920294 - DNA, 23 bp, Homo sapiens
agaattgtgcgacttcacaaaat

SEQ ID NO: 3920295 - DNA, 16 bp, Homo sapiens
agaatttctaccattt

SEQ ID NO: 3920296 - DNA, 21 bp, Homo sapiens
agaatttctttgtcattcaag

SEQ ID NO: 3920297 - DNA, 15 bp, Homo sapiens
agaatttgtattttg

SEQ ID NO: 3920298 - DNA, 15 bp, Homo sapiens
agaattttaaattat

SEQ ID NO: 3920299 - DNA, 22 bp, Homo sapiens
agaattttgtatattgtaggaa

SEQ ID NO: 3920300 - DNA, 18 bp, Homo sapiens
agacaaaccactgtacat

SEQ ID NO: 3920301 - DNA, 16 bp, Homo sapiens
agacaagagctgctgt

SEQ ID NO: 3920302 - DNA, 17 bp, Homo sapiens
agacaagagctgctgtc

SEQ ID NO: 3920303 - DNA, 20 bp, Homo sapiens
agacaagagctgctgtcctt

SEQ ID NO: 3920304 - DNA, 13 bp, Homo sapiens
agacaaggaacca

SEQ ID NO: 3920305 - DNA, 18 bp, Homo sapiens
agacaatatgaacaaact

SEQ ID NO: 3920306 - DNA, 15 bp, Homo sapiens
agacaatccactctc

SEQ ID NO: 3920307 - DNA, 18 bp, Homo sapiens
agacaatccactctcagg

SEQ ID NO: 3920308 - DNA, 20 bp, Homo sapiens
agacaatccactctcaggag

SEQ ID NO: 3920309 - DNA, 14 bp, Homo sapiens
agacacctgcacct

SEQ ID NO: 3920310 - DNA, 16 bp, Homo sapiens
agacacctgcacctcc

SEQ ID NO: 3920311 - DNA, 14 bp, Homo sapiens
agacaccttttgta

SEQ ID NO: 3920312 - DNA, 20 bp, Homo sapiens
agacactcctataaggagag

SEQ ID NO: 3920313 - DNA, 13 bp, Homo sapiens
agacacttgcctt

SEQ ID NO: 3920314 - DNA, 17 bp, Homo sapiens
agacagaaaaaaataaa

SEQ ID NO: 3920315 - DNA, 20 bp, Homo sapiens
agacagaccccttggctttt

SEQ ID NO: 3920316 - DNA, 21 bp, Homo sapiens
agacagaccggggttcaagcc

SEQ ID NO: 3920317 - DNA, 16 bp, Homo sapiens
agacagagaaatgtga

SEQ ID NO: 3920318 - DNA, 19 bp, Homo sapiens
agacagagaaatgtgaagg

SEQ ID NO: 3920319 - DNA, 22 bp, Homo sapiens
agacagagcccccaagcctctg

SEQ ID NO: 3920320 - DNA, 19 bp, Homo sapiens
agacagagccctgtgaggc

SEQ ID NO: 3920321 - DNA, 17 bp, Homo sapiens
agacagatacagcccca

SEQ ID NO: 3920322 - DNA, 17 bp, Homo sapiens
agacagcacttggctcc

SEQ ID NO: 3920323 - DNA, 18 bp, Homo sapiens
agacagcacttggctcct

SEQ ID NO: 3920324 - DNA, 14 bp, Homo sapiens
agacagctgacaga

SEQ ID NO: 3920325 - DNA, 20 bp, Homo sapiens
agacaggaaaatcctctggc

SEQ ID NO: 3920326 - DNA, 19 bp, Homo sapiens
agacaggagggcaagggcc

SEQ ID NO: 3920327 - DNA, 18 bp, Homo sapiens
agacaggcccaagagatg

SEQ ID NO: 3920328 - DNA, 19 bp, Homo sapiens
agacaggcgctggacagag

SEQ ID NO: 3920329 - DNA, 19 bp, Homo sapiens
agacagggcaatcttgtcc

SEQ ID NO: 3920330 - DNA, 15 bp, Homo sapiens
agacagggtctcact

SEQ ID NO: 3920331 - DNA, 15 bp, Homo sapiens
agacagtatatttat

SEQ ID NO: 3920332 - DNA, 18 bp, Homo sapiens
agacagtggatcatgaaa

SEQ ID NO: 3920333 - DNA, 13 bp, Homo sapiens
agacagtgtgtgt

SEQ ID NO: 3920334 - DNA, 17 bp, Homo sapiens
agacatccatgtttgta

SEQ ID NO: 3920335 - DNA, 22 bp, Homo sapiens
agacatccatgtttgtaaaact

SEQ ID NO: 3920336 - DNA, 19 bp, Homo sapiens
agacatgcagcctaaggct

SEQ ID NO: 3920337 - DNA, 14 bp, Homo sapiens
agacattgcctcca

SEQ ID NO: 3920338 - DNA, 11 bp, Homo sapiens
agaccacctgc

SEQ ID NO: 3920339 - DNA, 13 bp, Homo sapiens
agaccacctgcca

SEQ ID NO: 3920340 - DNA, 17 bp, Homo sapiens
agaccacctgccagcca

SEQ ID NO: 3920341 - DNA, 19 bp, Homo sapiens
agaccactgtcctggctgc

SEQ ID NO: 3920342 - DNA, 16 bp, Homo sapiens
agaccagactgtggag

SEQ ID NO: 3920343 - DNA, 22 bp, Homo sapiens
agaccagactgtggagaaataa

SEQ ID NO: 3920344 - DNA, 17 bp, Homo sapiens
agaccagtactgggaag

SEQ ID NO: 3920345 - DNA, 13 bp, Homo sapiens
agaccagttggga

SEQ ID NO: 3920346 - DNA, 18 bp, Homo sapiens
agaccatcctggcccctc

SEQ ID NO: 3920347 - DNA, 20 bp, Homo sapiens
agaccattgtcttccaaccc

SEQ ID NO: 3920348 - DNA, 22 bp, Homo sapiens
agaccattgtcttccaacccca

SEQ ID NO: 3920349 - DNA, 15 bp, Homo sapiens
agaccatttaacatg

SEQ ID NO: 3920350 - DNA, 18 bp, Homo sapiens
agaccatttaacatgcaa

SEQ ID NO: 3920351 - DNA, 13 bp, Homo sapiens
agacccacacatg

SEQ ID NO: 3920352 - DNA, 20 bp, Homo sapiens
agacccagtgtaaagaataa

SEQ ID NO: 3920353 - DNA, 15 bp, Homo sapiens
agacccattcctatt

SEQ ID NO: 3920354 - DNA, 13 bp, Homo sapiens
agaccccatctct

SEQ ID NO: 3920355 - DNA, 12 bp, Homo sapiens
agacccccactc

SEQ ID NO: 3920356 - DNA, 15 bp, Homo sapiens
agacccctggctttt

SEQ ID NO: 3920357 - DNA, 16 bp, Homo sapiens
agacccctgtggcaga

SEQ ID NO: 3920358 - DNA, 18 bp, Homo sapiens
agaccccttcctttcctc

SEQ ID NO: 3920359 - DNA, 16 bp, Homo sapiens
agaccctaccccacca

SEQ ID NO: 3920360 - DNA, 18 bp, Homo sapiens
agaccctaccccaccacg

SEQ ID NO: 3920361 - DNA, 13 bp, Homo sapiens
agaccctgagact

SEQ ID NO: 3920362 - DNA, 12 bp, Homo sapiens
agaccctgccct

SEQ ID NO: 3920363 - DNA, 15 bp, Homo sapiens
agaccctgcctgagc

SEQ ID NO: 3920364 - DNA, 22 bp, Homo sapiens
agaccctggaattcagcaccct

SEQ ID NO: 3920365 - DNA, 16 bp, Homo sapiens
agacccttgcattaga

SEQ ID NO: 3920366 - DNA, 21 bp, Homo sapiens
agaccgagcgctttctggaaa

SEQ ID NO: 3920367 - DNA, 14 bp, Homo sapiens
agaccgggggccag

SEQ ID NO: 3920368 - DNA, 22 bp, Homo sapiens
agaccgtgtcccaaggagctga

SEQ ID NO: 3920369 - DNA, 16 bp, Homo sapiens
agacctagacctgggc

SEQ ID NO: 3920370 - DNA, 11 bp, Homo sapiens
agacctcagcc

SEQ ID NO: 3920371 - DNA, 18 bp, Homo sapiens
agacctcagccatgagga

SEQ ID NO: 3920372 - DNA, 11 bp, Homo sapiens
agacctctgat

SEQ ID NO: 3920373 - DNA, 17 bp, Homo sapiens
agacctgacaagcactg

SEQ ID NO: 3920374 - DNA, 19 bp, Homo sapiens
agacctgacaccgtccctc

SEQ ID NO: 3920375 - DNA, 14 bp, Homo sapiens
agacctgaggcaga

SEQ ID NO: 3920376 - DNA, 12 bp, Homo sapiens
agacctgggcca

SEQ ID NO: 3920377 - DNA, 18 bp, Homo sapiens
agacgcctttctcctcca

SEQ ID NO: 3920378 - DNA, 14 bp, Homo sapiens
agacggctggacct

SEQ ID NO: 3920379 - DNA, 19 bp, Homo sapiens
agacgtctcaagactgaaa

SEQ ID NO: 3920380 - DNA, 17 bp, Homo sapiens
agacgtgaatgtctcag

SEQ ID NO: 3920381 - DNA, 13 bp, Homo sapiens
agactaaatgaaa

SEQ ID NO: 3920382 - DNA, 17 bp, Homo sapiens
agactaattaaaatctg

SEQ ID NO: 3920383 - DNA, 14 bp, Homo sapiens
agactatatacatg

SEQ ID NO: 3920384 - DNA, 17 bp, Homo sapiens
agactatatacatgtgt

SEQ ID NO: 3920385 - DNA, 20 bp, Homo sapiens
agactatatacatgtgtgta

SEQ ID NO: 3920386 - DNA, 14 bp, Homo sapiens
agactattcaaaca

SEQ ID NO: 3920387 - DNA, 18 bp, Homo sapiens
agactatttaacttgagg

SEQ ID NO: 3920388 - DNA, 13 bp, Homo sapiens
agactccaaagaa

SEQ ID NO: 3920389 - DNA, 19 bp, Homo sapiens
agactccaaagaaatgtaa

SEQ ID NO: 3920390 - DNA, 15 bp, Homo sapiens
agactccctcccctg

SEQ ID NO: 3920391 - DNA, 14 bp, Homo sapiens
agactcctgccctg

SEQ ID NO: 3920392 - DNA, 15 bp, Homo sapiens
agactcctgcttctt

SEQ ID NO: 3920393 - DNA, 15 bp, Homo sapiens
agactcctttcctct

SEQ ID NO: 3920394 - DNA, 16 bp, Homo sapiens
agactcctttcctctg

SEQ ID NO: 3920395 - DNA, 17 bp, Homo sapiens
agactcctttcctctga

SEQ ID NO: 3920396 - DNA, 21 bp, Homo sapiens
agactgaaagcagcagctagg

SEQ ID NO: 3920397 - DNA, 22 bp, Homo sapiens
agactgaattttaaatgttcac

SEQ ID NO: 3920398 - DNA, 19 bp, Homo sapiens
agactgagaggcagaagtc

SEQ ID NO: 3920399 - DNA, 15 bp, Homo sapiens
agactgagggagaga

SEQ ID NO: 3920400 - DNA, 19 bp, Homo sapiens
agactgcaagaggctcctg

SEQ ID NO: 3920401 - DNA, 12 bp, Homo sapiens
agactgcagctg

SEQ ID NO: 3920402 - DNA, 14 bp, Homo sapiens
agactggagcatct

SEQ ID NO: 3920403 - DNA, 23 bp, Homo sapiens
agactggagtgaggcttccaggc

SEQ ID NO: 3920404 - DNA, 14 bp, Homo sapiens
agactggcacagtt

SEQ ID NO: 3920405 - DNA, 18 bp, Homo sapiens
agactggcacagttttct

SEQ ID NO: 3920406 - DNA, 20 bp, Homo sapiens
agactggcacagttttctga

SEQ ID NO: 3920407 - DNA, 21 bp, Homo sapiens
agactggcacagttttctgag

SEQ ID NO: 3920408 - DNA, 16 bp, Homo sapiens
agactgggctagggag

SEQ ID NO: 3920409 - DNA, 17 bp, Homo sapiens
agactgggtgaaagtga

SEQ ID NO: 3920410 - DNA, 18 bp, Homo sapiens
agactggtcctgtgtgca

SEQ ID NO: 3920411 - DNA, 17 bp, Homo sapiens
agactgttaaatgaaac

SEQ ID NO: 3920412 - DNA, 21 bp, Homo sapiens
agacttcacactgcaagagcc

SEQ ID NO: 3920413 - DNA, 21 bp, Homo sapiens
agacttccaaacctgacagat

SEQ ID NO: 3920414 - DNA, 20 bp, Homo sapiens
agacttcgactcaggatcca

SEQ ID NO: 3920415 - DNA, 15 bp, Homo sapiens
agacttctggaaggc

SEQ ID NO: 3920416 - DNA, 16 bp, Homo sapiens
agacttctggaaggct

SEQ ID NO: 3920417 - DNA, 22 bp, Homo sapiens
agacttctggaaggctggctga

SEQ ID NO: 3920418 - DNA, 15 bp, Homo sapiens
agacttgaagcacag

SEQ ID NO: 3920419 - DNA, 17 bp, Homo sapiens
agacttggcaacagaag

SEQ ID NO: 3920420 - DNA, 17 bp, Homo sapiens
agacttggggaccagag

SEQ ID NO: 3920421 - DNA, 14 bp, Homo sapiens
agactttctcagtg

SEQ ID NO: 3920422 - DNA, 12 bp, Homo sapiens
agactttctgtt

SEQ ID NO: 3920423 - DNA, 21 bp, Homo sapiens
agagaaaaaaagtttgccaga

SEQ ID NO: 3920424 - DNA, 20 bp, Homo sapiens
agagaaaaagaaatgcaaaa

SEQ ID NO: 3920425 - DNA, 17 bp, Homo sapiens
agagaaaaagtgcccct

SEQ ID NO: 3920426 - DNA, 19 bp, Homo sapiens
agagaaaacttatttgagt

SEQ ID NO: 3920427 - DNA, 15 bp, Homo sapiens
agagaaagaagagac

SEQ ID NO: 3920428 - DNA, 16 bp, Homo sapiens
agagaaagaagagaca

SEQ ID NO: 3920429 - DNA, 17 bp, Homo sapiens
agagaaagaagagacag

SEQ ID NO: 3920430 - DNA, 14 bp, Homo sapiens
agagaaatctgaaa

SEQ ID NO: 3920431 - DNA, 15 bp, Homo sapiens
agagaaatgtgaagg

SEQ ID NO: 3920432 - DNA, 18 bp, Homo sapiens
agagaaatgtgaagggtg

SEQ ID NO: 3920433 - DNA, 17 bp, Homo sapiens
agagaagccacgctgtc

SEQ ID NO: 3920434 - DNA, 17 bp, Homo sapiens
agagaagctgagaagaa

SEQ ID NO: 3920435 - DNA, 13 bp, Homo sapiens
agagaagggaagc

SEQ ID NO: 3920436 - DNA, 20 bp, Homo sapiens
agagaagggaagcctcttca

SEQ ID NO: 3920437 - DNA, 22 bp, Homo sapiens
agagaagggggattggagggaa

SEQ ID NO: 3920438 - DNA, 19 bp, Homo sapiens
agagaatcacacaagtttg

SEQ ID NO: 3920439 - DNA, 22 bp, Homo sapiens
agagaatttctaccatttcaga

SEQ ID NO: 3920440 - DNA, 14 bp, Homo sapiens
agagacacctgcac

SEQ ID NO: 3920441 - DNA, 18 bp, Homo sapiens
agagacacctgcacctcc

SEQ ID NO: 3920442 - DNA, 20 bp, Homo sapiens
agagacacctgcacctcccc

SEQ ID NO: 3920443 - DNA, 22 bp, Homo sapiens
agagacacctgcacctcccccc

SEQ ID NO: 3920444 - DNA, 16 bp, Homo sapiens
agagacagagccccca

SEQ ID NO: 3920445 - DNA, 19 bp, Homo sapiens
agagacagagcccccaagc

SEQ ID NO: 3920446 - DNA, 21 bp, Homo sapiens
agagacaggaaaatcctctgg

SEQ ID NO: 3920447 - DNA, 23 bp, Homo sapiens
agagacaggaaaatcctctggct

SEQ ID NO: 3920448 - DNA, 15 bp, Homo sapiens
agagacaggcccaag

SEQ ID NO: 3920449 - DNA, 18 bp, Homo sapiens
agagacaggcccaagaga

SEQ ID NO: 3920450 - DNA, 14 bp, Homo sapiens
agagacccaaggag

SEQ ID NO: 3920451 - DNA, 21 bp, Homo sapiens
agagaccccttcctttcctct

SEQ ID NO: 3920452 - DNA, 23 bp, Homo sapiens
agagaccttttctctcccatacc

SEQ ID NO: 3920453 - DNA, 16 bp, Homo sapiens
agagacgcaagggaga

SEQ ID NO: 3920454 - DNA, 14 bp, Homo sapiens
agagacgtgtacat

SEQ ID NO: 3920455 - DNA, 18 bp, Homo sapiens
agagactatggagcctgg

SEQ ID NO: 3920456 - DNA, 21 bp, Homo sapiens
agagactccaagattcaaaga

SEQ ID NO: 3920457 - DNA, 14 bp, Homo sapiens
agagactctggaag

SEQ ID NO: 3920458 - DNA, 21 bp, Homo sapiens
agagactctggaagcccccca

SEQ ID NO: 3920459 - DNA, 17 bp, Homo sapiens
agagactgaaagcagca

SEQ ID NO: 3920460 - DNA, 14 bp, Homo sapiens
agagactggagcat

SEQ ID NO: 3920461 - DNA, 16 bp, Homo sapiens
agagacttggggacca

SEQ ID NO: 3920462 - DNA, 16 bp, Homo sapiens
agagacttttaatcag

SEQ ID NO: 3920463 - DNA, 17 bp, Homo sapiens
agagacttttaatcaga

SEQ ID NO: 3920464 - DNA, 19 bp, Homo sapiens
agagacttttaatcagaca

SEQ ID NO: 3920465 - DNA, 12 bp, Homo sapiens
agagagaaatct

SEQ ID NO: 3920466 - DNA, 11 bp, Homo sapiens
agagagaagcc

SEQ ID NO: 3920467 - DNA, 18 bp, Homo sapiens
agagagacattgcctcca

SEQ ID NO: 3920468 - DNA, 17 bp, Homo sapiens
agagagactgagggaga

SEQ ID NO: 3920469 - DNA, 14 bp, Homo sapiens
agagagagagaggt

SEQ ID NO: 3920470 - DNA, 12 bp, Homo sapiens
agagagagaggt

SEQ ID NO: 3920471 - DNA, 23 bp, Homo sapiens
agagagagggcctgctggagagc

SEQ ID NO: 3920472 - DNA, 16 bp, Homo sapiens
agagagcagaaataaa

SEQ ID NO: 3920473 - DNA, 15 bp, Homo sapiens
agagagccctggtcc

SEQ ID NO: 3920474 - DNA, 14 bp, Homo sapiens
agagaggaatcaga

SEQ ID NO: 3920475 - DNA, 15 bp, Homo sapiens
agagaggcacctgct

SEQ ID NO: 3920476 - DNA, 19 bp, Homo sapiens
agagaggcacctgctggaa

SEQ ID NO: 3920477 - DNA, 14 bp, Homo sapiens
agagaggccttttg

SEQ ID NO: 3920478 - DNA, 20 bp, Homo sapiens
agagaggcgcgtctgcccca

SEQ ID NO: 3920479 - DNA, 15 bp, Homo sapiens
agagagggcaagtgt

SEQ ID NO: 3920480 - DNA, 13 bp, Homo sapiens
agagagggcccag

SEQ ID NO: 3920481 - DNA, 15 bp, Homo sapiens
agagagggcccagct

SEQ ID NO: 3920482 - DNA, 16 bp, Homo sapiens
agagaggtagcgagct

SEQ ID NO: 3920483 - DNA, 19 bp, Homo sapiens
agagaggtagcgagctgct

SEQ ID NO: 3920484 - DNA, 18 bp, Homo sapiens
agagaggttctggggagg

SEQ ID NO: 3920485 - DNA, 24 bp, Homo sapiens
agagaggttctggggaggaagggc

SEQ ID NO: 3920486 - DNA, 16 bp, Homo sapiens
agagagtcctctggat

SEQ ID NO: 3920487 - DNA, 19 bp, Homo sapiens
agagatcaggaagagaagg

SEQ ID NO: 3920488 - DNA, 20 bp, Homo sapiens
agagatcaggaagagaagga

SEQ ID NO: 3920489 - DNA, 16 bp, Homo sapiens
agagatccaggaagca

SEQ ID NO: 3920490 - DNA, 14 bp, Homo sapiens
agagatgactgaaa

SEQ ID NO: 3920491 - DNA, 16 bp, Homo sapiens
agagatgcatgcgcag

SEQ ID NO: 3920492 - DNA, 16 bp, Homo sapiens
agagatgcctccaccg

SEQ ID NO: 3920493 - DNA, 19 bp, Homo sapiens
agagatgtggcaaagtgct

SEQ ID NO: 3920494 - DNA, 20 bp, Homo sapiens
agagattttgtcgggacaga

SEQ ID NO: 3920495 - DNA, 22 bp, Homo sapiens
agagcaacccctgtacccagct

SEQ ID NO: 3920496 - DNA, 13 bp, Homo sapiens
agagcagaaataa

SEQ ID NO: 3920497 - DNA, 19 bp, Homo sapiens
agagcagcctgatggccaa

SEQ ID NO: 3920498 - DNA, 21 bp, Homo sapiens
agagcagcctgatggccaagg

SEQ ID NO: 3920499 - DNA, 18 bp, Homo sapiens
agagcagctggctctcca

SEQ ID NO: 3920500 - DNA, 12 bp, Homo sapiens
agagcaggcaca

SEQ ID NO: 3920501 - DNA, 13 bp, Homo sapiens
agagcaggcacat

SEQ ID NO: 3920502 - DNA, 18 bp, Homo sapiens
agagcaggcacatggagg

SEQ ID NO: 3920503 - DNA, 19 bp, Homo sapiens
agagcaggcacatggagga

SEQ ID NO: 3920504 - DNA, 20 bp, Homo sapiens
agagcaggccacgctcaggc

SEQ ID NO: 3920505 - DNA, 16 bp, Homo sapiens
agagcatcatgcctct

SEQ ID NO: 3920506 - DNA, 17 bp, Homo sapiens
agagcatcatgcctctg

SEQ ID NO: 3920507 - DNA, 19 bp, Homo sapiens
agagcatcatgcctctgag

SEQ ID NO: 3920508 - DNA, 22 bp, Homo sapiens
agagcatcgtgacccttcaggg

SEQ ID NO: 3920509 - DNA, 16 bp, Homo sapiens
agagccagcctgggac

SEQ ID NO: 3920510 - DNA, 18 bp, Homo sapiens
agagccagctctctctac

SEQ ID NO: 3920511 - DNA, 14 bp, Homo sapiens
agagccaggctctg

SEQ ID NO: 3920512 - DNA, 15 bp, Homo sapiens
agagccatgggcctg

SEQ ID NO: 3920513 - DNA, 18 bp, Homo sapiens
agagccatgggcctgggc

SEQ ID NO: 3920514 - DNA, 14 bp, Homo sapiens
agagcccaagtgcc

SEQ ID NO: 3920515 - DNA, 14 bp, Homo sapiens
agagccccacacgg

SEQ ID NO: 3920516 - DNA, 13 bp, Homo sapiens
agagcccccaagc

SEQ ID NO: 3920517 - DNA, 15 bp, Homo sapiens
agagcccccaagcct

SEQ ID NO: 3920518 - DNA, 18 bp, Homo sapiens
agagcccccaagcctctg

SEQ ID NO: 3920519 - DNA, 21 bp, Homo sapiens
agagcccccaagcctctgccc

SEQ ID NO: 3920520 - DNA, 14 bp, Homo sapiens
agagccccccacaa

SEQ ID NO: 3920521 - DNA, 13 bp, Homo sapiens
agagccctgctgt

SEQ ID NO: 3920522 - DNA, 16 bp, Homo sapiens
agagccctgctgtggg

SEQ ID NO: 3920523 - DNA, 15 bp, Homo sapiens
agagccctgggaccg

SEQ ID NO: 3920524 - DNA, 17 bp, Homo sapiens
agagccctgggaccgct

SEQ ID NO: 3920525 - DNA, 18 bp, Homo sapiens
agagcctaagaaaatcat

SEQ ID NO: 3920526 - DNA, 18 bp, Homo sapiens
agagcctagccacctccc

SEQ ID NO: 3920527 - DNA, 13 bp, Homo sapiens
agagcctcttagt

SEQ ID NO: 3920528 - DNA, 18 bp, Homo sapiens
agagcctgctcccccacc

SEQ ID NO: 3920529 - DNA, 13 bp, Homo sapiens
agagcctggagaa

SEQ ID NO: 3920530 - DNA, 17 bp, Homo sapiens
agagcctggagaagctg

SEQ ID NO: 3920531 - DNA, 18 bp, Homo sapiens
agagcctggggtgttctc

SEQ ID NO: 3920532 - DNA, 22 bp, Homo sapiens
agagccttggtgtccacctggc

SEQ ID NO: 3920533 - DNA, 21 bp, Homo sapiens
agagcctttggatgaccagaa

SEQ ID NO: 3920534 - DNA, 14 bp, Homo sapiens
agagcgggagtgac

SEQ ID NO: 3920535 - DNA, 18 bp, Homo sapiens
agagcgggcctcttccct

SEQ ID NO: 3920536 - DNA, 21 bp, Homo sapiens
agagcgggcctcttccctcag

SEQ ID NO: 3920537 - DNA, 14 bp, Homo sapiens
agagcggggaggtg

SEQ ID NO: 3920538 - DNA, 18 bp, Homo sapiens
agagcggggaggtgcctg

SEQ ID NO: 3920539 - DNA, 18 bp, Homo sapiens
agagctagaacatggaga

SEQ ID NO: 3920540 - DNA, 22 bp, Homo sapiens
agagctagaacatggagagcta

SEQ ID NO: 3920541 - DNA, 18 bp, Homo sapiens
agagctagaacctggaga

SEQ ID NO: 3920542 - DNA, 22 bp, Homo sapiens
agagctagaacctggagaacta

SEQ ID NO: 3920543 - DNA, 18 bp, Homo sapiens
agagctaggagcaaagcc

SEQ ID NO: 3920544 - DNA, 19 bp, Homo sapiens
agagctaggagcaaagcct

SEQ ID NO: 3920545 - DNA, 17 bp, Homo sapiens
agagctatgttccctcc

SEQ ID NO: 3920546 - DNA, 16 bp, Homo sapiens
agagctcctgtcccta

SEQ ID NO: 3920547 - DNA, 19 bp, Homo sapiens
agagctcctgtccctaccc

SEQ ID NO: 3920548 - DNA, 15 bp, Homo sapiens
agagctcttaatgtt

SEQ ID NO: 3920549 - DNA, 16 bp, Homo sapiens
agagctgatggagaag

SEQ ID NO: 3920550 - DNA, 17 bp, Homo sapiens
agagctgatggagaagg

SEQ ID NO: 3920551 - DNA, 21 bp, Homo sapiens
agagctgatggagaaggaagg

SEQ ID NO: 3920552 - DNA, 15 bp, Homo sapiens
agagctgctctggaa

SEQ ID NO: 3920553 - DNA, 14 bp, Homo sapiens
agagctggaaggca

SEQ ID NO: 3920554 - DNA, 15 bp, Homo sapiens
agagctggaaggcag

SEQ ID NO: 3920555 - DNA, 20 bp, Homo sapiens
agagctggaaggcagggcag

SEQ ID NO: 3920556 - DNA, 22 bp, Homo sapiens
agagctggaaggcagggcagag

SEQ ID NO: 3920557 - DNA, 15 bp, Homo sapiens
agagctgggaaacag

SEQ ID NO: 3920558 - DNA, 21 bp, Homo sapiens
agagctgggaaacagggagcc

SEQ ID NO: 3920559 - DNA, 19 bp, Homo sapiens
agagctgttcacagccaga

SEQ ID NO: 3920560 - DNA, 15 bp, Homo sapiens
agagcttagcctgga

SEQ ID NO: 3920561 - DNA, 21 bp, Homo sapiens
agagcttggacagtctgagct

SEQ ID NO: 3920562 - DNA, 19 bp, Homo sapiens
agagcttggtggctgagct

SEQ ID NO: 3920563 - DNA, 16 bp, Homo sapiens
agagctttctttcaca

SEQ ID NO: 3920564 - DNA, 22 bp, Homo sapiens
agaggaaaaacgatcgctgtga

SEQ ID NO: 3920565 - DNA, 18 bp, Homo sapiens
agaggaagatgaagagaa

SEQ ID NO: 3920566 - DNA, 14 bp, Homo sapiens
agaggaagcaagaa

SEQ ID NO: 3920567 - DNA, 14 bp, Homo sapiens
agaggaccacagtg

SEQ ID NO: 3920568 - DNA, 19 bp, Homo sapiens
agaggaccacagtgggtgg

SEQ ID NO: 3920569 - DNA, 14 bp, Homo sapiens
agaggagaaactga

SEQ ID NO: 3920570 - DNA, 15 bp, Homo sapiens
agaggagaagagaca

SEQ ID NO: 3920571 - DNA, 13 bp, Homo sapiens
agaggagaccctg

SEQ ID NO: 3920572 - DNA, 14 bp, Homo sapiens
agaggagaccctgg

SEQ ID NO: 3920573 - DNA, 14 bp, Homo sapiens
agaggagcacctga

SEQ ID NO: 3920574 - DNA, 16 bp, Homo sapiens
agaggagcacctgaac

SEQ ID NO: 3920575 - DNA, 21 bp, Homo sapiens
agaggagggcgtgactcaccc

SEQ ID NO: 3920576 - DNA, 19 bp, Homo sapiens
agaggagtccagggcggga

SEQ ID NO: 3920577 - DNA, 16 bp, Homo sapiens
agaggagtgactgagc

SEQ ID NO: 3920578 - DNA, 20 bp, Homo sapiens
agaggcaagagacagaatga

SEQ ID NO: 3920579 - DNA, 13 bp, Homo sapiens
agaggcacctgct

SEQ ID NO: 3920580 - DNA, 15 bp, Homo sapiens
agaggcacctgctgg

SEQ ID NO: 3920581 - DNA, 19 bp, Homo sapiens
agaggcagaagtcagcccg

SEQ ID NO: 3920582 - DNA, 17 bp, Homo sapiens
agaggcagggaggggac

SEQ ID NO: 3920583 - DNA, 13 bp, Homo sapiens
agaggcagtgaga

SEQ ID NO: 3920584 - DNA, 22 bp, Homo sapiens
agaggcccagggagcaatggga

SEQ ID NO: 3920585 - DNA, 13 bp, Homo sapiens
agaggccctggat

SEQ ID NO: 3920586 - DNA, 24 bp, Homo sapiens
agaggccctggatcagcgtggcct

SEQ ID NO: 3920587 - DNA, 12 bp, Homo sapiens
agaggcctcagt

SEQ ID NO: 3920588 - DNA, 16 bp, Homo sapiens
agaggcggaaaccttg

SEQ ID NO: 3920589 - DNA, 16 bp, Homo sapiens
agaggctaagatgaga

SEQ ID NO: 3920590 - DNA, 15 bp, Homo sapiens
agaggctatttaaaa

SEQ ID NO: 3920591 - DNA, 16 bp, Homo sapiens
agaggctggaggcagg

SEQ ID NO: 3920592 - DNA, 19 bp, Homo sapiens
agaggctggaggcagggcc

SEQ ID NO: 3920593 - DNA, 20 bp, Homo sapiens
agaggctggaggcagggcct

SEQ ID NO: 3920594 - DNA, 22 bp, Homo sapiens
agaggctggaggcagggccttg

SEQ ID NO: 3920595 - DNA, 14 bp, Homo sapiens
agaggctggtgctg

SEQ ID NO: 3920596 - DNA, 21 bp, Homo sapiens
agaggcttcttcagatcagtg

SEQ ID NO: 3920597 - DNA, 21 bp, Homo sapiens
agagggaaggggcctacaccc

SEQ ID NO: 3920598 - DNA, 13 bp, Homo sapiens
agagggacagggt

SEQ ID NO: 3920599 - DNA, 14 bp, Homo sapiens
agagggcagaggct

SEQ ID NO: 3920600 - DNA, 16 bp, Homo sapiens
agagggccaagagaga

SEQ ID NO: 3920601 - DNA, 12 bp, Homo sapiens
agagggccacac

SEQ ID NO: 3920602 - DNA, 23 bp, Homo sapiens
agagggcccagctgtagccatgg

SEQ ID NO: 3920603 - DNA, 19 bp, Homo sapiens
agaggggaataatagaaga

SEQ ID NO: 3920604 - DNA, 20 bp, Homo sapiens
agaggggaataatagaagaa

SEQ ID NO: 3920605 - DNA, 20 bp, Homo sapiens
agaggggcagccgctaggag

SEQ ID NO: 3920606 - DNA, 13 bp, Homo sapiens
agaggggcctggg

SEQ ID NO: 3920607 - DNA, 15 bp, Homo sapiens
agaggggcctgggaa

SEQ ID NO: 3920608 - DNA, 14 bp, Homo sapiens
agagggggctctcc

SEQ ID NO: 3920609 - DNA, 15 bp, Homo sapiens
agagggggctctcca

SEQ ID NO: 3920610 - DNA, 22 bp, Homo sapiens
agagggtgggagcctaaggaag

SEQ ID NO: 3920611 - DNA, 19 bp, Homo sapiens
agaggtaaaagtgtgagca

SEQ ID NO: 3920612 - DNA, 21 bp, Homo sapiens
agaggtaactatcaatattta

SEQ ID NO: 3920613 - DNA, 23 bp, Homo sapiens
agaggtagcgagctgctctgcta

SEQ ID NO: 3920614 - DNA, 13 bp, Homo sapiens
agaggtccctgct

SEQ ID NO: 3920615 - DNA, 15 bp, Homo sapiens
agaggtccctgctta

SEQ ID NO: 3920616 - DNA, 14 bp, Homo sapiens
agaggtctgagccc

SEQ ID NO: 3920617 - DNA, 15 bp, Homo sapiens
agaggtctgagccct

SEQ ID NO: 3920618 - DNA, 16 bp, Homo sapiens
agaggtctgagccctg

SEQ ID NO: 3920619 - DNA, 23 bp, Homo sapiens
agaggtgaccccagggcacagga

SEQ ID NO: 3920620 - DNA, 23 bp, Homo sapiens
agaggtgagaccaaaggatccag

SEQ ID NO: 3920621 - DNA, 12 bp, Homo sapiens
agaggtgggcag

SEQ ID NO: 3920622 - DNA, 15 bp, Homo sapiens
agaggtgggcagctg

SEQ ID NO: 3920623 - DNA, 18 bp, Homo sapiens
agaggtgggcagctgggc

SEQ ID NO: 3920624 - DNA, 19 bp, Homo sapiens
agaggtgggcagctgggcc

SEQ ID NO: 3920625 - DNA, 11 bp, Homo sapiens
agaggtgggga

SEQ ID NO: 3920626 - DNA, 13 bp, Homo sapiens
agaggtggggacc

SEQ ID NO: 3920627 - DNA, 21 bp, Homo sapiens
agaggtggggagggagacaga

SEQ ID NO: 3920628 - DNA, 20 bp, Homo sapiens
agaggttaaggtgggtccag

SEQ ID NO: 3920629 - DNA, 22 bp, Homo sapiens
agaggttaaggtgggtccagga

SEQ ID NO: 3920630 - DNA, 23 bp, Homo sapiens
agaggttaaggtgggtccaggaa

SEQ ID NO: 3920631 - DNA, 17 bp, Homo sapiens
agaggttatctgcctgg

SEQ ID NO: 3920632 - DNA, 19 bp, Homo sapiens
agaggttatctgcctggcc

SEQ ID NO: 3920633 - DNA, 22 bp, Homo sapiens
agaggttatctgcctggcctgg

SEQ ID NO: 3920634 - DNA, 15 bp, Homo sapiens
agaggtttcttgaat

SEQ ID NO: 3920635 - DNA, 12 bp, Homo sapiens
agaggttttgtt

SEQ ID NO: 3920636 - DNA, 19 bp, Homo sapiens
agaggttttgttgttttat

SEQ ID NO: 3920637 - DNA, 19 bp, Homo sapiens
agagtaacatgccagcttc

SEQ ID NO: 3920638 - DNA, 16 bp, Homo sapiens
agagtacagtgagcca

SEQ ID NO: 3920639 - DNA, 18 bp, Homo sapiens
agagtagccgagagcctg

SEQ ID NO: 3920640 - DNA, 14 bp, Homo sapiens
agagtataggatgg

SEQ ID NO: 3920641 - DNA, 18 bp, Homo sapiens
agagtctgaaagacagaa

SEQ ID NO: 3920642 - DNA, 18 bp, Homo sapiens
agagtgaaataattaaaa

SEQ ID NO: 3920643 - DNA, 14 bp, Homo sapiens
agagtgagagggca

SEQ ID NO: 3920644 - DNA, 14 bp, Homo sapiens
agagtggctcctcc

SEQ ID NO: 3920645 - DNA, 19 bp, Homo sapiens
agagtgtgaaatagacatt

SEQ ID NO: 3920646 - DNA, 19 bp, Homo sapiens
agagtgtgggaagggagag

SEQ ID NO: 3920647 - DNA, 15 bp, Homo sapiens
agagttattgaatct

SEQ ID NO: 3920648 - DNA, 15 bp, Homo sapiens
agagttggctcaggc

SEQ ID NO: 3920649 - DNA, 15 bp, Homo sapiens
agagtttaacacaag

SEQ ID NO: 3920650 - DNA, 22 bp, Homo sapiens
agagtttaacacaagtcctgtg

SEQ ID NO: 3920651 - DNA, 15 bp, Homo sapiens
agataaagatgatct

SEQ ID NO: 3920652 - DNA, 21 bp, Homo sapiens
agataaccagctgtaacacag

SEQ ID NO: 3920653 - DNA, 16 bp, Homo sapiens
agataatcagcctctt

SEQ ID NO: 3920654 - DNA, 17 bp, Homo sapiens
agataatcagcctctta

SEQ ID NO: 3920655 - DNA, 16 bp, Homo sapiens
agataatctagaacac

SEQ ID NO: 3920656 - DNA, 17 bp, Homo sapiens
agataatgttctttaat

SEQ ID NO: 3920657 - DNA, 20 bp, Homo sapiens
agataatgttctttaatgtt

SEQ ID NO: 3920658 - DNA, 13 bp, Homo sapiens
agatacactcctg

SEQ ID NO: 3920659 - DNA, 19 bp, Homo sapiens
agatacattccctatcaaa

SEQ ID NO: 3920660 - DNA, 22 bp, Homo sapiens
agatacattccctatcaaaaca

SEQ ID NO: 3920661 - DNA, 17 bp, Homo sapiens
agatactttgctagccg

SEQ ID NO: 3920662 - DNA, 13 bp, Homo sapiens
agatagaatttcc

SEQ ID NO: 3920663 - DNA, 16 bp, Homo sapiens
agatagaatttccaat

SEQ ID NO: 3920664 - DNA, 15 bp, Homo sapiens
agatataaatggctg

SEQ ID NO: 3920665 - DNA, 22 bp, Homo sapiens
agatatatatttactaaaagaa

SEQ ID NO: 3920666 - DNA, 15 bp, Homo sapiens
agatatattttgagt

SEQ ID NO: 3920667 - DNA, 16 bp, Homo sapiens
agatatatttttcaca

SEQ ID NO: 3920668 - DNA, 15 bp, Homo sapiens
agatatcacttactc

SEQ ID NO: 3920669 - DNA, 15 bp, Homo sapiens
agatatcagagctct

SEQ ID NO: 3920670 - DNA, 18 bp, Homo sapiens
agatatcagagctcttaa

SEQ ID NO: 3920671 - DNA, 19 bp, Homo sapiens
agatatcagagctcttaat

SEQ ID NO: 3920672 - DNA, 16 bp, Homo sapiens
agatatgatatgtaaa

SEQ ID NO: 3920673 - DNA, 13 bp, Homo sapiens
agatatgcaaaag

SEQ ID NO: 3920674 - DNA, 17 bp, Homo sapiens
agatatggcagcgaaag

SEQ ID NO: 3920675 - DNA, 14 bp, Homo sapiens
agatattgcactag

SEQ ID NO: 3920676 - DNA, 22 bp, Homo sapiens
agatattgtcagagttctgctc

SEQ ID NO: 3920677 - DNA, 23 bp, Homo sapiens
agatatttacatgaattgcattt

SEQ ID NO: 3920678 - DNA, 14 bp, Homo sapiens
agatatttatatat

SEQ ID NO: 3920679 - DNA, 14 bp, Homo sapiens
agatatttttgtac

SEQ ID NO: 3920680 - DNA, 18 bp, Homo sapiens
agatattttttcagaaat

SEQ ID NO: 3920681 - DNA, 14 bp, Homo sapiens
agatcaatttgtaa

SEQ ID NO: 3920682 - DNA, 15 bp, Homo sapiens
agatcaccagcccgg

SEQ ID NO: 3920683 - DNA, 21 bp, Homo sapiens
agatcaccagcccggcctgct

SEQ ID NO: 3920684 - DNA, 18 bp, Homo sapiens
agatccacacacagagga

SEQ ID NO: 3920685 - DNA, 19 bp, Homo sapiens
agatcccatccatcagctc

SEQ ID NO: 3920686 - DNA, 21 bp, Homo sapiens
agatcccatccatcagctccc

SEQ ID NO: 3920687 - DNA, 22 bp, Homo sapiens
agatcccatccatcagctccct

SEQ ID NO: 3920688 - DNA, 13 bp, Homo sapiens
agatcccatctct

SEQ ID NO: 3920689 - DNA, 23 bp, Homo sapiens
agatcccatgtcacctcagctga

SEQ ID NO: 3920690 - DNA, 17 bp, Homo sapiens
agatcctaactgagaat

SEQ ID NO: 3920691 - DNA, 16 bp, Homo sapiens
agatcctctgctgact

SEQ ID NO: 3920692 - DNA, 20 bp, Homo sapiens
agatcctttaaatccttcca

SEQ ID NO: 3920693 - DNA, 20 bp, Homo sapiens
agatcgagaccatcctggct

SEQ ID NO: 3920694 - DNA, 12 bp, Homo sapiens
agatcgtattaa

SEQ ID NO: 3920695 - DNA, 19 bp, Homo sapiens
agatcgtattaattatctg

SEQ ID NO: 3920696 - DNA, 22 bp, Homo sapiens
agatcgtgccgttactctccaa

SEQ ID NO: 3920697 - DNA, 13 bp, Homo sapiens
agatctagaaagt

SEQ ID NO: 3920698 - DNA, 17 bp, Homo sapiens
agatctccctccaggga

SEQ ID NO: 3920699 - DNA, 18 bp, Homo sapiens
agatctcctatttttcag

SEQ ID NO: 3920700 - DNA, 20 bp, Homo sapiens
agatctcctatttttcagaa

SEQ ID NO: 3920701 - DNA, 16 bp, Homo sapiens
agatctgaaaggcaca

SEQ ID NO: 3920702 - DNA, 16 bp, Homo sapiens
agatctgcctgggcct

SEQ ID NO: 3920703 - DNA, 19 bp, Homo sapiens
agatctgcctgggcctgtg

SEQ ID NO: 3920704 - DNA, 20 bp, Homo sapiens
agatctgcctgggcctgtgc

SEQ ID NO: 3920705 - DNA, 24 bp, Homo sapiens
agatctgcctgggcctgtgcagca

SEQ ID NO: 3920706 - DNA, 17 bp, Homo sapiens
agatcttacatctgcag

SEQ ID NO: 3920707 - DNA, 19 bp, Homo sapiens
agatcttcaaacagaataa

SEQ ID NO: 3920708 - DNA, 13 bp, Homo sapiens
agatgaaagagga

SEQ ID NO: 3920709 - DNA, 17 bp, Homo sapiens
agatgaagagtgagagg

SEQ ID NO: 3920710 - DNA, 20 bp, Homo sapiens
agatgaagagtgagagggca

SEQ ID NO: 3920711 - DNA, 14 bp, Homo sapiens
agatgacttgaggc

SEQ ID NO: 3920712 - DNA, 15 bp, Homo sapiens
agatgagaggcagag

SEQ ID NO: 3920713 - DNA, 18 bp, Homo sapiens
agatgagatttgccagca

SEQ ID NO: 3920714 - DNA, 20 bp, Homo sapiens
agatgagatttgccagcaca

SEQ ID NO: 3920715 - DNA, 16 bp, Homo sapiens
agatgagggtgactgt

SEQ ID NO: 3920716 - DNA, 17 bp, Homo sapiens
agatgagggtgactgtc

SEQ ID NO: 3920717 - DNA, 19 bp, Homo sapiens
agatgataaatatttatgc

SEQ ID NO: 3920718 - DNA, 16 bp, Homo sapiens
agatgatctactcaga

SEQ ID NO: 3920719 - DNA, 12 bp, Homo sapiens
agatgatgatga

SEQ ID NO: 3920720 - DNA, 19 bp, Homo sapiens
agatgcacacacagatgca

SEQ ID NO: 3920721 - DNA, 22 bp, Homo sapiens
agatgcacacacagatgcacac

SEQ ID NO: 3920722 - DNA, 18 bp, Homo sapiens
agatgccattcatagaga

SEQ ID NO: 3920723 - DNA, 11 bp, Homo sapiens
agatgccctga

SEQ ID NO: 3920724 - DNA, 12 bp, Homo sapiens
agatgcctccac

SEQ ID NO: 3920725 - DNA, 21 bp, Homo sapiens
agatgccttcctgtctttctg

SEQ ID NO: 3920726 - DNA, 21 bp, Homo sapiens
agatggaatagaaaagatgag

SEQ ID NO: 3920727 - DNA, 22 bp, Homo sapiens
agatggaatagaaaagatgaga

SEQ ID NO: 3920728 - DNA, 19 bp, Homo sapiens
agatggaccagtagacaac

SEQ ID NO: 3920729 - DNA, 21 bp, Homo sapiens
agatggacccctcccttgctc

SEQ ID NO: 3920730 - DNA, 22 bp, Homo sapiens
agatggctgactttgctctttc

SEQ ID NO: 3920731 - DNA, 20 bp, Homo sapiens
agatggctgtgcctctgcct

SEQ ID NO: 3920732 - DNA, 14 bp, Homo sapiens
agatgggcacatga

SEQ ID NO: 3920733 - DNA, 18 bp, Homo sapiens
agatgggcacatgaggag

SEQ ID NO: 3920734 - DNA, 19 bp, Homo sapiens
agatgggcacatgaggagg

SEQ ID NO: 3920735 - DNA, 22 bp, Homo sapiens
agatgggcacatgaggagggtg

SEQ ID NO: 3920736 - DNA, 15 bp, Homo sapiens
agatggtagcagata

SEQ ID NO: 3920737 - DNA, 22 bp, Homo sapiens
agatggtagcagataaagacag

SEQ ID NO: 3920738 - DNA, 23 bp, Homo sapiens
agatggtagcagataaagacagc

SEQ ID NO: 3920739 - DNA, 14 bp, Homo sapiens
agatggtcagtgtg

SEQ ID NO: 3920740 - DNA, 15 bp, Homo sapiens
agatgtaggagggac

SEQ ID NO: 3920741 - DNA, 13 bp, Homo sapiens
agatgtcaaatat

SEQ ID NO: 3920742 - DNA, 17 bp, Homo sapiens
agcacctagcctcgctc

SEQ ID NO: 3920743 - DNA, 11 bp, Homo sapiens
agcacctgccg

SEQ ID NO: 3920744 - DNA, 19 bp, Homo sapiens
agcacctgccgacctcgtc

SEQ ID NO: 3920745 - DNA, 13 bp, Homo sapiens
agcacctgttttt

SEQ ID NO: 3920746 - DNA, 13 bp, Homo sapiens
agcaccttaatat

SEQ ID NO: 3920747 - DNA, 20 bp, Homo sapiens
agcaccttaatattattggg

SEQ ID NO: 3920748 - DNA, 17 bp, Homo sapiens
agcactcagaaaagaaa

SEQ ID NO: 3920749 - DNA, 22 bp, Homo sapiens
agcactcagaaaagaaaaccat

SEQ ID NO: 3920750 - DNA, 21 bp, Homo sapiens
agcactcccttaggcattatt

SEQ ID NO: 3920751 - DNA, 21 bp, Homo sapiens
agcactcctcggtactcccat

SEQ ID NO: 3920752 - DNA, 19 bp, Homo sapiens
agcactcgagaccatcctg

SEQ ID NO: 3920753 - DNA, 11 bp, Homo sapiens
agcactgaaaa

SEQ ID NO: 3920754 - DNA, 17 bp, Homo sapiens
agcactgacttctaagt

SEQ ID NO: 3920755 - DNA, 15 bp, Homo sapiens
agcactgcagatagc

SEQ ID NO: 3920756 - DNA, 21 bp, Homo sapiens
agcactgcagatagccagaca

SEQ ID NO: 3920757 - DNA, 22 bp, Homo sapiens
agcactgcagatagccagacac

SEQ ID NO: 3920758 - DNA, 23 bp, Homo sapiens
agcactgcagatagccagacaca

SEQ ID NO: 3920759 - DNA, 13 bp, Homo sapiens
agcactgccagga

SEQ ID NO: 3920760 - DNA, 21 bp, Homo sapiens
agcactgctaggcgagtgcca

SEQ ID NO: 3920761 - DNA, 23 bp, Homo sapiens
agcactgctaggcgagtgccagg

SEQ ID NO: 3920762 - DNA, 20 bp, Homo sapiens
agcactggagtgcagggagg

SEQ ID NO: 3920763 - DNA, 12 bp, Homo sapiens
agcactggccag

SEQ ID NO: 3920764 - DNA, 16 bp, Homo sapiens
agcactggccagagag

SEQ ID NO: 3920765 - DNA, 17 bp, Homo sapiens
agcactggccagagagg

SEQ ID NO: 3920766 - DNA, 23 bp, Homo sapiens
agcactggccagagagggcccag

SEQ ID NO: 3920767 - DNA, 21 bp, Homo sapiens
agcacttctttcctctccaat

SEQ ID NO: 3920768 - DNA, 23 bp, Homo sapiens
agcacttgaccttttcgacgctt

SEQ ID NO: 3920769 - DNA, 18 bp, Homo sapiens
agcacttgcgtcctgcag

SEQ ID NO: 3920770 - DNA, 18 bp, Homo sapiens
agcacttgttccttctgc

SEQ ID NO: 3920771 - DNA, 18 bp, Homo sapiens
agcactttaaccctctct

SEQ ID NO: 3920772 - DNA, 21 bp, Homo sapiens
agcactttgggaggccaaggt

SEQ ID NO: 3920773 - DNA, 22 bp, Homo sapiens
agcactttgggaggccaaggtg

SEQ ID NO: 3920774 - DNA, 14 bp, Homo sapiens
agcagaaaagtgct

SEQ ID NO: 3920775 - DNA, 17 bp, Homo sapiens
agcagaaaagtgcttag

SEQ ID NO: 3920776 - DNA, 20 bp, Homo sapiens
agcagaaaagtgcttagaaa

SEQ ID NO: 3920777 - DNA, 21 bp, Homo sapiens
agcagaaaagtgcttagaaag

SEQ ID NO: 3920778 - DNA, 18 bp, Homo sapiens
agcagaaaccaagtctac

SEQ ID NO: 3920779 - DNA, 18 bp, Homo sapiens
agcagaaaggcacgtcca

SEQ ID NO: 3920780 - DNA, 21 bp, Homo sapiens
agcagaacggagccccaggcc

SEQ ID NO: 3920781 - DNA, 22 bp, Homo sapiens
agcagagctgatggagaaggaa

SEQ ID NO: 3920782 - DNA, 19 bp, Homo sapiens
agcagagggcctaggagga

SEQ ID NO: 3920783 - DNA, 19 bp, Homo sapiens
agcagagttattgaatctt

SEQ ID NO: 3920784 - DNA, 14 bp, Homo sapiens
agcagataaagaca

SEQ ID NO: 3920785 - DNA, 15 bp, Homo sapiens
agcagataaagacag

SEQ ID NO: 3920786 - DNA, 15 bp, Homo sapiens
agcagatggaaagaa

SEQ ID NO: 3920787 - DNA, 18 bp, Homo sapiens
agcagatttaacaattcc

SEQ ID NO: 3920788 - DNA, 16 bp, Homo sapiens
agcagcaaaaatataa

SEQ ID NO: 3920789 - DNA, 20 bp, Homo sapiens
agcagcacgattttgcacaa

SEQ ID NO: 3920790 - DNA, 14 bp, Homo sapiens
agcagcactgcaga

SEQ ID NO: 3920791 - DNA, 22 bp, Homo sapiens
agcagcagctaggactgaggag

SEQ ID NO: 3920792 - DNA, 13 bp, Homo sapiens
agcagcagtgagc

SEQ ID NO: 3920793 - DNA, 15 bp, Homo sapiens
agcagcattcagcac

SEQ ID NO: 3920794 - DNA, 18 bp, Homo sapiens
agcagcattcagcacacc

SEQ ID NO: 3920795 - DNA, 10 bp, Homo sapiens
agcagccagc

SEQ ID NO: 3920796 - DNA, 11 bp, Homo sapiens
agcagccagcc

SEQ ID NO: 3920797 - DNA, 13 bp, Homo sapiens
agcagcccagctt

SEQ ID NO: 3920798 - DNA, 17 bp, Homo sapiens
agcagcccagcttcctg

SEQ ID NO: 3920799 - DNA, 17 bp, Homo sapiens
agcagccctcctcaccc

SEQ ID NO: 3920800 - DNA, 18 bp, Homo sapiens
agcagccgtttctccttg

SEQ ID NO: 3920801 - DNA, 14 bp, Homo sapiens
agcagcctcctggg

SEQ ID NO: 3920802 - DNA, 19 bp, Homo sapiens
agcagcctcctgggcagtc

SEQ ID NO: 3920803 - DNA, 20 bp, Homo sapiens
agcagcctgatggccaaggg

SEQ ID NO: 3920804 - DNA, 14 bp, Homo sapiens
agcagctaggactg

SEQ ID NO: 3920805 - DNA, 22 bp, Homo sapiens
agcagctaggactgaggagtgg

SEQ ID NO: 3920806 - DNA, 12 bp, Homo sapiens
agcagctgagca

SEQ ID NO: 3920807 - DNA, 13 bp, Homo sapiens
agcagctgagcag

SEQ ID NO: 3920808 - DNA, 14 bp, Homo sapiens
agcagctgagcagg

SEQ ID NO: 3920809 - DNA, 16 bp, Homo sapiens
agcagctgagcagggc

SEQ ID NO: 3920810 - DNA, 17 bp, Homo sapiens
agcagctgagcagggcc

SEQ ID NO: 3920811 - DNA, 19 bp, Homo sapiens
agcagctgagcagggccgg

SEQ ID NO: 3920812 - DNA, 17 bp, Homo sapiens
agcagctgcgggtctga

SEQ ID NO: 3920813 - DNA, 21 bp, Homo sapiens
agcagctgggccggccagcct

SEQ ID NO: 3920814 - DNA, 16 bp, Homo sapiens
agcagcttcagttgtt

SEQ ID NO: 3920815 - DNA, 17 bp, Homo sapiens
agcaggaacagagactc

SEQ ID NO: 3920816 - DNA, 17 bp, Homo sapiens
agcaggaacctgtactg

SEQ ID NO: 3920817 - DNA, 17 bp, Homo sapiens
agcaggaatgggaagga

SEQ ID NO: 3920818 - DNA, 20 bp, Homo sapiens
agcaggcacttgattccttg

SEQ ID NO: 3920819 - DNA, 17 bp, Homo sapiens
agcaggcagagcgggga

SEQ ID NO: 3920820 - DNA, 21 bp, Homo sapiens
agcaggcagagcggggaggtg

SEQ ID NO: 3920821 - DNA, 15 bp, Homo sapiens
agcaggcccgacaga

SEQ ID NO: 3920822 - DNA, 16 bp, Homo sapiens
agcaggcccgacagag

SEQ ID NO: 3920823 - DNA, 19 bp, Homo sapiens
agcaggcccgacagagaga

SEQ ID NO: 3920824 - DNA, 14 bp, Homo sapiens
agcaggctactgtc

SEQ ID NO: 3920825 - DNA, 17 bp, Homo sapiens
agcaggctactgtcagc

SEQ ID NO: 3920826 - DNA, 20 bp, Homo sapiens
agcaggctactgtcagctcc

SEQ ID NO: 3920827 - DNA, 18 bp, Homo sapiens
agcaggctcagactctgg

SEQ ID NO: 3920828 - DNA, 15 bp, Homo sapiens
agccagagcctgggg

SEQ ID NO: 3920829 - DNA, 22 bp, Homo sapiens
agccagagggtgggagcctaag

SEQ ID NO: 3920830 - DNA, 14 bp, Homo sapiens
agccagatccaccc

SEQ ID NO: 3920831 - DNA, 22 bp, Homo sapiens
agccagcaatgatgtccagaag

SEQ ID NO: 3920832 - DNA, 15 bp, Homo sapiens
agccagcccagccca

SEQ ID NO: 3920833 - DNA, 12 bp, Homo sapiens
agccagccctcc

SEQ ID NO: 3920834 - DNA, 15 bp, Homo sapiens
agccagccctccctg

SEQ ID NO: 3920835 - DNA, 20 bp, Homo sapiens
agccagccctccctgtcctc

SEQ ID NO: 3920836 - DNA, 23 bp, Homo sapiens
agccagccctccctgtcctcctc

SEQ ID NO: 3920837 - DNA, 20 bp, Homo sapiens
aatctcaaattctcaaccta

SEQ ID NO: 3920838 - DNA, 22 bp, Homo sapiens
aatctgagatctccctccaggg

SEQ ID NO: 3920839 - DNA, 20 bp, Homo sapiens
aatctgagcctaaatctaat

SEQ ID NO: 3920840 - DNA, 21 bp, Homo sapiens
aatctgataggaaaagaaggc

SEQ ID NO: 3920841 - DNA, 19 bp, Homo sapiens
aatctgatttaatgttttc

SEQ ID NO: 3920842 - DNA, 21 bp, Homo sapiens
aatctggaaggcccctcccag

SEQ ID NO: 3920843 - DNA, 19 bp, Homo sapiens
aatctggctcctgtttcca

SEQ ID NO: 3920844 - DNA, 21 bp, Homo sapiens
aatctggctcctgtttccatg

SEQ ID NO: 3920845 - DNA, 17 bp, Homo sapiens
aatctgggcatctcgtg

SEQ ID NO: 3920846 - DNA, 16 bp, Homo sapiens
aatctgtagggctgga

SEQ ID NO: 3920847 - DNA, 19 bp, Homo sapiens
aatctgtagggctggacct

SEQ ID NO: 3920848 - DNA, 22 bp, Homo sapiens
aatctgtagggctggacctatg

SEQ ID NO: 3920849 - DNA, 16 bp, Homo sapiens
aatctgtatatgttgt

SEQ ID NO: 3920850 - DNA, 23 bp, Homo sapiens
aatctgtgaattaaaaaagctca

SEQ ID NO: 3920851 - DNA, 17 bp, Homo sapiens
aatctgttactgaaatg

SEQ ID NO: 3920852 - DNA, 13 bp, Homo sapiens
aatctgttttgta

SEQ ID NO: 3920853 - DNA, 17 bp, Homo sapiens
aatctgttttgtatatg

SEQ ID NO: 3920854 - DNA, 19 bp, Homo sapiens
aatctgttttgtatatgat

SEQ ID NO: 3920855 - DNA, 19 bp, Homo sapiens
aatcttcaaggtgtaaaat

SEQ ID NO: 3920856 - DNA, 21 bp, Homo sapiens
aatcttcaaggtgtaaaatat

SEQ ID NO: 3920857 - DNA, 22 bp, Homo sapiens
aatcttgacacggtgaaatcca

SEQ ID NO: 3920858 - DNA, 23 bp, Homo sapiens
aatcttgacacggtgaaatccag

SEQ ID NO: 3920859 - DNA, 21 bp, Homo sapiens
aatctttcagcactcagaaaa

SEQ ID NO: 3920860 - DNA, 15 bp, Homo sapiens
aatctttctttacct

SEQ ID NO: 3920861 - DNA, 16 bp, Homo sapiens
aatctttgtgacagga

SEQ ID NO: 3920862 - DNA, 11 bp, Homo sapiens
aatgaaaataa

SEQ ID NO: 3920863 - DNA, 21 bp, Homo sapiens
aatgaaaataagtgaataata

SEQ ID NO: 3920864 - DNA, 14 bp, Homo sapiens
aatgaaacagatga

SEQ ID NO: 3920865 - DNA, 21 bp, Homo sapiens
aatgaaatcctgcttcagtgt

SEQ ID NO: 3920866 - DNA, 13 bp, Homo sapiens
aatgaaatgtctt

SEQ ID NO: 3920867 - DNA, 21 bp, Homo sapiens
aatgaaggttaggatttaaca

SEQ ID NO: 3920868 - DNA, 16 bp, Homo sapiens
aatgaagttattcttg

SEQ ID NO: 3920869 - DNA, 15 bp, Homo sapiens
aatgaataataatta

SEQ ID NO: 3920870 - DNA, 17 bp, Homo sapiens
aatgaattaaataaacc

SEQ ID NO: 3920871 - DNA, 14 bp, Homo sapiens
aatgacagaatgct

SEQ ID NO: 3920872 - DNA, 15 bp, Homo sapiens
aatgacatgcactga

SEQ ID NO: 3920873 - DNA, 16 bp, Homo sapiens
aatgaccaagaaaaag

SEQ ID NO: 3920874 - DNA, 18 bp, Homo sapiens
aatgaccacgggcctcag

SEQ ID NO: 3920875 - DNA, 17 bp, Homo sapiens
aatgactaaaaatatta

SEQ ID NO: 3920876 - DNA, 17 bp, Homo sapiens
aatgactataaacatta

SEQ ID NO: 3920877 - DNA, 15 bp, Homo sapiens
aatgactttttataa

SEQ ID NO: 3920878 - DNA, 16 bp, Homo sapiens
aatgaggacatgtttt

SEQ ID NO: 3920879 - DNA, 17 bp, Homo sapiens
aatgaggaggattgctt

SEQ ID NO: 3920880 - DNA, 15 bp, Homo sapiens
aatgatatccagtaa

SEQ ID NO: 3920881 - DNA, 14 bp, Homo sapiens
aatgatggcaattt

SEQ ID NO: 3920882 - DNA, 18 bp, Homo sapiens
aatgatggcaattttgta

SEQ ID NO: 3920883 - DNA, 14 bp, Homo sapiens
aatgatgtccagaa

SEQ ID NO: 3920884 - DNA, 19 bp, Homo sapiens
aatgatgttttagaatgat

SEQ ID NO: 3920885 - DNA, 14 bp, Homo sapiens
aatgattattttca

SEQ ID NO: 3920886 - DNA, 21 bp, Homo sapiens
aatgattattttcattacaat

SEQ ID NO: 3920887 - DNA, 19 bp, Homo sapiens
aatgattcataacaatgta

SEQ ID NO: 3920888 - DNA, 13 bp, Homo sapiens
aatgatttcatgc

SEQ ID NO: 3920889 - DNA, 20 bp, Homo sapiens
aatgatttccaaagagaaaa

SEQ ID NO: 3920890 - DNA, 15 bp, Homo sapiens
aatgattttcatcaa

SEQ ID NO: 3920891 - DNA, 12 bp, Homo sapiens
aatgcaaaatga

SEQ ID NO: 3920892 - DNA, 16 bp, Homo sapiens
aatgcacaagctcaga

SEQ ID NO: 3920893 - DNA, 17 bp, Homo sapiens
aatgcacaagctcagaa

SEQ ID NO: 3920894 - DNA, 16 bp, Homo sapiens
aatgcacaatttagaa

SEQ ID NO: 3920895 - DNA, 24 bp, Homo sapiens
aatgcacacacacagagatatgca

SEQ ID NO: 3920896 - DNA, 16 bp, Homo sapiens
aatgcacatccattcc

SEQ ID NO: 3920897 - DNA, 17 bp, Homo sapiens
aatgcacatccattccc

SEQ ID NO: 3920898 - DNA, 16 bp, Homo sapiens
aatgcagattcctggg

SEQ ID NO: 3920899 - DNA, 18 bp, Homo sapiens
aatgcagggaagagggca

SEQ ID NO: 3920900 - DNA, 15 bp, Homo sapiens
aatgcagtccagaat

SEQ ID NO: 3920901 - DNA, 17 bp, Homo sapiens
aatgcagtccagaataa

SEQ ID NO: 3920902 - DNA, 13 bp, Homo sapiens
acaaaatggaagg

SEQ ID NO: 3920903 - DNA, 14 bp, Homo sapiens
acaaacactgaatc

SEQ ID NO: 3920904 - DNA, 16 bp, Homo sapiens
acaaaccacaactgac

SEQ ID NO: 3920905 - DNA, 14 bp, Homo sapiens
acaaaccactgtac

SEQ ID NO: 3920906 - DNA, 17 bp, Homo sapiens
acaaaccactgtacata

SEQ ID NO: 3920907 - DNA, 18 bp, Homo sapiens
acaaaccactgtacatat

SEQ ID NO: 3920908 - DNA, 14 bp, Homo sapiens
acaaacctgcttgt

SEQ ID NO: 3920909 - DNA, 16 bp, Homo sapiens
acaaactgatttctca

SEQ ID NO: 3920910 - DNA, 14 bp, Homo sapiens
acaaagagaaaaag

SEQ ID NO: 3920911 - DNA, 21 bp, Homo sapiens
acaaagagaaaaagaaatgca

SEQ ID NO: 3920912 - DNA, 16 bp, Homo sapiens
acaaagagaataaaga

SEQ ID NO: 3920913 - DNA, 21 bp, Homo sapiens
acaaagatgtttgtcagatat

SEQ ID NO: 3920914 - DNA, 17 bp, Homo sapiens
acaaagccaacagtcaa

SEQ ID NO: 3920915 - DNA, 20 bp, Homo sapiens
acaaagcgagatcccatctc

SEQ ID NO: 3920916 - DNA, 21 bp, Homo sapiens
acaaagcttctatcccaggag

SEQ ID NO: 3920917 - DNA, 22 bp, Homo sapiens
acaaagcttctatcccaggagg

SEQ ID NO: 3920918 - DNA, 23 bp, Homo sapiens
acaaagcttctatcccaggaggt

SEQ ID NO: 3920919 - DNA, 13 bp, Homo sapiens
acaaaggggagaa

SEQ ID NO: 3920920 - DNA, 19 bp, Homo sapiens
acaaaggtataattttatg

SEQ ID NO: 3920921 - DNA, 16 bp, Homo sapiens
acaaataataagcaaa

SEQ ID NO: 3920922 - DNA, 20 bp, Homo sapiens
acaaataatgaacagcagaa

SEQ ID NO: 3920923 - DNA, 20 bp, Homo sapiens
acaaatatccaccactttaa

SEQ ID NO: 3920924 - DNA, 18 bp, Homo sapiens
acaaatatttattttctt

SEQ ID NO: 3920925 - DNA, 19 bp, Homo sapiens
acaaatctatattaaagtg

SEQ ID NO: 3920926 - DNA, 20 bp, Homo sapiens
acaaatctatattaaagtgt

SEQ ID NO: 3920927 - DNA, 23 bp, Homo sapiens
acaaatctatattaaagtgttat

SEQ ID NO: 3920928 - DNA, 15 bp, Homo sapiens
acaaatcttcaaggt

SEQ ID NO: 3920929 - DNA, 16 bp, Homo sapiens
acaaatcttcaaggtg

SEQ ID NO: 3920930 - DNA, 13 bp, Homo sapiens
acaacaaaccaaa

SEQ ID NO: 3920931 - DNA, 15 bp, Homo sapiens
acaacaacaacaata

SEQ ID NO: 3920932 - DNA, 12 bp, Homo sapiens
acaacaacaata

SEQ ID NO: 3920933 - DNA, 13 bp, Homo sapiens
acaacaacaataa

SEQ ID NO: 3920934 - DNA, 15 bp, Homo sapiens
acaacaacaataaca

SEQ ID NO: 3920935 - DNA, 17 bp, Homo sapiens
acaacaacaataacaac

SEQ ID NO: 3920936 - DNA, 13 bp, Homo sapiens
acaacaacaatac

SEQ ID NO: 3920937 - DNA, 13 bp, Homo sapiens
acaacaagaacaa

SEQ ID NO: 3920938 - DNA, 16 bp, Homo sapiens
acaacaagaacaacaa

SEQ ID NO: 3920939 - DNA, 13 bp, Homo sapiens
acaacaagagttt

SEQ ID NO: 3920940 - DNA, 13 bp, Homo sapiens
acaacaaggaccc

SEQ ID NO: 3920941 - DNA, 14 bp, Homo sapiens
acaacaaggaccct

SEQ ID NO: 3920942 - DNA, 17 bp, Homo sapiens
acaacaatacaacaaga

SEQ ID NO: 3920943 - DNA, 12 bp, Homo sapiens
acaacagactga

SEQ ID NO: 3920944 - DNA, 13 bp, Homo sapiens
acaacagactgaa

SEQ ID NO: 3920945 - DNA, 16 bp, Homo sapiens
acaacatccatgtcct

SEQ ID NO: 3920946 - DNA, 17 bp, Homo sapiens
acaacatccatgtccta

SEQ ID NO: 3920947 - DNA, 22 bp, Homo sapiens
acaacatccatgtcctatgtgt

SEQ ID NO: 3920948 - DNA, 12 bp, Homo sapiens
acaaccagagcc

SEQ ID NO: 3920949 - DNA, 13 bp, Homo sapiens
acaaccagagccc

SEQ ID NO: 3920950 - DNA, 11 bp, Homo sapiens
acaacccagaa

SEQ ID NO: 3920951 - DNA, 18 bp, Homo sapiens
acaaccctgttttatact

SEQ ID NO: 3920952 - DNA, 16 bp, Homo sapiens
acaacctgcccctccc

SEQ ID NO: 3920953 - DNA, 12 bp, Homo sapiens
acaacctggaga

SEQ ID NO: 3920954 - DNA, 18 bp, Homo sapiens
acaaccttctgtggctca

SEQ ID NO: 3920955 - DNA, 23 bp, Homo sapiens
acaactaatcaagagtgagtgaa

SEQ ID NO: 3920956 - DNA, 16 bp, Homo sapiens
acaactaggcttcagc

SEQ ID NO: 3920957 - DNA, 19 bp, Homo sapiens
acaactaggcttcagcata

SEQ ID NO: 3920958 - DNA, 16 bp, Homo sapiens
acaacttgtgttctat

SEQ ID NO: 3920959 - DNA, 17 bp, Homo sapiens
acaacttgtgttctatt

SEQ ID NO: 3920960 - DNA, 15 bp, Homo sapiens
acaagaaatccctgt

SEQ ID NO: 3920961 - DNA, 23 bp, Homo sapiens
acaagaaatccctgtttaatatt

SEQ ID NO: 3920962 - DNA, 13 bp, Homo sapiens
acaagaagctgct

SEQ ID NO: 3920963 - DNA, 13 bp, Homo sapiens
acaagagcccagc

SEQ ID NO: 3920964 - DNA, 20 bp, Homo sapiens
acaagagcccagcagggcct

SEQ ID NO: 3920965 - DNA, 23 bp, Homo sapiens
acaagaggttaaggtgggtccag

SEQ ID NO: 3920966 - DNA, 20 bp, Homo sapiens
acaagatctttcaggaaaga

SEQ ID NO: 3920967 - DNA, 16 bp, Homo sapiens
acaagattcccagaga

SEQ ID NO: 3920968 - DNA, 21 bp, Homo sapiens
acaagattcccagagacagga

SEQ ID NO: 3920969 - DNA, 14 bp, Homo sapiens
acaagcaataatta

SEQ ID NO: 3920970 - DNA, 15 bp, Homo sapiens
acaagcaataattag

SEQ ID NO: 3920971 - DNA, 17 bp, Homo sapiens
acaagcaataattagga

SEQ ID NO: 3920972 - DNA, 21 bp, Homo sapiens
acaagcaataattaggatcta

SEQ ID NO: 3920973 - DNA, 22 bp, Homo sapiens
acaagcacagacattaaacctg

SEQ ID NO: 3920974 - DNA, 21 bp, Homo sapiens
acaagccaacttgtaaataca

SEQ ID NO: 3920975 - DNA, 12 bp, Homo sapiens
acaagccacaga

SEQ ID NO: 3920976 - DNA, 13 bp, Homo sapiens
acaagccacagaa

SEQ ID NO: 3920977 - DNA, 13 bp, Homo sapiens
acaagccctggca

SEQ ID NO: 3920978 - DNA, 18 bp, Homo sapiens
acaagccttactcacctc

SEQ ID NO: 3920979 - DNA, 24 bp, Homo sapiens
acaagccttactcacctctctcta

SEQ ID NO: 3920980 - DNA, 23 bp, Homo sapiens
acaagctcaggaggcgaataaat

SEQ ID NO: 3920981 - DNA, 19 bp, Homo sapiens
acaagcttgtatatacata

SEQ ID NO: 3920982 - DNA, 21 bp, Homo sapiens
acaagcttgtatatacatatt

SEQ ID NO: 3920983 - DNA, 22 bp, Homo sapiens
acaaggcacttgtcactatgct

SEQ ID NO: 3920984 - DNA, 15 bp, Homo sapiens
acaaggcagcaaggc

SEQ ID NO: 3920985 - DNA, 22 bp, Homo sapiens
acaaggcagcaaggcccgagca

SEQ ID NO: 3920986 - DNA, 18 bp, Homo sapiens
acaaggctgaccaagaga

SEQ ID NO: 3920987 - DNA, 18 bp, Homo sapiens
acaagggtctagggagag

SEQ ID NO: 3920988 - DNA, 19 bp, Homo sapiens
acaagggtctagggagaga

SEQ ID NO: 3920989 - DNA, 13 bp, Homo sapiens
acaaggtagacat

SEQ ID NO: 3920990 - DNA, 20 bp, Homo sapiens
acaaggttccctctgagaat

SEQ ID NO: 3920991 - DNA, 18 bp, Homo sapiens
acaagtaatcactaaccc

SEQ ID NO: 3920992 - DNA, 14 bp, Homo sapiens
acaagtcacagctg

SEQ ID NO: 3920993 - DNA, 18 bp, Homo sapiens
acaagtcacagctgcagc

SEQ ID NO: 3920994 - DNA, 19 bp, Homo sapiens
acaagtcacagctgcagct

SEQ ID NO: 3920995 - DNA, 16 bp, Homo sapiens
acaagtcctgtgaatt

SEQ ID NO: 3920996 - DNA, 17 bp, Homo sapiens
acaagtcctgtgaattt

SEQ ID NO: 3920997 - DNA, 18 bp, Homo sapiens
acaagtgtatatcagaaa

SEQ ID NO: 3920998 - DNA, 19 bp, Homo sapiens
acaagtgtatatcagaaaa

SEQ ID NO: 3920999 - DNA, 20 bp, Homo sapiens
acaagtgtatatcagaaaag

SEQ ID NO: 3921000 - DNA, 13 bp, Homo sapiens
acaataaagagct

SEQ ID NO: 3921001 - DNA, 16 bp, Homo sapiens
acaataaagagctcaa

SEQ ID NO: 3921002 - DNA, 14 bp, Homo sapiens
acaataaataatct

SEQ ID NO: 3921003 - DNA, 15 bp, Homo sapiens
acaataaatattctg

SEQ ID NO: 3921004 - DNA, 22 bp, Homo sapiens
acaataaatattctgcatggaa

SEQ ID NO: 3921005 - DNA, 18 bp, Homo sapiens
acaataataaatcctcag

SEQ ID NO: 3921006 - DNA, 16 bp, Homo sapiens
acaataccactggtta

SEQ ID NO: 3921007 - DNA, 18 bp, Homo sapiens
acaataccagatcactca

SEQ ID NO: 3921008 - DNA, 15 bp, Homo sapiens
acaatagctattgca

SEQ ID NO: 3921009 - DNA, 16 bp, Homo sapiens
acaatatataaaaata

SEQ ID NO: 3921010 - DNA, 13 bp, Homo sapiens
acaatcctgaaga

SEQ ID NO: 3921011 - DNA, 14 bp, Homo sapiens
acaatcctgaagaa

SEQ ID NO: 3921012 - DNA, 19 bp, Homo sapiens
acaatgatgattaaacacc

SEQ ID NO: 3921013 - DNA, 20 bp, Homo sapiens
acaatgcctctcccacgatg

SEQ ID NO: 3921014 - DNA, 19 bp, Homo sapiens
acaatgccttgggagagat

SEQ ID NO: 3921015 - DNA, 12 bp, Homo sapiens
acaatggcagct

SEQ ID NO: 3921016 - DNA, 15 bp, Homo sapiens
acaatggccatggaa

SEQ ID NO: 3921017 - DNA, 21 bp, Homo sapiens
acaatggctaattcccagagt

SEQ ID NO: 3921018 - DNA, 15 bp, Homo sapiens
acaatggtttacatg

SEQ ID NO: 3921019 - DNA, 17 bp, Homo sapiens
acaatggtttacatgaa

SEQ ID NO: 3921020 - DNA, 18 bp, Homo sapiens
acaattattgtacactaa

SEQ ID NO: 3921021 - DNA, 16 bp, Homo sapiens
acaattgatacttcag

SEQ ID NO: 3921022 - DNA, 20 bp, Homo sapiens
acaattgatacttcaggtgc

SEQ ID NO: 3921023 - DNA, 22 bp, Homo sapiens
acaattgatacttcaggtgctt

SEQ ID NO: 3921024 - DNA, 20 bp, Homo sapiens
acaatttcctttatatttag

SEQ ID NO: 3921025 - DNA, 15 bp, Homo sapiens
acacaaacacctcct

SEQ ID NO: 3921026 - DNA, 16 bp, Homo sapiens
acacaaacacctccta

SEQ ID NO: 3921027 - DNA, 20 bp, Homo sapiens
acacaaaccacaactgacac

SEQ ID NO: 3921028 - DNA, 22 bp, Homo sapiens
acacaaagagaaaaagaaatgc

SEQ ID NO: 3921029 - DNA, 12 bp, Homo sapiens
acacaacattta

SEQ ID NO: 3921030 - DNA, 13 bp, Homo sapiens
acacaacatttat

SEQ ID NO: 3921031 - DNA, 19 bp, Homo sapiens
acacaagccacagaagcca

SEQ ID NO: 3921032 - DNA, 15 bp, Homo sapiens
acacaagctggaagc

SEQ ID NO: 3921033 - DNA, 15 bp, Homo sapiens
acacaagtcctgtga

SEQ ID NO: 3921034 - DNA, 14 bp, Homo sapiens
acacaatctttcct

SEQ ID NO: 3921035 - DNA, 16 bp, Homo sapiens
acacaatctttccttg

SEQ ID NO: 3921036 - DNA, 11 bp, Homo sapiens
acacacacaca

SEQ ID NO: 3921037 - DNA, 15 bp, Homo sapiens
acacacacacacaca

SEQ ID NO: 3921038 - DNA, 14 bp, Homo sapiens
acacacacacatac

SEQ ID NO: 3921039 - DNA, 13 bp, Homo sapiens
acacacacagaga

SEQ ID NO: 3921040 - DNA, 22 bp, Homo sapiens
acacacagaggaagagcaggca

SEQ ID NO: 3921041 - DNA, 13 bp, Homo sapiens
acacacagcagca

SEQ ID NO: 3921042 - DNA, 13 bp, Homo sapiens
acacacagctcct

SEQ ID NO: 3921043 - DNA, 18 bp, Homo sapiens
acacacatatacatatat

SEQ ID NO: 3921044 - DNA, 19 bp, Homo sapiens
acacacatatacatatata

SEQ ID NO: 3921045 - DNA, 21 bp, Homo sapiens
acacacatatacatatatata

SEQ ID NO: 3921046 - DNA, 16 bp, Homo sapiens
acacaccggtcaccga

SEQ ID NO: 3921047 - DNA, 21 bp, Homo sapiens
acacacgcaggaactcccagc

SEQ ID NO: 3921048 - DNA, 16 bp, Homo sapiens
acacacggaccatgtg

SEQ ID NO: 3921049 - DNA, 13 bp, Homo sapiens
acacactcagcag

SEQ ID NO: 3921050 - DNA, 10 bp, Homo sapiens
acacactgta

SEQ ID NO: 3921051 - DNA, 12 bp, Homo sapiens
acacagaaatat

SEQ ID NO: 3921052 - DNA, 14 bp, Homo sapiens
acacagaaatatat

SEQ ID NO: 3921053 - DNA, 17 bp, Homo sapiens
acacagagatatgcaca

SEQ ID NO: 3921054 - DNA, 12 bp, Homo sapiens
acacagaggaag

SEQ ID NO: 3921055 - DNA, 17 bp, Homo sapiens
acacagaggaagagcag

SEQ ID NO: 3921056 - DNA, 21 bp, Homo sapiens
acacagcgtccctagcagtga

SEQ ID NO: 3921057 - DNA, 22 bp, Homo sapiens
acacagctgagagacttttaat

SEQ ID NO: 3921058 - DNA, 13 bp, Homo sapiens
acacaggcctgtg

SEQ ID NO: 3921059 - DNA, 19 bp, Homo sapiens
acacagtctcagtccagat

SEQ ID NO: 3921060 - DNA, 22 bp, Homo sapiens
acacagtgttccagctgcctgg

SEQ ID NO: 3921061 - DNA, 13 bp, Homo sapiens
acacataatttga

SEQ ID NO: 3921062 - DNA, 11 bp, Homo sapiens
acacatacata

SEQ ID NO: 3921063 - DNA, 18 bp, Homo sapiens
acacatacatacatacat

SEQ ID NO: 3921064 - DNA, 15 bp, Homo sapiens
acacatactagaaag

SEQ ID NO: 3921065 - DNA, 22 bp, Homo sapiens
acacatagattaatggcactga

SEQ ID NO: 3921066 - DNA, 23 bp, Homo sapiens
acacatagattaatggcactgat

SEQ ID NO: 3921067 - DNA, 15 bp, Homo sapiens
acacatcagcttgcc

SEQ ID NO: 3921068 - DNA, 22 bp, Homo sapiens
acacatcagcttgccctgttaa

SEQ ID NO: 3921069 - DNA, 15 bp, Homo sapiens
acacatggacacaga

SEQ ID NO: 3921070 - DNA, 21 bp, Homo sapiens
acacatggacacagacccaca

SEQ ID NO: 3921071 - DNA, 17 bp, Homo sapiens
acacattacttgcacaa

SEQ ID NO: 3921072 - DNA, 16 bp, Homo sapiens
acaccacgaatttggt

SEQ ID NO: 3921073 - DNA, 11 bp, Homo sapiens
acaccactgcc

SEQ ID NO: 3921074 - DNA, 14 bp, Homo sapiens
acaccactgccctg

SEQ ID NO: 3921075 - DNA, 21 bp, Homo sapiens
acaccactgccctgcctgccc

SEQ ID NO: 3921076 - DNA, 14 bp, Homo sapiens
acagagacacctgc

SEQ ID NO: 3921077 - DNA, 21 bp, Homo sapiens
acagagacacctgcacctccc

SEQ ID NO: 3921078 - DNA, 23 bp, Homo sapiens
acagagacagaaacagagagaga

SEQ ID NO: 3921079 - DNA, 15 bp, Homo sapiens
acagagacaggccca

SEQ ID NO: 3921080 - DNA, 21 bp, Homo sapiens
acagagacaggcccaagagat

SEQ ID NO: 3921081 - DNA, 13 bp, Homo sapiens
acagagactctgg

SEQ ID NO: 3921082 - DNA, 14 bp, Homo sapiens
acagagagagactg

SEQ ID NO: 3921083 - DNA, 22 bp, Homo sapiens
acagagatgcatgcgcaggctc

SEQ ID NO: 3921084 - DNA, 23 bp, Homo sapiens
acagagatggaggccgagccaat

SEQ ID NO: 3921085 - DNA, 20 bp, Homo sapiens
acagagcactaggttcaatt

SEQ ID NO: 3921086 - DNA, 22 bp, Homo sapiens
acagagcactaggttcaattcc

SEQ ID NO: 3921087 - DNA, 19 bp, Homo sapiens
acagagcccccaagcctct

SEQ ID NO: 3921088 - DNA, 22 bp, Homo sapiens
acagagcccccaagcctctgcc

SEQ ID NO: 3921089 - DNA, 23 bp, Homo sapiens
acagagcccccaagcctctgccc

SEQ ID NO: 3921090 - DNA, 22 bp, Homo sapiens
acagagcgggcctcttccctca

SEQ ID NO: 3921091 - DNA, 23 bp, Homo sapiens
acagagcgggcctcttccctcag

SEQ ID NO: 3921092 - DNA, 14 bp, Homo sapiens
acagaggaagagca

SEQ ID NO: 3921093 - DNA, 20 bp, Homo sapiens
acagagggctagggaggtgg

SEQ ID NO: 3921094 - DNA, 13 bp, Homo sapiens
acagaggtaacta

SEQ ID NO: 3921095 - DNA, 18 bp, Homo sapiens
acagagtggagccctcag

SEQ ID NO: 3921096 - DNA, 23 bp, Homo sapiens
acagataccccacgttctatata

SEQ ID NO: 3921097 - DNA, 17 bp, Homo sapiens
acagatagacagtgctg

SEQ ID NO: 3921098 - DNA, 19 bp, Homo sapiens
acagatagacagtgctgcc

SEQ ID NO: 3921099 - DNA, 15 bp, Homo sapiens
acagatatacacatg

SEQ ID NO: 3921100 - DNA, 14 bp, Homo sapiens
acagatatgcacac

SEQ ID NO: 3921101 - DNA, 21 bp, Homo sapiens
acagatatgcacacacatgga

SEQ ID NO: 3921102 - DNA, 22 bp, Homo sapiens
acagatgataaatatttatgct

SEQ ID NO: 3921103 - DNA, 21 bp, Homo sapiens
acagatgcacacacagatgca

SEQ ID NO: 3921104 - DNA, 19 bp, Homo sapiens
acagatgggtattaaactt

SEQ ID NO: 3921105 - DNA, 18 bp, Homo sapiens
acagcaagggtgatggga

SEQ ID NO: 3921106 - DNA, 18 bp, Homo sapiens
acagcacccaggctccat

SEQ ID NO: 3921107 - DNA, 18 bp, Homo sapiens
acagcactacagatatca

SEQ ID NO: 3921108 - DNA, 15 bp, Homo sapiens
acagcagaggttctt

SEQ ID NO: 3921109 - DNA, 17 bp, Homo sapiens
acagcagcccctgcaca

SEQ ID NO: 3921110 - DNA, 14 bp, Homo sapiens
acagcagctgaaca

SEQ ID NO: 3921111 - DNA, 22 bp, Homo sapiens
acagcagtcttcttcacccgct

SEQ ID NO: 3921112 - DNA, 16 bp, Homo sapiens
acagcagtgtcatcag

SEQ ID NO: 3921113 - DNA, 17 bp, Homo sapiens
acagcagtgtcatcaga

SEQ ID NO: 3921114 - DNA, 13 bp, Homo sapiens
acagcccaagagg

SEQ ID NO: 3921115 - DNA, 19 bp, Homo sapiens
acagcccaagaggactgag

SEQ ID NO: 3921116 - DNA, 13 bp, Homo sapiens
acagcccagccta

SEQ ID NO: 3921117 - DNA, 14 bp, Homo sapiens
acagcccagcctag

SEQ ID NO: 3921118 - DNA, 13 bp, Homo sapiens
acagccccagggc

SEQ ID NO: 3921119 - DNA, 15 bp, Homo sapiens
acagccccagggccc

SEQ ID NO: 3921120 - DNA, 12 bp, Homo sapiens
acagccctggga

SEQ ID NO: 3921121 - DNA, 13 bp, Homo sapiens
acagccctgggag

SEQ ID NO: 3921122 - DNA, 17 bp, Homo sapiens
acagcctcacagaagaa

SEQ ID NO: 3921123 - DNA, 21 bp, Homo sapiens
acagcctgtggcggtgcctgg

SEQ ID NO: 3921124 - DNA, 15 bp, Homo sapiens
acagcgagaggcaga

SEQ ID NO: 3921125 - DNA, 14 bp, Homo sapiens
acagcgcgggcgga

SEQ ID NO: 3921126 - DNA, 22 bp, Homo sapiens
acagctaatcagcattctcact

SEQ ID NO: 3921127 - DNA, 17 bp, Homo sapiens
acagctcacctctgaag

SEQ ID NO: 3921128 - DNA, 14 bp, Homo sapiens
acagctcagagatg

SEQ ID NO: 3921129 - DNA, 21 bp, Homo sapiens
acagctcagctttttgtcttt

SEQ ID NO: 3921130 - DNA, 12 bp, Homo sapiens
acagctgacaga

SEQ ID NO: 3921131 - DNA, 15 bp, Homo sapiens
acagctgagagactt

SEQ ID NO: 3921132 - DNA, 16 bp, Homo sapiens
acagctgagagacttt

SEQ ID NO: 3921133 - DNA, 22 bp, Homo sapiens
acagctgagagacttttaatca

SEQ ID NO: 3921134 - DNA, 15 bp, Homo sapiens
acagctgcagctggg

SEQ ID NO: 3921135 - DNA, 14 bp, Homo sapiens
acagctgctgaaga

SEQ ID NO: 3921136 - DNA, 22 bp, Homo sapiens
acagctgcttgtcctgctctct

SEQ ID NO: 3921137 - DNA, 12 bp, Homo sapiens
acagctgtgcct

SEQ ID NO: 3921138 - DNA, 17 bp, Homo sapiens
acagctgtgcctcgctc

SEQ ID NO: 3921139 - DNA, 14 bp, Homo sapiens
acagctgtttaaga

SEQ ID NO: 3921140 - DNA, 16 bp, Homo sapiens
acagcttcttcatctt

SEQ ID NO: 3921141 - DNA, 14 bp, Homo sapiens
acaggaccagattt

SEQ ID NO: 3921142 - DNA, 18 bp, Homo sapiens
acaggactaacactcaga

SEQ ID NO: 3921143 - DNA, 16 bp, Homo sapiens
acaggagcagacagag

SEQ ID NO: 3921144 - DNA, 18 bp, Homo sapiens
acaggagcagacagagaa

SEQ ID NO: 3921145 - DNA, 20 bp, Homo sapiens
acaggagccccacccccatg

SEQ ID NO: 3921146 - DNA, 13 bp, Homo sapiens
acaggagctacct

SEQ ID NO: 3921147 - DNA, 23 bp, Homo sapiens
acaggagctacctgtgtggacag

SEQ ID NO: 3921148 - DNA, 23 bp, Homo sapiens
acaggaggttgtggatgctccag

SEQ ID NO: 3921149 - DNA, 21 bp, Homo sapiens
acaggcagctggatgagactt

SEQ ID NO: 3921150 - DNA, 13 bp, Homo sapiens
acaggcaggaaga

SEQ ID NO: 3921151 - DNA, 15 bp, Homo sapiens
acaggcaggaagaga

SEQ ID NO: 3921152 - DNA, 18 bp, Homo sapiens
acaggcaggaagagagag

SEQ ID NO: 3921153 - DNA, 19 bp, Homo sapiens
acaggcaggaagagagaga

SEQ ID NO: 3921154 - DNA, 23 bp, Homo sapiens
acaggcccggcccagcctaggcc

SEQ ID NO: 3921155 - DNA, 15 bp, Homo sapiens
acaggcccttcctct

SEQ ID NO: 3921156 - DNA, 23 bp, Homo sapiens
acaggcccttggggttcccccag

SEQ ID NO: 3921157 - DNA, 19 bp, Homo sapiens
acaggcctgtgtagctgtg

SEQ ID NO: 3921158 - DNA, 20 bp, Homo sapiens
acaggcctgtgtagctgtga

SEQ ID NO: 3921159 - DNA, 19 bp, Homo sapiens
acaggctgttctgcactga

SEQ ID NO: 3921160 - DNA, 21 bp, Homo sapiens
acaggctgttctgcactgaaa

SEQ ID NO: 3921161 - DNA, 22 bp, Homo sapiens
acagggaaccctgcttgcactt

SEQ ID NO: 3921162 - DNA, 23 bp, Homo sapiens
acatgtgtctgtgtggtatattt

SEQ ID NO: 3921163 - DNA, 15 bp, Homo sapiens
acatgtgtgtatata

SEQ ID NO: 3921164 - DNA, 20 bp, Homo sapiens
acatgttgtaagcactgact

SEQ ID NO: 3921165 - DNA, 19 bp, Homo sapiens
acatgtttaaattgtaaat

SEQ ID NO: 3921166 - DNA, 21 bp, Homo sapiens
acatgtttatttattctgcat

SEQ ID NO: 3921167 - DNA, 23 bp, Homo sapiens
acatgtttatttattctgcattt

SEQ ID NO: 3921168 - DNA, 23 bp, Homo sapiens
acatgtttttgttttctttgaat

SEQ ID NO: 3921169 - DNA, 12 bp, Homo sapiens
acattaaaagaa

SEQ ID NO: 3921170 - DNA, 13 bp, Homo sapiens
acattaaatgtct

SEQ ID NO: 3921171 - DNA, 13 bp, Homo sapiens
acattaacatcta

SEQ ID NO: 3921172 - DNA, 15 bp, Homo sapiens
acattaagtggcttt

SEQ ID NO: 3921173 - DNA, 19 bp, Homo sapiens
acattacttgcacaagctt

SEQ ID NO: 3921174 - DNA, 18 bp, Homo sapiens
acattagaacactgcatt

SEQ ID NO: 3921175 - DNA, 17 bp, Homo sapiens
acattagtatcccacta

SEQ ID NO: 3921176 - DNA, 15 bp, Homo sapiens
acattatcattcaaa

SEQ ID NO: 3921177 - DNA, 17 bp, Homo sapiens
acattatgctccagaaa

SEQ ID NO: 3921178 - DNA, 14 bp, Homo sapiens
acattatgtgtgca

SEQ ID NO: 3921179 - DNA, 15 bp, Homo sapiens
acattatgtgtgcat

SEQ ID NO: 3921180 - DNA, 21 bp, Homo sapiens
acattatgtgtgcatgtgtgt

SEQ ID NO: 3921181 - DNA, 13 bp, Homo sapiens
acattcaaggcat

SEQ ID NO: 3921182 - DNA, 20 bp, Homo sapiens
acattcacacagggctcttt

SEQ ID NO: 3921183 - DNA, 17 bp, Homo sapiens
acattccaaagaacagc

SEQ ID NO: 3921184 - DNA, 17 bp, Homo sapiens
acattcccatctgtcac

SEQ ID NO: 3921185 - DNA, 18 bp, Homo sapiens
acattccctatcaaaaca

SEQ ID NO: 3921186 - DNA, 20 bp, Homo sapiens
acattccctgcatccaatct

SEQ ID NO: 3921187 - DNA, 15 bp, Homo sapiens
acattccgaagaggg

SEQ ID NO: 3921188 - DNA, 19 bp, Homo sapiens
acattccttgtcaccagca

SEQ ID NO: 3921189 - DNA, 15 bp, Homo sapiens
acattgcctccacct

SEQ ID NO: 3921190 - DNA, 23 bp, Homo sapiens
acattgcctccacctctccttgg

SEQ ID NO: 3921191 - DNA, 13 bp, Homo sapiens
acattggacttcc

SEQ ID NO: 3921192 - DNA, 14 bp, Homo sapiens
acattggacttcct

SEQ ID NO: 3921193 - DNA, 22 bp, Homo sapiens
acattggtatatttccattcat

SEQ ID NO: 3921194 - DNA, 16 bp, Homo sapiens
acattgttaaaataaa

SEQ ID NO: 3921195 - DNA, 14 bp, Homo sapiens
acatttactgacca

SEQ ID NO: 3921196 - DNA, 13 bp, Homo sapiens
acatttatacatc

SEQ ID NO: 3921197 - DNA, 17 bp, Homo sapiens
acatttatatatatatg

SEQ ID NO: 3921198 - DNA, 19 bp, Homo sapiens
acatttatatatatatgta

SEQ ID NO: 3921199 - DNA, 14 bp, Homo sapiens
acatttcaaagctg

SEQ ID NO: 3921200 - DNA, 22 bp, Homo sapiens
acatttcataaggcctgccctc

SEQ ID NO: 3921201 - DNA, 14 bp, Homo sapiens
acatttctaacata

SEQ ID NO: 3921202 - DNA, 19 bp, Homo sapiens
acatttctaacatatgtat

SEQ ID NO: 3921203 - DNA, 21 bp, Homo sapiens
acatttctaacatatgtatta

SEQ ID NO: 3921204 - DNA, 15 bp, Homo sapiens
acatttctctgagca

SEQ ID NO: 3921205 - DNA, 14 bp, Homo sapiens
acatttcttatgat

SEQ ID NO: 3921206 - DNA, 13 bp, Homo sapiens
acatttgccttgc

SEQ ID NO: 3921207 - DNA, 13 bp, Homo sapiens
acatttgttcatg

SEQ ID NO: 3921208 - DNA, 22 bp, Homo sapiens
acattttatttattagctgtaa

SEQ ID NO: 3921209 - DNA, 23 bp, Homo sapiens
acattttatttattagctgtaaa

SEQ ID NO: 3921210 - DNA, 12 bp, Homo sapiens
acattttcattt

SEQ ID NO: 3921211 - DNA, 17 bp, Homo sapiens
acattttctcctaggag

SEQ ID NO: 3921212 - DNA, 21 bp, Homo sapiens
acattttctttctttttctgg

SEQ ID NO: 3921213 - DNA, 23 bp, Homo sapiens
acattttctttctttttctggaa

SEQ ID NO: 3921214 - DNA, 12 bp, Homo sapiens
acatttttacaa

SEQ ID NO: 3921215 - DNA, 20 bp, Homo sapiens
accaaaaaaatacttgagct

SEQ ID NO: 3921216 - DNA, 17 bp, Homo sapiens
accaaaaaagtattttt

SEQ ID NO: 3921217 - DNA, 23 bp, Homo sapiens
accaaagatatatacacaggatc

SEQ ID NO: 3921218 - DNA, 21 bp, Homo sapiens
accaaaggaatcgtttcaaat

SEQ ID NO: 3921219 - DNA, 17 bp, Homo sapiens
accaaatataaacttgt

SEQ ID NO: 3921220 - DNA, 22 bp, Homo sapiens
accaacacccaaagcatggact

SEQ ID NO: 3921221 - DNA, 22 bp, Homo sapiens
accaacatcccattgccctggt

SEQ ID NO: 3921222 - DNA, 16 bp, Homo sapiens
accaacatggagaaac

SEQ ID NO: 3921223 - DNA, 23 bp, Homo sapiens
accaacatggagaaaccctgtct

SEQ ID NO: 3921224 - DNA, 15 bp, Homo sapiens
accaaccaaccaacc

SEQ ID NO: 3921225 - DNA, 22 bp, Homo sapiens
accaacccatcagaaggagaag

SEQ ID NO: 3921226 - DNA, 17 bp, Homo sapiens
accaaccctgtttcctg

SEQ ID NO: 3921227 - DNA, 22 bp, Homo sapiens
accaactctgcactccatggcc

SEQ ID NO: 3921228 - DNA, 14 bp, Homo sapiens
accaactggcttct

SEQ ID NO: 3921229 - DNA, 19 bp, Homo sapiens
accaactggcttctgtgca

SEQ ID NO: 3921230 - DNA, 14 bp, Homo sapiens
accaactttctgta

SEQ ID NO: 3921231 - DNA, 13 bp, Homo sapiens
accaagagagaaa

SEQ ID NO: 3921232 - DNA, 18 bp, Homo sapiens
accaagagccaaaaatga

SEQ ID NO: 3921233 - DNA, 19 bp, Homo sapiens
accaagattggcctgaggc

SEQ ID NO: 3921234 - DNA, 14 bp, Homo sapiens
accaagccgtggct

SEQ ID NO: 3921235 - DNA, 15 bp, Homo sapiens
accaagccgtggctt

SEQ ID NO: 3921236 - DNA, 17 bp, Homo sapiens
accaagccgtggcttcc

SEQ ID NO: 3921237 - DNA, 18 bp, Homo sapiens
accaagccgtggcttccc

SEQ ID NO: 3921238 - DNA, 17 bp, Homo sapiens
accaagctcacagttcc

SEQ ID NO: 3921239 - DNA, 23 bp, Homo sapiens
accaagctgttccacttctctag

SEQ ID NO: 3921240 - DNA, 16 bp, Homo sapiens
accaagcttcagagcc

SEQ ID NO: 3921241 - DNA, 20 bp, Homo sapiens
accaagcttcagagcctagc

SEQ ID NO: 3921242 - DNA, 21 bp, Homo sapiens
accaagcttcagagcctagcc

SEQ ID NO: 3921243 - DNA, 12 bp, Homo sapiens
accaaggcagcc

SEQ ID NO: 3921244 - DNA, 19 bp, Homo sapiens
accaaggtcttcagccatc

SEQ ID NO: 3921245 - DNA, 15 bp, Homo sapiens
accaagtatttatta

SEQ ID NO: 3921246 - DNA, 12 bp, Homo sapiens
accaatcatttt

SEQ ID NO: 3921247 - DNA, 12 bp, Homo sapiens
accaatgcatgc

SEQ ID NO: 3921248 - DNA, 14 bp, Homo sapiens
accaatgtacccac

SEQ ID NO: 3921249 - DNA, 16 bp, Homo sapiens
accattgacctcagct

SEQ ID NO: 3921250 - DNA, 17 bp, Homo sapiens
accattgacctcagctg

SEQ ID NO: 3921251 - DNA, 18 bp, Homo sapiens
accattgacctcagctgc

SEQ ID NO: 3921252 - DNA, 22 bp, Homo sapiens
accattgacctcagctgcacat

SEQ ID NO: 3921253 - DNA, 13 bp, Homo sapiens
accattgtcttcc

SEQ ID NO: 3921254 - DNA, 14 bp, Homo sapiens
accattgtcttcca

SEQ ID NO: 3921255 - DNA, 23 bp, Homo sapiens
accattgtcttccaaccccagct

SEQ ID NO: 3921256 - DNA, 14 bp, Homo sapiens
accatttaacatgc

SEQ ID NO: 3921257 - DNA, 19 bp, Homo sapiens
accatttaattcataatta

SEQ ID NO: 3921258 - DNA, 14 bp, Homo sapiens
accatttcaaatgg

SEQ ID NO: 3921259 - DNA, 23 bp, Homo sapiens
acccaaaagtcaaaaggtgcctg

SEQ ID NO: 3921260 - DNA, 18 bp, Homo sapiens
acccaaagaccaatattc

SEQ ID NO: 3921261 - DNA, 16 bp, Homo sapiens
acccaaagcatggact

SEQ ID NO: 3921262 - DNA, 15 bp, Homo sapiens
acccaaataaatgtg

SEQ ID NO: 3921263 - DNA, 15 bp, Homo sapiens
acccaacagctcaga

SEQ ID NO: 3921264 - DNA, 12 bp, Homo sapiens
acccaaccactc

SEQ ID NO: 3921265 - DNA, 15 bp, Homo sapiens
acccaatgctcctgg

SEQ ID NO: 3921266 - DNA, 23 bp, Homo sapiens
acccacacatgtttacagaactg

SEQ ID NO: 3921267 - DNA, 19 bp, Homo sapiens
acccacagcctctgcctgt

SEQ ID NO: 3921268 - DNA, 17 bp, Homo sapiens
acccaccaaactgcaca

SEQ ID NO: 3921269 - DNA, 19 bp, Homo sapiens
acccaccgggccactcctt

SEQ ID NO: 3921270 - DNA, 16 bp, Homo sapiens
acccacctccaccccc

SEQ ID NO: 3921271 - DNA, 11 bp, Homo sapiens
acccacctgct

SEQ ID NO: 3921272 - DNA, 22 bp, Homo sapiens
acccacctgctgagagacccaa

SEQ ID NO: 3921273 - DNA, 18 bp, Homo sapiens
acccacgaacgctcttag

SEQ ID NO: 3921274 - DNA, 22 bp, Homo sapiens
acccacgtgagagaatctgcct

SEQ ID NO: 3921275 - DNA, 18 bp, Homo sapiens
acccactctcctctgcct

SEQ ID NO: 3921276 - DNA, 14 bp, Homo sapiens
acccactggccagt

SEQ ID NO: 3921277 - DNA, 22 bp, Homo sapiens
acccagaaattccttcccactc

SEQ ID NO: 3921278 - DNA, 23 bp, Homo sapiens
acccagaggaggcagaataagaa

SEQ ID NO: 3921279 - DNA, 15 bp, Homo sapiens
acccagcaacacaga

SEQ ID NO: 3921280 - DNA, 15 bp, Homo sapiens
acccagcatgtacaa

SEQ ID NO: 3921281 - DNA, 19 bp, Homo sapiens
acccagcccattctctctc

SEQ ID NO: 3921282 - DNA, 16 bp, Homo sapiens
acccagccctggggta

SEQ ID NO: 3921283 - DNA, 14 bp, Homo sapiens
acccagctactctg

SEQ ID NO: 3921284 - DNA, 20 bp, Homo sapiens
acccagctactctgtccagg

SEQ ID NO: 3921285 - DNA, 21 bp, Homo sapiens
acccagctactctgtccaggc

SEQ ID NO: 3921286 - DNA, 11 bp, Homo sapiens
acccaggaggt

SEQ ID NO: 3921287 - DNA, 23 bp, Homo sapiens
acccaggaggtggaggttgcagt

SEQ ID NO: 3921288 - DNA, 17 bp, Homo sapiens
acccaggccctccatgg

SEQ ID NO: 3921289 - DNA, 19 bp, Homo sapiens
acccaggccctccatgggc

SEQ ID NO: 3921290 - DNA, 21 bp, Homo sapiens
acccaggccctccatgggcta

SEQ ID NO: 3921291 - DNA, 13 bp, Homo sapiens
acccaggccgcct

SEQ ID NO: 3921292 - DNA, 12 bp, Homo sapiens
acccaggctcca

SEQ ID NO: 3921293 - DNA, 13 bp, Homo sapiens
acccaggctccat

SEQ ID NO: 3921294 - DNA, 16 bp, Homo sapiens
acccaggctccatggg

SEQ ID NO: 3921295 - DNA, 17 bp, Homo sapiens
acccaggctgcactgca

SEQ ID NO: 3921296 - DNA, 20 bp, Homo sapiens
acccagggctccctcctgga

SEQ ID NO: 3921297 - DNA, 21 bp, Homo sapiens
acccagggctccctcctggag

SEQ ID NO: 3921298 - DNA, 14 bp, Homo sapiens
acccaggtctccct

SEQ ID NO: 3921299 - DNA, 17 bp, Homo sapiens
acccagtccccgtgccc

SEQ ID NO: 3921300 - DNA, 21 bp, Homo sapiens
acccagtccccgtgccccgcc

SEQ ID NO: 3921301 - DNA, 13 bp, Homo sapiens
acccagtgctgcc

SEQ ID NO: 3921302 - DNA, 15 bp, Homo sapiens
acccagtgctgccat

SEQ ID NO: 3921303 - DNA, 22 bp, Homo sapiens
acccagtgctgccatgccactg

SEQ ID NO: 3921304 - DNA, 16 bp, Homo sapiens
acccatatatcttatg

SEQ ID NO: 3921305 - DNA, 18 bp, Homo sapiens
acccatcagaaggagaag

SEQ ID NO: 3921306 - DNA, 20 bp, Homo sapiens
acccatcctaccaatgcatg

SEQ ID NO: 3921307 - DNA, 16 bp, Homo sapiens
acccatcttcctgctg

SEQ ID NO: 3921308 - DNA, 14 bp, Homo sapiens
acccatgaatcaaa

SEQ ID NO: 3921309 - DNA, 18 bp, Homo sapiens
acccatgatgagctcctc

SEQ ID NO: 3921310 - DNA, 13 bp, Homo sapiens
acccatgccatag

SEQ ID NO: 3921311 - DNA, 17 bp, Homo sapiens
acccatgtgccaaggtg

SEQ ID NO: 3921312 - DNA, 13 bp, Homo sapiens
acccattcctatt

SEQ ID NO: 3921313 - DNA, 18 bp, Homo sapiens
accccaaagccccttgct

SEQ ID NO: 3921314 - DNA, 17 bp, Homo sapiens
accccaacgcacaggaa

SEQ ID NO: 3921315 - DNA, 13 bp, Homo sapiens
accccaagcagca

SEQ ID NO: 3921316 - DNA, 18 bp, Homo sapiens
accccaagcagcattcag

SEQ ID NO: 3921317 - DNA, 13 bp, Homo sapiens
accccaagggaca

SEQ ID NO: 3921318 - DNA, 12 bp, Homo sapiens
accccaccccct

SEQ ID NO: 3921319 - DNA, 12 bp, Homo sapiens
accccactccag

SEQ ID NO: 3921320 - DNA, 14 bp, Homo sapiens
accccactccagcc

SEQ ID NO: 3921321 - DNA, 16 bp, Homo sapiens
accccactccagccct

SEQ ID NO: 3921322 - DNA, 13 bp, Homo sapiens
accccagagtgtg

SEQ ID NO: 3921323 - DNA, 11 bp, Homo sapiens
accccagctgg

SEQ ID NO: 3921324 - DNA, 14 bp, Homo sapiens
accccagctggcct

SEQ ID NO: 3921325 - DNA, 23 bp, Homo sapiens
accccagctggcctctagaacac

SEQ ID NO: 3921326 - DNA, 15 bp, Homo sapiens
accccaggcatccca

SEQ ID NO: 3921327 - DNA, 17 bp, Homo sapiens
accccaggcatcccatc

SEQ ID NO: 3921328 - DNA, 10 bp, Homo sapiens
accccagggc

SEQ ID NO: 3921329 - DNA, 12 bp, Homo sapiens
accccagggcac

SEQ ID NO: 3921330 - DNA, 15 bp, Homo sapiens
accccagttctgctc

SEQ ID NO: 3921331 - DNA, 17 bp, Homo sapiens
accccagttctgctcct

SEQ ID NO: 3921332 - DNA, 21 bp, Homo sapiens
accccagttctgctcctctcc

SEQ ID NO: 3921333 - DNA, 17 bp, Homo sapiens
accccatccagttcatg

SEQ ID NO: 3921334 - DNA, 11 bp, Homo sapiens
accccatccct

SEQ ID NO: 3921335 - DNA, 14 bp, Homo sapiens
accccatcccttcc

SEQ ID NO: 3921336 - DNA, 14 bp, Homo sapiens
accctgtttcctga

SEQ ID NO: 3921337 - DNA, 15 bp, Homo sapiens
accctgtttcctgag

SEQ ID NO: 3921338 - DNA, 16 bp, Homo sapiens
accctgttttatactg

SEQ ID NO: 3921339 - DNA, 14 bp, Homo sapiens
acccttcagggcca

SEQ ID NO: 3921340 - DNA, 15 bp, Homo sapiens
acccttcagggccag

SEQ ID NO: 3921341 - DNA, 13 bp, Homo sapiens
acccttccagaca

SEQ ID NO: 3921342 - DNA, 22 bp, Homo sapiens
acccttcccaatcagcactgaa

SEQ ID NO: 3921343 - DNA, 14 bp, Homo sapiens
acccttctcttctc

SEQ ID NO: 3921344 - DNA, 15 bp, Homo sapiens
acccttctcttctcc

SEQ ID NO: 3921345 - DNA, 16 bp, Homo sapiens
acccttctttaaatca

SEQ ID NO: 3921346 - DNA, 19 bp, Homo sapiens
acccttctttaaatcaaaa

SEQ ID NO: 3921347 - DNA, 13 bp, Homo sapiens
acccttggacttg

SEQ ID NO: 3921348 - DNA, 20 bp, Homo sapiens
acccttgtaccccatccctt

SEQ ID NO: 3921349 - DNA, 17 bp, Homo sapiens
acccttgtgcttggtgg

SEQ ID NO: 3921350 - DNA, 15 bp, Homo sapiens
accctttatctctgt

SEQ ID NO: 3921351 - DNA, 16 bp, Homo sapiens
accctttatctctgta

SEQ ID NO: 3921352 - DNA, 14 bp, Homo sapiens
accctttccttcct

SEQ ID NO: 3921353 - DNA, 18 bp, Homo sapiens
accctttccttccttccc

SEQ ID NO: 3921354 - DNA, 21 bp, Homo sapiens
accctttccttccttccctgg

SEQ ID NO: 3921355 - DNA, 22 bp, Homo sapiens
accctttccttccttccctggc

SEQ ID NO: 3921356 - DNA, 15 bp, Homo sapiens
acccttttcctccag

SEQ ID NO: 3921357 - DNA, 17 bp, Homo sapiens
accgacgcgtctcctgt

SEQ ID NO: 3921358 - DNA, 20 bp, Homo sapiens
accgagcgctttctggaaaa

SEQ ID NO: 3921359 - DNA, 17 bp, Homo sapiens
accgagtctcttctcca

SEQ ID NO: 3921360 - DNA, 18 bp, Homo sapiens
accgatgtacacacacag

SEQ ID NO: 3921361 - DNA, 12 bp, Homo sapiens
accgcagaagga

SEQ ID NO: 3921362 - DNA, 13 bp, Homo sapiens
accgcagaaggaa

SEQ ID NO: 3921363 - DNA, 21 bp, Homo sapiens
accgccacacacacaggagca

SEQ ID NO: 3921364 - DNA, 14 bp, Homo sapiens
accgcgcatctctt

SEQ ID NO: 3921365 - DNA, 20 bp, Homo sapiens
accgctgccttttgctgctg

SEQ ID NO: 3921366 - DNA, 18 bp, Homo sapiens
accgctggggaacagagc

SEQ ID NO: 3921367 - DNA, 14 bp, Homo sapiens
accgcttcacccct

SEQ ID NO: 3921368 - DNA, 16 bp, Homo sapiens
accgcttcacccctgc

SEQ ID NO: 3921369 - DNA, 17 bp, Homo sapiens
accgcttcacccctgca

SEQ ID NO: 3921370 - DNA, 15 bp, Homo sapiens
accggcgctgcaggt

SEQ ID NO: 3921371 - DNA, 15 bp, Homo sapiens
accgggagcctcccc

SEQ ID NO: 3921372 - DNA, 19 bp, Homo sapiens
accgggatgaacctatcct

SEQ ID NO: 3921373 - DNA, 11 bp, Homo sapiens
accgggcctga

SEQ ID NO: 3921374 - DNA, 16 bp, Homo sapiens
accgggtgggcctggc

SEQ ID NO: 3921375 - DNA, 13 bp, Homo sapiens
accggtacagaaa

SEQ ID NO: 3921376 - DNA, 14 bp, Homo sapiens
accgtaattttatt

SEQ ID NO: 3921377 - DNA, 16 bp, Homo sapiens
accgtaattttattat

SEQ ID NO: 3921378 - DNA, 22 bp, Homo sapiens
accgtcatggcttaatgtttat

SEQ ID NO: 3921379 - DNA, 20 bp, Homo sapiens
accgtcttgggtcgccctac

SEQ ID NO: 3921380 - DNA, 20 bp, Homo sapiens
accgtgatttggaagagagg

SEQ ID NO: 3921381 - DNA, 23 bp, Homo sapiens
accgtgatttggaagagaggcac

SEQ ID NO: 3921382 - DNA, 19 bp, Homo sapiens
accgtggccctgccctctc

SEQ ID NO: 3921383 - DNA, 21 bp, Homo sapiens
accgtggccctgccctctcct

SEQ ID NO: 3921384 - DNA, 16 bp, Homo sapiens
accgtggcccttcctg

SEQ ID NO: 3921385 - DNA, 18 bp, Homo sapiens
accgtggcccttcctgga

SEQ ID NO: 3921386 - DNA, 21 bp, Homo sapiens
accgttttcatcctggcctcc

SEQ ID NO: 3921387 - DNA, 19 bp, Homo sapiens
acctaacgccctatttttg

SEQ ID NO: 3921388 - DNA, 16 bp, Homo sapiens
acctaatcaggctgag

SEQ ID NO: 3921389 - DNA, 21 bp, Homo sapiens
acctacataggcaaattggaa

SEQ ID NO: 3921390 - DNA, 21 bp, Homo sapiens
acctaccaccccttcctgtcc

SEQ ID NO: 3921391 - DNA, 16 bp, Homo sapiens
acctaccaccttccct

SEQ ID NO: 3921392 - DNA, 17 bp, Homo sapiens
acctagaacttcaaaat

SEQ ID NO: 3921393 - DNA, 15 bp, Homo sapiens
acctagacctgggcc

SEQ ID NO: 3921394 - DNA, 13 bp, Homo sapiens
acctagcaattcc

SEQ ID NO: 3921395 - DNA, 19 bp, Homo sapiens
acctagcatcttacaaaaa

SEQ ID NO: 3921396 - DNA, 17 bp, Homo sapiens
acctaggccactcctcc

SEQ ID NO: 3921397 - DNA, 23 bp, Homo sapiens
  misc_feature (6)..(6): n is a, c, g or t
  misc_feature (13)..(13): n is a, c, g or t
acctanccccccnacccccagtg

SEQ ID NO: 3921398 - DNA, 15 bp, Homo sapiens
acctataatgtgtgt

SEQ ID NO: 3921399 - DNA, 16 bp, Homo sapiens
acctataatgtgtgta

SEQ ID NO: 3921400 - DNA, 13 bp, Homo sapiens
acctatatgattt

SEQ ID NO: 3921401 - DNA, 17 bp, Homo sapiens
acctatatgatttatag

SEQ ID NO: 3921402 - DNA, 22 bp, Homo sapiens
acctatggtataatggttgact

SEQ ID NO: 3921403 - DNA, 17 bp, Homo sapiens
acctatgtcctaaggac

SEQ ID NO: 3921404 - DNA, 22 bp, Homo sapiens
acctatgtcctaaggacacact

SEQ ID NO: 3921405 - DNA, 23 bp, Homo sapiens
acctatgtcctaaggacacacta

SEQ ID NO: 3921406 - DNA, 15 bp, Homo sapiens
acctatgtgacagac

SEQ ID NO: 3921407 - DNA, 15 bp, Homo sapiens
acctcaatgccctgc

SEQ ID NO: 3921408 - DNA, 16 bp, Homo sapiens
acctcaatgccctgcc

SEQ ID NO: 3921409 - DNA, 17 bp, Homo sapiens
acctcaatgccctgcca

SEQ ID NO: 3921410 - DNA, 15 bp, Homo sapiens
acctcacagtgaccc

SEQ ID NO: 3921411 - DNA, 20 bp, Homo sapiens
acctcacagtgacccttccc

SEQ ID NO: 3921412 - DNA, 21 bp, Homo sapiens
acctcacagtgacccttccca

SEQ ID NO: 3921413 - DNA, 16 bp, Homo sapiens
acctcactatggtatg

SEQ ID NO: 3921414 - DNA, 24 bp, Homo sapiens
acctcactatggtatgctggccag

SEQ ID NO: 3921415 - DNA, 18 bp, Homo sapiens
acctcagacaatccactc

SEQ ID NO: 3921416 - DNA, 14 bp, Homo sapiens
acctcagccaaaca

SEQ ID NO: 3921417 - DNA, 16 bp, Homo sapiens
acctcagccaaacaca

SEQ ID NO: 3921418 - DNA, 17 bp, Homo sapiens
acctcagccaaacacag

SEQ ID NO: 3921419 - DNA, 22 bp, Homo sapiens
acctcagccatgaggagttgct

SEQ ID NO: 3921420 - DNA, 23 bp, Homo sapiens
acctcagcctcccagagtgctag

SEQ ID NO: 3921421 - DNA, 14 bp, Homo sapiens
acctcagccttgga

SEQ ID NO: 3921422 - DNA, 18 bp, Homo sapiens
acctcagctgcacattcc

SEQ ID NO: 3921423 - DNA, 13 bp, Homo sapiens
tgccccctcatct

SEQ ID NO: 3921424 - DNA, 23 bp, Homo sapiens
tgccccgttccctgtcagaggct

SEQ ID NO: 3921425 - DNA, 18 bp, Homo sapiens
tgcccctccagagacagg

SEQ ID NO: 3921426 - DNA, 21 bp, Homo sapiens
tgccccttcccatctcttcct

SEQ ID NO: 3921427 - DNA, 18 bp, Homo sapiens
tgccccttgggcatccac

SEQ ID NO: 3921428 - DNA, 13 bp, Homo sapiens
tgcccgccagcct

SEQ ID NO: 3921429 - DNA, 16 bp, Homo sapiens
tgcccgccagcctcag

SEQ ID NO: 3921430 - DNA, 12 bp, Homo sapiens
tgcccgcctagg

SEQ ID NO: 3921431 - DNA, 14 bp, Homo sapiens
tgccctcatttgtg

SEQ ID NO: 3921432 - DNA, 12 bp, Homo sapiens
tgccctccctgg

SEQ ID NO: 3921433 - DNA, 14 bp, Homo sapiens
tgccctccctgggg

SEQ ID NO: 3921434 - DNA, 21 bp, Homo sapiens
tgccctccctggggtccttgc

SEQ ID NO: 3921435 - DNA, 21 bp, Homo sapiens
tgccctctccttccttaccca

SEQ ID NO: 3921436 - DNA, 18 bp, Homo sapiens
tgccctgacccctgcacc

SEQ ID NO: 3921437 - DNA, 17 bp, Homo sapiens
tgccctgacctcccagc

SEQ ID NO: 3921438 - DNA, 22 bp, Homo sapiens
tgccctgacctcccagccctat

SEQ ID NO: 3921439 - DNA, 22 bp, Homo sapiens
tgccctgagtggatctccaagg

SEQ ID NO: 3921440 - DNA, 15 bp, Homo sapiens
tgccctgccacctgt

SEQ ID NO: 3921441 - DNA, 16 bp, Homo sapiens
tgccctgcccccacga

SEQ ID NO: 3921442 - DNA, 11 bp, Homo sapiens
tgccctgcctg

SEQ ID NO: 3921443 - DNA, 17 bp, Homo sapiens
tgccctgcctgcccact

SEQ ID NO: 3921444 - DNA, 18 bp, Homo sapiens
tgccctgcctgcccactt

SEQ ID NO: 3921445 - DNA, 13 bp, Homo sapiens
tgccctgccttca

SEQ ID NO: 3921446 - DNA, 23 bp, Homo sapiens
tgccctgcgaagtggctctcagg

SEQ ID NO: 3921447 - DNA, 21 bp, Homo sapiens
tgccctgctgccgcctcccag

SEQ ID NO: 3921448 - DNA, 15 bp, Homo sapiens
tgccctggagggagg

SEQ ID NO: 3921449 - DNA, 12 bp, Homo sapiens
tgccctggtgct

SEQ ID NO: 3921450 - DNA, 17 bp, Homo sapiens
tgccctgtaacttatct

SEQ ID NO: 3921451 - DNA, 20 bp, Homo sapiens
tgccctgtggattccagcat

SEQ ID NO: 3921452 - DNA, 20 bp, Homo sapiens
tgccctgttaaaagatgaaa

SEQ ID NO: 3921453 - DNA, 19 bp, Homo sapiens
tgccctgttgtgtatagat

SEQ ID NO: 3921454 - DNA, 14 bp, Homo sapiens
tgcccttgccctga

SEQ ID NO: 3921455 - DNA, 18 bp, Homo sapiens
tgcccttgccctgacctc

SEQ ID NO: 3921456 - DNA, 11 bp, Homo sapiens
tgcccttgggg

SEQ ID NO: 3921457 - DNA, 23 bp, Homo sapiens
tgcccttttcatctccagtgtga

SEQ ID NO: 3921458 - DNA, 21 bp, Homo sapiens
tgccgaccagagccccacacg

SEQ ID NO: 3921459 - DNA, 22 bp, Homo sapiens
tgccgaccagagccccacacgg

SEQ ID NO: 3921460 - DNA, 22 bp, Homo sapiens
tgccgacctcgtcctccccctg

SEQ ID NO: 3921461 - DNA, 16 bp, Homo sapiens
tgccgagcctaatgaa

SEQ ID NO: 3921462 - DNA, 17 bp, Homo sapiens
tgccgagcctaatgaaa

SEQ ID NO: 3921463 - DNA, 13 bp, Homo sapiens
tgccgcaccccag

SEQ ID NO: 3921464 - DNA, 15 bp, Homo sapiens
tgccgcaccccagag

SEQ ID NO: 3921465 - DNA, 18 bp, Homo sapiens
tgccgcaccccagagtgt

SEQ ID NO: 3921466 - DNA, 16 bp, Homo sapiens
tgccgcctcaatgtgg

SEQ ID NO: 3921467 - DNA, 16 bp, Homo sapiens
tgccgcctcccagcct

SEQ ID NO: 3921468 - DNA, 17 bp, Homo sapiens
tgccgcctcccagcctg

SEQ ID NO: 3921469 - DNA, 14 bp, Homo sapiens
tgccgggttttata

SEQ ID NO: 3921470 - DNA, 22 bp, Homo sapiens
tgccgttactctccaacctgga

SEQ ID NO: 3921471 - DNA, 18 bp, Homo sapiens
tgcctaattcctggcatg

SEQ ID NO: 3921472 - DNA, 17 bp, Homo sapiens
tgcctaggaattcccag

SEQ ID NO: 3921473 - DNA, 13 bp, Homo sapiens
tgcctaggccaaa

SEQ ID NO: 3921474 - DNA, 16 bp, Homo sapiens
tgcctatccatcctgc

SEQ ID NO: 3921475 - DNA, 15 bp, Homo sapiens
tgcctatttattcat

SEQ ID NO: 3921476 - DNA, 15 bp, Homo sapiens
tgcctatttattggg

SEQ ID NO: 3921477 - DNA, 23 bp, Homo sapiens
tgcctatttattggggatctgca

SEQ ID NO: 3921478 - DNA, 23 bp, Homo sapiens
tgcctcaatgtgaatcagaccct

SEQ ID NO: 3921479 - DNA, 18 bp, Homo sapiens
tgcctcaatgtgaccagg

SEQ ID NO: 3921480 - DNA, 19 bp, Homo sapiens
tgcctcaatgtgaccaggg

SEQ ID NO: 3921481 - DNA, 23 bp, Homo sapiens
tgcctcaatgtgaccaggggtga

SEQ ID NO: 3921482 - DNA, 15 bp, Homo sapiens
tgcctcatgccacac

SEQ ID NO: 3921483 - DNA, 14 bp, Homo sapiens
tgcctccctttctg

SEQ ID NO: 3921484 - DNA, 24 bp, Homo sapiens
tgcctcctcacccccagctttgct

SEQ ID NO: 3921485 - DNA, 17 bp, Homo sapiens
tggaattgggagcttgg

SEQ ID NO: 3921486 - DNA, 11 bp, Homo sapiens
tggacaaccca

SEQ ID NO: 3921487 - DNA, 13 bp, Homo sapiens
tggacaagaagct

SEQ ID NO: 3921488 - DNA, 13 bp, Homo sapiens
tggacaaggaggt

SEQ ID NO: 3921489 - DNA, 17 bp, Homo sapiens
tggacacagtgttccag

SEQ ID NO: 3921490 - DNA, 15 bp, Homo sapiens
tggacacctgccctg

SEQ ID NO: 3921491 - DNA, 16 bp, Homo sapiens
tggacagaatgatgga

SEQ ID NO: 3921492 - DNA, 23 bp, Homo sapiens
tggacaggactaacactcagaag

SEQ ID NO: 3921493 - DNA, 14 bp, Homo sapiens
tggacagtctgagc

SEQ ID NO: 3921494 - DNA, 18 bp, Homo sapiens
tggacatttgccttgctg

SEQ ID NO: 3921495 - DNA, 18 bp, Homo sapiens
tggaccaggacaggacca

SEQ ID NO: 3921496 - DNA, 16 bp, Homo sapiens
tggaccagtagacaac

SEQ ID NO: 3921497 - DNA, 14 bp, Homo sapiens
tggacccagacaca

SEQ ID NO: 3921498 - DNA, 15 bp, Homo sapiens
tggacccctcccttg

SEQ ID NO: 3921499 - DNA, 18 bp, Homo sapiens
tggacccctcccttgctc

SEQ ID NO: 3921500 - DNA, 16 bp, Homo sapiens
tggaccctcgcagcag

SEQ ID NO: 3921501 - DNA, 19 bp, Homo sapiens
tggaccgcttcccagaggc

SEQ ID NO: 3921502 - DNA, 16 bp, Homo sapiens
tggaccgggtgggcct

SEQ ID NO: 3921503 - DNA, 19 bp, Homo sapiens
tggaccgggtgggcctggc

SEQ ID NO: 3921504 - DNA, 15 bp, Homo sapiens
tggacctctgctctg

SEQ ID NO: 3921505 - DNA, 18 bp, Homo sapiens
tggacctctgcttcccca

SEQ ID NO: 3921506 - DNA, 18 bp, Homo sapiens
tggacctgagtcggcccc

SEQ ID NO: 3921507 - DNA, 14 bp, Homo sapiens
tggactcctcccac

SEQ ID NO: 3921508 - DNA, 16 bp, Homo sapiens
tggactcctcccacaa

SEQ ID NO: 3921509 - DNA, 11 bp, Homo sapiens
tggactgacta

SEQ ID NO: 3921510 - DNA, 23 bp, Homo sapiens
tggactgggttttgtctctgcat

SEQ ID NO: 3921511 - DNA, 18 bp, Homo sapiens
tggacttgaggattttga

SEQ ID NO: 3921512 - DNA, 14 bp, Homo sapiens
tggactttgttcac

SEQ ID NO: 3921513 - DNA, 19 bp, Homo sapiens
tggacttttgggggttgga

SEQ ID NO: 3921514 - DNA, 11 bp, Homo sapiens
tggagaaatta

SEQ ID NO: 3921515 - DNA, 15 bp, Homo sapiens
tggagaaattattta

SEQ ID NO: 3921516 - DNA, 21 bp, Homo sapiens
tggagaactagaacctggagg

SEQ ID NO: 3921517 - DNA, 11 bp, Homo sapiens
tggagaaggaa

SEQ ID NO: 3921518 - DNA, 22 bp, Homo sapiens
tggagaagtgtcgttttcataa

SEQ ID NO: 3921519 - DNA, 14 bp, Homo sapiens
tggagaattatata

SEQ ID NO: 3921520 - DNA, 19 bp, Homo sapiens
tggagacagtagaggcatg

SEQ ID NO: 3921521 - DNA, 19 bp, Homo sapiens
tggagaccgcttcacccct

SEQ ID NO: 3921522 - DNA, 21 bp, Homo sapiens
tggagaccgcttcacccctgc

SEQ ID NO: 3921523 - DNA, 13 bp, Homo sapiens
tggagactcctgc

SEQ ID NO: 3921524 - DNA, 19 bp, Homo sapiens
tggagactcctgccctgtt

SEQ ID NO: 3921525 - DNA, 19 bp, Homo sapiens
tggagactggtcctgtgtg

SEQ ID NO: 3921526 - DNA, 13 bp, Homo sapiens
tggagagagggga

SEQ ID NO: 3921527 - DNA, 20 bp, Homo sapiens
tggagagcagctggctctcc

SEQ ID NO: 3921528 - DNA, 20 bp, Homo sapiens
tggagagccagaacctggag

SEQ ID NO: 3921529 - DNA, 20 bp, Homo sapiens
tggagagccctgggaccgct

SEQ ID NO: 3921530 - DNA, 22 bp, Homo sapiens
tggagagctagaacctggagag

SEQ ID NO: 3921531 - DNA, 21 bp, Homo sapiens
tggagagctagaacctggagg

SEQ ID NO: 3921532 - DNA, 17 bp, Homo sapiens
tggagagctaggagcaa

SEQ ID NO: 3921533 - DNA, 15 bp, Homo sapiens
tggagaggcggcctc

SEQ ID NO: 3921534 - DNA, 17 bp, Homo sapiens
tggagagggacgaagaa

SEQ ID NO: 3921535 - DNA, 20 bp, Homo sapiens
tggagagggacgaagaaagg

SEQ ID NO: 3921536 - DNA, 23 bp, Homo sapiens
tggagatatttatggggggagaa

SEQ ID NO: 3921537 - DNA, 19 bp, Homo sapiens
tggagatcctaactgagaa

SEQ ID NO: 3921538 - DNA, 13 bp, Homo sapiens
tggagatgatgat

SEQ ID NO: 3921539 - DNA, 14 bp, Homo sapiens
tggagatgatgatg

SEQ ID NO: 3921540 - DNA, 16 bp, Homo sapiens
tggagatgatgatgat

SEQ ID NO: 3921541 - DNA, 15 bp, Homo sapiens
tggagcaagaaggaa

SEQ ID NO: 3921542 - DNA, 22 bp, Homo sapiens
tggagcagtacatgggaaagga

SEQ ID NO: 3921543 - DNA, 15 bp, Homo sapiens
tggagcatctgactc

SEQ ID NO: 3921544 - DNA, 16 bp, Homo sapiens
tggagcatctgactca

SEQ ID NO: 3921545 - DNA, 11 bp, Homo sapiens
tggagccactc

SEQ ID NO: 3921546 - DNA, 16 bp, Homo sapiens
tggagccactcctgtc

SEQ ID NO: 3921547 - DNA, 17 bp, Homo sapiens
tggagccactcctgtcc

SEQ ID NO: 3921548 - DNA, 18 bp, Homo sapiens
tggagccactcctgtccc

SEQ ID NO: 3921549 - DNA, 23 bp, Homo sapiens
tggagccactcctgtcccgcctt

SEQ ID NO: 3921550 - DNA, 11 bp, Homo sapiens
tggagccagag

SEQ ID NO: 3921551 - DNA, 13 bp, Homo sapiens
tggagccagagag

SEQ ID NO: 3921552 - DNA, 18 bp, Homo sapiens
tggagcctggcacaggac

SEQ ID NO: 3921553 - DNA, 23 bp, Homo sapiens
tggagctcttggaagagctcttc

SEQ ID NO: 3921554 - DNA, 18 bp, Homo sapiens
tggagcttgtacatattg

SEQ ID NO: 3921555 - DNA, 22 bp, Homo sapiens
tggagctttagcttctctgcca

SEQ ID NO: 3921556 - DNA, 14 bp, Homo sapiens
tggaggaaggtgct

SEQ ID NO: 3921557 - DNA, 18 bp, Homo sapiens
tggaggaaggtgctgagc

SEQ ID NO: 3921558 - DNA, 19 bp, Homo sapiens
tggaggaaggtgctgagct

SEQ ID NO: 3921559 - DNA, 21 bp, Homo sapiens
tggaggactagaacctggagg

SEQ ID NO: 3921560 - DNA, 17 bp, Homo sapiens
tggaggagaaataaact

SEQ ID NO: 3921561 - DNA, 22 bp, Homo sapiens
tggaggagcttgggggatgact

SEQ ID NO: 3921562 - DNA, 16 bp, Homo sapiens
tggaggaggaggagga

SEQ ID NO: 3921563 - DNA, 20 bp, Homo sapiens
tggaggatggagagagggga

SEQ ID NO: 3921564 - DNA, 14 bp, Homo sapiens
tggaggccaacaaa

SEQ ID NO: 3921565 - DNA, 19 bp, Homo sapiens
tggaggcctgatgctgccc

SEQ ID NO: 3921566 - DNA, 12 bp, Homo sapiens
tggaggctgctc

SEQ ID NO: 3921567 - DNA, 16 bp, Homo sapiens
tggagggaagacaggt

SEQ ID NO: 3921568 - DNA, 22 bp, Homo sapiens
tggagggcaaggggtttccaca

SEQ ID NO: 3921569 - DNA, 22 bp, Homo sapiens
tggagggctagaacctggagaa

SEQ ID NO: 3921570 - DNA, 20 bp, Homo sapiens
tggagggctagaactggaga

SEQ ID NO: 3921571 - DNA, 12 bp, Homo sapiens
tggagggctgga

SEQ ID NO: 3921572 - DNA, 23 bp, Homo sapiens
tggcgcgggaggcaccagctctg

SEQ ID NO: 3921573 - DNA, 15 bp, Homo sapiens
tggcggctactcagc

SEQ ID NO: 3921574 - DNA, 22 bp, Homo sapiens
tggcggctactcagcagccctc

SEQ ID NO: 3921575 - DNA, 23 bp, Homo sapiens
tggcggctactcagcagccctcc

SEQ ID NO: 3921576 - DNA, 18 bp, Homo sapiens
tggcggcttcctgtccac

SEQ ID NO: 3921577 - DNA, 17 bp, Homo sapiens
tggcgggcgcctgtagt

SEQ ID NO: 3921578 - DNA, 12 bp, Homo sapiens
tggcggggcagg

SEQ ID NO: 3921579 - DNA, 13 bp, Homo sapiens
tggcggtgcctgg

SEQ ID NO: 3921580 - DNA, 18 bp, Homo sapiens
tggcgtaatgggcctgcc

SEQ ID NO: 3921581 - DNA, 16 bp, Homo sapiens
tggctaattcaattta

SEQ ID NO: 3921582 - DNA, 22 bp, Homo sapiens
tggctactctgtgccagagcct

SEQ ID NO: 3921583 - DNA, 16 bp, Homo sapiens
tggctagtcagagaga

SEQ ID NO: 3921584 - DNA, 13 bp, Homo sapiens
tggctataaatat

SEQ ID NO: 3921585 - DNA, 17 bp, Homo sapiens
tggctatcctagagagg

SEQ ID NO: 3921586 - DNA, 19 bp, Homo sapiens
tggctatcctagagaggct

SEQ ID NO: 3921587 - DNA, 23 bp, Homo sapiens
tggctatctgcatttataaatgt

SEQ ID NO: 3921588 - DNA, 21 bp, Homo sapiens
tggctcaggaagaaaccccaa

SEQ ID NO: 3921589 - DNA, 13 bp, Homo sapiens
tggctcaggcaga

SEQ ID NO: 3921590 - DNA, 23 bp, Homo sapiens
tggctcatggcgtaatgggcctg

SEQ ID NO: 3921591 - DNA, 17 bp, Homo sapiens
tggctcccacaggccct

SEQ ID NO: 3921592 - DNA, 17 bp, Homo sapiens
tggctcctgtttccatg

SEQ ID NO: 3921593 - DNA, 14 bp, Homo sapiens
tggctctgcaatgg

SEQ ID NO: 3921594 - DNA, 14 bp, Homo sapiens
tggctcttcacctg

SEQ ID NO: 3921595 - DNA, 20 bp, Homo sapiens
tggctgaccccaaagagcct

SEQ ID NO: 3921596 - DNA, 18 bp, Homo sapiens
tgaatttattattgttct

SEQ ID NO: 3921597 - DNA, 13 bp, Homo sapiens
tgaatttcaggca

SEQ ID NO: 3921598 - DNA, 21 bp, Homo sapiens
tgaatttcttcactgttgaaa

SEQ ID NO: 3921599 - DNA, 18 bp, Homo sapiens
tgacaaaatttgttgaaa

SEQ ID NO: 3921600 - DNA, 18 bp, Homo sapiens
tgacaaattgtaactaca

SEQ ID NO: 3921601 - DNA, 13 bp, Homo sapiens
tgacaacagaagc

SEQ ID NO: 3921602 - DNA, 14 bp, Homo sapiens
tgacaacagaagct

SEQ ID NO: 3921603 - DNA, 16 bp, Homo sapiens
tgacaacagactgaat

SEQ ID NO: 3921604 - DNA, 19 bp, Homo sapiens
tgacaacatcccacagtgg

SEQ ID NO: 3921605 - DNA, 19 bp, Homo sapiens
tgacaagatggaaaataaa

SEQ ID NO: 3921606 - DNA, 13 bp, Homo sapiens
tgacaagtggagg

SEQ ID NO: 3921607 - DNA, 14 bp, Homo sapiens
tgacaataatttca

SEQ ID NO: 3921608 - DNA, 17 bp, Homo sapiens
tgacaataatttcaggt

SEQ ID NO: 3921609 - DNA, 15 bp, Homo sapiens
tgacaatatgatttt

SEQ ID NO: 3921610 - DNA, 13 bp, Homo sapiens
tgacacacagcag

SEQ ID NO: 3921611 - DNA, 23 bp, Homo sapiens
tgacacacgtatttatatttgga

SEQ ID NO: 3921612 - DNA, 18 bp, Homo sapiens
tgacacggtaggccaagc

SEQ ID NO: 3921613 - DNA, 17 bp, Homo sapiens
tgacacggtgaaatcca

SEQ ID NO: 3921614 - DNA, 18 bp, Homo sapiens
tgacacggtgaaatccag

SEQ ID NO: 3921615 - DNA, 19 bp, Homo sapiens
tgacagatacatagatgga

SEQ ID NO: 3921616 - DNA, 20 bp, Homo sapiens
tgacagatacatagatggac

SEQ ID NO: 3921617 - DNA, 22 bp, Homo sapiens
tgacagatgtcagccgagccgg

SEQ ID NO: 3921618 - DNA, 14 bp, Homo sapiens
tgacagctgtccct

SEQ ID NO: 3921619 - DNA, 17 bp, Homo sapiens
tgacagctgtccctgtc

SEQ ID NO: 3921620 - DNA, 18 bp, Homo sapiens
tgacagctgtccctgtca

SEQ ID NO: 3921621 - DNA, 20 bp, Homo sapiens
tgacagctgtccctgtcacc

SEQ ID NO: 3921622 - DNA, 17 bp, Homo sapiens
tgacaggaaagccctcc

SEQ ID NO: 3921623 - DNA, 12 bp, Homo sapiens
tgacagtatatt

SEQ ID NO: 3921624 - DNA, 21 bp, Homo sapiens
tgacagtatatttgaaactgt

SEQ ID NO: 3921625 - DNA, 21 bp, Homo sapiens
tgacagttactcttcagtttt

SEQ ID NO: 3921626 - DNA, 17 bp, Homo sapiens
tgacataacactataaa

SEQ ID NO: 3921627 - DNA, 13 bp, Homo sapiens
tgacatcacttgt

SEQ ID NO: 3921628 - DNA, 22 bp, Homo sapiens
tgacatcacttgtacaaaataa

SEQ ID NO: 3921629 - DNA, 20 bp, Homo sapiens
tgacatcccaggaggggcct

SEQ ID NO: 3921630 - DNA, 19 bp, Homo sapiens
tgacatctcctctatcaca

SEQ ID NO: 3921631 - DNA, 11 bp, Homo sapiens
tgacatgcact

SEQ ID NO: 3921632 - DNA, 15 bp, Homo sapiens
tgacatgcactgacc

SEQ ID NO: 3921633 - DNA, 19 bp, Homo sapiens
tgacatgcactgacccttc

SEQ ID NO: 3921634 - DNA, 21 bp, Homo sapiens
tgacatgcactgacccttcca

SEQ ID NO: 3921635 - DNA, 17 bp, Homo sapiens
tgacatgcatcatctca

SEQ ID NO: 3921636 - DNA, 20 bp, Homo sapiens
tgacatgccaccctctccat

SEQ ID NO: 3921637 - DNA, 18 bp, Homo sapiens
tgacattccttgtcacca

SEQ ID NO: 3921638 - DNA, 18 bp, Homo sapiens
tgacattgtagagcttct

SEQ ID NO: 3921639 - DNA, 22 bp, Homo sapiens
tgacatttccttctttgtctta

SEQ ID NO: 3921640 - DNA, 17 bp, Homo sapiens
tgacatttctaacatat

SEQ ID NO: 3921641 - DNA, 18 bp, Homo sapiens
tgacattttaaaaaacaa

SEQ ID NO: 3921642 - DNA, 18 bp, Homo sapiens
tgaccaacaggctgttct

SEQ ID NO: 3921643 - DNA, 17 bp, Homo sapiens
tgaccaacatggagaaa

SEQ ID NO: 3921644 - DNA, 18 bp, Homo sapiens
tgaccaacatggagaaac

SEQ ID NO: 3921645 - DNA, 23 bp, Homo sapiens
tgaccaacatggagaaaccctgt

SEQ ID NO: 3921646 - DNA, 16 bp, Homo sapiens
tgaccaagaaaaagaa

SEQ ID NO: 3921647 - DNA, 23 bp, Homo sapiens
tgaccacacgctgtctcttgaga

SEQ ID NO: 3921648 - DNA, 22 bp, Homo sapiens
tgaccacggacgtttccatcag

SEQ ID NO: 3921649 - DNA, 17 bp, Homo sapiens
tgaccacgggcctcagt

SEQ ID NO: 3921650 - DNA, 18 bp, Homo sapiens
tgaccacgggcctcagtt

SEQ ID NO: 3921651 - DNA, 22 bp, Homo sapiens
tgaccacgggcctcagtttccc

SEQ ID NO: 3921652 - DNA, 23 bp, Homo sapiens
tgaccacgggcctcagtttcccc

SEQ ID NO: 3921653 - DNA, 19 bp, Homo sapiens
tgaccagacctagacctgg

SEQ ID NO: 3921654 - DNA, 20 bp, Homo sapiens
tgaccagacctagacctggg

SEQ ID NO: 3921655 - DNA, 22 bp, Homo sapiens
tgaccagacctagacctgggcc

SEQ ID NO: 3921656 - DNA, 23 bp, Homo sapiens
tgaccagcctccatgctgcctcc

SEQ ID NO: 3921657 - DNA, 22 bp, Homo sapiens
tgaccaggggtgatttcagaga

SEQ ID NO: 3921658 - DNA, 19 bp, Homo sapiens
tgaccatcgtccttcctct

SEQ ID NO: 3921659 - DNA, 22 bp, Homo sapiens
tgaccatctcttaggtctaatg

SEQ ID NO: 3921660 - DNA, 14 bp, Homo sapiens
tgacccacatgcca

SEQ ID NO: 3921661 - DNA, 14 bp, Homo sapiens
tgacccacccagtg

SEQ ID NO: 3921662 - DNA, 20 bp, Homo sapiens
tctggaaaactcaggattct

SEQ ID NO: 3921663 - DNA, 13 bp, Homo sapiens
tctggaaaagagg

SEQ ID NO: 3921664 - DNA, 18 bp, Homo sapiens
tctggaaaatgtgaccca

SEQ ID NO: 3921665 - DNA, 14 bp, Homo sapiens
tctggaaagggcac

SEQ ID NO: 3921666 - DNA, 9 bp, Homo sapiens
tctggaaat

SEQ ID NO: 3921667 - DNA, 14 bp, Homo sapiens
tctggaaattttgt

SEQ ID NO: 3921668 - DNA, 13 bp, Homo sapiens
tctggaagagagg

SEQ ID NO: 3921669 - DNA, 13 bp, Homo sapiens
tctggaagctgag

SEQ ID NO: 3921670 - DNA, 16 bp, Homo sapiens
tctggaagctgagcag

SEQ ID NO: 3921671 - DNA, 18 bp, Homo sapiens
tctggaaggctggctgag

SEQ ID NO: 3921672 - DNA, 22 bp, Homo sapiens
tctggaatacatgaaatataga

SEQ ID NO: 3921673 - DNA, 13 bp, Homo sapiens
tctggacctcccc

SEQ ID NO: 3921674 - DNA, 15 bp, Homo sapiens
tctggactcctctgt

SEQ ID NO: 3921675 - DNA, 16 bp, Homo sapiens
tctggagaagcagtga

SEQ ID NO: 3921676 - DNA, 21 bp, Homo sapiens
tctggagagctagaacctgga

SEQ ID NO: 3921677 - DNA, 12 bp, Homo sapiens
tctggagcaaga

SEQ ID NO: 3921678 - DNA, 13 bp, Homo sapiens
tctggagccagag

SEQ ID NO: 3921679 - DNA, 17 bp, Homo sapiens
tctggaggctgcagagc

SEQ ID NO: 3921680 - DNA, 24 bp, Homo sapiens
tctggaggctgcagagctgaccca

SEQ ID NO: 3921681 - DNA, 22 bp, Homo sapiens
tctggataccagatatttgaat

SEQ ID NO: 3921682 - DNA, 15 bp, Homo sapiens
tctggatccctggag

SEQ ID NO: 3921683 - DNA, 19 bp, Homo sapiens
tctggatcctgctgtggcc

SEQ ID NO: 3921684 - DNA, 23 bp, Homo sapiens
tctggatcctgctgtggcctcac

SEQ ID NO: 3921685 - DNA, 18 bp, Homo sapiens
tctggatggcaccagagg

SEQ ID NO: 3921686 - DNA, 19 bp, Homo sapiens
tctggatggcaccagaggc

SEQ ID NO: 3921687 - DNA, 12 bp, Homo sapiens
tctggcagccac

SEQ ID NO: 3921688 - DNA, 22 bp, Homo sapiens
tctggcagccacacttctcagg

SEQ ID NO: 3921689 - DNA, 20 bp, Homo sapiens
tctggcagggtgggatggag

SEQ ID NO: 3921690 - DNA, 19 bp, Homo sapiens
tctggccaggagctggagg

SEQ ID NO: 3921691 - DNA, 14 bp, Homo sapiens
tctggccctgcctt

SEQ ID NO: 3921692 - DNA, 19 bp, Homo sapiens
tctggcggcttcctgtcca

SEQ ID NO: 3921693 - DNA, 21 bp, Homo sapiens
tctggctgagctgaacccatt

SEQ ID NO: 3921694 - DNA, 22 bp, Homo sapiens
tctggcttccaggtatctccag

SEQ ID NO: 3921695 - DNA, 23 bp, Homo sapiens
tctggctttctccgactgctagg

SEQ ID NO: 3921696 - DNA, 23 bp, Homo sapiens
tctggctttgtctctagccgggc

SEQ ID NO: 3921697 - DNA, 14 bp, Homo sapiens
tctgggaagggaag

SEQ ID NO: 3921698 - DNA, 17 bp, Homo sapiens
tctgggatggaccctcg

SEQ ID NO: 3921699 - DNA, 15 bp, Homo sapiens
tctgggatgtagaac

SEQ ID NO: 3921700 - DNA, 12 bp, Homo sapiens
tctgggcagctg

SEQ ID NO: 3921701 - DNA, 14 bp, Homo sapiens
tctgggcccccact

SEQ ID NO: 3921702 - DNA, 15 bp, Homo sapiens
tctgggcccccactt

SEQ ID NO: 3921703 - DNA, 17 bp, Homo sapiens
tctgggctcagggctgg

SEQ ID NO: 3921704 - DNA, 18 bp, Homo sapiens
tctgggctcagggctgga

SEQ ID NO: 3921705 - DNA, 20 bp, Homo sapiens
tctgggctcagggctggagt

SEQ ID NO: 3921706 - DNA, 13 bp, Homo sapiens
tctggggaggaag

SEQ ID NO: 3921707 - DNA, 15 bp, Homo sapiens
tctggggccctgggc

SEQ ID NO: 3921708 - DNA, 16 bp, Homo sapiens
tctggggccctgggcc

SEQ ID NO: 3921709 - DNA, 17 bp, Homo sapiens
tctggggttcagcccct

SEQ ID NO: 3921710 - DNA, 19 bp, Homo sapiens
tctggggttcagcccctcc

SEQ ID NO: 3921711 - DNA, 23 bp, Homo sapiens
tctggggttcagcccctcctctg

SEQ ID NO: 3921712 - DNA, 16 bp, Homo sapiens
tctgggtccctcggag

SEQ ID NO: 3921713 - DNA, 20 bp, Homo sapiens
tctggtagatttttaacgaa

SEQ ID NO: 3921714 - DNA, 21 bp, Homo sapiens
tctggtggccgatcggggcac

SEQ ID NO: 3921715 - DNA, 12 bp, Homo sapiens
tctggttgcttc

SEQ ID NO: 3921716 - DNA, 15 bp, Homo sapiens
tctgtaaactcaaaa

SEQ ID NO: 3921717 - DNA, 18 bp, Homo sapiens
tctgtaaactcaaaactt

SEQ ID NO: 3921718 - DNA, 18 bp, Homo sapiens
tctgtaattctattgtgc

SEQ ID NO: 3921719 - DNA, 14 bp, Homo sapiens
tctgtaatttttca

SEQ ID NO: 3921720 - DNA, 16 bp, Homo sapiens
tctgtacaaaaacaaa

SEQ ID NO: 3921721 - DNA, 18 bp, Homo sapiens
tctgtaccttgcagccat

SEQ ID NO: 3921722 - DNA, 15 bp, Homo sapiens
tctgtagggctggac

SEQ ID NO: 3921723 - DNA, 16 bp, Homo sapiens
tctgtagggctggacc

SEQ ID NO: 3921724 - DNA, 17 bp, Homo sapiens
tctgtagggctggacct

SEQ ID NO: 3921725 - DNA, 22 bp, Homo sapiens
tctgtataaaatgcaaaataaa

SEQ ID NO: 3921726 - DNA, 21 bp, Homo sapiens
tctgtataaacattaaatgtc

SEQ ID NO: 3921727 - DNA, 20 bp, Homo sapiens
tctgtatttaatggttttta

SEQ ID NO: 3921728 - DNA, 19 bp, Homo sapiens
tctgtcaccagctatctgt

SEQ ID NO: 3921729 - DNA, 14 bp, Homo sapiens
tctgtcacgtgaaa

SEQ ID NO: 3921730 - DNA, 20 bp, Homo sapiens
tctgtcagccagccgccctg

SEQ ID NO: 3921731 - DNA, 14 bp, Homo sapiens
tcttcttggcagct

SEQ ID NO: 3921732 - DNA, 13 bp, Homo sapiens
tcttctttctgag

SEQ ID NO: 3921733 - DNA, 14 bp, Homo sapiens
tcttctttctgaga

SEQ ID NO: 3921734 - DNA, 18 bp, Homo sapiens
tcttctttttttgtgatg

SEQ ID NO: 3921735 - DNA, 15 bp, Homo sapiens
tcttgaaacagcctg

SEQ ID NO: 3921736 - DNA, 11 bp, Homo sapiens
tcttgacccta

SEQ ID NO: 3921737 - DNA, 12 bp, Homo sapiens
tcttgagcagac

SEQ ID NO: 3921738 - DNA, 18 bp, Homo sapiens
tcttgagtagatctgctt

SEQ ID NO: 3921739 - DNA, 17 bp, Homo sapiens
tcttgccactgcctctt

SEQ ID NO: 3921740 - DNA, 13 bp, Homo sapiens
tcttgccccctca

SEQ ID NO: 3921741 - DNA, 13 bp, Homo sapiens
tcttgcctaggcc

SEQ ID NO: 3921742 - DNA, 16 bp, Homo sapiens
tcttgcctaggccaaa

SEQ ID NO: 3921743 - DNA, 14 bp, Homo sapiens
tcttgcctctctca

SEQ ID NO: 3921744 - DNA, 16 bp, Homo sapiens
tcttgcctgaggctca

SEQ ID NO: 3921745 - DNA, 20 bp, Homo sapiens
tcttgcctgaggctcaagag

SEQ ID NO: 3921746 - DNA, 19 bp, Homo sapiens
tcttgctggattaatgttt

SEQ ID NO: 3921747 - DNA, 22 bp, Homo sapiens
tcttgctgtaactcagacattc

SEQ ID NO: 3921748 - DNA, 12 bp, Homo sapiens
tcttggaaaaaa

SEQ ID NO: 3921749 - DNA, 19 bp, Homo sapiens
tcttggaaaaaaattacaa

SEQ ID NO: 3921750 - DNA, 16 bp, Homo sapiens
tcttggacctctgctc

SEQ ID NO: 3921751 - DNA, 21 bp, Homo sapiens
tcttggacctctgctctgagg

SEQ ID NO: 3921752 - DNA, 23 bp, Homo sapiens
tcttggcagcttaacattgactt

SEQ ID NO: 3921753 - DNA, 23 bp, Homo sapiens
tcttggcagtattccatgggatg

SEQ ID NO: 3921754 - DNA, 19 bp, Homo sapiens
tcttggcattttcctcgcc

SEQ ID NO: 3921755 - DNA, 18 bp, Homo sapiens
tcttggcctgcctcccag

SEQ ID NO: 3921756 - DNA, 16 bp, Homo sapiens
tcttggcttctgggac

SEQ ID NO: 3921757 - DNA, 18 bp, Homo sapiens
tcttggcttctgggacct

SEQ ID NO: 3921758 - DNA, 19 bp, Homo sapiens
tcttggcttctgggacctg

SEQ ID NO: 3921759 - DNA, 21 bp, Homo sapiens
tcttgggatgagaatgaaagc

SEQ ID NO: 3921760 - DNA, 21 bp, Homo sapiens
tcttgggctactggcagctcc

SEQ ID NO: 3921761 - DNA, 16 bp, Homo sapiens
tcttggggctcgcccc

SEQ ID NO: 3921762 - DNA, 16 bp, Homo sapiens
tcttggggtcccaggg

SEQ ID NO: 3921763 - DNA, 19 bp, Homo sapiens
tcttggggtcccagggaag

SEQ ID NO: 3921764 - DNA, 14 bp, Homo sapiens
tcttggtccctggt

SEQ ID NO: 3921765 - DNA, 18 bp, Homo sapiens
tcttggtttggggagaaa

SEQ ID NO: 3921766 - DNA, 22 bp, Homo sapiens
tcttgtacagttaactctccca

SEQ ID NO: 3921767 - DNA, 20 bp, Homo sapiens
tcttgtatttgggccaaggt

SEQ ID NO: 3921768 - DNA, 11 bp, Homo sapiens
tcttgtcagaa

SEQ ID NO: 3921769 - DNA, 20 bp, Homo sapiens
tcttgtcagaattggcctca

SEQ ID NO: 3921770 - DNA, 21 bp, Homo sapiens
tcttgtcagaattggcctcag

SEQ ID NO: 3921771 - DNA, 22 bp, Homo sapiens
tcttgtccacagtctcccattc

SEQ ID NO: 3921772 - DNA, 22 bp, Homo sapiens
tcttgtccatgtggttcttcaa

SEQ ID NO: 3921773 - DNA, 23 bp, Homo sapiens
tcttgtccatgtggttcttcaaa

SEQ ID NO: 3921774 - DNA, 23 bp, Homo sapiens
tcttgtcccctcttgacccatct

SEQ ID NO: 3921775 - DNA, 14 bp, Homo sapiens
tcttgtgcatgttt

SEQ ID NO: 3921776 - DNA, 14 bp, Homo sapiens
tcttgttttcagtt

SEQ ID NO: 3921777 - DNA, 14 bp, Homo sapiens
tctttaaatcaaaa

SEQ ID NO: 3921778 - DNA, 20 bp, Homo sapiens
tctttaaatcaaaagctgct

SEQ ID NO: 3921779 - DNA, 21 bp, Homo sapiens
tctttaaatcaaaagctgctt

SEQ ID NO: 3921780 - DNA, 14 bp, Homo sapiens
tctttaagaaagta

SEQ ID NO: 3921781 - DNA, 18 bp, Homo sapiens
tctttaagtattgtttta

SEQ ID NO: 3921782 - DNA, 23 bp, Homo sapiens
tctttaatcattttgcctctttt

SEQ ID NO: 3921783 - DNA, 18 bp, Homo sapiens
tctttacctgagaccagt

SEQ ID NO: 3921784 - DNA, 20 bp, Homo sapiens
tctttactcccttcctggcc

SEQ ID NO: 3921785 - DNA, 18 bp, Homo sapiens
tctttagcattgaagtgt

SEQ ID NO: 3921786 - DNA, 18 bp, Homo sapiens
tctttccccacctcttcc

SEQ ID NO: 3921787 - DNA, 17 bp, Homo sapiens
tctttccgtctccctaa

SEQ ID NO: 3921788 - DNA, 22 bp, Homo sapiens
tctttccgtctccctaaaataa

SEQ ID NO: 3921789 - DNA, 11 bp, Homo sapiens
tctttcctgtc

SEQ ID NO: 3921790 - DNA, 14 bp, Homo sapiens
tctttccttgtctc

SEQ ID NO: 3921791 - DNA, 15 bp, Homo sapiens
tctttccttgtctct

SEQ ID NO: 3921792 - DNA, 18 bp, Homo sapiens
tctttctaatgtgtgaat

SEQ ID NO: 3921793 - DNA, 18 bp, Homo sapiens
tctttctacattctcatc

SEQ ID NO: 3921794 - DNA, 14 bp, Homo sapiens
tctttctctaaata

SEQ ID NO: 3921795 - DNA, 13 bp, Homo sapiens
tctttctcttccc

SEQ ID NO: 3921796 - DNA, 14 bp, Homo sapiens
tctttcttcctctg

SEQ ID NO: 3921797 - DNA, 16 bp, Homo sapiens
tctttcttcctctgct

SEQ ID NO: 3921798 - DNA, 21 bp, Homo sapiens
tctttctttacctgagaccag

SEQ ID NO: 3921799 - DNA, 13 bp, Homo sapiens
tctttctttttct

SEQ ID NO: 3921800 - DNA, 14 bp, Homo sapiens
tctttctttttctg

SEQ ID NO: 3921801 - DNA, 21 bp, Homo sapiens
tctttgacgggaggcctcagt

SEQ ID NO: 3921802 - DNA, 15 bp, Homo sapiens
tctttgatccttctc

SEQ ID NO: 3921803 - DNA, 17 bp, Homo sapiens
tctttgctacaataaat

SEQ ID NO: 3921804 - DNA, 18 bp, Homo sapiens
tctttgctacaataaatg

SEQ ID NO: 3921805 - DNA, 19 bp, Homo sapiens
tctttgctacaataaatgc

SEQ ID NO: 3921806 - DNA, 23 bp, Homo sapiens
tctttgctacaataaatgctgaa

SEQ ID NO: 3921807 - DNA, 18 bp, Homo sapiens
tctttggaaggagtgaga

SEQ ID NO: 3921808 - DNA, 18 bp, Homo sapiens
tctttggggtcagccagg

SEQ ID NO: 3921809 - DNA, 19 bp, Homo sapiens
tctttggtttaatttaaag

SEQ ID NO: 3921810 - DNA, 17 bp, Homo sapiens
tctttgtaaaggtcaga

SEQ ID NO: 3921811 - DNA, 14 bp, Homo sapiens
tctttgtgacagga

SEQ ID NO: 3921812 - DNA, 16 bp, Homo sapiens
tctttgtgacaggaaa

SEQ ID NO: 3921813 - DNA, 19 bp, Homo sapiens
tctttgtgataacaaagag

SEQ ID NO: 3921814 - DNA, 13 bp, Homo sapiens
tctttgtgtagct

SEQ ID NO: 3921815 - DNA, 15 bp, Homo sapiens
tctttgtgtagcttt

SEQ ID NO: 3921816 - DNA, 18 bp, Homo sapiens
tctttgtgtagctttgct

SEQ ID NO: 3921817 - DNA, 13 bp, Homo sapiens
tcttttactcctt

SEQ ID NO: 3921818 - DNA, 13 bp, Homo sapiens
tcttttccctctc

SEQ ID NO: 3921819 - DNA, 15 bp, Homo sapiens
tcttttccctctcta

SEQ ID NO: 3921820 - DNA, 17 bp, Homo sapiens
tcttttctctgtgcttc

SEQ ID NO: 3921821 - DNA, 21 bp, Homo sapiens
tcttttgcccttcacagtgtt

SEQ ID NO: 3921822 - DNA, 13 bp, Homo sapiens
tctttttgtaatt

SEQ ID NO: 3921823 - DNA, 19 bp, Homo sapiens
tcttttttaaaagagatgt

SEQ ID NO: 3921824 - DNA, 14 bp, Homo sapiens
tctttttttgtgat

SEQ ID NO: 3921825 - DNA, 19 bp, Homo sapiens
tgaaaaaaagttgctttgt

SEQ ID NO: 3921826 - DNA, 18 bp, Homo sapiens
tgaaaaacacggcagctg

SEQ ID NO: 3921827 - DNA, 19 bp, Homo sapiens
tgaaaaacacggcagctgt

SEQ ID NO: 3921828 - DNA, 18 bp, Homo sapiens
tgaaaaactgatcaaaaa

SEQ ID NO: 3921829 - DNA, 22 bp, Homo sapiens
tgaaaaactgatcaaaaataaa

SEQ ID NO: 3921830 - DNA, 15 bp, Homo sapiens
tgaaaaatatgtgct

SEQ ID NO: 3921831 - DNA, 16 bp, Homo sapiens
tgaaaaatatgttgag

SEQ ID NO: 3921832 - DNA, 13 bp, Homo sapiens
tgaaaaattctca

SEQ ID NO: 3921833 - DNA, 21 bp, Homo sapiens
tgaaaacagcccaggtcctcc

SEQ ID NO: 3921834 - DNA, 23 bp, Homo sapiens
tgaaaacatggtagaattggaga

SEQ ID NO: 3921835 - DNA, 15 bp, Homo sapiens
tgaaaacccagagag

SEQ ID NO: 3921836 - DNA, 23 bp, Homo sapiens
tgaaaacccagagaggaatcaga

SEQ ID NO: 3921837 - DNA, 19 bp, Homo sapiens
tgaaaagactccaaagaaa

SEQ ID NO: 3921838 - DNA, 13 bp, Homo sapiens
tgaaaataataaa

SEQ ID NO: 3921839 - DNA, 17 bp, Homo sapiens
tgaaaatatttgtatca

SEQ ID NO: 3921840 - DNA, 20 bp, Homo sapiens
tgaaaatgaatagagagtat

SEQ ID NO: 3921841 - DNA, 17 bp, Homo sapiens
tgaaaatgagcctgtaa

SEQ ID NO: 3921842 - DNA, 18 bp, Homo sapiens
tgaaaatgagcctgtaat

SEQ ID NO: 3921843 - DNA, 13 bp, Homo sapiens
tgaaaatgttcat

SEQ ID NO: 3921844 - DNA, 16 bp, Homo sapiens
tgaaaattattttaaa

SEQ ID NO: 3921845 - DNA, 19 bp, Homo sapiens
tgaaaattattttaaacaa

SEQ ID NO: 3921846 - DNA, 21 bp, Homo sapiens
tgaaaattattttaaacaaaa

SEQ ID NO: 3921847 - DNA, 17 bp, Homo sapiens
tgaaaattgtatgttaa

SEQ ID NO: 3921848 - DNA, 20 bp, Homo sapiens
tgaaacaattattgtacact

SEQ ID NO: 3921849 - DNA, 23 bp, Homo sapiens
tgaaacaattattgtacactaac

SEQ ID NO: 3921850 - DNA, 16 bp, Homo sapiens
tgaaacacttctcatc

SEQ ID NO: 3921851 - DNA, 16 bp, Homo sapiens
tgaaacagatgataaa

SEQ ID NO: 3921852 - DNA, 17 bp, Homo sapiens
tgaaacagatgataaat

SEQ ID NO: 3921853 - DNA, 23 bp, Homo sapiens
tgaaacattcacacagggctctt

SEQ ID NO: 3921854 - DNA, 18 bp, Homo sapiens
tgaaacattccgaagagg

SEQ ID NO: 3921855 - DNA, 20 bp, Homo sapiens
tgaaaccacaggcccttggg

SEQ ID NO: 3921856 - DNA, 21 bp, Homo sapiens
tgaaaccacaggcccttgggg

SEQ ID NO: 3921857 - DNA, 21 bp, Homo sapiens
tgaaacccattaggcatgcct

SEQ ID NO: 3921858 - DNA, 18 bp, Homo sapiens
tgaaactagaagtcaaaa

SEQ ID NO: 3921859 - DNA, 20 bp, Homo sapiens
tgaaactcctgattttgtag

SEQ ID NO: 3921860 - DNA, 22 bp, Homo sapiens
tgaaactcctgattttgtagtt

SEQ ID NO: 3921861 - DNA, 15 bp, Homo sapiens
tgaaacttcataaat

SEQ ID NO: 3921862 - DNA, 20 bp, Homo sapiens
tgaaagaattatttttgtgt

SEQ ID NO: 3921863 - DNA, 15 bp, Homo sapiens
tgaaagacagaatgt

SEQ ID NO: 3921864 - DNA, 17 bp, Homo sapiens
tgaaagacagaatgtca

SEQ ID NO: 3921865 - DNA, 18 bp, Homo sapiens
tgaaagatggctgtgcct

SEQ ID NO: 3921866 - DNA, 22 bp, Homo sapiens
tgaaagatggctgtgcctctgc

SEQ ID NO: 3921867 - DNA, 21 bp, Homo sapiens
tgaaagcagcagctaggactg

SEQ ID NO: 3921868 - DNA, 23 bp, Homo sapiens
tgaaagccagctgccgaccagag

SEQ ID NO: 3921869 - DNA, 14 bp, Homo sapiens
tgaaagccatttgt

SEQ ID NO: 3921870 - DNA, 13 bp, Homo sapiens
tgaaagctagaga

SEQ ID NO: 3921871 - DNA, 16 bp, Homo sapiens
tgaaagggctatggca

SEQ ID NO: 3921872 - DNA, 19 bp, Homo sapiens
tgaaagggctatggcaagg

SEQ ID NO: 3921873 - DNA, 17 bp, Homo sapiens
tgaaagtgtaaaataga

SEQ ID NO: 3921874 - DNA, 18 bp, Homo sapiens
tgaaagtgtaaaatagaa

SEQ ID NO: 3921875 - DNA, 19 bp, Homo sapiens
tgaaataattaaaaaccac

SEQ ID NO: 3921876 - DNA, 16 bp, Homo sapiens
tgaaataccagtgtgg

SEQ ID NO: 3921877 - DNA, 16 bp, Homo sapiens
tgaaatattttacagt

SEQ ID NO: 3921878 - DNA, 14 bp, Homo sapiens
tgaaatccaggtct

SEQ ID NO: 3921879 - DNA, 22 bp, Homo sapiens
tgaaatcggaagggacttcctc

SEQ ID NO: 3921880 - DNA, 13 bp, Homo sapiens
tgaaatgaaagaa

SEQ ID NO: 3921881 - DNA, 17 bp, Homo sapiens
tgaaatgacagaatgct

SEQ ID NO: 3921882 - DNA, 19 bp, Homo sapiens
tgaaatgggagatggtcag

SEQ ID NO: 3921883 - DNA, 18 bp, Homo sapiens
tgaaatgggctttaacaa

SEQ ID NO: 3921884 - DNA, 10 bp, Homo sapiens
tgaaatgtct

SEQ ID NO: 3921885 - DNA, 17 bp, Homo sapiens
tcactgctcccccgtgt

SEQ ID NO: 3921886 - DNA, 13 bp, Homo sapiens
tcactgctggctg

SEQ ID NO: 3921887 - DNA, 18 bp, Homo sapiens
tcactgctggctgcctta

SEQ ID NO: 3921888 - DNA, 22 bp, Homo sapiens
tcactgctggctgccttagaac

SEQ ID NO: 3921889 - DNA, 18 bp, Homo sapiens
tcactggaccactgggca

SEQ ID NO: 3921890 - DNA, 22 bp, Homo sapiens
tcactggagcaccaggcacgaa

SEQ ID NO: 3921891 - DNA, 21 bp, Homo sapiens
tcactggagttacattaatgt

SEQ ID NO: 3921892 - DNA, 19 bp, Homo sapiens
tcactggatgaagattctc

SEQ ID NO: 3921893 - DNA, 18 bp, Homo sapiens
tcactggtagaccaaaat

SEQ ID NO: 3921894 - DNA, 23 bp, Homo sapiens
tcactgtaagactcattccctag

SEQ ID NO: 3921895 - DNA, 15 bp, Homo sapiens
tcactgtctcctggt

SEQ ID NO: 3921896 - DNA, 14 bp, Homo sapiens
tcactgtgagggga

SEQ ID NO: 3921897 - DNA, 20 bp, Homo sapiens
tcactgtgaggggaaggcct

SEQ ID NO: 3921898 - DNA, 21 bp, Homo sapiens
tcactgtgttggccaggctgg

SEQ ID NO: 3921899 - DNA, 18 bp, Homo sapiens
tcactgttgaaaattatt

SEQ ID NO: 3921900 - DNA, 19 bp, Homo sapiens
tcactgttgaaaattattt

SEQ ID NO: 3921901 - DNA, 12 bp, Homo sapiens
tcacttatacca

SEQ ID NO: 3921902 - DNA, 15 bp, Homo sapiens
tcacttccagtgttg

SEQ ID NO: 3921903 - DNA, 15 bp, Homo sapiens
tcacttccctgggaa

SEQ ID NO: 3921904 - DNA, 17 bp, Homo sapiens
tcacttgtaaataaata

SEQ ID NO: 3921905 - DNA, 15 bp, Homo sapiens
tcacttgtacaaaat

SEQ ID NO: 3921906 - DNA, 17 bp, Homo sapiens
tcacttgtacaaaataa

SEQ ID NO: 3921907 - DNA, 14 bp, Homo sapiens
tcacttttcagtga

SEQ ID NO: 3921908 - DNA, 12 bp, Homo sapiens
tcacttttcctc

SEQ ID NO: 3921909 - DNA, 13 bp, Homo sapiens
tcacttttcctcc

SEQ ID NO: 3921910 - DNA, 17 bp, Homo sapiens
tcagaaaagtagaatta

SEQ ID NO: 3921911 - DNA, 20 bp, Homo sapiens
tcagaaaagtagaattatat

SEQ ID NO: 3921912 - DNA, 17 bp, Homo sapiens
tcagaaagcattacatt

SEQ ID NO: 3921913 - DNA, 14 bp, Homo sapiens
tcagaaagggaggg

SEQ ID NO: 3921914 - DNA, 17 bp, Homo sapiens
tcagaaagggagggctc

SEQ ID NO: 3921915 - DNA, 23 bp, Homo sapiens
tcagaaagggagggctctgaggc

SEQ ID NO: 3921916 - DNA, 16 bp, Homo sapiens
tcagaacaatccgatt

SEQ ID NO: 3921917 - DNA, 18 bp, Homo sapiens
tcagaagcaggttcttga

SEQ ID NO: 3921918 - DNA, 21 bp, Homo sapiens
tcagaagccccatttgcacag

SEQ ID NO: 3921919 - DNA, 15 bp, Homo sapiens
tcagaagcctggggg

SEQ ID NO: 3921920 - DNA, 21 bp, Homo sapiens
tcagaagcctgggggcctggc

SEQ ID NO: 3921921 - DNA, 17 bp, Homo sapiens
tcagaaggctggggcca

SEQ ID NO: 3921922 - DNA, 11 bp, Homo sapiens
tcagacaagca

SEQ ID NO: 3921923 - DNA, 22 bp, Homo sapiens
tcagacaatccactctcaggag

SEQ ID NO: 3921924 - DNA, 23 bp, Homo sapiens
tcagacaatccactctcaggagg

SEQ ID NO: 3921925 - DNA, 22 bp, Homo sapiens
tcagacaattcagaagcatcac

SEQ ID NO: 3921926 - DNA, 19 bp, Homo sapiens
tcagacaggtaaatgggca

SEQ ID NO: 3921927 - DNA, 21 bp, Homo sapiens
tcagacatccatgtttgtaaa

SEQ ID NO: 3921928 - DNA, 18 bp, Homo sapiens
tcagaccagtactgggaa

SEQ ID NO: 3921929 - DNA, 12 bp, Homo sapiens
tcagaccccagc

SEQ ID NO: 3921930 - DNA, 17 bp, Homo sapiens
tcagaccccagcggctg

SEQ ID NO: 3921931 - DNA, 14 bp, Homo sapiens
tcagacccccactc

SEQ ID NO: 3921932 - DNA, 13 bp, Homo sapiens
tcagacctctgat

SEQ ID NO: 3921933 - DNA, 11 bp, Homo sapiens
tcagactctgg

SEQ ID NO: 3921934 - DNA, 23 bp, Homo sapiens
tcagagaatttctaccatttcag

SEQ ID NO: 3921935 - DNA, 16 bp, Homo sapiens
tcagagaggccttttg

SEQ ID NO: 3921936 - DNA, 22 bp, Homo sapiens
tcagagatggtaatctacagct

SEQ ID NO: 3921937 - DNA, 15 bp, Homo sapiens
tcagagcagagcaaa

SEQ ID NO: 3921938 - DNA, 18 bp, Homo sapiens
tcagagccaggctctgcc

SEQ ID NO: 3921939 - DNA, 16 bp, Homo sapiens
tcagagcccctccctg

SEQ ID NO: 3921940 - DNA, 12 bp, Homo sapiens
tcagagcctagc

SEQ ID NO: 3921941 - DNA, 16 bp, Homo sapiens
tcagagcctagccacc

SEQ ID NO: 3921942 - DNA, 20 bp, Homo sapiens
tcagagcctagccacctccc

SEQ ID NO: 3921943 - DNA, 19 bp, Homo sapiens
tcagagctcttcaagctgt

SEQ ID NO: 3921944 - DNA, 14 bp, Homo sapiens
tcagagctgggagt

SEQ ID NO: 3921945 - DNA, 22 bp, Homo sapiens
tcagagctgttggcctcgcctg

SEQ ID NO: 3921946 - DNA, 18 bp, Homo sapiens
tcagaggctaagatgaga

SEQ ID NO: 3921947 - DNA, 20 bp, Homo sapiens
tcagagttgtacactgtgta

SEQ ID NO: 3921948 - DNA, 17 bp, Homo sapiens
tcagatcgtattaatta

SEQ ID NO: 3921949 - DNA, 20 bp, Homo sapiens
tcagatctgaacacagttta

SEQ ID NO: 3921950 - DNA, 22 bp, Homo sapiens
tcagattcccagagcaaaataa

SEQ ID NO: 3921951 - DNA, 17 bp, Homo sapiens
tcagcaaggtgtgaatg

SEQ ID NO: 3921952 - DNA, 17 bp, Homo sapiens
tcagcaatagggtgcag

SEQ ID NO: 3921953 - DNA, 16 bp, Homo sapiens
tcagcacaccccaagg

SEQ ID NO: 3921954 - DNA, 17 bp, Homo sapiens
tcagcacaccccaaggg

SEQ ID NO: 3921955 - DNA, 12 bp, Homo sapiens
tcagcaccctgg

SEQ ID NO: 3921956 - DNA, 12 bp, Homo sapiens
tcctcacatagc

SEQ ID NO: 3921957 - DNA, 13 bp, Homo sapiens
tcctcacccccag

SEQ ID NO: 3921958 - DNA, 23 bp, Homo sapiens
tcctcactagtgtaaacaaaaat

SEQ ID NO: 3921959 - DNA, 11 bp, Homo sapiens
tcctcagactg

SEQ ID NO: 3921960 - DNA, 15 bp, Homo sapiens
tcctcagactgctca

SEQ ID NO: 3921961 - DNA, 20 bp, Homo sapiens
tcctcagagaatttctacca

SEQ ID NO: 3921962 - DNA, 12 bp, Homo sapiens
tcctcagctgcc

SEQ ID NO: 3921963 - DNA, 15 bp, Homo sapiens
tcctcagctgccaag

SEQ ID NO: 3921964 - DNA, 16 bp, Homo sapiens
tcctcaggggtggaga

SEQ ID NO: 3921965 - DNA, 19 bp, Homo sapiens
tcctcaggggtggagaagt

SEQ ID NO: 3921966 - DNA, 15 bp, Homo sapiens
tcctcatcccctcgt

SEQ ID NO: 3921967 - DNA, 16 bp, Homo sapiens
tcctccaaactcctgc

SEQ ID NO: 3921968 - DNA, 20 bp, Homo sapiens
tcctccaaactcctgcctgt

SEQ ID NO: 3921969 - DNA, 21 bp, Homo sapiens
tcctccaacaataaagagctc

SEQ ID NO: 3921970 - DNA, 18 bp, Homo sapiens
tcctccacagtgctgctt

SEQ ID NO: 3921971 - DNA, 20 bp, Homo sapiens
tcctccactcactccagccc

SEQ ID NO: 3921972 - DNA, 13 bp, Homo sapiens
tcctccactccac

SEQ ID NO: 3921973 - DNA, 17 bp, Homo sapiens
tcctccactccacctcc

SEQ ID NO: 3921974 - DNA, 18 bp, Homo sapiens
tcctccagacccctgtgg

SEQ ID NO: 3921975 - DNA, 20 bp, Homo sapiens
tcctccagggccacgtgcca

SEQ ID NO: 3921976 - DNA, 22 bp, Homo sapiens
tcctccatctagagattttctt

SEQ ID NO: 3921977 - DNA, 14 bp, Homo sapiens
tcctccattgctgt

SEQ ID NO: 3921978 - DNA, 19 bp, Homo sapiens
tcctccatttcaactccag

SEQ ID NO: 3921979 - DNA, 18 bp, Homo sapiens
tcctcccaaaatactaca

SEQ ID NO: 3921980 - DNA, 19 bp, Homo sapiens
tcctcccatcccctggact

SEQ ID NO: 3921981 - DNA, 18 bp, Homo sapiens
tcctcccatggccttccc

SEQ ID NO: 3921982 - DNA, 14 bp, Homo sapiens
tcctccccaccttc

SEQ ID NO: 3921983 - DNA, 17 bp, Homo sapiens
tcctccccaccttcccc

SEQ ID NO: 3921984 - DNA, 22 bp, Homo sapiens
tcctccccaccttccccagact

SEQ ID NO: 3921985 - DNA, 22 bp, Homo sapiens
tcctccccagtctacgttctcc

SEQ ID NO: 3921986 - DNA, 13 bp, Homo sapiens
tcctccccctgcc

SEQ ID NO: 3921987 - DNA, 14 bp, Homo sapiens
tcctccccctgcca

SEQ ID NO: 3921988 - DNA, 15 bp, Homo sapiens
tcctccccctgccag

SEQ ID NO: 3921989 - DNA, 18 bp, Homo sapiens
tcctccgtccacccaggc

SEQ ID NO: 3921990 - DNA, 20 bp, Homo sapiens
tcctcctccacagtgctgct

SEQ ID NO: 3921991 - DNA, 14 bp, Homo sapiens
tcctcctcccaact

SEQ ID NO: 3921992 - DNA, 18 bp, Homo sapiens
tcctcctgaagcctctgc

SEQ ID NO: 3921993 - DNA, 21 bp, Homo sapiens
tcctcctgaagcctctgccct

SEQ ID NO: 3921994 - DNA, 22 bp, Homo sapiens
tcctcctgaagcctctgccctg

SEQ ID NO: 3921995 - DNA, 12 bp, Homo sapiens
tcctcctgatgg

SEQ ID NO: 3921996 - DNA, 13 bp, Homo sapiens
tcctccttcttca

SEQ ID NO: 3921997 - DNA, 18 bp, Homo sapiens
tcctcgcctaggcctgtg

SEQ ID NO: 3921998 - DNA, 16 bp, Homo sapiens
tcctcggatcaccgag

SEQ ID NO: 3921999 - DNA, 16 bp, Homo sapiens
tcctcggtactcccat

SEQ ID NO: 3922000 - DNA, 19 bp, Homo sapiens
tcctctagctacactattg

SEQ ID NO: 3922001 - DNA, 17 bp, Homo sapiens
tcctctccaattgtaaa

SEQ ID NO: 3922002 - DNA, 16 bp, Homo sapiens
tcctctccactgcctt

SEQ ID NO: 3922003 - DNA, 17 bp, Homo sapiens
tcctctccactgccttc

SEQ ID NO: 3922004 - DNA, 16 bp, Homo sapiens
tcctctcgagcccaga

SEQ ID NO: 3922005 - DNA, 17 bp, Homo sapiens
tcctctcgagcccagat

SEQ ID NO: 3922006 - DNA, 12 bp, Homo sapiens
tcctctgctgct

SEQ ID NO: 3922007 - DNA, 16 bp, Homo sapiens
tcctctggcccagcct

SEQ ID NO: 3922008 - DNA, 17 bp, Homo sapiens
tcctctgtccaggcact

SEQ ID NO: 3922009 - DNA, 23 bp, Homo sapiens
tcctctgtctcgagcgccctgca

SEQ ID NO: 3922010 - DNA, 22 bp, Homo sapiens
tcctctgtttctccttctgaaa

SEQ ID NO: 3922011 - DNA, 20 bp, Homo sapiens
tcctcttaccgtagcctccg

SEQ ID NO: 3922012 - DNA, 18 bp, Homo sapiens
tcctcttccccttgccct

SEQ ID NO: 3922013 - DNA, 18 bp, Homo sapiens
tcctctttctctccttct

SEQ ID NO: 3922014 - DNA, 17 bp, Homo sapiens
tcctctttgcatggaat

SEQ ID NO: 3922015 - DNA, 14 bp, Homo sapiens
tcctgaaagtctgt

SEQ ID NO: 3922016 - DNA, 14 bp, Homo sapiens
tcctgaaatttcag

SEQ ID NO: 3922017 - DNA, 15 bp, Homo sapiens
tcctgaagcctctgc

SEQ ID NO: 3922018 - DNA, 16 bp, Homo sapiens
tcctgaatattaatcc

SEQ ID NO: 3922019 - DNA, 22 bp, Homo sapiens
tcctgaatttattattgttctt

SEQ ID NO: 3922020 - DNA, 14 bp, Homo sapiens
tcctgacccagtcc

SEQ ID NO: 3922021 - DNA, 16 bp, Homo sapiens
tcctgacccagtcccc

SEQ ID NO: 3922022 - DNA, 13 bp, Homo sapiens
tcctgaccctccc

SEQ ID NO: 3922023 - DNA, 16 bp, Homo sapiens
tcctgacctgaggctc

SEQ ID NO: 3922024 - DNA, 13 bp, Homo sapiens
tcctgacgccctg

SEQ ID NO: 3922025 - DNA, 14 bp, Homo sapiens
tcctgactccagtg

SEQ ID NO: 3922026 - DNA, 16 bp, Homo sapiens
tcctgagaaggcgagg

SEQ ID NO: 3922027 - DNA, 14 bp, Homo sapiens
tcctgagcactgcc

SEQ ID NO: 3922028 - DNA, 18 bp, Homo sapiens
tcctgagcactgccagga

SEQ ID NO: 3922029 - DNA, 19 bp, Homo sapiens
tcctgagcactgccaggag

SEQ ID NO: 3922030 - DNA, 23 bp, Homo sapiens
tcctgagcactgccaggagggac

SEQ ID NO: 3922031 - DNA, 17 bp, Homo sapiens
tcctgagggtccccacc

SEQ ID NO: 3922032 - DNA, 19 bp, Homo sapiens
tcctgagggtccccacctg

SEQ ID NO: 3922033 - DNA, 22 bp, Homo sapiens
tcctgagggtccccacctggga

SEQ ID NO: 3922034 - DNA, 23 bp, Homo sapiens
tcctgatgaaaaatatgtgcttg

SEQ ID NO: 3922035 - DNA, 17 bp, Homo sapiens
tcctgatggccaagagc

SEQ ID NO: 3922036 - DNA, 22 bp, Homo sapiens
tcctgatgtgccagaacttcga

SEQ ID NO: 3922037 - DNA, 16 bp, Homo sapiens
tcctgatttcagggaa

SEQ ID NO: 3922038 - DNA, 15 bp, Homo sapiens
tcctgatttctctga

SEQ ID NO: 3922039 - DNA, 16 bp, Homo sapiens
tcctgatttctctgaa

SEQ ID NO: 3922040 - DNA, 13 bp, Homo sapiens
tcctgattttgta

SEQ ID NO: 3922041 - DNA, 19 bp, Homo sapiens
tcctgcaatctccagggct

SEQ ID NO: 3922042 - DNA, 13 bp, Homo sapiens
tcctgcactccag

SEQ ID NO: 3922043 - DNA, 13 bp, Homo sapiens
tccttccatgaaa

SEQ ID NO: 3922044 - DNA, 20 bp, Homo sapiens
tccttcccaggagtggagga

SEQ ID NO: 3922045 - DNA, 9 bp, Homo sapiens
tccttcccc

SEQ ID NO: 3922046 - DNA, 23 bp, Homo sapiens
tccttcccccatcccctttcctc

SEQ ID NO: 3922047 - DNA, 15 bp, Homo sapiens
tccttcccctgtggt

SEQ ID NO: 3922048 - DNA, 9 bp, Homo sapiens
tccttccct

SEQ ID NO: 3922049 - DNA, 15 bp, Homo sapiens
tccttccctgggaag

SEQ ID NO: 3922050 - DNA, 17 bp, Homo sapiens
tccttcccttctctcct

SEQ ID NO: 3922051 - DNA, 18 bp, Homo sapiens
tccttcccttctctcctt

SEQ ID NO: 3922052 - DNA, 21 bp, Homo sapiens
tccttcccttctctccttccc

SEQ ID NO: 3922053 - DNA, 21 bp, Homo sapiens
tccttcctacacccttggact

SEQ ID NO: 3922054 - DNA, 10 bp, Homo sapiens
tccttcctgc

SEQ ID NO: 3922055 - DNA, 16 bp, Homo sapiens
tccttccttccctggc

SEQ ID NO: 3922056 - DNA, 16 bp, Homo sapiens
tccttcgtgtctctcc

SEQ ID NO: 3922057 - DNA, 18 bp, Homo sapiens
tccttctgcacccagaaa

SEQ ID NO: 3922058 - DNA, 12 bp, Homo sapiens
tccttctgcctt

SEQ ID NO: 3922059 - DNA, 15 bp, Homo sapiens
tccttctgccttttt

SEQ ID NO: 3922060 - DNA, 15 bp, Homo sapiens
tccttctttgtctta

SEQ ID NO: 3922061 - DNA, 16 bp, Homo sapiens
tccttgaaaaaaagtt

SEQ ID NO: 3922062 - DNA, 20 bp, Homo sapiens
tccttgcacccctcactctg

SEQ ID NO: 3922063 - DNA, 22 bp, Homo sapiens
tccttgcttatgacatcacttg

SEQ ID NO: 3922064 - DNA, 16 bp, Homo sapiens
tccttggactcatttt

SEQ ID NO: 3922065 - DNA, 17 bp, Homo sapiens
tccttgggctcctggct

SEQ ID NO: 3922066 - DNA, 23 bp, Homo sapiens
tccttgggctcctggctgccagg

SEQ ID NO: 3922067 - DNA, 12 bp, Homo sapiens
tccttggggcac

SEQ ID NO: 3922068 - DNA, 14 bp, Homo sapiens
tccttgtcaccagc

SEQ ID NO: 3922069 - DNA, 22 bp, Homo sapiens
tccttgtcaccagcaacatctc

SEQ ID NO: 3922070 - DNA, 19 bp, Homo sapiens
tccttgtggtttatgtcat

SEQ ID NO: 3922071 - DNA, 19 bp, Homo sapiens
tcctttcacaaccttctgt

SEQ ID NO: 3922072 - DNA, 20 bp, Homo sapiens
tcctttcacaaccttctgtg

SEQ ID NO: 3922073 - DNA, 22 bp, Homo sapiens
tcctttctctatcccaagccaa

SEQ ID NO: 3922074 - DNA, 15 bp, Homo sapiens
tcctttgagaaagaa

SEQ ID NO: 3922075 - DNA, 17 bp, Homo sapiens
tcctttgagaaagaaat

SEQ ID NO: 3922076 - DNA, 15 bp, Homo sapiens
tcctttgcactgagg

SEQ ID NO: 3922077 - DNA, 22 bp, Homo sapiens
tcctttgcattccatgatttta

SEQ ID NO: 3922078 - DNA, 14 bp, Homo sapiens
tccttttatgttat

SEQ ID NO: 3922079 - DNA, 22 bp, Homo sapiens
tccttttgatggggagaaaggg

SEQ ID NO: 3922080 - DNA, 13 bp, Homo sapiens
tccttttgctgtc

SEQ ID NO: 3922081 - DNA, 13 bp, Homo sapiens
tccttttgcttga

SEQ ID NO: 3922082 - DNA, 14 bp, Homo sapiens
tccttttgtcccca

SEQ ID NO: 3922083 - DNA, 19 bp, Homo sapiens
tccttttgtccccagggcc

SEQ ID NO: 3922084 - DNA, 17 bp, Homo sapiens
tccttttgtgtacagtg

SEQ ID NO: 3922085 - DNA, 12 bp, Homo sapiens
tcgaacaaactg

SEQ ID NO: 3922086 - DNA, 16 bp, Homo sapiens
tcgaacaaactgatgc

SEQ ID NO: 3922087 - DNA, 16 bp, Homo sapiens
tcgaaccaaggcagcc

SEQ ID NO: 3922088 - DNA, 15 bp, Homo sapiens
tcgaattaatagctt

SEQ ID NO: 3922089 - DNA, 16 bp, Homo sapiens
tcgaattaatagcttt

SEQ ID NO: 3922090 - DNA, 22 bp, Homo sapiens
tcgacctgcggctgctgtgtgc

SEQ ID NO: 3922091 - DNA, 16 bp, Homo sapiens
tcgactcaggatccag

SEQ ID NO: 3922092 - DNA, 18 bp, Homo sapiens
tcgagaccatcctggccc

SEQ ID NO: 3922093 - DNA, 13 bp, Homo sapiens
tcgagccactgca

SEQ ID NO: 3922094 - DNA, 16 bp, Homo sapiens
tcgagcccagatggaa

SEQ ID NO: 3922095 - DNA, 15 bp, Homo sapiens
tcgagccccctggat

SEQ ID NO: 3922096 - DNA, 22 bp, Homo sapiens
tcgagccccctggatgtcccct

SEQ ID NO: 3922097 - DNA, 14 bp, Homo sapiens
tcgagcgccctgca

SEQ ID NO: 3922098 - DNA, 16 bp, Homo sapiens
tcgagcgccctgcaga

SEQ ID NO: 3922099 - DNA, 19 bp, Homo sapiens
tcgaggcaccggcgctgca

SEQ ID NO: 3922100 - DNA, 21 bp, Homo sapiens
tcgaggcaccggcgctgcagg

SEQ ID NO: 3922101 - DNA, 15 bp, Homo sapiens
tcgaggtgtcaccct

SEQ ID NO: 3922102 - DNA, 19 bp, Homo sapiens
tcgaggttgccccttcccc

SEQ ID NO: 3922103 - DNA, 22 bp, Homo sapiens
tcgagttctcctatcttctcca

SEQ ID NO: 3922104 - DNA, 13 bp, Homo sapiens
tcgatcctggatt

SEQ ID NO: 3922105 - DNA, 19 bp, Homo sapiens
tcgatcctggattcactca

SEQ ID NO: 3922106 - DNA, 16 bp, Homo sapiens
tcgatctgtactgtaa

SEQ ID NO: 3922107 - DNA, 20 bp, Homo sapiens
tcgcaacccgtgccaagtcc

SEQ ID NO: 3922108 - DNA, 13 bp, Homo sapiens
tcgcagccaccct

SEQ ID NO: 3922109 - DNA, 14 bp, Homo sapiens
tcgcagccaccctg

SEQ ID NO: 3922110 - DNA, 20 bp, Homo sapiens
tcgcagcctggcggggcagg

SEQ ID NO: 3922111 - DNA, 18 bp, Homo sapiens
tcgcaggatccgctgcca

SEQ ID NO: 3922112 - DNA, 20 bp, Homo sapiens
tcgcaggatccgctgccacc

SEQ ID NO: 3922113 - DNA, 14 bp, Homo sapiens
tcgcagtcgcagga

SEQ ID NO: 3922114 - DNA, 17 bp, Homo sapiens
tcgcagtgatagttgac

SEQ ID NO: 3922115 - DNA, 17 bp, Homo sapiens
tcgcccacaagccttac

SEQ ID NO: 3922116 - DNA, 23 bp, Homo sapiens
tcgcccacaagccttactcacct

SEQ ID NO: 3922117 - DNA, 13 bp, Homo sapiens
tcgccccaggccc

SEQ ID NO: 3922118 - DNA, 19 bp, Homo sapiens
tcgccggccttgttttatt

SEQ ID NO: 3922119 - DNA, 22 bp, Homo sapiens
tcgccgtgttactgttgcactg

SEQ ID NO: 3922120 - DNA, 15 bp, Homo sapiens
tcgcctgagcccagg

SEQ ID NO: 3922121 - DNA, 18 bp, Homo sapiens
tcgcctgagcccaggagg

SEQ ID NO: 3922122 - DNA, 14 bp, Homo sapiens
tcgcctgggcccag

SEQ ID NO: 3922123 - DNA, 15 bp, Homo sapiens
tcgcctgggcccagg

SEQ ID NO: 3922124 - DNA, 21 bp, Homo sapiens
tcgcctgggcccaggctctgg

SEQ ID NO: 3922125 - DNA, 18 bp, Homo sapiens
tcgcctgtgggaagagaa

SEQ ID NO: 3922126 - DNA, 22 bp, Homo sapiens
tcgcgcgcagcgcgtgcacagc

SEQ ID NO: 3922127 - DNA, 15 bp, Homo sapiens
tcgctccccactctg

SEQ ID NO: 3922128 - DNA, 21 bp, Homo sapiens
tcgctccccactctgctctga

SEQ ID NO: 3922129 - DNA, 16 bp, Homo sapiens
tcgctccctgtagctc

SEQ ID NO: 3922130 - DNA, 20 bp, Homo sapiens
tcgctctgctggcctggccg

SEQ ID NO: 3922131 - DNA, 14 bp, Homo sapiens
tcgctcttgggagt

SEQ ID NO: 3922132 - DNA, 15 bp, Homo sapiens
tcgctgccaggacac

SEQ ID NO: 3922133 - DNA, 21 bp, Homo sapiens
tcgctgccaggacacctgccc

SEQ ID NO: 3922134 - DNA, 22 bp, Homo sapiens
tcgctgccaggacacctgcccc

SEQ ID NO: 3922135 - DNA, 23 bp, Homo sapiens
tcgctgggtgccgggctgcacag

SEQ ID NO: 3922136 - DNA, 16 bp, Homo sapiens
tcgcttctcctccagg

SEQ ID NO: 3922137 - DNA, 14 bp, Homo sapiens
tcgcttgagcccag

SEQ ID NO: 3922138 - DNA, 17 bp, Homo sapiens
tcgcttgagcccaggag

SEQ ID NO: 3922139 - DNA, 18 bp, Homo sapiens
tcgcttgagcccaggagt

SEQ ID NO: 3922140 - DNA, 14 bp, Homo sapiens
tcgcttgcttctgc

SEQ ID NO: 3922141 - DNA, 19 bp, Homo sapiens
tcgcttgcttctgcagcaa

SEQ ID NO: 3922142 - DNA, 18 bp, Homo sapiens
tcggacagtgcccatgca

SEQ ID NO: 3922143 - DNA, 22 bp, Homo sapiens
tcggacccaccaaactgcacac

SEQ ID NO: 3922144 - DNA, 14 bp, Homo sapiens
tcggagaagagctg

SEQ ID NO: 3922145 - DNA, 13 bp, Homo sapiens
tcggaggctgggc

SEQ ID NO: 3922146 - DNA, 14 bp, Homo sapiens
tcggaggctgggcc

SEQ ID NO: 3922147 - DNA, 19 bp, Homo sapiens
tcggaggctgggcccctgg

SEQ ID NO: 3922148 - DNA, 22 bp, Homo sapiens
tcggagtagaaattgttcctga

SEQ ID NO: 3922149 - DNA, 14 bp, Homo sapiens
tcggccccacatgg

SEQ ID NO: 3922150 - DNA, 19 bp, Homo sapiens
tcgggacacctgccctgcc

SEQ ID NO: 3922151 - DNA, 20 bp, Homo sapiens
tcgggacacctgccctgccc

SEQ ID NO: 3922152 - DNA, 15 bp, Homo sapiens
tcggggaactcctgg

SEQ ID NO: 3922153 - DNA, 16 bp, Homo sapiens
tcggggaactcctgga

SEQ ID NO: 3922154 - DNA, 19 bp, Homo sapiens
tcggggagaggctgaggac

SEQ ID NO: 3922155 - DNA, 12 bp, Homo sapiens
tcggggccctgt

SEQ ID NO: 3922156 - DNA, 20 bp, Homo sapiens
tcggggcccttggggcctgg

SEQ ID NO: 3922157 - DNA, 22 bp, Homo sapiens
tcggggcccttggggcctggct

SEQ ID NO: 3922158 - DNA, 16 bp, Homo sapiens
tcgggggtggcaaggg

SEQ ID NO: 3922159 - DNA, 19 bp, Homo sapiens
tcggggtgcacaggagggg

SEQ ID NO: 3922160 - DNA, 14 bp, Homo sapiens
tcggggtgtgatga

SEQ ID NO: 3922161 - DNA, 22 bp, Homo sapiens
tcgggttttattgtttaaaatc

SEQ ID NO: 3922162 - DNA, 13 bp, Homo sapiens
tcggtactcccat

SEQ ID NO: 3922163 - DNA, 15 bp, Homo sapiens
tcggtgggacagccc

SEQ ID NO: 3922164 - DNA, 17 bp, Homo sapiens
tcggtgggacagcccca

SEQ ID NO: 3922165 - DNA, 18 bp, Homo sapiens
tcggtgggacagccccag

SEQ ID NO: 3922166 - DNA, 19 bp, Homo sapiens
tcggtgggacagccccagg

SEQ ID NO: 3922167 - DNA, 12 bp, Homo sapiens
tcgtagctttcc

SEQ ID NO: 3922168 - DNA, 22 bp, Homo sapiens
tcgtagctttcccaaataaact

SEQ ID NO: 3922169 - DNA, 21 bp, Homo sapiens
tcgtcatgttggccaggctgg

SEQ ID NO: 3922170 - DNA, 14 bp, Homo sapiens
tcgtcccctgcctc

SEQ ID NO: 3922171 - DNA, 16 bp, Homo sapiens
tcgtcctccccctgcc

SEQ ID NO: 3922172 - DNA, 18 bp, Homo sapiens
tcgtcctccccctgccag

SEQ ID NO: 3922173 - DNA, 13 bp, Homo sapiens
tcgtcctgtccca

SEQ ID NO: 3922174 - DNA, 15 bp, Homo sapiens
tcgtccttactcctg

SEQ ID NO: 3922175 - DNA, 16 bp, Homo sapiens
tcgtccttactcctgt

SEQ ID NO: 3922176 - DNA, 14 bp, Homo sapiens
tcgtgaactcctga

SEQ ID NO: 3922177 - DNA, 22 bp, Homo sapiens
tcgtgcgcaacaacaaggaccc

SEQ ID NO: 3922178 - DNA, 15 bp, Homo sapiens
tcgtggacacctgcc

SEQ ID NO: 3922179 - DNA, 16 bp, Homo sapiens
tcgtggacacctgccc

SEQ ID NO: 3922180 - DNA, 17 bp, Homo sapiens
tcgtggacacctgccct

SEQ ID NO: 3922181 - DNA, 20 bp, Homo sapiens
tcgtggacacctgccctgcc

SEQ ID NO: 3922182 - DNA, 12 bp, Homo sapiens
tcgtggagagct

SEQ ID NO: 3922183 - DNA, 23 bp, Homo sapiens
tcgtgggagagagacgtgtacat

SEQ ID NO: 3922184 - DNA, 19 bp, Homo sapiens
tcgtgtagtggaagagcag

SEQ ID NO: 3922185 - DNA, 20 bp, Homo sapiens
tcgtgtagtggaagagcagc

SEQ ID NO: 3922186 - DNA, 23 bp, Homo sapiens
tcgtgtagtggaagagcagcctg

SEQ ID NO: 3922187 - DNA, 14 bp, Homo sapiens
tcgtgtctctccca

SEQ ID NO: 3922188 - DNA, 12 bp, Homo sapiens
tcgttgtgaggg

SEQ ID NO: 3922189 - DNA, 19 bp, Homo sapiens
tcgtttattgcttaatccc

SEQ ID NO: 3922190 - DNA, 20 bp, Homo sapiens
tcgttttcataacttgctga

SEQ ID NO: 3922191 - DNA, 16 bp, Homo sapiens
tctaaaaataaaatga

SEQ ID NO: 3922192 - DNA, 21 bp, Homo sapiens
tctaaaaattggtacttgttt

SEQ ID NO: 3922193 - DNA, 13 bp, Homo sapiens
tctaaaactatgg

SEQ ID NO: 3922194 - DNA, 13 bp, Homo sapiens
tctaaacattaat

SEQ ID NO: 3922195 - DNA, 17 bp, Homo sapiens
tctaaacattaatcaat

SEQ ID NO: 3922196 - DNA, 16 bp, Homo sapiens
tctaaagtttacagta

SEQ ID NO: 3922197 - DNA, 15 bp, Homo sapiens
tctaacctgatggca

SEQ ID NO: 3922198 - DNA, 13 bp, Homo sapiens
tctaacgcctgag

SEQ ID NO: 3922199 - DNA, 15 bp, Homo sapiens
tctaacgcctgagcc

SEQ ID NO: 3922200 - DNA, 21 bp, Homo sapiens
tctaacgcctgagcccaggga

SEQ ID NO: 3922201 - DNA, 15 bp, Homo sapiens
tctaactacaaggac

SEQ ID NO: 3922202 - DNA, 20 bp, Homo sapiens
tctaactgtaaatcacttgt

SEQ ID NO: 3922203 - DNA, 22 bp, Homo sapiens
tctaagccaactttaattgctt

SEQ ID NO: 3922204 - DNA, 14 bp, Homo sapiens
tctaagctggagct

SEQ ID NO: 3922205 - DNA, 21 bp, Homo sapiens
tctaagctggagctcttggaa

SEQ ID NO: 3922206 - DNA, 14 bp, Homo sapiens
tctaaggttctcat

SEQ ID NO: 3922207 - DNA, 20 bp, Homo sapiens
tctaagtaaaaccacagcag

SEQ ID NO: 3922208 - DNA, 21 bp, Homo sapiens
tctaagtaaaaccacagcagt

SEQ ID NO: 3922209 - DNA, 22 bp, Homo sapiens
tctaagtaaaaccacagcagtt

SEQ ID NO: 3922210 - DNA, 21 bp, Homo sapiens
tctaagtgaatacttggaagt

SEQ ID NO: 3922211 - DNA, 20 bp, Homo sapiens
tctaagttcatgtttgtaaa

SEQ ID NO: 3922212 - DNA, 19 bp, Homo sapiens
tctaatcaggttgttaatg

SEQ ID NO: 3922213 - DNA, 19 bp, Homo sapiens
tctaatgtctcttcctctg

SEQ ID NO: 3922214 - DNA, 14 bp, Homo sapiens
tctaatgtgtgaat

SEQ ID NO: 3922215 - DNA, 19 bp, Homo sapiens
tctaatttatacaaaataa

SEQ ID NO: 3922216 - DNA, 15 bp, Homo sapiens
tctacaaccagagcc

SEQ ID NO: 3922217 - DNA, 15 bp, Homo sapiens
tctcaggacacaggc

SEQ ID NO: 3922218 - DNA, 17 bp, Homo sapiens
tctcaggacacaggcct

SEQ ID NO: 3922219 - DNA, 18 bp, Homo sapiens
tctcaggacacaggcctg

SEQ ID NO: 3922220 - DNA, 20 bp, Homo sapiens
tctcaggacacaggcctgtg

SEQ ID NO: 3922221 - DNA, 21 bp, Homo sapiens
tctcaggacacaggcctgtgt

SEQ ID NO: 3922222 - DNA, 16 bp, Homo sapiens
tctcaggagcacaggc

SEQ ID NO: 3922223 - DNA, 18 bp, Homo sapiens
tctcaggagcacaggcag

SEQ ID NO: 3922224 - DNA, 23 bp, Homo sapiens
tctcaggagcacaggcagctgga

SEQ ID NO: 3922225 - DNA, 15 bp, Homo sapiens
tctcaggagtatctt

SEQ ID NO: 3922226 - DNA, 20 bp, Homo sapiens
tctcaggatcaagaaagtgt

SEQ ID NO: 3922227 - DNA, 22 bp, Homo sapiens
tctcaggggccagtgagggctg

SEQ ID NO: 3922228 - DNA, 13 bp, Homo sapiens
tctcaggtcactc

SEQ ID NO: 3922229 - DNA, 16 bp, Homo sapiens
tctcaggtcactccag

SEQ ID NO: 3922230 - DNA, 18 bp, Homo sapiens
tctcaggtcactccagtg

SEQ ID NO: 3922231 - DNA, 20 bp, Homo sapiens
tctcaggtgccactccctga

SEQ ID NO: 3922232 - DNA, 20 bp, Homo sapiens
tctcagtccagatgccttcc

SEQ ID NO: 3922233 - DNA, 14 bp, Homo sapiens
tctcagtgctctcc

SEQ ID NO: 3922234 - DNA, 16 bp, Homo sapiens
tctcataggaaaagta

SEQ ID NO: 3922235 - DNA, 19 bp, Homo sapiens
tctcataggaaaagtacat

SEQ ID NO: 3922236 - DNA, 15 bp, Homo sapiens
tctcatgcctgcctg

SEQ ID NO: 3922237 - DNA, 20 bp, Homo sapiens
tctcatgtctcagcctcctc

SEQ ID NO: 3922238 - DNA, 17 bp, Homo sapiens
tctcatgtgatcctttt

SEQ ID NO: 3922239 - DNA, 18 bp, Homo sapiens
tctcatgtgatcctttta

SEQ ID NO: 3922240 - DNA, 21 bp, Homo sapiens
tctcattcaggtgttctcttc

SEQ ID NO: 3922241 - DNA, 10 bp, Homo sapiens
tctcattccc

SEQ ID NO: 3922242 - DNA, 14 bp, Homo sapiens
tctcattccccagg

SEQ ID NO: 3922243 - DNA, 12 bp, Homo sapiens
tctcattctctt

SEQ ID NO: 3922244 - DNA, 21 bp, Homo sapiens
tctccaaacaccggcagaaaa

SEQ ID NO: 3922245 - DNA, 15 bp, Homo sapiens
tctccaaaggggctg

SEQ ID NO: 3922246 - DNA, 24 bp, Homo sapiens
tctccaaatattattcaagtgcct

SEQ ID NO: 3922247 - DNA, 18 bp, Homo sapiens
tctccaaatgattttcat

SEQ ID NO: 3922248 - DNA, 19 bp, Homo sapiens
tctccaaatgattttcatc

SEQ ID NO: 3922249 - DNA, 13 bp, Homo sapiens
tctccaattgtaa

SEQ ID NO: 3922250 - DNA, 21 bp, Homo sapiens
tctccaccaactggagcactg

SEQ ID NO: 3922251 - DNA, 12 bp, Homo sapiens
tctccacctcag

SEQ ID NO: 3922252 - DNA, 13 bp, Homo sapiens
tctccacctcagc

SEQ ID NO: 3922253 - DNA, 18 bp, Homo sapiens
tctccacctcagccttgg

SEQ ID NO: 3922254 - DNA, 13 bp, Homo sapiens
tctccactccaga

SEQ ID NO: 3922255 - DNA, 12 bp, Homo sapiens
tctccagccagc

SEQ ID NO: 3922256 - DNA, 16 bp, Homo sapiens
tctccagccagcaatg

SEQ ID NO: 3922257 - DNA, 14 bp, Homo sapiens
tctccagcccacac

SEQ ID NO: 3922258 - DNA, 15 bp, Homo sapiens
tctccagcccacacc

SEQ ID NO: 3922259 - DNA, 22 bp, Homo sapiens
tctccagcccacacccctccaa

SEQ ID NO: 3922260 - DNA, 19 bp, Homo sapiens
tctccaggattgaagagca

SEQ ID NO: 3922261 - DNA, 13 bp, Homo sapiens
tctccataatgcc

SEQ ID NO: 3922262 - DNA, 17 bp, Homo sapiens
tctccatctggcagggt

SEQ ID NO: 3922263 - DNA, 21 bp, Homo sapiens
tctccatttcacacaggtcct

SEQ ID NO: 3922264 - DNA, 22 bp, Homo sapiens
tctccatttcacacaggtcctg

SEQ ID NO: 3922265 - DNA, 14 bp, Homo sapiens
tctcccaggcccca

SEQ ID NO: 3922266 - DNA, 20 bp, Homo sapiens
tctcccaggccccatgacct

SEQ ID NO: 3922267 - DNA, 21 bp, Homo sapiens
tctcccaggccccatgacctc

SEQ ID NO: 3922268 - DNA, 21 bp, Homo sapiens
tctcccaggtggattttgtgg

SEQ ID NO: 3922269 - DNA, 23 bp, Homo sapiens
tctcccattctcatatgtagccc

SEQ ID NO: 3922270 - DNA, 16 bp, Homo sapiens
tctccccaggcctcca

SEQ ID NO: 3922271 - DNA, 16 bp, Homo sapiens
tctcccctctgccctg

SEQ ID NO: 3922272 - DNA, 18 bp, Homo sapiens
tctcccctctgccctgta

SEQ ID NO: 3922273 - DNA, 15 bp, Homo sapiens
tctcccgcgggcctg

SEQ ID NO: 3922274 - DNA, 14 bp, Homo sapiens
tctccctaaaataa

SEQ ID NO: 3922275 - DNA, 15 bp, Homo sapiens
tctccctaaaataaa

SEQ ID NO: 3922276 - DNA, 16 bp, Homo sapiens
tctccctaaaataaaa

SEQ ID NO: 3922277 - DNA, 21 bp, Homo sapiens
tctccctaaaataaaaaccag

SEQ ID NO: 3922278 - DNA, 22 bp, Homo sapiens
tctccctaaaataaaaaccaga

SEQ ID NO: 3922279 - DNA, 12 bp, Homo sapiens
tctccctccagg

SEQ ID NO: 3922280 - DNA, 14 bp, Homo sapiens
tctccctctcctgc

SEQ ID NO: 3922281 - DNA, 15 bp, Homo sapiens
tctccctctggccct

SEQ ID NO: 3922282 - DNA, 16 bp, Homo sapiens
tctccctctggccctg

SEQ ID NO: 3922283 - DNA, 19 bp, Homo sapiens
tctccctctggccctgcct

SEQ ID NO: 3922284 - DNA, 24 bp, Homo sapiens
tctccctgacatttctaacatatg

SEQ ID NO: 3922285 - DNA, 14 bp, Homo sapiens
tctccctgccgcct

SEQ ID NO: 3922286 - DNA, 22 bp, Homo sapiens
tctccctggctgacccctggcc

SEQ ID NO: 3922287 - DNA, 13 bp, Homo sapiens
tctcccttttaaa

SEQ ID NO: 3922288 - DNA, 13 bp, Homo sapiens
tctccggggtctg

SEQ ID NO: 3922289 - DNA, 19 bp, Homo sapiens
tctccggggtctgtgctgt

SEQ ID NO: 3922290 - DNA, 22 bp, Homo sapiens
tctccggggtctgtgctgtgcc

SEQ ID NO: 3922291 - DNA, 17 bp, Homo sapiens
tctccgggtgtggcctc

SEQ ID NO: 3922292 - DNA, 23 bp, Homo sapiens
tctccgggtgtggcctcagccct

SEQ ID NO: 3922293 - DNA, 17 bp, Homo sapiens
tctcctacctgctgctg

SEQ ID NO: 3922294 - DNA, 20 bp, Homo sapiens
tctcctacctgctgctgcta

SEQ ID NO: 3922295 - DNA, 14 bp, Homo sapiens
tctcctagcccctg

SEQ ID NO: 3922296 - DNA, 23 bp, Homo sapiens
tctcctaggagaagcagcctcct

SEQ ID NO: 3922297 - DNA, 18 bp, Homo sapiens
tctcctatttttcagaat

SEQ ID NO: 3922298 - DNA, 14 bp, Homo sapiens
tctcctcagactgc

SEQ ID NO: 3922299 - DNA, 20 bp, Homo sapiens
tctcctccattgctgttgtt

SEQ ID NO: 3922300 - DNA, 18 bp, Homo sapiens
tctcctcccatggccttc

SEQ ID NO: 3922301 - DNA, 15 bp, Homo sapiens
tctcctcctatttat

SEQ ID NO: 3922302 - DNA, 21 bp, Homo sapiens
tctcctcggccccctccatcg

SEQ ID NO: 3922303 - DNA, 20 bp, Homo sapiens
tctgagaaagactattcaaa

SEQ ID NO: 3922304 - DNA, 22 bp, Homo sapiens
tctgagaaagactattcaaaca

SEQ ID NO: 3922305 - DNA, 18 bp, Homo sapiens
tctgagaattccaaggag

SEQ ID NO: 3922306 - DNA, 20 bp, Homo sapiens
tctgagaattccaaggagtt

SEQ ID NO: 3922307 - DNA, 13 bp, Homo sapiens
tctgagaggccct

SEQ ID NO: 3922308 - DNA, 14 bp, Homo sapiens
tctgagaggccctg

SEQ ID NO: 3922309 - DNA, 17 bp, Homo sapiens
tctgagaggccctggat

SEQ ID NO: 3922310 - DNA, 21 bp, Homo sapiens
tctgagagttggctcaggcag

SEQ ID NO: 3922311 - DNA, 21 bp, Homo sapiens
tctgagatctccctccaggga

SEQ ID NO: 3922312 - DNA, 14 bp, Homo sapiens
tctgagatgtgttc

SEQ ID NO: 3922313 - DNA, 14 bp, Homo sapiens
tctgagcaccccct

SEQ ID NO: 3922314 - DNA, 11 bp, Homo sapiens
tctgagccctg

SEQ ID NO: 3922315 - DNA, 15 bp, Homo sapiens
tctgagccctggtgt

SEQ ID NO: 3922316 - DNA, 15 bp, Homo sapiens
tctgagcctaaatct

SEQ ID NO: 3922317 - DNA, 18 bp, Homo sapiens
tctgagccttgagagaaa

SEQ ID NO: 3922318 - DNA, 12 bp, Homo sapiens
tctgagctgggc

SEQ ID NO: 3922319 - DNA, 20 bp, Homo sapiens
tctgagcttttcatggaagt

SEQ ID NO: 3922320 - DNA, 22 bp, Homo sapiens
tctgagcttttcatggaagtgg

SEQ ID NO: 3922321 - DNA, 22 bp, Homo sapiens
tctgaggagaaacaaataagac

SEQ ID NO: 3922322 - DNA, 12 bp, Homo sapiens
tctgaggcctca

SEQ ID NO: 3922323 - DNA, 16 bp, Homo sapiens
tctgaggcttccagag

SEQ ID NO: 3922324 - DNA, 19 bp, Homo sapiens
tctgaggcttccagagagt

SEQ ID NO: 3922325 - DNA, 15 bp, Homo sapiens
tctgaggtcctgagc

SEQ ID NO: 3922326 - DNA, 18 bp, Homo sapiens
tctgaggtcctgagcact

SEQ ID NO: 3922327 - DNA, 20 bp, Homo sapiens
tctgaggtcctgagcactgc

SEQ ID NO: 3922328 - DNA, 18 bp, Homo sapiens
tctgagtcctgtctctgc

SEQ ID NO: 3922329 - DNA, 12 bp, Homo sapiens
tctgagttatgt

SEQ ID NO: 3922330 - DNA, 20 bp, Homo sapiens
tctgagtttcattctcctgc

SEQ ID NO: 3922331 - DNA, 15 bp, Homo sapiens
tctgataaaattgtg

SEQ ID NO: 3922332 - DNA, 23 bp, Homo sapiens
tctgataaaattgtgatgttttg

SEQ ID NO: 3922333 - DNA, 13 bp, Homo sapiens
tctgataaacaca

SEQ ID NO: 3922334 - DNA, 14 bp, Homo sapiens
tctgatacccagag

SEQ ID NO: 3922335 - DNA, 16 bp, Homo sapiens
tctgataggaaaagaa

SEQ ID NO: 3922336 - DNA, 23 bp, Homo sapiens
tctgatccctcgcccccacaccc

SEQ ID NO: 3922337 - DNA, 18 bp, Homo sapiens
tctgatcgggataacaaa

SEQ ID NO: 3922338 - DNA, 13 bp, Homo sapiens
tctgattatcagg

SEQ ID NO: 3922339 - DNA, 11 bp, Homo sapiens
tctgattccac

SEQ ID NO: 3922340 - DNA, 16 bp, Homo sapiens
tctgatttaatgtttt

SEQ ID NO: 3922341 - DNA, 19 bp, Homo sapiens
tctgatttaatgttttctg

SEQ ID NO: 3922342 - DNA, 20 bp, Homo sapiens
tctgatttaatgttttctgc

SEQ ID NO: 3922343 - DNA, 21 bp, Homo sapiens
tctgcacccagaaattccttc

SEQ ID NO: 3922344 - DNA, 19 bp, Homo sapiens
tctgcagacactgtgggta

SEQ ID NO: 3922345 - DNA, 14 bp, Homo sapiens
tctgcagccagccc

SEQ ID NO: 3922346 - DNA, 16 bp, Homo sapiens
tctgcagccagcccag

SEQ ID NO: 3922347 - DNA, 23 bp, Homo sapiens
tctgcagcccggcgccaccatcc

SEQ ID NO: 3922348 - DNA, 19 bp, Homo sapiens
tctgcatttataaatgtgt

SEQ ID NO: 3922349 - DNA, 23 bp, Homo sapiens
tctgcatttataaatgtgtggtg

SEQ ID NO: 3922350 - DNA, 10 bp, Homo sapiens
tctgccacca

SEQ ID NO: 3922351 - DNA, 17 bp, Homo sapiens
tctgccaccatcctgct

SEQ ID NO: 3922352 - DNA, 23 bp, Homo sapiens
tctgccacctcccctatccaccc

SEQ ID NO: 3922353 - DNA, 16 bp, Homo sapiens
tctgccaggcccatct

SEQ ID NO: 3922354 - DNA, 20 bp, Homo sapiens
tctgccccaagcagccagcc

SEQ ID NO: 3922355 - DNA, 21 bp, Homo sapiens
tctgccccaagcagccagcca

SEQ ID NO: 3922356 - DNA, 22 bp, Homo sapiens
tctgccccaagcccccaacccc

SEQ ID NO: 3922357 - DNA, 13 bp, Homo sapiens
tctgccccaaggg

SEQ ID NO: 3922358 - DNA, 14 bp, Homo sapiens
tctgccccaagggg

SEQ ID NO: 3922359 - DNA, 16 bp, Homo sapiens
tctgccccacccacct

SEQ ID NO: 3922360 - DNA, 13 bp, Homo sapiens
tctgccccaccct

SEQ ID NO: 3922361 - DNA, 15 bp, Homo sapiens
tctgccccaccctca

SEQ ID NO: 3922362 - DNA, 14 bp, Homo sapiens
tctgccccagaggc

SEQ ID NO: 3922363 - DNA, 18 bp, Homo sapiens
tctgccccagaggcctct

SEQ ID NO: 3922364 - DNA, 19 bp, Homo sapiens
tctgccccagtagtcagaa

SEQ ID NO: 3922365 - DNA, 23 bp, Homo sapiens
tctgccccagtagtcagaagcag

SEQ ID NO: 3922366 - DNA, 19 bp, Homo sapiens
tctgccccttctgtttcca

SEQ ID NO: 3922367 - DNA, 19 bp, Homo sapiens
tctgccccttgggcatcca

SEQ ID NO: 3922368 - DNA, 14 bp, Homo sapiens
tctgcccgcagagc

SEQ ID NO: 3922369 - DNA, 15 bp, Homo sapiens
tctgcccgcagagcc

SEQ ID NO: 3922370 - DNA, 17 bp, Homo sapiens
tctgcctatttattggg

SEQ ID NO: 3922371 - DNA, 17 bp, Homo sapiens
tctgcctggaaattctg

SEQ ID NO: 3922372 - DNA, 14 bp, Homo sapiens
tctgcctggcctgg

SEQ ID NO: 3922373 - DNA, 16 bp, Homo sapiens
tctgcctggcctggct

SEQ ID NO: 3922374 - DNA, 18 bp, Homo sapiens
tctgcctggcctggctcc

SEQ ID NO: 3922375 - DNA, 19 bp, Homo sapiens
tctgcctggcctggctccc

SEQ ID NO: 3922376 - DNA, 12 bp, Homo sapiens
tctgcctgggcc

SEQ ID NO: 3922377 - DNA, 13 bp, Homo sapiens
tctgcctgggcct

SEQ ID NO: 3922378 - DNA, 14 bp, Homo sapiens
tctgcctgggcctg

SEQ ID NO: 3922379 - DNA, 22 bp, Homo sapiens
tctgcctgggcctgtgcagcag

SEQ ID NO: 3922380 - DNA, 12 bp, Homo sapiens
tctgcctgtctc

SEQ ID NO: 3922381 - DNA, 14 bp, Homo sapiens
tctgcctgtctccc

SEQ ID NO: 3922382 - DNA, 19 bp, Homo sapiens
tctgccttttttcacagcc

SEQ ID NO: 3922383 - DNA, 17 bp, Homo sapiens
tctgcggccttccaccg

SEQ ID NO: 3922384 - DNA, 19 bp, Homo sapiens
tctgcggtggtgccagagg

SEQ ID NO: 3922385 - DNA, 19 bp, Homo sapiens
tctgcgtctctgctttaaa

SEQ ID NO: 3922386 - DNA, 20 bp, Homo sapiens
tctgcgtctctgctttaaag

SEQ ID NO: 3922387 - DNA, 13 bp, Homo sapiens
tctgctccagaga

SEQ ID NO: 3922388 - DNA, 14 bp, Homo sapiens
tctgctcctctcca

SEQ ID NO: 3922389 - DNA, 15 bp, Homo sapiens
tctgctcctctccag

SEQ ID NO: 3922390 - DNA, 15 bp, Homo sapiens
tcaaccattccccat

SEQ ID NO: 3922391 - DNA, 11 bp, Homo sapiens
tcaaccccaga

SEQ ID NO: 3922392 - DNA, 23 bp, Homo sapiens
tcaacctaccaccccttcctgtc

SEQ ID NO: 3922393 - DNA, 23 bp, Homo sapiens
tcaactgaaaagactcagtgttc

SEQ ID NO: 3922394 - DNA, 24 bp, Homo sapiens
tcaactgaccagcctccatgctgc

SEQ ID NO: 3922395 - DNA, 15 bp, Homo sapiens
tcaacttgaagcaag

SEQ ID NO: 3922396 - DNA, 20 bp, Homo sapiens
tcaacttggaaaaagaaaga

SEQ ID NO: 3922397 - DNA, 18 bp, Homo sapiens
tcaagaaaaaataaatgg

SEQ ID NO: 3922398 - DNA, 23 bp, Homo sapiens
tcaagaaaaaataaatggaaatc

SEQ ID NO: 3922399 - DNA, 12 bp, Homo sapiens
tcaagaaactga

SEQ ID NO: 3922400 - DNA, 23 bp, Homo sapiens
tcaagagaagaaaaaattaagag

SEQ ID NO: 3922401 - DNA, 15 bp, Homo sapiens
tcaagaggcccaggg

SEQ ID NO: 3922402 - DNA, 22 bp, Homo sapiens
tcaagattatattataataatg

SEQ ID NO: 3922403 - DNA, 18 bp, Homo sapiens
tcaagcactaaaaagtgg

SEQ ID NO: 3922404 - DNA, 20 bp, Homo sapiens
tcaagcatgcaataatgtgc

SEQ ID NO: 3922405 - DNA, 21 bp, Homo sapiens
tcaagccagcaacacagagca

SEQ ID NO: 3922406 - DNA, 20 bp, Homo sapiens
tcaagcctgtgggagtagaa

SEQ ID NO: 3922407 - DNA, 19 bp, Homo sapiens
tcaagctagaaggccacat

SEQ ID NO: 3922408 - DNA, 16 bp, Homo sapiens
tcaagctagccagagg

SEQ ID NO: 3922409 - DNA, 16 bp, Homo sapiens
tcaagggtccagaagt

SEQ ID NO: 3922410 - DNA, 24 bp, Homo sapiens
tcaagtacataaagtacataacaa

SEQ ID NO: 3922411 - DNA, 15 bp, Homo sapiens
tcaagtcatgatgga

SEQ ID NO: 3922412 - DNA, 14 bp, Homo sapiens
tcaagtccagagcc

SEQ ID NO: 3922413 - DNA, 18 bp, Homo sapiens
tcaagtgatatatgtatt

SEQ ID NO: 3922414 - DNA, 19 bp, Homo sapiens
tcaagtgcctcttgttgca

SEQ ID NO: 3922415 - DNA, 13 bp, Homo sapiens
tcaagttattgta

SEQ ID NO: 3922416 - DNA, 16 bp, Homo sapiens
tcaataaaaaaaagaa

SEQ ID NO: 3922417 - DNA, 19 bp, Homo sapiens
tcaataaaaaaaagaaatg

SEQ ID NO: 3922418 - DNA, 19 bp, Homo sapiens
tcaatagtaaaagataaca

SEQ ID NO: 3922419 - DNA, 14 bp, Homo sapiens
tcaatagtcaagaa

SEQ ID NO: 3922420 - DNA, 13 bp, Homo sapiens
tcaatatgcttac

SEQ ID NO: 3922421 - DNA, 21 bp, Homo sapiens
tcaatattaaatacagacact

SEQ ID NO: 3922422 - DNA, 19 bp, Homo sapiens
tcaatattgcctttgcctc

SEQ ID NO: 3922423 - DNA, 13 bp, Homo sapiens
tcaatatttaagt

SEQ ID NO: 3922424 - DNA, 19 bp, Homo sapiens
tcaatcatctgtgtgaaaa

SEQ ID NO: 3922425 - DNA, 13 bp, Homo sapiens
tcaatcccaaaag

SEQ ID NO: 3922426 - DNA, 16 bp, Homo sapiens
tcaatcccaaaagtca

SEQ ID NO: 3922427 - DNA, 15 bp, Homo sapiens
tcaatcccctcattc

SEQ ID NO: 3922428 - DNA, 15 bp, Homo sapiens
tcaatcctgccccca

SEQ ID NO: 3922429 - DNA, 15 bp, Homo sapiens
tcaatccttgttcag

SEQ ID NO: 3922430 - DNA, 16 bp, Homo sapiens
tcaatctatcaattac

SEQ ID NO: 3922431 - DNA, 16 bp, Homo sapiens
tcaatgattattttca

SEQ ID NO: 3922432 - DNA, 13 bp, Homo sapiens
tcaatgccctgcc

SEQ ID NO: 3922433 - DNA, 14 bp, Homo sapiens
tcaatgccctgcca

SEQ ID NO: 3922434 - DNA, 16 bp, Homo sapiens
tcaatgccctgccatt

SEQ ID NO: 3922435 - DNA, 13 bp, Homo sapiens
tcaattagtacag

SEQ ID NO: 3922436 - DNA, 15 bp, Homo sapiens
tcaattagtacagta

SEQ ID NO: 3922437 - DNA, 17 bp, Homo sapiens
tcaattagtacagtagc

SEQ ID NO: 3922438 - DNA, 22 bp, Homo sapiens
tcaattattacatttatacatc

SEQ ID NO: 3922439 - DNA, 18 bp, Homo sapiens
tcaattcaacacattact

SEQ ID NO: 3922440 - DNA, 21 bp, Homo sapiens
tcaattccatttaaaaaacaa

SEQ ID NO: 3922441 - DNA, 13 bp, Homo sapiens
tcaatttgtatat

SEQ ID NO: 3922442 - DNA, 13 bp, Homo sapiens
tcaatttttatac

SEQ ID NO: 3922443 - DNA, 14 bp, Homo sapiens
tcaatttttataca

SEQ ID NO: 3922444 - DNA, 16 bp, Homo sapiens
tcaatttttatacata

SEQ ID NO: 3922445 - DNA, 19 bp, Homo sapiens
tcaatttttatacatatca

SEQ ID NO: 3922446 - DNA, 14 bp, Homo sapiens
tcacaaaaaagaag

SEQ ID NO: 3922447 - DNA, 18 bp, Homo sapiens
tcacaaaaatggtggttt

SEQ ID NO: 3922448 - DNA, 21 bp, Homo sapiens
tcacaaaacctggcacaatgg

SEQ ID NO: 3922449 - DNA, 16 bp, Homo sapiens
tcacaacaacctggtc

SEQ ID NO: 3922450 - DNA, 12 bp, Homo sapiens
tcacaacagatc

SEQ ID NO: 3922451 - DNA, 13 bp, Homo sapiens
tcacaacctccgt

SEQ ID NO: 3922452 - DNA, 14 bp, Homo sapiens
tcacaagaagacca

SEQ ID NO: 3922453 - DNA, 15 bp, Homo sapiens
tcacaagaagaccag

SEQ ID NO: 3922454 - DNA, 15 bp, Homo sapiens
tcacaagcaataatt

SEQ ID NO: 3922455 - DNA, 16 bp, Homo sapiens
tcacaagcaataatta

SEQ ID NO: 3922456 - DNA, 12 bp, Homo sapiens
tcacaagcccag

SEQ ID NO: 3922457 - DNA, 18 bp, Homo sapiens
tcacaaggcagcaaggcc

SEQ ID NO: 3922458 - DNA, 18 bp, Homo sapiens
tcacaagggacgctttgg

SEQ ID NO: 3922459 - DNA, 17 bp, Homo sapiens
tcacacaaggctgggca

SEQ ID NO: 3922460 - DNA, 21 bp, Homo sapiens
tcacacaggcatttcctgggt

SEQ ID NO: 3922461 - DNA, 17 bp, Homo sapiens
tcacacagggctctttg

SEQ ID NO: 3922462 - DNA, 22 bp, Homo sapiens
tcacacatgcatcatcagccta

SEQ ID NO: 3922463 - DNA, 19 bp, Homo sapiens
tcacaccatcttaaatgac

SEQ ID NO: 3922464 - DNA, 15 bp, Homo sapiens
tcacaccctaataag

SEQ ID NO: 3922465 - DNA, 13 bp, Homo sapiens
tcacacctctggg

SEQ ID NO: 3922466 - DNA, 15 bp, Homo sapiens
tcacacctctgggct

SEQ ID NO: 3922467 - DNA, 22 bp, Homo sapiens
tcacacctgtaatcccagcact

SEQ ID NO: 3922468 - DNA, 17 bp, Homo sapiens
tcacacggggtatttta

SEQ ID NO: 3922469 - DNA, 13 bp, Homo sapiens
tcacactctgggt

SEQ ID NO: 3922470 - DNA, 18 bp, Homo sapiens
tcacactgcaagagcctt

SEQ ID NO: 3922471 - DNA, 13 bp, Homo sapiens
tcacacttggagc

SEQ ID NO: 3922472 - DNA, 11 bp, Homo sapiens
tcacagaagaa

SEQ ID NO: 3922473 - DNA, 12 bp, Homo sapiens
tcacagaggctt

SEQ ID NO: 3922474 - DNA, 17 bp, Homo sapiens
tcacagccagactggca

SEQ ID NO: 3922475 - DNA, 13 bp, Homo sapiens
tcacagcctctcc

SEQ ID NO: 3922476 - DNA, 16 bp, Homo sapiens
tcacagcctctccctt

SEQ ID NO: 3922477 - DNA, 13 bp, Homo sapiens
tcacagctctgta

SEQ ID NO: 3922478 - DNA, 18 bp, Homo sapiens
tcacaggactctgcctcc

SEQ ID NO: 3922479 - DNA, 23 bp, Homo sapiens
tcacaggactctgcctcctcttc

SEQ ID NO: 3922480 - DNA, 21 bp, Homo sapiens
tcacaggagcagacagagaaa

SEQ ID NO: 3922481 - DNA, 19 bp, Homo sapiens
tcacaggggcggggcagga

SEQ ID NO: 3922482 - DNA, 16 bp, Homo sapiens
tcacagtgacccttcc

SEQ ID NO: 3922483 - DNA, 17 bp, Homo sapiens
tcacagtgacccttccc

SEQ ID NO: 3922484 - DNA, 15 bp, Homo sapiens
tcacagtggcgagag

SEQ ID NO: 3922485 - DNA, 17 bp, Homo sapiens
tcacagtggcgagagga

SEQ ID NO: 3922486 - DNA, 18 bp, Homo sapiens
tcacagtggcgagaggag

SEQ ID NO: 3922487 - DNA, 14 bp, Homo sapiens
tcacagtgtttgca

SEQ ID NO: 3922488 - DNA, 18 bp, Homo sapiens
tcacagtgtttgcaatgg

SEQ ID NO: 3922489 - DNA, 22 bp, Homo sapiens
tcacagtgtttgcaatggtgtt

SEQ ID NO: 3922490 - DNA, 23 bp, Homo sapiens
tcacagtgtttgcaatggtgttg

SEQ ID NO: 3922491 - DNA, 14 bp, Homo sapiens
tcacagttcctcgc

SEQ ID NO: 3922492 - DNA, 16 bp, Homo sapiens
tcacagttcctcgccc

SEQ ID NO: 3922493 - DNA, 19 bp, Homo sapiens
tcacagttcctcgccctgg

SEQ ID NO: 3922494 - DNA, 22 bp, Homo sapiens
tcacagttggctggatgaaatt

SEQ ID NO: 3922495 - DNA, 18 bp, Homo sapiens
tcacatacaatttgcact

SEQ ID NO: 3922496 - DNA, 19 bp, Homo sapiens
tcacatacaatttgcactg

SEQ ID NO: 3922497 - DNA, 15 bp, Homo sapiens
tcacataccctcccc

SEQ ID NO: 3922498 - DNA, 21 bp, Homo sapiens
tcacatagctacccaaaagag

SEQ ID NO: 3922499 - DNA, 20 bp, Homo sapiens
tcacatatacaaaagcaaga

SEQ ID NO: 3922500 - DNA, 20 bp, Homo sapiens
tcacatcagagtgacatcca

SEQ ID NO: 3922501 - DNA, 23 bp, Homo sapiens
tcacatccaatgcatagtttgtt

SEQ ID NO: 3922502 - DNA, 20 bp, Homo sapiens
tcacattaatatttgctgac

SEQ ID NO: 3922503 - DNA, 16 bp, Homo sapiens
tcacattaatggtcta

SEQ ID NO: 3922504 - DNA, 22 bp, Homo sapiens
tcaccaagctcacagttcctcg

SEQ ID NO: 3922505 - DNA, 15 bp, Homo sapiens
tcaccaatgtaccca

SEQ ID NO: 3922506 - DNA, 23 bp, Homo sapiens
tcaccacaccaaacctctcttat

SEQ ID NO: 3922507 - DNA, 13 bp, Homo sapiens
tcaccaccctccc

SEQ ID NO: 3922508 - DNA, 15 bp, Homo sapiens
tcaccaccttcccag

SEQ ID NO: 3922509 - DNA, 19 bp, Homo sapiens
tcaccagcccggcctgctc

SEQ ID NO: 3922510 - DNA, 21 bp, Homo sapiens
tcaccagggtccgcaccagct

SEQ ID NO: 3922511 - DNA, 13 bp, Homo sapiens
tcaccagtgtccc

SEQ ID NO: 3922512 - DNA, 21 bp, Homo sapiens
tcaccagtgtcccctccactg

SEQ ID NO: 3922513 - DNA, 15 bp, Homo sapiens
tcacccacagggcta

SEQ ID NO: 3922514 - DNA, 21 bp, Homo sapiens
tcacccagctaatctgtaggg

SEQ ID NO: 3922515 - DNA, 12 bp, Homo sapiens
tcacccaggctg

SEQ ID NO: 3922516 - DNA, 15 bp, Homo sapiens
tcacccagtcctggc

SEQ ID NO: 3922517 - DNA, 14 bp, Homo sapiens
tcaccccccactca

SEQ ID NO: 3922518 - DNA, 18 bp, Homo sapiens
tcaccccccactcaccag

SEQ ID NO: 3922519 - DNA, 14 bp, Homo sapiens
tcaccccgtctggg

SEQ ID NO: 3922520 - DNA, 13 bp, Homo sapiens
tcacccctgcact

SEQ ID NO: 3922521 - DNA, 20 bp, Homo sapiens
tcacccgtacaggcaattcc

SEQ ID NO: 3922522 - DNA, 17 bp, Homo sapiens
tcaccctacctgtgcct

SEQ ID NO: 3922523 - DNA, 15 bp, Homo sapiens
tcaccctccacctct

SEQ ID NO: 3922524 - DNA, 23 bp, Homo sapiens
tcaccctgcagagctatggtgag

SEQ ID NO: 3922525 - DNA, 13 bp, Homo sapiens
tcacccttctggg

SEQ ID NO: 3922526 - DNA, 14 bp, Homo sapiens
tcacccttctgggc

SEQ ID NO: 3922527 - DNA, 22 bp, Homo sapiens
tcaccgagacggctggacctgc

SEQ ID NO: 3922528 - DNA, 23 bp, Homo sapiens
tcaccggagctttcaaagaagga

SEQ ID NO: 3922529 - DNA, 18 bp, Homo sapiens
tcaccgtggaccttcctg

SEQ ID NO: 3922530 - DNA, 14 bp, Homo sapiens
tcacctcctccact

SEQ ID NO: 3922531 - DNA, 21 bp, Homo sapiens
tcacctcctccactcactcca

SEQ ID NO: 3922532 - DNA, 14 bp, Homo sapiens
tcacctctcttcag

SEQ ID NO: 3922533 - DNA, 13 bp, Homo sapiens
tcacctctgcctc

SEQ ID NO: 3922534 - DNA, 19 bp, Homo sapiens
tcacctctggctttgtctc

SEQ ID NO: 3922535 - DNA, 13 bp, Homo sapiens
tcacctgcaagcc

SEQ ID NO: 3922536 - DNA, 18 bp, Homo sapiens
tcacctgcaagccccagg

SEQ ID NO: 3922537 - DNA, 19 bp, Homo sapiens
tcacctgcaagccccaggg

SEQ ID NO: 3922538 - DNA, 17 bp, Homo sapiens
tcacctgggcctttcct

SEQ ID NO: 3922539 - DNA, 22 bp, Homo sapiens
tcacctgggcctttcctgtgcc

SEQ ID NO: 3922540 - DNA, 22 bp, Homo sapiens
tcaccttatgtattattttcta

SEQ ID NO: 3922541 - DNA, 14 bp, Homo sapiens
tcacctttggtgca

SEQ ID NO: 3922542 - DNA, 21 bp, Homo sapiens
tcacctttttgacttttccaa

SEQ ID NO: 3922543 - DNA, 19 bp, Homo sapiens
tcactaatactaattcatt

SEQ ID NO: 3922544 - DNA, 22 bp, Homo sapiens
tcactacgggggggagaaggaa

SEQ ID NO: 3922545 - DNA, 12 bp, Homo sapiens
tcactagagctg

SEQ ID NO: 3922546 - DNA, 14 bp, Homo sapiens
tcactagccatgat

SEQ ID NO: 3922547 - DNA, 23 bp, Homo sapiens
tatgagtaggtttggccccctca

SEQ ID NO: 3922548 - DNA, 15 bp, Homo sapiens
tatgagtatacaata

SEQ ID NO: 3922549 - DNA, 15 bp, Homo sapiens
tatgagtcagtctct

SEQ ID NO: 3922550 - DNA, 18 bp, Homo sapiens
tatgagttgttttcagac

SEQ ID NO: 3922551 - DNA, 18 bp, Homo sapiens
tatgatctaatacaaaga

SEQ ID NO: 3922552 - DNA, 14 bp, Homo sapiens
tatgatttatagtt

SEQ ID NO: 3922553 - DNA, 15 bp, Homo sapiens
tatgcaaagcactga

SEQ ID NO: 3922554 - DNA, 12 bp, Homo sapiens
tatgcactggcc

SEQ ID NO: 3922555 - DNA, 14 bp, Homo sapiens
tatgcagaatgttt

SEQ ID NO: 3922556 - DNA, 15 bp, Homo sapiens
tatgccccaaatata

SEQ ID NO: 3922557 - DNA, 22 bp, Homo sapiens
tatgccgtataggatgtcagac

SEQ ID NO: 3922558 - DNA, 23 bp, Homo sapiens
tatgccttatgtaattattttct

SEQ ID NO: 3922559 - DNA, 21 bp, Homo sapiens
tatgctagtttattggaagtg

SEQ ID NO: 3922560 - DNA, 17 bp, Homo sapiens
tatgctatttctggcct

SEQ ID NO: 3922561 - DNA, 22 bp, Homo sapiens
tatgctatttctggcctcagca

SEQ ID NO: 3922562 - DNA, 13 bp, Homo sapiens
tatgctggccagc

SEQ ID NO: 3922563 - DNA, 20 bp, Homo sapiens
taattgatttgacccactca

SEQ ID NO: 3922564 - DNA, 21 bp, Homo sapiens
taattgcttacatttttacaa

SEQ ID NO: 3922565 - DNA, 21 bp, Homo sapiens
taattggaagaaattcctgta

SEQ ID NO: 3922566 - DNA, 18 bp, Homo sapiens
taattgtccctgtttcaa

SEQ ID NO: 3922567 - DNA, 18 bp, Homo sapiens
taattgttgattaatttg

SEQ ID NO: 3922568 - DNA, 22 bp, Homo sapiens
taattgttgattaatttgagaa

SEQ ID NO: 3922569 - DNA, 16 bp, Homo sapiens
taattgttgctaatct

SEQ ID NO: 3922570 - DNA, 20 bp, Homo sapiens
taatttaaaccagcagaaaa

SEQ ID NO: 3922571 - DNA, 22 bp, Homo sapiens
taatttaaaccagcagaaaagt

SEQ ID NO: 3922572 - DNA, 19 bp, Homo sapiens
taatttaaagccacaacca

SEQ ID NO: 3922573 - DNA, 14 bp, Homo sapiens
taatttaactaatt

SEQ ID NO: 3922574 - DNA, 15 bp, Homo sapiens
taatttaactaattt

SEQ ID NO: 3922575 - DNA, 18 bp, Homo sapiens
taatttaactaatttaaa

SEQ ID NO: 3922576 - DNA, 14 bp, Homo sapiens
taatttaatgcatg

SEQ ID NO: 3922577 - DNA, 21 bp, Homo sapiens
taatttaatgcatgttaggaa

SEQ ID NO: 3922578 - DNA, 17 bp, Homo sapiens
taatttatacaaaataa

SEQ ID NO: 3922579 - DNA, 14 bp, Homo sapiens
taattttaaacaaa

SEQ ID NO: 3922580 - DNA, 20 bp, Homo sapiens
taattttattattagattct

SEQ ID NO: 3922581 - DNA, 16 bp, Homo sapiens
taattttgtttgtaat

SEQ ID NO: 3922582 - DNA, 14 bp, Homo sapiens
taatttttacatga

SEQ ID NO: 3922583 - DNA, 16 bp, Homo sapiens
taatttttacatgacc

SEQ ID NO: 3922584 - DNA, 22 bp, Homo sapiens
taatttttcagctctctgtata

SEQ ID NO: 3922585 - DNA, 14 bp, Homo sapiens
tacaaaaacaaaac

SEQ ID NO: 3922586 - DNA, 14 bp, Homo sapiens
tacaaaaacacagc

SEQ ID NO: 3922587 - DNA, 21 bp, Homo sapiens
tacaaaaaccaaaaagttaaa

SEQ ID NO: 3922588 - DNA, 15 bp, Homo sapiens
tacaaaataatttaa

SEQ ID NO: 3922589 - DNA, 17 bp, Homo sapiens
tacaaaataatttaact

SEQ ID NO: 3922590 - DNA, 17 bp, Homo sapiens
tacaaatactgcctagt

SEQ ID NO: 3922591 - DNA, 16 bp, Homo sapiens
tacaaattcaaggaga

SEQ ID NO: 3922592 - DNA, 13 bp, Homo sapiens
tacaacaagaaca

SEQ ID NO: 3922593 - DNA, 14 bp, Homo sapiens
tacaacaagaacaa

SEQ ID NO: 3922594 - DNA, 14 bp, Homo sapiens
tacaaccagagccc

SEQ ID NO: 3922595 - DNA, 16 bp, Homo sapiens
tacaaccagagccccc

SEQ ID NO: 3922596 - DNA, 21 bp, Homo sapiens
tacaaccagagccccccacaa

SEQ ID NO: 3922597 - DNA, 22 bp, Homo sapiens
tacaaccagagccccccacaat

SEQ ID NO: 3922598 - DNA, 14 bp, Homo sapiens
tacaacttcaagtg

SEQ ID NO: 3922599 - DNA, 15 bp, Homo sapiens
tacaagcatatttga

SEQ ID NO: 3922600 - DNA, 19 bp, Homo sapiens
tacaaggtttggcaaaaaa

SEQ ID NO: 3922601 - DNA, 14 bp, Homo sapiens
tacaagttttgtat

SEQ ID NO: 3922602 - DNA, 14 bp, Homo sapiens
tacaataaatattc

SEQ ID NO: 3922603 - DNA, 15 bp, Homo sapiens
tacaataaatgctga

SEQ ID NO: 3922604 - DNA, 16 bp, Homo sapiens
tacaataaatgctgaa

SEQ ID NO: 3922605 - DNA, 17 bp, Homo sapiens
tacaataaatgctgaat

SEQ ID NO: 3922606 - DNA, 16 bp, Homo sapiens
tacaataataaatcct

SEQ ID NO: 3922607 - DNA, 20 bp, Homo sapiens
tacacaacatttatttcaaa

SEQ ID NO: 3922608 - DNA, 15 bp, Homo sapiens
tacacaagtaaacat

SEQ ID NO: 3922609 - DNA, 21 bp, Homo sapiens
tacacacatatacatatatat

SEQ ID NO: 3922610 - DNA, 17 bp, Homo sapiens
tacacactcaaatcaag

SEQ ID NO: 3922611 - DNA, 22 bp, Homo sapiens
tacacagtaaaaacttgtacta

SEQ ID NO: 3922612 - DNA, 23 bp, Homo sapiens
tacacagtaaaaacttgtactat

SEQ ID NO: 3922613 - DNA, 23 bp, Homo sapiens
tacacagtgggaactctgacaag

SEQ ID NO: 3922614 - DNA, 11 bp, Homo sapiens
tacacatacat

SEQ ID NO: 3922615 - DNA, 18 bp, Homo sapiens
tacacatacatacacata

SEQ ID NO: 3922616 - DNA, 13 bp, Homo sapiens
tacacatatacct

SEQ ID NO: 3922617 - DNA, 14 bp, Homo sapiens
tacacatataccta

SEQ ID NO: 3922618 - DNA, 18 bp, Homo sapiens
tacacatatacctataat

SEQ ID NO: 3922619 - DNA, 21 bp, Homo sapiens
tacacatatacctataatgtg

SEQ ID NO: 3922620 - DNA, 15 bp, Homo sapiens
tacacatggatgcac

SEQ ID NO: 3922621 - DNA, 19 bp, Homo sapiens
tacaccacctcactcctgt

SEQ ID NO: 3922622 - DNA, 12 bp, Homo sapiens
tacaccactctg

SEQ ID NO: 3922623 - DNA, 20 bp, Homo sapiens
tacaccactctggcagccac

SEQ ID NO: 3922624 - DNA, 21 bp, Homo sapiens
tacaccactctggcagccaca

SEQ ID NO: 3922625 - DNA, 24 bp, Homo sapiens
tacaccatgtttgagctcagaccc

SEQ ID NO: 3922626 - DNA, 14 bp, Homo sapiens
tacacccaaagagg

SEQ ID NO: 3922627 - DNA, 14 bp, Homo sapiens
tacactcctgctgt

SEQ ID NO: 3922628 - DNA, 16 bp, Homo sapiens
tacactctctgtacaa

SEQ ID NO: 3922629 - DNA, 15 bp, Homo sapiens
tacactggatatgtt

SEQ ID NO: 3922630 - DNA, 13 bp, Homo sapiens
tacacttggagcc

SEQ ID NO: 3922631 - DNA, 17 bp, Homo sapiens
tacacttgtataaatgt

SEQ ID NO: 3922632 - DNA, 23 bp, Homo sapiens
tacactttggccaagcaagaggt

SEQ ID NO: 3922633 - DNA, 19 bp, Homo sapiens
tacagaaatactgctctga

SEQ ID NO: 3922634 - DNA, 22 bp, Homo sapiens
tactctgtgccagagcctgggg

SEQ ID NO: 3922635 - DNA, 23 bp, Homo sapiens
tactctgtgccagagcctggggc

SEQ ID NO: 3922636 - DNA, 21 bp, Homo sapiens
tactcttcagaatatggacaa

SEQ ID NO: 3922637 - DNA, 15 bp, Homo sapiens
tactcttcctttcta

SEQ ID NO: 3922638 - DNA, 21 bp, Homo sapiens
tactctttatttctagcagag

SEQ ID NO: 3922639 - DNA, 20 bp, Homo sapiens
tactgaaaggttaccctgta

SEQ ID NO: 3922640 - DNA, 22 bp, Homo sapiens
tactgaggcctaaaagtaaaca

SEQ ID NO: 3922641 - DNA, 14 bp, Homo sapiens
tactgatccctttc

SEQ ID NO: 3922642 - DNA, 13 bp, Homo sapiens
tactgattctcct

SEQ ID NO: 3922643 - DNA, 13 bp, Homo sapiens
tactgcaataaat

SEQ ID NO: 3922644 - DNA, 21 bp, Homo sapiens
tactgccggtcacccaggctc

SEQ ID NO: 3922645 - DNA, 14 bp, Homo sapiens
tactgcctgcttgg

SEQ ID NO: 3922646 - DNA, 16 bp, Homo sapiens
tactgctgcaaagtgc

SEQ ID NO: 3922647 - DNA, 12 bp, Homo sapiens
tactggcagctc

SEQ ID NO: 3922648 - DNA, 14 bp, Homo sapiens
tactgtacttaata

SEQ ID NO: 3922649 - DNA, 20 bp, Homo sapiens
tactgtctggttttaacaat

SEQ ID NO: 3922650 - DNA, 21 bp, Homo sapiens
tactgtctggttttaacaatt

SEQ ID NO: 3922651 - DNA, 20 bp, Homo sapiens
tacttaactgtgtgaagaaa

SEQ ID NO: 3922652 - DNA, 14 bp, Homo sapiens
tacttaagagaaat

SEQ ID NO: 3922653 - DNA, 16 bp, Homo sapiens
tacttaagagaaatgg

SEQ ID NO: 3922654 - DNA, 22 bp, Homo sapiens
tacttacctaaacagatataaa

SEQ ID NO: 3922655 - DNA, 19 bp, Homo sapiens
tacttatttttgacagtgt

SEQ ID NO: 3922656 - DNA, 20 bp, Homo sapiens
tacttatttttgacagtgtt

SEQ ID NO: 3922657 - DNA, 14 bp, Homo sapiens
tacttcaggtgctt

SEQ ID NO: 3922658 - DNA, 18 bp, Homo sapiens
tacttcttcattcaatac

SEQ ID NO: 3922659 - DNA, 22 bp, Homo sapiens
tacttgcacaagcttgtatata

SEQ ID NO: 3922660 - DNA, 20 bp, Homo sapiens
tacttgtagaaatctgtaat

SEQ ID NO: 3922661 - DNA, 16 bp, Homo sapiens
tacttgtctgaggcct

SEQ ID NO: 3922662 - DNA, 19 bp, Homo sapiens
tacttgttacctttcccat

SEQ ID NO: 3922663 - DNA, 20 bp, Homo sapiens
tactttacactctctgtaca

SEQ ID NO: 3922664 - DNA, 20 bp, Homo sapiens
tactttatctgtgaccacac

SEQ ID NO: 3922665 - DNA, 22 bp, Homo sapiens
tactttcctattttcttttcca

SEQ ID NO: 3922666 - DNA, 19 bp, Homo sapiens
tactttgaaaccagaaaat

SEQ ID NO: 3922667 - DNA, 13 bp, Homo sapiens
tacttttgtttca

SEQ ID NO: 3922668 - DNA, 19 bp, Homo sapiens
tacttttttctagtttcag

SEQ ID NO: 3922669 - DNA, 14 bp, Homo sapiens
tactttttttcaca

SEQ ID NO: 3922670 - DNA, 17 bp, Homo sapiens
tagaaaaatctcattcc

SEQ ID NO: 3922671 - DNA, 16 bp, Homo sapiens
tagaaaacattcatcc

SEQ ID NO: 3922672 - DNA, 13 bp, Homo sapiens
tagaaaactgaaa

SEQ ID NO: 3922673 - DNA, 14 bp, Homo sapiens
tagaaacatgacac

SEQ ID NO: 3922674 - DNA, 16 bp, Homo sapiens
tagaaacatgacactg

SEQ ID NO: 3922675 - DNA, 17 bp, Homo sapiens
tagaaacatgacactga

SEQ ID NO: 3922676 - DNA, 23 bp, Homo sapiens
tagaaacatggttttgaaatgct

SEQ ID NO: 3922677 - DNA, 13 bp, Homo sapiens
tagaaactgagga

SEQ ID NO: 3922678 - DNA, 22 bp, Homo sapiens
tagaaagaaaagaccctgagac

SEQ ID NO: 3922679 - DNA, 23 bp, Homo sapiens
tagaaagaaaagaccctgagact

SEQ ID NO: 3922680 - DNA, 23 bp, Homo sapiens
tagaaagctgtttatttattcac

SEQ ID NO: 3922681 - DNA, 17 bp, Homo sapiens
tagaaagtgccagaaag

SEQ ID NO: 3922682 - DNA, 14 bp, Homo sapiens
tagaaatctgtaat

SEQ ID NO: 3922683 - DNA, 22 bp, Homo sapiens
tagaaattaccagagttgttct

SEQ ID NO: 3922684 - DNA, 15 bp, Homo sapiens
tagaacacaggcaaa

SEQ ID NO: 3922685 - DNA, 14 bp, Homo sapiens
tagaacacccactg

SEQ ID NO: 3922686 - DNA, 18 bp, Homo sapiens
tagaacacccactggcca

SEQ ID NO: 3922687 - DNA, 18 bp, Homo sapiens
tagaacataaagcaaata

SEQ ID NO: 3922688 - DNA, 17 bp, Homo sapiens
tagaacatgcacattta

SEQ ID NO: 3922689 - DNA, 16 bp, Homo sapiens
tagaaccaagaagggc

SEQ ID NO: 3922690 - DNA, 17 bp, Homo sapiens
tagaaccaagaagggct

SEQ ID NO: 3922691 - DNA, 23 bp, Homo sapiens
tagaaccaagaagggctagaacc

SEQ ID NO: 3922692 - DNA, 22 bp, Homo sapiens
tagaaccaagcttcagagccta

SEQ ID NO: 3922693 - DNA, 17 bp, Homo sapiens
tagaacctagaagggct

SEQ ID NO: 3922694 - DNA, 23 bp, Homo sapiens
tagaacctggaagggctagaacc

SEQ ID NO: 3922695 - DNA, 13 bp, Homo sapiens
tagaacctggaga

SEQ ID NO: 3922696 - DNA, 17 bp, Homo sapiens
tagaacctggagggctg

SEQ ID NO: 3922697 - DNA, 14 bp, Homo sapiens
tagaagctggagga

SEQ ID NO: 3922698 - DNA, 11 bp, Homo sapiens
tagaaggccac

SEQ ID NO: 3922699 - DNA, 23 bp, Homo sapiens
tagaaggctgtggtgagggaaga

SEQ ID NO: 3922700 - DNA, 16 bp, Homo sapiens
tagaagtggaccagga

SEQ ID NO: 3922701 - DNA, 18 bp, Homo sapiens
tagaagtggaccaggaca

SEQ ID NO: 3922702 - DNA, 19 bp, Homo sapiens
tagaagtggaccaggacag

SEQ ID NO: 3922703 - DNA, 20 bp, Homo sapiens
tagaagtggaccaggacagg

SEQ ID NO: 3922704 - DNA, 19 bp, Homo sapiens
tagaataaaattgtaaaat

SEQ ID NO: 3922705 - DNA, 13 bp, Homo sapiens
tagaataataata

SEQ ID NO: 3922706 - DNA, 15 bp, Homo sapiens
tagaataataataaa

SEQ ID NO: 3922707 - DNA, 12 bp, Homo sapiens
tagaatctggag

SEQ ID NO: 3922708 - DNA, 17 bp, Homo sapiens
tagaatgaaaactcatt

SEQ ID NO: 3922709 - DNA, 16 bp, Homo sapiens
tagaatgatttcatgc

SEQ ID NO: 3922710 - DNA, 20 bp, Homo sapiens
tagaatgcatgtaaggtctt

SEQ ID NO: 3922711 - DNA, 18 bp, Homo sapiens
tagaatgtgttttctgaa

SEQ ID NO: 3922712 - DNA, 23 bp, Homo sapiens
tagaattagtggagcttttgtat

SEQ ID NO: 3922713 - DNA, 12 bp, Homo sapiens
tagaattttaga

SEQ ID NO: 3922714 - DNA, 17 bp, Homo sapiens
tagacagtgctgccctg

SEQ ID NO: 3922715 - DNA, 14 bp, Homo sapiens
tagactaaatgaaa

SEQ ID NO: 3922716 - DNA, 18 bp, Homo sapiens
tagactaattaaaatctg

SEQ ID NO: 3922717 - DNA, 19 bp, Homo sapiens
tagactaattaaaatctgg

SEQ ID NO: 3922718 - DNA, 23 bp, Homo sapiens
tagactaattaaaatctggaaat

SEQ ID NO: 3922719 - DNA, 14 bp, Homo sapiens
tagactatatacat

SEQ ID NO: 3922720 - DNA, 18 bp, Homo sapiens
tagttaggaaataaaacc

SEQ ID NO: 3922721 - DNA, 15 bp, Homo sapiens
tagttaggtgtgcca

SEQ ID NO: 3922722 - DNA, 17 bp, Homo sapiens
tagttaggtgtgccaaa

SEQ ID NO: 3922723 - DNA, 18 bp, Homo sapiens
tagttcctgtggccagga

SEQ ID NO: 3922724 - DNA, 22 bp, Homo sapiens
tagttctcaatcactgctcccc

SEQ ID NO: 3922725 - DNA, 14 bp, Homo sapiens
tagttcttgtgcat

SEQ ID NO: 3922726 - DNA, 19 bp, Homo sapiens
tagttgaaacgcagacact

SEQ ID NO: 3922727 - DNA, 20 bp, Homo sapiens
tagtttacttcctaaatttc

SEQ ID NO: 3922728 - DNA, 22 bp, Homo sapiens
tagtttagatcccatgtcacct

SEQ ID NO: 3922729 - DNA, 14 bp, Homo sapiens
tagtttcagtaaat

SEQ ID NO: 3922730 - DNA, 13 bp, Homo sapiens
tagtttccagtgg

SEQ ID NO: 3922731 - DNA, 12 bp, Homo sapiens
tagtttcttgtg

SEQ ID NO: 3922732 - DNA, 17 bp, Homo sapiens
tagtttgtacatgcatt

SEQ ID NO: 3922733 - DNA, 17 bp, Homo sapiens
tagtttgtataacttct

SEQ ID NO: 3922734 - DNA, 20 bp, Homo sapiens
tagttttaacagaaccagag

SEQ ID NO: 3922735 - DNA, 13 bp, Homo sapiens
taagtggctgctg

SEQ ID NO: 3922736 - DNA, 20 bp, Homo sapiens
taagtggggttgcaaccact

SEQ ID NO: 3922737 - DNA, 14 bp, Homo sapiens
taagtgttgtaaat

SEQ ID NO: 3922738 - DNA, 16 bp, Homo sapiens
taagttcatgtttgta

SEQ ID NO: 3922739 - DNA, 16 bp, Homo sapiens
taagttgttatttcag

SEQ ID NO: 3922740 - DNA, 17 bp, Homo sapiens
taagtttatgtctaaag

SEQ ID NO: 3922741 - DNA, 18 bp, Homo sapiens
taagtttatgtctaaaga

SEQ ID NO: 3922742 - DNA, 16 bp, Homo sapiens
taagtttgatcaaatc

SEQ ID NO: 3922743 - DNA, 14 bp, Homo sapiens
taagttttttactt

SEQ ID NO: 3922744 - DNA, 20 bp, Homo sapiens
taagttttttacttccacag

SEQ ID NO: 3922745 - DNA, 17 bp, Homo sapiens
taataaacttagaataa

SEQ ID NO: 3922746 - DNA, 18 bp, Homo sapiens
taataaacttagaataaa

SEQ ID NO: 3922747 - DNA, 23 bp, Homo sapiens
taataaatctgagcctaaatcta

SEQ ID NO: 3922748 - DNA, 21 bp, Homo sapiens
taataaattgtttggcttcct

SEQ ID NO: 3922749 - DNA, 15 bp, Homo sapiens
taataagtttgatca

SEQ ID NO: 3922750 - DNA, 20 bp, Homo sapiens
taatacactaattcctttct

SEQ ID NO: 3922751 - DNA, 22 bp, Homo sapiens
taatacactaattcctttctat

SEQ ID NO: 3922752 - DNA, 18 bp, Homo sapiens
taataccaaatattttag

SEQ ID NO: 3922753 - DNA, 16 bp, Homo sapiens
taatactaaagtgtct

SEQ ID NO: 3922754 - DNA, 15 bp, Homo sapiens
taatactcacctcct

SEQ ID NO: 3922755 - DNA, 16 bp, Homo sapiens
taatagaaaactgaaa

SEQ ID NO: 3922756 - DNA, 17 bp, Homo sapiens
taatagactaaatgaaa

SEQ ID NO: 3922757 - DNA, 22 bp, Homo sapiens
taatagcgggttactttcacat

SEQ ID NO: 3922758 - DNA, 17 bp, Homo sapiens
taatagtccaatatttg

SEQ ID NO: 3922759 - DNA, 14 bp, Homo sapiens
taatagtccatgga

SEQ ID NO: 3922760 - DNA, 19 bp, Homo sapiens
taatagttagccctcagtc

SEQ ID NO: 3922761 - DNA, 18 bp, Homo sapiens
taatataatggaagagaa

SEQ ID NO: 3922762 - DNA, 20 bp, Homo sapiens
taatataatggaagagaaat

SEQ ID NO: 3922763 - DNA, 17 bp, Homo sapiens
taatatatcccagaaat

SEQ ID NO: 3922764 - DNA, 19 bp, Homo sapiens
taatatccactgcaatact

SEQ ID NO: 3922765 - DNA, 15 bp, Homo sapiens
taatatggcaaaaat

SEQ ID NO: 3922766 - DNA, 20 bp, Homo sapiens
taatatgtctgccacagaga

SEQ ID NO: 3922767 - DNA, 17 bp, Homo sapiens
taatattattggggttg

SEQ ID NO: 3922768 - DNA, 12 bp, Homo sapiens
taatattgtgct

SEQ ID NO: 3922769 - DNA, 21 bp, Homo sapiens
taatatttatgtctatttaag

SEQ ID NO: 3922770 - DNA, 23 bp, Homo sapiens
taatatttatgtctatttaagcc

SEQ ID NO: 3922771 - DNA, 14 bp, Homo sapiens
taatatttgctgac

SEQ ID NO: 3922772 - DNA, 19 bp, Homo sapiens
taatattttgtattttcaa

SEQ ID NO: 3922773 - DNA, 12 bp, Homo sapiens
taatcaaagcta

SEQ ID NO: 3922774 - DNA, 17 bp, Homo sapiens
taatcaatcatctgtgt

SEQ ID NO: 3922775 - DNA, 13 bp, Homo sapiens
taatcaccaaagt

SEQ ID NO: 3922776 - DNA, 14 bp, Homo sapiens
taatcaccaaagta

SEQ ID NO: 3922777 - DNA, 18 bp, Homo sapiens
taatcagcattattcttc

SEQ ID NO: 3922778 - DNA, 12 bp, Homo sapiens
taatcagcctct

SEQ ID NO: 3922779 - DNA, 15 bp, Homo sapiens
taatcaggcagcctt

SEQ ID NO: 3922780 - DNA, 14 bp, Homo sapiens
taatctagaacaca

SEQ ID NO: 3922781 - DNA, 13 bp, Homo sapiens
taatctccacagt

SEQ ID NO: 3922782 - DNA, 19 bp, Homo sapiens
taatctggaaggcccctcc

SEQ ID NO: 3922783 - DNA, 18 bp, Homo sapiens
taatctggactcctctgt

SEQ ID NO: 3922784 - DNA, 17 bp, Homo sapiens
taatctgggaagggaag

SEQ ID NO: 3922785 - DNA, 16 bp, Homo sapiens
taatgaaaaggaagtt

SEQ ID NO: 3922786 - DNA, 19 bp, Homo sapiens
taatgaaagggaaagtcag

SEQ ID NO: 3922787 - DNA, 13 bp, Homo sapiens
taatgaacagcag

SEQ ID NO: 3922788 - DNA, 18 bp, Homo sapiens
taatgaagctattgagaa

SEQ ID NO: 3922789 - DNA, 14 bp, Homo sapiens
taatgactttttat

SEQ ID NO: 3922790 - DNA, 19 bp, Homo sapiens
taatgactttttataatgt

SEQ ID NO: 3922791 - DNA, 20 bp, Homo sapiens
taatgagaacttcaatcact

SEQ ID NO: 3922792 - DNA, 15 bp, Homo sapiens
taatgagggactgga

SEQ ID NO: 3922793 - DNA, 17 bp, Homo sapiens
taatgattatatgacaa

SEQ ID NO: 3922794 - DNA, 21 bp, Homo sapiens
taatgcacaatttagaaaaca

SEQ ID NO: 3922795 - DNA, 19 bp, Homo sapiens
taatgcatgtggtatgagt

SEQ ID NO: 3922796 - DNA, 16 bp, Homo sapiens
taatgcatgttaggaa

SEQ ID NO: 3922797 - DNA, 17 bp, Homo sapiens
taatgcatgttaggaaa

SEQ ID NO: 3922798 - DNA, 14 bp, Homo sapiens
taatgctaagaaat

SEQ ID NO: 3922799 - DNA, 17 bp, Homo sapiens
taatgctcccatctcct

SEQ ID NO: 3922800 - DNA, 20 bp, Homo sapiens
taatgctcccatctcctgat

SEQ ID NO: 3922801 - DNA, 20 bp, Homo sapiens
taatgcttagagaatgttct

SEQ ID NO: 3922802 - DNA, 17 bp, Homo sapiens
taatgggccaattaaaa

SEQ ID NO: 3922803 - DNA, 23 bp, Homo sapiens
taatgggccaattaaaatatata

SEQ ID NO: 3922804 - DNA, 14 bp, Homo sapiens
taatggtttttatt

SEQ ID NO: 3922805 - DNA, 20 bp, Homo sapiens
taatgtaagaaaatttgaag

SEQ ID NO: 3922806 - DNA, 22 bp, Homo sapiens
taatgtaagaaaatttgaagta

SEQ ID NO: 3922807 - DNA, 19 bp, Homo sapiens
taatgtaagggtctgttgt

SEQ ID NO: 3922808 - DNA, 20 bp, Homo sapiens
taatgtaagggtctgttgta

SEQ ID NO: 3922809 - DNA, 19 bp, Homo sapiens
taatgtacaagttttgtat

SEQ ID NO: 3922810 - DNA, 21 bp, Homo sapiens
taatgtacaagttttgtataa

SEQ ID NO: 3922811 - DNA, 15 bp, Homo sapiens
taatgtacagagtgg

SEQ ID NO: 3922812 - DNA, 20 bp, Homo sapiens
taatgtacagagtggcccct

SEQ ID NO: 3922813 - DNA, 17 bp, Homo sapiens
taatgtgcaaattttgc

SEQ ID NO: 3922814 - DNA, 17 bp, Homo sapiens
taatgtgtgtatgtgta

SEQ ID NO: 3922815 - DNA, 17 bp, Homo sapiens
taatgtttgatttagta

SEQ ID NO: 3922816 - DNA, 15 bp, Homo sapiens
taatgttttgtacaa

SEQ ID NO: 3922817 - DNA, 16 bp, Homo sapiens
taatgttttgtacaat

SEQ ID NO: 3922818 - DNA, 22 bp, Homo sapiens
taattaaaaaccactgaacatt

SEQ ID NO: 3922819 - DNA, 12 bp, Homo sapiens
taattaaaatct

SEQ ID NO: 3922820 - DNA, 13 bp, Homo sapiens
taattaagtgcaa

SEQ ID NO: 3922821 - DNA, 14 bp, Homo sapiens
taattaatgtgtgt

SEQ ID NO: 3922822 - DNA, 17 bp, Homo sapiens
cctttctctgagagaga

SEQ ID NO: 3922823 - DNA, 16 bp, Homo sapiens
cctttctctggctcca

SEQ ID NO: 3922824 - DNA, 17 bp, Homo sapiens
cctttctctggctccag

SEQ ID NO: 3922825 - DNA, 18 bp, Homo sapiens
cctttctctggctccaga

SEQ ID NO: 3922826 - DNA, 19 bp, Homo sapiens
cctttctctggctccagaa

SEQ ID NO: 3922827 - DNA, 14 bp, Homo sapiens
cctttctggaccag

SEQ ID NO: 3922828 - DNA, 14 bp, Homo sapiens
cctttgagaaagaa

SEQ ID NO: 3922829 - DNA, 17 bp, Homo sapiens
cctttgagaaagaaata

SEQ ID NO: 3922830 - DNA, 22 bp, Homo sapiens
cctttgagggcagtggggagca

SEQ ID NO: 3922831 - DNA, 14 bp, Homo sapiens
cctttgcactgagg

SEQ ID NO: 3922832 - DNA, 17 bp, Homo sapiens
cctttgcactgagggcc

SEQ ID NO: 3922833 - DNA, 15 bp, Homo sapiens
cctttgcaggcccag

SEQ ID NO: 3922834 - DNA, 21 bp, Homo sapiens
cctttgcattccatgatttta

SEQ ID NO: 3922835 - DNA, 14 bp, Homo sapiens
cctttggaaaaatc

SEQ ID NO: 3922836 - DNA, 20 bp, Homo sapiens
cctttggaaaaatcttgggc

SEQ ID NO: 3922837 - DNA, 18 bp, Homo sapiens
cctttgggatcagcctcc

SEQ ID NO: 3922838 - DNA, 22 bp, Homo sapiens
cctttgggtactactgctgcaa

SEQ ID NO: 3922839 - DNA, 20 bp, Homo sapiens
cctttgttttgcactgacaa

SEQ ID NO: 3922840 - DNA, 16 bp, Homo sapiens
ccttttatagctatta

SEQ ID NO: 3922841 - DNA, 15 bp, Homo sapiens
ccttttatgttattt

SEQ ID NO: 3922842 - DNA, 16 bp, Homo sapiens
ccttttattctgtacc

SEQ ID NO: 3922843 - DNA, 20 bp, Homo sapiens
ccttttccaggagttctgaa

SEQ ID NO: 3922844 - DNA, 14 bp, Homo sapiens
ccttttctctccca

SEQ ID NO: 3922845 - DNA, 15 bp, Homo sapiens
ccttttctctcccat

SEQ ID NO: 3922846 - DNA, 12 bp, Homo sapiens
ccttttcttcct

SEQ ID NO: 3922847 - DNA, 19 bp, Homo sapiens
ccttttcttccttctttct

SEQ ID NO: 3922848 - DNA, 22 bp, Homo sapiens
ccttttgatggggagaaagggc

SEQ ID NO: 3922849 - DNA, 15 bp, Homo sapiens
ccttttgcctggctg

SEQ ID NO: 3922850 - DNA, 16 bp, Homo sapiens
ccttttgcctggctgt

SEQ ID NO: 3922851 - DNA, 18 bp, Homo sapiens
ccttttgcctggctgtgg

SEQ ID NO: 3922852 - DNA, 20 bp, Homo sapiens
ccttttgtccccagggcccc

SEQ ID NO: 3922853 - DNA, 16 bp, Homo sapiens
cctttttctttataaa

SEQ ID NO: 3922854 - DNA, 20 bp, Homo sapiens
ccttttttaaaagtaaatgt

SEQ ID NO: 3922855 - DNA, 19 bp, Homo sapiens
cctttttttagtaaatcct

SEQ ID NO: 3922856 - DNA, 18 bp, Homo sapiens
cgaaaattcatttcacat

SEQ ID NO: 3922857 - DNA, 21 bp, Homo sapiens
cgaaaccagttaagaatggaa

SEQ ID NO: 3922858 - DNA, 22 bp, Homo sapiens
cgaaaggatgtaaacagtgcct

SEQ ID NO: 3922859 - DNA, 23 bp, Homo sapiens
cgaaaggatgtaaacagtgcctg

SEQ ID NO: 3922860 - DNA, 20 bp, Homo sapiens
cgaaccaaggcagcctccag

SEQ ID NO: 3922861 - DNA, 13 bp, Homo sapiens
cgaactgtcctgg

SEQ ID NO: 3922862 - DNA, 22 bp, Homo sapiens
cgaagagggaatggatggggag

SEQ ID NO: 3922863 - DNA, 11 bp, Homo sapiens
cgaagcccagt

SEQ ID NO: 3922864 - DNA, 23 bp, Homo sapiens
cgaaggcagtgcaagagactctg

SEQ ID NO: 3922865 - DNA, 17 bp, Homo sapiens
cgaaggggaaaacccgc

SEQ ID NO: 3922866 - DNA, 16 bp, Homo sapiens
cgaaggggccccgggg

SEQ ID NO: 3922867 - DNA, 16 bp, Homo sapiens
cgaataaatgttcaaa

SEQ ID NO: 3922868 - DNA, 12 bp, Homo sapiens
cgaatcatctca

SEQ ID NO: 3922869 - DNA, 14 bp, Homo sapiens
cgaattaatagctt

SEQ ID NO: 3922870 - DNA, 22 bp, Homo sapiens
cgaatttggtgtggctgtattc

SEQ ID NO: 3922871 - DNA, 15 bp, Homo sapiens
cgacactgctgcacc

SEQ ID NO: 3922872 - DNA, 20 bp, Homo sapiens
cgacactgctgcaccagagt

SEQ ID NO: 3922873 - DNA, 14 bp, Homo sapiens
cgacagcccagcct

SEQ ID NO: 3922874 - DNA, 14 bp, Homo sapiens
cgacagcctggcac

SEQ ID NO: 3922875 - DNA, 16 bp, Homo sapiens
cgacaggagtattttt

SEQ ID NO: 3922876 - DNA, 15 bp, Homo sapiens
cgaccagagccccac

SEQ ID NO: 3922877 - DNA, 17 bp, Homo sapiens
cgactagcaggcatgcc

SEQ ID NO: 3922878 - DNA, 13 bp, Homo sapiens
cgactcttcctgc

SEQ ID NO: 3922879 - DNA, 18 bp, Homo sapiens
cgactttgagctggaaag

SEQ ID NO: 3922880 - DNA, 14 bp, Homo sapiens
cgagacacttgcct

SEQ ID NO: 3922881 - DNA, 15 bp, Homo sapiens
cgagaccatcctggc

SEQ ID NO: 3922882 - DNA, 16 bp, Homo sapiens
cgagaccatcctggcc

SEQ ID NO: 3922883 - DNA, 18 bp, Homo sapiens
cgagaccatcctggcccc

SEQ ID NO: 3922884 - DNA, 21 bp, Homo sapiens
cgagaccatcctggcccctcc

SEQ ID NO: 3922885 - DNA, 19 bp, Homo sapiens
cgagacccttgcattagaa

SEQ ID NO: 3922886 - DNA, 17 bp, Homo sapiens
cgagactgagaggcaga

SEQ ID NO: 3922887 - DNA, 19 bp, Homo sapiens
cgagagcctgctcccccac

SEQ ID NO: 3922888 - DNA, 14 bp, Homo sapiens
cgagaggcagagaa

SEQ ID NO: 3922889 - DNA, 13 bp, Homo sapiens
cgagaggtccctg

SEQ ID NO: 3922890 - DNA, 16 bp, Homo sapiens
cgagaggtccctgctt

SEQ ID NO: 3922891 - DNA, 19 bp, Homo sapiens
cgagagtagccgagagcct

SEQ ID NO: 3922892 - DNA, 20 bp, Homo sapiens
cgagagtagccgagagcctg

SEQ ID NO: 3922893 - DNA, 14 bp, Homo sapiens
cgagcaaccgtggc

SEQ ID NO: 3922894 - DNA, 16 bp, Homo sapiens
cgagcactggccagag

SEQ ID NO: 3922895 - DNA, 21 bp, Homo sapiens
cgagcactggccagagagggc

SEQ ID NO: 3922896 - DNA, 12 bp, Homo sapiens
cgagcagctgag

SEQ ID NO: 3922897 - DNA, 16 bp, Homo sapiens
cgagcagctgagcagg

SEQ ID NO: 3922898 - DNA, 18 bp, Homo sapiens
cgagcaggctactgtcag

SEQ ID NO: 3922899 - DNA, 13 bp, Homo sapiens
cgagcccagctac

SEQ ID NO: 3922900 - DNA, 19 bp, Homo sapiens
cgagcccagctacattcct

SEQ ID NO: 3922901 - DNA, 14 bp, Homo sapiens
cgagccccctggat

SEQ ID NO: 3922902 - DNA, 14 bp, Homo sapiens
cgagcctaatgaaa

SEQ ID NO: 3922903 - DNA, 20 bp, Homo sapiens
cgagcgccctgcagaccctg

SEQ ID NO: 3922904 - DNA, 22 bp, Homo sapiens
cgagctactctcttgccagcat

SEQ ID NO: 3922905 - DNA, 20 bp, Homo sapiens
cgaggcaccggcgctgcagg

SEQ ID NO: 3922906 - DNA, 15 bp, Homo sapiens
cgaggctcttccatc

SEQ ID NO: 3922907 - DNA, 23 bp, Homo sapiens
cgaggtggatcacagaggcttct

SEQ ID NO: 3922908 - DNA, 21 bp, Homo sapiens
cgaggtgtcaccctgcagagc

SEQ ID NO: 3922909 - DNA, 15 bp, Homo sapiens
gtctctctctctcta

SEQ ID NO: 3922910 - DNA, 12 bp, Homo sapiens
gtctctctttct

SEQ ID NO: 3922911 - DNA, 13 bp, Homo sapiens
gtctctgcatctc

SEQ ID NO: 3922912 - DNA, 14 bp, Homo sapiens
gtctctgtgctttg

SEQ ID NO: 3922913 - DNA, 17 bp, Homo sapiens
gtctcttcctctgttct

SEQ ID NO: 3922914 - DNA, 16 bp, Homo sapiens
gtctcttctccactgg

SEQ ID NO: 3922915 - DNA, 22 bp, Homo sapiens
gtctcttttttattctgttttc

SEQ ID NO: 3922916 - DNA, 19 bp, Homo sapiens
gtctgaaaatgttgttatg

SEQ ID NO: 3922917 - DNA, 23 bp, Homo sapiens
gtctgaaagacagaatgtcacca

SEQ ID NO: 3922918 - DNA, 13 bp, Homo sapiens
gtctgaacccttg

SEQ ID NO: 3922919 - DNA, 15 bp, Homo sapiens
gtctgaacccttgtg

SEQ ID NO: 3922920 - DNA, 23 bp, Homo sapiens
gtctgaaggaatagccagagagg

SEQ ID NO: 3922921 - DNA, 19 bp, Homo sapiens
gtctgaagtcactgcacag

SEQ ID NO: 3922922 - DNA, 16 bp, Homo sapiens
gtctgactccagagtc

SEQ ID NO: 3922923 - DNA, 17 bp, Homo sapiens
gtctgactccagagtct

SEQ ID NO: 3922924 - DNA, 16 bp, Homo sapiens
gtctgagcccccggct

SEQ ID NO: 3922925 - DNA, 12 bp, Homo sapiens
gtctgagccctg

SEQ ID NO: 3922926 - DNA, 19 bp, Homo sapiens
gtctgaggccccaggccct

SEQ ID NO: 3922927 - DNA, 19 bp, Homo sapiens
gtctgaggcctcatccctc

SEQ ID NO: 3922928 - DNA, 22 bp, Homo sapiens
gtctgaggcctcatccctcgga

SEQ ID NO: 3922929 - DNA, 17 bp, Homo sapiens
gtctgaggtcctgagca

SEQ ID NO: 3922930 - DNA, 18 bp, Homo sapiens
gtctgaggtcctgagcac

SEQ ID NO: 3922931 - DNA, 19 bp, Homo sapiens
gtctgaggtcctgagcact

SEQ ID NO: 3922932 - DNA, 21 bp, Homo sapiens
gtctgagtcctgtctctgcct

SEQ ID NO: 3922933 - DNA, 22 bp, Homo sapiens
gtctgagtcctgtctctgcctg

SEQ ID NO: 3922934 - DNA, 12 bp, Homo sapiens
gtctgatgtttg

SEQ ID NO: 3922935 - DNA, 22 bp, Homo sapiens
gtctgatttcaggatactctgt

SEQ ID NO: 3922936 - DNA, 15 bp, Homo sapiens
gtctgccacagagag

SEQ ID NO: 3922937 - DNA, 13 bp, Homo sapiens
gtctgccaggccc

SEQ ID NO: 3922938 - DNA, 21 bp, Homo sapiens
gtctgccaggcccatctcagg

SEQ ID NO: 3922939 - DNA, 14 bp, Homo sapiens
gtctgccccaccct

SEQ ID NO: 3922940 - DNA, 12 bp, Homo sapiens
gtctgcttctgt

SEQ ID NO: 3922941 - DNA, 17 bp, Homo sapiens
gtctgcttttgctgggg

SEQ ID NO: 3922942 - DNA, 13 bp, Homo sapiens
gtctggaagctga

SEQ ID NO: 3922943 - DNA, 17 bp, Homo sapiens
gtctggaagctgagcag

SEQ ID NO: 3922944 - DNA, 17 bp, Homo sapiens
gtctggagaagcagtga

SEQ ID NO: 3922945 - DNA, 19 bp, Homo sapiens
gtctggagaagcagtgagc

SEQ ID NO: 3922946 - DNA, 23 bp, Homo sapiens
gtctggataccagatatttgaat

SEQ ID NO: 3922947 - DNA, 22 bp, Homo sapiens
gtctggatctgggaccctttcc

SEQ ID NO: 3922948 - DNA, 19 bp, Homo sapiens
gtctgggatgtagaacttc

SEQ ID NO: 3922949 - DNA, 16 bp, Homo sapiens
gtctggggttcagccc

SEQ ID NO: 3922950 - DNA, 20 bp, Homo sapiens
gtctggggttcagcccctcc

SEQ ID NO: 3922951 - DNA, 23 bp, Homo sapiens
gtctggggttcagcccctcctct

SEQ ID NO: 3922952 - DNA, 16 bp, Homo sapiens
gtctggttttaacaat

SEQ ID NO: 3922953 - DNA, 18 bp, Homo sapiens
gtctggttttaacaattt

SEQ ID NO: 3922954 - DNA, 17 bp, Homo sapiens
gtctgtatatacatttc

SEQ ID NO: 3922955 - DNA, 20 bp, Homo sapiens
gtctgtcaccagctatctgt

SEQ ID NO: 3922956 - DNA, 17 bp, Homo sapiens
gtctgtcgctgggctgt

SEQ ID NO: 3922957 - DNA, 15 bp, Homo sapiens
gtctgtgctgtgcct

SEQ ID NO: 3922958 - DNA, 17 bp, Homo sapiens
gtctgtgctgtgcctgc

SEQ ID NO: 3922959 - DNA, 19 bp, Homo sapiens
gtctgtgctgtgcctgcta

SEQ ID NO: 3922960 - DNA, 17 bp, Homo sapiens
gtctgttcacttttcct

SEQ ID NO: 3922961 - DNA, 21 bp, Homo sapiens
gtctgttccccatggccactt

SEQ ID NO: 3922962 - DNA, 22 bp, Homo sapiens
gtctgtttcaatgacctgtatt

SEQ ID NO: 3922963 - DNA, 22 bp, Homo sapiens
gtcttaaaataacttatatcat

SEQ ID NO: 3922964 - DNA, 14 bp, Homo sapiens
gtcttaattaaaag

SEQ ID NO: 3922965 - DNA, 19 bp, Homo sapiens
gtcttagaagtggaccagg

SEQ ID NO: 3922966 - DNA, 20 bp, Homo sapiens
gtcttagaagtggaccagga

SEQ ID NO: 3922967 - DNA, 17 bp, Homo sapiens
gtcttcagcgagaccct

SEQ ID NO: 3922968 - DNA, 15 bp, Homo sapiens
gtcttccaaccccag

SEQ ID NO: 3922969 - DNA, 22 bp, Homo sapiens
gtcttccaaccccagctggcct

SEQ ID NO: 3922970 - DNA, 13 bp, Homo sapiens
gtcttccagagcc

SEQ ID NO: 3922971 - DNA, 11 bp, Homo sapiens
gtcttcctcac

SEQ ID NO: 3922972 - DNA, 15 bp, Homo sapiens
gtcttcttgtgtcct

SEQ ID NO: 3922973 - DNA, 17 bp, Homo sapiens
gtcttcttgtgtcctga

SEQ ID NO: 3922974 - DNA, 19 bp, Homo sapiens
gtcttcttgtgtcctgatg

SEQ ID NO: 3922975 - DNA, 19 bp, Homo sapiens
gtcttgctatttgagcatg

SEQ ID NO: 3922976 - DNA, 24 bp, Homo sapiens
gtcttgggctactggcagctcctc

SEQ ID NO: 3922977 - DNA, 19 bp, Homo sapiens
gtctttgtaatgtcaccac

SEQ ID NO: 3922978 - DNA, 13 bp, Homo sapiens
gtctttgtgggag

SEQ ID NO: 3922979 - DNA, 22 bp, Homo sapiens
gtctttgtgggagggtaagaca

SEQ ID NO: 3922980 - DNA, 18 bp, Homo sapiens
gtgaaacaattattgtac

SEQ ID NO: 3922981 - DNA, 14 bp, Homo sapiens
gtgaaaccacaggc

SEQ ID NO: 3922982 - DNA, 17 bp, Homo sapiens
gtgaaaccctgtctcta

SEQ ID NO: 3922983 - DNA, 15 bp, Homo sapiens
gtgaaagtgtaaaat

SEQ ID NO: 3922984 - DNA, 19 bp, Homo sapiens
gtgaaagtgtaaaatagaa

SEQ ID NO: 3922985 - DNA, 13 bp, Homo sapiens
gtgaacacatcag

SEQ ID NO: 3922986 - DNA, 13 bp, Homo sapiens
gtgaacccaggac

SEQ ID NO: 3922987 - DNA, 13 bp, Homo sapiens
gtgaagaaatgga

SEQ ID NO: 3922988 - DNA, 21 bp, Homo sapiens
gtgaagttacctcttacattt

SEQ ID NO: 3922989 - DNA, 15 bp, Homo sapiens
gtgaagttgcttctt

SEQ ID NO: 3922990 - DNA, 18 bp, Homo sapiens
gtgaataaaaaccctgta

SEQ ID NO: 3922991 - DNA, 20 bp, Homo sapiens
gtgaataaacttcagcacca

SEQ ID NO: 3922992 - DNA, 12 bp, Homo sapiens
gtgaataataat

SEQ ID NO: 3922993 - DNA, 15 bp, Homo sapiens
gtgaatatatggtct

SEQ ID NO: 3922994 - DNA, 15 bp, Homo sapiens
gtgaatcagacccta

SEQ ID NO: 3922995 - DNA, 18 bp, Homo sapiens
gtgaattctgtgaagaat

SEQ ID NO: 3922996 - DNA, 23 bp, Homo sapiens
gtgaccccagggcacaggagcta

SEQ ID NO: 3922997 - DNA, 18 bp, Homo sapiens
gtgacccggcaccccctg

SEQ ID NO: 3922998 - DNA, 22 bp, Homo sapiens
gtgacccggcaccccctgcagc

SEQ ID NO: 3922999 - DNA, 16 bp, Homo sapiens
gtgacccttcagggcc

SEQ ID NO: 3923000 - DNA, 17 bp, Homo sapiens
gtgacccttcagggcca

SEQ ID NO: 3923001 - DNA, 19 bp, Homo sapiens
gtgacccttcagggccaga

SEQ ID NO: 3923002 - DNA, 14 bp, Homo sapiens
gtgactctacctgc

SEQ ID NO: 3923003 - DNA, 12 bp, Homo sapiens
gtgactgaaggg

SEQ ID NO: 3923004 - DNA, 19 bp, Homo sapiens
gtgactgaaggggcacacc

SEQ ID NO: 3923005 - DNA, 17 bp, Homo sapiens
gtgactgaatttgggcc

SEQ ID NO: 3923006 - DNA, 16 bp, Homo sapiens
gtgactgccccaactc

SEQ ID NO: 3923007 - DNA, 20 bp, Homo sapiens
gtgactgccccaactcctgg

SEQ ID NO: 3923008 - DNA, 21 bp, Homo sapiens
gtgactgccccaactcctgga

SEQ ID NO: 3923009 - DNA, 21 bp, Homo sapiens
gtgactggagcccgagggcct

SEQ ID NO: 3923010 - DNA, 23 bp, Homo sapiens
gtgactggagcccgagggcctga

SEQ ID NO: 3923011 - DNA, 12 bp, Homo sapiens
gtgactggcacc

SEQ ID NO: 3923012 - DNA, 13 bp, Homo sapiens
gtgactggcaggt

SEQ ID NO: 3923013 - DNA, 21 bp, Homo sapiens
gtgactggcaggtgcagatgg

SEQ ID NO: 3923014 - DNA, 22 bp, Homo sapiens
gtgactgtcccaccgggagcct

SEQ ID NO: 3923015 - DNA, 17 bp, Homo sapiens
gtgagaaaaagctcctg

SEQ ID NO: 3923016 - DNA, 14 bp, Homo sapiens
gtgagaccacctct

SEQ ID NO: 3923017 - DNA, 20 bp, Homo sapiens
gtgagaccacctctcaatat

SEQ ID NO: 3923018 - DNA, 21 bp, Homo sapiens
gtgagcagatctgaaaggcac

SEQ ID NO: 3923019 - DNA, 21 bp, Homo sapiens
gtgagccgcatcttctccatc

SEQ ID NO: 3923020 - DNA, 14 bp, Homo sapiens
gtgagctgggaagc

SEQ ID NO: 3923021 - DNA, 12 bp, Homo sapiens
gtgaggcagggg

SEQ ID NO: 3923022 - DNA, 15 bp, Homo sapiens
gtgaggcccagcctg

SEQ ID NO: 3923023 - DNA, 23 bp, Homo sapiens
gtgaggcccagcctgtcctggta

SEQ ID NO: 3923024 - DNA, 13 bp, Homo sapiens
gtgaggcccctgg

SEQ ID NO: 3923025 - DNA, 11 bp, Homo sapiens
gtgaggcctgg

SEQ ID NO: 3923026 - DNA, 16 bp, Homo sapiens
gtgaggcttccaggct

SEQ ID NO: 3923027 - DNA, 17 bp, Homo sapiens
gtgaggcttccaggctc

SEQ ID NO: 3923028 - DNA, 12 bp, Homo sapiens
gtgagtggcagc

SEQ ID NO: 3923029 - DNA, 20 bp, Homo sapiens
gtgagtggcagccatgcctc

SEQ ID NO: 3923030 - DNA, 17 bp, Homo sapiens
gtgagttacagcgagag

SEQ ID NO: 3923031 - DNA, 11 bp, Homo sapiens
gtgataagtgg

SEQ ID NO: 3923032 - DNA, 20 bp, Homo sapiens
gtgatacaacttcaagtgca

SEQ ID NO: 3923033 - DNA, 21 bp, Homo sapiens
gtgatatatgtatttattgtc

SEQ ID NO: 3923034 - DNA, 17 bp, Homo sapiens
gtgatcagaaggctggg

SEQ ID NO: 3923035 - DNA, 22 bp, Homo sapiens
gtgatcagaaggctggggccag

SEQ ID NO: 3923036 - DNA, 22 bp, Homo sapiens
gtgatccttcatcgaacaaact

SEQ ID NO: 3923037 - DNA, 20 bp, Homo sapiens
gtgatctgtcccctctcccc

SEQ ID NO: 3923038 - DNA, 14 bp, Homo sapiens
gtgatgagggcagc

SEQ ID NO: 3923039 - DNA, 16 bp, Homo sapiens
gtgatgagggcagcag

SEQ ID NO: 3923040 - DNA, 18 bp, Homo sapiens
gtgatgagggcagcagcc

SEQ ID NO: 3923041 - DNA, 19 bp, Homo sapiens
gtgatgagggcagcagcca

SEQ ID NO: 3923042 - DNA, 20 bp, Homo sapiens
gtgatgagggcagcagccag

SEQ ID NO: 3923043 - DNA, 21 bp, Homo sapiens
gtgatgagggcagcagccagc

SEQ ID NO: 3923044 - DNA, 21 bp, Homo sapiens
gtgatggcgcgggaggcacca

SEQ ID NO: 3923045 - DNA, 20 bp, Homo sapiens
gtgatggtctcacagagcca

SEQ ID NO: 3923046 - DNA, 14 bp, Homo sapiens
gtgatggttcccct

SEQ ID NO: 3923047 - DNA, 16 bp, Homo sapiens
gtgatggttcccctgt

SEQ ID NO: 3923048 - DNA, 23 bp, Homo sapiens
gtgatggttcccctgttcactct

SEQ ID NO: 3923049 - DNA, 21 bp, Homo sapiens
gtgatgtgcaaggaaaataat

SEQ ID NO: 3923050 - DNA, 12 bp, Homo sapiens
gtgatgttttgt

SEQ ID NO: 3923051 - DNA, 15 bp, Homo sapiens
gtgatgtttttatga

SEQ ID NO: 3923052 - DNA, 15 bp, Homo sapiens
gtgattaacttgctt

SEQ ID NO: 3923053 - DNA, 22 bp, Homo sapiens
gtgattccttttgatggggaga

SEQ ID NO: 3923054 - DNA, 14 bp, Homo sapiens
gtgattctgggatg

SEQ ID NO: 3923055 - DNA, 21 bp, Homo sapiens
gtgatttagaactgtatgtca

SEQ ID NO: 3923056 - DNA, 14 bp, Homo sapiens
gtgattttgtacag

SEQ ID NO: 3923057 - DNA, 16 bp, Homo sapiens
gtgattttgtacagaa

SEQ ID NO: 3923058 - DNA, 17 bp, Homo sapiens
gtgattttgtacagaat

SEQ ID NO: 3923059 - DNA, 16 bp, Homo sapiens
gtgcaaattttgcatt

SEQ ID NO: 3923060 - DNA, 15 bp, Homo sapiens
gtgcaagagacagag

SEQ ID NO: 3923061 - DNA, 16 bp, Homo sapiens
gtgcaagagacagagc

SEQ ID NO: 3923062 - DNA, 17 bp, Homo sapiens
gtgcaatgagccagatg

SEQ ID NO: 3923063 - DNA, 21 bp, Homo sapiens
gtgcaatgcgtgttgtacata

SEQ ID NO: 3923064 - DNA, 20 bp, Homo sapiens
gtgcacaaatatttattttc

SEQ ID NO: 3923065 - DNA, 18 bp, Homo sapiens
gtgcacagcgcgggcgga

SEQ ID NO: 3923066 - DNA, 14 bp, Homo sapiens
gtgcacatgtgtct

SEQ ID NO: 3923067 - DNA, 19 bp, Homo sapiens
gtgcaccaccatgccaggc

SEQ ID NO: 3923068 - DNA, 13 bp, Homo sapiens
gtgcacccactca

SEQ ID NO: 3923069 - DNA, 21 bp, Homo sapiens
gtgcacccactcaccagggtc

SEQ ID NO: 3923070 - DNA, 13 bp, Homo sapiens
gtgctgccctgct

SEQ ID NO: 3923071 - DNA, 20 bp, Homo sapiens
gtgctgccctgctctgggga

SEQ ID NO: 3923072 - DNA, 13 bp, Homo sapiens
gtgctgcttctct

SEQ ID NO: 3923073 - DNA, 12 bp, Homo sapiens
gtgctggaggat

SEQ ID NO: 3923074 - DNA, 18 bp, Homo sapiens
gtgctgtacccttccacc

SEQ ID NO: 3923075 - DNA, 21 bp, Homo sapiens
gtgctgtacccttccacctcc

SEQ ID NO: 3923076 - DNA, 15 bp, Homo sapiens
gtgctgtggccaggg

SEQ ID NO: 3923077 - DNA, 18 bp, Homo sapiens
gtgctgtggccagggtga

SEQ ID NO: 3923078 - DNA, 18 bp, Homo sapiens
gtgctgtgggcagcaccc

SEQ ID NO: 3923079 - DNA, 19 bp, Homo sapiens
gtgcttaaattatttttat

SEQ ID NO: 3923080 - DNA, 16 bp, Homo sapiens
gtgcttaatgtgaact

SEQ ID NO: 3923081 - DNA, 19 bp, Homo sapiens
gtgcttccctaggctgagc

SEQ ID NO: 3923082 - DNA, 16 bp, Homo sapiens
gtgctttatttatggc

SEQ ID NO: 3923083 - DNA, 18 bp, Homo sapiens
gtgctttatttatggctt

SEQ ID NO: 3923084 - DNA, 14 bp, Homo sapiens
gtgctttcaggtct

SEQ ID NO: 3923085 - DNA, 15 bp, Homo sapiens
gtgcttttgatgtga

SEQ ID NO: 3923086 - DNA, 19 bp, Homo sapiens
gtggaaaaaagagaaaaac

SEQ ID NO: 3923087 - DNA, 18 bp, Homo sapiens
gtggaagccctccttcca

SEQ ID NO: 3923088 - DNA, 20 bp, Homo sapiens
gtggaagggggtgtgcgtgc

SEQ ID NO: 3923089 - DNA, 13 bp, Homo sapiens
gtggaatataaag

SEQ ID NO: 3923090 - DNA, 13 bp, Homo sapiens
gtggacacctgcc

SEQ ID NO: 3923091 - DNA, 22 bp, Homo sapiens
gtggaccacccgccctggcagt

SEQ ID NO: 3923092 - DNA, 13 bp, Homo sapiens
gtggaccaggaca

SEQ ID NO: 3923093 - DNA, 15 bp, Homo sapiens
gtggaccttcctgcc

SEQ ID NO: 3923094 - DNA, 20 bp, Homo sapiens
gtggagaggggtgcacccac

SEQ ID NO: 3923095 - DNA, 18 bp, Homo sapiens
gtggagagtgttcctgtt

SEQ ID NO: 3923096 - DNA, 16 bp, Homo sapiens
gtggaggaaggtgctg

SEQ ID NO: 3923097 - DNA, 19 bp, Homo sapiens
gtggaggaaggtgctgagc

SEQ ID NO: 3923098 - DNA, 20 bp, Homo sapiens
gtggaggaaggtgctgagct

SEQ ID NO: 3923099 - DNA, 12 bp, Homo sapiens
gtggaggaggag

SEQ ID NO: 3923100 - DNA, 11 bp, Homo sapiens
gtggaggcctg

SEQ ID NO: 3923101 - DNA, 13 bp, Homo sapiens
gtggaggcctgat

SEQ ID NO: 3923102 - DNA, 17 bp, Homo sapiens
gtggaggcctgatgctg

SEQ ID NO: 3923103 - DNA, 18 bp, Homo sapiens
gtggagggtaggggagtg

SEQ ID NO: 3923104 - DNA, 21 bp, Homo sapiens
gtggagtctcattctgttgcc

SEQ ID NO: 3923105 - DNA, 18 bp, Homo sapiens
gtggagtctgagtctgag

SEQ ID NO: 3923106 - DNA, 20 bp, Homo sapiens
gtggagtttgacattgtatg

SEQ ID NO: 3923107 - DNA, 14 bp, Homo sapiens
gtggatagctgcct

SEQ ID NO: 3923108 - DNA, 18 bp, Homo sapiens
gtggatgctccagggcag

SEQ ID NO: 3923109 - DNA, 20 bp, Homo sapiens
gtggatgctccagggcagcc

SEQ ID NO: 3923110 - DNA, 18 bp, Homo sapiens
gtggatttcctattttaa

SEQ ID NO: 3923111 - DNA, 15 bp, Homo sapiens
gtggcaaagtgctgt

SEQ ID NO: 3923112 - DNA, 15 bp, Homo sapiens
gtggcaagggggcgg

SEQ ID NO: 3923113 - DNA, 20 bp, Homo sapiens
gtggcaccagatgcaacctc

SEQ ID NO: 3923114 - DNA, 19 bp, Homo sapiens
gtggcacggagagaaggcc

SEQ ID NO: 3923115 - DNA, 14 bp, Homo sapiens
gtggcagaaaagag

SEQ ID NO: 3923116 - DNA, 18 bp, Homo sapiens
gtggcagaaaagaggaga

SEQ ID NO: 3923117 - DNA, 13 bp, Homo sapiens
gtggcagccatgc

SEQ ID NO: 3923118 - DNA, 14 bp, Homo sapiens
gtggcagccatgcc

SEQ ID NO: 3923119 - DNA, 15 bp, Homo sapiens
gtggcagccatgcct

SEQ ID NO: 3923120 - DNA, 19 bp, Homo sapiens
gtggcagccatgcctcatg

SEQ ID NO: 3923121 - DNA, 13 bp, Homo sapiens
gtggcaggaccag

SEQ ID NO: 3923122 - DNA, 20 bp, Homo sapiens
gtggcaggcacacagcagcc

SEQ ID NO: 3923123 - DNA, 23 bp, Homo sapiens
gtggcaggcacacagcagccccc

SEQ ID NO: 3923124 - DNA, 22 bp, Homo sapiens
gtggcatcgtagaagagatgtg

SEQ ID NO: 3923125 - DNA, 14 bp, Homo sapiens
gtggccagagctgg

SEQ ID NO: 3923126 - DNA, 15 bp, Homo sapiens
gtggccagagctgga

SEQ ID NO: 3923127 - DNA, 19 bp, Homo sapiens
gtggccagagctggaaggc

SEQ ID NO: 3923128 - DNA, 16 bp, Homo sapiens
gtggccatccctgggc

SEQ ID NO: 3923129 - DNA, 18 bp, Homo sapiens
gtggccatccctgggccc

SEQ ID NO: 3923130 - DNA, 15 bp, Homo sapiens
gtggccccaggtgcc

SEQ ID NO: 3923131 - DNA, 18 bp, Homo sapiens
gtggccccctgtgccagc

SEQ ID NO: 3923132 - DNA, 21 bp, Homo sapiens
gtggccccctgtgccagctca

SEQ ID NO: 3923133 - DNA, 18 bp, Homo sapiens
gtggcccctcacctgggc

SEQ ID NO: 3923134 - DNA, 16 bp, Homo sapiens
gtggccctggcctgct

SEQ ID NO: 3923135 - DNA, 17 bp, Homo sapiens
gtggccctggcctgctg

SEQ ID NO: 3923136 - DNA, 15 bp, Homo sapiens
gtggcccttcctgga

SEQ ID NO: 3923137 - DNA, 16 bp, Homo sapiens
gtggcccttcctggac

SEQ ID NO: 3923138 - DNA, 17 bp, Homo sapiens
gtggcccttcctggaca

SEQ ID NO: 3923139 - DNA, 21 bp, Homo sapiens
gtggcccttcctggacagctg

SEQ ID NO: 3923140 - DNA, 21 bp, Homo sapiens
gtggcctcacttccctgggaa

SEQ ID NO: 3923141 - DNA, 22 bp, Homo sapiens
gtggcctcacttccctgggaac

SEQ ID NO: 3923142 - DNA, 15 bp, Homo sapiens
gtggcctcagccctc

SEQ ID NO: 3923143 - DNA, 15 bp, Homo sapiens
gtggcctgtgtccag

SEQ ID NO: 3923144 - DNA, 17 bp, Homo sapiens
gtggcctgtgtccagca

SEQ ID NO: 3923145 - DNA, 19 bp, Homo sapiens
gtggcctgtgtccagcagc

SEQ ID NO: 3923146 - DNA, 22 bp, Homo sapiens
gtggcctgtgtccagcagctgc

SEQ ID NO: 3923147 - DNA, 21 bp, Homo sapiens
gtggccttccccttttgcctg

SEQ ID NO: 3923148 - DNA, 22 bp, Homo sapiens
gtggccttccccttttgcctgg

SEQ ID NO: 3923149 - DNA, 23 bp, Homo sapiens
gtggccttccccttttgcctggc

SEQ ID NO: 3923150 - DNA, 24 bp, Homo sapiens
gtggccttccccttttgcctggct

SEQ ID NO: 3923151 - DNA, 12 bp, Homo sapiens
gtggccttgccc

SEQ ID NO: 3923152 - DNA, 15 bp, Homo sapiens
gtggccttgcccgcc

SEQ ID NO: 3923153 - DNA, 23 bp, Homo sapiens
gtggccttgcccgccagcctcag

SEQ ID NO: 3923154 - DNA, 13 bp, Homo sapiens
gtggcgagaggag

SEQ ID NO: 3923155 - DNA, 19 bp, Homo sapiens
gtggctagtcagagagagt

SEQ ID NO: 3923156 - DNA, 13 bp, Homo sapiens
gtggctctccagt

SEQ ID NO: 3923157 - DNA, 13 bp, Homo sapiens
gtgtgtctgtctt

SEQ ID NO: 3923158 - DNA, 15 bp, Homo sapiens
gtgtgtctgttcact

SEQ ID NO: 3923159 - DNA, 18 bp, Homo sapiens
gtgtgtctgttgagtgca

SEQ ID NO: 3923160 - DNA, 14 bp, Homo sapiens
gtgtgtgaaaggaa

SEQ ID NO: 3923161 - DNA, 13 bp, Homo sapiens
gtgtgtgcatgtg

SEQ ID NO: 3923162 - DNA, 24 bp, Homo sapiens
gtgtgtggaaggcagggacagaga

SEQ ID NO: 3923163 - DNA, 18 bp, Homo sapiens
gtgtgtggtgtgtgtgct

SEQ ID NO: 3923164 - DNA, 12 bp, Homo sapiens
gtgtgtgtgtgt

SEQ ID NO: 3923165 - DNA, 22 bp, Homo sapiens
gtgtgtttaaataaagtatcat

SEQ ID NO: 3923166 - DNA, 22 bp, Homo sapiens
gtgtgtttccagatcgatcctg

SEQ ID NO: 3923167 - DNA, 21 bp, Homo sapiens
gtgttaggaggctgcatgctc

SEQ ID NO: 3923168 - DNA, 19 bp, Homo sapiens
gtgttccccatctgggtcc

SEQ ID NO: 3923169 - DNA, 16 bp, Homo sapiens
gtgttgaaaatgttca

SEQ ID NO: 3923170 - DNA, 18 bp, Homo sapiens
gtgttgaacacaattgat

SEQ ID NO: 3923171 - DNA, 22 bp, Homo sapiens
gtgttgccttagcacttctttc

SEQ ID NO: 3923172 - DNA, 19 bp, Homo sapiens
gtgttggctgtgtgacaga

SEQ ID NO: 3923173 - DNA, 13 bp, Homo sapiens
gtgttttctgaat

SEQ ID NO: 3923174 - DNA, 14 bp, Homo sapiens
gttaaaaaaaagcc

SEQ ID NO: 3923175 - DNA, 13 bp, Homo sapiens
gttaaaagacagt

SEQ ID NO: 3923176 - DNA, 18 bp, Homo sapiens
gttaaaatataaattaag

SEQ ID NO: 3923177 - DNA, 19 bp, Homo sapiens
gttaaaatataaattaaga

SEQ ID NO: 3923178 - DNA, 17 bp, Homo sapiens
gttaaagcatcagagat

SEQ ID NO: 3923179 - DNA, 20 bp, Homo sapiens
gttaaagtcagtgggaacgt

SEQ ID NO: 3923180 - DNA, 20 bp, Homo sapiens
gttaaccagaataaagttct

SEQ ID NO: 3923181 - DNA, 22 bp, Homo sapiens
gttaaggaccgtggccctgccc

SEQ ID NO: 3923182 - DNA, 19 bp, Homo sapiens
gttaaggacttctgcagct

SEQ ID NO: 3923183 - DNA, 24 bp, Homo sapiens
gttaataacttgtcctatgtcaat

SEQ ID NO: 3923184 - DNA, 16 bp, Homo sapiens
gttacaacagtaacac

SEQ ID NO: 3923185 - DNA, 17 bp, Homo sapiens
gttacatcacagtgttt

SEQ ID NO: 3923186 - DNA, 16 bp, Homo sapiens
gttacattaatgttaa

SEQ ID NO: 3923187 - DNA, 13 bp, Homo sapiens
gttaccatgaaga

SEQ ID NO: 3923188 - DNA, 19 bp, Homo sapiens
gttacctttcccatgctga

SEQ ID NO: 3923189 - DNA, 13 bp, Homo sapiens
gttactcagccct

SEQ ID NO: 3923190 - DNA, 17 bp, Homo sapiens
gttactcagccctgggc

SEQ ID NO: 3923191 - DNA, 18 bp, Homo sapiens
gttactcagccctgggcc

SEQ ID NO: 3923192 - DNA, 14 bp, Homo sapiens
gttactctccaacc

SEQ ID NO: 3923193 - DNA, 17 bp, Homo sapiens
gttactctccaacctgg

SEQ ID NO: 3923194 - DNA, 15 bp, Homo sapiens
gttactgattctcct

SEQ ID NO: 3923195 - DNA, 23 bp, Homo sapiens
gttacttcactttaattctcatg

SEQ ID NO: 3923196 - DNA, 19 bp, Homo sapiens
gttagaaatgcagaatcct

SEQ ID NO: 3923197 - DNA, 20 bp, Homo sapiens
gttagagaggtagcgagctg

SEQ ID NO: 3923198 - DNA, 20 bp, Homo sapiens
gttagccctcagtcagttcc

SEQ ID NO: 3923199 - DNA, 18 bp, Homo sapiens
gttaggaaataaaacctt

SEQ ID NO: 3923200 - DNA, 17 bp, Homo sapiens
gttaggaggctgcatgc

SEQ ID NO: 3923201 - DNA, 20 bp, Homo sapiens
gttaggaggctgcatgctct

SEQ ID NO: 3923202 - DNA, 23 bp, Homo sapiens
gttaggatttaacagtcatttaa

SEQ ID NO: 3923203 - DNA, 14 bp, Homo sapiens
gttatatattgtat

SEQ ID NO: 3923204 - DNA, 16 bp, Homo sapiens
gttatatattgtatta

SEQ ID NO: 3923205 - DNA, 17 bp, Homo sapiens
gttatatattgtattaa

SEQ ID NO: 3923206 - DNA, 19 bp, Homo sapiens
gttatattgaatatatcag

SEQ ID NO: 3923207 - DNA, 15 bp, Homo sapiens
gttatcagttaacat

SEQ ID NO: 3923208 - DNA, 17 bp, Homo sapiens
gttatctgcctggcctg

SEQ ID NO: 3923209 - DNA, 18 bp, Homo sapiens
gttatgtatatagatgtg

SEQ ID NO: 3923210 - DNA, 12 bp, Homo sapiens
gttattttcagt

SEQ ID NO: 3923211 - DNA, 17 bp, Homo sapiens
gttattttcagtatttt

SEQ ID NO: 3923212 - DNA, 19 bp, Homo sapiens
gttatttttgtccctgctc

SEQ ID NO: 3923213 - DNA, 15 bp, Homo sapiens
gttcaacttccagaa

SEQ ID NO: 3923214 - DNA, 13 bp, Homo sapiens
gttcaagaaataa

SEQ ID NO: 3923215 - DNA, 16 bp, Homo sapiens
gttcaagaccagcctg

SEQ ID NO: 3923216 - DNA, 23 bp, Homo sapiens
gttcaagcgattcttgtgcctca

SEQ ID NO: 3923217 - DNA, 20 bp, Homo sapiens
gttcaatgcaaagtaaaaaa

SEQ ID NO: 3923218 - DNA, 14 bp, Homo sapiens
gttcactagagctg

SEQ ID NO: 3923219 - DNA, 15 bp, Homo sapiens
gttcagcccctcctc

SEQ ID NO: 3923220 - DNA, 18 bp, Homo sapiens
gttcagcccctcctctgc

SEQ ID NO: 3923221 - DNA, 23 bp, Homo sapiens
gttcagcccctcctctgccacct

SEQ ID NO: 3923222 - DNA, 19 bp, Homo sapiens
gttcagctaagctaggaat

SEQ ID NO: 3923223 - DNA, 14 bp, Homo sapiens
gttcagggaagcag

SEQ ID NO: 3923224 - DNA, 15 bp, Homo sapiens
gttcagggaagcagg

SEQ ID NO: 3923225 - DNA, 20 bp, Homo sapiens
gttcagggaagcaggcagag

SEQ ID NO: 3923226 - DNA, 20 bp, Homo sapiens
gttcatctgagcaagagctg

SEQ ID NO: 3923227 - DNA, 22 bp, Homo sapiens
gttcatggcagatgtaggaggg

SEQ ID NO: 3923228 - DNA, 16 bp, Homo sapiens
gttcatggtgatcagt

SEQ ID NO: 3923229 - DNA, 14 bp, Homo sapiens
gttccacttctcta

SEQ ID NO: 3923230 - DNA, 19 bp, Homo sapiens
gttccacttctctagagaa

SEQ ID NO: 3923231 - DNA, 16 bp, Homo sapiens
gttccagctgcctggg

SEQ ID NO: 3923232 - DNA, 21 bp, Homo sapiens
gttcccaagagcatcatgcct

SEQ ID NO: 3923233 - DNA, 23 bp, Homo sapiens
gttcccaagagcatcatgcctct

SEQ ID NO: 3923234 - DNA, 18 bp, Homo sapiens
gttccccatctgggtcct

SEQ ID NO: 3923235 - DNA, 17 bp, Homo sapiens
gttccccttggcttcct

SEQ ID NO: 3923236 - DNA, 15 bp, Homo sapiens
gttcccggagcacag

SEQ ID NO: 3923237 - DNA, 20 bp, Homo sapiens
gttcccggagcacagccctg

SEQ ID NO: 3923238 - DNA, 22 bp, Homo sapiens
gttcccggagcacagccctggg

SEQ ID NO: 3923239 - DNA, 23 bp, Homo sapiens
gttcccggagcacagccctggga

SEQ ID NO: 3923240 - DNA, 20 bp, Homo sapiens
gttccctacttcctgtgact

SEQ ID NO: 3923241 - DNA, 21 bp, Homo sapiens
gttccctagctgaggatgaca

SEQ ID NO: 3923242 - DNA, 12 bp, Homo sapiens
gttccctctgag

SEQ ID NO: 3923243 - DNA, 13 bp, Homo sapiens
gttgtctctctaa

SEQ ID NO: 3923244 - DNA, 19 bp, Homo sapiens
gttgtctgaagtcactgca

SEQ ID NO: 3923245 - DNA, 14 bp, Homo sapiens
gttgtgaggcctgg

SEQ ID NO: 3923246 - DNA, 21 bp, Homo sapiens
gttgtgatcatcccatctaag

SEQ ID NO: 3923247 - DNA, 17 bp, Homo sapiens
gttgtgattttgtacag

SEQ ID NO: 3923248 - DNA, 14 bp, Homo sapiens
gttgtggatgctcc

SEQ ID NO: 3923249 - DNA, 17 bp, Homo sapiens
gttgtggatgctccagg

SEQ ID NO: 3923250 - DNA, 12 bp, Homo sapiens
gttgtgggcttt

SEQ ID NO: 3923251 - DNA, 15 bp, Homo sapiens
gttgttactgattct

SEQ ID NO: 3923252 - DNA, 16 bp, Homo sapiens
gttgttactgattctc

SEQ ID NO: 3923253 - DNA, 14 bp, Homo sapiens
gttgttcccacaca

SEQ ID NO: 3923254 - DNA, 19 bp, Homo sapiens
gttgttgcaccatctgctt

SEQ ID NO: 3923255 - DNA, 13 bp, Homo sapiens
gtttaaaaaatac

SEQ ID NO: 3923256 - DNA, 16 bp, Homo sapiens
gtttaaaaacaggaaa

SEQ ID NO: 3923257 - DNA, 17 bp, Homo sapiens
gtttaaaaacaggaaaa

SEQ ID NO: 3923258 - DNA, 10 bp, Homo sapiens
gtttaaaatc

SEQ ID NO: 3923259 - DNA, 16 bp, Homo sapiens
gtttaaaatcatttct

SEQ ID NO: 3923260 - DNA, 16 bp, Homo sapiens
gtttaaataaagtatc

SEQ ID NO: 3923261 - DNA, 14 bp, Homo sapiens
gtttaaattgtaaa

SEQ ID NO: 3923262 - DNA, 14 bp, Homo sapiens
gtttaatttaaagc

SEQ ID NO: 3923263 - DNA, 15 bp, Homo sapiens
gtttaatttaaagcc

SEQ ID NO: 3923264 - DNA, 15 bp, Homo sapiens
gtttacaaaaggcag

SEQ ID NO: 3923265 - DNA, 18 bp, Homo sapiens
gtttacaagtgtatatca

SEQ ID NO: 3923266 - DNA, 23 bp, Homo sapiens
gtttacaagtgtatatcagaaaa

SEQ ID NO: 3923267 - DNA, 17 bp, Homo sapiens
gtttacttttcagggca

SEQ ID NO: 3923268 - DNA, 19 bp, Homo sapiens
gtttacttttcagggcatc

SEQ ID NO: 3923269 - DNA, 22 bp, Homo sapiens
gtttagatcccatgtcacctca

SEQ ID NO: 3923270 - DNA, 15 bp, Homo sapiens
gtttatgtctaaaga

SEQ ID NO: 3923271 - DNA, 13 bp, Homo sapiens
gtttattaacaaa

SEQ ID NO: 3923272 - DNA, 17 bp, Homo sapiens
gtttattgcttaatccc

SEQ ID NO: 3923273 - DNA, 20 bp, Homo sapiens
gtttattggaagtgttcaag

SEQ ID NO: 3923274 - DNA, 14 bp, Homo sapiens
gtttatttattcac

SEQ ID NO: 3923275 - DNA, 15 bp, Homo sapiens
gtttatttattcact

SEQ ID NO: 3923276 - DNA, 17 bp, Homo sapiens
gtttatttattctgcat

SEQ ID NO: 3923277 - DNA, 12 bp, Homo sapiens
gtttatttccaa

SEQ ID NO: 3923278 - DNA, 21 bp, Homo sapiens
gtttatttccaaataaaatga

SEQ ID NO: 3923279 - DNA, 15 bp, Homo sapiens
gtttcagaagcccca

SEQ ID NO: 3923280 - DNA, 21 bp, Homo sapiens
gtttcagatatatatcatatt

SEQ ID NO: 3923281 - DNA, 19 bp, Homo sapiens
gtttcatttctactgtgac

SEQ ID NO: 3923282 - DNA, 16 bp, Homo sapiens
gtttccagaaaatata

SEQ ID NO: 3923283 - DNA, 23 bp, Homo sapiens
gtttccagtacacctttcagcca

SEQ ID NO: 3923284 - DNA, 21 bp, Homo sapiens
gtttccatttctcaatcagtg

SEQ ID NO: 3923285 - DNA, 22 bp, Homo sapiens
gtttcccgccaggaggtcctcc

SEQ ID NO: 3923286 - DNA, 13 bp, Homo sapiens
gtttctaaaacta

SEQ ID NO: 3923287 - DNA, 17 bp, Homo sapiens
gtttctagaggcctcag

SEQ ID NO: 3923288 - DNA, 12 bp, Homo sapiens
gtttgaacttca

SEQ ID NO: 3923289 - DNA, 21 bp, Homo sapiens
gtttgacctcacagtgaccct

SEQ ID NO: 3923290 - DNA, 17 bp, Homo sapiens
gtttgagacaagccctg

SEQ ID NO: 3923291 - DNA, 22 bp, Homo sapiens
gtttgagcgcagagtaaaataa

SEQ ID NO: 3923292 - DNA, 15 bp, Homo sapiens
gtttgagctcagacc

SEQ ID NO: 3923293 - DNA, 20 bp, Homo sapiens
gtttgatgtcattaatgtgt

SEQ ID NO: 3923294 - DNA, 17 bp, Homo sapiens
gtttgccagtgaagact

SEQ ID NO: 3923295 - DNA, 20 bp, Homo sapiens
gtttggatgggagtgagaca

SEQ ID NO: 3923296 - DNA, 14 bp, Homo sapiens
gtttggcttcctcc

SEQ ID NO: 3923297 - DNA, 12 bp, Homo sapiens
gtttgggagagt

SEQ ID NO: 3923298 - DNA, 22 bp, Homo sapiens
gtttggggaatgcggccgcatt

SEQ ID NO: 3923299 - DNA, 15 bp, Homo sapiens
gtttggggcaggagt

SEQ ID NO: 3923300 - DNA, 23 bp, Homo sapiens
gtttggggcaggagtagctgagc

SEQ ID NO: 3923301 - DNA, 19 bp, Homo sapiens
gtttgtcatatattcatgt

SEQ ID NO: 3923302 - DNA, 19 bp, Homo sapiens
gtttgtggaaaatgaaaat

SEQ ID NO: 3923303 - DNA, 19 bp, Homo sapiens
gttttaaacatagaaagtt

SEQ ID NO: 3923304 - DNA, 19 bp, Homo sapiens
gttttaaatttatttcaaa

SEQ ID NO: 3923305 - DNA, 22 bp, Homo sapiens
gttttaacaatttcctttatat

SEQ ID NO: 3923306 - DNA, 21 bp, Homo sapiens
gttttacaaatttttcctgca

SEQ ID NO: 3923307 - DNA, 23 bp, Homo sapiens
gttttacaataaaatcttgaaaa

SEQ ID NO: 3923308 - DNA, 21 bp, Homo sapiens
gttttacttttgtcttcctca

SEQ ID NO: 3923309 - DNA, 13 bp, Homo sapiens
gttttagaatgat

SEQ ID NO: 3923310 - DNA, 22 bp, Homo sapiens
gttttatcatgacatgttatat

SEQ ID NO: 3923311 - DNA, 15 bp, Homo sapiens
gttttattctgactt

SEQ ID NO: 3923312 - DNA, 22 bp, Homo sapiens
gttttattgtccttcagagctc

SEQ ID NO: 3923313 - DNA, 19 bp, Homo sapiens
gttttcacatacactcaaa

SEQ ID NO: 3923314 - DNA, 17 bp, Homo sapiens
gttttcagactcagact

SEQ ID NO: 3923315 - DNA, 16 bp, Homo sapiens
gttttcataacttgct

SEQ ID NO: 3923316 - DNA, 23 bp, Homo sapiens
gttttcataacttgctgaatttc

SEQ ID NO: 3923317 - DNA, 16 bp, Homo sapiens
gttttcatcctggcct

SEQ ID NO: 3923318 - DNA, 17 bp, Homo sapiens
gttttcatcctggcctc

SEQ ID NO: 3923319 - DNA, 19 bp, Homo sapiens
gttttctaactgtaaatca

SEQ ID NO: 3923320 - DNA, 17 bp, Homo sapiens
gttttctcagaacagct

SEQ ID NO: 3923321 - DNA, 20 bp, Homo sapiens
gttttctcagaacagctgaa

SEQ ID NO: 3923322 - DNA, 18 bp, Homo sapiens
gttttctcctcccaggaa

SEQ ID NO: 3923323 - DNA, 21 bp, Homo sapiens
gttttctcctcccaggaactg

SEQ ID NO: 3923324 - DNA, 17 bp, Homo sapiens
gttttctgagaaagact

SEQ ID NO: 3923325 - DNA, 16 bp, Homo sapiens
gttttctttgtaaagg

SEQ ID NO: 3923326 - DNA, 23 bp, Homo sapiens
gttttgaactaataaaagcataa

SEQ ID NO: 3923327 - DNA, 19 bp, Homo sapiens
gttttgatttgtactgaaa

SEQ ID NO: 3923328 - DNA, 14 bp, Homo sapiens
gttttgcactgaca

SEQ ID NO: 3923329 - DNA, 11 bp, Homo sapiens
taaaccagcag

SEQ ID NO: 3923330 - DNA, 13 bp, Homo sapiens
taaaccagcagaa

SEQ ID NO: 3923331 - DNA, 14 bp, Homo sapiens
taaaccagcagaaa

SEQ ID NO: 3923332 - DNA, 16 bp, Homo sapiens
taaaccagcagaaaag

SEQ ID NO: 3923333 - DNA, 17 bp, Homo sapiens
taaaccagcagaaaagt

SEQ ID NO: 3923334 - DNA, 19 bp, Homo sapiens
taaacccaggaggcggagg

SEQ ID NO: 3923335 - DNA, 22 bp, Homo sapiens
taaacccccgctccagatctgc

SEQ ID NO: 3923336 - DNA, 17 bp, Homo sapiens
taaacccctgggtaact

SEQ ID NO: 3923337 - DNA, 16 bp, Homo sapiens
taaacctggagatgat

SEQ ID NO: 3923338 - DNA, 18 bp, Homo sapiens
taaacctggagatgatga

SEQ ID NO: 3923339 - DNA, 19 bp, Homo sapiens
taaacctggagatgatgat

SEQ ID NO: 3923340 - DNA, 15 bp, Homo sapiens
taaactactgtaatt

SEQ ID NO: 3923341 - DNA, 12 bp, Homo sapiens
taaactagtttc

SEQ ID NO: 3923342 - DNA, 13 bp, Homo sapiens
taaactagtttcc

SEQ ID NO: 3923343 - DNA, 16 bp, Homo sapiens
taaactagtttccagt

SEQ ID NO: 3923344 - DNA, 18 bp, Homo sapiens
taaactagtttccagtgg

SEQ ID NO: 3923345 - DNA, 15 bp, Homo sapiens
taaactatttgtctt

SEQ ID NO: 3923346 - DNA, 16 bp, Homo sapiens
taaactcaaaatattt

SEQ ID NO: 3923347 - DNA, 21 bp, Homo sapiens
taaactcaaaatatttgtaca

SEQ ID NO: 3923348 - DNA, 22 bp, Homo sapiens
taaactctaaacattaatcaat

SEQ ID NO: 3923349 - DNA, 19 bp, Homo sapiens
taaactgaaaaatgtcagt

SEQ ID NO: 3923350 - DNA, 20 bp, Homo sapiens
taaactgtatcaaatctgta

SEQ ID NO: 3923351 - DNA, 15 bp, Homo sapiens
taaacttagaataaa

SEQ ID NO: 3923352 - DNA, 20 bp, Homo sapiens
taaacttagaataaaattgt

SEQ ID NO: 3923353 - DNA, 21 bp, Homo sapiens
taaacttagaataaaattgta

SEQ ID NO: 3923354 - DNA, 17 bp, Homo sapiens
taaacttattcctcctt

SEQ ID NO: 3923355 - DNA, 13 bp, Homo sapiens
taaacttcagcac

SEQ ID NO: 3923356 - DNA, 15 bp, Homo sapiens
taaactttgtgcctt

SEQ ID NO: 3923357 - DNA, 16 bp, Homo sapiens
taaactttgtgccttt

SEQ ID NO: 3923358 - DNA, 17 bp, Homo sapiens
taaagaactccttattt

SEQ ID NO: 3923359 - DNA, 14 bp, Homo sapiens
taaagaagtaaatt

SEQ ID NO: 3923360 - DNA, 14 bp, Homo sapiens
taaagacagaaaaa

SEQ ID NO: 3923361 - DNA, 20 bp, Homo sapiens
taaagacagaaaaaaataaa

SEQ ID NO: 3923362 - DNA, 22 bp, Homo sapiens
taaagacagaaaaaaataaaaa

SEQ ID NO: 3923363 - DNA, 15 bp, Homo sapiens
taaagactgagaccc

SEQ ID NO: 3923364 - DNA, 13 bp, Homo sapiens
taaagacttaaga

SEQ ID NO: 3923365 - DNA, 23 bp, Homo sapiens
taaagagcatggaaaaatactgc

SEQ ID NO: 3923366 - DNA, 10 bp, Homo sapiens
taaagagctc

SEQ ID NO: 3923367 - DNA, 16 bp, Homo sapiens
taaagagtatttacaa

SEQ ID NO: 3923368 - DNA, 17 bp, Homo sapiens
taaagatatcagagctc

SEQ ID NO: 3923369 - DNA, 20 bp, Homo sapiens
taaagatatcagagctctta

SEQ ID NO: 3923370 - DNA, 22 bp, Homo sapiens
taaagatgtcaaatatctcaga

SEQ ID NO: 3923371 - DNA, 11 bp, Homo sapiens
taaagatgtgt

SEQ ID NO: 3923372 - DNA, 15 bp, Homo sapiens
taaagcctatttttc

SEQ ID NO: 3923373 - DNA, 17 bp, Homo sapiens
taaagcctatttttcaa

SEQ ID NO: 3923374 - DNA, 17 bp, Homo sapiens
taaagctgcctgtagtt

SEQ ID NO: 3923375 - DNA, 16 bp, Homo sapiens
taaagctggacaagaa

SEQ ID NO: 3923376 - DNA, 18 bp, Homo sapiens
taaagctggacaagaagc

SEQ ID NO: 3923377 - DNA, 19 bp, Homo sapiens
taaagctggacaagaagct

SEQ ID NO: 3923378 - DNA, 23 bp, Homo sapiens
taaagctggacaagaagctgcta

SEQ ID NO: 3923379 - DNA, 16 bp, Homo sapiens
taaaggaagtcaccaa

SEQ ID NO: 3923380 - DNA, 18 bp, Homo sapiens
taaaggaagtcaccaaaa

SEQ ID NO: 3923381 - DNA, 20 bp, Homo sapiens
taaagggcaggtggttctaa

SEQ ID NO: 3923382 - DNA, 16 bp, Homo sapiens
taaagtacctgtagtg

SEQ ID NO: 3923383 - DNA, 15 bp, Homo sapiens
taaagtatcatgcat

SEQ ID NO: 3923384 - DNA, 16 bp, Homo sapiens
taaagtatcatgcatt

SEQ ID NO: 3923385 - DNA, 15 bp, Homo sapiens
taaagtatgtaaaca

SEQ ID NO: 3923386 - DNA, 16 bp, Homo sapiens
taaagtatgtaaacag

SEQ ID NO: 3923387 - DNA, 22 bp, Homo sapiens
taaagtatgtaaacaggagaca

SEQ ID NO: 3923388 - DNA, 22 bp, Homo sapiens
taaagtcaacaaccatgccagg

SEQ ID NO: 3923389 - DNA, 16 bp, Homo sapiens
taaagtcacttccagt

SEQ ID NO: 3923390 - DNA, 16 bp, Homo sapiens
taaagtgataatttct

SEQ ID NO: 3923391 - DNA, 12 bp, Homo sapiens
taaagtgtaata

SEQ ID NO: 3923392 - DNA, 16 bp, Homo sapiens
taaagtgtaataatat

SEQ ID NO: 3923393 - DNA, 12 bp, Homo sapiens
taaagtgtctat

SEQ ID NO: 3923394 - DNA, 23 bp, Homo sapiens
taaagtgtctattagttttcttt

SEQ ID NO: 3923395 - DNA, 14 bp, Homo sapiens
taaagtttacagta

SEQ ID NO: 3923396 - DNA, 19 bp, Homo sapiens
taaagtttacagtctttct

SEQ ID NO: 3923397 - DNA, 10 bp, Homo sapiens
taaataaaag

SEQ ID NO: 3923398 - DNA, 14 bp, Homo sapiens
taaataaatagatt

SEQ ID NO: 3923399 - DNA, 15 bp, Homo sapiens
taaataaatagattt

SEQ ID NO: 3923400 - DNA, 22 bp, Homo sapiens
taaataaatgaagtatttctca

SEQ ID NO: 3923401 - DNA, 12 bp, Homo sapiens
taaataaattca

SEQ ID NO: 3923402 - DNA, 18 bp, Homo sapiens
taaataaattcaaaccat

SEQ ID NO: 3923403 - DNA, 23 bp, Homo sapiens
taaatacaaaataaaattatggt

SEQ ID NO: 3923404 - DNA, 23 bp, Homo sapiens
taaatacaccacctcactcctgt

SEQ ID NO: 3923405 - DNA, 15 bp, Homo sapiens
taaatacagacacta

SEQ ID NO: 3923406 - DNA, 17 bp, Homo sapiens
taaatacagacactaag

SEQ ID NO: 3923407 - DNA, 13 bp, Homo sapiens
taaatacatgtgt

SEQ ID NO: 3923408 - DNA, 17 bp, Homo sapiens
taaatacatgtgtggat

SEQ ID NO: 3923409 - DNA, 22 bp, Homo sapiens
taaatacctcaacctatggtat

SEQ ID NO: 3923410 - DNA, 15 bp, Homo sapiens
taaatactgtacata

SEQ ID NO: 3923411 - DNA, 16 bp, Homo sapiens
taaatactgtacatag

SEQ ID NO: 3923412 - DNA, 14 bp, Homo sapiens
taaatagagttcca

SEQ ID NO: 3923413 - DNA, 22 bp, Homo sapiens
taaatagatttgattatttcct

SEQ ID NO: 3923414 - DNA, 18 bp, Homo sapiens
taaatatatatttttcaa

SEQ ID NO: 3923415 - DNA, 11 bp, Homo sapiens
taaatatatgt

SEQ ID NO: 3923416 - DNA, 22 bp, Homo sapiens
taactggaagcatgtaggagaa

SEQ ID NO: 3923417 - DNA, 13 bp, Homo sapiens
taactggtataga

SEQ ID NO: 3923418 - DNA, 11 bp, Homo sapiens
taactgtaaat

SEQ ID NO: 3923419 - DNA, 15 bp, Homo sapiens
taactgtaaatcact

SEQ ID NO: 3923420 - DNA, 18 bp, Homo sapiens
taactgtaaatcacttgt

SEQ ID NO: 3923421 - DNA, 20 bp, Homo sapiens
taactgtaaatcacttgtaa

SEQ ID NO: 3923422 - DNA, 18 bp, Homo sapiens
taactgtgtgaagaaatg

SEQ ID NO: 3923423 - DNA, 19 bp, Homo sapiens
taactgtgtgaagaaatgg

SEQ ID NO: 3923424 - DNA, 17 bp, Homo sapiens
taacttcaaatatagag

SEQ ID NO: 3923425 - DNA, 19 bp, Homo sapiens
taacttgcttagtatggtt

SEQ ID NO: 3923426 - DNA, 14 bp, Homo sapiens
tgagacctcagcca

SEQ ID NO: 3923427 - DNA, 16 bp, Homo sapiens
tgagacctcagccatg

SEQ ID NO: 3923428 - DNA, 19 bp, Homo sapiens
tgagacctcagccatgagg

SEQ ID NO: 3923429 - DNA, 15 bp, Homo sapiens
tgagacggcagagac

SEQ ID NO: 3923430 - DNA, 23 bp, Homo sapiens
tgagactctcttaggagcagagc

SEQ ID NO: 3923431 - DNA, 20 bp, Homo sapiens
tgagagaaaaagtgcccctt

SEQ ID NO: 3923432 - DNA, 17 bp, Homo sapiens
tgagagaatctgcctgt

SEQ ID NO: 3923433 - DNA, 20 bp, Homo sapiens
tgagaggaagatgaagagaa

SEQ ID NO: 3923434 - DNA, 16 bp, Homo sapiens
tgagaggcagaggcag

SEQ ID NO: 3923435 - DNA, 14 bp, Homo sapiens
tgagaggccctgga

SEQ ID NO: 3923436 - DNA, 16 bp, Homo sapiens
tgagaggccctggatc

SEQ ID NO: 3923437 - DNA, 21 bp, Homo sapiens
tgagaggcgacaggagtattt

SEQ ID NO: 3923438 - DNA, 17 bp, Homo sapiens
tgagagggcatgcgcac

SEQ ID NO: 3923439 - DNA, 19 bp, Homo sapiens
tgagagtctgaaagacaga

SEQ ID NO: 3923440 - DNA, 21 bp, Homo sapiens
tgagagttggctcaggcagac

SEQ ID NO: 3923441 - DNA, 18 bp, Homo sapiens
tgagatggagtctcactc

SEQ ID NO: 3923442 - DNA, 13 bp, Homo sapiens
tgagatgtgaaca

SEQ ID NO: 3923443 - DNA, 24 bp, Homo sapiens
tgagatgtgaacacatcagcttgc

SEQ ID NO: 3923444 - DNA, 19 bp, Homo sapiens
tgagattacagaggaagtt

SEQ ID NO: 3923445 - DNA, 20 bp, Homo sapiens
tgagcaaggacaacctgccc

SEQ ID NO: 3923446 - DNA, 13 bp, Homo sapiens
tgagcaccccctc

SEQ ID NO: 3923447 - DNA, 23 bp, Homo sapiens
tgagcaccccctcattcccctcg

SEQ ID NO: 3923448 - DNA, 17 bp, Homo sapiens
tgagcaccgtcatggct

SEQ ID NO: 3923449 - DNA, 21 bp, Homo sapiens
tgagcacctgcttcatgctca

SEQ ID NO: 3923450 - DNA, 13 bp, Homo sapiens
tgagcactgccag

SEQ ID NO: 3923451 - DNA, 14 bp, Homo sapiens
tgagcactgccagg

SEQ ID NO: 3923452 - DNA, 15 bp, Homo sapiens
tgagcactgccagga

SEQ ID NO: 3923453 - DNA, 16 bp, Homo sapiens
tgagcactgccaggag

SEQ ID NO: 3923454 - DNA, 13 bp, Homo sapiens
tgagcactgtagg

SEQ ID NO: 3923455 - DNA, 20 bp, Homo sapiens
tgagcagaggagtccagggc

SEQ ID NO: 3923456 - DNA, 22 bp, Homo sapiens
tgagcaggcccgacagagagat

SEQ ID NO: 3923457 - DNA, 19 bp, Homo sapiens
tgagcatgcacagctgctt

SEQ ID NO: 3923458 - DNA, 22 bp, Homo sapiens
tgagcccaggagctgagtcacc

SEQ ID NO: 3923459 - DNA, 12 bp, Homo sapiens
tgagcccaggcc

SEQ ID NO: 3923460 - DNA, 14 bp, Homo sapiens
tgagcccagggagg

SEQ ID NO: 3923461 - DNA, 15 bp, Homo sapiens
tgagcccagggaggc

SEQ ID NO: 3923462 - DNA, 21 bp, Homo sapiens
tgagccgagattgcgccactg

SEQ ID NO: 3923463 - DNA, 17 bp, Homo sapiens
tgagccgcatcttctcc

SEQ ID NO: 3923464 - DNA, 23 bp, Homo sapiens
tgagccgcatcttctccatctgg

SEQ ID NO: 3923465 - DNA, 19 bp, Homo sapiens
tgagcgcagagtaaaataa

SEQ ID NO: 3923466 - DNA, 21 bp, Homo sapiens
tgagctatgattatgccactg

SEQ ID NO: 3923467 - DNA, 18 bp, Homo sapiens
tgagctcacaaggcagca

SEQ ID NO: 3923468 - DNA, 19 bp, Homo sapiens
tgagctcacaaggcagcaa

SEQ ID NO: 3923469 - DNA, 22 bp, Homo sapiens
tgagctcacaaggcagcaaggc

SEQ ID NO: 3923470 - DNA, 20 bp, Homo sapiens
tgagctcagacccccactct

SEQ ID NO: 3923471 - DNA, 16 bp, Homo sapiens
tgagctgaagacaaac

SEQ ID NO: 3923472 - DNA, 17 bp, Homo sapiens
tgagctgagatcgtgcc

SEQ ID NO: 3923473 - DNA, 19 bp, Homo sapiens
tgagctggggcctggagag

SEQ ID NO: 3923474 - DNA, 23 bp, Homo sapiens
tgagctggggcctggagaggggc

SEQ ID NO: 3923475 - DNA, 23 bp, Homo sapiens
tgagctgtatatatatatgtgtg

SEQ ID NO: 3923476 - DNA, 23 bp, Homo sapiens
tgagcttagccttgtgccctgcc

SEQ ID NO: 3923477 - DNA, 18 bp, Homo sapiens
tgagcttttcatggaagt

SEQ ID NO: 3923478 - DNA, 18 bp, Homo sapiens
tgaggaacctcaaactgg

SEQ ID NO: 3923479 - DNA, 19 bp, Homo sapiens
tgaggacaaccattccaga

SEQ ID NO: 3923480 - DNA, 20 bp, Homo sapiens
tgaggacaaccattccagac

SEQ ID NO: 3923481 - DNA, 14 bp, Homo sapiens
tgaggacacatgtc

SEQ ID NO: 3923482 - DNA, 21 bp, Homo sapiens
tgaggacacgtggcctgcacc

SEQ ID NO: 3923483 - DNA, 19 bp, Homo sapiens
tgaggacatggagagagac

SEQ ID NO: 3923484 - DNA, 21 bp, Homo sapiens
tgaggactcatatatttaagc

SEQ ID NO: 3923485 - DNA, 14 bp, Homo sapiens
tgaggagagaagga

SEQ ID NO: 3923486 - DNA, 14 bp, Homo sapiens
tgaggagggtgccc

SEQ ID NO: 3923487 - DNA, 13 bp, Homo sapiens
tgaggagggtgga

SEQ ID NO: 3923488 - DNA, 15 bp, Homo sapiens
tgaggagtagctgag

SEQ ID NO: 3923489 - DNA, 22 bp, Homo sapiens
tgaggagtagctgagaggaaga

SEQ ID NO: 3923490 - DNA, 22 bp, Homo sapiens
tgaggagtctgaggtcctgagc

SEQ ID NO: 3923491 - DNA, 19 bp, Homo sapiens
tgcagaaaaaaaaaaagaa

SEQ ID NO: 3923492 - DNA, 17 bp, Homo sapiens
tgcagaaaagcacctgc

SEQ ID NO: 3923493 - DNA, 21 bp, Homo sapiens
tgcagaaaagcacctgccgac

SEQ ID NO: 3923494 - DNA, 22 bp, Homo sapiens
tgcagaaaagcacctgccgacc

SEQ ID NO: 3923495 - DNA, 15 bp, Homo sapiens
tgcagaaggccaaga

SEQ ID NO: 3923496 - DNA, 15 bp, Homo sapiens
tgcagaccctgccct

SEQ ID NO: 3923497 - DNA, 22 bp, Homo sapiens
tgcagagacgcaagggagaaga

SEQ ID NO: 3923498 - DNA, 13 bp, Homo sapiens
tgcagagagaagc

SEQ ID NO: 3923499 - DNA, 14 bp, Homo sapiens
tgcagagagaagcc

SEQ ID NO: 3923500 - DNA, 13 bp, Homo sapiens
tgcagagatttcc

SEQ ID NO: 3923501 - DNA, 14 bp, Homo sapiens
tgcagagctatggt

SEQ ID NO: 3923502 - DNA, 13 bp, Homo sapiens
tgcagaggattta

SEQ ID NO: 3923503 - DNA, 20 bp, Homo sapiens
tgcagaggtaaaagtgtgag

SEQ ID NO: 3923504 - DNA, 15 bp, Homo sapiens
tgcagaggtgagcag

SEQ ID NO: 3923505 - DNA, 12 bp, Homo sapiens
tgcagaggtttc

SEQ ID NO: 3923506 - DNA, 14 bp, Homo sapiens
tgcagaggtttctt

SEQ ID NO: 3923507 - DNA, 18 bp, Homo sapiens
tgcagatagccagacaca

SEQ ID NO: 3923508 - DNA, 15 bp, Homo sapiens
tgcagattcctgggc

SEQ ID NO: 3923509 - DNA, 19 bp, Homo sapiens
tgcagattcctgggcctgt

SEQ ID NO: 3923510 - DNA, 13 bp, Homo sapiens
tgcagcaactccc

SEQ ID NO: 3923511 - DNA, 15 bp, Homo sapiens
tgcagcaactcccac

SEQ ID NO: 3923512 - DNA, 17 bp, Homo sapiens
tgcagcaactcccacga

SEQ ID NO: 3923513 - DNA, 22 bp, Homo sapiens
tgcagcactttaaccctctctt

SEQ ID NO: 3923514 - DNA, 14 bp, Homo sapiens
tgcagcagcccagc

SEQ ID NO: 3923515 - DNA, 14 bp, Homo sapiens
tgcagccagcccag

SEQ ID NO: 3923516 - DNA, 20 bp, Homo sapiens
tgcagcccggcgccaccatc

SEQ ID NO: 3923517 - DNA, 17 bp, Homo sapiens
tgcagcctcctcctgac

SEQ ID NO: 3923518 - DNA, 21 bp, Homo sapiens
tgcagctctttcttctttgaa

SEQ ID NO: 3923519 - DNA, 18 bp, Homo sapiens
tgcagctgggccccatgc

SEQ ID NO: 3923520 - DNA, 22 bp, Homo sapiens
tgcagctgggccccatgctctg

SEQ ID NO: 3923521 - DNA, 15 bp, Homo sapiens
tgcagcttcatcaat

SEQ ID NO: 3923522 - DNA, 16 bp, Homo sapiens
tgcagcttctgtcctg

SEQ ID NO: 3923523 - DNA, 16 bp, Homo sapiens
tgcagcttgtagccag

SEQ ID NO: 3923524 - DNA, 16 bp, Homo sapiens
tgcaggaacgagcact

SEQ ID NO: 3923525 - DNA, 14 bp, Homo sapiens
tgcaggcccagcag

SEQ ID NO: 3923526 - DNA, 10 bp, Homo sapiens
tgcaggcccc

SEQ ID NO: 3923527 - DNA, 21 bp, Homo sapiens
tgcaggccgggtggccaatcc

SEQ ID NO: 3923528 - DNA, 13 bp, Homo sapiens
tgcaggctctggg

SEQ ID NO: 3923529 - DNA, 20 bp, Homo sapiens
tgcaggctctgggctcaggg

SEQ ID NO: 3923530 - DNA, 21 bp, Homo sapiens
tgcaggctctgggctcagggc

SEQ ID NO: 3923531 - DNA, 13 bp, Homo sapiens
tgcagggaagagg

SEQ ID NO: 3923532 - DNA, 16 bp, Homo sapiens
tgcagggaagagggca

SEQ ID NO: 3923533 - DNA, 17 bp, Homo sapiens
tgcagggaagagggcag

SEQ ID NO: 3923534 - DNA, 23 bp, Homo sapiens
tgcaggtacttcctcctgatggc

SEQ ID NO: 3923535 - DNA, 19 bp, Homo sapiens
tgcaggtattttaactgtg

SEQ ID NO: 3923536 - DNA, 20 bp, Homo sapiens
tgcaggtattttaactgtgt

SEQ ID NO: 3923537 - DNA, 15 bp, Homo sapiens
tgcagtagtctctgt

SEQ ID NO: 3923538 - DNA, 15 bp, Homo sapiens
tgcagtattgccaca

SEQ ID NO: 3923539 - DNA, 20 bp, Homo sapiens
tgcagtccagaataagtgct

SEQ ID NO: 3923540 - DNA, 23 bp, Homo sapiens
tgcagtccagaataagtgctgtt

SEQ ID NO: 3923541 - DNA, 20 bp, Homo sapiens
tgcagtccgcagtctggcct

SEQ ID NO: 3923542 - DNA, 13 bp, Homo sapiens
tgcagtctcagaa

SEQ ID NO: 3923543 - DNA, 17 bp, Homo sapiens
tgcagtctcagaaagcc

SEQ ID NO: 3923544 - DNA, 14 bp, Homo sapiens
tgcagtgagccatg

SEQ ID NO: 3923545 - DNA, 19 bp, Homo sapiens
tgcagttaatggggtagag

SEQ ID NO: 3923546 - DNA, 12 bp, Homo sapiens
tgcagtttccaa

SEQ ID NO: 3923547 - DNA, 23 bp, Homo sapiens
tgcataatcagcgccctggagtc

SEQ ID NO: 3923548 - DNA, 20 bp, Homo sapiens
tgcatagattccctgagcag

SEQ ID NO: 3923549 - DNA, 13 bp, Homo sapiens
tgcatagtttgtt

SEQ ID NO: 3923550 - DNA, 20 bp, Homo sapiens
tgcatatcggaggtggtgga

SEQ ID NO: 3923551 - DNA, 23 bp, Homo sapiens
tgcatatcggaggtggtggagga

SEQ ID NO: 3923552 - DNA, 17 bp, Homo sapiens
tgcatcagaaagggagg

SEQ ID NO: 3923553 - DNA, 22 bp, Homo sapiens
tgcatcagctgctgaaacaaca

SEQ ID NO: 3923554 - DNA, 20 bp, Homo sapiens
tgcatcagtattaatactaa

SEQ ID NO: 3923555 - DNA, 21 bp, Homo sapiens
tgcatccattcctcagggaca

SEQ ID NO: 3923556 - DNA, 21 bp, Homo sapiens
tgcatcccccagcactgatgt

SEQ ID NO: 3923557 - DNA, 20 bp, Homo sapiens
tgcatccgtagttccctgaa

SEQ ID NO: 3923558 - DNA, 16 bp, Homo sapiens
tgcatctactcaggcc

SEQ ID NO: 3923559 - DNA, 20 bp, Homo sapiens
tgcatctgggattcccacca

SEQ ID NO: 3923560 - DNA, 14 bp, Homo sapiens
tgcatgatgtattt

SEQ ID NO: 3923561 - DNA, 12 bp, Homo sapiens
tgcatgatttta

SEQ ID NO: 3923562 - DNA, 18 bp, Homo sapiens
tgcatgattttatacata

SEQ ID NO: 3923563 - DNA, 14 bp, Homo sapiens
tgcatgcctggtct

SEQ ID NO: 3923564 - DNA, 17 bp, Homo sapiens
tgcatgctctctgcagc

SEQ ID NO: 3923565 - DNA, 18 bp, Homo sapiens
tgcatgctctctgcagcc

SEQ ID NO: 3923566 - DNA, 13 bp, Homo sapiens
tgcatggactgtg

SEQ ID NO: 3923567 - DNA, 22 bp, Homo sapiens
tgcatggcttggggagcagagt

SEQ ID NO: 3923568 - DNA, 15 bp, Homo sapiens
tgcatgtaaaatgca

SEQ ID NO: 3923569 - DNA, 17 bp, Homo sapiens
tgcatgtaaaatgcagt

SEQ ID NO: 3923570 - DNA, 11 bp, Homo sapiens
tgcatgtgtgt

SEQ ID NO: 3923571 - DNA, 16 bp, Homo sapiens
tgcatgtgtgtgtctg

SEQ ID NO: 3923572 - DNA, 21 bp, Homo sapiens
tgcatgtgtgtgtctgtcttt

SEQ ID NO: 3923573 - DNA, 23 bp, Homo sapiens
tgcatgtgttgtacaataccaga

SEQ ID NO: 3923574 - DNA, 20 bp, Homo sapiens
tgcatgtttactttattaga

SEQ ID NO: 3923575 - DNA, 18 bp, Homo sapiens
tgcattaacttaaaagat

SEQ ID NO: 3923576 - DNA, 22 bp, Homo sapiens
tgcattagaaatagacagtata

SEQ ID NO: 3923577 - DNA, 13 bp, Homo sapiens
tgcattagaaatt

SEQ ID NO: 3923578 - DNA, 23 bp, Homo sapiens
tgcccaacctgctctcctcttgc

SEQ ID NO: 3923579 - DNA, 21 bp, Homo sapiens
tgcccagaattcccagctgtc

SEQ ID NO: 3923580 - DNA, 22 bp, Homo sapiens
tgcccagaattcccagctgtct

SEQ ID NO: 3923581 - DNA, 12 bp, Homo sapiens
tgcccagagatg

SEQ ID NO: 3923582 - DNA, 17 bp, Homo sapiens
tgcccagagatgcctcc

SEQ ID NO: 3923583 - DNA, 18 bp, Homo sapiens
tgcccaggagagccagcc

SEQ ID NO: 3923584 - DNA, 19 bp, Homo sapiens
tgcccaggctgctcttgaa

SEQ ID NO: 3923585 - DNA, 20 bp, Homo sapiens
tgcccaggctggtcttgaac

SEQ ID NO: 3923586 - DNA, 20 bp, Homo sapiens
tgcccatacccctgcctggg

SEQ ID NO: 3923587 - DNA, 19 bp, Homo sapiens
tgcccatgtgtcccctcac

SEQ ID NO: 3923588 - DNA, 16 bp, Homo sapiens
tgccccaactcctgga

SEQ ID NO: 3923589 - DNA, 16 bp, Homo sapiens
tgccccaactccttcc

SEQ ID NO: 3923590 - DNA, 17 bp, Homo sapiens
tgccccaagcagccagc

SEQ ID NO: 3923591 - DNA, 18 bp, Homo sapiens
tgccccaagcagccagcc

SEQ ID NO: 3923592 - DNA, 11 bp, Homo sapiens
tgccccaaggg

SEQ ID NO: 3923593 - DNA, 12 bp, Homo sapiens
tgccccaagggg

SEQ ID NO: 3923594 - DNA, 13 bp, Homo sapiens
tgccccagcttta

SEQ ID NO: 3923595 - DNA, 21 bp, Homo sapiens
tgccccatctcctcccatggc

SEQ ID NO: 3923596 - DNA, 22 bp, Homo sapiens
tgccccatctcctcccatggcc

SEQ ID NO: 3923597 - DNA, 23 bp, Homo sapiens
tgcccccaaaggtggtctgcttt

SEQ ID NO: 3923598 - DNA, 16 bp, Homo sapiens
tgcccccacccagtcc

SEQ ID NO: 3923599 - DNA, 14 bp, Homo sapiens
tgcccccatccctc

SEQ ID NO: 3923600 - DNA, 14 bp, Homo sapiens
tttattgagaattt

SEQ ID NO: 3923601 - DNA, 18 bp, Homo sapiens
tttattggaagtgttcaa

SEQ ID NO: 3923602 - DNA, 13 bp, Homo sapiens
tttattgtataaa

SEQ ID NO: 3923603 - DNA, 19 bp, Homo sapiens
tttattgtcattactgcct

SEQ ID NO: 3923604 - DNA, 22 bp, Homo sapiens
tttattgtttaaaatcatttct

SEQ ID NO: 3923605 - DNA, 22 bp, Homo sapiens
tttatttaacttttagtaaagt

SEQ ID NO: 3923606 - DNA, 14 bp, Homo sapiens
tttatttattcact

SEQ ID NO: 3923607 - DNA, 21 bp, Homo sapiens
tttattttcttttgtaaatgt

SEQ ID NO: 3923608 - DNA, 12 bp, Homo sapiens
tttcaaaagaca

SEQ ID NO: 3923609 - DNA, 17 bp, Homo sapiens
tttcaaaagtgatctgt

SEQ ID NO: 3923610 - DNA, 23 bp, Homo sapiens
tttcaaaagtggattttcctgaa

SEQ ID NO: 3923611 - DNA, 17 bp, Homo sapiens
tttcaaagctttttcca

SEQ ID NO: 3923612 - DNA, 14 bp, Homo sapiens
tttcaaatttcaca

SEQ ID NO: 3923613 - DNA, 18 bp, Homo sapiens
tttcaaccagcattcatg

SEQ ID NO: 3923614 - DNA, 18 bp, Homo sapiens
tttcaaccagcattttac

SEQ ID NO: 3923615 - DNA, 14 bp, Homo sapiens
tttcaactccagaa

SEQ ID NO: 3923616 - DNA, 14 bp, Homo sapiens
tttcaactggctgg

SEQ ID NO: 3923617 - DNA, 20 bp, Homo sapiens
tttcaacttggaaaaagaaa

SEQ ID NO: 3923618 - DNA, 18 bp, Homo sapiens
tttcaagaaaaaataaat

SEQ ID NO: 3923619 - DNA, 24 bp, Homo sapiens
tttcaagagtgcagttgattctga

SEQ ID NO: 3923620 - DNA, 14 bp, Homo sapiens
tttcaattctcaaa

SEQ ID NO: 3923621 - DNA, 14 bp, Homo sapiens
tttcaattgtattt

SEQ ID NO: 3923622 - DNA, 18 bp, Homo sapiens
tttcaattgtattttata

SEQ ID NO: 3923623 - DNA, 15 bp, Homo sapiens
tttcacattaatatt

SEQ ID NO: 3923624 - DNA, 23 bp, Homo sapiens
tttcaccatttccgggaaacgaa

SEQ ID NO: 3923625 - DNA, 16 bp, Homo sapiens
tttcaccttgggtttg

SEQ ID NO: 3923626 - DNA, 17 bp, Homo sapiens
tttcactgctggctgcc

SEQ ID NO: 3923627 - DNA, 18 bp, Homo sapiens
tttcactgctggctgcct

SEQ ID NO: 3923628 - DNA, 22 bp, Homo sapiens
tttcactgctggctgccttaga

SEQ ID NO: 3923629 - DNA, 23 bp, Homo sapiens
tttcagaaataaaatgaaatgtc

SEQ ID NO: 3923630 - DNA, 20 bp, Homo sapiens
tttcagaaatatgtggtttc

SEQ ID NO: 3923631 - DNA, 10 bp, Homo sapiens
tttcagaccc

SEQ ID NO: 3923632 - DNA, 20 bp, Homo sapiens
tttcagattcccagagcaaa

SEQ ID NO: 3923633 - DNA, 13 bp, Homo sapiens
tttcagctagttt

SEQ ID NO: 3923634 - DNA, 12 bp, Homo sapiens
tttcagctctct

SEQ ID NO: 3923635 - DNA, 18 bp, Homo sapiens
tttcagctgacagctgct

SEQ ID NO: 3923636 - DNA, 14 bp, Homo sapiens
tttcagctgtgaac

SEQ ID NO: 3923637 - DNA, 21 bp, Homo sapiens
tttcagctgtgaacatggact

SEQ ID NO: 3923638 - DNA, 16 bp, Homo sapiens
tttcaggacatggggc

SEQ ID NO: 3923639 - DNA, 22 bp, Homo sapiens
tttcaggcaggcacctagcaat

SEQ ID NO: 3923640 - DNA, 21 bp, Homo sapiens
tttcaggggtcgtcaccacct

SEQ ID NO: 3923641 - DNA, 16 bp, Homo sapiens
tttcaggtctggggct

SEQ ID NO: 3923642 - DNA, 18 bp, Homo sapiens
tttcaggttttgtaaaga

SEQ ID NO: 3923643 - DNA, 18 bp, Homo sapiens
tttcataaggcctgccct

SEQ ID NO: 3923644 - DNA, 22 bp, Homo sapiens
tttcataaggcctgccctccca

SEQ ID NO: 3923645 - DNA, 22 bp, Homo sapiens
tttcatccagtttgttctccgg

SEQ ID NO: 3923646 - DNA, 20 bp, Homo sapiens
tttcatgtagattttagttc

SEQ ID NO: 3923647 - DNA, 16 bp, Homo sapiens
tttcattacaatggaa

SEQ ID NO: 3923648 - DNA, 15 bp, Homo sapiens
tttcattctcctgcc

SEQ ID NO: 3923649 - DNA, 22 bp, Homo sapiens
tttccacaagattcccagagac

SEQ ID NO: 3923650 - DNA, 18 bp, Homo sapiens
tttccaccatcaaatgct

SEQ ID NO: 3923651 - DNA, 17 bp, Homo sapiens
tttccagaaaatataaa

SEQ ID NO: 3923652 - DNA, 22 bp, Homo sapiens
tttccagaaaatataaatgcat

SEQ ID NO: 3923653 - DNA, 21 bp, Homo sapiens
tttccagattcttccactggc

SEQ ID NO: 3923654 - DNA, 19 bp, Homo sapiens
tttccaggatcctgcagga

SEQ ID NO: 3923655 - DNA, 23 bp, Homo sapiens
tttccagggcatccgcagcccag

SEQ ID NO: 3923656 - DNA, 21 bp, Homo sapiens
tttccatgcagactcctcaga

SEQ ID NO: 3923657 - DNA, 14 bp, Homo sapiens
tttcccaggaatat

SEQ ID NO: 3923658 - DNA, 17 bp, Homo sapiens
tttcccatgatccagaa

SEQ ID NO: 3923659 - DNA, 21 bp, Homo sapiens
tttccccaaagtcttaaaata

SEQ ID NO: 3923660 - DNA, 18 bp, Homo sapiens
tttccccggtcccttgag

SEQ ID NO: 3923661 - DNA, 23 bp, Homo sapiens
tttccctcaaatgcgcgtgtgca

SEQ ID NO: 3923662 - DNA, 12 bp, Homo sapiens
tttccctcccca

SEQ ID NO: 3923663 - DNA, 13 bp, Homo sapiens
tttccctctctag

SEQ ID NO: 3923664 - DNA, 13 bp, Homo sapiens
tttccctgtgctg

SEQ ID NO: 3923665 - DNA, 23 bp, Homo sapiens
tttccctttgaggttgctttgtt

SEQ ID NO: 3923666 - DNA, 24 bp, Homo sapiens
tttccgctgtcgccccaggccctc

SEQ ID NO: 3923667 - DNA, 15 bp, Homo sapiens
tttccgtctccctaa

SEQ ID NO: 3923668 - DNA, 19 bp, Homo sapiens
tttccgtctccctaaaata

SEQ ID NO: 3923669 - DNA, 21 bp, Homo sapiens
tttcctaaaaataagctttat

SEQ ID NO: 3923670 - DNA, 14 bp, Homo sapiens
tttcctacaaaatg

SEQ ID NO: 3923671 - DNA, 24 bp, Homo sapiens
tttcctactctcaggatcaagaaa

SEQ ID NO: 3923672 - DNA, 17 bp, Homo sapiens
tttcctagccctctcac

SEQ ID NO: 3923673 - DNA, 14 bp, Homo sapiens
tttcctattttaaa

SEQ ID NO: 3923674 - DNA, 22 bp, Homo sapiens
tttcctattttaaaaccatgca

SEQ ID NO: 3923675 - DNA, 22 bp, Homo sapiens
tttcctccaaactcctgcctgt

SEQ ID NO: 3923676 - DNA, 14 bp, Homo sapiens
tttcctccccacct

SEQ ID NO: 3923677 - DNA, 21 bp, Homo sapiens
tttcctcttctattttgtaaa

SEQ ID NO: 3923678 - DNA, 15 bp, Homo sapiens
tttccttgtctctca

SEQ ID NO: 3923679 - DNA, 19 bp, Homo sapiens
tttccttgtctctcattct

SEQ ID NO: 3923680 - DNA, 16 bp, Homo sapiens
tttcctttgtcatcat

SEQ ID NO: 3923681 - DNA, 12 bp, Homo sapiens
tttcgctttcct

SEQ ID NO: 3923682 - DNA, 15 bp, Homo sapiens
tttcgctttcctctg

SEQ ID NO: 3923683 - DNA, 14 bp, Homo sapiens
tttcggtgggacag

SEQ ID NO: 3923684 - DNA, 19 bp, Homo sapiens
tttcgtgtagtggaagagc

SEQ ID NO: 3923685 - DNA, 15 bp, Homo sapiens
tttctaaaagaatat

SEQ ID NO: 3923686 - DNA, 20 bp, Homo sapiens
tttctaaaagaatattcaga

SEQ ID NO: 3923687 - DNA, 14 bp, Homo sapiens
tttctaaagttgtt

SEQ ID NO: 3923688 - DNA, 15 bp, Homo sapiens
tttctaaatctgaga

SEQ ID NO: 3923689 - DNA, 13 bp, Homo sapiens
tttctaactgtaa

SEQ ID NO: 3923690 - DNA, 17 bp, Homo sapiens
tttctaactgtaaatca

SEQ ID NO: 3923691 - DNA, 21 bp, Homo sapiens
tttctaactgtaaatcacttg

SEQ ID NO: 3923692 - DNA, 15 bp, Homo sapiens
tttctaatgtgtgaa

SEQ ID NO: 3923693 - DNA, 16 bp, Homo sapiens
tttctaccatttcaga

SEQ ID NO: 3923694 - DNA, 17 bp, Homo sapiens
tttctacttatcctcat

SEQ ID NO: 3923695 - DNA, 15 bp, Homo sapiens
tttctagactttctg

SEQ ID NO: 3923696 - DNA, 14 bp, Homo sapiens
tttctattccaaag

SEQ ID NO: 3923697 - DNA, 17 bp, Homo sapiens
tttctccctaaactgta

SEQ ID NO: 3923698 - DNA, 15 bp, Homo sapiens
tttctccctcacccc

SEQ ID NO: 3923699 - DNA, 20 bp, Homo sapiens
tttctccggggtctgtgctg

SEQ ID NO: 3923700 - DNA, 16 bp, Homo sapiens
tttctctgagagagat

SEQ ID NO: 3923701 - DNA, 12 bp, Homo sapiens
tttctgagaaaa

SEQ ID NO: 3923702 - DNA, 16 bp, Homo sapiens
tttctgaggagaaaca

SEQ ID NO: 3923703 - DNA, 22 bp, Homo sapiens
tttctgattcactattagagaa

SEQ ID NO: 3923704 - DNA, 15 bp, Homo sapiens
tttctgcgtgcttta

SEQ ID NO: 3923705 - DNA, 15 bp, Homo sapiens
tttctggaaattttg

SEQ ID NO: 3923706 - DNA, 18 bp, Homo sapiens
tttctggaatacatgaaa

SEQ ID NO: 3923707 - DNA, 11 bp, Homo sapiens
tttctgtgtgc

SEQ ID NO: 3923708 - DNA, 20 bp, Homo sapiens
tttctgtgtgcaccttacca

SEQ ID NO: 3923709 - DNA, 14 bp, Homo sapiens
tttctgttcatctt

SEQ ID NO: 3923710 - DNA, 17 bp, Homo sapiens
tttcttacataattttt

SEQ ID NO: 3923711 - DNA, 22 bp, Homo sapiens
tttcttacccatatatcttatg

SEQ ID NO: 3923712 - DNA, 18 bp, Homo sapiens
tttcttagtcgaatgtta

SEQ ID NO: 3923713 - DNA, 14 bp, Homo sapiens
tttcttcccatcac

SEQ ID NO: 3923714 - DNA, 14 bp, Homo sapiens
tttcttcctctgct

SEQ ID NO: 3923715 - DNA, 16 bp, Homo sapiens
tttcttcctctgctga

SEQ ID NO: 3923716 - DNA, 22 bp, Homo sapiens
tttcttccttctttctcttccc

SEQ ID NO: 3923717 - DNA, 12 bp, Homo sapiens
tttcttctattt

SEQ ID NO: 3923718 - DNA, 11 bp, Homo sapiens
tttcttctttg

SEQ ID NO: 3923719 - DNA, 16 bp, Homo sapiens
tttcttgcagatcaaa

SEQ ID NO: 3923720 - DNA, 15 bp, Homo sapiens
tttctttaagaaagt

SEQ ID NO: 3923721 - DNA, 16 bp, Homo sapiens
tttctttaagaaagta

SEQ ID NO: 3923722 - DNA, 15 bp, Homo sapiens
tttctttcacaaaaa

SEQ ID NO: 3923723 - DNA, 22 bp, Homo sapiens
tttctttgaatgctttttgaat

SEQ ID NO: 3923724 - DNA, 20 bp, Homo sapiens
tttcttttaaagaagtaaat

SEQ ID NO: 3923725 - DNA, 16 bp, Homo sapiens
tttctttttctggaaa

SEQ ID NO: 3923726 - DNA, 15 bp, Homo sapiens
tttctttttgtaatt

SEQ ID NO: 3923727 - DNA, 23 bp, Homo sapiens
tttgaaactgtaaatatgtttgt

SEQ ID NO: 3923728 - DNA, 14 bp, Homo sapiens
tttgaaagaaaaat

SEQ ID NO: 3923729 - DNA, 19 bp, Homo sapiens
tttgaaagtgaataaactt

SEQ ID NO: 3923730 - DNA, 22 bp, Homo sapiens
tttgaacaactaggcttcagca

SEQ ID NO: 3923731 - DNA, 19 bp, Homo sapiens
tttgaaggaggtgagggat

SEQ ID NO: 3923732 - DNA, 21 bp, Homo sapiens
tttgaatacccccagagacct

SEQ ID NO: 3923733 - DNA, 20 bp, Homo sapiens
tttgaatgtttatgttctca

SEQ ID NO: 3923734 - DNA, 18 bp, Homo sapiens
tttgacagtgttgaaaat

SEQ ID NO: 3923735 - DNA, 17 bp, Homo sapiens
tttgacatgaacagaaa

SEQ ID NO: 3923736 - DNA, 17 bp, Homo sapiens
tttgacattgtatgtat

SEQ ID NO: 3923737 - DNA, 20 bp, Homo sapiens
tttgacatttccttctttgt

SEQ ID NO: 3923738 - DNA, 18 bp, Homo sapiens
tttgacgggaggcctcag

SEQ ID NO: 3923739 - DNA, 19 bp, Homo sapiens
tttgacgggaggcctcagt

SEQ ID NO: 3923740 - DNA, 14 bp, Homo sapiens
tttgagaaagaaat

SEQ ID NO: 3923741 - DNA, 20 bp, Homo sapiens
tttgagaaagaaataattgt

SEQ ID NO: 3923742 - DNA, 16 bp, Homo sapiens
tttgagacaagccctg

SEQ ID NO: 3923743 - DNA, 19 bp, Homo sapiens
tttgagacaagccctggca

SEQ ID NO: 3923744 - DNA, 16 bp, Homo sapiens
tttgagcaattcattt

SEQ ID NO: 3923745 - DNA, 23 bp, Homo sapiens
tttgagcaattcatttcacttta

SEQ ID NO: 3923746 - DNA, 19 bp, Homo sapiens
tttgagcgcagagtaaaat

SEQ ID NO: 3923747 - DNA, 19 bp, Homo sapiens
tttgagtcaaaagcctggg

SEQ ID NO: 3923748 - DNA, 16 bp, Homo sapiens
tttgagtgattatttg

SEQ ID NO: 3923749 - DNA, 14 bp, Homo sapiens
tttgagttatagtt

SEQ ID NO: 3923750 - DNA, 19 bp, Homo sapiens
tttgagttattttaattat

SEQ ID NO: 3923751 - DNA, 16 bp, Homo sapiens
tttgatacatatgtga

SEQ ID NO: 3923752 - DNA, 19 bp, Homo sapiens
tttgatacatatgtgaata

SEQ ID NO: 3923753 - DNA, 14 bp, Homo sapiens
tttgatgtacatgt

SEQ ID NO: 3923754 - DNA, 16 bp, Homo sapiens
tttgatgtcagccttg

SEQ ID NO: 3923755 - DNA, 13 bp, Homo sapiens
tttgatttctatt

SEQ ID NO: 3923756 - DNA, 12 bp, Homo sapiens
tttgcacatgtg

SEQ ID NO: 3923757 - DNA, 14 bp, Homo sapiens
tttgcacatgtgac

SEQ ID NO: 3923758 - DNA, 12 bp, Homo sapiens
tttgcactgagg

SEQ ID NO: 3923759 - DNA, 14 bp, Homo sapiens
tttgcactgttact

SEQ ID NO: 3923760 - DNA, 21 bp, Homo sapiens
tttgcactgttactttttagt

SEQ ID NO: 3923761 - DNA, 19 bp, Homo sapiens
tttgcagaaaagcacctgc

SEQ ID NO: 3923762 - DNA, 18 bp, Homo sapiens
tttgcaggcccagcagac

SEQ ID NO: 3923763 - DNA, 13 bp, Homo sapiens
tttgcaggctctg

SEQ ID NO: 3923764 - DNA, 14 bp, Homo sapiens
tttgcaggctctgg

SEQ ID NO: 3923765 - DNA, 21 bp, Homo sapiens
tttgcatagattccctgagca

SEQ ID NO: 3923766 - DNA, 21 bp, Homo sapiens
tttgcatggaatttgtaagtt

SEQ ID NO: 3923767 - DNA, 14 bp, Homo sapiens
tttgcattccatga

SEQ ID NO: 3923768 - DNA, 19 bp, Homo sapiens
tttgcattccatgatttta

SEQ ID NO: 3923769 - DNA, 14 bp, Homo sapiens
tttgcattcctaca

SEQ ID NO: 3923770 - DNA, 19 bp, Homo sapiens
tttgccaccactagagctg

SEQ ID NO: 3923771 - DNA, 16 bp, Homo sapiens
tttgccagacttaaat

SEQ ID NO: 3923772 - DNA, 16 bp, Homo sapiens
tttgccagtgaagact

SEQ ID NO: 3923773 - DNA, 23 bp, Homo sapiens
tttgccagtgaagacttcttggg

SEQ ID NO: 3923774 - DNA, 21 bp, Homo sapiens
tttgccctgtggattccagca

SEQ ID NO: 3923775 - DNA, 17 bp, Homo sapiens
tttgctacaataaatgc

SEQ ID NO: 3923776 - DNA, 22 bp, Homo sapiens
tttgctacaataaatgctgaat

SEQ ID NO: 3923777 - DNA, 23 bp, Homo sapiens
tttgctcacacggggtattttag

SEQ ID NO: 3923778 - DNA, 16 bp, Homo sapiens
tttgcttggcagagag

SEQ ID NO: 3923779 - DNA, 18 bp, Homo sapiens
tttggaaaaatcttgggc

SEQ ID NO: 3923780 - DNA, 11 bp, Homo sapiens
tttggaatgtg

SEQ ID NO: 3923781 - DNA, 22 bp, Homo sapiens
tttggagaaattatttaataaa

SEQ ID NO: 3923782 - DNA, 21 bp, Homo sapiens
tttggagtcagtaggtccaag

SEQ ID NO: 3923783 - DNA, 15 bp, Homo sapiens
tttggataatatcca

SEQ ID NO: 3923784 - DNA, 19 bp, Homo sapiens
tttggatgggagtgagaca

SEQ ID NO: 3923785 - DNA, 19 bp, Homo sapiens
tttggcaatttttttatac

SEQ ID NO: 3923786 - DNA, 10 bp, Homo sapiens
tttggccttg

SEQ ID NO: 3923787 - DNA, 23 bp, Homo sapiens
tttggctctcctcagaagaaaga

SEQ ID NO: 3923788 - DNA, 18 bp, Homo sapiens
tttggcttctcctgtgac

SEQ ID NO: 3923789 - DNA, 19 bp, Homo sapiens
tttggggagggggaagaga

SEQ ID NO: 3923790 - DNA, 22 bp, Homo sapiens
tttggggagggggaagagaaat

SEQ ID NO: 3923791 - DNA, 17 bp, Homo sapiens
tttgggggttggatggg

SEQ ID NO: 3923792 - DNA, 23 bp, Homo sapiens
tttggtcccgtgcagcttctgtc

SEQ ID NO: 3923793 - DNA, 14 bp, Homo sapiens
tttggtgcagaggt

SEQ ID NO: 3923794 - DNA, 21 bp, Homo sapiens
tttggtgcagaggtttcttga

SEQ ID NO: 3923795 - DNA, 15 bp, Homo sapiens
tttggtgcctgcctc

SEQ ID NO: 3923796 - DNA, 12 bp, Homo sapiens
tttggtggtccc

SEQ ID NO: 3923797 - DNA, 20 bp, Homo sapiens
tttggttgtaaatgctcgtg

SEQ ID NO: 3923798 - DNA, 17 bp, Homo sapiens
tttgtaaactcaaaata

SEQ ID NO: 3923799 - DNA, 17 bp, Homo sapiens
tttgtaaactgtatcaa

SEQ ID NO: 3923800 - DNA, 23 bp, Homo sapiens
tttgtaaaggtcagagtcaaaat

SEQ ID NO: 3923801 - DNA, 13 bp, Homo sapiens
tttgtaacttcaa

SEQ ID NO: 3923802 - DNA, 13 bp, Homo sapiens
tttgtaagtttat

SEQ ID NO: 3923803 - DNA, 21 bp, Homo sapiens
tttgtaataaaggtctttgca

SEQ ID NO: 3923804 - DNA, 18 bp, Homo sapiens
tttgtaattgcttacatt

SEQ ID NO: 3923805 - DNA, 18 bp, Homo sapiens
tttgtacgttatatattg

SEQ ID NO: 3923806 - DNA, 14 bp, Homo sapiens
tttgtactgaaaaa

SEQ ID NO: 3923807 - DNA, 19 bp, Homo sapiens
tttgtaggggtcaaagaaa

SEQ ID NO: 3923808 - DNA, 19 bp, Homo sapiens
tttgtataacttcttaaaa

SEQ ID NO: 3923809 - DNA, 21 bp, Homo sapiens
tttgtattctttactaaagat

SEQ ID NO: 3923810 - DNA, 21 bp, Homo sapiens
tttgtcattttaaaatctgat

SEQ ID NO: 3923811 - DNA, 12 bp, Homo sapiens
tttgtcccaggt

SEQ ID NO: 3923812 - DNA, 17 bp, Homo sapiens
tttgtccccagggcccc

SEQ ID NO: 3923813 - DNA, 14 bp, Homo sapiens
tttgtctcctacct

SEQ ID NO: 3923814 - DNA, 13 bp, Homo sapiens
tttgtgctgtggg

SEQ ID NO: 3923815 - DNA, 16 bp, Homo sapiens
tttgtggaggtgagaa

SEQ ID NO: 3923816 - DNA, 17 bp, Homo sapiens
tttgtggcaccttttct

SEQ ID NO: 3923817 - DNA, 12 bp, Homo sapiens
tttgtgtttcta

SEQ ID NO: 3923818 - DNA, 20 bp, Homo sapiens
tttgttaaaaatattttctg

SEQ ID NO: 3923819 - DNA, 21 bp, Homo sapiens
tttgttatgtatatagatgtg

SEQ ID NO: 3923820 - DNA, 17 bp, Homo sapiens
tttgttatttgtacagt

SEQ ID NO: 3923821 - DNA, 18 bp, Homo sapiens
tttgttatttgtacagtt

SEQ ID NO: 3923822 - DNA, 20 bp, Homo sapiens
tttgttattttcagtatttt

SEQ ID NO: 3923823 - DNA, 15 bp, Homo sapiens
tttgttcaaagttgt

SEQ ID NO: 3923824 - DNA, 20 bp, Homo sapiens
tttgttcatgagtggatgga

SEQ ID NO: 3923825 - DNA, 15 bp, Homo sapiens
tttgttctttatttg

SEQ ID NO: 3923826 - DNA, 14 bp, Homo sapiens
tttgttgctgtcaa

SEQ ID NO: 3923827 - DNA, 20 bp, Homo sapiens
tttgttgtgattttgtacag

SEQ ID NO: 3923828 - DNA, 14 bp, Homo sapiens
tttgtttcctttgt

SEQ ID NO: 3923829 - DNA, 13 bp, Homo sapiens
tttgttttctttg

SEQ ID NO: 3923830 - DNA, 13 bp, Homo sapiens
ttttaaaaaatga

SEQ ID NO: 3923831 - DNA, 22 bp, Homo sapiens
ttttaaaacacttccataatct

SEQ ID NO: 3923832 - DNA, 16 bp, Homo sapiens
ttttaaaaccatgcag

SEQ ID NO: 3923833 - DNA, 20 bp, Homo sapiens
ttttaaacaaaatagaagct

SEQ ID NO: 3923834 - DNA, 13 bp, Homo sapiens
ttttaaacagtga

SEQ ID NO: 3923835 - DNA, 21 bp, Homo sapiens
ttttaaagaagtaaatttgtc

SEQ ID NO: 3923836 - DNA, 21 bp, Homo sapiens
ttttaaaggtagagatgtgtg

SEQ ID NO: 3923837 - DNA, 16 bp, Homo sapiens
ttttaaagtatatatt

SEQ ID NO: 3923838 - DNA, 22 bp, Homo sapiens
ttttaaagtatgttattgcata

SEQ ID NO: 3923839 - DNA, 18 bp, Homo sapiens
ttttaacagaaccagagg

SEQ ID NO: 3923840 - DNA, 22 bp, Homo sapiens
ttttaagctgtaaaaagagaga

SEQ ID NO: 3923841 - DNA, 17 bp, Homo sapiens
ttttaagcttgaagatt

SEQ ID NO: 3923842 - DNA, 15 bp, Homo sapiens
ttttaagtatttagg

SEQ ID NO: 3923843 - DNA, 19 bp, Homo sapiens
ttttacaaaacatacccag

SEQ ID NO: 3923844 - DNA, 12 bp, Homo sapiens
ttttacaataaa

SEQ ID NO: 3923845 - DNA, 12 bp, Homo sapiens
ttttacagagaa

SEQ ID NO: 3923846 - DNA, 20 bp, Homo sapiens
ttttacctgggatatgacaa

SEQ ID NO: 3923847 - DNA, 18 bp, Homo sapiens
ttttactacttgttacct

SEQ ID NO: 3923848 - DNA, 13 bp, Homo sapiens
ttttactcctttg

SEQ ID NO: 3923849 - DNA, 22 bp, Homo sapiens
ttttactcctttgcattccatg

SEQ ID NO: 3923850 - DNA, 22 bp, Homo sapiens
ttttactctatgccccaaatat

SEQ ID NO: 3923851 - DNA, 22 bp, Homo sapiens
ttttacttttgtcttcctcact

SEQ ID NO: 3923852 - DNA, 15 bp, Homo sapiens
ttttacttttgttct

SEQ ID NO: 3923853 - DNA, 19 bp, Homo sapiens
ttttagatgagattgtttt

SEQ ID NO: 3923854 - DNA, 15 bp, Homo sapiens
ttttaggagacagtc

SEQ ID NO: 3923855 - DNA, 18 bp, Homo sapiens
ttttaggcagggatttga

SEQ ID NO: 3923856 - DNA, 17 bp, Homo sapiens
ttttagggagctggtct

SEQ ID NO: 3923857 - DNA, 15 bp, Homo sapiens
ttttagtaaatcctt

SEQ ID NO: 3923858 - DNA, 15 bp, Homo sapiens
ttttagtcttttact

SEQ ID NO: 3923859 - DNA, 16 bp, Homo sapiens
tttttaaactagtaat

SEQ ID NO: 3923860 - DNA, 15 bp, Homo sapiens
tttttaaagctacaa

SEQ ID NO: 3923861 - DNA, 20 bp, Homo sapiens
tttttaaaggtagagatgtg

SEQ ID NO: 3923862 - DNA, 21 bp, Homo sapiens
tttttaattgaggacagcctg

SEQ ID NO: 3923863 - DNA, 16 bp, Homo sapiens
tttttactacagttgt

SEQ ID NO: 3923864 - DNA, 12 bp, Homo sapiens
tttttatacata

SEQ ID NO: 3923865 - DNA, 22 bp, Homo sapiens
tttttatacatatcagaaaagt

SEQ ID NO: 3923866 - DNA, 17 bp, Homo sapiens
tttttatactccataca

SEQ ID NO: 3923867 - DNA, 21 bp, Homo sapiens
tttttatactccatacataac

SEQ ID NO: 3923868 - DNA, 22 bp, Homo sapiens
tttttcaaccagcattttacta

SEQ ID NO: 3923869 - DNA, 11 bp, Homo sapiens
tttttcctttt

SEQ ID NO: 3923870 - DNA, 18 bp, Homo sapiens
tttttctacttttaaaga

SEQ ID NO: 3923871 - DNA, 21 bp, Homo sapiens
tttttctagtttcagtaaata

SEQ ID NO: 3923872 - DNA, 11 bp, Homo sapiens
tttttctggaa

SEQ ID NO: 3923873 - DNA, 13 bp, Homo sapiens
tttttctgtctct

SEQ ID NO: 3923874 - DNA, 16 bp, Homo sapiens
tttttctttataaact

SEQ ID NO: 3923875 - DNA, 13 bp, Homo sapiens
tttttgaaaacat

SEQ ID NO: 3923876 - DNA, 18 bp, Homo sapiens
tttttgatggtaagactg

SEQ ID NO: 3923877 - DNA, 18 bp, Homo sapiens
tttttggttgtcaatatt

SEQ ID NO: 3923878 - DNA, 16 bp, Homo sapiens
tttttgtaacttcaaa

SEQ ID NO: 3923879 - DNA, 18 bp, Homo sapiens
tttttgtaacttcaaata

SEQ ID NO: 3923880 - DNA, 12 bp, Homo sapiens
tttttgtccctg

SEQ ID NO: 3923881 - DNA, 22 bp, Homo sapiens
tttttgtccctgctcctcccaa

SEQ ID NO: 3923882 - DNA, 13 bp, Homo sapiens
tttttgtgtttct

SEQ ID NO: 3923883 - DNA, 13 bp, Homo sapiens
ttttttaaaagaa

SEQ ID NO: 3923884 - DNA, 17 bp, Homo sapiens
ttttttaacacataact

SEQ ID NO: 3923885 - DNA, 21 bp, Homo sapiens
ttttttaacactagaaaacat

SEQ ID NO: 3923886 - DNA, 12 bp, Homo sapiens
ttttttgaaaac

SEQ ID NO: 3923887 - DNA, 9 bp, Homo sapiens
ttttttgag

SEQ ID NO: 3923888 - DNA, 13 bp, Homo sapiens
ttttttgtaactt

SEQ ID NO: 3923889 - DNA, 13 bp, Homo sapiens
tttttttgctggt

SEQ ID NO: 3923890 - DNA, 12 bp, Homo sapiens
aaaatggaaaga

SEQ ID NO: 3923891 - DNA, 22 bp, Homo sapiens
aaaatggtggtttgtcatatat

SEQ ID NO: 3923892 - DNA, 21 bp, Homo sapiens
aaaatgtacactggatatgtt

SEQ ID NO: 3923893 - DNA, 22 bp, Homo sapiens
aaaatgtcaaagagaaaactta

SEQ ID NO: 3923894 - DNA, 18 bp, Homo sapiens
aaaatgttcgtattctat

SEQ ID NO: 3923895 - DNA, 13 bp, Homo sapiens
aaaattaaagccc

SEQ ID NO: 3923896 - DNA, 18 bp, Homo sapiens
aaaattaagagatacatt

SEQ ID NO: 3923897 - DNA, 19 bp, Homo sapiens
aaaattaggatttcatgat

SEQ ID NO: 3923898 - DNA, 12 bp, Homo sapiens
aaaattagtaat

SEQ ID NO: 3923899 - DNA, 17 bp, Homo sapiens
aaaattattttaaacaa

SEQ ID NO: 3923900 - DNA, 18 bp, Homo sapiens
aaaattattttaaacaaa

SEQ ID NO: 3923901 - DNA, 19 bp, Homo sapiens
aaaattattttaaacaaaa

SEQ ID NO: 3923902 - DNA, 13 bp, Homo sapiens
aaaattcatttca

SEQ ID NO: 3923903 - DNA, 14 bp, Homo sapiens
aaaattcatttcac

SEQ ID NO: 3923904 - DNA, 12 bp, Homo sapiens
aaaattgcacaa

SEQ ID NO: 3923905 - DNA, 17 bp, Homo sapiens
aaaattgcacaatttga

SEQ ID NO: 3923906 - DNA, 22 bp, Homo sapiens
aaaattgcacaatttgagcaat

SEQ ID NO: 3923907 - DNA, 15 bp, Homo sapiens
aaaattgtaaaattg

SEQ ID NO: 3923908 - DNA, 21 bp, Homo sapiens
aaaattgtatgttaagttact

SEQ ID NO: 3923909 - DNA, 17 bp, Homo sapiens
aaaattgtcaaatgtca

SEQ ID NO: 3923910 - DNA, 23 bp, Homo sapiens
aaaattgtgatgttttgttcaaa

SEQ ID NO: 3923911 - DNA, 20 bp, Homo sapiens
aaaatttcaacaagtagcta

SEQ ID NO: 3923912 - DNA, 13 bp, Homo sapiens
aaaattttataag

SEQ ID NO: 3923913 - DNA, 22 bp, Homo sapiens
aaaattttgtgagtgactcggt

SEQ ID NO: 3923914 - DNA, 13 bp, Homo sapiens
aaacaaaacaaca

SEQ ID NO: 3923915 - DNA, 14 bp, Homo sapiens
aaacaaaagagaga

SEQ ID NO: 3923916 - DNA, 12 bp, Homo sapiens
aaacaaaataga

SEQ ID NO: 3923917 - DNA, 15 bp, Homo sapiens
aaacaaaatatctga

SEQ ID NO: 3923918 - DNA, 17 bp, Homo sapiens
aaacaaaggttgagatg

SEQ ID NO: 3923919 - DNA, 15 bp, Homo sapiens
aaacaacaacaatac

SEQ ID NO: 3923920 - DNA, 17 bp, Homo sapiens
aaacaaccatcctgctc

SEQ ID NO: 3923921 - DNA, 12 bp, Homo sapiens
aaacaacttgtg

SEQ ID NO: 3923922 - DNA, 12 bp, Homo sapiens
aaacaagaatgt

SEQ ID NO: 3923923 - DNA, 15 bp, Homo sapiens
aaacaatcacactca

SEQ ID NO: 3923924 - DNA, 12 bp, Homo sapiens
aaacacagagcg

SEQ ID NO: 3923925 - DNA, 13 bp, Homo sapiens
aaacacagagcgg

SEQ ID NO: 3923926 - DNA, 15 bp, Homo sapiens
aaacacagagcggga

SEQ ID NO: 3923927 - DNA, 11 bp, Homo sapiens
aaacacagcaa

SEQ ID NO: 3923928 - DNA, 18 bp, Homo sapiens
aaacacagggttttgtat

SEQ ID NO: 3923929 - DNA, 11 bp, Homo sapiens
aaacacctcct

SEQ ID NO: 3923930 - DNA, 12 bp, Homo sapiens
aaacacctgaca

SEQ ID NO: 3923931 - DNA, 13 bp, Homo sapiens
aaacacctgacac

SEQ ID NO: 3923932 - DNA, 22 bp, Homo sapiens
aaacactccaccccctccagct

SEQ ID NO: 3923933 - DNA, 21 bp, Homo sapiens
aaacactgtaatcttaaaagt

SEQ ID NO: 3923934 - DNA, 12 bp, Homo sapiens
aaacactgtgta

SEQ ID NO: 3923935 - DNA, 13 bp, Homo sapiens
aaacactgtgtat

SEQ ID NO: 3923936 - DNA, 21 bp, Homo sapiens
aaacacttctcatcatattgt

SEQ ID NO: 3923937 - DNA, 13 bp, Homo sapiens
aaacagactattt

SEQ ID NO: 3923938 - DNA, 16 bp, Homo sapiens
aaacagagacaggccc

SEQ ID NO: 3923939 - DNA, 22 bp, Homo sapiens
aaacagagacaggcccaagaga

SEQ ID NO: 3923940 - DNA, 19 bp, Homo sapiens
aaacagatgataaatattt

SEQ ID NO: 3923941 - DNA, 14 bp, Homo sapiens
aaacaggaaaaaaa

SEQ ID NO: 3923942 - DNA, 17 bp, Homo sapiens
aaacaggagacaggaag

SEQ ID NO: 3923943 - DNA, 11 bp, Homo sapiens
aaacagggagc

SEQ ID NO: 3923944 - DNA, 22 bp, Homo sapiens
aaacagggcagtgacaagtgga

SEQ ID NO: 3923945 - DNA, 17 bp, Homo sapiens
aaacagtcgatcaaggg

SEQ ID NO: 3923946 - DNA, 16 bp, Homo sapiens
aaacatatcaattcaa

SEQ ID NO: 3923947 - DNA, 20 bp, Homo sapiens
aaacatatcaattcaacaca

SEQ ID NO: 3923948 - DNA, 22 bp, Homo sapiens
aaacatatcaattcaacacatt

SEQ ID NO: 3923949 - DNA, 13 bp, Homo sapiens
aaacatgaattat

SEQ ID NO: 3923950 - DNA, 21 bp, Homo sapiens
aaacatggtagaattggagag

SEQ ID NO: 3923951 - DNA, 14 bp, Homo sapiens
aaacattaaaagaa

SEQ ID NO: 3923952 - DNA, 13 bp, Homo sapiens
aaacattaaacac

SEQ ID NO: 3923953 - DNA, 14 bp, Homo sapiens
aaacattaaacact

SEQ ID NO: 3923954 - DNA, 15 bp, Homo sapiens
aaacattaaacactg

SEQ ID NO: 3923955 - DNA, 15 bp, Homo sapiens
aaacattaaatgtct

SEQ ID NO: 3923956 - DNA, 20 bp, Homo sapiens
aaacattaaatgtcttatat

SEQ ID NO: 3923957 - DNA, 13 bp, Homo sapiens
aaacattcatcca

SEQ ID NO: 3923958 - DNA, 24 bp, Homo sapiens
aaacattcatccagttgcaataaa

SEQ ID NO: 3923959 - DNA, 18 bp, Homo sapiens
aaacatttacaataaata

SEQ ID NO: 3923960 - DNA, 23 bp, Homo sapiens
aaacatttacaataaatattctg

SEQ ID NO: 3923961 - DNA, 14 bp, Homo sapiens
aaaccaagccgtgg

SEQ ID NO: 3923962 - DNA, 18 bp, Homo sapiens
aaaccaagtctacttcac

SEQ ID NO: 3923963 - DNA, 12 bp, Homo sapiens
aaaccaatgatt

SEQ ID NO: 3923964 - DNA, 15 bp, Homo sapiens
aaaccaatgattcat

SEQ ID NO: 3923965 - DNA, 21 bp, Homo sapiens
aaaccacaactgacacaggaa

SEQ ID NO: 3923966 - DNA, 22 bp, Homo sapiens
aaaccacaactgacacaggaaa

SEQ ID NO: 3923967 - DNA, 12 bp, Homo sapiens
aaaccacagcag

SEQ ID NO: 3923968 - DNA, 14 bp, Homo sapiens
aaaccactgtacat

SEQ ID NO: 3923969 - DNA, 16 bp, Homo sapiens
aaaccactgtacatat

SEQ ID NO: 3923970 - DNA, 17 bp, Homo sapiens
aaaccagcagaaaagtg

SEQ ID NO: 3923971 - DNA, 20 bp, Homo sapiens
aaaccagcagaaaagtgctt

SEQ ID NO: 3923972 - DNA, 13 bp, Homo sapiens
aaaccagcaggtg

SEQ ID NO: 3923973 - DNA, 20 bp, Homo sapiens
aaaccagtttagatttcaag

SEQ ID NO: 3923974 - DNA, 22 bp, Homo sapiens
aaaccatgtagttttaacagaa

SEQ ID NO: 3923975 - DNA, 14 bp, Homo sapiens
aaacccaaggaaca

SEQ ID NO: 3923976 - DNA, 16 bp, Homo sapiens
aaacccagcatgtaca

SEQ ID NO: 3923977 - DNA, 19 bp, Homo sapiens
aaatatatatacatatgta

SEQ ID NO: 3923978 - DNA, 12 bp, Homo sapiens
aaatatatatat

SEQ ID NO: 3923979 - DNA, 13 bp, Homo sapiens
aaatatatatata

SEQ ID NO: 3923980 - DNA, 17 bp, Homo sapiens
aaatatatatatatatt

SEQ ID NO: 3923981 - DNA, 20 bp, Homo sapiens
aaatatatttaatacctttg

SEQ ID NO: 3923982 - DNA, 20 bp, Homo sapiens
aaatatcagttactcagccc

SEQ ID NO: 3923983 - DNA, 18 bp, Homo sapiens
aaatatctacctgccctc

SEQ ID NO: 3923984 - DNA, 15 bp, Homo sapiens
aaatatctgacatct

SEQ ID NO: 3923985 - DNA, 13 bp, Homo sapiens
aaatatgcaaagc

SEQ ID NO: 3923986 - DNA, 18 bp, Homo sapiens
aaatatggaacttctaat

SEQ ID NO: 3923987 - DNA, 19 bp, Homo sapiens
aaatatggaacttctaata

SEQ ID NO: 3923988 - DNA, 20 bp, Homo sapiens
aaatatggaacttctaatat

SEQ ID NO: 3923989 - DNA, 14 bp, Homo sapiens
aaatatgtttgtgc

SEQ ID NO: 3923990 - DNA, 19 bp, Homo sapiens
aaatatttaagtatatagt

SEQ ID NO: 3923991 - DNA, 12 bp, Homo sapiens
aaatatttatgc

SEQ ID NO: 3923992 - DNA, 16 bp, Homo sapiens
aaatattttctgggtt

SEQ ID NO: 3923993 - DNA, 17 bp, Homo sapiens
aaatattttttaaagtc

SEQ ID NO: 3923994 - DNA, 16 bp, Homo sapiens
aaatcaaaagctgctt

SEQ ID NO: 3923995 - DNA, 18 bp, Homo sapiens
aaatcaaatatgcaaagc

SEQ ID NO: 3923996 - DNA, 19 bp, Homo sapiens
aaatcaacttgtgtactga

SEQ ID NO: 3923997 - DNA, 14 bp, Homo sapiens
aaatcacaagcaat

SEQ ID NO: 3923998 - DNA, 15 bp, Homo sapiens
aaatcacaagcaata

SEQ ID NO: 3923999 - DNA, 16 bp, Homo sapiens
aaatcacaagcaataa

SEQ ID NO: 3924000 - DNA, 17 bp, Homo sapiens
aaatcacaagcaataat

SEQ ID NO: 3924001 - DNA, 23 bp, Homo sapiens
aaatcaccatgtaacaaccagag

SEQ ID NO: 3924002 - DNA, 13 bp, Homo sapiens
aaatcacttgtaa

SEQ ID NO: 3924003 - DNA, 14 bp, Homo sapiens
aaatcacttgtaaa

SEQ ID NO: 3924004 - DNA, 16 bp, Homo sapiens
aaatcacttgtaaata

SEQ ID NO: 3924005 - DNA, 17 bp, Homo sapiens
aaatcacttgtaaataa

SEQ ID NO: 3924006 - DNA, 18 bp, Homo sapiens
aaatcacttgtaaataaa

SEQ ID NO: 3924007 - DNA, 13 bp, Homo sapiens
aaatcagtaattg

SEQ ID NO: 3924008 - DNA, 14 bp, Homo sapiens
aaatcagtcttgga

SEQ ID NO: 3924009 - DNA, 19 bp, Homo sapiens
aaatcagttatattcttta

SEQ ID NO: 3924010 - DNA, 20 bp, Homo sapiens
aaatcattgtagaaacacag

SEQ ID NO: 3924011 - DNA, 22 bp, Homo sapiens
aaatcatttctgcatcagctgc

SEQ ID NO: 3924012 - DNA, 15 bp, Homo sapiens
aaatcctactgaatg

SEQ ID NO: 3924013 - DNA, 17 bp, Homo sapiens
aaatcctttttctttat

SEQ ID NO: 3924014 - DNA, 19 bp, Homo sapiens
aaatcctttttctttataa

SEQ ID NO: 3924015 - DNA, 15 bp, Homo sapiens
aaatcgattggcttt

SEQ ID NO: 3924016 - DNA, 17 bp, Homo sapiens
aaatctaatattaaaaa

SEQ ID NO: 3924017 - DNA, 23 bp, Homo sapiens
aaatctaatcaggttgttaatgt

SEQ ID NO: 3924018 - DNA, 21 bp, Homo sapiens
aaatctagttttttttgtaaa

SEQ ID NO: 3924019 - DNA, 11 bp, Homo sapiens
aaatctatatt

SEQ ID NO: 3924020 - DNA, 19 bp, Homo sapiens
aaatctatattaaagtgtt

SEQ ID NO: 3924021 - DNA, 22 bp, Homo sapiens
aaatctatattaaagtgttata

SEQ ID NO: 3924022 - DNA, 11 bp, Homo sapiens
aaatctcatac

SEQ ID NO: 3924023 - DNA, 23 bp, Homo sapiens
aaatctcatactcccccacagtt

SEQ ID NO: 3924024 - DNA, 15 bp, Homo sapiens
aaatctctaatatgg

SEQ ID NO: 3924025 - DNA, 16 bp, Homo sapiens
aaatctggaaatctgt

SEQ ID NO: 3924026 - DNA, 13 bp, Homo sapiens
aaatctgttttgt

SEQ ID NO: 3924027 - DNA, 18 bp, Homo sapiens
aaatgaaagcatgtctca

SEQ ID NO: 3924028 - DNA, 19 bp, Homo sapiens
aaatgaacgatatgtagca

SEQ ID NO: 3924029 - DNA, 20 bp, Homo sapiens
aaatgaccaagaaaaagaaa

SEQ ID NO: 3924030 - DNA, 14 bp, Homo sapiens
aaatgacccaaaga

SEQ ID NO: 3924031 - DNA, 20 bp, Homo sapiens
aaatgactaaaaatattata

SEQ ID NO: 3924032 - DNA, 16 bp, Homo sapiens
aaatgaggacatgttt

SEQ ID NO: 3924033 - DNA, 13 bp, Homo sapiens
aaatgattttcat

SEQ ID NO: 3924034 - DNA, 16 bp, Homo sapiens
aaatgattttcatcaa

SEQ ID NO: 3924035 - DNA, 19 bp, Homo sapiens
aaatgattttcatcaattt

SEQ ID NO: 3924036 - DNA, 15 bp, Homo sapiens
aaatgcaaaaatctc

SEQ ID NO: 3924037 - DNA, 21 bp, Homo sapiens
aaatgcaaacacacaaaggta

SEQ ID NO: 3924038 - DNA, 20 bp, Homo sapiens
aaatgcaaacactgtgtatt

SEQ ID NO: 3924039 - DNA, 21 bp, Homo sapiens
aaatgcaaacactgtgtattt

SEQ ID NO: 3924040 - DNA, 18 bp, Homo sapiens
aaatgcagtccagaataa

SEQ ID NO: 3924041 - DNA, 15 bp, Homo sapiens
aaatgcataaatgca

SEQ ID NO: 3924042 - DNA, 16 bp, Homo sapiens
aaatgcatccattcct

SEQ ID NO: 3924043 - DNA, 13 bp, Homo sapiens
aaatgcatgattt

SEQ ID NO: 3924044 - DNA, 19 bp, Homo sapiens
aaatgcatgattttataca

SEQ ID NO: 3924045 - DNA, 20 bp, Homo sapiens
aaatgcatgattttatacat

SEQ ID NO: 3924046 - DNA, 22 bp, Homo sapiens
aaatgcatgattttatacatag

SEQ ID NO: 3924047 - DNA, 18 bp, Homo sapiens
aaatgctaaatgcaaaca

SEQ ID NO: 3924048 - DNA, 17 bp, Homo sapiens
aaatgctgaatgaatcc

SEQ ID NO: 3924049 - DNA, 22 bp, Homo sapiens
aaatgctgggggtaggtggcta

SEQ ID NO: 3924050 - DNA, 11 bp, Homo sapiens
aaatggagggt

SEQ ID NO: 3924051 - DNA, 15 bp, Homo sapiens
aaatggagggtgggg

SEQ ID NO: 3924052 - DNA, 13 bp, Homo sapiens
aaatggccatttg

SEQ ID NO: 3924053 - DNA, 19 bp, Homo sapiens
aaatggtggtttgtcatat

SEQ ID NO: 3924054 - DNA, 17 bp, Homo sapiens
aaatgtaacttttgtaa

SEQ ID NO: 3924055 - DNA, 20 bp, Homo sapiens
aaatgtaccttcagaataag

SEQ ID NO: 3924056 - DNA, 17 bp, Homo sapiens
aaatgtatatacacata

SEQ ID NO: 3924057 - DNA, 23 bp, Homo sapiens
aaatgtatatacacatataccta

SEQ ID NO: 3924058 - DNA, 17 bp, Homo sapiens
aaatgtatatatgtata

SEQ ID NO: 3924059 - DNA, 17 bp, Homo sapiens
aaatgtatcatagaaat

SEQ ID NO: 3924060 - DNA, 17 bp, Homo sapiens
aaatgtcatcaaatatt

SEQ ID NO: 3924061 - DNA, 22 bp, Homo sapiens
aaatgtcctgtggtgacaggcc

SEQ ID NO: 3924062 - DNA, 15 bp, Homo sapiens
aaatgtggctcctgg

SEQ ID NO: 3924063 - DNA, 11 bp, Homo sapiens
aaatgtgtatt

SEQ ID NO: 3924064 - DNA, 17 bp, Homo sapiens
aacactcagaagcctgg

SEQ ID NO: 3924065 - DNA, 14 bp, Homo sapiens
aacactgaatcatg

SEQ ID NO: 3924066 - DNA, 16 bp, Homo sapiens
aacactgtaatcttaa

SEQ ID NO: 3924067 - DNA, 13 bp, Homo sapiens
aacagaaacaaaa

SEQ ID NO: 3924068 - DNA, 16 bp, Homo sapiens
aacagaaacaaaaaca

SEQ ID NO: 3924069 - DNA, 16 bp, Homo sapiens
aacagaaccagagggt

SEQ ID NO: 3924070 - DNA, 13 bp, Homo sapiens
aacagactattta

SEQ ID NO: 3924071 - DNA, 17 bp, Homo sapiens
aacagactatttaactt

SEQ ID NO: 3924072 - DNA, 14 bp, Homo sapiens
aacagagcgggcct

SEQ ID NO: 3924073 - DNA, 20 bp, Homo sapiens
aacagatataaatggctggt

SEQ ID NO: 3924074 - DNA, 16 bp, Homo sapiens
aacagatcaatttgta

SEQ ID NO: 3924075 - DNA, 15 bp, Homo sapiens
aacagccaacaggtg

SEQ ID NO: 3924076 - DNA, 13 bp, Homo sapiens
aacagcctcacag

SEQ ID NO: 3924077 - DNA, 18 bp, Homo sapiens
aacagctcaagtcttccc

SEQ ID NO: 3924078 - DNA, 15 bp, Homo sapiens
aacagcttgaccaga

SEQ ID NO: 3924079 - DNA, 22 bp, Homo sapiens
aacagggcagtgacaagtggag

SEQ ID NO: 3924080 - DNA, 24 bp, Homo sapiens
aacagggcagtgacaagtggaggg

SEQ ID NO: 3924081 - DNA, 19 bp, Homo sapiens
aacaggggatcaaagttcc

SEQ ID NO: 3924082 - DNA, 22 bp, Homo sapiens
aacaggggatcaaagttcctgt

SEQ ID NO: 3924083 - DNA, 16 bp, Homo sapiens
aacaggtggcaggacc

SEQ ID NO: 3924084 - DNA, 21 bp, Homo sapiens
aacaggtggcaggaccaggac

SEQ ID NO: 3924085 - DNA, 16 bp, Homo sapiens
aacagtatttgtacaa

SEQ ID NO: 3924086 - DNA, 22 bp, Homo sapiens
aacagtatttgtacaaatactg

SEQ ID NO: 3924087 - DNA, 17 bp, Homo sapiens
aacagtcaaaacagaga

SEQ ID NO: 3924088 - DNA, 19 bp, Homo sapiens
aacagtcacccttctgggc

SEQ ID NO: 3924089 - DNA, 13 bp, Homo sapiens
aacagtctcagga

SEQ ID NO: 3924090 - DNA, 13 bp, Homo sapiens
aacagtgagcctg

SEQ ID NO: 3924091 - DNA, 14 bp, Homo sapiens
aacagtgcctgctg

SEQ ID NO: 3924092 - DNA, 16 bp, Homo sapiens
aacagttagctggagc

SEQ ID NO: 3924093 - DNA, 22 bp, Homo sapiens
aacatacccttctttaaatcaa

SEQ ID NO: 3924094 - DNA, 14 bp, Homo sapiens
aacatatcaattca

SEQ ID NO: 3924095 - DNA, 22 bp, Homo sapiens
aacatatcaattcaacacatta

SEQ ID NO: 3924096 - DNA, 19 bp, Homo sapiens
aacatcatcaggcttggaa

SEQ ID NO: 3924097 - DNA, 23 bp, Homo sapiens
aacatcatcaggcttggaatgaa

SEQ ID NO: 3924098 - DNA, 19 bp, Homo sapiens
aacatccaaggagaaacag

SEQ ID NO: 3924099 - DNA, 19 bp, Homo sapiens
aacatcccattgccctggt

SEQ ID NO: 3924100 - DNA, 22 bp, Homo sapiens
aacatcctaagtgggaagtgaa

SEQ ID NO: 3924101 - DNA, 22 bp, Homo sapiens
aacatctgtcctgtgaaagact

SEQ ID NO: 3924102 - DNA, 19 bp, Homo sapiens
aacatctttgaaaagaaaa

SEQ ID NO: 3924103 - DNA, 20 bp, Homo sapiens
aacatctttgaaaagaaaaa

SEQ ID NO: 3924104 - DNA, 18 bp, Homo sapiens
aacatctttttcctccct

SEQ ID NO: 3924105 - DNA, 21 bp, Homo sapiens
aacatctttttcctccctttc

SEQ ID NO: 3924106 - DNA, 21 bp, Homo sapiens
aacatgaaaaacacggcagct

SEQ ID NO: 3924107 - DNA, 23 bp, Homo sapiens
aacatgaaaaacacggcagctgt

SEQ ID NO: 3924108 - DNA, 13 bp, Homo sapiens
aacatgacactga

SEQ ID NO: 3924109 - DNA, 20 bp, Homo sapiens
aacatgtcggagtagaaatt

SEQ ID NO: 3924110 - DNA, 12 bp, Homo sapiens
aacattaaatgt

SEQ ID NO: 3924111 - DNA, 15 bp, Homo sapiens
aacattaaatgtctt

SEQ ID NO: 3924112 - DNA, 18 bp, Homo sapiens
aacattaaatgtcttata

SEQ ID NO: 3924113 - DNA, 21 bp, Homo sapiens
aacattaagattgaggcctgc

SEQ ID NO: 3924114 - DNA, 16 bp, Homo sapiens
aacatttttggtgtat

SEQ ID NO: 3924115 - DNA, 13 bp, Homo sapiens
aaccaacacccaa

SEQ ID NO: 3924116 - DNA, 17 bp, Homo sapiens
aaccaaccacaaaccac

SEQ ID NO: 3924117 - DNA, 14 bp, Homo sapiens
aaccaagcttcaga

SEQ ID NO: 3924118 - DNA, 16 bp, Homo sapiens
aaccaagcttcagagc

SEQ ID NO: 3924119 - DNA, 21 bp, Homo sapiens
aaccaagcttcagagcctagc

SEQ ID NO: 3924120 - DNA, 13 bp, Homo sapiens
aaccaaggcagcc

SEQ ID NO: 3924121 - DNA, 15 bp, Homo sapiens
aaccaaggcagcctc

SEQ ID NO: 3924122 - DNA, 14 bp, Homo sapiens
aaccaatgagctgt

SEQ ID NO: 3924123 - DNA, 16 bp, Homo sapiens
aaccacaactgacaca

SEQ ID NO: 3924124 - DNA, 17 bp, Homo sapiens
aaccacacttcttgaaa

SEQ ID NO: 3924125 - DNA, 12 bp, Homo sapiens
aaccacagcagt

SEQ ID NO: 3924126 - DNA, 22 bp, Homo sapiens
aaccacatacaacacaaagaga

SEQ ID NO: 3924127 - DNA, 23 bp, Homo sapiens
aaccacgagtaagatattattta

SEQ ID NO: 3924128 - DNA, 13 bp, Homo sapiens
aaccactgtacat

SEQ ID NO: 3924129 - DNA, 16 bp, Homo sapiens
aaccactgtacatata

SEQ ID NO: 3924130 - DNA, 17 bp, Homo sapiens
aaccacttggctgctca

SEQ ID NO: 3924131 - DNA, 17 bp, Homo sapiens
aaccagagccccccaca

SEQ ID NO: 3924132 - DNA, 13 bp, Homo sapiens
aaccagagggttg

SEQ ID NO: 3924133 - DNA, 12 bp, Homo sapiens
aaccagcagaaa

SEQ ID NO: 3924134 - DNA, 13 bp, Homo sapiens
aaccagcagaaaa

SEQ ID NO: 3924135 - DNA, 14 bp, Homo sapiens
aaccagcagaaaag

SEQ ID NO: 3924136 - DNA, 11 bp, Homo sapiens
aaccagcaggt

SEQ ID NO: 3924137 - DNA, 22 bp, Homo sapiens
aaccagctgtaacacagctgag

SEQ ID NO: 3924138 - DNA, 22 bp, Homo sapiens
aaccaggattttgtgttttttc

SEQ ID NO: 3924139 - DNA, 17 bp, Homo sapiens
aaccagggaggagagga

SEQ ID NO: 3924140 - DNA, 15 bp, Homo sapiens
aaccagggtgcatgg

SEQ ID NO: 3924141 - DNA, 23 bp, Homo sapiens
aaccagggtgcatggcttgggga

SEQ ID NO: 3924142 - DNA, 17 bp, Homo sapiens
aaccagtacttctaaga

SEQ ID NO: 3924143 - DNA, 17 bp, Homo sapiens
aaccagtatggaaggga

SEQ ID NO: 3924144 - DNA, 19 bp, Homo sapiens
aaccagtatggaagggagg

SEQ ID NO: 3924145 - DNA, 17 bp, Homo sapiens
aaccagtttagatttca

SEQ ID NO: 3924146 - DNA, 23 bp, Homo sapiens
aaccatagttatttacttgaaag

SEQ ID NO: 3924147 - DNA, 20 bp, Homo sapiens
aaccatctgtccctgcctca

SEQ ID NO: 3924148 - DNA, 20 bp, Homo sapiens
aaccatgcagcttcatcaat

SEQ ID NO: 3924149 - DNA, 22 bp, Homo sapiens
aaccatgcagcttcatcaattt

SEQ ID NO: 3924150 - DNA, 20 bp, Homo sapiens
aaccatgtagttttaacaga

SEQ ID NO: 3924151 - DNA, 13 bp, Homo sapiens
aagagagaaatct

SEQ ID NO: 3924152 - DNA, 15 bp, Homo sapiens
aagagaggacacaaa

SEQ ID NO: 3924153 - DNA, 13 bp, Homo sapiens
aagagaggcacct

SEQ ID NO: 3924154 - DNA, 16 bp, Homo sapiens
aagagatttcaacata

SEQ ID NO: 3924155 - DNA, 13 bp, Homo sapiens
aagagcaaaatga

SEQ ID NO: 3924156 - DNA, 12 bp, Homo sapiens
aagagcagcctg

SEQ ID NO: 3924157 - DNA, 13 bp, Homo sapiens
aagagcagcctga

SEQ ID NO: 3924158 - DNA, 20 bp, Homo sapiens
aagagcagcctgatggccaa

SEQ ID NO: 3924159 - DNA, 23 bp, Homo sapiens
aagagcagcctgatggccaaggg

SEQ ID NO: 3924160 - DNA, 19 bp, Homo sapiens
aagagcatcatgcctctga

SEQ ID NO: 3924161 - DNA, 14 bp, Homo sapiens
aagagcctggagaa

SEQ ID NO: 3924162 - DNA, 17 bp, Homo sapiens
aagagcctggagaagct

SEQ ID NO: 3924163 - DNA, 22 bp, Homo sapiens
aagagccttggtgtccacctgg

SEQ ID NO: 3924164 - DNA, 16 bp, Homo sapiens
aagagctagcgctgcc

SEQ ID NO: 3924165 - DNA, 21 bp, Homo sapiens
aagagctcttcggtttctgag

SEQ ID NO: 3924166 - DNA, 15 bp, Homo sapiens
aagaggaagcaagaa

SEQ ID NO: 3924167 - DNA, 15 bp, Homo sapiens
aagaggactgagact

SEQ ID NO: 3924168 - DNA, 17 bp, Homo sapiens
aagaggactgagactgg

SEQ ID NO: 3924169 - DNA, 22 bp, Homo sapiens
aagaggagagaggaagctctct

SEQ ID NO: 3924170 - DNA, 15 bp, Homo sapiens
aagaggcaagagaca

SEQ ID NO: 3924171 - DNA, 13 bp, Homo sapiens
aagaggcccaggg

SEQ ID NO: 3924172 - DNA, 17 bp, Homo sapiens
aagaggctggtgctgtg

SEQ ID NO: 3924173 - DNA, 14 bp, Homo sapiens
aagagggcctgtgg

SEQ ID NO: 3924174 - DNA, 19 bp, Homo sapiens
aagaggtgaccccagggca

SEQ ID NO: 3924175 - DNA, 22 bp, Homo sapiens
aagaggtgaccccagggcacag

SEQ ID NO: 3924176 - DNA, 15 bp, Homo sapiens
aagaggtggggacca

SEQ ID NO: 3924177 - DNA, 23 bp, Homo sapiens
aagagtagcaagttctagagaag

SEQ ID NO: 3924178 - DNA, 14 bp, Homo sapiens
aagagtgcattttc

SEQ ID NO: 3924179 - DNA, 21 bp, Homo sapiens
aagagtttaactttgggccca

SEQ ID NO: 3924180 - DNA, 19 bp, Homo sapiens
aagataaaatatcctcagg

SEQ ID NO: 3924181 - DNA, 21 bp, Homo sapiens
aagataacaagatctttcagg

SEQ ID NO: 3924182 - DNA, 22 bp, Homo sapiens
aagataacaagatctttcagga

SEQ ID NO: 3924183 - DNA, 20 bp, Homo sapiens
aagataatgttctttaatgt

SEQ ID NO: 3924184 - DNA, 23 bp, Homo sapiens
aagataatgttctttaatgttgt

SEQ ID NO: 3924185 - DNA, 15 bp, Homo sapiens
aagatacactcctgc

SEQ ID NO: 3924186 - DNA, 16 bp, Homo sapiens
aagatacactcctgct

SEQ ID NO: 3924187 - DNA, 17 bp, Homo sapiens
aagatacactcctgctg

SEQ ID NO: 3924188 - DNA, 18 bp, Homo sapiens
aagatacactcctgctgt

SEQ ID NO: 3924189 - DNA, 23 bp, Homo sapiens
aagatacggttgcttcaccttgg

SEQ ID NO: 3924190 - DNA, 21 bp, Homo sapiens
aagatatatacacaggatcct

SEQ ID NO: 3924191 - DNA, 14 bp, Homo sapiens
aagatatattttga

SEQ ID NO: 3924192 - DNA, 15 bp, Homo sapiens
aagatatttatatat

SEQ ID NO: 3924193 - DNA, 15 bp, Homo sapiens
aagatccaccctcaa

SEQ ID NO: 3924194 - DNA, 23 bp, Homo sapiens
aagatccaccctcaaatgtcaga

SEQ ID NO: 3924195 - DNA, 18 bp, Homo sapiens
aagatgaagagaagctga

SEQ ID NO: 3924196 - DNA, 17 bp, Homo sapiens
aagatgagagaactgga

SEQ ID NO: 3924197 - DNA, 18 bp, Homo sapiens
aagatgagatttgccagc

SEQ ID NO: 3924198 - DNA, 22 bp, Homo sapiens
aagatgagctctgaacaaacac

SEQ ID NO: 3924199 - DNA, 21 bp, Homo sapiens
aagatgccctccaatcctttc

SEQ ID NO: 3924200 - DNA, 16 bp, Homo sapiens
aagatggactctgaaa

SEQ ID NO: 3924201 - DNA, 18 bp, Homo sapiens
aagatggctgtgcctctg

SEQ ID NO: 3924202 - DNA, 21 bp, Homo sapiens
aagatggctgtgcctctgcct

SEQ ID NO: 3924203 - DNA, 13 bp, Homo sapiens
aagatgggcacat

SEQ ID NO: 3924204 - DNA, 13 bp, Homo sapiens
aagattaaaggaa

SEQ ID NO: 3924205 - DNA, 15 bp, Homo sapiens
aagattaaaggaagg

SEQ ID NO: 3924206 - DNA, 13 bp, Homo sapiens
aagattagaatga

SEQ ID NO: 3924207 - DNA, 19 bp, Homo sapiens
aagattatattataataat

SEQ ID NO: 3924208 - DNA, 12 bp, Homo sapiens
aagattcccaga

SEQ ID NO: 3924209 - DNA, 13 bp, Homo sapiens
aagattcccagag

SEQ ID NO: 3924210 - DNA, 14 bp, Homo sapiens
aagattcccagaga

SEQ ID NO: 3924211 - DNA, 13 bp, Homo sapiens
aagattgttttat

SEQ ID NO: 3924212 - DNA, 23 bp, Homo sapiens
aagattttggagggtcctccaca

SEQ ID NO: 3924213 - DNA, 19 bp, Homo sapiens
aagattttttttgtaactt

SEQ ID NO: 3924214 - DNA, 14 bp, Homo sapiens
aagcaaagggctcc

SEQ ID NO: 3924215 - DNA, 11 bp, Homo sapiens
aagcaaaggtg

SEQ ID NO: 3924216 - DNA, 20 bp, Homo sapiens
aagcaaatttcaaaagacat

SEQ ID NO: 3924217 - DNA, 21 bp, Homo sapiens
aagcaacacaagacacctttt

SEQ ID NO: 3924218 - DNA, 14 bp, Homo sapiens
aagcaacaggtttt

SEQ ID NO: 3924219 - DNA, 19 bp, Homo sapiens
aagcaacctcccaacccag

SEQ ID NO: 3924220 - DNA, 14 bp, Homo sapiens
aagcaactcacacg

SEQ ID NO: 3924221 - DNA, 12 bp, Homo sapiens
aagcaataatta

SEQ ID NO: 3924222 - DNA, 20 bp, Homo sapiens
aagcaataattaggatctat

SEQ ID NO: 3924223 - DNA, 22 bp, Homo sapiens
aagcaatgggcactggtatttg

SEQ ID NO: 3924224 - DNA, 16 bp, Homo sapiens
aagcacagacattaaa

SEQ ID NO: 3924225 - DNA, 14 bp, Homo sapiens
aagcacaggagaca

SEQ ID NO: 3924226 - DNA, 15 bp, Homo sapiens
aagcacatgtttatt

SEQ ID NO: 3924227 - DNA, 21 bp, Homo sapiens
aagcaccagcttctccaggct

SEQ ID NO: 3924228 - DNA, 21 bp, Homo sapiens
aagcacctgcagattctgatt

SEQ ID NO: 3924229 - DNA, 17 bp, Homo sapiens
aagcacctgccgacctc

SEQ ID NO: 3924230 - DNA, 20 bp, Homo sapiens
aagcacctgccgacctcgtc

SEQ ID NO: 3924231 - DNA, 16 bp, Homo sapiens
aagcaccttagctggc

SEQ ID NO: 3924232 - DNA, 19 bp, Homo sapiens
aagcaccttagctggcatt

SEQ ID NO: 3924233 - DNA, 19 bp, Homo sapiens
aagcactgacttctaagta

SEQ ID NO: 3924234 - DNA, 19 bp, Homo sapiens
aagcactgctaggcgagtg

SEQ ID NO: 3924235 - DNA, 22 bp, Homo sapiens
aagcactgtttaactgggagtg

SEQ ID NO: 3924236 - DNA, 20 bp, Homo sapiens
aagcacttgttccttctgct

SEQ ID NO: 3924237 - DNA, 17 bp, Homo sapiens
aagcagacgcagcagct

SEQ ID NO: 3924238 - DNA, 22 bp, Homo sapiens
aatattaccaaaaaagtatttt

SEQ ID NO: 3924239 - DNA, 21 bp, Homo sapiens
aatattataaatccaaagtaa

SEQ ID NO: 3924240 - DNA, 13 bp, Homo sapiens
aatattcaaatgt

SEQ ID NO: 3924241 - DNA, 14 bp, Homo sapiens
aatattcaataaag

SEQ ID NO: 3924242 - DNA, 16 bp, Homo sapiens
aatattcaataaagct

SEQ ID NO: 3924243 - DNA, 17 bp, Homo sapiens
aatatttaagtatatag

SEQ ID NO: 3924244 - DNA, 23 bp, Homo sapiens
aatatttaagtttgttgctgtca

SEQ ID NO: 3924245 - DNA, 15 bp, Homo sapiens
aatatttactcatca

SEQ ID NO: 3924246 - DNA, 18 bp, Homo sapiens
aatatttaggcaagagaa

SEQ ID NO: 3924247 - DNA, 14 bp, Homo sapiens
aatatttcaaatga

SEQ ID NO: 3924248 - DNA, 14 bp, Homo sapiens
aatattttgtattt

SEQ ID NO: 3924249 - DNA, 22 bp, Homo sapiens
aatatttttagctctgttcttt

SEQ ID NO: 3924250 - DNA, 14 bp, Homo sapiens
aatcaaaagctgct

SEQ ID NO: 3924251 - DNA, 16 bp, Homo sapiens
aatcaaaagctgcttg

SEQ ID NO: 3924252 - DNA, 19 bp, Homo sapiens
aatcaaaagctgcttgact

SEQ ID NO: 3924253 - DNA, 13 bp, Homo sapiens
aatcaaagcaagg

SEQ ID NO: 3924254 - DNA, 19 bp, Homo sapiens
aatcaaagcaagggctcca

SEQ ID NO: 3924255 - DNA, 23 bp, Homo sapiens
aatcaaccccagactcaaactca

SEQ ID NO: 3924256 - DNA, 16 bp, Homo sapiens
aatcaacttgtgtact

SEQ ID NO: 3924257 - DNA, 18 bp, Homo sapiens
aatcaagaatattcaaat

SEQ ID NO: 3924258 - DNA, 20 bp, Homo sapiens
aatcaagaatattcaaatgt

SEQ ID NO: 3924259 - DNA, 15 bp, Homo sapiens
aatcaaggaatcctg

SEQ ID NO: 3924260 - DNA, 20 bp, Homo sapiens
aatcaatctatcaattacag

SEQ ID NO: 3924261 - DNA, 14 bp, Homo sapiens
aatcaatttcccag

SEQ ID NO: 3924262 - DNA, 17 bp, Homo sapiens
aatcaatttcccagaag

SEQ ID NO: 3924263 - DNA, 15 bp, Homo sapiens
aatcacacctctggg

SEQ ID NO: 3924264 - DNA, 23 bp, Homo sapiens
aatcacagatgggtattaaactt

SEQ ID NO: 3924265 - DNA, 12 bp, Homo sapiens
aatcaccaaagt

SEQ ID NO: 3924266 - DNA, 20 bp, Homo sapiens
aatcaccacaccaaacctct

SEQ ID NO: 3924267 - DNA, 21 bp, Homo sapiens
aatcaccatgtaacaaccaga

SEQ ID NO: 3924268 - DNA, 18 bp, Homo sapiens
aatcactctgtccttgga

SEQ ID NO: 3924269 - DNA, 14 bp, Homo sapiens
aatcacttgtaaat

SEQ ID NO: 3924270 - DNA, 17 bp, Homo sapiens
aatcacttgtaaataaa

SEQ ID NO: 3924271 - DNA, 13 bp, Homo sapiens
aatcagacaaagt

SEQ ID NO: 3924272 - DNA, 20 bp, Homo sapiens
aatcagaccctaccccacca

SEQ ID NO: 3924273 - DNA, 15 bp, Homo sapiens
aatcagcactgaaaa

SEQ ID NO: 3924274 - DNA, 17 bp, Homo sapiens
aatcagcactgaaaata

SEQ ID NO: 3924275 - DNA, 16 bp, Homo sapiens
aatcagcctcttaaag

SEQ ID NO: 3924276 - DNA, 18 bp, Homo sapiens
aatcagcttttaataaaa

SEQ ID NO: 3924277 - DNA, 20 bp, Homo sapiens
aatcagcttttaataaaatt

SEQ ID NO: 3924278 - DNA, 21 bp, Homo sapiens
aatcagcttttaataaaattg

SEQ ID NO: 3924279 - DNA, 19 bp, Homo sapiens
aatcaggttgttaatgttg

SEQ ID NO: 3924280 - DNA, 20 bp, Homo sapiens
aatcagttatattctttaaa

SEQ ID NO: 3924281 - DNA, 15 bp, Homo sapiens
aatcataattttcaa

SEQ ID NO: 3924282 - DNA, 14 bp, Homo sapiens
aatcatcgaaaatt

SEQ ID NO: 3924283 - DNA, 19 bp, Homo sapiens
aatcatcgaaaattcattt

SEQ ID NO: 3924284 - DNA, 23 bp, Homo sapiens
aatcatcgaaaattcatttcaca

SEQ ID NO: 3924285 - DNA, 18 bp, Homo sapiens
aatcatgagtcagacatt

SEQ ID NO: 3924286 - DNA, 16 bp, Homo sapiens
aatcattctttcccct

SEQ ID NO: 3924287 - DNA, 14 bp, Homo sapiens
aatcattgtagaaa

SEQ ID NO: 3924288 - DNA, 18 bp, Homo sapiens
aatccacaaagccgtgcc

SEQ ID NO: 3924289 - DNA, 13 bp, Homo sapiens
aatccagaaagaa

SEQ ID NO: 3924290 - DNA, 19 bp, Homo sapiens
aatccaggtgggagagaca

SEQ ID NO: 3924291 - DNA, 22 bp, Homo sapiens
aatccaggtgggagagacactc

SEQ ID NO: 3924292 - DNA, 19 bp, Homo sapiens
aatccatgttagtttttac

SEQ ID NO: 3924293 - DNA, 19 bp, Homo sapiens
aatcccctcattcaggaaa

SEQ ID NO: 3924294 - DNA, 14 bp, Homo sapiens
aatccctgtttaat

SEQ ID NO: 3924295 - DNA, 23 bp, Homo sapiens
aatccctgtttaatatttaaaca

SEQ ID NO: 3924296 - DNA, 22 bp, Homo sapiens
aatcctagaaccaagcttcaga

SEQ ID NO: 3924297 - DNA, 14 bp, Homo sapiens
aatcctgcctctcc

SEQ ID NO: 3924298 - DNA, 22 bp, Homo sapiens
aatcctgtatattatggtgtaa

SEQ ID NO: 3924299 - DNA, 20 bp, Homo sapiens
aatcctttttctttataaac

SEQ ID NO: 3924300 - DNA, 17 bp, Homo sapiens
aatcgatctgtactgta

SEQ ID NO: 3924301 - DNA, 13 bp, Homo sapiens
aatcgattggctt

SEQ ID NO: 3924302 - DNA, 14 bp, Homo sapiens
aatcgccccagact

SEQ ID NO: 3924303 - DNA, 22 bp, Homo sapiens
aatcggcccacagctcccaccc

SEQ ID NO: 3924304 - DNA, 17 bp, Homo sapiens
aatctatattaaagtgt

SEQ ID NO: 3924305 - DNA, 18 bp, Homo sapiens
aatctattcagacaagca

SEQ ID NO: 3924306 - DNA, 19 bp, Homo sapiens
aatctattcagacaagcaa

SEQ ID NO: 3924307 - DNA, 23 bp, Homo sapiens
aatctatttacataaaatgggtg

SEQ ID NO: 3924308 - DNA, 12 bp, Homo sapiens
aatctcattccc

SEQ ID NO: 3924309 - DNA, 18 bp, Homo sapiens
aatctccagggctgcccc

SEQ ID NO: 3924310 - DNA, 21 bp, Homo sapiens
aatctccagggctgcccctgt

SEQ ID NO: 3924311 - DNA, 22 bp, Homo sapiens
aatctcttttttcaactggctg

SEQ ID NO: 3924312 - DNA, 19 bp, Homo sapiens
aatctgagcctaaatctaa

SEQ ID NO: 3924313 - DNA, 17 bp, Homo sapiens
aatctgataggaaaaga

SEQ ID NO: 3924314 - DNA, 12 bp, Homo sapiens
aatctgatttaa

SEQ ID NO: 3924315 - DNA, 11 bp, Homo sapiens
aatctgcaggg

SEQ ID NO: 3924316 - DNA, 18 bp, Homo sapiens
aatctgcagggagcaact

SEQ ID NO: 3924317 - DNA, 23 bp, Homo sapiens
aatctgcagggagcaactctcca

SEQ ID NO: 3924318 - DNA, 16 bp, Homo sapiens
aatctgctcagcaggc

SEQ ID NO: 3924319 - DNA, 19 bp, Homo sapiens
aatctgctcagcaggccct

SEQ ID NO: 3924320 - DNA, 21 bp, Homo sapiens
aatctgctggttttaacaact

SEQ ID NO: 3924321 - DNA, 11 bp, Homo sapiens
aatctgctgtt

SEQ ID NO: 3924322 - DNA, 16 bp, Homo sapiens
aatctggactcctctg

SEQ ID NO: 3924323 - DNA, 17 bp, Homo sapiens
aatctggactcctctgt

SEQ ID NO: 3924324 - DNA, 12 bp, Homo sapiens
aattttattcct

SEQ ID NO: 3924325 - DNA, 17 bp, Homo sapiens
aattttatttagttctt

SEQ ID NO: 3924326 - DNA, 17 bp, Homo sapiens
aattttcagaccccagc

SEQ ID NO: 3924327 - DNA, 18 bp, Homo sapiens
aattttctagactttctg

SEQ ID NO: 3924328 - DNA, 15 bp, Homo sapiens
aattttgcatttagt

SEQ ID NO: 3924329 - DNA, 15 bp, Homo sapiens
aattttgtttcagaa

SEQ ID NO: 3924330 - DNA, 14 bp, Homo sapiens
aattttgtttgtaa

SEQ ID NO: 3924331 - DNA, 17 bp, Homo sapiens
aatttttaaactagtaa

SEQ ID NO: 3924332 - DNA, 12 bp, Homo sapiens
aatttttataca

SEQ ID NO: 3924333 - DNA, 22 bp, Homo sapiens
aatttttatacatatcagaaaa

SEQ ID NO: 3924334 - DNA, 15 bp, Homo sapiens
aatttttatttttga

SEQ ID NO: 3924335 - DNA, 23 bp, Homo sapiens
aatttttcagctctctgtataaa

SEQ ID NO: 3924336 - DNA, 21 bp, Homo sapiens
aatttttcttatttcatttct

SEQ ID NO: 3924337 - DNA, 23 bp, Homo sapiens
aatttttgtcattttaaaatctg

SEQ ID NO: 3924338 - DNA, 21 bp, Homo sapiens
aattttttgatgtcagccttg

SEQ ID NO: 3924339 - DNA, 15 bp, Homo sapiens
aattttttttaatgt

SEQ ID NO: 3924340 - DNA, 15 bp, Homo sapiens
acaaaaacaaaacaa

SEQ ID NO: 3924341 - DNA, 16 bp, Homo sapiens
acaaaaacaaaacaaa

SEQ ID NO: 3924342 - DNA, 13 bp, Homo sapiens
acaaaaacacagc

SEQ ID NO: 3924343 - DNA, 15 bp, Homo sapiens
acaaaaacagcctca

SEQ ID NO: 3924344 - DNA, 15 bp, Homo sapiens
acaaaaaccagcagg

SEQ ID NO: 3924345 - DNA, 12 bp, Homo sapiens
acaaaacaacaa

SEQ ID NO: 3924346 - DNA, 14 bp, Homo sapiens
acaaaacaacaaca

SEQ ID NO: 3924347 - DNA, 20 bp, Homo sapiens
acaaaacaacaacaatacaa

SEQ ID NO: 3924348 - DNA, 16 bp, Homo sapiens
acaaaataaaattatg

SEQ ID NO: 3924349 - DNA, 12 bp, Homo sapiens
acaaaataaaca

SEQ ID NO: 3924350 - DNA, 10 bp, Homo sapiens
acaaaataat

SEQ ID NO: 3924351 - DNA, 15 bp, Homo sapiens
acaaaataatttaac

SEQ ID NO: 3924352 - DNA, 17 bp, Homo sapiens
acaaaataatttaacta

SEQ ID NO: 3924353 - DNA, 19 bp, Homo sapiens
acaaaataatttaactaat

SEQ ID NO: 3924354 - DNA, 22 bp, Homo sapiens
acaaaataatttaactaattta

SEQ ID NO: 3924355 - DNA, 19 bp, Homo sapiens
acaaaatcgattggcttta

SEQ ID NO: 3924356 - DNA, 14 bp, Homo sapiens
acaaacacctccta

SEQ ID NO: 3924357 - DNA, 15 bp, Homo sapiens
acaaacactgaatca

SEQ ID NO: 3924358 - DNA, 14 bp, Homo sapiens
acaaacataagtgc

SEQ ID NO: 3924359 - DNA, 21 bp, Homo sapiens
acaaaccacaactgacacagg

SEQ ID NO: 3924360 - DNA, 21 bp, Homo sapiens
acaaaccaccctaaaatgaca

SEQ ID NO: 3924361 - DNA, 16 bp, Homo sapiens
acaaactacatgtaat

SEQ ID NO: 3924362 - DNA, 17 bp, Homo sapiens
acaaactgatttctcac

SEQ ID NO: 3924363 - DNA, 13 bp, Homo sapiens
acaaactttaaat

SEQ ID NO: 3924364 - DNA, 16 bp, Homo sapiens
acaaagaaggcacagg

SEQ ID NO: 3924365 - DNA, 20 bp, Homo sapiens
acaaagagaaaaagaaatgc

SEQ ID NO: 3924366 - DNA, 23 bp, Homo sapiens
acaaagagaataaagacttcatg

SEQ ID NO: 3924367 - DNA, 23 bp, Homo sapiens
acaaaggagcctgtgaacccagg

SEQ ID NO: 3924368 - DNA, 24 bp, Homo sapiens
acaaaggttgagatgtaaaaggta

SEQ ID NO: 3924369 - DNA, 21 bp, Homo sapiens
acaaaggttttcctcttctat

SEQ ID NO: 3924370 - DNA, 14 bp, Homo sapiens
acaaagtaattcct

SEQ ID NO: 3924371 - DNA, 16 bp, Homo sapiens
acaaataacaatgtgc

SEQ ID NO: 3924372 - DNA, 22 bp, Homo sapiens
acaaatattgttaccatgaaga

SEQ ID NO: 3924373 - DNA, 13 bp, Homo sapiens
acaaatctatatt

SEQ ID NO: 3924374 - DNA, 22 bp, Homo sapiens
acaaattatgttacatctgttt

SEQ ID NO: 3924375 - DNA, 22 bp, Homo sapiens
acaaattcaaggagatataaaa

SEQ ID NO: 3924376 - DNA, 15 bp, Homo sapiens
acaaattctacagca

SEQ ID NO: 3924377 - DNA, 18 bp, Homo sapiens
acaaatttttatttctaa

SEQ ID NO: 3924378 - DNA, 14 bp, Homo sapiens
acaacaaaccaaaa

SEQ ID NO: 3924379 - DNA, 14 bp, Homo sapiens
acaacaacaacaat

SEQ ID NO: 3924380 - DNA, 16 bp, Homo sapiens
acaacaacaatacaac

SEQ ID NO: 3924381 - DNA, 12 bp, Homo sapiens
acaacaaggacc

SEQ ID NO: 3924382 - DNA, 15 bp, Homo sapiens
acaacaaggaccctg

SEQ ID NO: 3924383 - DNA, 9 bp, Homo sapiens
acaacaata

SEQ ID NO: 3924384 - DNA, 12 bp, Homo sapiens
acaacaataaca

SEQ ID NO: 3924385 - DNA, 14 bp, Homo sapiens
acaacagcagatgg

SEQ ID NO: 3924386 - DNA, 12 bp, Homo sapiens
acaacagtaaca

SEQ ID NO: 3924387 - DNA, 21 bp, Homo sapiens
acaacagttgggctgtcaaca

SEQ ID NO: 3924388 - DNA, 22 bp, Homo sapiens
acaacagttgggctgtcaacat

SEQ ID NO: 3924389 - DNA, 19 bp, Homo sapiens
acaacatcccacagtggca

SEQ ID NO: 3924390 - DNA, 23 bp, Homo sapiens
acaacatttatttcaaactattg

SEQ ID NO: 3924391 - DNA, 12 bp, Homo sapiens
acaacattttat

SEQ ID NO: 3924392 - DNA, 13 bp, Homo sapiens
acaacattttatt

SEQ ID NO: 3924393 - DNA, 18 bp, Homo sapiens
acaaccacatacaacaca

SEQ ID NO: 3924394 - DNA, 17 bp, Homo sapiens
acaaccagagcccccca

SEQ ID NO: 3924395 - DNA, 24 bp, Homo sapiens
acaaccccatcatatgacatgcca

SEQ ID NO: 3924396 - DNA, 17 bp, Homo sapiens
acaaccctgttttatac

SEQ ID NO: 3924397 - DNA, 18 bp, Homo sapiens
acaacctgcccctcccca

SEQ ID NO: 3924398 - DNA, 11 bp, Homo sapiens
acaagaacaac

SEQ ID NO: 3924399 - DNA, 16 bp, Homo sapiens
acaagagcgaaactcc

SEQ ID NO: 3924400 - DNA, 15 bp, Homo sapiens
acaagagctgctgtc

SEQ ID NO: 3924401 - DNA, 18 bp, Homo sapiens
acaagaggttaaggtggg

SEQ ID NO: 3924402 - DNA, 13 bp, Homo sapiens
acaagatctttca

SEQ ID NO: 3924403 - DNA, 14 bp, Homo sapiens
acaagattcccaga

SEQ ID NO: 3924404 - DNA, 11 bp, Homo sapiens
acaagcagagg

SEQ ID NO: 3924405 - DNA, 14 bp, Homo sapiens
acaagcatatttga

SEQ ID NO: 3924406 - DNA, 13 bp, Homo sapiens
acaagcccaggct

SEQ ID NO: 3924407 - DNA, 21 bp, Homo sapiens
acaagccttactcacctctct

SEQ ID NO: 3924408 - DNA, 12 bp, Homo sapiens
acaaggaaccac

SEQ ID NO: 3924409 - DNA, 24 bp, Homo sapiens
acaaggaaccaccgaagaggaagc

SEQ ID NO: 3924410 - DNA, 14 bp, Homo sapiens
acaaggaccctgtt

SEQ ID NO: 3924411 - DNA, 15 bp, Homo sapiens
acacagttgctgtca

SEQ ID NO: 3924412 - DNA, 22 bp, Homo sapiens
acacagttgctgtcataagaat

SEQ ID NO: 3924413 - DNA, 14 bp, Homo sapiens
acacagttttgaaa

SEQ ID NO: 3924414 - DNA, 16 bp, Homo sapiens
acacatacatacacat

SEQ ID NO: 3924415 - DNA, 23 bp, Homo sapiens
acacatacatacacatacataca

SEQ ID NO: 3924416 - DNA, 21 bp, Homo sapiens
acacatagattaatggcactg

SEQ ID NO: 3924417 - DNA, 12 bp, Homo sapiens
acacatatacat

SEQ ID NO: 3924418 - DNA, 16 bp, Homo sapiens
acacatatacatatat

SEQ ID NO: 3924419 - DNA, 20 bp, Homo sapiens
acacatcccggcctcttcca

SEQ ID NO: 3924420 - DNA, 16 bp, Homo sapiens
acacatcgcactgtgg

SEQ ID NO: 3924421 - DNA, 20 bp, Homo sapiens
acacatgcatcatcagccta

SEQ ID NO: 3924422 - DNA, 22 bp, Homo sapiens
acacatggctatcctagagagg

SEQ ID NO: 3924423 - DNA, 19 bp, Homo sapiens
acacattatgttagagagg

SEQ ID NO: 3924424 - DNA, 21 bp, Homo sapiens
acacattttctcctaggagaa

SEQ ID NO: 3924425 - DNA, 20 bp, Homo sapiens
acaccactctggcagccaca

SEQ ID NO: 3924426 - DNA, 13 bp, Homo sapiens
acaccactgccct

SEQ ID NO: 3924427 - DNA, 16 bp, Homo sapiens
acaccactgccctgcc

SEQ ID NO: 3924428 - DNA, 17 bp, Homo sapiens
acaccactgccctgcct

SEQ ID NO: 3924429 - DNA, 19 bp, Homo sapiens
acaccactgccctgcctgc

SEQ ID NO: 3924430 - DNA, 22 bp, Homo sapiens
acaccactgccctgcctgccca

SEQ ID NO: 3924431 - DNA, 21 bp, Homo sapiens
acaccagagtgtagaataata

SEQ ID NO: 3924432 - DNA, 16 bp, Homo sapiens
acaccattgttcctta

SEQ ID NO: 3924433 - DNA, 19 bp, Homo sapiens
acaccattgttccttacct

SEQ ID NO: 3924434 - DNA, 20 bp, Homo sapiens
acacccaaagaggtatttat

SEQ ID NO: 3924435 - DNA, 20 bp, Homo sapiens
acacccaaagcatggactaa

SEQ ID NO: 3924436 - DNA, 14 bp, Homo sapiens
acacccatgtaaat

SEQ ID NO: 3924437 - DNA, 13 bp, Homo sapiens
acaccccaaggga

SEQ ID NO: 3924438 - DNA, 19 bp, Homo sapiens
acaccccatctctcttccc

SEQ ID NO: 3924439 - DNA, 16 bp, Homo sapiens
acacccttggacttga

SEQ ID NO: 3924440 - DNA, 18 bp, Homo sapiens
acacccttggacttgagg

SEQ ID NO: 3924441 - DNA, 20 bp, Homo sapiens
acaccgtccctcagtgatac

SEQ ID NO: 3924442 - DNA, 12 bp, Homo sapiens
acacctcccagg

SEQ ID NO: 3924443 - DNA, 13 bp, Homo sapiens
acacctcccagga

SEQ ID NO: 3924444 - DNA, 22 bp, Homo sapiens
acacctccctgaaccatccctg

SEQ ID NO: 3924445 - DNA, 13 bp, Homo sapiens
acacctctgggct

SEQ ID NO: 3924446 - DNA, 11 bp, Homo sapiens
acacctgacac

SEQ ID NO: 3924447 - DNA, 14 bp, Homo sapiens
acacctgcacctcc

SEQ ID NO: 3924448 - DNA, 15 bp, Homo sapiens
acacctgcacctccc

SEQ ID NO: 3924449 - DNA, 24 bp, Homo sapiens
acacctgcacctccccccactgca

SEQ ID NO: 3924450 - DNA, 16 bp, Homo sapiens
acacctgccccagcgc

SEQ ID NO: 3924451 - DNA, 13 bp, Homo sapiens
acacctgccctgc

SEQ ID NO: 3924452 - DNA, 17 bp, Homo sapiens
acacctgccctgccctg

SEQ ID NO: 3924453 - DNA, 18 bp, Homo sapiens
acacctgccctgccctgc

SEQ ID NO: 3924454 - DNA, 17 bp, Homo sapiens
acacctgttgcacctca

SEQ ID NO: 3924455 - DNA, 19 bp, Homo sapiens
acacgagcaggctactgtc

SEQ ID NO: 3924456 - DNA, 15 bp, Homo sapiens
acacgctgtctcttg

SEQ ID NO: 3924457 - DNA, 15 bp, Homo sapiens
acacggaccatgtgg

SEQ ID NO: 3924458 - DNA, 15 bp, Homo sapiens
acacggtgaaatcca

SEQ ID NO: 3924459 - DNA, 19 bp, Homo sapiens
acacgtacctctcatcagt

SEQ ID NO: 3924460 - DNA, 16 bp, Homo sapiens
acacgtgctcgcagcc

SEQ ID NO: 3924461 - DNA, 14 bp, Homo sapiens
acacgtggcctgca

SEQ ID NO: 3924462 - DNA, 16 bp, Homo sapiens
acacgtggcctgcacc

SEQ ID NO: 3924463 - DNA, 14 bp, Homo sapiens
acacgtgtctataa

SEQ ID NO: 3924464 - DNA, 15 bp, Homo sapiens
acactaaacagacta

SEQ ID NO: 3924465 - DNA, 20 bp, Homo sapiens
acactaaacagactatttaa

SEQ ID NO: 3924466 - DNA, 15 bp, Homo sapiens
acactaatgaagata

SEQ ID NO: 3924467 - DNA, 17 bp, Homo sapiens
acactaattcctttcta

SEQ ID NO: 3924468 - DNA, 14 bp, Homo sapiens
acactacattagaa

SEQ ID NO: 3924469 - DNA, 23 bp, Homo sapiens
acactagttttgtgccagccgtg

SEQ ID NO: 3924470 - DNA, 19 bp, Homo sapiens
acactcaaatcaagaaact

SEQ ID NO: 3924471 - DNA, 16 bp, Homo sapiens
acactcagaagcctgg

SEQ ID NO: 3924472 - DNA, 19 bp, Homo sapiens
acactcagaagcctggggg

SEQ ID NO: 3924473 - DNA, 18 bp, Homo sapiens
acactccaccccctccag

SEQ ID NO: 3924474 - DNA, 19 bp, Homo sapiens
acactccaccccctccagc

SEQ ID NO: 3924475 - DNA, 19 bp, Homo sapiens
acactctagtgacttcctg

SEQ ID NO: 3924476 - DNA, 22 bp, Homo sapiens
acactctagtgacttcctggtg

SEQ ID NO: 3924477 - DNA, 18 bp, Homo sapiens
acactgcaagagccttgg

SEQ ID NO: 3924478 - DNA, 19 bp, Homo sapiens
acactgctgcaccagagtg

SEQ ID NO: 3924479 - DNA, 21 bp, Homo sapiens
acactggcgaaccatctcaat

SEQ ID NO: 3924480 - DNA, 14 bp, Homo sapiens
acactggtgactgc

SEQ ID NO: 3924481 - DNA, 14 bp, Homo sapiens
acactgtcagagct

SEQ ID NO: 3924482 - DNA, 22 bp, Homo sapiens
acactgtgtcccccccagtgca

SEQ ID NO: 3924483 - DNA, 14 bp, Homo sapiens
acacttccataatc

SEQ ID NO: 3924484 - DNA, 14 bp, Homo sapiens
acacttctcaggac

SEQ ID NO: 3924485 - DNA, 16 bp, Homo sapiens
acacttctcaggacac

SEQ ID NO: 3924486 - DNA, 22 bp, Homo sapiens
acacttctcaggacacaggcct

SEQ ID NO: 3924487 - DNA, 20 bp, Homo sapiens
acacttctcatcatattgta

SEQ ID NO: 3924488 - DNA, 20 bp, Homo sapiens
acacttcttgaaacagcctg

SEQ ID NO: 3924489 - DNA, 21 bp, Homo sapiens
acacttcttgaaacagcctgg

SEQ ID NO: 3924490 - DNA, 18 bp, Homo sapiens
acacttggagcccgtgca

SEQ ID NO: 3924491 - DNA, 21 bp, Homo sapiens
acagaaaacaaaagagagaat

SEQ ID NO: 3924492 - DNA, 12 bp, Homo sapiens
acagaaacaaaa

SEQ ID NO: 3924493 - DNA, 14 bp, Homo sapiens
acagaaatatatat

SEQ ID NO: 3924494 - DNA, 20 bp, Homo sapiens
acagaaatatatatacatat

SEQ ID NO: 3924495 - DNA, 13 bp, Homo sapiens
acagaaccagagg

SEQ ID NO: 3924496 - DNA, 20 bp, Homo sapiens
acagaaccagagggttgtac

SEQ ID NO: 3924497 - DNA, 21 bp, Homo sapiens
acagaagccaggagcaaatgt

SEQ ID NO: 3924498 - DNA, 16 bp, Homo sapiens
acattcaggaagatga

SEQ ID NO: 3924499 - DNA, 21 bp, Homo sapiens
acattccctatcaaaacatat

SEQ ID NO: 3924500 - DNA, 12 bp, Homo sapiens
acattcctcagc

SEQ ID NO: 3924501 - DNA, 19 bp, Homo sapiens
acattcctcagctgccaag

SEQ ID NO: 3924502 - DNA, 14 bp, Homo sapiens
acattcctggcccc

SEQ ID NO: 3924503 - DNA, 19 bp, Homo sapiens
acattcctggccccgggct

SEQ ID NO: 3924504 - DNA, 16 bp, Homo sapiens
acattggtaagaatga

SEQ ID NO: 3924505 - DNA, 15 bp, Homo sapiens
acattgttgctccct

SEQ ID NO: 3924506 - DNA, 21 bp, Homo sapiens
acattgttgctccctgtgaca

SEQ ID NO: 3924507 - DNA, 18 bp, Homo sapiens
acatttatatatatatgt

SEQ ID NO: 3924508 - DNA, 19 bp, Homo sapiens
acatttatttcaaactatt

SEQ ID NO: 3924509 - DNA, 18 bp, Homo sapiens
acatttcataaggcctgc

SEQ ID NO: 3924510 - DNA, 12 bp, Homo sapiens
acatttccctgt

SEQ ID NO: 3924511 - DNA, 17 bp, Homo sapiens
acatttctaacatatgt

SEQ ID NO: 3924512 - DNA, 18 bp, Homo sapiens
acatttctaacatatgta

SEQ ID NO: 3924513 - DNA, 17 bp, Homo sapiens
acatttgatgtacatgt

SEQ ID NO: 3924514 - DNA, 18 bp, Homo sapiens
acatttgatgtacatgtg

SEQ ID NO: 3924515 - DNA, 19 bp, Homo sapiens
acatttgatgtacatgtgt

SEQ ID NO: 3924516 - DNA, 17 bp, Homo sapiens
acattttaaaaaacaaa

SEQ ID NO: 3924517 - DNA, 10 bp, Homo sapiens
acattttatt

SEQ ID NO: 3924518 - DNA, 20 bp, Homo sapiens
acattttctcctaggagaag

SEQ ID NO: 3924519 - DNA, 19 bp, Homo sapiens
acattttgttatagaatac

SEQ ID NO: 3924520 - DNA, 14 bp, Homo sapiens
acatttttacaata

SEQ ID NO: 3924521 - DNA, 15 bp, Homo sapiens
acatttttacaataa

SEQ ID NO: 3924522 - DNA, 21 bp, Homo sapiens
accaaaatttctttttttaaa

SEQ ID NO: 3924523 - DNA, 23 bp, Homo sapiens
accaaaatttctttttttaaatt

SEQ ID NO: 3924524 - DNA, 18 bp, Homo sapiens
accaaagagactggagca

SEQ ID NO: 3924525 - DNA, 22 bp, Homo sapiens
accaaagagactggagcatctg

SEQ ID NO: 3924526 - DNA, 21 bp, Homo sapiens
accaaaggacattatgtgtgc

SEQ ID NO: 3924527 - DNA, 21 bp, Homo sapiens
accaaagggaaaactcttcat

SEQ ID NO: 3924528 - DNA, 15 bp, Homo sapiens
accaaatattttagc

SEQ ID NO: 3924529 - DNA, 21 bp, Homo sapiens
accaacatcccattgccctgg

SEQ ID NO: 3924530 - DNA, 15 bp, Homo sapiens
accaacatggagaaa

SEQ ID NO: 3924531 - DNA, 24 bp, Homo sapiens
accaacatggagaaaccctgtctc

SEQ ID NO: 3924532 - DNA, 16 bp, Homo sapiens
accaaccctgtttcct

SEQ ID NO: 3924533 - DNA, 23 bp, Homo sapiens
accaacgggaccccctggccctg

SEQ ID NO: 3924534 - DNA, 14 bp, Homo sapiens
accaactctgcact

SEQ ID NO: 3924535 - DNA, 15 bp, Homo sapiens
accaactctgcactc

SEQ ID NO: 3924536 - DNA, 12 bp, Homo sapiens
accaactttctg

SEQ ID NO: 3924537 - DNA, 15 bp, Homo sapiens
accaagagagaaaga

SEQ ID NO: 3924538 - DNA, 16 bp, Homo sapiens
accaagccgtggcttc

SEQ ID NO: 3924539 - DNA, 14 bp, Homo sapiens
accaagcttcagag

SEQ ID NO: 3924540 - DNA, 19 bp, Homo sapiens
accaagcttcagagcctag

SEQ ID NO: 3924541 - DNA, 23 bp, Homo sapiens
accaagcttcagagcctagccac

SEQ ID NO: 3924542 - DNA, 13 bp, Homo sapiens
accaaggcagcct

SEQ ID NO: 3924543 - DNA, 15 bp, Homo sapiens
accaaggcagcctcc

SEQ ID NO: 3924544 - DNA, 17 bp, Homo sapiens
accaaggcagcctccag

SEQ ID NO: 3924545 - DNA, 20 bp, Homo sapiens
accaaggcagcctccagagc

SEQ ID NO: 3924546 - DNA, 22 bp, Homo sapiens
accaaggcagcctccagagcca

SEQ ID NO: 3924547 - DNA, 15 bp, Homo sapiens
accaaggtcttcagc

SEQ ID NO: 3924548 - DNA, 12 bp, Homo sapiens
accaataaaaat

SEQ ID NO: 3924549 - DNA, 18 bp, Homo sapiens
accaatcccgtgaaagaa

SEQ ID NO: 3924550 - DNA, 22 bp, Homo sapiens
accaatcccgtgaaagaattat

SEQ ID NO: 3924551 - DNA, 15 bp, Homo sapiens
accaatcctggcagg

SEQ ID NO: 3924552 - DNA, 12 bp, Homo sapiens
accaatgattca

SEQ ID NO: 3924553 - DNA, 20 bp, Homo sapiens
accaatgcatgcagccactg

SEQ ID NO: 3924554 - DNA, 16 bp, Homo sapiens
accaatgccaagataa

SEQ ID NO: 3924555 - DNA, 22 bp, Homo sapiens
accaatgccaagataattcact

SEQ ID NO: 3924556 - DNA, 15 bp, Homo sapiens
accacaactgacaca

SEQ ID NO: 3924557 - DNA, 16 bp, Homo sapiens
accacaactgacacag

SEQ ID NO: 3924558 - DNA, 19 bp, Homo sapiens
accacaactgacacaggaa

SEQ ID NO: 3924559 - DNA, 15 bp, Homo sapiens
accacaccaaacctc

SEQ ID NO: 3924560 - DNA, 22 bp, Homo sapiens
accacacctccctgaaccatcc

SEQ ID NO: 3924561 - DNA, 16 bp, Homo sapiens
accacagcagctgaac

SEQ ID NO: 3924562 - DNA, 16 bp, Homo sapiens
accacaggcccttggg

SEQ ID NO: 3924563 - DNA, 19 bp, Homo sapiens
accacagtgggtggcacct

SEQ ID NO: 3924564 - DNA, 21 bp, Homo sapiens
accacagtgggtggcacctcc

SEQ ID NO: 3924565 - DNA, 23 bp, Homo sapiens
accacccactctcctctgcctca

SEQ ID NO: 3924566 - DNA, 17 bp, Homo sapiens
accacctaggccactcc

SEQ ID NO: 3924567 - DNA, 21 bp, Homo sapiens
accacctaggccactcctcca

SEQ ID NO: 3924568 - DNA, 15 bp, Homo sapiens
accacctcactcctg

SEQ ID NO: 3924569 - DNA, 23 bp, Homo sapiens
accacctctcaatattcaataaa

SEQ ID NO: 3924570 - DNA, 14 bp, Homo sapiens
accacctgccagcc

SEQ ID NO: 3924571 - DNA, 16 bp, Homo sapiens
accacctgccagccat

SEQ ID NO: 3924572 - DNA, 15 bp, Homo sapiens
accaccttcccagct

SEQ ID NO: 3924573 - DNA, 12 bp, Homo sapiens
accaccttccct

SEQ ID NO: 3924574 - DNA, 13 bp, Homo sapiens
accaccttccctc

SEQ ID NO: 3924575 - DNA, 18 bp, Homo sapiens
accaccttccctctttct

SEQ ID NO: 3924576 - DNA, 17 bp, Homo sapiens
accaccttggactcctc

SEQ ID NO: 3924577 - DNA, 19 bp, Homo sapiens
accaccttggactcctccc

SEQ ID NO: 3924578 - DNA, 22 bp, Homo sapiens
accaccttggactcctcccaca

SEQ ID NO: 3924579 - DNA, 18 bp, Homo sapiens
accacgatgtggccctgg

SEQ ID NO: 3924580 - DNA, 19 bp, Homo sapiens
accacgatgtggccctggc

SEQ ID NO: 3924581 - DNA, 18 bp, Homo sapiens
accacggcgtttttttac

SEQ ID NO: 3924582 - DNA, 17 bp, Homo sapiens
accacgggcctcagttt

SEQ ID NO: 3924583 - DNA, 14 bp, Homo sapiens
accacgtctgccag

SEQ ID NO: 3924584 - DNA, 17 bp, Homo sapiens
accgctggggaacagag

SEQ ID NO: 3924585 - DNA, 20 bp, Homo sapiens
accgcttcacccctgcactt

SEQ ID NO: 3924586 - DNA, 11 bp, Homo sapiens
accggcacctg

SEQ ID NO: 3924587 - DNA, 12 bp, Homo sapiens
accgggccactc

SEQ ID NO: 3924588 - DNA, 19 bp, Homo sapiens
accgggccactccttcctg

SEQ ID NO: 3924589 - DNA, 21 bp, Homo sapiens
accgggccactccttcctgcc

SEQ ID NO: 3924590 - DNA, 23 bp, Homo sapiens
accgggctgggagctctgcagag

SEQ ID NO: 3924591 - DNA, 13 bp, Homo sapiens
accgggctggggt

SEQ ID NO: 3924592 - DNA, 23 bp, Homo sapiens
accgggtgggcctggcctgagct

SEQ ID NO: 3924593 - DNA, 13 bp, Homo sapiens
accgtaattttat

SEQ ID NO: 3924594 - DNA, 13 bp, Homo sapiens
accgtagcctccg

SEQ ID NO: 3924595 - DNA, 13 bp, Homo sapiens
accgtcctgccca

SEQ ID NO: 3924596 - DNA, 16 bp, Homo sapiens
accgtctgtttttaaa

SEQ ID NO: 3924597 - DNA, 15 bp, Homo sapiens
accgtggccctgccc

SEQ ID NO: 3924598 - DNA, 20 bp, Homo sapiens
accgtggccctgccctctcc

SEQ ID NO: 3924599 - DNA, 17 bp, Homo sapiens
accgtggcccttcctgg

SEQ ID NO: 3924600 - DNA, 21 bp, Homo sapiens
accgtgtcccaaggagctgat

SEQ ID NO: 3924601 - DNA, 18 bp, Homo sapiens
accgttttcatcctggcc

SEQ ID NO: 3924602 - DNA, 19 bp, Homo sapiens
accgttttcatcctggcct

SEQ ID NO: 3924603 - DNA, 20 bp, Homo sapiens
accgttttcatcctggcctc

SEQ ID NO: 3924604 - DNA, 17 bp, Homo sapiens
acctaatcaggctgagg

SEQ ID NO: 3924605 - DNA, 14 bp, Homo sapiens
acctaccaaaaaat

SEQ ID NO: 3924606 - DNA, 19 bp, Homo sapiens
acctaccaccccttcctgt

SEQ ID NO: 3924607 - DNA, 14 bp, Homo sapiens
acctaccatgctgc

SEQ ID NO: 3924608 - DNA, 15 bp, Homo sapiens
acctaccatgctgct

SEQ ID NO: 3924609 - DNA, 17 bp, Homo sapiens
acctactactcaattgt

SEQ ID NO: 3924610 - DNA, 14 bp, Homo sapiens
acctactcacacag

SEQ ID NO: 3924611 - DNA, 14 bp, Homo sapiens
acctagacctgggc

SEQ ID NO: 3924612 - DNA, 18 bp, Homo sapiens
acctagcaattccatcac

SEQ ID NO: 3924613 - DNA, 20 bp, Homo sapiens
acctagtactctctgctcta

SEQ ID NO: 3924614 - DNA, 23 bp, Homo sapiens
acctagtactctctgctctagcc

SEQ ID NO: 3924615 - DNA, 18 bp, Homo sapiens
acctcaatgccctgccat

SEQ ID NO: 3924616 - DNA, 14 bp, Homo sapiens
acctcacagtgacc

SEQ ID NO: 3924617 - DNA, 14 bp, Homo sapiens
acctcacgctctgg

SEQ ID NO: 3924618 - DNA, 21 bp, Homo sapiens
acctcagacaatccactctca

SEQ ID NO: 3924619 - DNA, 22 bp, Homo sapiens
acctcagacaatccactctcag

SEQ ID NO: 3924620 - DNA, 14 bp, Homo sapiens
acctcagccatgag

SEQ ID NO: 3924621 - DNA, 23 bp, Homo sapiens
acctcagccatgaggagttgctg

SEQ ID NO: 3924622 - DNA, 18 bp, Homo sapiens
acctcagcctcccagagt

SEQ ID NO: 3924623 - DNA, 12 bp, Homo sapiens
acctcagctgca

SEQ ID NO: 3924624 - DNA, 16 bp, Homo sapiens
acctcagctgcacatt

SEQ ID NO: 3924625 - DNA, 19 bp, Homo sapiens
acctcagctgcacattcct

SEQ ID NO: 3924626 - DNA, 13 bp, Homo sapiens
acctcagtttcct

SEQ ID NO: 3924627 - DNA, 18 bp, Homo sapiens
acctcatgcctggccccc

SEQ ID NO: 3924628 - DNA, 19 bp, Homo sapiens
acctcatggtcatggacag

SEQ ID NO: 3924629 - DNA, 15 bp, Homo sapiens
acctcattcgcctgt

SEQ ID NO: 3924630 - DNA, 12 bp, Homo sapiens
acctccacccac

SEQ ID NO: 3924631 - DNA, 17 bp, Homo sapiens
acctccacccccgccac

SEQ ID NO: 3924632 - DNA, 17 bp, Homo sapiens
acctccacctcctgagt

SEQ ID NO: 3924633 - DNA, 18 bp, Homo sapiens
acctccagctttcctgta

SEQ ID NO: 3924634 - DNA, 14 bp, Homo sapiens
acctcccaccccac

SEQ ID NO: 3924635 - DNA, 17 bp, Homo sapiens
acctcccaccccactcc

SEQ ID NO: 3924636 - DNA, 18 bp, Homo sapiens
acctcccaccccactcca

SEQ ID NO: 3924637 - DNA, 19 bp, Homo sapiens
acctcccaccccactccag

SEQ ID NO: 3924638 - DNA, 14 bp, Homo sapiens
acctcccagcccta

SEQ ID NO: 3924639 - DNA, 22 bp, Homo sapiens
acctcccagccctatggatgtg

SEQ ID NO: 3924640 - DNA, 22 bp, Homo sapiens
acctccccacccccgctggggg

SEQ ID NO: 3924641 - DNA, 13 bp, Homo sapiens
acctccccctctt

SEQ ID NO: 3924642 - DNA, 19 bp, Homo sapiens
acctcccctatccacccag

SEQ ID NO: 3924643 - DNA, 20 bp, Homo sapiens
acctcccctatccacccagc

SEQ ID NO: 3924644 - DNA, 21 bp, Homo sapiens
acctcccctatccacccagcc

SEQ ID NO: 3924645 - DNA, 23 bp, Homo sapiens
acctcccctatccacccagccca

SEQ ID NO: 3924646 - DNA, 14 bp, Homo sapiens
acctccctgaacca

SEQ ID NO: 3924647 - DNA, 23 bp, Homo sapiens
acctcctacgtcaaacatgaagt

SEQ ID NO: 3924648 - DNA, 21 bp, Homo sapiens
acctcctagcaagacctgttg

SEQ ID NO: 3924649 - DNA, 12 bp, Homo sapiens
acctcctccact

SEQ ID NO: 3924650 - DNA, 19 bp, Homo sapiens
acctcctccactcactcca

SEQ ID NO: 3924651 - DNA, 19 bp, Homo sapiens
acctcctgagaaggcgagg

SEQ ID NO: 3924652 - DNA, 13 bp, Homo sapiens
acctcctgcccag

SEQ ID NO: 3924653 - DNA, 14 bp, Homo sapiens
acctcctgcccagg

SEQ ID NO: 3924654 - DNA, 21 bp, Homo sapiens
acctcctgcccaggagagcca

SEQ ID NO: 3924655 - DNA, 14 bp, Homo sapiens
acctcgaggctctt

SEQ ID NO: 3924656 - DNA, 15 bp, Homo sapiens
acctcgtcctccccc

SEQ ID NO: 3924657 - DNA, 14 bp, Homo sapiens
acctctccttggaa

SEQ ID NO: 3924658 - DNA, 19 bp, Homo sapiens
acctctctaagccacagct

SEQ ID NO: 3924659 - DNA, 14 bp, Homo sapiens
acctctcttcagcc

SEQ ID NO: 3924660 - DNA, 12 bp, Homo sapiens
acctctgctctg

SEQ ID NO: 3924661 - DNA, 11 bp, Homo sapiens
acctctgggct

SEQ ID NO: 3924662 - DNA, 15 bp, Homo sapiens
acctcttcacccccc

SEQ ID NO: 3924663 - DNA, 17 bp, Homo sapiens
acctcttctcttcctgt

SEQ ID NO: 3924664 - DNA, 15 bp, Homo sapiens
acctgaaaaaaagtt

SEQ ID NO: 3924665 - DNA, 17 bp, Homo sapiens
acctgacaatggcagct

SEQ ID NO: 3924666 - DNA, 19 bp, Homo sapiens
acctgacaatggcagctag

SEQ ID NO: 3924667 - DNA, 12 bp, Homo sapiens
acctgacacaag

SEQ ID NO: 3924668 - DNA, 19 bp, Homo sapiens
acctgacaccgtccctcag

SEQ ID NO: 3924669 - DNA, 22 bp, Homo sapiens
acctgacagatgtcagccgagc

SEQ ID NO: 3924670 - DNA, 15 bp, Homo sapiens
acctgaccggcacct

SEQ ID NO: 3924671 - DNA, 17 bp, Homo sapiens
actctccaacctggaca

SEQ ID NO: 3924672 - DNA, 19 bp, Homo sapiens
actctccccctttcaagga

SEQ ID NO: 3924673 - DNA, 13 bp, Homo sapiens
actctcccctccc

SEQ ID NO: 3924674 - DNA, 14 bp, Homo sapiens
actctcccctccct

SEQ ID NO: 3924675 - DNA, 22 bp, Homo sapiens
actctcccctccctcttccttc

SEQ ID NO: 3924676 - DNA, 19 bp, Homo sapiens
actctcctcggccccctcc

SEQ ID NO: 3924677 - DNA, 22 bp, Homo sapiens
actctccttcgtgtctctccca

SEQ ID NO: 3924678 - DNA, 13 bp, Homo sapiens
actctcggggccc

SEQ ID NO: 3924679 - DNA, 12 bp, Homo sapiens
actctctgctct

SEQ ID NO: 3924680 - DNA, 16 bp, Homo sapiens
actctctgctctagcc

SEQ ID NO: 3924681 - DNA, 17 bp, Homo sapiens
actctctgctctagcca

SEQ ID NO: 3924682 - DNA, 18 bp, Homo sapiens
actctctgctctagccag

SEQ ID NO: 3924683 - DNA, 20 bp, Homo sapiens
actctctgctctagccagga

SEQ ID NO: 3924684 - DNA, 21 bp, Homo sapiens
actctctgtacaaaaacaaaa

SEQ ID NO: 3924685 - DNA, 14 bp, Homo sapiens
actctgacaagggc

SEQ ID NO: 3924686 - DNA, 18 bp, Homo sapiens
actctgacaagggctgac

SEQ ID NO: 3924687 - DNA, 12 bp, Homo sapiens
actctgactctt

SEQ ID NO: 3924688 - DNA, 11 bp, Homo sapiens
actctgagccc

SEQ ID NO: 3924689 - DNA, 12 bp, Homo sapiens
actctgagccca

SEQ ID NO: 3924690 - DNA, 11 bp, Homo sapiens
actctgcactc

SEQ ID NO: 3924691 - DNA, 13 bp, Homo sapiens
actctgcactcca

SEQ ID NO: 3924692 - DNA, 23 bp, Homo sapiens
actctgcactccatggccacccc

SEQ ID NO: 3924693 - DNA, 12 bp, Homo sapiens
actctgcctcct

SEQ ID NO: 3924694 - DNA, 12 bp, Homo sapiens
actctgctctga

SEQ ID NO: 3924695 - DNA, 14 bp, Homo sapiens
actctgctctgatg

SEQ ID NO: 3924696 - DNA, 14 bp, Homo sapiens
actctggcacccag

SEQ ID NO: 3924697 - DNA, 13 bp, Homo sapiens
actctggcagcca

SEQ ID NO: 3924698 - DNA, 15 bp, Homo sapiens
actctggcagccaca

SEQ ID NO: 3924699 - DNA, 17 bp, Homo sapiens
actctggcttccaggta

SEQ ID NO: 3924700 - DNA, 21 bp, Homo sapiens
actctggtggtgcttttgtat

SEQ ID NO: 3924701 - DNA, 14 bp, Homo sapiens
actctgtcagatgg

SEQ ID NO: 3924702 - DNA, 21 bp, Homo sapiens
actctgtcagccagccgccct

SEQ ID NO: 3924703 - DNA, 15 bp, Homo sapiens
actctgtccaggcca

SEQ ID NO: 3924704 - DNA, 16 bp, Homo sapiens
actctgtccaggccac

SEQ ID NO: 3924705 - DNA, 11 bp, Homo sapiens
actctgtgcca

SEQ ID NO: 3924706 - DNA, 14 bp, Homo sapiens
actctgtgccagag

SEQ ID NO: 3924707 - DNA, 15 bp, Homo sapiens
actcttccatttatt

SEQ ID NO: 3924708 - DNA, 16 bp, Homo sapiens
actcttcctgcaagga

SEQ ID NO: 3924709 - DNA, 20 bp, Homo sapiens
actctttatttctagcagag

SEQ ID NO: 3924710 - DNA, 23 bp, Homo sapiens
actctttgacgggaggcctcagt

SEQ ID NO: 3924711 - DNA, 14 bp, Homo sapiens
actctttttagggc

SEQ ID NO: 3924712 - DNA, 20 bp, Homo sapiens
actctttttagggccaggca

SEQ ID NO: 3924713 - DNA, 14 bp, Homo sapiens
actgaaaaatgtca

SEQ ID NO: 3924714 - DNA, 18 bp, Homo sapiens
actgaaaaatgtcagtct

SEQ ID NO: 3924715 - DNA, 22 bp, Homo sapiens
actgaaaacatttcaaagctga

SEQ ID NO: 3924716 - DNA, 19 bp, Homo sapiens
actgaaaagactcagtgtt

SEQ ID NO: 3924717 - DNA, 16 bp, Homo sapiens
actgaaaatctaatat

SEQ ID NO: 3924718 - DNA, 14 bp, Homo sapiens
actgaaagcagcag

SEQ ID NO: 3924719 - DNA, 16 bp, Homo sapiens
actgaaagcagcagct

SEQ ID NO: 3924720 - DNA, 12 bp, Homo sapiens
actgaagagaca

SEQ ID NO: 3924721 - DNA, 20 bp, Homo sapiens
actgaagagaccacagcaat

SEQ ID NO: 3924722 - DNA, 21 bp, Homo sapiens
actgaaggagaaggtgcccca

SEQ ID NO: 3924723 - DNA, 17 bp, Homo sapiens
actgaagttaacagaga

SEQ ID NO: 3924724 - DNA, 14 bp, Homo sapiens
actgaatcatgtta

SEQ ID NO: 3924725 - DNA, 16 bp, Homo sapiens
actgaatttgggcctc

SEQ ID NO: 3924726 - DNA, 14 bp, Homo sapiens
actgacaagatgga

SEQ ID NO: 3924727 - DNA, 16 bp, Homo sapiens
actgacaagatggaaa

SEQ ID NO: 3924728 - DNA, 22 bp, Homo sapiens
actgacaagatggaaaataaat

SEQ ID NO: 3924729 - DNA, 13 bp, Homo sapiens
actgacacaggaa

SEQ ID NO: 3924730 - DNA, 20 bp, Homo sapiens
actgacacaggaaaccaaca

SEQ ID NO: 3924731 - DNA, 14 bp, Homo sapiens
actgaccccctccc

SEQ ID NO: 3924732 - DNA, 17 bp, Homo sapiens
actgaccccctcccctg

SEQ ID NO: 3924733 - DNA, 12 bp, Homo sapiens
actgacccttcc

SEQ ID NO: 3924734 - DNA, 17 bp, Homo sapiens
actgacccttccagaca

SEQ ID NO: 3924735 - DNA, 20 bp, Homo sapiens
actgaccttggagagacaca

SEQ ID NO: 3924736 - DNA, 21 bp, Homo sapiens
actgaccttggagagacacag

SEQ ID NO: 3924737 - DNA, 16 bp, Homo sapiens
actgacttctaagtaa

SEQ ID NO: 3924738 - DNA, 17 bp, Homo sapiens
actgagacggcagagac

SEQ ID NO: 3924739 - DNA, 21 bp, Homo sapiens
actgagccaaacacactgtaa

SEQ ID NO: 3924740 - DNA, 23 bp, Homo sapiens
actgagccaaacacactgtaaat

SEQ ID NO: 3924741 - DNA, 19 bp, Homo sapiens
actgaggagtagctgagag

SEQ ID NO: 3924742 - DNA, 14 bp, Homo sapiens
actgaggatgtgag

SEQ ID NO: 3924743 - DNA, 16 bp, Homo sapiens
actgaggccttctcaa

SEQ ID NO: 3924744 - DNA, 17 bp, Homo sapiens
actgatagtgtccaaat

SEQ ID NO: 3924745 - DNA, 16 bp, Homo sapiens
actgatcaaaaataaa

SEQ ID NO: 3924746 - DNA, 19 bp, Homo sapiens
actgatcaaaaataaacta

SEQ ID NO: 3924747 - DNA, 20 bp, Homo sapiens
actgatgcgaaaacttgaat

SEQ ID NO: 3924748 - DNA, 22 bp, Homo sapiens
actgatgttacatcacagtgtt

SEQ ID NO: 3924749 - DNA, 13 bp, Homo sapiens
actgatttcacaa

SEQ ID NO: 3924750 - DNA, 17 bp, Homo sapiens
actgatttcacaacaga

SEQ ID NO: 3924751 - DNA, 20 bp, Homo sapiens
actgatttcacaacagatca

SEQ ID NO: 3924752 - DNA, 13 bp, Homo sapiens
actgatttctcac

SEQ ID NO: 3924753 - DNA, 15 bp, Homo sapiens
actgcaaaggcgcag

SEQ ID NO: 3924754 - DNA, 16 bp, Homo sapiens
actgcacacacagctc

SEQ ID NO: 3924755 - DNA, 17 bp, Homo sapiens
actgcacacacagctcc

SEQ ID NO: 3924756 - DNA, 18 bp, Homo sapiens
actgcacacacagctcct

SEQ ID NO: 3924757 - DNA, 16 bp, Homo sapiens
actgcacagtgcatct

SEQ ID NO: 3924758 - DNA, 21 bp, Homo sapiens
agaagctgaggatcctcacag

SEQ ID NO: 3924759 - DNA, 13 bp, Homo sapiens
agaagctggagga

SEQ ID NO: 3924760 - DNA, 22 bp, Homo sapiens
agaaggaaggagactcacctct

SEQ ID NO: 3924761 - DNA, 17 bp, Homo sapiens
agaaggaaggaggcaga

SEQ ID NO: 3924762 - DNA, 17 bp, Homo sapiens
agaaggaaggcagggag

SEQ ID NO: 3924763 - DNA, 19 bp, Homo sapiens
agaaggaaggcagggagga

SEQ ID NO: 3924764 - DNA, 20 bp, Homo sapiens
agaaggaaggcagggaggag

SEQ ID NO: 3924765 - DNA, 22 bp, Homo sapiens
agaaggaattctaggcatccca

SEQ ID NO: 3924766 - DNA, 15 bp, Homo sapiens
agaaggagggcagag

SEQ ID NO: 3924767 - DNA, 20 bp, Homo sapiens
agaaggagttctgacattca

SEQ ID NO: 3924768 - DNA, 19 bp, Homo sapiens
agaaggcacaggtgtaaat

SEQ ID NO: 3924769 - DNA, 20 bp, Homo sapiens
agaaggcccataccttctgg

SEQ ID NO: 3924770 - DNA, 17 bp, Homo sapiens
agaaggcgaggagagtg

SEQ ID NO: 3924771 - DNA, 17 bp, Homo sapiens
agaaggctggggccagt

SEQ ID NO: 3924772 - DNA, 13 bp, Homo sapiens
agaagggagaagg

SEQ ID NO: 3924773 - DNA, 20 bp, Homo sapiens
agaagggagttgctcactca

SEQ ID NO: 3924774 - DNA, 16 bp, Homo sapiens
agaagggataatagac

SEQ ID NO: 3924775 - DNA, 13 bp, Homo sapiens
agaagggctagaa

SEQ ID NO: 3924776 - DNA, 23 bp, Homo sapiens
agaagggctagaacctggagagc

SEQ ID NO: 3924777 - DNA, 21 bp, Homo sapiens
agaagggctagaacctggagg

SEQ ID NO: 3924778 - DNA, 23 bp, Homo sapiens
agaagggggattggagggaagac

SEQ ID NO: 3924779 - DNA, 21 bp, Homo sapiens
agaaggtattccttttgtgta

SEQ ID NO: 3924780 - DNA, 13 bp, Homo sapiens
agaagtaaaagct

SEQ ID NO: 3924781 - DNA, 16 bp, Homo sapiens
agaagtaaaagctaat

SEQ ID NO: 3924782 - DNA, 21 bp, Homo sapiens
agaagtactgcccttttgtgt

SEQ ID NO: 3924783 - DNA, 18 bp, Homo sapiens
agaagtaggggaagacat

SEQ ID NO: 3924784 - DNA, 19 bp, Homo sapiens
agaagtaggggaagacatg

SEQ ID NO: 3924785 - DNA, 22 bp, Homo sapiens
agaagtcagcccgaatgcctgt

SEQ ID NO: 3924786 - DNA, 23 bp, Homo sapiens
agaagtcagcccgaatgcctgtc

SEQ ID NO: 3924787 - DNA, 13 bp, Homo sapiens
agaagtccctccc

SEQ ID NO: 3924788 - DNA, 18 bp, Homo sapiens
agaagtgaataactgcaa

SEQ ID NO: 3924789 - DNA, 18 bp, Homo sapiens
agaagtggaccaggacag

SEQ ID NO: 3924790 - DNA, 23 bp, Homo sapiens
agaagtggaccaggacaggacca

SEQ ID NO: 3924791 - DNA, 18 bp, Homo sapiens
agaagtgggccaggacag

SEQ ID NO: 3924792 - DNA, 16 bp, Homo sapiens
agaagtttctggccct

SEQ ID NO: 3924793 - DNA, 20 bp, Homo sapiens
agaagtttgatattaaagga

SEQ ID NO: 3924794 - DNA, 12 bp, Homo sapiens
agaataaaattg

SEQ ID NO: 3924795 - DNA, 14 bp, Homo sapiens
agaataaaattgta

SEQ ID NO: 3924796 - DNA, 16 bp, Homo sapiens
agaataagagaaagaa

SEQ ID NO: 3924797 - DNA, 17 bp, Homo sapiens
agaataataataaaaag

SEQ ID NO: 3924798 - DNA, 14 bp, Homo sapiens
agaatacagaaaat

SEQ ID NO: 3924799 - DNA, 21 bp, Homo sapiens
agaatacagaaagatggatgt

SEQ ID NO: 3924800 - DNA, 12 bp, Homo sapiens
agaatacttttt

SEQ ID NO: 3924801 - DNA, 23 bp, Homo sapiens
agaatagatctgatggtgagctg

SEQ ID NO: 3924802 - DNA, 14 bp, Homo sapiens
agaatagtgtctga

SEQ ID NO: 3924803 - DNA, 14 bp, Homo sapiens
agaatattcaaatg

SEQ ID NO: 3924804 - DNA, 15 bp, Homo sapiens
agaatattcaggact

SEQ ID NO: 3924805 - DNA, 19 bp, Homo sapiens
agaatatttcaaatgaaca

SEQ ID NO: 3924806 - DNA, 16 bp, Homo sapiens
agaatcacacaagttt

SEQ ID NO: 3924807 - DNA, 21 bp, Homo sapiens
agaatcagggcaggcttgcca

SEQ ID NO: 3924808 - DNA, 15 bp, Homo sapiens
agaatcataattttc

SEQ ID NO: 3924809 - DNA, 18 bp, Homo sapiens
agaatcataattttcaag

SEQ ID NO: 3924810 - DNA, 22 bp, Homo sapiens
agaatccacccatcctaccaat

SEQ ID NO: 3924811 - DNA, 18 bp, Homo sapiens
agaatcccactttctata

SEQ ID NO: 3924812 - DNA, 13 bp, Homo sapiens
agaatcctgcctc

SEQ ID NO: 3924813 - DNA, 19 bp, Homo sapiens
agaatctggctcctgtttc

SEQ ID NO: 3924814 - DNA, 16 bp, Homo sapiens
agaatgaaaactcatt

SEQ ID NO: 3924815 - DNA, 14 bp, Homo sapiens
agaatgagagtgtg

SEQ ID NO: 3924816 - DNA, 12 bp, Homo sapiens
agaatgagcctc

SEQ ID NO: 3924817 - DNA, 22 bp, Homo sapiens
agaatgagggaaattgctattt

SEQ ID NO: 3924818 - DNA, 23 bp, Homo sapiens
agaatgatatccagtaagcacat

SEQ ID NO: 3924819 - DNA, 14 bp, Homo sapiens
agaatgatttcatg

SEQ ID NO: 3924820 - DNA, 18 bp, Homo sapiens
agaatgcccaactcttca

SEQ ID NO: 3924821 - DNA, 15 bp, Homo sapiens
agaatggtagcacta

SEQ ID NO: 3924822 - DNA, 23 bp, Homo sapiens
agaatggtgtgggagagggatga

SEQ ID NO: 3924823 - DNA, 23 bp, Homo sapiens
agaatggttgccttaaagaaagt

SEQ ID NO: 3924824 - DNA, 17 bp, Homo sapiens
agaatgtatctcctcct

SEQ ID NO: 3924825 - DNA, 18 bp, Homo sapiens
agaatgtcaccagtcctg

SEQ ID NO: 3924826 - DNA, 18 bp, Homo sapiens
agaatgtgttttctgaat

SEQ ID NO: 3924827 - DNA, 17 bp, Homo sapiens
agaattaaaaatgaaat

SEQ ID NO: 3924828 - DNA, 13 bp, Homo sapiens
agaattatatagg

SEQ ID NO: 3924829 - DNA, 14 bp, Homo sapiens
agaattatatctaa

SEQ ID NO: 3924830 - DNA, 18 bp, Homo sapiens
agaattatatctaattta

SEQ ID NO: 3924831 - DNA, 24 bp, Homo sapiens
agaattatatctaatttatacaaa

SEQ ID NO: 3924832 - DNA, 13 bp, Homo sapiens
agaattccaagga

SEQ ID NO: 3924833 - DNA, 18 bp, Homo sapiens
agaattcctgaagccaga

SEQ ID NO: 3924834 - DNA, 17 bp, Homo sapiens
agaattgaacccaggag

SEQ ID NO: 3924835 - DNA, 19 bp, Homo sapiens
agaattgaacccaggaggt

SEQ ID NO: 3924836 - DNA, 22 bp, Homo sapiens
agaattgaacccaggaggtgga

SEQ ID NO: 3924837 - DNA, 12 bp, Homo sapiens
agaattgcctct

SEQ ID NO: 3924838 - DNA, 21 bp, Homo sapiens
agaattgtgcgacttcacaaa

SEQ ID NO: 3924839 - DNA, 22 bp, Homo sapiens
agaattgtgcgacttcacaaaa

SEQ ID NO: 3924840 - DNA, 20 bp, Homo sapiens
agaatttctaccatttcaga

SEQ ID NO: 3924841 - DNA, 21 bp, Homo sapiens
agaatttctaccatttcagag

SEQ ID NO: 3924842 - DNA, 16 bp, Homo sapiens
agaatttgtattttgc

SEQ ID NO: 3924843 - DNA, 18 bp, Homo sapiens
agaatttgtattttgctt

SEQ ID NO: 3924844 - DNA, 21 bp, Homo sapiens
agagctgagagtctgaaagac

SEQ ID NO: 3924845 - DNA, 23 bp, Homo sapiens
agagctgagagtctgaaagacag

SEQ ID NO: 3924846 - DNA, 19 bp, Homo sapiens
agagctgatggagaaggaa

SEQ ID NO: 3924847 - DNA, 14 bp, Homo sapiens
agagctgctctgga

SEQ ID NO: 3924848 - DNA, 16 bp, Homo sapiens
agagctgctctggaaa

SEQ ID NO: 3924849 - DNA, 23 bp, Homo sapiens
agagctgctctggaaaatgtgac

SEQ ID NO: 3924850 - DNA, 17 bp, Homo sapiens
agagctggaaggcaggg

SEQ ID NO: 3924851 - DNA, 19 bp, Homo sapiens
agagctggaaggcagggca

SEQ ID NO: 3924852 - DNA, 15 bp, Homo sapiens
agagctggcaaaggt

SEQ ID NO: 3924853 - DNA, 18 bp, Homo sapiens
agagctggcaaaggtggc

SEQ ID NO: 3924854 - DNA, 17 bp, Homo sapiens
agagctggctgtcttcc

SEQ ID NO: 3924855 - DNA, 12 bp, Homo sapiens
agagctgggagg

SEQ ID NO: 3924856 - DNA, 23 bp, Homo sapiens
agagctgggaggcatggccctgg

SEQ ID NO: 3924857 - DNA, 18 bp, Homo sapiens
agagctgttcacagccag

SEQ ID NO: 3924858 - DNA, 21 bp, Homo sapiens
agagctgttcacagccagact

SEQ ID NO: 3924859 - DNA, 16 bp, Homo sapiens
agagctgttggcctcg

SEQ ID NO: 3924860 - DNA, 20 bp, Homo sapiens
agagctgttggcctcgcctg

SEQ ID NO: 3924861 - DNA, 22 bp, Homo sapiens
agagctgttggcctcgcctggg

SEQ ID NO: 3924862 - DNA, 17 bp, Homo sapiens
agagcttattggccact

SEQ ID NO: 3924863 - DNA, 13 bp, Homo sapiens
agagcttcccagg

SEQ ID NO: 3924864 - DNA, 18 bp, Homo sapiens
agagcttggacagtctga

SEQ ID NO: 3924865 - DNA, 16 bp, Homo sapiens
agagcttggtggctga

SEQ ID NO: 3924866 - DNA, 17 bp, Homo sapiens
agaggaagatgaagaga

SEQ ID NO: 3924867 - DNA, 24 bp, Homo sapiens
agaggaatcagacttcacactgca

SEQ ID NO: 3924868 - DNA, 14 bp, Homo sapiens
agaggacgggaggc

SEQ ID NO: 3924869 - DNA, 14 bp, Homo sapiens
agaggagaggaaaa

SEQ ID NO: 3924870 - DNA, 13 bp, Homo sapiens
agaggagcacctg

SEQ ID NO: 3924871 - DNA, 16 bp, Homo sapiens
agaggagttgccaggg

SEQ ID NO: 3924872 - DNA, 17 bp, Homo sapiens
agaggcagaagaaccct

SEQ ID NO: 3924873 - DNA, 13 bp, Homo sapiens
agaggcagagaaa

SEQ ID NO: 3924874 - DNA, 14 bp, Homo sapiens
agaggcagagaaag

SEQ ID NO: 3924875 - DNA, 17 bp, Homo sapiens
agaggcaggagtggcag

SEQ ID NO: 3924876 - DNA, 24 bp, Homo sapiens
agaggcatgaacacacatggatgc

SEQ ID NO: 3924877 - DNA, 18 bp, Homo sapiens
agaggcatgtgatgtgca

SEQ ID NO: 3924878 - DNA, 15 bp, Homo sapiens
agaggcccagggagc

SEQ ID NO: 3924879 - DNA, 22 bp, Homo sapiens
agaggccctggatcagcgtggc

SEQ ID NO: 3924880 - DNA, 16 bp, Homo sapiens
agaggcgcgtctgccc

SEQ ID NO: 3924881 - DNA, 18 bp, Homo sapiens
agaggcgcgtctgcccca

SEQ ID NO: 3924882 - DNA, 17 bp, Homo sapiens
agaggcggaaaccttgc

SEQ ID NO: 3924883 - DNA, 19 bp, Homo sapiens
agaggcggaaaccttgcag

SEQ ID NO: 3924884 - DNA, 15 bp, Homo sapiens
agaggctggcaagga

SEQ ID NO: 3924885 - DNA, 14 bp, Homo sapiens
agaggcttcttcag

SEQ ID NO: 3924886 - DNA, 18 bp, Homo sapiens
agagggaatgttccctgc

SEQ ID NO: 3924887 - DNA, 18 bp, Homo sapiens
agagggatgtaactattg

SEQ ID NO: 3924888 - DNA, 21 bp, Homo sapiens
agagggcagcccccactttcc

SEQ ID NO: 3924889 - DNA, 15 bp, Homo sapiens
agagggcagtacctg

SEQ ID NO: 3924890 - DNA, 16 bp, Homo sapiens
agagggcagtacctgg

SEQ ID NO: 3924891 - DNA, 17 bp, Homo sapiens
agagggcagtacctggg

SEQ ID NO: 3924892 - DNA, 20 bp, Homo sapiens
agagggcagtacctgggaaa

SEQ ID NO: 3924893 - DNA, 17 bp, Homo sapiens
agagggccaagagagac

SEQ ID NO: 3924894 - DNA, 19 bp, Homo sapiens
agagggccatgcaattcat

SEQ ID NO: 3924895 - DNA, 20 bp, Homo sapiens
agagggcccagctgtagcca

SEQ ID NO: 3924896 - DNA, 15 bp, Homo sapiens
agagggcctgtggga

SEQ ID NO: 3924897 - DNA, 14 bp, Homo sapiens
agagggctagggag

SEQ ID NO: 3924898 - DNA, 22 bp, Homo sapiens
agagggctgttggacagctgct

SEQ ID NO: 3924899 - DNA, 19 bp, Homo sapiens
agaggggcctgggaaagga

SEQ ID NO: 3924900 - DNA, 22 bp, Homo sapiens
agaggggctaggggctggtcct

SEQ ID NO: 3924901 - DNA, 13 bp, Homo sapiens
agagggggctctc

SEQ ID NO: 3924902 - DNA, 20 bp, Homo sapiens
agaggggtacatttccctgt

SEQ ID NO: 3924903 - DNA, 16 bp, Homo sapiens
agaggtaaaagtgtga

SEQ ID NO: 3924904 - DNA, 23 bp, Homo sapiens
agaggtaaaagtgtgagcagtga

SEQ ID NO: 3924905 - DNA, 17 bp, Homo sapiens
agaggtagcgagctgct

SEQ ID NO: 3924906 - DNA, 20 bp, Homo sapiens
agaggtagcgagctgctctg

SEQ ID NO: 3924907 - DNA, 12 bp, Homo sapiens
agaggtccctgc

SEQ ID NO: 3924908 - DNA, 22 bp, Homo sapiens
agaggtccctgcttacctgacg

SEQ ID NO: 3924909 - DNA, 12 bp, Homo sapiens
agaggtctgagc

SEQ ID NO: 3924910 - DNA, 13 bp, Homo sapiens
agaggtctgagcc

SEQ ID NO: 3924911 - DNA, 15 bp, Homo sapiens
agaggtgaccccagg

SEQ ID NO: 3924912 - DNA, 16 bp, Homo sapiens
agaggtgaccccaggg

SEQ ID NO: 3924913 - DNA, 17 bp, Homo sapiens
agaggtgaccccagggc

SEQ ID NO: 3924914 - DNA, 24 bp, Homo sapiens
agaggtgaccccagggcacaggag

SEQ ID NO: 3924915 - DNA, 13 bp, Homo sapiens
agaggtgggcagc

SEQ ID NO: 3924916 - DNA, 14 bp, Homo sapiens
agaggtgggcagct

SEQ ID NO: 3924917 - DNA, 18 bp, Homo sapiens
agaggttatctgcctggc

SEQ ID NO: 3924918 - DNA, 21 bp, Homo sapiens
agaggttcctggggtggattc

SEQ ID NO: 3924919 - DNA, 23 bp, Homo sapiens
agaggttttaggaaacctggcat

SEQ ID NO: 3924920 - DNA, 15 bp, Homo sapiens
agagtaaaaactgaa

SEQ ID NO: 3924921 - DNA, 14 bp, Homo sapiens
agagtaccatgctg

SEQ ID NO: 3924922 - DNA, 21 bp, Homo sapiens
agagtagatggtgaaatttat

SEQ ID NO: 3924923 - DNA, 22 bp, Homo sapiens
agagtatggttgattcccagca

SEQ ID NO: 3924924 - DNA, 13 bp, Homo sapiens
agagtcagaggag

SEQ ID NO: 3924925 - DNA, 16 bp, Homo sapiens
agagtcagaggagaag

SEQ ID NO: 3924926 - DNA, 14 bp, Homo sapiens
agagtcctctggat

SEQ ID NO: 3924927 - DNA, 17 bp, Homo sapiens
agagtctgaaagacaga

SEQ ID NO: 3924928 - DNA, 12 bp, Homo sapiens
agagtctgagcc

SEQ ID NO: 3924929 - DNA, 16 bp, Homo sapiens
agagtgaaagggctat

SEQ ID NO: 3924930 - DNA, 17 bp, Homo sapiens
agagtgaaagggctatg

SEQ ID NO: 3924931 - DNA, 16 bp, Homo sapiens
agccagccggggcgag

SEQ ID NO: 3924932 - DNA, 17 bp, Homo sapiens
agccagccggtgcctgg

SEQ ID NO: 3924933 - DNA, 16 bp, Homo sapiens
agccagcctgggactc

SEQ ID NO: 3924934 - DNA, 13 bp, Homo sapiens
agccagctctctc

SEQ ID NO: 3924935 - DNA, 15 bp, Homo sapiens
agccagctctctcta

SEQ ID NO: 3924936 - DNA, 16 bp, Homo sapiens
agccagctctgcatta

SEQ ID NO: 3924937 - DNA, 16 bp, Homo sapiens
agccagctgccgacca

SEQ ID NO: 3924938 - DNA, 14 bp, Homo sapiens
agccaggagtctgt

SEQ ID NO: 3924939 - DNA, 17 bp, Homo sapiens
agccaggagtctgtgct

SEQ ID NO: 3924940 - DNA, 21 bp, Homo sapiens
agccaggagttgacgcatcct

SEQ ID NO: 3924941 - DNA, 13 bp, Homo sapiens
agccaggctctgc

SEQ ID NO: 3924942 - DNA, 14 bp, Homo sapiens
agccaggctctgcc

SEQ ID NO: 3924943 - DNA, 15 bp, Homo sapiens
agccaggctctgcct

SEQ ID NO: 3924944 - DNA, 14 bp, Homo sapiens
agccaggggctgct

SEQ ID NO: 3924945 - DNA, 19 bp, Homo sapiens
agccagtcttgcctaggcc

SEQ ID NO: 3924946 - DNA, 15 bp, Homo sapiens
agccagtgacttttt

SEQ ID NO: 3924947 - DNA, 20 bp, Homo sapiens
agccatcccttccctgtcca

SEQ ID NO: 3924948 - DNA, 23 bp, Homo sapiens
agccatgaccagttctggccagg

SEQ ID NO: 3924949 - DNA, 21 bp, Homo sapiens
agccatgatcgagccactgca

SEQ ID NO: 3924950 - DNA, 14 bp, Homo sapiens
agccatgcctcatg

SEQ ID NO: 3924951 - DNA, 16 bp, Homo sapiens
agccatgcctcatgcc

SEQ ID NO: 3924952 - DNA, 14 bp, Homo sapiens
agccatggctcagg

SEQ ID NO: 3924953 - DNA, 15 bp, Homo sapiens
agccatggctcaggc

SEQ ID NO: 3924954 - DNA, 18 bp, Homo sapiens
agccatggctcaggcaag

SEQ ID NO: 3924955 - DNA, 13 bp, Homo sapiens
agccatgggcctg

SEQ ID NO: 3924956 - DNA, 14 bp, Homo sapiens
agccatgggcctgg

SEQ ID NO: 3924957 - DNA, 15 bp, Homo sapiens
agccatgggcctggg

SEQ ID NO: 3924958 - DNA, 22 bp, Homo sapiens
agccatgggcctgggcctgctt

SEQ ID NO: 3924959 - DNA, 17 bp, Homo sapiens
agccatggtgacacaca

SEQ ID NO: 3924960 - DNA, 18 bp, Homo sapiens
agccatggtgacacacag

SEQ ID NO: 3924961 - DNA, 20 bp, Homo sapiens
agccattttggggggccccc

SEQ ID NO: 3924962 - DNA, 19 bp, Homo sapiens
agccattttttgaggagag

SEQ ID NO: 3924963 - DNA, 14 bp, Homo sapiens
agcccaagaggact

SEQ ID NO: 3924964 - DNA, 18 bp, Homo sapiens
agcccaagaggtctgagc

SEQ ID NO: 3924965 - DNA, 20 bp, Homo sapiens
agcccaagaggtctgagccc

SEQ ID NO: 3924966 - DNA, 21 bp, Homo sapiens
agcccaagaggtctgagccct

SEQ ID NO: 3924967 - DNA, 22 bp, Homo sapiens
agcccaagaggtctgagccctg

SEQ ID NO: 3924968 - DNA, 21 bp, Homo sapiens
agcccaagtgccatcccacat

SEQ ID NO: 3924969 - DNA, 22 bp, Homo sapiens
agcccaagtgccatcccacatt

SEQ ID NO: 3924970 - DNA, 13 bp, Homo sapiens
agcccagagggcc

SEQ ID NO: 3924971 - DNA, 18 bp, Homo sapiens
agcccagctacattcctc

SEQ ID NO: 3924972 - DNA, 19 bp, Homo sapiens
agcccagctacattcctca

SEQ ID NO: 3924973 - DNA, 13 bp, Homo sapiens
agcccagctggtg

SEQ ID NO: 3924974 - DNA, 12 bp, Homo sapiens
agcccaggagct

SEQ ID NO: 3924975 - DNA, 21 bp, Homo sapiens
agcccaggagctgagtcacct

SEQ ID NO: 3924976 - DNA, 13 bp, Homo sapiens
agcccaggccgtt

SEQ ID NO: 3924977 - DNA, 16 bp, Homo sapiens
agcccaggctgaagag

SEQ ID NO: 3924978 - DNA, 23 bp, Homo sapiens
agcccaggctggagatcctaact

SEQ ID NO: 3924979 - DNA, 14 bp, Homo sapiens
agcccagtgacctg

SEQ ID NO: 3924980 - DNA, 18 bp, Homo sapiens
agcccagtgacctgaccg

SEQ ID NO: 3924981 - DNA, 16 bp, Homo sapiens
agcccagtttcccttc

SEQ ID NO: 3924982 - DNA, 23 bp, Homo sapiens
agcccagtttcccttctatgcag

SEQ ID NO: 3924983 - DNA, 14 bp, Homo sapiens
agcccataaggcca

SEQ ID NO: 3924984 - DNA, 18 bp, Homo sapiens
agccccaaaccagggtgc

SEQ ID NO: 3924985 - DNA, 13 bp, Homo sapiens
agccccacagcac

SEQ ID NO: 3924986 - DNA, 15 bp, Homo sapiens
agccccacagcaccc

SEQ ID NO: 3924987 - DNA, 20 bp, Homo sapiens
agccccacagcacccaggct

SEQ ID NO: 3924988 - DNA, 21 bp, Homo sapiens
agccccacagcacccaggctc

SEQ ID NO: 3924989 - DNA, 16 bp, Homo sapiens
agccccaggcctctgt

SEQ ID NO: 3924990 - DNA, 18 bp, Homo sapiens
agccccaggcctctgtgt

SEQ ID NO: 3924991 - DNA, 17 bp, Homo sapiens
agccccagggcctgggg

SEQ ID NO: 3924992 - DNA, 11 bp, Homo sapiens
agccccagggg

SEQ ID NO: 3924993 - DNA, 23 bp, Homo sapiens
agccccataattttttttttcct

SEQ ID NO: 3924994 - DNA, 13 bp, Homo sapiens
agcccccaagcct

SEQ ID NO: 3924995 - DNA, 16 bp, Homo sapiens
agcccccaagcctctg

SEQ ID NO: 3924996 - DNA, 19 bp, Homo sapiens
agcccccaagcctctgccc

SEQ ID NO: 3924997 - DNA, 21 bp, Homo sapiens
agcccccaagcctctgcccca

SEQ ID NO: 3924998 - DNA, 13 bp, Homo sapiens
agccccccagcac

SEQ ID NO: 3924999 - DNA, 14 bp, Homo sapiens
agccccccagcact

SEQ ID NO: 3925000 - DNA, 20 bp, Homo sapiens
agccccctggatgggcattg

SEQ ID NO: 3925001 - DNA, 19 bp, Homo sapiens
agccccctggatgtcccct

SEQ ID NO: 3925002 - DNA, 20 bp, Homo sapiens
agccccgctcctcccctctt

SEQ ID NO: 3925003 - DNA, 14 bp, Homo sapiens
agcccctcagccct

SEQ ID NO: 3925004 - DNA, 15 bp, Homo sapiens
agcccctcagccctt

SEQ ID NO: 3925005 - DNA, 17 bp, Homo sapiens
agcccctcctctgccac

SEQ ID NO: 3925006 - DNA, 22 bp, Homo sapiens
agcccctcctctgccacctccc

SEQ ID NO: 3925007 - DNA, 23 bp, Homo sapiens
agcccctcctctgccacctcccc

SEQ ID NO: 3925008 - DNA, 15 bp, Homo sapiens
agccccttgtcctct

SEQ ID NO: 3925009 - DNA, 17 bp, Homo sapiens
agcccgagggcctgaca

SEQ ID NO: 3925010 - DNA, 21 bp, Homo sapiens
agcccggcctgctcccagcag

SEQ ID NO: 3925011 - DNA, 22 bp, Homo sapiens
agcccgggtgtgcctgccctgg

SEQ ID NO: 3925012 - DNA, 16 bp, Homo sapiens
agccctaaggatctct

SEQ ID NO: 3925013 - DNA, 15 bp, Homo sapiens
agccctacatcttca

SEQ ID NO: 3925014 - DNA, 20 bp, Homo sapiens
agccctacatcttcagctcc

SEQ ID NO: 3925015 - DNA, 14 bp, Homo sapiens
agccctatggatgt

SEQ ID NO: 3925016 - DNA, 15 bp, Homo sapiens
agccctatggatgtg

SEQ ID NO: 3925017 - DNA, 13 bp, Homo sapiens
agccctcagaaca

SEQ ID NO: 3925018 - DNA, 20 bp, Homo sapiens
agctgtaggtgtgcgggacc

SEQ ID NO: 3925019 - DNA, 20 bp, Homo sapiens
agctgtatatatatatgtgt

SEQ ID NO: 3925020 - DNA, 22 bp, Homo sapiens
agctgtatatatatatgtgtgt

SEQ ID NO: 3925021 - DNA, 20 bp, Homo sapiens
agctgtcatggaaaagccca

SEQ ID NO: 3925022 - DNA, 14 bp, Homo sapiens
agctgtcattcagg

SEQ ID NO: 3925023 - DNA, 15 bp, Homo sapiens
agctgtcccctctcc

SEQ ID NO: 3925024 - DNA, 15 bp, Homo sapiens
agctgtccctgtcac

SEQ ID NO: 3925025 - DNA, 13 bp, Homo sapiens
agctgtcgcatct

SEQ ID NO: 3925026 - DNA, 14 bp, Homo sapiens
agctgtcgcatctc

SEQ ID NO: 3925027 - DNA, 15 bp, Homo sapiens
agctgtcgcatctca

SEQ ID NO: 3925028 - DNA, 13 bp, Homo sapiens
agctgtctccagg

SEQ ID NO: 3925029 - DNA, 14 bp, Homo sapiens
agctgtctccagga

SEQ ID NO: 3925030 - DNA, 17 bp, Homo sapiens
agctgtctgctcagaca

SEQ ID NO: 3925031 - DNA, 18 bp, Homo sapiens
agctgtgacctgctgagc

SEQ ID NO: 3925032 - DNA, 13 bp, Homo sapiens
agctgtgtgaaat

SEQ ID NO: 3925033 - DNA, 16 bp, Homo sapiens
agctgttcacagccag

SEQ ID NO: 3925034 - DNA, 19 bp, Homo sapiens
agctgttcacagccagact

SEQ ID NO: 3925035 - DNA, 14 bp, Homo sapiens
agctgttggcctcg

SEQ ID NO: 3925036 - DNA, 21 bp, Homo sapiens
agctgttggcctcgcctgggc

SEQ ID NO: 3925037 - DNA, 23 bp, Homo sapiens
agctgttggcctcgcctgggccc

SEQ ID NO: 3925038 - DNA, 12 bp, Homo sapiens
agctgtttaaga

SEQ ID NO: 3925039 - DNA, 16 bp, Homo sapiens
agctgtttaagatggg

SEQ ID NO: 3925040 - DNA, 13 bp, Homo sapiens
agctgtttattta

SEQ ID NO: 3925041 - DNA, 18 bp, Homo sapiens
agctgtttttttcattag

SEQ ID NO: 3925042 - DNA, 14 bp, Homo sapiens
agcttaaataaatt

SEQ ID NO: 3925043 - DNA, 21 bp, Homo sapiens
agcttaaataaattcaaacca

SEQ ID NO: 3925044 - DNA, 13 bp, Homo sapiens
agcttacctgaca

SEQ ID NO: 3925045 - DNA, 13 bp, Homo sapiens
agcttagccttgt

SEQ ID NO: 3925046 - DNA, 15 bp, Homo sapiens
agcttagccttgtgc

SEQ ID NO: 3925047 - DNA, 20 bp, Homo sapiens
agcttagccttgtgccctgc

SEQ ID NO: 3925048 - DNA, 20 bp, Homo sapiens
agcttatgggatccttgtct

SEQ ID NO: 3925049 - DNA, 15 bp, Homo sapiens
agcttattaaaactc

SEQ ID NO: 3925050 - DNA, 22 bp, Homo sapiens
agcttattcatctgtttttctt

SEQ ID NO: 3925051 - DNA, 13 bp, Homo sapiens
agcttattggcca

SEQ ID NO: 3925052 - DNA, 14 bp, Homo sapiens
agcttattggccac

SEQ ID NO: 3925053 - DNA, 15 bp, Homo sapiens
agcttattggccact

SEQ ID NO: 3925054 - DNA, 13 bp, Homo sapiens
agcttcaagtgat

SEQ ID NO: 3925055 - DNA, 17 bp, Homo sapiens
agcttcaagtgatatat

SEQ ID NO: 3925056 - DNA, 19 bp, Homo sapiens
agcttcaagtgatatatgt

SEQ ID NO: 3925057 - DNA, 20 bp, Homo sapiens
agcttcaagtgatatatgta

SEQ ID NO: 3925058 - DNA, 12 bp, Homo sapiens
agcttcagagcc

SEQ ID NO: 3925059 - DNA, 22 bp, Homo sapiens
agcttcagagcctagccacctc

SEQ ID NO: 3925060 - DNA, 19 bp, Homo sapiens
agcttcagttgttttcccg

SEQ ID NO: 3925061 - DNA, 16 bp, Homo sapiens
agcttcatcaattttt

SEQ ID NO: 3925062 - DNA, 23 bp, Homo sapiens
agcttcatcaatttttatacata

SEQ ID NO: 3925063 - DNA, 21 bp, Homo sapiens
agcttctacagattttagaca

SEQ ID NO: 3925064 - DNA, 18 bp, Homo sapiens
agcttctatcccaggagg

SEQ ID NO: 3925065 - DNA, 17 bp, Homo sapiens
agcttctattaaatgta

SEQ ID NO: 3925066 - DNA, 12 bp, Homo sapiens
agcttctccagg

SEQ ID NO: 3925067 - DNA, 12 bp, Homo sapiens
agcttctctgcc

SEQ ID NO: 3925068 - DNA, 12 bp, Homo sapiens
agcttctgtcct

SEQ ID NO: 3925069 - DNA, 15 bp, Homo sapiens
agcttgaccagacct

SEQ ID NO: 3925070 - DNA, 18 bp, Homo sapiens
agcttgaccagacctaga

SEQ ID NO: 3925071 - DNA, 13 bp, Homo sapiens
agcttgagcctga

SEQ ID NO: 3925072 - DNA, 16 bp, Homo sapiens
agcttgccctgttaaa

SEQ ID NO: 3925073 - DNA, 19 bp, Homo sapiens
agcttgccctgttaaaaga

SEQ ID NO: 3925074 - DNA, 16 bp, Homo sapiens
agcttggacagtctga

SEQ ID NO: 3925075 - DNA, 14 bp, Homo sapiens
agcttgggaatgga

SEQ ID NO: 3925076 - DNA, 18 bp, Homo sapiens
agcttgtatatacatatt

SEQ ID NO: 3925077 - DNA, 21 bp, Homo sapiens
agcttgtatatacatattata

SEQ ID NO: 3925078 - DNA, 23 bp, Homo sapiens
agcttgtatatacatattataaa

SEQ ID NO: 3925079 - DNA, 15 bp, Homo sapiens
agctttacatgcaat

SEQ ID NO: 3925080 - DNA, 19 bp, Homo sapiens
agctttacatgcaatttat

SEQ ID NO: 3925081 - DNA, 21 bp, Homo sapiens
agctttacatgcaatttatta

SEQ ID NO: 3925082 - DNA, 18 bp, Homo sapiens
agctttatctgtcacaca

SEQ ID NO: 3925083 - DNA, 19 bp, Homo sapiens
agctttatttatttctttg

SEQ ID NO: 3925084 - DNA, 17 bp, Homo sapiens
agctttcagagccagtg

SEQ ID NO: 3925085 - DNA, 13 bp, Homo sapiens
agctttctccttt

SEQ ID NO: 3925086 - DNA, 11 bp, Homo sapiens
agctttcttct

SEQ ID NO: 3925087 - DNA, 15 bp, Homo sapiens
agctttcttctacaa

SEQ ID NO: 3925088 - DNA, 17 bp, Homo sapiens
agctttcttctacaacc

SEQ ID NO: 3925089 - DNA, 20 bp, Homo sapiens
agctttcttctacaaccaga

SEQ ID NO: 3925090 - DNA, 14 bp, Homo sapiens
agctttctttcaca

SEQ ID NO: 3925091 - DNA, 23 bp, Homo sapiens
agctttgaatacccccagagacc

SEQ ID NO: 3925092 - DNA, 16 bp, Homo sapiens
agctttgctaccaaag

SEQ ID NO: 3925093 - DNA, 16 bp, Homo sapiens
agcttttaataaaatt

SEQ ID NO: 3925094 - DNA, 18 bp, Homo sapiens
agcttttaataaaattga

SEQ ID NO: 3925095 - DNA, 15 bp, Homo sapiens
agcttttattgtata

SEQ ID NO: 3925096 - DNA, 20 bp, Homo sapiens
agcttttcaaacaagaatgt

SEQ ID NO: 3925097 - DNA, 13 bp, Homo sapiens
aggaaaaaaaata

SEQ ID NO: 3925098 - DNA, 15 bp, Homo sapiens
aggaaaaaaatgact

SEQ ID NO: 3925099 - DNA, 18 bp, Homo sapiens
aggaaaacaaatcactgt

SEQ ID NO: 3925100 - DNA, 21 bp, Homo sapiens
aggaaaaccaagccgtggctt

SEQ ID NO: 3925101 - DNA, 17 bp, Homo sapiens
aggaaaacgggaaagaa

SEQ ID NO: 3925102 - DNA, 13 bp, Homo sapiens
aggaaaagaaaag

SEQ ID NO: 3925103 - DNA, 14 bp, Homo sapiens
aggaaaagaaggct

SEQ ID NO: 3925104 - DNA, 13 bp, Homo sapiens
aggaaaaggcctg

SEQ ID NO: 3925105 - DNA, 21 bp, Homo sapiens
aggcatgcctctgatatggga

SEQ ID NO: 3925106 - DNA, 23 bp, Homo sapiens
aggcatgcctctgatatgggact

SEQ ID NO: 3925107 - DNA, 15 bp, Homo sapiens
aggcattatttaatg

SEQ ID NO: 3925108 - DNA, 20 bp, Homo sapiens
aggcattatttaatgtttga

SEQ ID NO: 3925109 - DNA, 15 bp, Homo sapiens
aggcatttcctgggt

SEQ ID NO: 3925110 - DNA, 17 bp, Homo sapiens
aggcatttcctgggtgg

SEQ ID NO: 3925111 - DNA, 21 bp, Homo sapiens
aggcatttgcctaattcctgg

SEQ ID NO: 3925112 - DNA, 20 bp, Homo sapiens
aggccaagctgaagtgaagg

SEQ ID NO: 3925113 - DNA, 18 bp, Homo sapiens
aggccaagtcaggccctt

SEQ ID NO: 3925114 - DNA, 21 bp, Homo sapiens
aggccacatgtcaccgtggac

SEQ ID NO: 3925115 - DNA, 18 bp, Homo sapiens
aggccacgctcaggcccg

SEQ ID NO: 3925116 - DNA, 15 bp, Homo sapiens
aggccactgtggcca

SEQ ID NO: 3925117 - DNA, 19 bp, Homo sapiens
aggccactgtggccagagc

SEQ ID NO: 3925118 - DNA, 21 bp, Homo sapiens
aggccactgtggccagagctg

SEQ ID NO: 3925119 - DNA, 12 bp, Homo sapiens
aggccagcctgg

SEQ ID NO: 3925120 - DNA, 16 bp, Homo sapiens
aggccagcctggcctc

SEQ ID NO: 3925121 - DNA, 20 bp, Homo sapiens
aggccagcctggcctcctgc

SEQ ID NO: 3925122 - DNA, 22 bp, Homo sapiens
aggccagcctggcctcctgcct

SEQ ID NO: 3925123 - DNA, 16 bp, Homo sapiens
aggccaggccaccagg

SEQ ID NO: 3925124 - DNA, 17 bp, Homo sapiens
aggccaggccaccagga

SEQ ID NO: 3925125 - DNA, 18 bp, Homo sapiens
aggccaggccaccaggat

SEQ ID NO: 3925126 - DNA, 13 bp, Homo sapiens
aggcccagcagac

SEQ ID NO: 3925127 - DNA, 14 bp, Homo sapiens
aggcccagggagca

SEQ ID NO: 3925128 - DNA, 18 bp, Homo sapiens
aggcccatctcaggtgcc

SEQ ID NO: 3925129 - DNA, 20 bp, Homo sapiens
aggccccatgacctccagct

SEQ ID NO: 3925130 - DNA, 13 bp, Homo sapiens
aggcccctgagga

SEQ ID NO: 3925131 - DNA, 19 bp, Homo sapiens
aggcccgacagagagatga

SEQ ID NO: 3925132 - DNA, 21 bp, Homo sapiens
aggcccgacagagagatgaag

SEQ ID NO: 3925133 - DNA, 21 bp, Homo sapiens
aggcccggcccagcctaggcc

SEQ ID NO: 3925134 - DNA, 10 bp, Homo sapiens
aggccctccc

SEQ ID NO: 3925135 - DNA, 22 bp, Homo sapiens
aggccctccctgactccctgtg

SEQ ID NO: 3925136 - DNA, 23 bp, Homo sapiens
aggccctccctgactccctgtgg

SEQ ID NO: 3925137 - DNA, 16 bp, Homo sapiens
aggccctgccttcagc

SEQ ID NO: 3925138 - DNA, 13 bp, Homo sapiens
aggccctggatca

SEQ ID NO: 3925139 - DNA, 21 bp, Homo sapiens
aggccctggatcagcgtggcc

SEQ ID NO: 3925140 - DNA, 23 bp, Homo sapiens
aggccctggatcagcgtggcctt

SEQ ID NO: 3925141 - DNA, 20 bp, Homo sapiens
aggccctggtgtcaggcagg

SEQ ID NO: 3925142 - DNA, 13 bp, Homo sapiens
aggccctgtctgt

SEQ ID NO: 3925143 - DNA, 18 bp, Homo sapiens
aggcccttcctctccact

SEQ ID NO: 3925144 - DNA, 22 bp, Homo sapiens
aggcccttcctctccactgcct

SEQ ID NO: 3925145 - DNA, 21 bp, Homo sapiens
aggcccttggggttcccccag

SEQ ID NO: 3925146 - DNA, 22 bp, Homo sapiens
aggcccttggggttcccccaga

SEQ ID NO: 3925147 - DNA, 23 bp, Homo sapiens
aggcccttggggttcccccagac

SEQ ID NO: 3925148 - DNA, 14 bp, Homo sapiens
aggcccttgtcctg

SEQ ID NO: 3925149 - DNA, 23 bp, Homo sapiens
aggccgaagctaacagggaaggc

SEQ ID NO: 3925150 - DNA, 13 bp, Homo sapiens
aggccgtgtctct

SEQ ID NO: 3925151 - DNA, 14 bp, Homo sapiens
aggccgtgtctctg

SEQ ID NO: 3925152 - DNA, 18 bp, Homo sapiens
aggccgtgtctctgagga

SEQ ID NO: 3925153 - DNA, 22 bp, Homo sapiens
aggccgttccccttggcttcct

SEQ ID NO: 3925154 - DNA, 22 bp, Homo sapiens
aggcctaatctcatacctctga

SEQ ID NO: 3925155 - DNA, 13 bp, Homo sapiens
aggcctcatccct

SEQ ID NO: 3925156 - DNA, 20 bp, Homo sapiens
aggcctccacgggggcggca

SEQ ID NO: 3925157 - DNA, 13 bp, Homo sapiens
aggcctccagcct

SEQ ID NO: 3925158 - DNA, 18 bp, Homo sapiens
aggcctccagcctctccc

SEQ ID NO: 3925159 - DNA, 21 bp, Homo sapiens
aggcctccagcctctcccggc

SEQ ID NO: 3925160 - DNA, 12 bp, Homo sapiens
aggcctgccctc

SEQ ID NO: 3925161 - DNA, 13 bp, Homo sapiens
aggcctgcctgtt

SEQ ID NO: 3925162 - DNA, 14 bp, Homo sapiens
aggcctggaaccag

SEQ ID NO: 3925163 - DNA, 15 bp, Homo sapiens
aggcctggaaccagg

SEQ ID NO: 3925164 - DNA, 19 bp, Homo sapiens
aggcctggaaccagggagg

SEQ ID NO: 3925165 - DNA, 20 bp, Homo sapiens
aggcctggaaccagggagga

SEQ ID NO: 3925166 - DNA, 11 bp, Homo sapiens
aggcctggcca

SEQ ID NO: 3925167 - DNA, 15 bp, Homo sapiens
aggcctggccaggca

SEQ ID NO: 3925168 - DNA, 21 bp, Homo sapiens
aggcctggccttgtcaggacc

SEQ ID NO: 3925169 - DNA, 22 bp, Homo sapiens
aggcctggccttgtcaggaccc

SEQ ID NO: 3925170 - DNA, 16 bp, Homo sapiens
aggcctgggacccagc

SEQ ID NO: 3925171 - DNA, 17 bp, Homo sapiens
aggcctgggggcaggga

SEQ ID NO: 3925172 - DNA, 18 bp, Homo sapiens
aggcctggggtgacccgg

SEQ ID NO: 3925173 - DNA, 20 bp, Homo sapiens
aggcctggggtgacccggca

SEQ ID NO: 3925174 - DNA, 24 bp, Homo sapiens
aggcctgtgtagctgtgacctgct

SEQ ID NO: 3925175 - DNA, 13 bp, Homo sapiens
aggccttttcacg

SEQ ID NO: 3925176 - DNA, 12 bp, Homo sapiens
aggcgaataaat

SEQ ID NO: 3925177 - DNA, 16 bp, Homo sapiens
aggcgcgtctgcccca

SEQ ID NO: 3925178 - DNA, 19 bp, Homo sapiens
aggcgcgtctgccccaccc

SEQ ID NO: 3925179 - DNA, 16 bp, Homo sapiens
aggcggaaaccttgca

SEQ ID NO: 3925180 - DNA, 17 bp, Homo sapiens
aggcggaaaccttgcag

SEQ ID NO: 3925181 - DNA, 20 bp, Homo sapiens
aggcggagagtacagtgagc

SEQ ID NO: 3925182 - DNA, 17 bp, Homo sapiens
aggcggtcatgtgtgca

SEQ ID NO: 3925183 - DNA, 21 bp, Homo sapiens
aggcggtcatgtgtgcatgtg

SEQ ID NO: 3925184 - DNA, 16 bp, Homo sapiens
aggcgtgcaaggggct

SEQ ID NO: 3925185 - DNA, 15 bp, Homo sapiens
aggcgttggtgccac

SEQ ID NO: 3925186 - DNA, 22 bp, Homo sapiens
aggctaagatgagatttgccag

SEQ ID NO: 3925187 - DNA, 23 bp, Homo sapiens
aggctaagatgagatttgccagc

SEQ ID NO: 3925188 - DNA, 12 bp, Homo sapiens
aggctacccctt

SEQ ID NO: 3925189 - DNA, 17 bp, Homo sapiens
aggctacttcggggctg

SEQ ID NO: 3925190 - DNA, 22 bp, Homo sapiens
aggctacttcggggctgggaag

SEQ ID NO: 3925191 - DNA, 18 bp, Homo sapiens
aggtaggcccttgtcctg

SEQ ID NO: 3925192 - DNA, 20 bp, Homo sapiens
aggtagggccagctcacaag

SEQ ID NO: 3925193 - DNA, 17 bp, Homo sapiens
aggtatcaggcacaggc

SEQ ID NO: 3925194 - DNA, 13 bp, Homo sapiens
aggtatctccagg

SEQ ID NO: 3925195 - DNA, 17 bp, Homo sapiens
aggtattaaagatgtgt

SEQ ID NO: 3925196 - DNA, 19 bp, Homo sapiens
aggtattaaagatgtgttg

SEQ ID NO: 3925197 - DNA, 22 bp, Homo sapiens
aggtattccttttgtgtacagt

SEQ ID NO: 3925198 - DNA, 23 bp, Homo sapiens
aggtcatctcctttcatccccac

SEQ ID NO: 3925199 - DNA, 23 bp, Homo sapiens
aggtcattcttaagatttctcct

SEQ ID NO: 3925200 - DNA, 13 bp, Homo sapiens
aggtccaagggcc

SEQ ID NO: 3925201 - DNA, 18 bp, Homo sapiens
aggtccaagggccatact

SEQ ID NO: 3925202 - DNA, 16 bp, Homo sapiens
aggtccctgcttacct

SEQ ID NO: 3925203 - DNA, 20 bp, Homo sapiens
aggtccctgcttacctgacg

SEQ ID NO: 3925204 - DNA, 15 bp, Homo sapiens
aggtccggaggggtt

SEQ ID NO: 3925205 - DNA, 11 bp, Homo sapiens
aggtcctcctc

SEQ ID NO: 3925206 - DNA, 13 bp, Homo sapiens
aggtcctgagcac

SEQ ID NO: 3925207 - DNA, 15 bp, Homo sapiens
aggtcctgagcactg

SEQ ID NO: 3925208 - DNA, 16 bp, Homo sapiens
aggtcctgagcactgc

SEQ ID NO: 3925209 - DNA, 17 bp, Homo sapiens
aggtcctgagcactgcc

SEQ ID NO: 3925210 - DNA, 12 bp, Homo sapiens
aggtcctggctt

SEQ ID NO: 3925211 - DNA, 14 bp, Homo sapiens
aggtcctggcttct

SEQ ID NO: 3925212 - DNA, 19 bp, Homo sapiens
aggtcctggtggggcagct

SEQ ID NO: 3925213 - DNA, 22 bp, Homo sapiens
aggtcctggtggggcagctcct

SEQ ID NO: 3925214 - DNA, 21 bp, Homo sapiens
aggtcgaccccaaagcccctt

SEQ ID NO: 3925215 - DNA, 17 bp, Homo sapiens
aggtctagactttctca

SEQ ID NO: 3925216 - DNA, 13 bp, Homo sapiens
aggtctccctgga

SEQ ID NO: 3925217 - DNA, 15 bp, Homo sapiens
aggtctccttactct

SEQ ID NO: 3925218 - DNA, 20 bp, Homo sapiens
aggtctccttactctgagcc

SEQ ID NO: 3925219 - DNA, 22 bp, Homo sapiens
aggtctccttactctgagccca

SEQ ID NO: 3925220 - DNA, 14 bp, Homo sapiens
aggtctgagccctg

SEQ ID NO: 3925221 - DNA, 23 bp, Homo sapiens
aggtctgagccctggtgtgtttc

SEQ ID NO: 3925222 - DNA, 22 bp, Homo sapiens
aggtgaaaacagcccaggtcct

SEQ ID NO: 3925223 - DNA, 14 bp, Homo sapiens
aggtgaccccaggg

SEQ ID NO: 3925224 - DNA, 16 bp, Homo sapiens
aggtgaccccagggca

SEQ ID NO: 3925225 - DNA, 21 bp, Homo sapiens
aggtgaccccagggcacagga

SEQ ID NO: 3925226 - DNA, 24 bp, Homo sapiens
aggtgaccccagggcacaggagct

SEQ ID NO: 3925227 - DNA, 23 bp, Homo sapiens
aggtgagaccaaaggatccagag

SEQ ID NO: 3925228 - DNA, 15 bp, Homo sapiens
aggtgagaccacctc

SEQ ID NO: 3925229 - DNA, 16 bp, Homo sapiens
aggtgagaccacctct

SEQ ID NO: 3925230 - DNA, 17 bp, Homo sapiens
aggtgcaagtgccccag

SEQ ID NO: 3925231 - DNA, 17 bp, Homo sapiens
aggtgcagatgggctgt

SEQ ID NO: 3925232 - DNA, 15 bp, Homo sapiens
aggtgccaccaataa

SEQ ID NO: 3925233 - DNA, 17 bp, Homo sapiens
aggtgccactccctgag

SEQ ID NO: 3925234 - DNA, 19 bp, Homo sapiens
aggtgccactccctgagct

SEQ ID NO: 3925235 - DNA, 12 bp, Homo sapiens
aggtgcccagga

SEQ ID NO: 3925236 - DNA, 23 bp, Homo sapiens
aggtgcctgagctggggcctgga

SEQ ID NO: 3925237 - DNA, 18 bp, Homo sapiens
aggtgcctgtgaggcagg

SEQ ID NO: 3925238 - DNA, 23 bp, Homo sapiens
aggtgccttcttattctcactcc

SEQ ID NO: 3925239 - DNA, 20 bp, Homo sapiens
aggtgctacaaaaacacagc

SEQ ID NO: 3925240 - DNA, 22 bp, Homo sapiens
aggtgctacaaaaacacagcaa

SEQ ID NO: 3925241 - DNA, 23 bp, Homo sapiens
aggtgctgagcttagccttgtgc

SEQ ID NO: 3925242 - DNA, 11 bp, Homo sapiens
aggtggaagcc

SEQ ID NO: 3925243 - DNA, 16 bp, Homo sapiens
aggtggaagccctcct

SEQ ID NO: 3925244 - DNA, 14 bp, Homo sapiens
aggtggccactcca

SEQ ID NO: 3925245 - DNA, 17 bp, Homo sapiens
aggtggctatggccacc

SEQ ID NO: 3925246 - DNA, 18 bp, Homo sapiens
aggtgggcagaggctggc

SEQ ID NO: 3925247 - DNA, 17 bp, Homo sapiens
aggtgggcagctgggcc

SEQ ID NO: 3925248 - DNA, 14 bp, Homo sapiens
aggtgggtccagga

SEQ ID NO: 3925249 - DNA, 19 bp, Homo sapiens
aggtgggtccaggaaggca

SEQ ID NO: 3925250 - DNA, 23 bp, Homo sapiens
aggtgggttttcttcccatcact

SEQ ID NO: 3925251 - DNA, 19 bp, Homo sapiens
aggtggtcctgagacctga

SEQ ID NO: 3925252 - DNA, 14 bp, Homo sapiens
aggtggtggaggag

SEQ ID NO: 3925253 - DNA, 19 bp, Homo sapiens
aggtgtaaaatatctacct

SEQ ID NO: 3925254 - DNA, 14 bp, Homo sapiens
aggtgtaaatatag

SEQ ID NO: 3925255 - DNA, 15 bp, Homo sapiens
aggtgtcaccctgca

SEQ ID NO: 3925256 - DNA, 18 bp, Homo sapiens
aggtgtcaccctgcagag

SEQ ID NO: 3925257 - DNA, 19 bp, Homo sapiens
aggtgtcaccctgcagagc

SEQ ID NO: 3925258 - DNA, 21 bp, Homo sapiens
aggtgtcaccctgcagagcta

SEQ ID NO: 3925259 - DNA, 14 bp, Homo sapiens
aggtgtctgcaccc

SEQ ID NO: 3925260 - DNA, 16 bp, Homo sapiens
aggtgtctgcacccag

SEQ ID NO: 3925261 - DNA, 23 bp, Homo sapiens
aggtgtcttttccactcctatgg

SEQ ID NO: 3925262 - DNA, 16 bp, Homo sapiens
aggtgttgaaaatgag

SEQ ID NO: 3925263 - DNA, 20 bp, Homo sapiens
aggtgttgccatttctctgc

SEQ ID NO: 3925264 - DNA, 14 bp, Homo sapiens
aggtgtttatacag

SEQ ID NO: 3925265 - DNA, 14 bp, Homo sapiens
aggttaaaatataa

SEQ ID NO: 3925266 - DNA, 17 bp, Homo sapiens
aggttaccctgtaacat

SEQ ID NO: 3925267 - DNA, 18 bp, Homo sapiens
aggttaggatttaacagt

SEQ ID NO: 3925268 - DNA, 18 bp, Homo sapiens
aggttatctgcctggcct

SEQ ID NO: 3925269 - DNA, 22 bp, Homo sapiens
aggttatctgcctggcctggct

SEQ ID NO: 3925270 - DNA, 14 bp, Homo sapiens
aggttcccagcagc

SEQ ID NO: 3925271 - DNA, 16 bp, Homo sapiens
aggttccctctgagaa

SEQ ID NO: 3925272 - DNA, 13 bp, Homo sapiens
aggttctaggtcc

SEQ ID NO: 3925273 - DNA, 15 bp, Homo sapiens
aggttctggggagga

SEQ ID NO: 3925274 - DNA, 20 bp, Homo sapiens
aggttgacagtcccttgctg

SEQ ID NO: 3925275 - DNA, 12 bp, Homo sapiens
aggttgcagtga

SEQ ID NO: 3925276 - DNA, 16 bp, Homo sapiens
aggttgtctgaagtca

SEQ ID NO: 3925277 - DNA, 19 bp, Homo sapiens
agtgctttacatgctgtgc

SEQ ID NO: 3925278 - DNA, 18 bp, Homo sapiens
agtgctttacctttaaaa

SEQ ID NO: 3925279 - DNA, 19 bp, Homo sapiens
agtggaaaaaagagaaaaa

SEQ ID NO: 3925280 - DNA, 20 bp, Homo sapiens
agtggaaaaaagagaaaaac

SEQ ID NO: 3925281 - DNA, 16 bp, Homo sapiens
agtggaagagcagcct

SEQ ID NO: 3925282 - DNA, 19 bp, Homo sapiens
agtggaatgcagggaagag

SEQ ID NO: 3925283 - DNA, 20 bp, Homo sapiens
agtggacattcaaaaacctg

SEQ ID NO: 3925284 - DNA, 16 bp, Homo sapiens
agtggagaattatata

SEQ ID NO: 3925285 - DNA, 13 bp, Homo sapiens
agtggagcttttg

SEQ ID NO: 3925286 - DNA, 12 bp, Homo sapiens
agtggagggggt

SEQ ID NO: 3925287 - DNA, 17 bp, Homo sapiens
agtggagggggtgtctg

SEQ ID NO: 3925288 - DNA, 23 bp, Homo sapiens
agtggagggggtgtctggaagct

SEQ ID NO: 3925289 - DNA, 14 bp, Homo sapiens
agtggatctccaag

SEQ ID NO: 3925290 - DNA, 18 bp, Homo sapiens
agtggatctccaaggacc

SEQ ID NO: 3925291 - DNA, 18 bp, Homo sapiens
agtggatgcattcctgag

SEQ ID NO: 3925292 - DNA, 17 bp, Homo sapiens
agtggatggaggagaaa

SEQ ID NO: 3925293 - DNA, 20 bp, Homo sapiens
agtggatggaggagaaataa

SEQ ID NO: 3925294 - DNA, 16 bp, Homo sapiens
agtggattttcctgaa

SEQ ID NO: 3925295 - DNA, 22 bp, Homo sapiens
agtggcagccatgcctcatgcc

SEQ ID NO: 3925296 - DNA, 22 bp, Homo sapiens
agtggcagctgtcccctctccc

SEQ ID NO: 3925297 - DNA, 20 bp, Homo sapiens
agtggcccctgcccccaaag

SEQ ID NO: 3925298 - DNA, 19 bp, Homo sapiens
agtggccgcaagcgcaggg

SEQ ID NO: 3925299 - DNA, 22 bp, Homo sapiens
agtggccgcaagcgcagggagg

SEQ ID NO: 3925300 - DNA, 17 bp, Homo sapiens
agtggctcctcccggtg

SEQ ID NO: 3925301 - DNA, 16 bp, Homo sapiens
agtggctcgctccctg

SEQ ID NO: 3925302 - DNA, 20 bp, Homo sapiens
agtggctcttctaacctcag

SEQ ID NO: 3925303 - DNA, 11 bp, Homo sapiens
agtggctgctg

SEQ ID NO: 3925304 - DNA, 22 bp, Homo sapiens
agtggcttgtgattctgggatg

SEQ ID NO: 3925305 - DNA, 20 bp, Homo sapiens
agtgggaacgtgactgcccc

SEQ ID NO: 3925306 - DNA, 18 bp, Homo sapiens
agtgggaactctgacaag

SEQ ID NO: 3925307 - DNA, 17 bp, Homo sapiens
agtgggaagtgaagccc

SEQ ID NO: 3925308 - DNA, 21 bp, Homo sapiens
agtgggacagggcatggccag

SEQ ID NO: 3925309 - DNA, 13 bp, Homo sapiens
agtgggccaggac

SEQ ID NO: 3925310 - DNA, 15 bp, Homo sapiens
agtgggccaggacag

SEQ ID NO: 3925311 - DNA, 16 bp, Homo sapiens
agtgggccaggacagg

SEQ ID NO: 3925312 - DNA, 21 bp, Homo sapiens
agtgggccaggacaggcccgg

SEQ ID NO: 3925313 - DNA, 17 bp, Homo sapiens
agtggggtaattctgct

SEQ ID NO: 3925314 - DNA, 22 bp, Homo sapiens
agtgggttcactagagctggga

SEQ ID NO: 3925315 - DNA, 22 bp, Homo sapiens
agtggtttgatggtgacttcct

SEQ ID NO: 3925316 - DNA, 16 bp, Homo sapiens
agtgtaaggcataggg

SEQ ID NO: 3925317 - DNA, 23 bp, Homo sapiens
agtgtccagaccattgtcttcca

SEQ ID NO: 3925318 - DNA, 22 bp, Homo sapiens
agtgtctattagttttctttgt

SEQ ID NO: 3925319 - DNA, 17 bp, Homo sapiens
agtgtcttaattaaaag

SEQ ID NO: 3925320 - DNA, 15 bp, Homo sapiens
agtgtgaaatagaca

SEQ ID NO: 3925321 - DNA, 12 bp, Homo sapiens
agtgtgagaatc

SEQ ID NO: 3925322 - DNA, 16 bp, Homo sapiens
agtgtgagtggcagcc

SEQ ID NO: 3925323 - DNA, 17 bp, Homo sapiens
agtgtgagtggcagcca

SEQ ID NO: 3925324 - DNA, 22 bp, Homo sapiens
agtgtgagtggcagccatgcct

SEQ ID NO: 3925325 - DNA, 15 bp, Homo sapiens
agtgtgcgtgtgtgc

SEQ ID NO: 3925326 - DNA, 16 bp, Homo sapiens
agtgtgcgtgtgtgca

SEQ ID NO: 3925327 - DNA, 22 bp, Homo sapiens
agtgtgggtgatcagaaggctg

SEQ ID NO: 3925328 - DNA, 16 bp, Homo sapiens
agtgtgtgtgcatgtg

SEQ ID NO: 3925329 - DNA, 19 bp, Homo sapiens
agtgtgtgtgcatgtgtgt

SEQ ID NO: 3925330 - DNA, 23 bp, Homo sapiens
agtgtgtgtgtctgttgagtgca

SEQ ID NO: 3925331 - DNA, 19 bp, Homo sapiens
agtgtgtttccttcagtgc

SEQ ID NO: 3925332 - DNA, 22 bp, Homo sapiens
agtgttattttctttgaaattg

SEQ ID NO: 3925333 - DNA, 17 bp, Homo sapiens
agtgttcaagaaataaa

SEQ ID NO: 3925334 - DNA, 18 bp, Homo sapiens
agtgttccagctgcctgg

SEQ ID NO: 3925335 - DNA, 19 bp, Homo sapiens
agtgttccagctgcctggg

SEQ ID NO: 3925336 - DNA, 15 bp, Homo sapiens
agtgttcccaaattg

SEQ ID NO: 3925337 - DNA, 17 bp, Homo sapiens
agtgttctgtgggcttg

SEQ ID NO: 3925338 - DNA, 19 bp, Homo sapiens
agtgttggctgtgtgacag

SEQ ID NO: 3925339 - DNA, 17 bp, Homo sapiens
agtgtttaacttgtcaa

SEQ ID NO: 3925340 - DNA, 24 bp, Homo sapiens
agtgttttttcactttagctatgt

SEQ ID NO: 3925341 - DNA, 18 bp, Homo sapiens
agttaaagggcagaaggg

SEQ ID NO: 3925342 - DNA, 21 bp, Homo sapiens
agttaacattaacatctatta

SEQ ID NO: 3925343 - DNA, 14 bp, Homo sapiens
agttaagtatttac

SEQ ID NO: 3925344 - DNA, 15 bp, Homo sapiens
agttaagtgaatgtc

SEQ ID NO: 3925345 - DNA, 20 bp, Homo sapiens
agttaatatatcccagaaat

SEQ ID NO: 3925346 - DNA, 20 bp, Homo sapiens
agttaatggggtagaggagg

SEQ ID NO: 3925347 - DNA, 17 bp, Homo sapiens
agttacagcgagaggca

SEQ ID NO: 3925348 - DNA, 22 bp, Homo sapiens
agttacggagggaggacatcat

SEQ ID NO: 3925349 - DNA, 13 bp, Homo sapiens
agttactcagccc

SEQ ID NO: 3925350 - DNA, 19 bp, Homo sapiens
agttactcttcagttttag

SEQ ID NO: 3925351 - DNA, 15 bp, Homo sapiens
agttacttacctgca

SEQ ID NO: 3925352 - DNA, 22 bp, Homo sapiens
agttacttcactttaattctca

SEQ ID NO: 3925353 - DNA, 16 bp, Homo sapiens
agttagaaatctccag

SEQ ID NO: 3925354 - DNA, 22 bp, Homo sapiens
agttagaaatctccagtgtgcg

SEQ ID NO: 3925355 - DNA, 17 bp, Homo sapiens
agttagagaatatattt

SEQ ID NO: 3925356 - DNA, 13 bp, Homo sapiens
agttaggaaataa

SEQ ID NO: 3925357 - DNA, 18 bp, Homo sapiens
agttaggaaataaaacct

SEQ ID NO: 3925358 - DNA, 22 bp, Homo sapiens
agttaggaaataaaacctttca

SEQ ID NO: 3925359 - DNA, 16 bp, Homo sapiens
agttaggatagcattt

SEQ ID NO: 3925360 - DNA, 18 bp, Homo sapiens
agttaggatagcattttt

SEQ ID NO: 3925361 - DNA, 14 bp, Homo sapiens
agttaggtgtgcca

SEQ ID NO: 3925362 - DNA, 15 bp, Homo sapiens
agttatagtttcaga

SEQ ID NO: 3925363 - DNA, 19 bp, Homo sapiens
atatatgtgcagtatttta

SEQ ID NO: 3925364 - DNA, 18 bp, Homo sapiens
atatatgtgtgtttaaat

SEQ ID NO: 3925365 - DNA, 21 bp, Homo sapiens
atatatgtgtgtttaaataaa

SEQ ID NO: 3925366 - DNA, 19 bp, Homo sapiens
atatattggtaacatcctt

SEQ ID NO: 3925367 - DNA, 21 bp, Homo sapiens
atatattggtaacatcctttc

SEQ ID NO: 3925368 - DNA, 12 bp, Homo sapiens
atatatttaaag

SEQ ID NO: 3925369 - DNA, 17 bp, Homo sapiens
atatatttactaaaaga

SEQ ID NO: 3925370 - DNA, 18 bp, Homo sapiens
atatatttactaaaagaa

SEQ ID NO: 3925371 - DNA, 19 bp, Homo sapiens
atatatttactaaaagaat

SEQ ID NO: 3925372 - DNA, 22 bp, Homo sapiens
atatatttcacgtgttccctct

SEQ ID NO: 3925373 - DNA, 23 bp, Homo sapiens
atatatttgattgtaaaaacaaa

SEQ ID NO: 3925374 - DNA, 21 bp, Homo sapiens
atatatttttatatttagtta

SEQ ID NO: 3925375 - DNA, 14 bp, Homo sapiens
atatatttttcaac

SEQ ID NO: 3925376 - DNA, 22 bp, Homo sapiens
atatatttttcaaccagcattt

SEQ ID NO: 3925377 - DNA, 14 bp, Homo sapiens
atatatttttcaca

SEQ ID NO: 3925378 - DNA, 21 bp, Homo sapiens
atatatttttcacagtttttc

SEQ ID NO: 3925379 - DNA, 16 bp, Homo sapiens
atatcaattcaacaca

SEQ ID NO: 3925380 - DNA, 17 bp, Homo sapiens
atatcaattcaacacat

SEQ ID NO: 3925381 - DNA, 11 bp, Homo sapiens
atatcacctct

SEQ ID NO: 3925382 - DNA, 12 bp, Homo sapiens
atatcacctctc

SEQ ID NO: 3925383 - DNA, 14 bp, Homo sapiens
atatcagaaaagta

SEQ ID NO: 3925384 - DNA, 15 bp, Homo sapiens
atatcagaaaagtag

SEQ ID NO: 3925385 - DNA, 20 bp, Homo sapiens
atatcagaaaagtagaatta

SEQ ID NO: 3925386 - DNA, 15 bp, Homo sapiens
atatcagacctctga

SEQ ID NO: 3925387 - DNA, 16 bp, Homo sapiens
atatcagacctctgat

SEQ ID NO: 3925388 - DNA, 20 bp, Homo sapiens
atatcagacctctgatccct

SEQ ID NO: 3925389 - DNA, 21 bp, Homo sapiens
atatcagcctgagtctcctgt

SEQ ID NO: 3925390 - DNA, 18 bp, Homo sapiens
atatcatgaaacacttct

SEQ ID NO: 3925391 - DNA, 20 bp, Homo sapiens
atatccacatctttaagtat

SEQ ID NO: 3925392 - DNA, 16 bp, Homo sapiens
atatcggaggtggtgg

SEQ ID NO: 3925393 - DNA, 16 bp, Homo sapiens
atatctaatttataca

SEQ ID NO: 3925394 - DNA, 23 bp, Homo sapiens
atatctaatttatacaaaataat

SEQ ID NO: 3925395 - DNA, 22 bp, Homo sapiens
atatctacctgccctctctcag

SEQ ID NO: 3925396 - DNA, 23 bp, Homo sapiens
atatctacctgccctctctcagt

SEQ ID NO: 3925397 - DNA, 22 bp, Homo sapiens
atatctatagtagtcaattagt

SEQ ID NO: 3925398 - DNA, 23 bp, Homo sapiens
atatctatagtagtcaattagta

SEQ ID NO: 3925399 - DNA, 13 bp, Homo sapiens
atatctcagaggc

SEQ ID NO: 3925400 - DNA, 22 bp, Homo sapiens
atatctgaacacatactagaaa

SEQ ID NO: 3925401 - DNA, 18 bp, Homo sapiens
atatctgataaaattgtg

SEQ ID NO: 3925402 - DNA, 18 bp, Homo sapiens
atatgaaatgataaagat

SEQ ID NO: 3925403 - DNA, 15 bp, Homo sapiens
atatgacagctgtcc

SEQ ID NO: 3925404 - DNA, 21 bp, Homo sapiens
atatgacagctgtccctgtca

SEQ ID NO: 3925405 - DNA, 18 bp, Homo sapiens
atatgactcctttctcta

SEQ ID NO: 3925406 - DNA, 20 bp, Homo sapiens
atatgagagaatcacacaag

SEQ ID NO: 3925407 - DNA, 15 bp, Homo sapiens
atatgagtatacaat

SEQ ID NO: 3925408 - DNA, 20 bp, Homo sapiens
atatgagtatacaatatata

SEQ ID NO: 3925409 - DNA, 18 bp, Homo sapiens
atatgataaagagggatg

SEQ ID NO: 3925410 - DNA, 14 bp, Homo sapiens
atatgatatgtaaa

SEQ ID NO: 3925411 - DNA, 15 bp, Homo sapiens
atatgatctaataca

SEQ ID NO: 3925412 - DNA, 18 bp, Homo sapiens
atatgatctaatacaaag

SEQ ID NO: 3925413 - DNA, 13 bp, Homo sapiens
atatgatttatag

SEQ ID NO: 3925414 - DNA, 18 bp, Homo sapiens
atatgattttttaaaaga

SEQ ID NO: 3925415 - DNA, 22 bp, Homo sapiens
atatgattttttaaaagaaatt

SEQ ID NO: 3925416 - DNA, 13 bp, Homo sapiens
atatgcaaagcac

SEQ ID NO: 3925417 - DNA, 15 bp, Homo sapiens
atatgcaaagcactg

SEQ ID NO: 3925418 - DNA, 16 bp, Homo sapiens
atatgcaaagcactga

SEQ ID NO: 3925419 - DNA, 15 bp, Homo sapiens
atatgcatatatttt

SEQ ID NO: 3925420 - DNA, 19 bp, Homo sapiens
atatggaaccttccctcca

SEQ ID NO: 3925421 - DNA, 20 bp, Homo sapiens
atatggaaccttccctccaa

SEQ ID NO: 3925422 - DNA, 20 bp, Homo sapiens
atatggaacttctaatatat

SEQ ID NO: 3925423 - DNA, 14 bp, Homo sapiens
atatgggactgagc

SEQ ID NO: 3925424 - DNA, 14 bp, Homo sapiens
atatgtaaaataaa

SEQ ID NO: 3925425 - DNA, 15 bp, Homo sapiens
atatgtaaaataaaa

SEQ ID NO: 3925426 - DNA, 16 bp, Homo sapiens
atatgtagactatata

SEQ ID NO: 3925427 - DNA, 18 bp, Homo sapiens
atatgtagactatataca

SEQ ID NO: 3925428 - DNA, 21 bp, Homo sapiens
atatgtagactatatacatgt

SEQ ID NO: 3925429 - DNA, 17 bp, Homo sapiens
atatgtagccctcatga

SEQ ID NO: 3925430 - DNA, 13 bp, Homo sapiens
atatgtatatata

SEQ ID NO: 3925431 - DNA, 15 bp, Homo sapiens
atatgtatttattgt

SEQ ID NO: 3925432 - DNA, 18 bp, Homo sapiens
atatgtatttattgtcat

SEQ ID NO: 3925433 - DNA, 12 bp, Homo sapiens
atatgtctgcca

SEQ ID NO: 3925434 - DNA, 15 bp, Homo sapiens
atatgtctgcttctg

SEQ ID NO: 3925435 - DNA, 22 bp, Homo sapiens
atatgtgtatatatacatacac

SEQ ID NO: 3925436 - DNA, 20 bp, Homo sapiens
atatgtgtgtttaaataaag

SEQ ID NO: 3925437 - DNA, 16 bp, Homo sapiens
atatgttcaactggag

SEQ ID NO: 3925438 - DNA, 14 bp, Homo sapiens
atatgttgtaataa

SEQ ID NO: 3925439 - DNA, 16 bp, Homo sapiens
atatgttgttaaacac

SEQ ID NO: 3925440 - DNA, 14 bp, Homo sapiens
atattaaaggagtt

SEQ ID NO: 3925441 - DNA, 15 bp, Homo sapiens
atattaaagtgttat

SEQ ID NO: 3925442 - DNA, 17 bp, Homo sapiens
atattaaagtgttatac

SEQ ID NO: 3925443 - DNA, 12 bp, Homo sapiens
atattaaataca

SEQ ID NO: 3925444 - DNA, 22 bp, Homo sapiens
atattaatttttgaaacccatt

SEQ ID NO: 3925445 - DNA, 12 bp, Homo sapiens
atattaccaaaa

SEQ ID NO: 3925446 - DNA, 18 bp, Homo sapiens
atattaggggatggagag

SEQ ID NO: 3925447 - DNA, 18 bp, Homo sapiens
atattataaataaatgcc

SEQ ID NO: 3925448 - DNA, 16 bp, Homo sapiens
atattatggaagattt

SEQ ID NO: 3925449 - DNA, 16 bp, Homo sapiens
atattatggtgtaatg

SEQ ID NO: 3925450 - DNA, 15 bp, Homo sapiens
atcctttttctttat

SEQ ID NO: 3925451 - DNA, 18 bp, Homo sapiens
atcctttttctttataaa

SEQ ID NO: 3925452 - DNA, 13 bp, Homo sapiens
atccttttttaaa

SEQ ID NO: 3925453 - DNA, 16 bp, Homo sapiens
atccttttttaaaagt

SEQ ID NO: 3925454 - DNA, 17 bp, Homo sapiens
atcgaaaattcatttca

SEQ ID NO: 3925455 - DNA, 13 bp, Homo sapiens
atcgaacaaactg

SEQ ID NO: 3925456 - DNA, 12 bp, Homo sapiens
atcgactttata

SEQ ID NO: 3925457 - DNA, 19 bp, Homo sapiens
atcgactttatacagaact

SEQ ID NO: 3925458 - DNA, 15 bp, Homo sapiens
atcgcttgagcccag

SEQ ID NO: 3925459 - DNA, 17 bp, Homo sapiens
atcgcttgagcccagga

SEQ ID NO: 3925460 - DNA, 16 bp, Homo sapiens
atcggagcctcctctc

SEQ ID NO: 3925461 - DNA, 21 bp, Homo sapiens
atcggaggctgggcccctggg

SEQ ID NO: 3925462 - DNA, 18 bp, Homo sapiens
atcggaggtggtggagga

SEQ ID NO: 3925463 - DNA, 23 bp, Homo sapiens
atcggcccacagctcccacccca

SEQ ID NO: 3925464 - DNA, 21 bp, Homo sapiens
atcgtgacccttcagggccag

SEQ ID NO: 3925465 - DNA, 22 bp, Homo sapiens
atcgtgacccttcagggccaga

SEQ ID NO: 3925466 - DNA, 18 bp, Homo sapiens
atctaagctgcagcttcc

SEQ ID NO: 3925467 - DNA, 14 bp, Homo sapiens
atctaatattaaaa

SEQ ID NO: 3925468 - DNA, 19 bp, Homo sapiens
atctaatcaggttgttaat

SEQ ID NO: 3925469 - DNA, 20 bp, Homo sapiens
atctaatcaggttgttaatg

SEQ ID NO: 3925470 - DNA, 22 bp, Homo sapiens
atctaatgtaagaaaatttgaa

SEQ ID NO: 3925471 - DNA, 16 bp, Homo sapiens
atctaatgtctcttcc

SEQ ID NO: 3925472 - DNA, 21 bp, Homo sapiens
atctaatgtctcttcctctgt

SEQ ID NO: 3925473 - DNA, 12 bp, Homo sapiens
atctaatttata

SEQ ID NO: 3925474 - DNA, 15 bp, Homo sapiens
atctaatttatacaa

SEQ ID NO: 3925475 - DNA, 18 bp, Homo sapiens
atctaatttatacaaaat

SEQ ID NO: 3925476 - DNA, 16 bp, Homo sapiens
atctacagctcacctc

SEQ ID NO: 3925477 - DNA, 21 bp, Homo sapiens
atctacctcactattcaagta

SEQ ID NO: 3925478 - DNA, 14 bp, Homo sapiens
atctacctgccctc

SEQ ID NO: 3925479 - DNA, 17 bp, Homo sapiens
atctacctgccctctct

SEQ ID NO: 3925480 - DNA, 17 bp, Homo sapiens
atctagaaagaaaagac

SEQ ID NO: 3925481 - DNA, 18 bp, Homo sapiens
atctagaaagtgggttca

SEQ ID NO: 3925482 - DNA, 21 bp, Homo sapiens
atctagaacacaggcaaaatc

SEQ ID NO: 3925483 - DNA, 13 bp, Homo sapiens
atctagagatttt

SEQ ID NO: 3925484 - DNA, 22 bp, Homo sapiens
atctagatcaattaattcttaa

SEQ ID NO: 3925485 - DNA, 16 bp, Homo sapiens
atctagcttcatgcct

SEQ ID NO: 3925486 - DNA, 18 bp, Homo sapiens
atctagcttcatgcctca

SEQ ID NO: 3925487 - DNA, 20 bp, Homo sapiens
atctagcttcatgcctcagt

SEQ ID NO: 3925488 - DNA, 23 bp, Homo sapiens
atctatagtagtcaattagtaca

SEQ ID NO: 3925489 - DNA, 16 bp, Homo sapiens
atctatattaaagtgt

SEQ ID NO: 3925490 - DNA, 15 bp, Homo sapiens
atctatatttaacaa

SEQ ID NO: 3925491 - DNA, 17 bp, Homo sapiens
atctatcaatagtcaag

SEQ ID NO: 3925492 - DNA, 20 bp, Homo sapiens
atctatcaatagtcaagaaa

SEQ ID NO: 3925493 - DNA, 21 bp, Homo sapiens
atctatctgcctttacctaca

SEQ ID NO: 3925494 - DNA, 12 bp, Homo sapiens
atctatgcaatt

SEQ ID NO: 3925495 - DNA, 14 bp, Homo sapiens
atctatgcaatttt

SEQ ID NO: 3925496 - DNA, 17 bp, Homo sapiens
atctattcagacaagca

SEQ ID NO: 3925497 - DNA, 19 bp, Homo sapiens
atctcaaattctcaaccta

SEQ ID NO: 3925498 - DNA, 19 bp, Homo sapiens
atctcagaggctatagctg

SEQ ID NO: 3925499 - DNA, 15 bp, Homo sapiens
atctcaggtgccact

SEQ ID NO: 3925500 - DNA, 16 bp, Homo sapiens
atctcaggtgccactc

SEQ ID NO: 3925501 - DNA, 18 bp, Homo sapiens
atctcatacctctgacca

SEQ ID NO: 3925502 - DNA, 19 bp, Homo sapiens
atctcataggttgccaata

SEQ ID NO: 3925503 - DNA, 15 bp, Homo sapiens
atctccactccagat

SEQ ID NO: 3925504 - DNA, 15 bp, Homo sapiens
atctccagcatcctg

SEQ ID NO: 3925505 - DNA, 18 bp, Homo sapiens
atctccagtattcttgtc

SEQ ID NO: 3925506 - DNA, 12 bp, Homo sapiens
atctccatttca

SEQ ID NO: 3925507 - DNA, 15 bp, Homo sapiens
atctccccaggcctc

SEQ ID NO: 3925508 - DNA, 16 bp, Homo sapiens
atctccccaggcctcc

SEQ ID NO: 3925509 - DNA, 19 bp, Homo sapiens
atctccccaggcctccagc

SEQ ID NO: 3925510 - DNA, 23 bp, Homo sapiens
atctccccttgcactaaagtatg

SEQ ID NO: 3925511 - DNA, 19 bp, Homo sapiens
atctccctgccgcctcaat

SEQ ID NO: 3925512 - DNA, 18 bp, Homo sapiens
atctcctatttttcagaa

SEQ ID NO: 3925513 - DNA, 20 bp, Homo sapiens
atctcctatttttcagaatg

SEQ ID NO: 3925514 - DNA, 20 bp, Homo sapiens
atctcctcccatggccttcc

SEQ ID NO: 3925515 - DNA, 22 bp, Homo sapiens
atctcctcccatggccttccct

SEQ ID NO: 3925516 - DNA, 17 bp, Homo sapiens
atctccttcccctacac

SEQ ID NO: 3925517 - DNA, 16 bp, Homo sapiens
atctcgagccccctgg

SEQ ID NO: 3925518 - DNA, 13 bp, Homo sapiens
atctctaatatgg

SEQ ID NO: 3925519 - DNA, 15 bp, Homo sapiens
atctctaattggaag

SEQ ID NO: 3925520 - DNA, 13 bp, Homo sapiens
atctctatttaat

SEQ ID NO: 3925521 - DNA, 19 bp, Homo sapiens
atctctatttaatatttat

SEQ ID NO: 3925522 - DNA, 14 bp, Homo sapiens
atctctcaggagca

SEQ ID NO: 3925523 - DNA, 17 bp, Homo sapiens
atctctcaggagcacag

SEQ ID NO: 3925524 - DNA, 20 bp, Homo sapiens
atctctccacggtagcactt

SEQ ID NO: 3925525 - DNA, 20 bp, Homo sapiens
atctctcggttccacgtccc

SEQ ID NO: 3925526 - DNA, 19 bp, Homo sapiens
atctctctgcctatttatt

SEQ ID NO: 3925527 - DNA, 22 bp, Homo sapiens
atctctctgcctatttattggg

SEQ ID NO: 3925528 - DNA, 19 bp, Homo sapiens
atctcttcctgattcccca

SEQ ID NO: 3925529 - DNA, 16 bp, Homo sapiens
atctgaaagtatattt

SEQ ID NO: 3925530 - DNA, 13 bp, Homo sapiens
atctgaagctatt

SEQ ID NO: 3925531 - DNA, 20 bp, Homo sapiens
atctgaagcttcactcactg

SEQ ID NO: 3925532 - DNA, 19 bp, Homo sapiens
atctgacagttactcttca

SEQ ID NO: 3925533 - DNA, 18 bp, Homo sapiens
atctgagatctccctcca

SEQ ID NO: 3925534 - DNA, 17 bp, Homo sapiens
atctgagcaagagctgg

SEQ ID NO: 3925535 - DNA, 22 bp, Homo sapiens
atctgagcaagagctggcaaag

SEQ ID NO: 3925536 - DNA, 13 bp, Homo sapiens
atgctaaatgcaa

SEQ ID NO: 3925537 - DNA, 13 bp, Homo sapiens
atgctatctctgt

SEQ ID NO: 3925538 - DNA, 19 bp, Homo sapiens
atgctatttctggcctcag

SEQ ID NO: 3925539 - DNA, 22 bp, Homo sapiens
atgctatttctggcctcagcag

SEQ ID NO: 3925540 - DNA, 16 bp, Homo sapiens
atgctcaagtttttca

SEQ ID NO: 3925541 - DNA, 20 bp, Homo sapiens
atgctcaagtttttcagaaa

SEQ ID NO: 3925542 - DNA, 15 bp, Homo sapiens
atgctcacagtctca

SEQ ID NO: 3925543 - DNA, 13 bp, Homo sapiens
atgctcagccctg

SEQ ID NO: 3925544 - DNA, 18 bp, Homo sapiens
atgctcagccctgactgg

SEQ ID NO: 3925545 - DNA, 17 bp, Homo sapiens
atgctcccatctcctga

SEQ ID NO: 3925546 - DNA, 14 bp, Homo sapiens
atgctcgtgtgatt

SEQ ID NO: 3925547 - DNA, 16 bp, Homo sapiens
atgctcgtgtgatttc

SEQ ID NO: 3925548 - DNA, 12 bp, Homo sapiens
atgctctgcccc

SEQ ID NO: 3925549 - DNA, 23 bp, Homo sapiens
atgctctgtgcgagggttactat

SEQ ID NO: 3925550 - DNA, 19 bp, Homo sapiens
atgctgactgtactcctcc

SEQ ID NO: 3925551 - DNA, 20 bp, Homo sapiens
atgctgactgtactcctccc

SEQ ID NO: 3925552 - DNA, 21 bp, Homo sapiens
atgctgactgtactcctccca

SEQ ID NO: 3925553 - DNA, 21 bp, Homo sapiens
atgctgccccgttccctgtca

SEQ ID NO: 3925554 - DNA, 24 bp, Homo sapiens
atgctgccccgttccctgtcagag

SEQ ID NO: 3925555 - DNA, 15 bp, Homo sapiens
atgctggccagcacc

SEQ ID NO: 3925556 - DNA, 22 bp, Homo sapiens
atgctggcctcccaataaagct

SEQ ID NO: 3925557 - DNA, 19 bp, Homo sapiens
atgctgggtgttgcatttc

SEQ ID NO: 3925558 - DNA, 19 bp, Homo sapiens
atgctggtctaggagctgt

SEQ ID NO: 3925559 - DNA, 20 bp, Homo sapiens
atgctgtcaactatgatatg

SEQ ID NO: 3925560 - DNA, 22 bp, Homo sapiens
atgctgtcaactatgatatggt

SEQ ID NO: 3925561 - DNA, 16 bp, Homo sapiens
atgctgtgctctttga

SEQ ID NO: 3925562 - DNA, 13 bp, Homo sapiens
atgcttaaaatat

SEQ ID NO: 3925563 - DNA, 16 bp, Homo sapiens
atgcttaaaatatgta

SEQ ID NO: 3925564 - DNA, 23 bp, Homo sapiens
atgcttaaaatatgtatgtctaa

SEQ ID NO: 3925565 - DNA, 15 bp, Homo sapiens
atgcttacaaaaaag

SEQ ID NO: 3925566 - DNA, 19 bp, Homo sapiens
atgcttcaagtgttgctct

SEQ ID NO: 3925567 - DNA, 14 bp, Homo sapiens
atgcttcagttgta

SEQ ID NO: 3925568 - DNA, 17 bp, Homo sapiens
atgcttcagttgtactt

SEQ ID NO: 3925569 - DNA, 14 bp, Homo sapiens
atgcttctgttgta

SEQ ID NO: 3925570 - DNA, 15 bp, Homo sapiens
atgcttcttccttac

SEQ ID NO: 3925571 - DNA, 15 bp, Homo sapiens
atgctttccaaaacc

SEQ ID NO: 3925572 - DNA, 22 bp, Homo sapiens
atgctttccttttcttccttct

SEQ ID NO: 3925573 - DNA, 18 bp, Homo sapiens
atgctttgggaggccaag

SEQ ID NO: 3925574 - DNA, 19 bp, Homo sapiens
atgctttgggaggccaagg

SEQ ID NO: 3925575 - DNA, 22 bp, Homo sapiens
atgctttgtcttcagcctctcc

SEQ ID NO: 3925576 - DNA, 17 bp, Homo sapiens
atggaaaataaattata

SEQ ID NO: 3925577 - DNA, 14 bp, Homo sapiens
atggaaacagggca

SEQ ID NO: 3925578 - DNA, 17 bp, Homo sapiens
atggaaacagggcagtg

SEQ ID NO: 3925579 - DNA, 11 bp, Homo sapiens
atggaaagaat

SEQ ID NO: 3925580 - DNA, 16 bp, Homo sapiens
atggaacataaaatac

SEQ ID NO: 3925581 - DNA, 17 bp, Homo sapiens
atggaaccttccctcca

SEQ ID NO: 3925582 - DNA, 19 bp, Homo sapiens
atggaaccttccctccaaa

SEQ ID NO: 3925583 - DNA, 18 bp, Homo sapiens
atggaacttctaatatat

SEQ ID NO: 3925584 - DNA, 19 bp, Homo sapiens
atggaacttctaatatatt

SEQ ID NO: 3925585 - DNA, 12 bp, Homo sapiens
atggaagagaaa

SEQ ID NO: 3925586 - DNA, 13 bp, Homo sapiens
atggaagagaaat

SEQ ID NO: 3925587 - DNA, 15 bp, Homo sapiens
atggaagagaaatct

SEQ ID NO: 3925588 - DNA, 17 bp, Homo sapiens
atggaagagaaatctca

SEQ ID NO: 3925589 - DNA, 10 bp, Homo sapiens
atggaagtgt

SEQ ID NO: 3925590 - DNA, 15 bp, Homo sapiens
atggaatttgtaagt

SEQ ID NO: 3925591 - DNA, 17 bp, Homo sapiens
atggaatttgtaagttt

SEQ ID NO: 3925592 - DNA, 16 bp, Homo sapiens
atggacaatataaact

SEQ ID NO: 3925593 - DNA, 22 bp, Homo sapiens
atggacaatataaactgaaaaa

SEQ ID NO: 3925594 - DNA, 21 bp, Homo sapiens
atggacaccccttatccagga

SEQ ID NO: 3925595 - DNA, 13 bp, Homo sapiens
atggacccctccc

SEQ ID NO: 3925596 - DNA, 23 bp, Homo sapiens
atggaccctcgcagcaggtgcaa

SEQ ID NO: 3925597 - DNA, 22 bp, Homo sapiens
atggaccgggtgggcctggcct

SEQ ID NO: 3925598 - DNA, 21 bp, Homo sapiens
atggactaaccccaacgcaca

SEQ ID NO: 3925599 - DNA, 21 bp, Homo sapiens
atggactcatggcttagaaat

SEQ ID NO: 3925600 - DNA, 12 bp, Homo sapiens
atggacttcaaa

SEQ ID NO: 3925601 - DNA, 20 bp, Homo sapiens
atggacttttgggggttgga

SEQ ID NO: 3925602 - DNA, 13 bp, Homo sapiens
atggagaaggaag

SEQ ID NO: 3925603 - DNA, 14 bp, Homo sapiens
atggagaaggaagg

SEQ ID NO: 3925604 - DNA, 21 bp, Homo sapiens
atggagactggtcctgtgtgc

SEQ ID NO: 3925605 - DNA, 11 bp, Homo sapiens
atggagagaga

SEQ ID NO: 3925606 - DNA, 15 bp, Homo sapiens
atggagagccctggg

SEQ ID NO: 3925607 - DNA, 15 bp, Homo sapiens
atggagcctcttctg

SEQ ID NO: 3925608 - DNA, 13 bp, Homo sapiens
atggagcttgtac

SEQ ID NO: 3925609 - DNA, 22 bp, Homo sapiens
atggaggaaaaccaagccgtgg

SEQ ID NO: 3925610 - DNA, 15 bp, Homo sapiens
atggaggagaagaat

SEQ ID NO: 3925611 - DNA, 19 bp, Homo sapiens
atggaggcaggctccccct

SEQ ID NO: 3925612 - DNA, 12 bp, Homo sapiens
atggagggtggg

SEQ ID NO: 3925613 - DNA, 15 bp, Homo sapiens
atggatgctggggag

SEQ ID NO: 3925614 - DNA, 13 bp, Homo sapiens
atggatggacaga

SEQ ID NO: 3925615 - DNA, 17 bp, Homo sapiens
atggatggacagaatga

SEQ ID NO: 3925616 - DNA, 20 bp, Homo sapiens
atggatgtggggtccccatc

SEQ ID NO: 3925617 - DNA, 23 bp, Homo sapiens
atggcaagggggtgtcatctgag

SEQ ID NO: 3925618 - DNA, 14 bp, Homo sapiens
atggcaccagcccc

SEQ ID NO: 3925619 - DNA, 20 bp, Homo sapiens
atggcaccagccccctggat

SEQ ID NO: 3925620 - DNA, 19 bp, Homo sapiens
atggcagatgtaggaggga

SEQ ID NO: 3925621 - DNA, 21 bp, Homo sapiens
atggcagatgtaggagggact

SEQ ID NO: 3925622 - DNA, 19 bp, Homo sapiens
atggcagctagactggagt

SEQ ID NO: 3925623 - DNA, 19 bp, Homo sapiens
attacctcctgtgtggaag

SEQ ID NO: 3925624 - DNA, 14 bp, Homo sapiens
attacgtgagccag

SEQ ID NO: 3925625 - DNA, 20 bp, Homo sapiens
attacgtgagccaggtaatg

SEQ ID NO: 3925626 - DNA, 13 bp, Homo sapiens
attactctttctc

SEQ ID NO: 3925627 - DNA, 17 bp, Homo sapiens
attacttatttttgaca

SEQ ID NO: 3925628 - DNA, 18 bp, Homo sapiens
attacttatttttgacag

SEQ ID NO: 3925629 - DNA, 19 bp, Homo sapiens
attacttatttttgacagt

SEQ ID NO: 3925630 - DNA, 18 bp, Homo sapiens
attacttgcacaagcttg

SEQ ID NO: 3925631 - DNA, 15 bp, Homo sapiens
attactttaatactc

SEQ ID NO: 3925632 - DNA, 23 bp, Homo sapiens
attagaaactgaaaactgtaaat

SEQ ID NO: 3925633 - DNA, 19 bp, Homo sapiens
attagaacaggcaagtgaa

SEQ ID NO: 3925634 - DNA, 23 bp, Homo sapiens
attagaacaggcaagtgaagaaa

SEQ ID NO: 3925635 - DNA, 15 bp, Homo sapiens
attagcacctctttt

SEQ ID NO: 3925636 - DNA, 16 bp, Homo sapiens
attagctgtaaataca

SEQ ID NO: 3925637 - DNA, 16 bp, Homo sapiens
attagctgtgtgaaat

SEQ ID NO: 3925638 - DNA, 21 bp, Homo sapiens
attaggaggctcaacaataaa

SEQ ID NO: 3925639 - DNA, 22 bp, Homo sapiens
attaggaggctcaacaataaaa

SEQ ID NO: 3925640 - DNA, 17 bp, Homo sapiens
attaggatctatgcaat

SEQ ID NO: 3925641 - DNA, 18 bp, Homo sapiens
attaggtactatctgtga

SEQ ID NO: 3925642 - DNA, 19 bp, Homo sapiens
attaggtactatctgtgaa

SEQ ID NO: 3925643 - DNA, 21 bp, Homo sapiens
attagtacagtagcttaaata

SEQ ID NO: 3925644 - DNA, 12 bp, Homo sapiens
attataaaacca

SEQ ID NO: 3925645 - DNA, 15 bp, Homo sapiens
attataaataaatgc

SEQ ID NO: 3925646 - DNA, 15 bp, Homo sapiens
attataacttaaaat

SEQ ID NO: 3925647 - DNA, 13 bp, Homo sapiens
attataatgaatt

SEQ ID NO: 3925648 - DNA, 23 bp, Homo sapiens
attatataggttgtgcaaattaa

SEQ ID NO: 3925649 - DNA, 23 bp, Homo sapiens
attatatagtaatgcactctcag

SEQ ID NO: 3925650 - DNA, 22 bp, Homo sapiens
attatatagtataccatacatt

SEQ ID NO: 3925651 - DNA, 20 bp, Homo sapiens
attatatctaatttatacaa

SEQ ID NO: 3925652 - DNA, 21 bp, Homo sapiens
attatatctaatttatacaaa

SEQ ID NO: 3925653 - DNA, 13 bp, Homo sapiens
attatattaaaat

SEQ ID NO: 3925654 - DNA, 16 bp, Homo sapiens
attatcatgggaaaag

SEQ ID NO: 3925655 - DNA, 18 bp, Homo sapiens
attatctcaaaactgcac

SEQ ID NO: 3925656 - DNA, 22 bp, Homo sapiens
attatctgatcgggataacaaa

SEQ ID NO: 3925657 - DNA, 13 bp, Homo sapiens
attatgcactggc

SEQ ID NO: 3925658 - DNA, 15 bp, Homo sapiens
attatggtgtaatgc

SEQ ID NO: 3925659 - DNA, 19 bp, Homo sapiens
attatggtgtaatgcacaa

SEQ ID NO: 3925660 - DNA, 17 bp, Homo sapiens
attatgtatgtttacat

SEQ ID NO: 3925661 - DNA, 11 bp, Homo sapiens
attatgtgtgc

SEQ ID NO: 3925662 - DNA, 13 bp, Homo sapiens
attatgtgtgcat

SEQ ID NO: 3925663 - DNA, 21 bp, Homo sapiens
attatgtgtgcatgtgtgtat

SEQ ID NO: 3925664 - DNA, 23 bp, Homo sapiens
attattaataaattttaacattt

SEQ ID NO: 3925665 - DNA, 18 bp, Homo sapiens
attattaataccaaatat

SEQ ID NO: 3925666 - DNA, 13 bp, Homo sapiens
attattcatttaa

SEQ ID NO: 3925667 - DNA, 19 bp, Homo sapiens
attattcatttaaaatgat

SEQ ID NO: 3925668 - DNA, 12 bp, Homo sapiens
attattcttcag

SEQ ID NO: 3925669 - DNA, 21 bp, Homo sapiens
attattgagctctatttcccc

SEQ ID NO: 3925670 - DNA, 13 bp, Homo sapiens
attattgctgttg

SEQ ID NO: 3925671 - DNA, 14 bp, Homo sapiens
attattttaaacaa

SEQ ID NO: 3925672 - DNA, 17 bp, Homo sapiens
attattttcattacaat

SEQ ID NO: 3925673 - DNA, 16 bp, Homo sapiens
attattttctatagct

SEQ ID NO: 3925674 - DNA, 17 bp, Homo sapiens
attattttctatagctc

SEQ ID NO: 3925675 - DNA, 17 bp, Homo sapiens
attattttgttgtgatt

SEQ ID NO: 3925676 - DNA, 22 bp, Homo sapiens
attatttttatacaccattgtt

SEQ ID NO: 3925677 - DNA, 18 bp, Homo sapiens
attatttttgtgtttcta

SEQ ID NO: 3925678 - DNA, 16 bp, Homo sapiens
attcaaacagtctcag

SEQ ID NO: 3925679 - DNA, 18 bp, Homo sapiens
attcaaacagtctcagga

SEQ ID NO: 3925680 - DNA, 19 bp, Homo sapiens
attcaaacagtctcaggaa

SEQ ID NO: 3925681 - DNA, 18 bp, Homo sapiens
attcaaaccatttaattc

SEQ ID NO: 3925682 - DNA, 19 bp, Homo sapiens
attcaaaccatttaattca

SEQ ID NO: 3925683 - DNA, 14 bp, Homo sapiens
attcaaagagacta

SEQ ID NO: 3925684 - DNA, 17 bp, Homo sapiens
attcaaagctctattaa

SEQ ID NO: 3925685 - DNA, 21 bp, Homo sapiens
attcaacacattacttgcaca

SEQ ID NO: 3925686 - DNA, 15 bp, Homo sapiens
attcaagaaacagaa

SEQ ID NO: 3925687 - DNA, 21 bp, Homo sapiens
attcaaggcatttctatcaca

SEQ ID NO: 3925688 - DNA, 12 bp, Homo sapiens
attcaagtgcct

SEQ ID NO: 3925689 - DNA, 21 bp, Homo sapiens
attcaagtgcctcttgttgca

SEQ ID NO: 3925690 - DNA, 16 bp, Homo sapiens
attcaagttattgtac

SEQ ID NO: 3925691 - DNA, 12 bp, Homo sapiens
attcaataaaaa

SEQ ID NO: 3925692 - DNA, 18 bp, Homo sapiens
attcaataaaaaaaagaa

SEQ ID NO: 3925693 - DNA, 22 bp, Homo sapiens
attcaataaaaaaaagaaatga

SEQ ID NO: 3925694 - DNA, 12 bp, Homo sapiens
attcaataaagc

SEQ ID NO: 3925695 - DNA, 14 bp, Homo sapiens
attcacaatagaaa

SEQ ID NO: 3925696 - DNA, 22 bp, Homo sapiens
attcacaatgaaatgctctcct

SEQ ID NO: 3925697 - DNA, 18 bp, Homo sapiens
attcacacagggctcttt

SEQ ID NO: 3925698 - DNA, 23 bp, Homo sapiens
attcacatcactgattgggtgcc

SEQ ID NO: 3925699 - DNA, 19 bp, Homo sapiens
attcacatttgatgtacat

SEQ ID NO: 3925700 - DNA, 14 bp, Homo sapiens
attcactattagag

SEQ ID NO: 3925701 - DNA, 19 bp, Homo sapiens
attcactattagagaaaca

SEQ ID NO: 3925702 - DNA, 12 bp, Homo sapiens
attcactcccac

SEQ ID NO: 3925703 - DNA, 14 bp, Homo sapiens
attcactgtaagtt

SEQ ID NO: 3925704 - DNA, 15 bp, Homo sapiens
attcagaagcatcac

SEQ ID NO: 3925705 - DNA, 13 bp, Homo sapiens
attcagacaagca

SEQ ID NO: 3925706 - DNA, 15 bp, Homo sapiens
attcagcacacccca

SEQ ID NO: 3925707 - DNA, 18 bp, Homo sapiens
attcagcacaccccaagg

SEQ ID NO: 3925708 - DNA, 20 bp, Homo sapiens
attcagcaccctgggtgcca

SEQ ID NO: 3925709 - DNA, 14 bp, Homo sapiens
attcagcactgatt

SEQ ID NO: 3925710 - DNA, 13 bp, Homo sapiens
atttcacattaat

SEQ ID NO: 3925711 - DNA, 21 bp, Homo sapiens
atttcacattaatatttgctg

SEQ ID NO: 3925712 - DNA, 22 bp, Homo sapiens
atttcacattaatatttgctga

SEQ ID NO: 3925713 - DNA, 22 bp, Homo sapiens
atttcagagaggccttttggaa

SEQ ID NO: 3925714 - DNA, 18 bp, Homo sapiens
atttcagattcccagagc

SEQ ID NO: 3925715 - DNA, 19 bp, Homo sapiens
atttcaggcattttgttct

SEQ ID NO: 3925716 - DNA, 20 bp, Homo sapiens
atttcaggttttgtaaagat

SEQ ID NO: 3925717 - DNA, 21 bp, Homo sapiens
atttcaggttttgtaaagatg

SEQ ID NO: 3925718 - DNA, 12 bp, Homo sapiens
atttcataaaga

SEQ ID NO: 3925719 - DNA, 19 bp, Homo sapiens
atttcatccagtttgttct

SEQ ID NO: 3925720 - DNA, 22 bp, Homo sapiens
atttcattttttgcatcagtat

SEQ ID NO: 3925721 - DNA, 17 bp, Homo sapiens
atttccaaataaaatga

SEQ ID NO: 3925722 - DNA, 12 bp, Homo sapiens
atttccaggccc

SEQ ID NO: 3925723 - DNA, 13 bp, Homo sapiens
atttcccacaccc

SEQ ID NO: 3925724 - DNA, 23 bp, Homo sapiens
atttcccttgaaattttaaacta

SEQ ID NO: 3925725 - DNA, 18 bp, Homo sapiens
atttcctattttaaaacc

SEQ ID NO: 3925726 - DNA, 20 bp, Homo sapiens
atttcctattttaaaaccat

SEQ ID NO: 3925727 - DNA, 23 bp, Homo sapiens
atttcctattttaaaaccatgca

SEQ ID NO: 3925728 - DNA, 22 bp, Homo sapiens
atttcctcaacgttgctcccca

SEQ ID NO: 3925729 - DNA, 24 bp, Homo sapiens
atttcctcaacgttgctccccatc

SEQ ID NO: 3925730 - DNA, 14 bp, Homo sapiens
atttcctccatggt

SEQ ID NO: 3925731 - DNA, 17 bp, Homo sapiens
atttctaacatatgtat

SEQ ID NO: 3925732 - DNA, 20 bp, Homo sapiens
atttctaacatatgtattaa

SEQ ID NO: 3925733 - DNA, 19 bp, Homo sapiens
atttctacatagtaactct

SEQ ID NO: 3925734 - DNA, 17 bp, Homo sapiens
atttctaccatttcaga

SEQ ID NO: 3925735 - DNA, 22 bp, Homo sapiens
atttctatcttgaatttcatgc

SEQ ID NO: 3925736 - DNA, 23 bp, Homo sapiens
atttctattcaaggtggccaaat

SEQ ID NO: 3925737 - DNA, 18 bp, Homo sapiens
atttctcaatcagtgcag

SEQ ID NO: 3925738 - DNA, 17 bp, Homo sapiens
atttctcctactttaca

SEQ ID NO: 3925739 - DNA, 18 bp, Homo sapiens
atttctcgggtgcatttg

SEQ ID NO: 3925740 - DNA, 18 bp, Homo sapiens
atttctctgagcagtcag

SEQ ID NO: 3925741 - DNA, 20 bp, Homo sapiens
atttctgctcttccaaagct

SEQ ID NO: 3925742 - DNA, 15 bp, Homo sapiens
atttctggcctcagc

SEQ ID NO: 3925743 - DNA, 15 bp, Homo sapiens
atttcttatgatttt

SEQ ID NO: 3925744 - DNA, 18 bp, Homo sapiens
atttcttttaaagaagta

SEQ ID NO: 3925745 - DNA, 18 bp, Homo sapiens
atttctttttttaaattg

SEQ ID NO: 3925746 - DNA, 16 bp, Homo sapiens
atttgaagcaaagcac

SEQ ID NO: 3925747 - DNA, 16 bp, Homo sapiens
atttgaagtaaaggat

SEQ ID NO: 3925748 - DNA, 14 bp, Homo sapiens
atttgaatggtgca

SEQ ID NO: 3925749 - DNA, 23 bp, Homo sapiens
atttgacaaaatttgttgaaatt

SEQ ID NO: 3925750 - DNA, 13 bp, Homo sapiens
atttgagcaattc

SEQ ID NO: 3925751 - DNA, 14 bp, Homo sapiens
atttgagcatgcac

SEQ ID NO: 3925752 - DNA, 15 bp, Homo sapiens
atttgagcatgcaca

SEQ ID NO: 3925753 - DNA, 14 bp, Homo sapiens
atttgatacaaaat

SEQ ID NO: 3925754 - DNA, 15 bp, Homo sapiens
atttgatgtacatgt

SEQ ID NO: 3925755 - DNA, 17 bp, Homo sapiens
atttgatgtacatgtgt

SEQ ID NO: 3925756 - DNA, 21 bp, Homo sapiens
atttgattgtaaaaacaaaaa

SEQ ID NO: 3925757 - DNA, 13 bp, Homo sapiens
atttgccagcaca

SEQ ID NO: 3925758 - DNA, 14 bp, Homo sapiens
atttgccctgtgga

SEQ ID NO: 3925759 - DNA, 20 bp, Homo sapiens
atttgctttcttttctccca

SEQ ID NO: 3925760 - DNA, 14 bp, Homo sapiens
atttggagtgtgta

SEQ ID NO: 3925761 - DNA, 21 bp, Homo sapiens
atttggggcttgcatgccaaa

SEQ ID NO: 3925762 - DNA, 23 bp, Homo sapiens
atttgtaaaagaacagtaaacat

SEQ ID NO: 3925763 - DNA, 22 bp, Homo sapiens
atttgtaagtttatgtctaaag

SEQ ID NO: 3925764 - DNA, 15 bp, Homo sapiens
atttgtaattgctta

SEQ ID NO: 3925765 - DNA, 20 bp, Homo sapiens
atttgtaattgcttacattt

SEQ ID NO: 3925766 - DNA, 18 bp, Homo sapiens
atttgtacagttcagttc

SEQ ID NO: 3925767 - DNA, 21 bp, Homo sapiens
atttgtacatagttatttatt

SEQ ID NO: 3925768 - DNA, 23 bp, Homo sapiens
atttgtactgaaaaatggtaatt

SEQ ID NO: 3925769 - DNA, 14 bp, Homo sapiens
atttgtatatcatg

SEQ ID NO: 3925770 - DNA, 16 bp, Homo sapiens
atttgtatatcatgaa

SEQ ID NO: 3925771 - DNA, 13 bp, Homo sapiens
atttgtggtcaca

SEQ ID NO: 3925772 - DNA, 13 bp, Homo sapiens
atttgtgtaatag

SEQ ID NO: 3925773 - DNA, 21 bp, Homo sapiens
atttgtgtaatagaaaactga

SEQ ID NO: 3925774 - DNA, 18 bp, Homo sapiens
atttgttatttgtacagt

SEQ ID NO: 3925775 - DNA, 17 bp, Homo sapiens
atttgttattttcagta

SEQ ID NO: 3925776 - DNA, 17 bp, Homo sapiens
atttgttcccaagagca

SEQ ID NO: 3925777 - DNA, 14 bp, Homo sapiens
atttgttgaaatta

SEQ ID NO: 3925778 - DNA, 20 bp, Homo sapiens
atttgttgaaattatgtatg

SEQ ID NO: 3925779 - DNA, 16 bp, Homo sapiens
atttgtttacatgcag

SEQ ID NO: 3925780 - DNA, 16 bp, Homo sapiens
attttaaaaaatgaaa

SEQ ID NO: 3925781 - DNA, 23 bp, Homo sapiens
attttaaaaaatgaaaataagtg

SEQ ID NO: 3925782 - DNA, 19 bp, Homo sapiens
attttaaaaccatgcagct

SEQ ID NO: 3925783 - DNA, 23 bp, Homo sapiens
attttaaaaccatgcagcttcat

SEQ ID NO: 3925784 - DNA, 20 bp, Homo sapiens
attttaaaagcaattatatt

SEQ ID NO: 3925785 - DNA, 13 bp, Homo sapiens
attttaaaatctg

SEQ ID NO: 3925786 - DNA, 16 bp, Homo sapiens
attttaaaatctgatt

SEQ ID NO: 3925787 - DNA, 22 bp, Homo sapiens
attttaaattataacttaaaat

SEQ ID NO: 3925788 - DNA, 19 bp, Homo sapiens
attttaacaaaagaagatt

SEQ ID NO: 3925789 - DNA, 13 bp, Homo sapiens
attttaacatttt

SEQ ID NO: 3925790 - DNA, 14 bp, Homo sapiens
attttaagcttgaa

SEQ ID NO: 3925791 - DNA, 15 bp, Homo sapiens
attttaatattttgt

SEQ ID NO: 3925792 - DNA, 18 bp, Homo sapiens
attttacagagaatctga

SEQ ID NO: 3925793 - DNA, 21 bp, Homo sapiens
attttacctgggatatgacaa

SEQ ID NO: 3925794 - DNA, 18 bp, Homo sapiens
attttagggctgtagact

SEQ ID NO: 3925795 - DNA, 21 bp, Homo sapiens
attttatacatagtcacaaaa

SEQ ID NO: 3925796 - DNA, 19 bp, Homo sapiens
caagagggcactggtggcc

SEQ ID NO: 3925797 - DNA, 15 bp, Homo sapiens
caagataactgagaa

SEQ ID NO: 3925798 - DNA, 19 bp, Homo sapiens
caagatgagagaactggag

SEQ ID NO: 3925799 - DNA, 21 bp, Homo sapiens
caagatggaggggctgactca

SEQ ID NO: 3925800 - DNA, 15 bp, Homo sapiens
caagattcccagaga

SEQ ID NO: 3925801 - DNA, 19 bp, Homo sapiens
caagattcccagagacagg

SEQ ID NO: 3925802 - DNA, 17 bp, Homo sapiens
caagattttccacaaga

SEQ ID NO: 3925803 - DNA, 18 bp, Homo sapiens
caagattttccacaagat

SEQ ID NO: 3925804 - DNA, 21 bp, Homo sapiens
caagattttttttgtaacttc

SEQ ID NO: 3925805 - DNA, 17 bp, Homo sapiens
caagcacctgcagattc

SEQ ID NO: 3925806 - DNA, 16 bp, Homo sapiens
caagcactaaaaagtg

SEQ ID NO: 3925807 - DNA, 15 bp, Homo sapiens
caagcagcattcagc

SEQ ID NO: 3925808 - DNA, 11 bp, Homo sapiens
caagcagccag

SEQ ID NO: 3925809 - DNA, 14 bp, Homo sapiens
caagcagccagcca

SEQ ID NO: 3925810 - DNA, 15 bp, Homo sapiens
caagcagccagccag

SEQ ID NO: 3925811 - DNA, 16 bp, Homo sapiens
caagcagccagccagt

SEQ ID NO: 3925812 - DNA, 16 bp, Homo sapiens
caagcagccgcagcgc

SEQ ID NO: 3925813 - DNA, 19 bp, Homo sapiens
caagcagggaaagctccac

SEQ ID NO: 3925814 - DNA, 15 bp, Homo sapiens
caagcagggctctgc

SEQ ID NO: 3925815 - DNA, 22 bp, Homo sapiens
caagcatgcaataatgtgcaaa

SEQ ID NO: 3925816 - DNA, 22 bp, Homo sapiens
caagcatggtcccacatccctg

SEQ ID NO: 3925817 - DNA, 23 bp, Homo sapiens
caagcatggtcccacatccctgg

SEQ ID NO: 3925818 - DNA, 23 bp, Homo sapiens
caagcattgcttcagaatgaatt

SEQ ID NO: 3925819 - DNA, 17 bp, Homo sapiens
caagcatttgccctgtg

SEQ ID NO: 3925820 - DNA, 15 bp, Homo sapiens
caagccaacttgtaa

SEQ ID NO: 3925821 - DNA, 18 bp, Homo sapiens
caagccaacttgtaaata

SEQ ID NO: 3925822 - DNA, 19 bp, Homo sapiens
caagccatggtgacacaca

SEQ ID NO: 3925823 - DNA, 16 bp, Homo sapiens
caagccccagggcctg

SEQ ID NO: 3925824 - DNA, 19 bp, Homo sapiens
caagcccctcagcccttgc

SEQ ID NO: 3925825 - DNA, 12 bp, Homo sapiens
caagccctggca

SEQ ID NO: 3925826 - DNA, 13 bp, Homo sapiens
caagccctggcaa

SEQ ID NO: 3925827 - DNA, 21 bp, Homo sapiens
caagccggccccccctctttt

SEQ ID NO: 3925828 - DNA, 16 bp, Homo sapiens
caagccgtggcttccc

SEQ ID NO: 3925829 - DNA, 13 bp, Homo sapiens
caagcctctgccc

SEQ ID NO: 3925830 - DNA, 15 bp, Homo sapiens
caagcctctgcccca

SEQ ID NO: 3925831 - DNA, 12 bp, Homo sapiens
caagcctggtct

SEQ ID NO: 3925832 - DNA, 13 bp, Homo sapiens
caagcctggtctc

SEQ ID NO: 3925833 - DNA, 16 bp, Homo sapiens
caagcctggtctcctc

SEQ ID NO: 3925834 - DNA, 19 bp, Homo sapiens
caagcctggtctcctccca

SEQ ID NO: 3925835 - DNA, 13 bp, Homo sapiens
caagcctgtggga

SEQ ID NO: 3925836 - DNA, 14 bp, Homo sapiens
caagcctgtgggag

SEQ ID NO: 3925837 - DNA, 16 bp, Homo sapiens
caagccttactcacct

SEQ ID NO: 3925838 - DNA, 19 bp, Homo sapiens
caagccttactcacctctc

SEQ ID NO: 3925839 - DNA, 20 bp, Homo sapiens
caagccttactcacctctct

SEQ ID NO: 3925840 - DNA, 18 bp, Homo sapiens
caagcgattctcatgtct

SEQ ID NO: 3925841 - DNA, 22 bp, Homo sapiens
caagcgattcttgtgcctcagc

SEQ ID NO: 3925842 - DNA, 15 bp, Homo sapiens
caagcgcagggagga

SEQ ID NO: 3925843 - DNA, 21 bp, Homo sapiens
caagcgcagggaggatgccac

SEQ ID NO: 3925844 - DNA, 18 bp, Homo sapiens
caagcgtgcagcttgttc

SEQ ID NO: 3925845 - DNA, 18 bp, Homo sapiens
caagctagaaggccacat

SEQ ID NO: 3925846 - DNA, 14 bp, Homo sapiens
caagctcaaccttg

SEQ ID NO: 3925847 - DNA, 16 bp, Homo sapiens
caagctcacagttcct

SEQ ID NO: 3925848 - DNA, 21 bp, Homo sapiens
caagctcacagttcctcgccc

SEQ ID NO: 3925849 - DNA, 21 bp, Homo sapiens
caagctccatctccactccag

SEQ ID NO: 3925850 - DNA, 13 bp, Homo sapiens
caagctgaagtga

SEQ ID NO: 3925851 - DNA, 15 bp, Homo sapiens
caagctgaggtgccc

SEQ ID NO: 3925852 - DNA, 18 bp, Homo sapiens
caagctgaggtgcccagg

SEQ ID NO: 3925853 - DNA, 21 bp, Homo sapiens
caagctgaggtgcccaggaga

SEQ ID NO: 3925854 - DNA, 12 bp, Homo sapiens
caagctgtcccc

SEQ ID NO: 3925855 - DNA, 16 bp, Homo sapiens
caagctgtcccctctg

SEQ ID NO: 3925856 - DNA, 13 bp, Homo sapiens
caagctgttccac

SEQ ID NO: 3925857 - DNA, 14 bp, Homo sapiens
caagctgttttctt

SEQ ID NO: 3925858 - DNA, 17 bp, Homo sapiens
caagcttcaagtgatat

SEQ ID NO: 3925859 - DNA, 13 bp, Homo sapiens
caagcttcagagc

SEQ ID NO: 3925860 - DNA, 14 bp, Homo sapiens
caagcttcagagcc

SEQ ID NO: 3925861 - DNA, 16 bp, Homo sapiens
caagcttcagagccta

SEQ ID NO: 3925862 - DNA, 19 bp, Homo sapiens
caagcttcagagcctagcc

SEQ ID NO: 3925863 - DNA, 21 bp, Homo sapiens
caagcttcagagcctagccac

SEQ ID NO: 3925864 - DNA, 16 bp, Homo sapiens
caagcttgtatataca

SEQ ID NO: 3925865 - DNA, 17 bp, Homo sapiens
caagcttgtatatacat

SEQ ID NO: 3925866 - DNA, 19 bp, Homo sapiens
caagcttgtatatacatat

SEQ ID NO: 3925867 - DNA, 18 bp, Homo sapiens
caagcttgtgagagctgg

SEQ ID NO: 3925868 - DNA, 12 bp, Homo sapiens
caagctttcttc

SEQ ID NO: 3925869 - DNA, 23 bp, Homo sapiens
caagctttcttctacaaccagag

SEQ ID NO: 3925870 - DNA, 22 bp, Homo sapiens
caagctttgaatacccccagag

SEQ ID NO: 3925871 - DNA, 23 bp, Homo sapiens
caagctttgaatacccccagaga

SEQ ID NO: 3925872 - DNA, 17 bp, Homo sapiens
caaggaaaataatagga

SEQ ID NO: 3925873 - DNA, 20 bp, Homo sapiens
caaggacaacctgcccctcc

SEQ ID NO: 3925874 - DNA, 20 bp, Homo sapiens
caaggaccctgttttccaca

SEQ ID NO: 3925875 - DNA, 18 bp, Homo sapiens
caaggaccgtttttacta

SEQ ID NO: 3925876 - DNA, 16 bp, Homo sapiens
caaggagaaacagaga

SEQ ID NO: 3925877 - DNA, 20 bp, Homo sapiens
caaggagaaacagagacagg

SEQ ID NO: 3925878 - DNA, 23 bp, Homo sapiens
caaggagatataaaatctagatc

SEQ ID NO: 3925879 - DNA, 23 bp, Homo sapiens
caaggagctgatttccaggcccc

SEQ ID NO: 3925880 - DNA, 12 bp, Homo sapiens
caaggaggaaaa

SEQ ID NO: 3925881 - DNA, 14 bp, Homo sapiens
caaggaggaaaaac

SEQ ID NO: 3925882 - DNA, 18 bp, Homo sapiens
caaggagtaagtacaaat

SEQ ID NO: 3925883 - DNA, 22 bp, Homo sapiens
cacatatacaaaagcaagactt

SEQ ID NO: 3925884 - DNA, 23 bp, Homo sapiens
cacatatacctataatgtgtgta

SEQ ID NO: 3925885 - DNA, 21 bp, Homo sapiens
cacatccacacacgcaggaac

SEQ ID NO: 3925886 - DNA, 13 bp, Homo sapiens
cacatccattccc

SEQ ID NO: 3925887 - DNA, 21 bp, Homo sapiens
cacatccattcccaagaaatg

SEQ ID NO: 3925888 - DNA, 16 bp, Homo sapiens
cacatcccggcctctt

SEQ ID NO: 3925889 - DNA, 19 bp, Homo sapiens
cacatccctgccctcctac

SEQ ID NO: 3925890 - DNA, 13 bp, Homo sapiens
cacatccctgggc

SEQ ID NO: 3925891 - DNA, 17 bp, Homo sapiens
cacatccctgggcctgc

SEQ ID NO: 3925892 - DNA, 16 bp, Homo sapiens
cacatcttctcagtgt

SEQ ID NO: 3925893 - DNA, 14 bp, Homo sapiens
cacatctttcctgt

SEQ ID NO: 3925894 - DNA, 17 bp, Homo sapiens
cacatgacgtaaaattt

SEQ ID NO: 3925895 - DNA, 20 bp, Homo sapiens
cacatgaggagggtgccctc

SEQ ID NO: 3925896 - DNA, 15 bp, Homo sapiens
cacatggatgagcac

SEQ ID NO: 3925897 - DNA, 12 bp, Homo sapiens
cacatgtcaccg

SEQ ID NO: 3925898 - DNA, 20 bp, Homo sapiens
cacatgtcaccgtggacctt

SEQ ID NO: 3925899 - DNA, 17 bp, Homo sapiens
cacattaagtggctttt

SEQ ID NO: 3925900 - DNA, 18 bp, Homo sapiens
cacattaatggtctaaaa

SEQ ID NO: 3925901 - DNA, 16 bp, Homo sapiens
cacattacttgcacaa

SEQ ID NO: 3925902 - DNA, 17 bp, Homo sapiens
cacattagactatccat

SEQ ID NO: 3925903 - DNA, 14 bp, Homo sapiens
cacattctcctgtg

SEQ ID NO: 3925904 - DNA, 16 bp, Homo sapiens
cacattctcctgtgcc

SEQ ID NO: 3925905 - DNA, 19 bp, Homo sapiens
cacattctcctgtgcccct

SEQ ID NO: 3925906 - DNA, 21 bp, Homo sapiens
cacatttacctcgaggctctt

SEQ ID NO: 3925907 - DNA, 18 bp, Homo sapiens
cacatttatatatatatg

SEQ ID NO: 3925908 - DNA, 20 bp, Homo sapiens
cacatttatatatatatgta

SEQ ID NO: 3925909 - DNA, 16 bp, Homo sapiens
cacatttgatgtacat

SEQ ID NO: 3925910 - DNA, 19 bp, Homo sapiens
caccaacccatcagaagga

SEQ ID NO: 3925911 - DNA, 19 bp, Homo sapiens
caccaagctcacagttcct

SEQ ID NO: 3925912 - DNA, 17 bp, Homo sapiens
caccaatgtacccaccg

SEQ ID NO: 3925913 - DNA, 23 bp, Homo sapiens
caccaatgtacccaccgggccac

SEQ ID NO: 3925914 - DNA, 21 bp, Homo sapiens
caccacactccccgcctgtcc

SEQ ID NO: 3925915 - DNA, 11 bp, Homo sapiens
caccacccaaa

SEQ ID NO: 3925916 - DNA, 16 bp, Homo sapiens
caccacctcactcctg

SEQ ID NO: 3925917 - DNA, 17 bp, Homo sapiens
caccacctcactcctgt

SEQ ID NO: 3925918 - DNA, 13 bp, Homo sapiens
caccaccttccca

SEQ ID NO: 3925919 - DNA, 14 bp, Homo sapiens
caccaccttcccag

SEQ ID NO: 3925920 - DNA, 16 bp, Homo sapiens
caccaccttcccagct

SEQ ID NO: 3925921 - DNA, 18 bp, Homo sapiens
caccaccttggactcctc

SEQ ID NO: 3925922 - DNA, 19 bp, Homo sapiens
caccaccttggactcctcc

SEQ ID NO: 3925923 - DNA, 13 bp, Homo sapiens
caccacgaatttg

SEQ ID NO: 3925924 - DNA, 18 bp, Homo sapiens
caccacgatgtggccctg

SEQ ID NO: 3925925 - DNA, 20 bp, Homo sapiens
caccacggcgtttttttaca

SEQ ID NO: 3925926 - DNA, 20 bp, Homo sapiens
caccacgtctgccaggccca

SEQ ID NO: 3925927 - DNA, 13 bp, Homo sapiens
caccactccattc

SEQ ID NO: 3925928 - DNA, 16 bp, Homo sapiens
caccactgccctgcct

SEQ ID NO: 3925929 - DNA, 17 bp, Homo sapiens
caccactgccctgcctg

SEQ ID NO: 3925930 - DNA, 21 bp, Homo sapiens
caccagaggctgcagaaggcc

SEQ ID NO: 3925931 - DNA, 12 bp, Homo sapiens
caccagagtgaa

SEQ ID NO: 3925932 - DNA, 22 bp, Homo sapiens
caccagccccctggatgggcat

SEQ ID NO: 3925933 - DNA, 15 bp, Homo sapiens
caccagcccggcctg

SEQ ID NO: 3925934 - DNA, 23 bp, Homo sapiens
caccagcctggtgcccatcctcc

SEQ ID NO: 3925935 - DNA, 13 bp, Homo sapiens
caccagctctgtg

SEQ ID NO: 3925936 - DNA, 15 bp, Homo sapiens
caccagctctgtggc

SEQ ID NO: 3925937 - DNA, 23 bp, Homo sapiens
caccagctctgtggcctgtgtcc

SEQ ID NO: 3925938 - DNA, 17 bp, Homo sapiens
caccagcttctccaggc

SEQ ID NO: 3925939 - DNA, 23 bp, Homo sapiens
caccaggaatgttaaagtcagtg

SEQ ID NO: 3925940 - DNA, 20 bp, Homo sapiens
caccaggcacgaacccacct

SEQ ID NO: 3925941 - DNA, 22 bp, Homo sapiens
caccaggcacgaacccacctgc

SEQ ID NO: 3925942 - DNA, 23 bp, Homo sapiens
caccaggcacgaacccacctgct

SEQ ID NO: 3925943 - DNA, 24 bp, Homo sapiens
caccaggcacgaacccacctgctg

SEQ ID NO: 3925944 - DNA, 21 bp, Homo sapiens
caccagggtccgcaccagctg

SEQ ID NO: 3925945 - DNA, 23 bp, Homo sapiens
caccagggtccgcaccagctgct

SEQ ID NO: 3925946 - DNA, 24 bp, Homo sapiens
caccagggtccgcaccagctgctc

SEQ ID NO: 3925947 - DNA, 16 bp, Homo sapiens
caccagtgtcccctcc

SEQ ID NO: 3925948 - DNA, 20 bp, Homo sapiens
caccatcaccctctgggcag

SEQ ID NO: 3925949 - DNA, 15 bp, Homo sapiens
caccatcctgcagcc

SEQ ID NO: 3925950 - DNA, 13 bp, Homo sapiens
caccatcctgctg

SEQ ID NO: 3925951 - DNA, 14 bp, Homo sapiens
caccatgccaggct

SEQ ID NO: 3925952 - DNA, 15 bp, Homo sapiens
caccatggaggcagg

SEQ ID NO: 3925953 - DNA, 18 bp, Homo sapiens
caccatgtttgagctcag

SEQ ID NO: 3925954 - DNA, 22 bp, Homo sapiens
caccatgtttgagctcagaccc

SEQ ID NO: 3925955 - DNA, 23 bp, Homo sapiens
caccatgtttgagctcagacccc

SEQ ID NO: 3925956 - DNA, 21 bp, Homo sapiens
caccattcacatttgatgtac

SEQ ID NO: 3925957 - DNA, 17 bp, Homo sapiens
cacccaaagcatggact

SEQ ID NO: 3925958 - DNA, 15 bp, Homo sapiens
cacccacctccaccc

SEQ ID NO: 3925959 - DNA, 16 bp, Homo sapiens
cacccacgtgagagaa

SEQ ID NO: 3925960 - DNA, 13 bp, Homo sapiens
cacccactcacca

SEQ ID NO: 3925961 - DNA, 13 bp, Homo sapiens
cacccactggcca

SEQ ID NO: 3925962 - DNA, 15 bp, Homo sapiens
cacccactggccagt

SEQ ID NO: 3925963 - DNA, 17 bp, Homo sapiens
cacccactggccagtcc

SEQ ID NO: 3925964 - DNA, 18 bp, Homo sapiens
cacccactggccagtcct

SEQ ID NO: 3925965 - DNA, 20 bp, Homo sapiens
cacccagagggtagggcagc

SEQ ID NO: 3925966 - DNA, 12 bp, Homo sapiens
cacccagcccat

SEQ ID NO: 3925967 - DNA, 13 bp, Homo sapiens
cacccagcccatt

SEQ ID NO: 3925968 - DNA, 20 bp, Homo sapiens
cacccaggcaggccctgcct

SEQ ID NO: 3925969 - DNA, 15 bp, Homo sapiens
cactgccaggcacct

SEQ ID NO: 3925970 - DNA, 20 bp, Homo sapiens
cactgccaggcacctggcct

SEQ ID NO: 3925971 - DNA, 14 bp, Homo sapiens
cactgccatgcctc

SEQ ID NO: 3925972 - DNA, 11 bp, Homo sapiens
cactgccctgc

SEQ ID NO: 3925973 - DNA, 15 bp, Homo sapiens
cactgccctgcctgc

SEQ ID NO: 3925974 - DNA, 18 bp, Homo sapiens
cactgccctgcctgccca

SEQ ID NO: 3925975 - DNA, 20 bp, Homo sapiens
cactgccctgcctgcccact

SEQ ID NO: 3925976 - DNA, 18 bp, Homo sapiens
cactgctgcaccagagtg

SEQ ID NO: 3925977 - DNA, 16 bp, Homo sapiens
cactgctttccagcct

SEQ ID NO: 3925978 - DNA, 18 bp, Homo sapiens
cactggagtgcagggagg

SEQ ID NO: 3925979 - DNA, 11 bp, Homo sapiens
cactggccaga

SEQ ID NO: 3925980 - DNA, 17 bp, Homo sapiens
cactggccagagagggc

SEQ ID NO: 3925981 - DNA, 12 bp, Homo sapiens
cactggccagtc

SEQ ID NO: 3925982 - DNA, 18 bp, Homo sapiens
cactggccagtcctagag

SEQ ID NO: 3925983 - DNA, 13 bp, Homo sapiens
cactggccccacc

SEQ ID NO: 3925984 - DNA, 14 bp, Homo sapiens
cactggccccaccc

SEQ ID NO: 3925985 - DNA, 14 bp, Homo sapiens
cactggctccacat

SEQ ID NO: 3925986 - DNA, 20 bp, Homo sapiens
cactgggtctcactcctgag

SEQ ID NO: 3925987 - DNA, 20 bp, Homo sapiens
cactggtagaccaaaataaa

SEQ ID NO: 3925988 - DNA, 22 bp, Homo sapiens
cactggtgactgcgatcttcag

SEQ ID NO: 3925989 - DNA, 21 bp, Homo sapiens
cactggtggcccgacagcctg

SEQ ID NO: 3925990 - DNA, 23 bp, Homo sapiens
cactggtggcccgacagcctggc

SEQ ID NO: 3925991 - DNA, 21 bp, Homo sapiens
cactggttaaaataaagccta

SEQ ID NO: 3925992 - DNA, 19 bp, Homo sapiens
cactgtaaacccctgggta

SEQ ID NO: 3925993 - DNA, 19 bp, Homo sapiens
cactgtaaatatccacaga

SEQ ID NO: 3925994 - DNA, 14 bp, Homo sapiens
cactgtaagtttat

SEQ ID NO: 3925995 - DNA, 15 bp, Homo sapiens
cactgtaagtttatt

SEQ ID NO: 3925996 - DNA, 22 bp, Homo sapiens
cactgtaagtttattttttcta

SEQ ID NO: 3925997 - DNA, 16 bp, Homo sapiens
cactgtaatcttaaaa

SEQ ID NO: 3925998 - DNA, 11 bp, Homo sapiens
cactgtacata

SEQ ID NO: 3925999 - DNA, 14 bp, Homo sapiens
cactgtcaagatga

SEQ ID NO: 3926000 - DNA, 20 bp, Homo sapiens
cactgtcaccctccacctct

SEQ ID NO: 3926001 - DNA, 22 bp, Homo sapiens
cactgtcagagctgttggcctc

SEQ ID NO: 3926002 - DNA, 16 bp, Homo sapiens
cactgtccctcaaatg

SEQ ID NO: 3926003 - DNA, 16 bp, Homo sapiens
cactgtccgcctctgc

SEQ ID NO: 3926004 - DNA, 13 bp, Homo sapiens
cactgtcctggct

SEQ ID NO: 3926005 - DNA, 13 bp, Homo sapiens
cactgtctcaact

SEQ ID NO: 3926006 - DNA, 14 bp, Homo sapiens
cactgtcttcacaa

SEQ ID NO: 3926007 - DNA, 15 bp, Homo sapiens
cactgtggccagagc

SEQ ID NO: 3926008 - DNA, 18 bp, Homo sapiens
cactgtggccagagctgg

SEQ ID NO: 3926009 - DNA, 20 bp, Homo sapiens
cactgtggccagagctggaa

SEQ ID NO: 3926010 - DNA, 22 bp, Homo sapiens
cactgtggccagagctggaagg

SEQ ID NO: 3926011 - DNA, 23 bp, Homo sapiens
cactgtggccagagctggaaggc

SEQ ID NO: 3926012 - DNA, 14 bp, Homo sapiens
cactgttgaaaatt

SEQ ID NO: 3926013 - DNA, 17 bp, Homo sapiens
cactgttgaaaattatt

SEQ ID NO: 3926014 - DNA, 18 bp, Homo sapiens
cactgttgaaaattattt

SEQ ID NO: 3926015 - DNA, 19 bp, Homo sapiens
cactgtttaactgggagtg

SEQ ID NO: 3926016 - DNA, 19 bp, Homo sapiens
cacttagaaattgcatttc

SEQ ID NO: 3926017 - DNA, 20 bp, Homo sapiens
cacttagaaattgcatttcc

SEQ ID NO: 3926018 - DNA, 15 bp, Homo sapiens
cacttagcccaagag

SEQ ID NO: 3926019 - DNA, 22 bp, Homo sapiens
cacttagccgtccatggcacca

SEQ ID NO: 3926020 - DNA, 15 bp, Homo sapiens
cacttagctatcaga

SEQ ID NO: 3926021 - DNA, 15 bp, Homo sapiens
cacttataccaaagg

SEQ ID NO: 3926022 - DNA, 22 bp, Homo sapiens
cacttattatgaggctattaaa

SEQ ID NO: 3926023 - DNA, 15 bp, Homo sapiens
cacttcactgtgagg

SEQ ID NO: 3926024 - DNA, 16 bp, Homo sapiens
cacttcaggctcttct

SEQ ID NO: 3926025 - DNA, 20 bp, Homo sapiens
cacttcaggctcttctcctt

SEQ ID NO: 3926026 - DNA, 23 bp, Homo sapiens
cacttcaggctcttctcctttca

SEQ ID NO: 3926027 - DNA, 19 bp, Homo sapiens
cacttccaggagcccagag

SEQ ID NO: 3926028 - DNA, 12 bp, Homo sapiens
cacttccagtgt

SEQ ID NO: 3926029 - DNA, 20 bp, Homo sapiens
cacttccagtgttggctgtg

SEQ ID NO: 3926030 - DNA, 13 bp, Homo sapiens
cacttctatgcaa

SEQ ID NO: 3926031 - DNA, 14 bp, Homo sapiens
cacttctcaggaca

SEQ ID NO: 3926032 - DNA, 21 bp, Homo sapiens
cacttctcaggacacaggcct

SEQ ID NO: 3926033 - DNA, 23 bp, Homo sapiens
cacttctcaggacacaggcctgt

SEQ ID NO: 3926034 - DNA, 19 bp, Homo sapiens
cacttcttaaaggcctgga

SEQ ID NO: 3926035 - DNA, 21 bp, Homo sapiens
cacttcttaaaggcctggaac

SEQ ID NO: 3926036 - DNA, 17 bp, Homo sapiens
cacttcttgaaacagcc

SEQ ID NO: 3926037 - DNA, 20 bp, Homo sapiens
cacttcttgaaacagcctgg

SEQ ID NO: 3926038 - DNA, 13 bp, Homo sapiens
cacttgacattcc

SEQ ID NO: 3926039 - DNA, 14 bp, Homo sapiens
cacttgacattcct

SEQ ID NO: 3926040 - DNA, 16 bp, Homo sapiens
cacttgcgtcctgcag

SEQ ID NO: 3926041 - DNA, 17 bp, Homo sapiens
cacttgcgtcctgcaga

SEQ ID NO: 3926042 - DNA, 23 bp, Homo sapiens
cacttgcgtcctgcagaggacca

SEQ ID NO: 3926043 - DNA, 14 bp, Homo sapiens
cacttggaaaggtt

SEQ ID NO: 3926044 - DNA, 14 bp, Homo sapiens
cacttggagcccgt

SEQ ID NO: 3926045 - DNA, 18 bp, Homo sapiens
cacttggagcccgtgcag

SEQ ID NO: 3926046 - DNA, 20 bp, Homo sapiens
cacttggggcaccttgctcc

SEQ ID NO: 3926047 - DNA, 22 bp, Homo sapiens
cacttggggtcaccaccctccc

SEQ ID NO: 3926048 - DNA, 23 bp, Homo sapiens
cacttggggtcaccaccctcccc

SEQ ID NO: 3926049 - DNA, 16 bp, Homo sapiens
cacttgggtcttccct

SEQ ID NO: 3926050 - DNA, 17 bp, Homo sapiens
cacttgtacaaaataaa

SEQ ID NO: 3926051 - DNA, 20 bp, Homo sapiens
cacttgtataaatgtatata

SEQ ID NO: 3926052 - DNA, 22 bp, Homo sapiens
cacttgttccttctgcttctcc

SEQ ID NO: 3926053 - DNA, 18 bp, Homo sapiens
cactttaagagagaaatc

SEQ ID NO: 3926054 - DNA, 12 bp, Homo sapiens
cactttcagagt

SEQ ID NO: 3926055 - DNA, 19 bp, Homo sapiens
cagagggccaagagagaca

SEQ ID NO: 3926056 - DNA, 13 bp, Homo sapiens
cagagggctaggg

SEQ ID NO: 3926057 - DNA, 14 bp, Homo sapiens
cagaggggcagccg

SEQ ID NO: 3926058 - DNA, 18 bp, Homo sapiens
cagaggtaaaagtgtgag

SEQ ID NO: 3926059 - DNA, 17 bp, Homo sapiens
cagaggtgagcagagga

SEQ ID NO: 3926060 - DNA, 17 bp, Homo sapiens
cagaggtggccagagct

SEQ ID NO: 3926061 - DNA, 15 bp, Homo sapiens
cagagtataggatgg

SEQ ID NO: 3926062 - DNA, 12 bp, Homo sapiens
cagagtctgagc

SEQ ID NO: 3926063 - DNA, 13 bp, Homo sapiens
cagagtctgagcc

SEQ ID NO: 3926064 - DNA, 20 bp, Homo sapiens
cagagtgacatccaggagga

SEQ ID NO: 3926065 - DNA, 17 bp, Homo sapiens
cagagtggagccctcag

SEQ ID NO: 3926066 - DNA, 17 bp, Homo sapiens
cagagtgtgcagactga

SEQ ID NO: 3926067 - DNA, 19 bp, Homo sapiens
cagagtgtgggaagggaga

SEQ ID NO: 3926068 - DNA, 21 bp, Homo sapiens
cagagttattgaatcttaatt

SEQ ID NO: 3926069 - DNA, 17 bp, Homo sapiens
cagataaagacagctga

SEQ ID NO: 3926070 - DNA, 16 bp, Homo sapiens
cagataatcagcctct

SEQ ID NO: 3926071 - DNA, 17 bp, Homo sapiens
cagataatcagcctctt

SEQ ID NO: 3926072 - DNA, 18 bp, Homo sapiens
cagataatcagcctctta

SEQ ID NO: 3926073 - DNA, 16 bp, Homo sapiens
cagatacatggggaac

SEQ ID NO: 3926074 - DNA, 20 bp, Homo sapiens
cagatagacagtgctgccct

SEQ ID NO: 3926075 - DNA, 23 bp, Homo sapiens
cagatataaatggctggttttta

SEQ ID NO: 3926076 - DNA, 15 bp, Homo sapiens
cagatatacacatgg

SEQ ID NO: 3926077 - DNA, 18 bp, Homo sapiens
cagatatacacatggatg

SEQ ID NO: 3926078 - DNA, 14 bp, Homo sapiens
cagatatatttttc

SEQ ID NO: 3926079 - DNA, 16 bp, Homo sapiens
cagatatatttttcac

SEQ ID NO: 3926080 - DNA, 18 bp, Homo sapiens
cagatatgcacacacatg

SEQ ID NO: 3926081 - DNA, 17 bp, Homo sapiens
cagatcccatccatcag

SEQ ID NO: 3926082 - DNA, 23 bp, Homo sapiens
cagatcccatccatcagctccct

SEQ ID NO: 3926083 - DNA, 15 bp, Homo sapiens
cagatcgatcctgga

SEQ ID NO: 3926084 - DNA, 15 bp, Homo sapiens
cagatcgtattaatt

SEQ ID NO: 3926085 - DNA, 16 bp, Homo sapiens
cagatcgtattaatta

SEQ ID NO: 3926086 - DNA, 17 bp, Homo sapiens
cagatcgtattaattat

SEQ ID NO: 3926087 - DNA, 14 bp, Homo sapiens
cagatctgaacaca

SEQ ID NO: 3926088 - DNA, 13 bp, Homo sapiens
cagatctgcctgg

SEQ ID NO: 3926089 - DNA, 15 bp, Homo sapiens
cagatctgcctgggc

SEQ ID NO: 3926090 - DNA, 16 bp, Homo sapiens
cagatctgcctgggcc

SEQ ID NO: 3926091 - DNA, 19 bp, Homo sapiens
cagatctgcctgggcctgt

SEQ ID NO: 3926092 - DNA, 20 bp, Homo sapiens
cagatctgcctgggcctgtg

SEQ ID NO: 3926093 - DNA, 22 bp, Homo sapiens
cagatctgcctgggcctgtgca

SEQ ID NO: 3926094 - DNA, 14 bp, Homo sapiens
cagatcttgacagt

SEQ ID NO: 3926095 - DNA, 17 bp, Homo sapiens
cagatgataaatattta

SEQ ID NO: 3926096 - DNA, 18 bp, Homo sapiens
cagatgatctctccacgg

SEQ ID NO: 3926097 - DNA, 12 bp, Homo sapiens
cagatgctgggg

SEQ ID NO: 3926098 - DNA, 15 bp, Homo sapiens
cagatggaggtgcca

SEQ ID NO: 3926099 - DNA, 15 bp, Homo sapiens
cagatggtcacacag

SEQ ID NO: 3926100 - DNA, 20 bp, Homo sapiens
cagatgtgggctttgatttc

SEQ ID NO: 3926101 - DNA, 23 bp, Homo sapiens
cagatgttgaatgcccacaggca

SEQ ID NO: 3926102 - DNA, 18 bp, Homo sapiens
cagattcctgggcctgtc

SEQ ID NO: 3926103 - DNA, 12 bp, Homo sapiens
cagattctgatt

SEQ ID NO: 3926104 - DNA, 17 bp, Homo sapiens
cagatttagtgaaagct

SEQ ID NO: 3926105 - DNA, 20 bp, Homo sapiens
cagatttgctaatttatcct

SEQ ID NO: 3926106 - DNA, 19 bp, Homo sapiens
cagatttttgggctccact

SEQ ID NO: 3926107 - DNA, 19 bp, Homo sapiens
cagattttttacagctgcc

SEQ ID NO: 3926108 - DNA, 20 bp, Homo sapiens
cagattttttttggactgtt

SEQ ID NO: 3926109 - DNA, 16 bp, Homo sapiens
cagcaacacaagctgg

SEQ ID NO: 3926110 - DNA, 17 bp, Homo sapiens
cagcaacacaagctgga

SEQ ID NO: 3926111 - DNA, 18 bp, Homo sapiens
cagcaacatctcgagccc

SEQ ID NO: 3926112 - DNA, 23 bp, Homo sapiens
cagcaacgcaggcccccaggtgc

SEQ ID NO: 3926113 - DNA, 15 bp, Homo sapiens
cagcaaggcccgagc

SEQ ID NO: 3926114 - DNA, 13 bp, Homo sapiens
cagcacaccccaa

SEQ ID NO: 3926115 - DNA, 13 bp, Homo sapiens
cagcacaggggcc

SEQ ID NO: 3926116 - DNA, 14 bp, Homo sapiens
cagcacaggggccc

SEQ ID NO: 3926117 - DNA, 16 bp, Homo sapiens
cagcacaggggcccca

SEQ ID NO: 3926118 - DNA, 22 bp, Homo sapiens
cagcacaggggccccagatctg

SEQ ID NO: 3926119 - DNA, 16 bp, Homo sapiens
cagcacccaggctcca

SEQ ID NO: 3926120 - DNA, 20 bp, Homo sapiens
cagcacccaggctccatggg

SEQ ID NO: 3926121 - DNA, 16 bp, Homo sapiens
cagcacccctgtctct

SEQ ID NO: 3926122 - DNA, 16 bp, Homo sapiens
cagcaccctctcctgg

SEQ ID NO: 3926123 - DNA, 18 bp, Homo sapiens
cagcaccctctcctgggg

SEQ ID NO: 3926124 - DNA, 13 bp, Homo sapiens
cagcaccctgggt

SEQ ID NO: 3926125 - DNA, 17 bp, Homo sapiens
cagcaccctgggtgcca

SEQ ID NO: 3926126 - DNA, 14 bp, Homo sapiens
cagcactgaaaata

SEQ ID NO: 3926127 - DNA, 15 bp, Homo sapiens
cagcacttggctcct

SEQ ID NO: 3926128 - DNA, 21 bp, Homo sapiens
cagcactttaaccctctcttc

SEQ ID NO: 3926129 - DNA, 24 bp, Homo sapiens
cagcactttaaccctctcttccct

SEQ ID NO: 3926130 - DNA, 12 bp, Homo sapiens
cagcagaaaagt

SEQ ID NO: 3926131 - DNA, 15 bp, Homo sapiens
cagcagaaaagtgct

SEQ ID NO: 3926132 - DNA, 18 bp, Homo sapiens
cagcagaaaagtgcttag

SEQ ID NO: 3926133 - DNA, 22 bp, Homo sapiens
cagcagaaaagtgcttagaaag

SEQ ID NO: 3926134 - DNA, 18 bp, Homo sapiens
cagcagatggaaagaaag

SEQ ID NO: 3926135 - DNA, 15 bp, Homo sapiens
cagcagcactgcaga

SEQ ID NO: 3926136 - DNA, 11 bp, Homo sapiens
cagcagccagc

SEQ ID NO: 3926137 - DNA, 19 bp, Homo sapiens
cagcagccagccctgcctg

SEQ ID NO: 3926138 - DNA, 12 bp, Homo sapiens
cagcagcccagc

SEQ ID NO: 3926139 - DNA, 13 bp, Homo sapiens
cagcagcccccca

SEQ ID NO: 3926140 - DNA, 15 bp, Homo sapiens
cagcagccccccagc

SEQ ID NO: 3926141 - DNA, 21 bp, Homo sapiens
cagcagccccccagcactaag

SEQ ID NO: 3926142 - DNA, 18 bp, Homo sapiens
cagcttaacattgacttc

SEQ ID NO: 3926143 - DNA, 21 bp, Homo sapiens
cagcttatgggatccttgtct

SEQ ID NO: 3926144 - DNA, 13 bp, Homo sapiens
cagcttcctgtca

SEQ ID NO: 3926145 - DNA, 12 bp, Homo sapiens
cagcttctccag

SEQ ID NO: 3926146 - DNA, 13 bp, Homo sapiens
cagcttctccagg

SEQ ID NO: 3926147 - DNA, 14 bp, Homo sapiens
cagcttctccaggc

SEQ ID NO: 3926148 - DNA, 18 bp, Homo sapiens
cagcttgaaactgagatg

SEQ ID NO: 3926149 - DNA, 15 bp, Homo sapiens
cagcttgaccagacc

SEQ ID NO: 3926150 - DNA, 16 bp, Homo sapiens
cagcttgaccagacct

SEQ ID NO: 3926151 - DNA, 15 bp, Homo sapiens
cagcttgctcttcag

SEQ ID NO: 3926152 - DNA, 23 bp, Homo sapiens
cagcttgctcttcagtgggagaa

SEQ ID NO: 3926153 - DNA, 15 bp, Homo sapiens
cagcttgtagccagc

SEQ ID NO: 3926154 - DNA, 17 bp, Homo sapiens
cagcttgtagccagccg

SEQ ID NO: 3926155 - DNA, 18 bp, Homo sapiens
cagcttgtagccagccgg

SEQ ID NO: 3926156 - DNA, 18 bp, Homo sapiens
cagctttacacacacaga

SEQ ID NO: 3926157 - DNA, 21 bp, Homo sapiens
cagctttacatgcaatttatt

SEQ ID NO: 3926158 - DNA, 18 bp, Homo sapiens
cagctttatctgtcacac

SEQ ID NO: 3926159 - DNA, 15 bp, Homo sapiens
cagctttcagagcca

SEQ ID NO: 3926160 - DNA, 16 bp, Homo sapiens
cagctttttgtctttt

SEQ ID NO: 3926161 - DNA, 19 bp, Homo sapiens
cagctttttgtcttttctg

SEQ ID NO: 3926162 - DNA, 21 bp, Homo sapiens
caggaaaaaaaaaaaaaagac

SEQ ID NO: 3926163 - DNA, 22 bp, Homo sapiens
caggaaaacaaatcactgtatt

SEQ ID NO: 3926164 - DNA, 13 bp, Homo sapiens
caggaaaaggcct

SEQ ID NO: 3926165 - DNA, 17 bp, Homo sapiens
caggaaaaggcctgggg

SEQ ID NO: 3926166 - DNA, 17 bp, Homo sapiens
caggaaaatcctctggc

SEQ ID NO: 3926167 - DNA, 11 bp, Homo sapiens
caggaaagaat

SEQ ID NO: 3926168 - DNA, 14 bp, Homo sapiens
caggaaagccctcc

SEQ ID NO: 3926169 - DNA, 23 bp, Homo sapiens
caggaaagccctcccccttcccc

SEQ ID NO: 3926170 - DNA, 14 bp, Homo sapiens
caggaacagagact

SEQ ID NO: 3926171 - DNA, 18 bp, Homo sapiens
caggaacagagactctgg

SEQ ID NO: 3926172 - DNA, 19 bp, Homo sapiens
caggaacagagactctgga

SEQ ID NO: 3926173 - DNA, 16 bp, Homo sapiens
caggaacgagcactgg

SEQ ID NO: 3926174 - DNA, 19 bp, Homo sapiens
caggaacgagcactggcca

SEQ ID NO: 3926175 - DNA, 20 bp, Homo sapiens
caggaacgagcactggccag

SEQ ID NO: 3926176 - DNA, 14 bp, Homo sapiens
caggaactcccagc

SEQ ID NO: 3926177 - DNA, 16 bp, Homo sapiens
caggaactcccagcaa

SEQ ID NO: 3926178 - DNA, 13 bp, Homo sapiens
caggaactgggcc

SEQ ID NO: 3926179 - DNA, 18 bp, Homo sapiens
caggaagaaaccccaagc

SEQ ID NO: 3926180 - DNA, 19 bp, Homo sapiens
caggaagaaaccccaagca

SEQ ID NO: 3926181 - DNA, 21 bp, Homo sapiens
caggaagagagagagagaggt

SEQ ID NO: 3926182 - DNA, 12 bp, Homo sapiens
caggaaggcagc

SEQ ID NO: 3926183 - DNA, 15 bp, Homo sapiens
caggaaggcagctgc

SEQ ID NO: 3926184 - DNA, 16 bp, Homo sapiens
caggaaggcagctgct

SEQ ID NO: 3926185 - DNA, 19 bp, Homo sapiens
caggaaggcagctgctctt

SEQ ID NO: 3926186 - DNA, 18 bp, Homo sapiens
caggaagggggtccaccc

SEQ ID NO: 3926187 - DNA, 17 bp, Homo sapiens
caggaataggcatttgc

SEQ ID NO: 3926188 - DNA, 22 bp, Homo sapiens
caggaatatcccaaacttcgga

SEQ ID NO: 3926189 - DNA, 17 bp, Homo sapiens
caggacacaggcctgtg

SEQ ID NO: 3926190 - DNA, 20 bp, Homo sapiens
caggacacaggcctgtgtag

SEQ ID NO: 3926191 - DNA, 20 bp, Homo sapiens
caggacacatcccggcctct

SEQ ID NO: 3926192 - DNA, 13 bp, Homo sapiens
caggacacctgcc

SEQ ID NO: 3926193 - DNA, 17 bp, Homo sapiens
caggacatggggcatag

SEQ ID NO: 3926194 - DNA, 23 bp, Homo sapiens
caggacatggggcatagaaactg

SEQ ID NO: 3926195 - DNA, 19 bp, Homo sapiens
caggaccagtcccagagca

SEQ ID NO: 3926196 - DNA, 12 bp, Homo sapiens
caggacccaggc

SEQ ID NO: 3926197 - DNA, 17 bp, Homo sapiens
caggacccaggccctcc

SEQ ID NO: 3926198 - DNA, 18 bp, Homo sapiens
caggacccaggccctcca

SEQ ID NO: 3926199 - DNA, 16 bp, Homo sapiens
caggaccccaacccct

SEQ ID NO: 3926200 - DNA, 19 bp, Homo sapiens
caggacctccggggagagc

SEQ ID NO: 3926201 - DNA, 22 bp, Homo sapiens
caggacctccggggagagcaga

SEQ ID NO: 3926202 - DNA, 13 bp, Homo sapiens
caggaccttttga

SEQ ID NO: 3926203 - DNA, 17 bp, Homo sapiens
caggactaacactcaga

SEQ ID NO: 3926204 - DNA, 19 bp, Homo sapiens
caggactaacactcagaag

SEQ ID NO: 3926205 - DNA, 18 bp, Homo sapiens
caggactgaattgtcccc

SEQ ID NO: 3926206 - DNA, 15 bp, Homo sapiens
caggacttaaaatga

SEQ ID NO: 3926207 - DNA, 23 bp, Homo sapiens
caggacttaacggctccaggatt

SEQ ID NO: 3926208 - DNA, 20 bp, Homo sapiens
caggacttggtctgatttca

SEQ ID NO: 3926209 - DNA, 18 bp, Homo sapiens
caggagagccagccctcc

SEQ ID NO: 3926210 - DNA, 23 bp, Homo sapiens
caggagagccagccctccctgtc

SEQ ID NO: 3926211 - DNA, 17 bp, Homo sapiens
caggagcacaggcagct

SEQ ID NO: 3926212 - DNA, 21 bp, Homo sapiens
caggagcagacagagaaatgt

SEQ ID NO: 3926213 - DNA, 16 bp, Homo sapiens
caggagcaggaacaga

SEQ ID NO: 3926214 - DNA, 17 bp, Homo sapiens
caggagcaggaacagag

SEQ ID NO: 3926215 - DNA, 20 bp, Homo sapiens
caggagcaggaacagagact

SEQ ID NO: 3926216 - DNA, 23 bp, Homo sapiens
caggagcaggaacagagactctg

SEQ ID NO: 3926217 - DNA, 15 bp, Homo sapiens
caggagcccagaggg

SEQ ID NO: 3926218 - DNA, 16 bp, Homo sapiens
caggagcctgtgcctc

SEQ ID NO: 3926219 - DNA, 21 bp, Homo sapiens
caggagctgagtcacctcctc

SEQ ID NO: 3926220 - DNA, 16 bp, Homo sapiens
caggagctgctcctgg

SEQ ID NO: 3926221 - DNA, 20 bp, Homo sapiens
caggagctgctcctggctga

SEQ ID NO: 3926222 - DNA, 23 bp, Homo sapiens
caggaggaatcatgtcaggcctg

SEQ ID NO: 3926223 - DNA, 23 bp, Homo sapiens
caggaggccctggtgtcaggcag

SEQ ID NO: 3926224 - DNA, 14 bp, Homo sapiens
caggaggcctggcc

SEQ ID NO: 3926225 - DNA, 15 bp, Homo sapiens
caggaggcctggcct

SEQ ID NO: 3926226 - DNA, 18 bp, Homo sapiens
caggaggcgaataaatgt

SEQ ID NO: 3926227 - DNA, 20 bp, Homo sapiens
caggaggcgaataaatgttc

SEQ ID NO: 3926228 - DNA, 21 bp, Homo sapiens
cagggccccagaaggcaggga

SEQ ID NO: 3926229 - DNA, 14 bp, Homo sapiens
cagggcctggtgtg

SEQ ID NO: 3926230 - DNA, 22 bp, Homo sapiens
cagggcctggtgtgaggctggg

SEQ ID NO: 3926231 - DNA, 14 bp, Homo sapiens
cagggccttgccca

SEQ ID NO: 3926232 - DNA, 18 bp, Homo sapiens
cagggccttgcccagaga

SEQ ID NO: 3926233 - DNA, 19 bp, Homo sapiens
cagggccttgcccagagat

SEQ ID NO: 3926234 - DNA, 18 bp, Homo sapiens
cagggctccctcctggag

SEQ ID NO: 3926235 - DNA, 21 bp, Homo sapiens
cagggctccctcctggagcat

SEQ ID NO: 3926236 - DNA, 13 bp, Homo sapiens
cagggctctgccc

SEQ ID NO: 3926237 - DNA, 18 bp, Homo sapiens
cagggctggagtgcgctc

SEQ ID NO: 3926238 - DNA, 20 bp, Homo sapiens
cagggctggagtgcgctctt

SEQ ID NO: 3926239 - DNA, 17 bp, Homo sapiens
cagggcttttcccagga

SEQ ID NO: 3926240 - DNA, 18 bp, Homo sapiens
cagggcttttcccaggaa

SEQ ID NO: 3926241 - DNA, 14 bp, Homo sapiens
caggggaaaatgaa

SEQ ID NO: 3926242 - DNA, 15 bp, Homo sapiens
caggggaccacacct

SEQ ID NO: 3926243 - DNA, 20 bp, Homo sapiens
caggggagagggtctggaga

SEQ ID NO: 3926244 - DNA, 12 bp, Homo sapiens
caggggcaggcc

SEQ ID NO: 3926245 - DNA, 13 bp, Homo sapiens
caggggcaggcct

SEQ ID NO: 3926246 - DNA, 23 bp, Homo sapiens
caggggccccagatctgcctggg

SEQ ID NO: 3926247 - DNA, 24 bp, Homo sapiens
caggggccccagatctgcctgggc

SEQ ID NO: 3926248 - DNA, 15 bp, Homo sapiens
caggggctgctcatc

SEQ ID NO: 3926249 - DNA, 16 bp, Homo sapiens
cagggggtgtgtctgc

SEQ ID NO: 3926250 - DNA, 22 bp, Homo sapiens
caggggtatatttagaccctgt

SEQ ID NO: 3926251 - DNA, 13 bp, Homo sapiens
caggggtctgagc

SEQ ID NO: 3926252 - DNA, 18 bp, Homo sapiens
caggggtgcctgtggggg

SEQ ID NO: 3926253 - DNA, 17 bp, Homo sapiens
caggggtgggagagcca

SEQ ID NO: 3926254 - DNA, 13 bp, Homo sapiens
cagggtagcaggt

SEQ ID NO: 3926255 - DNA, 16 bp, Homo sapiens
cagggtagcaggtacc

SEQ ID NO: 3926256 - DNA, 17 bp, Homo sapiens
cagggtatcccagaccc

SEQ ID NO: 3926257 - DNA, 16 bp, Homo sapiens
cagggtccgcaccagc

SEQ ID NO: 3926258 - DNA, 17 bp, Homo sapiens
cagggtccgcaccagct

SEQ ID NO: 3926259 - DNA, 21 bp, Homo sapiens
cagggtccgcaccagctgctc

SEQ ID NO: 3926260 - DNA, 17 bp, Homo sapiens
cagggtcttgggctact

SEQ ID NO: 3926261 - DNA, 22 bp, Homo sapiens
cagggtcttgggctactggcag

SEQ ID NO: 3926262 - DNA, 17 bp, Homo sapiens
cagggtgaatcagatgg

SEQ ID NO: 3926263 - DNA, 21 bp, Homo sapiens
cagggtgagagctgctctgga

SEQ ID NO: 3926264 - DNA, 22 bp, Homo sapiens
cagggtgaggtgcttgccccca

SEQ ID NO: 3926265 - DNA, 23 bp, Homo sapiens
cagggtgttacaaggcacttgtc

SEQ ID NO: 3926266 - DNA, 18 bp, Homo sapiens
cagggttgatcacactct

SEQ ID NO: 3926267 - DNA, 21 bp, Homo sapiens
cagggttgatcacactctggg

SEQ ID NO: 3926268 - DNA, 15 bp, Homo sapiens
cagggttttgtattc

SEQ ID NO: 3926269 - DNA, 17 bp, Homo sapiens
caggtaaatgggcagtg

SEQ ID NO: 3926270 - DNA, 23 bp, Homo sapiens
caggtaaatgggcagtgcctcct

SEQ ID NO: 3926271 - DNA, 20 bp, Homo sapiens
caggtaatgagggactggaa

SEQ ID NO: 3926272 - DNA, 22 bp, Homo sapiens
caggtaatgagggactggaacc

SEQ ID NO: 3926273 - DNA, 23 bp, Homo sapiens
caggtaatgagggactggaacca

SEQ ID NO: 3926274 - DNA, 16 bp, Homo sapiens
caggtacttcctcctg

SEQ ID NO: 3926275 - DNA, 20 bp, Homo sapiens
caggtacttcctcctgatgg

SEQ ID NO: 3926276 - DNA, 19 bp, Homo sapiens
caggtagatcgcttgagcc

SEQ ID NO: 3926277 - DNA, 23 bp, Homo sapiens
caggtagatcgcttgagcccagg

SEQ ID NO: 3926278 - DNA, 13 bp, Homo sapiens
caggtaggccctt

SEQ ID NO: 3926279 - DNA, 20 bp, Homo sapiens
caggtaggcccttgtcctgc

SEQ ID NO: 3926280 - DNA, 15 bp, Homo sapiens
caggtatcaggcaca

SEQ ID NO: 3926281 - DNA, 17 bp, Homo sapiens
caggtatcaggcacagg

SEQ ID NO: 3926282 - DNA, 19 bp, Homo sapiens
caggtatcaggcacaggca

SEQ ID NO: 3926283 - DNA, 14 bp, Homo sapiens
caggtatctccagg

SEQ ID NO: 3926284 - DNA, 18 bp, Homo sapiens
caggtatctccaggattg

SEQ ID NO: 3926285 - DNA, 22 bp, Homo sapiens
caggtccctcctttggaccctg

SEQ ID NO: 3926286 - DNA, 22 bp, Homo sapiens
caggtcctctgatacccagagc

SEQ ID NO: 3926287 - DNA, 18 bp, Homo sapiens
caggtcctgcccatgtgt

SEQ ID NO: 3926288 - DNA, 14 bp, Homo sapiens
caggtcctggtggg

SEQ ID NO: 3926289 - DNA, 17 bp, Homo sapiens
caggtctagactttctc

SEQ ID NO: 3926290 - DNA, 14 bp, Homo sapiens
caggtgactggagc

SEQ ID NO: 3926291 - DNA, 14 bp, Homo sapiens
caggtgcaagagac

SEQ ID NO: 3926292 - DNA, 15 bp, Homo sapiens
caggtgcaagagaca

SEQ ID NO: 3926293 - DNA, 18 bp, Homo sapiens
caggtgcaagagacagag

SEQ ID NO: 3926294 - DNA, 19 bp, Homo sapiens
caggtgcaagagacagagc

SEQ ID NO: 3926295 - DNA, 23 bp, Homo sapiens
caggtgcaagagacagagccccc

SEQ ID NO: 3926296 - DNA, 16 bp, Homo sapiens
caggtgccaccaataa

SEQ ID NO: 3926297 - DNA, 17 bp, Homo sapiens
caggtgccaccaataaa

SEQ ID NO: 3926298 - DNA, 14 bp, Homo sapiens
caggtgccactccc

SEQ ID NO: 3926299 - DNA, 21 bp, Homo sapiens
caggtgccactccctgagctt

SEQ ID NO: 3926300 - DNA, 15 bp, Homo sapiens
caggtggcaggacca

SEQ ID NO: 3926301 - DNA, 17 bp, Homo sapiens
caggtggcaggaccagg

SEQ ID NO: 3926302 - DNA, 18 bp, Homo sapiens
caggtggcaggaccagga

SEQ ID NO: 3926303 - DNA, 20 bp, Homo sapiens
caggtggcaggaccaggact

SEQ ID NO: 3926304 - DNA, 15 bp, Homo sapiens
caggtggccactcca

SEQ ID NO: 3926305 - DNA, 20 bp, Homo sapiens
caggtggctgacccagtccc

SEQ ID NO: 3926306 - DNA, 14 bp, Homo sapiens
caggtgtaaatata

SEQ ID NO: 3926307 - DNA, 17 bp, Homo sapiens
caggtgtggtggctcat

SEQ ID NO: 3926308 - DNA, 20 bp, Homo sapiens
caggtgtggtgtaatttata

SEQ ID NO: 3926309 - DNA, 23 bp, Homo sapiens
caggttagaacctagaagggcta

SEQ ID NO: 3926310 - DNA, 17 bp, Homo sapiens
caggttcccagcagctg

SEQ ID NO: 3926311 - DNA, 20 bp, Homo sapiens
caggttcccagcagctgggc

SEQ ID NO: 3926312 - DNA, 14 bp, Homo sapiens
caggtttgccagtg

SEQ ID NO: 3926313 - DNA, 23 bp, Homo sapiens
caggtttggggagggggaagaga

SEQ ID NO: 3926314 - DNA, 20 bp, Homo sapiens
cataaccccaggcatcccat

SEQ ID NO: 3926315 - DNA, 21 bp, Homo sapiens
cataagaatgaataataatta

SEQ ID NO: 3926316 - DNA, 20 bp, Homo sapiens
cataagaccataacagccaa

SEQ ID NO: 3926317 - DNA, 23 bp, Homo sapiens
cataagaccataacagccaacag

SEQ ID NO: 3926318 - DNA, 12 bp, Homo sapiens
cataagattaaa

SEQ ID NO: 3926319 - DNA, 15 bp, Homo sapiens
cataagattaaagga

SEQ ID NO: 3926320 - DNA, 16 bp, Homo sapiens
cataagattaaaggaa

SEQ ID NO: 3926321 - DNA, 17 bp, Homo sapiens
cataagattaaaggaag

SEQ ID NO: 3926322 - DNA, 21 bp, Homo sapiens
cataagattaaaggaaggaaa

SEQ ID NO: 3926323 - DNA, 22 bp, Homo sapiens
cataagattaaaggaaggaaaa

SEQ ID NO: 3926324 - DNA, 19 bp, Homo sapiens
cataaggagaatgtatctc

SEQ ID NO: 3926325 - DNA, 22 bp, Homo sapiens
cataaggagaatgtatctcctc

SEQ ID NO: 3926326 - DNA, 16 bp, Homo sapiens
cataaggcctgccctc

SEQ ID NO: 3926327 - DNA, 18 bp, Homo sapiens
cataaggcctgccctccc

SEQ ID NO: 3926328 - DNA, 17 bp, Homo sapiens
cataatagttagccctc

SEQ ID NO: 3926329 - DNA, 19 bp, Homo sapiens
cataatctggactcctctg

SEQ ID NO: 3926330 - DNA, 12 bp, Homo sapiens
cataatgccact

SEQ ID NO: 3926331 - DNA, 22 bp, Homo sapiens
cataatgctcccatctcctgat

SEQ ID NO: 3926332 - DNA, 15 bp, Homo sapiens
cataattagaacaat

SEQ ID NO: 3926333 - DNA, 18 bp, Homo sapiens
cataattcttgtatatta

SEQ ID NO: 3926334 - DNA, 22 bp, Homo sapiens
cataattttcaagagaagaaaa

SEQ ID NO: 3926335 - DNA, 16 bp, Homo sapiens
catacaacacaaagag

SEQ ID NO: 3926336 - DNA, 14 bp, Homo sapiens
catacaatttgcac

SEQ ID NO: 3926337 - DNA, 15 bp, Homo sapiens
catacaatttgcact

SEQ ID NO: 3926338 - DNA, 17 bp, Homo sapiens
catacactcaaacaatc

SEQ ID NO: 3926339 - DNA, 16 bp, Homo sapiens
catacacttgtataaa

SEQ ID NO: 3926340 - DNA, 17 bp, Homo sapiens
catacagaggtaactat

SEQ ID NO: 3926341 - DNA, 15 bp, Homo sapiens
catacatacatatat

SEQ ID NO: 3926342 - DNA, 14 bp, Homo sapiens
catacatatatatc

SEQ ID NO: 3926343 - DNA, 20 bp, Homo sapiens
catacatatatatctgataa

SEQ ID NO: 3926344 - DNA, 17 bp, Homo sapiens
cataccaacacgagcag

SEQ ID NO: 3926345 - DNA, 16 bp, Homo sapiens
cataccacaataaaaa

SEQ ID NO: 3926346 - DNA, 15 bp, Homo sapiens
catacccctgcctgg

SEQ ID NO: 3926347 - DNA, 16 bp, Homo sapiens
catacccctgcctggg

SEQ ID NO: 3926348 - DNA, 18 bp, Homo sapiens
catacccctgcctgggtt

SEQ ID NO: 3926349 - DNA, 18 bp, Homo sapiens
cataccctttatctctgt

SEQ ID NO: 3926350 - DNA, 15 bp, Homo sapiens
cataccttggactga

SEQ ID NO: 3926351 - DNA, 21 bp, Homo sapiens
catactcatttctaaaagaat

SEQ ID NO: 3926352 - DNA, 19 bp, Homo sapiens
catagaaacatgacactga

SEQ ID NO: 3926353 - DNA, 16 bp, Homo sapiens
catagagatatgcaca

SEQ ID NO: 3926354 - DNA, 23 bp, Homo sapiens
catagagtgactccaagaacaat

SEQ ID NO: 3926355 - DNA, 14 bp, Homo sapiens
catagagtttaaca

SEQ ID NO: 3926356 - DNA, 14 bp, Homo sapiens
catagatggaccag

SEQ ID NO: 3926357 - DNA, 20 bp, Homo sapiens
catagatggaccagtagaca

SEQ ID NO: 3926358 - DNA, 17 bp, Homo sapiens
catagattaatggcact

SEQ ID NO: 3926359 - DNA, 18 bp, Homo sapiens
catagattgagaagtttt

SEQ ID NO: 3926360 - DNA, 15 bp, Homo sapiens
catagcgctggctca

SEQ ID NO: 3926361 - DNA, 19 bp, Homo sapiens
catagcgctggctcaggaa

SEQ ID NO: 3926362 - DNA, 23 bp, Homo sapiens
cataggaaaagtacatttaatac

SEQ ID NO: 3926363 - DNA, 18 bp, Homo sapiens
cataggcaatatctttaa

SEQ ID NO: 3926364 - DNA, 21 bp, Homo sapiens
cataggcggtcatgtgtgcat

SEQ ID NO: 3926365 - DNA, 22 bp, Homo sapiens
catagttatttacttgaaagat

SEQ ID NO: 3926366 - DNA, 16 bp, Homo sapiens
catatacatatatata

SEQ ID NO: 3926367 - DNA, 15 bp, Homo sapiens
catatacctataatg

SEQ ID NO: 3926368 - DNA, 17 bp, Homo sapiens
catatacctataatgtg

SEQ ID NO: 3926369 - DNA, 18 bp, Homo sapiens
catatataactagctaga

SEQ ID NO: 3926370 - DNA, 19 bp, Homo sapiens
catatatatatacacatac

SEQ ID NO: 3926371 - DNA, 22 bp, Homo sapiens
catatatatatacacatacata

SEQ ID NO: 3926372 - DNA, 23 bp, Homo sapiens
catatatatatacacatacatac

SEQ ID NO: 3926373 - DNA, 12 bp, Homo sapiens
catatatatctg

SEQ ID NO: 3926374 - DNA, 12 bp, Homo sapiens
catatattcatg

SEQ ID NO: 3926375 - DNA, 17 bp, Homo sapiens
catatattcatgtaata

SEQ ID NO: 3926376 - DNA, 16 bp, Homo sapiens
catatcagaaaagtag

SEQ ID NO: 3926377 - DNA, 18 bp, Homo sapiens
catatcagaaaagtagaa

SEQ ID NO: 3926378 - DNA, 14 bp, Homo sapiens
catatcagacctct

SEQ ID NO: 3926379 - DNA, 18 bp, Homo sapiens
catatcagacctctgatc

SEQ ID NO: 3926380 - DNA, 12 bp, Homo sapiens
catatcattttt

SEQ ID NO: 3926381 - DNA, 22 bp, Homo sapiens
catatgaaaaaaatgcatttta

SEQ ID NO: 3926382 - DNA, 13 bp, Homo sapiens
catatgagtcttt

SEQ ID NO: 3926383 - DNA, 15 bp, Homo sapiens
catatggaggcctga

SEQ ID NO: 3926384 - DNA, 20 bp, Homo sapiens
catatgtagactatatacat

SEQ ID NO: 3926385 - DNA, 15 bp, Homo sapiens
catattataaataaa

SEQ ID NO: 3926386 - DNA, 15 bp, Homo sapiens
catattgtatgtaag

SEQ ID NO: 3926387 - DNA, 23 bp, Homo sapiens
catatttatattgtatattctgg

SEQ ID NO: 3926388 - DNA, 13 bp, Homo sapiens
catattttcacag

SEQ ID NO: 3926389 - DNA, 23 bp, Homo sapiens
catattttcacatgacgtaaaat

SEQ ID NO: 3926390 - DNA, 13 bp, Homo sapiens
catattttgtata

SEQ ID NO: 3926391 - DNA, 18 bp, Homo sapiens
catcaaatttgccaccac

SEQ ID NO: 3926392 - DNA, 15 bp, Homo sapiens
catcaagcatgcaat

SEQ ID NO: 3926393 - DNA, 20 bp, Homo sapiens
catcaatggaaacagggcag

SEQ ID NO: 3926394 - DNA, 12 bp, Homo sapiens
catcaatttaaa

SEQ ID NO: 3926395 - DNA, 13 bp, Homo sapiens
catcaatttttat

SEQ ID NO: 3926396 - DNA, 17 bp, Homo sapiens
catcaatttttatacat

SEQ ID NO: 3926397 - DNA, 19 bp, Homo sapiens
catcaatttttatacatat

SEQ ID NO: 3926398 - DNA, 24 bp, Homo sapiens
catcaatttttatacatatcagaa

SEQ ID NO: 3926399 - DNA, 13 bp, Homo sapiens
catcacccagtcc

SEQ ID NO: 3926400 - DNA, 18 bp, Homo sapiens
catcacccagtcctggcc

SEQ ID NO: 3926401 - DNA, 19 bp, Homo sapiens
catgggctagtgtgagtgg

SEQ ID NO: 3926402 - DNA, 22 bp, Homo sapiens
catgggctagtgtgagtggcag

SEQ ID NO: 3926403 - DNA, 12 bp, Homo sapiens
catgggcttgga

SEQ ID NO: 3926404 - DNA, 18 bp, Homo sapiens
catggggcatagaaactg

SEQ ID NO: 3926405 - DNA, 23 bp, Homo sapiens
catggggcatagaaactgaggag

SEQ ID NO: 3926406 - DNA, 21 bp, Homo sapiens
catgggtccatgggaataaag

SEQ ID NO: 3926407 - DNA, 22 bp, Homo sapiens
catggtcagctcacaccctaat

SEQ ID NO: 3926408 - DNA, 15 bp, Homo sapiens
catggtcatggacag

SEQ ID NO: 3926409 - DNA, 15 bp, Homo sapiens
catggtcccacatcc

SEQ ID NO: 3926410 - DNA, 17 bp, Homo sapiens
catggtcccacatccct

SEQ ID NO: 3926411 - DNA, 21 bp, Homo sapiens
catggtcccacatccctgggc

SEQ ID NO: 3926412 - DNA, 17 bp, Homo sapiens
catggtccggtgtcctt

SEQ ID NO: 3926413 - DNA, 21 bp, Homo sapiens
catggtctctcgggcccccca

SEQ ID NO: 3926414 - DNA, 19 bp, Homo sapiens
catggtgcagttgacagca

SEQ ID NO: 3926415 - DNA, 20 bp, Homo sapiens
catggtgctttcaggtctgg

SEQ ID NO: 3926416 - DNA, 12 bp, Homo sapiens
catggtggcgca

SEQ ID NO: 3926417 - DNA, 20 bp, Homo sapiens
catgtaaaatgcagtccaga

SEQ ID NO: 3926418 - DNA, 21 bp, Homo sapiens
catgtaacaggtaaccacaat

SEQ ID NO: 3926419 - DNA, 13 bp, Homo sapiens
catgtaataaatc

SEQ ID NO: 3926420 - DNA, 18 bp, Homo sapiens
catgtaatgaatggtcag

SEQ ID NO: 3926421 - DNA, 21 bp, Homo sapiens
catgtacaaaatcgattggct

SEQ ID NO: 3926422 - DNA, 17 bp, Homo sapiens
catgtagattttagttc

SEQ ID NO: 3926423 - DNA, 14 bp, Homo sapiens
catgtatctacctc

SEQ ID NO: 3926424 - DNA, 16 bp, Homo sapiens
catgtatgtgcacatg

SEQ ID NO: 3926425 - DNA, 19 bp, Homo sapiens
catgtatgtgcacatgtgt

SEQ ID NO: 3926426 - DNA, 20 bp, Homo sapiens
catgtatgtgcacatgtgtc

SEQ ID NO: 3926427 - DNA, 16 bp, Homo sapiens
catgtattatcacatc

SEQ ID NO: 3926428 - DNA, 15 bp, Homo sapiens
catgtatttatctct

SEQ ID NO: 3926429 - DNA, 20 bp, Homo sapiens
catgtatttatctctattta

SEQ ID NO: 3926430 - DNA, 23 bp, Homo sapiens
catgtcaccgtggaccttcctgc

SEQ ID NO: 3926431 - DNA, 13 bp, Homo sapiens
catgtcagagcca

SEQ ID NO: 3926432 - DNA, 16 bp, Homo sapiens
catgtcaggcctgtgt

SEQ ID NO: 3926433 - DNA, 22 bp, Homo sapiens
catgtccaagtccaacctgcct

SEQ ID NO: 3926434 - DNA, 23 bp, Homo sapiens
catgtccctaccgagtctcttct

SEQ ID NO: 3926435 - DNA, 18 bp, Homo sapiens
catgtcctatgtgtgact

SEQ ID NO: 3926436 - DNA, 15 bp, Homo sapiens
catgtctcacagacg

SEQ ID NO: 3926437 - DNA, 19 bp, Homo sapiens
catgtctcagcctcctcag

SEQ ID NO: 3926438 - DNA, 21 bp, Homo sapiens
catgtgaccacatacgtgtta

SEQ ID NO: 3926439 - DNA, 19 bp, Homo sapiens
catgtgatccttttatgtt

SEQ ID NO: 3926440 - DNA, 22 bp, Homo sapiens
catgtgatccttttatgttatt

SEQ ID NO: 3926441 - DNA, 22 bp, Homo sapiens
catgtgctattgaactgagcca

SEQ ID NO: 3926442 - DNA, 21 bp, Homo sapiens
catgtgcttccctaggctgag

SEQ ID NO: 3926443 - DNA, 12 bp, Homo sapiens
catgtggagtgg

SEQ ID NO: 3926444 - DNA, 19 bp, Homo sapiens
catgtggccccaggtgcca

SEQ ID NO: 3926445 - DNA, 23 bp, Homo sapiens
catgtggtatgtagcccggccag

SEQ ID NO: 3926446 - DNA, 17 bp, Homo sapiens
catgtgtcccctcactc

SEQ ID NO: 3926447 - DNA, 20 bp, Homo sapiens
catgtgtcccctcactctgt

SEQ ID NO: 3926448 - DNA, 15 bp, Homo sapiens
catgtgtctgtgtgg

SEQ ID NO: 3926449 - DNA, 13 bp, Homo sapiens
catgtgtgactcc

SEQ ID NO: 3926450 - DNA, 18 bp, Homo sapiens
catgtgtgactccagcct

SEQ ID NO: 3926451 - DNA, 20 bp, Homo sapiens
catgtgtgcatgtgagcaca

SEQ ID NO: 3926452 - DNA, 17 bp, Homo sapiens
catgtgtgcctgtggca

SEQ ID NO: 3926453 - DNA, 19 bp, Homo sapiens
catgtgtgcctgtggcaga

SEQ ID NO: 3926454 - DNA, 19 bp, Homo sapiens
catgtgtgtatatatgtgt

SEQ ID NO: 3926455 - DNA, 20 bp, Homo sapiens
catgtgtgtatatatgtgta

SEQ ID NO: 3926456 - DNA, 15 bp, Homo sapiens
catgtgtgtgtctgt

SEQ ID NO: 3926457 - DNA, 19 bp, Homo sapiens
catgtgtgtgtctgtcttt

SEQ ID NO: 3926458 - DNA, 20 bp, Homo sapiens
catgtgtgtgtctgtctttg

SEQ ID NO: 3926459 - DNA, 17 bp, Homo sapiens
catgttgcatgcctatg

SEQ ID NO: 3926460 - DNA, 16 bp, Homo sapiens
catgttggccaggctg

SEQ ID NO: 3926461 - DNA, 20 bp, Homo sapiens
catgttggccaggctggtct

SEQ ID NO: 3926462 - DNA, 22 bp, Homo sapiens
catgttggtcaaaagctggatt

SEQ ID NO: 3926463 - DNA, 14 bp, Homo sapiens
catgtttaaattgt

SEQ ID NO: 3926464 - DNA, 20 bp, Homo sapiens
catgtttgagctcagacccc

SEQ ID NO: 3926465 - DNA, 13 bp, Homo sapiens
catgtttgtaaaa

SEQ ID NO: 3926466 - DNA, 23 bp, Homo sapiens
catgtttttgttttctttgaatg

SEQ ID NO: 3926467 - DNA, 20 bp, Homo sapiens
cattaaaagaagactggaag

SEQ ID NO: 3926468 - DNA, 20 bp, Homo sapiens
cattaagacacacctctgga

SEQ ID NO: 3926469 - DNA, 15 bp, Homo sapiens
cattaagtggctttt

SEQ ID NO: 3926470 - DNA, 17 bp, Homo sapiens
cattaatatttgctgac

SEQ ID NO: 3926471 - DNA, 17 bp, Homo sapiens
cattaatcaccaaagta

SEQ ID NO: 3926472 - DNA, 13 bp, Homo sapiens
cattaatgtgttg

SEQ ID NO: 3926473 - DNA, 23 bp, Homo sapiens
cattaatgttaattcagcactga

SEQ ID NO: 3926474 - DNA, 22 bp, Homo sapiens
cattacatgtttaaattgtaaa

SEQ ID NO: 3926475 - DNA, 23 bp, Homo sapiens
cattacatgtttaaattgtaaat

SEQ ID NO: 3926476 - DNA, 13 bp, Homo sapiens
cattacgtgagcc

SEQ ID NO: 3926477 - DNA, 16 bp, Homo sapiens
cattacgtgagccagg

SEQ ID NO: 3926478 - DNA, 17 bp, Homo sapiens
cattacgtgagccaggt

SEQ ID NO: 3926479 - DNA, 23 bp, Homo sapiens
cattactttaatactcacctcct

SEQ ID NO: 3926480 - DNA, 23 bp, Homo sapiens
cattagaaactgaaaactgtaaa

SEQ ID NO: 3926481 - DNA, 17 bp, Homo sapiens
cattagaaatagacagt

SEQ ID NO: 3926482 - DNA, 19 bp, Homo sapiens
cattagagcccatttcaat

SEQ ID NO: 3926483 - DNA, 12 bp, Homo sapiens
cattatctcaaa

SEQ ID NO: 3926484 - DNA, 13 bp, Homo sapiens
cattatgtgtgca

SEQ ID NO: 3926485 - DNA, 23 bp, Homo sapiens
cattatgtgtgcatgtgtgtata

SEQ ID NO: 3926486 - DNA, 14 bp, Homo sapiens
cattatttaatgtt

SEQ ID NO: 3926487 - DNA, 12 bp, Homo sapiens
ccacactgtcag

SEQ ID NO: 3926488 - DNA, 18 bp, Homo sapiens
ccacactgtcagagctgt

SEQ ID NO: 3926489 - DNA, 20 bp, Homo sapiens
ccacacttcaggctcttctc

SEQ ID NO: 3926490 - DNA, 21 bp, Homo sapiens
ccacacttcaggctcttctcc

SEQ ID NO: 3926491 - DNA, 14 bp, Homo sapiens
ccacacttctcagg

SEQ ID NO: 3926492 - DNA, 17 bp, Homo sapiens
ccacacttctcaggaca

SEQ ID NO: 3926493 - DNA, 24 bp, Homo sapiens
ccacacttctcaggacacaggcct

SEQ ID NO: 3926494 - DNA, 12 bp, Homo sapiens
ccacacttcttg

SEQ ID NO: 3926495 - DNA, 13 bp, Homo sapiens
ccacacttcttga

SEQ ID NO: 3926496 - DNA, 21 bp, Homo sapiens
ccacacttcttgaaacagcct

SEQ ID NO: 3926497 - DNA, 22 bp, Homo sapiens
ccacacttcttgaaacagcctg

SEQ ID NO: 3926498 - DNA, 17 bp, Homo sapiens
ccacagaagccaggagc

SEQ ID NO: 3926499 - DNA, 20 bp, Homo sapiens
ccacagactccctcccctgc

SEQ ID NO: 3926500 - DNA, 17 bp, Homo sapiens
ccacagcaattggctcc

SEQ ID NO: 3926501 - DNA, 19 bp, Homo sapiens
ccacagcaattggctcctc

SEQ ID NO: 3926502 - DNA, 15 bp, Homo sapiens
ccacagcacccaggc

SEQ ID NO: 3926503 - DNA, 17 bp, Homo sapiens
ccacagcagttgaaaag

SEQ ID NO: 3926504 - DNA, 18 bp, Homo sapiens
ccacagcagttgaaaaga

SEQ ID NO: 3926505 - DNA, 14 bp, Homo sapiens
ccacagccccacag

SEQ ID NO: 3926506 - DNA, 16 bp, Homo sapiens
ccacagccccacagca

SEQ ID NO: 3926507 - DNA, 18 bp, Homo sapiens
ccacagccccacagcacc

SEQ ID NO: 3926508 - DNA, 19 bp, Homo sapiens
ccacagcggaggagctccg

SEQ ID NO: 3926509 - DNA, 19 bp, Homo sapiens
ccacagctcccaccccacc

SEQ ID NO: 3926510 - DNA, 18 bp, Homo sapiens
ccacaggcccttcctctc

SEQ ID NO: 3926511 - DNA, 17 bp, Homo sapiens
ccacagggctaagagct

SEQ ID NO: 3926512 - DNA, 19 bp, Homo sapiens
ccacaggggcaggcctggg

SEQ ID NO: 3926513 - DNA, 15 bp, Homo sapiens
ccacagtcctcacag

SEQ ID NO: 3926514 - DNA, 19 bp, Homo sapiens
ccacagtgcccagctaatt

SEQ ID NO: 3926515 - DNA, 13 bp, Homo sapiens
ccacagtgctgct

SEQ ID NO: 3926516 - DNA, 15 bp, Homo sapiens
ccacagtgctgcttc

SEQ ID NO: 3926517 - DNA, 18 bp, Homo sapiens
ccacagtgctgcttctct

SEQ ID NO: 3926518 - DNA, 23 bp, Homo sapiens
ccacagtgggtggcacctcctga

SEQ ID NO: 3926519 - DNA, 20 bp, Homo sapiens
ccacatccacacacgcagga

SEQ ID NO: 3926520 - DNA, 13 bp, Homo sapiens
ccacatcccaggc

SEQ ID NO: 3926521 - DNA, 18 bp, Homo sapiens
ccacatccctgggcctgc

SEQ ID NO: 3926522 - DNA, 20 bp, Homo sapiens
ccacatccctgggcctgctg

SEQ ID NO: 3926523 - DNA, 23 bp, Homo sapiens
ccacatccctgggcctgctgctg

SEQ ID NO: 3926524 - DNA, 17 bp, Homo sapiens
ccacattggacttcctt

SEQ ID NO: 3926525 - DNA, 15 bp, Homo sapiens
ccaccaaactgcaca

SEQ ID NO: 3926526 - DNA, 21 bp, Homo sapiens
ccaccaaactgcacacacagc

SEQ ID NO: 3926527 - DNA, 12 bp, Homo sapiens
ccaccaacccat

SEQ ID NO: 3926528 - DNA, 15 bp, Homo sapiens
ccaccaaccctcaga

SEQ ID NO: 3926529 - DNA, 19 bp, Homo sapiens
ccaccaactctgcactcca

SEQ ID NO: 3926530 - DNA, 17 bp, Homo sapiens
ccaccacaccgcagaag

SEQ ID NO: 3926531 - DNA, 11 bp, Homo sapiens
ccaccacccaa

SEQ ID NO: 3926532 - DNA, 18 bp, Homo sapiens
ccaccacctaggccactc

SEQ ID NO: 3926533 - DNA, 20 bp, Homo sapiens
ccaccacctaggccactcct

SEQ ID NO: 3926534 - DNA, 22 bp, Homo sapiens
ccaccacctaggccactcctcc

SEQ ID NO: 3926535 - DNA, 15 bp, Homo sapiens
ccaccacgtctgcca

SEQ ID NO: 3926536 - DNA, 20 bp, Homo sapiens
ccaccacgtctgccaggccc

SEQ ID NO: 3926537 - DNA, 16 bp, Homo sapiens
ccaccatgccaggcta

SEQ ID NO: 3926538 - DNA, 15 bp, Homo sapiens
ccacccaacagcacc

SEQ ID NO: 3926539 - DNA, 17 bp, Homo sapiens
ccacccaacagcaccaa

SEQ ID NO: 3926540 - DNA, 15 bp, Homo sapiens
ccacccaacagctca

SEQ ID NO: 3926541 - DNA, 15 bp, Homo sapiens
ccacccacctcagcc

SEQ ID NO: 3926542 - DNA, 15 bp, Homo sapiens
ccacccactgtccgc

SEQ ID NO: 3926543 - DNA, 18 bp, Homo sapiens
ccacccagcaacacagag

SEQ ID NO: 3926544 - DNA, 12 bp, Homo sapiens
ccacccagccca

SEQ ID NO: 3926545 - DNA, 15 bp, Homo sapiens
ccacccaggcaggcc

SEQ ID NO: 3926546 - DNA, 12 bp, Homo sapiens
ccacccaggctg

SEQ ID NO: 3926547 - DNA, 18 bp, Homo sapiens
ccacccagggctccctcc

SEQ ID NO: 3926548 - DNA, 12 bp, Homo sapiens
ccacccagtgct

SEQ ID NO: 3926549 - DNA, 13 bp, Homo sapiens
ccacccagtgctg

SEQ ID NO: 3926550 - DNA, 16 bp, Homo sapiens
ccacccagtgctgcca

SEQ ID NO: 3926551 - DNA, 15 bp, Homo sapiens
ccacccatcttcctg

SEQ ID NO: 3926552 - DNA, 19 bp, Homo sapiens
ccacccatcttcctgctgc

SEQ ID NO: 3926553 - DNA, 21 bp, Homo sapiens
ccacccatcttcctgctgctg

SEQ ID NO: 3926554 - DNA, 22 bp, Homo sapiens
ccacccatcttcctgctgctgt

SEQ ID NO: 3926555 - DNA, 12 bp, Homo sapiens
ccaccccaacat

SEQ ID NO: 3926556 - DNA, 21 bp, Homo sapiens
ccacccccgccacggccaccc

SEQ ID NO: 3926557 - DNA, 14 bp, Homo sapiens
ccaccccctccagc

SEQ ID NO: 3926558 - DNA, 19 bp, Homo sapiens
ccaccccctccccagggga

SEQ ID NO: 3926559 - DNA, 15 bp, Homo sapiens
ccaccccggcctcca

SEQ ID NO: 3926560 - DNA, 20 bp, Homo sapiens
ccacccgtaggcagcctctc

SEQ ID NO: 3926561 - DNA, 21 bp, Homo sapiens
ccacccgttctgctggcctgg

SEQ ID NO: 3926562 - DNA, 12 bp, Homo sapiens
ccaccctctcca

SEQ ID NO: 3926563 - DNA, 21 bp, Homo sapiens
ccaccctgaggagtctgaggt

SEQ ID NO: 3926564 - DNA, 23 bp, Homo sapiens
ccaccctgaggagtctgaggtcc

SEQ ID NO: 3926565 - DNA, 21 bp, Homo sapiens
ccaccgcaccgggccctcctt

SEQ ID NO: 3926566 - DNA, 15 bp, Homo sapiens
ccaccgcagaaggaa

SEQ ID NO: 3926567 - DNA, 21 bp, Homo sapiens
ccaccgctgcctaagtggctg

SEQ ID NO: 3926568 - DNA, 22 bp, Homo sapiens
ccaccgctgccttttgctgctg

SEQ ID NO: 3926569 - DNA, 15 bp, Homo sapiens
ccaccgggccactcc

SEQ ID NO: 3926570 - DNA, 19 bp, Homo sapiens
ccaccgggccactccttcc

SEQ ID NO: 3926571 - DNA, 22 bp, Homo sapiens
ccaccgggccactccttcctgc

SEQ ID NO: 3926572 - DNA, 22 bp, Homo sapiens
ccaccgggctgggagctctgca

SEQ ID NO: 3926573 - DNA, 17 bp, Homo sapiens
ccacctaatcaggctga

SEQ ID NO: 3926574 - DNA, 12 bp, Homo sapiens
ccccatgggctt

SEQ ID NO: 3926575 - DNA, 21 bp, Homo sapiens
ccccatgtttaaactttgtgc

SEQ ID NO: 3926576 - DNA, 12 bp, Homo sapiens
cccccaagcctc

SEQ ID NO: 3926577 - DNA, 12 bp, Homo sapiens
cccccaccccct

SEQ ID NO: 3926578 - DNA, 22 bp, Homo sapiens
cccccacctgacaatggcagct

SEQ ID NO: 3926579 - DNA, 21 bp, Homo sapiens
cccccactctcattccccagg

SEQ ID NO: 3926580 - DNA, 13 bp, Homo sapiens
cccccacttggga

SEQ ID NO: 3926581 - DNA, 11 bp, Homo sapiens
cccccagagac

SEQ ID NO: 3926582 - DNA, 12 bp, Homo sapiens
cccccagagacc

SEQ ID NO: 3926583 - DNA, 14 bp, Homo sapiens
cccccagagacctt

SEQ ID NO: 3926584 - DNA, 18 bp, Homo sapiens
cccccaggtgttgccatt

SEQ ID NO: 3926585 - DNA, 11 bp, Homo sapiens
cccccatcccc

SEQ ID NO: 3926586 - DNA, 17 bp, Homo sapiens
cccccatctccccaggc

SEQ ID NO: 3926587 - DNA, 13 bp, Homo sapiens
cccccatgtggct

SEQ ID NO: 3926588 - DNA, 22 bp, Homo sapiens
cccccatgtttaaactttgtgc

SEQ ID NO: 3926589 - DNA, 12 bp, Homo sapiens
ccccccactgca

SEQ ID NO: 3926590 - DNA, 12 bp, Homo sapiens
ccccccagcact

SEQ ID NO: 3926591 - DNA, 13 bp, Homo sapiens
ccccccagcacta

SEQ ID NO: 3926592 - DNA, 13 bp, Homo sapiens
cccccctccaggc

SEQ ID NO: 3926593 - DNA, 20 bp, Homo sapiens
ccccccttgaatctgcaggg

SEQ ID NO: 3926594 - DNA, 23 bp, Homo sapiens
cccccgacactgctgcaccagag

SEQ ID NO: 3926595 - DNA, 19 bp, Homo sapiens
cccccgccacggccaccct

SEQ ID NO: 3926596 - DNA, 11 bp, Homo sapiens
ccccctcattc

SEQ ID NO: 3926597 - DNA, 12 bp, Homo sapiens
ccccctccagct

SEQ ID NO: 3926598 - DNA, 15 bp, Homo sapiens
ccccctccagctcca

SEQ ID NO: 3926599 - DNA, 13 bp, Homo sapiens
ccccctccccagg

SEQ ID NO: 3926600 - DNA, 11 bp, Homo sapiens
ccccctgcagc

SEQ ID NO: 3926601 - DNA, 23 bp, Homo sapiens
ccccctgcagcttgtagccagcc

SEQ ID NO: 3926602 - DNA, 12 bp, Homo sapiens
ccccctggagag

SEQ ID NO: 3926603 - DNA, 23 bp, Homo sapiens
ccccctggatgggcattgggctg

SEQ ID NO: 3926604 - DNA, 22 bp, Homo sapiens
ccccctggatgtcccctgtccc

SEQ ID NO: 3926605 - DNA, 15 bp, Homo sapiens
ccccctggccctgcc

SEQ ID NO: 3926606 - DNA, 20 bp, Homo sapiens
ccccctggggcttctcctga

SEQ ID NO: 3926607 - DNA, 21 bp, Homo sapiens
ccccctggggcttctcctgac

SEQ ID NO: 3926608 - DNA, 15 bp, Homo sapiens
ccccctgtgccagct

SEQ ID NO: 3926609 - DNA, 16 bp, Homo sapiens
ccccctgtgccagctc

SEQ ID NO: 3926610 - DNA, 16 bp, Homo sapiens
ccccgacttcatccca

SEQ ID NO: 3926611 - DNA, 17 bp, Homo sapiens
ccccgcctgtcctgcct

SEQ ID NO: 3926612 - DNA, 17 bp, Homo sapiens
ccccgcggtgctctggc

SEQ ID NO: 3926613 - DNA, 14 bp, Homo sapiens
ccccgctccagatc

SEQ ID NO: 3926614 - DNA, 16 bp, Homo sapiens
ccccggcctctctctt

SEQ ID NO: 3926615 - DNA, 16 bp, Homo sapiens
ccccgggctctggcca

SEQ ID NO: 3926616 - DNA, 21 bp, Homo sapiens
ccccgggctctggccaccctg

SEQ ID NO: 3926617 - DNA, 21 bp, Homo sapiens
ccccgttccctgtcagaggct

SEQ ID NO: 3926618 - DNA, 16 bp, Homo sapiens
cccctaacctggctta

SEQ ID NO: 3926619 - DNA, 18 bp, Homo sapiens
cccctactcccctgatcc

SEQ ID NO: 3926620 - DNA, 17 bp, Homo sapiens
cccctatccacccagcc

SEQ ID NO: 3926621 - DNA, 21 bp, Homo sapiens
cccctatccacccagcccatt

SEQ ID NO: 3926622 - DNA, 15 bp, Homo sapiens
cccctcacctgggcc

SEQ ID NO: 3926623 - DNA, 20 bp, Homo sapiens
cccctcacctgggcctttcc

SEQ ID NO: 3926624 - DNA, 21 bp, Homo sapiens
cccctcactctgtcagccagc

SEQ ID NO: 3926625 - DNA, 13 bp, Homo sapiens
cccctcagagctc

SEQ ID NO: 3926626 - DNA, 23 bp, Homo sapiens
cccctcagatgatctctccacgg

SEQ ID NO: 3926627 - DNA, 14 bp, Homo sapiens
cccctcagcccttg

SEQ ID NO: 3926628 - DNA, 15 bp, Homo sapiens
cccctcatgtgtgct

SEQ ID NO: 3926629 - DNA, 12 bp, Homo sapiens
cccctccactgt

SEQ ID NO: 3926630 - DNA, 15 bp, Homo sapiens
cccctccagctccag

SEQ ID NO: 3926631 - DNA, 20 bp, Homo sapiens
cccctccaggcatgctggcc

SEQ ID NO: 3926632 - DNA, 15 bp, Homo sapiens
cccctccccagggga

SEQ ID NO: 3926633 - DNA, 20 bp, Homo sapiens
cccctccctcctctggccca

SEQ ID NO: 3926634 - DNA, 14 bp, Homo sapiens
cccctccctctgcc

SEQ ID NO: 3926635 - DNA, 20 bp, Homo sapiens
cccctccctcttccttcccc

SEQ ID NO: 3926636 - DNA, 14 bp, Homo sapiens
cccctccttgctct

SEQ ID NO: 3926637 - DNA, 13 bp, Homo sapiens
cccctcgctgctg

SEQ ID NO: 3926638 - DNA, 14 bp, Homo sapiens
cccctcgctgctgc

SEQ ID NO: 3926639 - DNA, 11 bp, Homo sapiens
cccctctcccc

SEQ ID NO: 3926640 - DNA, 13 bp, Homo sapiens
cccctctgccctg

SEQ ID NO: 3926641 - DNA, 17 bp, Homo sapiens
cccctctgccctgtata

SEQ ID NO: 3926642 - DNA, 21 bp, Homo sapiens
cccctctgtcatcactccctg

SEQ ID NO: 3926643 - DNA, 18 bp, Homo sapiens
cccctcttttggccttgt

SEQ ID NO: 3926644 - DNA, 13 bp, Homo sapiens
cccctgaagactt

SEQ ID NO: 3926645 - DNA, 14 bp, Homo sapiens
cccctgaggactgg

SEQ ID NO: 3926646 - DNA, 23 bp, Homo sapiens
cccctgcagcttgtagccagccg

SEQ ID NO: 3926647 - DNA, 12 bp, Homo sapiens
cccctgcctggg

SEQ ID NO: 3926648 - DNA, 15 bp, Homo sapiens
cccctgcctgggttt

SEQ ID NO: 3926649 - DNA, 19 bp, Homo sapiens
cccctgctactcctgtgct

SEQ ID NO: 3926650 - DNA, 13 bp, Homo sapiens
cccctgctgctca

SEQ ID NO: 3926651 - DNA, 15 bp, Homo sapiens
cccctggatgtcccc

SEQ ID NO: 3926652 - DNA, 13 bp, Homo sapiens
cccctggccctgc

SEQ ID NO: 3926653 - DNA, 23 bp, Homo sapiens
cccctgggcatcttctggcttga

SEQ ID NO: 3926654 - DNA, 18 bp, Homo sapiens
cccctggggcttctcctg

SEQ ID NO: 3926655 - DNA, 23 bp, Homo sapiens
cccctggtgcactggccccaccc

SEQ ID NO: 3926656 - DNA, 20 bp, Homo sapiens
cccctgtcccaccaactctg

SEQ ID NO: 3926657 - DNA, 15 bp, Homo sapiens
cccctgtgccagctc

SEQ ID NO: 3926658 - DNA, 23 bp, Homo sapiens
ccccttaagggttgaaggcagtc

SEQ ID NO: 3926659 - DNA, 15 bp, Homo sapiens
ccccttatccaggac

SEQ ID NO: 3926660 - DNA, 15 bp, Homo sapiens
ccccttccccatctc

SEQ ID NO: 3926661 - DNA, 16 bp, Homo sapiens
ccctcaaaccctgtgg

SEQ ID NO: 3926662 - DNA, 22 bp, Homo sapiens
ccctcaatccccaagctggcag

SEQ ID NO: 3926663 - DNA, 13 bp, Homo sapiens
ccctcaccccaag

SEQ ID NO: 3926664 - DNA, 17 bp, Homo sapiens
ccctcacctgggccttt

SEQ ID NO: 3926665 - DNA, 17 bp, Homo sapiens
ccctcactctgtcagcc

SEQ ID NO: 3926666 - DNA, 18 bp, Homo sapiens
ccctcactgaatgcctca

SEQ ID NO: 3926667 - DNA, 13 bp, Homo sapiens
ccctcagagccac

SEQ ID NO: 3926668 - DNA, 12 bp, Homo sapiens
ccctcagagctc

SEQ ID NO: 3926669 - DNA, 22 bp, Homo sapiens
ccctcagatgatctctccacgg

SEQ ID NO: 3926670 - DNA, 12 bp, Homo sapiens
ccctcagccctt

SEQ ID NO: 3926671 - DNA, 13 bp, Homo sapiens
ccctcatcctttt

SEQ ID NO: 3926672 - DNA, 22 bp, Homo sapiens
ccctcatcttgccccctcatct

SEQ ID NO: 3926673 - DNA, 15 bp, Homo sapiens
ccctcattcaggaaa

SEQ ID NO: 3926674 - DNA, 18 bp, Homo sapiens
ccctccaaagccccacct

SEQ ID NO: 3926675 - DNA, 18 bp, Homo sapiens
ccctccaccgcagaagga

SEQ ID NO: 3926676 - DNA, 21 bp, Homo sapiens
ccctccaccgcagaaggaagg

SEQ ID NO: 3926677 - DNA, 20 bp, Homo sapiens
ccctccacgcctcctggcca

SEQ ID NO: 3926678 - DNA, 16 bp, Homo sapiens
ccctccagaccctgcc

SEQ ID NO: 3926679 - DNA, 19 bp, Homo sapiens
ccctccagaccctgcctga

SEQ ID NO: 3926680 - DNA, 11 bp, Homo sapiens
ccctccagagt

SEQ ID NO: 3926681 - DNA, 15 bp, Homo sapiens
ccctccagctccagt

SEQ ID NO: 3926682 - DNA, 14 bp, Homo sapiens
ccctcccaacctca

SEQ ID NO: 3926683 - DNA, 20 bp, Homo sapiens
ccctccccaaacccatcaga

SEQ ID NO: 3926684 - DNA, 22 bp, Homo sapiens
ccctccccaaacccatcagaca

SEQ ID NO: 3926685 - DNA, 21 bp, Homo sapiens
ccctccccacacctccctact

SEQ ID NO: 3926686 - DNA, 18 bp, Homo sapiens
ccctccccacagtcctca

SEQ ID NO: 3926687 - DNA, 13 bp, Homo sapiens
ccctccccagccc

SEQ ID NO: 3926688 - DNA, 17 bp, Homo sapiens
ccctccccgcacccccc

SEQ ID NO: 3926689 - DNA, 13 bp, Homo sapiens
ccctccctctgcc

SEQ ID NO: 3926690 - DNA, 14 bp, Homo sapiens
ccctccctctgccc

SEQ ID NO: 3926691 - DNA, 16 bp, Homo sapiens
ccctccctctgcccca

SEQ ID NO: 3926692 - DNA, 13 bp, Homo sapiens
ccctccctgactc

SEQ ID NO: 3926693 - DNA, 13 bp, Homo sapiens
ccctcctaaccta

SEQ ID NO: 3926694 - DNA, 11 bp, Homo sapiens
ccctcctctgc

SEQ ID NO: 3926695 - DNA, 14 bp, Homo sapiens
ccctcctctggccc

SEQ ID NO: 3926696 - DNA, 23 bp, Homo sapiens
ccctccttgctctgcaggcacct

SEQ ID NO: 3926697 - DNA, 16 bp, Homo sapiens
ccctcgaaccaaggca

SEQ ID NO: 3926698 - DNA, 22 bp, Homo sapiens
ccctcgaaccaaggcagcctcc

SEQ ID NO: 3926699 - DNA, 14 bp, Homo sapiens
ccctcgcagcaggt

SEQ ID NO: 3926700 - DNA, 13 bp, Homo sapiens
ccctcgctgctgc

SEQ ID NO: 3926701 - DNA, 15 bp, Homo sapiens
ccctcgtccacaggg

SEQ ID NO: 3926702 - DNA, 14 bp, Homo sapiens
ccctcgtcctgtcc

SEQ ID NO: 3926703 - DNA, 17 bp, Homo sapiens
ccctcgtcctgtcccag

SEQ ID NO: 3926704 - DNA, 21 bp, Homo sapiens
ccctcgtcctgtcccagaggt

SEQ ID NO: 3926705 - DNA, 16 bp, Homo sapiens
ccctcgtggacacctg

SEQ ID NO: 3926706 - DNA, 23 bp, Homo sapiens
ccctctaacccccagtgccacag

SEQ ID NO: 3926707 - DNA, 13 bp, Homo sapiens
ccctctccatgcc

SEQ ID NO: 3926708 - DNA, 17 bp, Homo sapiens
ccctctcccccgcccaa

SEQ ID NO: 3926709 - DNA, 13 bp, Homo sapiens
ccctctcctgcct

SEQ ID NO: 3926710 - DNA, 13 bp, Homo sapiens
ccctctcctgggg

SEQ ID NO: 3926711 - DNA, 22 bp, Homo sapiens
ccctctgaatggtccagggttg

SEQ ID NO: 3926712 - DNA, 17 bp, Homo sapiens
ccctctgccccaagcag

SEQ ID NO: 3926713 - DNA, 20 bp, Homo sapiens
ccctctgccccaagcagcca

SEQ ID NO: 3926714 - DNA, 21 bp, Homo sapiens
ccctctgccccaagcagccag

SEQ ID NO: 3926715 - DNA, 23 bp, Homo sapiens
ccctctggatcctgctgtggcct

SEQ ID NO: 3926716 - DNA, 13 bp, Homo sapiens
ccctctggccctg

SEQ ID NO: 3926717 - DNA, 14 bp, Homo sapiens
ccctctggccctgc

SEQ ID NO: 3926718 - DNA, 19 bp, Homo sapiens
ccctctgggcagctgtcat

SEQ ID NO: 3926719 - DNA, 20 bp, Homo sapiens
ccctctgggcagctgtcatg

SEQ ID NO: 3926720 - DNA, 21 bp, Homo sapiens
ccctctgtcatcactccctgg

SEQ ID NO: 3926721 - DNA, 19 bp, Homo sapiens
ccctctgtgtcctctcccc

SEQ ID NO: 3926722 - DNA, 17 bp, Homo sapiens
ccctcttccttccccca

SEQ ID NO: 3926723 - DNA, 22 bp, Homo sapiens
ccctcttgacccatctccccct

SEQ ID NO: 3926724 - DNA, 16 bp, Homo sapiens
ccctctttccccacct

SEQ ID NO: 3926725 - DNA, 18 bp, Homo sapiens
ccctctttccccacctct

SEQ ID NO: 3926726 - DNA, 15 bp, Homo sapiens
ccctgaaaaactgat

SEQ ID NO: 3926727 - DNA, 14 bp, Homo sapiens
ccctgaaaacccag

SEQ ID NO: 3926728 - DNA, 13 bp, Homo sapiens
ccctgaaccatcc

SEQ ID NO: 3926729 - DNA, 16 bp, Homo sapiens
ccctgacctcccagcc

SEQ ID NO: 3926730 - DNA, 13 bp, Homo sapiens
ccctgagactcca

SEQ ID NO: 3926731 - DNA, 16 bp, Homo sapiens
ccctgagactccagaa

SEQ ID NO: 3926732 - DNA, 15 bp, Homo sapiens
ccctgaggagtctga

SEQ ID NO: 3926733 - DNA, 22 bp, Homo sapiens
ccctgaggagtctgaggtcctg

SEQ ID NO: 3926734 - DNA, 19 bp, Homo sapiens
ccctgagtggatctccaag

SEQ ID NO: 3926735 - DNA, 21 bp, Homo sapiens
ccctgagtggatctccaagga

SEQ ID NO: 3926736 - DNA, 22 bp, Homo sapiens
ccctgagtggatctccaaggac

SEQ ID NO: 3926737 - DNA, 18 bp, Homo sapiens
ccctgataacaacctgga

SEQ ID NO: 3926738 - DNA, 18 bp, Homo sapiens
ccctgcaccctggaaagg

SEQ ID NO: 3926739 - DNA, 22 bp, Homo sapiens
  misc_feature (13)..(13): n is a, c, g or t
ccctgcacctgcnttgtccctg

SEQ ID NO: 3926740 - DNA, 13 bp, Homo sapiens
ccctgcagaccct

SEQ ID NO: 3926741 - DNA, 14 bp, Homo sapiens
ccctgcagaccctg

SEQ ID NO: 3926742 - DNA, 12 bp, Homo sapiens
ccctgcagcctg

SEQ ID NO: 3926743 - DNA, 13 bp, Homo sapiens
ccctgcagcctgg

SEQ ID NO: 3926744 - DNA, 20 bp, Homo sapiens
ccctgcagcttgtagccagc

SEQ ID NO: 3926745 - DNA, 21 bp, Homo sapiens
ccctgcagcttgtagccagcc

SEQ ID NO: 3926746 - DNA, 12 bp, Homo sapiens
ccctgcatcccc

SEQ ID NO: 3926747 - DNA, 13 bp, Homo sapiens
ccctgccacctgt

SEQ ID NO: 3926748 - DNA, 14 bp, Homo sapiens
ccggtcacccaggc

SEQ ID NO: 3926749 - DNA, 16 bp, Homo sapiens
ccggtcacccaggctc

SEQ ID NO: 3926750 - DNA, 23 bp, Homo sapiens
ccggtcaccgagacggctggacc

SEQ ID NO: 3926751 - DNA, 20 bp, Homo sapiens
ccggtcccttgagacctcag

SEQ ID NO: 3926752 - DNA, 15 bp, Homo sapiens
ccgtaggcagcctct

SEQ ID NO: 3926753 - DNA, 14 bp, Homo sapiens
ccgtagttccctga

SEQ ID NO: 3926754 - DNA, 16 bp, Homo sapiens
ccgtagttccctgaaa

SEQ ID NO: 3926755 - DNA, 13 bp, Homo sapiens
ccgtccacccagg

SEQ ID NO: 3926756 - DNA, 14 bp, Homo sapiens
ccgtccacccaggc

SEQ ID NO: 3926757 - DNA, 16 bp, Homo sapiens
ccgtccacccaggctg

SEQ ID NO: 3926758 - DNA, 21 bp, Homo sapiens
ccgtccacccaggctgcactg

SEQ ID NO: 3926759 - DNA, 24 bp, Homo sapiens
ccgtccacccaggctgcactgcag

SEQ ID NO: 3926760 - DNA, 14 bp, Homo sapiens
ccgtccatggcacc

SEQ ID NO: 3926761 - DNA, 16 bp, Homo sapiens
ccgtctccctaaaata

SEQ ID NO: 3926762 - DNA, 17 bp, Homo sapiens
ccgtctgactccagagt

SEQ ID NO: 3926763 - DNA, 22 bp, Homo sapiens
ccgtctgactccagagtctgag

SEQ ID NO: 3926764 - DNA, 19 bp, Homo sapiens
ccgtctggggttcagcccc

SEQ ID NO: 3926765 - DNA, 12 bp, Homo sapiens
ccgtctgttttt

SEQ ID NO: 3926766 - DNA, 22 bp, Homo sapiens
ccgtcttggggctcgccccacc

SEQ ID NO: 3926767 - DNA, 23 bp, Homo sapiens
ccgtgaagcagtgcctcgaggca

SEQ ID NO: 3926768 - DNA, 19 bp, Homo sapiens
ccgtgatttggaagagagg

SEQ ID NO: 3926769 - DNA, 14 bp, Homo sapiens
ccgtgcactcccta

SEQ ID NO: 3926770 - DNA, 17 bp, Homo sapiens
ccgtgcactccctaaga

SEQ ID NO: 3926771 - DNA, 15 bp, Homo sapiens
ccgtgcagtacaggc

SEQ ID NO: 3926772 - DNA, 15 bp, Homo sapiens
ccgtggaccttcctg

SEQ ID NO: 3926773 - DNA, 16 bp, Homo sapiens
ccgtggaccttcctgc

SEQ ID NO: 3926774 - DNA, 14 bp, Homo sapiens
ccgtggaggctgct

SEQ ID NO: 3926775 - DNA, 15 bp, Homo sapiens
ccgtggaggctgctc

SEQ ID NO: 3926776 - DNA, 11 bp, Homo sapiens
ccgtggagggt

SEQ ID NO: 3926777 - DNA, 15 bp, Homo sapiens
ccgtggccctgccct

SEQ ID NO: 3926778 - DNA, 20 bp, Homo sapiens
ccgtggccctgccctctcct

SEQ ID NO: 3926779 - DNA, 16 bp, Homo sapiens
ccgtggcccttcctgg

SEQ ID NO: 3926780 - DNA, 22 bp, Homo sapiens
ccgtggcccttcctggacagct

SEQ ID NO: 3926781 - DNA, 15 bp, Homo sapiens
ccgtggcttcccgct

SEQ ID NO: 3926782 - DNA, 21 bp, Homo sapiens
ccgtggcttcccgctcagccc

SEQ ID NO: 3926783 - DNA, 11 bp, Homo sapiens
ccgtgtcccaa

SEQ ID NO: 3926784 - DNA, 15 bp, Homo sapiens
ccgtgtcccaaggag

SEQ ID NO: 3926785 - DNA, 16 bp, Homo sapiens
ccgtgtcccaaggagc

SEQ ID NO: 3926786 - DNA, 17 bp, Homo sapiens
ccgtgtcccaaggagct

SEQ ID NO: 3926787 - DNA, 18 bp, Homo sapiens
ccgtgtcccaaggagctg

SEQ ID NO: 3926788 - DNA, 13 bp, Homo sapiens
ccgttactctcca

SEQ ID NO: 3926789 - DNA, 15 bp, Homo sapiens
ccgttccctgtcaga

SEQ ID NO: 3926790 - DNA, 19 bp, Homo sapiens
ccgtttatgggccttgctt

SEQ ID NO: 3926791 - DNA, 20 bp, Homo sapiens
cctaaaaataagctttattt

SEQ ID NO: 3926792 - DNA, 20 bp, Homo sapiens
cctaaacccccgctccagat

SEQ ID NO: 3926793 - DNA, 14 bp, Homo sapiens
cctaaccaaatgct

SEQ ID NO: 3926794 - DNA, 15 bp, Homo sapiens
cctaacctggcttat

SEQ ID NO: 3926795 - DNA, 19 bp, Homo sapiens
cctaacgggggtgcggcag

SEQ ID NO: 3926796 - DNA, 22 bp, Homo sapiens
cctaacgggggtgcggcaggag

SEQ ID NO: 3926797 - DNA, 17 bp, Homo sapiens
cctaagaagtccccagg

SEQ ID NO: 3926798 - DNA, 15 bp, Homo sapiens
cctaagagagcacct

SEQ ID NO: 3926799 - DNA, 12 bp, Homo sapiens
cctaagcctgtt

SEQ ID NO: 3926800 - DNA, 17 bp, Homo sapiens
cctaaggatctctcagg

SEQ ID NO: 3926801 - DNA, 23 bp, Homo sapiens
cctaaggatctctcaggagcaca

SEQ ID NO: 3926802 - DNA, 20 bp, Homo sapiens
cctaagtgggaagtgaagcc

SEQ ID NO: 3926803 - DNA, 21 bp, Homo sapiens
cctaatatttaggcaagagaa

SEQ ID NO: 3926804 - DNA, 14 bp, Homo sapiens
cctaatctcatacc

SEQ ID NO: 3926805 - DNA, 18 bp, Homo sapiens
cctaatctcatacctctg

SEQ ID NO: 3926806 - DNA, 19 bp, Homo sapiens
cctaatggagaagacccac

SEQ ID NO: 3926807 - DNA, 17 bp, Homo sapiens
cctacagaaatactgct

SEQ ID NO: 3926808 - DNA, 20 bp, Homo sapiens
cctacagaaatactgctctg

SEQ ID NO: 3926809 - DNA, 15 bp, Homo sapiens
cctacagtggctgtc

SEQ ID NO: 3926810 - DNA, 15 bp, Homo sapiens
cctaccaccttccct

SEQ ID NO: 3926811 - DNA, 21 bp, Homo sapiens
cctaccaccttccctctttct

SEQ ID NO: 3926812 - DNA, 15 bp, Homo sapiens
cctacccaaccactc

SEQ ID NO: 3926813 - DNA, 13 bp, Homo sapiens
cctaccccaccac

SEQ ID NO: 3926814 - DNA, 14 bp, Homo sapiens
cctaccccaccacg

SEQ ID NO: 3926815 - DNA, 20 bp, Homo sapiens
cctacccccagcctgacaaa

SEQ ID NO: 3926816 - DNA, 16 bp, Homo sapiens
cctaccgagtctcttc

SEQ ID NO: 3926817 - DNA, 17 bp, Homo sapiens
cctaccgagtctcttct

SEQ ID NO: 3926818 - DNA, 23 bp, Homo sapiens
cctaccgagtctcttctccactg

SEQ ID NO: 3926819 - DNA, 15 bp, Homo sapiens
cctacctgctgctgc

SEQ ID NO: 3926820 - DNA, 14 bp, Homo sapiens
cctacctgtgcctg

SEQ ID NO: 3926821 - DNA, 15 bp, Homo sapiens
cctacctgtgcctga

SEQ ID NO: 3926822 - DNA, 16 bp, Homo sapiens
cctactactcaattgt

SEQ ID NO: 3926823 - DNA, 21 bp, Homo sapiens
cctactagttttccttgaaaa

SEQ ID NO: 3926824 - DNA, 16 bp, Homo sapiens
cctactcacacaggca

SEQ ID NO: 3926825 - DNA, 22 bp, Homo sapiens
cctactcacacaggcatttcct

SEQ ID NO: 3926826 - DNA, 23 bp, Homo sapiens
cctactcacacaggcatttcctg

SEQ ID NO: 3926827 - DNA, 14 bp, Homo sapiens
cctactcccctggg

SEQ ID NO: 3926828 - DNA, 15 bp, Homo sapiens
cctactcccctgggc

SEQ ID NO: 3926829 - DNA, 15 bp, Homo sapiens
cctacttcctgtgac

SEQ ID NO: 3926830 - DNA, 18 bp, Homo sapiens
cctacttgtgactgaagg

SEQ ID NO: 3926831 - DNA, 19 bp, Homo sapiens
cctacttgtgactgaaggg

SEQ ID NO: 3926832 - DNA, 13 bp, Homo sapiens
cctacttttcaag

SEQ ID NO: 3926833 - DNA, 18 bp, Homo sapiens
cctagaaccaagcttcag

SEQ ID NO: 3926834 - DNA, 21 bp, Homo sapiens
cctagaaccaagcttcagagc

SEQ ID NO: 3926835 - DNA, 16 bp, Homo sapiens
cctctgaggaagaagg

SEQ ID NO: 3926836 - DNA, 24 bp, Homo sapiens
cctctgattttggcatgtggagac

SEQ ID NO: 3926837 - DNA, 13 bp, Homo sapiens
cctctgccacctc

SEQ ID NO: 3926838 - DNA, 15 bp, Homo sapiens
cctctgccacctccc

SEQ ID NO: 3926839 - DNA, 20 bp, Homo sapiens
cctctgccacctcccctatc

SEQ ID NO: 3926840 - DNA, 14 bp, Homo sapiens
cctctgccatgccc

SEQ ID NO: 3926841 - DNA, 20 bp, Homo sapiens
cctctgccccaagcagccag

SEQ ID NO: 3926842 - DNA, 22 bp, Homo sapiens
cctctgccccaaggggcccaca

SEQ ID NO: 3926843 - DNA, 18 bp, Homo sapiens
cctctgcccgcagagccc

SEQ ID NO: 3926844 - DNA, 15 bp, Homo sapiens
cctctgccctgcctc

SEQ ID NO: 3926845 - DNA, 17 bp, Homo sapiens
cctctgccctgcctccc

SEQ ID NO: 3926846 - DNA, 13 bp, Homo sapiens
cctctgcctcaat

SEQ ID NO: 3926847 - DNA, 19 bp, Homo sapiens
cctctgcctgtctccccca

SEQ ID NO: 3926848 - DNA, 21 bp, Homo sapiens
cctctgctctgaggcttccag

SEQ ID NO: 3926849 - DNA, 20 bp, Homo sapiens
cctctgcttgcatcacttgg

SEQ ID NO: 3926850 - DNA, 21 bp, Homo sapiens
cctctggatccctggaggggc

SEQ ID NO: 3926851 - DNA, 20 bp, Homo sapiens
cctctggatcctgctgtggc

SEQ ID NO: 3926852 - DNA, 14 bp, Homo sapiens
cctctggcccagcc

SEQ ID NO: 3926853 - DNA, 15 bp, Homo sapiens
cctctggcccagcct

SEQ ID NO: 3926854 - DNA, 22 bp, Homo sapiens
cctctgggcagctgtcatggaa

SEQ ID NO: 3926855 - DNA, 19 bp, Homo sapiens
cctctgggccaagactcct

SEQ ID NO: 3926856 - DNA, 19 bp, Homo sapiens
cctctggggttcatctagg

SEQ ID NO: 3926857 - DNA, 23 bp, Homo sapiens
cctctggggttcatctagggaca

SEQ ID NO: 3926858 - DNA, 15 bp, Homo sapiens
cctctgtcatcactc

SEQ ID NO: 3926859 - DNA, 20 bp, Homo sapiens
cctctgtcatcactccctgg

SEQ ID NO: 3926860 - DNA, 22 bp, Homo sapiens
cctctgtctcgagcgccctgca

SEQ ID NO: 3926861 - DNA, 19 bp, Homo sapiens
cctcttagtgattgtgtct

SEQ ID NO: 3926862 - DNA, 15 bp, Homo sapiens
cctcttccccttgcc

SEQ ID NO: 3926863 - DNA, 15 bp, Homo sapiens
cctcttcctccctca

SEQ ID NO: 3926864 - DNA, 19 bp, Homo sapiens
cctcttcctccctcattcc

SEQ ID NO: 3926865 - DNA, 14 bp, Homo sapiens
cctcttcctcctgg

SEQ ID NO: 3926866 - DNA, 17 bp, Homo sapiens
cctcttctattttgtaa

SEQ ID NO: 3926867 - DNA, 16 bp, Homo sapiens
cctcttctgccaagag

SEQ ID NO: 3926868 - DNA, 14 bp, Homo sapiens
cctcttctgccagc

SEQ ID NO: 3926869 - DNA, 14 bp, Homo sapiens
cctcttgccactgc

SEQ ID NO: 3926870 - DNA, 14 bp, Homo sapiens
cctcttgcctctct

SEQ ID NO: 3926871 - DNA, 12 bp, Homo sapiens
cctcttgctcaa

SEQ ID NO: 3926872 - DNA, 15 bp, Homo sapiens
cctcttggacctctg

SEQ ID NO: 3926873 - DNA, 13 bp, Homo sapiens
cctcttgtgctca

SEQ ID NO: 3926874 - DNA, 19 bp, Homo sapiens
cctctttactcccttcctg

SEQ ID NO: 3926875 - DNA, 21 bp, Homo sapiens
cctctttccccacctcttcct

SEQ ID NO: 3926876 - DNA, 13 bp, Homo sapiens
cctctttctctcc

SEQ ID NO: 3926877 - DNA, 17 bp, Homo sapiens
cctcttttccctctcta

SEQ ID NO: 3926878 - DNA, 16 bp, Homo sapiens
cctgaaaacccagaga

SEQ ID NO: 3926879 - DNA, 17 bp, Homo sapiens
cctgaaaacccagagag

SEQ ID NO: 3926880 - DNA, 15 bp, Homo sapiens
cctgaacaagaattg

SEQ ID NO: 3926881 - DNA, 15 bp, Homo sapiens
cctgaaccccatggg

SEQ ID NO: 3926882 - DNA, 16 bp, Homo sapiens
cctgaaccccatgggc

SEQ ID NO: 3926883 - DNA, 18 bp, Homo sapiens
cctgaaccccatgggctt

SEQ ID NO: 3926884 - DNA, 23 bp, Homo sapiens
cctgaaccccatgggcttggact

SEQ ID NO: 3926885 - DNA, 19 bp, Homo sapiens
cctgaagaaaccacaggtt

SEQ ID NO: 3926886 - DNA, 13 bp, Homo sapiens
cctgaaggttcct

SEQ ID NO: 3926887 - DNA, 16 bp, Homo sapiens
cctgaatattaatccc

SEQ ID NO: 3926888 - DNA, 22 bp, Homo sapiens
cctgaatggttccatgcctgag

SEQ ID NO: 3926889 - DNA, 19 bp, Homo sapiens
cctgaatttattattgttc

SEQ ID NO: 3926890 - DNA, 21 bp, Homo sapiens
cctgaattttgttgctgtttt

SEQ ID NO: 3926891 - DNA, 19 bp, Homo sapiens
cctgacaagcactgctagg

SEQ ID NO: 3926892 - DNA, 13 bp, Homo sapiens
cctgacaatggca

SEQ ID NO: 3926893 - DNA, 21 bp, Homo sapiens
cctgacagatgtcagccgagc

SEQ ID NO: 3926894 - DNA, 19 bp, Homo sapiens
cctgacaggttcccagcag

SEQ ID NO: 3926895 - DNA, 21 bp, Homo sapiens
cctgacaggttcccagcagct

SEQ ID NO: 3926896 - DNA, 14 bp, Homo sapiens
cctgaccggcacct

SEQ ID NO: 3926897 - DNA, 13 bp, Homo sapiens
cctgacctcccag

SEQ ID NO: 3926898 - DNA, 17 bp, Homo sapiens
cctgacctcccagccct

SEQ ID NO: 3926899 - DNA, 18 bp, Homo sapiens
cctgacctcccagcccta

SEQ ID NO: 3926900 - DNA, 22 bp, Homo sapiens
cctgacgccctgcgttggagcc

SEQ ID NO: 3926901 - DNA, 16 bp, Homo sapiens
cctgactccctgtggg

SEQ ID NO: 3926902 - DNA, 23 bp, Homo sapiens
cctgactggtgctataggctgga

SEQ ID NO: 3926903 - DNA, 13 bp, Homo sapiens
cctgagactccag

SEQ ID NO: 3926904 - DNA, 14 bp, Homo sapiens
cctgagactccaga

SEQ ID NO: 3926905 - DNA, 15 bp, Homo sapiens
cctgagactccagaa

SEQ ID NO: 3926906 - DNA, 23 bp, Homo sapiens
cctgagactccagaatctgctgt

SEQ ID NO: 3926907 - DNA, 17 bp, Homo sapiens
cctgagcactgccagga

SEQ ID NO: 3926908 - DNA, 14 bp, Homo sapiens
cctgagcccaggag

SEQ ID NO: 3926909 - DNA, 15 bp, Homo sapiens
cctgagcccagggag

SEQ ID NO: 3926910 - DNA, 16 bp, Homo sapiens
cctgagcctgccgagc

SEQ ID NO: 3926911 - DNA, 21 bp, Homo sapiens
cctgagcctgccgagcaaccg

SEQ ID NO: 3926912 - DNA, 18 bp, Homo sapiens
cctgagctagaagctgga

SEQ ID NO: 3926913 - DNA, 21 bp, Homo sapiens
cctgagctagaagctggagga

SEQ ID NO: 3926914 - DNA, 11 bp, Homo sapiens
cctgagctggg

SEQ ID NO: 3926915 - DNA, 12 bp, Homo sapiens
cctgagctgggg

SEQ ID NO: 3926916 - DNA, 22 bp, Homo sapiens
cctgagctggggcctggagagg

SEQ ID NO: 3926917 - DNA, 23 bp, Homo sapiens
cctgagctggggcctggagaggg

SEQ ID NO: 3926918 - DNA, 16 bp, Homo sapiens
cctgagctttggggac

SEQ ID NO: 3926919 - DNA, 18 bp, Homo sapiens
cctgagctttggggacag

SEQ ID NO: 3926920 - DNA, 18 bp, Homo sapiens
cctgaggagtctgaggtc

SEQ ID NO: 3926921 - DNA, 19 bp, Homo sapiens
cctgaggagtctgaggtcc

SEQ ID NO: 3926922 - DNA, 13 bp, Homo sapiens
cctgggccaaaag

SEQ ID NO: 3926923 - DNA, 12 bp, Homo sapiens
cctgggcccagg

SEQ ID NO: 3926924 - DNA, 14 bp, Homo sapiens
cctgggcccaggct

SEQ ID NO: 3926925 - DNA, 15 bp, Homo sapiens
cctgggcccaggctc

SEQ ID NO: 3926926 - DNA, 16 bp, Homo sapiens
cctgggcccaggctct

SEQ ID NO: 3926927 - DNA, 17 bp, Homo sapiens
cctgggcccaggctctg

SEQ ID NO: 3926928 - DNA, 20 bp, Homo sapiens
cctgggcccaggctctggga

SEQ ID NO: 3926929 - DNA, 15 bp, Homo sapiens
cctgggccccaccac

SEQ ID NO: 3926930 - DNA, 23 bp, Homo sapiens
cctgggccccaccacctaggcca

SEQ ID NO: 3926931 - DNA, 12 bp, Homo sapiens
cctgggcccctc

SEQ ID NO: 3926932 - DNA, 21 bp, Homo sapiens
cctgggcccctccacgcctcc

SEQ ID NO: 3926933 - DNA, 23 bp, Homo sapiens
cctgggcccctccacgcctcctg

SEQ ID NO: 3926934 - DNA, 17 bp, Homo sapiens
cctgggccctggggcct

SEQ ID NO: 3926935 - DNA, 22 bp, Homo sapiens
cctgggccctggggcctgtact

SEQ ID NO: 3926936 - DNA, 17 bp, Homo sapiens
cctgggcctatggagag

SEQ ID NO: 3926937 - DNA, 18 bp, Homo sapiens
cctgggcctatggagagc

SEQ ID NO: 3926938 - DNA, 12 bp, Homo sapiens
cctgggcctgct

SEQ ID NO: 3926939 - DNA, 15 bp, Homo sapiens
cctgggcctgctgct

SEQ ID NO: 3926940 - DNA, 16 bp, Homo sapiens
cctgggcctgctgctg

SEQ ID NO: 3926941 - DNA, 19 bp, Homo sapiens
cctgggcctgctgctgaga

SEQ ID NO: 3926942 - DNA, 16 bp, Homo sapiens
cctgggcctgtgcagc

SEQ ID NO: 3926943 - DNA, 14 bp, Homo sapiens
cctgggcctttcct

SEQ ID NO: 3926944 - DNA, 15 bp, Homo sapiens
cctgggcctttcctg

SEQ ID NO: 3926945 - DNA, 20 bp, Homo sapiens
cctgggcctttcctgtgcca

SEQ ID NO: 3926946 - DNA, 14 bp, Homo sapiens
cctggggcctgtac

SEQ ID NO: 3926947 - DNA, 16 bp, Homo sapiens
cctggggctcctttct

SEQ ID NO: 3926948 - DNA, 21 bp, Homo sapiens
cctggggctctaacgcctgag

SEQ ID NO: 3926949 - DNA, 15 bp, Homo sapiens
cctgggggccagctg

SEQ ID NO: 3926950 - DNA, 19 bp, Homo sapiens
cctgggggcctggctggct

SEQ ID NO: 3926951 - DNA, 22 bp, Homo sapiens
cctgggggttctttcttcctct

SEQ ID NO: 3926952 - DNA, 18 bp, Homo sapiens
cctggggtctctgctgca

SEQ ID NO: 3926953 - DNA, 20 bp, Homo sapiens
cctgggtcctgttccctacc

SEQ ID NO: 3926954 - DNA, 23 bp, Homo sapiens
cctgggtgagaatcctgcctctc

SEQ ID NO: 3926955 - DNA, 18 bp, Homo sapiens
cctgggtgccattcccag

SEQ ID NO: 3926956 - DNA, 15 bp, Homo sapiens
cctgggtggctactc

SEQ ID NO: 3926957 - DNA, 23 bp, Homo sapiens
cctgggtggctactctgtgccag

SEQ ID NO: 3926958 - DNA, 15 bp, Homo sapiens
cctgggtggggctgc

SEQ ID NO: 3926959 - DNA, 17 bp, Homo sapiens
cctgggtggggctgctc

SEQ ID NO: 3926960 - DNA, 23 bp, Homo sapiens
cctgggtggggctgctcctccag

SEQ ID NO: 3926961 - DNA, 22 bp, Homo sapiens
cctgggttttctaactgtaaat

SEQ ID NO: 3926962 - DNA, 21 bp, Homo sapiens
cctggtccctcgtccacaggg

SEQ ID NO: 3926963 - DNA, 14 bp, Homo sapiens
cctggtcctgaggg

SEQ ID NO: 3926964 - DNA, 12 bp, Homo sapiens
cctggtctcctc

SEQ ID NO: 3926965 - DNA, 18 bp, Homo sapiens
cctggtgaggcccagcct

SEQ ID NO: 3926966 - DNA, 22 bp, Homo sapiens
cctggtgattctgatgcagcct

SEQ ID NO: 3926967 - DNA, 21 bp, Homo sapiens
cctggtgctgccacacttcag

SEQ ID NO: 3926968 - DNA, 14 bp, Homo sapiens
cctggtggcaccag

SEQ ID NO: 3926969 - DNA, 17 bp, Homo sapiens
cctggtggcaccagatg

SEQ ID NO: 3926970 - DNA, 18 bp, Homo sapiens
cctggtggggcagctcct

SEQ ID NO: 3926971 - DNA, 23 bp, Homo sapiens
cctggtgtgaggctgggccagcc

SEQ ID NO: 3926972 - DNA, 18 bp, Homo sapiens
cctggtttctgttctgtt

SEQ ID NO: 3926973 - DNA, 21 bp, Homo sapiens
cctgtaacacaagccacagaa

SEQ ID NO: 3926974 - DNA, 22 bp, Homo sapiens
cctgtaacacaagccacagaag

SEQ ID NO: 3926975 - DNA, 14 bp, Homo sapiens
cctgtaatcccagc

SEQ ID NO: 3926976 - DNA, 15 bp, Homo sapiens
cctgtaatcccagca

SEQ ID NO: 3926977 - DNA, 13 bp, Homo sapiens
cctgtacccagct

SEQ ID NO: 3926978 - DNA, 17 bp, Homo sapiens
cctgtaccccagcactt

SEQ ID NO: 3926979 - DNA, 14 bp, Homo sapiens
cctgtactgcctgc

SEQ ID NO: 3926980 - DNA, 19 bp, Homo sapiens
cctgtactgggttattttt

SEQ ID NO: 3926981 - DNA, 15 bp, Homo sapiens
cctgtagcatcttct

SEQ ID NO: 3926982 - DNA, 21 bp, Homo sapiens
cctgtagcatcttctggagtc

SEQ ID NO: 3926983 - DNA, 20 bp, Homo sapiens
cctgtagctctgcctccctc

SEQ ID NO: 3926984 - DNA, 22 bp, Homo sapiens
cctgtagttaggaaataaaacc

SEQ ID NO: 3926985 - DNA, 16 bp, Homo sapiens
cctgtataaccccacc

SEQ ID NO: 3926986 - DNA, 17 bp, Homo sapiens
cctgtataaccccacct

SEQ ID NO: 3926987 - DNA, 17 bp, Homo sapiens
cctgtatataatactaa

SEQ ID NO: 3926988 - DNA, 21 bp, Homo sapiens
cctgtatattatggtgtaatg

SEQ ID NO: 3926989 - DNA, 23 bp, Homo sapiens
cctgtatattatggtgtaatgca

SEQ ID NO: 3926990 - DNA, 21 bp, Homo sapiens
cctgtatttgttcccaagagc

SEQ ID NO: 3926991 - DNA, 13 bp, Homo sapiens
cctgtcagagatc

SEQ ID NO: 3926992 - DNA, 22 bp, Homo sapiens
cctgtcattcccaccaccctga

SEQ ID NO: 3926993 - DNA, 23 bp, Homo sapiens
cctgtccaacctaacccctttcc

SEQ ID NO: 3926994 - DNA, 19 bp, Homo sapiens
cctgtcccaccaactctgc

SEQ ID NO: 3926995 - DNA, 21 bp, Homo sapiens
cctgtcccaccaactctgcac

SEQ ID NO: 3926996 - DNA, 13 bp, Homo sapiens
cctgtcccacctc

SEQ ID NO: 3926997 - DNA, 16 bp, Homo sapiens
cctgtcccacctcttc

SEQ ID NO: 3926998 - DNA, 14 bp, Homo sapiens
cctgtcccagaggt

SEQ ID NO: 3926999 - DNA, 19 bp, Homo sapiens
cctgtcccctgaaaaactg

SEQ ID NO: 3927000 - DNA, 22 bp, Homo sapiens
cctgtcccgccttcctcctcca

SEQ ID NO: 3927001 - DNA, 16 bp, Homo sapiens
cctgtccctacccact

SEQ ID NO: 3927002 - DNA, 20 bp, Homo sapiens
cctgtccctacccactcttt

SEQ ID NO: 3927003 - DNA, 17 bp, Homo sapiens
cctgtcctcccatcccc

SEQ ID NO: 3927004 - DNA, 23 bp, Homo sapiens
cctgtcctcccatcccctggact

SEQ ID NO: 3927005 - DNA, 14 bp, Homo sapiens
cctgtcctcctcgg

SEQ ID NO: 3927006 - DNA, 21 bp, Homo sapiens
cctgtcctggtacagcagggt

SEQ ID NO: 3927007 - DNA, 15 bp, Homo sapiens
cctgtgactatggct

SEQ ID NO: 3927008 - DNA, 10 bp, Homo sapiens
aaaaattgca

SEQ ID NO: 3927009 - DNA, 12 bp, Homo sapiens
aaaaattgcaca

SEQ ID NO: 3927010 - DNA, 18 bp, Homo sapiens
aaaaattgcacaatttga

SEQ ID NO: 3927011 - DNA, 15 bp, Homo sapiens
aaaacaaatcactgt

SEQ ID NO: 3927012 - DNA, 14 bp, Homo sapiens
aaaacaacaacaat

SEQ ID NO: 3927013 - DNA, 15 bp, Homo sapiens
aaaacaagaatgaaa

SEQ ID NO: 3927014 - DNA, 12 bp, Homo sapiens
aaaacacagcaa

SEQ ID NO: 3927015 - DNA, 14 bp, Homo sapiens
aaaacactagtttt

SEQ ID NO: 3927016 - DNA, 17 bp, Homo sapiens
aaaacataaaatataca

SEQ ID NO: 3927017 - DNA, 16 bp, Homo sapiens
aaaacatatcaattca

SEQ ID NO: 3927018 - DNA, 19 bp, Homo sapiens
aaaacatatcaattcaaca

SEQ ID NO: 3927019 - DNA, 13 bp, Homo sapiens
aaaacattcatcc

SEQ ID NO: 3927020 - DNA, 19 bp, Homo sapiens
aaaaccaagccgtggcttc

SEQ ID NO: 3927021 - DNA, 14 bp, Homo sapiens
aaaaccaatgattc

SEQ ID NO: 3927022 - DNA, 15 bp, Homo sapiens
aaaaccatgcagctt

SEQ ID NO: 3927023 - DNA, 20 bp, Homo sapiens
aaaaccatgcagcttcatca

SEQ ID NO: 3927024 - DNA, 18 bp, Homo sapiens
aaaaccctgctttttgac

SEQ ID NO: 3927025 - DNA, 13 bp, Homo sapiens
aaaaccttgattt

SEQ ID NO: 3927026 - DNA, 21 bp, Homo sapiens
aaaacctttccccagacacat

SEQ ID NO: 3927027 - DNA, 23 bp, Homo sapiens
aaaacgcctcttttccctctcta

SEQ ID NO: 3927028 - DNA, 17 bp, Homo sapiens
aaaactaaatatatgtc

SEQ ID NO: 3927029 - DNA, 17 bp, Homo sapiens
aaaactatccaattaaa

SEQ ID NO: 3927030 - DNA, 12 bp, Homo sapiens
aaaactatggtt

SEQ ID NO: 3927031 - DNA, 18 bp, Homo sapiens
aaaactcagttaaaatgt

SEQ ID NO: 3927032 - DNA, 21 bp, Homo sapiens
aaaactgatcaaaaataaact

SEQ ID NO: 3927033 - DNA, 11 bp, Homo sapiens
aaaacttattt

SEQ ID NO: 3927034 - DNA, 15 bp, Homo sapiens
aaaacttatttgagt

SEQ ID NO: 3927035 - DNA, 15 bp, Homo sapiens
aaaacttgaatctgt

SEQ ID NO: 3927036 - DNA, 14 bp, Homo sapiens
aaaagaaaaccatt

SEQ ID NO: 3927037 - DNA, 10 bp, Homo sapiens
aaaagaaagc

SEQ ID NO: 3927038 - DNA, 12 bp, Homo sapiens
aaaagaaatgaa

SEQ ID NO: 3927039 - DNA, 16 bp, Homo sapiens
aaaagaacagtaaaca

SEQ ID NO: 3927040 - DNA, 12 bp, Homo sapiens
aaaagacatgtt

SEQ ID NO: 3927041 - DNA, 18 bp, Homo sapiens
aaaagacatgttgtaaat

SEQ ID NO: 3927042 - DNA, 22 bp, Homo sapiens
aaaagactattaagagcaataa

SEQ ID NO: 3927043 - DNA, 18 bp, Homo sapiens
aaaagagaaaaaccaatg

SEQ ID NO: 3927044 - DNA, 13 bp, Homo sapiens
aaaagataaagat

SEQ ID NO: 3927045 - DNA, 15 bp, Homo sapiens
aaaagcataaatgca

SEQ ID NO: 3927046 - DNA, 16 bp, Homo sapiens
aaaagcatgactattt

SEQ ID NO: 3927047 - DNA, 11 bp, Homo sapiens
aaaagcccagt

SEQ ID NO: 3927048 - DNA, 16 bp, Homo sapiens
aaaagcccagtgacct

SEQ ID NO: 3927049 - DNA, 21 bp, Homo sapiens
aaaagcccagtgacctgaccg

SEQ ID NO: 3927050 - DNA, 12 bp, Homo sapiens
aaaagctcctgt

SEQ ID NO: 3927051 - DNA, 20 bp, Homo sapiens
aaaagctcttacactacatt

SEQ ID NO: 3927052 - DNA, 19 bp, Homo sapiens
aaaagctgaagcctattta

SEQ ID NO: 3927053 - DNA, 21 bp, Homo sapiens
aaaagctgcttgactatcaca

SEQ ID NO: 3927054 - DNA, 21 bp, Homo sapiens
aaaaggagaaaggagctctga

SEQ ID NO: 3927055 - DNA, 18 bp, Homo sapiens
aaaaggagagaagaaagt

SEQ ID NO: 3927056 - DNA, 18 bp, Homo sapiens
aaaaggccagtggaaatt

SEQ ID NO: 3927057 - DNA, 12 bp, Homo sapiens
aaaaggcctggg

SEQ ID NO: 3927058 - DNA, 20 bp, Homo sapiens
aaaaggctaggtacacagct

SEQ ID NO: 3927059 - DNA, 11 bp, Homo sapiens
aaaaggggcat

SEQ ID NO: 3927060 - DNA, 15 bp, Homo sapiens
aaaaggtattaaatt

SEQ ID NO: 3927061 - DNA, 20 bp, Homo sapiens
aaaaggtgcctgtgaggcag

SEQ ID NO: 3927062 - DNA, 13 bp, Homo sapiens
aaaagtacattta

SEQ ID NO: 3927063 - DNA, 14 bp, Homo sapiens
aaaagtaccataga

SEQ ID NO: 3927064 - DNA, 18 bp, Homo sapiens
aaaagtagaattatatct

SEQ ID NO: 3927065 - DNA, 21 bp, Homo sapiens
aaaagtgcaatgcgtgttgta

SEQ ID NO: 3927066 - DNA, 17 bp, Homo sapiens
aaaagtgcttagaaagt

SEQ ID NO: 3927067 - DNA, 21 bp, Homo sapiens
aaaagtggctaattcaattta

SEQ ID NO: 3927068 - DNA, 22 bp, Homo sapiens
aaaagtttacaagtgtatatca

SEQ ID NO: 3927069 - DNA, 17 bp, Homo sapiens
aaaagtttgccagaagt

SEQ ID NO: 3927070 - DNA, 16 bp, Homo sapiens
aaaataaaaaaataca

SEQ ID NO: 3927071 - DNA, 20 bp, Homo sapiens
aaaataaaaaaatacagtaa

SEQ ID NO: 3927072 - DNA, 17 bp, Homo sapiens
aaaataaaaaccagaat

SEQ ID NO: 3927073 - DNA, 20 bp, Homo sapiens
aaaataaaccaaaggacatt

SEQ ID NO: 3927074 - DNA, 18 bp, Homo sapiens
aaaataaactagtttcca

SEQ ID NO: 3927075 - DNA, 21 bp, Homo sapiens
aaaataaactagtttccagtg

SEQ ID NO: 3927076 - DNA, 14 bp, Homo sapiens
aaaataaatgtttt

SEQ ID NO: 3927077 - DNA, 15 bp, Homo sapiens
aaaataacttatatc

SEQ ID NO: 3927078 - DNA, 23 bp, Homo sapiens
aaaataataggatataaaacaca

SEQ ID NO: 3927079 - DNA, 16 bp, Homo sapiens
aaaataattgatttca

SEQ ID NO: 3927080 - DNA, 22 bp, Homo sapiens
aaaataattgatttcaagacct

SEQ ID NO: 3927081 - DNA, 12 bp, Homo sapiens
aaaataatttaa

SEQ ID NO: 3927082 - DNA, 14 bp, Homo sapiens
aaaataatttaact

SEQ ID NO: 3927083 - DNA, 20 bp, Homo sapiens
aaaataatttaactaattta

SEQ ID NO: 3927084 - DNA, 22 bp, Homo sapiens
aaaataatttaactaatttaaa

SEQ ID NO: 3927085 - DNA, 23 bp, Homo sapiens
aaaataatttaactaatttaaac

SEQ ID NO: 3927086 - DNA, 19 bp, Homo sapiens
aaaataattttaaacaaag

SEQ ID NO: 3927087 - DNA, 13 bp, Homo sapiens
aaaatacagtaaa

SEQ ID NO: 3927088 - DNA, 14 bp, Homo sapiens
aaaatacagtaaag

SEQ ID NO: 3927089 - DNA, 21 bp, Homo sapiens
aaaatactatgaaatgaaaga

SEQ ID NO: 3927090 - DNA, 19 bp, Homo sapiens
aaaatacttgagctgtata

SEQ ID NO: 3927091 - DNA, 22 bp, Homo sapiens
aaaatagcaacactctatattt

SEQ ID NO: 3927092 - DNA, 10 bp, Homo sapiens
aaaatataaa

SEQ ID NO: 3927093 - DNA, 22 bp, Homo sapiens
aaaatataaatgcatgatttta

SEQ ID NO: 3927094 - DNA, 13 bp, Homo sapiens
aaaatataaatta

SEQ ID NO: 3927095 - DNA, 22 bp, Homo sapiens
aaaccaagtctacttcactaat

SEQ ID NO: 3927096 - DNA, 17 bp, Homo sapiens
aaaccaatgattcataa

SEQ ID NO: 3927097 - DNA, 16 bp, Homo sapiens
aaaccagaatcataat

SEQ ID NO: 3927098 - DNA, 17 bp, Homo sapiens
aaaccagaatcataatt

SEQ ID NO: 3927099 - DNA, 16 bp, Homo sapiens
aaaccagcagaaaagt

SEQ ID NO: 3927100 - DNA, 18 bp, Homo sapiens
aaaccagttaagaatgga

SEQ ID NO: 3927101 - DNA, 14 bp, Homo sapiens
aaaccatgcagctt

SEQ ID NO: 3927102 - DNA, 20 bp, Homo sapiens
aaaccatgcagcttcatcaa

SEQ ID NO: 3927103 - DNA, 16 bp, Homo sapiens
aaaccatgtagtttta

SEQ ID NO: 3927104 - DNA, 15 bp, Homo sapiens
aaaccatttaattca

SEQ ID NO: 3927105 - DNA, 13 bp, Homo sapiens
aaaccatttcaaa

SEQ ID NO: 3927106 - DNA, 14 bp, Homo sapiens
aaaccatttcaaat

SEQ ID NO: 3927107 - DNA, 15 bp, Homo sapiens
aaaccatttcaaatg

SEQ ID NO: 3927108 - DNA, 17 bp, Homo sapiens
aaacccagcatgtacaa

SEQ ID NO: 3927109 - DNA, 19 bp, Homo sapiens
aaacccattaggcatgcct

SEQ ID NO: 3927110 - DNA, 18 bp, Homo sapiens
aaacccccgctccagatc

SEQ ID NO: 3927111 - DNA, 13 bp, Homo sapiens
aaacccctgggta

SEQ ID NO: 3927112 - DNA, 11 bp, Homo sapiens
aaaccctggtt

SEQ ID NO: 3927113 - DNA, 16 bp, Homo sapiens
aaacctagaacttcaa

SEQ ID NO: 3927114 - DNA, 23 bp, Homo sapiens
aaacctgaggatgcaacaaatat

SEQ ID NO: 3927115 - DNA, 16 bp, Homo sapiens
aaacctggagatgatg

SEQ ID NO: 3927116 - DNA, 16 bp, Homo sapiens
aaaccttgcagcattt

SEQ ID NO: 3927117 - DNA, 21 bp, Homo sapiens
aaaccttgcagcatttttatt

SEQ ID NO: 3927118 - DNA, 11 bp, Homo sapiens
aaacctttcaa

SEQ ID NO: 3927119 - DNA, 19 bp, Homo sapiens
aaacctttcaaatttcaca

SEQ ID NO: 3927120 - DNA, 19 bp, Homo sapiens
aaacgaagccatctttctt

SEQ ID NO: 3927121 - DNA, 14 bp, Homo sapiens
aaacgagataatgt

SEQ ID NO: 3927122 - DNA, 16 bp, Homo sapiens
aaacgatcgctgtgaa

SEQ ID NO: 3927123 - DNA, 22 bp, Homo sapiens
aaacgcctcttttccctctcta

SEQ ID NO: 3927124 - DNA, 19 bp, Homo sapiens
aaacgtacttaactgtgtg

SEQ ID NO: 3927125 - DNA, 23 bp, Homo sapiens
aaacgtacttaactgtgtgaaga

SEQ ID NO: 3927126 - DNA, 21 bp, Homo sapiens
aaacgtgggtatttcctgcta

SEQ ID NO: 3927127 - DNA, 16 bp, Homo sapiens
aaactagaagtcaaaa

SEQ ID NO: 3927128 - DNA, 22 bp, Homo sapiens
aaactagtaatgggccaattaa

SEQ ID NO: 3927129 - DNA, 16 bp, Homo sapiens
aaactatcttggtgaa

SEQ ID NO: 3927130 - DNA, 17 bp, Homo sapiens
aaactatgatcacagtg

SEQ ID NO: 3927131 - DNA, 21 bp, Homo sapiens
aaactatggttcccaataaaa

SEQ ID NO: 3927132 - DNA, 20 bp, Homo sapiens
aaactatttgtctttcagga

SEQ ID NO: 3927133 - DNA, 13 bp, Homo sapiens
aaactcaaaactt

SEQ ID NO: 3927134 - DNA, 13 bp, Homo sapiens
aaactcaaaatat

SEQ ID NO: 3927135 - DNA, 21 bp, Homo sapiens
aaactcaaaatatttgtacat

SEQ ID NO: 3927136 - DNA, 16 bp, Homo sapiens
aaactcactgctcaag

SEQ ID NO: 3927137 - DNA, 15 bp, Homo sapiens
aaactcagttaaaat

SEQ ID NO: 3927138 - DNA, 17 bp, Homo sapiens
aaactcagttaaaatgt

SEQ ID NO: 3927139 - DNA, 17 bp, Homo sapiens
aaactcctgattttgta

SEQ ID NO: 3927140 - DNA, 14 bp, Homo sapiens
aaactcctgcctgt

SEQ ID NO: 3927141 - DNA, 14 bp, Homo sapiens
aaactccttttgct

SEQ ID NO: 3927142 - DNA, 19 bp, Homo sapiens
aaactccttttgctgtctt

SEQ ID NO: 3927143 - DNA, 20 bp, Homo sapiens
aaactccttttgctgtcttt

SEQ ID NO: 3927144 - DNA, 14 bp, Homo sapiens
aaactgaaaatcta

SEQ ID NO: 3927145 - DNA, 13 bp, Homo sapiens
aaactgagaaatg

SEQ ID NO: 3927146 - DNA, 13 bp, Homo sapiens
aaactgaggagta

SEQ ID NO: 3927147 - DNA, 21 bp, Homo sapiens
aaactgaggagtagctgagag

SEQ ID NO: 3927148 - DNA, 19 bp, Homo sapiens
aaactgaggccattatttc

SEQ ID NO: 3927149 - DNA, 16 bp, Homo sapiens
aaactgatcaaaaata

SEQ ID NO: 3927150 - DNA, 18 bp, Homo sapiens
aaactgatcaaaaataaa

SEQ ID NO: 3927151 - DNA, 20 bp, Homo sapiens
aaactgatcaaaaataaact

SEQ ID NO: 3927152 - DNA, 22 bp, Homo sapiens
aaactgatcaaaaataaactag

SEQ ID NO: 3927153 - DNA, 14 bp, Homo sapiens
aaactgcattagaa

SEQ ID NO: 3927154 - DNA, 17 bp, Homo sapiens
aaacttagaataaaatt

SEQ ID NO: 3927155 - DNA, 14 bp, Homo sapiens
aaacttatttgagt

SEQ ID NO: 3927156 - DNA, 21 bp, Homo sapiens
aaacttgaatctgttactgaa

SEQ ID NO: 3927157 - DNA, 21 bp, Homo sapiens
aaactttagagtagcatgaga

SEQ ID NO: 3927158 - DNA, 20 bp, Homo sapiens
aaagaaaccgtaattttatt

SEQ ID NO: 3927159 - DNA, 15 bp, Homo sapiens
aaagaaatgtaaggg

SEQ ID NO: 3927160 - DNA, 22 bp, Homo sapiens
aaagaaccaaaagttttcctga

SEQ ID NO: 3927161 - DNA, 23 bp, Homo sapiens
aaagaacggcatgtgaattctgt

SEQ ID NO: 3927162 - DNA, 13 bp, Homo sapiens
aaagaactgcccc

SEQ ID NO: 3927163 - DNA, 23 bp, Homo sapiens
aaagaaggctgcctaaggaggag

SEQ ID NO: 3927164 - DNA, 15 bp, Homo sapiens
aaagaagtaaatttg

SEQ ID NO: 3927165 - DNA, 20 bp, Homo sapiens
aaagaagtaaatttgtccaa

SEQ ID NO: 3927166 - DNA, 23 bp, Homo sapiens
aaagaagtaggggaagacatgca

SEQ ID NO: 3927167 - DNA, 13 bp, Homo sapiens
aaagaatattcag

SEQ ID NO: 3927168 - DNA, 13 bp, Homo sapiens
aaagacagaatgt

SEQ ID NO: 3927169 - DNA, 20 bp, Homo sapiens
aaagacagtggatcatgaaa

SEQ ID NO: 3927170 - DNA, 22 bp, Homo sapiens
aaagacagtggatcatgaaaag

SEQ ID NO: 3927171 - DNA, 13 bp, Homo sapiens
aaagaccagggct

SEQ ID NO: 3927172 - DNA, 22 bp, Homo sapiens
aaagactattaagagcaataaa

SEQ ID NO: 3927173 - DNA, 15 bp, Homo sapiens
aaagactattcaaac

SEQ ID NO: 3927174 - DNA, 17 bp, Homo sapiens
aaagactgcagctgctg

SEQ ID NO: 3927175 - DNA, 18 bp, Homo sapiens
aaagactgcagctgctga

SEQ ID NO: 3927176 - DNA, 18 bp, Homo sapiens
aaagagaaaaaaagtttg

SEQ ID NO: 3927177 - DNA, 22 bp, Homo sapiens
aaagagctttagtcctagagga

SEQ ID NO: 3927178 - DNA, 20 bp, Homo sapiens
aaagaggcagcttgaaactg

SEQ ID NO: 3927179 - DNA, 20 bp, Homo sapiens
aaagaggtgaccccagggca

SEQ ID NO: 3927180 - DNA, 21 bp, Homo sapiens
aaagaggtggattcctgggca

SEQ ID NO: 3927181 - DNA, 22 bp, Homo sapiens
aaagagtgggctgcatctggga

SEQ ID NO: 3927182 - DNA, 13 bp, Homo sapiens
aaagataaagatg

SEQ ID NO: 3927183 - DNA, 22 bp, Homo sapiens
aaagataacaagatctttcagg

SEQ ID NO: 3927184 - DNA, 13 bp, Homo sapiens
aaagatgaaaata

SEQ ID NO: 3927185 - DNA, 16 bp, Homo sapiens
aaagatggatgtgctt

SEQ ID NO: 3927186 - DNA, 14 bp, Homo sapiens
aaagcaaaagaagt

SEQ ID NO: 3927187 - DNA, 14 bp, Homo sapiens
aaagcaaaataata

SEQ ID NO: 3927188 - DNA, 13 bp, Homo sapiens
aaagcaaatgaga

SEQ ID NO: 3927189 - DNA, 14 bp, Homo sapiens
aaagcaagactgtt

SEQ ID NO: 3927190 - DNA, 20 bp, Homo sapiens
aaagcaagggctccagcatc

SEQ ID NO: 3927191 - DNA, 15 bp, Homo sapiens
aaagcaattatattg

SEQ ID NO: 3927192 - DNA, 15 bp, Homo sapiens
aaagcacaggagaca

SEQ ID NO: 3927193 - DNA, 14 bp, Homo sapiens
aaagcactttttaa

SEQ ID NO: 3927194 - DNA, 17 bp, Homo sapiens
aaagcattgtaaatgtg

SEQ ID NO: 3927195 - DNA, 19 bp, Homo sapiens
aaagcattgtaaatgtgct

SEQ ID NO: 3927196 - DNA, 20 bp, Homo sapiens
aaagcattgtaaatgtgctt

SEQ ID NO: 3927197 - DNA, 19 bp, Homo sapiens
aaagccagctgccgaccag

SEQ ID NO: 3927198 - DNA, 16 bp, Homo sapiens
aaagcccaacctcctg

SEQ ID NO: 3927199 - DNA, 17 bp, Homo sapiens
aaagccctcccccttcc

SEQ ID NO: 3927200 - DNA, 20 bp, Homo sapiens
aaagctacctgtggtgatgt

SEQ ID NO: 3927201 - DNA, 16 bp, Homo sapiens
aaagctcctgtcctcc

SEQ ID NO: 3927202 - DNA, 15 bp, Homo sapiens
aaagctgaagaaaat

SEQ ID NO: 3927203 - DNA, 17 bp, Homo sapiens
aaagctgcctgtagtta

SEQ ID NO: 3927204 - DNA, 20 bp, Homo sapiens
aaagctggacaagaagctgc

SEQ ID NO: 3927205 - DNA, 21 bp, Homo sapiens
aaagctggacaagaagctgct

SEQ ID NO: 3927206 - DNA, 21 bp, Homo sapiens
aaagcttctatcccaggaggt

SEQ ID NO: 3927207 - DNA, 14 bp, Homo sapiens
aaaggacattatgt

SEQ ID NO: 3927208 - DNA, 22 bp, Homo sapiens
aaaggactaacataaaatctgt

SEQ ID NO: 3927209 - DNA, 16 bp, Homo sapiens
aaaggagagaagaaag

SEQ ID NO: 3927210 - DNA, 15 bp, Homo sapiens
aaaggatattttctt

SEQ ID NO: 3927211 - DNA, 17 bp, Homo sapiens
aaaggatgaaagtctga

SEQ ID NO: 3927212 - DNA, 20 bp, Homo sapiens
aaaggatgaaagtctgagaa

SEQ ID NO: 3927213 - DNA, 21 bp, Homo sapiens
aaaggatgtaaacagtgcctg

SEQ ID NO: 3927214 - DNA, 13 bp, Homo sapiens
aaaggattaagat

SEQ ID NO: 3927215 - DNA, 18 bp, Homo sapiens
aaaggattcatgtggaat

SEQ ID NO: 3927216 - DNA, 11 bp, Homo sapiens
aaaggcctgga

SEQ ID NO: 3927217 - DNA, 12 bp, Homo sapiens
aaaggcctgggg

SEQ ID NO: 3927218 - DNA, 21 bp, Homo sapiens
aaaggcgcagtgcttctctac

SEQ ID NO: 3927219 - DNA, 14 bp, Homo sapiens
aaagggaaactatt

SEQ ID NO: 3927220 - DNA, 23 bp, Homo sapiens
aaagggacccgaagcccaggctg

SEQ ID NO: 3927221 - DNA, 23 bp, Homo sapiens
aaagggagcactgggttgacttt

SEQ ID NO: 3927222 - DNA, 18 bp, Homo sapiens
aaagggagggctctgagg

SEQ ID NO: 3927223 - DNA, 22 bp, Homo sapiens
aaagggagggctctgaggcgcc

SEQ ID NO: 3927224 - DNA, 14 bp, Homo sapiens
aaagggcagccagg

SEQ ID NO: 3927225 - DNA, 18 bp, Homo sapiens
aaagggcagccaggggct

SEQ ID NO: 3927226 - DNA, 20 bp, Homo sapiens
aaagggcagccaggggctgc

SEQ ID NO: 3927227 - DNA, 23 bp, Homo sapiens
aaaggggagaagggccagcccta

SEQ ID NO: 3927228 - DNA, 19 bp, Homo sapiens
aaaggggagttgagtcaca

SEQ ID NO: 3927229 - DNA, 19 bp, Homo sapiens
aaaggggcgagcacccacg

SEQ ID NO: 3927230 - DNA, 17 bp, Homo sapiens
aaaggtagagatgtgtg

SEQ ID NO: 3927231 - DNA, 18 bp, Homo sapiens
aaaggtctttttaaacca

SEQ ID NO: 3927232 - DNA, 21 bp, Homo sapiens
aaaggtgcctgtgaggcaggg

SEQ ID NO: 3927233 - DNA, 14 bp, Homo sapiens
aaaggtgtgtcaaa

SEQ ID NO: 3927234 - DNA, 19 bp, Homo sapiens
aaaggttgttttgaaactg

SEQ ID NO: 3927235 - DNA, 15 bp, Homo sapiens
aaaggtttcatgtag

SEQ ID NO: 3927236 - DNA, 19 bp, Homo sapiens
aaagtaccatagaacagaa

SEQ ID NO: 3927237 - DNA, 23 bp, Homo sapiens
aaagtactctttaagagtgaaat

SEQ ID NO: 3927238 - DNA, 17 bp, Homo sapiens
aaagtagaattatatct

SEQ ID NO: 3927239 - DNA, 22 bp, Homo sapiens
aaagtagaattatatctaattt

SEQ ID NO: 3927240 - DNA, 16 bp, Homo sapiens
aaagtatacttttgtt

SEQ ID NO: 3927241 - DNA, 14 bp, Homo sapiens
aaagtatatattta

SEQ ID NO: 3927242 - DNA, 15 bp, Homo sapiens
aaagtatatatttat

SEQ ID NO: 3927243 - DNA, 15 bp, Homo sapiens
aaagtcgaattaata

SEQ ID NO: 3927244 - DNA, 12 bp, Homo sapiens
aaagtctaaagt

SEQ ID NO: 3927245 - DNA, 17 bp, Homo sapiens
aaagtctgtgtccaatt

SEQ ID NO: 3927246 - DNA, 22 bp, Homo sapiens
aaagtctgtgtgatgaactttc

SEQ ID NO: 3927247 - DNA, 15 bp, Homo sapiens
aaagtgaataaactt

SEQ ID NO: 3927248 - DNA, 19 bp, Homo sapiens
aaagtgaataaacttcagc

SEQ ID NO: 3927249 - DNA, 19 bp, Homo sapiens
aaagtgcagcccttcctcc

SEQ ID NO: 3927250 - DNA, 17 bp, Homo sapiens
aaagtggattttcctga

SEQ ID NO: 3927251 - DNA, 18 bp, Homo sapiens
aaagtggattttcctgaa

SEQ ID NO: 3927252 - DNA, 19 bp, Homo sapiens
aaagtggctaattcaattt

SEQ ID NO: 3927253 - DNA, 21 bp, Homo sapiens
aaagtgggttcactagagctg

SEQ ID NO: 3927254 - DNA, 19 bp, Homo sapiens
aaagttattgtgatatcct

SEQ ID NO: 3927255 - DNA, 18 bp, Homo sapiens
aaagttattgtgttgcct

SEQ ID NO: 3927256 - DNA, 20 bp, Homo sapiens
aaagttattgtgttgcctta

SEQ ID NO: 3927257 - DNA, 15 bp, Homo sapiens
aaagtttaaaaaata

SEQ ID NO: 3927258 - DNA, 15 bp, Homo sapiens
aaagtttacagtaaa

SEQ ID NO: 3927259 - DNA, 18 bp, Homo sapiens
aaagtttacagtaaataa

SEQ ID NO: 3927260 - DNA, 22 bp, Homo sapiens
aaagtttacagtaaataaattg

SEQ ID NO: 3927261 - DNA, 17 bp, Homo sapiens
aaataaaacctttcaaa

SEQ ID NO: 3927262 - DNA, 13 bp, Homo sapiens
aaataaaatgatg

SEQ ID NO: 3927263 - DNA, 13 bp, Homo sapiens
aaataaaattatg

SEQ ID NO: 3927264 - DNA, 18 bp, Homo sapiens
aaataaacaaataacaat

SEQ ID NO: 3927265 - DNA, 11 bp, Homo sapiens
aaataaacctg

SEQ ID NO: 3927266 - DNA, 12 bp, Homo sapiens
aaataaactagt

SEQ ID NO: 3927267 - DNA, 17 bp, Homo sapiens
aaataaactagtttcca

SEQ ID NO: 3927268 - DNA, 13 bp, Homo sapiens
aaataaacttatt

SEQ ID NO: 3927269 - DNA, 15 bp, Homo sapiens
aaataaatgtatcat

SEQ ID NO: 3927270 - DNA, 16 bp, Homo sapiens
aaataaatgtatcata

SEQ ID NO: 3927271 - DNA, 13 bp, Homo sapiens
aaataaattcaaa

SEQ ID NO: 3927272 - DNA, 23 bp, Homo sapiens
aaataaattggtgataagtggaa

SEQ ID NO: 3927273 - DNA, 12 bp, Homo sapiens
aaataaattgtt

SEQ ID NO: 3927274 - DNA, 13 bp, Homo sapiens
aaataaattgttt

SEQ ID NO: 3927275 - DNA, 15 bp, Homo sapiens
aaataaattttgaat

SEQ ID NO: 3927276 - DNA, 14 bp, Homo sapiens
aaataaattttgtt

SEQ ID NO: 3927277 - DNA, 14 bp, Homo sapiens
aaataacaatgtgc

SEQ ID NO: 3927278 - DNA, 17 bp, Homo sapiens
aaataacaatgtgctct

SEQ ID NO: 3927279 - DNA, 12 bp, Homo sapiens
aaataagagaga

SEQ ID NO: 3927280 - DNA, 17 bp, Homo sapiens
aaataatgtaagggtct

SEQ ID NO: 3927281 - DNA, 18 bp, Homo sapiens
aaataatgtaagggtctg

SEQ ID NO: 3927282 - DNA, 19 bp, Homo sapiens
aaataatttaactaattta

SEQ ID NO: 3927283 - DNA, 21 bp, Homo sapiens
aaataatttaactaatttaaa

SEQ ID NO: 3927284 - DNA, 17 bp, Homo sapiens
aaatacaaaataaaatt

SEQ ID NO: 3927285 - DNA, 18 bp, Homo sapiens
aaatacaaaataaaatta

SEQ ID NO: 3927286 - DNA, 23 bp, Homo sapiens
aaatacacagatgattaaacaga

SEQ ID NO: 3927287 - DNA, 22 bp, Homo sapiens
aaatacaccacctcactcctgt

SEQ ID NO: 3927288 - DNA, 14 bp, Homo sapiens
aaatacagacacta

SEQ ID NO: 3927289 - DNA, 14 bp, Homo sapiens
aaatacatgtgtgg

SEQ ID NO: 3927290 - DNA, 22 bp, Homo sapiens
aaatacatgtgtggatgtgtaa

SEQ ID NO: 3927291 - DNA, 13 bp, Homo sapiens
aaatactgtacat

SEQ ID NO: 3927292 - DNA, 16 bp, Homo sapiens
aaatactgtacataga

SEQ ID NO: 3927293 - DNA, 17 bp, Homo sapiens
aaatactgtacatagat

SEQ ID NO: 3927294 - DNA, 21 bp, Homo sapiens
aaatactgtacatagatgtat

SEQ ID NO: 3927295 - DNA, 23 bp, Homo sapiens
aaatactgtacatagatgtatca

SEQ ID NO: 3927296 - DNA, 20 bp, Homo sapiens
aaatacttgagctgtatata

SEQ ID NO: 3927297 - DNA, 15 bp, Homo sapiens
aaatagacagtatat

SEQ ID NO: 3927298 - DNA, 18 bp, Homo sapiens
aaatagagttccaaataa

SEQ ID NO: 3927299 - DNA, 17 bp, Homo sapiens
aaatagatttgattatt

SEQ ID NO: 3927300 - DNA, 19 bp, Homo sapiens
aaatagctccgtggagcag

SEQ ID NO: 3927301 - DNA, 13 bp, Homo sapiens
aaatagctctttc

SEQ ID NO: 3927302 - DNA, 12 bp, Homo sapiens
aaatataaaata

SEQ ID NO: 3927303 - DNA, 13 bp, Homo sapiens
aaatataaatgca

SEQ ID NO: 3927304 - DNA, 15 bp, Homo sapiens
aaatataaatgcatg

SEQ ID NO: 3927305 - DNA, 17 bp, Homo sapiens
aaatataaccattacat

SEQ ID NO: 3927306 - DNA, 19 bp, Homo sapiens
aaatataaccattacatgt

SEQ ID NO: 3927307 - DNA, 20 bp, Homo sapiens
aaatatagagatatttttgt

SEQ ID NO: 3927308 - DNA, 20 bp, Homo sapiens
aaatatatataaatatatat

SEQ ID NO: 3927309 - DNA, 14 bp, Homo sapiens
aaatatatatatat

SEQ ID NO: 3927310 - DNA, 20 bp, Homo sapiens
aaatatatatatatatttaa

SEQ ID NO: 3927311 - DNA, 18 bp, Homo sapiens
aaatatatatttttcaac

SEQ ID NO: 3927312 - DNA, 21 bp, Homo sapiens
aaatatatttaatacctttgg

SEQ ID NO: 3927313 - DNA, 14 bp, Homo sapiens
aaatatcctcaggg

SEQ ID NO: 3927314 - DNA, 23 bp, Homo sapiens
aaatatcctcaggggtggagaag

SEQ ID NO: 3927315 - DNA, 20 bp, Homo sapiens
aaatatctacctgccctctc

SEQ ID NO: 3927316 - DNA, 13 bp, Homo sapiens
aaatatctcagag

SEQ ID NO: 3927317 - DNA, 24 bp, Homo sapiens
aaatatgaaatgataaagatgtca

SEQ ID NO: 3927318 - DNA, 19 bp, Homo sapiens
aaatatggctataaatata

SEQ ID NO: 3927319 - DNA, 13 bp, Homo sapiens
aaatatgtatgtc

SEQ ID NO: 3927320 - DNA, 15 bp, Homo sapiens
aaatatgtttgtgcc

SEQ ID NO: 3927321 - DNA, 22 bp, Homo sapiens
aaatattaccaaaaaagtattt

SEQ ID NO: 3927322 - DNA, 16 bp, Homo sapiens
aaatattctgtaagaa

SEQ ID NO: 3927323 - DNA, 20 bp, Homo sapiens
aaatattgttaccatgaaga

SEQ ID NO: 3927324 - DNA, 17 bp, Homo sapiens
aaatatttaagtatata

SEQ ID NO: 3927325 - DNA, 20 bp, Homo sapiens
aaatatttaagtatatagta

SEQ ID NO: 3927326 - DNA, 15 bp, Homo sapiens
aaatatttatatatt

SEQ ID NO: 3927327 - DNA, 22 bp, Homo sapiens
aaatatttatgcttaaaatatg

SEQ ID NO: 3927328 - DNA, 15 bp, Homo sapiens
aaatatttatgtaaa

SEQ ID NO: 3927329 - DNA, 21 bp, Homo sapiens
aaatatttggtctctatttca

SEQ ID NO: 3927330 - DNA, 15 bp, Homo sapiens
aaatatttgtacata

SEQ ID NO: 3927331 - DNA, 14 bp, Homo sapiens
aaatattttagcct

SEQ ID NO: 3927332 - DNA, 13 bp, Homo sapiens
aaatcaaaagctg

SEQ ID NO: 3927333 - DNA, 20 bp, Homo sapiens
aaatcaaaagctgcttgact

SEQ ID NO: 3927334 - DNA, 15 bp, Homo sapiens
aaatcaaatatgcaa

SEQ ID NO: 3927335 - DNA, 16 bp, Homo sapiens
aaatcaaatatgcaaa

SEQ ID NO: 3927336 - DNA, 19 bp, Homo sapiens
aaatcaaatatgcaaagca

SEQ ID NO: 3927337 - DNA, 16 bp, Homo sapiens
aaatcacacctctggg

SEQ ID NO: 3927338 - DNA, 22 bp, Homo sapiens
aaatcaccacaccaaacctctc

SEQ ID NO: 3927339 - DNA, 23 bp, Homo sapiens
aaatcacttgtaaataaatagat

SEQ ID NO: 3927340 - DNA, 19 bp, Homo sapiens
aaatcagcgatgtgtcacc

SEQ ID NO: 3927341 - DNA, 21 bp, Homo sapiens
aaatcagttatattctttaaa

SEQ ID NO: 3927342 - DNA, 11 bp, Homo sapiens
aaatcatttct

SEQ ID NO: 3927343 - DNA, 12 bp, Homo sapiens
aaatcatttctg

SEQ ID NO: 3927344 - DNA, 19 bp, Homo sapiens
aaatcatttctgcatcagc

SEQ ID NO: 3927345 - DNA, 16 bp, Homo sapiens
aaatccagtttcccac

SEQ ID NO: 3927346 - DNA, 17 bp, Homo sapiens
aaatccagtttcccacc

SEQ ID NO: 3927347 - DNA, 22 bp, Homo sapiens
aaatccccggctgcttccttct

SEQ ID NO: 3927348 - DNA, 17 bp, Homo sapiens
aaatccctgtttaatat

SEQ ID NO: 3927349 - DNA, 12 bp, Homo sapiens
aaatcctctggc

SEQ ID NO: 3927350 - DNA, 16 bp, Homo sapiens
aaatccttccatgaaa

SEQ ID NO: 3927351 - DNA, 14 bp, Homo sapiens
aaatcgattggctt

SEQ ID NO: 3927352 - DNA, 14 bp, Homo sapiens
aaatctaactacaa

SEQ ID NO: 3927353 - DNA, 19 bp, Homo sapiens
aaatctaatattaaaaata

SEQ ID NO: 3927354 - DNA, 21 bp, Homo sapiens
aaatctaatcaggttgttaat

SEQ ID NO: 3927355 - DNA, 21 bp, Homo sapiens
aaatctagatcaattaattct

SEQ ID NO: 3927356 - DNA, 18 bp, Homo sapiens
aaatctatattaaagtgt

SEQ ID NO: 3927357 - DNA, 19 bp, Homo sapiens
aaatctattcagacaagca

SEQ ID NO: 3927358 - DNA, 22 bp, Homo sapiens
aaatctcagaattccttttcta

SEQ ID NO: 3927359 - DNA, 12 bp, Homo sapiens
aaatctcattcc

SEQ ID NO: 3927360 - DNA, 12 bp, Homo sapiens
aaatctctaata

SEQ ID NO: 3927361 - DNA, 15 bp, Homo sapiens
aaatctgatttaatg

SEQ ID NO: 3927362 - DNA, 18 bp, Homo sapiens
aaatctgatttaatgttt

SEQ ID NO: 3927363 - DNA, 19 bp, Homo sapiens
aaatctgatttaatgtttt

SEQ ID NO: 3927364 - DNA, 22 bp, Homo sapiens
aaatctgatttaatgttttctg

SEQ ID NO: 3927365 - DNA, 18 bp, Homo sapiens
aaatctgtaattctattg

SEQ ID NO: 3927366 - DNA, 18 bp, Homo sapiens
aaatctgtttgatccctg

SEQ ID NO: 3927367 - DNA, 19 bp, Homo sapiens
aaatctgtttgatccctgt

SEQ ID NO: 3927368 - DNA, 14 bp, Homo sapiens
aaatcttaacttga

SEQ ID NO: 3927369 - DNA, 14 bp, Homo sapiens
aaatgaaatgtctt

SEQ ID NO: 3927370 - DNA, 19 bp, Homo sapiens
aaatgaaggttaggattta

SEQ ID NO: 3927371 - DNA, 22 bp, Homo sapiens
aaatgaaggttaggatttaaca

SEQ ID NO: 3927372 - DNA, 14 bp, Homo sapiens
aaatgaatagagag

SEQ ID NO: 3927373 - DNA, 13 bp, Homo sapiens
aaatgacagtgaa

SEQ ID NO: 3927374 - DNA, 13 bp, Homo sapiens
aaatgaccaagaa

SEQ ID NO: 3927375 - DNA, 18 bp, Homo sapiens
aaatgaccaagaaaaaga

SEQ ID NO: 3927376 - DNA, 17 bp, Homo sapiens
aaatgacccaaagacca

SEQ ID NO: 3927377 - DNA, 17 bp, Homo sapiens
aaatgactaaaaatatt

SEQ ID NO: 3927378 - DNA, 22 bp, Homo sapiens
aaatgagtttttatggggctga

SEQ ID NO: 3927379 - DNA, 15 bp, Homo sapiens
aaatgataaagatgt

SEQ ID NO: 3927380 - DNA, 17 bp, Homo sapiens
aaatgataaagatgtca

SEQ ID NO: 3927381 - DNA, 20 bp, Homo sapiens
aaatgataaagatgtcaaat

SEQ ID NO: 3927382 - DNA, 22 bp, Homo sapiens
aaatgattgtaaaatagcttgt

SEQ ID NO: 3927383 - DNA, 16 bp, Homo sapiens
aaatgcaaaaatctct

SEQ ID NO: 3927384 - DNA, 17 bp, Homo sapiens
aaatgcaaacacacaaa

SEQ ID NO: 3927385 - DNA, 17 bp, Homo sapiens
aaatgcaaacactgtgt

SEQ ID NO: 3927386 - DNA, 20 bp, Homo sapiens
aaatgcatccattcctcagg

SEQ ID NO: 3927387 - DNA, 12 bp, Homo sapiens
aaatgcatgatt

SEQ ID NO: 3927388 - DNA, 16 bp, Homo sapiens
aaatgcatgattttat

SEQ ID NO: 3927389 - DNA, 21 bp, Homo sapiens
aaatgccaactggtcactgtg

SEQ ID NO: 3927390 - DNA, 21 bp, Homo sapiens
aaatgctattgttgtgggctt

SEQ ID NO: 3927391 - DNA, 17 bp, Homo sapiens
aaatggcaagttttgat

SEQ ID NO: 3927392 - DNA, 19 bp, Homo sapiens
aaatggccatttgcttttt

SEQ ID NO: 3927393 - DNA, 20 bp, Homo sapiens
aaatgggttggtgcttctaa

SEQ ID NO: 3927394 - DNA, 16 bp, Homo sapiens
aaatggtggtttgtca

SEQ ID NO: 3927395 - DNA, 23 bp, Homo sapiens
aaatggtggtttgtcatatattc

SEQ ID NO: 3927396 - DNA, 13 bp, Homo sapiens
aaatgtatataca

SEQ ID NO: 3927397 - DNA, 15 bp, Homo sapiens
aaatgtatatacaca

SEQ ID NO: 3927398 - DNA, 16 bp, Homo sapiens
aaatgtatatacacat

SEQ ID NO: 3927399 - DNA, 22 bp, Homo sapiens
aaatgtatatacacatatacct

SEQ ID NO: 3927400 - DNA, 20 bp, Homo sapiens
aaatgtatcatagaaatgta

SEQ ID NO: 3927401 - DNA, 23 bp, Homo sapiens
aaatgtatcctgataaacattaa

SEQ ID NO: 3927402 - DNA, 16 bp, Homo sapiens
aaatgtcatcaaatat

SEQ ID NO: 3927403 - DNA, 15 bp, Homo sapiens
aaatgtccaaaatgt

SEQ ID NO: 3927404 - DNA, 18 bp, Homo sapiens
aaatgtctatagagaaaa

SEQ ID NO: 3927405 - DNA, 18 bp, Homo sapiens
aaatgtcttatatagcag

SEQ ID NO: 3927406 - DNA, 15 bp, Homo sapiens
aaatgtgatcaactg

SEQ ID NO: 3927407 - DNA, 15 bp, Homo sapiens
aaatgtgtggtgcta

SEQ ID NO: 3927408 - DNA, 16 bp, Homo sapiens
aaatgtgtggtgctaa

SEQ ID NO: 3927409 - DNA, 15 bp, Homo sapiens
aaatgttgaaatctt

SEQ ID NO: 3927410 - DNA, 23 bp, Homo sapiens
aaatgtttctgcagtagtctctg

SEQ ID NO: 3927411 - DNA, 13 bp, Homo sapiens
aaatgttttacaa

SEQ ID NO: 3927412 - DNA, 15 bp, Homo sapiens
aaattaagactttaa

SEQ ID NO: 3927413 - DNA, 17 bp, Homo sapiens
aaattaagagatacatt

SEQ ID NO: 3927414 - DNA, 14 bp, Homo sapiens
aaattaaggtctgg

SEQ ID NO: 3927415 - DNA, 22 bp, Homo sapiens
aaattacacccaaagaggtatt

SEQ ID NO: 3927416 - DNA, 14 bp, Homo sapiens
aaattactctttct

SEQ ID NO: 3927417 - DNA, 18 bp, Homo sapiens
aaattagctgtgtgaaat

SEQ ID NO: 3927418 - DNA, 18 bp, Homo sapiens
aaattaggatttcatgat

SEQ ID NO: 3927419 - DNA, 19 bp, Homo sapiens
aaattataacttaaaatat

SEQ ID NO: 3927420 - DNA, 16 bp, Homo sapiens
aaattataagatgtca

SEQ ID NO: 3927421 - DNA, 16 bp, Homo sapiens
aaattatggtgaaatt

SEQ ID NO: 3927422 - DNA, 17 bp, Homo sapiens
aaattattttaatattt

SEQ ID NO: 3927423 - DNA, 20 bp, Homo sapiens
aaattattttaatattttgt

SEQ ID NO: 3927424 - DNA, 21 bp, Homo sapiens
aaattattttaatattttgta

SEQ ID NO: 3927425 - DNA, 22 bp, Homo sapiens
aaattattttaatattttgtat

SEQ ID NO: 3927426 - DNA, 19 bp, Homo sapiens
aaattcaaaccatttaatt

SEQ ID NO: 3927427 - DNA, 21 bp, Homo sapiens
aaattcaaaccatttaattca

SEQ ID NO: 3927428 - DNA, 20 bp, Homo sapiens
aaattcaaggagatataaaa

SEQ ID NO: 3927429 - DNA, 14 bp, Homo sapiens
aaattcatttcaca

SEQ ID NO: 3927430 - DNA, 13 bp, Homo sapiens
aaattcatttttt

SEQ ID NO: 3927431 - DNA, 12 bp, Homo sapiens
aaattgcacaat

SEQ ID NO: 3927432 - DNA, 13 bp, Homo sapiens
aaattgcacaatt

SEQ ID NO: 3927433 - DNA, 15 bp, Homo sapiens
aaattgctattttat

SEQ ID NO: 3927434 - DNA, 22 bp, Homo sapiens
aaattgctcctaagcttcaaat

SEQ ID NO: 3927435 - DNA, 19 bp, Homo sapiens
aaattgcttttgttgtgac

SEQ ID NO: 3927436 - DNA, 16 bp, Homo sapiens
aaattggaaacatttt

SEQ ID NO: 3927437 - DNA, 19 bp, Homo sapiens
aaattggtgataagtggaa

SEQ ID NO: 3927438 - DNA, 14 bp, Homo sapiens
aaattggtgtttct

SEQ ID NO: 3927439 - DNA, 17 bp, Homo sapiens
aacactgaatcatgtta

SEQ ID NO: 3927440 - DNA, 19 bp, Homo sapiens
aacactgaatcatgttaat

SEQ ID NO: 3927441 - DNA, 19 bp, Homo sapiens
aacactggcaacaacaaag

SEQ ID NO: 3927442 - DNA, 14 bp, Homo sapiens
aacactgtgtattt

SEQ ID NO: 3927443 - DNA, 12 bp, Homo sapiens
aacagaaccaga

SEQ ID NO: 3927444 - DNA, 13 bp, Homo sapiens
aacagaattttaa

SEQ ID NO: 3927445 - DNA, 18 bp, Homo sapiens
aacagacaaaaacagcct

SEQ ID NO: 3927446 - DNA, 21 bp, Homo sapiens
aacagacaaaaacagcctcac

SEQ ID NO: 3927447 - DNA, 15 bp, Homo sapiens
aacagacaggagaaa

SEQ ID NO: 3927448 - DNA, 23 bp, Homo sapiens
aacagactgaattttaaatgttc

SEQ ID NO: 3927449 - DNA, 15 bp, Homo sapiens
aacagagaaggcagg

SEQ ID NO: 3927450 - DNA, 10 bp, Homo sapiens
aacagagact

SEQ ID NO: 3927451 - DNA, 13 bp, Homo sapiens
aacagagatgtga

SEQ ID NO: 3927452 - DNA, 15 bp, Homo sapiens
aactcagagcccctc

SEQ ID NO: 3927453 - DNA, 14 bp, Homo sapiens
aactcagagcctcc

SEQ ID NO: 3927454 - DNA, 16 bp, Homo sapiens
aactccactctccttc

SEQ ID NO: 3927455 - DNA, 21 bp, Homo sapiens
aactccctgaacctcagtttc

SEQ ID NO: 3927456 - DNA, 11 bp, Homo sapiens
aactcctcctt

SEQ ID NO: 3927457 - DNA, 17 bp, Homo sapiens
aactcctgattttgtag

SEQ ID NO: 3927458 - DNA, 21 bp, Homo sapiens
aactcctgattttgtagttaa

SEQ ID NO: 3927459 - DNA, 10 bp, Homo sapiens
aactcctgcc

SEQ ID NO: 3927460 - DNA, 21 bp, Homo sapiens
aactcctttagcaggtggtcc

SEQ ID NO: 3927461 - DNA, 16 bp, Homo sapiens
aactctgcactccatg

SEQ ID NO: 3927462 - DNA, 16 bp, Homo sapiens
aactctggcttccagg

SEQ ID NO: 3927463 - DNA, 13 bp, Homo sapiens
aactcttcatttt

SEQ ID NO: 3927464 - DNA, 15 bp, Homo sapiens
aactgaagagacagt

SEQ ID NO: 3927465 - DNA, 15 bp, Homo sapiens
aactgaaggagaagg

SEQ ID NO: 3927466 - DNA, 20 bp, Homo sapiens
aactgaatgtttattccttg

SEQ ID NO: 3927467 - DNA, 11 bp, Homo sapiens
aactgacacag

SEQ ID NO: 3927468 - DNA, 21 bp, Homo sapiens
aactgagccaaacacactgta

SEQ ID NO: 3927469 - DNA, 23 bp, Homo sapiens
aactgagccaaacacactgtaaa

SEQ ID NO: 3927470 - DNA, 16 bp, Homo sapiens
aactgaggaattttct

SEQ ID NO: 3927471 - DNA, 16 bp, Homo sapiens
aactgatcaaaaataa

SEQ ID NO: 3927472 - DNA, 18 bp, Homo sapiens
aactgatcaaaaataaac

SEQ ID NO: 3927473 - DNA, 21 bp, Homo sapiens
aactgatcaaaaataaactag

SEQ ID NO: 3927474 - DNA, 22 bp, Homo sapiens
aactgatcaaaaataaactagt

SEQ ID NO: 3927475 - DNA, 15 bp, Homo sapiens
aactgatggaccggg

SEQ ID NO: 3927476 - DNA, 23 bp, Homo sapiens
aactgatggaccgggtgggcctg

SEQ ID NO: 3927477 - DNA, 17 bp, Homo sapiens
aactgcacacacagctc

SEQ ID NO: 3927478 - DNA, 19 bp, Homo sapiens
aactgcactgtcaagatga

SEQ ID NO: 3927479 - DNA, 13 bp, Homo sapiens
aactgctctgccc

SEQ ID NO: 3927480 - DNA, 10 bp, Homo sapiens
aactgctgag

SEQ ID NO: 3927481 - DNA, 18 bp, Homo sapiens
aactgctgatcaatgaaa

SEQ ID NO: 3927482 - DNA, 19 bp, Homo sapiens
aactgctgatcaatgaaat

SEQ ID NO: 3927483 - DNA, 18 bp, Homo sapiens
aactggagcaagaaggaa

SEQ ID NO: 3927484 - DNA, 21 bp, Homo sapiens
aactggccaagctgaggtgcc

SEQ ID NO: 3927485 - DNA, 19 bp, Homo sapiens
aactggctgtttgatagca

SEQ ID NO: 3927486 - DNA, 15 bp, Homo sapiens
aactggcttctgtgc

SEQ ID NO: 3927487 - DNA, 22 bp, Homo sapiens
aactggggcttgcaagaggagg

SEQ ID NO: 3927488 - DNA, 23 bp, Homo sapiens
aactgtaaatacaaaataaaatt

SEQ ID NO: 3927489 - DNA, 11 bp, Homo sapiens
aactgtaaatc

SEQ ID NO: 3927490 - DNA, 14 bp, Homo sapiens
aactgtaaatcact

SEQ ID NO: 3927491 - DNA, 21 bp, Homo sapiens
aactgtaaatcacttgtaaat

SEQ ID NO: 3927492 - DNA, 22 bp, Homo sapiens
aactgtaaatcacttgtaaata

SEQ ID NO: 3927493 - DNA, 19 bp, Homo sapiens
aactgtatcaaatctgtat

SEQ ID NO: 3927494 - DNA, 16 bp, Homo sapiens
aactgtgccctgcctt

SEQ ID NO: 3927495 - DNA, 18 bp, Homo sapiens
aactgtgccctgccttca

SEQ ID NO: 3927496 - DNA, 14 bp, Homo sapiens
aactgtgtgaagaa

SEQ ID NO: 3927497 - DNA, 15 bp, Homo sapiens
aactgtgtgaagaaa

SEQ ID NO: 3927498 - DNA, 21 bp, Homo sapiens
aactgttctggcctcagacca

SEQ ID NO: 3927499 - DNA, 11 bp, Homo sapiens
aacttaaaaga

SEQ ID NO: 3927500 - DNA, 16 bp, Homo sapiens
aacttaacatatttac

SEQ ID NO: 3927501 - DNA, 19 bp, Homo sapiens
aacttacacttggagcccg

SEQ ID NO: 3927502 - DNA, 23 bp, Homo sapiens
aacttatatcatcagcatacctt

SEQ ID NO: 3927503 - DNA, 21 bp, Homo sapiens
aacttatctagaaagaaaaga

SEQ ID NO: 3927504 - DNA, 19 bp, Homo sapiens
aacttatttgagtgattat

SEQ ID NO: 3927505 - DNA, 15 bp, Homo sapiens
aacttcagacacaaa

SEQ ID NO: 3927506 - DNA, 12 bp, Homo sapiens
aacttcagcacc

SEQ ID NO: 3927507 - DNA, 18 bp, Homo sapiens
aacttcctttgagaattg

SEQ ID NO: 3927508 - DNA, 13 bp, Homo sapiens
aacttgaatctgt

SEQ ID NO: 3927509 - DNA, 17 bp, Homo sapiens
aacttgaggacacatgt

SEQ ID NO: 3927510 - DNA, 18 bp, Homo sapiens
aacttgaggacacatgtc

SEQ ID NO: 3927511 - DNA, 16 bp, Homo sapiens
aacttgagggtaataa

SEQ ID NO: 3927512 - DNA, 19 bp, Homo sapiens
aacttgagggtaataaact

SEQ ID NO: 3927513 - DNA, 12 bp, Homo sapiens
aacttgatatag

SEQ ID NO: 3927514 - DNA, 23 bp, Homo sapiens
aacttggaaaaatccagaaagaa

SEQ ID NO: 3927515 - DNA, 13 bp, Homo sapiens
aacttggagtttc

SEQ ID NO: 3927516 - DNA, 19 bp, Homo sapiens
aacttgtatattccaccat

SEQ ID NO: 3927517 - DNA, 22 bp, Homo sapiens
aacttgtcagaatttctttgtc

SEQ ID NO: 3927518 - DNA, 15 bp, Homo sapiens
aactttctgtaaact

SEQ ID NO: 3927519 - DNA, 16 bp, Homo sapiens
aactttgtgcctttga

SEQ ID NO: 3927520 - DNA, 17 bp, Homo sapiens
aagaaaaaaaagaaagc

SEQ ID NO: 3927521 - DNA, 14 bp, Homo sapiens
aagaaaagaccctg

SEQ ID NO: 3927522 - DNA, 11 bp, Homo sapiens
aagaaaagata

SEQ ID NO: 3927523 - DNA, 15 bp, Homo sapiens
aagaaaagataaaga

SEQ ID NO: 3927524 - DNA, 22 bp, Homo sapiens
aagaaaagcagacgcagcagct

SEQ ID NO: 3927525 - DNA, 19 bp, Homo sapiens
aagaaaagtgaatgctcaa

SEQ ID NO: 3927526 - DNA, 11 bp, Homo sapiens
aagaaacagaa

SEQ ID NO: 3927527 - DNA, 18 bp, Homo sapiens
aagaaacaggggatcaaa

SEQ ID NO: 3927528 - DNA, 11 bp, Homo sapiens
aagaaacccaa

SEQ ID NO: 3927529 - DNA, 23 bp, Homo sapiens
aagaaaccccaagcagcattcag

SEQ ID NO: 3927530 - DNA, 22 bp, Homo sapiens
aagaaacgtacttaactgtgtg

SEQ ID NO: 3927531 - DNA, 18 bp, Homo sapiens
aagaaactcacgatgaaa

SEQ ID NO: 3927532 - DNA, 21 bp, Homo sapiens
aagaaagaatgcaagagtgga

SEQ ID NO: 3927533 - DNA, 18 bp, Homo sapiens
aagaaagcacctgttttt

SEQ ID NO: 3927534 - DNA, 17 bp, Homo sapiens
aagaaagctggtaaact

SEQ ID NO: 3927535 - DNA, 13 bp, Homo sapiens
aagaaatccctgt

SEQ ID NO: 3927536 - DNA, 17 bp, Homo sapiens
aagaaattcctgtagca

SEQ ID NO: 3927537 - DNA, 19 bp, Homo sapiens
aagaacaacaacaacaata

SEQ ID NO: 3927538 - DNA, 21 bp, Homo sapiens
aagaacaattgtccatggtct

SEQ ID NO: 3927539 - DNA, 14 bp, Homo sapiens
aagaacggaagaag

SEQ ID NO: 3927540 - DNA, 16 bp, Homo sapiens
aagaacgtcattttgg

SEQ ID NO: 3927541 - DNA, 17 bp, Homo sapiens
aagaagacatggagact

SEQ ID NO: 3927542 - DNA, 19 bp, Homo sapiens
aagaagaccagactgtgga

SEQ ID NO: 3927543 - DNA, 11 bp, Homo sapiens
aagaagagaca

SEQ ID NO: 3927544 - DNA, 22 bp, Homo sapiens
aagaagctcccagatgctgggg

SEQ ID NO: 3927545 - DNA, 13 bp, Homo sapiens
aagaagctgagga

SEQ ID NO: 3927546 - DNA, 21 bp, Homo sapiens
aagaaggcacaggtgtaaata

SEQ ID NO: 3927547 - DNA, 22 bp, Homo sapiens
aagaagggctagaacctggagg

SEQ ID NO: 3927548 - DNA, 20 bp, Homo sapiens
aagaagtaggggaagacatg

SEQ ID NO: 3927549 - DNA, 14 bp, Homo sapiens
aagaagtccccagg

SEQ ID NO: 3927550 - DNA, 13 bp, Homo sapiens
aagaatacagaaa

SEQ ID NO: 3927551 - DNA, 17 bp, Homo sapiens
aagaatacagaaaatgc

SEQ ID NO: 3927552 - DNA, 16 bp, Homo sapiens
aagaatattcagagaa

SEQ ID NO: 3927553 - DNA, 13 bp, Homo sapiens
aagaatattgtat

SEQ ID NO: 3927554 - DNA, 13 bp, Homo sapiens
aagaatattttaa

SEQ ID NO: 3927555 - DNA, 19 bp, Homo sapiens
aagaatcacctcaaattgt

SEQ ID NO: 3927556 - DNA, 21 bp, Homo sapiens
aagaatgcagattcctgggcc

SEQ ID NO: 3927557 - DNA, 14 bp, Homo sapiens
aagaattatttttg

SEQ ID NO: 3927558 - DNA, 22 bp, Homo sapiens
aagaattatttttgtgtttcta

SEQ ID NO: 3927559 - DNA, 13 bp, Homo sapiens
aagaattcctgaa

SEQ ID NO: 3927560 - DNA, 19 bp, Homo sapiens
aagaattcctgaagccaga

SEQ ID NO: 3927561 - DNA, 14 bp, Homo sapiens
aagaattgtccatg

SEQ ID NO: 3927562 - DNA, 17 bp, Homo sapiens
aagacaaaggttttcct

SEQ ID NO: 3927563 - DNA, 12 bp, Homo sapiens
aagacagaatgt

SEQ ID NO: 3927564 - DNA, 15 bp, Homo sapiens
aagacagtgtgtgtg

SEQ ID NO: 3927565 - DNA, 14 bp, Homo sapiens
aagacatgcagcct

SEQ ID NO: 3927566 - DNA, 18 bp, Homo sapiens
aagacatggagactcctg

SEQ ID NO: 3927567 - DNA, 19 bp, Homo sapiens
aagacatggagactcctgc

SEQ ID NO: 3927568 - DNA, 15 bp, Homo sapiens
aagaccagcctggcc

SEQ ID NO: 3927569 - DNA, 20 bp, Homo sapiens
aagaccagcctggccaacat

SEQ ID NO: 3927570 - DNA, 12 bp, Homo sapiens
aagaccagggct

SEQ ID NO: 3927571 - DNA, 12 bp, Homo sapiens
aagaccagtcca

SEQ ID NO: 3927572 - DNA, 17 bp, Homo sapiens
aagacccagtgtaaaga

SEQ ID NO: 3927573 - DNA, 13 bp, Homo sapiens
aagaccccatctc

SEQ ID NO: 3927574 - DNA, 14 bp, Homo sapiens
aagaccctgagact

SEQ ID NO: 3927575 - DNA, 22 bp, Homo sapiens
aagaccgtgtcccaaggagctg

SEQ ID NO: 3927576 - DNA, 13 bp, Homo sapiens
aagacctctgtga

SEQ ID NO: 3927577 - DNA, 17 bp, Homo sapiens
aagacctgttgctagaa

SEQ ID NO: 3927578 - DNA, 20 bp, Homo sapiens
aagacgtgatgccaggacca

SEQ ID NO: 3927579 - DNA, 12 bp, Homo sapiens
aagacgtttttg

SEQ ID NO: 3927580 - DNA, 21 bp, Homo sapiens
aagacgtttttgtgctgtggg

SEQ ID NO: 3927581 - DNA, 22 bp, Homo sapiens
aagacgtttttgtgctgtgggc

SEQ ID NO: 3927582 - DNA, 17 bp, Homo sapiens
aagactcattccctaga

SEQ ID NO: 3927583 - DNA, 14 bp, Homo sapiens
aagactccaaagaa

SEQ ID NO: 3927584 - DNA, 14 bp, Homo sapiens
aagactgaaacggc

SEQ ID NO: 3927585 - DNA, 14 bp, Homo sapiens
aagactgcagctgc

SEQ ID NO: 3927586 - DNA, 16 bp, Homo sapiens
aagactgcagctgctg

SEQ ID NO: 3927587 - DNA, 14 bp, Homo sapiens
aagacttaagatta

SEQ ID NO: 3927588 - DNA, 13 bp, Homo sapiens
aagacttcatgtt

SEQ ID NO: 3927589 - DNA, 19 bp, Homo sapiens
aagagaaaaaccaatgatt

SEQ ID NO: 3927590 - DNA, 14 bp, Homo sapiens
aagagaaatctcat

SEQ ID NO: 3927591 - DNA, 12 bp, Homo sapiens
aagagaaatttt

SEQ ID NO: 3927592 - DNA, 14 bp, Homo sapiens
aagagaagaaaaaa

SEQ ID NO: 3927593 - DNA, 17 bp, Homo sapiens
aagagaagctgagaaga

SEQ ID NO: 3927594 - DNA, 19 bp, Homo sapiens
aagagacaaacacctccca

SEQ ID NO: 3927595 - DNA, 22 bp, Homo sapiens
aagagacaggagggcaagggcc

SEQ ID NO: 3927596 - DNA, 13 bp, Homo sapiens
aagagaccagcac

SEQ ID NO: 3927597 - DNA, 23 bp, Homo sapiens
aagagactccaagattcaaagag

SEQ ID NO: 3927598 - DNA, 20 bp, Homo sapiens
aagagactctcttagggaaa

SEQ ID NO: 3927599 - DNA, 15 bp, Homo sapiens
aagagactctggcct

SEQ ID NO: 3927600 - DNA, 16 bp, Homo sapiens
aagagactctggcctc

SEQ ID NO: 3927601 - DNA, 18 bp, Homo sapiens
aagagagaaaacttattt

SEQ ID NO: 3927602 - DNA, 14 bp, Homo sapiens
aagagagaaagaag

SEQ ID NO: 3927603 - DNA, 11 bp, Homo sapiens
aagagagaaat

SEQ ID NO: 3927604 - DNA, 17 bp, Homo sapiens
aagagaggcacctgctg

SEQ ID NO: 3927605 - DNA, 18 bp, Homo sapiens
aagagaggcacctgctgg

SEQ ID NO: 3927606 - DNA, 21 bp, Homo sapiens
aagagagggccatgcaattca

SEQ ID NO: 3927607 - DNA, 16 bp, Homo sapiens
aagagatcaggaagag

SEQ ID NO: 3927608 - DNA, 18 bp, Homo sapiens
aagagatgtagcagaata

SEQ ID NO: 3927609 - DNA, 14 bp, Homo sapiens
aagagatgtggcaa

SEQ ID NO: 3927610 - DNA, 15 bp, Homo sapiens
aagagatttcaacat

SEQ ID NO: 3927611 - DNA, 17 bp, Homo sapiens
aagagcatcatgcctct

SEQ ID NO: 3927612 - DNA, 23 bp, Homo sapiens
aagagcatcatgcctctgaggcc

SEQ ID NO: 3927613 - DNA, 13 bp, Homo sapiens
aagagcctggaga

SEQ ID NO: 3927614 - DNA, 13 bp, Homo sapiens
aagagctgctgtc

SEQ ID NO: 3927615 - DNA, 14 bp, Homo sapiens
aagaggagaccctg

SEQ ID NO: 3927616 - DNA, 15 bp, Homo sapiens
aagaggaggagggat

SEQ ID NO: 3927617 - DNA, 20 bp, Homo sapiens
aagaggagtttcgaggtaga

SEQ ID NO: 3927618 - DNA, 21 bp, Homo sapiens
aagaggcaagagacagaatga

SEQ ID NO: 3927619 - DNA, 18 bp, Homo sapiens
aagaggcccagggagcaa

SEQ ID NO: 3927620 - DNA, 18 bp, Homo sapiens
aagagggagatggagact

SEQ ID NO: 3927621 - DNA, 21 bp, Homo sapiens
aagaggtatttatctttactt

SEQ ID NO: 3927622 - DNA, 15 bp, Homo sapiens
aagaggtctgagccc

SEQ ID NO: 3927623 - DNA, 18 bp, Homo sapiens
aagaggtctgagccctgg

SEQ ID NO: 3927624 - DNA, 16 bp, Homo sapiens
aagaggtgaccccagg

SEQ ID NO: 3927625 - DNA, 18 bp, Homo sapiens
aagaggtgaccccagggc

SEQ ID NO: 3927626 - DNA, 21 bp, Homo sapiens
aagaggtgaccccagggcaca

SEQ ID NO: 3927627 - DNA, 13 bp, Homo sapiens
aagaggtggggac

SEQ ID NO: 3927628 - DNA, 21 bp, Homo sapiens
aagagtagcaagttctagaga

SEQ ID NO: 3927629 - DNA, 23 bp, Homo sapiens
aagagttcttaaggattgtgata

SEQ ID NO: 3927630 - DNA, 22 bp, Homo sapiens
aagagtttaactttgggcccag

SEQ ID NO: 3927631 - DNA, 17 bp, Homo sapiens
aagataaagatgatcta

SEQ ID NO: 3927632 - DNA, 19 bp, Homo sapiens
aagatacactcctgctgtg

SEQ ID NO: 3927633 - DNA, 17 bp, Homo sapiens
aagataggtttgagttc

SEQ ID NO: 3927634 - DNA, 17 bp, Homo sapiens
aagatatcagagctctt

SEQ ID NO: 3927635 - DNA, 18 bp, Homo sapiens
aagatatcagagctctta

SEQ ID NO: 3927636 - DNA, 16 bp, Homo sapiens
aagatcgaatttttca

SEQ ID NO: 3927637 - DNA, 23 bp, Homo sapiens
aagatctgcagggggtgtgtctg

SEQ ID NO: 3927638 - DNA, 13 bp, Homo sapiens
aagatctttcagg

SEQ ID NO: 3927639 - DNA, 20 bp, Homo sapiens
aagatgaaaaatggtccctt

SEQ ID NO: 3927640 - DNA, 14 bp, Homo sapiens
aagatgaaaatatt

SEQ ID NO: 3927641 - DNA, 17 bp, Homo sapiens
aagatgaagagaagctg

SEQ ID NO: 3927642 - DNA, 21 bp, Homo sapiens
aagatgaattttatcagccat

SEQ ID NO: 3927643 - DNA, 18 bp, Homo sapiens
aagatgatctactcagaa

SEQ ID NO: 3927644 - DNA, 15 bp, Homo sapiens
aagatggatgtgctt

SEQ ID NO: 3927645 - DNA, 17 bp, Homo sapiens
aagatggctgactttgc

SEQ ID NO: 3927646 - DNA, 20 bp, Homo sapiens
aagatggctgtgcctctgcc

SEQ ID NO: 3927647 - DNA, 23 bp, Homo sapiens
aagatggctgtgcctctgcctgt

SEQ ID NO: 3927648 - DNA, 15 bp, Homo sapiens
aagatgggcacatga

SEQ ID NO: 3927649 - DNA, 22 bp, Homo sapiens
aagatgggcacatgaggagggt

SEQ ID NO: 3927650 - DNA, 23 bp, Homo sapiens
aagatggtagcagataaagacag

SEQ ID NO: 3927651 - DNA, 14 bp, Homo sapiens
aagatgtcaaatat

SEQ ID NO: 3927652 - DNA, 15 bp, Homo sapiens
aagatgtcaaatatc

SEQ ID NO: 3927653 - DNA, 18 bp, Homo sapiens
aagatgtcaaatatctca

SEQ ID NO: 3927654 - DNA, 16 bp, Homo sapiens
aagatgtttgtcagat

SEQ ID NO: 3927655 - DNA, 12 bp, Homo sapiens
aagattaaagga

SEQ ID NO: 3927656 - DNA, 17 bp, Homo sapiens
aagattaaaggaaggaa

SEQ ID NO: 3927657 - DNA, 21 bp, Homo sapiens
aagattaaattatatctgagg

SEQ ID NO: 3927658 - DNA, 21 bp, Homo sapiens
aagattaggtactatctgtga

SEQ ID NO: 3927659 - DNA, 23 bp, Homo sapiens
aagattaggtactatctgtgaag

SEQ ID NO: 3927660 - DNA, 14 bp, Homo sapiens
aagattcaaagaga

SEQ ID NO: 3927661 - DNA, 17 bp, Homo sapiens
aagattctcctgtgcta

SEQ ID NO: 3927662 - DNA, 14 bp, Homo sapiens
aagatttaacacta

SEQ ID NO: 3927663 - DNA, 23 bp, Homo sapiens
aagatttaccttttctgttgtac

SEQ ID NO: 3927664 - DNA, 17 bp, Homo sapiens
aagatttccaagtgcca

SEQ ID NO: 3927665 - DNA, 21 bp, Homo sapiens
aagatttgttttgtcaagtgt

SEQ ID NO: 3927666 - DNA, 13 bp, Homo sapiens
aagattttaaatt

SEQ ID NO: 3927667 - DNA, 15 bp, Homo sapiens
aagattttttttgta

SEQ ID NO: 3927668 - DNA, 15 bp, Homo sapiens
aagcaaaagaagtaa

SEQ ID NO: 3927669 - DNA, 17 bp, Homo sapiens
aagcaaagttgggtgta

SEQ ID NO: 3927670 - DNA, 22 bp, Homo sapiens
aagcaaatttcaaaagacatgt

SEQ ID NO: 3927671 - DNA, 17 bp, Homo sapiens
aagcaagaaagccgtac

SEQ ID NO: 3927672 - DNA, 19 bp, Homo sapiens
aagcaagacttccaggtag

SEQ ID NO: 3927673 - DNA, 20 bp, Homo sapiens
aagcaagggctccagcatcc

SEQ ID NO: 3927674 - DNA, 16 bp, Homo sapiens
aagcaattgccctgta

SEQ ID NO: 3927675 - DNA, 18 bp, Homo sapiens
aagcacaggagacactgt

SEQ ID NO: 3927676 - DNA, 20 bp, Homo sapiens
aagcacagtctgatgacaca

SEQ ID NO: 3927677 - DNA, 16 bp, Homo sapiens
aagcacatattgagca

SEQ ID NO: 3927678 - DNA, 20 bp, Homo sapiens
aagcaccagcttctccaggc

SEQ ID NO: 3927679 - DNA, 13 bp, Homo sapiens
aagcacctgccga

SEQ ID NO: 3927680 - DNA, 21 bp, Homo sapiens
aagcactcccttaggcattat

SEQ ID NO: 3927681 - DNA, 22 bp, Homo sapiens
aagcactgactgggaccaggca

SEQ ID NO: 3927682 - DNA, 17 bp, Homo sapiens
aagcactgacttctaag

SEQ ID NO: 3927683 - DNA, 23 bp, Homo sapiens
aagcactgctaggcgagtgccag

SEQ ID NO: 3927684 - DNA, 13 bp, Homo sapiens
aagcagagcttcc

SEQ ID NO: 3927685 - DNA, 18 bp, Homo sapiens
aagcagcagctaggactg

SEQ ID NO: 3927686 - DNA, 12 bp, Homo sapiens
aagcagccagcc

SEQ ID NO: 3927687 - DNA, 13 bp, Homo sapiens
aagcagccagcca

SEQ ID NO: 3927688 - DNA, 17 bp, Homo sapiens
aagcagccagccagtct

SEQ ID NO: 3927689 - DNA, 11 bp, Homo sapiens
aagcagctggg

SEQ ID NO: 3927690 - DNA, 18 bp, Homo sapiens
aagcagggaaagctccac

SEQ ID NO: 3927691 - DNA, 15 bp, Homo sapiens
aagcaggttcttgat

SEQ ID NO: 3927692 - DNA, 16 bp, Homo sapiens
aagcaggttcttgatg

SEQ ID NO: 3927693 - DNA, 17 bp, Homo sapiens
aagcagtgcctcgaggc

SEQ ID NO: 3927694 - DNA, 21 bp, Homo sapiens
aagcagtgcctcgaggcaccg

SEQ ID NO: 3927695 - DNA, 18 bp, Homo sapiens
aagcagtgcttgtaaacc

SEQ ID NO: 3927696 - DNA, 18 bp, Homo sapiens
aagcagtgtgtccttggg

SEQ ID NO: 3927697 - DNA, 15 bp, Homo sapiens
aagcagtgtttctac

SEQ ID NO: 3927698 - DNA, 13 bp, Homo sapiens
aagcatatttgag

SEQ ID NO: 3927699 - DNA, 13 bp, Homo sapiens
aagcatcagaaag

SEQ ID NO: 3927700 - DNA, 22 bp, Homo sapiens
aagcatcagagatggtaatcta

SEQ ID NO: 3927701 - DNA, 19 bp, Homo sapiens
aagcatgcaataatgtgca

SEQ ID NO: 3927702 - DNA, 17 bp, Homo sapiens
aagcatggtcccacatc

SEQ ID NO: 3927703 - DNA, 13 bp, Homo sapiens
aagcattgtaaat

SEQ ID NO: 3927704 - DNA, 19 bp, Homo sapiens
aagcattgtaaatgtgctt

SEQ ID NO: 3927705 - DNA, 17 bp, Homo sapiens
aagccaacttgtaaata

SEQ ID NO: 3927706 - DNA, 11 bp, Homo sapiens
aagccacagaa

SEQ ID NO: 3927707 - DNA, 14 bp, Homo sapiens
aagccacagcttct

SEQ ID NO: 3927708 - DNA, 13 bp, Homo sapiens
aagccacatagag

SEQ ID NO: 3927709 - DNA, 15 bp, Homo sapiens
aagccagagcctggg

SEQ ID NO: 3927710 - DNA, 21 bp, Homo sapiens
aagccagctgccgaccagagc

SEQ ID NO: 3927711 - DNA, 13 bp, Homo sapiens
aagccagtggcag

SEQ ID NO: 3927712 - DNA, 18 bp, Homo sapiens
aagccatggtgacacaca

SEQ ID NO: 3927713 - DNA, 20 bp, Homo sapiens
aagccattttttgaggagag

SEQ ID NO: 3927714 - DNA, 22 bp, Homo sapiens
aagcccaacctcctgacctgtc

SEQ ID NO: 3927715 - DNA, 18 bp, Homo sapiens
aagcccagtgacctgacc

SEQ ID NO: 3927716 - DNA, 16 bp, Homo sapiens
aagccccagggcctgg

SEQ ID NO: 3927717 - DNA, 18 bp, Homo sapiens
aagccccagggcctgggg

SEQ ID NO: 3927718 - DNA, 22 bp, Homo sapiens
aagccccccacctttctcgctg

SEQ ID NO: 3927719 - DNA, 12 bp, Homo sapiens
aagcccctcagc

SEQ ID NO: 3927720 - DNA, 16 bp, Homo sapiens
aagcccctcagccctt

SEQ ID NO: 3927721 - DNA, 22 bp, Homo sapiens
aagccggttgcagagaatctgt

SEQ ID NO: 3927722 - DNA, 14 bp, Homo sapiens
aagccgtctgactc

SEQ ID NO: 3927723 - DNA, 16 bp, Homo sapiens
aagccgtctgactcca

SEQ ID NO: 3927724 - DNA, 18 bp, Homo sapiens
aagccgtctgactccaga

SEQ ID NO: 3927725 - DNA, 13 bp, Homo sapiens
aagcctccctcct

SEQ ID NO: 3927726 - DNA, 15 bp, Homo sapiens
aagcctccggtttcc

SEQ ID NO: 3927727 - DNA, 18 bp, Homo sapiens
aagcctccgtcaggagag

SEQ ID NO: 3927728 - DNA, 19 bp, Homo sapiens
aagcctctgccccaagggg

SEQ ID NO: 3927729 - DNA, 19 bp, Homo sapiens
aagcctctgccctgcctcc

SEQ ID NO: 3927730 - DNA, 23 bp, Homo sapiens
aagcctgcctaggaattcccagc

SEQ ID NO: 3927731 - DNA, 16 bp, Homo sapiens
aagcctgggggcctgg

SEQ ID NO: 3927732 - DNA, 18 bp, Homo sapiens
aagcctgggggcctggct

SEQ ID NO: 3927733 - DNA, 23 bp, Homo sapiens
aagcctgggggcctggctggctg

SEQ ID NO: 3927734 - DNA, 13 bp, Homo sapiens
aagcctgtataga

SEQ ID NO: 3927735 - DNA, 12 bp, Homo sapiens
aagcctgtgaat

SEQ ID NO: 3927736 - DNA, 19 bp, Homo sapiens
aagcctgttttgttggaag

SEQ ID NO: 3927737 - DNA, 18 bp, Homo sapiens
aagccttactcacctctc

SEQ ID NO: 3927738 - DNA, 19 bp, Homo sapiens
aagccttactcacctctct

SEQ ID NO: 3927739 - DNA, 20 bp, Homo sapiens
aagcgattcttgtgcctcag

SEQ ID NO: 3927740 - DNA, 21 bp, Homo sapiens
aagcgattcttgtgcctcagc

SEQ ID NO: 3927741 - DNA, 20 bp, Homo sapiens
aagcggttgcttctggctcc

SEQ ID NO: 3927742 - DNA, 16 bp, Homo sapiens
aagctagaacctggag

SEQ ID NO: 3927743 - DNA, 17 bp, Homo sapiens
aagctagaaggccacat

SEQ ID NO: 3927744 - DNA, 14 bp, Homo sapiens
aagctaggaatgaa

SEQ ID NO: 3927745 - DNA, 16 bp, Homo sapiens
aagctattgatgtttc

SEQ ID NO: 3927746 - DNA, 14 bp, Homo sapiens
aagctcagaataga

SEQ ID NO: 3927747 - DNA, 17 bp, Homo sapiens
aagctcagctactgatt

SEQ ID NO: 3927748 - DNA, 20 bp, Homo sapiens
aagctcatattttgtatata

SEQ ID NO: 3927749 - DNA, 21 bp, Homo sapiens
aagctcatattttgtatatat

SEQ ID NO: 3927750 - DNA, 22 bp, Homo sapiens
aagctcatattttgtatatatc

SEQ ID NO: 3927751 - DNA, 20 bp, Homo sapiens
aagctcctgtcctcccatcc

SEQ ID NO: 3927752 - DNA, 22 bp, Homo sapiens
aagctcctgtcctcccatcccc

SEQ ID NO: 3927753 - DNA, 14 bp, Homo sapiens
aagctgagaagaag

SEQ ID NO: 3927754 - DNA, 16 bp, Homo sapiens
aagctgagaagaagct

SEQ ID NO: 3927755 - DNA, 22 bp, Homo sapiens
aagctgagaagaagctgaggat

SEQ ID NO: 3927756 - DNA, 13 bp, Homo sapiens
aagctgagcaggc

SEQ ID NO: 3927757 - DNA, 22 bp, Homo sapiens
aagctgaggatcctcacaggag

SEQ ID NO: 3927758 - DNA, 13 bp, Homo sapiens
aagctgaggtgcc

SEQ ID NO: 3927759 - DNA, 17 bp, Homo sapiens
aagctgaggtgcccagg

SEQ ID NO: 3927760 - DNA, 11 bp, Homo sapiens
aagctgcagct

SEQ ID NO: 3927761 - DNA, 12 bp, Homo sapiens
aagctgcagctt

SEQ ID NO: 3927762 - DNA, 16 bp, Homo sapiens
aagctgcagcttcctg

SEQ ID NO: 3927763 - DNA, 14 bp, Homo sapiens
aagctgcctgtagt

SEQ ID NO: 3927764 - DNA, 16 bp, Homo sapiens
aagctgcctgtagtta

SEQ ID NO: 3927765 - DNA, 19 bp, Homo sapiens
aagctgcctgtagttagga

SEQ ID NO: 3927766 - DNA, 21 bp, Homo sapiens
aagctgctgagaatctagcct

SEQ ID NO: 3927767 - DNA, 19 bp, Homo sapiens
aagctgcttgactatcaca

SEQ ID NO: 3927768 - DNA, 20 bp, Homo sapiens
aagctgcttgactatcacat

SEQ ID NO: 3927769 - DNA, 14 bp, Homo sapiens
aagctggaagcaca

SEQ ID NO: 3927770 - DNA, 20 bp, Homo sapiens
aagctggacaagaagctgct

SEQ ID NO: 3927771 - DNA, 19 bp, Homo sapiens
aagctggcagctgtcattc

SEQ ID NO: 3927772 - DNA, 19 bp, Homo sapiens
aagctgggggaagggtggt

SEQ ID NO: 3927773 - DNA, 17 bp, Homo sapiens
aagctggtaaactattt

SEQ ID NO: 3927774 - DNA, 18 bp, Homo sapiens
aagctgtactcagagcag

SEQ ID NO: 3927775 - DNA, 19 bp, Homo sapiens
aagctgtttatttattcac

SEQ ID NO: 3927776 - DNA, 22 bp, Homo sapiens
aagcttaaattgcttttgttgt

SEQ ID NO: 3927777 - DNA, 18 bp, Homo sapiens
aagcttattaaaactcat

SEQ ID NO: 3927778 - DNA, 19 bp, Homo sapiens
aagcttcaagtgatatatg

SEQ ID NO: 3927779 - DNA, 16 bp, Homo sapiens
aagcttcagagcctag

SEQ ID NO: 3927780 - DNA, 18 bp, Homo sapiens
aagcttcagagcctagcc

SEQ ID NO: 3927781 - DNA, 20 bp, Homo sapiens
aagcttcagagcctagccac

SEQ ID NO: 3927782 - DNA, 14 bp, Homo sapiens
aagcttgtatatac

SEQ ID NO: 3927783 - DNA, 15 bp, Homo sapiens
aaggaaaaccaggga

SEQ ID NO: 3927784 - DNA, 14 bp, Homo sapiens
aaggaaaccaaagg

SEQ ID NO: 3927785 - DNA, 18 bp, Homo sapiens
aaggaaaccttttcatgc

SEQ ID NO: 3927786 - DNA, 21 bp, Homo sapiens
aaggaaacttgaatcaaagca

SEQ ID NO: 3927787 - DNA, 14 bp, Homo sapiens
aaggaacaagagaa

SEQ ID NO: 3927788 - DNA, 21 bp, Homo sapiens
aaggaacactggaaaataaat

SEQ ID NO: 3927789 - DNA, 17 bp, Homo sapiens
aaggaaggcagggagga

SEQ ID NO: 3927790 - DNA, 22 bp, Homo sapiens
aaggaagggcatccttctgcct

SEQ ID NO: 3927791 - DNA, 16 bp, Homo sapiens
aaggaaggttttctcc

SEQ ID NO: 3927792 - DNA, 16 bp, Homo sapiens
aaggaagtcaccaaaa

SEQ ID NO: 3927793 - DNA, 21 bp, Homo sapiens
aaggaataaattgctccttga

SEQ ID NO: 3927794 - DNA, 16 bp, Homo sapiens
aaggaatagccagaga

SEQ ID NO: 3927795 - DNA, 17 bp, Homo sapiens
aaggaatctccagtttt

SEQ ID NO: 3927796 - DNA, 15 bp, Homo sapiens
aaggaattctaggca

SEQ ID NO: 3927797 - DNA, 21 bp, Homo sapiens
aaggacaacctgcccctcccc

SEQ ID NO: 3927798 - DNA, 15 bp, Homo sapiens
aaggacatgtgctat

SEQ ID NO: 3927799 - DNA, 16 bp, Homo sapiens
aaggacattatgtgtg

SEQ ID NO: 3927800 - DNA, 17 bp, Homo sapiens
aaggacattatgtgtgc

SEQ ID NO: 3927801 - DNA, 20 bp, Homo sapiens
aaggaccaactggcttctgt

SEQ ID NO: 3927802 - DNA, 18 bp, Homo sapiens
aaggacccacccatcttc

SEQ ID NO: 3927803 - DNA, 23 bp, Homo sapiens
aaggacccacccatcttcctgct

SEQ ID NO: 3927804 - DNA, 21 bp, Homo sapiens
aaggacccggaggggcctggc

SEQ ID NO: 3927805 - DNA, 17 bp, Homo sapiens
aaggaccgtttttacta

SEQ ID NO: 3927806 - DNA, 21 bp, Homo sapiens
aaggacggccttcaactgaaa

SEQ ID NO: 3927807 - DNA, 17 bp, Homo sapiens
aaggactaacataaaat

SEQ ID NO: 3927808 - DNA, 17 bp, Homo sapiens
aaggagactcacctctg

SEQ ID NO: 3927809 - DNA, 15 bp, Homo sapiens
aaggagatataaaat

SEQ ID NO: 3927810 - DNA, 12 bp, Homo sapiens
aaggagcctgtg

SEQ ID NO: 3927811 - DNA, 13 bp, Homo sapiens
aaggagcctgtga

SEQ ID NO: 3927812 - DNA, 19 bp, Homo sapiens
aaggagctgatttccaggc

SEQ ID NO: 3927813 - DNA, 11 bp, Homo sapiens
aaggaggaaaa

SEQ ID NO: 3927814 - DNA, 12 bp, Homo sapiens
aaggaggaaaac

SEQ ID NO: 3927815 - DNA, 16 bp, Homo sapiens
aaggaggcatgcctct

SEQ ID NO: 3927816 - DNA, 15 bp, Homo sapiens
aaggagggcagagcc

SEQ ID NO: 3927817 - DNA, 17 bp, Homo sapiens
aaggagggcagagccat

SEQ ID NO: 3927818 - DNA, 19 bp, Homo sapiens
aaggaggtgagggatgtga

SEQ ID NO: 3927819 - DNA, 20 bp, Homo sapiens
aaggagttccatgaagacca

SEQ ID NO: 3927820 - DNA, 22 bp, Homo sapiens
aaggatatttactacttttgca

SEQ ID NO: 3927821 - DNA, 22 bp, Homo sapiens
aaggatcagaacagcagaggtt

SEQ ID NO: 3927822 - DNA, 15 bp, Homo sapiens
aaggatcagaatgga

SEQ ID NO: 3927823 - DNA, 22 bp, Homo sapiens
aaggatctctcaggagcacagg

SEQ ID NO: 3927824 - DNA, 19 bp, Homo sapiens
aaggatgtaaacagtgcct

SEQ ID NO: 3927825 - DNA, 21 bp, Homo sapiens
aaggatgttctggctttacat

SEQ ID NO: 3927826 - DNA, 22 bp, Homo sapiens
aaggatgttctggctttacatt

SEQ ID NO: 3927827 - DNA, 18 bp, Homo sapiens
aaggattaagatacactc

SEQ ID NO: 3927828 - DNA, 20 bp, Homo sapiens
aaggattaagatacactcct

SEQ ID NO: 3927829 - DNA, 16 bp, Homo sapiens
aaggattcatgtggaa

SEQ ID NO: 3927830 - DNA, 14 bp, Homo sapiens
aaggattgtgatat

SEQ ID NO: 3927831 - DNA, 17 bp, Homo sapiens
aaggattgtgatatttt

SEQ ID NO: 3927832 - DNA, 17 bp, Homo sapiens
aaggcaaagcccctgga

SEQ ID NO: 3927833 - DNA, 18 bp, Homo sapiens
aaggcaaagcccctggaa

SEQ ID NO: 3927834 - DNA, 17 bp, Homo sapiens
aaggcacaggtgtaaat

SEQ ID NO: 3927835 - DNA, 21 bp, Homo sapiens
aaggcagcctccagagccagc

SEQ ID NO: 3927836 - DNA, 12 bp, Homo sapiens
aaggcagctgct

SEQ ID NO: 3927837 - DNA, 16 bp, Homo sapiens
aaggcaggaatgtgtg

SEQ ID NO: 3927838 - DNA, 14 bp, Homo sapiens
aaggcaggcagggc

SEQ ID NO: 3927839 - DNA, 16 bp, Homo sapiens
aaggcaggcagggctc

SEQ ID NO: 3927840 - DNA, 22 bp, Homo sapiens
aaggcaggcagggctctcctgg

SEQ ID NO: 3927841 - DNA, 20 bp, Homo sapiens
aaggcagggacagagatgga

SEQ ID NO: 3927842 - DNA, 15 bp, Homo sapiens
aaggcatatacaaat

SEQ ID NO: 3927843 - DNA, 16 bp, Homo sapiens
aaggcatgttcctctg

SEQ ID NO: 3927844 - DNA, 21 bp, Homo sapiens
aaggccaataaagagttagaa

SEQ ID NO: 3927845 - DNA, 18 bp, Homo sapiens
aaggccagtggaaattca

SEQ ID NO: 3927846 - DNA, 21 bp, Homo sapiens
aaggccagtggaaattcaggt

SEQ ID NO: 3927847 - DNA, 20 bp, Homo sapiens
aaggcccgagcagctgagca

SEQ ID NO: 3927848 - DNA, 21 bp, Homo sapiens
aaggcccgagcagctgagcag

SEQ ID NO: 3927849 - DNA, 16 bp, Homo sapiens
aaggccgtgtctctga

SEQ ID NO: 3927850 - DNA, 13 bp, Homo sapiens
aaggcctctgtcc

SEQ ID NO: 3927851 - DNA, 16 bp, Homo sapiens
aaggcctcttgtgctc

SEQ ID NO: 3927852 - DNA, 23 bp, Homo sapiens
aaggcctcttgtgctcacgctcc

SEQ ID NO: 3927853 - DNA, 16 bp, Homo sapiens
aaggcctgccctccca

SEQ ID NO: 3927854 - DNA, 23 bp, Homo sapiens
aaggctacttcggggctgggaag

SEQ ID NO: 3927855 - DNA, 15 bp, Homo sapiens
aaggctgaccaagag

SEQ ID NO: 3927856 - DNA, 17 bp, Homo sapiens
aaggctgaccaagagag

SEQ ID NO: 3927857 - DNA, 12 bp, Homo sapiens
aaggctggctga

SEQ ID NO: 3927858 - DNA, 16 bp, Homo sapiens
aaggctggctgagtgg

SEQ ID NO: 3927859 - DNA, 14 bp, Homo sapiens
aaggctggggccag

SEQ ID NO: 3927860 - DNA, 23 bp, Homo sapiens
aaggctggggccagtgtaaggca

SEQ ID NO: 3927861 - DNA, 16 bp, Homo sapiens
aaggctttgccatggg

SEQ ID NO: 3927862 - DNA, 23 bp, Homo sapiens
aagggaaactgccagcaacgcag

SEQ ID NO: 3927863 - DNA, 18 bp, Homo sapiens
aagggaaggaactctggc

SEQ ID NO: 3927864 - DNA, 17 bp, Homo sapiens
aagggaagttgtgcctt

SEQ ID NO: 3927865 - DNA, 22 bp, Homo sapiens
aagggacccgaagcccaggctg

SEQ ID NO: 3927866 - DNA, 17 bp, Homo sapiens
aagggagaagaaatcca

SEQ ID NO: 3927867 - DNA, 17 bp, Homo sapiens
aagggagggctctgagg

SEQ ID NO: 3927868 - DNA, 21 bp, Homo sapiens
aagggagggctctgaggcgcc

SEQ ID NO: 3927869 - DNA, 18 bp, Homo sapiens
aagggagttgctcactca

SEQ ID NO: 3927870 - DNA, 23 bp, Homo sapiens
aagggagttgctcactcaggact

SEQ ID NO: 3927871 - DNA, 14 bp, Homo sapiens
aagggatggcaaga

SEQ ID NO: 3927872 - DNA, 18 bp, Homo sapiens
aagggcagaaggggaaga

SEQ ID NO: 3927873 - DNA, 22 bp, Homo sapiens
aagggcagccaggggctgctca

SEQ ID NO: 3927874 - DNA, 17 bp, Homo sapiens
aagggcatcaggcactg

SEQ ID NO: 3927875 - DNA, 18 bp, Homo sapiens
aagggcatcaggcactgg

SEQ ID NO: 3927876 - DNA, 13 bp, Homo sapiens
aagggccagccct

SEQ ID NO: 3927877 - DNA, 22 bp, Homo sapiens
aagggccagccctacatcttca

SEQ ID NO: 3927878 - DNA, 23 bp, Homo sapiens
aagggccagccctacatcttcag

SEQ ID NO: 3927879 - DNA, 12 bp, Homo sapiens
aagggccaggag

SEQ ID NO: 3927880 - DNA, 17 bp, Homo sapiens
aagggccaggagagaga

SEQ ID NO: 3927881 - DNA, 16 bp, Homo sapiens
aagggccatgctgaag

SEQ ID NO: 3927882 - DNA, 15 bp, Homo sapiens
aagtgatatatgtat

SEQ ID NO: 3927883 - DNA, 17 bp, Homo sapiens
aagtgatatatgtattt

SEQ ID NO: 3927884 - DNA, 21 bp, Homo sapiens
aagtgatatatgtatttattg

SEQ ID NO: 3927885 - DNA, 22 bp, Homo sapiens
aagtgatatcacctctcttcag

SEQ ID NO: 3927886 - DNA, 21 bp, Homo sapiens
aagtgatctgtcccctctccc

SEQ ID NO: 3927887 - DNA, 14 bp, Homo sapiens
aagtgcaaatactc

SEQ ID NO: 3927888 - DNA, 20 bp, Homo sapiens
aagtgcaatgcgtgttgtac

SEQ ID NO: 3927889 - DNA, 21 bp, Homo sapiens
aagtgcagcccttcctcctga

SEQ ID NO: 3927890 - DNA, 21 bp, Homo sapiens
aagtgccactcattcctgtag

SEQ ID NO: 3927891 - DNA, 14 bp, Homo sapiens
aagtgccatcccac

SEQ ID NO: 3927892 - DNA, 17 bp, Homo sapiens
aagtgcctcttgttgca

SEQ ID NO: 3927893 - DNA, 16 bp, Homo sapiens
aagtgctccccacacg

SEQ ID NO: 3927894 - DNA, 13 bp, Homo sapiens
aagtgctgtaccc

SEQ ID NO: 3927895 - DNA, 15 bp, Homo sapiens
aagtgctgtttgaga

SEQ ID NO: 3927896 - DNA, 13 bp, Homo sapiens
aagtgcttagaaa

SEQ ID NO: 3927897 - DNA, 14 bp, Homo sapiens
aagtggaaaaaaga

SEQ ID NO: 3927898 - DNA, 19 bp, Homo sapiens
aagtggctaattcaattta

SEQ ID NO: 3927899 - DNA, 14 bp, Homo sapiens
aagtggctgctgac

SEQ ID NO: 3927900 - DNA, 16 bp, Homo sapiens
aagtgggccaggacag

SEQ ID NO: 3927901 - DNA, 15 bp, Homo sapiens
aagtggggctctggg

SEQ ID NO: 3927902 - DNA, 14 bp, Homo sapiens
aagtgtaaaataga

SEQ ID NO: 3927903 - DNA, 16 bp, Homo sapiens
aagtgtaataatatga

SEQ ID NO: 3927904 - DNA, 15 bp, Homo sapiens
aagtgtgagcagtga

SEQ ID NO: 3927905 - DNA, 23 bp, Homo sapiens
aagtgtgtggaaggcagggacag

SEQ ID NO: 3927906 - DNA, 13 bp, Homo sapiens
aagtgttcaagaa

SEQ ID NO: 3927907 - DNA, 19 bp, Homo sapiens
aagtgttcaagaaataaaa

SEQ ID NO: 3927908 - DNA, 23 bp, Homo sapiens
aagtgttggctaatgaagggaaa

SEQ ID NO: 3927909 - DNA, 18 bp, Homo sapiens
aagtgttgtaaatattta

SEQ ID NO: 3927910 - DNA, 23 bp, Homo sapiens
aagtgtttaacttgtcaaaaaac

SEQ ID NO: 3927911 - DNA, 16 bp, Homo sapiens
aagttacacaattaat

SEQ ID NO: 3927912 - DNA, 16 bp, Homo sapiens
aagttacttattctag

SEQ ID NO: 3927913 - DNA, 22 bp, Homo sapiens
aagttacttcactttaattctc

SEQ ID NO: 3927914 - DNA, 14 bp, Homo sapiens
aagttagctgagcg

SEQ ID NO: 3927915 - DNA, 21 bp, Homo sapiens
aagttagctgagcgtggtggc

SEQ ID NO: 3927916 - DNA, 17 bp, Homo sapiens
aagttatagtatatctg

SEQ ID NO: 3927917 - DNA, 16 bp, Homo sapiens
aagttatattgaatat

SEQ ID NO: 3927918 - DNA, 22 bp, Homo sapiens
aagttatattgaatatatcaga

SEQ ID NO: 3927919 - DNA, 14 bp, Homo sapiens
aagttatgagggtc

SEQ ID NO: 3927920 - DNA, 22 bp, Homo sapiens
aagttattaatcttatgtgttt

SEQ ID NO: 3927921 - DNA, 12 bp, Homo sapiens
aagttattgtgt

SEQ ID NO: 3927922 - DNA, 17 bp, Homo sapiens
aagttattgtgttgcct

SEQ ID NO: 3927923 - DNA, 24 bp, Homo sapiens
aagttattgtgttgccttagcact

SEQ ID NO: 3927924 - DNA, 19 bp, Homo sapiens
aagttcaatctgtttttca

SEQ ID NO: 3927925 - DNA, 16 bp, Homo sapiens
aagttcagggaagcag

SEQ ID NO: 3927926 - DNA, 19 bp, Homo sapiens
aagttccagtgttctctct

SEQ ID NO: 3927927 - DNA, 14 bp, Homo sapiens
aagttccctacttc

SEQ ID NO: 3927928 - DNA, 15 bp, Homo sapiens
aagttcgaaagaaaa

SEQ ID NO: 3927929 - DNA, 15 bp, Homo sapiens
aagttcttctccaat

SEQ ID NO: 3927930 - DNA, 18 bp, Homo sapiens
aagttgtgccttttatag

SEQ ID NO: 3927931 - DNA, 18 bp, Homo sapiens
aagttgttcacatatatg

SEQ ID NO: 3927932 - DNA, 18 bp, Homo sapiens
aagtttacaagtgtatat

SEQ ID NO: 3927933 - DNA, 20 bp, Homo sapiens
aagtttacagtaaataaatt

SEQ ID NO: 3927934 - DNA, 21 bp, Homo sapiens
aagtttacagtaaataaattg

SEQ ID NO: 3927935 - DNA, 14 bp, Homo sapiens
aagtttcaccttgg

SEQ ID NO: 3927936 - DNA, 13 bp, Homo sapiens
aagttttgtacag

SEQ ID NO: 3927937 - DNA, 22 bp, Homo sapiens
aagttttgtataaataataaag

SEQ ID NO: 3927938 - DNA, 17 bp, Homo sapiens
aagtttttctaacagta

SEQ ID NO: 3927939 - DNA, 21 bp, Homo sapiens
aataaaaaaatacagtaaagt

SEQ ID NO: 3927940 - DNA, 19 bp, Homo sapiens
aataaaaacttcagaaaaa

SEQ ID NO: 3927941 - DNA, 13 bp, Homo sapiens
aataaaacctttc

SEQ ID NO: 3927942 - DNA, 21 bp, Homo sapiens
aataaaacctttcaaatttca

SEQ ID NO: 3927943 - DNA, 23 bp, Homo sapiens
aataaaacctttcaaatttcaca

SEQ ID NO: 3927944 - DNA, 14 bp, Homo sapiens
aataaaatcctgct

SEQ ID NO: 3927945 - DNA, 19 bp, Homo sapiens
aataaaatgaggacatgtt

SEQ ID NO: 3927946 - DNA, 14 bp, Homo sapiens
aataaaattgcact

SEQ ID NO: 3927947 - DNA, 14 bp, Homo sapiens
aataaaattgtaaa

SEQ ID NO: 3927948 - DNA, 17 bp, Homo sapiens
aataaaccaaaggacat

SEQ ID NO: 3927949 - DNA, 21 bp, Homo sapiens
aataaaccaaaggacattatg

SEQ ID NO: 3927950 - DNA, 14 bp, Homo sapiens
aataaaccattttt

SEQ ID NO: 3927951 - DNA, 17 bp, Homo sapiens
aataaacctggagatga

SEQ ID NO: 3927952 - DNA, 18 bp, Homo sapiens
aataaacctggagatgat

SEQ ID NO: 3927953 - DNA, 19 bp, Homo sapiens
aataaactagtttccagtg

SEQ ID NO: 3927954 - DNA, 21 bp, Homo sapiens
aataaacttagaataaaattg

SEQ ID NO: 3927955 - DNA, 17 bp, Homo sapiens
aataaacttattcctcc

SEQ ID NO: 3927956 - DNA, 15 bp, Homo sapiens
aataaagagttagaa

SEQ ID NO: 3927957 - DNA, 18 bp, Homo sapiens
aataaagagttagaatga

SEQ ID NO: 3927958 - DNA, 19 bp, Homo sapiens
aataaagcctatttttcaa

SEQ ID NO: 3927959 - DNA, 15 bp, Homo sapiens
aataaagtatcatgc

SEQ ID NO: 3927960 - DNA, 21 bp, Homo sapiens
aataaatcattaatactcttc

SEQ ID NO: 3927961 - DNA, 13 bp, Homo sapiens
aataaatgccaac

SEQ ID NO: 3927962 - DNA, 13 bp, Homo sapiens
aataaatgctgaa

SEQ ID NO: 3927963 - DNA, 13 bp, Homo sapiens
aataaatgttcaa

SEQ ID NO: 3927964 - DNA, 17 bp, Homo sapiens
aataaatgttcaaactg

SEQ ID NO: 3927965 - DNA, 14 bp, Homo sapiens
aataaattaagttt

SEQ ID NO: 3927966 - DNA, 19 bp, Homo sapiens
aataaattcaaaccattta

SEQ ID NO: 3927967 - DNA, 14 bp, Homo sapiens
aataaattcagata

SEQ ID NO: 3927968 - DNA, 19 bp, Homo sapiens
aagggccatgctgaaggga

SEQ ID NO: 3927969 - DNA, 24 bp, Homo sapiens
aagggctccagcatccagcctgtg

SEQ ID NO: 3927970 - DNA, 17 bp, Homo sapiens
aagggctgacctgcctc

SEQ ID NO: 3927971 - DNA, 18 bp, Homo sapiens
aaggggagaagggccagc

SEQ ID NO: 3927972 - DNA, 23 bp, Homo sapiens
aaggggcacaccactgccctgcc

SEQ ID NO: 3927973 - DNA, 15 bp, Homo sapiens
aaggggcacctggga

SEQ ID NO: 3927974 - DNA, 16 bp, Homo sapiens
aaggggcacctgggaa

SEQ ID NO: 3927975 - DNA, 13 bp, Homo sapiens
aaggggcccacaa

SEQ ID NO: 3927976 - DNA, 20 bp, Homo sapiens
aaggggccccggggctggca

SEQ ID NO: 3927977 - DNA, 14 bp, Homo sapiens
aaggggctgctggg

SEQ ID NO: 3927978 - DNA, 21 bp, Homo sapiens
aaggggctgctggggcatgtg

SEQ ID NO: 3927979 - DNA, 17 bp, Homo sapiens
aagggggtcaaaggaag

SEQ ID NO: 3927980 - DNA, 13 bp, Homo sapiens
aaggggtgccctc

SEQ ID NO: 3927981 - DNA, 15 bp, Homo sapiens
aaggggtgccctctg

SEQ ID NO: 3927982 - DNA, 18 bp, Homo sapiens
aagggtatgggaagccat

SEQ ID NO: 3927983 - DNA, 16 bp, Homo sapiens
aagggtctagggagag

SEQ ID NO: 3927984 - DNA, 18 bp, Homo sapiens
aagggtctagggagagac

SEQ ID NO: 3927985 - DNA, 14 bp, Homo sapiens
aagggtcttcttgg

SEQ ID NO: 3927986 - DNA, 18 bp, Homo sapiens
aagggtggtctgagcacc

SEQ ID NO: 3927987 - DNA, 16 bp, Homo sapiens
aagggtggtttggcaa

SEQ ID NO: 3927988 - DNA, 19 bp, Homo sapiens
aaggtcagttgccatggtt

SEQ ID NO: 3927989 - DNA, 20 bp, Homo sapiens
aaggtcattgtggctatctg

SEQ ID NO: 3927990 - DNA, 19 bp, Homo sapiens
aaggtctttggttcagcta

SEQ ID NO: 3927991 - DNA, 13 bp, Homo sapiens
aaggtgctgagct

SEQ ID NO: 3927992 - DNA, 23 bp, Homo sapiens
aaggtggggtatttaccacagca

SEQ ID NO: 3927993 - DNA, 21 bp, Homo sapiens
aaggtggggtctttgtgagag

SEQ ID NO: 3927994 - DNA, 22 bp, Homo sapiens
aaggtgggtccaggaaggcagc

SEQ ID NO: 3927995 - DNA, 19 bp, Homo sapiens
aaggtgtcttttccactcc

SEQ ID NO: 3927996 - DNA, 21 bp, Homo sapiens
aaggtgtttccatttctcaat

SEQ ID NO: 3927997 - DNA, 17 bp, Homo sapiens
aaggttaggatttaaca

SEQ ID NO: 3927998 - DNA, 17 bp, Homo sapiens
aaggttctcataggaaa

SEQ ID NO: 3927999 - DNA, 18 bp, Homo sapiens
aaggttgttttgaaactg

SEQ ID NO: 3928000 - DNA, 14 bp, Homo sapiens
aaggtttcaagact

SEQ ID NO: 3928001 - DNA, 17 bp, Homo sapiens
aaggtttgtatattgtc

SEQ ID NO: 3928002 - DNA, 20 bp, Homo sapiens
aaggttttcctcttctattt

SEQ ID NO: 3928003 - DNA, 13 bp, Homo sapiens
aaggttttctcca

SEQ ID NO: 3928004 - DNA, 14 bp, Homo sapiens
aagtaaaaccacag

SEQ ID NO: 3928005 - DNA, 22 bp, Homo sapiens
aagtaaaagctaattaggattt

SEQ ID NO: 3928006 - DNA, 18 bp, Homo sapiens
aagtaaattacattaaaa

SEQ ID NO: 3928007 - DNA, 13 bp, Homo sapiens
aagtaatataatg

SEQ ID NO: 3928008 - DNA, 21 bp, Homo sapiens
aagtaatataatggaagagaa

SEQ ID NO: 3928009 - DNA, 12 bp, Homo sapiens
aagtacatttaa

SEQ ID NO: 3928010 - DNA, 17 bp, Homo sapiens
aagtaccatagaacaga

SEQ ID NO: 3928011 - DNA, 12 bp, Homo sapiens
aagtacctgtag

SEQ ID NO: 3928012 - DNA, 17 bp, Homo sapiens
aagtactgctgtaaata

SEQ ID NO: 3928013 - DNA, 16 bp, Homo sapiens
aagtagaaaatttctt

SEQ ID NO: 3928014 - DNA, 15 bp, Homo sapiens
aagtagaattatatc

SEQ ID NO: 3928015 - DNA, 14 bp, Homo sapiens
aagtatattttcct

SEQ ID NO: 3928016 - DNA, 12 bp, Homo sapiens
aagtatcatgca

SEQ ID NO: 3928017 - DNA, 22 bp, Homo sapiens
aagtatgtaaagtatgtaaaca

SEQ ID NO: 3928018 - DNA, 17 bp, Homo sapiens
aagtatgtgatatctga

SEQ ID NO: 3928019 - DNA, 19 bp, Homo sapiens
aagtattgcgaatgtgcag

SEQ ID NO: 3928020 - DNA, 21 bp, Homo sapiens
aagtattgctgagtccaacaa

SEQ ID NO: 3928021 - DNA, 20 bp, Homo sapiens
aagtattttatctgtgttgt

SEQ ID NO: 3928022 - DNA, 19 bp, Homo sapiens
aagtcaaaaggtgcctgtg

SEQ ID NO: 3928023 - DNA, 22 bp, Homo sapiens
aagtcaaagtaaaacttgctgc

SEQ ID NO: 3928024 - DNA, 20 bp, Homo sapiens
aagtcaacaaccatgccagg

SEQ ID NO: 3928025 - DNA, 12 bp, Homo sapiens
aagtcacagctg

SEQ ID NO: 3928026 - DNA, 23 bp, Homo sapiens
aagtcacagctgcagctgggccc

SEQ ID NO: 3928027 - DNA, 14 bp, Homo sapiens
aagtcaccggagct

SEQ ID NO: 3928028 - DNA, 12 bp, Homo sapiens
aagtcactgcac

SEQ ID NO: 3928029 - DNA, 15 bp, Homo sapiens
aagtcacttccagtg

SEQ ID NO: 3928030 - DNA, 16 bp, Homo sapiens
aagtcacttccagtgt

SEQ ID NO: 3928031 - DNA, 17 bp, Homo sapiens
aagtccaggtcctggtg

SEQ ID NO: 3928032 - DNA, 18 bp, Homo sapiens
aagtccaggtcctggtgg

SEQ ID NO: 3928033 - DNA, 19 bp, Homo sapiens
aagtccaggtcctggtggg

SEQ ID NO: 3928034 - DNA, 21 bp, Homo sapiens
aagtccaggtcctggtggggc

SEQ ID NO: 3928035 - DNA, 23 bp, Homo sapiens
aagtcctatcgactttatacaga

SEQ ID NO: 3928036 - DNA, 24 bp, Homo sapiens
aagtcgtccttactcctgtgggag

SEQ ID NO: 3928037 - DNA, 18 bp, Homo sapiens
aagtcgtttcaggacatg

SEQ ID NO: 3928038 - DNA, 15 bp, Homo sapiens
aagtctaaagtttac

SEQ ID NO: 3928039 - DNA, 15 bp, Homo sapiens
aagtctagaaaccag

SEQ ID NO: 3928040 - DNA, 14 bp, Homo sapiens
aagtctccttcccc

SEQ ID NO: 3928041 - DNA, 22 bp, Homo sapiens
aagtctgagaatgcccaactct

SEQ ID NO: 3928042 - DNA, 14 bp, Homo sapiens
aagtctgtgtccaa

SEQ ID NO: 3928043 - DNA, 23 bp, Homo sapiens
aagtctgtgtgatgaactttctc

SEQ ID NO: 3928044 - DNA, 17 bp, Homo sapiens
aagtcttaaaataactt

SEQ ID NO: 3928045 - DNA, 18 bp, Homo sapiens
aagtcttaaaataactta

SEQ ID NO: 3928046 - DNA, 18 bp, Homo sapiens
aagtcttacttaaaaaaa

SEQ ID NO: 3928047 - DNA, 16 bp, Homo sapiens
aagtgaagaaaagtga

SEQ ID NO: 3928048 - DNA, 12 bp, Homo sapiens
aagtgaagcccc

SEQ ID NO: 3928049 - DNA, 22 bp, Homo sapiens
aagtgaagccccttgtcctctc

SEQ ID NO: 3928050 - DNA, 16 bp, Homo sapiens
aagtgaataaacttca

SEQ ID NO: 3928051 - DNA, 20 bp, Homo sapiens
aagtgaataaacttcagcac

SEQ ID NO: 3928052 - DNA, 22 bp, Homo sapiens
aagtgagaagctgggcatgaac

SEQ ID NO: 3928053 - DNA, 21 bp, Homo sapiens
aagtgaggaagcctaaataaa

SEQ ID NO: 3928054 - DNA, 14 bp, Homo sapiens
aatatgaacaaact

SEQ ID NO: 3928055 - DNA, 16 bp, Homo sapiens
aatatgacagctgtcc

SEQ ID NO: 3928056 - DNA, 10 bp, Homo sapiens
aatatgctta

SEQ ID NO: 3928057 - DNA, 14 bp, Homo sapiens
aatatggaacttct

SEQ ID NO: 3928058 - DNA, 17 bp, Homo sapiens
aatatggaacttctaat

SEQ ID NO: 3928059 - DNA, 18 bp, Homo sapiens
aatatggaacttctaata

SEQ ID NO: 3928060 - DNA, 20 bp, Homo sapiens
aatatggaacttctaatata

SEQ ID NO: 3928061 - DNA, 15 bp, Homo sapiens
aatatggctataaat

SEQ ID NO: 3928062 - DNA, 18 bp, Homo sapiens
aatatggctataaatata

SEQ ID NO: 3928063 - DNA, 19 bp, Homo sapiens
aatattaaatacagacact

SEQ ID NO: 3928064 - DNA, 12 bp, Homo sapiens
aatattattggg

SEQ ID NO: 3928065 - DNA, 15 bp, Homo sapiens
aatattcctgcattt

SEQ ID NO: 3928066 - DNA, 17 bp, Homo sapiens
aatatttaaacagcagt

SEQ ID NO: 3928067 - DNA, 19 bp, Homo sapiens
aatatttaaacagcagtgt

SEQ ID NO: 3928068 - DNA, 13 bp, Homo sapiens
aatatttaagtat

SEQ ID NO: 3928069 - DNA, 23 bp, Homo sapiens
aatatttatgtctatttaagcct

SEQ ID NO: 3928070 - DNA, 12 bp, Homo sapiens
aatatttgctga

SEQ ID NO: 3928071 - DNA, 15 bp, Homo sapiens
aatattttctgggtt

SEQ ID NO: 3928072 - DNA, 12 bp, Homo sapiens
aatattttgtat

SEQ ID NO: 3928073 - DNA, 18 bp, Homo sapiens
aatcaaaactctcctaca

SEQ ID NO: 3928074 - DNA, 15 bp, Homo sapiens
aatcaaaagctgctt

SEQ ID NO: 3928075 - DNA, 16 bp, Homo sapiens
aatcaaagacatggaa

SEQ ID NO: 3928076 - DNA, 15 bp, Homo sapiens
aatcaagaaacttaa

SEQ ID NO: 3928077 - DNA, 16 bp, Homo sapiens
aatcaatttcccagaa

SEQ ID NO: 3928078 - DNA, 14 bp, Homo sapiens
aatcacaagcaata

SEQ ID NO: 3928079 - DNA, 19 bp, Homo sapiens
aatcacaagcaataattag

SEQ ID NO: 3928080 - DNA, 13 bp, Homo sapiens
aatcacctggagg

SEQ ID NO: 3928081 - DNA, 21 bp, Homo sapiens
aatcacttgtaaataaataga

SEQ ID NO: 3928082 - DNA, 12 bp, Homo sapiens
aatcagcactga

SEQ ID NO: 3928083 - DNA, 13 bp, Homo sapiens
aatcagcactgaa

SEQ ID NO: 3928084 - DNA, 12 bp, Homo sapiens
aatcagcattct

SEQ ID NO: 3928085 - DNA, 18 bp, Homo sapiens
aatcagcattctcactcc

SEQ ID NO: 3928086 - DNA, 15 bp, Homo sapiens
aatcagcgccctgga

SEQ ID NO: 3928087 - DNA, 19 bp, Homo sapiens
aatcaggttgacagtccct

SEQ ID NO: 3928088 - DNA, 18 bp, Homo sapiens
aatcaggttgttaatgtt

SEQ ID NO: 3928089 - DNA, 21 bp, Homo sapiens
aatcagttatattctttaaat

SEQ ID NO: 3928090 - DNA, 22 bp, Homo sapiens
aatcagttatattctttaaatt

SEQ ID NO: 3928091 - DNA, 20 bp, Homo sapiens
aatcataattttcaagagaa

SEQ ID NO: 3928092 - DNA, 16 bp, Homo sapiens
aatcatcgaaaattca

SEQ ID NO: 3928093 - DNA, 16 bp, Homo sapiens
aatcatgtcaggcctg

SEQ ID NO: 3928094 - DNA, 13 bp, Homo sapiens
aatcattgtagaa

SEQ ID NO: 3928095 - DNA, 14 bp, Homo sapiens
aatcatttgctttt

SEQ ID NO: 3928096 - DNA, 17 bp, Homo sapiens
aatccaacccatgatga

SEQ ID NO: 3928097 - DNA, 20 bp, Homo sapiens
aatccacaaagccgtgcctt

SEQ ID NO: 3928098 - DNA, 21 bp, Homo sapiens
aatccacaaagccgtgccttt

SEQ ID NO: 3928099 - DNA, 18 bp, Homo sapiens
aatccacaagccattttt

SEQ ID NO: 3928100 - DNA, 23 bp, Homo sapiens
aatccacccatcctaccaatgca

SEQ ID NO: 3928101 - DNA, 15 bp, Homo sapiens
aatccactctcagga

SEQ ID NO: 3928102 - DNA, 16 bp, Homo sapiens
aatccaggtgggagag

SEQ ID NO: 3928103 - DNA, 16 bp, Homo sapiens
aatccgagtgtttgcc

SEQ ID NO: 3928104 - DNA, 17 bp, Homo sapiens
aatccgcctgcagagga

SEQ ID NO: 3928105 - DNA, 18 bp, Homo sapiens
aatcctgagtctgggcaa

SEQ ID NO: 3928106 - DNA, 12 bp, Homo sapiens
aatcctgcctct

SEQ ID NO: 3928107 - DNA, 15 bp, Homo sapiens
aatccttatttatat

SEQ ID NO: 3928108 - DNA, 21 bp, Homo sapiens
aatcctttgagaatgtgattc

SEQ ID NO: 3928109 - DNA, 14 bp, Homo sapiens
aatctaactacaag

SEQ ID NO: 3928110 - DNA, 18 bp, Homo sapiens
aatctcatacctctgacc

SEQ ID NO: 3928111 - DNA, 19 bp, Homo sapiens
aatctcatacctctgacca

SEQ ID NO: 3928112 - DNA, 23 bp, Homo sapiens
aatctcataggttgccaataata

SEQ ID NO: 3928113 - DNA, 19 bp, Homo sapiens
aatctccagggctgcccct

SEQ ID NO: 3928114 - DNA, 20 bp, Homo sapiens
aatctccagggctgcccctg

SEQ ID NO: 3928115 - DNA, 22 bp, Homo sapiens
aatctccagggctgcccctgta

SEQ ID NO: 3928116 - DNA, 15 bp, Homo sapiens
aatctccagtattct

SEQ ID NO: 3928117 - DNA, 18 bp, Homo sapiens
aatctctaaatcaagtat

SEQ ID NO: 3928118 - DNA, 20 bp, Homo sapiens
aatctgaagctattgatgtt

SEQ ID NO: 3928119 - DNA, 18 bp, Homo sapiens
aatctgaagcttcactca

SEQ ID NO: 3928120 - DNA, 15 bp, Homo sapiens
aatctgataggaaaa

SEQ ID NO: 3928121 - DNA, 17 bp, Homo sapiens
aatctgatttaatgttt

SEQ ID NO: 3928122 - DNA, 20 bp, Homo sapiens
aatctgatttaatgttttct

SEQ ID NO: 3928123 - DNA, 21 bp, Homo sapiens
aatctgatttaatgttttctg

SEQ ID NO: 3928124 - DNA, 22 bp, Homo sapiens
aatctgatttaatgttttctgc

SEQ ID NO: 3928125 - DNA, 21 bp, Homo sapiens
aatctgctgttgccatagccc

SEQ ID NO: 3928126 - DNA, 15 bp, Homo sapiens
aatctggaaatctgt

SEQ ID NO: 3928127 - DNA, 16 bp, Homo sapiens
aatctggaaatctgtt

SEQ ID NO: 3928128 - DNA, 21 bp, Homo sapiens
aatctggaaatctgttttgta

SEQ ID NO: 3928129 - DNA, 15 bp, Homo sapiens
aatctgggactttca

SEQ ID NO: 3928130 - DNA, 22 bp, Homo sapiens
aatctgtatatgttgtaataaa

SEQ ID NO: 3928131 - DNA, 16 bp, Homo sapiens
aatctgtgaattaaaa

SEQ ID NO: 3928132 - DNA, 15 bp, Homo sapiens
aatctgttactgaaa

SEQ ID NO: 3928133 - DNA, 17 bp, Homo sapiens
aatctgtttgatccctg

SEQ ID NO: 3928134 - DNA, 22 bp, Homo sapiens
aatctgttttgtatatgatcta

SEQ ID NO: 3928135 - DNA, 13 bp, Homo sapiens
aatcttagcatgc

SEQ ID NO: 3928136 - DNA, 20 bp, Homo sapiens
aatctttccttgtctctcat

SEQ ID NO: 3928137 - DNA, 14 bp, Homo sapiens
aatctttcttacta

SEQ ID NO: 3928138 - DNA, 21 bp, Homo sapiens
aatctttctttacctgagacc

SEQ ID NO: 3928139 - DNA, 14 bp, Homo sapiens
aatgaaaaattctc

SEQ ID NO: 3928140 - DNA, 22 bp, Homo sapiens
aataaattggtgataagtggaa

SEQ ID NO: 3928141 - DNA, 14 bp, Homo sapiens
aataaattttgttt

SEQ ID NO: 3928142 - DNA, 23 bp, Homo sapiens
aataacaacaatggtttacatga

SEQ ID NO: 3928143 - DNA, 20 bp, Homo sapiens
aataacataatttgtacata

SEQ ID NO: 3928144 - DNA, 13 bp, Homo sapiens
aataacatttgtg

SEQ ID NO: 3928145 - DNA, 19 bp, Homo sapiens
aataactagtgttgcttgg

SEQ ID NO: 3928146 - DNA, 11 bp, Homo sapiens
aataagaaagt

SEQ ID NO: 3928147 - DNA, 17 bp, Homo sapiens
aataaggatttgttcac

SEQ ID NO: 3928148 - DNA, 19 bp, Homo sapiens
aataaggggcacctgggaa

SEQ ID NO: 3928149 - DNA, 21 bp, Homo sapiens
aataataattaggttaacatt

SEQ ID NO: 3928150 - DNA, 16 bp, Homo sapiens
aataatagccatcctt

SEQ ID NO: 3928151 - DNA, 13 bp, Homo sapiens
aataatcggccca

SEQ ID NO: 3928152 - DNA, 16 bp, Homo sapiens
aataatcggcccacag

SEQ ID NO: 3928153 - DNA, 17 bp, Homo sapiens
aataatgtaagggtctg

SEQ ID NO: 3928154 - DNA, 12 bp, Homo sapiens
aataatgtgcaa

SEQ ID NO: 3928155 - DNA, 14 bp, Homo sapiens
aataatgtgcaaat

SEQ ID NO: 3928156 - DNA, 21 bp, Homo sapiens
aataatgtgcaaattttgcat

SEQ ID NO: 3928157 - DNA, 14 bp, Homo sapiens
aataatgttctgtc

SEQ ID NO: 3928158 - DNA, 15 bp, Homo sapiens
aataatgttctgtca

SEQ ID NO: 3928159 - DNA, 22 bp, Homo sapiens
aataattaggttaacattgttg

SEQ ID NO: 3928160 - DNA, 18 bp, Homo sapiens
aataattatccagagttt

SEQ ID NO: 3928161 - DNA, 10 bp, Homo sapiens
aataatttaa

SEQ ID NO: 3928162 - DNA, 21 bp, Homo sapiens
aataatttaactaatttaaac

SEQ ID NO: 3928163 - DNA, 17 bp, Homo sapiens
aatacaaaataaaatta

SEQ ID NO: 3928164 - DNA, 22 bp, Homo sapiens
aatacaagccactaccttctga

SEQ ID NO: 3928165 - DNA, 15 bp, Homo sapiens
aatacacaagtaaac

SEQ ID NO: 3928166 - DNA, 21 bp, Homo sapiens
aatacaccacctcactcctgt

SEQ ID NO: 3928167 - DNA, 17 bp, Homo sapiens
aatacaccacgaatttg

SEQ ID NO: 3928168 - DNA, 21 bp, Homo sapiens
aatacagacactaagttatag

SEQ ID NO: 3928169 - DNA, 13 bp, Homo sapiens
aatacagtaaagt

SEQ ID NO: 3928170 - DNA, 16 bp, Homo sapiens
aatacagtggatctca

SEQ ID NO: 3928171 - DNA, 12 bp, Homo sapiens
aatacagtgtta

SEQ ID NO: 3928172 - DNA, 21 bp, Homo sapiens
aatacataactagtttaatta

SEQ ID NO: 3928173 - DNA, 13 bp, Homo sapiens
aataccaaatatt

SEQ ID NO: 3928174 - DNA, 14 bp, Homo sapiens
aataccaaatattt

SEQ ID NO: 3928175 - DNA, 16 bp, Homo sapiens
aatacccccagagacc

SEQ ID NO: 3928176 - DNA, 17 bp, Homo sapiens
aatacccccagagacct

SEQ ID NO: 3928177 - DNA, 15 bp, Homo sapiens
aatacctttggaaaa

SEQ ID NO: 3928178 - DNA, 22 bp, Homo sapiens
aatactatgaaatgaaagaact

SEQ ID NO: 3928179 - DNA, 14 bp, Homo sapiens
aatactcacctcct

SEQ ID NO: 3928180 - DNA, 19 bp, Homo sapiens
aatactccaagcttcaagt

SEQ ID NO: 3928181 - DNA, 22 bp, Homo sapiens
aatactgccggtcacccaggct

SEQ ID NO: 3928182 - DNA, 13 bp, Homo sapiens
aatactgctctga

SEQ ID NO: 3928183 - DNA, 22 bp, Homo sapiens
aatactgctctgaatattttgt

SEQ ID NO: 3928184 - DNA, 16 bp, Homo sapiens
aatactgtacatagat

SEQ ID NO: 3928185 - DNA, 20 bp, Homo sapiens
aatacttcatttggtgctgg

SEQ ID NO: 3928186 - DNA, 19 bp, Homo sapiens
aatagaaaactgaaaatct

SEQ ID NO: 3928187 - DNA, 21 bp, Homo sapiens
aatagaaactcaccatgtaaa

SEQ ID NO: 3928188 - DNA, 15 bp, Homo sapiens
aatagacagtatatt

SEQ ID NO: 3928189 - DNA, 19 bp, Homo sapiens
aatagagattaattttaac

SEQ ID NO: 3928190 - DNA, 18 bp, Homo sapiens
aatagatacagcagaggc

SEQ ID NO: 3928191 - DNA, 20 bp, Homo sapiens
aatagatcctaggtgctgga

SEQ ID NO: 3928192 - DNA, 19 bp, Homo sapiens
aatagctctttcagggggg

SEQ ID NO: 3928193 - DNA, 17 bp, Homo sapiens
aatagcttttattgtat

SEQ ID NO: 3928194 - DNA, 16 bp, Homo sapiens
aataggttaatatcaa

SEQ ID NO: 3928195 - DNA, 17 bp, Homo sapiens
aatagtcaagaaaaatt

SEQ ID NO: 3928196 - DNA, 15 bp, Homo sapiens
aatagtccaatattt

SEQ ID NO: 3928197 - DNA, 22 bp, Homo sapiens
aatagtccccatcagcaccatg

SEQ ID NO: 3928198 - DNA, 21 bp, Homo sapiens
aatagttgtccatattttcac

SEQ ID NO: 3928199 - DNA, 20 bp, Homo sapiens
aatagtttctgattcactat

SEQ ID NO: 3928200 - DNA, 17 bp, Homo sapiens
aatataaacttgtgtat

SEQ ID NO: 3928201 - DNA, 18 bp, Homo sapiens
aatataaagttaaaaaaa

SEQ ID NO: 3928202 - DNA, 15 bp, Homo sapiens
aatataaatgtttaa

SEQ ID NO: 3928203 - DNA, 14 bp, Homo sapiens
aatatacaaacatg

SEQ ID NO: 3928204 - DNA, 16 bp, Homo sapiens
aatatacaaacatgtg

SEQ ID NO: 3928205 - DNA, 14 bp, Homo sapiens
aatatagagatatt

SEQ ID NO: 3928206 - DNA, 12 bp, Homo sapiens
aatatataaaaa

SEQ ID NO: 3928207 - DNA, 19 bp, Homo sapiens
aatatataaaaatatatat

SEQ ID NO: 3928208 - DNA, 20 bp, Homo sapiens
aatatataaaaatatatata

SEQ ID NO: 3928209 - DNA, 12 bp, Homo sapiens
aatatatataca

SEQ ID NO: 3928210 - DNA, 17 bp, Homo sapiens
aatatatatacatatgt

SEQ ID NO: 3928211 - DNA, 22 bp, Homo sapiens
aatatatatagtgctatatata

SEQ ID NO: 3928212 - DNA, 19 bp, Homo sapiens
aatatatatatatatttaa

SEQ ID NO: 3928213 - DNA, 19 bp, Homo sapiens
aatatatatttttcaacca

SEQ ID NO: 3928214 - DNA, 16 bp, Homo sapiens
aatatatcccagaaat

SEQ ID NO: 3928215 - DNA, 13 bp, Homo sapiens
aatatatggtctg

SEQ ID NO: 3928216 - DNA, 15 bp, Homo sapiens
aatatatttttatat

SEQ ID NO: 3928217 - DNA, 21 bp, Homo sapiens
aatatcagttactcagccctg

SEQ ID NO: 3928218 - DNA, 20 bp, Homo sapiens
aatatccaccactttaacct

SEQ ID NO: 3928219 - DNA, 18 bp, Homo sapiens
aatatctacctgccctct

SEQ ID NO: 3928220 - DNA, 19 bp, Homo sapiens
aatatctacctgccctctc

SEQ ID NO: 3928221 - DNA, 22 bp, Homo sapiens
aatatctacctgccctctctca

SEQ ID NO: 3928222 - DNA, 15 bp, Homo sapiens
aatatctgccccagt

SEQ ID NO: 3928223 - DNA, 18 bp, Homo sapiens
aatatcttgctggattaa

SEQ ID NO: 3928224 - DNA, 21 bp, Homo sapiens
aatatcttgctggattaatgt

SEQ ID NO: 3928225 - DNA, 14 bp, Homo sapiens
aatatgaaatgata

SEQ ID NO: 3928226 - DNA, 23 bp, Homo sapiens
aatgtagtggagagatcatagct

SEQ ID NO: 3928227 - DNA, 16 bp, Homo sapiens
aatgtatataaagtac

SEQ ID NO: 3928228 - DNA, 17 bp, Homo sapiens
aatgtatatacacatat

SEQ ID NO: 3928229 - DNA, 18 bp, Homo sapiens
aatgtatatacacatata

SEQ ID NO: 3928230 - DNA, 16 bp, Homo sapiens
aatgtatcatagaaat

SEQ ID NO: 3928231 - DNA, 19 bp, Homo sapiens
aatgtatcatagaaatgta

SEQ ID NO: 3928232 - DNA, 18 bp, Homo sapiens
aatgtattgaacttggaa

SEQ ID NO: 3928233 - DNA, 17 bp, Homo sapiens
aatgtatttatatgtta

SEQ ID NO: 3928234 - DNA, 16 bp, Homo sapiens
aatgtcaccaccttcc

SEQ ID NO: 3928235 - DNA, 20 bp, Homo sapiens
aatgtcaccaccttcccagc

SEQ ID NO: 3928236 - DNA, 13 bp, Homo sapiens
aatgtcagagcta

SEQ ID NO: 3928237 - DNA, 16 bp, Homo sapiens
aatgtctatagagaaa

SEQ ID NO: 3928238 - DNA, 20 bp, Homo sapiens
aatgtctcagcgaggtgtaa

SEQ ID NO: 3928239 - DNA, 18 bp, Homo sapiens
aatgtctttgttggaaaa

SEQ ID NO: 3928240 - DNA, 22 bp, Homo sapiens
aatgtctttgttggaaaagaat

SEQ ID NO: 3928241 - DNA, 23 bp, Homo sapiens
aatgtgaatcagaccctacccca

SEQ ID NO: 3928242 - DNA, 20 bp, Homo sapiens
aatgtgatcaactgttcagg

SEQ ID NO: 3928243 - DNA, 18 bp, Homo sapiens
aatgtgcaaattttgcat

SEQ ID NO: 3928244 - DNA, 21 bp, Homo sapiens
aatgtggcccctgaacaagaa

SEQ ID NO: 3928245 - DNA, 17 bp, Homo sapiens
aatgtggcctaaaaatg

SEQ ID NO: 3928246 - DNA, 20 bp, Homo sapiens
aatgtggcctaaaaatgcaa

SEQ ID NO: 3928247 - DNA, 12 bp, Homo sapiens
aatgtgtaaatg

SEQ ID NO: 3928248 - DNA, 17 bp, Homo sapiens
aatgtgtaagcattgta

SEQ ID NO: 3928249 - DNA, 13 bp, Homo sapiens
aatgtgtgtatgt

SEQ ID NO: 3928250 - DNA, 23 bp, Homo sapiens
aatgttaattcagcactgatttc

SEQ ID NO: 3928251 - DNA, 13 bp, Homo sapiens
aatgttgaaatct

SEQ ID NO: 3928252 - DNA, 21 bp, Homo sapiens
aatgttgggatttatatctat

SEQ ID NO: 3928253 - DNA, 18 bp, Homo sapiens
aatgtttatgttctcaga

SEQ ID NO: 3928254 - DNA, 16 bp, Homo sapiens
aatgtttattccttga

SEQ ID NO: 3928255 - DNA, 13 bp, Homo sapiens
aatgtttcaaatc

SEQ ID NO: 3928256 - DNA, 20 bp, Homo sapiens
aatgtttccaacctggagta

SEQ ID NO: 3928257 - DNA, 13 bp, Homo sapiens
aatgtttgattta

SEQ ID NO: 3928258 - DNA, 13 bp, Homo sapiens
aattaaaatatat

SEQ ID NO: 3928259 - DNA, 16 bp, Homo sapiens
aattaaaatatatata

SEQ ID NO: 3928260 - DNA, 20 bp, Homo sapiens
aattaaaatatatataaata

SEQ ID NO: 3928261 - DNA, 15 bp, Homo sapiens
aattaaaatctggaa

SEQ ID NO: 3928262 - DNA, 12 bp, Homo sapiens
aattaagacaag

SEQ ID NO: 3928263 - DNA, 24 bp, Homo sapiens
aattactaaattgtatacattttg

SEQ ID NO: 3928264 - DNA, 16 bp, Homo sapiens
aattactatattttag

SEQ ID NO: 3928265 - DNA, 12 bp, Homo sapiens
aattagcaattg

SEQ ID NO: 3928266 - DNA, 19 bp, Homo sapiens
aattaggaggctcaacaat

SEQ ID NO: 3928267 - DNA, 15 bp, Homo sapiens
aattaggttaacatt

SEQ ID NO: 3928268 - DNA, 16 bp, Homo sapiens
aattaggttaacattg

SEQ ID NO: 3928269 - DNA, 13 bp, Homo sapiens
aattagtacagta

SEQ ID NO: 3928270 - DNA, 16 bp, Homo sapiens
aattagtacagtagct

SEQ ID NO: 3928271 - DNA, 19 bp, Homo sapiens
aattagtacagtagcttaa

SEQ ID NO: 3928272 - DNA, 17 bp, Homo sapiens
aattataacttaaaata

SEQ ID NO: 3928273 - DNA, 11 bp, Homo sapiens
aattatatcta

SEQ ID NO: 3928274 - DNA, 18 bp, Homo sapiens
aattatatctaatttata

SEQ ID NO: 3928275 - DNA, 21 bp, Homo sapiens
aattatatctaatttatacaa

SEQ ID NO: 3928276 - DNA, 15 bp, Homo sapiens
aattatccagagttt

SEQ ID NO: 3928277 - DNA, 18 bp, Homo sapiens
aattatgcactggccacc

SEQ ID NO: 3928278 - DNA, 21 bp, Homo sapiens
aattatgtatgtttacatatc

SEQ ID NO: 3928279 - DNA, 23 bp, Homo sapiens
aattattatgactcaataaaaga

SEQ ID NO: 3928280 - DNA, 23 bp, Homo sapiens
aattattcctttcctagactaat

SEQ ID NO: 3928281 - DNA, 14 bp, Homo sapiens
aattattgtacact

SEQ ID NO: 3928282 - DNA, 18 bp, Homo sapiens
aattatttgtgtaataga

SEQ ID NO: 3928283 - DNA, 19 bp, Homo sapiens
aattatttgtgtaatagaa

SEQ ID NO: 3928284 - DNA, 19 bp, Homo sapiens
aattattttaatattttgt

SEQ ID NO: 3928285 - DNA, 20 bp, Homo sapiens
aattattttaatattttgta

SEQ ID NO: 3928286 - DNA, 23 bp, Homo sapiens
aattattttgttgtgattttgta

SEQ ID NO: 3928287 - DNA, 21 bp, Homo sapiens
aattcaaaccatttaattcat

SEQ ID NO: 3928288 - DNA, 18 bp, Homo sapiens
aattcaaagctctattaa

SEQ ID NO: 3928289 - DNA, 16 bp, Homo sapiens
aattcaacacattact

SEQ ID NO: 3928290 - DNA, 13 bp, Homo sapiens
aattcactcccac

SEQ ID NO: 3928291 - DNA, 23 bp, Homo sapiens
aattcactcccacacccaagaag

SEQ ID NO: 3928292 - DNA, 23 bp, Homo sapiens
aattcacttagggtcgagcatcc

SEQ ID NO: 3928293 - DNA, 16 bp, Homo sapiens
aattcagaagcatcac

SEQ ID NO: 3928294 - DNA, 17 bp, Homo sapiens
aattcagcaccctgggt

SEQ ID NO: 3928295 - DNA, 18 bp, Homo sapiens
aattcagcaccctgggtg

SEQ ID NO: 3928296 - DNA, 15 bp, Homo sapiens
aattcagcactgatt

SEQ ID NO: 3928297 - DNA, 20 bp, Homo sapiens
aattcagcactgatttcaca

SEQ ID NO: 3928298 - DNA, 23 bp, Homo sapiens
aattcagcactgatttcacaaca

SEQ ID NO: 3928299 - DNA, 21 bp, Homo sapiens
aattcaggtgaaaatgttcat

SEQ ID NO: 3928300 - DNA, 14 bp, Homo sapiens
aattcattaaattt

SEQ ID NO: 3928301 - DNA, 23 bp, Homo sapiens
aattcattaaatttctggatttg

SEQ ID NO: 3928302 - DNA, 16 bp, Homo sapiens
aattccataaccccag

SEQ ID NO: 3928303 - DNA, 14 bp, Homo sapiens
aattcccccacttg

SEQ ID NO: 3928304 - DNA, 17 bp, Homo sapiens
aattcctgtagcatctt

SEQ ID NO: 3928305 - DNA, 12 bp, Homo sapiens
aattccttccca

SEQ ID NO: 3928306 - DNA, 15 bp, Homo sapiens
aattccttcccactc

SEQ ID NO: 3928307 - DNA, 23 bp, Homo sapiens
aattctaggcatcccaggggacc

SEQ ID NO: 3928308 - DNA, 22 bp, Homo sapiens
aattctcaacctaccacccctt

SEQ ID NO: 3928309 - DNA, 13 bp, Homo sapiens
aattctcatgtga

SEQ ID NO: 3928310 - DNA, 16 bp, Homo sapiens
aattctcatgtgatcc

SEQ ID NO: 3928311 - DNA, 20 bp, Homo sapiens
aattctcatgtgatcctttt

SEQ ID NO: 3928312 - DNA, 15 bp, Homo sapiens
aatgaaaccaaagcc

SEQ ID NO: 3928313 - DNA, 17 bp, Homo sapiens
aatgaaaccaaagccag

SEQ ID NO: 3928314 - DNA, 17 bp, Homo sapiens
aatgaaagcatgtctca

SEQ ID NO: 3928315 - DNA, 14 bp, Homo sapiens
aatgaaatacacaa

SEQ ID NO: 3928316 - DNA, 18 bp, Homo sapiens
aatgaaatgctctccttt

SEQ ID NO: 3928317 - DNA, 19 bp, Homo sapiens
aatgaaatgctctcctttc

SEQ ID NO: 3928318 - DNA, 16 bp, Homo sapiens
aatgaagtatttctca

SEQ ID NO: 3928319 - DNA, 12 bp, Homo sapiens
aatgaatgacct

SEQ ID NO: 3928320 - DNA, 22 bp, Homo sapiens
aatgaattctctctaaaaataa

SEQ ID NO: 3928321 - DNA, 15 bp, Homo sapiens
aatgacaacagaagc

SEQ ID NO: 3928322 - DNA, 19 bp, Homo sapiens
aatgacacggtaggccaag

SEQ ID NO: 3928323 - DNA, 16 bp, Homo sapiens
aatgacagaatgctgt

SEQ ID NO: 3928324 - DNA, 21 bp, Homo sapiens
aatgacagaatgctgttttaa

SEQ ID NO: 3928325 - DNA, 18 bp, Homo sapiens
aatgaccaagaaaaagaa

SEQ ID NO: 3928326 - DNA, 16 bp, Homo sapiens
aatgacccaaagacca

SEQ ID NO: 3928327 - DNA, 18 bp, Homo sapiens
aatgactttttataatgt

SEQ ID NO: 3928328 - DNA, 14 bp, Homo sapiens
aatgagaacttcaa

SEQ ID NO: 3928329 - DNA, 15 bp, Homo sapiens
aatgagacttgctct

SEQ ID NO: 3928330 - DNA, 14 bp, Homo sapiens
aatgagcctgtaat

SEQ ID NO: 3928331 - DNA, 19 bp, Homo sapiens
aatgagctgtatctgtaat

SEQ ID NO: 3928332 - DNA, 24 bp, Homo sapiens
aatgaggcttggggctggagagga

SEQ ID NO: 3928333 - DNA, 23 bp, Homo sapiens
aatgataagcaggaaggatggca

SEQ ID NO: 3928334 - DNA, 17 bp, Homo sapiens
aatgatgattaaacacc

SEQ ID NO: 3928335 - DNA, 20 bp, Homo sapiens
aatgatgattaaacacctga

SEQ ID NO: 3928336 - DNA, 23 bp, Homo sapiens
aatgattatgtgtcctttcttga

SEQ ID NO: 3928337 - DNA, 19 bp, Homo sapiens
aatgattattttcattaca

SEQ ID NO: 3928338 - DNA, 16 bp, Homo sapiens
aatgattcataacaat

SEQ ID NO: 3928339 - DNA, 18 bp, Homo sapiens
aatgattcataacaatgt

SEQ ID NO: 3928340 - DNA, 13 bp, Homo sapiens
aatgattgtaaaa

SEQ ID NO: 3928341 - DNA, 14 bp, Homo sapiens
aatgattgtaaaat

SEQ ID NO: 3928342 - DNA, 18 bp, Homo sapiens
aatgattttcatcaattt

SEQ ID NO: 3928343 - DNA, 20 bp, Homo sapiens
aatgattttcatcaatttaa

SEQ ID NO: 3928344 - DNA, 14 bp, Homo sapiens
aatgatttttagat

SEQ ID NO: 3928345 - DNA, 13 bp, Homo sapiens
aatgcaaaaatct

SEQ ID NO: 3928346 - DNA, 21 bp, Homo sapiens
aatgcaagattttccacaaga

SEQ ID NO: 3928347 - DNA, 10 bp, Homo sapiens
aatgcacaat

SEQ ID NO: 3928348 - DNA, 13 bp, Homo sapiens
aatgcacaattta

SEQ ID NO: 3928349 - DNA, 17 bp, Homo sapiens
aatgcacaatttagaaa

SEQ ID NO: 3928350 - DNA, 18 bp, Homo sapiens
aatgcacaatttagaaaa

SEQ ID NO: 3928351 - DNA, 21 bp, Homo sapiens
aatgcacaatttagaaaacat

SEQ ID NO: 3928352 - DNA, 21 bp, Homo sapiens
aatgcacaccaaaaaaatact

SEQ ID NO: 3928353 - DNA, 18 bp, Homo sapiens
aatgcagattcctgggcc

SEQ ID NO: 3928354 - DNA, 20 bp, Homo sapiens
aatgcagattcctgggcctg

SEQ ID NO: 3928355 - DNA, 23 bp, Homo sapiens
aatgcagtccagaataagtgctg

SEQ ID NO: 3928356 - DNA, 19 bp, Homo sapiens
aatgcatccattcctcagg

SEQ ID NO: 3928357 - DNA, 16 bp, Homo sapiens
aatgcatgattttata

SEQ ID NO: 3928358 - DNA, 19 bp, Homo sapiens
aatgcatgattttatacat

SEQ ID NO: 3928359 - DNA, 21 bp, Homo sapiens
aatgcatgattttatacatag

SEQ ID NO: 3928360 - DNA, 19 bp, Homo sapiens
aatgcatgcagccactgtg

SEQ ID NO: 3928361 - DNA, 17 bp, Homo sapiens
aatgcattattttgaat

SEQ ID NO: 3928362 - DNA, 17 bp, Homo sapiens
aatgcattgtcttgtgg

SEQ ID NO: 3928363 - DNA, 17 bp, Homo sapiens
aatgccaagataattca

SEQ ID NO: 3928364 - DNA, 22 bp, Homo sapiens
aatgccagagacggaagccttt

SEQ ID NO: 3928365 - DNA, 19 bp, Homo sapiens
aatgcccgtaatgcttaga

SEQ ID NO: 3928366 - DNA, 17 bp, Homo sapiens
aatgccttgggagagat

SEQ ID NO: 3928367 - DNA, 23 bp, Homo sapiens
aatgctcgtgtgatttcctacag

SEQ ID NO: 3928368 - DNA, 18 bp, Homo sapiens
aatgctgaaaatcaaagt

SEQ ID NO: 3928369 - DNA, 16 bp, Homo sapiens
aatgctgttgcctcat

SEQ ID NO: 3928370 - DNA, 17 bp, Homo sapiens
aatgctttctgaagctt

SEQ ID NO: 3928371 - DNA, 17 bp, Homo sapiens
aatggaattcagtaaca

SEQ ID NO: 3928372 - DNA, 14 bp, Homo sapiens
aatggacttcaaat

SEQ ID NO: 3928373 - DNA, 13 bp, Homo sapiens
aatggagcttgta

SEQ ID NO: 3928374 - DNA, 16 bp, Homo sapiens
aatggagcttgtacat

SEQ ID NO: 3928375 - DNA, 19 bp, Homo sapiens
aatggatttttaaattata

SEQ ID NO: 3928376 - DNA, 10 bp, Homo sapiens
aatggccatg

SEQ ID NO: 3928377 - DNA, 21 bp, Homo sapiens
aatggccctagaactgtgcct

SEQ ID NO: 3928378 - DNA, 16 bp, Homo sapiens
aatggctgtaaactat

SEQ ID NO: 3928379 - DNA, 18 bp, Homo sapiens
aatggctgtaaactataa

SEQ ID NO: 3928380 - DNA, 19 bp, Homo sapiens
aatgggagggggctccatg

SEQ ID NO: 3928381 - DNA, 23 bp, Homo sapiens
aatgggcactgggatgagccgct

SEQ ID NO: 3928382 - DNA, 13 bp, Homo sapiens
aatgggtgatatg

SEQ ID NO: 3928383 - DNA, 15 bp, Homo sapiens
aatggtatgagctga

SEQ ID NO: 3928384 - DNA, 18 bp, Homo sapiens
aatggtatgagctgaggg

SEQ ID NO: 3928385 - DNA, 14 bp, Homo sapiens
aatggtccagggtt

SEQ ID NO: 3928386 - DNA, 14 bp, Homo sapiens
aatggtcccttctt

SEQ ID NO: 3928387 - DNA, 22 bp, Homo sapiens
aatggtctttctaatgtgtgaa

SEQ ID NO: 3928388 - DNA, 20 bp, Homo sapiens
aatggtgggaaccctcccca

SEQ ID NO: 3928389 - DNA, 17 bp, Homo sapiens
aatggtggtttgtcata

SEQ ID NO: 3928390 - DNA, 18 bp, Homo sapiens
aatggtttacatgaacac

SEQ ID NO: 3928391 - DNA, 18 bp, Homo sapiens
aatggtttttatttctcg

SEQ ID NO: 3928392 - DNA, 20 bp, Homo sapiens
aatgtaagggtctgttgtaa

SEQ ID NO: 3928393 - DNA, 23 bp, Homo sapiens
aatgtaagggtctgttgtaaatg

SEQ ID NO: 3928394 - DNA, 16 bp, Homo sapiens
aatgtacaagttttgt

SEQ ID NO: 3928395 - DNA, 18 bp, Homo sapiens
aatgtacccaccgggcca

SEQ ID NO: 3928396 - DNA, 22 bp, Homo sapiens
aatgtacgaaactgtatgatta

SEQ ID NO: 3928397 - DNA, 23 bp, Homo sapiens
aatgtaggtttagatatataact

SEQ ID NO: 3928398 - DNA, 22 bp, Homo sapiens
acaccattgttccttaccttta

SEQ ID NO: 3928399 - DNA, 19 bp, Homo sapiens
acacccaaagaggtattta

SEQ ID NO: 3928400 - DNA, 22 bp, Homo sapiens
acacccaaagcatggactaacc

SEQ ID NO: 3928401 - DNA, 16 bp, Homo sapiens
acacccaagtccaggc

SEQ ID NO: 3928402 - DNA, 15 bp, Homo sapiens
acacccactggccag

SEQ ID NO: 3928403 - DNA, 16 bp, Homo sapiens
acacccatgtaaatgt

SEQ ID NO: 3928404 - DNA, 21 bp, Homo sapiens
acacccatgtaaatgtccaaa

SEQ ID NO: 3928405 - DNA, 14 bp, Homo sapiens
acacccccaagaca

SEQ ID NO: 3928406 - DNA, 20 bp, Homo sapiens
acacccctccaaagccccac

SEQ ID NO: 3928407 - DNA, 17 bp, Homo sapiens
acaccccttatccagga

SEQ ID NO: 3928408 - DNA, 13 bp, Homo sapiens
acaccctaataag

SEQ ID NO: 3928409 - DNA, 16 bp, Homo sapiens
acaccgggcctggaga

SEQ ID NO: 3928410 - DNA, 14 bp, Homo sapiens
acaccgtccctcag

SEQ ID NO: 3928411 - DNA, 12 bp, Homo sapiens
acacctctgggc

SEQ ID NO: 3928412 - DNA, 18 bp, Homo sapiens
acacctgcacctcccccc

SEQ ID NO: 3928413 - DNA, 19 bp, Homo sapiens
acacctgcacctcccccca

SEQ ID NO: 3928414 - DNA, 12 bp, Homo sapiens
acacctgcccca

SEQ ID NO: 3928415 - DNA, 13 bp, Homo sapiens
acacctgccccag

SEQ ID NO: 3928416 - DNA, 22 bp, Homo sapiens
acacctgccctgccctgccacc

SEQ ID NO: 3928417 - DNA, 21 bp, Homo sapiens
acacctgtaatcccagcactt

SEQ ID NO: 3928418 - DNA, 22 bp, Homo sapiens
acaccttgtgaccttctctata

SEQ ID NO: 3928419 - DNA, 21 bp, Homo sapiens
acacctttgttttgcactgac

SEQ ID NO: 3928420 - DNA, 22 bp, Homo sapiens
acaccttttccaggagttctga

SEQ ID NO: 3928421 - DNA, 22 bp, Homo sapiens
acaccttttgtatttaaaacct

SEQ ID NO: 3928422 - DNA, 21 bp, Homo sapiens
acacgcaagggcatcaggcac

SEQ ID NO: 3928423 - DNA, 14 bp, Homo sapiens
acacggaggcatct

SEQ ID NO: 3928424 - DNA, 23 bp, Homo sapiens
acacggatgcacagagatatgca

SEQ ID NO: 3928425 - DNA, 17 bp, Homo sapiens
acacggggtattttagg

SEQ ID NO: 3928426 - DNA, 16 bp, Homo sapiens
acacggtaggccaagc

SEQ ID NO: 3928427 - DNA, 17 bp, Homo sapiens
acacggtgaaatccagg

SEQ ID NO: 3928428 - DNA, 13 bp, Homo sapiens
acacgtatttata

SEQ ID NO: 3928429 - DNA, 19 bp, Homo sapiens
acacgtatttatatttgga

SEQ ID NO: 3928430 - DNA, 18 bp, Homo sapiens
acacgtgctcgcagcctg

SEQ ID NO: 3928431 - DNA, 20 bp, Homo sapiens
acacgtgctcgcagcctggc

SEQ ID NO: 3928432 - DNA, 21 bp, Homo sapiens
acactaaacagactatttaac

SEQ ID NO: 3928433 - DNA, 13 bp, Homo sapiens
acactagcctctc

SEQ ID NO: 3928434 - DNA, 19 bp, Homo sapiens
acactagttttgtgccagc

SEQ ID NO: 3928435 - DNA, 18 bp, Homo sapiens
acactattaccatgagaa

SEQ ID NO: 3928436 - DNA, 16 bp, Homo sapiens
acactattgcattgtt

SEQ ID NO: 3928437 - DNA, 17 bp, Homo sapiens
acactcaaatcaagaaa

SEQ ID NO: 3928438 - DNA, 18 bp, Homo sapiens
acactcaaatcaagaaac

SEQ ID NO: 3928439 - DNA, 14 bp, Homo sapiens
acactcagaagcct

SEQ ID NO: 3928440 - DNA, 12 bp, Homo sapiens
acaactgacaca

SEQ ID NO: 3928441 - DNA, 14 bp, Homo sapiens
acaactgacacagg

SEQ ID NO: 3928442 - DNA, 16 bp, Homo sapiens
acaactgacacaggaa

SEQ ID NO: 3928443 - DNA, 20 bp, Homo sapiens
acaactgtctaatgacacgg

SEQ ID NO: 3928444 - DNA, 17 bp, Homo sapiens
acaacttcaagtgcatg

SEQ ID NO: 3928445 - DNA, 13 bp, Homo sapiens
acaagaagaccag

SEQ ID NO: 3928446 - DNA, 22 bp, Homo sapiens
acaagaagctcccagatgctgg

SEQ ID NO: 3928447 - DNA, 17 bp, Homo sapiens
acaagagctgctgtcct

SEQ ID NO: 3928448 - DNA, 18 bp, Homo sapiens
acaagagtttatttccaa

SEQ ID NO: 3928449 - DNA, 15 bp, Homo sapiens
acaagatctttcagg

SEQ ID NO: 3928450 - DNA, 16 bp, Homo sapiens
acaagatctttcagga

SEQ ID NO: 3928451 - DNA, 18 bp, Homo sapiens
acaagattcccagagaca

SEQ ID NO: 3928452 - DNA, 15 bp, Homo sapiens
acaagcatatttgag

SEQ ID NO: 3928453 - DNA, 23 bp, Homo sapiens
acaagcatggtcccacatccctg

SEQ ID NO: 3928454 - DNA, 18 bp, Homo sapiens
acaagccacagaagccag

SEQ ID NO: 3928455 - DNA, 14 bp, Homo sapiens
acaagccctggcaa

SEQ ID NO: 3928456 - DNA, 20 bp, Homo sapiens
acaagccttactcacctctc

SEQ ID NO: 3928457 - DNA, 18 bp, Homo sapiens
acaagctggaagcacatg

SEQ ID NO: 3928458 - DNA, 18 bp, Homo sapiens
acaagcttgtatatacat

SEQ ID NO: 3928459 - DNA, 20 bp, Homo sapiens
acaagcttgtatatacatat

SEQ ID NO: 3928460 - DNA, 21 bp, Homo sapiens
acaaggaatagtcgcgcaagc

SEQ ID NO: 3928461 - DNA, 21 bp, Homo sapiens
acaaggaccctgttttccaca

SEQ ID NO: 3928462 - DNA, 17 bp, Homo sapiens
acaaggcacttgtcact

SEQ ID NO: 3928463 - DNA, 13 bp, Homo sapiens
acaaggctgacca

SEQ ID NO: 3928464 - DNA, 15 bp, Homo sapiens
acaaggtagacatgg

SEQ ID NO: 3928465 - DNA, 18 bp, Homo sapiens
acaaggttcttctaaaat

SEQ ID NO: 3928466 - DNA, 15 bp, Homo sapiens
acaagtcctgtgaat

SEQ ID NO: 3928467 - DNA, 19 bp, Homo sapiens
acaagtcctgtgaatttct

SEQ ID NO: 3928468 - DNA, 14 bp, Homo sapiens
acaagtggaggggg

SEQ ID NO: 3928469 - DNA, 22 bp, Homo sapiens
acaagtggagggggtgtctgga

SEQ ID NO: 3928470 - DNA, 15 bp, Homo sapiens
acaagttattctctt

SEQ ID NO: 3928471 - DNA, 15 bp, Homo sapiens
acaataaaacattat

SEQ ID NO: 3928472 - DNA, 13 bp, Homo sapiens
acaataaagactg

SEQ ID NO: 3928473 - DNA, 16 bp, Homo sapiens
acaataaatattctgc

SEQ ID NO: 3928474 - DNA, 11 bp, Homo sapiens
acaataaatgc

SEQ ID NO: 3928475 - DNA, 15 bp, Homo sapiens
acaataaatgtgctt

SEQ ID NO: 3928476 - DNA, 19 bp, Homo sapiens
acaataattaatgtgtgtc

SEQ ID NO: 3928477 - DNA, 15 bp, Homo sapiens
acaatacaacaagaa

SEQ ID NO: 3928478 - DNA, 18 bp, Homo sapiens
acaatacaacaagaacaa

SEQ ID NO: 3928479 - DNA, 16 bp, Homo sapiens
acaatacatgctgcta

SEQ ID NO: 3928480 - DNA, 22 bp, Homo sapiens
acagtagcttaaataaattcaa

SEQ ID NO: 3928481 - DNA, 18 bp, Homo sapiens
acagtattctcagtgctc

SEQ ID NO: 3928482 - DNA, 16 bp, Homo sapiens
acagtcacccttctgg

SEQ ID NO: 3928483 - DNA, 14 bp, Homo sapiens
acagtcattcacat

SEQ ID NO: 3928484 - DNA, 13 bp, Homo sapiens
acagtcatttaaa

SEQ ID NO: 3928485 - DNA, 21 bp, Homo sapiens
acagtcctcacagcctctccc

SEQ ID NO: 3928486 - DNA, 18 bp, Homo sapiens
acagtgagcctgaatttt

SEQ ID NO: 3928487 - DNA, 21 bp, Homo sapiens
acagtgagcctgaattttgtt

SEQ ID NO: 3928488 - DNA, 17 bp, Homo sapiens
acagtgcccagctaatt

SEQ ID NO: 3928489 - DNA, 18 bp, Homo sapiens
acagtgcccagctaattt

SEQ ID NO: 3928490 - DNA, 14 bp, Homo sapiens
acagtgcctgctga

SEQ ID NO: 3928491 - DNA, 16 bp, Homo sapiens
acagtgctgccctgcg

SEQ ID NO: 3928492 - DNA, 24 bp, Homo sapiens
acagtgctgccctgcgaagtggct

SEQ ID NO: 3928493 - DNA, 22 bp, Homo sapiens
acagtggaggaaaatccatgga

SEQ ID NO: 3928494 - DNA, 14 bp, Homo sapiens
acagtggagtgaga

SEQ ID NO: 3928495 - DNA, 16 bp, Homo sapiens
acagtggcgagaggag

SEQ ID NO: 3928496 - DNA, 16 bp, Homo sapiens
acagtgggaactctga

SEQ ID NO: 3928497 - DNA, 21 bp, Homo sapiens
acagtgggaactctgacaagg

SEQ ID NO: 3928498 - DNA, 14 bp, Homo sapiens
acagtgggtggcac

SEQ ID NO: 3928499 - DNA, 16 bp, Homo sapiens
acagtgggtggcacct

SEQ ID NO: 3928500 - DNA, 11 bp, Homo sapiens
acagtgtgtgt

SEQ ID NO: 3928501 - DNA, 20 bp, Homo sapiens
acagtgttattttctttgaa

SEQ ID NO: 3928502 - DNA, 21 bp, Homo sapiens
acagtgttccagctgcctggg

SEQ ID NO: 3928503 - DNA, 21 bp, Homo sapiens
acagtgttgaaaatgttcaga

SEQ ID NO: 3928504 - DNA, 16 bp, Homo sapiens
acagttcaagaaagct

SEQ ID NO: 3928505 - DNA, 12 bp, Homo sapiens
acagttcagttc

SEQ ID NO: 3928506 - DNA, 16 bp, Homo sapiens
acagttcagttcctct

SEQ ID NO: 3928507 - DNA, 19 bp, Homo sapiens
acagttcctcgccctgggt

SEQ ID NO: 3928508 - DNA, 13 bp, Homo sapiens
acagttggcagag

SEQ ID NO: 3928509 - DNA, 20 bp, Homo sapiens
acagtttgatgtcattaatg

SEQ ID NO: 3928510 - DNA, 14 bp, Homo sapiens
acagtttgctctag

SEQ ID NO: 3928511 - DNA, 21 bp, Homo sapiens
acagtttggaagtgttaacta

SEQ ID NO: 3928512 - DNA, 13 bp, Homo sapiens
acagttttgtgaa

SEQ ID NO: 3928513 - DNA, 15 bp, Homo sapiens
acataaagcaaatag

SEQ ID NO: 3928514 - DNA, 14 bp, Homo sapiens
acataacaagaaaa

SEQ ID NO: 3928515 - DNA, 16 bp, Homo sapiens
acataactagtttaat

SEQ ID NO: 3928516 - DNA, 18 bp, Homo sapiens
acatacaacacaaagaga

SEQ ID NO: 3928517 - DNA, 12 bp, Homo sapiens
acatacaatttg

SEQ ID NO: 3928518 - DNA, 13 bp, Homo sapiens
acatacacataca

SEQ ID NO: 3928519 - DNA, 16 bp, Homo sapiens
acatacacatacatac

SEQ ID NO: 3928520 - DNA, 20 bp, Homo sapiens
acatacacttgtataaatgt

SEQ ID NO: 3928521 - DNA, 13 bp, Homo sapiens
acatacatacaca

SEQ ID NO: 3928522 - DNA, 13 bp, Homo sapiens
acatacatacata

SEQ ID NO: 3928523 - DNA, 16 bp, Homo sapiens
acatacatacatacat

SEQ ID NO: 3928524 - DNA, 16 bp, Homo sapiens
acatacatacatatat

SEQ ID NO: 3928525 - DNA, 14 bp, Homo sapiens
acatacatatatat

SEQ ID NO: 3928526 - DNA, 17 bp, Homo sapiens
acatacccttctttaaa

SEQ ID NO: 3928527 - DNA, 20 bp, Homo sapiens
acatacccttctttaaatca

SEQ ID NO: 3928528 - DNA, 17 bp, Homo sapiens
acatacgaaacacaaac

SEQ ID NO: 3928529 - DNA, 16 bp, Homo sapiens
acatacgtgtctgtgt

SEQ ID NO: 3928530 - DNA, 12 bp, Homo sapiens
acatacgtgtta

SEQ ID NO: 3928531 - DNA, 18 bp, Homo sapiens
acagagaaattctgtggt

SEQ ID NO: 3928532 - DNA, 15 bp, Homo sapiens
acagagaaggcagga

SEQ ID NO: 3928533 - DNA, 17 bp, Homo sapiens
acagagacagaaacaga

SEQ ID NO: 3928534 - DNA, 15 bp, Homo sapiens
acagagagagactga

SEQ ID NO: 3928535 - DNA, 16 bp, Homo sapiens
acagagatatgcacac

SEQ ID NO: 3928536 - DNA, 17 bp, Homo sapiens
acagagccgcaaatcaa

SEQ ID NO: 3928537 - DNA, 19 bp, Homo sapiens
acagagcgggcctcttccc

SEQ ID NO: 3928538 - DNA, 17 bp, Homo sapiens
acagaggaagagcaggc

SEQ ID NO: 3928539 - DNA, 20 bp, Homo sapiens
acagaggagggcgtgactca

SEQ ID NO: 3928540 - DNA, 15 bp, Homo sapiens
acagaggcaggagtg

SEQ ID NO: 3928541 - DNA, 23 bp, Homo sapiens
acagagggatggcgaatacctca

SEQ ID NO: 3928542 - DNA, 13 bp, Homo sapiens
acagaggggcagg

SEQ ID NO: 3928543 - DNA, 14 bp, Homo sapiens
acagaggtaactat

SEQ ID NO: 3928544 - DNA, 17 bp, Homo sapiens
acagatacatagatgga

SEQ ID NO: 3928545 - DNA, 14 bp, Homo sapiens
acagatataaatgg

SEQ ID NO: 3928546 - DNA, 17 bp, Homo sapiens
acagatatacacatgga

SEQ ID NO: 3928547 - DNA, 20 bp, Homo sapiens
acagatgggtattaaacttg

SEQ ID NO: 3928548 - DNA, 20 bp, Homo sapiens
acagatgtcagccgagccgg

SEQ ID NO: 3928549 - DNA, 21 bp, Homo sapiens
acagattctagccaaactatt

SEQ ID NO: 3928550 - DNA, 17 bp, Homo sapiens
acagcaagccggccccc

SEQ ID NO: 3928551 - DNA, 12 bp, Homo sapiens
acagcacccagg

SEQ ID NO: 3928552 - DNA, 13 bp, Homo sapiens
acagcacccaggc

SEQ ID NO: 3928553 - DNA, 17 bp, Homo sapiens
acagcacccaggctcca

SEQ ID NO: 3928554 - DNA, 13 bp, Homo sapiens
acagcagaaagac

SEQ ID NO: 3928555 - DNA, 16 bp, Homo sapiens
acagcagcactgcaga

SEQ ID NO: 3928556 - DNA, 19 bp, Homo sapiens
acagcagtggagagtgttc

SEQ ID NO: 3928557 - DNA, 15 bp, Homo sapiens
acagcagttgaaaag

SEQ ID NO: 3928558 - DNA, 22 bp, Homo sapiens
acagcagttgaaaagactccaa

SEQ ID NO: 3928559 - DNA, 23 bp, Homo sapiens
acagccaaatgcatggtgcagtt

SEQ ID NO: 3928560 - DNA, 23 bp, Homo sapiens
acagccaacaggtggcaggacca

SEQ ID NO: 3928561 - DNA, 15 bp, Homo sapiens
acagcccagcctagc

SEQ ID NO: 3928562 - DNA, 14 bp, Homo sapiens
acagcccaggtcct

SEQ ID NO: 3928563 - DNA, 14 bp, Homo sapiens
acagcccattttat

SEQ ID NO: 3928564 - DNA, 13 bp, Homo sapiens
acagccccacagc

SEQ ID NO: 3928565 - DNA, 14 bp, Homo sapiens
acagccccacagca

SEQ ID NO: 3928566 - DNA, 20 bp, Homo sapiens
acagccccacagcacccagg

SEQ ID NO: 3928567 - DNA, 21 bp, Homo sapiens
acagccccacagcacccaggc

SEQ ID NO: 3928568 - DNA, 11 bp, Homo sapiens
acagccccagg

SEQ ID NO: 3928569 - DNA, 16 bp, Homo sapiens
acagccccagggccct

SEQ ID NO: 3928570 - DNA, 23 bp, Homo sapiens
acagcccgggtgtgcctgccctg

SEQ ID NO: 3928571 - DNA, 14 bp, Homo sapiens
acagcctcacagaa

SEQ ID NO: 3928572 - DNA, 17 bp, Homo sapiens
acacacgtatttatatt

SEQ ID NO: 3928573 - DNA, 23 bp, Homo sapiens
acacacgtatttatatttggaaa

SEQ ID NO: 3928574 - DNA, 13 bp, Homo sapiens
acacactaatcga

SEQ ID NO: 3928575 - DNA, 15 bp, Homo sapiens
acacactcagcagcc

SEQ ID NO: 3928576 - DNA, 19 bp, Homo sapiens
acacactcagcagccccct

SEQ ID NO: 3928577 - DNA, 21 bp, Homo sapiens
acacactgtaaacccctgggt

SEQ ID NO: 3928578 - DNA, 20 bp, Homo sapiens
acacagaggttttaaacagt

SEQ ID NO: 3928579 - DNA, 19 bp, Homo sapiens
acacagatttttgggctcc

SEQ ID NO: 3928580 - DNA, 21 bp, Homo sapiens
acacagcagtatgaatgatgt

SEQ ID NO: 3928581 - DNA, 18 bp, Homo sapiens
acacagcgtccctagcag

SEQ ID NO: 3928582 - DNA, 22 bp, Homo sapiens
acacaggcctgtgtagctgtga

SEQ ID NO: 3928583 - DNA, 14 bp, Homo sapiens
acacagggctcttt

SEQ ID NO: 3928584 - DNA, 19 bp, Homo sapiens
acacagggctctttgatgg

SEQ ID NO: 3928585 - DNA, 16 bp, Homo sapiens
acacagtctcagtcca

SEQ ID NO: 3928586 - DNA, 19 bp, Homo sapiens
acacagtgggaactctgac

SEQ ID NO: 3928587 - DNA, 10 bp, Homo sapiens
acacagtgtt

SEQ ID NO: 3928588 - DNA, 21 bp, Homo sapiens
acacagtgttccagctgcctg

SEQ ID NO: 3928589 - DNA, 16 bp, Homo sapiens
acacataactagaaac

SEQ ID NO: 3928590 - DNA, 15 bp, Homo sapiens
acacatacatacaca

SEQ ID NO: 3928591 - DNA, 14 bp, Homo sapiens
acacatacatacat

SEQ ID NO: 3928592 - DNA, 14 bp, Homo sapiens
acacatacatcctg

SEQ ID NO: 3928593 - DNA, 18 bp, Homo sapiens
acacatagattaatggca

SEQ ID NO: 3928594 - DNA, 14 bp, Homo sapiens
acacatatacatat

SEQ ID NO: 3928595 - DNA, 15 bp, Homo sapiens
acacatatacatata

SEQ ID NO: 3928596 - DNA, 22 bp, Homo sapiens
acacatcccggcctcttccacc

SEQ ID NO: 3928597 - DNA, 19 bp, Homo sapiens
acacatccctaatgtgtgc

SEQ ID NO: 3928598 - DNA, 13 bp, Homo sapiens
acacatctttcct

SEQ ID NO: 3928599 - DNA, 12 bp, Homo sapiens
acacattctcct

SEQ ID NO: 3928600 - DNA, 13 bp, Homo sapiens
acacattctcctg

SEQ ID NO: 3928601 - DNA, 14 bp, Homo sapiens
acacattttctcct

SEQ ID NO: 3928602 - DNA, 23 bp, Homo sapiens
acacattttctcctaggagaagc

SEQ ID NO: 3928603 - DNA, 14 bp, Homo sapiens
acaccaaataaata

SEQ ID NO: 3928604 - DNA, 17 bp, Homo sapiens
acaccacagcaagccgg

SEQ ID NO: 3928605 - DNA, 13 bp, Homo sapiens
acaccactctggc

SEQ ID NO: 3928606 - DNA, 17 bp, Homo sapiens
acaccactctggcagcc

SEQ ID NO: 3928607 - DNA, 18 bp, Homo sapiens
acaccactctggcagcca

SEQ ID NO: 3928608 - DNA, 22 bp, Homo sapiens
acaccactctggcagccacact

SEQ ID NO: 3928609 - DNA, 15 bp, Homo sapiens
acaccactgccctgc

SEQ ID NO: 3928610 - DNA, 18 bp, Homo sapiens
acaccactgccctgcctg

SEQ ID NO: 3928611 - DNA, 19 bp, Homo sapiens
acaccatcaccctctgggc

SEQ ID NO: 3928612 - DNA, 19 bp, Homo sapiens
acaccatcttaaatgacag

SEQ ID NO: 3928613 - DNA, 23 bp, Homo sapiens
acaccatgtttgagctcagaccc

SEQ ID NO: 3928614 - DNA, 23 bp, Homo sapiens
actggcaggtgcagatgggctgt

SEQ ID NO: 3928615 - DNA, 14 bp, Homo sapiens
actggccaagctga

SEQ ID NO: 3928616 - DNA, 17 bp, Homo sapiens
actggccaagctgaggt

SEQ ID NO: 3928617 - DNA, 18 bp, Homo sapiens
actggccaagctgaggtg

SEQ ID NO: 3928618 - DNA, 19 bp, Homo sapiens
actggccaagctgaggtgc

SEQ ID NO: 3928619 - DNA, 21 bp, Homo sapiens
actggccaagctgaggtgccc

SEQ ID NO: 3928620 - DNA, 13 bp, Homo sapiens
actggccacccaa

SEQ ID NO: 3928621 - DNA, 15 bp, Homo sapiens
agaaatatatataca

SEQ ID NO: 3928622 - DNA, 17 bp, Homo sapiens
agaaatctccagtgtgc

SEQ ID NO: 3928623 - DNA, 19 bp, Homo sapiens
agaaatctgtaattctatt

SEQ ID NO: 3928624 - DNA, 14 bp, Homo sapiens
agaaatgcaaaaat

SEQ ID NO: 3928625 - DNA, 16 bp, Homo sapiens
agaaattccttcccac

SEQ ID NO: 3928626 - DNA, 23 bp, Homo sapiens
agaaattctgtcatagaaagtgc

SEQ ID NO: 3928627 - DNA, 17 bp, Homo sapiens
agaaattgcatttcctg

SEQ ID NO: 3928628 - DNA, 14 bp, Homo sapiens
agaaattgcctcct

SEQ ID NO: 3928629 - DNA, 18 bp, Homo sapiens
agaacaacaacaacaata

SEQ ID NO: 3928630 - DNA, 21 bp, Homo sapiens
agaacaacaacaacaataaca

SEQ ID NO: 3928631 - DNA, 18 bp, Homo sapiens
agaacaagtcacagctgc

SEQ ID NO: 3928632 - DNA, 16 bp, Homo sapiens
agaacacccactggcc

SEQ ID NO: 3928633 - DNA, 14 bp, Homo sapiens
agaacacgctttca

SEQ ID NO: 3928634 - DNA, 18 bp, Homo sapiens
agaacagacgttaccaat

SEQ ID NO: 3928635 - DNA, 16 bp, Homo sapiens
agaacaggcaagtgaa

SEQ ID NO: 3928636 - DNA, 14 bp, Homo sapiens
agaacagtaaacat

SEQ ID NO: 3928637 - DNA, 14 bp, Homo sapiens
agaacataaagcaa

SEQ ID NO: 3928638 - DNA, 16 bp, Homo sapiens
agaacataaagcaaat

SEQ ID NO: 3928639 - DNA, 18 bp, Homo sapiens
agaacatccaaggagaaa

SEQ ID NO: 3928640 - DNA, 20 bp, Homo sapiens
agaacatgcacatttatata

SEQ ID NO: 3928641 - DNA, 18 bp, Homo sapiens
agaaccaaaagttttcct

SEQ ID NO: 3928642 - DNA, 16 bp, Homo sapiens
agaaccaagaagggct

SEQ ID NO: 3928643 - DNA, 15 bp, Homo sapiens
agaaccaagcttcag

SEQ ID NO: 3928644 - DNA, 16 bp, Homo sapiens
agaaccaagcttcaga

SEQ ID NO: 3928645 - DNA, 17 bp, Homo sapiens
agaaccaagcttcagag

SEQ ID NO: 3928646 - DNA, 20 bp, Homo sapiens
agaaccaagcttcagagcct

SEQ ID NO: 3928647 - DNA, 13 bp, Homo sapiens
agaaccacactgt

SEQ ID NO: 3928648 - DNA, 19 bp, Homo sapiens
agaaccacttggctgctca

SEQ ID NO: 3928649 - DNA, 12 bp, Homo sapiens
agaaccagaggg

SEQ ID NO: 3928650 - DNA, 19 bp, Homo sapiens
agaacccctacatgaaaca

SEQ ID NO: 3928651 - DNA, 16 bp, Homo sapiens
agaacctagaagggct

SEQ ID NO: 3928652 - DNA, 13 bp, Homo sapiens
agaacctggcctt

SEQ ID NO: 3928653 - DNA, 21 bp, Homo sapiens
agaacggagccccaggcctct

SEQ ID NO: 3928654 - DNA, 19 bp, Homo sapiens
agaactccggaatgaccag

SEQ ID NO: 3928655 - DNA, 21 bp, Homo sapiens
agaactccttattttgtatta

SEQ ID NO: 3928656 - DNA, 19 bp, Homo sapiens
agaactgaattaagttatt

SEQ ID NO: 3928657 - DNA, 22 bp, Homo sapiens
agaactgaggtcactgggttct

SEQ ID NO: 3928658 - DNA, 13 bp, Homo sapiens
agaactgccattg

SEQ ID NO: 3928659 - DNA, 21 bp, Homo sapiens
agaactgccccatctcctccc

SEQ ID NO: 3928660 - DNA, 20 bp, Homo sapiens
agaactgctaaatactgtac

SEQ ID NO: 3928661 - DNA, 15 bp, Homo sapiens
agaacttcaaaatgt

SEQ ID NO: 3928662 - DNA, 17 bp, Homo sapiens
agaagaaaaaattaaga

SEQ ID NO: 3928663 - DNA, 22 bp, Homo sapiens
agaagaaattctgtcatagaaa

SEQ ID NO: 3928664 - DNA, 15 bp, Homo sapiens
agaagaagctgagga

SEQ ID NO: 3928665 - DNA, 18 bp, Homo sapiens
agaagaatattcaggact

SEQ ID NO: 3928666 - DNA, 16 bp, Homo sapiens
agaagacatggagact

SEQ ID NO: 3928667 - DNA, 20 bp, Homo sapiens
agaagacatggagactcctg

SEQ ID NO: 3928668 - DNA, 22 bp, Homo sapiens
agaagaccaaagcattgcctgc

SEQ ID NO: 3928669 - DNA, 15 bp, Homo sapiens
agaagagagaaatag

SEQ ID NO: 3928670 - DNA, 22 bp, Homo sapiens
agaagagatgtggcaaagtgct

SEQ ID NO: 3928671 - DNA, 21 bp, Homo sapiens
agaagagctgttcacagccag

SEQ ID NO: 3928672 - DNA, 22 bp, Homo sapiens
agaagagctgttcacagccaga

SEQ ID NO: 3928673 - DNA, 22 bp, Homo sapiens
agaagaggaggagggattctgg

SEQ ID NO: 3928674 - DNA, 17 bp, Homo sapiens
agaagaggctggtgctg

SEQ ID NO: 3928675 - DNA, 16 bp, Homo sapiens
agaagagggcctgtgg

SEQ ID NO: 3928676 - DNA, 16 bp, Homo sapiens
agaagatggactctga

SEQ ID NO: 3928677 - DNA, 13 bp, Homo sapiens
agaagcagtgagc

SEQ ID NO: 3928678 - DNA, 14 bp, Homo sapiens
agaagcagtgagcc

SEQ ID NO: 3928679 - DNA, 23 bp, Homo sapiens
agaagcatcaccatgcatggtgg

SEQ ID NO: 3928680 - DNA, 18 bp, Homo sapiens
agaagccacgctgtcctc

SEQ ID NO: 3928681 - DNA, 14 bp, Homo sapiens
agaagccaggagca

SEQ ID NO: 3928682 - DNA, 13 bp, Homo sapiens
agaagcctggggg

SEQ ID NO: 3928683 - DNA, 18 bp, Homo sapiens
agaagcctgggggcctgg

SEQ ID NO: 3928684 - DNA, 19 bp, Homo sapiens
agaagcctgggggcctggc

SEQ ID NO: 3928685 - DNA, 16 bp, Homo sapiens
agaagcctgttttgtt

SEQ ID NO: 3928686 - DNA, 13 bp, Homo sapiens
agaagctaagctg

SEQ ID NO: 3928687 - DNA, 13 bp, Homo sapiens
agaagctcccaga

SEQ ID NO: 3928688 - DNA, 21 bp, Homo sapiens
agaaggaaggcagggaggagg

SEQ ID NO: 3928689 - DNA, 16 bp, Homo sapiens
agaaggagggcagagc

SEQ ID NO: 3928690 - DNA, 18 bp, Homo sapiens
agaaggagggcagagcca

SEQ ID NO: 3928691 - DNA, 20 bp, Homo sapiens
agaaggagtcagaaactgtt

SEQ ID NO: 3928692 - DNA, 22 bp, Homo sapiens
agaaggcaagtttctagctaga

SEQ ID NO: 3928693 - DNA, 22 bp, Homo sapiens
agaaggcctcttgtgctcacgc

SEQ ID NO: 3928694 - DNA, 13 bp, Homo sapiens
agaaggcgaggag

SEQ ID NO: 3928695 - DNA, 13 bp, Homo sapiens
agaagggaagcct

SEQ ID NO: 3928696 - DNA, 21 bp, Homo sapiens
agaagggagttgctcactcag

SEQ ID NO: 3928697 - DNA, 21 bp, Homo sapiens
agaagggctagaacctggaga

SEQ ID NO: 3928698 - DNA, 18 bp, Homo sapiens
agaaggggaagatactga

SEQ ID NO: 3928699 - DNA, 20 bp, Homo sapiens
agaaggttgctctagattga

SEQ ID NO: 3928700 - DNA, 21 bp, Homo sapiens
agaagtaggcatgagggatca

SEQ ID NO: 3928701 - DNA, 17 bp, Homo sapiens
agaagtcaaagtaaaac

SEQ ID NO: 3928702 - DNA, 15 bp, Homo sapiens
agaagtggaccagga

SEQ ID NO: 3928703 - DNA, 19 bp, Homo sapiens
agaagtggaccaggacagg

SEQ ID NO: 3928704 - DNA, 17 bp, Homo sapiens
agaagtgggccaggaca

SEQ ID NO: 3928705 - DNA, 16 bp, Homo sapiens
actgagaaatgaatgc

SEQ ID NO: 3928706 - DNA, 18 bp, Homo sapiens
actgagccaaacacactg

SEQ ID NO: 3928707 - DNA, 20 bp, Homo sapiens
actgagccaaacacactgta

SEQ ID NO: 3928708 - DNA, 22 bp, Homo sapiens
actgagccaaacacactgtaaa

SEQ ID NO: 3928709 - DNA, 24 bp, Homo sapiens
actgagccaaacacactgtaaata

SEQ ID NO: 3928710 - DNA, 16 bp, Homo sapiens
actgaggaattttctt

SEQ ID NO: 3928711 - DNA, 20 bp, Homo sapiens
actgaggaattttctttgtg

SEQ ID NO: 3928712 - DNA, 18 bp, Homo sapiens
actgaggagtagctgaga

SEQ ID NO: 3928713 - DNA, 21 bp, Homo sapiens
actgaggagtagctgagagga

SEQ ID NO: 3928714 - DNA, 15 bp, Homo sapiens
actgaggccattatt

SEQ ID NO: 3928715 - DNA, 17 bp, Homo sapiens
actgaggtcactgggtt

SEQ ID NO: 3928716 - DNA, 13 bp, Homo sapiens
actgagtggcttg

SEQ ID NO: 3928717 - DNA, 21 bp, Homo sapiens
actgatcaaaaataaactagt

SEQ ID NO: 3928718 - DNA, 19 bp, Homo sapiens
actgatgcgaaaacttgaa

SEQ ID NO: 3928719 - DNA, 20 bp, Homo sapiens
actgatggaccgggtgggcc

SEQ ID NO: 3928720 - DNA, 23 bp, Homo sapiens
actgatggaccgggtgggcctgg

SEQ ID NO: 3928721 - DNA, 16 bp, Homo sapiens
actgatgggacatcaa

SEQ ID NO: 3928722 - DNA, 17 bp, Homo sapiens
actgatgggacatcaaa

SEQ ID NO: 3928723 - DNA, 20 bp, Homo sapiens
actgattgggtgccatgtgg

SEQ ID NO: 3928724 - DNA, 20 bp, Homo sapiens
actgattgttttagagacta

SEQ ID NO: 3928725 - DNA, 21 bp, Homo sapiens
actgattgttttagagactat

SEQ ID NO: 3928726 - DNA, 16 bp, Homo sapiens
actgatttggagatat

SEQ ID NO: 3928727 - DNA, 17 bp, Homo sapiens
actgcaacctcttcctc

SEQ ID NO: 3928728 - DNA, 19 bp, Homo sapiens
actgcaacttctacctccg

SEQ ID NO: 3928729 - DNA, 15 bp, Homo sapiens
actgcaagagccttg

SEQ ID NO: 3928730 - DNA, 17 bp, Homo sapiens
actgcaagaggctcctg

SEQ ID NO: 3928731 - DNA, 13 bp, Homo sapiens
actgcaatactaa

SEQ ID NO: 3928732 - DNA, 15 bp, Homo sapiens
actgcacacacagct

SEQ ID NO: 3928733 - DNA, 22 bp, Homo sapiens
actgcacagcggcccctgcatc

SEQ ID NO: 3928734 - DNA, 22 bp, Homo sapiens
actgcacagtgcatctcagccc

SEQ ID NO: 3928735 - DNA, 15 bp, Homo sapiens
actgcactccagcct

SEQ ID NO: 3928736 - DNA, 12 bp, Homo sapiens
actgcagctgct

SEQ ID NO: 3928737 - DNA, 14 bp, Homo sapiens
actgcagctgctga

SEQ ID NO: 3928738 - DNA, 15 bp, Homo sapiens
actgcagctttacat

SEQ ID NO: 3928739 - DNA, 21 bp, Homo sapiens
actgcaggccccgcttgtcca

SEQ ID NO: 3928740 - DNA, 23 bp, Homo sapiens
actgcaggccccgcttgtccagc

SEQ ID NO: 3928741 - DNA, 15 bp, Homo sapiens
actgcatactgatcc

SEQ ID NO: 3928742 - DNA, 18 bp, Homo sapiens
actgcatatcggaggtgg

SEQ ID NO: 3928743 - DNA, 16 bp, Homo sapiens
actgcattagaaatta

SEQ ID NO: 3928744 - DNA, 12 bp, Homo sapiens
actgccaggagg

SEQ ID NO: 3928745 - DNA, 13 bp, Homo sapiens
actgccaggaggg

SEQ ID NO: 3928746 - DNA, 21 bp, Homo sapiens
actgccaggagggacaaagga

SEQ ID NO: 3928747 - DNA, 14 bp, Homo sapiens
actgccaggcacct

SEQ ID NO: 3928748 - DNA, 21 bp, Homo sapiens
actgccaggcacctggcctgc

SEQ ID NO: 3928749 - DNA, 17 bp, Homo sapiens
actgccccaactcctgg

SEQ ID NO: 3928750 - DNA, 18 bp, Homo sapiens
actgccccaactcctgga

SEQ ID NO: 3928751 - DNA, 14 bp, Homo sapiens
actgccccatctcc

SEQ ID NO: 3928752 - DNA, 15 bp, Homo sapiens
actgccccatctcct

SEQ ID NO: 3928753 - DNA, 23 bp, Homo sapiens
actgccctgcctgcccacttagc

SEQ ID NO: 3928754 - DNA, 22 bp, Homo sapiens
actgccgcaagtctgcagcccg

SEQ ID NO: 3928755 - DNA, 14 bp, Homo sapiens
actgcctcttcctc

SEQ ID NO: 3928756 - DNA, 15 bp, Homo sapiens
actgcctcttcctcc

SEQ ID NO: 3928757 - DNA, 9 bp, Homo sapiens
actgcctgc

SEQ ID NO: 3928758 - DNA, 20 bp, Homo sapiens
actgctaggcgagtgccagg

SEQ ID NO: 3928759 - DNA, 21 bp, Homo sapiens
actgctaggcgagtgccagga

SEQ ID NO: 3928760 - DNA, 22 bp, Homo sapiens
actgctaggcgagtgccaggac

SEQ ID NO: 3928761 - DNA, 19 bp, Homo sapiens
actgctcatcattccttga

SEQ ID NO: 3928762 - DNA, 19 bp, Homo sapiens
actgctctgaatattttgt

SEQ ID NO: 3928763 - DNA, 13 bp, Homo sapiens
actgctgagccac

SEQ ID NO: 3928764 - DNA, 16 bp, Homo sapiens
actgctgagccactcg

SEQ ID NO: 3928765 - DNA, 18 bp, Homo sapiens
actgctgatcaatgaaat

SEQ ID NO: 3928766 - DNA, 19 bp, Homo sapiens
actgctgcaaagtgcaaat

SEQ ID NO: 3928767 - DNA, 15 bp, Homo sapiens
actgctgcaccagag

SEQ ID NO: 3928768 - DNA, 21 bp, Homo sapiens
actggaatcgatctgtactgt

SEQ ID NO: 3928769 - DNA, 19 bp, Homo sapiens
actggaccccgcctcccag

SEQ ID NO: 3928770 - DNA, 20 bp, Homo sapiens
actggaccccgcctcccagc

SEQ ID NO: 3928771 - DNA, 17 bp, Homo sapiens
actggacgcccagctga

SEQ ID NO: 3928772 - DNA, 15 bp, Homo sapiens
actggactgggtttt

SEQ ID NO: 3928773 - DNA, 23 bp, Homo sapiens
actggagaccgcttcacccctgc

SEQ ID NO: 3928774 - DNA, 18 bp, Homo sapiens
actggagcatctgactca

SEQ ID NO: 3928775 - DNA, 23 bp, Homo sapiens
actggaggtcacattcaggaaga

SEQ ID NO: 3928776 - DNA, 21 bp, Homo sapiens
actggagtgaggcttccaggc

SEQ ID NO: 3928777 - DNA, 14 bp, Homo sapiens
actggagttacatt

SEQ ID NO: 3928778 - DNA, 14 bp, Homo sapiens
actggatgaagatt

SEQ ID NO: 3928779 - DNA, 21 bp, Homo sapiens
actggcacagttttctgagaa

SEQ ID NO: 3928780 - DNA, 13 bp, Homo sapiens
actggcaggtgca

SEQ ID NO: 3928781 - DNA, 21 bp, Homo sapiens
actggcaggtgcagatgggct

SEQ ID NO: 3928782 - DNA, 17 bp, Homo sapiens
acttcactttaattctc

SEQ ID NO: 3928783 - DNA, 14 bp, Homo sapiens
acttcaggctcttc

SEQ ID NO: 3928784 - DNA, 17 bp, Homo sapiens
acttcaggctcttctcc

SEQ ID NO: 3928785 - DNA, 18 bp, Homo sapiens
acttcaggctcttctcct

SEQ ID NO: 3928786 - DNA, 20 bp, Homo sapiens
acttcaggttgttctgtata

SEQ ID NO: 3928787 - DNA, 17 bp, Homo sapiens
actttgatgcatttcca

SEQ ID NO: 3928788 - DNA, 15 bp, Homo sapiens
actttgctctttctt

SEQ ID NO: 3928789 - DNA, 17 bp, Homo sapiens
actttggcttctcctgt

SEQ ID NO: 3928790 - DNA, 18 bp, Homo sapiens
actttggcttctcctgtg

SEQ ID NO: 3928791 - DNA, 20 bp, Homo sapiens
actttggcttctcctgtgac

SEQ ID NO: 3928792 - DNA, 20 bp, Homo sapiens
actttgggaggccaaggtgg

SEQ ID NO: 3928793 - DNA, 17 bp, Homo sapiens
actttgttaaaaatatt

SEQ ID NO: 3928794 - DNA, 17 bp, Homo sapiens
acttttcctccctcagt

SEQ ID NO: 3928795 - DNA, 11 bp, Homo sapiens
acttttctgta

SEQ ID NO: 3928796 - DNA, 20 bp, Homo sapiens
acttttgggggttggatggg

SEQ ID NO: 3928797 - DNA, 17 bp, Homo sapiens
acttttgtaagacaaag

SEQ ID NO: 3928798 - DNA, 13 bp, Homo sapiens
acttttgtttcag

SEQ ID NO: 3928799 - DNA, 12 bp, Homo sapiens
actttttataat

SEQ ID NO: 3928800 - DNA, 14 bp, Homo sapiens
actttttataatgt

SEQ ID NO: 3928801 - DNA, 14 bp, Homo sapiens
actttttatactcc

SEQ ID NO: 3928802 - DNA, 16 bp, Homo sapiens
agaaaaaaaaaaagaa

SEQ ID NO: 3928803 - DNA, 14 bp, Homo sapiens
agaaaaaccaatga

SEQ ID NO: 3928804 - DNA, 23 bp, Homo sapiens
agaaaaaccaatgattcataaca

SEQ ID NO: 3928805 - DNA, 13 bp, Homo sapiens
agaaaaagaaaaa

SEQ ID NO: 3928806 - DNA, 15 bp, Homo sapiens
agaaaaagaaatgca

SEQ ID NO: 3928807 - DNA, 21 bp, Homo sapiens
agaaaaagttgcagtctcaga

SEQ ID NO: 3928808 - DNA, 21 bp, Homo sapiens
agaaaactcctttagcaggtg

SEQ ID NO: 3928809 - DNA, 16 bp, Homo sapiens
agaaaagataaagatg

SEQ ID NO: 3928810 - DNA, 16 bp, Homo sapiens
agaaaagcacctgccg

SEQ ID NO: 3928811 - DNA, 21 bp, Homo sapiens
agaaaagcagacgcagcagct

SEQ ID NO: 3928812 - DNA, 15 bp, Homo sapiens
agaaaagtagaatta

SEQ ID NO: 3928813 - DNA, 22 bp, Homo sapiens
agaaaagtagaattatatctaa

SEQ ID NO: 3928814 - DNA, 17 bp, Homo sapiens
agaaaagtgcttagaaa

SEQ ID NO: 3928815 - DNA, 21 bp, Homo sapiens
agaaaagtgcttagaaagtta

SEQ ID NO: 3928816 - DNA, 13 bp, Homo sapiens
agaaaatataaat

SEQ ID NO: 3928817 - DNA, 16 bp, Homo sapiens
agaaaatataaatgca

SEQ ID NO: 3928818 - DNA, 17 bp, Homo sapiens
agaaaatataaatgcat

SEQ ID NO: 3928819 - DNA, 11 bp, Homo sapiens
agaaaatgaag

SEQ ID NO: 3928820 - DNA, 14 bp, Homo sapiens
agaaacacaatatt

SEQ ID NO: 3928821 - DNA, 22 bp, Homo sapiens
agaaacacagggttttgtattc

SEQ ID NO: 3928822 - DNA, 15 bp, Homo sapiens
agaaacacagttttg

SEQ ID NO: 3928823 - DNA, 14 bp, Homo sapiens
agaaacactcaaca

SEQ ID NO: 3928824 - DNA, 14 bp, Homo sapiens
agaaacagagacag

SEQ ID NO: 3928825 - DNA, 15 bp, Homo sapiens
agaaacagataccat

SEQ ID NO: 3928826 - DNA, 20 bp, Homo sapiens
agaaacaggggatcaaagtt

SEQ ID NO: 3928827 - DNA, 21 bp, Homo sapiens
agaaacaggggatcaaagttc

SEQ ID NO: 3928828 - DNA, 22 bp, Homo sapiens
agaaacaggggatcaaagttcc

SEQ ID NO: 3928829 - DNA, 17 bp, Homo sapiens
agaaacatgacactgac

SEQ ID NO: 3928830 - DNA, 18 bp, Homo sapiens
agaaacatgacactgacc

SEQ ID NO: 3928831 - DNA, 19 bp, Homo sapiens
agaaaccagtatggaaggg

SEQ ID NO: 3928832 - DNA, 15 bp, Homo sapiens
agaaaccccaagcag

SEQ ID NO: 3928833 - DNA, 13 bp, Homo sapiens
agaaaccctgtct

SEQ ID NO: 3928834 - DNA, 20 bp, Homo sapiens
agaaacgaagccatctttct

SEQ ID NO: 3928835 - DNA, 17 bp, Homo sapiens
agaaactcacgatgaaa

SEQ ID NO: 3928836 - DNA, 22 bp, Homo sapiens
agaaacttcctttgagaattgt

SEQ ID NO: 3928837 - DNA, 19 bp, Homo sapiens
agaaactttgatctctgct

SEQ ID NO: 3928838 - DNA, 22 bp, Homo sapiens
agaaactttgatctctgcttac

SEQ ID NO: 3928839 - DNA, 11 bp, Homo sapiens
agaaagaaata

SEQ ID NO: 3928840 - DNA, 12 bp, Homo sapiens
agaaagaagaga

SEQ ID NO: 3928841 - DNA, 13 bp, Homo sapiens
agaaagaagagac

SEQ ID NO: 3928842 - DNA, 18 bp, Homo sapiens
agaaagactattcaaaca

SEQ ID NO: 3928843 - DNA, 19 bp, Homo sapiens
agaaagactattcaaacag

SEQ ID NO: 3928844 - DNA, 23 bp, Homo sapiens
agaaagactattcaaacagtctc

SEQ ID NO: 3928845 - DNA, 21 bp, Homo sapiens
agaaagaggtgaccccagggc

SEQ ID NO: 3928846 - DNA, 13 bp, Homo sapiens
agaaagatccacc

SEQ ID NO: 3928847 - DNA, 14 bp, Homo sapiens
agaaagatccaccc

SEQ ID NO: 3928848 - DNA, 19 bp, Homo sapiens
agaaagatggatgtgcttt

SEQ ID NO: 3928849 - DNA, 14 bp, Homo sapiens
agaaagcaacttat

SEQ ID NO: 3928850 - DNA, 17 bp, Homo sapiens
agaaagcacctgttttt

SEQ ID NO: 3928851 - DNA, 18 bp, Homo sapiens
agaaagcacctgttttta

SEQ ID NO: 3928852 - DNA, 18 bp, Homo sapiens
agaaagccgtactgtcta

SEQ ID NO: 3928853 - DNA, 21 bp, Homo sapiens
agaaagctctgcatgtgtgtt

SEQ ID NO: 3928854 - DNA, 19 bp, Homo sapiens
agaaagctggtaaactatt

SEQ ID NO: 3928855 - DNA, 23 bp, Homo sapiens
agaaaggattaagatacactcct

SEQ ID NO: 3928856 - DNA, 13 bp, Homo sapiens
agaaagggagggc

SEQ ID NO: 3928857 - DNA, 17 bp, Homo sapiens
agaaagggagggctctg

SEQ ID NO: 3928858 - DNA, 18 bp, Homo sapiens
agaaagggagggctctga

SEQ ID NO: 3928859 - DNA, 21 bp, Homo sapiens
agaaagggagggctctgaggc

SEQ ID NO: 3928860 - DNA, 17 bp, Homo sapiens
agaaagggcaaattatt

SEQ ID NO: 3928861 - DNA, 20 bp, Homo sapiens
agaaaggggcagtttaaagc

SEQ ID NO: 3928862 - DNA, 20 bp, Homo sapiens
agaaagtcgaattaatagct

SEQ ID NO: 3928863 - DNA, 12 bp, Homo sapiens
agaaataaaaat

SEQ ID NO: 3928864 - DNA, 22 bp, Homo sapiens
agaaataaaaatcaacttgtgt

SEQ ID NO: 3928865 - DNA, 21 bp, Homo sapiens
agaaataaacttattcctcct

SEQ ID NO: 3928866 - DNA, 14 bp, Homo sapiens
agaaataaattttg

SEQ ID NO: 3928867 - DNA, 22 bp, Homo sapiens
agaaataaattttgtttcagaa

SEQ ID NO: 3928868 - DNA, 13 bp, Homo sapiens
agaaataattgtt

SEQ ID NO: 3928869 - DNA, 14 bp, Homo sapiens
agaaatactgctct

SEQ ID NO: 3928870 - DNA, 20 bp, Homo sapiens
agactgatgggacatcaaat

SEQ ID NO: 3928871 - DNA, 20 bp, Homo sapiens
agactggacggggaaaccta

SEQ ID NO: 3928872 - DNA, 15 bp, Homo sapiens
agactggagcatctg

SEQ ID NO: 3928873 - DNA, 16 bp, Homo sapiens
agactggagcatctga

SEQ ID NO: 3928874 - DNA, 14 bp, Homo sapiens
agactggagtgagg

SEQ ID NO: 3928875 - DNA, 21 bp, Homo sapiens
agactggagtgaggcttccag

SEQ ID NO: 3928876 - DNA, 15 bp, Homo sapiens
agactggtcctgtgt

SEQ ID NO: 3928877 - DNA, 22 bp, Homo sapiens
agactggtttatccacccacaa

SEQ ID NO: 3928878 - DNA, 17 bp, Homo sapiens
agactgtaattaagtaa

SEQ ID NO: 3928879 - DNA, 14 bp, Homo sapiens
agactgttgctcaa

SEQ ID NO: 3928880 - DNA, 23 bp, Homo sapiens
agactgttgctcaaatctattca

SEQ ID NO: 3928881 - DNA, 14 bp, Homo sapiens
agacttaagattaa

SEQ ID NO: 3928882 - DNA, 15 bp, Homo sapiens
agacttaagattaaa

SEQ ID NO: 3928883 - DNA, 16 bp, Homo sapiens
agacttacttattctt

SEQ ID NO: 3928884 - DNA, 12 bp, Homo sapiens
agacttactttc

SEQ ID NO: 3928885 - DNA, 15 bp, Homo sapiens
agacttcacactgca

SEQ ID NO: 3928886 - DNA, 14 bp, Homo sapiens
agacttcaggttgt

SEQ ID NO: 3928887 - DNA, 19 bp, Homo sapiens
agacttcaggttgttctgt

SEQ ID NO: 3928888 - DNA, 13 bp, Homo sapiens
agacttctggaag

SEQ ID NO: 3928889 - DNA, 18 bp, Homo sapiens
agacttctggaaggctgg

SEQ ID NO: 3928890 - DNA, 18 bp, Homo sapiens
agacttgacaacatccca

SEQ ID NO: 3928891 - DNA, 23 bp, Homo sapiens
agacttgacaacatcccacagtg

SEQ ID NO: 3928892 - DNA, 13 bp, Homo sapiens
agacttgctctct

SEQ ID NO: 3928893 - DNA, 19 bp, Homo sapiens
agacttggcaacagaagca

SEQ ID NO: 3928894 - DNA, 18 bp, Homo sapiens
agacttggggaccagagg

SEQ ID NO: 3928895 - DNA, 18 bp, Homo sapiens
agactttaaaagatgaaa

SEQ ID NO: 3928896 - DNA, 16 bp, Homo sapiens
agagaaaaaactagag

SEQ ID NO: 3928897 - DNA, 16 bp, Homo sapiens
agagaaaaaccaatga

SEQ ID NO: 3928898 - DNA, 18 bp, Homo sapiens
agagaaaacttatttgag

SEQ ID NO: 3928899 - DNA, 20 bp, Homo sapiens
agagaaaacttatttgagtg

SEQ ID NO: 3928900 - DNA, 17 bp, Homo sapiens
agagaaaataaaccaag

SEQ ID NO: 3928901 - DNA, 14 bp, Homo sapiens
agagaaatcacagg

SEQ ID NO: 3928902 - DNA, 20 bp, Homo sapiens
agagaaatgtgaagggtggg

SEQ ID NO: 3928903 - DNA, 21 bp, Homo sapiens
agagaaatttttatttttgaa

SEQ ID NO: 3928904 - DNA, 17 bp, Homo sapiens
agagaagaaagaacgga

SEQ ID NO: 3928905 - DNA, 13 bp, Homo sapiens
agagaagaaagtg

SEQ ID NO: 3928906 - DNA, 20 bp, Homo sapiens
agagaagataatgttcttta

SEQ ID NO: 3928907 - DNA, 20 bp, Homo sapiens
agagaagatgtgatttattt

SEQ ID NO: 3928908 - DNA, 16 bp, Homo sapiens
agagaagctgagaaga

SEQ ID NO: 3928909 - DNA, 12 bp, Homo sapiens
agagaaggagcc

SEQ ID NO: 3928910 - DNA, 13 bp, Homo sapiens
agagaataaagac

SEQ ID NO: 3928911 - DNA, 17 bp, Homo sapiens
agagaatatatttttga

SEQ ID NO: 3928912 - DNA, 17 bp, Homo sapiens
agagaatatttcaaatg

SEQ ID NO: 3928913 - DNA, 21 bp, Homo sapiens
agagaatatttcaaatgaaca

SEQ ID NO: 3928914 - DNA, 23 bp, Homo sapiens
agagaatatttcaaatgaacacg

SEQ ID NO: 3928915 - DNA, 23 bp, Homo sapiens
agagaatttctaccatttcagag

SEQ ID NO: 3928916 - DNA, 21 bp, Homo sapiens
agagacaaacacctcccagga

SEQ ID NO: 3928917 - DNA, 13 bp, Homo sapiens
agagacacagaga

SEQ ID NO: 3928918 - DNA, 15 bp, Homo sapiens
agagacacagagatg

SEQ ID NO: 3928919 - DNA, 15 bp, Homo sapiens
agagacacctgcacc

SEQ ID NO: 3928920 - DNA, 16 bp, Homo sapiens
agagacactcccaggg

SEQ ID NO: 3928921 - DNA, 18 bp, Homo sapiens
agagacagaaacagagag

SEQ ID NO: 3928922 - DNA, 21 bp, Homo sapiens
agagacagaaacagagagaga

SEQ ID NO: 3928923 - DNA, 13 bp, Homo sapiens
agagacagaatga

SEQ ID NO: 3928924 - DNA, 21 bp, Homo sapiens
agagacagaccccttggcttt

SEQ ID NO: 3928925 - DNA, 13 bp, Homo sapiens
agagacagagccc

SEQ ID NO: 3928926 - DNA, 16 bp, Homo sapiens
agagacccaaggagga

SEQ ID NO: 3928927 - DNA, 15 bp, Homo sapiens
agagaccccaggatc

SEQ ID NO: 3928928 - DNA, 19 bp, Homo sapiens
agagaccccttcctttcct

SEQ ID NO: 3928929 - DNA, 17 bp, Homo sapiens
agagacccttgtttgat

SEQ ID NO: 3928930 - DNA, 13 bp, Homo sapiens
agagaccttttct

SEQ ID NO: 3928931 - DNA, 15 bp, Homo sapiens
agagacgcagccctg

SEQ ID NO: 3928932 - DNA, 18 bp, Homo sapiens
agagactcaaagagactc

SEQ ID NO: 3928933 - DNA, 16 bp, Homo sapiens
agagactctggaagcc

SEQ ID NO: 3928934 - DNA, 23 bp, Homo sapiens
agagactgaaagcagcagctagg

SEQ ID NO: 3928935 - DNA, 24 bp, Homo sapiens
agagactgaaagcagcagctagga

SEQ ID NO: 3928936 - DNA, 14 bp, Homo sapiens
agagactgagggag

SEQ ID NO: 3928937 - DNA, 19 bp, Homo sapiens
agagagaaaacttatttga

SEQ ID NO: 3928938 - DNA, 21 bp, Homo sapiens
agagagaaaacttatttgagt

SEQ ID NO: 3928939 - DNA, 20 bp, Homo sapiens
agagagacagagacagagag

SEQ ID NO: 3928940 - DNA, 17 bp, Homo sapiens
agagagactcaaagaga

SEQ ID NO: 3928941 - DNA, 19 bp, Homo sapiens
agagagaggttctggggag

SEQ ID NO: 3928942 - DNA, 21 bp, Homo sapiens
agagagaggttctggggagga

SEQ ID NO: 3928943 - DNA, 15 bp, Homo sapiens
agagagcagaaataa

SEQ ID NO: 3928944 - DNA, 13 bp, Homo sapiens
agagaggagcacc

SEQ ID NO: 3928945 - DNA, 17 bp, Homo sapiens
agagaggatgcagaggg

SEQ ID NO: 3928946 - DNA, 12 bp, Homo sapiens
agagaggcacct

SEQ ID NO: 3928947 - DNA, 11 bp, Homo sapiens
agagaggcatg

SEQ ID NO: 3928948 - DNA, 20 bp, Homo sapiens
agagaggcatgtgatgtgca

SEQ ID NO: 3928949 - DNA, 23 bp, Homo sapiens
agagaggcgcgtctgccccaccc

SEQ ID NO: 3928950 - DNA, 13 bp, Homo sapiens
agagaggctggca

SEQ ID NO: 3928951 - DNA, 15 bp, Homo sapiens
agagagggcagaggg

SEQ ID NO: 3928952 - DNA, 14 bp, Homo sapiens
agagagggcccagc

SEQ ID NO: 3928953 - DNA, 15 bp, Homo sapiens
agagagggggctctc

SEQ ID NO: 3928954 - DNA, 13 bp, Homo sapiens
agagaggttctgg

SEQ ID NO: 3928955 - DNA, 16 bp, Homo sapiens
agagagtcttccaggt

SEQ ID NO: 3928956 - DNA, 16 bp, Homo sapiens
agacaggcccaagaga

SEQ ID NO: 3928957 - DNA, 22 bp, Homo sapiens
agacaggcccaagagatgaaga

SEQ ID NO: 3928958 - DNA, 23 bp, Homo sapiens
agacaggcccaagagatgaagag

SEQ ID NO: 3928959 - DNA, 21 bp, Homo sapiens
agacagtagccaagttatatt

SEQ ID NO: 3928960 - DNA, 14 bp, Homo sapiens
agacagttcaagaa

SEQ ID NO: 3928961 - DNA, 16 bp, Homo sapiens
agacatacgaaacaca

SEQ ID NO: 3928962 - DNA, 21 bp, Homo sapiens
agacatccatgtttgtaaaac

SEQ ID NO: 3928963 - DNA, 18 bp, Homo sapiens
agacatggagactcctgc

SEQ ID NO: 3928964 - DNA, 14 bp, Homo sapiens
agacatggatttga

SEQ ID NO: 3928965 - DNA, 22 bp, Homo sapiens
agacatttgtaaatgtaaaact

SEQ ID NO: 3928966 - DNA, 13 bp, Homo sapiens
agacatttttatt

SEQ ID NO: 3928967 - DNA, 21 bp, Homo sapiens
agaccacagcaattggctcct

SEQ ID NO: 3928968 - DNA, 16 bp, Homo sapiens
agaccacctgccagcc

SEQ ID NO: 3928969 - DNA, 18 bp, Homo sapiens
agaccacctgccagccat

SEQ ID NO: 3928970 - DNA, 19 bp, Homo sapiens
agaccacctgccagccatc

SEQ ID NO: 3928971 - DNA, 20 bp, Homo sapiens
agaccacctgccagccatca

SEQ ID NO: 3928972 - DNA, 21 bp, Homo sapiens
agaccacctgccagccatcac

SEQ ID NO: 3928973 - DNA, 22 bp, Homo sapiens
agaccacctgccagccatcaca

SEQ ID NO: 3928974 - DNA, 23 bp, Homo sapiens
agaccacctgccagccatcacaa

SEQ ID NO: 3928975 - DNA, 18 bp, Homo sapiens
agaccagactgtggagaa

SEQ ID NO: 3928976 - DNA, 22 bp, Homo sapiens
agaccagttgggagcactggag

SEQ ID NO: 3928977 - DNA, 17 bp, Homo sapiens
agaccatccaccaggcc

SEQ ID NO: 3928978 - DNA, 20 bp, Homo sapiens
agaccatcctggcccctcca

SEQ ID NO: 3928979 - DNA, 16 bp, Homo sapiens
agaccattgtcttcca

SEQ ID NO: 3928980 - DNA, 17 bp, Homo sapiens
agaccattgtcttccaa

SEQ ID NO: 3928981 - DNA, 18 bp, Homo sapiens
agaccattgtcttccaac

SEQ ID NO: 3928982 - DNA, 23 bp, Homo sapiens
agaccattgtcttccaaccccag

SEQ ID NO: 3928983 - DNA, 16 bp, Homo sapiens
agaccatttaacatgc

SEQ ID NO: 3928984 - DNA, 14 bp, Homo sapiens
agacccaaggagga

SEQ ID NO: 3928985 - DNA, 18 bp, Homo sapiens
agacccctctcaacaccc

SEQ ID NO: 3928986 - DNA, 13 bp, Homo sapiens
agacccctgtggc

SEQ ID NO: 3928987 - DNA, 15 bp, Homo sapiens
agaccccttcctttc

SEQ ID NO: 3928988 - DNA, 19 bp, Homo sapiens
agaccccttcctttcctct

SEQ ID NO: 3928989 - DNA, 19 bp, Homo sapiens
agaccctaagcctcctttt

SEQ ID NO: 3928990 - DNA, 18 bp, Homo sapiens
agaccctgcctgagccca

SEQ ID NO: 3928991 - DNA, 17 bp, Homo sapiens
agacccttgcattagaa

SEQ ID NO: 3928992 - DNA, 18 bp, Homo sapiens
agaccgcttcacccctgc

SEQ ID NO: 3928993 - DNA, 19 bp, Homo sapiens
agaccgcttcacccctgca

SEQ ID NO: 3928994 - DNA, 20 bp, Homo sapiens
agaccgcttcacccctgcac

SEQ ID NO: 3928995 - DNA, 21 bp, Homo sapiens
agaccgcttcacccctgcact

SEQ ID NO: 3928996 - DNA, 19 bp, Homo sapiens
agaccgggggccagacaca

SEQ ID NO: 3928997 - DNA, 15 bp, Homo sapiens
agacctagacctggg

SEQ ID NO: 3928998 - DNA, 17 bp, Homo sapiens
agacctagacctgggcc

SEQ ID NO: 3928999 - DNA, 16 bp, Homo sapiens
agacctatttgacata

SEQ ID NO: 3929000 - DNA, 19 bp, Homo sapiens
agacctctactgccttgga

SEQ ID NO: 3929001 - DNA, 22 bp, Homo sapiens
agacctctcaacagatctgtgg

SEQ ID NO: 3929002 - DNA, 12 bp, Homo sapiens
agacctctgatc

SEQ ID NO: 3929003 - DNA, 13 bp, Homo sapiens
agacctctgatcc

SEQ ID NO: 3929004 - DNA, 21 bp, Homo sapiens
agacctgggccaaaagggcag

SEQ ID NO: 3929005 - DNA, 19 bp, Homo sapiens
agaccttttctctcccata

SEQ ID NO: 3929006 - DNA, 13 bp, Homo sapiens
agacgcagccctg

SEQ ID NO: 3929007 - DNA, 20 bp, Homo sapiens
agacgctcaagaatcctctg

SEQ ID NO: 3929008 - DNA, 22 bp, Homo sapiens
agacggcagagaccccaggatc

SEQ ID NO: 3929009 - DNA, 15 bp, Homo sapiens
agacggctggacctg

SEQ ID NO: 3929010 - DNA, 17 bp, Homo sapiens
agacggctggacctgca

SEQ ID NO: 3929011 - DNA, 15 bp, Homo sapiens
agacggtgttgcaga

SEQ ID NO: 3929012 - DNA, 19 bp, Homo sapiens
agacgtgaatgtctcagcg

SEQ ID NO: 3929013 - DNA, 19 bp, Homo sapiens
agacgtgatgccaggacca

SEQ ID NO: 3929014 - DNA, 22 bp, Homo sapiens
agacgtttttgtgctgtgggca

SEQ ID NO: 3929015 - DNA, 23 bp, Homo sapiens
agactaagccctgtcgagacact

SEQ ID NO: 3929016 - DNA, 16 bp, Homo sapiens
agactaatagagacac

SEQ ID NO: 3929017 - DNA, 19 bp, Homo sapiens
agactaatagagacacaga

SEQ ID NO: 3929018 - DNA, 18 bp, Homo sapiens
agactaattaaaatctgg

SEQ ID NO: 3929019 - DNA, 22 bp, Homo sapiens
agactaattaaaatctggaaat

SEQ ID NO: 3929020 - DNA, 18 bp, Homo sapiens
agactataaagcagtaga

SEQ ID NO: 3929021 - DNA, 12 bp, Homo sapiens
agactatataca

SEQ ID NO: 3929022 - DNA, 19 bp, Homo sapiens
agactatatacatgtgtgt

SEQ ID NO: 3929023 - DNA, 15 bp, Homo sapiens
agactatggagcctg

SEQ ID NO: 3929024 - DNA, 20 bp, Homo sapiens
agactatggagcctggcaca

SEQ ID NO: 3929025 - DNA, 21 bp, Homo sapiens
agactatggagcctggcacag

SEQ ID NO: 3929026 - DNA, 16 bp, Homo sapiens
agactattcaaacagt

SEQ ID NO: 3929027 - DNA, 20 bp, Homo sapiens
agactattcaaacagtctca

SEQ ID NO: 3929028 - DNA, 12 bp, Homo sapiens
agactcacctct

SEQ ID NO: 3929029 - DNA, 17 bp, Homo sapiens
agactcacctctgcctc

SEQ ID NO: 3929030 - DNA, 15 bp, Homo sapiens
agactcagactccat

SEQ ID NO: 3929031 - DNA, 12 bp, Homo sapiens
agactcagtgtt

SEQ ID NO: 3929032 - DNA, 22 bp, Homo sapiens
agactccaaagaaatgtaaggg

SEQ ID NO: 3929033 - DNA, 14 bp, Homo sapiens
agactccagaatct

SEQ ID NO: 3929034 - DNA, 19 bp, Homo sapiens
agactccagaatctgctgt

SEQ ID NO: 3929035 - DNA, 14 bp, Homo sapiens
agactcctgtccct

SEQ ID NO: 3929036 - DNA, 15 bp, Homo sapiens
agactctggaagccc

SEQ ID NO: 3929037 - DNA, 18 bp, Homo sapiens
agactgaaagcagcagct

SEQ ID NO: 3929038 - DNA, 16 bp, Homo sapiens
agactgagcacctgct

SEQ ID NO: 3929039 - DNA, 17 bp, Homo sapiens
agactgagcacctgctt

SEQ ID NO: 3929040 - DNA, 16 bp, Homo sapiens
agactgagggagagac

SEQ ID NO: 3929041 - DNA, 16 bp, Homo sapiens
agatgtaggagggact

SEQ ID NO: 3929042 - DNA, 14 bp, Homo sapiens
agatgtatcattaa

SEQ ID NO: 3929043 - DNA, 18 bp, Homo sapiens
agatgtcagccgagccgg

SEQ ID NO: 3929044 - DNA, 17 bp, Homo sapiens
agatgtgataaggatca

SEQ ID NO: 3929045 - DNA, 19 bp, Homo sapiens
agatgtgcaagtcttgtca

SEQ ID NO: 3929046 - DNA, 17 bp, Homo sapiens
agatgtgtgtgtgtgta

SEQ ID NO: 3929047 - DNA, 19 bp, Homo sapiens
agatgtgttgctatcctga

SEQ ID NO: 3929048 - DNA, 15 bp, Homo sapiens
agatgttgtcattat

SEQ ID NO: 3929049 - DNA, 19 bp, Homo sapiens
agatgtttgtcagatatga

SEQ ID NO: 3929050 - DNA, 24 bp, Homo sapiens
agatgtttgtcagatatgatatgt

SEQ ID NO: 3929051 - DNA, 15 bp, Homo sapiens
agattaaaggaagga

SEQ ID NO: 3929052 - DNA, 18 bp, Homo sapiens
agattaaggtgatgtgat

SEQ ID NO: 3929053 - DNA, 17 bp, Homo sapiens
agattaatggcactgat

SEQ ID NO: 3929054 - DNA, 21 bp, Homo sapiens
agattagaatgaaaattgtat

SEQ ID NO: 3929055 - DNA, 13 bp, Homo sapiens
agattcccagaga

SEQ ID NO: 3929056 - DNA, 13 bp, Homo sapiens
agattcccagagc

SEQ ID NO: 3929057 - DNA, 16 bp, Homo sapiens
agattcccagagcaaa

SEQ ID NO: 3929058 - DNA, 15 bp, Homo sapiens
agattcctgggcctg

SEQ ID NO: 3929059 - DNA, 16 bp, Homo sapiens
agattcctgggcctgt

SEQ ID NO: 3929060 - DNA, 17 bp, Homo sapiens
agattcctgggcctgtc

SEQ ID NO: 3929061 - DNA, 16 bp, Homo sapiens
agattctccaaatgat

SEQ ID NO: 3929062 - DNA, 17 bp, Homo sapiens
agattgccccagagccc

SEQ ID NO: 3929063 - DNA, 16 bp, Homo sapiens
agattgcgccactgca

SEQ ID NO: 3929064 - DNA, 12 bp, Homo sapiens
agattgcttctc

SEQ ID NO: 3929065 - DNA, 14 bp, Homo sapiens
agatttcaacatat

SEQ ID NO: 3929066 - DNA, 17 bp, Homo sapiens
agatttcaagaaaaaat

SEQ ID NO: 3929067 - DNA, 19 bp, Homo sapiens
agatttcaagaaaaaataa

SEQ ID NO: 3929068 - DNA, 15 bp, Homo sapiens
agatttcacatcagc

SEQ ID NO: 3929069 - DNA, 13 bp, Homo sapiens
agatttcctccat

SEQ ID NO: 3929070 - DNA, 17 bp, Homo sapiens
agatttcctccatggtg

SEQ ID NO: 3929071 - DNA, 22 bp, Homo sapiens
agatttcctccatggtggaagg

SEQ ID NO: 3929072 - DNA, 13 bp, Homo sapiens
agatttgattatt

SEQ ID NO: 3929073 - DNA, 15 bp, Homo sapiens
agatttgccagcaca

SEQ ID NO: 3929074 - DNA, 13 bp, Homo sapiens
agattttaaattc

SEQ ID NO: 3929075 - DNA, 19 bp, Homo sapiens
agattttaaattcacaata

SEQ ID NO: 3929076 - DNA, 23 bp, Homo sapiens
agattttccacaagattcccaga

SEQ ID NO: 3929077 - DNA, 13 bp, Homo sapiens
agattttccttcc

SEQ ID NO: 3929078 - DNA, 12 bp, Homo sapiens
agcaaagcctgt

SEQ ID NO: 3929079 - DNA, 22 bp, Homo sapiens
agcaaagcctgttcatggcaga

SEQ ID NO: 3929080 - DNA, 18 bp, Homo sapiens
agcaaaggaaaccaaagg

SEQ ID NO: 3929081 - DNA, 17 bp, Homo sapiens
agcaaatgtttctgcag

SEQ ID NO: 3929082 - DNA, 14 bp, Homo sapiens
agcaaattagtaat

SEQ ID NO: 3929083 - DNA, 24 bp, Homo sapiens
agcaaatttcaaaagacatgttgt

SEQ ID NO: 3929084 - DNA, 14 bp, Homo sapiens
agcaacacaagctg

SEQ ID NO: 3929085 - DNA, 18 bp, Homo sapiens
agcaacacaagctggaag

SEQ ID NO: 3929086 - DNA, 16 bp, Homo sapiens
agcaacagaaaaatgg

SEQ ID NO: 3929087 - DNA, 15 bp, Homo sapiens
agcaaccgtggccct

SEQ ID NO: 3929088 - DNA, 19 bp, Homo sapiens
agcaaccgtggcccttcct

SEQ ID NO: 3929089 - DNA, 12 bp, Homo sapiens
agcaactcccac

SEQ ID NO: 3929090 - DNA, 14 bp, Homo sapiens
agcaactcccacga

SEQ ID NO: 3929091 - DNA, 12 bp, Homo sapiens
agcaagaaagcc

SEQ ID NO: 3929092 - DNA, 18 bp, Homo sapiens
agcaagacctgttggtta

SEQ ID NO: 3929093 - DNA, 23 bp, Homo sapiens
agcaagagagagctcgctcttgg

SEQ ID NO: 3929094 - DNA, 13 bp, Homo sapiens
agcaagagctggc

SEQ ID NO: 3929095 - DNA, 14 bp, Homo sapiens
agcaaggcccgagc

SEQ ID NO: 3929096 - DNA, 17 bp, Homo sapiens
agcaaggcccgagcagc

SEQ ID NO: 3929097 - DNA, 18 bp, Homo sapiens
agcaaggcccgagcagct

SEQ ID NO: 3929098 - DNA, 20 bp, Homo sapiens
agcaaggcccgagcagctga

SEQ ID NO: 3929099 - DNA, 20 bp, Homo sapiens
agcaagggtgatgggaaagc

SEQ ID NO: 3929100 - DNA, 22 bp, Homo sapiens
agcaagggtgatgggaaagcat

SEQ ID NO: 3929101 - DNA, 23 bp, Homo sapiens
agcaagttctagagaagaggctg

SEQ ID NO: 3929102 - DNA, 14 bp, Homo sapiens
agcaataattagga

SEQ ID NO: 3929103 - DNA, 21 bp, Homo sapiens
agcaataattaggatctatgc

SEQ ID NO: 3929104 - DNA, 15 bp, Homo sapiens
agcaatatgtaaata

SEQ ID NO: 3929105 - DNA, 20 bp, Homo sapiens
agcaatgatgtccagaagaa

SEQ ID NO: 3929106 - DNA, 23 bp, Homo sapiens
agcaatgatgtccagaagaatat

SEQ ID NO: 3929107 - DNA, 13 bp, Homo sapiens
agcaatggacctt

SEQ ID NO: 3929108 - DNA, 17 bp, Homo sapiens
agcaatgggagggggct

SEQ ID NO: 3929109 - DNA, 19 bp, Homo sapiens
agcaatgggagggggctcc

SEQ ID NO: 3929110 - DNA, 13 bp, Homo sapiens
agcaattggctcc

SEQ ID NO: 3929111 - DNA, 17 bp, Homo sapiens
agcacaccccaagggac

SEQ ID NO: 3929112 - DNA, 13 bp, Homo sapiens
agcacagagggct

SEQ ID NO: 3929113 - DNA, 12 bp, Homo sapiens
agcacagccctg

SEQ ID NO: 3929114 - DNA, 18 bp, Homo sapiens
agcaggccacgctcaggc

SEQ ID NO: 3929115 - DNA, 18 bp, Homo sapiens
agcaggcccgacagagag

SEQ ID NO: 3929116 - DNA, 20 bp, Homo sapiens
agcaggcccgacagagagat

SEQ ID NO: 3929117 - DNA, 21 bp, Homo sapiens
agcaggcccgacagagagatg

SEQ ID NO: 3929118 - DNA, 19 bp, Homo sapiens
agcaggctactgtcagctc

SEQ ID NO: 3929119 - DNA, 16 bp, Homo sapiens
agcagggaaagctcca

SEQ ID NO: 3929120 - DNA, 14 bp, Homo sapiens
agcagggacacccc

SEQ ID NO: 3929121 - DNA, 14 bp, Homo sapiens
agcagggccgggga

SEQ ID NO: 3929122 - DNA, 15 bp, Homo sapiens
agcaggggtctgagc

SEQ ID NO: 3929123 - DNA, 16 bp, Homo sapiens
agcagggtcttgctgt

SEQ ID NO: 3929124 - DNA, 23 bp, Homo sapiens
agcaggtgcaagagacagagccc

SEQ ID NO: 3929125 - DNA, 16 bp, Homo sapiens
agcaggtggcatctct

SEQ ID NO: 3929126 - DNA, 19 bp, Homo sapiens
agcaggtgtggtggctcat

SEQ ID NO: 3929127 - DNA, 22 bp, Homo sapiens
agcaggtgtggtggctcatggc

SEQ ID NO: 3929128 - DNA, 16 bp, Homo sapiens
agcaggttcttgatgt

SEQ ID NO: 3929129 - DNA, 15 bp, Homo sapiens
agcagtacatgggaa

SEQ ID NO: 3929130 - DNA, 15 bp, Homo sapiens
agcagtatgaatgat

SEQ ID NO: 3929131 - DNA, 15 bp, Homo sapiens
agcagtccctgagac

SEQ ID NO: 3929132 - DNA, 20 bp, Homo sapiens
agcagtgcctcgaggcaccg

SEQ ID NO: 3929133 - DNA, 21 bp, Homo sapiens
agcagtggccgcaagcgcagg

SEQ ID NO: 3929134 - DNA, 20 bp, Homo sapiens
agcagtgtcatcagaagata

SEQ ID NO: 3929135 - DNA, 22 bp, Homo sapiens
agcagtgtgtccttggggcaca

SEQ ID NO: 3929136 - DNA, 23 bp, Homo sapiens
agcagtgtgtccttggggcacag

SEQ ID NO: 3929137 - DNA, 18 bp, Homo sapiens
agcagttccatgaagaca

SEQ ID NO: 3929138 - DNA, 17 bp, Homo sapiens
agcagttctgcagagga

SEQ ID NO: 3929139 - DNA, 23 bp, Homo sapiens
agcagttgaaaagactccaaaga

SEQ ID NO: 3929140 - DNA, 14 bp, Homo sapiens
agcagtttgctttg

SEQ ID NO: 3929141 - DNA, 14 bp, Homo sapiens
agcataaatgcaaa

SEQ ID NO: 3929142 - DNA, 22 bp, Homo sapiens
agcataccaacacgagcaggct

SEQ ID NO: 3929143 - DNA, 20 bp, Homo sapiens
agcataccagtactcagtat

SEQ ID NO: 3929144 - DNA, 18 bp, Homo sapiens
agcataccttggactgac

SEQ ID NO: 3929145 - DNA, 16 bp, Homo sapiens
agcatacctttattgt

SEQ ID NO: 3929146 - DNA, 19 bp, Homo sapiens
agcatacctttattgtgat

SEQ ID NO: 3929147 - DNA, 12 bp, Homo sapiens
agcatcagagat

SEQ ID NO: 3929148 - DNA, 15 bp, Homo sapiens
agcatcttgtcaaga

SEQ ID NO: 3929149 - DNA, 19 bp, Homo sapiens
agcatgagagaattgtatc

SEQ ID NO: 3929150 - DNA, 17 bp, Homo sapiens
agcatgatctgaaaaat

SEQ ID NO: 3929151 - DNA, 18 bp, Homo sapiens
agcatggactctgggttt

SEQ ID NO: 3929152 - DNA, 15 bp, Homo sapiens
agcatggagagcctc

SEQ ID NO: 3929153 - DNA, 13 bp, Homo sapiens
agcatggctgtga

SEQ ID NO: 3929154 - DNA, 16 bp, Homo sapiens
agcatgtgttgaaaaa

SEQ ID NO: 3929155 - DNA, 17 bp, Homo sapiens
agcattacgtgagccag

SEQ ID NO: 3929156 - DNA, 19 bp, Homo sapiens
agcattacgtgagccaggt

SEQ ID NO: 3929157 - DNA, 20 bp, Homo sapiens
agcattacgtgagccaggta

SEQ ID NO: 3929158 - DNA, 17 bp, Homo sapiens
agcattattcttcagaa

SEQ ID NO: 3929159 - DNA, 20 bp, Homo sapiens
agcattcagcacaccccaag

SEQ ID NO: 3929160 - DNA, 19 bp, Homo sapiens
agcatttgccattcctgga

SEQ ID NO: 3929161 - DNA, 20 bp, Homo sapiens
agcatttgccctgtggattc

SEQ ID NO: 3929162 - DNA, 20 bp, Homo sapiens
agcatttttattcatgccat

SEQ ID NO: 3929163 - DNA, 18 bp, Homo sapiens
agcatttttgatttatgc

SEQ ID NO: 3929164 - DNA, 16 bp, Homo sapiens
agccaaaacagatcca

SEQ ID NO: 3929165 - DNA, 17 bp, Homo sapiens
agccaaacacactgtaa

SEQ ID NO: 3929166 - DNA, 18 bp, Homo sapiens
agccaaacacactgtaaa

SEQ ID NO: 3929167 - DNA, 13 bp, Homo sapiens
agccaacagcagc

SEQ ID NO: 3929168 - DNA, 21 bp, Homo sapiens
agccaacagtcaaaacagaga

SEQ ID NO: 3929169 - DNA, 19 bp, Homo sapiens
agccaacttggctttcccg

SEQ ID NO: 3929170 - DNA, 23 bp, Homo sapiens
agccaaggccctgagttggcagt

SEQ ID NO: 3929171 - DNA, 23 bp, Homo sapiens
agccaagttatattgaatatatc

SEQ ID NO: 3929172 - DNA, 19 bp, Homo sapiens
agccaatatttactcatca

SEQ ID NO: 3929173 - DNA, 17 bp, Homo sapiens
agccacaaccacataca

SEQ ID NO: 3929174 - DNA, 23 bp, Homo sapiens
agccacagaagccaggagcaaat

SEQ ID NO: 3929175 - DNA, 15 bp, Homo sapiens
agccacagccgtgct

SEQ ID NO: 3929176 - DNA, 19 bp, Homo sapiens
agccaccctgaggagtctg

SEQ ID NO: 3929177 - DNA, 20 bp, Homo sapiens
agccaccctgaggagtctga

SEQ ID NO: 3929178 - DNA, 12 bp, Homo sapiens
agccacctccca

SEQ ID NO: 3929179 - DNA, 20 bp, Homo sapiens
agccacctcccaccccactc

SEQ ID NO: 3929180 - DNA, 21 bp, Homo sapiens
agccacctcccaccccactcc

SEQ ID NO: 3929181 - DNA, 14 bp, Homo sapiens
agccacgctgtcct

SEQ ID NO: 3929182 - DNA, 18 bp, Homo sapiens
agccacgctgtcctctcg

SEQ ID NO: 3929183 - DNA, 20 bp, Homo sapiens
agccacgttccttactgcag

SEQ ID NO: 3929184 - DNA, 22 bp, Homo sapiens
agccacgttccttactgcagaa

SEQ ID NO: 3929185 - DNA, 19 bp, Homo sapiens
agccactcctgtcccgcct

SEQ ID NO: 3929186 - DNA, 15 bp, Homo sapiens
agccactcgggaggc

SEQ ID NO: 3929187 - DNA, 14 bp, Homo sapiens
agccactgtgctga

SEQ ID NO: 3929188 - DNA, 14 bp, Homo sapiens
agccagaacctgga

SEQ ID NO: 3929189 - DNA, 13 bp, Homo sapiens
agccagagcctgg

SEQ ID NO: 3929190 - DNA, 19 bp, Homo sapiens
agccagagggtgggagcct

SEQ ID NO: 3929191 - DNA, 23 bp, Homo sapiens
agccagcaatgatgtccagaaga

SEQ ID NO: 3929192 - DNA, 12 bp, Homo sapiens
agccagcccagc

SEQ ID NO: 3929193 - DNA, 14 bp, Homo sapiens
agccagcccagccc

SEQ ID NO: 3929194 - DNA, 13 bp, Homo sapiens
agccagccctccc

SEQ ID NO: 3929195 - DNA, 15 bp, Homo sapiens
agccagccctgcctg

SEQ ID NO: 3929196 - DNA, 20 bp, Homo sapiens
agccagccctgcctggagga

SEQ ID NO: 3929197 - DNA, 23 bp, Homo sapiens
agccagccctgcctggaggacct

SEQ ID NO: 3929198 - DNA, 14 bp, Homo sapiens
agccagccgccctg

SEQ ID NO: 3929199 - DNA, 16 bp, Homo sapiens
agccagccgccctggg

SEQ ID NO: 3929200 - DNA, 14 bp, Homo sapiens
aggcaccatctccc

SEQ ID NO: 3929201 - DNA, 16 bp, Homo sapiens
aggcaccccctggaga

SEQ ID NO: 3929202 - DNA, 20 bp, Homo sapiens
aggcaccccctggagagaag

SEQ ID NO: 3929203 - DNA, 20 bp, Homo sapiens
aggcacccttctttcctctt

SEQ ID NO: 3929204 - DNA, 17 bp, Homo sapiens
aggcaccggcgctgcag

SEQ ID NO: 3929205 - DNA, 13 bp, Homo sapiens
aggcacctggcct

SEQ ID NO: 3929206 - DNA, 14 bp, Homo sapiens
aggcacctggcctg

SEQ ID NO: 3929207 - DNA, 20 bp, Homo sapiens
aggcacctggcctgctggga

SEQ ID NO: 3929208 - DNA, 21 bp, Homo sapiens
aggcacctggcctgctgggaa

SEQ ID NO: 3929209 - DNA, 14 bp, Homo sapiens
aggcacgaacccac

SEQ ID NO: 3929210 - DNA, 14 bp, Homo sapiens
aggcactgctgccc

SEQ ID NO: 3929211 - DNA, 15 bp, Homo sapiens
aggcactggtggcat

SEQ ID NO: 3929212 - DNA, 18 bp, Homo sapiens
aggcagacgtggggaggg

SEQ ID NO: 3929213 - DNA, 21 bp, Homo sapiens
aggcagacgtggggagggtgg

SEQ ID NO: 3929214 - DNA, 22 bp, Homo sapiens
aggcagacgtggggagggtgga

SEQ ID NO: 3929215 - DNA, 15 bp, Homo sapiens
aggcagagaaagaag

SEQ ID NO: 3929216 - DNA, 22 bp, Homo sapiens
aggcagagaaagaagagacagg

SEQ ID NO: 3929217 - DNA, 14 bp, Homo sapiens
aggcagagaagaaa

SEQ ID NO: 3929218 - DNA, 15 bp, Homo sapiens
aggcagagaagaaag

SEQ ID NO: 3929219 - DNA, 18 bp, Homo sapiens
aggcagagcggggaggtg

SEQ ID NO: 3929220 - DNA, 20 bp, Homo sapiens
aggcagagcggggaggtgcc

SEQ ID NO: 3929221 - DNA, 22 bp, Homo sapiens
aggcagagcggggaggtgcctg

SEQ ID NO: 3929222 - DNA, 17 bp, Homo sapiens
aggcagaggatgttctg

SEQ ID NO: 3929223 - DNA, 16 bp, Homo sapiens
aggcagcctccagagc

SEQ ID NO: 3929224 - DNA, 19 bp, Homo sapiens
aggcagcctccagagccag

SEQ ID NO: 3929225 - DNA, 23 bp, Homo sapiens
aggcagcctccagagccagcctg

SEQ ID NO: 3929226 - DNA, 11 bp, Homo sapiens
aggcagctcca

SEQ ID NO: 3929227 - DNA, 13 bp, Homo sapiens
aggcagctccaac

SEQ ID NO: 3929228 - DNA, 15 bp, Homo sapiens
aggcagcttgaaact

SEQ ID NO: 3929229 - DNA, 14 bp, Homo sapiens
aggcaggaagagag

SEQ ID NO: 3929230 - DNA, 15 bp, Homo sapiens
aggcaggaagagaga

SEQ ID NO: 3929231 - DNA, 17 bp, Homo sapiens
aggcaggaagagagaga

SEQ ID NO: 3929232 - DNA, 21 bp, Homo sapiens
aggcaggcacctagcaattcc

SEQ ID NO: 3929233 - DNA, 14 bp, Homo sapiens
aggcaggcagggct

SEQ ID NO: 3929234 - DNA, 15 bp, Homo sapiens
aggcaggctccccct

SEQ ID NO: 3929235 - DNA, 12 bp, Homo sapiens
aggcagggaggg

SEQ ID NO: 3929236 - DNA, 14 bp, Homo sapiens
aggcagggatttga

SEQ ID NO: 3929237 - DNA, 15 bp, Homo sapiens
aggcagggatttgag

SEQ ID NO: 3929238 - DNA, 24 bp, Homo sapiens
aggcagggcaaatgacatgcactg

SEQ ID NO: 3929239 - DNA, 13 bp, Homo sapiens
aggcagggctctc

SEQ ID NO: 3929240 - DNA, 22 bp, Homo sapiens
aggcagggctctcctggcttcc

SEQ ID NO: 3929241 - DNA, 13 bp, Homo sapiens
aggcaggggcgga

SEQ ID NO: 3929242 - DNA, 16 bp, Homo sapiens
aggcaggggtgggaga

SEQ ID NO: 3929243 - DNA, 17 bp, Homo sapiens
aggcaggggtgggagag

SEQ ID NO: 3929244 - DNA, 15 bp, Homo sapiens
aggcaggtgcctgga

SEQ ID NO: 3929245 - DNA, 17 bp, Homo sapiens
aggcaggtttgccagtg

SEQ ID NO: 3929246 - DNA, 14 bp, Homo sapiens
aggcagtctgaacc

SEQ ID NO: 3929247 - DNA, 19 bp, Homo sapiens
aggcagttcaaagcaggat

SEQ ID NO: 3929248 - DNA, 13 bp, Homo sapiens
aggcatcccaggg

SEQ ID NO: 3929249 - DNA, 17 bp, Homo sapiens
aggcatcccaggggacc

SEQ ID NO: 3929250 - DNA, 18 bp, Homo sapiens
aggcatcccaggggacca

SEQ ID NO: 3929251 - DNA, 14 bp, Homo sapiens
aggcatctgcaccc

SEQ ID NO: 3929252 - DNA, 15 bp, Homo sapiens
aggcatgagggatca

SEQ ID NO: 3929253 - DNA, 15 bp, Homo sapiens
aggcatgcctctgat

SEQ ID NO: 3929254 - DNA, 17 bp, Homo sapiens
aggcatgcctctgatat

SEQ ID NO: 3929255 - DNA, 15 bp, Homo sapiens
aggagcaaagcctgt

SEQ ID NO: 3929256 - DNA, 16 bp, Homo sapiens
aggagcaaagcctgtt

SEQ ID NO: 3929257 - DNA, 18 bp, Homo sapiens
aggagcaaatgtttctgc

SEQ ID NO: 3929258 - DNA, 22 bp, Homo sapiens
aggagcaaatgtttctgcagta

SEQ ID NO: 3929259 - DNA, 17 bp, Homo sapiens
aggagcagacagagaaa

SEQ ID NO: 3929260 - DNA, 16 bp, Homo sapiens
aggagcagagggccta

SEQ ID NO: 3929261 - DNA, 21 bp, Homo sapiens
aggagcatttggagagaaggc

SEQ ID NO: 3929262 - DNA, 21 bp, Homo sapiens
aggagccggaccaagatgggc

SEQ ID NO: 3929263 - DNA, 18 bp, Homo sapiens
aggagcctgtgaacccag

SEQ ID NO: 3929264 - DNA, 20 bp, Homo sapiens
aggagcctgtgaacccagga

SEQ ID NO: 3929265 - DNA, 12 bp, Homo sapiens
aggagctacctg

SEQ ID NO: 3929266 - DNA, 18 bp, Homo sapiens
aggagctacctgtgtgga

SEQ ID NO: 3929267 - DNA, 22 bp, Homo sapiens
aggagctacctgtgtggacagg

SEQ ID NO: 3929268 - DNA, 19 bp, Homo sapiens
aggagctcagccgtgcact

SEQ ID NO: 3929269 - DNA, 18 bp, Homo sapiens
aggagctgatttccaggc

SEQ ID NO: 3929270 - DNA, 21 bp, Homo sapiens
aggagctgatttccaggcccc

SEQ ID NO: 3929271 - DNA, 19 bp, Homo sapiens
aggaggaaaacgggaaaga

SEQ ID NO: 3929272 - DNA, 15 bp, Homo sapiens
aggaggaaggcaaag

SEQ ID NO: 3929273 - DNA, 16 bp, Homo sapiens
aggaggaaggcaaagc

SEQ ID NO: 3929274 - DNA, 21 bp, Homo sapiens
aggaggaataagctcccaggg

SEQ ID NO: 3929275 - DNA, 13 bp, Homo sapiens
aggaggaggaagg

SEQ ID NO: 3929276 - DNA, 12 bp, Homo sapiens
aggaggaggagg

SEQ ID NO: 3929277 - DNA, 20 bp, Homo sapiens
aggaggccctggtgtcaggc

SEQ ID NO: 3929278 - DNA, 23 bp, Homo sapiens
aggaggcgcagcccgaagcccag

SEQ ID NO: 3929279 - DNA, 16 bp, Homo sapiens
aggaggctgaggcaga

SEQ ID NO: 3929280 - DNA, 14 bp, Homo sapiens
aggaggctgcggcc

SEQ ID NO: 3929281 - DNA, 18 bp, Homo sapiens
aggagggacaaaggagcc

SEQ ID NO: 3929282 - DNA, 19 bp, Homo sapiens
aggagggactgtcgctgct

SEQ ID NO: 3929283 - DNA, 20 bp, Homo sapiens
aggagggcaagggccatgct

SEQ ID NO: 3929284 - DNA, 23 bp, Homo sapiens
aggagggcagagccatgggcctg

SEQ ID NO: 3929285 - DNA, 16 bp, Homo sapiens
aggagggcatgggagg

SEQ ID NO: 3929286 - DNA, 13 bp, Homo sapiens
aggagggtgccct

SEQ ID NO: 3929287 - DNA, 16 bp, Homo sapiens
aggaggtgtcccaagc

SEQ ID NO: 3929288 - DNA, 16 bp, Homo sapiens
aggaggttggtgactg

SEQ ID NO: 3929289 - DNA, 21 bp, Homo sapiens
aggaggttgtggatgctccag

SEQ ID NO: 3929290 - DNA, 18 bp, Homo sapiens
aggagtagctgagaggaa

SEQ ID NO: 3929291 - DNA, 14 bp, Homo sapiens
aggagtagctgagc

SEQ ID NO: 3929292 - DNA, 15 bp, Homo sapiens
aggagtagctgagct

SEQ ID NO: 3929293 - DNA, 13 bp, Homo sapiens
aggagtctgtgct

SEQ ID NO: 3929294 - DNA, 14 bp, Homo sapiens
aggagtgagatcat

SEQ ID NO: 3929295 - DNA, 18 bp, Homo sapiens
aggagtggaggaggcctg

SEQ ID NO: 3929296 - DNA, 16 bp, Homo sapiens
aggagttaagagtagc

SEQ ID NO: 3929297 - DNA, 20 bp, Homo sapiens
aggagttctgaagctgacag

SEQ ID NO: 3929298 - DNA, 19 bp, Homo sapiens
aggagtttcgaggtagagt

SEQ ID NO: 3929299 - DNA, 17 bp, Homo sapiens
aggagtttgagacaagc

SEQ ID NO: 3929300 - DNA, 23 bp, Homo sapiens
aggagtttgagacaagccctggc

SEQ ID NO: 3929301 - DNA, 24 bp, Homo sapiens
aggagtttgagacaagccctggca

SEQ ID NO: 3929302 - DNA, 14 bp, Homo sapiens
aggatagcattttt

SEQ ID NO: 3929303 - DNA, 22 bp, Homo sapiens
aggatatcatcttttctaatct

SEQ ID NO: 3929304 - DNA, 17 bp, Homo sapiens
aggatcagccccgctcc

SEQ ID NO: 3929305 - DNA, 18 bp, Homo sapiens
aggatccctcccagatcc

SEQ ID NO: 3929306 - DNA, 14 bp, Homo sapiens
aggatccgctgcca

SEQ ID NO: 3929307 - DNA, 16 bp, Homo sapiens
aggatcctcacaggag

SEQ ID NO: 3929308 - DNA, 19 bp, Homo sapiens
aggatcctcacaggagcag

SEQ ID NO: 3929309 - DNA, 14 bp, Homo sapiens
aggatcctgcagga

SEQ ID NO: 3929310 - DNA, 16 bp, Homo sapiens
aggatcctgcaggaac

SEQ ID NO: 3929311 - DNA, 18 bp, Homo sapiens
agctcttctatttaaaaa

SEQ ID NO: 3929312 - DNA, 21 bp, Homo sapiens
agctcttctatttaaaaaata

SEQ ID NO: 3929313 - DNA, 16 bp, Homo sapiens
agctcttggaagagct

SEQ ID NO: 3929314 - DNA, 19 bp, Homo sapiens
agctcttggcattttcctc

SEQ ID NO: 3929315 - DNA, 17 bp, Homo sapiens
agctctttcttctttga

SEQ ID NO: 3929316 - DNA, 21 bp, Homo sapiens
agctgaaacattccgaagagg

SEQ ID NO: 3929317 - DNA, 16 bp, Homo sapiens
agctgaagtgaaggag

SEQ ID NO: 3929318 - DNA, 17 bp, Homo sapiens
agctgaagtgaaggaga

SEQ ID NO: 3929319 - DNA, 20 bp, Homo sapiens
agctgacacataatttgaat

SEQ ID NO: 3929320 - DNA, 14 bp, Homo sapiens
agctgacagctgct

SEQ ID NO: 3929321 - DNA, 17 bp, Homo sapiens
agctgacccagagtgga

SEQ ID NO: 3929322 - DNA, 17 bp, Homo sapiens
agctgagaagaagctga

SEQ ID NO: 3929323 - DNA, 14 bp, Homo sapiens
agctgagagccctg

SEQ ID NO: 3929324 - DNA, 16 bp, Homo sapiens
agctgagagccctgct

SEQ ID NO: 3929325 - DNA, 18 bp, Homo sapiens
agctgagagccctgctgt

SEQ ID NO: 3929326 - DNA, 16 bp, Homo sapiens
agctgagaggaagatg

SEQ ID NO: 3929327 - DNA, 17 bp, Homo sapiens
agctgagagtctgaaag

SEQ ID NO: 3929328 - DNA, 23 bp, Homo sapiens
agctgagagtctgaaagacagaa

SEQ ID NO: 3929329 - DNA, 16 bp, Homo sapiens
agctgagcaggcccga

SEQ ID NO: 3929330 - DNA, 15 bp, Homo sapiens
agctgagcagggccg

SEQ ID NO: 3929331 - DNA, 18 bp, Homo sapiens
agctgagctcacaaggca

SEQ ID NO: 3929332 - DNA, 19 bp, Homo sapiens
agctgagctcacaaggcag

SEQ ID NO: 3929333 - DNA, 17 bp, Homo sapiens
agctgaggatgacagag

SEQ ID NO: 3929334 - DNA, 22 bp, Homo sapiens
agctgaggggggccgtgcccag

SEQ ID NO: 3929335 - DNA, 14 bp, Homo sapiens
agctgagtcacctc

SEQ ID NO: 3929336 - DNA, 17 bp, Homo sapiens
agctgagtcacctcctc

SEQ ID NO: 3929337 - DNA, 20 bp, Homo sapiens
agctgagttacttgtctgag

SEQ ID NO: 3929338 - DNA, 15 bp, Homo sapiens
agctgatgatgtctc

SEQ ID NO: 3929339 - DNA, 16 bp, Homo sapiens
agctgatttccaggcc

SEQ ID NO: 3929340 - DNA, 19 bp, Homo sapiens
agctgattttgtcactgtc

SEQ ID NO: 3929341 - DNA, 15 bp, Homo sapiens
agctgcaagtgacat

SEQ ID NO: 3929342 - DNA, 18 bp, Homo sapiens
agctgcaagtgacatctc

SEQ ID NO: 3929343 - DNA, 18 bp, Homo sapiens
agctgcacattcctggcc

SEQ ID NO: 3929344 - DNA, 21 bp, Homo sapiens
agctgcagaaacgaagccatc

SEQ ID NO: 3929345 - DNA, 11 bp, Homo sapiens
agctgcagaac

SEQ ID NO: 3929346 - DNA, 13 bp, Homo sapiens
agctgcagctggg

SEQ ID NO: 3929347 - DNA, 15 bp, Homo sapiens
agctgcagctgggcc

SEQ ID NO: 3929348 - DNA, 16 bp, Homo sapiens
agctgcagctgggccc

SEQ ID NO: 3929349 - DNA, 17 bp, Homo sapiens
agctgccaaaatcgtag

SEQ ID NO: 3929350 - DNA, 17 bp, Homo sapiens
agctgccaagtctattt

SEQ ID NO: 3929351 - DNA, 11 bp, Homo sapiens
agctgctctgc

SEQ ID NO: 3929352 - DNA, 14 bp, Homo sapiens
agctgctctgcccc

SEQ ID NO: 3929353 - DNA, 15 bp, Homo sapiens
agctgctctggaaaa

SEQ ID NO: 3929354 - DNA, 21 bp, Homo sapiens
agctgctcttagtgcccgcct

SEQ ID NO: 3929355 - DNA, 22 bp, Homo sapiens
agctgcttgactatcacataca

SEQ ID NO: 3929356 - DNA, 15 bp, Homo sapiens
agctggaaagcagcc

SEQ ID NO: 3929357 - DNA, 11 bp, Homo sapiens
agctggaaata

SEQ ID NO: 3929358 - DNA, 19 bp, Homo sapiens
agctggaaataaacctgga

SEQ ID NO: 3929359 - DNA, 12 bp, Homo sapiens
agctggaaggca

SEQ ID NO: 3929360 - DNA, 16 bp, Homo sapiens
agctggaaggcagggc

SEQ ID NO: 3929361 - DNA, 19 bp, Homo sapiens
agctggaaggcagggcaga

SEQ ID NO: 3929362 - DNA, 21 bp, Homo sapiens
agctggaattctaaatgctgg

SEQ ID NO: 3929363 - DNA, 14 bp, Homo sapiens
agctggacaagaag

SEQ ID NO: 3929364 - DNA, 18 bp, Homo sapiens
agctggacaagaagctgc

SEQ ID NO: 3929365 - DNA, 19 bp, Homo sapiens
agctggacaagaagctgct

SEQ ID NO: 3929366 - DNA, 20 bp, Homo sapiens
agctggacaagaagctgcta

SEQ ID NO: 3929367 - DNA, 19 bp, Homo sapiens
agctggacatgctttggca

SEQ ID NO: 3929368 - DNA, 23 bp, Homo sapiens
agctggagctcttggaagagctc

SEQ ID NO: 3929369 - DNA, 20 bp, Homo sapiens
agctggcattggtctgctga

SEQ ID NO: 3929370 - DNA, 15 bp, Homo sapiens
aggaaatagaattga

SEQ ID NO: 3929371 - DNA, 20 bp, Homo sapiens
aggaaatcaaatatgcaaag

SEQ ID NO: 3929372 - DNA, 23 bp, Homo sapiens
aggaaatgctattgttgtgggct

SEQ ID NO: 3929373 - DNA, 16 bp, Homo sapiens
aggaacagagactctg

SEQ ID NO: 3929374 - DNA, 19 bp, Homo sapiens
aggaacagagactctggaa

SEQ ID NO: 3929375 - DNA, 23 bp, Homo sapiens
aggaacagctcttcactcagcca

SEQ ID NO: 3929376 - DNA, 14 bp, Homo sapiens
aggaacatgtaact

SEQ ID NO: 3929377 - DNA, 23 bp, Homo sapiens
aggaacctgtactgggttatttt

SEQ ID NO: 3929378 - DNA, 14 bp, Homo sapiens
aggaacgagcactg

SEQ ID NO: 3929379 - DNA, 16 bp, Homo sapiens
aggaacgagcactggc

SEQ ID NO: 3929380 - DNA, 18 bp, Homo sapiens
aggaacgagcactggcca

SEQ ID NO: 3929381 - DNA, 13 bp, Homo sapiens
aggaactctggct

SEQ ID NO: 3929382 - DNA, 16 bp, Homo sapiens
aggaactctggcttcc

SEQ ID NO: 3929383 - DNA, 18 bp, Homo sapiens
aggaactctggcttccag

SEQ ID NO: 3929384 - DNA, 19 bp, Homo sapiens
aggaactctggcttccagg

SEQ ID NO: 3929385 - DNA, 20 bp, Homo sapiens
aggaagaaaccccaagcagc

SEQ ID NO: 3929386 - DNA, 18 bp, Homo sapiens
aggaagaagggataatag

SEQ ID NO: 3929387 - DNA, 14 bp, Homo sapiens
aggaagagaaggag

SEQ ID NO: 3929388 - DNA, 17 bp, Homo sapiens
aggaagagaaggagcag

SEQ ID NO: 3929389 - DNA, 12 bp, Homo sapiens
aggaagagagag

SEQ ID NO: 3929390 - DNA, 13 bp, Homo sapiens
aggaagagagaga

SEQ ID NO: 3929391 - DNA, 14 bp, Homo sapiens
aggaagagagagag

SEQ ID NO: 3929392 - DNA, 12 bp, Homo sapiens
aggaagagcagg

SEQ ID NO: 3929393 - DNA, 17 bp, Homo sapiens
aggaagagcaggcacat

SEQ ID NO: 3929394 - DNA, 17 bp, Homo sapiens
aggaagatgaaagagga

SEQ ID NO: 3929395 - DNA, 18 bp, Homo sapiens
aggaagatgaagagaagc

SEQ ID NO: 3929396 - DNA, 16 bp, Homo sapiens
aggaagcctaaataaa

SEQ ID NO: 3929397 - DNA, 14 bp, Homo sapiens
aggaaggaggcaga

SEQ ID NO: 3929398 - DNA, 13 bp, Homo sapiens
aggaaggcaaagc

SEQ ID NO: 3929399 - DNA, 14 bp, Homo sapiens
aggaaggcagctgc

SEQ ID NO: 3929400 - DNA, 18 bp, Homo sapiens
aggaaggcagctgctctt

SEQ ID NO: 3929401 - DNA, 20 bp, Homo sapiens
aggaaggcagggaggaggca

SEQ ID NO: 3929402 - DNA, 14 bp, Homo sapiens
aggaagggactgac

SEQ ID NO: 3929403 - DNA, 18 bp, Homo sapiens
aggaagggcatccttctg

SEQ ID NO: 3929404 - DNA, 13 bp, Homo sapiens
aggaagggccagg

SEQ ID NO: 3929405 - DNA, 14 bp, Homo sapiens
aggaagggccagga

SEQ ID NO: 3929406 - DNA, 16 bp, Homo sapiens
aggaagggccaggaga

SEQ ID NO: 3929407 - DNA, 17 bp, Homo sapiens
aggaagggccaggagag

SEQ ID NO: 3929408 - DNA, 16 bp, Homo sapiens
aggaagggggttgtgg

SEQ ID NO: 3929409 - DNA, 22 bp, Homo sapiens
aggaagggtgggaagcttgctg

SEQ ID NO: 3929410 - DNA, 17 bp, Homo sapiens
aggaaggtgctgagctt

SEQ ID NO: 3929411 - DNA, 16 bp, Homo sapiens
aggaatagcccgagga

SEQ ID NO: 3929412 - DNA, 23 bp, Homo sapiens
aggaatatcccaaacttcggaaa

SEQ ID NO: 3929413 - DNA, 15 bp, Homo sapiens
aggaatcagacttca

SEQ ID NO: 3929414 - DNA, 21 bp, Homo sapiens
aggaatcatgtcaggcctgtg

SEQ ID NO: 3929415 - DNA, 23 bp, Homo sapiens
aggaatcatgtcaggcctgtgtg

SEQ ID NO: 3929416 - DNA, 23 bp, Homo sapiens
aggaatcctttgagaatgtgatt

SEQ ID NO: 3929417 - DNA, 22 bp, Homo sapiens
aggaatgttaaagtcagtggga

SEQ ID NO: 3929418 - DNA, 14 bp, Homo sapiens
aggacaacctgccc

SEQ ID NO: 3929419 - DNA, 15 bp, Homo sapiens
aggacaacctgcccc

SEQ ID NO: 3929420 - DNA, 13 bp, Homo sapiens
aggacacactaat

SEQ ID NO: 3929421 - DNA, 14 bp, Homo sapiens
aggacacaggcctg

SEQ ID NO: 3929422 - DNA, 19 bp, Homo sapiens
aggacacatcccggcctct

SEQ ID NO: 3929423 - DNA, 12 bp, Homo sapiens
aggacacctgcc

SEQ ID NO: 3929424 - DNA, 16 bp, Homo sapiens
aggacacctgccccag

SEQ ID NO: 3929425 - DNA, 19 bp, Homo sapiens
aggacacctgccccagcgc

SEQ ID NO: 3929426 - DNA, 15 bp, Homo sapiens
aggacacgtggcctg

SEQ ID NO: 3929427 - DNA, 19 bp, Homo sapiens
aggacagagctggctgtct

SEQ ID NO: 3929428 - DNA, 22 bp, Homo sapiens
aggacagcctgtggcggtgcct

SEQ ID NO: 3929429 - DNA, 20 bp, Homo sapiens
aggacagttgggctatgtgt

SEQ ID NO: 3929430 - DNA, 12 bp, Homo sapiens
aggacatcataa

SEQ ID NO: 3929431 - DNA, 16 bp, Homo sapiens
aggacatggagagaga

SEQ ID NO: 3929432 - DNA, 16 bp, Homo sapiens
aggacatggggcatag

SEQ ID NO: 3929433 - DNA, 15 bp, Homo sapiens
aggacatgtttttgt

SEQ ID NO: 3929434 - DNA, 23 bp, Homo sapiens
aggacatgtttttgttttctttg

SEQ ID NO: 3929435 - DNA, 19 bp, Homo sapiens
aggaccaactggcttctgt

SEQ ID NO: 3929436 - DNA, 14 bp, Homo sapiens
aggaccaatgttgt

SEQ ID NO: 3929437 - DNA, 19 bp, Homo sapiens
aggaccacagtgggtggca

SEQ ID NO: 3929438 - DNA, 12 bp, Homo sapiens
aggaccaggact

SEQ ID NO: 3929439 - DNA, 23 bp, Homo sapiens
aggaccaggactatagcccaggt

SEQ ID NO: 3929440 - DNA, 16 bp, Homo sapiens
aggacccacccatctt

SEQ ID NO: 3929441 - DNA, 13 bp, Homo sapiens
aggacccaggccg

SEQ ID NO: 3929442 - DNA, 14 bp, Homo sapiens
aggacccaggccgc

SEQ ID NO: 3929443 - DNA, 17 bp, Homo sapiens
aggacccggaggggcct

SEQ ID NO: 3929444 - DNA, 21 bp, Homo sapiens
aggacccggaggggcctggca

SEQ ID NO: 3929445 - DNA, 17 bp, Homo sapiens
aggaccgtggccctgcc

SEQ ID NO: 3929446 - DNA, 14 bp, Homo sapiens
aggacctgagcctg

SEQ ID NO: 3929447 - DNA, 18 bp, Homo sapiens
aggactaacactcagaag

SEQ ID NO: 3929448 - DNA, 22 bp, Homo sapiens
aggactaacataaaatctgtga

SEQ ID NO: 3929449 - DNA, 18 bp, Homo sapiens
aggactatagcccaggtc

SEQ ID NO: 3929450 - DNA, 19 bp, Homo sapiens
aggactatagcccaggtcc

SEQ ID NO: 3929451 - DNA, 16 bp, Homo sapiens
aggactatgggtacat

SEQ ID NO: 3929452 - DNA, 13 bp, Homo sapiens
aggactccctcca

SEQ ID NO: 3929453 - DNA, 21 bp, Homo sapiens
aggactctgccccttctgttt

SEQ ID NO: 3929454 - DNA, 12 bp, Homo sapiens
aggactctgcct

SEQ ID NO: 3929455 - DNA, 13 bp, Homo sapiens
aggactctggcct

SEQ ID NO: 3929456 - DNA, 22 bp, Homo sapiens
aggactggagaccgcttcaccc

SEQ ID NO: 3929457 - DNA, 13 bp, Homo sapiens
agccctgggaccg

SEQ ID NO: 3929458 - DNA, 15 bp, Homo sapiens
agccctgggaccgct

SEQ ID NO: 3929459 - DNA, 20 bp, Homo sapiens
agccctgggaccgctacacc

SEQ ID NO: 3929460 - DNA, 16 bp, Homo sapiens
agccctgggccccacc

SEQ ID NO: 3929461 - DNA, 17 bp, Homo sapiens
agccctgggggccagct

SEQ ID NO: 3929462 - DNA, 21 bp, Homo sapiens
agccctgggggccagctggtg

SEQ ID NO: 3929463 - DNA, 16 bp, Homo sapiens
agccctggtgtgtttc

SEQ ID NO: 3929464 - DNA, 21 bp, Homo sapiens
agccctgtcgagacacttgcc

SEQ ID NO: 3929465 - DNA, 11 bp, Homo sapiens
agcccttccct

SEQ ID NO: 3929466 - DNA, 13 bp, Homo sapiens
agcccttccctgc

SEQ ID NO: 3929467 - DNA, 14 bp, Homo sapiens
agcccttcctcctg

SEQ ID NO: 3929468 - DNA, 18 bp, Homo sapiens
agcccttctgcctttctc

SEQ ID NO: 3929469 - DNA, 14 bp, Homo sapiens
agcccttgccccca

SEQ ID NO: 3929470 - DNA, 15 bp, Homo sapiens
agcccttgcccccat

SEQ ID NO: 3929471 - DNA, 23 bp, Homo sapiens
agccgactgcacagcggcccctg

SEQ ID NO: 3929472 - DNA, 17 bp, Homo sapiens
agccgagagcctgctcc

SEQ ID NO: 3929473 - DNA, 18 bp, Homo sapiens
agccgagagcctgctccc

SEQ ID NO: 3929474 - DNA, 21 bp, Homo sapiens
agccgagagcctgctccccca

SEQ ID NO: 3929475 - DNA, 21 bp, Homo sapiens
agccgagattgcgccactgca

SEQ ID NO: 3929476 - DNA, 16 bp, Homo sapiens
agccgagccgggcctg

SEQ ID NO: 3929477 - DNA, 18 bp, Homo sapiens
agccgagccgggcctggg

SEQ ID NO: 3929478 - DNA, 16 bp, Homo sapiens
agccgcatcttctcca

SEQ ID NO: 3929479 - DNA, 17 bp, Homo sapiens
agccgcatcttctccat

SEQ ID NO: 3929480 - DNA, 17 bp, Homo sapiens
agccgccatcagcccaa

SEQ ID NO: 3929481 - DNA, 13 bp, Homo sapiens
agccgccctgggc

SEQ ID NO: 3929482 - DNA, 22 bp, Homo sapiens
agccgctgtgagcccctggtcc

SEQ ID NO: 3929483 - DNA, 21 bp, Homo sapiens
agccggaccaagatgggcaca

SEQ ID NO: 3929484 - DNA, 22 bp, Homo sapiens
agccggaccaagatgggcacat

SEQ ID NO: 3929485 - DNA, 19 bp, Homo sapiens
agccggccccccctctttt

SEQ ID NO: 3929486 - DNA, 12 bp, Homo sapiens
agccggtgcctg

SEQ ID NO: 3929487 - DNA, 14 bp, Homo sapiens
agccggtgcctggc

SEQ ID NO: 3929488 - DNA, 14 bp, Homo sapiens
agccgtactgtcta

SEQ ID NO: 3929489 - DNA, 15 bp, Homo sapiens
agccgtagagggtgg

SEQ ID NO: 3929490 - DNA, 16 bp, Homo sapiens
agccgtccatggcacc

SEQ ID NO: 3929491 - DNA, 18 bp, Homo sapiens
agccgtctgactccagag

SEQ ID NO: 3929492 - DNA, 20 bp, Homo sapiens
agccgtctgactccagagtc

SEQ ID NO: 3929493 - DNA, 24 bp, Homo sapiens
agccgtctgactccagagtctgag

SEQ ID NO: 3929494 - DNA, 16 bp, Homo sapiens
agccgtgccttcagct

SEQ ID NO: 3929495 - DNA, 17 bp, Homo sapiens
agccgtgccttcagctc

SEQ ID NO: 3929496 - DNA, 21 bp, Homo sapiens
agccgtgcctttctctggctc

SEQ ID NO: 3929497 - DNA, 13 bp, Homo sapiens
agccgtggcttcc

SEQ ID NO: 3929498 - DNA, 22 bp, Homo sapiens
agccgtggcttcccgctcagcc

SEQ ID NO: 3929499 - DNA, 23 bp, Homo sapiens
agccgtggcttcccgctcagccc

SEQ ID NO: 3929500 - DNA, 15 bp, Homo sapiens
agcctaaatctaatc

SEQ ID NO: 3929501 - DNA, 23 bp, Homo sapiens
agcctaatgaaagggaaagtcag

SEQ ID NO: 3929502 - DNA, 20 bp, Homo sapiens
agcctacccttgtaccccat

SEQ ID NO: 3929503 - DNA, 21 bp, Homo sapiens
agcctacccttgtaccccatc

SEQ ID NO: 3929504 - DNA, 15 bp, Homo sapiens
agcctagccacctcc

SEQ ID NO: 3929505 - DNA, 18 bp, Homo sapiens
agcctcactattacttga

SEQ ID NO: 3929506 - DNA, 13 bp, Homo sapiens
agcctcagctcag

SEQ ID NO: 3929507 - DNA, 18 bp, Homo sapiens
agcctcagtgccacttga

SEQ ID NO: 3929508 - DNA, 13 bp, Homo sapiens
agcctccagagcc

SEQ ID NO: 3929509 - DNA, 15 bp, Homo sapiens
agcctccagagccag

SEQ ID NO: 3929510 - DNA, 16 bp, Homo sapiens
agcctccagagccagc

SEQ ID NO: 3929511 - DNA, 18 bp, Homo sapiens
agcctccagagccagcct

SEQ ID NO: 3929512 - DNA, 19 bp, Homo sapiens
agcctccagagccagcctg

SEQ ID NO: 3929513 - DNA, 21 bp, Homo sapiens
agcctccagagccagcctggg

SEQ ID NO: 3929514 - DNA, 22 bp, Homo sapiens
agcctccagagccagcctggga

SEQ ID NO: 3929515 - DNA, 23 bp, Homo sapiens
agcctccagagccagcctgggac

SEQ ID NO: 3929516 - DNA, 24 bp, Homo sapiens
agcctccagagccagcctgggact

SEQ ID NO: 3929517 - DNA, 12 bp, Homo sapiens
agcctcccagag

SEQ ID NO: 3929518 - DNA, 12 bp, Homo sapiens
agcctcccccac

SEQ ID NO: 3929519 - DNA, 23 bp, Homo sapiens
agcctccccctcagatgatctct

SEQ ID NO: 3929520 - DNA, 24 bp, Homo sapiens
agcctccctcctcgtcccctgcct

SEQ ID NO: 3929521 - DNA, 22 bp, Homo sapiens
agcctccggtttccactactgt

SEQ ID NO: 3929522 - DNA, 16 bp, Homo sapiens
agcctccgtcaggaga

SEQ ID NO: 3929523 - DNA, 21 bp, Homo sapiens
agcctccgtttatgggccttg

SEQ ID NO: 3929524 - DNA, 21 bp, Homo sapiens
agcctcctaagcagctgggac

SEQ ID NO: 3929525 - DNA, 19 bp, Homo sapiens
agccatgatcgagccactg

SEQ ID NO: 3929526 - DNA, 15 bp, Homo sapiens
agccatgcctcatgc

SEQ ID NO: 3929527 - DNA, 17 bp, Homo sapiens
agccatgcctcatgcca

SEQ ID NO: 3929528 - DNA, 19 bp, Homo sapiens
agccatggctcaggcaagc

SEQ ID NO: 3929529 - DNA, 20 bp, Homo sapiens
agccatggctcaggcaagcc

SEQ ID NO: 3929530 - DNA, 22 bp, Homo sapiens
agccatggctcaggcaagcccc

SEQ ID NO: 3929531 - DNA, 16 bp, Homo sapiens
agccatgggcctgggc

SEQ ID NO: 3929532 - DNA, 17 bp, Homo sapiens
agccatgggcctgggcc

SEQ ID NO: 3929533 - DNA, 18 bp, Homo sapiens
agccatgggcctgggcct

SEQ ID NO: 3929534 - DNA, 19 bp, Homo sapiens
agccatgggcctgggcctg

SEQ ID NO: 3929535 - DNA, 21 bp, Homo sapiens
agccatgggcctgggcctgct

SEQ ID NO: 3929536 - DNA, 19 bp, Homo sapiens
agccatggtgacacacagc

SEQ ID NO: 3929537 - DNA, 21 bp, Homo sapiens
agccatggtgacacacagcag

SEQ ID NO: 3929538 - DNA, 16 bp, Homo sapiens
agcccaaagctgttgg

SEQ ID NO: 3929539 - DNA, 15 bp, Homo sapiens
agcccaagtgccatc

SEQ ID NO: 3929540 - DNA, 16 bp, Homo sapiens
agcccaagtgccatcc

SEQ ID NO: 3929541 - DNA, 18 bp, Homo sapiens
agcccaagtgccatccca

SEQ ID NO: 3929542 - DNA, 19 bp, Homo sapiens
agcccaagtgccatcccac

SEQ ID NO: 3929543 - DNA, 23 bp, Homo sapiens
agcccaagtgccatcccacattc

SEQ ID NO: 3929544 - DNA, 16 bp, Homo sapiens
agcccacacccctcca

SEQ ID NO: 3929545 - DNA, 23 bp, Homo sapiens
agcccacgcccgactagcaggca

SEQ ID NO: 3929546 - DNA, 15 bp, Homo sapiens
agcccacttgtcatc

SEQ ID NO: 3929547 - DNA, 15 bp, Homo sapiens
agcccagcccagctg

SEQ ID NO: 3929548 - DNA, 16 bp, Homo sapiens
agcccagcccagctgg

SEQ ID NO: 3929549 - DNA, 20 bp, Homo sapiens
agcccagcctagcccacttg

SEQ ID NO: 3929550 - DNA, 17 bp, Homo sapiens
agcccagctacattcct

SEQ ID NO: 3929551 - DNA, 20 bp, Homo sapiens
agcccagctacattcctcag

SEQ ID NO: 3929552 - DNA, 23 bp, Homo sapiens
agcccagctacattcctcagctg

SEQ ID NO: 3929553 - DNA, 16 bp, Homo sapiens
agcccagctggtggga

SEQ ID NO: 3929554 - DNA, 20 bp, Homo sapiens
agcccaggagtttgagacaa

SEQ ID NO: 3929555 - DNA, 16 bp, Homo sapiens
agcccagggaggccga

SEQ ID NO: 3929556 - DNA, 15 bp, Homo sapiens
agcccaggggagcag

SEQ ID NO: 3929557 - DNA, 16 bp, Homo sapiens
agcccagtgacctgac

SEQ ID NO: 3929558 - DNA, 17 bp, Homo sapiens
agcccagtttcccttct

SEQ ID NO: 3929559 - DNA, 15 bp, Homo sapiens
agcccatggcctctg

SEQ ID NO: 3929560 - DNA, 16 bp, Homo sapiens
agcccattctctctcc

SEQ ID NO: 3929561 - DNA, 18 bp, Homo sapiens
agcccattctctctcctg

SEQ ID NO: 3929562 - DNA, 20 bp, Homo sapiens
agcccattctctctcctgtc

SEQ ID NO: 3929563 - DNA, 21 bp, Homo sapiens
agcccattctctctcctgtcc

SEQ ID NO: 3929564 - DNA, 19 bp, Homo sapiens
agcccattttatctttgaa

SEQ ID NO: 3929565 - DNA, 19 bp, Homo sapiens
agcccattttgaggccaga

SEQ ID NO: 3929566 - DNA, 15 bp, Homo sapiens
agccccaaaccaggg

SEQ ID NO: 3929567 - DNA, 18 bp, Homo sapiens
agccccaagccatggtga

SEQ ID NO: 3929568 - DNA, 15 bp, Homo sapiens
agccccacacggagg

SEQ ID NO: 3929569 - DNA, 22 bp, Homo sapiens
agccccacagcacccaggctcc

SEQ ID NO: 3929570 - DNA, 12 bp, Homo sapiens
agccccaggcct

SEQ ID NO: 3929571 - DNA, 15 bp, Homo sapiens
agccccaggcctctg

SEQ ID NO: 3929572 - DNA, 21 bp, Homo sapiens
agccccaggcctctgtgtcct

SEQ ID NO: 3929573 - DNA, 13 bp, Homo sapiens
agccccagggccc

SEQ ID NO: 3929574 - DNA, 13 bp, Homo sapiens
agccccagggcct

SEQ ID NO: 3929575 - DNA, 20 bp, Homo sapiens
agcccccaaccccgcggtgc

SEQ ID NO: 3929576 - DNA, 12 bp, Homo sapiens
agcccccaagcc

SEQ ID NO: 3929577 - DNA, 23 bp, Homo sapiens
agcccccactttcctacaaaatg

SEQ ID NO: 3929578 - DNA, 17 bp, Homo sapiens
agccccccacctttctc

SEQ ID NO: 3929579 - DNA, 20 bp, Homo sapiens
agccccccacctttctcgct

SEQ ID NO: 3929580 - DNA, 19 bp, Homo sapiens
agccccctaagagagcacc

SEQ ID NO: 3929581 - DNA, 17 bp, Homo sapiens
agcccctcagcccttgc

SEQ ID NO: 3929582 - DNA, 13 bp, Homo sapiens
agcccctcctctg

SEQ ID NO: 3929583 - DNA, 14 bp, Homo sapiens
agcccctcctctgc

SEQ ID NO: 3929584 - DNA, 18 bp, Homo sapiens
agcccctcctctgccacc

SEQ ID NO: 3929585 - DNA, 15 bp, Homo sapiens
agcccctgtcatggt

SEQ ID NO: 3929586 - DNA, 14 bp, Homo sapiens
agcccgaggaccgg

SEQ ID NO: 3929587 - DNA, 17 bp, Homo sapiens
agcccgaggaccgggct

SEQ ID NO: 3929588 - DNA, 18 bp, Homo sapiens
agcccgcccaaggggact

SEQ ID NO: 3929589 - DNA, 15 bp, Homo sapiens
agcccggccagggcc

SEQ ID NO: 3929590 - DNA, 16 bp, Homo sapiens
agcccggccagggcct

SEQ ID NO: 3929591 - DNA, 17 bp, Homo sapiens
agcccggccagggcctg

SEQ ID NO: 3929592 - DNA, 20 bp, Homo sapiens
agcccggcgccaccatcctg

SEQ ID NO: 3929593 - DNA, 13 bp, Homo sapiens
agcccgggacagg

SEQ ID NO: 3929594 - DNA, 20 bp, Homo sapiens
agcccgtgcagtacaggcaa

SEQ ID NO: 3929595 - DNA, 14 bp, Homo sapiens
agagcttggtggct

SEQ ID NO: 3929596 - DNA, 12 bp, Homo sapiens
agagctttcttt

SEQ ID NO: 3929597 - DNA, 17 bp, Homo sapiens
agaggaaaaaaatgact

SEQ ID NO: 3929598 - DNA, 15 bp, Homo sapiens
agaggaacaggtgga

SEQ ID NO: 3929599 - DNA, 13 bp, Homo sapiens
agaggaagagcag

SEQ ID NO: 3929600 - DNA, 19 bp, Homo sapiens
aggggactatttatgaagg

SEQ ID NO: 3929601 - DNA, 15 bp, Homo sapiens
aggggacttgtgcca

SEQ ID NO: 3929602 - DNA, 20 bp, Homo sapiens
aggggagaagggccagccct

SEQ ID NO: 3929603 - DNA, 13 bp, Homo sapiens
aggggagtgtggg

SEQ ID NO: 3929604 - DNA, 17 bp, Homo sapiens
aggggagtgtgggtgat

SEQ ID NO: 3929605 - DNA, 14 bp, Homo sapiens
aggggatcaaagtt

SEQ ID NO: 3929606 - DNA, 20 bp, Homo sapiens
aggggatcaaagttcctgtt

SEQ ID NO: 3929607 - DNA, 18 bp, Homo sapiens
aggggcacacaatgctat

SEQ ID NO: 3929608 - DNA, 20 bp, Homo sapiens
aggggcacaccactgccctg

SEQ ID NO: 3929609 - DNA, 21 bp, Homo sapiens
aggggcacctgggaaaacaga

SEQ ID NO: 3929610 - DNA, 15 bp, Homo sapiens
aggggcaggcctggg

SEQ ID NO: 3929611 - DNA, 16 bp, Homo sapiens
aggggcaggcctggga

SEQ ID NO: 3929612 - DNA, 17 bp, Homo sapiens
aggggcaggcctgggac

SEQ ID NO: 3929613 - DNA, 21 bp, Homo sapiens
aggggcaggcctgggacccag

SEQ ID NO: 3929614 - DNA, 19 bp, Homo sapiens
aggggccagtgagggctgg

SEQ ID NO: 3929615 - DNA, 19 bp, Homo sapiens
aggggccccggggctggca

SEQ ID NO: 3929616 - DNA, 21 bp, Homo sapiens
aggggccccggggctggcaag

SEQ ID NO: 3929617 - DNA, 13 bp, Homo sapiens
aggggcctctgaa

SEQ ID NO: 3929618 - DNA, 13 bp, Homo sapiens
aggggcctggcag

SEQ ID NO: 3929619 - DNA, 16 bp, Homo sapiens
aggggcggggcaggaa

SEQ ID NO: 3929620 - DNA, 20 bp, Homo sapiens
aggggctagaacctagagaa

SEQ ID NO: 3929621 - DNA, 14 bp, Homo sapiens
aggggctcagcaag

SEQ ID NO: 3929622 - DNA, 15 bp, Homo sapiens
aggggctcagcaagg

SEQ ID NO: 3929623 - DNA, 16 bp, Homo sapiens
aggggctcagcaaggt

SEQ ID NO: 3929624 - DNA, 20 bp, Homo sapiens
aggggctcagcaaggtgtga

SEQ ID NO: 3929625 - DNA, 14 bp, Homo sapiens
aggggctgctgggg

SEQ ID NO: 3929626 - DNA, 18 bp, Homo sapiens
aggggctgctggggcatg

SEQ ID NO: 3929627 - DNA, 20 bp, Homo sapiens
aggggctgctggggcatgtg

SEQ ID NO: 3929628 - DNA, 15 bp, Homo sapiens
agggggaagagaaat

SEQ ID NO: 3929629 - DNA, 19 bp, Homo sapiens
agggggcctttaaagactt

SEQ ID NO: 3929630 - DNA, 15 bp, Homo sapiens
agggggcgctcagga

SEQ ID NO: 3929631 - DNA, 22 bp, Homo sapiens
agggggcgctcaggacccaggc

SEQ ID NO: 3929632 - DNA, 17 bp, Homo sapiens
agggggctccatggagg

SEQ ID NO: 3929633 - DNA, 20 bp, Homo sapiens
agggggctccatggaggagg

SEQ ID NO: 3929634 - DNA, 21 bp, Homo sapiens
aggggggttgtgaggcctggc

SEQ ID NO: 3929635 - DNA, 18 bp, Homo sapiens
agggggtcgtggagagct

SEQ ID NO: 3929636 - DNA, 23 bp, Homo sapiens
agggggtgattagagggaggaga

SEQ ID NO: 3929637 - DNA, 19 bp, Homo sapiens
aggggtaggcagagccttt

SEQ ID NO: 3929638 - DNA, 22 bp, Homo sapiens
aggggtcctgatttcagggaaa

SEQ ID NO: 3929639 - DNA, 23 bp, Homo sapiens
aggggtcctgatttcagggaaat

SEQ ID NO: 3929640 - DNA, 15 bp, Homo sapiens
aggggtctccctgga

SEQ ID NO: 3929641 - DNA, 14 bp, Homo sapiens
aggggtctgagcca

SEQ ID NO: 3929642 - DNA, 22 bp, Homo sapiens
aggggtgatttcagagagggca

SEQ ID NO: 3929643 - DNA, 23 bp, Homo sapiens
aggggtgcacccactcaccaggg

SEQ ID NO: 3929644 - DNA, 15 bp, Homo sapiens
aggggtgccctctgg

SEQ ID NO: 3929645 - DNA, 17 bp, Homo sapiens
agggtagggcagcagat

SEQ ID NO: 3929646 - DNA, 16 bp, Homo sapiens
agggtatgggaagcca

SEQ ID NO: 3929647 - DNA, 16 bp, Homo sapiens
agggtccccagctggt

SEQ ID NO: 3929648 - DNA, 16 bp, Homo sapiens
agggtccgcaccagct

SEQ ID NO: 3929649 - DNA, 15 bp, Homo sapiens
agggtcctccacaat

SEQ ID NO: 3929650 - DNA, 19 bp, Homo sapiens
agggtctagggagagaccc

SEQ ID NO: 3929651 - DNA, 22 bp, Homo sapiens
agggtctcactatgttgcccag

SEQ ID NO: 3929652 - DNA, 15 bp, Homo sapiens
agggtctggagaagc

SEQ ID NO: 3929653 - DNA, 13 bp, Homo sapiens
agggtctgttgta

SEQ ID NO: 3929654 - DNA, 20 bp, Homo sapiens
agggtctgttgtaaatgacc

SEQ ID NO: 3929655 - DNA, 13 bp, Homo sapiens
agggtcttgcaag

SEQ ID NO: 3929656 - DNA, 13 bp, Homo sapiens
agggtcttgctgt

SEQ ID NO: 3929657 - DNA, 23 bp, Homo sapiens
agggtgacatcccaggaggggcc

SEQ ID NO: 3929658 - DNA, 14 bp, Homo sapiens
agggtgagagctgc

SEQ ID NO: 3929659 - DNA, 21 bp, Homo sapiens
agggtgatgggaaagcattgt

SEQ ID NO: 3929660 - DNA, 20 bp, Homo sapiens
agggtgcagttttccaggaa

SEQ ID NO: 3929661 - DNA, 22 bp, Homo sapiens
agggtgcatggcttggggagca

SEQ ID NO: 3929662 - DNA, 22 bp, Homo sapiens
agggtgctacgtacatgtgagg

SEQ ID NO: 3929663 - DNA, 21 bp, Homo sapiens
agggtggaggaaggtgctgag

SEQ ID NO: 3929664 - DNA, 22 bp, Homo sapiens
agggtggccccctgtgccagct

SEQ ID NO: 3929665 - DNA, 21 bp, Homo sapiens
agggtgggaagcttgctggct

SEQ ID NO: 3929666 - DNA, 20 bp, Homo sapiens
agggtggtctgagcaccccc

SEQ ID NO: 3929667 - DNA, 18 bp, Homo sapiens
agggttggtgggctggcc

SEQ ID NO: 3929668 - DNA, 22 bp, Homo sapiens
agggttggtgggctggcccagc

SEQ ID NO: 3929669 - DNA, 23 bp, Homo sapiens
agggttggtgggctggcccagcc

SEQ ID NO: 3929670 - DNA, 22 bp, Homo sapiens
agggttgtactattgtttaaaa

SEQ ID NO: 3929671 - DNA, 17 bp, Homo sapiens
aggtaaaagtgtgagca

SEQ ID NO: 3929672 - DNA, 21 bp, Homo sapiens
aggtaccactgatttggagat

SEQ ID NO: 3929673 - DNA, 15 bp, Homo sapiens
aggtactaaatacct

SEQ ID NO: 3929674 - DNA, 22 bp, Homo sapiens
aggtactatctgtgaagttaca

SEQ ID NO: 3929675 - DNA, 20 bp, Homo sapiens
aggtacttcctcctgatggc

SEQ ID NO: 3929676 - DNA, 14 bp, Homo sapiens
aggtagagatgtgt

SEQ ID NO: 3929677 - DNA, 16 bp, Homo sapiens
aggtagagatgtgtgt

SEQ ID NO: 3929678 - DNA, 17 bp, Homo sapiens
aggtagagtttgaagga

SEQ ID NO: 3929679 - DNA, 20 bp, Homo sapiens
aggtagagtttgaaggaggt

SEQ ID NO: 3929680 - DNA, 14 bp, Homo sapiens
aggtagcgagctgc

SEQ ID NO: 3929681 - DNA, 20 bp, Homo sapiens
aggtagcgagctgctctgct

SEQ ID NO: 3929682 - DNA, 21 bp, Homo sapiens
aggtagcgagctgctctgcta

SEQ ID NO: 3929683 - DNA, 19 bp, Homo sapiens
aggtagcttacctgacaca

SEQ ID NO: 3929684 - DNA, 20 bp, Homo sapiens
aggtaggcccttgtcctgcc

SEQ ID NO: 3929685 - DNA, 18 bp, Homo sapiens
aggctctgaaagccagct

SEQ ID NO: 3929686 - DNA, 19 bp, Homo sapiens
aggctctgacccagtgaga

SEQ ID NO: 3929687 - DNA, 16 bp, Homo sapiens
aggctctggagccaga

SEQ ID NO: 3929688 - DNA, 12 bp, Homo sapiens
aggctctgggct

SEQ ID NO: 3929689 - DNA, 15 bp, Homo sapiens
aggctctgggctcag

SEQ ID NO: 3929690 - DNA, 16 bp, Homo sapiens
aggctctgggctcagg

SEQ ID NO: 3929691 - DNA, 18 bp, Homo sapiens
aggctctgggctcagggc

SEQ ID NO: 3929692 - DNA, 19 bp, Homo sapiens
aggctctgggctcagggct

SEQ ID NO: 3929693 - DNA, 18 bp, Homo sapiens
aggctcttcctggacctg

SEQ ID NO: 3929694 - DNA, 13 bp, Homo sapiens
aggctcttctcct

SEQ ID NO: 3929695 - DNA, 22 bp, Homo sapiens
aggctctttggggtcagccagg

SEQ ID NO: 3929696 - DNA, 12 bp, Homo sapiens
aggctgaagagt

SEQ ID NO: 3929697 - DNA, 15 bp, Homo sapiens
aggctgaccaagaga

SEQ ID NO: 3929698 - DNA, 13 bp, Homo sapiens
aggctgagctggc

SEQ ID NO: 3929699 - DNA, 15 bp, Homo sapiens
aggctgagctggcat

SEQ ID NO: 3929700 - DNA, 13 bp, Homo sapiens
aggctgaggactt

SEQ ID NO: 3929701 - DNA, 13 bp, Homo sapiens
aggctgcactgca

SEQ ID NO: 3929702 - DNA, 19 bp, Homo sapiens
aggctgcactgcagtgatg

SEQ ID NO: 3929703 - DNA, 21 bp, Homo sapiens
aggctgcactgcagtgatggc

SEQ ID NO: 3929704 - DNA, 20 bp, Homo sapiens
aggctgcagaaggccaagaa

SEQ ID NO: 3929705 - DNA, 19 bp, Homo sapiens
aggctgcagagctgaccca

SEQ ID NO: 3929706 - DNA, 15 bp, Homo sapiens
aggctgcatgctctg

SEQ ID NO: 3929707 - DNA, 14 bp, Homo sapiens
aggctggagatcct

SEQ ID NO: 3929708 - DNA, 19 bp, Homo sapiens
aggctggaggcagggcctt

SEQ ID NO: 3929709 - DNA, 23 bp, Homo sapiens
aggctggaggcagggccttgccc

SEQ ID NO: 3929710 - DNA, 20 bp, Homo sapiens
aggctggagtgcagtggcat

SEQ ID NO: 3929711 - DNA, 11 bp, Homo sapiens
aggctggctga

SEQ ID NO: 3929712 - DNA, 15 bp, Homo sapiens
aggctggctgagtgg

SEQ ID NO: 3929713 - DNA, 15 bp, Homo sapiens
aggctgggccagcct

SEQ ID NO: 3929714 - DNA, 21 bp, Homo sapiens
aggctgggccagcctcagctc

SEQ ID NO: 3929715 - DNA, 12 bp, Homo sapiens
aggctgggcccc

SEQ ID NO: 3929716 - DNA, 14 bp, Homo sapiens
aggctgggcccctg

SEQ ID NO: 3929717 - DNA, 16 bp, Homo sapiens
aggctgggcccctggg

SEQ ID NO: 3929718 - DNA, 22 bp, Homo sapiens
aggctgggggcgggggagccaa

SEQ ID NO: 3929719 - DNA, 18 bp, Homo sapiens
aggctggtcgtgaactcc

SEQ ID NO: 3929720 - DNA, 13 bp, Homo sapiens
aggctggtcttga

SEQ ID NO: 3929721 - DNA, 22 bp, Homo sapiens
aggctggtgctgtggccagggt

SEQ ID NO: 3929722 - DNA, 23 bp, Homo sapiens
aggctggtgctgtggccagggtg

SEQ ID NO: 3929723 - DNA, 21 bp, Homo sapiens
aggctgttctgcactgaaaag

SEQ ID NO: 3929724 - DNA, 16 bp, Homo sapiens
aggcttatcaaaatct

SEQ ID NO: 3929725 - DNA, 13 bp, Homo sapiens
aggcttccagaga

SEQ ID NO: 3929726 - DNA, 20 bp, Homo sapiens
aggcttccaggctcttcctg

SEQ ID NO: 3929727 - DNA, 16 bp, Homo sapiens
aggcttcttcagatca

SEQ ID NO: 3929728 - DNA, 17 bp, Homo sapiens
aggcttggggctggaga

SEQ ID NO: 3929729 - DNA, 21 bp, Homo sapiens
aggctttcaattgtattttat

SEQ ID NO: 3929730 - DNA, 21 bp, Homo sapiens
aggctttgccatgggcctgct

SEQ ID NO: 3929731 - DNA, 22 bp, Homo sapiens
aggctttgccatgggcctgctg

SEQ ID NO: 3929732 - DNA, 16 bp, Homo sapiens
agggaaaactcttcat

SEQ ID NO: 3929733 - DNA, 23 bp, Homo sapiens
agggaaactgccagcaacgcagg

SEQ ID NO: 3929734 - DNA, 16 bp, Homo sapiens
agggaaatggagggtg

SEQ ID NO: 3929735 - DNA, 23 bp, Homo sapiens
agggaagaaaactatcctgcggg

SEQ ID NO: 3929736 - DNA, 15 bp, Homo sapiens
agggaagacaggtct

SEQ ID NO: 3929737 - DNA, 12 bp, Homo sapiens
atatatatgtgt

SEQ ID NO: 3929738 - DNA, 20 bp, Homo sapiens
atatatcatattggtattca

SEQ ID NO: 3929739 - DNA, 22 bp, Homo sapiens
atatatctgataaaattgtgat

SEQ ID NO: 3929740 - DNA, 18 bp, Homo sapiens
atatatctgcttcagtgg

SEQ ID NO: 3929741 - DNA, 16 bp, Homo sapiens
atatatggcatattta

SEQ ID NO: 3929742 - DNA, 14 bp, Homo sapiens
atatatgtatatgt

SEQ ID NO: 3929743 - DNA, 17 bp, Homo sapiens
atatatgtatatgtata

SEQ ID NO: 3929744 - DNA, 20 bp, Homo sapiens
atatatgtatatgtatatat

SEQ ID NO: 3929745 - DNA, 18 bp, Homo sapiens
atatatgtgtatatatac

SEQ ID NO: 3929746 - DNA, 16 bp, Homo sapiens
atatatgtgtgtttaa

SEQ ID NO: 3929747 - DNA, 23 bp, Homo sapiens
atatatgtgtgtttaaataaagt

SEQ ID NO: 3929748 - DNA, 22 bp, Homo sapiens
atatattaaaatgtaggaagaa

SEQ ID NO: 3929749 - DNA, 21 bp, Homo sapiens
atatattcatgtaataaatct

SEQ ID NO: 3929750 - DNA, 18 bp, Homo sapiens
atatatttaatacctttg

SEQ ID NO: 3929751 - DNA, 18 bp, Homo sapiens
atatatttgaatatcatt

SEQ ID NO: 3929752 - DNA, 21 bp, Homo sapiens
atatatttgaatatcattaaa

SEQ ID NO: 3929753 - DNA, 16 bp, Homo sapiens
atatatttttcaacca

SEQ ID NO: 3929754 - DNA, 20 bp, Homo sapiens
atatatttttcaaccagcat

SEQ ID NO: 3929755 - DNA, 15 bp, Homo sapiens
atatatttttcacag

SEQ ID NO: 3929756 - DNA, 17 bp, Homo sapiens
atatcaaggatgttctg

SEQ ID NO: 3929757 - DNA, 17 bp, Homo sapiens
atatcagaaaagtagaa

SEQ ID NO: 3929758 - DNA, 18 bp, Homo sapiens
atatcagaatcgctaata

SEQ ID NO: 3929759 - DNA, 14 bp, Homo sapiens
atatcagacctctg

SEQ ID NO: 3929760 - DNA, 18 bp, Homo sapiens
atatcagacctctgatcc

SEQ ID NO: 3929761 - DNA, 12 bp, Homo sapiens
atatcagcctga

SEQ ID NO: 3929762 - DNA, 18 bp, Homo sapiens
atatcagttactcagccc

SEQ ID NO: 3929763 - DNA, 21 bp, Homo sapiens
atatcagttactcagccctgg

SEQ ID NO: 3929764 - DNA, 21 bp, Homo sapiens
atatcagttataattattcca

SEQ ID NO: 3929765 - DNA, 19 bp, Homo sapiens
atatcatattggtattcac

SEQ ID NO: 3929766 - DNA, 21 bp, Homo sapiens
atatcatcagcatacctttat

SEQ ID NO: 3929767 - DNA, 14 bp, Homo sapiens
atatcatgaaacac

SEQ ID NO: 3929768 - DNA, 23 bp, Homo sapiens
atatcattataactgaaggagaa

SEQ ID NO: 3929769 - DNA, 22 bp, Homo sapiens
atatccacagactccctcccct

SEQ ID NO: 3929770 - DNA, 20 bp, Homo sapiens
atatcccaaacttcggaaac

SEQ ID NO: 3929771 - DNA, 19 bp, Homo sapiens
atatctaatttatacaaaa

SEQ ID NO: 3929772 - DNA, 17 bp, Homo sapiens
atatctacctgccctct

SEQ ID NO: 3929773 - DNA, 18 bp, Homo sapiens
atatctacctgccctctc

SEQ ID NO: 3929774 - DNA, 21 bp, Homo sapiens
atatctattattataaaaata

SEQ ID NO: 3929775 - DNA, 23 bp, Homo sapiens
atatctattattataaaaataat

SEQ ID NO: 3929776 - DNA, 21 bp, Homo sapiens
atatctgacatcttatttact

SEQ ID NO: 3929777 - DNA, 17 bp, Homo sapiens
atatctgataaaattgt

SEQ ID NO: 3929778 - DNA, 19 bp, Homo sapiens
atatctgccccagtagtca

SEQ ID NO: 3929779 - DNA, 15 bp, Homo sapiens
atatctggacaagcc

SEQ ID NO: 3929780 - DNA, 15 bp, Homo sapiens
atatcttatgttaaa

SEQ ID NO: 3929781 - DNA, 20 bp, Homo sapiens
atatgaaaaaaatgcatttt

SEQ ID NO: 3929782 - DNA, 22 bp, Homo sapiens
atatgaaatgataaagatgtca

SEQ ID NO: 3929783 - DNA, 18 bp, Homo sapiens
atatgacaatcctgaaga

SEQ ID NO: 3929784 - DNA, 23 bp, Homo sapiens
atatgacaatcctgaagaaacca

SEQ ID NO: 3929785 - DNA, 17 bp, Homo sapiens
atatgacatgccaccct

SEQ ID NO: 3929786 - DNA, 21 bp, Homo sapiens
atatgagtatacaatatataa

SEQ ID NO: 3929787 - DNA, 22 bp, Homo sapiens
atatgagtatacaatatataaa

SEQ ID NO: 3929788 - DNA, 19 bp, Homo sapiens
atatgattttatttgacaa

SEQ ID NO: 3929789 - DNA, 19 bp, Homo sapiens
atatgattttttaaaagaa

SEQ ID NO: 3929790 - DNA, 18 bp, Homo sapiens
atatggaacttctaatat

SEQ ID NO: 3929791 - DNA, 18 bp, Homo sapiens
atatggactcagttttct

SEQ ID NO: 3929792 - DNA, 16 bp, Homo sapiens
atatggcaaaaatggc

SEQ ID NO: 3929793 - DNA, 15 bp, Homo sapiens
atatggcaagaaagc

SEQ ID NO: 3929794 - DNA, 19 bp, Homo sapiens
atatggcaagaaagctggt

SEQ ID NO: 3929795 - DNA, 14 bp, Homo sapiens
atatgggtgctggc

SEQ ID NO: 3929796 - DNA, 13 bp, Homo sapiens
atatgtaaaataa

SEQ ID NO: 3929797 - DNA, 20 bp, Homo sapiens
atatgtaaaataaaattatg

SEQ ID NO: 3929798 - DNA, 13 bp, Homo sapiens
atatgtagactat

SEQ ID NO: 3929799 - DNA, 20 bp, Homo sapiens
atatgtagactatatacatg

SEQ ID NO: 3929800 - DNA, 23 bp, Homo sapiens
atatgtagactatatacatgtgt

SEQ ID NO: 3929801 - DNA, 13 bp, Homo sapiens
atatgtagccctc

SEQ ID NO: 3929802 - DNA, 14 bp, Homo sapiens
atatgtatatatat

SEQ ID NO: 3929803 - DNA, 13 bp, Homo sapiens
atatgtatatgta

SEQ ID NO: 3929804 - DNA, 17 bp, Homo sapiens
atatgtatatgtatata

SEQ ID NO: 3929805 - DNA, 13 bp, Homo sapiens
atatgtatgtcta

SEQ ID NO: 3929806 - DNA, 14 bp, Homo sapiens
atatgtatgtctaa

SEQ ID NO: 3929807 - DNA, 17 bp, Homo sapiens
atatgtattaagccaaa

SEQ ID NO: 3929808 - DNA, 21 bp, Homo sapiens
atatgtattaagccaaacatg

SEQ ID NO: 3929809 - DNA, 22 bp, Homo sapiens
atatgtattaagccaaacatga

SEQ ID NO: 3929810 - DNA, 20 bp, Homo sapiens
atatgtatttattgtcatta

SEQ ID NO: 3929811 - DNA, 13 bp, Homo sapiens
atatgtctgcttc

SEQ ID NO: 3929812 - DNA, 16 bp, Homo sapiens
atatgtctgcttctgt

SEQ ID NO: 3929813 - DNA, 13 bp, Homo sapiens
atatgtgtgtgtg

SEQ ID NO: 3929814 - DNA, 15 bp, Homo sapiens
atatgttcaactgga

SEQ ID NO: 3929815 - DNA, 12 bp, Homo sapiens
atattaaagtgt

SEQ ID NO: 3929816 - DNA, 13 bp, Homo sapiens
atattaaatacag

SEQ ID NO: 3929817 - DNA, 17 bp, Homo sapiens
atattaaatacagacac

SEQ ID NO: 3929818 - DNA, 19 bp, Homo sapiens
atattaaatacagacacta

SEQ ID NO: 3929819 - DNA, 20 bp, Homo sapiens
atattataaataaatgccaa

SEQ ID NO: 3929820 - DNA, 14 bp, Homo sapiens
atattataaatcca

SEQ ID NO: 3929821 - DNA, 17 bp, Homo sapiens
atattataacttaaaaa

SEQ ID NO: 3929822 - DNA, 19 bp, Homo sapiens
atattataataatgttctc

SEQ ID NO: 3929823 - DNA, 23 bp, Homo sapiens
atagcattgaacatttcttatga

SEQ ID NO: 3929824 - DNA, 22 bp, Homo sapiens
atagccacatccctttgaaaca

SEQ ID NO: 3929825 - DNA, 11 bp, Homo sapiens
atagccagaga

SEQ ID NO: 3929826 - DNA, 16 bp, Homo sapiens
atagccagagaggagc

SEQ ID NO: 3929827 - DNA, 14 bp, Homo sapiens
atagccgggcatgg

SEQ ID NO: 3929828 - DNA, 13 bp, Homo sapiens
atagcgctggctc

SEQ ID NO: 3929829 - DNA, 20 bp, Homo sapiens
atagcgtgggttatcagtta

SEQ ID NO: 3929830 - DNA, 18 bp, Homo sapiens
atagctattgcatgtaaa

SEQ ID NO: 3929831 - DNA, 23 bp, Homo sapiens
atagctcttctatttaaaaaata

SEQ ID NO: 3929832 - DNA, 14 bp, Homo sapiens
atagcttttattgt

SEQ ID NO: 3929833 - DNA, 18 bp, Homo sapiens
atagcttttattgtataa

SEQ ID NO: 3929834 - DNA, 19 bp, Homo sapiens
ataggaaaagtacatttaa

SEQ ID NO: 3929835 - DNA, 16 bp, Homo sapiens
ataggcggtcatgtgt

SEQ ID NO: 3929836 - DNA, 21 bp, Homo sapiens
ataggctggagaagctcaccc

SEQ ID NO: 3929837 - DNA, 19 bp, Homo sapiens
ataacaagatctttcagga

SEQ ID NO: 3929838 - DNA, 22 bp, Homo sapiens
ataacaaggttcttctaaaatt

SEQ ID NO: 3929839 - DNA, 17 bp, Homo sapiens
ataacaatgtatgtgaa

SEQ ID NO: 3929840 - DNA, 18 bp, Homo sapiens
ataacaatgtatgtgaaa

SEQ ID NO: 3929841 - DNA, 16 bp, Homo sapiens
ataacaatgtgctctc

SEQ ID NO: 3929842 - DNA, 13 bp, Homo sapiens
ataacctatatga

SEQ ID NO: 3929843 - DNA, 16 bp, Homo sapiens
ataactagtgttgctt

SEQ ID NO: 3929844 - DNA, 16 bp, Homo sapiens
ataactgaaggagaag

SEQ ID NO: 3929845 - DNA, 22 bp, Homo sapiens
ataactgtcatctagccccttc

SEQ ID NO: 3929846 - DNA, 12 bp, Homo sapiens
ataacttaaaaa

SEQ ID NO: 3929847 - DNA, 16 bp, Homo sapiens
ataacttaaaatattt

SEQ ID NO: 3929848 - DNA, 19 bp, Homo sapiens
ataacttcttaaaagttgt

SEQ ID NO: 3929849 - DNA, 15 bp, Homo sapiens
ataacttgatataga

SEQ ID NO: 3929850 - DNA, 16 bp, Homo sapiens
ataacttgctgaattt

SEQ ID NO: 3929851 - DNA, 19 bp, Homo sapiens
ataacttgctgaatttcag

SEQ ID NO: 3929852 - DNA, 22 bp, Homo sapiens
ataacttgctgaatttcaggca

SEQ ID NO: 3929853 - DNA, 18 bp, Homo sapiens
ataagaaacatgatgtga

SEQ ID NO: 3929854 - DNA, 18 bp, Homo sapiens
ataagaatggagcagtac

SEQ ID NO: 3929855 - DNA, 18 bp, Homo sapiens
ataagaatggttgcctta

SEQ ID NO: 3929856 - DNA, 16 bp, Homo sapiens
ataagattaaaggaag

SEQ ID NO: 3929857 - DNA, 20 bp, Homo sapiens
ataagattagaatgaaaatt

SEQ ID NO: 3929858 - DNA, 21 bp, Homo sapiens
ataagcaaatttcaaaagaca

SEQ ID NO: 3929859 - DNA, 16 bp, Homo sapiens
ataagcagatttaaca

SEQ ID NO: 3929860 - DNA, 13 bp, Homo sapiens
ataagcaggaagg

SEQ ID NO: 3929861 - DNA, 24 bp, Homo sapiens
ataaggaggaaaacgggaaagaat

SEQ ID NO: 3929862 - DNA, 14 bp, Homo sapiens
ataaggccagaaac

SEQ ID NO: 3929863 - DNA, 16 bp, Homo sapiens
ataaggcctgccctcc

SEQ ID NO: 3929864 - DNA, 17 bp, Homo sapiens
ataaggcctgccctccc

SEQ ID NO: 3929865 - DNA, 16 bp, Homo sapiens
ataagttccatgttaa

SEQ ID NO: 3929866 - DNA, 17 bp, Homo sapiens
ataagttccatgttaaa

SEQ ID NO: 3929867 - DNA, 14 bp, Homo sapiens
ataataaaaagata

SEQ ID NO: 3929868 - DNA, 22 bp, Homo sapiens
ataataattaggttaacattgt

SEQ ID NO: 3929869 - DNA, 19 bp, Homo sapiens
ataatactaaagtgtctat

SEQ ID NO: 3929870 - DNA, 23 bp, Homo sapiens
ataatatggaaccttccctccaa

SEQ ID NO: 3929871 - DNA, 22 bp, Homo sapiens
ataatatgtttgaggttaaaat

SEQ ID NO: 3929872 - DNA, 20 bp, Homo sapiens
ataatcaattattacattta

SEQ ID NO: 3929873 - DNA, 21 bp, Homo sapiens
ataatcaattattacatttat

SEQ ID NO: 3929874 - DNA, 14 bp, Homo sapiens
ataatcagcctctt

SEQ ID NO: 3929875 - DNA, 15 bp, Homo sapiens
ataatctagaacaca

SEQ ID NO: 3929876 - DNA, 20 bp, Homo sapiens
ataatgaacagcagaaagac

SEQ ID NO: 3929877 - DNA, 12 bp, Homo sapiens
ataatgccactg

SEQ ID NO: 3929878 - DNA, 14 bp, Homo sapiens
ataatggttgactg

SEQ ID NO: 3929879 - DNA, 17 bp, Homo sapiens
ataatgtgcaaattttg

SEQ ID NO: 3929880 - DNA, 20 bp, Homo sapiens
ataatgtgcaaattttgcat

SEQ ID NO: 3929881 - DNA, 23 bp, Homo sapiens
ataatgtgcaaattttgcattta

SEQ ID NO: 3929882 - DNA, 17 bp, Homo sapiens
ataatgtggatttccta

SEQ ID NO: 3929883 - DNA, 18 bp, Homo sapiens
ataatgtggatttcctat

SEQ ID NO: 3929884 - DNA, 12 bp, Homo sapiens
ataatgtgtgta

SEQ ID NO: 3929885 - DNA, 19 bp, Homo sapiens
ataatgttctttaatgttg

SEQ ID NO: 3929886 - DNA, 23 bp, Homo sapiens
ataattaaaaaccactgaacatt

SEQ ID NO: 3929887 - DNA, 17 bp, Homo sapiens
ataattaatgtgtgtct

SEQ ID NO: 3929888 - DNA, 17 bp, Homo sapiens
ataattagaacaatagc

SEQ ID NO: 3929889 - DNA, 23 bp, Homo sapiens
ataattaggatctatgcaatttt

SEQ ID NO: 3929890 - DNA, 17 bp, Homo sapiens
ataattatccagagttt

SEQ ID NO: 3929891 - DNA, 22 bp, Homo sapiens
ataattgttgattaatttgaga

SEQ ID NO: 3929892 - DNA, 13 bp, Homo sapiens
ataatttaactaa

SEQ ID NO: 3929893 - DNA, 15 bp, Homo sapiens
ataatttaactaatt

SEQ ID NO: 3929894 - DNA, 22 bp, Homo sapiens
ataatttgtacatatgtaaaat

SEQ ID NO: 3929895 - DNA, 15 bp, Homo sapiens
ataattttatgaatg

SEQ ID NO: 3929896 - DNA, 19 bp, Homo sapiens
ataattttatgaatgtctt

SEQ ID NO: 3929897 - DNA, 18 bp, Homo sapiens
ataatttttaaagtatat

SEQ ID NO: 3929898 - DNA, 16 bp, Homo sapiens
ataattttttattcaa

SEQ ID NO: 3929899 - DNA, 14 bp, Homo sapiens
atacaaaataattt

SEQ ID NO: 3929900 - DNA, 15 bp, Homo sapiens
atacaaaataattta

SEQ ID NO: 3929901 - DNA, 21 bp, Homo sapiens
atacaaaataatttaactaat

SEQ ID NO: 3929902 - DNA, 16 bp, Homo sapiens
atacaacaagaacaac

SEQ ID NO: 3929903 - DNA, 20 bp, Homo sapiens
atacaacatgtagctgagtt

SEQ ID NO: 3929904 - DNA, 15 bp, Homo sapiens
atacaatatataaaa

SEQ ID NO: 3929905 - DNA, 14 bp, Homo sapiens
atacaatttgcact
